United States Patent 9,205,144 (IDENTIFICATION OF CONSERVED PEPTIDE BLOCKS IN HOMOLOGOUS POLYPEPTIDES) - sequence listing, part 10

SEQ ID NO: 355973 - protein, 10 aa, Influenza virus
KIDLWSYNAE

SEQ ID NO: 355974 - protein, 10 aa, Influenza virus
IDLWSYNAEL

SEQ ID NO: 355975 - protein, 10 aa, Influenza virus
DLWSYNAELL

SEQ ID NO: 355976 - protein, 10 aa, Influenza virus
LWSYNAELLV

SEQ ID NO: 355977 - protein, 10 aa, Influenza virus
WSYNAELLVA

SEQ ID NO: 355978 - protein, 10 aa, Influenza virus
SYNAELLVAL

SEQ ID NO: 355979 - protein, 10 aa, Influenza virus
YNAELLVALE

SEQ ID NO: 355980 - protein, 10 aa, Influenza virus
NAELLVALEN

SEQ ID NO: 355981 - protein, 10 aa, Influenza virus
AELLVALENQ

SEQ ID NO: 355982 - protein, 10 aa, Influenza virus
LLVALENQHT

SEQ ID NO: 355983 - protein, 10 aa, Influenza virus
LVALENQHTI

SEQ ID NO: 355984 - protein, 10 aa, Influenza virus
VALENQHTID

SEQ ID NO: 355985 - protein, 10 aa, Influenza virus
ALENQHTIDL

SEQ ID NO: 355986 - protein, 10 aa, Influenza virus
LENQHTIDLT

SEQ ID NO: 355987 - protein, 10 aa, Influenza virus
ENQHTIDLTD

SEQ ID NO: 355988 - protein, 10 aa, Influenza virus
NQHTIDLTDS

SEQ ID NO: 355989 - protein, 10 aa, Influenza virus
QHTIDLTDSE

SEQ ID NO: 355990 - protein, 10 aa, Influenza virus
HTIDLTDSEM

SEQ ID NO: 355991 - protein, 10 aa, Influenza virus
TIDLTDSEMN

SEQ ID NO: 355992 - protein, 10 aa, Influenza virus
IDLTDSEMNK

SEQ ID NO: 355993 - protein, 10 aa, Influenza virus
DLTDSEMNKL

SEQ ID NO: 355994 - protein, 10 aa, Influenza virus
LTDSEMNKLF

SEQ ID NO: 355995 - protein, 10 aa, Influenza virus
TDSEMNKLFE

SEQ ID NO: 355996 - protein, 10 aa, Influenza virus
DSEMNKLFER

SEQ ID NO: 355997 - protein, 10 aa, Influenza virus
SEMNKLFERT

SEQ ID NO: 355998 - protein, 10 aa, Influenza virus
TKKQLRENAE

SEQ ID NO: 355999 - protein, 10 aa, Influenza virus
KKQLRENAED

SEQ ID NO: 356000 - protein, 10 aa, Influenza virus
KQLRENAEDM

SEQ ID NO: 356001 - protein, 10 aa, Influenza virus
QLRENAEDMG

SEQ ID NO: 356002 - protein, 10 aa, Influenza virus
LRENAEDMGN

SEQ ID NO: 356003 - protein, 10 aa, Influenza virus
RENAEDMGNG

SEQ ID NO: 356004 - protein, 10 aa, Influenza virus
ENAEDMGNGC

SEQ ID NO: 356005 - protein, 10 aa, Influenza virus
NAEDMGNGCF

SEQ ID NO: 356006 - protein, 10 aa, Influenza virus
AEDMGNGCFK

SEQ ID NO: 356007 - protein, 10 aa, Influenza virus
EDMGNGCFKI

SEQ ID NO: 356008 - protein, 10 aa, Influenza virus
DMGNGCFKIY

SEQ ID NO: 356009 - protein, 10 aa, Influenza virus
MGNGCFKIYH

SEQ ID NO: 356010 - protein, 10 aa, Influenza virus
GNGCFKIYHK

SEQ ID NO: 356011 - protein, 10 aa, Influenza virus
NGCFKIYHKC

SEQ ID NO: 356012 - protein, 10 aa, Influenza virus
GCFKIYHKCD

SEQ ID NO: 356013 - protein, 10 aa, Influenza virus
CFKIYHKCDN

SEQ ID NO: 356014 - protein, 10 aa, Influenza virus
CIGSIRNGTY

SEQ ID NO: 356015 - protein, 10 aa, Influenza virus
IGSIRNGTYD

SEQ ID NO: 356016 - protein, 10 aa, Influenza virus
GSIRNGTYDH

SEQ ID NO: 356017 - protein, 10 aa, Influenza virus
SIRNGTYDHD

SEQ ID NO: 356018 - protein, 10 aa, Influenza virus
YRDEALNNRF

SEQ ID NO: 356019 - protein, 10 aa, Influenza virus
RDEALNNRFQ

SEQ ID NO: 356020 - protein, 10 aa, Influenza virus
EALNNRFQIK

SEQ ID NO: 356021 - protein, 10 aa, Influenza virus
GYKDWILWIS

SEQ ID NO: 356022 - protein, 10 aa, Influenza virus
YKDWILWISF

SEQ ID NO: 356023 - protein, 10 aa, Influenza virus
KDWILWISFA

SEQ ID NO: 356024 - protein, 10 aa, Influenza virus
DWILWISFAI

SEQ ID NO: 356025 - protein, 10 aa, Influenza virus
WILWISFAIS

SEQ ID NO: 356026 - protein, 10 aa, Influenza virus
ILWISFAISC

SEQ ID NO: 356027 - protein, 10 aa, Influenza virus
LWISFAISCF

SEQ ID NO: 356028 - protein, 10 aa, Influenza virus
WISFAISCFL

SEQ ID NO: 356029 - protein, 10 aa, Influenza virus
ISFAISCFLL

SEQ ID NO: 356030 - protein, 10 aa, Influenza virus
SFAISCFLLC

SEQ ID NO: 356031 - protein, 10 aa, Influenza virus
LGFIMWACQK

SEQ ID NO: 356032 - protein, 10 aa, Influenza virus
GFIMWACQKG

SEQ ID NO: 356033 - protein, 10 aa, Influenza virus
FIMWACQKGN

SEQ ID NO: 356034 - protein, 10 aa, Influenza virus
IMWACQKGNI

SEQ ID NO: 356035 - protein, 10 aa, Influenza virus
MWACQKGNIR

SEQ ID NO: 356036 - protein, 10 aa, Influenza virus
WACQKGNIRC

SEQ ID NO: 356037 - protein, 10 aa, Influenza virus
ACQKGNIRCN

SEQ ID NO: 356038 - protein, 10 aa, Influenza virus
CQKGNIRCNI

SEQ ID NO: 356039 - protein, 10 aa, Influenza virus
QKGNIRCNIC

SEQ ID NO: 356040 - protein, 10 aa, Influenza virus
KGNIRCNICI

SEQ ID NO: 356041 - protein, 10 aa, Influenza virus
AKAGVKMNPN

SEQ ID NO: 356042 - protein, 10 aa, Influenza virus
KAGVKMNPNQ

SEQ ID NO: 356043 - protein, 10 aa, Influenza virus
AGVKMNPNQK

SEQ ID NO: 356044 - protein, 10 aa, Influenza virus
GVKMNPNQKI

SEQ ID NO: 356045 - protein, 10 aa, Influenza virus
VKMNPNQKII

SEQ ID NO: 356046 - protein, 10 aa, Influenza virus
KMNPNQKIIT

SEQ ID NO: 356047 - protein, 10 aa, Influenza virus
EKEKEICSVV

SEQ ID NO: 356048 - protein, 10 aa, Influenza virus
KEKEICSVVL

SEQ ID NO: 356049 - protein, 10 aa, Influenza virus
ITGFAPFSKD

SEQ ID NO: 356050 - protein, 10 aa, Influenza virus
TGFAPFSKDN

SEQ ID NO: 356051 - protein, 10 aa, Influenza virus
GFAPFSKDNS

SEQ ID NO: 356052 - protein, 10 aa, Influenza virus
FAPFSKDNSI

SEQ ID NO: 356053 - protein, 10 aa, Influenza virus
APFSKDNSIR

SEQ ID NO: 356054 - protein, 10 aa, Influenza virus
PFSKDNSIRL

SEQ ID NO: 356055 - protein, 10 aa, Influenza virus
FSKDNSIRLS

SEQ ID NO: 356056 - protein, 10 aa, Influenza virus
SKDNSIRLSA

SEQ ID NO: 356057 - protein, 10 aa, Influenza virus
KDNSIRLSAG

SEQ ID NO: 356058 - protein, 10 aa, Influenza virus
DNSIRLSAGG

SEQ ID NO: 356059 - protein, 10 aa, Influenza virus
NSIRLSAGGD

SEQ ID NO: 356060 - protein, 10 aa, Influenza virus
SIRLSAGGDI

SEQ ID NO: 356061 - protein, 10 aa, Influenza virus
IRLSAGGDIW

SEQ ID NO: 356062 - protein, 10 aa, Influenza virus
RLSAGGDIWV

SEQ ID NO: 356063 - protein, 10 aa, Influenza virus
LSAGGDIWVT

SEQ ID NO: 356064 - protein, 10 aa, Influenza virus
SAGGDIWVTR

SEQ ID NO: 356065 - protein, 10 aa, Influenza virus
AGGDIWVTRE

SEQ ID NO: 356066 - protein, 10 aa, Influenza virus
GGDIWVTREP

SEQ ID NO: 356067 - protein, 10 aa, Influenza virus
GDIWVTREPY

SEQ ID NO: 356068 - protein, 10 aa, Influenza virus
DIWVTREPYV

SEQ ID NO: 356069 - protein, 10 aa, Influenza virus
IWVTREPYVS

SEQ ID NO: 356070 - protein, 10 aa, Influenza virus
WVTREPYVSC

SEQ ID NO: 356071 - protein, 10 aa, Influenza virus
VTREPYVSCD

SEQ ID NO: 356072 - protein, 10 aa, Influenza virus
DKCYQFALGQ

SEQ ID NO: 356073 - protein, 10 aa, Influenza virus
KCYQFALGQG

SEQ ID NO: 356074 - protein, 10 aa, Influenza virus
CYQFALGQGT

SEQ ID NO: 356075 - protein, 10 aa, Influenza virus
YQFALGQGTT

SEQ ID NO: 356076 - protein, 10 aa, Influenza virus
QFALGQGTTL

SEQ ID NO: 356077 - protein, 10 aa, Influenza virus
FALGQGTTLN

SEQ ID NO: 356078 - protein, 10 aa, Influenza virus
ALGQGTTLNN

SEQ ID NO: 356079 - protein, 10 aa, Influenza virus
RTPYRTLLMN

SEQ ID NO: 356080 - protein, 10 aa, Influenza virus
TPYRTLLMNE

SEQ ID NO: 356081 - protein, 10 aa, Influenza virus
PYRTLLMNEL

SEQ ID NO: 356082 - protein, 10 aa, Influenza virus
YRTLLMNELG

SEQ ID NO: 356083 - protein, 10 aa, Influenza virus
RTLLMNELGV

SEQ ID NO: 356084 - protein, 10 aa, Influenza virus
TLLMNELGVP

SEQ ID NO: 356085 - protein, 10 aa, Influenza virus
LLMNELGVPF

SEQ ID NO: 356086 - protein, 10 aa, Influenza virus
LMNELGVPFH

SEQ ID NO: 356087 - protein, 10 aa, Influenza virus
MNELGVPFHL

SEQ ID NO: 356088 - protein, 10 aa, Influenza virus
NELGVPFHLG

SEQ ID NO: 356089 - protein, 10 aa, Influenza virus
ELGVPFHLGT

SEQ ID NO: 356090 - protein, 10 aa, Influenza virus
LGVPFHLGTK

SEQ ID NO: 356091 - protein, 10 aa, Influenza virus
GVPFHLGTKQ

SEQ ID NO: 356092 - protein, 10 aa, Influenza virus
VPFHLGTKQV

SEQ ID NO: 356093 - protein, 10 aa, Influenza virus
PFHLGTKQVC

SEQ ID NO: 356094 - protein, 10 aa, Influenza virus
FHLGTKQVCI

SEQ ID NO: 356095 - protein, 10 aa, Influenza virus
HLGTKQVCIA

SEQ ID NO: 356096 - protein, 10 aa, Influenza virus
LGTKQVCIAW

SEQ ID NO: 356097 - protein, 10 aa, Influenza virus
GTKQVCIAWS

SEQ ID NO: 356098 - protein, 10 aa, Influenza virus
TKQVCIAWSS

SEQ ID NO: 356099 - protein, 10 aa, Influenza virus
KQVCIAWSSS

SEQ ID NO: 356100 - protein, 10 aa, Influenza virus
QVCIAWSSSS

SEQ ID NO: 356101 - protein, 10 aa, Influenza virus
VCIAWSSSSC

SEQ ID NO: 356102 - protein, 10 aa, Influenza virus
CIAWSSSSCH

SEQ ID NO: 356103 - protein, 10 aa, Influenza virus
IAWSSSSCHD

SEQ ID NO: 356104 - protein, 10 aa, Influenza virus
AWSSSSCHDG

SEQ ID NO: 356105 - protein, 10 aa, Influenza virus
WSSSSCHDGK

SEQ ID NO: 356106 - protein, 10 aa, Influenza virus
SSSSCHDGKA

SEQ ID NO: 356107 - protein, 10 aa, Influenza virus
SSSCHDGKAW

SEQ ID NO: 356108 - protein, 10 aa, Influenza virus
SSCHDGKAWL

SEQ ID NO: 356109 - protein, 10 aa, Influenza virus
SCHDGKAWLH

SEQ ID NO: 356110 - protein, 10 aa, Influenza virus
CHDGKAWLHV

SEQ ID NO: 356111 - protein, 10 aa, Influenza virus
HDGKAWLHVC

SEQ ID NO: 356112 - protein, 10 aa, Influenza virus
DGKAWLHVCV

SEQ ID NO: 356113 - protein, 10 aa, Influenza virus
GKAWLHVCVT

SEQ ID NO: 356114 - protein, 10 aa, Influenza virus
KAWLHVCVTG

SEQ ID NO: 356115 - protein, 10 aa, Influenza virus
NATASFIYNG

SEQ ID NO: 356116 - protein, 10 aa, Influenza virus
EILRTQESEC

SEQ ID NO: 356117 - protein, 10 aa, Influenza virus
ILRTQESECV

SEQ ID NO: 356118 - protein, 10 aa, Influenza virus
LRTQESECVC

SEQ ID NO: 356119 - protein, 10 aa, Influenza virus
RTQESECVCI

SEQ ID NO: 356120 - protein, 10 aa, Influenza virus
TQESECVCIN

SEQ ID NO: 356121 - protein, 10 aa, Influenza virus
QESECVCING

SEQ ID NO: 356122 - protein, 10 aa, Influenza virus
ESECVCINGT

SEQ ID NO: 356123 - protein, 10 aa, Influenza virus
SECVCINGTC

SEQ ID NO: 356124 - protein, 10 aa, Influenza virus
ECVCINGTCT

SEQ ID NO: 356125 - protein, 10 aa, Influenza virus
CVCINGTCTV

SEQ ID NO: 356126 - protein, 10 aa, Influenza virus
VCINGTCTVV

SEQ ID NO: 356127 - protein, 10 aa, Influenza virus
CINGTCTVVM

SEQ ID NO: 356128 - protein, 10 aa, Influenza virus
INGTCTVVMT

SEQ ID NO: 356129 - protein, 10 aa, Influenza virus
NGTCTVVMTD

SEQ ID NO: 356130 - protein, 10 aa, Influenza virus
GTCTVVMTDG

SEQ ID NO: 356131 - protein, 10 aa, Influenza virus
TCTVVMTDGS

SEQ ID NO: 356132 - protein, 10 aa, Influenza virus
CTVVMTDGSA

SEQ ID NO: 356133 - protein, 10 aa, Influenza virus
TVVMTDGSAS

SEQ ID NO: 356134 - protein, 10 aa, Influenza virus
VVMTDGSASG

SEQ ID NO: 356135 - protein, 10 aa, Influenza virus
EYYFVKEGKI

SEQ ID NO: 356136 - protein, 10 aa, Influenza virus
YYFVKEGKIV

SEQ ID NO: 356137 - protein, 10 aa, Influenza virus
YFVKEGKIVH

SEQ ID NO: 356138 - protein, 10 aa, Influenza virus
LSGSAQHVEE

SEQ ID NO: 356139 - protein, 10 aa, Influenza virus
SGSAQHVEEC

SEQ ID NO: 356140 - protein, 10 aa, Influenza virus
GSAQHVEECS

SEQ ID NO: 356141 - protein, 10 aa, Influenza virus
SAQHVEECSC

SEQ ID NO: 356142 - protein, 10 aa, Influenza virus
AQHVEECSCY

SEQ ID NO: 356143 - protein, 10 aa, Influenza virus
QHVEECSCYP

SEQ ID NO: 356144 - protein, 10 aa, Influenza virus
HVEECSCYPR

SEQ ID NO: 356145 - protein, 10 aa, Influenza virus
VEECSCYPRY

SEQ ID NO: 356146 - protein, 10 aa, Influenza virus
EECSCYPRYP

SEQ ID NO: 356147 - protein, 10 aa, Influenza virus
ECSCYPRYPG

SEQ ID NO: 356148 - protein, 10 aa, Influenza virus
VRCVCRDNWK

SEQ ID NO: 356149 - protein, 10 aa, Influenza virus
RCVCRDNWKG

SEQ ID NO: 356150 - protein, 10 aa, Influenza virus
CVCRDNWKGS

SEQ ID NO: 356151 - protein, 10 aa, Influenza virus
VCRDNWKGSN

SEQ ID NO: 356152 - protein, 10 aa, Influenza virus
CRDNWKGSNR

SEQ ID NO: 356153 - protein, 10 aa, Influenza virus
RDNWKGSNRP

SEQ ID NO: 356154 - protein, 10 aa, Influenza virus
DNWKGSNRPI

SEQ ID NO: 356155 - protein, 10 aa, Influenza virus
NWKGSNRPIV

SEQ ID NO: 356156 - protein, 10 aa, Influenza virus
WKGSNRPIVD

SEQ ID NO: 356157 - protein, 10 aa, Influenza virus
KGSNRPIVDI

SEQ ID NO: 356158 - protein, 10 aa, Influenza virus
GSNRPIVDIN

SEQ ID NO: 356159 - protein, 10 aa, Influenza virus
SSYVCSGLVG

SEQ ID NO: 356160 - protein, 10 aa, Influenza virus
SYVCSGLVGD

SEQ ID NO: 356161 - protein, 10 aa, Influenza virus
YVCSGLVGDT

SEQ ID NO: 356162 - protein, 10 aa, Influenza virus
VCSGLVGDTP

SEQ ID NO: 356163 - protein, 10 aa, Influenza virus
CSGLVGDTPR

SEQ ID NO: 356164 - protein, 10 aa, Influenza virus
SGLVGDTPRK

SEQ ID NO: 356165 - protein, 10 aa, Influenza virus
HGVKGWAFDD

SEQ ID NO: 356166 - protein, 10 aa, Influenza virus
GVKGWAFDDG

SEQ ID NO: 356167 - protein, 10 aa, Influenza virus
GNDVWMGRTI

SEQ ID NO: 356168 - protein, 10 aa, Influenza virus
RSGYETFKVI

SEQ ID NO: 356169 - protein, 10 aa, Influenza virus
RSGYSGIFSV

SEQ ID NO: 356170 - protein, 10 aa, Influenza virus
SGYSGIFSVE

SEQ ID NO: 356171 - protein, 10 aa, Influenza virus
GYSGIFSVEG

SEQ ID NO: 356172 - protein, 10 aa, Influenza virus
YSGIFSVEGK

SEQ ID NO: 356173 - protein, 10 aa, Influenza virus
KSCINRCFYV

SEQ ID NO: 356174 - protein, 10 aa, Influenza virus
SCINRCFYVE

SEQ ID NO: 356175 - protein, 10 aa, Influenza virus
CINRCFYVEL

SEQ ID NO: 356176 - protein, 10 aa, Influenza virus
INRCFYVELI

SEQ ID NO: 356177 - protein, 10 aa, Influenza virus
NRCFYVELIR

SEQ ID NO: 356178 - protein, 10 aa, Influenza virus
RCFYVELIRG

SEQ ID NO: 356179 - protein, 10 aa, Influenza virus
CFYVELIRGR

SEQ ID NO: 356180 - protein, 10 aa, Influenza virus
EVLWTSNSIV

SEQ ID NO: 356181 - protein, 10 aa, Influenza virus
VLWTSNSIVV

SEQ ID NO: 356182 - protein, 10 aa, Influenza virus
LWTSNSIVVF

SEQ ID NO: 356183 - protein, 10 aa, Influenza virus
WTSNSIVVFC

SEQ ID NO: 356184 - protein, 10 aa, Influenza virus
TSNSIVVFCG

SEQ ID NO: 356185 - protein, 10 aa, Influenza virus
SNSIVVFCGT

SEQ ID NO: 356186 - protein, 10 aa, Influenza virus
NSIVVFCGTS

SEQ ID NO: 356187 - protein, 10 aa, Influenza virus
SIVVFCGTSG

SEQ ID NO: 356188 - protein, 10 aa, Influenza virus
IVVFCGTSGT

SEQ ID NO: 356189 - protein, 10 aa, Influenza virus
VVFCGTSGTY

SEQ ID NO: 356190 - protein, 10 aa, Influenza virus
VFCGTSGTYG

SEQ ID NO: 356191 - protein, 10 aa, Influenza virus
FCGTSGTYGT

SEQ ID NO: 356192 - protein, 10 aa, Influenza virus
CGTSGTYGTG

SEQ ID NO: 356193 - protein, 10 aa, Influenza virus
GTSGTYGTGS

SEQ ID NO: 356194 - protein, 10 aa, Influenza virus
TSGTYGTGSW

SEQ ID NO: 356195 - protein, 10 aa, Influenza virus
SGTYGTGSWP

SEQ ID NO: 356196 - protein, 10 aa, Influenza virus
GTYGTGSWPD

SEQ ID NO: 356197 - protein, 10 aa, Influenza virus
TYGTGSWPDG

SEQ ID NO: 356198 - protein, 10 aa, Influenza virus
YGTGSWPDGA

SEQ ID NO: 356199 - protein, 10 aa, Influenza virus
GTGSWPDGAD

SEQ ID NO: 356200 - protein, 10 aa, Influenza virus
GADINLHAYI

SEQ ID NO: 356201 - protein, 10 aa, Influenza virus
ADINLHAYIS

SEQ ID NO: 356202 - protein, 10 aa, Influenza virus
DINLHAYISF

SEQ ID NO: 356203 - protein, 10 aa, Influenza virus
INLHAYISFR

SEQ ID NO: 356204 - protein, 10 aa, Influenza virus
NLHAYISFRN

SEQ ID NO: 356205 - protein, 10 aa, Influenza virus
LHAYISFRNL

SEQ ID NO: 356206 - protein, 10 aa, Influenza virus
YTGNPVICLG

SEQ ID NO: 356207 - protein, 10 aa, Influenza virus
TGNPVICLGH

SEQ ID NO: 356208 - protein, 10 aa, Influenza virus
GNPVICLGHH

SEQ ID NO: 356209 - protein, 10 aa, Influenza virus
NPVICLGHHA

SEQ ID NO: 356210 - protein, 10 aa, Influenza virus
PVICLGHHAV

SEQ ID NO: 356211 - protein, 10 aa, Influenza virus
WICMGHHAVA

SEQ ID NO: 356212 - protein, 10 aa, Influenza virus
NGTMVKTLTD

SEQ ID NO: 356213 - protein, 10 aa, Influenza virus
IEVVTAQELV

SEQ ID NO: 356214 - protein, 10 aa, Influenza virus
EVVTAQELVE

SEQ ID NO: 356215 - protein, 10 aa, Influenza virus
VVTAQELVES

SEQ ID NO: 356216 - protein, 10 aa, Influenza virus
LCPSPLRLVD

SEQ ID NO: 356217 - protein, 10 aa, Influenza virus
CDIVNGALGS

SEQ ID NO: 356218 - protein, 10 aa, Influenza virus
DIVNGALGSP

SEQ ID NO: 356219 - protein, 10 aa, Influenza virus
IVNGALGSPG

SEQ ID NO: 356220 - protein, 10 aa, Influenza virus
VNGALGSPGC

SEQ ID NO: 356221 - protein, 10 aa, Influenza virus
NGALGSPGCD

SEQ ID NO: 356222 - protein, 10 aa, Influenza virus
GALGSPGCDH

SEQ ID NO: 356223 - protein, 10 aa, Influenza virus
ALGSPGCDHL

SEQ ID NO: 356224 - protein, 10 aa, Influenza virus
DTCYPFDVPD

SEQ ID NO: 356225 - protein, 10 aa, Influenza virus
TCYPFDVPDY

SEQ ID NO: 356226 - protein, 10 aa, Influenza virus
CYPFDVPDYQ

SEQ ID NO: 356227 - protein, 10 aa, Influenza virus
YPFDVPDYQS

SEQ ID NO: 356228 - protein, 10 aa, Influenza virus
DVPDYQSLRS

SEQ ID NO: 356229 - protein, 10 aa, Influenza virus
VPDYQSLRSI

SEQ ID NO: 356230 - protein, 10 aa, Influenza virus
PDYQSLRSIL

SEQ ID NO: 356231 - protein, 10 aa, Influenza virus
DYQSLRSILA

SEQ ID NO: 356232 - protein, 10 aa, Influenza virus
YQSLRSILAN

SEQ ID NO: 356233 - protein, 10 aa, Influenza virus
QSLRSILANN

SEQ ID NO: 356234 - protein, 10 aa, Influenza virus
SLRSILANNG

SEQ ID NO: 356235 - protein, 10 aa, Influenza virus
LRSILANNGK

SEQ ID NO: 356236 - protein, 10 aa, Influenza virus
RSILANNGKF

SEQ ID NO: 356237 - protein, 10 aa, Influenza virus
SILANNGKFE

SEQ ID NO: 356238 - protein, 10 aa, Influenza virus
ILANNGKFEF

SEQ ID NO: 356239 - protein, 10 aa, Influenza virus
LANNGKFEFI

SEQ ID NO: 356240 - protein, 10 aa, Influenza virus
ANNGKFEFIA

SEQ ID NO: 356241 - protein, 10 aa, Influenza virus
NNGKFEFIAE

SEQ ID NO: 356242 - protein, 10 aa, Influenza virus
NGKFEFIAEE

SEQ ID NO: 356243 - protein, 10 aa, Influenza virus
GKFEFIAEEF

SEQ ID NO: 356244 - protein, 10 aa, Influenza virus
TVKQNGKSGA

SEQ ID NO: 356245 - protein, 10 aa, Influenza virus
VKQNGKSGAC

SEQ ID NO: 356246 - protein, 10 aa, Influenza virus
KQNGKSGACK

SEQ ID NO: 356247 - protein, 10 aa, Influenza virus
QNGKSGACKR

SEQ ID NO: 356248 - protein, 10 aa, Influenza virus
NGKSGACKRA

SEQ ID NO: 356249 - protein, 10 aa, Influenza virus
GKSGACKRAN

SEQ ID NO: 356250 - protein, 10 aa, Influenza virus
NDFFNRLNWL

SEQ ID NO: 356251 - protein, 10 aa, Influenza virus
YPLQNLTKVN

SEQ ID NO: 356252 - protein, 10 aa, Influenza virus
QNLTKVNNGD

SEQ ID NO: 356253 - protein, 10 aa, Influenza virus
NLTKVNNGDY

SEQ ID NO: 356254 - protein, 10 aa, Influenza virus
NNGDYARLYI

SEQ ID NO: 356255 - protein, 10 aa, Influenza virus
NGDYARLYIW

SEQ ID NO: 356256 - protein, 10 aa, Influenza virus
GDYARLYIWG

SEQ ID NO: 356257 - protein, 10 aa, Influenza virus
DYARLYIWGV

SEQ ID NO: 356258 - protein, 10 aa, Influenza virus
YARLYIWGVH

SEQ ID NO: 356259 - protein, 10 aa, Influenza virus
ARLYIWGVHH

SEQ ID NO: 356260 - protein, 10 aa, Influenza virus
RLYIWGVHHP

SEQ ID NO: 356261 - protein, 10 aa, Influenza virus
LYIWGVHHPS

SEQ ID NO: 356262 - protein, 10 aa, Influenza virus
YIWGVHHPST

SEQ ID NO: 356263 - protein, 10 aa, Influenza virus
IWGVHHPSTD

SEQ ID NO: 356264 - protein, 10 aa, Influenza virus
WGVHHPSTDT

SEQ ID NO: 356265 - protein, 10 aa, Influenza virus
GVHHPSTDTE

SEQ ID NO: 356266 - protein, 10 aa, Influenza virus
VHHPSTDTEQ

SEQ ID NO: 356267 - protein, 10 aa, Influenza virus
LYKNNPGRVT

SEQ ID NO: 356268 - protein, 10 aa, Influenza virus
NNPGRVTVST

SEQ ID NO: 356269 - protein, 10 aa, Influenza virus
NPGRVTVSTK

SEQ ID NO: 356270 - protein, 10 aa, Influenza virus
RPWVRGQSGR

SEQ ID NO: 356271 - protein, 10 aa, Influenza virus
VRGQSGRISF

SEQ ID NO: 356272 - protein, 10 aa, Influenza virus
RGQSGRISFY

SEQ ID NO: 356273 - protein, 10 aa, Influenza virus
GQSGRISFYW

SEQ ID NO: 356274 - protein, 10 aa, Influenza virus
QSGRISFYWT

SEQ ID NO: 356275 - protein, 10 aa, Influenza virus
SGRISFYWTI

SEQ ID NO: 356276 - protein, 10 aa, Influenza virus
GRISFYWTIV

SEQ ID NO: 356277 - protein, 10 aa, Influenza virus
RISFYWTIVE

SEQ ID NO: 356278 - protein, 10 aa, Influenza virus
ISFYWTIVEP

SEQ ID NO: 356279 - protein, 10 aa, Influenza virus
SFYWTIVEPG

SEQ ID NO: 356280 - protein, 10 aa, Influenza virus
FYWTIVEPGD

SEQ ID NO: 356281 - protein, 10 aa, Influenza virus
PGDLIVFNTI

SEQ ID NO: 356282 - protein, 10 aa, Influenza virus
GDLIVFNTIG

SEQ ID NO: 356283 - protein, 10 aa, Influenza virus
DLIVFNTIGN

SEQ ID NO: 356284 - protein, 10 aa, Influenza virus
LIVFNTIGNL

SEQ ID NO: 356285 - protein, 10 aa, Influenza virus
IVFNTIGNLI

SEQ ID NO: 356286 - protein, 10 aa, Influenza virus
VFNTIGNLIA

SEQ ID NO: 356287 - protein, 10 aa, Influenza virus
FNTIGNLIAP

SEQ ID NO: 356288 - protein, 10 aa, Influenza virus
NTIGNLIAPR

SEQ ID NO: 356289 - protein, 10 aa, Influenza virus
TIGNLIAPRG

SEQ ID NO: 356290 - protein, 10 aa, Influenza virus
IGNLIAPRGH

SEQ ID NO: 356291 - protein, 10 aa, Influenza virus
GNLIAPRGHY

SEQ ID NO: 356292 - protein, 10 aa, Influenza virus
NLIAPRGHYK

SEQ ID NO: 356293 - protein, 10 aa, Influenza virus
LIAPRGHYKL

SEQ ID NO: 356294 - protein, 10 aa, Influenza virus
IGSCVSKCHT

SEQ ID NO: 356295 - protein, 10 aa, Influenza virus
GDCPKYVKQG

SEQ ID NO: 356296 - protein, 10 aa, Influenza virus
DCPKYVKQGS

SEQ ID NO: 356297 - protein, 10 aa, Influenza virus
CPKYVKQGSL

SEQ ID NO: 356298 - protein, 10 aa, Influenza virus
PKYVKQGSLK

SEQ ID NO: 356299 - protein, 10 aa, Influenza virus
KYVKQGSLKL

SEQ ID NO: 356300 - protein, 10 aa, Influenza virus
YVKQGSLKLA

SEQ ID NO: 356301 - protein, 10 aa, Influenza virus
VKQGSLKLAT

SEQ ID NO: 356302 - protein, 10 aa, Influenza virus
KQGSLKLATG

SEQ ID NO: 356303 - protein, 10 aa, Influenza virus
QGSLKLATGM

SEQ ID NO: 356304 - protein, 10 aa, Influenza virus
GSLKLATGMR

SEQ ID NO: 356305 - protein, 10 aa, Influenza virus
SLKLATGMRN

SEQ ID NO: 356306 - protein, 10 aa, Influenza virus
LKLATGMRNI

SEQ ID NO: 356307 - protein, 10 aa, Influenza virus
KLATGMRNIP

SEQ ID NO: 356308 - protein, 10 aa, Influenza virus
LATGMRNIPE

SEQ ID NO: 356309 - protein, 10 aa, Influenza virus
ATGMRNIPEK

SEQ ID NO: 356310 - protein, 10 aa, Influenza virus
RGLFGAIAGF

SEQ ID NO: 356311 - protein, 10 aa, Influenza virus
GLFGAIAGFI

SEQ ID NO: 356312 - protein, 10 aa, Influenza virus
LFGAIAGFIE

SEQ ID NO: 356313 - protein, 10 aa, Influenza virus
FGAIAGFIEN

SEQ ID NO: 356314 - protein, 10 aa, Influenza virus
GAIAGFIENG

SEQ ID NO: 356315 - protein, 10 aa, Influenza virus
AIAGFIENGW

SEQ ID NO: 356316 - protein, 10 aa, Influenza virus
IAGFIENGWQ

SEQ ID NO: 356317 - protein, 10 aa, Influenza virus
AGFIENGWQG

SEQ ID NO: 356318 - protein, 10 aa, Influenza virus
GFIENGWQGL

SEQ ID NO: 356319 - protein, 10 aa, Influenza virus
FIENGWQGLI

SEQ ID NO: 356320 - protein, 10 aa, Influenza virus
IENGWQGLID

SEQ ID NO: 356321 - protein, 10 aa, Influenza virus
ENGWQGLIDG

SEQ ID NO: 356322 - protein, 10 aa, Influenza virus
NGWQGLIDGW

SEQ ID NO: 356323 - protein, 10 aa, Influenza virus
GWQGLIDGWY

SEQ ID NO: 356324 - protein, 10 aa, Influenza virus
WQGLIDGWYG

SEQ ID NO: 356325 - protein, 10 aa, Influenza virus
QGLIDGWYGF

SEQ ID NO: 356326 - protein, 10 aa, Influenza virus
GLIDGWYGFR

SEQ ID NO: 356327 - protein, 10 aa, Influenza virus
LIDGWYGFRH

SEQ ID NO: 356328 - protein, 10 aa, Influenza virus
IDGWYGFRHQ

SEQ ID NO: 356329 - protein, 10 aa, Influenza virus
DGWYGFRHQN

SEQ ID NO: 356330 - protein, 10 aa, Influenza virus
GWYGFRHQNA

SEQ ID NO: 356331 - protein, 10 aa, Influenza virus
WYGFRHQNAE

SEQ ID NO: 356332 - protein, 10 aa, Influenza virus
YGFRHQNAEG

SEQ ID NO: 356333 - protein, 10 aa, Influenza virus
GFRHQNAEGT

SEQ ID NO: 356334 - protein, 10 aa, Influenza virus
FRHQNAEGTG

SEQ ID NO: 356335 - protein, 10 aa, Influenza virus
RHQNAEGTGT

SEQ ID NO: 356336 - protein, 10 aa, Influenza virus
HQNAEGTGTA

SEQ ID NO: 356337 - protein, 10 aa, Influenza virus
QNAEGTGTAA

SEQ ID NO: 356338 - protein, 10 aa, Influenza virus
NAEGTGTAAD

SEQ ID NO: 356339 - protein, 10 aa, Influenza virus
AEGTGTAADL

SEQ ID NO: 356340 - protein, 10 aa, Influenza virus
EGTGTAADLK

SEQ ID NO: 356341 - protein, 10 aa, Influenza virus
GTGTAADLKS

SEQ ID NO: 356342 - protein, 10 aa, Influenza virus
TGTAADLKST

SEQ ID NO: 356343 - protein, 10 aa, Influenza virus
GTAADLKSTQ

SEQ ID NO: 356344 - protein, 10 aa, Influenza virus
TAADLKSTQA

SEQ ID NO: 356345 - protein, 10 aa, Influenza virus
AADLKSTQAA

SEQ ID NO: 356346 - protein, 10 aa, Influenza virus
ADLKSTQAAI

SEQ ID NO: 356347 - protein, 10 aa, Influenza virus
DLKSTQAAID

SEQ ID NO: 356348 - protein, 10 aa, Influenza virus
LKSTQAAIDQ

SEQ ID NO: 356349 - protein, 10 aa, Influenza virus
KSTQAAIDQI

SEQ ID NO: 356350 - protein, 10 aa, Influenza virus
TQAAIDQING

SEQ ID NO: 356351 - protein, 10 aa, Influenza virus
QAAIDQINGK

SEQ ID NO: 356352 - protein, 10 aa, Influenza virus
AAIDQINGKL

SEQ ID NO: 356353 - protein, 10 aa, Influenza virus
AIDQINGKLN

SEQ ID NO: 356354 - protein, 10 aa, Influenza virus
IDQINGKLNR

SEQ ID NO: 356355 - protein, 10 aa, Influenza virus
DQINGKLNRL

SEQ ID NO: 356356 - protein, 10 aa, Influenza virus
QINGKLNRLI

SEQ ID NO: 356357 - protein, 10 aa, Influenza virus
INGKLNRLIE

SEQ ID NO: 356358 - protein, 10 aa, Influenza virus
NGKLNRLIEK

SEQ ID NO: 356359 - protein, 10 aa, Influenza virus
GKLNRLIEKT

SEQ ID NO: 356360 - protein, 10 aa, Influenza virus
KLNRLIEKTN

SEQ ID NO: 356361 - protein, 10 aa, Influenza virus
LNRLIEKTNE

SEQ ID NO: 356362 - protein, 10 aa, Influenza virus
NRLIEKTNEK

SEQ ID NO: 356363 - protein, 10 aa, Influenza virus
RLIEKTNEKY

SEQ ID NO: 356364 - protein, 10 aa, Influenza virus
LIEKTNEKYH

SEQ ID NO: 356365 - protein, 10 aa, Influenza virus
IEKTNEKYHQ

SEQ ID NO: 356366 - protein, 10 aa, Influenza virus
EKTNEKYHQI

SEQ ID NO: 356367 - protein, 10 aa, Influenza virus
KTNEKYHQIE

SEQ ID NO: 356368 - protein, 10 aa, Influenza virus
TNEKYHQIEK

SEQ ID NO: 356369 - protein, 10 aa, Influenza virus
NEKYHQIEKE

SEQ ID NO: 356370 - protein, 10 aa, Influenza virus
EKYHQIEKEF

SEQ ID NO: 356371 - protein, 10 aa, Influenza virus
KYHQIEKEFE

SEQ ID NO: 356372 - protein, 10 aa, Influenza virus
YHQIEKEFEQ

SEQ ID NO: 356373 - protein, 10 aa, Influenza virus
HQIEKEFEQV

SEQ ID NO: 356374 - protein, 10 aa, Influenza virus
QIEKEFEQVE

SEQ ID NO: 356375 - protein, 10 aa, Influenza virus
IEKEFEQVEG

SEQ ID NO: 356376 - protein, 10 aa, Influenza virus
EKEFEQVEGR

SEQ ID NO: 356377 - protein, 10 aa, Influenza virus
KEFEQVEGRI

SEQ ID NO: 356378 - protein, 10 aa, Influenza virus
EFEQVEGRIQ

SEQ ID NO: 356379 - protein, 10 aa, Influenza virus
FEQVEGRIQD

SEQ ID NO: 356380 - protein, 10 aa, Influenza virus
EQVEGRIQDL

SEQ ID NO: 356381 - protein, 10 aa, Influenza virus
QVEGRIQDLE

SEQ ID NO: 356382 - protein, 10 aa, Influenza virus
QDLEKYVEDT

SEQ ID NO: 356383 - protein, 10 aa, Influenza virus
DLEKYVEDTK

SEQ ID NO: 356384 - protein, 10 aa, Influenza virus
LEKYVEDTKI

SEQ ID NO: 356385 - protein, 10 aa, Influenza virus
EKYVEDTKID

SEQ ID NO: 356386 - protein, 10 aa, Influenza virus
KYVEDTKIDL

SEQ ID NO: 356387 - protein, 10 aa, Influenza virus
YVEDTKIDLW

SEQ ID NO: 356388 - protein, 10 aa, Influenza virus
VEDTKIDLWS

SEQ ID NO: 356389 - protein, 10 aa, Influenza virus
EDTKIDLWSY

SEQ ID NO: 356390 - protein, 10 aa, Influenza virus
DTKIDLWSYN

SEQ ID NO: 356391 - protein, 10 aa, Influenza virus
TKIDLWSYNA

SEQ ID NO: 356392 - protein, 10 aa, Influenza virus
KIDLWSYNAE

SEQ ID NO: 356393 - protein, 10 aa, Influenza virus
IDLWSYNAEL

SEQ ID NO: 356394 - protein, 10 aa, Influenza virus
DLWSYNAELL

SEQ ID NO: 356395 - protein, 10 aa, Influenza virus
LWSYNAELLV

SEQ ID NO: 356396 - protein, 10 aa, Influenza virus
WSYNAELLVA

SEQ ID NO: 356397 - protein, 10 aa, Influenza virus
SYNAELLVAL

SEQ ID NO: 356398 - protein, 10 aa, Influenza virus
YNAELLVALE

SEQ ID NO: 356399 - protein, 10 aa, Influenza virus
NAELLVALEN

SEQ ID NO: 356400 - protein, 10 aa, Influenza virus
AELLVALENQ

SEQ ID NO: 356401 - protein, 10 aa, Influenza virus
ELLVALENQH

SEQ ID NO: 356402 - protein, 10 aa, Influenza virus
LLVALENQHT

SEQ ID NO: 356403 - protein, 10 aa, Influenza virus
LVALENQHTI

SEQ ID NO: 356404 - protein, 10 aa, Influenza virus
VALENQHTID

SEQ ID NO: 356405 - protein, 10 aa, Influenza virus
ALENQHTIDV

SEQ ID NO: 356406 - protein, 10 aa, Influenza virus
LENQHTIDVT

SEQ ID NO: 356407 - protein, 10 aa, Influenza virus
ENQHTIDVTD

SEQ ID NO: 356408 - protein, 10 aa, Influenza virus
NQHTIDVTDS

SEQ ID NO: 356409 - protein, 10 aa, Influenza virus
QHTIDVTDSE

SEQ ID NO: 356410 - protein, 10 aa, Influenza virus
HTIDVTDSEM

SEQ ID NO: 356411 - protein, 10 aa, Influenza virus
TIDVTDSEMN

SEQ ID NO: 356412 - protein, 10 aa, Influenza virus
IDVTDSEMNK

SEQ ID NO: 356413 - protein, 10 aa, Influenza virus
VTDSEMNKLF

SEQ ID NO: 356414 - protein, 10 aa, Influenza virus
TDSEMNKLFE

SEQ ID NO: 356415 - protein, 10 aa, Influenza virus
DSEMNKLFER

SEQ ID NO: 356416 - protein, 10 aa, Influenza virus
SEMNKLFERV

SEQ ID NO: 356417 - protein, 10 aa, Influenza virus
EMNKLFERVR

SEQ ID NO: 356418 - protein, 10 aa, Influenza virus
KLFERVRRQL

SEQ ID NO: 356419 - protein, 10 aa, Influenza virus
LFERVRRQLR

SEQ ID NO: 356420 - protein, 10 aa, Influenza virus
FERVRRQLRE

SEQ ID NO: 356421 - protein, 10 aa, Influenza virus
ERVRRQLREN

SEQ ID NO: 356422 - protein, 10 aa, Influenza virus
RVRRQLRENA

SEQ ID NO: 356423 - protein, 10 aa, Influenza virus
VRRQLRENAE

SEQ ID NO: 356424 - protein, 10 aa, Influenza virus
RRQLRENAED

SEQ ID NO: 356425 - protein, 10 aa, Influenza virus
RQLRENAEDK

SEQ ID NO: 356426 - protein, 10 aa, Influenza virus
QLRENAEDKG

SEQ ID NO: 356427 - protein, 10 aa, Influenza virus
LRENAEDKGN

SEQ ID NO: 356428 - protein, 10 aa, Influenza virus
RENAEDKGNG

SEQ ID NO: 356429 - protein, 10 aa, Influenza virus
ENAEDKGNGC

SEQ ID NO: 356430 - protein, 10 aa, Influenza virus
NAEDKGNGCF

SEQ ID NO: 356431 - protein, 10 aa, Influenza virus
AEDKGNGCFE

SEQ ID NO: 356432 - protein, 10 aa, Influenza virus
EDKGNGCFEI

SEQ ID NO: 356433 - protein, 10 aa, Influenza virus
DKGNGCFEIF

SEQ ID NO: 356434 - protein, 10 aa, Influenza virus
KGNGCFEIFH

SEQ ID NO: 356435 - protein, 10 aa, Influenza virus
GNGCFEIFHQ

SEQ ID NO: 356436 - protein, 10 aa, Influenza virus
NGCFEIFHQC

SEQ ID NO: 356437 - protein, 10 aa, Influenza virus
GCFEIFHQCD

SEQ ID NO: 356438 - protein, 10 aa, Influenza virus
CFEIFHQCDN

SEQ ID NO: 356439 - protein, 10 aa, Influenza virus
CDNNCIESIR

SEQ ID NO: 356440 - protein, 10 aa, Influenza virus
DNNCIESIRN

SEQ ID NO: 356441 - protein, 10 aa, Influenza virus
NNCIESIRNG

SEQ ID NO: 356442 - protein, 10 aa, Influenza virus
NCIESIRNGT

SEQ ID NO: 356443 - protein, 10 aa, Influenza virus
CIESIRNGTY

SEQ ID NO: 356444 - protein, 10 aa, Influenza virus
IESIRNGTYD

SEQ ID NO: 356445 - protein, 10 aa, Influenza virus
ESIRNGTYDH

SEQ ID NO: 356446 - protein, 10 aa, Influenza virus
SIRNGTYDHD

SEQ ID NO: 356447 - protein, 10 aa, Influenza virus
YRDEAINNRF

SEQ ID NO: 356448 - protein, 10 aa, Influenza virus
RDEAINNRFQ

SEQ ID NO: 356449 - protein, 10 aa, Influenza virus
DEAINNRFQI

SEQ ID NO: 356450 - protein, 10 aa, Influenza virus
EAINNRFQIQ

SEQ ID NO: 356451 - protein, 10 aa, Influenza virus
AINNRFQIQG

SEQ ID NO: 356452 - protein, 10 aa, Influenza virus
INNRFQIQGV

SEQ ID NO: 356453 - protein, 10 aa, Influenza virus
NRFQIQGVKL

SEQ ID NO: 356454 - protein, 10 aa, Influenza virus
RFQIQGVKLT

SEQ ID NO: 356455 - protein, 10 aa, Influenza virus
FQIQGVKLTQ

SEQ ID NO: 356456 - protein, 10 aa, Influenza virus
QIQGVKLTQG

SEQ ID NO: 356457 - protein, 10 aa, Influenza virus
IQGVKLTQGY

SEQ ID NO: 356458 - protein, 10 aa, Influenza virus
QGVKLTQGYK

SEQ ID NO: 356459 - protein, 10 aa, Influenza virus
GVKLTQGYKD

SEQ ID NO: 356460 - protein, 10 aa, Influenza virus
KLTQGYKDII

SEQ ID NO: 356461 - protein, 10 aa, Influenza virus
LTQGYKDIIL

SEQ ID NO: 356462 - protein, 10 aa, Influenza virus
TQGYKDIILW

SEQ ID NO: 356463 - protein, 10 aa, Influenza virus
QGYKDIILWI

SEQ ID NO: 356464 - protein, 10 aa, Influenza virus
GYKDIILWIS

SEQ ID NO: 356465 - protein, 10 aa, Influenza virus
YKDIILWISF

SEQ ID NO: 356466 - protein, 10 aa, Influenza virus
KDIILWISFS

SEQ ID NO: 356467 - protein, 10 aa, Influenza virus
DIILWISFSI

SEQ ID NO: 356468 - protein, 10 aa, Influenza virus
IILWISFSIS

SEQ ID NO: 356469 - protein, 10 aa, Influenza virus
ILWISFSISC

SEQ ID NO: 356470 - protein, 10 aa, Influenza virus
LWISFSISCF

SEQ ID NO: 356471 - protein, 10 aa, Influenza virus
WISFSISCFL

SEQ ID NO: 356472 - protein, 10 aa, Influenza virus
ISFSISCFLL

SEQ ID NO: 356473 - protein, 10 aa, Influenza virus
SFSISCFLLV

SEQ ID NO: 356474 - protein, 10 aa, Influenza virus
FSISCFLLVA

SEQ ID NO: 356475 - protein, 10 aa, Influenza virus
VTTRQASPSC

SEQ ID NO: 356476 - protein, 10 aa, Influenza virus
TTRQASPSCL

SEQ ID NO: 356477 - protein, 10 aa, Influenza virus
TRQASPSCLV

SEQ ID NO: 356478 - protein, 10 aa, Influenza virus
RQASPSCLVV

SEQ ID NO: 356479 - protein, 10 aa, Influenza virus
QASPSCLVVR

SEQ ID NO: 356480 - protein, 10 aa, Influenza virus
ASPSCLVVRK

SEQ ID NO: 356481 - protein, 10 aa, Influenza virus
SISCFLLVAL

SEQ ID NO: 356482 - protein, 10 aa, Influenza virus
ISCFLLVALL

SEQ ID NO: 356483 - protein, 10 aa, Influenza virus
SCFLLVALLL

SEQ ID NO: 356484 - protein, 10 aa, Influenza virus
ALLLAFILWA

SEQ ID NO: 356485 - protein, 10 aa, Influenza virus
LLLAFILWAC

SEQ ID NO: 356486 - protein, 10 aa, Influenza virus
LLAFILWACQ

SEQ ID NO: 356487 - protein, 10 aa, Influenza virus
LAFILWACQN

SEQ ID NO: 356488 - protein, 10 aa, Influenza virus
AFILWACQNG

SEQ ID NO: 356489 - protein, 10 aa, Influenza virus
FILWACQNGN

SEQ ID NO: 356490 - protein, 10 aa, Influenza virus
LWACQNGNIR

SEQ ID NO: 356491 - protein, 10 aa, Influenza virus
WACQNGNIRC

SEQ ID NO: 356492 - protein, 10 aa, Influenza virus
ACQNGNIRCQ

SEQ ID NO: 356493 - protein, 10 aa, Influenza virus
CQNGNIRCQI

SEQ ID NO: 356494 - protein, 10 aa, Influenza virus
QNGNIRCQIC

SEQ ID NO: 356495 - protein, 10 aa, Influenza virus
NGNIRCQICI

SEQ ID NO: 356496 - protein, 10 aa, Influenza virus
ICQMEKIVLL

SEQ ID NO: 356497 - protein, 10 aa, Influenza virus
VKMEKIVLLL

SEQ ID NO: 356498 - protein, 10 aa, Influenza virus
KMEKIVLLLA

SEQ ID NO: 356499 - protein, 10 aa, Influenza virus
SDQICIGYHA

SEQ ID NO: 356500 - protein, 10 aa, Influenza virus
DQICIGYHAN

SEQ ID NO: 356501 - protein, 10 aa, Influenza virus
QICIGYHANN

SEQ ID NO: 356502 - protein, 10 aa, Influenza virus
ICIGYHANNS

SEQ ID NO: 356503 - protein, 10 aa, Influenza virus
CIGYHANNST

SEQ ID NO: 356504 - protein, 10 aa, Influenza virus
IGYHANNSTE

SEQ ID NO: 356505 - protein, 10 aa, Influenza virus
QVDTIMEKNV

SEQ ID NO: 356506 - protein, 10 aa, Influenza virus
VDTIMEKNVT

SEQ ID NO: 356507 - protein, 10 aa, Influenza virus
DTIMEKNVTV

SEQ ID NO: 356508 - protein, 10 aa, Influenza virus
TIMEKNVTVT

SEQ ID NO: 356509 - protein, 10 aa, Influenza virus
IMEKNVTVTH

SEQ ID NO: 356510 - protein, 10 aa, Influenza virus
MEKNVTVTHA

SEQ ID NO: 356511 - protein, 10 aa, Influenza virus
EKNVTVTHAQ

SEQ ID NO: 356512 - protein, 10 aa, Influenza virus
KNVTVTHAQD

SEQ ID NO: 356513 - protein, 10 aa, Influenza virus
NVTVTHAQDI

SEQ ID NO: 356514 - protein, 10 aa, Influenza virus
VTVTHAQDIL

SEQ ID NO: 356515 - protein, 10 aa, Influenza virus
TVTHAQDILE

SEQ ID NO: 356516 - protein, 10 aa, Influenza virus
VTHAQDILEK

SEQ ID NO: 356517 - protein, 10 aa, Influenza virus
LRDCSVAGWL

SEQ ID NO: 356518 - protein, 10 aa, Influenza virus
DCSVAGWLLG

SEQ ID NO: 356519 - protein, 10 aa, Influenza virus
CSVAGWLLGN

SEQ ID NO: 356520 - protein, 10 aa, Influenza virus
SVAGWLLGNP

SEQ ID NO: 356521 - protein, 10 aa, Influenza virus
VAGWLLGNPM

SEQ ID NO: 356522 - protein, 10 aa, Influenza virus
AGWLLGNPMC

SEQ ID NO: 356523 - protein, 10 aa, Influenza virus
GWLLGNPMCD

SEQ ID NO: 356524 - protein, 10 aa, Influenza virus
WLLGNPMCDE

SEQ ID NO: 356525 - protein, 10 aa, Influenza virus
LLGNPMCDEF

SEQ ID NO: 356526 - protein, 10 aa, Influenza virus
VPEWSYIVEK

SEQ ID NO: 356527 - protein, 10 aa, Influenza virus
ADHPPKVAWS

SEQ ID NO: 356528 - protein, 10 aa, Influenza virus
NGRSSFFRNV

SEQ ID NO: 356529 - protein, 10 aa, Influenza virus
YISVGTSTLN

SEQ ID NO: 356530 - protein, 10 aa, Influenza virus
SVGTSTLNQR

SEQ ID NO: 356531 - protein, 10 aa, Influenza virus
FESNGNFIAP

SEQ ID NO: 356532 - protein, 10 aa, Influenza virus
ESNGNFIAPE

SEQ ID NO: 356533 - protein, 10 aa, Influenza virus
SNGNFIAPEY

SEQ ID NO: 356534 - protein, 10 aa, Influenza virus
NGNFIAPEYA

SEQ ID NO: 356535 - protein, 10 aa, Influenza virus
GNFIAPEYAY

SEQ ID NO: 356536 - protein, 10 aa, Influenza virus
NFIAPEYAYK

SEQ ID NO: 356537 - protein, 10 aa, Influenza virus
FIAPEYAYKI

SEQ ID NO: 356538 - protein, 10 aa, Influenza virus
PSVKLPMGAI

SEQ ID NO: 356539 - protein, 10 aa, Influenza virus
GAIGAIDSSM

SEQ ID NO: 356540 - protein, 10 aa, Influenza virus
AIGAIDSSMP

SEQ ID NO: 356541 - protein, 10 aa, Influenza virus
IGAIDSSMPF

SEQ ID NO: 356542 - protein, 10 aa, Influenza virus
PFHNIHPLTI

SEQ ID NO: 356543 - protein, 10 aa, Influenza virus
FHNIHPLTIG

SEQ ID NO: 356544 - protein, 10 aa, Influenza virus
HPLTIGECPK

SEQ ID NO: 356545 - protein, 10 aa, Influenza virus
PLTIGECPKY

SEQ ID NO: 356546 - protein, 10 aa, Influenza virus
TIGECPKYVK

SEQ ID NO: 356547 - protein, 10 aa, Influenza virus
IGECPKYVKS

SEQ ID NO: 356548 - protein, 10 aa, Influenza virus
REREGGRRRK

SEQ ID NO: 356549 - protein, 10 aa, Influenza virus
EREGGRRRKR

SEQ ID NO: 356550 - protein, 10 aa, Influenza virus
RRKKRGLFGA

SEQ ID NO: 356551 - protein, 10 aa, Influenza virus
KKKRGLFGAI

SEQ ID NO: 356552 - protein, 10 aa, Influenza virus
KRRKKRGLFG

SEQ ID NO: 356553 - protein, 10 aa, Influenza virus
RRKKRGLFGA

SEQ ID NO: 356554 - protein, 10 aa, Influenza virus
RKKRGLFGAI

SEQ ID NO: 356555 - protein, 10 aa, Influenza virus
KKRGLFGAIA

SEQ ID NO: 356556 - protein, 10 aa, Influenza virus
KRGLFGAIAG

SEQ ID NO: 356557 - protein, 10 aa, Influenza virus
RRGLFGAIAG

SEQ ID NO: 356558 - protein, 10 aa, Influenza virus
RGLFGAIAGF

SEQ ID NO: 356559 - protein, 10 aa, Influenza virus
GLFGAIAGFI

SEQ ID NO: 356560 - protein, 10 aa, Influenza virus
LFGAIAGFIE

SEQ ID NO: 356561 - protein, 10 aa, Influenza virus
FGAIAGFIEG

SEQ ID NO: 356562 - protein, 10 aa, Influenza virus
GAIAGFIEGG

SEQ ID NO: 356563 - protein, 10 aa, Influenza virus
AIAGFIEGGW

SEQ ID NO: 356564 - protein, 10 aa, Influenza virus
IAGFIEGGWQ

SEQ ID NO: 356565 - protein, 10 aa, Influenza virus
AGFIEGGWQG

SEQ ID NO: 356566 - protein, 10 aa, Influenza virus
GFIEGGWQGM

SEQ ID NO: 356567 - protein, 10 aa, Influenza virus
FIEGGWQGMV

SEQ ID NO: 356568 - protein, 10 aa, Influenza virus
IEGGWQGMVD

SEQ ID NO: 356569 - protein, 10 aa, Influenza virus
EGGWQGMVDG

SEQ ID NO: 356570 - protein, 10 aa, Influenza virus
GGWQGMVDGW

SEQ ID NO: 356571 - protein, 10 aa, Influenza virus
GWQGMVDGWY

SEQ ID NO: 356572 - protein, 10 aa, Influenza virus
WQGMVDGWYG

SEQ ID NO: 356573 - protein, 10 aa, Influenza virus
QGMVDGWYGY

SEQ ID NO: 356574 - protein, 10 aa, Influenza virus
GMVDGWYGYH

SEQ ID NO: 356575 - protein, 10 aa, Influenza virus
MVDGWYGYHH

SEQ ID NO: 356576 - protein, 10 aa, Influenza virus
VDGWYGYHHS

SEQ ID NO: 356577 - protein, 10 aa, Influenza virus
DGWYGYHHSN

SEQ ID NO: 356578 - protein, 10 aa, Influenza virus
NEQGSGYAAD

SEQ ID NO: 356579 - protein, 10 aa, Influenza virus
EQGSGYAADK

SEQ ID NO: 356580 - protein, 10 aa, Influenza virus
QGSGYAADKE

SEQ ID NO: 356581 - protein, 10 aa, Influenza virus
GSGYAADKES

SEQ ID NO: 356582 - protein, 10 aa, Influenza virus
SGYAADKEST

SEQ ID NO: 356583 - protein, 10 aa, Influenza virus
GYAADKESTQ

SEQ ID NO: 356584 - protein, 10 aa, Influenza virus
YAADKESTQK

SEQ ID NO: 356585 - protein, 10 aa, Influenza virus
AADKESTQKA

SEQ ID NO: 356586 - protein, 10 aa, Influenza virus
GVTNKVNSII

SEQ ID NO: 356587 - protein, 10 aa, Influenza virus
VNSIIDKMNT

SEQ ID NO: 356588 - protein, 10 aa, Influenza virus
FLDVWTYNAE

SEQ ID NO: 356589 - protein, 10 aa, Influenza virus
LDVWTYNAEL

SEQ ID NO: 356590 - protein, 10 aa, Influenza virus
DVWTYNAELL

SEQ ID NO: 356591 - protein, 10 aa, Influenza virus
VWTYNAELLV

SEQ ID NO: 356592 - protein, 10 aa, Influenza virus
WTYNAELLVL

SEQ ID NO: 356593 - protein, 10 aa, Influenza virus
TYNAELLVLM

SEQ ID NO: 356594 - protein, 10 aa, Influenza virus
YNAELLVLME

SEQ ID NO: 356595 - protein, 10 aa, Influenza virus
NAELLVLMEN

SEQ ID NO: 356596 - protein, 10 aa, Influenza virus
AELLVLMENE

SEQ ID NO: 356597 - protein, 10 aa, Influenza virus
ELLVLMENER

SEQ ID NO: 356598 - protein, 10 aa, Influenza virus
LLVLMENERT

SEQ ID NO: 356599 - protein, 10 aa, Influenza virus
LVLMENERTL

SEQ ID NO: 356600 - protein, 10 aa, Influenza virus
VLMENERTLD

SEQ ID NO: 356601 - protein, 10 aa, Influenza virus
LMENERTLDF

SEQ ID NO: 356602 - protein, 10 aa, Influenza virus
MENERTLDFH

SEQ ID NO: 356603 - protein, 10 aa, Influenza virus
ENERTLDFHD

SEQ ID NO: 356604 - protein, 10 aa, Influenza virus
NERTLDFHDS

SEQ ID NO: 356605 - protein, 10 aa, Influenza virus
ERTLDFHDSN

SEQ ID NO: 356606 - protein, 10 aa, Influenza virus
RTLDFHDSNV

SEQ ID NO: 356607 - protein, 10 aa, Influenza virus
TLDFHDSNVK

SEQ ID NO: 356608 - protein, 10 aa, Influenza virus
LDFHDSNVKN

SEQ ID NO: 356609 - protein, 10 aa, Influenza virus
DFHDSNVKNL

SEQ ID NO: 356610 - protein, 10 aa, Influenza virus
FHDSNVKNLY

SEQ ID NO: 356611 - protein, 10 aa, Influenza virus
HDSNVKNLYD

SEQ ID NO: 356612 - protein, 10 aa, Influenza virus
DSNVKNLYDK

SEQ ID NO: 356613 - protein, 10 aa, Influenza virus
NVKNLYDKVR

SEQ ID NO: 356614 - protein, 10 aa, Influenza virus
NLYDKVRLQL

SEQ ID NO: 356615 - protein, 10 aa, Influenza virus
KVRLQLRDNA

SEQ ID NO: 356616 - protein, 10 aa, Influenza virus
VRLQLRDNAK

SEQ ID NO: 356617 - protein, 10 aa, Influenza virus
RLQLRDNAKE

SEQ ID NO: 356618 - protein, 10 aa, Influenza virus
LQLRDNAKEL

SEQ ID NO: 356619 - protein, 10 aa, Influenza virus
QLRDNAKELG

SEQ ID NO: 356620 - protein, 10 aa, Influenza virus
LRDNAKELGN

SEQ ID NO: 356621 - protein, 10 aa, Influenza virus
RDNAKELGNG

SEQ ID NO: 356622 - protein, 10 aa, Influenza virus
DNAKELGNGC

SEQ ID NO: 356623 - protein, 10 aa, Influenza virus
NAKELGNGCF

SEQ ID NO: 356624 - protein, 10 aa, Influenza virus
AKELGNGCFE

SEQ ID NO: 356625 - protein, 10 aa, Influenza virus
KELGNGCFEF

SEQ ID NO: 356626 - protein, 10 aa, Influenza virus
ELGNGCFEFY

SEQ ID NO: 356627 - protein, 10 aa, Influenza virus
LGNGCFEFYH

SEQ ID NO: 356628 - protein, 10 aa, Influenza virus
GNGCFEFYHK

SEQ ID NO: 356629 - protein, 10 aa, Influenza virus
NGCFEFYHKC

SEQ ID NO: 356630 - protein, 10 aa, Influenza virus
GCFEFYHKCD

SEQ ID NO: 356631 - protein, 10 aa, Influenza virus
CFEFYHKCDN

SEQ ID NO: 356632 - protein, 10 aa, Influenza virus
CMESVRNGTY

SEQ ID NO: 356633 - protein, 10 aa, Influenza virus
YQILSIYSTV

SEQ ID NO: 356634 - protein, 10 aa, Influenza virus
QILSIYSTVA

SEQ ID NO: 356635 - protein, 10 aa, Influenza virus
ILSIYSTVAS

SEQ ID NO: 356636 - protein, 10 aa, Influenza virus
LSIYSTVASS

SEQ ID NO: 356637 - protein, 10 aa, Influenza virus
SIYSTVASSL

SEQ ID NO: 356638 - protein, 10 aa, Influenza virus
EFPSTGNHGS

SEQ ID NO: 356639 - protein, 10 aa, Influenza virus
FPSTGNHGSL

SEQ ID NO: 356640 - protein, 10 aa, Influenza virus
PSTGNHGSLV

SEQ ID NO: 356641 - protein, 10 aa, Influenza virus
STGNHGSLVL

SEQ ID NO: 356642 - protein, 10 aa, Influenza virus
TGNHGSLVLS

SEQ ID NO: 356643 - protein, 10 aa, Influenza virus
GNHGSLVLSL

SEQ ID NO: 356644 - protein, 10 aa, Influenza virus
NHGSLVLSLW

SEQ ID NO: 356645 - protein, 10 aa, Influenza virus
HGSLVLSLWM

SEQ ID NO: 356646 - protein, 10 aa, Influenza virus
GLSLWMCSNG

SEQ ID NO: 356647 - protein, 10 aa, Influenza virus
LSLWMCSNGS

SEQ ID NO: 356648 - protein, 10 aa, Influenza virus
LWMCSNGSLQ

SEQ ID NO: 356649 - protein, 10 aa, Influenza virus
WMCSNGSLQC

SEQ ID NO: 356650 - protein, 10 aa, Influenza virus
MCSNGSLQCR

SEQ ID NO: 356651 - protein, 10 aa, Influenza virus
CSNGSLQCRI

SEQ ID NO: 356652 - protein, 10 aa, Influenza virus
SNGSLQCRIC

SEQ ID NO: 356653 - protein, 10 aa, Influenza virus
NGSLQCRICI

SEQ ID NO: 356654 - protein, 10 aa, Influenza virus
AFKFVSSDCS

SEQ ID NO: 356655 - protein, 10 aa, Influenza virus
IRFVNSDCSK

SEQ ID NO: 356656 - protein, 10 aa, Influenza virus
ICQMEKIVLL

SEQ ID NO: 356657 - protein, 10 aa, Influenza virus
VKMEKIVLLL

SEQ ID NO: 356658 - protein, 10 aa, Influenza virus
KMEKIVLLLA

SEQ ID NO: 356659 - protein, 10 aa, Influenza virus
SDQICIGYHA

SEQ ID NO: 356660 - protein, 10 aa, Influenza virus
DQICIGYHAN

SEQ ID NO: 356661 - protein, 10 aa, Influenza virus
QICIGYHANN

SEQ ID NO: 356662 - protein, 10 aa, Influenza virus
ICIGYHANNS

SEQ ID NO: 356663 - protein, 10 aa, Influenza virus
CIGYHANNST

SEQ ID NO: 356664 - protein, 10 aa, Influenza virus
IGYHANNSTE

SEQ ID NO: 356665 - protein, 10 aa, Influenza virus
GYHANNSTEQ

SEQ ID NO: 356666 - protein, 10 aa, Influenza virus
HANNSTEQVD

SEQ ID NO: 356667 - protein, 10 aa, Influenza virus
ANNSTEQVDT

SEQ ID NO: 356668 - protein, 10 aa, Influenza virus
NNSTEQVDTI

SEQ ID NO: 356669 - protein, 10 aa, Influenza virus
NSTEQVDTIM

SEQ ID NO: 356670 - protein, 10 aa, Influenza virus
STEQVDTIME

SEQ ID NO: 356671 - protein, 10 aa, Influenza virus
TEQVDTIMEK

SEQ ID NO: 356672 - protein, 10 aa, Influenza virus
EQVDTIMEKN

SEQ ID NO: 356673 - protein, 10 aa, Influenza virus
QVDTIMEKNV

SEQ ID NO: 356674 - protein, 10 aa, Influenza virus
VDTIMEKNVT

SEQ ID NO: 356675 - protein, 10 aa, Influenza virus
DTIMEKNVTV

SEQ ID NO: 356676 - protein, 10 aa, Influenza virus
TIMEKNVTVT

SEQ ID NO: 356677 - protein, 10 aa, Influenza virus
IMEKNVTVTH

SEQ ID NO: 356678 - protein, 10 aa, Influenza virus
MEKNVTVTHA

SEQ ID NO: 356679 - protein, 10 aa, Influenza virus
EKNVTVTHAQ

SEQ ID NO: 356680 - protein, 10 aa, Influenza virus
KNVTVTHAQD

SEQ ID NO: 356681 - protein, 10 aa, Influenza virus
NVTVTHAQDI

SEQ ID NO: 356682 - protein, 10 aa, Influenza virus
VTVTHAQDIL

SEQ ID NO: 356683 - protein, 10 aa, Influenza virus
TVTHAQDILE

SEQ ID NO: 356684 - protein, 10 aa, Influenza virus
VTHAQDILEK

SEQ ID NO: 356685 - protein, 10 aa, Influenza virus
GVKPLILRDC

SEQ ID NO: 356686 - protein, 10 aa, Influenza virus
VKPLILRDCS

SEQ ID NO: 356687 - protein, 10 aa, Influenza virus
KPLILRDCSV

SEQ ID NO: 356688 - protein, 10 aa, Influenza virus
PLILRDCSVA

SEQ ID NO: 356689 - protein, 10 aa, Influenza virus
LILRDCSVAG

SEQ ID NO: 356690 - protein, 10 aa, Influenza virus
ILRDCSVAGW

SEQ ID NO: 356691 - protein, 10 aa, Influenza virus
LRDCSVAGWL

SEQ ID NO: 356692 - protein, 10 aa, Influenza virus
RDCSVAGWLL

SEQ ID NO: 356693 - protein, 10 aa, Influenza virus
DCSVAGWLLG

SEQ ID NO: 356694 - protein, 10 aa, Influenza virus
CSVAGWLLGN

SEQ ID NO: 356695 - protein, 10 aa, Influenza virus
SVAGWLLGNP

SEQ ID NO: 356696 - protein, 10 aa, Influenza virus
VAGWLLGNPM

SEQ ID NO: 356697 - protein, 10 aa, Influenza virus
AGWLLGNPMC

SEQ ID NO: 356698 - protein, 10 aa, Influenza virus
GWLLGNPMCD

SEQ ID NO: 356699 - protein, 10 aa, Influenza virus
WLLGNPMCDE

SEQ ID NO: 356700 - protein, 10 aa, Influenza virus
LLGNPMCDEF

SEQ ID NO: 356701 - protein, 10 aa, Influenza virus
NVPEWSYIVE

SEQ ID NO: 356702 - protein, 10 aa, Influenza virus
VPEWSYIVEK

SEQ ID NO: 356703 - protein, 10 aa, Influenza virus
FNDYEELKHL

SEQ ID NO: 356704 - protein, 10 aa, Influenza virus
NDYEELKHLL

SEQ ID NO: 356705 - protein, 10 aa, Influenza virus
DYEELKHLLS

SEQ ID NO: 356706 - protein, 10 aa, Influenza virus
YEELKHLLSR

SEQ ID NO: 356707 - protein, 10 aa, Influenza virus
EELKHLLSRI

SEQ ID NO: 356708 - protein, 10 aa, Influenza virus
ADHPPKVAWS

SEQ ID NO: 356709 - protein, 10 aa, Influenza virus
TYISVGTSTL

SEQ ID NO: 356710 - protein, 10 aa, Influenza virus
YISVGTSTLN

SEQ ID NO: 356711 - protein, 10 aa, Influenza virus
ISVGTSTLNQ

SEQ ID NO: 356712 - protein, 10 aa, Influenza virus
SVGTSTLNQR

SEQ ID NO: 356713 - protein, 10 aa, Influenza virus
VGTSTLNQRL

SEQ ID NO: 356714 - protein, 10 aa, Influenza virus
INFESNGNFI

SEQ ID NO: 356715 - protein, 10 aa, Influenza virus
NFESNGNFIA

SEQ ID NO: 356716 - protein, 10 aa, Influenza virus
FESNGNFIAP

SEQ ID NO: 356717 - protein, 10 aa, Influenza virus
ESNGNFIAPE

SEQ ID NO: 356718 - protein, 10 aa, Influenza virus
SNGNFIAPEY

SEQ ID NO: 356719 - protein, 10 aa, Influenza virus
NGNFIAPEYA

SEQ ID NO: 356720 - protein, 10 aa, Influenza virus
GNFIAPEYAY

SEQ ID NO: 356721 - protein, 10 aa, Influenza virus
NFIAPEYAYK

SEQ ID NO: 356722 - protein, 10 aa, Influenza virus
FIAPEYAYKI

SEQ ID NO: 356723 - protein, 10 aa, Influenza virus
AYKIVKKGDS

SEQ ID NO: 356724 - protein, 10 aa, Influenza virus
PSVKLPMGAI

SEQ ID NO: 356725 - protein, 10 aa, Influenza virus
CQTPIGAINS

SEQ ID NO: 356726 - protein, 10 aa, Influenza virus
GAIGAIDSSM

SEQ ID NO: 356727 - protein, 10 aa, Influenza virus
AIGAIDSSMP

SEQ ID NO: 356728 - protein, 10 aa, Influenza virus
IGAIDSSMPF

SEQ ID NO: 356729 - protein, 10 aa, Influenza virus
GAINSSMPFH

SEQ ID NO: 356730 - protein, 10 aa, Influenza virus
AINSSMPFHN

SEQ ID NO: 356731 - protein, 10 aa, Influenza virus
INSSMPFHNI

SEQ ID NO: 356732 - protein, 10 aa, Influenza virus
NSSMPFHNIH

SEQ ID NO: 356733 - protein, 10 aa, Influenza virus
SSMPFHNIHP

SEQ ID NO: 356734 - protein, 10 aa, Influenza virus
SMPFHNIHPL

SEQ ID NO: 356735 - protein, 10 aa, Influenza virus
MPFHNIHPLT

SEQ ID NO: 356736 - protein, 10 aa, Influenza virus
PFHNIHPLTI

SEQ ID NO: 356737 - protein, 10 aa, Influenza virus
FHNIHPLTIG

SEQ ID NO: 356738 - protein, 10 aa, Influenza virus
HNIHPLTIGE

SEQ ID NO: 356739 - protein, 10 aa, Influenza virus
NIHPLTIGEC

SEQ ID NO: 356740 - protein, 10 aa, Influenza virus
IHPLTIGECP

SEQ ID NO: 356741 - protein, 10 aa, Influenza virus
HPLTIGECPK

SEQ ID NO: 356742 - protein, 10 aa, Influenza virus
PLTIGECPKY

SEQ ID NO: 356743 - protein, 10 aa, Influenza virus
LTIGECPKYV

SEQ ID NO: 356744 - protein, 10 aa, Influenza virus
TIGECPKYVK

SEQ ID NO: 356745 - protein, 10 aa, Influenza virus
IGECPKYVKS

SEQ ID NO: 356746 - protein, 10 aa, Influenza virus
GECPKYVKSN

SEQ ID NO: 356747 - protein, 10 aa, Influenza virus
RLVLATGLRN

SEQ ID NO: 356748 - protein, 10 aa, Influenza virus
REREGGRRRK

SEQ ID NO: 356749 - protein, 10 aa, Influenza virus
EREGGRRRKR

SEQ ID NO: 356750 - protein, 10 aa, Influenza virus
RKKRGLFGAI

SEQ ID NO: 356751 - protein, 10 aa, Influenza virus
KKRGLFGAIA

SEQ ID NO: 356752 - protein, 10 aa, Influenza virus
KKRGLFGAIA

SEQ ID NO: 356753 - protein, 10 aa, Influenza virus
KRGLFGAIAG

SEQ ID NO: 356754 - protein, 10 aa, Influenza virus
RGLFGAIAGF

SEQ ID NO: 356755 - protein, 10 aa, Influenza virus
GLFGAIAGFI

SEQ ID NO: 356756 - protein, 10 aa, Influenza virus
LFGAIAGFIE

SEQ ID NO: 356757 - protein, 10 aa, Influenza virus
FGAIAGFIEG

SEQ ID NO: 356758 - protein, 10 aa, Influenza virus
GAIAGFIEGG

SEQ ID NO: 356759 - protein, 10 aa, Influenza virus
AIAGFIEGGW

SEQ ID NO: 356760 - protein, 10 aa, Influenza virus
IAGFIEGGWQ

SEQ ID NO: 356761 - protein, 10 aa, Influenza virus
AGFIEGGWQG

SEQ ID NO: 356762 - protein, 10 aa, Influenza virus
GFIEGGWQGM

SEQ ID NO: 356763 - protein, 10 aa, Influenza virus
FIEGGWQGMV

SEQ ID NO: 356764 - protein, 10 aa, Influenza virus
IEGGWQGMVD

SEQ ID NO: 356765 - protein, 10 aa, Influenza virus
EGGWQGMVDG

SEQ ID NO: 356766 - protein, 10 aa, Influenza virus
GGWQGMVDGW

SEQ ID NO: 356767 - protein, 10 aa, Influenza virus
GWQGMVDGWY

SEQ ID NO: 356768 - protein, 10 aa, Influenza virus
WQGMVDGWYG

SEQ ID NO: 356769 - protein, 10 aa, Influenza virus
QGMVDGWYGY

SEQ ID NO: 356770 - protein, 10 aa, Influenza virus
GMVDGWYGYH

SEQ ID NO: 356771 - protein, 10 aa, Influenza virus
MVDGWYGYHH

SEQ ID NO: 356772 - protein, 10 aa, Influenza virus
VDGWYGYHHS

SEQ ID NO: 356773 - protein, 10 aa, Influenza virus
DGWYGYHHSN

SEQ ID NO: 356774 - protein, 10 aa, Influenza virus
GWYGYHHSNE

SEQ ID NO: 356775 - protein, 10 aa, Influenza virus
HSNEQGSGYA

SEQ ID NO: 356776 - protein, 10 aa, Influenza virus
SNEQGSGYAA

SEQ ID NO: 356777 - protein, 10 aa, Influenza virus
NEQGSGYAAD

SEQ ID NO: 356778 - protein, 10 aa, Influenza virus
EQGSGYAADK

SEQ ID NO: 356779 - protein, 10 aa, Influenza virus
QGSGYAADKE

SEQ ID NO: 356780 - protein, 10 aa, Influenza virus
GSGYAADKES

SEQ ID NO: 356781 - protein, 10 aa, Influenza virus
SGYAADKEST

SEQ ID NO: 356782 - protein, 10 aa, Influenza virus
GYAADKESTQ

SEQ ID NO: 356783 - protein, 10 aa, Influenza virus
YAADKESTQK

SEQ ID NO: 356784 - protein, 10 aa, Influenza virus
AADKESTQKA

SEQ ID NO: 356785 - protein, 10 aa, Influenza virus
ESTQKAIDGV

SEQ ID NO: 356786 - protein, 10 aa, Influenza virus
STQKAIDGVT

SEQ ID NO: 356787 - protein, 10 aa, Influenza virus
TQKAIDGVTN

SEQ ID NO: 356788 - protein, 10 aa, Influenza virus
QKAIDGVTNK

SEQ ID NO: 356789 - protein, 10 aa, Influenza virus
AIDGVTNKVN

SEQ ID NO: 356790 - protein, 10 aa, Influenza virus
IDGVTNKVNS

SEQ ID NO: 356791 - protein, 10 aa, Influenza virus
DGVTNKVNSI

SEQ ID NO: 356792 - protein, 10 aa, Influenza virus
GVTNKVNSII

SEQ ID NO: 356793 - protein, 10 aa, Influenza virus
VTNKVNSIID

SEQ ID NO: 356794 - protein, 10 aa, Influenza virus
TNKVNSIIDK

SEQ ID NO: 356795 - protein, 10 aa, Influenza virus
NKVNSIIDKM

SEQ ID NO: 356796 - protein, 10 aa, Influenza virus
KVNSIIDKMN

SEQ ID NO: 356797 - protein, 10 aa, Influenza virus
VNSIIDKMNT

SEQ ID NO: 356798 - protein, 10 aa, Influenza virus
NSIIDKMNTQ

SEQ ID NO: 356799 - protein, 10 aa, Influenza virus
SIIDKMNTQF

SEQ ID NO: 356800 - protein, 10 aa, Influenza virus
IIDKMNTQFE

SEQ ID NO: 356801 - protein, 10 aa, Influenza virus
IDKMNTQFEA

SEQ ID NO: 356802 - protein, 10 aa, Influenza virus
KMNTQFEAVG

SEQ ID NO: 356803 - protein, 10 aa, Influenza virus
MNTQFEAVGR

SEQ ID NO: 356804 - protein, 10 aa, Influenza virus
NTQFEAVGRE

SEQ ID NO: 356805 - protein, 10 aa, Influenza virus
TQFEAVGREF

SEQ ID NO: 356806 - protein, 10 aa, Influenza virus
QFEAVGREFN

SEQ ID NO: 356807 - protein, 10 aa, Influenza virus
LERRIENLNK

SEQ ID NO: 356808 - protein, 10 aa, Influenza virus
ERRIENLNKK

SEQ ID NO: 356809 - protein, 10 aa, Influenza virus
RRIENLNKKM

SEQ ID NO: 356810 - protein, 10 aa, Influenza virus
RIENLNKKME

SEQ ID NO: 356811 - protein, 10 aa, Influenza virus
IENLNKKMED

SEQ ID NO: 356812 - protein, 10 aa, Influenza virus
ENLNKKMEDG

SEQ ID NO: 356813 - protein, 10 aa, Influenza virus
NLNKKMEDGF

SEQ ID NO: 356814 - protein, 10 aa, Influenza virus
LNKKMEDGFL

SEQ ID NO: 356815 - protein, 10 aa, Influenza virus
NKKMEDGFLD

SEQ ID NO: 356816 - protein, 10 aa, Influenza virus
KKMEDGFLDV

SEQ ID NO: 356817 - protein, 10 aa, Influenza virus
KMEDGFLDVW

SEQ ID NO: 356818 - protein, 10 aa, Influenza virus
MEDGFLDVWT

SEQ ID NO: 356819 - protein, 10 aa, Influenza virus
EDGFLDVWTY

SEQ ID NO: 356820 - protein, 10 aa, Influenza virus
DGFLDVWTYN

SEQ ID NO: 356821 - protein, 10 aa, Influenza virus
GFLDVWTYNA

SEQ ID NO: 356822 - protein, 10 aa, Influenza virus
FLDVWTYNAE

SEQ ID NO: 356823 - protein, 10 aa, Influenza virus
LDVWTYNAEL

SEQ ID NO: 356824 - protein, 10 aa, Influenza virus
DVWTYNAELL

SEQ ID NO: 356825 - protein, 10 aa, Influenza virus
VWTYNAELLV

SEQ ID NO: 356826 - protein, 10 aa, Influenza virus
WTYNAELLVL

SEQ ID NO: 356827 - protein, 10 aa, Influenza virus
TYNAELLVLM

SEQ ID NO: 356828 - protein, 10 aa, Influenza virus
YNAELLVLME

SEQ ID NO: 356829 - protein, 10 aa, Influenza virus
NAELLVLMEN

SEQ ID NO: 356830 - protein, 10 aa, Influenza virus
AELLVLMENE

SEQ ID NO: 356831 - protein, 10 aa, Influenza virus
ELLVLMENER

SEQ ID NO: 356832 - protein, 10 aa, Influenza virus
LLVLMENERT

SEQ ID NO: 356833 - protein, 10 aa, Influenza virus
LVLMENERTL

SEQ ID NO: 356834 - protein, 10 aa, Influenza virus
VLMENERTLD

SEQ ID NO: 356835 - protein, 10 aa, Influenza virus
LMENERTLDF

SEQ ID NO: 356836 - protein, 10 aa, Influenza virus
MENERTLDFH

SEQ ID NO: 356837 - protein, 10 aa, Influenza virus
ENERTLDFHD

SEQ ID NO: 356838 - protein, 10 aa, Influenza virus
NERTLDFHDS

SEQ ID NO: 356839 - protein, 10 aa, Influenza virus
ERTLDFHDSN

SEQ ID NO: 356840 - protein, 10 aa, Influenza virus
RTLDFHDSNV

SEQ ID NO: 356841 - protein, 10 aa, Influenza virus
TLDFHDSNVK

SEQ ID NO: 356842 - protein, 10 aa, Influenza virus
LDFHDSNVKN

SEQ ID NO: 356843 - protein, 10 aa, Influenza virus
DFHDSNVKNL

SEQ ID NO: 356844 - protein, 10 aa, Influenza virus
FHDSNVKNLY

SEQ ID NO: 356845 - protein, 10 aa, Influenza virus
HDSNVKNLYD

SEQ ID NO: 356846 - protein, 10 aa, Influenza virus
DSNVKNLYDK

SEQ ID NO: 356847 - protein, 10 aa, Influenza virus
SNVKNLYDKV

SEQ ID NO: 356848 - protein, 10 aa, Influenza virus
NVKNLYDKVR

SEQ ID NO: 356849 - protein, 10 aa, Influenza virus
VKNLYDKVRL

SEQ ID NO: 356850 - protein, 10 aa, Influenza virus
KNLYDKVRLQ

SEQ ID NO: 356851 - protein, 10 aa, Influenza virus
NLYDKVRLQL

SEQ ID NO: 356852 - protein, 10 aa, Influenza virus
LYDKVRLQLR

SEQ ID NO: 356853 - protein, 10 aa, Influenza virus
YDKVRLQLRD

SEQ ID NO: 356854 - protein, 10 aa, Influenza virus
DKVRLQLRDN

SEQ ID NO: 356855 - protein, 10 aa, Influenza virus
KVRLQLRDNA

SEQ ID NO: 356856 - protein, 10 aa, Influenza virus
VRLQLRDNAK

SEQ ID NO: 356857 - protein, 10 aa, Influenza virus
RLQLRDNAKE

SEQ ID NO: 356858 - protein, 10 aa, Influenza virus
LQLRDNAKEL

SEQ ID NO: 356859 - protein, 10 aa, Influenza virus
QLRDNAKELG

SEQ ID NO: 356860 - protein, 10 aa, Influenza virus
LRDNAKELGN

SEQ ID NO: 356861 - protein, 10 aa, Influenza virus
RDNAKELGNG

SEQ ID NO: 356862 - protein, 10 aa, Influenza virus
DNAKELGNGC

SEQ ID NO: 356863 - protein, 10 aa, Influenza virus
NAKELGNGCF

SEQ ID NO: 356864 - protein, 10 aa, Influenza virus
AKELGNGCFE

SEQ ID NO: 356865 - protein, 10 aa, Influenza virus
KELGNGCFEF

SEQ ID NO: 356866 - protein, 10 aa, Influenza virus
ELGNGCFEFY

SEQ ID NO: 356867 - protein, 10 aa, Influenza virus
LGNGCFEFYH

SEQ ID NO: 356868 - protein, 10 aa, Influenza virus
GNGCFEFYHK

SEQ ID NO: 356869 - protein, 10 aa, Influenza virus
NGCFEFYHKC

SEQ ID NO: 356870 - protein, 10 aa, Influenza virus
GCFEFYHKCD

SEQ ID NO: 356871 - protein, 10 aa, Influenza virus
CFEFYHKCDN

SEQ ID NO: 356872 - protein, 10 aa, Influenza virus
CMESVRNGTY

SEQ ID NO: 356873 - protein, 10 aa, Influenza virus
GTYQILSIYS

SEQ ID NO: 356874 - protein, 10 aa, Influenza virus
TYQILSIYST

SEQ ID NO: 356875 - protein, 10 aa, Influenza virus
YQILSIYSTV

SEQ ID NO: 356876 - protein, 10 aa, Influenza virus
QILSIYSTVA

SEQ ID NO: 356877 - protein, 10 aa, Influenza virus
ILSIYSTVAS

SEQ ID NO: 356878 - protein, 10 aa, Influenza virus
LSIYSTVASS

SEQ ID NO: 356879 - protein, 10 aa, Influenza virus
SIYSTVASSL

SEQ ID NO: 356880 - protein, 10 aa, Influenza virus
YSTVASSLAL

SEQ ID NO: 356881 - protein, 10 aa, Influenza virus
STVASSLALA

SEQ ID NO: 356882 - protein, 10 aa, Influenza virus
TVASSLALAI

SEQ ID NO: 356883 - protein, 10 aa, Influenza virus
EFPSTGNHGS

SEQ ID NO: 356884 - protein, 10 aa, Influenza virus
FPSTGNHGSL

SEQ ID NO: 356885 - protein, 10 aa, Influenza virus
PSTGNHGSLV

SEQ ID NO: 356886 - protein, 10 aa, Influenza virus
STGNHGSLVL

SEQ ID NO: 356887 - protein, 10 aa, Influenza virus
TGNHGSLVLS

SEQ ID NO: 356888 - protein, 10 aa, Influenza virus
GNHGSLVLSL

SEQ ID NO: 356889 - protein, 10 aa, Influenza virus
NHGSLVLSLW

SEQ ID NO: 356890 - protein, 10 aa, Influenza virus
HGSLVLSLWM

SEQ ID NO: 356891 - protein, 10 aa, Influenza virus
AGLSLWMCSN

SEQ ID NO: 356892 - protein, 10 aa, Influenza virus
GLSLWMCSNG

SEQ ID NO: 356893 - protein, 10 aa, Influenza virus
LSLWMCSNGS

SEQ ID NO: 356894 - protein, 10 aa, Influenza virus
SLWMCSNGSL

SEQ ID NO: 356895 - protein, 10 aa, Influenza virus
LWMCSNGSLQ

SEQ ID NO: 356896 - protein, 10 aa, Influenza virus
WMCSNGSLQC

SEQ ID NO: 356897 - protein, 10 aa, Influenza virus
MCSNGSLQCR

SEQ ID NO: 356898 - protein, 10 aa, Influenza virus
CSNGSLQCRI

SEQ ID NO: 356899 - protein, 10 aa, Influenza virus
SNGSLQCRIC

SEQ ID NO: 356900 - protein, 10 aa, Influenza virus
NGSLQCRICI

SEQ ID NO: 356901 - protein, 10 aa, Influenza virus
AFKFVSSDCS

SEQ ID NO: 356902 - protein, 10 aa, Influenza virus
IRFVNSDCSK

SEQ ID NO: 356903 - protein, 10 aa, Influenza virus
LVFREQKQEF

SEQ ID NO: 356904 - protein, 10 aa, Influenza virus
GLREQKQEFK

SEQ ID NO: 356905 - protein, 10 aa, Influenza virus
LREQKQEFKM

SEQ ID NO: 356906 - protein, 10 aa, Influenza virus
REQKQEFKMN

SEQ ID NO: 356907 - protein, 10 aa, Influenza virus
EQKQEFKMNP

SEQ ID NO: 356908 - protein, 10 aa, Influenza virus
QKQEFKMNPN

SEQ ID NO: 356909 - protein, 10 aa, Influenza virus
KQEFKMNPNK

SEQ ID NO: 356910 - protein, 10 aa, Influenza virus
QEFKMNPNKK

SEQ ID NO: 356911 - protein, 10 aa, Influenza virus
EFKMNPNKKI

SEQ ID NO: 356912 - protein, 10 aa, Influenza virus
FKMNPNKKII

SEQ ID NO: 356913 - protein, 10 aa, Influenza virus
KMNPNKKIIT

SEQ ID NO: 356914 - protein, 10 aa, Influenza virus
NRDITIGSIC

SEQ ID NO: 356915 - protein, 10 aa, Influenza virus
RDITIGSICM

SEQ ID NO: 356916 - protein, 10 aa, Influenza virus
DITIGSICMV

SEQ ID NO: 356917 - protein, 10 aa, Influenza virus
NLDLNMGQPF

SEQ ID NO: 356918 - protein, 10 aa, Influenza virus
LDLNMGQPFY

SEQ ID NO: 356919 - protein, 10 aa, Influenza virus
DLNMGQPFYS

SEQ ID NO: 356920 - protein, 10 aa, Influenza virus
LNMGQPFYSH

SEQ ID NO: 356921 - protein, 10 aa, Influenza virus
GPSHSIHTGN

SEQ ID NO: 356922 - protein, 10 aa, Influenza virus
YENNTWVNQT

SEQ ID NO: 356923 - protein, 10 aa, Influenza virus
ENNTWVNQTY

SEQ ID NO: 356924 - protein, 10 aa, Influenza virus
YSKDNSIRIG

SEQ ID NO: 356925 - protein, 10 aa, Influenza virus
SKDNSIRIGS

SEQ ID NO: 356926 - protein, 10 aa, Influenza virus
KDNSIRIGSK

SEQ ID NO: 356927 - protein, 10 aa, Influenza virus
DNSIRIGSKG

SEQ ID NO: 356928 - protein, 10 aa, Influenza virus
NSIRIGSKGD

SEQ ID NO: 356929 - protein, 10 aa, Influenza virus
SIRIGSKGDV

SEQ ID NO: 356930 - protein, 10 aa, Influenza virus
IRIGSKGDVF

SEQ ID NO: 356931 - protein, 10 aa, Influenza virus
RIGSKGDVFV

SEQ ID NO: 356932 - protein, 10 aa, Influenza virus
GDVFVIREPF

SEQ ID NO: 356933 - protein, 10 aa, Influenza virus
IREPFISCSH

SEQ ID NO: 356934 - protein, 10 aa, Influenza virus
REPFISCSHL

SEQ ID NO: 356935 - protein, 10 aa, Influenza virus
EPFISCSHLE

SEQ ID NO: 356936 - protein, 10 aa, Influenza virus
PFISCSHLEC

SEQ ID NO: 356937 - protein, 10 aa, Influenza virus
FISCSHLECR

SEQ ID NO: 356938 - protein, 10 aa, Influenza virus
ISCSHLECRT

SEQ ID NO: 356939 - protein, 10 aa, Influenza virus
SCSHLECRTF

SEQ ID NO: 356940 - protein, 10 aa, Influenza virus
CSHLECRTFF

SEQ ID NO: 356941 - protein, 10 aa, Influenza virus
SHLECRTFFL

SEQ ID NO: 356942 - protein, 10 aa, Influenza virus
HLECRTFFLT

SEQ ID NO: 356943 - protein, 10 aa, Influenza virus
LECRTFFLTQ

SEQ ID NO: 356944 - protein, 10 aa, Influenza virus
ECRTFFLTQG

SEQ ID NO: 356945 - protein, 10 aa, Influenza virus
CRTFFLTQGA

SEQ ID NO: 356946 - protein, 10 aa, Influenza virus
RTFFLTQGAL

SEQ ID NO: 356947 - protein, 10 aa, Influenza virus
TFFLTQGALL

SEQ ID NO: 356948 - protein, 10 aa, Influenza virus
FFLTQGALLN

SEQ ID NO: 356949 - protein, 10 aa, Influenza virus
FLTQGALLND

SEQ ID NO: 356950 - protein, 10 aa, Influenza virus
LTQGALLNDK

SEQ ID NO: 356951 - protein, 10 aa, Influenza virus
TQGALLNDKH

SEQ ID NO: 356952 - protein, 10 aa, Influenza virus
QGALLNDKHS

SEQ ID NO: 356953 - protein, 10 aa, Influenza virus
GALLNDKHSN

SEQ ID NO: 356954 - protein, 10 aa, Influenza virus
ALLNDKHSNG

SEQ ID NO: 356955 - protein, 10 aa, Influenza virus
LLNDKHSNGT

SEQ ID NO: 356956 - protein, 10 aa, Influenza virus
LNDKHSNGTV

SEQ ID NO: 356957 - protein, 10 aa, Influenza virus
KHSNGTVKDR

SEQ ID NO: 356958 - protein, 10 aa, Influenza virus
HSNGTVKDRS

SEQ ID NO: 356959 - protein, 10 aa, Influenza virus
SNGTVKDRSP

SEQ ID NO: 356960 - protein, 10 aa, Influenza virus
KDRSPHRTLM

SEQ ID NO: 356961 - protein, 10 aa, Influenza virus
DRSPHRTLMS

SEQ ID NO: 356962 - protein, 10 aa, Influenza virus
RSPHRTLMSC

SEQ ID NO: 356963 - protein, 10 aa, Influenza virus
SPHRTLMSCP

SEQ ID NO: 356964 - protein, 10 aa, Influenza virus
GEAPSPYNSR

SEQ ID NO: 356965 - protein, 10 aa, Influenza virus
EAPSPYNSRF

SEQ ID NO: 356966 - protein, 10 aa, Influenza virus
APSPYNSRFE

SEQ ID NO: 356967 - protein, 10 aa, Influenza virus
PSPYNSRFES

SEQ ID NO: 356968 - protein, 10 aa, Influenza virus
SPYNSRFESV

SEQ ID NO: 356969 - protein, 10 aa, Influenza virus
PYNSRFESVA

SEQ ID NO: 356970 - protein, 10 aa, Influenza virus
YNSRFESVAW

SEQ ID NO: 356971 - protein, 10 aa, Influenza virus
NSRFESVAWS

SEQ ID NO: 356972 - protein, 10 aa, Influenza virus
SRFESVAWSA

SEQ ID NO: 356973 - protein, 10 aa, Influenza virus
RFESVAWSAS

SEQ ID NO: 356974 - protein, 10 aa, Influenza virus
FESVAWSASA

SEQ ID NO: 356975 - protein, 10 aa, Influenza virus
ESVAWSASAC

SEQ ID NO: 356976 - protein, 10 aa, Influenza virus
SVAWSASACH

SEQ ID NO: 356977 - protein, 10 aa, Influenza virus
VAWSASACHD

SEQ ID NO: 356978 - protein, 10 aa, Influenza virus
AWSASACHDG

SEQ ID NO: 356979 - protein, 10 aa, Influenza virus
WSASACHDGT

SEQ ID NO: 356980 - protein, 10 aa, Influenza virus
SASACHDGTS

SEQ ID NO: 356981 - protein, 10 aa, Influenza virus
ASACHDGTSW

SEQ ID NO: 356982 - protein, 10 aa, Influenza virus
SACHDGTSWL

SEQ ID NO: 356983 - protein, 10 aa, Influenza virus
CHDGTSWLTI

SEQ ID NO: 356984 - protein, 10 aa, Influenza virus
SWLTIGISGP

SEQ ID NO: 356985 - protein, 10 aa, Influenza virus
WLTIGISGPD

SEQ ID NO: 356986 - protein, 10 aa, Influenza virus
LTIGISGPDN

SEQ ID NO: 356987 - protein, 10 aa, Influenza virus
IGISGPDNGA

SEQ ID NO: 356988 - protein, 10 aa, Influenza virus
GISGPDNGAV

SEQ ID NO: 356989 - protein, 10 aa, Influenza virus
ISGPDNGAVA

SEQ ID NO: 356990 - protein, 10 aa, Influenza virus
SGPDNGAVAV

SEQ ID NO: 356991 - protein, 10 aa, Influenza virus
GPDNGAVAVL

SEQ ID NO: 356992 - protein, 10 aa, Influenza virus
PDNGAVAVLK

SEQ ID NO: 356993 - protein, 10 aa, Influenza virus
DNGAVAVLKY

SEQ ID NO: 356994 - protein, 10 aa, Influenza virus
GAVAVLKYNG

SEQ ID NO: 356995 - protein, 10 aa, Influenza virus
KYNGIITDTI

SEQ ID NO: 356996 - protein, 10 aa, Influenza virus
GIITDTIKSW

SEQ ID NO: 356997 - protein, 10 aa, Influenza virus
NILRTQESEC

SEQ ID NO: 356998 - protein, 10 aa, Influenza virus
ILRTQESECA

SEQ ID NO: 356999 - protein, 10 aa, Influenza virus
LRTQESECAC

SEQ ID NO: 357000 - protein, 10 aa, Influenza virus
RTQESECACV

SEQ ID NO: 357001 - protein, 10 aa, Influenza virus
TQESECACVN

SEQ ID NO: 357002 - protein, 10 aa, Influenza virus
QESECACVNG

SEQ ID NO: 357003 - protein, 10 aa, Influenza virus
GSCFTVMTDG

SEQ ID NO: 357004 - protein, 10 aa, Influenza virus
SCFTVMTDGP

SEQ ID NO: 357005 - protein, 10 aa, Influenza virus
CFTVMTDGPS

SEQ ID NO: 357006 - protein, 10 aa, Influenza virus
YKYKIFKNGK

SEQ ID NO: 357007 - protein, 10 aa, Influenza virus
KYKIFKNGKK

SEQ ID NO: 357008 - protein, 10 aa, Influenza virus
GKKGKWLNQS

SEQ ID NO: 357009 - protein, 10 aa, Influenza virus
APNYHYEECS

SEQ ID NO: 357010 - protein, 10 aa, Influenza virus
PNYHYEECSC

SEQ ID NO: 357011 - protein, 10 aa, Influenza virus
NYHYEECSCY

SEQ ID NO: 357012 - protein, 10 aa, Influenza virus
YHYEECSCYP

SEQ ID NO: 357013 - protein, 10 aa, Influenza virus
HYEECSCYPD

SEQ ID NO: 357014 - protein, 10 aa, Influenza virus
YEECSCYPDA

SEQ ID NO: 357015 - protein, 10 aa, Influenza virus
EECSCYPDAG

SEQ ID NO: 357016 - protein, 10 aa, Influenza virus
ECSCYPDAGE

SEQ ID NO: 357017 - protein, 10 aa, Influenza virus
TCVCRDNWHG

SEQ ID NO: 357018 - protein, 10 aa, Influenza virus
CVCRDNWHGS

SEQ ID NO: 357019 - protein, 10 aa, Influenza virus
VCRDNWHGSN

SEQ ID NO: 357020 - protein, 10 aa, Influenza virus
CRDNWHGSNR

SEQ ID NO: 357021 - protein, 10 aa, Influenza virus
RDNWHGSNRP

SEQ ID NO: 357022 - protein, 10 aa, Influenza virus
DNWHGSNRPW

SEQ ID NO: 357023 - protein, 10 aa, Influenza virus
NWHGSNRPWV

SEQ ID NO: 357024 - protein, 10 aa, Influenza virus
WHGSNRPWVS

SEQ ID NO: 357025 - protein, 10 aa, Influenza virus
HGSNRPWVSF

SEQ ID NO: 357026 - protein, 10 aa, Influenza virus
GSNRPWVSFN

SEQ ID NO: 357027 - protein, 10 aa, Influenza virus
IGYICSGVFG

SEQ ID NO: 357028 - protein, 10 aa, Influenza virus
GYICSGVFGD

SEQ ID NO: 357029 - protein, 10 aa, Influenza virus
YICSGVFGDN

SEQ ID NO: 357030 - protein, 10 aa, Influenza virus
ICSGVFGDNP

SEQ ID NO: 357031 - protein, 10 aa, Influenza virus
CSGVFGDNPR

SEQ ID NO: 357032 - protein, 10 aa, Influenza virus
SGVFGDNPRP

SEQ ID NO: 357033 - protein, 10 aa, Influenza virus
FGDNPRPNDG

SEQ ID NO: 357034 - protein, 10 aa, Influenza virus
GVKGFSFKYG

SEQ ID NO: 357035 - protein, 10 aa, Influenza virus
KGFSFKYGNG

SEQ ID NO: 357036 - protein, 10 aa, Influenza virus
FKYGNGVWIG

SEQ ID NO: 357037 - protein, 10 aa, Influenza virus
KYGNGVWIGR

SEQ ID NO: 357038 - protein, 10 aa, Influenza virus
YGNGVWIGRT

SEQ ID NO: 357039 - protein, 10 aa, Influenza virus
GNGVWIGRTK

SEQ ID NO: 357040 - protein, 10 aa, Influenza virus
NGVWIGRTKS

SEQ ID NO: 357041 - protein, 10 aa, Influenza virus
GVWIGRTKST

SEQ ID NO: 357042 - protein, 10 aa, Influenza virus
SRSGFEMIWD

SEQ ID NO: 357043 - protein, 10 aa, Influenza virus
RSGFEMIWDP

SEQ ID NO: 357044 - protein, 10 aa, Influenza virus
SGFEMIWDPN

SEQ ID NO: 357045 - protein, 10 aa, Influenza virus
GFEMIWDPNG

SEQ ID NO: 357046 - protein, 10 aa, Influenza virus
FEMIWDPNGW

SEQ ID NO: 357047 - protein, 10 aa, Influenza virus
ITDWSGYSGS

SEQ ID NO: 357048 - protein, 10 aa, Influenza virus
TDWSGYSGSF

SEQ ID NO: 357049 - protein, 10 aa, Influenza virus
DWSGYSGSFV

SEQ ID NO: 357050 - protein, 10 aa, Influenza virus
WSGYSGSFVQ

SEQ ID NO: 357051 - protein, 10 aa, Influenza virus
SGYSGSFVQH

SEQ ID NO: 357052 - protein, 10 aa, Influenza virus
GYSGSFVQHP

SEQ ID NO: 357053 - protein, 10 aa, Influenza virus
YSGSFVQHPE

SEQ ID NO: 357054 - protein, 10 aa, Influenza virus
SGSFVQHPEL

SEQ ID NO: 357055 - protein, 10 aa, Influenza virus
GSFVQHPELT

SEQ ID NO: 357056 - protein, 10 aa, Influenza virus
SFVQHPELTG

SEQ ID NO: 357057 - protein, 10 aa, Influenza virus
FVQHPELTGL

SEQ ID NO: 357058 - protein, 10 aa, Influenza virus
VQHPELTGLD

SEQ ID NO: 357059 - protein, 10 aa, Influenza virus
QHPELTGLDC

SEQ ID NO: 357060 - protein, 10 aa, Influenza virus
DCIRPCFWVE

SEQ ID NO: 357061 - protein, 10 aa, Influenza virus
CIRPCFWVEL

SEQ ID NO: 357062 - protein, 10 aa, Influenza virus
IRPCFWVELI

SEQ ID NO: 357063 - protein, 10 aa, Influenza virus
RPCFWVELIR

SEQ ID NO: 357064 - protein, 10 aa, Influenza virus
PCFWVELIRG

SEQ ID NO: 357065 - protein, 10 aa, Influenza virus
CFWVELIRGR

SEQ ID NO: 357066 - protein, 10 aa, Influenza virus
FWVELIRGRP

SEQ ID NO: 357067 - protein, 10 aa, Influenza virus
WVELIRGRPK

SEQ ID NO: 357068 - protein, 10 aa, Influenza virus
VELIRGRPKE

SEQ ID NO: 357069 - protein, 10 aa, Influenza virus
IWTSGSSISF

SEQ ID NO: 357070 - protein, 10 aa, Influenza virus
WTSGSSISFC

SEQ ID NO: 357071 - protein, 10 aa, Influenza virus
TSGSSISFCG

SEQ ID NO: 357072 - protein, 10 aa, Influenza virus
SGSSISFCGV

SEQ ID NO: 357073 - protein, 10 aa, Influenza virus
GSSISFCGVN

SEQ ID NO: 357074 - protein, 10 aa, Influenza virus
IFLWCKIVTT

SEQ ID NO: 357075 - protein, 10 aa, Influenza virus
FLWCKIVTTV

SEQ ID NO: 357076 - protein, 10 aa, Influenza virus
LWCKIVTTVG

SEQ ID NO: 357077 - protein, 10 aa, Influenza virus
WCKIVTTVGW

SEQ ID NO: 357078 - protein, 10 aa, Influenza virus
CKIVTTVGWS

SEQ ID NO: 357079 - protein, 10 aa, Influenza virus
KIVTTVGWSW

SEQ ID NO: 357080 - protein, 10 aa, Influenza virus
IVTTVGWSWP

SEQ ID NO: 357081 - protein, 10 aa, Influenza virus
VTTVGWSWPD

SEQ ID NO: 357082 - protein, 10 aa, Influenza virus
WSWPDGAELP

SEQ ID NO: 357083 - protein, 10 aa, Influenza virus
SWPDGAELPF

SEQ ID NO: 357084 - protein, 10 aa, Influenza virus
AELPFTIDKY

SEQ ID NO: 357085 - protein, 10 aa, Influenza virus
DQICIGYHAN

SEQ ID NO: 357086 - protein, 10 aa, Influenza virus
QICIGYHANN

SEQ ID NO: 357087 - protein, 10 aa, Influenza virus
ICIGYHANNS

SEQ ID NO: 357088 - protein, 10 aa, Influenza virus
CIGYHANNST

SEQ ID NO: 357089 - protein, 10 aa, Influenza virus
IGYHANNSTE

SEQ ID NO: 357090 - protein, 10 aa, Influenza virus
GYHANNSTEQ

SEQ ID NO: 357091 - protein, 10 aa, Influenza virus
YHANNSTEQV

SEQ ID NO: 357092 - protein, 10 aa, Influenza virus
HANNSTEQVD

SEQ ID NO: 357093 - protein, 10 aa, Influenza virus
ANNSTEQVDT

SEQ ID NO: 357094 - protein, 10 aa, Influenza virus
NNSTEQVDTI

SEQ ID NO: 357095 - protein, 10 aa, Influenza virus
QVDTIMEKNV

SEQ ID NO: 357096 - protein, 10 aa, Influenza virus
DTIMEKNVTV

SEQ ID NO: 357097 - protein, 10 aa, Influenza virus
TIMEKNVTVT

SEQ ID NO: 357098 - protein, 10 aa, Influenza virus
EKNVTVTHAQ

SEQ ID NO: 357099 - protein, 10 aa, Influenza virus
AGWLLGNPMC

SEQ ID NO: 357100 - protein, 10 aa, Influenza virus
VPEWSYIVEK

SEQ ID NO: 357101 - protein, 10 aa, Influenza virus
PEWSYIVEKD

SEQ ID NO: 357102 - protein, 10 aa, Influenza virus
EWSYIVEKDN

SEQ ID NO: 357103 - protein, 10 aa, Influenza virus
WSYIVEKDNP

SEQ ID NO: 357104 - protein, 10 aa, Influenza virus
YYNGRSSFFR

SEQ ID NO: 357105 - protein, 10 aa, Influenza virus
SSFFRNVVWL

SEQ ID NO: 357106 - protein, 10 aa, Influenza virus
SFFRNVVWLI

SEQ ID NO: 357107 - protein, 10 aa, Influenza virus
FFRNVVWLIK

SEQ ID NO: 357108 - protein, 10 aa, Influenza virus
FRNVVWLIKK

SEQ ID NO: 357109 - protein, 10 aa, Influenza virus
IATRPKVNGQ

SEQ ID NO: 357110 - protein, 10 aa, Influenza virus
FESNGNFIAP

SEQ ID NO: 357111 - protein, 10 aa, Influenza virus
ESNGNFIAPE

SEQ ID NO: 357112 - protein, 10 aa, Influenza virus
SNGNFIAPEY

SEQ ID NO: 357113 - protein, 10 aa, Influenza virus
NGNFIAPEYA

SEQ ID NO: 357114 - protein, 10 aa, Influenza virus
GNFIAPEYAY

SEQ ID NO: 357115 - protein, 10 aa, Influenza virus
NFIAPEYAYK

SEQ ID NO: 357116 - protein, 10 aa, Influenza virus
FIAPEYAYKI

SEQ ID NO: 357117 - protein, 10 aa, Influenza virus
YGNCDTKCQT

SEQ ID NO: 357118 - protein, 10 aa, Influenza virus
GNCDTKCQTP

SEQ ID NO: 357119 - protein, 10 aa, Influenza virus
RKRKRKTRGL

SEQ ID NO: 357120 - protein, 10 aa, Influenza virus
KRKRKTRGLF

SEQ ID NO: 357121 - protein, 10 aa, Influenza virus
RKRKTRGLFG

SEQ ID NO: 357122 - protein, 10 aa, Influenza virus
KRKTRGLFGA

SEQ ID NO: 357123 - protein, 10 aa, Influenza virus
EKRRKKRGLF

SEQ ID NO: 357124 - protein, 10 aa, Influenza virus
KRRKKRGLFG

SEQ ID NO: 357125 - protein, 10 aa, Influenza virus
RRKKRGLFGA

SEQ ID NO: 357126 - protein, 10 aa, Influenza virus
RKKRGLFGAI

SEQ ID NO: 357127 - protein, 10 aa, Influenza virus
ETRGLFGAIA

SEQ ID NO: 357128 - protein, 10 aa, Influenza virus
TRGLFGAIAG

SEQ ID NO: 357129 - protein, 10 aa, Influenza virus
RGLFGAIAGF

SEQ ID NO: 357130 - protein, 10 aa, Influenza virus
GLFGAIAGFI

SEQ ID NO: 357131 - protein, 10 aa, Influenza virus
LFGAIAGFIE

SEQ ID NO: 357132 - protein, 10 aa, Influenza virus
FGAIAGFIEG

SEQ ID NO: 357133 - protein, 10 aa, Influenza virus
GAIAGFIEGG

SEQ ID NO: 357134 - protein, 10 aa, Influenza virus
AIAGFIEGGW

SEQ ID NO: 357135 - protein, 10 aa, Influenza virus
IAGFIEGGWQ

SEQ ID NO: 357136 - protein, 10 aa, Influenza virus
AGFIEGGWQG

SEQ ID NO: 357137 - protein, 10 aa, Influenza virus
GFIEGGWQGM

SEQ ID NO: 357138 - protein, 10 aa, Influenza virus
FIEGGWQGMV

SEQ ID NO: 357139 - protein, 10 aa, Influenza virus
IEGGWQGMVD

SEQ ID NO: 357140 - protein, 10 aa, Influenza virus
EGGWQGMVDG

SEQ ID NO: 357141 - protein, 10 aa, Influenza virus
GGWQGMVDGW

SEQ ID NO: 357142 - protein, 10 aa, Influenza virus
GWQGMVDGWY

SEQ ID NO: 357143 - protein, 10 aa, Influenza virus
WQGMVDGWYG

SEQ ID NO: 357144 - protein, 10 aa, Influenza virus
QGMVDGWYGY

SEQ ID NO: 357145 - protein, 10 aa, Influenza virus
GMVDGWYGYH

SEQ ID NO: 357146 - protein, 10 aa, Influenza virus
MVDGWYGYHH

SEQ ID NO: 357147 - protein, 10 aa, Influenza virus
VDGWYGYHHS

SEQ ID NO: 357148 - protein, 10 aa, Influenza virus
DGWYGYHHSN

SEQ ID NO: 357149 - protein, 10 aa, Influenza virus
GSGYAADKES

SEQ ID NO: 357150 - protein, 10 aa, Influenza virus
SGYAADKEST

SEQ ID NO: 357151 - protein, 10 aa, Influenza virus
GYAADKESTQ

SEQ ID NO: 357152 - protein, 10 aa, Influenza virus
YAADKESTQK

SEQ ID NO: 357153 - protein, 10 aa, Influenza virus
AADKESTQKA

SEQ ID NO: 357154 - protein, 10 aa, Influenza virus
STQKAIDGIT

SEQ ID NO: 357155 - protein, 10 aa, Influenza virus
VWTYNAELLV

SEQ ID NO: 357156 - protein, 10 aa, Influenza virus
WTYNAELLVL

SEQ ID NO: 357157 - protein, 10 aa, Influenza virus
TYNAELLVLM

SEQ ID NO: 357158 - protein, 10 aa, Influenza virus
YNAELLVLME

SEQ ID NO: 357159 - protein, 10 aa, Influenza virus
NAELLVLMEN

SEQ ID NO: 357160 - protein, 10 aa, Influenza virus
AELLVLMENE

SEQ ID NO: 357161 - protein, 10 aa, Influenza virus
ELLVLMENER

SEQ ID NO: 357162 - protein, 10 aa, Influenza virus
LLVLMENERT

SEQ ID NO: 357163 - protein, 10 aa, Influenza virus
LVLMENERTL

SEQ ID NO: 357164 - protein, 10 aa, Influenza virus
VLMENERTLD

SEQ ID NO: 357165 - protein, 10 aa, Influenza virus
LMENERTLDF

SEQ ID NO: 357166 - protein, 10 aa, Influenza virus
MENERTLDFH

SEQ ID NO: 357167 - protein, 10 aa, Influenza virus
ENERTLDFHD

SEQ ID NO: 357168 - protein, 10 aa, Influenza virus
NERTLDFHDS

SEQ ID NO: 357169 - protein, 10 aa, Influenza virus
ERTLDFHDSN

SEQ ID NO: 357170 - protein, 10 aa, Influenza virus
RTLDFHDSNV

SEQ ID NO: 357171 - protein, 10 aa, Influenza virus
TLDFHDSNVK

SEQ ID NO: 357172 - protein, 10 aa, Influenza virus
LDFHDSNVKN

SEQ ID NO: 357173 - protein, 10 aa, Influenza virus
DFHDSNVKNL

SEQ ID NO: 357174 - protein, 10 aa, Influenza virus
FHDSNVKNLY

SEQ ID NO: 357175 - protein, 10 aa, Influenza virus
HDSNVKNLYD

SEQ ID NO: 357176 - protein, 10 aa, Influenza virus
DSNVKNLYDK

SEQ ID NO: 357177 - protein, 10 aa, Influenza virus
SNVKNLYDKV

SEQ ID NO: 357178 - protein, 10 aa, Influenza virus
NVKNLYDKVR

SEQ ID NO: 357179 - protein, 10 aa, Influenza virus
NLYDKVRLQL

SEQ ID NO: 357180 - protein, 10 aa, Influenza virus
DNAKELGNGC

SEQ ID NO: 357181 - protein, 10 aa, Influenza virus
NAKELGNGCF

SEQ ID NO: 357182 - protein, 10 aa, Influenza virus
AKELGNGCFE

SEQ ID NO: 357183 - protein, 10 aa, Influenza virus
KELGNGCFEF

SEQ ID NO: 357184 - protein, 10 aa, Influenza virus
ELGNGCFEFY

SEQ ID NO: 357185 - protein, 10 aa, Influenza virus
LGNGCFEFYH

SEQ ID NO: 357186 - protein, 10 aa, Influenza virus
GNGCFEFYHK

SEQ ID NO: 357187 - protein, 10 aa, Influenza virus
NGCFEFYHKC

SEQ ID NO: 357188 - protein, 10 aa, Influenza virus
GCFEFYHKCD

SEQ ID NO: 357189 - protein, 10 aa, Influenza virus
ECMESVRNGT

SEQ ID NO: 357190 - protein, 10 aa, Influenza virus
CMESVRNGTY

SEQ ID NO: 357191 - protein, 10 aa, Influenza virus
ESVRNGTYDY

SEQ ID NO: 357192 - protein, 10 aa, Influenza virus
ILSIYSTVAS

SEQ ID NO: 357193 - protein, 10 aa, Influenza virus
LSIYSTVASS

SEQ ID NO: 357194 - protein, 10 aa, Influenza virus
SIYSTVASSL

SEQ ID NO: 357195 - protein, 10 aa, Influenza virus
LAIMIAGLSF

SEQ ID NO: 357196 - protein, 10 aa, Influenza virus
AIMIAGLSFW

SEQ ID NO: 357197 - protein, 10 aa, Influenza virus
IAGLSFWMCS

SEQ ID NO: 357198 - protein, 10 aa, Influenza virus
AGLSFWMCSN

SEQ ID NO: 357199 - protein, 10 aa, Influenza virus
GLSFWMCSNG

SEQ ID NO: 357200 - protein, 10 aa, Influenza virus
LSFWMCSNGS

SEQ ID NO: 357201 - protein, 10 aa, Influenza virus
SFWMCSNGSL

SEQ ID NO: 357202 - protein, 10 aa, Influenza virus
FWMCSNGSLQ

SEQ ID NO: 357203 - protein, 10 aa, Influenza virus
WMCSNGSLQC

SEQ ID NO: 357204 - protein, 10 aa, Influenza virus
MCSNGSLQCR

SEQ ID NO: 357205 - protein, 10 aa, Influenza virus
CSNGSLQCRI

SEQ ID NO: 357206 - protein, 10 aa, Influenza virus
SNGSLQCRIC

SEQ ID NO: 357207 - protein, 10 aa, Influenza virus
NGSLQCRICI

SEQ ID NO: 357208 - protein, 10 aa, Influenza virus
KPQCQITGFA

SEQ ID NO: 357209 - protein, 10 aa, Influenza virus
PQCQITGFAP

SEQ ID NO: 357210 - protein, 10 aa, Influenza virus
QCQITGFAPF

SEQ ID NO: 357211 - protein, 10 aa, Influenza virus
ITGFAPFSKD

SEQ ID NO: 357212 - protein, 10 aa, Influenza virus
TGFAPFSKDN

SEQ ID NO: 357213 - protein, 10 aa, Influenza virus
GFAPFSKDNS

SEQ ID NO: 357214 - protein, 10 aa, Influenza virus
FAPFSKDNSI

SEQ ID NO: 357215 - protein, 10 aa, Influenza virus
APFSKDNSIR

SEQ ID NO: 357216 - protein, 10 aa, Influenza virus
PFSKDNSIRL

SEQ ID NO: 357217 - protein, 10 aa, Influenza virus
FSKDNSIRLS

SEQ ID NO: 357218 - protein, 10 aa, Influenza virus
SKDNSIRLSA

SEQ ID NO: 357219 - protein, 10 aa, Influenza virus
KDNSIRLSAG

SEQ ID NO: 357220 - protein, 10 aa, Influenza virus
DNSIRLSAGG

SEQ ID NO: 357221 - protein, 10 aa, Influenza virus
IWVTREPYVS

SEQ ID NO: 357222 - protein, 10 aa, Influenza virus
WVTREPYVSC

SEQ ID NO: 357223 - protein, 10 aa, Influenza virus
VTREPYVSCD

SEQ ID NO: 357224 - protein, 10 aa, Influenza virus
KCYQFALGQG

SEQ ID NO: 357225 - protein, 10 aa, Influenza virus
CYQFALGQGT

SEQ ID NO: 357226 - protein, 10 aa, Influenza virus
YQFALGQGTT

SEQ ID NO: 357227 - protein, 10 aa, Influenza virus
QFALGQGTTL

SEQ ID NO: 357228 - protein, 10 aa, Influenza virus
FALGQGTTLD

SEQ ID NO: 357229 - protein, 10 aa, Influenza virus
KHSNGTIHDR

SEQ ID NO: 357230 - protein, 10 aa, Influenza virus
HSNGTIHDRI

SEQ ID NO: 357231 - protein, 10 aa, Influenza virus
PHRTLLMNEL

SEQ ID NO: 357232 - protein, 10 aa, Influenza virus
HRTLLMNELG

SEQ ID NO: 357233 - protein, 10 aa, Influenza virus
RTLLMNELGV

SEQ ID NO: 357234 - protein, 10 aa, Influenza virus
TLLMNELGVP

SEQ ID NO: 357235 - protein, 10 aa, Influenza virus
LLMNELGVPF

SEQ ID NO: 357236 - protein, 10 aa, Influenza virus
LMNELGVPFH

SEQ ID NO: 357237 - protein, 10 aa, Influenza virus
MNELGVPFHL

SEQ ID NO: 357238 - protein, 10 aa, Influenza virus
NELGVPFHLG

SEQ ID NO: 357239 - protein, 10 aa, Influenza virus
ELGVPFHLGT

SEQ ID NO: 357240 - protein, 10 aa, Influenza virus
LGVPFHLGTK

SEQ ID NO: 357241 - protein, 10 aa, Influenza virus
GVPFHLGTKQ

SEQ ID NO: 357242 - protein, 10 aa, Influenza virus
VPFHLGTKQV

SEQ ID NO: 357243 - protein, 10 aa, Influenza virus
PFHLGTKQVC

SEQ ID NO: 357244 - protein, 10 aa, Influenza virus
FHLGTKQVCI

SEQ ID NO: 357245 - protein, 10 aa, Influenza virus
HLGTKQVCIA

SEQ ID NO: 357246 - protein, 10 aa, Influenza virus
LGTKQVCIAW

SEQ ID NO: 357247 - protein, 10 aa, Influenza virus
GTKQVCIAWS

SEQ ID NO: 357248 - protein, 10 aa, Influenza virus
TKQVCIAWSS

SEQ ID NO: 357249 - protein, 10 aa, Influenza virus
KQVCIAWSSS

SEQ ID NO: 357250 - protein, 10 aa, Influenza virus
QVCIAWSSSS

SEQ ID NO: 357251 - protein, 10 aa, Influenza virus
VCIAWSSSSC

SEQ ID NO: 357252 - protein, 10 aa, Influenza virus
CIAWSSSSCH

SEQ ID NO: 357253 - protein, 10 aa, Influenza virus
IAWSSSSCHD

SEQ ID NO: 357254 - protein, 10 aa, Influenza virus
AWSSSSCHDG

SEQ ID NO: 357255 - protein, 10 aa, Influenza virus
WSSSSCHDGK

SEQ ID NO: 357256 - protein, 10 aa, Influenza virus
SSSSCHDGKA

SEQ ID NO: 357257 - protein, 10 aa, Influenza virus
SSSCHDGKAW

SEQ ID NO: 357258 - protein, 10 aa, Influenza virus
SSCHDGKAWL

SEQ ID NO: 357259 - protein, 10 aa, Influenza virus
SCHDGKAWLH

SEQ ID NO: 357260 - protein, 10 aa, Influenza virus
CHDGKAWLHV

SEQ ID NO: 357261 - protein, 10 aa, Influenza virus
HDGKAWLHVC

SEQ ID NO: 357262 - protein, 10 aa, Influenza virus
AWLHVCVTGD

SEQ ID NO: 357263 - protein, 10 aa, Influenza virus
WLHVCVTGDD

SEQ ID NO: 357264 - protein, 10 aa, Influenza virus
SWSQNILRTQ

SEQ ID NO: 357265 - protein, 10 aa, Influenza virus
WSQNILRTQE

SEQ ID NO: 357266 - protein, 10 aa, Influenza virus
SQNILRTQES

SEQ ID NO: 357267 - protein, 10 aa, Influenza virus
QNILRTQESE

SEQ ID NO: 357268 - protein, 10 aa, Influenza virus
NILRTQESEC

SEQ ID NO: 357269 - protein, 10 aa, Influenza virus
ILRTQESECV

SEQ ID NO: 357270 - protein, 10 aa, Influenza virus
LRTQESECVC

SEQ ID NO: 357271 - protein, 10 aa, Influenza virus
RTQESECVCI

SEQ ID NO: 357272 - protein, 10 aa, Influenza virus
TQESECVCIN

SEQ ID NO: 357273 - protein, 10 aa, Influenza virus
CTVVMTDGSA

SEQ ID NO: 357274 - protein, 10 aa, Influenza virus
TVVMTDGSAS

SEQ ID NO: 357275 - protein, 10 aa, Influenza virus
VVMTDGSASG

SEQ ID NO: 357276 - protein, 10 aa, Influenza virus
GSAQHIEECS

SEQ ID NO: 357277 - protein, 10 aa, Influenza virus
SAQHIEECSC

SEQ ID NO: 357278 - protein, 10 aa, Influenza virus
AQHIEECSCY

SEQ ID NO: 357279 - protein, 10 aa, Influenza virus
QHIEECSCYP

SEQ ID NO: 357280 - protein, 10 aa, Influenza virus
SYPNVRCVCR

SEQ ID NO: 357281 - protein, 10 aa, Influenza virus
VRCVCRDNWK

SEQ ID NO: 357282 - protein, 10 aa, Influenza virus
RCVCRDNWKG

SEQ ID NO: 357283 - protein, 10 aa, Influenza virus
CVCRDNWKGS

SEQ ID NO: 357284 - protein, 10 aa, Influenza virus
VCRDNWKGSN

SEQ ID NO: 357285 - protein, 10 aa, Influenza virus
CRDNWKGSNR

SEQ ID NO: 357286 - protein, 10 aa, Influenza virus
RDNWKGSNRP

SEQ ID NO: 357287 - protein, 10 aa, Influenza virus
DNWKGSNRPV

SEQ ID NO: 357288 - protein, 10 aa, Influenza virus
KLDINMADYS

SEQ ID NO: 357289 - protein, 10 aa, Influenza virus
SSYVCSGLVG

SEQ ID NO: 357290 - protein, 10 aa, Influenza virus
SYVCSGLVGD

SEQ ID NO: 357291 - protein, 10 aa, Influenza virus
YVCSGLVGDT

SEQ ID NO: 357292 - protein, 10 aa, Influenza virus
VCSGLVGDTP

SEQ ID NO: 357293 - protein, 10 aa, Influenza virus
CSGLVGDTPR

SEQ ID NO: 357294 - protein, 10 aa, Influenza virus
SGLVGDTPRN

SEQ ID NO: 357295 - protein, 10 aa, Influenza virus
GLVGDTPRND

SEQ ID NO: 357296 - protein, 10 aa, Influenza virus
LVGDTPRNDD

SEQ ID NO: 357297 - protein, 10 aa, Influenza virus
VGDTPRNDDS

SEQ ID NO: 357298 - protein, 10 aa, Influenza virus
SSSNCRDPNN

SEQ ID NO: 357299 - protein, 10 aa, Influenza virus
SSNCRDPNNE

SEQ ID NO: 357300 - protein, 10 aa, Influenza virus
SNCRDPNNER

SEQ ID NO: 357301 - protein, 10 aa, Influenza virus
GNPGVKGWAF

SEQ ID NO: 357302 - protein, 10 aa, Influenza virus
NPGVKGWAFD

SEQ ID NO: 357303 - protein, 10 aa, Influenza virus
SKDSRSGYET

SEQ ID NO: 357304 - protein, 10 aa, Influenza virus
KDSRSGYETF

SEQ ID NO: 357305 - protein, 10 aa, Influenza virus
DSRSGYETFR

SEQ ID NO: 357306 - protein, 10 aa, Influenza virus
SRSGYETFRV

SEQ ID NO: 357307 - protein, 10 aa, Influenza virus
RSGYETFRVI

SEQ ID NO: 357308 - protein, 10 aa, Influenza virus
NWSGYSGIFS

SEQ ID NO: 357309 - protein, 10 aa, Influenza virus
WSGYSGIFSV

SEQ ID NO: 357310 - protein, 10 aa, Influenza virus
SGYSGIFSVE

SEQ ID NO: 357311 - protein, 10 aa, Influenza virus
SCINRCFYVE

SEQ ID NO: 357312 - protein, 10 aa, Influenza virus
CINRCFYVEL

SEQ ID NO: 357313 - protein, 10 aa, Influenza virus
INRCFYVELI

SEQ ID NO: 357314 - protein, 10 aa, Influenza virus
NRCFYVELIR

SEQ ID NO: 357315 - protein, 10 aa, Influenza virus
RCFYVELIRG

SEQ ID NO: 357316 - protein, 10 aa, Influenza virus
CFYVELIRGR

SEQ ID NO: 357317 - protein, 10 aa, Influenza virus
FYVELIRGRP

SEQ ID NO: 357318 - protein, 10 aa, Influenza virus
YVELIRGRPQ

SEQ ID NO: 357319 - protein, 10 aa, Influenza virus
VELIRGRPQE

SEQ ID NO: 357320 - protein, 10 aa, Influenza virus
RVWWTSNSIV

SEQ ID NO: 357321 - protein, 10 aa, Influenza virus
VWWTSNSIVV

SEQ ID NO: 357322 - protein, 10 aa, Influenza virus
WWTSNSIVVF

SEQ ID NO: 357323 - protein, 10 aa, Influenza virus
WTSNSIVVFC

SEQ ID NO: 357324 - protein, 10 aa, Influenza virus
TSNSIVVFCG

SEQ ID NO: 357325 - protein, 10 aa, Influenza virus
SNSIVVFCGT

SEQ ID NO: 357326 - protein, 10 aa, Influenza virus
NSIVVFCGTS

SEQ ID NO: 357327 - protein, 10 aa, Influenza virus
SIVVFCGTSG

SEQ ID NO: 357328 - protein, 10 aa, Influenza virus
IVVFCGTSGT

SEQ ID NO: 357329 - protein, 10 aa, Influenza virus
VVFCGTSGTY

SEQ ID NO: 357330 - protein, 10 aa, Influenza virus
VFCGTSGTYG

SEQ ID NO: 357331 - protein, 10 aa, Influenza virus
FCGTSGTYGT

SEQ ID NO: 357332 - protein, 10 aa, Influenza virus
CGTSGTYGTG

SEQ ID NO: 357333 - protein, 10 aa, Influenza virus
GTSGTYGTGS

SEQ ID NO: 357334 - protein, 10 aa, Influenza virus
TSGTYGTGSW

SEQ ID NO: 357335 - protein, 10 aa, Influenza virus
SGTYGTGSWP

SEQ ID NO: 357336 - protein, 10 aa, Influenza virus
GTYGTGSWPD

SEQ ID NO: 357337 - protein, 10 aa, Influenza virus
TYGTGSWPDG

SEQ ID NO: 357338 - protein, 10 aa, Influenza virus
YGTGSWPDGA

SEQ ID NO: 357339 - protein, 10 aa, Influenza virus
GTGSWPDGAN

SEQ ID NO: 357340 - protein, 10 aa, Influenza virus
TGSWPDGANI

SEQ ID NO: 357341 - protein, 10 aa, Influenza virus
GSWPDGANIN

SEQ ID NO: 357342 - protein, 10 aa, Influenza virus
SWPDGANINF

SEQ ID NO: 357343 - protein, 10 aa, Influenza virus
WPDGANINFM

SEQ ID NO: 357344 - protein, 10 aa, Influenza virus
PDGANINFMP

SEQ ID NO: 357345 - protein, 10 aa, Influenza virus
KSDKICIGYH

SEQ ID NO: 357346 - protein, 10 aa, Influenza virus
SDKICIGYHA

SEQ ID NO: 357347 - protein, 10 aa, Influenza virus
DKICIGYHAN

SEQ ID NO: 357348 - protein, 10 aa, Influenza virus
KICIGYHANN

SEQ ID NO: 357349 - protein, 10 aa, Influenza virus
ICIGYHANNS

SEQ ID NO: 357350 - protein, 10 aa, Influenza virus
CIGYHANNST

SEQ ID NO: 357351 - protein, 10 aa, Influenza virus
IGYHANNSTT

SEQ ID NO: 357352 - protein, 10 aa, Influenza virus
GYHANNSTTQ

SEQ ID NO: 357353 - protein, 10 aa, Influenza virus
YHANNSTTQV

SEQ ID NO: 357354 - protein, 10 aa, Influenza virus
HANNSTTQVD

SEQ ID NO: 357355 - protein, 10 aa, Influenza virus
ANNSTTQVDT

SEQ ID NO: 357356 - protein, 10 aa, Influenza virus
NNSTTQVDTI

SEQ ID NO: 357357 - protein, 10 aa, Influenza virus
VDTILEKNVT

SEQ ID NO: 357358 - protein, 10 aa, Influenza virus
DTILEKNVTV

SEQ ID NO: 357359 - protein, 10 aa, Influenza virus
TILEKNVTVT

SEQ ID NO: 357360 - protein, 10 aa, Influenza virus
ILEKNVTVTH

SEQ ID NO: 357361 - protein, 10 aa, Influenza virus
LEKNVTVTHS

SEQ ID NO: 357362 - protein, 10 aa, Influenza virus
EKNVTVTHSV

SEQ ID NO: 357363 - protein, 10 aa, Influenza virus
KNVTVTHSVE

SEQ ID NO: 357364 - protein, 10 aa, Influenza virus
NVTVTHSVEL

SEQ ID NO: 357365 - protein, 10 aa, Influenza virus
VTVTHSVELL

SEQ ID NO: 357366 - protein, 10 aa, Influenza virus
TVTHSVELLE

SEQ ID NO: 357367 - protein, 10 aa, Influenza virus
VTHSVELLEN

SEQ ID NO: 357368 - protein, 10 aa, Influenza virus
EGWILGNPQC

SEQ ID NO: 357369 - protein, 10 aa, Influenza virus
GWILGNPQCD

SEQ ID NO: 357370 - protein, 10 aa, Influenza virus
SSFYRNLLWI

SEQ ID NO: 357371 - protein, 10 aa, Influenza virus
ILYFWGVHHP

SEQ ID NO: 357372 - protein, 10 aa, Influenza virus
WSVLKPGETL

SEQ ID NO: 357373 - protein, 10 aa, Influenza virus
LKPGETLNVE

SEQ ID NO: 357374 - protein, 10 aa, Influenza virus
KPGETLNVES

SEQ ID NO: 357375 - protein, 10 aa, Influenza virus
PGETLNVESN

SEQ ID NO: 357376 - protein, 10 aa, Influenza virus
GETLNVESNG

SEQ ID NO: 357377 - protein, 10 aa, Influenza virus
ETLNVESNGN

SEQ ID NO: 357378 - protein, 10 aa, Influenza virus
TLNVESNGNL

SEQ ID NO: 357379 - protein, 10 aa, Influenza virus
LNVESNGNLI

SEQ ID NO: 357380 - protein, 10 aa, Influenza virus
NVESNGNLIA

SEQ ID NO: 357381 - protein, 10 aa, Influenza virus
VESNGNLIAP

SEQ ID NO: 357382 - protein, 10 aa, Influenza virus
ESNGNLIAPW

SEQ ID NO: 357383 - protein, 10 aa, Influenza virus
SNGNLIAPWY

SEQ ID NO: 357384 - protein, 10 aa, Influenza virus
NGNLIAPWYA

SEQ ID NO: 357385 - protein, 10 aa, Influenza virus
GNLIAPWYAY

SEQ ID NO: 357386 - protein, 10 aa, Influenza virus
NLIAPWYAYK

SEQ ID NO: 357387 - protein, 10 aa, Influenza virus
NNNKGAVFKS

SEQ ID NO: 357388 - protein, 10 aa, Influenza virus
TNKTFQNVSP

SEQ ID NO: 357389 - protein, 10 aa, Influenza virus
NKTFQNVSPL

SEQ ID NO: 357390 - protein, 10 aa, Influenza virus
KTFQNVSPLW

SEQ ID NO: 357391 - protein, 10 aa, Influenza virus
FQNVSPLWIG

SEQ ID NO: 357392 - protein, 10 aa, Influenza virus
SLRLATGLRN

SEQ ID NO: 357393 - protein, 10 aa, Influenza virus
LRLATGLRNV

SEQ ID NO: 357394 - protein, 10 aa, Influenza virus
RLATGLRNVP

SEQ ID NO: 357395 - protein, 10 aa, Influenza virus
LATGLRNVPQ

SEQ ID NO: 357396 - protein, 10 aa, Influenza virus
TRGLFGAIAG

SEQ ID NO: 357397 - protein, 10 aa, Influenza virus
RGLFGAIAGF

SEQ ID NO: 357398 - protein, 10 aa, Influenza virus
GLFGAIAGFI

SEQ ID NO: 357399 - protein, 10 aa, Influenza virus
LFGAIAGFIE

SEQ ID NO: 357400 - protein, 10 aa, Influenza virus
FGAIAGFIEG

SEQ ID NO: 357401 - protein, 10 aa, Influenza virus
GAIAGFIEGG

SEQ ID NO: 357402 - protein, 10 aa, Influenza virus
AIAGFIEGGW

SEQ ID NO: 357403 - protein, 10 aa, Influenza virus
IAGFIEGGWT

SEQ ID NO: 357404 - protein, 10 aa, Influenza virus
AGFIEGGWTG

SEQ ID NO: 357405 - protein, 10 aa, Influenza virus
GFIEGGWTGM

SEQ ID NO: 357406 - protein, 10 aa, Influenza virus
FIEGGWTGMI

SEQ ID NO: 357407 - protein, 10 aa, Influenza virus
IEGGWTGMID

SEQ ID NO: 357408 - protein, 10 aa, Influenza virus
EGGWTGMIDG

SEQ ID NO: 357409 - protein, 10 aa, Influenza virus
GGWTGMIDGW

SEQ ID NO: 357410 - protein, 10 aa, Influenza virus
GWTGMIDGWY

SEQ ID NO: 357411 - protein, 10 aa, Influenza virus
WTGMIDGWYG

SEQ ID NO: 357412 - protein, 10 aa, Influenza virus
TGMIDGWYGY

SEQ ID NO: 357413 - protein, 10 aa, Influenza virus
GMIDGWYGYH

SEQ ID NO: 357414 - protein, 10 aa, Influenza virus
MIDGWYGYHH

SEQ ID NO: 357415 - protein, 10 aa, Influenza virus
IDGWYGYHHE

SEQ ID NO: 357416 - protein, 10 aa, Influenza virus
DGWYGYHHEN

SEQ ID NO: 357417 - protein, 10 aa, Influenza virus
GWYGYHHENS

SEQ ID NO: 357418 - protein, 10 aa, Influenza virus
WYGYHHENSQ

SEQ ID NO: 357419 - protein, 10 aa, Influenza virus
YGYHHENSQG

SEQ ID NO: 357420 - protein, 10 aa, Influenza virus
GYHHENSQGS

SEQ ID NO: 357421 - protein, 10 aa, Influenza virus
YHHENSQGSG

SEQ ID NO: 357422 - protein, 10 aa, Influenza virus
HHENSQGSGY

SEQ ID NO: 357423 - protein, 10 aa, Influenza virus
HENSQGSGYA

SEQ ID NO: 357424 - protein, 10 aa, Influenza virus
ENSQGSGYAA

SEQ ID NO: 357425 - protein, 10 aa, Influenza virus
NSQGSGYAAD

SEQ ID NO: 357426 - protein, 10 aa, Influenza virus
SQGSGYAADK

SEQ ID NO: 357427 - protein, 10 aa, Influenza virus
QGSGYAADKE

SEQ ID NO: 357428 - protein, 10 aa, Influenza virus
GSGYAADKES

SEQ ID NO: 357429 - protein, 10 aa, Influenza virus
SGYAADKEST

SEQ ID NO: 357430 - protein, 10 aa, Influenza virus
GYAADKESTQ

SEQ ID NO: 357431 - protein, 10 aa, Influenza virus
YAADKESTQK

SEQ ID NO: 357432 - protein, 10 aa, Influenza virus
AADKESTQKA

SEQ ID NO: 357433 - protein, 10 aa, Influenza virus
HEFSNLERRI

SEQ ID NO: 357434 - protein, 10 aa, Influenza virus
DGFLDVWTYN

SEQ ID NO: 357435 - protein, 10 aa, Influenza virus
GFLDVWTYNA

SEQ ID NO: 357436 - protein, 10 aa, Influenza virus
FLDVWTYNAE

SEQ ID NO: 357437 - protein, 10 aa, Influenza virus
LDVWTYNAEL

SEQ ID NO: 357438 - protein, 10 aa, Influenza virus
DVWTYNAELL

SEQ ID NO: 357439 - protein, 10 aa, Influenza virus
VWTYNAELLV

SEQ ID NO: 357440 - protein, 10 aa, Influenza virus
WTYNAELLVL

SEQ ID NO: 357441 - protein, 10 aa, Influenza virus
TYNAELLVLL

SEQ ID NO: 357442 - protein, 10 aa, Influenza virus
YNAELLVLLE

SEQ ID NO: 357443 - protein, 10 aa, Influenza virus
NAELLVLLEN

SEQ ID NO: 357444 - protein, 10 aa, Influenza virus
AELLVLLENE

SEQ ID NO: 357445 - protein, 10 aa, Influenza virus
ELLVLLENER

SEQ ID NO: 357446 - protein, 10 aa, Influenza virus
LLVLLENERT

SEQ ID NO: 357447 - protein, 10 aa, Influenza virus
LVLLENERTL

SEQ ID NO: 357448 - protein, 10 aa, Influenza virus
VLLENERTLD

SEQ ID NO: 357449 - protein, 10 aa, Influenza virus
ENERTLDLHD

SEQ ID NO: 357450 - protein, 10 aa, Influenza virus
NERTLDLHDA

SEQ ID NO: 357451 - protein, 10 aa, Influenza virus
ERTLDLHDAN

SEQ ID NO: 357452 - protein, 10 aa, Influenza virus
RTLDLHDANV

SEQ ID NO: 357453 - protein, 10 aa, Influenza virus
TLDLHDANVK

SEQ ID NO: 357454 - protein, 10 aa, Influenza virus
LRDNANDLGN

SEQ ID NO: 357455 - protein, 10 aa, Influenza virus
RDNANDLGNG

SEQ ID NO: 357456 - protein, 10 aa, Influenza virus
DNANDLGNGC

SEQ ID NO: 357457 - protein, 10 aa, Influenza virus
NANDLGNGCF

SEQ ID NO: 357458 - protein, 10 aa, Influenza virus
ANDLGNGCFE

SEQ ID NO: 357459 - protein, 10 aa, Influenza virus
NDLGNGCFEF

SEQ ID NO: 357460 - protein, 10 aa, Influenza virus
DLGNGCFEFW

SEQ ID NO: 357461 - protein, 10 aa, Influenza virus
LGNGCFEFWH

SEQ ID NO: 357462 - protein, 10 aa, Influenza virus
GNGCFEFWHK

SEQ ID NO: 357463 - protein, 10 aa, Influenza virus
NGCFEFWHKC

SEQ ID NO: 357464 - protein, 10 aa, Influenza virus
GCFEFWHKCD

SEQ ID NO: 357465 - protein, 10 aa, Influenza virus
CFEFWHKCDN

SEQ ID NO: 357466 - protein, 10 aa, Influenza virus
FEFWHKCDNE

SEQ ID NO: 357467 - protein, 10 aa, Influenza virus
EFWHKCDNEC

SEQ ID NO: 357468 - protein, 10 aa, Influenza virus
KNGTYDYPKY

SEQ ID NO: 357469 - protein, 10 aa, Influenza virus
NGTYDYPKYQ

SEQ ID NO: 357470 - protein, 10 aa, Influenza virus
GVYQILAIYS

SEQ ID NO: 357471 - protein, 10 aa, Influenza virus
VYQILAIYST

SEQ ID NO: 357472 - protein, 10 aa, Influenza virus
YQILAIYSTV

SEQ ID NO: 357473 - protein, 10 aa, Influenza virus
QILAIYSTVS

SEQ ID NO: 357474 - protein, 10 aa, Influenza virus
ILAIYSTVSS

SEQ ID NO: 357475 - protein, 10 aa, Influenza virus
LAIYSTVSSS

SEQ ID NO: 357476 - protein, 10 aa, Influenza virus
AIYSTVSSSL

SEQ ID NO: 357477 - protein, 10 aa, Influenza virus
IYSTVSSSLV

SEQ ID NO: 357478 - protein, 10 aa, Influenza virus
YSTVSSSLVL

SEQ ID NO: 357479 - protein, 10 aa, Influenza virus
STVSSSLVLV

SEQ ID NO: 357480 - protein, 10 aa, Influenza virus
TVSSSLVLVG

SEQ ID NO: 357481 - protein, 10 aa, Influenza virus
VSSSLVLVGL

SEQ ID NO: 357482 - protein, 10 aa, Influenza virus
SSSLVLVGLI

SEQ ID NO: 357483 - protein, 10 aa, Influenza virus
WMCSNGSMQC

SEQ ID NO: 357484 - protein, 10 aa, Influenza virus
MCSNGSMQCR

SEQ ID NO: 357485 - protein, 10 aa, Influenza virus
NGSMQCRICI

SEQ ID NO: 357486 - protein, 10 aa, Influenza virus
GSMQCRICIG

SEQ ID NO: 357487 - protein, 10 aa, Influenza virus
SMQCRICIGS

SEQ ID NO: 357488 - protein, 10 aa, Influenza virus
SKSRGYKMNT

SEQ ID NO: 357489 - protein, 10 aa, Influenza virus
KSRGYKMNTQ

SEQ ID NO: 357490 - protein, 10 aa, Influenza virus
SRGYKMNTQI

SEQ ID NO: 357491 - protein, 10 aa, Influenza virus
RGYKMNTQIL

SEQ ID NO: 357492 - protein, 10 aa, Influenza virus
GCDHSDNADK

SEQ ID NO: 357493 - protein, 10 aa, Influenza virus
CDHSDNADKI

SEQ ID NO: 357494 - protein, 10 aa, Influenza virus
DHSDNADKIC

SEQ ID NO: 357495 - protein, 10 aa, Influenza virus
HSDNADKICL

SEQ ID NO: 357496 - protein, 10 aa, Influenza virus
SDNADKICLG

SEQ ID NO: 357497 - protein, 10 aa, Influenza virus
DNADKICLGH

SEQ ID NO: 357498 - protein, 10 aa, Influenza virus
GDKICLGHHA

SEQ ID NO: 357499 - protein, 10 aa, Influenza virus
DKICLGHHAV

SEQ ID NO: 357500 - protein, 10 aa, Influenza virus
TLTERGIEVV

SEQ ID NO: 357501 - protein, 10 aa, Influenza virus
LTERGIEVVN

SEQ ID NO: 357502 - protein, 10 aa, Influenza virus
TERGIEVVNA

SEQ ID NO: 357503 - protein, 10 aa, Influenza virus
ERGIEVVNAT

SEQ ID NO: 357504 - protein, 10 aa, Influenza virus
RGIEVVNATE

SEQ ID NO: 357505 - protein, 10 aa, Influenza virus
GIEVVNATET

SEQ ID NO: 357506 - protein, 10 aa, Influenza virus
IEVVNATETV

SEQ ID NO: 357507 - protein, 10 aa, Influenza virus
EVVNATETVE

SEQ ID NO: 357508 - protein, 10 aa, Influenza virus
VVNATETVET

SEQ ID NO: 357509 - protein, 10 aa, Influenza virus
GPPQCDQFLE

SEQ ID NO: 357510 - protein, 10 aa, Influenza virus
PPQCDQFLEF

SEQ ID NO: 357511 - protein, 10 aa, Influenza virus
SSSFYAEMKW

SEQ ID NO: 357512 - protein, 10 aa, Influenza virus
SSFYAEMKWL

SEQ ID NO: 357513 - protein, 10 aa, Influenza virus
SFYAEMKWLL

SEQ ID NO: 357514 - protein, 10 aa, Influenza virus
FYAEMKWLLS

SEQ ID NO: 357515 - protein, 10 aa, Influenza virus
YAEMKWLLSN

SEQ ID NO: 357516 - protein, 10 aa, Influenza virus
GQSGRIDFHW

SEQ ID NO: 357517 - protein, 10 aa, Influenza virus
FTFNGAFIAP

SEQ ID NO: 357518 - protein, 10 aa, Influenza virus
FNGAFIAPDR

SEQ ID NO: 357519 - protein, 10 aa, Influenza virus
NGAFIAPDRA

SEQ ID NO: 357520 - protein, 10 aa, Influenza virus
GAFIAPDRAS

SEQ ID NO: 357521 - protein, 10 aa, Influenza virus
AFIAPDRASF

SEQ ID NO: 357522 - protein, 10 aa, Influenza virus
SLLLATGMRN

SEQ ID NO: 357523 - protein, 10 aa, Influenza virus
LLLATGMRNV

SEQ ID NO: 357524 - protein, 10 aa, Influenza virus
LLATGMRNVP

SEQ ID NO: 357525 - protein, 10 aa, Influenza virus
LATGMRNVPE

SEQ ID NO: 357526 - protein, 10 aa, Influenza virus
THKQLTHHMR

SEQ ID NO: 357527 - protein, 10 aa, Influenza virus
HKQLTHHMRK

SEQ ID NO: 357528 - protein, 10 aa, Influenza virus
KQLTHHMRKK

SEQ ID NO: 357529 - protein, 10 aa, Influenza virus
QLTHHMRKKR

SEQ ID NO: 357530 - protein, 10 aa, Influenza virus
LTHHMRKKRG

SEQ ID NO: 357531 - protein, 10 aa, Influenza virus
THHMRKKRGL

SEQ ID NO: 357532 - protein, 10 aa, Influenza virus
HHMRKKRGLF

SEQ ID NO: 357533 - protein, 10 aa, Influenza virus
HMRKKRGLFG

SEQ ID NO: 357534 - protein, 10 aa, Influenza virus
MRKKRGLFGA

SEQ ID NO: 357535 - protein, 10 aa, Influenza virus
RKKRGLFGAI

SEQ ID NO: 357536 - protein, 10 aa, Influenza virus
RETRGLFGAI

SEQ ID NO: 357537 - protein, 10 aa, Influenza virus
MTRGLFGAIA

SEQ ID NO: 357538 - protein, 10 aa, Influenza virus
PRGLFGAIAG

SEQ ID NO: 357539 - protein, 10 aa, Influenza virus
TKPRPRRGLF

SEQ ID NO: 357540 - protein, 10 aa, Influenza virus
KPRPRRGLFG

SEQ ID NO: 357541 - protein, 10 aa, Influenza virus
PRPRRGLFGA

SEQ ID NO: 357542 - protein, 10 aa, Influenza virus
RPRRGLFGAI

SEQ ID NO: 357543 - protein, 10 aa, Influenza virus
PRRGLFGAIA

SEQ ID NO: 357544 - protein, 10 aa, Influenza virus
RRGLFGAIAG

SEQ ID NO: 357545 - protein, 10 aa, Influenza virus
RGLFGAIAGF

SEQ ID NO: 357546 - protein, 10 aa, Influenza virus
GLFGAIAGFI

SEQ ID NO: 357547 - protein, 10 aa, Influenza virus
LFGAIAGFIE

SEQ ID NO: 357548 - protein, 10 aa, Influenza virus
FGAIAGFIEN

SEQ ID NO: 357549 - protein, 10 aa, Influenza virus
GAIAGFIENG

SEQ ID NO: 357550 - protein, 10 aa, Influenza virus
AIAGFIENGW

SEQ ID NO: 357551 - protein, 10 aa, Influenza virus
IAGFIENGWE

SEQ ID NO: 357552 - protein, 10 aa, Influenza virus
AGFIENGWEG

SEQ ID NO: 357553 - protein, 10 aa, Influenza virus
GFIENGWEGL

SEQ ID NO: 357554 - protein, 10 aa, Influenza virus
FIENGWEGLI

SEQ ID NO: 357555 - protein, 10 aa, Influenza virus
IENGWEGLID

SEQ ID NO: 357556 - protein, 10 aa, Influenza virus
ENGWEGLIDG

SEQ ID NO: 357557 - protein, 10 aa, Influenza virus
NGWEGLIDGW

SEQ ID NO: 357558 - protein, 10 aa, Influenza virus
GWEGLIDGWY

SEQ ID NO: 357559 - protein, 10 aa, Influenza virus
WEGLIDGWYG

SEQ ID NO: 357560 - protein, 10 aa, Influenza virus
EGLIDGWYGF

SEQ ID NO: 357561 - protein, 10 aa, Influenza virus
GLIDGWYGFR

SEQ ID NO: 357562 - protein, 10 aa, Influenza virus
LIDGWYGFRH

SEQ ID NO: 357563 - protein, 10 aa, Influenza virus
IDGWYGFRHQ

SEQ ID NO: 357564 - protein, 10 aa, Influenza virus
DGWYGFRHQN

SEQ ID NO: 357565 - protein, 10 aa, Influenza virus
GWYGFRHQNA

SEQ ID NO: 357566 - protein, 10 aa, Influenza virus
WYGFRHQNAQ

SEQ ID NO: 357567 - protein, 10 aa, Influenza virus
YGFRHQNAQG

SEQ ID NO: 357568 - protein, 10 aa, Influenza virus
GFRHQNAQGE

SEQ ID NO: 357569 - protein, 10 aa, Influenza virus
FRHQNAQGEG

SEQ ID NO: 357570 - protein, 10 aa, Influenza virus
RHQNAQGEGT

SEQ ID NO: 357571 - protein, 10 aa, Influenza virus
HQNAQGEGTA

SEQ ID NO: 357572 - protein, 10 aa, Influenza virus
QNAQGEGTAA

SEQ ID NO: 357573 - protein, 10 aa, Influenza virus
NAQGEGTAAD

SEQ ID NO: 357574 - protein, 10 aa, Influenza virus
AQGEGTAADY

SEQ ID NO: 357575 - protein, 10 aa, Influenza virus
QGEGTAADYK

SEQ ID NO: 357576 - protein, 10 aa, Influenza virus
GEGTAADYKS

SEQ ID NO: 357577 - protein, 10 aa, Influenza virus
EGTAADYKST

SEQ ID NO: 357578 - protein, 10 aa, Influenza virus
GTAADYKSTQ

SEQ ID NO: 357579 - protein, 10 aa, Influenza virus
TAADYKSTQS

SEQ ID NO: 357580 - protein, 10 aa, Influenza virus
AADYKSTQSA

SEQ ID NO: 357581 - protein, 10 aa, Influenza virus
ADYKSTQSAI

SEQ ID NO: 357582 - protein, 10 aa, Influenza virus
DYKSTQSAID

SEQ ID NO: 357583 - protein, 10 aa, Influenza virus
YKSTQSAIDQ

SEQ ID NO: 357584 - protein, 10 aa, Influenza virus
KSTQSAIDQI

SEQ ID NO: 357585 - protein, 10 aa, Influenza virus
STQSAIDQIT

SEQ ID NO: 357586 - protein, 10 aa, Influenza virus
TQSAIDQITG

SEQ ID NO: 357587 - protein, 10 aa, Influenza virus
QSAIDQITGK

SEQ ID NO: 357588 - protein, 10 aa, Influenza virus
SAIDQITGKL

SEQ ID NO: 357589 - protein, 10 aa, Influenza virus
AIDQITGKLN

SEQ ID NO: 357590 - protein, 10 aa, Influenza virus
IDQITGKLNR

SEQ ID NO: 357591 - protein, 10 aa, Influenza virus
DQITGKLNRL

SEQ ID NO: 357592 - protein, 10 aa, Influenza virus
QITGKLNRLI

SEQ ID NO: 357593 - protein, 10 aa, Influenza virus
EQQIGNVINW

SEQ ID NO: 357594 - protein, 10 aa, Influenza virus
QQIGNVINWT

SEQ ID NO: 357595 - protein, 10 aa, Influenza virus
QIGNVINWTR

SEQ ID NO: 357596 - protein, 10 aa, Influenza virus
IGNVINWTRD

SEQ ID NO: 357597 - protein, 10 aa, Influenza virus
GNVINWTRDS

SEQ ID NO: 357598 - protein, 10 aa, Influenza virus
WSYNAELLVA

SEQ ID NO: 357599 - protein, 10 aa, Influenza virus
AELLVAMENQ

SEQ ID NO: 357600 - protein, 10 aa, Influenza virus
ELLVAMENQH

SEQ ID NO: 357601 - protein, 10 aa, Influenza virus
LLVAMENQHT

SEQ ID NO: 357602 - protein, 10 aa, Influenza virus
LVAMENQHTI

SEQ ID NO: 357603 - protein, 10 aa, Influenza virus
VAMENQHTID

SEQ ID NO: 357604 - protein, 10 aa, Influenza virus
AMENQHTIDL

SEQ ID NO: 357605 - protein, 10 aa, Influenza virus
MENQHTIDLA

SEQ ID NO: 357606 - protein, 10 aa, Influenza virus
ENQHTIDLAD

SEQ ID NO: 357607 - protein, 10 aa, Influenza virus
NQHTIDLADS

SEQ ID NO: 357608 - protein, 10 aa, Influenza virus
QHTIDLADSE

SEQ ID NO: 357609 - protein, 10 aa, Influenza virus
HTIDLADSEM

SEQ ID NO: 357610 - protein, 10 aa, Influenza virus
SEMNKLYERV

SEQ ID NO: 357611 - protein, 10 aa, Influenza virus
VRKQLRENAE

SEQ ID NO: 357612 - protein, 10 aa, Influenza virus
RKQLRENAEE

SEQ ID NO: 357613 - protein, 10 aa, Influenza virus
KQLRENAEED

SEQ ID NO: 357614 - protein, 10 aa, Influenza virus
QLRENAEEDG

SEQ ID NO: 357615 - protein, 10 aa, Influenza virus
LRENAEEDGT

SEQ ID NO: 357616 - protein, 10 aa, Influenza virus
RENAEEDGTG

SEQ ID NO: 357617 - protein, 10 aa, Influenza virus
ENAEEDGTGC

SEQ ID NO: 357618 - protein, 10 aa, Influenza virus
NAEEDGTGCF

SEQ ID NO: 357619 - protein, 10 aa, Influenza virus
AEEDGTGCFE

SEQ ID NO: 357620 - protein, 10 aa, Influenza virus
EEDGTGCFEI

SEQ ID NO: 357621 - protein, 10 aa, Influenza virus
EDGTGCFEIF

SEQ ID NO: 357622 - protein, 10 aa, Influenza virus
DGTGCFEIFH

SEQ ID NO: 357623 - protein, 10 aa, Influenza virus
GTGCFEIFHK

SEQ ID NO: 357624 - protein, 10 aa, Influenza virus
TGCFEIFHKC

SEQ ID NO: 357625 - protein, 10 aa, Influenza virus
GCFEIFHKCD

SEQ ID NO: 357626 - protein, 10 aa, Influenza virus
CFEIFHKCDD

SEQ ID NO: 357627 - protein, 10 aa, Influenza virus
CMESIRNNTY

SEQ ID NO: 357628 - protein, 10 aa, Influenza virus
MESIRNNTYD

SEQ ID NO: 357629 - protein, 10 aa, Influenza virus
ESIRNNTYDH

SEQ ID NO: 357630 - protein, 10 aa, Influenza virus
SGYKDIILWF

SEQ ID NO: 357631 - protein, 10 aa, Influenza virus
GYKDIILWFS

SEQ ID NO: 357632 - protein, 10 aa, Influenza virus
YKDIILWFSF

SEQ ID NO: 357633 - protein, 10 aa, Influenza virus
KDIILWFSFG

SEQ ID NO: 357634 - protein, 10 aa, Influenza virus
DIILWFSFGA

SEQ ID NO: 357635 - protein, 10 aa, Influenza virus
IILWFSFGAS

SEQ ID NO: 357636 - protein, 10 aa, Influenza virus
ILWFSFGASC

SEQ ID NO: 357637 - protein, 10 aa, Influenza virus
LWFSFGASCF

SEQ ID NO: 357638 - protein, 10 aa, Influenza virus
WFSFGASCFL

SEQ ID NO: 357639 - protein, 10 aa, Influenza virus
FSFGASCFLL

SEQ ID NO: 357640 - protein, 10 aa, Influenza virus
KNGNMRCTIC

SEQ ID NO: 357641 - protein, 10 aa, Influenza virus
NGNMRCTICI

SEQ ID NO: 357642 - protein, 10 aa, Influenza virus
ETCSALFVYS

SEQ ID NO: 357643 - protein, 10 aa, Influenza virus
TCSALFVYSL

SEQ ID NO: 357644 - protein, 10 aa, Influenza virus
CSALFVYSLR

SEQ ID NO: 357645 - protein, 10 aa, Influenza virus
SALFVYSLRK

SEQ ID NO: 357646 - protein, 10 aa, Influenza virus
SKSRGYKMNT

SEQ ID NO: 357647 - protein, 10 aa, Influenza virus
KSRGYKMNTQ

SEQ ID NO: 357648 - protein, 10 aa, Influenza virus
SRGYKMNTQI

SEQ ID NO: 357649 - protein, 10 aa, Influenza virus
RGYKMNTQIL

SEQ ID NO: 357650 - protein, 10 aa, Influenza virus
GYKMNTQILI

SEQ ID NO: 357651 - protein, 10 aa, Influenza virus
YKMNTQILIL

SEQ ID NO: 357652 - protein, 10 aa, Influenza virus
KMNTQILILA

SEQ ID NO: 357653 - protein, 10 aa, Influenza virus
AKGDKICLGH

SEQ ID NO: 357654 - protein, 10 aa, Influenza virus
KGDKICLGHH

SEQ ID NO: 357655 - protein, 10 aa, Influenza virus
GDKICLGHHA

SEQ ID NO: 357656 - protein, 10 aa, Influenza virus
DKICLGHHAV

SEQ ID NO: 357657 - protein, 10 aa, Influenza virus
KICLGHHAVA

SEQ ID NO: 357658 - protein, 10 aa, Influenza virus
ICLGHHAVAN

SEQ ID NO: 357659 - protein, 10 aa, Influenza virus
CLGHHAVANG

SEQ ID NO: 357660 - protein, 10 aa, Influenza virus
LGHHAVANGT

SEQ ID NO: 357661 - protein, 10 aa, Influenza virus
GHHAVANGTK

SEQ ID NO: 357662 - protein, 10 aa, Influenza virus
HHAVANGTKV

SEQ ID NO: 357663 - protein, 10 aa, Influenza virus
HAVANGTKVN

SEQ ID NO: 357664 - protein, 10 aa, Influenza virus
AVANGTKVNT

SEQ ID NO: 357665 - protein, 10 aa, Influenza virus
VANGTKVNTL

SEQ ID NO: 357666 - protein, 10 aa, Influenza virus
ANGTKVNTLT

SEQ ID NO: 357667 - protein, 10 aa, Influenza virus
NGTKVNTLTE

SEQ ID NO: 357668 - protein, 10 aa, Influenza virus
GTKVNTLTER

SEQ ID NO: 357669 - protein, 10 aa, Influenza virus
TKVNTLTERG

SEQ ID NO: 357670 - protein, 10 aa, Influenza virus
KVNTLTERGI

SEQ ID NO: 357671 - protein, 10 aa, Influenza virus
VNTLTERGIE

SEQ ID NO: 357672 - protein, 10 aa, Influenza virus
NTLTERGIEV

SEQ ID NO: 357673 - protein, 10 aa, Influenza virus
TLTERGIEVV

SEQ ID NO: 357674 - protein, 10 aa, Influenza virus
LTERGIEVVN

SEQ ID NO: 357675 - protein, 10 aa, Influenza virus
TERGIEVVNA

SEQ ID NO: 357676 - protein, 10 aa, Influenza virus
ERGIEVVNAT

SEQ ID NO: 357677 - protein, 10 aa, Influenza virus
RGIEVVNATE

SEQ ID NO: 357678 - protein, 10 aa, Influenza virus
GIEVVNATET

SEQ ID NO: 357679 - protein, 10 aa, Influenza virus
IEVVNATETV

SEQ ID NO: 357680 - protein, 10 aa, Influenza virus
EVVNATETVE

SEQ ID NO: 357681 - protein, 10 aa, Influenza virus
VVNATETVET

SEQ ID NO: 357682 - protein, 10 aa, Influenza virus
VNATETVETA

SEQ ID NO: 357683 - protein, 10 aa, Influenza virus
DLGQCGLLGT

SEQ ID NO: 357684 - protein, 10 aa, Influenza virus
CGLLGTLIGP

SEQ ID NO: 357685 - protein, 10 aa, Influenza virus
GLLGTLIGPP

SEQ ID NO: 357686 - protein, 10 aa, Influenza virus
IGPPQCDQFL

SEQ ID NO: 357687 - protein, 10 aa, Influenza virus
GPPQCDQFLE

SEQ ID NO: 357688 - protein, 10 aa, Influenza virus
PPQCDQFLEF

SEQ ID NO: 357689 - protein, 10 aa, Influenza virus
SDLIIERREG

SEQ ID NO: 357690 - protein, 10 aa, Influenza virus
DLIIERREGT

SEQ ID NO: 357691 - protein, 10 aa, Influenza virus
LIIERREGTD

SEQ ID NO: 357692 - protein, 10 aa, Influenza virus
CYPGKFTNEE

SEQ ID NO: 357693 - protein, 10 aa, Influenza virus
FTNEESLRQI

SEQ ID NO: 357694 - protein, 10 aa, Influenza virus
NEESLRQILR

SEQ ID NO: 357695 - protein, 10 aa, Influenza virus
LRQILRRSGG

SEQ ID NO: 357696 - protein, 10 aa, Influenza virus
RQILRRSGGI

SEQ ID NO: 357697 - protein, 10 aa, Influenza virus
GFTYSGIRTN

SEQ ID NO: 357698 - protein, 10 aa, Influenza virus
FTYSGIRTNG

SEQ ID NO: 357699 - protein, 10 aa, Influenza virus
TYSGIRTNGA

SEQ ID NO: 357700 - protein, 10 aa, Influenza virus
RSGSSFYAEM

SEQ ID NO: 357701 - protein, 10 aa, Influenza virus
SGSSFYAEMK

SEQ ID NO: 357702 - protein, 10 aa, Influenza virus
GSSFYAEMKW

SEQ ID NO: 357703 - protein, 10 aa, Influenza virus
SSFYAEMKWL

SEQ ID NO: 357704 - protein, 10 aa, Influenza virus
SFYAEMKWLL

SEQ ID NO: 357705 - protein, 10 aa, Influenza virus
FYAEMKWLLS

SEQ ID NO: 357706 - protein, 10 aa, Influenza virus
YAEMKWLLSN

SEQ ID NO: 357707 - protein, 10 aa, Influenza virus
AEMKWLLSNS

SEQ ID NO: 357708 - protein, 10 aa, Influenza virus
EMKWLLSNSD

SEQ ID NO: 357709 - protein, 10 aa, Influenza virus
MKWLLSNSDN

SEQ ID NO: 357710 - protein, 10 aa, Influenza virus
ALIIWGVHHS

SEQ ID NO: 357711 - protein, 10 aa, Influenza virus
EQTKLYGSGN

SEQ ID NO: 357712 - protein, 10 aa, Influenza virus
QTKLYGSGNK

SEQ ID NO: 357713 - protein, 10 aa, Influenza virus
TKLYGSGNKL

SEQ ID NO: 357714 - protein, 10 aa, Influenza virus
KLYGSGNKLI

SEQ ID NO: 357715 - protein, 10 aa, Influenza virus
PGARRIDFHW

SEQ ID NO: 357716 - protein, 10 aa, Influenza virus
GARRIDFHWL

SEQ ID NO: 357717 - protein, 10 aa, Influenza virus
ARRIDFHWLL

SEQ ID NO: 357718 - protein, 10 aa, Influenza virus
RRIDFHWLLL

SEQ ID NO: 357719 - protein, 10 aa, Influenza virus
PQVNGQSGRI

SEQ ID NO: 357720 - protein, 10 aa, Influenza virus
QVNGQSGRID

SEQ ID NO: 357721 - protein, 10 aa, Influenza virus
VNGQSGRIDF

SEQ ID NO: 357722 - protein, 10 aa, Influenza virus
NGQSGRIDFH

SEQ ID NO: 357723 - protein, 10 aa, Influenza virus
GQSGRIDFHW

SEQ ID NO: 357724 - protein, 10 aa, Influenza virus
QSGRIDFHWL

SEQ ID NO: 357725 - protein, 10 aa, Influenza virus
SGRIDFHWLL

SEQ ID NO: 357726 - protein, 10 aa, Influenza virus
GRIDFHWLLL

SEQ ID NO: 357727 - protein, 10 aa, Influenza virus
NDTVTFTFNG

SEQ ID NO: 357728 - protein, 10 aa, Influenza virus
DTVTFTFNGA

SEQ ID NO: 357729 - protein, 10 aa, Influenza virus
TVTFTFNGAF

SEQ ID NO: 357730 - protein, 10 aa, Influenza virus
VTFTFNGAFI

SEQ ID NO: 357731 - protein, 10 aa, Influenza virus
TFTFNGAFIA

SEQ ID NO: 357732 - protein, 10 aa, Influenza virus
FTFNGAFIAP

SEQ ID NO: 357733 - protein, 10 aa, Influenza virus
TFNGAFIAPD

SEQ ID NO: 357734 - protein, 10 aa, Influenza virus
FNGAFIAPDR

SEQ ID NO: 357735 - protein, 10 aa, Influenza virus
NGAFIAPDRA

SEQ ID NO: 357736 - protein, 10 aa, Influenza virus
GAFIAPDRAS

SEQ ID NO: 357737 - protein, 10 aa, Influenza virus
AFIAPDRASF

SEQ ID NO: 357738 - protein, 10 aa, Influenza virus
FIAPDRASFF

SEQ ID NO: 357739 - protein, 10 aa, Influenza virus
IAPDRASFFR

SEQ ID NO: 357740 - protein, 10 aa, Influenza virus
APDRASFFRG

SEQ ID NO: 357741 - protein, 10 aa, Influenza virus
GGTIVSSLPF

SEQ ID NO: 357742 - protein, 10 aa, Influenza virus
GTIVSSLPFQ

SEQ ID NO: 357743 - protein, 10 aa, Influenza virus
TIVSSLPFQN

SEQ ID NO: 357744 - protein, 10 aa, Influenza virus
IVSSLPFQNI

SEQ ID NO: 357745 - protein, 10 aa, Influenza virus
VSSLPFQNIN

SEQ ID NO: 357746 - protein, 10 aa, Influenza virus
SSLPFQNINP

SEQ ID NO: 357747 - protein, 10 aa, Influenza virus
TVGKCPRYVK

SEQ ID NO: 357748 - protein, 10 aa, Influenza virus
VGKCPRYVKQ

SEQ ID NO: 357749 - protein, 10 aa, Influenza virus
VKQKSLLLAT

SEQ ID NO: 357750 - protein, 10 aa, Influenza virus
KQKSLLLATG

SEQ ID NO: 357751 - protein, 10 aa, Influenza virus
QKSLLLATGM

SEQ ID NO: 357752 - protein, 10 aa, Influenza virus
KSLLLATGMR

SEQ ID NO: 357753 - protein, 10 aa, Influenza virus
SLLLATGMRN

SEQ ID NO: 357754 - protein, 10 aa, Influenza virus
LLLATGMRNV

SEQ ID NO: 357755 - protein, 10 aa, Influenza virus
LLATGMRNVP

SEQ ID NO: 357756 - protein, 10 aa, Influenza virus
LATGMRNVPE

SEQ ID NO: 357757 - protein, 10 aa, Influenza virus
ATGMRNVPEK

SEQ ID NO: 357758 - protein, 10 aa, Influenza virus
TGMRNVPEKP

SEQ ID NO: 357759 - protein, 10 aa, Influenza virus
GMRNVPEKPK

SEQ ID NO: 357760 - protein, 10 aa, Influenza virus
PKPRGLFGAI

SEQ ID NO: 357761 - protein, 10 aa, Influenza virus
KPRGLFGAIA

SEQ ID NO: 357762 - protein, 10 aa, Influenza virus
PRGLFGAIAG

SEQ ID NO: 357763 - protein, 10 aa, Influenza virus
RGLFGAIAGF

SEQ ID NO: 357764 - protein, 10 aa, Influenza virus
GLFGAIAGFI

SEQ ID NO: 357765 - protein, 10 aa, Influenza virus
LFGAIAGFIE

SEQ ID NO: 357766 - protein, 10 aa, Influenza virus
FGAIAGFIEN

SEQ ID NO: 357767 - protein, 10 aa, Influenza virus
GAIAGFIENG

SEQ ID NO: 357768 - protein, 10 aa, Influenza virus
AIAGFIENGW

SEQ ID NO: 357769 - protein, 10 aa, Influenza virus
IAGFIENGWE

SEQ ID NO: 357770 - protein, 10 aa, Influenza virus
AGFIENGWEG

SEQ ID NO: 357771 - protein, 10 aa, Influenza virus
GFIENGWEGL

SEQ ID NO: 357772 - protein, 10 aa, Influenza virus
FIENGWEGLI

SEQ ID NO: 357773 - protein, 10 aa, Influenza virus
IENGWEGLIN

SEQ ID NO: 357774 - protein, 10 aa, Influenza virus
ENGWEGLING

SEQ ID NO: 357775 - protein, 10 aa, Influenza virus
NGWEGLINGW

SEQ ID NO: 357776 - protein, 10 aa, Influenza virus
GWEGLINGWY

SEQ ID NO: 357777 - protein, 10 aa, Influenza virus
WEGLINGWYG

SEQ ID NO: 357778 - protein, 10 aa, Influenza virus
EGLINGWYGF

SEQ ID NO: 357779 - protein, 10 aa, Influenza virus
GLINGWYGFR

SEQ ID NO: 357780 - protein, 10 aa, Influenza virus
LINGWYGFRH

SEQ ID NO: 357781 - protein, 10 aa, Influenza virus
INGWYGFRHQ

SEQ ID NO: 357782 - protein, 10 aa, Influenza virus
NGWYGFRHQN

SEQ ID NO: 357783 - protein, 10 aa, Influenza virus
GWYGFRHQNA

SEQ ID NO: 357784 - protein, 10 aa, Influenza virus
WYGFRHQNAQ

SEQ ID NO: 357785 - protein, 10 aa, Influenza virus
YGFRHQNAQG

SEQ ID NO: 357786 - protein, 10 aa, Influenza virus
GFRHQNAQGE

SEQ ID NO: 357787 - protein, 10 aa, Influenza virus
FRHQNAQGEG

SEQ ID NO: 357788 - protein, 10 aa, Influenza virus
RHQNAQGEGT

SEQ ID NO: 357789 - protein, 10 aa, Influenza virus
HQNAQGEGTA

SEQ ID NO: 357790 - protein, 10 aa, Influenza virus
QNAQGEGTAA

SEQ ID NO: 357791 - protein, 10 aa, Influenza virus
NAQGEGTAAD

SEQ ID NO: 357792 - protein, 10 aa, Influenza virus
AQGEGTAADY

SEQ ID NO: 357793 - protein, 10 aa, Influenza virus
QGEGTAADYK

SEQ ID NO: 357794 - protein, 10 aa, Influenza virus
GEGTAADYKS

SEQ ID NO: 357795 - protein, 10 aa, Influenza virus
EGTAADYKST

SEQ ID NO: 357796 - protein, 10 aa, Influenza virus
GTAADYKSTQ

SEQ ID NO: 357797 - protein, 10 aa, Influenza virus
TAADYKSTQS

SEQ ID NO: 357798 - protein, 10 aa, Influenza virus
AADYKSTQSA

SEQ ID NO: 357799 - protein, 10 aa, Influenza virus
ADYKSTQSAI

SEQ ID NO: 357800 - protein, 10 aa, Influenza virus
DYKSTQSAID

SEQ ID NO: 357801 - protein, 10 aa, Influenza virus
YKSTQSAIDQ

SEQ ID NO: 357802 - protein, 10 aa, Influenza virus
KSTQSAIDQI

SEQ ID NO: 357803 - protein, 10 aa, Influenza virus
STQSAIDQIT

SEQ ID NO: 357804 - protein, 10 aa, Influenza virus
TQSAIDQITG

SEQ ID NO: 357805 - protein, 10 aa, Influenza virus
QSAIDQITGK

SEQ ID NO: 357806 - protein, 10 aa, Influenza virus
SAIDQITGKL

SEQ ID NO: 357807 - protein, 10 aa, Influenza virus
AIDQITGKLN

SEQ ID NO: 357808 - protein, 10 aa, Influenza virus
IDQITGKLNR

SEQ ID NO: 357809 - protein, 10 aa, Influenza virus
DQITGKLNRL

SEQ ID NO: 357810 - protein, 10 aa, Influenza virus
QITGKLNRLI

SEQ ID NO: 357811 - protein, 10 aa, Influenza virus
ITGKLNRLIG

SEQ ID NO: 357812 - protein, 10 aa, Influenza virus
TGKLNRLIGK

SEQ ID NO: 357813 - protein, 10 aa, Influenza virus
GKLNRLIGKT

SEQ ID NO: 357814 - protein, 10 aa, Influenza virus
KLNRLIGKTN

SEQ ID NO: 357815 - protein, 10 aa, Influenza virus
LNRLIGKTNQ

SEQ ID NO: 357816 - protein, 10 aa, Influenza virus
NRLIGKTNQQ

SEQ ID NO: 357817 - protein, 10 aa, Influenza virus
RLIGKTNQQF

SEQ ID NO: 357818 - protein, 10 aa, Influenza virus
LIGKTNQQFE

SEQ ID NO: 357819 - protein, 10 aa, Influenza virus
IGKTNQQFEL

SEQ ID NO: 357820 - protein, 10 aa, Influenza virus
GKTNQQFELI

SEQ ID NO: 357821 - protein, 10 aa, Influenza virus
KTNQQFELID

SEQ ID NO: 357822 - protein, 10 aa, Influenza virus
TNQQFELIDN

SEQ ID NO: 357823 - protein, 10 aa, Influenza virus
NQQFELIDNE

SEQ ID NO: 357824 - protein, 10 aa, Influenza virus
QQFELIDNEF

SEQ ID NO: 357825 - protein, 10 aa, Influenza virus
FELIDNEFNE

SEQ ID NO: 357826 - protein, 10 aa, Influenza virus
NEFNEIEQQI

SEQ ID NO: 357827 - protein, 10 aa, Influenza virus
EFNEIEQQIG

SEQ ID NO: 357828 - protein, 10 aa, Influenza virus
FNEIEQQIGN

SEQ ID NO: 357829 - protein, 10 aa, Influenza virus
NEIEQQIGNV

SEQ ID NO: 357830 - protein, 10 aa, Influenza virus
EIEQQIGNVI

SEQ ID NO: 357831 - protein, 10 aa, Influenza virus
IEQQIGNVIN

SEQ ID NO: 357832 - protein, 10 aa, Influenza virus
EQQIGNVINW

SEQ ID NO: 357833 - protein, 10 aa, Influenza virus
QQIGNVINWT

SEQ ID NO: 357834 - protein, 10 aa, Influenza virus
QIGNVINWTR

SEQ ID NO: 357835 - protein, 10 aa, Influenza virus
IGNVINWTRD

SEQ ID NO: 357836 - protein, 10 aa, Influenza virus
GNVINWTRDA

SEQ ID NO: 357837 - protein, 10 aa, Influenza virus
NVINWTRDAM

SEQ ID NO: 357838 - protein, 10 aa, Influenza virus
VINWTRDAMT

SEQ ID NO: 357839 - protein, 10 aa, Influenza virus
INWTRDAMTE

SEQ ID NO: 357840 - protein, 10 aa, Influenza virus
NWTRDAMTEI

SEQ ID NO: 357841 - protein, 10 aa, Influenza virus
WTRDAMTEIW

SEQ ID NO: 357842 - protein, 10 aa, Influenza virus
TRDAMTEIWS

SEQ ID NO: 357843 - protein, 10 aa, Influenza virus
RDAMTEIWSY

SEQ ID NO: 357844 - protein, 10 aa, Influenza virus
DAMTEIWSYN

SEQ ID NO: 357845 - protein, 10 aa, Influenza virus
AMTEIWSYNA

SEQ ID NO: 357846 - protein, 10 aa, Influenza virus
MTEIWSYNAE

SEQ ID NO: 357847 - protein, 10 aa, Influenza virus
TEIWSYNAEL

SEQ ID NO: 357848 - protein, 10 aa, Influenza virus
EIWSYNAELL

SEQ ID NO: 357849 - protein, 10 aa, Influenza virus
IWSYNAELLV

SEQ ID NO: 357850 - protein, 10 aa, Influenza virus
WSYNAELLVA

SEQ ID NO: 357851 - protein, 10 aa, Influenza virus
SYNAELLVAM

SEQ ID NO: 357852 - protein, 10 aa, Influenza virus
YNAELLVAME

SEQ ID NO: 357853 - protein, 10 aa, Influenza virus
NAELLVAMEN

SEQ ID NO: 357854 - protein, 10 aa, Influenza virus
AELLVAMENQ

SEQ ID NO: 357855 - protein, 10 aa, Influenza virus
ELLVAMENQH

SEQ ID NO: 357856 - protein, 10 aa, Influenza virus
LLVAMENQHT

SEQ ID NO: 357857 - protein, 10 aa, Influenza virus
LVAMENQHTI

SEQ ID NO: 357858 - protein, 10 aa, Influenza virus
VAMENQHTID

SEQ ID NO: 357859 - protein, 10 aa, Influenza virus
AMENQHTIDL

SEQ ID NO: 357860 - protein, 10 aa, Influenza virus
MENQHTIDLA

SEQ ID NO: 357861 - protein, 10 aa, Influenza virus
ENQHTIDLAD

SEQ ID NO: 357862 - protein, 10 aa, Influenza virus
NQHTIDLADS

SEQ ID NO: 357863 - protein, 10 aa, Influenza virus
QHTIDLADSE

SEQ ID NO: 357864 - protein, 10 aa, Influenza virus
HTIDLADSEM

SEQ ID NO: 357865 - protein, 10 aa, Influenza virus
IDLADSEMSK

SEQ ID NO: 357866 - protein, 10 aa, Influenza virus
DLADSEMSKL

SEQ ID NO: 357867 - protein, 10 aa, Influenza virus
LADSEMSKLY

SEQ ID NO: 357868 - protein, 10 aa, Influenza virus
DSEMSKLYER

SEQ ID NO: 357869 - protein, 10 aa, Influenza virus
SEMSKLYERV

SEQ ID NO: 357870 - protein, 10 aa, Influenza virus
EMSKLYERVK

SEQ ID NO: 357871 - protein, 10 aa, Influenza virus
KLYERVKKQL

SEQ ID NO: 357872 - protein, 10 aa, Influenza virus
LYERVKKQLR

SEQ ID NO: 357873 - protein, 10 aa, Influenza virus
YERVKKQLRE

SEQ ID NO: 357874 - protein, 10 aa, Influenza virus
ERVKKQLREN

SEQ ID NO: 357875 - protein, 10 aa, Influenza virus
RVKKQLRENA

SEQ ID NO: 357876 - protein, 10 aa, Influenza virus
VKKQLRENAE

SEQ ID NO: 357877 - protein, 10 aa, Influenza virus
KKQLRENAEE

SEQ ID NO: 357878 - protein, 10 aa, Influenza virus
KQLRENAEED

SEQ ID NO: 357879 - protein, 10 aa, Influenza virus
QLRENAEEDG

SEQ ID NO: 357880 - protein, 10 aa, Influenza virus
LRENAEEDGT

SEQ ID NO: 357881 - protein, 10 aa, Influenza virus
RENAEEDGTG

SEQ ID NO: 357882 - protein, 10 aa, Influenza virus
ENAEEDGTGC

SEQ ID NO: 357883 - protein, 10 aa, Influenza virus
NAEEDGTGCF

SEQ ID NO: 357884 - protein, 10 aa, Influenza virus
AEEDGTGCFE

SEQ ID NO: 357885 - protein, 10 aa, Influenza virus
EEDGTGCFEI

SEQ ID NO: 357886 - protein, 10 aa, Influenza virus
EDGTGCFEIF

SEQ ID NO: 357887 - protein, 10 aa, Influenza virus
DGTGCFEIFH

SEQ ID NO: 357888 - protein, 10 aa, Influenza virus
GTGCFEIFHK

SEQ ID NO: 357889 - protein, 10 aa, Influenza virus
TGCFEIFHKC

SEQ ID NO: 357890 - protein, 10 aa, Influenza virus
GCFEIFHKCD

SEQ ID NO: 357891 - protein, 10 aa, Influenza virus
CFEIFHKCDD

SEQ ID NO: 357892 - protein, 10 aa, Influenza virus
FEIFHKCDDQ

SEQ ID NO: 357893 - protein, 10 aa, Influenza virus
EIFHKCDDQC

SEQ ID NO: 357894 - protein, 10 aa, Influenza virus
IFHKCDDQCM

SEQ ID NO: 357895 - protein, 10 aa, Influenza virus
FHKCDDQCME

SEQ ID NO: 357896 - protein, 10 aa, Influenza virus
HKCDDQCMES

SEQ ID NO: 357897 - protein, 10 aa, Influenza virus
KCDDQCMESI

SEQ ID NO: 357898 - protein, 10 aa, Influenza virus
CDDQCMESIR

SEQ ID NO: 357899 - protein, 10 aa, Influenza virus
DDQCMESIRN

SEQ ID NO: 357900 - protein, 10 aa, Influenza virus
DQCMESIRNN

SEQ ID NO: 357901 - protein, 10 aa, Influenza virus
QCMESIRNNT

SEQ ID NO: 357902 - protein, 10 aa, Influenza virus
CMESIRNNTY

SEQ ID NO: 357903 - protein, 10 aa, Influenza virus
MESIRNNTYD

SEQ ID NO: 357904 - protein, 10 aa, Influenza virus
ESIRNNTYDH

SEQ ID NO: 357905 - protein, 10 aa, Influenza virus
SIRNNTYDHT

SEQ ID NO: 357906 - protein, 10 aa, Influenza virus
IRNNTYDHTQ

SEQ ID NO: 357907 - protein, 10 aa, Influenza virus
RNNTYDHTQY

SEQ ID NO: 357908 - protein, 10 aa, Influenza virus
NNTYDHTQYR

SEQ ID NO: 357909 - protein, 10 aa, Influenza virus
QYRTESLQNR

SEQ ID NO: 357910 - protein, 10 aa, Influenza virus
YRTESLQNRI

SEQ ID NO: 357911 - protein, 10 aa, Influenza virus
RTESLQNRIQ

SEQ ID NO: 357912 - protein, 10 aa, Influenza virus
TESLQNRIQI

SEQ ID NO: 357913 - protein, 10 aa, Influenza virus
ESLQNRIQID

SEQ ID NO: 357914 - protein, 10 aa, Influenza virus
SLQNRIQIDP

SEQ ID NO: 357915 - protein, 10 aa, Influenza virus
LQNRIQIDPV

SEQ ID NO: 357916 - protein, 10 aa, Influenza virus
QNRIQIDPVK

SEQ ID NO: 357917 - protein, 10 aa, Influenza virus
NRIQIDPVKL

SEQ ID NO: 357918 - protein, 10 aa, Influenza virus
RIQIDPVKLS

SEQ ID NO: 357919 - protein, 10 aa, Influenza virus
IQIDPVKLSS

SEQ ID NO: 357920 - protein, 10 aa, Influenza virus
QIDPVKLSSG

SEQ ID NO: 357921 - protein, 10 aa, Influenza virus
IDPVKLSSGY

SEQ ID NO: 357922 - protein, 10 aa, Influenza virus
DPVKLSSGYK

SEQ ID NO: 357923 - protein, 10 aa, Influenza virus
PVKLSSGYKD

SEQ ID NO: 357924 - protein, 10 aa, Influenza virus
VKLSSGYKDI

SEQ ID NO: 357925 - protein, 10 aa, Influenza virus
KLSSGYKDII

SEQ ID NO: 357926 - protein, 10 aa, Influenza virus
LSSGYKDIIL

SEQ ID NO: 357927 - protein, 10 aa, Influenza virus
SSGYKDIILW

SEQ ID NO: 357928 - protein, 10 aa, Influenza virus
SGYKDIILWF

SEQ ID NO: 357929 - protein, 10 aa, Influenza virus
GYKDIILWFS

SEQ ID NO: 357930 - protein, 10 aa, Influenza virus
YKDIILWFSF

SEQ ID NO: 357931 - protein, 10 aa, Influenza virus
KDIILWFSFG

SEQ ID NO: 357932 - protein, 10 aa, Influenza virus
DIILWFSFGA

SEQ ID NO: 357933 - protein, 10 aa, Influenza virus
IILWFSFGAS

SEQ ID NO: 357934 - protein, 10 aa, Influenza virus
ILWFSFGASC

SEQ ID NO: 357935 - protein, 10 aa, Influenza virus
LWFSFGASCF

SEQ ID NO: 357936 - protein, 10 aa, Influenza virus
WFSFGASCFL

SEQ ID NO: 357937 - protein, 10 aa, Influenza virus
FSFGASCFLL

SEQ ID NO: 357938 - protein, 10 aa, Influenza virus
SFGASCFLLL

SEQ ID NO: 357939 - protein, 10 aa, Influenza virus
FGASCFLLLA

SEQ ID NO: 357940 - protein, 10 aa, Influenza virus
GASCFLLLAI

SEQ ID NO: 357941 - protein, 10 aa, Influenza virus
ASCFLLLAIA

SEQ ID NO: 357942 - protein, 10 aa, Influenza virus
LLAIAMGLVF

SEQ ID NO: 357943 - protein, 10 aa, Influenza virus
AIAMGLVFIC

SEQ ID NO: 357944 - protein, 10 aa, Influenza virus
AMGLVFICIK

SEQ ID NO: 357945 - protein, 10 aa, Influenza virus
MGLVFICIKN

SEQ ID NO: 357946 - protein, 10 aa, Influenza virus
GLVFICIKNG

SEQ ID NO: 357947 - protein, 10 aa, Influenza virus
LVFICIKNGN

SEQ ID NO: 357948 - protein, 10 aa, Influenza virus
VFICIKNGNM

SEQ ID NO: 357949 - protein, 10 aa, Influenza virus
FICIKNGNMQ

SEQ ID NO: 357950 - protein, 10 aa, Influenza virus
ICIKNGNMQC

SEQ ID NO: 357951 - protein, 10 aa, Influenza virus
CIKNGNMQCT

SEQ ID NO: 357952 - protein, 10 aa, Influenza virus
IKNGNMQCTI

SEQ ID NO: 357953 - protein, 10 aa, Influenza virus
KNGNMQCTIC

SEQ ID NO: 357954 - protein, 10 aa, Influenza virus
NGNMQCTICI

SEQ ID NO: 357955 - protein, 10 aa, Influenza virus
ETCSALFVYS

SEQ ID NO: 357956 - protein, 10 aa, Influenza virus
TCSALFVYSL

SEQ ID NO: 357957 - protein, 10 aa, Influenza virus
CSALFVYSLR

SEQ ID NO: 357958 - protein, 10 aa, Influenza virus
SALFVYSLRK

SEQ ID NO: 357959 - protein, 10 aa, Influenza virus
MNPNQKIITI

SEQ ID NO: 357960 - protein, 10 aa, Influenza virus
NPNQKIITIG

SEQ ID NO: 357961 - protein, 10 aa, Influenza virus
PNQKIITIGS

SEQ ID NO: 357962 - protein, 10 aa, Influenza virus
NQKIITIGSV

SEQ ID NO: 357963 - protein, 10 aa, Influenza virus
QKIITIGSVS

SEQ ID NO: 357964 - protein, 10 aa, Influenza virus
KIITIGSVSL

SEQ ID NO: 357965 - protein, 10 aa, Influenza virus
IITIGSVSLT

SEQ ID NO: 357966 - protein, 10 aa, Influenza virus
ITIGSVSLTI

SEQ ID NO: 357967 - protein, 10 aa, Influenza virus
TIGSVSLTIA

SEQ ID NO: 357968 - protein, 10 aa, Influenza virus
IGSVSLTIAT

SEQ ID NO: 357969 - protein, 10 aa, Influenza virus
ERNITEIVYL

SEQ ID NO: 357970 - protein, 10 aa, Influenza virus
RNITEIVYLN

SEQ ID NO: 357971 - protein, 10 aa, Influenza virus
NITEIVYLNN

SEQ ID NO: 357972 - protein, 10 aa, Influenza virus
ITEIVYLNNT

SEQ ID NO: 357973 - protein, 10 aa, Influenza virus
YRSWSKPQCQ

SEQ ID NO: 357974 - protein, 10 aa, Influenza virus
RSWSKPQCQI

SEQ ID NO: 357975 - protein, 10 aa, Influenza virus
WSKPQCQITG

SEQ ID NO: 357976 - protein, 10 aa, Influenza virus
GFAPFSKDNS

SEQ ID NO: 357977 - protein, 10 aa, Influenza virus
FAPFSKDNSI

SEQ ID NO: 357978 - protein, 10 aa, Influenza virus
APFSKDNSIR

SEQ ID NO: 357979 - protein, 10 aa, Influenza virus
PFSKDNSIRL

SEQ ID NO: 357980 - protein, 10 aa, Influenza virus
FSKDNSIRLS

SEQ ID NO: 357981 - protein, 10 aa, Influenza virus
SKDNSIRLSA

SEQ ID NO: 357982 - protein, 10 aa, Influenza virus
KDNSIRLSAG

SEQ ID NO: 357983 - protein, 10 aa, Influenza virus
DNSIRLSAGG

SEQ ID NO: 357984 - protein, 10 aa, Influenza virus
NSIRLSAGGD

SEQ ID NO: 357985 - protein, 10 aa, Influenza virus
SIRLSAGGDI

SEQ ID NO: 357986 - protein, 10 aa, Influenza virus
IRLSAGGDIW

SEQ ID NO: 357987 - protein, 10 aa, Influenza virus
RLSAGGDIWI

SEQ ID NO: 357988 - protein, 10 aa, Influenza virus
LSAGGDIWIT

SEQ ID NO: 357989 - protein, 10 aa, Influenza virus
SAGGDIWITR

SEQ ID NO: 357990 - protein, 10 aa, Influenza virus
AGGDIWITRE

SEQ ID NO: 357991 - protein, 10 aa, Influenza virus
GGDIWITREP

SEQ ID NO: 357992 - protein, 10 aa, Influenza virus
GDIWITREPY

SEQ ID NO: 357993 - protein, 10 aa, Influenza virus
DIWITREPYV

SEQ ID NO: 357994 - protein, 10 aa, Influenza virus
IWITREPYVS

SEQ ID NO: 357995 - protein, 10 aa, Influenza virus
WITREPYVSC

SEQ ID NO: 357996 - protein, 10 aa, Influenza virus
ITREPYVSCD

SEQ ID NO: 357997 - protein, 10 aa, Influenza virus
TREPYVSCDT

SEQ ID NO: 357998 - protein, 10 aa, Influenza virus
SKCYQFALGQ

SEQ ID NO: 357999 - protein, 10 aa, Influenza virus
KCYQFALGQG

SEQ ID NO: 358000 - protein, 10 aa, Influenza virus
CYQFALGQGT

SEQ ID NO: 358001 - protein, 10 aa, Influenza virus
YQFALGQGTT

SEQ ID NO: 358002 - protein, 10 aa, Influenza virus
QFALGQGTTL

SEQ ID NO: 358003 - protein, 10 aa, Influenza virus
FALGQGTTLD

SEQ ID NO: 358004 - protein, 10 aa, Influenza virus
ALGQGTTLDN

SEQ ID NO: 358005 - protein, 10 aa, Influenza virus
LGQGTTLDNK

SEQ ID NO: 358006 - protein, 10 aa, Influenza virus
GQGTTLDNKH

SEQ ID NO: 358007 - protein, 10 aa, Influenza virus
QGTTLDNKHS

SEQ ID NO: 358008 - protein, 10 aa, Influenza virus
GTTLDNKHSN

SEQ ID NO: 358009 - protein, 10 aa, Influenza virus
TTLDNKHSNG

SEQ ID NO: 358010 - protein, 10 aa, Influenza virus
TLDNKHSNGT

SEQ ID NO: 358011 - protein, 10 aa, Influenza virus
NKHSNGTIHD

SEQ ID NO: 358012 - protein, 10 aa, Influenza virus
KHSNGTIHDR

SEQ ID NO: 358013 - protein, 10 aa, Influenza virus
HSNGTIHDRI

SEQ ID NO: 358014 - protein, 10 aa, Influenza virus
HDRIPHRTLL

SEQ ID NO: 358015 - protein, 10 aa, Influenza virus
DRIPHRTLLM

SEQ ID NO: 358016 - protein, 10 aa, Influenza virus
RIPHRTLLMN

SEQ ID NO: 358017 - protein, 10 aa, Influenza virus
IPHRTLLMNE

SEQ ID NO: 358018 - protein, 10 aa, Influenza virus
PHRTLLMNEL

SEQ ID NO: 358019 - protein, 10 aa, Influenza virus
HRTLLMNELG

SEQ ID NO: 358020 - protein, 10 aa, Influenza virus
RTLLMNELGV

SEQ ID NO: 358021 - protein, 10 aa, Influenza virus
TLLMNELGVP

SEQ ID NO: 358022 - protein, 10 aa, Influenza virus
LLMNELGVPF

SEQ ID NO: 358023 - protein, 10 aa, Influenza virus
LMNELGVPFH

SEQ ID NO: 358024 - protein, 10 aa, Influenza virus
MNELGVPFHL

SEQ ID NO: 358025 - protein, 10 aa, Influenza virus
NELGVPFHLG

SEQ ID NO: 358026 - protein, 10 aa, Influenza virus
ELGVPFHLGT

SEQ ID NO: 358027 - protein, 10 aa, Influenza virus
LGVPFHLGTK

SEQ ID NO: 358028 - protein, 10 aa, Influenza virus
GVPFHLGTKQ

SEQ ID NO: 358029 - protein, 10 aa, Influenza virus
VPFHLGTKQV

SEQ ID NO: 358030 - protein, 10 aa, Influenza virus
PFHLGTKQVC

SEQ ID NO: 358031 - protein, 10 aa, Influenza virus
FHLGTKQVCI

SEQ ID NO: 358032 - protein, 10 aa, Influenza virus
HLGTKQVCIA

SEQ ID NO: 358033 - protein, 10 aa, Influenza virus
LGTKQVCIAW

SEQ ID NO: 358034 - protein, 10 aa, Influenza virus
GTKQVCIAWS

SEQ ID NO: 358035 - protein, 10 aa, Influenza virus
TKQVCIAWSS

SEQ ID NO: 358036 - protein, 10 aa, Influenza virus
KQVCIAWSSS

SEQ ID NO: 358037 - protein, 10 aa, Influenza virus
QVCIAWSSSS

SEQ ID NO: 358038 - protein, 10 aa, Influenza virus
VCIAWSSSSC

SEQ ID NO: 358039 - protein, 10 aa, Influenza virus
CIAWSSSSCH

SEQ ID NO: 358040 - protein, 10 aa, Influenza virus
IAWSSSSCHD

SEQ ID NO: 358041 - protein, 10 aa, Influenza virus
AWSSSSCHDG

SEQ ID NO: 358042 - protein, 10 aa, Influenza virus
WSSSSCHDGK

SEQ ID NO: 358043 - protein, 10 aa, Influenza virus
SSSSCHDGKA

SEQ ID NO: 358044 - protein, 10 aa, Influenza virus
SSSCHDGKAW

SEQ ID NO: 358045 - protein, 10 aa, Influenza virus
SSCHDGKAWL

SEQ ID NO: 358046 - protein, 10 aa, Influenza virus
SCHDGKAWLH

SEQ ID NO: 358047 - protein, 10 aa, Influenza virus
CHDGKAWLHV

SEQ ID NO: 358048 - protein, 10 aa, Influenza virus
HDGKAWLHVC

SEQ ID NO: 358049 - protein, 10 aa, Influenza virus
DGKAWLHVCV

SEQ ID NO: 358050 - protein, 10 aa, Influenza virus
GKAWLHVCVT

SEQ ID NO: 358051 - protein, 10 aa, Influenza virus
KAWLHVCVTG

SEQ ID NO: 358052 - protein, 10 aa, Influenza virus
AWLHVCVTGD

SEQ ID NO: 358053 - protein, 10 aa, Influenza virus
WLHVCVTGDD

SEQ ID NO: 358054 - protein, 10 aa, Influenza virus
LHVCVTGDDR

SEQ ID NO: 358055 - protein, 10 aa, Influenza virus
HVCVTGDDRN

SEQ ID NO: 358056 - protein, 10 aa, Influenza virus
VCVTGDDRNA

SEQ ID NO: 358057 - protein, 10 aa, Influenza virus
CVTGDDRNAT

SEQ ID NO: 358058 - protein, 10 aa, Influenza virus
VTGDDRNATA

SEQ ID NO: 358059 - protein, 10 aa, Influenza virus
TGDDRNATAS

SEQ ID NO: 358060 - protein, 10 aa, Influenza virus
GDDRNATASF

SEQ ID NO: 358061 - protein, 10 aa, Influenza virus
DDRNATASFI

SEQ ID NO: 358062 - protein, 10 aa, Influenza virus
DRNATASFIY

SEQ ID NO: 358063 - protein, 10 aa, Influenza virus
NATASFIYNG

SEQ ID NO: 358064 - protein, 10 aa, Influenza virus
LVDSIGSWSQ

SEQ ID NO: 358065 - protein, 10 aa, Influenza virus
VDSIGSWSQN

SEQ ID NO: 358066 - protein, 10 aa, Influenza virus
DSIGSWSQNI

SEQ ID NO: 358067 - protein, 10 aa, Influenza virus
SIGSWSQNIL

SEQ ID NO: 358068 - protein, 10 aa, Influenza virus
IGSWSQNILR

SEQ ID NO: 358069 - protein, 10 aa, Influenza virus
GSWSQNILRT

SEQ ID NO: 358070 - protein, 10 aa, Influenza virus
SWSQNILRTQ

SEQ ID NO: 358071 - protein, 10 aa, Influenza virus
WSQNILRTQE

SEQ ID NO: 358072 - protein, 10 aa, Influenza virus
SQNILRTQES

SEQ ID NO: 358073 - protein, 10 aa, Influenza virus
QNILRTQESE

SEQ ID NO: 358074 - protein, 10 aa, Influenza virus
NILRTQESEC

SEQ ID NO: 358075 - protein, 10 aa, Influenza virus
ILRTQESECV

SEQ ID NO: 358076 - protein, 10 aa, Influenza virus
LRTQESECVC

SEQ ID NO: 358077 - protein, 10 aa, Influenza virus
RTQESECVCI

SEQ ID NO: 358078 - protein, 10 aa, Influenza virus
TQESECVCIN

SEQ ID NO: 358079 - protein, 10 aa, Influenza virus
QESECVCING

SEQ ID NO: 358080 - protein, 10 aa, Influenza virus
ESECVCINGS

SEQ ID NO: 358081 - protein, 10 aa, Influenza virus
SECVCINGSC

SEQ ID NO: 358082 - protein, 10 aa, Influenza virus
ECVCINGSCT

SEQ ID NO: 358083 - protein, 10 aa, Influenza virus
CVCINGSCTV

SEQ ID NO: 358084 - protein, 10 aa, Influenza virus
VCINGSCTVV

SEQ ID NO: 358085 - protein, 10 aa, Influenza virus
CINGSCTVVM

SEQ ID NO: 358086 - protein, 10 aa, Influenza virus
INGSCTVVMT

SEQ ID NO: 358087 - protein, 10 aa, Influenza virus
NGSCTVVMTD

SEQ ID NO: 358088 - protein, 10 aa, Influenza virus
GSCTVVMTDG

SEQ ID NO: 358089 - protein, 10 aa, Influenza virus
SCTVVMTDGS

SEQ ID NO: 358090 - protein, 10 aa, Influenza virus
CTVVMTDGSA

SEQ ID NO: 358091 - protein, 10 aa, Influenza virus
TVVMTDGSAS

SEQ ID NO: 358092 - protein, 10 aa, Influenza virus
VVMTDGSASG

SEQ ID NO: 358093 - protein, 10 aa, Influenza virus
VMTDGSASGK

SEQ ID NO: 358094 - protein, 10 aa, Influenza virus
MTDGSASGKA

SEQ ID NO: 358095 - protein, 10 aa, Influenza virus
TDGSASGKAD

SEQ ID NO: 358096 - protein, 10 aa, Influenza virus
DGSASGKADT

SEQ ID NO: 358097 - protein, 10 aa, Influenza virus
EGKIVHISPL

SEQ ID NO: 358098 - protein, 10 aa, Influenza virus
GKIVHISPLS

SEQ ID NO: 358099 - protein, 10 aa, Influenza virus
KIVHISPLSG

SEQ ID NO: 358100 - protein, 10 aa, Influenza virus
IVHISPLSGS

SEQ ID NO: 358101 - protein, 10 aa, Influenza virus
VHISPLSGSA

SEQ ID NO: 358102 - protein, 10 aa, Influenza virus
HISPLSGSAQ

SEQ ID NO: 358103 - protein, 10 aa, Influenza virus
ISPLSGSAQH

SEQ ID NO: 358104 - protein, 10 aa, Influenza virus
SPLSGSAQHI

SEQ ID NO: 358105 - protein, 10 aa, Influenza virus
PLSGSAQHIE

SEQ ID NO: 358106 - protein, 10 aa, Influenza virus
LSGSAQHIEE

SEQ ID NO: 358107 - protein, 10 aa, Influenza virus
SGSAQHIEEC

SEQ ID NO: 358108 - protein, 10 aa, Influenza virus
GSAQHIEECS

SEQ ID NO: 358109 - protein, 10 aa, Influenza virus
SAQHIEECSC

SEQ ID NO: 358110 - protein, 10 aa, Influenza virus
AQHIEECSCY

SEQ ID NO: 358111 - protein, 10 aa, Influenza virus
QHIEECSCYP

SEQ ID NO: 358112 - protein, 10 aa, Influenza virus
HIEECSCYPR

SEQ ID NO: 358113 - protein, 10 aa, Influenza virus
IEECSCYPRY

SEQ ID NO: 358114 - protein, 10 aa, Influenza virus
EECSCYPRYP

SEQ ID NO: 358115 - protein, 10 aa, Influenza virus
ECSCYPRYPN

SEQ ID NO: 358116 - protein, 10 aa, Influenza virus
CSCYPRYPNV

SEQ ID NO: 358117 - protein, 10 aa, Influenza virus
SCYPRYPNVR

SEQ ID NO: 358118 - protein, 10 aa, Influenza virus
CYPRYPNVRC

SEQ ID NO: 358119 - protein, 10 aa, Influenza virus
YPRYPNVRCV

SEQ ID NO: 358120 - protein, 10 aa, Influenza virus
PRYPNVRCVC

SEQ ID NO: 358121 - protein, 10 aa, Influenza virus
RYPNVRCVCR

SEQ ID NO: 358122 - protein, 10 aa, Influenza virus
YPNVRCVCRD

SEQ ID NO: 358123 - protein, 10 aa, Influenza virus
PNVRCVCRDN

SEQ ID NO: 358124 - protein, 10 aa, Influenza virus
NVRCVCRDNW

SEQ ID NO: 358125 - protein, 10 aa, Influenza virus
VRCVCRDNWK

SEQ ID NO: 358126 - protein, 10 aa, Influenza virus
RCVCRDNWKG

SEQ ID NO: 358127 - protein, 10 aa, Influenza virus
CVCRDNWKGS

SEQ ID NO: 358128 - protein, 10 aa, Influenza virus
VCRDNWKGSN

SEQ ID NO: 358129 - protein, 10 aa, Influenza virus
CRDNWKGSNR

SEQ ID NO: 358130 - protein, 10 aa, Influenza virus
RDNWKGSNRP

SEQ ID NO: 358131 - protein, 10 aa, Influenza virus
DNWKGSNRPV

SEQ ID NO: 358132 - protein, 10 aa, Influenza virus
NWKGSNRPVI

SEQ ID NO: 358133 - protein, 10 aa, Influenza virus
WKGSNRPVID

SEQ ID NO: 358134 - protein, 10 aa, Influenza virus
KGSNRPVIDI

SEQ ID NO: 358135 - protein, 10 aa, Influenza virus
GSNRPVIDIN

SEQ ID NO: 358136 - protein, 10 aa, Influenza virus
SNRPVIDINM

SEQ ID NO: 358137 - protein, 10 aa, Influenza virus
IDSSYVCSGL

SEQ ID NO: 358138 - protein, 10 aa, Influenza virus
DSSYVCSGLV

SEQ ID NO: 358139 - protein, 10 aa, Influenza virus
SSYVCSGLVG

SEQ ID NO: 358140 - protein, 10 aa, Influenza virus
SYVCSGLVGD

SEQ ID NO: 358141 - protein, 10 aa, Influenza virus
YVCSGLVGDT

SEQ ID NO: 358142 - protein, 10 aa, Influenza virus
VCSGLVGDTP

SEQ ID NO: 358143 - protein, 10 aa, Influenza virus
CSGLVGDTPR

SEQ ID NO: 358144 - protein, 10 aa, Influenza virus
SGLVGDTPRN

SEQ ID NO: 358145 - protein, 10 aa, Influenza virus
GLVGDTPRNE

SEQ ID NO: 358146 - protein, 10 aa, Influenza virus
LVGDTPRNED

SEQ ID NO: 358147 - protein, 10 aa, Influenza virus
VGDTPRNEDG

SEQ ID NO: 358148 - protein, 10 aa, Influenza virus
GDTPRNEDGS

SEQ ID NO: 358149 - protein, 10 aa, Influenza virus
DTPRNEDGSS

SEQ ID NO: 358150 - protein, 10 aa, Influenza virus
TPRNEDGSSS

SEQ ID NO: 358151 - protein, 10 aa, Influenza virus
PRNEDGSSSS

SEQ ID NO: 358152 - protein, 10 aa, Influenza virus
RNEDGSSSSN

SEQ ID NO: 358153 - protein, 10 aa, Influenza virus
NEDGSSSSNC

SEQ ID NO: 358154 - protein, 10 aa, Influenza virus
DPNEERGNPG

SEQ ID NO: 358155 - protein, 10 aa, Influenza virus
PNEERGNPGV

SEQ ID NO: 358156 - protein, 10 aa, Influenza virus
NEERGNPGVK

SEQ ID NO: 358157 - protein, 10 aa, Influenza virus
EERGNPGVKG

SEQ ID NO: 358158 - protein, 10 aa, Influenza virus
ERGNPGVKGW

SEQ ID NO: 358159 - protein, 10 aa, Influenza virus
RGNPGVKGWA

SEQ ID NO: 358160 - protein, 10 aa, Influenza virus
GNPGVKGWAF

SEQ ID NO: 358161 - protein, 10 aa, Influenza virus
NPGVKGWAFD

SEQ ID NO: 358162 - protein, 10 aa, Influenza virus
PGVKGWAFDS

SEQ ID NO: 358163 - protein, 10 aa, Influenza virus
GVKGWAFDSG

SEQ ID NO: 358164 - protein, 10 aa, Influenza virus
VKGWAFDSGD

SEQ ID NO: 358165 - protein, 10 aa, Influenza virus
KGWAFDSGDD

SEQ ID NO: 358166 - protein, 10 aa, Influenza virus
SGDDVWMGRT

SEQ ID NO: 358167 - protein, 10 aa, Influenza virus
GDDVWMGRTI

SEQ ID NO: 358168 - protein, 10 aa, Influenza virus
DDVWMGRTIS

SEQ ID NO: 358169 - protein, 10 aa, Influenza virus
DVWMGRTISR

SEQ ID NO: 358170 - protein, 10 aa, Influenza virus
VWMGRTISRD

SEQ ID NO: 358171 - protein, 10 aa, Influenza virus
WMGRTISRDS

SEQ ID NO: 358172 - protein, 10 aa, Influenza virus
MGRTISRDSR

SEQ ID NO: 358173 - protein, 10 aa, Influenza virus
GRTISRDSRS

SEQ ID NO: 358174 - protein, 10 aa, Influenza virus
RTISRDSRSG

SEQ ID NO: 358175 - protein, 10 aa, Influenza virus
TISRDSRSGY

SEQ ID NO: 358176 - protein, 10 aa, Influenza virus
ISRDSRSGYE

SEQ ID NO: 358177 - protein, 10 aa, Influenza virus
SRDSRSGYET

SEQ ID NO: 358178 - protein, 10 aa, Influenza virus
RDSRSGYETF

SEQ ID NO: 358179 - protein, 10 aa, Influenza virus
DSRSGYETFR

SEQ ID NO: 358180 - protein, 10 aa, Influenza virus
SRSGYETFRV

SEQ ID NO: 358181 - protein, 10 aa, Influenza virus
RSGYETFRVI

SEQ ID NO: 358182 - protein, 10 aa, Influenza virus
SGYETFRVIG

SEQ ID NO: 358183 - protein, 10 aa, Influenza virus
GYETFRVIGG

SEQ ID NO: 358184 - protein, 10 aa, Influenza virus
YETFRVIGGW

SEQ ID NO: 358185 - protein, 10 aa, Influenza virus
ETFRVIGGWT

SEQ ID NO: 358186 - protein, 10 aa, Influenza virus
VIGGWTTANS

SEQ ID NO: 358187 - protein, 10 aa, Influenza virus
IGGWTTANSK

SEQ ID NO: 358188 - protein, 10 aa, Influenza virus
GGWTTANSKS

SEQ ID NO: 358189 - protein, 10 aa, Influenza virus
GWTTANSKSQ

SEQ ID NO: 358190 - protein, 10 aa, Influenza virus
RQVIVDNNNW

SEQ ID NO: 358191 - protein, 10 aa, Influenza virus
IVDNNNWSGY

SEQ ID NO: 358192 - protein, 10 aa, Influenza virus
VDNNNWSGYS

SEQ ID NO: 358193 - protein, 10 aa, Influenza virus
DNNNWSGYSG

SEQ ID NO: 358194 - protein, 10 aa, Influenza virus
NNNWSGYSGI

SEQ ID NO: 358195 - protein, 10 aa, Influenza virus
NNWSGYSGIF

SEQ ID NO: 358196 - protein, 10 aa, Influenza virus
NWSGYSGIFS

SEQ ID NO: 358197 - protein, 10 aa, Influenza virus
WSGYSGIFSV

SEQ ID NO: 358198 - protein, 10 aa, Influenza virus
SGYSGIFSVE

SEQ ID NO: 358199 - protein, 10 aa, Influenza virus
KSCINRCFYV

SEQ ID NO: 358200 - protein, 10 aa, Influenza virus
SCINRCFYVE

SEQ ID NO: 358201 - protein, 10 aa, Influenza virus
CINRCFYVEL

SEQ ID NO: 358202 - protein, 10 aa, Influenza virus
INRCFYVELI

SEQ ID NO: 358203 - protein, 10 aa, Influenza virus
NRCFYVELIR

SEQ ID NO: 358204 - protein, 10 aa, Influenza virus
RCFYVELIRG

SEQ ID NO: 358205 - protein, 10 aa, Influenza virus
CFYVELIRGR

SEQ ID NO: 358206 - protein, 10 aa, Influenza virus
FYVELIRGRP

SEQ ID NO: 358207 - protein, 10 aa, Influenza virus
YVELIRGRPK

SEQ ID NO: 358208 - protein, 10 aa, Influenza virus
VELIRGRPKE

SEQ ID NO: 358209 - protein, 10 aa, Influenza virus
PKETRVWWTS

SEQ ID NO: 358210 - protein, 10 aa, Influenza virus
KETRVWWTSN

SEQ ID NO: 358211 - protein, 10 aa, Influenza virus
ETRVWWTSNS

SEQ ID NO: 358212 - protein, 10 aa, Influenza virus
TRVWWTSNSI

SEQ ID NO: 358213 - protein, 10 aa, Influenza virus
RVWWTSNSIV

SEQ ID NO: 358214 - protein, 10 aa, Influenza virus
VWWTSNSIVV

SEQ ID NO: 358215 - protein, 10 aa, Influenza virus
WWTSNSIVVF

SEQ ID NO: 358216 - protein, 10 aa, Influenza virus
WTSNSIVVFC

SEQ ID NO: 358217 - protein, 10 aa, Influenza virus
TSNSIVVFCG

SEQ ID NO: 358218 - protein, 10 aa, Influenza virus
SNSIVVFCGT

SEQ ID NO: 358219 - protein, 10 aa, Influenza virus
NSIVVFCGTS

SEQ ID NO: 358220 - protein, 10 aa, Influenza virus
SIVVFCGTSG

SEQ ID NO: 358221 - protein, 10 aa, Influenza virus
IVVFCGTSGT

SEQ ID NO: 358222 - protein, 10 aa, Influenza virus
VVFCGTSGTY

SEQ ID NO: 358223 - protein, 10 aa, Influenza virus
VFCGTSGTYG

SEQ ID NO: 358224 - protein, 10 aa, Influenza virus
FCGTSGTYGT

SEQ ID NO: 358225 - protein, 10 aa, Influenza virus
CGTSGTYGTG

SEQ ID NO: 358226 - protein, 10 aa, Influenza virus
GTSGTYGTGS

SEQ ID NO: 358227 - protein, 10 aa, Influenza virus
TSGTYGTGSW

SEQ ID NO: 358228 - protein, 10 aa, Influenza virus
SGTYGTGSWP

SEQ ID NO: 358229 - protein, 10 aa, Influenza virus
GTYGTGSWPD

SEQ ID NO: 358230 - protein, 10 aa, Influenza virus
TYGTGSWPDG

SEQ ID NO: 358231 - protein, 10 aa, Influenza virus
YGTGSWPDGA

SEQ ID NO: 358232 - protein, 10 aa, Influenza virus
GTGSWPDGAN

SEQ ID NO: 358233 - protein, 10 aa, Influenza virus
TGSWPDGANI

SEQ ID NO: 358234 - protein, 10 aa, Influenza virus
GSWPDGANIN

SEQ ID NO: 358235 - protein, 10 aa, Influenza virus
SWPDGANINF

SEQ ID NO: 358236 - protein, 10 aa, Influenza virus
WPDGANINFM

SEQ ID NO: 358237 - protein, 10 aa, Influenza virus
SKSRGYKMNT

SEQ ID NO: 358238 - protein, 10 aa, Influenza virus
KSRGYKMNNQ

SEQ ID NO: 358239 - protein, 10 aa, Influenza virus
SRGYKMNTQI

SEQ ID NO: 358240 - protein, 10 aa, Influenza virus
RGYKMNTQIL

SEQ ID NO: 358241 - protein, 10 aa, Influenza virus
GYKMNTQILV

SEQ ID NO: 358242 - protein, 10 aa, Influenza virus
YKMNTQILVF

SEQ ID NO: 358243 - protein, 10 aa, Influenza virus
KMNTQILVFA

SEQ ID NO: 358244 - protein, 10 aa, Influenza virus
GDKICLGHHA

SEQ ID NO: 358245 - protein, 10 aa, Influenza virus
DKICLGHHAV

SEQ ID NO: 358246 - protein, 10 aa, Influenza virus
KICLGHHAVA

SEQ ID NO: 358247 - protein, 10 aa, Influenza virus
ICLGHHAVAN

SEQ ID NO: 358248 - protein, 10 aa, Influenza virus
CLGHHAVANG

SEQ ID NO: 358249 - protein, 10 aa, Influenza virus
LGHHAVANGT

SEQ ID NO: 358250 - protein, 10 aa, Influenza virus
GHHAVANGTK

SEQ ID NO: 358251 - protein, 10 aa, Influenza virus
HHAVANGTKV

SEQ ID NO: 358252 - protein, 10 aa, Influenza virus
NGTKVNTLTE

SEQ ID NO: 358253 - protein, 10 aa, Influenza virus
VNTLTERGIE

SEQ ID NO: 358254 - protein, 10 aa, Influenza virus
NTLTERGIEV

SEQ ID NO: 358255 - protein, 10 aa, Influenza virus
TLTERGIEVV

SEQ ID NO: 358256 - protein, 10 aa, Influenza virus
LTERGIEVVN

SEQ ID NO: 358257 - protein, 10 aa, Influenza virus
TERGIEVVNA

SEQ ID NO: 358258 - protein, 10 aa, Influenza virus
ERGIEVVNAT

SEQ ID NO: 358259 - protein, 10 aa, Influenza virus
RGIEVVNATE

SEQ ID NO: 358260 - protein, 10 aa, Influenza virus
GIEVVNATET

SEQ ID NO: 358261 - protein, 10 aa, Influenza virus
IEVVNATETV

SEQ ID NO: 358262 - protein, 10 aa, Influenza virus
EVVNATETVE

SEQ ID NO: 358263 - protein, 10 aa, Influenza virus
VVNATETVET

SEQ ID NO: 358264 - protein, 10 aa, Influenza virus
TDLGQCGLLG

SEQ ID NO: 358265 - protein, 10 aa, Influenza virus
DLGQCGLLGT

SEQ ID NO: 358266 - protein, 10 aa, Influenza virus
CGLLGTLIGP

SEQ ID NO: 358267 - protein, 10 aa, Influenza virus
GLLGTLIGPP

SEQ ID NO: 358268 - protein, 10 aa, Influenza virus
LLGTLIGPPQ

SEQ ID NO: 358269 - protein, 10 aa, Influenza virus
LGTLIGPPQC

SEQ ID NO: 358270 - protein, 10 aa, Influenza virus
GTLIGPPQCD

SEQ ID NO: 358271 - protein, 10 aa, Influenza virus
IGPPQCDQFL

SEQ ID NO: 358272 - protein, 10 aa, Influenza virus
GPPQCDQFLE

SEQ ID NO: 358273 - protein, 10 aa, Influenza virus
PPQCDQFLEF

SEQ ID NO: 358274 - protein, 10 aa, Influenza virus
DVCYPGKFTN

SEQ ID NO: 358275 - protein, 10 aa, Influenza virus
LRQILRGSGG

SEQ ID NO: 358276 - protein, 10 aa, Influenza virus
RQILRGSGGI

SEQ ID NO: 358277 - protein, 10 aa, Influenza virus
GSSFYAEMKW

SEQ ID NO: 358278 - protein, 10 aa, Influenza virus
SSSFYAEMKW

SEQ ID NO: 358279 - protein, 10 aa, Influenza virus
SSFYAEMKWL

SEQ ID NO: 358280 - protein, 10 aa, Influenza virus
SFYAEMKWLL

SEQ ID NO: 358281 - protein, 10 aa, Influenza virus
FYAEMKWLLS

SEQ ID NO: 358282 - protein, 10 aa, Influenza virus
YAEMKWLLSN

SEQ ID NO: 358283 - protein, 10 aa, Influenza virus
AEMKWLLSNS

SEQ ID NO: 358284 - protein, 10 aa, Influenza virus
EMKWLLSNSD

SEQ ID NO: 358285 - protein, 10 aa, Influenza virus
MKWLLSNSDN

SEQ ID NO: 358286 - protein, 10 aa, Influenza virus
PALIIWGVHH

SEQ ID NO: 358287 - protein, 10 aa, Influenza virus
ALIIWGVHHS

SEQ ID NO: 358288 - protein, 10 aa, Influenza virus
LYGSGNKLIT

SEQ ID NO: 358289 - protein, 10 aa, Influenza virus
YGSGNKLITV

SEQ ID NO: 358290 - protein, 10 aa, Influenza virus
SSKYQQSFTP

SEQ ID NO: 358291 - protein, 10 aa, Influenza virus
SKYQQSFTPS

SEQ ID NO: 358292 - protein, 10 aa, Influenza virus
KYQQSFTPSP

SEQ ID NO: 358293 - protein, 10 aa, Influenza virus
YQQSFTPSPG

SEQ ID NO: 358294 - protein, 10 aa, Influenza virus
QSFTPSPGAR

SEQ ID NO: 358295 - protein, 10 aa, Influenza virus
VNGQSGRIDF

SEQ ID NO: 358296 - protein, 10 aa, Influenza virus
NGQSGRIDFH

SEQ ID NO: 358297 - protein, 10 aa, Influenza virus
GQSGRIDFHW

SEQ ID NO: 358298 - protein, 10 aa, Influenza virus
QSGRIDFHWL

SEQ ID NO: 358299 - protein, 10 aa, Influenza virus
NDTVTFTFNG

SEQ ID NO: 358300 - protein, 10 aa, Influenza virus
FTFNGAFIAP

SEQ ID NO: 358301 - protein, 10 aa, Influenza virus
TFNGAFIAPD

SEQ ID NO: 358302 - protein, 10 aa, Influenza virus
FNGAFIAPDR

SEQ ID NO: 358303 - protein, 10 aa, Influenza virus
NGAFIAPDRA

SEQ ID NO: 358304 - protein, 10 aa, Influenza virus
GAFIAPDRAS

SEQ ID NO: 358305 - protein, 10 aa, Influenza virus
AFIAPDRASF

SEQ ID NO: 358306 - protein, 10 aa, Influenza virus
FIAPDRASFF

SEQ ID NO: 358307 - protein, 10 aa, Influenza virus
GGTIVSSLPF

SEQ ID NO: 358308 - protein, 10 aa, Influenza virus
GTIVSSLPFQ

SEQ ID NO: 358309 - protein, 10 aa, Influenza virus
TIVSSLPFQN

SEQ ID NO: 358310 - protein, 10 aa, Influenza virus
IVSSLPFQNI

SEQ ID NO: 358311 - protein, 10 aa, Influenza virus
VSSLPFQNIN

SEQ ID NO: 358312 - protein, 10 aa, Influenza virus
SLPFQNINPR

SEQ ID NO: 358313 - protein, 10 aa, Influenza virus
LPFQNINPRT

SEQ ID NO: 358314 - protein, 10 aa, Influenza virus
VGKCPRYVKQ

SEQ ID NO: 358315 - protein, 10 aa, Influenza virus
SLLLATGMRN

SEQ ID NO: 358316 - protein, 10 aa, Influenza virus
LLLATGMRNV

SEQ ID NO: 358317 - protein, 10 aa, Influenza virus
LLATGMRNVP

SEQ ID NO: 358318 - protein, 10 aa, Influenza virus
LATGMRNVPE

SEQ ID NO: 358319 - protein, 10 aa, Influenza virus
ATGMRNVPEN

SEQ ID NO: 358320 - protein, 10 aa, Influenza virus
TGMRNVPENP

SEQ ID NO: 358321 - protein, 10 aa, Influenza virus
GMRNVPENPK

SEQ ID NO: 358322 - protein, 10 aa, Influenza virus
CSPLSRCRET

SEQ ID NO: 358323 - protein, 10 aa, Influenza virus
RKRGLFGAIA

SEQ ID NO: 358324 - protein, 10 aa, Influenza virus
LSRCRETRGL

SEQ ID NO: 358325 - protein, 10 aa, Influenza virus
SRCRETRGLF

SEQ ID NO: 358326 - protein, 10 aa, Influenza virus
RCRETRGLFG

SEQ ID NO: 358327 - protein, 10 aa, Influenza virus
CRETRGLFGA

SEQ ID NO: 358328 - protein, 10 aa, Influenza virus
RETRGLFGAI

SEQ ID NO: 358329 - protein, 10 aa, Influenza virus
MTRGLFGAIA

SEQ ID NO: 358330 - protein, 10 aa, Influenza virus
TRGLFGAIAG

SEQ ID NO: 358331 - protein, 10 aa, Influenza virus
TKPRPRRGLF

SEQ ID NO: 358332 - protein, 10 aa, Influenza virus
KPRPRRGLFG

SEQ ID NO: 358333 - protein, 10 aa, Influenza virus
PRPRRGLFGA

SEQ ID NO: 358334 - protein, 10 aa, Influenza virus
RPRRGLFGAI

SEQ ID NO: 358335 - protein, 10 aa, Influenza virus
PRRGLFGAIA

SEQ ID NO: 358336 - protein, 10 aa, Influenza virus
RRGLFGAIAG

SEQ ID NO: 358337 - protein, 10 aa, Influenza virus
RGLFGAIAGF

SEQ ID NO: 358338 - protein, 10 aa, Influenza virus
GLFGAIAGFI

SEQ ID NO: 358339 - protein, 10 aa, Influenza virus
LFGAIAGFIE

SEQ ID NO: 358340 - protein, 10 aa, Influenza virus
FGAIAGFIEN

SEQ ID NO: 358341 - protein, 10 aa, Influenza virus
GAIAGFIENG

SEQ ID NO: 358342 - protein, 10 aa, Influenza virus
AIAGFIENGW

SEQ ID NO: 358343 - protein, 10 aa, Influenza virus
IAGFIENGWE

SEQ ID NO: 358344 - protein, 10 aa, Influenza virus
AGFIENGWEG

SEQ ID NO: 358345 - protein, 10 aa, Influenza virus
GFIENGWEGL

SEQ ID NO: 358346 - protein, 10 aa, Influenza virus
FIENGWEGLI

SEQ ID NO: 358347 - protein, 10 aa, Influenza virus
IENGWEGLID

SEQ ID NO: 358348 - protein, 10 aa, Influenza virus
ENGWEGLIDG

SEQ ID NO: 358349 - protein, 10 aa, Influenza virus
NGWEGLIDGW

SEQ ID NO: 358350 - protein, 10 aa, Influenza virus
GWEGLIDGWY

SEQ ID NO: 358351 - protein, 10 aa, Influenza virus
WEGLIDGWYG

SEQ ID NO: 358352 - protein, 10 aa, Influenza virus
EGLIDGWYGF

SEQ ID NO: 358353 - protein, 10 aa, Influenza virus
GLIDGWYGFR

SEQ ID NO: 358354 - protein, 10 aa, Influenza virus
LIDGWYGFRH

SEQ ID NO: 358355 - protein, 10 aa, Influenza virus
IDGWYGFRHQ

SEQ ID NO: 358356 - protein, 10 aa, Influenza virus
DGWYGFRHQN

SEQ ID NO: 358357 - protein, 10 aa, Influenza virus
GWYGFRHQNA

SEQ ID NO: 358358 - protein, 10 aa, Influenza virus
WYGFRHQNAQ

SEQ ID NO: 358359 - protein, 10 aa, Influenza virus
YGFRHQNAQG

SEQ ID NO: 358360 - protein, 10 aa, Influenza virus
GFRHQNAQGE

SEQ ID NO: 358361 - protein, 10 aa, Influenza virus
FRHQNAQGEG

SEQ ID NO: 358362 - protein, 10 aa, Influenza virus
RHQNAQGEGT

SEQ ID NO: 358363 - protein, 10 aa, Influenza virus
HQNAQGEGTA

SEQ ID NO: 358364 - protein, 10 aa, Influenza virus
QNAQGEGTAA

SEQ ID NO: 358365 - protein, 10 aa, Influenza virus
NAQGEGTAAD

SEQ ID NO: 358366 - protein, 10 aa, Influenza virus
AQGEGTAADY

SEQ ID NO: 358367 - protein, 10 aa, Influenza virus
QGEGTAADYK

SEQ ID NO: 358368 - protein, 10 aa, Influenza virus
GEGTAADYKS

SEQ ID NO: 358369 - protein, 10 aa, Influenza virus
EGTAADYKST

SEQ ID NO: 358370 - protein, 10 aa, Influenza virus
GTAADYKSTQ

SEQ ID NO: 358371 - protein, 10 aa, Influenza virus
TAADYKSTQS

SEQ ID NO: 358372 - protein, 10 aa, Influenza virus
AADYKSTQSA

SEQ ID NO: 358373 - protein, 10 aa, Influenza virus
ADYKSTQSAI

SEQ ID NO: 358374 - protein, 10 aa, Influenza virus
DYKSTQSAID

SEQ ID NO: 358375 - protein, 10 aa, Influenza virus
YKSTQSAIDQ

SEQ ID NO: 358376 - protein, 10 aa, Influenza virus
KSTQSAIDQI

SEQ ID NO: 358377 - protein, 10 aa, Influenza virus
STQSAIDQIT

SEQ ID NO: 358378 - protein, 10 aa, Influenza virus
TQSAIDQITG

SEQ ID NO: 358379 - protein, 10 aa, Influenza virus
QSAIDQITGK

SEQ ID NO: 358380 - protein, 10 aa, Influenza virus
SAIDQITGKL

SEQ ID NO: 358381 - protein, 10 aa, Influenza virus
AIDQITGKLN

SEQ ID NO: 358382 - protein, 10 aa, Influenza virus
IDQITGKLNR

SEQ ID NO: 358383 - protein, 10 aa, Influenza virus
DQITGKLNRL

SEQ ID NO: 358384 - protein, 10 aa, Influenza virus
QITGKLNRLI

SEQ ID NO: 358385 - protein, 10 aa, Influenza virus
ITGKLNRLID

SEQ ID NO: 358386 - protein, 10 aa, Influenza virus
TGKLNRLIDK

SEQ ID NO: 358387 - protein, 10 aa, Influenza virus
GKLNRLIDKT

SEQ ID NO: 358388 - protein, 10 aa, Influenza virus
KLNRLIDKTN

SEQ ID NO: 358389 - protein, 10 aa, Influenza virus
LNRLIDKTNQ

SEQ ID NO: 358390 - protein, 10 aa, Influenza virus
NRLIDKTNQQ

SEQ ID NO: 358391 - protein, 10 aa, Influenza virus
RLIDKTNQQF

SEQ ID NO: 358392 - protein, 10 aa, Influenza virus
IDKTNQQFEL

SEQ ID NO: 358393 - protein, 10 aa, Influenza virus
DKTNQQFELI

SEQ ID NO: 358394 - protein, 10 aa, Influenza virus
KTNQQFELID

SEQ ID NO: 358395 - protein, 10 aa, Influenza virus
TNQQFELIDN

SEQ ID NO: 358396 - protein, 10 aa, Influenza virus
NQQFELIDNE

SEQ ID NO: 358397 - protein, 10 aa, Influenza virus
QQFELIDNEF

SEQ ID NO: 358398 - protein, 10 aa, Influenza virus
FNEIEQQIGN

SEQ ID NO: 358399 - protein, 10 aa, Influenza virus
EIEQQIGNVI

SEQ ID NO: 358400 - protein, 10 aa, Influenza virus
IEQQIGNVIN

SEQ ID NO: 358401 - protein, 10 aa, Influenza virus
EQQIGNVINW

SEQ ID NO: 358402 - protein, 10 aa, Influenza virus
QQIGNVINWT

SEQ ID NO: 358403 - protein, 10 aa, Influenza virus
QIGNVINWTR

SEQ ID NO: 358404 - protein, 10 aa, Influenza virus
IGNVINWTRD

SEQ ID NO: 358405 - protein, 10 aa, Influenza virus
GNVINWTRDS

SEQ ID NO: 358406 - protein, 10 aa, Influenza virus
NVINWTRDSM

SEQ ID NO: 358407 - protein, 10 aa, Influenza virus
VINWTRDSMT

SEQ ID NO: 358408 - protein, 10 aa, Influenza virus
INWTRDSMTE

SEQ ID NO: 358409 - protein, 10 aa, Influenza virus
NWTRDSMTEV

SEQ ID NO: 358410 - protein, 10 aa, Influenza virus
WTRDSMTEVW

SEQ ID NO: 358411 - protein, 10 aa, Influenza virus
TRDSMTEVWS

SEQ ID NO: 358412 - protein, 10 aa, Influenza virus
RDSMTEVWSY

SEQ ID NO: 358413 - protein, 10 aa, Influenza virus
DSMTEVWSYN

SEQ ID NO: 358414 - protein, 10 aa, Influenza virus
SMTEVWSYNA

SEQ ID NO: 358415 - protein, 10 aa, Influenza virus
MTEVWSYNAE

SEQ ID NO: 358416 - protein, 10 aa, Influenza virus
TEVWSYNAEL

SEQ ID NO: 358417 - protein, 10 aa, Influenza virus
EVWSYNAELL

SEQ ID NO: 358418 - protein, 10 aa, Influenza virus
VWSYNAELLV

SEQ ID NO: 358419 - protein, 10 aa, Influenza virus
WSYNAELLVA

SEQ ID NO: 358420 - protein, 10 aa, Influenza virus
SYNAELLVAM

SEQ ID NO: 358421 - protein, 10 aa, Influenza virus
YNAELLVAME

SEQ ID NO: 358422 - protein, 10 aa, Influenza virus
NAELLVAMEN

SEQ ID NO: 358423 - protein, 10 aa, Influenza virus
AELLVAMENQ

SEQ ID NO: 358424 - protein, 10 aa, Influenza virus
ELLVAMENQH

SEQ ID NO: 358425 - protein, 10 aa, Influenza virus
LLVAMENQHT

SEQ ID NO: 358426 - protein, 10 aa, Influenza virus
LVAMENQHTI

SEQ ID NO: 358427 - protein, 10 aa, Influenza virus
VAMENQHTID

SEQ ID NO: 358428 - protein, 10 aa, Influenza virus
AMENQHTIDL

SEQ ID NO: 358429 - protein, 10 aa, Influenza virus
MENQHTIDLA

SEQ ID NO: 358430 - protein, 10 aa, Influenza virus
ENQHTIDLAD

SEQ ID NO: 358431 - protein, 10 aa, Influenza virus
NQHTIDLADS

SEQ ID NO: 358432 - protein, 10 aa, Influenza virus
QHTIDLADSE

SEQ ID NO: 358433 - protein, 10 aa, Influenza virus
HTIDLADSEM

SEQ ID NO: 358434 - protein, 10 aa, Influenza virus
TIDLADSEMN

SEQ ID NO: 358435 - protein, 10 aa, Influenza virus
IDLADSEMNK

SEQ ID NO: 358436 - protein, 10 aa, Influenza virus
DLADSEMNKL

SEQ ID NO: 358437 - protein, 10 aa, Influenza virus
LADSEMNKLY

SEQ ID NO: 358438 - protein, 10 aa, Influenza virus
ADSEMNKLYE

SEQ ID NO: 358439 - protein, 10 aa, Influenza virus
DSEMNKLYER

SEQ ID NO: 358440 - protein, 10 aa, Influenza virus
SEMNKLYERV

SEQ ID NO: 358441 - protein, 10 aa, Influenza virus
KLYERVRKQL

SEQ ID NO: 358442 - protein, 10 aa, Influenza virus
LYERVRKQLR

SEQ ID NO: 358443 - protein, 10 aa, Influenza virus
YERVRKQLRE

SEQ ID NO: 358444 - protein, 10 aa, Influenza virus
ERVRKQLREN

SEQ ID NO: 358445 - protein, 10 aa, Influenza virus
RVRKQLRENA

SEQ ID NO: 358446 - protein, 10 aa, Influenza virus
VRKQLRENAE

SEQ ID NO: 358447 - protein, 10 aa, Influenza virus
RKQLRENAEE

SEQ ID NO: 358448 - protein, 10 aa, Influenza virus
KQLRENAEED

SEQ ID NO: 358449 - protein, 10 aa, Influenza virus
QLRENAEEDG

SEQ ID NO: 358450 - protein, 10 aa, Influenza virus
LRENAEEDGT

SEQ ID NO: 358451 - protein, 10 aa, Influenza virus
RENAEEDGTG

SEQ ID NO: 358452 - protein, 10 aa, Influenza virus
ENAEEDGTGC

SEQ ID NO: 358453 - protein, 10 aa, Influenza virus
NAEEDGTGCF

SEQ ID NO: 358454 - protein, 10 aa, Influenza virus
AEEDGTGCFE

SEQ ID NO: 358455 - protein, 10 aa, Influenza virus
EEDGTGCFEI

SEQ ID NO: 358456 - protein, 10 aa, Influenza virus
EDGTGCFEIF

SEQ ID NO: 358457 - protein, 10 aa, Influenza virus
DGTGCFEIFH

SEQ ID NO: 358458 - protein, 10 aa, Influenza virus
GTGCFEIFHK

SEQ ID NO: 358459 - protein, 10 aa, Influenza virus
TGCFEIFHKC

SEQ ID NO: 358460 - protein, 10 aa, Influenza virus
GCFEIFHKCD

SEQ ID NO: 358461 - protein, 10 aa, Influenza virus
CFEIFHKCDD

SEQ ID NO: 358462 - protein, 10 aa, Influenza virus
CMESIRNNTY

SEQ ID NO: 358463 - protein, 10 aa, Influenza virus
MESIRNNTYD

SEQ ID NO: 358464 - protein, 10 aa, Influenza virus
ESIRNNTYDH

SEQ ID NO: 358465 - protein, 10 aa, Influenza virus
SIRNNTYDHT

SEQ ID NO: 358466 - protein, 10 aa, Influenza virus
QYRTESLQNR

SEQ ID NO: 358467 - protein, 10 aa, Influenza virus
YRTESLQNRI

SEQ ID NO: 358468 - protein, 10 aa, Influenza virus
QNRIQIDPVK

SEQ ID NO: 358469 - protein, 10 aa, Influenza virus
NRIQIDPVKL

SEQ ID NO: 358470 - protein, 10 aa, Influenza virus
DPVKLSSGYK

SEQ ID NO: 358471 - protein, 10 aa, Influenza virus
PVKLSSGYKD

SEQ ID NO: 358472 - protein, 10 aa, Influenza virus
SSGYKDIILW

SEQ ID NO: 358473 - protein, 10 aa, Influenza virus
SGYKDIILWF

SEQ ID NO: 358474 - protein, 10 aa, Influenza virus
GYKDIILWFS

SEQ ID NO: 358475 - protein, 10 aa, Influenza virus
YKDIILWFSF

SEQ ID NO: 358476 - protein, 10 aa, Influenza virus
KDIILWFSFG

SEQ ID NO: 358477 - protein, 10 aa, Influenza virus
DIILWFSFGA

SEQ ID NO: 358478 - protein, 10 aa, Influenza virus
IILWFSFGAS

SEQ ID NO: 358479 - protein, 10 aa, Influenza virus
ILWFSFGASC

SEQ ID NO: 358480 - protein, 10 aa, Influenza virus
LWFSFGASCF

SEQ ID NO: 358481 - protein, 10 aa, Influenza virus
WFSFGASCFL

SEQ ID NO: 358482 - protein, 10 aa, Influenza virus
FSFGASCFLL

SEQ ID NO: 358483 - protein, 10 aa, Influenza virus
SFGASCFLLL

SEQ ID NO: 358484 - protein, 10 aa, Influenza virus
FGASCFLLLA

SEQ ID NO: 358485 - protein, 10 aa, Influenza virus
GASCFLLLAI

SEQ ID NO: 358486 - protein, 10 aa, Influenza virus
FICIKNGNMR

SEQ ID NO: 358487 - protein, 10 aa, Influenza virus
ICIKNGNMRC

SEQ ID NO: 358488 - protein, 10 aa, Influenza virus
CIKNGNMRCT

SEQ ID NO: 358489 - protein, 10 aa, Influenza virus
IKNGNMRCTI

SEQ ID NO: 358490 - protein, 10 aa, Influenza virus
KNGNMRCTIC

SEQ ID NO: 358491 - protein, 10 aa, Influenza virus
NGNMRCTICI

SEQ ID NO: 358492 - protein, 10 aa, Influenza virus
GVVNTTLSTI

SEQ ID NO: 358493 - protein, 10 aa, Influenza virus
VVNTTLSTIA

SEQ ID NO: 358494 - protein, 10 aa, Influenza virus
VNTTLSTIAL

SEQ ID NO: 358495 - protein, 10 aa, Influenza virus
NTTLSTIALL

SEQ ID NO: 358496 - protein, 10 aa, Influenza virus
TTLSTIALLI

SEQ ID NO: 358497 - protein, 10 aa, Influenza virus
TLSTIALLIG

SEQ ID NO: 358498 - protein, 10 aa, Influenza virus
LSTIALLIGV

SEQ ID NO: 358499 - protein, 10 aa, Influenza virus
STIALLIGVG

SEQ ID NO: 358500 - protein, 10 aa, Influenza virus
TIALLIGVGN

SEQ ID NO: 358501 - protein, 10 aa, Influenza virus
IALLIGVGNL

SEQ ID NO: 358502 - protein, 10 aa, Influenza virus
IGVGNLVFNT

SEQ ID NO: 358503 - protein, 10 aa, Influenza virus
GVGNLVFNTV

SEQ ID NO: 358504 - protein, 10 aa, Influenza virus
VGNLVFNTVI

SEQ ID NO: 358505 - protein, 10 aa, Influenza virus
GNLVFNTVIH

SEQ ID NO: 358506 - protein, 10 aa, Influenza virus
NLVFNTVIHE

SEQ ID NO: 358507 - protein, 10 aa, Influenza virus
ITYNNTVINN

SEQ ID NO: 358508 - protein, 10 aa, Influenza virus
TYNNTVINNI

SEQ ID NO: 358509 - protein, 10 aa, Influenza virus
YNNTVINNIT

SEQ ID NO: 358510 - protein, 10 aa, Influenza virus
NNTVINNITT

SEQ ID NO: 358511 - protein, 10 aa, Influenza virus
NTVINNITTT

SEQ ID NO: 358512 - protein, 10 aa, Influenza virus
TVINNITTTI

SEQ ID NO: 358513 - protein, 10 aa, Influenza virus
VINNITTTII

SEQ ID NO: 358514 - protein, 10 aa, Influenza virus
FKSPLPLCPF

SEQ ID NO: 358515 - protein, 10 aa, Influenza virus
PLPLCPFRGF

SEQ ID NO: 358516 - protein, 10 aa, Influenza virus
LPLCPFRGFF

SEQ ID NO: 358517 - protein, 10 aa, Influenza virus
PLCPFRGFFP

SEQ ID NO: 358518 - protein, 10 aa, Influenza virus
LCPFRGFFPF

SEQ ID NO: 358519 - protein, 10 aa, Influenza virus
CPFRGFFPFH

SEQ ID NO: 358520 - protein, 10 aa, Influenza virus
PFRGFFPFHK

SEQ ID NO: 358521 - protein, 10 aa, Influenza virus
FRGFFPFHKD

SEQ ID NO: 358522 - protein, 10 aa, Influenza virus
RGFFPFHKDN

SEQ ID NO: 358523 - protein, 10 aa, Influenza virus
GFFPFHKDNA

SEQ ID NO: 358524 - protein, 10 aa, Influenza virus
FFPFHKDNAI

SEQ ID NO: 358525 - protein, 10 aa, Influenza virus
FPFHKDNAIR

SEQ ID NO: 358526 - protein, 10 aa, Influenza virus
PFHKDNAIRL

SEQ ID NO: 358527 - protein, 10 aa, Influenza virus
FHKDNAIRLG

SEQ ID NO: 358528 - protein, 10 aa, Influenza virus
HKDNAIRLGE

SEQ ID NO: 358529 - protein, 10 aa, Influenza virus
KDNAIRLGEN

SEQ ID NO: 358530 - protein, 10 aa, Influenza virus
DNAIRLGENK

SEQ ID NO: 358531 - protein, 10 aa, Influenza virus
VIVTREPYVS

SEQ ID NO: 358532 - protein, 10 aa, Influenza virus
IVTREPYVSC

SEQ ID NO: 358533 - protein, 10 aa, Influenza virus
VTREPYVSCD

SEQ ID NO: 358534 - protein, 10 aa, Influenza virus
TREPYVSCDN

SEQ ID NO: 358535 - protein, 10 aa, Influenza virus
NCWSFALAQG

SEQ ID NO: 358536 - protein, 10 aa, Influenza virus
CWSFALAQGA

SEQ ID NO: 358537 - protein, 10 aa, Influenza virus
WSFALAQGAL

SEQ ID NO: 358538 - protein, 10 aa, Influenza virus
SFALAQGALL

SEQ ID NO: 358539 - protein, 10 aa, Influenza virus
FALAQGALLG

SEQ ID NO: 358540 - protein, 10 aa, Influenza virus
ALAQGALLGT

SEQ ID NO: 358541 - protein, 10 aa, Influenza virus
LAQGALLGTK

SEQ ID NO: 358542 - protein, 10 aa, Influenza virus
AQGALLGTKH

SEQ ID NO: 358543 - protein, 10 aa, Influenza virus
QGALLGTKHS

SEQ ID NO: 358544 - protein, 10 aa, Influenza virus
GALLGTKHSN

SEQ ID NO: 358545 - protein, 10 aa, Influenza virus
ALLGTKHSNG

SEQ ID NO: 358546 - protein, 10 aa, Influenza virus
LLGTKHSNGT

SEQ ID NO: 358547 - protein, 10 aa, Influenza virus
KDRTPYRSLI

SEQ ID NO: 358548 - protein, 10 aa, Influenza virus
DRTPYRSLIR

SEQ ID NO: 358549 - protein, 10 aa, Influenza virus
RTPYRSLIRF

SEQ ID NO: 358550 - protein, 10 aa, Influenza virus
TPYRSLIRFP

SEQ ID NO: 358551 - protein, 10 aa, Influenza virus
PYRSLIRFPI

SEQ ID NO: 358552 - protein, 10 aa, Influenza virus
YRSLIRFPIG

SEQ ID NO: 358553 - protein, 10 aa, Influenza virus
RSLIRFPIGT

SEQ ID NO: 358554 - protein, 10 aa, Influenza virus
SLIRFPIGTA

SEQ ID NO: 358555 - protein, 10 aa, Influenza virus
LIRFPIGTAP

SEQ ID NO: 358556 - protein, 10 aa, Influenza virus
FPIGTAPVLG

SEQ ID NO: 358557 - protein, 10 aa, Influenza virus
PIGTAPVLGN

SEQ ID NO: 358558 - protein, 10 aa, Influenza virus
IGTAPVLGNY

SEQ ID NO: 358559 - protein, 10 aa, Influenza virus
GTAPVLGNYK

SEQ ID NO: 358560 - protein, 10 aa, Influenza virus
TAPVLGNYKE

SEQ ID NO: 358561 - protein, 10 aa, Influenza virus
APVLGNYKEI

SEQ ID NO: 358562 - protein, 10 aa, Influenza virus
PVLGNYKEIC

SEQ ID NO: 358563 - protein, 10 aa, Influenza virus
LGNYKEICIA

SEQ ID NO: 358564 - protein, 10 aa, Influenza virus
GNYKEICIAW

SEQ ID NO: 358565 - protein, 10 aa, Influenza virus
NYKEICIAWS

SEQ ID NO: 358566 - protein, 10 aa, Influenza virus
YKEICIAWSS

SEQ ID NO: 358567 - protein, 10 aa, Influenza virus
EICIAWSSSS

SEQ ID NO: 358568 - protein, 10 aa, Influenza virus
ICIAWSSSSC

SEQ ID NO: 358569 - protein, 10 aa, Influenza virus
CIAWSSSSCF

SEQ ID NO: 358570 - protein, 10 aa, Influenza virus
IAWSSSSCFD

SEQ ID NO: 358571 - protein, 10 aa, Influenza virus
AWSSSSCFDG

SEQ ID NO: 358572 - protein, 10 aa, Influenza virus
WSSSSCFDGK

SEQ ID NO: 358573 - protein, 10 aa, Influenza virus
SSSSCFDGKE

SEQ ID NO: 358574 - protein, 10 aa, Influenza virus
SSSCFDGKEW

SEQ ID NO: 358575 - protein, 10 aa, Influenza virus
SSCFDGKEWM

SEQ ID NO: 358576 - protein, 10 aa, Influenza virus
SCFDGKEWMH

SEQ ID NO: 358577 - protein, 10 aa, Influenza virus
CFDGKEWMHV

SEQ ID NO: 358578 - protein, 10 aa, Influenza virus
FDGKEWMHVC

SEQ ID NO: 358579 - protein, 10 aa, Influenza virus
DGKEWMHVCM

SEQ ID NO: 358580 - protein, 10 aa, Influenza virus
GKEWMHVCMT

SEQ ID NO: 358581 - protein, 10 aa, Influenza virus
KEWMHVCMTG

SEQ ID NO: 358582 - protein, 10 aa, Influenza virus
GRMTDSIKSW

SEQ ID NO: 358583 - protein, 10 aa, Influenza virus
RMTDSIKSWR

SEQ ID NO: 358584 - protein, 10 aa, Influenza virus
MTDSIKSWRK

SEQ ID NO: 358585 - protein, 10 aa, Influenza virus
TDSIKSWRKD

SEQ ID NO: 358586 - protein, 10 aa, Influenza virus
DSIKSWRKDI

SEQ ID NO: 358587 - protein, 10 aa, Influenza virus
SIKSWRKDIL

SEQ ID NO: 358588 - protein, 10 aa, Influenza virus
IKSWRKDILR

SEQ ID NO: 358589 - protein, 10 aa, Influenza virus
KSWRKDILRT

SEQ ID NO: 358590 - protein, 10 aa, Influenza virus
SWRKDILRTQ

SEQ ID NO: 358591 - protein, 10 aa, Influenza virus
WRKDILRTQE

SEQ ID NO: 358592 - protein, 10 aa, Influenza virus
RKDILRTQES

SEQ ID NO: 358593 - protein, 10 aa, Influenza virus
KDILRTQESE

SEQ ID NO: 358594 - protein, 10 aa, Influenza virus
DILRTQESEC

SEQ ID NO: 358595 - protein, 10 aa, Influenza virus
ILRTQESECQ

SEQ ID NO: 358596 - protein, 10 aa, Influenza virus
LRTQESECQC

SEQ ID NO: 358597 - protein, 10 aa, Influenza virus
RTQESECQCI

SEQ ID NO: 358598 - protein, 10 aa, Influenza virus
TQESECQCID

SEQ ID NO: 358599 - protein, 10 aa, Influenza virus
QESECQCIDG

SEQ ID NO: 358600 - protein, 10 aa, Influenza virus
GTCVVAVTDG

SEQ ID NO: 358601 - protein, 10 aa, Influenza virus
TCVVAVTDGP

SEQ ID NO: 358602 - protein, 10 aa, Influenza virus
CVVAVTDGPA

SEQ ID NO: 358603 - protein, 10 aa, Influenza virus
VVAVTDGPAA

SEQ ID NO: 358604 - protein, 10 aa, Influenza virus
VAVTDGPAAN

SEQ ID NO: 358605 - protein, 10 aa, Influenza virus
AVTDGPAANS

SEQ ID NO: 358606 - protein, 10 aa, Influenza virus
VTDGPAANSA

SEQ ID NO: 358607 - protein, 10 aa, Influenza virus
TDGPAANSAD

SEQ ID NO: 358608 - protein, 10 aa, Influenza virus
DGPAANSADH

SEQ ID NO: 358609 - protein, 10 aa, Influenza virus
GPAANSADHR

SEQ ID NO: 358610 - protein, 10 aa, Influenza virus
PAANSADHRV

SEQ ID NO: 358611 - protein, 10 aa, Influenza virus
AANSADHRVY

SEQ ID NO: 358612 - protein, 10 aa, Influenza virus
ANSADHRVYW

SEQ ID NO: 358613 - protein, 10 aa, Influenza virus
NSADHRVYWI

SEQ ID NO: 358614 - protein, 10 aa, Influenza virus
SADHRVYWIR

SEQ ID NO: 358615 - protein, 10 aa, Influenza virus
ADHRVYWIRE

SEQ ID NO: 358616 - protein, 10 aa, Influenza virus
DHRVYWIREG

SEQ ID NO: 358617 - protein, 10 aa, Influenza virus
HRVYWIREGR

SEQ ID NO: 358618 - protein, 10 aa, Influenza virus
KIQHLEECSC

SEQ ID NO: 358619 - protein, 10 aa, Influenza virus
IQHLEECSCY

SEQ ID NO: 358620 - protein, 10 aa, Influenza virus
QHLEECSCYV

SEQ ID NO: 358621 - protein, 10 aa, Influenza virus
HLEECSCYVD

SEQ ID NO: 358622 - protein, 10 aa, Influenza virus
LEECSCYVDI

SEQ ID NO: 358623 - protein, 10 aa, Influenza virus
EECSCYVDID

SEQ ID NO: 358624 - protein, 10 aa, Influenza virus
ECSCYVDIDV

SEQ ID NO: 358625 - protein, 10 aa, Influenza virus
CSCYVDIDVY

SEQ ID NO: 358626 - protein, 10 aa, Influenza virus
SCYVDIDVYC

SEQ ID NO: 358627 - protein, 10 aa, Influenza virus
DIDVYCICRD

SEQ ID NO: 358628 - protein, 10 aa, Influenza virus
IDVYCICRDN

SEQ ID NO: 358629 - protein, 10 aa, Influenza virus
DVYCICRDNW

SEQ ID NO: 358630 - protein, 10 aa, Influenza virus
VYCICRDNWK

SEQ ID NO: 358631 - protein, 10 aa, Influenza virus
YCICRDNWKG

SEQ ID NO: 358632 - protein, 10 aa, Influenza virus
CICRDNWKGS

SEQ ID NO: 358633 - protein, 10 aa, Influenza virus
ICRDNWKGSN

SEQ ID NO: 358634 - protein, 10 aa, Influenza virus
CRDNWKGSNR

SEQ ID NO: 358635 - protein, 10 aa, Influenza virus
RDNWKGSNRP

SEQ ID NO: 358636 - protein, 10 aa, Influenza virus
DNWKGSNRPW

SEQ ID NO: 358637 - protein, 10 aa, Influenza virus
NWKGSNRPWM

SEQ ID NO: 358638 - protein, 10 aa, Influenza virus
WKGSNRPWMR

SEQ ID NO: 358639 - protein, 10 aa, Influenza virus
KGSNRPWMRI

SEQ ID NO: 358640 - protein, 10 aa, Influenza virus
GSNRPWMRIN

SEQ ID NO: 358641 - protein, 10 aa, Influenza virus
SNRPWMRINN

SEQ ID NO: 358642 - protein, 10 aa, Influenza virus
NRPWMRINNE

SEQ ID NO: 358643 - protein, 10 aa, Influenza virus
RPWMRINNET

SEQ ID NO: 358644 - protein, 10 aa, Influenza virus
PWMRINNETI

SEQ ID NO: 358645 - protein, 10 aa, Influenza virus
WMRINNETIL

SEQ ID NO: 358646 - protein, 10 aa, Influenza virus
MRINNETILE

SEQ ID NO: 358647 - protein, 10 aa, Influenza virus
RINNETILET

SEQ ID NO: 358648 - protein, 10 aa, Influenza virus
INNETILETG

SEQ ID NO: 358649 - protein, 10 aa, Influenza virus
NNETILETGY

SEQ ID NO: 358650 - protein, 10 aa, Influenza virus
NETILETGYV

SEQ ID NO: 358651 - protein, 10 aa, Influenza virus
ETILETGYVC

SEQ ID NO: 358652 - protein, 10 aa, Influenza virus
TILETGYVCS

SEQ ID NO: 358653 - protein, 10 aa, Influenza virus
ILETGYVCSK

SEQ ID NO: 358654 - protein, 10 aa, Influenza virus
LETGYVCSKF

SEQ ID NO: 358655 - protein, 10 aa, Influenza virus
ETGYVCSKFH

SEQ ID NO: 358656 - protein, 10 aa, Influenza virus
TGYVCSKFHS

SEQ ID NO: 358657 - protein, 10 aa, Influenza virus
GYVCSKFHSD

SEQ ID NO: 358658 - protein, 10 aa, Influenza virus
YVCSKFHSDT

SEQ ID NO: 358659 - protein, 10 aa, Influenza virus
VCSKFHSDTP

SEQ ID NO: 358660 - protein, 10 aa, Influenza virus
CSKFHSDTPR

SEQ ID NO: 358661 - protein, 10 aa, Influenza virus
SKFHSDTPRP

SEQ ID NO: 358662 - protein, 10 aa, Influenza virus
KFHSDTPRPA

SEQ ID NO: 358663 - protein, 10 aa, Influenza virus
FHSDTPRPAD

SEQ ID NO: 358664 - protein, 10 aa, Influenza virus
HSDTPRPADP

SEQ ID NO: 358665 - protein, 10 aa, Influenza virus
SDTPRPADPS

SEQ ID NO: 358666 - protein, 10 aa, Influenza virus
DPSTVSCDSP

SEQ ID NO: 358667 - protein, 10 aa, Influenza virus
PSTVSCDSPS

SEQ ID NO: 358668 - protein, 10 aa, Influenza virus
STVSCDSPSN

SEQ ID NO: 358669 - protein, 10 aa, Influenza virus
SCDSPSNVNG

SEQ ID NO: 358670 - protein, 10 aa, Influenza virus
CDSPSNVNGG

SEQ ID NO: 358671 - protein, 10 aa, Influenza virus
NGGPGVKGFG

SEQ ID NO: 358672 - protein, 10 aa, Influenza virus
GGPGVKGFGF

SEQ ID NO: 358673 - protein, 10 aa, Influenza virus
GPGVKGFGFK

SEQ ID NO: 358674 - protein, 10 aa, Influenza virus
GVKGFGFKAG

SEQ ID NO: 358675 - protein, 10 aa, Influenza virus
GNDVWLGRTV

SEQ ID NO: 358676 - protein, 10 aa, Influenza virus
NDVWLGRTVS

SEQ ID NO: 358677 - protein, 10 aa, Influenza virus
DVWLGRTVST

SEQ ID NO: 358678 - protein, 10 aa, Influenza virus
VWLGRTVSTS

SEQ ID NO: 358679 - protein, 10 aa, Influenza virus
WLGRTVSTSG

SEQ ID NO: 358680 - protein, 10 aa, Influenza virus
LGRTVSTSGR

SEQ ID NO: 358681 - protein, 10 aa, Influenza virus
GRTVSTSGRS

SEQ ID NO: 358682 - protein, 10 aa, Influenza virus
EGWINSPNHA

SEQ ID NO: 358683 - protein, 10 aa, Influenza virus
GWINSPNHAK

SEQ ID NO: 358684 - protein, 10 aa, Influenza virus
WINSPNHAKS

SEQ ID NO: 358685 - protein, 10 aa, Influenza virus
AKSVTQTLVS

SEQ ID NO: 358686 - protein, 10 aa, Influenza virus
KSITQTLVSN

SEQ ID NO: 358687 - protein, 10 aa, Influenza virus
SITQTLVSNN

SEQ ID NO: 358688 - protein, 10 aa, Influenza virus
ITQTLVSNND

SEQ ID NO: 358689 - protein, 10 aa, Influenza virus
TQTLVSNNDW

SEQ ID NO: 358690 - protein, 10 aa, Influenza virus
QTLVSNNDWS

SEQ ID NO: 358691 - protein, 10 aa, Influenza virus
TLVSNNDWSG

SEQ ID NO: 358692 - protein, 10 aa, Influenza virus
LVSNNDWSGY

SEQ ID NO: 358693 - protein, 10 aa, Influenza virus
VSNNDWSGYS

SEQ ID NO: 358694 - protein, 10 aa, Influenza virus
SNNDWSGYSG

SEQ ID NO: 358695 - protein, 10 aa, Influenza virus
NNDWSGYSGS

SEQ ID NO: 358696 - protein, 10 aa, Influenza virus
NDWSGYSGSF

SEQ ID NO: 358697 - protein, 10 aa, Influenza virus
DWSGYSGSFI

SEQ ID NO: 358698 - protein, 10 aa, Influenza virus
WSGYSGSFIV

SEQ ID NO: 358699 - protein, 10 aa, Influenza virus
DCFQPCFYVE

SEQ ID NO: 358700 - protein, 10 aa, Influenza virus
CFQPCFYVEL

SEQ ID NO: 358701 - protein, 10 aa, Influenza virus
FQPCFYVELI

SEQ ID NO: 358702 - protein, 10 aa, Influenza virus
QPCFYVELIR

SEQ ID NO: 358703 - protein, 10 aa, Influenza virus
PCFYVELIRG

SEQ ID NO: 358704 - protein, 10 aa, Influenza virus
CFYVELIRGR

SEQ ID NO: 358705 - protein, 10 aa, Influenza virus
FYVELIRGRP

SEQ ID NO: 358706 - protein, 10 aa, Influenza virus
YVELIRGRPN

SEQ ID NO: 358707 - protein, 10 aa, Influenza virus
NDDVSWTSNS

SEQ ID NO: 358708 - protein, 10 aa, Influenza virus
DDVSWTSNSI

SEQ ID NO: 358709 - protein, 10 aa, Influenza virus
DVSWTSNSIV

SEQ ID NO: 358710 - protein, 10 aa, Influenza virus
VSWTSNSIVT

SEQ ID NO: 358711 - protein, 10 aa, Influenza virus
SWTSNSIVTF

SEQ ID NO: 358712 - protein, 10 aa, Influenza virus
WTSNSIVTFC

SEQ ID NO: 358713 - protein, 10 aa, Influenza virus
TSNSIVTFCG

SEQ ID NO: 358714 - protein, 10 aa, Influenza virus
SNSIVTFCGL

SEQ ID NO: 358715 - protein, 10 aa, Influenza virus
NSIVTFCGLD

SEQ ID NO: 358716 - protein, 10 aa, Influenza virus
SIVTFCGLDN

SEQ ID NO: 358717 - protein, 10 aa, Influenza virus
IVTFCGLDNE

SEQ ID NO: 358718 - protein, 10 aa, Influenza virus
VTFCGLDNEP

SEQ ID NO: 358719 - protein, 10 aa, Influenza virus
TFCGLDNEPG

SEQ ID NO: 358720 - protein, 10 aa, Influenza virus
FCGLDNEPGS

SEQ ID NO: 358721 - protein, 10 aa, Influenza virus
CGLDNEPGSG

SEQ ID NO: 358722 - protein, 10 aa, Influenza virus
GLDNEPGSGN

SEQ ID NO: 358723 - protein, 10 aa, Influenza virus
LDNEPGSGNW

SEQ ID NO: 358724 - protein, 10 aa, Influenza virus
DNEPGSGNWP

SEQ ID NO: 358725 - protein, 10 aa, Influenza virus
NEPGSGNWPD

SEQ ID NO: 358726 - protein, 10 aa, Influenza virus
EPGSGNWPDG

SEQ ID NO: 358727 - protein, 10 aa, Influenza virus
PGSGNWPDGS

SEQ ID NO: 358728 - protein, 10 aa, Influenza virus
GSGNWPDGSN

SEQ ID NO: 358729 - protein, 10 aa, Influenza virus
SGNWPDGSNI

SEQ ID NO: 358730 - protein, 10 aa, Influenza virus
GNWPDGSNIG

SEQ ID NO: 358731 - protein, 10 aa, Influenza virus
NWPDGSNIGF

SEQ ID NO: 358732 - protein, 10 aa, Influenza virus
WPDGSNIGFM

SEQ ID NO: 358733 - protein, 10 aa, Influenza virus
PDGSNIGFMP

SEQ ID NO: 358734 - protein, 10 aa, Influenza virus
DGSNIGFMPK

SEQ ID NO: 358735 - protein, 10 aa, Influenza virus
SKSRGYKMNT

SEQ ID NO: 358736 - protein, 10 aa, Influenza virus
KSRGYKMNTQ

SEQ ID NO: 358737 - protein, 10 aa, Influenza virus
SRGYKMNTQI

SEQ ID NO: 358738 - protein, 10 aa, Influenza virus
RGYKMNTQIL

SEQ ID NO: 358739 - protein, 10 aa, Influenza virus
GYKMNTQILV

SEQ ID NO: 358740 - protein, 10 aa, Influenza virus
YKMNTQILVF

SEQ ID NO: 358741 - protein, 10 aa, Influenza virus
KMNTQILVFA

SEQ ID NO: 358742 - protein, 10 aa, Influenza virus
GCDHSDNADK

SEQ ID NO: 358743 - protein, 10 aa, Influenza virus
CDHSDNADKI

SEQ ID NO: 358744 - protein, 10 aa, Influenza virus
DHSDNADKIC

SEQ ID NO: 358745 - protein, 10 aa, Influenza virus
HSDNADKICL

SEQ ID NO: 358746 - protein, 10 aa, Influenza virus
SDNADKICLG

SEQ ID NO: 358747 - protein, 10 aa, Influenza virus
DNADKICLGH

SEQ ID NO: 358748 - protein, 10 aa, Influenza virus
ADKICLGHHA

SEQ ID NO: 358749 - protein, 10 aa, Influenza virus
DKICLGHHAV

SEQ ID NO: 358750 - protein, 10 aa, Influenza virus
NGTKVNTLTE

SEQ ID NO: 358751 - protein, 10 aa, Influenza virus
GTKVNTLTER

SEQ ID NO: 358752 - protein, 10 aa, Influenza virus
KVNTLTERGV

SEQ ID NO: 358753 - protein, 10 aa, Influenza virus
VNTLTERGVE

SEQ ID NO: 358754 - protein, 10 aa, Influenza virus
NTLTERGVEV

SEQ ID NO: 358755 - protein, 10 aa, Influenza virus
TLTERGVEVV

SEQ ID NO: 358756 - protein, 10 aa, Influenza virus
LTERGVEVVN

SEQ ID NO: 358757 - protein, 10 aa, Influenza virus
TERGVEVVNA

SEQ ID NO: 358758 - protein, 10 aa, Influenza virus
ERGVEVVNAT

SEQ ID NO: 358759 - protein, 10 aa, Influenza virus
RGVEVVNATE

SEQ ID NO: 358760 - protein, 10 aa, Influenza virus
GVEVVNATET

SEQ ID NO: 358761 - protein, 10 aa, Influenza virus
VEVVNATETV

SEQ ID NO: 358762 - protein, 10 aa, Influenza virus
EVVNATETVE

SEQ ID NO: 358763 - protein, 10 aa, Influenza virus
VVNATETVER

SEQ ID NO: 358764 - protein, 10 aa, Influenza virus
DLGQCGLLGT

SEQ ID NO: 358765 - protein, 10 aa, Influenza virus
TGPPQCDQFL

SEQ ID NO: 358766 - protein, 10 aa, Influenza virus
GPPQCDQFLE

SEQ ID NO: 358767 - protein, 10 aa, Influenza virus
PPQCDQFLEF

SEQ ID NO: 358768 - protein, 10 aa, Influenza virus
LRQILRESGG

SEQ ID NO: 358769 - protein, 10 aa, Influenza virus
MGFTYSGIRT

SEQ ID NO: 358770 - protein, 10 aa, Influenza virus
GFTYSGIRTN

SEQ ID NO: 358771 - protein, 10 aa, Influenza virus
FTYSGIRTNG

SEQ ID NO: 358772 - protein, 10 aa, Influenza virus
RSGSSFYAEM

SEQ ID NO: 358773 - protein, 10 aa, Influenza virus
SGSSFYAEMK

SEQ ID NO: 358774 - protein, 10 aa, Influenza virus
GSSFYAEMKW

SEQ ID NO: 358775 - protein, 10 aa, Influenza virus
SSFYAEMKWL

SEQ ID NO: 358776 - protein, 10 aa, Influenza virus
SFYAEMKWLL

SEQ ID NO: 358777 - protein, 10 aa, Influenza virus
FYAEMKWLLS

SEQ ID NO: 358778 - protein, 10 aa, Influenza virus
YAEMKWLLSN

SEQ ID NO: 358779 - protein, 10 aa, Influenza virus
FPQMTKSYKN

SEQ ID NO: 358780 - protein, 10 aa, Influenza virus
PALIIWGIHH

SEQ ID NO: 358781 - protein, 10 aa, Influenza virus
TVGSSNYQQS

SEQ ID NO: 358782 - protein, 10 aa, Influenza virus
RPQVNGQSGR

SEQ ID NO: 358783 - protein, 10 aa, Influenza virus
PQVNGQSGRI

SEQ ID NO: 358784 - protein, 10 aa, Influenza virus
QVNGQSGRID

SEQ ID NO: 358785 - protein, 10 aa, Influenza virus
VNGQSGRIDF

SEQ ID NO: 358786 - protein, 10 aa, Influenza virus
NGQSGRIDFH

SEQ ID NO: 358787 - protein, 10 aa, Influenza virus
GQSGRIDFHW

SEQ ID NO: 358788 - protein, 10 aa, Influenza virus
QSGRIDFHWL

SEQ ID NO: 358789 - protein, 10 aa, Influenza virus
NDTVTFSFNG

SEQ ID NO: 358790 - protein, 10 aa, Influenza virus
DTVTFSFNGA

SEQ ID NO: 358791 - protein, 10 aa, Influenza virus
TVTFSFNGAF

SEQ ID NO: 358792 - protein, 10 aa, Influenza virus
TFSFNGAFIA

SEQ ID NO: 358793 - protein, 10 aa, Influenza virus
FSFNGAFIAP

SEQ ID NO: 358794 - protein, 10 aa, Influenza virus
FNGAFIAPDR

SEQ ID NO: 358795 - protein, 10 aa, Influenza virus
NGAFIAPDRA

SEQ ID NO: 358796 - protein, 10 aa, Influenza virus
GAFIAPDRAS

SEQ ID NO: 358797 - protein, 10 aa, Influenza virus
AFIAPDRASF

SEQ ID NO: 358798 - protein, 10 aa, Influenza virus
LPFQNINSRA

SEQ ID NO: 358799 - protein, 10 aa, Influenza virus
VGKCPRYVKQ

SEQ ID NO: 358800 - protein, 10 aa, Influenza virus
SLLLATGMKN

SEQ ID NO: 358801 - protein, 10 aa, Influenza virus
LLLATGMKNV

SEQ ID NO: 358802 - protein, 10 aa, Influenza virus
LLATGMKNVP

SEQ ID NO: 358803 - protein, 10 aa, Influenza virus
LATGMKNVPE

SEQ ID NO: 358804 - protein, 10 aa, Influenza virus
THKQLTHHMR

SEQ ID NO: 358805 - protein, 10 aa, Influenza virus
HKQLTHHMRK

SEQ ID NO: 358806 - protein, 10 aa, Influenza virus
KQLTHHMRKK

SEQ ID NO: 358807 - protein, 10 aa, Influenza virus
QLTHHMRKKR

SEQ ID NO: 358808 - protein, 10 aa, Influenza virus
LTHHMRKKRG

SEQ ID NO: 358809 - protein, 10 aa, Influenza virus
THHMRKKRGL

SEQ ID NO: 358810 - protein, 10 aa, Influenza virus
HHMRKKRGLF

SEQ ID NO: 358811 - protein, 10 aa, Influenza virus
HMRKKRGLFG

SEQ ID NO: 358812 - protein, 10 aa, Influenza virus
MRKKRGLFGA

SEQ ID NO: 358813 - protein, 10 aa, Influenza virus
EKRGLFGAIA

SEQ ID NO: 358814 - protein, 10 aa, Influenza virus
RGLFGAIAGF

SEQ ID NO: 358815 - protein, 10 aa, Influenza virus
GLFGAIAGFI

SEQ ID NO: 358816 - protein, 10 aa, Influenza virus
LFGAIAGFIE

SEQ ID NO: 358817 - protein, 10 aa, Influenza virus
FGAIAGFIEN

SEQ ID NO: 358818 - protein, 10 aa, Influenza virus
GAIAGFIENG

SEQ ID NO: 358819 - protein, 10 aa, Influenza virus
AIAGFIENGW

SEQ ID NO: 358820 - protein, 10 aa, Influenza virus
IAGFIENGWE

SEQ ID NO: 358821 - protein, 10 aa, Influenza virus
AGFIENGWEG

SEQ ID NO: 358822 - protein, 10 aa, Influenza virus
GFIENGWEGL

SEQ ID NO: 358823 - protein, 10 aa, Influenza virus
FIENGWEGLI

SEQ ID NO: 358824 - protein, 10 aa, Influenza virus
IENGWEGLID

SEQ ID NO: 358825 - protein, 10 aa, Influenza virus
ENGWEGLIDG

SEQ ID NO: 358826 - protein, 10 aa, Influenza virus
NGWEGLIDGW

SEQ ID NO: 358827 - protein, 10 aa, Influenza virus
GWEGLIDGWY

SEQ ID NO: 358828 - protein, 10 aa, Influenza virus
WEGLIDGWYG

SEQ ID NO: 358829 - protein, 10 aa, Influenza virus
EGLIDGWYGF

SEQ ID NO: 358830 - protein, 10 aa, Influenza virus
GLIDGWYGFR

SEQ ID NO: 358831 - protein, 10 aa, Influenza virus
LIDGWYGFRH

SEQ ID NO: 358832 - protein, 10 aa, Influenza virus
IDGWYGFRHQ

SEQ ID NO: 358833 - protein, 10 aa, Influenza virus
DGWYGFRHQN

SEQ ID NO: 358834 - protein, 10 aa, Influenza virus
GWYGFRHQNA

SEQ ID NO: 358835 - protein, 10 aa, Influenza virus
WYGFRHQNAQ

SEQ ID NO: 358836 - protein, 10 aa, Influenza virus
YGFRHQNAQG

SEQ ID NO: 358837 - protein, 10 aa, Influenza virus
GFRHQNAQGE

SEQ ID NO: 358838 - protein, 10 aa, Influenza virus
FRHQNAQGEG

SEQ ID NO: 358839 - protein, 10 aa, Influenza virus
RHQNAQGEGT

SEQ ID NO: 358840 - protein, 10 aa, Influenza virus
HQNAQGEGTA

SEQ ID NO: 358841 - protein, 10 aa, Influenza virus
QNAQGEGTAA

SEQ ID NO: 358842 - protein, 10 aa, Influenza virus
NAQGEGTAAD

SEQ ID NO: 358843 - protein, 10 aa, Influenza virus
AQGEGTAADY

SEQ ID NO: 358844 - protein, 10 aa, Influenza virus
QGEGTAADYK

SEQ ID NO: 358845 - protein, 10 aa, Influenza virus
GEGTAADYKS

SEQ ID NO: 358846 - protein, 10 aa, Influenza virus
EGTAADYKST

SEQ ID NO: 358847 - protein, 10 aa, Influenza virus
GTAADYKSTQ

SEQ ID NO: 358848 - protein, 10 aa, Influenza virus
TAADYKSTQS

SEQ ID NO: 358849 - protein, 10 aa, Influenza virus
AADYKSTQSA

SEQ ID NO: 358850 - protein, 10 aa, Influenza virus
ADYKSTQSAI

SEQ ID NO: 358851 - protein, 10 aa, Influenza virus
DYKSTQSAID

SEQ ID NO: 358852 - protein, 10 aa, Influenza virus
YKSTQSAIDQ

SEQ ID NO: 358853 - protein, 10 aa, Influenza virus
KSTQSAIDQI

SEQ ID NO: 358854 - protein, 10 aa, Influenza virus
STQSAIDQIT

SEQ ID NO: 358855 - protein, 10 aa, Influenza virus
TQSAIDQITG

SEQ ID NO: 358856 - protein, 10 aa, Influenza virus
QSAIDQITGK

SEQ ID NO: 358857 - protein, 10 aa, Influenza virus
SAIDQITGKL

SEQ ID NO: 358858 - protein, 10 aa, Influenza virus
AIDQITGKLN

SEQ ID NO: 358859 - protein, 10 aa, Influenza virus
IDQITGKLNR

SEQ ID NO: 358860 - protein, 10 aa, Influenza virus
DQITGKLNRL

SEQ ID NO: 358861 - protein, 10 aa, Influenza virus
QITGKLNRLI

SEQ ID NO: 358862 - protein, 10 aa, Influenza virus
ITGKLNRLIE

SEQ ID NO: 358863 - protein, 10 aa, Influenza virus
TGKLNRLIEK

SEQ ID NO: 358864 - protein, 10 aa, Influenza virus
GKLNRLIEKT

SEQ ID NO: 358865 - protein, 10 aa, Influenza virus
KLNRLIEKTN

SEQ ID NO: 358866 - protein, 10 aa, Influenza virus
LNRLIEKTNQ

SEQ ID NO: 358867 - protein, 10 aa, Influenza virus
NRLIEKTNQQ

SEQ ID NO: 358868 - protein, 10 aa, Influenza virus
RLIEKTNQQF

SEQ ID NO: 358869 - protein, 10 aa, Influenza virus
LIEKTNQQFE

SEQ ID NO: 358870 - protein, 10 aa, Influenza virus
IEKTNQQFEL

SEQ ID NO: 358871 - protein, 10 aa, Influenza virus
EKTNQQFELI

SEQ ID NO: 358872 - protein, 10 aa, Influenza virus
KTNQQFELID

SEQ ID NO: 358873 - protein, 10 aa, Influenza virus
TNQQFELIDN

SEQ ID NO: 358874 - protein, 10 aa, Influenza virus
NQQFELIDNE

SEQ ID NO: 358875 - protein, 10 aa, Influenza virus
QQFELIDNEF

SEQ ID NO: 358876 - protein, 10 aa, Influenza virus
QFELIDNEFT

SEQ ID NO: 358877 - protein, 10 aa, Influenza virus
FELIDNEFTE

SEQ ID NO: 358878 - protein, 10 aa, Influenza virus
EVEKQIGNVI

SEQ ID NO: 358879 - protein, 10 aa, Influenza virus
VEKQIGNVIN

SEQ ID NO: 358880 - protein, 10 aa, Influenza virus
EKQIGNVINW

SEQ ID NO: 358881 - protein, 10 aa, Influenza virus
KQIGNVINWT

SEQ ID NO: 358882 - protein, 10 aa, Influenza virus
QIGNVINWTR

SEQ ID NO: 358883 - protein, 10 aa, Influenza virus
IGNVINWTRD

SEQ ID NO: 358884 - protein, 10 aa, Influenza virus
GNVINWTRDS

SEQ ID NO: 358885 - protein, 10 aa, Influenza virus
NVINWTRDSM

SEQ ID NO: 358886 - protein, 10 aa, Influenza virus
VINWTRDSMT

SEQ ID NO: 358887 - protein, 10 aa, Influenza virus
INWTRDSMTE

SEQ ID NO: 358888 - protein, 10 aa, Influenza virus
TEVWSYNAEL

SEQ ID NO: 358889 - protein, 10 aa, Influenza virus
EVWSYNAELL

SEQ ID NO: 358890 - protein, 10 aa, Influenza virus
WSYNAELLVA

SEQ ID NO: 358891 - protein, 10 aa, Influenza virus
SYNAELLVAM

SEQ ID NO: 358892 - protein, 10 aa, Influenza virus
YNAELLVAME

SEQ ID NO: 358893 - protein, 10 aa, Influenza virus
NAELLVAMEN

SEQ ID NO: 358894 - protein, 10 aa, Influenza virus
AELLVAMENQ

SEQ ID NO: 358895 - protein, 10 aa, Influenza virus
ELLVAMENQH

SEQ ID NO: 358896 - protein, 10 aa, Influenza virus
LLVAMENQHT

SEQ ID NO: 358897 - protein, 10 aa, Influenza virus
LVAMENQHTI

SEQ ID NO: 358898 - protein, 10 aa, Influenza virus
VAMENQHTID

SEQ ID NO: 358899 - protein, 10 aa, Influenza virus
AMENQHTIDL

SEQ ID NO: 358900 - protein, 10 aa, Influenza virus
MENQHTIDLA

SEQ ID NO: 358901 - protein, 10 aa, Influenza virus
ENQHTIDLAD

SEQ ID NO: 358902 - protein, 10 aa, Influenza virus
NQHTIDLADS

SEQ ID NO: 358903 - protein, 10 aa, Influenza virus
QHTIDLADSE

SEQ ID NO: 358904 - protein, 10 aa, Influenza virus
HTIDLADSEM

SEQ ID NO: 358905 - protein, 10 aa, Influenza virus
TIDLADSEMN

SEQ ID NO: 358906 - protein, 10 aa, Influenza virus
IDLADSEMNK

SEQ ID NO: 358907 - protein, 10 aa, Influenza virus
DLADSEMNKL

SEQ ID NO: 358908 - protein, 10 aa, Influenza virus
LADSEMNKLY

SEQ ID NO: 358909 - protein, 10 aa, Influenza virus
ADSEMNKLYE

SEQ ID NO: 358910 - protein, 10 aa, Influenza virus
DSEMNKLYER

SEQ ID NO: 358911 - protein, 10 aa, Influenza virus
SEMNKLYERV

SEQ ID NO: 358912 - protein, 10 aa, Influenza virus
EMNKLYERVR

SEQ ID NO: 358913 - protein, 10 aa, Influenza virus
MNKLYERVKR

SEQ ID NO: 358914 - protein, 10 aa, Influenza virus
NKLYERVKRQ

SEQ ID NO: 358915 - protein, 10 aa, Influenza virus
KLYERVKRQL

SEQ ID NO: 358916 - protein, 10 aa, Influenza virus
LYERVKRQLR

SEQ ID NO: 358917 - protein, 10 aa, Influenza virus
YERVKRQLRE

SEQ ID NO: 358918 - protein, 10 aa, Influenza virus
ERVKRQLREN

SEQ ID NO: 358919 - protein, 10 aa, Influenza virus
RVKRQLRENA

SEQ ID NO: 358920 - protein, 10 aa, Influenza virus
VRRQLRENAE

SEQ ID NO: 358921 - protein, 10 aa, Influenza virus
RRQLRENAEE

SEQ ID NO: 358922 - protein, 10 aa, Influenza virus
RQLRENAEED

SEQ ID NO: 358923 - protein, 10 aa, Influenza virus
QLRENAEEDG

SEQ ID NO: 358924 - protein, 10 aa, Influenza virus
LRENAEEDGT

SEQ ID NO: 358925 - protein, 10 aa, Influenza virus
RENAEEDGTG

SEQ ID NO: 358926 - protein, 10 aa, Influenza virus
ENAEEDGTGC

SEQ ID NO: 358927 - protein, 10 aa, Influenza virus
NAEEDGTGCF

SEQ ID NO: 358928 - protein, 10 aa, Influenza virus
AEEDGTGCFE

SEQ ID NO: 358929 - protein, 10 aa, Influenza virus
EEDGTGCFEI

SEQ ID NO: 358930 - protein, 10 aa, Influenza virus
EDGTGCFEIF

SEQ ID NO: 358931 - protein, 10 aa, Influenza virus
DGTGCFEIFH

SEQ ID NO: 358932 - protein, 10 aa, Influenza virus
GTGCFEIFHK

SEQ ID NO: 358933 - protein, 10 aa, Influenza virus
TGCFEIFHKC

SEQ ID NO: 358934 - protein, 10 aa, Influenza virus
GCFEIFHKCD

SEQ ID NO: 358935 - protein, 10 aa, Influenza virus
CFEIFHKCDD

SEQ ID NO: 358936 - protein, 10 aa, Influenza virus
FEIFHKCDDD

SEQ ID NO: 358937 - protein, 10 aa, Influenza virus
EIFHKCDDDC

SEQ ID NO: 358938 - protein, 10 aa, Influenza virus
IFHKCDDDCM

SEQ ID NO: 358939 - protein, 10 aa, Influenza virus
CMASIRNNTY

SEQ ID NO: 358940 - protein, 10 aa, Influenza virus
MASIRNNTYD

SEQ ID NO: 358941 - protein, 10 aa, Influenza virus
ASIRNNTYDH

SEQ ID NO: 358942 - protein, 10 aa, Influenza virus
SIRNNTYDHS

SEQ ID NO: 358943 - protein, 10 aa, Influenza virus
IRNNTYDHSK

SEQ ID NO: 358944 - protein, 10 aa, Influenza virus
RNNTYDHSKY

SEQ ID NO: 358945 - protein, 10 aa, Influenza virus
NNTYDHSKYR

SEQ ID NO: 358946 - protein, 10 aa, Influenza virus
IDPVKLSSGY

SEQ ID NO: 358947 - protein, 10 aa, Influenza virus
DPVKLSSGYK

SEQ ID NO: 358948 - protein, 10 aa, Influenza virus
PVKLSSGYKD

SEQ ID NO: 358949 - protein, 10 aa, Influenza virus
VKLSSGYKDV

SEQ ID NO: 358950 - protein, 10 aa, Influenza virus
KLSSGYKDVI

SEQ ID NO: 358951 - protein, 10 aa, Influenza virus
LSSGYKDVIL

SEQ ID NO: 358952 - protein, 10 aa, Influenza virus
SSGYKDVILW

SEQ ID NO: 358953 - protein, 10 aa, Influenza virus
SGYKDVILWF

SEQ ID NO: 358954 - protein, 10 aa, Influenza virus
GYKDVILWFS

SEQ ID NO: 358955 - protein, 10 aa, Influenza virus
YKDVILWFSF

SEQ ID NO: 358956 - protein, 10 aa, Influenza virus
KDVILWFSFG

SEQ ID NO: 358957 - protein, 10 aa, Influenza virus
DVILWFSFGA

SEQ ID NO: 358958 - protein, 10 aa, Influenza virus
VILWFSFGAS

SEQ ID NO: 358959 - protein, 10 aa, Influenza virus
ILWFSFGASC

SEQ ID NO: 358960 - protein, 10 aa, Influenza virus
LWFSFGASCF

SEQ ID NO: 358961 - protein, 10 aa, Influenza virus
WFSFGASCFI

SEQ ID NO: 358962 - protein, 10 aa, Influenza virus
FSFGASCFIL

SEQ ID NO: 358963 - protein, 10 aa, Influenza virus
GASCFILLAI

SEQ ID NO: 358964 - protein, 10 aa, Influenza virus
LVFICVKNGN

SEQ ID NO: 358965 - protein, 10 aa, Influenza virus
VFICVKNGNM

SEQ ID NO: 358966 - protein, 10 aa, Influenza virus
FICVKNGNMR

SEQ ID NO: 358967 - protein, 10 aa, Influenza virus
ICVKNGNMRC

SEQ ID NO: 358968 - protein, 10 aa, Influenza virus
CVKNGNMRCT

SEQ ID NO: 358969 - protein, 10 aa, Influenza virus
VKNGNMRCTI

SEQ ID NO: 358970 - protein, 10 aa, Influenza virus
KNGNMRCTIC

SEQ ID NO: 358971 - protein, 10 aa, Influenza virus
NGNMRCTICI

SEQ ID NO: 358972 - protein, 10 aa, Influenza virus
MNPNQKLFAL

SEQ ID NO: 358973 - protein, 10 aa, Influenza virus
NPNQKLFALS

SEQ ID NO: 358974 - protein, 10 aa, Influenza virus
PNQKLFALSG

SEQ ID NO: 358975 - protein, 10 aa, Influenza virus
NQKLFALSGV

SEQ ID NO: 358976 - protein, 10 aa, Influenza virus
QKLFALSGVA

SEQ ID NO: 358977 - protein, 10 aa, Influenza virus
KLFALSGVAI

SEQ ID NO: 358978 - protein, 10 aa, Influenza virus
LFALSGVAIA

SEQ ID NO: 358979 - protein, 10 aa, Influenza virus
FALSGVAIAL

SEQ ID NO: 358980 - protein, 10 aa, Influenza virus
ALSGVAIALS

SEQ ID NO: 358981 - protein, 10 aa, Influenza virus
LSGVAIALSV

SEQ ID NO: 358982 - protein, 10 aa, Influenza virus
SGVAIALSVL

SEQ ID NO: 358983 - protein, 10 aa, Influenza virus
GVAIALSVLN

SEQ ID NO: 358984 - protein, 10 aa, Influenza virus
VAIALSVLNL

SEQ ID NO: 358985 - protein, 10 aa, Influenza virus
AIALSVLNLL

SEQ ID NO: 358986 - protein, 10 aa, Influenza virus
IALSVLNLLI

SEQ ID NO: 358987 - protein, 10 aa, Influenza virus
ALSVLNLLIG

SEQ ID NO: 358988 - protein, 10 aa, Influenza virus
LSVLNLLIGI

SEQ ID NO: 358989 - protein, 10 aa, Influenza virus
SVLNLLIGIS

SEQ ID NO: 358990 - protein, 10 aa, Influenza virus
VLNLLIGISN

SEQ ID NO: 358991 - protein, 10 aa, Influenza virus
LNLLIGISNV

SEQ ID NO: 358992 - protein, 10 aa, Influenza virus
NLLIGISNVG

SEQ ID NO: 358993 - protein, 10 aa, Influenza virus
LLIGISNVGL

SEQ ID NO: 358994 - protein, 10 aa, Influenza virus
LIGISNVGLN

SEQ ID NO: 358995 - protein, 10 aa, Influenza virus
SNVGLNVSLH

SEQ ID NO: 358996 - protein, 10 aa, Influenza virus
NVGLNVSLHL

SEQ ID NO: 358997 - protein, 10 aa, Influenza virus
ENTYVNNTTI

SEQ ID NO: 358998 - protein, 10 aa, Influenza virus
NTYVNNTTII

SEQ ID NO: 358999 - protein, 10 aa, Influenza virus
SYLLLNKSLC

SEQ ID NO: 359000 - protein, 10 aa, Influenza virus
YLLLNKSLCN

SEQ ID NO: 359001 - protein, 10 aa, Influenza virus
LLLNKSLCNV

SEQ ID NO: 359002 - protein, 10 aa, Influenza virus
LLNKSLCNVE

SEQ ID NO: 359003 - protein, 10 aa, Influenza virus
LNKSLCNVEG

SEQ ID NO: 359004 - protein, 10 aa, Influenza virus
NKSLCNVEGW

SEQ ID NO: 359005 - protein, 10 aa, Influenza virus
KSLCNVEGWV

SEQ ID NO: 359006 - protein, 10 aa, Influenza virus
SLCNVEGWVV

SEQ ID NO: 359007 - protein, 10 aa, Influenza virus
LCNVEGWVVI

SEQ ID NO: 359008 - protein, 10 aa, Influenza virus
VEGWVVIAKD

SEQ ID NO: 359009 - protein, 10 aa, Influenza virus
EGWVVIAKDN

SEQ ID NO: 359010 - protein, 10 aa, Influenza virus
GWVVIAKDNA

SEQ ID NO: 359011 - protein, 10 aa, Influenza virus
WVVIAKDNAV

SEQ ID NO: 359012 - protein, 10 aa, Influenza virus
VVIAKDNAVR

SEQ ID NO: 359013 - protein, 10 aa, Influenza virus
VIAKDNAVRF

SEQ ID NO: 359014 - protein, 10 aa, Influenza virus
IAKDNAVRFG

SEQ ID NO: 359015 - protein, 10 aa, Influenza virus
AKDNAVRFGE

SEQ ID NO: 359016 - protein, 10 aa, Influenza virus
KDNAVRFGES

SEQ ID NO: 359017 - protein, 10 aa, Influenza virus
DNAVRFGESE

SEQ ID NO: 359018 - protein, 10 aa, Influenza virus
NAVRFGESEQ

SEQ ID NO: 359019 - protein, 10 aa, Influenza virus
AVRFGESEQI

SEQ ID NO: 359020 - protein, 10 aa, Influenza virus
VRFGESEQII

SEQ ID NO: 359021 - protein, 10 aa, Influenza virus
RFGESEQIIV

SEQ ID NO: 359022 - protein, 10 aa, Influenza virus
FGESEQIIVT

SEQ ID NO: 359023 - protein, 10 aa, Influenza virus
GESEQIIVTR

SEQ ID NO: 359024 - protein, 10 aa, Influenza virus
ESEQIIVTRE

SEQ ID NO: 359025 - protein, 10 aa, Influenza virus
SEQIIVTREP

SEQ ID NO: 359026 - protein, 10 aa, Influenza virus
EQIIVTREPY

SEQ ID NO: 359027 - protein, 10 aa, Influenza virus
QIIVTREPYV

SEQ ID NO: 359028 - protein, 10 aa, Influenza virus
IIVTREPYVS

SEQ ID NO: 359029 - protein, 10 aa, Influenza virus
IVTREPYVSC

SEQ ID NO: 359030 - protein, 10 aa, Influenza virus
VTREPYVSCD

SEQ ID NO: 359031 - protein, 10 aa, Influenza virus
TREPYVSCDP

SEQ ID NO: 359032 - protein, 10 aa, Influenza virus
REPYVSCDPT

SEQ ID NO: 359033 - protein, 10 aa, Influenza virus
GCKMYALHQG

SEQ ID NO: 359034 - protein, 10 aa, Influenza virus
CKMYALHQGT

SEQ ID NO: 359035 - protein, 10 aa, Influenza virus
KMYALHQGTT

SEQ ID NO: 359036 - protein, 10 aa, Influenza virus
MYALHQGTTI

SEQ ID NO: 359037 - protein, 10 aa, Influenza virus
YALHQGTTIR

SEQ ID NO: 359038 - protein, 10 aa, Influenza virus
ALHQGTTIRN

SEQ ID NO: 359039 - protein, 10 aa, Influenza virus
LHQGTTIRNK

SEQ ID NO: 359040 - protein, 10 aa, Influenza virus
HQGTTIRNKH

SEQ ID NO: 359041 - protein, 10 aa, Influenza virus
QGTTIRNKHS

SEQ ID NO: 359042 - protein, 10 aa, Influenza virus
GTTIRNKHSN

SEQ ID NO: 359043 - protein, 10 aa, Influenza virus
TTIRNKHSNG

SEQ ID NO: 359044 - protein, 10 aa, Influenza virus
TIRNKHSNGT

SEQ ID NO: 359045 - protein, 10 aa, Influenza virus
IRNKHSNGTI

SEQ ID NO: 359046 - protein, 10 aa, Influenza virus
RNKHSNGTIH

SEQ ID NO: 359047 - protein, 10 aa, Influenza virus
NKHSNGTIHD

SEQ ID NO: 359048 - protein, 10 aa, Influenza virus
KHSNGTIHDR

SEQ ID NO: 359049 - protein, 10 aa, Influenza virus
HSNGTIHDRT

SEQ ID NO: 359050 - protein, 10 aa, Influenza virus
SNGTIHDRTA

SEQ ID NO: 359051 - protein, 10 aa, Influenza virus
NGTIHDRTAF

SEQ ID NO: 359052 - protein, 10 aa, Influenza virus
GTIHDRTAFR

SEQ ID NO: 359053 - protein, 10 aa, Influenza virus
TIHDRTAFRG

SEQ ID NO: 359054 - protein, 10 aa, Influenza virus
IHDRTAFRGL

SEQ ID NO: 359055 - protein, 10 aa, Influenza virus
HDRTAFRGLI

SEQ ID NO: 359056 - protein, 10 aa, Influenza virus
DRTAFRGLIS

SEQ ID NO: 359057 - protein, 10 aa, Influenza virus
RTAFRGLIST

SEQ ID NO: 359058 - protein, 10 aa, Influenza virus
FRGLISTPLG

SEQ ID NO: 359059 - protein, 10 aa, Influenza virus
SNSDFMCVGW

SEQ ID NO: 359060 - protein, 10 aa, Influenza virus
NSDFMCVGWS

SEQ ID NO: 359061 - protein, 10 aa, Influenza virus
SDFMCVGWSS

SEQ ID NO: 359062 - protein, 10 aa, Influenza virus
DFMCVGWSST

SEQ ID NO: 359063 - protein, 10 aa, Influenza virus
FMCVGWSSTT

SEQ ID NO: 359064 - protein, 10 aa, Influenza virus
MCVGWSSTTC

SEQ ID NO: 359065 - protein, 10 aa, Influenza virus
CVGWSSTTCH

SEQ ID NO: 359066 - protein, 10 aa, Influenza virus
VGWSSTTCHD

SEQ ID NO: 359067 - protein, 10 aa, Influenza virus
GWSSTTCHDG

SEQ ID NO: 359068 - protein, 10 aa, Influenza virus
WSSTTCHDGI

SEQ ID NO: 359069 - protein, 10 aa, Influenza virus
CHDGIGRMTI

SEQ ID NO: 359070 - protein, 10 aa, Influenza virus
HDGIGRMTIC

SEQ ID NO: 359071 - protein, 10 aa, Influenza virus
RMTICIQGNN

SEQ ID NO: 359072 - protein, 10 aa, Influenza virus
QGNNDNATAT

SEQ ID NO: 359073 - protein, 10 aa, Influenza virus
GNNDNATATV

SEQ ID NO: 359074 - protein, 10 aa, Influenza virus
NNDNATATVY

SEQ ID NO: 359075 - protein, 10 aa, Influenza virus
NDNATATVYY

SEQ ID NO: 359076 - protein, 10 aa, Influenza virus
DNATATVYYN

SEQ ID NO: 359077 - protein, 10 aa, Influenza virus
NATATVYYNR

SEQ ID NO: 359078 - protein, 10 aa, Influenza virus
ATATVYYNRR

SEQ ID NO: 359079 - protein, 10 aa, Influenza virus
TATVYYNRRL

SEQ ID NO: 359080 - protein, 10 aa, Influenza virus
ATVYYNRRLT

SEQ ID NO: 359081 - protein, 10 aa, Influenza virus
TVYYNRRLTT

SEQ ID NO: 359082 - protein, 10 aa, Influenza virus
VYYNRRLTTT

SEQ ID NO: 359083 - protein, 10 aa, Influenza virus
YYNRRLTTTI

SEQ ID NO: 359084 - protein, 10 aa, Influenza virus
RRLTTTIKTW

SEQ ID NO: 359085 - protein, 10 aa, Influenza virus
RLTTTIKTWA

SEQ ID NO: 359086 - protein, 10 aa, Influenza virus
LTTTIKTWAR

SEQ ID NO: 359087 - protein, 10 aa, Influenza virus
TTTIKTWARN

SEQ ID NO: 359088 - protein, 10 aa, Influenza virus
TTIKTWARNI

SEQ ID NO: 359089 - protein, 10 aa, Influenza virus
TIKTWARNIL

SEQ ID NO: 359090 - protein, 10 aa, Influenza virus
IKTWARNILR

SEQ ID NO: 359091 - protein, 10 aa, Influenza virus
KTWARNILRT

SEQ ID NO: 359092 - protein, 10 aa, Influenza virus
TWARNILRTQ

SEQ ID NO: 359093 - protein, 10 aa, Influenza virus
WARNILRTQE

SEQ ID NO: 359094 - protein, 10 aa, Influenza virus
ARNILRTQES

SEQ ID NO: 359095 - protein, 10 aa, Influenza virus
RNILRTQESE

SEQ ID NO: 359096 - protein, 10 aa, Influenza virus
NILRTQESEC

SEQ ID NO: 359097 - protein, 10 aa, Influenza virus
ILRTQESECV

SEQ ID NO: 359098 - protein, 10 aa, Influenza virus
LRTQESECVC

SEQ ID NO: 359099 - protein, 10 aa, Influenza virus
RTQESECVCH

SEQ ID NO: 359100 - protein, 10 aa, Influenza virus
TQESECVCHN

SEQ ID NO: 359101 - protein, 10 aa, Influenza virus
QESECVCHNG

SEQ ID NO: 359102 - protein, 10 aa, Influenza virus
ESECVCHNGT

SEQ ID NO: 359103 - protein, 10 aa, Influenza virus
SECVCHNGTC

SEQ ID NO: 359104 - protein, 10 aa, Influenza virus
ECVCHNGTCA

SEQ ID NO: 359105 - protein, 10 aa, Influenza virus
CVCHNGTCAV

SEQ ID NO: 359106 - protein, 10 aa, Influenza virus
HNGTCAVVMT

SEQ ID NO: 359107 - protein, 10 aa, Influenza virus
NGTCAVVMTD

SEQ ID NO: 359108 - protein, 10 aa, Influenza virus
GTCAVVMTDG

SEQ ID NO: 359109 - protein, 10 aa, Influenza virus
AVVMTDGSAS

SEQ ID NO: 359110 - protein, 10 aa, Influenza virus
VVMTDGSASS

SEQ ID NO: 359111 - protein, 10 aa, Influenza virus
MTDGSASSQA

SEQ ID NO: 359112 - protein, 10 aa, Influenza virus
LKGSARHIEE

SEQ ID NO: 359113 - protein, 10 aa, Influenza virus
KGSARHIEEC

SEQ ID NO: 359114 - protein, 10 aa, Influenza virus
GSARHIEECS

SEQ ID NO: 359115 - protein, 10 aa, Influenza virus
SARHIEECSC

SEQ ID NO: 359116 - protein, 10 aa, Influenza virus
ARHIEECSCY

SEQ ID NO: 359117 - protein, 10 aa, Influenza virus
RHIEECSCYG

SEQ ID NO: 359118 - protein, 10 aa, Influenza virus
HIEECSCYGH

SEQ ID NO: 359119 - protein, 10 aa, Influenza virus
IEECSCYGHN

SEQ ID NO: 359120 - protein, 10 aa, Influenza virus
VTCVCRDNWQ

SEQ ID NO: 359121 - protein, 10 aa, Influenza virus
TCVCRDNWQG

SEQ ID NO: 359122 - protein, 10 aa, Influenza virus
CVCRDNWQGA

SEQ ID NO: 359123 - protein, 10 aa, Influenza virus
VCRDNWQGAN

SEQ ID NO: 359124 - protein, 10 aa, Influenza virus
CRDNWQGANR

SEQ ID NO: 359125 - protein, 10 aa, Influenza virus
RDNWQGANRP

SEQ ID NO: 359126 - protein, 10 aa, Influenza virus
DNWQGANRPI

SEQ ID NO: 359127 - protein, 10 aa, Influenza virus
NWQGANRPII

SEQ ID NO: 359128 - protein, 10 aa, Influenza virus
WQGANRPIIE

SEQ ID NO: 359129 - protein, 10 aa, Influenza virus
QGANRPIIEI

SEQ ID NO: 359130 - protein, 10 aa, Influenza virus
GANRPIIEID

SEQ ID NO: 359131 - protein, 10 aa, Influenza virus
ANRPIIEIDM

SEQ ID NO: 359132 - protein, 10 aa, Influenza virus
NRPIIEIDMN

SEQ ID NO: 359133 - protein, 10 aa, Influenza virus
LEHTSRYVCT

SEQ ID NO: 359134 - protein, 10 aa, Influenza virus
EHTSRYVCTG

SEQ ID NO: 359135 - protein, 10 aa, Influenza virus
YVCTGILTDT

SEQ ID NO: 359136 - protein, 10 aa, Influenza virus
VCTGILTDTS

SEQ ID NO: 359137 - protein, 10 aa, Influenza virus
CTGILTDTSR

SEQ ID NO: 359138 - protein, 10 aa, Influenza virus
TGILTDTSRP

SEQ ID NO: 359139 - protein, 10 aa, Influenza virus
GILTDTSRPG

SEQ ID NO: 359140 - protein, 10 aa, Influenza virus
ILTDTSRPGD

SEQ ID NO: 359141 - protein, 10 aa, Influenza virus
LTDTSRPGDK

SEQ ID NO: 359142 - protein, 10 aa, Influenza virus
GDCSNPITGS

SEQ ID NO: 359143 - protein, 10 aa, Influenza virus
DCSNPITGSP

SEQ ID NO: 359144 - protein, 10 aa, Influenza virus
CSNPITGSPG

SEQ ID NO: 359145 - protein, 10 aa, Influenza virus
NPITGSPGAP

SEQ ID NO: 359146 - protein, 10 aa, Influenza virus
PITGSPGAPG

SEQ ID NO: 359147 - protein, 10 aa, Influenza virus
APGVKGFGFL

SEQ ID NO: 359148 - protein, 10 aa, Influenza virus
PGVKGFGFLN

SEQ ID NO: 359149 - protein, 10 aa, Influenza virus
GVKGFGFLNG

SEQ ID NO: 359150 - protein, 10 aa, Influenza virus
DNTWLGRTIS

SEQ ID NO: 359151 - protein, 10 aa, Influenza virus
NTWLGRTISP

SEQ ID NO: 359152 - protein, 10 aa, Influenza virus
TWLGRTISPR

SEQ ID NO: 359153 - protein, 10 aa, Influenza virus
WLGRTISPRS

SEQ ID NO: 359154 - protein, 10 aa, Influenza virus
LGRTISPRSR

SEQ ID NO: 359155 - protein, 10 aa, Influenza virus
GRTISPRSRS

SEQ ID NO: 359156 - protein, 10 aa, Influenza virus
RTISPRSRSG

SEQ ID NO: 359157 - protein, 10 aa, Influenza virus
TISPRSRSGF

SEQ ID NO: 359158 - protein, 10 aa, Influenza virus
ISPRSRSGFE

SEQ ID NO: 359159 - protein, 10 aa, Influenza virus
SPRSRSGFEM

SEQ ID NO: 359160 - protein, 10 aa, Influenza virus
PRSRSGFEML

SEQ ID NO: 359161 - protein, 10 aa, Influenza virus
RSRSGFEMLK

SEQ ID NO: 359162 - protein, 10 aa, Influenza virus
SRSGFEMLKI

SEQ ID NO: 359163 - protein, 10 aa, Influenza virus
RSGFEMLKIP

SEQ ID NO: 359164 - protein, 10 aa, Influenza virus
SGFEMLKIPN

SEQ ID NO: 359165 - protein, 10 aa, Influenza virus
GFEMLKIPNA

SEQ ID NO: 359166 - protein, 10 aa, Influenza virus
FEMLKIPNAG

SEQ ID NO: 359167 - protein, 10 aa, Influenza virus
EMLKIPNAGT

SEQ ID NO: 359168 - protein, 10 aa, Influenza virus
MLKIPNAGTD

SEQ ID NO: 359169 - protein, 10 aa, Influenza virus
LKIPNAGTDP

SEQ ID NO: 359170 - protein, 10 aa, Influenza virus
RQEIVDNNNW

SEQ ID NO: 359171 - protein, 10 aa, Influenza virus
QEIVDNNNWS

SEQ ID NO: 359172 - protein, 10 aa, Influenza virus
EIVDNNNWSG

SEQ ID NO: 359173 - protein, 10 aa, Influenza virus
IVDNNNWSGY

SEQ ID NO: 359174 - protein, 10 aa, Influenza virus
VDNNNWSGYS

SEQ ID NO: 359175 - protein, 10 aa, Influenza virus
DNNNWSGYSG

SEQ ID NO: 359176 - protein, 10 aa, Influenza virus
NNNWSGYSGS

SEQ ID NO: 359177 - protein, 10 aa, Influenza virus
NNWSGYSGSF

SEQ ID NO: 359178 - protein, 10 aa, Influenza virus
NWSGYSGSFI

SEQ ID NO: 359179 - protein, 10 aa, Influenza virus
WSGYSGSFID

SEQ ID NO: 359180 - protein, 10 aa, Influenza virus
SGYSGSFIDY

SEQ ID NO: 359181 - protein, 10 aa, Influenza virus
GYSGSFIDYW

SEQ ID NO: 359182 - protein, 10 aa, Influenza virus
YSGSFIDYWN

SEQ ID NO: 359183 - protein, 10 aa, Influenza virus
SGSFIDYWND

SEQ ID NO: 359184 - protein, 10 aa, Influenza virus
SECYNPCFYV

SEQ ID NO: 359185 - protein, 10 aa, Influenza virus
ECYNPCFYVE

SEQ ID NO: 359186 - protein, 10 aa, Influenza virus
CYNPCFYVEL

SEQ ID NO: 359187 - protein, 10 aa, Influenza virus
YNPCFYVELI

SEQ ID NO: 359188 - protein, 10 aa, Influenza virus
NPCFYVELIR

SEQ ID NO: 359189 - protein, 10 aa, Influenza virus
PCFYVELIRG

SEQ ID NO: 359190 - protein, 10 aa, Influenza virus
CFYVELIRGR

SEQ ID NO: 359191 - protein, 10 aa, Influenza virus
FYVELIRGRP

SEQ ID NO: 359192 - protein, 10 aa, Influenza virus
YVELIRGRPE

SEQ ID NO: 359193 - protein, 10 aa, Influenza virus
VELIRGRPEE

SEQ ID NO: 359194 - protein, 10 aa, Influenza virus
ELIRGRPEEA

SEQ ID NO: 359195 - protein, 10 aa, Influenza virus
LIRGRPEEAK

SEQ ID NO: 359196 - protein, 10 aa, Influenza virus
IRGRPEEAKY

SEQ ID NO: 359197 - protein, 10 aa, Influenza virus
RGRPEEAKYV

SEQ ID NO: 359198 - protein, 10 aa, Influenza virus
GRPEEAKYVW

SEQ ID NO: 359199 - protein, 10 aa, Influenza virus
RPEEAKYVWW

SEQ ID NO: 359200 - protein, 10 aa, Influenza virus
PEEAKYVWWT

SEQ ID NO: 359201 - protein, 10 aa, Influenza virus
EEAKYVWWTS

SEQ ID NO: 359202 - protein, 10 aa, Influenza virus
EAKYVWWTSN

SEQ ID NO: 359203 - protein, 10 aa, Influenza virus
AKYVWWTSNS

SEQ ID NO: 359204 - protein, 10 aa, Influenza virus
KYVWWTSNSL

SEQ ID NO: 359205 - protein, 10 aa, Influenza virus
YVWWTSNSLI

SEQ ID NO: 359206 - protein, 10 aa, Influenza virus
VWWTSNSLIA

SEQ ID NO: 359207 - protein, 10 aa, Influenza virus
WWTSNSLIAL

SEQ ID NO: 359208 - protein, 10 aa, Influenza virus
WTSNSLIALC

SEQ ID NO: 359209 - protein, 10 aa, Influenza virus
TSNSLIALCG

SEQ ID NO: 359210 - protein, 10 aa, Influenza virus
SNSLIALCGS

SEQ ID NO: 359211 - protein, 10 aa, Influenza virus
NSLIALCGSP

SEQ ID NO: 359212 - protein, 10 aa, Influenza virus
PVGSGSFPDG

SEQ ID NO: 359213 - protein, 10 aa, Influenza virus
VGSGSFPDGA

SEQ ID NO: 359214 - protein, 10 aa, Influenza virus
GSGSFPDGAQ

SEQ ID NO: 359215 - protein, 10 aa, Influenza virus
SGSFPDGAQI

SEQ ID NO: 359216 - protein, 10 aa, Influenza virus
GSFPDGAQIQ

SEQ ID NO: 359217 - protein, 10 aa, Influenza virus
SFPDGAQIQY

SEQ ID NO: 359218 - protein, 10 aa, Influenza virus
FPDGAQIQYF

SEQ ID NO: 359219 - protein, 10 aa, Influenza virus
PDGAQIQYFS

SEQ ID NO: 359220 - protein, 10 aa, Influenza virus
LLASTNAYDR

SEQ ID NO: 359221 - protein, 10 aa, Influenza virus
LASTNAYDRI

SEQ ID NO: 359222 - protein, 10 aa, Influenza virus
ASTNAYDRIC

SEQ ID NO: 359223 - protein, 10 aa, Influenza virus
STNAYDRICI

SEQ ID NO: 359224 - protein, 10 aa, Influenza virus
TNAYDRICIG

SEQ ID NO: 359225 - protein, 10 aa, Influenza virus
NAYDRICIGY

SEQ ID NO: 359226 - protein, 10 aa, Influenza virus
AYDRICIGYQ

SEQ ID NO: 359227 - protein, 10 aa, Influenza virus
YDRICIGYQS

SEQ ID NO: 359228 - protein, 10 aa, Influenza virus
DRICIGYQSN

SEQ ID NO: 359229 - protein, 10 aa, Influenza virus
RICIGYQSNN

SEQ ID NO: 359230 - protein, 10 aa, Influenza virus
ICIGYQSNNS

SEQ ID NO: 359231 - protein, 10 aa, Influenza virus
CIGYQSNNST

SEQ ID NO: 359232 - protein, 10 aa, Influenza virus
IGYQSNNSTD

SEQ ID NO: 359233 - protein, 10 aa, Influenza virus
GYQSNNSTDT

SEQ ID NO: 359234 - protein, 10 aa, Influenza virus
YQSNNSTDTV

SEQ ID NO: 359235 - protein, 10 aa, Influenza virus
QSNNSTDTVN

SEQ ID NO: 359236 - protein, 10 aa, Influenza virus
SNNSTDTVNT

SEQ ID NO: 359237 - protein, 10 aa, Influenza virus
NNSTDTVNTL

SEQ ID NO: 359238 - protein, 10 aa, Influenza virus
NSTDTVNTLI

SEQ ID NO: 359239 - protein, 10 aa, Influenza virus
STDTVNTLIE

SEQ ID NO: 359240 - protein, 10 aa, Influenza virus
TDTVNTLIEQ

SEQ ID NO: 359241 - protein, 10 aa, Influenza virus
TLIEQNVPVT

SEQ ID NO: 359242 - protein, 10 aa, Influenza virus
LIEQNVPVTQ

SEQ ID NO: 359243 - protein, 10 aa, Influenza virus
EQNVPVTQTM

SEQ ID NO: 359244 - protein, 10 aa, Influenza virus
QNVPVTQTME

SEQ ID NO: 359245 - protein, 10 aa, Influenza virus
NVPVTQTMEL

SEQ ID NO: 359246 - protein, 10 aa, Influenza virus
VPVTQTMELV

SEQ ID NO: 359247 - protein, 10 aa, Influenza virus
PVTQTMELVE

SEQ ID NO: 359248 - protein, 10 aa, Influenza virus
VTQTMELVET

SEQ ID NO: 359249 - protein, 10 aa, Influenza virus
TQTMELVETE

SEQ ID NO: 359250 - protein, 10 aa, Influenza virus
QTMELVETEK

SEQ ID NO: 359251 - protein, 10 aa, Influenza virus
TMELVETEKH

SEQ ID NO: 359252 - protein, 10 aa, Influenza virus
EKHPAYCNTD

SEQ ID NO: 359253 - protein, 10 aa, Influenza virus
KHPAYCNTDL

SEQ ID NO: 359254 - protein, 10 aa, Influenza virus
HPAYCNTDLG

SEQ ID NO: 359255 - protein, 10 aa, Influenza virus
PAYCNTDLGT

SEQ ID NO: 359256 - protein, 10 aa, Influenza virus
AYCNTDLGAP

SEQ ID NO: 359257 - protein, 10 aa, Influenza virus
YCNTDLGAPL

SEQ ID NO: 359258 - protein, 10 aa, Influenza virus
CNTDLGAPLE

SEQ ID NO: 359259 - protein, 10 aa, Influenza virus
NTDLGAPLEL

SEQ ID NO: 359260 - protein, 10 aa, Influenza virus
TDLGAPLELR

SEQ ID NO: 359261 - protein, 10 aa, Influenza virus
DLGAPLELRD

SEQ ID NO: 359262 - protein, 10 aa, Influenza virus
LGAPLELRDC

SEQ ID NO: 359263 - protein, 10 aa, Influenza virus
GAPLELRDCK

SEQ ID NO: 359264 - protein, 10 aa, Influenza virus
APLELRDCKI

SEQ ID NO: 359265 - protein, 10 aa, Influenza virus
PLELRDCKIE

SEQ ID NO: 359266 - protein, 10 aa, Influenza virus
LELRDCKIEA

SEQ ID NO: 359267 - protein, 10 aa, Influenza virus
ELRDCKIEAV

SEQ ID NO: 359268 - protein, 10 aa, Influenza virus
LRDCKIEAVI

SEQ ID NO: 359269 - protein, 10 aa, Influenza virus
RDCKIEAVIY

SEQ ID NO: 359270 - protein, 10 aa, Influenza virus
DCKIEAVIYG

SEQ ID NO: 359271 - protein, 10 aa, Influenza virus
CKIEAVIYGN

SEQ ID NO: 359272 - protein, 10 aa, Influenza virus
KIEAVIYGNP

SEQ ID NO: 359273 - protein, 10 aa, Influenza virus
IEAVIYGNPK

SEQ ID NO: 359274 - protein, 10 aa, Influenza virus
EAVIYGNPKC

SEQ ID NO: 359275 - protein, 10 aa, Influenza virus
AVIYGNPKCD

SEQ ID NO: 359276 - protein, 10 aa, Influenza virus
VIYGNPKCDI

SEQ ID NO: 359277 - protein, 10 aa, Influenza virus
IYGNPKCDIH

SEQ ID NO: 359278 - protein, 10 aa, Influenza virus
YGNPKCDIHL

SEQ ID NO: 359279 - protein, 10 aa, Influenza virus
GNPKCDIHLK

SEQ ID NO: 359280 - protein, 10 aa, Influenza virus
NPKCDIHLKD

SEQ ID NO: 359281 - protein, 10 aa, Influenza virus
PKCDIHLKDQ

SEQ ID NO: 359282 - protein, 10 aa, Influenza virus
HLKDQGWSYI

SEQ ID NO: 359283 - protein, 10 aa, Influenza virus
LKDQGWSYIV

SEQ ID NO: 359284 - protein, 10 aa, Influenza virus
KDQGWSYIVE

SEQ ID NO: 359285 - protein, 10 aa, Influenza virus
DQGWSYIVER

SEQ ID NO: 359286 - protein, 10 aa, Influenza virus
QGWSYIVERP

SEQ ID NO: 359287 - protein, 10 aa, Influenza virus
GWSYIVERPS

SEQ ID NO: 359288 - protein, 10 aa, Influenza virus
WSYIVERPSA

SEQ ID NO: 359289 - protein, 10 aa, Influenza virus
SYIVERPSAP

SEQ ID NO: 359290 - protein, 10 aa, Influenza virus
YIVERPSAPE

SEQ ID NO: 359291 - protein, 10 aa, Influenza virus
IVERPSAPEG

SEQ ID NO: 359292 - protein, 10 aa, Influenza virus
VERPSAPEGM

SEQ ID NO: 359293 - protein, 10 aa, Influenza virus
ERPSAPEGMC

SEQ ID NO: 359294 - protein, 10 aa, Influenza virus
RPSAPEGMCY

SEQ ID NO: 359295 - protein, 10 aa, Influenza virus
PSAPEGMCYP

SEQ ID NO: 359296 - protein, 10 aa, Influenza virus
SAPEGMCYPG

SEQ ID NO: 359297 - protein, 10 aa, Influenza virus
APEGMCYPGS

SEQ ID NO: 359298 - protein, 10 aa, Influenza virus
PEGMCYPGSV

SEQ ID NO: 359299 - protein, 10 aa, Influenza virus
EGMCYPGSVE

SEQ ID NO: 359300 - protein, 10 aa, Influenza virus
GMCYPGSVEN

SEQ ID NO: 359301 - protein, 10 aa, Influenza virus
MCYPGSVENL

SEQ ID NO: 359302 - protein, 10 aa, Influenza virus
CYPGSVENLE

SEQ ID NO: 359303 - protein, 10 aa, Influenza virus
YPGSVENLEE

SEQ ID NO: 359304 - protein, 10 aa, Influenza virus
PGSVENLEEL

SEQ ID NO: 359305 - protein, 10 aa, Influenza virus
GSVENLEELR

SEQ ID NO: 359306 - protein, 10 aa, Influenza virus
SVENLEELRF

SEQ ID NO: 359307 - protein, 10 aa, Influenza virus
VENLEELRFV

SEQ ID NO: 359308 - protein, 10 aa, Influenza virus
ENLEELRFVF

SEQ ID NO: 359309 - protein, 10 aa, Influenza virus
NLEELRFVFS

SEQ ID NO: 359310 - protein, 10 aa, Influenza virus
LEELRFVFSN

SEQ ID NO: 359311 - protein, 10 aa, Influenza virus
EELRFVFSNA

SEQ ID NO: 359312 - protein, 10 aa, Influenza virus
ELRFVFSNAA

SEQ ID NO: 359313 - protein, 10 aa, Influenza virus
LRFVFSNAAS

SEQ ID NO: 359314 - protein, 10 aa, Influenza virus
RFVFSNAASY

SEQ ID NO: 359315 - protein, 10 aa, Influenza virus
FVFSNAASYK

SEQ ID NO: 359316 - protein, 10 aa, Influenza virus
VFSNAASYKR

SEQ ID NO: 359317 - protein, 10 aa, Influenza virus
FSNAASYKRI

SEQ ID NO: 359318 - protein, 10 aa, Influenza virus
SNAASYKRIR

SEQ ID NO: 359319 - protein, 10 aa, Influenza virus
NAASYKRIRL

SEQ ID NO: 359320 - protein, 10 aa, Influenza virus
AASYKRIRLF

SEQ ID NO: 359321 - protein, 10 aa, Influenza virus
ASYKRIRLFD

SEQ ID NO: 359322 - protein, 10 aa, Influenza virus
SYKRIRLFDY

SEQ ID NO: 359323 - protein, 10 aa, Influenza virus
YKRIRLFDYS

SEQ ID NO: 359324 - protein, 10 aa, Influenza virus
KRIRLFDYSR

SEQ ID NO: 359325 - protein, 10 aa, Influenza virus
RIRLFDYSRW

SEQ ID NO: 359326 - protein, 10 aa, Influenza virus
IRLFDYSRWN

SEQ ID NO: 359327 - protein, 10 aa, Influenza virus
RLFDYSRWNV

SEQ ID NO: 359328 - protein, 10 aa, Influenza virus
LFDYSRWNVT

SEQ ID NO: 359329 - protein, 10 aa, Influenza virus
WNVTSSGTSK

SEQ ID NO: 359330 - protein, 10 aa, Influenza virus
NVTSSGTSKA

SEQ ID NO: 359331 - protein, 10 aa, Influenza virus
VTSSGTSKAC

SEQ ID NO: 359332 - protein, 10 aa, Influenza virus
TSSGTSKACN

SEQ ID NO: 359333 - protein, 10 aa, Influenza virus
SSGTSKACNA

SEQ ID NO: 359334 - protein, 10 aa, Influenza virus
SGTSKACNAS

SEQ ID NO: 359335 - protein, 10 aa, Influenza virus
GTSKACNAST

SEQ ID NO: 359336 - protein, 10 aa, Influenza virus
TSKACNASTG

SEQ ID NO: 359337 - protein, 10 aa, Influenza virus
SKACNASTGG

SEQ ID NO: 359338 - protein, 10 aa, Influenza virus
KACNASTGGQ

SEQ ID NO: 359339 - protein, 10 aa, Influenza virus
ACNASTGGQS

SEQ ID NO: 359340 - protein, 10 aa, Influenza virus
CNASTGGQSF

SEQ ID NO: 359341 - protein, 10 aa, Influenza virus
NASTGGQSFY

SEQ ID NO: 359342 - protein, 10 aa, Influenza virus
ASTGGQSFYR

SEQ ID NO: 359343 - protein, 10 aa, Influenza virus
STGGQSFYRS

SEQ ID NO: 359344 - protein, 10 aa, Influenza virus
TGGQSFYRSI

SEQ ID NO: 359345 - protein, 10 aa, Influenza virus
GGQSFYRSIN

SEQ ID NO: 359346 - protein, 10 aa, Influenza virus
GQSFYRSINW

SEQ ID NO: 359347 - protein, 10 aa, Influenza virus
QSFYRSINWL

SEQ ID NO: 359348 - protein, 10 aa, Influenza virus
SFYRSINWLT

SEQ ID NO: 359349 - protein, 10 aa, Influenza virus
FYRSINWLTK

SEQ ID NO: 359350 - protein, 10 aa, Influenza virus
YRSINWLTKK

SEQ ID NO: 359351 - protein, 10 aa, Influenza virus
RSINWLTKKK

SEQ ID NO: 359352 - protein, 10 aa, Influenza virus
SINWLTKKKP

SEQ ID NO: 359353 - protein, 10 aa, Influenza virus
INWLTKKKPD

SEQ ID NO: 359354 - protein, 10 aa, Influenza virus
NWLTKKKPDT

SEQ ID NO: 359355 - protein, 10 aa, Influenza virus
WLTKKKPDTY

SEQ ID NO: 359356 - protein, 10 aa, Influenza virus
LTKKKPDTYD

SEQ ID NO: 359357 - protein, 10 aa, Influenza virus
TKKKPDTYDF

SEQ ID NO: 359358 - protein, 10 aa, Influenza virus
KKKPDTYDFN

SEQ ID NO: 359359 - protein, 10 aa, Influenza virus
KKPDTYDFNE

SEQ ID NO: 359360 - protein, 10 aa, Influenza virus
KPDTYDFNEG

SEQ ID NO: 359361 - protein, 10 aa, Influenza virus
NPEAYNFNEG

SEQ ID NO: 359362 - protein, 10 aa, Influenza virus
PDTYDFNEGS

SEQ ID NO: 359363 - protein, 10 aa, Influenza virus
DTYDFNEGSY

SEQ ID NO: 359364 - protein, 10 aa, Influenza virus
NNEDGDIIFL

SEQ ID NO: 359365 - protein, 10 aa, Influenza virus
NEDGDIIFLW

SEQ ID NO: 359366 - protein, 10 aa, Influenza virus
EDGDIIFLWG

SEQ ID NO: 359367 - protein, 10 aa, Influenza virus
DGDIIFLWGI

SEQ ID NO: 359368 - protein, 10 aa, Influenza virus
GDIIFLWGIH

SEQ ID NO: 359369 - protein, 10 aa, Influenza virus
DIIFLWGIHH

SEQ ID NO: 359370 - protein, 10 aa, Influenza virus
IIFLWGIHHP

SEQ ID NO: 359371 - protein, 10 aa, Influenza virus
IFLWGIHHPP

SEQ ID NO: 359372 - protein, 10 aa, Influenza virus
FLWGIHHPPD

SEQ ID NO: 359373 - protein, 10 aa, Influenza virus
LWGIHHPPDT

SEQ ID NO: 359374 - protein, 10 aa, Influenza virus
WGIHHPPDTK

SEQ ID NO: 359375 - protein, 10 aa, Influenza virus
GIHHPPDTKE

SEQ ID NO: 359376 - protein, 10 aa, Influenza virus
IHHPPDTKEQ

SEQ ID NO: 359377 - protein, 10 aa, Influenza virus
HHPPDTKEQT

SEQ ID NO: 359378 - protein, 10 aa, Influenza virus
TKEQTTLYKN

SEQ ID NO: 359379 - protein, 10 aa, Influenza virus
KEQTTLYKNA

SEQ ID NO: 359380 - protein, 10 aa, Influenza virus
EQTTLYKNAN

SEQ ID NO: 359381 - protein, 10 aa, Influenza virus
QTTLYKNANT

SEQ ID NO: 359382 - protein, 10 aa, Influenza virus
TTLYKNANTL

SEQ ID NO: 359383 - protein, 10 aa, Influenza virus
TLYKNANTLS

SEQ ID NO: 359384 - protein, 10 aa, Influenza virus
LYKNANTLSS

SEQ ID NO: 359385 - protein, 10 aa, Influenza virus
YKNANTLSSV

SEQ ID NO: 359386 - protein, 10 aa, Influenza virus
KNANTLSSVT

SEQ ID NO: 359387 - protein, 10 aa, Influenza virus
NANTLSSVTT

SEQ ID NO: 359388 - protein, 10 aa, Influenza virus
ANTLSSVTTN

SEQ ID NO: 359389 - protein, 10 aa, Influenza virus
NTLSSVTTNT

SEQ ID NO: 359390 - protein, 10 aa, Influenza virus
TLSSVTTNTI

SEQ ID NO: 359391 - protein, 10 aa, Influenza virus
LSSVTTNTIN

SEQ ID NO: 359392 - protein, 10 aa, Influenza virus
SSVTTNTINR

SEQ ID NO: 359393 - protein, 10 aa, Influenza virus
SVTTNTINRS

SEQ ID NO: 359394 - protein, 10 aa, Influenza virus
VTTNTINRSF

SEQ ID NO: 359395 - protein, 10 aa, Influenza virus
TTNTINRSFQ

SEQ ID NO: 359396 - protein, 10 aa, Influenza virus
TNTINRSFQP

SEQ ID NO: 359397 - protein, 10 aa, Influenza virus
NTINRSFQPN

SEQ ID NO: 359398 - protein, 10 aa, Influenza virus
TINRSFQPNI

SEQ ID NO: 359399 - protein, 10 aa, Influenza virus
INRSFQPNIG

SEQ ID NO: 359400 - protein, 10 aa, Influenza virus
NRSFQPNIGP

SEQ ID NO: 359401 - protein, 10 aa, Influenza virus
RSFQPNIGPR

SEQ ID NO: 359402 - protein, 10 aa, Influenza virus
SFQPNIGPRP

SEQ ID NO: 359403 - protein, 10 aa, Influenza virus
FQPNIGPRPL

SEQ ID NO: 359404 - protein, 10 aa, Influenza virus
QPNIGPRPLV

SEQ ID NO: 359405 - protein, 10 aa, Influenza virus
PNIGPRPLVR

SEQ ID NO: 359406 - protein, 10 aa, Influenza virus
NIGPRPLVRG

SEQ ID NO: 359407 - protein, 10 aa, Influenza virus
IGPRPLVRGQ

SEQ ID NO: 359408 - protein, 10 aa, Influenza virus
GPRPLVRGQQ

SEQ ID NO: 359409 - protein, 10 aa, Influenza virus
PRPLVRGQQG

SEQ ID NO: 359410 - protein, 10 aa, Influenza virus
RPLVRGQQGR

SEQ ID NO: 359411 - protein, 10 aa, Influenza virus
PLVRGQQGRM

SEQ ID NO: 359412 - protein, 10 aa, Influenza virus
LVRGQQGRMD

SEQ ID NO: 359413 - protein, 10 aa, Influenza virus
VRGQQGRMDY

SEQ ID NO: 359414 - protein, 10 aa, Influenza virus
RGQQGRMDYY

SEQ ID NO: 359415 - protein, 10 aa, Influenza virus
GQQGRMDYYW

SEQ ID NO: 359416 - protein, 10 aa, Influenza virus
QQGRMDYYWG

SEQ ID NO: 359417 - protein, 10 aa, Influenza virus
QGRMDYYWGI

SEQ ID NO: 359418 - protein, 10 aa, Influenza virus
GRMDYYWGIL

SEQ ID NO: 359419 - protein, 10 aa, Influenza virus
RMDYYWGILK

SEQ ID NO: 359420 - protein, 10 aa, Influenza virus
MDYYWGILKR

SEQ ID NO: 359421 - protein, 10 aa, Influenza virus
DYYWGILKRG

SEQ ID NO: 359422 - protein, 10 aa, Influenza virus
YYWGILKRGE

SEQ ID NO: 359423 - protein, 10 aa, Influenza virus
YWGILKRGET

SEQ ID NO: 359424 - protein, 10 aa, Influenza virus
WGILKRGETL

SEQ ID NO: 359425 - protein, 10 aa, Influenza virus
GILKRGETLK

SEQ ID NO: 359426 - protein, 10 aa, Influenza virus
ILKRGETLKI

SEQ ID NO: 359427 - protein, 10 aa, Influenza virus
LKRGETLKIR

SEQ ID NO: 359428 - protein, 10 aa, Influenza virus
KRGETLKIRT

SEQ ID NO: 359429 - protein, 10 aa, Influenza virus
RGETLKIRTN

SEQ ID NO: 359430 - protein, 10 aa, Influenza virus
GETLKIRTNG

SEQ ID NO: 359431 - protein, 10 aa, Influenza virus
ETLKIRTNGN

SEQ ID NO: 359432 - protein, 10 aa, Influenza virus
TLKIRTNGNL

SEQ ID NO: 359433 - protein, 10 aa, Influenza virus
LKIRTNGNLI

SEQ ID NO: 359434 - protein, 10 aa, Influenza virus
KIRTNGNLIA

SEQ ID NO: 359435 - protein, 10 aa, Influenza virus
IRTNGNLIAP

SEQ ID NO: 359436 - protein, 10 aa, Influenza virus
RTNGNLIAPE

SEQ ID NO: 359437 - protein, 10 aa, Influenza virus
TNGNLIAPEF

SEQ ID NO: 359438 - protein, 10 aa, Influenza virus
NGNLIAPEFG

SEQ ID NO: 359439 - protein, 10 aa, Influenza virus
GNLIAPEFGY

SEQ ID NO: 359440 - protein, 10 aa, Influenza virus
NLIAPEFGYL

SEQ ID NO: 359441 - protein, 10 aa, Influenza virus
LIAPEFGYLL

SEQ ID NO: 359442 - protein, 10 aa, Influenza virus
IAPEFGYLLK

SEQ ID NO: 359443 - protein, 10 aa, Influenza virus
APEFGYLLKG

SEQ ID NO: 359444 - protein, 10 aa, Influenza virus
PEFGYLLKGE

SEQ ID NO: 359445 - protein, 10 aa, Influenza virus
EFGYLLKGES

SEQ ID NO: 359446 - protein, 10 aa, Influenza virus
FGYLLKGESH

SEQ ID NO: 359447 - protein, 10 aa, Influenza virus
GYLLKGESHG

SEQ ID NO: 359448 - protein, 10 aa, Influenza virus
YLLKGESHGR

SEQ ID NO: 359449 - protein, 10 aa, Influenza virus
GESHGRIIQN

SEQ ID NO: 359450 - protein, 10 aa, Influenza virus
ESHGRIIQNE

SEQ ID NO: 359451 - protein, 10 aa, Influenza virus
SHGRIIQNED

SEQ ID NO: 359452 - protein, 10 aa, Influenza virus
HGRIIQNEDI

SEQ ID NO: 359453 - protein, 10 aa, Influenza virus
GRIIQNEDIP

SEQ ID NO: 359454 - protein, 10 aa, Influenza virus
RIIQNEDIPI

SEQ ID NO: 359455 - protein, 10 aa, Influenza virus
IIQNEDIPIG

SEQ ID NO: 359456 - protein, 10 aa, Influenza virus
IQNEDIPIGN

SEQ ID NO: 359457 - protein, 10 aa, Influenza virus
QNEDIPIGNC

SEQ ID NO: 359458 - protein, 10 aa, Influenza virus
CHTKCQTYAG

SEQ ID NO: 359459 - protein, 10 aa, Influenza virus
HTKCQTYAGA

SEQ ID NO: 359460 - protein, 10 aa, Influenza virus
TKCQTYAGAI

SEQ ID NO: 359461 - protein, 10 aa, Influenza virus
KCQTYAGAIN

SEQ ID NO: 359462 - protein, 10 aa, Influenza virus
CQTYAGAINS

SEQ ID NO: 359463 - protein, 10 aa, Influenza virus
QTYAGAINSS

SEQ ID NO: 359464 - protein, 10 aa, Influenza virus
TYAGAINSSK

SEQ ID NO: 359465 - protein, 10 aa, Influenza virus
YAGAINSSKP

SEQ ID NO: 359466 - protein, 10 aa, Influenza virus
GAINSSKPFQ

SEQ ID NO: 359467 - protein, 10 aa, Influenza virus
AINSSKPFQN

SEQ ID NO: 359468 - protein, 10 aa, Influenza virus
INSSKPFQNA

SEQ ID NO: 359469 - protein, 10 aa, Influenza virus
NSSKPFQNAS

SEQ ID NO: 359470 - protein, 10 aa, Influenza virus
SSKPFQNASR

SEQ ID NO: 359471 - protein, 10 aa, Influenza virus
SKPFQNASRH

SEQ ID NO: 359472 - protein, 10 aa, Influenza virus
PFQNASRHYM

SEQ ID NO: 359473 - protein, 10 aa, Influenza virus
FQNASRHYMG

SEQ ID NO: 359474 - protein, 10 aa, Influenza virus
QNASRHYMGE

SEQ ID NO: 359475 - protein, 10 aa, Influenza virus
NASRHYMGEC

SEQ ID NO: 359476 - protein, 10 aa, Influenza virus
ASRHYMGECP

SEQ ID NO: 359477 - protein, 10 aa, Influenza virus
SRHYMGECPK

SEQ ID NO: 359478 - protein, 10 aa, Influenza virus
RHYMGECPKY

SEQ ID NO: 359479 - protein, 10 aa, Influenza virus
MGECPKYVKK

SEQ ID NO: 359480 - protein, 10 aa, Influenza virus
YVKKASLRLA

SEQ ID NO: 359481 - protein, 10 aa, Influenza virus
KKASLRLAVG

SEQ ID NO: 359482 - protein, 10 aa, Influenza virus
KASLRLAVGL

SEQ ID NO: 359483 - protein, 10 aa, Influenza virus
ASLRLAVGLR

SEQ ID NO: 359484 - protein, 10 aa, Influenza virus
SLRLAVGLRN

SEQ ID NO: 359485 - protein, 10 aa, Influenza virus
LRLAVGLRNT

SEQ ID NO: 359486 - protein, 10 aa, Influenza virus
RLAVGLRNTP

SEQ ID NO: 359487 - protein, 10 aa, Influenza virus
LAVGLRNTPS

SEQ ID NO: 359488 - protein, 10 aa, Influenza virus
AVGLRNTPSI

SEQ ID NO: 359489 - protein, 10 aa, Influenza virus
VGLRNTPSIE

SEQ ID NO: 359490 - protein, 10 aa, Influenza virus
GLRNTPSIEP

SEQ ID NO: 359491 - protein, 10 aa, Influenza virus
LRNTPSIEPK

SEQ ID NO: 359492 - protein, 10 aa, Influenza virus
RNTPSIEPKG

SEQ ID NO: 359493 - protein, 10 aa, Influenza virus
NTPSIEPKGL

SEQ ID NO: 359494 - protein, 10 aa, Influenza virus
TPSIEPKGLF

SEQ ID NO: 359495 - protein, 10 aa, Influenza virus
PSIEPKGLFG

SEQ ID NO: 359496 - protein, 10 aa, Influenza virus
SIEPKGLFGA

SEQ ID NO: 359497 - protein, 10 aa, Influenza virus
IEPKGLFGAI

SEQ ID NO: 359498 - protein, 10 aa, Influenza virus
EPKGLFGAIA

SEQ ID NO: 359499 - protein, 10 aa, Influenza virus
PKGLFGAIAG

SEQ ID NO: 359500 - protein, 10 aa, Influenza virus
KGLFGAIAGF

SEQ ID NO: 359501 - protein, 10 aa, Influenza virus
GLFGAIAGFI

SEQ ID NO: 359502 - protein, 10 aa, Influenza virus
LFGAIAGFIE

SEQ ID NO: 359503 - protein, 10 aa, Influenza virus
FGAIAGFIEG

SEQ ID NO: 359504 - protein, 10 aa, Influenza virus
GAIAGFIEGG

SEQ ID NO: 359505 - protein, 10 aa, Influenza virus
AIAGFIEGGW

SEQ ID NO: 359506 - protein, 10 aa, Influenza virus
IAGFIEGGWS

SEQ ID NO: 359507 - protein, 10 aa, Influenza virus
AGFIEGGWSG

SEQ ID NO: 359508 - protein, 10 aa, Influenza virus
GFIEGGWSGM

SEQ ID NO: 359509 - protein, 10 aa, Influenza virus
FIEGGWSGMI

SEQ ID NO: 359510 - protein, 10 aa, Influenza virus
IEGGWSGMID

SEQ ID NO: 359511 - protein, 10 aa, Influenza virus
EGGWSGMIDG

SEQ ID NO: 359512 - protein, 10 aa, Influenza virus
GGWSGMIDGW

SEQ ID NO: 359513 - protein, 10 aa, Influenza virus
GWSGMIDGWY

SEQ ID NO: 359514 - protein, 10 aa, Influenza virus
WSGMIDGWYG

SEQ ID NO: 359515 - protein, 10 aa, Influenza virus
SGMIDGWYGF

SEQ ID NO: 359516 - protein, 10 aa, Influenza virus
GMIDGWYGFH

SEQ ID NO: 359517 - protein, 10 aa, Influenza virus
MIDGWYGFHH

SEQ ID NO: 359518 - protein, 10 aa, Influenza virus
IDGWYGFHHS

SEQ ID NO: 359519 - protein, 10 aa, Influenza virus
DGWYGFHHSN

SEQ ID NO: 359520 - protein, 10 aa, Influenza virus
GWYGFHHSNS

SEQ ID NO: 359521 - protein, 10 aa, Influenza virus
WYGFHHSNSE

SEQ ID NO: 359522 - protein, 10 aa, Influenza virus
YGFHHSNSEG

SEQ ID NO: 359523 - protein, 10 aa, Influenza virus
GFHHSNSEGT

SEQ ID NO: 359524 - protein, 10 aa, Influenza virus
FHHSNSEGTG

SEQ ID NO: 359525 - protein, 10 aa, Influenza virus
HHSNSEGTGM

SEQ ID NO: 359526 - protein, 10 aa, Influenza virus
HSNSEGTGMA

SEQ ID NO: 359527 - protein, 10 aa, Influenza virus
SNSEGTGMAA

SEQ ID NO: 359528 - protein, 10 aa, Influenza virus
NSEGTGMAAD

SEQ ID NO: 359529 - protein, 10 aa, Influenza virus
SEGTGMAADQ

SEQ ID NO: 359530 - protein, 10 aa, Influenza virus
EGTGMAADQK

SEQ ID NO: 359531 - protein, 10 aa, Influenza virus
GTGMAADQKS

SEQ ID NO: 359532 - protein, 10 aa, Influenza virus
TGMAADQKST

SEQ ID NO: 359533 - protein, 10 aa, Influenza virus
GMAADQKSTQ

SEQ ID NO: 359534 - protein, 10 aa, Influenza virus
MAADQKSTQE

SEQ ID NO: 359535 - protein, 10 aa, Influenza virus
AADQKSTQEA

SEQ ID NO: 359536 - protein, 10 aa, Influenza virus
ADQKSTQEAI

SEQ ID NO: 359537 - protein, 10 aa, Influenza virus
DQKSTQEAID

SEQ ID NO: 359538 - protein, 10 aa, Influenza virus
QKSTQEAIDK

SEQ ID NO: 359539 - protein, 10 aa, Influenza virus
KSTQEAIDKI

SEQ ID NO: 359540 - protein, 10 aa, Influenza virus
STQEAIDKIT

SEQ ID NO: 359541 - protein, 10 aa, Influenza virus
TQEAIDKITN

SEQ ID NO: 359542 - protein, 10 aa, Influenza virus
QEAIDKITNK

SEQ ID NO: 359543 - protein, 10 aa, Influenza virus
EAIDKITNKV

SEQ ID NO: 359544 - protein, 10 aa, Influenza virus
AIDKITNKVN

SEQ ID NO: 359545 - protein, 10 aa, Influenza virus
IDKITNKVNN

SEQ ID NO: 359546 - protein, 10 aa, Influenza virus
DKITNKVNNI

SEQ ID NO: 359547 - protein, 10 aa, Influenza virus
KITNKVNNIV

SEQ ID NO: 359548 - protein, 10 aa, Influenza virus
ITNKVNNIVD

SEQ ID NO: 359549 - protein, 10 aa, Influenza virus
TNKVNNIVDK

SEQ ID NO: 359550 - protein, 10 aa, Influenza virus
NKVNNIVDKM

SEQ ID NO: 359551 - protein, 10 aa, Influenza virus
KVNNIVDKMN

SEQ ID NO: 359552 - protein, 10 aa, Influenza virus
VNNIVDKMNR

SEQ ID NO: 359553 - protein, 10 aa, Influenza virus
NNIVDKMNRE

SEQ ID NO: 359554 - protein, 10 aa, Influenza virus
NIVDKMNREF

SEQ ID NO: 359555 - protein, 10 aa, Influenza virus
IVDKMNREFE

SEQ ID NO: 359556 - protein, 10 aa, Influenza virus
VDKMNREFEV

SEQ ID NO: 359557 - protein, 10 aa, Influenza virus
DKMNREFEVV

SEQ ID NO: 359558 - protein, 10 aa, Influenza virus
KMNREFEVVN

SEQ ID NO: 359559 - protein, 10 aa, Influenza virus
MNREFEVVNH

SEQ ID NO: 359560 - protein, 10 aa, Influenza virus
NREFEVVNHE

SEQ ID NO: 359561 - protein, 10 aa, Influenza virus
REFEVVNHEF

SEQ ID NO: 359562 - protein, 10 aa, Influenza virus
EFEVVNHEFS

SEQ ID NO: 359563 - protein, 10 aa, Influenza virus
EKRINMINDK

SEQ ID NO: 359564 - protein, 10 aa, Influenza virus
KRINMINDKI

SEQ ID NO: 359565 - protein, 10 aa, Influenza virus
INMINDKIDD

SEQ ID NO: 359566 - protein, 10 aa, Influenza virus
NMINDKIDDQ

SEQ ID NO: 359567 - protein, 10 aa, Influenza virus
MINDKIDDQI

SEQ ID NO: 359568 - protein, 10 aa, Influenza virus
INDKIDDQIE

SEQ ID NO: 359569 - protein, 10 aa, Influenza virus
DKIDDQIEDL

SEQ ID NO: 359570 - protein, 10 aa, Influenza virus
KIDDQIEDLW

SEQ ID NO: 359571 - protein, 10 aa, Influenza virus
IDDQIEDLWA

SEQ ID NO: 359572 - protein, 10 aa, Influenza virus
DDQIEDLWAY

SEQ ID NO: 359573 - protein, 10 aa, Influenza virus
DQIEDLWAYN

SEQ ID NO: 359574 - protein, 10 aa, Influenza virus
QIEDLWAYNA

SEQ ID NO: 359575 - protein, 10 aa, Influenza virus
IEDLWAYNAE

SEQ ID NO: 359576 - protein, 10 aa, Influenza virus
EDLWAYNAEL

SEQ ID NO: 359577 - protein, 10 aa, Influenza virus
DLWAYNAELL

SEQ ID NO: 359578 - protein, 10 aa, Influenza virus
LWAYNAELLV

SEQ ID NO: 359579 - protein, 10 aa, Influenza virus
WAYNAELLVL

SEQ ID NO: 359580 - protein, 10 aa, Influenza virus
AYNAELLVLL

SEQ ID NO: 359581 - protein, 10 aa, Influenza virus
YNAELLVLLE

SEQ ID NO: 359582 - protein, 10 aa, Influenza virus
NAELLVLLEN

SEQ ID NO: 359583 - protein, 10 aa, Influenza virus
AELLVLLENQ

SEQ ID NO: 359584 - protein, 10 aa, Influenza virus
ELLVLLENQK

SEQ ID NO: 359585 - protein, 10 aa, Influenza virus
LLVLLENQKT

SEQ ID NO: 359586 - protein, 10 aa, Influenza virus
LVLLENQKTL

SEQ ID NO: 359587 - protein, 10 aa, Influenza virus
VLLENQKTLD

SEQ ID NO: 359588 - protein, 10 aa, Influenza virus
LLENQKTLDE

SEQ ID NO: 359589 - protein, 10 aa, Influenza virus
LENQKTLDEH

SEQ ID NO: 359590 - protein, 10 aa, Influenza virus
ENQKTLDEHD

SEQ ID NO: 359591 - protein, 10 aa, Influenza virus
NQKTLDEHDS

SEQ ID NO: 359592 - protein, 10 aa, Influenza virus
QKTLDEHDSN

SEQ ID NO: 359593 - protein, 10 aa, Influenza virus
KTLDEHDSNV

SEQ ID NO: 359594 - protein, 10 aa, Influenza virus
TLDEHDSNVK

SEQ ID NO: 359595 - protein, 10 aa, Influenza virus
LDEHDSNVKN

SEQ ID NO: 359596 - protein, 10 aa, Influenza virus
DEHDSNVKNL

SEQ ID NO: 359597 - protein, 10 aa, Influenza virus
EHDSNVKNLF

SEQ ID NO: 359598 - protein, 10 aa, Influenza virus
HDSNVKNLFD

SEQ ID NO: 359599 - protein, 10 aa, Influenza virus
DSNVKNLFDE

SEQ ID NO: 359600 - protein, 10 aa, Influenza virus
SNVKNLFDEV

SEQ ID NO: 359601 - protein, 10 aa, Influenza virus
NVKNLFDEVK

SEQ ID NO: 359602 - protein, 10 aa, Influenza virus
VKNLFDEVKR

SEQ ID NO: 359603 - protein, 10 aa, Influenza virus
KNLFDEVKRR

SEQ ID NO: 359604 - protein, 10 aa, Influenza virus
NLFDEVKRRL

SEQ ID NO: 359605 - protein, 10 aa, Influenza virus
LFDEVKRRLS

SEQ ID NO: 359606 - protein, 10 aa, Influenza virus
FDEVKRRLSA

SEQ ID NO: 359607 - protein, 10 aa, Influenza virus
DEVKRRLSAN

SEQ ID NO: 359608 - protein, 10 aa, Influenza virus
EVKRRLSANA

SEQ ID NO: 359609 - protein, 10 aa, Influenza virus
NAIDAGNGCF

SEQ ID NO: 359610 - protein, 10 aa, Influenza virus
AIDAGNGCFD

SEQ ID NO: 359611 - protein, 10 aa, Influenza virus
IDAGNGCFDI

SEQ ID NO: 359612 - protein, 10 aa, Influenza virus
DAGNGCFDIL

SEQ ID NO: 359613 - protein, 10 aa, Influenza virus
AGNGCFDILH

SEQ ID NO: 359614 - protein, 10 aa, Influenza virus
GNGCFDILHK

SEQ ID NO: 359615 - protein, 10 aa, Influenza virus
NGCFDILHKC

SEQ ID NO: 359616 - protein, 10 aa, Influenza virus
GCFDILHKCN

SEQ ID NO: 359617 - protein, 10 aa, Influenza virus
CFDILHKCNN

SEQ ID NO: 359618 - protein, 10 aa, Influenza virus
FDILHKCNNE

SEQ ID NO: 359619 - protein, 10 aa, Influenza virus
DILHKCNNEC

SEQ ID NO: 359620 - protein, 10 aa, Influenza virus
ILHKCNNECM

SEQ ID NO: 359621 - protein, 10 aa, Influenza virus
LHKCNNECME

SEQ ID NO: 359622 - protein, 10 aa, Influenza virus
HKCNNECMET

SEQ ID NO: 359623 - protein, 10 aa, Influenza virus
KCNNECMETI

SEQ ID NO: 359624 - protein, 10 aa, Influenza virus
CNNECMETIK

SEQ ID NO: 359625 - protein, 10 aa, Influenza virus
NNECMETIKN

SEQ ID NO: 359626 - protein, 10 aa, Influenza virus
NECMETIKNG

SEQ ID NO: 359627 - protein, 10 aa, Influenza virus
ECMETIKNGT

SEQ ID NO: 359628 - protein, 10 aa, Influenza virus
CMETIKNGTY

SEQ ID NO: 359629 - protein, 10 aa, Influenza virus
METIKNGTYN

SEQ ID NO: 359630 - protein, 10 aa, Influenza virus
ETIKNGTYDH

SEQ ID NO: 359631 - protein, 10 aa, Influenza virus
TIKNGTYNHK

SEQ ID NO: 359632 - protein, 10 aa, Influenza virus
IKNGTYDHKE

SEQ ID NO: 359633 - protein, 10 aa, Influenza virus
KNGTYNHKEY

SEQ ID NO: 359634 - protein, 10 aa, Influenza virus
NGTYDHKEYE

SEQ ID NO: 359635 - protein, 10 aa, Influenza virus
GTYNHKEYEE

SEQ ID NO: 359636 - protein, 10 aa, Influenza virus
TYDHKEYEEE

SEQ ID NO: 359637 - protein, 10 aa, Influenza virus
YNHKEYEEEA

SEQ ID NO: 359638 - protein, 10 aa, Influenza virus
DHKEYEEEAK

SEQ ID NO: 359639 - protein, 10 aa, Influenza virus
HKEYEEEAKL

SEQ ID NO: 359640 - protein, 10 aa, Influenza virus
KEYEEEAKLE

SEQ ID NO: 359641 - protein, 10 aa, Influenza virus
EYEEEAKLER

SEQ ID NO: 359642 - protein, 10 aa, Influenza virus
YEEEAKLERS

SEQ ID NO: 359643 - protein, 10 aa, Influenza virus
EEEAKLERSK

SEQ ID NO: 359644 - protein, 10 aa, Influenza virus
EEAKLERSKI

SEQ ID NO: 359645 - protein, 10 aa, Influenza virus
EAKLERSKIN

SEQ ID NO: 359646 - protein, 10 aa, Influenza virus
AKLERSKING

SEQ ID NO: 359647 - protein, 10 aa, Influenza virus
KLERSKINGV

SEQ ID NO: 359648 - protein, 10 aa, Influenza virus
LERSKINGVK

SEQ ID NO: 359649 - protein, 10 aa, Influenza virus
ERSKINGVKL

SEQ ID NO: 359650 - protein, 10 aa, Influenza virus
RSKINGVKLE

SEQ ID NO: 359651 - protein, 10 aa, Influenza virus
SKINGVKLEE

SEQ ID NO: 359652 - protein, 10 aa, Influenza virus
KINGVKLEEN

SEQ ID NO: 359653 - protein, 10 aa, Influenza virus
INGVKLEENT

SEQ ID NO: 359654 - protein, 10 aa, Influenza virus
NGVKLEENTT

SEQ ID NO: 359655 - protein, 10 aa, Influenza virus
GVKLEENTTY

SEQ ID NO: 359656 - protein, 10 aa, Influenza virus
VKLEENTTYK

SEQ ID NO: 359657 - protein, 10 aa, Influenza virus
KLEENTTYKI

SEQ ID NO: 359658 - protein, 10 aa, Influenza virus
LEENTTYKIL

SEQ ID NO: 359659 - protein, 10 aa, Influenza virus
EENTTYKILS

SEQ ID NO: 359660 - protein, 10 aa, Influenza virus
ENTTYKILSI

SEQ ID NO: 359661 - protein, 10 aa, Influenza virus
NTTYKILSIY

SEQ ID NO: 359662 - protein, 10 aa, Influenza virus
TTYKILSIYS

SEQ ID NO: 359663 - protein, 10 aa, Influenza virus
TYKILSIYST

SEQ ID NO: 359664 - protein, 10 aa, Influenza virus
YKILSIYSTV

SEQ ID NO: 359665 - protein, 10 aa, Influenza virus
KILSIYSTVA

SEQ ID NO: 359666 - protein, 10 aa, Influenza virus
ILSIYSTVAA

SEQ ID NO: 359667 - protein, 10 aa, Influenza virus
LSIYSTVAAS

SEQ ID NO: 359668 - protein, 10 aa, Influenza virus
SIYSTVAASL

SEQ ID NO: 359669 - protein, 10 aa, Influenza virus
IYSTVAASLC

SEQ ID NO: 359670 - protein, 10 aa, Influenza virus
YSTVAASLCL

SEQ ID NO: 359671 - protein, 10 aa, Influenza virus
STVAASLCLA

SEQ ID NO: 359672 - protein, 10 aa, Influenza virus
TVAASLCLAI

SEQ ID NO: 359673 - protein, 10 aa, Influenza virus
VAASLCLAIL

SEQ ID NO: 359674 - protein, 10 aa, Influenza virus
AASLCLAILI

SEQ ID NO: 359675 - protein, 10 aa, Influenza virus
ASLCLAILIA

SEQ ID NO: 359676 - protein, 10 aa, Influenza virus
SLCLAILIAG

SEQ ID NO: 359677 - protein, 10 aa, Influenza virus
LCLAILIAGG

SEQ ID NO: 359678 - protein, 10 aa, Influenza virus
CLAILIAGGL

SEQ ID NO: 359679 - protein, 10 aa, Influenza virus
LAILIAGGLI

SEQ ID NO: 359680 - protein, 10 aa, Influenza virus
AILIAGGLIL

SEQ ID NO: 359681 - protein, 10 aa, Influenza virus
ILIAGGLILG

SEQ ID NO: 359682 - protein, 10 aa, Influenza virus
LIAGGLILGM

SEQ ID NO: 359683 - protein, 10 aa, Influenza virus
IAGGLILGMQ

SEQ ID NO: 359684 - protein, 10 aa, Influenza virus
AGGLILGMQN

SEQ ID NO: 359685 - protein, 10 aa, Influenza virus
GGLILGMQNG

SEQ ID NO: 359686 - protein, 10 aa, Influenza virus
GLILGMQNGS

SEQ ID NO: 359687 - protein, 10 aa, Influenza virus
LILGMQNGSC

SEQ ID NO: 359688 - protein, 10 aa, Influenza virus
ILGMQNGSCR

SEQ ID NO: 359689 - protein, 10 aa, Influenza virus
LGMQNGSCRC

SEQ ID NO: 359690 - protein, 10 aa, Influenza virus
GMQNGSCRCM

SEQ ID NO: 359691 - protein, 10 aa, Influenza virus
MQNGSCRCMF

SEQ ID NO: 359692 - protein, 10 aa, Influenza virus
QNGSCRCMFC

SEQ ID NO: 359693 - protein, 10 aa, Influenza virus
NGSCRCMFCI

SEQ ID NO: 359694 - protein, 10 aa, Influenza virus
RWKHVTNTIL

SEQ ID NO: 359695 - protein, 10 aa, Influenza virus
WKHVTNTILL

SEQ ID NO: 359696 - protein, 10 aa, Influenza virus
YQSTNSTETV

SEQ ID NO: 359697 - protein, 10 aa, Influenza virus
EGLIYGNPSC

SEQ ID NO: 359698 - protein, 10 aa, Influenza virus
GLIYGNPSCD

SEQ ID NO: 359699 - protein, 10 aa, Influenza virus
LKPGQTLRIR

SEQ ID NO: 359700 - protein, 10 aa, Influenza virus
KPGQTLRIRS

SEQ ID NO: 359701 - protein, 10 aa, Influenza virus
PGQTLRIRSN

SEQ ID NO: 359702 - protein, 10 aa, Influenza virus
QTLRIRSNGN

SEQ ID NO: 359703 - protein, 10 aa, Influenza virus
TLRIRSNGNL

SEQ ID NO: 359704 - protein, 10 aa, Influenza virus
SNGNLIAPWY

SEQ ID NO: 359705 - protein, 10 aa, Influenza virus
SLKLAVGLRN

SEQ ID NO: 359706 - protein, 10 aa, Influenza virus
RGLFGAIAGF

SEQ ID NO: 359707 - protein, 10 aa, Influenza virus
GLFGAIAGFI

SEQ ID NO: 359708 - protein, 10 aa, Influenza virus
LFGAIAGFIE

SEQ ID NO: 359709 - protein, 10 aa, Influenza virus
FGAIAGFIEG

SEQ ID NO: 359710 - protein, 10 aa, Influenza virus
GAIAGFIEGG

SEQ ID NO: 359711 - protein, 10 aa, Influenza virus
AIAGFIEGGW

SEQ ID NO: 359712 - protein, 10 aa, Influenza virus
IAGFIEGGWS

SEQ ID NO: 359713 - protein, 10 aa, Influenza virus
AGFIEGGWSG

SEQ ID NO: 359714 - protein, 10 aa, Influenza virus
GFIEGGWSGL

SEQ ID NO: 359715 - protein, 10 aa, Influenza virus
FIEGGWSGLV

SEQ ID NO: 359716 - protein, 10 aa, Influenza virus
IEGGWSGLVA

SEQ ID NO: 359717 - protein, 10 aa, Influenza virus
EGGWSGLVAG

SEQ ID NO: 359718 - protein, 10 aa, Influenza virus
GGWSGLVAGW

SEQ ID NO: 359719 - protein, 10 aa, Influenza virus
GWSGLVAGWY

SEQ ID NO: 359720 - protein, 10 aa, Influenza virus
WSGLVAGWYG

SEQ ID NO: 359721 - protein, 10 aa, Influenza virus
SGLVAGWYGF

SEQ ID NO: 359722 - protein, 10 aa, Influenza virus
GLVAGWYGFQ

SEQ ID NO: 359723 - protein, 10 aa, Influenza virus
LVAGWYGFQH

SEQ ID NO: 359724 - protein, 10 aa, Influenza virus
VAGWYGFQHS

SEQ ID NO: 359725 - protein, 10 aa, Influenza virus
AGWYGFQHSN

SEQ ID NO: 359726 - protein, 10 aa, Influenza virus
GWYGFQHSND

SEQ ID NO: 359727 - protein, 10 aa, Influenza virus
WYGFQHSNDQ

SEQ ID NO: 359728 - protein, 10 aa, Influenza virus
YGFQHSNDQG

SEQ ID NO: 359729 - protein, 10 aa, Influenza virus
DQIQDIWAYN

SEQ ID NO: 359730 - protein, 10 aa, Influenza virus
QIQDIWAYNA

SEQ ID NO: 359731 - protein, 10 aa, Influenza virus
IQDIWAYNAE

SEQ ID NO: 359732 - protein, 10 aa, Influenza virus
QDIWAYNAEL

SEQ ID NO: 359733 - protein, 10 aa, Influenza virus
DIWAYNAELL

SEQ ID NO: 359734 - protein, 10 aa, Influenza virus
IWAYNAELLV

SEQ ID NO: 359735 - protein, 10 aa, Influenza virus
WAYNAELLVL

SEQ ID NO: 359736 - protein, 10 aa, Influenza virus
AYNAELLVLL

SEQ ID NO: 359737 - protein, 10 aa, Influenza virus
YNAELLVLLE

SEQ ID NO: 359738 - protein, 10 aa, Influenza virus
NAELLVLLEN

SEQ ID NO: 359739 - protein, 10 aa, Influenza virus
AELLVLLENQ

SEQ ID NO: 359740 - protein, 10 aa, Influenza virus
ELLVLLENQK

SEQ ID NO: 359741 - protein, 10 aa, Influenza virus
LLVLLENQKT

SEQ ID NO: 359742 - protein, 10 aa, Influenza virus
LVLLENQKTL

SEQ ID NO: 359743 - protein, 10 aa, Influenza virus
VLLENQKTLD

SEQ ID NO: 359744 - protein, 10 aa, Influenza virus
LLENQKTLDE

SEQ ID NO: 359745 - protein, 10 aa, Influenza virus
LENQKTLDEH

SEQ ID NO: 359746 - protein, 10 aa, Influenza virus
EDGKGCFELY

SEQ ID NO: 359747 - protein, 10 aa, Influenza virus
DGKGCFELYH

SEQ ID NO: 359748 - protein, 10 aa, Influenza virus
GKGCFELYHK

SEQ ID NO: 359749 - protein, 10 aa, Influenza virus
KGCFELYHKC

SEQ ID NO: 359750 - protein, 10 aa, Influenza virus
GCFELYHKCD

SEQ ID NO: 359751 - protein, 10 aa, Influenza virus
CMETIRNGTY

SEQ ID NO: 359752 - protein, 10 aa, Influenza virus
EGTYKILTIY

SEQ ID NO: 359753 - protein, 10 aa, Influenza virus
GTYKILTIYS

SEQ ID NO: 359754 - protein, 10 aa, Influenza virus
TYKILTIYST

SEQ ID NO: 359755 - protein, 10 aa, Influenza virus
YKILTIYSTV

SEQ ID NO: 359756 - protein, 10 aa, Influenza virus
KILTIYSTVA

SEQ ID NO: 359757 - protein, 10 aa, Influenza virus
ILTIYSTVAS

SEQ ID NO: 359758 - protein, 10 aa, Influenza virus
LTIYSTVASS

SEQ ID NO: 359759 - protein, 10 aa, Influenza virus
TIYSTVASSL

SEQ ID NO: 359760 - protein, 10 aa, Influenza virus
RWKHVTNTIL

SEQ ID NO: 359761 - protein, 10 aa, Influenza virus
WKHVTNTILL

SEQ ID NO: 359762 - protein, 10 aa, Influenza virus
YQSTNSTETV

SEQ ID NO: 359763 - protein, 10 aa, Influenza virus
EGLIYGNPSC

SEQ ID NO: 359764 - protein, 10 aa, Influenza virus
GLIYGNPSCD

SEQ ID NO: 359765 - protein, 10 aa, Influenza virus
LKPGQTLRIR

SEQ ID NO: 359766 - protein, 10 aa, Influenza virus
KPGQTLRIRS

SEQ ID NO: 359767 - protein, 10 aa, Influenza virus
PGQTLRIRSN

SEQ ID NO: 359768 - protein, 10 aa, Influenza virus
QTLRIRSNGN

SEQ ID NO: 359769 - protein, 10 aa, Influenza virus
TLRIRSNGNL

SEQ ID NO: 359770 - protein, 10 aa, Influenza virus
SNGNLIAPWY

SEQ ID NO: 359771 - protein, 10 aa, Influenza virus
SLKLAVGLRN

SEQ ID NO: 359772 - protein, 10 aa, Influenza virus
RGLFGAIAGF

SEQ ID NO: 359773 - protein, 10 aa, Influenza virus
GLFGAIAGFI

SEQ ID NO: 359774 - protein, 10 aa, Influenza virus
LFGAIAGFIE

SEQ ID NO: 359775 - protein, 10 aa, Influenza virus
FGAIAGFIEG

SEQ ID NO: 359776 - protein, 10 aa, Influenza virus
GAIAGFIEGG

SEQ ID NO: 359777 - protein, 10 aa, Influenza virus
AIAGFIEGGW

SEQ ID NO: 359778 - protein, 10 aa, Influenza virus
IAGFIEGGWS

SEQ ID NO: 359779 - protein, 10 aa, Influenza virus
AGFIEGGWSG

SEQ ID NO: 359780 - protein, 10 aa, Influenza virus
GFIEGGWSGL

SEQ ID NO: 359781 - protein, 10 aa, Influenza virus
FIEGGWSGLV

SEQ ID NO: 359782 - protein, 10 aa, Influenza virus
IEGGWSGLVA

SEQ ID NO: 359783 - protein, 10 aa, Influenza virus
EGGWSGLVAG

SEQ ID NO: 359784 - protein, 10 aa, Influenza virus
GGWSGLVAGW

SEQ ID NO: 359785 - protein, 10 aa, Influenza virus
GWSGLVAGWY

SEQ ID NO: 359786 - protein, 10 aa, Influenza virus
WSGLVAGWYG

SEQ ID NO: 359787 - protein, 10 aa, Influenza virus
SGLVAGWYGF

SEQ ID NO: 359788 - protein, 10 aa, Influenza virus
GLVAGWYGFQ

SEQ ID NO: 359789 - protein, 10 aa, Influenza virus
LVAGWYGFQH

SEQ ID NO: 359790 - protein, 10 aa, Influenza virus
VAGWYGFQHS

SEQ ID NO: 359791 - protein, 10 aa, Influenza virus
AGWYGFQHSN

SEQ ID NO: 359792 - protein, 10 aa, Influenza virus
GWYGFQHSND

SEQ ID NO: 359793 - protein, 10 aa, Influenza virus
WYGFQHSNDQ

SEQ ID NO: 359794 - protein, 10 aa, Influenza virus
YGFQHSNDQG

SEQ ID NO: 359795 - protein, 10 aa, Influenza virus
DDQIQDIWAY

SEQ ID NO: 359796 - protein, 10 aa, Influenza virus
DQIQDIWAYN

SEQ ID NO: 359797 - protein, 10 aa, Influenza virus
QIQDIWAYNA

SEQ ID NO: 359798 - protein, 10 aa, Influenza virus
IQDIWAYNAE

SEQ ID NO: 359799 - protein, 10 aa, Influenza virus
QDIWAYNAEL

SEQ ID NO: 359800 - protein, 10 aa, Influenza virus
DIWAYNAELL

SEQ ID NO: 359801 - protein, 10 aa, Influenza virus
IWAYNAELLV

SEQ ID NO: 359802 - protein, 10 aa, Influenza virus
WAYNAELLVL

SEQ ID NO: 359803 - protein, 10 aa, Influenza virus
AYNAELLVLL

SEQ ID NO: 359804 - protein, 10 aa, Influenza virus
YNAELLVLLE

SEQ ID NO: 359805 - protein, 10 aa, Influenza virus
NAELLVLLEN

SEQ ID NO: 359806 - protein, 10 aa, Influenza virus
AELLVLLENQ

SEQ ID NO: 359807 - protein, 10 aa, Influenza virus
ELLVLLENQK

SEQ ID NO: 359808 - protein, 10 aa, Influenza virus
LLVLLENQKT

SEQ ID NO: 359809 - protein, 10 aa, Influenza virus
LVLLENQKTL

SEQ ID NO: 359810 - protein, 10 aa, Influenza virus
VLLENQKTLD

SEQ ID NO: 359811 - protein, 10 aa, Influenza virus
LLENQKTLDE

SEQ ID NO: 359812 - protein, 10 aa, Influenza virus
LENQKTLDEH

SEQ ID NO: 359813 - protein, 10 aa, Influenza virus
ENQKTLDEHD

SEQ ID NO: 359814 - protein, 10 aa, Influenza virus
EDGKGCFELY

SEQ ID NO: 359815 - protein, 10 aa, Influenza virus
DGKGCFELYH

SEQ ID NO: 359816 - protein, 10 aa, Influenza virus
GKGCFELYHK

SEQ ID NO: 359817 - protein, 10 aa, Influenza virus
KGCFELYHKC

SEQ ID NO: 359818 - protein, 10 aa, Influenza virus
GCFELYHKCD

SEQ ID NO: 359819 - protein, 10 aa, Influenza virus
CMETIRNGTY

SEQ ID NO: 359820 - protein, 10 aa, Influenza virus
EGTYKILTIY

SEQ ID NO: 359821 - protein, 10 aa, Influenza virus
GTYKILTIYS

SEQ ID NO: 359822 - protein, 10 aa, Influenza virus
TYKILTIYST

SEQ ID NO: 359823 - protein, 10 aa, Influenza virus
YKILTIYSTV

SEQ ID NO: 359824 - protein, 10 aa, Influenza virus
KILTIYSTVA

SEQ ID NO: 359825 - protein, 10 aa, Influenza virus
ILTIYSTVAS

SEQ ID NO: 359826 - protein, 10 aa, Influenza virus
LTIYSTVASS

SEQ ID NO: 359827 - protein, 10 aa, Influenza virus
TIYSTVASSL

SEQ ID NO: 359828 - protein, 10 aa, Influenza virus
IAIGSVSRTI

SEQ ID NO: 359829 - protein, 10 aa, Influenza virus
VPLVPCEPII

SEQ ID NO: 359830 - protein, 10 aa, Influenza virus
PLVPCEPIII

SEQ ID NO: 359831 - protein, 10 aa, Influenza virus
LVPCEPIIIE

SEQ ID NO: 359832 - protein, 10 aa, Influenza virus
WSKPQCQITG

SEQ ID NO: 359833 - protein, 10 aa, Influenza virus
SKPQCQITGF

SEQ ID NO: 359834 - protein, 10 aa, Influenza virus
KPQCQITGFA

SEQ ID NO: 359835 - protein, 10 aa, Influenza virus
CYQFALGQGT

SEQ ID NO: 359836 - protein, 10 aa, Influenza virus
YQFALGQGTT

SEQ ID NO: 359837 - protein, 10 aa, Influenza virus
QFALGQGTTL

SEQ ID NO: 359838 - protein, 10 aa, Influenza virus
PHRTLLMNEL

SEQ ID NO: 359839 - protein, 10 aa, Influenza virus
HRTLLMNELG

SEQ ID NO: 359840 - protein, 10 aa, Influenza virus
RTLLMNELGV

SEQ ID NO: 359841 - protein, 10 aa, Influenza virus
TLLMNELGVP

SEQ ID NO: 359842 - protein, 10 aa, Influenza virus
LLMNELGVPF

SEQ ID NO: 359843 - protein, 10 aa, Influenza virus
LMNELGVPFH

SEQ ID NO: 359844 - protein, 10 aa, Influenza virus
TKQVCIAWSS

SEQ ID NO: 359845 - protein, 10 aa, Influenza virus
QVCIAWSSSS

SEQ ID NO: 359846 - protein, 10 aa, Influenza virus
VCIAWSSSSC

SEQ ID NO: 359847 - protein, 10 aa, Influenza virus
CIAWSSSSCH

SEQ ID NO: 359848 - protein, 10 aa, Influenza virus
IAWSSSSCHD

SEQ ID NO: 359849 - protein, 10 aa, Influenza virus
AWSSSSCHDG

SEQ ID NO: 359850 - protein, 10 aa, Influenza virus
WSSSSCHDGK

SEQ ID NO: 359851 - protein, 10 aa, Influenza virus
SSSSCHDGKA

SEQ ID NO: 359852 - protein, 10 aa, Influenza virus
SSSCHDGKAW

SEQ ID NO: 359853 - protein, 10 aa, Influenza virus
SSCHDGKAWL

SEQ ID NO: 359854 - protein, 10 aa, Influenza virus
SCHDGKAWLH

SEQ ID NO: 359855 - protein, 10 aa, Influenza virus
NILRTQESEC

SEQ ID NO: 359856 - protein, 10 aa, Influenza virus
ILRTQESECV

SEQ ID NO: 359857 - protein, 10 aa, Influenza virus
LRTQESECVC

SEQ ID NO: 359858 - protein, 10 aa, Influenza virus
GSAQHVEECS

SEQ ID NO: 359859 - protein, 10 aa, Influenza virus
SAQHVEECSC

SEQ ID NO: 359860 - protein, 10 aa, Influenza virus
AQHVEECSCY

SEQ ID NO: 359861 - protein, 10 aa, Influenza virus
QHVEECSCYP

SEQ ID NO: 359862 - protein, 10 aa, Influenza virus
HVEECSCYPR

SEQ ID NO: 359863 - protein, 10 aa, Influenza virus
VCRDNWKGSN

SEQ ID NO: 359864 - protein, 10 aa, Influenza virus
CRDNWKGSNR

SEQ ID NO: 359865 - protein, 10 aa, Influenza virus
RDNWKGSNRP

SEQ ID NO: 359866 - protein, 10 aa, Influenza virus
DNWKGSNRPV

SEQ ID NO: 359867 - protein, 10 aa, Influenza virus
YVCSGLVGDT

SEQ ID NO: 359868 - protein, 10 aa, Influenza virus
VCSGLVGDTP

SEQ ID NO: 359869 - protein, 10 aa, Influenza virus
CSGLVGDTPR

SEQ ID NO: 359870 - protein, 10 aa, Influenza virus
SGLVGDTPRN

SEQ ID NO: 359871 - protein, 10 aa, Influenza virus
CINRCFYVEL

SEQ ID NO: 359872 - protein, 10 aa, Influenza virus
INRCFYVELI

SEQ ID NO: 359873 - protein, 10 aa, Influenza virus
NRCFYVELIR

SEQ ID NO: 359874 - protein, 10 aa, Influenza virus
RCFYVELIRG

SEQ ID NO: 359875 - protein, 10 aa, Influenza virus
CFYVELIRGR

SEQ ID NO: 359876 - protein, 10 aa, Influenza virus
FYVELIRGRP

SEQ ID NO: 359877 - protein, 10 aa, Influenza virus
GTGSWPDGAN

SEQ ID NO: 359878 - protein, 10 aa, Influenza virus
MLKMSLLTEV

SEQ ID NO: 359879 - protein, 10 aa, Influenza virus
LKMSLLTEVE

SEQ ID NO: 359880 - protein, 10 aa, Influenza virus
KMSLLTEVET

SEQ ID NO: 359881 - protein, 10 aa, Influenza virus
MSLLTEVETY

SEQ ID NO: 359882 - protein, 10 aa, Influenza virus
SLLTEVETYV

SEQ ID NO: 359883 - protein, 10 aa, Influenza virus
LLTEVETYVL

SEQ ID NO: 359884 - protein, 10 aa, Influenza virus
LTEVETYVLS

SEQ ID NO: 359885 - protein, 10 aa, Influenza virus
TEVETYVLSI

SEQ ID NO: 359886 - protein, 10 aa, Influenza virus
EVETYVLSIV

SEQ ID NO: 359887 - protein, 10 aa, Influenza virus
VETYVLSIVP

SEQ ID NO: 359888 - protein, 10 aa, Influenza virus
ETYVLSIVPS

SEQ ID NO: 359889 - protein, 10 aa, Influenza virus
TYVLSIVPSG

SEQ ID NO: 359890 - protein, 10 aa, Influenza virus
YVLSIVPSGP

SEQ ID NO: 359891 - protein, 10 aa, Influenza virus
VLSIVPSGPL

SEQ ID NO: 359892 - protein, 10 aa, Influenza virus
LSIVPSGPLK

SEQ ID NO: 359893 - protein, 10 aa, Influenza virus
SIVPSGPLKA

SEQ ID NO: 359894 - protein, 10 aa, Influenza virus
IVPSGPLKAE

SEQ ID NO: 359895 - protein, 10 aa, Influenza virus
VPSGPLKAEI

SEQ ID NO: 359896 - protein, 10 aa, Influenza virus
PSGPLKAEIA

SEQ ID NO: 359897 - protein, 10 aa, Influenza virus
SGPLKAEIAQ

SEQ ID NO: 359898 - protein, 10 aa, Influenza virus
GPLKAEIAQR

SEQ ID NO: 359899 - protein, 10 aa, Influenza virus
PLKAEIAQRL

SEQ ID NO: 359900 - protein, 10 aa, Influenza virus
LKAEIAQRLE

SEQ ID NO: 359901 - protein, 10 aa, Influenza virus
KAEIAQRLED

SEQ ID NO: 359902 - protein, 10 aa, Influenza virus
AEIAQRLEDV

SEQ ID NO: 359903 - protein, 10 aa, Influenza virus
EIAQRLEDVF

SEQ ID NO: 359904 - protein, 10 aa, Influenza virus
IAQRLEDVFA

SEQ ID NO: 359905 - protein, 10 aa, Influenza virus
AQRLEDVFAG

SEQ ID NO: 359906 - protein, 10 aa, Influenza virus
QRLEDVFAGK

SEQ ID NO: 359907 - protein, 10 aa, Influenza virus
VFAGKNTDLE

SEQ ID NO: 359908 - protein, 10 aa, Influenza virus
FAGKNTDLEA

SEQ ID NO: 359909 - protein, 10 aa, Influenza virus
AGKNTDLEAL

SEQ ID NO: 359910 - protein, 10 aa, Influenza virus
GKNTDLEALM

SEQ ID NO: 359911 - protein, 10 aa, Influenza virus
KNTDLEALME

SEQ ID NO: 359912 - protein, 10 aa, Influenza virus
NTDLEALMEW

SEQ ID NO: 359913 - protein, 10 aa, Influenza virus
TDLEALMEWL

SEQ ID NO: 359914 - protein, 10 aa, Influenza virus
DLEALMEWLK

SEQ ID NO: 359915 - protein, 10 aa, Influenza virus
LEALMEWLKT

SEQ ID NO: 359916 - protein, 10 aa, Influenza virus
EALMEWLKTR

SEQ ID NO: 359917 - protein, 10 aa, Influenza virus
ALMEWLKTRP

SEQ ID NO: 359918 - protein, 10 aa, Influenza virus
LMEWLKTRPI

SEQ ID NO: 359919 - protein, 10 aa, Influenza virus
MEWLKTRPIL

SEQ ID NO: 359920 - protein, 10 aa, Influenza virus
EWLKTRPILS

SEQ ID NO: 359921 - protein, 10 aa, Influenza virus
WLKTRPILSP

SEQ ID NO: 359922 - protein, 10 aa, Influenza virus
LKTRPILSPL

SEQ ID NO: 359923 - protein, 10 aa, Influenza virus
KTRPILSPLT

SEQ ID NO: 359924 - protein, 10 aa, Influenza virus
TRPILSPLTK

SEQ ID NO: 359925 - protein, 10 aa, Influenza virus
RPILSPLTKG

SEQ ID NO: 359926 - protein, 10 aa, Influenza virus
PILSPLTKGI

SEQ ID NO: 359927 - protein, 10 aa, Influenza virus
ILSPLTKGIL

SEQ ID NO: 359928 - protein, 10 aa, Influenza virus
LSPLTKGILG

SEQ ID NO: 359929 - protein, 10 aa, Influenza virus
SPLTKGILGF

SEQ ID NO: 359930 - protein, 10 aa, Influenza virus
PLTKGILGFV

SEQ ID NO: 359931 - protein, 10 aa, Influenza virus
LTKGILGFVF

SEQ ID NO: 359932 - protein, 10 aa, Influenza virus
TKGILGFVFT

SEQ ID NO: 359933 - protein, 10 aa, Influenza virus
KGILGFVFTL

SEQ ID NO: 359934 - protein, 10 aa, Influenza virus
GILGFVFTLT

SEQ ID NO: 359935 - protein, 10 aa, Influenza virus
ILGFVFTLTV

SEQ ID NO: 359936 - protein, 10 aa, Influenza virus
LGFVFTLTVP

SEQ ID NO: 359937 - protein, 10 aa, Influenza virus
GFVFTLTVPS

SEQ ID NO: 359938 - protein, 10 aa, Influenza virus
FVFTLTVPSE

SEQ ID NO: 359939 - protein, 10 aa, Influenza virus
VFTLTVPSER

SEQ ID NO: 359940 - protein, 10 aa, Influenza virus
FTLTVPSERG

SEQ ID NO: 359941 - protein, 10 aa, Influenza virus
TLTVPSERGL

SEQ ID NO: 359942 - protein, 10 aa, Influenza virus
LTVPSERGLQ

SEQ ID NO: 359943 - protein, 10 aa, Influenza virus
TVPSERGLQR

SEQ ID NO: 359944 - protein, 10 aa, Influenza virus
VPSERGLQRR

SEQ ID NO: 359945 - protein, 10 aa, Influenza virus
PSERGLQRRR

SEQ ID NO: 359946 - protein, 10 aa, Influenza virus
SERGLQRRRF

SEQ ID NO: 359947 - protein, 10 aa, Influenza virus
ERGLQRRRFV

SEQ ID NO: 359948 - protein, 10 aa, Influenza virus
RGLQRRRFVQ

SEQ ID NO: 359949 - protein, 10 aa, Influenza virus
GLQRRRFVQN

SEQ ID NO: 359950 - protein, 10 aa, Influenza virus
LQRRRFVQNA

SEQ ID NO: 359951 - protein, 10 aa, Influenza virus
QRRRFVQNAL

SEQ ID NO: 359952 - protein, 10 aa, Influenza virus
RRRFVQNALN

SEQ ID NO: 359953 - protein, 10 aa, Influenza virus
RRFVQNALNG

SEQ ID NO: 359954 - protein, 10 aa, Influenza virus
RFVQNALNGN

SEQ ID NO: 359955 - protein, 10 aa, Influenza virus
FVQNALNGNG

SEQ ID NO: 359956 - protein, 10 aa, Influenza virus
VQNALNGNGD

SEQ ID NO: 359957 - protein, 10 aa, Influenza virus
QNALNGNGDP

SEQ ID NO: 359958 - protein, 10 aa, Influenza virus
NALNGNGDPN

SEQ ID NO: 359959 - protein, 10 aa, Influenza virus
ALNGNGDPNN

SEQ ID NO: 359960 - protein, 10 aa, Influenza virus
LNGNGDPNNM

SEQ ID NO: 359961 - protein, 10 aa, Influenza virus
NGNGDPNNMD

SEQ ID NO: 359962 - protein, 10 aa, Influenza virus
GNGDPNNMDR

SEQ ID NO: 359963 - protein, 10 aa, Influenza virus
NGDPNNMDRA

SEQ ID NO: 359964 - protein, 10 aa, Influenza virus
GDPNNMDRAV

SEQ ID NO: 359965 - protein, 10 aa, Influenza virus
DPNNMDRAVK

SEQ ID NO: 359966 - protein, 10 aa, Influenza virus
PNNMDRAVKL

SEQ ID NO: 359967 - protein, 10 aa, Influenza virus
NNMDRAVKLY

SEQ ID NO: 359968 - protein, 10 aa, Influenza virus
NMDRAVKLYR

SEQ ID NO: 359969 - protein, 10 aa, Influenza virus
MDRAVKLYRK

SEQ ID NO: 359970 - protein, 10 aa, Influenza virus
DRAVKLYRKL

SEQ ID NO: 359971 - protein, 10 aa, Influenza virus
RAVKLYRKLK

SEQ ID NO: 359972 - protein, 10 aa, Influenza virus
AVKLYRKLKR

SEQ ID NO: 359973 - protein, 10 aa, Influenza virus
VKLYRKLKRE

SEQ ID NO: 359974 - protein, 10 aa, Influenza virus
KLYRKLKREI

SEQ ID NO: 359975 - protein, 10 aa, Influenza virus
LYRKLKREIT

SEQ ID NO: 359976 - protein, 10 aa, Influenza virus
YRKLKREITF

SEQ ID NO: 359977 - protein, 10 aa, Influenza virus
RKLKREITFH

SEQ ID NO: 359978 - protein, 10 aa, Influenza virus
KLKREITFHG

SEQ ID NO: 359979 - protein, 10 aa, Influenza virus
LKREITFHGA

SEQ ID NO: 359980 - protein, 10 aa, Influenza virus
KREITFHGAK

SEQ ID NO: 359981 - protein, 10 aa, Influenza virus
REITFHGAKE

SEQ ID NO: 359982 - protein, 10 aa, Influenza virus
EITFHGAKEV

SEQ ID NO: 359983 - protein, 10 aa, Influenza virus
GAKEVALSYS

SEQ ID NO: 359984 - protein, 10 aa, Influenza virus
VALSYSTGAL

SEQ ID NO: 359985 - protein, 10 aa, Influenza virus
ALSYSTGALA

SEQ ID NO: 359986 - protein, 10 aa, Influenza virus
LSYSTGALAS

SEQ ID NO: 359987 - protein, 10 aa, Influenza virus
SYSTGALASC

SEQ ID NO: 359988 - protein, 10 aa, Influenza virus
YSTGALASCM

SEQ ID NO: 359989 - protein, 10 aa, Influenza virus
STGALASCMG

SEQ ID NO: 359990 - protein, 10 aa, Influenza virus
TGALASCMGL

SEQ ID NO: 359991 - protein, 10 aa, Influenza virus
GALASCMGLI

SEQ ID NO: 359992 - protein, 10 aa, Influenza virus
ALASCMGLIY

SEQ ID NO: 359993 - protein, 10 aa, Influenza virus
LASCMGLIYN

SEQ ID NO: 359994 - protein, 10 aa, Influenza virus
ASCMGLIYNR

SEQ ID NO: 359995 - protein, 10 aa, Influenza virus
SCMGLIYNRM

SEQ ID NO: 359996 - protein, 10 aa, Influenza virus
CMGLIYNRMG

SEQ ID NO: 359997 - protein, 10 aa, Influenza virus
MGLIYNRMGT

SEQ ID NO: 359998 - protein, 10 aa, Influenza virus
GLIYNRMGTV

SEQ ID NO: 359999 - protein, 10 aa, Influenza virus
LIYNRMGTVT

SEQ ID NO: 360000 - protein, 10 aa, Influenza virus
AFGLVCATCE

SEQ ID NO: 360001 - protein, 10 aa, Influenza virus
FGLVCATCEQ

SEQ ID NO: 360002 - protein, 10 aa, Influenza virus
GLVCATCEQI

SEQ ID NO: 360003 - protein, 10 aa, Influenza virus
LVCATCEQIA

SEQ ID NO: 360004 - protein, 10 aa, Influenza virus
VCATCEQIAD

SEQ ID NO: 360005 - protein, 10 aa, Influenza virus
CATCEQIADS

SEQ ID NO: 360006 - protein, 10 aa, Influenza virus
ATCEQIADSQ

SEQ ID NO: 360007 - protein, 10 aa, Influenza virus
TCEQIADSQH

SEQ ID NO: 360008 - protein, 10 aa, Influenza virus
CEQIADSQHR

SEQ ID NO: 360009 - protein, 10 aa, Influenza virus
EQIADSQHRS

SEQ ID NO: 360010 - protein, 10 aa, Influenza virus
QIADSQHRSH

SEQ ID NO: 360011 - protein, 10 aa, Influenza virus
IADSQHRSHR

SEQ ID NO: 360012 - protein, 10 aa, Influenza virus
ADSQHRSHRQ

SEQ ID NO: 360013 - protein, 10 aa, Influenza virus
DSQHRSHRQM

SEQ ID NO: 360014 - protein, 10 aa, Influenza virus
TTTNPLIRHE

SEQ ID NO: 360015 - protein, 10 aa, Influenza virus
TTNPLIRHEN

SEQ ID NO: 360016 - protein, 10 aa, Influenza virus
TNPLIRHENR

SEQ ID NO: 360017 - protein, 10 aa, Influenza virus
NPLIRHENRM

SEQ ID NO: 360018 - protein, 10 aa, Influenza virus
PLIRHENRMV

SEQ ID NO: 360019 - protein, 10 aa, Influenza virus
LIRHENRMVL

SEQ ID NO: 360020 - protein, 10 aa, Influenza virus
IRHENRMVLA

SEQ ID NO: 360021 - protein, 10 aa, Influenza virus
RHENRMVLAS

SEQ ID NO: 360022 - protein, 10 aa, Influenza virus
HENRMVLAST

SEQ ID NO: 360023 - protein, 10 aa, Influenza virus
ENRMVLASTT

SEQ ID NO: 360024 - protein, 10 aa, Influenza virus
NRMVLASTTA

SEQ ID NO: 360025 - protein, 10 aa, Influenza virus
RMVLASTTAK

SEQ ID NO: 360026 - protein, 10 aa, Influenza virus
MVLASTTAKA

SEQ ID NO: 360027 - protein, 10 aa, Influenza virus
VLASTTAKAM

SEQ ID NO: 360028 - protein, 10 aa, Influenza virus
LASTTAKAME

SEQ ID NO: 360029 - protein, 10 aa, Influenza virus
ASTTAKAMEQ

SEQ ID NO: 360030 - protein, 10 aa, Influenza virus
STTAKAMEQM

SEQ ID NO: 360031 - protein, 10 aa, Influenza virus
TTAKAMEQMA

SEQ ID NO: 360032 - protein, 10 aa, Influenza virus
TAKAMEQMAG

SEQ ID NO: 360033 - protein, 10 aa, Influenza virus
AKAMEQMAGS

SEQ ID NO: 360034 - protein, 10 aa, Influenza virus
KAMEQMAGSS

SEQ ID NO: 360035 - protein, 10 aa, Influenza virus
AMEQMAGSSE

SEQ ID NO: 360036 - protein, 10 aa, Influenza virus
MEQMAGSSEQ

SEQ ID NO: 360037 - protein, 10 aa, Influenza virus
EQMAGSSEQA

SEQ ID NO: 360038 - protein, 10 aa, Influenza virus
QMAGSSEQAA

SEQ ID NO: 360039 - protein, 10 aa, Influenza virus
MAGSSEQAAE

SEQ ID NO: 360040 - protein, 10 aa, Influenza virus
AGSSEQAAEA

SEQ ID NO: 360041 - protein, 10 aa, Influenza virus
GSSEQAAEAM

SEQ ID NO: 360042 - protein, 10 aa, Influenza virus
SSEQAAEAME

SEQ ID NO: 360043 - protein, 10 aa, Influenza virus
SEQAAEAMEV

SEQ ID NO: 360044 - protein, 10 aa, Influenza virus
EQAAEAMEVA

SEQ ID NO: 360045 - protein, 10 aa, Influenza virus
MVQAMRTIGT

SEQ ID NO: 360046 - protein, 10 aa, Influenza virus
DLLENLQAYQ

SEQ ID NO: 360047 - protein, 10 aa, Influenza virus
LLENLQAYQK

SEQ ID NO: 360048 - protein, 10 aa, Influenza virus
LENLQAYQKR

SEQ ID NO: 360049 - protein, 10 aa, Influenza virus
ENLQAYQKRM

SEQ ID NO: 360050 - protein, 10 aa, Influenza virus
NLQAYQKRMG

SEQ ID NO: 360051 - protein, 10 aa, Influenza virus
LQAYQKRMGV

SEQ ID NO: 360052 - protein, 10 aa, Influenza virus
QAYQKRMGVQ

SEQ ID NO: 360053 - protein, 10 aa, Influenza virus
AYQKRMGVQM

SEQ ID NO: 360054 - protein, 10 aa, Influenza virus
YQKRMGVQMQ

SEQ ID NO: 360055 - protein, 10 aa, Influenza virus
QKRMGVQMQR

SEQ ID NO: 360056 - protein, 10 aa, Influenza virus
RMGVQMQRFK

SEQ ID NO: 360057 - protein, 10 aa, Influenza virus
MGVQMQRFRR

SEQ ID NO: 360058 - protein, 10 aa, Influenza virus
GVQMQRFRRP

SEQ ID NO: 360059 - protein, 10 aa, Influenza virus
VQMQRFRRPD

SEQ ID NO: 360060 - protein, 10 aa, Influenza virus
QMQRFRRPDS

SEQ ID NO: 360061 - protein, 10 aa, Influenza virus
MQRFRRPDSS

SEQ ID NO: 360062 - protein, 10 aa, Influenza virus
QRFRRPDSSW

SEQ ID NO: 360063 - protein, 10 aa, Influenza virus
RFRRPDSSWL

SEQ ID NO: 360064 - protein, 10 aa, Influenza virus
FRRPDSSWLF

SEQ ID NO: 360065 - protein, 10 aa, Influenza virus
RRPDSSWLFG

SEQ ID NO: 360066 - protein, 10 aa, Influenza virus
RPDSSWLFGG

SEQ ID NO: 360067 - protein, 10 aa, Influenza virus
SSRHCSKYHW

SEQ ID NO: 360068 - protein, 10 aa, Influenza virus
SRHCSKYHWN

SEQ ID NO: 360069 - protein, 10 aa, Influenza virus
RHCSKYHWNL

SEQ ID NO: 360070 - protein, 10 aa, Influenza virus
HCSKYHWNLA

SEQ ID NO: 360071 - protein, 10 aa, Influenza virus
CSKYHWNLAL

SEQ ID NO: 360072 - protein, 10 aa, Influenza virus
SKYHWNLALD

SEQ ID NO: 360073 - protein, 10 aa, Influenza virus
KYHWNLALDI

SEQ ID NO: 360074 - protein, 10 aa, Influenza virus
YHWNLALDIV

SEQ ID NO: 360075 - protein, 10 aa, Influenza virus
HWNLALDIVD

SEQ ID NO: 360076 - protein, 10 aa, Influenza virus
WNLALDIVDS

SEQ ID NO: 360077 - protein, 10 aa, Influenza virus
MSLLTEVETP

SEQ ID NO: 360078 - protein, 10 aa, Influenza virus
RPTRNGWGCK

SEQ ID NO: 360079 - protein, 10 aa, Influenza virus
GVPESMREEY

SEQ ID NO: 360080 - protein, 10 aa, Influenza virus
DHFVSIELEG

SEQ ID NO: 360081 - protein, 10 aa, Influenza virus
SKSRVDNHSM

SEQ ID NO: 360082 - protein, 10 aa, Influenza virus
KSRVDNHSMS

SEQ ID NO: 360083 - protein, 10 aa, Influenza virus
SRVDNHSMSD

SEQ ID NO: 360084 - protein, 10 aa, Influenza virus
RVDNHSMSDI

SEQ ID NO: 360085 - protein, 10 aa, Influenza virus
VDNHSMSDIE

SEQ ID NO: 360086 - protein, 10 aa, Influenza virus
DNHSMSDIEA

SEQ ID NO: 360087 - protein, 10 aa, Influenza virus
NHSMSDIEAM

SEQ ID NO: 360088 - protein, 10 aa, Influenza virus
HSMSDIEAMA

SEQ ID NO: 360089 - protein, 10 aa, Influenza virus
SMSDIEAMAS

SEQ ID NO: 360090 - protein, 10 aa, Influenza virus
MSDIEAMASQ

SEQ ID NO: 360091 - protein, 10 aa, Influenza virus
SDIEAMASQG

SEQ ID NO: 360092 - protein, 10 aa, Influenza virus
DIEAMASQGT

SEQ ID NO: 360093 - protein, 10 aa, Influenza virus
IEAMASQGTK

SEQ ID NO: 360094 - protein, 10 aa, Influenza virus
EAMASQGTKR

SEQ ID NO: 360095 - protein, 10 aa, Influenza virus
AMASQGTKRS

SEQ ID NO: 360096 - protein, 10 aa, Influenza virus
MASQGTKRSY

SEQ ID NO: 360097 - protein, 10 aa, Influenza virus
ASQGTKRSYE

SEQ ID NO: 360098 - protein, 10 aa, Influenza virus
SQGTKRSYEQ

SEQ ID NO: 360099 - protein, 10 aa, Influenza virus
QGTKRSYEQM

SEQ ID NO: 360100 - protein, 10 aa, Influenza virus
GTKRSYEQME

SEQ ID NO: 360101 - protein, 10 aa, Influenza virus
TKRSYEQMET

SEQ ID NO: 360102 - protein, 10 aa, Influenza virus
KRSYEQMETG

SEQ ID NO: 360103 - protein, 10 aa, Influenza virus
RSYEQMETGG

SEQ ID NO: 360104 - protein, 10 aa, Influenza virus
YEQMETGGER

SEQ ID NO: 360105 - protein, 10 aa, Influenza virus
SEQMETGGER

SEQ ID NO: 360106 - protein, 10 aa, Influenza virus
EQMETGGERQ

SEQ ID NO: 360107 - protein, 10 aa, Influenza virus
TEIRASVGRM

SEQ ID NO: 360108 - protein, 10 aa, Influenza virus
EIRASVGRMV

SEQ ID NO: 360109 - protein, 10 aa, Influenza virus
GGIGRFYIQM

SEQ ID NO: 360110 - protein, 10 aa, Influenza virus
GIGRFYIQMC

SEQ ID NO: 360111 - protein, 10 aa, Influenza virus
IGRFYIQMCT

SEQ ID NO: 360112 - protein, 10 aa, Influenza virus
GRFYIQMCTE

SEQ ID NO: 360113 - protein, 10 aa, Influenza virus
RFYIQMCTEL

SEQ ID NO: 360114 - protein, 10 aa, Influenza virus
FYIQMCTELK

SEQ ID NO: 360115 - protein, 10 aa, Influenza virus
YIQMCTELKL

SEQ ID NO: 360116 - protein, 10 aa, Influenza virus
IQMCTELKLS

SEQ ID NO: 360117 - protein, 10 aa, Influenza virus
QMCTELKLSD

SEQ ID NO: 360118 - protein, 10 aa, Influenza virus
EGRLIQNSIT

SEQ ID NO: 360119 - protein, 10 aa, Influenza virus
GRLIQNSITI

SEQ ID NO: 360120 - protein, 10 aa, Influenza virus
RLIQNSITIE

SEQ ID NO: 360121 - protein, 10 aa, Influenza virus
TIERMVLSAF

SEQ ID NO: 360122 - protein, 10 aa, Influenza virus
IERMVLSAFD

SEQ ID NO: 360123 - protein, 10 aa, Influenza virus
ERMVLSAFDE

SEQ ID NO: 360124 - protein, 10 aa, Influenza virus
RMVLSAFDER

SEQ ID NO: 360125 - protein, 10 aa, Influenza virus
MVLSAFDERR

SEQ ID NO: 360126 - protein, 10 aa, Influenza virus
VLSAFDERRN

SEQ ID NO: 360127 - protein, 10 aa, Influenza virus
LSAFDERRNK

SEQ ID NO: 360128 - protein, 10 aa, Influenza virus
SAFDERRNKY

SEQ ID NO: 360129 - protein, 10 aa, Influenza virus
AFDERRNKYL

SEQ ID NO: 360130 - protein, 10 aa, Influenza virus
FDERRNKYLE

SEQ ID NO: 360131 - protein, 10 aa, Influenza virus
DERRNKYLEE

SEQ ID NO: 360132 - protein, 10 aa, Influenza virus
ERRNKYLEEH

SEQ ID NO: 360133 - protein, 10 aa, Influenza virus
RRNKYLEEHP

SEQ ID NO: 360134 - protein, 10 aa, Influenza virus
RNKYLEEHPS

SEQ ID NO: 360135 - protein, 10 aa, Influenza virus
NKYLEEHPSA

SEQ ID NO: 360136 - protein, 10 aa, Influenza virus
KYLEEHPSAG

SEQ ID NO: 360137 - protein, 10 aa, Influenza virus
YLEEHPSAGK

SEQ ID NO: 360138 - protein, 10 aa, Influenza virus
LEEHPSAGKD

SEQ ID NO: 360139 - protein, 10 aa, Influenza virus
EEHPSAGKDP

SEQ ID NO: 360140 - protein, 10 aa, Influenza virus
EHPSAGKDPK

SEQ ID NO: 360141 - protein, 10 aa, Influenza virus
HPSAGKDPKK

SEQ ID NO: 360142 - protein, 10 aa, Influenza virus
PSAGKDPKKT

SEQ ID NO: 360143 - protein, 10 aa, Influenza virus
SAGKDPKKTG

SEQ ID NO: 360144 - protein, 10 aa, Influenza virus
AGKDPKKTGG

SEQ ID NO: 360145 - protein, 10 aa, Influenza virus
GKDPKKTGGP

SEQ ID NO: 360146 - protein, 10 aa, Influenza virus
KDPKKTGGPI

SEQ ID NO: 360147 - protein, 10 aa, Influenza virus
DPKKTGGPIY

SEQ ID NO: 360148 - protein, 10 aa, Influenza virus
PKKTGGPIYR

SEQ ID NO: 360149 - protein, 10 aa, Influenza virus
KKTGGPIYRR

SEQ ID NO: 360150 - protein, 10 aa, Influenza virus
EIRRIWRQAN

SEQ ID NO: 360151 - protein, 10 aa, Influenza virus
RRIWRQANNG

SEQ ID NO: 360152 - protein, 10 aa, Influenza virus
RIWRQANNGE

SEQ ID NO: 360153 - protein, 10 aa, Influenza virus
WRQANNGEDA

SEQ ID NO: 360154 - protein, 10 aa, Influenza virus
AGLTHIMIWH

SEQ ID NO: 360155 - protein, 10 aa, Influenza virus
GLTHIMIWHS

SEQ ID NO: 360156 - protein, 10 aa, Influenza virus
LTHIMIWHSN

SEQ ID NO: 360157 - protein, 10 aa, Influenza virus
THIMIWHSNL

SEQ ID NO: 360158 - protein, 10 aa, Influenza virus
HIMIWHSNLN

SEQ ID NO: 360159 - protein, 10 aa, Influenza virus
IMIWHSNLND

SEQ ID NO: 360160 - protein, 10 aa, Influenza virus
MIWHSNLNDA

SEQ ID NO: 360161 - protein, 10 aa, Influenza virus
IWHSNLNDAT

SEQ ID NO: 360162 - protein, 10 aa, Influenza virus
WHSNLNDATY

SEQ ID NO: 360163 - protein, 10 aa, Influenza virus
HSNLNDATYQ

SEQ ID NO: 360164 - protein, 10 aa, Influenza virus
SNLNDATYQR

SEQ ID NO: 360165 - protein, 10 aa, Influenza virus
NLNDATYQRT

SEQ ID NO: 360166 - protein, 10 aa, Influenza virus
LNDATYQRTR

SEQ ID NO: 360167 - protein, 10 aa, Influenza virus
NDATYQRTRA

SEQ ID NO: 360168 - protein, 10 aa, Influenza virus
DATYQRTRAL

SEQ ID NO: 360169 - protein, 10 aa, Influenza virus
ATYQRTRALV

SEQ ID NO: 360170 - protein, 10 aa, Influenza virus
TYQRTRALVR

SEQ ID NO: 360171 - protein, 10 aa, Influenza virus
YQRTRALVRT

SEQ ID NO: 360172 - protein, 10 aa, Influenza virus
QRTRALVRTG

SEQ ID NO: 360173 - protein, 10 aa, Influenza virus
RTRALVRTGM

SEQ ID NO: 360174 - protein, 10 aa, Influenza virus
TRALVRTGMD

SEQ ID NO: 360175 - protein, 10 aa, Influenza virus
RALVRTGMDP

SEQ ID NO: 360176 - protein, 10 aa, Influenza virus
ALVRTGMDPR

SEQ ID NO: 360177 - protein, 10 aa, Influenza virus
LVRTGMDPRM

SEQ ID NO: 360178 - protein, 10 aa, Influenza virus
VRTGMDPRMC

SEQ ID NO: 360179 - protein, 10 aa, Influenza virus
RTGMDPRMCS

SEQ ID NO: 360180 - protein, 10 aa, Influenza virus
TGMDPRMCSL

SEQ ID NO: 360181 - protein, 10 aa, Influenza virus
GMDPRMCSLM

SEQ ID NO: 360182 - protein, 10 aa, Influenza virus
MDPRMCSLMQ

SEQ ID NO: 360183 - protein, 10 aa, Influenza virus
DPRMCSLMQG

SEQ ID NO: 360184 - protein, 10 aa, Influenza virus
PRMCSLMQGS

SEQ ID NO: 360185 - protein, 10 aa, Influenza virus
RMCSLMQGST

SEQ ID NO: 360186 - protein, 10 aa, Influenza virus
MCSLMQGSTL

SEQ ID NO: 360187 - protein, 10 aa, Influenza virus
CSLMQGSTLP

SEQ ID NO: 360188 - protein, 10 aa, Influenza virus
SLMQGSTLPR

SEQ ID NO: 360189 - protein, 10 aa, Influenza virus
LMQGSTLPRR

SEQ ID NO: 360190 - protein, 10 aa, Influenza virus
MQGSTLPRRS

SEQ ID NO: 360191 - protein, 10 aa, Influenza virus
QGSTLPRRSG

SEQ ID NO: 360192 - protein, 10 aa, Influenza virus
GSTLPRRSGA

SEQ ID NO: 360193 - protein, 10 aa, Influenza virus
STLPRRSGAA

SEQ ID NO: 360194 - protein, 10 aa, Influenza virus
TLPRRSGAAG

SEQ ID NO: 360195 - protein, 10 aa, Influenza virus
LPRRSGAAGA

SEQ ID NO: 360196 - protein, 10 aa, Influenza virus
PRRSGAAGAA

SEQ ID NO: 360197 - protein, 10 aa, Influenza virus
RRSGAAGAAV

SEQ ID NO: 360198 - protein, 10 aa, Influenza virus
RSGAAGAAVK

SEQ ID NO: 360199 - protein, 10 aa, Influenza virus
SGAAGAAVKG

SEQ ID NO: 360200 - protein, 10 aa, Influenza virus
GAAGAAVKGV

SEQ ID NO: 360201 - protein, 10 aa, Influenza virus
AAGAAVKGVG

SEQ ID NO: 360202 - protein, 10 aa, Influenza virus
AGAAVKGVGT

SEQ ID NO: 360203 - protein, 10 aa, Influenza virus
GAAVKGVGTM

SEQ ID NO: 360204 - protein, 10 aa, Influenza virus
VMELIRMIKR

SEQ ID NO: 360205 - protein, 10 aa, Influenza virus
MELIRMIKRG

SEQ ID NO: 360206 - protein, 10 aa, Influenza virus
ELIRMIKRGI

SEQ ID NO: 360207 - protein, 10 aa, Influenza virus
LIRMIKRGIN

SEQ ID NO: 360208 - protein, 10 aa, Influenza virus
IRMIKRGIND

SEQ ID NO: 360209 - protein, 10 aa, Influenza virus
RMIKRGINDR

SEQ ID NO: 360210 - protein, 10 aa, Influenza virus
MIKRGINDRN

SEQ ID NO: 360211 - protein, 10 aa, Influenza virus
IKRGINDRNF

SEQ ID NO: 360212 - protein, 10 aa, Influenza virus
KRGINDRNFW

SEQ ID NO: 360213 - protein, 10 aa, Influenza virus
RGINDRNFWR

SEQ ID NO: 360214 - protein, 10 aa, Influenza virus
GINDRNFWRG

SEQ ID NO: 360215 - protein, 10 aa, Influenza virus
INDRNFWRGE

SEQ ID NO: 360216 - protein, 10 aa, Influenza virus
NDRNFWRGEN

SEQ ID NO: 360217 - protein, 10 aa, Influenza virus
DRNFWRGENG

SEQ ID NO: 360218 - protein, 10 aa, Influenza virus
RNFWRGENGR

SEQ ID NO: 360219 - protein, 10 aa, Influenza virus
NFWRGENGRR

SEQ ID NO: 360220 - protein, 10 aa, Influenza virus
FWRGENGRRT

SEQ ID NO: 360221 - protein, 10 aa, Influenza virus
WRGENGRRTR

SEQ ID NO: 360222 - protein, 10 aa, Influenza virus
TRIAYERMCN

SEQ ID NO: 360223 - protein, 10 aa, Influenza virus
RIAYERMCNI

SEQ ID NO: 360224 - protein, 10 aa, Influenza virus
IAYERMCNIL

SEQ ID NO: 360225 - protein, 10 aa, Influenza virus
AYERMCNILK

SEQ ID NO: 360226 - protein, 10 aa, Influenza virus
YERMCNILKG

SEQ ID NO: 360227 - protein, 10 aa, Influenza virus
ERMCNILKGK

SEQ ID NO: 360228 - protein, 10 aa, Influenza virus
RMCNILKGKF

SEQ ID NO: 360229 - protein, 10 aa, Influenza virus
MCNILKGKFQ

SEQ ID NO: 360230 - protein, 10 aa, Influenza virus
CNILKGKFQT

SEQ ID NO: 360231 - protein, 10 aa, Influenza virus
NILKGKFQTA

SEQ ID NO: 360232 - protein, 10 aa, Influenza virus
ILKGKFQTAA

SEQ ID NO: 360233 - protein, 10 aa, Influenza virus
LKGKFQTAAQ

SEQ ID NO: 360234 - protein, 10 aa, Influenza virus
SKGSSKQQHK

SEQ ID NO: 360235 - protein, 10 aa, Influenza virus
KGKFQTAAQR

SEQ ID NO: 360236 - protein, 10 aa, Influenza virus
GKFQTAAQRA

SEQ ID NO: 360237 - protein, 10 aa, Influenza virus
KFQTAAQRAM

SEQ ID NO: 360238 - protein, 10 aa, Influenza virus
FQTAAQRAMM

SEQ ID NO: 360239 - protein, 10 aa, Influenza virus
QTAAQRAMMD

SEQ ID NO: 360240 - protein, 10 aa, Influenza virus
TAAQRAMMDQ

SEQ ID NO: 360241 - protein, 10 aa, Influenza virus
AAQRAMMDQV

SEQ ID NO: 360242 - protein, 10 aa, Influenza virus
AQRAMMDQVR

SEQ ID NO: 360243 - protein, 10 aa, Influenza virus
QRAMMDQVRE

SEQ ID NO: 360244 - protein, 10 aa, Influenza virus
RAMMDQVRES

SEQ ID NO: 360245 - protein, 10 aa, Influenza virus
AMMDQVRESR

SEQ ID NO: 360246 - protein, 10 aa, Influenza virus
MMDQVRESRN

SEQ ID NO: 360247 - protein, 10 aa, Influenza virus
MDQVRESRNP

SEQ ID NO: 360248 - protein, 10 aa, Influenza virus
DQVRESRNPG

SEQ ID NO: 360249 - protein, 10 aa, Influenza virus
QVRESRNPGN

SEQ ID NO: 360250 - protein, 10 aa, Influenza virus
VRESRNPGNA

SEQ ID NO: 360251 - protein, 10 aa, Influenza virus
RESRNPGNAE

SEQ ID NO: 360252 - protein, 10 aa, Influenza virus
ESRNPGNAEI

SEQ ID NO: 360253 - protein, 10 aa, Influenza virus
SRNPGNAEIE

SEQ ID NO: 360254 - protein, 10 aa, Influenza virus
RNPGNAEIED

SEQ ID NO: 360255 - protein, 10 aa, Influenza virus
NPGNAEIEDL

SEQ ID NO: 360256 - protein, 10 aa, Influenza virus
PGNAEIEDLI

SEQ ID NO: 360257 - protein, 10 aa, Influenza virus
GNAEIEDLIF

SEQ ID NO: 360258 - protein, 10 aa, Influenza virus
NAEIEDLIFL

SEQ ID NO: 360259 - protein, 10 aa, Influenza virus
AEIEDLIFLA

SEQ ID NO: 360260 - protein, 10 aa, Influenza virus
EIEDLIFLAR

SEQ ID NO: 360261 - protein, 10 aa, Influenza virus
IEDLIFLARS

SEQ ID NO: 360262 - protein, 10 aa, Influenza virus
EDLIFLARSA

SEQ ID NO: 360263 - protein, 10 aa, Influenza virus
DLIFLARSAL

SEQ ID NO: 360264 - protein, 10 aa, Influenza virus
LIFLARSALI

SEQ ID NO: 360265 - protein, 10 aa, Influenza virus
IFLARSALIL

SEQ ID NO: 360266 - protein, 10 aa, Influenza virus
FLARSALILR

SEQ ID NO: 360267 - protein, 10 aa, Influenza virus
LARSALILRG

SEQ ID NO: 360268 - protein, 10 aa, Influenza virus
ARSALILRGS

SEQ ID NO: 360269 - protein, 10 aa, Influenza virus
RSALILRGSV

SEQ ID NO: 360270 - protein, 10 aa, Influenza virus
SASALILRGS

SEQ ID NO: 360271 - protein, 10 aa, Influenza virus
ASALILRGSV

SEQ ID NO: 360272 - protein, 10 aa, Influenza virus
SALILRGSVA

SEQ ID NO: 360273 - protein, 10 aa, Influenza virus
ALILRGSVAH

SEQ ID NO: 360274 - protein, 10 aa, Influenza virus
LILRGSVAHK

SEQ ID NO: 360275 - protein, 10 aa, Influenza virus
ILRGSVAHKS

SEQ ID NO: 360276 - protein, 10 aa, Influenza virus
LRGSVAHKSC

SEQ ID NO: 360277 - protein, 10 aa, Influenza virus
RGSVAHKSCL

SEQ ID NO: 360278 - protein, 10 aa, Influenza virus
GSVAHKSCLP

SEQ ID NO: 360279 - protein, 10 aa, Influenza virus
SVAHKSCLPA

SEQ ID NO: 360280 - protein, 10 aa, Influenza virus
VAHKSCLPAC

SEQ ID NO: 360281 - protein, 10 aa, Influenza virus
AHKSCLPACV

SEQ ID NO: 360282 - protein, 10 aa, Influenza virus
HKSCLPACVY

SEQ ID NO: 360283 - protein, 10 aa, Influenza virus
KSCLPACVYG

SEQ ID NO: 360284 - protein, 10 aa, Influenza virus
SCLPACVYGL

SEQ ID NO: 360285 - protein, 10 aa, Influenza virus
CLPACVYGLA

SEQ ID NO: 360286 - protein, 10 aa, Influenza virus
GYDFEREGYS

SEQ ID NO: 360287 - protein, 10 aa, Influenza virus
YDFEREGYSL

SEQ ID NO: 360288 - protein, 10 aa, Influenza virus
DFEREGYSLV

SEQ ID NO: 360289 - protein, 10 aa, Influenza virus
FEREGYSLVG

SEQ ID NO: 360290 - protein, 10 aa, Influenza virus
EREGYSLVGI

SEQ ID NO: 360291 - protein, 10 aa, Influenza virus
REGYSLVGID

SEQ ID NO: 360292 - protein, 10 aa, Influenza virus
EGYSLVGIDP

SEQ ID NO: 360293 - protein, 10 aa, Influenza virus
GYSLVGIDPF

SEQ ID NO: 360294 - protein, 10 aa, Influenza virus
YSLVGIDPFK

SEQ ID NO: 360295 - protein, 10 aa, Influenza virus
SLVGIDPFKL

SEQ ID NO: 360296 - protein, 10 aa, Influenza virus
LVGIDPFKLL

SEQ ID NO: 360297 - protein, 10 aa, Influenza virus
VGIDPFKLLQ

SEQ ID NO: 360298 - protein, 10 aa, Influenza virus
DPDPFRLLQN

SEQ ID NO: 360299 - protein, 10 aa, Influenza virus
PDPFRLLQNS

SEQ ID NO: 360300 - protein, 10 aa, Influenza virus
DPFKLLQNSQ

SEQ ID NO: 360301 - protein, 10 aa, Influenza virus
PFRLLQNSQV

SEQ ID NO: 360302 - protein, 10 aa, Influenza virus
PRLLQNSQVF

SEQ ID NO: 360303 - protein, 10 aa, Influenza virus
RPNENPAHKS

SEQ ID NO: 360304 - protein, 10 aa, Influenza virus
PNENPAHKSQ

SEQ ID NO: 360305 - protein, 10 aa, Influenza virus
NENPAHKSQL

SEQ ID NO: 360306 - protein, 10 aa, Influenza virus
ENPAHKSQLV

SEQ ID NO: 360307 - protein, 10 aa, Influenza virus
NPAHKSQLVW

SEQ ID NO: 360308 - protein, 10 aa, Influenza virus
PAHKSQLVWM

SEQ ID NO: 360309 - protein, 10 aa, Influenza virus
AHKSQLVWMA

SEQ ID NO: 360310 - protein, 10 aa, Influenza virus
HKSQLVWMAC

SEQ ID NO: 360311 - protein, 10 aa, Influenza virus
KSQLVWMACH

SEQ ID NO: 360312 - protein, 10 aa, Influenza virus
SQLVWMACHS

SEQ ID NO: 360313 - protein, 10 aa, Influenza virus
QLVWMACHSA

SEQ ID NO: 360314 - protein, 10 aa, Influenza virus
LVWMACHSAA

SEQ ID NO: 360315 - protein, 10 aa, Influenza virus
VWMACHSAAF

SEQ ID NO: 360316 - protein, 10 aa, Influenza virus
WMACHSAAFE

SEQ ID NO: 360317 - protein, 10 aa, Influenza virus
MACHSAAFED

SEQ ID NO: 360318 - protein, 10 aa, Influenza virus
ACHSAAFEDL

SEQ ID NO: 360319 - protein, 10 aa, Influenza virus
CHSAAFEDLR

SEQ ID NO: 360320 - protein, 10 aa, Influenza virus
HSAAFEDLRV

SEQ ID NO: 360321 - protein, 10 aa, Influenza virus
SAAFEDLRVS

SEQ ID NO: 360322 - protein, 10 aa, Influenza virus
LSTRGVQIAS

SEQ ID NO: 360323 - protein, 10 aa, Influenza virus
STRGVQIASN

SEQ ID NO: 360324 - protein, 10 aa, Influenza virus
TRGVQIASNE

SEQ ID NO: 360325 - protein, 10 aa, Influenza virus
RGVQIASNEN

SEQ ID NO: 360326 - protein, 10 aa, Influenza virus
TLELRSRYWA

SEQ ID NO: 360327 - protein, 10 aa, Influenza virus
LELRSRYWAI

SEQ ID NO: 360328 - protein, 10 aa, Influenza virus
ELRSRYWAIR

SEQ ID NO: 360329 - protein, 10 aa, Influenza virus
LRSRYWAIRT

SEQ ID NO: 360330 - protein, 10 aa, Influenza virus
RSRYWAIRTR

SEQ ID NO: 360331 - protein, 10 aa, Influenza virus
SRYWAIRTRS

SEQ ID NO: 360332 - protein, 10 aa, Influenza virus
RYWAIRTRSG

SEQ ID NO: 360333 - protein, 10 aa, Influenza virus
YWAIRTRSGG

SEQ ID NO: 360334 - protein, 10 aa, Influenza virus
WAIRTRSGGN

SEQ ID NO: 360335 - protein, 10 aa, Influenza virus
AIRTRSGGNT

SEQ ID NO: 360336 - protein, 10 aa, Influenza virus
IRTRSGGNTN

SEQ ID NO: 360337 - protein, 10 aa, Influenza virus
RTRSGGNTNQ

SEQ ID NO: 360338 - protein, 10 aa, Influenza virus
ASAGQISVQP

SEQ ID NO: 360339 - protein, 10 aa, Influenza virus
SVQPTFSVQR

SEQ ID NO: 360340 - protein, 10 aa, Influenza virus
VQPTFSVQRN

SEQ ID NO: 360341 - protein, 10 aa, Influenza virus
QPTFSVQRNL

SEQ ID NO: 360342 - protein, 10 aa, Influenza virus
PTFSVQRNLP

SEQ ID NO: 360343 - protein, 10 aa, Influenza virus
TFSVQRNLPF

SEQ ID NO: 360344 - protein, 10 aa, Influenza virus
FSVQRNLPFE

SEQ ID NO: 360345 - protein, 10 aa, Influenza virus
SVQRNLPFER

SEQ ID NO: 360346 - protein, 10 aa, Influenza virus
EGRTSDMRTE

SEQ ID NO: 360347 - protein, 10 aa, Influenza virus
GRTSDMRTEI

SEQ ID NO: 360348 - protein, 10 aa, Influenza virus
RTSDMRTEII

SEQ ID NO: 360349 - protein, 10 aa, Influenza virus
RRAEIIKMES

SEQ ID NO: 360350 - protein, 10 aa, Influenza virus
TEIIIRMMEN

SEQ ID NO: 360351 - protein, 10 aa, Influenza virus
EIIIRMMENA

SEQ ID NO: 360352 - protein, 10 aa, Influenza virus
IIIRMMENAR

SEQ ID NO: 360353 - protein, 10 aa, Influenza virus
DVSFQGRGVF

SEQ ID NO: 360354 - protein, 10 aa, Influenza virus
VSFQGRGVFE

SEQ ID NO: 360355 - protein, 10 aa, Influenza virus
SFQGRGVFEL

SEQ ID NO: 360356 - protein, 10 aa, Influenza virus
FQGRGVFELS

SEQ ID NO: 360357 - protein, 10 aa, Influenza virus
QGRGVFELSD

SEQ ID NO: 360358 - protein, 10 aa, Influenza virus
GRGVFELSDE

SEQ ID NO: 360359 - protein, 10 aa, Influenza virus
RRGQGHLDEK

SEQ ID NO: 360360 - protein, 10 aa, Influenza virus
RGVFELSDEK

SEQ ID NO: 360361 - protein, 10 aa, Influenza virus
GVFELSDEKA

SEQ ID NO: 360362 - protein, 10 aa, Influenza virus
VFELSDEKAT

SEQ ID NO: 360363 - protein, 10 aa, Influenza virus
ATNPIVPSFD

SEQ ID NO: 360364 - protein, 10 aa, Influenza virus
PIVPSFDMSN

SEQ ID NO: 360365 - protein, 10 aa, Influenza virus
MSNEGSYFFG

SEQ ID NO: 360366 - protein, 10 aa, Influenza virus
SNEGSYFFGD

SEQ ID NO: 360367 - protein, 10 aa, Influenza virus
NEGSYFFGDN

SEQ ID NO: 360368 - protein, 10 aa, Influenza virus
EGSYFFGDNA

SEQ ID NO: 360369 - protein, 10 aa, Influenza virus
GSYFFGDNAE

SEQ ID NO: 360370 - protein, 10 aa, Influenza virus
SYFFGDNAEE

SEQ ID NO: 360371 - protein, 10 aa, Influenza virus
YFFGDNAEEY

SEQ ID NO: 360372 - protein, 10 aa, Influenza virus
DNAEEYRRLR

SEQ ID NO: 360373 - protein, 10 aa, Influenza virus
MLFVQSYFQL

SEQ ID NO: 360374 - protein, 10 aa, Influenza virus
LFVQSYFQLF

SEQ ID NO: 360375 - protein, 10 aa, Influenza virus
FVQSYFQLFL

SEQ ID NO: 360376 - protein, 10 aa, Influenza virus
VQSYFQLFLV

SEQ ID NO: 360377 - protein, 10 aa, Influenza virus
QSYFQLFLVC

SEQ ID NO: 360378 - protein, 10 aa, Influenza virus
SYFQLFLVCV

SEQ ID NO: 360379 - protein, 10 aa, Influenza virus
YFQLFLVCVS

SEQ ID NO: 360380 - protein, 10 aa, Influenza virus
FQLFLVCVSL

SEQ ID NO: 360381 - protein, 10 aa, Influenza virus
QLFLVCVSLL

SEQ ID NO: 360382 - protein, 10 aa, Influenza virus
LFLVCVSLLQ

SEQ ID NO: 360383 - protein, 10 aa, Influenza virus
FLVCVSLLQS

SEQ ID NO: 360384 - protein, 10 aa, Influenza virus
LVCVSLLQSA

SEQ ID NO: 360385 - protein, 10 aa, Influenza virus
VCVSLLQSAI

SEQ ID NO: 360386 - protein, 10 aa, Influenza virus
CVSLLQSAIL

SEQ ID NO: 360387 - protein, 10 aa, Influenza virus
VSLLQSAILS

SEQ ID NO: 360388 - protein, 10 aa, Influenza virus
SLLQSAILSL

SEQ ID NO: 360389 - protein, 10 aa, Influenza virus
LLQSAILSLQ

SEQ ID NO: 360390 - protein, 10 aa, Influenza virus
SSFQVDCFLW

SEQ ID NO: 360391 - protein, 10 aa, Influenza virus
SFQVDCFLWH

SEQ ID NO: 360392 - protein, 10 aa, Influenza virus
FQVDCFLWHV

SEQ ID NO: 360393 - protein, 10 aa, Influenza virus
QVDCFLWHVR

SEQ ID NO: 360394 - protein, 10 aa, Influenza virus
GDAPFLDRLR

SEQ ID NO: 360395 - protein, 10 aa, Influenza virus
DAPFLDRLRR

SEQ ID NO: 360396 - protein, 10 aa, Influenza virus
APFLDRLRRD

SEQ ID NO: 360397 - protein, 10 aa, Influenza virus
PFLDRLRRDQ

SEQ ID NO: 360398 - protein, 10 aa, Influenza virus
SLLLLQANLC

SEQ ID NO: 360399 - protein, 10 aa, Influenza virus
LLLLQANLCR

SEQ ID NO: 360400 - protein, 10 aa, Influenza virus
LLLQANLCRF

SEQ ID NO: 360401 - protein, 10 aa, Influenza virus
LLQANLCRFL

SEQ ID NO: 360402 - protein, 10 aa, Influenza virus
LQANLCRFLE

SEQ ID NO: 360403 - protein, 10 aa, Influenza virus
QANLCRFLET

SEQ ID NO: 360404 - protein, 10 aa, Influenza virus
ANLCRFLETR

SEQ ID NO: 360405 - protein, 10 aa, Influenza virus
NLCRFLETRT

SEQ ID NO: 360406 - protein, 10 aa, Influenza virus
DRLRRDQKSL

SEQ ID NO: 360407 - protein, 10 aa, Influenza virus
RRDQKSLRGR

SEQ ID NO: 360408 - protein, 10 aa, Influenza virus
PMRTPIAFLT

SEQ ID NO: 360409 - protein, 10 aa, Influenza virus
MRTPIAFLTS

SEQ ID NO: 360410 - protein, 10 aa, Influenza virus
RTPIAFLTSS

SEQ ID NO: 360411 - protein, 10 aa, Influenza virus
TPIAFLTSSI

SEQ ID NO: 360412 - protein, 10 aa, Influenza virus
PIAFLTSSIV

SEQ ID NO: 360413 - protein, 10 aa, Influenza virus
IAFLTSSIVC

SEQ ID NO: 360414 - protein, 10 aa, Influenza virus
AFLTSSIVCP

SEQ ID NO: 360415 - protein, 10 aa, Influenza virus
FLTSSIVCPG

SEQ ID NO: 360416 - protein, 10 aa, Influenza virus
IASVPASRYL

SEQ ID NO: 360417 - protein, 10 aa, Influenza virus
ASVPASRYLI

SEQ ID NO: 360418 - protein, 10 aa, Influenza virus
SKITLKFAFN

SEQ ID NO: 360419 - protein, 10 aa, Influenza virus
KITLKFAFNM

SEQ ID NO: 360420 - protein, 10 aa, Influenza virus
ITLKFAFNMM

SEQ ID NO: 360421 - protein, 10 aa, Influenza virus
AGVETMVILS

SEQ ID NO: 360422 - protein, 10 aa, Influenza virus
GVETMVILSA

SEQ ID NO: 360423 - protein, 10 aa, Influenza virus
NWPSSSGGLE

SEQ ID NO: 360424 - protein, 10 aa, Influenza virus
SRNGKWREQL

SEQ ID NO: 360425 - protein, 10 aa, Influenza virus
RNGKWREQLS

SEQ ID NO: 360426 - protein, 10 aa, Influenza virus
NGKWREQLSQ

SEQ ID NO: 360427 - protein, 10 aa, Influenza virus
GKWREQLSQK

SEQ ID NO: 360428 - protein, 10 aa, Influenza virus
KWREQLSQKF

SEQ ID NO: 360429 - protein, 10 aa, Influenza virus
WREQLSQKFE

SEQ ID NO: 360430 - protein, 10 aa, Influenza virus
REQLSQKFEE

SEQ ID NO: 360431 - protein, 10 aa, Influenza virus
EQLSQKFEEI

SEQ ID NO: 360432 - protein, 10 aa, Influenza virus
QLSQKFEEIR

SEQ ID NO: 360433 - protein, 10 aa, Influenza virus
LSQKFEEIRW

SEQ ID NO: 360434 - protein, 10 aa, Influenza virus
EVRGDQMAHC

SEQ ID NO: 360435 - protein, 10 aa, Influenza virus
VRRDQMAHCR

SEQ ID NO: 360436 - protein, 10 aa, Influenza virus
RHRLKITENS

SEQ ID NO: 360437 - protein, 10 aa, Influenza virus
HRLKITENSF

SEQ ID NO: 360438 - protein, 10 aa, Influenza virus
RLKITENSFE

SEQ ID NO: 360439 - protein, 10 aa, Influenza virus
LKITENSFEQ

SEQ ID NO: 360440 - protein, 10 aa, Influenza virus
KITENSFEQI

SEQ ID NO: 360441 - protein, 10 aa, Influenza virus
ITENSFEQIT

SEQ ID NO: 360442 - protein, 10 aa, Influenza virus
TENSFEQITF

SEQ ID NO: 360443 - protein, 10 aa, Influenza virus
ENSFEQITFM

SEQ ID NO: 360444 - protein, 10 aa, Influenza virus
NSFEQITFMQ

SEQ ID NO: 360445 - protein, 10 aa, Influenza virus
SFEQITFMQA

SEQ ID NO: 360446 - protein, 10 aa, Influenza virus
FEQITFMQAL

SEQ ID NO: 360447 - protein, 10 aa, Influenza virus
EQITFMQALQ

SEQ ID NO: 360448 - protein, 10 aa, Influenza virus
QITFMQALQL

SEQ ID NO: 360449 - protein, 10 aa, Influenza virus
TAFSGMSANG

SEQ ID NO: 360450 - protein, 10 aa, Influenza virus
AFSGMSANGD

SEQ ID NO: 360451 - protein, 10 aa, Influenza virus
FSGMSANGDI

SEQ ID NO: 360452 - protein, 10 aa, Influenza virus
SGMSANGDIL

SEQ ID NO: 360453 - protein, 10 aa, Influenza virus
GMSANGDILM

SEQ ID NO: 360454 - protein, 10 aa, Influenza virus
FQYLLFQDIL

SEQ ID NO: 360455 - protein, 10 aa, Influenza virus
QYLLFQDILM

SEQ ID NO: 360456 - protein, 10 aa, Influenza virus
YLLFQDILMR

SEQ ID NO: 360457 - protein, 10 aa, Influenza virus
LLFQDILMRM

SEQ ID NO: 360458 - protein, 10 aa, Influenza virus
LFQDILMRMS

SEQ ID NO: 360459 - protein, 10 aa, Influenza virus
LWHVRKRFAD

SEQ ID NO: 360460 - protein, 10 aa, Influenza virus
WHVRKRFADQ

SEQ ID NO: 360461 - protein, 10 aa, Influenza virus
HVRKRFADQE

SEQ ID NO: 360462 - protein, 10 aa, Influenza virus
VRKRFADQEL

SEQ ID NO: 360463 - protein, 10 aa, Influenza virus
RKRFADQELG

SEQ ID NO: 360464 - protein, 10 aa, Influenza virus
KRFADQELGD

SEQ ID NO: 360465 - protein, 10 aa, Influenza virus
RFADQELGDA

SEQ ID NO: 360466 - protein, 10 aa, Influenza virus
FADQELGDAP

SEQ ID NO: 360467 - protein, 10 aa, Influenza virus
ADQELGDAPF

SEQ ID NO: 360468 - protein, 10 aa, Influenza virus
DQELGDAPFL

SEQ ID NO: 360469 - protein, 10 aa, Influenza virus
QELGDAPFLD

SEQ ID NO: 360470 - protein, 10 aa, Influenza virus
ELGDAPFLDR

SEQ ID NO: 360471 - protein, 10 aa, Influenza virus
LGDAPFLDRL

SEQ ID NO: 360472 - protein, 10 aa, Influenza virus
GDAPFLDRLR

SEQ ID NO: 360473 - protein, 10 aa, Influenza virus
DAPFLDRLRR

SEQ ID NO: 360474 - protein, 10 aa, Influenza virus
APFLDRLRRD

SEQ ID NO: 360475 - protein, 10 aa, Influenza virus
PFLDRLRRDQ

SEQ ID NO: 360476 - protein, 10 aa, Influenza virus
FLDRLRRDQK

SEQ ID NO: 360477 - protein, 10 aa, Influenza virus
LDRLRRDQKS

SEQ ID NO: 360478 - protein, 10 aa, Influenza virus
DRLRRDQKSL

SEQ ID NO: 360479 - protein, 10 aa, Influenza virus
RLRRDQKSLR

SEQ ID NO: 360480 - protein, 10 aa, Influenza virus
LRRDQKSLRG

SEQ ID NO: 360481 - protein, 10 aa, Influenza virus
RRDQKSLRGR

SEQ ID NO: 360482 - protein, 10 aa, Influenza virus
RDQKSLRGRG

SEQ ID NO: 360483 - protein, 10 aa, Influenza virus
DQKSLRGRGS

SEQ ID NO: 360484 - protein, 10 aa, Influenza virus
QKSLRGRGST

SEQ ID NO: 360485 - protein, 10 aa, Influenza virus
KSLRGRGSTL

SEQ ID NO: 360486 - protein, 10 aa, Influenza virus
SLRGRGSTLG

SEQ ID NO: 360487 - protein, 10 aa, Influenza virus
LRGRGSTLGL

SEQ ID NO: 360488 - protein, 10 aa, Influenza virus
RGRGSTLGLD

SEQ ID NO: 360489 - protein, 10 aa, Influenza virus
GRGSTLGLDI

SEQ ID NO: 360490 - protein, 10 aa, Influenza virus
RGSTLGLDIR

SEQ ID NO: 360491 - protein, 10 aa, Influenza virus
GSTLGLDIRT

SEQ ID NO: 360492 - protein, 10 aa, Influenza virus
STLGLDIRTA

SEQ ID NO: 360493 - protein, 10 aa, Influenza virus
TLGLDIRTAT

SEQ ID NO: 360494 - protein, 10 aa, Influenza virus
LGLDIRTATR

SEQ ID NO: 360495 - protein, 10 aa, Influenza virus
GLDIRTATRE

SEQ ID NO: 360496 - protein, 10 aa, Influenza virus
LDIRTATREG

SEQ ID NO: 360497 - protein, 10 aa, Influenza virus
DIRTATREGK

SEQ ID NO: 360498 - protein, 10 aa, Influenza virus
IRTATREGKH

SEQ ID NO: 360499 - protein, 10 aa, Influenza virus
RTATREGKHI

SEQ ID NO: 360500 - protein, 10 aa, Influenza virus
TATREGKHIV

SEQ ID NO: 360501 - protein, 10 aa, Influenza virus
ATREGKHIVE

SEQ ID NO: 360502 - protein, 10 aa, Influenza virus
TREGKHIVER

SEQ ID NO: 360503 - protein, 10 aa, Influenza virus
REGKHIVERI

SEQ ID NO: 360504 - protein, 10 aa, Influenza virus
EGKHIVERIL

SEQ ID NO: 360505 - protein, 10 aa, Influenza virus
GKHIVERILE

SEQ ID NO: 360506 - protein, 10 aa, Influenza virus
KHIVERILEE

SEQ ID NO: 360507 - protein, 10 aa, Influenza virus
HIVERILEEE

SEQ ID NO: 360508 - protein, 10 aa, Influenza virus
IVERILEEES

SEQ ID NO: 360509 - protein, 10 aa, Influenza virus
VERILEEESD

SEQ ID NO: 360510 - protein, 10 aa, Influenza virus
ERILEEESDE

SEQ ID NO: 360511 - protein, 10 aa, Influenza virus
RILEEESDEA

SEQ ID NO: 360512 - protein, 10 aa, Influenza virus
ILEEESDEAL

SEQ ID NO: 360513 - protein, 10 aa, Influenza virus
LEEESDEALK

SEQ ID NO: 360514 - protein, 10 aa, Influenza virus
EEESDEALKM

SEQ ID NO: 360515 - protein, 10 aa, Influenza virus
EESDEALKMT

SEQ ID NO: 360516 - protein, 10 aa, Influenza virus
ESDEALKMTI

SEQ ID NO: 360517 - protein, 10 aa, Influenza virus
SDEALKMTIA

SEQ ID NO: 360518 - protein, 10 aa, Influenza virus
DEALKMTIAS

SEQ ID NO: 360519 - protein, 10 aa, Influenza virus
EALKMTIASD

SEQ ID NO: 360520 - protein, 10 aa, Influenza virus
ALKMTIASDI

SEQ ID NO: 360521 - protein, 10 aa, Influenza virus
LKMTIASDIL

SEQ ID NO: 360522 - protein, 10 aa, Influenza virus
KMTIASDILT

SEQ ID NO: 360523 - protein, 10 aa, Influenza virus
MTIASDILTR

SEQ ID NO: 360524 - protein, 10 aa, Influenza virus
TIASDILTRM

SEQ ID NO: 360525 - protein, 10 aa, Influenza virus
IASDILKRMS

SEQ ID NO: 360526 - protein, 10 aa, Influenza virus
ASDILTRMSK

SEQ ID NO: 360527 - protein, 10 aa, Influenza virus
RPHPEDLNGM

SEQ ID NO: 360528 - protein, 10 aa, Influenza virus
TENSFEQITF

SEQ ID NO: 360529 - protein, 10 aa, Influenza virus
ENSFEQITFM

SEQ ID NO: 360530 - protein, 10 aa, Influenza virus
NSFEQITFMQ

SEQ ID NO: 360531 - protein, 10 aa, Influenza virus
SFEQITFMQA

SEQ ID NO: 360532 - protein, 10 aa, Influenza virus
FEQITFMQAL

SEQ ID NO: 360533 - protein, 10 aa, Influenza virus
EQITFMQALQ

SEQ ID NO: 360534 - protein, 10 aa, Influenza virus
QITFMQALQL

SEQ ID NO: 360535 - protein, 10 aa, Influenza virus
ITFMQALQLL

SEQ ID NO: 360536 - protein, 10 aa, Influenza virus
TFMQALQLLL

SEQ ID NO: 360537 - protein, 10 aa, Influenza virus
FMQALQLLLE

SEQ ID NO: 360538 - protein, 10 aa, Influenza virus
MQALQLLLEV

SEQ ID NO: 360539 - protein, 10 aa, Influenza virus
QALQLLLEVE

SEQ ID NO: 360540 - protein, 10 aa, Influenza virus
ALQLLLEVEQ

SEQ ID NO: 360541 - protein, 10 aa, Influenza virus
LQLLLEVEQE

SEQ ID NO: 360542 - protein, 10 aa, Influenza virus
EVEQEIRTFS

SEQ ID NO: 360543 - protein, 10 aa, Influenza virus
EIRTFSFQLI

SEQ ID NO: 360544 - protein, 10 aa, Influenza virus
IRTFSFQLIL

SEQ ID NO: 360545 - protein, 10 aa, Influenza virus
RTFSFQLINN

SEQ ID NO: 360546 - protein, 10 aa, Influenza virus
TFSFQLINNK

SEQ ID NO: 360547 - protein, 10 aa, Influenza virus
FSFQLINNKK

SEQ ID NO: 360548 - protein, 10 aa, Influenza virus
SFQLINNKKP

SEQ ID NO: 360549 - protein, 10 aa, Influenza virus
MEDFVRQCFN

SEQ ID NO: 360550 - protein, 10 aa, Influenza virus
DFVRQCFNPM

SEQ ID NO: 360551 - protein, 10 aa, Influenza virus
FVRQCFNPMI

SEQ ID NO: 360552 - protein, 10 aa, Influenza virus
VRQCFNPMIV

SEQ ID NO: 360553 - protein, 10 aa, Influenza virus
RQCFNPMIVE

SEQ ID NO: 360554 - protein, 10 aa, Influenza virus
QCFNPMIVEL

SEQ ID NO: 360555 - protein, 10 aa, Influenza virus
CFNPMIVELA

SEQ ID NO: 360556 - protein, 10 aa, Influenza virus
FNPMIVELAE

SEQ ID NO: 360557 - protein, 10 aa, Influenza virus
VELAEKAMKE

SEQ ID NO: 360558 - protein, 10 aa, Influenza virus
ELAEKAMKEY

SEQ ID NO: 360559 - protein, 10 aa, Influenza virus
LAEKAMKEYG

SEQ ID NO: 360560 - protein, 10 aa, Influenza virus
AEKAMKEYGE

SEQ ID NO: 360561 - protein, 10 aa, Influenza virus
ETNKFAAICT

SEQ ID NO: 360562 - protein, 10 aa, Influenza virus
TNKFAAICTH

SEQ ID NO: 360563 - protein, 10 aa, Influenza virus
NKFAAICTHL

SEQ ID NO: 360564 - protein, 10 aa, Influenza virus
KFAAICTHLE

SEQ ID NO: 360565 - protein, 10 aa, Influenza virus
AAICTHLEVC

SEQ ID NO: 360566 - protein, 10 aa, Influenza virus
AICTHLEVCF

SEQ ID NO: 360567 - protein, 10 aa, Influenza virus
ICTHLEVCFM

SEQ ID NO: 360568 - protein, 10 aa, Influenza virus
CTHLEVCFMY

SEQ ID NO: 360569 - protein, 10 aa, Influenza virus
THLEVCFMYS

SEQ ID NO: 360570 - protein, 10 aa, Influenza virus
HLEVCFMYSD

SEQ ID NO: 360571 - protein, 10 aa, Influenza virus
LEVCFMYSDF

SEQ ID NO: 360572 - protein, 10 aa, Influenza virus
EVCFMYSDFH

SEQ ID NO: 360573 - protein, 10 aa, Influenza virus
VCFMYSDFHF

SEQ ID NO: 360574 - protein, 10 aa, Influenza virus
CFMYSDFHFI

SEQ ID NO: 360575 - protein, 10 aa, Influenza virus
FMYSDFHFID

SEQ ID NO: 360576 - protein, 10 aa, Influenza virus
MYSDFHFIDE

SEQ ID NO: 360577 - protein, 10 aa, Influenza virus
YSDFHFIDER

SEQ ID NO: 360578 - protein, 10 aa, Influenza virus
DPNALLKHRF

SEQ ID NO: 360579 - protein, 10 aa, Influenza virus
PNALLKHRFE

SEQ ID NO: 360580 - protein, 10 aa, Influenza virus
NALLKHRFEI

SEQ ID NO: 360581 - protein, 10 aa, Influenza virus
ALLKHRFEII

SEQ ID NO: 360582 - protein, 10 aa, Influenza virus
LLKHRFEIIE

SEQ ID NO: 360583 - protein, 10 aa, Influenza virus
LKHRFEIIEG

SEQ ID NO: 360584 - protein, 10 aa, Influenza virus
KHRFEIIEGR

SEQ ID NO: 360585 - protein, 10 aa, Influenza virus
HRFEIIEGRD

SEQ ID NO: 360586 - protein, 10 aa, Influenza virus
RFEIIEGRDR

SEQ ID NO: 360587 - protein, 10 aa, Influenza virus
FEIIEGRDRT

SEQ ID NO: 360588 - protein, 10 aa, Influenza virus
KPKFLPDLYD

SEQ ID NO: 360589 - protein, 10 aa, Influenza virus
PKFLPDLYDY

SEQ ID NO: 360590 - protein, 10 aa, Influenza virus
KFLPDLYDYK

SEQ ID NO: 360591 - protein, 10 aa, Influenza virus
FLPDLYDYKE

SEQ ID NO: 360592 - protein, 10 aa, Influenza virus
LPDLYDYKEN

SEQ ID NO: 360593 - protein, 10 aa, Influenza virus
PDLYDYKENR

SEQ ID NO: 360594 - protein, 10 aa, Influenza virus
DLYDYKENRF

SEQ ID NO: 360595 - protein, 10 aa, Influenza virus
RFIEIGVTRR

SEQ ID NO: 360596 - protein, 10 aa, Influenza virus
FIEIGVTRRE

SEQ ID NO: 360597 - protein, 10 aa, Influenza virus
EIGVTRREVH

SEQ ID NO: 360598 - protein, 10 aa, Influenza virus
IGVTRREVHI

SEQ ID NO: 360599 - protein, 10 aa, Influenza virus
GVTRREVHIY

SEQ ID NO: 360600 - protein, 10 aa, Influenza virus
VTRREVHIYY

SEQ ID NO: 360601 - protein, 10 aa, Influenza virus
TRREVHIYYL

SEQ ID NO: 360602 - protein, 10 aa, Influenza virus
RREVHIYYLE

SEQ ID NO: 360603 - protein, 10 aa, Influenza virus
REVHIYYLEK

SEQ ID NO: 360604 - protein, 10 aa, Influenza virus
YYLEKANKIK

SEQ ID NO: 360605 - protein, 10 aa, Influenza virus
YLEKANKIKS

SEQ ID NO: 360606 - protein, 10 aa, Influenza virus
EKTHIHIFSF

SEQ ID NO: 360607 - protein, 10 aa, Influenza virus
THIHIFSFTG

SEQ ID NO: 360608 - protein, 10 aa, Influenza virus
HIHIFSFTGE

SEQ ID NO: 360609 - protein, 10 aa, Influenza virus
IHIFSFTGEE

SEQ ID NO: 360610 - protein, 10 aa, Influenza virus
HIFSFTGEEM

SEQ ID NO: 360611 - protein, 10 aa, Influenza virus
IFSFTGEEMA

SEQ ID NO: 360612 - protein, 10 aa, Influenza virus
FSFTGEEMAT

SEQ ID NO: 360613 - protein, 10 aa, Influenza virus
SFTGEEMATK

SEQ ID NO: 360614 - protein, 10 aa, Influenza virus
DYTLDEESRA

SEQ ID NO: 360615 - protein, 10 aa, Influenza virus
YTLDEESRAR

SEQ ID NO: 360616 - protein, 10 aa, Influenza virus
TLDEESRARI

SEQ ID NO: 360617 - protein, 10 aa, Influenza virus
LDEESRARIK

SEQ ID NO: 360618 - protein, 10 aa, Influenza virus
ASSKSRARIK

SEQ ID NO: 360619 - protein, 10 aa, Influenza virus
DEESRARIKT

SEQ ID NO: 360620 - protein, 10 aa, Influenza virus
EESRARIKTR

SEQ ID NO: 360621 - protein, 10 aa, Influenza virus
ESRARIKTRL

SEQ ID NO: 360622 - protein, 10 aa, Influenza virus
SRARIKTRLF

SEQ ID NO: 360623 - protein, 10 aa, Influenza virus
RARIKTRLFT

SEQ ID NO: 360624 - protein, 10 aa, Influenza virus
ARIKTRLFTI

SEQ ID NO: 360625 - protein, 10 aa, Influenza virus
RIKTRLFTIR

SEQ ID NO: 360626 - protein, 10 aa, Influenza virus
IKTRLFTIRQ

SEQ ID NO: 360627 - protein, 10 aa, Influenza virus
KTRLFTIRQE

SEQ ID NO: 360628 - protein, 10 aa, Influenza virus
TRLFTIRQEM

SEQ ID NO: 360629 - protein, 10 aa, Influenza virus
RLFTIRQEMA

SEQ ID NO: 360630 - protein, 10 aa, Influenza virus
LFTIRQEMAS

SEQ ID NO: 360631 - protein, 10 aa, Influenza virus
RGLWDSFRQS

SEQ ID NO: 360632 - protein, 10 aa, Influenza virus
GLWDSFRQSE

SEQ ID NO: 360633 - protein, 10 aa, Influenza virus
LWDSFRQSER

SEQ ID NO: 360634 - protein, 10 aa, Influenza virus
WDSFRQSERG

SEQ ID NO: 360635 - protein, 10 aa, Influenza virus
DSFRQSERGE

SEQ ID NO: 360636 - protein, 10 aa, Influenza virus
SFRQSERGEE

SEQ ID NO: 360637 - protein, 10 aa, Influenza virus
FRQSERGEET

SEQ ID NO: 360638 - protein, 10 aa, Influenza virus
RQSERGEETI

SEQ ID NO: 360639 - protein, 10 aa, Influenza virus
QSERGEETIE

SEQ ID NO: 360640 - protein, 10 aa, Influenza virus
SERGEETIEE

SEQ ID NO: 360641 - protein, 10 aa, Influenza virus
ERGEETIEER

SEQ ID NO: 360642 - protein, 10 aa, Influenza virus
RGEETIEERF

SEQ ID NO: 360643 - protein, 10 aa, Influenza virus
GEETIEERFE

SEQ ID NO: 360644 - protein, 10 aa, Influenza virus
EETIEERFEI

SEQ ID NO: 360645 - protein, 10 aa, Influenza virus
RSIEEKFEIT

SEQ ID NO: 360646 - protein, 10 aa, Influenza virus
LADQSLPPNF

SEQ ID NO: 360647 - protein, 10 aa, Influenza virus
ADQSLPPNFS

SEQ ID NO: 360648 - protein, 10 aa, Influenza virus
FRAYVDGFEP

SEQ ID NO: 360649 - protein, 10 aa, Influenza virus
RAYVDGFEPN

SEQ ID NO: 360650 - protein, 10 aa, Influenza virus
AYVDGFEPNG

SEQ ID NO: 360651 - protein, 10 aa, Influenza virus
YVDGFEPNGC

SEQ ID NO: 360652 - protein, 10 aa, Influenza virus
VDGFEPNGCI

SEQ ID NO: 360653 - protein, 10 aa, Influenza virus
DGFEPNGCIE

SEQ ID NO: 360654 - protein, 10 aa, Influenza virus
GFEPNGCIEG

SEQ ID NO: 360655 - protein, 10 aa, Influenza virus
FEPNGCIEGK

SEQ ID NO: 360656 - protein, 10 aa, Influenza virus
EPNGCIEGKL

SEQ ID NO: 360657 - protein, 10 aa, Influenza virus
PNGCIEGKLS

SEQ ID NO: 360658 - protein, 10 aa, Influenza virus
NGCIEGKLSQ

SEQ ID NO: 360659 - protein, 10 aa, Influenza virus
GCIEGKLSQM

SEQ ID NO: 360660 - protein, 10 aa, Influenza virus
CIEGKLSQMS

SEQ ID NO: 360661 - protein, 10 aa, Influenza virus
IEGKLSQMSK

SEQ ID NO: 360662 - protein, 10 aa, Influenza virus
CSQRSKFLLM

SEQ ID NO: 360663 - protein, 10 aa, Influenza virus
SQRSKFLLMD

SEQ ID NO: 360664 - protein, 10 aa, Influenza virus
QRSKFLLMDA

SEQ ID NO: 360665 - protein, 10 aa, Influenza virus
RSKFLLMDAL

SEQ ID NO: 360666 - protein, 10 aa, Influenza virus
SKFLLMDALK

SEQ ID NO: 360667 - protein, 10 aa, Influenza virus
KFLLMDALKL

SEQ ID NO: 360668 - protein, 10 aa, Influenza virus
FLLMDALKLS

SEQ ID NO: 360669 - protein, 10 aa, Influenza virus
LLMDALKLSI

SEQ ID NO: 360670 - protein, 10 aa, Influenza virus
LMDALKLSIE

SEQ ID NO: 360671 - protein, 10 aa, Influenza virus
MDALKLSIED

SEQ ID NO: 360672 - protein, 10 aa, Influenza virus
DALKLSIEDP

SEQ ID NO: 360673 - protein, 10 aa, Influenza virus
LKLSIEDPSH

SEQ ID NO: 360674 - protein, 10 aa, Influenza virus
KLSIEDPSHE

SEQ ID NO: 360675 - protein, 10 aa, Influenza virus
LSIEDPSHEG

SEQ ID NO: 360676 - protein, 10 aa, Influenza virus
KASKEPEVHE

SEQ ID NO: 360677 - protein, 10 aa, Influenza virus
ASKEPEVHEG

SEQ ID NO: 360678 - protein, 10 aa, Influenza virus
SIEDPSHEGE

SEQ ID NO: 360679 - protein, 10 aa, Influenza virus
IEDPSHEGEG

SEQ ID NO: 360680 - protein, 10 aa, Influenza virus
EDPSHEGEGI

SEQ ID NO: 360681 - protein, 10 aa, Influenza virus
DPSHEGEGIP

SEQ ID NO: 360682 - protein, 10 aa, Influenza virus
PSHEGEGIPL

SEQ ID NO: 360683 - protein, 10 aa, Influenza virus
SHEGEGIPLY

SEQ ID NO: 360684 - protein, 10 aa, Influenza virus
HEGEGIPLYD

SEQ ID NO: 360685 - protein, 10 aa, Influenza virus
EGEGIPLYDA

SEQ ID NO: 360686 - protein, 10 aa, Influenza virus
GEGIPLYDAI

SEQ ID NO: 360687 - protein, 10 aa, Influenza virus
EGIPLYDAIK

SEQ ID NO: 360688 - protein, 10 aa, Influenza virus
GIPLYDAIKC

SEQ ID NO: 360689 - protein, 10 aa, Influenza virus
LKDEEKIPKT

SEQ ID NO: 360690 - protein, 10 aa, Influenza virus
LKWALGENMA

SEQ ID NO: 360691 - protein, 10 aa, Influenza virus
KWALGENMAP

SEQ ID NO: 360692 - protein, 10 aa, Influenza virus
WALGENMAPE

SEQ ID NO: 360693 - protein, 10 aa, Influenza virus
ALGENMAPEK

SEQ ID NO: 360694 - protein, 10 aa, Influenza virus
LGENMAPEKV

SEQ ID NO: 360695 - protein, 10 aa, Influenza virus
GENMAPEKVD

SEQ ID NO: 360696 - protein, 10 aa, Influenza virus
ENMAPEKVDF

SEQ ID NO: 360697 - protein, 10 aa, Influenza virus
WIQSEFNKAC

SEQ ID NO: 360698 - protein, 10 aa, Influenza virus
IQSEFNKACE

SEQ ID NO: 360699 - protein, 10 aa, Influenza virus
QNEFNKACEL

SEQ ID NO: 360700 - protein, 10 aa, Influenza virus
NEFNKACELT

SEQ ID NO: 360701 - protein, 10 aa, Influenza virus
EFNKACELTD

SEQ ID NO: 360702 - protein, 10 aa, Influenza virus
FNKACELTDS

SEQ ID NO: 360703 - protein, 10 aa, Influenza virus
NKACELTDSS

SEQ ID NO: 360704 - protein, 10 aa, Influenza virus
KACELTDSSW

SEQ ID NO: 360705 - protein, 10 aa, Influenza virus
KTAYELTDSS

SEQ ID NO: 360706 - protein, 10 aa, Influenza virus
TAYELTDSSW

SEQ ID NO: 360707 - protein, 10 aa, Influenza virus
WIELDEIGED

SEQ ID NO: 360708 - protein, 10 aa, Influenza virus
ELDEIGEDVA

SEQ ID NO: 360709 - protein, 10 aa, Influenza virus
LDEIGEDVAP

SEQ ID NO: 360710 - protein, 10 aa, Influenza virus
DEIGEDVAPI

SEQ ID NO: 360711 - protein, 10 aa, Influenza virus
EIGEDVAPIE

SEQ ID NO: 360712 - protein, 10 aa, Influenza virus
IGEDVAPIEH

SEQ ID NO: 360713 - protein, 10 aa, Influenza virus
APIEHIASMR

SEQ ID NO: 360714 - protein, 10 aa, Influenza virus
PIEHIASMRR

SEQ ID NO: 360715 - protein, 10 aa, Influenza virus
IASMRRNYFT

SEQ ID NO: 360716 - protein, 10 aa, Influenza virus
RRNYFTAEVS

SEQ ID NO: 360717 - protein, 10 aa, Influenza virus
YFTAEVSHCR

SEQ ID NO: 360718 - protein, 10 aa, Influenza virus
FTAEVSHCRA

SEQ ID NO: 360719 - protein, 10 aa, Influenza virus
TAEVSHCRAT

SEQ ID NO: 360720 - protein, 10 aa, Influenza virus
AEVSHCRATE

SEQ ID NO: 360721 - protein, 10 aa, Influenza virus
EVSHCRATEY

SEQ ID NO: 360722 - protein, 10 aa, Influenza virus
VSHCRATEYI

SEQ ID NO: 360723 - protein, 10 aa, Influenza virus
ISKSRATEYI

SEQ ID NO: 360724 - protein, 10 aa, Influenza virus
SHCRATEYIM

SEQ ID NO: 360725 - protein, 10 aa, Influenza virus
HCRATEYIMK

SEQ ID NO: 360726 - protein, 10 aa, Influenza virus
CRATEYIMKG

SEQ ID NO: 360727 - protein, 10 aa, Influenza virus
RATEYIMKGV

SEQ ID NO: 360728 - protein, 10 aa, Influenza virus
ATEYIMKGVY

SEQ ID NO: 360729 - protein, 10 aa, Influenza virus
MKGVYINTAL

SEQ ID NO: 360730 - protein, 10 aa, Influenza virus
KGVYINTALL

SEQ ID NO: 360731 - protein, 10 aa, Influenza virus
GVYINTALLN

SEQ ID NO: 360732 - protein, 10 aa, Influenza virus
VYINTALLNA

SEQ ID NO: 360733 - protein, 10 aa, Influenza virus
YINTALLNAS

SEQ ID NO: 360734 - protein, 10 aa, Influenza virus
INTALLNASC

SEQ ID NO: 360735 - protein, 10 aa, Influenza virus
NTALLNASCA

SEQ ID NO: 360736 - protein, 10 aa, Influenza virus
TALLNASCAA

SEQ ID NO: 360737 - protein, 10 aa, Influenza virus
ALLNASCAAM

SEQ ID NO: 360738 - protein, 10 aa, Influenza virus
LLNASCAAMD

SEQ ID NO: 360739 - protein, 10 aa, Influenza virus
LNASCAAMDD

SEQ ID NO: 360740 - protein, 10 aa, Influenza virus
NASCAAMDDF

SEQ ID NO: 360741 - protein, 10 aa, Influenza virus
ASCAAMDDFQ

SEQ ID NO: 360742 - protein, 10 aa, Influenza virus
SCAAMDDFQL

SEQ ID NO: 360743 - protein, 10 aa, Influenza virus
CAAMDDFQLI

SEQ ID NO: 360744 - protein, 10 aa, Influenza virus
AAMDDFQLIP

SEQ ID NO: 360745 - protein, 10 aa, Influenza virus
AMDDFQLIPM

SEQ ID NO: 360746 - protein, 10 aa, Influenza virus
MDDFQLIPMI

SEQ ID NO: 360747 - protein, 10 aa, Influenza virus
DDFQLIPMIS

SEQ ID NO: 360748 - protein, 10 aa, Influenza virus
DFQLIPMISK

SEQ ID NO: 360749 - protein, 10 aa, Influenza virus
FQLIPMISKC

SEQ ID NO: 360750 - protein, 10 aa, Influenza virus
QLIPMISKCR

SEQ ID NO: 360751 - protein, 10 aa, Influenza virus
LIPMISKCRT

SEQ ID NO: 360752 - protein, 10 aa, Influenza virus
IPMISKCRTK

SEQ ID NO: 360753 - protein, 10 aa, Influenza virus
PMISKCRTKE

SEQ ID NO: 360754 - protein, 10 aa, Influenza virus
MISKCRTKEG

SEQ ID NO: 360755 - protein, 10 aa, Influenza virus
ISKCRTKEGR

SEQ ID NO: 360756 - protein, 10 aa, Influenza virus
SKCRTKEGRR

SEQ ID NO: 360757 - protein, 10 aa, Influenza virus
KCRTKEGRRK

SEQ ID NO: 360758 - protein, 10 aa, Influenza virus
CRTKEGRRKT

SEQ ID NO: 360759 - protein, 10 aa, Influenza virus
RTKEGRRKTN

SEQ ID NO: 360760 - protein, 10 aa, Influenza virus
TKEGRRKTNL

SEQ ID NO: 360761 - protein, 10 aa, Influenza virus
KEGRRKTNLY

SEQ ID NO: 360762 - protein, 10 aa, Influenza virus
EGRRKTNLYG

SEQ ID NO: 360763 - protein, 10 aa, Influenza virus
GRRKTNLYGF

SEQ ID NO: 360764 - protein, 10 aa, Influenza virus
RRKTNLYGFI

SEQ ID NO: 360765 - protein, 10 aa, Influenza virus
RKTNLYGFII

SEQ ID NO: 360766 - protein, 10 aa, Influenza virus
KTNLYGFIIK

SEQ ID NO: 360767 - protein, 10 aa, Influenza virus
TNLYGFIIKG

SEQ ID NO: 360768 - protein, 10 aa, Influenza virus
NLYGFIIKGR

SEQ ID NO: 360769 - protein, 10 aa, Influenza virus
LYGFIIKGRS

SEQ ID NO: 360770 - protein, 10 aa, Influenza virus
YGFIIKGRSH

SEQ ID NO: 360771 - protein, 10 aa, Influenza virus
GFIIKGRSHL

SEQ ID NO: 360772 - protein, 10 aa, Influenza virus
FIIKGRSHLR

SEQ ID NO: 360773 - protein, 10 aa, Influenza virus
IIKGRSHLRN

SEQ ID NO: 360774 - protein, 10 aa, Influenza virus
IKGRSHLRND

SEQ ID NO: 360775 - protein, 10 aa, Influenza virus
KGRSHLRNDT

SEQ ID NO: 360776 - protein, 10 aa, Influenza virus
GRSHLRNDTD

SEQ ID NO: 360777 - protein, 10 aa, Influenza virus
RSHLRNDTDV

SEQ ID NO: 360778 - protein, 10 aa, Influenza virus
SHLRNDTDVV

SEQ ID NO: 360779 - protein, 10 aa, Influenza virus
HLRNDTDVVN

SEQ ID NO: 360780 - protein, 10 aa, Influenza virus
LRNDTDVVNF

SEQ ID NO: 360781 - protein, 10 aa, Influenza virus
RNDTDVVNFV

SEQ ID NO: 360782 - protein, 10 aa, Influenza virus
NDTDVVNFVS

SEQ ID NO: 360783 - protein, 10 aa, Influenza virus
DTDVVNFVSM

SEQ ID NO: 360784 - protein, 10 aa, Influenza virus
TDVVNFVSME

SEQ ID NO: 360785 - protein, 10 aa, Influenza virus
DVVNFVSMEF

SEQ ID NO: 360786 - protein, 10 aa, Influenza virus
GSLNFVSMEF

SEQ ID NO: 360787 - protein, 10 aa, Influenza virus
VVNFVSMEFS

SEQ ID NO: 360788 - protein, 10 aa, Influenza virus
VNFVSMEFSL

SEQ ID NO: 360789 - protein, 10 aa, Influenza virus
NFVSMEFSLT

SEQ ID NO: 360790 - protein, 10 aa, Influenza virus
FVSMEFSLTD

SEQ ID NO: 360791 - protein, 10 aa, Influenza virus
VSMEFSLTDP

SEQ ID NO: 360792 - protein, 10 aa, Influenza virus
SMEFSLTDPR

SEQ ID NO: 360793 - protein, 10 aa, Influenza virus
MEFSLTDPRL

SEQ ID NO: 360794 - protein, 10 aa, Influenza virus
EFSLTDPRLE

SEQ ID NO: 360795 - protein, 10 aa, Influenza virus
PMFLYVRTNG

SEQ ID NO: 360796 - protein, 10 aa, Influenza virus
MFLYVRTNGT

SEQ ID NO: 360797 - protein, 10 aa, Influenza virus
FLYVRTNGTS

SEQ ID NO: 360798 - protein, 10 aa, Influenza virus
LYVRTNGTSK

SEQ ID NO: 360799 - protein, 10 aa, Influenza virus
YVRTNGTSKI

SEQ ID NO: 360800 - protein, 10 aa, Influenza virus
VRTNGTSKIK

SEQ ID NO: 360801 - protein, 10 aa, Influenza virus
RTNGTSKIKM

SEQ ID NO: 360802 - protein, 10 aa, Influenza virus
TNGTSKIKMK

SEQ ID NO: 360803 - protein, 10 aa, Influenza virus
NGTSKIKMKW

SEQ ID NO: 360804 - protein, 10 aa, Influenza virus
GTSKIKMKWG

SEQ ID NO: 360805 - protein, 10 aa, Influenza virus
TSKIKMKWGM

SEQ ID NO: 360806 - protein, 10 aa, Influenza virus
SKIKMKWGME

SEQ ID NO: 360807 - protein, 10 aa, Influenza virus
KIKMKWGMEM

SEQ ID NO: 360808 - protein, 10 aa, Influenza virus
IKMKWGMEMR

SEQ ID NO: 360809 - protein, 10 aa, Influenza virus
KMKWGMEMRR

SEQ ID NO: 360810 - protein, 10 aa, Influenza virus
MKWGMEMRRC

SEQ ID NO: 360811 - protein, 10 aa, Influenza virus
KWGMEMRRCL

SEQ ID NO: 360812 - protein, 10 aa, Influenza virus
WGMEMRRCLL

SEQ ID NO: 360813 - protein, 10 aa, Influenza virus
GMEMRRCLLQ

SEQ ID NO: 360814 - protein, 10 aa, Influenza virus
MEMRRCLLQS

SEQ ID NO: 360815 - protein, 10 aa, Influenza virus
EMRRCLLQSL

SEQ ID NO: 360816 - protein, 10 aa, Influenza virus
MRRCLLQSLQ

SEQ ID NO: 360817 - protein, 10 aa, Influenza virus
RRCLLQSLQQ

SEQ ID NO: 360818 - protein, 10 aa, Influenza virus
RCLLQSLQQI

SEQ ID NO: 360819 - protein, 10 aa, Influenza virus
CLLQSLQQIE

SEQ ID NO: 360820 - protein, 10 aa, Influenza virus
LLQSLQQIES

SEQ ID NO: 360821 - protein, 10 aa, Influenza virus
LQSLQQIESM

SEQ ID NO: 360822 - protein, 10 aa, Influenza virus
QSLQQIESMI

SEQ ID NO: 360823 - protein, 10 aa, Influenza virus
SLQQIESMIE

SEQ ID NO: 360824 - protein, 10 aa, Influenza virus
LQQIESMIEA

SEQ ID NO: 360825 - protein, 10 aa, Influenza virus
QQIESMIEAE

SEQ ID NO: 360826 - protein, 10 aa, Influenza virus
QIESMIEAES

SEQ ID NO: 360827 - protein, 10 aa, Influenza virus
IESMIEAESS

SEQ ID NO: 360828 - protein, 10 aa, Influenza virus
ESMIEAESSV

SEQ ID NO: 360829 - protein, 10 aa, Influenza virus
SMIEAESSVK

SEQ ID NO: 360830 - protein, 10 aa, Influenza virus
MIEAESSVKE

SEQ ID NO: 360831 - protein, 10 aa, Influenza virus
IEAESSVKEK

SEQ ID NO: 360832 - protein, 10 aa, Influenza virus
EAESSVKEKD

SEQ ID NO: 360833 - protein, 10 aa, Influenza virus
AESSVKEKDM

SEQ ID NO: 360834 - protein, 10 aa, Influenza virus
ESSVKEKDMT

SEQ ID NO: 360835 - protein, 10 aa, Influenza virus
SSVKEKDMTK

SEQ ID NO: 360836 - protein, 10 aa, Influenza virus
KEKDMTKEFF

SEQ ID NO: 360837 - protein, 10 aa, Influenza virus
EKDMTKEFFE

SEQ ID NO: 360838 - protein, 10 aa, Influenza virus
VEEGSIGKVC

SEQ ID NO: 360839 - protein, 10 aa, Influenza virus
EEGSIGKVCR

SEQ ID NO: 360840 - protein, 10 aa, Influenza virus
EGSIGKVCRT

SEQ ID NO: 360841 - protein, 10 aa, Influenza virus
GSIGKVCRTL

SEQ ID NO: 360842 - protein, 10 aa, Influenza virus
SIGKVCRTLL

SEQ ID NO: 360843 - protein, 10 aa, Influenza virus
IGKVCRTLLA

SEQ ID NO: 360844 - protein, 10 aa, Influenza virus
GKVCRTLLAK

SEQ ID NO: 360845 - protein, 10 aa, Influenza virus
KVCRTLLAKS

SEQ ID NO: 360846 - protein, 10 aa, Influenza virus
VCRTLLAKSV

SEQ ID NO: 360847 - protein, 10 aa, Influenza virus
CRTLLAKSVF

SEQ ID NO: 360848 - protein, 10 aa, Influenza virus
RTLLAKSVFN

SEQ ID NO: 360849 - protein, 10 aa, Influenza virus
TLLAKSVFNS

SEQ ID NO: 360850 - protein, 10 aa, Influenza virus
LLAKSVFNSL

SEQ ID NO: 360851 - protein, 10 aa, Influenza virus
LAKSVFNSLY

SEQ ID NO: 360852 - protein, 10 aa, Influenza virus
AKSVFNSLYA

SEQ ID NO: 360853 - protein, 10 aa, Influenza virus
KSVFNSLYAS

SEQ ID NO: 360854 - protein, 10 aa, Influenza virus
SVFNSLYASP

SEQ ID NO: 360855 - protein, 10 aa, Influenza virus
FNSLYASPQL

SEQ ID NO: 360856 - protein, 10 aa, Influenza virus
NSLYASPQLE

SEQ ID NO: 360857 - protein, 10 aa, Influenza virus
SLYASPQLEG

SEQ ID NO: 360858 - protein, 10 aa, Influenza virus
LYASPQLEGF

SEQ ID NO: 360859 - protein, 10 aa, Influenza virus
YASPQLEGFS

SEQ ID NO: 360860 - protein, 10 aa, Influenza virus
ASPQLEGFSA

SEQ ID NO: 360861 - protein, 10 aa, Influenza virus
SPQLEGFSAE

SEQ ID NO: 360862 - protein, 10 aa, Influenza virus
PQLEGFSAES

SEQ ID NO: 360863 - protein, 10 aa, Influenza virus
QLEGFSAESR

SEQ ID NO: 360864 - protein, 10 aa, Influenza virus
LEGFSAESRK

SEQ ID NO: 360865 - protein, 10 aa, Influenza virus
EGFSAESRKL

SEQ ID NO: 360866 - protein, 10 aa, Influenza virus
GFSAESRKLL

SEQ ID NO: 360867 - protein, 10 aa, Influenza virus
FSAESRKLLL

SEQ ID NO: 360868 - protein, 10 aa, Influenza virus
SAESRKLLLI

SEQ ID NO: 360869 - protein, 10 aa, Influenza virus
AESRKLLLIV

SEQ ID NO: 360870 - protein, 10 aa, Influenza virus
ESRKLLLIVQ

SEQ ID NO: 360871 - protein, 10 aa, Influenza virus
SRKLLLIVQA

SEQ ID NO: 360872 - protein, 10 aa, Influenza virus
QALRDNLEPG

SEQ ID NO: 360873 - protein, 10 aa, Influenza virus
ALRDNLEPGT

SEQ ID NO: 360874 - protein, 10 aa, Influenza virus
LRDNLEPGTF

SEQ ID NO: 360875 - protein, 10 aa, Influenza virus
RDNLEPGTFD

SEQ ID NO: 360876 - protein, 10 aa, Influenza virus
DNLEPGTFDL

SEQ ID NO: 360877 - protein, 10 aa, Influenza virus
LEPGTFDLGG

SEQ ID NO: 360878 - protein, 10 aa, Influenza virus
EPGTFDLGGL

SEQ ID NO: 360879 - protein, 10 aa, Influenza virus
PGTFDLGGLY

SEQ ID NO: 360880 - protein, 10 aa, Influenza virus
GLYEAIEECL

SEQ ID NO: 360881 - protein, 10 aa, Influenza virus
LYEAIEECLI

SEQ ID NO: 360882 - protein, 10 aa, Influenza virus
YEAIEECLIN

SEQ ID NO: 360883 - protein, 10 aa, Influenza virus
EAIEECLIND

SEQ ID NO: 360884 - protein, 10 aa, Influenza virus
AIEECLINDP

SEQ ID NO: 360885 - protein, 10 aa, Influenza virus
IEECLINDPW

SEQ ID NO: 360886 - protein, 10 aa, Influenza virus
EECLINDPWV

SEQ ID NO: 360887 - protein, 10 aa, Influenza virus
ECLINDPWVL

SEQ ID NO: 360888 - protein, 10 aa, Influenza virus
CLINDPWVLL

SEQ ID NO: 360889 - protein, 10 aa, Influenza virus
LINDPWVLLN

SEQ ID NO: 360890 - protein, 10 aa, Influenza virus
INDPWVLLNA

SEQ ID NO: 360891 - protein, 10 aa, Influenza virus
NDPWVLLNAS

SEQ ID NO: 360892 - protein, 10 aa, Influenza virus
DPWVLLNASW

SEQ ID NO: 360893 - protein, 10 aa, Influenza virus
PWVLLNASWF

SEQ ID NO: 360894 - protein, 10 aa, Influenza virus
WVLLNASWFN

SEQ ID NO: 360895 - protein, 10 aa, Influenza virus
VLLNASWFNS

SEQ ID NO: 360896 - protein, 10 aa, Influenza virus
LLNASWFNSF

SEQ ID NO: 360897 - protein, 10 aa, Influenza virus
LNASWFNSFL

SEQ ID NO: 360898 - protein, 10 aa, Influenza virus
NASWFNSFLT

SEQ ID NO: 360899 - protein, 10 aa, Influenza virus
ASWFNSFLTH

SEQ ID NO: 360900 - protein, 10 aa, Influenza virus
NSSLTHALRE

SEQ ID NO: 360901 - protein, 10 aa, Influenza virus
SSLTHALREL

SEQ ID NO: 360902 - protein, 10 aa, Influenza virus
SLTHALRELW

SEQ ID NO: 360903 - protein, 10 aa, Influenza virus
LTHALRELWQ

SEQ ID NO: 360904 - protein, 10 aa, Influenza virus
THALRELWQC

SEQ ID NO: 360905 - protein, 10 aa, Influenza virus
HALRELWQCY

SEQ ID NO: 360906 - protein, 10 aa, Influenza virus
ALRELWQCYY

SEQ ID NO: 360907 - protein, 10 aa, Influenza virus
LRELWQCYYL

SEQ ID NO: 360908 - protein, 10 aa, Influenza virus
RELWQCYYLL

SEQ ID NO: 360909 - protein, 10 aa, Influenza virus
MDVNPTLLFL

SEQ ID NO: 360910 - protein, 10 aa, Influenza virus
DVNPTLLFLK

SEQ ID NO: 360911 - protein, 10 aa, Influenza virus
VNPTLLFLKV

SEQ ID NO: 360912 - protein, 10 aa, Influenza virus
INPTLLFLKV

SEQ ID NO: 360913 - protein, 10 aa, Influenza virus
NPTLLFLKVP

SEQ ID NO: 360914 - protein, 10 aa, Influenza virus
YFFLKVPVQN

SEQ ID NO: 360915 - protein, 10 aa, Influenza virus
PAQNAISTTF

SEQ ID NO: 360916 - protein, 10 aa, Influenza virus
AQNAISTTFP

SEQ ID NO: 360917 - protein, 10 aa, Influenza virus
QNAISTTFPY

SEQ ID NO: 360918 - protein, 10 aa, Influenza virus
NAISTTFPYT

SEQ ID NO: 360919 - protein, 10 aa, Influenza virus
AISTTFPYTG

SEQ ID NO: 360920 - protein, 10 aa, Influenza virus
ISTTFPYTGD

SEQ ID NO: 360921 - protein, 10 aa, Influenza virus
STTFPYTGDP

SEQ ID NO: 360922 - protein, 10 aa, Influenza virus
TTFPYTGDPP

SEQ ID NO: 360923 - protein, 10 aa, Influenza virus
TFPYTGDPPY

SEQ ID NO: 360924 - protein, 10 aa, Influenza virus
FPYTGDPPYS

SEQ ID NO: 360925 - protein, 10 aa, Influenza virus
PYTGDPPYSH

SEQ ID NO: 360926 - protein, 10 aa, Influenza virus
YTGDPPYSHG

SEQ ID NO: 360927 - protein, 10 aa, Influenza virus
TGDPPYSHGT

SEQ ID NO: 360928 - protein, 10 aa, Influenza virus
GDPPYSHGTG

SEQ ID NO: 360929 - protein, 10 aa, Influenza virus
DPPYSHGTGT

SEQ ID NO: 360930 - protein, 10 aa, Influenza virus
PPYSHGTGTG

SEQ ID NO: 360931 - protein, 10 aa, Influenza virus
PYSHGTGTGY

SEQ ID NO: 360932 - protein, 10 aa, Influenza virus
YSHGTGTGYT

SEQ ID NO: 360933 - protein, 10 aa, Influenza virus
SHGTGTGYTM

SEQ ID NO: 360934 - protein, 10 aa, Influenza virus
HGTGTGYTMD

SEQ ID NO: 360935 - protein, 10 aa, Influenza virus
GTGTGYTMDT

SEQ ID NO: 360936 - protein, 10 aa, Influenza virus
TGTGYTMDTV

SEQ ID NO: 360937 - protein, 10 aa, Influenza virus
GTGYTMDTVN

SEQ ID NO: 360938 - protein, 10 aa, Influenza virus
TGYTMDTVNR

SEQ ID NO: 360939 - protein, 10 aa, Influenza virus
GYTMDTVNRT

SEQ ID NO: 360940 - protein, 10 aa, Influenza virus
YTMDTVNRTH

SEQ ID NO: 360941 - protein, 10 aa, Influenza virus
TMDTVNRTHQ

SEQ ID NO: 360942 - protein, 10 aa, Influenza virus
MDTVNRTHQY

SEQ ID NO: 360943 - protein, 10 aa, Influenza virus
DTVNRTHQYS

SEQ ID NO: 360944 - protein, 10 aa, Influenza virus
TVNRTHQYSE

SEQ ID NO: 360945 - protein, 10 aa, Influenza virus
VNRTHQYSEK

SEQ ID NO: 360946 - protein, 10 aa, Influenza virus
NRTHQYSEKG

SEQ ID NO: 360947 - protein, 10 aa, Influenza virus
RTHQYSEKGK

SEQ ID NO: 360948 - protein, 10 aa, Influenza virus
THQYSEKGKW

SEQ ID NO: 360949 - protein, 10 aa, Influenza virus
TETGAPQLNP

SEQ ID NO: 360950 - protein, 10 aa, Influenza virus
ETGAPQLNPI

SEQ ID NO: 360951 - protein, 10 aa, Influenza virus
TGAPQLNPID

SEQ ID NO: 360952 - protein, 10 aa, Influenza virus
GAPQLNPIDG

SEQ ID NO: 360953 - protein, 10 aa, Influenza virus
APQLNPIDGP

SEQ ID NO: 360954 - protein, 10 aa, Influenza virus
PQLNPIDGPL

SEQ ID NO: 360955 - protein, 10 aa, Influenza virus
QLNPIDGPLP

SEQ ID NO: 360956 - protein, 10 aa, Influenza virus
LNPIDGPLPE

SEQ ID NO: 360957 - protein, 10 aa, Influenza virus
DNEPSGYAQT

SEQ ID NO: 360958 - protein, 10 aa, Influenza virus
NEPSGYAQTD

SEQ ID NO: 360959 - protein, 10 aa, Influenza virus
EPSGYAQTDC

SEQ ID NO: 360960 - protein, 10 aa, Influenza virus
PSGYAQTDCV

SEQ ID NO: 360961 - protein, 10 aa, Influenza virus
SGYAQTDCVL

SEQ ID NO: 360962 - protein, 10 aa, Influenza virus
GYAQTDCVLE

SEQ ID NO: 360963 - protein, 10 aa, Influenza virus
YAQTDCVLEA

SEQ ID NO: 360964 - protein, 10 aa, Influenza virus
AQTDCVLEAM

SEQ ID NO: 360965 - protein, 10 aa, Influenza virus
QTDCVLEAMA

SEQ ID NO: 360966 - protein, 10 aa, Influenza virus
TDCVLEAMAF

SEQ ID NO: 360967 - protein, 10 aa, Influenza virus
DCVLEAMAFL

SEQ ID NO: 360968 - protein, 10 aa, Influenza virus
CVLEAMAFLE

SEQ ID NO: 360969 - protein, 10 aa, Influenza virus
VLEAMAFLEE

SEQ ID NO: 360970 - protein, 10 aa, Influenza virus
LEAMAFLEES

SEQ ID NO: 360971 - protein, 10 aa, Influenza virus
EAMAFLEESH

SEQ ID NO: 360972 - protein, 10 aa, Influenza virus
AMAFLEESHP

SEQ ID NO: 360973 - protein, 10 aa, Influenza virus
MAFLEESHPG

SEQ ID NO: 360974 - protein, 10 aa, Influenza virus
LEESHPGIFE

SEQ ID NO: 360975 - protein, 10 aa, Influenza virus
SHPGIFENSC

SEQ ID NO: 360976 - protein, 10 aa, Influenza virus
HPGIFENSCL

SEQ ID NO: 360977 - protein, 10 aa, Influenza virus
PGIFENSCLE

SEQ ID NO: 360978 - protein, 10 aa, Influenza virus
VQQTRVDKLT

SEQ ID NO: 360979 - protein, 10 aa, Influenza virus
QQTRVDKLTQ

SEQ ID NO: 360980 - protein, 10 aa, Influenza virus
QTRVDKLTQG

SEQ ID NO: 360981 - protein, 10 aa, Influenza virus
TRVDKLTQGR

SEQ ID NO: 360982 - protein, 10 aa, Influenza virus
RVDKLTQGRQ

SEQ ID NO: 360983 - protein, 10 aa, Influenza virus
VDKLTQGRQT

SEQ ID NO: 360984 - protein, 10 aa, Influenza virus
DKLTQGRQTY

SEQ ID NO: 360985 - protein, 10 aa, Influenza virus
KLTQGRQTYD

SEQ ID NO: 360986 - protein, 10 aa, Influenza virus
LTQGRQTYDW

SEQ ID NO: 360987 - protein, 10 aa, Influenza virus
TQGRQTYDWT

SEQ ID NO: 360988 - protein, 10 aa, Influenza virus
QGRQTYDWTL

SEQ ID NO: 360989 - protein, 10 aa, Influenza virus
GRQTYDWTLN

SEQ ID NO: 360990 - protein, 10 aa, Influenza virus
RQTYDWTLNR

SEQ ID NO: 360991 - protein, 10 aa, Influenza virus
QTYDWTLNRN

SEQ ID NO: 360992 - protein, 10 aa, Influenza virus
TYDWTLNRNQ

SEQ ID NO: 360993 - protein, 10 aa, Influenza virus
YDWTLNRNQP

SEQ ID NO: 360994 - protein, 10 aa, Influenza virus
DWTLNRNQPA

SEQ ID NO: 360995 - protein, 10 aa, Influenza virus
WTLNRNQPAA

SEQ ID NO: 360996 - protein, 10 aa, Influenza virus
TLNRNQPAAT

SEQ ID NO: 360997 - protein, 10 aa, Influenza virus
LNRNQPAATA

SEQ ID NO: 360998 - protein, 10 aa, Influenza virus
NRNQPAATAL

SEQ ID NO: 360999 - protein, 10 aa, Influenza virus
RNQPAATALA

SEQ ID NO: 361000 - protein, 10 aa, Influenza virus
NQPAATALAN

SEQ ID NO: 361001 - protein, 10 aa, Influenza virus
QPAATALANT

SEQ ID NO: 361002 - protein, 10 aa, Influenza virus
PAATALANTI

SEQ ID NO: 361003 - protein, 10 aa, Influenza virus
AATALANTIE

SEQ ID NO: 361004 - protein, 10 aa, Influenza virus
ATALANTIEV

SEQ ID NO: 361005 - protein, 10 aa, Influenza virus
TALANTIEVF

SEQ ID NO: 361006 - protein, 10 aa, Influenza virus
ALANTIEVFR

SEQ ID NO: 361007 - protein, 10 aa, Influenza virus
LANTIEVFRS

SEQ ID NO: 361008 - protein, 10 aa, Influenza virus
ANTIEVFRSN

SEQ ID NO: 361009 - protein, 10 aa, Influenza virus
NESGRLIDFL

SEQ ID NO: 361010 - protein, 10 aa, Influenza virus
ESGRLIDFLK

SEQ ID NO: 361011 - protein, 10 aa, Influenza virus
SGRLIDFLKD

SEQ ID NO: 361012 - protein, 10 aa, Influenza virus
GRLIDFLKDV

SEQ ID NO: 361013 - protein, 10 aa, Influenza virus
RLIDFLKDVM

SEQ ID NO: 361014 - protein, 10 aa, Influenza virus
ITTHFQRKRR

SEQ ID NO: 361015 - protein, 10 aa, Influenza virus
TTHFQRKRRV

SEQ ID NO: 361016 - protein, 10 aa, Influenza virus
THFQRKRRVR

SEQ ID NO: 361017 - protein, 10 aa, Influenza virus
HFQRKRRVRD

SEQ ID NO: 361018 - protein, 10 aa, Influenza virus
FQRKRRVRDN

SEQ ID NO: 361019 - protein, 10 aa, Influenza virus
MVTQRTIGKK

SEQ ID NO: 361020 - protein, 10 aa, Influenza virus
TQRTIGKKKQ

SEQ ID NO: 361021 - protein, 10 aa, Influenza virus
SYLIRALTLN

SEQ ID NO: 361022 - protein, 10 aa, Influenza virus
YLIRALTLNT

SEQ ID NO: 361023 - protein, 10 aa, Influenza virus
LIRALTLNTM

SEQ ID NO: 361024 - protein, 10 aa, Influenza virus
IRALTLNTMT

SEQ ID NO: 361025 - protein, 10 aa, Influenza virus
RALTLNTMTK

SEQ ID NO: 361026 - protein, 10 aa, Influenza virus
ALTLNTMTKD

SEQ ID NO: 361027 - protein, 10 aa, Influenza virus
LTLNTMTKDA

SEQ ID NO: 361028 - protein, 10 aa, Influenza virus
TLNTMTKDAE

SEQ ID NO: 361029 - protein, 10 aa, Influenza virus
LNTMTKDAER

SEQ ID NO: 361030 - protein, 10 aa, Influenza virus
NTMTKDAERG

SEQ ID NO: 361031 - protein, 10 aa, Influenza virus
TMTKDAERGK

SEQ ID NO: 361032 - protein, 10 aa, Influenza virus
MTKDAERGKL

SEQ ID NO: 361033 - protein, 10 aa, Influenza virus
TKDAERGKLK

SEQ ID NO: 361034 - protein, 10 aa, Influenza virus
KDAERGKLKR

SEQ ID NO: 361035 - protein, 10 aa, Influenza virus
DAERGKLKRR

SEQ ID NO: 361036 - protein, 10 aa, Influenza virus
AERGKLKRRA

SEQ ID NO: 361037 - protein, 10 aa, Influenza virus
ERGKLKRRAI

SEQ ID NO: 361038 - protein, 10 aa, Influenza virus
RGKLKRRAIA

SEQ ID NO: 361039 - protein, 10 aa, Influenza virus
GKLKRRAIAT

SEQ ID NO: 361040 - protein, 10 aa, Influenza virus
KLKRRAIATP

SEQ ID NO: 361041 - protein, 10 aa, Influenza virus
LKRRAIATPG

SEQ ID NO: 361042 - protein, 10 aa, Influenza virus
KRRAIATPGM

SEQ ID NO: 361043 - protein, 10 aa, Influenza virus
RRAIATPGMQ

SEQ ID NO: 361044 - protein, 10 aa, Influenza virus
RAIATPGMQI

SEQ ID NO: 361045 - protein, 10 aa, Influenza virus
AIATPGMQIR

SEQ ID NO: 361046 - protein, 10 aa, Influenza virus
IATPGMQIRG

SEQ ID NO: 361047 - protein, 10 aa, Influenza virus
ATPGMQIRGF

SEQ ID NO: 361048 - protein, 10 aa, Influenza virus
TPGMQIRGFV

SEQ ID NO: 361049 - protein, 10 aa, Influenza virus
PGMQIRGFVY

SEQ ID NO: 361050 - protein, 10 aa, Influenza virus
GMQIRGFVYF

SEQ ID NO: 361051 - protein, 10 aa, Influenza virus
MQIRGFVYFV

SEQ ID NO: 361052 - protein, 10 aa, Influenza virus
QIRGFVYFVE

SEQ ID NO: 361053 - protein, 10 aa, Influenza virus
IRGFVYFVET

SEQ ID NO: 361054 - protein, 10 aa, Influenza virus
RGFVYFVETL

SEQ ID NO: 361055 - protein, 10 aa, Influenza virus
GFVYFVETLA

SEQ ID NO: 361056 - protein, 10 aa, Influenza virus
LARSICEKLE

SEQ ID NO: 361057 - protein, 10 aa, Influenza virus
ARSICEKLEQ

SEQ ID NO: 361058 - protein, 10 aa, Influenza virus
RSICEKLEQS

SEQ ID NO: 361059 - protein, 10 aa, Influenza virus
SICEKLEQSG

SEQ ID NO: 361060 - protein, 10 aa, Influenza virus
ICEKLEQSGL

SEQ ID NO: 361061 - protein, 10 aa, Influenza virus
CEKLEQSGLP

SEQ ID NO: 361062 - protein, 10 aa, Influenza virus
EKLEQSGLPV

SEQ ID NO: 361063 - protein, 10 aa, Influenza virus
KLEQSGLPVG

SEQ ID NO: 361064 - protein, 10 aa, Influenza virus
LEQSGLPVGG

SEQ ID NO: 361065 - protein, 10 aa, Influenza virus
EQSGLPVGGN

SEQ ID NO: 361066 - protein, 10 aa, Influenza virus
QSGLPVGGNE

SEQ ID NO: 361067 - protein, 10 aa, Influenza virus
SGLPVGGNEK

SEQ ID NO: 361068 - protein, 10 aa, Influenza virus
GLPVGGNEKK

SEQ ID NO: 361069 - protein, 10 aa, Influenza virus
LPVGGNEKKA

SEQ ID NO: 361070 - protein, 10 aa, Influenza virus
PVGGNEKKAK

SEQ ID NO: 361071 - protein, 10 aa, Influenza virus
VGGNEKKAKL

SEQ ID NO: 361072 - protein, 10 aa, Influenza virus
GGNEKKAKLA

SEQ ID NO: 361073 - protein, 10 aa, Influenza virus
GNEKKAKLAN

SEQ ID NO: 361074 - protein, 10 aa, Influenza virus
NEKKAKLANV

SEQ ID NO: 361075 - protein, 10 aa, Influenza virus
EKKAKLANVV

SEQ ID NO: 361076 - protein, 10 aa, Influenza virus
KKAKLANVVR

SEQ ID NO: 361077 - protein, 10 aa, Influenza virus
KAKLANVVRK

SEQ ID NO: 361078 - protein, 10 aa, Influenza virus
AKLANVVRKM

SEQ ID NO: 361079 - protein, 10 aa, Influenza virus
KLANVVRKMM

SEQ ID NO: 361080 - protein, 10 aa, Influenza virus
LANVVRKMMT

SEQ ID NO: 361081 - protein, 10 aa, Influenza virus
ANVVRKMMTN

SEQ ID NO: 361082 - protein, 10 aa, Influenza virus
NVVRKMMTNS

SEQ ID NO: 361083 - protein, 10 aa, Influenza virus
VVRKMMTNSQ

SEQ ID NO: 361084 - protein, 10 aa, Influenza virus
VRKMMTNSQD

SEQ ID NO: 361085 - protein, 10 aa, Influenza virus
RKMMTNSQDT

SEQ ID NO: 361086 - protein, 10 aa, Influenza virus
KMMTNSQDTE

SEQ ID NO: 361087 - protein, 10 aa, Influenza virus
NSQDTELSFT

SEQ ID NO: 361088 - protein, 10 aa, Influenza virus
SQDTELSFTI

SEQ ID NO: 361089 - protein, 10 aa, Influenza virus
QDTELSFTIT

SEQ ID NO: 361090 - protein, 10 aa, Influenza virus
DTELSFTITG

SEQ ID NO: 361091 - protein, 10 aa, Influenza virus
TELSFTITGD

SEQ ID NO: 361092 - protein, 10 aa, Influenza virus
ELSFTITGDN

SEQ ID NO: 361093 - protein, 10 aa, Influenza virus
LSFTITGDNT

SEQ ID NO: 361094 - protein, 10 aa, Influenza virus
SFTITGDNTK

SEQ ID NO: 361095 - protein, 10 aa, Influenza virus
FTITGDNTKW

SEQ ID NO: 361096 - protein, 10 aa, Influenza virus
TITGDNTKWN

SEQ ID NO: 361097 - protein, 10 aa, Influenza virus
ITGDNTKWNE

SEQ ID NO: 361098 - protein, 10 aa, Influenza virus
TGDNTKWNEN

SEQ ID NO: 361099 - protein, 10 aa, Influenza virus
GDNTKWNENQ

SEQ ID NO: 361100 - protein, 10 aa, Influenza virus
DNTKWNENQN

SEQ ID NO: 361101 - protein, 10 aa, Influenza virus
NTKWNENQNP

SEQ ID NO: 361102 - protein, 10 aa, Influenza virus
TKWNENQNPR

SEQ ID NO: 361103 - protein, 10 aa, Influenza virus
KWNENQNPRM

SEQ ID NO: 361104 - protein, 10 aa, Influenza virus
WNENQNPRMF

SEQ ID NO: 361105 - protein, 10 aa, Influenza virus
NENQNPRMFL

SEQ ID NO: 361106 - protein, 10 aa, Influenza virus
ENQNPRMFLA

SEQ ID NO: 361107 - protein, 10 aa, Influenza virus
NQNQNPRMFL

SEQ ID NO: 361108 - protein, 10 aa, Influenza virus
QNQNPRMFLA

SEQ ID NO: 361109 - protein, 10 aa, Influenza virus
NQNPRMFLAM

SEQ ID NO: 361110 - protein, 10 aa, Influenza virus
QNPRMFLAMI

SEQ ID NO: 361111 - protein, 10 aa, Influenza virus
NPRMFLAMIT

SEQ ID NO: 361112 - protein, 10 aa, Influenza virus
PRMFLAMITY

SEQ ID NO: 361113 - protein, 10 aa, Influenza virus
RMFLAMITYI

SEQ ID NO: 361114 - protein, 10 aa, Influenza virus
MFLAMITYIT

SEQ ID NO: 361115 - protein, 10 aa, Influenza virus
FLAMITYITR

SEQ ID NO: 361116 - protein, 10 aa, Influenza virus
QPEWFRNILS

SEQ ID NO: 361117 - protein, 10 aa, Influenza virus
WFRNVLSIAP

SEQ ID NO: 361118 - protein, 10 aa, Influenza virus
FRNVLSIAPI

SEQ ID NO: 361119 - protein, 10 aa, Influenza virus
RNVLSIAPIM

SEQ ID NO: 361120 - protein, 10 aa, Influenza virus
NVLSIAPIMF

SEQ ID NO: 361121 - protein, 10 aa, Influenza virus
VLSIAPIMFS

SEQ ID NO: 361122 - protein, 10 aa, Influenza virus
LSIAPIMFSN

SEQ ID NO: 361123 - protein, 10 aa, Influenza virus
SIAPIMFSNK

SEQ ID NO: 361124 - protein, 10 aa, Influenza virus
IAPIMFSNKM

SEQ ID NO: 361125 - protein, 10 aa, Influenza virus
APIMFSNKMA

SEQ ID NO: 361126 - protein, 10 aa, Influenza virus
PIMFSNKMAR

SEQ ID NO: 361127 - protein, 10 aa, Influenza virus
IMFSNKMARL

SEQ ID NO: 361128 - protein, 10 aa, Influenza virus
MFSNKMARLG

SEQ ID NO: 361129 - protein, 10 aa, Influenza virus
FSNKMARLGK

SEQ ID NO: 361130 - protein, 10 aa, Influenza virus
SNKMARLGKG

SEQ ID NO: 361131 - protein, 10 aa, Influenza virus
NKMARLGKGY

SEQ ID NO: 361132 - protein, 10 aa, Influenza virus
KMARLGKGYM

SEQ ID NO: 361133 - protein, 10 aa, Influenza virus
MARLGKGYMF

SEQ ID NO: 361134 - protein, 10 aa, Influenza virus
ARLGKGYMFE

SEQ ID NO: 361135 - protein, 10 aa, Influenza virus
RLGKGYMFES

SEQ ID NO: 361136 - protein, 10 aa, Influenza virus
LGKGYMFESK

SEQ ID NO: 361137 - protein, 10 aa, Influenza virus
KIEKIEKIRP

SEQ ID NO: 361138 - protein, 10 aa, Influenza virus
IEKIEKIRPL

SEQ ID NO: 361139 - protein, 10 aa, Influenza virus
EKIEKIRPLL

SEQ ID NO: 361140 - protein, 10 aa, Influenza virus
GTASLSPGMM

SEQ ID NO: 361141 - protein, 10 aa, Influenza virus
TASLSPGMMM

SEQ ID NO: 361142 - protein, 10 aa, Influenza virus
ASLSPGMMMG

SEQ ID NO: 361143 - protein, 10 aa, Influenza virus
SLSPGMMMGM

SEQ ID NO: 361144 - protein, 10 aa, Influenza virus
LSPGMMMGMF

SEQ ID NO: 361145 - protein, 10 aa, Influenza virus
SPGMMMGMFN

SEQ ID NO: 361146 - protein, 10 aa, Influenza virus
PGMMMGMFNM

SEQ ID NO: 361147 - protein, 10 aa, Influenza virus
GMMMGMFNML

SEQ ID NO: 361148 - protein, 10 aa, Influenza virus
MMMGMFNMLS

SEQ ID NO: 361149 - protein, 10 aa, Influenza virus
MMGMFNMLST

SEQ ID NO: 361150 - protein, 10 aa, Influenza virus
MGMFNMLSTV

SEQ ID NO: 361151 - protein, 10 aa, Influenza virus
GMFNMLSTVL

SEQ ID NO: 361152 - protein, 10 aa, Influenza virus
MFNMLSTVLG

SEQ ID NO: 361153 - protein, 10 aa, Influenza virus
FNMLSTVLGV

SEQ ID NO: 361154 - protein, 10 aa, Influenza virus
NMLSTVLGVS

SEQ ID NO: 361155 - protein, 10 aa, Influenza virus
MLSTVLGVSI

SEQ ID NO: 361156 - protein, 10 aa, Influenza virus
LSTVLGVSIL

SEQ ID NO: 361157 - protein, 10 aa, Influenza virus
STVLGVSILN

SEQ ID NO: 361158 - protein, 10 aa, Influenza virus
TVLGVSILNL

SEQ ID NO: 361159 - protein, 10 aa, Influenza virus
VLGVSILNLG

SEQ ID NO: 361160 - protein, 10 aa, Influenza virus
LGVSILNLGQ

SEQ ID NO: 361161 - protein, 10 aa, Influenza virus
GVSILNLGQK

SEQ ID NO: 361162 - protein, 10 aa, Influenza virus
TTYWWDGLQS

SEQ ID NO: 361163 - protein, 10 aa, Influenza virus
TYWWDGLQSS

SEQ ID NO: 361164 - protein, 10 aa, Influenza virus
YWWDGLQSSD

SEQ ID NO: 361165 - protein, 10 aa, Influenza virus
WWDGLQSSDD

SEQ ID NO: 361166 - protein, 10 aa, Influenza virus
WDGLQSSDDF

SEQ ID NO: 361167 - protein, 10 aa, Influenza virus
DGLQSSDDFA

SEQ ID NO: 361168 - protein, 10 aa, Influenza virus
GLQSSDDFAL

SEQ ID NO: 361169 - protein, 10 aa, Influenza virus
LQSSDDFALI

SEQ ID NO: 361170 - protein, 10 aa, Influenza virus
QSSDDFALIV

SEQ ID NO: 361171 - protein, 10 aa, Influenza virus
SSDDFALIVN

SEQ ID NO: 361172 - protein, 10 aa, Influenza virus
SDDFALIVNA

SEQ ID NO: 361173 - protein, 10 aa, Influenza virus
DDFALIVNAP

SEQ ID NO: 361174 - protein, 10 aa, Influenza virus
GIQAGVDRFY

SEQ ID NO: 361175 - protein, 10 aa, Influenza virus
IQAGVDRFYR

SEQ ID NO: 361176 - protein, 10 aa, Influenza virus
QAGVDRFYRT

SEQ ID NO: 361177 - protein, 10 aa, Influenza virus
AGVDRFYRTC

SEQ ID NO: 361178 - protein, 10 aa, Influenza virus
GVDRFYRTCK

SEQ ID NO: 361179 - protein, 10 aa, Influenza virus
VDRFYRTCKL

SEQ ID NO: 361180 - protein, 10 aa, Influenza virus
DRFYRTCKLV

SEQ ID NO: 361181 - protein, 10 aa, Influenza virus
RFYRTCKLVG

SEQ ID NO: 361182 - protein, 10 aa, Influenza virus
FYRTCKLVGI

SEQ ID NO: 361183 - protein, 10 aa, Influenza virus
YRTCKLVGIN

SEQ ID NO: 361184 - protein, 10 aa, Influenza virus
RTCKLVGINM

SEQ ID NO: 361185 - protein, 10 aa, Influenza virus
TCKLVGINMS

SEQ ID NO: 361186 - protein, 10 aa, Influenza virus
CKLVGINMSK

SEQ ID NO: 361187 - protein, 10 aa, Influenza virus
KLVGINMSKK

SEQ ID NO: 361188 - protein, 10 aa, Influenza virus
LVGINMSKKK

SEQ ID NO: 361189 - protein, 10 aa, Influenza virus
VGINMSKKKS

SEQ ID NO: 361190 - protein, 10 aa, Influenza virus
GINMSKKKSY

SEQ ID NO: 361191 - protein, 10 aa, Influenza virus
INMSKKKSYI

SEQ ID NO: 361192 - protein, 10 aa, Influenza virus
NMSKKKSYIN

SEQ ID NO: 361193 - protein, 10 aa, Influenza virus
MSKKKSYINR

SEQ ID NO: 361194 - protein, 10 aa, Influenza virus
SKKKSYINRT

SEQ ID NO: 361195 - protein, 10 aa, Influenza virus
KKKSYINRTG

SEQ ID NO: 361196 - protein, 10 aa, Influenza virus
KKSYINRTGT

SEQ ID NO: 361197 - protein, 10 aa, Influenza virus
KSYINRTGTF

SEQ ID NO: 361198 - protein, 10 aa, Influenza virus
SYINRTGTFE

SEQ ID NO: 361199 - protein, 10 aa, Influenza virus
YINRTGTFEF

SEQ ID NO: 361200 - protein, 10 aa, Influenza virus
INRTGTFEFT

SEQ ID NO: 361201 - protein, 10 aa, Influenza virus
NRTGTFEFTS

SEQ ID NO: 361202 - protein, 10 aa, Influenza virus
RTGTFEFTSF

SEQ ID NO: 361203 - protein, 10 aa, Influenza virus
TGTFEFTSFF

SEQ ID NO: 361204 - protein, 10 aa, Influenza virus
GTFEFTSFFY

SEQ ID NO: 361205 - protein, 10 aa, Influenza virus
TFEFTSFFYR

SEQ ID NO: 361206 - protein, 10 aa, Influenza virus
FEFTSFFYRY

SEQ ID NO: 361207 - protein, 10 aa, Influenza virus
EFTSFFYRYG

SEQ ID NO: 361208 - protein, 10 aa, Influenza virus
FTSFFYRYGF

SEQ ID NO: 361209 - protein, 10 aa, Influenza virus
TSFFYRYGFV

SEQ ID NO: 361210 - protein, 10 aa, Influenza virus
SFFYRYGFVA

SEQ ID NO: 361211 - protein, 10 aa, Influenza virus
FFYRYGFVAN

SEQ ID NO: 361212 - protein, 10 aa, Influenza virus
FYRYGFVANF

SEQ ID NO: 361213 - protein, 10 aa, Influenza virus
YRYGFVANFS

SEQ ID NO: 361214 - protein, 10 aa, Influenza virus
RYGFVANFSM

SEQ ID NO: 361215 - protein, 10 aa, Influenza virus
YGFVANFSME

SEQ ID NO: 361216 - protein, 10 aa, Influenza virus
GFVANFSMEL

SEQ ID NO: 361217 - protein, 10 aa, Influenza virus
FVANFSMELP

SEQ ID NO: 361218 - protein, 10 aa, Influenza virus
VANFSMELPS

SEQ ID NO: 361219 - protein, 10 aa, Influenza virus
ANFSMELPSF

SEQ ID NO: 361220 - protein, 10 aa, Influenza virus
NFSMELPSFG

SEQ ID NO: 361221 - protein, 10 aa, Influenza virus
FSMELPSFGV

SEQ ID NO: 361222 - protein, 10 aa, Influenza virus
SMELPSFGVS

SEQ ID NO: 361223 - protein, 10 aa, Influenza virus
MELPSFGVSG

SEQ ID NO: 361224 - protein, 10 aa, Influenza virus
ELPSFGVSGI

SEQ ID NO: 361225 - protein, 10 aa, Influenza virus
LPSFGVSGIN

SEQ ID NO: 361226 - protein, 10 aa, Influenza virus
PSFGVSGINE

SEQ ID NO: 361227 - protein, 10 aa, Influenza virus
SFGVSGINES

SEQ ID NO: 361228 - protein, 10 aa, Influenza virus
FGVSGINESA

SEQ ID NO: 361229 - protein, 10 aa, Influenza virus
GVSGINESAD

SEQ ID NO: 361230 - protein, 10 aa, Influenza virus
VSGINESADM

SEQ ID NO: 361231 - protein, 10 aa, Influenza virus
SGINESADMS

SEQ ID NO: 361232 - protein, 10 aa, Influenza virus
GINESADMSI

SEQ ID NO: 361233 - protein, 10 aa, Influenza virus
INESADMSIG

SEQ ID NO: 361234 - protein, 10 aa, Influenza virus
NESADMSIGV

SEQ ID NO: 361235 - protein, 10 aa, Influenza virus
ESADMSIGVT

SEQ ID NO: 361236 - protein, 10 aa, Influenza virus
SADMSIGVTV

SEQ ID NO: 361237 - protein, 10 aa, Influenza virus
ADMSIGVTVI

SEQ ID NO: 361238 - protein, 10 aa, Influenza virus
DMSIGVTVIK

SEQ ID NO: 361239 - protein, 10 aa, Influenza virus
MSIGVTVIKN

SEQ ID NO: 361240 - protein, 10 aa, Influenza virus
SIGVTVIKNN

SEQ ID NO: 361241 - protein, 10 aa, Influenza virus
IGVTVIKNNM

SEQ ID NO: 361242 - protein, 10 aa, Influenza virus
GVTVIKNNMI

SEQ ID NO: 361243 - protein, 10 aa, Influenza virus
VTVIKNNMIN

SEQ ID NO: 361244 - protein, 10 aa, Influenza virus
TVIKNNMINN

SEQ ID NO: 361245 - protein, 10 aa, Influenza virus
VIKNNMINND

SEQ ID NO: 361246 - protein, 10 aa, Influenza virus
IKNNMINNDL

SEQ ID NO: 361247 - protein, 10 aa, Influenza virus
KNNMINNDLG

SEQ ID NO: 361248 - protein, 10 aa, Influenza virus
NNMINNDLGP

SEQ ID NO: 361249 - protein, 10 aa, Influenza virus
NMINNDLGPA

SEQ ID NO: 361250 - protein, 10 aa, Influenza virus
MINNDLGPAT

SEQ ID NO: 361251 - protein, 10 aa, Influenza virus
INNDLGPATA

SEQ ID NO: 361252 - protein, 10 aa, Influenza virus
NNDLGPATAQ

SEQ ID NO: 361253 - protein, 10 aa, Influenza virus
NDLGPATAQM

SEQ ID NO: 361254 - protein, 10 aa, Influenza virus
DLGPATAQMA

SEQ ID NO: 361255 - protein, 10 aa, Influenza virus
LGPATAQMAL

SEQ ID NO: 361256 - protein, 10 aa, Influenza virus
GPATAQMALQ

SEQ ID NO: 361257 - protein, 10 aa, Influenza virus
PATAQMALQL

SEQ ID NO: 361258 - protein, 10 aa, Influenza virus
ATAQMALQLF

SEQ ID NO: 361259 - protein, 10 aa, Influenza virus
TAQMALQLFI

SEQ ID NO: 361260 - protein, 10 aa, Influenza virus
AQMALQLFIK

SEQ ID NO: 361261 - protein, 10 aa, Influenza virus
QMALQLFIKD

SEQ ID NO: 361262 - protein, 10 aa, Influenza virus
MALQLFIKDY

SEQ ID NO: 361263 - protein, 10 aa, Influenza virus
ALQLFIKDYR

SEQ ID NO: 361264 - protein, 10 aa, Influenza virus
LQLFIKDYRY

SEQ ID NO: 361265 - protein, 10 aa, Influenza virus
QLFIKDYRYT

SEQ ID NO: 361266 - protein, 10 aa, Influenza virus
LFIKDYRYTY

SEQ ID NO: 361267 - protein, 10 aa, Influenza virus
FIKDYRYTYR

SEQ ID NO: 361268 - protein, 10 aa, Influenza virus
IKDYRYTYRC

SEQ ID NO: 361269 - protein, 10 aa, Influenza virus
KDYRYTYRCH

SEQ ID NO: 361270 - protein, 10 aa, Influenza virus
DYRYTYRCHR

SEQ ID NO: 361271 - protein, 10 aa, Influenza virus
YRYTYRCHRG

SEQ ID NO: 361272 - protein, 10 aa, Influenza virus
RYTYRCHRGD

SEQ ID NO: 361273 - protein, 10 aa, Influenza virus
YTYRCHRGDT

SEQ ID NO: 361274 - protein, 10 aa, Influenza virus
TYRCHRGDTQ

SEQ ID NO: 361275 - protein, 10 aa, Influenza virus
YRCHRGDTQI

SEQ ID NO: 361276 - protein, 10 aa, Influenza virus
GLLVSDGGPN

SEQ ID NO: 361277 - protein, 10 aa, Influenza virus
LLVSDGGPNL

SEQ ID NO: 361278 - protein, 10 aa, Influenza virus
LVSDGGPNLY

SEQ ID NO: 361279 - protein, 10 aa, Influenza virus
VSDGGPNLYN

SEQ ID NO: 361280 - protein, 10 aa, Influenza virus
SDGGPNLYNI

SEQ ID NO: 361281 - protein, 10 aa, Influenza virus
DGGPNLYNIR

SEQ ID NO: 361282 - protein, 10 aa, Influenza virus
GGPNLYNIRN

SEQ ID NO: 361283 - protein, 10 aa, Influenza virus
GPNLYNIRNL

SEQ ID NO: 361284 - protein, 10 aa, Influenza virus
PNLYNIRNLH

SEQ ID NO: 361285 - protein, 10 aa, Influenza virus
NLYNIRNLHI

SEQ ID NO: 361286 - protein, 10 aa, Influenza virus
LYNIRNLHIP

SEQ ID NO: 361287 - protein, 10 aa, Influenza virus
YNIRNLHIPE

SEQ ID NO: 361288 - protein, 10 aa, Influenza virus
NIRNLHIPEV

SEQ ID NO: 361289 - protein, 10 aa, Influenza virus
IRNLHIPEVC

SEQ ID NO: 361290 - protein, 10 aa, Influenza virus
RNLHIPEVCL

SEQ ID NO: 361291 - protein, 10 aa, Influenza virus
NLHIPEVCLK

SEQ ID NO: 361292 - protein, 10 aa, Influenza virus
LHIPEVCLKW

SEQ ID NO: 361293 - protein, 10 aa, Influenza virus
HIPEVCLKWE

SEQ ID NO: 361294 - protein, 10 aa, Influenza virus
IPEVCLKWEL

SEQ ID NO: 361295 - protein, 10 aa, Influenza virus
PEVCLKWELM

SEQ ID NO: 361296 - protein, 10 aa, Influenza virus
EVCLKWELMD

SEQ ID NO: 361297 - protein, 10 aa, Influenza virus
YQGRLCNPLN

SEQ ID NO: 361298 - protein, 10 aa, Influenza virus
QGRLCNPLNP

SEQ ID NO: 361299 - protein, 10 aa, Influenza virus
GRLCNPLNPF

SEQ ID NO: 361300 - protein, 10 aa, Influenza virus
RLCNPLNPFV

SEQ ID NO: 361301 - protein, 10 aa, Influenza virus
LCNPLNPFVS

SEQ ID NO: 361302 - protein, 10 aa, Influenza virus
CNPLNPFVSH

SEQ ID NO: 361303 - protein, 10 aa, Influenza virus
HPRGLLEVGT

SEQ ID NO: 361304 - protein, 10 aa, Influenza virus
PRGLLEVGTR

SEQ ID NO: 361305 - protein, 10 aa, Influenza virus
RGLLEVGTRW

SEQ ID NO: 361306 - protein, 10 aa, Influenza virus
GLLEVGTRWM

SEQ ID NO: 361307 - protein, 10 aa, Influenza virus
LLEVGTRWMK

SEQ ID NO: 361308 - protein, 10 aa, Influenza virus
LEVGTRWMKI

SEQ ID NO: 361309 - protein, 10 aa, Influenza virus
EVGTRWMKII

SEQ ID NO: 361310 - protein, 10 aa, Influenza virus
VGTRWMKIIR

SEQ ID NO: 361311 - protein, 10 aa, Influenza virus
GTRWMKIIRV

SEQ ID NO: 361312 - protein, 10 aa, Influenza virus
TRWMKIIRVG

SEQ ID NO: 361313 - protein, 10 aa, Influenza virus
RWMKIIRVGC

SEQ ID NO: 361314 - protein, 10 aa, Influenza virus
WMKIIRVGCV

SEQ ID NO: 361315 - protein, 10 aa, Influenza virus
MKIIRVGCVI

SEQ ID NO: 361316 - protein, 10 aa, Influenza virus
KIIRVGCVIL

SEQ ID NO: 361317 - protein, 10 aa, Influenza virus
IIRVGCVILL

SEQ ID NO: 361318 - protein, 10 aa, Influenza virus
IRVGCVILLN

SEQ ID NO: 361319 - protein, 10 aa, Influenza virus
RVGCVILLNP

SEQ ID NO: 361320 - protein, 10 aa, Influenza virus
VGCVILLNPF

SEQ ID NO: 361321 - protein, 10 aa, Influenza virus
GCVILLNPFV

SEQ ID NO: 361322 - protein, 10 aa, Influenza virus
CVILLNPFVS

SEQ ID NO: 361323 - protein, 10 aa, Influenza virus
VILLNPFVSH

SEQ ID NO: 361324 - protein, 10 aa, Influenza virus
ILLNPFVSHK

SEQ ID NO: 361325 - protein, 10 aa, Influenza virus
LLNPFVSHKE

SEQ ID NO: 361326 - protein, 10 aa, Influenza virus
MEYDAVATTH

SEQ ID NO: 361327 - protein, 10 aa, Influenza virus
EYDAVATTHS

SEQ ID NO: 361328 - protein, 10 aa, Influenza virus
YDAVATTHSW

SEQ ID NO: 361329 - protein, 10 aa, Influenza virus
DAVATTHSWI

SEQ ID NO: 361330 - protein, 10 aa, Influenza virus
AVATTHSWIP

SEQ ID NO: 361331 - protein, 10 aa, Influenza virus
VATTHSWIPK

SEQ ID NO: 361332 - protein, 10 aa, Influenza virus
ATTHSWIPKR

SEQ ID NO: 361333 - protein, 10 aa, Influenza virus
TTHSWIPKRN

SEQ ID NO: 361334 - protein, 10 aa, Influenza virus
THSWIPKRNR

SEQ ID NO: 361335 - protein, 10 aa, Influenza virus
HSWIPKRNRS

SEQ ID NO: 361336 - protein, 10 aa, Influenza virus
SWIPKRNRSI

SEQ ID NO: 361337 - protein, 10 aa, Influenza virus
WIPKRNRSIL

SEQ ID NO: 361338 - protein, 10 aa, Influenza virus
IPKRNRSILN

SEQ ID NO: 361339 - protein, 10 aa, Influenza virus
PKRNRSILNT

SEQ ID NO: 361340 - protein, 10 aa, Influenza virus
KRNRSILNTS

SEQ ID NO: 361341 - protein, 10 aa, Influenza virus
RNRSILNTSQ

SEQ ID NO: 361342 - protein, 10 aa, Influenza virus
NRSILNTSQR

SEQ ID NO: 361343 - protein, 10 aa, Influenza virus
RSILNTSQRG

SEQ ID NO: 361344 - protein, 10 aa, Influenza virus
SILNTSQRGI

SEQ ID NO: 361345 - protein, 10 aa, Influenza virus
ICNSNAITRS

SEQ ID NO: 361346 - protein, 10 aa, Influenza virus
CNSNAITRSG

SEQ ID NO: 361347 - protein, 10 aa, Influenza virus
NSNAITRSGQ

SEQ ID NO: 361348 - protein, 10 aa, Influenza virus
SNAITRSGQN

SEQ ID NO: 361349 - protein, 10 aa, Influenza virus
NAITRSGQNH

SEQ ID NO: 361350 - protein, 10 aa, Influenza virus
AITRSGQNHG

SEQ ID NO: 361351 - protein, 10 aa, Influenza virus
ITRSGQNHGI

SEQ ID NO: 361352 - protein, 10 aa, Influenza virus
TRSGQNHGIC

SEQ ID NO: 361353 - protein, 10 aa, Influenza virus
RSGQNHGICA

SEQ ID NO: 361354 - protein, 10 aa, Influenza virus
SGQNHGICAV

SEQ ID NO: 361355 - protein, 10 aa, Influenza virus
GQNHGICAVA

SEQ ID NO: 361356 - protein, 10 aa, Influenza virus
QNHGICAVAT

SEQ ID NO: 361357 - protein, 10 aa, Influenza virus
NHGICAVATT

SEQ ID NO: 361358 - protein, 10 aa, Influenza virus
HGICAVATTH

SEQ ID NO: 361359 - protein, 10 aa, Influenza virus
GICAVATTHS

SEQ ID NO: 361360 - protein, 10 aa, Influenza virus
ICAVATTHSW

SEQ ID NO: 361361 - protein, 10 aa, Influenza virus
CAVATTHSWV

SEQ ID NO: 361362 - protein, 10 aa, Influenza virus
AVATTHSWVP

SEQ ID NO: 361363 - protein, 10 aa, Influenza virus
VATTHSWVPI

SEQ ID NO: 361364 - protein, 10 aa, Influenza virus
ATTHSWVPIL

SEQ ID NO: 361365 - protein, 10 aa, Influenza virus
TTHSWVPILN

SEQ ID NO: 361366 - protein, 10 aa, Influenza virus
THSWVPILNT

SEQ ID NO: 361367 - protein, 10 aa, Influenza virus
HSWVPILNTS

SEQ ID NO: 361368 - protein, 10 aa, Influenza virus
SWVPILNTSQ

SEQ ID NO: 361369 - protein, 10 aa, Influenza virus
WVPILNTSQR

SEQ ID NO: 361370 - protein, 10 aa, Influenza virus
VPILNTSQRG

SEQ ID NO: 361371 - protein, 10 aa, Influenza virus
PILNTSQRGI

SEQ ID NO: 361372 - protein, 10 aa, Influenza virus
ILNTSQRGIL

SEQ ID NO: 361373 - protein, 10 aa, Influenza virus
LNTSQRGILE

SEQ ID NO: 361374 - protein, 10 aa, Influenza virus
NTSQRGILED

SEQ ID NO: 361375 - protein, 10 aa, Influenza virus
TSQRGILEDE

SEQ ID NO: 361376 - protein, 10 aa, Influenza virus
SQRGILEDEQ

SEQ ID NO: 361377 - protein, 10 aa, Influenza virus
QRGILEDEQM

SEQ ID NO: 361378 - protein, 10 aa, Influenza virus
RGILEDEQMY

SEQ ID NO: 361379 - protein, 10 aa, Influenza virus
GILEDEQMYQ

SEQ ID NO: 361380 - protein, 10 aa, Influenza virus
ILEDEQMYQK

SEQ ID NO: 361381 - protein, 10 aa, Influenza virus
LEDEQMYQKC

SEQ ID NO: 361382 - protein, 10 aa, Influenza virus
EDEQMYQKCC

SEQ ID NO: 361383 - protein, 10 aa, Influenza virus
DEQMYQKCCN

SEQ ID NO: 361384 - protein, 10 aa, Influenza virus
EQMYQKCCNL

SEQ ID NO: 361385 - protein, 10 aa, Influenza virus
QMYQKCCNLF

SEQ ID NO: 361386 - protein, 10 aa, Influenza virus
MYQKCCNLFE

SEQ ID NO: 361387 - protein, 10 aa, Influenza virus
YQKCCNLFEK

SEQ ID NO: 361388 - protein, 10 aa, Influenza virus
QKCCNLFEKF

SEQ ID NO: 361389 - protein, 10 aa, Influenza virus
KCCNLFEKFF

SEQ ID NO: 361390 - protein, 10 aa, Influenza virus
CCNLFEKFFP

SEQ ID NO: 361391 - protein, 10 aa, Influenza virus
CNLFEKFFPS

SEQ ID NO: 361392 - protein, 10 aa, Influenza virus
NLFEKFFPSS

SEQ ID NO: 361393 - protein, 10 aa, Influenza virus
LFEKFFPSSS

SEQ ID NO: 361394 - protein, 10 aa, Influenza virus
FEKFFPSSSY

SEQ ID NO: 361395 - protein, 10 aa, Influenza virus
EKFFPSSSYR

SEQ ID NO: 361396 - protein, 10 aa, Influenza virus
KFFPSSSYRR

SEQ ID NO: 361397 - protein, 10 aa, Influenza virus
FFPSSSYRRP

SEQ ID NO: 361398 - protein, 10 aa, Influenza virus
FPSSSYRRPV

SEQ ID NO: 361399 - protein, 10 aa, Influenza virus
PSSSYRRPVG

SEQ ID NO: 361400 - protein, 10 aa, Influenza virus
SSSYRRPVGI

SEQ ID NO: 361401 - protein, 10 aa, Influenza virus
SSYRRPVGIS

SEQ ID NO: 361402 - protein, 10 aa, Influenza virus
SYRRPVGISS

SEQ ID NO: 361403 - protein, 10 aa, Influenza virus
YRRPVGISSM

SEQ ID NO: 361404 - protein, 10 aa, Influenza virus
RRPVGISSMV

SEQ ID NO: 361405 - protein, 10 aa, Influenza virus
RPVGISSMVE

SEQ ID NO: 361406 - protein, 10 aa, Influenza virus
PVGISSMVEA

SEQ ID NO: 361407 - protein, 10 aa, Influenza virus
VGISSMVEAM

SEQ ID NO: 361408 - protein, 10 aa, Influenza virus
GISSMVEAMV

SEQ ID NO: 361409 - protein, 10 aa, Influenza virus
ISSMVEAMVS

SEQ ID NO: 361410 - protein, 10 aa, Influenza virus
SSMVEAMVSR

SEQ ID NO: 361411 - protein, 10 aa, Influenza virus
SMVEAMVSRA

SEQ ID NO: 361412 - protein, 10 aa, Influenza virus
MVEAMVSRAR

SEQ ID NO: 361413 - protein, 10 aa, Influenza virus
VEAMVSRARI

SEQ ID NO: 361414 - protein, 10 aa, Influenza virus
EAMVSRARID

SEQ ID NO: 361415 - protein, 10 aa, Influenza virus
AMVSRARIDA

SEQ ID NO: 361416 - protein, 10 aa, Influenza virus
MVSRARIDAR

SEQ ID NO: 361417 - protein, 10 aa, Influenza virus
VSRARIDARI

SEQ ID NO: 361418 - protein, 10 aa, Influenza virus
SRARIDARID

SEQ ID NO: 361419 - protein, 10 aa, Influenza virus
RARIDARIDF

SEQ ID NO: 361420 - protein, 10 aa, Influenza virus
ARIDARIDFE

SEQ ID NO: 361421 - protein, 10 aa, Influenza virus
RIDARIDFES

SEQ ID NO: 361422 - protein, 10 aa, Influenza virus
IDARIDFESG

SEQ ID NO: 361423 - protein, 10 aa, Influenza virus
DARIDFESGR

SEQ ID NO: 361424 - protein, 10 aa, Influenza virus
ARIDFESGRI

SEQ ID NO: 361425 - protein, 10 aa, Influenza virus
GKKEEFSEIM

SEQ ID NO: 361426 - protein, 10 aa, Influenza virus
IEELRRQKSL

SEQ ID NO: 361427 - protein, 10 aa, Influenza virus
EELRRQKWWV

SEQ ID NO: 361428 - protein, 10 aa, Influenza virus
ELRRQKWWVW

SEQ ID NO: 361429 - protein, 10 aa, Influenza virus
LRRQKWWVWL

SEQ ID NO: 361430 - protein, 10 aa, Influenza virus
RRQKWWVWLW

SEQ ID NO: 361431 - protein, 10 aa, Influenza virus
RQKWWVWLWL

SEQ ID NO: 361432 - protein, 10 aa, Influenza virus
QKWWVWLWLV

SEQ ID NO: 361433 - protein, 10 aa, Influenza virus
KSLIWLWLVL

SEQ ID NO: 361434 - protein, 10 aa, Influenza virus
WWVWLWLVLR

SEQ ID NO: 361435 - protein, 10 aa, Influenza virus
LIWLWLVLRE

SEQ ID NO: 361436 - protein, 10 aa, Influenza virus
IWLWLVLREK

SEQ ID NO: 361437 - protein, 10 aa, Influenza virus
WLWLVLREKM

SEQ ID NO: 361438 - protein, 10 aa, Influenza virus
LWLVLREKMP

SEQ ID NO: 361439 - protein, 10 aa, Influenza virus
SKSRSNIFNM

SEQ ID NO: 361440 - protein, 10 aa, Influenza virus
KSRSNIFNME

SEQ ID NO: 361441 - protein, 10 aa, Influenza virus
SRSNIFNMER

SEQ ID NO: 361442 - protein, 10 aa, Influenza virus
RSNIFNMERI

SEQ ID NO: 361443 - protein, 10 aa, Influenza virus
SNIFNMERIK

SEQ ID NO: 361444 - protein, 10 aa, Influenza virus
NIFNMERIKE

SEQ ID NO: 361445 - protein, 10 aa, Influenza virus
IFNMERIKEL

SEQ ID NO: 361446 - protein, 10 aa, Influenza virus
FNMERIKELR

SEQ ID NO: 361447 - protein, 10 aa, Influenza virus
NMERIKELRD

SEQ ID NO: 361448 - protein, 10 aa, Influenza virus
LMSQSRTREI

SEQ ID NO: 361449 - protein, 10 aa, Influenza virus
MSQSRTREIL

SEQ ID NO: 361450 - protein, 10 aa, Influenza virus
SQSRTREILT

SEQ ID NO: 361451 - protein, 10 aa, Influenza virus
QSRTREILTK

SEQ ID NO: 361452 - protein, 10 aa, Influenza virus
SRTREILTKT

SEQ ID NO: 361453 - protein, 10 aa, Influenza virus
RTREILTKTT

SEQ ID NO: 361454 - protein, 10 aa, Influenza virus
TREILTKTTV

SEQ ID NO: 361455 - protein, 10 aa, Influenza virus
REILTKTTVD

SEQ ID NO: 361456 - protein, 10 aa, Influenza virus
EILTKTTVDH

SEQ ID NO: 361457 - protein, 10 aa, Influenza virus
ILTKTTVDHM

SEQ ID NO: 361458 - protein, 10 aa, Influenza virus
LTKTTVDHMA

SEQ ID NO: 361459 - protein, 10 aa, Influenza virus
TKTTVDHMAI

SEQ ID NO: 361460 - protein, 10 aa, Influenza virus
KTTVDHMAII

SEQ ID NO: 361461 - protein, 10 aa, Influenza virus
TTVDHMAIIK

SEQ ID NO: 361462 - protein, 10 aa, Influenza virus
TVDHMAIIKK

SEQ ID NO: 361463 - protein, 10 aa, Influenza virus
VDHMAIIKKY

SEQ ID NO: 361464 - protein, 10 aa, Influenza virus
DHMAIIKKYT

SEQ ID NO: 361465 - protein, 10 aa, Influenza virus
HMAIIKKYTS

SEQ ID NO: 361466 - protein, 10 aa, Influenza virus
MAIIKKYTSG

SEQ ID NO: 361467 - protein, 10 aa, Influenza virus
AIIKKYTSGR

SEQ ID NO: 361468 - protein, 10 aa, Influenza virus
IIKKYTSGRQ

SEQ ID NO: 361469 - protein, 10 aa, Influenza virus
IKKYTSGRQE

SEQ ID NO: 361470 - protein, 10 aa, Influenza virus
GHNQEYTSGR

SEQ ID NO: 361471 - protein, 10 aa, Influenza virus
HNQEYTSGRQ

SEQ ID NO: 361472 - protein, 10 aa, Influenza virus
NQEYTSGRQE

SEQ ID NO: 361473 - protein, 10 aa, Influenza virus
KKYTSGRQEK

SEQ ID NO: 361474 - protein, 10 aa, Influenza virus
KYTSGRQEKN

SEQ ID NO: 361475 - protein, 10 aa, Influenza virus
YTSGRQEKNP

SEQ ID NO: 361476 - protein, 10 aa, Influenza virus
TSGRQEKNPA

SEQ ID NO: 361477 - protein, 10 aa, Influenza virus
SGRQEKNPAL

SEQ ID NO: 361478 - protein, 10 aa, Influenza virus
GRQEKNPALR

SEQ ID NO: 361479 - protein, 10 aa, Influenza virus
RQEKNPALRM

SEQ ID NO: 361480 - protein, 10 aa, Influenza virus
QEKNPALRMK

SEQ ID NO: 361481 - protein, 10 aa, Influenza virus
EKNPALRMKW

SEQ ID NO: 361482 - protein, 10 aa, Influenza virus
KNPALRMKWM

SEQ ID NO: 361483 - protein, 10 aa, Influenza virus
NPALRMKWMM

SEQ ID NO: 361484 - protein, 10 aa, Influenza virus
PALRMKWMMA

SEQ ID NO: 361485 - protein, 10 aa, Influenza virus
ALRMKWMMAM

SEQ ID NO: 361486 - protein, 10 aa, Influenza virus
LRMKWMMAMK

SEQ ID NO: 361487 - protein, 10 aa, Influenza virus
RMKWMMAMKY

SEQ ID NO: 361488 - protein, 10 aa, Influenza virus
MKWMMAMKYP

SEQ ID NO: 361489 - protein, 10 aa, Influenza virus
KWMMAMKYPI

SEQ ID NO: 361490 - protein, 10 aa, Influenza virus
WMMAMKYPIT

SEQ ID NO: 361491 - protein, 10 aa, Influenza virus
MMAMKYPITA

SEQ ID NO: 361492 - protein, 10 aa, Influenza virus
MAMKYPITAD

SEQ ID NO: 361493 - protein, 10 aa, Influenza virus
MVSPLAVTWW

SEQ ID NO: 361494 - protein, 10 aa, Influenza virus
VSPLAVTWWN

SEQ ID NO: 361495 - protein, 10 aa, Influenza virus
SPLAVTWWNR

SEQ ID NO: 361496 - protein, 10 aa, Influenza virus
PLAVTWWNRN

SEQ ID NO: 361497 - protein, 10 aa, Influenza virus
LAVTWWNRNG

SEQ ID NO: 361498 - protein, 10 aa, Influenza virus
AVTWWNRNGP

SEQ ID NO: 361499 - protein, 10 aa, Influenza virus
HYPKVYKTYF

SEQ ID NO: 361500 - protein, 10 aa, Influenza virus
GTFGPVHFRN

SEQ ID NO: 361501 - protein, 10 aa, Influenza virus
TFGPVHFRNQ

SEQ ID NO: 361502 - protein, 10 aa, Influenza virus
FGPVHFRNQV

SEQ ID NO: 361503 - protein, 10 aa, Influenza virus
GPVHFRNQVK

SEQ ID NO: 361504 - protein, 10 aa, Influenza virus
PVHFRNQVKI

SEQ ID NO: 361505 - protein, 10 aa, Influenza virus
VHFRNQVKIR

SEQ ID NO: 361506 - protein, 10 aa, Influenza virus
HFRNQVKIRR

SEQ ID NO: 361507 - protein, 10 aa, Influenza virus
FRNQVKIRRR

SEQ ID NO: 361508 - protein, 10 aa, Influenza virus
RNQVKIRRRV

SEQ ID NO: 361509 - protein, 10 aa, Influenza virus
NQVKIRRRVD

SEQ ID NO: 361510 - protein, 10 aa, Influenza virus
QVKIRRRVDI

SEQ ID NO: 361511 - protein, 10 aa, Influenza virus
VKIRRRVDIN

SEQ ID NO: 361512 - protein, 10 aa, Influenza virus
KIRRRVDINP

SEQ ID NO: 361513 - protein, 10 aa, Influenza virus
IRRRVDINPG

SEQ ID NO: 361514 - protein, 10 aa, Influenza virus
RRRVDINPGH

SEQ ID NO: 361515 - protein, 10 aa, Influenza virus
RRVDINPGHA

SEQ ID NO: 361516 - protein, 10 aa, Influenza virus
RVDINPGHAD

SEQ ID NO: 361517 - protein, 10 aa, Influenza virus
AKEAQDVIME

SEQ ID NO: 361518 - protein, 10 aa, Influenza virus
KEAQDVIMEV

SEQ ID NO: 361519 - protein, 10 aa, Influenza virus
EAQDVIMEVV

SEQ ID NO: 361520 - protein, 10 aa, Influenza virus
AQDVIMEVVF

SEQ ID NO: 361521 - protein, 10 aa, Influenza virus
QDVIMEVVFP

SEQ ID NO: 361522 - protein, 10 aa, Influenza virus
DVIMEVVFPN

SEQ ID NO: 361523 - protein, 10 aa, Influenza virus
VIMEVVFPNE

SEQ ID NO: 361524 - protein, 10 aa, Influenza virus
IMEVVFPNEV

SEQ ID NO: 361525 - protein, 10 aa, Influenza virus
MEVVFPNEVG

SEQ ID NO: 361526 - protein, 10 aa, Influenza virus
EVVFPNEVGA

SEQ ID NO: 361527 - protein, 10 aa, Influenza virus
VVFPNEVGAR

SEQ ID NO: 361528 - protein, 10 aa, Influenza virus
VFPNEVGARI

SEQ ID NO: 361529 - protein, 10 aa, Influenza virus
FPNEVGARIL

SEQ ID NO: 361530 - protein, 10 aa, Influenza virus
PNEVGARILT

SEQ ID NO: 361531 - protein, 10 aa, Influenza virus
NEVGARILTS

SEQ ID NO: 361532 - protein, 10 aa, Influenza virus
EVGARILTSE

SEQ ID NO: 361533 - protein, 10 aa, Influenza virus
VGARILTSES

SEQ ID NO: 361534 - protein, 10 aa, Influenza virus
GARILTSESQ

SEQ ID NO: 361535 - protein, 10 aa, Influenza virus
ARILTSESQL

SEQ ID NO: 361536 - protein, 10 aa, Influenza virus
IAPLMVAYML

SEQ ID NO: 361537 - protein, 10 aa, Influenza virus
APLMVAYMLE

SEQ ID NO: 361538 - protein, 10 aa, Influenza virus
PLMVAYMLER

SEQ ID NO: 361539 - protein, 10 aa, Influenza virus
LMVAYMLERE

SEQ ID NO: 361540 - protein, 10 aa, Influenza virus
MVAYMLEREL

SEQ ID NO: 361541 - protein, 10 aa, Influenza virus
VAYMLERELV

SEQ ID NO: 361542 - protein, 10 aa, Influenza virus
AYMLERELVR

SEQ ID NO: 361543 - protein, 10 aa, Influenza virus
YMLERELVRK

SEQ ID NO: 361544 - protein, 10 aa, Influenza virus
MLERELVRKT

SEQ ID NO: 361545 - protein, 10 aa, Influenza virus
LERELVRKTR

SEQ ID NO: 361546 - protein, 10 aa, Influenza virus
ERELVRKTRF

SEQ ID NO: 361547 - protein, 10 aa, Influenza virus
RELVRKTRFL

SEQ ID NO: 361548 - protein, 10 aa, Influenza virus
ELVRKTRFLP

SEQ ID NO: 361549 - protein, 10 aa, Influenza virus
LVRKTRFLPV

SEQ ID NO: 361550 - protein, 10 aa, Influenza virus
VRKTRFLPVA

SEQ ID NO: 361551 - protein, 10 aa, Influenza virus
RKTRFLPVAG

SEQ ID NO: 361552 - protein, 10 aa, Influenza virus
KTRFLPVAGG

SEQ ID NO: 361553 - protein, 10 aa, Influenza virus
TRFLPVAGGT

SEQ ID NO: 361554 - protein, 10 aa, Influenza virus
RFLPVAGGTS

SEQ ID NO: 361555 - protein, 10 aa, Influenza virus
FLPVAGGTSS

SEQ ID NO: 361556 - protein, 10 aa, Influenza virus
GGTSSVYIEV

SEQ ID NO: 361557 - protein, 10 aa, Influenza virus
GTSSVYIEVL

SEQ ID NO: 361558 - protein, 10 aa, Influenza virus
TSSVYIEVLH

SEQ ID NO: 361559 - protein, 10 aa, Influenza virus
SSVYIEVLHL

SEQ ID NO: 361560 - protein, 10 aa, Influenza virus
SVYIEVLHLT

SEQ ID NO: 361561 - protein, 10 aa, Influenza virus
VYIEVLHLTQ

SEQ ID NO: 361562 - protein, 10 aa, Influenza virus
YIEVLHLTQG

SEQ ID NO: 361563 - protein, 10 aa, Influenza virus
IEVLHLTQGT

SEQ ID NO: 361564 - protein, 10 aa, Influenza virus
EVLHLTQGTC

SEQ ID NO: 361565 - protein, 10 aa, Influenza virus
VLHLTQGTCW

SEQ ID NO: 361566 - protein, 10 aa, Influenza virus
LHLTQGTCWE

SEQ ID NO: 361567 - protein, 10 aa, Influenza virus
HLTQGTCWEQ

SEQ ID NO: 361568 - protein, 10 aa, Influenza virus
LTQGTCWEQM

SEQ ID NO: 361569 - protein, 10 aa, Influenza virus
TQGTCWEQMY

SEQ ID NO: 361570 - protein, 10 aa, Influenza virus
QGTCWEQMYT

SEQ ID NO: 361571 - protein, 10 aa, Influenza virus
GTCWEQMYTP

SEQ ID NO: 361572 - protein, 10 aa, Influenza virus
TCWEQMYTPG

SEQ ID NO: 361573 - protein, 10 aa, Influenza virus
CWEQMYTPGG

SEQ ID NO: 361574 - protein, 10 aa, Influenza virus
WEQMYTPGGE

SEQ ID NO: 361575 - protein, 10 aa, Influenza virus
EQMYTPGGEV

SEQ ID NO: 361576 - protein, 10 aa, Influenza virus
YTPGGEVRND

SEQ ID NO: 361577 - protein, 10 aa, Influenza virus
VRNDDVDQSL

SEQ ID NO: 361578 - protein, 10 aa, Influenza virus
NDDVDQSLII

SEQ ID NO: 361579 - protein, 10 aa, Influenza virus
DDVDQSLIIA

SEQ ID NO: 361580 - protein, 10 aa, Influenza virus
DVDQSLIIAA

SEQ ID NO: 361581 - protein, 10 aa, Influenza virus
VDQSLIIAAR

SEQ ID NO: 361582 - protein, 10 aa, Influenza virus
DQSLIIAARN

SEQ ID NO: 361583 - protein, 10 aa, Influenza virus
QSLIIAARNI

SEQ ID NO: 361584 - protein, 10 aa, Influenza virus
SLIIAARNIV

SEQ ID NO: 361585 - protein, 10 aa, Influenza virus
LIIAARNIVR

SEQ ID NO: 361586 - protein, 10 aa, Influenza virus
IIAARNIVRR

SEQ ID NO: 361587 - protein, 10 aa, Influenza virus
IAARNIVRRA

SEQ ID NO: 361588 - protein, 10 aa, Influenza virus
AARNIVRRAA

SEQ ID NO: 361589 - protein, 10 aa, Influenza virus
ARNIVRRAAV

SEQ ID NO: 361590 - protein, 10 aa, Influenza virus
RNIVRRAAVS

SEQ ID NO: 361591 - protein, 10 aa, Influenza virus
NIVRRAAVSA

SEQ ID NO: 361592 - protein, 10 aa, Influenza virus
IVRRAAVSAD

SEQ ID NO: 361593 - protein, 10 aa, Influenza virus
VRRAAVSADP

SEQ ID NO: 361594 - protein, 10 aa, Influenza virus
RRAAVSADPL

SEQ ID NO: 361595 - protein, 10 aa, Influenza virus
RAAVSADPLA

SEQ ID NO: 361596 - protein, 10 aa, Influenza virus
AAVSADPLAS

SEQ ID NO: 361597 - protein, 10 aa, Influenza virus
AVSADPLASL

SEQ ID NO: 361598 - protein, 10 aa, Influenza virus
VSADPLASLL

SEQ ID NO: 361599 - protein, 10 aa, Influenza virus
SADPLASLLE

SEQ ID NO: 361600 - protein, 10 aa, Influenza virus
ADPLASLLEM

SEQ ID NO: 361601 - protein, 10 aa, Influenza virus
DPLASLLEMC

SEQ ID NO: 361602 - protein, 10 aa, Influenza virus
PLASLLEMCH

SEQ ID NO: 361603 - protein, 10 aa, Influenza virus
LASLLEMCHS

SEQ ID NO: 361604 - protein, 10 aa, Influenza virus
ASLLEMCHST

SEQ ID NO: 361605 - protein, 10 aa, Influenza virus
SLLEMCHSTQ

SEQ ID NO: 361606 - protein, 10 aa, Influenza virus
LLEMCHSTQI

SEQ ID NO: 361607 - protein, 10 aa, Influenza virus
LEMCHSTQIG

SEQ ID NO: 361608 - protein, 10 aa, Influenza virus
EMCHSTQIGG

SEQ ID NO: 361609 - protein, 10 aa, Influenza virus
DILRQNPTEE

SEQ ID NO: 361610 - protein, 10 aa, Influenza virus
ILRQNPTEEQ

SEQ ID NO: 361611 - protein, 10 aa, Influenza virus
LRQNPTEEQA

SEQ ID NO: 361612 - protein, 10 aa, Influenza virus
RQNPTEEQAV

SEQ ID NO: 361613 - protein, 10 aa, Influenza virus
QNPTEEQAVD

SEQ ID NO: 361614 - protein, 10 aa, Influenza virus
NPTEEQAVDI

SEQ ID NO: 361615 - protein, 10 aa, Influenza virus
PTEEQAVDIC

SEQ ID NO: 361616 - protein, 10 aa, Influenza virus
TEEQAVDICK

SEQ ID NO: 361617 - protein, 10 aa, Influenza virus
EEQAVDICKA

SEQ ID NO: 361618 - protein, 10 aa, Influenza virus
EQAVDICKAA

SEQ ID NO: 361619 - protein, 10 aa, Influenza virus
QAVDICKAAM

SEQ ID NO: 361620 - protein, 10 aa, Influenza virus
AVDICKAAMG

SEQ ID NO: 361621 - protein, 10 aa, Influenza virus
ICKAAMGLRI

SEQ ID NO: 361622 - protein, 10 aa, Influenza virus
CKAAMGLRIS

SEQ ID NO: 361623 - protein, 10 aa, Influenza virus
KAAMGLRISS

SEQ ID NO: 361624 - protein, 10 aa, Influenza virus
AAMGLRISSS

SEQ ID NO: 361625 - protein, 10 aa, Influenza virus
AMGLRISSSF

SEQ ID NO: 361626 - protein, 10 aa, Influenza virus
MGLRISSSFS

SEQ ID NO: 361627 - protein, 10 aa, Influenza virus
GLRISSSFSF

SEQ ID NO: 361628 - protein, 10 aa, Influenza virus
LRISSSFSFG

SEQ ID NO: 361629 - protein, 10 aa, Influenza virus
RISSSFSFGG

SEQ ID NO: 361630 - protein, 10 aa, Influenza virus
ISSSFSFGGF

SEQ ID NO: 361631 - protein, 10 aa, Influenza virus
SSSFSFGGFT

SEQ ID NO: 361632 - protein, 10 aa, Influenza virus
SSFSFGGFTF

SEQ ID NO: 361633 - protein, 10 aa, Influenza virus
SFSFGGFTFK

SEQ ID NO: 361634 - protein, 10 aa, Influenza virus
FSFGGFTFKR

SEQ ID NO: 361635 - protein, 10 aa, Influenza virus
SFGGFTFKRT

SEQ ID NO: 361636 - protein, 10 aa, Influenza virus
FGGFTFKRTS

SEQ ID NO: 361637 - protein, 10 aa, Influenza virus
GGFTFKRTSG

SEQ ID NO: 361638 - protein, 10 aa, Influenza virus
FTFKRTSGSS

SEQ ID NO: 361639 - protein, 10 aa, Influenza virus
EEEVLTGNLQ

SEQ ID NO: 361640 - protein, 10 aa, Influenza virus
EEVLTGNLQT

SEQ ID NO: 361641 - protein, 10 aa, Influenza virus
EVLTGNLQTL

SEQ ID NO: 361642 - protein, 10 aa, Influenza virus
VLTGNLQTLK

SEQ ID NO: 361643 - protein, 10 aa, Influenza virus
LTGNLQTLKI

SEQ ID NO: 361644 - protein, 10 aa, Influenza virus
EGYEEFTMVG

SEQ ID NO: 361645 - protein, 10 aa, Influenza virus
ATAILRKATR

SEQ ID NO: 361646 - protein, 10 aa, Influenza virus
IVAMVFSQED

SEQ ID NO: 361647 - protein, 10 aa, Influenza virus
VAMVFSQEDC

SEQ ID NO: 361648 - protein, 10 aa, Influenza virus
AMVFSQEDCM

SEQ ID NO: 361649 - protein, 10 aa, Influenza virus
MVFSQEDCMI

SEQ ID NO: 361650 - protein, 10 aa, Influenza virus
VFSQEDCMIK

SEQ ID NO: 361651 - protein, 10 aa, Influenza virus
FSQEDCMIKA

SEQ ID NO: 361652 - protein, 10 aa, Influenza virus
QEDCMIKAVR

SEQ ID NO: 361653 - protein, 10 aa, Influenza virus
DCMIKAVRGD

SEQ ID NO: 361654 - protein, 10 aa, Influenza virus
CMIKAVRGDL

SEQ ID NO: 361655 - protein, 10 aa, Influenza virus
MIKAVRGDLN

SEQ ID NO: 361656 - protein, 10 aa, Influenza virus
IKAVRGDLNF

SEQ ID NO: 361657 - protein, 10 aa, Influenza virus
KAVRGDLNFV

SEQ ID NO: 361658 - protein, 10 aa, Influenza virus
AVRGDLNFVN

SEQ ID NO: 361659 - protein, 10 aa, Influenza virus
VRGDLNFVNR

SEQ ID NO: 361660 - protein, 10 aa, Influenza virus
RGDLNFVNRA

SEQ ID NO: 361661 - protein, 10 aa, Influenza virus
GDLNFVNRAN

SEQ ID NO: 361662 - protein, 10 aa, Influenza virus
DLNFVNRANQ

SEQ ID NO: 361663 - protein, 10 aa, Influenza virus
LNFVNRANQR

SEQ ID NO: 361664 - protein, 10 aa, Influenza virus
NFVNRANQRL

SEQ ID NO: 361665 - protein, 10 aa, Influenza virus
FVNRANQRLN

SEQ ID NO: 361666 - protein, 10 aa, Influenza virus
VNRANQRLNP

SEQ ID NO: 361667 - protein, 10 aa, Influenza virus
NRANQRLNPM

SEQ ID NO: 361668 - protein, 10 aa, Influenza virus
RANQRLNPMH

SEQ ID NO: 361669 - protein, 10 aa, Influenza virus
ANQRLNPMHQ

SEQ ID NO: 361670 - protein, 10 aa, Influenza virus
NQRLNPMHQL

SEQ ID NO: 361671 - protein, 10 aa, Influenza virus
QRLNPMHQLL

SEQ ID NO: 361672 - protein, 10 aa, Influenza virus
RLNPMHQLLR

SEQ ID NO: 361673 - protein, 10 aa, Influenza virus
LNPMHQLLRH

SEQ ID NO: 361674 - protein, 10 aa, Influenza virus
NPMHQLLRHF

SEQ ID NO: 361675 - protein, 10 aa, Influenza virus
PMHQLLRHFQ

SEQ ID NO: 361676 - protein, 10 aa, Influenza virus
MHQLLRHFQK

SEQ ID NO: 361677 - protein, 10 aa, Influenza virus
HQLLRHFQKD

SEQ ID NO: 361678 - protein, 10 aa, Influenza virus
QLLRHFQKDA

SEQ ID NO: 361679 - protein, 10 aa, Influenza virus
LLRHFQKDAK

SEQ ID NO: 361680 - protein, 10 aa, Influenza virus
LRHFQKDAKV

SEQ ID NO: 361681 - protein, 10 aa, Influenza virus
RHFQKDAKVL

SEQ ID NO: 361682 - protein, 10 aa, Influenza virus
RVSKMGVDEY

SEQ ID NO: 361683 - protein, 10 aa, Influenza virus
SKMGVDEYSS

SEQ ID NO: 361684 - protein, 10 aa, Influenza virus
MGVDEYSSTE

SEQ ID NO: 361685 - protein, 10 aa, Influenza virus
GVDEYSSTER

SEQ ID NO: 361686 - protein, 10 aa, Influenza virus
VVSIDRFLRV

SEQ ID NO: 361687 - protein, 10 aa, Influenza virus
VSIDRFLRVR

SEQ ID NO: 361688 - protein, 10 aa, Influenza virus
SIDRFLRVRD

SEQ ID NO: 361689 - protein, 10 aa, Influenza virus
IDRFLRVRDQ

SEQ ID NO: 361690 - protein, 10 aa, Influenza virus
DRFLRVRDQR

SEQ ID NO: 361691 - protein, 10 aa, Influenza virus
RFLRVRDQRG

SEQ ID NO: 361692 - protein, 10 aa, Influenza virus
FLRVRDQRGN

SEQ ID NO: 361693 - protein, 10 aa, Influenza virus
RGNVLLSPEE

SEQ ID NO: 361694 - protein, 10 aa, Influenza virus
GNVLLSPEEV

SEQ ID NO: 361695 - protein, 10 aa, Influenza virus
NVLLSPEEVS

SEQ ID NO: 361696 - protein, 10 aa, Influenza virus
VLLSPEEVSE

SEQ ID NO: 361697 - protein, 10 aa, Influenza virus
LLSPEEVSET

SEQ ID NO: 361698 - protein, 10 aa, Influenza virus
LSPEEVSETQ

SEQ ID NO: 361699 - protein, 10 aa, Influenza virus
SPEEVSETQG

SEQ ID NO: 361700 - protein, 10 aa, Influenza virus
PEEVSETQGT

SEQ ID NO: 361701 - protein, 10 aa, Influenza virus
EEVSETQGTE

SEQ ID NO: 361702 - protein, 10 aa, Influenza virus
EKLTITYSSS

SEQ ID NO: 361703 - protein, 10 aa, Influenza virus
KLTITYSSSM

SEQ ID NO: 361704 - protein, 10 aa, Influenza virus
LTITYSSSMM

SEQ ID NO: 361705 - protein, 10 aa, Influenza virus
TITYSSSMMW

SEQ ID NO: 361706 - protein, 10 aa, Influenza virus
ITYSSSMMWE

SEQ ID NO: 361707 - protein, 10 aa, Influenza virus
TYSSSMMWEI

SEQ ID NO: 361708 - protein, 10 aa, Influenza virus
YSSSMMWEIN

SEQ ID NO: 361709 - protein, 10 aa, Influenza virus
SSSMMWEING

SEQ ID NO: 361710 - protein, 10 aa, Influenza virus
SSMMWEINGP

SEQ ID NO: 361711 - protein, 10 aa, Influenza virus
SMMWEINGPE

SEQ ID NO: 361712 - protein, 10 aa, Influenza virus
MMWEINGPES

SEQ ID NO: 361713 - protein, 10 aa, Influenza virus
MWEINGPESV

SEQ ID NO: 361714 - protein, 10 aa, Influenza virus
WEINGPESVL

SEQ ID NO: 361715 - protein, 10 aa, Influenza virus
EINGPESVLV

SEQ ID NO: 361716 - protein, 10 aa, Influenza virus
INGPESVLVN

SEQ ID NO: 361717 - protein, 10 aa, Influenza virus
NGPESVLVNT

SEQ ID NO: 361718 - protein, 10 aa, Influenza virus
GPESVLVNTY

SEQ ID NO: 361719 - protein, 10 aa, Influenza virus
PESVLVNTYQ

SEQ ID NO: 361720 - protein, 10 aa, Influenza virus
ESVLVNTYQW

SEQ ID NO: 361721 - protein, 10 aa, Influenza virus
SVLVNTYQWI

SEQ ID NO: 361722 - protein, 10 aa, Influenza virus
VLVNTYQWII

SEQ ID NO: 361723 - protein, 10 aa, Influenza virus
LVNTYQWIIR

SEQ ID NO: 361724 - protein, 10 aa, Influenza virus
VNTYQWIIRN

SEQ ID NO: 361725 - protein, 10 aa, Influenza virus
NTYQWIIRNW

SEQ ID NO: 361726 - protein, 10 aa, Influenza virus
TYQWIIRNWE

SEQ ID NO: 361727 - protein, 10 aa, Influenza virus
LYNKMEFEPF

SEQ ID NO: 361728 - protein, 10 aa, Influenza virus
YNKMEFEPFQ

SEQ ID NO: 361729 - protein, 10 aa, Influenza virus
NKMEFEPFQS

SEQ ID NO: 361730 - protein, 10 aa, Influenza virus
KMEFEPFQSL

SEQ ID NO: 361731 - protein, 10 aa, Influenza virus
MEFEPFQSLV

SEQ ID NO: 361732 - protein, 10 aa, Influenza virus
EFEPFQSLVP

SEQ ID NO: 361733 - protein, 10 aa, Influenza virus
FEPFQSLVPK

SEQ ID NO: 361734 - protein, 10 aa, Influenza virus
EPFQSLVPKA

SEQ ID NO: 361735 - protein, 10 aa, Influenza virus
QYSGFVRTLF

SEQ ID NO: 361736 - protein, 10 aa, Influenza virus
YSGFVRTLFQ

SEQ ID NO: 361737 - protein, 10 aa, Influenza virus
SGFVRTLFQQ

SEQ ID NO: 361738 - protein, 10 aa, Influenza virus
GFVRTLFQQM

SEQ ID NO: 361739 - protein, 10 aa, Influenza virus
FVRTLFQQMR

SEQ ID NO: 361740 - protein, 10 aa, Influenza virus
VRTLFQQMRD

SEQ ID NO: 361741 - protein, 10 aa, Influenza virus
RTLFQQMRDV

SEQ ID NO: 361742 - protein, 10 aa, Influenza virus
TLFQQMRDVL

SEQ ID NO: 361743 - protein, 10 aa, Influenza virus
LFQQMRDVLG

SEQ ID NO: 361744 - protein, 10 aa, Influenza virus
FQQMRDVLGT

SEQ ID NO: 361745 - protein, 10 aa, Influenza virus
QQMRDVLGTF

SEQ ID NO: 361746 - protein, 10 aa, Influenza virus
QMRDVLGTFD

SEQ ID NO: 361747 - protein, 10 aa, Influenza virus
MRDVLGTFDT

SEQ ID NO: 361748 - protein, 10 aa, Influenza virus
GTFDTVQIIK

SEQ ID NO: 361749 - protein, 10 aa, Influenza virus
TVQIIKLLPF

SEQ ID NO: 361750 - protein, 10 aa, Influenza virus
VQIIKLLPFA

SEQ ID NO: 361751 - protein, 10 aa, Influenza virus
QIIKLLPFAA

SEQ ID NO: 361752 - protein, 10 aa, Influenza virus
IIKLLPFAAA

SEQ ID NO: 361753 - protein, 10 aa, Influenza virus
IKLLPFAAAP

SEQ ID NO: 361754 - protein, 10 aa, Influenza virus
KLLPFAAAPP

SEQ ID NO: 361755 - protein, 10 aa, Influenza virus
LLPFAAAPPE

SEQ ID NO: 361756 - protein, 10 aa, Influenza virus
LPFAAAPPEQ

SEQ ID NO: 361757 - protein, 10 aa, Influenza virus
PFAAAPPEQS

SEQ ID NO: 361758 - protein, 10 aa, Influenza virus
APPEQSRMQF

SEQ ID NO: 361759 - protein, 10 aa, Influenza virus
PPEQSRMQFS

SEQ ID NO: 361760 - protein, 10 aa, Influenza virus
PEQSRMQFSS

SEQ ID NO: 361761 - protein, 10 aa, Influenza virus
QSRMQFSSLT

SEQ ID NO: 361762 - protein, 10 aa, Influenza virus
SRMQFSSLTV

SEQ ID NO: 361763 - protein, 10 aa, Influenza virus
RMQFSSLTVN

SEQ ID NO: 361764 - protein, 10 aa, Influenza virus
MQFSSLTVNV

SEQ ID NO: 361765 - protein, 10 aa, Influenza virus
QFSSLTVNVR

SEQ ID NO: 361766 - protein, 10 aa, Influenza virus
FSSLTVNVRG

SEQ ID NO: 361767 - protein, 10 aa, Influenza virus
SSLTVNVRGS

SEQ ID NO: 361768 - protein, 10 aa, Influenza virus
SLTVNVRGSG

SEQ ID NO: 361769 - protein, 10 aa, Influenza virus
LTVNVRGSGM

SEQ ID NO: 361770 - protein, 10 aa, Influenza virus
TVNVRGSGMR

SEQ ID NO: 361771 - protein, 10 aa, Influenza virus
VNVRGSGMRI

SEQ ID NO: 361772 - protein, 10 aa, Influenza virus
NVRGSGMRIL

SEQ ID NO: 361773 - protein, 10 aa, Influenza virus
RGSGMRILVR

SEQ ID NO: 361774 - protein, 10 aa, Influenza virus
GSGMRILVRG

SEQ ID NO: 361775 - protein, 10 aa, Influenza virus
GMRILVRGNS

SEQ ID NO: 361776 - protein, 10 aa, Influenza virus
MRILVRGNSP

SEQ ID NO: 361777 - protein, 10 aa, Influenza virus
LVRGNSPVFN

SEQ ID NO: 361778 - protein, 10 aa, Influenza virus
VRGNSPVFNY

SEQ ID NO: 361779 - protein, 10 aa, Influenza virus
RGNSPVFNYN

SEQ ID NO: 361780 - protein, 10 aa, Influenza virus
GNSPVFNYNK

SEQ ID NO: 361781 - protein, 10 aa, Influenza virus
KRLTVLGKDA

SEQ ID NO: 361782 - protein, 10 aa, Influenza virus
RLTVLGKDAG

SEQ ID NO: 361783 - protein, 10 aa, Influenza virus
AGAGALAEDP

SEQ ID NO: 361784 - protein, 10 aa, Influenza virus
GAGALAEDPD

SEQ ID NO: 361785 - protein, 10 aa, Influenza virus
AGVESAVLRG

SEQ ID NO: 361786 - protein, 10 aa, Influenza virus
GVESAVLRGF

SEQ ID NO: 361787 - protein, 10 aa, Influenza virus
VESAVLRGFL

SEQ ID NO: 361788 - protein, 10 aa, Influenza virus
ESAVLRGFLI

SEQ ID NO: 361789 - protein, 10 aa, Influenza virus
SAVLRGFLIL

SEQ ID NO: 361790 - protein, 10 aa, Influenza virus
AVLRGFLILG

SEQ ID NO: 361791 - protein, 10 aa, Influenza virus
VLRGFLILGK

SEQ ID NO: 361792 - protein, 10 aa, Influenza virus
LRGFLILGKE

SEQ ID NO: 361793 - protein, 10 aa, Influenza virus
RGFLILGKED

SEQ ID NO: 361794 - protein, 10 aa, Influenza virus
GFLILGKEDK

SEQ ID NO: 361795 - protein, 10 aa, Influenza virus
GKEDKRYGPA

SEQ ID NO: 361796 - protein, 10 aa, Influenza virus
QKKDKRYGPA

SEQ ID NO: 361797 - protein, 10 aa, Influenza virus
KEDKRYGPAL

SEQ ID NO: 361798 - protein, 10 aa, Influenza virus
EDKRYGPALS

SEQ ID NO: 361799 - protein, 10 aa, Influenza virus
DKRYGPALSI

SEQ ID NO: 361800 - protein, 10 aa, Influenza virus
KRYGPALSIN

SEQ ID NO: 361801 - protein, 10 aa, Influenza virus
RYGPALSINE

SEQ ID NO: 361802 - protein, 10 aa, Influenza virus
YGPALSINEL

SEQ ID NO: 361803 - protein, 10 aa, Influenza virus
GPALSINELS

SEQ ID NO: 361804 - protein, 10 aa, Influenza virus
LAKGEKANVL

SEQ ID NO: 361805 - protein, 10 aa, Influenza virus
AKGEKANVLI

SEQ ID NO: 361806 - protein, 10 aa, Influenza virus
KGEKANVLIG

SEQ ID NO: 361807 - protein, 10 aa, Influenza virus
GEKANVLIGQ

SEQ ID NO: 361808 - protein, 10 aa, Influenza virus
EKANVLIGQG

SEQ ID NO: 361809 - protein, 10 aa, Influenza virus
KANVLIGQGD

SEQ ID NO: 361810 - protein, 10 aa, Influenza virus
ANVLIGQGDV

SEQ ID NO: 361811 - protein, 10 aa, Influenza virus
NVLIGQGDVV

SEQ ID NO: 361812 - protein, 10 aa, Influenza virus
VLIGQGDVVL

SEQ ID NO: 361813 - protein, 10 aa, Influenza virus
LIGQGDVVLV

SEQ ID NO: 361814 - protein, 10 aa, Influenza virus
IGQGDVVLVM

SEQ ID NO: 361815 - protein, 10 aa, Influenza virus
GQGDVVLVMK

SEQ ID NO: 361816 - protein, 10 aa, Influenza virus
QGDVVLVMKR

SEQ ID NO: 361817 - protein, 10 aa, Influenza virus
GDVVLVMKRK

SEQ ID NO: 361818 - protein, 10 aa, Influenza virus
DVVLVMKRKR

SEQ ID NO: 361819 - protein, 10 aa, Influenza virus
VVLVMKRKRD

SEQ ID NO: 361820 - protein, 10 aa, Influenza virus
VLVMKRKRDS

SEQ ID NO: 361821 - protein, 10 aa, Influenza virus
LVMKRKRDSS

SEQ ID NO: 361822 - protein, 10 aa, Influenza virus
VMKRKRDSSI

SEQ ID NO: 361823 - protein, 10 aa, Influenza virus
MKRKRDSSIL

SEQ ID NO: 361824 - protein, 10 aa, Influenza virus
KRKRDSSILT

SEQ ID NO: 361825 - protein, 10 aa, Influenza virus
RKRDSSILTD

SEQ ID NO: 361826 - protein, 10 aa, Influenza virus
KRDSSILTDS

SEQ ID NO: 361827 - protein, 10 aa, Influenza virus
RDSSILTDSQ

SEQ ID NO: 361828 - protein, 10 aa, Influenza virus
DSSILTDSQT

SEQ ID NO: 361829 - protein, 10 aa, Influenza virus
SSILTDSQTA

SEQ ID NO: 361830 - protein, 10 aa, Influenza virus
SILTDSQTAT

SEQ ID NO: 361831 - protein, 10 aa, Influenza virus
ILTDSQTATK

SEQ ID NO: 361832 - protein, 10 aa, Influenza virus
LTDSQTATKR

SEQ ID NO: 361833 - protein, 10 aa, Influenza virus
TDSQTATKRI

SEQ ID NO: 361834 - protein, 10 aa, Influenza virus
DSQTATKRIR

SEQ ID NO: 361835 - protein, 10 aa, Influenza virus
SQTATKRIRM

SEQ ID NO: 361836 - protein, 10 aa, Influenza virus
QTATKRIRMA

SEQ ID NO: 361837 - protein, 10 aa, Influenza virus
TATKRIRMAI

SEQ ID NO: 361838 - protein, 10 aa, Influenza virus
KRIRMAINQC

SEQ ID NO: 361839 - protein, 10 aa, Influenza virus
RIRMATNECR

SEQ ID NO: 361840 - protein, 10 aa, Influenza virus
IRMAINWGRI

SEQ ID NO: 361841 - protein, 10 aa, Influenza virus
RMAINWGRIV

SEQ ID NO: 361842 - protein, 10 aa, Influenza virus
QGKTKATKME

SEQ ID NO: 361843 - protein, 10 aa, Influenza virus
IFIFLLLTHW

SEQ ID NO: 361844 - protein, 10 aa, Influenza virus
FIFLLLTHWA

SEQ ID NO: 361845 - protein, 10 aa, Influenza virus
VLSCIFCLAF

SEQ ID NO: 361846 - protein, 10 aa, Influenza virus
SDNADKICLG

SEQ ID NO: 361847 - protein, 10 aa, Influenza virus
EKENSYPKIN

SEQ ID NO: 361848 - protein, 10 aa, Influenza virus
APSGVEYNGK

SEQ ID NO: 361849 - protein, 10 aa, Influenza virus
SGVEYNGKSL

SEQ ID NO: 361850 - protein, 10 aa, Influenza virus
GVEYNGKSLG

SEQ ID NO: 361851 - protein, 10 aa, Influenza virus
VEYNGKSLGI

SEQ ID NO: 361852 - protein, 10 aa, Influenza virus
IGAIDSSMPF

SEQ ID NO: 361853 - protein, 10 aa, Influenza virus
IPIGERGLFG

SEQ ID NO: 361854 - protein, 10 aa, Influenza virus
KLLKERGFFG

SEQ ID NO: 361855 - protein, 10 aa, Influenza virus
LLKERGFFGA

SEQ ID NO: 361856 - protein, 10 aa, Influenza virus
RRKRGLFGAI

SEQ ID NO: 361857 - protein, 10 aa, Influenza virus
TRRQKRGLFG

SEQ ID NO: 361858 - protein, 10 aa, Influenza virus
RRKKRGLFGA

SEQ ID NO: 361859 - protein, 10 aa, Influenza virus
RQKRGLFGAI

SEQ ID NO: 361860 - protein, 10 aa, Influenza virus
QKRGLFGAIA

SEQ ID NO: 361861 - protein, 10 aa, Influenza virus
AHKQLTHHMR

SEQ ID NO: 361862 - protein, 10 aa, Influenza virus
RKKRGLFGAK

SEQ ID NO: 361863 - protein, 10 aa, Influenza virus
RETRGLFGAI

SEQ ID NO: 361864 - protein, 10 aa, Influenza virus
ETRGLFGAIA

SEQ ID NO: 361865 - protein, 10 aa, Influenza virus
TRGLFGAIAG

SEQ ID NO: 361866 - protein, 10 aa, Influenza virus
RGIFGAIAGF

SEQ ID NO: 361867 - protein, 10 aa, Influenza virus
GIFGAIAGFI

SEQ ID NO: 361868 - protein, 10 aa, Influenza virus
IFGAIAGFIE

SEQ ID NO: 361869 - protein, 10 aa, Influenza virus
FGAIAGFIEN

SEQ ID NO: 361870 - protein, 10 aa, Influenza virus
GAIAGFIENG

SEQ ID NO: 361871 - protein, 10 aa, Influenza virus
AIAGFIENGW

SEQ ID NO: 361872 - protein, 10 aa, Influenza virus
HSCLQCRICI

SEQ ID NO: 361873 - protein, 10 aa, Influenza virus
IDFRDMRKNT

SEQ ID NO: 361874 - protein, 10 aa, Influenza virus
LDQNFRNIRK

SEQ ID NO: 361875 - protein, 10 aa, Influenza virus
LVFREQKQEF

SEQ ID NO: 361876 - protein, 10 aa, Influenza virus
FSGSQKQEFK

SEQ ID NO: 361877 - protein, 10 aa, Influenza virus
SGSQKQEFKM

SEQ ID NO: 361878 - protein, 10 aa, Influenza virus
GSQKQEFKMN

SEQ ID NO: 361879 - protein, 10 aa, Influenza virus
SQKQEFKMNP

SEQ ID NO: 361880 - protein, 10 aa, Influenza virus
QKQEIKMNPN

SEQ ID NO: 361881 - protein, 10 aa, Influenza virus
KQEFKMNPNQ

SEQ ID NO: 361882 - protein, 10 aa, Influenza virus
QEFKMNPNQK

SEQ ID NO: 361883 - protein, 10 aa, Influenza virus
EFKMNPNQKI

SEQ ID NO: 361884 - protein, 10 aa, Influenza virus
FKMNPNQKII

SEQ ID NO: 361885 - protein, 10 aa, Influenza virus
KMNPNQKIIT

SEQ ID NO: 361886 - protein, 10 aa, Influenza virus
IREGLILEYY

SEQ ID NO: 361887 - protein, 10 aa, Influenza virus
VMGQASYKIF

SEQ ID NO: 361888 - protein, 10 aa, Influenza virus
GKRGKWVKSV

SEQ ID NO: 361889 - protein, 10 aa, Influenza virus
IKHLEECSCY

SEQ ID NO: 361890 - protein, 10 aa, Influenza virus
SYLNVRCVCR

SEQ ID NO: 361891 - protein, 10 aa, Influenza virus
DNYGVKGFGF

SEQ ID NO: 361892 - protein, 10 aa, Influenza virus
LVFREQKQEF

SEQ ID NO: 361893 - protein, 10 aa, Influenza virus
FSGSQKQEFK

SEQ ID NO: 361894 - protein, 10 aa, Influenza virus
SGSQKQEFKM

SEQ ID NO: 361895 - protein, 10 aa, Influenza virus
GSQKQEFKMN

SEQ ID NO: 361896 - protein, 10 aa, Influenza virus
SQKQEFKMNP

SEQ ID NO: 361897 - protein, 10 aa, Influenza virus
QKQEIKMNPN

SEQ ID NO: 361898 - protein, 10 aa, Influenza virus
KQEFKMNPNQ

SEQ ID NO: 361899 - protein, 10 aa, Influenza virus
QEFKMNPNQK

SEQ ID NO: 361900 - protein, 10 aa, Influenza virus
EFKMNPNQKI

SEQ ID NO: 361901 - protein, 10 aa, Influenza virus
FKMNPNQKII

SEQ ID NO: 361902 - protein, 10 aa, Influenza virus
KMNPNQKIIT

SEQ ID NO: 361903 - protein, 10 aa, Influenza virus
ASQYGPSHSI

SEQ ID NO: 361904 - protein, 10 aa, Influenza virus
TKDNSIRIGS

SEQ ID NO: 361905 - protein, 10 aa, Influenza virus
KDNSVRIGSK

SEQ ID NO: 361906 - protein, 10 aa, Influenza virus
DNSVRIGSKG

SEQ ID NO: 361907 - protein, 10 aa, Influenza virus
NSVRIGSKGD

SEQ ID NO: 361908 - protein, 10 aa, Influenza virus
VRIGSKGDVF

SEQ ID NO: 361909 - protein, 10 aa, Influenza virus
RIGSKGDIFV

SEQ ID NO: 361910 - protein, 10 aa, Influenza virus
GDIFVIREPF

SEQ ID NO: 361911 - protein, 10 aa, Influenza virus
FVMREPFISC

SEQ ID NO: 361912 - protein, 10 aa, Influenza virus
VMREPFISCS

SEQ ID NO: 361913 - protein, 10 aa, Influenza virus
LECKTFFLTQ

SEQ ID NO: 361914 - protein, 10 aa, Influenza virus
ECKTFFLTQG

SEQ ID NO: 361915 - protein, 10 aa, Influenza virus
CKTFFLTQGA

SEQ ID NO: 361916 - protein, 10 aa, Influenza virus
KTFFLTQGAL

SEQ ID NO: 361917 - protein, 10 aa, Influenza virus
LTQGALLNDR

SEQ ID NO: 361918 - protein, 10 aa, Influenza virus
TQGALLNDRH

SEQ ID NO: 361919 - protein, 10 aa, Influenza virus
QGALLNDRHS

SEQ ID NO: 361920 - protein, 10 aa, Influenza virus
GALLNDRHSN

SEQ ID NO: 361921 - protein, 10 aa, Influenza virus
ALLNDRHSNG

SEQ ID NO: 361922 - protein, 10 aa, Influenza virus
LLNDRHSNGT

SEQ ID NO: 361923 - protein, 10 aa, Influenza virus
LNDKHSNGTV

SEQ ID NO: 361924 - protein, 10 aa, Influenza virus
DRSPYRALMS

SEQ ID NO: 361925 - protein, 10 aa, Influenza virus
RSPYRALMSC

SEQ ID NO: 361926 - protein, 10 aa, Influenza virus
SPYRALMSCP

SEQ ID NO: 361927 - protein, 10 aa, Influenza virus
VGEAPSPYNS

SEQ ID NO: 361928 - protein, 10 aa, Influenza virus
GEAPSPYNSR

SEQ ID NO: 361929 - protein, 10 aa, Influenza virus
EAPSPYNSRF

SEQ ID NO: 361930 - protein, 10 aa, Influenza virus
APSPYNSRFE

SEQ ID NO: 361931 - protein, 10 aa, Influenza virus
PSPYNSKFES

SEQ ID NO: 361932 - protein, 10 aa, Influenza virus
SPYNSKFESV

SEQ ID NO: 361933 - protein, 10 aa, Influenza virus
PYNSKFESVA

SEQ ID NO: 361934 - protein, 10 aa, Influenza virus
YNSKFESVAW

SEQ ID NO: 361935 - protein, 10 aa, Influenza virus
NSKFESVAWS

SEQ ID NO: 361936 - protein, 10 aa, Influenza virus
SKFESVAWSA

SEQ ID NO: 361937 - protein, 10 aa, Influenza virus
KFESVAWSAS

SEQ ID NO: 361938 - protein, 10 aa, Influenza virus
WSASACHDGM

SEQ ID NO: 361939 - protein, 10 aa, Influenza virus
SWLTIGISGP

SEQ ID NO: 361940 - protein, 10 aa, Influenza virus
WITIGISGPD

SEQ ID NO: 361941 - protein, 10 aa, Influenza virus
TIGISGPDDG

SEQ ID NO: 361942 - protein, 10 aa, Influenza virus
IGISGPDDGA

SEQ ID NO: 361943 - protein, 10 aa, Influenza virus
GISGPDDGAV

SEQ ID NO: 361944 - protein, 10 aa, Influenza virus
ISGPDDGAVA

SEQ ID NO: 361945 - protein, 10 aa, Influenza virus
SGPDDGAVAV

SEQ ID NO: 361946 - protein, 10 aa, Influenza virus
GPDDGAVAVL

SEQ ID NO: 361947 - protein, 10 aa, Influenza virus
PDDGAVAVLK

SEQ ID NO: 361948 - protein, 10 aa, Influenza virus
DDGAVAVLKY

SEQ ID NO: 361949 - protein, 10 aa, Influenza virus
EAVAVLKYNG

SEQ ID NO: 361950 - protein, 10 aa, Influenza virus
AVLKYNGMIT

SEQ ID NO: 361951 - protein, 10 aa, Influenza virus
ILRTQESECV

SEQ ID NO: 361952 - protein, 10 aa, Influenza virus
LRTQESECVC

SEQ ID NO: 361953 - protein, 10 aa, Influenza virus
NGSCFTIMTD

SEQ ID NO: 361954 - protein, 10 aa, Influenza virus
GSCFTIMTDG

SEQ ID NO: 361955 - protein, 10 aa, Influenza virus
SCFTIMTDGP

SEQ ID NO: 361956 - protein, 10 aa, Influenza virus
CFTIMTDGPS

SEQ ID NO: 361957 - protein, 10 aa, Influenza virus
GKRGKWVKSV

SEQ ID NO: 361958 - protein, 10 aa, Influenza virus
APNFHYEECS

SEQ ID NO: 361959 - protein, 10 aa, Influenza virus
PNFHYEECSC

SEQ ID NO: 361960 - protein, 10 aa, Influenza virus
NFHYEECSCY

SEQ ID NO: 361961 - protein, 10 aa, Influenza virus
FHYEECSCYP

SEQ ID NO: 361962 - protein, 10 aa, Influenza virus
YYEECSCYPD

SEQ ID NO: 361963 - protein, 10 aa, Influenza virus
YEECSCYPDT

SEQ ID NO: 361964 - protein, 10 aa, Influenza virus
CVCRDNWHAS

SEQ ID NO: 361965 - protein, 10 aa, Influenza virus
VCRDNWHASN

SEQ ID NO: 361966 - protein, 10 aa, Influenza virus
CRDNWHASNR

SEQ ID NO: 361967 - protein, 10 aa, Influenza virus
RDNWHASNRP

SEQ ID NO: 361968 - protein, 10 aa, Influenza virus
DNWHASNRPW

SEQ ID NO: 361969 - protein, 10 aa, Influenza virus
NWHASNRPWV

SEQ ID NO: 361970 - protein, 10 aa, Influenza virus
WHASNRPWVS

SEQ ID NO: 361971 - protein, 10 aa, Influenza virus
HASNRPWVSF

SEQ ID NO: 361972 - protein, 10 aa, Influenza virus
GYICSGIFGD

SEQ ID NO: 361973 - protein, 10 aa, Influenza virus
YICSGIFGDN

SEQ ID NO: 361974 - protein, 10 aa, Influenza virus
ICSGIFGDNP

SEQ ID NO: 361975 - protein, 10 aa, Influenza virus
CSGIFGDNPR

SEQ ID NO: 361976 - protein, 10 aa, Influenza virus
RYGNGVWIGR

SEQ ID NO: 361977 - protein, 10 aa, Influenza virus
YDNGVWIGRT

SEQ ID NO: 361978 - protein, 10 aa, Influenza virus
DNGVWIGRTK

SEQ ID NO: 361979 - protein, 10 aa, Influenza virus
NGVWIGRTKN

SEQ ID NO: 361980 - protein, 10 aa, Influenza virus
GFEMIWDPDG

SEQ ID NO: 361981 - protein, 10 aa, Influenza virus
FEMIWDPDGW

SEQ ID NO: 361982 - protein, 10 aa, Influenza virus
NEWSGYSGSF

SEQ ID NO: 361983 - protein, 10 aa, Influenza virus
EWSGYSGSFV

SEQ ID NO: 361984 - protein, 10 aa, Influenza virus
WSGYSGSFIQ

SEQ ID NO: 361985 - protein, 10 aa, Influenza virus
SGYSGSFIQH

SEQ ID NO: 361986 - protein, 10 aa, Influenza virus
GYSGSFIQHP

SEQ ID NO: 361987 - protein, 10 aa, Influenza virus
YSGSFIQHPE

SEQ ID NO: 361988 - protein, 10 aa, Influenza virus
SGSFIQHPEL

SEQ ID NO: 361989 - protein, 10 aa, Influenza virus
GSFIQHPELT

SEQ ID NO: 361990 - protein, 10 aa, Influenza virus
SFIQHPELTG

SEQ ID NO: 361991 - protein, 10 aa, Influenza virus
FVQHPELTGM

SEQ ID NO: 361992 - protein, 10 aa, Influenza virus
QHPELTGMNC

SEQ ID NO: 361993 - protein, 10 aa, Influenza virus
DCMRPCFWVE

SEQ ID NO: 361994 - protein, 10 aa, Influenza virus
CMRPCFWVEL

SEQ ID NO: 361995 - protein, 10 aa, Influenza virus
IRPCFWVELV

SEQ ID NO: 361996 - protein, 10 aa, Influenza virus
RPCFWVELVR

SEQ ID NO: 361997 - protein, 10 aa, Influenza virus
PCFWVELVRG

SEQ ID NO: 361998 - protein, 10 aa, Influenza virus
CFWVELVRGL

SEQ ID NO: 361999 - protein, 10 aa, Influenza virus
FWVELVRGLP

SEQ ID NO: 362000 - protein, 10 aa, Influenza virus
ATIWTSGSSI

SEQ ID NO: 362001 - protein, 10 aa, Influenza virus
TIWASGSSIS

SEQ ID NO: 362002 - protein, 10 aa, Influenza virus
IWASGSSISF

SEQ ID NO: 362003 - protein, 10 aa, Influenza virus
WASGSSISFC

SEQ ID NO: 362004 - protein, 10 aa, Influenza virus
ASGSSISFCG

SEQ ID NO: 362005 - protein, 10 aa, Influenza virus
SGSIISFCGV

SEQ ID NO: 362006 - protein, 10 aa, Influenza virus
GSSISFCGVD

SEQ ID NO: 362007 - protein, 10 aa, Influenza virus
WSWPDGADLP

SEQ ID NO: 362008 - protein, 10 aa, Influenza virus
SWPDGADLPF

SEQ ID NO: 362009 - protein, 10 aa, Influenza virus
KNNQVILCGP

SEQ ID NO: 362010 - protein, 10 aa, Influenza virus
GFAPFAKDNS

SEQ ID NO: 362011 - protein, 10 aa, Influenza virus
PFAKDNSIRL

SEQ ID NO: 362012 - protein, 10 aa, Influenza virus
AKDNSIRLSA

SEQ ID NO: 362013 - protein, 10 aa, Influenza virus
KDNSIRLSAS

SEQ ID NO: 362014 - protein, 10 aa, Influenza virus
DNSIRLSASG

SEQ ID NO: 362015 - protein, 10 aa, Influenza virus
IWITREPYVS

SEQ ID NO: 362016 - protein, 10 aa, Influenza virus
WITREPYVSC

SEQ ID NO: 362017 - protein, 10 aa, Influenza virus
RCYQFALGQG

SEQ ID NO: 362018 - protein, 10 aa, Influenza virus
PHRTLLMNEL

SEQ ID NO: 362019 - protein, 10 aa, Influenza virus
HRTLLMNELG

SEQ ID NO: 362020 - protein, 10 aa, Influenza virus
RTLLMSELGV

SEQ ID NO: 362021 - protein, 10 aa, Influenza virus
TLLMSELGVP

SEQ ID NO: 362022 - protein, 10 aa, Influenza virus
LLMSELGVPF

SEQ ID NO: 362023 - protein, 10 aa, Influenza virus
LMSELGVPFH

SEQ ID NO: 362024 - protein, 10 aa, Influenza virus
MSELGVPFHL

SEQ ID NO: 362025 - protein, 10 aa, Influenza virus
NELGVPFHLA

SEQ ID NO: 362026 - protein, 10 aa, Influenza virus
ELGVPFHLAT

SEQ ID NO: 362027 - protein, 10 aa, Influenza virus
LGVPFHLGTR

SEQ ID NO: 362028 - protein, 10 aa, Influenza virus
GVPFHLGTRQ

SEQ ID NO: 362029 - protein, 10 aa, Influenza virus
VPFHLGTRQV

SEQ ID NO: 362030 - protein, 10 aa, Influenza virus
PFHLGTRQVC

SEQ ID NO: 362031 - protein, 10 aa, Influenza virus
TRQVCIAWSS

SEQ ID NO: 362032 - protein, 10 aa, Influenza virus
RQVCIAWSSS

SEQ ID NO: 362033 - protein, 10 aa, Influenza virus
QVCMAWSSSS

SEQ ID NO: 362034 - protein, 10 aa, Influenza virus
VCMAWSSSSC

SEQ ID NO: 362035 - protein, 10 aa, Influenza virus
CMAWSSSSCH

SEQ ID NO: 362036 - protein, 10 aa, Influenza virus
MAWSSSSCHD

SEQ ID NO: 362037 - protein, 10 aa, Influenza virus
AWSSSSCYDG

SEQ ID NO: 362038 - protein, 10 aa, Influenza virus
WSSSSCHDGR

SEQ ID NO: 362039 - protein, 10 aa, Influenza virus
SSSSCHDGRA

SEQ ID NO: 362040 - protein, 10 aa, Influenza virus
SSSCHDGRAW

SEQ ID NO: 362041 - protein, 10 aa, Influenza virus
SSCHDGRAWL

SEQ ID NO: 362042 - protein, 10 aa, Influenza virus
SCHDGRAWLH

SEQ ID NO: 362043 - protein, 10 aa, Influenza virus
KILRTQESEC

SEQ ID NO: 362044 - protein, 10 aa, Influenza virus
ILRTQESECI

SEQ ID NO: 362045 - protein, 10 aa, Influenza virus
LRTQESECIC

SEQ ID NO: 362046 - protein, 10 aa, Influenza virus
RTQESECICI

SEQ ID NO: 362047 - protein, 10 aa, Influenza virus
TQESECVCIS

SEQ ID NO: 362048 - protein, 10 aa, Influenza virus
CAVVMTDGSA

SEQ ID NO: 362049 - protein, 10 aa, Influenza virus
AVVMTDGSAS

SEQ ID NO: 362050 - protein, 10 aa, Influenza virus
IREGLILEYY

SEQ ID NO: 362051 - protein, 10 aa, Influenza virus
REGLILEYYF

SEQ ID NO: 362052 - protein, 10 aa, Influenza virus
GSAQHIEECS

SEQ ID NO: 362053 - protein, 10 aa, Influenza virus
SAQHIEECSC

SEQ ID NO: 362054 - protein, 10 aa, Influenza virus
AQHIEECSCY

SEQ ID NO: 362055 - protein, 10 aa, Influenza virus
QHIEECSCYP

SEQ ID NO: 362056 - protein, 10 aa, Influenza virus
HIEECSCYPR

SEQ ID NO: 362057 - protein, 10 aa, Influenza virus
SYLNVRCVCR

SEQ ID NO: 362058 - protein, 10 aa, Influenza virus
VRCICRDNWK

SEQ ID NO: 362059 - protein, 10 aa, Influenza virus
RCICRDNWKG

SEQ ID NO: 362060 - protein, 10 aa, Influenza virus
CICRDNWKGS

SEQ ID NO: 362061 - protein, 10 aa, Influenza virus
ICRDNWKGSN

SEQ ID NO: 362062 - protein, 10 aa, Influenza virus
CRDNWRGSNR

SEQ ID NO: 362063 - protein, 10 aa, Influenza virus
RDNWRGSNRP

SEQ ID NO: 362064 - protein, 10 aa, Influenza virus
DNWKGSNRPV

SEQ ID NO: 362065 - protein, 10 aa, Influenza virus
YLCSGLVGDT

SEQ ID NO: 362066 - protein, 10 aa, Influenza virus
LCSGLVGDTP

SEQ ID NO: 362067 - protein, 10 aa, Influenza virus
SGLVGDTPRN

SEQ ID NO: 362068 - protein, 10 aa, Influenza virus
SGYSGVFSVE

SEQ ID NO: 362069 - protein, 10 aa, Influenza virus
CVNRCFYVEL

SEQ ID NO: 362070 - protein, 10 aa, Influenza virus
VNRCFYVELI

SEQ ID NO: 362071 - protein, 10 aa, Influenza virus
CFYVELIRGS

SEQ ID NO: 362072 - protein, 10 aa, Influenza virus
WTSNSIIVFC

SEQ ID NO: 362073 - protein, 10 aa, Influenza virus
TSNSIIVFCG

SEQ ID NO: 362074 - protein, 10 aa, Influenza virus
SNSIIVFCGT

SEQ ID NO: 362075 - protein, 10 aa, Influenza virus
NSIIVFCGTS

SEQ ID NO: 362076 - protein, 10 aa, Influenza virus
SIIVFCGTSG

SEQ ID NO: 362077 - protein, 10 aa, Influenza virus
IIVFCGTSGT

SEQ ID NO: 362078 - protein, 10 aa, Influenza virus
IVFCGTSGTY

SEQ ID NO: 362079 - protein, 10 aa, Influenza virus
AFCGTSGTYG

SEQ ID NO: 362080 - protein, 10 aa, Influenza virus
FCGTSGTYGS

SEQ ID NO: 362081 - protein, 10 aa, Influenza virus
CGTSGTYGSG

SEQ ID NO: 362082 - protein, 10 aa, Influenza virus
GTSGTYGSGS

SEQ ID NO: 362083 - protein, 10 aa, Influenza virus
TSGTYGSGSW

SEQ ID NO: 362084 - protein, 10 aa, Influenza virus
SGTYGSGSWP

SEQ ID NO: 362085 - protein, 10 aa, Influenza virus
GTYGSGSWPD

SEQ ID NO: 362086 - protein, 10 aa, Influenza virus
TYGSGSWPDG

SEQ ID NO: 362087 - protein, 10 aa, Influenza virus
YGSGSWPDGA

SEQ ID NO: 362088 - protein, 10 aa, Influenza virus
TSISCLYKLS

SEQ ID NO: 362089 - protein, 10 aa, Influenza virus
NINFMPYISF

SEQ ID NO: 362090 - protein, 10 aa, Influenza virus
INFMPYISFA

SEQ ID NO: 362091 - protein, 10 aa, Influenza virus
GNLIFNTVIH

SEQ ID NO: 362092 - protein, 10 aa, Influenza virus
LPLCPFKGFF

SEQ ID NO: 362093 - protein, 10 aa, Influenza virus
PLCPFKGFFP

SEQ ID NO: 362094 - protein, 10 aa, Influenza virus
LCPFKGFFPF

SEQ ID NO: 362095 - protein, 10 aa, Influenza virus
CPFKGFFPFH

SEQ ID NO: 362096 - protein, 10 aa, Influenza virus
PFKGFFPFHK

SEQ ID NO: 362097 - protein, 10 aa, Influenza virus
FKGFFPFHKD

SEQ ID NO: 362098 - protein, 10 aa, Influenza virus
KGFFPFHKDN

SEQ ID NO: 362099 - protein, 10 aa, Influenza virus
FFPFHKDNAL

SEQ ID NO: 362100 - protein, 10 aa, Influenza virus
FPFHKDNALR

SEQ ID NO: 362101 - protein, 10 aa, Influenza virus
PFHKDNALRL

SEQ ID NO: 362102 - protein, 10 aa, Influenza virus
FHKDNALRLA

SEQ ID NO: 362103 - protein, 10 aa, Influenza virus
HKDNALRLAE

SEQ ID NO: 362104 - protein, 10 aa, Influenza virus
KDNALRLAEN

SEQ ID NO: 362105 - protein, 10 aa, Influenza virus
IVTREPYISC

SEQ ID NO: 362106 - protein, 10 aa, Influenza virus
VTREPYISCD

SEQ ID NO: 362107 - protein, 10 aa, Influenza virus
TREPYISCDN

SEQ ID NO: 362108 - protein, 10 aa, Influenza virus
DCWSFALAQG

SEQ ID NO: 362109 - protein, 10 aa, Influenza virus
CWSFALAQGT

SEQ ID NO: 362110 - protein, 10 aa, Influenza virus
WSFALAQGTL

SEQ ID NO: 362111 - protein, 10 aa, Influenza virus
SFALAQGALV

SEQ ID NO: 362112 - protein, 10 aa, Influenza virus
FALAQGALVG

SEQ ID NO: 362113 - protein, 10 aa, Influenza virus
ALAQGALVGT

SEQ ID NO: 362114 - protein, 10 aa, Influenza virus
LLGTNHSNGT

SEQ ID NO: 362115 - protein, 10 aa, Influenza virus
HSNGTNKDRT

SEQ ID NO: 362116 - protein, 10 aa, Influenza virus
KDRTSYRSLI

SEQ ID NO: 362117 - protein, 10 aa, Influenza virus
DRTPYRSLIQ

SEQ ID NO: 362118 - protein, 10 aa, Influenza virus
RTPYRSLIQF

SEQ ID NO: 362119 - protein, 10 aa, Influenza virus
TPYRSLIQFP

SEQ ID NO: 362120 - protein, 10 aa, Influenza virus
YRSLIRFPVG

SEQ ID NO: 362121 - protein, 10 aa, Influenza virus
CVAWSSSSCF

SEQ ID NO: 362122 - protein, 10 aa, Influenza virus
VAWSSSSCFD

SEQ ID NO: 362123 - protein, 10 aa, Influenza virus
WSSSSCFDGR

SEQ ID NO: 362124 - protein, 10 aa, Influenza virus
SSSSCFDGRE

SEQ ID NO: 362125 - protein, 10 aa, Influenza virus
SSSCFDGREW

SEQ ID NO: 362126 - protein, 10 aa, Influenza virus
SSCFDGKEWL

SEQ ID NO: 362127 - protein, 10 aa, Influenza virus
SCFDGKEWLH

SEQ ID NO: 362128 - protein, 10 aa, Influenza virus
CFDGKEWMHI

SEQ ID NO: 362129 - protein, 10 aa, Influenza virus
FDGKEWMHIC

SEQ ID NO: 362130 - protein, 10 aa, Influenza virus
RDILRTQESE

SEQ ID NO: 362131 - protein, 10 aa, Influenza virus
NILRTQESEC

SEQ ID NO: 362132 - protein, 10 aa, Influenza virus
RTQESECQCL

SEQ ID NO: 362133 - protein, 10 aa, Influenza virus
KIKHLEECSC

SEQ ID NO: 362134 - protein, 10 aa, Influenza virus
IKHLEECSCY

SEQ ID NO: 362135 - protein, 10 aa, Influenza virus
KHLEECSCYV

SEQ ID NO: 362136 - protein, 10 aa, Influenza virus
HLEECSCYTD

SEQ ID NO: 362137 - protein, 10 aa, Influenza virus
DVYCVCRDNW

SEQ ID NO: 362138 - protein, 10 aa, Influenza virus
VYCVCRDNWK

SEQ ID NO: 362139 - protein, 10 aa, Influenza virus
YCVCRDNWKG

SEQ ID NO: 362140 - protein, 10 aa, Influenza virus
CVCRDNWKGS

SEQ ID NO: 362141 - protein, 10 aa, Influenza virus
VCRDNWKGSN

SEQ ID NO: 362142 - protein, 10 aa, Influenza virus
NWKGSNRPWV

SEQ ID NO: 362143 - protein, 10 aa, Influenza virus
WKGSNRPWVR

SEQ ID NO: 362144 - protein, 10 aa, Influenza virus
KGSNRPWVRM

SEQ ID NO: 362145 - protein, 10 aa, Influenza virus
GSNRPWVRMN

SEQ ID NO: 362146 - protein, 10 aa, Influenza virus
SNRPWVRMNN

SEQ ID NO: 362147 - protein, 10 aa, Influenza virus
NRPWVRMNNE

SEQ ID NO: 362148 - protein, 10 aa, Influenza virus
RPWVRMNNET

SEQ ID NO: 362149 - protein, 10 aa, Influenza virus
PWVRMNNETI

SEQ ID NO: 362150 - protein, 10 aa, Influenza virus
MNNETILETG

SEQ ID NO: 362151 - protein, 10 aa, Influenza virus
SNETILETGY

SEQ ID NO: 362152 - protein, 10 aa, Influenza virus
NETILETGYI

SEQ ID NO: 362153 - protein, 10 aa, Influenza virus
ETILETGYIC

SEQ ID NO: 362154 - protein, 10 aa, Influenza virus
TILETGYICS

SEQ ID NO: 362155 - protein, 10 aa, Influenza virus
ILETGYICSK

SEQ ID NO: 362156 - protein, 10 aa, Influenza virus
LETGYICSKF

SEQ ID NO: 362157 - protein, 10 aa, Influenza virus
ETGYICSKFH

SEQ ID NO: 362158 - protein, 10 aa, Influenza virus
TGYICSKFHS

SEQ ID NO: 362159 - protein, 10 aa, Influenza virus
GYICSKFHSD

SEQ ID NO: 362160 - protein, 10 aa, Influenza virus
YICSKFHSDT

SEQ ID NO: 362161 - protein, 10 aa, Influenza virus
ICSKFHSDTP

SEQ ID NO: 362162 - protein, 10 aa, Influenza virus
KFHSDTPRPD

SEQ ID NO: 362163 - protein, 10 aa, Influenza virus
FHSDTPRPDD

SEQ ID NO: 362164 - protein, 10 aa, Influenza virus
HSDTPRPDDP

SEQ ID NO: 362165 - protein, 10 aa, Influenza virus
SDTPRPDDPS

SEQ ID NO: 362166 - protein, 10 aa, Influenza virus
GDDVWLGRTV

SEQ ID NO: 362167 - protein, 10 aa, Influenza virus
DDVWLGRTVS

SEQ ID NO: 362168 - protein, 10 aa, Influenza virus
TQTLVSNSDW

SEQ ID NO: 362169 - protein, 10 aa, Influenza virus
QTLVSNSDWS

SEQ ID NO: 362170 - protein, 10 aa, Influenza virus
TLVSNSDWSG

SEQ ID NO: 362171 - protein, 10 aa, Influenza virus
LVSNSDWSGY

SEQ ID NO: 362172 - protein, 10 aa, Influenza virus
VSNSDWSGYS

SEQ ID NO: 362173 - protein, 10 aa, Influenza virus
SNSDWSGYSG

SEQ ID NO: 362174 - protein, 10 aa, Influenza virus
NSDWSGYSGS

SEQ ID NO: 362175 - protein, 10 aa, Influenza virus
SDWSGYSGSF

SEQ ID NO: 362176 - protein, 10 aa, Influenza virus
DWSGYSGSFV

SEQ ID NO: 362177 - protein, 10 aa, Influenza virus
WSGYSGSFII

SEQ ID NO: 362178 - protein, 10 aa, Influenza virus
GCFQPCFYIE

SEQ ID NO: 362179 - protein, 10 aa, Influenza virus
CFQPCFYIEL

SEQ ID NO: 362180 - protein, 10 aa, Influenza virus
FQPCFYIELI

SEQ ID NO: 362181 - protein, 10 aa, Influenza virus
QPCFYIELIR

SEQ ID NO: 362182 - protein, 10 aa, Influenza virus
PCFYIELIRG

SEQ ID NO: 362183 - protein, 10 aa, Influenza virus
CFYIELIRGR

SEQ ID NO: 362184 - protein, 10 aa, Influenza virus
VSWTSNSMVT

SEQ ID NO: 362185 - protein, 10 aa, Influenza virus
SWTSNSMVTF

SEQ ID NO: 362186 - protein, 10 aa, Influenza virus
WASNSIVTFC

SEQ ID NO: 362187 - protein, 10 aa, Influenza virus
TSNSMVTFCG

SEQ ID NO: 362188 - protein, 10 aa, Influenza virus
SNSMVTFCGL

SEQ ID NO: 362189 - protein, 10 aa, Influenza virus
NSIVTFCGLN

SEQ ID NO: 362190 - protein, 10 aa, Influenza virus
SIVTFCGLNN

SEQ ID NO: 362191 - protein, 10 aa, Influenza virus
IVTFCGLNNE

SEQ ID NO: 362192 - protein, 10 aa, Influenza virus
VTFCGLNNEP

SEQ ID NO: 362193 - protein, 10 aa, Influenza virus
TFCGLNNEPG

SEQ ID NO: 362194 - protein, 10 aa, Influenza virus
FCGLNNEPGS

SEQ ID NO: 362195 - protein, 10 aa, Influenza virus
CGLNNEPGSG

SEQ ID NO: 362196 - protein, 10 aa, Influenza virus
NNEPGSGNWP

SEQ ID NO: 362197 - protein, 10 aa, Influenza virus
NEPGSGDWPD

SEQ ID NO: 362198 - protein, 10 aa, Influenza virus
EPGSGDWPDG

SEQ ID NO: 362199 - protein, 10 aa, Influenza virus
PGSGNWPDGA

SEQ ID NO: 362200 - protein, 10 aa, Influenza virus
WPDGANIGFM

SEQ ID NO: 362201 - protein, 10 aa, Influenza virus
PDGANIGFMP

SEQ ID NO: 362202 - protein, 10 aa, Influenza virus
DGANIGFMPK

SEQ ID NO: 362203 - protein, 10 aa, Influenza virus
MNPNQMIITI

SEQ ID NO: 362204 - protein, 10 aa, Influenza virus
NPNQKIVTIG

SEQ ID NO: 362205 - protein, 10 aa, Influenza virus
PNQKIVTIGS

SEQ ID NO: 362206 - protein, 10 aa, Influenza virus
LTTIGLLLQI

SEQ ID NO: 362207 - protein, 10 aa, Influenza virus
TTIGLLLQIT

SEQ ID NO: 362208 - protein, 10 aa, Influenza virus
TIGLLLQITS

SEQ ID NO: 362209 - protein, 10 aa, Influenza virus
IGLLLQITSL

SEQ ID NO: 362210 - protein, 10 aa, Influenza virus
GLLLQIISLC

SEQ ID NO: 362211 - protein, 10 aa, Influenza virus
LLLQIISLCS

SEQ ID NO: 362212 - protein, 10 aa, Influenza virus
LLQIISLCSI

SEQ ID NO: 362213 - protein, 10 aa, Influenza virus
LQIISLCSIW

SEQ ID NO: 362214 - protein, 10 aa, Influenza virus
QIISLCSIWF

SEQ ID NO: 362215 - protein, 10 aa, Influenza virus
IISLCSIWFS

SEQ ID NO: 362216 - protein, 10 aa, Influenza virus
ISLCSIWFSH

SEQ ID NO: 362217 - protein, 10 aa, Influenza virus
SIWFSHYNQM

SEQ ID NO: 362218 - protein, 10 aa, Influenza virus
IWFSHYNQMT

SEQ ID NO: 362219 - protein, 10 aa, Influenza virus
WFSHYNQMTQ

SEQ ID NO: 362220 - protein, 10 aa, Influenza virus
FSHYNQMTQA

SEQ ID NO: 362221 - protein, 10 aa, Influenza virus
CSNDTINYYN

SEQ ID NO: 362222 - protein, 10 aa, Influenza virus
SNDTINYYNE

SEQ ID NO: 362223 - protein, 10 aa, Influenza virus
NDTINYYNET

SEQ ID NO: 362224 - protein, 10 aa, Influenza virus
DTINYYNETF

SEQ ID NO: 362225 - protein, 10 aa, Influenza virus
TINYYNETFV

SEQ ID NO: 362226 - protein, 10 aa, Influenza virus
INYYNETFVN

SEQ ID NO: 362227 - protein, 10 aa, Influenza virus
NYYNETFVNI

SEQ ID NO: 362228 - protein, 10 aa, Influenza virus
YYNETFVNMT

SEQ ID NO: 362229 - protein, 10 aa, Influenza virus
YNETFVNVTH

SEQ ID NO: 362230 - protein, 10 aa, Influenza virus
NETFVNVTHV

SEQ ID NO: 362231 - protein, 10 aa, Influenza virus
ETFVNVTHVQ

SEQ ID NO: 362232 - protein, 10 aa, Influenza virus
TFVNVTHVQN

SEQ ID NO: 362233 - protein, 10 aa, Influenza virus
FVNVTHVQNN

SEQ ID NO: 362234 - protein, 10 aa, Influenza virus
VNVTHVQNNY

SEQ ID NO: 362235 - protein, 10 aa, Influenza virus
NVTHVQNNYT

SEQ ID NO: 362236 - protein, 10 aa, Influenza virus
VTHVQNNYTT

SEQ ID NO: 362237 - protein, 10 aa, Influenza virus
TNVQNNYTTI

SEQ ID NO: 362238 - protein, 10 aa, Influenza virus
LCPVKGWAPL

SEQ ID NO: 362239 - protein, 10 aa, Influenza virus
CPVKGWAPLS

SEQ ID NO: 362240 - protein, 10 aa, Influenza virus
PVKGWAPLSK

SEQ ID NO: 362241 - protein, 10 aa, Influenza virus
VKGWAPLSKD

SEQ ID NO: 362242 - protein, 10 aa, Influenza virus
KGWAPLSKDN

SEQ ID NO: 362243 - protein, 10 aa, Influenza virus
GEVSVIREPF

SEQ ID NO: 362244 - protein, 10 aa, Influenza virus
EVFVIREPCI

SEQ ID NO: 362245 - protein, 10 aa, Influenza virus
VFVIREPFVS

SEQ ID NO: 362246 - protein, 10 aa, Influenza virus
SVIREPFISC

SEQ ID NO: 362247 - protein, 10 aa, Influenza virus
VIREPCISCS

SEQ ID NO: 362248 - protein, 10 aa, Influenza virus
IREPFISCSV

SEQ ID NO: 362249 - protein, 10 aa, Influenza virus
ISCSINECRT

SEQ ID NO: 362250 - protein, 10 aa, Influenza virus
SCSINECRTF

SEQ ID NO: 362251 - protein, 10 aa, Influenza virus
CSINECRTFF

SEQ ID NO: 362252 - protein, 10 aa, Influenza virus
SINECRTFFL

SEQ ID NO: 362253 - protein, 10 aa, Influenza virus
INECRTFFLT

SEQ ID NO: 362254 - protein, 10 aa, Influenza virus
NECRTFFLTQ

SEQ ID NO: 362255 - protein, 10 aa, Influenza virus
PFRTLMSCPM

SEQ ID NO: 362256 - protein, 10 aa, Influenza virus
FRTLMSCPMG

SEQ ID NO: 362257 - protein, 10 aa, Influenza virus
RTLMSCPMGV

SEQ ID NO: 362258 - protein, 10 aa, Influenza virus
TLMSCPMGVA

SEQ ID NO: 362259 - protein, 10 aa, Influenza virus
LMSCPMGVAP

SEQ ID NO: 362260 - protein, 10 aa, Influenza virus
MSCPMGVAPS

SEQ ID NO: 362261 - protein, 10 aa, Influenza virus
SCPMGVAPSP

SEQ ID NO: 362262 - protein, 10 aa, Influenza virus
CPMGVAPSPS

SEQ ID NO: 362263 - protein, 10 aa, Influenza virus
PMGVAPSPSN

SEQ ID NO: 362264 - protein, 10 aa, Influenza virus
MGVAPSPSNS

SEQ ID NO: 362265 - protein, 10 aa, Influenza virus
WSATACSDGS

SEQ ID NO: 362266 - protein, 10 aa, Influenza virus
SATACSDGSG

SEQ ID NO: 362267 - protein, 10 aa, Influenza virus
ATACSDGSGW

SEQ ID NO: 362268 - protein, 10 aa, Influenza virus
TACSDGSGWL

SEQ ID NO: 362269 - protein, 10 aa, Influenza virus
ACSDGSGWLT

SEQ ID NO: 362270 - protein, 10 aa, Influenza virus
CSDGPGWLTI

SEQ ID NO: 362271 - protein, 10 aa, Influenza virus
SDGPGWLTIG

SEQ ID NO: 362272 - protein, 10 aa, Influenza virus
DGPGWLTIGI

SEQ ID NO: 362273 - protein, 10 aa, Influenza virus
GPGWLTIGIT

SEQ ID NO: 362274 - protein, 10 aa, Influenza virus
PGWLTIGITG

SEQ ID NO: 362275 - protein, 10 aa, Influenza virus
GWLTIGITGP

SEQ ID NO: 362276 - protein, 10 aa, Influenza virus
WLTIGITGPD

SEQ ID NO: 362277 - protein, 10 aa, Influenza virus
LTLGITGPDS

SEQ ID NO: 362278 - protein, 10 aa, Influenza virus
TLGITGPDST

SEQ ID NO: 362279 - protein, 10 aa, Influenza virus
LGITGPDSTA

SEQ ID NO: 362280 - protein, 10 aa, Influenza virus
GITGPDSTAV

SEQ ID NO: 362281 - protein, 10 aa, Influenza virus
ITGPDSTAVA

SEQ ID NO: 362282 - protein, 10 aa, Influenza virus
TGPDSTAVAV

SEQ ID NO: 362283 - protein, 10 aa, Influenza virus
GPDSTAVAVI

SEQ ID NO: 362284 - protein, 10 aa, Influenza virus
PDSTAVAVIK

SEQ ID NO: 362285 - protein, 10 aa, Influenza virus
DSTAVAVIKY

SEQ ID NO: 362286 - protein, 10 aa, Influenza virus
STAVAVIKYN

SEQ ID NO: 362287 - protein, 10 aa, Influenza virus
TAVAVIKYNG

SEQ ID NO: 362288 - protein, 10 aa, Influenza virus
AVAVIKYNGI

SEQ ID NO: 362289 - protein, 10 aa, Influenza virus
VAVIKYNGII

SEQ ID NO: 362290 - protein, 10 aa, Influenza virus
AVIKYNGIIT

SEQ ID NO: 362291 - protein, 10 aa, Influenza virus
VIKYNGIITD

SEQ ID NO: 362292 - protein, 10 aa, Influenza virus
IKYNGIITDT

SEQ ID NO: 362293 - protein, 10 aa, Influenza virus
KYNGVITDTL

SEQ ID NO: 362294 - protein, 10 aa, Influenza virus
YNGVITDTLK

SEQ ID NO: 362295 - protein, 10 aa, Influenza virus
NGVITDTLKS

SEQ ID NO: 362296 - protein, 10 aa, Influenza virus
GVITDTLKSW

SEQ ID NO: 362297 - protein, 10 aa, Influenza virus
VITDTLKSWK

SEQ ID NO: 362298 - protein, 10 aa, Influenza virus
ITDTFKSWKG

SEQ ID NO: 362299 - protein, 10 aa, Influenza virus
TDTFKSWKGN

SEQ ID NO: 362300 - protein, 10 aa, Influenza virus
DTFKSWKGNI

SEQ ID NO: 362301 - protein, 10 aa, Influenza virus
TFKSWKGNIM

SEQ ID NO: 362302 - protein, 10 aa, Influenza virus
FKSWKGNIMR

SEQ ID NO: 362303 - protein, 10 aa, Influenza virus
CQDEFCYTLM

SEQ ID NO: 362304 - protein, 10 aa, Influenza virus
QDEFCYTLMT

SEQ ID NO: 362305 - protein, 10 aa, Influenza virus
DEFCYTLMTD

SEQ ID NO: 362306 - protein, 10 aa, Influenza virus
EFCYTLMTDG

SEQ ID NO: 362307 - protein, 10 aa, Influenza virus
FCYTLMTDGP

SEQ ID NO: 362308 - protein, 10 aa, Influenza virus
CYTLMTDGPS

SEQ ID NO: 362309 - protein, 10 aa, Influenza virus
YTLMTDGPSD

SEQ ID NO: 362310 - protein, 10 aa, Influenza virus
TLMTDGPSDA

SEQ ID NO: 362311 - protein, 10 aa, Influenza virus
LMTDGPSDAQ

SEQ ID NO: 362312 - protein, 10 aa, Influenza virus
MTDGPSDAQA

SEQ ID NO: 362313 - protein, 10 aa, Influenza virus
TDGPSNAQAF

SEQ ID NO: 362314 - protein, 10 aa, Influenza virus
DGPSNAQAFY

SEQ ID NO: 362315 - protein, 10 aa, Influenza virus
GPSNAQAFYK

SEQ ID NO: 362316 - protein, 10 aa, Influenza virus
PSNAQAFYKI

SEQ ID NO: 362317 - protein, 10 aa, Influenza virus
SNAQAFYKIL

SEQ ID NO: 362318 - protein, 10 aa, Influenza virus
NAQAFYKILK

SEQ ID NO: 362319 - protein, 10 aa, Influenza virus
GQAFYKILKI

SEQ ID NO: 362320 - protein, 10 aa, Influenza virus
QAFYKILKIK

SEQ ID NO: 362321 - protein, 10 aa, Influenza virus
AFYKILKIKK

SEQ ID NO: 362322 - protein, 10 aa, Influenza virus
FYKILKIKKG

SEQ ID NO: 362323 - protein, 10 aa, Influenza virus
YKILKIKKGK

SEQ ID NO: 362324 - protein, 10 aa, Influenza virus
KILKIKKGKI

SEQ ID NO: 362325 - protein, 10 aa, Influenza virus
ILKIKKGKIV

SEQ ID NO: 362326 - protein, 10 aa, Influenza virus
ATGYHFEECS

SEQ ID NO: 362327 - protein, 10 aa, Influenza virus
TGYHFEECSC

SEQ ID NO: 362328 - protein, 10 aa, Influenza virus
GYHFEECSCY

SEQ ID NO: 362329 - protein, 10 aa, Influenza virus
YHFEECSCYP

SEQ ID NO: 362330 - protein, 10 aa, Influenza virus
FEECSCYPSR

SEQ ID NO: 362331 - protein, 10 aa, Influenza virus
EECSCYPSGE

SEQ ID NO: 362332 - protein, 10 aa, Influenza virus
ECSCYPSGEN

SEQ ID NO: 362333 - protein, 10 aa, Influenza virus
NVECVCRDNW

SEQ ID NO: 362334 - protein, 10 aa, Influenza virus
VECVCRDNWR

SEQ ID NO: 362335 - protein, 10 aa, Influenza virus
NWRGSNRPWV

SEQ ID NO: 362336 - protein, 10 aa, Influenza virus
WQGSNRPWIR

SEQ ID NO: 362337 - protein, 10 aa, Influenza virus
RGSNRPWVRF

SEQ ID NO: 362338 - protein, 10 aa, Influenza virus
NRPWIRFNSN

SEQ ID NO: 362339 - protein, 10 aa, Influenza virus
RPWIRFNSNL

SEQ ID NO: 362340 - protein, 10 aa, Influenza virus
PWIRFNSNLD

SEQ ID NO: 362341 - protein, 10 aa, Influenza virus
WIRFNSNLDY

SEQ ID NO: 362342 - protein, 10 aa, Influenza virus
IRFNSNLDYQ

SEQ ID NO: 362343 - protein, 10 aa, Influenza virus
RFNSNLDYQI

SEQ ID NO: 362344 - protein, 10 aa, Influenza virus
FNSNLDYQIG

SEQ ID NO: 362345 - protein, 10 aa, Influenza virus
NSNLDYQIGY

SEQ ID NO: 362346 - protein, 10 aa, Influenza virus
SDLDYQIGYI

SEQ ID NO: 362347 - protein, 10 aa, Influenza virus
DLDYQIGYIC

SEQ ID NO: 362348 - protein, 10 aa, Influenza virus
LDYQIGYICS

SEQ ID NO: 362349 - protein, 10 aa, Influenza virus
DYQIGYICSG

SEQ ID NO: 362350 - protein, 10 aa, Influenza virus
YQIGYVCSGV

SEQ ID NO: 362351 - protein, 10 aa, Influenza virus
QIGYVCSGVF

SEQ ID NO: 362352 - protein, 10 aa, Influenza virus
IGYVCSGVFG

SEQ ID NO: 362353 - protein, 10 aa, Influenza virus
GYVCSGVFGD

SEQ ID NO: 362354 - protein, 10 aa, Influenza virus
YVCSGVFGDN

SEQ ID NO: 362355 - protein, 10 aa, Influenza virus
VCSGVFGDNP

SEQ ID NO: 362356 - protein, 10 aa, Influenza virus
CSGVFGDNPR

SEQ ID NO: 362357 - protein, 10 aa, Influenza virus
SGVFGDNPRP

SEQ ID NO: 362358 - protein, 10 aa, Influenza virus
FGDNPRPADG

SEQ ID NO: 362359 - protein, 10 aa, Influenza virus
PRPADGTGSC

SEQ ID NO: 362360 - protein, 10 aa, Influenza virus
GPINNGKGRY

SEQ ID NO: 362361 - protein, 10 aa, Influenza virus
PINNGKGRYG

SEQ ID NO: 362362 - protein, 10 aa, Influenza virus
INNGKGRYGV

SEQ ID NO: 362363 - protein, 10 aa, Influenza virus
DGVWIGRTKN

SEQ ID NO: 362364 - protein, 10 aa, Influenza virus
EVWIGRTKSL

SEQ ID NO: 362365 - protein, 10 aa, Influenza virus
GRTKSLESRR

SEQ ID NO: 362366 - protein, 10 aa, Influenza virus
RTKNLESRSG

SEQ ID NO: 362367 - protein, 10 aa, Influenza virus
TKSLESRRGF

SEQ ID NO: 362368 - protein, 10 aa, Influenza virus
KNLESRSGFE

SEQ ID NO: 362369 - protein, 10 aa, Influenza virus
SLESRRGFEM

SEQ ID NO: 362370 - protein, 10 aa, Influenza virus
LESRSGFEMI

SEQ ID NO: 362371 - protein, 10 aa, Influenza virus
ESRSGFEMIW

SEQ ID NO: 362372 - protein, 10 aa, Influenza virus
SRSGFEMIWD

SEQ ID NO: 362373 - protein, 10 aa, Influenza virus
RSGFEMIWDA

SEQ ID NO: 362374 - protein, 10 aa, Influenza virus
SGFEMIWDAN

SEQ ID NO: 362375 - protein, 10 aa, Influenza virus
GFEMIWDANG

SEQ ID NO: 362376 - protein, 10 aa, Influenza virus
FEMIWDANGW

SEQ ID NO: 362377 - protein, 10 aa, Influenza virus
EMIWDANGWV

SEQ ID NO: 362378 - protein, 10 aa, Influenza virus
MIWDANGWVS

SEQ ID NO: 362379 - protein, 10 aa, Influenza virus
IWDANGWVST

SEQ ID NO: 362380 - protein, 10 aa, Influenza virus
WDANGWVTAD

SEQ ID NO: 362381 - protein, 10 aa, Influenza virus
DDNGWVSTDK

SEQ ID NO: 362382 - protein, 10 aa, Influenza virus
ANGWVSTDKN

SEQ ID NO: 362383 - protein, 10 aa, Influenza virus
NGWVSTDKNS

SEQ ID NO: 362384 - protein, 10 aa, Influenza virus
GWVSTDKNSN

SEQ ID NO: 362385 - protein, 10 aa, Influenza virus
WVSTDKNSNG

SEQ ID NO: 362386 - protein, 10 aa, Influenza virus
VSTDKNSNGV

SEQ ID NO: 362387 - protein, 10 aa, Influenza virus
STDKNSNGVQ

SEQ ID NO: 362388 - protein, 10 aa, Influenza virus
TDKNSNGVQD

SEQ ID NO: 362389 - protein, 10 aa, Influenza virus
DKNSNGVQDI

SEQ ID NO: 362390 - protein, 10 aa, Influenza virus
KNSNGVQDII

SEQ ID NO: 362391 - protein, 10 aa, Influenza virus
NSNGVQDIID

SEQ ID NO: 362392 - protein, 10 aa, Influenza virus
NGVQDIIDNN

SEQ ID NO: 362393 - protein, 10 aa, Influenza virus
GVQDIIDNNN

SEQ ID NO: 362394 - protein, 10 aa, Influenza virus
VQDIIDNNNW

SEQ ID NO: 362395 - protein, 10 aa, Influenza virus
QDIIDNNNWS

SEQ ID NO: 362396 - protein, 10 aa, Influenza virus
DIIDNNNWSG

SEQ ID NO: 362397 - protein, 10 aa, Influenza virus
IIDNNNWSGY

SEQ ID NO: 362398 - protein, 10 aa, Influenza virus
IDNNNWSGYS

SEQ ID NO: 362399 - protein, 10 aa, Influenza virus
DNNNWSGYSG

SEQ ID NO: 362400 - protein, 10 aa, Influenza virus
NNNWSGYSGS

SEQ ID NO: 362401 - protein, 10 aa, Influenza virus
NNWSGYSGSF

SEQ ID NO: 362402 - protein, 10 aa, Influenza virus
GYSGSFSIRW

SEQ ID NO: 362403 - protein, 10 aa, Influenza virus
YSGSFSIRWE

SEQ ID NO: 362404 - protein, 10 aa, Influenza virus
SGSFSIRWET

SEQ ID NO: 362405 - protein, 10 aa, Influenza virus
GSFSIRWETT

SEQ ID NO: 362406 - protein, 10 aa, Influenza virus
SFSIRWETTG

SEQ ID NO: 362407 - protein, 10 aa, Influenza virus
FSIRWETTGR

SEQ ID NO: 362408 - protein, 10 aa, Influenza virus
SIRWETTGRN

SEQ ID NO: 362409 - protein, 10 aa, Influenza virus
IRWETTGRNC

SEQ ID NO: 362410 - protein, 10 aa, Influenza virus
RWETTGRNCT

SEQ ID NO: 362411 - protein, 10 aa, Influenza virus
GETTGRNCTI

SEQ ID NO: 362412 - protein, 10 aa, Influenza virus
ETTGRNCTIP

SEQ ID NO: 362413 - protein, 10 aa, Influenza virus
TTGRNCTIPC

SEQ ID NO: 362414 - protein, 10 aa, Influenza virus
TGRNCTIPCF

SEQ ID NO: 362415 - protein, 10 aa, Influenza virus
GRNCTIPCFW

SEQ ID NO: 362416 - protein, 10 aa, Influenza virus
RNCTIPCFWV

SEQ ID NO: 362417 - protein, 10 aa, Influenza virus
NCTIPCFWVE

SEQ ID NO: 362418 - protein, 10 aa, Influenza virus
CTIPCFWVEM

SEQ ID NO: 362419 - protein, 10 aa, Influenza virus
TIPCFWVEMI

SEQ ID NO: 362420 - protein, 10 aa, Influenza virus
IPCFWVEMIR

SEQ ID NO: 362421 - protein, 10 aa, Influenza virus
EMIRGQPKER

SEQ ID NO: 362422 - protein, 10 aa, Influenza virus
MIRGQPKEKA

SEQ ID NO: 362423 - protein, 10 aa, Influenza virus
IRGQPKEKAI

SEQ ID NO: 362424 - protein, 10 aa, Influenza virus
RGQPKEKAIW

SEQ ID NO: 362425 - protein, 10 aa, Influenza virus
GQPKEKAIWT

SEQ ID NO: 362426 - protein, 10 aa, Influenza virus
QPKEKAIWTS

SEQ ID NO: 362427 - protein, 10 aa, Influenza virus
PKEKAIWTSG

SEQ ID NO: 362428 - protein, 10 aa, Influenza virus
KEKAIWTSGS

SEQ ID NO: 362429 - protein, 10 aa, Influenza virus
EKAIWTSGSS

SEQ ID NO: 362430 - protein, 10 aa, Influenza virus
KAIWTSGSSI

SEQ ID NO: 362431 - protein, 10 aa, Influenza virus
AIWTSGSSIA

SEQ ID NO: 362432 - protein, 10 aa, Influenza virus
GSSIAFCGVD

SEQ ID NO: 362433 - protein, 10 aa, Influenza virus
SSIAFCGVDS

SEQ ID NO: 362434 - protein, 10 aa, Influenza virus
SIAFCGVDSD

SEQ ID NO: 362435 - protein, 10 aa, Influenza virus
IAFCGVDSDT

SEQ ID NO: 362436 - protein, 10 aa, Influenza virus
AFCGVDSDTT

SEQ ID NO: 362437 - protein, 10 aa, Influenza virus
FCGVDSDTTG

SEQ ID NO: 362438 - protein, 10 aa, Influenza virus
CGVDSDTTGW

SEQ ID NO: 362439 - protein, 10 aa, Influenza virus
SDTTSWSWPD

SEQ ID NO: 362440 - protein, 10 aa, Influenza virus
DTTSWSWPDG

SEQ ID NO: 362441 - protein, 10 aa, Influenza virus
TTSWSWPDGA

SEQ ID NO: 362442 - protein, 10 aa, Influenza virus
TSWSWPDGAL

SEQ ID NO: 362443 - protein, 10 aa, Influenza virus
SWSWPDGALL

SEQ ID NO: 362444 - protein, 10 aa, Influenza virus
WSWPDGALFP

SEQ ID NO: 362445 - protein, 10 aa, Influenza virus
SWPDGALLPL

SEQ ID NO: 362446 - protein, 10 aa, Influenza virus
WPDGALLPLT

SEQ ID NO: 362447 - protein, 10 aa, Influenza virus
GALLPFDIDR

SEQ ID NO: 362448 - protein, 10 aa, Influenza virus
NQKIITIGSI

SEQ ID NO: 362449 - protein, 10 aa, Influenza virus
QKIITIGSIS

SEQ ID NO: 362450 - protein, 10 aa, Influenza virus
KIITIGSISL

SEQ ID NO: 362451 - protein, 10 aa, Influenza virus
IITIGSISLG

SEQ ID NO: 362452 - protein, 10 aa, Influenza virus
TTEIYNETVR

SEQ ID NO: 362453 - protein, 10 aa, Influenza virus
TEVYNETVRL

SEQ ID NO: 362454 - protein, 10 aa, Influenza virus
DFLNNTEPLC

SEQ ID NO: 362455 - protein, 10 aa, Influenza virus
FLNNTEPLCE

SEQ ID NO: 362456 - protein, 10 aa, Influenza virus
LNNTEPLCEV

SEQ ID NO: 362457 - protein, 10 aa, Influenza virus
NNTEPLCEVS

SEQ ID NO: 362458 - protein, 10 aa, Influenza virus
NTEPLCEVSG

SEQ ID NO: 362459 - protein, 10 aa, Influenza virus
TEPLCEVSGF

SEQ ID NO: 362460 - protein, 10 aa, Influenza virus
EPLCEVSGFA

SEQ ID NO: 362461 - protein, 10 aa, Influenza virus
PLCEVSGFAI

SEQ ID NO: 362462 - protein, 10 aa, Influenza virus
SGFAIISKDN

SEQ ID NO: 362463 - protein, 10 aa, Influenza virus
GFAIFSKDNG

SEQ ID NO: 362464 - protein, 10 aa, Influenza virus
FAIISKDNGI

SEQ ID NO: 362465 - protein, 10 aa, Influenza virus
AIFSKDNGIR

SEQ ID NO: 362466 - protein, 10 aa, Influenza virus
IVSKDNGIRV

SEQ ID NO: 362467 - protein, 10 aa, Influenza virus
VSKDNGIRVG

SEQ ID NO: 362468 - protein, 10 aa, Influenza virus
SKDNGIRVGS

SEQ ID NO: 362469 - protein, 10 aa, Influenza virus
KDNGIRVGSR

SEQ ID NO: 362470 - protein, 10 aa, Influenza virus
DNGIRVGSRG

SEQ ID NO: 362471 - protein, 10 aa, Influenza virus
NGIRVGSRGH

SEQ ID NO: 362472 - protein, 10 aa, Influenza virus
GIRIGSRGHI

SEQ ID NO: 362473 - protein, 10 aa, Influenza virus
IRIGSRGHIF

SEQ ID NO: 362474 - protein, 10 aa, Influenza virus
RIGSRGHIFV

SEQ ID NO: 362475 - protein, 10 aa, Influenza virus
IGSRGHIFVI

SEQ ID NO: 362476 - protein, 10 aa, Influenza virus
GSRGHIFVIR

SEQ ID NO: 362477 - protein, 10 aa, Influenza virus
SRGHIFVIRE

SEQ ID NO: 362478 - protein, 10 aa, Influenza virus
RGHIFVIREP

SEQ ID NO: 362479 - protein, 10 aa, Influenza virus
GHIFVIREPF

SEQ ID NO: 362480 - protein, 10 aa, Influenza virus
HIFVIREPFV

SEQ ID NO: 362481 - protein, 10 aa, Influenza virus
VFVIREPFVS

SEQ ID NO: 362482 - protein, 10 aa, Influenza virus
FVIREPFVSC

SEQ ID NO: 362483 - protein, 10 aa, Influenza virus
VIREPFVSCG

SEQ ID NO: 362484 - protein, 10 aa, Influenza virus
IREPFVSCGP

SEQ ID NO: 362485 - protein, 10 aa, Influenza virus
REPFVACGPS

SEQ ID NO: 362486 - protein, 10 aa, Influenza virus
EPFVACGPSE

SEQ ID NO: 362487 - protein, 10 aa, Influenza virus
PFVACGPSEC

SEQ ID NO: 362488 - protein, 10 aa, Influenza virus
FVACGPSECR

SEQ ID NO: 362489 - protein, 10 aa, Influenza virus
VACGPSECRT

SEQ ID NO: 362490 - protein, 10 aa, Influenza virus
ACGPSECRTF

SEQ ID NO: 362491 - protein, 10 aa, Influenza virus
CGPSECRTFF

SEQ ID NO: 362492 - protein, 10 aa, Influenza virus
GPSECRTFFL

SEQ ID NO: 362493 - protein, 10 aa, Influenza virus
PSECRTFFLT

SEQ ID NO: 362494 - protein, 10 aa, Influenza virus
SECRTFFLTQ

SEQ ID NO: 362495 - protein, 10 aa, Influenza virus
LTQGALLNDR

SEQ ID NO: 362496 - protein, 10 aa, Influenza virus
TPCVLLNDKH

SEQ ID NO: 362497 - protein, 10 aa, Influenza virus
QGALLNDRHS

SEQ ID NO: 362498 - protein, 10 aa, Influenza virus
GALLNDRHSN

SEQ ID NO: 362499 - protein, 10 aa, Influenza virus
VLLNDKHSNN

SEQ ID NO: 362500 - protein, 10 aa, Influenza virus
NDKHSNNTVR

SEQ ID NO: 362501 - protein, 10 aa, Influenza virus
DRHSNNTVKD

SEQ ID NO: 362502 - protein, 10 aa, Influenza virus
KHSNNTVRDR

SEQ ID NO: 362503 - protein, 10 aa, Influenza virus
PYRALMSVPM

SEQ ID NO: 362504 - protein, 10 aa, Influenza virus
YRALMSVPMG

SEQ ID NO: 362505 - protein, 10 aa, Influenza virus
RALMSVLLGS

SEQ ID NO: 362506 - protein, 10 aa, Influenza virus
ALMSVLLGSS

SEQ ID NO: 362507 - protein, 10 aa, Influenza virus
LMSVPMGSSP

SEQ ID NO: 362508 - protein, 10 aa, Influenza virus
MSVPLGSSSN

SEQ ID NO: 362509 - protein, 10 aa, Influenza virus
SVPMGSSPNA

SEQ ID NO: 362510 - protein, 10 aa, Influenza virus
VLLGSSPNAY

SEQ ID NO: 362511 - protein, 10 aa, Influenza virus
LLGSSPNAYQ

SEQ ID NO: 362512 - protein, 10 aa, Influenza virus
LGSSSNAYQA

SEQ ID NO: 362513 - protein, 10 aa, Influenza virus
GSSPNAYQAR

SEQ ID NO: 362514 - protein, 10 aa, Influenza virus
SSPNAYQARF

SEQ ID NO: 362515 - protein, 10 aa, Influenza virus
SPNAYQARFE

SEQ ID NO: 362516 - protein, 10 aa, Influenza virus
PNAYQARFES

SEQ ID NO: 362517 - protein, 10 aa, Influenza virus
NAYQARFESV

SEQ ID NO: 362518 - protein, 10 aa, Influenza virus
FESVGWSATA

SEQ ID NO: 362519 - protein, 10 aa, Influenza virus
ESVGWSATAC

SEQ ID NO: 362520 - protein, 10 aa, Influenza virus
SVGWSATACH

SEQ ID NO: 362521 - protein, 10 aa, Influenza virus
VGWSATACHD

SEQ ID NO: 362522 - protein, 10 aa, Influenza virus
GWSATACHDG

SEQ ID NO: 362523 - protein, 10 aa, Influenza virus
SATACHDGKK

SEQ ID NO: 362524 - protein, 10 aa, Influenza virus
ATACHDGKKW

SEQ ID NO: 362525 - protein, 10 aa, Influenza virus
TACHDGKKWL

SEQ ID NO: 362526 - protein, 10 aa, Influenza virus
GVSGADDDAY

SEQ ID NO: 362527 - protein, 10 aa, Influenza virus
VSGADDDAYA

SEQ ID NO: 362528 - protein, 10 aa, Influenza virus
SGADNDAYAV

SEQ ID NO: 362529 - protein, 10 aa, Influenza virus
GADNDAYAVI

SEQ ID NO: 362530 - protein, 10 aa, Influenza virus
ADNDAYAVIH

SEQ ID NO: 362531 - protein, 10 aa, Influenza virus
DNDAYAVIHY

SEQ ID NO: 362532 - protein, 10 aa, Influenza virus
NDAYAVIHYG

SEQ ID NO: 362533 - protein, 10 aa, Influenza virus
AYAVIHYGGV

SEQ ID NO: 362534 - protein, 10 aa, Influenza virus
YAVIHYGGVP

SEQ ID NO: 362535 - protein, 10 aa, Influenza virus
AVIHYGGVPT

SEQ ID NO: 362536 - protein, 10 aa, Influenza virus
VIHYGGVPTD

SEQ ID NO: 362537 - protein, 10 aa, Influenza virus
IHYGGVPTDV

SEQ ID NO: 362538 - protein, 10 aa, Influenza virus
HYGGVPTDVV

SEQ ID NO: 362539 - protein, 10 aa, Influenza virus
YGGVPTDVVR

SEQ ID NO: 362540 - protein, 10 aa, Influenza virus
GGVPTDVVRS

SEQ ID NO: 362541 - protein, 10 aa, Influenza virus
GVPTDVVRSW

SEQ ID NO: 362542 - protein, 10 aa, Influenza virus
PTDVVRSWKK

SEQ ID NO: 362543 - protein, 10 aa, Influenza virus
TDVVRSWKKQ

SEQ ID NO: 362544 - protein, 10 aa, Influenza virus
DVVRSWKKQI

SEQ ID NO: 362545 - protein, 10 aa, Influenza virus
VVRSWKKQIL

SEQ ID NO: 362546 - protein, 10 aa, Influenza virus
VRSWKKQILR

SEQ ID NO: 362547 - protein, 10 aa, Influenza virus
RSWKKQILRT

SEQ ID NO: 362548 - protein, 10 aa, Influenza virus
SWKKQILRTQ

SEQ ID NO: 362549 - protein, 10 aa, Influenza virus
WKKQILRTQE

SEQ ID NO: 362550 - protein, 10 aa, Influenza virus
KKQILRTQES

SEQ ID NO: 362551 - protein, 10 aa, Influenza virus
KKILRTQESS

SEQ ID NO: 362552 - protein, 10 aa, Influenza virus
KILRTQESSC

SEQ ID NO: 362553 - protein, 10 aa, Influenza virus
RTQESSCVCV

SEQ ID NO: 362554 - protein, 10 aa, Influenza virus
TQESSCVCMN

SEQ ID NO: 362555 - protein, 10 aa, Influenza virus
QESSCVCMNG

SEQ ID NO: 362556 - protein, 10 aa, Influenza virus
YWVMTDGPAS

SEQ ID NO: 362557 - protein, 10 aa, Influenza virus
WVMTDGPANS

SEQ ID NO: 362558 - protein, 10 aa, Influenza virus
VMTDGPANSQ

SEQ ID NO: 362559 - protein, 10 aa, Influenza virus
MTDGPANSQA

SEQ ID NO: 362560 - protein, 10 aa, Influenza virus
TDGPANSQAS

SEQ ID NO: 362561 - protein, 10 aa, Influenza virus
DGPANSQASY

SEQ ID NO: 362562 - protein, 10 aa, Influenza virus
GPANSQASYK

SEQ ID NO: 362563 - protein, 10 aa, Influenza virus
PANSQASYKI

SEQ ID NO: 362564 - protein, 10 aa, Influenza virus
ANSQASYKIF

SEQ ID NO: 362565 - protein, 10 aa, Influenza virus
NSQASYKIFK

SEQ ID NO: 362566 - protein, 10 aa, Influenza virus
SQASYKIFKS

SEQ ID NO: 362567 - protein, 10 aa, Influenza virus
QASYKIFKSQ

SEQ ID NO: 362568 - protein, 10 aa, Influenza virus
EISFQGGHIE

SEQ ID NO: 362569 - protein, 10 aa, Influenza virus
ISFQGGHIEE

SEQ ID NO: 362570 - protein, 10 aa, Influenza virus
LFQGGHIEEC

SEQ ID NO: 362571 - protein, 10 aa, Influenza virus
FQSGHIEECS

SEQ ID NO: 362572 - protein, 10 aa, Influenza virus
QSGHIEECSC

SEQ ID NO: 362573 - protein, 10 aa, Influenza virus
IEECSCYPNM

SEQ ID NO: 362574 - protein, 10 aa, Influenza virus
EECSCYPNMG

SEQ ID NO: 362575 - protein, 10 aa, Influenza virus
ECSCYPNMGK

SEQ ID NO: 362576 - protein, 10 aa, Influenza virus
CSCYPNMGKV

SEQ ID NO: 362577 - protein, 10 aa, Influenza virus
SCYPNMGKVE

SEQ ID NO: 362578 - protein, 10 aa, Influenza virus
CYPNMGKVEC

SEQ ID NO: 362579 - protein, 10 aa, Influenza virus
YPNMGKVECV

SEQ ID NO: 362580 - protein, 10 aa, Influenza virus
PNMGKVECVC

SEQ ID NO: 362581 - protein, 10 aa, Influenza virus
NMGKVECVCR

SEQ ID NO: 362582 - protein, 10 aa, Influenza virus
MGKVECVCRD

SEQ ID NO: 362583 - protein, 10 aa, Influenza virus
GQVECVCRDN

SEQ ID NO: 362584 - protein, 10 aa, Influenza virus
QVECVCRDNW

SEQ ID NO: 362585 - protein, 10 aa, Influenza virus
DNWNGMNRPV

SEQ ID NO: 362586 - protein, 10 aa, Influenza virus
NWNGMNRPVL

SEQ ID NO: 362587 - protein, 10 aa, Influenza virus
YNVGYLCAGI

SEQ ID NO: 362588 - protein, 10 aa, Influenza virus
NVGYLCAGIP

SEQ ID NO: 362589 - protein, 10 aa, Influenza virus
AGIPTDTPRI

SEQ ID NO: 362590 - protein, 10 aa, Influenza virus
GIPTDTPRIQ

SEQ ID NO: 362591 - protein, 10 aa, Influenza virus
IPTDTPRIQD

SEQ ID NO: 362592 - protein, 10 aa, Influenza virus
PTDTPRVQDN

SEQ ID NO: 362593 - protein, 10 aa, Influenza virus
AIGGSGTNNY

SEQ ID NO: 362594 - protein, 10 aa, Influenza virus
IGGSGTNNYG

SEQ ID NO: 362595 - protein, 10 aa, Influenza virus
GGSGTDNYGV

SEQ ID NO: 362596 - protein, 10 aa, Influenza virus
GSGTDNYGVK

SEQ ID NO: 362597 - protein, 10 aa, Influenza virus
SGTDNYGVKG

SEQ ID NO: 362598 - protein, 10 aa, Influenza virus
GTDNYGVKGF

SEQ ID NO: 362599 - protein, 10 aa, Influenza virus
TDNYGVKGFG

SEQ ID NO: 362600 - protein, 10 aa, Influenza virus
DNYGVKGFGF

SEQ ID NO: 362601 - protein, 10 aa, Influenza virus
VKGFGFRQGT

SEQ ID NO: 362602 - protein, 10 aa, Influenza virus
KGFGFRQGTS

SEQ ID NO: 362603 - protein, 10 aa, Influenza virus
GFGFRQGTSV

SEQ ID NO: 362604 - protein, 10 aa, Influenza virus
FGFRQGTSVW

SEQ ID NO: 362605 - protein, 10 aa, Influenza virus
GFRQGTSVWA

SEQ ID NO: 362606 - protein, 10 aa, Influenza virus
FRQGTSVWAG

SEQ ID NO: 362607 - protein, 10 aa, Influenza virus
RQGTSVWAGR

SEQ ID NO: 362608 - protein, 10 aa, Influenza virus
QGTSVWAGRT

SEQ ID NO: 362609 - protein, 10 aa, Influenza virus
GNSVWAGRTI

SEQ ID NO: 362610 - protein, 10 aa, Influenza virus
SSRSGFEVLL

SEQ ID NO: 362611 - protein, 10 aa, Influenza virus
SRSGFEVLLI

SEQ ID NO: 362612 - protein, 10 aa, Influenza virus
RSGFEVLLIE

SEQ ID NO: 362613 - protein, 10 aa, Influenza virus
SGFEVLLIED

SEQ ID NO: 362614 - protein, 10 aa, Influenza virus
GFEVLLIEDG

SEQ ID NO: 362615 - protein, 10 aa, Influenza virus
FEVLLIEDGW

SEQ ID NO: 362616 - protein, 10 aa, Influenza virus
EVLNNMNWSG

SEQ ID NO: 362617 - protein, 10 aa, Influenza virus
VLNNMNWSGY

SEQ ID NO: 362618 - protein, 10 aa, Influenza virus
LNNRNWSGYS

SEQ ID NO: 362619 - protein, 10 aa, Influenza virus
NNRNWSGYSG

SEQ ID NO: 362620 - protein, 10 aa, Influenza virus
NKNWSGYSGS

SEQ ID NO: 362621 - protein, 10 aa, Influenza virus
KNWSGYSGSF

SEQ ID NO: 362622 - protein, 10 aa, Influenza virus
NWSGYSGSFT

SEQ ID NO: 362623 - protein, 10 aa, Influenza virus
WSGYSGSFTI

SEQ ID NO: 362624 - protein, 10 aa, Influenza virus
SGYSGSFTIP

SEQ ID NO: 362625 - protein, 10 aa, Influenza virus
GYSGAFTIPT

SEQ ID NO: 362626 - protein, 10 aa, Influenza virus
CIVPCFWLEM

SEQ ID NO: 362627 - protein, 10 aa, Influenza virus
IVPCFWLEMI

SEQ ID NO: 362628 - protein, 10 aa, Influenza virus
CFWLEMIRGR

SEQ ID NO: 362629 - protein, 10 aa, Influenza virus
FWLEMIRGRP

SEQ ID NO: 362630 - protein, 10 aa, Influenza virus
WLEMIRGRPE

SEQ ID NO: 362631 - protein, 10 aa, Influenza virus
LEMIRGRPEE

SEQ ID NO: 362632 - protein, 10 aa, Influenza virus
EMIRGRPEER

SEQ ID NO: 362633 - protein, 10 aa, Influenza virus
PEEGTSIWTS

SEQ ID NO: 362634 - protein, 10 aa, Influenza virus
EEGTSIWTSS

SEQ ID NO: 362635 - protein, 10 aa, Influenza virus
EGTSIWTSSS

SEQ ID NO: 362636 - protein, 10 aa, Influenza virus
GTSIWTSSSS

SEQ ID NO: 362637 - protein, 10 aa, Influenza virus
NSIWTSSSST

SEQ ID NO: 362638 - protein, 10 aa, Influenza virus
SSTVFCGVSG

SEQ ID NO: 362639 - protein, 10 aa, Influenza virus
STVFCGVSGE

SEQ ID NO: 362640 - protein, 10 aa, Influenza virus
TVFCGVSGEV

SEQ ID NO: 362641 - protein, 10 aa, Influenza virus
VFCGVSGEVP

SEQ ID NO: 362642 - protein, 10 aa, Influenza virus
FCGVSGEVPG

SEQ ID NO: 362643 - protein, 10 aa, Influenza virus
CGVSGEVPGW

SEQ ID NO: 362644 - protein, 10 aa, Influenza virus
GVSGEVPGWS

SEQ ID NO: 362645 - protein, 10 aa, Influenza virus
VSGEVPGWSW

SEQ ID NO: 362646 - protein, 10 aa, Influenza virus
SGEVPGWSWD

SEQ ID NO: 362647 - protein, 10 aa, Influenza virus
GEVPGWSWDD

SEQ ID NO: 362648 - protein, 10 aa, Influenza virus
EVPGWSWGDG

SEQ ID NO: 362649 - protein, 10 aa, Influenza virus
VPGWSWGDGA

SEQ ID NO: 362650 - protein, 10 aa, Influenza virus
PEWSWDDGAI

SEQ ID NO: 362651 - protein, 10 aa, Influenza virus
GWSWGDGAIL

SEQ ID NO: 362652 - protein, 10 aa, Influenza virus
SWDDGAILPL

SEQ ID NO: 362653 - protein, 10 aa, Influenza virus
WGDGAILPFD

SEQ ID NO: 362654 - protein, 10 aa, Influenza virus
DDGAILPLTS

SEQ ID NO: 362655 - protein, 10 aa, Influenza virus
DGAILPFGID

SEQ ID NO: 362656 - protein, 10 aa, Influenza virus
GAILPFGIDK

SEQ ID NO: 362657 - protein, 10 aa, Influenza virus
MNPNQKITCI

SEQ ID NO: 362658 - protein, 10 aa, Influenza virus
NPNQKITCIS

SEQ ID NO: 362659 - protein, 10 aa, Influenza virus
PNQKITCISA

SEQ ID NO: 362660 - protein, 10 aa, Influenza virus
CISATGVTLS

SEQ ID NO: 362661 - protein, 10 aa, Influenza virus
ISATGVTLSV

SEQ ID NO: 362662 - protein, 10 aa, Influenza virus
SATGVTLSVV

SEQ ID NO: 362663 - protein, 10 aa, Influenza virus
TGVTLSVVSL

SEQ ID NO: 362664 - protein, 10 aa, Influenza virus
GVTLSVVSLL

SEQ ID NO: 362665 - protein, 10 aa, Influenza virus
GIANLGLNIG

SEQ ID NO: 362666 - protein, 10 aa, Influenza virus
ANLGLNIGIH

SEQ ID NO: 362667 - protein, 10 aa, Influenza virus
KPLCEVSSWH

SEQ ID NO: 362668 - protein, 10 aa, Influenza virus
PLCEVSSWHI

SEQ ID NO: 362669 - protein, 10 aa, Influenza virus
LCEVSSWHIL

SEQ ID NO: 362670 - protein, 10 aa, Influenza virus
CEVSSWHILS

SEQ ID NO: 362671 - protein, 10 aa, Influenza virus
EVSSWHILSK

SEQ ID NO: 362672 - protein, 10 aa, Influenza virus
VSSWHILSKD

SEQ ID NO: 362673 - protein, 10 aa, Influenza virus
SSWHILSKDN

SEQ ID NO: 362674 - protein, 10 aa, Influenza virus
SWHIFSKDNA

SEQ ID NO: 362675 - protein, 10 aa, Influenza virus
WHIFSKDNAI

SEQ ID NO: 362676 - protein, 10 aa, Influenza virus
HIFSKDNAIR

SEQ ID NO: 362677 - protein, 10 aa, Influenza virus
IFSKDNAIRI

SEQ ID NO: 362678 - protein, 10 aa, Influenza virus
FSKDNAIRIG

SEQ ID NO: 362679 - protein, 10 aa, Influenza virus
KDNAIRIGEN

SEQ ID NO: 362680 - protein, 10 aa, Influenza virus
DNAIRIGENA

SEQ ID NO: 362681 - protein, 10 aa, Influenza virus
NAIRIGENAH

SEQ ID NO: 362682 - protein, 10 aa, Influenza virus
NAHILVTREP

SEQ ID NO: 362683 - protein, 10 aa, Influenza virus
AHVLVTREPY

SEQ ID NO: 362684 - protein, 10 aa, Influenza virus
HVLVTREPYL

SEQ ID NO: 362685 - protein, 10 aa, Influenza virus
VLVTREPYLS

SEQ ID NO: 362686 - protein, 10 aa, Influenza virus
VTREPYLSCD

SEQ ID NO: 362687 - protein, 10 aa, Influenza virus
TREPYLSCDP

SEQ ID NO: 362688 - protein, 10 aa, Influenza virus
GCRMFALSQG

SEQ ID NO: 362689 - protein, 10 aa, Influenza virus
FALSQGTTLK

SEQ ID NO: 362690 - protein, 10 aa, Influenza virus
ALSQGTTLKG

SEQ ID NO: 362691 - protein, 10 aa, Influenza virus
LSQGTTLRGQ

SEQ ID NO: 362692 - protein, 10 aa, Influenza virus
SQGTTLRGQH

SEQ ID NO: 362693 - protein, 10 aa, Influenza virus
QGTTLRGQHA

SEQ ID NO: 362694 - protein, 10 aa, Influenza virus
GTTLRGQHAN

SEQ ID NO: 362695 - protein, 10 aa, Influenza virus
TTLRGQHANG

SEQ ID NO: 362696 - protein, 10 aa, Influenza virus
TLRGQHANGT

SEQ ID NO: 362697 - protein, 10 aa, Influenza virus
LRGQHANGTI

SEQ ID NO: 362698 - protein, 10 aa, Influenza virus
RGQHANGTIH

SEQ ID NO: 362699 - protein, 10 aa, Influenza virus
GQHANGTIHD

SEQ ID NO: 362700 - protein, 10 aa, Influenza virus
QHANGTIHDR

SEQ ID NO: 362701 - protein, 10 aa, Influenza virus
HANGTMHDRS

SEQ ID NO: 362702 - protein, 10 aa, Influenza virus
ANGTIHDRSQ

SEQ ID NO: 362703 - protein, 10 aa, Influenza virus
NGTIHDRSQF

SEQ ID NO: 362704 - protein, 10 aa, Influenza virus
GTIHDRSQFR

SEQ ID NO: 362705 - protein, 10 aa, Influenza virus
TIHDRSQFRA

SEQ ID NO: 362706 - protein, 10 aa, Influenza virus
IHDRSQFRAL

SEQ ID NO: 362707 - protein, 10 aa, Influenza virus
HDRSPFRALV

SEQ ID NO: 362708 - protein, 10 aa, Influenza virus
DRSPFRALVS

SEQ ID NO: 362709 - protein, 10 aa, Influenza virus
RSPFRALVSW

SEQ ID NO: 362710 - protein, 10 aa, Influenza virus
SPFRALVSWE

SEQ ID NO: 362711 - protein, 10 aa, Influenza virus
PFRALVSWEM

SEQ ID NO: 362712 - protein, 10 aa, Influenza virus
FRALVSWEMG

SEQ ID NO: 362713 - protein, 10 aa, Influenza virus
RALVSWEMGQ

SEQ ID NO: 362714 - protein, 10 aa, Influenza virus
ALVSWEMGQA

SEQ ID NO: 362715 - protein, 10 aa, Influenza virus
LVSWEMGQAP

SEQ ID NO: 362716 - protein, 10 aa, Influenza virus
VSWEMGQAPS

SEQ ID NO: 362717 - protein, 10 aa, Influenza virus
SWGMGQAPSP

SEQ ID NO: 362718 - protein, 10 aa, Influenza virus
WGMGQAPSPY

SEQ ID NO: 362719 - protein, 10 aa, Influenza virus
GMGQAPSPYN

SEQ ID NO: 362720 - protein, 10 aa, Influenza virus
VECIGWSSTS

SEQ ID NO: 362721 - protein, 10 aa, Influenza virus
ECIGWSSTSC

SEQ ID NO: 362722 - protein, 10 aa, Influenza virus
CIGWSSTSCH

SEQ ID NO: 362723 - protein, 10 aa, Influenza virus
IGWSSTSCHD

SEQ ID NO: 362724 - protein, 10 aa, Influenza virus
WSSTSCHDGM

SEQ ID NO: 362725 - protein, 10 aa, Influenza virus
SSTSCHDGMS

SEQ ID NO: 362726 - protein, 10 aa, Influenza virus
STSCHDGMSR

SEQ ID NO: 362727 - protein, 10 aa, Influenza virus
TSCHDGMSRM

SEQ ID NO: 362728 - protein, 10 aa, Influenza virus
SCHDGMSRMS

SEQ ID NO: 362729 - protein, 10 aa, Influenza virus
SRMSICISGP

SEQ ID NO: 362730 - protein, 10 aa, Influenza virus
RMSICISGPN

SEQ ID NO: 362731 - protein, 10 aa, Influenza virus
MSICISGPNN

SEQ ID NO: 362732 - protein, 10 aa, Influenza virus
SICISGPNNN

SEQ ID NO: 362733 - protein, 10 aa, Influenza virus
ICISGPNNNA

SEQ ID NO: 362734 - protein, 10 aa, Influenza virus
CISGPNNNAS

SEQ ID NO: 362735 - protein, 10 aa, Influenza virus
ISGPNNNASA

SEQ ID NO: 362736 - protein, 10 aa, Influenza virus
SGPNDNASAV

SEQ ID NO: 362737 - protein, 10 aa, Influenza virus
GPNDNASAVV

SEQ ID NO: 362738 - protein, 10 aa, Influenza virus
PNDNASAVVW

SEQ ID NO: 362739 - protein, 10 aa, Influenza virus
NDNASAVVWY

SEQ ID NO: 362740 - protein, 10 aa, Influenza virus
TEIPSWAGNI

SEQ ID NO: 362741 - protein, 10 aa, Influenza virus
EIPSWAGNIL

SEQ ID NO: 362742 - protein, 10 aa, Influenza virus
IPSWAGNILR

SEQ ID NO: 362743 - protein, 10 aa, Influenza virus
PSWAGNILRT

SEQ ID NO: 362744 - protein, 10 aa, Influenza virus
SWEGNILRTQ

SEQ ID NO: 362745 - protein, 10 aa, Influenza virus
WEGNILRTQE

SEQ ID NO: 362746 - protein, 10 aa, Influenza virus
EGNILRTQES

SEQ ID NO: 362747 - protein, 10 aa, Influenza virus
TQESECVCHK

SEQ ID NO: 362748 - protein, 10 aa, Influenza virus
QESECVCHKG

SEQ ID NO: 362749 - protein, 10 aa, Influenza virus
ESECVCHKGI

SEQ ID NO: 362750 - protein, 10 aa, Influenza virus
SECVCHKGIC

SEQ ID NO: 362751 - protein, 10 aa, Influenza virus
ECVCHKGICP

SEQ ID NO: 362752 - protein, 10 aa, Influenza virus
CVCHKGICPV

SEQ ID NO: 362753 - protein, 10 aa, Influenza virus
VCHKGICPVV

SEQ ID NO: 362754 - protein, 10 aa, Influenza virus
GVCPVVMTDG

SEQ ID NO: 362755 - protein, 10 aa, Influenza virus
VCPVVMTDGP

SEQ ID NO: 362756 - protein, 10 aa, Influenza virus
PVVMTDGPAS

SEQ ID NO: 362757 - protein, 10 aa, Influenza virus
GNAQHIEECS

SEQ ID NO: 362758 - protein, 10 aa, Influenza virus
NAQHIEECSC

SEQ ID NO: 362759 - protein, 10 aa, Influenza virus
HIEECSCYGS

SEQ ID NO: 362760 - protein, 10 aa, Influenza virus
VKCICRDNWK

SEQ ID NO: 362761 - protein, 10 aa, Influenza virus
KCVCRDNWKG

SEQ ID NO: 362762 - protein, 10 aa, Influenza virus
CVCRDNWKGA

SEQ ID NO: 362763 - protein, 10 aa, Influenza virus
VCRDNWKGAN

SEQ ID NO: 362764 - protein, 10 aa, Influenza virus
CRDNWRGANR

SEQ ID NO: 362765 - protein, 10 aa, Influenza virus
RDNWRGANRP

SEQ ID NO: 362766 - protein, 10 aa, Influenza virus
DNWKGANRPI

SEQ ID NO: 362767 - protein, 10 aa, Influenza virus
NWKGANRPII

SEQ ID NO: 362768 - protein, 10 aa, Influenza virus
WKGANRPIIT

SEQ ID NO: 362769 - protein, 10 aa, Influenza virus
KGANRPIITI

SEQ ID NO: 362770 - protein, 10 aa, Influenza virus
GANRPVITID

SEQ ID NO: 362771 - protein, 10 aa, Influenza virus
MTHMSKYLCS

SEQ ID NO: 362772 - protein, 10 aa, Influenza virus
YLCSKVLTDT

SEQ ID NO: 362773 - protein, 10 aa, Influenza virus
LCSKVLTDTS

SEQ ID NO: 362774 - protein, 10 aa, Influenza virus
CSKVLTDTSR

SEQ ID NO: 362775 - protein, 10 aa, Influenza virus
SKVLTDTSRP

SEQ ID NO: 362776 - protein, 10 aa, Influenza virus
LTDTSRPSDP

SEQ ID NO: 362777 - protein, 10 aa, Influenza virus
GGGPDPGVKG

SEQ ID NO: 362778 - protein, 10 aa, Influenza virus
GGPDPGVKGF

SEQ ID NO: 362779 - protein, 10 aa, Influenza virus
GPDPGVKGFA

SEQ ID NO: 362780 - protein, 10 aa, Influenza virus
PGVKGFAFLN

SEQ ID NO: 362781 - protein, 10 aa, Influenza virus
GVKGFAFLNG

SEQ ID NO: 362782 - protein, 10 aa, Influenza virus
NSWLGRTTSK

SEQ ID NO: 362783 - protein, 10 aa, Influenza virus
SWLGRTTSKD

SEQ ID NO: 362784 - protein, 10 aa, Influenza virus
WLGRTTSKDS

SEQ ID NO: 362785 - protein, 10 aa, Influenza virus
LGRTTSKDSR

SEQ ID NO: 362786 - protein, 10 aa, Influenza virus
GRTTSKDSRS

SEQ ID NO: 362787 - protein, 10 aa, Influenza virus
RTTSKDSRSG

SEQ ID NO: 362788 - protein, 10 aa, Influenza virus
TTSKDSRSGY

SEQ ID NO: 362789 - protein, 10 aa, Influenza virus
TSKDSRSGYE

SEQ ID NO: 362790 - protein, 10 aa, Influenza virus
DSRSGYEVLK

SEQ ID NO: 362791 - protein, 10 aa, Influenza virus
SRSGYEVLKV

SEQ ID NO: 362792 - protein, 10 aa, Influenza virus
RSGYEVLKVP

SEQ ID NO: 362793 - protein, 10 aa, Influenza virus
SGYEVLKVPN

SEQ ID NO: 362794 - protein, 10 aa, Influenza virus
GYEVLKVPNA

SEQ ID NO: 362795 - protein, 10 aa, Influenza virus
YEVLKVPNAE

SEQ ID NO: 362796 - protein, 10 aa, Influenza virus
IVNNQDWSGY

SEQ ID NO: 362797 - protein, 10 aa, Influenza virus
VNNQDWSGYS

SEQ ID NO: 362798 - protein, 10 aa, Influenza virus
NNQDWSGYSG

SEQ ID NO: 362799 - protein, 10 aa, Influenza virus
NQNWSGYSGS

SEQ ID NO: 362800 - protein, 10 aa, Influenza virus
QNWSGYSGSF

SEQ ID NO: 362801 - protein, 10 aa, Influenza virus
NWSGYSGSFI

SEQ ID NO: 362802 - protein, 10 aa, Influenza virus
WSGYSGSFID

SEQ ID NO: 362803 - protein, 10 aa, Influenza virus
SGYSGSFIDY

SEQ ID NO: 362804 - protein, 10 aa, Influenza virus
GYSGSFIDYW

SEQ ID NO: 362805 - protein, 10 aa, Influenza virus
KECFNPCFYV

SEQ ID NO: 362806 - protein, 10 aa, Influenza virus
KCFNPCFYVE

SEQ ID NO: 362807 - protein, 10 aa, Influenza virus
CFYVELIRGM

SEQ ID NO: 362808 - protein, 10 aa, Influenza virus
FYVELIRGMP

SEQ ID NO: 362809 - protein, 10 aa, Influenza virus
YVELIRGMPK

SEQ ID NO: 362810 - protein, 10 aa, Influenza virus
VELIRGMPKE

SEQ ID NO: 362811 - protein, 10 aa, Influenza virus
ELIRGRPKEN

SEQ ID NO: 362812 - protein, 10 aa, Influenza virus
VFWTSNSIVA

SEQ ID NO: 362813 - protein, 10 aa, Influenza virus
FWTSNSIVAL

SEQ ID NO: 362814 - protein, 10 aa, Influenza virus
NSIVALCGSR

SEQ ID NO: 362815 - protein, 10 aa, Influenza virus
SIVALCGSRE

SEQ ID NO: 362816 - protein, 10 aa, Influenza virus
IVALCGSRER

SEQ ID NO: 362817 - protein, 10 aa, Influenza virus
VALCGSRERL

SEQ ID NO: 362818 - protein, 10 aa, Influenza virus
ALCGSRERLG

SEQ ID NO: 362819 - protein, 10 aa, Influenza virus
LCGSRERLGS

SEQ ID NO: 362820 - protein, 10 aa, Influenza virus
CGSRERLGSW

SEQ ID NO: 362821 - protein, 10 aa, Influenza virus
GSRERLGSWS

SEQ ID NO: 362822 - protein, 10 aa, Influenza virus
SRERLGSWSW

SEQ ID NO: 362823 - protein, 10 aa, Influenza virus
RERLGSWSWH

SEQ ID NO: 362824 - protein, 10 aa, Influenza virus
EQLGSWSWHD

SEQ ID NO: 362825 - protein, 10 aa, Influenza virus
QLGSWSWHDG

SEQ ID NO: 362826 - protein, 10 aa, Influenza virus
WSWHDGAEIT

SEQ ID NO: 362827 - protein, 10 aa, Influenza virus
SWHDGAEITY

SEQ ID NO: 362828 - protein, 10 aa, Influenza virus
WHDGAEITYF

SEQ ID NO: 362829 - protein, 10 aa, Influenza virus
HDGAEITYFK

SEQ ID NO: 362830 - protein, 10 aa, Influenza virus
MNPNQKLFAS

SEQ ID NO: 362831 - protein, 10 aa, Influenza virus
NPNQKLFASS

SEQ ID NO: 362832 - protein, 10 aa, Influenza virus
PNQKLFASSG

SEQ ID NO: 362833 - protein, 10 aa, Influenza virus
NQKLFASSGI

SEQ ID NO: 362834 - protein, 10 aa, Influenza virus
QKLFASSGIA

SEQ ID NO: 362835 - protein, 10 aa, Influenza virus
KLFASSGIAI

SEQ ID NO: 362836 - protein, 10 aa, Influenza virus
NLIIGISNVG

SEQ ID NO: 362837 - protein, 10 aa, Influenza virus
LIIGISNVGL

SEQ ID NO: 362838 - protein, 10 aa, Influenza virus
IIGISNVGLN

SEQ ID NO: 362839 - protein, 10 aa, Influenza virus
SNMSLNISLY

SEQ ID NO: 362840 - protein, 10 aa, Influenza virus
NMSLNISLYS

SEQ ID NO: 362841 - protein, 10 aa, Influenza virus
ENTYVNNTTI

SEQ ID NO: 362842 - protein, 10 aa, Influenza virus
NTYVNNTTII

SEQ ID NO: 362843 - protein, 10 aa, Influenza virus
YLLLNKSLCN

SEQ ID NO: 362844 - protein, 10 aa, Influenza virus
LLLNKSLCNV

SEQ ID NO: 362845 - protein, 10 aa, Influenza virus
GWVVIAKDNA

SEQ ID NO: 362846 - protein, 10 aa, Influenza virus
WVVIAKDNAV

SEQ ID NO: 362847 - protein, 10 aa, Influenza virus
VVIAKDNAVR

SEQ ID NO: 362848 - protein, 10 aa, Influenza virus
VIAKDNAVRF

SEQ ID NO: 362849 - protein, 10 aa, Influenza virus
IAKDNAVRFG

SEQ ID NO: 362850 - protein, 10 aa, Influenza virus
AKDNAVRFGE

SEQ ID NO: 362851 - protein, 10 aa, Influenza virus
KDNAVRFGES

SEQ ID NO: 362852 - protein, 10 aa, Influenza virus
DNAVRFGESE

SEQ ID NO: 362853 - protein, 10 aa, Influenza virus
NAVRFGESEQ

SEQ ID NO: 362854 - protein, 10 aa, Influenza virus
AVRFGESEQI

SEQ ID NO: 362855 - protein, 10 aa, Influenza virus
VRFGESEQII

SEQ ID NO: 362856 - protein, 10 aa, Influenza virus
RFGESEQVIV

SEQ ID NO: 362857 - protein, 10 aa, Influenza virus
FGESEQVIVT

SEQ ID NO: 362858 - protein, 10 aa, Influenza virus
GESEQVIVTR

SEQ ID NO: 362859 - protein, 10 aa, Influenza virus
ESEQVIVTRE

SEQ ID NO: 362860 - protein, 10 aa, Influenza virus
SEQVIVTREP

SEQ ID NO: 362861 - protein, 10 aa, Influenza virus
EQVIVTREPY

SEQ ID NO: 362862 - protein, 10 aa, Influenza virus
QVIVTREPYV

SEQ ID NO: 362863 - protein, 10 aa, Influenza virus
VIVTREPYVS

SEQ ID NO: 362864 - protein, 10 aa, Influenza virus
REPYVSCDPT

SEQ ID NO: 362865 - protein, 10 aa, Influenza virus
GCRMYALHQG

SEQ ID NO: 362866 - protein, 10 aa, Influenza virus
CRMYALHQGT

SEQ ID NO: 362867 - protein, 10 aa, Influenza virus
RMYALHQGTT

SEQ ID NO: 362868 - protein, 10 aa, Influenza virus
LHQGTTIRNR

SEQ ID NO: 362869 - protein, 10 aa, Influenza virus
HQGTTIRNRH

SEQ ID NO: 362870 - protein, 10 aa, Influenza virus
QGTTIRNRHS

SEQ ID NO: 362871 - protein, 10 aa, Influenza virus
GTTIRNRHSN

SEQ ID NO: 362872 - protein, 10 aa, Influenza virus
TTIRNKHSNS

SEQ ID NO: 362873 - protein, 10 aa, Influenza virus
TIRNKHSNST

SEQ ID NO: 362874 - protein, 10 aa, Influenza virus
IRNKHSNSTT

SEQ ID NO: 362875 - protein, 10 aa, Influenza virus
RNKHSNSTTH

SEQ ID NO: 362876 - protein, 10 aa, Influenza virus
NKHSNSTTHD

SEQ ID NO: 362877 - protein, 10 aa, Influenza virus
KHSNSTTHDR

SEQ ID NO: 362878 - protein, 10 aa, Influenza virus
HSNSTTHDRT

SEQ ID NO: 362879 - protein, 10 aa, Influenza virus
TTHDRTAFRG

SEQ ID NO: 362880 - protein, 10 aa, Influenza virus
THDRTAFRGL

SEQ ID NO: 362881 - protein, 10 aa, Influenza virus
DRTAFRGLMS

SEQ ID NO: 362882 - protein, 10 aa, Influenza virus
RTAFRGLMST

SEQ ID NO: 362883 - protein, 10 aa, Influenza virus
AFRGLISTHL

SEQ ID NO: 362884 - protein, 10 aa, Influenza virus
FRGLMSTPLG

SEQ ID NO: 362885 - protein, 10 aa, Influenza virus
SNSDFMCVGW

SEQ ID NO: 362886 - protein, 10 aa, Influenza virus
NSDFMCVGWS

SEQ ID NO: 362887 - protein, 10 aa, Influenza virus
SDFMCVGWSS

SEQ ID NO: 362888 - protein, 10 aa, Influenza virus
DFMCVGWSST

SEQ ID NO: 362889 - protein, 10 aa, Influenza virus
FMCVGWSSTT

SEQ ID NO: 362890 - protein, 10 aa, Influenza virus
MCVGWSSTTC

SEQ ID NO: 362891 - protein, 10 aa, Influenza virus
CVGWSSTTCH

SEQ ID NO: 362892 - protein, 10 aa, Influenza virus
VGWSSTTCHD

SEQ ID NO: 362893 - protein, 10 aa, Influenza virus
GWSSTTCHDG

SEQ ID NO: 362894 - protein, 10 aa, Influenza virus
WSSTTCHDGI

SEQ ID NO: 362895 - protein, 10 aa, Influenza virus
CHDGVGRMTI

SEQ ID NO: 362896 - protein, 10 aa, Influenza virus
HDGVGRMTIC

SEQ ID NO: 362897 - protein, 10 aa, Influenza virus
RMTICIQGNN

SEQ ID NO: 362898 - protein, 10 aa, Influenza virus
QGNNNNATAT

SEQ ID NO: 362899 - protein, 10 aa, Influenza virus
GNNNNATATV

SEQ ID NO: 362900 - protein, 10 aa, Influenza virus
NNNNATATVY

SEQ ID NO: 362901 - protein, 10 aa, Influenza virus
NNNATATVYY

SEQ ID NO: 362902 - protein, 10 aa, Influenza virus
DNATATVYYN

SEQ ID NO: 362903 - protein, 10 aa, Influenza virus
NATATVYYNR

SEQ ID NO: 362904 - protein, 10 aa, Influenza virus
ATATVYYNRR

SEQ ID NO: 362905 - protein, 10 aa, Influenza virus
TATVYYNRRL

SEQ ID NO: 362906 - protein, 10 aa, Influenza virus
ATVYYNRRLT

SEQ ID NO: 362907 - protein, 10 aa, Influenza virus
TVYYNRRLTT

SEQ ID NO: 362908 - protein, 10 aa, Influenza virus
VYYNRRLTTT

SEQ ID NO: 362909 - protein, 10 aa, Influenza virus
YYNRRLTTTI

SEQ ID NO: 362910 - protein, 10 aa, Influenza virus
KRLTTTIKTW

SEQ ID NO: 362911 - protein, 10 aa, Influenza virus
RLTTTIKPWA

SEQ ID NO: 362912 - protein, 10 aa, Influenza virus
LTTTIKTWAR

SEQ ID NO: 362913 - protein, 10 aa, Influenza virus
TTTIKTWARN

SEQ ID NO: 362914 - protein, 10 aa, Influenza virus
TTIKTWARNI

SEQ ID NO: 362915 - protein, 10 aa, Influenza virus
TIKTWARNIL

SEQ ID NO: 362916 - protein, 10 aa, Influenza virus
IKTWARNILR

SEQ ID NO: 362917 - protein, 10 aa, Influenza virus
KTWARNILRT

SEQ ID NO: 362918 - protein, 10 aa, Influenza virus
TWARNILRTQ

SEQ ID NO: 362919 - protein, 10 aa, Influenza virus
WARNILRTQE

SEQ ID NO: 362920 - protein, 10 aa, Influenza virus
ARNILRTQES

SEQ ID NO: 362921 - protein, 10 aa, Influenza virus
RNILRTQESE

SEQ ID NO: 362922 - protein, 10 aa, Influenza virus
KILRTQESEC

SEQ ID NO: 362923 - protein, 10 aa, Influenza virus
TQESECVCHD

SEQ ID NO: 362924 - protein, 10 aa, Influenza virus
QESECVCHNS

SEQ ID NO: 362925 - protein, 10 aa, Influenza virus
ESECVCHNST

SEQ ID NO: 362926 - protein, 10 aa, Influenza virus
SECVCHNSTC

SEQ ID NO: 362927 - protein, 10 aa, Influenza virus
ECVCHNGTCA

SEQ ID NO: 362928 - protein, 10 aa, Influenza virus
GTCAVVMTDG

SEQ ID NO: 362929 - protein, 10 aa, Influenza virus
MTDGPANNQA

SEQ ID NO: 362930 - protein, 10 aa, Influenza virus
LKGSAKHIEE

SEQ ID NO: 362931 - protein, 10 aa, Influenza virus
KGSAKHIEEC

SEQ ID NO: 362932 - protein, 10 aa, Influenza virus
GSAKHIEECS

SEQ ID NO: 362933 - protein, 10 aa, Influenza virus
SAKHIEECSC

SEQ ID NO: 362934 - protein, 10 aa, Influenza virus
AKHIEECSCY

SEQ ID NO: 362935 - protein, 10 aa, Influenza virus
KHIEECSCYG

SEQ ID NO: 362936 - protein, 10 aa, Influenza virus
HVEECSCYGH

SEQ ID NO: 362937 - protein, 10 aa, Influenza virus
IEECSCYGHS

SEQ ID NO: 362938 - protein, 10 aa, Influenza virus
RVTCVCRDNW

SEQ ID NO: 362939 - protein, 10 aa, Influenza virus
ATCVCRDNWQ

SEQ ID NO: 362940 - protein, 10 aa, Influenza virus
SCVCRDNWQG

SEQ ID NO: 362941 - protein, 10 aa, Influenza virus
CGCRDNWQGA

SEQ ID NO: 362942 - protein, 10 aa, Influenza virus
ICRDNWQGAN

SEQ ID NO: 362943 - protein, 10 aa, Influenza virus
DNWQGANRPI

SEQ ID NO: 362944 - protein, 10 aa, Influenza virus
NWQGANRPII

SEQ ID NO: 362945 - protein, 10 aa, Influenza virus
WQGANRPIIE

SEQ ID NO: 362946 - protein, 10 aa, Influenza virus
QGANRPIIEI

SEQ ID NO: 362947 - protein, 10 aa, Influenza virus
GANRPIIEID

SEQ ID NO: 362948 - protein, 10 aa, Influenza virus
ANRPIIEIDM

SEQ ID NO: 362949 - protein, 10 aa, Influenza virus
CTGILTDTSR

SEQ ID NO: 362950 - protein, 10 aa, Influenza virus
TGILTDTSRP

SEQ ID NO: 362951 - protein, 10 aa, Influenza virus
GILTDTSRPG

SEQ ID NO: 362952 - protein, 10 aa, Influenza virus
ILTDTSRPGD

SEQ ID NO: 362953 - protein, 10 aa, Influenza virus
LTDTSRPGDK

SEQ ID NO: 362954 - protein, 10 aa, Influenza virus
GDCSNPITGS

SEQ ID NO: 362955 - protein, 10 aa, Influenza virus
DCSNPITGSP

SEQ ID NO: 362956 - protein, 10 aa, Influenza virus
CSNPITGSPG

SEQ ID NO: 362957 - protein, 10 aa, Influenza virus
NPITGSPSAP

SEQ ID NO: 362958 - protein, 10 aa, Influenza virus
PITGSPSAPG

SEQ ID NO: 362959 - protein, 10 aa, Influenza virus
APGIKGFGFL

SEQ ID NO: 362960 - protein, 10 aa, Influenza virus
PGVKGFGFLN

SEQ ID NO: 362961 - protein, 10 aa, Influenza virus
DNTWLGRTIS

SEQ ID NO: 362962 - protein, 10 aa, Influenza virus
NTWLGRTFSP

SEQ ID NO: 362963 - protein, 10 aa, Influenza virus
TWLGRTISPK

SEQ ID NO: 362964 - protein, 10 aa, Influenza virus
WLGRTISPRL

SEQ ID NO: 362965 - protein, 10 aa, Influenza virus
LGRTISPKLR

SEQ ID NO: 362966 - protein, 10 aa, Influenza virus
TISPRLRSGF

SEQ ID NO: 362967 - protein, 10 aa, Influenza virus
ISPRLRSGFE

SEQ ID NO: 362968 - protein, 10 aa, Influenza virus
SPKLRSGFEM

SEQ ID NO: 362969 - protein, 10 aa, Influenza virus
PRLRSGFEML

SEQ ID NO: 362970 - protein, 10 aa, Influenza virus
RLRSGFEMLK

SEQ ID NO: 362971 - protein, 10 aa, Influenza virus
LRSGFEMLKI

SEQ ID NO: 362972 - protein, 10 aa, Influenza virus
RSGFEMLKVP

SEQ ID NO: 362973 - protein, 10 aa, Influenza virus
SGFEMLKVPN

SEQ ID NO: 362974 - protein, 10 aa, Influenza virus
GFEMLKVPNA

SEQ ID NO: 362975 - protein, 10 aa, Influenza virus
FEMLKIPNAE

SEQ ID NO: 362976 - protein, 10 aa, Influenza virus
LKIPNAETDP

SEQ ID NO: 362977 - protein, 10 aa, Influenza virus
NRSGYSGSFI

SEQ ID NO: 362978 - protein, 10 aa, Influenza virus
YSGSFIDYWN

SEQ ID NO: 362979 - protein, 10 aa, Influenza virus
SGSFIDYWND

SEQ ID NO: 362980 - protein, 10 aa, Influenza virus
NECYNPCFYV

SEQ ID NO: 362981 - protein, 10 aa, Influenza virus
VCYNPCFYVE

SEQ ID NO: 362982 - protein, 10 aa, Influenza virus
IRGRPEEVKY

SEQ ID NO: 362983 - protein, 10 aa, Influenza virus
RGRPEEVKYV

SEQ ID NO: 362984 - protein, 10 aa, Influenza virus
GRPEEAKYVE

SEQ ID NO: 362985 - protein, 10 aa, Influenza virus
RPEEAKYVEW

SEQ ID NO: 362986 - protein, 10 aa, Influenza virus
PEEAKYVEWT

SEQ ID NO: 362987 - protein, 10 aa, Influenza virus
EEAKYVEWTS

SEQ ID NO: 362988 - protein, 10 aa, Influenza virus
EAKYVEWTSN

SEQ ID NO: 362989 - protein, 10 aa, Influenza virus
AKYVEWTSNS

SEQ ID NO: 362990 - protein, 10 aa, Influenza virus
KYVEWTSNSL

SEQ ID NO: 362991 - protein, 10 aa, Influenza virus
YVWWTSNSLI

SEQ ID NO: 362992 - protein, 10 aa, Influenza virus
VWWTSNSLIA

SEQ ID NO: 362993 - protein, 10 aa, Influenza virus
WWTSNSLIAL

SEQ ID NO: 362994 - protein, 10 aa, Influenza virus
WTSNSLIALC

SEQ ID NO: 362995 - protein, 10 aa, Influenza virus
TSNSLIALCG

SEQ ID NO: 362996 - protein, 10 aa, Influenza virus
SNSLIALCGS

SEQ ID NO: 362997 - protein, 10 aa, Influenza virus
NSLIALCGSP

SEQ ID NO: 362998 - protein, 10 aa, Influenza virus
SLVALCGSPV

SEQ ID NO: 362999 - protein, 10 aa, Influenza virus
PVGSGSFPDG

SEQ ID NO: 363000 - protein, 10 aa, Influenza virus
VGPGSFPDGA

SEQ ID NO: 363001 - protein, 10 aa, Influenza virus
GPGSFPDGAQ

SEQ ID NO: 363002 - protein, 10 aa, Influenza virus
PGSFPDGAQI

SEQ ID NO: 363003 - protein, 10 aa, Influenza virus
GSFPDGAQIK

SEQ ID NO: 363004 - protein, 10 aa, Influenza virus
SFPDGAQIKY

SEQ ID NO: 363005 - protein, 10 aa, Influenza virus
FPDGAQIKYF

SEQ ID NO: 363006 - protein, 10 aa, Influenza virus
PDGAQIKYFS

SEQ ID NO: 363007 - protein, 10 aa, Influenza virus
QGFAPFSKDN

SEQ ID NO: 363008 - protein, 10 aa, Influenza virus
FAPYSKDNGI

SEQ ID NO: 363009 - protein, 10 aa, Influenza virus
KDNGIRIGSK

SEQ ID NO: 363010 - protein, 10 aa, Influenza virus
DNGIRIGSKG

SEQ ID NO: 363011 - protein, 10 aa, Influenza virus
NGIRIGSKGH

SEQ ID NO: 363012 - protein, 10 aa, Influenza virus
GIRIGSRGHI

SEQ ID NO: 363013 - protein, 10 aa, Influenza virus
IRIGSRGHIF

SEQ ID NO: 363014 - protein, 10 aa, Influenza virus
RIGSRGHIFV

SEQ ID NO: 363015 - protein, 10 aa, Influenza virus
IGSRGHIFVI

SEQ ID NO: 363016 - protein, 10 aa, Influenza virus
GSRGHIFVIR

SEQ ID NO: 363017 - protein, 10 aa, Influenza virus
SRGHIFVIRE

SEQ ID NO: 363018 - protein, 10 aa, Influenza virus
RGHIFVIREP

SEQ ID NO: 363019 - protein, 10 aa, Influenza virus
GHIFVIREPF

SEQ ID NO: 363020 - protein, 10 aa, Influenza virus
HIFVIREPFV

SEQ ID NO: 363021 - protein, 10 aa, Influenza virus
IFVIREPFVS

SEQ ID NO: 363022 - protein, 10 aa, Influenza virus
FIIREPFVSC

SEQ ID NO: 363023 - protein, 10 aa, Influenza virus
IIREPFVSCS

SEQ ID NO: 363024 - protein, 10 aa, Influenza virus
GCRTFFLTQG

SEQ ID NO: 363025 - protein, 10 aa, Influenza virus
CRTFFLTHGS

SEQ ID NO: 363026 - protein, 10 aa, Influenza virus
RTFFLTHGSL

SEQ ID NO: 363027 - protein, 10 aa, Influenza virus
TFFLTHGSLL

SEQ ID NO: 363028 - protein, 10 aa, Influenza virus
FFLTHGSLLN

SEQ ID NO: 363029 - protein, 10 aa, Influenza virus
FLTHGSLLND

SEQ ID NO: 363030 - protein, 10 aa, Influenza virus
LTQGSLLNDR

SEQ ID NO: 363031 - protein, 10 aa, Influenza virus
TQGSLLNDRH

SEQ ID NO: 363032 - protein, 10 aa, Influenza virus
QGSLLNDRHS

SEQ ID NO: 363033 - protein, 10 aa, Influenza virus
GSLLNDRHSN

SEQ ID NO: 363034 - protein, 10 aa, Influenza virus
SLLNDRHSNG

SEQ ID NO: 363035 - protein, 10 aa, Influenza virus
LLNDRHSNGT

SEQ ID NO: 363036 - protein, 10 aa, Influenza virus
NDKHSNGTIK

SEQ ID NO: 363037 - protein, 10 aa, Influenza virus
DKHSNGTIKD

SEQ ID NO: 363038 - protein, 10 aa, Influenza virus
KHSNGTIKDR

SEQ ID NO: 363039 - protein, 10 aa, Influenza virus
HSNGTIKDRS

SEQ ID NO: 363040 - protein, 10 aa, Influenza virus
SNGTIKDRSP

SEQ ID NO: 363041 - protein, 10 aa, Influenza virus
NGTVKDRSPF

SEQ ID NO: 363042 - protein, 10 aa, Influenza virus
GTVKDRSPFR

SEQ ID NO: 363043 - protein, 10 aa, Influenza virus
TVKDRSPFRT

SEQ ID NO: 363044 - protein, 10 aa, Influenza virus
VKDRSPFRTL

SEQ ID NO: 363045 - protein, 10 aa, Influenza virus
KDRSPFRTLM

SEQ ID NO: 363046 - protein, 10 aa, Influenza virus
DRSPFRTLMS

SEQ ID NO: 363047 - protein, 10 aa, Influenza virus
RSPFRTLMSV

SEQ ID NO: 363048 - protein, 10 aa, Influenza virus
SPYRTLMSVK

SEQ ID NO: 363049 - protein, 10 aa, Influenza virus
RTLMSVKIGQ

SEQ ID NO: 363050 - protein, 10 aa, Influenza virus
VGQSPNVYQA

SEQ ID NO: 363051 - protein, 10 aa, Influenza virus
GQSPNVYQAK

SEQ ID NO: 363052 - protein, 10 aa, Influenza virus
QSPNVYQAKF

SEQ ID NO: 363053 - protein, 10 aa, Influenza virus
SPNVYQAKFE

SEQ ID NO: 363054 - protein, 10 aa, Influenza virus
PNVYQARFES

SEQ ID NO: 363055 - protein, 10 aa, Influenza virus
NVYQARFESV

SEQ ID NO: 363056 - protein, 10 aa, Influenza virus
VYQARFESVA

SEQ ID NO: 363057 - protein, 10 aa, Influenza virus
YQARFESVAW

SEQ ID NO: 363058 - protein, 10 aa, Influenza virus
QARFESVAWS

SEQ ID NO: 363059 - protein, 10 aa, Influenza virus
ARFESVAWSA

SEQ ID NO: 363060 - protein, 10 aa, Influenza virus
RFESVAWSAT

SEQ ID NO: 363061 - protein, 10 aa, Influenza virus
FESVAWSATA

SEQ ID NO: 363062 - protein, 10 aa, Influenza virus
ESVAWSATAC

SEQ ID NO: 363063 - protein, 10 aa, Influenza virus
SVAWSATACH

SEQ ID NO: 363064 - protein, 10 aa, Influenza virus
WSATACHDGR

SEQ ID NO: 363065 - protein, 10 aa, Influenza virus
SATACHDGRK

SEQ ID NO: 363066 - protein, 10 aa, Influenza virus
ATACHDGRKW

SEQ ID NO: 363067 - protein, 10 aa, Influenza virus
TACHDGRKWM

SEQ ID NO: 363068 - protein, 10 aa, Influenza virus
ACHDGRKWMT

SEQ ID NO: 363069 - protein, 10 aa, Influenza virus
GNILRTQESS

SEQ ID NO: 363070 - protein, 10 aa, Influenza virus
NILRTQESSC

SEQ ID NO: 363071 - protein, 10 aa, Influenza virus
IMRTQESSCT

SEQ ID NO: 363072 - protein, 10 aa, Influenza virus
MRTQESSCTC

SEQ ID NO: 363073 - protein, 10 aa, Influenza virus
TQESSCTCIK

SEQ ID NO: 363074 - protein, 10 aa, Influenza virus
QESSCTCIKG

SEQ ID NO: 363075 - protein, 10 aa, Influenza virus
GDCYWVMTDG

SEQ ID NO: 363076 - protein, 10 aa, Influenza virus
DCYWVMTDGP

SEQ ID NO: 363077 - protein, 10 aa, Influenza virus
CFWVMTDGPA

SEQ ID NO: 363078 - protein, 10 aa, Influenza virus
FWVMTDGPAN

SEQ ID NO: 363079 - protein, 10 aa, Influenza virus
WVMTDGPANK

SEQ ID NO: 363080 - protein, 10 aa, Influenza virus
VMTDGPANKQ

SEQ ID NO: 363081 - protein, 10 aa, Influenza virus
MTDGPANKQA

SEQ ID NO: 363082 - protein, 10 aa, Influenza virus
FSGGHIEECS

SEQ ID NO: 363083 - protein, 10 aa, Influenza virus
SGGHIEECSC

SEQ ID NO: 363084 - protein, 10 aa, Influenza virus
EGHIEECSCY

SEQ ID NO: 363085 - protein, 10 aa, Influenza virus
IEECSCYPND

SEQ ID NO: 363086 - protein, 10 aa, Influenza virus
EECSCYPNDG

SEQ ID NO: 363087 - protein, 10 aa, Influenza virus
ECSCYPNDGK

SEQ ID NO: 363088 - protein, 10 aa, Influenza virus
CSCYPNDGKV

SEQ ID NO: 363089 - protein, 10 aa, Influenza virus
SCYPNDGKVE

SEQ ID NO: 363090 - protein, 10 aa, Influenza virus
CYPNDGKVEC

SEQ ID NO: 363091 - protein, 10 aa, Influenza virus
YPNEGKVECI

SEQ ID NO: 363092 - protein, 10 aa, Influenza virus
PNEGKVECIC

SEQ ID NO: 363093 - protein, 10 aa, Influenza virus
NEGKVECICR

SEQ ID NO: 363094 - protein, 10 aa, Influenza virus
EGKVECICRD

SEQ ID NO: 363095 - protein, 10 aa, Influenza virus
GKVECICRDN

SEQ ID NO: 363096 - protein, 10 aa, Influenza virus
KVECICRDNW

SEQ ID NO: 363097 - protein, 10 aa, Influenza virus
VECICRDNWT

SEQ ID NO: 363098 - protein, 10 aa, Influenza virus
ECICRDNWTG

SEQ ID NO: 363099 - protein, 10 aa, Influenza virus
CICRDNWTGT

SEQ ID NO: 363100 - protein, 10 aa, Influenza virus
ICRDNWTGTN

SEQ ID NO: 363101 - protein, 10 aa, Influenza virus
DNWTGTNRPI

SEQ ID NO: 363102 - protein, 10 aa, Influenza virus
NWTGTNRPIL

SEQ ID NO: 363103 - protein, 10 aa, Influenza virus
WTGTNRPILV

SEQ ID NO: 363104 - protein, 10 aa, Influenza virus
TGTNRPILVI

SEQ ID NO: 363105 - protein, 10 aa, Influenza virus
GTNRPILVIS

SEQ ID NO: 363106 - protein, 10 aa, Influenza virus
LSYTVGYLCA

SEQ ID NO: 363107 - protein, 10 aa, Influenza virus
SYTVGYLCAG

SEQ ID NO: 363108 - protein, 10 aa, Influenza virus
VGYLCAGIPT

SEQ ID NO: 363109 - protein, 10 aa, Influenza virus
GYLCAGIPTD

SEQ ID NO: 363110 - protein, 10 aa, Influenza virus
YLCAGIPTDT

SEQ ID NO: 363111 - protein, 10 aa, Influenza virus
LCAGIPTDTP

SEQ ID NO: 363112 - protein, 10 aa, Influenza virus
CAGIPTDTPR

SEQ ID NO: 363113 - protein, 10 aa, Influenza virus
AGIPTDTPRG

SEQ ID NO: 363114 - protein, 10 aa, Influenza virus
GIPTDTPRGE

SEQ ID NO: 363115 - protein, 10 aa, Influenza virus
IPTDTPRGED

SEQ ID NO: 363116 - protein, 10 aa, Influenza virus
PTDTPRGEDS

SEQ ID NO: 363117 - protein, 10 aa, Influenza virus
TDTPRGEDSQ

SEQ ID NO: 363118 - protein, 10 aa, Influenza virus
DTPRGEDAQF

SEQ ID NO: 363119 - protein, 10 aa, Influenza virus
KGYGVKGFGF

SEQ ID NO: 363120 - protein, 10 aa, Influenza virus
VKGFGFRQGT

SEQ ID NO: 363121 - protein, 10 aa, Influenza virus
KGFGFRQGTD

SEQ ID NO: 363122 - protein, 10 aa, Influenza virus
GFGFRQGTDV

SEQ ID NO: 363123 - protein, 10 aa, Influenza virus
FGFRQGTDVW

SEQ ID NO: 363124 - protein, 10 aa, Influenza virus
DDPNWSGYSG

SEQ ID NO: 363125 - protein, 10 aa, Influenza virus
DPNWSGYSGS

SEQ ID NO: 363126 - protein, 10 aa, Influenza virus
PNWSGYSGSF

SEQ ID NO: 363127 - protein, 10 aa, Influenza virus
GYSGSFTLPI

SEQ ID NO: 363128 - protein, 10 aa, Influenza virus
YSGSFTLPIE

SEQ ID NO: 363129 - protein, 10 aa, Influenza virus
SGSFTLPIEL

SEQ ID NO: 363130 - protein, 10 aa, Influenza virus
DCLVPCFWVE

SEQ ID NO: 363131 - protein, 10 aa, Influenza virus
CFWVEMIRGE

SEQ ID NO: 363132 - protein, 10 aa, Influenza virus
FWVEMIRGEP

SEQ ID NO: 363133 - protein, 10 aa, Influenza virus
WVEMIRGEPE

SEQ ID NO: 363134 - protein, 10 aa, Influenza virus
VEMIRGEPEE

SEQ ID NO: 363135 - protein, 10 aa, Influenza virus
TIWTSSSSVV

SEQ ID NO: 363136 - protein, 10 aa, Influenza virus
IWTSSSSVVM

SEQ ID NO: 363137 - protein, 10 aa, Influenza virus
WTSSSSVVMC

SEQ ID NO: 363138 - protein, 10 aa, Influenza virus
TSSSSVVMCG

SEQ ID NO: 363139 - protein, 10 aa, Influenza virus
SSSSVVMCGV

SEQ ID NO: 363140 - protein, 10 aa, Influenza virus
SSSVVMCGVD

SEQ ID NO: 363141 - protein, 10 aa, Influenza virus
SSIVMCGVDY

SEQ ID NO: 363142 - protein, 10 aa, Influenza virus
ASWSWHDGAI

SEQ ID NO: 363143 - protein, 10 aa, Influenza virus
SWSWHDGAIL

SEQ ID NO: 363144 - protein, 10 aa, Influenza virus
WSWHDGAVLP

SEQ ID NO: 363145 - protein, 10 aa, Influenza virus
SWHDGAVLPF

SEQ ID NO: 363146 - protein, 10 aa, Influenza virus
ILPFDFDKIS

SEQ ID NO: 363147 - protein, 10 aa, Influenza virus
LPFDFDKISQ

SEQ ID NO: 363148 - protein, 10 aa, Influenza virus
MNPNQKILCA

SEQ ID NO: 363149 - protein, 10 aa, Influenza virus
NPNQKILCAS

SEQ ID NO: 363150 - protein, 10 aa, Influenza virus
PNQKILCASA

SEQ ID NO: 363151 - protein, 10 aa, Influenza virus
NQKILCTSAI

SEQ ID NO: 363152 - protein, 10 aa, Influenza virus
QKILCASATA

SEQ ID NO: 363153 - protein, 10 aa, Influenza virus
VNLGLNIGLH

SEQ ID NO: 363154 - protein, 10 aa, Influenza virus
NLGLNVGLHL

SEQ ID NO: 363155 - protein, 10 aa, Influenza virus
LGLNIGLHLR

SEQ ID NO: 363156 - protein, 10 aa, Influenza virus
GLNIGLHLRP

SEQ ID NO: 363157 - protein, 10 aa, Influenza virus
SQTVINNYYN

SEQ ID NO: 363158 - protein, 10 aa, Influenza virus
QTVINNYYNE

SEQ ID NO: 363159 - protein, 10 aa, Influenza virus
TVINNYYNET

SEQ ID NO: 363160 - protein, 10 aa, Influenza virus
VINNYYNETN

SEQ ID NO: 363161 - protein, 10 aa, Influenza virus
FNNLTRELCT

SEQ ID NO: 363162 - protein, 10 aa, Influenza virus
NNLTRELCTI

SEQ ID NO: 363163 - protein, 10 aa, Influenza virus
NLTRELCTIN

SEQ ID NO: 363164 - protein, 10 aa, Influenza virus
LTRELCTINS

SEQ ID NO: 363165 - protein, 10 aa, Influenza virus
TRELCTINSW

SEQ ID NO: 363166 - protein, 10 aa, Influenza virus
RELCTINSWH

SEQ ID NO: 363167 - protein, 10 aa, Influenza virus
ELCTINSWHI

SEQ ID NO: 363168 - protein, 10 aa, Influenza virus
LCTINSWHIF

SEQ ID NO: 363169 - protein, 10 aa, Influenza virus
CTINSWHIFG

SEQ ID NO: 363170 - protein, 10 aa, Influenza virus
TINSWHIFGK

SEQ ID NO: 363171 - protein, 10 aa, Influenza virus
INSWHIFGKD

SEQ ID NO: 363172 - protein, 10 aa, Influenza virus
NSWHIFGKDN

SEQ ID NO: 363173 - protein, 10 aa, Influenza virus
SWHIFGKDNA

SEQ ID NO: 363174 - protein, 10 aa, Influenza virus
WHIFGKDNAI

SEQ ID NO: 363175 - protein, 10 aa, Influenza virus
HIFGKDNAIR

SEQ ID NO: 363176 - protein, 10 aa, Influenza virus
IFGKDNAIRI

SEQ ID NO: 363177 - protein, 10 aa, Influenza virus
FGKDNAIRIG

SEQ ID NO: 363178 - protein, 10 aa, Influenza virus
GKDNAIRIGE

SEQ ID NO: 363179 - protein, 10 aa, Influenza virus
KDNAVRIGEN

SEQ ID NO: 363180 - protein, 10 aa, Influenza virus
DNAVRIGENS

SEQ ID NO: 363181 - protein, 10 aa, Influenza virus
RIGENSDVLV

SEQ ID NO: 363182 - protein, 10 aa, Influenza virus
IGENSDVLVT

SEQ ID NO: 363183 - protein, 10 aa, Influenza virus
GENSDVLVTR

SEQ ID NO: 363184 - protein, 10 aa, Influenza virus
ENSDVLVTRE

SEQ ID NO: 363185 - protein, 10 aa, Influenza virus
NSDVLVTREP

SEQ ID NO: 363186 - protein, 10 aa, Influenza virus
SDILVTREPY

SEQ ID NO: 363187 - protein, 10 aa, Influenza virus
DILVTREPYV

SEQ ID NO: 363188 - protein, 10 aa, Influenza virus
ILVTREPYVS

SEQ ID NO: 363189 - protein, 10 aa, Influenza virus
VTREPYVSCE

SEQ ID NO: 363190 - protein, 10 aa, Influenza virus
TREPYVSCEP

SEQ ID NO: 363191 - protein, 10 aa, Influenza virus
REPYVSCEPD

SEQ ID NO: 363192 - protein, 10 aa, Influenza virus
EPYVSCEPDE

SEQ ID NO: 363193 - protein, 10 aa, Influenza virus
PYVSCEPDEC

SEQ ID NO: 363194 - protein, 10 aa, Influenza virus
YVSCDPDGCR

SEQ ID NO: 363195 - protein, 10 aa, Influenza virus
VSCDPDGCRF

SEQ ID NO: 363196 - protein, 10 aa, Influenza virus
SCEPDECRFY

SEQ ID NO: 363197 - protein, 10 aa, Influenza virus
CEPDECRFYA

SEQ ID NO: 363198 - protein, 10 aa, Influenza virus
DPDGCRFYAL

SEQ ID NO: 363199 - protein, 10 aa, Influenza virus
PDGCRFYALS

SEQ ID NO: 363200 - protein, 10 aa, Influenza virus
DGCRFYALSQ

SEQ ID NO: 363201 - protein, 10 aa, Influenza virus
GCRFYALSQG

SEQ ID NO: 363202 - protein, 10 aa, Influenza virus
LSQGTTIRGR

SEQ ID NO: 363203 - protein, 10 aa, Influenza virus
SQGTTIRGRH

SEQ ID NO: 363204 - protein, 10 aa, Influenza virus
QGTTIRGRHS

SEQ ID NO: 363205 - protein, 10 aa, Influenza virus
GTTIRGRHSN

SEQ ID NO: 363206 - protein, 10 aa, Influenza virus
TTIRGRHSNG

SEQ ID NO: 363207 - protein, 10 aa, Influenza virus
TIRGRHSNGT

SEQ ID NO: 363208 - protein, 10 aa, Influenza virus
IRGRHSNGTI

SEQ ID NO: 363209 - protein, 10 aa, Influenza virus
RGRHSNGTIH

SEQ ID NO: 363210 - protein, 10 aa, Influenza virus
GRHSNGTIHD

SEQ ID NO: 363211 - protein, 10 aa, Influenza virus
RHSNGTIHDR

SEQ ID NO: 363212 - protein, 10 aa, Influenza virus
TIHDRSQYRS

SEQ ID NO: 363213 - protein, 10 aa, Influenza virus
IHDRSQYRSL

SEQ ID NO: 363214 - protein, 10 aa, Influenza virus
HDRSQYRSLI

SEQ ID NO: 363215 - protein, 10 aa, Influenza virus
DRSQYRSLIS

SEQ ID NO: 363216 - protein, 10 aa, Influenza virus
RSQYRSLISW

SEQ ID NO: 363217 - protein, 10 aa, Influenza virus
SQYRSLISWP

SEQ ID NO: 363218 - protein, 10 aa, Influenza virus
QYRSLISWPL

SEQ ID NO: 363219 - protein, 10 aa, Influenza virus
YRSLISWPLS

SEQ ID NO: 363220 - protein, 10 aa, Influenza virus
RSLISWPLSS

SEQ ID NO: 363221 - protein, 10 aa, Influenza virus
SLISWPLSSP

SEQ ID NO: 363222 - protein, 10 aa, Influenza virus
LVSWPLSSPP

SEQ ID NO: 363223 - protein, 10 aa, Influenza virus
VSWPLSSPPT

SEQ ID NO: 363224 - protein, 10 aa, Influenza virus
SWPQSSPPTV

SEQ ID NO: 363225 - protein, 10 aa, Influenza virus
WPQSSPPTVY

SEQ ID NO: 363226 - protein, 10 aa, Influenza virus
PQSSPPTVYN

SEQ ID NO: 363227 - protein, 10 aa, Influenza virus
LSSPPTVYNT

SEQ ID NO: 363228 - protein, 10 aa, Influenza virus
SSPPTVYNTR

SEQ ID NO: 363229 - protein, 10 aa, Influenza virus
RIECIGWSST

SEQ ID NO: 363230 - protein, 10 aa, Influenza virus
IECIGWSSTS

SEQ ID NO: 363231 - protein, 10 aa, Influenza virus
WSSTSCHDGK

SEQ ID NO: 363232 - protein, 10 aa, Influenza virus
SSTSCHDGKS

SEQ ID NO: 363233 - protein, 10 aa, Influenza virus
STSCHDGKSR

SEQ ID NO: 363234 - protein, 10 aa, Influenza virus
TSCHDGKSRM

SEQ ID NO: 363235 - protein, 10 aa, Influenza virus
SCHDGKSRMS

SEQ ID NO: 363236 - protein, 10 aa, Influenza virus
RMSICVSGPN

SEQ ID NO: 363237 - protein, 10 aa, Influenza virus
MSICVSGPNN

SEQ ID NO: 363238 - protein, 10 aa, Influenza virus
SICVSGPNNN

SEQ ID NO: 363239 - protein, 10 aa, Influenza virus
ICVSGPNNNA

SEQ ID NO: 363240 - protein, 10 aa, Influenza virus
CVSGPNNNAS

SEQ ID NO: 363241 - protein, 10 aa, Influenza virus
VSGPNNNASA

SEQ ID NO: 363242 - protein, 10 aa, Influenza virus
SGPNNNASAI

SEQ ID NO: 363243 - protein, 10 aa, Influenza virus
GPNNNASAVV

SEQ ID NO: 363244 - protein, 10 aa, Influenza virus
PNNNASAVVW

SEQ ID NO: 363245 - protein, 10 aa, Influenza virus
NNNASAVVWY

SEQ ID NO: 363246 - protein, 10 aa, Influenza virus
NNASAVVWYN

SEQ ID NO: 363247 - protein, 10 aa, Influenza virus
RRPVAEINTW

SEQ ID NO: 363248 - protein, 10 aa, Influenza virus
RPVAEINTWA

SEQ ID NO: 363249 - protein, 10 aa, Influenza virus
PVAEINTWAR

SEQ ID NO: 363250 - protein, 10 aa, Influenza virus
VAEINTWARN

SEQ ID NO: 363251 - protein, 10 aa, Influenza virus
AEINTWARNI

SEQ ID NO: 363252 - protein, 10 aa, Influenza virus
TQESECVCHS

SEQ ID NO: 363253 - protein, 10 aa, Influenza virus
QESECVCHSG

SEQ ID NO: 363254 - protein, 10 aa, Influenza virus
ESECVCHNGI

SEQ ID NO: 363255 - protein, 10 aa, Influenza virus
SECVCHNGIC

SEQ ID NO: 363256 - protein, 10 aa, Influenza virus
ECVCHNGICP

SEQ ID NO: 363257 - protein, 10 aa, Influenza virus
CVCHNGICPV

SEQ ID NO: 363258 - protein, 10 aa, Influenza virus
VCHNGICPVV

SEQ ID NO: 363259 - protein, 10 aa, Influenza virus
CHNGICPVVF

SEQ ID NO: 363260 - protein, 10 aa, Influenza virus
HNGICPVVFT

SEQ ID NO: 363261 - protein, 10 aa, Influenza virus
NGICPVVFTD

SEQ ID NO: 363262 - protein, 10 aa, Influenza virus
GICPVVFTDG

SEQ ID NO: 363263 - protein, 10 aa, Influenza virus
ICPVVFTDGS

SEQ ID NO: 363264 - protein, 10 aa, Influenza virus
TDGSATGPAD

SEQ ID NO: 363265 - protein, 10 aa, Influenza virus
DGSATGPADT

SEQ ID NO: 363266 - protein, 10 aa, Influenza virus
GSATGPADTR

SEQ ID NO: 363267 - protein, 10 aa, Influenza virus
SATGPAETRI

SEQ ID NO: 363268 - protein, 10 aa, Influenza virus
ATGPAETRIY

SEQ ID NO: 363269 - protein, 10 aa, Influenza virus
TGPAETRIYY

SEQ ID NO: 363270 - protein, 10 aa, Influenza virus
GPAETRIYYF

SEQ ID NO: 363271 - protein, 10 aa, Influenza virus
LAGTAKHIEE

SEQ ID NO: 363272 - protein, 10 aa, Influenza virus
AGTAKHIEEC

SEQ ID NO: 363273 - protein, 10 aa, Influenza virus
TAKHIEECSS

SEQ ID NO: 363274 - protein, 10 aa, Influenza virus
AKHIEECSSY

SEQ ID NO: 363275 - protein, 10 aa, Influenza virus
KHIEECSSYG

SEQ ID NO: 363276 - protein, 10 aa, Influenza virus
HIEECSCYGV

SEQ ID NO: 363277 - protein, 10 aa, Influenza virus
VTCTCRDNWQ

SEQ ID NO: 363278 - protein, 10 aa, Influenza virus
ICTCRDNWQG

SEQ ID NO: 363279 - protein, 10 aa, Influenza virus
WQGSNRPVIR

SEQ ID NO: 363280 - protein, 10 aa, Influenza virus
QGSNRPVIRI

SEQ ID NO: 363281 - protein, 10 aa, Influenza virus
GSNRPVIQIN

SEQ ID NO: 363282 - protein, 10 aa, Influenza virus
SNRPVIQINP

SEQ ID NO: 363283 - protein, 10 aa, Influenza virus
VMTHTSQYIC

SEQ ID NO: 363284 - protein, 10 aa, Influenza virus
MKHTSQYICS

SEQ ID NO: 363285 - protein, 10 aa, Influenza virus
KHTSQYICSP

SEQ ID NO: 363286 - protein, 10 aa, Influenza virus
TDNPRPNDPT

SEQ ID NO: 363287 - protein, 10 aa, Influenza virus
IGKCNDPYPG

SEQ ID NO: 363288 - protein, 10 aa, Influenza virus
GKCNEPYPGN

SEQ ID NO: 363289 - protein, 10 aa, Influenza virus
KCNEPYPGNN

SEQ ID NO: 363290 - protein, 10 aa, Influenza virus
CNEPYPGNNN

SEQ ID NO: 363291 - protein, 10 aa, Influenza virus
NEPYPGNNNN

SEQ ID NO: 363292 - protein, 10 aa, Influenza virus
EPYPGNNNNG

SEQ ID NO: 363293 - protein, 10 aa, Influenza virus
PYPGSNNNGV

SEQ ID NO: 363294 - protein, 10 aa, Influenza virus
YPGSNNNGVK

SEQ ID NO: 363295 - protein, 10 aa, Influenza virus
PGNNNKGVKG

SEQ ID NO: 363296 - protein, 10 aa, Influenza virus
GNNNKGVKGF

SEQ ID NO: 363297 - protein, 10 aa, Influenza virus
NNNNGVKGFA

SEQ ID NO: 363298 - protein, 10 aa, Influenza virus
NNNGVKGFAY

SEQ ID NO: 363299 - protein, 10 aa, Influenza virus
NNGVKGFAYL

SEQ ID NO: 363300 - protein, 10 aa, Influenza virus
NGVKGFSYLN

SEQ ID NO: 363301 - protein, 10 aa, Influenza virus
GVKGFSYLNG

SEQ ID NO: 363302 - protein, 10 aa, Influenza virus
NTWLGRTISI

SEQ ID NO: 363303 - protein, 10 aa, Influenza virus
TWLGRTISIA

SEQ ID NO: 363304 - protein, 10 aa, Influenza virus
WLGRTISIAS

SEQ ID NO: 363305 - protein, 10 aa, Influenza virus
LGRTISIASR

SEQ ID NO: 363306 - protein, 10 aa, Influenza virus
GRTISIASRS

SEQ ID NO: 363307 - protein, 10 aa, Influenza virus
RTISIASRSG

SEQ ID NO: 363308 - protein, 10 aa, Influenza virus
TISIASRSGY

SEQ ID NO: 363309 - protein, 10 aa, Influenza virus
ISIASRSGYE

SEQ ID NO: 363310 - protein, 10 aa, Influenza virus
SIASRSGYEM

SEQ ID NO: 363311 - protein, 10 aa, Influenza virus
IASRSGYEML

SEQ ID NO: 363312 - protein, 10 aa, Influenza virus
ASRAGYEMLK

SEQ ID NO: 363313 - protein, 10 aa, Influenza virus
SRYGYEMLKV

SEQ ID NO: 363314 - protein, 10 aa, Influenza virus
RAGYEMLKVP

SEQ ID NO: 363315 - protein, 10 aa, Influenza virus
SGYEILKVPN

SEQ ID NO: 363316 - protein, 10 aa, Influenza virus
EILKVPNALT

SEQ ID NO: 363317 - protein, 10 aa, Influenza virus
VLRVPNALTD

SEQ ID NO: 363318 - protein, 10 aa, Influenza virus
LKVPNALTDN

SEQ ID NO: 363319 - protein, 10 aa, Influenza virus
KVPNALTDNR

SEQ ID NO: 363320 - protein, 10 aa, Influenza virus
VPNALTDNRS

SEQ ID NO: 363321 - protein, 10 aa, Influenza virus
PNALTDDKSK

SEQ ID NO: 363322 - protein, 10 aa, Influenza virus
NALTDDKSKP

SEQ ID NO: 363323 - protein, 10 aa, Influenza virus
QGQTVVLNTD

SEQ ID NO: 363324 - protein, 10 aa, Influenza virus
GQTVVLNTDW

SEQ ID NO: 363325 - protein, 10 aa, Influenza virus
QTVVLNTDWS

SEQ ID NO: 363326 - protein, 10 aa, Influenza virus
TVVLNTDWSG

SEQ ID NO: 363327 - protein, 10 aa, Influenza virus
VVLNTDWSGY

SEQ ID NO: 363328 - protein, 10 aa, Influenza virus
VSNTDWSGYS

SEQ ID NO: 363329 - protein, 10 aa, Influenza virus
LTTDWSGYSG

SEQ ID NO: 363330 - protein, 10 aa, Influenza virus
DWSGYSGSFI

SEQ ID NO: 363331 - protein, 10 aa, Influenza virus
WSGYSGSFID

SEQ ID NO: 363332 - protein, 10 aa, Influenza virus
SGYSGSFIDY

SEQ ID NO: 363333 - protein, 10 aa, Influenza virus
GYSGSFIDYW

SEQ ID NO: 363334 - protein, 10 aa, Influenza virus
YSGSFIDYWA

SEQ ID NO: 363335 - protein, 10 aa, Influenza virus
SGSFIDYWAK

SEQ ID NO: 363336 - protein, 10 aa, Influenza virus
GSFIDYWAKG

SEQ ID NO: 363337 - protein, 10 aa, Influenza virus
DYWAEGDCYR

SEQ ID NO: 363338 - protein, 10 aa, Influenza virus
YWAEGDCYRA

SEQ ID NO: 363339 - protein, 10 aa, Influenza virus
WAEGDCYRAC

SEQ ID NO: 363340 - protein, 10 aa, Influenza virus
AEGDCYRACF

SEQ ID NO: 363341 - protein, 10 aa, Influenza virus
EGDCYRACFY

SEQ ID NO: 363342 - protein, 10 aa, Influenza virus
GDCYRACFYV

SEQ ID NO: 363343 - protein, 10 aa, Influenza virus
DCYRACFYVE

SEQ ID NO: 363344 - protein, 10 aa, Influenza virus
ELIRGRPKEE

SEQ ID NO: 363345 - protein, 10 aa, Influenza virus
LIRGRPKEEK

SEQ ID NO: 363346 - protein, 10 aa, Influenza virus
IRGRPKEEKV

SEQ ID NO: 363347 - protein, 10 aa, Influenza virus
RGRPKEEKVW

SEQ ID NO: 363348 - protein, 10 aa, Influenza virus
GRPKEEKVWW

SEQ ID NO: 363349 - protein, 10 aa, Influenza virus
RPKEEKVWWT

SEQ ID NO: 363350 - protein, 10 aa, Influenza virus
PKEEKVWWTS

SEQ ID NO: 363351 - protein, 10 aa, Influenza virus
KEEKVWWTSN

SEQ ID NO: 363352 - protein, 10 aa, Influenza virus
EEKVWWTSNS

SEQ ID NO: 363353 - protein, 10 aa, Influenza virus
EKVWWTSNSI

SEQ ID NO: 363354 - protein, 10 aa, Influenza virus
RVWWTSNSIV

SEQ ID NO: 363355 - protein, 10 aa, Influenza virus
VWWTSNSIIS

SEQ ID NO: 363356 - protein, 10 aa, Influenza virus
WWTSNSIISM

SEQ ID NO: 363357 - protein, 10 aa, Influenza virus
WTSNSIISMC

SEQ ID NO: 363358 - protein, 10 aa, Influenza virus
NSIISMCSST

SEQ ID NO: 363359 - protein, 10 aa, Influenza virus
SIISMCSSTE

SEQ ID NO: 363360 - protein, 10 aa, Influenza virus
IISMCSSTEF

SEQ ID NO: 363361 - protein, 10 aa, Influenza virus
ISMCSSTEFL

SEQ ID NO: 363362 - protein, 10 aa, Influenza virus
SSTEFLGQWD

SEQ ID NO: 363363 - protein, 10 aa, Influenza virus
STEFLGQWDW

SEQ ID NO: 363364 - protein, 10 aa, Influenza virus
TEFLGQWDWP

SEQ ID NO: 363365 - protein, 10 aa, Influenza virus
EFLGQWDWPD

SEQ ID NO: 363366 - protein, 10 aa, Influenza virus
FLGQWDWPDG

SEQ ID NO: 363367 - protein, 10 aa, Influenza virus
LGQWDWPDGA

SEQ ID NO: 363368 - protein, 10 aa, Influenza virus
GQWDWPDGAK

SEQ ID NO: 363369 - protein, 10 aa, Influenza virus
QWDWPDGAKI

SEQ ID NO: 363370 - protein, 10 aa, Influenza virus
WDWPDGAKIE

SEQ ID NO: 363371 - protein, 10 aa, Influenza virus
DWPDGAKIEY

SEQ ID NO: 363372 - protein, 10 aa, Influenza virus
WPDGAEIEYF

SEQ ID NO: 363373 - protein, 10 aa, Influenza virus
PDGAEIEYFL

SEQ ID NO: 363374 - protein, 10 aa, Influenza virus
GIDKICLGHH

SEQ ID NO: 363375 - protein, 10 aa, Influenza virus
IDKICLGHHA

SEQ ID NO: 363376 - protein, 10 aa, Influenza virus
DRICLGHHAV

SEQ ID NO: 363377 - protein, 10 aa, Influenza virus
KICLGHHAVP

SEQ ID NO: 363378 - protein, 10 aa, Influenza virus
ICLGHHAVPN

SEQ ID NO: 363379 - protein, 10 aa, Influenza virus
CLGHHAVPNG

SEQ ID NO: 363380 - protein, 10 aa, Influenza virus
LGHHAVPNGT

SEQ ID NO: 363381 - protein, 10 aa, Influenza virus
QEEVTNATET

SEQ ID NO: 363382 - protein, 10 aa, Influenza virus
VTNATETVEN

SEQ ID NO: 363383 - protein, 10 aa, Influenza virus
KDLGSCHPIG

SEQ ID NO: 363384 - protein, 10 aa, Influenza virus
DLGSCHPIGM

SEQ ID NO: 363385 - protein, 10 aa, Influenza virus
NEGALRQKIM

SEQ ID NO: 363386 - protein, 10 aa, Influenza virus
EGALRQKIME

SEQ ID NO: 363387 - protein, 10 aa, Influenza virus
GALRQKIMES

SEQ ID NO: 363388 - protein, 10 aa, Influenza virus
LRQKVMESGG

SEQ ID NO: 363389 - protein, 10 aa, Influenza virus
RQKIMESGGV

SEQ ID NO: 363390 - protein, 10 aa, Influenza virus
QNFPQTANTY

SEQ ID NO: 363391 - protein, 10 aa, Influenza virus
NFPQTANTYR

SEQ ID NO: 363392 - protein, 10 aa, Influenza virus
FPQTANTYRN

SEQ ID NO: 363393 - protein, 10 aa, Influenza virus
PQTANTYRNT

SEQ ID NO: 363394 - protein, 10 aa, Influenza virus
QTANTYRNTD

SEQ ID NO: 363395 - protein, 10 aa, Influenza virus
TTNTYRNTDT

SEQ ID NO: 363396 - protein, 10 aa, Influenza virus
LYGTQPLSIS

SEQ ID NO: 363397 - protein, 10 aa, Influenza virus
YGTQSLSISI

SEQ ID NO: 363398 - protein, 10 aa, Influenza virus
GTQSLSISIG

SEQ ID NO: 363399 - protein, 10 aa, Influenza virus
TQSLSISIGS

SEQ ID NO: 363400 - protein, 10 aa, Influenza virus
QSLSISIGSS

SEQ ID NO: 363401 - protein, 10 aa, Influenza virus
SLSISIGSST

SEQ ID NO: 363402 - protein, 10 aa, Influenza virus
LSISIGSSTY

SEQ ID NO: 363403 - protein, 10 aa, Influenza virus
SISVESSTYQ

SEQ ID NO: 363404 - protein, 10 aa, Influenza virus
ISVESSTYQN

SEQ ID NO: 363405 - protein, 10 aa, Influenza virus
VGSSTYQNSF

SEQ ID NO: 363406 - protein, 10 aa, Influenza virus
GSSTYQNSFV

SEQ ID NO: 363407 - protein, 10 aa, Influenza virus
SSTYQNSFVP

SEQ ID NO: 363408 - protein, 10 aa, Influenza virus
STYQNSFVPV

SEQ ID NO: 363409 - protein, 10 aa, Influenza virus
TYQNSFVPVV

SEQ ID NO: 363410 - protein, 10 aa, Influenza virus
YQNSFVPVVG

SEQ ID NO: 363411 - protein, 10 aa, Influenza virus
NSFVPVVGAR

SEQ ID NO: 363412 - protein, 10 aa, Influenza virus
SFVPVVGARP

SEQ ID NO: 363413 - protein, 10 aa, Influenza virus
FVPVIGARPQ

SEQ ID NO: 363414 - protein, 10 aa, Influenza virus
VPVIGARPQV

SEQ ID NO: 363415 - protein, 10 aa, Influenza virus
PVIGARPQVN

SEQ ID NO: 363416 - protein, 10 aa, Influenza virus
VIGARPQVNG

SEQ ID NO: 363417 - protein, 10 aa, Influenza virus
IGARPQVNGQ

SEQ ID NO: 363418 - protein, 10 aa, Influenza virus
RARPQVNGQS

SEQ ID NO: 363419 - protein, 10 aa, Influenza virus
ARPKVNGQSG

SEQ ID NO: 363420 - protein, 10 aa, Influenza virus
RPKVNGQSGR

SEQ ID NO: 363421 - protein, 10 aa, Influenza virus
PKVNGQSGRI

SEQ ID NO: 363422 - protein, 10 aa, Influenza virus
VNGQSGRIEF

SEQ ID NO: 363423 - protein, 10 aa, Influenza virus
NGQSGRIEFH

SEQ ID NO: 363424 - protein, 10 aa, Influenza virus
GQSGRIEFHW

SEQ ID NO: 363425 - protein, 10 aa, Influenza virus
PGDSITFSHN

SEQ ID NO: 363426 - protein, 10 aa, Influenza virus
GDSITFSHNG

SEQ ID NO: 363427 - protein, 10 aa, Influenza virus
DSITFSHNGG

SEQ ID NO: 363428 - protein, 10 aa, Influenza virus
SITFSHNGGL

SEQ ID NO: 363429 - protein, 10 aa, Influenza virus
ITFSHNGGRI

SEQ ID NO: 363430 - protein, 10 aa, Influenza virus
TFSHNGGRIA

SEQ ID NO: 363431 - protein, 10 aa, Influenza virus
FSHNGGRIAP

SEQ ID NO: 363432 - protein, 10 aa, Influenza virus
HNGGLIAPDR

SEQ ID NO: 363433 - protein, 10 aa, Influenza virus
NGGLIAPDRV

SEQ ID NO: 363434 - protein, 10 aa, Influenza virus
CESKCFWRGG

SEQ ID NO: 363435 - protein, 10 aa, Influenza virus
ESKCFWRGGS

SEQ ID NO: 363436 - protein, 10 aa, Influenza virus
SKCFWRGGSI

SEQ ID NO: 363437 - protein, 10 aa, Influenza virus
KCFWRGGSIN

SEQ ID NO: 363438 - protein, 10 aa, Influenza virus
CFWRGGSINT

SEQ ID NO: 363439 - protein, 10 aa, Influenza virus
GGSINTRLPF

SEQ ID NO: 363440 - protein, 10 aa, Influenza virus
GSINTRLPFQ

SEQ ID NO: 363441 - protein, 10 aa, Influenza virus
SINTRLPFQN

SEQ ID NO: 363442 - protein, 10 aa, Influenza virus
INTRLPFQNL

SEQ ID NO: 363443 - protein, 10 aa, Influenza virus
NTRLPFQNLS

SEQ ID NO: 363444 - protein, 10 aa, Influenza virus
TRLPFQNLSP

SEQ ID NO: 363445 - protein, 10 aa, Influenza virus
RLPFQNLSPR

SEQ ID NO: 363446 - protein, 10 aa, Influenza virus
TVGQCPKYVS

SEQ ID NO: 363447 - protein, 10 aa, Influenza virus
RSLLLATGMR

SEQ ID NO: 363448 - protein, 10 aa, Influenza virus
SLMLATGMRN

SEQ ID NO: 363449 - protein, 10 aa, Influenza virus
LMLATGMRNV

SEQ ID NO: 363450 - protein, 10 aa, Influenza virus
MLATGMRNVP

SEQ ID NO: 363451 - protein, 10 aa, Influenza virus
ATGMRNVPEI

SEQ ID NO: 363452 - protein, 10 aa, Influenza virus
QERGLFGAIA

SEQ ID NO: 363453 - protein, 10 aa, Influenza virus
ERGLFGAIAG

SEQ ID NO: 363454 - protein, 10 aa, Influenza virus
RGLFGAKAGF

SEQ ID NO: 363455 - protein, 10 aa, Influenza virus
GLFGAKAGFI

SEQ ID NO: 363456 - protein, 10 aa, Influenza virus
LFGAKAGFIE

SEQ ID NO: 363457 - protein, 10 aa, Influenza virus
FGAKAGFIEN

SEQ ID NO: 363458 - protein, 10 aa, Influenza virus
GAKAGFIENG

SEQ ID NO: 363459 - protein, 10 aa, Influenza virus
AKAGFIENGW

SEQ ID NO: 363460 - protein, 10 aa, Influenza virus
KAGFIENGWE

SEQ ID NO: 363461 - protein, 10 aa, Influenza virus
FIENGWEGMI

SEQ ID NO: 363462 - protein, 10 aa, Influenza virus
IENGWEGMID

SEQ ID NO: 363463 - protein, 10 aa, Influenza virus
ENGWEGMIDG

SEQ ID NO: 363464 - protein, 10 aa, Influenza virus
NGWEGMIDGW

SEQ ID NO: 363465 - protein, 10 aa, Influenza virus
GWEGMIDGWY

SEQ ID NO: 363466 - protein, 10 aa, Influenza virus
WEGMIDGWYG

SEQ ID NO: 363467 - protein, 10 aa, Influenza virus
EGMIDGWYGF

SEQ ID NO: 363468 - protein, 10 aa, Influenza virus
GMIDGWYGFR

SEQ ID NO: 363469 - protein, 10 aa, Influenza virus
MIDGWYGFRH

SEQ ID NO: 363470 - protein, 10 aa, Influenza virus
IDGWYGFRHQ

SEQ ID NO: 363471 - protein, 10 aa, Influenza virus
GFRHQNAQGI

SEQ ID NO: 363472 - protein, 10 aa, Influenza virus
FRHQNAQGIG

SEQ ID NO: 363473 - protein, 10 aa, Influenza virus
RHQNAQGIGQ

SEQ ID NO: 363474 - protein, 10 aa, Influenza virus
HQNAQGIGQA

SEQ ID NO: 363475 - protein, 10 aa, Influenza virus
QNAQGIGQAA

SEQ ID NO: 363476 - protein, 10 aa, Influenza virus
NAQGIGQAAD

SEQ ID NO: 363477 - protein, 10 aa, Influenza virus
AQGIGQAADY

SEQ ID NO: 363478 - protein, 10 aa, Influenza virus
QGIGQAADYK

SEQ ID NO: 363479 - protein, 10 aa, Influenza virus
GIGQAADYKS

SEQ ID NO: 363480 - protein, 10 aa, Influenza virus
IGQAADYKST

SEQ ID NO: 363481 - protein, 10 aa, Influenza virus
GQAADYESTQ

SEQ ID NO: 363482 - protein, 10 aa, Influenza virus
QAADYKSTQT

SEQ ID NO: 363483 - protein, 10 aa, Influenza virus
AADYKSTQTA

SEQ ID NO: 363484 - protein, 10 aa, Influenza virus
ADYKSTQAAV

SEQ ID NO: 363485 - protein, 10 aa, Influenza virus
AVDQITGKLN

SEQ ID NO: 363486 - protein, 10 aa, Influenza virus
VDQITGKLNR

SEQ ID NO: 363487 - protein, 10 aa, Influenza virus
VQITGKLNRL

SEQ ID NO: 363488 - protein, 10 aa, Influenza virus
QVTGKLNRLI

SEQ ID NO: 363489 - protein, 10 aa, Influenza virus
VTGKLNRLIE

SEQ ID NO: 363490 - protein, 10 aa, Influenza virus
EFESIESEFN

SEQ ID NO: 363491 - protein, 10 aa, Influenza virus
FESIESEFNE

SEQ ID NO: 363492 - protein, 10 aa, Influenza virus
ESIESEFNEI

SEQ ID NO: 363493 - protein, 10 aa, Influenza virus
SIESEFNEIE

SEQ ID NO: 363494 - protein, 10 aa, Influenza virus
IESEFNEIEH

SEQ ID NO: 363495 - protein, 10 aa, Influenza virus
ESEFNEIEHQ

SEQ ID NO: 363496 - protein, 10 aa, Influenza virus
SEFNEIEHQI

SEQ ID NO: 363497 - protein, 10 aa, Influenza virus
EFNEIEHQIG

SEQ ID NO: 363498 - protein, 10 aa, Influenza virus
FNEIEHQIGN

SEQ ID NO: 363499 - protein, 10 aa, Influenza virus
NEIEHQIGNV

SEQ ID NO: 363500 - protein, 10 aa, Influenza virus
ETEHQIGNVI

SEQ ID NO: 363501 - protein, 10 aa, Influenza virus
TEHQIGNVIN

SEQ ID NO: 363502 - protein, 10 aa, Influenza virus
EYQIGNVINW

SEQ ID NO: 363503 - protein, 10 aa, Influenza virus
YQIGNVINWT

SEQ ID NO: 363504 - protein, 10 aa, Influenza virus
DSITYIWTYQ

SEQ ID NO: 363505 - protein, 10 aa, Influenza virus
SITYIWTYQA

SEQ ID NO: 363506 - protein, 10 aa, Influenza virus
ITYIWTYQAE

SEQ ID NO: 363507 - protein, 10 aa, Influenza virus
TYIWTYQAEL

SEQ ID NO: 363508 - protein, 10 aa, Influenza virus
YIWTYQAELL

SEQ ID NO: 363509 - protein, 10 aa, Influenza virus
IWTYQEELLV

SEQ ID NO: 363510 - protein, 10 aa, Influenza virus
WTYQEELLVA

SEQ ID NO: 363511 - protein, 10 aa, Influenza virus
TYNAELLVAM

SEQ ID NO: 363512 - protein, 10 aa, Influenza virus
YQAELLIAME

SEQ ID NO: 363513 - protein, 10 aa, Influenza virus
QAELLIAMEN

SEQ ID NO: 363514 - protein, 10 aa, Influenza virus
MENQHTIEMT

SEQ ID NO: 363515 - protein, 10 aa, Influenza virus
ENQHTIEMTD

SEQ ID NO: 363516 - protein, 10 aa, Influenza virus
NQHTIDMGDS

SEQ ID NO: 363517 - protein, 10 aa, Influenza virus
QHTIEMTDSE

SEQ ID NO: 363518 - protein, 10 aa, Influenza virus
HTIDMADSTM

SEQ ID NO: 363519 - protein, 10 aa, Influenza virus
TIDLADSEML

SEQ ID NO: 363520 - protein, 10 aa, Influenza virus
IEMTDSEMLN

SEQ ID NO: 363521 - protein, 10 aa, Influenza virus
DLADSEMLNL

SEQ ID NO: 363522 - protein, 10 aa, Influenza virus
MGDSEMLNLY

SEQ ID NO: 363523 - protein, 10 aa, Influenza virus
ADSEMLNLYD

SEQ ID NO: 363524 - protein, 10 aa, Influenza virus
DSEMLNLYDR

SEQ ID NO: 363525 - protein, 10 aa, Influenza virus
SEMLNLYDRV

SEQ ID NO: 363526 - protein, 10 aa, Influenza virus
EMLNLYDRVR

SEQ ID NO: 363527 - protein, 10 aa, Influenza virus
MLNLYDRVRK

SEQ ID NO: 363528 - protein, 10 aa, Influenza virus
LNLYDRVRKQ

SEQ ID NO: 363529 - protein, 10 aa, Influenza virus
NLYDRVRKQL

SEQ ID NO: 363530 - protein, 10 aa, Influenza virus
LYDRVRKQLR

SEQ ID NO: 363531 - protein, 10 aa, Influenza virus
YDRVRKQLRQ

SEQ ID NO: 363532 - protein, 10 aa, Influenza virus
DRVRKQLRQN

SEQ ID NO: 363533 - protein, 10 aa, Influenza virus
LRQNAEEDGR

SEQ ID NO: 363534 - protein, 10 aa, Influenza virus
RQNAEEDGRG

SEQ ID NO: 363535 - protein, 10 aa, Influenza virus
QNAEEDGRGC

SEQ ID NO: 363536 - protein, 10 aa, Influenza virus
NAEEDGRGCF

SEQ ID NO: 363537 - protein, 10 aa, Influenza virus
AEEDGRGCFE

SEQ ID NO: 363538 - protein, 10 aa, Influenza virus
EEDGRGCFEI

SEQ ID NO: 363539 - protein, 10 aa, Influenza virus
EDGRGCFEIY

SEQ ID NO: 363540 - protein, 10 aa, Influenza virus
DGRGCFEIYH

SEQ ID NO: 363541 - protein, 10 aa, Influenza virus
SCMESIRNNT

SEQ ID NO: 363542 - protein, 10 aa, Influenza virus
CMERIRNNTY

SEQ ID NO: 363543 - protein, 10 aa, Influenza virus
MESIRNNTYN

SEQ ID NO: 363544 - protein, 10 aa, Influenza virus
ESIRNNTYNH

SEQ ID NO: 363545 - protein, 10 aa, Influenza virus
IRNNTYDHSQ

SEQ ID NO: 363546 - protein, 10 aa, Influenza virus
RNNTYDHSQY

SEQ ID NO: 363547 - protein, 10 aa, Influenza virus
NNTYDHSQYR

SEQ ID NO: 363548 - protein, 10 aa, Influenza virus
NTYDHSQYRE

SEQ ID NO: 363549 - protein, 10 aa, Influenza virus
TYDHSQYREE

SEQ ID NO: 363550 - protein, 10 aa, Influenza virus
HSQYREEALL

SEQ ID NO: 363551 - protein, 10 aa, Influenza virus
HYREEALLNR

SEQ ID NO: 363552 - protein, 10 aa, Influenza virus
YREESLLNRL

SEQ ID NO: 363553 - protein, 10 aa, Influenza virus
REEALLNRLS

SEQ ID NO: 363554 - protein, 10 aa, Influenza virus
EEALLNRLSI

SEQ ID NO: 363555 - protein, 10 aa, Influenza virus
EALLNRLSIN

SEQ ID NO: 363556 - protein, 10 aa, Influenza virus
ALLNRLNINS

SEQ ID NO: 363557 - protein, 10 aa, Influenza virus
LLNRLNINSV

SEQ ID NO: 363558 - protein, 10 aa, Influenza virus
INSVKLSSGY

SEQ ID NO: 363559 - protein, 10 aa, Influenza virus
NSVKLSSGYK

SEQ ID NO: 363560 - protein, 10 aa, Influenza virus
LSSGYKDIIL

SEQ ID NO: 363561 - protein, 10 aa, Influenza virus
SSGYKDIILW

SEQ ID NO: 363562 - protein, 10 aa, Influenza virus
SGYKDIILWF

SEQ ID NO: 363563 - protein, 10 aa, Influenza virus
GYKDIILWFS

SEQ ID NO: 363564 - protein, 10 aa, Influenza virus
YKDIILWFSF

SEQ ID NO: 363565 - protein, 10 aa, Influenza virus
KDIILWFSFG

SEQ ID NO: 363566 - protein, 10 aa, Influenza virus
DIILWFSFGA

SEQ ID NO: 363567 - protein, 10 aa, Influenza virus
IILWFSFGAS

SEQ ID NO: 363568 - protein, 10 aa, Influenza virus
ILWFSFGASS

SEQ ID NO: 363569 - protein, 10 aa, Influenza virus
LWFSFGASSF

SEQ ID NO: 363570 - protein, 10 aa, Influenza virus
WFSFGASCFI

SEQ ID NO: 363571 - protein, 10 aa, Influenza virus
FSFGASCFIL

SEQ ID NO: 363572 - protein, 10 aa, Influenza virus
SFGASCFILL

SEQ ID NO: 363573 - protein, 10 aa, Influenza virus
FGASCFILLA

SEQ ID NO: 363574 - protein, 10 aa, Influenza virus
GIDKICLGHH

SEQ ID NO: 363575 - protein, 10 aa, Influenza virus
IDKICLGHHA

SEQ ID NO: 363576 - protein, 10 aa, Influenza virus
DRICLGHHAV

SEQ ID NO: 363577 - protein, 10 aa, Influenza virus
KICLGHHAVP

SEQ ID NO: 363578 - protein, 10 aa, Influenza virus
ICLGHHAVPN

SEQ ID NO: 363579 - protein, 10 aa, Influenza virus
CLGHHAVPNG

SEQ ID NO: 363580 - protein, 10 aa, Influenza virus
LGHHAVPNGT

SEQ ID NO: 363581 - protein, 10 aa, Influenza virus
GHHAVPNGTI

SEQ ID NO: 363582 - protein, 10 aa, Influenza virus
PNGTIVKTLT

SEQ ID NO: 363583 - protein, 10 aa, Influenza virus
NGTIVKTLTS

SEQ ID NO: 363584 - protein, 10 aa, Influenza virus
GTIVKTLTSE

SEQ ID NO: 363585 - protein, 10 aa, Influenza virus
TIVKTLTNEQ

SEQ ID NO: 363586 - protein, 10 aa, Influenza virus
IVKTLTNEQE

SEQ ID NO: 363587 - protein, 10 aa, Influenza virus
KTLTNEQEEV

SEQ ID NO: 363588 - protein, 10 aa, Influenza virus
EQEEVTNATE

SEQ ID NO: 363589 - protein, 10 aa, Influenza virus
QEEVTNATET

SEQ ID NO: 363590 - protein, 10 aa, Influenza virus
EKVTNATETV

SEQ ID NO: 363591 - protein, 10 aa, Influenza virus
EVINATETVE

SEQ ID NO: 363592 - protein, 10 aa, Influenza virus
VTNATETVEN

SEQ ID NO: 363593 - protein, 10 aa, Influenza virus
TNATETVEST

SEQ ID NO: 363594 - protein, 10 aa, Influenza virus
KDLGSCHPIG

SEQ ID NO: 363595 - protein, 10 aa, Influenza virus
DLGSCHPIGM

SEQ ID NO: 363596 - protein, 10 aa, Influenza virus
GTPACDLYLT

SEQ ID NO: 363597 - protein, 10 aa, Influenza virus
TPACDLYLTG

SEQ ID NO: 363598 - protein, 10 aa, Influenza virus
CDPHLTGTWD

SEQ ID NO: 363599 - protein, 10 aa, Influenza virus
DPHLTGTWDT

SEQ ID NO: 363600 - protein, 10 aa, Influenza virus
LYLTGTWDTL

SEQ ID NO: 363601 - protein, 10 aa, Influenza virus
YLTGTWDTLI

SEQ ID NO: 363602 - protein, 10 aa, Influenza virus
LTGIWDTLIE

SEQ ID NO: 363603 - protein, 10 aa, Influenza virus
TGIWDTLIER

SEQ ID NO: 363604 - protein, 10 aa, Influenza virus
GTWDTLIERE

SEQ ID NO: 363605 - protein, 10 aa, Influenza virus
TWDTLIEREN

SEQ ID NO: 363606 - protein, 10 aa, Influenza virus
WDTLIERENA

SEQ ID NO: 363607 - protein, 10 aa, Influenza virus
AHCYPGATIN

SEQ ID NO: 363608 - protein, 10 aa, Influenza virus
HCYPGATINE

SEQ ID NO: 363609 - protein, 10 aa, Influenza virus
CYPGATINEE

SEQ ID NO: 363610 - protein, 10 aa, Influenza virus
YPGATINEEA

SEQ ID NO: 363611 - protein, 10 aa, Influenza virus
PGATINEEAL

SEQ ID NO: 363612 - protein, 10 aa, Influenza virus
GATINEEALR

SEQ ID NO: 363613 - protein, 10 aa, Influenza virus
ATINEEALRQ

SEQ ID NO: 363614 - protein, 10 aa, Influenza virus
TINEEALRQK

SEQ ID NO: 363615 - protein, 10 aa, Influenza virus
INEEALRQKI

SEQ ID NO: 363616 - protein, 10 aa, Influenza virus
NEGALRQKIM

SEQ ID NO: 363617 - protein, 10 aa, Influenza virus
EGALRQKIME

SEQ ID NO: 363618 - protein, 10 aa, Influenza virus
GALRQKIMES

SEQ ID NO: 363619 - protein, 10 aa, Influenza virus
QKIMESGGIS

SEQ ID NO: 363620 - protein, 10 aa, Influenza virus
KIMESGGISK

SEQ ID NO: 363621 - protein, 10 aa, Influenza virus
IMESGGISKI

SEQ ID NO: 363622 - protein, 10 aa, Influenza virus
MESGGIDKIG

SEQ ID NO: 363623 - protein, 10 aa, Influenza virus
ESGGIDKIGT

SEQ ID NO: 363624 - protein, 10 aa, Influenza virus
GGDSFYAELK

SEQ ID NO: 363625 - protein, 10 aa, Influenza virus
GDSFYAELKW

SEQ ID NO: 363626 - protein, 10 aa, Influenza virus
DSFYAELKWL

SEQ ID NO: 363627 - protein, 10 aa, Influenza virus
SFYAELKWLI

SEQ ID NO: 363628 - protein, 10 aa, Influenza virus
FYAELKWLIS

SEQ ID NO: 363629 - protein, 10 aa, Influenza virus
YAELKWLISK

SEQ ID NO: 363630 - protein, 10 aa, Influenza virus
AELKWLVSKT

SEQ ID NO: 363631 - protein, 10 aa, Influenza virus
ELKWLVSKTK

SEQ ID NO: 363632 - protein, 10 aa, Influenza virus
LKWLVSKTKG

SEQ ID NO: 363633 - protein, 10 aa, Influenza virus
KWLVSKTKGQ

SEQ ID NO: 363634 - protein, 10 aa, Influenza virus
QNFPQTANTY

SEQ ID NO: 363635 - protein, 10 aa, Influenza virus
NFPQTANTYR

SEQ ID NO: 363636 - protein, 10 aa, Influenza virus
FPQTANTYRN

SEQ ID NO: 363637 - protein, 10 aa, Influenza virus
PQTANTYRNT

SEQ ID NO: 363638 - protein, 10 aa, Influenza virus
QTANTYRNTD

SEQ ID NO: 363639 - protein, 10 aa, Influenza virus
TANTYRNTDS

SEQ ID NO: 363640 - protein, 10 aa, Influenza virus
EHLIVWGIHH

SEQ ID NO: 363641 - protein, 10 aa, Influenza virus
HLIVWGIHHP

SEQ ID NO: 363642 - protein, 10 aa, Influenza virus
LIVWGIHHPS

SEQ ID NO: 363643 - protein, 10 aa, Influenza virus
IVWGIHHPSS

SEQ ID NO: 363644 - protein, 10 aa, Influenza virus
WGIHHPSSTK

SEQ ID NO: 363645 - protein, 10 aa, Influenza virus
GIHHPSSTKE

SEQ ID NO: 363646 - protein, 10 aa, Influenza virus
IHHPSSTKEK

SEQ ID NO: 363647 - protein, 10 aa, Influenza virus
HHPSSTKEKN

SEQ ID NO: 363648 - protein, 10 aa, Influenza virus
HPSSTKEKND

SEQ ID NO: 363649 - protein, 10 aa, Influenza virus
PSSAQEKNDL

SEQ ID NO: 363650 - protein, 10 aa, Influenza virus
SSAQEKNDLY

SEQ ID NO: 363651 - protein, 10 aa, Influenza virus
STKEKNDLYG

SEQ ID NO: 363652 - protein, 10 aa, Influenza virus
KEKNDLYGTQ

SEQ ID NO: 363653 - protein, 10 aa, Influenza virus
EKNDLYGTQP

SEQ ID NO: 363654 - protein, 10 aa, Influenza virus
KNELYGTQSL

SEQ ID NO: 363655 - protein, 10 aa, Influenza virus
NDLYGTQPLS

SEQ ID NO: 363656 - protein, 10 aa, Influenza virus
DLYGTQPLSI

SEQ ID NO: 363657 - protein, 10 aa, Influenza virus
LYGTQPLSIS

SEQ ID NO: 363658 - protein, 10 aa, Influenza virus
YGTQSLSISI

SEQ ID NO: 363659 - protein, 10 aa, Influenza virus
GTQSLSISVE

SEQ ID NO: 363660 - protein, 10 aa, Influenza virus
TQSLSISVES

SEQ ID NO: 363661 - protein, 10 aa, Influenza virus
QSLSISVESS

SEQ ID NO: 363662 - protein, 10 aa, Influenza virus
SLSISVESST

SEQ ID NO: 363663 - protein, 10 aa, Influenza virus
LSISVESSTY

SEQ ID NO: 363664 - protein, 10 aa, Influenza virus
SISVESSTYQ

SEQ ID NO: 363665 - protein, 10 aa, Influenza virus
ISVESSTYQN

SEQ ID NO: 363666 - protein, 10 aa, Influenza virus
SVGSSTYQNS

SEQ ID NO: 363667 - protein, 10 aa, Influenza virus
VESSTYQNNF

SEQ ID NO: 363668 - protein, 10 aa, Influenza virus
GSSTYQNSFV

SEQ ID NO: 363669 - protein, 10 aa, Influenza virus
SSTYQNSFVP

SEQ ID NO: 363670 - protein, 10 aa, Influenza virus
STYQNSFVPV

SEQ ID NO: 363671 - protein, 10 aa, Influenza virus
TYQNSFVPVV

SEQ ID NO: 363672 - protein, 10 aa, Influenza virus
YQNSFVPVVG

SEQ ID NO: 363673 - protein, 10 aa, Influenza virus
QNSFVPVVGA

SEQ ID NO: 363674 - protein, 10 aa, Influenza virus
NSFVPVVGAR

SEQ ID NO: 363675 - protein, 10 aa, Influenza virus
SFVPVVGARP

SEQ ID NO: 363676 - protein, 10 aa, Influenza virus
QVNGQSGRIN

SEQ ID NO: 363677 - protein, 10 aa, Influenza virus
VNGQSGRINF

SEQ ID NO: 363678 - protein, 10 aa, Influenza virus
NGQSGRINFH

SEQ ID NO: 363679 - protein, 10 aa, Influenza virus
GQSGRINFHW

SEQ ID NO: 363680 - protein, 10 aa, Influenza virus
QSGRIDFHWA

SEQ ID NO: 363681 - protein, 10 aa, Influenza virus
VRPGDNITFS

SEQ ID NO: 363682 - protein, 10 aa, Influenza virus
RPGDNITFSH

SEQ ID NO: 363683 - protein, 10 aa, Influenza virus
PGDNITFSDN

SEQ ID NO: 363684 - protein, 10 aa, Influenza virus
GDNITFLHNG

SEQ ID NO: 363685 - protein, 10 aa, Influenza virus
DNITFSDNGG

SEQ ID NO: 363686 - protein, 10 aa, Influenza virus
NIIFSHNGGL

SEQ ID NO: 363687 - protein, 10 aa, Influenza virus
ITFLHNGGLI

SEQ ID NO: 363688 - protein, 10 aa, Influenza virus
TFLHNGGLIA

SEQ ID NO: 363689 - protein, 10 aa, Influenza virus
FSHNGGLVAP

SEQ ID NO: 363690 - protein, 10 aa, Influenza virus
SHNGGLIAPD

SEQ ID NO: 363691 - protein, 10 aa, Influenza virus
HNGGLVAPSR

SEQ ID NO: 363692 - protein, 10 aa, Influenza virus
NGGLVAPSRV

SEQ ID NO: 363693 - protein, 10 aa, Influenza virus
GGLIAPSRVT

SEQ ID NO: 363694 - protein, 10 aa, Influenza virus
GLIAPSRVTK

SEQ ID NO: 363695 - protein, 10 aa, Influenza virus
LIAPSRVTKL

SEQ ID NO: 363696 - protein, 10 aa, Influenza virus
APSRVSKLRG

SEQ ID NO: 363697 - protein, 10 aa, Influenza virus
DNNCESKCFW

SEQ ID NO: 363698 - protein, 10 aa, Influenza virus
CESKCFWRGG

SEQ ID NO: 363699 - protein, 10 aa, Influenza virus
ESKCFWRGGS

SEQ ID NO: 363700 - protein, 10 aa, Influenza virus
SKCFWRGGSI

SEQ ID NO: 363701 - protein, 10 aa, Influenza virus
KCFWKGGSIK

SEQ ID NO: 363702 - protein, 10 aa, Influenza virus
CFWKGGSIKT

SEQ ID NO: 363703 - protein, 10 aa, Influenza virus
FWKGGSIKTK

SEQ ID NO: 363704 - protein, 10 aa, Influenza virus
WKGGSIKTKL

SEQ ID NO: 363705 - protein, 10 aa, Influenza virus
KGGSIKTKLP

SEQ ID NO: 363706 - protein, 10 aa, Influenza virus
GGSIKTKLPF

SEQ ID NO: 363707 - protein, 10 aa, Influenza virus
GSIKTKLPFQ

SEQ ID NO: 363708 - protein, 10 aa, Influenza virus
SIKTKLPFQN

SEQ ID NO: 363709 - protein, 10 aa, Influenza virus
IKTKLPFQNL

SEQ ID NO: 363710 - protein, 10 aa, Influenza virus
KTKLPFQNLS

SEQ ID NO: 363711 - protein, 10 aa, Influenza virus
TRLPFQNLSP

SEQ ID NO: 363712 - protein, 10 aa, Influenza virus
RLPFQNLSPR

SEQ ID NO: 363713 - protein, 10 aa, Influenza virus
TVGQCPKYVS

SEQ ID NO: 363714 - protein, 10 aa, Influenza virus
VGQCPKYVSK

SEQ ID NO: 363715 - protein, 10 aa, Influenza virus
RSLLLATGMR

SEQ ID NO: 363716 - protein, 10 aa, Influenza virus
SLMLATGMRN

SEQ ID NO: 363717 - protein, 10 aa, Influenza virus
LMLATGMRNV

SEQ ID NO: 363718 - protein, 10 aa, Influenza virus
MLATGMRNVP

SEQ ID NO: 363719 - protein, 10 aa, Influenza virus
ATGMRNVPEI

SEQ ID NO: 363720 - protein, 10 aa, Influenza virus
QERGLFGAIA

SEQ ID NO: 363721 - protein, 10 aa, Influenza virus
ERGLFGAIAG

SEQ ID NO: 363722 - protein, 10 aa, Influenza virus
GLFGAKAGFI

SEQ ID NO: 363723 - protein, 10 aa, Influenza virus
LFGAKAGFIE

SEQ ID NO: 363724 - protein, 10 aa, Influenza virus
FGAKAGFIEN

SEQ ID NO: 363725 - protein, 10 aa, Influenza virus
GAKAGFIENG

SEQ ID NO: 363726 - protein, 10 aa, Influenza virus
AIAGFLENGW

SEQ ID NO: 363727 - protein, 10 aa, Influenza virus
IAGFLENGWE

SEQ ID NO: 363728 - protein, 10 aa, Influenza virus
IENGWEGMVN

SEQ ID NO: 363729 - protein, 10 aa, Influenza virus
QGTGQAADYE

SEQ ID NO: 363730 - protein, 10 aa, Influenza virus
GTGQAADYES

SEQ ID NO: 363731 - protein, 10 aa, Influenza virus
TGQAADYEST

SEQ ID NO: 363732 - protein, 10 aa, Influenza virus
GQAADYESTQ

SEQ ID NO: 363733 - protein, 10 aa, Influenza virus
QAADYESTQA

SEQ ID NO: 363734 - protein, 10 aa, Influenza virus
AADYESTQAA

SEQ ID NO: 363735 - protein, 10 aa, Influenza virus
ADYKSTQAAV

SEQ ID NO: 363736 - protein, 10 aa, Influenza virus
DYKSTQAAVD

SEQ ID NO: 363737 - protein, 10 aa, Influenza virus
YKSTQAAVDQ

SEQ ID NO: 363738 - protein, 10 aa, Influenza virus
KSTQAAVDQI

SEQ ID NO: 363739 - protein, 10 aa, Influenza virus
STQAAVDQIT

SEQ ID NO: 363740 - protein, 10 aa, Influenza virus
TQAAVDQITG

SEQ ID NO: 363741 - protein, 10 aa, Influenza virus
QAAVDQITGK

SEQ ID NO: 363742 - protein, 10 aa, Influenza virus
AAVDQITGKL

SEQ ID NO: 363743 - protein, 10 aa, Influenza virus
AVDQITGKLN

SEQ ID NO: 363744 - protein, 10 aa, Influenza virus
VDQITGKLNR

SEQ ID NO: 363745 - protein, 10 aa, Influenza virus
DQVTGKLNRL

SEQ ID NO: 363746 - protein, 10 aa, Influenza virus
QVTGKLNRLI

SEQ ID NO: 363747 - protein, 10 aa, Influenza virus
VTGKLNRLIE

SEQ ID NO: 363748 - protein, 10 aa, Influenza virus
EFESIESEFN

SEQ ID NO: 363749 - protein, 10 aa, Influenza virus
FESIESEFNE

SEQ ID NO: 363750 - protein, 10 aa, Influenza virus
ESIESEFNEI

SEQ ID NO: 363751 - protein, 10 aa, Influenza virus
SIESEFNEIE

SEQ ID NO: 363752 - protein, 10 aa, Influenza virus
IESEFNEIEH

SEQ ID NO: 363753 - protein, 10 aa, Influenza virus
ESEFNEIEHQ

SEQ ID NO: 363754 - protein, 10 aa, Influenza virus
SEFNEIEHQI

SEQ ID NO: 363755 - protein, 10 aa, Influenza virus
EFNEIEHQIG

SEQ ID NO: 363756 - protein, 10 aa, Influenza virus
FNEIEHQIGN

SEQ ID NO: 363757 - protein, 10 aa, Influenza virus
NEIEHQIGNV

SEQ ID NO: 363758 - protein, 10 aa, Influenza virus
ETEHQIGNVI

SEQ ID NO: 363759 - protein, 10 aa, Influenza virus
TEHQIGNVIN

SEQ ID NO: 363760 - protein, 10 aa, Influenza virus
EYQIGNVINW

SEQ ID NO: 363761 - protein, 10 aa, Influenza virus
YQIGNVINWT

SEQ ID NO: 363762 - protein, 10 aa, Influenza virus
IWTYNAELLV

SEQ ID NO: 363763 - protein, 10 aa, Influenza virus
WTYNAELLVA

SEQ ID NO: 363764 - protein, 10 aa, Influenza virus
TYQAELLIAM

SEQ ID NO: 363765 - protein, 10 aa, Influenza virus
YQAELLIAME

SEQ ID NO: 363766 - protein, 10 aa, Influenza virus
QAELLIAMEN

SEQ ID NO: 363767 - protein, 10 aa, Influenza virus
QHTIDMADST

SEQ ID NO: 363768 - protein, 10 aa, Influenza virus
HTIDMADSTM

SEQ ID NO: 363769 - protein, 10 aa, Influenza virus
TIDLADSEML

SEQ ID NO: 363770 - protein, 10 aa, Influenza virus
IDMADSTMLN

SEQ ID NO: 363771 - protein, 10 aa, Influenza virus
DLADSEMLNL

SEQ ID NO: 363772 - protein, 10 aa, Influenza virus
LADSEMLNLY

SEQ ID NO: 363773 - protein, 10 aa, Influenza virus
ADSEMLNLYD

SEQ ID NO: 363774 - protein, 10 aa, Influenza virus
DSEMLNLYDR

SEQ ID NO: 363775 - protein, 10 aa, Influenza virus
SEMLNLYDRV

SEQ ID NO: 363776 - protein, 10 aa, Influenza virus
EMLNLYDRVR

SEQ ID NO: 363777 - protein, 10 aa, Influenza virus
MLNLYDRVRK

SEQ ID NO: 363778 - protein, 10 aa, Influenza virus
LNLYDRVRKQ

SEQ ID NO: 363779 - protein, 10 aa, Influenza virus
NLYDRVRKQL

SEQ ID NO: 363780 - protein, 10 aa, Influenza virus
LYDRVRKQLR

SEQ ID NO: 363781 - protein, 10 aa, Influenza virus
YDRVRKQLRQ

SEQ ID NO: 363782 - protein, 10 aa, Influenza virus
DRVRKQLRQN

SEQ ID NO: 363783 - protein, 10 aa, Influenza virus
LRQNAEEDGR

SEQ ID NO: 363784 - protein, 10 aa, Influenza virus
RQNAEEDGRG

SEQ ID NO: 363785 - protein, 10 aa, Influenza virus
QNAEEDGRGC

SEQ ID NO: 363786 - protein, 10 aa, Influenza virus
NAEEDGRGCF

SEQ ID NO: 363787 - protein, 10 aa, Influenza virus
AEEDGRGCFE

SEQ ID NO: 363788 - protein, 10 aa, Influenza virus
EEDGRGCFEI

SEQ ID NO: 363789 - protein, 10 aa, Influenza virus
EDGRGCFEIY

SEQ ID NO: 363790 - protein, 10 aa, Influenza virus
DGRGCFEIYH

SEQ ID NO: 363791 - protein, 10 aa, Influenza virus
GKGCFEIYHA

SEQ ID NO: 363792 - protein, 10 aa, Influenza virus
KGCFEIYHAC

SEQ ID NO: 363793 - protein, 10 aa, Influenza virus
GCFEIYHACD

SEQ ID NO: 363794 - protein, 10 aa, Influenza virus
CDDSCMESIR

SEQ ID NO: 363795 - protein, 10 aa, Influenza virus
DSCMESIRNN

SEQ ID NO: 363796 - protein, 10 aa, Influenza virus
SCMESIRNNT

SEQ ID NO: 363797 - protein, 10 aa, Influenza virus
CMERIRNNTY

SEQ ID NO: 363798 - protein, 10 aa, Influenza virus
MESIRDNTYD

SEQ ID NO: 363799 - protein, 10 aa, Influenza virus
ESIRDNTYDH

SEQ ID NO: 363800 - protein, 10 aa, Influenza virus
SIRNNTYDHA

SEQ ID NO: 363801 - protein, 10 aa, Influenza virus
IRNNTYDHAQ

SEQ ID NO: 363802 - protein, 10 aa, Influenza virus
RNNTYDHAQY

SEQ ID NO: 363803 - protein, 10 aa, Influenza virus
NNTYDHAQYR

SEQ ID NO: 363804 - protein, 10 aa, Influenza virus
NTYDHAQYRE

SEQ ID NO: 363805 - protein, 10 aa, Influenza virus
TYDHAQYREE

SEQ ID NO: 363806 - protein, 10 aa, Influenza virus
YDHAQYREEA

SEQ ID NO: 363807 - protein, 10 aa, Influenza virus
DHAQYREEAL

SEQ ID NO: 363808 - protein, 10 aa, Influenza virus
HAQYREEALL

SEQ ID NO: 363809 - protein, 10 aa, Influenza virus
AQYREEALLN

SEQ ID NO: 363810 - protein, 10 aa, Influenza virus
REEALLNRLS

SEQ ID NO: 363811 - protein, 10 aa, Influenza virus
EEALLNRLSI

SEQ ID NO: 363812 - protein, 10 aa, Influenza virus
EALLNRLSIN

SEQ ID NO: 363813 - protein, 10 aa, Influenza virus
ALLNRLNINS

SEQ ID NO: 363814 - protein, 10 aa, Influenza virus
LLNRLNINSV

SEQ ID NO: 363815 - protein, 10 aa, Influenza virus
LNRLNINSVK

SEQ ID NO: 363816 - protein, 10 aa, Influenza virus
NRLNINSVKL

SEQ ID NO: 363817 - protein, 10 aa, Influenza virus
RLNINSVKLS

SEQ ID NO: 363818 - protein, 10 aa, Influenza virus
LNINSVKLSS

SEQ ID NO: 363819 - protein, 10 aa, Influenza virus
NINSVKLSSG

SEQ ID NO: 363820 - protein, 10 aa, Influenza virus
INSVKLSSGY

SEQ ID NO: 363821 - protein, 10 aa, Influenza virus
NSVKLSSGYK

SEQ ID NO: 363822 - protein, 10 aa, Influenza virus
SVKLSSGYKD

SEQ ID NO: 363823 - protein, 10 aa, Influenza virus
VKLSSGYKDI

SEQ ID NO: 363824 - protein, 10 aa, Influenza virus
KLSSGYKDII

SEQ ID NO: 363825 - protein, 10 aa, Influenza virus
LSSGYKDIIL

SEQ ID NO: 363826 - protein, 10 aa, Influenza virus
SSGYKDIILW

SEQ ID NO: 363827 - protein, 10 aa, Influenza virus
SGYKDIILWF

SEQ ID NO: 363828 - protein, 10 aa, Influenza virus
GYKDIILWFS

SEQ ID NO: 363829 - protein, 10 aa, Influenza virus
YKDIILWFSF

SEQ ID NO: 363830 - protein, 10 aa, Influenza virus
KDIILWFSFG

SEQ ID NO: 363831 - protein, 10 aa, Influenza virus
DIILWFSFGA

SEQ ID NO: 363832 - protein, 10 aa, Influenza virus
IILWFSFGAS

SEQ ID NO: 363833 - protein, 10 aa, Influenza virus
WFSFGASCFI

SEQ ID NO: 363834 - protein, 10 aa, Influenza virus
FSFGASCFIL

SEQ ID NO: 363835 - protein, 10 aa, Influenza virus
SFGASCFILL

SEQ ID NO: 363836 - protein, 10 aa, Influenza virus
FGASCFILLA

SEQ ID NO: 363837 - protein, 10 aa, Influenza virus
GASCFILLAV

SEQ ID NO: 363838 - protein, 10 aa, Influenza virus
VMGLVFFCLK

SEQ ID NO: 363839 - protein, 10 aa, Influenza virus
MGLVFFCLRN

SEQ ID NO: 363840 - protein, 10 aa, Influenza virus
GLVFFCLRNG

SEQ ID NO: 363841 - protein, 10 aa, Influenza virus
LVFFCLRNGN

SEQ ID NO: 363842 - protein, 10 aa, Influenza virus
VFFCLRNGNM

SEQ ID NO: 363843 - protein, 10 aa, Influenza virus
FFCLRNGNMR

SEQ ID NO: 363844 - protein, 10 aa, Influenza virus
FCLRNGNMRC

SEQ ID NO: 363845 - protein, 10 aa, Influenza virus
CLRNGNMRCT

SEQ ID NO: 363846 - protein, 10 aa, Influenza virus
LRNGNMRCTI

SEQ ID NO: 363847 - protein, 10 aa, Influenza virus
RNGNMRCTIC

SEQ ID NO: 363848 - protein, 10 aa, Influenza virus
MNPNQKLFTL

SEQ ID NO: 363849 - protein, 10 aa, Influenza virus
NPNQKLFTLS

SEQ ID NO: 363850 - protein, 10 aa, Influenza virus
PNQKLFTLSG

SEQ ID NO: 363851 - protein, 10 aa, Influenza virus
NQKLFTLSGV

SEQ ID NO: 363852 - protein, 10 aa, Influenza virus
QKLFTLSGVA

SEQ ID NO: 363853 - protein, 10 aa, Influenza virus
KLFTLSGVAI

SEQ ID NO: 363854 - protein, 10 aa, Influenza virus
LFTLSGVAIA

SEQ ID NO: 363855 - protein, 10 aa, Influenza virus
FTLSGVAIAL

SEQ ID NO: 363856 - protein, 10 aa, Influenza virus
LNLIIGISNV

SEQ ID NO: 363857 - protein, 10 aa, Influenza virus
NLIIGISNVG

SEQ ID NO: 363858 - protein, 10 aa, Influenza virus
LIIGISNVGL

SEQ ID NO: 363859 - protein, 10 aa, Influenza virus
IIGISNVGLN

SEQ ID NO: 363860 - protein, 10 aa, Influenza virus
IGISNVGLNI

SEQ ID NO: 363861 - protein, 10 aa, Influenza virus
GISNVGLNIS

SEQ ID NO: 363862 - protein, 10 aa, Influenza virus
ISNVGLNISL

SEQ ID NO: 363863 - protein, 10 aa, Influenza virus
SNVGLKVSLH

SEQ ID NO: 363864 - protein, 10 aa, Influenza virus
NVGLNISLHL

SEQ ID NO: 363865 - protein, 10 aa, Influenza virus
VGLNISLHLK

SEQ ID NO: 363866 - protein, 10 aa, Influenza virus
EKGAKQEENL

SEQ ID NO: 363867 - protein, 10 aa, Influenza virus
TQNNTTVVEN

SEQ ID NO: 363868 - protein, 10 aa, Influenza virus
QNNTTVVENT

SEQ ID NO: 363869 - protein, 10 aa, Influenza virus
NNTTVVENTY

SEQ ID NO: 363870 - protein, 10 aa, Influenza virus
NTTVVENTYV

SEQ ID NO: 363871 - protein, 10 aa, Influenza virus
TTVVENTYVN

SEQ ID NO: 363872 - protein, 10 aa, Influenza virus
TVVENTYVNN

SEQ ID NO: 363873 - protein, 10 aa, Influenza virus
VVENTYVNNT

SEQ ID NO: 363874 - protein, 10 aa, Influenza virus
VENTYVNNTT

SEQ ID NO: 363875 - protein, 10 aa, Influenza virus
ENTYVNNTTI

SEQ ID NO: 363876 - protein, 10 aa, Influenza virus
NTYVNNTTII

SEQ ID NO: 363877 - protein, 10 aa, Influenza virus
YVNNTTIITK

SEQ ID NO: 363878 - protein, 10 aa, Influenza virus
YLVLNKSLCK

SEQ ID NO: 363879 - protein, 10 aa, Influenza virus
LVLNKSLCKV

SEQ ID NO: 363880 - protein, 10 aa, Influenza virus
VLNKSLCKVE

SEQ ID NO: 363881 - protein, 10 aa, Influenza virus
LNKSLCNVEG

SEQ ID NO: 363882 - protein, 10 aa, Influenza virus
NKSLCNVEGW

SEQ ID NO: 363883 - protein, 10 aa, Influenza virus
KSLCNVEGWV

SEQ ID NO: 363884 - protein, 10 aa, Influenza virus
SLCNVEGWVV

SEQ ID NO: 363885 - protein, 10 aa, Influenza virus
LCNVEGWVVI

SEQ ID NO: 363886 - protein, 10 aa, Influenza virus
CNVEGWVVIA

SEQ ID NO: 363887 - protein, 10 aa, Influenza virus
NVEGWVVIAK

SEQ ID NO: 363888 - protein, 10 aa, Influenza virus
VEGWVVIAKD

SEQ ID NO: 363889 - protein, 10 aa, Influenza virus
EGWVVIAKDN

SEQ ID NO: 363890 - protein, 10 aa, Influenza virus
GWVVIAKDNA

SEQ ID NO: 363891 - protein, 10 aa, Influenza virus
WVVIAKDNAV

SEQ ID NO: 363892 - protein, 10 aa, Influenza virus
VVIAKDNAVR

SEQ ID NO: 363893 - protein, 10 aa, Influenza virus
VIAKDNAVRF

SEQ ID NO: 363894 - protein, 10 aa, Influenza virus
IAKDNAVRFG

SEQ ID NO: 363895 - protein, 10 aa, Influenza virus
AKDNAVRFGE

SEQ ID NO: 363896 - protein, 10 aa, Influenza virus
KDNAVRFGES

SEQ ID NO: 363897 - protein, 10 aa, Influenza virus
DNAVRFGESE

SEQ ID NO: 363898 - protein, 10 aa, Influenza virus
NAVRFGESEQ

SEQ ID NO: 363899 - protein, 10 aa, Influenza virus
AIRFGESEQV

SEQ ID NO: 363900 - protein, 10 aa, Influenza virus
VRFGESEQII

SEQ ID NO: 363901 - protein, 10 aa, Influenza virus
RFGESEQVIV

SEQ ID NO: 363902 - protein, 10 aa, Influenza virus
FGESEQVIVT

SEQ ID NO: 363903 - protein, 10 aa, Influenza virus
GESEQVIVTR

SEQ ID NO: 363904 - protein, 10 aa, Influenza virus
ESEQVIVTRE

SEQ ID NO: 363905 - protein, 10 aa, Influenza virus
SEQVIVTREP

SEQ ID NO: 363906 - protein, 10 aa, Influenza virus
EQVIVTREPY

SEQ ID NO: 363907 - protein, 10 aa, Influenza virus
QVIVTREPYV

SEQ ID NO: 363908 - protein, 10 aa, Influenza virus
VIVTREPYVS

SEQ ID NO: 363909 - protein, 10 aa, Influenza virus
REPYVSCDPT

SEQ ID NO: 363910 - protein, 10 aa, Influenza virus
EPYVSCDPTG

SEQ ID NO: 363911 - protein, 10 aa, Influenza virus
PYVSCDPTGC

SEQ ID NO: 363912 - protein, 10 aa, Influenza virus
YVSCDPLGCR

SEQ ID NO: 363913 - protein, 10 aa, Influenza virus
VSCDPLGCRM

SEQ ID NO: 363914 - protein, 10 aa, Influenza virus
SCDPLGCRMY

SEQ ID NO: 363915 - protein, 10 aa, Influenza virus
CDPLGCRMYA

SEQ ID NO: 363916 - protein, 10 aa, Influenza virus
DPLGCRMYAL

SEQ ID NO: 363917 - protein, 10 aa, Influenza virus
PLGCRMYALH

SEQ ID NO: 363918 - protein, 10 aa, Influenza virus
LGCRMYALHQ

SEQ ID NO: 363919 - protein, 10 aa, Influenza virus
GCRMYALHQG

SEQ ID NO: 363920 - protein, 10 aa, Influenza virus
CRMYALHQGT

SEQ ID NO: 363921 - protein, 10 aa, Influenza virus
RMYALHQGTT

SEQ ID NO: 363922 - protein, 10 aa, Influenza virus
LHQGTTIRNR

SEQ ID NO: 363923 - protein, 10 aa, Influenza virus
HQGTTIRNRH

SEQ ID NO: 363924 - protein, 10 aa, Influenza virus
QGTTIRNRHS

SEQ ID NO: 363925 - protein, 10 aa, Influenza virus
GTTIRNRHSN

SEQ ID NO: 363926 - protein, 10 aa, Influenza virus
TTIRNRHSNG

SEQ ID NO: 363927 - protein, 10 aa, Influenza virus
TIRNRHSNGT

SEQ ID NO: 363928 - protein, 10 aa, Influenza virus
IRNRHSNGTI

SEQ ID NO: 363929 - protein, 10 aa, Influenza virus
RNRHSNGTIH

SEQ ID NO: 363930 - protein, 10 aa, Influenza virus
NRHSNGTIHD

SEQ ID NO: 363931 - protein, 10 aa, Influenza virus
RHSNGTIHDR

SEQ ID NO: 363932 - protein, 10 aa, Influenza virus
HDRTAFRGLM

SEQ ID NO: 363933 - protein, 10 aa, Influenza virus
DRTAFRGLMS

SEQ ID NO: 363934 - protein, 10 aa, Influenza virus
RTAFRGLMST

SEQ ID NO: 363935 - protein, 10 aa, Influenza virus
TAFRGLMSTP

SEQ ID NO: 363936 - protein, 10 aa, Influenza virus
AFRGLMSTPL

SEQ ID NO: 363937 - protein, 10 aa, Influenza virus
FRGLMSTPLG

SEQ ID NO: 363938 - protein, 10 aa, Influenza virus
RGLISTPLGT

SEQ ID NO: 363939 - protein, 10 aa, Influenza virus
GLISTPLGTP

SEQ ID NO: 363940 - protein, 10 aa, Influenza virus
LISTPLGTPP

SEQ ID NO: 363941 - protein, 10 aa, Influenza virus
ISTPLGSPPV

SEQ ID NO: 363942 - protein, 10 aa, Influenza virus
STPLGSPPVV

SEQ ID NO: 363943 - protein, 10 aa, Influenza virus
TPLGSPPVVS

SEQ ID NO: 363944 - protein, 10 aa, Influenza virus
PLGSPPVVSN

SEQ ID NO: 363945 - protein, 10 aa, Influenza virus
LGSPPVVSNS

SEQ ID NO: 363946 - protein, 10 aa, Influenza virus
GSPPVVSNSD

SEQ ID NO: 363947 - protein, 10 aa, Influenza virus
SPPVVSNSDF

SEQ ID NO: 363948 - protein, 10 aa, Influenza virus
VSNSEFLCVG

SEQ ID NO: 363949 - protein, 10 aa, Influenza virus
SNSEFLCVGW

SEQ ID NO: 363950 - protein, 10 aa, Influenza virus
NSEFLCVGWS

SEQ ID NO: 363951 - protein, 10 aa, Influenza virus
SEFLCVGWSS

SEQ ID NO: 363952 - protein, 10 aa, Influenza virus
EFLCVGWSST

SEQ ID NO: 363953 - protein, 10 aa, Influenza virus
FICVGWSSTS

SEQ ID NO: 363954 - protein, 10 aa, Influenza virus
ICVGWSSTSC

SEQ ID NO: 363955 - protein, 10 aa, Influenza virus
CVGWSSTTCH

SEQ ID NO: 363956 - protein, 10 aa, Influenza virus
VGWSSTTCHD

SEQ ID NO: 363957 - protein, 10 aa, Influenza virus
GWSSTTCHDG

SEQ ID NO: 363958 - protein, 10 aa, Influenza virus
WSSTSCHDGV

SEQ ID NO: 363959 - protein, 10 aa, Influenza virus
SSTSCHDGVG

SEQ ID NO: 363960 - protein, 10 aa, Influenza virus
STSCHDGVGR

SEQ ID NO: 363961 - protein, 10 aa, Influenza virus
TSCHDGVGRM

SEQ ID NO: 363962 - protein, 10 aa, Influenza virus
SCHDGVGRMT

SEQ ID NO: 363963 - protein, 10 aa, Influenza virus
CHDGVGRMTI

SEQ ID NO: 363964 - protein, 10 aa, Influenza virus
HDGVGRMTIC

SEQ ID NO: 363965 - protein, 10 aa, Influenza virus
DGVGRMTICV

SEQ ID NO: 363966 - protein, 10 aa, Influenza virus
GVGRMTICVQ

SEQ ID NO: 363967 - protein, 10 aa, Influenza virus
VGRMTICVQG

SEQ ID NO: 363968 - protein, 10 aa, Influenza virus
GRMTICIQGN

SEQ ID NO: 363969 - protein, 10 aa, Influenza virus
RMTICIQGNN

SEQ ID NO: 363970 - protein, 10 aa, Influenza virus
MTICVQGNNN

SEQ ID NO: 363971 - protein, 10 aa, Influenza virus
TICVQGNNNN

SEQ ID NO: 363972 - protein, 10 aa, Influenza virus
ICVQGNNNNA

SEQ ID NO: 363973 - protein, 10 aa, Influenza virus
CVQGNNNNAT

SEQ ID NO: 363974 - protein, 10 aa, Influenza virus
VQGNNNNATA

SEQ ID NO: 363975 - protein, 10 aa, Influenza virus
QGNNNNATAT

SEQ ID NO: 363976 - protein, 10 aa, Influenza virus
GNNNNATATV

SEQ ID NO: 363977 - protein, 10 aa, Influenza virus
NNNNATATVY

SEQ ID NO: 363978 - protein, 10 aa, Influenza virus
NNNATATVYY

SEQ ID NO: 363979 - protein, 10 aa, Influenza virus
NNATATVYYD

SEQ ID NO: 363980 - protein, 10 aa, Influenza virus
NATATVYYNR

SEQ ID NO: 363981 - protein, 10 aa, Influenza virus
ATATVYYNRR

SEQ ID NO: 363982 - protein, 10 aa, Influenza virus
TATVYYNRRL

SEQ ID NO: 363983 - protein, 10 aa, Influenza virus
ATVYYNRRLT

SEQ ID NO: 363984 - protein, 10 aa, Influenza virus
TVYYNRRLTT

SEQ ID NO: 363985 - protein, 10 aa, Influenza virus
VYYNRRLTTT

SEQ ID NO: 363986 - protein, 10 aa, Influenza virus
YYNRRLTTTI

SEQ ID NO: 363987 - protein, 10 aa, Influenza virus
YNRRLTTTIK

SEQ ID NO: 363988 - protein, 10 aa, Influenza virus
NRRLTTTIKT

SEQ ID NO: 363989 - protein, 10 aa, Influenza virus
RRLTTTIKPW

SEQ ID NO: 363990 - protein, 10 aa, Influenza virus
RLTTTIKPWA

SEQ ID NO: 363991 - protein, 10 aa, Influenza virus
LTTTIKTWAR

SEQ ID NO: 363992 - protein, 10 aa, Influenza virus
TTTIKTWARN

SEQ ID NO: 363993 - protein, 10 aa, Influenza virus
TTIKTWARNI

SEQ ID NO: 363994 - protein, 10 aa, Influenza virus
TIKTWARNIL

SEQ ID NO: 363995 - protein, 10 aa, Influenza virus
IKTWARNILR

SEQ ID NO: 363996 - protein, 10 aa, Influenza virus
KTWARNILRT

SEQ ID NO: 363997 - protein, 10 aa, Influenza virus
TWARNILRTQ

SEQ ID NO: 363998 - protein, 10 aa, Influenza virus
WARNILRTQE

SEQ ID NO: 363999 - protein, 10 aa, Influenza virus
ARNILRTQES

SEQ ID NO: 364000 - protein, 10 aa, Influenza virus
RNILRTQESE

SEQ ID NO: 364001 - protein, 10 aa, Influenza virus
KILRTQESEC

SEQ ID NO: 364002 - protein, 10 aa, Influenza virus
ECVCHNGTCA

SEQ ID NO: 364003 - protein, 10 aa, Influenza virus
CVCHNGTCAV

SEQ ID NO: 364004 - protein, 10 aa, Influenza virus
VCHNGTCVVV

SEQ ID NO: 364005 - protein, 10 aa, Influenza virus
CHNGTCVVVM

SEQ ID NO: 364006 - protein, 10 aa, Influenza virus
HNGTCVVVMT

SEQ ID NO: 364007 - protein, 10 aa, Influenza virus
NGTCVVVMTD

SEQ ID NO: 364008 - protein, 10 aa, Influenza virus
GTCVVVMTDG

SEQ ID NO: 364009 - protein, 10 aa, Influenza virus
TCVVVMTDGS

SEQ ID NO: 364010 - protein, 10 aa, Influenza virus
CVVVMTDGSA

SEQ ID NO: 364011 - protein, 10 aa, Influenza virus
VVVMTDGSAS

SEQ ID NO: 364012 - protein, 10 aa, Influenza virus
VVMTDGSASS

SEQ ID NO: 364013 - protein, 10 aa, Influenza virus
VMTDGSASSQ

SEQ ID NO: 364014 - protein, 10 aa, Influenza virus
MTDGSANSQA

SEQ ID NO: 364015 - protein, 10 aa, Influenza virus
TDGSASSQAH

SEQ ID NO: 364016 - protein, 10 aa, Influenza virus
DGSASSQAHT

SEQ ID NO: 364017 - protein, 10 aa, Influenza virus
GSASSQAHTK

SEQ ID NO: 364018 - protein, 10 aa, Influenza virus
QAHTKVLYFH

SEQ ID NO: 364019 - protein, 10 aa, Influenza virus
AHTKVLYFHK

SEQ ID NO: 364020 - protein, 10 aa, Influenza virus
HTKVLYFHKG

SEQ ID NO: 364021 - protein, 10 aa, Influenza virus
TKVMYFHKGL

SEQ ID NO: 364022 - protein, 10 aa, Influenza virus
YFHKGLIIKE

SEQ ID NO: 364023 - protein, 10 aa, Influenza virus
FHKGLIIKEE

SEQ ID NO: 364024 - protein, 10 aa, Influenza virus
KEEPLKGSAK

SEQ ID NO: 364025 - protein, 10 aa, Influenza virus
EEPLKGSAKH

SEQ ID NO: 364026 - protein, 10 aa, Influenza virus
LKGSAKHIEE

SEQ ID NO: 364027 - protein, 10 aa, Influenza virus
KGSAKHIEEC

SEQ ID NO: 364028 - protein, 10 aa, Influenza virus
GSAKHIEECS

SEQ ID NO: 364029 - protein, 10 aa, Influenza virus
SAKHIEECSC

SEQ ID NO: 364030 - protein, 10 aa, Influenza virus
AKHIEECSCY

SEQ ID NO: 364031 - protein, 10 aa, Influenza virus
KHIEECSCYG

SEQ ID NO: 364032 - protein, 10 aa, Influenza virus
HIEECPCYGH

SEQ ID NO: 364033 - protein, 10 aa, Influenza virus
IEECSCYGHD

SEQ ID NO: 364034 - protein, 10 aa, Influenza virus
EECSCYGHDS

SEQ ID NO: 364035 - protein, 10 aa, Influenza virus
ECSCYGHDSK

SEQ ID NO: 364036 - protein, 10 aa, Influenza virus
CYGHDSKVTC

SEQ ID NO: 364037 - protein, 10 aa, Influenza virus
QKITCVCRDN

SEQ ID NO: 364038 - protein, 10 aa, Influenza virus
KITCVCRDNW

SEQ ID NO: 364039 - protein, 10 aa, Influenza virus
ITCVCRDNWQ

SEQ ID NO: 364040 - protein, 10 aa, Influenza virus
DNWQGANRPI

SEQ ID NO: 364041 - protein, 10 aa, Influenza virus
NWQGANRPII

SEQ ID NO: 364042 - protein, 10 aa, Influenza virus
WQGANRPIIE

SEQ ID NO: 364043 - protein, 10 aa, Influenza virus
QGANRPVIKI

SEQ ID NO: 364044 - protein, 10 aa, Influenza virus
GANRPVIKID

SEQ ID NO: 364045 - protein, 10 aa, Influenza virus
ANRPVIKIDM

SEQ ID NO: 364046 - protein, 10 aa, Influenza virus
TLEHTSRYVC

SEQ ID NO: 364047 - protein, 10 aa, Influenza virus
LEHTSRYVCT

SEQ ID NO: 364048 - protein, 10 aa, Influenza virus
EHTSRYVCTG

SEQ ID NO: 364049 - protein, 10 aa, Influenza virus
HTSRYVCTGI

SEQ ID NO: 364050 - protein, 10 aa, Influenza virus
TSRYVCTGIL

SEQ ID NO: 364051 - protein, 10 aa, Influenza virus
SRYVCTGILT

SEQ ID NO: 364052 - protein, 10 aa, Influenza virus
RYVCTGILTD

SEQ ID NO: 364053 - protein, 10 aa, Influenza virus
YVCTGILTDT

SEQ ID NO: 364054 - protein, 10 aa, Influenza virus
VCTGILTDTS

SEQ ID NO: 364055 - protein, 10 aa, Influenza virus
CTGILTDTSR

SEQ ID NO: 364056 - protein, 10 aa, Influenza virus
TGILTDTSRP

SEQ ID NO: 364057 - protein, 10 aa, Influenza virus
GILTDTSRPG

SEQ ID NO: 364058 - protein, 10 aa, Influenza virus
ILTDTSRPGD

SEQ ID NO: 364059 - protein, 10 aa, Influenza virus
LTDTSRPGDK

SEQ ID NO: 364060 - protein, 10 aa, Influenza virus
GDCSNPITGS

SEQ ID NO: 364061 - protein, 10 aa, Influenza virus
DCSNPITGSP

SEQ ID NO: 364062 - protein, 10 aa, Influenza virus
CSNPITGSPG

SEQ ID NO: 364063 - protein, 10 aa, Influenza virus
SNPITGSPGA

SEQ ID NO: 364064 - protein, 10 aa, Influenza virus
NPITGSPSAP

SEQ ID NO: 364065 - protein, 10 aa, Influenza virus
PITGSPSAPG

SEQ ID NO: 364066 - protein, 10 aa, Influenza virus
ITGSPSAPGV

SEQ ID NO: 364067 - protein, 10 aa, Influenza virus
TGSPSAPGVK

SEQ ID NO: 364068 - protein, 10 aa, Influenza virus
GSPSAPGVKG

SEQ ID NO: 364069 - protein, 10 aa, Influenza virus
SPSAPGVKGF

SEQ ID NO: 364070 - protein, 10 aa, Influenza virus
PSAPGVKGFG

SEQ ID NO: 364071 - protein, 10 aa, Influenza virus
SAPGVKGFGF

SEQ ID NO: 364072 - protein, 10 aa, Influenza virus
PGVKGFGFLN

SEQ ID NO: 364073 - protein, 10 aa, Influenza virus
GVKGFGFLNG

SEQ ID NO: 364074 - protein, 10 aa, Influenza virus
SNTWLGRTIS

SEQ ID NO: 364075 - protein, 10 aa, Influenza virus
NTWLGRTFSP

SEQ ID NO: 364076 - protein, 10 aa, Influenza virus
TWLGGTISPR

SEQ ID NO: 364077 - protein, 10 aa, Influenza virus
WLGRTFSPRS

SEQ ID NO: 364078 - protein, 10 aa, Influenza virus
LGRTFSPRSR

SEQ ID NO: 364079 - protein, 10 aa, Influenza virus
GRTISPHSRS

SEQ ID NO: 364080 - protein, 10 aa, Influenza virus
RTFSPRSRSG

SEQ ID NO: 364081 - protein, 10 aa, Influenza virus
TISPHSRSGF

SEQ ID NO: 364082 - protein, 10 aa, Influenza virus
ISPHSRSGFE

SEQ ID NO: 364083 - protein, 10 aa, Influenza virus
SRSGFEMLKV

SEQ ID NO: 364084 - protein, 10 aa, Influenza virus
RSGFEMLKVP

SEQ ID NO: 364085 - protein, 10 aa, Influenza virus
SGFEMLKVPN

SEQ ID NO: 364086 - protein, 10 aa, Influenza virus
GFEMLKVPNA

SEQ ID NO: 364087 - protein, 10 aa, Influenza virus
FEMLKIPNAE

SEQ ID NO: 364088 - protein, 10 aa, Influenza virus
EMLKIPNAET

SEQ ID NO: 364089 - protein, 10 aa, Influenza virus
MLKIPNAETD

SEQ ID NO: 364090 - protein, 10 aa, Influenza virus
LKIPNAETDP

SEQ ID NO: 364091 - protein, 10 aa, Influenza virus
KIPNAETDPN

SEQ ID NO: 364092 - protein, 10 aa, Influenza virus
IPNAETDPNS

SEQ ID NO: 364093 - protein, 10 aa, Influenza virus
NSNWSGYSGS

SEQ ID NO: 364094 - protein, 10 aa, Influenza virus
SNWSGYSGSF

SEQ ID NO: 364095 - protein, 10 aa, Influenza virus
NLSGYSGSFI

SEQ ID NO: 364096 - protein, 10 aa, Influenza virus
YSGSFIDYWN

SEQ ID NO: 364097 - protein, 10 aa, Influenza virus
SGSFIDYWDD

SEQ ID NO: 364098 - protein, 10 aa, Influenza virus
NECYNPCFYV

SEQ ID NO: 364099 - protein, 10 aa, Influenza virus
VCYNPCFYVE

SEQ ID NO: 364100 - protein, 10 aa, Influenza virus
ELIRGRPEEV

SEQ ID NO: 364101 - protein, 10 aa, Influenza virus
LIRGRPEEVK

SEQ ID NO: 364102 - protein, 10 aa, Influenza virus
IRGRPEEVKY

SEQ ID NO: 364103 - protein, 10 aa, Influenza virus
RGRPEEVKYV

SEQ ID NO: 364104 - protein, 10 aa, Influenza virus
GRPEEVKYVW

SEQ ID NO: 364105 - protein, 10 aa, Influenza virus
RPEEVKYVWW

SEQ ID NO: 364106 - protein, 10 aa, Influenza virus
PEEVKYVWWT

SEQ ID NO: 364107 - protein, 10 aa, Influenza virus
EEVKYVWWTS

SEQ ID NO: 364108 - protein, 10 aa, Influenza virus
EVKYVWWTSN

SEQ ID NO: 364109 - protein, 10 aa, Influenza virus
VKYVWWTSNS

SEQ ID NO: 364110 - protein, 10 aa, Influenza virus
YVWWTSNSLI

SEQ ID NO: 364111 - protein, 10 aa, Influenza virus
VWWTSNSLIA

SEQ ID NO: 364112 - protein, 10 aa, Influenza virus
WWTSNSLIAL

SEQ ID NO: 364113 - protein, 10 aa, Influenza virus
WTSNSLIALC

SEQ ID NO: 364114 - protein, 10 aa, Influenza virus
TSNSLIALCG

SEQ ID NO: 364115 - protein, 10 aa, Influenza virus
SNSLIALCGS

SEQ ID NO: 364116 - protein, 10 aa, Influenza virus
NSLIALCGSP

SEQ ID NO: 364117 - protein, 10 aa, Influenza virus
SLVALCGSPV

SEQ ID NO: 364118 - protein, 10 aa, Influenza virus
LVALCGSPVS

SEQ ID NO: 364119 - protein, 10 aa, Influenza virus
VALCGSPVSV

SEQ ID NO: 364120 - protein, 10 aa, Influenza virus
ALCGSPVSVG

SEQ ID NO: 364121 - protein, 10 aa, Influenza virus
LCGSPVSVGS

SEQ ID NO: 364122 - protein, 10 aa, Influenza virus
CGSPVSVGSG

SEQ ID NO: 364123 - protein, 10 aa, Influenza virus
GSPVSVGSGS

SEQ ID NO: 364124 - protein, 10 aa, Influenza virus
SPVSVGSGSF

SEQ ID NO: 364125 - protein, 10 aa, Influenza virus
PVSVGSGSFP

SEQ ID NO: 364126 - protein, 10 aa, Influenza virus
VSVGSGSFPD

SEQ ID NO: 364127 - protein, 10 aa, Influenza virus
PVGSGSFPDG

SEQ ID NO: 364128 - protein, 10 aa, Influenza virus
GSGSFPDGAK

SEQ ID NO: 364129 - protein, 10 aa, Influenza virus
SGSFPNGAQI

SEQ ID NO: 364130 - protein, 10 aa, Influenza virus
GSFPNGAQIQ

SEQ ID NO: 364131 - protein, 10 aa, Influenza virus
SFPNGAQIQY

SEQ ID NO: 364132 - protein, 10 aa, Influenza virus
FPNGAQIQYF

SEQ ID NO: 364133 - protein, 10 aa, Influenza virus
PDGAKIQYFS

SEQ ID NO: 364134 - protein, 10 aa, Influenza virus
KADEICIGYL

SEQ ID NO: 364135 - protein, 10 aa, Influenza virus
ADEICIGYMS

SEQ ID NO: 364136 - protein, 10 aa, Influenza virus
DEICIGYMSN

SEQ ID NO: 364137 - protein, 10 aa, Influenza virus
EICIGYMSNN

SEQ ID NO: 364138 - protein, 10 aa, Influenza virus
ICIGYMSNNS

SEQ ID NO: 364139 - protein, 10 aa, Influenza virus
CIGYMSNNST

SEQ ID NO: 364140 - protein, 10 aa, Influenza virus
IGYLSNNSTD

SEQ ID NO: 364141 - protein, 10 aa, Influenza virus
GYLSNNSTDK

SEQ ID NO: 364142 - protein, 10 aa, Influenza virus
YLSNNSTDKV

SEQ ID NO: 364143 - protein, 10 aa, Influenza virus
LSNNSTDKVD

SEQ ID NO: 364144 - protein, 10 aa, Influenza virus
SNNSTDKVDT

SEQ ID NO: 364145 - protein, 10 aa, Influenza virus
NNSTDKVDTI

SEQ ID NO: 364146 - protein, 10 aa, Influenza virus
NSTDKVDTII

SEQ ID NO: 364147 - protein, 10 aa, Influenza virus
STDKVDTIIE

SEQ ID NO: 364148 - protein, 10 aa, Influenza virus
TDKVDTIIEN

SEQ ID NO: 364149 - protein, 10 aa, Influenza virus
DKVDTIIENN

SEQ ID NO: 364150 - protein, 10 aa, Influenza virus
KVDTIIENNV

SEQ ID NO: 364151 - protein, 10 aa, Influenza virus
VDTIIENNVT

SEQ ID NO: 364152 - protein, 10 aa, Influenza virus
DTIIENNVTV

SEQ ID NO: 364153 - protein, 10 aa, Influenza virus
TIIENNVTVT

SEQ ID NO: 364154 - protein, 10 aa, Influenza virus
IIENNVTVTS

SEQ ID NO: 364155 - protein, 10 aa, Influenza virus
IENNVTVTSS

SEQ ID NO: 364156 - protein, 10 aa, Influenza virus
ENNVTVTSSV

SEQ ID NO: 364157 - protein, 10 aa, Influenza virus
NNVTVTSSVE

SEQ ID NO: 364158 - protein, 10 aa, Influenza virus
NVTVTSSIEL

SEQ ID NO: 364159 - protein, 10 aa, Influenza virus
VTVTSSIELV

SEQ ID NO: 364160 - protein, 10 aa, Influenza virus
TVTSSIELVE

SEQ ID NO: 364161 - protein, 10 aa, Influenza virus
VTSSVELVET

SEQ ID NO: 364162 - protein, 10 aa, Influenza virus
HTGSFCSING

SEQ ID NO: 364163 - protein, 10 aa, Influenza virus
TGSFCSINGK

SEQ ID NO: 364164 - protein, 10 aa, Influenza virus
FCSINGKQPI

SEQ ID NO: 364165 - protein, 10 aa, Influenza virus
CSINGKQPIS

SEQ ID NO: 364166 - protein, 10 aa, Influenza virus
SINGKQPISL

SEQ ID NO: 364167 - protein, 10 aa, Influenza virus
INGKQPISLG

SEQ ID NO: 364168 - protein, 10 aa, Influenza virus
NGKQPISLGD

SEQ ID NO: 364169 - protein, 10 aa, Influenza virus
GKQPISLGDC

SEQ ID NO: 364170 - protein, 10 aa, Influenza virus
KQPISLGDCS

SEQ ID NO: 364171 - protein, 10 aa, Influenza virus
QPISLGDCSF

SEQ ID NO: 364172 - protein, 10 aa, Influenza virus
PISLGGCSFA

SEQ ID NO: 364173 - protein, 10 aa, Influenza virus
ISLGGCSFAG

SEQ ID NO: 364174 - protein, 10 aa, Influenza virus
SLGGCSFAGW

SEQ ID NO: 364175 - protein, 10 aa, Influenza virus
LGGCSFAGWI

SEQ ID NO: 364176 - protein, 10 aa, Influenza virus
GDCSFTGWIL

SEQ ID NO: 364177 - protein, 10 aa, Influenza virus
DCSFAGWLLG

SEQ ID NO: 364178 - protein, 10 aa, Influenza virus
CSFAGWLLGN

SEQ ID NO: 364179 - protein, 10 aa, Influenza virus
SFTGWILGNP

SEQ ID NO: 364180 - protein, 10 aa, Influenza virus
FAGWILGNPR

SEQ ID NO: 364181 - protein, 10 aa, Influenza virus
AGWILGNPRC

SEQ ID NO: 364182 - protein, 10 aa, Influenza virus
GWILGNPRCD

SEQ ID NO: 364183 - protein, 10 aa, Influenza virus
WILGNPMCDE

SEQ ID NO: 364184 - protein, 10 aa, Influenza virus
ILGNPMCDEL

SEQ ID NO: 364185 - protein, 10 aa, Influenza virus
LGNPMCDELI

SEQ ID NO: 364186 - protein, 10 aa, Influenza virus
GNPMCDELIG

SEQ ID NO: 364187 - protein, 10 aa, Influenza virus
NPMCDELIGK

SEQ ID NO: 364188 - protein, 10 aa, Influenza virus
CDELIGKTSW

SEQ ID NO: 364189 - protein, 10 aa, Influenza virus
DELIGKTSWS

SEQ ID NO: 364190 - protein, 10 aa, Influenza virus
ELIGKTSWSY

SEQ ID NO: 364191 - protein, 10 aa, Influenza virus
LIGKNSWSYI

SEQ ID NO: 364192 - protein, 10 aa, Influenza virus
IEKTSWSYIV

SEQ ID NO: 364193 - protein, 10 aa, Influenza virus
GKNSWSYIVE

SEQ ID NO: 364194 - protein, 10 aa, Influenza virus
KTSWSYIVER

SEQ ID NO: 364195 - protein, 10 aa, Influenza virus
TSWSYIVEKS

SEQ ID NO: 364196 - protein, 10 aa, Influenza virus
SWSYIVEKSN

SEQ ID NO: 364197 - protein, 10 aa, Influenza virus
WSYIVEKLNP

SEQ ID NO: 364198 - protein, 10 aa, Influenza virus
NPANGICYPG

SEQ ID NO: 364199 - protein, 10 aa, Influenza virus
NGICYPGSLD

SEQ ID NO: 364200 - protein, 10 aa, Influenza virus
SFFRHMVWLI

SEQ ID NO: 364201 - protein, 10 aa, Influenza virus
WLVHQSGTYP

SEQ ID NO: 364202 - protein, 10 aa, Influenza virus
FNNTKERDVL

SEQ ID NO: 364203 - protein, 10 aa, Influenza virus
INGQAGRMTF

SEQ ID NO: 364204 - protein, 10 aa, Influenza virus
QAGRMTFYWK

SEQ ID NO: 364205 - protein, 10 aa, Influenza virus
AGRMTFYWKI

SEQ ID NO: 364206 - protein, 10 aa, Influenza virus
GRMTFYWKIV

SEQ ID NO: 364207 - protein, 10 aa, Influenza virus
TFESNGAFIA

SEQ ID NO: 364208 - protein, 10 aa, Influenza virus
FESNGAFIAP

SEQ ID NO: 364209 - protein, 10 aa, Influenza virus
ESNGAFIAPR

SEQ ID NO: 364210 - protein, 10 aa, Influenza virus
SNGAFIAPRY

SEQ ID NO: 364211 - protein, 10 aa, Influenza virus
LAPRYAFEIV

SEQ ID NO: 364212 - protein, 10 aa, Influenza virus
APRYAFEIVS

SEQ ID NO: 364213 - protein, 10 aa, Influenza virus
CQTEIGGINT

SEQ ID NO: 364214 - protein, 10 aa, Influenza virus
SVHRNTIGDC

SEQ ID NO: 364215 - protein, 10 aa, Influenza virus
VHRNTFGDCP

SEQ ID NO: 364216 - protein, 10 aa, Influenza virus
HRNTFGDCPK

SEQ ID NO: 364217 - protein, 10 aa, Influenza virus
RNTFGDCPKY

SEQ ID NO: 364218 - protein, 10 aa, Influenza virus
NTIGDCPKYM

SEQ ID NO: 364219 - protein, 10 aa, Influenza virus
TIGDCPKYMN

SEQ ID NO: 364220 - protein, 10 aa, Influenza virus
IGDCPKYMNV

SEQ ID NO: 364221 - protein, 10 aa, Influenza virus
GDCPKYMNVK

SEQ ID NO: 364222 - protein, 10 aa, Influenza virus
DCPKYVNVRS

SEQ ID NO: 364223 - protein, 10 aa, Influenza virus
CPKYMNVKSL

SEQ ID NO: 364224 - protein, 10 aa, Influenza virus
PKYVNVRSLK

SEQ ID NO: 364225 - protein, 10 aa, Influenza virus
KYVNVRSLKL

SEQ ID NO: 364226 - protein, 10 aa, Influenza virus
YVNVRSLKLA

SEQ ID NO: 364227 - protein, 10 aa, Influenza virus
NVRSLKLATG

SEQ ID NO: 364228 - protein, 10 aa, Influenza virus
KSLKLATGPR

SEQ ID NO: 364229 - protein, 10 aa, Influenza virus
SLKLATGPRN

SEQ ID NO: 364230 - protein, 10 aa, Influenza virus
LKLATGLRNI

SEQ ID NO: 364231 - protein, 10 aa, Influenza virus
KLATGLRNIP

SEQ ID NO: 364232 - protein, 10 aa, Influenza virus
LATGLRNIPA

SEQ ID NO: 364233 - protein, 10 aa, Influenza virus
SRGLFGAIAG

SEQ ID NO: 364234 - protein, 10 aa, Influenza virus
RGLFGAKAGF

SEQ ID NO: 364235 - protein, 10 aa, Influenza virus
GLFGAKAGFI

SEQ ID NO: 364236 - protein, 10 aa, Influenza virus
LFGAKAGFIE

SEQ ID NO: 364237 - protein, 10 aa, Influenza virus
FGAKAGFIEG

SEQ ID NO: 364238 - protein, 10 aa, Influenza virus
GAKAGFIEGG

SEQ ID NO: 364239 - protein, 10 aa, Influenza virus
AKAGFIEGGW

SEQ ID NO: 364240 - protein, 10 aa, Influenza virus
KAGFIEGGWP

SEQ ID NO: 364241 - protein, 10 aa, Influenza virus
GWYGFQHRND

SEQ ID NO: 364242 - protein, 10 aa, Influenza virus
WYGFQHRNDE

SEQ ID NO: 364243 - protein, 10 aa, Influenza virus
YGFQHRDEEG

SEQ ID NO: 364244 - protein, 10 aa, Influenza virus
GFQHRDEEGT

SEQ ID NO: 364245 - protein, 10 aa, Influenza virus
FQHRNDEGTG

SEQ ID NO: 364246 - protein, 10 aa, Influenza virus
QHRNEEGTGV

SEQ ID NO: 364247 - protein, 10 aa, Influenza virus
HRDEEGTGIA

SEQ ID NO: 364248 - protein, 10 aa, Influenza virus
RNEEGTGVAA

SEQ ID NO: 364249 - protein, 10 aa, Influenza virus
NDEGTGIAAD

SEQ ID NO: 364250 - protein, 10 aa, Influenza virus
EEGTGIAADR

SEQ ID NO: 364251 - protein, 10 aa, Influenza virus
EGTGIAADRE

SEQ ID NO: 364252 - protein, 10 aa, Influenza virus
GTGIAADRES

SEQ ID NO: 364253 - protein, 10 aa, Influenza virus
TGIAADREST

SEQ ID NO: 364254 - protein, 10 aa, Influenza virus
GIAADRESTQ

SEQ ID NO: 364255 - protein, 10 aa, Influenza virus
IAADRESTQK

SEQ ID NO: 364256 - protein, 10 aa, Influenza virus
AADRESTQKA

SEQ ID NO: 364257 - protein, 10 aa, Influenza virus
NIWSYNAQLL

SEQ ID NO: 364258 - protein, 10 aa, Influenza virus
LWSYNAQLLV

SEQ ID NO: 364259 - protein, 10 aa, Influenza virus
WSYNAQLLVW

SEQ ID NO: 364260 - protein, 10 aa, Influenza virus
SYNAQLLVWL

SEQ ID NO: 364261 - protein, 10 aa, Influenza virus
YNAQLLVWLE

SEQ ID NO: 364262 - protein, 10 aa, Influenza virus
NAQLLVWLEN

SEQ ID NO: 364263 - protein, 10 aa, Influenza virus
AQLLVWLENE

SEQ ID NO: 364264 - protein, 10 aa, Influenza virus
QLLVWLENEK

SEQ ID NO: 364265 - protein, 10 aa, Influenza virus
LLVWLENEKT

SEQ ID NO: 364266 - protein, 10 aa, Influenza virus
LVWLENEKTL

SEQ ID NO: 364267 - protein, 10 aa, Influenza virus
VWLENEKTLD

SEQ ID NO: 364268 - protein, 10 aa, Influenza virus
WLENEKTLDL

SEQ ID NO: 364269 - protein, 10 aa, Influenza virus
TLDLHDSNVK

SEQ ID NO: 364270 - protein, 10 aa, Influenza virus
LDLHDSNVRS

SEQ ID NO: 364271 - protein, 10 aa, Influenza virus
DLHDSNVRSL

SEQ ID NO: 364272 - protein, 10 aa, Influenza virus
LHDSNVRSLH

SEQ ID NO: 364273 - protein, 10 aa, Influenza virus
HDSNVRSLHE

SEQ ID NO: 364274 - protein, 10 aa, Influenza virus
DSNVRNLHER

SEQ ID NO: 364275 - protein, 10 aa, Influenza virus
LRDNAKDEGN

SEQ ID NO: 364276 - protein, 10 aa, Influenza virus
RDNAKDEGNG

SEQ ID NO: 364277 - protein, 10 aa, Influenza virus
GNAKDEGNGC

SEQ ID NO: 364278 - protein, 10 aa, Influenza virus
ARDEGNGCFT

SEQ ID NO: 364279 - protein, 10 aa, Influenza virus
RDEGNGCFTF

SEQ ID NO: 364280 - protein, 10 aa, Influenza virus
GNGCFTFYHR

SEQ ID NO: 364281 - protein, 10 aa, Influenza virus
NGCFPFYHKC

SEQ ID NO: 364282 - protein, 10 aa, Influenza virus
GCFTFYHKCN

SEQ ID NO: 364283 - protein, 10 aa, Influenza virus
CFTFYHKCDD

SEQ ID NO: 364284 - protein, 10 aa, Influenza virus
FYHKCDNKCI

SEQ ID NO: 364285 - protein, 10 aa, Influenza virus
YHKCDNKCIE

SEQ ID NO: 364286 - protein, 10 aa, Influenza virus
NECIERVRNG

SEQ ID NO: 364287 - protein, 10 aa, Influenza virus
ECIERVRNGT

SEQ ID NO: 364288 - protein, 10 aa, Influenza virus
CIERVRNGTY

SEQ ID NO: 364289 - protein, 10 aa, Influenza virus
IERVRNGTYD

SEQ ID NO: 364290 - protein, 10 aa, Influenza virus
ERVRNGTYDH

SEQ ID NO: 364291 - protein, 10 aa, Influenza virus
RVRNGTYDHK

SEQ ID NO: 364292 - protein, 10 aa, Influenza virus
IRNGTYDHKE

SEQ ID NO: 364293 - protein, 10 aa, Influenza virus
NGTYDHKDFE

SEQ ID NO: 364294 - protein, 10 aa, Influenza virus
GTYDHKEFEK

SEQ ID NO: 364295 - protein, 10 aa, Influenza virus
TYDHKEFEKE

SEQ ID NO: 364296 - protein, 10 aa, Influenza virus
YDHKEFEKES

SEQ ID NO: 364297 - protein, 10 aa, Influenza virus
DHKEFEEESR

SEQ ID NO: 364298 - protein, 10 aa, Influenza virus
ESKINRQEIE

SEQ ID NO: 364299 - protein, 10 aa, Influenza virus
SKINRQEIEG

SEQ ID NO: 364300 - protein, 10 aa, Influenza virus
INRQEIEGVK

SEQ ID NO: 364301 - protein, 10 aa, Influenza virus
NRQEIEGVRL

SEQ ID NO: 364302 - protein, 10 aa, Influenza virus
RQEIEGVKLN

SEQ ID NO: 364303 - protein, 10 aa, Influenza virus
GNIYKILSIY

SEQ ID NO: 364304 - protein, 10 aa, Influenza virus
NIYKILSIYS

SEQ ID NO: 364305 - protein, 10 aa, Influenza virus
IYKILSIYSC

SEQ ID NO: 364306 - protein, 10 aa, Influenza virus
YKILSICSCI

SEQ ID NO: 364307 - protein, 10 aa, Influenza virus
KILSIYSCVA

SEQ ID NO: 364308 - protein, 10 aa, Influenza virus
ILSIYSCVAS

SEQ ID NO: 364309 - protein, 10 aa, Influenza virus
LSICSCIASS

SEQ ID NO: 364310 - protein, 10 aa, Influenza virus
SIYSCVASSL

SEQ ID NO: 364311 - protein, 10 aa, Influenza virus
IYSCIASSLI

SEQ ID NO: 364312 - protein, 10 aa, Influenza virus
YSCIASSLIL

SEQ ID NO: 364313 - protein, 10 aa, Influenza virus
SCIASSLILA

SEQ ID NO: 364314 - protein, 10 aa, Influenza virus
CIASSLILAA

SEQ ID NO: 364315 - protein, 10 aa, Influenza virus
IASSLVLAAL

SEQ ID NO: 364316 - protein, 10 aa, Influenza virus
ASSLVLAALI

SEQ ID NO: 364317 - protein, 10 aa, Influenza virus
SSLVLAALIM

SEQ ID NO: 364318 - protein, 10 aa, Influenza virus
SLVLAALIMG

SEQ ID NO: 364319 - protein, 10 aa, Influenza virus
WTCSNGSCRC

SEQ ID NO: 364320 - protein, 10 aa, Influenza virus
TCSNGSCRCT

SEQ ID NO: 364321 - protein, 10 aa, Influenza virus
CNNGSCRCTI

SEQ ID NO: 364322 - protein, 10 aa, Influenza virus
NNGSCRCTIC

SEQ ID NO: 364323 - protein, 10 aa, Influenza virus
LAYDKICIGY

SEQ ID NO: 364324 - protein, 10 aa, Influenza virus
IGYQTNNSTD

SEQ ID NO: 364325 - protein, 10 aa, Influenza virus
GYQTNNSTDT

SEQ ID NO: 364326 - protein, 10 aa, Influenza virus
YQTNNSTDTV

SEQ ID NO: 364327 - protein, 10 aa, Influenza virus
QTNNSTDTVN

SEQ ID NO: 364328 - protein, 10 aa, Influenza virus
TNNSTDTVNT

SEQ ID NO: 364329 - protein, 10 aa, Influenza virus
NNSTDTVNTL

SEQ ID NO: 364330 - protein, 10 aa, Influenza virus
NSTDTVNTLI

SEQ ID NO: 364331 - protein, 10 aa, Influenza virus
STDTVNTLIE

SEQ ID NO: 364332 - protein, 10 aa, Influenza virus
TDTVNTLIEQ

SEQ ID NO: 364333 - protein, 10 aa, Influenza virus
DTVNTLIEQN

SEQ ID NO: 364334 - protein, 10 aa, Influenza virus
TVNTLSEQNV

SEQ ID NO: 364335 - protein, 10 aa, Influenza virus
VNTLSEQNVP

SEQ ID NO: 364336 - protein, 10 aa, Influenza virus
NTLSEQNVPV

SEQ ID NO: 364337 - protein, 10 aa, Influenza virus
TLSEQNVPVT

SEQ ID NO: 364338 - protein, 10 aa, Influenza virus
LSEQNVPVTQ

SEQ ID NO: 364339 - protein, 10 aa, Influenza virus
SEQNVPVTQV

SEQ ID NO: 364340 - protein, 10 aa, Influenza virus
EQNIPVTQVE

SEQ ID NO: 364341 - protein, 10 aa, Influenza virus
QNIPVTQVEE

SEQ ID NO: 364342 - protein, 10 aa, Influenza virus
NIPVTQVEEL

SEQ ID NO: 364343 - protein, 10 aa, Influenza virus
IPVTQVEELV

SEQ ID NO: 364344 - protein, 10 aa, Influenza virus
VTQVEELVHR

SEQ ID NO: 364345 - protein, 10 aa, Influenza virus
TQVEELVHGQ

SEQ ID NO: 364346 - protein, 10 aa, Influenza virus
QVEELVHGQV

SEQ ID NO: 364347 - protein, 10 aa, Influenza virus
VEELVHGQVN

SEQ ID NO: 364348 - protein, 10 aa, Influenza virus
EELVHGQVNP

SEQ ID NO: 364349 - protein, 10 aa, Influenza virus
TELGAPLVLD

SEQ ID NO: 364350 - protein, 10 aa, Influenza virus
ELGAPLVLDD

SEQ ID NO: 364351 - protein, 10 aa, Influenza virus
LGAPLVLDDC

SEQ ID NO: 364352 - protein, 10 aa, Influenza virus
GAPLVLDDCS

SEQ ID NO: 364353 - protein, 10 aa, Influenza virus
APLVLDDCSL

SEQ ID NO: 364354 - protein, 10 aa, Influenza virus
PLVLDDCSLK

SEQ ID NO: 364355 - protein, 10 aa, Influenza virus
LVLDDCSLKG

SEQ ID NO: 364356 - protein, 10 aa, Influenza virus
VLDDCSLEGI

SEQ ID NO: 364357 - protein, 10 aa, Influenza virus
LDDCSLEGII

SEQ ID NO: 364358 - protein, 10 aa, Influenza virus
DDCSLEGIIL

SEQ ID NO: 364359 - protein, 10 aa, Influenza virus
DCSLEGIILG

SEQ ID NO: 364360 - protein, 10 aa, Influenza virus
CSLEGIILGN

SEQ ID NO: 364361 - protein, 10 aa, Influenza virus
SLEGIILGNP

SEQ ID NO: 364362 - protein, 10 aa, Influenza virus
LEGIILGNPK

SEQ ID NO: 364363 - protein, 10 aa, Influenza virus
EGIILGNPKC

SEQ ID NO: 364364 - protein, 10 aa, Influenza virus
GIILGNPKCD

SEQ ID NO: 364365 - protein, 10 aa, Influenza virus
LILGNPKCDP

SEQ ID NO: 364366 - protein, 10 aa, Influenza virus
ILGNPKCDPY

SEQ ID NO: 364367 - protein, 10 aa, Influenza virus
LGNPKCDPYL

SEQ ID NO: 364368 - protein, 10 aa, Influenza virus
GNPKCDPYLN

SEQ ID NO: 364369 - protein, 10 aa, Influenza virus
NPKCDPYLNG

SEQ ID NO: 364370 - protein, 10 aa, Influenza virus
PKCDPYLNGR

SEQ ID NO: 364371 - protein, 10 aa, Influenza virus
KCDPYLNGRE

SEQ ID NO: 364372 - protein, 10 aa, Influenza virus
CDPYLNGREW

SEQ ID NO: 364373 - protein, 10 aa, Influenza virus
DPYLNGREWS

SEQ ID NO: 364374 - protein, 10 aa, Influenza virus
PYLNGREWSY

SEQ ID NO: 364375 - protein, 10 aa, Influenza virus
YLSGREWSYI

SEQ ID NO: 364376 - protein, 10 aa, Influenza virus
LSGREWSYIV

SEQ ID NO: 364377 - protein, 10 aa, Influenza virus
SGREWSYIVE

SEQ ID NO: 364378 - protein, 10 aa, Influenza virus
REWSYIVERT

SEQ ID NO: 364379 - protein, 10 aa, Influenza virus
EWSYIVERTK

SEQ ID NO: 364380 - protein, 10 aa, Influenza virus
WSYIVERTKE

SEQ ID NO: 364381 - protein, 10 aa, Influenza virus
SYIVERTKEM

SEQ ID NO: 364382 - protein, 10 aa, Influenza virus
YIVERTKEME

SEQ ID NO: 364383 - protein, 10 aa, Influenza virus
IVERTKEMEG

SEQ ID NO: 364384 - protein, 10 aa, Influenza virus
VERPKEMEGV

SEQ ID NO: 364385 - protein, 10 aa, Influenza virus
ERPKEMEGVC

SEQ ID NO: 364386 - protein, 10 aa, Influenza virus
RPKEMEGVCY

SEQ ID NO: 364387 - protein, 10 aa, Influenza virus
PKEMEGVCYP

SEQ ID NO: 364388 - protein, 10 aa, Influenza virus
KEMEGVCYPG

SEQ ID NO: 364389 - protein, 10 aa, Influenza virus
EMEGVCYPGS

SEQ ID NO: 364390 - protein, 10 aa, Influenza virus
MEGVCYPGSI

SEQ ID NO: 364391 - protein, 10 aa, Influenza virus
EGVCYPGSIE

SEQ ID NO: 364392 - protein, 10 aa, Influenza virus
GVCYPGSIEN

SEQ ID NO: 364393 - protein, 10 aa, Influenza virus
VCYPGSIENQ

SEQ ID NO: 364394 - protein, 10 aa, Influenza virus
CYPGSVENQE

SEQ ID NO: 364395 - protein, 10 aa, Influenza virus
YPGSVENQEE

SEQ ID NO: 364396 - protein, 10 aa, Influenza virus
PGSIKNQEEL

SEQ ID NO: 364397 - protein, 10 aa, Influenza virus
GSIKNQEELR

SEQ ID NO: 364398 - protein, 10 aa, Influenza virus
SIENQEELRF

SEQ ID NO: 364399 - protein, 10 aa, Influenza virus
IENQEELRFL

SEQ ID NO: 364400 - protein, 10 aa, Influenza virus
ENQEELRFLF

SEQ ID NO: 364401 - protein, 10 aa, Influenza virus
NQEELRFLFS

SEQ ID NO: 364402 - protein, 10 aa, Influenza virus
QEELRFLFSS

SEQ ID NO: 364403 - protein, 10 aa, Influenza virus
EELRFLFSSI

SEQ ID NO: 364404 - protein, 10 aa, Influenza virus
ELRFLFSSIK

SEQ ID NO: 364405 - protein, 10 aa, Influenza virus
LRFLFSSIKK

SEQ ID NO: 364406 - protein, 10 aa, Influenza virus
RFLFSSIKKY

SEQ ID NO: 364407 - protein, 10 aa, Influenza virus
FLFSSIKKYE

SEQ ID NO: 364408 - protein, 10 aa, Influenza virus
LFSSIKRYER

SEQ ID NO: 364409 - protein, 10 aa, Influenza virus
FSSIKRYERV

SEQ ID NO: 364410 - protein, 10 aa, Influenza virus
SSIKRYERVK

SEQ ID NO: 364411 - protein, 10 aa, Influenza virus
SIKRYERVKM

SEQ ID NO: 364412 - protein, 10 aa, Influenza virus
IKRYERVKMF

SEQ ID NO: 364413 - protein, 10 aa, Influenza virus
KRYERVKMFD

SEQ ID NO: 364414 - protein, 10 aa, Influenza virus
RYERVKMFDF

SEQ ID NO: 364415 - protein, 10 aa, Influenza virus
YERVKMFDFS

SEQ ID NO: 364416 - protein, 10 aa, Influenza virus
ERVKMFDFSK

SEQ ID NO: 364417 - protein, 10 aa, Influenza virus
RVKMFDFSKW

SEQ ID NO: 364418 - protein, 10 aa, Influenza virus
VKMFDFSKWN

SEQ ID NO: 364419 - protein, 10 aa, Influenza virus
KMFDFSKWNV

SEQ ID NO: 364420 - protein, 10 aa, Influenza virus
MFDFSKWNVT

SEQ ID NO: 364421 - protein, 10 aa, Influenza virus
FDFSKWNVTY

SEQ ID NO: 364422 - protein, 10 aa, Influenza virus
DFSKWNVTYT

SEQ ID NO: 364423 - protein, 10 aa, Influenza virus
FSKWNVTYTG

SEQ ID NO: 364424 - protein, 10 aa, Influenza virus
SKWNVTYTGT

SEQ ID NO: 364425 - protein, 10 aa, Influenza virus
KWNVTYTGIS

SEQ ID NO: 364426 - protein, 10 aa, Influenza virus
WNVTYTGTSR

SEQ ID NO: 364427 - protein, 10 aa, Influenza virus
NVTYTGTSRA

SEQ ID NO: 364428 - protein, 10 aa, Influenza virus
VTYTGTSRAC

SEQ ID NO: 364429 - protein, 10 aa, Influenza virus
TYTGTSRACN

SEQ ID NO: 364430 - protein, 10 aa, Influenza virus
ISNQGSFYRN

SEQ ID NO: 364431 - protein, 10 aa, Influenza virus
SNQGSFYRSI

SEQ ID NO: 364432 - protein, 10 aa, Influenza virus
NQGSFYRNMR

SEQ ID NO: 364433 - protein, 10 aa, Influenza virus
QGSFYRNMRW

SEQ ID NO: 364434 - protein, 10 aa, Influenza virus
GSFYRSIRWL

SEQ ID NO: 364435 - protein, 10 aa, Influenza virus
SFYRSIRWLT

SEQ ID NO: 364436 - protein, 10 aa, Influenza virus
FYRSIRWLTL

SEQ ID NO: 364437 - protein, 10 aa, Influenza virus
YRSIRWLTLK

SEQ ID NO: 364438 - protein, 10 aa, Influenza virus
RSMRWLTLKL

SEQ ID NO: 364439 - protein, 10 aa, Influenza virus
MRWLTLKSEQ

SEQ ID NO: 364440 - protein, 10 aa, Influenza virus
RWLTLKSEQF

SEQ ID NO: 364441 - protein, 10 aa, Influenza virus
WLTLKSEQFP

SEQ ID NO: 364442 - protein, 10 aa, Influenza virus
LTLKSEQFPV

SEQ ID NO: 364443 - protein, 10 aa, Influenza virus
TLKSEQFPVQ

SEQ ID NO: 364444 - protein, 10 aa, Influenza virus
LKSEQFPVQT

SEQ ID NO: 364445 - protein, 10 aa, Influenza virus
KSEQFPVQTD

SEQ ID NO: 364446 - protein, 10 aa, Influenza virus
SEQFPVQTDE

SEQ ID NO: 364447 - protein, 10 aa, Influenza virus
EQFPVQTDEY

SEQ ID NO: 364448 - protein, 10 aa, Influenza virus
VQTDEYKNTG

SEQ ID NO: 364449 - protein, 10 aa, Influenza virus
QTDEYKNTGD

SEQ ID NO: 364450 - protein, 10 aa, Influenza virus
TDEYKNTGDS

SEQ ID NO: 364451 - protein, 10 aa, Influenza virus
DEYKNTRDSN

SEQ ID NO: 364452 - protein, 10 aa, Influenza virus
EYKNTRDSNI

SEQ ID NO: 364453 - protein, 10 aa, Influenza virus
FMWAIHHPPT

SEQ ID NO: 364454 - protein, 10 aa, Influenza virus
TWAIHHPPTT

SEQ ID NO: 364455 - protein, 10 aa, Influenza virus
WAIHHPPTSN

SEQ ID NO: 364456 - protein, 10 aa, Influenza virus
AIHHPPTSNE

SEQ ID NO: 364457 - protein, 10 aa, Influenza virus
IHHPPTSNEQ

SEQ ID NO: 364458 - protein, 10 aa, Influenza virus
HHPPTSNEQV

SEQ ID NO: 364459 - protein, 10 aa, Influenza virus
EINRSFRPNI

SEQ ID NO: 364460 - protein, 10 aa, Influenza virus
INRSFRPNIG

SEQ ID NO: 364461 - protein, 10 aa, Influenza virus
NRSFRPNIGP

SEQ ID NO: 364462 - protein, 10 aa, Influenza virus
RSFRPNIGPR

SEQ ID NO: 364463 - protein, 10 aa, Influenza virus
SFRPNIGPRP

SEQ ID NO: 364464 - protein, 10 aa, Influenza virus
FKPNIGPRPF

SEQ ID NO: 364465 - protein, 10 aa, Influenza virus
KPNIGPRPFV

SEQ ID NO: 364466 - protein, 10 aa, Influenza virus
PNIGPRPFVR

SEQ ID NO: 364467 - protein, 10 aa, Influenza virus
NIGPRPFVRG

SEQ ID NO: 364468 - protein, 10 aa, Influenza virus
IGPRPFVRGQ

SEQ ID NO: 364469 - protein, 10 aa, Influenza virus
GPRPFVRGQQ

SEQ ID NO: 364470 - protein, 10 aa, Influenza virus
PRPFVRGQQG

SEQ ID NO: 364471 - protein, 10 aa, Influenza virus
RPFVRGQQGR

SEQ ID NO: 364472 - protein, 10 aa, Influenza virus
PFVRGQQGRM

SEQ ID NO: 364473 - protein, 10 aa, Influenza virus
FVRGQQGRMD

SEQ ID NO: 364474 - protein, 10 aa, Influenza virus
VREQQGRMDY

SEQ ID NO: 364475 - protein, 10 aa, Influenza virus
REQQGRMDYY

SEQ ID NO: 364476 - protein, 10 aa, Influenza virus
EQQGRMDYYW

SEQ ID NO: 364477 - protein, 10 aa, Influenza virus
QGRMDYYWAI

SEQ ID NO: 364478 - protein, 10 aa, Influenza virus
GRMDYYWAIL

SEQ ID NO: 364479 - protein, 10 aa, Influenza virus
RMDYYWAILK

SEQ ID NO: 364480 - protein, 10 aa, Influenza virus
MDYYWAILKP

SEQ ID NO: 364481 - protein, 10 aa, Influenza virus
DYYWAILKPG

SEQ ID NO: 364482 - protein, 10 aa, Influenza virus
YYWAILKPGQ

SEQ ID NO: 364483 - protein, 10 aa, Influenza virus
YWAILKPGQT

SEQ ID NO: 364484 - protein, 10 aa, Influenza virus
WAILKPGQTV

SEQ ID NO: 364485 - protein, 10 aa, Influenza virus
AILKPGQTVK

SEQ ID NO: 364486 - protein, 10 aa, Influenza virus
ILKPGQTVKI

SEQ ID NO: 364487 - protein, 10 aa, Influenza virus
LKPGQTVKIK

SEQ ID NO: 364488 - protein, 10 aa, Influenza virus
KPGQTVKIKT

SEQ ID NO: 364489 - protein, 10 aa, Influenza virus
PGQTVKIQTS

SEQ ID NO: 364490 - protein, 10 aa, Influenza virus
GQTVKIQTSG

SEQ ID NO: 364491 - protein, 10 aa, Influenza virus
QTVKIQTSGN

SEQ ID NO: 364492 - protein, 10 aa, Influenza virus
TVKIQTSGNL

SEQ ID NO: 364493 - protein, 10 aa, Influenza virus
VKIKTNGNLI

SEQ ID NO: 364494 - protein, 10 aa, Influenza virus
KIKTNGNLIA

SEQ ID NO: 364495 - protein, 10 aa, Influenza virus
IKTNGNLIAP

SEQ ID NO: 364496 - protein, 10 aa, Influenza virus
QTSGNLIAPE

SEQ ID NO: 364497 - protein, 10 aa, Influenza virus
TSGNLIAPEY

SEQ ID NO: 364498 - protein, 10 aa, Influenza virus
SGNLIAPEYG

SEQ ID NO: 364499 - protein, 10 aa, Influenza virus
GNLIAPEYGY

SEQ ID NO: 364500 - protein, 10 aa, Influenza virus
NLIAPEYGYL

SEQ ID NO: 364501 - protein, 10 aa, Influenza virus
LIAPEYGHLV

SEQ ID NO: 364502 - protein, 10 aa, Influenza virus
IAPEYGHLVT

SEQ ID NO: 364503 - protein, 10 aa, Influenza virus
APEYGHLVTG

SEQ ID NO: 364504 - protein, 10 aa, Influenza virus
PEYGHLVTGK

SEQ ID NO: 364505 - protein, 10 aa, Influenza virus
EYGHLVTGKS

SEQ ID NO: 364506 - protein, 10 aa, Influenza virus
YGHLVTGKSH

SEQ ID NO: 364507 - protein, 10 aa, Influenza virus
GHLVTGKSHG

SEQ ID NO: 364508 - protein, 10 aa, Influenza virus
HLVTGKSHGR

SEQ ID NO: 364509 - protein, 10 aa, Influenza virus
LITGKSHGRV

SEQ ID NO: 364510 - protein, 10 aa, Influenza virus
VTGKSHGRIL

SEQ ID NO: 364511 - protein, 10 aa, Influenza virus
TGKSHGRVLK

SEQ ID NO: 364512 - protein, 10 aa, Influenza virus
GKSHGRVLKN

SEQ ID NO: 364513 - protein, 10 aa, Influenza virus
KSHGRILKND

SEQ ID NO: 364514 - protein, 10 aa, Influenza virus
SHGRILKNDL

SEQ ID NO: 364515 - protein, 10 aa, Influenza virus
HGRILKNDLP

SEQ ID NO: 364516 - protein, 10 aa, Influenza virus
TGCQLNEGVM

SEQ ID NO: 364517 - protein, 10 aa, Influenza virus
GCQLNEGVMN

SEQ ID NO: 364518 - protein, 10 aa, Influenza virus
CQLNEGVINT

SEQ ID NO: 364519 - protein, 10 aa, Influenza virus
QLNEGVINTS

SEQ ID NO: 364520 - protein, 10 aa, Influenza virus
LNEGIMNTSK

SEQ ID NO: 364521 - protein, 10 aa, Influenza virus
NEGVINTSKP

SEQ ID NO: 364522 - protein, 10 aa, Influenza virus
EGVINTSKPF

SEQ ID NO: 364523 - protein, 10 aa, Influenza virus
GVINTSKPFQ

SEQ ID NO: 364524 - protein, 10 aa, Influenza virus
IMNTSKPFQN

SEQ ID NO: 364525 - protein, 10 aa, Influenza virus
MNTSKPLQNT

SEQ ID NO: 364526 - protein, 10 aa, Influenza virus
NTSKPFQNIC

SEQ ID NO: 364527 - protein, 10 aa, Influenza virus
TSKPLQNTSK

SEQ ID NO: 364528 - protein, 10 aa, Influenza virus
SKPFQNICKP

SEQ ID NO: 364529 - protein, 10 aa, Influenza virus
KPFQNTSRHY

SEQ ID NO: 364530 - protein, 10 aa, Influenza virus
PLQNTSKHYI

SEQ ID NO: 364531 - protein, 10 aa, Influenza virus
FQNICKPYIG

SEQ ID NO: 364532 - protein, 10 aa, Influenza virus
QNICKPYIGK

SEQ ID NO: 364533 - protein, 10 aa, Influenza virus
NTSRHYIGKC

SEQ ID NO: 364534 - protein, 10 aa, Influenza virus
ICKPYIGKCP

SEQ ID NO: 364535 - protein, 10 aa, Influenza virus
SKHYIGKCPR

SEQ ID NO: 364536 - protein, 10 aa, Influenza virus
KHYIGKCPRY

SEQ ID NO: 364537 - protein, 10 aa, Influenza virus
HYIGKCPRYI

SEQ ID NO: 364538 - protein, 10 aa, Influenza virus
YIGKCPRYIP

SEQ ID NO: 364539 - protein, 10 aa, Influenza virus
IGKCPRYIPS

SEQ ID NO: 364540 - protein, 10 aa, Influenza virus
GKCPKYIPSN

SEQ ID NO: 364541 - protein, 10 aa, Influenza virus
KCPKYIPSNS

SEQ ID NO: 364542 - protein, 10 aa, Influenza virus
CPKYIPSNSL

SEQ ID NO: 364543 - protein, 10 aa, Influenza virus
PKYIPSNSLK

SEQ ID NO: 364544 - protein, 10 aa, Influenza virus
KYIPSNSLKL

SEQ ID NO: 364545 - protein, 10 aa, Influenza virus
YIPSNSLKLA

SEQ ID NO: 364546 - protein, 10 aa, Influenza virus
IPSNSLKLAI

SEQ ID NO: 364547 - protein, 10 aa, Influenza virus
PSNSLKLAIG

SEQ ID NO: 364548 - protein, 10 aa, Influenza virus
SNSLKLAIGL

SEQ ID NO: 364549 - protein, 10 aa, Influenza virus
NSLKLAIGLR

SEQ ID NO: 364550 - protein, 10 aa, Influenza virus
SLKLAIGPRN

SEQ ID NO: 364551 - protein, 10 aa, Influenza virus
LKLAIGPRNV

SEQ ID NO: 364552 - protein, 10 aa, Influenza virus
KLAIGPRNVP

SEQ ID NO: 364553 - protein, 10 aa, Influenza virus
LAIGPRNVPQ

SEQ ID NO: 364554 - protein, 10 aa, Influenza virus
AIGLRNVPQV

SEQ ID NO: 364555 - protein, 10 aa, Influenza virus
IGLRNVPQVQ

SEQ ID NO: 364556 - protein, 10 aa, Influenza virus
RNVPQVQNRG

SEQ ID NO: 364557 - protein, 10 aa, Influenza virus
NVPQVQNRGL

SEQ ID NO: 364558 - protein, 10 aa, Influenza virus
VPQVQNRGLF

SEQ ID NO: 364559 - protein, 10 aa, Influenza virus
PQVQNRGLFG

SEQ ID NO: 364560 - protein, 10 aa, Influenza virus
QVQNRGLFGA

SEQ ID NO: 364561 - protein, 10 aa, Influenza virus
QDRGLFGAIA

SEQ ID NO: 364562 - protein, 10 aa, Influenza virus
DRGLFGAIAG

SEQ ID NO: 364563 - protein, 10 aa, Influenza virus
RGLFGAKAGF

SEQ ID NO: 364564 - protein, 10 aa, Influenza virus
GLFGAKAGFI

SEQ ID NO: 364565 - protein, 10 aa, Influenza virus
LFGAKAGFIE

SEQ ID NO: 364566 - protein, 10 aa, Influenza virus
FGAKAGFIEG

SEQ ID NO: 364567 - protein, 10 aa, Influenza virus
GAKAGFIEGG

SEQ ID NO: 364568 - protein, 10 aa, Influenza virus
AKAGFIEGGW

SEQ ID NO: 364569 - protein, 10 aa, Influenza virus
KAGFIEGGWP

SEQ ID NO: 364570 - protein, 10 aa, Influenza virus
AGFIEGRWPG

SEQ ID NO: 364571 - protein, 10 aa, Influenza virus
GFIEGRWPGL

SEQ ID NO: 364572 - protein, 10 aa, Influenza virus
FIEGRWPGLV

SEQ ID NO: 364573 - protein, 10 aa, Influenza virus
IEGRWPGLVA

SEQ ID NO: 364574 - protein, 10 aa, Influenza virus
EGRWPGLVAG

SEQ ID NO: 364575 - protein, 10 aa, Influenza virus
GRWPGLVAGW

SEQ ID NO: 364576 - protein, 10 aa, Influenza virus
RWPGLVAGWY

SEQ ID NO: 364577 - protein, 10 aa, Influenza virus
GWYGFQHQNS

SEQ ID NO: 364578 - protein, 10 aa, Influenza virus
WYGFQHQNSE

SEQ ID NO: 364579 - protein, 10 aa, Influenza virus
YGFQHQNSEG

SEQ ID NO: 364580 - protein, 10 aa, Influenza virus
GFQHQNSEGT

SEQ ID NO: 364581 - protein, 10 aa, Influenza virus
FQHQNSEGTG

SEQ ID NO: 364582 - protein, 10 aa, Influenza virus
QHQNAEGTGM

SEQ ID NO: 364583 - protein, 10 aa, Influenza virus
HQNAEGTGMA

SEQ ID NO: 364584 - protein, 10 aa, Influenza virus
QNAEGTGMAA

SEQ ID NO: 364585 - protein, 10 aa, Influenza virus
NAEGTGMAAD

SEQ ID NO: 364586 - protein, 10 aa, Influenza virus
AEGTGMAADR

SEQ ID NO: 364587 - protein, 10 aa, Influenza virus
EGTGMAADRD

SEQ ID NO: 364588 - protein, 10 aa, Influenza virus
GTGMAADRDS

SEQ ID NO: 364589 - protein, 10 aa, Influenza virus
TGMAADRDST

SEQ ID NO: 364590 - protein, 10 aa, Influenza virus
GMAADRDSTQ

SEQ ID NO: 364591 - protein, 10 aa, Influenza virus
AADRDSTQRA

SEQ ID NO: 364592 - protein, 10 aa, Influenza virus
ADRDSTQRAI

SEQ ID NO: 364593 - protein, 10 aa, Influenza virus
DRDSTQRAID

SEQ ID NO: 364594 - protein, 10 aa, Influenza virus
RDSTQRAIDN

SEQ ID NO: 364595 - protein, 10 aa, Influenza virus
DSTQRAIDNM

SEQ ID NO: 364596 - protein, 10 aa, Influenza virus
STQRAIDNMQ

SEQ ID NO: 364597 - protein, 10 aa, Influenza virus
TQRAIDNMQN

SEQ ID NO: 364598 - protein, 10 aa, Influenza virus
QRAIDNMQNK

SEQ ID NO: 364599 - protein, 10 aa, Influenza virus
RAIDNMQNKL

SEQ ID NO: 364600 - protein, 10 aa, Influenza virus
AIDIMQNKLN

SEQ ID NO: 364601 - protein, 10 aa, Influenza virus
IDIMQNKLNN

SEQ ID NO: 364602 - protein, 10 aa, Influenza virus
DIMQNKLNNV

SEQ ID NO: 364603 - protein, 10 aa, Influenza virus
NMQNRLNNVI

SEQ ID NO: 364604 - protein, 10 aa, Influenza virus
MQNRLNNVID

SEQ ID NO: 364605 - protein, 10 aa, Influenza virus
QNRLNNVIDK

SEQ ID NO: 364606 - protein, 10 aa, Influenza virus
NRLNNVIDKM

SEQ ID NO: 364607 - protein, 10 aa, Influenza virus
KLNNVIDKMY

SEQ ID NO: 364608 - protein, 10 aa, Influenza virus
LNNVIDKMYK

SEQ ID NO: 364609 - protein, 10 aa, Influenza virus
NNVIDKMNNQ

SEQ ID NO: 364610 - protein, 10 aa, Influenza virus
NVIDKMNNQF

SEQ ID NO: 364611 - protein, 10 aa, Influenza virus
EFSKVETRIN

SEQ ID NO: 364612 - protein, 10 aa, Influenza virus
VETRINMINS

SEQ ID NO: 364613 - protein, 10 aa, Influenza virus
TRINMINSKI

SEQ ID NO: 364614 - protein, 10 aa, Influenza virus
RINMINSKIN

SEQ ID NO: 364615 - protein, 10 aa, Influenza virus
INTINSKIDD

SEQ ID NO: 364616 - protein, 10 aa, Influenza virus
NTINSKIDDQ

SEQ ID NO: 364617 - protein, 10 aa, Influenza virus
IDDQVTDIWA

SEQ ID NO: 364618 - protein, 10 aa, Influenza virus
DDQVTDIWAY

SEQ ID NO: 364619 - protein, 10 aa, Influenza virus
DQVTDIWAYN

SEQ ID NO: 364620 - protein, 10 aa, Influenza virus
QVTDIWAYNA

SEQ ID NO: 364621 - protein, 10 aa, Influenza virus
VTDIWAYNAE

SEQ ID NO: 364622 - protein, 10 aa, Influenza virus
IDIWAYNAEL

SEQ ID NO: 364623 - protein, 10 aa, Influenza virus
DIWAYNAELI

SEQ ID NO: 364624 - protein, 10 aa, Influenza virus
IWAYNAELIV

SEQ ID NO: 364625 - protein, 10 aa, Influenza virus
WAYNAELIVL

SEQ ID NO: 364626 - protein, 10 aa, Influenza virus
AYNAELIVLL

SEQ ID NO: 364627 - protein, 10 aa, Influenza virus
YNAELIVLLE

SEQ ID NO: 364628 - protein, 10 aa, Influenza virus
NAELIVLLEN

SEQ ID NO: 364629 - protein, 10 aa, Influenza virus
AELIVLLENQ

SEQ ID NO: 364630 - protein, 10 aa, Influenza virus
ELIVLLENQK

SEQ ID NO: 364631 - protein, 10 aa, Influenza virus
LIVLLENQKT

SEQ ID NO: 364632 - protein, 10 aa, Influenza virus
IVLLENQKTL

SEQ ID NO: 364633 - protein, 10 aa, Influenza virus
HDANVRNLHE

SEQ ID NO: 364634 - protein, 10 aa, Influenza virus
DANVRNLHER

SEQ ID NO: 364635 - protein, 10 aa, Influenza virus
ANVRNLHDRI

SEQ ID NO: 364636 - protein, 10 aa, Influenza virus
NVRNLHDRIR

SEQ ID NO: 364637 - protein, 10 aa, Influenza virus
VRNLHDRIRR

SEQ ID NO: 364638 - protein, 10 aa, Influenza virus
ENAIDAGDGC

SEQ ID NO: 364639 - protein, 10 aa, Influenza virus
NAVDTGDGCF

SEQ ID NO: 364640 - protein, 10 aa, Influenza virus
AVDTGDGCFE

SEQ ID NO: 364641 - protein, 10 aa, Influenza virus
VDTGDGCFEI

SEQ ID NO: 364642 - protein, 10 aa, Influenza virus
DAGDGCFEIL

SEQ ID NO: 364643 - protein, 10 aa, Influenza virus
AGDGCFEILH

SEQ ID NO: 364644 - protein, 10 aa, Influenza virus
GDGCFEILHR

SEQ ID NO: 364645 - protein, 10 aa, Influenza virus
DGCFEILHRC

SEQ ID NO: 364646 - protein, 10 aa, Influenza virus
GCFEILHRCD

SEQ ID NO: 364647 - protein, 10 aa, Influenza virus
CFEILHKCDD

SEQ ID NO: 364648 - protein, 10 aa, Influenza virus
TIKNGTYNHQ

SEQ ID NO: 364649 - protein, 10 aa, Influenza virus
YEEESKLERQ

SEQ ID NO: 364650 - protein, 10 aa, Influenza virus
EEESKLERQK

SEQ ID NO: 364651 - protein, 10 aa, Influenza virus
ERQRINGVKL

SEQ ID NO: 364652 - protein, 10 aa, Influenza virus
RQKVNGVKLE

SEQ ID NO: 364653 - protein, 10 aa, Influenza virus
QKVNGVKLEE

SEQ ID NO: 364654 - protein, 10 aa, Influenza virus
RINGVKLEEN

SEQ ID NO: 364655 - protein, 10 aa, Influenza virus
VNGVKLEENS

SEQ ID NO: 364656 - protein, 10 aa, Influenza virus
SGVKLEENST

SEQ ID NO: 364657 - protein, 10 aa, Influenza virus
SVASSLVLLF

SEQ ID NO: 364658 - protein, 10 aa, Influenza virus
VASSLVLLFM

SEQ ID NO: 364659 - protein, 10 aa, Influenza virus
ASSLVLLFMI

SEQ ID NO: 364660 - protein, 10 aa, Influenza virus
SSLVLLFMII

SEQ ID NO: 364661 - protein, 10 aa, Influenza virus
SLVLLFMIIG

SEQ ID NO: 364662 - protein, 10 aa, Influenza virus
LVLLFMIIGG

SEQ ID NO: 364663 - protein, 10 aa, Influenza virus
VLLFMIIGGF

SEQ ID NO: 364664 - protein, 10 aa, Influenza virus
LLFMIIGGFI

SEQ ID NO: 364665 - protein, 10 aa, Influenza virus
LFMIIGGFIF

SEQ ID NO: 364666 - protein, 10 aa, Influenza virus
FMIIGGFIFG

SEQ ID NO: 364667 - protein, 10 aa, Influenza virus
FIFGCQNGNI

SEQ ID NO: 364668 - protein, 10 aa, Influenza virus
IFGCQNGNIR

SEQ ID NO: 364669 - protein, 10 aa, Influenza virus
FGCQNGNIRC

SEQ ID NO: 364670 - protein, 10 aa, Influenza virus
GCQNGNIRCT

SEQ ID NO: 364671 - protein, 10 aa, Influenza virus
CQNGNIRCTF

SEQ ID NO: 364672 - protein, 10 aa, Influenza virus
QNGNIRCTFC

SEQ ID NO: 364673 - protein, 10 aa, Influenza virus
NGNIRCTFCI

SEQ ID NO: 364674 - protein, 10 aa, Influenza virus
ADKICVGYLS

SEQ ID NO: 364675 - protein, 10 aa, Influenza virus
DKICVGYLST

SEQ ID NO: 364676 - protein, 10 aa, Influenza virus
KICVGYLSTN

SEQ ID NO: 364677 - protein, 10 aa, Influenza virus
ICIGYLSTNS

SEQ ID NO: 364678 - protein, 10 aa, Influenza virus
CVGYLSTNST

SEQ ID NO: 364679 - protein, 10 aa, Influenza virus
VGYLSTNSTE

SEQ ID NO: 364680 - protein, 10 aa, Influenza virus
GYLSTNSSEK

SEQ ID NO: 364681 - protein, 10 aa, Influenza virus
YLSTNSSEKV

SEQ ID NO: 364682 - protein, 10 aa, Influenza virus
LSTNSSEKVD

SEQ ID NO: 364683 - protein, 10 aa, Influenza virus
STNSSEKVDT

SEQ ID NO: 364684 - protein, 10 aa, Influenza virus
TNSSEKVDTL

SEQ ID NO: 364685 - protein, 10 aa, Influenza virus
NSSEKVDTLL

SEQ ID NO: 364686 - protein, 10 aa, Influenza virus
SSEKVDTLLE

SEQ ID NO: 364687 - protein, 10 aa, Influenza virus
VDTLLENDVP

SEQ ID NO: 364688 - protein, 10 aa, Influenza virus
DTLLENDVPV

SEQ ID NO: 364689 - protein, 10 aa, Influenza virus
TLLENDVPVT

SEQ ID NO: 364690 - protein, 10 aa, Influenza virus
LLENDVPVTS

SEQ ID NO: 364691 - protein, 10 aa, Influenza virus
LENDVPVTSS

SEQ ID NO: 364692 - protein, 10 aa, Influenza virus
VPVTSSVDLI

SEQ ID NO: 364693 - protein, 10 aa, Influenza virus
PVTSSVDLIE

SEQ ID NO: 364694 - protein, 10 aa, Influenza virus
VTSSVDLIET

SEQ ID NO: 364695 - protein, 10 aa, Influenza virus
DLIETNHTGT

SEQ ID NO: 364696 - protein, 10 aa, Influenza virus
LIETNHTGTY

SEQ ID NO: 364697 - protein, 10 aa, Influenza virus
IETNHTGTYC

SEQ ID NO: 364698 - protein, 10 aa, Influenza virus
ETSHTGTYCS

SEQ ID NO: 364699 - protein, 10 aa, Influenza virus
TSHTGTYCSL

SEQ ID NO: 364700 - protein, 10 aa, Influenza virus
HTGTYCSLDG

SEQ ID NO: 364701 - protein, 10 aa, Influenza virus
GVSPVHLGDC

SEQ ID NO: 364702 - protein, 10 aa, Influenza virus
VSPVHLGDCS

SEQ ID NO: 364703 - protein, 10 aa, Influenza virus
SPVHLGDCRF

SEQ ID NO: 364704 - protein, 10 aa, Influenza virus
PVHLGDCRFE

SEQ ID NO: 364705 - protein, 10 aa, Influenza virus
VHLGDCRFEG

SEQ ID NO: 364706 - protein, 10 aa, Influenza virus
HLGDCRFEGW

SEQ ID NO: 364707 - protein, 10 aa, Influenza virus
LGDCRFEGWI

SEQ ID NO: 364708 - protein, 10 aa, Influenza virus
GDCRFEGWIV

SEQ ID NO: 364709 - protein, 10 aa, Influenza virus
DCRFEGWIVG

SEQ ID NO: 364710 - protein, 10 aa, Influenza virus
CRFEGWIVGN

SEQ ID NO: 364711 - protein, 10 aa, Influenza virus
RFEGWIVGNP

SEQ ID NO: 364712 - protein, 10 aa, Influenza virus
FEGWIVGNPS

SEQ ID NO: 364713 - protein, 10 aa, Influenza virus
EGWIVGNPSC

SEQ ID NO: 364714 - protein, 10 aa, Influenza virus
GTREWSYLIE

SEQ ID NO: 364715 - protein, 10 aa, Influenza virus
VREWSYLIED

SEQ ID NO: 364716 - protein, 10 aa, Influenza virus
EWSYLIEDPG

SEQ ID NO: 364717 - protein, 10 aa, Influenza virus
WSYLIEDPGA

SEQ ID NO: 364718 - protein, 10 aa, Influenza virus
SYLIEDPGAP

SEQ ID NO: 364719 - protein, 10 aa, Influenza virus
YLIEDPGAPH

SEQ ID NO: 364720 - protein, 10 aa, Influenza virus
LIEDPGAPHG

SEQ ID NO: 364721 - protein, 10 aa, Influenza virus
IEDPGAPHGL

SEQ ID NO: 364722 - protein, 10 aa, Influenza virus
EDPGAPHGLC

SEQ ID NO: 364723 - protein, 10 aa, Influenza virus
DPGAPHGLCY

SEQ ID NO: 364724 - protein, 10 aa, Influenza virus
PGAPHGLCYP

SEQ ID NO: 364725 - protein, 10 aa, Influenza virus
GAPHGLCYPG

SEQ ID NO: 364726 - protein, 10 aa, Influenza virus
APHRLCYPGE

SEQ ID NO: 364727 - protein, 10 aa, Influenza virus
PHRLCYPGEL

SEQ ID NO: 364728 - protein, 10 aa, Influenza virus
HGLCYPGELN

SEQ ID NO: 364729 - protein, 10 aa, Influenza virus
GLCYPGELNN

SEQ ID NO: 364730 - protein, 10 aa, Influenza virus
LCYPGELNNN

SEQ ID NO: 364731 - protein, 10 aa, Influenza virus
CYPGELNNNG

SEQ ID NO: 364732 - protein, 10 aa, Influenza virus
YPGELNNNGE

SEQ ID NO: 364733 - protein, 10 aa, Influenza virus
PGELNNNGEL

SEQ ID NO: 364734 - protein, 10 aa, Influenza virus
GELNNNGELR

SEQ ID NO: 364735 - protein, 10 aa, Influenza virus
ELNNNGELRH

SEQ ID NO: 364736 - protein, 10 aa, Influenza virus
LNNNGELRHL

SEQ ID NO: 364737 - protein, 10 aa, Influenza virus
NNNGELRHLF

SEQ ID NO: 364738 - protein, 10 aa, Influenza virus
ELRHLFSGIK

SEQ ID NO: 364739 - protein, 10 aa, Influenza virus
LRHLFSGIKS

SEQ ID NO: 364740 - protein, 10 aa, Influenza virus
RHLFSGIKSF

SEQ ID NO: 364741 - protein, 10 aa, Influenza virus
HLFSGIKSFS

SEQ ID NO: 364742 - protein, 10 aa, Influenza virus
LFSGIKSFSR

SEQ ID NO: 364743 - protein, 10 aa, Influenza virus
FSGIKSFSRT

SEQ ID NO: 364744 - protein, 10 aa, Influenza virus
SGIKSFSRTE

SEQ ID NO: 364745 - protein, 10 aa, Influenza virus
GIKSFSRTEL

SEQ ID NO: 364746 - protein, 10 aa, Influenza virus
IKSFSRTELI

SEQ ID NO: 364747 - protein, 10 aa, Influenza virus
RSFSRTELIA

SEQ ID NO: 364748 - protein, 10 aa, Influenza virus
SFSRTELIPP

SEQ ID NO: 364749 - protein, 10 aa, Influenza virus
TGTSSFYRNL

SEQ ID NO: 364750 - protein, 10 aa, Influenza virus
GTYNNTTGRD

SEQ ID NO: 364751 - protein, 10 aa, Influenza virus
AYNNTTGRDV

SEQ ID NO: 364752 - protein, 10 aa, Influenza virus
NTTGRDVLVM

SEQ ID NO: 364753 - protein, 10 aa, Influenza virus
TTGRDVLVMW

SEQ ID NO: 364754 - protein, 10 aa, Influenza virus
TGRDVLVMWG

SEQ ID NO: 364755 - protein, 10 aa, Influenza virus
GRDVLVMWGI

SEQ ID NO: 364756 - protein, 10 aa, Influenza virus
RDVLVMWGIH

SEQ ID NO: 364757 - protein, 10 aa, Influenza virus
DVLVMWGIHH

SEQ ID NO: 364758 - protein, 10 aa, Influenza virus
VLVMWGIHHP

SEQ ID NO: 364759 - protein, 10 aa, Influenza virus
PYTLVSTKSW

SEQ ID NO: 364760 - protein, 10 aa, Influenza virus
YTLVSTKSWS

SEQ ID NO: 364761 - protein, 10 aa, Influenza virus
GIRPGYNGQK

SEQ ID NO: 364762 - protein, 10 aa, Influenza virus
IRPGYNGQKS

SEQ ID NO: 364763 - protein, 10 aa, Influenza virus
RPGYNGQRSW

SEQ ID NO: 364764 - protein, 10 aa, Influenza virus
PGYNGQKSWM

SEQ ID NO: 364765 - protein, 10 aa, Influenza virus
GYNGQKSWMK

SEQ ID NO: 364766 - protein, 10 aa, Influenza virus
YNGQKSWMKI

SEQ ID NO: 364767 - protein, 10 aa, Influenza virus
NGQKSWMKIY

SEQ ID NO: 364768 - protein, 10 aa, Influenza virus
GQKSWMKIYW

SEQ ID NO: 364769 - protein, 10 aa, Influenza virus
ITFESNGGLL

SEQ ID NO: 364770 - protein, 10 aa, Influenza virus
TFESNGGLLA

SEQ ID NO: 364771 - protein, 10 aa, Influenza virus
FESNGGFLAP

SEQ ID NO: 364772 - protein, 10 aa, Influenza virus
ESNGGLLAPK

SEQ ID NO: 364773 - protein, 10 aa, Influenza virus
SNGGLLAPKY

SEQ ID NO: 364774 - protein, 10 aa, Influenza virus
NGGLLAPKYG

SEQ ID NO: 364775 - protein, 10 aa, Influenza virus
GGLLAPKYGY

SEQ ID NO: 364776 - protein, 10 aa, Influenza virus
GLLAPKYGYI

SEQ ID NO: 364777 - protein, 10 aa, Influenza virus
LLAPKYGYII

SEQ ID NO: 364778 - protein, 10 aa, Influenza virus
LAPKYGYIIE

SEQ ID NO: 364779 - protein, 10 aa, Influenza virus
APKYGYIIEE

SEQ ID NO: 364780 - protein, 10 aa, Influenza virus
PKYGYIIEEY

SEQ ID NO: 364781 - protein, 10 aa, Influenza virus
KYGYIIEEYG

SEQ ID NO: 364782 - protein, 10 aa, Influenza virus
YGYIIEEYGR

SEQ ID NO: 364783 - protein, 10 aa, Influenza virus
GYIIEEYGRG

SEQ ID NO: 364784 - protein, 10 aa, Influenza virus
YIIEEYGRGR

SEQ ID NO: 364785 - protein, 10 aa, Influenza virus
IIEEYGRGRI

SEQ ID NO: 364786 - protein, 10 aa, Influenza virus
IEEYGRGRIF

SEQ ID NO: 364787 - protein, 10 aa, Influenza virus
EEYGRGRIFQ

SEQ ID NO: 364788 - protein, 10 aa, Influenza virus
EYGRGRIFQS

SEQ ID NO: 364789 - protein, 10 aa, Influenza virus
YGKGRIFQSP

SEQ ID NO: 364790 - protein, 10 aa, Influenza virus
GKGRIFQSPI

SEQ ID NO: 364791 - protein, 10 aa, Influenza virus
KGRIFQSPIR

SEQ ID NO: 364792 - protein, 10 aa, Influenza virus
RCNTKCQTSV

SEQ ID NO: 364793 - protein, 10 aa, Influenza virus
CNTRCQTSVG

SEQ ID NO: 364794 - protein, 10 aa, Influenza virus
NTRCQTSVGG

SEQ ID NO: 364795 - protein, 10 aa, Influenza virus
TRCQTSVGGI

SEQ ID NO: 364796 - protein, 10 aa, Influenza virus
RCQTSVGGIN

SEQ ID NO: 364797 - protein, 10 aa, Influenza virus
CQTSVGGIDT

SEQ ID NO: 364798 - protein, 10 aa, Influenza virus
QTSVGGIDTN

SEQ ID NO: 364799 - protein, 10 aa, Influenza virus
TSVGGINTNR

SEQ ID NO: 364800 - protein, 10 aa, Influenza virus
SVGGINTNRT

SEQ ID NO: 364801 - protein, 10 aa, Influenza virus
VGGINTNRTF

SEQ ID NO: 364802 - protein, 10 aa, Influenza virus
GGINTNRTFQ

SEQ ID NO: 364803 - protein, 10 aa, Influenza virus
GINTNRTFQN

SEQ ID NO: 364804 - protein, 10 aa, Influenza virus
INTNRTFQNI

SEQ ID NO: 364805 - protein, 10 aa, Influenza virus
NTNRTFQNID

SEQ ID NO: 364806 - protein, 10 aa, Influenza virus
TNRTFQNIDK

SEQ ID NO: 364807 - protein, 10 aa, Influenza virus
NRTFQNIDKN

SEQ ID NO: 364808 - protein, 10 aa, Influenza virus
RTFQNIDKNA

SEQ ID NO: 364809 - protein, 10 aa, Influenza virus
TFQNIDKNAL

SEQ ID NO: 364810 - protein, 10 aa, Influenza virus
FQNIDKNALG

SEQ ID NO: 364811 - protein, 10 aa, Influenza virus
QNIDKNALGD

SEQ ID NO: 364812 - protein, 10 aa, Influenza virus
NIDKNALGDC

SEQ ID NO: 364813 - protein, 10 aa, Influenza virus
IDKNALGDCP

SEQ ID NO: 364814 - protein, 10 aa, Influenza virus
DKNALGDCPK

SEQ ID NO: 364815 - protein, 10 aa, Influenza virus
KNALGDCPKY

SEQ ID NO: 364816 - protein, 10 aa, Influenza virus
NALGNCPKYI

SEQ ID NO: 364817 - protein, 10 aa, Influenza virus
ALGNCPKYIK

SEQ ID NO: 364818 - protein, 10 aa, Influenza virus
LGNCPKYIKS

SEQ ID NO: 364819 - protein, 10 aa, Influenza virus
GNCPKYIKSG

SEQ ID NO: 364820 - protein, 10 aa, Influenza virus
NCPKYIKSGQ

SEQ ID NO: 364821 - protein, 10 aa, Influenza virus
CPKYIKSDQL

SEQ ID NO: 364822 - protein, 10 aa, Influenza virus
PKYIKSDQLK

SEQ ID NO: 364823 - protein, 10 aa, Influenza virus
KYIKSDQLKL

SEQ ID NO: 364824 - protein, 10 aa, Influenza virus
YIKSDQLKLA

SEQ ID NO: 364825 - protein, 10 aa, Influenza virus
IKSDQLKLAT

SEQ ID NO: 364826 - protein, 10 aa, Influenza virus
KSDQLKLATG

SEQ ID NO: 364827 - protein, 10 aa, Influenza virus
SDQLKLATGL

SEQ ID NO: 364828 - protein, 10 aa, Influenza virus
DQLKLATGLR

SEQ ID NO: 364829 - protein, 10 aa, Influenza virus
QLKLATGLKN

SEQ ID NO: 364830 - protein, 10 aa, Influenza virus
LKLATGLRNI

SEQ ID NO: 364831 - protein, 10 aa, Influenza virus
KLATGLRNIP

SEQ ID NO: 364832 - protein, 10 aa, Influenza virus
LATGLRNVPT

SEQ ID NO: 364833 - protein, 10 aa, Influenza virus
RGFFGAIAGF

SEQ ID NO: 364834 - protein, 10 aa, Influenza virus
GLLGAIAGFI

SEQ ID NO: 364835 - protein, 10 aa, Influenza virus
FFGAIAGFIE

SEQ ID NO: 364836 - protein, 10 aa, Influenza virus
DGTIAGFIEG

SEQ ID NO: 364837 - protein, 10 aa, Influenza virus
GTIAGFIEGG

SEQ ID NO: 364838 - protein, 10 aa, Influenza virus
TIAGFIEGGW

SEQ ID NO: 364839 - protein, 10 aa, Influenza virus
GFQHQNEQGT

SEQ ID NO: 364840 - protein, 10 aa, Influenza virus
FQHQNEQGTG

SEQ ID NO: 364841 - protein, 10 aa, Influenza virus
QHQNEQGVGM

SEQ ID NO: 364842 - protein, 10 aa, Influenza virus
HQNEQGVGMA

SEQ ID NO: 364843 - protein, 10 aa, Influenza virus
QNEQGVGMAA

SEQ ID NO: 364844 - protein, 10 aa, Influenza virus
NEQGVGMAAD

SEQ ID NO: 364845 - protein, 10 aa, Influenza virus
EQGVGMAADK

SEQ ID NO: 364846 - protein, 10 aa, Influenza virus
QGVGMAADKE

SEQ ID NO: 364847 - protein, 10 aa, Influenza virus
GVGMAADKES

SEQ ID NO: 364848 - protein, 10 aa, Influenza virus
VGMAADKEST

SEQ ID NO: 364849 - protein, 10 aa, Influenza virus
GMAADKESTQ

SEQ ID NO: 364850 - protein, 10 aa, Influenza virus
MAADKESTQK

SEQ ID NO: 364851 - protein, 10 aa, Influenza virus
AAEKESTQKA

SEQ ID NO: 364852 - protein, 10 aa, Influenza virus
AEKESTQKAI

SEQ ID NO: 364853 - protein, 10 aa, Influenza virus
EKESTQKAID

SEQ ID NO: 364854 - protein, 10 aa, Influenza virus
KESTQKAIDR

SEQ ID NO: 364855 - protein, 10 aa, Influenza virus
ESTQKAIDRI

SEQ ID NO: 364856 - protein, 10 aa, Influenza virus
STQKAIDRIT

SEQ ID NO: 364857 - protein, 10 aa, Influenza virus
TQKAIDRITT

SEQ ID NO: 364858 - protein, 10 aa, Influenza virus
QKAIDRITTK

SEQ ID NO: 364859 - protein, 10 aa, Influenza virus
KAIDRITTKI

SEQ ID NO: 364860 - protein, 10 aa, Influenza virus
AIDRITTKIN

SEQ ID NO: 364861 - protein, 10 aa, Influenza virus
IDRITTKINN

SEQ ID NO: 364862 - protein, 10 aa, Influenza virus
DRITTKINNI

SEQ ID NO: 364863 - protein, 10 aa, Influenza virus
RITTKINNII

SEQ ID NO: 364864 - protein, 10 aa, Influenza virus
ITTKINNIIE

SEQ ID NO: 364865 - protein, 10 aa, Influenza virus
TTKINNIIEK

SEQ ID NO: 364866 - protein, 10 aa, Influenza virus
TKINNIIEKM

SEQ ID NO: 364867 - protein, 10 aa, Influenza virus
KINNIIEKMN

SEQ ID NO: 364868 - protein, 10 aa, Influenza virus
INNIIEKMNG

SEQ ID NO: 364869 - protein, 10 aa, Influenza virus
NNIIEKMNGN

SEQ ID NO: 364870 - protein, 10 aa, Influenza virus
NIIEKMNGNY

SEQ ID NO: 364871 - protein, 10 aa, Influenza virus
IIEKMNGNYD

SEQ ID NO: 364872 - protein, 10 aa, Influenza virus
IEKMNGNYDS

SEQ ID NO: 364873 - protein, 10 aa, Influenza virus
EKMNGNYDSI

SEQ ID NO: 364874 - protein, 10 aa, Influenza virus
NYDSIRGEFS

SEQ ID NO: 364875 - protein, 10 aa, Influenza virus
YDSIRGEFSQ

SEQ ID NO: 364876 - protein, 10 aa, Influenza virus
DSIRGEFSQV

SEQ ID NO: 364877 - protein, 10 aa, Influenza virus
SIRGEFSQVE

SEQ ID NO: 364878 - protein, 10 aa, Influenza virus
IRGEFSQVEQ

SEQ ID NO: 364879 - protein, 10 aa, Influenza virus
RGEFSQVEQR

SEQ ID NO: 364880 - protein, 10 aa, Influenza virus
GEFSQVEQRI

SEQ ID NO: 364881 - protein, 10 aa, Influenza virus
EFSQVEQRIN

SEQ ID NO: 364882 - protein, 10 aa, Influenza virus
FSQVEQRINM

SEQ ID NO: 364883 - protein, 10 aa, Influenza virus
SQVEQRINML

SEQ ID NO: 364884 - protein, 10 aa, Influenza virus
QVEKRINMLA

SEQ ID NO: 364885 - protein, 10 aa, Influenza virus
VEKRINMLAD

SEQ ID NO: 364886 - protein, 10 aa, Influenza virus
EKRINMLADR

SEQ ID NO: 364887 - protein, 10 aa, Influenza virus
KRINMLADRI

SEQ ID NO: 364888 - protein, 10 aa, Influenza virus
DRIDDAVTDI

SEQ ID NO: 364889 - protein, 10 aa, Influenza virus
RIDDAVTDIW

SEQ ID NO: 364890 - protein, 10 aa, Influenza virus
IDDAVTDIWS

SEQ ID NO: 364891 - protein, 10 aa, Influenza virus
DDAVTDIWSY

SEQ ID NO: 364892 - protein, 10 aa, Influenza virus
DAVTDIWSYN

SEQ ID NO: 364893 - protein, 10 aa, Influenza virus
AVTDIWSYNA

SEQ ID NO: 364894 - protein, 10 aa, Influenza virus
VTDIWSYNAK

SEQ ID NO: 364895 - protein, 10 aa, Influenza virus
TDIWSYNAKL

SEQ ID NO: 364896 - protein, 10 aa, Influenza virus
DIWSYNAKLL

SEQ ID NO: 364897 - protein, 10 aa, Influenza virus
IWSYNAKLLV

SEQ ID NO: 364898 - protein, 10 aa, Influenza virus
WSYNARLLVL

SEQ ID NO: 364899 - protein, 10 aa, Influenza virus
SYNARLLVLL

SEQ ID NO: 364900 - protein, 10 aa, Influenza virus
YNARLLVLLE

SEQ ID NO: 364901 - protein, 10 aa, Influenza virus
NARLLVLLEN

SEQ ID NO: 364902 - protein, 10 aa, Influenza virus
ARLLVLLEND

SEQ ID NO: 364903 - protein, 10 aa, Influenza virus
RLLVLLENDK

SEQ ID NO: 364904 - protein, 10 aa, Influenza virus
VLLENDKTLN

SEQ ID NO: 364905 - protein, 10 aa, Influenza virus
LLENDKTLDL

SEQ ID NO: 364906 - protein, 10 aa, Influenza virus
LENDKTLDLH

SEQ ID NO: 364907 - protein, 10 aa, Influenza virus
ENDKTLDLHD

SEQ ID NO: 364908 - protein, 10 aa, Influenza virus
NDKTLDLHDA

SEQ ID NO: 364909 - protein, 10 aa, Influenza virus
DKTLDLHDAN

SEQ ID NO: 364910 - protein, 10 aa, Influenza virus
KTLDLHDANV

SEQ ID NO: 364911 - protein, 10 aa, Influenza virus
TLDMHDANVK

SEQ ID NO: 364912 - protein, 10 aa, Influenza virus
LDMHDANVKN

SEQ ID NO: 364913 - protein, 10 aa, Influenza virus
DMHDANVKNL

SEQ ID NO: 364914 - protein, 10 aa, Influenza virus
MHDANVKNLH

SEQ ID NO: 364915 - protein, 10 aa, Influenza virus
HDANVRNLHE

SEQ ID NO: 364916 - protein, 10 aa, Influenza virus
DANVRNLHEQ

SEQ ID NO: 364917 - protein, 10 aa, Influenza virus
ANVRNLHEQV

SEQ ID NO: 364918 - protein, 10 aa, Influenza virus
NVRNLHEQVR

SEQ ID NO: 364919 - protein, 10 aa, Influenza virus
NAVDEGNGCF

SEQ ID NO: 364920 - protein, 10 aa, Influenza virus
AVDEGNGCFE

SEQ ID NO: 364921 - protein, 10 aa, Influenza virus
VDEGNGCFEL

SEQ ID NO: 364922 - protein, 10 aa, Influenza virus
NEGNGCFELL

SEQ ID NO: 364923 - protein, 10 aa, Influenza virus
CFELLHKCNN

SEQ ID NO: 364924 - protein, 10 aa, Influenza virus
FELLHKCNNS

SEQ ID NO: 364925 - protein, 10 aa, Influenza virus
ELLHKCNNSC

SEQ ID NO: 364926 - protein, 10 aa, Influenza virus
LLHKCNNSCM

SEQ ID NO: 364927 - protein, 10 aa, Influenza virus
LHKCNNSCME

SEQ ID NO: 364928 - protein, 10 aa, Influenza virus
HKCNNSCMET

SEQ ID NO: 364929 - protein, 10 aa, Influenza virus
KCNNSCMETI

SEQ ID NO: 364930 - protein, 10 aa, Influenza virus
CNNSCMETIR

SEQ ID NO: 364931 - protein, 10 aa, Influenza virus
NNSCMETIRN

SEQ ID NO: 364932 - protein, 10 aa, Influenza virus
NSCMETIRNG

SEQ ID NO: 364933 - protein, 10 aa, Influenza virus
SCMDTIRNGT

SEQ ID NO: 364934 - protein, 10 aa, Influenza virus
CMDTIRNGTY

SEQ ID NO: 364935 - protein, 10 aa, Influenza virus
METIRNGTYD

SEQ ID NO: 364936 - protein, 10 aa, Influenza virus
ETIRNGTYDH

SEQ ID NO: 364937 - protein, 10 aa, Influenza virus
TIRNGTYDHT

SEQ ID NO: 364938 - protein, 10 aa, Influenza virus
EYEEESKLKR

SEQ ID NO: 364939 - protein, 10 aa, Influenza virus
YEEESKLKRQ

SEQ ID NO: 364940 - protein, 10 aa, Influenza virus
EEESKLKRQE

SEQ ID NO: 364941 - protein, 10 aa, Influenza virus
ESKLKRQEIN

SEQ ID NO: 364942 - protein, 10 aa, Influenza virus
SKLKRQEING

SEQ ID NO: 364943 - protein, 10 aa, Influenza virus
KLKRQEINGI

SEQ ID NO: 364944 - protein, 10 aa, Influenza virus
LKRQEINGIK

SEQ ID NO: 364945 - protein, 10 aa, Influenza virus
KRQEINGIKL

SEQ ID NO: 364946 - protein, 10 aa, Influenza virus
RQEINGIKLK

SEQ ID NO: 364947 - protein, 10 aa, Influenza virus
QEINGIKLKS

SEQ ID NO: 364948 - protein, 10 aa, Influenza virus
SDDSVYKALS

SEQ ID NO: 364949 - protein, 10 aa, Influenza virus
DDSVYKALSI

SEQ ID NO: 364950 - protein, 10 aa, Influenza virus
DSVYKALSIY

SEQ ID NO: 364951 - protein, 10 aa, Influenza virus
SVYKALSIYS

SEQ ID NO: 364952 - protein, 10 aa, Influenza virus
VYRALSIYSC

SEQ ID NO: 364953 - protein, 10 aa, Influenza virus
YRALSIYSCI

SEQ ID NO: 364954 - protein, 10 aa, Influenza virus
RALSIYSCIA

SEQ ID NO: 364955 - protein, 10 aa, Influenza virus
SIYSCIASSI

SEQ ID NO: 364956 - protein, 10 aa, Influenza virus
IYSCIASSIV

SEQ ID NO: 364957 - protein, 10 aa, Influenza virus
YSCIASSIVL

SEQ ID NO: 364958 - protein, 10 aa, Influenza virus
SCIASSIVLV

SEQ ID NO: 364959 - protein, 10 aa, Influenza virus
CIASSIVLVG

SEQ ID NO: 364960 - protein, 10 aa, Influenza virus
IASSIVLVGL

SEQ ID NO: 364961 - protein, 10 aa, Influenza virus
ASSIVLVGLI

SEQ ID NO: 364962 - protein, 10 aa, Influenza virus
SSIVLVGLIL

SEQ ID NO: 364963 - protein, 10 aa, Influenza virus
VLVGLILSFI

SEQ ID NO: 364964 - protein, 10 aa, Influenza virus
LVGLILSFIM

SEQ ID NO: 364965 - protein, 10 aa, Influenza virus
VGLILSFIMW

SEQ ID NO: 364966 - protein, 10 aa, Influenza virus
GLILSFIMWA

SEQ ID NO: 364967 - protein, 10 aa, Influenza virus
LILSFIMWAC

SEQ ID NO: 364968 - protein, 10 aa, Influenza virus
FIMWACSNGS

SEQ ID NO: 364969 - protein, 10 aa, Influenza virus
IMWACSNGSC

SEQ ID NO: 364970 - protein, 10 aa, Influenza virus
MWACSNGSCR

SEQ ID NO: 364971 - protein, 10 aa, Influenza virus
WACSNGSCRF

SEQ ID NO: 364972 - protein, 10 aa, Influenza virus
GSEHTAYSQI

SEQ ID NO: 364973 - protein, 10 aa, Influenza virus
SEHTAYSQIT

SEQ ID NO: 364974 - protein, 10 aa, Influenza virus
EHTAYSQITN

SEQ ID NO: 364975 - protein, 10 aa, Influenza virus
FSRLNWLTKE

SEQ ID NO: 364976 - protein, 10 aa, Influenza virus
SRLNWLTKET

SEQ ID NO: 364977 - protein, 10 aa, Influenza virus
RLNWLTKETN

SEQ ID NO: 364978 - protein, 10 aa, Influenza virus
LNWLTKETNG

SEQ ID NO: 364979 - protein, 10 aa, Influenza virus
NWLTKETNGN

SEQ ID NO: 364980 - protein, 10 aa, Influenza virus
WLTKETNGNY

SEQ ID NO: 364981 - protein, 10 aa, Influenza virus
LTKETNGNYG

SEQ ID NO: 364982 - protein, 10 aa, Influenza virus
TKETNGNYGP

SEQ ID NO: 364983 - protein, 10 aa, Influenza virus
KETNGNYGPI

SEQ ID NO: 364984 - protein, 10 aa, Influenza virus
ETNGNYGPIN

SEQ ID NO: 364985 - protein, 10 aa, Influenza virus
ILVLGLSMVR

SEQ ID NO: 364986 - protein, 10 aa, Influenza virus
LVLGLSMVRS

SEQ ID NO: 364987 - protein, 10 aa, Influenza virus
VLGLSMVRSD

SEQ ID NO: 364988 - protein, 10 aa, Influenza virus
LGLSMVRSDK

SEQ ID NO: 364989 - protein, 10 aa, Influenza virus
GLSMVRSDKI

SEQ ID NO: 364990 - protein, 10 aa, Influenza virus
LSMVRSDKIC

SEQ ID NO: 364991 - protein, 10 aa, Influenza virus
SMVRSDKICL

SEQ ID NO: 364992 - protein, 10 aa, Influenza virus
MVRSDKICLG

SEQ ID NO: 364993 - protein, 10 aa, Influenza virus
VRSDKICLGH

SEQ ID NO: 364994 - protein, 10 aa, Influenza virus
RSDKICLGHH

SEQ ID NO: 364995 - protein, 10 aa, Influenza virus
KICLGHHAVP

SEQ ID NO: 364996 - protein, 10 aa, Influenza virus
ICLGHHAVPN

SEQ ID NO: 364997 - protein, 10 aa, Influenza virus
CLGHHAVPNG

SEQ ID NO: 364998 - protein, 10 aa, Influenza virus
LGHHAVPNGT

SEQ ID NO: 364999 - protein, 10 aa, Influenza virus
GHHAVPNGTK

SEQ ID NO: 365000 - protein, 10 aa, Influenza virus
HHAVPNGTKV

SEQ ID NO: 365001 - protein, 10 aa, Influenza virus
HAVPNGTKVN

SEQ ID NO: 365002 - protein, 10 aa, Influenza virus
AVPNGTKVNT

SEQ ID NO: 365003 - protein, 10 aa, Influenza virus
VPNGTKVNTL

SEQ ID NO: 365004 - protein, 10 aa, Influenza virus
PNGTKVNTLT

SEQ ID NO: 365005 - protein, 10 aa, Influenza virus
GTKVNTLTEK

SEQ ID NO: 365006 - protein, 10 aa, Influenza virus
TKVNTLTEKG

SEQ ID NO: 365007 - protein, 10 aa, Influenza virus
KVNTLTEKGV

SEQ ID NO: 365008 - protein, 10 aa, Influenza virus
VNTLTEKGVE

SEQ ID NO: 365009 - protein, 10 aa, Influenza virus
NTLTEKGVEV

SEQ ID NO: 365010 - protein, 10 aa, Influenza virus
TLTEKGVEVV

SEQ ID NO: 365011 - protein, 10 aa, Influenza virus
LTEKGVEVVN

SEQ ID NO: 365012 - protein, 10 aa, Influenza virus
TEKGVEVVNA

SEQ ID NO: 365013 - protein, 10 aa, Influenza virus
EKGVEVVNAT

SEQ ID NO: 365014 - protein, 10 aa, Influenza virus
KGVEVVNATE

SEQ ID NO: 365015 - protein, 10 aa, Influenza virus
TETVEITGIN

SEQ ID NO: 365016 - protein, 10 aa, Influenza virus
ETVEITGINK

SEQ ID NO: 365017 - protein, 10 aa, Influenza virus
TVEITGINKV

SEQ ID NO: 365018 - protein, 10 aa, Influenza virus
VEITGINKVC

SEQ ID NO: 365019 - protein, 10 aa, Influenza virus
EITGINKVCT

SEQ ID NO: 365020 - protein, 10 aa, Influenza virus
ITGINKVCTK

SEQ ID NO: 365021 - protein, 10 aa, Influenza virus
TGINKVCTKG

SEQ ID NO: 365022 - protein, 10 aa, Influenza virus
GINKVCTKGK

SEQ ID NO: 365023 - protein, 10 aa, Influenza virus
INKVCTKGKK

SEQ ID NO: 365024 - protein, 10 aa, Influenza virus
NKVCTKGKKA

SEQ ID NO: 365025 - protein, 10 aa, Influenza virus
TIIGPPQCDS

SEQ ID NO: 365026 - protein, 10 aa, Influenza virus
IIGPPQCDSH

SEQ ID NO: 365027 - protein, 10 aa, Influenza virus
IGPPQCDSHL

SEQ ID NO: 365028 - protein, 10 aa, Influenza virus
GPPQCDSHLK

SEQ ID NO: 365029 - protein, 10 aa, Influenza virus
PPQCDSHLKF

SEQ ID NO: 365030 - protein, 10 aa, Influenza virus
PQCDSHLKFK

SEQ ID NO: 365031 - protein, 10 aa, Influenza virus
QCDSHLKFKA

SEQ ID NO: 365032 - protein, 10 aa, Influenza virus
CDSHLKFKAD

SEQ ID NO: 365033 - protein, 10 aa, Influenza virus
DSHLKFKADL

SEQ ID NO: 365034 - protein, 10 aa, Influenza virus
SHLKFKADLI

SEQ ID NO: 365035 - protein, 10 aa, Influenza virus
HLKFKADLII

SEQ ID NO: 365036 - protein, 10 aa, Influenza virus
LKFKADLIIE

SEQ ID NO: 365037 - protein, 10 aa, Influenza virus
KFKADLIIER

SEQ ID NO: 365038 - protein, 10 aa, Influenza virus
NSSDICYPGK

SEQ ID NO: 365039 - protein, 10 aa, Influenza virus
SSDICYPGKF

SEQ ID NO: 365040 - protein, 10 aa, Influenza virus
SDICYPGKFT

SEQ ID NO: 365041 - protein, 10 aa, Influenza virus
DICYPGKFTN

SEQ ID NO: 365042 - protein, 10 aa, Influenza virus
ICYPGKFTNE

SEQ ID NO: 365043 - protein, 10 aa, Influenza virus
CYPGKFTNEE

SEQ ID NO: 365044 - protein, 10 aa, Influenza virus
YPGKFTNEEA

SEQ ID NO: 365045 - protein, 10 aa, Influenza virus
PGKFTNEEAL

SEQ ID NO: 365046 - protein, 10 aa, Influenza virus
GKFTNEEALR

SEQ ID NO: 365047 - protein, 10 aa, Influenza virus
KFTNEEALRQ

SEQ ID NO: 365048 - protein, 10 aa, Influenza virus
RESGGIDKEP

SEQ ID NO: 365049 - protein, 10 aa, Influenza virus
ESGGIDKEPM

SEQ ID NO: 365050 - protein, 10 aa, Influenza virus
SGGIDKEPMG

SEQ ID NO: 365051 - protein, 10 aa, Influenza virus
GGIDKEPMGF

SEQ ID NO: 365052 - protein, 10 aa, Influenza virus
GIDKEPMGFR

SEQ ID NO: 365053 - protein, 10 aa, Influenza virus
IDKEPMGFRY

SEQ ID NO: 365054 - protein, 10 aa, Influenza virus
DKEPMGFRYS

SEQ ID NO: 365055 - protein, 10 aa, Influenza virus
KEPMGFRYSG

SEQ ID NO: 365056 - protein, 10 aa, Influenza virus
EPMGFRYSGI

SEQ ID NO: 365057 - protein, 10 aa, Influenza virus
PMGFRYSGIK

SEQ ID NO: 365058 - protein, 10 aa, Influenza virus
MGFRYSGIKT

SEQ ID NO: 365059 - protein, 10 aa, Influenza virus
GFRYSGIKTD

SEQ ID NO: 365060 - protein, 10 aa, Influenza virus
FRYSGIKTDG

SEQ ID NO: 365061 - protein, 10 aa, Influenza virus
RYSGIKTDGA

SEQ ID NO: 365062 - protein, 10 aa, Influenza virus
YSGIKTDGAT

SEQ ID NO: 365063 - protein, 10 aa, Influenza virus
SGIKTDGATS

SEQ ID NO: 365064 - protein, 10 aa, Influenza virus
GIKTDGATSA

SEQ ID NO: 365065 - protein, 10 aa, Influenza virus
IKTDGATSAC

SEQ ID NO: 365066 - protein, 10 aa, Influenza virus
KTDGATSACK

SEQ ID NO: 365067 - protein, 10 aa, Influenza virus
SFYSEMKWLL

SEQ ID NO: 365068 - protein, 10 aa, Influenza virus
FYSEMKWLLS

SEQ ID NO: 365069 - protein, 10 aa, Influenza virus
YSEMKWLLSS

SEQ ID NO: 365070 - protein, 10 aa, Influenza virus
SEMKWLLSSK

SEQ ID NO: 365071 - protein, 10 aa, Influenza virus
EMKWLLSSKA

SEQ ID NO: 365072 - protein, 10 aa, Influenza virus
MKWLLSSKAN

SEQ ID NO: 365073 - protein, 10 aa, Influenza virus
KWLLSSKANQ

SEQ ID NO: 365074 - protein, 10 aa, Influenza virus
WLLSSKANQV

SEQ ID NO: 365075 - protein, 10 aa, Influenza virus
LLSSKANQVF

SEQ ID NO: 365076 - protein, 10 aa, Influenza virus
LSSKANQVFP

SEQ ID NO: 365077 - protein, 10 aa, Influenza virus
SSKANQVFPQ

SEQ ID NO: 365078 - protein, 10 aa, Influenza virus
SKANQVFPQL

SEQ ID NO: 365079 - protein, 10 aa, Influenza virus
KANQVFPQLN

SEQ ID NO: 365080 - protein, 10 aa, Influenza virus
ANQVFPQLNQ

SEQ ID NO: 365081 - protein, 10 aa, Influenza virus
PQLNQTYRNN

SEQ ID NO: 365082 - protein, 10 aa, Influenza virus
QLNQTYRNNR

SEQ ID NO: 365083 - protein, 10 aa, Influenza virus
LNQTYRNNRK

SEQ ID NO: 365084 - protein, 10 aa, Influenza virus
NQTYRNNRKE

SEQ ID NO: 365085 - protein, 10 aa, Influenza virus
QTYRNNRKEP

SEQ ID NO: 365086 - protein, 10 aa, Influenza virus
TYRNNRKEPA

SEQ ID NO: 365087 - protein, 10 aa, Influenza virus
YRNNRKEPAL

SEQ ID NO: 365088 - protein, 10 aa, Influenza virus
RNNRKEPALI

SEQ ID NO: 365089 - protein, 10 aa, Influenza virus
NNRKEPALIV

SEQ ID NO: 365090 - protein, 10 aa, Influenza virus
NRKEPALIVW

SEQ ID NO: 365091 - protein, 10 aa, Influenza virus
LDEQNKLYGA

SEQ ID NO: 365092 - protein, 10 aa, Influenza virus
DEQNKLYGAG

SEQ ID NO: 365093 - protein, 10 aa, Influenza virus
EQNKLYGAGN

SEQ ID NO: 365094 - protein, 10 aa, Influenza virus
QNKLYGAGNK

SEQ ID NO: 365095 - protein, 10 aa, Influenza virus
NKLYGAGNKL

SEQ ID NO: 365096 - protein, 10 aa, Influenza virus
KLYGAGNKLI

SEQ ID NO: 365097 - protein, 10 aa, Influenza virus
LYGAGNKLIT

SEQ ID NO: 365098 - protein, 10 aa, Influenza virus
YGAGNKLITV

SEQ ID NO: 365099 - protein, 10 aa, Influenza virus
GAGNKLITVG

SEQ ID NO: 365100 - protein, 10 aa, Influenza virus
AGNKLITVGS

SEQ ID NO: 365101 - protein, 10 aa, Influenza virus
LITVGSSKYR

SEQ ID NO: 365102 - protein, 10 aa, Influenza virus
ITVGSSKYRQ

SEQ ID NO: 365103 - protein, 10 aa, Influenza virus
TVGSSKYRQS

SEQ ID NO: 365104 - protein, 10 aa, Influenza virus
VGSSKYRQSF

SEQ ID NO: 365105 - protein, 10 aa, Influenza virus
GSSKYRQSFS

SEQ ID NO: 365106 - protein, 10 aa, Influenza virus
SSKYRQSFSP

SEQ ID NO: 365107 - protein, 10 aa, Influenza virus
SKYRQSFSPS

SEQ ID NO: 365108 - protein, 10 aa, Influenza virus
KYRQSFSPSP

SEQ ID NO: 365109 - protein, 10 aa, Influenza virus
YRQSFSPSPG

SEQ ID NO: 365110 - protein, 10 aa, Influenza virus
QQSFSPSPGD

SEQ ID NO: 365111 - protein, 10 aa, Influenza virus
QSFSPSPGDR

SEQ ID NO: 365112 - protein, 10 aa, Influenza virus
SFSPSPGDRP

SEQ ID NO: 365113 - protein, 10 aa, Influenza virus
FSPSPGDRPK

SEQ ID NO: 365114 - protein, 10 aa, Influenza virus
SPSPGDRPKV

SEQ ID NO: 365115 - protein, 10 aa, Influenza virus
PSPGDRPKVN

SEQ ID NO: 365116 - protein, 10 aa, Influenza virus
SPGDRPKVNG

SEQ ID NO: 365117 - protein, 10 aa, Influenza virus
PGDRPKVNGQ

SEQ ID NO: 365118 - protein, 10 aa, Influenza virus
GDRPKVNGQA

SEQ ID NO: 365119 - protein, 10 aa, Influenza virus
DRPKVNGQAG

SEQ ID NO: 365120 - protein, 10 aa, Influenza virus
FLRSNAPSGV

SEQ ID NO: 365121 - protein, 10 aa, Influenza virus
LRSNAPSGVE

SEQ ID NO: 365122 - protein, 10 aa, Influenza virus
RSNAPSGVEY

SEQ ID NO: 365123 - protein, 10 aa, Influenza virus
SNAPSGVEYN

SEQ ID NO: 365124 - protein, 10 aa, Influenza virus
NAPSGVEYNG

SEQ ID NO: 365125 - protein, 10 aa, Influenza virus
APSGVEYNGK

SEQ ID NO: 365126 - protein, 10 aa, Influenza virus
PSGVEYNGKS

SEQ ID NO: 365127 - protein, 10 aa, Influenza virus
SGVEYNGKSL

SEQ ID NO: 365128 - protein, 10 aa, Influenza virus
GVEYNGKSLG

SEQ ID NO: 365129 - protein, 10 aa, Influenza virus
VEYNGKSLGI

SEQ ID NO: 365130 - protein, 10 aa, Influenza virus
PLPFQNIDSW

SEQ ID NO: 365131 - protein, 10 aa, Influenza virus
LPFQNIDSWA

SEQ ID NO: 365132 - protein, 10 aa, Influenza virus
PFQNIDSWAV

SEQ ID NO: 365133 - protein, 10 aa, Influenza virus
FQNIDSWAVG

SEQ ID NO: 365134 - protein, 10 aa, Influenza virus
QNIDSWAVGR

SEQ ID NO: 365135 - protein, 10 aa, Influenza virus
NIDSWAVGRC

SEQ ID NO: 365136 - protein, 10 aa, Influenza virus
IDSWAVGRCP

SEQ ID NO: 365137 - protein, 10 aa, Influenza virus
DSWAVGRCPR

SEQ ID NO: 365138 - protein, 10 aa, Influenza virus
SWAVGRCPRY

SEQ ID NO: 365139 - protein, 10 aa, Influenza virus
WAVGRCPRYV

SEQ ID NO: 365140 - protein, 10 aa, Influenza virus
AVGRCPRYVK

SEQ ID NO: 365141 - protein, 10 aa, Influenza virus
VGRCPRYVKQ

SEQ ID NO: 365142 - protein, 10 aa, Influenza virus
GRCPRYVKQS

SEQ ID NO: 365143 - protein, 10 aa, Influenza virus
RCPRYVKQSS

SEQ ID NO: 365144 - protein, 10 aa, Influenza virus
GMKNVPEKIH

SEQ ID NO: 365145 - protein, 10 aa, Influenza virus
MKNVPEKIHT

SEQ ID NO: 365146 - protein, 10 aa, Influenza virus
KNVPEKIHTR

SEQ ID NO: 365147 - protein, 10 aa, Influenza virus
NVPEKIHTRG

SEQ ID NO: 365148 - protein, 10 aa, Influenza virus
VPEKIHTRGL

SEQ ID NO: 365149 - protein, 10 aa, Influenza virus
PEKIHTRGLF

SEQ ID NO: 365150 - protein, 10 aa, Influenza virus
EKIHTRGLFG

SEQ ID NO: 365151 - protein, 10 aa, Influenza virus
KIHTRGLFGA

SEQ ID NO: 365152 - protein, 10 aa, Influenza virus
IHTRGLFGAI

SEQ ID NO: 365153 - protein, 10 aa, Influenza virus
HTRGLFGAIA

SEQ ID NO: 365154 - protein, 10 aa, Influenza virus
VKRRPVAKAG

SEQ ID NO: 365155 - protein, 10 aa, Influenza virus
KRRPVAKAGF

SEQ ID NO: 365156 - protein, 10 aa, Influenza virus
RRPVAKAGFI

SEQ ID NO: 365157 - protein, 10 aa, Influenza virus
RPVAKAGFIE

SEQ ID NO: 365158 - protein, 10 aa, Influenza virus
PVAKAGFIEN

SEQ ID NO: 365159 - protein, 10 aa, Influenza virus
VAKAGFIENG

SEQ ID NO: 365160 - protein, 10 aa, Influenza virus
AKAGFIENGW

SEQ ID NO: 365161 - protein, 10 aa, Influenza virus
KAGFIENGWE

SEQ ID NO: 365162 - protein, 10 aa, Influenza virus
LNRLIEKTNT

SEQ ID NO: 365163 - protein, 10 aa, Influenza virus
NRLIEKTNTQ

SEQ ID NO: 365164 - protein, 10 aa, Influenza virus
RLIEKTNTQF

SEQ ID NO: 365165 - protein, 10 aa, Influenza virus
LIEKTNTQFE

SEQ ID NO: 365166 - protein, 10 aa, Influenza virus
IEKTNTQFEL

SEQ ID NO: 365167 - protein, 10 aa, Influenza virus
EKTNTQFELI

SEQ ID NO: 365168 - protein, 10 aa, Influenza virus
KTNTQFELID

SEQ ID NO: 365169 - protein, 10 aa, Influenza virus
TNTQFELIDN

SEQ ID NO: 365170 - protein, 10 aa, Influenza virus
NTQFELIDNE

SEQ ID NO: 365171 - protein, 10 aa, Influenza virus
TQFELIDNEF

SEQ ID NO: 365172 - protein, 10 aa, Influenza virus
IMINPVKLSG

SEQ ID NO: 365173 - protein, 10 aa, Influenza virus
MINPVKLSGG

SEQ ID NO: 365174 - protein, 10 aa, Influenza virus
INPVKLSGGY

SEQ ID NO: 365175 - protein, 10 aa, Influenza virus
NPVKLSGGYK

SEQ ID NO: 365176 - protein, 10 aa, Influenza virus
PVKLSGGYKD

SEQ ID NO: 365177 - protein, 10 aa, Influenza virus
VKLSGGYKDV

SEQ ID NO: 365178 - protein, 10 aa, Influenza virus
KLSGGYKDVI

SEQ ID NO: 365179 - protein, 10 aa, Influenza virus
LSGGYKDVIL

SEQ ID NO: 365180 - protein, 10 aa, Influenza virus
SGGYKDVILW

SEQ ID NO: 365181 - protein, 10 aa, Influenza virus
GGYKDVILWF

SEQ ID NO: 365182 - protein, 10 aa, Influenza virus
VKYSRADKIC

SEQ ID NO: 365183 - protein, 10 aa, Influenza virus
KYSRADKICI

SEQ ID NO: 365184 - protein, 10 aa, Influenza virus
YSRADKICIG

SEQ ID NO: 365185 - protein, 10 aa, Influenza virus
SRADKICIGY

SEQ ID NO: 365186 - protein, 10 aa, Influenza virus
RADKICIGYL

SEQ ID NO: 365187 - protein, 10 aa, Influenza virus
ICIGYLSNNA

SEQ ID NO: 365188 - protein, 10 aa, Influenza virus
CIGYLSNNST

SEQ ID NO: 365189 - protein, 10 aa, Influenza virus
IGYLSNNSTD

SEQ ID NO: 365190 - protein, 10 aa, Influenza virus
GYLSNNSTDK

SEQ ID NO: 365191 - protein, 10 aa, Influenza virus
YLSNNSTDKV

SEQ ID NO: 365192 - protein, 10 aa, Influenza virus
LSNNSTDKVD

SEQ ID NO: 365193 - protein, 10 aa, Influenza virus
SNNSTDKVDT

SEQ ID NO: 365194 - protein, 10 aa, Influenza virus
NNSTDKVDTL

SEQ ID NO: 365195 - protein, 10 aa, Influenza virus
NSTDKVDTLT

SEQ ID NO: 365196 - protein, 10 aa, Influenza virus
STDKVDTLTE

SEQ ID NO: 365197 - protein, 10 aa, Influenza virus
TDTVDTLTEN

SEQ ID NO: 365198 - protein, 10 aa, Influenza virus
DKVDTLTENG

SEQ ID NO: 365199 - protein, 10 aa, Influenza virus
KVDTLTENGV

SEQ ID NO: 365200 - protein, 10 aa, Influenza virus
IDTLTETGVP

SEQ ID NO: 365201 - protein, 10 aa, Influenza virus
DTLTETGVPV

SEQ ID NO: 365202 - protein, 10 aa, Influenza virus
TLTETGVPVT

SEQ ID NO: 365203 - protein, 10 aa, Influenza virus
LTETGVPVTS

SEQ ID NO: 365204 - protein, 10 aa, Influenza virus
TETGVPVTSS

SEQ ID NO: 365205 - protein, 10 aa, Influenza virus
ENGVPVTSSV

SEQ ID NO: 365206 - protein, 10 aa, Influenza virus
NGVPVTSSVD

SEQ ID NO: 365207 - protein, 10 aa, Influenza virus
GVPVTSSIDL

SEQ ID NO: 365208 - protein, 10 aa, Influenza virus
VPVTSSIDLV

SEQ ID NO: 365209 - protein, 10 aa, Influenza virus
PVTSSIDLVE

SEQ ID NO: 365210 - protein, 10 aa, Influenza virus
VTSSIDLVET

SEQ ID NO: 365211 - protein, 10 aa, Influenza virus
TSSIDLVETN

SEQ ID NO: 365212 - protein, 10 aa, Influenza virus
SSIDLVETNH

SEQ ID NO: 365213 - protein, 10 aa, Influenza virus
SIDLVETNHT

SEQ ID NO: 365214 - protein, 10 aa, Influenza virus
IDLVETNHTG

SEQ ID NO: 365215 - protein, 10 aa, Influenza virus
TGTYCSLNGI

SEQ ID NO: 365216 - protein, 10 aa, Influenza virus
GTYCSLNGIS

SEQ ID NO: 365217 - protein, 10 aa, Influenza virus
TYCSLNGISP

SEQ ID NO: 365218 - protein, 10 aa, Influenza virus
YCSLNGISPI

SEQ ID NO: 365219 - protein, 10 aa, Influenza virus
CSLNGISPIH

SEQ ID NO: 365220 - protein, 10 aa, Influenza virus
SLNGISPIHL

SEQ ID NO: 365221 - protein, 10 aa, Influenza virus
LNGISPIHLG

SEQ ID NO: 365222 - protein, 10 aa, Influenza virus
NGISPIHLGD

SEQ ID NO: 365223 - protein, 10 aa, Influenza virus
GISPIHLGDC

SEQ ID NO: 365224 - protein, 10 aa, Influenza virus
ISPIHLGDCS

SEQ ID NO: 365225 - protein, 10 aa, Influenza virus
SPVHLGDCSF

SEQ ID NO: 365226 - protein, 10 aa, Influenza virus
PVHLGDCSFE

SEQ ID NO: 365227 - protein, 10 aa, Influenza virus
VHLGDCSFEG

SEQ ID NO: 365228 - protein, 10 aa, Influenza virus
WIVGNPSCAS

SEQ ID NO: 365229 - protein, 10 aa, Influenza virus
IVGNPSCASN

SEQ ID NO: 365230 - protein, 10 aa, Influenza virus
VGNPSCASNI

SEQ ID NO: 365231 - protein, 10 aa, Influenza virus
GNPSCASNIN

SEQ ID NO: 365232 - protein, 10 aa, Influenza virus
NPSCASNINI

SEQ ID NO: 365233 - protein, 10 aa, Influenza virus
PSCASNINIR

SEQ ID NO: 365234 - protein, 10 aa, Influenza virus
SCASNINIRE

SEQ ID NO: 365235 - protein, 10 aa, Influenza virus
CASNINIREW

SEQ ID NO: 365236 - protein, 10 aa, Influenza virus
ASNINIREWS

SEQ ID NO: 365237 - protein, 10 aa, Influenza virus
SNINIREWSY

SEQ ID NO: 365238 - protein, 10 aa, Influenza virus
YLIEDPNAPH

SEQ ID NO: 365239 - protein, 10 aa, Influenza virus
LIEDPNAPHK

SEQ ID NO: 365240 - protein, 10 aa, Influenza virus
IEDPNAPHKL

SEQ ID NO: 365241 - protein, 10 aa, Influenza virus
EDPNAPHKLC

SEQ ID NO: 365242 - protein, 10 aa, Influenza virus
DPNAPHKLCF

SEQ ID NO: 365243 - protein, 10 aa, Influenza virus
PNAPHKLCFP

SEQ ID NO: 365244 - protein, 10 aa, Influenza virus
NAPNKLCFPG

SEQ ID NO: 365245 - protein, 10 aa, Influenza virus
APNKLCFPGE

SEQ ID NO: 365246 - protein, 10 aa, Influenza virus
KLCYPGELDN

SEQ ID NO: 365247 - protein, 10 aa, Influenza virus
LCYPGELDNN

SEQ ID NO: 365248 - protein, 10 aa, Influenza virus
CYPGELDNNG

SEQ ID NO: 365249 - protein, 10 aa, Influenza virus
YPGELDNNGE

SEQ ID NO: 365250 - protein, 10 aa, Influenza virus
PGEVDNNGEL

SEQ ID NO: 365251 - protein, 10 aa, Influenza virus
GEVDNNGELR

SEQ ID NO: 365252 - protein, 10 aa, Influenza virus
EVDNNGELRH

SEQ ID NO: 365253 - protein, 10 aa, Influenza virus
VDNNGELRHL

SEQ ID NO: 365254 - protein, 10 aa, Influenza virus
NSFSRTELIN

SEQ ID NO: 365255 - protein, 10 aa, Influenza virus
SFSRTELINP

SEQ ID NO: 365256 - protein, 10 aa, Influenza virus
FSRTELIPPS

SEQ ID NO: 365257 - protein, 10 aa, Influenza virus
SRTELIPPSK

SEQ ID NO: 365258 - protein, 10 aa, Influenza virus
RTELINPSKW

SEQ ID NO: 365259 - protein, 10 aa, Influenza virus
TELINPSKWG

SEQ ID NO: 365260 - protein, 10 aa, Influenza virus
PSKWGDILEG

SEQ ID NO: 365261 - protein, 10 aa, Influenza virus
SKWGDILEGT

SEQ ID NO: 365262 - protein, 10 aa, Influenza virus
KWGDILEGTT

SEQ ID NO: 365263 - protein, 10 aa, Influenza virus
WGDILEGTTA

SEQ ID NO: 365264 - protein, 10 aa, Influenza virus
GDILEGTTAS

SEQ ID NO: 365265 - protein, 10 aa, Influenza virus
DILEGTTASC

SEQ ID NO: 365266 - protein, 10 aa, Influenza virus
ILEGTTASCQ

SEQ ID NO: 365267 - protein, 10 aa, Influenza virus
LEGTTASCQN

SEQ ID NO: 365268 - protein, 10 aa, Influenza virus
EGTTASCQNR

SEQ ID NO: 365269 - protein, 10 aa, Influenza virus
GTTASCQNRG

SEQ ID NO: 365270 - protein, 10 aa, Influenza virus
TTASCQNRGA

SEQ ID NO: 365271 - protein, 10 aa, Influenza virus
SFYRNLIWLV

SEQ ID NO: 365272 - protein, 10 aa, Influenza virus
FYRNLIWLVN

SEQ ID NO: 365273 - protein, 10 aa, Influenza virus
IGEYPVVKGE

SEQ ID NO: 365274 - protein, 10 aa, Influenza virus
VKGDYNNTTG

SEQ ID NO: 365275 - protein, 10 aa, Influenza virus
KGEYNNTTGR

SEQ ID NO: 365276 - protein, 10 aa, Influenza virus
GEYNNTTGRD

SEQ ID NO: 365277 - protein, 10 aa, Influenza virus
EYNNTTGRDV

SEQ ID NO: 365278 - protein, 10 aa, Influenza virus
VLWGIHHPDS

SEQ ID NO: 365279 - protein, 10 aa, Influenza virus
LWGIHHPDSE

SEQ ID NO: 365280 - protein, 10 aa, Influenza virus
WGIHHPDTET

SEQ ID NO: 365281 - protein, 10 aa, Influenza virus
GIHHPDTEAT

SEQ ID NO: 365282 - protein, 10 aa, Influenza virus
IHHPDSETTA

SEQ ID NO: 365283 - protein, 10 aa, Influenza virus
ATKLYVNKNP

SEQ ID NO: 365284 - protein, 10 aa, Influenza virus
TKLYVNKNPY

SEQ ID NO: 365285 - protein, 10 aa, Influenza virus
NLYVNKNPYT

SEQ ID NO: 365286 - protein, 10 aa, Influenza virus
LYASKNPYTL

SEQ ID NO: 365287 - protein, 10 aa, Influenza virus
YASKNPYTLV

SEQ ID NO: 365288 - protein, 10 aa, Influenza virus
ASKNPYTLVS

SEQ ID NO: 365289 - protein, 10 aa, Influenza virus
SKNPYTLVST

SEQ ID NO: 365290 - protein, 10 aa, Influenza virus
TLVSTKEWSR

SEQ ID NO: 365291 - protein, 10 aa, Influenza virus
LVSTKEWSRR

SEQ ID NO: 365292 - protein, 10 aa, Influenza virus
VSTKEWSRRY

SEQ ID NO: 365293 - protein, 10 aa, Influenza virus
STKEWSRRYE

SEQ ID NO: 365294 - protein, 10 aa, Influenza virus
TKEWSRRYEL

SEQ ID NO: 365295 - protein, 10 aa, Influenza virus
KEWSRRYELE

SEQ ID NO: 365296 - protein, 10 aa, Influenza virus
EWSRRYELEI

SEQ ID NO: 365297 - protein, 10 aa, Influenza virus
WSRRYELEIG

SEQ ID NO: 365298 - protein, 10 aa, Influenza virus
SRRYELEIGT

SEQ ID NO: 365299 - protein, 10 aa, Influenza virus
RRYELEIGTR

SEQ ID NO: 365300 - protein, 10 aa, Influenza virus
RYELEIGARI

SEQ ID NO: 365301 - protein, 10 aa, Influenza virus
YELEIGARIG

SEQ ID NO: 365302 - protein, 10 aa, Influenza virus
ELEIGARIGE

SEQ ID NO: 365303 - protein, 10 aa, Influenza virus
LEIGARIGEG

SEQ ID NO: 365304 - protein, 10 aa, Influenza virus
EIGARIGEGQ

SEQ ID NO: 365305 - protein, 10 aa, Influenza virus
IGARIGEGQR

SEQ ID NO: 365306 - protein, 10 aa, Influenza virus
GARIGEGQRS

SEQ ID NO: 365307 - protein, 10 aa, Influenza virus
ARIGEGQRSW

SEQ ID NO: 365308 - protein, 10 aa, Influenza virus
RIGEGQRSWM

SEQ ID NO: 365309 - protein, 10 aa, Influenza virus
IGEGQRSWMK

SEQ ID NO: 365310 - protein, 10 aa, Influenza virus
GDGQRSWMKI

SEQ ID NO: 365311 - protein, 10 aa, Influenza virus
DGQRSWMKIY

SEQ ID NO: 365312 - protein, 10 aa, Influenza virus
GQRSWMKIYW

SEQ ID NO: 365313 - protein, 10 aa, Influenza virus
QRSWMKIYWH

SEQ ID NO: 365314 - protein, 10 aa, Influenza virus
RSWMKIYWHL

SEQ ID NO: 365315 - protein, 10 aa, Influenza virus
SWMKIYWHLM

SEQ ID NO: 365316 - protein, 10 aa, Influenza virus
WMKLYWHLMR

SEQ ID NO: 365317 - protein, 10 aa, Influenza virus
MKLYWHLMRP

SEQ ID NO: 365318 - protein, 10 aa, Influenza virus
KLYWHLMRPG

SEQ ID NO: 365319 - protein, 10 aa, Influenza virus
LYWHLMRPGE

SEQ ID NO: 365320 - protein, 10 aa, Influenza virus
YWHLMRPGER

SEQ ID NO: 365321 - protein, 10 aa, Influenza virus
WHLMRPGERI

SEQ ID NO: 365322 - protein, 10 aa, Influenza virus
PGERIMFESN

SEQ ID NO: 365323 - protein, 10 aa, Influenza virus
GERIMFESNG

SEQ ID NO: 365324 - protein, 10 aa, Influenza virus
ERIMFESNGG

SEQ ID NO: 365325 - protein, 10 aa, Influenza virus
RIMFESNGGL

SEQ ID NO: 365326 - protein, 10 aa, Influenza virus
MFESNGGLIA

SEQ ID NO: 365327 - protein, 10 aa, Influenza virus
FESNGGLIAP

SEQ ID NO: 365328 - protein, 10 aa, Influenza virus
ESNGGLIAPR

SEQ ID NO: 365329 - protein, 10 aa, Influenza virus
SNGGLIAPRY

SEQ ID NO: 365330 - protein, 10 aa, Influenza virus
NGGLIAPRYG

SEQ ID NO: 365331 - protein, 10 aa, Influenza virus
GGLIAPRYGY

SEQ ID NO: 365332 - protein, 10 aa, Influenza virus
GLIAPRYGYI

SEQ ID NO: 365333 - protein, 10 aa, Influenza virus
LIAPRYGYII

SEQ ID NO: 365334 - protein, 10 aa, Influenza virus
IAPRYGYIIE

SEQ ID NO: 365335 - protein, 10 aa, Influenza virus
YGYIIEKYGS

SEQ ID NO: 365336 - protein, 10 aa, Influenza virus
GYIIEKYGSG

SEQ ID NO: 365337 - protein, 10 aa, Influenza virus
YIIEKYGSGR

SEQ ID NO: 365338 - protein, 10 aa, Influenza virus
IIEKYGSGRI

SEQ ID NO: 365339 - protein, 10 aa, Influenza virus
IEKYGSGRIF

SEQ ID NO: 365340 - protein, 10 aa, Influenza virus
EKYGSGRIFQ

SEQ ID NO: 365341 - protein, 10 aa, Influenza virus
KYGSGRIFQS

SEQ ID NO: 365342 - protein, 10 aa, Influenza virus
YGSGRIFQSG

SEQ ID NO: 365343 - protein, 10 aa, Influenza virus
GSGRIFQSGV

SEQ ID NO: 365344 - protein, 10 aa, Influenza virus
SGRIFQSGVR

SEQ ID NO: 365345 - protein, 10 aa, Influenza virus
GRIFQSGVRL

SEQ ID NO: 365346 - protein, 10 aa, Influenza virus
RIFQSGVRLA

SEQ ID NO: 365347 - protein, 10 aa, Influenza virus
RLAKCNTKCQ

SEQ ID NO: 365348 - protein, 10 aa, Influenza virus
LAKCNTKCQT

SEQ ID NO: 365349 - protein, 10 aa, Influenza virus
ARCNTKCQTS

SEQ ID NO: 365350 - protein, 10 aa, Influenza virus
KCNTKCQTSV

SEQ ID NO: 365351 - protein, 10 aa, Influenza virus
CNTKCQTSVG

SEQ ID NO: 365352 - protein, 10 aa, Influenza virus
NTKCQTSLGG

SEQ ID NO: 365353 - protein, 10 aa, Influenza virus
TKCQTSLGGI

SEQ ID NO: 365354 - protein, 10 aa, Influenza virus
GGVNTNKTFQ

SEQ ID NO: 365355 - protein, 10 aa, Influenza virus
GVNTNKTFQN

SEQ ID NO: 365356 - protein, 10 aa, Influenza virus
VNTNKTFQNI

SEQ ID NO: 365357 - protein, 10 aa, Influenza virus
NTNKTFQNID

SEQ ID NO: 365358 - protein, 10 aa, Influenza virus
TNKTFQNIDR

SEQ ID NO: 365359 - protein, 10 aa, Influenza virus
NKTFQNIDRN

SEQ ID NO: 365360 - protein, 10 aa, Influenza virus
KTFQNIDRNA

SEQ ID NO: 365361 - protein, 10 aa, Influenza virus
TFQNIDRNAI

SEQ ID NO: 365362 - protein, 10 aa, Influenza virus
FQNIDRNAIG

SEQ ID NO: 365363 - protein, 10 aa, Influenza virus
QNIDRNAIGD

SEQ ID NO: 365364 - protein, 10 aa, Influenza virus
NIDRNAIGDC

SEQ ID NO: 365365 - protein, 10 aa, Influenza virus
IDRNAIGDCP

SEQ ID NO: 365366 - protein, 10 aa, Influenza virus
DRNAIGDCPK

SEQ ID NO: 365367 - protein, 10 aa, Influenza virus
RNAIGDCPKY

SEQ ID NO: 365368 - protein, 10 aa, Influenza virus
NAIGDCPKYI

SEQ ID NO: 365369 - protein, 10 aa, Influenza virus
AIGDCPKYIK

SEQ ID NO: 365370 - protein, 10 aa, Influenza virus
IGDCPKYIKS

SEQ ID NO: 365371 - protein, 10 aa, Influenza virus
LATGLRNVPI

SEQ ID NO: 365372 - protein, 10 aa, Influenza virus
ATGLRNVPSV

SEQ ID NO: 365373 - protein, 10 aa, Influenza virus
NERGLFGAIA

SEQ ID NO: 365374 - protein, 10 aa, Influenza virus
QGTGIAADKT

SEQ ID NO: 365375 - protein, 10 aa, Influenza virus
GTGIAADKTS

SEQ ID NO: 365376 - protein, 10 aa, Influenza virus
TGIAADKTST

SEQ ID NO: 365377 - protein, 10 aa, Influenza virus
GIAADKTSTQ

SEQ ID NO: 365378 - protein, 10 aa, Influenza virus
IAADKTSTQK

SEQ ID NO: 365379 - protein, 10 aa, Influenza virus
AADKTSTQKA

SEQ ID NO: 365380 - protein, 10 aa, Influenza virus
ADKTSTQKAI

SEQ ID NO: 365381 - protein, 10 aa, Influenza virus
DKASTQKAIN

SEQ ID NO: 365382 - protein, 10 aa, Influenza virus
KASTQKAINE

SEQ ID NO: 365383 - protein, 10 aa, Influenza virus
ASTQKAINEI

SEQ ID NO: 365384 - protein, 10 aa, Influenza virus
STQKAIDEIT

SEQ ID NO: 365385 - protein, 10 aa, Influenza virus
TQKAIDEITT

SEQ ID NO: 365386 - protein, 10 aa, Influenza virus
QKAIDEITTK

SEQ ID NO: 365387 - protein, 10 aa, Influenza virus
KAIDEITTKI

SEQ ID NO: 365388 - protein, 10 aa, Influenza virus
AIDEITTKIN

SEQ ID NO: 365389 - protein, 10 aa, Influenza virus
IDEITTKINN

SEQ ID NO: 365390 - protein, 10 aa, Influenza virus
DEITTKINNI

SEQ ID NO: 365391 - protein, 10 aa, Influenza virus
NQVEKRINMI

SEQ ID NO: 365392 - protein, 10 aa, Influenza virus
QVEKRINMIA

SEQ ID NO: 365393 - protein, 10 aa, Influenza virus
VEKRINMIAD

SEQ ID NO: 365394 - protein, 10 aa, Influenza virus
EKRINMIADR

SEQ ID NO: 365395 - protein, 10 aa, Influenza virus
KRINMIADRV

SEQ ID NO: 365396 - protein, 10 aa, Influenza virus
RINMIADRVD

SEQ ID NO: 365397 - protein, 10 aa, Influenza virus
INMIADRVDD

SEQ ID NO: 365398 - protein, 10 aa, Influenza virus
NMIADRVDDA

SEQ ID NO: 365399 - protein, 10 aa, Influenza virus
MIADRVDDAV

SEQ ID NO: 365400 - protein, 10 aa, Influenza virus
IADRVDDAVT

SEQ ID NO: 365401 - protein, 10 aa, Influenza virus
ADWVDDAVTD

SEQ ID NO: 365402 - protein, 10 aa, Influenza virus
DRVDDAVTDV

SEQ ID NO: 365403 - protein, 10 aa, Influenza virus
RVDDAVTDVW

SEQ ID NO: 365404 - protein, 10 aa, Influenza virus
VDDAVTDVWS

SEQ ID NO: 365405 - protein, 10 aa, Influenza virus
DDAVTDVWSY

SEQ ID NO: 365406 - protein, 10 aa, Influenza virus
DAVTDVWSYN

SEQ ID NO: 365407 - protein, 10 aa, Influenza virus
AVTDVWSYNA

SEQ ID NO: 365408 - protein, 10 aa, Influenza virus
VTDVWSYNAK

SEQ ID NO: 365409 - protein, 10 aa, Influenza virus
TDVWSYNAKL

SEQ ID NO: 365410 - protein, 10 aa, Influenza virus
DVWSYNAKLL

SEQ ID NO: 365411 - protein, 10 aa, Influenza virus
VWSYNAKLLV

SEQ ID NO: 365412 - protein, 10 aa, Influenza virus
SYNAKLLVLL

SEQ ID NO: 365413 - protein, 10 aa, Influenza virus
YNAKLLVLLE

SEQ ID NO: 365414 - protein, 10 aa, Influenza virus
NAKLLVLLEN

SEQ ID NO: 365415 - protein, 10 aa, Influenza virus
AKLLVLLENG

SEQ ID NO: 365416 - protein, 10 aa, Influenza virus
KLLVLLENGR

SEQ ID NO: 365417 - protein, 10 aa, Influenza virus
LLVLLENGRT

SEQ ID NO: 365418 - protein, 10 aa, Influenza virus
LVLLENGRTL

SEQ ID NO: 365419 - protein, 10 aa, Influenza virus
VLLENGRTLD

SEQ ID NO: 365420 - protein, 10 aa, Influenza virus
LLENGRTLDL

SEQ ID NO: 365421 - protein, 10 aa, Influenza virus
LENGRTLDLH

SEQ ID NO: 365422 - protein, 10 aa, Influenza virus
ENGRTLDLHD

SEQ ID NO: 365423 - protein, 10 aa, Influenza virus
NGRTLDLHDA

SEQ ID NO: 365424 - protein, 10 aa, Influenza virus
GRTLDLHDAN

SEQ ID NO: 365425 - protein, 10 aa, Influenza virus
RTLGLHDANV

SEQ ID NO: 365426 - protein, 10 aa, Influenza virus
TLDLHDANVK

SEQ ID NO: 365427 - protein, 10 aa, Influenza virus
LDLHDANVKN

SEQ ID NO: 365428 - protein, 10 aa, Influenza virus
DLHDANVKNL

SEQ ID NO: 365429 - protein, 10 aa, Influenza virus
LHDANVKNLH

SEQ ID NO: 365430 - protein, 10 aa, Influenza virus
HDANVRNLHE

SEQ ID NO: 365431 - protein, 10 aa, Influenza virus
DANVRNLHEQ

SEQ ID NO: 365432 - protein, 10 aa, Influenza virus
ANVRNLHEQI

SEQ ID NO: 365433 - protein, 10 aa, Influenza virus
NVRNLHEQIK

SEQ ID NO: 365434 - protein, 10 aa, Influenza virus
VRNLHEQIKR

SEQ ID NO: 365435 - protein, 10 aa, Influenza virus
LKDNAIDEGD

SEQ ID NO: 365436 - protein, 10 aa, Influenza virus
KDNAIDEGDG

SEQ ID NO: 365437 - protein, 10 aa, Influenza virus
SNAIDEGDGC

SEQ ID NO: 365438 - protein, 10 aa, Influenza virus
AIDEGDGCFS

SEQ ID NO: 365439 - protein, 10 aa, Influenza virus
IDEGDGCFSI

SEQ ID NO: 365440 - protein, 10 aa, Influenza virus
DEGDGCFSIL

SEQ ID NO: 365441 - protein, 10 aa, Influenza virus
EGDGCFSILH

SEQ ID NO: 365442 - protein, 10 aa, Influenza virus
GDGCFSILHK

SEQ ID NO: 365443 - protein, 10 aa, Influenza virus
DGCFSILHKC

SEQ ID NO: 365444 - protein, 10 aa, Influenza virus
GCFSILHKCN

SEQ ID NO: 365445 - protein, 10 aa, Influenza virus
CFSILHKCND

SEQ ID NO: 365446 - protein, 10 aa, Influenza virus
FSILHKCNDS

SEQ ID NO: 365447 - protein, 10 aa, Influenza virus
SILHKCNDSC

SEQ ID NO: 365448 - protein, 10 aa, Influenza virus
ILHKCNDSCM

SEQ ID NO: 365449 - protein, 10 aa, Influenza virus
FHKCNDSCME

SEQ ID NO: 365450 - protein, 10 aa, Influenza virus
HKCNDSCMEA

SEQ ID NO: 365451 - protein, 10 aa, Influenza virus
KCNDSCMEAI

SEQ ID NO: 365452 - protein, 10 aa, Influenza virus
CNDSCMEAIR

SEQ ID NO: 365453 - protein, 10 aa, Influenza virus
NDSCMEAIRN

SEQ ID NO: 365454 - protein, 10 aa, Influenza virus
DSCMEAIRNG

SEQ ID NO: 365455 - protein, 10 aa, Influenza virus
SCMEAIRNGT

SEQ ID NO: 365456 - protein, 10 aa, Influenza virus
CMEAIRNGTY

SEQ ID NO: 365457 - protein, 10 aa, Influenza virus
MEAIRNGTYN

SEQ ID NO: 365458 - protein, 10 aa, Influenza virus
EAIRNGTYNH

SEQ ID NO: 365459 - protein, 10 aa, Influenza virus
AIRNGTYNHE

SEQ ID NO: 365460 - protein, 10 aa, Influenza virus
NGTYNHEDYR

SEQ ID NO: 365461 - protein, 10 aa, Influenza virus
GTYNHEDYRE

SEQ ID NO: 365462 - protein, 10 aa, Influenza virus
TYNHEDYREE

SEQ ID NO: 365463 - protein, 10 aa, Influenza virus
YNHEDYREES

SEQ ID NO: 365464 - protein, 10 aa, Influenza virus
NHEDYREESQ

SEQ ID NO: 365465 - protein, 10 aa, Influenza virus
HEDYREESQL

SEQ ID NO: 365466 - protein, 10 aa, Influenza virus
EDYREESQLK

SEQ ID NO: 365467 - protein, 10 aa, Influenza virus
DYREESQLKR

SEQ ID NO: 365468 - protein, 10 aa, Influenza virus
YREESQLKRQ

SEQ ID NO: 365469 - protein, 10 aa, Influenza virus
REESQLKRQE

SEQ ID NO: 365470 - protein, 10 aa, Influenza virus
EESQLKKQEI

SEQ ID NO: 365471 - protein, 10 aa, Influenza virus
ESQLKKQEIE

SEQ ID NO: 365472 - protein, 10 aa, Influenza virus
SQLKKQEIEG

SEQ ID NO: 365473 - protein, 10 aa, Influenza virus
QLKKQEIEGI

SEQ ID NO: 365474 - protein, 10 aa, Influenza virus
LKKQEIEGIK

SEQ ID NO: 365475 - protein, 10 aa, Influenza virus
KKQEIEGIKL

SEQ ID NO: 365476 - protein, 10 aa, Influenza virus
KQEIEGIKLK

SEQ ID NO: 365477 - protein, 10 aa, Influenza virus
QEIEGIKLKS

SEQ ID NO: 365478 - protein, 10 aa, Influenza virus
EIEGIKLKSE

SEQ ID NO: 365479 - protein, 10 aa, Influenza virus
IEGIKLKSED

SEQ ID NO: 365480 - protein, 10 aa, Influenza virus
EGIKLKSEDN

SEQ ID NO: 365481 - protein, 10 aa, Influenza virus
GIKLKTEDNI

SEQ ID NO: 365482 - protein, 10 aa, Influenza virus
IKLKTEDNIY

SEQ ID NO: 365483 - protein, 10 aa, Influenza virus
KLKTEDNIYK

SEQ ID NO: 365484 - protein, 10 aa, Influenza virus
LKTEDNVYKI

SEQ ID NO: 365485 - protein, 10 aa, Influenza virus
KTEDNVYKIL

SEQ ID NO: 365486 - protein, 10 aa, Influenza virus
TEDNVYKVLS

SEQ ID NO: 365487 - protein, 10 aa, Influenza virus
EDNVYKILSI

SEQ ID NO: 365488 - protein, 10 aa, Influenza virus
DNVYKILSIY

SEQ ID NO: 365489 - protein, 10 aa, Influenza virus
NVYKILSIYS

SEQ ID NO: 365490 - protein, 10 aa, Influenza virus
VYKILSIYSC

SEQ ID NO: 365491 - protein, 10 aa, Influenza virus
YKVLSIYSCI

SEQ ID NO: 365492 - protein, 10 aa, Influenza virus
KVLSIYSCIA

SEQ ID NO: 365493 - protein, 10 aa, Influenza virus
VLSIYSCIAS

SEQ ID NO: 365494 - protein, 10 aa, Influenza virus
LAIYSCIASS

SEQ ID NO: 365495 - protein, 10 aa, Influenza virus
SIYSCIASST

SEQ ID NO: 365496 - protein, 10 aa, Influenza virus
IYSCIASSTV

SEQ ID NO: 365497 - protein, 10 aa, Influenza virus
YSCIASSIVM

SEQ ID NO: 365498 - protein, 10 aa, Influenza virus
SCIASSIVLV

SEQ ID NO: 365499 - protein, 10 aa, Influenza virus
CIASSIVMVG

SEQ ID NO: 365500 - protein, 10 aa, Influenza virus
IASSVVLVGL

SEQ ID NO: 365501 - protein, 10 aa, Influenza virus
ASSIVLVGLI

SEQ ID NO: 365502 - protein, 10 aa, Influenza virus
SSIVLVGLIL

SEQ ID NO: 365503 - protein, 10 aa, Influenza virus
SIVLVGLILA

SEQ ID NO: 365504 - protein, 10 aa, Influenza virus
IVMVGLILAF

SEQ ID NO: 365505 - protein, 10 aa, Influenza virus
VMVGLILAFI

SEQ ID NO: 365506 - protein, 10 aa, Influenza virus
MVGLILAFIM

SEQ ID NO: 365507 - protein, 10 aa, Influenza virus
VGLILAFILW

SEQ ID NO: 365508 - protein, 10 aa, Influenza virus
GLILAFILWA

SEQ ID NO: 365509 - protein, 10 aa, Influenza virus
LILAFILWAC

SEQ ID NO: 365510 - protein, 10 aa, Influenza virus
ILAFILWACS

SEQ ID NO: 365511 - protein, 10 aa, Influenza virus
LAFIMWACSN

SEQ ID NO: 365512 - protein, 10 aa, Influenza virus
AFIMWACSNG

SEQ ID NO: 365513 - protein, 10 aa, Influenza virus
FIMWACSNGS

SEQ ID NO: 365514 - protein, 10 aa, Influenza virus
IMWACSNGSC

SEQ ID NO: 365515 - protein, 10 aa, Influenza virus
MWACSNGSCR

SEQ ID NO: 365516 - protein, 10 aa, Influenza virus
WACSNGSCRF

SEQ ID NO: 365517 - protein, 10 aa, Influenza virus
ACSNGSCRFN

SEQ ID NO: 365518 - protein, 10 aa, Influenza virus
CSNGSCRFNV

SEQ ID NO: 365519 - protein, 10 aa, Influenza virus
SNGSCRFNVC

SEQ ID NO: 365520 - protein, 10 aa, Influenza virus
NGSCRFNVCI

SEQ ID NO: 365521 - protein, 10 aa, Influenza virus
QGKTKATKME

SEQ ID NO: 365522 - protein, 10 aa, Influenza virus
GKTKATKMEA

SEQ ID NO: 365523 - protein, 10 aa, Influenza virus
KTKATKMEAI

SEQ ID NO: 365524 - protein, 10 aa, Influenza virus
TKATKMKAII

SEQ ID NO: 365525 - protein, 10 aa, Influenza virus
KATKMKAIIV

SEQ ID NO: 365526 - protein, 10 aa, Influenza virus
QPNDGQVLYF

SEQ ID NO: 365527 - protein, 10 aa, Influenza virus
PNDGQVLYFL

SEQ ID NO: 365528 - protein, 10 aa, Influenza virus
SNAPSGVEYN

SEQ ID NO: 365529 - protein, 10 aa, Influenza virus
NAPSGVEYNG

SEQ ID NO: 365530 - protein, 10 aa, Influenza virus
APSGVEYNGK

SEQ ID NO: 365531 - protein, 10 aa, Influenza virus
PSGVEYNGKS

SEQ ID NO: 365532 - protein, 10 aa, Influenza virus
SGVEYNGKSL

SEQ ID NO: 365533 - protein, 10 aa, Influenza virus
GVEYNGKSLG

SEQ ID NO: 365534 - protein, 10 aa, Influenza virus
VEYNGKSLGI

SEQ ID NO: 365535 - protein, 10 aa, Influenza virus
FGAIAGFIEN

SEQ ID NO: 365536 - protein, 10 aa, Influenza virus
GAIAGFIENG

SEQ ID NO: 365537 - protein, 10 aa, Influenza virus
AIAGFIENGW

SEQ ID NO: 365538 - protein, 10 aa, Influenza virus
IAGFIEGGWP

SEQ ID NO: 365539 - protein, 10 aa, Influenza virus
AGFIEGGWPG

SEQ ID NO: 365540 - protein, 10 aa, Influenza virus
GFIEGGWPGL

SEQ ID NO: 365541 - protein, 10 aa, Influenza virus
FIEGGWTGMI

SEQ ID NO: 365542 - protein, 10 aa, Influenza virus
IEGGWTGMID

SEQ ID NO: 365543 - protein, 10 aa, Influenza virus
EGGWTGMIDG

SEQ ID NO: 365544 - protein, 10 aa, Influenza virus
GGWTGMIDGW

SEQ ID NO: 365545 - protein, 10 aa, Influenza virus
GWTGMIDGWY

SEQ ID NO: 365546 - protein, 10 aa, Influenza virus
WTGMIDGWYG

SEQ ID NO: 365547 - protein, 10 aa, Influenza virus
TGMIDGWYGY

SEQ ID NO: 365548 - protein, 10 aa, Influenza virus
GMIDGWYGYH

SEQ ID NO: 365549 - protein, 10 aa, Influenza virus
MIDGWYGYHH

SEQ ID NO: 365550 - protein, 10 aa, Influenza virus
DGWYGFRHQN

SEQ ID NO: 365551 - protein, 10 aa, Influenza virus
YQAELLVAME

SEQ ID NO: 365552 - protein, 10 aa, Influenza virus
QAELLVAMEN

SEQ ID NO: 365553 - protein, 10 aa, Influenza virus
MVLLQCRICI

SEQ ID NO: 365554 - protein, 10 aa, Influenza virus
MRCTISLVKT

SEQ ID NO: 365555 - protein, 10 aa, Influenza virus
QCRICILDQN

SEQ ID NO: 365556 - protein, 10 aa, Influenza virus
CRICIDFRDM

SEQ ID NO: 365557 - protein, 10 aa, Influenza virus
RICIDFRDMR

SEQ ID NO: 365558 - protein, 10 aa, Influenza virus
ISLVKTTLFL

SEQ ID NO: 365559 - protein, 10 aa, Influenza virus
CILDQNFRNI

SEQ ID NO: 365560 - protein, 10 aa, Influenza virus
ILDQNFRNIR

SEQ ID NO: 365561 - protein, 10 aa, Influenza virus
LDQNFRNIRK

SEQ ID NO: 365562 - protein, 10 aa, Influenza virus
QGKTKATKME

SEQ ID NO: 365563 - protein, 10 aa, Influenza virus
GKTKATKMEA

SEQ ID NO: 365564 - protein, 10 aa, Influenza virus
KTKATKMEAI

SEQ ID NO: 365565 - protein, 10 aa, Influenza virus
TKATKMKAII

SEQ ID NO: 365566 - protein, 10 aa, Influenza virus
KATKMKAIIV

SEQ ID NO: 365567 - protein, 10 aa, Influenza virus
ATKMEAILVV

SEQ ID NO: 365568 - protein, 10 aa, Influenza virus
TKMEAILVVL

SEQ ID NO: 365569 - protein, 10 aa, Influenza virus
KMEAILVVLL

SEQ ID NO: 365570 - protein, 10 aa, Influenza virus
ADTICIGYHA

SEQ ID NO: 365571 - protein, 10 aa, Influenza virus
DTICIGYHAN

SEQ ID NO: 365572 - protein, 10 aa, Influenza virus
TICIGYHANN

SEQ ID NO: 365573 - protein, 10 aa, Influenza virus
ICIGYHANNS

SEQ ID NO: 365574 - protein, 10 aa, Influenza virus
CVGYHANNST

SEQ ID NO: 365575 - protein, 10 aa, Influenza virus
VGYHANNSTD

SEQ ID NO: 365576 - protein, 10 aa, Influenza virus
NNSTDTVDTI

SEQ ID NO: 365577 - protein, 10 aa, Influenza virus
NSTDTVDTIL

SEQ ID NO: 365578 - protein, 10 aa, Influenza virus
STDTVDTILE

SEQ ID NO: 365579 - protein, 10 aa, Influenza virus
TDTVDTILEK

SEQ ID NO: 365580 - protein, 10 aa, Influenza virus
DTVDTILEKN

SEQ ID NO: 365581 - protein, 10 aa, Influenza virus
TVDTILEKNV

SEQ ID NO: 365582 - protein, 10 aa, Influenza virus
VDTILEKNVT

SEQ ID NO: 365583 - protein, 10 aa, Influenza virus
DTILEKNVTV

SEQ ID NO: 365584 - protein, 10 aa, Influenza virus
TILEKNVTVT

SEQ ID NO: 365585 - protein, 10 aa, Influenza virus
ILEKNVTVTH

SEQ ID NO: 365586 - protein, 10 aa, Influenza virus
LERNVTVTHS

SEQ ID NO: 365587 - protein, 10 aa, Influenza virus
ERNVTVTHSV

SEQ ID NO: 365588 - protein, 10 aa, Influenza virus
RNVTVTHSVN

SEQ ID NO: 365589 - protein, 10 aa, Influenza virus
NVTVTHSVNI

SEQ ID NO: 365590 - protein, 10 aa, Influenza virus
VTVTHSVNIL

SEQ ID NO: 365591 - protein, 10 aa, Influenza virus
TVTHSVNILE

SEQ ID NO: 365592 - protein, 10 aa, Influenza virus
VAGWILGNPE

SEQ ID NO: 365593 - protein, 10 aa, Influenza virus
AGWLLGNPEC

SEQ ID NO: 365594 - protein, 10 aa, Influenza virus
NYEELREQLS

SEQ ID NO: 365595 - protein, 10 aa, Influenza virus
YEELKEQLST

SEQ ID NO: 365596 - protein, 10 aa, Influenza virus
EELKEQLSTV

SEQ ID NO: 365597 - protein, 10 aa, Influenza virus
ELKEQLSTVS

SEQ ID NO: 365598 - protein, 10 aa, Influenza virus
LKEQLSTVSS

SEQ ID NO: 365599 - protein, 10 aa, Influenza virus
KEQLSTVSSF

SEQ ID NO: 365600 - protein, 10 aa, Influenza virus
EQLSTVSSFE

SEQ ID NO: 365601 - protein, 10 aa, Influenza virus
QLSSVSSFEK

SEQ ID NO: 365602 - protein, 10 aa, Influenza virus
LSSVSSFEKF

SEQ ID NO: 365603 - protein, 10 aa, Influenza virus
SSVSSFEKFE

SEQ ID NO: 365604 - protein, 10 aa, Influenza virus
SVSSFEKFEI

SEQ ID NO: 365605 - protein, 10 aa, Influenza virus
VSSFEKFEIF

SEQ ID NO: 365606 - protein, 10 aa, Influenza virus
SSFEKFEIFP

SEQ ID NO: 365607 - protein, 10 aa, Influenza virus
SFEKFEIFPK

SEQ ID NO: 365608 - protein, 10 aa, Influenza virus
KEKENSYPKI

SEQ ID NO: 365609 - protein, 10 aa, Influenza virus
EKENSYPKIN

SEQ ID NO: 365610 - protein, 10 aa, Influenza virus
DTIIFEANGN

SEQ ID NO: 365611 - protein, 10 aa, Influenza virus
TIIFEANGNL

SEQ ID NO: 365612 - protein, 10 aa, Influenza virus
FEANGNLIAP

SEQ ID NO: 365613 - protein, 10 aa, Influenza virus
VTIGECPKYV

SEQ ID NO: 365614 - protein, 10 aa, Influenza virus
TIGECPKYVR

SEQ ID NO: 365615 - protein, 10 aa, Influenza virus
IGECPKYVRS

SEQ ID NO: 365616 - protein, 10 aa, Influenza virus
GECPKYVRSA

SEQ ID NO: 365617 - protein, 10 aa, Influenza virus
KLRMVTGLRN

SEQ ID NO: 365618 - protein, 10 aa, Influenza virus
LRMVTGLRNI

SEQ ID NO: 365619 - protein, 10 aa, Influenza virus
RMVTGLRNIP

SEQ ID NO: 365620 - protein, 10 aa, Influenza virus
MVTGLRNIPS

SEQ ID NO: 365621 - protein, 10 aa, Influenza virus
VTGLRNIPSI

SEQ ID NO: 365622 - protein, 10 aa, Influenza virus
TGLRNIPSIQ

SEQ ID NO: 365623 - protein, 10 aa, Influenza virus
GLRNIPSIQS

SEQ ID NO: 365624 - protein, 10 aa, Influenza virus
LRNIPSIQSR

SEQ ID NO: 365625 - protein, 10 aa, Influenza virus
RNIPSIQSRG

SEQ ID NO: 365626 - protein, 10 aa, Influenza virus
NIPSIQSRGL

SEQ ID NO: 365627 - protein, 10 aa, Influenza virus
IPSIQSRGLF

SEQ ID NO: 365628 - protein, 10 aa, Influenza virus
PSVQSRGLFG

SEQ ID NO: 365629 - protein, 10 aa, Influenza virus
SVQSRGLFGA

SEQ ID NO: 365630 - protein, 10 aa, Influenza virus
VQSRGLFGAI

SEQ ID NO: 365631 - protein, 10 aa, Influenza virus
FIEGGWTGMI

SEQ ID NO: 365632 - protein, 10 aa, Influenza virus
IEGGWTGMID

SEQ ID NO: 365633 - protein, 10 aa, Influenza virus
EGGWTGMIDG

SEQ ID NO: 365634 - protein, 10 aa, Influenza virus
GGWTGMIDGW

SEQ ID NO: 365635 - protein, 10 aa, Influenza virus
GWTGMIDGWY

SEQ ID NO: 365636 - protein, 10 aa, Influenza virus
WTGMIDGWYG

SEQ ID NO: 365637 - protein, 10 aa, Influenza virus
TGMIDGWYGY

SEQ ID NO: 365638 - protein, 10 aa, Influenza virus
GMIDGWYGYH

SEQ ID NO: 365639 - protein, 10 aa, Influenza virus
MIDGWYGYHH

SEQ ID NO: 365640 - protein, 10 aa, Influenza virus
IDGWYGYHHQ

SEQ ID NO: 365641 - protein, 10 aa, Influenza virus
GWYGYHHQNG

SEQ ID NO: 365642 - protein, 10 aa, Influenza virus
WYGYHHQNGQ

SEQ ID NO: 365643 - protein, 10 aa, Influenza virus
YGYHHQNGQG

SEQ ID NO: 365644 - protein, 10 aa, Influenza virus
GYHHQNGQGS

SEQ ID NO: 365645 - protein, 10 aa, Influenza virus
YHHQNGQGSG

SEQ ID NO: 365646 - protein, 10 aa, Influenza virus
HHQNGQGSGY

SEQ ID NO: 365647 - protein, 10 aa, Influenza virus
HQNGQGSGYA

SEQ ID NO: 365648 - protein, 10 aa, Influenza virus
QNGQGSGYAA

SEQ ID NO: 365649 - protein, 10 aa, Influenza virus
NGQGSGYAAD

SEQ ID NO: 365650 - protein, 10 aa, Influenza virus
EQGSGYAADQ

SEQ ID NO: 365651 - protein, 10 aa, Influenza virus
QGSGYAADQK

SEQ ID NO: 365652 - protein, 10 aa, Influenza virus
GSGYAADQKS

SEQ ID NO: 365653 - protein, 10 aa, Influenza virus
SGYAADQKST

SEQ ID NO: 365654 - protein, 10 aa, Influenza virus
GYAADQKSTQ

SEQ ID NO: 365655 - protein, 10 aa, Influenza virus
NKVNSIIEKM

SEQ ID NO: 365656 - protein, 10 aa, Influenza virus
KVNSIIEKMN

SEQ ID NO: 365657 - protein, 10 aa, Influenza virus
NSVIEKMNIQ

SEQ ID NO: 365658 - protein, 10 aa, Influenza virus
SVIEKMNIQF

SEQ ID NO: 365659 - protein, 10 aa, Influenza virus
VIEKMNIQFT

SEQ ID NO: 365660 - protein, 10 aa, Influenza virus
IEKMNIQFTS

SEQ ID NO: 365661 - protein, 10 aa, Influenza virus
EKMNIQFTSV

SEQ ID NO: 365662 - protein, 10 aa, Influenza virus
KMNIQFTSVG

SEQ ID NO: 365663 - protein, 10 aa, Influenza virus
MNIQFTSVGK

SEQ ID NO: 365664 - protein, 10 aa, Influenza virus
NIQFTSVGKE

SEQ ID NO: 365665 - protein, 10 aa, Influenza virus
IQFTSVGKEF

SEQ ID NO: 365666 - protein, 10 aa, Influenza virus
QFTAVGKEFS

SEQ ID NO: 365667 - protein, 10 aa, Influenza virus
RMENLNKKVD

SEQ ID NO: 365668 - protein, 10 aa, Influenza virus
MENLNKKVDD

SEQ ID NO: 365669 - protein, 10 aa, Influenza virus
ENLNKKIDDG

SEQ ID NO: 365670 - protein, 10 aa, Influenza virus
NLNKKIDDGF

SEQ ID NO: 365671 - protein, 10 aa, Influenza virus
LNKKVDDGFI

SEQ ID NO: 365672 - protein, 10 aa, Influenza virus
NKKVDDGFID

SEQ ID NO: 365673 - protein, 10 aa, Influenza virus
DDGFIDIWTY

SEQ ID NO: 365674 - protein, 10 aa, Influenza virus
DGFIDIWTYN

SEQ ID NO: 365675 - protein, 10 aa, Influenza virus
GFIDIWTYNA

SEQ ID NO: 365676 - protein, 10 aa, Influenza virus
FIDIWTYNAE

SEQ ID NO: 365677 - protein, 10 aa, Influenza virus
IDIWTYNAEL

SEQ ID NO: 365678 - protein, 10 aa, Influenza virus
DVWTYNAELL

SEQ ID NO: 365679 - protein, 10 aa, Influenza virus
VWTYNAELLV

SEQ ID NO: 365680 - protein, 10 aa, Influenza virus
WTYNAELLIL

SEQ ID NO: 365681 - protein, 10 aa, Influenza virus
TYNAELLILL

SEQ ID NO: 365682 - protein, 10 aa, Influenza virus
YNAELLILLE

SEQ ID NO: 365683 - protein, 10 aa, Influenza virus
NAELLILLEN

SEQ ID NO: 365684 - protein, 10 aa, Influenza virus
AELLILLENE

SEQ ID NO: 365685 - protein, 10 aa, Influenza virus
ELLILLENER

SEQ ID NO: 365686 - protein, 10 aa, Influenza virus
LLILLENERT

SEQ ID NO: 365687 - protein, 10 aa, Influenza virus
LILLENERTL

SEQ ID NO: 365688 - protein, 10 aa, Influenza virus
ILLENERTLD

SEQ ID NO: 365689 - protein, 10 aa, Influenza virus
LLENERTLDF

SEQ ID NO: 365690 - protein, 10 aa, Influenza virus
LENERTLDFH

SEQ ID NO: 365691 - protein, 10 aa, Influenza virus
ENERTLDFHD

SEQ ID NO: 365692 - protein, 10 aa, Influenza virus
NERTLDFHDS

SEQ ID NO: 365693 - protein, 10 aa, Influenza virus
NNAKELGNGC

SEQ ID NO: 365694 - protein, 10 aa, Influenza virus
NAKELGNGCF

SEQ ID NO: 365695 - protein, 10 aa, Influenza virus
AKELGNGCFE

SEQ ID NO: 365696 - protein, 10 aa, Influenza virus
KELGNGCFEF

SEQ ID NO: 365697 - protein, 10 aa, Influenza virus
ELGNGCFEFY

SEQ ID NO: 365698 - protein, 10 aa, Influenza virus
LGNGCFEFYH

SEQ ID NO: 365699 - protein, 10 aa, Influenza virus
GCFEFYHKCN

SEQ ID NO: 365700 - protein, 10 aa, Influenza virus
CFEFYHKCND

SEQ ID NO: 365701 - protein, 10 aa, Influenza virus
CMESVRNGTY

SEQ ID NO: 365702 - protein, 10 aa, Influenza virus
MESVKNGTYN

SEQ ID NO: 365703 - protein, 10 aa, Influenza virus
ESVKNGTYNY

SEQ ID NO: 365704 - protein, 10 aa, Influenza virus
SVKNGTYNYP

SEQ ID NO: 365705 - protein, 10 aa, Influenza virus
VKNGTYNYPK

SEQ ID NO: 365706 - protein, 10 aa, Influenza virus
KNGTYNYPKY

SEQ ID NO: 365707 - protein, 10 aa, Influenza virus
NGTYNYPKYS

SEQ ID NO: 365708 - protein, 10 aa, Influenza virus
GTYNYPKYSE

SEQ ID NO: 365709 - protein, 10 aa, Influenza virus
TYNYPKYSEE

SEQ ID NO: 365710 - protein, 10 aa, Influenza virus
YDYPKYSEES

SEQ ID NO: 365711 - protein, 10 aa, Influenza virus
YPKYSEESKL

SEQ ID NO: 365712 - protein, 10 aa, Influenza virus
VYQILAIYST

SEQ ID NO: 365713 - protein, 10 aa, Influenza virus
YQILAIYSTA

SEQ ID NO: 365714 - protein, 10 aa, Influenza virus
QILAIYSTAA

SEQ ID NO: 365715 - protein, 10 aa, Influenza virus
ILAIYSTAAS

SEQ ID NO: 365716 - protein, 10 aa, Influenza virus
LAIYSTAASS

SEQ ID NO: 365717 - protein, 10 aa, Influenza virus
AIYSTAASSL

SEQ ID NO: 365718 - protein, 10 aa, Influenza virus
IYSTAASSLV

SEQ ID NO: 365719 - protein, 10 aa, Influenza virus
YSTAASSLVL

SEQ ID NO: 365720 - protein, 10 aa, Influenza virus
ASSLVLLVSL

SEQ ID NO: 365721 - protein, 10 aa, Influenza virus
SSLVLLVSLG

SEQ ID NO: 365722 - protein, 10 aa, Influenza virus
SLVLLVSLGA

SEQ ID NO: 365723 - protein, 10 aa, Influenza virus
LLVSLGAISF

SEQ ID NO: 365724 - protein, 10 aa, Influenza virus
LVSLGAISFW

SEQ ID NO: 365725 - protein, 10 aa, Influenza virus
VSLGAVSFWM

SEQ ID NO: 365726 - protein, 10 aa, Influenza virus
SLGAVSFWMC

SEQ ID NO: 365727 - protein, 10 aa, Influenza virus
LGAVSFWMCS

SEQ ID NO: 365728 - protein, 10 aa, Influenza virus
GAISFWMCSG

SEQ ID NO: 365729 - protein, 10 aa, Influenza virus
AISFWMCSGH

SEQ ID NO: 365730 - protein, 10 aa, Influenza virus
ISFWMCSGHS

SEQ ID NO: 365731 - protein, 10 aa, Influenza virus
SFWMCSGHSC

SEQ ID NO: 365732 - protein, 10 aa, Influenza virus
FWMCSNGSLR

SEQ ID NO: 365733 - protein, 10 aa, Influenza virus
WMCSNGSLRC

SEQ ID NO: 365734 - protein, 10 aa, Influenza virus
MCSNGSLRCR

SEQ ID NO: 365735 - protein, 10 aa, Influenza virus
CSNGSLQCRV

SEQ ID NO: 365736 - protein, 10 aa, Influenza virus
SNGSLQCRVC

SEQ ID NO: 365737 - protein, 10 aa, Influenza virus
NGSLQCRVCI

SEQ ID NO: 365738 - protein, 10 aa, Influenza virus
MVLLQCRICI

SEQ ID NO: 365739 - protein, 10 aa, Influenza virus
LQCRICILDQ

SEQ ID NO: 365740 - protein, 10 aa, Influenza virus
QCRICILDQN

SEQ ID NO: 365741 - protein, 10 aa, Influenza virus
CRICIDFRDM

SEQ ID NO: 365742 - protein, 10 aa, Influenza virus
RICIDFRDMR

SEQ ID NO: 365743 - protein, 10 aa, Influenza virus
ICIDFRDMRK

SEQ ID NO: 365744 - protein, 10 aa, Influenza virus
CILDQNFRNI

SEQ ID NO: 365745 - protein, 10 aa, Influenza virus
IDFRDMRKNT

SEQ ID NO: 365746 - protein, 10 aa, Influenza virus
LDQNFRNIRK

SEQ ID NO: 365747 - protein, 10 aa, Influenza virus
KMNPNQKIIT

SEQ ID NO: 365748 - protein, 10 aa, Influenza virus
GWAIYTKDNS

SEQ ID NO: 365749 - protein, 10 aa, Influenza virus
TKDNSIRIGS

SEQ ID NO: 365750 - protein, 10 aa, Influenza virus
KDNSVRIGSK

SEQ ID NO: 365751 - protein, 10 aa, Influenza virus
DNSVRIGSKG

SEQ ID NO: 365752 - protein, 10 aa, Influenza virus
NSVRIGSKGD

SEQ ID NO: 365753 - protein, 10 aa, Influenza virus
SVRIGSKGDV

SEQ ID NO: 365754 - protein, 10 aa, Influenza virus
VRIGSKGDVF

SEQ ID NO: 365755 - protein, 10 aa, Influenza virus
RIGSKGDIFV

SEQ ID NO: 365756 - protein, 10 aa, Influenza virus
IGSKGDIFVI

SEQ ID NO: 365757 - protein, 10 aa, Influenza virus
GSKGDIFVIR

SEQ ID NO: 365758 - protein, 10 aa, Influenza virus
SKGDIFVIRE

SEQ ID NO: 365759 - protein, 10 aa, Influenza virus
KGDIFVIREP

SEQ ID NO: 365760 - protein, 10 aa, Influenza virus
GDIFVIREPF

SEQ ID NO: 365761 - protein, 10 aa, Influenza virus
DIFVIREPFI

SEQ ID NO: 365762 - protein, 10 aa, Influenza virus
IFVIREPFIS

SEQ ID NO: 365763 - protein, 10 aa, Influenza virus
FVMREPFISC

SEQ ID NO: 365764 - protein, 10 aa, Influenza virus
VMREPFISCS

SEQ ID NO: 365765 - protein, 10 aa, Influenza virus
IREPFISCSH

SEQ ID NO: 365766 - protein, 10 aa, Influenza virus
REPFISCSHL

SEQ ID NO: 365767 - protein, 10 aa, Influenza virus
EPFISCSHLE

SEQ ID NO: 365768 - protein, 10 aa, Influenza virus
PFISCSHLEC

SEQ ID NO: 365769 - protein, 10 aa, Influenza virus
LECKTFFLTQ

SEQ ID NO: 365770 - protein, 10 aa, Influenza virus
ECKTFFLTQG

SEQ ID NO: 365771 - protein, 10 aa, Influenza virus
CKTFFLTQGA

SEQ ID NO: 365772 - protein, 10 aa, Influenza virus
KTFFLTQGAL

SEQ ID NO: 365773 - protein, 10 aa, Influenza virus
LTQGALLNDR

SEQ ID NO: 365774 - protein, 10 aa, Influenza virus
TQGALLNDRH

SEQ ID NO: 365775 - protein, 10 aa, Influenza virus
QGALLNDRHS

SEQ ID NO: 365776 - protein, 10 aa, Influenza virus
GALLNDRHSN

SEQ ID NO: 365777 - protein, 10 aa, Influenza virus
ALLNDRHSNG

SEQ ID NO: 365778 - protein, 10 aa, Influenza virus
LLNDRHSNGT

SEQ ID NO: 365779 - protein, 10 aa, Influenza virus
LNDKHSNGTV

SEQ ID NO: 365780 - protein, 10 aa, Influenza virus
NDKHSNGTVK

SEQ ID NO: 365781 - protein, 10 aa, Influenza virus
HSNGTVKDRS

SEQ ID NO: 365782 - protein, 10 aa, Influenza virus
KDRSPYRALM

SEQ ID NO: 365783 - protein, 10 aa, Influenza virus
DRSPYRALMS

SEQ ID NO: 365784 - protein, 10 aa, Influenza virus
RSPYRALMSC

SEQ ID NO: 365785 - protein, 10 aa, Influenza virus
SPYRALMSCP

SEQ ID NO: 365786 - protein, 10 aa, Influenza virus
RALMSCPLGE

SEQ ID NO: 365787 - protein, 10 aa, Influenza virus
LMSCPLGEAP

SEQ ID NO: 365788 - protein, 10 aa, Influenza virus
MSCPLGEAPS

SEQ ID NO: 365789 - protein, 10 aa, Influenza virus
SCPLGEAPSP

SEQ ID NO: 365790 - protein, 10 aa, Influenza virus
CPLGEAPSPY

SEQ ID NO: 365791 - protein, 10 aa, Influenza virus
PLGEAPSPYN

SEQ ID NO: 365792 - protein, 10 aa, Influenza virus
LGEAPSPYNS

SEQ ID NO: 365793 - protein, 10 aa, Influenza virus
GEAPSPYNSK

SEQ ID NO: 365794 - protein, 10 aa, Influenza virus
EAPSPYNSKF

SEQ ID NO: 365795 - protein, 10 aa, Influenza virus
APSPYNSKFE

SEQ ID NO: 365796 - protein, 10 aa, Influenza virus
PSPYNSKFES

SEQ ID NO: 365797 - protein, 10 aa, Influenza virus
SPYNSKFESV

SEQ ID NO: 365798 - protein, 10 aa, Influenza virus
PYNSKFESVA

SEQ ID NO: 365799 - protein, 10 aa, Influenza virus
YNSKFESVAW

SEQ ID NO: 365800 - protein, 10 aa, Influenza virus
NSKFESVAWS

SEQ ID NO: 365801 - protein, 10 aa, Influenza virus
SKFESVAWSA

SEQ ID NO: 365802 - protein, 10 aa, Influenza virus
KFESVAWSAS

SEQ ID NO: 365803 - protein, 10 aa, Influenza virus
WSASACHDGM

SEQ ID NO: 365804 - protein, 10 aa, Influenza virus
GWLTIGISGP

SEQ ID NO: 365805 - protein, 10 aa, Influenza virus
WITIGISGPD

SEQ ID NO: 365806 - protein, 10 aa, Influenza virus
LTIGISGPDD

SEQ ID NO: 365807 - protein, 10 aa, Influenza virus
TIGISGPDDG

SEQ ID NO: 365808 - protein, 10 aa, Influenza virus
IGISGPDDGA

SEQ ID NO: 365809 - protein, 10 aa, Influenza virus
GISGPDDGAV

SEQ ID NO: 365810 - protein, 10 aa, Influenza virus
ISGPDDGAVA

SEQ ID NO: 365811 - protein, 10 aa, Influenza virus
SGPDDGAVAV

SEQ ID NO: 365812 - protein, 10 aa, Influenza virus
GPDDGAVAVL

SEQ ID NO: 365813 - protein, 10 aa, Influenza virus
PDDGAVAVLK

SEQ ID NO: 365814 - protein, 10 aa, Influenza virus
DDGAVAVLKY

SEQ ID NO: 365815 - protein, 10 aa, Influenza virus
DGAVAVLKYN

SEQ ID NO: 365816 - protein, 10 aa, Influenza virus
GAVAVLKYKG

SEQ ID NO: 365817 - protein, 10 aa, Influenza virus
AVAVLKYKGI

SEQ ID NO: 365818 - protein, 10 aa, Influenza virus
VAVLKYKGII

SEQ ID NO: 365819 - protein, 10 aa, Influenza virus
AVLKYKGIIT

SEQ ID NO: 365820 - protein, 10 aa, Influenza virus
VLKYNGIITG

SEQ ID NO: 365821 - protein, 10 aa, Influenza virus
LKYNGIITGT

SEQ ID NO: 365822 - protein, 10 aa, Influenza virus
GIITGTIKSW

SEQ ID NO: 365823 - protein, 10 aa, Influenza virus
QILRTQESEC

SEQ ID NO: 365824 - protein, 10 aa, Influenza virus
ILRTQESECV

SEQ ID NO: 365825 - protein, 10 aa, Influenza virus
LRTQESECVC

SEQ ID NO: 365826 - protein, 10 aa, Influenza virus
RTQESECVCM

SEQ ID NO: 365827 - protein, 10 aa, Influenza virus
TQESECVCMN

SEQ ID NO: 365828 - protein, 10 aa, Influenza virus
QESECVCMNG

SEQ ID NO: 365829 - protein, 10 aa, Influenza virus
ESECVCMNGS

SEQ ID NO: 365830 - protein, 10 aa, Influenza virus
SECVCMNGSC

SEQ ID NO: 365831 - protein, 10 aa, Influenza virus
NGSCFTIMTD

SEQ ID NO: 365832 - protein, 10 aa, Influenza virus
GSCFTIMTDG

SEQ ID NO: 365833 - protein, 10 aa, Influenza virus
SCFTIMTDGP

SEQ ID NO: 365834 - protein, 10 aa, Influenza virus
CFTIMTDGPS

SEQ ID NO: 365835 - protein, 10 aa, Influenza virus
APNFHYEECS

SEQ ID NO: 365836 - protein, 10 aa, Influenza virus
PNFHYEECSC

SEQ ID NO: 365837 - protein, 10 aa, Influenza virus
NFHYEECSCY

SEQ ID NO: 365838 - protein, 10 aa, Influenza virus
FHYEECSCYP

SEQ ID NO: 365839 - protein, 10 aa, Influenza virus
YYEECSCYPD

SEQ ID NO: 365840 - protein, 10 aa, Influenza virus
YEECSCYPDT

SEQ ID NO: 365841 - protein, 10 aa, Influenza virus
VMCVCRDNWH

SEQ ID NO: 365842 - protein, 10 aa, Influenza virus
MCVCRDNWHG

SEQ ID NO: 365843 - protein, 10 aa, Influenza virus
CVCRDNWHAS

SEQ ID NO: 365844 - protein, 10 aa, Influenza virus
VCRDNWHASN

SEQ ID NO: 365845 - protein, 10 aa, Influenza virus
CRDNWHASNR

SEQ ID NO: 365846 - protein, 10 aa, Influenza virus
RDNWHASNRP

SEQ ID NO: 365847 - protein, 10 aa, Influenza virus
DNWHASNRPW

SEQ ID NO: 365848 - protein, 10 aa, Influenza virus
NWHASNRPWV

SEQ ID NO: 365849 - protein, 10 aa, Influenza virus
WHASNRPWVS

SEQ ID NO: 365850 - protein, 10 aa, Influenza virus
HASNRPWVSF

SEQ ID NO: 365851 - protein, 10 aa, Influenza virus
ASNRPWVSFD

SEQ ID NO: 365852 - protein, 10 aa, Influenza virus
SNRPWVSFDQ

SEQ ID NO: 365853 - protein, 10 aa, Influenza virus
NRPWVSFDQN

SEQ ID NO: 365854 - protein, 10 aa, Influenza virus
RPWVSFDQNL

SEQ ID NO: 365855 - protein, 10 aa, Influenza virus
IGYICSGVFG

SEQ ID NO: 365856 - protein, 10 aa, Influenza virus
GYICSGVFGD

SEQ ID NO: 365857 - protein, 10 aa, Influenza virus
YICSGVFGDN

SEQ ID NO: 365858 - protein, 10 aa, Influenza virus
ICSGVFGDNP

SEQ ID NO: 365859 - protein, 10 aa, Influenza virus
CSGVFGDNPR

SEQ ID NO: 365860 - protein, 10 aa, Influenza virus
SGVFGDNPRP

SEQ ID NO: 365861 - protein, 10 aa, Influenza virus
GANGVKGFSY

SEQ ID NO: 365862 - protein, 10 aa, Influenza virus
GVKGFSYKYG

SEQ ID NO: 365863 - protein, 10 aa, Influenza virus
KGFSYKYGNG

SEQ ID NO: 365864 - protein, 10 aa, Influenza virus
GFSYKYGNGV

SEQ ID NO: 365865 - protein, 10 aa, Influenza virus
FSYKYGNGVW

SEQ ID NO: 365866 - protein, 10 aa, Influenza virus
RYGNGVWIGR

SEQ ID NO: 365867 - protein, 10 aa, Influenza virus
YDNGVWIGRT

SEQ ID NO: 365868 - protein, 10 aa, Influenza virus
DNGVWIGRTK

SEQ ID NO: 365869 - protein, 10 aa, Influenza virus
NGVWMGRTKS

SEQ ID NO: 365870 - protein, 10 aa, Influenza virus
GVWIGRTKSN

SEQ ID NO: 365871 - protein, 10 aa, Influenza virus
GFEMIWDPDG

SEQ ID NO: 365872 - protein, 10 aa, Influenza virus
FEMIWDPDGW

SEQ ID NO: 365873 - protein, 10 aa, Influenza virus
EMIWDPDGWT

SEQ ID NO: 365874 - protein, 10 aa, Influenza virus
TDWSGYSGSF

SEQ ID NO: 365875 - protein, 10 aa, Influenza virus
DWSGYSGSFV

SEQ ID NO: 365876 - protein, 10 aa, Influenza virus
FVQHPELTGM

SEQ ID NO: 365877 - protein, 10 aa, Influenza virus
VQHPELTGMN

SEQ ID NO: 365878 - protein, 10 aa, Influenza virus
QHPELTGMNC

SEQ ID NO: 365879 - protein, 10 aa, Influenza virus
HPELTGLDCM

SEQ ID NO: 365880 - protein, 10 aa, Influenza virus
DCMRPCFWVE

SEQ ID NO: 365881 - protein, 10 aa, Influenza virus
CMRPCFWVEL

SEQ ID NO: 365882 - protein, 10 aa, Influenza virus
IRPCFWVELV

SEQ ID NO: 365883 - protein, 10 aa, Influenza virus
RPCFWVELVR

SEQ ID NO: 365884 - protein, 10 aa, Influenza virus
PCFWVELVRG

SEQ ID NO: 365885 - protein, 10 aa, Influenza virus
CFWVELVRGL

SEQ ID NO: 365886 - protein, 10 aa, Influenza virus
FWVELVRGLP

SEQ ID NO: 365887 - protein, 10 aa, Influenza virus
ATIWTSGSSI

SEQ ID NO: 365888 - protein, 10 aa, Influenza virus
TIWASGSSIS

SEQ ID NO: 365889 - protein, 10 aa, Influenza virus
IWASGSSISF

SEQ ID NO: 365890 - protein, 10 aa, Influenza virus
WASGSSISFC

SEQ ID NO: 365891 - protein, 10 aa, Influenza virus
ASGSSISFCG

SEQ ID NO: 365892 - protein, 10 aa, Influenza virus
SASSISFCGV

SEQ ID NO: 365893 - protein, 10 aa, Influenza virus
GSSISFCGVD

SEQ ID NO: 365894 - protein, 10 aa, Influenza virus
SSISFCGVDS

SEQ ID NO: 365895 - protein, 10 aa, Influenza virus
WSWPDGADLP

SEQ ID NO: 365896 - protein, 10 aa, Influenza virus
SWPDGADLPF

SEQ ID NO: 365897 - protein, 10 aa, Influenza virus
WPDGADLPFT

SEQ ID NO: 365898 - protein, 10 aa, Influenza virus
PDGADLPFTI

SEQ ID NO: 365899 - protein, 10 aa, Influenza virus
DTLCIGYHAN

SEQ ID NO: 365900 - protein, 10 aa, Influenza virus
TLCIGYHANN

SEQ ID NO: 365901 - protein, 10 aa, Influenza virus
LCIGYHANNS

SEQ ID NO: 365902 - protein, 10 aa, Influenza virus
CVGYHANNST

SEQ ID NO: 365903 - protein, 10 aa, Influenza virus
VGYHANNSTD

SEQ ID NO: 365904 - protein, 10 aa, Influenza virus
GYHANNSTET

SEQ ID NO: 365905 - protein, 10 aa, Influenza virus
YHANNSTETV

SEQ ID NO: 365906 - protein, 10 aa, Influenza virus
HANNSTETVD

SEQ ID NO: 365907 - protein, 10 aa, Influenza virus
ANNSTETVDT

SEQ ID NO: 365908 - protein, 10 aa, Influenza virus
KNITVTHSVN

SEQ ID NO: 365909 - protein, 10 aa, Influenza virus
NITVTHSVNL

SEQ ID NO: 365910 - protein, 10 aa, Influenza virus
ITVTHSVNLL

SEQ ID NO: 365911 - protein, 10 aa, Influenza virus
TVTHSINLLE

SEQ ID NO: 365912 - protein, 10 aa, Influenza virus
PFQNIHPVTI

SEQ ID NO: 365913 - protein, 10 aa, Influenza virus
FQNIHPVTIG

SEQ ID NO: 365914 - protein, 10 aa, Influenza virus
HPITIGECPK

SEQ ID NO: 365915 - protein, 10 aa, Influenza virus
PITIGECPKY

SEQ ID NO: 365916 - protein, 10 aa, Influenza virus
ITIGECPKYV

SEQ ID NO: 365917 - protein, 10 aa, Influenza virus
TIGECPKYVR

SEQ ID NO: 365918 - protein, 10 aa, Influenza virus
IGECPKYVRS

SEQ ID NO: 365919 - protein, 10 aa, Influenza virus
SIQTRGLFGA

SEQ ID NO: 365920 - protein, 10 aa, Influenza virus
IQTRGLFGAI

SEQ ID NO: 365921 - protein, 10 aa, Influenza virus
QTRGLFGAIA

SEQ ID NO: 365922 - protein, 10 aa, Influenza virus
TRGLFGAIAG

SEQ ID NO: 365923 - protein, 10 aa, Influenza virus
FIEGGWTGMV

SEQ ID NO: 365924 - protein, 10 aa, Influenza virus
IEGGWTGMVD

SEQ ID NO: 365925 - protein, 10 aa, Influenza virus
EGGWTGMVDG

SEQ ID NO: 365926 - protein, 10 aa, Influenza virus
GGWTGMVDGW

SEQ ID NO: 365927 - protein, 10 aa, Influenza virus
GWTGMVDGWY

SEQ ID NO: 365928 - protein, 10 aa, Influenza virus
WTGMVDGWYG

SEQ ID NO: 365929 - protein, 10 aa, Influenza virus
TGMVDGWYGY

SEQ ID NO: 365930 - protein, 10 aa, Influenza virus
NEQGSGFAAD

SEQ ID NO: 365931 - protein, 10 aa, Influenza virus
ESLNNKVDDG

SEQ ID NO: 365932 - protein, 10 aa, Influenza virus
DVWTYNAELL

SEQ ID NO: 365933 - protein, 10 aa, Influenza virus
VWTYNAELLV

SEQ ID NO: 365934 - protein, 10 aa, Influenza virus
WTYNAELLIL

SEQ ID NO: 365935 - protein, 10 aa, Influenza virus
TYNAELLILL

SEQ ID NO: 365936 - protein, 10 aa, Influenza virus
YNAELLILLE

SEQ ID NO: 365937 - protein, 10 aa, Influenza virus
NAELLILLEN

SEQ ID NO: 365938 - protein, 10 aa, Influenza virus
AELLILLENE

SEQ ID NO: 365939 - protein, 10 aa, Influenza virus
ELLILLENER

SEQ ID NO: 365940 - protein, 10 aa, Influenza virus
LLILLENERT

SEQ ID NO: 365941 - protein, 10 aa, Influenza virus
LILLENERTL

SEQ ID NO: 365942 - protein, 10 aa, Influenza virus
ILLENERTLD

SEQ ID NO: 365943 - protein, 10 aa, Influenza virus
LLENERTLDY

SEQ ID NO: 365944 - protein, 10 aa, Influenza virus
LENERTLDYH

SEQ ID NO: 365945 - protein, 10 aa, Influenza virus
ENERTLDYHD

SEQ ID NO: 365946 - protein, 10 aa, Influenza virus
NERTLDYHDS

SEQ ID NO: 365947 - protein, 10 aa, Influenza virus
ERTLDYHDSN

SEQ ID NO: 365948 - protein, 10 aa, Influenza virus
RTLDYHDSNV

SEQ ID NO: 365949 - protein, 10 aa, Influenza virus
NNAKELGNGC

SEQ ID NO: 365950 - protein, 10 aa, Influenza virus
NAKELGNGCF

SEQ ID NO: 365951 - protein, 10 aa, Influenza virus
AKELGNGCFE

SEQ ID NO: 365952 - protein, 10 aa, Influenza virus
KELGNGCFEF

SEQ ID NO: 365953 - protein, 10 aa, Influenza virus
ELGNGCFEFY

SEQ ID NO: 365954 - protein, 10 aa, Influenza virus
LGNGCFEFYH

SEQ ID NO: 365955 - protein, 10 aa, Influenza virus
GNGCFEFYHR

SEQ ID NO: 365956 - protein, 10 aa, Influenza virus
NGCFEFYHRC

SEQ ID NO: 365957 - protein, 10 aa, Influenza virus
GCFEFYHKCD

SEQ ID NO: 365958 - protein, 10 aa, Influenza virus
CFEFYHKCDD

SEQ ID NO: 365959 - protein, 10 aa, Influenza virus
CMDSVKNGTY

SEQ ID NO: 365960 - protein, 10 aa, Influenza virus
CFWMCSNGSL

SEQ ID NO: 365961 - protein, 10 aa, Influenza virus
FWMCSNGSLH

SEQ ID NO: 365962 - protein, 10 aa, Influenza virus
WMCPNGSLQC

SEQ ID NO: 365963 - protein, 10 aa, Influenza virus
MCSNGSLQCK

SEQ ID NO: 365964 - protein, 10 aa, Influenza virus
CSNGSLQCKI

SEQ ID NO: 365965 - protein, 10 aa, Influenza virus
KNNQVILCGP

SEQ ID NO: 365966 - protein, 10 aa, Influenza virus
IKGFAPFSKD

SEQ ID NO: 365967 - protein, 10 aa, Influenza virus
KGFAPFSKDN

SEQ ID NO: 365968 - protein, 10 aa, Influenza virus
PFSKDNSVRL

SEQ ID NO: 365969 - protein, 10 aa, Influenza virus
KDNSIRLSAS

SEQ ID NO: 365970 - protein, 10 aa, Influenza virus
DNSIRLSASG

SEQ ID NO: 365971 - protein, 10 aa, Influenza virus
NSIRLSAGGA

SEQ ID NO: 365972 - protein, 10 aa, Influenza virus
SIRLSAGGAI

SEQ ID NO: 365973 - protein, 10 aa, Influenza virus
IRLSAGGAIW

SEQ ID NO: 365974 - protein, 10 aa, Influenza virus
RLSAGGAIWV

SEQ ID NO: 365975 - protein, 10 aa, Influenza virus
LSAGGAIWVT

SEQ ID NO: 365976 - protein, 10 aa, Influenza virus
SAGGAIWVTR

SEQ ID NO: 365977 - protein, 10 aa, Influenza virus
AGGAIWVTRE

SEQ ID NO: 365978 - protein, 10 aa, Influenza virus
GGAIWVTREP

SEQ ID NO: 365979 - protein, 10 aa, Influenza virus
GAIWVTREPY

SEQ ID NO: 365980 - protein, 10 aa, Influenza virus
AIWVTREPYV

SEQ ID NO: 365981 - protein, 10 aa, Influenza virus
IWITREPYVS

SEQ ID NO: 365982 - protein, 10 aa, Influenza virus
WITREPYVSC

SEQ ID NO: 365983 - protein, 10 aa, Influenza virus
RCYQFALGQG

SEQ ID NO: 365984 - protein, 10 aa, Influenza virus
FALGQGTTLD

SEQ ID NO: 365985 - protein, 10 aa, Influenza virus
ALGQGTTLDN

SEQ ID NO: 365986 - protein, 10 aa, Influenza virus
DRTPHRTLLM

SEQ ID NO: 365987 - protein, 10 aa, Influenza virus
PHRTLLMNEL

SEQ ID NO: 365988 - protein, 10 aa, Influenza virus
HRTLLMNELG

SEQ ID NO: 365989 - protein, 10 aa, Influenza virus
RTLLMNELGI

SEQ ID NO: 365990 - protein, 10 aa, Influenza virus
TLLMNELGIP

SEQ ID NO: 365991 - protein, 10 aa, Influenza virus
LLMNELGIPF

SEQ ID NO: 365992 - protein, 10 aa, Influenza virus
LMNELGIPFH

SEQ ID NO: 365993 - protein, 10 aa, Influenza virus
MNELGIPFHL

SEQ ID NO: 365994 - protein, 10 aa, Influenza virus
NELGIPFHLG

SEQ ID NO: 365995 - protein, 10 aa, Influenza virus
ELGIPFHLGT

SEQ ID NO: 365996 - protein, 10 aa, Influenza virus
LGVPFHLGTR

SEQ ID NO: 365997 - protein, 10 aa, Influenza virus
PFHLGTRQVC

SEQ ID NO: 365998 - protein, 10 aa, Influenza virus
LGTRQVCIAW

SEQ ID NO: 365999 - protein, 10 aa, Influenza virus
GTRQVCIAWS

SEQ ID NO: 366000 - protein, 10 aa, Influenza virus
TRQVCIAWSS

SEQ ID NO: 366001 - protein, 10 aa, Influenza virus
RQVCIAWSSS

SEQ ID NO: 366002 - protein, 10 aa, Influenza virus
QVCMAWSSSS

SEQ ID NO: 366003 - protein, 10 aa, Influenza virus
VCMAWSSSSC

SEQ ID NO: 366004 - protein, 10 aa, Influenza virus
CMAWSSSSCH

SEQ ID NO: 366005 - protein, 10 aa, Influenza virus
MAWSSSSCHD

SEQ ID NO: 366006 - protein, 10 aa, Influenza virus
AWSSSSCYDG

SEQ ID NO: 366007 - protein, 10 aa, Influenza virus
WSSSSCYDGK

SEQ ID NO: 366008 - protein, 10 aa, Influenza virus
SSSSCYDGKA

SEQ ID NO: 366009 - protein, 10 aa, Influenza virus
SSSCYDGKAW

SEQ ID NO: 366010 - protein, 10 aa, Influenza virus
SSCYDGKAWL

SEQ ID NO: 366011 - protein, 10 aa, Influenza virus
SCYDGKAWLH

SEQ ID NO: 366012 - protein, 10 aa, Influenza virus
CYDGKAWLHV

SEQ ID NO: 366013 - protein, 10 aa, Influenza virus
YDGKAWLHVC

SEQ ID NO: 366014 - protein, 10 aa, Influenza virus
KILRTQESEC

SEQ ID NO: 366015 - protein, 10 aa, Influenza virus
ILRTQESECI

SEQ ID NO: 366016 - protein, 10 aa, Influenza virus
LRTQESECIC

SEQ ID NO: 366017 - protein, 10 aa, Influenza virus
RTQESECICI

SEQ ID NO: 366018 - protein, 10 aa, Influenza virus
ICTVVMTDGS

SEQ ID NO: 366019 - protein, 10 aa, Influenza virus
CAVVMTDGSA

SEQ ID NO: 366020 - protein, 10 aa, Influenza virus
AVVMTDGSAS

SEQ ID NO: 366021 - protein, 10 aa, Influenza virus
VIMTDGSASG

SEQ ID NO: 366022 - protein, 10 aa, Influenza virus
GSAQHIEECS

SEQ ID NO: 366023 - protein, 10 aa, Influenza virus
SAQHIEECSC

SEQ ID NO: 366024 - protein, 10 aa, Influenza virus
AQHIEECSCY

SEQ ID NO: 366025 - protein, 10 aa, Influenza virus
QHIEECSCYP

SEQ ID NO: 366026 - protein, 10 aa, Influenza virus
HIEECSCYPR

SEQ ID NO: 366027 - protein, 10 aa, Influenza virus
VEECSCYPRF

SEQ ID NO: 366028 - protein, 10 aa, Influenza virus
EECSCYPRFP

SEQ ID NO: 366029 - protein, 10 aa, Influenza virus
VRCICRDNWK

SEQ ID NO: 366030 - protein, 10 aa, Influenza virus
RCICRDNWKG

SEQ ID NO: 366031 - protein, 10 aa, Influenza virus
CICRDNWKGS

SEQ ID NO: 366032 - protein, 10 aa, Influenza virus
ICRDNWKGSN

SEQ ID NO: 366033 - protein, 10 aa, Influenza virus
CRDNWRGSNR

SEQ ID NO: 366034 - protein, 10 aa, Influenza virus
RDNWRGSNRP

SEQ ID NO: 366035 - protein, 10 aa, Influenza virus
DNWKGSNRPV

SEQ ID NO: 366036 - protein, 10 aa, Influenza virus
NWKGSNRPVV

SEQ ID NO: 366037 - protein, 10 aa, Influenza virus
WKGSNRPVVD

SEQ ID NO: 366038 - protein, 10 aa, Influenza virus
KGSNRPVVDI

SEQ ID NO: 366039 - protein, 10 aa, Influenza virus
SSYMCSGLVG

SEQ ID NO: 366040 - protein, 10 aa, Influenza virus
SYMCSGLVGD

SEQ ID NO: 366041 - protein, 10 aa, Influenza virus
YMCSGLVGDT

SEQ ID NO: 366042 - protein, 10 aa, Influenza virus
MCSGLVGDTP

SEQ ID NO: 366043 - protein, 10 aa, Influenza virus
GNHGVKGWAF

SEQ ID NO: 366044 - protein, 10 aa, Influenza virus
NHGVKGWAFD

SEQ ID NO: 366045 - protein, 10 aa, Influenza virus
RLGYETFKVI

SEQ ID NO: 366046 - protein, 10 aa, Influenza virus
SGYSGVFSVE

SEQ ID NO: 366047 - protein, 10 aa, Influenza virus
NCINRCFYVE

SEQ ID NO: 366048 - protein, 10 aa, Influenza virus
VNRCFYVELI

SEQ ID NO: 366049 - protein, 10 aa, Influenza virus
FYVELIRGRR

SEQ ID NO: 366050 - protein, 10 aa, Influenza virus
VLWTSNSIVV

SEQ ID NO: 366051 - protein, 10 aa, Influenza virus
LWTSNSIVVF

SEQ ID NO: 366052 - protein, 10 aa, Influenza virus
WTSNSIVAFC

SEQ ID NO: 366053 - protein, 10 aa, Influenza virus
TSNSIVAFCG

SEQ ID NO: 366054 - protein, 10 aa, Influenza virus
SNSIVVFCGA

SEQ ID NO: 366055 - protein, 10 aa, Influenza virus
NSIVVFCGTP

SEQ ID NO: 366056 - protein, 10 aa, Influenza virus
SIVAFCGTSG

SEQ ID NO: 366057 - protein, 10 aa, Influenza virus
IVAFCGTSGT

SEQ ID NO: 366058 - protein, 10 aa, Influenza virus
VVFCGASGTY

SEQ ID NO: 366059 - protein, 10 aa, Influenza virus
VFCGTSGIYG

SEQ ID NO: 366060 - protein, 10 aa, Influenza virus
GTYGTGTWPD

SEQ ID NO: 366061 - protein, 10 aa, Influenza virus
MDKQTKTMTI

SEQ ID NO: 366062 - protein, 10 aa, Influenza virus
DNKTKKMTIT

SEQ ID NO: 366063 - protein, 10 aa, Influenza virus
NQTKKMTITF

SEQ ID NO: 366064 - protein, 10 aa, Influenza virus
QTKKMTITFL

SEQ ID NO: 366065 - protein, 10 aa, Influenza virus
TKKMTITFLI

SEQ ID NO: 366066 - protein, 10 aa, Influenza virus
KKMTITFLIL

SEQ ID NO: 366067 - protein, 10 aa, Influenza virus
KMTITFLILL

SEQ ID NO: 366068 - protein, 10 aa, Influenza virus
GDQICIGYHS

SEQ ID NO: 366069 - protein, 10 aa, Influenza virus
DQICIGYHSN

SEQ ID NO: 366070 - protein, 10 aa, Influenza virus
QICIGYHSNN

SEQ ID NO: 366071 - protein, 10 aa, Influenza virus
ICIGYHSNNS

SEQ ID NO: 366072 - protein, 10 aa, Influenza virus
CIGYHSNNST

SEQ ID NO: 366073 - protein, 10 aa, Influenza virus
IGYHSNNSTE

SEQ ID NO: 366074 - protein, 10 aa, Influenza virus
GYHSNNSTEK

SEQ ID NO: 366075 - protein, 10 aa, Influenza virus
DTILEQNVTV

SEQ ID NO: 366076 - protein, 10 aa, Influenza virus
TILEQNVTVT

SEQ ID NO: 366077 - protein, 10 aa, Influenza virus
ILEQNVTVTH

SEQ ID NO: 366078 - protein, 10 aa, Influenza virus
LEQNVTVTHA

SEQ ID NO: 366079 - protein, 10 aa, Influenza virus
ERNVTVTHAQ

SEQ ID NO: 366080 - protein, 10 aa, Influenza virus
NVTVTHAQDI

SEQ ID NO: 366081 - protein, 10 aa, Influenza virus
VTVTHAQDIL

SEQ ID NO: 366082 - protein, 10 aa, Influenza virus
TVTHAQDILE

SEQ ID NO: 366083 - protein, 10 aa, Influenza virus
VTHAQDILEK

SEQ ID NO: 366084 - protein, 10 aa, Influenza virus
NILEKTHNGK

SEQ ID NO: 366085 - protein, 10 aa, Influenza virus
ILEKVHNGKL

SEQ ID NO: 366086 - protein, 10 aa, Influenza virus
LEKVHNGKLC

SEQ ID NO: 366087 - protein, 10 aa, Influenza virus
HNGKLCRLSG

SEQ ID NO: 366088 - protein, 10 aa, Influenza virus
GIPPLELRDC

SEQ ID NO: 366089 - protein, 10 aa, Influenza virus
IPPLELRDCS

SEQ ID NO: 366090 - protein, 10 aa, Influenza virus
PPLELRDCSI

SEQ ID NO: 366091 - protein, 10 aa, Influenza virus
PLELRDCSIA

SEQ ID NO: 366092 - protein, 10 aa, Influenza virus
LELRDCSIAG

SEQ ID NO: 366093 - protein, 10 aa, Influenza virus
ELRDCSIAGW

SEQ ID NO: 366094 - protein, 10 aa, Influenza virus
LRDCSIAGWL

SEQ ID NO: 366095 - protein, 10 aa, Influenza virus
RDCSIAGWLL

SEQ ID NO: 366096 - protein, 10 aa, Influenza virus
IAGWLLGNPK

SEQ ID NO: 366097 - protein, 10 aa, Influenza virus
AGWLLGNPKC

SEQ ID NO: 366098 - protein, 10 aa, Influenza virus
GWLLGNPKCD

SEQ ID NO: 366099 - protein, 10 aa, Influenza virus
WLLGNPECDI

SEQ ID NO: 366100 - protein, 10 aa, Influenza virus
LLGNPECDIL

SEQ ID NO: 366101 - protein, 10 aa, Influenza virus
LGNPECDILL

SEQ ID NO: 366102 - protein, 10 aa, Influenza virus
VPEWSYIMEK

SEQ ID NO: 366103 - protein, 10 aa, Influenza virus
PEWSYIMEKE

SEQ ID NO: 366104 - protein, 10 aa, Influenza virus
SSFFRNMVWL

SEQ ID NO: 366105 - protein, 10 aa, Influenza virus
SFFRNMIWLT

SEQ ID NO: 366106 - protein, 10 aa, Influenza virus
GSYNNTSGEQ

SEQ ID NO: 366107 - protein, 10 aa, Influenza virus
SYNNTNGEQI

SEQ ID NO: 366108 - protein, 10 aa, Influenza virus
YNNTNGEQIL

SEQ ID NO: 366109 - protein, 10 aa, Influenza virus
INFESTGNLV

SEQ ID NO: 366110 - protein, 10 aa, Influenza virus
NFESTGNLVA

SEQ ID NO: 366111 - protein, 10 aa, Influenza virus
FESTGNLVAP

SEQ ID NO: 366112 - protein, 10 aa, Influenza virus
ESTGNLVAPE

SEQ ID NO: 366113 - protein, 10 aa, Influenza virus
STGNLVAPEY

SEQ ID NO: 366114 - protein, 10 aa, Influenza virus
TGNLVAPEYG

SEQ ID NO: 366115 - protein, 10 aa, Influenza virus
GNLVAPEYGF

SEQ ID NO: 366116 - protein, 10 aa, Influenza virus
NLVAPEYGFK

SEQ ID NO: 366117 - protein, 10 aa, Influenza virus
LVAPEYGFKI

SEQ ID NO: 366118 - protein, 10 aa, Influenza virus
VAPEYGFKIS

SEQ ID NO: 366119 - protein, 10 aa, Influenza virus
APEYGFRISK

SEQ ID NO: 366120 - protein, 10 aa, Influenza virus
PEYGFRISKR

SEQ ID NO: 366121 - protein, 10 aa, Influenza virus
EYGFRISKRG

SEQ ID NO: 366122 - protein, 10 aa, Influenza virus
YGFKISKRGG

SEQ ID NO: 366123 - protein, 10 aa, Influenza virus
GFKISKRGGS

SEQ ID NO: 366124 - protein, 10 aa, Influenza virus
FKISKRGGSG

SEQ ID NO: 366125 - protein, 10 aa, Influenza virus
KISKRGGSGI

SEQ ID NO: 366126 - protein, 10 aa, Influenza virus
ISKRGGSGIM

SEQ ID NO: 366127 - protein, 10 aa, Influenza virus
SKRGGSGIMK

SEQ ID NO: 366128 - protein, 10 aa, Influenza virus
KRGGSGIMKT

SEQ ID NO: 366129 - protein, 10 aa, Influenza virus
CETRCQTPLG

SEQ ID NO: 366130 - protein, 10 aa, Influenza virus
ETRCQTPLGA

SEQ ID NO: 366131 - protein, 10 aa, Influenza virus
TRCQTPLGAI

SEQ ID NO: 366132 - protein, 10 aa, Influenza virus
RCQTPLGAIN

SEQ ID NO: 366133 - protein, 10 aa, Influenza virus
CQTPLGALNT

SEQ ID NO: 366134 - protein, 10 aa, Influenza virus
QTPLGALNTT

SEQ ID NO: 366135 - protein, 10 aa, Influenza virus
TPLGALNTTL

SEQ ID NO: 366136 - protein, 10 aa, Influenza virus
PLGALNTTLP

SEQ ID NO: 366137 - protein, 10 aa, Influenza virus
LGALNTTLPF

SEQ ID NO: 366138 - protein, 10 aa, Influenza virus
GALNTTLPFH

SEQ ID NO: 366139 - protein, 10 aa, Influenza virus
ALNTTLPFHN

SEQ ID NO: 366140 - protein, 10 aa, Influenza virus
INTTLPFHNV

SEQ ID NO: 366141 - protein, 10 aa, Influenza virus
NTTLPFHNVH

SEQ ID NO: 366142 - protein, 10 aa, Influenza virus
TTLPFHNVHP

SEQ ID NO: 366143 - protein, 10 aa, Influenza virus
TLPFHNVHPL

SEQ ID NO: 366144 - protein, 10 aa, Influenza virus
LPFHNVHPLT

SEQ ID NO: 366145 - protein, 10 aa, Influenza virus
PFHNVHPLTI

SEQ ID NO: 366146 - protein, 10 aa, Influenza virus
FHNVHPLTIG

SEQ ID NO: 366147 - protein, 10 aa, Influenza virus
HNVHPLTIGE

SEQ ID NO: 366148 - protein, 10 aa, Influenza virus
NVHPLTIGEC

SEQ ID NO: 366149 - protein, 10 aa, Influenza virus
VHPLTIGECP

SEQ ID NO: 366150 - protein, 10 aa, Influenza virus
HPLAIGECPK

SEQ ID NO: 366151 - protein, 10 aa, Influenza virus
PLAIGECPKY

SEQ ID NO: 366152 - protein, 10 aa, Influenza virus
LAIGECPKYV

SEQ ID NO: 366153 - protein, 10 aa, Influenza virus
AIGECPKYVK

SEQ ID NO: 366154 - protein, 10 aa, Influenza virus
IGECPKYIKS

SEQ ID NO: 366155 - protein, 10 aa, Influenza virus
PQMESRGLFG

SEQ ID NO: 366156 - protein, 10 aa, Influenza virus
QMESRGLFGA

SEQ ID NO: 366157 - protein, 10 aa, Influenza virus
MESRGLFGAI

SEQ ID NO: 366158 - protein, 10 aa, Influenza virus
EPRGLFGAIA

SEQ ID NO: 366159 - protein, 10 aa, Influenza virus
PRGLFGAIAG

SEQ ID NO: 366160 - protein, 10 aa, Influenza virus
FIEGGWQGMI

SEQ ID NO: 366161 - protein, 10 aa, Influenza virus
IEGGWQGMID

SEQ ID NO: 366162 - protein, 10 aa, Influenza virus
EGGWQGMIDG

SEQ ID NO: 366163 - protein, 10 aa, Influenza virus
GGWQGMIDGW

SEQ ID NO: 366164 - protein, 10 aa, Influenza virus
GWQGMIDGWY

SEQ ID NO: 366165 - protein, 10 aa, Influenza virus
WQGMIDGWYG

SEQ ID NO: 366166 - protein, 10 aa, Influenza virus
QGMIDGWYGY

SEQ ID NO: 366167 - protein, 10 aa, Influenza virus
GMIDGWYGYH

SEQ ID NO: 366168 - protein, 10 aa, Influenza virus
MIDGWYGYHH

SEQ ID NO: 366169 - protein, 10 aa, Influenza virus
IDGWYGYHHS

SEQ ID NO: 366170 - protein, 10 aa, Influenza virus
GYHHSNDQGA

SEQ ID NO: 366171 - protein, 10 aa, Influenza virus
YHHSNDQGAG

SEQ ID NO: 366172 - protein, 10 aa, Influenza virus
HHSNDQGAGY

SEQ ID NO: 366173 - protein, 10 aa, Influenza virus
HSNDQGAGYA

SEQ ID NO: 366174 - protein, 10 aa, Influenza virus
SNDQGAGYAA

SEQ ID NO: 366175 - protein, 10 aa, Influenza virus
NDQGAGYAAD

SEQ ID NO: 366176 - protein, 10 aa, Influenza virus
DQGAGYAADK

SEQ ID NO: 366177 - protein, 10 aa, Influenza virus
QGAGYAADKE

SEQ ID NO: 366178 - protein, 10 aa, Influenza virus
GAGYAADKES

SEQ ID NO: 366179 - protein, 10 aa, Influenza virus
AGYAADKEST

SEQ ID NO: 366180 - protein, 10 aa, Influenza virus
GYAADKASTQ

SEQ ID NO: 366181 - protein, 10 aa, Influenza virus
YAADKESTQR

SEQ ID NO: 366182 - protein, 10 aa, Influenza virus
AADKESTQRA

SEQ ID NO: 366183 - protein, 10 aa, Influenza virus
NLEKRLENLN

SEQ ID NO: 366184 - protein, 10 aa, Influenza virus
LEKRLENLNK

SEQ ID NO: 366185 - protein, 10 aa, Influenza virus
EKRLENLNKK

SEQ ID NO: 366186 - protein, 10 aa, Influenza virus
RLENLNKKVE

SEQ ID NO: 366187 - protein, 10 aa, Influenza virus
LENLNKKVED

SEQ ID NO: 366188 - protein, 10 aa, Influenza virus
ENLNKKVEDG

SEQ ID NO: 366189 - protein, 10 aa, Influenza virus
NLNKKVEDGF

SEQ ID NO: 366190 - protein, 10 aa, Influenza virus
VWTYNVELLV

SEQ ID NO: 366191 - protein, 10 aa, Influenza virus
WTYNVELLVL

SEQ ID NO: 366192 - protein, 10 aa, Influenza virus
TYNVELLVLM

SEQ ID NO: 366193 - protein, 10 aa, Influenza virus
YNAEVLVLME

SEQ ID NO: 366194 - protein, 10 aa, Influenza virus
NAEVLVLMEN

SEQ ID NO: 366195 - protein, 10 aa, Influenza virus
AEVLVLMENE

SEQ ID NO: 366196 - protein, 10 aa, Influenza virus
ELLVLMENEM

SEQ ID NO: 366197 - protein, 10 aa, Influenza virus
LLVLMENEMT

SEQ ID NO: 366198 - protein, 10 aa, Influenza virus
LVLMENEMTL

SEQ ID NO: 366199 - protein, 10 aa, Influenza virus
VLMENEMTLD

SEQ ID NO: 366200 - protein, 10 aa, Influenza virus
LMENERTLDY

SEQ ID NO: 366201 - protein, 10 aa, Influenza virus
MENERTLDYH

SEQ ID NO: 366202 - protein, 10 aa, Influenza virus
ENERTLDYHD

SEQ ID NO: 366203 - protein, 10 aa, Influenza virus
NERTLDYHDS

SEQ ID NO: 366204 - protein, 10 aa, Influenza virus
ERTLDYHDSN

SEQ ID NO: 366205 - protein, 10 aa, Influenza virus
RTLDYHDSNV

SEQ ID NO: 366206 - protein, 10 aa, Influenza virus
TLDFHDSNVR

SEQ ID NO: 366207 - protein, 10 aa, Influenza virus
LDFHDSNVRN

SEQ ID NO: 366208 - protein, 10 aa, Influenza virus
DFHDSNVRNL

SEQ ID NO: 366209 - protein, 10 aa, Influenza virus
FHDSNVRNLY

SEQ ID NO: 366210 - protein, 10 aa, Influenza virus
HDSNVRNLYD

SEQ ID NO: 366211 - protein, 10 aa, Influenza virus
SLYDKVRMQL

SEQ ID NO: 366212 - protein, 10 aa, Influenza virus
LYNKVRMQLR

SEQ ID NO: 366213 - protein, 10 aa, Influenza virus
YNKVRMQLRD

SEQ ID NO: 366214 - protein, 10 aa, Influenza virus
NKVRMQLRDN

SEQ ID NO: 366215 - protein, 10 aa, Influenza virus
KVRMQLRDNV

SEQ ID NO: 366216 - protein, 10 aa, Influenza virus
VRMQLRDNVK

SEQ ID NO: 366217 - protein, 10 aa, Influenza virus
RMQLRDNVKE

SEQ ID NO: 366218 - protein, 10 aa, Influenza virus
MQLRDNVKEL

SEQ ID NO: 366219 - protein, 10 aa, Influenza virus
QLRDNVKELG

SEQ ID NO: 366220 - protein, 10 aa, Influenza virus
DNVKELGNGC

SEQ ID NO: 366221 - protein, 10 aa, Influenza virus
NVKELGNGCF

SEQ ID NO: 366222 - protein, 10 aa, Influenza virus
VKELGNGCFE

SEQ ID NO: 366223 - protein, 10 aa, Influenza virus
KELGNGCFEF

SEQ ID NO: 366224 - protein, 10 aa, Influenza virus
ELGNGCFEFY

SEQ ID NO: 366225 - protein, 10 aa, Influenza virus
LGNGCFEFYH

SEQ ID NO: 366226 - protein, 10 aa, Influenza virus
GCFEFYHKCN

SEQ ID NO: 366227 - protein, 10 aa, Influenza virus
CFEFYHKCDN

SEQ ID NO: 366228 - protein, 10 aa, Influenza virus
FEFYHKCDNE

SEQ ID NO: 366229 - protein, 10 aa, Influenza virus
EFYHKCDNEC

SEQ ID NO: 366230 - protein, 10 aa, Influenza virus
FYHKCDNECM

SEQ ID NO: 366231 - protein, 10 aa, Influenza virus
YHKCDDECMD

SEQ ID NO: 366232 - protein, 10 aa, Influenza virus
HKCDDECMDS

SEQ ID NO: 366233 - protein, 10 aa, Influenza virus
NGTYDYSKYE

SEQ ID NO: 366234 - protein, 10 aa, Influenza virus
GTYDYSKYEE

SEQ ID NO: 366235 - protein, 10 aa, Influenza virus
TYDYSKYEEE

SEQ ID NO: 366236 - protein, 10 aa, Influenza virus
YDYSKYEEES

SEQ ID NO: 366237 - protein, 10 aa, Influenza virus
YSKYEEESKL

SEQ ID NO: 366238 - protein, 10 aa, Influenza virus
PKYEEESKLK

SEQ ID NO: 366239 - protein, 10 aa, Influenza virus
KYEEESKLKR

SEQ ID NO: 366240 - protein, 10 aa, Influenza virus
YEEESKLKRN

SEQ ID NO: 366241 - protein, 10 aa, Influenza virus
EEESKLKRNE

SEQ ID NO: 366242 - protein, 10 aa, Influenza virus
EESKLKRNEI

SEQ ID NO: 366243 - protein, 10 aa, Influenza virus
ESKLKRNEIK

SEQ ID NO: 366244 - protein, 10 aa, Influenza virus
SKLKRNEIKG

SEQ ID NO: 366245 - protein, 10 aa, Influenza virus
MGIYQILAIY

SEQ ID NO: 366246 - protein, 10 aa, Influenza virus
GIYQILAIYA

SEQ ID NO: 366247 - protein, 10 aa, Influenza virus
IYQILAIYAT

SEQ ID NO: 366248 - protein, 10 aa, Influenza virus
AGSLSLAIMM

SEQ ID NO: 366249 - protein, 10 aa, Influenza virus
GSLSLAIMMA

SEQ ID NO: 366250 - protein, 10 aa, Influenza virus
SLSLAIMMAG

SEQ ID NO: 366251 - protein, 10 aa, Influenza virus
LSLAIMMAGI

SEQ ID NO: 366252 - protein, 10 aa, Influenza virus
SLAIMMAGIS

SEQ ID NO: 366253 - protein, 10 aa, Influenza virus
AGISLWMCSN

SEQ ID NO: 366254 - protein, 10 aa, Influenza virus
GISLWMCSNG

SEQ ID NO: 366255 - protein, 10 aa, Influenza virus
ISLWMCSNGS

SEQ ID NO: 366256 - protein, 10 aa, Influenza virus
SLWMCSNGSL

SEQ ID NO: 366257 - protein, 10 aa, Influenza virus
LWMCSNGSLQ

SEQ ID NO: 366258 - protein, 10 aa, Influenza virus
VKGDQICIGY

SEQ ID NO: 366259 - protein, 10 aa, Influenza virus
KGDQICIGYH

SEQ ID NO: 366260 - protein, 10 aa, Influenza virus
GDQICIGYHS

SEQ ID NO: 366261 - protein, 10 aa, Influenza virus
DQICIGYHSN

SEQ ID NO: 366262 - protein, 10 aa, Influenza virus
QICIGYHSNN

SEQ ID NO: 366263 - protein, 10 aa, Influenza virus
ICIGYHSNNS

SEQ ID NO: 366264 - protein, 10 aa, Influenza virus
CIGYHSNNST

SEQ ID NO: 366265 - protein, 10 aa, Influenza virus
IGYHSNNSTE

SEQ ID NO: 366266 - protein, 10 aa, Influenza virus
GYHSNNSTEK

SEQ ID NO: 366267 - protein, 10 aa, Influenza virus
TVDTILERNV

SEQ ID NO: 366268 - protein, 10 aa, Influenza virus
IDTILERNVT

SEQ ID NO: 366269 - protein, 10 aa, Influenza virus
ERNVTVTHAQ

SEQ ID NO: 366270 - protein, 10 aa, Influenza virus
RNVTVTHAQD

SEQ ID NO: 366271 - protein, 10 aa, Influenza virus
NVTVTHAQDI

SEQ ID NO: 366272 - protein, 10 aa, Influenza virus
VTVTHAQDIL

SEQ ID NO: 366273 - protein, 10 aa, Influenza virus
TVTHAQDILE

SEQ ID NO: 366274 - protein, 10 aa, Influenza virus
VTHAQDILEK

SEQ ID NO: 366275 - protein, 10 aa, Influenza virus
THAQDILEKT

SEQ ID NO: 366276 - protein, 10 aa, Influenza virus
HAQDILEKTH

SEQ ID NO: 366277 - protein, 10 aa, Influenza virus
AQDILEKTHN

SEQ ID NO: 366278 - protein, 10 aa, Influenza virus
QDILEKTHNG

SEQ ID NO: 366279 - protein, 10 aa, Influenza virus
NILEKTHNGK

SEQ ID NO: 366280 - protein, 10 aa, Influenza virus
ILEKTHNGRL

SEQ ID NO: 366281 - protein, 10 aa, Influenza virus
LEKAHNGKLC

SEQ ID NO: 366282 - protein, 10 aa, Influenza virus
EKTHNGKLCR

SEQ ID NO: 366283 - protein, 10 aa, Influenza virus
KTHNGKLCRL

SEQ ID NO: 366284 - protein, 10 aa, Influenza virus
THNGKLCRLS

SEQ ID NO: 366285 - protein, 10 aa, Influenza virus
HNGKLCRLSG

SEQ ID NO: 366286 - protein, 10 aa, Influenza virus
NGKLCRLSGI

SEQ ID NO: 366287 - protein, 10 aa, Influenza virus
GKLCRLSGIP

SEQ ID NO: 366288 - protein, 10 aa, Influenza virus
KLCRLSGIPP

SEQ ID NO: 366289 - protein, 10 aa, Influenza virus
LCRLSGIPPL

SEQ ID NO: 366290 - protein, 10 aa, Influenza virus
CRLSGIPPLE

SEQ ID NO: 366291 - protein, 10 aa, Influenza virus
RLSGIPPLEL

SEQ ID NO: 366292 - protein, 10 aa, Influenza virus
LSGIPPLELG

SEQ ID NO: 366293 - protein, 10 aa, Influenza virus
SGIPPLELGD

SEQ ID NO: 366294 - protein, 10 aa, Influenza virus
PLELGNCSIA

SEQ ID NO: 366295 - protein, 10 aa, Influenza virus
LELGDCSITG

SEQ ID NO: 366296 - protein, 10 aa, Influenza virus
ELGNCSIAGW

SEQ ID NO: 366297 - protein, 10 aa, Influenza virus
LGNCSIAGWL

SEQ ID NO: 366298 - protein, 10 aa, Influenza virus
GDCSITGWLL

SEQ ID NO: 366299 - protein, 10 aa, Influenza virus
NCSIAGWLLG

SEQ ID NO: 366300 - protein, 10 aa, Influenza virus
GNPECDRLLR

SEQ ID NO: 366301 - protein, 10 aa, Influenza virus
VPEWSYIVER

SEQ ID NO: 366302 - protein, 10 aa, Influenza virus
PEWSYIVERE

SEQ ID NO: 366303 - protein, 10 aa, Influenza virus
EWSYIVEREN

SEQ ID NO: 366304 - protein, 10 aa, Influenza virus
WSYIVERENP

SEQ ID NO: 366305 - protein, 10 aa, Influenza virus
LCYPGSFNNY

SEQ ID NO: 366306 - protein, 10 aa, Influenza virus
CYPGSFNNYE

SEQ ID NO: 366307 - protein, 10 aa, Influenza virus
YPGSFNNYEE

SEQ ID NO: 366308 - protein, 10 aa, Influenza virus
PGSFNNYEEL

SEQ ID NO: 366309 - protein, 10 aa, Influenza virus
GSFNNYEELK

SEQ ID NO: 366310 - protein, 10 aa, Influenza virus
VTHFEKVKIL

SEQ ID NO: 366311 - protein, 10 aa, Influenza virus
HFEKVKILPR

SEQ ID NO: 366312 - protein, 10 aa, Influenza virus
FEKVKILPRD

SEQ ID NO: 366313 - protein, 10 aa, Influenza virus
PSFFRNMIWL

SEQ ID NO: 366314 - protein, 10 aa, Influenza virus
SFFRNMIWLT

SEQ ID NO: 366315 - protein, 10 aa, Influenza virus
AKRSYNNTSG

SEQ ID NO: 366316 - protein, 10 aa, Influenza virus
KRSYNNTSGE

SEQ ID NO: 366317 - protein, 10 aa, Influenza virus
RSYNNTSGEQ

SEQ ID NO: 366318 - protein, 10 aa, Influenza virus
SYNNTNGEQI

SEQ ID NO: 366319 - protein, 10 aa, Influenza virus
YNNTNGEQIL

SEQ ID NO: 366320 - protein, 10 aa, Influenza virus
NNTSGEQMLV

SEQ ID NO: 366321 - protein, 10 aa, Influenza virus
NTSGEQMLVI

SEQ ID NO: 366322 - protein, 10 aa, Influenza virus
TSGEQMLVIW

SEQ ID NO: 366323 - protein, 10 aa, Influenza virus
SGEQMLVIWG

SEQ ID NO: 366324 - protein, 10 aa, Influenza virus
IWGIHHPNDD

SEQ ID NO: 366325 - protein, 10 aa, Influenza virus
LYQKVGTYVS

SEQ ID NO: 366326 - protein, 10 aa, Influenza virus
WDVINFESTG

SEQ ID NO: 366327 - protein, 10 aa, Influenza virus
DVINFESTGN

SEQ ID NO: 366328 - protein, 10 aa, Influenza virus
VINFESTGNL

SEQ ID NO: 366329 - protein, 10 aa, Influenza virus
INFESTGNLV

SEQ ID NO: 366330 - protein, 10 aa, Influenza virus
NFESTGNLVA

SEQ ID NO: 366331 - protein, 10 aa, Influenza virus
FESTGNLVAP

SEQ ID NO: 366332 - protein, 10 aa, Influenza virus
ESTGNLVAPE

SEQ ID NO: 366333 - protein, 10 aa, Influenza virus
STGNLVAPEY

SEQ ID NO: 366334 - protein, 10 aa, Influenza virus
TGNLVAPEYG

SEQ ID NO: 366335 - protein, 10 aa, Influenza virus
GNLVAPEYGF

SEQ ID NO: 366336 - protein, 10 aa, Influenza virus
NLVAPEYGFK

SEQ ID NO: 366337 - protein, 10 aa, Influenza virus
LVAPEYGFKI

SEQ ID NO: 366338 - protein, 10 aa, Influenza virus
VAPEYGFKIS

SEQ ID NO: 366339 - protein, 10 aa, Influenza virus
VPEYGFKISK

SEQ ID NO: 366340 - protein, 10 aa, Influenza virus
PEYGFKISRR

SEQ ID NO: 366341 - protein, 10 aa, Influenza virus
EYGFRISKRG

SEQ ID NO: 366342 - protein, 10 aa, Influenza virus
YGFKISKRGG

SEQ ID NO: 366343 - protein, 10 aa, Influenza virus
GFKISKRGGS

SEQ ID NO: 366344 - protein, 10 aa, Influenza virus
FKISKRGGSG

SEQ ID NO: 366345 - protein, 10 aa, Influenza virus
KISKRGGSGI

SEQ ID NO: 366346 - protein, 10 aa, Influenza virus
ISKRGGSGIM

SEQ ID NO: 366347 - protein, 10 aa, Influenza virus
SKRGGSGIMK

SEQ ID NO: 366348 - protein, 10 aa, Influenza virus
KRGGSGIMKT

SEQ ID NO: 366349 - protein, 10 aa, Influenza virus
RGGSGIMKTE

SEQ ID NO: 366350 - protein, 10 aa, Influenza virus
SGIMKTEKTL

SEQ ID NO: 366351 - protein, 10 aa, Influenza virus
NCETKCQSPL

SEQ ID NO: 366352 - protein, 10 aa, Influenza virus
CETKCQSPLG

SEQ ID NO: 366353 - protein, 10 aa, Influenza virus
ETKCQSPLGA

SEQ ID NO: 366354 - protein, 10 aa, Influenza virus
TKCQTPLGAL

SEQ ID NO: 366355 - protein, 10 aa, Influenza virus
KCQTPLGALN

SEQ ID NO: 366356 - protein, 10 aa, Influenza virus
CQTPLGALNT

SEQ ID NO: 366357 - protein, 10 aa, Influenza virus
QTPLGALNTT

SEQ ID NO: 366358 - protein, 10 aa, Influenza virus
TPLGALNTTL

SEQ ID NO: 366359 - protein, 10 aa, Influenza virus
PLGALNTTLP

SEQ ID NO: 366360 - protein, 10 aa, Influenza virus
LGALNTTLPF

SEQ ID NO: 366361 - protein, 10 aa, Influenza virus
GALNTTLPFH

SEQ ID NO: 366362 - protein, 10 aa, Influenza virus
ALNTTLPFHN

SEQ ID NO: 366363 - protein, 10 aa, Influenza virus
INTTLPFHNI

SEQ ID NO: 366364 - protein, 10 aa, Influenza virus
NTTLPFHNIH

SEQ ID NO: 366365 - protein, 10 aa, Influenza virus
TTLPFHNIHP

SEQ ID NO: 366366 - protein, 10 aa, Influenza virus
TLPFHNIHPL

SEQ ID NO: 366367 - protein, 10 aa, Influenza virus
LPFHNIHPLT

SEQ ID NO: 366368 - protein, 10 aa, Influenza virus
PFHNIHPLTI

SEQ ID NO: 366369 - protein, 10 aa, Influenza virus
FHNIHPLTIG

SEQ ID NO: 366370 - protein, 10 aa, Influenza virus
HNIHPLTIGE

SEQ ID NO: 366371 - protein, 10 aa, Influenza virus
NIHPLTIGEC

SEQ ID NO: 366372 - protein, 10 aa, Influenza virus
IHPLTIGECP

SEQ ID NO: 366373 - protein, 10 aa, Influenza virus
HPLAIGECPK

SEQ ID NO: 366374 - protein, 10 aa, Influenza virus
PLTIGECPRY

SEQ ID NO: 366375 - protein, 10 aa, Influenza virus
LTIGECPRYV

SEQ ID NO: 366376 - protein, 10 aa, Influenza virus
TIGECPKYVR

SEQ ID NO: 366377 - protein, 10 aa, Influenza virus
IGECPKYVRS

SEQ ID NO: 366378 - protein, 10 aa, Influenza virus
GECPKYVKSD

SEQ ID NO: 366379 - protein, 10 aa, Influenza virus
ECPKYVKSDR

SEQ ID NO: 366380 - protein, 10 aa, Influenza virus
CPKYVKSDRL

SEQ ID NO: 366381 - protein, 10 aa, Influenza virus
PKYVKSDRLV

SEQ ID NO: 366382 - protein, 10 aa, Influenza virus
KYVKSDRLVL

SEQ ID NO: 366383 - protein, 10 aa, Influenza virus
YVKSDRLVLA

SEQ ID NO: 366384 - protein, 10 aa, Influenza virus
VKSDRLVLAT

SEQ ID NO: 366385 - protein, 10 aa, Influenza virus
KSDRLVLATG

SEQ ID NO: 366386 - protein, 10 aa, Influenza virus
SDRLVLATGL

SEQ ID NO: 366387 - protein, 10 aa, Influenza virus
DRLVLATGLR

SEQ ID NO: 366388 - protein, 10 aa, Influenza virus
RLVLATGLRN

SEQ ID NO: 366389 - protein, 10 aa, Influenza virus
LVLATGLRNI

SEQ ID NO: 366390 - protein, 10 aa, Influenza virus
VLATGLRNIP

SEQ ID NO: 366391 - protein, 10 aa, Influenza virus
LATGLRNIPQ

SEQ ID NO: 366392 - protein, 10 aa, Influenza virus
ATGLRNIPQI

SEQ ID NO: 366393 - protein, 10 aa, Influenza virus
TGLRNIPQIE

SEQ ID NO: 366394 - protein, 10 aa, Influenza virus
RNIPQIESRG

SEQ ID NO: 366395 - protein, 10 aa, Influenza virus
NIPQIESRGL

SEQ ID NO: 366396 - protein, 10 aa, Influenza virus
IPQIESRGLF

SEQ ID NO: 366397 - protein, 10 aa, Influenza virus
PQMESRGLFG

SEQ ID NO: 366398 - protein, 10 aa, Influenza virus
QMESRGLFGA

SEQ ID NO: 366399 - protein, 10 aa, Influenza virus
MESRGLFGAI

SEQ ID NO: 366400 - protein, 10 aa, Influenza virus
EPRGLFGAIA

SEQ ID NO: 366401 - protein, 10 aa, Influenza virus
ARGLFGAIAG

SEQ ID NO: 366402 - protein, 10 aa, Influenza virus
FIEGGWQGMI

SEQ ID NO: 366403 - protein, 10 aa, Influenza virus
IEGGWQGMID

SEQ ID NO: 366404 - protein, 10 aa, Influenza virus
EGGWQGMIDG

SEQ ID NO: 366405 - protein, 10 aa, Influenza virus
GGWQGMIDGW

SEQ ID NO: 366406 - protein, 10 aa, Influenza virus
GWQGMIDGWY

SEQ ID NO: 366407 - protein, 10 aa, Influenza virus
WQGMIDGWYG

SEQ ID NO: 366408 - protein, 10 aa, Influenza virus
QGMIDGWYGY

SEQ ID NO: 366409 - protein, 10 aa, Influenza virus
GMIDGWYGYH

SEQ ID NO: 366410 - protein, 10 aa, Influenza virus
MIDGWYGYHH

SEQ ID NO: 366411 - protein, 10 aa, Influenza virus
IDGWYGYHHS

SEQ ID NO: 366412 - protein, 10 aa, Influenza virus
GYHHSNDQGA

SEQ ID NO: 366413 - protein, 10 aa, Influenza virus
YHHSNDQGAG

SEQ ID NO: 366414 - protein, 10 aa, Influenza virus
HHSNDQGAGY

SEQ ID NO: 366415 - protein, 10 aa, Influenza virus
HSNDQGAGYA

SEQ ID NO: 366416 - protein, 10 aa, Influenza virus
SNDQGAGYAA

SEQ ID NO: 366417 - protein, 10 aa, Influenza virus
NDQGAGYAAD

SEQ ID NO: 366418 - protein, 10 aa, Influenza virus
DQGAGYAADK

SEQ ID NO: 366419 - protein, 10 aa, Influenza virus
QGSGYAADKA

SEQ ID NO: 366420 - protein, 10 aa, Influenza virus
GSGYAADKAS

SEQ ID NO: 366421 - protein, 10 aa, Influenza virus
SGYAADKAST

SEQ ID NO: 366422 - protein, 10 aa, Influenza virus
GYAADKASTQ

SEQ ID NO: 366423 - protein, 10 aa, Influenza virus
YAADKASTQK

SEQ ID NO: 366424 - protein, 10 aa, Influenza virus
AADKASTQKA

SEQ ID NO: 366425 - protein, 10 aa, Influenza virus
ADKESTQKAI

SEQ ID NO: 366426 - protein, 10 aa, Influenza virus
NSIIEKMNTQ

SEQ ID NO: 366427 - protein, 10 aa, Influenza virus
AVGKEFNNLE

SEQ ID NO: 366428 - protein, 10 aa, Influenza virus
KEFSNLEKRL

SEQ ID NO: 366429 - protein, 10 aa, Influenza virus
EFSNLEKRLE

SEQ ID NO: 366430 - protein, 10 aa, Influenza virus
FSNLEKRLEN

SEQ ID NO: 366431 - protein, 10 aa, Influenza virus
SNLEKRLENL

SEQ ID NO: 366432 - protein, 10 aa, Influenza virus
NLEKRLENLN

SEQ ID NO: 366433 - protein, 10 aa, Influenza virus
LEKRLENLNK

SEQ ID NO: 366434 - protein, 10 aa, Influenza virus
EKRLENLNKK

SEQ ID NO: 366435 - protein, 10 aa, Influenza virus
RLENLNKKVE

SEQ ID NO: 366436 - protein, 10 aa, Influenza virus
LENLNKKVED

SEQ ID NO: 366437 - protein, 10 aa, Influenza virus
ENLNKKVEDG

SEQ ID NO: 366438 - protein, 10 aa, Influenza virus
NLNKKVEDGF

SEQ ID NO: 366439 - protein, 10 aa, Influenza virus
MEDGFIDVWT

SEQ ID NO: 366440 - protein, 10 aa, Influenza virus
EDGFIDVWTY

SEQ ID NO: 366441 - protein, 10 aa, Influenza virus
DGFIDVWTYN

SEQ ID NO: 366442 - protein, 10 aa, Influenza virus
GFIDVWTYNA

SEQ ID NO: 366443 - protein, 10 aa, Influenza virus
FIDVWTYNAE

SEQ ID NO: 366444 - protein, 10 aa, Influenza virus
IDVWTYNAEL

SEQ ID NO: 366445 - protein, 10 aa, Influenza virus
DVWTYNTELL

SEQ ID NO: 366446 - protein, 10 aa, Influenza virus
ELLVLMENEM

SEQ ID NO: 366447 - protein, 10 aa, Influenza virus
LLVLMENEMT

SEQ ID NO: 366448 - protein, 10 aa, Influenza virus
LVLMENEMTL

SEQ ID NO: 366449 - protein, 10 aa, Influenza virus
VLMENEMTLD

SEQ ID NO: 366450 - protein, 10 aa, Influenza virus
LMENEMTLDF

SEQ ID NO: 366451 - protein, 10 aa, Influenza virus
MENEMTLDFH

SEQ ID NO: 366452 - protein, 10 aa, Influenza virus
ENEMTLDFHD

SEQ ID NO: 366453 - protein, 10 aa, Influenza virus
NEMTLDFHDS

SEQ ID NO: 366454 - protein, 10 aa, Influenza virus
EMTLDFHDSN

SEQ ID NO: 366455 - protein, 10 aa, Influenza virus
MTLDFHDSNV

SEQ ID NO: 366456 - protein, 10 aa, Influenza virus
TLDFHDSNVR

SEQ ID NO: 366457 - protein, 10 aa, Influenza virus
LDFHDSNVKS

SEQ ID NO: 366458 - protein, 10 aa, Influenza virus
DFHDSNVKSL

SEQ ID NO: 366459 - protein, 10 aa, Influenza virus
FHDSNVKSLY

SEQ ID NO: 366460 - protein, 10 aa, Influenza virus
HDSNVKSLYD

SEQ ID NO: 366461 - protein, 10 aa, Influenza virus
VKSLYDKVRM

SEQ ID NO: 366462 - protein, 10 aa, Influenza virus
KSLYDKVRMQ

SEQ ID NO: 366463 - protein, 10 aa, Influenza virus
SLYDKVRMQL

SEQ ID NO: 366464 - protein, 10 aa, Influenza virus
LYNKVRMQLR

SEQ ID NO: 366465 - protein, 10 aa, Influenza virus
YNKVRMQLRD

SEQ ID NO: 366466 - protein, 10 aa, Influenza virus
NKVRMQLRDN

SEQ ID NO: 366467 - protein, 10 aa, Influenza virus
KVRMQLRDNA

SEQ ID NO: 366468 - protein, 10 aa, Influenza virus
VRMQLRDNAK

SEQ ID NO: 366469 - protein, 10 aa, Influenza virus
RMQLRDNAKE

SEQ ID NO: 366470 - protein, 10 aa, Influenza virus
MQLRDNAKEI

SEQ ID NO: 366471 - protein, 10 aa, Influenza virus
QLRDNAKEIG

SEQ ID NO: 366472 - protein, 10 aa, Influenza virus
LRDNAKEIGN

SEQ ID NO: 366473 - protein, 10 aa, Influenza virus
RDNAKEIGNG

SEQ ID NO: 366474 - protein, 10 aa, Influenza virus
DNAKEIGNGC

SEQ ID NO: 366475 - protein, 10 aa, Influenza virus
NAKEIGNGCF

SEQ ID NO: 366476 - protein, 10 aa, Influenza virus
AKEIGNGCFE

SEQ ID NO: 366477 - protein, 10 aa, Influenza virus
KEIGNGCFEF

SEQ ID NO: 366478 - protein, 10 aa, Influenza virus
EIGNGCFEFY

SEQ ID NO: 366479 - protein, 10 aa, Influenza virus
IGNGCFEFYH

SEQ ID NO: 366480 - protein, 10 aa, Influenza virus
GCFEFYHKCN

SEQ ID NO: 366481 - protein, 10 aa, Influenza virus
CFEFYHKCDN

SEQ ID NO: 366482 - protein, 10 aa, Influenza virus
FEFYHKCDNE

SEQ ID NO: 366483 - protein, 10 aa, Influenza virus
EFYHKCDNEC

SEQ ID NO: 366484 - protein, 10 aa, Influenza virus
FYHKCDNECM

SEQ ID NO: 366485 - protein, 10 aa, Influenza virus
CMNSVRNGTY

SEQ ID NO: 366486 - protein, 10 aa, Influenza virus
RNGTYDYPKY

SEQ ID NO: 366487 - protein, 10 aa, Influenza virus
NGTYYYPKYE

SEQ ID NO: 366488 - protein, 10 aa, Influenza virus
GTYYYPKYEE

SEQ ID NO: 366489 - protein, 10 aa, Influenza virus
TYYYPKYEEE

SEQ ID NO: 366490 - protein, 10 aa, Influenza virus
YYYPKYEEES

SEQ ID NO: 366491 - protein, 10 aa, Influenza virus
DYPKYEEESR

SEQ ID NO: 366492 - protein, 10 aa, Influenza virus
YPKYEEESRL

SEQ ID NO: 366493 - protein, 10 aa, Influenza virus
PKYEEESKLK

SEQ ID NO: 366494 - protein, 10 aa, Influenza virus
KYEEESKLKR

SEQ ID NO: 366495 - protein, 10 aa, Influenza virus
YEEESKLKRN

SEQ ID NO: 366496 - protein, 10 aa, Influenza virus
EEESKLKRNE

SEQ ID NO: 366497 - protein, 10 aa, Influenza virus
EESKLKRNEI

SEQ ID NO: 366498 - protein, 10 aa, Influenza virus
ESKLKRNEIK

SEQ ID NO: 366499 - protein, 10 aa, Influenza virus
SKLKRNEIKG

SEQ ID NO: 366500 - protein, 10 aa, Influenza virus
KLKRNEIKGV

SEQ ID NO: 366501 - protein, 10 aa, Influenza virus
LKRNEIKGVK

SEQ ID NO: 366502 - protein, 10 aa, Influenza virus
KRNEIKGVKL

SEQ ID NO: 366503 - protein, 10 aa, Influenza virus
RNEIKGVELS

SEQ ID NO: 366504 - protein, 10 aa, Influenza virus
NEIKGVKLSN

SEQ ID NO: 366505 - protein, 10 aa, Influenza virus
EIKGVKLSNM

SEQ ID NO: 366506 - protein, 10 aa, Influenza virus
IKGVKLSNMG

SEQ ID NO: 366507 - protein, 10 aa, Influenza virus
KGVKLSNMGV

SEQ ID NO: 366508 - protein, 10 aa, Influenza virus
GVKLSNMGVY

SEQ ID NO: 366509 - protein, 10 aa, Influenza virus
VKLSNMGVYQ

SEQ ID NO: 366510 - protein, 10 aa, Influenza virus
KLSNMGVYQI

SEQ ID NO: 366511 - protein, 10 aa, Influenza virus
LSNMGVYQIL

SEQ ID NO: 366512 - protein, 10 aa, Influenza virus
SNMGVYQILA

SEQ ID NO: 366513 - protein, 10 aa, Influenza virus
NMGVYQILAI

SEQ ID NO: 366514 - protein, 10 aa, Influenza virus
MGIYQILAIY

SEQ ID NO: 366515 - protein, 10 aa, Influenza virus
GIYQILAIYA

SEQ ID NO: 366516 - protein, 10 aa, Influenza virus
IYQILAIYAT

SEQ ID NO: 366517 - protein, 10 aa, Influenza virus
YQILVIYATV

SEQ ID NO: 366518 - protein, 10 aa, Influenza virus
QILVIYATVA

SEQ ID NO: 366519 - protein, 10 aa, Influenza virus
VLAIYATVAG

SEQ ID NO: 366520 - protein, 10 aa, Influenza virus
AGSLSLAIMI

SEQ ID NO: 366521 - protein, 10 aa, Influenza virus
GSLSLAIMIA

SEQ ID NO: 366522 - protein, 10 aa, Influenza virus
SLSLAIMIAG

SEQ ID NO: 366523 - protein, 10 aa, Influenza virus
LSLAIMIAGI

SEQ ID NO: 366524 - protein, 10 aa, Influenza virus
SLAIMIAGIS

SEQ ID NO: 366525 - protein, 10 aa, Influenza virus
AGISLWMCSN

SEQ ID NO: 366526 - protein, 10 aa, Influenza virus
GISLWMCSNG

SEQ ID NO: 366527 - protein, 10 aa, Influenza virus
ISLWMCSNGS

SEQ ID NO: 366528 - protein, 10 aa, Influenza virus
SLWMCSNGSL

SEQ ID NO: 366529 - protein, 10 aa, Influenza virus
LWMCSNGSLQ

SEQ ID NO: 366530 - protein, 10 aa, Influenza virus
CSNGSLQCRV

SEQ ID NO: 366531 - protein, 10 aa, Influenza virus
SNGSLQCRVC

SEQ ID NO: 366532 - protein, 10 aa, Influenza virus
NGSLQCRVCI

SEQ ID NO: 366533 - protein, 10 aa, Influenza virus
MNPNQKTITI

SEQ ID NO: 366534 - protein, 10 aa, Influenza virus
NPNQKTITIG

SEQ ID NO: 366535 - protein, 10 aa, Influenza virus
PNQKTITIGS

SEQ ID NO: 366536 - protein, 10 aa, Influenza virus
NQKIITIGSA

SEQ ID NO: 366537 - protein, 10 aa, Influenza virus
QKIITIGSAS

SEQ ID NO: 366538 - protein, 10 aa, Influenza virus
KIITIGSASL

SEQ ID NO: 366539 - protein, 10 aa, Influenza virus
QIAILVTTVT

SEQ ID NO: 366540 - protein, 10 aa, Influenza virus
IAILVTTVTL

SEQ ID NO: 366541 - protein, 10 aa, Influenza virus
AILVTTVTLH

SEQ ID NO: 366542 - protein, 10 aa, Influenza virus
ILVTTVTLHF

SEQ ID NO: 366543 - protein, 10 aa, Influenza virus
LVTTVTLHFK

SEQ ID NO: 366544 - protein, 10 aa, Influenza virus
VTTVTLHFKQ

SEQ ID NO: 366545 - protein, 10 aa, Influenza virus
TTVTLHFKQN

SEQ ID NO: 366546 - protein, 10 aa, Influenza virus
TVTLHFKQNE

SEQ ID NO: 366547 - protein, 10 aa, Influenza virus
VTLHFKQNEC

SEQ ID NO: 366548 - protein, 10 aa, Influenza virus
TLHFKQNECS

SEQ ID NO: 366549 - protein, 10 aa, Influenza virus
PCEPIIVERN

SEQ ID NO: 366550 - protein, 10 aa, Influenza virus
WSKPQCKITG

SEQ ID NO: 366551 - protein, 10 aa, Influenza virus
SKPQCKITGF

SEQ ID NO: 366552 - protein, 10 aa, Influenza virus
KPQCKITGFA

SEQ ID NO: 366553 - protein, 10 aa, Influenza virus
PQCKITGFAP

SEQ ID NO: 366554 - protein, 10 aa, Influenza virus
QCKITGFAPF

SEQ ID NO: 366555 - protein, 10 aa, Influenza virus
CKITGFAPFS

SEQ ID NO: 366556 - protein, 10 aa, Influenza virus
KITGFAPFSK

SEQ ID NO: 366557 - protein, 10 aa, Influenza virus
KDNPIRLSGG

SEQ ID NO: 366558 - protein, 10 aa, Influenza virus
DNSIRLSADG

SEQ ID NO: 366559 - protein, 10 aa, Influenza virus
NSIRLSASGD

SEQ ID NO: 366560 - protein, 10 aa, Influenza virus
SIRLSADGDI

SEQ ID NO: 366561 - protein, 10 aa, Influenza virus
IRLSADGDIW

SEQ ID NO: 366562 - protein, 10 aa, Influenza virus
RLSAGGDIWI

SEQ ID NO: 366563 - protein, 10 aa, Influenza virus
LSAGGDIWIT

SEQ ID NO: 366564 - protein, 10 aa, Influenza virus
SAGGDIWITR

SEQ ID NO: 366565 - protein, 10 aa, Influenza virus
AGGDIWITRE

SEQ ID NO: 366566 - protein, 10 aa, Influenza virus
GGDIWITREP

SEQ ID NO: 366567 - protein, 10 aa, Influenza virus
GDIWITREPY

SEQ ID NO: 366568 - protein, 10 aa, Influenza virus
DIWITREPYV

SEQ ID NO: 366569 - protein, 10 aa, Influenza virus
IWITREPYVS

SEQ ID NO: 366570 - protein, 10 aa, Influenza virus
WITREPYVSC

SEQ ID NO: 366571 - protein, 10 aa, Influenza virus
ITREPYVSCD

SEQ ID NO: 366572 - protein, 10 aa, Influenza virus
TREPYVSCDT

SEQ ID NO: 366573 - protein, 10 aa, Influenza virus
SKCYQFALGQ

SEQ ID NO: 366574 - protein, 10 aa, Influenza virus
CYQFALGQGA

SEQ ID NO: 366575 - protein, 10 aa, Influenza virus
YQFALGQGAT

SEQ ID NO: 366576 - protein, 10 aa, Influenza virus
FALGQGTTLE

SEQ ID NO: 366577 - protein, 10 aa, Influenza virus
ALGQGTTLNN

SEQ ID NO: 366578 - protein, 10 aa, Influenza virus
LGQGTTLNNK

SEQ ID NO: 366579 - protein, 10 aa, Influenza virus
GQGTTLENKH

SEQ ID NO: 366580 - protein, 10 aa, Influenza virus
QGTTLNNKHS

SEQ ID NO: 366581 - protein, 10 aa, Influenza virus
GTTLNNKHSN

SEQ ID NO: 366582 - protein, 10 aa, Influenza virus
TTLDNKHSND

SEQ ID NO: 366583 - protein, 10 aa, Influenza virus
TLDNKHSNDT

SEQ ID NO: 366584 - protein, 10 aa, Influenza virus
LDNKHSNDTI

SEQ ID NO: 366585 - protein, 10 aa, Influenza virus
DNKHSNDTIH

SEQ ID NO: 366586 - protein, 10 aa, Influenza virus
NKHSNDTIHD

SEQ ID NO: 366587 - protein, 10 aa, Influenza virus
KHSNDTIHDR

SEQ ID NO: 366588 - protein, 10 aa, Influenza virus
TVHDRIPHRT

SEQ ID NO: 366589 - protein, 10 aa, Influenza virus
VHDRIPHRTL

SEQ ID NO: 366590 - protein, 10 aa, Influenza virus
HDRTPHRTLL

SEQ ID NO: 366591 - protein, 10 aa, Influenza virus
DRTPHRTLLM

SEQ ID NO: 366592 - protein, 10 aa, Influenza virus
RTPHRTLLMN

SEQ ID NO: 366593 - protein, 10 aa, Influenza virus
TPHRTLLMNE

SEQ ID NO: 366594 - protein, 10 aa, Influenza virus
TLLMNELGVS

SEQ ID NO: 366595 - protein, 10 aa, Influenza virus
LLMNELGVSF

SEQ ID NO: 366596 - protein, 10 aa, Influenza virus
LMNELGVSFH

SEQ ID NO: 366597 - protein, 10 aa, Influenza virus
MNELGVSFHL

SEQ ID NO: 366598 - protein, 10 aa, Influenza virus
NELGVSFHLG

SEQ ID NO: 366599 - protein, 10 aa, Influenza virus
ELGVSFHLGT

SEQ ID NO: 366600 - protein, 10 aa, Influenza virus
LGVPFHLGTR

SEQ ID NO: 366601 - protein, 10 aa, Influenza virus
GVPFHLGTRQ

SEQ ID NO: 366602 - protein, 10 aa, Influenza virus
VPFHLGTRQV

SEQ ID NO: 366603 - protein, 10 aa, Influenza virus
PFHLGTRQVC

SEQ ID NO: 366604 - protein, 10 aa, Influenza virus
FHLGTRQVCI

SEQ ID NO: 366605 - protein, 10 aa, Influenza virus
HLGTRQVCIA

SEQ ID NO: 366606 - protein, 10 aa, Influenza virus
LGTRQVCIAW

SEQ ID NO: 366607 - protein, 10 aa, Influenza virus
GTRQVCIAWS

SEQ ID NO: 366608 - protein, 10 aa, Influenza virus
TRQVCIAWSS

SEQ ID NO: 366609 - protein, 10 aa, Influenza virus
RQVCIAWSSS

SEQ ID NO: 366610 - protein, 10 aa, Influenza virus
QVCIAWSSSS

SEQ ID NO: 366611 - protein, 10 aa, Influenza virus
VCIAWSSSSC

SEQ ID NO: 366612 - protein, 10 aa, Influenza virus
CIAWSSSSCH

SEQ ID NO: 366613 - protein, 10 aa, Influenza virus
IAWSSSSCHD

SEQ ID NO: 366614 - protein, 10 aa, Influenza virus
WSSSSCHDGR

SEQ ID NO: 366615 - protein, 10 aa, Influenza virus
SSSSCHDGRA

SEQ ID NO: 366616 - protein, 10 aa, Influenza virus
SSSCHDGRAW

SEQ ID NO: 366617 - protein, 10 aa, Influenza virus
SSCHDGRAWL

SEQ ID NO: 366618 - protein, 10 aa, Influenza virus
SCHDGRAWLH

SEQ ID NO: 366619 - protein, 10 aa, Influenza virus
CHDGRAWLHV

SEQ ID NO: 366620 - protein, 10 aa, Influenza virus
HDGRAWLHVC

SEQ ID NO: 366621 - protein, 10 aa, Influenza virus
DGKAWLHVCI

SEQ ID NO: 366622 - protein, 10 aa, Influenza virus
GKAWLHVCIT

SEQ ID NO: 366623 - protein, 10 aa, Influenza virus
KAWLHVCITG

SEQ ID NO: 366624 - protein, 10 aa, Influenza virus
AWLHVCITGD

SEQ ID NO: 366625 - protein, 10 aa, Influenza virus
WLHVCITGDD

SEQ ID NO: 366626 - protein, 10 aa, Influenza virus
CVTGDDKNAT

SEQ ID NO: 366627 - protein, 10 aa, Influenza virus
VTGDDKNATA

SEQ ID NO: 366628 - protein, 10 aa, Influenza virus
TGDDKNATAS

SEQ ID NO: 366629 - protein, 10 aa, Influenza virus
GDDKNATASF

SEQ ID NO: 366630 - protein, 10 aa, Influenza virus
DDKNATASFI

SEQ ID NO: 366631 - protein, 10 aa, Influenza virus
DKNATASFIY

SEQ ID NO: 366632 - protein, 10 aa, Influenza virus
NATASFIYNG

SEQ ID NO: 366633 - protein, 10 aa, Influenza virus
DSIVSWSQNI

SEQ ID NO: 366634 - protein, 10 aa, Influenza virus
SIVSWSQNIL

SEQ ID NO: 366635 - protein, 10 aa, Influenza virus
IVSWSQNILR

SEQ ID NO: 366636 - protein, 10 aa, Influenza virus
VSWSQNILRT

SEQ ID NO: 366637 - protein, 10 aa, Influenza virus
SWSHNILRTQ

SEQ ID NO: 366638 - protein, 10 aa, Influenza virus
WSHNILRTQE

SEQ ID NO: 366639 - protein, 10 aa, Influenza virus
SQNILRTHES

SEQ ID NO: 366640 - protein, 10 aa, Influenza virus
QNILRTHESE

SEQ ID NO: 366641 - protein, 10 aa, Influenza virus
ILRTQESECI

SEQ ID NO: 366642 - protein, 10 aa, Influenza virus
LRTHESECVC

SEQ ID NO: 366643 - protein, 10 aa, Influenza virus
RTHESECVCI

SEQ ID NO: 366644 - protein, 10 aa, Influenza virus
TQESECVCIS

SEQ ID NO: 366645 - protein, 10 aa, Influenza virus
QESECVCISG

SEQ ID NO: 366646 - protein, 10 aa, Influenza virus
ESECVCINGS

SEQ ID NO: 366647 - protein, 10 aa, Influenza virus
SECVCINGSC

SEQ ID NO: 366648 - protein, 10 aa, Influenza virus
ECVCINGSCT

SEQ ID NO: 366649 - protein, 10 aa, Influenza virus
CVCINGSCTV

SEQ ID NO: 366650 - protein, 10 aa, Influenza virus
VCINGSCTVV

SEQ ID NO: 366651 - protein, 10 aa, Influenza virus
CINGSCTVVM

SEQ ID NO: 366652 - protein, 10 aa, Influenza virus
INGSCTVVMT

SEQ ID NO: 366653 - protein, 10 aa, Influenza virus
NGSCTVVMTD

SEQ ID NO: 366654 - protein, 10 aa, Influenza virus
GSCTVVMTDG

SEQ ID NO: 366655 - protein, 10 aa, Influenza virus
SCTVVMTDGS

SEQ ID NO: 366656 - protein, 10 aa, Influenza virus
CAVVMTDGSA

SEQ ID NO: 366657 - protein, 10 aa, Influenza virus
AVVMTDGSAS

SEQ ID NO: 366658 - protein, 10 aa, Influenza virus
VMTDGSASGK

SEQ ID NO: 366659 - protein, 10 aa, Influenza virus
MTDGSASGKA

SEQ ID NO: 366660 - protein, 10 aa, Influenza virus
TDGSASGKAD

SEQ ID NO: 366661 - protein, 10 aa, Influenza virus
DGSASGKADT

SEQ ID NO: 366662 - protein, 10 aa, Influenza virus
GSASGKADTR

SEQ ID NO: 366663 - protein, 10 aa, Influenza virus
SASGKADTRI

SEQ ID NO: 366664 - protein, 10 aa, Influenza virus
ASGKADTRIL

SEQ ID NO: 366665 - protein, 10 aa, Influenza virus
SGKADTRILF

SEQ ID NO: 366666 - protein, 10 aa, Influenza virus
GKADTRILFI

SEQ ID NO: 366667 - protein, 10 aa, Influenza virus
ADTRILFIEE

SEQ ID NO: 366668 - protein, 10 aa, Influenza virus
DTRILFIEEG

SEQ ID NO: 366669 - protein, 10 aa, Influenza virus
TRILFIEEGK

SEQ ID NO: 366670 - protein, 10 aa, Influenza virus
EGKIIHISPL

SEQ ID NO: 366671 - protein, 10 aa, Influenza virus
IHISPLSGSA

SEQ ID NO: 366672 - protein, 10 aa, Influenza virus
HIGPLSGSAQ

SEQ ID NO: 366673 - protein, 10 aa, Influenza virus
IGPLSGSAQH

SEQ ID NO: 366674 - protein, 10 aa, Influenza virus
SPLSGSAQHV

SEQ ID NO: 366675 - protein, 10 aa, Influenza virus
PLSGSAQHVE

SEQ ID NO: 366676 - protein, 10 aa, Influenza virus
LSGSAQHVEE

SEQ ID NO: 366677 - protein, 10 aa, Influenza virus
SGSAQHVEEC

SEQ ID NO: 366678 - protein, 10 aa, Influenza virus
GSAQHVEECS

SEQ ID NO: 366679 - protein, 10 aa, Influenza virus
SAQHVEECSC

SEQ ID NO: 366680 - protein, 10 aa, Influenza virus
AQHVEECSCY

SEQ ID NO: 366681 - protein, 10 aa, Influenza virus
QHVEECSCYP

SEQ ID NO: 366682 - protein, 10 aa, Influenza virus
HVEECSCYPR

SEQ ID NO: 366683 - protein, 10 aa, Influenza virus
VEECSCYPRY

SEQ ID NO: 366684 - protein, 10 aa, Influenza virus
EECSCYPQYP

SEQ ID NO: 366685 - protein, 10 aa, Influenza virus
ECSCYPRYPG

SEQ ID NO: 366686 - protein, 10 aa, Influenza virus
CSCYPRYPGV

SEQ ID NO: 366687 - protein, 10 aa, Influenza virus
SCYPRYPGVR

SEQ ID NO: 366688 - protein, 10 aa, Influenza virus
CYPRYPGVRC

SEQ ID NO: 366689 - protein, 10 aa, Influenza virus
YPGVRCICRD

SEQ ID NO: 366690 - protein, 10 aa, Influenza virus
PGVRCICRDN

SEQ ID NO: 366691 - protein, 10 aa, Influenza virus
GVRCICRDNW

SEQ ID NO: 366692 - protein, 10 aa, Influenza virus
VRCVCRDNWK

SEQ ID NO: 366693 - protein, 10 aa, Influenza virus
RCVCRDNWKG

SEQ ID NO: 366694 - protein, 10 aa, Influenza virus
CVCRDNWKGS

SEQ ID NO: 366695 - protein, 10 aa, Influenza virus
VCRDNWKGSN

SEQ ID NO: 366696 - protein, 10 aa, Influenza virus
CRDNWRGSNR

SEQ ID NO: 366697 - protein, 10 aa, Influenza virus
RDNWRGSNRP

SEQ ID NO: 366698 - protein, 10 aa, Influenza virus
DNWKGSNRPI

SEQ ID NO: 366699 - protein, 10 aa, Influenza virus
GSNRPVVDIN

SEQ ID NO: 366700 - protein, 10 aa, Influenza virus
DINMADYSID

SEQ ID NO: 366701 - protein, 10 aa, Influenza virus
INMADYSIDS

SEQ ID NO: 366702 - protein, 10 aa, Influenza virus
EYSIDSSYVC

SEQ ID NO: 366703 - protein, 10 aa, Influenza virus
YSIDSSYICS

SEQ ID NO: 366704 - protein, 10 aa, Influenza virus
SIDSSYICSG

SEQ ID NO: 366705 - protein, 10 aa, Influenza virus
IDSSYICSGL

SEQ ID NO: 366706 - protein, 10 aa, Influenza virus
DSSYICSGLV

SEQ ID NO: 366707 - protein, 10 aa, Influenza virus
SSYICSGLVG

SEQ ID NO: 366708 - protein, 10 aa, Influenza virus
SYICSGLVGD

SEQ ID NO: 366709 - protein, 10 aa, Influenza virus
YICSGLVGDT

SEQ ID NO: 366710 - protein, 10 aa, Influenza virus
ICSGLVGDTP

SEQ ID NO: 366711 - protein, 10 aa, Influenza virus
GLVGDTPRNG

SEQ ID NO: 366712 - protein, 10 aa, Influenza virus
LVGDTPRNGD

SEQ ID NO: 366713 - protein, 10 aa, Influenza virus
VGDTPRNDDR

SEQ ID NO: 366714 - protein, 10 aa, Influenza virus
GDTPRNDDRS

SEQ ID NO: 366715 - protein, 10 aa, Influenza virus
DTPRNDDRSS

SEQ ID NO: 366716 - protein, 10 aa, Influenza virus
SNSNCRNPNN

SEQ ID NO: 366717 - protein, 10 aa, Influenza virus
NSNCRNPNNE

SEQ ID NO: 366718 - protein, 10 aa, Influenza virus
SNCRNPNNER

SEQ ID NO: 366719 - protein, 10 aa, Influenza virus
NCRNPNNERG

SEQ ID NO: 366720 - protein, 10 aa, Influenza virus
PNNERGNQGV

SEQ ID NO: 366721 - protein, 10 aa, Influenza virus
NNERGNQGVK

SEQ ID NO: 366722 - protein, 10 aa, Influenza virus
NERGNQGVKG

SEQ ID NO: 366723 - protein, 10 aa, Influenza virus
ERGNQGVKGW

SEQ ID NO: 366724 - protein, 10 aa, Influenza virus
RGNQGVKGWA

SEQ ID NO: 366725 - protein, 10 aa, Influenza virus
GNQGVKGWAF

SEQ ID NO: 366726 - protein, 10 aa, Influenza virus
NQGVKGWAFD

SEQ ID NO: 366727 - protein, 10 aa, Influenza virus
QGVKGWAFDN

SEQ ID NO: 366728 - protein, 10 aa, Influenza virus
GVKGWAFDSG

SEQ ID NO: 366729 - protein, 10 aa, Influenza virus
GNDVWMGRTI

SEQ ID NO: 366730 - protein, 10 aa, Influenza virus
KDSRSGYETF

SEQ ID NO: 366731 - protein, 10 aa, Influenza virus
DSRSGYETFK

SEQ ID NO: 366732 - protein, 10 aa, Influenza virus
SRSGYETFKV

SEQ ID NO: 366733 - protein, 10 aa, Influenza virus
RSGYETFRVI

SEQ ID NO: 366734 - protein, 10 aa, Influenza virus
SGYETFRVIG

SEQ ID NO: 366735 - protein, 10 aa, Influenza virus
GYETFRVIGG

SEQ ID NO: 366736 - protein, 10 aa, Influenza virus
YETFRVIGGW

SEQ ID NO: 366737 - protein, 10 aa, Influenza virus
ETFKVIGGWT

SEQ ID NO: 366738 - protein, 10 aa, Influenza virus
TFKVIGGWTT

SEQ ID NO: 366739 - protein, 10 aa, Influenza virus
SDNRSGYSGI

SEQ ID NO: 366740 - protein, 10 aa, Influenza virus
DNRSGYSGIF

SEQ ID NO: 366741 - protein, 10 aa, Influenza virus
NRSGYSGIFS

SEQ ID NO: 366742 - protein, 10 aa, Influenza virus
RSGYSGIFSV

SEQ ID NO: 366743 - protein, 10 aa, Influenza virus
GYSGIFSVEH

SEQ ID NO: 366744 - protein, 10 aa, Influenza virus
YSGIFSVENK

SEQ ID NO: 366745 - protein, 10 aa, Influenza virus
KGCINRCFYV

SEQ ID NO: 366746 - protein, 10 aa, Influenza virus
GCINRCFYVE

SEQ ID NO: 366747 - protein, 10 aa, Influenza virus
CVNRCFYVEL

SEQ ID NO: 366748 - protein, 10 aa, Influenza virus
VNRCFYVELI

SEQ ID NO: 366749 - protein, 10 aa, Influenza virus
FYVELIRGRK

SEQ ID NO: 366750 - protein, 10 aa, Influenza virus
YVELIRGRKQ

SEQ ID NO: 366751 - protein, 10 aa, Influenza virus
VELIRGRKQE

SEQ ID NO: 366752 - protein, 10 aa, Influenza virus
KQETRVWWTS

SEQ ID NO: 366753 - protein, 10 aa, Influenza virus
QEARVWWTSN

SEQ ID NO: 366754 - protein, 10 aa, Influenza virus
EARVWWTSNS

SEQ ID NO: 366755 - protein, 10 aa, Influenza virus
ARVWWTSNSI

SEQ ID NO: 366756 - protein, 10 aa, Influenza virus
RVWWTSNSIA

SEQ ID NO: 366757 - protein, 10 aa, Influenza virus
VWWTSNSIAV

SEQ ID NO: 366758 - protein, 10 aa, Influenza virus
WWTSNSIAVF

SEQ ID NO: 366759 - protein, 10 aa, Influenza virus
WTSNSIAVFC

SEQ ID NO: 366760 - protein, 10 aa, Influenza virus
TSNSIAVFCG

SEQ ID NO: 366761 - protein, 10 aa, Influenza virus
SNSIAVFCGT

SEQ ID NO: 366762 - protein, 10 aa, Influenza virus
NSIAVFCGTS

SEQ ID NO: 366763 - protein, 10 aa, Influenza virus
SIAVFCGTSG

SEQ ID NO: 366764 - protein, 10 aa, Influenza virus
IAVFCGTSGT

SEQ ID NO: 366765 - protein, 10 aa, Influenza virus
AVFCGTSGTY

SEQ ID NO: 366766 - protein, 10 aa, Influenza virus
GTGSWPDGAD

SEQ ID NO: 366767 - protein, 10 aa, Influenza virus
TGSWPDGADI

SEQ ID NO: 366768 - protein, 10 aa, Influenza virus
GSWPDGADIN

SEQ ID NO: 366769 - protein, 10 aa, Influenza virus
SWPDGANINL

SEQ ID NO: 366770 - protein, 10 aa, Influenza virus
WPDGANINLM

SEQ ID NO: 366771 - protein, 10 aa, Influenza virus
PDGANINLMP

SEQ ID NO: 366772 - protein, 10 aa, Influenza virus
DGANINLMPI

SEQ ID NO: 366773 - protein, 10 aa, Influenza virus
HSMSGFRSNL

SEQ ID NO: 366774 - protein, 10 aa, Influenza virus
IMRTVIALSY

SEQ ID NO: 366775 - protein, 10 aa, Influenza virus
IFNFILLTHW

SEQ ID NO: 366776 - protein, 10 aa, Influenza virus
FNFILLTHWA

SEQ ID NO: 366777 - protein, 10 aa, Influenza virus
VLSCIFCLAF

SEQ ID NO: 366778 - protein, 10 aa, Influenza virus
MATLCLGHHA

SEQ ID NO: 366779 - protein, 10 aa, Influenza virus
TLCLGHHAVA

SEQ ID NO: 366780 - protein, 10 aa, Influenza virus
LCLGHHAVAN

SEQ ID NO: 366781 - protein, 10 aa, Influenza virus
CLGHHAVANG

SEQ ID NO: 366782 - protein, 10 aa, Influenza virus
LGHHAVANGT

SEQ ID NO: 366783 - protein, 10 aa, Influenza virus
DHIEVTNATE

SEQ ID NO: 366784 - protein, 10 aa, Influenza virus
HIEVTNATEL

SEQ ID NO: 366785 - protein, 10 aa, Influenza virus
VEVTNATELV

SEQ ID NO: 366786 - protein, 10 aa, Influenza virus
VTNATELVQN

SEQ ID NO: 366787 - protein, 10 aa, Influenza virus
CTLMDALLGD

SEQ ID NO: 366788 - protein, 10 aa, Influenza virus
TLMDALLGDP

SEQ ID NO: 366789 - protein, 10 aa, Influenza virus
DALLGDPHCD

SEQ ID NO: 366790 - protein, 10 aa, Influenza virus
SLRSLIASSG

SEQ ID NO: 366791 - protein, 10 aa, Influenza virus
LRSLIASSGT

SEQ ID NO: 366792 - protein, 10 aa, Influenza virus
RSLIASSGTL

SEQ ID NO: 366793 - protein, 10 aa, Influenza virus
SLIASSGTLE

SEQ ID NO: 366794 - protein, 10 aa, Influenza virus
FDKLYVWGVH

SEQ ID NO: 366795 - protein, 10 aa, Influenza virus
DKLYVWGVHH

SEQ ID NO: 366796 - protein, 10 aa, Influenza virus
KLYVWGVHHP

SEQ ID NO: 366797 - protein, 10 aa, Influenza virus
SNGNLIAPRG

SEQ ID NO: 366798 - protein, 10 aa, Influenza virus
NGNLIAPRGY

SEQ ID NO: 366799 - protein, 10 aa, Influenza virus
GNLVAPRGYF

SEQ ID NO: 366800 - protein, 10 aa, Influenza virus
NLVAPRGYFK

SEQ ID NO: 366801 - protein, 10 aa, Influenza virus
SACITPNGSI

SEQ ID NO: 366802 - protein, 10 aa, Influenza virus
ECITPNGSIS

SEQ ID NO: 366803 - protein, 10 aa, Influenza virus
CITPNGSISN

SEQ ID NO: 366804 - protein, 10 aa, Influenza virus
ITPNGSISND

SEQ ID NO: 366805 - protein, 10 aa, Influenza virus
GSISNDKPFQ

SEQ ID NO: 366806 - protein, 10 aa, Influenza virus
KPFQNVNKIT

SEQ ID NO: 366807 - protein, 10 aa, Influenza virus
PFQNVNKITY

SEQ ID NO: 366808 - protein, 10 aa, Influenza virus
FQNVNKITYG

SEQ ID NO: 366809 - protein, 10 aa, Influenza virus
LKLATGMRNI

SEQ ID NO: 366810 - protein, 10 aa, Influenza virus
KLATGMRNIP

SEQ ID NO: 366811 - protein, 10 aa, Influenza virus
LATGMRNIPE

SEQ ID NO: 366812 - protein, 10 aa, Influenza virus
ATGMRNVPER

SEQ ID NO: 366813 - protein, 10 aa, Influenza virus
RGLFGAIAGF

SEQ ID NO: 366814 - protein, 10 aa, Influenza virus
GLFGAIAGFI

SEQ ID NO: 366815 - protein, 10 aa, Influenza virus
LFGAIAGFIE

SEQ ID NO: 366816 - protein, 10 aa, Influenza virus
FIENGWEGMI

SEQ ID NO: 366817 - protein, 10 aa, Influenza virus
IENGWEGMID

SEQ ID NO: 366818 - protein, 10 aa, Influenza virus
ENGWEGMIDG

SEQ ID NO: 366819 - protein, 10 aa, Influenza virus
NGWEGMIDGW

SEQ ID NO: 366820 - protein, 10 aa, Influenza virus
GWEGMIDGWY

SEQ ID NO: 366821 - protein, 10 aa, Influenza virus
WEGMIDGWYG

SEQ ID NO: 366822 - protein, 10 aa, Influenza virus
EGMIDGWYGF

SEQ ID NO: 366823 - protein, 10 aa, Influenza virus
GMIDGWYGFR

SEQ ID NO: 366824 - protein, 10 aa, Influenza virus
MIDGWYGFRH

SEQ ID NO: 366825 - protein, 10 aa, Influenza virus
DGWYGFRYQN

SEQ ID NO: 366826 - protein, 10 aa, Influenza virus
GWYGFRYQNS

SEQ ID NO: 366827 - protein, 10 aa, Influenza virus
WYGFRYQNSE

SEQ ID NO: 366828 - protein, 10 aa, Influenza virus
YGFRYQNSEG

SEQ ID NO: 366829 - protein, 10 aa, Influenza virus
NSEGIGQAAD

SEQ ID NO: 366830 - protein, 10 aa, Influenza virus
SEGIGQAADL

SEQ ID NO: 366831 - protein, 10 aa, Influenza virus
EGIGQAADLK

SEQ ID NO: 366832 - protein, 10 aa, Influenza virus
GIGQAADLKS

SEQ ID NO: 366833 - protein, 10 aa, Influenza virus
IGQAADLKST

SEQ ID NO: 366834 - protein, 10 aa, Influenza virus
QAADLKSTQT

SEQ ID NO: 366835 - protein, 10 aa, Influenza virus
AADLKSTQTA

SEQ ID NO: 366836 - protein, 10 aa, Influenza virus
ADLKSTQTAI

SEQ ID NO: 366837 - protein, 10 aa, Influenza virus
DLKSTQAAIN

SEQ ID NO: 366838 - protein, 10 aa, Influenza virus
LKSTQAAINQ

SEQ ID NO: 366839 - protein, 10 aa, Influenza virus
KSTQAAINQI

SEQ ID NO: 366840 - protein, 10 aa, Influenza virus
IEKTNEKFHQ

SEQ ID NO: 366841 - protein, 10 aa, Influenza virus
EKTNEKFHQI

SEQ ID NO: 366842 - protein, 10 aa, Influenza virus
RTNEKFHQIE

SEQ ID NO: 366843 - protein, 10 aa, Influenza virus
HQIEKEFSEI

SEQ ID NO: 366844 - protein, 10 aa, Influenza virus
QIEKEFSEIE

SEQ ID NO: 366845 - protein, 10 aa, Influenza virus
IEKEFSEIEG

SEQ ID NO: 366846 - protein, 10 aa, Influenza virus
EKEFSEIEGR

SEQ ID NO: 366847 - protein, 10 aa, Influenza virus
KEFSEIEGRI

SEQ ID NO: 366848 - protein, 10 aa, Influenza virus
EFSEIEGRIQ

SEQ ID NO: 366849 - protein, 10 aa, Influenza virus
FSEIEGRIQD

SEQ ID NO: 366850 - protein, 10 aa, Influenza virus
SEIEGRIQDL

SEQ ID NO: 366851 - protein, 10 aa, Influenza virus
EIEGRIQDLE

SEQ ID NO: 366852 - protein, 10 aa, Influenza virus
IEGRIQDLEK

SEQ ID NO: 366853 - protein, 10 aa, Influenza virus
EGRIQDLERY

SEQ ID NO: 366854 - protein, 10 aa, Influenza virus
GRIQDLERYV

SEQ ID NO: 366855 - protein, 10 aa, Influenza virus
RIQDLERYVE

SEQ ID NO: 366856 - protein, 10 aa, Influenza virus
IQDLERYVED

SEQ ID NO: 366857 - protein, 10 aa, Influenza virus
QDLERYVEDT

SEQ ID NO: 366858 - protein, 10 aa, Influenza virus
DLERYVEDTK

SEQ ID NO: 366859 - protein, 10 aa, Influenza virus
LEKYVEDTKV

SEQ ID NO: 366860 - protein, 10 aa, Influenza virus
EKYVEDTKVD

SEQ ID NO: 366861 - protein, 10 aa, Influenza virus
KYVEDTKVDL

SEQ ID NO: 366862 - protein, 10 aa, Influenza virus
YVEDTKVDLW

SEQ ID NO: 366863 - protein, 10 aa, Influenza virus
VEDTKVDLWS

SEQ ID NO: 366864 - protein, 10 aa, Influenza virus
EDTKVDLWSY

SEQ ID NO: 366865 - protein, 10 aa, Influenza virus
DTKVDLWSYN

SEQ ID NO: 366866 - protein, 10 aa, Influenza virus
TKVDLWSYNA

SEQ ID NO: 366867 - protein, 10 aa, Influenza virus
KVDLWSYNAE

SEQ ID NO: 366868 - protein, 10 aa, Influenza virus
VDLWSYNAEL

SEQ ID NO: 366869 - protein, 10 aa, Influenza virus
DLWSYNAGLL

SEQ ID NO: 366870 - protein, 10 aa, Influenza virus
LWSYNAGLLV

SEQ ID NO: 366871 - protein, 10 aa, Influenza virus
WSYNAGLLVA

SEQ ID NO: 366872 - protein, 10 aa, Influenza virus
SYNAGLLVAL

SEQ ID NO: 366873 - protein, 10 aa, Influenza virus
YNAGLLVALE

SEQ ID NO: 366874 - protein, 10 aa, Influenza virus
NAGLLVALEN

SEQ ID NO: 366875 - protein, 10 aa, Influenza virus
AGLLVALENQ

SEQ ID NO: 366876 - protein, 10 aa, Influenza virus
GLLVALENQH

SEQ ID NO: 366877 - protein, 10 aa, Influenza virus
VLVALENQHT

SEQ ID NO: 366878 - protein, 10 aa, Influenza virus
LVALENQNTI

SEQ ID NO: 366879 - protein, 10 aa, Influenza virus
VALENQHTIH

SEQ ID NO: 366880 - protein, 10 aa, Influenza virus
ALENQHTIHL

SEQ ID NO: 366881 - protein, 10 aa, Influenza virus
LENQHTIHLT

SEQ ID NO: 366882 - protein, 10 aa, Influenza virus
ENQHTIHLTD

SEQ ID NO: 366883 - protein, 10 aa, Influenza virus
NQHTIDLTDA

SEQ ID NO: 366884 - protein, 10 aa, Influenza virus
QHTIDLTDAE

SEQ ID NO: 366885 - protein, 10 aa, Influenza virus
HTIDLTDAEM

SEQ ID NO: 366886 - protein, 10 aa, Influenza virus
TIDLTDAEMN

SEQ ID NO: 366887 - protein, 10 aa, Influenza virus
LTDAEMNKLF

SEQ ID NO: 366888 - protein, 10 aa, Influenza virus
TDAEMNKLFE

SEQ ID NO: 366889 - protein, 10 aa, Influenza virus
TRRQLRENAE

SEQ ID NO: 366890 - protein, 10 aa, Influenza virus
RRQLRENAED

SEQ ID NO: 366891 - protein, 10 aa, Influenza virus
RQLRENAEDM

SEQ ID NO: 366892 - protein, 10 aa, Influenza virus
QLRENAEDIG

SEQ ID NO: 366893 - protein, 10 aa, Influenza virus
LRENAEDMGG

SEQ ID NO: 366894 - protein, 10 aa, Influenza virus
RENAEDMGGG

SEQ ID NO: 366895 - protein, 10 aa, Influenza virus
ENAEDMGGGC

SEQ ID NO: 366896 - protein, 10 aa, Influenza virus
NAEDMGGGCF

SEQ ID NO: 366897 - protein, 10 aa, Influenza virus
GCFTIYHKCD

SEQ ID NO: 366898 - protein, 10 aa, Influenza virus
CFTIYHKCDN

SEQ ID NO: 366899 - protein, 10 aa, Influenza virus
GYKDWVLWIS

SEQ ID NO: 366900 - protein, 10 aa, Influenza virus
YKDWVLWISF

SEQ ID NO: 366901 - protein, 10 aa, Influenza virus
KDWVLWISFA

SEQ ID NO: 366902 - protein, 10 aa, Influenza virus
DWVLWISFAI

SEQ ID NO: 366903 - protein, 10 aa, Influenza virus
WVLWISFAIS

SEQ ID NO: 366904 - protein, 10 aa, Influenza virus
VLWISFAISC

SEQ ID NO: 366905 - protein, 10 aa, Influenza virus
LWISFATSCF

SEQ ID NO: 366906 - protein, 10 aa, Influenza virus
WISFATSCFL

SEQ ID NO: 366907 - protein, 10 aa, Influenza virus
GFIMWACQRG

SEQ ID NO: 366908 - protein, 10 aa, Influenza virus
FIMWACQRGN

SEQ ID NO: 366909 - protein, 10 aa, Influenza virus
IMWACQRGNI

SEQ ID NO: 366910 - protein, 10 aa, Influenza virus
MWACQRGNIR

SEQ ID NO: 366911 - protein, 10 aa, Influenza virus
WACQRGNIRC

SEQ ID NO: 366912 - protein, 10 aa, Influenza virus
ACQRGNIRCN

SEQ ID NO: 366913 - protein, 10 aa, Influenza virus
CQRGNIRCNI

SEQ ID NO: 366914 - protein, 10 aa, Influenza virus
QRGNIRCNIC

SEQ ID NO: 366915 - protein, 10 aa, Influenza virus
RGNIRCNICI

SEQ ID NO: 366916 - protein, 10 aa, Influenza virus
SMSGFRSNLP

SEQ ID NO: 366917 - protein, 10 aa, Influenza virus
MATLCLGHHA

SEQ ID NO: 366918 - protein, 10 aa, Influenza virus
MLCLGHHAVP

SEQ ID NO: 366919 - protein, 10 aa, Influenza virus
GHHAVPNGTL

SEQ ID NO: 366920 - protein, 10 aa, Influenza virus
HHAVPNGTLV

SEQ ID NO: 366921 - protein, 10 aa, Influenza virus
HAVPNGTLVK

SEQ ID NO: 366922 - protein, 10 aa, Influenza virus
AVPNGTLVKT

SEQ ID NO: 366923 - protein, 10 aa, Influenza virus
VPNGTLVKTI

SEQ ID NO: 366924 - protein, 10 aa, Influenza virus
PNGTLVKTIT

SEQ ID NO: 366925 - protein, 10 aa, Influenza virus
DHIEVTNATE

SEQ ID NO: 366926 - protein, 10 aa, Influenza virus
HIEVTNATEL

SEQ ID NO: 366927 - protein, 10 aa, Influenza virus
VEVTNATELV

SEQ ID NO: 366928 - protein, 10 aa, Influenza virus
VTNATELVQN

SEQ ID NO: 366929 - protein, 10 aa, Influenza virus
CTLMDALLGD

SEQ ID NO: 366930 - protein, 10 aa, Influenza virus
TLMDALLGDP

SEQ ID NO: 366931 - protein, 10 aa, Influenza virus
LIDALLGDPH

SEQ ID NO: 366932 - protein, 10 aa, Influenza virus
IDALLGDPHC

SEQ ID NO: 366933 - protein, 10 aa, Influenza virus
DALLGDPHCD

SEQ ID NO: 366934 - protein, 10 aa, Influenza virus
SLRSLIASSG

SEQ ID NO: 366935 - protein, 10 aa, Influenza virus
LRSLIASSGT

SEQ ID NO: 366936 - protein, 10 aa, Influenza virus
RSLIASSGTL

SEQ ID NO: 366937 - protein, 10 aa, Influenza virus
SLIASSGTLE

SEQ ID NO: 366938 - protein, 10 aa, Influenza virus
LIASSGTLEF

SEQ ID NO: 366939 - protein, 10 aa, Influenza virus
FDKLYVWGVH

SEQ ID NO: 366940 - protein, 10 aa, Influenza virus
DKLYVWGVHH

SEQ ID NO: 366941 - protein, 10 aa, Influenza virus
KLYVWGVHHP

SEQ ID NO: 366942 - protein, 10 aa, Influenza virus
SVYWTVVKPG

SEQ ID NO: 366943 - protein, 10 aa, Influenza virus
VYWTVVKPGD

SEQ ID NO: 366944 - protein, 10 aa, Influenza virus
SNGNLIAPRG

SEQ ID NO: 366945 - protein, 10 aa, Influenza virus
NGNLIAPRGY

SEQ ID NO: 366946 - protein, 10 aa, Influenza virus
GNLIAPRGYY

SEQ ID NO: 366947 - protein, 10 aa, Influenza virus
NLIAPRGYFR

SEQ ID NO: 366948 - protein, 10 aa, Influenza virus
LIAPRGYFKM

SEQ ID NO: 366949 - protein, 10 aa, Influenza virus
SACITPNGSI

SEQ ID NO: 366950 - protein, 10 aa, Influenza virus
ACITPNGSIP

SEQ ID NO: 366951 - protein, 10 aa, Influenza virus
CITPNGSISN

SEQ ID NO: 366952 - protein, 10 aa, Influenza virus
ITPNGSIPNE

SEQ ID NO: 366953 - protein, 10 aa, Influenza virus
TPNGSIPNEK

SEQ ID NO: 366954 - protein, 10 aa, Influenza virus
PNGSIPNEKP

SEQ ID NO: 366955 - protein, 10 aa, Influenza virus
NGSIPNEKPF

SEQ ID NO: 366956 - protein, 10 aa, Influenza virus
GSIPNEKPFQ

SEQ ID NO: 366957 - protein, 10 aa, Influenza virus
SIPNEKPFQN

SEQ ID NO: 366958 - protein, 10 aa, Influenza virus
PNEKPFQNVN

SEQ ID NO: 366959 - protein, 10 aa, Influenza virus
NDKPFQNVNK

SEQ ID NO: 366960 - protein, 10 aa, Influenza virus
KPFQNVNKIT

SEQ ID NO: 366961 - protein, 10 aa, Influenza virus
PFQNVNKITY

SEQ ID NO: 366962 - protein, 10 aa, Influenza virus
FQNVNKITYG

SEQ ID NO: 366963 - protein, 10 aa, Influenza virus
QNVNKITYGA

SEQ ID NO: 366964 - protein, 10 aa, Influenza virus
NVNKITYGAC

SEQ ID NO: 366965 - protein, 10 aa, Influenza virus
VNKITYGACP

SEQ ID NO: 366966 - protein, 10 aa, Influenza virus
YVKQSTLKLA

SEQ ID NO: 366967 - protein, 10 aa, Influenza virus
VKQSTLKLAT

SEQ ID NO: 366968 - protein, 10 aa, Influenza virus
KQSTLKLATG

SEQ ID NO: 366969 - protein, 10 aa, Influenza virus
QSTLKLATGM

SEQ ID NO: 366970 - protein, 10 aa, Influenza virus
STLKLATGMR

SEQ ID NO: 366971 - protein, 10 aa, Influenza virus
LKLATGMRNI

SEQ ID NO: 366972 - protein, 10 aa, Influenza virus
KLATGMRNIP

SEQ ID NO: 366973 - protein, 10 aa, Influenza virus
LATGMRNIPE

SEQ ID NO: 366974 - protein, 10 aa, Influenza virus
ATGMRNIPEK

SEQ ID NO: 366975 - protein, 10 aa, Influenza virus
TGMRNVPETQ

SEQ ID NO: 366976 - protein, 10 aa, Influenza virus
GMRNVPETQT

SEQ ID NO: 366977 - protein, 10 aa, Influenza virus
MRNVPETQTR

SEQ ID NO: 366978 - protein, 10 aa, Influenza virus
RNVPETQTRG

SEQ ID NO: 366979 - protein, 10 aa, Influenza virus
PEKQTRGLFG

SEQ ID NO: 366980 - protein, 10 aa, Influenza virus
EKQTRGLFGA

SEQ ID NO: 366981 - protein, 10 aa, Influenza virus
KQTRGLFGAI

SEQ ID NO: 366982 - protein, 10 aa, Influenza virus
QTRGLFGAIA

SEQ ID NO: 366983 - protein, 10 aa, Influenza virus
TRGLFGAIAG

SEQ ID NO: 366984 - protein, 10 aa, Influenza virus
RGLFGAIAGF

SEQ ID NO: 366985 - protein, 10 aa, Influenza virus
GLFGAIAGFI

SEQ ID NO: 366986 - protein, 10 aa, Influenza virus
LFGAIAGFIE

SEQ ID NO: 366987 - protein, 10 aa, Influenza virus
FIENGWEGMM

SEQ ID NO: 366988 - protein, 10 aa, Influenza virus
IENGWEGMMD

SEQ ID NO: 366989 - protein, 10 aa, Influenza virus
ENGWEGMMDG

SEQ ID NO: 366990 - protein, 10 aa, Influenza virus
NGWEGMMDGW

SEQ ID NO: 366991 - protein, 10 aa, Influenza virus
GWEGMMDGWY

SEQ ID NO: 366992 - protein, 10 aa, Influenza virus
WEGMMDGWYG

SEQ ID NO: 366993 - protein, 10 aa, Influenza virus
EGMMDGWYGF

SEQ ID NO: 366994 - protein, 10 aa, Influenza virus
GMMDGWYGFR

SEQ ID NO: 366995 - protein, 10 aa, Influenza virus
MMDGWYGFRH

SEQ ID NO: 366996 - protein, 10 aa, Influenza virus
MDGWYGFRHQ

SEQ ID NO: 366997 - protein, 10 aa, Influenza virus
NGWYGFRHQN

SEQ ID NO: 366998 - protein, 10 aa, Influenza virus
GWYGFRHHNS

SEQ ID NO: 366999 - protein, 10 aa, Influenza virus
WYGFRHHNSE

SEQ ID NO: 367000 - protein, 10 aa, Influenza virus
YGFRHHNSEG

SEQ ID NO: 367001 - protein, 10 aa, Influenza virus
RHQNSEGIGQ

SEQ ID NO: 367002 - protein, 10 aa, Influenza virus
NSEGIGQAAD

SEQ ID NO: 367003 - protein, 10 aa, Influenza virus
SEGIGQAADL

SEQ ID NO: 367004 - protein, 10 aa, Influenza virus
EGIGQAADLK

SEQ ID NO: 367005 - protein, 10 aa, Influenza virus
GIGQAADLKS

SEQ ID NO: 367006 - protein, 10 aa, Influenza virus
IGQAADLKST

SEQ ID NO: 367007 - protein, 10 aa, Influenza virus
ADLKSTQAAV

SEQ ID NO: 367008 - protein, 10 aa, Influenza virus
DLKSTQAAID

SEQ ID NO: 367009 - protein, 10 aa, Influenza virus
LKSTQAAIDQ

SEQ ID NO: 367010 - protein, 10 aa, Influenza virus
KSTQAAIDQI

SEQ ID NO: 367011 - protein, 10 aa, Influenza virus
IEKTNEKFHQ

SEQ ID NO: 367012 - protein, 10 aa, Influenza virus
EKTNEKFHQI

SEQ ID NO: 367013 - protein, 10 aa, Influenza virus
HQIEKEFTEV

SEQ ID NO: 367014 - protein, 10 aa, Influenza virus
EKEFTEVEGR

SEQ ID NO: 367015 - protein, 10 aa, Influenza virus
KEFTEVEGRI

SEQ ID NO: 367016 - protein, 10 aa, Influenza virus
EFTEVEGRIQ

SEQ ID NO: 367017 - protein, 10 aa, Influenza virus
FTEVEGRIQD

SEQ ID NO: 367018 - protein, 10 aa, Influenza virus
TEVEGRIQDL

SEQ ID NO: 367019 - protein, 10 aa, Influenza virus
VEGRIQDLER

SEQ ID NO: 367020 - protein, 10 aa, Influenza virus
EGRIQDLERY

SEQ ID NO: 367021 - protein, 10 aa, Influenza virus
GRIQDLERYV

SEQ ID NO: 367022 - protein, 10 aa, Influenza virus
RIQDLERYVE

SEQ ID NO: 367023 - protein, 10 aa, Influenza virus
IQDLERYVED

SEQ ID NO: 367024 - protein, 10 aa, Influenza virus
QDLERYVEDT

SEQ ID NO: 367025 - protein, 10 aa, Influenza virus
DLERYVEDTK

SEQ ID NO: 367026 - protein, 10 aa, Influenza virus
LEKYVEDTKV

SEQ ID NO: 367027 - protein, 10 aa, Influenza virus
EKYVEDTKVD

SEQ ID NO: 367028 - protein, 10 aa, Influenza virus
KYVEDTKVDL

SEQ ID NO: 367029 - protein, 10 aa, Influenza virus
YVEDTKVDLW

SEQ ID NO: 367030 - protein, 10 aa, Influenza virus
VEDTKVDLWS

SEQ ID NO: 367031 - protein, 10 aa, Influenza virus
EDTKVDLWSY

SEQ ID NO: 367032 - protein, 10 aa, Influenza virus
DTKVDLWSYN

SEQ ID NO: 367033 - protein, 10 aa, Influenza virus
TKVDLWSYNA

SEQ ID NO: 367034 - protein, 10 aa, Influenza virus
KIDLWSYNAG

SEQ ID NO: 367035 - protein, 10 aa, Influenza virus
IDLWSYNAGL

SEQ ID NO: 367036 - protein, 10 aa, Influenza virus
DLWSYNAGLL

SEQ ID NO: 367037 - protein, 10 aa, Influenza virus
LWSYNAGLLV

SEQ ID NO: 367038 - protein, 10 aa, Influenza virus
WSYNAGLLVA

SEQ ID NO: 367039 - protein, 10 aa, Influenza virus
SYNAGLLVAL

SEQ ID NO: 367040 - protein, 10 aa, Influenza virus
YNAGLLVALE

SEQ ID NO: 367041 - protein, 10 aa, Influenza virus
NAGLLVALEN

SEQ ID NO: 367042 - protein, 10 aa, Influenza virus
AGLLVALENQ

SEQ ID NO: 367043 - protein, 10 aa, Influenza virus
LLVALENQNT

SEQ ID NO: 367044 - protein, 10 aa, Influenza virus
LVALENQNTI

SEQ ID NO: 367045 - protein, 10 aa, Influenza virus
VALENQHTIH

SEQ ID NO: 367046 - protein, 10 aa, Influenza virus
ALENQHTIHL

SEQ ID NO: 367047 - protein, 10 aa, Influenza virus
LENQHTIHLT

SEQ ID NO: 367048 - protein, 10 aa, Influenza virus
ENQHTIHLTD

SEQ ID NO: 367049 - protein, 10 aa, Influenza virus
NQHTIHLTDS

SEQ ID NO: 367050 - protein, 10 aa, Influenza virus
QHTIHLTDSE

SEQ ID NO: 367051 - protein, 10 aa, Influenza virus
HTIHLTDSEM

SEQ ID NO: 367052 - protein, 10 aa, Influenza virus
TIDLTDSEMS

SEQ ID NO: 367053 - protein, 10 aa, Influenza virus
IDLTDSEMSK

SEQ ID NO: 367054 - protein, 10 aa, Influenza virus
DLTDSEMSKL

SEQ ID NO: 367055 - protein, 10 aa, Influenza virus
LTDSEMSKLF

SEQ ID NO: 367056 - protein, 10 aa, Influenza virus
TDSEMSKLFE

SEQ ID NO: 367057 - protein, 10 aa, Influenza virus
DSEMNKLFEK

SEQ ID NO: 367058 - protein, 10 aa, Influenza virus
SEMNKLFEKT

SEQ ID NO: 367059 - protein, 10 aa, Influenza virus
TRKQLRENAE

SEQ ID NO: 367060 - protein, 10 aa, Influenza virus
RKQLRENAED

SEQ ID NO: 367061 - protein, 10 aa, Influenza virus
RQLRENAEDM

SEQ ID NO: 367062 - protein, 10 aa, Influenza virus
QLRENAEEMG

SEQ ID NO: 367063 - protein, 10 aa, Influenza virus
LRENAEEMGN

SEQ ID NO: 367064 - protein, 10 aa, Influenza virus
RENAEEMGNG

SEQ ID NO: 367065 - protein, 10 aa, Influenza virus
ENAEEMGNGC

SEQ ID NO: 367066 - protein, 10 aa, Influenza virus
NAEDMGNGCL

SEQ ID NO: 367067 - protein, 10 aa, Influenza virus
AEDMGNGCFT

SEQ ID NO: 367068 - protein, 10 aa, Influenza virus
EDMGNGCFTI

SEQ ID NO: 367069 - protein, 10 aa, Influenza virus
DMGNGCFTIY

SEQ ID NO: 367070 - protein, 10 aa, Influenza virus
MGNGCFTIYH

SEQ ID NO: 367071 - protein, 10 aa, Influenza virus
GNGCFTIYHK

SEQ ID NO: 367072 - protein, 10 aa, Influenza virus
NGCFTIYHKC

SEQ ID NO: 367073 - protein, 10 aa, Influenza virus
GCFTIYHKCD

SEQ ID NO: 367074 - protein, 10 aa, Influenza virus
CFTIYHKCDN

SEQ ID NO: 367075 - protein, 10 aa, Influenza virus
CIESIRNGTY

SEQ ID NO: 367076 - protein, 10 aa, Influenza virus
IESIRNGTYD

SEQ ID NO: 367077 - protein, 10 aa, Influenza virus
ESIRNGTYDH

SEQ ID NO: 367078 - protein, 10 aa, Influenza virus
SIRNGTYDHN

SEQ ID NO: 367079 - protein, 10 aa, Influenza virus
YRDEAVNNRF

SEQ ID NO: 367080 - protein, 10 aa, Influenza virus
RDEAVNNRFQ

SEQ ID NO: 367081 - protein, 10 aa, Influenza virus
EAVNNRFQIK

SEQ ID NO: 367082 - protein, 10 aa, Influenza virus
GYKDWVLWIS

SEQ ID NO: 367083 - protein, 10 aa, Influenza virus
YKDWVLWISF

SEQ ID NO: 367084 - protein, 10 aa, Influenza virus
KDWVLWISFA

SEQ ID NO: 367085 - protein, 10 aa, Influenza virus
DWVLWISFAI

SEQ ID NO: 367086 - protein, 10 aa, Influenza virus
WVLWISFAIS

SEQ ID NO: 367087 - protein, 10 aa, Influenza virus
VLWISFAISC

SEQ ID NO: 367088 - protein, 10 aa, Influenza virus
LWISFATSCF

SEQ ID NO: 367089 - protein, 10 aa, Influenza virus
WISFATSCFL

SEQ ID NO: 367090 - protein, 10 aa, Influenza virus
ISFATSCFLL

SEQ ID NO: 367091 - protein, 10 aa, Influenza virus
SFATSCFLLC

SEQ ID NO: 367092 - protein, 10 aa, Influenza virus
LGFIMWACQR

SEQ ID NO: 367093 - protein, 10 aa, Influenza virus
GFIMWACQRG

SEQ ID NO: 367094 - protein, 10 aa, Influenza virus
FIMWACQRGN

SEQ ID NO: 367095 - protein, 10 aa, Influenza virus
IMWACQRGNI

SEQ ID NO: 367096 - protein, 10 aa, Influenza virus
MWACQRGNIR

SEQ ID NO: 367097 - protein, 10 aa, Influenza virus
WACQRGNIRC

SEQ ID NO: 367098 - protein, 10 aa, Influenza virus
ACQRGNIRCN

SEQ ID NO: 367099 - protein, 10 aa, Influenza virus
CQRGNIRCNI

SEQ ID NO: 367100 - protein, 10 aa, Influenza virus
QRGNIRCNIC

SEQ ID NO: 367101 - protein, 10 aa, Influenza virus
RGNIRCNICI

SEQ ID NO: 367102 - protein, 10 aa, Influenza virus
IAGFAPFSKD

SEQ ID NO: 367103 - protein, 10 aa, Influenza virus
FSKDNSIRLA

SEQ ID NO: 367104 - protein, 10 aa, Influenza virus
SKDNSIRLAA

SEQ ID NO: 367105 - protein, 10 aa, Influenza virus
KDNSIRLAAG

SEQ ID NO: 367106 - protein, 10 aa, Influenza virus
DNSIRLAAGG

SEQ ID NO: 367107 - protein, 10 aa, Influenza virus
NSIRLSAGGA

SEQ ID NO: 367108 - protein, 10 aa, Influenza virus
SIRLSAGGAI

SEQ ID NO: 367109 - protein, 10 aa, Influenza virus
IRLSAGGAIW

SEQ ID NO: 367110 - protein, 10 aa, Influenza virus
RLSAGGAIWV

SEQ ID NO: 367111 - protein, 10 aa, Influenza virus
LSAGGAIWVT

SEQ ID NO: 367112 - protein, 10 aa, Influenza virus
SAGGAIWVTR

SEQ ID NO: 367113 - protein, 10 aa, Influenza virus
AGGAIWVTRE

SEQ ID NO: 367114 - protein, 10 aa, Influenza virus
GGDIWVTREL

SEQ ID NO: 367115 - protein, 10 aa, Influenza virus
GDIWVTRELY

SEQ ID NO: 367116 - protein, 10 aa, Influenza virus
DIWVTRELYV

SEQ ID NO: 367117 - protein, 10 aa, Influenza virus
IWVTRELYVS

SEQ ID NO: 367118 - protein, 10 aa, Influenza virus
WVTRELYVSC

SEQ ID NO: 367119 - protein, 10 aa, Influenza virus
VTREPYVSCS

SEQ ID NO: 367120 - protein, 10 aa, Influenza virus
GKCYQFALGQ

SEQ ID NO: 367121 - protein, 10 aa, Influenza virus
FALGQGTTLD

SEQ ID NO: 367122 - protein, 10 aa, Influenza virus
ALGQGTTLDN

SEQ ID NO: 367123 - protein, 10 aa, Influenza virus
RIPHRTLLMN

SEQ ID NO: 367124 - protein, 10 aa, Influenza virus
IPHRTLLMNE

SEQ ID NO: 367125 - protein, 10 aa, Influenza virus
PHRTLLMNEL

SEQ ID NO: 367126 - protein, 10 aa, Influenza virus
HRTLLMNELG

SEQ ID NO: 367127 - protein, 10 aa, Influenza virus
LLMSELGVPF

SEQ ID NO: 367128 - protein, 10 aa, Influenza virus
LMSELGVPFH

SEQ ID NO: 367129 - protein, 10 aa, Influenza virus
MSELGVPFHL

SEQ ID NO: 367130 - protein, 10 aa, Influenza virus
SELGVPFHLG

SEQ ID NO: 367131 - protein, 10 aa, Influenza virus
LGVPFHLGTR

SEQ ID NO: 367132 - protein, 10 aa, Influenza virus
GVPFHLGTRQ

SEQ ID NO: 367133 - protein, 10 aa, Influenza virus
VPFHLGTRQV

SEQ ID NO: 367134 - protein, 10 aa, Influenza virus
PFHLGTRQVC

SEQ ID NO: 367135 - protein, 10 aa, Influenza virus
FHLGTRQVCI

SEQ ID NO: 367136 - protein, 10 aa, Influenza virus
HLGTRQVCIA

SEQ ID NO: 367137 - protein, 10 aa, Influenza virus
LGTRQVCIAW

SEQ ID NO: 367138 - protein, 10 aa, Influenza virus
GTRQVCIAWS

SEQ ID NO: 367139 - protein, 10 aa, Influenza virus
TRQVCIAWSS

SEQ ID NO: 367140 - protein, 10 aa, Influenza virus
RQVCIAWSSS

SEQ ID NO: 367141 - protein, 10 aa, Influenza virus
QVCMAWSSSS

SEQ ID NO: 367142 - protein, 10 aa, Influenza virus
VCMAWSSSSC

SEQ ID NO: 367143 - protein, 10 aa, Influenza virus
CMAWSSSSCH

SEQ ID NO: 367144 - protein, 10 aa, Influenza virus
MAWSSSSCHD

SEQ ID NO: 367145 - protein, 10 aa, Influenza virus
CHDGRAWLHV

SEQ ID NO: 367146 - protein, 10 aa, Influenza virus
HDGRAWLHVC

SEQ ID NO: 367147 - protein, 10 aa, Influenza virus
DGKAWLHVCI

SEQ ID NO: 367148 - protein, 10 aa, Influenza virus
GKAWLHVCIT

SEQ ID NO: 367149 - protein, 10 aa, Influenza virus
KAWLHVCITG

SEQ ID NO: 367150 - protein, 10 aa, Influenza virus
NATASFIYDG

SEQ ID NO: 367151 - protein, 10 aa, Influenza virus
KILRTQESEC

SEQ ID NO: 367152 - protein, 10 aa, Influenza virus
TQESECICIN

SEQ ID NO: 367153 - protein, 10 aa, Influenza virus
QESECICING

SEQ ID NO: 367154 - protein, 10 aa, Influenza virus
ESECICINGT

SEQ ID NO: 367155 - protein, 10 aa, Influenza virus
SECICINGTC

SEQ ID NO: 367156 - protein, 10 aa, Influenza virus
ECVCINGTCA

SEQ ID NO: 367157 - protein, 10 aa, Influenza virus
CVCINGTCAV

SEQ ID NO: 367158 - protein, 10 aa, Influenza virus
VCINGTCAVV

SEQ ID NO: 367159 - protein, 10 aa, Influenza virus
CINGTCAVVM

SEQ ID NO: 367160 - protein, 10 aa, Influenza virus
INGTCAVVMT

SEQ ID NO: 367161 - protein, 10 aa, Influenza virus
NGTCAVVMTD

SEQ ID NO: 367162 - protein, 10 aa, Influenza virus
GTCAVVMTDG

SEQ ID NO: 367163 - protein, 10 aa, Influenza virus
TCAVVMTDGS

SEQ ID NO: 367164 - protein, 10 aa, Influenza virus
CAVVMTDGSA

SEQ ID NO: 367165 - protein, 10 aa, Influenza virus
AVVMTDGSAS

SEQ ID NO: 367166 - protein, 10 aa, Influenza virus
VVMTDGSASE

SEQ ID NO: 367167 - protein, 10 aa, Influenza virus
LSGSAQHIEE

SEQ ID NO: 367168 - protein, 10 aa, Influenza virus
SGSAQHIEEC

SEQ ID NO: 367169 - protein, 10 aa, Influenza virus
GSAQHIEECS

SEQ ID NO: 367170 - protein, 10 aa, Influenza virus
SAQHIEECSC

SEQ ID NO: 367171 - protein, 10 aa, Influenza virus
AQHIEECSCY

SEQ ID NO: 367172 - protein, 10 aa, Influenza virus
QHIEECSCYP

SEQ ID NO: 367173 - protein, 10 aa, Influenza virus
HIEECSCYPR

SEQ ID NO: 367174 - protein, 10 aa, Influenza virus
IEECSCYPRY

SEQ ID NO: 367175 - protein, 10 aa, Influenza virus
EECSCYPRFP

SEQ ID NO: 367176 - protein, 10 aa, Influenza virus
ECSCYPRYPN

SEQ ID NO: 367177 - protein, 10 aa, Influenza virus
VRCICRDNWK

SEQ ID NO: 367178 - protein, 10 aa, Influenza virus
RCICRDNWKG

SEQ ID NO: 367179 - protein, 10 aa, Influenza virus
CICRDNWKGS

SEQ ID NO: 367180 - protein, 10 aa, Influenza virus
ICRDNWKGSN

SEQ ID NO: 367181 - protein, 10 aa, Influenza virus
CRDNWRGSNR

SEQ ID NO: 367182 - protein, 10 aa, Influenza virus
RDNWRGSNRP

SEQ ID NO: 367183 - protein, 10 aa, Influenza virus
DNWKGSNRPV

SEQ ID NO: 367184 - protein, 10 aa, Influenza virus
NWKGSNRPVV

SEQ ID NO: 367185 - protein, 10 aa, Influenza virus
WKGSNRPVVD

SEQ ID NO: 367186 - protein, 10 aa, Influenza virus
KGSNRPVVDI

SEQ ID NO: 367187 - protein, 10 aa, Influenza virus
GSNRPVVDIN

SEQ ID NO: 367188 - protein, 10 aa, Influenza virus
SRYVCSGLVG

SEQ ID NO: 367189 - protein, 10 aa, Influenza virus
RYVCSGLVGD

SEQ ID NO: 367190 - protein, 10 aa, Influenza virus
YMCSGLVGDT

SEQ ID NO: 367191 - protein, 10 aa, Influenza virus
MCSGLVGDTP

SEQ ID NO: 367192 - protein, 10 aa, Influenza virus
SGLVGDTPRN

SEQ ID NO: 367193 - protein, 10 aa, Influenza virus
PGVKGWAFDN

SEQ ID NO: 367194 - protein, 10 aa, Influenza virus
GVKGWAFDNG

SEQ ID NO: 367195 - protein, 10 aa, Influenza virus
GDDVWMGRTI

SEQ ID NO: 367196 - protein, 10 aa, Influenza virus
RLGYETFKVI

SEQ ID NO: 367197 - protein, 10 aa, Influenza virus
WSGYSGIFSV

SEQ ID NO: 367198 - protein, 10 aa, Influenza virus
SGYSGVFSVE

SEQ ID NO: 367199 - protein, 10 aa, Influenza virus
GYSGIFSVES

SEQ ID NO: 367200 - protein, 10 aa, Influenza virus
YSGIFSVESK

SEQ ID NO: 367201 - protein, 10 aa, Influenza virus
KSCVNRCFYV

SEQ ID NO: 367202 - protein, 10 aa, Influenza virus
SCVNRCFYVE

SEQ ID NO: 367203 - protein, 10 aa, Influenza virus
CVNRCFYVEL

SEQ ID NO: 367204 - protein, 10 aa, Influenza virus
VNRCFYVELI

SEQ ID NO: 367205 - protein, 10 aa, Influenza virus
CFYVELIRGS

SEQ ID NO: 367206 - protein, 10 aa, Influenza virus
EVWWTSNSIV

SEQ ID NO: 367207 - protein, 10 aa, Influenza virus
VWWTSNSIVV

SEQ ID NO: 367208 - protein, 10 aa, Influenza virus
WWTSNSIVVF

SEQ ID NO: 367209 - protein, 10 aa, Influenza virus
NSIVAFCGTS

SEQ ID NO: 367210 - protein, 10 aa, Influenza virus
FCGTSGTYGS

SEQ ID NO: 367211 - protein, 10 aa, Influenza virus
CGTSGTYGSG

SEQ ID NO: 367212 - protein, 10 aa, Influenza virus
GTSGTYGSGS

SEQ ID NO: 367213 - protein, 10 aa, Influenza virus
TSGTYGSGSW

SEQ ID NO: 367214 - protein, 10 aa, Influenza virus
SGTYGSGSWP

SEQ ID NO: 367215 - protein, 10 aa, Influenza virus
GTYGSGSWPD

SEQ ID NO: 367216 - protein, 10 aa, Influenza virus
TYGSGSWPDG

SEQ ID NO: 367217 - protein, 10 aa, Influenza virus
YGSGSWPDGA

SEQ ID NO: 367218 - protein, 10 aa, Influenza virus
GTGSWPDGAN

SEQ ID NO: 367219 - protein, 10 aa, Influenza virus
GADINLMPIY

SEQ ID NO: 367220 - protein, 10 aa, Influenza virus
ADIKSHAYIS

SEQ ID NO: 367221 - protein, 10 aa, Influenza virus
DIKSHAYISF

SEQ ID NO: 367222 - protein, 10 aa, Influenza virus
YTGNPVICMG

SEQ ID NO: 367223 - protein, 10 aa, Influenza virus
TGNPVICMGH

SEQ ID NO: 367224 - protein, 10 aa, Influenza virus
GNPVICMGHH

SEQ ID NO: 367225 - protein, 10 aa, Influenza virus
NPVICMGHHA

SEQ ID NO: 367226 - protein, 10 aa, Influenza virus
PVICMGHHAV

SEQ ID NO: 367227 - protein, 10 aa, Influenza virus
NGTMVKTLAD

SEQ ID NO: 367228 - protein, 10 aa, Influenza virus
VEVVTAQELV

SEQ ID NO: 367229 - protein, 10 aa, Influenza virus
EVVAAQELVE

SEQ ID NO: 367230 - protein, 10 aa, Influenza virus
VVAAQELVES

SEQ ID NO: 367231 - protein, 10 aa, Influenza virus
LCPSPLRLID

SEQ ID NO: 367232 - protein, 10 aa, Influenza virus
CDIINGALGS

SEQ ID NO: 367233 - protein, 10 aa, Influenza virus
DIINGALGSP

SEQ ID NO: 367234 - protein, 10 aa, Influenza virus
IINGALGSPG

SEQ ID NO: 367235 - protein, 10 aa, Influenza virus
INGALGSPGC

SEQ ID NO: 367236 - protein, 10 aa, Influenza virus
NSALGSPGCD

SEQ ID NO: 367237 - protein, 10 aa, Influenza virus
GALGSPGCDR

SEQ ID NO: 367238 - protein, 10 aa, Influenza virus
ALGSPGCDRL

SEQ ID NO: 367239 - protein, 10 aa, Influenza virus
DTCYPFDVPE

SEQ ID NO: 367240 - protein, 10 aa, Influenza virus
TCYPFDVPEY

SEQ ID NO: 367241 - protein, 10 aa, Influenza virus
CYPFDVPEYQ

SEQ ID NO: 367242 - protein, 10 aa, Influenza virus
YPFDVPEYQS

SEQ ID NO: 367243 - protein, 10 aa, Influenza virus
DVPEYQSLRS

SEQ ID NO: 367244 - protein, 10 aa, Influenza virus
VPEYQSLRSI

SEQ ID NO: 367245 - protein, 10 aa, Influenza virus
PEYQSLRSIL

SEQ ID NO: 367246 - protein, 10 aa, Influenza virus
EYQSLRSILA

SEQ ID NO: 367247 - protein, 10 aa, Influenza virus
YQSIRSILAN

SEQ ID NO: 367248 - protein, 10 aa, Influenza virus
LRSILANNGR

SEQ ID NO: 367249 - protein, 10 aa, Influenza virus
RSILANNGRF

SEQ ID NO: 367250 - protein, 10 aa, Influenza virus
SILANNGRFE

SEQ ID NO: 367251 - protein, 10 aa, Influenza virus
ILANNGRFEF

SEQ ID NO: 367252 - protein, 10 aa, Influenza virus
LANNGRFEFI

SEQ ID NO: 367253 - protein, 10 aa, Influenza virus
ANNGRFEFIA

SEQ ID NO: 367254 - protein, 10 aa, Influenza virus
NNGRFEFIAE

SEQ ID NO: 367255 - protein, 10 aa, Influenza virus
NGRFEFIAEE

SEQ ID NO: 367256 - protein, 10 aa, Influenza virus
GRFEFIAEEF

SEQ ID NO: 367257 - protein, 10 aa, Influenza virus
TVKQNGKSSA

SEQ ID NO: 367258 - protein, 10 aa, Influenza virus
VKQNGKSSAC

SEQ ID NO: 367259 - protein, 10 aa, Influenza virus
KQNGKSSACK

SEQ ID NO: 367260 - protein, 10 aa, Influenza virus
QNGKSSACKR

SEQ ID NO: 367261 - protein, 10 aa, Influenza virus
NGKSSACKRA

SEQ ID NO: 367262 - protein, 10 aa, Influenza virus
GKSSACKRAN

SEQ ID NO: 367263 - protein, 10 aa, Influenza virus
NDFFRRLNWL

SEQ ID NO: 367264 - protein, 10 aa, Influenza virus
YPLQNLTKIN

SEQ ID NO: 367265 - protein, 10 aa, Influenza virus
QNLTKINNGD

SEQ ID NO: 367266 - protein, 10 aa, Influenza virus
NLTKINNGDY

SEQ ID NO: 367267 - protein, 10 aa, Influenza virus
NNGDYTRLYI

SEQ ID NO: 367268 - protein, 10 aa, Influenza virus
NGDYTRLYIW

SEQ ID NO: 367269 - protein, 10 aa, Influenza virus
GDYTRLYIWG

SEQ ID NO: 367270 - protein, 10 aa, Influenza virus
DYTRLYIWGV

SEQ ID NO: 367271 - protein, 10 aa, Influenza virus
YTRLYIWGVH

SEQ ID NO: 367272 - protein, 10 aa, Influenza virus
TRLYIWGVHH

SEQ ID NO: 367273 - protein, 10 aa, Influenza virus
WGVHHPSTDK

SEQ ID NO: 367274 - protein, 10 aa, Influenza virus
GVHHPSTDKE

SEQ ID NO: 367275 - protein, 10 aa, Influenza virus
VHHPSTDKEQ

SEQ ID NO: 367276 - protein, 10 aa, Influenza virus
LYKNSPGRVT

SEQ ID NO: 367277 - protein, 10 aa, Influenza virus
NSPGRVTVST

SEQ ID NO: 367278 - protein, 10 aa, Influenza virus
NPGRVTVSTQ

SEQ ID NO: 367279 - protein, 10 aa, Influenza virus
RPLVRGQSGR

SEQ ID NO: 367280 - protein, 10 aa, Influenza virus
VRGQSGRVSF

SEQ ID NO: 367281 - protein, 10 aa, Influenza virus
RGQSGRVSFY

SEQ ID NO: 367282 - protein, 10 aa, Influenza virus
GQSGRVSFYW

SEQ ID NO: 367283 - protein, 10 aa, Influenza virus
QSGRVSFYWT

SEQ ID NO: 367284 - protein, 10 aa, Influenza virus
SGRVSFYWTI

SEQ ID NO: 367285 - protein, 10 aa, Influenza virus
GRVSFYWTIV

SEQ ID NO: 367286 - protein, 10 aa, Influenza virus
RVSFYWTIVE

SEQ ID NO: 367287 - protein, 10 aa, Influenza virus
VSFYWTIVEP

SEQ ID NO: 367288 - protein, 10 aa, Influenza virus
SFYWTIVDPG

SEQ ID NO: 367289 - protein, 10 aa, Influenza virus
FYWTIVDPGD

SEQ ID NO: 367290 - protein, 10 aa, Influenza virus
PGDIIVFNTI

SEQ ID NO: 367291 - protein, 10 aa, Influenza virus
GDIIVFNTIG

SEQ ID NO: 367292 - protein, 10 aa, Influenza virus
DIIVFNTIGN

SEQ ID NO: 367293 - protein, 10 aa, Influenza virus
IIVFNTIGNL

SEQ ID NO: 367294 - protein, 10 aa, Influenza virus
IVFNTIGNLV

SEQ ID NO: 367295 - protein, 10 aa, Influenza virus
VFNTIGNLVA

SEQ ID NO: 367296 - protein, 10 aa, Influenza virus
FNTIGNLVAP

SEQ ID NO: 367297 - protein, 10 aa, Influenza virus
NTIGNLVAPR

SEQ ID NO: 367298 - protein, 10 aa, Influenza virus
TIGNLVAPRG

SEQ ID NO: 367299 - protein, 10 aa, Influenza virus
IGNLVAPRGH

SEQ ID NO: 367300 - protein, 10 aa, Influenza virus
GNLVAPRGHY

SEQ ID NO: 367301 - protein, 10 aa, Influenza virus
NLVAPRGHYK

SEQ ID NO: 367302 - protein, 10 aa, Influenza virus
LVAPRGHYKL

SEQ ID NO: 367303 - protein, 10 aa, Influenza virus
IGSCASKCHT

SEQ ID NO: 367304 - protein, 10 aa, Influenza virus
GDCPKYIKQG

SEQ ID NO: 367305 - protein, 10 aa, Influenza virus
ECPKYVKQGS

SEQ ID NO: 367306 - protein, 10 aa, Influenza virus
CPKYIKQGSL

SEQ ID NO: 367307 - protein, 10 aa, Influenza virus
PKYIKQGSLK

SEQ ID NO: 367308 - protein, 10 aa, Influenza virus
KYIKQGSLKL

SEQ ID NO: 367309 - protein, 10 aa, Influenza virus
YIKQGSLKLA

SEQ ID NO: 367310 - protein, 10 aa, Influenza virus
IKQGSLKLAT

SEQ ID NO: 367311 - protein, 10 aa, Influenza virus
KQGSLRLATG

SEQ ID NO: 367312 - protein, 10 aa, Influenza virus
QGSLRLATGM

SEQ ID NO: 367313 - protein, 10 aa, Influenza virus
GSLRLATGMR

SEQ ID NO: 367314 - protein, 10 aa, Influenza virus
LRLATGMRNI

SEQ ID NO: 367315 - protein, 10 aa, Influenza virus
RLATGMRNIP

SEQ ID NO: 367316 - protein, 10 aa, Influenza virus
ATGMRNIPER

SEQ ID NO: 367317 - protein, 10 aa, Influenza virus
KGLFGAIAGF

SEQ ID NO: 367318 - protein, 10 aa, Influenza virus
GWYGFRHQNS

SEQ ID NO: 367319 - protein, 10 aa, Influenza virus
WYGFRHQNSE

SEQ ID NO: 367320 - protein, 10 aa, Influenza virus
YGFRHQNSEG

SEQ ID NO: 367321 - protein, 10 aa, Influenza virus
GFRHQNSEGT

SEQ ID NO: 367322 - protein, 10 aa, Influenza virus
FRHQNSEGTG

SEQ ID NO: 367323 - protein, 10 aa, Influenza virus
RHQNSEGTGT

SEQ ID NO: 367324 - protein, 10 aa, Influenza virus
HQNSEGTGTA

SEQ ID NO: 367325 - protein, 10 aa, Influenza virus
QNSEGTGTAA

SEQ ID NO: 367326 - protein, 10 aa, Influenza virus
NSEGTGTAAD

SEQ ID NO: 367327 - protein, 10 aa, Influenza virus
SEGTGTAADL

SEQ ID NO: 367328 - protein, 10 aa, Influenza virus
TAADLKSTQT

SEQ ID NO: 367329 - protein, 10 aa, Influenza virus
AADLKSTQTA

SEQ ID NO: 367330 - protein, 10 aa, Influenza virus
ADLKSTQTAI

SEQ ID NO: 367331 - protein, 10 aa, Influenza virus
DLKSTQTAID

SEQ ID NO: 367332 - protein, 10 aa, Influenza virus
LKSTQTAIDQ

SEQ ID NO: 367333 - protein, 10 aa, Influenza virus
KSTQTAIDQI

SEQ ID NO: 367334 - protein, 10 aa, Influenza virus
TQTAIDQING

SEQ ID NO: 367335 - protein, 10 aa, Influenza virus
QTAIDQINGK

SEQ ID NO: 367336 - protein, 10 aa, Influenza virus
TAIDQINGKL

SEQ ID NO: 367337 - protein, 10 aa, Influenza virus
AIDQITGKLN

SEQ ID NO: 367338 - protein, 10 aa, Influenza virus
IDQITGKLNR

SEQ ID NO: 367339 - protein, 10 aa, Influenza virus
DQITGKLNRL

SEQ ID NO: 367340 - protein, 10 aa, Influenza virus
QITGKLNRLI

SEQ ID NO: 367341 - protein, 10 aa, Influenza virus
ITGKLNRLIE

SEQ ID NO: 367342 - protein, 10 aa, Influenza virus
NGKLNRLIER

SEQ ID NO: 367343 - protein, 10 aa, Influenza virus
GKLNRLIERT

SEQ ID NO: 367344 - protein, 10 aa, Influenza virus
KLNRLIERTN

SEQ ID NO: 367345 - protein, 10 aa, Influenza virus
LNRLIEKTND

SEQ ID NO: 367346 - protein, 10 aa, Influenza virus
NRLIEKTNDK

SEQ ID NO: 367347 - protein, 10 aa, Influenza virus
RLIEKTNDKY

SEQ ID NO: 367348 - protein, 10 aa, Influenza virus
LIERTNEKYH

SEQ ID NO: 367349 - protein, 10 aa, Influenza virus
IERTNEKYHQ

SEQ ID NO: 367350 - protein, 10 aa, Influenza virus
EKTNDKYHQI

SEQ ID NO: 367351 - protein, 10 aa, Influenza virus
KTNDKYHQIE

SEQ ID NO: 367352 - protein, 10 aa, Influenza virus
TNDKYHQIEK

SEQ ID NO: 367353 - protein, 10 aa, Influenza virus
NDKYHQIEKE

SEQ ID NO: 367354 - protein, 10 aa, Influenza virus
DKYHQIEKEF

SEQ ID NO: 367355 - protein, 10 aa, Influenza virus
KYHQIEKEFG

SEQ ID NO: 367356 - protein, 10 aa, Influenza virus
YHQIEKEFGQ

SEQ ID NO: 367357 - protein, 10 aa, Influenza virus
HQIEKEFGQV

SEQ ID NO: 367358 - protein, 10 aa, Influenza virus
QIEKEFGQVE

SEQ ID NO: 367359 - protein, 10 aa, Influenza virus
IEKEFGQVEG

SEQ ID NO: 367360 - protein, 10 aa, Influenza virus
EKEFGQVEGR

SEQ ID NO: 367361 - protein, 10 aa, Influenza virus
KEFGQVEGRI

SEQ ID NO: 367362 - protein, 10 aa, Influenza virus
EFGQVEGRIQ

SEQ ID NO: 367363 - protein, 10 aa, Influenza virus
FGQVEGRIQD

SEQ ID NO: 367364 - protein, 10 aa, Influenza virus
GQVEGRIQDL

SEQ ID NO: 367365 - protein, 10 aa, Influenza virus
QVEGRIQYLE

SEQ ID NO: 367366 - protein, 10 aa, Influenza virus
QDLERYVEDT

SEQ ID NO: 367367 - protein, 10 aa, Influenza virus
DLERYVEDTK

SEQ ID NO: 367368 - protein, 10 aa, Influenza virus
LEKYVEDTKV

SEQ ID NO: 367369 - protein, 10 aa, Influenza virus
EKYVEDTKVD

SEQ ID NO: 367370 - protein, 10 aa, Influenza virus
KYVEDTKVDL

SEQ ID NO: 367371 - protein, 10 aa, Influenza virus
YVEDTKVDLW

SEQ ID NO: 367372 - protein, 10 aa, Influenza virus
VEDTKVDLWS

SEQ ID NO: 367373 - protein, 10 aa, Influenza virus
EDTKVDLWSY

SEQ ID NO: 367374 - protein, 10 aa, Influenza virus
DTKVDLWSYN

SEQ ID NO: 367375 - protein, 10 aa, Influenza virus
TKVDLWSYNA

SEQ ID NO: 367376 - protein, 10 aa, Influenza virus
KVDLWSYNAE

SEQ ID NO: 367377 - protein, 10 aa, Influenza virus
VDLWSYNAEL

SEQ ID NO: 367378 - protein, 10 aa, Influenza virus
ALENQHTIDM

SEQ ID NO: 367379 - protein, 10 aa, Influenza virus
LENQHTIDMT

SEQ ID NO: 367380 - protein, 10 aa, Influenza virus
ENQHTIDMTD

SEQ ID NO: 367381 - protein, 10 aa, Influenza virus
NQHTIDMTDS

SEQ ID NO: 367382 - protein, 10 aa, Influenza virus
QHTIDMTDSE

SEQ ID NO: 367383 - protein, 10 aa, Influenza virus
HTIDMTDSEM

SEQ ID NO: 367384 - protein, 10 aa, Influenza virus
TIDVTDSEMD

SEQ ID NO: 367385 - protein, 10 aa, Influenza virus
IDVTDSEMNR

SEQ ID NO: 367386 - protein, 10 aa, Influenza virus
MTDSEMNKLF

SEQ ID NO: 367387 - protein, 10 aa, Influenza virus
TDSEMDKLFE

SEQ ID NO: 367388 - protein, 10 aa, Influenza virus
DSEMNRLFER

SEQ ID NO: 367389 - protein, 10 aa, Influenza virus
SEMNRLFERV

SEQ ID NO: 367390 - protein, 10 aa, Influenza virus
EMNKLFERVK

SEQ ID NO: 367391 - protein, 10 aa, Influenza virus
KLFERVRHQL

SEQ ID NO: 367392 - protein, 10 aa, Influenza virus
LFERVRHQLR

SEQ ID NO: 367393 - protein, 10 aa, Influenza virus
FERVRHQLRE

SEQ ID NO: 367394 - protein, 10 aa, Influenza virus
ERVRHQLREN

SEQ ID NO: 367395 - protein, 10 aa, Influenza virus
RVRHQLRENA

SEQ ID NO: 367396 - protein, 10 aa, Influenza virus
VRHQLRENAE

SEQ ID NO: 367397 - protein, 10 aa, Influenza virus
RHQLRENAED

SEQ ID NO: 367398 - protein, 10 aa, Influenza virus
RQLRENAEDR

SEQ ID NO: 367399 - protein, 10 aa, Influenza virus
QLRENAEDRG

SEQ ID NO: 367400 - protein, 10 aa, Influenza virus
LRENAEDRGN

SEQ ID NO: 367401 - protein, 10 aa, Influenza virus
RENAEDRGNG

SEQ ID NO: 367402 - protein, 10 aa, Influenza virus
ENAEDRGNGC

SEQ ID NO: 367403 - protein, 10 aa, Influenza virus
NAEDRGNGCF

SEQ ID NO: 367404 - protein, 10 aa, Influenza virus
AEDRGNGCFE

SEQ ID NO: 367405 - protein, 10 aa, Influenza virus
EDRGNGCFEI

SEQ ID NO: 367406 - protein, 10 aa, Influenza virus
DRGNGCFEIF

SEQ ID NO: 367407 - protein, 10 aa, Influenza virus
RGNGCFEIFH

SEQ ID NO: 367408 - protein, 10 aa, Influenza virus
GNGCFEIFHK

SEQ ID NO: 367409 - protein, 10 aa, Influenza virus
NGCFEIFHKC

SEQ ID NO: 367410 - protein, 10 aa, Influenza virus
GCFEIFHKCD

SEQ ID NO: 367411 - protein, 10 aa, Influenza virus
CFEIFHKCDN

SEQ ID NO: 367412 - protein, 10 aa, Influenza virus
CDNSCIESIR

SEQ ID NO: 367413 - protein, 10 aa, Influenza virus
DNSCIESIRN

SEQ ID NO: 367414 - protein, 10 aa, Influenza virus
NSCIESIRNG

SEQ ID NO: 367415 - protein, 10 aa, Influenza virus
SCIESIRNGT

SEQ ID NO: 367416 - protein, 10 aa, Influenza virus
IESIRNGTYN

SEQ ID NO: 367417 - protein, 10 aa, Influenza virus
ESIRNGTYNH

SEQ ID NO: 367418 - protein, 10 aa, Influenza virus
SIRNGTYNHD

SEQ ID NO: 367419 - protein, 10 aa, Influenza virus
YRDEAISNRF

SEQ ID NO: 367420 - protein, 10 aa, Influenza virus
RDEAISNRFQ

SEQ ID NO: 367421 - protein, 10 aa, Influenza virus
DEAISNRFQI

SEQ ID NO: 367422 - protein, 10 aa, Influenza virus
EAISNRFQIQ

SEQ ID NO: 367423 - protein, 10 aa, Influenza virus
AISNRFQIQG

SEQ ID NO: 367424 - protein, 10 aa, Influenza virus
ISNRFQIQGV

SEQ ID NO: 367425 - protein, 10 aa, Influenza virus
NRFQIQGVRL

SEQ ID NO: 367426 - protein, 10 aa, Influenza virus
RFQIQGVRLT

SEQ ID NO: 367427 - protein, 10 aa, Influenza virus
FQIQGVRLTQ

SEQ ID NO: 367428 - protein, 10 aa, Influenza virus
QIQGVRLTQG

SEQ ID NO: 367429 - protein, 10 aa, Influenza virus
IQGVRLTQGY

SEQ ID NO: 367430 - protein, 10 aa, Influenza virus
QGVRLTQGYK

SEQ ID NO: 367431 - protein, 10 aa, Influenza virus
GVRLTQGYKD

SEQ ID NO: 367432 - protein, 10 aa, Influenza virus
RLTQGYKDII

SEQ ID NO: 367433 - protein, 10 aa, Influenza virus
LAQGYKDIIL

SEQ ID NO: 367434 - protein, 10 aa, Influenza virus
AQGYKDIILW

SEQ ID NO: 367435 - protein, 10 aa, Influenza virus
QGYKDIILWV

SEQ ID NO: 367436 - protein, 10 aa, Influenza virus
GYKDIILWVS

SEQ ID NO: 367437 - protein, 10 aa, Influenza virus
YKDIILWVSF

SEQ ID NO: 367438 - protein, 10 aa, Influenza virus
KDIILWVSFS

SEQ ID NO: 367439 - protein, 10 aa, Influenza virus
DIILWVSFSI

SEQ ID NO: 367440 - protein, 10 aa, Influenza virus
IILWVSFSIS

SEQ ID NO: 367441 - protein, 10 aa, Influenza virus
ILWVSFSISC

SEQ ID NO: 367442 - protein, 10 aa, Influenza virus
LWVSFSISCF

SEQ ID NO: 367443 - protein, 10 aa, Influenza virus
WVSFSISCFL

SEQ ID NO: 367444 - protein, 10 aa, Influenza virus
VSFSISCFLL

SEQ ID NO: 367445 - protein, 10 aa, Influenza virus
SFSISCFLLA

SEQ ID NO: 367446 - protein, 10 aa, Influenza virus
FSISCFLLAA

SEQ ID NO: 367447 - protein, 10 aa, Influenza virus
SISCFLLAAL

SEQ ID NO: 367448 - protein, 10 aa, Influenza virus
ISCFLLAALL

SEQ ID NO: 367449 - protein, 10 aa, Influenza virus
SCFLLAALLL

SEQ ID NO: 367450 - protein, 10 aa, Influenza virus
ALLIAFVLWA

SEQ ID NO: 367451 - protein, 10 aa, Influenza virus
LLIAFVLWAC

SEQ ID NO: 367452 - protein, 10 aa, Influenza virus
LIAFVLWACQ

SEQ ID NO: 367453 - protein, 10 aa, Influenza virus
IAFVLWACQN

SEQ ID NO: 367454 - protein, 10 aa, Influenza virus
AFVLWACQNG

SEQ ID NO: 367455 - protein, 10 aa, Influenza virus
FVLWACQNGN

SEQ ID NO: 367456 - protein, 10 aa, Influenza virus
LWACQNGNLR

SEQ ID NO: 367457 - protein, 10 aa, Influenza virus
WACQNGNLRC

SEQ ID NO: 367458 - protein, 10 aa, Influenza virus
ACQNGNLRCQ

SEQ ID NO: 367459 - protein, 10 aa, Influenza virus
CQNGNLRCQI

SEQ ID NO: 367460 - protein, 10 aa, Influenza virus
QNGNLRCQIC

SEQ ID NO: 367461 - protein, 10 aa, Influenza virus
NGNLRCQICI

SEQ ID NO: 367462 - protein, 10 aa, Influenza virus
SVKMEKIVLL

SEQ ID NO: 367463 - protein, 10 aa, Influenza virus
CQMEKIVLLF

SEQ ID NO: 367464 - protein, 10 aa, Influenza virus
QMEKIVLLFA

SEQ ID NO: 367465 - protein, 10 aa, Influenza virus
GDQICIGYHA

SEQ ID NO: 367466 - protein, 10 aa, Influenza virus
DHICIGYHAN

SEQ ID NO: 367467 - protein, 10 aa, Influenza virus
HICIGYHANN

SEQ ID NO: 367468 - protein, 10 aa, Influenza virus
ICVGYHANNS

SEQ ID NO: 367469 - protein, 10 aa, Influenza virus
CVGYHANNST

SEQ ID NO: 367470 - protein, 10 aa, Influenza virus
IGYHANNSTK

SEQ ID NO: 367471 - protein, 10 aa, Influenza virus
QIDTIMEKNV

SEQ ID NO: 367472 - protein, 10 aa, Influenza virus
VDTIMERNVT

SEQ ID NO: 367473 - protein, 10 aa, Influenza virus
DTIMERNVTV

SEQ ID NO: 367474 - protein, 10 aa, Influenza virus
TIMERNVTVT

SEQ ID NO: 367475 - protein, 10 aa, Influenza virus
IMERNVTVTH

SEQ ID NO: 367476 - protein, 10 aa, Influenza virus
MERNVTVTHA

SEQ ID NO: 367477 - protein, 10 aa, Influenza virus
ERNVTVTHAQ

SEQ ID NO: 367478 - protein, 10 aa, Influenza virus
KNVTVTHAQN

SEQ ID NO: 367479 - protein, 10 aa, Influenza virus
NVTVTHAQNI

SEQ ID NO: 367480 - protein, 10 aa, Influenza virus
VTVTHAQNIL

SEQ ID NO: 367481 - protein, 10 aa, Influenza virus
TVTHAQNILE

SEQ ID NO: 367482 - protein, 10 aa, Influenza virus
VTHAQDILER

SEQ ID NO: 367483 - protein, 10 aa, Influenza virus
LKDCSVAGWL

SEQ ID NO: 367484 - protein, 10 aa, Influenza virus
DCSIAGWLLG

SEQ ID NO: 367485 - protein, 10 aa, Influenza virus
CSIAGWLLGN

SEQ ID NO: 367486 - protein, 10 aa, Influenza virus
SIAGWLLGNP

SEQ ID NO: 367487 - protein, 10 aa, Influenza virus
VAGWLLGNPL

SEQ ID NO: 367488 - protein, 10 aa, Influenza virus
AGWLLGNPLC

SEQ ID NO: 367489 - protein, 10 aa, Influenza virus
GWLLGNPLCD

SEQ ID NO: 367490 - protein, 10 aa, Influenza virus
WLLGNPLCDE

SEQ ID NO: 367491 - protein, 10 aa, Influenza virus
LLGNPLCDEF

SEQ ID NO: 367492 - protein, 10 aa, Influenza virus
VSEWSYIVEK

SEQ ID NO: 367493 - protein, 10 aa, Influenza virus
TGRSSFFRNV

SEQ ID NO: 367494 - protein, 10 aa, Influenza virus
YVSVGTSTLN

SEQ ID NO: 367495 - protein, 10 aa, Influenza virus
SIGTSTLNQR

SEQ ID NO: 367496 - protein, 10 aa, Influenza virus
FESTGNFIAP

SEQ ID NO: 367497 - protein, 10 aa, Influenza virus
ESTGNFIAPE

SEQ ID NO: 367498 - protein, 10 aa, Influenza virus
SNGNFIAPEN

SEQ ID NO: 367499 - protein, 10 aa, Influenza virus
NGNFIAPENA

SEQ ID NO: 367500 - protein, 10 aa, Influenza virus
GNFIAPENAY

SEQ ID NO: 367501 - protein, 10 aa, Influenza virus
NFIAPENAYK

SEQ ID NO: 367502 - protein, 10 aa, Influenza virus
FIAPENAYKI

SEQ ID NO: 367503 - protein, 10 aa, Influenza virus
PFHNVHPLTI

SEQ ID NO: 367504 - protein, 10 aa, Influenza virus
FHNVHPLTIG

SEQ ID NO: 367505 - protein, 10 aa, Influenza virus
HPFTIGECPK

SEQ ID NO: 367506 - protein, 10 aa, Influenza virus
PFTIGECPKY

SEQ ID NO: 367507 - protein, 10 aa, Influenza virus
TIGECPRYVK

SEQ ID NO: 367508 - protein, 10 aa, Influenza virus
IGECPRYVKS

SEQ ID NO: 367509 - protein, 10 aa, Influenza virus
RRKRGLFGAI

SEQ ID NO: 367510 - protein, 10 aa, Influenza virus
TRRQKRGLFG

SEQ ID NO: 367511 - protein, 10 aa, Influenza virus
RRQKRGLFGA

SEQ ID NO: 367512 - protein, 10 aa, Influenza virus
RQKRGLFGAI

SEQ ID NO: 367513 - protein, 10 aa, Influenza virus
QKRGLFGAIA

SEQ ID NO: 367514 - protein, 10 aa, Influenza virus
TRGLFGAIAG

SEQ ID NO: 367515 - protein, 10 aa, Influenza virus
FIEGGWQGMI

SEQ ID NO: 367516 - protein, 10 aa, Influenza virus
IEGGWQGMID

SEQ ID NO: 367517 - protein, 10 aa, Influenza virus
EGGWQGMIDG

SEQ ID NO: 367518 - protein, 10 aa, Influenza virus
GGWQGMIDGW

SEQ ID NO: 367519 - protein, 10 aa, Influenza virus
GWQGMIDGWY

SEQ ID NO: 367520 - protein, 10 aa, Influenza virus
WQGMIDGWYG

SEQ ID NO: 367521 - protein, 10 aa, Influenza virus
QGMVDGWYGF

SEQ ID NO: 367522 - protein, 10 aa, Influenza virus
GMVDGWYGFH

SEQ ID NO: 367523 - protein, 10 aa, Influenza virus
MVDGWYGFHH

SEQ ID NO: 367524 - protein, 10 aa, Influenza virus
VDGWYGFHHS

SEQ ID NO: 367525 - protein, 10 aa, Influenza virus
DGWYGFHHSN

SEQ ID NO: 367526 - protein, 10 aa, Influenza virus
NGQGSGYAAD

SEQ ID NO: 367527 - protein, 10 aa, Influenza virus
GQGSGYAADK

SEQ ID NO: 367528 - protein, 10 aa, Influenza virus
QGSGYAADQE

SEQ ID NO: 367529 - protein, 10 aa, Influenza virus
GSGYAADQES

SEQ ID NO: 367530 - protein, 10 aa, Influenza virus
SGYAADQEST

SEQ ID NO: 367531 - protein, 10 aa, Influenza virus
GYAADQESTQ

SEQ ID NO: 367532 - protein, 10 aa, Influenza virus
YAADKESTQR

SEQ ID NO: 367533 - protein, 10 aa, Influenza virus
AADKESTQRA

SEQ ID NO: 367534 - protein, 10 aa, Influenza virus
GITNKVNSII

SEQ ID NO: 367535 - protein, 10 aa, Influenza virus
VNSIINKMNT

SEQ ID NO: 367536 - protein, 10 aa, Influenza virus
FLNVWTYNAE

SEQ ID NO: 367537 - protein, 10 aa, Influenza virus
LNVWTYNAEL

SEQ ID NO: 367538 - protein, 10 aa, Influenza virus
NVWTYNAELL

SEQ ID NO: 367539 - protein, 10 aa, Influenza virus
VWTYNAEILV

SEQ ID NO: 367540 - protein, 10 aa, Influenza virus
YNAEILVLME

SEQ ID NO: 367541 - protein, 10 aa, Influenza virus
NAEILVLMEN

SEQ ID NO: 367542 - protein, 10 aa, Influenza virus
AEILVLMENE

SEQ ID NO: 367543 - protein, 10 aa, Influenza virus
LMENERTLDL

SEQ ID NO: 367544 - protein, 10 aa, Influenza virus
MENERTLDLH

SEQ ID NO: 367545 - protein, 10 aa, Influenza virus
ENERTLDLHD

SEQ ID NO: 367546 - protein, 10 aa, Influenza virus
NERTLDLHDS

SEQ ID NO: 367547 - protein, 10 aa, Influenza virus
ERTLDLHDSN

SEQ ID NO: 367548 - protein, 10 aa, Influenza virus
RTLDLHDSNV

SEQ ID NO: 367549 - protein, 10 aa, Influenza virus
TLDLHDSNVK

SEQ ID NO: 367550 - protein, 10 aa, Influenza virus
LDLHDSNVKN

SEQ ID NO: 367551 - protein, 10 aa, Influenza virus
DLHDSNVKNL

SEQ ID NO: 367552 - protein, 10 aa, Influenza virus
LHDSNVKNLY

SEQ ID NO: 367553 - protein, 10 aa, Influenza virus
HDSNVKNLYE

SEQ ID NO: 367554 - protein, 10 aa, Influenza virus
DSNVKNLYEK

SEQ ID NO: 367555 - protein, 10 aa, Influenza virus
NVKNLYEKVR

SEQ ID NO: 367556 - protein, 10 aa, Influenza virus
NLYEKVRLQL

SEQ ID NO: 367557 - protein, 10 aa, Influenza virus
KVRLQLKDNA

SEQ ID NO: 367558 - protein, 10 aa, Influenza virus
VRLQLKDNAK

SEQ ID NO: 367559 - protein, 10 aa, Influenza virus
RLQLKDNAKE

SEQ ID NO: 367560 - protein, 10 aa, Influenza virus
LQLKDNAKEL

SEQ ID NO: 367561 - protein, 10 aa, Influenza virus
QLKDNAKELG

SEQ ID NO: 367562 - protein, 10 aa, Influenza virus
LKDNAKELGN

SEQ ID NO: 367563 - protein, 10 aa, Influenza virus
KDNAKELGNG

SEQ ID NO: 367564 - protein, 10 aa, Influenza virus
DNARELGNGC

SEQ ID NO: 367565 - protein, 10 aa, Influenza virus
NARELGNGCF

SEQ ID NO: 367566 - protein, 10 aa, Influenza virus
ARELGNGCFE

SEQ ID NO: 367567 - protein, 10 aa, Influenza virus
RELGNGCFEF

SEQ ID NO: 367568 - protein, 10 aa, Influenza virus
GNGCFEFYHR

SEQ ID NO: 367569 - protein, 10 aa, Influenza virus
NGCFEFYHRC

SEQ ID NO: 367570 - protein, 10 aa, Influenza virus
GCFEFYHRCD

SEQ ID NO: 367571 - protein, 10 aa, Influenza virus
CFEFYHRCDN

SEQ ID NO: 367572 - protein, 10 aa, Influenza virus
CMESIRNGTY

SEQ ID NO: 367573 - protein, 10 aa, Influenza virus
YQILSIYSTA

SEQ ID NO: 367574 - protein, 10 aa, Influenza virus
QILSIYSTAA

SEQ ID NO: 367575 - protein, 10 aa, Influenza virus
ILSIYSTAAS

SEQ ID NO: 367576 - protein, 10 aa, Influenza virus
LSIYSTAASS

SEQ ID NO: 367577 - protein, 10 aa, Influenza virus
SIYSTAASSL

SEQ ID NO: 367578 - protein, 10 aa, Influenza virus
GLSFWMCSNG

SEQ ID NO: 367579 - protein, 10 aa, Influenza virus
LSFWMCSNGS

SEQ ID NO: 367580 - protein, 10 aa, Influenza virus
FWMCSNGSLQ

SEQ ID NO: 367581 - protein, 10 aa, Influenza virus
WMCFNGSLQC

SEQ ID NO: 367582 - protein, 10 aa, Influenza virus
MCSNGSLQCK

SEQ ID NO: 367583 - protein, 10 aa, Influenza virus
CSNGSLQCRV

SEQ ID NO: 367584 - protein, 10 aa, Influenza virus
SNGSLQCRVC

SEQ ID NO: 367585 - protein, 10 aa, Influenza virus
NGSLQCRVCI

SEQ ID NO: 367586 - protein, 10 aa, Influenza virus
CIRFVNSDCS

SEQ ID NO: 367587 - protein, 10 aa, Influenza virus
SVKMEKIVLL

SEQ ID NO: 367588 - protein, 10 aa, Influenza virus
CQMEKIVLLF

SEQ ID NO: 367589 - protein, 10 aa, Influenza virus
QMEKIVLLFA

SEQ ID NO: 367590 - protein, 10 aa, Influenza virus
SDHICIGYHA

SEQ ID NO: 367591 - protein, 10 aa, Influenza virus
DHICIGYHAN

SEQ ID NO: 367592 - protein, 10 aa, Influenza virus
HICIGYHANN

SEQ ID NO: 367593 - protein, 10 aa, Influenza virus
ICVGYHANNS

SEQ ID NO: 367594 - protein, 10 aa, Influenza virus
CVGYHANNST

SEQ ID NO: 367595 - protein, 10 aa, Influenza virus
IGYHANNSTK

SEQ ID NO: 367596 - protein, 10 aa, Influenza virus
GYHANNSTKQ

SEQ ID NO: 367597 - protein, 10 aa, Influenza virus
HANNSTKQVD

SEQ ID NO: 367598 - protein, 10 aa, Influenza virus
ANNSTKQVDT

SEQ ID NO: 367599 - protein, 10 aa, Influenza virus
NNSTKQVDTI

SEQ ID NO: 367600 - protein, 10 aa, Influenza virus
NSTKQVDTIM

SEQ ID NO: 367601 - protein, 10 aa, Influenza virus
STKQVDTIME

SEQ ID NO: 367602 - protein, 10 aa, Influenza virus
TKQVDTIMEK

SEQ ID NO: 367603 - protein, 10 aa, Influenza virus
KQVDTIMEKN

SEQ ID NO: 367604 - protein, 10 aa, Influenza virus
QVDTIMERNV

SEQ ID NO: 367605 - protein, 10 aa, Influenza virus
VDTIMERNVT

SEQ ID NO: 367606 - protein, 10 aa, Influenza virus
DTIMERNVTV

SEQ ID NO: 367607 - protein, 10 aa, Influenza virus
TIMERNVTVT

SEQ ID NO: 367608 - protein, 10 aa, Influenza virus
IMERNVTVTH

SEQ ID NO: 367609 - protein, 10 aa, Influenza virus
MERNVTVTHA

SEQ ID NO: 367610 - protein, 10 aa, Influenza virus
ERNVTVTHAQ

SEQ ID NO: 367611 - protein, 10 aa, Influenza virus
RNVTVTHAQD

SEQ ID NO: 367612 - protein, 10 aa, Influenza virus
NVTVTHAQNI

SEQ ID NO: 367613 - protein, 10 aa, Influenza virus
VTVTHAQNIL

SEQ ID NO: 367614 - protein, 10 aa, Influenza virus
TVTHAQNILE

SEQ ID NO: 367615 - protein, 10 aa, Influenza virus
VTHAQDILER

SEQ ID NO: 367616 - protein, 10 aa, Influenza virus
GVKPLILKDC

SEQ ID NO: 367617 - protein, 10 aa, Influenza virus
VKPLILKDCS

SEQ ID NO: 367618 - protein, 10 aa, Influenza virus
KPLILKDCSV

SEQ ID NO: 367619 - protein, 10 aa, Influenza virus
PLILKDCSVA

SEQ ID NO: 367620 - protein, 10 aa, Influenza virus
LILKDCSVAG

SEQ ID NO: 367621 - protein, 10 aa, Influenza virus
ILKDCSVAGW

SEQ ID NO: 367622 - protein, 10 aa, Influenza virus
LKDCSVAGWL

SEQ ID NO: 367623 - protein, 10 aa, Influenza virus
KDCSVAGWLL

SEQ ID NO: 367624 - protein, 10 aa, Influenza virus
VAGWLLGNPL

SEQ ID NO: 367625 - protein, 10 aa, Influenza virus
AGWLLGNPLC

SEQ ID NO: 367626 - protein, 10 aa, Influenza virus
GWLLGNPLCD

SEQ ID NO: 367627 - protein, 10 aa, Influenza virus
WLLGNPLCDE

SEQ ID NO: 367628 - protein, 10 aa, Influenza virus
LLGNPLCDEF

SEQ ID NO: 367629 - protein, 10 aa, Influenza virus
NVSEWSYIVE

SEQ ID NO: 367630 - protein, 10 aa, Influenza virus
VSEWSYIVEK

SEQ ID NO: 367631 - protein, 10 aa, Influenza virus
FNNYEELKHL

SEQ ID NO: 367632 - protein, 10 aa, Influenza virus
NNYEELKHLL

SEQ ID NO: 367633 - protein, 10 aa, Influenza virus
NYEELKHLLS

SEQ ID NO: 367634 - protein, 10 aa, Influenza virus
YEELKHLMSS

SEQ ID NO: 367635 - protein, 10 aa, Influenza virus
EELKHLMSST

SEQ ID NO: 367636 - protein, 10 aa, Influenza virus
TYISIGTSTL

SEQ ID NO: 367637 - protein, 10 aa, Influenza virus
YISIGTSTLN

SEQ ID NO: 367638 - protein, 10 aa, Influenza virus
ISIGTSTLNQ

SEQ ID NO: 367639 - protein, 10 aa, Influenza virus
SIGTSTLNQR

SEQ ID NO: 367640 - protein, 10 aa, Influenza virus
IGTSTLNQRL

SEQ ID NO: 367641 - protein, 10 aa, Influenza virus
IHFESNGNFI

SEQ ID NO: 367642 - protein, 10 aa, Influenza virus
HFESNGNFIA

SEQ ID NO: 367643 - protein, 10 aa, Influenza virus
FDSNGNFIAP

SEQ ID NO: 367644 - protein, 10 aa, Influenza virus
DSNGNFIAPE

SEQ ID NO: 367645 - protein, 10 aa, Influenza virus
SNGNFIAPEN

SEQ ID NO: 367646 - protein, 10 aa, Influenza virus
NGNFIAPENA

SEQ ID NO: 367647 - protein, 10 aa, Influenza virus
GNFIAPENAY

SEQ ID NO: 367648 - protein, 10 aa, Influenza virus
NFIAPENAYK

SEQ ID NO: 367649 - protein, 10 aa, Influenza virus
FIAPENAYKI

SEQ ID NO: 367650 - protein, 10 aa, Influenza virus
AYKIVKEGDS

SEQ ID NO: 367651 - protein, 10 aa, Influenza virus
CQTPMGAINS

SEQ ID NO: 367652 - protein, 10 aa, Influenza virus
GAVNSSMPFH

SEQ ID NO: 367653 - protein, 10 aa, Influenza virus
AVNSSMPFHN

SEQ ID NO: 367654 - protein, 10 aa, Influenza virus
INSSMPFHNV

SEQ ID NO: 367655 - protein, 10 aa, Influenza virus
NSSMPFHNVH

SEQ ID NO: 367656 - protein, 10 aa, Influenza virus
SSMPFHNVHP

SEQ ID NO: 367657 - protein, 10 aa, Influenza virus
SMPFHNVHPL

SEQ ID NO: 367658 - protein, 10 aa, Influenza virus
MPFHNVHPLT

SEQ ID NO: 367659 - protein, 10 aa, Influenza virus
PFHNVHPLTI

SEQ ID NO: 367660 - protein, 10 aa, Influenza virus
FHNVHPLTIG

SEQ ID NO: 367661 - protein, 10 aa, Influenza virus
HNVHPLTIGE

SEQ ID NO: 367662 - protein, 10 aa, Influenza virus
NVHPLTIGEC

SEQ ID NO: 367663 - protein, 10 aa, Influenza virus
VHPLTIGECP

SEQ ID NO: 367664 - protein, 10 aa, Influenza virus
HPLTIGKCPK

SEQ ID NO: 367665 - protein, 10 aa, Influenza virus
PLTIGKCPKY

SEQ ID NO: 367666 - protein, 10 aa, Influenza virus
LTIGKCPKYV

SEQ ID NO: 367667 - protein, 10 aa, Influenza virus
GECPKYVKSD

SEQ ID NO: 367668 - protein, 10 aa, Influenza virus
KLVLATGLRN

SEQ ID NO: 367669 - protein, 10 aa, Influenza virus
RKRGLFGAIA

SEQ ID NO: 367670 - protein, 10 aa, Influenza virus
KRGLFGAIAG

SEQ ID NO: 367671 - protein, 10 aa, Influenza virus
TRGLFGAIAG

SEQ ID NO: 367672 - protein, 10 aa, Influenza virus
FIEGGWQGMI

SEQ ID NO: 367673 - protein, 10 aa, Influenza virus
IEGGWQGMID

SEQ ID NO: 367674 - protein, 10 aa, Influenza virus
EGGWQGMIDG

SEQ ID NO: 367675 - protein, 10 aa, Influenza virus
GGWQGMIDGW

SEQ ID NO: 367676 - protein, 10 aa, Influenza virus
GWQGMIDGWY

SEQ ID NO: 367677 - protein, 10 aa, Influenza virus
WQGMIDGWYG

SEQ ID NO: 367678 - protein, 10 aa, Influenza virus
QGMVDGWYGF

SEQ ID NO: 367679 - protein, 10 aa, Influenza virus
GMVDGWYGFH

SEQ ID NO: 367680 - protein, 10 aa, Influenza virus
MVDGWYGFHH

SEQ ID NO: 367681 - protein, 10 aa, Influenza virus
VDGWYGFHHS

SEQ ID NO: 367682 - protein, 10 aa, Influenza virus
DGWYGFHHSN

SEQ ID NO: 367683 - protein, 10 aa, Influenza virus
GWYGFHHSNE

SEQ ID NO: 367684 - protein, 10 aa, Influenza virus
HSNGQGSGYA

SEQ ID NO: 367685 - protein, 10 aa, Influenza virus
SNGQGSGYAA

SEQ ID NO: 367686 - protein, 10 aa, Influenza virus
NGQGSGYAAD

SEQ ID NO: 367687 - protein, 10 aa, Influenza virus
GQGSGYAADK

SEQ ID NO: 367688 - protein, 10 aa, Influenza virus
QGSGYAADQE

SEQ ID NO: 367689 - protein, 10 aa, Influenza virus
GSGYAADQES

SEQ ID NO: 367690 - protein, 10 aa, Influenza virus
SGYAADQEST

SEQ ID NO: 367691 - protein, 10 aa, Influenza virus
GYAADQESTQ

SEQ ID NO: 367692 - protein, 10 aa, Influenza virus
YAADKESTQR

SEQ ID NO: 367693 - protein, 10 aa, Influenza virus
AADKESTQRA

SEQ ID NO: 367694 - protein, 10 aa, Influenza virus
ESTQKAIDGI

SEQ ID NO: 367695 - protein, 10 aa, Influenza virus
STQKAIDGIT

SEQ ID NO: 367696 - protein, 10 aa, Influenza virus
TQKAIDGITN

SEQ ID NO: 367697 - protein, 10 aa, Influenza virus
QKAIDGITNK

SEQ ID NO: 367698 - protein, 10 aa, Influenza virus
AIDGITNKVN

SEQ ID NO: 367699 - protein, 10 aa, Influenza virus
IDGITNKVNS

SEQ ID NO: 367700 - protein, 10 aa, Influenza virus
DGITNKVNSI

SEQ ID NO: 367701 - protein, 10 aa, Influenza virus
GITNKVNSII

SEQ ID NO: 367702 - protein, 10 aa, Influenza virus
VTNKVNSIIN

SEQ ID NO: 367703 - protein, 10 aa, Influenza virus
TNKVNSIINK

SEQ ID NO: 367704 - protein, 10 aa, Influenza virus
NKVNSIINKM

SEQ ID NO: 367705 - protein, 10 aa, Influenza virus
KVNSIINKMN

SEQ ID NO: 367706 - protein, 10 aa, Influenza virus
VNSIINKMNT

SEQ ID NO: 367707 - protein, 10 aa, Influenza virus
NSIINKMNTQ

SEQ ID NO: 367708 - protein, 10 aa, Influenza virus
SIINKMNTQF

SEQ ID NO: 367709 - protein, 10 aa, Influenza virus
IINKMNTQFE

SEQ ID NO: 367710 - protein, 10 aa, Influenza virus
INKMNTQFEA

SEQ ID NO: 367711 - protein, 10 aa, Influenza virus
KMNTQFEAIG

SEQ ID NO: 367712 - protein, 10 aa, Influenza virus
MNTQFEAVGK

SEQ ID NO: 367713 - protein, 10 aa, Influenza virus
NTQFEAVGKE

SEQ ID NO: 367714 - protein, 10 aa, Influenza virus
TQFEAVGKEF

SEQ ID NO: 367715 - protein, 10 aa, Influenza virus
QFEAVGKEFN

SEQ ID NO: 367716 - protein, 10 aa, Influenza virus
LEKRIENLNK

SEQ ID NO: 367717 - protein, 10 aa, Influenza virus
EKRIENLNKK

SEQ ID NO: 367718 - protein, 10 aa, Influenza virus
KRIENLNKKM

SEQ ID NO: 367719 - protein, 10 aa, Influenza virus
RIESLNKKME

SEQ ID NO: 367720 - protein, 10 aa, Influenza virus
IESLNKKMED

SEQ ID NO: 367721 - protein, 10 aa, Influenza virus
ESLNKKMEDG

SEQ ID NO: 367722 - protein, 10 aa, Influenza virus
SLNKKMEDGF

SEQ ID NO: 367723 - protein, 10 aa, Influenza virus
LNRKMEDGFL

SEQ ID NO: 367724 - protein, 10 aa, Influenza virus
NRKMEDGFLD

SEQ ID NO: 367725 - protein, 10 aa, Influenza virus
RKMEDGFLDV

SEQ ID NO: 367726 - protein, 10 aa, Influenza virus
TLDFHDSNVR

SEQ ID NO: 367727 - protein, 10 aa, Influenza virus
LDFHDSNVRN

SEQ ID NO: 367728 - protein, 10 aa, Influenza virus
DFHDSNVRNL

SEQ ID NO: 367729 - protein, 10 aa, Influenza virus
FHDSNVRNLY

SEQ ID NO: 367730 - protein, 10 aa, Influenza virus
HDSNVKNLYE

SEQ ID NO: 367731 - protein, 10 aa, Influenza virus
DSNVKNLYEK

SEQ ID NO: 367732 - protein, 10 aa, Influenza virus
SNVKNLYEKV

SEQ ID NO: 367733 - protein, 10 aa, Influenza virus
NVKNLYEKVR

SEQ ID NO: 367734 - protein, 10 aa, Influenza virus
VKNLYEKVRL

SEQ ID NO: 367735 - protein, 10 aa, Influenza virus
KNLYEKVRLQ

SEQ ID NO: 367736 - protein, 10 aa, Influenza virus
NLYEKVRLQL

SEQ ID NO: 367737 - protein, 10 aa, Influenza virus
LYDKVRLQLK

SEQ ID NO: 367738 - protein, 10 aa, Influenza virus
YDKVRLQLKD

SEQ ID NO: 367739 - protein, 10 aa, Influenza virus
DKVRLQLKDN

SEQ ID NO: 367740 - protein, 10 aa, Influenza virus
KVRLQLKDNA

SEQ ID NO: 367741 - protein, 10 aa, Influenza virus
VRLQLKDNAK

SEQ ID NO: 367742 - protein, 10 aa, Influenza virus
RLQLKDNAKE

SEQ ID NO: 367743 - protein, 10 aa, Influenza virus
LQLKDNAKEL

SEQ ID NO: 367744 - protein, 10 aa, Influenza virus
QLKDNAKELG

SEQ ID NO: 367745 - protein, 10 aa, Influenza virus
LKDNAKELGN

SEQ ID NO: 367746 - protein, 10 aa, Influenza virus
KDNAKELGNG

SEQ ID NO: 367747 - protein, 10 aa, Influenza virus
GNGCFEFYHR

SEQ ID NO: 367748 - protein, 10 aa, Influenza virus
NGCFEFYHRC

SEQ ID NO: 367749 - protein, 10 aa, Influenza virus
GCFEFYHRCD

SEQ ID NO: 367750 - protein, 10 aa, Influenza virus
CFEFYHRCDN

SEQ ID NO: 367751 - protein, 10 aa, Influenza virus
CMESIRNGTY

SEQ ID NO: 367752 - protein, 10 aa, Influenza virus
GIYQILSIYS

SEQ ID NO: 367753 - protein, 10 aa, Influenza virus
IYQILSIYST

SEQ ID NO: 367754 - protein, 10 aa, Influenza virus
YQILSIYSTA

SEQ ID NO: 367755 - protein, 10 aa, Influenza virus
QILSIYSTAA

SEQ ID NO: 367756 - protein, 10 aa, Influenza virus
ILSIYSTAAS

SEQ ID NO: 367757 - protein, 10 aa, Influenza virus
LSIYSTAASS

SEQ ID NO: 367758 - protein, 10 aa, Influenza virus
SIYSTAASSL

SEQ ID NO: 367759 - protein, 10 aa, Influenza virus
YSTVASSLVL

SEQ ID NO: 367760 - protein, 10 aa, Influenza virus
STVASSLVLA

SEQ ID NO: 367761 - protein, 10 aa, Influenza virus
TVASSLVLAI

SEQ ID NO: 367762 - protein, 10 aa, Influenza virus
AGLFLWMCSN

SEQ ID NO: 367763 - protein, 10 aa, Influenza virus
GLFLWMCSNG

SEQ ID NO: 367764 - protein, 10 aa, Influenza virus
LFLWMCSNGS

SEQ ID NO: 367765 - protein, 10 aa, Influenza virus
FLWMCSNGSL

SEQ ID NO: 367766 - protein, 10 aa, Influenza virus
FWMCSNGSLQ

SEQ ID NO: 367767 - protein, 10 aa, Influenza virus
WMCFNGSLQC

SEQ ID NO: 367768 - protein, 10 aa, Influenza virus
MCSNGSLQCK

SEQ ID NO: 367769 - protein, 10 aa, Influenza virus
CSNGSLQCRV

SEQ ID NO: 367770 - protein, 10 aa, Influenza virus
SNGSLQCRVC

SEQ ID NO: 367771 - protein, 10 aa, Influenza virus
NGSLQCRVCI

SEQ ID NO: 367772 - protein, 10 aa, Influenza virus
CIKFVSSDCS

SEQ ID NO: 367773 - protein, 10 aa, Influenza virus
FSGSQKQEFK

SEQ ID NO: 367774 - protein, 10 aa, Influenza virus
SGSQKQEFKM

SEQ ID NO: 367775 - protein, 10 aa, Influenza virus
GSQKQEFKMN

SEQ ID NO: 367776 - protein, 10 aa, Influenza virus
SQKQEFKMNP

SEQ ID NO: 367777 - protein, 10 aa, Influenza virus
QKQEIKMNPN

SEQ ID NO: 367778 - protein, 10 aa, Influenza virus
KQEIKMNPNQ

SEQ ID NO: 367779 - protein, 10 aa, Influenza virus
QEIKMNPNQK

SEQ ID NO: 367780 - protein, 10 aa, Influenza virus
EIKMNPNQKI

SEQ ID NO: 367781 - protein, 10 aa, Influenza virus
IKMNPNQKIM

SEQ ID NO: 367782 - protein, 10 aa, Influenza virus
KMNPNQKIIT

SEQ ID NO: 367783 - protein, 10 aa, Influenza virus
IEIITIGSIC

SEQ ID NO: 367784 - protein, 10 aa, Influenza virus
EIITIGSICM

SEQ ID NO: 367785 - protein, 10 aa, Influenza virus
IITIGSICMV

SEQ ID NO: 367786 - protein, 10 aa, Influenza virus
YENTTWVNQT

SEQ ID NO: 367787 - protein, 10 aa, Influenza virus
ENNTWVNQTF

SEQ ID NO: 367788 - protein, 10 aa, Influenza virus
HSKDNSIRIG

SEQ ID NO: 367789 - protein, 10 aa, Influenza virus
SKDNGIRIGS

SEQ ID NO: 367790 - protein, 10 aa, Influenza virus
KDNSIRIGSR

SEQ ID NO: 367791 - protein, 10 aa, Influenza virus
DNSIRIGSRG

SEQ ID NO: 367792 - protein, 10 aa, Influenza virus
NSIRIGSRGD

SEQ ID NO: 367793 - protein, 10 aa, Influenza virus
SIRIGSRGDV

SEQ ID NO: 367794 - protein, 10 aa, Influenza virus
IRIGSRGDVF

SEQ ID NO: 367795 - protein, 10 aa, Influenza virus
RIGSRGDVFV

SEQ ID NO: 367796 - protein, 10 aa, Influenza virus
GDVFVVREPF

SEQ ID NO: 367797 - protein, 10 aa, Influenza virus
VREPFISCSH

SEQ ID NO: 367798 - protein, 10 aa, Influenza virus
REPFISCSHM

SEQ ID NO: 367799 - protein, 10 aa, Influenza virus
EPFISCSHME

SEQ ID NO: 367800 - protein, 10 aa, Influenza virus
PFISCSHMEC

SEQ ID NO: 367801 - protein, 10 aa, Influenza virus
FISCSHMECR

SEQ ID NO: 367802 - protein, 10 aa, Influenza virus
ISCSHMECRT

SEQ ID NO: 367803 - protein, 10 aa, Influenza virus
SCSHMECRTF

SEQ ID NO: 367804 - protein, 10 aa, Influenza virus
CSHMECRTFF

SEQ ID NO: 367805 - protein, 10 aa, Influenza virus
SHMECRTFFL

SEQ ID NO: 367806 - protein, 10 aa, Influenza virus
HMECRTFFLT

SEQ ID NO: 367807 - protein, 10 aa, Influenza virus
MECRTFFLTQ

SEQ ID NO: 367808 - protein, 10 aa, Influenza virus
ECRTFFLTHG

SEQ ID NO: 367809 - protein, 10 aa, Influenza virus
CRTFFLTQGS

SEQ ID NO: 367810 - protein, 10 aa, Influenza virus
RTFFLTQGSL

SEQ ID NO: 367811 - protein, 10 aa, Influenza virus
TFFLTQGSLL

SEQ ID NO: 367812 - protein, 10 aa, Influenza virus
FFLTQGSLLN

SEQ ID NO: 367813 - protein, 10 aa, Influenza virus
FLTQGSLLND

SEQ ID NO: 367814 - protein, 10 aa, Influenza virus
LTQGSLLNDK

SEQ ID NO: 367815 - protein, 10 aa, Influenza virus
TQGSLLNDKH

SEQ ID NO: 367816 - protein, 10 aa, Influenza virus
QGSLLNDKHS

SEQ ID NO: 367817 - protein, 10 aa, Influenza virus
GSLLNDKHSN

SEQ ID NO: 367818 - protein, 10 aa, Influenza virus
SLLNDKHSNG

SEQ ID NO: 367819 - protein, 10 aa, Influenza virus
LLNDKHSNET

SEQ ID NO: 367820 - protein, 10 aa, Influenza virus
LNDKHSNGTI

SEQ ID NO: 367821 - protein, 10 aa, Influenza virus
KHSNGTIKDR

SEQ ID NO: 367822 - protein, 10 aa, Influenza virus
HSNGTIKDRS

SEQ ID NO: 367823 - protein, 10 aa, Influenza virus
SNGTIKDRSP

SEQ ID NO: 367824 - protein, 10 aa, Influenza virus
KDRSPYRTLM

SEQ ID NO: 367825 - protein, 10 aa, Influenza virus
DRSPYRTLMS

SEQ ID NO: 367826 - protein, 10 aa, Influenza virus
RSPYRTLMSC

SEQ ID NO: 367827 - protein, 10 aa, Influenza virus
SPYRTLMSCP

SEQ ID NO: 367828 - protein, 10 aa, Influenza virus
GEAPSPYNSK

SEQ ID NO: 367829 - protein, 10 aa, Influenza virus
EAPSPYNSKF

SEQ ID NO: 367830 - protein, 10 aa, Influenza virus
APSPYNSKFE

SEQ ID NO: 367831 - protein, 10 aa, Influenza virus
PSPYNSKFES

SEQ ID NO: 367832 - protein, 10 aa, Influenza virus
SPYNSKFESV

SEQ ID NO: 367833 - protein, 10 aa, Influenza virus
PYNSKFESVA

SEQ ID NO: 367834 - protein, 10 aa, Influenza virus
YNSKFESVAW

SEQ ID NO: 367835 - protein, 10 aa, Influenza virus
NSKFESVAWS

SEQ ID NO: 367836 - protein, 10 aa, Influenza virus
WSASACHDGI

SEQ ID NO: 367837 - protein, 10 aa, Influenza virus
SASACHDGIS

SEQ ID NO: 367838 - protein, 10 aa, Influenza virus
ASACHDGISW

SEQ ID NO: 367839 - protein, 10 aa, Influenza virus
SACHDGISWL

SEQ ID NO: 367840 - protein, 10 aa, Influenza virus
CHDGISWLTI

SEQ ID NO: 367841 - protein, 10 aa, Influenza virus
NWLTIGISGP

SEQ ID NO: 367842 - protein, 10 aa, Influenza virus
WLTIGVSGPD

SEQ ID NO: 367843 - protein, 10 aa, Influenza virus
LTIGISGPDS

SEQ ID NO: 367844 - protein, 10 aa, Influenza virus
IGISGPDNEA

SEQ ID NO: 367845 - protein, 10 aa, Influenza virus
GISGPDNEAV

SEQ ID NO: 367846 - protein, 10 aa, Influenza virus
ISGPDNEAVA

SEQ ID NO: 367847 - protein, 10 aa, Influenza virus
SGPDNEAVAV

SEQ ID NO: 367848 - protein, 10 aa, Influenza virus
GPDNEAVAVL

SEQ ID NO: 367849 - protein, 10 aa, Influenza virus
PDNEAVAVLK

SEQ ID NO: 367850 - protein, 10 aa, Influenza virus
DNEAVAVLKY

SEQ ID NO: 367851 - protein, 10 aa, Influenza virus
EAVAVLKYNG

SEQ ID NO: 367852 - protein, 10 aa, Influenza virus
KYNGMITDTI

SEQ ID NO: 367853 - protein, 10 aa, Influenza virus
GMITDTIKSW

SEQ ID NO: 367854 - protein, 10 aa, Influenza virus
NIMRTQESEC

SEQ ID NO: 367855 - protein, 10 aa, Influenza virus
IMRTQESECA

SEQ ID NO: 367856 - protein, 10 aa, Influenza virus
MRTQESECAC

SEQ ID NO: 367857 - protein, 10 aa, Influenza virus
RTQESECACI

SEQ ID NO: 367858 - protein, 10 aa, Influenza virus
TQESECACIN

SEQ ID NO: 367859 - protein, 10 aa, Influenza virus
QESECACING

SEQ ID NO: 367860 - protein, 10 aa, Influenza virus
GSCFTIMTDG

SEQ ID NO: 367861 - protein, 10 aa, Influenza virus
SCFTIMTDGP

SEQ ID NO: 367862 - protein, 10 aa, Influenza virus
CFTIMTDGPS

SEQ ID NO: 367863 - protein, 10 aa, Influenza virus
GKRGKWVKSV

SEQ ID NO: 367864 - protein, 10 aa, Influenza virus
APDYHYEECS

SEQ ID NO: 367865 - protein, 10 aa, Influenza virus
PDYHYEECSC

SEQ ID NO: 367866 - protein, 10 aa, Influenza virus
DYHYEECSCY

SEQ ID NO: 367867 - protein, 10 aa, Influenza virus
HYEECSCYPN

SEQ ID NO: 367868 - protein, 10 aa, Influenza virus
YEECSCYPDS

SEQ ID NO: 367869 - protein, 10 aa, Influenza virus
EECSCYPDAS

SEQ ID NO: 367870 - protein, 10 aa, Influenza virus
ECSCYPDASE

SEQ ID NO: 367871 - protein, 10 aa, Influenza virus
ICVCRDNWHG

SEQ ID NO: 367872 - protein, 10 aa, Influenza virus
NWHGSNRPWI

SEQ ID NO: 367873 - protein, 10 aa, Influenza virus
WHGSNRPWIS

SEQ ID NO: 367874 - protein, 10 aa, Influenza virus
HGSNRPWISF

SEQ ID NO: 367875 - protein, 10 aa, Influenza virus
GSNRPWISFN

SEQ ID NO: 367876 - protein, 10 aa, Influenza virus
IGYICSGIFG

SEQ ID NO: 367877 - protein, 10 aa, Influenza virus
GYICSGIFGD

SEQ ID NO: 367878 - protein, 10 aa, Influenza virus
YICSGIFGDN

SEQ ID NO: 367879 - protein, 10 aa, Influenza virus
ICSGIFGDNP

SEQ ID NO: 367880 - protein, 10 aa, Influenza virus
CSGIFGDNPR

SEQ ID NO: 367881 - protein, 10 aa, Influenza virus
SGIFGDNPRP

SEQ ID NO: 367882 - protein, 10 aa, Influenza virus
FGDTPRPNDG

SEQ ID NO: 367883 - protein, 10 aa, Influenza virus
GIKGFSFKYG

SEQ ID NO: 367884 - protein, 10 aa, Influenza virus
KGFSFRYGNG

SEQ ID NO: 367885 - protein, 10 aa, Influenza virus
FRYGNGVWIG

SEQ ID NO: 367886 - protein, 10 aa, Influenza virus
RYGNGVWIGR

SEQ ID NO: 367887 - protein, 10 aa, Influenza virus
YGNGAWIGRT

SEQ ID NO: 367888 - protein, 10 aa, Influenza virus
GNGAWIGRTK

SEQ ID NO: 367889 - protein, 10 aa, Influenza virus
DGVWIGRTKS

SEQ ID NO: 367890 - protein, 10 aa, Influenza virus
GVWIGRTKSP

SEQ ID NO: 367891 - protein, 10 aa, Influenza virus
SRSGFEMVWD

SEQ ID NO: 367892 - protein, 10 aa, Influenza virus
RSGFEMVWDP

SEQ ID NO: 367893 - protein, 10 aa, Influenza virus
SGFEMVWDPN

SEQ ID NO: 367894 - protein, 10 aa, Influenza virus
GFEMVWDPNG

SEQ ID NO: 367895 - protein, 10 aa, Influenza virus
FEMVWDPNGW

SEQ ID NO: 367896 - protein, 10 aa, Influenza virus
LTDWSGYSGS

SEQ ID NO: 367897 - protein, 10 aa, Influenza virus
TEWSGYSGSF

SEQ ID NO: 367898 - protein, 10 aa, Influenza virus
DWSGYSGSFI

SEQ ID NO: 367899 - protein, 10 aa, Influenza virus
WSGYSGSFIQ

SEQ ID NO: 367900 - protein, 10 aa, Influenza virus
SGYSGSFIQH

SEQ ID NO: 367901 - protein, 10 aa, Influenza virus
GYSGSFIQHP

SEQ ID NO: 367902 - protein, 10 aa, Influenza virus
YSGSFIQHPE

SEQ ID NO: 367903 - protein, 10 aa, Influenza virus
SGSFIQHPEL

SEQ ID NO: 367904 - protein, 10 aa, Influenza virus
GSFIQHPELT

SEQ ID NO: 367905 - protein, 10 aa, Influenza virus
SFIQHPELTG

SEQ ID NO: 367906 - protein, 10 aa, Influenza virus
FIQHPELTGL

SEQ ID NO: 367907 - protein, 10 aa, Influenza virus
VQHPELTGLN

SEQ ID NO: 367908 - protein, 10 aa, Influenza virus
QHPELTGLNC

SEQ ID NO: 367909 - protein, 10 aa, Influenza virus
DCMRPCFWVE

SEQ ID NO: 367910 - protein, 10 aa, Influenza virus
CMRPCFWVEL

SEQ ID NO: 367911 - protein, 10 aa, Influenza virus
MRPCFWVELI

SEQ ID NO: 367912 - protein, 10 aa, Influenza virus
RPCFWVELVR

SEQ ID NO: 367913 - protein, 10 aa, Influenza virus
PCFWVELVRG

SEQ ID NO: 367914 - protein, 10 aa, Influenza virus
CFWVELIRGQ

SEQ ID NO: 367915 - protein, 10 aa, Influenza virus
FWVELIRGQP

SEQ ID NO: 367916 - protein, 10 aa, Influenza virus
WVELIRGQPK

SEQ ID NO: 367917 - protein, 10 aa, Influenza virus
VELIRGQPKE

SEQ ID NO: 367918 - protein, 10 aa, Influenza virus
VWTSGSSISF

SEQ ID NO: 367919 - protein, 10 aa, Influenza virus
WTSGSIISFC

SEQ ID NO: 367920 - protein, 10 aa, Influenza virus
TSGSIISFCG

SEQ ID NO: 367921 - protein, 10 aa, Influenza virus
SGSIISFCGV

SEQ ID NO: 367922 - protein, 10 aa, Influenza virus
GSSISFCGVS

SEQ ID NO: 367923 - protein, 10 aa, Influenza virus
WSWPDDAELP

SEQ ID NO: 367924 - protein, 10 aa, Influenza virus
SWPDDAELPF

SEQ ID NO: 367925 - protein, 10 aa, Influenza virus
AELPFTIDKS

SEQ ID NO: 367926 - protein, 10 aa, Influenza virus
DRICIGYHAN

SEQ ID NO: 367927 - protein, 10 aa, Influenza virus
RICIGYHANN

SEQ ID NO: 367928 - protein, 10 aa, Influenza virus
ICIGHHANNS

SEQ ID NO: 367929 - protein, 10 aa, Influenza virus
CIGYHANNSK

SEQ ID NO: 367930 - protein, 10 aa, Influenza virus
IGYHANNSTK

SEQ ID NO: 367931 - protein, 10 aa, Influenza virus
GYHANNSTKQ

SEQ ID NO: 367932 - protein, 10 aa, Influenza virus
YHANNSTKQV

SEQ ID NO: 367933 - protein, 10 aa, Influenza virus
HANNSTKQVD

SEQ ID NO: 367934 - protein, 10 aa, Influenza virus
ANNSTKQVDT

SEQ ID NO: 367935 - protein, 10 aa, Influenza virus
NNSTKQVDTI

SEQ ID NO: 367936 - protein, 10 aa, Influenza virus
QIDTIMEKNV

SEQ ID NO: 367937 - protein, 10 aa, Influenza virus
DTIMERNVTV

SEQ ID NO: 367938 - protein, 10 aa, Influenza virus
TIMERNVTVT

SEQ ID NO: 367939 - protein, 10 aa, Influenza virus
ERNVTVTHAQ

SEQ ID NO: 367940 - protein, 10 aa, Influenza virus
AGWLIGNPKC

SEQ ID NO: 367941 - protein, 10 aa, Influenza virus
APEWSYIVEK

SEQ ID NO: 367942 - protein, 10 aa, Influenza virus
PEWSYIVEKN

SEQ ID NO: 367943 - protein, 10 aa, Influenza virus
EWSYIVEKDS

SEQ ID NO: 367944 - protein, 10 aa, Influenza virus
WSYIVEKDSP

SEQ ID NO: 367945 - protein, 10 aa, Influenza virus
YHTGRSSFFR

SEQ ID NO: 367946 - protein, 10 aa, Influenza virus
SSFYRNVVWL

SEQ ID NO: 367947 - protein, 10 aa, Influenza virus
SFFRNVVWLT

SEQ ID NO: 367948 - protein, 10 aa, Influenza virus
FFRNVVWLTK

SEQ ID NO: 367949 - protein, 10 aa, Influenza virus
FRNVVWLTKK

SEQ ID NO: 367950 - protein, 10 aa, Influenza virus
IATRPQVNGQ

SEQ ID NO: 367951 - protein, 10 aa, Influenza virus
FESTGNFIAP

SEQ ID NO: 367952 - protein, 10 aa, Influenza virus
ESTGNFIAPE

SEQ ID NO: 367953 - protein, 10 aa, Influenza virus
STGNFIAPEY

SEQ ID NO: 367954 - protein, 10 aa, Influenza virus
TGNFIAPEYA

SEQ ID NO: 367955 - protein, 10 aa, Influenza virus
GNFIAPEYAF

SEQ ID NO: 367956 - protein, 10 aa, Influenza virus
NFIAPEYAYR

SEQ ID NO: 367957 - protein, 10 aa, Influenza virus
FIAPEYAFKI

SEQ ID NO: 367958 - protein, 10 aa, Influenza virus
YGNCNTKCQT

SEQ ID NO: 367959 - protein, 10 aa, Influenza virus
GNCNTKCQTP

SEQ ID NO: 367960 - protein, 10 aa, Influenza virus
ERRRKKRGLF

SEQ ID NO: 367961 - protein, 10 aa, Influenza virus
RRRKKRGLFG

SEQ ID NO: 367962 - protein, 10 aa, Influenza virus
KKRGLFGAIA

SEQ ID NO: 367963 - protein, 10 aa, Influenza virus
KRGLFGAIAG

SEQ ID NO: 367964 - protein, 10 aa, Influenza virus
GFIEGGWQGL

SEQ ID NO: 367965 - protein, 10 aa, Influenza virus
FIEGGWQGMI

SEQ ID NO: 367966 - protein, 10 aa, Influenza virus
IEGGWQGMID

SEQ ID NO: 367967 - protein, 10 aa, Influenza virus
EGGWQGMIDG

SEQ ID NO: 367968 - protein, 10 aa, Influenza virus
GGWQGMIDGW

SEQ ID NO: 367969 - protein, 10 aa, Influenza virus
GWQGMIDGWY

SEQ ID NO: 367970 - protein, 10 aa, Influenza virus
WQGMIDGWYG

SEQ ID NO: 367971 - protein, 10 aa, Influenza virus
QGMIDGWYGY

SEQ ID NO: 367972 - protein, 10 aa, Influenza virus
GMIDGWYGYH

SEQ ID NO: 367973 - protein, 10 aa, Influenza virus
MIDGWYGYHH

SEQ ID NO: 367974 - protein, 10 aa, Influenza virus
IDGWYGYHHS

SEQ ID NO: 367975 - protein, 10 aa, Influenza virus
DGWYGYHHIN

SEQ ID NO: 367976 - protein, 10 aa, Influenza virus
GSGYAADKKS

SEQ ID NO: 367977 - protein, 10 aa, Influenza virus
SGYAADKKST

SEQ ID NO: 367978 - protein, 10 aa, Influenza virus
GYAADKKSTQ

SEQ ID NO: 367979 - protein, 10 aa, Influenza virus
YAADKKSTQK

SEQ ID NO: 367980 - protein, 10 aa, Influenza virus
AADKKSTQKA

SEQ ID NO: 367981 - protein, 10 aa, Influenza virus
STQKAINGIT

SEQ ID NO: 367982 - protein, 10 aa, Influenza virus
VWTYNTELLV

SEQ ID NO: 367983 - protein, 10 aa, Influenza virus
WTYNAELFVL

SEQ ID NO: 367984 - protein, 10 aa, Influenza virus
TYNAELLVLI

SEQ ID NO: 367985 - protein, 10 aa, Influenza virus
YNAELFVLME

SEQ ID NO: 367986 - protein, 10 aa, Influenza virus
NAELLVLIEN

SEQ ID NO: 367987 - protein, 10 aa, Influenza virus
AELLVLIENE

SEQ ID NO: 367988 - protein, 10 aa, Influenza virus
ELFVLMENER

SEQ ID NO: 367989 - protein, 10 aa, Influenza virus
LLVLIENERT

SEQ ID NO: 367990 - protein, 10 aa, Influenza virus
FVLMENERTL

SEQ ID NO: 367991 - protein, 10 aa, Influenza virus
VLMENERTLY

SEQ ID NO: 367992 - protein, 10 aa, Influenza virus
LMENERTLDL

SEQ ID NO: 367993 - protein, 10 aa, Influenza virus
MENERTLDLH

SEQ ID NO: 367994 - protein, 10 aa, Influenza virus
ENERTLDLHD

SEQ ID NO: 367995 - protein, 10 aa, Influenza virus
NERTLDLHDS

SEQ ID NO: 367996 - protein, 10 aa, Influenza virus
ERTLDLHDSN

SEQ ID NO: 367997 - protein, 10 aa, Influenza virus
RTLDLHDSNV

SEQ ID NO: 367998 - protein, 10 aa, Influenza virus
TLDLHDSNVK

SEQ ID NO: 367999 - protein, 10 aa, Influenza virus
LDLHDSNVKN

SEQ ID NO: 368000 - protein, 10 aa, Influenza virus
DLHDSNVKNL

SEQ ID NO: 368001 - protein, 10 aa, Influenza virus
LHDSNVKNLY

SEQ ID NO: 368002 - protein, 10 aa, Influenza virus
HDSNVRNLYD

SEQ ID NO: 368003 - protein, 10 aa, Influenza virus
DSNVRNLYDK

SEQ ID NO: 368004 - protein, 10 aa, Influenza virus
SNVRNLYDKV

SEQ ID NO: 368005 - protein, 10 aa, Influenza virus
NVRNLYDKVR

SEQ ID NO: 368006 - protein, 10 aa, Influenza virus
NLYNKVRLQL

SEQ ID NO: 368007 - protein, 10 aa, Influenza virus
DNARELGNGC

SEQ ID NO: 368008 - protein, 10 aa, Influenza virus
NARELGNGCF

SEQ ID NO: 368009 - protein, 10 aa, Influenza virus
ARELGNGCFE

SEQ ID NO: 368010 - protein, 10 aa, Influenza virus
RELGNGCFEF

SEQ ID NO: 368011 - protein, 10 aa, Influenza virus
EMGNGCFEFY

SEQ ID NO: 368012 - protein, 10 aa, Influenza virus
MGNGCFEFYH

SEQ ID NO: 368013 - protein, 10 aa, Influenza virus
GNGCFEFYHR

SEQ ID NO: 368014 - protein, 10 aa, Influenza virus
NGCFEFYHRC

SEQ ID NO: 368015 - protein, 10 aa, Influenza virus
GCFEFYHRCD

SEQ ID NO: 368016 - protein, 10 aa, Influenza virus
ECMESVKNGT

SEQ ID NO: 368017 - protein, 10 aa, Influenza virus
CMESVKNGTY

SEQ ID NO: 368018 - protein, 10 aa, Influenza virus
ESVRNGTYNY

SEQ ID NO: 368019 - protein, 10 aa, Influenza virus
ILSIYSTVVS

SEQ ID NO: 368020 - protein, 10 aa, Influenza virus
LSIYSTVVSS

SEQ ID NO: 368021 - protein, 10 aa, Influenza virus
SIYSTVVSSL

SEQ ID NO: 368022 - protein, 10 aa, Influenza virus
LAIMVAGLSF

SEQ ID NO: 368023 - protein, 10 aa, Influenza virus
AIMVAGLSFW

SEQ ID NO: 368024 - protein, 10 aa, Influenza virus
VAGLSFWMCS

SEQ ID NO: 368025 - protein, 10 aa, Influenza virus
AGLFFWMCSN

SEQ ID NO: 368026 - protein, 10 aa, Influenza virus
GLFFWMCSNG

SEQ ID NO: 368027 - protein, 10 aa, Influenza virus
LFFWMCSNGS

SEQ ID NO: 368028 - protein, 10 aa, Influenza virus
FFWMCSNGSL

SEQ ID NO: 368029 - protein, 10 aa, Influenza virus
LWMCSNGSLQ

SEQ ID NO: 368030 - protein, 10 aa, Influenza virus
MCSNGSLQCT

SEQ ID NO: 368031 - protein, 10 aa, Influenza virus
CSNGSLQCTI

SEQ ID NO: 368032 - protein, 10 aa, Influenza virus
SNGSLQCRVC

SEQ ID NO: 368033 - protein, 10 aa, Influenza virus
NGSLQCTICI

SEQ ID NO: 368034 - protein, 10 aa, Influenza virus
KPQCQVTGFA

SEQ ID NO: 368035 - protein, 10 aa, Influenza virus
PQCQVTGFAP

SEQ ID NO: 368036 - protein, 10 aa, Influenza virus
QCQVTGFAPF

SEQ ID NO: 368037 - protein, 10 aa, Influenza virus
VTGFAPFSKD

SEQ ID NO: 368038 - protein, 10 aa, Influenza virus
AGFAPFSKDN

SEQ ID NO: 368039 - protein, 10 aa, Influenza virus
APFSKDNSIQ

SEQ ID NO: 368040 - protein, 10 aa, Influenza virus
PFSKDNSIQL

SEQ ID NO: 368041 - protein, 10 aa, Influenza virus
FSKDNSIQLS

SEQ ID NO: 368042 - protein, 10 aa, Influenza virus
SKDNSIQLSA

SEQ ID NO: 368043 - protein, 10 aa, Influenza virus
KDNSIQLSAG

SEQ ID NO: 368044 - protein, 10 aa, Influenza virus
DNSIQLSAGG

SEQ ID NO: 368045 - protein, 10 aa, Influenza virus
IWITREPYVS

SEQ ID NO: 368046 - protein, 10 aa, Influenza virus
WITREPYVSC

SEQ ID NO: 368047 - protein, 10 aa, Influenza virus
VTREPYVSCS

SEQ ID NO: 368048 - protein, 10 aa, Influenza virus
RCYQFALGQG

SEQ ID NO: 368049 - protein, 10 aa, Influenza virus
FALGQGTTLN

SEQ ID NO: 368050 - protein, 10 aa, Influenza virus
NHSNGTIHDR

SEQ ID NO: 368051 - protein, 10 aa, Influenza virus
HSNGTIHDRT

SEQ ID NO: 368052 - protein, 10 aa, Influenza virus
PHRTLLMSEL

SEQ ID NO: 368053 - protein, 10 aa, Influenza virus
HRTLLMSELG

SEQ ID NO: 368054 - protein, 10 aa, Influenza virus
RTLLMSELGV

SEQ ID NO: 368055 - protein, 10 aa, Influenza virus
TLLMSELGVP

SEQ ID NO: 368056 - protein, 10 aa, Influenza virus
LLMSELGVPF

SEQ ID NO: 368057 - protein, 10 aa, Influenza virus
LMSELGVPFH

SEQ ID NO: 368058 - protein, 10 aa, Influenza virus
MSELGVPFHL

SEQ ID NO: 368059 - protein, 10 aa, Influenza virus
SELGVPFHLG

SEQ ID NO: 368060 - protein, 10 aa, Influenza virus
ELGIPFHLGT

SEQ ID NO: 368061 - protein, 10 aa, Influenza virus
LGVPFHLGTR

SEQ ID NO: 368062 - protein, 10 aa, Influenza virus
GVPFHLGTRQ

SEQ ID NO: 368063 - protein, 10 aa, Influenza virus
VPFHLGTRQV

SEQ ID NO: 368064 - protein, 10 aa, Influenza virus
PFHLGTRQVC

SEQ ID NO: 368065 - protein, 10 aa, Influenza virus
FHLGTRQVCI

SEQ ID NO: 368066 - protein, 10 aa, Influenza virus
HLGTRQVCIA

SEQ ID NO: 368067 - protein, 10 aa, Influenza virus
LGTRQVCIAW

SEQ ID NO: 368068 - protein, 10 aa, Influenza virus
GTRQVCIAWS

SEQ ID NO: 368069 - protein, 10 aa, Influenza virus
TRQVCIAWSS

SEQ ID NO: 368070 - protein, 10 aa, Influenza virus
RQVCIAWSSS

SEQ ID NO: 368071 - protein, 10 aa, Influenza virus
QVCMAWSSSS

SEQ ID NO: 368072 - protein, 10 aa, Influenza virus
VCMAWSSSSC

SEQ ID NO: 368073 - protein, 10 aa, Influenza virus
CMAWSSSSCH

SEQ ID NO: 368074 - protein, 10 aa, Influenza virus
MAWSSSSCHD

SEQ ID NO: 368075 - protein, 10 aa, Influenza virus
AWSRSSCHDG

SEQ ID NO: 368076 - protein, 10 aa, Influenza virus
WSSSSCHDGR

SEQ ID NO: 368077 - protein, 10 aa, Influenza virus
SSSSCHDGRA

SEQ ID NO: 368078 - protein, 10 aa, Influenza virus
SSSCHDGRAW

SEQ ID NO: 368079 - protein, 10 aa, Influenza virus
SSCHDGRAWL

SEQ ID NO: 368080 - protein, 10 aa, Influenza virus
SCHDGRAWLH

SEQ ID NO: 368081 - protein, 10 aa, Influenza virus
CHDGRAWLHV

SEQ ID NO: 368082 - protein, 10 aa, Influenza virus
HDGRAWLHVC

SEQ ID NO: 368083 - protein, 10 aa, Influenza virus
AWLHICVTGD

SEQ ID NO: 368084 - protein, 10 aa, Influenza virus
WLHICVTGDD

SEQ ID NO: 368085 - protein, 10 aa, Influenza virus
SWSKNILRTQ

SEQ ID NO: 368086 - protein, 10 aa, Influenza virus
WSKNILRTQE

SEQ ID NO: 368087 - protein, 10 aa, Influenza virus
SKNILRTQES

SEQ ID NO: 368088 - protein, 10 aa, Influenza virus
KNILRTQESE

SEQ ID NO: 368089 - protein, 10 aa, Influenza virus
ILRTQESECI

SEQ ID NO: 368090 - protein, 10 aa, Influenza virus
LRTQESECIC

SEQ ID NO: 368091 - protein, 10 aa, Influenza virus
RTQESECVCV

SEQ ID NO: 368092 - protein, 10 aa, Influenza virus
TQESECVCIS

SEQ ID NO: 368093 - protein, 10 aa, Influenza virus
CAVVMTDGSA

SEQ ID NO: 368094 - protein, 10 aa, Influenza virus
AVVMTDGSAS

SEQ ID NO: 368095 - protein, 10 aa, Influenza virus
VVMTDGSASR

SEQ ID NO: 368096 - protein, 10 aa, Influenza virus
GSAQHVEECS

SEQ ID NO: 368097 - protein, 10 aa, Influenza virus
SAQHVEECSC

SEQ ID NO: 368098 - protein, 10 aa, Influenza virus
AQHVEECSCY

SEQ ID NO: 368099 - protein, 10 aa, Influenza virus
QHVEECSCYP

SEQ ID NO: 368100 - protein, 10 aa, Influenza virus
SYLNVRCVCR

SEQ ID NO: 368101 - protein, 10 aa, Influenza virus
IRCVCRDNWK

SEQ ID NO: 368102 - protein, 10 aa, Influenza virus
RCICRDNWKG

SEQ ID NO: 368103 - protein, 10 aa, Influenza virus
CICRDNWKGS

SEQ ID NO: 368104 - protein, 10 aa, Influenza virus
ICRDNWKGSN

SEQ ID NO: 368105 - protein, 10 aa, Influenza virus
CRDNWMGSNR

SEQ ID NO: 368106 - protein, 10 aa, Influenza virus
RDNWMGSNRP

SEQ ID NO: 368107 - protein, 10 aa, Influenza virus
DNWKGSNRPI

SEQ ID NO: 368108 - protein, 10 aa, Influenza virus
SSYICSGLVG

SEQ ID NO: 368109 - protein, 10 aa, Influenza virus
SYICSGLVGD

SEQ ID NO: 368110 - protein, 10 aa, Influenza virus
YICSGLVGDT

SEQ ID NO: 368111 - protein, 10 aa, Influenza virus
ICSGLVGDTP

SEQ ID NO: 368112 - protein, 10 aa, Influenza virus
GLVGDTPRNN

SEQ ID NO: 368113 - protein, 10 aa, Influenza virus
LVGDTPRNND

SEQ ID NO: 368114 - protein, 10 aa, Influenza virus
VGDTPRNDDG

SEQ ID NO: 368115 - protein, 10 aa, Influenza virus
SNSNCKDPNN

SEQ ID NO: 368116 - protein, 10 aa, Influenza virus
NSNCKDPNNE

SEQ ID NO: 368117 - protein, 10 aa, Influenza virus
SNCKDPNNER

SEQ ID NO: 368118 - protein, 10 aa, Influenza virus
GNSGVKGWAF

SEQ ID NO: 368119 - protein, 10 aa, Influenza virus
NSGVKGWAFD

SEQ ID NO: 368120 - protein, 10 aa, Influenza virus
SKNSRSGYET

SEQ ID NO: 368121 - protein, 10 aa, Influenza virus
KNSRSGYETF

SEQ ID NO: 368122 - protein, 10 aa, Influenza virus
DSRSGYETFK

SEQ ID NO: 368123 - protein, 10 aa, Influenza virus
SRSGYETFKV

SEQ ID NO: 368124 - protein, 10 aa, Influenza virus
RSGYETFKVI

SEQ ID NO: 368125 - protein, 10 aa, Influenza virus
NWSGYSGVFS

SEQ ID NO: 368126 - protein, 10 aa, Influenza virus
WSGYSGVFSV

SEQ ID NO: 368127 - protein, 10 aa, Influenza virus
SGYSGVFSVE

SEQ ID NO: 368128 - protein, 10 aa, Influenza virus
GCINRCFYVE

SEQ ID NO: 368129 - protein, 10 aa, Influenza virus
CVNRCFYVEL

SEQ ID NO: 368130 - protein, 10 aa, Influenza virus
VNRCFYVELI

SEQ ID NO: 368131 - protein, 10 aa, Influenza virus
FYVEMIRGRP

SEQ ID NO: 368132 - protein, 10 aa, Influenza virus
YVELIRGRPK

SEQ ID NO: 368133 - protein, 10 aa, Influenza virus
VELIRGRPKE

SEQ ID NO: 368134 - protein, 10 aa, Influenza virus
RVWWTSNSII

SEQ ID NO: 368135 - protein, 10 aa, Influenza virus
VWWTSNSIVA

SEQ ID NO: 368136 - protein, 10 aa, Influenza virus
WWTSNSIVAF

SEQ ID NO: 368137 - protein, 10 aa, Influenza virus
WTSNSIVAFC

SEQ ID NO: 368138 - protein, 10 aa, Influenza virus
TSNSIVAFCG

SEQ ID NO: 368139 - protein, 10 aa, Influenza virus
SNSIVAFCGT

SEQ ID NO: 368140 - protein, 10 aa, Influenza virus
NSIVAFCGTS

SEQ ID NO: 368141 - protein, 10 aa, Influenza virus
SIVAFCGTSG

SEQ ID NO: 368142 - protein, 10 aa, Influenza virus
IVAFCGTSGT

SEQ ID NO: 368143 - protein, 10 aa, Influenza virus
VAFCGTSGTY

SEQ ID NO: 368144 - protein, 10 aa, Influenza virus
AFCGTSGTYG

SEQ ID NO: 368145 - protein, 10 aa, Influenza virus
GTGSWPDGAD

SEQ ID NO: 368146 - protein, 10 aa, Influenza virus
TGSWPDGADI

SEQ ID NO: 368147 - protein, 10 aa, Influenza virus
GSWPDGADIN

SEQ ID NO: 368148 - protein, 10 aa, Influenza virus
SWPDGANINL

SEQ ID NO: 368149 - protein, 10 aa, Influenza virus
WPDGANINLM

SEQ ID NO: 368150 - protein, 10 aa, Influenza virus
PDGANINLMP

SEQ ID NO: 368151 - protein, 10 aa, Influenza virus
RSDKICIGYH

SEQ ID NO: 368152 - protein, 10 aa, Influenza virus
SDRICIGYHA

SEQ ID NO: 368153 - protein, 10 aa, Influenza virus
DRICIGYHAN

SEQ ID NO: 368154 - protein, 10 aa, Influenza virus
RICIGYHANN

SEQ ID NO: 368155 - protein, 10 aa, Influenza virus
GYHANNSTTK

SEQ ID NO: 368156 - protein, 10 aa, Influenza virus
YHANNSTTKV

SEQ ID NO: 368157 - protein, 10 aa, Influenza virus
HANNSTTKVD

SEQ ID NO: 368158 - protein, 10 aa, Influenza virus
ANNSTTKVDT

SEQ ID NO: 368159 - protein, 10 aa, Influenza virus
NNSTTKVDTI

SEQ ID NO: 368160 - protein, 10 aa, Influenza virus
VDTLLEKNVT

SEQ ID NO: 368161 - protein, 10 aa, Influenza virus
DTLLEKNVTV

SEQ ID NO: 368162 - protein, 10 aa, Influenza virus
TLLEKNVTVT

SEQ ID NO: 368163 - protein, 10 aa, Influenza virus
LLEKNVTVTH

SEQ ID NO: 368164 - protein, 10 aa, Influenza virus
LERNVTVTHS

SEQ ID NO: 368165 - protein, 10 aa, Influenza virus
EKNVTVTHSI

SEQ ID NO: 368166 - protein, 10 aa, Influenza virus
KNVTVTHSIE

SEQ ID NO: 368167 - protein, 10 aa, Influenza virus
NVTVTHSIEL

SEQ ID NO: 368168 - protein, 10 aa, Influenza virus
VTVTHSIELL

SEQ ID NO: 368169 - protein, 10 aa, Influenza virus
TVTHSIELLE

SEQ ID NO: 368170 - protein, 10 aa, Influenza virus
VTHSVELLES

SEQ ID NO: 368171 - protein, 10 aa, Influenza virus
EGWILGNPRC

SEQ ID NO: 368172 - protein, 10 aa, Influenza virus
GWILGNPRCD

SEQ ID NO: 368173 - protein, 10 aa, Influenza virus
PSFYRNLLWI

SEQ ID NO: 368174 - protein, 10 aa, Influenza virus
VLYFWGVHHP

SEQ ID NO: 368175 - protein, 10 aa, Influenza virus
WSILKPGETL

SEQ ID NO: 368176 - protein, 10 aa, Influenza virus
LRPGETLNVE

SEQ ID NO: 368177 - protein, 10 aa, Influenza virus
RPGETLNVES

SEQ ID NO: 368178 - protein, 10 aa, Influenza virus
PGETLKVESN

SEQ ID NO: 368179 - protein, 10 aa, Influenza virus
GETLKVESNG

SEQ ID NO: 368180 - protein, 10 aa, Influenza virus
ETLKVESNGN

SEQ ID NO: 368181 - protein, 10 aa, Influenza virus
TLKVESNGNL

SEQ ID NO: 368182 - protein, 10 aa, Influenza virus
LNVESNGNLV

SEQ ID NO: 368183 - protein, 10 aa, Influenza virus
NVESNGNLVA

SEQ ID NO: 368184 - protein, 10 aa, Influenza virus
VESNGNLVAP

SEQ ID NO: 368185 - protein, 10 aa, Influenza virus
ESNGNLVAPW

SEQ ID NO: 368186 - protein, 10 aa, Influenza virus
SNGNLVAPWY

SEQ ID NO: 368187 - protein, 10 aa, Influenza virus
NGNLVAPWYA

SEQ ID NO: 368188 - protein, 10 aa, Influenza virus
GNLVAPWYAY

SEQ ID NO: 368189 - protein, 10 aa, Influenza virus
NLIAPWYAYR

SEQ ID NO: 368190 - protein, 10 aa, Influenza virus
TNKTFQNISP

SEQ ID NO: 368191 - protein, 10 aa, Influenza virus
NKTFQNISPV

SEQ ID NO: 368192 - protein, 10 aa, Influenza virus
KTFQNISPVW

SEQ ID NO: 368193 - protein, 10 aa, Influenza virus
FQNISPVWIG

SEQ ID NO: 368194 - protein, 10 aa, Influenza virus
SLKLATGLRN

SEQ ID NO: 368195 - protein, 10 aa, Influenza virus
LKLATGLRNV

SEQ ID NO: 368196 - protein, 10 aa, Influenza virus
KLATGLRNVP

SEQ ID NO: 368197 - protein, 10 aa, Influenza virus
LATGLRNIPQ

SEQ ID NO: 368198 - protein, 10 aa, Influenza virus
TRGIFGAIAG

SEQ ID NO: 368199 - protein, 10 aa, Influenza virus
RGIFGAIAGF

SEQ ID NO: 368200 - protein, 10 aa, Influenza virus
GIFGAIAGFI

SEQ ID NO: 368201 - protein, 10 aa, Influenza virus
IFGAIAGFIE

SEQ ID NO: 368202 - protein, 10 aa, Influenza virus
GFIEGGWTGL

SEQ ID NO: 368203 - protein, 10 aa, Influenza virus
FIEGGWTGMV

SEQ ID NO: 368204 - protein, 10 aa, Influenza virus
IEGGWTGMVD

SEQ ID NO: 368205 - protein, 10 aa, Influenza virus
EGGWTGMVDG

SEQ ID NO: 368206 - protein, 10 aa, Influenza virus
GGWTGMVDGW

SEQ ID NO: 368207 - protein, 10 aa, Influenza virus
GWTGMVDGWY

SEQ ID NO: 368208 - protein, 10 aa, Influenza virus
WTGMVDGWYG

SEQ ID NO: 368209 - protein, 10 aa, Influenza virus
TGMVDGWYGY

SEQ ID NO: 368210 - protein, 10 aa, Influenza virus
GMVDGWYGYH

SEQ ID NO: 368211 - protein, 10 aa, Influenza virus
MVDGWYGYHH

SEQ ID NO: 368212 - protein, 10 aa, Influenza virus
VDGWYGYHHE

SEQ ID NO: 368213 - protein, 10 aa, Influenza virus
SQGSGYAADR

SEQ ID NO: 368214 - protein, 10 aa, Influenza virus
QGSGYAADRE

SEQ ID NO: 368215 - protein, 10 aa, Influenza virus
GSGYAADRES

SEQ ID NO: 368216 - protein, 10 aa, Influenza virus
SGYAADREST

SEQ ID NO: 368217 - protein, 10 aa, Influenza virus
GYAADRESTQ

SEQ ID NO: 368218 - protein, 10 aa, Influenza virus
YAADRESTQK

SEQ ID NO: 368219 - protein, 10 aa, Influenza virus
AADRESTQKA

SEQ ID NO: 368220 - protein, 10 aa, Influenza virus
HEFSSLERRI

SEQ ID NO: 368221 - protein, 10 aa, Influenza virus
DGFLNVWTYN

SEQ ID NO: 368222 - protein, 10 aa, Influenza virus
GFLNVWTYNA

SEQ ID NO: 368223 - protein, 10 aa, Influenza virus
FLNVWTYNAE

SEQ ID NO: 368224 - protein, 10 aa, Influenza virus
LNVWTYNAEL

SEQ ID NO: 368225 - protein, 10 aa, Influenza virus
NVWTYNAELL

SEQ ID NO: 368226 - protein, 10 aa, Influenza virus
VWTYNAELLI

SEQ ID NO: 368227 - protein, 10 aa, Influenza virus
WTYNAELLIL

SEQ ID NO: 368228 - protein, 10 aa, Influenza virus
TYNAELLILL

SEQ ID NO: 368229 - protein, 10 aa, Influenza virus
YNAELLILLE

SEQ ID NO: 368230 - protein, 10 aa, Influenza virus
NAELLILLEN

SEQ ID NO: 368231 - protein, 10 aa, Influenza virus
AELLILLENE

SEQ ID NO: 368232 - protein, 10 aa, Influenza virus
ELLILLENER

SEQ ID NO: 368233 - protein, 10 aa, Influenza virus
LLILLENERT

SEQ ID NO: 368234 - protein, 10 aa, Influenza virus
LILLENERTL

SEQ ID NO: 368235 - protein, 10 aa, Influenza virus
ILLENERTLD

SEQ ID NO: 368236 - protein, 10 aa, Influenza virus
ENERTLDMHD

SEQ ID NO: 368237 - protein, 10 aa, Influenza virus
NERTLDMHDA

SEQ ID NO: 368238 - protein, 10 aa, Influenza virus
ERTLDMHDAN

SEQ ID NO: 368239 - protein, 10 aa, Influenza virus
RTLDMHDANV

SEQ ID NO: 368240 - protein, 10 aa, Influenza virus
TLDMHDANVK

SEQ ID NO: 368241 - protein, 10 aa, Influenza virus
LRDNAKDLGN

SEQ ID NO: 368242 - protein, 10 aa, Influenza virus
RDNAKDLGNG

SEQ ID NO: 368243 - protein, 10 aa, Influenza virus
DNAKDLGNGC

SEQ ID NO: 368244 - protein, 10 aa, Influenza virus
NAKDLGNGCF

SEQ ID NO: 368245 - protein, 10 aa, Influenza virus
AKDLGNGCFE

SEQ ID NO: 368246 - protein, 10 aa, Influenza virus
KDLGNGCFEF

SEQ ID NO: 368247 - protein, 10 aa, Influenza virus
ILGNGCFEFW

SEQ ID NO: 368248 - protein, 10 aa, Influenza virus
GCFEFWHKCN

SEQ ID NO: 368249 - protein, 10 aa, Influenza virus
CFEFWHKCDD

SEQ ID NO: 368250 - protein, 10 aa, Influenza virus
FEFWHKCDDE

SEQ ID NO: 368251 - protein, 10 aa, Influenza virus
EFWHKCDDEC

SEQ ID NO: 368252 - protein, 10 aa, Influenza virus
KNGTYNYPKY

SEQ ID NO: 368253 - protein, 10 aa, Influenza virus
NGTYNYPKYQ

SEQ ID NO: 368254 - protein, 10 aa, Influenza virus
DVYQILAIYS

SEQ ID NO: 368255 - protein, 10 aa, Influenza virus
IYQILAIYST

SEQ ID NO: 368256 - protein, 10 aa, Influenza virus
YQILSIYSTV

SEQ ID NO: 368257 - protein, 10 aa, Influenza virus
QILAIYSTIS

SEQ ID NO: 368258 - protein, 10 aa, Influenza virus
ILAIYSTISS

SEQ ID NO: 368259 - protein, 10 aa, Influenza virus
LAIYSTISSS

SEQ ID NO: 368260 - protein, 10 aa, Influenza virus
AIYSTISSSL

SEQ ID NO: 368261 - protein, 10 aa, Influenza virus
IYSTISSSLV

SEQ ID NO: 368262 - protein, 10 aa, Influenza virus
YSTISSSLVL

SEQ ID NO: 368263 - protein, 10 aa, Influenza virus
STVSSSLVLA

SEQ ID NO: 368264 - protein, 10 aa, Influenza virus
TVSSSLVLAG

SEQ ID NO: 368265 - protein, 10 aa, Influenza virus
VSSSLVLAGL

SEQ ID NO: 368266 - protein, 10 aa, Influenza virus
SSSLVLVGLV

SEQ ID NO: 368267 - protein, 10 aa, Influenza virus
WMCSNSSMQC

SEQ ID NO: 368268 - protein, 10 aa, Influenza virus
MCSNGSMQCK

SEQ ID NO: 368269 - protein, 10 aa, Influenza virus
NGSMQCKICI

SEQ ID NO: 368270 - protein, 10 aa, Influenza virus
SKSRGYKMNN

SEQ ID NO: 368271 - protein, 10 aa, Influenza virus
KSRGYKMNNQ

SEQ ID NO: 368272 - protein, 10 aa, Influenza virus
SRGYKMNNQI

SEQ ID NO: 368273 - protein, 10 aa, Influenza virus
RGYKMNNQIL

SEQ ID NO: 368274 - protein, 10 aa, Influenza virus
ADKICLGHHA

SEQ ID NO: 368275 - protein, 10 aa, Influenza virus
TLTERGVEVV

SEQ ID NO: 368276 - protein, 10 aa, Influenza virus
LTERGVEVVN

SEQ ID NO: 368277 - protein, 10 aa, Influenza virus
TERGVEVVNA

SEQ ID NO: 368278 - protein, 10 aa, Influenza virus
ERGVEVVNAT

SEQ ID NO: 368279 - protein, 10 aa, Influenza virus
RGVEVVNATE

SEQ ID NO: 368280 - protein, 10 aa, Influenza virus
GVEVVNATET

SEQ ID NO: 368281 - protein, 10 aa, Influenza virus
VEVVNATETV

SEQ ID NO: 368282 - protein, 10 aa, Influenza virus
EVVDATETVE

SEQ ID NO: 368283 - protein, 10 aa, Influenza virus
VVNATETVER

SEQ ID NO: 368284 - protein, 10 aa, Influenza virus
GPPQCDLFLE

SEQ ID NO: 368285 - protein, 10 aa, Influenza virus
PPQCDLFLEF

SEQ ID NO: 368286 - protein, 10 aa, Influenza virus
PSFYAEMKWL

SEQ ID NO: 368287 - protein, 10 aa, Influenza virus
SFYAEMEWLL

SEQ ID NO: 368288 - protein, 10 aa, Influenza virus
FYAEMEWLLS

SEQ ID NO: 368289 - protein, 10 aa, Influenza virus
YAEMKWLLSS

SEQ ID NO: 368290 - protein, 10 aa, Influenza virus
GQSGRIDFYW

SEQ ID NO: 368291 - protein, 10 aa, Influenza virus
FSFNGAFIAP

SEQ ID NO: 368292 - protein, 10 aa, Influenza virus
FNGAFIAPNR

SEQ ID NO: 368293 - protein, 10 aa, Influenza virus
NGAFIAPDRV

SEQ ID NO: 368294 - protein, 10 aa, Influenza virus
GAFIAPDRVS

SEQ ID NO: 368295 - protein, 10 aa, Influenza virus
AFIAPDRVSF

SEQ ID NO: 368296 - protein, 10 aa, Influenza virus
SLLLATGMKN

SEQ ID NO: 368297 - protein, 10 aa, Influenza virus
LLLATGMKNV

SEQ ID NO: 368298 - protein, 10 aa, Influenza virus
LLATGMKNVP

SEQ ID NO: 368299 - protein, 10 aa, Influenza virus
LATGMKNVPE

SEQ ID NO: 368300 - protein, 10 aa, Influenza virus
AHKQLTHHMR

SEQ ID NO: 368301 - protein, 10 aa, Influenza virus
RKKRGLFGAK

SEQ ID NO: 368302 - protein, 10 aa, Influenza virus
RMTRGLFGAI

SEQ ID NO: 368303 - protein, 10 aa, Influenza virus
ETRGLFGAIA

SEQ ID NO: 368304 - protein, 10 aa, Influenza virus
TRGLFGAIAG

SEQ ID NO: 368305 - protein, 10 aa, Influenza virus
FIENGWEGLV

SEQ ID NO: 368306 - protein, 10 aa, Influenza virus
IENGWEGLIN

SEQ ID NO: 368307 - protein, 10 aa, Influenza virus
ENGWEGLING

SEQ ID NO: 368308 - protein, 10 aa, Influenza virus
NGWEGLINGW

SEQ ID NO: 368309 - protein, 10 aa, Influenza virus
GWEGLINGWY

SEQ ID NO: 368310 - protein, 10 aa, Influenza virus
WEGLINGWYG

SEQ ID NO: 368311 - protein, 10 aa, Influenza virus
EGLINGWYGF

SEQ ID NO: 368312 - protein, 10 aa, Influenza virus
GLINGWYGFR

SEQ ID NO: 368313 - protein, 10 aa, Influenza virus
LINGWYGFRH

SEQ ID NO: 368314 - protein, 10 aa, Influenza virus
INGWYGFRHQ

SEQ ID NO: 368315 - protein, 10 aa, Influenza virus
NGWYGFRHQN

SEQ ID NO: 368316 - protein, 10 aa, Influenza virus
GWYGYRHQNA

SEQ ID NO: 368317 - protein, 10 aa, Influenza virus
WYGYRHQNAQ

SEQ ID NO: 368318 - protein, 10 aa, Influenza virus
YGYRHQNAQG

SEQ ID NO: 368319 - protein, 10 aa, Influenza virus
GYRHQNAQGE

SEQ ID NO: 368320 - protein, 10 aa, Influenza virus
YRHQNAQGEG

SEQ ID NO: 368321 - protein, 10 aa, Influenza virus
RHQNAQGEGI

SEQ ID NO: 368322 - protein, 10 aa, Influenza virus
HQNAQGEGIA

SEQ ID NO: 368323 - protein, 10 aa, Influenza virus
QNAQGEGIAA

SEQ ID NO: 368324 - protein, 10 aa, Influenza virus
NAQGEGIAAD

SEQ ID NO: 368325 - protein, 10 aa, Influenza virus
AQGEGIAADY

SEQ ID NO: 368326 - protein, 10 aa, Influenza virus
QGEGIAADYK

SEQ ID NO: 368327 - protein, 10 aa, Influenza virus
GEGIAADYKS

SEQ ID NO: 368328 - protein, 10 aa, Influenza virus
EGIAADYKST

SEQ ID NO: 368329 - protein, 10 aa, Influenza virus
GIAADYKSTQ

SEQ ID NO: 368330 - protein, 10 aa, Influenza virus
IAADYKSTQS

SEQ ID NO: 368331 - protein, 10 aa, Influenza virus
ADYKSTQSAV

SEQ ID NO: 368332 - protein, 10 aa, Influenza virus
DYKSTQSAIN

SEQ ID NO: 368333 - protein, 10 aa, Influenza virus
YKSTQSAINQ

SEQ ID NO: 368334 - protein, 10 aa, Influenza virus
KSTQSAIDQV

SEQ ID NO: 368335 - protein, 10 aa, Influenza virus
STQSAIDQVT

SEQ ID NO: 368336 - protein, 10 aa, Influenza virus
TQSAIDQVTG

SEQ ID NO: 368337 - protein, 10 aa, Influenza virus
QSAIDQVTGK

SEQ ID NO: 368338 - protein, 10 aa, Influenza virus
SAIDQVTGKL

SEQ ID NO: 368339 - protein, 10 aa, Influenza virus
AIDQVTGKLN

SEQ ID NO: 368340 - protein, 10 aa, Influenza virus
IDQVTGKLNR

SEQ ID NO: 368341 - protein, 10 aa, Influenza virus
DQVTGKLNRL

SEQ ID NO: 368342 - protein, 10 aa, Influenza virus
QVTGKLNRLI

SEQ ID NO: 368343 - protein, 10 aa, Influenza virus
EKQIGNVINW

SEQ ID NO: 368344 - protein, 10 aa, Influenza virus
KQIGNVINWT

SEQ ID NO: 368345 - protein, 10 aa, Influenza virus
QIGNVINWTQ

SEQ ID NO: 368346 - protein, 10 aa, Influenza virus
IGNVINWTQD

SEQ ID NO: 368347 - protein, 10 aa, Influenza virus
GNVINWTRDA

SEQ ID NO: 368348 - protein, 10 aa, Influenza virus
WSYNAEFLVA

SEQ ID NO: 368349 - protein, 10 aa, Influenza virus
AEFLVAVENQ

SEQ ID NO: 368350 - protein, 10 aa, Influenza virus
EFLVAVENQH

SEQ ID NO: 368351 - protein, 10 aa, Influenza virus
FLVAVENQHT

SEQ ID NO: 368352 - protein, 10 aa, Influenza virus
LVAVENQHTI

SEQ ID NO: 368353 - protein, 10 aa, Influenza virus
VAVENQHTID

SEQ ID NO: 368354 - protein, 10 aa, Influenza virus
AVENQHTIDL

SEQ ID NO: 368355 - protein, 10 aa, Influenza virus
MENQHTIDLT

SEQ ID NO: 368356 - protein, 10 aa, Influenza virus
ENQHTIDLTD

SEQ ID NO: 368357 - protein, 10 aa, Influenza virus
NQHTIDLTDS

SEQ ID NO: 368358 - protein, 10 aa, Influenza virus
QHTIDLTDSE

SEQ ID NO: 368359 - protein, 10 aa, Influenza virus
HTIDLTDSEM

SEQ ID NO: 368360 - protein, 10 aa, Influenza virus
SEMSKLYERV

SEQ ID NO: 368361 - protein, 10 aa, Influenza virus
VKKQLRENAE

SEQ ID NO: 368362 - protein, 10 aa, Influenza virus
KKQLRENAEE

SEQ ID NO: 368363 - protein, 10 aa, Influenza virus
RQLRENAEED

SEQ ID NO: 368364 - protein, 10 aa, Influenza virus
LLRENAEEDG

SEQ ID NO: 368365 - protein, 10 aa, Influenza virus
LRENAEEDGN

SEQ ID NO: 368366 - protein, 10 aa, Influenza virus
RENAEEDGNG

SEQ ID NO: 368367 - protein, 10 aa, Influenza virus
ENAEEDGNGC

SEQ ID NO: 368368 - protein, 10 aa, Influenza virus
NAEEDGNGCF

SEQ ID NO: 368369 - protein, 10 aa, Influenza virus
AEEDGNGCFE

SEQ ID NO: 368370 - protein, 10 aa, Influenza virus
EEDGNGCFEI

SEQ ID NO: 368371 - protein, 10 aa, Influenza virus
EDGNGCFEIF

SEQ ID NO: 368372 - protein, 10 aa, Influenza virus
DGNGCFEIFH

SEQ ID NO: 368373 - protein, 10 aa, Influenza virus
GNGCFEIFHQ

SEQ ID NO: 368374 - protein, 10 aa, Influenza virus
NGCFEIFHQC

SEQ ID NO: 368375 - protein, 10 aa, Influenza virus
GCFEIFHQCD

SEQ ID NO: 368376 - protein, 10 aa, Influenza virus
CFEIFHQCDN

SEQ ID NO: 368377 - protein, 10 aa, Influenza virus
CMASIRNNTY

SEQ ID NO: 368378 - protein, 10 aa, Influenza virus
MASIRNNTYD

SEQ ID NO: 368379 - protein, 10 aa, Influenza virus
ASIRNNTYDH

SEQ ID NO: 368380 - protein, 10 aa, Influenza virus
SGYKDVILWF

SEQ ID NO: 368381 - protein, 10 aa, Influenza virus
GYKDVILWFS

SEQ ID NO: 368382 - protein, 10 aa, Influenza virus
YKDVILWFSF

SEQ ID NO: 368383 - protein, 10 aa, Influenza virus
KDVILWFSFG

SEQ ID NO: 368384 - protein, 10 aa, Influenza virus
DVILWFSFGA

SEQ ID NO: 368385 - protein, 10 aa, Influenza virus
VILWFSFGAS

SEQ ID NO: 368386 - protein, 10 aa, Influenza virus
WFSFGASCFI

SEQ ID NO: 368387 - protein, 10 aa, Influenza virus
FSFGASCFIL

SEQ ID NO: 368388 - protein, 10 aa, Influenza virus
KNGNMQCTIC

SEQ ID NO: 368389 - protein, 10 aa, Influenza virus
NGNMQCTICI

SEQ ID NO: 368390 - protein, 10 aa, Influenza virus
VKGDKICLGH

SEQ ID NO: 368391 - protein, 10 aa, Influenza virus
NADKICLGHH

SEQ ID NO: 368392 - protein, 10 aa, Influenza virus
ADKICLGHHA

SEQ ID NO: 368393 - protein, 10 aa, Influenza virus
KICLGHHAVS

SEQ ID NO: 368394 - protein, 10 aa, Influenza virus
ICLGHHAVSN

SEQ ID NO: 368395 - protein, 10 aa, Influenza virus
CLGHHAVSNG

SEQ ID NO: 368396 - protein, 10 aa, Influenza virus
LGHHAVSNGT

SEQ ID NO: 368397 - protein, 10 aa, Influenza virus
GHHAVSNGTK

SEQ ID NO: 368398 - protein, 10 aa, Influenza virus
HHAVSNGTKV

SEQ ID NO: 368399 - protein, 10 aa, Influenza virus
HAVSNGTKVN

SEQ ID NO: 368400 - protein, 10 aa, Influenza virus
AVSNGTKVNT

SEQ ID NO: 368401 - protein, 10 aa, Influenza virus
VSNGTKVNTL

SEQ ID NO: 368402 - protein, 10 aa, Influenza virus
SNGTKVNTLT

SEQ ID NO: 368403 - protein, 10 aa, Influenza virus
NGTKINTLTE

SEQ ID NO: 368404 - protein, 10 aa, Influenza virus
GTKVNTLTEK

SEQ ID NO: 368405 - protein, 10 aa, Influenza virus
TKVNTLTEKG

SEQ ID NO: 368406 - protein, 10 aa, Influenza virus
KVNTLTEKGI

SEQ ID NO: 368407 - protein, 10 aa, Influenza virus
VNTLTEKGIE

SEQ ID NO: 368408 - protein, 10 aa, Influenza virus
NTLTEKGIEV

SEQ ID NO: 368409 - protein, 10 aa, Influenza virus
TLTEKGIEVV

SEQ ID NO: 368410 - protein, 10 aa, Influenza virus
LTEKGIEVVN

SEQ ID NO: 368411 - protein, 10 aa, Influenza virus
TEKGIEVVNA

SEQ ID NO: 368412 - protein, 10 aa, Influenza virus
EKGIEVVNAT

SEQ ID NO: 368413 - protein, 10 aa, Influenza virus
KGIEVVNATE

SEQ ID NO: 368414 - protein, 10 aa, Influenza virus
GVEVVNATET

SEQ ID NO: 368415 - protein, 10 aa, Influenza virus
VEVVNATETV

SEQ ID NO: 368416 - protein, 10 aa, Influenza virus
VVNATETVER

SEQ ID NO: 368417 - protein, 10 aa, Influenza virus
VNATETVETT

SEQ ID NO: 368418 - protein, 10 aa, Influenza virus
DLGRCGLLGT

SEQ ID NO: 368419 - protein, 10 aa, Influenza virus
CGLLGTLTGP

SEQ ID NO: 368420 - protein, 10 aa, Influenza virus
GLLGTLTGPP

SEQ ID NO: 368421 - protein, 10 aa, Influenza virus
TGPPQCDQFL

SEQ ID NO: 368422 - protein, 10 aa, Influenza virus
GPPQCDKFLE

SEQ ID NO: 368423 - protein, 10 aa, Influenza virus
PPQCDKFLEF

SEQ ID NO: 368424 - protein, 10 aa, Influenza virus
ADLIIERREG

SEQ ID NO: 368425 - protein, 10 aa, Influenza virus
DLIIERREGN

SEQ ID NO: 368426 - protein, 10 aa, Influenza virus
LIIERREGND

SEQ ID NO: 368427 - protein, 10 aa, Influenza virus
CYPGRFTNEE

SEQ ID NO: 368428 - protein, 10 aa, Influenza virus
FVNEEALRQI

SEQ ID NO: 368429 - protein, 10 aa, Influenza virus
NEEALRQILR

SEQ ID NO: 368430 - protein, 10 aa, Influenza virus
LRQILRGSGG

SEQ ID NO: 368431 - protein, 10 aa, Influenza virus
RQILRGSGGI

SEQ ID NO: 368432 - protein, 10 aa, Influenza virus
GFTYNGIRTN

SEQ ID NO: 368433 - protein, 10 aa, Influenza virus
FTYNGIRTNG

SEQ ID NO: 368434 - protein, 10 aa, Influenza virus
TYNGIRTNGA

SEQ ID NO: 368435 - protein, 10 aa, Influenza virus
RLGSSFYAEM

SEQ ID NO: 368436 - protein, 10 aa, Influenza virus
LGSSFYAEMK

SEQ ID NO: 368437 - protein, 10 aa, Influenza virus
GSSFYAELKW

SEQ ID NO: 368438 - protein, 10 aa, Influenza virus
YAEMKWLLSS

SEQ ID NO: 368439 - protein, 10 aa, Influenza virus
AEMKWLLSNT

SEQ ID NO: 368440 - protein, 10 aa, Influenza virus
EMKWLLSNTD

SEQ ID NO: 368441 - protein, 10 aa, Influenza virus
MKWLLSNTDN

SEQ ID NO: 368442 - protein, 10 aa, Influenza virus
ALIIWGIHHS

SEQ ID NO: 368443 - protein, 10 aa, Influenza virus
EQTKLYGNGN

SEQ ID NO: 368444 - protein, 10 aa, Influenza virus
QTKLYGNGNK

SEQ ID NO: 368445 - protein, 10 aa, Influenza virus
TKLYGNGNKL

SEQ ID NO: 368446 - protein, 10 aa, Influenza virus
KLYGSGNKLV

SEQ ID NO: 368447 - protein, 10 aa, Influenza virus
PGARPQVNGQ

SEQ ID NO: 368448 - protein, 10 aa, Influenza virus
GARPQVNGQS

SEQ ID NO: 368449 - protein, 10 aa, Influenza virus
ARPQVNGQSG

SEQ ID NO: 368450 - protein, 10 aa, Influenza virus
RPQVNGQSGR

SEQ ID NO: 368451 - protein, 10 aa, Influenza virus
PQVNGQFGRI

SEQ ID NO: 368452 - protein, 10 aa, Influenza virus
QVNGQFGRID

SEQ ID NO: 368453 - protein, 10 aa, Influenza virus
VNGQFGRIDF

SEQ ID NO: 368454 - protein, 10 aa, Influenza virus
NGQFGRIDFH

SEQ ID NO: 368455 - protein, 10 aa, Influenza virus
GQFGRIDFHW

SEQ ID NO: 368456 - protein, 10 aa, Influenza virus
QFGRIDFHWL

SEQ ID NO: 368457 - protein, 10 aa, Influenza virus
SGRIDFHWLM

SEQ ID NO: 368458 - protein, 10 aa, Influenza virus
GRIDFHWLML

SEQ ID NO: 368459 - protein, 10 aa, Influenza virus
NDTVTFSFNG

SEQ ID NO: 368460 - protein, 10 aa, Influenza virus
DTVTFSFNGA

SEQ ID NO: 368461 - protein, 10 aa, Influenza virus
TVTFSFNGAF

SEQ ID NO: 368462 - protein, 10 aa, Influenza virus
VTFSFNGAFI

SEQ ID NO: 368463 - protein, 10 aa, Influenza virus
TFSFNGAFIA

SEQ ID NO: 368464 - protein, 10 aa, Influenza virus
FSFNGAFIAP

SEQ ID NO: 368465 - protein, 10 aa, Influenza virus
SFNGAFIAPD

SEQ ID NO: 368466 - protein, 10 aa, Influenza virus
FNGAFIAPNR

SEQ ID NO: 368467 - protein, 10 aa, Influenza virus
NGAFIAPNRA

SEQ ID NO: 368468 - protein, 10 aa, Influenza virus
GAFIAPNRAS

SEQ ID NO: 368469 - protein, 10 aa, Influenza virus
AFIAPNRASF

SEQ ID NO: 368470 - protein, 10 aa, Influenza virus
FIAPDRASFL

SEQ ID NO: 368471 - protein, 10 aa, Influenza virus
IAPDRASFLR

SEQ ID NO: 368472 - protein, 10 aa, Influenza virus
APDRASFLRG

SEQ ID NO: 368473 - protein, 10 aa, Influenza virus
GGTIISNLPF

SEQ ID NO: 368474 - protein, 10 aa, Influenza virus
GTIISNLPFQ

SEQ ID NO: 368475 - protein, 10 aa, Influenza virus
TIISNLPFQN

SEQ ID NO: 368476 - protein, 10 aa, Influenza virus
IISNLPFQNI

SEQ ID NO: 368477 - protein, 10 aa, Influenza virus
ISNLPFQNIN

SEQ ID NO: 368478 - protein, 10 aa, Influenza virus
SSLPFQNINS

SEQ ID NO: 368479 - protein, 10 aa, Influenza virus
TVGRCPRYVK

SEQ ID NO: 368480 - protein, 10 aa, Influenza virus
VGRCPRYVKQ

SEQ ID NO: 368481 - protein, 10 aa, Influenza virus
VKQTSLLLAT

SEQ ID NO: 368482 - protein, 10 aa, Influenza virus
KQTSLLLATG

SEQ ID NO: 368483 - protein, 10 aa, Influenza virus
QTSLLLATGM

SEQ ID NO: 368484 - protein, 10 aa, Influenza virus
TSLLLATGMR

SEQ ID NO: 368485 - protein, 10 aa, Influenza virus
SLLLATGMKN

SEQ ID NO: 368486 - protein, 10 aa, Influenza virus
LLLATGMKNV

SEQ ID NO: 368487 - protein, 10 aa, Influenza virus
LLATGMKNVP

SEQ ID NO: 368488 - protein, 10 aa, Influenza virus
LATGMKNVPE

SEQ ID NO: 368489 - protein, 10 aa, Influenza virus
ATGMRNVPEN

SEQ ID NO: 368490 - protein, 10 aa, Influenza virus
TGMRNVPENP

SEQ ID NO: 368491 - protein, 10 aa, Influenza virus
GMRNVPENPK

SEQ ID NO: 368492 - protein, 10 aa, Influenza virus
PKKRGLFGAI

SEQ ID NO: 368493 - protein, 10 aa, Influenza virus
KKRGLFGAIA

SEQ ID NO: 368494 - protein, 10 aa, Influenza virus
KRGLFGAIAG

SEQ ID NO: 368495 - protein, 10 aa, Influenza virus
FIENGWEGLV

SEQ ID NO: 368496 - protein, 10 aa, Influenza virus
IENGWEGLID

SEQ ID NO: 368497 - protein, 10 aa, Influenza virus
ENGWEGLIDG

SEQ ID NO: 368498 - protein, 10 aa, Influenza virus
NGWEGLIDGW

SEQ ID NO: 368499 - protein, 10 aa, Influenza virus
GWEGLIDGWY

SEQ ID NO: 368500 - protein, 10 aa, Influenza virus
WEGLIDGWYG

SEQ ID NO: 368501 - protein, 10 aa, Influenza virus
EGLIDGWYGF

SEQ ID NO: 368502 - protein, 10 aa, Influenza virus
GLIDGWYGFR

SEQ ID NO: 368503 - protein, 10 aa, Influenza virus
LIDGWYGFRH

SEQ ID NO: 368504 - protein, 10 aa, Influenza virus
IDGWYGFRHQ

SEQ ID NO: 368505 - protein, 10 aa, Influenza virus
DGWYGFRHQN

SEQ ID NO: 368506 - protein, 10 aa, Influenza virus
GWYGFRHQNT

SEQ ID NO: 368507 - protein, 10 aa, Influenza virus
WYGFRHQNTQ

SEQ ID NO: 368508 - protein, 10 aa, Influenza virus
YGFRHQNTQG

SEQ ID NO: 368509 - protein, 10 aa, Influenza virus
GFRHQNTQGE

SEQ ID NO: 368510 - protein, 10 aa, Influenza virus
RHQNTQGEGT

SEQ ID NO: 368511 - protein, 10 aa, Influenza virus
HQNTQGEGTA

SEQ ID NO: 368512 - protein, 10 aa, Influenza virus
QNTQGEGTAA

SEQ ID NO: 368513 - protein, 10 aa, Influenza virus
NTQGEGTAAD

SEQ ID NO: 368514 - protein, 10 aa, Influenza virus
TQGEGTAADY

SEQ ID NO: 368515 - protein, 10 aa, Influenza virus
ITGKLNRLID

SEQ ID NO: 368516 - protein, 10 aa, Influenza virus
TGKLNRLIDK

SEQ ID NO: 368517 - protein, 10 aa, Influenza virus
GKLNRLIDKT

SEQ ID NO: 368518 - protein, 10 aa, Influenza virus
KLNRLIDKTN

SEQ ID NO: 368519 - protein, 10 aa, Influenza virus
LNRLIDKTNQ

SEQ ID NO: 368520 - protein, 10 aa, Influenza virus
NRLIDKTNQQ

SEQ ID NO: 368521 - protein, 10 aa, Influenza virus
RLIDKTNQQF

SEQ ID NO: 368522 - protein, 10 aa, Influenza virus
LIDKTNQQFE

SEQ ID NO: 368523 - protein, 10 aa, Influenza virus
IDKTNQQFEL

SEQ ID NO: 368524 - protein, 10 aa, Influenza virus
DKTNQQFELI

SEQ ID NO: 368525 - protein, 10 aa, Influenza virus
KTNQQFELIN

SEQ ID NO: 368526 - protein, 10 aa, Influenza virus
TNQQFELINN

SEQ ID NO: 368527 - protein, 10 aa, Influenza virus
NQQFELINNE

SEQ ID NO: 368528 - protein, 10 aa, Influenza virus
QQFELINNEF

SEQ ID NO: 368529 - protein, 10 aa, Influenza virus
FELINNEFNE

SEQ ID NO: 368530 - protein, 10 aa, Influenza virus
NEFNEVEQQI

SEQ ID NO: 368531 - protein, 10 aa, Influenza virus
EFNEVEQQIG

SEQ ID NO: 368532 - protein, 10 aa, Influenza virus
FNEVEQQIGN

SEQ ID NO: 368533 - protein, 10 aa, Influenza virus
NEVEQQIGNV

SEQ ID NO: 368534 - protein, 10 aa, Influenza virus
EVEQQIGNVI

SEQ ID NO: 368535 - protein, 10 aa, Influenza virus
VEQQIGNVIN

SEQ ID NO: 368536 - protein, 10 aa, Influenza virus
EKQIGNVINW

SEQ ID NO: 368537 - protein, 10 aa, Influenza virus
KQIGNVINWT

SEQ ID NO: 368538 - protein, 10 aa, Influenza virus
QIGNVINWTQ

SEQ ID NO: 368539 - protein, 10 aa, Influenza virus
IGNVINWTQD

SEQ ID NO: 368540 - protein, 10 aa, Influenza virus
GNVINWTQDA

SEQ ID NO: 368541 - protein, 10 aa, Influenza virus
NVINWTQDAM

SEQ ID NO: 368542 - protein, 10 aa, Influenza virus
VINWTQDAMT

SEQ ID NO: 368543 - protein, 10 aa, Influenza virus
INWTQDAMTE

SEQ ID NO: 368544 - protein, 10 aa, Influenza virus
NWTQDAMTEV

SEQ ID NO: 368545 - protein, 10 aa, Influenza virus
WTQDAMTEVW

SEQ ID NO: 368546 - protein, 10 aa, Influenza virus
TQDAMTEVWS

SEQ ID NO: 368547 - protein, 10 aa, Influenza virus
QDAMTEVWSY

SEQ ID NO: 368548 - protein, 10 aa, Influenza virus
DAMTEVWSYN

SEQ ID NO: 368549 - protein, 10 aa, Influenza virus
AMTEVWSYNA

SEQ ID NO: 368550 - protein, 10 aa, Influenza virus
MTEVWSYNAE

SEQ ID NO: 368551 - protein, 10 aa, Influenza virus
TEVWSYNAEL

SEQ ID NO: 368552 - protein, 10 aa, Influenza virus
EVWSYNAELL

SEQ ID NO: 368553 - protein, 10 aa, Influenza virus
VWSYNAELLV

SEQ ID NO: 368554 - protein, 10 aa, Influenza virus
SYNAELLVAL

SEQ ID NO: 368555 - protein, 10 aa, Influenza virus
YNAELLVALE

SEQ ID NO: 368556 - protein, 10 aa, Influenza virus
NAELLVALEN

SEQ ID NO: 368557 - protein, 10 aa, Influenza virus
AELLVALENQ

SEQ ID NO: 368558 - protein, 10 aa, Influenza virus
ELLVALENQH

SEQ ID NO: 368559 - protein, 10 aa, Influenza virus
LLVALENQHT

SEQ ID NO: 368560 - protein, 10 aa, Influenza virus
LVALENQHTI

SEQ ID NO: 368561 - protein, 10 aa, Influenza virus
VALENQHTID

SEQ ID NO: 368562 - protein, 10 aa, Influenza virus
ALENQHTIDL

SEQ ID NO: 368563 - protein, 10 aa, Influenza virus
MENQHTIDLT

SEQ ID NO: 368564 - protein, 10 aa, Influenza virus
ENQHTIDLTD

SEQ ID NO: 368565 - protein, 10 aa, Influenza virus
NQHTIDLTDS

SEQ ID NO: 368566 - protein, 10 aa, Influenza virus
QHTIDLTDSE

SEQ ID NO: 368567 - protein, 10 aa, Influenza virus
HTIDLTDSEM

SEQ ID NO: 368568 - protein, 10 aa, Influenza virus
IDLADSEMNK

SEQ ID NO: 368569 - protein, 10 aa, Influenza virus
DLADSEMNKL

SEQ ID NO: 368570 - protein, 10 aa, Influenza virus
LADSEMNKLY

SEQ ID NO: 368571 - protein, 10 aa, Influenza virus
DSEMNKLYER

SEQ ID NO: 368572 - protein, 10 aa, Influenza virus
SEMNKLYERV

SEQ ID NO: 368573 - protein, 10 aa, Influenza virus
EMSKLYERVR

SEQ ID NO: 368574 - protein, 10 aa, Influenza virus
KLYERVRKQL

SEQ ID NO: 368575 - protein, 10 aa, Influenza virus
LYERVRKQLR

SEQ ID NO: 368576 - protein, 10 aa, Influenza virus
YERVRKQLRE

SEQ ID NO: 368577 - protein, 10 aa, Influenza virus
ERVRKQLREN

SEQ ID NO: 368578 - protein, 10 aa, Influenza virus
RVRKQLRENA

SEQ ID NO: 368579 - protein, 10 aa, Influenza virus
VRKQLRENAE

SEQ ID NO: 368580 - protein, 10 aa, Influenza virus
RKQLRENAEE

SEQ ID NO: 368581 - protein, 10 aa, Influenza virus
RQLRENAEED

SEQ ID NO: 368582 - protein, 10 aa, Influenza virus
CFEIFHKCDN

SEQ ID NO: 368583 - protein, 10 aa, Influenza virus
FEIFHKCDDH

SEQ ID NO: 368584 - protein, 10 aa, Influenza virus
EIFHKCDDHC

SEQ ID NO: 368585 - protein, 10 aa, Influenza virus
IFHKCDDHCM

SEQ ID NO: 368586 - protein, 10 aa, Influenza virus
FHKCDDHCME

SEQ ID NO: 368587 - protein, 10 aa, Influenza virus
HKCDDHCMES

SEQ ID NO: 368588 - protein, 10 aa, Influenza virus
KCDDHCMESI

SEQ ID NO: 368589 - protein, 10 aa, Influenza virus
CDDHCMESIR

SEQ ID NO: 368590 - protein, 10 aa, Influenza virus
DDHCMESIRN

SEQ ID NO: 368591 - protein, 10 aa, Influenza virus
DHCMESIRNN

SEQ ID NO: 368592 - protein, 10 aa, Influenza virus
HCMESIRNNT

SEQ ID NO: 368593 - protein, 10 aa, Influenza virus
CMASIRNNTY

SEQ ID NO: 368594 - protein, 10 aa, Influenza virus
MASIRNNTYD

SEQ ID NO: 368595 - protein, 10 aa, Influenza virus
ASIRNNTYDH

SEQ ID NO: 368596 - protein, 10 aa, Influenza virus
SIRNNTYDHS

SEQ ID NO: 368597 - protein, 10 aa, Influenza virus
IRNNTYDHSK

SEQ ID NO: 368598 - protein, 10 aa, Influenza virus
RNNTYDHSKY

SEQ ID NO: 368599 - protein, 10 aa, Influenza virus
NNTYDHSKYR

SEQ ID NO: 368600 - protein, 10 aa, Influenza virus
KYREEAMQNR

SEQ ID NO: 368601 - protein, 10 aa, Influenza virus
YREEAMQNRI

SEQ ID NO: 368602 - protein, 10 aa, Influenza virus
REEAMQNRIQ

SEQ ID NO: 368603 - protein, 10 aa, Influenza virus
EEAMQNRIQI

SEQ ID NO: 368604 - protein, 10 aa, Influenza virus
EAMQNRIQID

SEQ ID NO: 368605 - protein, 10 aa, Influenza virus
AMQNRIQIDP

SEQ ID NO: 368606 - protein, 10 aa, Influenza virus
LQNRIQIDSV

SEQ ID NO: 368607 - protein, 10 aa, Influenza virus
QNRIQIDSVK

SEQ ID NO: 368608 - protein, 10 aa, Influenza virus
NRIQIDSVKL

SEQ ID NO: 368609 - protein, 10 aa, Influenza virus
RIQIDSVKLS

SEQ ID NO: 368610 - protein, 10 aa, Influenza virus
IQIDSVKLSS

SEQ ID NO: 368611 - protein, 10 aa, Influenza virus
QIDSVKLSSG

SEQ ID NO: 368612 - protein, 10 aa, Influenza virus
IDSVKLSSGY

SEQ ID NO: 368613 - protein, 10 aa, Influenza virus
DSVKLSSGYK

SEQ ID NO: 368614 - protein, 10 aa, Influenza virus
SVKLSSGYKD

SEQ ID NO: 368615 - protein, 10 aa, Influenza virus
VKLSSGYKDV

SEQ ID NO: 368616 - protein, 10 aa, Influenza virus
KLSSGYKDVI

SEQ ID NO: 368617 - protein, 10 aa, Influenza virus
LSSGYKDVIL

SEQ ID NO: 368618 - protein, 10 aa, Influenza virus
SSGYKDVILW

SEQ ID NO: 368619 - protein, 10 aa, Influenza virus
SGYKDVILWF

SEQ ID NO: 368620 - protein, 10 aa, Influenza virus
GYKDVILWFS

SEQ ID NO: 368621 - protein, 10 aa, Influenza virus
YKDVILWFSF

SEQ ID NO: 368622 - protein, 10 aa, Influenza virus
KDVILWFSFG

SEQ ID NO: 368623 - protein, 10 aa, Influenza virus
DVILWFSFGA

SEQ ID NO: 368624 - protein, 10 aa, Influenza virus
VILWFSFGAS

SEQ ID NO: 368625 - protein, 10 aa, Influenza virus
WFSFGASCFI

SEQ ID NO: 368626 - protein, 10 aa, Influenza virus
FSFGASCFIL

SEQ ID NO: 368627 - protein, 10 aa, Influenza virus
SFGASCFILL

SEQ ID NO: 368628 - protein, 10 aa, Influenza virus
FGASCFILLA

SEQ ID NO: 368629 - protein, 10 aa, Influenza virus
GASCFILLAI

SEQ ID NO: 368630 - protein, 10 aa, Influenza virus
ASCFILLAIA

SEQ ID NO: 368631 - protein, 10 aa, Influenza virus
LLAIVMGLVF

SEQ ID NO: 368632 - protein, 10 aa, Influenza virus
AIVMGLVFIC

SEQ ID NO: 368633 - protein, 10 aa, Influenza virus
VMGLVFICIK

SEQ ID NO: 368634 - protein, 10 aa, Influenza virus
MGLVFMCVKN

SEQ ID NO: 368635 - protein, 10 aa, Influenza virus
GLVFMCVKNG

SEQ ID NO: 368636 - protein, 10 aa, Influenza virus
LVFMCVKNGN

SEQ ID NO: 368637 - protein, 10 aa, Influenza virus
VFMCVKNGNM

SEQ ID NO: 368638 - protein, 10 aa, Influenza virus
FICIKNGNMR

SEQ ID NO: 368639 - protein, 10 aa, Influenza virus
ICIKNGNMRC

SEQ ID NO: 368640 - protein, 10 aa, Influenza virus
CIKNGNMRCT

SEQ ID NO: 368641 - protein, 10 aa, Influenza virus
IKNGNMRCTI

SEQ ID NO: 368642 - protein, 10 aa, Influenza virus
KNGNMRCTIC

SEQ ID NO: 368643 - protein, 10 aa, Influenza virus
NGNMRCTICI

SEQ ID NO: 368644 - protein, 10 aa, Influenza virus
QKIITIGSIS

SEQ ID NO: 368645 - protein, 10 aa, Influenza virus
KIITIGSISL

SEQ ID NO: 368646 - protein, 10 aa, Influenza virus
IITIGSVSLI

SEQ ID NO: 368647 - protein, 10 aa, Influenza virus
ITIGSISLTI

SEQ ID NO: 368648 - protein, 10 aa, Influenza virus
TIGSVSLTIT

SEQ ID NO: 368649 - protein, 10 aa, Influenza virus
IGSVSLTITT

SEQ ID NO: 368650 - protein, 10 aa, Influenza virus
EKNITEIVYL

SEQ ID NO: 368651 - protein, 10 aa, Influenza virus
KNITEIVYLN

SEQ ID NO: 368652 - protein, 10 aa, Influenza virus
NVTETLYLNH

SEQ ID NO: 368653 - protein, 10 aa, Influenza virus
VTETLYLNHT

SEQ ID NO: 368654 - protein, 10 aa, Influenza virus
YRNWSKPQCQ

SEQ ID NO: 368655 - protein, 10 aa, Influenza virus
RNWSKPQCQI

SEQ ID NO: 368656 - protein, 10 aa, Influenza virus
WSKPQCQISG

SEQ ID NO: 368657 - protein, 10 aa, Influenza virus
GFAPFAKDNS

SEQ ID NO: 368658 - protein, 10 aa, Influenza virus
FAPFAKDNSI

SEQ ID NO: 368659 - protein, 10 aa, Influenza virus
APFAKDNSIR

SEQ ID NO: 368660 - protein, 10 aa, Influenza virus
PFAKDNSIRL

SEQ ID NO: 368661 - protein, 10 aa, Influenza virus
FAKDNSIRLS

SEQ ID NO: 368662 - protein, 10 aa, Influenza virus
AKDNSIRLSA

SEQ ID NO: 368663 - protein, 10 aa, Influenza virus
KDNSVRLSAS

SEQ ID NO: 368664 - protein, 10 aa, Influenza virus
DNSVRLSAGG

SEQ ID NO: 368665 - protein, 10 aa, Influenza virus
NSIRLSAGGH

SEQ ID NO: 368666 - protein, 10 aa, Influenza virus
SIRLSAGGHI

SEQ ID NO: 368667 - protein, 10 aa, Influenza virus
IRLSAGGHIW

SEQ ID NO: 368668 - protein, 10 aa, Influenza virus
RLSAGGHIWV

SEQ ID NO: 368669 - protein, 10 aa, Influenza virus
LSAGGHIWVT

SEQ ID NO: 368670 - protein, 10 aa, Influenza virus
SAGGHIWVTR

SEQ ID NO: 368671 - protein, 10 aa, Influenza virus
AGGHIWVTRE

SEQ ID NO: 368672 - protein, 10 aa, Influenza virus
GGHIWVTREP

SEQ ID NO: 368673 - protein, 10 aa, Influenza virus
GHIWVTREPY

SEQ ID NO: 368674 - protein, 10 aa, Influenza virus
HIWVTREPYV

SEQ ID NO: 368675 - protein, 10 aa, Influenza virus
IWVTREPYVS

SEQ ID NO: 368676 - protein, 10 aa, Influenza virus
WVTREPYVSC

SEQ ID NO: 368677 - protein, 10 aa, Influenza virus
VTREPYVSCD

SEQ ID NO: 368678 - protein, 10 aa, Influenza virus
TREPYVSCGP

SEQ ID NO: 368679 - protein, 10 aa, Influenza virus
NKCYQFALGQ

SEQ ID NO: 368680 - protein, 10 aa, Influenza virus
RCYQFALGQG

SEQ ID NO: 368681 - protein, 10 aa, Influenza virus
FALGQGTTLY

SEQ ID NO: 368682 - protein, 10 aa, Influenza virus
ALGQGTTLYN

SEQ ID NO: 368683 - protein, 10 aa, Influenza virus
LGQGTTLDNE

SEQ ID NO: 368684 - protein, 10 aa, Influenza virus
GQGTTLDNEH

SEQ ID NO: 368685 - protein, 10 aa, Influenza virus
QGTTLDNEHS

SEQ ID NO: 368686 - protein, 10 aa, Influenza virus
GTTLDNEHSN

SEQ ID NO: 368687 - protein, 10 aa, Influenza virus
TTLDNEHSNG

SEQ ID NO: 368688 - protein, 10 aa, Influenza virus
TLDNEHSNGT

SEQ ID NO: 368689 - protein, 10 aa, Influenza virus
NEHSNGTIHD

SEQ ID NO: 368690 - protein, 10 aa, Influenza virus
EHSNGTIHDR

SEQ ID NO: 368691 - protein, 10 aa, Influenza virus
HSNGTIHDRT

SEQ ID NO: 368692 - protein, 10 aa, Influenza virus
HDRTPHRTLL

SEQ ID NO: 368693 - protein, 10 aa, Influenza virus
DRTPHRTLLM

SEQ ID NO: 368694 - protein, 10 aa, Influenza virus
RTPHRTLLMN

SEQ ID NO: 368695 - protein, 10 aa, Influenza virus
TPHRTLLMNE

SEQ ID NO: 368696 - protein, 10 aa, Influenza virus
SHRTLLMNEL

SEQ ID NO: 368697 - protein, 10 aa, Influenza virus
LGVPFHLGTR

SEQ ID NO: 368698 - protein, 10 aa, Influenza virus
GVPFHLGTRQ

SEQ ID NO: 368699 - protein, 10 aa, Influenza virus
VPFHLGTRQV

SEQ ID NO: 368700 - protein, 10 aa, Influenza virus
PFHLGTRQVC

SEQ ID NO: 368701 - protein, 10 aa, Influenza virus
FHLGTRQVCI

SEQ ID NO: 368702 - protein, 10 aa, Influenza virus
HLGTRQVCIA

SEQ ID NO: 368703 - protein, 10 aa, Influenza virus
LGTRQVCIAW

SEQ ID NO: 368704 - protein, 10 aa, Influenza virus
GTRQVCIAWS

SEQ ID NO: 368705 - protein, 10 aa, Influenza virus
TRQVCIAWSS

SEQ ID NO: 368706 - protein, 10 aa, Influenza virus
RQVCIAWSSS

SEQ ID NO: 368707 - protein, 10 aa, Influenza virus
QVCMAWSSSS

SEQ ID NO: 368708 - protein, 10 aa, Influenza virus
VCMAWSSSSC

SEQ ID NO: 368709 - protein, 10 aa, Influenza virus
CMAWSSSSCH

SEQ ID NO: 368710 - protein, 10 aa, Influenza virus
MAWSSSSCHD

SEQ ID NO: 368711 - protein, 10 aa, Influenza virus
CHDGKAWLHI

SEQ ID NO: 368712 - protein, 10 aa, Influenza virus
HDGKAWLHIC

SEQ ID NO: 368713 - protein, 10 aa, Influenza virus
DGKAWLHVCI

SEQ ID NO: 368714 - protein, 10 aa, Influenza virus
GKAWLHVCIT

SEQ ID NO: 368715 - protein, 10 aa, Influenza virus
KAWLHVCITG

SEQ ID NO: 368716 - protein, 10 aa, Influenza virus
AWLHVCITGD

SEQ ID NO: 368717 - protein, 10 aa, Influenza virus
WLHVCITGDD

SEQ ID NO: 368718 - protein, 10 aa, Influenza virus
LHVCVTGDDK

SEQ ID NO: 368719 - protein, 10 aa, Influenza virus
HICVTGDDRN

SEQ ID NO: 368720 - protein, 10 aa, Influenza virus
VCITGDDRNA

SEQ ID NO: 368721 - protein, 10 aa, Influenza virus
CITGDDRNAT

SEQ ID NO: 368722 - protein, 10 aa, Influenza virus
ITGDDRNATA

SEQ ID NO: 368723 - protein, 10 aa, Influenza virus
TGDDKNATAS

SEQ ID NO: 368724 - protein, 10 aa, Influenza virus
GDDKNATASF

SEQ ID NO: 368725 - protein, 10 aa, Influenza virus
DDKNATASFI

SEQ ID NO: 368726 - protein, 10 aa, Influenza virus
DKNATASFIY

SEQ ID NO: 368727 - protein, 10 aa, Influenza virus
NATASFIYDG

SEQ ID NO: 368728 - protein, 10 aa, Influenza virus
LVDSIVSWSQ

SEQ ID NO: 368729 - protein, 10 aa, Influenza virus
VDSIVSWSQN

SEQ ID NO: 368730 - protein, 10 aa, Influenza virus
DSIVSWSQNI

SEQ ID NO: 368731 - protein, 10 aa, Influenza virus
SIVSWSQNIL

SEQ ID NO: 368732 - protein, 10 aa, Influenza virus
IVSWSQNILR

SEQ ID NO: 368733 - protein, 10 aa, Influenza virus
VSWSQNILRT

SEQ ID NO: 368734 - protein, 10 aa, Influenza virus
ESECVCINGT

SEQ ID NO: 368735 - protein, 10 aa, Influenza virus
SECVCINGTC

SEQ ID NO: 368736 - protein, 10 aa, Influenza virus
ECVCINGTCT

SEQ ID NO: 368737 - protein, 10 aa, Influenza virus
CVCINGTCTV

SEQ ID NO: 368738 - protein, 10 aa, Influenza virus
VCINGTCTVV

SEQ ID NO: 368739 - protein, 10 aa, Influenza virus
CINGTCTVVM

SEQ ID NO: 368740 - protein, 10 aa, Influenza virus
INGTCTVVMT

SEQ ID NO: 368741 - protein, 10 aa, Influenza virus
NGTCTVVMTD

SEQ ID NO: 368742 - protein, 10 aa, Influenza virus
GTCTVVMTDG

SEQ ID NO: 368743 - protein, 10 aa, Influenza virus
SCTVVMTDGN

SEQ ID NO: 368744 - protein, 10 aa, Influenza virus
CTVVMTDGNA

SEQ ID NO: 368745 - protein, 10 aa, Influenza virus
TVVMTDGNAS

SEQ ID NO: 368746 - protein, 10 aa, Influenza virus
VVMTDGNASG

SEQ ID NO: 368747 - protein, 10 aa, Influenza virus
VMTDGNASGK

SEQ ID NO: 368748 - protein, 10 aa, Influenza virus
MTDGNASGKA

SEQ ID NO: 368749 - protein, 10 aa, Influenza virus
TDGNASGKAD

SEQ ID NO: 368750 - protein, 10 aa, Influenza virus
DGNASGKADT

SEQ ID NO: 368751 - protein, 10 aa, Influenza virus
EGKIIHISPL

SEQ ID NO: 368752 - protein, 10 aa, Influenza virus
GKIIHISPLS

SEQ ID NO: 368753 - protein, 10 aa, Influenza virus
KIIHISPLSG

SEQ ID NO: 368754 - protein, 10 aa, Influenza virus
IIHISPLSGS

SEQ ID NO: 368755 - protein, 10 aa, Influenza virus
IHISPLSGSA

SEQ ID NO: 368756 - protein, 10 aa, Influenza virus
HIEECSCYPQ

SEQ ID NO: 368757 - protein, 10 aa, Influenza virus
IEECSCYPQY

SEQ ID NO: 368758 - protein, 10 aa, Influenza virus
EECSCYPQYP

SEQ ID NO: 368759 - protein, 10 aa, Influenza virus
ECSCYPQYPN

SEQ ID NO: 368760 - protein, 10 aa, Influenza virus
CSCYPQYPNV

SEQ ID NO: 368761 - protein, 10 aa, Influenza virus
SCYPQYPNVR

SEQ ID NO: 368762 - protein, 10 aa, Influenza virus
CYPQYPNVRC

SEQ ID NO: 368763 - protein, 10 aa, Influenza virus
YPQYPNVRCV

SEQ ID NO: 368764 - protein, 10 aa, Influenza virus
PQYPNVRCVC

SEQ ID NO: 368765 - protein, 10 aa, Influenza virus
QYPNVRCVCR

SEQ ID NO: 368766 - protein, 10 aa, Influenza virus
YPDVRCVCRD

SEQ ID NO: 368767 - protein, 10 aa, Influenza virus
PDVRCVCRDN

SEQ ID NO: 368768 - protein, 10 aa, Influenza virus
DVRCVCRDNW

SEQ ID NO: 368769 - protein, 10 aa, Influenza virus
DNWKGSNRPI

SEQ ID NO: 368770 - protein, 10 aa, Influenza virus
NWKGSNRPII

SEQ ID NO: 368771 - protein, 10 aa, Influenza virus
WKGSNRPIID

SEQ ID NO: 368772 - protein, 10 aa, Influenza virus
KGSNRPVIDV

SEQ ID NO: 368773 - protein, 10 aa, Influenza virus
GSNRPVIDVN

SEQ ID NO: 368774 - protein, 10 aa, Influenza virus
SNRPVIDVNM

SEQ ID NO: 368775 - protein, 10 aa, Influenza virus
INSSYVCSGL

SEQ ID NO: 368776 - protein, 10 aa, Influenza virus
NSSYVCSGLV

SEQ ID NO: 368777 - protein, 10 aa, Influenza virus
SGYVCSGLVG

SEQ ID NO: 368778 - protein, 10 aa, Influenza virus
SYLCSGLVGD

SEQ ID NO: 368779 - protein, 10 aa, Influenza virus
GLVGDTPRND

SEQ ID NO: 368780 - protein, 10 aa, Influenza virus
LVGDTPRNDD

SEQ ID NO: 368781 - protein, 10 aa, Influenza virus
VGDTPRNEDS

SEQ ID NO: 368782 - protein, 10 aa, Influenza virus
GDTPRNEDSS

SEQ ID NO: 368783 - protein, 10 aa, Influenza virus
DTPRNEDSSS

SEQ ID NO: 368784 - protein, 10 aa, Influenza virus
TPRNEDSSSS

SEQ ID NO: 368785 - protein, 10 aa, Influenza virus
PRNEDSSSSS

SEQ ID NO: 368786 - protein, 10 aa, Influenza virus
RNEDSSSSSN

SEQ ID NO: 368787 - protein, 10 aa, Influenza virus
NEDSSSSSNC

SEQ ID NO: 368788 - protein, 10 aa, Influenza virus
DPNDERGNPG

SEQ ID NO: 368789 - protein, 10 aa, Influenza virus
PNDERGNPGV

SEQ ID NO: 368790 - protein, 10 aa, Influenza virus
NDERGNPGVK

SEQ ID NO: 368791 - protein, 10 aa, Influenza virus
DERGNPGVKG

SEQ ID NO: 368792 - protein, 10 aa, Influenza virus
EKGNPGVKGW

SEQ ID NO: 368793 - protein, 10 aa, Influenza virus
KGNPGVKGWA

SEQ ID NO: 368794 - protein, 10 aa, Influenza virus
GSPGVKGWAF

SEQ ID NO: 368795 - protein, 10 aa, Influenza virus
SPGVKGWAFD

SEQ ID NO: 368796 - protein, 10 aa, Influenza virus
PGVKGWAFDN

SEQ ID NO: 368797 - protein, 10 aa, Influenza virus
GVKGWAFDNG

SEQ ID NO: 368798 - protein, 10 aa, Influenza virus
VKGWAFDNGD

SEQ ID NO: 368799 - protein, 10 aa, Influenza virus
KGWAFDNGDD

SEQ ID NO: 368800 - protein, 10 aa, Influenza virus
NGDDVWMGRT

SEQ ID NO: 368801 - protein, 10 aa, Influenza virus
GNDVWMGRTI

SEQ ID NO: 368802 - protein, 10 aa, Influenza virus
NDVWMGRTIS

SEQ ID NO: 368803 - protein, 10 aa, Influenza virus
DVWMGRTISK

SEQ ID NO: 368804 - protein, 10 aa, Influenza virus
VWMGRTISKD

SEQ ID NO: 368805 - protein, 10 aa, Influenza virus
WMGRTISKDS

SEQ ID NO: 368806 - protein, 10 aa, Influenza virus
MGRTISKDSR

SEQ ID NO: 368807 - protein, 10 aa, Influenza virus
GRTISKDSRS

SEQ ID NO: 368808 - protein, 10 aa, Influenza virus
RTISKDSRSG

SEQ ID NO: 368809 - protein, 10 aa, Influenza virus
TISKDSRSGY

SEQ ID NO: 368810 - protein, 10 aa, Influenza virus
ISKDSRSGYE

SEQ ID NO: 368811 - protein, 10 aa, Influenza virus
SKDSRSGYET

SEQ ID NO: 368812 - protein, 10 aa, Influenza virus
KDSRSGYETF

SEQ ID NO: 368813 - protein, 10 aa, Influenza virus
DSRSGYETFK

SEQ ID NO: 368814 - protein, 10 aa, Influenza virus
SRSGYETFKV

SEQ ID NO: 368815 - protein, 10 aa, Influenza virus
RSGYETFKVI

SEQ ID NO: 368816 - protein, 10 aa, Influenza virus
SGYETFRVIS

SEQ ID NO: 368817 - protein, 10 aa, Influenza virus
GYETFRVISG

SEQ ID NO: 368818 - protein, 10 aa, Influenza virus
YETFRVISGW

SEQ ID NO: 368819 - protein, 10 aa, Influenza virus
ETFRVIGGWA

SEQ ID NO: 368820 - protein, 10 aa, Influenza virus
VIGGWATANS

SEQ ID NO: 368821 - protein, 10 aa, Influenza virus
IGGWATANSK

SEQ ID NO: 368822 - protein, 10 aa, Influenza virus
GGWATANSKS

SEQ ID NO: 368823 - protein, 10 aa, Influenza virus
GWATANSKSQ

SEQ ID NO: 368824 - protein, 10 aa, Influenza virus
RQVIVDNSNW

SEQ ID NO: 368825 - protein, 10 aa, Influenza virus
IVDNNNWFGY

SEQ ID NO: 368826 - protein, 10 aa, Influenza virus
VDNSNWSGYS

SEQ ID NO: 368827 - protein, 10 aa, Influenza virus
DNNNWFGYFG

SEQ ID NO: 368828 - protein, 10 aa, Influenza virus
NSNWSGYSGI

SEQ ID NO: 368829 - protein, 10 aa, Influenza virus
NNWFGYFGIF

SEQ ID NO: 368830 - protein, 10 aa, Influenza virus
NWFGYFGIFF

SEQ ID NO: 368831 - protein, 10 aa, Influenza virus
WFGYFGIFFV

SEQ ID NO: 368832 - protein, 10 aa, Influenza virus
FGYFGIFFVE

SEQ ID NO: 368833 - protein, 10 aa, Influenza virus
KSCVNRCFYV

SEQ ID NO: 368834 - protein, 10 aa, Influenza virus
SCVNRCFYVE

SEQ ID NO: 368835 - protein, 10 aa, Influenza virus
CVNRCFYVEL

SEQ ID NO: 368836 - protein, 10 aa, Influenza virus
VNRCFYVELI

SEQ ID NO: 368837 - protein, 10 aa, Influenza virus
CFYVELIRGM

SEQ ID NO: 368838 - protein, 10 aa, Influenza virus
FYVELIRGMP

SEQ ID NO: 368839 - protein, 10 aa, Influenza virus
YVELIRGRPQ

SEQ ID NO: 368840 - protein, 10 aa, Influenza virus
VELIRGRPQE

SEQ ID NO: 368841 - protein, 10 aa, Influenza virus
PQETRVWWTS

SEQ ID NO: 368842 - protein, 10 aa, Influenza virus
QETRVWWTSN

SEQ ID NO: 368843 - protein, 10 aa, Influenza virus
ENRVWWTSNS

SEQ ID NO: 368844 - protein, 10 aa, Influenza virus
NRVWWTSNSI

SEQ ID NO: 368845 - protein, 10 aa, Influenza virus
RVWWTSNSII

SEQ ID NO: 368846 - protein, 10 aa, Influenza virus
VWWTSNSIIV

SEQ ID NO: 368847 - protein, 10 aa, Influenza virus
WWTSNSIIVF

SEQ ID NO: 368848 - protein, 10 aa, Influenza virus
WTSNSIIVFC

SEQ ID NO: 368849 - protein, 10 aa, Influenza virus
TSNSIIVFCG

SEQ ID NO: 368850 - protein, 10 aa, Influenza virus
SNSIIVFCGT

SEQ ID NO: 368851 - protein, 10 aa, Influenza virus
NSIIVFCGTS

SEQ ID NO: 368852 - protein, 10 aa, Influenza virus
SIIVFCGTSG

SEQ ID NO: 368853 - protein, 10 aa, Influenza virus
IIVFCGTSGT

SEQ ID NO: 368854 - protein, 10 aa, Influenza virus
IVFCGTSGTY

SEQ ID NO: 368855 - protein, 10 aa, Influenza virus
VFCGTSGNYG

SEQ ID NO: 368856 - protein, 10 aa, Influenza virus
GSWPDGANIS

SEQ ID NO: 368857 - protein, 10 aa, Influenza virus
SWPDGANISF

SEQ ID NO: 368858 - protein, 10 aa, Influenza virus
WPDGANISFM

SEQ ID NO: 368859 - protein, 10 aa, Influenza virus
SKSRGYKMNN

SEQ ID NO: 368860 - protein, 10 aa, Influenza virus
KSRGYKMNTQ

SEQ ID NO: 368861 - protein, 10 aa, Influenza virus
SRGYKMNNQI

SEQ ID NO: 368862 - protein, 10 aa, Influenza virus
RGYKMNNQIL

SEQ ID NO: 368863 - protein, 10 aa, Influenza virus
GYKMNTRILI

SEQ ID NO: 368864 - protein, 10 aa, Influenza virus
YKMNNQILIL

SEQ ID NO: 368865 - protein, 10 aa, Influenza virus
KMNTRILILT

SEQ ID NO: 368866 - protein, 10 aa, Influenza virus
ADKICLGHHA

SEQ ID NO: 368867 - protein, 10 aa, Influenza virus
KICLGHHAVS

SEQ ID NO: 368868 - protein, 10 aa, Influenza virus
ICLGHHAVSN

SEQ ID NO: 368869 - protein, 10 aa, Influenza virus
CLGHHAVSNG

SEQ ID NO: 368870 - protein, 10 aa, Influenza virus
LGHHAVSNGT

SEQ ID NO: 368871 - protein, 10 aa, Influenza virus
GHHAVSNGTK

SEQ ID NO: 368872 - protein, 10 aa, Influenza virus
HHAVSNGTKV

SEQ ID NO: 368873 - protein, 10 aa, Influenza virus
NGTRVNTLTE

SEQ ID NO: 368874 - protein, 10 aa, Influenza virus
VNTLTERGVE

SEQ ID NO: 368875 - protein, 10 aa, Influenza virus
NTLTERGVEV

SEQ ID NO: 368876 - protein, 10 aa, Influenza virus
TLTERGVEVV

SEQ ID NO: 368877 - protein, 10 aa, Influenza virus
LTERGVEVVN

SEQ ID NO: 368878 - protein, 10 aa, Influenza virus
TERGVEVVNA

SEQ ID NO: 368879 - protein, 10 aa, Influenza virus
ERGVEVVNAT

SEQ ID NO: 368880 - protein, 10 aa, Influenza virus
RGVEVVNATE

SEQ ID NO: 368881 - protein, 10 aa, Influenza virus
GVEVVNATET

SEQ ID NO: 368882 - protein, 10 aa, Influenza virus
VEVVNATETV

SEQ ID NO: 368883 - protein, 10 aa, Influenza virus
EVVDATETVE

SEQ ID NO: 368884 - protein, 10 aa, Influenza virus
VVNATETVER

SEQ ID NO: 368885 - protein, 10 aa, Influenza virus
VDLGQCGLLG

SEQ ID NO: 368886 - protein, 10 aa, Influenza virus
DLGQCGILGI

SEQ ID NO: 368887 - protein, 10 aa, Influenza virus
CGLLGTITGP

SEQ ID NO: 368888 - protein, 10 aa, Influenza virus
GLLGTITGPP

SEQ ID NO: 368889 - protein, 10 aa, Influenza virus
LLGTITGPPQ

SEQ ID NO: 368890 - protein, 10 aa, Influenza virus
LGTITGPPQC

SEQ ID NO: 368891 - protein, 10 aa, Influenza virus
GTITGPPQCD

SEQ ID NO: 368892 - protein, 10 aa, Influenza virus
TGPPQCDQFL

SEQ ID NO: 368893 - protein, 10 aa, Influenza virus
GPPQCDLFLE

SEQ ID NO: 368894 - protein, 10 aa, Influenza virus
PPQCDLFLEF

SEQ ID NO: 368895 - protein, 10 aa, Influenza virus
DVCYPGKFVN

SEQ ID NO: 368896 - protein, 10 aa, Influenza virus
LRQILRESGG

SEQ ID NO: 368897 - protein, 10 aa, Influenza virus
RQILRESGGI

SEQ ID NO: 368898 - protein, 10 aa, Influenza virus
ESSFYAEMKW

SEQ ID NO: 368899 - protein, 10 aa, Influenza virus
PSFYAEMKWL

SEQ ID NO: 368900 - protein, 10 aa, Influenza virus
AEMKWLLSNT

SEQ ID NO: 368901 - protein, 10 aa, Influenza virus
EMKWLLSNTD

SEQ ID NO: 368902 - protein, 10 aa, Influenza virus
MKWLLSNTDN

SEQ ID NO: 368903 - protein, 10 aa, Influenza virus
PALIIWGIHH

SEQ ID NO: 368904 - protein, 10 aa, Influenza virus
ALIIWGIHHS

SEQ ID NO: 368905 - protein, 10 aa, Influenza virus
LYGSGAKLIT

SEQ ID NO: 368906 - protein, 10 aa, Influenza virus
YGSGAKLITV

SEQ ID NO: 368907 - protein, 10 aa, Influenza virus
SSNYQQSFVP

SEQ ID NO: 368908 - protein, 10 aa, Influenza virus
SNYQQSFVPS

SEQ ID NO: 368909 - protein, 10 aa, Influenza virus
NYQQSFVPSP

SEQ ID NO: 368910 - protein, 10 aa, Influenza virus
YQQSFVPSPG

SEQ ID NO: 368911 - protein, 10 aa, Influenza virus
QSFVPSPGAR

SEQ ID NO: 368912 - protein, 10 aa, Influenza virus
VNGQFGRINF

SEQ ID NO: 368913 - protein, 10 aa, Influenza virus
NGQFGRINFH

SEQ ID NO: 368914 - protein, 10 aa, Influenza virus
GQFGRINFHW

SEQ ID NO: 368915 - protein, 10 aa, Influenza virus
QFGRINFHWL

SEQ ID NO: 368916 - protein, 10 aa, Influenza virus
NDTVTFSFNG

SEQ ID NO: 368917 - protein, 10 aa, Influenza virus
FSFNGAFIAP

SEQ ID NO: 368918 - protein, 10 aa, Influenza virus
SFNGAFIAPD

SEQ ID NO: 368919 - protein, 10 aa, Influenza virus
FNGAFVAPDR

SEQ ID NO: 368920 - protein, 10 aa, Influenza virus
NGAFIAPDRV

SEQ ID NO: 368921 - protein, 10 aa, Influenza virus
GAFIAPDRVS

SEQ ID NO: 368922 - protein, 10 aa, Influenza virus
AFIAPDRVSF

SEQ ID NO: 368923 - protein, 10 aa, Influenza virus
FIAPDRASFL

SEQ ID NO: 368924 - protein, 10 aa, Influenza virus
GGTIISNLPF

SEQ ID NO: 368925 - protein, 10 aa, Influenza virus
GTIISNLPFQ

SEQ ID NO: 368926 - protein, 10 aa, Influenza virus
TIISNLPFQN

SEQ ID NO: 368927 - protein, 10 aa, Influenza virus
IISNLPFQNI

SEQ ID NO: 368928 - protein, 10 aa, Influenza virus
ISNLPFQNIN

SEQ ID NO: 368929 - protein, 10 aa, Influenza virus
NLPFQNINSR

SEQ ID NO: 368930 - protein, 10 aa, Influenza virus
LPFQNINSRA

SEQ ID NO: 368931 - protein, 10 aa, Influenza virus
IGKCPRYVKQ

SEQ ID NO: 368932 - protein, 10 aa, Influenza virus
SLLLATGMKN

SEQ ID NO: 368933 - protein, 10 aa, Influenza virus
LLLATGMKNV

SEQ ID NO: 368934 - protein, 10 aa, Influenza virus
LLATGMKNVP

SEQ ID NO: 368935 - protein, 10 aa, Influenza virus
LATGMKNVPE

SEQ ID NO: 368936 - protein, 10 aa, Influenza virus
ATGMKNVPEI

SEQ ID NO: 368937 - protein, 10 aa, Influenza virus
TGMKNVPEIP

SEQ ID NO: 368938 - protein, 10 aa, Influenza virus
GMKNVPEIPK

SEQ ID NO: 368939 - protein, 10 aa, Influenza virus
CSPLSRCRKT

SEQ ID NO: 368940 - protein, 10 aa, Influenza virus
SPLSRCRETR

SEQ ID NO: 368941 - protein, 10 aa, Influenza virus
LSRCRKTRGL

SEQ ID NO: 368942 - protein, 10 aa, Influenza virus
YRKRMTRGLF

SEQ ID NO: 368943 - protein, 10 aa, Influenza virus
RKRMTRGLFG

SEQ ID NO: 368944 - protein, 10 aa, Influenza virus
KRMTRGLFGA

SEQ ID NO: 368945 - protein, 10 aa, Influenza virus
RMTRGLFGAI

SEQ ID NO: 368946 - protein, 10 aa, Influenza virus
ETRGLFGAIA

SEQ ID NO: 368947 - protein, 10 aa, Influenza virus
ARGLFGAIAG

SEQ ID NO: 368948 - protein, 10 aa, Influenza virus
FIENGWEGLV

SEQ ID NO: 368949 - protein, 10 aa, Influenza virus
IENGWEGLVD

SEQ ID NO: 368950 - protein, 10 aa, Influenza virus
ENGWEGLVDG

SEQ ID NO: 368951 - protein, 10 aa, Influenza virus
NGWEGLVDGW

SEQ ID NO: 368952 - protein, 10 aa, Influenza virus
GWEGLVDGWY

SEQ ID NO: 368953 - protein, 10 aa, Influenza virus
WEGLVDGWYG

SEQ ID NO: 368954 - protein, 10 aa, Influenza virus
EGLVDGWYGF

SEQ ID NO: 368955 - protein, 10 aa, Influenza virus
GLVDGWYGFR

SEQ ID NO: 368956 - protein, 10 aa, Influenza virus
LVDGWYGFRH

SEQ ID NO: 368957 - protein, 10 aa, Influenza virus
VDGWYGFRHQ

SEQ ID NO: 368958 - protein, 10 aa, Influenza virus
NGWYGFRHQN

SEQ ID NO: 368959 - protein, 10 aa, Influenza virus
GWYGFKHQNA

SEQ ID NO: 368960 - protein, 10 aa, Influenza virus
WYGFKHQNAQ

SEQ ID NO: 368961 - protein, 10 aa, Influenza virus
YGFKHQNAQG

SEQ ID NO: 368962 - protein, 10 aa, Influenza virus
GFKHQNAQGE

SEQ ID NO: 368963 - protein, 10 aa, Influenza virus
FKHQNAQGEG

SEQ ID NO: 368964 - protein, 10 aa, Influenza virus
RHQNAQGEGI

SEQ ID NO: 368965 - protein, 10 aa, Influenza virus
HQNAQGEGIA

SEQ ID NO: 368966 - protein, 10 aa, Influenza virus
QNAQGEGIAA

SEQ ID NO: 368967 - protein, 10 aa, Influenza virus
NAQGEGIAAD

SEQ ID NO: 368968 - protein, 10 aa, Influenza virus
AQGEGIAADY

SEQ ID NO: 368969 - protein, 10 aa, Influenza virus
QGEGIAADYK

SEQ ID NO: 368970 - protein, 10 aa, Influenza virus
GEGIAADYKS

SEQ ID NO: 368971 - protein, 10 aa, Influenza virus
EGIAADYKST

SEQ ID NO: 368972 - protein, 10 aa, Influenza virus
GIAADYKSTQ

SEQ ID NO: 368973 - protein, 10 aa, Influenza virus
IAADYKSTQS

SEQ ID NO: 368974 - protein, 10 aa, Influenza virus
AADYKSTPSA

SEQ ID NO: 368975 - protein, 10 aa, Influenza virus
ADYKSTQSAV

SEQ ID NO: 368976 - protein, 10 aa, Influenza virus
DYKSTQSAIN

SEQ ID NO: 368977 - protein, 10 aa, Influenza virus
YKSTQSAINQ

SEQ ID NO: 368978 - protein, 10 aa, Influenza virus
KSTQSAINQI

SEQ ID NO: 368979 - protein, 10 aa, Influenza virus
STQSAINQIT

SEQ ID NO: 368980 - protein, 10 aa, Influenza virus
TQSAINQITG

SEQ ID NO: 368981 - protein, 10 aa, Influenza virus
QSAINQITGK

SEQ ID NO: 368982 - protein, 10 aa, Influenza virus
SAINQITGKL

SEQ ID NO: 368983 - protein, 10 aa, Influenza virus
AINQITGKLN

SEQ ID NO: 368984 - protein, 10 aa, Influenza virus
INQITGKLNR

SEQ ID NO: 368985 - protein, 10 aa, Influenza virus
NQITGKLNRL

SEQ ID NO: 368986 - protein, 10 aa, Influenza virus
QITGKLNRII

SEQ ID NO: 368987 - protein, 10 aa, Influenza virus
ITGKLNRLIE

SEQ ID NO: 368988 - protein, 10 aa, Influenza virus
TGKLNRLIEK

SEQ ID NO: 368989 - protein, 10 aa, Influenza virus
GKLNRLIEKT

SEQ ID NO: 368990 - protein, 10 aa, Influenza virus
KLNRLIEKTN

SEQ ID NO: 368991 - protein, 10 aa, Influenza virus
LNRLIEKTNQ

SEQ ID NO: 368992 - protein, 10 aa, Influenza virus
NRLIEKTNQQ

SEQ ID NO: 368993 - protein, 10 aa, Influenza virus
RLIEKTNQQF

SEQ ID NO: 368994 - protein, 10 aa, Influenza virus
IEKTNQQFEL

SEQ ID NO: 368995 - protein, 10 aa, Influenza virus
EKTNQQFELI

SEQ ID NO: 368996 - protein, 10 aa, Influenza virus
KTNQQFEMID

SEQ ID NO: 368997 - protein, 10 aa, Influenza virus
TNQQFEMIDN

SEQ ID NO: 368998 - protein, 10 aa, Influenza virus
NQQFEMIDNE

SEQ ID NO: 368999 - protein, 10 aa, Influenza virus
QQFEMIDNEF

SEQ ID NO: 369000 - protein, 10 aa, Influenza virus
FTEVEKQIGN

SEQ ID NO: 369001 - protein, 10 aa, Influenza virus
EVEKQIGNVI

SEQ ID NO: 369002 - protein, 10 aa, Influenza virus
VEKQIGNVIN

SEQ ID NO: 369003 - protein, 10 aa, Influenza virus
EKQIGNVINW

SEQ ID NO: 369004 - protein, 10 aa, Influenza virus
KQIGNVINWT

SEQ ID NO: 369005 - protein, 10 aa, Influenza virus
GNVINWTRDA

SEQ ID NO: 369006 - protein, 10 aa, Influenza virus
NVINWTRDSI

SEQ ID NO: 369007 - protein, 10 aa, Influenza virus
VINWTRDSIT

SEQ ID NO: 369008 - protein, 10 aa, Influenza virus
INWTRDSITE

SEQ ID NO: 369009 - protein, 10 aa, Influenza virus
NWTRDSMTEI

SEQ ID NO: 369010 - protein, 10 aa, Influenza virus
WTRDSMTEIW

SEQ ID NO: 369011 - protein, 10 aa, Influenza virus
TRDSMTEIWS

SEQ ID NO: 369012 - protein, 10 aa, Influenza virus
RDSMTEIWSY

SEQ ID NO: 369013 - protein, 10 aa, Influenza virus
DSMTEIWSYN

SEQ ID NO: 369014 - protein, 10 aa, Influenza virus
SMTEIWSYNA

SEQ ID NO: 369015 - protein, 10 aa, Influenza virus
MTEIWSYNAE

SEQ ID NO: 369016 - protein, 10 aa, Influenza virus
TEIWSYNAEL

SEQ ID NO: 369017 - protein, 10 aa, Influenza virus
EIWSYNAELL

SEQ ID NO: 369018 - protein, 10 aa, Influenza virus
IWSYNAELLV

SEQ ID NO: 369019 - protein, 10 aa, Influenza virus
MVVYAELLVA

SEQ ID NO: 369020 - protein, 10 aa, Influenza virus
VVYAELLVAM

SEQ ID NO: 369021 - protein, 10 aa, Influenza virus
VYAELLVAME

SEQ ID NO: 369022 - protein, 10 aa, Influenza virus
YAELLVAMEN

SEQ ID NO: 369023 - protein, 10 aa, Influenza virus
TIDLADSEMD

SEQ ID NO: 369024 - protein, 10 aa, Influenza virus
IDLADSEMDK

SEQ ID NO: 369025 - protein, 10 aa, Influenza virus
DLADSEMDKL

SEQ ID NO: 369026 - protein, 10 aa, Influenza virus
LADSEMDKLY

SEQ ID NO: 369027 - protein, 10 aa, Influenza virus
ADSEMDKLYE

SEQ ID NO: 369028 - protein, 10 aa, Influenza virus
DSEMDKLYER

SEQ ID NO: 369029 - protein, 10 aa, Influenza virus
SEMDKLYERV

SEQ ID NO: 369030 - protein, 10 aa, Influenza virus
KLYERVRRQL

SEQ ID NO: 369031 - protein, 10 aa, Influenza virus
LYERVRRQLR

SEQ ID NO: 369032 - protein, 10 aa, Influenza virus
YERVRRQLRE

SEQ ID NO: 369033 - protein, 10 aa, Influenza virus
ERVRRQLREN

SEQ ID NO: 369034 - protein, 10 aa, Influenza virus
RVRRQLRENA

SEQ ID NO: 369035 - protein, 10 aa, Influenza virus
VRRQLRENAE

SEQ ID NO: 369036 - protein, 10 aa, Influenza virus
RRQLRENAEE

SEQ ID NO: 369037 - protein, 10 aa, Influenza virus
RQLRENAEED

SEQ ID NO: 369038 - protein, 10 aa, Influenza virus
CFEIFHKCDN

SEQ ID NO: 369039 - protein, 10 aa, Influenza virus
CMASIRNNTY

SEQ ID NO: 369040 - protein, 10 aa, Influenza virus
MASIRNNTYD

SEQ ID NO: 369041 - protein, 10 aa, Influenza virus
ASIRNNTYDH

SEQ ID NO: 369042 - protein, 10 aa, Influenza virus
SIRNNTYDHS

SEQ ID NO: 369043 - protein, 10 aa, Influenza virus
KYREEAMQNR

SEQ ID NO: 369044 - protein, 10 aa, Influenza virus
YREEAMQNRI

SEQ ID NO: 369045 - protein, 10 aa, Influenza virus
QNRIQINPVK

SEQ ID NO: 369046 - protein, 10 aa, Influenza virus
NRIQINPVKL

SEQ ID NO: 369047 - protein, 10 aa, Influenza virus
NPVKLSSGYK

SEQ ID NO: 369048 - protein, 10 aa, Influenza virus
PVKLSSGYKE

SEQ ID NO: 369049 - protein, 10 aa, Influenza virus
SSGYKDVILW

SEQ ID NO: 369050 - protein, 10 aa, Influenza virus
SGYKDVILWF

SEQ ID NO: 369051 - protein, 10 aa, Influenza virus
GYKDVILWFS

SEQ ID NO: 369052 - protein, 10 aa, Influenza virus
YKDVILWFSF

SEQ ID NO: 369053 - protein, 10 aa, Influenza virus
KDVILWFSFG

SEQ ID NO: 369054 - protein, 10 aa, Influenza virus
DVILWFSFGA

SEQ ID NO: 369055 - protein, 10 aa, Influenza virus
VILWFSFGAS

SEQ ID NO: 369056 - protein, 10 aa, Influenza virus
WFSFGASCFI

SEQ ID NO: 369057 - protein, 10 aa, Influenza virus
FSFGASCFIL

SEQ ID NO: 369058 - protein, 10 aa, Influenza virus
SFGASCFILL

SEQ ID NO: 369059 - protein, 10 aa, Influenza virus
FGASCFILLA

SEQ ID NO: 369060 - protein, 10 aa, Influenza virus
GASCFILLAI

SEQ ID NO: 369061 - protein, 10 aa, Influenza virus
FICVKNGNMR

SEQ ID NO: 369062 - protein, 10 aa, Influenza virus
ICVKNGNMRC

SEQ ID NO: 369063 - protein, 10 aa, Influenza virus
CVKNGNMRCT

SEQ ID NO: 369064 - protein, 10 aa, Influenza virus
VKNGNMRCTI

SEQ ID NO: 369065 - protein, 10 aa, Influenza virus
KNGNMQCTIC

SEQ ID NO: 369066 - protein, 10 aa, Influenza virus
DGNMRCTICI

SEQ ID NO: 369067 - protein, 10 aa, Influenza virus
GIVNTTLSTI

SEQ ID NO: 369068 - protein, 10 aa, Influenza virus
IVNTTLSTIA

SEQ ID NO: 369069 - protein, 10 aa, Influenza virus
VNTILSTKAL

SEQ ID NO: 369070 - protein, 10 aa, Influenza virus
NTTLSTIALI

SEQ ID NO: 369071 - protein, 10 aa, Influenza virus
TTLSTIALII

SEQ ID NO: 369072 - protein, 10 aa, Influenza virus
TLSTIALIIG

SEQ ID NO: 369073 - protein, 10 aa, Influenza virus
LSTIALLIGI

SEQ ID NO: 369074 - protein, 10 aa, Influenza virus
STIALLIGIG

SEQ ID NO: 369075 - protein, 10 aa, Influenza virus
TIALLIGIGN

SEQ ID NO: 369076 - protein, 10 aa, Influenza virus
IALLIGIGNL

SEQ ID NO: 369077 - protein, 10 aa, Influenza virus
IGVGNLIFNT

SEQ ID NO: 369078 - protein, 10 aa, Influenza virus
GVGNLIFNTV

SEQ ID NO: 369079 - protein, 10 aa, Influenza virus
VGNLIFNTVI

SEQ ID NO: 369080 - protein, 10 aa, Influenza virus
GNLIFNTVIH

SEQ ID NO: 369081 - protein, 10 aa, Influenza virus
NLIFNTVIHG

SEQ ID NO: 369082 - protein, 10 aa, Influenza virus
ITYNSTVVNN

SEQ ID NO: 369083 - protein, 10 aa, Influenza virus
TYNSTVVNNI

SEQ ID NO: 369084 - protein, 10 aa, Influenza virus
YNSTVVNNIT

SEQ ID NO: 369085 - protein, 10 aa, Influenza virus
NSTVVNNITT

SEQ ID NO: 369086 - protein, 10 aa, Influenza virus
STVVNNITTT

SEQ ID NO: 369087 - protein, 10 aa, Influenza virus
TVVNNITTTI

SEQ ID NO: 369088 - protein, 10 aa, Influenza virus
VVNNITTTIV

SEQ ID NO: 369089 - protein, 10 aa, Influenza virus
FKSSLPLCPF

SEQ ID NO: 369090 - protein, 10 aa, Influenza virus
SLPLCPFRGF

SEQ ID NO: 369091 - protein, 10 aa, Influenza virus
LPLCPFQGFF

SEQ ID NO: 369092 - protein, 10 aa, Influenza virus
PLCPFQGFFP

SEQ ID NO: 369093 - protein, 10 aa, Influenza virus
LCPFQGFFPF

SEQ ID NO: 369094 - protein, 10 aa, Influenza virus
CPFQGFFPFH

SEQ ID NO: 369095 - protein, 10 aa, Influenza virus
PFQGFFPFHK

SEQ ID NO: 369096 - protein, 10 aa, Influenza virus
FQGFFPFHKD

SEQ ID NO: 369097 - protein, 10 aa, Influenza virus
QGFFPFHKDN

SEQ ID NO: 369098 - protein, 10 aa, Influenza virus
FFPFHKGNSA

SEQ ID NO: 369099 - protein, 10 aa, Influenza virus
FPFHKGNSAR

SEQ ID NO: 369100 - protein, 10 aa, Influenza virus
PFHKDNALRL

SEQ ID NO: 369101 - protein, 10 aa, Influenza virus
FHKGNSARLI

SEQ ID NO: 369102 - protein, 10 aa, Influenza virus
HKDNAIRPGE

SEQ ID NO: 369103 - protein, 10 aa, Influenza virus
KDNALRLAEN

SEQ ID NO: 369104 - protein, 10 aa, Influenza virus
DNALRLAENK

SEQ ID NO: 369105 - protein, 10 aa, Influenza virus
VIVTREPYIS

SEQ ID NO: 369106 - protein, 10 aa, Influenza virus
IVTREPYISC

SEQ ID NO: 369107 - protein, 10 aa, Influenza virus
VTREPYISCD

SEQ ID NO: 369108 - protein, 10 aa, Influenza virus
TREPYVSCDY

SEQ ID NO: 369109 - protein, 10 aa, Influenza virus
DCWSFALAQG

SEQ ID NO: 369110 - protein, 10 aa, Influenza virus
CWSFALAQGV

SEQ ID NO: 369111 - protein, 10 aa, Influenza virus
WSFALAQGVL

SEQ ID NO: 369112 - protein, 10 aa, Influenza virus
SFALAQGALV

SEQ ID NO: 369113 - protein, 10 aa, Influenza virus
FALAQGALVG

SEQ ID NO: 369114 - protein, 10 aa, Influenza virus
ALAQGALVGT

SEQ ID NO: 369115 - protein, 10 aa, Influenza virus
LAQGALVGTK

SEQ ID NO: 369116 - protein, 10 aa, Influenza virus
AQGALLGTNH

SEQ ID NO: 369117 - protein, 10 aa, Influenza virus
QGALLGTNHS

SEQ ID NO: 369118 - protein, 10 aa, Influenza virus
GALVGTKHSN

SEQ ID NO: 369119 - protein, 10 aa, Influenza virus
ALVGTKHSNG

SEQ ID NO: 369120 - protein, 10 aa, Influenza virus
LLGTNHSNGT

SEQ ID NO: 369121 - protein, 10 aa, Influenza virus
KDRTSYRSLI

SEQ ID NO: 369122 - protein, 10 aa, Influenza virus
DRTPYRSLIQ

SEQ ID NO: 369123 - protein, 10 aa, Influenza virus
RTPYRSLIQF

SEQ ID NO: 369124 - protein, 10 aa, Influenza virus
TPYRSLIQFP

SEQ ID NO: 369125 - protein, 10 aa, Influenza virus
PYRSLIQFPI

SEQ ID NO: 369126 - protein, 10 aa, Influenza virus
YRSLIQFPIG

SEQ ID NO: 369127 - protein, 10 aa, Influenza virus
RSLIRFPIGV

SEQ ID NO: 369128 - protein, 10 aa, Influenza virus
SLIRFPIGVA

SEQ ID NO: 369129 - protein, 10 aa, Influenza virus
LIRFPIGVAP

SEQ ID NO: 369130 - protein, 10 aa, Influenza virus
FPIGVAPVLG

SEQ ID NO: 369131 - protein, 10 aa, Influenza virus
PIGVAPVLGN

SEQ ID NO: 369132 - protein, 10 aa, Influenza virus
IGVAPVLGNY

SEQ ID NO: 369133 - protein, 10 aa, Influenza virus
GVAPVLGNYK

SEQ ID NO: 369134 - protein, 10 aa, Influenza virus
VAPVLGNYKE

SEQ ID NO: 369135 - protein, 10 aa, Influenza virus
APVLGNYREI

SEQ ID NO: 369136 - protein, 10 aa, Influenza virus
PVLGNYREIC

SEQ ID NO: 369137 - protein, 10 aa, Influenza virus
LGNYKEICVA

SEQ ID NO: 369138 - protein, 10 aa, Influenza virus
GNYKEICVAW

SEQ ID NO: 369139 - protein, 10 aa, Influenza virus
NYKEICVAWS

SEQ ID NO: 369140 - protein, 10 aa, Influenza virus
YKEICVAWSS

SEQ ID NO: 369141 - protein, 10 aa, Influenza virus
EICVAWSSSS

SEQ ID NO: 369142 - protein, 10 aa, Influenza virus
ICVAWSSSSC

SEQ ID NO: 369143 - protein, 10 aa, Influenza virus
CVAWSSSSCF

SEQ ID NO: 369144 - protein, 10 aa, Influenza virus
VAWSSSSCFD

SEQ ID NO: 369145 - protein, 10 aa, Influenza virus
AWSSTSCFDG

SEQ ID NO: 369146 - protein, 10 aa, Influenza virus
WSSTSCFDGK

SEQ ID NO: 369147 - protein, 10 aa, Influenza virus
SSTSCFDGKE

SEQ ID NO: 369148 - protein, 10 aa, Influenza virus
STSCFDGKEW

SEQ ID NO: 369149 - protein, 10 aa, Influenza virus
TSCFDGKEWM

SEQ ID NO: 369150 - protein, 10 aa, Influenza virus
CFDGKEWLHV

SEQ ID NO: 369151 - protein, 10 aa, Influenza virus
FDGKEWMHIC

SEQ ID NO: 369152 - protein, 10 aa, Influenza virus
DGKEWMHVCI

SEQ ID NO: 369153 - protein, 10 aa, Influenza virus
GKEWMHVCIT

SEQ ID NO: 369154 - protein, 10 aa, Influenza virus
KEWMHVCITG

SEQ ID NO: 369155 - protein, 10 aa, Influenza virus
GKMTDSIKSW

SEQ ID NO: 369156 - protein, 10 aa, Influenza virus
KMTDSIKSWR

SEQ ID NO: 369157 - protein, 10 aa, Influenza virus
MTDSIKSWRR

SEQ ID NO: 369158 - protein, 10 aa, Influenza virus
TDSIKSWRRD

SEQ ID NO: 369159 - protein, 10 aa, Influenza virus
DSIKSWRRDI

SEQ ID NO: 369160 - protein, 10 aa, Influenza virus
SIKSWRRDIL

SEQ ID NO: 369161 - protein, 10 aa, Influenza virus
IKSWRRDILR

SEQ ID NO: 369162 - protein, 10 aa, Influenza virus
KSWRRDILRT

SEQ ID NO: 369163 - protein, 10 aa, Influenza virus
SWRRDILRTQ

SEQ ID NO: 369164 - protein, 10 aa, Influenza virus
WRRDILRTQE

SEQ ID NO: 369165 - protein, 10 aa, Influenza virus
RRDILRTQES

SEQ ID NO: 369166 - protein, 10 aa, Influenza virus
RDILRTQESE

SEQ ID NO: 369167 - protein, 10 aa, Influenza virus
LRTQESECLC

SEQ ID NO: 369168 - protein, 10 aa, Influenza virus
RTQESECQRI

SEQ ID NO: 369169 - protein, 10 aa, Influenza virus
TQESECQCIG

SEQ ID NO: 369170 - protein, 10 aa, Influenza virus
QESECQCIGG

SEQ ID NO: 369171 - protein, 10 aa, Influenza virus
GTCVVTVTDG

SEQ ID NO: 369172 - protein, 10 aa, Influenza virus
TCVVTVTDGP

SEQ ID NO: 369173 - protein, 10 aa, Influenza virus
CVVTVTDGPA

SEQ ID NO: 369174 - protein, 10 aa, Influenza virus
VVTVTDGPAA

SEQ ID NO: 369175 - protein, 10 aa, Influenza virus
VTVTDGPAAN

SEQ ID NO: 369176 - protein, 10 aa, Influenza virus
AVTDGPAANN

SEQ ID NO: 369177 - protein, 10 aa, Influenza virus
VTDGPAANNA

SEQ ID NO: 369178 - protein, 10 aa, Influenza virus
TDGPAANNAD

SEQ ID NO: 369179 - protein, 10 aa, Influenza virus
DGPAANNADH

SEQ ID NO: 369180 - protein, 10 aa, Influenza virus
GPAANNADHR

SEQ ID NO: 369181 - protein, 10 aa, Influenza virus
PAANSADHRI

SEQ ID NO: 369182 - protein, 10 aa, Influenza virus
AANSADHRIY

SEQ ID NO: 369183 - protein, 10 aa, Influenza virus
ANSADHRIYW

SEQ ID NO: 369184 - protein, 10 aa, Influenza virus
NSADHRIYWI

SEQ ID NO: 369185 - protein, 10 aa, Influenza virus
SADHRIYWIR

SEQ ID NO: 369186 - protein, 10 aa, Influenza virus
ADHRIYWIRE

SEQ ID NO: 369187 - protein, 10 aa, Influenza virus
DHRIYWIREG

SEQ ID NO: 369188 - protein, 10 aa, Influenza virus
HRVYWIREGK

SEQ ID NO: 369189 - protein, 10 aa, Influenza virus
KIKHLEECSC

SEQ ID NO: 369190 - protein, 10 aa, Influenza virus
IKHLEECSCY

SEQ ID NO: 369191 - protein, 10 aa, Influenza virus
KHLEECSCYV

SEQ ID NO: 369192 - protein, 10 aa, Influenza virus
HLEECSCYMD

SEQ ID NO: 369193 - protein, 10 aa, Influenza virus
LEECSCYMDI

SEQ ID NO: 369194 - protein, 10 aa, Influenza virus
EECSCYMDID

SEQ ID NO: 369195 - protein, 10 aa, Influenza virus
ECSCYVDIDI

SEQ ID NO: 369196 - protein, 10 aa, Influenza virus
CSCYVDIDIY

SEQ ID NO: 369197 - protein, 10 aa, Influenza virus
SCYVDIDIYC

SEQ ID NO: 369198 - protein, 10 aa, Influenza virus
DIDIYCICRD

SEQ ID NO: 369199 - protein, 10 aa, Influenza virus
IDIYCICRDN

SEQ ID NO: 369200 - protein, 10 aa, Influenza virus
DIYCICRDNW

SEQ ID NO: 369201 - protein, 10 aa, Influenza virus
IYCICRDNWK

SEQ ID NO: 369202 - protein, 10 aa, Influenza virus
YCVCRDNWKG

SEQ ID NO: 369203 - protein, 10 aa, Influenza virus
CVCRDNWKGS

SEQ ID NO: 369204 - protein, 10 aa, Influenza virus
VCRDNWKGSN

SEQ ID NO: 369205 - protein, 10 aa, Influenza virus
NWKGSNRPWI

SEQ ID NO: 369206 - protein, 10 aa, Influenza virus
WKGSNRPWIR

SEQ ID NO: 369207 - protein, 10 aa, Influenza virus
KGSNRPWIRI

SEQ ID NO: 369208 - protein, 10 aa, Influenza virus
GSNRPWIRIN

SEQ ID NO: 369209 - protein, 10 aa, Influenza virus
SNRPWIRINN

SEQ ID NO: 369210 - protein, 10 aa, Influenza virus
NRPWIRINNE

SEQ ID NO: 369211 - protein, 10 aa, Influenza virus
RPWIRINNET

SEQ ID NO: 369212 - protein, 10 aa, Influenza virus
PWIRINNETI

SEQ ID NO: 369213 - protein, 10 aa, Influenza virus
WIRINNETIL

SEQ ID NO: 369214 - protein, 10 aa, Influenza virus
IRINNETILE

SEQ ID NO: 369215 - protein, 10 aa, Influenza virus
RISNETILET

SEQ ID NO: 369216 - protein, 10 aa, Influenza virus
ISNETILETG

SEQ ID NO: 369217 - protein, 10 aa, Influenza virus
SNETILETGY

SEQ ID NO: 369218 - protein, 10 aa, Influenza virus
NETILETGYI

SEQ ID NO: 369219 - protein, 10 aa, Influenza virus
ETILETRYVC

SEQ ID NO: 369220 - protein, 10 aa, Influenza virus
TILETGYICS

SEQ ID NO: 369221 - protein, 10 aa, Influenza virus
IVETGYVCSK

SEQ ID NO: 369222 - protein, 10 aa, Influenza virus
LETGYICSKF

SEQ ID NO: 369223 - protein, 10 aa, Influenza virus
ETGYICSKFH

SEQ ID NO: 369224 - protein, 10 aa, Influenza virus
TRYVCSKFHS

SEQ ID NO: 369225 - protein, 10 aa, Influenza virus
RYVCSKFHSD

SEQ ID NO: 369226 - protein, 10 aa, Influenza virus
KFHSDTPRPD

SEQ ID NO: 369227 - protein, 10 aa, Influenza virus
FHSDTPRPDD

SEQ ID NO: 369228 - protein, 10 aa, Influenza virus
HSDTPRPDDP

SEQ ID NO: 369229 - protein, 10 aa, Influenza virus
SDTPRPDDPS

SEQ ID NO: 369230 - protein, 10 aa, Influenza virus
DPSTMSCDSP

SEQ ID NO: 369231 - protein, 10 aa, Influenza virus
PSTMSCDSPS

SEQ ID NO: 369232 - protein, 10 aa, Influenza virus
STMSCDSPSN

SEQ ID NO: 369233 - protein, 10 aa, Influenza virus
SCDSPSNING

SEQ ID NO: 369234 - protein, 10 aa, Influenza virus
CDSPSNINGG

SEQ ID NO: 369235 - protein, 10 aa, Influenza virus
NGGLGVKGFG

SEQ ID NO: 369236 - protein, 10 aa, Influenza virus
GGLGVKGFGF

SEQ ID NO: 369237 - protein, 10 aa, Influenza virus
GLGVKGFGFK

SEQ ID NO: 369238 - protein, 10 aa, Influenza virus
GVKGFGFKTG

SEQ ID NO: 369239 - protein, 10 aa, Influenza virus
GDDVWLGRTV

SEQ ID NO: 369240 - protein, 10 aa, Influenza virus
DDVWLGRTVS

SEQ ID NO: 369241 - protein, 10 aa, Influenza virus
DVWLGRTVSN

SEQ ID NO: 369242 - protein, 10 aa, Influenza virus
VWLGRTVSNS

SEQ ID NO: 369243 - protein, 10 aa, Influenza virus
WLGRTVSNSG

SEQ ID NO: 369244 - protein, 10 aa, Influenza virus
LGRTVSNSGR

SEQ ID NO: 369245 - protein, 10 aa, Influenza virus
GRTVSNSGRS

SEQ ID NO: 369246 - protein, 10 aa, Influenza virus
EGWINSPNHV

SEQ ID NO: 369247 - protein, 10 aa, Influenza virus
GWINSPNHVK

SEQ ID NO: 369248 - protein, 10 aa, Influenza virus
WINSPNHVKS

SEQ ID NO: 369249 - protein, 10 aa, Influenza virus
AKSITQTLVS

SEQ ID NO: 369250 - protein, 10 aa, Influenza virus
KSVTQTLVSN

SEQ ID NO: 369251 - protein, 10 aa, Influenza virus
SVTQTLVSNN

SEQ ID NO: 369252 - protein, 10 aa, Influenza virus
VTQTLVSNND

SEQ ID NO: 369253 - protein, 10 aa, Influenza virus
TQTLVSNDDW

SEQ ID NO: 369254 - protein, 10 aa, Influenza virus
QTLVSNDDWS

SEQ ID NO: 369255 - protein, 10 aa, Influenza virus
TLVSNSDWSG

SEQ ID NO: 369256 - protein, 10 aa, Influenza virus
LVSNDDWSGY

SEQ ID NO: 369257 - protein, 10 aa, Influenza virus
VSNSDWSGYS

SEQ ID NO: 369258 - protein, 10 aa, Influenza virus
SNSDWSGYSG

SEQ ID NO: 369259 - protein, 10 aa, Influenza virus
NSDWSGYSGS

SEQ ID NO: 369260 - protein, 10 aa, Influenza virus
DDWSGYSGSF

SEQ ID NO: 369261 - protein, 10 aa, Influenza virus
DWSGYSGSFV

SEQ ID NO: 369262 - protein, 10 aa, Influenza virus
WSGYSGSFII

SEQ ID NO: 369263 - protein, 10 aa, Influenza virus
GCFQPCFYIE

SEQ ID NO: 369264 - protein, 10 aa, Influenza virus
CFQPCFYIEL

SEQ ID NO: 369265 - protein, 10 aa, Influenza virus
FQPCFYIELI

SEQ ID NO: 369266 - protein, 10 aa, Influenza virus
QPCFYIELIR

SEQ ID NO: 369267 - protein, 10 aa, Influenza virus
PCFYIELIRG

SEQ ID NO: 369268 - protein, 10 aa, Influenza virus
CFYIELIRGR

SEQ ID NO: 369269 - protein, 10 aa, Influenza virus
FYIELIRGRP

SEQ ID NO: 369270 - protein, 10 aa, Influenza virus
YIELIRGRPN

SEQ ID NO: 369271 - protein, 10 aa, Influenza virus
NDNVSWTSNS

SEQ ID NO: 369272 - protein, 10 aa, Influenza virus
DNVSWTSNSI

SEQ ID NO: 369273 - protein, 10 aa, Influenza virus
NVSWTSNSIV

SEQ ID NO: 369274 - protein, 10 aa, Influenza virus
VSWASNSIVT

SEQ ID NO: 369275 - protein, 10 aa, Influenza virus
SWASNSIVTF

SEQ ID NO: 369276 - protein, 10 aa, Influenza virus
WASNSIVTFC

SEQ ID NO: 369277 - protein, 10 aa, Influenza virus
ASNSIVTFCG

SEQ ID NO: 369278 - protein, 10 aa, Influenza virus
NSIVTFCGLN

SEQ ID NO: 369279 - protein, 10 aa, Influenza virus
SIVTFCGLNN

SEQ ID NO: 369280 - protein, 10 aa, Influenza virus
IVTFCGLNNE

SEQ ID NO: 369281 - protein, 10 aa, Influenza virus
VTFCGLNNEP

SEQ ID NO: 369282 - protein, 10 aa, Influenza virus
TFCGLNNEPG

SEQ ID NO: 369283 - protein, 10 aa, Influenza virus
FCGLNNEPGS

SEQ ID NO: 369284 - protein, 10 aa, Influenza virus
CGLNNEPGSG

SEQ ID NO: 369285 - protein, 10 aa, Influenza virus
GLNNEPGSGN

SEQ ID NO: 369286 - protein, 10 aa, Influenza virus
LNNEPGSGNW

SEQ ID NO: 369287 - protein, 10 aa, Influenza virus
NNEPGSGNWP

SEQ ID NO: 369288 - protein, 10 aa, Influenza virus
PGSGNWPDGA

SEQ ID NO: 369289 - protein, 10 aa, Influenza virus
GSGHWPDGSN

SEQ ID NO: 369290 - protein, 10 aa, Influenza virus
SGNWPDGANI

SEQ ID NO: 369291 - protein, 10 aa, Influenza virus
GNWPDGSDIG

SEQ ID NO: 369292 - protein, 10 aa, Influenza virus
NWPDGSDIGF

SEQ ID NO: 369293 - protein, 10 aa, Influenza virus
WPDGANIGFM

SEQ ID NO: 369294 - protein, 10 aa, Influenza virus
PDGSDIGFMP

SEQ ID NO: 369295 - protein, 10 aa, Influenza virus
DGANIGFMPK

SEQ ID NO: 369296 - protein, 10 aa, Influenza virus
SKSRGYKMNI

SEQ ID NO: 369297 - protein, 10 aa, Influenza virus
KSRGYKMNTK

SEQ ID NO: 369298 - protein, 10 aa, Influenza virus
SRGYKMNIQI

SEQ ID NO: 369299 - protein, 10 aa, Influenza virus
RGYKMNIQIL

SEQ ID NO: 369300 - protein, 10 aa, Influenza virus
GYKMNIQILI

SEQ ID NO: 369301 - protein, 10 aa, Influenza virus
YKMNTKILVL

SEQ ID NO: 369302 - protein, 10 aa, Influenza virus
KMNTQILIFA

SEQ ID NO: 369303 - protein, 10 aa, Influenza virus
GDKICLGHHA

SEQ ID NO: 369304 - protein, 10 aa, Influenza virus
DKICLGRHAV

SEQ ID NO: 369305 - protein, 10 aa, Influenza virus
NGTKVDTLTE

SEQ ID NO: 369306 - protein, 10 aa, Influenza virus
GTKVDTLTEK

SEQ ID NO: 369307 - protein, 10 aa, Influenza virus
KVDTLTEKGI

SEQ ID NO: 369308 - protein, 10 aa, Influenza virus
VDTLTEKGIE

SEQ ID NO: 369309 - protein, 10 aa, Influenza virus
DTLTEKGIEV

SEQ ID NO: 369310 - protein, 10 aa, Influenza virus
TLTEKGIEVV

SEQ ID NO: 369311 - protein, 10 aa, Influenza virus
LTEKGIEVVN

SEQ ID NO: 369312 - protein, 10 aa, Influenza virus
TEKGIEVVNA

SEQ ID NO: 369313 - protein, 10 aa, Influenza virus
EKGIEVVNAT

SEQ ID NO: 369314 - protein, 10 aa, Influenza virus
KGIEVVNATE

SEQ ID NO: 369315 - protein, 10 aa, Influenza virus
GIEVVNATET

SEQ ID NO: 369316 - protein, 10 aa, Influenza virus
IEVVNATETV

SEQ ID NO: 369317 - protein, 10 aa, Influenza virus
VVNATETVEQ

SEQ ID NO: 369318 - protein, 10 aa, Influenza virus
DLGQCGLLGI

SEQ ID NO: 369319 - protein, 10 aa, Influenza virus
IGPPQCDQFL

SEQ ID NO: 369320 - protein, 10 aa, Influenza virus
GPPQCDLFLE

SEQ ID NO: 369321 - protein, 10 aa, Influenza virus
PPQCDLFLEF

SEQ ID NO: 369322 - protein, 10 aa, Influenza virus
LRQILRKSGG

SEQ ID NO: 369323 - protein, 10 aa, Influenza virus
MGFTYTGVRT

SEQ ID NO: 369324 - protein, 10 aa, Influenza virus
GFTYTGVRTN

SEQ ID NO: 369325 - protein, 10 aa, Influenza virus
FTYTGVRTNG

SEQ ID NO: 369326 - protein, 10 aa, Influenza virus
RSRSSFYAEM

SEQ ID NO: 369327 - protein, 10 aa, Influenza virus
SRSSFYAEMK

SEQ ID NO: 369328 - protein, 10 aa, Influenza virus
RSSFYAEMKW

SEQ ID NO: 369329 - protein, 10 aa, Influenza virus
SSFYAEMEWL

SEQ ID NO: 369330 - protein, 10 aa, Influenza virus
SFYAEMEWLL

SEQ ID NO: 369331 - protein, 10 aa, Influenza virus
FYAEMEWLLS

SEQ ID NO: 369332 - protein, 10 aa, Influenza virus
YAEMKWLLSS

SEQ ID NO: 369333 - protein, 10 aa, Influenza virus
FPQTTKSYKN

SEQ ID NO: 369334 - protein, 10 aa, Influenza virus
PALIVWGIHH

SEQ ID NO: 369335 - protein, 10 aa, Influenza virus
TVGSSKYQQS

SEQ ID NO: 369336 - protein, 10 aa, Influenza virus
RPQINGQSGR

SEQ ID NO: 369337 - protein, 10 aa, Influenza virus
PQINGQSGRI

SEQ ID NO: 369338 - protein, 10 aa, Influenza virus
QINGQSGRID

SEQ ID NO: 369339 - protein, 10 aa, Influenza virus
INGQSGRIDF

SEQ ID NO: 369340 - protein, 10 aa, Influenza virus
NGQSGRIDFY

SEQ ID NO: 369341 - protein, 10 aa, Influenza virus
GQSGRIDFYW

SEQ ID NO: 369342 - protein, 10 aa, Influenza virus
QSGRIDFYWL

SEQ ID NO: 369343 - protein, 10 aa, Influenza virus
NDTVTFTFNG

SEQ ID NO: 369344 - protein, 10 aa, Influenza virus
DTVTFTFNGA

SEQ ID NO: 369345 - protein, 10 aa, Influenza virus
TVTFTFNGAF

SEQ ID NO: 369346 - protein, 10 aa, Influenza virus
TFTFNGAFIA

SEQ ID NO: 369347 - protein, 10 aa, Influenza virus
FTFNGAFIAP

SEQ ID NO: 369348 - protein, 10 aa, Influenza virus
FNGAFVAPDR

SEQ ID NO: 369349 - protein, 10 aa, Influenza virus
NGAFVAPDRV

SEQ ID NO: 369350 - protein, 10 aa, Influenza virus
GAFVAPDRVS

SEQ ID NO: 369351 - protein, 10 aa, Influenza virus
AFVAPDRVSF

SEQ ID NO: 369352 - protein, 10 aa, Influenza virus
LPFQNINSRT

SEQ ID NO: 369353 - protein, 10 aa, Influenza virus
IGKCPRYVKQ

SEQ ID NO: 369354 - protein, 10 aa, Influenza virus
SLMLATGMKN

SEQ ID NO: 369355 - protein, 10 aa, Influenza virus
LMLATGMKNV

SEQ ID NO: 369356 - protein, 10 aa, Influenza virus
MLATGMKNVP

SEQ ID NO: 369357 - protein, 10 aa, Influenza virus
LATGMRNVPE

SEQ ID NO: 369358 - protein, 10 aa, Influenza virus
AHKQLTHHMR

SEQ ID NO: 369359 - protein, 10 aa, Influenza virus
KKKKKRGLFG

SEQ ID NO: 369360 - protein, 10 aa, Influenza virus
KRKKRGLFGA

SEQ ID NO: 369361 - protein, 10 aa, Influenza virus
RRRGLFGAIA

SEQ ID NO: 369362 - protein, 10 aa, Influenza virus
KGLFGAIAGF

SEQ ID NO: 369363 - protein, 10 aa, Influenza virus
FIENGWEGLV

SEQ ID NO: 369364 - protein, 10 aa, Influenza virus
IENGWEGLVD

SEQ ID NO: 369365 - protein, 10 aa, Influenza virus
ENGWEGLVDG

SEQ ID NO: 369366 - protein, 10 aa, Influenza virus
NGWEGLVDGW

SEQ ID NO: 369367 - protein, 10 aa, Influenza virus
GWEGLVDGWY

SEQ ID NO: 369368 - protein, 10 aa, Influenza virus
WEGLVDGWYG

SEQ ID NO: 369369 - protein, 10 aa, Influenza virus
EGLVDGWYGF

SEQ ID NO: 369370 - protein, 10 aa, Influenza virus
GLVDGWYGFR

SEQ ID NO: 369371 - protein, 10 aa, Influenza virus
LVDGWYGFRH

SEQ ID NO: 369372 - protein, 10 aa, Influenza virus
VDGWYGFRHQ

SEQ ID NO: 369373 - protein, 10 aa, Influenza virus
DGWYGYRHQN

SEQ ID NO: 369374 - protein, 10 aa, Influenza virus
GWYGYRHQNA

SEQ ID NO: 369375 - protein, 10 aa, Influenza virus
WYGYRHQNAQ

SEQ ID NO: 369376 - protein, 10 aa, Influenza virus
YGYRHQNAQG

SEQ ID NO: 369377 - protein, 10 aa, Influenza virus
GYRHQNAQGE

SEQ ID NO: 369378 - protein, 10 aa, Influenza virus
YRHQNAQGEG

SEQ ID NO: 369379 - protein, 10 aa, Influenza virus
KHQNAQGEGT

SEQ ID NO: 369380 - protein, 10 aa, Influenza virus
HQNSQGEGTA

SEQ ID NO: 369381 - protein, 10 aa, Influenza virus
QNSQGEGTAA

SEQ ID NO: 369382 - protein, 10 aa, Influenza virus
NSQGEGTAAD

SEQ ID NO: 369383 - protein, 10 aa, Influenza virus
SQGEGTAADY

SEQ ID NO: 369384 - protein, 10 aa, Influenza virus
ADYKSTQAAI

SEQ ID NO: 369385 - protein, 10 aa, Influenza virus
DYKSTQSAIN

SEQ ID NO: 369386 - protein, 10 aa, Influenza virus
YKSTQSAINQ

SEQ ID NO: 369387 - protein, 10 aa, Influenza virus
KSTQSAINQI

SEQ ID NO: 369388 - protein, 10 aa, Influenza virus
STQSAINQIT

SEQ ID NO: 369389 - protein, 10 aa, Influenza virus
TQSAINQITG

SEQ ID NO: 369390 - protein, 10 aa, Influenza virus
QSAINQITGK

SEQ ID NO: 369391 - protein, 10 aa, Influenza virus
SAINQITGKL

SEQ ID NO: 369392 - protein, 10 aa, Influenza virus
AINQITGKLN

SEQ ID NO: 369393 - protein, 10 aa, Influenza virus
INQITGKLNR

SEQ ID NO: 369394 - protein, 10 aa, Influenza virus
NQITGKLNRL

SEQ ID NO: 369395 - protein, 10 aa, Influenza virus
QITGTLNRLI

SEQ ID NO: 369396 - protein, 10 aa, Influenza virus
ITGKLNRLID

SEQ ID NO: 369397 - protein, 10 aa, Influenza virus
TGKLNRLIDK

SEQ ID NO: 369398 - protein, 10 aa, Influenza virus
GKLNRLIDKT

SEQ ID NO: 369399 - protein, 10 aa, Influenza virus
KLNRLIDKTN

SEQ ID NO: 369400 - protein, 10 aa, Influenza virus
LNRLIDKTNQ

SEQ ID NO: 369401 - protein, 10 aa, Influenza virus
NRLIDKTNQQ

SEQ ID NO: 369402 - protein, 10 aa, Influenza virus
RLIDKTNQQF

SEQ ID NO: 369403 - protein, 10 aa, Influenza virus
LIDKTNQQFE

SEQ ID NO: 369404 - protein, 10 aa, Influenza virus
IDKTNQQFEL

SEQ ID NO: 369405 - protein, 10 aa, Influenza virus
DKTNQQFELI

SEQ ID NO: 369406 - protein, 10 aa, Influenza virus
RTNQQFELID

SEQ ID NO: 369407 - protein, 10 aa, Influenza virus
TNQQFEMIDN

SEQ ID NO: 369408 - protein, 10 aa, Influenza virus
NQQFEMIDNE

SEQ ID NO: 369409 - protein, 10 aa, Influenza virus
QQFEMIDNEF

SEQ ID NO: 369410 - protein, 10 aa, Influenza virus
QFELIDNEFN

SEQ ID NO: 369411 - protein, 10 aa, Influenza virus
FELIDNEFNE

SEQ ID NO: 369412 - protein, 10 aa, Influenza virus
EIEKQIGNVI

SEQ ID NO: 369413 - protein, 10 aa, Influenza virus
IEKQIGNVIN

SEQ ID NO: 369414 - protein, 10 aa, Influenza virus
EQQIGNVINW

SEQ ID NO: 369415 - protein, 10 aa, Influenza virus
QQIGNVINWT

SEQ ID NO: 369416 - protein, 10 aa, Influenza virus
QLGNVINWTR

SEQ ID NO: 369417 - protein, 10 aa, Influenza virus
LGNVINWTRD

SEQ ID NO: 369418 - protein, 10 aa, Influenza virus
NVINWTRDSI

SEQ ID NO: 369419 - protein, 10 aa, Influenza virus
VINWTRDSIT

SEQ ID NO: 369420 - protein, 10 aa, Influenza virus
INWTRDSITE

SEQ ID NO: 369421 - protein, 10 aa, Influenza virus
IEVWSYNAEF

SEQ ID NO: 369422 - protein, 10 aa, Influenza virus
EVWSYNAEFL

SEQ ID NO: 369423 - protein, 10 aa, Influenza virus
WSYNAEFLVA

SEQ ID NO: 369424 - protein, 10 aa, Influenza virus
SYNAEFLVAV

SEQ ID NO: 369425 - protein, 10 aa, Influenza virus
YNAEFLVAVE

SEQ ID NO: 369426 - protein, 10 aa, Influenza virus
NAEFLVAVEN

SEQ ID NO: 369427 - protein, 10 aa, Influenza virus
AEFLVAVENQ

SEQ ID NO: 369428 - protein, 10 aa, Influenza virus
EFLVAVENQH

SEQ ID NO: 369429 - protein, 10 aa, Influenza virus
FLVAVENQHT

SEQ ID NO: 369430 - protein, 10 aa, Influenza virus
LVAVENQHTI

SEQ ID NO: 369431 - protein, 10 aa, Influenza virus
VAVENQHTID

SEQ ID NO: 369432 - protein, 10 aa, Influenza virus
AVENQHTIDL

SEQ ID NO: 369433 - protein, 10 aa, Influenza virus
VENQHTIDLT

SEQ ID NO: 369434 - protein, 10 aa, Influenza virus
ENQHTIDLTD

SEQ ID NO: 369435 - protein, 10 aa, Influenza virus
NQHTIDLTDS

SEQ ID NO: 369436 - protein, 10 aa, Influenza virus
QHTIDLTDSE

SEQ ID NO: 369437 - protein, 10 aa, Influenza virus
HTIDLTDSEM

SEQ ID NO: 369438 - protein, 10 aa, Influenza virus
TIDLTDSEMN

SEQ ID NO: 369439 - protein, 10 aa, Influenza virus
IDLTDSEMNK

SEQ ID NO: 369440 - protein, 10 aa, Influenza virus
DLTDSEMNKL

SEQ ID NO: 369441 - protein, 10 aa, Influenza virus
LTDSEMNKLY

SEQ ID NO: 369442 - protein, 10 aa, Influenza virus
TDSEMNKLYE

SEQ ID NO: 369443 - protein, 10 aa, Influenza virus
DSEMNKLYEK

SEQ ID NO: 369444 - protein, 10 aa, Influenza virus
SEMNKLYEKV

SEQ ID NO: 369445 - protein, 10 aa, Influenza virus
EMNKLYERVK

SEQ ID NO: 369446 - protein, 10 aa, Influenza virus
MNKLYERVRR

SEQ ID NO: 369447 - protein, 10 aa, Influenza virus
NKLYERVRRQ

SEQ ID NO: 369448 - protein, 10 aa, Influenza virus
KLYERVRRQL

SEQ ID NO: 369449 - protein, 10 aa, Influenza virus
LYERVRRQLR

SEQ ID NO: 369450 - protein, 10 aa, Influenza virus
YERVRRQLRE

SEQ ID NO: 369451 - protein, 10 aa, Influenza virus
ERVRRQLREN

SEQ ID NO: 369452 - protein, 10 aa, Influenza virus
RVRRQLRENA

SEQ ID NO: 369453 - protein, 10 aa, Influenza virus
VKRQLRENAE

SEQ ID NO: 369454 - protein, 10 aa, Influenza virus
KRQLRENAEE

SEQ ID NO: 369455 - protein, 10 aa, Influenza virus
KQLRENAEED

SEQ ID NO: 369456 - protein, 10 aa, Influenza virus
QLRENAEEDC

SEQ ID NO: 369457 - protein, 10 aa, Influenza virus
LRENAEEDGN

SEQ ID NO: 369458 - protein, 10 aa, Influenza virus
RENAEEDGNG

SEQ ID NO: 369459 - protein, 10 aa, Influenza virus
ENAEEDGNGC

SEQ ID NO: 369460 - protein, 10 aa, Influenza virus
NAEEDGNGCF

SEQ ID NO: 369461 - protein, 10 aa, Influenza virus
AEEDGNGCFE

SEQ ID NO: 369462 - protein, 10 aa, Influenza virus
EEDGNGCFEI

SEQ ID NO: 369463 - protein, 10 aa, Influenza virus
EDGNGCFEIF

SEQ ID NO: 369464 - protein, 10 aa, Influenza virus
DGNGCFEIFH

SEQ ID NO: 369465 - protein, 10 aa, Influenza virus
GNGCFEIFHQ

SEQ ID NO: 369466 - protein, 10 aa, Influenza virus
NGCFEIFHQC

SEQ ID NO: 369467 - protein, 10 aa, Influenza virus
GCFEIFHQCD

SEQ ID NO: 369468 - protein, 10 aa, Influenza virus
CFEIFHQCDN

SEQ ID NO: 369469 - protein, 10 aa, Influenza virus
FEIFHQCDND

SEQ ID NO: 369470 - protein, 10 aa, Influenza virus
EIFHQCDNDC

SEQ ID NO: 369471 - protein, 10 aa, Influenza virus
IFHQCDNDCM

SEQ ID NO: 369472 - protein, 10 aa, Influenza virus
CMESIRNNTY

SEQ ID NO: 369473 - protein, 10 aa, Influenza virus
MESIRNNTYD

SEQ ID NO: 369474 - protein, 10 aa, Influenza virus
ESIRNNTYDH

SEQ ID NO: 369475 - protein, 10 aa, Influenza virus
SIRNNTYDHK

SEQ ID NO: 369476 - protein, 10 aa, Influenza virus
IRNNTYDHKK

SEQ ID NO: 369477 - protein, 10 aa, Influenza virus
RNNTYDHKKY

SEQ ID NO: 369478 - protein, 10 aa, Influenza virus
NNTYDHKKYR

SEQ ID NO: 369479 - protein, 10 aa, Influenza virus
IDAVKLSSGY

SEQ ID NO: 369480 - protein, 10 aa, Influenza virus
DAVKLSSGYK

SEQ ID NO: 369481 - protein, 10 aa, Influenza virus
AVKLSSGYKD

SEQ ID NO: 369482 - protein, 10 aa, Influenza virus
VKLSSGYKDI

SEQ ID NO: 369483 - protein, 10 aa, Influenza virus
KLSSGYKDII

SEQ ID NO: 369484 - protein, 10 aa, Influenza virus
LSSGYKDIIL

SEQ ID NO: 369485 - protein, 10 aa, Influenza virus
SSGYKDIILW

SEQ ID NO: 369486 - protein, 10 aa, Influenza virus
SGYKDIILWF

SEQ ID NO: 369487 - protein, 10 aa, Influenza virus
GYKDIILWFS

SEQ ID NO: 369488 - protein, 10 aa, Influenza virus
YKDIILWFSF

SEQ ID NO: 369489 - protein, 10 aa, Influenza virus
KDIILWFSFG

SEQ ID NO: 369490 - protein, 10 aa, Influenza virus
DIILWFSFGA

SEQ ID NO: 369491 - protein, 10 aa, Influenza virus
IILWFSFGAS

SEQ ID NO: 369492 - protein, 10 aa, Influenza virus
ILWFSLGASC

SEQ ID NO: 369493 - protein, 10 aa, Influenza virus
LWFSLGASCF

SEQ ID NO: 369494 - protein, 10 aa, Influenza virus
WFSFGASCFL

SEQ ID NO: 369495 - protein, 10 aa, Influenza virus
FSFGASCFLL

SEQ ID NO: 369496 - protein, 10 aa, Influenza virus
GASCFLLLAI

SEQ ID NO: 369497 - protein, 10 aa, Influenza virus
LVFMCVKNGN

SEQ ID NO: 369498 - protein, 10 aa, Influenza virus
VFMCVKNGNM

SEQ ID NO: 369499 - protein, 10 aa, Influenza virus
FMCVKNGNMR

SEQ ID NO: 369500 - protein, 10 aa, Influenza virus
MCVKNGNMRC

SEQ ID NO: 369501 - protein, 10 aa, Influenza virus
CIKNGNMRCT

SEQ ID NO: 369502 - protein, 10 aa, Influenza virus
IKNGNMRCTI

SEQ ID NO: 369503 - protein, 10 aa, Influenza virus
KNGNMQCTIC

SEQ ID NO: 369504 - protein, 10 aa, Influenza virus
NGNMQCTICI

SEQ ID NO: 369505 - protein, 10 aa, Influenza virus
MNPNQKLFAS

SEQ ID NO: 369506 - protein, 10 aa, Influenza virus
NPNQKLFASS

SEQ ID NO: 369507 - protein, 10 aa, Influenza virus
PNQKLFASSG

SEQ ID NO: 369508 - protein, 10 aa, Influenza virus
NQKLFASSGI

SEQ ID NO: 369509 - protein, 10 aa, Influenza virus
QKLFASSGIA

SEQ ID NO: 369510 - protein, 10 aa, Influenza virus
KLFASSGIAI

SEQ ID NO: 369511 - protein, 10 aa, Influenza virus
LFASSGIAIV

SEQ ID NO: 369512 - protein, 10 aa, Influenza virus
FASSGIAIVL

SEQ ID NO: 369513 - protein, 10 aa, Influenza virus
ASSGIAIVLG

SEQ ID NO: 369514 - protein, 10 aa, Influenza virus
LSGVAIALSI

SEQ ID NO: 369515 - protein, 10 aa, Influenza virus
SGVAIALSIL

SEQ ID NO: 369516 - protein, 10 aa, Influenza virus
GVAIALSILN

SEQ ID NO: 369517 - protein, 10 aa, Influenza virus
VAIALSILNL

SEQ ID NO: 369518 - protein, 10 aa, Influenza virus
AIALSILNLL

SEQ ID NO: 369519 - protein, 10 aa, Influenza virus
IALSILNLLI

SEQ ID NO: 369520 - protein, 10 aa, Influenza virus
ALSILNLLIG

SEQ ID NO: 369521 - protein, 10 aa, Influenza virus
LSILNLLIGI

SEQ ID NO: 369522 - protein, 10 aa, Influenza virus
SILNLLIGIS

SEQ ID NO: 369523 - protein, 10 aa, Influenza virus
ILNLLIGISN

SEQ ID NO: 369524 - protein, 10 aa, Influenza virus
INLLIGISNM

SEQ ID NO: 369525 - protein, 10 aa, Influenza virus
NLLIGISNMS

SEQ ID NO: 369526 - protein, 10 aa, Influenza virus
LLIGISNMSL

SEQ ID NO: 369527 - protein, 10 aa, Influenza virus
LIGISNMSLN

SEQ ID NO: 369528 - protein, 10 aa, Influenza virus
SNMSLNISLY

SEQ ID NO: 369529 - protein, 10 aa, Influenza virus
NMSLNISLYS

SEQ ID NO: 369530 - protein, 10 aa, Influenza virus
ENTYVNNTTV

SEQ ID NO: 369531 - protein, 10 aa, Influenza virus
NTYVNNTTVI

SEQ ID NO: 369532 - protein, 10 aa, Influenza virus
NYLMLNKSLC

SEQ ID NO: 369533 - protein, 10 aa, Influenza virus
YLMLNKSLCK

SEQ ID NO: 369534 - protein, 10 aa, Influenza virus
LMLNKSLCKV

SEQ ID NO: 369535 - protein, 10 aa, Influenza virus
MLNKSLCKVE

SEQ ID NO: 369536 - protein, 10 aa, Influenza virus
LNKSLCKVEG

SEQ ID NO: 369537 - protein, 10 aa, Influenza virus
NKSLCKVEGW

SEQ ID NO: 369538 - protein, 10 aa, Influenza virus
KSLCKVEGWV

SEQ ID NO: 369539 - protein, 10 aa, Influenza virus
SLCKVEGWVV

SEQ ID NO: 369540 - protein, 10 aa, Influenza virus
LCKVEGWVVV

SEQ ID NO: 369541 - protein, 10 aa, Influenza virus
VEGWVVVAKD

SEQ ID NO: 369542 - protein, 10 aa, Influenza virus
EGWVVVAKDN

SEQ ID NO: 369543 - protein, 10 aa, Influenza virus
GWVVVAKDNA

SEQ ID NO: 369544 - protein, 10 aa, Influenza virus
WVVVAKDNAI

SEQ ID NO: 369545 - protein, 10 aa, Influenza virus
VVVAKDNAIR

SEQ ID NO: 369546 - protein, 10 aa, Influenza virus
VVAKDNAIRF

SEQ ID NO: 369547 - protein, 10 aa, Influenza virus
VAKDNAIRFG

SEQ ID NO: 369548 - protein, 10 aa, Influenza virus
AKDNAIRFGE

SEQ ID NO: 369549 - protein, 10 aa, Influenza virus
KDNAIRFGES

SEQ ID NO: 369550 - protein, 10 aa, Influenza virus
DNAIRFGESE

SEQ ID NO: 369551 - protein, 10 aa, Influenza virus
NAIRFGESEQ

SEQ ID NO: 369552 - protein, 10 aa, Influenza virus
AIRFGESEQI

SEQ ID NO: 369553 - protein, 10 aa, Influenza virus
IRFGESEQII

SEQ ID NO: 369554 - protein, 10 aa, Influenza virus
RFGESEQVIV

SEQ ID NO: 369555 - protein, 10 aa, Influenza virus
FGESEQVIVT

SEQ ID NO: 369556 - protein, 10 aa, Influenza virus
GESEQVIVTR

SEQ ID NO: 369557 - protein, 10 aa, Influenza virus
ESEQVIVTRE

SEQ ID NO: 369558 - protein, 10 aa, Influenza virus
SEQVIVTREP

SEQ ID NO: 369559 - protein, 10 aa, Influenza virus
EQVIVTREPY

SEQ ID NO: 369560 - protein, 10 aa, Influenza virus
QVIVTREPYV

SEQ ID NO: 369561 - protein, 10 aa, Influenza virus
VIVTREPYVS

SEQ ID NO: 369562 - protein, 10 aa, Influenza virus
VVTREPYVSC

SEQ ID NO: 369563 - protein, 10 aa, Influenza virus
REPYVSCDPL

SEQ ID NO: 369564 - protein, 10 aa, Influenza virus
SCKMYALHQG

SEQ ID NO: 369565 - protein, 10 aa, Influenza virus
CRMYALHQGT

SEQ ID NO: 369566 - protein, 10 aa, Influenza virus
RMYALHQGTT

SEQ ID NO: 369567 - protein, 10 aa, Influenza virus
TTIRNKHSNS

SEQ ID NO: 369568 - protein, 10 aa, Influenza virus
TIRNKHSNST

SEQ ID NO: 369569 - protein, 10 aa, Influenza virus
IRNKHSNSTT

SEQ ID NO: 369570 - protein, 10 aa, Influenza virus
RNKHSNSTTH

SEQ ID NO: 369571 - protein, 10 aa, Influenza virus
NKHSNSTTHD

SEQ ID NO: 369572 - protein, 10 aa, Influenza virus
KHSNSTTHDR

SEQ ID NO: 369573 - protein, 10 aa, Influenza virus
HSNSTTHDRT

SEQ ID NO: 369574 - protein, 10 aa, Influenza virus
SNSTTHDRTA

SEQ ID NO: 369575 - protein, 10 aa, Influenza virus
NSTTHDRTAF

SEQ ID NO: 369576 - protein, 10 aa, Influenza virus
STTHDRTAFR

SEQ ID NO: 369577 - protein, 10 aa, Influenza virus
TTHDRTAFRG

SEQ ID NO: 369578 - protein, 10 aa, Influenza virus
THDRTAFRGL

SEQ ID NO: 369579 - protein, 10 aa, Influenza virus
HDRTTFRGLI

SEQ ID NO: 369580 - protein, 10 aa, Influenza virus
DRTAFRGLMS

SEQ ID NO: 369581 - protein, 10 aa, Influenza virus
RTAFRGLMST

SEQ ID NO: 369582 - protein, 10 aa, Influenza virus
FRGLISTHLG

SEQ ID NO: 369583 - protein, 10 aa, Influenza virus
SNSDFICVGW

SEQ ID NO: 369584 - protein, 10 aa, Influenza virus
NSDFLCVGWS

SEQ ID NO: 369585 - protein, 10 aa, Influenza virus
SDFICVGWSS

SEQ ID NO: 369586 - protein, 10 aa, Influenza virus
DFICVGWSST

SEQ ID NO: 369587 - protein, 10 aa, Influenza virus
FICVGWSSTS

SEQ ID NO: 369588 - protein, 10 aa, Influenza virus
ICVGWSSTSC

SEQ ID NO: 369589 - protein, 10 aa, Influenza virus
CVGWSSTSCH

SEQ ID NO: 369590 - protein, 10 aa, Influenza virus
VGWSSTSCHD

SEQ ID NO: 369591 - protein, 10 aa, Influenza virus
GWSSTSCHDG

SEQ ID NO: 369592 - protein, 10 aa, Influenza virus
WSSTSCHDGI

SEQ ID NO: 369593 - protein, 10 aa, Influenza virus
CHDGVGRMTI

SEQ ID NO: 369594 - protein, 10 aa, Influenza virus
HDGVGRMTIC

SEQ ID NO: 369595 - protein, 10 aa, Influenza virus
RMTICVQGNN

SEQ ID NO: 369596 - protein, 10 aa, Influenza virus
QGDNENATAT

SEQ ID NO: 369597 - protein, 10 aa, Influenza virus
GDNENATATV

SEQ ID NO: 369598 - protein, 10 aa, Influenza virus
DNENATATVY

SEQ ID NO: 369599 - protein, 10 aa, Influenza virus
NENATATVYY

SEQ ID NO: 369600 - protein, 10 aa, Influenza virus
ENATATVYYN

SEQ ID NO: 369601 - protein, 10 aa, Influenza virus
NATATVYYDR

SEQ ID NO: 369602 - protein, 10 aa, Influenza virus
ATATVYYDRR

SEQ ID NO: 369603 - protein, 10 aa, Influenza virus
TATVYYDRRL

SEQ ID NO: 369604 - protein, 10 aa, Influenza virus
ATVYYDRRLT

SEQ ID NO: 369605 - protein, 10 aa, Influenza virus
TVYYDRRLTT

SEQ ID NO: 369606 - protein, 10 aa, Influenza virus
VYYDRRLTTT

SEQ ID NO: 369607 - protein, 10 aa, Influenza virus
YYDRRLTTTI

SEQ ID NO: 369608 - protein, 10 aa, Influenza virus
KRLTTTIKTW

SEQ ID NO: 369609 - protein, 10 aa, Influenza virus
RLTTTIRTWA

SEQ ID NO: 369610 - protein, 10 aa, Influenza virus
LTTTIKTWAK

SEQ ID NO: 369611 - protein, 10 aa, Influenza virus
TTTIKTWAKN

SEQ ID NO: 369612 - protein, 10 aa, Influenza virus
TTIKTWAKNI

SEQ ID NO: 369613 - protein, 10 aa, Influenza virus
TIKTWAKNIL

SEQ ID NO: 369614 - protein, 10 aa, Influenza virus
IKTWAKNILR

SEQ ID NO: 369615 - protein, 10 aa, Influenza virus
KTWAKNILRT

SEQ ID NO: 369616 - protein, 10 aa, Influenza virus
TWAKNILRTQ

SEQ ID NO: 369617 - protein, 10 aa, Influenza virus
WAKNILRTQE

SEQ ID NO: 369618 - protein, 10 aa, Influenza virus
AKNILRTQES

SEQ ID NO: 369619 - protein, 10 aa, Influenza virus
KNILRTQESE

SEQ ID NO: 369620 - protein, 10 aa, Influenza virus
NILRTQDSEC

SEQ ID NO: 369621 - protein, 10 aa, Influenza virus
ILRTQDSECV

SEQ ID NO: 369622 - protein, 10 aa, Influenza virus
LRTQESECVR

SEQ ID NO: 369623 - protein, 10 aa, Influenza virus
RTQESECVRH

SEQ ID NO: 369624 - protein, 10 aa, Influenza virus
TQESECVRHN

SEQ ID NO: 369625 - protein, 10 aa, Influenza virus
QESECVCHNS

SEQ ID NO: 369626 - protein, 10 aa, Influenza virus
ESECVCHNST

SEQ ID NO: 369627 - protein, 10 aa, Influenza virus
SECVCHNSTC

SEQ ID NO: 369628 - protein, 10 aa, Influenza virus
ECVCHNGTCV

SEQ ID NO: 369629 - protein, 10 aa, Influenza virus
CVCHNGTCVV

SEQ ID NO: 369630 - protein, 10 aa, Influenza virus
HNSTCVVVMT

SEQ ID NO: 369631 - protein, 10 aa, Influenza virus
NSTCVVVMTD

SEQ ID NO: 369632 - protein, 10 aa, Influenza virus
STCVVVMTDG

SEQ ID NO: 369633 - protein, 10 aa, Influenza virus
VVVMTDGPAN

SEQ ID NO: 369634 - protein, 10 aa, Influenza virus
VVMTDGPANN

SEQ ID NO: 369635 - protein, 10 aa, Influenza virus
MTDGPANNQA

SEQ ID NO: 369636 - protein, 10 aa, Influenza virus
LKGSAKHIEE

SEQ ID NO: 369637 - protein, 10 aa, Influenza virus
KGSAKHIEEC

SEQ ID NO: 369638 - protein, 10 aa, Influenza virus
GSAKHIEECS

SEQ ID NO: 369639 - protein, 10 aa, Influenza virus
SAKHIEECSC

SEQ ID NO: 369640 - protein, 10 aa, Influenza virus
AKHIEECSCY

SEQ ID NO: 369641 - protein, 10 aa, Influenza virus
KHIEECSCYG

SEQ ID NO: 369642 - protein, 10 aa, Influenza virus
HIEEWSCYGH

SEQ ID NO: 369643 - protein, 10 aa, Influenza virus
IEECSCYGHS

SEQ ID NO: 369644 - protein, 10 aa, Influenza virus
ATCVCRDNWQ

SEQ ID NO: 369645 - protein, 10 aa, Influenza virus
SCVCRDNWQG

SEQ ID NO: 369646 - protein, 10 aa, Influenza virus
CGCRDNWQGA

SEQ ID NO: 369647 - protein, 10 aa, Influenza virus
GCRDNWQGAN

SEQ ID NO: 369648 - protein, 10 aa, Influenza virus
DNWQGANRPV

SEQ ID NO: 369649 - protein, 10 aa, Influenza virus
NWQGANRPVI

SEQ ID NO: 369650 - protein, 10 aa, Influenza virus
WQGANRPVIE

SEQ ID NO: 369651 - protein, 10 aa, Influenza virus
QGANRPVIEI

SEQ ID NO: 369652 - protein, 10 aa, Influenza virus
GANRPVIEID

SEQ ID NO: 369653 - protein, 10 aa, Influenza virus
ANRPVIEIDM

SEQ ID NO: 369654 - protein, 10 aa, Influenza virus
NRPVIEIDMN

SEQ ID NO: 369655 - protein, 10 aa, Influenza virus
LEHTSRYICT

SEQ ID NO: 369656 - protein, 10 aa, Influenza virus
EHTSRYICTG

SEQ ID NO: 369657 - protein, 10 aa, Influenza virus
YLCTGVLTDT

SEQ ID NO: 369658 - protein, 10 aa, Influenza virus
LCTGVLTDTS

SEQ ID NO: 369659 - protein, 10 aa, Influenza virus
CTGVLTDTSR

SEQ ID NO: 369660 - protein, 10 aa, Influenza virus
TGVLTDTSRP

SEQ ID NO: 369661 - protein, 10 aa, Influenza virus
GVLTDTSRPS

SEQ ID NO: 369662 - protein, 10 aa, Influenza virus
VLTDTSRPSD

SEQ ID NO: 369663 - protein, 10 aa, Influenza virus
LTDTSRPSDK

SEQ ID NO: 369664 - protein, 10 aa, Influenza virus
GDCNNPITGS

SEQ ID NO: 369665 - protein, 10 aa, Influenza virus
DCNNPITGSP

SEQ ID NO: 369666 - protein, 10 aa, Influenza virus
CNNPITGSPG

SEQ ID NO: 369667 - protein, 10 aa, Influenza virus
NPITGSPGVP

SEQ ID NO: 369668 - protein, 10 aa, Influenza virus
PITGSPGVPG

SEQ ID NO: 369669 - protein, 10 aa, Influenza virus
APGIKGFGFL

SEQ ID NO: 369670 - protein, 10 aa, Influenza virus
PGVKGFGFLD

SEQ ID NO: 369671 - protein, 10 aa, Influenza virus
GVKGFGFLDS

SEQ ID NO: 369672 - protein, 10 aa, Influenza virus
GNTWLGRTIS

SEQ ID NO: 369673 - protein, 10 aa, Influenza virus
STWLGRTISP

SEQ ID NO: 369674 - protein, 10 aa, Influenza virus
TWLGRTISPK

SEQ ID NO: 369675 - protein, 10 aa, Influenza virus
WLGRTISPRL

SEQ ID NO: 369676 - protein, 10 aa, Influenza virus
LGRTISPRLR

SEQ ID NO: 369677 - protein, 10 aa, Influenza virus
GRTISPRLRS

SEQ ID NO: 369678 - protein, 10 aa, Influenza virus
RTISPRLRSG

SEQ ID NO: 369679 - protein, 10 aa, Influenza virus
TISPRLRSGF

SEQ ID NO: 369680 - protein, 10 aa, Influenza virus
ISPRLRSGFE

SEQ ID NO: 369681 - protein, 10 aa, Influenza virus
SPRLRSGFEM

SEQ ID NO: 369682 - protein, 10 aa, Influenza virus
PRLRSGFEML

SEQ ID NO: 369683 - protein, 10 aa, Influenza virus
RLRSGFEMLK

SEQ ID NO: 369684 - protein, 10 aa, Influenza virus
LRSGFEMLKI

SEQ ID NO: 369685 - protein, 10 aa, Influenza virus
RNGFEMLKIP

SEQ ID NO: 369686 - protein, 10 aa, Influenza virus
SGFEMLKIHN

SEQ ID NO: 369687 - protein, 10 aa, Influenza virus
GFEMLKIHNA

SEQ ID NO: 369688 - protein, 10 aa, Influenza virus
FEMLKIPNAE

SEQ ID NO: 369689 - protein, 10 aa, Influenza virus
EMLKIPNAET

SEQ ID NO: 369690 - protein, 10 aa, Influenza virus
MLKIPNAETD

SEQ ID NO: 369691 - protein, 10 aa, Influenza virus
LKIPNAETDP

SEQ ID NO: 369692 - protein, 10 aa, Influenza virus
RQEIVSNDNW

SEQ ID NO: 369693 - protein, 10 aa, Influenza virus
QEIVSNDNWS

SEQ ID NO: 369694 - protein, 10 aa, Influenza virus
EIVSNDNWSG

SEQ ID NO: 369695 - protein, 10 aa, Influenza virus
IVSNDNWSGY

SEQ ID NO: 369696 - protein, 10 aa, Influenza virus
VSNDNWSGYS

SEQ ID NO: 369697 - protein, 10 aa, Influenza virus
SNDNWSGYSG

SEQ ID NO: 369698 - protein, 10 aa, Influenza virus
NDNWSGYSGS

SEQ ID NO: 369699 - protein, 10 aa, Influenza virus
DNWSGYSGSF

SEQ ID NO: 369700 - protein, 10 aa, Influenza virus
NRSGYSGSFI

SEQ ID NO: 369701 - protein, 10 aa, Influenza virus
RSGYSGSFID

SEQ ID NO: 369702 - protein, 10 aa, Influenza virus
YSGSFIDYWD

SEQ ID NO: 369703 - protein, 10 aa, Influenza virus
SGSFIDYWDE

SEQ ID NO: 369704 - protein, 10 aa, Influenza virus
NECYNPCFYV

SEQ ID NO: 369705 - protein, 10 aa, Influenza virus
GRPEEAKYVE

SEQ ID NO: 369706 - protein, 10 aa, Influenza virus
RPEEAKYVEW

SEQ ID NO: 369707 - protein, 10 aa, Influenza virus
PEEAKYVEWT

SEQ ID NO: 369708 - protein, 10 aa, Influenza virus
EEAKYVEWTS

SEQ ID NO: 369709 - protein, 10 aa, Influenza virus
EAKYVEWTSN

SEQ ID NO: 369710 - protein, 10 aa, Influenza virus
AKYVEWTSNS

SEQ ID NO: 369711 - protein, 10 aa, Influenza virus
KYVEWTSNSL

SEQ ID NO: 369712 - protein, 10 aa, Influenza virus
YVWWTSNSLV

SEQ ID NO: 369713 - protein, 10 aa, Influenza virus
VWWTSNSLVA

SEQ ID NO: 369714 - protein, 10 aa, Influenza virus
WWTSNSLVAL

SEQ ID NO: 369715 - protein, 10 aa, Influenza virus
WTSNSLVALC

SEQ ID NO: 369716 - protein, 10 aa, Influenza virus
TSNSLVALCG

SEQ ID NO: 369717 - protein, 10 aa, Influenza virus
SNSLVALCGS

SEQ ID NO: 369718 - protein, 10 aa, Influenza virus
NSLVALCGSP

SEQ ID NO: 369719 - protein, 10 aa, Influenza virus
SVGSGSFPDG

SEQ ID NO: 369720 - protein, 10 aa, Influenza virus
VGPGSFPDGA

SEQ ID NO: 369721 - protein, 10 aa, Influenza virus
GPGSFPDGAQ

SEQ ID NO: 369722 - protein, 10 aa, Influenza virus
PGSFPDGAQI

SEQ ID NO: 369723 - protein, 10 aa, Influenza virus
GSFPDGAQIK

SEQ ID NO: 369724 - protein, 10 aa, Influenza virus
SFPDGAQIKY

SEQ ID NO: 369725 - protein, 10 aa, Influenza virus
FPDGAQIKYF

SEQ ID NO: 369726 - protein, 10 aa, Influenza virus
PDGAQIKYFS

SEQ ID NO: 369727 - protein, 10 aa, Influenza virus
LLVSTNAYDR

SEQ ID NO: 369728 - protein, 10 aa, Influenza virus
LVSTNAYDRI

SEQ ID NO: 369729 - protein, 10 aa, Influenza virus
VSTNAYDRIC

SEQ ID NO: 369730 - protein, 10 aa, Influenza virus
STNAHDRICI

SEQ ID NO: 369731 - protein, 10 aa, Influenza virus
TNAHDRICIG

SEQ ID NO: 369732 - protein, 10 aa, Influenza virus
NAHDRICIGY

SEQ ID NO: 369733 - protein, 10 aa, Influenza virus
AHDRICIGYQ

SEQ ID NO: 369734 - protein, 10 aa, Influenza virus
HDRICIGYQS

SEQ ID NO: 369735 - protein, 10 aa, Influenza virus
IGYQSNNSTN

SEQ ID NO: 369736 - protein, 10 aa, Influenza virus
GYQSNNSTNT

SEQ ID NO: 369737 - protein, 10 aa, Influenza virus
YQSNNSTNTV

SEQ ID NO: 369738 - protein, 10 aa, Influenza virus
QSNNSTNTVN

SEQ ID NO: 369739 - protein, 10 aa, Influenza virus
SNNSTDTVDT

SEQ ID NO: 369740 - protein, 10 aa, Influenza virus
NNSTDTVDTL

SEQ ID NO: 369741 - protein, 10 aa, Influenza virus
NSTDTVDTLI

SEQ ID NO: 369742 - protein, 10 aa, Influenza virus
STDTVNTLTE

SEQ ID NO: 369743 - protein, 10 aa, Influenza virus
TNTVNTLIEQ

SEQ ID NO: 369744 - protein, 10 aa, Influenza virus
TLTEQNVPVT

SEQ ID NO: 369745 - protein, 10 aa, Influenza virus
LMEQNVPVTQ

SEQ ID NO: 369746 - protein, 10 aa, Influenza virus
EQNVPVTQAM

SEQ ID NO: 369747 - protein, 10 aa, Influenza virus
QNVPVTQAME

SEQ ID NO: 369748 - protein, 10 aa, Influenza virus
NVPVTQAMEL

SEQ ID NO: 369749 - protein, 10 aa, Influenza virus
VPVTQAMELV

SEQ ID NO: 369750 - protein, 10 aa, Influenza virus
PVTQAMELVE

SEQ ID NO: 369751 - protein, 10 aa, Influenza virus
VTQTMELVEA

SEQ ID NO: 369752 - protein, 10 aa, Influenza virus
TQTMELVEAE

SEQ ID NO: 369753 - protein, 10 aa, Influenza virus
QTMELVEAEK

SEQ ID NO: 369754 - protein, 10 aa, Influenza virus
TMELVEAEKH

SEQ ID NO: 369755 - protein, 10 aa, Influenza virus
EKHSAYCNTD

SEQ ID NO: 369756 - protein, 10 aa, Influenza virus
KHSAYCNTDL

SEQ ID NO: 369757 - protein, 10 aa, Influenza virus
HSAYCNTDLG

SEQ ID NO: 369758 - protein, 10 aa, Influenza virus
PAYCNTDLGA

SEQ ID NO: 369759 - protein, 10 aa, Influenza virus
AYCNTDLGTP

SEQ ID NO: 369760 - protein, 10 aa, Influenza virus
YCNTDLGTPL

SEQ ID NO: 369761 - protein, 10 aa, Influenza virus
CNTDLGTPLE

SEQ ID NO: 369762 - protein, 10 aa, Influenza virus
NTDLGTPLEL

SEQ ID NO: 369763 - protein, 10 aa, Influenza virus
TDLGTPLELR

SEQ ID NO: 369764 - protein, 10 aa, Influenza virus
DLGTPLELRD

SEQ ID NO: 369765 - protein, 10 aa, Influenza virus
LGTPLELRDC

SEQ ID NO: 369766 - protein, 10 aa, Influenza virus
GTPLELRDCK

SEQ ID NO: 369767 - protein, 10 aa, Influenza virus
TPLELRDCKI

SEQ ID NO: 369768 - protein, 10 aa, Influenza virus
PLELRDCKVE

SEQ ID NO: 369769 - protein, 10 aa, Influenza virus
LELRDCKVEA

SEQ ID NO: 369770 - protein, 10 aa, Influenza virus
ELRDCKVEAV

SEQ ID NO: 369771 - protein, 10 aa, Influenza virus
LRDCKVEAVI

SEQ ID NO: 369772 - protein, 10 aa, Influenza virus
RDCKVEAVIY

SEQ ID NO: 369773 - protein, 10 aa, Influenza virus
DCKVEAVIYG

SEQ ID NO: 369774 - protein, 10 aa, Influenza virus
CKVEAVIYGN

SEQ ID NO: 369775 - protein, 10 aa, Influenza virus
KVEAVIYGNP

SEQ ID NO: 369776 - protein, 10 aa, Influenza virus
VEAVIYGNPK

SEQ ID NO: 369777 - protein, 10 aa, Influenza virus
VIYGNPKCDV

SEQ ID NO: 369778 - protein, 10 aa, Influenza virus
IYGNPKCDVH

SEQ ID NO: 369779 - protein, 10 aa, Influenza virus
YGNPKCDVHL

SEQ ID NO: 369780 - protein, 10 aa, Influenza virus
GNPKCDVHLK

SEQ ID NO: 369781 - protein, 10 aa, Influenza virus
NPKCDVHLKD

SEQ ID NO: 369782 - protein, 10 aa, Influenza virus
PKCDVHLKDQ

SEQ ID NO: 369783 - protein, 10 aa, Influenza virus
HLKDQDWSYI

SEQ ID NO: 369784 - protein, 10 aa, Influenza virus
LKDQDWSYIV

SEQ ID NO: 369785 - protein, 10 aa, Influenza virus
KDQSWSYIVE

SEQ ID NO: 369786 - protein, 10 aa, Influenza virus
DQDWSYIVER

SEQ ID NO: 369787 - protein, 10 aa, Influenza virus
QDWSYIVERP

SEQ ID NO: 369788 - protein, 10 aa, Influenza virus
SWSYIVERPS

SEQ ID NO: 369789 - protein, 10 aa, Influenza virus
APEGMCYPGF

SEQ ID NO: 369790 - protein, 10 aa, Influenza virus
PEGMCYPGSI

SEQ ID NO: 369791 - protein, 10 aa, Influenza virus
EGMCYPGSIE

SEQ ID NO: 369792 - protein, 10 aa, Influenza virus
GMCYPGSIEN

SEQ ID NO: 369793 - protein, 10 aa, Influenza virus
MCYPGSIENL

SEQ ID NO: 369794 - protein, 10 aa, Influenza virus
CYPGSIENLE

SEQ ID NO: 369795 - protein, 10 aa, Influenza virus
YPGSIENLEE

SEQ ID NO: 369796 - protein, 10 aa, Influenza virus
PGSIENLEEL

SEQ ID NO: 369797 - protein, 10 aa, Influenza virus
GSIENLEELR

SEQ ID NO: 369798 - protein, 10 aa, Influenza virus
SIENLEELRF

SEQ ID NO: 369799 - protein, 10 aa, Influenza virus
IENLEELRFV

SEQ ID NO: 369800 - protein, 10 aa, Influenza virus
LEELRFVFSS

SEQ ID NO: 369801 - protein, 10 aa, Influenza virus
EELRFVFSSA

SEQ ID NO: 369802 - protein, 10 aa, Influenza virus
ELRFVFSSAA

SEQ ID NO: 369803 - protein, 10 aa, Influenza virus
LRFVFSSAAS

SEQ ID NO: 369804 - protein, 10 aa, Influenza virus
RFVFSSAASY

SEQ ID NO: 369805 - protein, 10 aa, Influenza virus
FVFSSAASYK

SEQ ID NO: 369806 - protein, 10 aa, Influenza virus
VFSSAASYKR

SEQ ID NO: 369807 - protein, 10 aa, Influenza virus
FSSAASYKRI

SEQ ID NO: 369808 - protein, 10 aa, Influenza virus
SSAASYKRIR

SEQ ID NO: 369809 - protein, 10 aa, Influenza virus
SAASYKRIRL

SEQ ID NO: 369810 - protein, 10 aa, Influenza virus
AASYKRVRLF

SEQ ID NO: 369811 - protein, 10 aa, Influenza virus
ASYKRVRLFD

SEQ ID NO: 369812 - protein, 10 aa, Influenza virus
SYKRVRLFDY

SEQ ID NO: 369813 - protein, 10 aa, Influenza virus
YKRVRLFDYS

SEQ ID NO: 369814 - protein, 10 aa, Influenza virus
KRIRLFDYSK

SEQ ID NO: 369815 - protein, 10 aa, Influenza virus
RIRLFDYSKW

SEQ ID NO: 369816 - protein, 10 aa, Influenza virus
IRLFDYSKWN

SEQ ID NO: 369817 - protein, 10 aa, Influenza virus
RLFDYSKWNV

SEQ ID NO: 369818 - protein, 10 aa, Influenza virus
LFDYSKWNVT

SEQ ID NO: 369819 - protein, 10 aa, Influenza virus
WNVTRSGTSK

SEQ ID NO: 369820 - protein, 10 aa, Influenza virus
NVTRSGTSKA

SEQ ID NO: 369821 - protein, 10 aa, Influenza virus
VTRSGTSKAC

SEQ ID NO: 369822 - protein, 10 aa, Influenza virus
TRSGTSKACN

SEQ ID NO: 369823 - protein, 10 aa, Influenza virus
RSGTSKACNA

SEQ ID NO: 369824 - protein, 10 aa, Influenza virus
SGTSKACSAS

SEQ ID NO: 369825 - protein, 10 aa, Influenza virus
GTSKACSAST

SEQ ID NO: 369826 - protein, 10 aa, Influenza virus
TSKACSASTG

SEQ ID NO: 369827 - protein, 10 aa, Influenza virus
SKACSASTGG

SEQ ID NO: 369828 - protein, 10 aa, Influenza virus
KACSASTGGQ

SEQ ID NO: 369829 - protein, 10 aa, Influenza virus
ACNASTGGQA

SEQ ID NO: 369830 - protein, 10 aa, Influenza virus
CNASTGGQAF

SEQ ID NO: 369831 - protein, 10 aa, Influenza virus
NASTGGQAFY

SEQ ID NO: 369832 - protein, 10 aa, Influenza virus
ASTGGQAFYR

SEQ ID NO: 369833 - protein, 10 aa, Influenza virus
STGGQAFYRS

SEQ ID NO: 369834 - protein, 10 aa, Influenza virus
TGGQAFYRSI

SEQ ID NO: 369835 - protein, 10 aa, Influenza virus
GGQAFYRSIN

SEQ ID NO: 369836 - protein, 10 aa, Influenza virus
GQAFYRSINW

SEQ ID NO: 369837 - protein, 10 aa, Influenza virus
QAFYRSINWL

SEQ ID NO: 369838 - protein, 10 aa, Influenza virus
AFYRSINWLT

SEQ ID NO: 369839 - protein, 10 aa, Influenza virus
RSINWLTKKE

SEQ ID NO: 369840 - protein, 10 aa, Influenza virus
SINWLTKKKN

SEQ ID NO: 369841 - protein, 10 aa, Influenza virus
INWLTKKKNP

SEQ ID NO: 369842 - protein, 10 aa, Influenza virus
NWLTKKKNPE

SEQ ID NO: 369843 - protein, 10 aa, Influenza virus
WLTKKKNPEA

SEQ ID NO: 369844 - protein, 10 aa, Influenza virus
LTKKKNPEAY

SEQ ID NO: 369845 - protein, 10 aa, Influenza virus
TKKKNPEAYN

SEQ ID NO: 369846 - protein, 10 aa, Influenza virus
KKKNPEAYNF

SEQ ID NO: 369847 - protein, 10 aa, Influenza virus
KKNPEAYNFN

SEQ ID NO: 369848 - protein, 10 aa, Influenza virus
KNPEAYNFNE

SEQ ID NO: 369849 - protein, 10 aa, Influenza virus
PDTYDFNEGT

SEQ ID NO: 369850 - protein, 10 aa, Influenza virus
DTYDFNEGTY

SEQ ID NO: 369851 - protein, 10 aa, Influenza virus
NNEDGNIIFL

SEQ ID NO: 369852 - protein, 10 aa, Influenza virus
NEDGNIIFLW

SEQ ID NO: 369853 - protein, 10 aa, Influenza virus
EDGNIIFLWG

SEQ ID NO: 369854 - protein, 10 aa, Influenza virus
DGNIIFLWGI

SEQ ID NO: 369855 - protein, 10 aa, Influenza virus
GNIIFLWGIH

SEQ ID NO: 369856 - protein, 10 aa, Influenza virus
NIIFLWGIHH

SEQ ID NO: 369857 - protein, 10 aa, Influenza virus
FLWGIHHPPN

SEQ ID NO: 369858 - protein, 10 aa, Influenza virus
LWGIHHPPDA

SEQ ID NO: 369859 - protein, 10 aa, Influenza virus
WGIHHPPDAK

SEQ ID NO: 369860 - protein, 10 aa, Influenza virus
GIHHPPDAKE

SEQ ID NO: 369861 - protein, 10 aa, Influenza virus
IHHPPDAKEQ

SEQ ID NO: 369862 - protein, 10 aa, Influenza virus
HHPPDAKEQT

SEQ ID NO: 369863 - protein, 10 aa, Influenza virus
AKEQTTLYKN

SEQ ID NO: 369864 - protein, 10 aa, Influenza virus
KEQTALYKNA

SEQ ID NO: 369865 - protein, 10 aa, Influenza virus
EQTALYKNAN

SEQ ID NO: 369866 - protein, 10 aa, Influenza virus
QTALYKNANT

SEQ ID NO: 369867 - protein, 10 aa, Influenza virus
TALYKNANTL

SEQ ID NO: 369868 - protein, 10 aa, Influenza virus
ALYKNANTLS

SEQ ID NO: 369869 - protein, 10 aa, Influenza virus
LYKNTNTLSS

SEQ ID NO: 369870 - protein, 10 aa, Influenza virus
YKNTNTLSSV

SEQ ID NO: 369871 - protein, 10 aa, Influenza virus
KNANTLSSVN

SEQ ID NO: 369872 - protein, 10 aa, Influenza virus
NTNTLSSVTT

SEQ ID NO: 369873 - protein, 10 aa, Influenza virus
TNTLSSVTTN

SEQ ID NO: 369874 - protein, 10 aa, Influenza virus
NTLSSVNTNT

SEQ ID NO: 369875 - protein, 10 aa, Influenza virus
TLSSVNTNTI

SEQ ID NO: 369876 - protein, 10 aa, Influenza virus
LSSVNTNTIN

SEQ ID NO: 369877 - protein, 10 aa, Influenza virus
SSVNTNTINR

SEQ ID NO: 369878 - protein, 10 aa, Influenza virus
SVTTNTINRI

SEQ ID NO: 369879 - protein, 10 aa, Influenza virus
VTTNTINRIF

SEQ ID NO: 369880 - protein, 10 aa, Influenza virus
TTNTINRSFR

SEQ ID NO: 369881 - protein, 10 aa, Influenza virus
TNTINRSFRP

SEQ ID NO: 369882 - protein, 10 aa, Influenza virus
NTINRSFRPN

SEQ ID NO: 369883 - protein, 10 aa, Influenza virus
TINRSFRPNI

SEQ ID NO: 369884 - protein, 10 aa, Influenza virus
INRIFQPNIG

SEQ ID NO: 369885 - protein, 10 aa, Influenza virus
NRSFRPNIGP

SEQ ID NO: 369886 - protein, 10 aa, Influenza virus
RIFQPNIGPR

SEQ ID NO: 369887 - protein, 10 aa, Influenza virus
IFQPNIGPRP

SEQ ID NO: 369888 - protein, 10 aa, Influenza virus
FRPNIGPRPL

SEQ ID NO: 369889 - protein, 10 aa, Influenza virus
RPNIGPRPLV

SEQ ID NO: 369890 - protein, 10 aa, Influenza virus
PNIGPRALVR

SEQ ID NO: 369891 - protein, 10 aa, Influenza virus
NIGPRPLVRE

SEQ ID NO: 369892 - protein, 10 aa, Influenza virus
IGPRPLVREQ

SEQ ID NO: 369893 - protein, 10 aa, Influenza virus
GPRALVRGQQ

SEQ ID NO: 369894 - protein, 10 aa, Influenza virus
PRPLVREQQG

SEQ ID NO: 369895 - protein, 10 aa, Influenza virus
RALVRGQQGR

SEQ ID NO: 369896 - protein, 10 aa, Influenza virus
PLVREQQGRM

SEQ ID NO: 369897 - protein, 10 aa, Influenza virus
LVRGQQGWMD

SEQ ID NO: 369898 - protein, 10 aa, Influenza virus
VRGQQGTMDY

SEQ ID NO: 369899 - protein, 10 aa, Influenza virus
RGQQGTMDYY

SEQ ID NO: 369900 - protein, 10 aa, Influenza virus
EQQGRMDYYW

SEQ ID NO: 369901 - protein, 10 aa, Influenza virus
QQGTMDYYWG

SEQ ID NO: 369902 - protein, 10 aa, Influenza virus
QGWMDYYWGI

SEQ ID NO: 369903 - protein, 10 aa, Influenza virus
GTMDYYWGIL

SEQ ID NO: 369904 - protein, 10 aa, Influenza virus
WMDYYWGILK

SEQ ID NO: 369905 - protein, 10 aa, Influenza virus
IAPEFGYLLR

SEQ ID NO: 369906 - protein, 10 aa, Influenza virus
APEFGYLLRG

SEQ ID NO: 369907 - protein, 10 aa, Influenza virus
PEFGYLLRGE

SEQ ID NO: 369908 - protein, 10 aa, Influenza virus
EFGYLLRGES

SEQ ID NO: 369909 - protein, 10 aa, Influenza virus
FGYLLKGESY

SEQ ID NO: 369910 - protein, 10 aa, Influenza virus
GYLLKGESYG

SEQ ID NO: 369911 - protein, 10 aa, Influenza virus
YLLKGESYGR

SEQ ID NO: 369912 - protein, 10 aa, Influenza virus
GESYGRIIQN

SEQ ID NO: 369913 - protein, 10 aa, Influenza virus
ESYGRIIQNE

SEQ ID NO: 369914 - protein, 10 aa, Influenza virus
SYGRIIQNED

SEQ ID NO: 369915 - protein, 10 aa, Influenza virus
YGRIIQNEDI

SEQ ID NO: 369916 - protein, 10 aa, Influenza virus
GKIIQNEDIP

SEQ ID NO: 369917 - protein, 10 aa, Influenza virus
KIIQNEDIPI

SEQ ID NO: 369918 - protein, 10 aa, Influenza virus
IIQNEDIPIE

SEQ ID NO: 369919 - protein, 10 aa, Influenza virus
IQNEDIPIGS

SEQ ID NO: 369920 - protein, 10 aa, Influenza virus
QNEDIPIGSC

SEQ ID NO: 369921 - protein, 10 aa, Influenza virus
CNTKCQTYAG

SEQ ID NO: 369922 - protein, 10 aa, Influenza virus
NTKCQTYAGA

SEQ ID NO: 369923 - protein, 10 aa, Influenza virus
TKCQTYTGAI

SEQ ID NO: 369924 - protein, 10 aa, Influenza virus
KCQTYTGAIN

SEQ ID NO: 369925 - protein, 10 aa, Influenza virus
CQTYTGAINS

SEQ ID NO: 369926 - protein, 10 aa, Influenza virus
QTYTGAINSS

SEQ ID NO: 369927 - protein, 10 aa, Influenza virus
TYTGAINSSK

SEQ ID NO: 369928 - protein, 10 aa, Influenza virus
YTGAINSSKP

SEQ ID NO: 369929 - protein, 10 aa, Influenza virus
GAINSSRPFQ

SEQ ID NO: 369930 - protein, 10 aa, Influenza virus
AINSSRPFQN

SEQ ID NO: 369931 - protein, 10 aa, Influenza virus
INSSRPFQNA

SEQ ID NO: 369932 - protein, 10 aa, Influenza virus
NSSRPFQNAS

SEQ ID NO: 369933 - protein, 10 aa, Influenza virus
SSRPFQNASR

SEQ ID NO: 369934 - protein, 10 aa, Influenza virus
SRPFQNASRH

SEQ ID NO: 369935 - protein, 10 aa, Influenza virus
PFQNTSRHYM

SEQ ID NO: 369936 - protein, 10 aa, Influenza virus
FQNTSRHYMG

SEQ ID NO: 369937 - protein, 10 aa, Influenza virus
QNASRHHMGE

SEQ ID NO: 369938 - protein, 10 aa, Influenza virus
NASRYYMGEC

SEQ ID NO: 369939 - protein, 10 aa, Influenza virus
ASRHHMGECP

SEQ ID NO: 369940 - protein, 10 aa, Influenza virus
SRYYMGECPK

SEQ ID NO: 369941 - protein, 10 aa, Influenza virus
RYYMGECPKY

SEQ ID NO: 369942 - protein, 10 aa, Influenza virus
MGECPKYVRK

SEQ ID NO: 369943 - protein, 10 aa, Influenza virus
YVKKESLRLA

SEQ ID NO: 369944 - protein, 10 aa, Influenza virus
KKESLRLAVG

SEQ ID NO: 369945 - protein, 10 aa, Influenza virus
KESLRLAVGL

SEQ ID NO: 369946 - protein, 10 aa, Influenza virus
ESLRLAVGLR

SEQ ID NO: 369947 - protein, 10 aa, Influenza virus
SLRLALGLRN

SEQ ID NO: 369948 - protein, 10 aa, Influenza virus
LRLALGLRNT

SEQ ID NO: 369949 - protein, 10 aa, Influenza virus
RLALGLRNTP

SEQ ID NO: 369950 - protein, 10 aa, Influenza virus
LALGLRNTPS

SEQ ID NO: 369951 - protein, 10 aa, Influenza virus
AVGLRNTPSV

SEQ ID NO: 369952 - protein, 10 aa, Influenza virus
VGLRNTPSVE

SEQ ID NO: 369953 - protein, 10 aa, Influenza virus
GLRNTPSVEP

SEQ ID NO: 369954 - protein, 10 aa, Influenza virus
LRNTPSVEPK

SEQ ID NO: 369955 - protein, 10 aa, Influenza virus
RNTPSVEPKG

SEQ ID NO: 369956 - protein, 10 aa, Influenza virus
NTPSVEPKGL

SEQ ID NO: 369957 - protein, 10 aa, Influenza virus
TPSVEPRGLF

SEQ ID NO: 369958 - protein, 10 aa, Influenza virus
PSVEPRGLFG

SEQ ID NO: 369959 - protein, 10 aa, Influenza virus
SVEPRGLFGA

SEQ ID NO: 369960 - protein, 10 aa, Influenza virus
VEPRGLFGAI

SEQ ID NO: 369961 - protein, 10 aa, Influenza virus
EPRGLFGAIA

SEQ ID NO: 369962 - protein, 10 aa, Influenza virus
PRGLFGAIAG

SEQ ID NO: 369963 - protein, 10 aa, Influenza virus
RGLFGAIAGF

SEQ ID NO: 369964 - protein, 10 aa, Influenza virus
IAGFIEGGWC

SEQ ID NO: 369965 - protein, 10 aa, Influenza virus
AGFIEGGWCG

SEQ ID NO: 369966 - protein, 10 aa, Influenza virus
GFIEGGWCGM

SEQ ID NO: 369967 - protein, 10 aa, Influenza virus
FIEGGWCGMI

SEQ ID NO: 369968 - protein, 10 aa, Influenza virus
IEGGWCGMID

SEQ ID NO: 369969 - protein, 10 aa, Influenza virus
EGGWCGMIDG

SEQ ID NO: 369970 - protein, 10 aa, Influenza virus
GGWCGMIDGW

SEQ ID NO: 369971 - protein, 10 aa, Influenza virus
GWCGMIDGWY

SEQ ID NO: 369972 - protein, 10 aa, Influenza virus
WCGMIDGWYG

SEQ ID NO: 369973 - protein, 10 aa, Influenza virus
CGMIDGWYGF

SEQ ID NO: 369974 - protein, 10 aa, Influenza virus
GWYGFHHSNA

SEQ ID NO: 369975 - protein, 10 aa, Influenza virus
WYGFHHSNAE

SEQ ID NO: 369976 - protein, 10 aa, Influenza virus
YGFHHSNAEG

SEQ ID NO: 369977 - protein, 10 aa, Influenza virus
GFHHSNAEGT

SEQ ID NO: 369978 - protein, 10 aa, Influenza virus
FHHSNAEGTG

SEQ ID NO: 369979 - protein, 10 aa, Influenza virus
HHSNAEGTGM

SEQ ID NO: 369980 - protein, 10 aa, Influenza virus
HSNAEGTGMA

SEQ ID NO: 369981 - protein, 10 aa, Influenza virus
SNAEGTGMAA

SEQ ID NO: 369982 - protein, 10 aa, Influenza virus
NAEGTGMAAD

SEQ ID NO: 369983 - protein, 10 aa, Influenza virus
AEGTGMAADQ

SEQ ID NO: 369984 - protein, 10 aa, Influenza virus
DQKSTQEAIN

SEQ ID NO: 369985 - protein, 10 aa, Influenza virus
QKSTQEAIGK

SEQ ID NO: 369986 - protein, 10 aa, Influenza virus
KSTQEAINKI

SEQ ID NO: 369987 - protein, 10 aa, Influenza virus
STQEAINKIT

SEQ ID NO: 369988 - protein, 10 aa, Influenza virus
TQEAIGKITN

SEQ ID NO: 369989 - protein, 10 aa, Influenza virus
QEAINKITNK

SEQ ID NO: 369990 - protein, 10 aa, Influenza virus
EAIDKITNKI

SEQ ID NO: 369991 - protein, 10 aa, Influenza virus
AIDKITNKIN

SEQ ID NO: 369992 - protein, 10 aa, Influenza virus
IDKITNKINN

SEQ ID NO: 369993 - protein, 10 aa, Influenza virus
DKITNKINNI

SEQ ID NO: 369994 - protein, 10 aa, Influenza virus
KITNKINNIV

SEQ ID NO: 369995 - protein, 10 aa, Influenza virus
ITNKINNIVD

SEQ ID NO: 369996 - protein, 10 aa, Influenza virus
TNKINNIVDK

SEQ ID NO: 369997 - protein, 10 aa, Influenza virus
NKINNIVDKM

SEQ ID NO: 369998 - protein, 10 aa, Influenza virus
KINNIVDKMN

SEQ ID NO: 369999 - protein, 10 aa, Influenza virus
INNIVDKMNR

SEQ ID NO: 370000 - protein, 10 aa, Influenza virus
IVDKMNREFG

SEQ ID NO: 370001 - protein, 10 aa, Influenza virus
VDKMNREFGV

SEQ ID NO: 370002 - protein, 10 aa, Influenza virus
DKMNREFGVV

SEQ ID NO: 370003 - protein, 10 aa, Influenza virus
KMNREFGVVN

SEQ ID NO: 370004 - protein, 10 aa, Influenza virus
MNREFGVVNH

SEQ ID NO: 370005 - protein, 10 aa, Influenza virus
NREFGVVNHE

SEQ ID NO: 370006 - protein, 10 aa, Influenza virus
REFGVVNHEF

SEQ ID NO: 370007 - protein, 10 aa, Influenza virus
EFGVVNHEFS

SEQ ID NO: 370008 - protein, 10 aa, Influenza virus
EKRINVINDK

SEQ ID NO: 370009 - protein, 10 aa, Influenza virus
KKINMINDKI

SEQ ID NO: 370010 - protein, 10 aa, Influenza virus
INMINDKIND

SEQ ID NO: 370011 - protein, 10 aa, Influenza virus
NMINDKINDQ

SEQ ID NO: 370012 - protein, 10 aa, Influenza virus
MINDKINDQI

SEQ ID NO: 370013 - protein, 10 aa, Influenza virus
INDKINDQIE

SEQ ID NO: 370014 - protein, 10 aa, Influenza virus
DKINDQIEDL

SEQ ID NO: 370015 - protein, 10 aa, Influenza virus
KINDQIEDLW

SEQ ID NO: 370016 - protein, 10 aa, Influenza virus
INDQIEDLWA

SEQ ID NO: 370017 - protein, 10 aa, Influenza virus
NDQIEDLWAY

SEQ ID NO: 370018 - protein, 10 aa, Influenza virus
DQIEGLWAYN

SEQ ID NO: 370019 - protein, 10 aa, Influenza virus
QIENLWAYNA

SEQ ID NO: 370020 - protein, 10 aa, Influenza virus
IEGLWAYNAE

SEQ ID NO: 370021 - protein, 10 aa, Influenza virus
ENLWAYNAEL

SEQ ID NO: 370022 - protein, 10 aa, Influenza virus
GLWAYNAELL

SEQ ID NO: 370023 - protein, 10 aa, Influenza virus
LLVLLENQKI

SEQ ID NO: 370024 - protein, 10 aa, Influenza virus
LVLLENQKIL

SEQ ID NO: 370025 - protein, 10 aa, Influenza virus
VLLENQKILD

SEQ ID NO: 370026 - protein, 10 aa, Influenza virus
LLENQKILDE

SEQ ID NO: 370027 - protein, 10 aa, Influenza virus
LENQKTLDKH

SEQ ID NO: 370028 - protein, 10 aa, Influenza virus
ENQKILDEHD

SEQ ID NO: 370029 - protein, 10 aa, Influenza virus
NQKTLDKHDS

SEQ ID NO: 370030 - protein, 10 aa, Influenza virus
QKTLDKHDSN

SEQ ID NO: 370031 - protein, 10 aa, Influenza virus
KTLDKHDSNV

SEQ ID NO: 370032 - protein, 10 aa, Influenza virus
ILDEHDSNVK

SEQ ID NO: 370033 - protein, 10 aa, Influenza virus
LDEHDSNVEN

SEQ ID NO: 370034 - protein, 10 aa, Influenza virus
DEHDSNVENL

SEQ ID NO: 370035 - protein, 10 aa, Influenza virus
EHDSNVENLF

SEQ ID NO: 370036 - protein, 10 aa, Influenza virus
HDSNVENLFD

SEQ ID NO: 370037 - protein, 10 aa, Influenza virus
DSNVENLFDE

SEQ ID NO: 370038 - protein, 10 aa, Influenza virus
SNVENLFDEV

SEQ ID NO: 370039 - protein, 10 aa, Influenza virus
NVKNLFDEVR

SEQ ID NO: 370040 - protein, 10 aa, Influenza virus
VKNLFDEVRR

SEQ ID NO: 370041 - protein, 10 aa, Influenza virus
KNLFDEVRRR

SEQ ID NO: 370042 - protein, 10 aa, Influenza virus
NLFDEVRRRL

SEQ ID NO: 370043 - protein, 10 aa, Influenza virus
LFDEVRRRLS

SEQ ID NO: 370044 - protein, 10 aa, Influenza virus
FDEVKRRLST

SEQ ID NO: 370045 - protein, 10 aa, Influenza virus
DEVKRRLSTN

SEQ ID NO: 370046 - protein, 10 aa, Influenza virus
EVKRRLSTNA

SEQ ID NO: 370047 - protein, 10 aa, Influenza virus
NAIDTGNGCF

SEQ ID NO: 370048 - protein, 10 aa, Influenza virus
AIDTGNGCFD

SEQ ID NO: 370049 - protein, 10 aa, Influenza virus
IDTGNGCFDI

SEQ ID NO: 370050 - protein, 10 aa, Influenza virus
DTGNGCFDIL

SEQ ID NO: 370051 - protein, 10 aa, Influenza virus
TGNGCFDILH

SEQ ID NO: 370052 - protein, 10 aa, Influenza virus
GKGCFDILHK

SEQ ID NO: 370053 - protein, 10 aa, Influenza virus
KGCFDILHKC

SEQ ID NO: 370054 - protein, 10 aa, Influenza virus
GCFDILHKCD

SEQ ID NO: 370055 - protein, 10 aa, Influenza virus
CFDILHKCDN

SEQ ID NO: 370056 - protein, 10 aa, Influenza virus
FDILHKCDNE

SEQ ID NO: 370057 - protein, 10 aa, Influenza virus
DILHKCDNEC

SEQ ID NO: 370058 - protein, 10 aa, Influenza virus
ILHKCDNECM

SEQ ID NO: 370059 - protein, 10 aa, Influenza virus
LHKCDNECME

SEQ ID NO: 370060 - protein, 10 aa, Influenza virus
HKCDNECMET

SEQ ID NO: 370061 - protein, 10 aa, Influenza virus
KCDNECMETI

SEQ ID NO: 370062 - protein, 10 aa, Influenza virus
CDNECMETIK

SEQ ID NO: 370063 - protein, 10 aa, Influenza virus
DNECMETIKN

SEQ ID NO: 370064 - protein, 10 aa, Influenza virus
NKCMETIKNG

SEQ ID NO: 370065 - protein, 10 aa, Influenza virus
KCMETIKNGT

SEQ ID NO: 370066 - protein, 10 aa, Influenza virus
METIKNGTYD

SEQ ID NO: 370067 - protein, 10 aa, Influenza virus
ETIKNGTYNH

SEQ ID NO: 370068 - protein, 10 aa, Influenza virus
TIKNGTYDHK

SEQ ID NO: 370069 - protein, 10 aa, Influenza virus
IKNGTYNHKE

SEQ ID NO: 370070 - protein, 10 aa, Influenza virus
KNGTYDHKEY

SEQ ID NO: 370071 - protein, 10 aa, Influenza virus
NGTYNHKEYE

SEQ ID NO: 370072 - protein, 10 aa, Influenza virus
GTYDHKEYEE

SEQ ID NO: 370073 - protein, 10 aa, Influenza virus
TYNHKEYEEE

SEQ ID NO: 370074 - protein, 10 aa, Influenza virus
YDHKEYEEEA

SEQ ID NO: 370075 - protein, 10 aa, Influenza virus
NHKEYEEEAK

SEQ ID NO: 370076 - protein, 10 aa, Influenza virus
HKDYEEEAKL

SEQ ID NO: 370077 - protein, 10 aa, Influenza virus
KDYEEEAKLE

SEQ ID NO: 370078 - protein, 10 aa, Influenza virus
DYEEEAKLER

SEQ ID NO: 370079 - protein, 10 aa, Influenza virus
YEEEAKLEKS

SEQ ID NO: 370080 - protein, 10 aa, Influenza virus
EEEAKLEKSR

SEQ ID NO: 370081 - protein, 10 aa, Influenza virus
EEAKLEKSRI

SEQ ID NO: 370082 - protein, 10 aa, Influenza virus
EAKLEKSRIN

SEQ ID NO: 370083 - protein, 10 aa, Influenza virus
AKLEKSRING

SEQ ID NO: 370084 - protein, 10 aa, Influenza virus
KLERSKINEV

SEQ ID NO: 370085 - protein, 10 aa, Influenza virus
LERSKINGVI

SEQ ID NO: 370086 - protein, 10 aa, Influenza virus
ERSKINGVIL

SEQ ID NO: 370087 - protein, 10 aa, Influenza virus
RSKINGVRLE

SEQ ID NO: 370088 - protein, 10 aa, Influenza virus
SKINGVILEE

SEQ ID NO: 370089 - protein, 10 aa, Influenza virus
KINEVKLEEN

SEQ ID NO: 370090 - protein, 10 aa, Influenza virus
INEVKLEENT

SEQ ID NO: 370091 - protein, 10 aa, Influenza virus
NGVRLEENTT

SEQ ID NO: 370092 - protein, 10 aa, Influenza virus
GVRLEENTTY

SEQ ID NO: 370093 - protein, 10 aa, Influenza virus
VKLEENTSYK

SEQ ID NO: 370094 - protein, 10 aa, Influenza virus
KLEENTSYKI

SEQ ID NO: 370095 - protein, 10 aa, Influenza virus
LEENTSYKIL

SEQ ID NO: 370096 - protein, 10 aa, Influenza virus
EENTSYKILS

SEQ ID NO: 370097 - protein, 10 aa, Influenza virus
ENTSYKILSI

SEQ ID NO: 370098 - protein, 10 aa, Influenza virus
NTTYRILSIY

SEQ ID NO: 370099 - protein, 10 aa, Influenza virus
TSYKILSIYS

SEQ ID NO: 370100 - protein, 10 aa, Influenza virus
SYKILSIYST

SEQ ID NO: 370101 - protein, 10 aa, Influenza virus
YRILSIYSTV

SEQ ID NO: 370102 - protein, 10 aa, Influenza virus
RILSIYSTVA

SEQ ID NO: 370103 - protein, 10 aa, Influenza virus
TVAASLCLAV

SEQ ID NO: 370104 - protein, 10 aa, Influenza virus
VAASLCLAVL

SEQ ID NO: 370105 - protein, 10 aa, Influenza virus
AASLCLAVLI

SEQ ID NO: 370106 - protein, 10 aa, Influenza virus
ASLCLAVLIA

SEQ ID NO: 370107 - protein, 10 aa, Influenza virus
SLCLAILVAG

SEQ ID NO: 370108 - protein, 10 aa, Influenza virus
LCLAVLIAGG

SEQ ID NO: 370109 - protein, 10 aa, Influenza virus
CLAVLIAGGL

SEQ ID NO: 370110 - protein, 10 aa, Influenza virus
LAVLIAGGLI

SEQ ID NO: 370111 - protein, 10 aa, Influenza virus
AVLIAGGLIL

SEQ ID NO: 370112 - protein, 10 aa, Influenza virus
VLIAGGLILG

SEQ ID NO: 370113 - protein, 10 aa, Influenza virus
LVAGGLILGM

SEQ ID NO: 370114 - protein, 10 aa, Influenza virus
VAGGLILGMQ

SEQ ID NO: 370115 - protein, 10 aa, Influenza virus
LILGMQNGSY

SEQ ID NO: 370116 - protein, 10 aa, Influenza virus
ILGMQNGSYR

SEQ ID NO: 370117 - protein, 10 aa, Influenza virus
LGMQNGSYRC

SEQ ID NO: 370118 - protein, 10 aa, Influenza virus
GMQNGSYRCM

SEQ ID NO: 370119 - protein, 10 aa, Influenza virus
MQNGSYRCMF

SEQ ID NO: 370120 - protein, 10 aa, Influenza virus
QNGSYRCMFC

SEQ ID NO: 370121 - protein, 10 aa, Influenza virus
NGSYRCMFCI

SEQ ID NO: 370122 - protein, 10 aa, Influenza virus
HQSTNSTETV

SEQ ID NO: 370123 - protein, 10 aa, Influenza virus
EGLVYGNPSC

SEQ ID NO: 370124 - protein, 10 aa, Influenza virus
GLVYGNPSCD

SEQ ID NO: 370125 - protein, 10 aa, Influenza virus
LKPGQTLRVR

SEQ ID NO: 370126 - protein, 10 aa, Influenza virus
KPGQTLRVRS

SEQ ID NO: 370127 - protein, 10 aa, Influenza virus
PGQTLRVRSN

SEQ ID NO: 370128 - protein, 10 aa, Influenza virus
QTLRVRSNGN

SEQ ID NO: 370129 - protein, 10 aa, Influenza virus
TLRVRSNGNL

SEQ ID NO: 370130 - protein, 10 aa, Influenza virus
SNGNLIAPWF

SEQ ID NO: 370131 - protein, 10 aa, Influenza virus
SLKLAIGLRN

SEQ ID NO: 370132 - protein, 10 aa, Influenza virus
RGIFGAIAGF

SEQ ID NO: 370133 - protein, 10 aa, Influenza virus
GIFGAIAGFI

SEQ ID NO: 370134 - protein, 10 aa, Influenza virus
IFGAIAGFIE

SEQ ID NO: 370135 - protein, 10 aa, Influenza virus
IAGFIEGGWP

SEQ ID NO: 370136 - protein, 10 aa, Influenza virus
AGFIEGGWPG

SEQ ID NO: 370137 - protein, 10 aa, Influenza virus
GFIEGGWPGL

SEQ ID NO: 370138 - protein, 10 aa, Influenza virus
FIEGGWPGLV

SEQ ID NO: 370139 - protein, 10 aa, Influenza virus
IEGGWPGLVA

SEQ ID NO: 370140 - protein, 10 aa, Influenza virus
EGGWPGLVAG

SEQ ID NO: 370141 - protein, 10 aa, Influenza virus
GGWPGLVAGW

SEQ ID NO: 370142 - protein, 10 aa, Influenza virus
GWPGLVAGWY

SEQ ID NO: 370143 - protein, 10 aa, Influenza virus
WPGLVAGWYG

SEQ ID NO: 370144 - protein, 10 aa, Influenza virus
PGLVAGWYGF

SEQ ID NO: 370145 - protein, 10 aa, Influenza virus
GLIAGWYGFQ

SEQ ID NO: 370146 - protein, 10 aa, Influenza virus
LIAGWYGFQH

SEQ ID NO: 370147 - protein, 10 aa, Influenza virus
IAGWYGFQHS

SEQ ID NO: 370148 - protein, 10 aa, Influenza virus
AGWYGFQHTN

SEQ ID NO: 370149 - protein, 10 aa, Influenza virus
GWYGFQHSNA

SEQ ID NO: 370150 - protein, 10 aa, Influenza virus
WYGFQHSNAQ

SEQ ID NO: 370151 - protein, 10 aa, Influenza virus
YGFQHSNAQG

SEQ ID NO: 370152 - protein, 10 aa, Influenza virus
DQIQDVWAYN

SEQ ID NO: 370153 - protein, 10 aa, Influenza virus
QIQDVWAYNA

SEQ ID NO: 370154 - protein, 10 aa, Influenza virus
IQDVWAYNAE

SEQ ID NO: 370155 - protein, 10 aa, Influenza virus
QDVWAYNAEL

SEQ ID NO: 370156 - protein, 10 aa, Influenza virus
DVWAYNAELL

SEQ ID NO: 370157 - protein, 10 aa, Influenza virus
VWAYNAELLV

SEQ ID NO: 370158 - protein, 10 aa, Influenza virus
AYNAELLVLI

SEQ ID NO: 370159 - protein, 10 aa, Influenza virus
YNAELLVLLG

SEQ ID NO: 370160 - protein, 10 aa, Influenza virus
NAELLVLLGN

SEQ ID NO: 370161 - protein, 10 aa, Influenza virus
AELLVLLGNQ

SEQ ID NO: 370162 - protein, 10 aa, Influenza virus
ELLVLLGNQK

SEQ ID NO: 370163 - protein, 10 aa, Influenza virus
LLVLLGNQKT

SEQ ID NO: 370164 - protein, 10 aa, Influenza virus
LVLLGNQKTL

SEQ ID NO: 370165 - protein, 10 aa, Influenza virus
VLLGNQKTLD

SEQ ID NO: 370166 - protein, 10 aa, Influenza virus
LLGNQKTLDE

SEQ ID NO: 370167 - protein, 10 aa, Influenza virus
LGNQKTLDEH

SEQ ID NO: 370168 - protein, 10 aa, Influenza virus
EDGNGCFELY

SEQ ID NO: 370169 - protein, 10 aa, Influenza virus
DGNGCFELYH

SEQ ID NO: 370170 - protein, 10 aa, Influenza virus
GNGCFELYHK

SEQ ID NO: 370171 - protein, 10 aa, Influenza virus
NGCFELYHKC

SEQ ID NO: 370172 - protein, 10 aa, Influenza virus
GCFDLYHKCD

SEQ ID NO: 370173 - protein, 10 aa, Influenza virus
CMATIRNGTY

SEQ ID NO: 370174 - protein, 10 aa, Influenza virus
EGIYKILTIY

SEQ ID NO: 370175 - protein, 10 aa, Influenza virus
GIYKILTIYS

SEQ ID NO: 370176 - protein, 10 aa, Influenza virus
IYKILTIYST

SEQ ID NO: 370177 - protein, 10 aa, Influenza virus
YKILTIYSTA

SEQ ID NO: 370178 - protein, 10 aa, Influenza virus
KILTIYSTAA

SEQ ID NO: 370179 - protein, 10 aa, Influenza virus
ILTIYSTAAS

SEQ ID NO: 370180 - protein, 10 aa, Influenza virus
LTIYSTAASS

SEQ ID NO: 370181 - protein, 10 aa, Influenza virus
TIYSTAASSL

SEQ ID NO: 370182 - protein, 10 aa, Influenza virus
HQSTNSTETV

SEQ ID NO: 370183 - protein, 10 aa, Influenza virus
EGLVYGNPSC

SEQ ID NO: 370184 - protein, 10 aa, Influenza virus
GLVYGNPSCD

SEQ ID NO: 370185 - protein, 10 aa, Influenza virus
LKPGQTLRVR

SEQ ID NO: 370186 - protein, 10 aa, Influenza virus
KPGQTLRVRS

SEQ ID NO: 370187 - protein, 10 aa, Influenza virus
PGQTLRVRSN

SEQ ID NO: 370188 - protein, 10 aa, Influenza virus
QTLRVRSNGN

SEQ ID NO: 370189 - protein, 10 aa, Influenza virus
TLRVRSNGNL

SEQ ID NO: 370190 - protein, 10 aa, Influenza virus
SNGNLIAPWF

SEQ ID NO: 370191 - protein, 10 aa, Influenza virus
SLKLAIGLRN

SEQ ID NO: 370192 - protein, 10 aa, Influenza virus
IAGFIEGGWP

SEQ ID NO: 370193 - protein, 10 aa, Influenza virus
AGFIEGGWPG

SEQ ID NO: 370194 - protein, 10 aa, Influenza virus
GFIEGGWPGL

SEQ ID NO: 370195 - protein, 10 aa, Influenza virus
FIEGGWPGLV

SEQ ID NO: 370196 - protein, 10 aa, Influenza virus
IEGGWPGLVA

SEQ ID NO: 370197 - protein, 10 aa, Influenza virus
EGGWPGLVAG

SEQ ID NO: 370198 - protein, 10 aa, Influenza virus
GGWPGLVAGW

SEQ ID NO: 370199 - protein, 10 aa, Influenza virus
GWPGLVAGWY

SEQ ID NO: 370200 - protein, 10 aa, Influenza virus
WPGLVAGWYG

SEQ ID NO: 370201 - protein, 10 aa, Influenza virus
PGLVAGWYGF

SEQ ID NO: 370202 - protein, 10 aa, Influenza virus
GLIAGWYGFQ

SEQ ID NO: 370203 - protein, 10 aa, Influenza virus
LIAGWYGFQH

SEQ ID NO: 370204 - protein, 10 aa, Influenza virus
IAGWYGFQHS

SEQ ID NO: 370205 - protein, 10 aa, Influenza virus
AGWYGFQHTN

SEQ ID NO: 370206 - protein, 10 aa, Influenza virus
GWYGFQHSNA

SEQ ID NO: 370207 - protein, 10 aa, Influenza virus
WYGFQHSNAQ

SEQ ID NO: 370208 - protein, 10 aa, Influenza virus
YGFQHSNAQG

SEQ ID NO: 370209 - protein, 10 aa, Influenza virus
DDQIQDVWAY

SEQ ID NO: 370210 - protein, 10 aa, Influenza virus
DQIQDVWAYN

SEQ ID NO: 370211 - protein, 10 aa, Influenza virus
QIQDVWAYNA

SEQ ID NO: 370212 - protein, 10 aa, Influenza virus
IQDVWAYNAE

SEQ ID NO: 370213 - protein, 10 aa, Influenza virus
QDVWAYNAEL

SEQ ID NO: 370214 - protein, 10 aa, Influenza virus
DVWAYNAELL

SEQ ID NO: 370215 - protein, 10 aa, Influenza virus
VWAYNAELLV

SEQ ID NO: 370216 - protein, 10 aa, Influenza virus
AYNAELLVLI

SEQ ID NO: 370217 - protein, 10 aa, Influenza virus
YNAELLVLLG

SEQ ID NO: 370218 - protein, 10 aa, Influenza virus
NAELLVLLGN

SEQ ID NO: 370219 - protein, 10 aa, Influenza virus
AELLVLLGNQ

SEQ ID NO: 370220 - protein, 10 aa, Influenza virus
ELLVLLGNQK

SEQ ID NO: 370221 - protein, 10 aa, Influenza virus
LLVLLGNQKT

SEQ ID NO: 370222 - protein, 10 aa, Influenza virus
LVLLGNQKTL

SEQ ID NO: 370223 - protein, 10 aa, Influenza virus
VLLGNQKTLD

SEQ ID NO: 370224 - protein, 10 aa, Influenza virus
LLGNQKTLDE

SEQ ID NO: 370225 - protein, 10 aa, Influenza virus
LGNQKTLDEH

SEQ ID NO: 370226 - protein, 10 aa, Influenza virus
GNQKTLDEHD

SEQ ID NO: 370227 - protein, 10 aa, Influenza virus
EDGNGCFELY

SEQ ID NO: 370228 - protein, 10 aa, Influenza virus
DGNGCFELYH

SEQ ID NO: 370229 - protein, 10 aa, Influenza virus
GNGCFELYHK

SEQ ID NO: 370230 - protein, 10 aa, Influenza virus
NGCFELYHKC

SEQ ID NO: 370231 - protein, 10 aa, Influenza virus
GCFDLYHKCD

SEQ ID NO: 370232 - protein, 10 aa, Influenza virus
CMATIRNGTY

SEQ ID NO: 370233 - protein, 10 aa, Influenza virus
EGIYKILTIY

SEQ ID NO: 370234 - protein, 10 aa, Influenza virus
GIYKILTIYS

SEQ ID NO: 370235 - protein, 10 aa, Influenza virus
IYKILTIYST

SEQ ID NO: 370236 - protein, 10 aa, Influenza virus
YKILTIYSTA

SEQ ID NO: 370237 - protein, 10 aa, Influenza virus
KILTIYSTAA

SEQ ID NO: 370238 - protein, 10 aa, Influenza virus
ILTIYSTAAS

SEQ ID NO: 370239 - protein, 10 aa, Influenza virus
LTIYSTAASS

SEQ ID NO: 370240 - protein, 10 aa, Influenza virus
TIYSTAASSL

SEQ ID NO: 370241 - protein, 10 aa, Influenza virus
WLKPQCQITG

SEQ ID NO: 370242 - protein, 10 aa, Influenza virus
LKPQCQITGF

SEQ ID NO: 370243 - protein, 10 aa, Influenza virus
KPQCQITGFV

SEQ ID NO: 370244 - protein, 10 aa, Influenza virus
CYQFALGHGT

SEQ ID NO: 370245 - protein, 10 aa, Influenza virus
YQFALGHGTT

SEQ ID NO: 370246 - protein, 10 aa, Influenza virus
QFALGHGTTL

SEQ ID NO: 370247 - protein, 10 aa, Influenza virus
PYRTLLMSEL

SEQ ID NO: 370248 - protein, 10 aa, Influenza virus
YRTLLMSELG

SEQ ID NO: 370249 - protein, 10 aa, Influenza virus
RTLLMSELGV

SEQ ID NO: 370250 - protein, 10 aa, Influenza virus
TLLMSELGVP

SEQ ID NO: 370251 - protein, 10 aa, Influenza virus
LLMSELGVPF

SEQ ID NO: 370252 - protein, 10 aa, Influenza virus
LMSELGVPFH

SEQ ID NO: 370253 - protein, 10 aa, Influenza virus
TKQVCMAWSS

SEQ ID NO: 370254 - protein, 10 aa, Influenza virus
QVCMAWSSSS

SEQ ID NO: 370255 - protein, 10 aa, Influenza virus
VCMAWSSSSC

SEQ ID NO: 370256 - protein, 10 aa, Influenza virus
CMAWSSSSCH

SEQ ID NO: 370257 - protein, 10 aa, Influenza virus
MAWSSSSCHD

SEQ ID NO: 370258 - protein, 10 aa, Influenza virus
AWSSSSCYDG

SEQ ID NO: 370259 - protein, 10 aa, Influenza virus
WSSSSCHDGR

SEQ ID NO: 370260 - protein, 10 aa, Influenza virus
SSSSCHDGRA

SEQ ID NO: 370261 - protein, 10 aa, Influenza virus
SSSCHDGRAW

SEQ ID NO: 370262 - protein, 10 aa, Influenza virus
SSCHDGRAWL

SEQ ID NO: 370263 - protein, 10 aa, Influenza virus
SCHDGRAWLH

SEQ ID NO: 370264 - protein, 10 aa, Influenza virus
SILRTQESEC

SEQ ID NO: 370265 - protein, 10 aa, Influenza virus
ILRTQESECI

SEQ ID NO: 370266 - protein, 10 aa, Influenza virus
LRTQESECIC

SEQ ID NO: 370267 - protein, 10 aa, Influenza virus
GSAQHIEECS

SEQ ID NO: 370268 - protein, 10 aa, Influenza virus
SAQHIEECSC

SEQ ID NO: 370269 - protein, 10 aa, Influenza virus
AQHIEECSCY

SEQ ID NO: 370270 - protein, 10 aa, Influenza virus
QHIEECSCYP

SEQ ID NO: 370271 - protein, 10 aa, Influenza virus
HIEECSCYPR

SEQ ID NO: 370272 - protein, 10 aa, Influenza virus
VCRDNWRGSN

SEQ ID NO: 370273 - protein, 10 aa, Influenza virus
CRDNWRGSNR

SEQ ID NO: 370274 - protein, 10 aa, Influenza virus
RDNWRGSNRP

SEQ ID NO: 370275 - protein, 10 aa, Influenza virus
DNWRGSNRPV

SEQ ID NO: 370276 - protein, 10 aa, Influenza virus
YLCSGLVGDT

SEQ ID NO: 370277 - protein, 10 aa, Influenza virus
LCSGLVGDTP

SEQ ID NO: 370278 - protein, 10 aa, Influenza virus
SGLVGDTPRS

SEQ ID NO: 370279 - protein, 10 aa, Influenza virus
CVNRCFYVEL

SEQ ID NO: 370280 - protein, 10 aa, Influenza virus
VNRCFYVELI

SEQ ID NO: 370281 - protein, 10 aa, Influenza virus
NRCFYVELVR

SEQ ID NO: 370282 - protein, 10 aa, Influenza virus
RCFYVELVRG

SEQ ID NO: 370283 - protein, 10 aa, Influenza virus
CFYVELVRGR

SEQ ID NO: 370284 - protein, 10 aa, Influenza virus
FYVELVRGRP

SEQ ID NO: 370285 - protein, 10 aa, Influenza virus
GTGSWPDGAD

SEQ ID NO: 370286 - protein, 10 aa, Influenza virus
QLTEVETYVL

SEQ ID NO: 370287 - protein, 10 aa, Influenza virus
TEVETYVLSV

SEQ ID NO: 370288 - protein, 10 aa, Influenza virus
EVETYVLSII

SEQ ID NO: 370289 - protein, 10 aa, Influenza virus
VETYVLSIIP

SEQ ID NO: 370290 - protein, 10 aa, Influenza virus
ETYVLSIIPS

SEQ ID NO: 370291 - protein, 10 aa, Influenza virus
TYVLSIIPSG

SEQ ID NO: 370292 - protein, 10 aa, Influenza virus
YVLSIIPSGP

SEQ ID NO: 370293 - protein, 10 aa, Influenza virus
VLSIIPSGPL

SEQ ID NO: 370294 - protein, 10 aa, Influenza virus
LSIIPSGPLK

SEQ ID NO: 370295 - protein, 10 aa, Influenza virus
SIIPSGPLKA

SEQ ID NO: 370296 - protein, 10 aa, Influenza virus
IIPSGPLKAE

SEQ ID NO: 370297 - protein, 10 aa, Influenza virus
IPSGPLKAEI

SEQ ID NO: 370298 - protein, 10 aa, Influenza virus
GPLKAEIAQK

SEQ ID NO: 370299 - protein, 10 aa, Influenza virus
PLKAEIAQKL

SEQ ID NO: 370300 - protein, 10 aa, Influenza virus
LKAEIAQKLE

SEQ ID NO: 370301 - protein, 10 aa, Influenza virus
KAEIAQRLES

SEQ ID NO: 370302 - protein, 10 aa, Influenza virus
AEIAQRLESV

SEQ ID NO: 370303 - protein, 10 aa, Influenza virus
EIAQRLESVF

SEQ ID NO: 370304 - protein, 10 aa, Influenza virus
IAQRLESVFA

SEQ ID NO: 370305 - protein, 10 aa, Influenza virus
AQRLESVFAG

SEQ ID NO: 370306 - protein, 10 aa, Influenza virus
QRLESVFAGK

SEQ ID NO: 370307 - protein, 10 aa, Influenza virus
VFAGKNADLE

SEQ ID NO: 370308 - protein, 10 aa, Influenza virus
FAGKNADLEA

SEQ ID NO: 370309 - protein, 10 aa, Influenza virus
AGKNADLEAL

SEQ ID NO: 370310 - protein, 10 aa, Influenza virus
GKNADLEALM

SEQ ID NO: 370311 - protein, 10 aa, Influenza virus
KNADLEALME

SEQ ID NO: 370312 - protein, 10 aa, Influenza virus
NADLEALMEW

SEQ ID NO: 370313 - protein, 10 aa, Influenza virus
TDLEALMEWI

SEQ ID NO: 370314 - protein, 10 aa, Influenza virus
DLEALMEWIK

SEQ ID NO: 370315 - protein, 10 aa, Influenza virus
LEALMEWIKT

SEQ ID NO: 370316 - protein, 10 aa, Influenza virus
EALMEWIKTR

SEQ ID NO: 370317 - protein, 10 aa, Influenza virus
ALMEWIKTRP

SEQ ID NO: 370318 - protein, 10 aa, Influenza virus
LMEWIKTRPI

SEQ ID NO: 370319 - protein, 10 aa, Influenza virus
MEWIKTRPIL

SEQ ID NO: 370320 - protein, 10 aa, Influenza virus
EWIKTRPILS

SEQ ID NO: 370321 - protein, 10 aa, Influenza virus
WIKTRPILSP

SEQ ID NO: 370322 - protein, 10 aa, Influenza virus
IKTRPILSPL

SEQ ID NO: 370323 - protein, 10 aa, Influenza virus
PILSPLTKGM

SEQ ID NO: 370324 - protein, 10 aa, Influenza virus
ILSPLTKGML

SEQ ID NO: 370325 - protein, 10 aa, Influenza virus
LSPLTKGMLG

SEQ ID NO: 370326 - protein, 10 aa, Influenza virus
SPLTKGMLGF

SEQ ID NO: 370327 - protein, 10 aa, Influenza virus
PLTKGMLGFV

SEQ ID NO: 370328 - protein, 10 aa, Influenza virus
LTKGMLGFVF

SEQ ID NO: 370329 - protein, 10 aa, Influenza virus
TKGMLGFVFT

SEQ ID NO: 370330 - protein, 10 aa, Influenza virus
KGMLGFVFTL

SEQ ID NO: 370331 - protein, 10 aa, Influenza virus
GMLGFVFTLT

SEQ ID NO: 370332 - protein, 10 aa, Influenza virus
MLGFVFTLTV

SEQ ID NO: 370333 - protein, 10 aa, Influenza virus
ERGLQRRRFI

SEQ ID NO: 370334 - protein, 10 aa, Influenza virus
RGLQRRRFIQ

SEQ ID NO: 370335 - protein, 10 aa, Influenza virus
GLQRRRFIQN

SEQ ID NO: 370336 - protein, 10 aa, Influenza virus
LQRRRFIQNA

SEQ ID NO: 370337 - protein, 10 aa, Influenza virus
QRRRFIQNAL

SEQ ID NO: 370338 - protein, 10 aa, Influenza virus
RRRFVQNALS

SEQ ID NO: 370339 - protein, 10 aa, Influenza virus
RRFVQNALSG

SEQ ID NO: 370340 - protein, 10 aa, Influenza virus
RFVQNALSGN

SEQ ID NO: 370341 - protein, 10 aa, Influenza virus
FVQNALSGNG

SEQ ID NO: 370342 - protein, 10 aa, Influenza virus
VQNALSGNGD

SEQ ID NO: 370343 - protein, 10 aa, Influenza virus
QNALSGNGDP

SEQ ID NO: 370344 - protein, 10 aa, Influenza virus
NALSGNGDPN

SEQ ID NO: 370345 - protein, 10 aa, Influenza virus
ALSGNGDPNN

SEQ ID NO: 370346 - protein, 10 aa, Influenza virus
LSGNGDPNNM

SEQ ID NO: 370347 - protein, 10 aa, Influenza virus
SGNGDPNNMD

SEQ ID NO: 370348 - protein, 10 aa, Influenza virus
GNGDPNNMDK

SEQ ID NO: 370349 - protein, 10 aa, Influenza virus
NGDPNNMDKA

SEQ ID NO: 370350 - protein, 10 aa, Influenza virus
GDPNNMDKAV

SEQ ID NO: 370351 - protein, 10 aa, Influenza virus
DPNNMDKAVK

SEQ ID NO: 370352 - protein, 10 aa, Influenza virus
PNNMDKAVKL

SEQ ID NO: 370353 - protein, 10 aa, Influenza virus
NNMDKAVKLY

SEQ ID NO: 370354 - protein, 10 aa, Influenza virus
NMDRAVKLYK

SEQ ID NO: 370355 - protein, 10 aa, Influenza virus
MDRAVKLYKK

SEQ ID NO: 370356 - protein, 10 aa, Influenza virus
DRAVKLYKKL

SEQ ID NO: 370357 - protein, 10 aa, Influenza virus
RAVKLYKKLK

SEQ ID NO: 370358 - protein, 10 aa, Influenza virus
AVKLYKKLKR

SEQ ID NO: 370359 - protein, 10 aa, Influenza virus
VKLYKKLKRE

SEQ ID NO: 370360 - protein, 10 aa, Influenza virus
KLYKKLKREI

SEQ ID NO: 370361 - protein, 10 aa, Influenza virus
LYKKLKREIT

SEQ ID NO: 370362 - protein, 10 aa, Influenza virus
YKKLKREITF

SEQ ID NO: 370363 - protein, 10 aa, Influenza virus
KKLKREITFH

SEQ ID NO: 370364 - protein, 10 aa, Influenza virus
KLKREMTFHG

SEQ ID NO: 370365 - protein, 10 aa, Influenza virus
LKREMTFHGA

SEQ ID NO: 370366 - protein, 10 aa, Influenza virus
KREMTFHGAK

SEQ ID NO: 370367 - protein, 10 aa, Influenza virus
REMTFHGAKE

SEQ ID NO: 370368 - protein, 10 aa, Influenza virus
EITFHGAKEI

SEQ ID NO: 370369 - protein, 10 aa, Influenza virus
GAKEIALSYS

SEQ ID NO: 370370 - protein, 10 aa, Influenza virus
IALSYSAGAL

SEQ ID NO: 370371 - protein, 10 aa, Influenza virus
ALSYSAGALA

SEQ ID NO: 370372 - protein, 10 aa, Influenza virus
LSYSAGALAS

SEQ ID NO: 370373 - protein, 10 aa, Influenza virus
SYSAGALASC

SEQ ID NO: 370374 - protein, 10 aa, Influenza virus
YSAGALASCM

SEQ ID NO: 370375 - protein, 10 aa, Influenza virus
SAGALASCMG

SEQ ID NO: 370376 - protein, 10 aa, Influenza virus
AGALASCMGL

SEQ ID NO: 370377 - protein, 10 aa, Influenza virus
MGLIYNRMGA

SEQ ID NO: 370378 - protein, 10 aa, Influenza virus
GLIYNRMGAV

SEQ ID NO: 370379 - protein, 10 aa, Influenza virus
LIYNRMGAVT

SEQ ID NO: 370380 - protein, 10 aa, Influenza virus
AFGLICATCE

SEQ ID NO: 370381 - protein, 10 aa, Influenza virus
FGLICATCEQ

SEQ ID NO: 370382 - protein, 10 aa, Influenza virus
GLICATCEQI

SEQ ID NO: 370383 - protein, 10 aa, Influenza virus
LICATCEQIA

SEQ ID NO: 370384 - protein, 10 aa, Influenza virus
ICATCEQIAD

SEQ ID NO: 370385 - protein, 10 aa, Influenza virus
CATCEQIADA

SEQ ID NO: 370386 - protein, 10 aa, Influenza virus
ATCEQIADAQ

SEQ ID NO: 370387 - protein, 10 aa, Influenza virus
TCEQIADAQH

SEQ ID NO: 370388 - protein, 10 aa, Influenza virus
CEQIADSQHK

SEQ ID NO: 370389 - protein, 10 aa, Influenza virus
EQIADSQHKS

SEQ ID NO: 370390 - protein, 10 aa, Influenza virus
QIADSQHKSH

SEQ ID NO: 370391 - protein, 10 aa, Influenza virus
IADSQHKSHR

SEQ ID NO: 370392 - protein, 10 aa, Influenza virus
ADSQHKSHRQ

SEQ ID NO: 370393 - protein, 10 aa, Influenza virus
DSQHKSHRQM

SEQ ID NO: 370394 - protein, 10 aa, Influenza virus
ATTNPLIKHE

SEQ ID NO: 370395 - protein, 10 aa, Influenza virus
TTNPLIKHEN

SEQ ID NO: 370396 - protein, 10 aa, Influenza virus
TNPLIKHENR

SEQ ID NO: 370397 - protein, 10 aa, Influenza virus
NPLIKHENRM

SEQ ID NO: 370398 - protein, 10 aa, Influenza virus
PLIKHENRMV

SEQ ID NO: 370399 - protein, 10 aa, Influenza virus
LIKHENRMVL

SEQ ID NO: 370400 - protein, 10 aa, Influenza virus
IKHENRMVLA

SEQ ID NO: 370401 - protein, 10 aa, Influenza virus
KHENRMVLAS

SEQ ID NO: 370402 - protein, 10 aa, Influenza virus
HENRMVIAST

SEQ ID NO: 370403 - protein, 10 aa, Influenza virus
ENRMVIASTT

SEQ ID NO: 370404 - protein, 10 aa, Influenza virus
NRMVIASTTA

SEQ ID NO: 370405 - protein, 10 aa, Influenza virus
RMVIASTTAK

SEQ ID NO: 370406 - protein, 10 aa, Influenza virus
MVIASTTAKA

SEQ ID NO: 370407 - protein, 10 aa, Influenza virus
VIASTTAKAM

SEQ ID NO: 370408 - protein, 10 aa, Influenza virus
IASTTAKAME

SEQ ID NO: 370409 - protein, 10 aa, Influenza virus
STTAKAMEQV

SEQ ID NO: 370410 - protein, 10 aa, Influenza virus
TTAKAMEQVA

SEQ ID NO: 370411 - protein, 10 aa, Influenza virus
TAKAMEQVAG

SEQ ID NO: 370412 - protein, 10 aa, Influenza virus
AKAMEQVAGS

SEQ ID NO: 370413 - protein, 10 aa, Influenza virus
KAMEQVAGSS

SEQ ID NO: 370414 - protein, 10 aa, Influenza virus
AMEQVAGSSE

SEQ ID NO: 370415 - protein, 10 aa, Influenza virus
MEQVAGSSEQ

SEQ ID NO: 370416 - protein, 10 aa, Influenza virus
EQVAGSSEQA

SEQ ID NO: 370417 - protein, 10 aa, Influenza virus
QVAGSSEQAA

SEQ ID NO: 370418 - protein, 10 aa, Influenza virus
VAGSSEQAAE

SEQ ID NO: 370419 - protein, 10 aa, Influenza virus
AGSNEQAAEA

SEQ ID NO: 370420 - protein, 10 aa, Influenza virus
GSSEQAAEAI

SEQ ID NO: 370421 - protein, 10 aa, Influenza virus
SSEQAAEAMD

SEQ ID NO: 370422 - protein, 10 aa, Influenza virus
SEQAAEAMEI

SEQ ID NO: 370423 - protein, 10 aa, Influenza virus
EQAAEAMEIA

SEQ ID NO: 370424 - protein, 10 aa, Influenza virus
MVHAMRTIGT

SEQ ID NO: 370425 - protein, 10 aa, Influenza virus
DLLENLQTYQ

SEQ ID NO: 370426 - protein, 10 aa, Influenza virus
LLENLQTYQK

SEQ ID NO: 370427 - protein, 10 aa, Influenza virus
LENLQTYQKR

SEQ ID NO: 370428 - protein, 10 aa, Influenza virus
ENLQTYQKRM

SEQ ID NO: 370429 - protein, 10 aa, Influenza virus
NLQTYQKRMG

SEQ ID NO: 370430 - protein, 10 aa, Influenza virus
LQTYQKRMGV

SEQ ID NO: 370431 - protein, 10 aa, Influenza virus
QTYQKRMGVQ

SEQ ID NO: 370432 - protein, 10 aa, Influenza virus
TYQKRMGVQM

SEQ ID NO: 370433 - protein, 10 aa, Influenza virus
YQKRMGVQLQ

SEQ ID NO: 370434 - protein, 10 aa, Influenza virus
QKRMGVQLQR

SEQ ID NO: 370435 - protein, 10 aa, Influenza virus
RMGVQLQRFK

SEQ ID NO: 370436 - protein, 10 aa, Influenza virus
MSLLTEVETL

SEQ ID NO: 370437 - protein, 10 aa, Influenza virus
GVPKSMREEY

SEQ ID NO: 370438 - protein, 10 aa, Influenza virus
GHFVNIELED

SEQ ID NO: 370439 - protein, 10 aa, Influenza virus
MSDINIMASQ

SEQ ID NO: 370440 - protein, 10 aa, Influenza virus
SDINIMASQG

SEQ ID NO: 370441 - protein, 10 aa, Influenza virus
DINIMASQGT

SEQ ID NO: 370442 - protein, 10 aa, Influenza virus
INIMASQGTK

SEQ ID NO: 370443 - protein, 10 aa, Influenza virus
NIMASQGTKR

SEQ ID NO: 370444 - protein, 10 aa, Influenza virus
IMASQGTKRS

SEQ ID NO: 370445 - protein, 10 aa, Influenza virus
MASQGTKRSH

SEQ ID NO: 370446 - protein, 10 aa, Influenza virus
ASQGTKRSHE

SEQ ID NO: 370447 - protein, 10 aa, Influenza virus
SQGTKRSHEQ

SEQ ID NO: 370448 - protein, 10 aa, Influenza virus
QGTKRSHEQM

SEQ ID NO: 370449 - protein, 10 aa, Influenza virus
GTKRSHEQME

SEQ ID NO: 370450 - protein, 10 aa, Influenza virus
TKRSHEQMET

SEQ ID NO: 370451 - protein, 10 aa, Influenza virus
KRSYEQMETD

SEQ ID NO: 370452 - protein, 10 aa, Influenza virus
RSYEQMETDG

SEQ ID NO: 370453 - protein, 10 aa, Influenza virus
YEQMETDGDR

SEQ ID NO: 370454 - protein, 10 aa, Influenza virus
EQMETDGDRQ

SEQ ID NO: 370455 - protein, 10 aa, Influenza virus
TEIRASVGKM

SEQ ID NO: 370456 - protein, 10 aa, Influenza virus
EIRASVGRMI

SEQ ID NO: 370457 - protein, 10 aa, Influenza virus
DGIGRFYIQM

SEQ ID NO: 370458 - protein, 10 aa, Influenza virus
GIGRFYVQMC

SEQ ID NO: 370459 - protein, 10 aa, Influenza virus
IGRFYVQMCT

SEQ ID NO: 370460 - protein, 10 aa, Influenza virus
GRFYVQMCTE

SEQ ID NO: 370461 - protein, 10 aa, Influenza virus
RFYVQMCTEL

SEQ ID NO: 370462 - protein, 10 aa, Influenza virus
FYVQMCTELK

SEQ ID NO: 370463 - protein, 10 aa, Influenza virus
YVQMCTELKL

SEQ ID NO: 370464 - protein, 10 aa, Influenza virus
IQMCTELKLN

SEQ ID NO: 370465 - protein, 10 aa, Influenza virus
QMCTELKLND

SEQ ID NO: 370466 - protein, 10 aa, Influenza virus
EGRLIQNSLT

SEQ ID NO: 370467 - protein, 10 aa, Influenza virus
GRLIQNSLTI

SEQ ID NO: 370468 - protein, 10 aa, Influenza virus
RLIQNSLTIE

SEQ ID NO: 370469 - protein, 10 aa, Influenza virus
TIEKMVLSAF

SEQ ID NO: 370470 - protein, 10 aa, Influenza virus
IEKMVLSAFD

SEQ ID NO: 370471 - protein, 10 aa, Influenza virus
EKMVLSAFDE

SEQ ID NO: 370472 - protein, 10 aa, Influenza virus
KMVLSAFDER

SEQ ID NO: 370473 - protein, 10 aa, Influenza virus
LSAFDERRNR

SEQ ID NO: 370474 - protein, 10 aa, Influenza virus
SAFDERRNRY

SEQ ID NO: 370475 - protein, 10 aa, Influenza virus
AFDERRNRYL

SEQ ID NO: 370476 - protein, 10 aa, Influenza virus
FDERRNRYLE

SEQ ID NO: 370477 - protein, 10 aa, Influenza virus
DERRNRYLEE

SEQ ID NO: 370478 - protein, 10 aa, Influenza virus
ERRNRYLEEH

SEQ ID NO: 370479 - protein, 10 aa, Influenza virus
RRNRYLEEHP

SEQ ID NO: 370480 - protein, 10 aa, Influenza virus
RNRYLEEHPS

SEQ ID NO: 370481 - protein, 10 aa, Influenza virus
NRYLEEHPSA

SEQ ID NO: 370482 - protein, 10 aa, Influenza virus
RYLEEHPSAG

SEQ ID NO: 370483 - protein, 10 aa, Influenza virus
YLEEHPNAGK

SEQ ID NO: 370484 - protein, 10 aa, Influenza virus
LEEHPNAGKD

SEQ ID NO: 370485 - protein, 10 aa, Influenza virus
EEHPNAGKDP

SEQ ID NO: 370486 - protein, 10 aa, Influenza virus
EHPNAGKDPK

SEQ ID NO: 370487 - protein, 10 aa, Influenza virus
HPNAGKDPKK

SEQ ID NO: 370488 - protein, 10 aa, Influenza virus
PNAGKDPKKT

SEQ ID NO: 370489 - protein, 10 aa, Influenza virus
NAGKDPKKTG

SEQ ID NO: 370490 - protein, 10 aa, Influenza virus
TGKDPKKTGG

SEQ ID NO: 370491 - protein, 10 aa, Influenza virus
PKKTGGPIYK

SEQ ID NO: 370492 - protein, 10 aa, Influenza virus
KKTGGPIYKR

SEQ ID NO: 370493 - protein, 10 aa, Influenza virus
EIRRVWRQAN

SEQ ID NO: 370494 - protein, 10 aa, Influenza virus
RRVWRQANNG

SEQ ID NO: 370495 - protein, 10 aa, Influenza virus
RVWRQANNGE

SEQ ID NO: 370496 - protein, 10 aa, Influenza virus
WRQANNGDDA

SEQ ID NO: 370497 - protein, 10 aa, Influenza virus
AGLTHLMIWH

SEQ ID NO: 370498 - protein, 10 aa, Influenza virus
GLTHLMIWHS

SEQ ID NO: 370499 - protein, 10 aa, Influenza virus
LTHLMIWHSN

SEQ ID NO: 370500 - protein, 10 aa, Influenza virus
THLMIWHSNL

SEQ ID NO: 370501 - protein, 10 aa, Influenza virus
HLMIWHSNLN

SEQ ID NO: 370502 - protein, 10 aa, Influenza virus
LMIWHSNLND

SEQ ID NO: 370503 - protein, 10 aa, Influenza virus
MIWHSNLNDT

SEQ ID NO: 370504 - protein, 10 aa, Influenza virus
IWHSNLNDTT

SEQ ID NO: 370505 - protein, 10 aa, Influenza virus
WHSNLNDTTY

SEQ ID NO: 370506 - protein, 10 aa, Influenza virus
HSNLNDTTYQ

SEQ ID NO: 370507 - protein, 10 aa, Influenza virus
SNLNDTTYQR

SEQ ID NO: 370508 - protein, 10 aa, Influenza virus
NLNDTTYQRT

SEQ ID NO: 370509 - protein, 10 aa, Influenza virus
LNDTTYQRTR

SEQ ID NO: 370510 - protein, 10 aa, Influenza virus
NDTTYQRTRA

SEQ ID NO: 370511 - protein, 10 aa, Influenza virus
DTTYQRTRAL

SEQ ID NO: 370512 - protein, 10 aa, Influenza virus
TTYQRTRALV

SEQ ID NO: 370513 - protein, 10 aa, Influenza virus
YQRTRALVRS

SEQ ID NO: 370514 - protein, 10 aa, Influenza virus
QRTRALVRSG

SEQ ID NO: 370515 - protein, 10 aa, Influenza virus
RTRALVRSGM

SEQ ID NO: 370516 - protein, 10 aa, Influenza virus
TRALVRSGMD

SEQ ID NO: 370517 - protein, 10 aa, Influenza virus
RALVRSGMDP

SEQ ID NO: 370518 - protein, 10 aa, Influenza virus
ALVRSGMDPR

SEQ ID NO: 370519 - protein, 10 aa, Influenza virus
LVRSGMDPRM

SEQ ID NO: 370520 - protein, 10 aa, Influenza virus
VRSGMDPRMC

SEQ ID NO: 370521 - protein, 10 aa, Influenza virus
RSGMDPRMCS

SEQ ID NO: 370522 - protein, 10 aa, Influenza virus
SGMDPRMCSL

SEQ ID NO: 370523 - protein, 10 aa, Influenza virus
RRSGAAGAAI

SEQ ID NO: 370524 - protein, 10 aa, Influenza virus
RSGAAGAAIK

SEQ ID NO: 370525 - protein, 10 aa, Influenza virus
SGAAGAAIKG

SEQ ID NO: 370526 - protein, 10 aa, Influenza virus
GAAGAAVKGI

SEQ ID NO: 370527 - protein, 10 aa, Influenza virus
AAGAAVKGIG

SEQ ID NO: 370528 - protein, 10 aa, Influenza virus
AGAAVKGIGT

SEQ ID NO: 370529 - protein, 10 aa, Influenza virus
GAAVKGVGTI

SEQ ID NO: 370530 - protein, 10 aa, Influenza virus
AMELIRMIKR

SEQ ID NO: 370531 - protein, 10 aa, Influenza virus
MELIRMVKRG

SEQ ID NO: 370532 - protein, 10 aa, Influenza virus
ELIRMVKRGI

SEQ ID NO: 370533 - protein, 10 aa, Influenza virus
LIRMVKRGIN

SEQ ID NO: 370534 - protein, 10 aa, Influenza virus
IRMVKRGIND

SEQ ID NO: 370535 - protein, 10 aa, Influenza virus
RMVKRGINDR

SEQ ID NO: 370536 - protein, 10 aa, Influenza virus
MVKRGINDRN

SEQ ID NO: 370537 - protein, 10 aa, Influenza virus
VKRGINDRNF

SEQ ID NO: 370538 - protein, 10 aa, Influenza virus
KRGVNDRNFW

SEQ ID NO: 370539 - protein, 10 aa, Influenza virus
RGVNDRNFWR

SEQ ID NO: 370540 - protein, 10 aa, Influenza virus
GVNDRNFWRG

SEQ ID NO: 370541 - protein, 10 aa, Influenza virus
VNDRNFWRGE

SEQ ID NO: 370542 - protein, 10 aa, Influenza virus
NDRNFWRGDN

SEQ ID NO: 370543 - protein, 10 aa, Influenza virus
DRNFWRGDNG

SEQ ID NO: 370544 - protein, 10 aa, Influenza virus
RNFWRGDNGR

SEQ ID NO: 370545 - protein, 10 aa, Influenza virus
NFWRGENGRK

SEQ ID NO: 370546 - protein, 10 aa, Influenza virus
FWRGENGRKT

SEQ ID NO: 370547 - protein, 10 aa, Influenza virus
WRGENGRKTR

SEQ ID NO: 370548 - protein, 10 aa, Influenza virus
TRVAYERMCN

SEQ ID NO: 370549 - protein, 10 aa, Influenza virus
RVAYERMCNI

SEQ ID NO: 370550 - protein, 10 aa, Influenza virus
VAYERMCNIL

SEQ ID NO: 370551 - protein, 10 aa, Influenza virus
KGKFQTAAQK

SEQ ID NO: 370552 - protein, 10 aa, Influenza virus
GKFQTAAQKA

SEQ ID NO: 370553 - protein, 10 aa, Influenza virus
KFQTAAQKAM

SEQ ID NO: 370554 - protein, 10 aa, Influenza virus
FQTAAQRAMV

SEQ ID NO: 370555 - protein, 10 aa, Influenza virus
QTAAQRAMVD

SEQ ID NO: 370556 - protein, 10 aa, Influenza virus
TAAQRAMVDQ

SEQ ID NO: 370557 - protein, 10 aa, Influenza virus
AAQRAMVDQV

SEQ ID NO: 370558 - protein, 10 aa, Influenza virus
AQRAMVDQVR

SEQ ID NO: 370559 - protein, 10 aa, Influenza virus
QRAMVDQVRE

SEQ ID NO: 370560 - protein, 10 aa, Influenza virus
RAMVDQVRES

SEQ ID NO: 370561 - protein, 10 aa, Influenza virus
AMVDQVRESR

SEQ ID NO: 370562 - protein, 10 aa, Influenza virus
MVDQVRESRN

SEQ ID NO: 370563 - protein, 10 aa, Influenza virus
VDQVRESRNP

SEQ ID NO: 370564 - protein, 10 aa, Influenza virus
DQVREGRNPG

SEQ ID NO: 370565 - protein, 10 aa, Influenza virus
QVREGRNPGN

SEQ ID NO: 370566 - protein, 10 aa, Influenza virus
VREGRNPGNA

SEQ ID NO: 370567 - protein, 10 aa, Influenza virus
REGRNPGNAE

SEQ ID NO: 370568 - protein, 10 aa, Influenza virus
EGRNPGNAEI

SEQ ID NO: 370569 - protein, 10 aa, Influenza virus
GRNPGNAEIE

SEQ ID NO: 370570 - protein, 10 aa, Influenza virus
RSPGNAEIED

SEQ ID NO: 370571 - protein, 10 aa, Influenza virus
SPGNAEIEDL

SEQ ID NO: 370572 - protein, 10 aa, Influenza virus
PGNAEIEDLT

SEQ ID NO: 370573 - protein, 10 aa, Influenza virus
GNAEIEDLTF

SEQ ID NO: 370574 - protein, 10 aa, Influenza virus
NAEIEDLTFL

SEQ ID NO: 370575 - protein, 10 aa, Influenza virus
AEIEDLTFLA

SEQ ID NO: 370576 - protein, 10 aa, Influenza virus
EIEDLTFLAR

SEQ ID NO: 370577 - protein, 10 aa, Influenza virus
IEDLTFLARS

SEQ ID NO: 370578 - protein, 10 aa, Influenza virus
EDLTFLARSA

SEQ ID NO: 370579 - protein, 10 aa, Influenza virus
DLTFLARSAL

SEQ ID NO: 370580 - protein, 10 aa, Influenza virus
LTFLARSALI

SEQ ID NO: 370581 - protein, 10 aa, Influenza virus
TFLARSALIL

SEQ ID NO: 370582 - protein, 10 aa, Influenza virus
FSARSALILR

SEQ ID NO: 370583 - protein, 10 aa, Influenza virus
SARSALILRG

SEQ ID NO: 370584 - protein, 10 aa, Influenza virus
ARSALILRGA

SEQ ID NO: 370585 - protein, 10 aa, Influenza virus
RSALILRGSI

SEQ ID NO: 370586 - protein, 10 aa, Influenza virus
SALILRGSIA

SEQ ID NO: 370587 - protein, 10 aa, Influenza virus
ALILRGSIAH

SEQ ID NO: 370588 - protein, 10 aa, Influenza virus
LILRGSIAHK

SEQ ID NO: 370589 - protein, 10 aa, Influenza virus
ILRGSIAHKS

SEQ ID NO: 370590 - protein, 10 aa, Influenza virus
LRGSIAHKSC

SEQ ID NO: 370591 - protein, 10 aa, Influenza virus
RGSIAHKSCL

SEQ ID NO: 370592 - protein, 10 aa, Influenza virus
GSIAHKSCLP

SEQ ID NO: 370593 - protein, 10 aa, Influenza virus
SIAHKSCLPA

SEQ ID NO: 370594 - protein, 10 aa, Influenza virus
IAHKSCLPAC

SEQ ID NO: 370595 - protein, 10 aa, Influenza virus
AHKSCLPACA

SEQ ID NO: 370596 - protein, 10 aa, Influenza virus
HKSCLPACAY

SEQ ID NO: 370597 - protein, 10 aa, Influenza virus
KSCLPACAYG

SEQ ID NO: 370598 - protein, 10 aa, Influenza virus
SCLPACVYGP

SEQ ID NO: 370599 - protein, 10 aa, Influenza virus
CLPACVYGPA

SEQ ID NO: 370600 - protein, 10 aa, Influenza virus
GHDFEREGYS

SEQ ID NO: 370601 - protein, 10 aa, Influenza virus
HDFEREGYSL

SEQ ID NO: 370602 - protein, 10 aa, Influenza virus
DFEKEGYSLV

SEQ ID NO: 370603 - protein, 10 aa, Influenza virus
FEKEGYSLVG

SEQ ID NO: 370604 - protein, 10 aa, Influenza virus
EKEGYSLVGI

SEQ ID NO: 370605 - protein, 10 aa, Influenza virus
KEGYSLVGID

SEQ ID NO: 370606 - protein, 10 aa, Influenza virus
EGYSLVGVDP

SEQ ID NO: 370607 - protein, 10 aa, Influenza virus
GYSLVGVDPF

SEQ ID NO: 370608 - protein, 10 aa, Influenza virus
YSLVGIDPFR

SEQ ID NO: 370609 - protein, 10 aa, Influenza virus
SLVGIDPFRL

SEQ ID NO: 370610 - protein, 10 aa, Influenza virus
LVGIDPFRLL

SEQ ID NO: 370611 - protein, 10 aa, Influenza virus
VGIDPFRLLQ

SEQ ID NO: 370612 - protein, 10 aa, Influenza virus
DPFRLLQNSQ

SEQ ID NO: 370613 - protein, 10 aa, Influenza virus
PFKLLQNSQV

SEQ ID NO: 370614 - protein, 10 aa, Influenza virus
RSNENPAHKS

SEQ ID NO: 370615 - protein, 10 aa, Influenza virus
SNENPAHKSQ

SEQ ID NO: 370616 - protein, 10 aa, Influenza virus
NENPVHKSQL

SEQ ID NO: 370617 - protein, 10 aa, Influenza virus
ENPVHKSQLI

SEQ ID NO: 370618 - protein, 10 aa, Influenza virus
NPVHKSQLIW

SEQ ID NO: 370619 - protein, 10 aa, Influenza virus
PVHKSQLIWM

SEQ ID NO: 370620 - protein, 10 aa, Influenza virus
VHKSQLIWMA

SEQ ID NO: 370621 - protein, 10 aa, Influenza virus
HKSQLIWMAC

SEQ ID NO: 370622 - protein, 10 aa, Influenza virus
KSQLVWMACN

SEQ ID NO: 370623 - protein, 10 aa, Influenza virus
SQLVWMACNS

SEQ ID NO: 370624 - protein, 10 aa, Influenza virus
QLVWMACNSA

SEQ ID NO: 370625 - protein, 10 aa, Influenza virus
LVWMACNSAA

SEQ ID NO: 370626 - protein, 10 aa, Influenza virus
VWMACNSAAF

SEQ ID NO: 370627 - protein, 10 aa, Influenza virus
WMACNSAAFE

SEQ ID NO: 370628 - protein, 10 aa, Influenza virus
MACNSAAFED

SEQ ID NO: 370629 - protein, 10 aa, Influenza virus
ACNSAAFEDL

SEQ ID NO: 370630 - protein, 10 aa, Influenza virus
CNSAAFEDLR

SEQ ID NO: 370631 - protein, 10 aa, Influenza virus
HSAAFEDLRL

SEQ ID NO: 370632 - protein, 10 aa, Influenza virus
SAAFEDLRLL

SEQ ID NO: 370633 - protein, 10 aa, Influenza virus
LSTRGVQVAS

SEQ ID NO: 370634 - protein, 10 aa, Influenza virus
STRGVQVASN

SEQ ID NO: 370635 - protein, 10 aa, Influenza virus
TRGVQVASNE

SEQ ID NO: 370636 - protein, 10 aa, Influenza virus
RGVQVASNEN

SEQ ID NO: 370637 - protein, 10 aa, Influenza virus
TLELRSGYWA

SEQ ID NO: 370638 - protein, 10 aa, Influenza virus
LELRSGYWAI

SEQ ID NO: 370639 - protein, 10 aa, Influenza virus
ELRSGYWAIR

SEQ ID NO: 370640 - protein, 10 aa, Influenza virus
LRSGYWAIRT

SEQ ID NO: 370641 - protein, 10 aa, Influenza virus
RSGYWAIRTR

SEQ ID NO: 370642 - protein, 10 aa, Influenza virus
SGYWAIRTRS

SEQ ID NO: 370643 - protein, 10 aa, Influenza virus
GYWAIRTRSG

SEQ ID NO: 370644 - protein, 10 aa, Influenza virus
AIRTKSGGNT

SEQ ID NO: 370645 - protein, 10 aa, Influenza virus
IRTRSGGNTS

SEQ ID NO: 370646 - protein, 10 aa, Influenza virus
RTRSGGNTSQ

SEQ ID NO: 370647 - protein, 10 aa, Influenza virus
ASAGQTSVQP

SEQ ID NO: 370648 - protein, 10 aa, Influenza virus
STQPTFSVQR

SEQ ID NO: 370649 - protein, 10 aa, Influenza virus
TQPTFSVQRN

SEQ ID NO: 370650 - protein, 10 aa, Influenza virus
QPAFSVQRNL

SEQ ID NO: 370651 - protein, 10 aa, Influenza virus
PAFSVQRNLP

SEQ ID NO: 370652 - protein, 10 aa, Influenza virus
AFSVQRNLPF

SEQ ID NO: 370653 - protein, 10 aa, Influenza virus
FSVQRNLPFD

SEQ ID NO: 370654 - protein, 10 aa, Influenza virus
SVQRNLPFEK

SEQ ID NO: 370655 - protein, 10 aa, Influenza virus
EGRTSDMRAE

SEQ ID NO: 370656 - protein, 10 aa, Influenza virus
GRTSDMRAEI

SEQ ID NO: 370657 - protein, 10 aa, Influenza virus
RTSDMRAEII

SEQ ID NO: 370658 - protein, 10 aa, Influenza virus
DLSFQGRGVF

SEQ ID NO: 370659 - protein, 10 aa, Influenza virus
LSFQGRGVFE

SEQ ID NO: 370660 - protein, 10 aa, Influenza virus
SFRGRGVFEL

SEQ ID NO: 370661 - protein, 10 aa, Influenza virus
FRGRGVFELS

SEQ ID NO: 370662 - protein, 10 aa, Influenza virus
RGRGVFELSD

SEQ ID NO: 370663 - protein, 10 aa, Influenza virus
GRGVFEFSDE

SEQ ID NO: 370664 - protein, 10 aa, Influenza virus
RGVFELSDER

SEQ ID NO: 370665 - protein, 10 aa, Influenza virus
GVFELSDERA

SEQ ID NO: 370666 - protein, 10 aa, Influenza virus
VFELSDERAT

SEQ ID NO: 370667 - protein, 10 aa, Influenza virus
ATNPIVPSFE

SEQ ID NO: 370668 - protein, 10 aa, Influenza virus
PIVPSFDMNN

SEQ ID NO: 370669 - protein, 10 aa, Influenza virus
MNNEGSYFFG

SEQ ID NO: 370670 - protein, 10 aa, Influenza virus
NNEGSYFFGD

SEQ ID NO: 370671 - protein, 10 aa, Influenza virus
KEGSYFFGDN

SEQ ID NO: 370672 - protein, 10 aa, Influenza virus
GSYFFGDNAK

SEQ ID NO: 370673 - protein, 10 aa, Influenza virus
SYFFGDSAEE

SEQ ID NO: 370674 - protein, 10 aa, Influenza virus
YFFGDNAEEF

SEQ ID NO: 370675 - protein, 10 aa, Influenza virus
TSFQVDCYLW

SEQ ID NO: 370676 - protein, 10 aa, Influenza virus
SFQVDCYLWH

SEQ ID NO: 370677 - protein, 10 aa, Influenza virus
FQVDCFLWHI

SEQ ID NO: 370678 - protein, 10 aa, Influenza virus
QVDCFLWHIR

SEQ ID NO: 370679 - protein, 10 aa, Influenza virus
SDAPFLDRLR

SEQ ID NO: 370680 - protein, 10 aa, Influenza virus
DAPFDDRLRR

SEQ ID NO: 370681 - protein, 10 aa, Influenza virus
APFDDRLRRD

SEQ ID NO: 370682 - protein, 10 aa, Influenza virus
PFDDRLRRDQ

SEQ ID NO: 370683 - protein, 10 aa, Influenza virus
SSLLLQANLC

SEQ ID NO: 370684 - protein, 10 aa, Influenza virus
SLLLQANLCR

SEQ ID NO: 370685 - protein, 10 aa, Influenza virus
DRLRRDQRSL

SEQ ID NO: 370686 - protein, 10 aa, Influenza virus
RRDQKSLKGR

SEQ ID NO: 370687 - protein, 10 aa, Influenza virus
ASVPASRYLT

SEQ ID NO: 370688 - protein, 10 aa, Influenza virus
SVPASRYLID

SEQ ID NO: 370689 - protein, 10 aa, Influenza virus
VPASRYLIDM

SEQ ID NO: 370690 - protein, 10 aa, Influenza virus
PASRYLTDMT

SEQ ID NO: 370691 - protein, 10 aa, Influenza virus
EVRHRLKITE

SEQ ID NO: 370692 - protein, 10 aa, Influenza virus
VRHRLKITEN

SEQ ID NO: 370693 - protein, 10 aa, Influenza virus
RRDQMAHCRM

SEQ ID NO: 370694 - protein, 10 aa, Influenza virus
FQVDCFLWHV

SEQ ID NO: 370695 - protein, 10 aa, Influenza virus
QVDCFLWHVR

SEQ ID NO: 370696 - protein, 10 aa, Influenza virus
VDCFLWHVRK

SEQ ID NO: 370697 - protein, 10 aa, Influenza virus
DCFLWHVRKR

SEQ ID NO: 370698 - protein, 10 aa, Influenza virus
CFLWHVRKRF

SEQ ID NO: 370699 - protein, 10 aa, Influenza virus
KMTIASDILK

SEQ ID NO: 370700 - protein, 10 aa, Influenza virus
MTIASDILKR

SEQ ID NO: 370701 - protein, 10 aa, Influenza virus
TIASDILKRM

SEQ ID NO: 370702 - protein, 10 aa, Influenza virus
IASDILTRMS

SEQ ID NO: 370703 - protein, 10 aa, Influenza virus
ASDILKRMSK

SEQ ID NO: 370704 - protein, 10 aa, Influenza virus
TESSFEQITF

SEQ ID NO: 370705 - protein, 10 aa, Influenza virus
ENSFEQITFL

SEQ ID NO: 370706 - protein, 10 aa, Influenza virus
NSFEQITFLQ

SEQ ID NO: 370707 - protein, 10 aa, Influenza virus
SFEQITFLQA

SEQ ID NO: 370708 - protein, 10 aa, Influenza virus
FEQITFLQAL

SEQ ID NO: 370709 - protein, 10 aa, Influenza virus
EQITFLQALQ

SEQ ID NO: 370710 - protein, 10 aa, Influenza virus
QITFLQALQL

SEQ ID NO: 370711 - protein, 10 aa, Influenza virus
ITFLQALQLL

SEQ ID NO: 370712 - protein, 10 aa, Influenza virus
TFMQALQLLF

SEQ ID NO: 370713 - protein, 10 aa, Influenza virus
FMQALQLLFE

SEQ ID NO: 370714 - protein, 10 aa, Influenza virus
MQALQLLFEV

SEQ ID NO: 370715 - protein, 10 aa, Influenza virus
QALQLLFEVE

SEQ ID NO: 370716 - protein, 10 aa, Influenza virus
ALQLLFEVEQ

SEQ ID NO: 370717 - protein, 10 aa, Influenza virus
LQLLFEVEQE

SEQ ID NO: 370718 - protein, 10 aa, Influenza virus
EVEQEIRAFS

SEQ ID NO: 370719 - protein, 10 aa, Influenza virus
EIRAFSFQLI

SEQ ID NO: 370720 - protein, 10 aa, Influenza virus
IRTFSFQLIN

SEQ ID NO: 370721 - protein, 10 aa, Influenza virus
RTFSFQLILI

SEQ ID NO: 370722 - protein, 10 aa, Influenza virus
MENFVRQCFN

SEQ ID NO: 370723 - protein, 10 aa, Influenza virus
NFVRQCFNPM

SEQ ID NO: 370724 - protein, 10 aa, Influenza virus
FVRQCFNPMV

SEQ ID NO: 370725 - protein, 10 aa, Influenza virus
VRQCFNPMII

SEQ ID NO: 370726 - protein, 10 aa, Influenza virus
RQCFNPMIIE

SEQ ID NO: 370727 - protein, 10 aa, Influenza virus
QCFNPMIIEL

SEQ ID NO: 370728 - protein, 10 aa, Influenza virus
CFNPMIIELA

SEQ ID NO: 370729 - protein, 10 aa, Influenza virus
FNPMIIELAE

SEQ ID NO: 370730 - protein, 10 aa, Influenza virus
VELAEKTMKE

SEQ ID NO: 370731 - protein, 10 aa, Influenza virus
ELAEKTMKEY

SEQ ID NO: 370732 - protein, 10 aa, Influenza virus
LAEKTMKEYG

SEQ ID NO: 370733 - protein, 10 aa, Influenza virus
AEKTMKEYGE

SEQ ID NO: 370734 - protein, 10 aa, Influenza virus
ETNKLAAICT

SEQ ID NO: 370735 - protein, 10 aa, Influenza virus
TNKLAAICTH

SEQ ID NO: 370736 - protein, 10 aa, Influenza virus
NKFAAICTHM

SEQ ID NO: 370737 - protein, 10 aa, Influenza virus
KFAAICTHME

SEQ ID NO: 370738 - protein, 10 aa, Influenza virus
AAICTHMEVC

SEQ ID NO: 370739 - protein, 10 aa, Influenza virus
AICTHMEVCF

SEQ ID NO: 370740 - protein, 10 aa, Influenza virus
ICTHMEVCFM

SEQ ID NO: 370741 - protein, 10 aa, Influenza virus
CTHMEVCFMY

SEQ ID NO: 370742 - protein, 10 aa, Influenza virus
THMEVCFMYS

SEQ ID NO: 370743 - protein, 10 aa, Influenza virus
HMEVCFMYSD

SEQ ID NO: 370744 - protein, 10 aa, Influenza virus
MEVCFMYSDF

SEQ ID NO: 370745 - protein, 10 aa, Influenza virus
EICFMYSDFH

SEQ ID NO: 370746 - protein, 10 aa, Influenza virus
ICFMYSDFHF

SEQ ID NO: 370747 - protein, 10 aa, Influenza virus
FMYSDFHFIN

SEQ ID NO: 370748 - protein, 10 aa, Influenza virus
MYSDFHFINE

SEQ ID NO: 370749 - protein, 10 aa, Influenza virus
YSDFHFINEQ

SEQ ID NO: 370750 - protein, 10 aa, Influenza virus
DSNALLKHRF

SEQ ID NO: 370751 - protein, 10 aa, Influenza virus
SNALLKHRFE

SEQ ID NO: 370752 - protein, 10 aa, Influenza virus
NVLLKHRFEI

SEQ ID NO: 370753 - protein, 10 aa, Influenza virus
VLLKHRFEII

SEQ ID NO: 370754 - protein, 10 aa, Influenza virus
FEIIEGRDRI

SEQ ID NO: 370755 - protein, 10 aa, Influenza virus
KPRFLPDLYD

SEQ ID NO: 370756 - protein, 10 aa, Influenza virus
PRFLPDLYDY

SEQ ID NO: 370757 - protein, 10 aa, Influenza virus
RFLPDLYDYK

SEQ ID NO: 370758 - protein, 10 aa, Influenza virus
YLPDLYDYKE

SEQ ID NO: 370759 - protein, 10 aa, Influenza virus
LPDLYDYKED

SEQ ID NO: 370760 - protein, 10 aa, Influenza virus
PDLYDYKEDR

SEQ ID NO: 370761 - protein, 10 aa, Influenza virus
DLYDYKEDRF

SEQ ID NO: 370762 - protein, 10 aa, Influenza virus
RFVEIGVTRR

SEQ ID NO: 370763 - protein, 10 aa, Influenza virus
FVEIGVTRRE

SEQ ID NO: 370764 - protein, 10 aa, Influenza virus
EIGVTRREIH

SEQ ID NO: 370765 - protein, 10 aa, Influenza virus
IGVTRREVHT

SEQ ID NO: 370766 - protein, 10 aa, Influenza virus
GVTRREVHTY

SEQ ID NO: 370767 - protein, 10 aa, Influenza virus
VTRREVHTYY

SEQ ID NO: 370768 - protein, 10 aa, Influenza virus
TRREVHTYYL

SEQ ID NO: 370769 - protein, 10 aa, Influenza virus
RREVHTYYLE

SEQ ID NO: 370770 - protein, 10 aa, Influenza virus
REVHTYYLEK

SEQ ID NO: 370771 - protein, 10 aa, Influenza virus
YYLEKASKIK

SEQ ID NO: 370772 - protein, 10 aa, Influenza virus
YLEKANKIKT

SEQ ID NO: 370773 - protein, 10 aa, Influenza virus
ENTHIHIFSF

SEQ ID NO: 370774 - protein, 10 aa, Influenza virus
THIHIFSFNG

SEQ ID NO: 370775 - protein, 10 aa, Influenza virus
HIHIFSFNGE

SEQ ID NO: 370776 - protein, 10 aa, Influenza virus
IHIFSFNGEE

SEQ ID NO: 370777 - protein, 10 aa, Influenza virus
HIFSFNGEEM

SEQ ID NO: 370778 - protein, 10 aa, Influenza virus
IFSFNGEEMA

SEQ ID NO: 370779 - protein, 10 aa, Influenza virus
FSFNGEEMAT

SEQ ID NO: 370780 - protein, 10 aa, Influenza virus
SFTGEEMATR

SEQ ID NO: 370781 - protein, 10 aa, Influenza virus
DYTIDEESRA

SEQ ID NO: 370782 - protein, 10 aa, Influenza virus
YTIDEESRAR

SEQ ID NO: 370783 - protein, 10 aa, Influenza virus
TIDEESRARI

SEQ ID NO: 370784 - protein, 10 aa, Influenza virus
IDEESRARIK

SEQ ID NO: 370785 - protein, 10 aa, Influenza virus
TRLFTIRQEL

SEQ ID NO: 370786 - protein, 10 aa, Influenza virus
RLFTIRQELA

SEQ ID NO: 370787 - protein, 10 aa, Influenza virus
LFTIRQEMAN

SEQ ID NO: 370788 - protein, 10 aa, Influenza virus
RSLWDSFRQS

SEQ ID NO: 370789 - protein, 10 aa, Influenza virus
SLWDSFRQSE

SEQ ID NO: 370790 - protein, 10 aa, Influenza virus
LWDPFRQSER

SEQ ID NO: 370791 - protein, 10 aa, Influenza virus
SFRQSERGED

SEQ ID NO: 370792 - protein, 10 aa, Influenza virus
FRQSERGEDT

SEQ ID NO: 370793 - protein, 10 aa, Influenza virus
RQSERGEDTI

SEQ ID NO: 370794 - protein, 10 aa, Influenza virus
QSERGEDTIE

SEQ ID NO: 370795 - protein, 10 aa, Influenza virus
SERGEDTIEE

SEQ ID NO: 370796 - protein, 10 aa, Influenza virus
ERGEETIEEK

SEQ ID NO: 370797 - protein, 10 aa, Influenza virus
RGEETIEEKF

SEQ ID NO: 370798 - protein, 10 aa, Influenza virus
GEETIEEKFE

SEQ ID NO: 370799 - protein, 10 aa, Influenza virus
EETIEEKFEI

SEQ ID NO: 370800 - protein, 10 aa, Influenza virus
LANQSLPPNF

SEQ ID NO: 370801 - protein, 10 aa, Influenza virus
ANQSLPPNFS

SEQ ID NO: 370802 - protein, 10 aa, Influenza virus
FRAYVDGFKP

SEQ ID NO: 370803 - protein, 10 aa, Influenza virus
RAYVDGFKPN

SEQ ID NO: 370804 - protein, 10 aa, Influenza virus
AYVDGFKPNG

SEQ ID NO: 370805 - protein, 10 aa, Influenza virus
YVDGFEPNGY

SEQ ID NO: 370806 - protein, 10 aa, Influenza virus
VDGFEPNGYI

SEQ ID NO: 370807 - protein, 10 aa, Influenza virus
DGFEPNGYIE

SEQ ID NO: 370808 - protein, 10 aa, Influenza virus
GFEPNGYIEG

SEQ ID NO: 370809 - protein, 10 aa, Influenza virus
FEPNGYIEGK

SEQ ID NO: 370810 - protein, 10 aa, Influenza virus
EPNGYIEGKL

SEQ ID NO: 370811 - protein, 10 aa, Influenza virus
PNGYIEGKLS

SEQ ID NO: 370812 - protein, 10 aa, Influenza virus
NGYIEGKLSQ

SEQ ID NO: 370813 - protein, 10 aa, Influenza virus
GYIEGKLSQM

SEQ ID NO: 370814 - protein, 10 aa, Influenza virus
YIEGKLSQMS

SEQ ID NO: 370815 - protein, 10 aa, Influenza virus
IEGKLSQMSR

SEQ ID NO: 370816 - protein, 10 aa, Influenza virus
CHQRSKFLLM

SEQ ID NO: 370817 - protein, 10 aa, Influenza virus
HQRSKFLLMD

SEQ ID NO: 370818 - protein, 10 aa, Influenza virus
QRSKFLLMDS

SEQ ID NO: 370819 - protein, 10 aa, Influenza virus
RSKFLLMDSL

SEQ ID NO: 370820 - protein, 10 aa, Influenza virus
SKFLLMDSLK

SEQ ID NO: 370821 - protein, 10 aa, Influenza virus
KFLLMDSLKL

SEQ ID NO: 370822 - protein, 10 aa, Influenza virus
FLLMDSLKLS

SEQ ID NO: 370823 - protein, 10 aa, Influenza virus
LLMDSLKLSI

SEQ ID NO: 370824 - protein, 10 aa, Influenza virus
LMDSLKLSIE

SEQ ID NO: 370825 - protein, 10 aa, Influenza virus
MDSLKLSIED

SEQ ID NO: 370826 - protein, 10 aa, Influenza virus
DSLKLSIEDP

SEQ ID NO: 370827 - protein, 10 aa, Influenza virus
LKLSIEDPNH

SEQ ID NO: 370828 - protein, 10 aa, Influenza virus
KLSIEDPNHE

SEQ ID NO: 370829 - protein, 10 aa, Influenza virus
LSIEDPNHEG

SEQ ID NO: 370830 - protein, 10 aa, Influenza virus
SIEDPNHEGE

SEQ ID NO: 370831 - protein, 10 aa, Influenza virus
IEDPNHEGEG

SEQ ID NO: 370832 - protein, 10 aa, Influenza virus
EDPNHEGEGI

SEQ ID NO: 370833 - protein, 10 aa, Influenza virus
DPNHEGEGIP

SEQ ID NO: 370834 - protein, 10 aa, Influenza virus
PNHEGEGIPL

SEQ ID NO: 370835 - protein, 10 aa, Influenza virus
NHEGEGIPLY

SEQ ID NO: 370836 - protein, 10 aa, Influenza virus
HEGEGIPLHD

SEQ ID NO: 370837 - protein, 10 aa, Influenza virus
EGEGIPLHDA

SEQ ID NO: 370838 - protein, 10 aa, Influenza virus
GEGIPLYDAV

SEQ ID NO: 370839 - protein, 10 aa, Influenza virus
EGIPLYDAVR

SEQ ID NO: 370840 - protein, 10 aa, Influenza virus
GIPLYDAVRC

SEQ ID NO: 370841 - protein, 10 aa, Influenza virus
LRWALGENMA

SEQ ID NO: 370842 - protein, 10 aa, Influenza virus
RWALGENMAP

SEQ ID NO: 370843 - protein, 10 aa, Influenza virus
WVLGENMAPE

SEQ ID NO: 370844 - protein, 10 aa, Influenza virus
VLGENMAPEK

SEQ ID NO: 370845 - protein, 10 aa, Influenza virus
LGENMAPEKM

SEQ ID NO: 370846 - protein, 10 aa, Influenza virus
GENMAPEKMD

SEQ ID NO: 370847 - protein, 10 aa, Influenza virus
ENMAPEKMDF

SEQ ID NO: 370848 - protein, 10 aa, Influenza virus
WIQNEFNKAC

SEQ ID NO: 370849 - protein, 10 aa, Influenza virus
IQNEFNKACE

SEQ ID NO: 370850 - protein, 10 aa, Influenza virus
QSEFNKACEL

SEQ ID NO: 370851 - protein, 10 aa, Influenza virus
SEFNKACELT

SEQ ID NO: 370852 - protein, 10 aa, Influenza virus
NKACELTDSI

SEQ ID NO: 370853 - protein, 10 aa, Influenza virus
KACELTDSIW

SEQ ID NO: 370854 - protein, 10 aa, Influenza virus
WLELDEIGED

SEQ ID NO: 370855 - protein, 10 aa, Influenza virus
ELDEIGEDIA

SEQ ID NO: 370856 - protein, 10 aa, Influenza virus
LDEIGEDIAP

SEQ ID NO: 370857 - protein, 10 aa, Influenza virus
DEIGEDIAPI

SEQ ID NO: 370858 - protein, 10 aa, Influenza virus
EIGEDIAPIE

SEQ ID NO: 370859 - protein, 10 aa, Influenza virus
IGEDVAPIEY

SEQ ID NO: 370860 - protein, 10 aa, Influenza virus
APIEYIASMR

SEQ ID NO: 370861 - protein, 10 aa, Influenza virus
PIEYIASMRR

SEQ ID NO: 370862 - protein, 10 aa, Influenza virus
VASMRRNYFT

SEQ ID NO: 370863 - protein, 10 aa, Influenza virus
RRNYFTAEIS

SEQ ID NO: 370864 - protein, 10 aa, Influenza virus
YFTAEISHCR

SEQ ID NO: 370865 - protein, 10 aa, Influenza virus
FTAEISHCRA

SEQ ID NO: 370866 - protein, 10 aa, Influenza virus
TAEISHCRAT

SEQ ID NO: 370867 - protein, 10 aa, Influenza virus
AEISHCRATE

SEQ ID NO: 370868 - protein, 10 aa, Influenza virus
EISHCRATEY

SEQ ID NO: 370869 - protein, 10 aa, Influenza virus
ISHCRATEYI

SEQ ID NO: 370870 - protein, 10 aa, Influenza virus
SYCRATEYIM

SEQ ID NO: 370871 - protein, 10 aa, Influenza virus
YCRATEYIMK

SEQ ID NO: 370872 - protein, 10 aa, Influenza virus
CRATEYMMKG

SEQ ID NO: 370873 - protein, 10 aa, Influenza virus
RATEYMMKGV

SEQ ID NO: 370874 - protein, 10 aa, Influenza virus
ATEYMMKGVY

SEQ ID NO: 370875 - protein, 10 aa, Influenza virus
MKGVYVNTAL

SEQ ID NO: 370876 - protein, 10 aa, Influenza virus
KGVYVNTALL

SEQ ID NO: 370877 - protein, 10 aa, Influenza virus
GVYVNTALLN

SEQ ID NO: 370878 - protein, 10 aa, Influenza virus
VYVNTALLNA

SEQ ID NO: 370879 - protein, 10 aa, Influenza virus
YVNTALLNAS

SEQ ID NO: 370880 - protein, 10 aa, Influenza virus
VNTALLNASC

SEQ ID NO: 370881 - protein, 10 aa, Influenza virus
NTAMLNASCA

SEQ ID NO: 370882 - protein, 10 aa, Influenza virus
TAMLNASCAA

SEQ ID NO: 370883 - protein, 10 aa, Influenza virus
AMLNASCAAM

SEQ ID NO: 370884 - protein, 10 aa, Influenza virus
MLNASCAAMD

SEQ ID NO: 370885 - protein, 10 aa, Influenza virus
LNASCAAMDE

SEQ ID NO: 370886 - protein, 10 aa, Influenza virus
NASCAAMDEF

SEQ ID NO: 370887 - protein, 10 aa, Influenza virus
ASCAAMDEFQ

SEQ ID NO: 370888 - protein, 10 aa, Influenza virus
SCAAMDEFQL

SEQ ID NO: 370889 - protein, 10 aa, Influenza virus
CAAMDEFQLI

SEQ ID NO: 370890 - protein, 10 aa, Influenza virus
AAMDEFQLIP

SEQ ID NO: 370891 - protein, 10 aa, Influenza virus
AMDEFQLIPM

SEQ ID NO: 370892 - protein, 10 aa, Influenza virus
MDEFQLIPMI

SEQ ID NO: 370893 - protein, 10 aa, Influenza virus
DEFQLIPMIS

SEQ ID NO: 370894 - protein, 10 aa, Influenza virus
EFQLIPMISK

SEQ ID NO: 370895 - protein, 10 aa, Influenza virus
FQLIPMISKS

SEQ ID NO: 370896 - protein, 10 aa, Influenza virus
QLIPMISKCK

SEQ ID NO: 370897 - protein, 10 aa, Influenza virus
LIPMISKCKT

SEQ ID NO: 370898 - protein, 10 aa, Influenza virus
IPMISKCRTR

SEQ ID NO: 370899 - protein, 10 aa, Influenza virus
PMISKCRTRE

SEQ ID NO: 370900 - protein, 10 aa, Influenza virus
MISKCRTREG

SEQ ID NO: 370901 - protein, 10 aa, Influenza virus
ISKCRTREGR

SEQ ID NO: 370902 - protein, 10 aa, Influenza virus
SKCRTREGRR

SEQ ID NO: 370903 - protein, 10 aa, Influenza virus
KCRTREGRRK

SEQ ID NO: 370904 - protein, 10 aa, Influenza virus
CRTREGRRKT

SEQ ID NO: 370905 - protein, 10 aa, Influenza virus
RTREGRRKTN

SEQ ID NO: 370906 - protein, 10 aa, Influenza virus
TREGRRKTNL

SEQ ID NO: 370907 - protein, 10 aa, Influenza virus
REGRRKTNLY

SEQ ID NO: 370908 - protein, 10 aa, Influenza virus
EGRRRTNLYG

SEQ ID NO: 370909 - protein, 10 aa, Influenza virus
GRRRTNLYGF

SEQ ID NO: 370910 - protein, 10 aa, Influenza virus
RRRTNLYGFI

SEQ ID NO: 370911 - protein, 10 aa, Influenza virus
RKTNLYGFIV

SEQ ID NO: 370912 - protein, 10 aa, Influenza virus
KTNLYGFIVK

SEQ ID NO: 370913 - protein, 10 aa, Influenza virus
TNLYGFIVKG

SEQ ID NO: 370914 - protein, 10 aa, Influenza virus
NLYGFIVKGR

SEQ ID NO: 370915 - protein, 10 aa, Influenza virus
LYGFIVKGRS

SEQ ID NO: 370916 - protein, 10 aa, Influenza virus
YGFIVKGRSH

SEQ ID NO: 370917 - protein, 10 aa, Influenza virus
GFIVKGRSHL

SEQ ID NO: 370918 - protein, 10 aa, Influenza virus
FIVKGRSHLR

SEQ ID NO: 370919 - protein, 10 aa, Influenza virus
IVKGRSHLRN

SEQ ID NO: 370920 - protein, 10 aa, Influenza virus
VKGRSHLRND

SEQ ID NO: 370921 - protein, 10 aa, Influenza virus
LRNDTDVVNY

SEQ ID NO: 370922 - protein, 10 aa, Influenza virus
RNDTDVVNYV

SEQ ID NO: 370923 - protein, 10 aa, Influenza virus
NDTDVVNYVS

SEQ ID NO: 370924 - protein, 10 aa, Influenza virus
DTDVVNYVSM

SEQ ID NO: 370925 - protein, 10 aa, Influenza virus
TDVVNYVSME

SEQ ID NO: 370926 - protein, 10 aa, Influenza virus
DVVNYVSMEF

SEQ ID NO: 370927 - protein, 10 aa, Influenza virus
VVNYVSMEFS

SEQ ID NO: 370928 - protein, 10 aa, Influenza virus
VNYVSMEFSL

SEQ ID NO: 370929 - protein, 10 aa, Influenza virus
NYVSMEFSLT

SEQ ID NO: 370930 - protein, 10 aa, Influenza virus
YVSMEFSLTD

SEQ ID NO: 370931 - protein, 10 aa, Influenza virus
LSMEFSLTDP

SEQ ID NO: 370932 - protein, 10 aa, Influenza virus
SMEFSLTDPK

SEQ ID NO: 370933 - protein, 10 aa, Influenza virus
MEFSLTDPRF

SEQ ID NO: 370934 - protein, 10 aa, Influenza virus
EFSLTDPRFE

SEQ ID NO: 370935 - protein, 10 aa, Influenza virus
PMFLYIRTNG

SEQ ID NO: 370936 - protein, 10 aa, Influenza virus
MFLYIRTNGT

SEQ ID NO: 370937 - protein, 10 aa, Influenza virus
FLYIRTNGTS

SEQ ID NO: 370938 - protein, 10 aa, Influenza virus
LYIRTNGTSK

SEQ ID NO: 370939 - protein, 10 aa, Influenza virus
YVRTNGTSKV

SEQ ID NO: 370940 - protein, 10 aa, Influenza virus
VRTNGTSKVK

SEQ ID NO: 370941 - protein, 10 aa, Influenza virus
RTNGTSKVKM

SEQ ID NO: 370942 - protein, 10 aa, Influenza virus
TNGTSKVKMK

SEQ ID NO: 370943 - protein, 10 aa, Influenza virus
NGTSKVKMKW

SEQ ID NO: 370944 - protein, 10 aa, Influenza virus
GTSKVKMKWG

SEQ ID NO: 370945 - protein, 10 aa, Influenza virus
TSKVKMKWGM

SEQ ID NO: 370946 - protein, 10 aa, Influenza virus
SKVKMKWGME

SEQ ID NO: 370947 - protein, 10 aa, Influenza virus
KVKMKWGMEM

SEQ ID NO: 370948 - protein, 10 aa, Influenza virus
VKMKWGMEMR

SEQ ID NO: 370949 - protein, 10 aa, Influenza virus
KMKWGMELRR

SEQ ID NO: 370950 - protein, 10 aa, Influenza virus
MKWGMELRRC

SEQ ID NO: 370951 - protein, 10 aa, Influenza virus
KWGMELRRCL

SEQ ID NO: 370952 - protein, 10 aa, Influenza virus
WGMELRRCLL

SEQ ID NO: 370953 - protein, 10 aa, Influenza virus
GMELRRCLLQ

SEQ ID NO: 370954 - protein, 10 aa, Influenza virus
MELRRCLLQS

SEQ ID NO: 370955 - protein, 10 aa, Influenza virus
ELRRCLLQSL

SEQ ID NO: 370956 - protein, 10 aa, Influenza virus
LRRCLLQSLQ

SEQ ID NO: 370957 - protein, 10 aa, Influenza virus
LQSLQQIESI

SEQ ID NO: 370958 - protein, 10 aa, Influenza virus
QSLQQIESMV

SEQ ID NO: 370959 - protein, 10 aa, Influenza virus
SLQQIESMVE

SEQ ID NO: 370960 - protein, 10 aa, Influenza virus
LQQIESMVEA

SEQ ID NO: 370961 - protein, 10 aa, Influenza virus
QQIESMVEAE

SEQ ID NO: 370962 - protein, 10 aa, Influenza virus
QIESMVEAES

SEQ ID NO: 370963 - protein, 10 aa, Influenza virus
IESMVEAESS

SEQ ID NO: 370964 - protein, 10 aa, Influenza virus
ESMIEAESSI

SEQ ID NO: 370965 - protein, 10 aa, Influenza virus
SMIEAESSIK

SEQ ID NO: 370966 - protein, 10 aa, Influenza virus
MIEAESSIKE

SEQ ID NO: 370967 - protein, 10 aa, Influenza virus
IEAESSIKEK

SEQ ID NO: 370968 - protein, 10 aa, Influenza virus
EAESSIKEKD

SEQ ID NO: 370969 - protein, 10 aa, Influenza virus
AESSIKEKDM

SEQ ID NO: 370970 - protein, 10 aa, Influenza virus
ESSIKEKDMT

SEQ ID NO: 370971 - protein, 10 aa, Influenza virus
SSIKEKDMTK

SEQ ID NO: 370972 - protein, 10 aa, Influenza virus
KEKDMTREFF

SEQ ID NO: 370973 - protein, 10 aa, Influenza virus
EKDMTREFFE

SEQ ID NO: 370974 - protein, 10 aa, Influenza virus
VEESSIGKVC

SEQ ID NO: 370975 - protein, 10 aa, Influenza virus
EESSIGKVCR

SEQ ID NO: 370976 - protein, 10 aa, Influenza virus
ESSIGKVCRT

SEQ ID NO: 370977 - protein, 10 aa, Influenza virus
SSIGKVCRTL

SEQ ID NO: 370978 - protein, 10 aa, Influenza virus
SIGKVCRALL

SEQ ID NO: 370979 - protein, 10 aa, Influenza virus
GKVCRALLAK

SEQ ID NO: 370980 - protein, 10 aa, Influenza virus
KVCRALLAKS

SEQ ID NO: 370981 - protein, 10 aa, Influenza virus
VCRALLAKSV

SEQ ID NO: 370982 - protein, 10 aa, Influenza virus
TLLAKSVFNC

SEQ ID NO: 370983 - protein, 10 aa, Influenza virus
LLAKSVFNCL

SEQ ID NO: 370984 - protein, 10 aa, Influenza virus
LAKSVFNCLY

SEQ ID NO: 370985 - protein, 10 aa, Influenza virus
AKSVFNCLYA

SEQ ID NO: 370986 - protein, 10 aa, Influenza virus
KSVFNCLYAS

SEQ ID NO: 370987 - protein, 10 aa, Influenza virus
SVFNSLYASS

SEQ ID NO: 370988 - protein, 10 aa, Influenza virus
FNSLYASSQL

SEQ ID NO: 370989 - protein, 10 aa, Influenza virus
NSLYASSQLE

SEQ ID NO: 370990 - protein, 10 aa, Influenza virus
SLYASSQLEG

SEQ ID NO: 370991 - protein, 10 aa, Influenza virus
LYASSQLEGF

SEQ ID NO: 370992 - protein, 10 aa, Influenza virus
YASSQLEGFS

SEQ ID NO: 370993 - protein, 10 aa, Influenza virus
ASSQLEGFSA

SEQ ID NO: 370994 - protein, 10 aa, Influenza virus
SSQLEGFSAE

SEQ ID NO: 370995 - protein, 10 aa, Influenza virus
SQLEGFSAES

SEQ ID NO: 370996 - protein, 10 aa, Influenza virus
EGFSAESRKM

SEQ ID NO: 370997 - protein, 10 aa, Influenza virus
GFSAESRKML

SEQ ID NO: 370998 - protein, 10 aa, Influenza virus
FSAESRKMLL

SEQ ID NO: 370999 - protein, 10 aa, Influenza virus
SAESRKLLLV

SEQ ID NO: 371000 - protein, 10 aa, Influenza virus
AESRKLLLVV

SEQ ID NO: 371001 - protein, 10 aa, Influenza virus
ESRKLLLVVQ

SEQ ID NO: 371002 - protein, 10 aa, Influenza virus
SRKLLLVVQA

SEQ ID NO: 371003 - protein, 10 aa, Influenza virus
QALRDSLEPG

SEQ ID NO: 371004 - protein, 10 aa, Influenza virus
ALRDSLEPGT

SEQ ID NO: 371005 - protein, 10 aa, Influenza virus
LRDSLEPGTF

SEQ ID NO: 371006 - protein, 10 aa, Influenza virus
RDSLEPGTFD

SEQ ID NO: 371007 - protein, 10 aa, Influenza virus
DNLEPGTFDI

SEQ ID NO: 371008 - protein, 10 aa, Influenza virus
LEPGTFDLEG

SEQ ID NO: 371009 - protein, 10 aa, Influenza virus
EPGTFDLEGL

SEQ ID NO: 371010 - protein, 10 aa, Influenza virus
PGTFDLEGLY

SEQ ID NO: 371011 - protein, 10 aa, Influenza virus
GLYESIEECL

SEQ ID NO: 371012 - protein, 10 aa, Influenza virus
LYESIEECLI

SEQ ID NO: 371013 - protein, 10 aa, Influenza virus
YESIEECLIN

SEQ ID NO: 371014 - protein, 10 aa, Influenza virus
ESIEECLIND

SEQ ID NO: 371015 - protein, 10 aa, Influenza virus
SIEECLINDP

SEQ ID NO: 371016 - protein, 10 aa, Influenza virus
VEECLINDPW

SEQ ID NO: 371017 - protein, 10 aa, Influenza virus
NASWFNSFLA

SEQ ID NO: 371018 - protein, 10 aa, Influenza virus
ASWFNSFLAH

SEQ ID NO: 371019 - protein, 10 aa, Influenza virus
NSFLTHALRF

SEQ ID NO: 371020 - protein, 10 aa, Influenza virus
SFLAHALKLV

SEQ ID NO: 371021 - protein, 10 aa, Influenza virus
FLAHALKLVV

SEQ ID NO: 371022 - protein, 10 aa, Influenza virus
LAHALKLVVA

SEQ ID NO: 371023 - protein, 10 aa, Influenza virus
AHALKLVVAM

SEQ ID NO: 371024 - protein, 10 aa, Influenza virus
HALKLVVAML

SEQ ID NO: 371025 - protein, 10 aa, Influenza virus
DVNPTLLFLE

SEQ ID NO: 371026 - protein, 10 aa, Influenza virus
VNPTLLFLKI

SEQ ID NO: 371027 - protein, 10 aa, Influenza virus
NPTLLFLKIP

SEQ ID NO: 371028 - protein, 10 aa, Influenza virus
PVQNAISTTF

SEQ ID NO: 371029 - protein, 10 aa, Influenza virus
VQNAISTTFP

SEQ ID NO: 371030 - protein, 10 aa, Influenza virus
GTGYTMDTVS

SEQ ID NO: 371031 - protein, 10 aa, Influenza virus
TGYTMDTVSR

SEQ ID NO: 371032 - protein, 10 aa, Influenza virus
GYTMDTVSRT

SEQ ID NO: 371033 - protein, 10 aa, Influenza virus
YTMDTVSRTH

SEQ ID NO: 371034 - protein, 10 aa, Influenza virus
TMDTVSRTHQ

SEQ ID NO: 371035 - protein, 10 aa, Influenza virus
MDTVSRTHQY

SEQ ID NO: 371036 - protein, 10 aa, Influenza virus
VNRTHQYSER

SEQ ID NO: 371037 - protein, 10 aa, Influenza virus
NRTHQYSERG

SEQ ID NO: 371038 - protein, 10 aa, Influenza virus
RTHQYSERGR

SEQ ID NO: 371039 - protein, 10 aa, Influenza virus
THQYSERGRW

SEQ ID NO: 371040 - protein, 10 aa, Influenza virus
SETGAPQLNP

SEQ ID NO: 371041 - protein, 10 aa, Influenza virus
EIGAPQLNPI

SEQ ID NO: 371042 - protein, 10 aa, Influenza virus
IGAPQLNPID

SEQ ID NO: 371043 - protein, 10 aa, Influenza virus
KAPQLNPIDG

SEQ ID NO: 371044 - protein, 10 aa, Influenza virus
ALQLNPIDGP

SEQ ID NO: 371045 - protein, 10 aa, Influenza virus
LQLNPIDGPL

SEQ ID NO: 371046 - protein, 10 aa, Influenza virus
LNPIDGPLPK

SEQ ID NO: 371047 - protein, 10 aa, Influenza virus
DNEPTGYAQT

SEQ ID NO: 371048 - protein, 10 aa, Influenza virus
NEPTGYAQTD

SEQ ID NO: 371049 - protein, 10 aa, Influenza virus
EPTGYAQTDC

SEQ ID NO: 371050 - protein, 10 aa, Influenza virus
PTGYAQTDCV

SEQ ID NO: 371051 - protein, 10 aa, Influenza virus
TGYAQTDCVL

SEQ ID NO: 371052 - protein, 10 aa, Influenza virus
TDCVLEAMAL

SEQ ID NO: 371053 - protein, 10 aa, Influenza virus
DCVLEAMALL

SEQ ID NO: 371054 - protein, 10 aa, Influenza virus
CVLEAMALLE

SEQ ID NO: 371055 - protein, 10 aa, Influenza virus
VLEAMAFLEK

SEQ ID NO: 371056 - protein, 10 aa, Influenza virus
LEAMAFLEKS

SEQ ID NO: 371057 - protein, 10 aa, Influenza virus
EAMAFLEKSH

SEQ ID NO: 371058 - protein, 10 aa, Influenza virus
AMAFLEKSHP

SEQ ID NO: 371059 - protein, 10 aa, Influenza virus
MAFLEKSHPG

SEQ ID NO: 371060 - protein, 10 aa, Influenza virus
LEKSHPGIFE

SEQ ID NO: 371061 - protein, 10 aa, Influenza virus
SHPGLFENSC

SEQ ID NO: 371062 - protein, 10 aa, Influenza virus
HPGIFENSCI

SEQ ID NO: 371063 - protein, 10 aa, Influenza virus
PGIFENSCIE

SEQ ID NO: 371064 - protein, 10 aa, Influenza virus
IQQTRVDKLT

SEQ ID NO: 371065 - protein, 10 aa, Influenza virus
QQTRVDRLTQ

SEQ ID NO: 371066 - protein, 10 aa, Influenza virus
QTRVDRLTQG

SEQ ID NO: 371067 - protein, 10 aa, Influenza virus
TRVDRLTQGR

SEQ ID NO: 371068 - protein, 10 aa, Influenza virus
RVDRLTQGRQ

SEQ ID NO: 371069 - protein, 10 aa, Influenza virus
VDRLTQGRQT

SEQ ID NO: 371070 - protein, 10 aa, Influenza virus
DKLTQGRQTF

SEQ ID NO: 371071 - protein, 10 aa, Influenza virus
KLTQGRQTFD

SEQ ID NO: 371072 - protein, 10 aa, Influenza virus
LTQGRQTFDW

SEQ ID NO: 371073 - protein, 10 aa, Influenza virus
TQGRQTFDWT

SEQ ID NO: 371074 - protein, 10 aa, Influenza virus
QGRQTFDWTL

SEQ ID NO: 371075 - protein, 10 aa, Influenza virus
GRQTFDWTLN

SEQ ID NO: 371076 - protein, 10 aa, Influenza virus
RQTFDWTLNR

SEQ ID NO: 371077 - protein, 10 aa, Influenza virus
QTFDWTLNRN

SEQ ID NO: 371078 - protein, 10 aa, Influenza virus
TFDWTLNRNQ

SEQ ID NO: 371079 - protein, 10 aa, Influenza virus
FDWTLNRNQP

SEQ ID NO: 371080 - protein, 10 aa, Influenza virus
ATALANTIEI

SEQ ID NO: 371081 - protein, 10 aa, Influenza virus
TALANTIEIF

SEQ ID NO: 371082 - protein, 10 aa, Influenza virus
ALANTIEIFR

SEQ ID NO: 371083 - protein, 10 aa, Influenza virus
LANTIEIFRS

SEQ ID NO: 371084 - protein, 10 aa, Influenza virus
ANTIEIFRSN

SEQ ID NO: 371085 - protein, 10 aa, Influenza virus
SESGRLIDFL

SEQ ID NO: 371086 - protein, 10 aa, Influenza virus
ESGRLMDFLK

SEQ ID NO: 371087 - protein, 10 aa, Influenza virus
SGRLMDFLKD

SEQ ID NO: 371088 - protein, 10 aa, Influenza virus
GRLMDFLKDV

SEQ ID NO: 371089 - protein, 10 aa, Influenza virus
RLIDFLKDVI

SEQ ID NO: 371090 - protein, 10 aa, Influenza virus
VTTHFQRKRR

SEQ ID NO: 371091 - protein, 10 aa, Influenza virus
VTHFQRKRRV

SEQ ID NO: 371092 - protein, 10 aa, Influenza virus
THFQRKRRIR

SEQ ID NO: 371093 - protein, 10 aa, Influenza virus
HFQRKRRIRD

SEQ ID NO: 371094 - protein, 10 aa, Influenza virus
FQRKRRIRDN

SEQ ID NO: 371095 - protein, 10 aa, Influenza virus
MITQRTIGKK

SEQ ID NO: 371096 - protein, 10 aa, Influenza virus
TQRTIGKKKH

SEQ ID NO: 371097 - protein, 10 aa, Influenza virus
GYLIRALTLN

SEQ ID NO: 371098 - protein, 10 aa, Influenza virus
YLIRTLTLNT

SEQ ID NO: 371099 - protein, 10 aa, Influenza virus
LIRTLTLNTM

SEQ ID NO: 371100 - protein, 10 aa, Influenza virus
IRTLTLNTMT

SEQ ID NO: 371101 - protein, 10 aa, Influenza virus
RTLTLNTMTK

SEQ ID NO: 371102 - protein, 10 aa, Influenza virus
TLTLNTMTKD

SEQ ID NO: 371103 - protein, 10 aa, Influenza virus
PGMQIRGFVH

SEQ ID NO: 371104 - protein, 10 aa, Influenza virus
GMQIRGFVHF

SEQ ID NO: 371105 - protein, 10 aa, Influenza virus
MQIRGFVHFV

SEQ ID NO: 371106 - protein, 10 aa, Influenza virus
QIRGFVHFVE

SEQ ID NO: 371107 - protein, 10 aa, Influenza virus
IRGFVYFVEA

SEQ ID NO: 371108 - protein, 10 aa, Influenza virus
RGFVYFVEAL

SEQ ID NO: 371109 - protein, 10 aa, Influenza virus
GFVYFVEALA

SEQ ID NO: 371110 - protein, 10 aa, Influenza virus
LARRICEKLE

SEQ ID NO: 371111 - protein, 10 aa, Influenza virus
ARRICEKLEQ

SEQ ID NO: 371112 - protein, 10 aa, Influenza virus
RRICEKLEQS

SEQ ID NO: 371113 - protein, 10 aa, Influenza virus
RICEKLEQSG

SEQ ID NO: 371114 - protein, 10 aa, Influenza virus
ANVVRKMMTS

SEQ ID NO: 371115 - protein, 10 aa, Influenza virus
NVVRKMMTSS

SEQ ID NO: 371116 - protein, 10 aa, Influenza virus
VVRKMMTSSQ

SEQ ID NO: 371117 - protein, 10 aa, Influenza virus
VRKMMTSSQD

SEQ ID NO: 371118 - protein, 10 aa, Influenza virus
RKMMTSSQDT

SEQ ID NO: 371119 - protein, 10 aa, Influenza virus
KMMTSSQDTE

SEQ ID NO: 371120 - protein, 10 aa, Influenza virus
NSQDTEISFT

SEQ ID NO: 371121 - protein, 10 aa, Influenza virus
SQDTEISFTI

SEQ ID NO: 371122 - protein, 10 aa, Influenza virus
QDTEISFTIT

SEQ ID NO: 371123 - protein, 10 aa, Influenza virus
DTEISFTITG

SEQ ID NO: 371124 - protein, 10 aa, Influenza virus
TEISFTITGD

SEQ ID NO: 371125 - protein, 10 aa, Influenza virus
EISFTITGDN

SEQ ID NO: 371126 - protein, 10 aa, Influenza virus
ISFTITGDNT

SEQ ID NO: 371127 - protein, 10 aa, Influenza virus
KWNENQNPRV

SEQ ID NO: 371128 - protein, 10 aa, Influenza virus
WNENQNPRVF

SEQ ID NO: 371129 - protein, 10 aa, Influenza virus
NENQNPRVFL

SEQ ID NO: 371130 - protein, 10 aa, Influenza virus
ENQNPRIFLA

SEQ ID NO: 371131 - protein, 10 aa, Influenza virus
NQNPRIFLAM

SEQ ID NO: 371132 - protein, 10 aa, Influenza virus
QNPRIFLAMI

SEQ ID NO: 371133 - protein, 10 aa, Influenza virus
NPRIFLAMIT

SEQ ID NO: 371134 - protein, 10 aa, Influenza virus
PRIFLAMITY

SEQ ID NO: 371135 - protein, 10 aa, Influenza virus
RIFLAMITYI

SEQ ID NO: 371136 - protein, 10 aa, Influenza virus
IFLAMITYIT

SEQ ID NO: 371137 - protein, 10 aa, Influenza virus
FLAMITYITK

SEQ ID NO: 371138 - protein, 10 aa, Influenza virus
QPEWFRNVLS

SEQ ID NO: 371139 - protein, 10 aa, Influenza virus
WFRNILSMAP

SEQ ID NO: 371140 - protein, 10 aa, Influenza virus
FRNILSMAPI

SEQ ID NO: 371141 - protein, 10 aa, Influenza virus
RNILSMAPIM

SEQ ID NO: 371142 - protein, 10 aa, Influenza virus
NILSMAPIMF

SEQ ID NO: 371143 - protein, 10 aa, Influenza virus
ILSMAPIMFS

SEQ ID NO: 371144 - protein, 10 aa, Influenza virus
LSMAPIMFSN

SEQ ID NO: 371145 - protein, 10 aa, Influenza virus
SMAPIMFSNK

SEQ ID NO: 371146 - protein, 10 aa, Influenza virus
MAPIMFSNKM

SEQ ID NO: 371147 - protein, 10 aa, Influenza virus
PIMFSNKVAR

SEQ ID NO: 371148 - protein, 10 aa, Influenza virus
IMFSNKVARL

SEQ ID NO: 371149 - protein, 10 aa, Influenza virus
MFSNKVARLG

SEQ ID NO: 371150 - protein, 10 aa, Influenza virus
FSNKMARLGR

SEQ ID NO: 371151 - protein, 10 aa, Influenza virus
SNKMARLGRG

SEQ ID NO: 371152 - protein, 10 aa, Influenza virus
NKMARLGRGY

SEQ ID NO: 371153 - protein, 10 aa, Influenza virus
KMARLGRGYM

SEQ ID NO: 371154 - protein, 10 aa, Influenza virus
MARLGRGYMF

SEQ ID NO: 371155 - protein, 10 aa, Influenza virus
ARLGRGYMFE

SEQ ID NO: 371156 - protein, 10 aa, Influenza virus
RLGRGYMFES

SEQ ID NO: 371157 - protein, 10 aa, Influenza virus
LGRGYMFESK

SEQ ID NO: 371158 - protein, 10 aa, Influenza virus
GAASLSPGMM

SEQ ID NO: 371159 - protein, 10 aa, Influenza virus
AASLSPGMMM

SEQ ID NO: 371160 - protein, 10 aa, Influenza virus
VSLSPGMMMG

SEQ ID NO: 371161 - protein, 10 aa, Influenza virus
STVLGVSVLN

SEQ ID NO: 371162 - protein, 10 aa, Influenza virus
TVLGVSVLNL

SEQ ID NO: 371163 - protein, 10 aa, Influenza virus
VLGVSVLNLG

SEQ ID NO: 371164 - protein, 10 aa, Influenza virus
LGVSVLNLGQ

SEQ ID NO: 371165 - protein, 10 aa, Influenza virus
GVSILNLGQR

SEQ ID NO: 371166 - protein, 10 aa, Influenza virus
TIYWWDGLQS

SEQ ID NO: 371167 - protein, 10 aa, Influenza virus
IYWWDGLQSS

SEQ ID NO: 371168 - protein, 10 aa, Influenza virus
QSSDDFALIL

SEQ ID NO: 371169 - protein, 10 aa, Influenza virus
SSDDFALILN

SEQ ID NO: 371170 - protein, 10 aa, Influenza virus
SDDFALILNA

SEQ ID NO: 371171 - protein, 10 aa, Influenza virus
DDFALIVNAS

SEQ ID NO: 371172 - protein, 10 aa, Influenza virus
GIQAGVNRFY

SEQ ID NO: 371173 - protein, 10 aa, Influenza virus
IQAGVNRFYR

SEQ ID NO: 371174 - protein, 10 aa, Influenza virus
QAGVDRFYRI

SEQ ID NO: 371175 - protein, 10 aa, Influenza virus
AGVDRFYRIC

SEQ ID NO: 371176 - protein, 10 aa, Influenza virus
GVDRFYRICK

SEQ ID NO: 371177 - protein, 10 aa, Influenza virus
VDRFYRICKL

SEQ ID NO: 371178 - protein, 10 aa, Influenza virus
DRFYRTCKLL

SEQ ID NO: 371179 - protein, 10 aa, Influenza virus
RFYRTCKLLG

SEQ ID NO: 371180 - protein, 10 aa, Influenza virus
FYRTCKLLGI

SEQ ID NO: 371181 - protein, 10 aa, Influenza virus
YRTCKLLGIN

SEQ ID NO: 371182 - protein, 10 aa, Influenza virus
RTCKLLGINM

SEQ ID NO: 371183 - protein, 10 aa, Influenza virus
TCKLLGINMS

SEQ ID NO: 371184 - protein, 10 aa, Influenza virus
CKLLGINMSK

SEQ ID NO: 371185 - protein, 10 aa, Influenza virus
KLLGINMSKK

SEQ ID NO: 371186 - protein, 10 aa, Influenza virus
LLGINMSKKK

SEQ ID NO: 371187 - protein, 10 aa, Influenza virus
LGINMSKKKS

SEQ ID NO: 371188 - protein, 10 aa, Influenza virus
INMSKRKSYI

SEQ ID NO: 371189 - protein, 10 aa, Influenza virus
NMSKRKSYIN

SEQ ID NO: 371190 - protein, 10 aa, Influenza virus
MSKKKSYINK

SEQ ID NO: 371191 - protein, 10 aa, Influenza virus
SKKKSYINKT

SEQ ID NO: 371192 - protein, 10 aa, Influenza virus
KKKSYINKTG

SEQ ID NO: 371193 - protein, 10 aa, Influenza virus
KKSYINKTGT

SEQ ID NO: 371194 - protein, 10 aa, Influenza virus
KSYINKTGTF

SEQ ID NO: 371195 - protein, 10 aa, Influenza virus
SYINKTGTFE

SEQ ID NO: 371196 - protein, 10 aa, Influenza virus
YINKTGTFEF

SEQ ID NO: 371197 - protein, 10 aa, Influenza virus
INKTGTFEFT

SEQ ID NO: 371198 - protein, 10 aa, Influenza virus
NKTGTFEFTS

SEQ ID NO: 371199 - protein, 10 aa, Influenza virus
KTGTFEFTSF

SEQ ID NO: 371200 - protein, 10 aa, Influenza virus
ELPSFGVSGV

SEQ ID NO: 371201 - protein, 10 aa, Influenza virus
LPSFGVSGVN

SEQ ID NO: 371202 - protein, 10 aa, Influenza virus
PSFGVSGVNE

SEQ ID NO: 371203 - protein, 10 aa, Influenza virus
SFGVSGVNES

SEQ ID NO: 371204 - protein, 10 aa, Influenza virus
FGVSGVNESA

SEQ ID NO: 371205 - protein, 10 aa, Influenza virus
GVSGVNESAD

SEQ ID NO: 371206 - protein, 10 aa, Influenza virus
VSGVNESADM

SEQ ID NO: 371207 - protein, 10 aa, Influenza virus
SGVNESADMS

SEQ ID NO: 371208 - protein, 10 aa, Influenza virus
GVNESADMSI

SEQ ID NO: 371209 - protein, 10 aa, Influenza virus
VNESADMSIG

SEQ ID NO: 371210 - protein, 10 aa, Influenza virus
NESADMSIGI

SEQ ID NO: 371211 - protein, 10 aa, Influenza virus
ESADMSIGIT

SEQ ID NO: 371212 - protein, 10 aa, Influenza virus
SADMSIGITV

SEQ ID NO: 371213 - protein, 10 aa, Influenza virus
ADMSIGITVI

SEQ ID NO: 371214 - protein, 10 aa, Influenza virus
DMSIGITVIK

SEQ ID NO: 371215 - protein, 10 aa, Influenza virus
MSIGITVIKN

SEQ ID NO: 371216 - protein, 10 aa, Influenza virus
SIGITVIKNN

SEQ ID NO: 371217 - protein, 10 aa, Influenza virus
IGITVIKNNM

SEQ ID NO: 371218 - protein, 10 aa, Influenza virus
GITVIKNNMI

SEQ ID NO: 371219 - protein, 10 aa, Influenza virus
ITVIKNNMIN

SEQ ID NO: 371220 - protein, 10 aa, Influenza virus
TVIRNNMINN

SEQ ID NO: 371221 - protein, 10 aa, Influenza virus
VIRNNMINND

SEQ ID NO: 371222 - protein, 10 aa, Influenza virus
IRNNMINNDL

SEQ ID NO: 371223 - protein, 10 aa, Influenza virus
RNNMINNDLG

SEQ ID NO: 371224 - protein, 10 aa, Influenza virus
DYRYTYRCHK

SEQ ID NO: 371225 - protein, 10 aa, Influenza virus
YRYTYRCHKG

SEQ ID NO: 371226 - protein, 10 aa, Influenza virus
RYTYRCHKGD

SEQ ID NO: 371227 - protein, 10 aa, Influenza virus
YTYRCHKGDT

SEQ ID NO: 371228 - protein, 10 aa, Influenza virus
TYRCHKGDTQ

SEQ ID NO: 371229 - protein, 10 aa, Influenza virus
YRCHKGDTQI

SEQ ID NO: 371230 - protein, 10 aa, Influenza virus
GLLISDGGPN

SEQ ID NO: 371231 - protein, 10 aa, Influenza virus
LLISDGGPNL

SEQ ID NO: 371232 - protein, 10 aa, Influenza virus
LISDGGPNLY

SEQ ID NO: 371233 - protein, 10 aa, Influenza virus
ISDGGPNLYN

SEQ ID NO: 371234 - protein, 10 aa, Influenza virus
ADGGPNLYNI

SEQ ID NO: 371235 - protein, 10 aa, Influenza virus
NIRNLHIPEA

SEQ ID NO: 371236 - protein, 10 aa, Influenza virus
IRNLHIPEAG

SEQ ID NO: 371237 - protein, 10 aa, Influenza virus
RNLHIPEAGL

SEQ ID NO: 371238 - protein, 10 aa, Influenza virus
NLHIPEAGLK

SEQ ID NO: 371239 - protein, 10 aa, Influenza virus
LHIPEAGLKW

SEQ ID NO: 371240 - protein, 10 aa, Influenza virus
HIPEVCLKWD

SEQ ID NO: 371241 - protein, 10 aa, Influenza virus
IPEVCLKWDL

SEQ ID NO: 371242 - protein, 10 aa, Influenza virus
PEVCLKWDLM

SEQ ID NO: 371243 - protein, 10 aa, Influenza virus
EVCLKWDLMD

SEQ ID NO: 371244 - protein, 10 aa, Influenza virus
YRGRLCNPLN

SEQ ID NO: 371245 - protein, 10 aa, Influenza virus
RGRLCNPLNP

SEQ ID NO: 371246 - protein, 10 aa, Influenza virus
GRLCNPMNPF

SEQ ID NO: 371247 - protein, 10 aa, Influenza virus
RLCNPMNPFV

SEQ ID NO: 371248 - protein, 10 aa, Influenza virus
LCNPLNPFVN

SEQ ID NO: 371249 - protein, 10 aa, Influenza virus
CNPLNPFVNH

SEQ ID NO: 371250 - protein, 10 aa, Influenza virus
IEYDAVATTH

SEQ ID NO: 371251 - protein, 10 aa, Influenza virus
DAVATTHSWV

SEQ ID NO: 371252 - protein, 10 aa, Influenza virus
AVATTHSWVP

SEQ ID NO: 371253 - protein, 10 aa, Influenza virus
VATTHSWVPK

SEQ ID NO: 371254 - protein, 10 aa, Influenza virus
ATTHSWVPKR

SEQ ID NO: 371255 - protein, 10 aa, Influenza virus
TTHSWVPKRN

SEQ ID NO: 371256 - protein, 10 aa, Influenza virus
THSWVPKRNR

SEQ ID NO: 371257 - protein, 10 aa, Influenza virus
HSWVPKRNRS

SEQ ID NO: 371258 - protein, 10 aa, Influenza virus
SWVPKRNRSI

SEQ ID NO: 371259 - protein, 10 aa, Influenza virus
WVPKRNRSIL

SEQ ID NO: 371260 - protein, 10 aa, Influenza virus
VPKRNRSILN

SEQ ID NO: 371261 - protein, 10 aa, Influenza virus
SILNTSQRGV

SEQ ID NO: 371262 - protein, 10 aa, Influenza virus
ILNTSQRGVL

SEQ ID NO: 371263 - protein, 10 aa, Influenza virus
LNTSQRGVLE

SEQ ID NO: 371264 - protein, 10 aa, Influenza virus
NTSQRGVLED

SEQ ID NO: 371265 - protein, 10 aa, Influenza virus
TSQRGVLEDE

SEQ ID NO: 371266 - protein, 10 aa, Influenza virus
SQRGVLEDEQ

SEQ ID NO: 371267 - protein, 10 aa, Influenza virus
QRGVLEDEQM

SEQ ID NO: 371268 - protein, 10 aa, Influenza virus
RGVLEDEQMY

SEQ ID NO: 371269 - protein, 10 aa, Influenza virus
GVLEDEQMYQ

SEQ ID NO: 371270 - protein, 10 aa, Influenza virus
ILEDEQMYQR

SEQ ID NO: 371271 - protein, 10 aa, Influenza virus
LEDEQMYQRC

SEQ ID NO: 371272 - protein, 10 aa, Influenza virus
EDEQMYQRCC

SEQ ID NO: 371273 - protein, 10 aa, Influenza virus
DEQMYQRCCN

SEQ ID NO: 371274 - protein, 10 aa, Influenza virus
EQMYQRCCNL

SEQ ID NO: 371275 - protein, 10 aa, Influenza virus
QMYQRCCNLF

SEQ ID NO: 371276 - protein, 10 aa, Influenza virus
MYQRCCNLFE

SEQ ID NO: 371277 - protein, 10 aa, Influenza virus
YQRCCNLFEK

SEQ ID NO: 371278 - protein, 10 aa, Influenza virus
QRCCNLFEKF

SEQ ID NO: 371279 - protein, 10 aa, Influenza virus
RCCNLFEKFF

SEQ ID NO: 371280 - protein, 10 aa, Influenza virus
CCSLFEKFFP

SEQ ID NO: 371281 - protein, 10 aa, Influenza virus
CSLFEKFFPS

SEQ ID NO: 371282 - protein, 10 aa, Influenza virus
SLFEKFFPSS

SEQ ID NO: 371283 - protein, 10 aa, Influenza virus
FPSSSYRRPI

SEQ ID NO: 371284 - protein, 10 aa, Influenza virus
PSSSYRRPIG

SEQ ID NO: 371285 - protein, 10 aa, Influenza virus
SSSYRRPIGI

SEQ ID NO: 371286 - protein, 10 aa, Influenza virus
SSYRRPIGIS

SEQ ID NO: 371287 - protein, 10 aa, Influenza virus
SYRRPIGISS

SEQ ID NO: 371288 - protein, 10 aa, Influenza virus
YRRPIGISSM

SEQ ID NO: 371289 - protein, 10 aa, Influenza virus
RRPIGISSMV

SEQ ID NO: 371290 - protein, 10 aa, Influenza virus
RPIGISSMVE

SEQ ID NO: 371291 - protein, 10 aa, Influenza virus
PIGISSMVEA

SEQ ID NO: 371292 - protein, 10 aa, Influenza virus
IGISSMVEAM

SEQ ID NO: 371293 - protein, 10 aa, Influenza virus
GISSMMEAMV

SEQ ID NO: 371294 - protein, 10 aa, Influenza virus
ISSMMEAMVS

SEQ ID NO: 371295 - protein, 10 aa, Influenza virus
SSMMEAMVSR

SEQ ID NO: 371296 - protein, 10 aa, Influenza virus
SMMEAMVSRA

SEQ ID NO: 371297 - protein, 10 aa, Influenza virus
MMEAMVSRAR

SEQ ID NO: 371298 - protein, 10 aa, Influenza virus
MEAMVSRARI

SEQ ID NO: 371299 - protein, 10 aa, Influenza virus
EAMISRARID

SEQ ID NO: 371300 - protein, 10 aa, Influenza virus
AMISRARIDA

SEQ ID NO: 371301 - protein, 10 aa, Influenza virus
MISRARIDAR

SEQ ID NO: 371302 - protein, 10 aa, Influenza virus
VSRARIDARV

SEQ ID NO: 371303 - protein, 10 aa, Influenza virus
SRARIDARVD

SEQ ID NO: 371304 - protein, 10 aa, Influenza virus
RARIDARVDF

SEQ ID NO: 371305 - protein, 10 aa, Influenza virus
ARIDARVDFE

SEQ ID NO: 371306 - protein, 10 aa, Influenza virus
RIDARVDFES

SEQ ID NO: 371307 - protein, 10 aa, Influenza virus
IDARVDFESG

SEQ ID NO: 371308 - protein, 10 aa, Influenza virus
DARVDFESGR

SEQ ID NO: 371309 - protein, 10 aa, Influenza virus
ARVDFESGRI

SEQ ID NO: 371310 - protein, 10 aa, Influenza virus
GKKEFSEIMK

SEQ ID NO: 371311 - protein, 10 aa, Influenza virus
IEELRRQKWW

SEQ ID NO: 371312 - protein, 10 aa, Influenza virus
EELRRQKSLI

SEQ ID NO: 371313 - protein, 10 aa, Influenza virus
ELRRQKSLIW

SEQ ID NO: 371314 - protein, 10 aa, Influenza virus
LRRQKSLIWL

SEQ ID NO: 371315 - protein, 10 aa, Influenza virus
RRQKSLIWLW

SEQ ID NO: 371316 - protein, 10 aa, Influenza virus
RQKSLIWLWL

SEQ ID NO: 371317 - protein, 10 aa, Influenza virus
QKSLIWLWLV

SEQ ID NO: 371318 - protein, 10 aa, Influenza virus
KWWVWLWLVL

SEQ ID NO: 371319 - protein, 10 aa, Influenza virus
SLIWLWLVLR

SEQ ID NO: 371320 - protein, 10 aa, Influenza virus
WVWLWLVLRE

SEQ ID NO: 371321 - protein, 10 aa, Influenza virus
VWLWLVLREK

SEQ ID NO: 371322 - protein, 10 aa, Influenza virus
SESRSNIFNM

SEQ ID NO: 371323 - protein, 10 aa, Influenza virus
ESRSNIFNME

SEQ ID NO: 371324 - protein, 10 aa, Influenza virus
SRSIIFNMER

SEQ ID NO: 371325 - protein, 10 aa, Influenza virus
RSIIFNMERI

SEQ ID NO: 371326 - protein, 10 aa, Influenza virus
SIIFNMERIK

SEQ ID NO: 371327 - protein, 10 aa, Influenza virus
IIFNMERIKE

SEQ ID NO: 371328 - protein, 10 aa, Influenza virus
NMERIKELRY

SEQ ID NO: 371329 - protein, 10 aa, Influenza virus
LMLQSRTREI

SEQ ID NO: 371330 - protein, 10 aa, Influenza virus
MLQSRTREIL

SEQ ID NO: 371331 - protein, 10 aa, Influenza virus
LQSRTREILT

SEQ ID NO: 371332 - protein, 10 aa, Influenza virus
QSRTREILTR

SEQ ID NO: 371333 - protein, 10 aa, Influenza virus
SRTREILTRT

SEQ ID NO: 371334 - protein, 10 aa, Influenza virus
RTREILTRTT

SEQ ID NO: 371335 - protein, 10 aa, Influenza virus
TREILTRTTV

SEQ ID NO: 371336 - protein, 10 aa, Influenza virus
REILTRTTVD

SEQ ID NO: 371337 - protein, 10 aa, Influenza virus
EILTRTTVDH

SEQ ID NO: 371338 - protein, 10 aa, Influenza virus
ILTRTTVDHM

SEQ ID NO: 371339 - protein, 10 aa, Influenza virus
LTRTTVDHMA

SEQ ID NO: 371340 - protein, 10 aa, Influenza virus
TRTTVDHMAI

SEQ ID NO: 371341 - protein, 10 aa, Influenza virus
RTTVDHMAII

SEQ ID NO: 371342 - protein, 10 aa, Influenza virus
ITVDHMAIIK

SEQ ID NO: 371343 - protein, 10 aa, Influenza virus
HMAIIKRYTS

SEQ ID NO: 371344 - protein, 10 aa, Influenza virus
MAIIKKYTSA

SEQ ID NO: 371345 - protein, 10 aa, Influenza virus
AIIKKYTSAR

SEQ ID NO: 371346 - protein, 10 aa, Influenza virus
IIKKYTSARQ

SEQ ID NO: 371347 - protein, 10 aa, Influenza virus
IKKYTSARQE

SEQ ID NO: 371348 - protein, 10 aa, Influenza virus
KKYTSARQEK

SEQ ID NO: 371349 - protein, 10 aa, Influenza virus
KYTSARQEKN

SEQ ID NO: 371350 - protein, 10 aa, Influenza virus
YTSARQEKNP

SEQ ID NO: 371351 - protein, 10 aa, Influenza virus
TSGRQEKNPS

SEQ ID NO: 371352 - protein, 10 aa, Influenza virus
SGRQEKNPSL

SEQ ID NO: 371353 - protein, 10 aa, Influenza virus
GRQEKNPSLR

SEQ ID NO: 371354 - protein, 10 aa, Influenza virus
RQEKNPSLRM

SEQ ID NO: 371355 - protein, 10 aa, Influenza virus
QEKNPSLRMK

SEQ ID NO: 371356 - protein, 10 aa, Influenza virus
EKNPSLRMKW

SEQ ID NO: 371357 - protein, 10 aa, Influenza virus
KNPSLRMKWM

SEQ ID NO: 371358 - protein, 10 aa, Influenza virus
NPSLRMKWMM

SEQ ID NO: 371359 - protein, 10 aa, Influenza virus
PSLRMKWMMA

SEQ ID NO: 371360 - protein, 10 aa, Influenza virus
SLRMKWMMAM

SEQ ID NO: 371361 - protein, 10 aa, Influenza virus
LRMKWMMAMR

SEQ ID NO: 371362 - protein, 10 aa, Influenza virus
RMKWMMAMRY

SEQ ID NO: 371363 - protein, 10 aa, Influenza virus
MKWMMAMRYP

SEQ ID NO: 371364 - protein, 10 aa, Influenza virus
KWMMAMRYPI

SEQ ID NO: 371365 - protein, 10 aa, Influenza virus
WMMAMRYPIT

SEQ ID NO: 371366 - protein, 10 aa, Influenza virus
MMAMRYPITA

SEQ ID NO: 371367 - protein, 10 aa, Influenza virus
MAMRYPITAD

SEQ ID NO: 371368 - protein, 10 aa, Influenza virus
MISPLAVTWW

SEQ ID NO: 371369 - protein, 10 aa, Influenza virus
ISPLAVTWWN

SEQ ID NO: 371370 - protein, 10 aa, Influenza virus
PLAVTWWNRK

SEQ ID NO: 371371 - protein, 10 aa, Influenza virus
LAVTWWNRKG

SEQ ID NO: 371372 - protein, 10 aa, Influenza virus
AVTWWNRKGP

SEQ ID NO: 371373 - protein, 10 aa, Influenza virus
HYPKIYKTYF

SEQ ID NO: 371374 - protein, 10 aa, Influenza virus
GTFGPVHFQN

SEQ ID NO: 371375 - protein, 10 aa, Influenza virus
TFGPVHFQNQ

SEQ ID NO: 371376 - protein, 10 aa, Influenza virus
FGPVHFRNQI

SEQ ID NO: 371377 - protein, 10 aa, Influenza virus
GPVHFRNQIK

SEQ ID NO: 371378 - protein, 10 aa, Influenza virus
PVHFRNQIKI

SEQ ID NO: 371379 - protein, 10 aa, Influenza virus
VHFRNQIKIR

SEQ ID NO: 371380 - protein, 10 aa, Influenza virus
HFRNQIKIRR

SEQ ID NO: 371381 - protein, 10 aa, Influenza virus
FRNQIKIRRR

SEQ ID NO: 371382 - protein, 10 aa, Influenza virus
RNQIKIRRRV

SEQ ID NO: 371383 - protein, 10 aa, Influenza virus
NQIKIRRRVD

SEQ ID NO: 371384 - protein, 10 aa, Influenza virus
QVKIRRRVDT

SEQ ID NO: 371385 - protein, 10 aa, Influenza virus
VKIRRRVDTN

SEQ ID NO: 371386 - protein, 10 aa, Influenza virus
KIRRRVDTNP

SEQ ID NO: 371387 - protein, 10 aa, Influenza virus
IRRRVDTNPG

SEQ ID NO: 371388 - protein, 10 aa, Influenza virus
RRRVDTNPGH

SEQ ID NO: 371389 - protein, 10 aa, Influenza virus
RRVDTNPGHA

SEQ ID NO: 371390 - protein, 10 aa, Influenza virus
RVDTNPGHAD

SEQ ID NO: 371391 - protein, 10 aa, Influenza virus
SKEAQDVIME

SEQ ID NO: 371392 - protein, 10 aa, Influenza virus
VVFPNEVGAK

SEQ ID NO: 371393 - protein, 10 aa, Influenza virus
VFPNEVGAKI

SEQ ID NO: 371394 - protein, 10 aa, Influenza virus
FPNEVGAKIL

SEQ ID NO: 371395 - protein, 10 aa, Influenza virus
PNEVGAKILT

SEQ ID NO: 371396 - protein, 10 aa, Influenza virus
NEVGAKILTS

SEQ ID NO: 371397 - protein, 10 aa, Influenza virus
EVGAKILTSE

SEQ ID NO: 371398 - protein, 10 aa, Influenza virus
VGAKILTSES

SEQ ID NO: 371399 - protein, 10 aa, Influenza virus
GAKILTSESQ

SEQ ID NO: 371400 - protein, 10 aa, Influenza virus
AKILTSESQL

SEQ ID NO: 371401 - protein, 10 aa, Influenza virus
ISPLMVAYML

SEQ ID NO: 371402 - protein, 10 aa, Influenza virus
SPLMVAYMLE

SEQ ID NO: 371403 - protein, 10 aa, Influenza virus
MMAYMLEREL

SEQ ID NO: 371404 - protein, 10 aa, Influenza virus
VRKTRFLPVS

SEQ ID NO: 371405 - protein, 10 aa, Influenza virus
RKTRFLPVSG

SEQ ID NO: 371406 - protein, 10 aa, Influenza virus
KTRFLPVSGG

SEQ ID NO: 371407 - protein, 10 aa, Influenza virus
TRFLPVSGGT

SEQ ID NO: 371408 - protein, 10 aa, Influenza virus
RFLPVAGGTG

SEQ ID NO: 371409 - protein, 10 aa, Influenza virus
FLPVAGGTGS

SEQ ID NO: 371410 - protein, 10 aa, Influenza virus
GGTGSVYIEV

SEQ ID NO: 371411 - protein, 10 aa, Influenza virus
GTGSVYIEVL

SEQ ID NO: 371412 - protein, 10 aa, Influenza virus
TGSVYIEVLH

SEQ ID NO: 371413 - protein, 10 aa, Influenza virus
GSVYIEVLHL

SEQ ID NO: 371414 - protein, 10 aa, Influenza virus
SIYIEVLHLT

SEQ ID NO: 371415 - protein, 10 aa, Influenza virus
IYIEVLHLTQ

SEQ ID NO: 371416 - protein, 10 aa, Influenza virus
YVEVLHLTQG

SEQ ID NO: 371417 - protein, 10 aa, Influenza virus
IEVLHLTQGA

SEQ ID NO: 371418 - protein, 10 aa, Influenza virus
EVLHLTQGAC

SEQ ID NO: 371419 - protein, 10 aa, Influenza virus
VLHLTQGACW

SEQ ID NO: 371420 - protein, 10 aa, Influenza virus
LHLTQGACWE

SEQ ID NO: 371421 - protein, 10 aa, Influenza virus
HLTQGACWEQ

SEQ ID NO: 371422 - protein, 10 aa, Influenza virus
LTQGACWEQL

SEQ ID NO: 371423 - protein, 10 aa, Influenza virus
TQGACWEQLY

SEQ ID NO: 371424 - protein, 10 aa, Influenza virus
QGACWEQLYT

SEQ ID NO: 371425 - protein, 10 aa, Influenza virus
GACWEQLYTP

SEQ ID NO: 371426 - protein, 10 aa, Influenza virus
ACWEQLYTPG

SEQ ID NO: 371427 - protein, 10 aa, Influenza virus
CWEQLYTPGG

SEQ ID NO: 371428 - protein, 10 aa, Influenza virus
WEQMYTPGGG

SEQ ID NO: 371429 - protein, 10 aa, Influenza virus
EQMYTPGGGV

SEQ ID NO: 371430 - protein, 10 aa, Influenza virus
YTPGGGVRND

SEQ ID NO: 371431 - protein, 10 aa, Influenza virus
VRNDDIDQSL

SEQ ID NO: 371432 - protein, 10 aa, Influenza virus
NDDIDQSLII

SEQ ID NO: 371433 - protein, 10 aa, Influenza virus
DDIDQSLIIA

SEQ ID NO: 371434 - protein, 10 aa, Influenza virus
DIDQSLIIAA

SEQ ID NO: 371435 - protein, 10 aa, Influenza virus
IDQSLIIAAR

SEQ ID NO: 371436 - protein, 10 aa, Influenza virus
DQSLIIAARS

SEQ ID NO: 371437 - protein, 10 aa, Influenza virus
QSLIIAARSI

SEQ ID NO: 371438 - protein, 10 aa, Influenza virus
SLIIAARSIV

SEQ ID NO: 371439 - protein, 10 aa, Influenza virus
LIIAARSIVR

SEQ ID NO: 371440 - protein, 10 aa, Influenza virus
IIAARSIVRR

SEQ ID NO: 371441 - protein, 10 aa, Influenza virus
IAARSIVRRA

SEQ ID NO: 371442 - protein, 10 aa, Influenza virus
AARNIVRRAT

SEQ ID NO: 371443 - protein, 10 aa, Influenza virus
ARNIVRRATV

SEQ ID NO: 371444 - protein, 10 aa, Influenza virus
RNIVRRATVS

SEQ ID NO: 371445 - protein, 10 aa, Influenza virus
NIVRRATVSA

SEQ ID NO: 371446 - protein, 10 aa, Influenza virus
IVRRATVSAD

SEQ ID NO: 371447 - protein, 10 aa, Influenza virus
VRRATVSADP

SEQ ID NO: 371448 - protein, 10 aa, Influenza virus
RRATVSADPL

SEQ ID NO: 371449 - protein, 10 aa, Influenza virus
RATVSADPLA

SEQ ID NO: 371450 - protein, 10 aa, Influenza virus
ATVSADPLAS

SEQ ID NO: 371451 - protein, 10 aa, Influenza virus
TVSADPLASL

SEQ ID NO: 371452 - protein, 10 aa, Influenza virus
VSADPLLSLL

SEQ ID NO: 371453 - protein, 10 aa, Influenza virus
SADPLLSLLE

SEQ ID NO: 371454 - protein, 10 aa, Influenza virus
ADPLLSLLEM

SEQ ID NO: 371455 - protein, 10 aa, Influenza virus
DPLLSLLEMC

SEQ ID NO: 371456 - protein, 10 aa, Influenza virus
PLLSLLEMCH

SEQ ID NO: 371457 - protein, 10 aa, Influenza virus
LASLLEMCHG

SEQ ID NO: 371458 - protein, 10 aa, Influenza virus
LSLLEMCHST

SEQ ID NO: 371459 - protein, 10 aa, Influenza virus
SLLEMCHSTR

SEQ ID NO: 371460 - protein, 10 aa, Influenza virus
LLEMCHSTRI

SEQ ID NO: 371461 - protein, 10 aa, Influenza virus
LEMCHSTRIG

SEQ ID NO: 371462 - protein, 10 aa, Influenza virus
EMCHSTRIGG

SEQ ID NO: 371463 - protein, 10 aa, Influenza virus
DILKQNPTEE

SEQ ID NO: 371464 - protein, 10 aa, Influenza virus
ILKQNPTEEQ

SEQ ID NO: 371465 - protein, 10 aa, Influenza virus
LKQNPTEEQA

SEQ ID NO: 371466 - protein, 10 aa, Influenza virus
KQNPTEEQAV

SEQ ID NO: 371467 - protein, 10 aa, Influenza virus
QNPTEEQAVG

SEQ ID NO: 371468 - protein, 10 aa, Influenza virus
NPTEEQAVGI

SEQ ID NO: 371469 - protein, 10 aa, Influenza virus
PTEEQAVGIC

SEQ ID NO: 371470 - protein, 10 aa, Influenza virus
TEEQAVGICK

SEQ ID NO: 371471 - protein, 10 aa, Influenza virus
EEQAVGICKA

SEQ ID NO: 371472 - protein, 10 aa, Influenza virus
EQAVGICKAA

SEQ ID NO: 371473 - protein, 10 aa, Influenza virus
QAVDICKAAI

SEQ ID NO: 371474 - protein, 10 aa, Influenza virus
AVDICKAAIG

SEQ ID NO: 371475 - protein, 10 aa, Influenza virus
ICKAAIGLRI

SEQ ID NO: 371476 - protein, 10 aa, Influenza virus
CKAAIGLRIS

SEQ ID NO: 371477 - protein, 10 aa, Influenza virus
KAAIGLRISS

SEQ ID NO: 371478 - protein, 10 aa, Influenza virus
AAIGLRISSS

SEQ ID NO: 371479 - protein, 10 aa, Influenza virus
AIGLRISSSF

SEQ ID NO: 371480 - protein, 10 aa, Influenza virus
IGLRISSSFS

SEQ ID NO: 371481 - protein, 10 aa, Influenza virus
GLKISSSFSF

SEQ ID NO: 371482 - protein, 10 aa, Influenza virus
LKISSSFSFG

SEQ ID NO: 371483 - protein, 10 aa, Influenza virus
KISSSFSFGG

SEQ ID NO: 371484 - protein, 10 aa, Influenza virus
FGGFTFKRTK

SEQ ID NO: 371485 - protein, 10 aa, Influenza virus
GGFTFKRTKG

SEQ ID NO: 371486 - protein, 10 aa, Influenza virus
FTFKRTKGSS

SEQ ID NO: 371487 - protein, 10 aa, Influenza virus
EEEMLTGNLQ

SEQ ID NO: 371488 - protein, 10 aa, Influenza virus
EEMLTGNLQT

SEQ ID NO: 371489 - protein, 10 aa, Influenza virus
EMLTGNLQTL

SEQ ID NO: 371490 - protein, 10 aa, Influenza virus
VLTGNLQTLR

SEQ ID NO: 371491 - protein, 10 aa, Influenza virus
LTGNLQTLKL

SEQ ID NO: 371492 - protein, 10 aa, Influenza virus
EGYEEFTLVG

SEQ ID NO: 371493 - protein, 10 aa, Influenza virus
ATAILKKATR

SEQ ID NO: 371494 - protein, 10 aa, Influenza virus
VVAMVFSQED

SEQ ID NO: 371495 - protein, 10 aa, Influenza virus
VAMVFSQEEC

SEQ ID NO: 371496 - protein, 10 aa, Influenza virus
AMVFSQEECM

SEQ ID NO: 371497 - protein, 10 aa, Influenza virus
MVFSQEDCMV

SEQ ID NO: 371498 - protein, 10 aa, Influenza virus
VFSQEDCMVK

SEQ ID NO: 371499 - protein, 10 aa, Influenza virus
FSQEDCMVKA

SEQ ID NO: 371500 - protein, 10 aa, Influenza virus
QEDCMVKAVR

SEQ ID NO: 371501 - protein, 10 aa, Influenza virus
DCMVKAVRGD

SEQ ID NO: 371502 - protein, 10 aa, Influenza virus
CMVKAVRGDL

SEQ ID NO: 371503 - protein, 10 aa, Influenza virus
MVKAVRGDLN

SEQ ID NO: 371504 - protein, 10 aa, Influenza virus
VKAVRGDLNF

SEQ ID NO: 371505 - protein, 10 aa, Influenza virus
VNRANQRLNT

SEQ ID NO: 371506 - protein, 10 aa, Influenza virus
NRANQRLNTM

SEQ ID NO: 371507 - protein, 10 aa, Influenza virus
RANQRLNTMH

SEQ ID NO: 371508 - protein, 10 aa, Influenza virus
ANQRLNTMHQ

SEQ ID NO: 371509 - protein, 10 aa, Influenza virus
NQRLNTMHQL

SEQ ID NO: 371510 - protein, 10 aa, Influenza virus
QRLNTMHQLL

SEQ ID NO: 371511 - protein, 10 aa, Influenza virus
RLNTMHQLLR

SEQ ID NO: 371512 - protein, 10 aa, Influenza virus
LNTMHQLLRH

SEQ ID NO: 371513 - protein, 10 aa, Influenza virus
NTMHQLLRHF

SEQ ID NO: 371514 - protein, 10 aa, Influenza virus
TMHQLLRHFQ

SEQ ID NO: 371515 - protein, 10 aa, Influenza virus
HQLLRHFQKN

SEQ ID NO: 371516 - protein, 10 aa, Influenza virus
QLLRHFQKNA

SEQ ID NO: 371517 - protein, 10 aa, Influenza virus
LLRHFQKDAR

SEQ ID NO: 371518 - protein, 10 aa, Influenza virus
LRHFQKDAKI

SEQ ID NO: 371519 - protein, 10 aa, Influenza virus
RHFQKDAKIL

SEQ ID NO: 371520 - protein, 10 aa, Influenza virus
RISKMGVDEY

SEQ ID NO: 371521 - protein, 10 aa, Influenza virus
SKMGVDEYSN

SEQ ID NO: 371522 - protein, 10 aa, Influenza virus
MGVDEYSNAE

SEQ ID NO: 371523 - protein, 10 aa, Influenza virus
GVDEYSNAER

SEQ ID NO: 371524 - protein, 10 aa, Influenza virus
IVSIDRFLRV

SEQ ID NO: 371525 - protein, 10 aa, Influenza virus
VNIDRFLRVR

SEQ ID NO: 371526 - protein, 10 aa, Influenza virus
NIDRFLRVRD

SEQ ID NO: 371527 - protein, 10 aa, Influenza virus
IDRFLRVKDQ

SEQ ID NO: 371528 - protein, 10 aa, Influenza virus
DRFLRVRDQQ

SEQ ID NO: 371529 - protein, 10 aa, Influenza virus
RFLRVRDQQG

SEQ ID NO: 371530 - protein, 10 aa, Influenza virus
FLRVRDQQGN

SEQ ID NO: 371531 - protein, 10 aa, Influenza virus
QGNVLLSPEE

SEQ ID NO: 371532 - protein, 10 aa, Influenza virus
GNILLSPEEV

SEQ ID NO: 371533 - protein, 10 aa, Influenza virus
NILLSPEEVS

SEQ ID NO: 371534 - protein, 10 aa, Influenza virus
ILLSPEEVSE

SEQ ID NO: 371535 - protein, 10 aa, Influenza virus
LSPEEVSEAQ

SEQ ID NO: 371536 - protein, 10 aa, Influenza virus
SPEEVSEAQG

SEQ ID NO: 371537 - protein, 10 aa, Influenza virus
PEEVSETQGI

SEQ ID NO: 371538 - protein, 10 aa, Influenza virus
EEVSETQGIE

SEQ ID NO: 371539 - protein, 10 aa, Influenza virus
ERLTITYSSS

SEQ ID NO: 371540 - protein, 10 aa, Influenza virus
RLTITYSSSM

SEQ ID NO: 371541 - protein, 10 aa, Influenza virus
LTITYSSSLM

SEQ ID NO: 371542 - protein, 10 aa, Influenza virus
TITYSSSLMW

SEQ ID NO: 371543 - protein, 10 aa, Influenza virus
ITYSSSLMWE

SEQ ID NO: 371544 - protein, 10 aa, Influenza virus
TYSSSLMWEI

SEQ ID NO: 371545 - protein, 10 aa, Influenza virus
YSSSLMWEIN

SEQ ID NO: 371546 - protein, 10 aa, Influenza virus
SSSLMWEING

SEQ ID NO: 371547 - protein, 10 aa, Influenza virus
SSLMWEINGP

SEQ ID NO: 371548 - protein, 10 aa, Influenza virus
SLMWEINGPE

SEQ ID NO: 371549 - protein, 10 aa, Influenza virus
LMWEINGPES

SEQ ID NO: 371550 - protein, 10 aa, Influenza virus
MWEVNGPESV

SEQ ID NO: 371551 - protein, 10 aa, Influenza virus
WEVNGPESVL

SEQ ID NO: 371552 - protein, 10 aa, Influenza virus
EINGPESVLI

SEQ ID NO: 371553 - protein, 10 aa, Influenza virus
INGPESVLIN

SEQ ID NO: 371554 - protein, 10 aa, Influenza virus
NGPESVLINT

SEQ ID NO: 371555 - protein, 10 aa, Influenza virus
GPESVLINTY

SEQ ID NO: 371556 - protein, 10 aa, Influenza virus
PESVLINTYQ

SEQ ID NO: 371557 - protein, 10 aa, Influenza virus
ESVLINTYQW

SEQ ID NO: 371558 - protein, 10 aa, Influenza virus
SVLINTYQWI

SEQ ID NO: 371559 - protein, 10 aa, Influenza virus
VLINTYQWII

SEQ ID NO: 371560 - protein, 10 aa, Influenza virus
LINTYQWIIR

SEQ ID NO: 371561 - protein, 10 aa, Influenza virus
INTYQWIIRN

SEQ ID NO: 371562 - protein, 10 aa, Influenza virus
NTYQWVIRNW

SEQ ID NO: 371563 - protein, 10 aa, Influenza virus
TYQWVIRNWE

SEQ ID NO: 371564 - protein, 10 aa, Influenza virus
LYNKIEFEPF

SEQ ID NO: 371565 - protein, 10 aa, Influenza virus
YNKIEFEPFQ

SEQ ID NO: 371566 - protein, 10 aa, Influenza virus
NKIEFEPFQS

SEQ ID NO: 371567 - protein, 10 aa, Influenza virus
KIEFEPFQSL

SEQ ID NO: 371568 - protein, 10 aa, Influenza virus
IEFEPFQSLV

SEQ ID NO: 371569 - protein, 10 aa, Influenza virus
EFEPFQSLIP

SEQ ID NO: 371570 - protein, 10 aa, Influenza virus
FEPFQSLVPR

SEQ ID NO: 371571 - protein, 10 aa, Influenza virus
EPFQSLVPRA

SEQ ID NO: 371572 - protein, 10 aa, Influenza virus
RYSGFVRTLF

SEQ ID NO: 371573 - protein, 10 aa, Influenza virus
RTLFQQMRDI

SEQ ID NO: 371574 - protein, 10 aa, Influenza virus
TLFQQMRDIL

SEQ ID NO: 371575 - protein, 10 aa, Influenza virus
LFQQMRDILG

SEQ ID NO: 371576 - protein, 10 aa, Influenza virus
FQQMRDILGT

SEQ ID NO: 371577 - protein, 10 aa, Influenza virus
QQMRDILGTF

SEQ ID NO: 371578 - protein, 10 aa, Influenza virus
QMRDILGTFD

SEQ ID NO: 371579 - protein, 10 aa, Influenza virus
MRDILGTFDT

SEQ ID NO: 371580 - protein, 10 aa, Influenza virus
GTFDTTQIIK

SEQ ID NO: 371581 - protein, 10 aa, Influenza virus
TTQIIKLLPF

SEQ ID NO: 371582 - protein, 10 aa, Influenza virus
TQIIKLLPFA

SEQ ID NO: 371583 - protein, 10 aa, Influenza virus
QVIKLLPFAA

SEQ ID NO: 371584 - protein, 10 aa, Influenza virus
VIKLLPFAAA

SEQ ID NO: 371585 - protein, 10 aa, Influenza virus
IKLLPFASAP

SEQ ID NO: 371586 - protein, 10 aa, Influenza virus
KLLPFASAPP

SEQ ID NO: 371587 - protein, 10 aa, Influenza virus
LLPFAAAPPK

SEQ ID NO: 371588 - protein, 10 aa, Influenza virus
LPFAAAPPKQ

SEQ ID NO: 371589 - protein, 10 aa, Influenza virus
PFAAAPPKQS

SEQ ID NO: 371590 - protein, 10 aa, Influenza virus
APPKQSRMQF

SEQ ID NO: 371591 - protein, 10 aa, Influenza virus
PPKQSRMQFS

SEQ ID NO: 371592 - protein, 10 aa, Influenza virus
PKQSRMQFSS

SEQ ID NO: 371593 - protein, 10 aa, Influenza virus
QSKMQFSSLT

SEQ ID NO: 371594 - protein, 10 aa, Influenza virus
SKMQFSSLTV

SEQ ID NO: 371595 - protein, 10 aa, Influenza virus
KMQFSSLTVN

SEQ ID NO: 371596 - protein, 10 aa, Influenza virus
MQFSSLTVSV

SEQ ID NO: 371597 - protein, 10 aa, Influenza virus
QFSSLTVSVR

SEQ ID NO: 371598 - protein, 10 aa, Influenza virus
FSSLTVSVRG

SEQ ID NO: 371599 - protein, 10 aa, Influenza virus
SSLTVNVRGT

SEQ ID NO: 371600 - protein, 10 aa, Influenza virus
SLTVNVRGTG

SEQ ID NO: 371601 - protein, 10 aa, Influenza virus
LTVNVRGSGL

SEQ ID NO: 371602 - protein, 10 aa, Influenza virus
TVNVRGSGLR

SEQ ID NO: 371603 - protein, 10 aa, Influenza virus
VNVRGSGLRI

SEQ ID NO: 371604 - protein, 10 aa, Influenza virus
NVRGSGLRIL

SEQ ID NO: 371605 - protein, 10 aa, Influenza virus
RGSGLRILVR

SEQ ID NO: 371606 - protein, 10 aa, Influenza virus
GSGLRILVRG

SEQ ID NO: 371607 - protein, 10 aa, Influenza virus
GLRILVRGNS

SEQ ID NO: 371608 - protein, 10 aa, Influenza virus
LRILVRGNSP

SEQ ID NO: 371609 - protein, 10 aa, Influenza virus
LIRGNSPVFN

SEQ ID NO: 371610 - protein, 10 aa, Influenza virus
IRGNSPVFNY

SEQ ID NO: 371611 - protein, 10 aa, Influenza virus
RGNSPIFNYN

SEQ ID NO: 371612 - protein, 10 aa, Influenza virus
GNSPVFNYNR

SEQ ID NO: 371613 - protein, 10 aa, Influenza virus
KRLTILGKDA

SEQ ID NO: 371614 - protein, 10 aa, Influenza virus
RLTILGKDAG

SEQ ID NO: 371615 - protein, 10 aa, Influenza virus
SGVESAVLRG

SEQ ID NO: 371616 - protein, 10 aa, Influenza virus
SAVLRGFLII

SEQ ID NO: 371617 - protein, 10 aa, Influenza virus
AVLRGFLIIG

SEQ ID NO: 371618 - protein, 10 aa, Influenza virus
VLRGFLIIGK

SEQ ID NO: 371619 - protein, 10 aa, Influenza virus
LRGFLIIGKE

SEQ ID NO: 371620 - protein, 10 aa, Influenza virus
RGFLIIGKED

SEQ ID NO: 371621 - protein, 10 aa, Influenza virus
GFLIIGKEDR

SEQ ID NO: 371622 - protein, 10 aa, Influenza virus
GKEDRRYGPA

SEQ ID NO: 371623 - protein, 10 aa, Influenza virus
KEDRRYGPAL

SEQ ID NO: 371624 - protein, 10 aa, Influenza virus
EDRRYGPALS

SEQ ID NO: 371625 - protein, 10 aa, Influenza virus
DRRYGPALSI

SEQ ID NO: 371626 - protein, 10 aa, Influenza virus
RRYGPALSIN

SEQ ID NO: 371627 - protein, 10 aa, Influenza virus
RYGPALSISE

SEQ ID NO: 371628 - protein, 10 aa, Influenza virus
YGPALSISEL

SEQ ID NO: 371629 - protein, 10 aa, Influenza virus
GPALSISELS

SEQ ID NO: 371630 - protein, 10 aa, Influenza virus
LTKGEKANVL

SEQ ID NO: 371631 - protein, 10 aa, Influenza virus
TKGEKANVLI

SEQ ID NO: 371632 - protein, 10 aa, Influenza virus
RGEKANVLIG

SEQ ID NO: 371633 - protein, 10 aa, Influenza virus
ANVLIGQGDI

SEQ ID NO: 371634 - protein, 10 aa, Influenza virus
NVLIGQGDIV

SEQ ID NO: 371635 - protein, 10 aa, Influenza virus
VLIGQGDIVL

SEQ ID NO: 371636 - protein, 10 aa, Influenza virus
LIGQGDIVLV

SEQ ID NO: 371637 - protein, 10 aa, Influenza virus
IGQGDIVLVM

SEQ ID NO: 371638 - protein, 10 aa, Influenza virus
GQGDIVLVMK

SEQ ID NO: 371639 - protein, 10 aa, Influenza virus
QGDIVLVMKR

SEQ ID NO: 371640 - protein, 10 aa, Influenza virus
GDIVLVMKRK

SEQ ID NO: 371641 - protein, 10 aa, Influenza virus
DIVLVMKRKR

SEQ ID NO: 371642 - protein, 10 aa, Influenza virus
IVLVMKRKRD

SEQ ID NO: 371643 - protein, 10 aa, Influenza virus
VLVMKRKRNS

SEQ ID NO: 371644 - protein, 10 aa, Influenza virus
LVMKRKRNSS

SEQ ID NO: 371645 - protein, 10 aa, Influenza virus
VMKRKRNSSI

SEQ ID NO: 371646 - protein, 10 aa, Influenza virus
MKRKRNSSIL

SEQ ID NO: 371647 - protein, 10 aa, Influenza virus
KRKRNSSILT

SEQ ID NO: 371648 - protein, 10 aa, Influenza virus
RKRNSSILTD

SEQ ID NO: 371649 - protein, 10 aa, Influenza virus
KRNSSILTDS

SEQ ID NO: 371650 - protein, 10 aa, Influenza virus
RNSSILTDSQ

SEQ ID NO: 371651 - protein, 10 aa, Influenza virus
NSSILTDSQT

SEQ ID NO: 371652 - protein, 10 aa, Influenza virus
TDSQTATKRL

SEQ ID NO: 371653 - protein, 10 aa, Influenza virus
DSQTATKRLR

SEQ ID NO: 371654 - protein, 10 aa, Influenza virus
SQTATKRLRM

SEQ ID NO: 371655 - protein, 10 aa, Influenza virus
QTATKRLRMA

SEQ ID NO: 371656 - protein, 10 aa, Influenza virus
TATKRLRMAI

SEQ ID NO: 371657 - protein, 10 aa, Influenza virus
KRIRMAINLV

SEQ ID NO: 371658 - protein, 10 aa, Influenza virus
RIRMAINWGR

SEQ ID NO: 371659 - protein, 10 aa, Influenza virus
IRMATNECRI

SEQ ID NO: 371660 - protein, 10 aa, Influenza virus
RMATNECRII

SEQ ID NO: 371661 - protein, 10 aa, Influenza virus
IFNFILLTHW

SEQ ID NO: 371662 - protein, 10 aa, Influenza virus
FNFILLTHWA

SEQ ID NO: 371663 - protein, 10 aa, Influenza virus
DNNKNATNPL

SEQ ID NO: 371664 - protein, 10 aa, Influenza virus
NNNKGAVFKS

SEQ ID NO: 371665 - protein, 10 aa, Influenza virus
RRRKRGLFGA

SEQ ID NO: 371666 - protein, 10 aa, Influenza virus
IHKQLTHHMR

SEQ ID NO: 371667 - protein, 10 aa, Influenza virus
RKTRGLFGAI

SEQ ID NO: 371668 - protein, 10 aa, Influenza virus
KTRGLFGAIA

SEQ ID NO: 371669 - protein, 10 aa, Influenza virus
KRGLFGAIAG

SEQ ID NO: 371670 - protein, 10 aa, Influenza virus
KGLFGAIAGF

SEQ ID NO: 371671 - protein, 10 aa, Influenza virus
HGSLQCRICI

SEQ ID NO: 371672 - protein, 10 aa, Influenza virus
IRFVNSDCSK

SEQ ID NO: 371673 - protein, 10 aa, Influenza virus
VFREQKQEFK

SEQ ID NO: 371674 - protein, 10 aa, Influenza virus
FREQKQEFKM

SEQ ID NO: 371675 - protein, 10 aa, Influenza virus
AKAGVKMNPN

SEQ ID NO: 371676 - protein, 10 aa, Influenza virus
KQEIKMNPNQ

SEQ ID NO: 371677 - protein, 10 aa, Influenza virus
QEIKMNPNQK

SEQ ID NO: 371678 - protein, 10 aa, Influenza virus
EIKMNPNQKI

SEQ ID NO: 371679 - protein, 10 aa, Influenza virus
IKMNPNQKIM

SEQ ID NO: 371680 - protein, 10 aa, Influenza virus
KMNPNQKIII

SEQ ID NO: 371681 - protein, 10 aa, Influenza virus
RKGLILEYYS

SEQ ID NO: 371682 - protein, 10 aa, Influenza virus
EKGKVVKSVE

SEQ ID NO: 371683 - protein, 10 aa, Influenza virus
VQHLEECSCY

SEQ ID NO: 371684 - protein, 10 aa, Influenza virus
VFREQKQEFK

SEQ ID NO: 371685 - protein, 10 aa, Influenza virus
FREQKQEFKM

SEQ ID NO: 371686 - protein, 10 aa, Influenza virus
KQEIKMNPNQ

SEQ ID NO: 371687 - protein, 10 aa, Influenza virus
QEIKMNPNQK

SEQ ID NO: 371688 - protein, 10 aa, Influenza virus
EIKMNPNQKI

SEQ ID NO: 371689 - protein, 10 aa, Influenza virus
IKMNPNQKIM

SEQ ID NO: 371690 - protein, 10 aa, Influenza virus
KMNPNQKIII

SEQ ID NO: 371691 - protein, 10 aa, Influenza virus
SKDNSVRIGS

SEQ ID NO: 371692 - protein, 10 aa, Influenza virus
KDNGIRIGSK

SEQ ID NO: 371693 - protein, 10 aa, Influenza virus
DNGIRIGSKG

SEQ ID NO: 371694 - protein, 10 aa, Influenza virus
NGIRIGSKGD

SEQ ID NO: 371695 - protein, 10 aa, Influenza virus
IRIGSKGDIF

SEQ ID NO: 371696 - protein, 10 aa, Influenza virus
RIGSRGDVFV

SEQ ID NO: 371697 - protein, 10 aa, Influenza virus
GDIFVMREPF

SEQ ID NO: 371698 - protein, 10 aa, Influenza virus
FVVREPFISC

SEQ ID NO: 371699 - protein, 10 aa, Influenza virus
VVREPFISCS

SEQ ID NO: 371700 - protein, 10 aa, Influenza virus
MECRTFFLTQ

SEQ ID NO: 371701 - protein, 10 aa, Influenza virus
SLLNDKHSNG

SEQ ID NO: 371702 - protein, 10 aa, Influenza virus
LNDRHSNGTV

SEQ ID NO: 371703 - protein, 10 aa, Influenza virus
DRSPHRTLMS

SEQ ID NO: 371704 - protein, 10 aa, Influenza virus
RSPHRTLMSC

SEQ ID NO: 371705 - protein, 10 aa, Influenza virus
SPHRTLMSCP

SEQ ID NO: 371706 - protein, 10 aa, Influenza virus
LGEAPSPYNS

SEQ ID NO: 371707 - protein, 10 aa, Influenza virus
GEAPSPYNSK

SEQ ID NO: 371708 - protein, 10 aa, Influenza virus
EAPSPYNSKF

SEQ ID NO: 371709 - protein, 10 aa, Influenza virus
APSPYNSKFE

SEQ ID NO: 371710 - protein, 10 aa, Influenza virus
WSASACHDGT

SEQ ID NO: 371711 - protein, 10 aa, Influenza virus
GWLTIGISGP

SEQ ID NO: 371712 - protein, 10 aa, Influenza virus
WLTIGVSGPD

SEQ ID NO: 371713 - protein, 10 aa, Influenza virus
TIGISGPDNE

SEQ ID NO: 371714 - protein, 10 aa, Influenza virus
IGISGPDNEA

SEQ ID NO: 371715 - protein, 10 aa, Influenza virus
GISGPDNEAV

SEQ ID NO: 371716 - protein, 10 aa, Influenza virus
ISGPDNEAVA

SEQ ID NO: 371717 - protein, 10 aa, Influenza virus
SGPDNEAVAV

SEQ ID NO: 371718 - protein, 10 aa, Influenza virus
GPDNEAVAVL

SEQ ID NO: 371719 - protein, 10 aa, Influenza virus
PDNEAVAVLK

SEQ ID NO: 371720 - protein, 10 aa, Influenza virus
DNEAVAVLKY

SEQ ID NO: 371721 - protein, 10 aa, Influenza virus
GAVAVVKYNG

SEQ ID NO: 371722 - protein, 10 aa, Influenza virus
AVVKYNGIIT

SEQ ID NO: 371723 - protein, 10 aa, Influenza virus
IMRTQESECA

SEQ ID NO: 371724 - protein, 10 aa, Influenza virus
MRTQESECAC

SEQ ID NO: 371725 - protein, 10 aa, Influenza virus
NGSCFTVLTD

SEQ ID NO: 371726 - protein, 10 aa, Influenza virus
GSCFTVLTDG

SEQ ID NO: 371727 - protein, 10 aa, Influenza virus
SCFTVLTDGP

SEQ ID NO: 371728 - protein, 10 aa, Influenza virus
CFTVLTDGPS

SEQ ID NO: 371729 - protein, 10 aa, Influenza virus
EKGKVVKSVE

SEQ ID NO: 371730 - protein, 10 aa, Influenza virus
APNFYYEECS

SEQ ID NO: 371731 - protein, 10 aa, Influenza virus
PNFYYEECSC

SEQ ID NO: 371732 - protein, 10 aa, Influenza virus
NFYYEECSCY

SEQ ID NO: 371733 - protein, 10 aa, Influenza virus
FYYEECSCYP

SEQ ID NO: 371734 - protein, 10 aa, Influenza virus
HYEECSCYPE

SEQ ID NO: 371735 - protein, 10 aa, Influenza virus
YEECSCYPDA

SEQ ID NO: 371736 - protein, 10 aa, Influenza virus
NWHASNRPWI

SEQ ID NO: 371737 - protein, 10 aa, Influenza virus
WHASNRPWIS

SEQ ID NO: 371738 - protein, 10 aa, Influenza virus
HASNRPWISF

SEQ ID NO: 371739 - protein, 10 aa, Influenza virus
YICSGVFGDS

SEQ ID NO: 371740 - protein, 10 aa, Influenza virus
ICSGVFGDSP

SEQ ID NO: 371741 - protein, 10 aa, Influenza virus
CSGVFGDSPR

SEQ ID NO: 371742 - protein, 10 aa, Influenza virus
KYDNGVWIGR

SEQ ID NO: 371743 - protein, 10 aa, Influenza virus
YGDGVWIGRT

SEQ ID NO: 371744 - protein, 10 aa, Influenza virus
GDGVWIGRTK

SEQ ID NO: 371745 - protein, 10 aa, Influenza virus
DGVWIGRTKS

SEQ ID NO: 371746 - protein, 10 aa, Influenza virus
GFEMVWDPNG

SEQ ID NO: 371747 - protein, 10 aa, Influenza virus
FEMVWDPNGW

SEQ ID NO: 371748 - protein, 10 aa, Influenza virus
NDWSGYSGSF

SEQ ID NO: 371749 - protein, 10 aa, Influenza virus
DWSGYSGSFI

SEQ ID NO: 371750 - protein, 10 aa, Influenza virus
FIQHPELTGL

SEQ ID NO: 371751 - protein, 10 aa, Influenza virus
QHPELTGLNC

SEQ ID NO: 371752 - protein, 10 aa, Influenza virus
NCIRPCFWVE

SEQ ID NO: 371753 - protein, 10 aa, Influenza virus
CIKPCFWVEL

SEQ ID NO: 371754 - protein, 10 aa, Influenza virus
MRPCFWVELI

SEQ ID NO: 371755 - protein, 10 aa, Influenza virus
KPCFWVELIR

SEQ ID NO: 371756 - protein, 10 aa, Influenza virus
CFWVELIRGQ

SEQ ID NO: 371757 - protein, 10 aa, Influenza virus
FWVELIRGQP

SEQ ID NO: 371758 - protein, 10 aa, Influenza virus
TVWTSGSSIS

SEQ ID NO: 371759 - protein, 10 aa, Influenza virus
VWTSGSSISF

SEQ ID NO: 371760 - protein, 10 aa, Influenza virus
WTSGSIISFC

SEQ ID NO: 371761 - protein, 10 aa, Influenza virus
TSGSIISFCG

SEQ ID NO: 371762 - protein, 10 aa, Influenza virus
SASSISFCGV

SEQ ID NO: 371763 - protein, 10 aa, Influenza virus
GSSISFCGVS

SEQ ID NO: 371764 - protein, 10 aa, Influenza virus
WSWPDGAEVP

SEQ ID NO: 371765 - protein, 10 aa, Influenza virus
SWPDGAEVPF

SEQ ID NO: 371766 - protein, 10 aa, Influenza virus
KNNQVILCEQ

SEQ ID NO: 371767 - protein, 10 aa, Influenza virus
GFVPFSKDNS

SEQ ID NO: 371768 - protein, 10 aa, Influenza virus
PFTKDNSIRL

SEQ ID NO: 371769 - protein, 10 aa, Influenza virus
TKDNSIRLSA

SEQ ID NO: 371770 - protein, 10 aa, Influenza virus
KDNSVRLSAG

SEQ ID NO: 371771 - protein, 10 aa, Influenza virus
DNSVRLSAGG

SEQ ID NO: 371772 - protein, 10 aa, Influenza virus
IWVTRELYVS

SEQ ID NO: 371773 - protein, 10 aa, Influenza virus
WVTRELYVSC

SEQ ID NO: 371774 - protein, 10 aa, Influenza virus
NCYQFALGQG

SEQ ID NO: 371775 - protein, 10 aa, Influenza virus
PHRTLLMSEL

SEQ ID NO: 371776 - protein, 10 aa, Influenza virus
HRTLLMSELG

SEQ ID NO: 371777 - protein, 10 aa, Influenza virus
RTLLMNELGI

SEQ ID NO: 371778 - protein, 10 aa, Influenza virus
TLLMNELGIP

SEQ ID NO: 371779 - protein, 10 aa, Influenza virus
LLMNELGIPF

SEQ ID NO: 371780 - protein, 10 aa, Influenza virus
LMNELGIPFH

SEQ ID NO: 371781 - protein, 10 aa, Influenza virus
MNELGIPFHL

SEQ ID NO: 371782 - protein, 10 aa, Influenza virus
SELGVPFHLG

SEQ ID NO: 371783 - protein, 10 aa, Influenza virus
ELGIPFHLGT

SEQ ID NO: 371784 - protein, 10 aa, Influenza virus
LGVPFHLATK

SEQ ID NO: 371785 - protein, 10 aa, Influenza virus
GVPFHLATKQ

SEQ ID NO: 371786 - protein, 10 aa, Influenza virus
VPFHLATKQV

SEQ ID NO: 371787 - protein, 10 aa, Influenza virus
PFHLATKQVC

SEQ ID NO: 371788 - protein, 10 aa, Influenza virus
TKQVCMAWSS

SEQ ID NO: 371789 - protein, 10 aa, Influenza virus
KQVCMAWSSS

SEQ ID NO: 371790 - protein, 10 aa, Influenza virus
QVCVAWSSSS

SEQ ID NO: 371791 - protein, 10 aa, Influenza virus
VCVAWSSSSC

SEQ ID NO: 371792 - protein, 10 aa, Influenza virus
CVAWSSSSCH

SEQ ID NO: 371793 - protein, 10 aa, Influenza virus
VAWSSSSCHD

SEQ ID NO: 371794 - protein, 10 aa, Influenza virus
WSSSSCYDGK

SEQ ID NO: 371795 - protein, 10 aa, Influenza virus
SSSSCYDGKA

SEQ ID NO: 371796 - protein, 10 aa, Influenza virus
SSSCYDGKAW

SEQ ID NO: 371797 - protein, 10 aa, Influenza virus
SSCYDGKAWL

SEQ ID NO: 371798 - protein, 10 aa, Influenza virus
SCYDGKAWLH

SEQ ID NO: 371799 - protein, 10 aa, Influenza virus
EILRTQESEC

SEQ ID NO: 371800 - protein, 10 aa, Influenza virus
TQESECICIN

SEQ ID NO: 371801 - protein, 10 aa, Influenza virus
CTVVMTDGNA

SEQ ID NO: 371802 - protein, 10 aa, Influenza virus
TVVMTDGNAS

SEQ ID NO: 371803 - protein, 10 aa, Influenza virus
GNAQHVEECS

SEQ ID NO: 371804 - protein, 10 aa, Influenza virus
NAQHVEECSC

SEQ ID NO: 371805 - protein, 10 aa, Influenza virus
HVEECSCYPQ

SEQ ID NO: 371806 - protein, 10 aa, Influenza virus
VRCVCRDNWR

SEQ ID NO: 371807 - protein, 10 aa, Influenza virus
RCVCRDNWRG

SEQ ID NO: 371808 - protein, 10 aa, Influenza virus
CVCRDNWRGS

SEQ ID NO: 371809 - protein, 10 aa, Influenza virus
VCRDNWRGSN

SEQ ID NO: 371810 - protein, 10 aa, Influenza virus
DNWRGSNRPV

SEQ ID NO: 371811 - protein, 10 aa, Influenza virus
YMCSGLVGDT

SEQ ID NO: 371812 - protein, 10 aa, Influenza virus
MCSGLVGDTP

SEQ ID NO: 371813 - protein, 10 aa, Influenza virus
SGLVGDTPRS

SEQ ID NO: 371814 - protein, 10 aa, Influenza virus
SGYSGIFSIE

SEQ ID NO: 371815 - protein, 10 aa, Influenza virus
CFYVELVRGR

SEQ ID NO: 371816 - protein, 10 aa, Influenza virus
WTSNSIVAFC

SEQ ID NO: 371817 - protein, 10 aa, Influenza virus
TSNSIVAFCG

SEQ ID NO: 371818 - protein, 10 aa, Influenza virus
SNSIVAFCGT

SEQ ID NO: 371819 - protein, 10 aa, Influenza virus
NSIVAFCGTS

SEQ ID NO: 371820 - protein, 10 aa, Influenza virus
SIVAFCGTSG

SEQ ID NO: 371821 - protein, 10 aa, Influenza virus
IIAFCGTSGT

SEQ ID NO: 371822 - protein, 10 aa, Influenza virus
IAFCGTSGTY

SEQ ID NO: 371823 - protein, 10 aa, Influenza virus
FCGTSGTYGA

SEQ ID NO: 371824 - protein, 10 aa, Influenza virus
CGTSGTYGAG

SEQ ID NO: 371825 - protein, 10 aa, Influenza virus
GTSGTYGAGS

SEQ ID NO: 371826 - protein, 10 aa, Influenza virus
TSGTYGAGSW

SEQ ID NO: 371827 - protein, 10 aa, Influenza virus
SGTYGAGSWP

SEQ ID NO: 371828 - protein, 10 aa, Influenza virus
GTYGAGSWPD

SEQ ID NO: 371829 - protein, 10 aa, Influenza virus
TYGAGSWPDG

SEQ ID NO: 371830 - protein, 10 aa, Influenza virus
YGAGSWPDGA

SEQ ID NO: 371831 - protein, 10 aa, Influenza virus
ADIKSHAYIS

SEQ ID NO: 371832 - protein, 10 aa, Influenza virus
SISCLYKLSQ

SEQ ID NO: 371833 - protein, 10 aa, Influenza virus
ISCLYKLSQF

SEQ ID NO: 371834 - protein, 10 aa, Influenza virus
GNLAFNAVIH

SEQ ID NO: 371835 - protein, 10 aa, Influenza virus
LPLCPFQGFF

SEQ ID NO: 371836 - protein, 10 aa, Influenza virus
PLCPFQGFFP

SEQ ID NO: 371837 - protein, 10 aa, Influenza virus
LCPFQGFFPF

SEQ ID NO: 371838 - protein, 10 aa, Influenza virus
CPFQGFFPFH

SEQ ID NO: 371839 - protein, 10 aa, Influenza virus
PFQGFFPFHK

SEQ ID NO: 371840 - protein, 10 aa, Influenza virus
FQGFFPFHKD

SEQ ID NO: 371841 - protein, 10 aa, Influenza virus
QGFFPFHKDN

SEQ ID NO: 371842 - protein, 10 aa, Influenza virus
FFPFHKDNAV

SEQ ID NO: 371843 - protein, 10 aa, Influenza virus
FPFHKDNAVR

SEQ ID NO: 371844 - protein, 10 aa, Influenza virus
PFHKDNAVRL

SEQ ID NO: 371845 - protein, 10 aa, Influenza virus
FHKDNAVRLG

SEQ ID NO: 371846 - protein, 10 aa, Influenza virus
HKDNAVRLGE

SEQ ID NO: 371847 - protein, 10 aa, Influenza virus
KDNAVRLGEN

SEQ ID NO: 371848 - protein, 10 aa, Influenza virus
LVTREPYISC

SEQ ID NO: 371849 - protein, 10 aa, Influenza virus
ITREPYVSCD

SEQ ID NO: 371850 - protein, 10 aa, Influenza virus
TREPYVSCDY

SEQ ID NO: 371851 - protein, 10 aa, Influenza virus
GCWSFALAQG

SEQ ID NO: 371852 - protein, 10 aa, Influenza virus
CWSFALAQGV

SEQ ID NO: 371853 - protein, 10 aa, Influenza virus
WSFALSQGAL

SEQ ID NO: 371854 - protein, 10 aa, Influenza virus
SFALAQGTLL

SEQ ID NO: 371855 - protein, 10 aa, Influenza virus
FALAQGTLLG

SEQ ID NO: 371856 - protein, 10 aa, Influenza virus
ALAQGTLLGT

SEQ ID NO: 371857 - protein, 10 aa, Influenza virus
LVGTKHSNGT

SEQ ID NO: 371858 - protein, 10 aa, Influenza virus
HSNGTVKDRT

SEQ ID NO: 371859 - protein, 10 aa, Influenza virus
EDRTPYRSLI

SEQ ID NO: 371860 - protein, 10 aa, Influenza virus
DRTSYRSLIR

SEQ ID NO: 371861 - protein, 10 aa, Influenza virus
RTSYRSLIRF

SEQ ID NO: 371862 - protein, 10 aa, Influenza virus
TSYRSLIRFP

SEQ ID NO: 371863 - protein, 10 aa, Influenza virus
YRSLIQFPIG

SEQ ID NO: 371864 - protein, 10 aa, Influenza virus
CAAWSSSSCF

SEQ ID NO: 371865 - protein, 10 aa, Influenza virus
AAWSSSSCFD

SEQ ID NO: 371866 - protein, 10 aa, Influenza virus
SSCFDGREWM

SEQ ID NO: 371867 - protein, 10 aa, Influenza virus
SCFDGREWMH

SEQ ID NO: 371868 - protein, 10 aa, Influenza virus
CFDGKEWLHV

SEQ ID NO: 371869 - protein, 10 aa, Influenza virus
FDGKEWLHVC

SEQ ID NO: 371870 - protein, 10 aa, Influenza virus
NNILRTQESE

SEQ ID NO: 371871 - protein, 10 aa, Influenza virus
RIQHLEECSC

SEQ ID NO: 371872 - protein, 10 aa, Influenza virus
VQHLEECSCY

SEQ ID NO: 371873 - protein, 10 aa, Influenza virus
QHLEECSCYT

SEQ ID NO: 371874 - protein, 10 aa, Influenza virus
HLEECSCYMD

SEQ ID NO: 371875 - protein, 10 aa, Influenza virus
DIYCICRDNW

SEQ ID NO: 371876 - protein, 10 aa, Influenza virus
IYCICRDNWK

SEQ ID NO: 371877 - protein, 10 aa, Influenza virus
NWKGSNRPWI

SEQ ID NO: 371878 - protein, 10 aa, Influenza virus
WKGSNRPWIR

SEQ ID NO: 371879 - protein, 10 aa, Influenza virus
KGSNRPWVRI

SEQ ID NO: 371880 - protein, 10 aa, Influenza virus
GSNRPWMRIS

SEQ ID NO: 371881 - protein, 10 aa, Influenza virus
SNRPWMRISN

SEQ ID NO: 371882 - protein, 10 aa, Influenza virus
NRPWMRISNE

SEQ ID NO: 371883 - protein, 10 aa, Influenza virus
RPWMRISNET

SEQ ID NO: 371884 - protein, 10 aa, Influenza virus
PWMRISNETI

SEQ ID NO: 371885 - protein, 10 aa, Influenza virus
ISNETILETG

SEQ ID NO: 371886 - protein, 10 aa, Influenza virus
NNETIIETGY

SEQ ID NO: 371887 - protein, 10 aa, Influenza virus
NETIIETGYV

SEQ ID NO: 371888 - protein, 10 aa, Influenza virus
ETIIETGYVC

SEQ ID NO: 371889 - protein, 10 aa, Influenza virus
TIIETGYVCS

SEQ ID NO: 371890 - protein, 10 aa, Influenza virus
IIETGYVCSK

SEQ ID NO: 371891 - protein, 10 aa, Influenza virus
IETGYVCSKF

SEQ ID NO: 371892 - protein, 10 aa, Influenza virus
ETGYVCGKFH

SEQ ID NO: 371893 - protein, 10 aa, Influenza virus
GYVCGKFHSD

SEQ ID NO: 371894 - protein, 10 aa, Influenza virus
KFHSDTPRPV

SEQ ID NO: 371895 - protein, 10 aa, Influenza virus
FHSDTPRPVD

SEQ ID NO: 371896 - protein, 10 aa, Influenza virus
HSDTPRPVDP

SEQ ID NO: 371897 - protein, 10 aa, Influenza virus
SDTPRPVDPS

SEQ ID NO: 371898 - protein, 10 aa, Influenza virus
QNDVWLGRTI

SEQ ID NO: 371899 - protein, 10 aa, Influenza virus
NDVWLGRTIS

SEQ ID NO: 371900 - protein, 10 aa, Influenza virus
IQTLVSNNDW

SEQ ID NO: 371901 - protein, 10 aa, Influenza virus
QTLVANNDWS

SEQ ID NO: 371902 - protein, 10 aa, Influenza virus
TLVANNDWSG

SEQ ID NO: 371903 - protein, 10 aa, Influenza virus
DWSGYSGSFS

SEQ ID NO: 371904 - protein, 10 aa, Influenza virus
WSGYSGSFVI

SEQ ID NO: 371905 - protein, 10 aa, Influenza virus
GCFQPCFYVE

SEQ ID NO: 371906 - protein, 10 aa, Influenza virus
FQPCFYVELT

SEQ ID NO: 371907 - protein, 10 aa, Influenza virus
QPCFYVELTR

SEQ ID NO: 371908 - protein, 10 aa, Influenza virus
PCFYVELTRG

SEQ ID NO: 371909 - protein, 10 aa, Influenza virus
CFYIELIRGK

SEQ ID NO: 371910 - protein, 10 aa, Influenza virus
VSWASNSIVT

SEQ ID NO: 371911 - protein, 10 aa, Influenza virus
SWASNSIVTF

SEQ ID NO: 371912 - protein, 10 aa, Influenza virus
WTSNSMVTFC

SEQ ID NO: 371913 - protein, 10 aa, Influenza virus
ASNSIVTFCG

SEQ ID NO: 371914 - protein, 10 aa, Influenza virus
NSMVTFCGLD

SEQ ID NO: 371915 - protein, 10 aa, Influenza virus
SMVTFCGLDN

SEQ ID NO: 371916 - protein, 10 aa, Influenza virus
MVTFCGLDNE

SEQ ID NO: 371917 - protein, 10 aa, Influenza virus
CGLDNEPGSE

SEQ ID NO: 371918 - protein, 10 aa, Influenza virus
DNEPGSGDWP

SEQ ID NO: 371919 - protein, 10 aa, Influenza virus
PGSGDWPDGS

SEQ ID NO: 371920 - protein, 10 aa, Influenza virus
WPDGSDIGFM

SEQ ID NO: 371921 - protein, 10 aa, Influenza virus
PDGSDIGFMP

SEQ ID NO: 371922 - protein, 10 aa, Influenza virus
DGSDIGFMPK

SEQ ID NO: 371923 - protein, 10 aa, Influenza virus
MNPNQSIITI

SEQ ID NO: 371924 - protein, 10 aa, Influenza virus
NPNQMIITIG

SEQ ID NO: 371925 - protein, 10 aa, Influenza virus
PNQSIITIGS

SEQ ID NO: 371926 - protein, 10 aa, Influenza virus
LTTIGPLLQI

SEQ ID NO: 371927 - protein, 10 aa, Influenza virus
TTVGLLLQII

SEQ ID NO: 371928 - protein, 10 aa, Influenza virus
TVGLLLQIIS

SEQ ID NO: 371929 - protein, 10 aa, Influenza virus
VGLLLQIISL

SEQ ID NO: 371930 - protein, 10 aa, Influenza virus
GPLLQITSLC

SEQ ID NO: 371931 - protein, 10 aa, Influenza virus
PLLQITSLCS

SEQ ID NO: 371932 - protein, 10 aa, Influenza virus
IWFSHYNQMK

SEQ ID NO: 371933 - protein, 10 aa, Influenza virus
WFSHYNQMKQ

SEQ ID NO: 371934 - protein, 10 aa, Influenza virus
FSHYNQVTQP

SEQ ID NO: 371935 - protein, 10 aa, Influenza virus
YNETFVNITN

SEQ ID NO: 371936 - protein, 10 aa, Influenza virus
NETFVNMTNV

SEQ ID NO: 371937 - protein, 10 aa, Influenza virus
ETFVNMTNVQ

SEQ ID NO: 371938 - protein, 10 aa, Influenza virus
TFVNITNVQN

SEQ ID NO: 371939 - protein, 10 aa, Influenza virus
FVNVTNVQND

SEQ ID NO: 371940 - protein, 10 aa, Influenza virus
VNVTNVQNDY

SEQ ID NO: 371941 - protein, 10 aa, Influenza virus
NVTNVQNDYT

SEQ ID NO: 371942 - protein, 10 aa, Influenza virus
VTNVQNDYTT

SEQ ID NO: 371943 - protein, 10 aa, Influenza virus
THVQNNYTTV

SEQ ID NO: 371944 - protein, 10 aa, Influenza virus
LCPIKGWAPL

SEQ ID NO: 371945 - protein, 10 aa, Influenza virus
CPIKGWAPLS

SEQ ID NO: 371946 - protein, 10 aa, Influenza virus
PIKGWAPLSK

SEQ ID NO: 371947 - protein, 10 aa, Influenza virus
IKGWAPLSKD

SEQ ID NO: 371948 - protein, 10 aa, Influenza virus
EVSVIREPFI

SEQ ID NO: 371949 - protein, 10 aa, Influenza virus
VSVIREPFIS

SEQ ID NO: 371950 - protein, 10 aa, Influenza virus
FVIREPCISC

SEQ ID NO: 371951 - protein, 10 aa, Influenza virus
IREPFVSCSI

SEQ ID NO: 371952 - protein, 10 aa, Influenza virus
ISCSIDECRT

SEQ ID NO: 371953 - protein, 10 aa, Influenza virus
SCSIDECRTF

SEQ ID NO: 371954 - protein, 10 aa, Influenza virus
CSIDECRTFF

SEQ ID NO: 371955 - protein, 10 aa, Influenza virus
SIDECRTFFL

SEQ ID NO: 371956 - protein, 10 aa, Influenza virus
IDECRTFFLT

SEQ ID NO: 371957 - protein, 10 aa, Influenza virus
DECRTFFLTQ

SEQ ID NO: 371958 - protein, 10 aa, Influenza virus
PFRTLMSCPV

SEQ ID NO: 371959 - protein, 10 aa, Influenza virus
FRTLMSCPVG

SEQ ID NO: 371960 - protein, 10 aa, Influenza virus
RTLMSCPVGV

SEQ ID NO: 371961 - protein, 10 aa, Influenza virus
TLMSCPVGVA

SEQ ID NO: 371962 - protein, 10 aa, Influenza virus
LMSCPVGVAP

SEQ ID NO: 371963 - protein, 10 aa, Influenza virus
MSCPVGVAPS

SEQ ID NO: 371964 - protein, 10 aa, Influenza virus
SCPVGVAPSP

SEQ ID NO: 371965 - protein, 10 aa, Influenza virus
CPVGVAPSPS

SEQ ID NO: 371966 - protein, 10 aa, Influenza virus
PVGVAPSPSN

SEQ ID NO: 371967 - protein, 10 aa, Influenza virus
VGVAPSPSNS

SEQ ID NO: 371968 - protein, 10 aa, Influenza virus
CSDGSGWLTL

SEQ ID NO: 371969 - protein, 10 aa, Influenza virus
SDGSGWLTLG

SEQ ID NO: 371970 - protein, 10 aa, Influenza virus
DGSGWLTLGI

SEQ ID NO: 371971 - protein, 10 aa, Influenza virus
GSGWLTLGIT

SEQ ID NO: 371972 - protein, 10 aa, Influenza virus
SGWLTLGITG

SEQ ID NO: 371973 - protein, 10 aa, Influenza virus
LTLGITGPDT

SEQ ID NO: 371974 - protein, 10 aa, Influenza virus
TLGITGPDTT

SEQ ID NO: 371975 - protein, 10 aa, Influenza virus
LGITGPDTTA

SEQ ID NO: 371976 - protein, 10 aa, Influenza virus
GITGPDTTAV

SEQ ID NO: 371977 - protein, 10 aa, Influenza virus
ITGPDTTAVA

SEQ ID NO: 371978 - protein, 10 aa, Influenza virus
TGPDTTAVAV

SEQ ID NO: 371979 - protein, 10 aa, Influenza virus
GPDTTAVAVL

SEQ ID NO: 371980 - protein, 10 aa, Influenza virus
PDTTAVAVLK

SEQ ID NO: 371981 - protein, 10 aa, Influenza virus
DTTAVAVLKY

SEQ ID NO: 371982 - protein, 10 aa, Influenza virus
TTAVAVLKYN

SEQ ID NO: 371983 - protein, 10 aa, Influenza virus
AVAVLKYNGV

SEQ ID NO: 371984 - protein, 10 aa, Influenza virus
VAVLKYNGVI

SEQ ID NO: 371985 - protein, 10 aa, Influenza virus
AVLKYNGVIT

SEQ ID NO: 371986 - protein, 10 aa, Influenza virus
VLKYNGVITD

SEQ ID NO: 371987 - protein, 10 aa, Influenza virus
LKYNGVITDT

SEQ ID NO: 371988 - protein, 10 aa, Influenza virus
KYNGIITDTF

SEQ ID NO: 371989 - protein, 10 aa, Influenza virus
YNGIITDTFK

SEQ ID NO: 371990 - protein, 10 aa, Influenza virus
NGIITDTFKS

SEQ ID NO: 371991 - protein, 10 aa, Influenza virus
GIITDTFKSW

SEQ ID NO: 371992 - protein, 10 aa, Influenza virus
IITDTFKSWK

SEQ ID NO: 371993 - protein, 10 aa, Influenza virus
CQDEFCYTLV

SEQ ID NO: 371994 - protein, 10 aa, Influenza virus
QDEFCYTLVT

SEQ ID NO: 371995 - protein, 10 aa, Influenza virus
DEFCYTLVTD

SEQ ID NO: 371996 - protein, 10 aa, Influenza virus
EFCYTLVTDG

SEQ ID NO: 371997 - protein, 10 aa, Influenza virus
FCYTLVTDGP

SEQ ID NO: 371998 - protein, 10 aa, Influenza virus
CYTLVTDGPS

SEQ ID NO: 371999 - protein, 10 aa, Influenza virus
YTLVTDGPSD

SEQ ID NO: 372000 - protein, 10 aa, Influenza virus
TLITDGPSNA

SEQ ID NO: 372001 - protein, 10 aa, Influenza virus
LITDGPSNAQ

SEQ ID NO: 372002 - protein, 10 aa, Influenza virus
ITDGPSNAQA

SEQ ID NO: 372003 - protein, 10 aa, Influenza virus
PSDAQAFYKL

SEQ ID NO: 372004 - protein, 10 aa, Influenza virus
SDAQAFYKLL

SEQ ID NO: 372005 - protein, 10 aa, Influenza virus
DGQAFYKILK

SEQ ID NO: 372006 - protein, 10 aa, Influenza virus
KILKIKKGKL

SEQ ID NO: 372007 - protein, 10 aa, Influenza virus
ILKIRKGKIM

SEQ ID NO: 372008 - protein, 10 aa, Influenza virus
APGFHFEECS

SEQ ID NO: 372009 - protein, 10 aa, Influenza virus
PGFHFEECSC

SEQ ID NO: 372010 - protein, 10 aa, Influenza virus
ECSCYPSGES

SEQ ID NO: 372011 - protein, 10 aa, Influenza virus
DVECVCRDNW

SEQ ID NO: 372012 - protein, 10 aa, Influenza virus
RPWIRFNSDP

SEQ ID NO: 372013 - protein, 10 aa, Influenza virus
PWVRFNSDLD

SEQ ID NO: 372014 - protein, 10 aa, Influenza virus
WVRFNSDLDY

SEQ ID NO: 372015 - protein, 10 aa, Influenza virus
IRFNSDPDYQ

SEQ ID NO: 372016 - protein, 10 aa, Influenza virus
RFNSDPDYQI

SEQ ID NO: 372017 - protein, 10 aa, Influenza virus
FNSDPDYQIG

SEQ ID NO: 372018 - protein, 10 aa, Influenza virus
NSDLNYQIGY

SEQ ID NO: 372019 - protein, 10 aa, Influenza virus
SNLDYQIGYV

SEQ ID NO: 372020 - protein, 10 aa, Influenza virus
NLDYQIGYVC

SEQ ID NO: 372021 - protein, 10 aa, Influenza virus
PDYQIGYVCS

SEQ ID NO: 372022 - protein, 10 aa, Influenza virus
YQIGYICSGV

SEQ ID NO: 372023 - protein, 10 aa, Influenza virus
QIGYICSGVF

SEQ ID NO: 372024 - protein, 10 aa, Influenza virus
IGYICSGVFG

SEQ ID NO: 372025 - protein, 10 aa, Influenza virus
GYICSGVFGD

SEQ ID NO: 372026 - protein, 10 aa, Influenza virus
YICSGVFGDN

SEQ ID NO: 372027 - protein, 10 aa, Influenza virus
ICSGVFGDNP

SEQ ID NO: 372028 - protein, 10 aa, Influenza virus
SGIFGDSPRP

SEQ ID NO: 372029 - protein, 10 aa, Influenza virus
FGDNPRPMDS

SEQ ID NO: 372030 - protein, 10 aa, Influenza virus
PRPVDGIGSC

SEQ ID NO: 372031 - protein, 10 aa, Influenza virus
SPINNGKGRY

SEQ ID NO: 372032 - protein, 10 aa, Influenza virus
RSGFEMVWDD

SEQ ID NO: 372033 - protein, 10 aa, Influenza virus
RGFEMVWDAN

SEQ ID NO: 372034 - protein, 10 aa, Influenza virus
MVWDANGWVT

SEQ ID NO: 372035 - protein, 10 aa, Influenza virus
VWDDNGWVST

SEQ ID NO: 372036 - protein, 10 aa, Influenza virus
DNGWVSTDKD

SEQ ID NO: 372037 - protein, 10 aa, Influenza virus
NGWVTADKDS

SEQ ID NO: 372038 - protein, 10 aa, Influenza virus
GWVSTDKSSN

SEQ ID NO: 372039 - protein, 10 aa, Influenza virus
WVSTDKSSNG

SEQ ID NO: 372040 - protein, 10 aa, Influenza virus
VTADKDSNGV

SEQ ID NO: 372041 - protein, 10 aa, Influenza virus
TADKDSNGVQ

SEQ ID NO: 372042 - protein, 10 aa, Influenza virus
TDKSSNGVQD

SEQ ID NO: 372043 - protein, 10 aa, Influenza virus
WETTGRNCTV

SEQ ID NO: 372044 - protein, 10 aa, Influenza virus
MIRGQPNERT

SEQ ID NO: 372045 - protein, 10 aa, Influenza virus
IRGQPKERTI

SEQ ID NO: 372046 - protein, 10 aa, Influenza virus
RGQPKERTIW

SEQ ID NO: 372047 - protein, 10 aa, Influenza virus
GQPKERTIWT

SEQ ID NO: 372048 - protein, 10 aa, Influenza virus
QPKERTIWTS

SEQ ID NO: 372049 - protein, 10 aa, Influenza virus
PKERTIWTSG

SEQ ID NO: 372050 - protein, 10 aa, Influenza virus
NERTIWTSGS

SEQ ID NO: 372051 - protein, 10 aa, Influenza virus
ERTIWTSGSS

SEQ ID NO: 372052 - protein, 10 aa, Influenza virus
RTIWTSGSSI

SEQ ID NO: 372053 - protein, 10 aa, Influenza virus
SIAFCGVNSN

SEQ ID NO: 372054 - protein, 10 aa, Influenza virus
IAFCGVNSNT

SEQ ID NO: 372055 - protein, 10 aa, Influenza virus
FCGVDSDTTS

SEQ ID NO: 372056 - protein, 10 aa, Influenza virus
CGVDSDTTSW

SEQ ID NO: 372057 - protein, 10 aa, Influenza virus
SDTTCWSWPD

SEQ ID NO: 372058 - protein, 10 aa, Influenza virus
DTTCWSWPDG

SEQ ID NO: 372059 - protein, 10 aa, Influenza virus
TTGWPWPDGA

SEQ ID NO: 372060 - protein, 10 aa, Influenza virus
TGWPWPDGAL

SEQ ID NO: 372061 - protein, 10 aa, Influenza virus
GWPWPDGALL

SEQ ID NO: 372062 - protein, 10 aa, Influenza virus
SWPDGALFPL

SEQ ID NO: 372063 - protein, 10 aa, Influenza virus
NQKIITIGSA

SEQ ID NO: 372064 - protein, 10 aa, Influenza virus
QKIITIGSAS

SEQ ID NO: 372065 - protein, 10 aa, Influenza virus
KIITIGSASL

SEQ ID NO: 372066 - protein, 10 aa, Influenza virus
IITIGSASLG

SEQ ID NO: 372067 - protein, 10 aa, Influenza virus
ITEIYNETVR

SEQ ID NO: 372068 - protein, 10 aa, Influenza virus
TEVYNETVRV

SEQ ID NO: 372069 - protein, 10 aa, Influenza virus
EFFNNTEPLC

SEQ ID NO: 372070 - protein, 10 aa, Influenza virus
FLNNTEPLCD

SEQ ID NO: 372071 - protein, 10 aa, Influenza virus
LNNTEPLCDV

SEQ ID NO: 372072 - protein, 10 aa, Influenza virus
NNTEPLCDVS

SEQ ID NO: 372073 - protein, 10 aa, Influenza virus
NTEPLCDVSG

SEQ ID NO: 372074 - protein, 10 aa, Influenza virus
TEPLCDVSGF

SEQ ID NO: 372075 - protein, 10 aa, Influenza virus
EPLCDVSGFA

SEQ ID NO: 372076 - protein, 10 aa, Influenza virus
PLCDVSGFAI

SEQ ID NO: 372077 - protein, 10 aa, Influenza virus
SGFAIFSKDN

SEQ ID NO: 372078 - protein, 10 aa, Influenza virus
GFAIISKDNG

SEQ ID NO: 372079 - protein, 10 aa, Influenza virus
FAIFSKDNGI

SEQ ID NO: 372080 - protein, 10 aa, Influenza virus
AIISKDNGIR

SEQ ID NO: 372081 - protein, 10 aa, Influenza virus
IISKDNGIRI

SEQ ID NO: 372082 - protein, 10 aa, Influenza virus
FSKDNGIRIG

SEQ ID NO: 372083 - protein, 10 aa, Influenza virus
GIRVGSRGHV

SEQ ID NO: 372084 - protein, 10 aa, Influenza virus
IRVGSRGHVF

SEQ ID NO: 372085 - protein, 10 aa, Influenza virus
RVGSRGHVFV

SEQ ID NO: 372086 - protein, 10 aa, Influenza virus
VGSRGHVFVI

SEQ ID NO: 372087 - protein, 10 aa, Influenza virus
IFVIREPFVA

SEQ ID NO: 372088 - protein, 10 aa, Influenza virus
VIREPFVACS

SEQ ID NO: 372089 - protein, 10 aa, Influenza virus
IREPFVACSP

SEQ ID NO: 372090 - protein, 10 aa, Influenza virus
REPFVSCGPS

SEQ ID NO: 372091 - protein, 10 aa, Influenza virus
EPFVSCGPSE

SEQ ID NO: 372092 - protein, 10 aa, Influenza virus
PFVSCGPSEC

SEQ ID NO: 372093 - protein, 10 aa, Influenza virus
FVSCGPSECR

SEQ ID NO: 372094 - protein, 10 aa, Influenza virus
VSCGPSECRT

SEQ ID NO: 372095 - protein, 10 aa, Influenza virus
SCGPSECRTF

SEQ ID NO: 372096 - protein, 10 aa, Influenza virus
CGPAECRTFF

SEQ ID NO: 372097 - protein, 10 aa, Influenza virus
GPAECRTFFL

SEQ ID NO: 372098 - protein, 10 aa, Influenza virus
PAECRTFFLT

SEQ ID NO: 372099 - protein, 10 aa, Influenza virus
AECRTFFLTQ

SEQ ID NO: 372100 - protein, 10 aa, Influenza virus
LMSVPLGSSS

SEQ ID NO: 372101 - protein, 10 aa, Influenza virus
MSVPMGSSPN

SEQ ID NO: 372102 - protein, 10 aa, Influenza virus
SVPLGSSSNA

SEQ ID NO: 372103 - protein, 10 aa, Influenza virus
VPLGSSSNAY

SEQ ID NO: 372104 - protein, 10 aa, Influenza virus
PLGSSSNAYQ

SEQ ID NO: 372105 - protein, 10 aa, Influenza virus
GSSPNAYQAQ

SEQ ID NO: 372106 - protein, 10 aa, Influenza virus
SSSNAYQAKF

SEQ ID NO: 372107 - protein, 10 aa, Influenza virus
SPNAYQAQFE

SEQ ID NO: 372108 - protein, 10 aa, Influenza virus
SNAYQAKFES

SEQ ID NO: 372109 - protein, 10 aa, Influenza virus
NAYQAQFESV

SEQ ID NO: 372110 - protein, 10 aa, Influenza virus
FESIAWSATA

SEQ ID NO: 372111 - protein, 10 aa, Influenza virus
ESIAWSATAC

SEQ ID NO: 372112 - protein, 10 aa, Influenza virus
SIAWSATACH

SEQ ID NO: 372113 - protein, 10 aa, Influenza virus
VEWSATACHD

SEQ ID NO: 372114 - protein, 10 aa, Influenza virus
SATACHDGKG

SEQ ID NO: 372115 - protein, 10 aa, Influenza virus
ATACHDGKGW

SEQ ID NO: 372116 - protein, 10 aa, Influenza virus
TACHDGKEWM

SEQ ID NO: 372117 - protein, 10 aa, Influenza virus
GVSGADNDAY

SEQ ID NO: 372118 - protein, 10 aa, Influenza virus
VSGADNDAYA

SEQ ID NO: 372119 - protein, 10 aa, Influenza virus
SGADDEAYAV

SEQ ID NO: 372120 - protein, 10 aa, Influenza virus
GADDEAYAVI

SEQ ID NO: 372121 - protein, 10 aa, Influenza virus
ADDEAYAVIH

SEQ ID NO: 372122 - protein, 10 aa, Influenza virus
AYAVIHYGGI

SEQ ID NO: 372123 - protein, 10 aa, Influenza virus
YAVIHYGGIP

SEQ ID NO: 372124 - protein, 10 aa, Influenza virus
AVIHYGGIPT

SEQ ID NO: 372125 - protein, 10 aa, Influenza virus
VIHYGGIPTD

SEQ ID NO: 372126 - protein, 10 aa, Influenza virus
IHYGGIPTDV

SEQ ID NO: 372127 - protein, 10 aa, Influenza virus
HYGGIPTDVV

SEQ ID NO: 372128 - protein, 10 aa, Influenza virus
YGGIPTDVVR

SEQ ID NO: 372129 - protein, 10 aa, Influenza virus
GGIPTDVVRS

SEQ ID NO: 372130 - protein, 10 aa, Influenza virus
GIPTDVVRSW

SEQ ID NO: 372131 - protein, 10 aa, Influenza virus
PTDVIRSWRK

SEQ ID NO: 372132 - protein, 10 aa, Influenza virus
TDVIRSWRKQ

SEQ ID NO: 372133 - protein, 10 aa, Influenza virus
DVIRSWRKQI

SEQ ID NO: 372134 - protein, 10 aa, Influenza virus
VIRSWRKQIL

SEQ ID NO: 372135 - protein, 10 aa, Influenza virus
IRSWRKQILR

SEQ ID NO: 372136 - protein, 10 aa, Influenza virus
RSWRKKILRT

SEQ ID NO: 372137 - protein, 10 aa, Influenza virus
SWRKKILRTQ

SEQ ID NO: 372138 - protein, 10 aa, Influenza virus
WRKKILRTQE

SEQ ID NO: 372139 - protein, 10 aa, Influenza virus
RKKILRTQES

SEQ ID NO: 372140 - protein, 10 aa, Influenza virus
RQILRTQESS

SEQ ID NO: 372141 - protein, 10 aa, Influenza virus
RTQESSCVCI

SEQ ID NO: 372142 - protein, 10 aa, Influenza virus
TQESSCVCVK

SEQ ID NO: 372143 - protein, 10 aa, Influenza virus
QESSCVCVKG

SEQ ID NO: 372144 - protein, 10 aa, Influenza virus
WVMTDGPANK

SEQ ID NO: 372145 - protein, 10 aa, Influenza virus
VMTDGPANKQ

SEQ ID NO: 372146 - protein, 10 aa, Influenza virus
MTDGPANKQA

SEQ ID NO: 372147 - protein, 10 aa, Influenza virus
TDGPANKQAS

SEQ ID NO: 372148 - protein, 10 aa, Influenza virus
DGPANKQASY

SEQ ID NO: 372149 - protein, 10 aa, Influenza virus
GPANKQASYK

SEQ ID NO: 372150 - protein, 10 aa, Influenza virus
PANKQASYKI

SEQ ID NO: 372151 - protein, 10 aa, Influenza virus
ANKQASYKIF

SEQ ID NO: 372152 - protein, 10 aa, Influenza virus
SNQASYKIFK

SEQ ID NO: 372153 - protein, 10 aa, Influenza virus
KQASYKIFKS

SEQ ID NO: 372154 - protein, 10 aa, Influenza virus
QASYKIFKSY

SEQ ID NO: 372155 - protein, 10 aa, Influenza virus
EVLFQGGHIE

SEQ ID NO: 372156 - protein, 10 aa, Influenza virus
VLFQGGHIEE

SEQ ID NO: 372157 - protein, 10 aa, Influenza virus
SFQSGHIEEC

SEQ ID NO: 372158 - protein, 10 aa, Influenza virus
IEECSCYPNS

SEQ ID NO: 372159 - protein, 10 aa, Influenza virus
EECSCYPNSG

SEQ ID NO: 372160 - protein, 10 aa, Influenza virus
ECSCYPNSGK

SEQ ID NO: 372161 - protein, 10 aa, Influenza virus
CSCYPNSGKV

SEQ ID NO: 372162 - protein, 10 aa, Influenza virus
SCYPNSGKVE

SEQ ID NO: 372163 - protein, 10 aa, Influenza virus
CYPNSGKVEC

SEQ ID NO: 372164 - protein, 10 aa, Influenza virus
YPNSGKVECV

SEQ ID NO: 372165 - protein, 10 aa, Influenza virus
PNSGKVECVC

SEQ ID NO: 372166 - protein, 10 aa, Influenza virus
NSGKVECVCR

SEQ ID NO: 372167 - protein, 10 aa, Influenza virus
SGKVECVCRD

SEQ ID NO: 372168 - protein, 10 aa, Influenza virus
CQVECVCRDN

SEQ ID NO: 372169 - protein, 10 aa, Influenza virus
YDVGYLCAGI

SEQ ID NO: 372170 - protein, 10 aa, Influenza virus
DVGYLCAGIP

SEQ ID NO: 372171 - protein, 10 aa, Influenza virus
PTDTPRIQDS

SEQ ID NO: 372172 - protein, 10 aa, Influenza virus
AVGGSGTDNY

SEQ ID NO: 372173 - protein, 10 aa, Influenza virus
VGGSGTDNYG

SEQ ID NO: 372174 - protein, 10 aa, Influenza virus
KGFAFKQGNS

SEQ ID NO: 372175 - protein, 10 aa, Influenza virus
GFAFKQGNSV

SEQ ID NO: 372176 - protein, 10 aa, Influenza virus
FGFRQGNNVW

SEQ ID NO: 372177 - protein, 10 aa, Influenza virus
AFKQGNSVWA

SEQ ID NO: 372178 - protein, 10 aa, Influenza virus
FKQGNSVWAG

SEQ ID NO: 372179 - protein, 10 aa, Influenza virus
RQGNNVWAGR

SEQ ID NO: 372180 - protein, 10 aa, Influenza virus
GTSVWAGRTI

SEQ ID NO: 372181 - protein, 10 aa, Influenza virus
SSRSGFEVLF

SEQ ID NO: 372182 - protein, 10 aa, Influenza virus
SRSGFEVLFI

SEQ ID NO: 372183 - protein, 10 aa, Influenza virus
RSGFEVLFIE

SEQ ID NO: 372184 - protein, 10 aa, Influenza virus
SGFEILLIEE

SEQ ID NO: 372185 - protein, 10 aa, Influenza virus
GFEILLIEEG

SEQ ID NO: 372186 - protein, 10 aa, Influenza virus
FEILLIEEGW

SEQ ID NO: 372187 - protein, 10 aa, Influenza virus
EVLNNRNWSG

SEQ ID NO: 372188 - protein, 10 aa, Influenza virus
VLDNKNWSGY

SEQ ID NO: 372189 - protein, 10 aa, Influenza virus
LNNMNWSGYS

SEQ ID NO: 372190 - protein, 10 aa, Influenza virus
NNMNWSGYSG

SEQ ID NO: 372191 - protein, 10 aa, Influenza virus
NRNWSGYSGS

SEQ ID NO: 372192 - protein, 10 aa, Influenza virus
KHWSGYSGSF

SEQ ID NO: 372193 - protein, 10 aa, Influenza virus
WSGYSGAFTV

SEQ ID NO: 372194 - protein, 10 aa, Influenza virus
SGYSGAFTVP

SEQ ID NO: 372195 - protein, 10 aa, Influenza virus
GYSGSFTIPT

SEQ ID NO: 372196 - protein, 10 aa, Influenza virus
WLEMIRGKPK

SEQ ID NO: 372197 - protein, 10 aa, Influenza virus
LEMIRGKPKE

SEQ ID NO: 372198 - protein, 10 aa, Influenza virus
EMIRGKPEEG

SEQ ID NO: 372199 - protein, 10 aa, Influenza virus
PKERTSIWTS

SEQ ID NO: 372200 - protein, 10 aa, Influenza virus
KERTSIWTSS

SEQ ID NO: 372201 - protein, 10 aa, Influenza virus
ERPSIWTSSS

SEQ ID NO: 372202 - protein, 10 aa, Influenza virus
RNSIWTSSSS

SEQ ID NO: 372203 - protein, 10 aa, Influenza virus
TSIWTSSSSM

SEQ ID NO: 372204 - protein, 10 aa, Influenza virus
TVFCGVSSEA

SEQ ID NO: 372205 - protein, 10 aa, Influenza virus
FCGVSSEVPE

SEQ ID NO: 372206 - protein, 10 aa, Influenza virus
CGVSSEVPGC

SEQ ID NO: 372207 - protein, 10 aa, Influenza virus
GVSSEVPGCT

SEQ ID NO: 372208 - protein, 10 aa, Influenza virus
VSSEAPGWSW

SEQ ID NO: 372209 - protein, 10 aa, Influenza virus
SSEAPGWSWD

SEQ ID NO: 372210 - protein, 10 aa, Influenza virus
SEVPEWSWDD

SEQ ID NO: 372211 - protein, 10 aa, Influenza virus
EAPGWSWDDG

SEQ ID NO: 372212 - protein, 10 aa, Influenza virus
APGWSWDDGA

SEQ ID NO: 372213 - protein, 10 aa, Influenza virus
WDDGAILPLT

SEQ ID NO: 372214 - protein, 10 aa, Influenza virus
DDGAILPFGI

SEQ ID NO: 372215 - protein, 10 aa, Influenza virus
MNPNQKIMCI

SEQ ID NO: 372216 - protein, 10 aa, Influenza virus
NPNQKIMCIS

SEQ ID NO: 372217 - protein, 10 aa, Influenza virus
PNQKIMCISA

SEQ ID NO: 372218 - protein, 10 aa, Influenza virus
CISTTGMTLS

SEQ ID NO: 372219 - protein, 10 aa, Influenza virus
ISTTGMTLSV

SEQ ID NO: 372220 - protein, 10 aa, Influenza virus
STTGMTLSVV

SEQ ID NO: 372221 - protein, 10 aa, Influenza virus
TGMILSVVSL

SEQ ID NO: 372222 - protein, 10 aa, Influenza virus
GMILSVVSLL

SEQ ID NO: 372223 - protein, 10 aa, Influenza virus
GVANLGLNIG

SEQ ID NO: 372224 - protein, 10 aa, Influenza virus
ANLGLNVGLH

SEQ ID NO: 372225 - protein, 10 aa, Influenza virus
KPLCAVNSWH

SEQ ID NO: 372226 - protein, 10 aa, Influenza virus
PLCAVNSWHI

SEQ ID NO: 372227 - protein, 10 aa, Influenza virus
LCAVNSWHIL

SEQ ID NO: 372228 - protein, 10 aa, Influenza virus
CAVNSWHILS

SEQ ID NO: 372229 - protein, 10 aa, Influenza virus
AVNSWHILSK

SEQ ID NO: 372230 - protein, 10 aa, Influenza virus
VNSWHIFSKD

SEQ ID NO: 372231 - protein, 10 aa, Influenza virus
NSWHIFSKDN

SEQ ID NO: 372232 - protein, 10 aa, Influenza virus
WHILSKDNAV

SEQ ID NO: 372233 - protein, 10 aa, Influenza virus
HILSKDNAVR

SEQ ID NO: 372234 - protein, 10 aa, Influenza virus
KDNAIRIGEE

SEQ ID NO: 372235 - protein, 10 aa, Influenza virus
DNAIRIGEEA

SEQ ID NO: 372236 - protein, 10 aa, Influenza virus
NAIRIGEEAH

SEQ ID NO: 372237 - protein, 10 aa, Influenza virus
EAHILVTREP

SEQ ID NO: 372238 - protein, 10 aa, Influenza virus
ECRIFALSQG

SEQ ID NO: 372239 - protein, 10 aa, Influenza virus
LSQGTTLKGR

SEQ ID NO: 372240 - protein, 10 aa, Influenza virus
SQGTTLKGRH

SEQ ID NO: 372241 - protein, 10 aa, Influenza virus
QGTTLKGRHA

SEQ ID NO: 372242 - protein, 10 aa, Influenza virus
GTTLKGRHAN

SEQ ID NO: 372243 - protein, 10 aa, Influenza virus
TTLKGRHANG

SEQ ID NO: 372244 - protein, 10 aa, Influenza virus
TLKGRHANGT

SEQ ID NO: 372245 - protein, 10 aa, Influenza virus
LRGRHANGTM

SEQ ID NO: 372246 - protein, 10 aa, Influenza virus
RGRHANGTIN

SEQ ID NO: 372247 - protein, 10 aa, Influenza virus
GRHANGTMHD

SEQ ID NO: 372248 - protein, 10 aa, Influenza virus
RHANGTMHDR

SEQ ID NO: 372249 - protein, 10 aa, Influenza virus
HANGTINDRS

SEQ ID NO: 372250 - protein, 10 aa, Influenza virus
ANGTMHDRSP

SEQ ID NO: 372251 - protein, 10 aa, Influenza virus
NGTIHDRSPY

SEQ ID NO: 372252 - protein, 10 aa, Influenza virus
GTIHDRSPYR

SEQ ID NO: 372253 - protein, 10 aa, Influenza virus
TIHDRSPYRA

SEQ ID NO: 372254 - protein, 10 aa, Influenza virus
IHDRSPYRAL

SEQ ID NO: 372255 - protein, 10 aa, Influenza virus
HDRSQFRALI

SEQ ID NO: 372256 - protein, 10 aa, Influenza virus
DRSQFRALIS

SEQ ID NO: 372257 - protein, 10 aa, Influenza virus
RSQFRALISW

SEQ ID NO: 372258 - protein, 10 aa, Influenza virus
SQFRALISWE

SEQ ID NO: 372259 - protein, 10 aa, Influenza virus
QFRALISWEM

SEQ ID NO: 372260 - protein, 10 aa, Influenza virus
YRALISWEMG

SEQ ID NO: 372261 - protein, 10 aa, Influenza virus
RALISWGMGQ

SEQ ID NO: 372262 - protein, 10 aa, Influenza virus
ALISWGMGQA

SEQ ID NO: 372263 - protein, 10 aa, Influenza virus
LISWGMGQAP

SEQ ID NO: 372264 - protein, 10 aa, Influenza virus
ISWGMGQAPS

SEQ ID NO: 372265 - protein, 10 aa, Influenza virus
SWEMGLAPSP

SEQ ID NO: 372266 - protein, 10 aa, Influenza virus
WEMGLAPSPY

SEQ ID NO: 372267 - protein, 10 aa, Influenza virus
EMGQAPSPYT

SEQ ID NO: 372268 - protein, 10 aa, Influenza virus
IECIGWSSTS

SEQ ID NO: 372269 - protein, 10 aa, Influenza virus
WSSTSCHDGV

SEQ ID NO: 372270 - protein, 10 aa, Influenza virus
SSTSCHDGVS

SEQ ID NO: 372271 - protein, 10 aa, Influenza virus
STSCHDGVSR

SEQ ID NO: 372272 - protein, 10 aa, Influenza virus
TSCHDGVSRM

SEQ ID NO: 372273 - protein, 10 aa, Influenza virus
SCHDGVSRMS

SEQ ID NO: 372274 - protein, 10 aa, Influenza virus
SRMSVCMSGP

SEQ ID NO: 372275 - protein, 10 aa, Influenza virus
RMSVCMSGPN

SEQ ID NO: 372276 - protein, 10 aa, Influenza virus
MSICMSGPND

SEQ ID NO: 372277 - protein, 10 aa, Influenza virus
SICMSGPNDN

SEQ ID NO: 372278 - protein, 10 aa, Influenza virus
ICMSGPNDNA

SEQ ID NO: 372279 - protein, 10 aa, Influenza virus
CMSGPNDNAS

SEQ ID NO: 372280 - protein, 10 aa, Influenza virus
MSGPNDNASA

SEQ ID NO: 372281 - protein, 10 aa, Influenza virus
GPNNNASAVI

SEQ ID NO: 372282 - protein, 10 aa, Influenza virus
PNNNASAVIW

SEQ ID NO: 372283 - protein, 10 aa, Influenza virus
NNNASAVIWY

SEQ ID NO: 372284 - protein, 10 aa, Influenza virus
TEIPSWEGNI

SEQ ID NO: 372285 - protein, 10 aa, Influenza virus
EIPSWEGNIL

SEQ ID NO: 372286 - protein, 10 aa, Influenza virus
IPSWEGNILR

SEQ ID NO: 372287 - protein, 10 aa, Influenza virus
PSWEGNILRT

SEQ ID NO: 372288 - protein, 10 aa, Influenza virus
SWAGNVLRTQ

SEQ ID NO: 372289 - protein, 10 aa, Influenza virus
ESECVCHKGV

SEQ ID NO: 372290 - protein, 10 aa, Influenza virus
SECVCHKGVC

SEQ ID NO: 372291 - protein, 10 aa, Influenza virus
ECVCHKGVCP

SEQ ID NO: 372292 - protein, 10 aa, Influenza virus
CVCHKGVCPV

SEQ ID NO: 372293 - protein, 10 aa, Influenza virus
VCHKGVCPVV

SEQ ID NO: 372294 - protein, 10 aa, Influenza virus
PVVMTDGPAD

SEQ ID NO: 372295 - protein, 10 aa, Influenza virus
GSAEHIEECS

SEQ ID NO: 372296 - protein, 10 aa, Influenza virus
SAEHIEECSC

SEQ ID NO: 372297 - protein, 10 aa, Influenza virus
IKCVCRDNWK

SEQ ID NO: 372298 - protein, 10 aa, Influenza virus
KCICRDNWRG

SEQ ID NO: 372299 - protein, 10 aa, Influenza virus
CICRDNWRGA

SEQ ID NO: 372300 - protein, 10 aa, Influenza virus
ICRDNWRGAN

SEQ ID NO: 372301 - protein, 10 aa, Influenza virus
DNWRGANRPV

SEQ ID NO: 372302 - protein, 10 aa, Influenza virus
NWRGANRPVI

SEQ ID NO: 372303 - protein, 10 aa, Influenza virus
WKGANRPVII

SEQ ID NO: 372304 - protein, 10 aa, Influenza virus
KGANRPVIII

SEQ ID NO: 372305 - protein, 10 aa, Influenza virus
GANRPVIIID

SEQ ID NO: 372306 - protein, 10 aa, Influenza virus
MTHTSRYLCS

SEQ ID NO: 372307 - protein, 10 aa, Influenza virus
YLCSRILTDT

SEQ ID NO: 372308 - protein, 10 aa, Influenza virus
LCSRILTDTS

SEQ ID NO: 372309 - protein, 10 aa, Influenza virus
CSRILTDTSR

SEQ ID NO: 372310 - protein, 10 aa, Influenza virus
SRILTDTSRP

SEQ ID NO: 372311 - protein, 10 aa, Influenza virus
LTDTSRPTDP

SEQ ID NO: 372312 - protein, 10 aa, Influenza virus
GGTPDPGVKG

SEQ ID NO: 372313 - protein, 10 aa, Influenza virus
GTPDPGVKGF

SEQ ID NO: 372314 - protein, 10 aa, Influenza virus
TPDPGVKGFA

SEQ ID NO: 372315 - protein, 10 aa, Influenza virus
PGIKGFAFLD

SEQ ID NO: 372316 - protein, 10 aa, Influenza virus
GVKGFAFLDE

SEQ ID NO: 372317 - protein, 10 aa, Influenza virus
WLGRTISKDL

SEQ ID NO: 372318 - protein, 10 aa, Influenza virus
LGRTISKDLR

SEQ ID NO: 372319 - protein, 10 aa, Influenza virus
GRTISKDLRS

SEQ ID NO: 372320 - protein, 10 aa, Influenza virus
RTISKDLRSG

SEQ ID NO: 372321 - protein, 10 aa, Influenza virus
TISKDLRSGY

SEQ ID NO: 372322 - protein, 10 aa, Influenza virus
ISKDLRSGYE

SEQ ID NO: 372323 - protein, 10 aa, Influenza virus
DSRSGYEILK

SEQ ID NO: 372324 - protein, 10 aa, Influenza virus
SRSGYEILKV

SEQ ID NO: 372325 - protein, 10 aa, Influenza virus
RSGYEILKVP

SEQ ID NO: 372326 - protein, 10 aa, Influenza virus
SGYEILKVPN

SEQ ID NO: 372327 - protein, 10 aa, Influenza virus
GYEILKVPNA

SEQ ID NO: 372328 - protein, 10 aa, Influenza virus
YEILKVPNAE

SEQ ID NO: 372329 - protein, 10 aa, Influenza virus
IINNQNWSGY

SEQ ID NO: 372330 - protein, 10 aa, Influenza virus
INNQNWSGYS

SEQ ID NO: 372331 - protein, 10 aa, Influenza virus
DNQNWSGYSG

SEQ ID NO: 372332 - protein, 10 aa, Influenza virus
NQDWSGYSGA

SEQ ID NO: 372333 - protein, 10 aa, Influenza virus
QDWSGYSGAF

SEQ ID NO: 372334 - protein, 10 aa, Influenza virus
DWSGYSGAFI

SEQ ID NO: 372335 - protein, 10 aa, Influenza virus
WSGYSGAFMD

SEQ ID NO: 372336 - protein, 10 aa, Influenza virus
SGYSGAFMDY

SEQ ID NO: 372337 - protein, 10 aa, Influenza virus
GYSGAFMDYW

SEQ ID NO: 372338 - protein, 10 aa, Influenza virus
KKCFNPCFYV

SEQ ID NO: 372339 - protein, 10 aa, Influenza virus
YVELIRGRPR

SEQ ID NO: 372340 - protein, 10 aa, Influenza virus
VELIRGRPRE

SEQ ID NO: 372341 - protein, 10 aa, Influenza virus
ELIRGMPKES

SEQ ID NO: 372342 - protein, 10 aa, Influenza virus
VLWTSNSMVA

SEQ ID NO: 372343 - protein, 10 aa, Influenza virus
LWTSNSMVAL

SEQ ID NO: 372344 - protein, 10 aa, Influenza virus
SIVALCGSKK

SEQ ID NO: 372345 - protein, 10 aa, Influenza virus
IVALCGSKEQ

SEQ ID NO: 372346 - protein, 10 aa, Influenza virus
VALCGSKEQL

SEQ ID NO: 372347 - protein, 10 aa, Influenza virus
ALCGSKEQLG

SEQ ID NO: 372348 - protein, 10 aa, Influenza virus
LCGSKEQLGS

SEQ ID NO: 372349 - protein, 10 aa, Influenza virus
CGSKEQLGSW

SEQ ID NO: 372350 - protein, 10 aa, Influenza virus
GSKEQLGSWS

SEQ ID NO: 372351 - protein, 10 aa, Influenza virus
SKEQLGSWSW

SEQ ID NO: 372352 - protein, 10 aa, Influenza virus
KEQLGSWSWH

SEQ ID NO: 372353 - protein, 10 aa, Influenza virus
KRLGSWSWHD

SEQ ID NO: 372354 - protein, 10 aa, Influenza virus
HDGAEIIYFE

SEQ ID NO: 372355 - protein, 10 aa, Influenza virus
MNPNQKLFTL

SEQ ID NO: 372356 - protein, 10 aa, Influenza virus
NPNQKLFTLS

SEQ ID NO: 372357 - protein, 10 aa, Influenza virus
PNQKLFTLSG

SEQ ID NO: 372358 - protein, 10 aa, Influenza virus
NQKLFTLSGV

SEQ ID NO: 372359 - protein, 10 aa, Influenza virus
QKLFTLSGVA

SEQ ID NO: 372360 - protein, 10 aa, Influenza virus
KLFTLSGVAI

SEQ ID NO: 372361 - protein, 10 aa, Influenza virus
NLLIGISNMS

SEQ ID NO: 372362 - protein, 10 aa, Influenza virus
LLIGISNMSL

SEQ ID NO: 372363 - protein, 10 aa, Influenza virus
LIGISNMSLN

SEQ ID NO: 372364 - protein, 10 aa, Influenza virus
SNVVLNVSLH

SEQ ID NO: 372365 - protein, 10 aa, Influenza virus
NVVLNVSLHL

SEQ ID NO: 372366 - protein, 10 aa, Influenza virus
ENKYVNNTTI

SEQ ID NO: 372367 - protein, 10 aa, Influenza virus
NTYINNTTII

SEQ ID NO: 372368 - protein, 10 aa, Influenza virus
YLVLNKSLCK

SEQ ID NO: 372369 - protein, 10 aa, Influenza virus
LVLNKSLCKV

SEQ ID NO: 372370 - protein, 10 aa, Influenza virus
GWVAVAKDNA

SEQ ID NO: 372371 - protein, 10 aa, Influenza virus
WVVIAKDNAI

SEQ ID NO: 372372 - protein, 10 aa, Influenza virus
VVIAKDNAIR

SEQ ID NO: 372373 - protein, 10 aa, Influenza virus
VIAKDNAIRF

SEQ ID NO: 372374 - protein, 10 aa, Influenza virus
IAKDNAIRFG

SEQ ID NO: 372375 - protein, 10 aa, Influenza virus
KDNAIRFGEG

SEQ ID NO: 372376 - protein, 10 aa, Influenza virus
AIRFGESEQV

SEQ ID NO: 372377 - protein, 10 aa, Influenza virus
IRFGESEQVI

SEQ ID NO: 372378 - protein, 10 aa, Influenza virus
RFGEGEQIIV

SEQ ID NO: 372379 - protein, 10 aa, Influenza virus
FGEGEQIIVT

SEQ ID NO: 372380 - protein, 10 aa, Influenza virus
GEGEQIIVTR

SEQ ID NO: 372381 - protein, 10 aa, Influenza virus
EGEQIIVTRE

SEQ ID NO: 372382 - protein, 10 aa, Influenza virus
GEQIIVTREP

SEQ ID NO: 372383 - protein, 10 aa, Influenza virus
REPYVSCDPS

SEQ ID NO: 372384 - protein, 10 aa, Influenza virus
SCKMYALHQG

SEQ ID NO: 372385 - protein, 10 aa, Influenza virus
TTIRNRHSNG

SEQ ID NO: 372386 - protein, 10 aa, Influenza virus
TIRNRHSNGT

SEQ ID NO: 372387 - protein, 10 aa, Influenza virus
IRNKHSNGTT

SEQ ID NO: 372388 - protein, 10 aa, Influenza virus
RNKHSNGTTH

SEQ ID NO: 372389 - protein, 10 aa, Influenza virus
NKHSNGTTHD

SEQ ID NO: 372390 - protein, 10 aa, Influenza virus
KHSNGTTHDR

SEQ ID NO: 372391 - protein, 10 aa, Influenza virus
HSNGTTHDRT

SEQ ID NO: 372392 - protein, 10 aa, Influenza virus
TIHDRTTFRG

SEQ ID NO: 372393 - protein, 10 aa, Influenza virus
IHDRTTFRGL

SEQ ID NO: 372394 - protein, 10 aa, Influenza virus
DRNAFRGLIS

SEQ ID NO: 372395 - protein, 10 aa, Influenza virus
RNAFRGLIST

SEQ ID NO: 372396 - protein, 10 aa, Influenza virus
AFRGLMSTPL

SEQ ID NO: 372397 - protein, 10 aa, Influenza virus
FRGLISTHLG

SEQ ID NO: 372398 - protein, 10 aa, Influenza virus
SNSDFICVGW

SEQ ID NO: 372399 - protein, 10 aa, Influenza virus
NSDFICVGWS

SEQ ID NO: 372400 - protein, 10 aa, Influenza virus
SDFICVGWSS

SEQ ID NO: 372401 - protein, 10 aa, Influenza virus
DFICVGWSST

SEQ ID NO: 372402 - protein, 10 aa, Influenza virus
FICVGWSSTS

SEQ ID NO: 372403 - protein, 10 aa, Influenza virus
ICVGWSSTSC

SEQ ID NO: 372404 - protein, 10 aa, Influenza virus
WSSTSCHDGV

SEQ ID NO: 372405 - protein, 10 aa, Influenza virus
CHDGVNRMTI

SEQ ID NO: 372406 - protein, 10 aa, Influenza virus
HDGIARMTIC

SEQ ID NO: 372407 - protein, 10 aa, Influenza virus
RMTICVQGDN

SEQ ID NO: 372408 - protein, 10 aa, Influenza virus
QGDNENATAT

SEQ ID NO: 372409 - protein, 10 aa, Influenza virus
GDNENATATV

SEQ ID NO: 372410 - protein, 10 aa, Influenza virus
DNENATATVY

SEQ ID NO: 372411 - protein, 10 aa, Influenza virus
NENATATVYY

SEQ ID NO: 372412 - protein, 10 aa, Influenza virus
NNATATVYYD

SEQ ID NO: 372413 - protein, 10 aa, Influenza virus
NATATVYYNK

SEQ ID NO: 372414 - protein, 10 aa, Influenza virus
ATATVYYNKR

SEQ ID NO: 372415 - protein, 10 aa, Influenza virus
TATVYYNKRL

SEQ ID NO: 372416 - protein, 10 aa, Influenza virus
ATVYYNKRLT

SEQ ID NO: 372417 - protein, 10 aa, Influenza virus
TVYYNKRLTT

SEQ ID NO: 372418 - protein, 10 aa, Influenza virus
VYYNKRLTTT

SEQ ID NO: 372419 - protein, 10 aa, Influenza virus
YYNKRLTTTI

SEQ ID NO: 372420 - protein, 10 aa, Influenza virus
GRLTTTIKTW

SEQ ID NO: 372421 - protein, 10 aa, Influenza virus
RLTTTIRTWA

SEQ ID NO: 372422 - protein, 10 aa, Influenza virus
LTTTIKTWAK

SEQ ID NO: 372423 - protein, 10 aa, Influenza virus
TTTIKTWAKN

SEQ ID NO: 372424 - protein, 10 aa, Influenza virus
TTIKTWAKNI

SEQ ID NO: 372425 - protein, 10 aa, Influenza virus
TIKTWAKNIL

SEQ ID NO: 372426 - protein, 10 aa, Influenza virus
IKTWAKNILR

SEQ ID NO: 372427 - protein, 10 aa, Influenza virus
KTWAKNILRT

SEQ ID NO: 372428 - protein, 10 aa, Influenza virus
TWAKNILRTQ

SEQ ID NO: 372429 - protein, 10 aa, Influenza virus
WAKNILRTQE

SEQ ID NO: 372430 - protein, 10 aa, Influenza virus
AKNILRTQES

SEQ ID NO: 372431 - protein, 10 aa, Influenza virus
KNILRTQESE

SEQ ID NO: 372432 - protein, 10 aa, Influenza virus
QESECVCHDG

SEQ ID NO: 372433 - protein, 10 aa, Influenza virus
DSECVSHNGT

SEQ ID NO: 372434 - protein, 10 aa, Influenza virus
SECVCHDGTC

SEQ ID NO: 372435 - protein, 10 aa, Influenza virus
ECVCHNSTCV

SEQ ID NO: 372436 - protein, 10 aa, Influenza virus
GTCVVVMTDG

SEQ ID NO: 372437 - protein, 10 aa, Influenza virus
MTDGPASSQA

SEQ ID NO: 372438 - protein, 10 aa, Influenza virus
LRGSARHIEE

SEQ ID NO: 372439 - protein, 10 aa, Influenza virus
RGSARHIEEC

SEQ ID NO: 372440 - protein, 10 aa, Influenza virus
GSARHVEECS

SEQ ID NO: 372441 - protein, 10 aa, Influenza virus
SARHVEECSC

SEQ ID NO: 372442 - protein, 10 aa, Influenza virus
ARHIEEWSCY

SEQ ID NO: 372443 - protein, 10 aa, Influenza virus
RHIEEWSCYG

SEQ ID NO: 372444 - protein, 10 aa, Influenza virus
IEECSCYGHD

SEQ ID NO: 372445 - protein, 10 aa, Influenza virus
KATCVCRDNW

SEQ ID NO: 372446 - protein, 10 aa, Influenza virus
ITCVCRDNWQ

SEQ ID NO: 372447 - protein, 10 aa, Influenza virus
TCICRDNWQG

SEQ ID NO: 372448 - protein, 10 aa, Influenza virus
WQGANRPVIK

SEQ ID NO: 372449 - protein, 10 aa, Influenza virus
QGANRPVIKI

SEQ ID NO: 372450 - protein, 10 aa, Influenza virus
GANRPVIKID

SEQ ID NO: 372451 - protein, 10 aa, Influenza virus
ANRPVIKIDM

SEQ ID NO: 372452 - protein, 10 aa, Influenza virus
GVLTDTSRPK

SEQ ID NO: 372453 - protein, 10 aa, Influenza virus
VLTDTSRPKD

SEQ ID NO: 372454 - protein, 10 aa, Influenza virus
LTDTSRPKDK

SEQ ID NO: 372455 - protein, 10 aa, Influenza virus
GECFNPITGS

SEQ ID NO: 372456 - protein, 10 aa, Influenza virus
ECFNPITGSP

SEQ ID NO: 372457 - protein, 10 aa, Influenza virus
CFNPITGSPG

SEQ ID NO: 372458 - protein, 10 aa, Influenza virus
NPITGSPGVP

SEQ ID NO: 372459 - protein, 10 aa, Influenza virus
PITGSPGVPG

SEQ ID NO: 372460 - protein, 10 aa, Influenza virus
VPGVKGFGFL

SEQ ID NO: 372461 - protein, 10 aa, Influenza virus
PGIKGFGFLN

SEQ ID NO: 372462 - protein, 10 aa, Influenza virus
SNTWLGRTIS

SEQ ID NO: 372463 - protein, 10 aa, Influenza virus
STWLGRTISP

SEQ ID NO: 372464 - protein, 10 aa, Influenza virus
TWLGRTFSPR

SEQ ID NO: 372465 - protein, 10 aa, Influenza virus
WLGRTISPKL

SEQ ID NO: 372466 - protein, 10 aa, Influenza virus
LGRTISPRLR

SEQ ID NO: 372467 - protein, 10 aa, Influenza virus
TISPKLRSGF

SEQ ID NO: 372468 - protein, 10 aa, Influenza virus
ISPKLRSGFE

SEQ ID NO: 372469 - protein, 10 aa, Influenza virus
SPRLRSGFEM

SEQ ID NO: 372470 - protein, 10 aa, Influenza virus
PKLRSGFEML

SEQ ID NO: 372471 - protein, 10 aa, Influenza virus
KLRSGFEMLK

SEQ ID NO: 372472 - protein, 10 aa, Influenza virus
SRSGFEMLKV

SEQ ID NO: 372473 - protein, 10 aa, Influenza virus
RSGFEMLRIP

SEQ ID NO: 372474 - protein, 10 aa, Influenza virus
SGFEMLKIHN

SEQ ID NO: 372475 - protein, 10 aa, Influenza virus
GFEMLRIPNA

SEQ ID NO: 372476 - protein, 10 aa, Influenza virus
FEMLKVPNAG

SEQ ID NO: 372477 - protein, 10 aa, Influenza virus
LKIPNAGIDP

SEQ ID NO: 372478 - protein, 10 aa, Influenza virus
DWSGYSGSFI

SEQ ID NO: 372479 - protein, 10 aa, Influenza virus
SGSFIDYWDD

SEQ ID NO: 372480 - protein, 10 aa, Influenza virus
SVCYNPCFYV

SEQ ID NO: 372481 - protein, 10 aa, Influenza virus
ACYNPCFYVE

SEQ ID NO: 372482 - protein, 10 aa, Influenza virus
GRPEEVKYVW

SEQ ID NO: 372483 - protein, 10 aa, Influenza virus
RPEEVKYVWW

SEQ ID NO: 372484 - protein, 10 aa, Influenza virus
PEEAKYVWWA

SEQ ID NO: 372485 - protein, 10 aa, Influenza virus
EEAKYVWWAS

SEQ ID NO: 372486 - protein, 10 aa, Influenza virus
EAKYVWWASN

SEQ ID NO: 372487 - protein, 10 aa, Influenza virus
AKYVWWASNS

SEQ ID NO: 372488 - protein, 10 aa, Influenza virus
KYVWWASNSL

SEQ ID NO: 372489 - protein, 10 aa, Influenza virus
YVEWTSNSLI

SEQ ID NO: 372490 - protein, 10 aa, Influenza virus
VEWTSNSLIA

SEQ ID NO: 372491 - protein, 10 aa, Influenza virus
EWTSNSLIAL

SEQ ID NO: 372492 - protein, 10 aa, Influenza virus
WASNSLIALC

SEQ ID NO: 372493 - protein, 10 aa, Influenza virus
ASNSLIALCG

SEQ ID NO: 372494 - protein, 10 aa, Influenza virus
SLIALCGSPF

SEQ ID NO: 372495 - protein, 10 aa, Influenza virus
PVGPGSFPDG

SEQ ID NO: 372496 - protein, 10 aa, Influenza virus
VGSGSFPNGA

SEQ ID NO: 372497 - protein, 10 aa, Influenza virus
GSGSFPDGAK

SEQ ID NO: 372498 - protein, 10 aa, Influenza virus
SGSFPDGARI

SEQ ID NO: 372499 - protein, 10 aa, Influenza virus
GFFPDGPQIQ

SEQ ID NO: 372500 - protein, 10 aa, Influenza virus
SFPNGAQIQY

SEQ ID NO: 372501 - protein, 10 aa, Influenza virus
FPDGPQIQYF

SEQ ID NO: 372502 - protein, 10 aa, Influenza virus
PDGAKIQYFS

SEQ ID NO: 372503 - protein, 10 aa, Influenza virus
RGFAPFSKDN

SEQ ID NO: 372504 - protein, 10 aa, Influenza virus
GIRIGSKGHV

SEQ ID NO: 372505 - protein, 10 aa, Influenza virus
IRIGSKGHVF

SEQ ID NO: 372506 - protein, 10 aa, Influenza virus
RIGSKGHVFV

SEQ ID NO: 372507 - protein, 10 aa, Influenza virus
IGSKGHVFVI

SEQ ID NO: 372508 - protein, 10 aa, Influenza virus
GSKGHVFVIR

SEQ ID NO: 372509 - protein, 10 aa, Influenza virus
SKGHVFVIRE

SEQ ID NO: 372510 - protein, 10 aa, Influenza virus
KGHVFVIREP

SEQ ID NO: 372511 - protein, 10 aa, Influenza virus
HVFIIREPFV

SEQ ID NO: 372512 - protein, 10 aa, Influenza virus
VFIIREPFVS

SEQ ID NO: 372513 - protein, 10 aa, Influenza virus
FVIREPFISC

SEQ ID NO: 372514 - protein, 10 aa, Influenza virus
ECRTFFLTHG

SEQ ID NO: 372515 - protein, 10 aa, Influenza virus
TFFITQGSLL

SEQ ID NO: 372516 - protein, 10 aa, Influenza virus
FFITQGSLLN

SEQ ID NO: 372517 - protein, 10 aa, Influenza virus
FLTQGSLVND

SEQ ID NO: 372518 - protein, 10 aa, Influenza virus
LTHGSLLNDK

SEQ ID NO: 372519 - protein, 10 aa, Influenza virus
THGSLLNDKH

SEQ ID NO: 372520 - protein, 10 aa, Influenza virus
HGSLLNDKHS

SEQ ID NO: 372521 - protein, 10 aa, Influenza virus
GSLLNDKHFN

SEQ ID NO: 372522 - protein, 10 aa, Influenza virus
SLPNDKHSNG

SEQ ID NO: 372523 - protein, 10 aa, Influenza virus
LPNDKHSNGT

SEQ ID NO: 372524 - protein, 10 aa, Influenza virus
NDRHSNGTVK

SEQ ID NO: 372525 - protein, 10 aa, Influenza virus
DRHSNGTVKD

SEQ ID NO: 372526 - protein, 10 aa, Influenza virus
RHSNGTVKDR

SEQ ID NO: 372527 - protein, 10 aa, Influenza virus
HSNGTMKDRS

SEQ ID NO: 372528 - protein, 10 aa, Influenza virus
SNGTMKDRSP

SEQ ID NO: 372529 - protein, 10 aa, Influenza virus
NGTIKDRSPY

SEQ ID NO: 372530 - protein, 10 aa, Influenza virus
GTIKDRSPYR

SEQ ID NO: 372531 - protein, 10 aa, Influenza virus
TIKDRSPYRT

SEQ ID NO: 372532 - protein, 10 aa, Influenza virus
IKDRSPYRTL

SEQ ID NO: 372533 - protein, 10 aa, Influenza virus
SPFRTLMSVE

SEQ ID NO: 372534 - protein, 10 aa, Influenza virus
RTLMSVEVGQ

SEQ ID NO: 372535 - protein, 10 aa, Influenza virus
IGQSPNVYQS

SEQ ID NO: 372536 - protein, 10 aa, Influenza virus
GQSPNVYQSR

SEQ ID NO: 372537 - protein, 10 aa, Influenza virus
QSPNVYQSRF

SEQ ID NO: 372538 - protein, 10 aa, Influenza virus
SPNVYQSRFE

SEQ ID NO: 372539 - protein, 10 aa, Influenza virus
PNVYQAKFES

SEQ ID NO: 372540 - protein, 10 aa, Influenza virus
NVYQAKFESV

SEQ ID NO: 372541 - protein, 10 aa, Influenza virus
VYQAKFESVA

SEQ ID NO: 372542 - protein, 10 aa, Influenza virus
YQAKFESVAW

SEQ ID NO: 372543 - protein, 10 aa, Influenza virus
QAKFESVAWS

SEQ ID NO: 372544 - protein, 10 aa, Influenza virus
AKFESVAWSA

SEQ ID NO: 372545 - protein, 10 aa, Influenza virus
KFESVAWSAT

SEQ ID NO: 372546 - protein, 10 aa, Influenza virus
TACHDGKKWT

SEQ ID NO: 372547 - protein, 10 aa, Influenza virus
ACHDGKKWMA

SEQ ID NO: 372548 - protein, 10 aa, Influenza virus
GDIMRTQESS

SEQ ID NO: 372549 - protein, 10 aa, Influenza virus
DIMRTQESSC

SEQ ID NO: 372550 - protein, 10 aa, Influenza virus
ILRTQESSCS

SEQ ID NO: 372551 - protein, 10 aa, Influenza virus
TQESSCTCIR

SEQ ID NO: 372552 - protein, 10 aa, Influenza virus
QESSCTCIRG

SEQ ID NO: 372553 - protein, 10 aa, Influenza virus
GECFWVMTDG

SEQ ID NO: 372554 - protein, 10 aa, Influenza virus
ECFWVMTDGP

SEQ ID NO: 372555 - protein, 10 aa, Influenza virus
WVMTDGPANS

SEQ ID NO: 372556 - protein, 10 aa, Influenza virus
VMTDGPANSQ

SEQ ID NO: 372557 - protein, 10 aa, Influenza virus
MTDGPANSQA

SEQ ID NO: 372558 - protein, 10 aa, Influenza virus
FDGGHIEECS

SEQ ID NO: 372559 - protein, 10 aa, Influenza virus
DGGHIEECSC

SEQ ID NO: 372560 - protein, 10 aa, Influenza virus
CSCYPNNGKV

SEQ ID NO: 372561 - protein, 10 aa, Influenza virus
SCYPNNGKVE

SEQ ID NO: 372562 - protein, 10 aa, Influenza virus
CYPNNGKVEC

SEQ ID NO: 372563 - protein, 10 aa, Influenza virus
YPNDGKVECV

SEQ ID NO: 372564 - protein, 10 aa, Influenza virus
PNDGKVECVC

SEQ ID NO: 372565 - protein, 10 aa, Influenza virus
NDGKVECVCR

SEQ ID NO: 372566 - protein, 10 aa, Influenza virus
DGKVECVCRD

SEQ ID NO: 372567 - protein, 10 aa, Influenza virus
WTGTNRPVLI

SEQ ID NO: 372568 - protein, 10 aa, Influenza virus
TGTNRPVLII

SEQ ID NO: 372569 - protein, 10 aa, Influenza virus
GTNRPVLIIS

SEQ ID NO: 372570 - protein, 10 aa, Influenza virus
LSYKVGYLCA

SEQ ID NO: 372571 - protein, 10 aa, Influenza virus
SYKVGYLCAG

SEQ ID NO: 372572 - protein, 10 aa, Influenza virus
VGYLCAGIPS

SEQ ID NO: 372573 - protein, 10 aa, Influenza virus
GYLCAGIPSD

SEQ ID NO: 372574 - protein, 10 aa, Influenza virus
YLCAGIPSDT

SEQ ID NO: 372575 - protein, 10 aa, Influenza virus
LCAGIPSDTP

SEQ ID NO: 372576 - protein, 10 aa, Influenza virus
CAGIPSDTPR

SEQ ID NO: 372577 - protein, 10 aa, Influenza virus
AGIPSDTPRG

SEQ ID NO: 372578 - protein, 10 aa, Influenza virus
GIPSDTPRGE

SEQ ID NO: 372579 - protein, 10 aa, Influenza virus
IPSDTPRGED

SEQ ID NO: 372580 - protein, 10 aa, Influenza virus
PSDTPRGEDA

SEQ ID NO: 372581 - protein, 10 aa, Influenza virus
SDTPRGEDAQ

SEQ ID NO: 372582 - protein, 10 aa, Influenza virus
DTPRGEDNQF

SEQ ID NO: 372583 - protein, 10 aa, Influenza virus
LGYGVKGFGF

SEQ ID NO: 372584 - protein, 10 aa, Influenza virus
VKGFGFRQGD

SEQ ID NO: 372585 - protein, 10 aa, Influenza virus
KGFGFRQGDD

SEQ ID NO: 372586 - protein, 10 aa, Influenza virus
GFGFRQGDDV

SEQ ID NO: 372587 - protein, 10 aa, Influenza virus
FGFRQGDDVW

SEQ ID NO: 372588 - protein, 10 aa, Influenza virus
DNSNWSGYSG

SEQ ID NO: 372589 - protein, 10 aa, Influenza virus
NSNWSGYSGS

SEQ ID NO: 372590 - protein, 10 aa, Influenza virus
SNWSGYSGSF

SEQ ID NO: 372591 - protein, 10 aa, Influenza virus
YSGSFTLPVG

SEQ ID NO: 372592 - protein, 10 aa, Influenza virus
SGSFTLPVGL

SEQ ID NO: 372593 - protein, 10 aa, Influenza virus
GCLVPCFWVE

SEQ ID NO: 372594 - protein, 10 aa, Influenza virus
CFWVEMIRGR

SEQ ID NO: 372595 - protein, 10 aa, Influenza virus
FWVEMIRGRP

SEQ ID NO: 372596 - protein, 10 aa, Influenza virus
WVEMIRGRPE

SEQ ID NO: 372597 - protein, 10 aa, Influenza virus
VEMIRGRPEE

SEQ ID NO: 372598 - protein, 10 aa, Influenza virus
TVWTSSSSIV

SEQ ID NO: 372599 - protein, 10 aa, Influenza virus
SSSIVMCGVN

SEQ ID NO: 372600 - protein, 10 aa, Influenza virus
SSVVMCGVDH

SEQ ID NO: 372601 - protein, 10 aa, Influenza virus
ADWSWHDGAV

SEQ ID NO: 372602 - protein, 10 aa, Influenza virus
DWSWHDGAVL

SEQ ID NO: 372603 - protein, 10 aa, Influenza virus
SWHDGAILPL

SEQ ID NO: 372604 - protein, 10 aa, Influenza virus
MNPNQKILFA

SEQ ID NO: 372605 - protein, 10 aa, Influenza virus
NPNQKILFAS

SEQ ID NO: 372606 - protein, 10 aa, Influenza virus
PNQKILFASA

SEQ ID NO: 372607 - protein, 10 aa, Influenza virus
NQKILCASAT

SEQ ID NO: 372608 - protein, 10 aa, Influenza virus
QKILCTSAIA

SEQ ID NO: 372609 - protein, 10 aa, Influenza virus
ANLGLNVGLH

SEQ ID NO: 372610 - protein, 10 aa, Influenza virus
LGLNVGLHLK

SEQ ID NO: 372611 - protein, 10 aa, Influenza virus
GLNVGLHLKP

SEQ ID NO: 372612 - protein, 10 aa, Influenza virus
SQTIINNYHN

SEQ ID NO: 372613 - protein, 10 aa, Influenza virus
QTIINNYYNK

SEQ ID NO: 372614 - protein, 10 aa, Influenza virus
TIINNYYNKT

SEQ ID NO: 372615 - protein, 10 aa, Influenza virus
IINNYYNKTN

SEQ ID NO: 372616 - protein, 10 aa, Influenza virus
FNNLTRGLCT

SEQ ID NO: 372617 - protein, 10 aa, Influenza virus
NNLTRGLCTI

SEQ ID NO: 372618 - protein, 10 aa, Influenza virus
NLTRGLCTIN

SEQ ID NO: 372619 - protein, 10 aa, Influenza virus
LTRGLCTINS

SEQ ID NO: 372620 - protein, 10 aa, Influenza virus
TRGLCTINSW

SEQ ID NO: 372621 - protein, 10 aa, Influenza virus
RGLCTINSWH

SEQ ID NO: 372622 - protein, 10 aa, Influenza virus
RLCTINSWHI

SEQ ID NO: 372623 - protein, 10 aa, Influenza virus
LCTINSWHIH

SEQ ID NO: 372624 - protein, 10 aa, Influenza virus
CIINSWHIYG

SEQ ID NO: 372625 - protein, 10 aa, Influenza virus
IINSWHIYGK

SEQ ID NO: 372626 - protein, 10 aa, Influenza virus
WHIFGKDNAV

SEQ ID NO: 372627 - protein, 10 aa, Influenza virus
HIFGKDNAVR

SEQ ID NO: 372628 - protein, 10 aa, Influenza virus
IFGKDNAVRI

SEQ ID NO: 372629 - protein, 10 aa, Influenza virus
FGKDNAVRIG

SEQ ID NO: 372630 - protein, 10 aa, Influenza virus
KDNAIRIGEN

SEQ ID NO: 372631 - protein, 10 aa, Influenza virus
DNAIRIGENS

SEQ ID NO: 372632 - protein, 10 aa, Influenza virus
RIGEDSDILV

SEQ ID NO: 372633 - protein, 10 aa, Influenza virus
IGEDSDILVT

SEQ ID NO: 372634 - protein, 10 aa, Influenza virus
GEDSDILVTR

SEQ ID NO: 372635 - protein, 10 aa, Influenza virus
EDSDILVTRE

SEQ ID NO: 372636 - protein, 10 aa, Influenza virus
DSDILVTREP

SEQ ID NO: 372637 - protein, 10 aa, Influenza virus
REPYVSCDPN

SEQ ID NO: 372638 - protein, 10 aa, Influenza virus
EPYVSCDPDG

SEQ ID NO: 372639 - protein, 10 aa, Influenza virus
PYVSCDPDGC

SEQ ID NO: 372640 - protein, 10 aa, Influenza virus
YVSCEPDECR

SEQ ID NO: 372641 - protein, 10 aa, Influenza virus
VSCEPDECRF

SEQ ID NO: 372642 - protein, 10 aa, Influenza virus
SCDPDGCRFY

SEQ ID NO: 372643 - protein, 10 aa, Influenza virus
CDPDGCRFYA

SEQ ID NO: 372644 - protein, 10 aa, Influenza virus
EPDECRFYAL

SEQ ID NO: 372645 - protein, 10 aa, Influenza virus
PNECRFYALS

SEQ ID NO: 372646 - protein, 10 aa, Influenza virus
NECRFYALSQ

SEQ ID NO: 372647 - protein, 10 aa, Influenza virus
HDRSQYRALV

SEQ ID NO: 372648 - protein, 10 aa, Influenza virus
DRSQYRALVS

SEQ ID NO: 372649 - protein, 10 aa, Influenza virus
RSQYRALVSW

SEQ ID NO: 372650 - protein, 10 aa, Influenza virus
SQYRALVSWP

SEQ ID NO: 372651 - protein, 10 aa, Influenza virus
QYRALVSWPL

SEQ ID NO: 372652 - protein, 10 aa, Influenza virus
YRALVSWPLS

SEQ ID NO: 372653 - protein, 10 aa, Influenza virus
RALVSWPLSS

SEQ ID NO: 372654 - protein, 10 aa, Influenza virus
ALVSWPLSSP

SEQ ID NO: 372655 - protein, 10 aa, Influenza virus
LISWPQSSPP

SEQ ID NO: 372656 - protein, 10 aa, Influenza virus
ISWPQSSPPT

SEQ ID NO: 372657 - protein, 10 aa, Influenza virus
LSSPPTVYNN

SEQ ID NO: 372658 - protein, 10 aa, Influenza virus
SSPPTVYNNR

SEQ ID NO: 372659 - protein, 10 aa, Influenza virus
KVECIGWSST

SEQ ID NO: 372660 - protein, 10 aa, Influenza virus
SSTSCHDGKA

SEQ ID NO: 372661 - protein, 10 aa, Influenza virus
STSCHDGKAR

SEQ ID NO: 372662 - protein, 10 aa, Influenza virus
TSCHDGKARM

SEQ ID NO: 372663 - protein, 10 aa, Influenza virus
SCHDGKARMS

SEQ ID NO: 372664 - protein, 10 aa, Influenza virus
RMSVCISGPN

SEQ ID NO: 372665 - protein, 10 aa, Influenza virus
MSVCISGPNN

SEQ ID NO: 372666 - protein, 10 aa, Influenza virus
SVCISGPNNN

SEQ ID NO: 372667 - protein, 10 aa, Influenza virus
VCISGPNNNA

SEQ ID NO: 372668 - protein, 10 aa, Influenza virus
GPNNNASAIV

SEQ ID NO: 372669 - protein, 10 aa, Influenza virus
PNNNASAIVW

SEQ ID NO: 372670 - protein, 10 aa, Influenza virus
NNNASAIVWY

SEQ ID NO: 372671 - protein, 10 aa, Influenza virus
NNASAVIWYK

SEQ ID NO: 372672 - protein, 10 aa, Influenza virus
GRPITEINTW

SEQ ID NO: 372673 - protein, 10 aa, Influenza virus
RPITEINTWA

SEQ ID NO: 372674 - protein, 10 aa, Influenza virus
PITEINTWAR

SEQ ID NO: 372675 - protein, 10 aa, Influenza virus
ITEINTWARN

SEQ ID NO: 372676 - protein, 10 aa, Influenza virus
TQESECVCQN

SEQ ID NO: 372677 - protein, 10 aa, Influenza virus
QESECVCHDG

SEQ ID NO: 372678 - protein, 10 aa, Influenza virus
ESECVCHSGI

SEQ ID NO: 372679 - protein, 10 aa, Influenza virus
SECVCHSGIC

SEQ ID NO: 372680 - protein, 10 aa, Influenza virus
ECVCHSGICP

SEQ ID NO: 372681 - protein, 10 aa, Influenza virus
CVCHSGICPV

SEQ ID NO: 372682 - protein, 10 aa, Influenza virus
VCHSGICPVV

SEQ ID NO: 372683 - protein, 10 aa, Influenza virus
CHSGICPVVF

SEQ ID NO: 372684 - protein, 10 aa, Influenza virus
HSGICPVVFT

SEQ ID NO: 372685 - protein, 10 aa, Influenza virus
SGICPVVFTD

SEQ ID NO: 372686 - protein, 10 aa, Influenza virus
SATGPADTRI

SEQ ID NO: 372687 - protein, 10 aa, Influenza virus
ATGPADTRIY

SEQ ID NO: 372688 - protein, 10 aa, Influenza virus
TGPADTRIYY

SEQ ID NO: 372689 - protein, 10 aa, Influenza virus
GPADTRIYYF

SEQ ID NO: 372690 - protein, 10 aa, Influenza virus
LNGTAKHIEE

SEQ ID NO: 372691 - protein, 10 aa, Influenza virus
NGTAKHIEEC

SEQ ID NO: 372692 - protein, 10 aa, Influenza virus
HIEECSCYGK

SEQ ID NO: 372693 - protein, 10 aa, Influenza virus
IICTCRDNWQ

SEQ ID NO: 372694 - protein, 10 aa, Influenza virus
GSNRPVIRID

SEQ ID NO: 372695 - protein, 10 aa, Influenza virus
SNRPVIRIDP

SEQ ID NO: 372696 - protein, 10 aa, Influenza virus
MMTHTSQYIC

SEQ ID NO: 372697 - protein, 10 aa, Influenza virus
TDNPRPNDPN

SEQ ID NO: 372698 - protein, 10 aa, Influenza virus
VGKCNEPYPG

SEQ ID NO: 372699 - protein, 10 aa, Influenza virus
CNDPYPGNNB

SEQ ID NO: 372700 - protein, 10 aa, Influenza virus
NDPYPGNSNN

SEQ ID NO: 372701 - protein, 10 aa, Influenza virus
DPYPGNSNNG

SEQ ID NO: 372702 - protein, 10 aa, Influenza virus
PYPGNNNGVK

SEQ ID NO: 372703 - protein, 10 aa, Influenza virus
YPGNNNKGVK

SEQ ID NO: 372704 - protein, 10 aa, Influenza virus
PGNNBNGVKG

SEQ ID NO: 372705 - protein, 10 aa, Influenza virus
GNNBNGVKGF

SEQ ID NO: 372706 - protein, 10 aa, Influenza virus
SNNNGVKGFS

SEQ ID NO: 372707 - protein, 10 aa, Influenza virus
SNNGVKGFSY

SEQ ID NO: 372708 - protein, 10 aa, Influenza virus
NGVKGFAYLD

SEQ ID NO: 372709 - protein, 10 aa, Influenza virus
GVKGFAYLDG

SEQ ID NO: 372710 - protein, 10 aa, Influenza virus
NTWLGRTLNT

SEQ ID NO: 372711 - protein, 10 aa, Influenza virus
TWLGRTTSTA

SEQ ID NO: 372712 - protein, 10 aa, Influenza virus
WLGRTINTAS

SEQ ID NO: 372713 - protein, 10 aa, Influenza virus
LGRTINTASR

SEQ ID NO: 372714 - protein, 10 aa, Influenza virus
GRTINTASRS

SEQ ID NO: 372715 - protein, 10 aa, Influenza virus
RTISTASRAG

SEQ ID NO: 372716 - protein, 10 aa, Influenza virus
TISTASRAGY

SEQ ID NO: 372717 - protein, 10 aa, Influenza virus
ISTASRYGYE

SEQ ID NO: 372718 - protein, 10 aa, Influenza virus
NTASRSGYEM

SEQ ID NO: 372719 - protein, 10 aa, Influenza virus
IASRSGYEIL

SEQ ID NO: 372720 - protein, 10 aa, Influenza virus
ASRYGYEMLK

SEQ ID NO: 372721 - protein, 10 aa, Influenza virus
SRSGYEILKV

SEQ ID NO: 372722 - protein, 10 aa, Influenza virus
RSGYEILKVP

SEQ ID NO: 372723 - protein, 10 aa, Influenza virus
AGYEMLKVPN

SEQ ID NO: 372724 - protein, 10 aa, Influenza virus
MLKVPNALID

SEQ ID NO: 372725 - protein, 10 aa, Influenza virus
LRVPNALTDD

SEQ ID NO: 372726 - protein, 10 aa, Influenza virus
KVPNALTDDK

SEQ ID NO: 372727 - protein, 10 aa, Influenza virus
VPNALTDDKS

SEQ ID NO: 372728 - protein, 10 aa, Influenza virus
PNALTDNRSK

SEQ ID NO: 372729 - protein, 10 aa, Influenza virus
NALTDNRSKP

SEQ ID NO: 372730 - protein, 10 aa, Influenza virus
QGQTIVLTTD

SEQ ID NO: 372731 - protein, 10 aa, Influenza virus
GQTIVLTTDW

SEQ ID NO: 372732 - protein, 10 aa, Influenza virus
QTIVLTTDWS

SEQ ID NO: 372733 - protein, 10 aa, Influenza virus
TIVLDTDWSG

SEQ ID NO: 372734 - protein, 10 aa, Influenza virus
IVLTTDWSGY

SEQ ID NO: 372735 - protein, 10 aa, Influenza virus
DWSGYSGSFV

SEQ ID NO: 372736 - protein, 10 aa, Influenza virus
WSGYSGSFVD

SEQ ID NO: 372737 - protein, 10 aa, Influenza virus
SGYSGSFVDY

SEQ ID NO: 372738 - protein, 10 aa, Influenza virus
GYSGSFVDYW

SEQ ID NO: 372739 - protein, 10 aa, Influenza virus
YSGSFVDYWA

SEQ ID NO: 372740 - protein, 10 aa, Influenza virus
SGSFVDYWAE

SEQ ID NO: 372741 - protein, 10 aa, Influenza virus
GSFVDYWAEG

SEQ ID NO: 372742 - protein, 10 aa, Influenza virus
DYWAKGECYR

SEQ ID NO: 372743 - protein, 10 aa, Influenza virus
YWAKGECYRA

SEQ ID NO: 372744 - protein, 10 aa, Influenza virus
WAKGECYRAC

SEQ ID NO: 372745 - protein, 10 aa, Influenza virus
AKGECYRACF

SEQ ID NO: 372746 - protein, 10 aa, Influenza virus
KGECYRACFY

SEQ ID NO: 372747 - protein, 10 aa, Influenza virus
EECYRACFYV

SEQ ID NO: 372748 - protein, 10 aa, Influenza virus
LIRGRPKEDR

SEQ ID NO: 372749 - protein, 10 aa, Influenza virus
IRGRPKEDRV

SEQ ID NO: 372750 - protein, 10 aa, Influenza virus
RGRPKEDRVW

SEQ ID NO: 372751 - protein, 10 aa, Influenza virus
GRPKEDRVWW

SEQ ID NO: 372752 - protein, 10 aa, Influenza virus
RPKEDRVWWT

SEQ ID NO: 372753 - protein, 10 aa, Influenza virus
PKEDRVWWTS

SEQ ID NO: 372754 - protein, 10 aa, Influenza virus
KEDRVWWTSN

SEQ ID NO: 372755 - protein, 10 aa, Influenza virus
EDRVWWTSNS

SEQ ID NO: 372756 - protein, 10 aa, Influenza virus
DRVWWTSNSI

SEQ ID NO: 372757 - protein, 10 aa, Influenza virus
EVWWTSNSIV

SEQ ID NO: 372758 - protein, 10 aa, Influenza virus
GQWNWPDGAE

SEQ ID NO: 372759 - protein, 10 aa, Influenza virus
QWNWPDGAEI

SEQ ID NO: 372760 - protein, 10 aa, Influenza virus
WNWPDGAEIE

SEQ ID NO: 372761 - protein, 10 aa, Influenza virus
NWPDGAEIEY

SEQ ID NO: 372762 - protein, 10 aa, Influenza virus
WPDGAKIEYS

SEQ ID NO: 372763 - protein, 10 aa, Influenza virus
PDGAKIKYFL

SEQ ID NO: 372764 - protein, 10 aa, Influenza virus
GLDRICLGHH

SEQ ID NO: 372765 - protein, 10 aa, Influenza virus
LDRICLGHHA

SEQ ID NO: 372766 - protein, 10 aa, Influenza virus
KICLGHHAVA

SEQ ID NO: 372767 - protein, 10 aa, Influenza virus
ICLGHHAVAN

SEQ ID NO: 372768 - protein, 10 aa, Influenza virus
CLGHHAVANG

SEQ ID NO: 372769 - protein, 10 aa, Influenza virus
LGHHAVANGT

SEQ ID NO: 372770 - protein, 10 aa, Influenza virus
HEEVTNATET

SEQ ID NO: 372771 - protein, 10 aa, Influenza virus
KDLGNCHPVG

SEQ ID NO: 372772 - protein, 10 aa, Influenza virus
DLGNCHPVGM

SEQ ID NO: 372773 - protein, 10 aa, Influenza virus
SEEALRQKIM

SEQ ID NO: 372774 - protein, 10 aa, Influenza virus
RQKIMKSGGI

SEQ ID NO: 372775 - protein, 10 aa, Influenza virus
QSFPQTTNTY

SEQ ID NO: 372776 - protein, 10 aa, Influenza virus
NFPRTTNTYR

SEQ ID NO: 372777 - protein, 10 aa, Influenza virus
FPRTTNTYRN

SEQ ID NO: 372778 - protein, 10 aa, Influenza virus
PRTTNTYRNT

SEQ ID NO: 372779 - protein, 10 aa, Influenza virus
RTTNTYRNTD

SEQ ID NO: 372780 - protein, 10 aa, Influenza virus
TANTYRNTDS

SEQ ID NO: 372781 - protein, 10 aa, Influenza virus
LYGAQSLSIS

SEQ ID NO: 372782 - protein, 10 aa, Influenza virus
YGTQPLSISV

SEQ ID NO: 372783 - protein, 10 aa, Influenza virus
GTQSLSISVE

SEQ ID NO: 372784 - protein, 10 aa, Influenza virus
TQSLSISVES

SEQ ID NO: 372785 - protein, 10 aa, Influenza virus
QSLSISVESS

SEQ ID NO: 372786 - protein, 10 aa, Influenza virus
SLSISVESST

SEQ ID NO: 372787 - protein, 10 aa, Influenza virus
LSISVESSTY

SEQ ID NO: 372788 - protein, 10 aa, Influenza virus
SISIGSSTYQ

SEQ ID NO: 372789 - protein, 10 aa, Influenza virus
ISIGSSTYQN

SEQ ID NO: 372790 - protein, 10 aa, Influenza virus
VESSTYQNNF

SEQ ID NO: 372791 - protein, 10 aa, Influenza virus
ESSTYQNNFV

SEQ ID NO: 372792 - protein, 10 aa, Influenza virus
SSIYQNSFVP

SEQ ID NO: 372793 - protein, 10 aa, Influenza virus
STYHNSFVPV

SEQ ID NO: 372794 - protein, 10 aa, Influenza virus
TYQNNFVPVI

SEQ ID NO: 372795 - protein, 10 aa, Influenza virus
YQNNFVPVIG

SEQ ID NO: 372796 - protein, 10 aa, Influenza virus
NNFVPVIGAR

SEQ ID NO: 372797 - protein, 10 aa, Influenza virus
NFVPVIGARP

SEQ ID NO: 372798 - protein, 10 aa, Influenza virus
FVPVMGARPQ

SEQ ID NO: 372799 - protein, 10 aa, Influenza virus
VPVMGARPQV

SEQ ID NO: 372800 - protein, 10 aa, Influenza virus
PVVRARPQVN

SEQ ID NO: 372801 - protein, 10 aa, Influenza virus
VMGARPQVNG

SEQ ID NO: 372802 - protein, 10 aa, Influenza virus
MGARPQVNGQ

SEQ ID NO: 372803 - protein, 10 aa, Influenza virus
GARPKVNGQS

SEQ ID NO: 372804 - protein, 10 aa, Influenza virus
ARPQVNGQRG

SEQ ID NO: 372805 - protein, 10 aa, Influenza virus
RPLVNGQSGR

SEQ ID NO: 372806 - protein, 10 aa, Influenza virus
PQVNGQSGRV

SEQ ID NO: 372807 - protein, 10 aa, Influenza virus
VNGQSGRINF

SEQ ID NO: 372808 - protein, 10 aa, Influenza virus
NGQRGRIDFH

SEQ ID NO: 372809 - protein, 10 aa, Influenza virus
GQRGRIDFHW

SEQ ID NO: 372810 - protein, 10 aa, Influenza virus
PGDNITFLHN

SEQ ID NO: 372811 - protein, 10 aa, Influenza virus
GDHITFSHNG

SEQ ID NO: 372812 - protein, 10 aa, Influenza virus
HNITFSHNGG

SEQ ID NO: 372813 - protein, 10 aa, Influenza virus
NITFSHNGGR

SEQ ID NO: 372814 - protein, 10 aa, Influenza virus
ITFSHNGGLV

SEQ ID NO: 372815 - protein, 10 aa, Influenza virus
TFSDNGGLIA

SEQ ID NO: 372816 - protein, 10 aa, Influenza virus
FSHNGGLVAP

SEQ ID NO: 372817 - protein, 10 aa, Influenza virus
HNGGLIAPNR

SEQ ID NO: 372818 - protein, 10 aa, Influenza virus
NGGLIAPNRV

SEQ ID NO: 372819 - protein, 10 aa, Influenza virus
CESKCFWKSG

SEQ ID NO: 372820 - protein, 10 aa, Influenza virus
KSKCFWRGGS

SEQ ID NO: 372821 - protein, 10 aa, Influenza virus
SKCFWREGSI

SEQ ID NO: 372822 - protein, 10 aa, Influenza virus
KCFWKGGSIK

SEQ ID NO: 372823 - protein, 10 aa, Influenza virus
CFWKGGSIKT

SEQ ID NO: 372824 - protein, 10 aa, Influenza virus
GGSIKTKLPF

SEQ ID NO: 372825 - protein, 10 aa, Influenza virus
GSIKTKLPFQ

SEQ ID NO: 372826 - protein, 10 aa, Influenza virus
SIKTKLPFQN

SEQ ID NO: 372827 - protein, 10 aa, Influenza virus
IKTKLPFQNL

SEQ ID NO: 372828 - protein, 10 aa, Influenza virus
KTKLPFQNLS

SEQ ID NO: 372829 - protein, 10 aa, Influenza virus
TELPFQNLSP

SEQ ID NO: 372830 - protein, 10 aa, Influenza virus
ELPFQNLSPR

SEQ ID NO: 372831 - protein, 10 aa, Influenza virus
TVGQCPKYVK

SEQ ID NO: 372832 - protein, 10 aa, Influenza virus
KSLMLATGMR

SEQ ID NO: 372833 - protein, 10 aa, Influenza virus
ATGMRNVPET

SEQ ID NO: 372834 - protein, 10 aa, Influenza virus
QGRGLFGAKA

SEQ ID NO: 372835 - protein, 10 aa, Influenza virus
GRGLFGAKAG

SEQ ID NO: 372836 - protein, 10 aa, Influenza virus
IENGWEGMVE

SEQ ID NO: 372837 - protein, 10 aa, Influenza virus
HQNAQGTGQV

SEQ ID NO: 372838 - protein, 10 aa, Influenza virus
QNAQGTGLAA

SEQ ID NO: 372839 - protein, 10 aa, Influenza virus
NAQGTGQVAD

SEQ ID NO: 372840 - protein, 10 aa, Influenza virus
AQGTGLAADY

SEQ ID NO: 372841 - protein, 10 aa, Influenza virus
QGTGQAADYE

SEQ ID NO: 372842 - protein, 10 aa, Influenza virus
GTGQAADYES

SEQ ID NO: 372843 - protein, 10 aa, Influenza virus
TGQAADYEST

SEQ ID NO: 372844 - protein, 10 aa, Influenza virus
QAADYESTQA

SEQ ID NO: 372845 - protein, 10 aa, Influenza virus
AADYESTQAA

SEQ ID NO: 372846 - protein, 10 aa, Influenza virus
ADYKSTQTAI

SEQ ID NO: 372847 - protein, 10 aa, Influenza virus
AINQITGKLN

SEQ ID NO: 372848 - protein, 10 aa, Influenza virus
IDQVTGKLNR

SEQ ID NO: 372849 - protein, 10 aa, Influenza virus
NQITGKLNRL

SEQ ID NO: 372850 - protein, 10 aa, Influenza virus
ESIESEFSET

SEQ ID NO: 372851 - protein, 10 aa, Influenza virus
SIESEFSETE

SEQ ID NO: 372852 - protein, 10 aa, Influenza virus
IESEFSETEH

SEQ ID NO: 372853 - protein, 10 aa, Influenza virus
ESEFSETEHQ

SEQ ID NO: 372854 - protein, 10 aa, Influenza virus
SEFSETEHQI

SEQ ID NO: 372855 - protein, 10 aa, Influenza virus
EFSETEHQIG

SEQ ID NO: 372856 - protein, 10 aa, Influenza virus
FSETEHQIGN

SEQ ID NO: 372857 - protein, 10 aa, Influenza virus
SETEHQIGNV

SEQ ID NO: 372858 - protein, 10 aa, Influenza virus
EIEYQIGNVI

SEQ ID NO: 372859 - protein, 10 aa, Influenza virus
IEYQIGNVIN

SEQ ID NO: 372860 - protein, 10 aa, Influenza virus
QHTIDLADSE

SEQ ID NO: 372861 - protein, 10 aa, Influenza virus
HTIDLADSEM

SEQ ID NO: 372862 - protein, 10 aa, Influenza virus
TIEMTDSEML

SEQ ID NO: 372863 - protein, 10 aa, Influenza virus
IDLADSEMLN

SEQ ID NO: 372864 - protein, 10 aa, Influenza virus
DMGDSEMLNL

SEQ ID NO: 372865 - protein, 10 aa, Influenza virus
MTDSEMLNLY

SEQ ID NO: 372866 - protein, 10 aa, Influenza virus
GDSEMLNLYE

SEQ ID NO: 372867 - protein, 10 aa, Influenza virus
EMLNLYEGVR

SEQ ID NO: 372868 - protein, 10 aa, Influenza virus
NCMESIRDNT

SEQ ID NO: 372869 - protein, 10 aa, Influenza virus
MERIRNNTYD

SEQ ID NO: 372870 - protein, 10 aa, Influenza virus
ERIRNNTYDH

SEQ ID NO: 372871 - protein, 10 aa, Influenza virus
IRNNTYDHAQ

SEQ ID NO: 372872 - protein, 10 aa, Influenza virus
RNNTYDHAQY

SEQ ID NO: 372873 - protein, 10 aa, Influenza virus
NNTYDHAQYR

SEQ ID NO: 372874 - protein, 10 aa, Influenza virus
NTYDHAQYRE

SEQ ID NO: 372875 - protein, 10 aa, Influenza virus
TYDHAQYREE

SEQ ID NO: 372876 - protein, 10 aa, Influenza virus
HAQYREEALL

SEQ ID NO: 372877 - protein, 10 aa, Influenza virus
QYREESLLNR

SEQ ID NO: 372878 - protein, 10 aa, Influenza virus
YREEALLNRI

SEQ ID NO: 372879 - protein, 10 aa, Influenza virus
REESLLNRLS

SEQ ID NO: 372880 - protein, 10 aa, Influenza virus
EESLLNRLSI

SEQ ID NO: 372881 - protein, 10 aa, Influenza virus
ESLLNRLSIN

SEQ ID NO: 372882 - protein, 10 aa, Influenza virus
ALLNRLSINP

SEQ ID NO: 372883 - protein, 10 aa, Influenza virus
LLNRLSINPV

SEQ ID NO: 372884 - protein, 10 aa, Influenza virus
INPVTLSSGY

SEQ ID NO: 372885 - protein, 10 aa, Influenza virus
NPVTLSSGYK

SEQ ID NO: 372886 - protein, 10 aa, Influenza virus
LSSSYKDIIL

SEQ ID NO: 372887 - protein, 10 aa, Influenza virus
FSGYKDIILW

SEQ ID NO: 372888 - protein, 10 aa, Influenza virus
WFSFGASSFV

SEQ ID NO: 372889 - protein, 10 aa, Influenza virus
FSFGASSFVL

SEQ ID NO: 372890 - protein, 10 aa, Influenza virus
SFGASSFVLL

SEQ ID NO: 372891 - protein, 10 aa, Influenza virus
FGASSFVLLA

SEQ ID NO: 372892 - protein, 10 aa, Influenza virus
GLDRICLGHH

SEQ ID NO: 372893 - protein, 10 aa, Influenza virus
LDRICLGHHA

SEQ ID NO: 372894 - protein, 10 aa, Influenza virus
RICLGHHAVA

SEQ ID NO: 372895 - protein, 10 aa, Influenza virus
ICLGHHAVAN

SEQ ID NO: 372896 - protein, 10 aa, Influenza virus
CLGHHAVANG

SEQ ID NO: 372897 - protein, 10 aa, Influenza virus
LGHHAVANGT

SEQ ID NO: 372898 - protein, 10 aa, Influenza virus
GHHAVANGTI

SEQ ID NO: 372899 - protein, 10 aa, Influenza virus
ANGTIVKTLT

SEQ ID NO: 372900 - protein, 10 aa, Influenza virus
NGTIIKTLTN

SEQ ID NO: 372901 - protein, 10 aa, Influenza virus
GTVVKTLTNE

SEQ ID NO: 372902 - protein, 10 aa, Influenza virus
TIVKTLTSEK

SEQ ID NO: 372903 - protein, 10 aa, Influenza virus
IVKTLTSEKE

SEQ ID NO: 372904 - protein, 10 aa, Influenza virus
KTLTSEKEEV

SEQ ID NO: 372905 - protein, 10 aa, Influenza virus
EKEEVINATE

SEQ ID NO: 372906 - protein, 10 aa, Influenza virus
KEKVTNATET

SEQ ID NO: 372907 - protein, 10 aa, Influenza virus
TNATETVESR

SEQ ID NO: 372908 - protein, 10 aa, Influenza virus
KDLGNCHPVG

SEQ ID NO: 372909 - protein, 10 aa, Influenza virus
DLGNCHPVGM

SEQ ID NO: 372910 - protein, 10 aa, Influenza virus
GTPVCDPHLT

SEQ ID NO: 372911 - protein, 10 aa, Influenza virus
TPVCDPHLTG

SEQ ID NO: 372912 - protein, 10 aa, Influenza virus
CDLYLTGTWD

SEQ ID NO: 372913 - protein, 10 aa, Influenza virus
DLYLTGTWDT

SEQ ID NO: 372914 - protein, 10 aa, Influenza virus
PHLTGTWDTL

SEQ ID NO: 372915 - protein, 10 aa, Influenza virus
HLTGMWDTLI

SEQ ID NO: 372916 - protein, 10 aa, Influenza virus
LTGKWDTLIE

SEQ ID NO: 372917 - protein, 10 aa, Influenza virus
TGMWDTLIER

SEQ ID NO: 372918 - protein, 10 aa, Influenza virus
GTWDTLIERG

SEQ ID NO: 372919 - protein, 10 aa, Influenza virus
TWDTLIERGS

SEQ ID NO: 372920 - protein, 10 aa, Influenza virus
WDTLIERENS

SEQ ID NO: 372921 - protein, 10 aa, Influenza virus
AYCYPGTTVN

SEQ ID NO: 372922 - protein, 10 aa, Influenza virus
YCYPGTTVNE

SEQ ID NO: 372923 - protein, 10 aa, Influenza virus
CYPGTTVNEE

SEQ ID NO: 372924 - protein, 10 aa, Influenza virus
YPGTTVNEEA

SEQ ID NO: 372925 - protein, 10 aa, Influenza virus
PGTTVNEEAL

SEQ ID NO: 372926 - protein, 10 aa, Influenza virus
GTTVNEEALR

SEQ ID NO: 372927 - protein, 10 aa, Influenza virus
TTVNEEALRQ

SEQ ID NO: 372928 - protein, 10 aa, Influenza virus
TVNEGALRQK

SEQ ID NO: 372929 - protein, 10 aa, Influenza virus
VNEGALRQKI

SEQ ID NO: 372930 - protein, 10 aa, Influenza virus
IMESGGISKM

SEQ ID NO: 372931 - protein, 10 aa, Influenza virus
MESGGISKIS

SEQ ID NO: 372932 - protein, 10 aa, Influenza virus
ESGGISKIST

SEQ ID NO: 372933 - protein, 10 aa, Influenza virus
GKNSFYAELK

SEQ ID NO: 372934 - protein, 10 aa, Influenza virus
KNSFYAELKW

SEQ ID NO: 372935 - protein, 10 aa, Influenza virus
AELKWLVSKN

SEQ ID NO: 372936 - protein, 10 aa, Influenza virus
ELKWLVSKNK

SEQ ID NO: 372937 - protein, 10 aa, Influenza virus
LKWLVSKNKG

SEQ ID NO: 372938 - protein, 10 aa, Influenza virus
KWLVSKNKGQ

SEQ ID NO: 372939 - protein, 10 aa, Influenza virus
QNFPRTTNTY

SEQ ID NO: 372940 - protein, 10 aa, Influenza virus
NFPRTTNTYR

SEQ ID NO: 372941 - protein, 10 aa, Influenza virus
FPRTTNTYRN

SEQ ID NO: 372942 - protein, 10 aa, Influenza virus
PRTTNTYRNT

SEQ ID NO: 372943 - protein, 10 aa, Influenza virus
RTTNTYRNTD

SEQ ID NO: 372944 - protein, 10 aa, Influenza virus
TTNTYRNTDT

SEQ ID NO: 372945 - protein, 10 aa, Influenza virus
EHLITWGIHH

SEQ ID NO: 372946 - protein, 10 aa, Influenza virus
HLITWGIHHP

SEQ ID NO: 372947 - protein, 10 aa, Influenza virus
LIMWGIHHPS

SEQ ID NO: 372948 - protein, 10 aa, Influenza virus
IMWGIHHPSS

SEQ ID NO: 372949 - protein, 10 aa, Influenza virus
WGIHHPSSAQ

SEQ ID NO: 372950 - protein, 10 aa, Influenza virus
GIHHPSSAQE

SEQ ID NO: 372951 - protein, 10 aa, Influenza virus
IHHPSSAQEK

SEQ ID NO: 372952 - protein, 10 aa, Influenza virus
HHPSSAQEKN

SEQ ID NO: 372953 - protein, 10 aa, Influenza virus
HPSSAQEKND

SEQ ID NO: 372954 - protein, 10 aa, Influenza virus
PSSTKEKNDL

SEQ ID NO: 372955 - protein, 10 aa, Influenza virus
SSTKEKNDLY

SEQ ID NO: 372956 - protein, 10 aa, Influenza virus
SAQEKNDLYG

SEQ ID NO: 372957 - protein, 10 aa, Influenza virus
KEKNELYGTQ

SEQ ID NO: 372958 - protein, 10 aa, Influenza virus
EKNELYGTQS

SEQ ID NO: 372959 - protein, 10 aa, Influenza virus
KNDLYGTQPL

SEQ ID NO: 372960 - protein, 10 aa, Influenza virus
NELYGTQSLS

SEQ ID NO: 372961 - protein, 10 aa, Influenza virus
ELYGTQSLSI

SEQ ID NO: 372962 - protein, 10 aa, Influenza virus
YGTQPLSISV

SEQ ID NO: 372963 - protein, 10 aa, Influenza virus
GTQSLSISIG

SEQ ID NO: 372964 - protein, 10 aa, Influenza virus
TQSLSISIGS

SEQ ID NO: 372965 - protein, 10 aa, Influenza virus
QPLSISVGSS

SEQ ID NO: 372966 - protein, 10 aa, Influenza virus
SLSISIGSST

SEQ ID NO: 372967 - protein, 10 aa, Influenza virus
LSISIGSSTY

SEQ ID NO: 372968 - protein, 10 aa, Influenza virus
SISIGSSTYQ

SEQ ID NO: 372969 - protein, 10 aa, Influenza virus
ISIGSSTYQN

SEQ ID NO: 372970 - protein, 10 aa, Influenza virus
SVESSTYQNN

SEQ ID NO: 372971 - protein, 10 aa, Influenza virus
VGSSTYQNSF

SEQ ID NO: 372972 - protein, 10 aa, Influenza virus
ESSTYQNNFV

SEQ ID NO: 372973 - protein, 10 aa, Influenza virus
SSIYQNSFVP

SEQ ID NO: 372974 - protein, 10 aa, Influenza virus
STYHNSFVPV

SEQ ID NO: 372975 - protein, 10 aa, Influenza virus
TYQNNFVPVI

SEQ ID NO: 372976 - protein, 10 aa, Influenza virus
YQNNFVPVIG

SEQ ID NO: 372977 - protein, 10 aa, Influenza virus
QNNFVPVIGA

SEQ ID NO: 372978 - protein, 10 aa, Influenza virus
QSGRINFHWT

SEQ ID NO: 372979 - protein, 10 aa, Influenza virus
IQPGDNITFS

SEQ ID NO: 372980 - protein, 10 aa, Influenza virus
QPGDNITFSD

SEQ ID NO: 372981 - protein, 10 aa, Influenza virus
PGDNIIFSHN

SEQ ID NO: 372982 - protein, 10 aa, Influenza virus
GDNITFSDNG

SEQ ID NO: 372983 - protein, 10 aa, Influenza virus
DNIIFSHNGG

SEQ ID NO: 372984 - protein, 10 aa, Influenza virus
NITFLHNGGL

SEQ ID NO: 372985 - protein, 10 aa, Influenza virus
ITFSHNGGLV

SEQ ID NO: 372986 - protein, 10 aa, Influenza virus
IFSHNGGLIA

SEQ ID NO: 372987 - protein, 10 aa, Influenza virus
FLHNGGLIAP

SEQ ID NO: 372988 - protein, 10 aa, Influenza virus
SDNGGLIAPS

SEQ ID NO: 372989 - protein, 10 aa, Influenza virus
HNGGLIAPDR

SEQ ID NO: 372990 - protein, 10 aa, Influenza virus
GGLVAPSRVS

SEQ ID NO: 372991 - protein, 10 aa, Influenza virus
GLIAPDRVSK

SEQ ID NO: 372992 - protein, 10 aa, Influenza virus
LIAPDRVSKL

SEQ ID NO: 372993 - protein, 10 aa, Influenza virus
APSRVTKLKG

SEQ ID NO: 372994 - protein, 10 aa, Influenza virus
DNSCESKCFW

SEQ ID NO: 372995 - protein, 10 aa, Influenza virus
KCFWRGGSIN

SEQ ID NO: 372996 - protein, 10 aa, Influenza virus
CFWRGGSINT

SEQ ID NO: 372997 - protein, 10 aa, Influenza virus
FWRGGSINTK

SEQ ID NO: 372998 - protein, 10 aa, Influenza virus
WRGGSINTKL

SEQ ID NO: 372999 - protein, 10 aa, Influenza virus
RGGSINTKLP

SEQ ID NO: 373000 - protein, 10 aa, Influenza virus
GGSINTRLPF

SEQ ID NO: 373001 - protein, 10 aa, Influenza virus
GSINTRLPFQ

SEQ ID NO: 373002 - protein, 10 aa, Influenza virus
SINTRLPFQN

SEQ ID NO: 373003 - protein, 10 aa, Influenza virus
INTRLPFQNL

SEQ ID NO: 373004 - protein, 10 aa, Influenza virus
NTRLPFQNLS

SEQ ID NO: 373005 - protein, 10 aa, Influenza virus
VGQCPKYVNQ

SEQ ID NO: 373006 - protein, 10 aa, Influenza virus
KSLMLATGMR

SEQ ID NO: 373007 - protein, 10 aa, Influenza virus
ATGMRNVPET

SEQ ID NO: 373008 - protein, 10 aa, Influenza virus
QAADYKSTQK

SEQ ID NO: 373009 - protein, 10 aa, Influenza virus
AADYKSTQKT

SEQ ID NO: 373010 - protein, 10 aa, Influenza virus
ADYKSTQKTI

SEQ ID NO: 373011 - protein, 10 aa, Influenza virus
DYKSTQKTID

SEQ ID NO: 373012 - protein, 10 aa, Influenza virus
YESTQAAIDQ

SEQ ID NO: 373013 - protein, 10 aa, Influenza virus
KSTQKTIDQV

SEQ ID NO: 373014 - protein, 10 aa, Influenza virus
STQKTIDQVT

SEQ ID NO: 373015 - protein, 10 aa, Influenza virus
TQKTIDQVTG

SEQ ID NO: 373016 - protein, 10 aa, Influenza virus
QKTIDQVTGK

SEQ ID NO: 373017 - protein, 10 aa, Influenza virus
KTIDQVTGKL

SEQ ID NO: 373018 - protein, 10 aa, Influenza virus
TIDQVTGKLN

SEQ ID NO: 373019 - protein, 10 aa, Influenza virus
IDQVTGKLNR

SEQ ID NO: 373020 - protein, 10 aa, Influenza virus
ESIESEFSET

SEQ ID NO: 373021 - protein, 10 aa, Influenza virus
SIESEFSETE

SEQ ID NO: 373022 - protein, 10 aa, Influenza virus
IESEFSETEH

SEQ ID NO: 373023 - protein, 10 aa, Influenza virus
ESEFSETEHQ

SEQ ID NO: 373024 - protein, 10 aa, Influenza virus
SEFSETEHQI

SEQ ID NO: 373025 - protein, 10 aa, Influenza virus
EFSETEHQIG

SEQ ID NO: 373026 - protein, 10 aa, Influenza virus
FSETEHQIGN

SEQ ID NO: 373027 - protein, 10 aa, Influenza virus
SETEHQIGNV

SEQ ID NO: 373028 - protein, 10 aa, Influenza virus
EIEYQIGNVI

SEQ ID NO: 373029 - protein, 10 aa, Influenza virus
IEYQIGNVIN

SEQ ID NO: 373030 - protein, 10 aa, Influenza virus
DSEMLNLYEG

SEQ ID NO: 373031 - protein, 10 aa, Influenza virus
STMLNLYERV

SEQ ID NO: 373032 - protein, 10 aa, Influenza virus
TMLNLYERVR

SEQ ID NO: 373033 - protein, 10 aa, Influenza virus
GKGCFEIYHT

SEQ ID NO: 373034 - protein, 10 aa, Influenza virus
KGCFEIYHTC

SEQ ID NO: 373035 - protein, 10 aa, Influenza virus
GCFEIYHTCD

SEQ ID NO: 373036 - protein, 10 aa, Influenza virus
CDNNCMESIR

SEQ ID NO: 373037 - protein, 10 aa, Influenza virus
NNCMESIRNN

SEQ ID NO: 373038 - protein, 10 aa, Influenza virus
NCMESIRDNT

SEQ ID NO: 373039 - protein, 10 aa, Influenza virus
SIRNNTYDHS

SEQ ID NO: 373040 - protein, 10 aa, Influenza virus
IRNNTYDHSQ

SEQ ID NO: 373041 - protein, 10 aa, Influenza virus
RNNTYDHSQY

SEQ ID NO: 373042 - protein, 10 aa, Influenza virus
NNTYDHSQYR

SEQ ID NO: 373043 - protein, 10 aa, Influenza virus
NTYDHSQYRE

SEQ ID NO: 373044 - protein, 10 aa, Influenza virus
TYDHSQYREE

SEQ ID NO: 373045 - protein, 10 aa, Influenza virus
YDHSQYREEA

SEQ ID NO: 373046 - protein, 10 aa, Influenza virus
DHSQYREEAL

SEQ ID NO: 373047 - protein, 10 aa, Influenza virus
HSQYREEALL

SEQ ID NO: 373048 - protein, 10 aa, Influenza virus
SQYREEALLN

SEQ ID NO: 373049 - protein, 10 aa, Influenza virus
ALLNRLSINP

SEQ ID NO: 373050 - protein, 10 aa, Influenza virus
LLNRLSINPV

SEQ ID NO: 373051 - protein, 10 aa, Influenza virus
LNRLSINPVK

SEQ ID NO: 373052 - protein, 10 aa, Influenza virus
NRLSINPVKL

SEQ ID NO: 373053 - protein, 10 aa, Influenza virus
RLSINPVKLS

SEQ ID NO: 373054 - protein, 10 aa, Influenza virus
LSINPVKLSS

SEQ ID NO: 373055 - protein, 10 aa, Influenza virus
SINPVKLSSG

SEQ ID NO: 373056 - protein, 10 aa, Influenza virus
INPVTLSSGY

SEQ ID NO: 373057 - protein, 10 aa, Influenza virus
NPVTLSSGYK

SEQ ID NO: 373058 - protein, 10 aa, Influenza virus
PVTLSSGYKD

SEQ ID NO: 373059 - protein, 10 aa, Influenza virus
VTLSSGYKDI

SEQ ID NO: 373060 - protein, 10 aa, Influenza virus
TLSSGYKDII

SEQ ID NO: 373061 - protein, 10 aa, Influenza virus
NVILWFSFGA

SEQ ID NO: 373062 - protein, 10 aa, Influenza virus
GASCFVLLAA

SEQ ID NO: 373063 - protein, 10 aa, Influenza virus
IMGLVFFCLR

SEQ ID NO: 373064 - protein, 10 aa, Influenza virus
VGLVFFCLKN

SEQ ID NO: 373065 - protein, 10 aa, Influenza virus
GLFFFCLKNG

SEQ ID NO: 373066 - protein, 10 aa, Influenza virus
LFFFCLKNGN

SEQ ID NO: 373067 - protein, 10 aa, Influenza virus
FFFCLKNGNM

SEQ ID NO: 373068 - protein, 10 aa, Influenza virus
KNGNMRCTIL

SEQ ID NO: 373069 - protein, 10 aa, Influenza virus
MNPNQNLFTL

SEQ ID NO: 373070 - protein, 10 aa, Influenza virus
NPKSKLFTLS

SEQ ID NO: 373071 - protein, 10 aa, Influenza virus
PKSKLFTLSG

SEQ ID NO: 373072 - protein, 10 aa, Influenza virus
KSKLFTLSGV

SEQ ID NO: 373073 - protein, 10 aa, Influenza virus
QNLFTLSGVA

SEQ ID NO: 373074 - protein, 10 aa, Influenza virus
KLFALSGVAV

SEQ ID NO: 373075 - protein, 10 aa, Influenza virus
LFALSGVAVA

SEQ ID NO: 373076 - protein, 10 aa, Influenza virus
FALSGVAVAL

SEQ ID NO: 373077 - protein, 10 aa, Influenza virus
MNLLIGISNV

SEQ ID NO: 373078 - protein, 10 aa, Influenza virus
VGLKVSLHLK

SEQ ID NO: 373079 - protein, 10 aa, Influenza virus
EKGPKQEENS

SEQ ID NO: 373080 - protein, 10 aa, Influenza virus
NQNNTTVVEN

SEQ ID NO: 373081 - protein, 10 aa, Influenza virus
QTNTTLIENT

SEQ ID NO: 373082 - protein, 10 aa, Influenza virus
NNTTVVENKY

SEQ ID NO: 373083 - protein, 10 aa, Influenza virus
TVVENKYVNN

SEQ ID NO: 373084 - protein, 10 aa, Influenza virus
VVENKYVNNT

SEQ ID NO: 373085 - protein, 10 aa, Influenza virus
IENTYVNKTT

SEQ ID NO: 373086 - protein, 10 aa, Influenza virus
ENKYVNNTTI

SEQ ID NO: 373087 - protein, 10 aa, Influenza virus
NTYVNKTTVI

SEQ ID NO: 373088 - protein, 10 aa, Influenza virus
YVNNTTVISK

SEQ ID NO: 373089 - protein, 10 aa, Influenza virus
YLLLNKSLCN

SEQ ID NO: 373090 - protein, 10 aa, Influenza virus
LLLNKSLCNV

SEQ ID NO: 373091 - protein, 10 aa, Influenza virus
LLNKSLCNVE

SEQ ID NO: 373092 - protein, 10 aa, Influenza virus
LNKSLCSVEG

SEQ ID NO: 373093 - protein, 10 aa, Influenza virus
NKSLCSVEGW

SEQ ID NO: 373094 - protein, 10 aa, Influenza virus
KSLCSVEGWV

SEQ ID NO: 373095 - protein, 10 aa, Influenza virus
SLCSVEGWVV

SEQ ID NO: 373096 - protein, 10 aa, Influenza virus
LCSVEGWVVI

SEQ ID NO: 373097 - protein, 10 aa, Influenza virus
CSVEGWVVIA

SEQ ID NO: 373098 - protein, 10 aa, Influenza virus
SVEGWVVIAK

SEQ ID NO: 373099 - protein, 10 aa, Influenza virus
WVVIAKDNAI

SEQ ID NO: 373100 - protein, 10 aa, Influenza virus
VVIAKDNAIR

SEQ ID NO: 373101 - protein, 10 aa, Influenza virus
VIAKDNAIRF

SEQ ID NO: 373102 - protein, 10 aa, Influenza virus
IAKDNAIRFG

SEQ ID NO: 373103 - protein, 10 aa, Influenza virus
KDNAIRFGEG

SEQ ID NO: 373104 - protein, 10 aa, Influenza virus
DNAIRFGEGE

SEQ ID NO: 373105 - protein, 10 aa, Influenza virus
NAIRFGEGEQ

SEQ ID NO: 373106 - protein, 10 aa, Influenza virus
AVRFGESEQI

SEQ ID NO: 373107 - protein, 10 aa, Influenza virus
IRFGESEQVI

SEQ ID NO: 373108 - protein, 10 aa, Influenza virus
RFGEGEQIIV

SEQ ID NO: 373109 - protein, 10 aa, Influenza virus
FGEGEQIIVT

SEQ ID NO: 373110 - protein, 10 aa, Influenza virus
GEGEQIIVTR

SEQ ID NO: 373111 - protein, 10 aa, Influenza virus
EGEQIIVTRE

SEQ ID NO: 373112 - protein, 10 aa, Influenza virus
GEQIIVTREP

SEQ ID NO: 373113 - protein, 10 aa, Influenza virus
REPYVSCDPS

SEQ ID NO: 373114 - protein, 10 aa, Influenza virus
EPYVSCDPSG

SEQ ID NO: 373115 - protein, 10 aa, Influenza virus
PYVSCDPSGC

SEQ ID NO: 373116 - protein, 10 aa, Influenza virus
YVSCDPTGCK

SEQ ID NO: 373117 - protein, 10 aa, Influenza virus
VSCDPTGCKM

SEQ ID NO: 373118 - protein, 10 aa, Influenza virus
SCDPSGCKMY

SEQ ID NO: 373119 - protein, 10 aa, Influenza virus
CDPSGCKMYA

SEQ ID NO: 373120 - protein, 10 aa, Influenza virus
DPSGCKMYAL

SEQ ID NO: 373121 - protein, 10 aa, Influenza virus
PSGCKMYALH

SEQ ID NO: 373122 - protein, 10 aa, Influenza virus
TGCKMYALHQ

SEQ ID NO: 373123 - protein, 10 aa, Influenza virus
RGLMSTPLGT

SEQ ID NO: 373124 - protein, 10 aa, Influenza virus
GLMSTPLGSP

SEQ ID NO: 373125 - protein, 10 aa, Influenza virus
LMSTPLGSPP

SEQ ID NO: 373126 - protein, 10 aa, Influenza virus
ISTPLGTPPT

SEQ ID NO: 373127 - protein, 10 aa, Influenza virus
STPLGTPPTV

SEQ ID NO: 373128 - protein, 10 aa, Influenza virus
TPLGTPPTVS

SEQ ID NO: 373129 - protein, 10 aa, Influenza virus
PLGTPPTVSN

SEQ ID NO: 373130 - protein, 10 aa, Influenza virus
LGTPPTVSNS

SEQ ID NO: 373131 - protein, 10 aa, Influenza virus
GTPPTVSNSD

SEQ ID NO: 373132 - protein, 10 aa, Influenza virus
TPPTVSNSDF

SEQ ID NO: 373133 - protein, 10 aa, Influenza virus
VSNSDFICVG

SEQ ID NO: 373134 - protein, 10 aa, Influenza virus
SNSDFICVGW

SEQ ID NO: 373135 - protein, 10 aa, Influenza virus
NSDFICVGWS

SEQ ID NO: 373136 - protein, 10 aa, Influenza virus
SDFICVGWSS

SEQ ID NO: 373137 - protein, 10 aa, Influenza virus
DFICVGWSST

SEQ ID NO: 373138 - protein, 10 aa, Influenza virus
FMCVGWSSTT

SEQ ID NO: 373139 - protein, 10 aa, Influenza virus
MCVGWSSTTC

SEQ ID NO: 373140 - protein, 10 aa, Influenza virus
WSSTTCHDGI

SEQ ID NO: 373141 - protein, 10 aa, Influenza virus
SSTTCHDGIG

SEQ ID NO: 373142 - protein, 10 aa, Influenza virus
STTCHDGIGR

SEQ ID NO: 373143 - protein, 10 aa, Influenza virus
TTCHDGIGRM

SEQ ID NO: 373144 - protein, 10 aa, Influenza virus
TCHDGIGRMT

SEQ ID NO: 373145 - protein, 10 aa, Influenza virus
DGVGRMTICI

SEQ ID NO: 373146 - protein, 10 aa, Influenza virus
GIGRMTICIQ

SEQ ID NO: 373147 - protein, 10 aa, Influenza virus
VGRMTICIQG

SEQ ID NO: 373148 - protein, 10 aa, Influenza virus
GRMTICVQGK

SEQ ID NO: 373149 - protein, 10 aa, Influenza virus
RMTICVQGKN

SEQ ID NO: 373150 - protein, 10 aa, Influenza virus
MTICIQGNND

SEQ ID NO: 373151 - protein, 10 aa, Influenza virus
TICIQGNNDN

SEQ ID NO: 373152 - protein, 10 aa, Influenza virus
ICIQGNNDNA

SEQ ID NO: 373153 - protein, 10 aa, Influenza virus
CIQGNNDNAT

SEQ ID NO: 373154 - protein, 10 aa, Influenza virus
IQGNNDNATA

SEQ ID NO: 373155 - protein, 10 aa, Influenza virus
QGNNKNATAT

SEQ ID NO: 373156 - protein, 10 aa, Influenza virus
GNNKNATATV

SEQ ID NO: 373157 - protein, 10 aa, Influenza virus
NNKNATATVY

SEQ ID NO: 373158 - protein, 10 aa, Influenza virus
NKNATATVYY

SEQ ID NO: 373159 - protein, 10 aa, Influenza virus
DNATATVYYN

SEQ ID NO: 373160 - protein, 10 aa, Influenza virus
NATATVYYER

SEQ ID NO: 373161 - protein, 10 aa, Influenza virus
ATATVYYNGR

SEQ ID NO: 373162 - protein, 10 aa, Influenza virus
TATVYYNRRP

SEQ ID NO: 373163 - protein, 10 aa, Influenza virus
ATVYYNGRLT

SEQ ID NO: 373164 - protein, 10 aa, Influenza virus
TVYYNRRPTT

SEQ ID NO: 373165 - protein, 10 aa, Influenza virus
VYYNRRPTTT

SEQ ID NO: 373166 - protein, 10 aa, Influenza virus
YYNGRLTTTI

SEQ ID NO: 373167 - protein, 10 aa, Influenza virus
YERRLTTTIK

SEQ ID NO: 373168 - protein, 10 aa, Influenza virus
NRRLTTTIKP

SEQ ID NO: 373169 - protein, 10 aa, Influenza virus
GRLTTTIKTW

SEQ ID NO: 373170 - protein, 10 aa, Influenza virus
LTTTIKPWAR

SEQ ID NO: 373171 - protein, 10 aa, Influenza virus
TTTIKPWARN

SEQ ID NO: 373172 - protein, 10 aa, Influenza virus
TTIKPWARNI

SEQ ID NO: 373173 - protein, 10 aa, Influenza virus
TIKPWARNIL

SEQ ID NO: 373174 - protein, 10 aa, Influenza virus
IKPWARNILR

SEQ ID NO: 373175 - protein, 10 aa, Influenza virus
KPWARNILRT

SEQ ID NO: 373176 - protein, 10 aa, Influenza virus
PWARNILRTQ

SEQ ID NO: 373177 - protein, 10 aa, Influenza virus
WAGKILRTQE

SEQ ID NO: 373178 - protein, 10 aa, Influenza virus
AGKILRTQES

SEQ ID NO: 373179 - protein, 10 aa, Influenza virus
GKILRTQESE

SEQ ID NO: 373180 - protein, 10 aa, Influenza virus
VCHNGTCAVV

SEQ ID NO: 373181 - protein, 10 aa, Influenza virus
CHNGTCAVVM

SEQ ID NO: 373182 - protein, 10 aa, Influenza virus
HNGTCAVVMT

SEQ ID NO: 373183 - protein, 10 aa, Influenza virus
NGTCAVVMTD

SEQ ID NO: 373184 - protein, 10 aa, Influenza virus
GTCAVVMTDG

SEQ ID NO: 373185 - protein, 10 aa, Influenza virus
TCAVVMTDGS

SEQ ID NO: 373186 - protein, 10 aa, Influenza virus
CAVVMTDGSA

SEQ ID NO: 373187 - protein, 10 aa, Influenza virus
AVVMTDGSAS

SEQ ID NO: 373188 - protein, 10 aa, Influenza virus
VIMTDGPASS

SEQ ID NO: 373189 - protein, 10 aa, Influenza virus
IMTDGPANSQ

SEQ ID NO: 373190 - protein, 10 aa, Influenza virus
MTDGPASSQA

SEQ ID NO: 373191 - protein, 10 aa, Influenza virus
TDGPASSQAY

SEQ ID NO: 373192 - protein, 10 aa, Influenza virus
DGSASGQAYT

SEQ ID NO: 373193 - protein, 10 aa, Influenza virus
GPANSQAYTK

SEQ ID NO: 373194 - protein, 10 aa, Influenza virus
QAYTKVMYFH

SEQ ID NO: 373195 - protein, 10 aa, Influenza virus
AYTKVMYFHK

SEQ ID NO: 373196 - protein, 10 aa, Influenza virus
YTKVMYFHKG

SEQ ID NO: 373197 - protein, 10 aa, Influenza virus
TKVLYFHKGI

SEQ ID NO: 373198 - protein, 10 aa, Influenza virus
YFHKGIVIKE

SEQ ID NO: 373199 - protein, 10 aa, Influenza virus
FHKGIVIKEE

SEQ ID NO: 373200 - protein, 10 aa, Influenza virus
KEEVLKGSAR

SEQ ID NO: 373201 - protein, 10 aa, Influenza virus
EETLKGSARH

SEQ ID NO: 373202 - protein, 10 aa, Influenza virus
LQGSARHIEE

SEQ ID NO: 373203 - protein, 10 aa, Influenza virus
QGSARHIEEC

SEQ ID NO: 373204 - protein, 10 aa, Influenza virus
GSARHVEECS

SEQ ID NO: 373205 - protein, 10 aa, Influenza virus
SARHVEECSC

SEQ ID NO: 373206 - protein, 10 aa, Influenza virus
ARHVEECSCY

SEQ ID NO: 373207 - protein, 10 aa, Influenza virus
RHVEECSCYG

SEQ ID NO: 373208 - protein, 10 aa, Influenza virus
IEECSCYGHS

SEQ ID NO: 373209 - protein, 10 aa, Influenza virus
EECSCYGHNQ

SEQ ID NO: 373210 - protein, 10 aa, Influenza virus
ECSCYGHNQK

SEQ ID NO: 373211 - protein, 10 aa, Influenza virus
CYGHNQKITC

SEQ ID NO: 373212 - protein, 10 aa, Influenza virus
QKVTCVCRDN

SEQ ID NO: 373213 - protein, 10 aa, Influenza virus
KVTCICRDNW

SEQ ID NO: 373214 - protein, 10 aa, Influenza virus
ATCVCRDNWQ

SEQ ID NO: 373215 - protein, 10 aa, Influenza virus
WQGANRPVIK

SEQ ID NO: 373216 - protein, 10 aa, Influenza virus
QGANRPIIEI

SEQ ID NO: 373217 - protein, 10 aa, Influenza virus
GANRPIIEID

SEQ ID NO: 373218 - protein, 10 aa, Influenza virus
ANRPIIEIDM

SEQ ID NO: 373219 - protein, 10 aa, Influenza virus
VMEHTSQYLC

SEQ ID NO: 373220 - protein, 10 aa, Influenza virus
MKHTSQYLCT

SEQ ID NO: 373221 - protein, 10 aa, Influenza virus
EHTSQYICTG

SEQ ID NO: 373222 - protein, 10 aa, Influenza virus
HTSQYLCTGI

SEQ ID NO: 373223 - protein, 10 aa, Influenza virus
TSQYLCTGIL

SEQ ID NO: 373224 - protein, 10 aa, Influenza virus
SQYLCTGILT

SEQ ID NO: 373225 - protein, 10 aa, Influenza virus
QYLCTGILTD

SEQ ID NO: 373226 - protein, 10 aa, Influenza virus
YLCTGILTDT

SEQ ID NO: 373227 - protein, 10 aa, Influenza virus
LCTGILTDTS

SEQ ID NO: 373228 - protein, 10 aa, Influenza virus
GILTDTSRPS

SEQ ID NO: 373229 - protein, 10 aa, Influenza virus
ILTDTSRPSD

SEQ ID NO: 373230 - protein, 10 aa, Influenza virus
LTDTSRPSDR

SEQ ID NO: 373231 - protein, 10 aa, Influenza virus
CSNPITGSPS

SEQ ID NO: 373232 - protein, 10 aa, Influenza virus
SNPITGSPSA

SEQ ID NO: 373233 - protein, 10 aa, Influenza virus
GVKGFGFLDG

SEQ ID NO: 373234 - protein, 10 aa, Influenza virus
DNTWLGRTIS

SEQ ID NO: 373235 - protein, 10 aa, Influenza virus
TWLGRTFSPR

SEQ ID NO: 373236 - protein, 10 aa, Influenza virus
WLGRTISPHS

SEQ ID NO: 373237 - protein, 10 aa, Influenza virus
LGGTISPRSR

SEQ ID NO: 373238 - protein, 10 aa, Influenza virus
GRTFSPRSRS

SEQ ID NO: 373239 - protein, 10 aa, Influenza virus
GTISPRSRSG

SEQ ID NO: 373240 - protein, 10 aa, Influenza virus
FEMLKVPNAG

SEQ ID NO: 373241 - protein, 10 aa, Influenza virus
EMLKVPNAGT

SEQ ID NO: 373242 - protein, 10 aa, Influenza virus
MLKVPNAGTD

SEQ ID NO: 373243 - protein, 10 aa, Influenza virus
LKVPNAGTDP

SEQ ID NO: 373244 - protein, 10 aa, Influenza virus
KIPNAETDPS

SEQ ID NO: 373245 - protein, 10 aa, Influenza virus
IPNAETDPSS

SEQ ID NO: 373246 - protein, 10 aa, Influenza virus
NNKWSGYSGS

SEQ ID NO: 373247 - protein, 10 aa, Influenza virus
NNLSGYSGSF

SEQ ID NO: 373248 - protein, 10 aa, Influenza virus
KWSGYSGSFI

SEQ ID NO: 373249 - protein, 10 aa, Influenza virus
SGSFIDYWND

SEQ ID NO: 373250 - protein, 10 aa, Influenza virus
SVCYNPCFYV

SEQ ID NO: 373251 - protein, 10 aa, Influenza virus
ACYNPCFYVE

SEQ ID NO: 373252 - protein, 10 aa, Influenza virus
SLIALCGSPF

SEQ ID NO: 373253 - protein, 10 aa, Influenza virus
LVALCGSPVP

SEQ ID NO: 373254 - protein, 10 aa, Influenza virus
VALCGSPVPV

SEQ ID NO: 373255 - protein, 10 aa, Influenza virus
ALCGSPVPVG

SEQ ID NO: 373256 - protein, 10 aa, Influenza virus
LCGSPVPVGS

SEQ ID NO: 373257 - protein, 10 aa, Influenza virus
CGSPVPVGSG

SEQ ID NO: 373258 - protein, 10 aa, Influenza virus
GSPVPVGSGS

SEQ ID NO: 373259 - protein, 10 aa, Influenza virus
SPVPVGSGSF

SEQ ID NO: 373260 - protein, 10 aa, Influenza virus
PVPVGSGSFP

SEQ ID NO: 373261 - protein, 10 aa, Influenza virus
VPVGSGSFPD

SEQ ID NO: 373262 - protein, 10 aa, Influenza virus
GSGSFPDGAR

SEQ ID NO: 373263 - protein, 10 aa, Influenza virus
SGSFPDGARI

SEQ ID NO: 373264 - protein, 10 aa, Influenza virus
GSFPDGAKIQ

SEQ ID NO: 373265 - protein, 10 aa, Influenza virus
SFPDGARIQY

SEQ ID NO: 373266 - protein, 10 aa, Influenza virus
FPDGAKIQYF

SEQ ID NO: 373267 - protein, 10 aa, Influenza virus
PDGARIQYFS

SEQ ID NO: 373268 - protein, 10 aa, Influenza virus
RADEICIGYL

SEQ ID NO: 373269 - protein, 10 aa, Influenza virus
ADEICIGHLS

SEQ ID NO: 373270 - protein, 10 aa, Influenza virus
DKICIGYLSN

SEQ ID NO: 373271 - protein, 10 aa, Influenza virus
KICIGYLSNN

SEQ ID NO: 373272 - protein, 10 aa, Influenza virus
IGYMSNNSTE

SEQ ID NO: 373273 - protein, 10 aa, Influenza virus
GYLSNNSTER

SEQ ID NO: 373274 - protein, 10 aa, Influenza virus
YLSNNSTERV

SEQ ID NO: 373275 - protein, 10 aa, Influenza virus
LSNNSTDKVN

SEQ ID NO: 373276 - protein, 10 aa, Influenza virus
SNNSTDKVNT

SEQ ID NO: 373277 - protein, 10 aa, Influenza virus
NNSTDKVNTI

SEQ ID NO: 373278 - protein, 10 aa, Influenza virus
NSTDKVNTII

SEQ ID NO: 373279 - protein, 10 aa, Influenza virus
STDKVNTIIE

SEQ ID NO: 373280 - protein, 10 aa, Influenza virus
TDKVNTIIEN

SEQ ID NO: 373281 - protein, 10 aa, Influenza virus
DKVNTIIENN

SEQ ID NO: 373282 - protein, 10 aa, Influenza virus
KVNTIIENNV

SEQ ID NO: 373283 - protein, 10 aa, Influenza virus
VNTIIENNVT

SEQ ID NO: 373284 - protein, 10 aa, Influenza virus
NTIIENNVTV

SEQ ID NO: 373285 - protein, 10 aa, Influenza virus
IIESNVTVTN

SEQ ID NO: 373286 - protein, 10 aa, Influenza virus
IESNVTVTNS

SEQ ID NO: 373287 - protein, 10 aa, Influenza virus
ESNVTVTSSI

SEQ ID NO: 373288 - protein, 10 aa, Influenza virus
SNVTVTSSIE

SEQ ID NO: 373289 - protein, 10 aa, Influenza virus
NITVTSSVEL

SEQ ID NO: 373290 - protein, 10 aa, Influenza virus
ITVTSSVELV

SEQ ID NO: 373291 - protein, 10 aa, Influenza virus
VTSSIELVEN

SEQ ID NO: 373292 - protein, 10 aa, Influenza virus
HTGTFCSING

SEQ ID NO: 373293 - protein, 10 aa, Influenza virus
TGSFCSINGR

SEQ ID NO: 373294 - protein, 10 aa, Influenza virus
FCSINGKAPI

SEQ ID NO: 373295 - protein, 10 aa, Influenza virus
CSINGKAPIS

SEQ ID NO: 373296 - protein, 10 aa, Influenza virus
SINGKAPISL

SEQ ID NO: 373297 - protein, 10 aa, Influenza virus
INGKAPISLG

SEQ ID NO: 373298 - protein, 10 aa, Influenza virus
NGKAPISLGD

SEQ ID NO: 373299 - protein, 10 aa, Influenza virus
GKAPISLGGC

SEQ ID NO: 373300 - protein, 10 aa, Influenza virus
RAPISLGDCS

SEQ ID NO: 373301 - protein, 10 aa, Influenza virus
EPISLGDCSF

SEQ ID NO: 373302 - protein, 10 aa, Influenza virus
LGDCSFTGWI

SEQ ID NO: 373303 - protein, 10 aa, Influenza virus
GDCSFAGWLL

SEQ ID NO: 373304 - protein, 10 aa, Influenza virus
GCSFAGWILG

SEQ ID NO: 373305 - protein, 10 aa, Influenza virus
FTGWILGNPM

SEQ ID NO: 373306 - protein, 10 aa, Influenza virus
TGWILGNPMC

SEQ ID NO: 373307 - protein, 10 aa, Influenza virus
WILGNPRCDD

SEQ ID NO: 373308 - protein, 10 aa, Influenza virus
ILGNPRCDDL

SEQ ID NO: 373309 - protein, 10 aa, Influenza virus
LGNPRCDDLI

SEQ ID NO: 373310 - protein, 10 aa, Influenza virus
GNPRCDDLIG

SEQ ID NO: 373311 - protein, 10 aa, Influenza virus
NPRCDDLIGK

SEQ ID NO: 373312 - protein, 10 aa, Influenza virus
CDYLIGKTSW

SEQ ID NO: 373313 - protein, 10 aa, Influenza virus
DYLIGKTSWS

SEQ ID NO: 373314 - protein, 10 aa, Influenza virus
NLIGKTSWSY

SEQ ID NO: 373315 - protein, 10 aa, Influenza virus
NSWSYIVEKP

SEQ ID NO: 373316 - protein, 10 aa, Influenza virus
SWSYIVEKTN

SEQ ID NO: 373317 - protein, 10 aa, Influenza virus
WSYIVEKSNP

SEQ ID NO: 373318 - protein, 10 aa, Influenza virus
NPVNGICYPG

SEQ ID NO: 373319 - protein, 10 aa, Influenza virus
NGICYPGILE

SEQ ID NO: 373320 - protein, 10 aa, Influenza virus
AFFRNMVWLI

SEQ ID NO: 373321 - protein, 10 aa, Influenza virus
WLIHQSETYP

SEQ ID NO: 373322 - protein, 10 aa, Influenza virus
FNNTKGGDVL

SEQ ID NO: 373323 - protein, 10 aa, Influenza virus
QAGRMTFYWA

SEQ ID NO: 373324 - protein, 10 aa, Influenza virus
AGRMTFYWTM

SEQ ID NO: 373325 - protein, 10 aa, Influenza virus
GRMTFYWTMV

SEQ ID NO: 373326 - protein, 10 aa, Influenza virus
TFESDGAFLA

SEQ ID NO: 373327 - protein, 10 aa, Influenza virus
FESDGAFLAP

SEQ ID NO: 373328 - protein, 10 aa, Influenza virus
ESDGAFLAPR

SEQ ID NO: 373329 - protein, 10 aa, Influenza virus
SDGAFLAPRY

SEQ ID NO: 373330 - protein, 10 aa, Influenza virus
IAPRYAFELV

SEQ ID NO: 373331 - protein, 10 aa, Influenza virus
APRYAFELVF

SEQ ID NO: 373332 - protein, 10 aa, Influenza virus
CQTEVGGINT

SEQ ID NO: 373333 - protein, 10 aa, Influenza virus
NVHRSTIGDC

SEQ ID NO: 373334 - protein, 10 aa, Influenza virus
VHRNAIGDCP

SEQ ID NO: 373335 - protein, 10 aa, Influenza virus
HRNAIGDCPK

SEQ ID NO: 373336 - protein, 10 aa, Influenza virus
RSTIGDCPKY

SEQ ID NO: 373337 - protein, 10 aa, Influenza virus
NTFGDCPKYV

SEQ ID NO: 373338 - protein, 10 aa, Influenza virus
AIGDCPKYVN

SEQ ID NO: 373339 - protein, 10 aa, Influenza virus
IGDCPKYVNI

SEQ ID NO: 373340 - protein, 10 aa, Influenza virus
GDCPKYVNVR

SEQ ID NO: 373341 - protein, 10 aa, Influenza virus
DCPKYMNVKS

SEQ ID NO: 373342 - protein, 10 aa, Influenza virus
CPKYVNVRSL

SEQ ID NO: 373343 - protein, 10 aa, Influenza virus
PKYMNVKSLK

SEQ ID NO: 373344 - protein, 10 aa, Influenza virus
KYMNVKSLKL

SEQ ID NO: 373345 - protein, 10 aa, Influenza virus
YMNVKSLKLA

SEQ ID NO: 373346 - protein, 10 aa, Influenza virus
NVKSLKLASG

SEQ ID NO: 373347 - protein, 10 aa, Influenza virus
RSLKLATGLR

SEQ ID NO: 373348 - protein, 10 aa, Influenza virus
SLKLASGLRN

SEQ ID NO: 373349 - protein, 10 aa, Influenza virus
LKLATGPRNV

SEQ ID NO: 373350 - protein, 10 aa, Influenza virus
KLATGPRNVP

SEQ ID NO: 373351 - protein, 10 aa, Influenza virus
LATGPRNVPA

SEQ ID NO: 373352 - protein, 10 aa, Influenza virus
ARGLFGAIAG

SEQ ID NO: 373353 - protein, 10 aa, Influenza virus
QHRDEEGTGI

SEQ ID NO: 373354 - protein, 10 aa, Influenza virus
HRNDEGTGIA

SEQ ID NO: 373355 - protein, 10 aa, Influenza virus
RDEEGTGIAA

SEQ ID NO: 373356 - protein, 10 aa, Influenza virus
NEEGTGVAAD

SEQ ID NO: 373357 - protein, 10 aa, Influenza virus
DEGTGIAADK

SEQ ID NO: 373358 - protein, 10 aa, Influenza virus
IAADKESTQT

SEQ ID NO: 373359 - protein, 10 aa, Influenza virus
AADKESTQTA

SEQ ID NO: 373360 - protein, 10 aa, Influenza virus
DIWSYNARLL

SEQ ID NO: 373361 - protein, 10 aa, Influenza virus
IWSYNARLLV

SEQ ID NO: 373362 - protein, 10 aa, Influenza virus
WSYNAKLLVL

SEQ ID NO: 373363 - protein, 10 aa, Influenza virus
SYNARLLVLL

SEQ ID NO: 373364 - protein, 10 aa, Influenza virus
YNARLLVLLE

SEQ ID NO: 373365 - protein, 10 aa, Influenza virus
NAKLLVLLEN

SEQ ID NO: 373366 - protein, 10 aa, Influenza virus
AKLLVLLENE

SEQ ID NO: 373367 - protein, 10 aa, Influenza virus
KLLVLLENEK

SEQ ID NO: 373368 - protein, 10 aa, Influenza virus
LDLHDSNVTN

SEQ ID NO: 373369 - protein, 10 aa, Influenza virus
DLHDSNVKNL

SEQ ID NO: 373370 - protein, 10 aa, Influenza virus
LHDSNVTNLH

SEQ ID NO: 373371 - protein, 10 aa, Influenza virus
HDSNVKNLHE

SEQ ID NO: 373372 - protein, 10 aa, Influenza virus
DSNVRSLHEK

SEQ ID NO: 373373 - protein, 10 aa, Influenza virus
LKGNAKDEGN

SEQ ID NO: 373374 - protein, 10 aa, Influenza virus
KGNAKDEGNG

SEQ ID NO: 373375 - protein, 10 aa, Influenza virus
NNAKDEGNGC

SEQ ID NO: 373376 - protein, 10 aa, Influenza virus
GCFPFYHKCD

SEQ ID NO: 373377 - protein, 10 aa, Influenza virus
CFTFYHKCNN

SEQ ID NO: 373378 - protein, 10 aa, Influenza virus
FYHKCDDECI

SEQ ID NO: 373379 - protein, 10 aa, Influenza virus
YHKCDDECIE

SEQ ID NO: 373380 - protein, 10 aa, Influenza virus
NKCIERVRNG

SEQ ID NO: 373381 - protein, 10 aa, Influenza virus
KCIERVRNGT

SEQ ID NO: 373382 - protein, 10 aa, Influenza virus
CIEKIRNGTY

SEQ ID NO: 373383 - protein, 10 aa, Influenza virus
IEKIRNGTYD

SEQ ID NO: 373384 - protein, 10 aa, Influenza virus
EKIRNGTYDH

SEQ ID NO: 373385 - protein, 10 aa, Influenza virus
KIRNGTYDHK

SEQ ID NO: 373386 - protein, 10 aa, Influenza virus
GTYDHKDFEE

SEQ ID NO: 373387 - protein, 10 aa, Influenza virus
TYDHKDFEEE

SEQ ID NO: 373388 - protein, 10 aa, Influenza virus
YDHKEFKEES

SEQ ID NO: 373389 - protein, 10 aa, Influenza virus
DHKEFEKESK

SEQ ID NO: 373390 - protein, 10 aa, Influenza virus
ESRLNRQEIE

SEQ ID NO: 373391 - protein, 10 aa, Influenza virus
SRLNRQEIEG

SEQ ID NO: 373392 - protein, 10 aa, Influenza virus
INRQEIEGVR

SEQ ID NO: 373393 - protein, 10 aa, Influenza virus
NRQEIGGVKL

SEQ ID NO: 373394 - protein, 10 aa, Influenza virus
RQEIEGVRLD

SEQ ID NO: 373395 - protein, 10 aa, Influenza virus
GDVYKILSIY

SEQ ID NO: 373396 - protein, 10 aa, Influenza virus
DVYKILSIYS

SEQ ID NO: 373397 - protein, 10 aa, Influenza virus
ICSCIASSLV

SEQ ID NO: 373398 - protein, 10 aa, Influenza virus
CSCIASSLVL

SEQ ID NO: 373399 - protein, 10 aa, Influenza virus
IASSLILAAI

SEQ ID NO: 373400 - protein, 10 aa, Influenza virus
ASSLILAAII

SEQ ID NO: 373401 - protein, 10 aa, Influenza virus
SSLILAAIIM

SEQ ID NO: 373402 - protein, 10 aa, Influenza virus
SLILAAIIMG

SEQ ID NO: 373403 - protein, 10 aa, Influenza virus
WACNNGSCRC

SEQ ID NO: 373404 - protein, 10 aa, Influenza virus
ACNNGSCRCT

SEQ ID NO: 373405 - protein, 10 aa, Influenza virus
CGNGSCRCTI

SEQ ID NO: 373406 - protein, 10 aa, Influenza virus
GNGSCRCTIC

SEQ ID NO: 373407 - protein, 10 aa, Influenza virus
VAYDKICIGY

SEQ ID NO: 373408 - protein, 10 aa, Influenza virus
NSTETVNTLS

SEQ ID NO: 373409 - protein, 10 aa, Influenza virus
STETVNTLSE

SEQ ID NO: 373410 - protein, 10 aa, Influenza virus
TETVNTLSEQ

SEQ ID NO: 373411 - protein, 10 aa, Influenza virus
ETVNTLSEQN

SEQ ID NO: 373412 - protein, 10 aa, Influenza virus
TVNTLTEQNV

SEQ ID NO: 373413 - protein, 10 aa, Influenza virus
VNTLTEQNVP

SEQ ID NO: 373414 - protein, 10 aa, Influenza virus
NTLTEQNVPV

SEQ ID NO: 373415 - protein, 10 aa, Influenza virus
TLTEQNVPVT

SEQ ID NO: 373416 - protein, 10 aa, Influenza virus
LTEQNVPVTQ

SEQ ID NO: 373417 - protein, 10 aa, Influenza virus
TEQNVPVTQV

SEQ ID NO: 373418 - protein, 10 aa, Influenza virus
TQVEELVHRG

SEQ ID NO: 373419 - protein, 10 aa, Influenza virus
QVEELVHGGV

SEQ ID NO: 373420 - protein, 10 aa, Influenza virus
VEELVHGGVD

SEQ ID NO: 373421 - protein, 10 aa, Influenza virus
EELVHGGVDP

SEQ ID NO: 373422 - protein, 10 aa, Influenza virus
TKLGSPLVLD

SEQ ID NO: 373423 - protein, 10 aa, Influenza virus
KLGSPLVLDD

SEQ ID NO: 373424 - protein, 10 aa, Influenza virus
VLDDCSLKGL

SEQ ID NO: 373425 - protein, 10 aa, Influenza virus
LDDCSLKGLI

SEQ ID NO: 373426 - protein, 10 aa, Influenza virus
DDCSLEGLVL

SEQ ID NO: 373427 - protein, 10 aa, Influenza virus
DCSLKGLILG

SEQ ID NO: 373428 - protein, 10 aa, Influenza virus
CSLEGLILSN

SEQ ID NO: 373429 - protein, 10 aa, Influenza virus
SLKGLILGNP

SEQ ID NO: 373430 - protein, 10 aa, Influenza virus
LEGLILSNPK

SEQ ID NO: 373431 - protein, 10 aa, Influenza virus
KGLILGNPKC

SEQ ID NO: 373432 - protein, 10 aa, Influenza virus
GLVLGNPKCD

SEQ ID NO: 373433 - protein, 10 aa, Influenza virus
IILGNPKCDL

SEQ ID NO: 373434 - protein, 10 aa, Influenza virus
ILSNPKCDLY

SEQ ID NO: 373435 - protein, 10 aa, Influenza virus
LSNPKCDLYL

SEQ ID NO: 373436 - protein, 10 aa, Influenza virus
GNPKCDLYLS

SEQ ID NO: 373437 - protein, 10 aa, Influenza virus
NPKCDLYLSG

SEQ ID NO: 373438 - protein, 10 aa, Influenza virus
PKCDLYLSGR

SEQ ID NO: 373439 - protein, 10 aa, Influenza virus
KCDLYLSGRE

SEQ ID NO: 373440 - protein, 10 aa, Influenza virus
CDLYLSGREW

SEQ ID NO: 373441 - protein, 10 aa, Influenza virus
DLYLSGREWS

SEQ ID NO: 373442 - protein, 10 aa, Influenza virus
LYLSGREWSY

SEQ ID NO: 373443 - protein, 10 aa, Influenza virus
SYIVERPKEI

SEQ ID NO: 373444 - protein, 10 aa, Influenza virus
YIVERPKEIE

SEQ ID NO: 373445 - protein, 10 aa, Influenza virus
IVERPKEIEG

SEQ ID NO: 373446 - protein, 10 aa, Influenza virus
VERTKEMEGI

SEQ ID NO: 373447 - protein, 10 aa, Influenza virus
ERTKEMEGIC

SEQ ID NO: 373448 - protein, 10 aa, Influenza virus
RTKEMEGICY

SEQ ID NO: 373449 - protein, 10 aa, Influenza virus
TKEMEGICYP

SEQ ID NO: 373450 - protein, 10 aa, Influenza virus
KEIEGICYPG

SEQ ID NO: 373451 - protein, 10 aa, Influenza virus
EIEGICYPGS

SEQ ID NO: 373452 - protein, 10 aa, Influenza virus
IEGICYPGSI

SEQ ID NO: 373453 - protein, 10 aa, Influenza virus
EGICYPGSVE

SEQ ID NO: 373454 - protein, 10 aa, Influenza virus
GICYPGSVEN

SEQ ID NO: 373455 - protein, 10 aa, Influenza virus
ICYPGSVENQ

SEQ ID NO: 373456 - protein, 10 aa, Influenza virus
CYPGSIKNQE

SEQ ID NO: 373457 - protein, 10 aa, Influenza virus
YPGSIKNQEE

SEQ ID NO: 373458 - protein, 10 aa, Influenza virus
PGSVENQEEL

SEQ ID NO: 373459 - protein, 10 aa, Influenza virus
GSIENQEELK

SEQ ID NO: 373460 - protein, 10 aa, Influenza virus
SIKNQEELRS

SEQ ID NO: 373461 - protein, 10 aa, Influenza virus
IKNQEELRSL

SEQ ID NO: 373462 - protein, 10 aa, Influenza virus
ENQEELKSLF

SEQ ID NO: 373463 - protein, 10 aa, Influenza virus
NQEELKSLFS

SEQ ID NO: 373464 - protein, 10 aa, Influenza virus
QEELKSLFSS

SEQ ID NO: 373465 - protein, 10 aa, Influenza virus
EELKSLFSSI

SEQ ID NO: 373466 - protein, 10 aa, Influenza virus
ELKSLFSSIK

SEQ ID NO: 373467 - protein, 10 aa, Influenza virus
LRSLFSSIKR

SEQ ID NO: 373468 - protein, 10 aa, Influenza virus
RSLFSSIKRY

SEQ ID NO: 373469 - protein, 10 aa, Influenza virus
SLFSSIKRYE

SEQ ID NO: 373470 - protein, 10 aa, Influenza virus
YERVKMFDFI

SEQ ID NO: 373471 - protein, 10 aa, Influenza virus
ERVKMFDFIK

SEQ ID NO: 373472 - protein, 10 aa, Influenza virus
RVKMFDFIKW

SEQ ID NO: 373473 - protein, 10 aa, Influenza virus
VKMFDFIKWN

SEQ ID NO: 373474 - protein, 10 aa, Influenza virus
KMFDFIKWNV

SEQ ID NO: 373475 - protein, 10 aa, Influenza virus
MFDFIKWNVT

SEQ ID NO: 373476 - protein, 10 aa, Influenza virus
FDFTKWNVTH

SEQ ID NO: 373477 - protein, 10 aa, Influenza virus
DFIKWNVTYT

SEQ ID NO: 373478 - protein, 10 aa, Influenza virus
FIKWNVTYTG

SEQ ID NO: 373479 - protein, 10 aa, Influenza virus
TKWNVTYTGI

SEQ ID NO: 373480 - protein, 10 aa, Influenza virus
KWNVTHTGTS

SEQ ID NO: 373481 - protein, 10 aa, Influenza virus
WNVTYTGISK

SEQ ID NO: 373482 - protein, 10 aa, Influenza virus
NVTYTGISKA

SEQ ID NO: 373483 - protein, 10 aa, Influenza virus
VTYTGISKAC

SEQ ID NO: 373484 - protein, 10 aa, Influenza virus
TYTGISKACN

SEQ ID NO: 373485 - protein, 10 aa, Influenza virus
TSNRGSFYRS

SEQ ID NO: 373486 - protein, 10 aa, Influenza virus
SNRGSFYRSM

SEQ ID NO: 373487 - protein, 10 aa, Influenza virus
NQGSFYRSIR

SEQ ID NO: 373488 - protein, 10 aa, Influenza virus
QGSFYRSIRW

SEQ ID NO: 373489 - protein, 10 aa, Influenza virus
GSFYRNMRWL

SEQ ID NO: 373490 - protein, 10 aa, Influenza virus
SFYRNMRWLT

SEQ ID NO: 373491 - protein, 10 aa, Influenza virus
FYRNMRWLTL

SEQ ID NO: 373492 - protein, 10 aa, Influenza virus
YRNMRWLTLK

SEQ ID NO: 373493 - protein, 10 aa, Influenza virus
RNMRWLTLKS

SEQ ID NO: 373494 - protein, 10 aa, Influenza virus
IRWLTLKSGQ

SEQ ID NO: 373495 - protein, 10 aa, Influenza virus
RWLTLKLGQF

SEQ ID NO: 373496 - protein, 10 aa, Influenza virus
WLTLKLGQFP

SEQ ID NO: 373497 - protein, 10 aa, Influenza virus
LTLKLGQFPV

SEQ ID NO: 373498 - protein, 10 aa, Influenza virus
TLKLGQFPVQ

SEQ ID NO: 373499 - protein, 10 aa, Influenza virus
LKLGQFPVQT

SEQ ID NO: 373500 - protein, 10 aa, Influenza virus
KLGQFPVQTD

SEQ ID NO: 373501 - protein, 10 aa, Influenza virus
LGQFPVQTDE

SEQ ID NO: 373502 - protein, 10 aa, Influenza virus
DEYKNTGDSD

SEQ ID NO: 373503 - protein, 10 aa, Influenza virus
EYKNTGDSDI

SEQ ID NO: 373504 - protein, 10 aa, Influenza virus
FIWAIHHPPT

SEQ ID NO: 373505 - protein, 10 aa, Influenza virus
MWAIHHPPTS

SEQ ID NO: 373506 - protein, 10 aa, Influenza virus
WAIHHPPTTD

SEQ ID NO: 373507 - protein, 10 aa, Influenza virus
AIHHPPTTDE

SEQ ID NO: 373508 - protein, 10 aa, Influenza virus
IHHPPTTDEQ

SEQ ID NO: 373509 - protein, 10 aa, Influenza virus
HHPPTSDEQI

SEQ ID NO: 373510 - protein, 10 aa, Influenza virus
EINRIFRPNI

SEQ ID NO: 373511 - protein, 10 aa, Influenza virus
INRIFRPNIG

SEQ ID NO: 373512 - protein, 10 aa, Influenza virus
NRIFRPNIGP

SEQ ID NO: 373513 - protein, 10 aa, Influenza virus
RIFRPNIGPR

SEQ ID NO: 373514 - protein, 10 aa, Influenza virus
IFRPNIGPRP

SEQ ID NO: 373515 - protein, 10 aa, Influenza virus
FRPNIGPRPL

SEQ ID NO: 373516 - protein, 10 aa, Influenza virus
RPNIGPRPLV

SEQ ID NO: 373517 - protein, 10 aa, Influenza virus
PNIGPRPLVM

SEQ ID NO: 373518 - protein, 10 aa, Influenza virus
NIGPRPLVRE

SEQ ID NO: 373519 - protein, 10 aa, Influenza virus
IGPRPLVREQ

SEQ ID NO: 373520 - protein, 10 aa, Influenza virus
GPRPLVREQQ

SEQ ID NO: 373521 - protein, 10 aa, Influenza virus
PRPLVREQQG

SEQ ID NO: 373522 - protein, 10 aa, Influenza virus
RPLVREQQGR

SEQ ID NO: 373523 - protein, 10 aa, Influenza virus
PLVREQQGRM

SEQ ID NO: 373524 - protein, 10 aa, Influenza virus
LVREQQGRMD

SEQ ID NO: 373525 - protein, 10 aa, Influenza virus
VMGQQGRMDY

SEQ ID NO: 373526 - protein, 10 aa, Influenza virus
MGQQGRMDYY

SEQ ID NO: 373527 - protein, 10 aa, Influenza virus
PGQTVKIKTN

SEQ ID NO: 373528 - protein, 10 aa, Influenza virus
GQTVKIKTNG

SEQ ID NO: 373529 - protein, 10 aa, Influenza virus
QTVKIKTNGN

SEQ ID NO: 373530 - protein, 10 aa, Influenza virus
TVKIKTNGNL

SEQ ID NO: 373531 - protein, 10 aa, Influenza virus
VKIQTSGNLI

SEQ ID NO: 373532 - protein, 10 aa, Influenza virus
KIQTSGNLIA

SEQ ID NO: 373533 - protein, 10 aa, Influenza virus
IQTSGNLIAP

SEQ ID NO: 373534 - protein, 10 aa, Influenza virus
KTNGNLIAPE

SEQ ID NO: 373535 - protein, 10 aa, Influenza virus
LIAPEYGYLI

SEQ ID NO: 373536 - protein, 10 aa, Influenza virus
IAPEYGHLTT

SEQ ID NO: 373537 - protein, 10 aa, Influenza virus
APEYGHLTTG

SEQ ID NO: 373538 - protein, 10 aa, Influenza virus
PEYGHLTTGK

SEQ ID NO: 373539 - protein, 10 aa, Influenza virus
EYGHLTTGKS

SEQ ID NO: 373540 - protein, 10 aa, Influenza virus
YGYLITGKSH

SEQ ID NO: 373541 - protein, 10 aa, Influenza virus
GHLTTGKSHG

SEQ ID NO: 373542 - protein, 10 aa, Influenza virus
YLITGKSHGR

SEQ ID NO: 373543 - protein, 10 aa, Influenza virus
LVTGKSHGRI

SEQ ID NO: 373544 - protein, 10 aa, Influenza virus
ITGKSHGRVL

SEQ ID NO: 373545 - protein, 10 aa, Influenza virus
KSHGRVLKNN

SEQ ID NO: 373546 - protein, 10 aa, Influenza virus
SHGRVLKNNL

SEQ ID NO: 373547 - protein, 10 aa, Influenza virus
HGRVLKNNLP

SEQ ID NO: 373548 - protein, 10 aa, Influenza virus
TKCQLNEGVM

SEQ ID NO: 373549 - protein, 10 aa, Influenza virus
KCQLNEGVMN

SEQ ID NO: 373550 - protein, 10 aa, Influenza virus
CQLNEGIMNT

SEQ ID NO: 373551 - protein, 10 aa, Influenza virus
QLNEGIMNTS

SEQ ID NO: 373552 - protein, 10 aa, Influenza virus
LNEGVINTSK

SEQ ID NO: 373553 - protein, 10 aa, Influenza virus
NEGIMNTSKP

SEQ ID NO: 373554 - protein, 10 aa, Influenza virus
EGIMNTSKPF

SEQ ID NO: 373555 - protein, 10 aa, Influenza virus
GVMNTSKPLQ

SEQ ID NO: 373556 - protein, 10 aa, Influenza virus
VMNTSKPLQN

SEQ ID NO: 373557 - protein, 10 aa, Influenza virus
MNTSKPFQNI

SEQ ID NO: 373558 - protein, 10 aa, Influenza virus
NTSKPLQNTS

SEQ ID NO: 373559 - protein, 10 aa, Influenza virus
TSKPFQNICK

SEQ ID NO: 373560 - protein, 10 aa, Influenza virus
SKPFQNTSRH

SEQ ID NO: 373561 - protein, 10 aa, Influenza virus
KPFQNICKPY

SEQ ID NO: 373562 - protein, 10 aa, Influenza virus
PFQNTSRHYI

SEQ ID NO: 373563 - protein, 10 aa, Influenza virus
FQNTSRHYIG

SEQ ID NO: 373564 - protein, 10 aa, Influenza virus
QNTSRHYIGK

SEQ ID NO: 373565 - protein, 10 aa, Influenza virus
NICKPYIGKC

SEQ ID NO: 373566 - protein, 10 aa, Influenza virus
TSRHYIGKCP

SEQ ID NO: 373567 - protein, 10 aa, Influenza virus
SRHYIGKCPK

SEQ ID NO: 373568 - protein, 10 aa, Influenza virus
KPYIGKCPKY

SEQ ID NO: 373569 - protein, 10 aa, Influenza virus
PYIGKCPKYI

SEQ ID NO: 373570 - protein, 10 aa, Influenza virus
YIGKCPKYIS

SEQ ID NO: 373571 - protein, 10 aa, Influenza virus
IGKCPKYISS

SEQ ID NO: 373572 - protein, 10 aa, Influenza virus
GKCPRYIPSG

SEQ ID NO: 373573 - protein, 10 aa, Influenza virus
KCPRYIPSGS

SEQ ID NO: 373574 - protein, 10 aa, Influenza virus
CPRYIPSGSL

SEQ ID NO: 373575 - protein, 10 aa, Influenza virus
PRYIPSGSLK

SEQ ID NO: 373576 - protein, 10 aa, Influenza virus
RYIPSGSLKL

SEQ ID NO: 373577 - protein, 10 aa, Influenza virus
YISSGSLKLA

SEQ ID NO: 373578 - protein, 10 aa, Influenza virus
IPSRSLKLAI

SEQ ID NO: 373579 - protein, 10 aa, Influenza virus
PSRSLKLAIG

SEQ ID NO: 373580 - protein, 10 aa, Influenza virus
SGSLKLAIGP

SEQ ID NO: 373581 - protein, 10 aa, Influenza virus
GSLKLAIGPR

SEQ ID NO: 373582 - protein, 10 aa, Influenza virus
AIGPRNVPQA

SEQ ID NO: 373583 - protein, 10 aa, Influenza virus
IGPRNVPQVQ

SEQ ID NO: 373584 - protein, 10 aa, Influenza virus
RNVPQAQNRG

SEQ ID NO: 373585 - protein, 10 aa, Influenza virus
NVPQAQNRGL

SEQ ID NO: 373586 - protein, 10 aa, Influenza virus
VPQAQNRGLF

SEQ ID NO: 373587 - protein, 10 aa, Influenza virus
PQAQNRGLFG

SEQ ID NO: 373588 - protein, 10 aa, Influenza virus
QAQNRGLFGA

SEQ ID NO: 373589 - protein, 10 aa, Influenza virus
QNRGLFGAKA

SEQ ID NO: 373590 - protein, 10 aa, Influenza virus
NRGLFGAKAG

SEQ ID NO: 373591 - protein, 10 aa, Influenza virus
GAIAGFIEGR

SEQ ID NO: 373592 - protein, 10 aa, Influenza virus
AIAGFIEGRW

SEQ ID NO: 373593 - protein, 10 aa, Influenza virus
IAGFIEGRWP

SEQ ID NO: 373594 - protein, 10 aa, Influenza virus
GFQHQNAEGI

SEQ ID NO: 373595 - protein, 10 aa, Influenza virus
FQHQNAEGIG

SEQ ID NO: 373596 - protein, 10 aa, Influenza virus
QHQNSEGTGI

SEQ ID NO: 373597 - protein, 10 aa, Influenza virus
HQNSEGTGIA

SEQ ID NO: 373598 - protein, 10 aa, Influenza virus
QNSEGTGIAA

SEQ ID NO: 373599 - protein, 10 aa, Influenza virus
NSEGTGIAAD

SEQ ID NO: 373600 - protein, 10 aa, Influenza virus
SEGTGIAADR

SEQ ID NO: 373601 - protein, 10 aa, Influenza virus
EGTGIAADRG

SEQ ID NO: 373602 - protein, 10 aa, Influenza virus
GTGIAADRGS

SEQ ID NO: 373603 - protein, 10 aa, Influenza virus
IGIAADRDST

SEQ ID NO: 373604 - protein, 10 aa, Influenza virus
GIAADRGSTQ

SEQ ID NO: 373605 - protein, 10 aa, Influenza virus
AADRDSTQMA

SEQ ID NO: 373606 - protein, 10 aa, Influenza virus
ADRDSTQMAI

SEQ ID NO: 373607 - protein, 10 aa, Influenza virus
DRDSTQMAID

SEQ ID NO: 373608 - protein, 10 aa, Influenza virus
RDSTQMAIDN

SEQ ID NO: 373609 - protein, 10 aa, Influenza virus
DSTQMAIDNM

SEQ ID NO: 373610 - protein, 10 aa, Influenza virus
STQMAIDNMQ

SEQ ID NO: 373611 - protein, 10 aa, Influenza virus
TQMAIDNMQN

SEQ ID NO: 373612 - protein, 10 aa, Influenza virus
QMAIDNMQNK

SEQ ID NO: 373613 - protein, 10 aa, Influenza virus
MAIDNMQNKL

SEQ ID NO: 373614 - protein, 10 aa, Influenza virus
AIDNMQNRLN

SEQ ID NO: 373615 - protein, 10 aa, Influenza virus
IDNMQNRLNN

SEQ ID NO: 373616 - protein, 10 aa, Influenza virus
DNMQNRLNNV

SEQ ID NO: 373617 - protein, 10 aa, Influenza virus
IMQNKLNNVI

SEQ ID NO: 373618 - protein, 10 aa, Influenza virus
RLNNVIDKMN

SEQ ID NO: 373619 - protein, 10 aa, Influenza virus
LNNVIDKMNN

SEQ ID NO: 373620 - protein, 10 aa, Influenza virus
NNVIDKMYKQ

SEQ ID NO: 373621 - protein, 10 aa, Influenza virus
NVIDKMYKQF

SEQ ID NO: 373622 - protein, 10 aa, Influenza virus
EFSEVETRIN

SEQ ID NO: 373623 - protein, 10 aa, Influenza virus
VESRINTINS

SEQ ID NO: 373624 - protein, 10 aa, Influenza virus
SRINTINSKI

SEQ ID NO: 373625 - protein, 10 aa, Influenza virus
RINTINSKID

SEQ ID NO: 373626 - protein, 10 aa, Influenza virus
INMINSKIED

SEQ ID NO: 373627 - protein, 10 aa, Influenza virus
NMINSKINDQ

SEQ ID NO: 373628 - protein, 10 aa, Influenza virus
IEDQITDIWA

SEQ ID NO: 373629 - protein, 10 aa, Influenza virus
EDQITDIWAY

SEQ ID NO: 373630 - protein, 10 aa, Influenza virus
DQIIDIWAYN

SEQ ID NO: 373631 - protein, 10 aa, Influenza virus
QIIDIWAYNA

SEQ ID NO: 373632 - protein, 10 aa, Influenza virus
IIDIWAYNAE

SEQ ID NO: 373633 - protein, 10 aa, Influenza virus
ANVRNLHDRT

SEQ ID NO: 373634 - protein, 10 aa, Influenza virus
NVRNLHDRVK

SEQ ID NO: 373635 - protein, 10 aa, Influenza virus
VRNLHDRVKR

SEQ ID NO: 373636 - protein, 10 aa, Influenza virus
ENALDTGDGC

SEQ ID NO: 373637 - protein, 10 aa, Influenza virus
NALDTGDGCF

SEQ ID NO: 373638 - protein, 10 aa, Influenza virus
ALDTGDGCFE

SEQ ID NO: 373639 - protein, 10 aa, Influenza virus
LDTGDGCFEI

SEQ ID NO: 373640 - protein, 10 aa, Influenza virus
DNGDGCFEIL

SEQ ID NO: 373641 - protein, 10 aa, Influenza virus
NGDGCFEILH

SEQ ID NO: 373642 - protein, 10 aa, Influenza virus
GCFEILHRCN

SEQ ID NO: 373643 - protein, 10 aa, Influenza virus
CFEILHRCDD

SEQ ID NO: 373644 - protein, 10 aa, Influenza virus
TIRNGTYNHR

SEQ ID NO: 373645 - protein, 10 aa, Influenza virus
YEEESRIERQ

SEQ ID NO: 373646 - protein, 10 aa, Influenza virus
EEESKLERQR

SEQ ID NO: 373647 - protein, 10 aa, Influenza virus
ERQKVNGVKL

SEQ ID NO: 373648 - protein, 10 aa, Influenza virus
RQRINGVKLE

SEQ ID NO: 373649 - protein, 10 aa, Influenza virus
QRINGVKLEE

SEQ ID NO: 373650 - protein, 10 aa, Influenza virus
KVNGVKLEEN

SEQ ID NO: 373651 - protein, 10 aa, Influenza virus
ISGVKLEENS

SEQ ID NO: 373652 - protein, 10 aa, Influenza virus
ADRICIGYLS

SEQ ID NO: 373653 - protein, 10 aa, Influenza virus
DRICIGYLST

SEQ ID NO: 373654 - protein, 10 aa, Influenza virus
RICIGYLSTN

SEQ ID NO: 373655 - protein, 10 aa, Influenza virus
CIGYLSTNSS

SEQ ID NO: 373656 - protein, 10 aa, Influenza virus
IGYLSTNSSE

SEQ ID NO: 373657 - protein, 10 aa, Influenza virus
GYLSTNSTEK

SEQ ID NO: 373658 - protein, 10 aa, Influenza virus
YLSTNSTEKV

SEQ ID NO: 373659 - protein, 10 aa, Influenza virus
LSTNSTEKVD

SEQ ID NO: 373660 - protein, 10 aa, Influenza virus
STNSTEKVDT

SEQ ID NO: 373661 - protein, 10 aa, Influenza virus
TNSTEKVDTL

SEQ ID NO: 373662 - protein, 10 aa, Influenza virus
NSTEKVDTLL

SEQ ID NO: 373663 - protein, 10 aa, Influenza virus
STEKVDTLLE

SEQ ID NO: 373664 - protein, 10 aa, Influenza virus
VDTLLENNVP

SEQ ID NO: 373665 - protein, 10 aa, Influenza virus
DTLLENNVPV

SEQ ID NO: 373666 - protein, 10 aa, Influenza virus
TLLENNVPVT

SEQ ID NO: 373667 - protein, 10 aa, Influenza virus
LLENNVPVTS

SEQ ID NO: 373668 - protein, 10 aa, Influenza virus
LENNVPVTSS

SEQ ID NO: 373669 - protein, 10 aa, Influenza virus
VPVTSSIDLI

SEQ ID NO: 373670 - protein, 10 aa, Influenza virus
PVTSSIDLIE

SEQ ID NO: 373671 - protein, 10 aa, Influenza virus
VTSSIDLIET

SEQ ID NO: 373672 - protein, 10 aa, Influenza virus
DLVETSHTGT

SEQ ID NO: 373673 - protein, 10 aa, Influenza virus
LVETSHTGTY

SEQ ID NO: 373674 - protein, 10 aa, Influenza virus
VETSHTGTYC

SEQ ID NO: 373675 - protein, 10 aa, Influenza virus
ETTHTGTYCS

SEQ ID NO: 373676 - protein, 10 aa, Influenza virus
TTHTGTYCSL

SEQ ID NO: 373677 - protein, 10 aa, Influenza virus
HTGTYCSLGG

SEQ ID NO: 373678 - protein, 10 aa, Influenza virus
VSPVHLGDCR

SEQ ID NO: 373679 - protein, 10 aa, Influenza virus
SPVHLGDCNF

SEQ ID NO: 373680 - protein, 10 aa, Influenza virus
PVHLGDCNFE

SEQ ID NO: 373681 - protein, 10 aa, Influenza virus
VHLGDCNFEG

SEQ ID NO: 373682 - protein, 10 aa, Influenza virus
HLGDCNFEGW

SEQ ID NO: 373683 - protein, 10 aa, Influenza virus
LGDCNFEGWI

SEQ ID NO: 373684 - protein, 10 aa, Influenza virus
GDCSFEGWIG

SEQ ID NO: 373685 - protein, 10 aa, Influenza virus
DCSFEGWIGG

SEQ ID NO: 373686 - protein, 10 aa, Influenza virus
CNFEGWIVGN

SEQ ID NO: 373687 - protein, 10 aa, Influenza virus
NFEGWIVGNP

SEQ ID NO: 373688 - protein, 10 aa, Influenza virus
FEGWIGGNPA

SEQ ID NO: 373689 - protein, 10 aa, Influenza virus
EGWIGGNPAC

SEQ ID NO: 373690 - protein, 10 aa, Influenza virus
GVREWSYLIE

SEQ ID NO: 373691 - protein, 10 aa, Influenza virus
TREWSYLIED

SEQ ID NO: 373692 - protein, 10 aa, Influenza virus
EWSYLIEDPA

SEQ ID NO: 373693 - protein, 10 aa, Influenza virus
WSYLIEDPAA

SEQ ID NO: 373694 - protein, 10 aa, Influenza virus
SYLIEDPAAP

SEQ ID NO: 373695 - protein, 10 aa, Influenza virus
YLIEDPAAPH

SEQ ID NO: 373696 - protein, 10 aa, Influenza virus
LIEDPTAPHG

SEQ ID NO: 373697 - protein, 10 aa, Influenza virus
IEDPTAPHGL

SEQ ID NO: 373698 - protein, 10 aa, Influenza virus
EDPAAPHGLC

SEQ ID NO: 373699 - protein, 10 aa, Influenza virus
DPAAPHGLCY

SEQ ID NO: 373700 - protein, 10 aa, Influenza virus
PAAPHGLCYP

SEQ ID NO: 373701 - protein, 10 aa, Influenza virus
AAPHGLCYPG

SEQ ID NO: 373702 - protein, 10 aa, Influenza virus
HRLCYPGELD

SEQ ID NO: 373703 - protein, 10 aa, Influenza virus
RLCYPGELDN

SEQ ID NO: 373704 - protein, 10 aa, Influenza virus
SGIKSFSRTQ

SEQ ID NO: 373705 - protein, 10 aa, Influenza virus
GIKSFSRTQL

SEQ ID NO: 373706 - protein, 10 aa, Influenza virus
IKSFSRTQLI

SEQ ID NO: 373707 - protein, 10 aa, Influenza virus
KSFSRTELIA

SEQ ID NO: 373708 - protein, 10 aa, Influenza virus
SFSRTQLIAP

SEQ ID NO: 373709 - protein, 10 aa, Influenza virus
TGTNSFYRNL

SEQ ID NO: 373710 - protein, 10 aa, Influenza virus
RTYNNTTGRD

SEQ ID NO: 373711 - protein, 10 aa, Influenza virus
VYNNTTGRDV

SEQ ID NO: 373712 - protein, 10 aa, Influenza virus
NTTGRDVLVI

SEQ ID NO: 373713 - protein, 10 aa, Influenza virus
TTGRDVLVIW

SEQ ID NO: 373714 - protein, 10 aa, Influenza virus
TGRDVLVIWG

SEQ ID NO: 373715 - protein, 10 aa, Influenza virus
GRDVLVIWGI

SEQ ID NO: 373716 - protein, 10 aa, Influenza virus
RDVLVIWGIH

SEQ ID NO: 373717 - protein, 10 aa, Influenza virus
DVLVIWGIHH

SEQ ID NO: 373718 - protein, 10 aa, Influenza virus
VLVIWGIHHP

SEQ ID NO: 373719 - protein, 10 aa, Influenza virus
PYTLVSTGSW

SEQ ID NO: 373720 - protein, 10 aa, Influenza virus
YTLVSTGSWS

SEQ ID NO: 373721 - protein, 10 aa, Influenza virus
GVRPGYNGQK

SEQ ID NO: 373722 - protein, 10 aa, Influenza virus
VRPGYNGQKS

SEQ ID NO: 373723 - protein, 10 aa, Influenza virus
RPRYNGQRSW

SEQ ID NO: 373724 - protein, 10 aa, Influenza virus
PGYNGQKSWT

SEQ ID NO: 373725 - protein, 10 aa, Influenza virus
GYNGQKSWTK

SEQ ID NO: 373726 - protein, 10 aa, Influenza virus
YNGQKSWTKI

SEQ ID NO: 373727 - protein, 10 aa, Influenza virus
NGQKSWTKIY

SEQ ID NO: 373728 - protein, 10 aa, Influenza virus
GQKSWTKIYW

SEQ ID NO: 373729 - protein, 10 aa, Influenza virus
ITFESNGGFL

SEQ ID NO: 373730 - protein, 10 aa, Influenza virus
TFESNGGFLA

SEQ ID NO: 373731 - protein, 10 aa, Influenza virus
ESNGGFLAPR

SEQ ID NO: 373732 - protein, 10 aa, Influenza virus
SNGGFLAPRY

SEQ ID NO: 373733 - protein, 10 aa, Influenza virus
NGGFLAPRYG

SEQ ID NO: 373734 - protein, 10 aa, Influenza virus
GGFLAPRYGY

SEQ ID NO: 373735 - protein, 10 aa, Influenza virus
GFLAPRYGYI

SEQ ID NO: 373736 - protein, 10 aa, Influenza virus
FLAPRYGYII

SEQ ID NO: 373737 - protein, 10 aa, Influenza virus
YGKGRIFQSH

SEQ ID NO: 373738 - protein, 10 aa, Influenza virus
GKGRIFQSHI

SEQ ID NO: 373739 - protein, 10 aa, Influenza virus
KGRIFQSHIR

SEQ ID NO: 373740 - protein, 10 aa, Influenza virus
RCNTRCQTSV

SEQ ID NO: 373741 - protein, 10 aa, Influenza virus
KCQTSVGGID

SEQ ID NO: 373742 - protein, 10 aa, Influenza virus
TSVGGIDTNK

SEQ ID NO: 373743 - protein, 10 aa, Influenza virus
SVGGIDTNKT

SEQ ID NO: 373744 - protein, 10 aa, Influenza virus
VGGIDTNKTF

SEQ ID NO: 373745 - protein, 10 aa, Influenza virus
GGIDTNKTFQ

SEQ ID NO: 373746 - protein, 10 aa, Influenza virus
GIDTNKTFQN

SEQ ID NO: 373747 - protein, 10 aa, Influenza virus
IDTNKTFQNI

SEQ ID NO: 373748 - protein, 10 aa, Influenza virus
DTNKTFQNID

SEQ ID NO: 373749 - protein, 10 aa, Influenza virus
TNRTFQNIDR

SEQ ID NO: 373750 - protein, 10 aa, Influenza virus
NKTFQNIDKN

SEQ ID NO: 373751 - protein, 10 aa, Influenza virus
KTFQNIDKNA

SEQ ID NO: 373752 - protein, 10 aa, Influenza virus
TFQNIDRNAL

SEQ ID NO: 373753 - protein, 10 aa, Influenza virus
FQNIDRNALG

SEQ ID NO: 373754 - protein, 10 aa, Influenza virus
QNIERNALGN

SEQ ID NO: 373755 - protein, 10 aa, Influenza virus
NIERNALGNC

SEQ ID NO: 373756 - protein, 10 aa, Influenza virus
IERNALGNCP

SEQ ID NO: 373757 - protein, 10 aa, Influenza virus
ERNALGNCPK

SEQ ID NO: 373758 - protein, 10 aa, Influenza virus
RNALGNCPKY

SEQ ID NO: 373759 - protein, 10 aa, Influenza virus
NALGECPKYI

SEQ ID NO: 373760 - protein, 10 aa, Influenza virus
ALGECPKYIK

SEQ ID NO: 373761 - protein, 10 aa, Influenza virus
LGECPKYIKS

SEQ ID NO: 373762 - protein, 10 aa, Influenza virus
GECPKYIKSD

SEQ ID NO: 373763 - protein, 10 aa, Influenza virus
ECPKYIKSDQ

SEQ ID NO: 373764 - protein, 10 aa, Influenza virus
GQLKLATGLK

SEQ ID NO: 373765 - protein, 10 aa, Influenza virus
LKLATGLKNV

SEQ ID NO: 373766 - protein, 10 aa, Influenza virus
KLATGLKNVP

SEQ ID NO: 373767 - protein, 10 aa, Influenza virus
LATGLRNIPA

SEQ ID NO: 373768 - protein, 10 aa, Influenza virus
RAVDGTIAGF

SEQ ID NO: 373769 - protein, 10 aa, Influenza virus
GFFGAIAGFI

SEQ ID NO: 373770 - protein, 10 aa, Influenza virus
LLGAIAGFIE

SEQ ID NO: 373771 - protein, 10 aa, Influenza virus
LGAIAGFIEG

SEQ ID NO: 373772 - protein, 10 aa, Influenza virus
GFQHQNEQGM

SEQ ID NO: 373773 - protein, 10 aa, Influenza virus
FQHQNEQGMG

SEQ ID NO: 373774 - protein, 10 aa, Influenza virus
QHQNEQGVGI

SEQ ID NO: 373775 - protein, 10 aa, Influenza virus
HQNEQGVGIA

SEQ ID NO: 373776 - protein, 10 aa, Influenza virus
QNEQGVGIAA

SEQ ID NO: 373777 - protein, 10 aa, Influenza virus
NEQGVGIAAD

SEQ ID NO: 373778 - protein, 10 aa, Influenza virus
EQGVGIAADK

SEQ ID NO: 373779 - protein, 10 aa, Influenza virus
QGVGIAADKE

SEQ ID NO: 373780 - protein, 10 aa, Influenza virus
GVGIAADKES

SEQ ID NO: 373781 - protein, 10 aa, Influenza virus
VGIAADKEST

SEQ ID NO: 373782 - protein, 10 aa, Influenza virus
GIAAEKESTQ

SEQ ID NO: 373783 - protein, 10 aa, Influenza virus
IAAEKESTQK

SEQ ID NO: 373784 - protein, 10 aa, Influenza virus
IRGEFNQVEN

SEQ ID NO: 373785 - protein, 10 aa, Influenza virus
RGEFNQVENR

SEQ ID NO: 373786 - protein, 10 aa, Influenza virus
GEFNQVENRI

SEQ ID NO: 373787 - protein, 10 aa, Influenza virus
EFNQVENRIN

SEQ ID NO: 373788 - protein, 10 aa, Influenza virus
FNQVENRINM

SEQ ID NO: 373789 - protein, 10 aa, Influenza virus
NQVENRINML

SEQ ID NO: 373790 - protein, 10 aa, Influenza virus
QVENRINMLA

SEQ ID NO: 373791 - protein, 10 aa, Influenza virus
VENRINMLAD

SEQ ID NO: 373792 - protein, 10 aa, Influenza virus
ENRINMLADR

SEQ ID NO: 373793 - protein, 10 aa, Influenza virus
NRINMLADRI

SEQ ID NO: 373794 - protein, 10 aa, Influenza virus
VTDIWSYNAR

SEQ ID NO: 373795 - protein, 10 aa, Influenza virus
TDIWSYNARL

SEQ ID NO: 373796 - protein, 10 aa, Influenza virus
DIWSYNARLL

SEQ ID NO: 373797 - protein, 10 aa, Influenza virus
IWSYNARLLV

SEQ ID NO: 373798 - protein, 10 aa, Influenza virus
LLENDKTLNM

SEQ ID NO: 373799 - protein, 10 aa, Influenza virus
LENDKTLNMH

SEQ ID NO: 373800 - protein, 10 aa, Influenza virus
ENDKTLNMHD

SEQ ID NO: 373801 - protein, 10 aa, Influenza virus
NDKTLNMHDA

SEQ ID NO: 373802 - protein, 10 aa, Influenza virus
DKTLNMHDAN

SEQ ID NO: 373803 - protein, 10 aa, Influenza virus
KTLNMHDANV

SEQ ID NO: 373804 - protein, 10 aa, Influenza virus
TLNMHDANVR

SEQ ID NO: 373805 - protein, 10 aa, Influenza virus
LDLHDANVRN

SEQ ID NO: 373806 - protein, 10 aa, Influenza virus
DLHDANVRNL

SEQ ID NO: 373807 - protein, 10 aa, Influenza virus
LHDANVRNLH

SEQ ID NO: 373808 - protein, 10 aa, Influenza virus
HDANVKNLHE

SEQ ID NO: 373809 - protein, 10 aa, Influenza virus
DANVKNLHEQ

SEQ ID NO: 373810 - protein, 10 aa, Influenza virus
ANVKNLHEQV

SEQ ID NO: 373811 - protein, 10 aa, Influenza virus
NVKNLHEQVR

SEQ ID NO: 373812 - protein, 10 aa, Influenza virus
NAINEGNGCF

SEQ ID NO: 373813 - protein, 10 aa, Influenza virus
AINEGNGCFE

SEQ ID NO: 373814 - protein, 10 aa, Influenza virus
INEGNGCFEL

SEQ ID NO: 373815 - protein, 10 aa, Influenza virus
FELLHKCNNT

SEQ ID NO: 373816 - protein, 10 aa, Influenza virus
ELLHKCNNTC

SEQ ID NO: 373817 - protein, 10 aa, Influenza virus
LLHKCNNTCM

SEQ ID NO: 373818 - protein, 10 aa, Influenza virus
LHKCNNTCME

SEQ ID NO: 373819 - protein, 10 aa, Influenza virus
HKCNDSCMDT

SEQ ID NO: 373820 - protein, 10 aa, Influenza virus
KCNDSCMDTI

SEQ ID NO: 373821 - protein, 10 aa, Influenza virus
CNDSCMDTIR

SEQ ID NO: 373822 - protein, 10 aa, Influenza virus
NNTCMETIRN

SEQ ID NO: 373823 - protein, 10 aa, Influenza virus
DSCMDTIRNG

SEQ ID NO: 373824 - protein, 10 aa, Influenza virus
TCMETIRNGT

SEQ ID NO: 373825 - protein, 10 aa, Influenza virus
MDTIRNGTYN

SEQ ID NO: 373826 - protein, 10 aa, Influenza virus
DTIRNGTYNH

SEQ ID NO: 373827 - protein, 10 aa, Influenza virus
TIRNGTYNHA

SEQ ID NO: 373828 - protein, 10 aa, Influenza virus
KYEEESKLKR

SEQ ID NO: 373829 - protein, 10 aa, Influenza virus
ESKLKRQEID

SEQ ID NO: 373830 - protein, 10 aa, Influenza virus
SKLKRQEIDG

SEQ ID NO: 373831 - protein, 10 aa, Influenza virus
KLKRQEIDGI

SEQ ID NO: 373832 - protein, 10 aa, Influenza virus
LKRQEIDGIK

SEQ ID NO: 373833 - protein, 10 aa, Influenza virus
KRQEIDGIKL

SEQ ID NO: 373834 - protein, 10 aa, Influenza virus
RQEIDGIKLK

SEQ ID NO: 373835 - protein, 10 aa, Influenza virus
QEIDGIKLKS

SEQ ID NO: 373836 - protein, 10 aa, Influenza virus
SDDNVYKALS

SEQ ID NO: 373837 - protein, 10 aa, Influenza virus
DDNVYKALSI

SEQ ID NO: 373838 - protein, 10 aa, Influenza virus
DGVYKALSIY

SEQ ID NO: 373839 - protein, 10 aa, Influenza virus
GVYKALSIYS

SEQ ID NO: 373840 - protein, 10 aa, Influenza virus
YSCIASSIVM

SEQ ID NO: 373841 - protein, 10 aa, Influenza virus
SCIASSIVMV

SEQ ID NO: 373842 - protein, 10 aa, Influenza virus
CIASSIVMVG

SEQ ID NO: 373843 - protein, 10 aa, Influenza virus
IASSIVMVGL

SEQ ID NO: 373844 - protein, 10 aa, Influenza virus
ASSIVMVGLI

SEQ ID NO: 373845 - protein, 10 aa, Influenza virus
SSIVMVGLIL

SEQ ID NO: 373846 - protein, 10 aa, Influenza virus
VMVGLILAFI

SEQ ID NO: 373847 - protein, 10 aa, Influenza virus
MVGLILAFIM

SEQ ID NO: 373848 - protein, 10 aa, Influenza virus
VGLILTFIMW

SEQ ID NO: 373849 - protein, 10 aa, Influenza virus
GLILAFIMWT

SEQ ID NO: 373850 - protein, 10 aa, Influenza virus
LILAFIMWTC

SEQ ID NO: 373851 - protein, 10 aa, Influenza virus
FIMWTCNSGN

SEQ ID NO: 373852 - protein, 10 aa, Influenza virus
IMWTCNSGNC

SEQ ID NO: 373853 - protein, 10 aa, Influenza virus
MWTCNSGNCR

SEQ ID NO: 373854 - protein, 10 aa, Influenza virus
WTCNSGNCRF

SEQ ID NO: 373855 - protein, 10 aa, Influenza virus
SEMKWLSSSG

SEQ ID NO: 373856 - protein, 10 aa, Influenza virus
EMKWLLSSKD

SEQ ID NO: 373857 - protein, 10 aa, Influenza virus
MKWLSSSGNN

SEQ ID NO: 373858 - protein, 10 aa, Influenza virus
KWLSSSGNNQ

SEQ ID NO: 373859 - protein, 10 aa, Influenza virus
WLLSSKDNQV

SEQ ID NO: 373860 - protein, 10 aa, Influenza virus
LLSSKDNQVF

SEQ ID NO: 373861 - protein, 10 aa, Influenza virus
SSSGNNQVFP

SEQ ID NO: 373862 - protein, 10 aa, Influenza virus
SSGNNQVFPQ

SEQ ID NO: 373863 - protein, 10 aa, Influenza virus
SGNNQVFPQL

SEQ ID NO: 373864 - protein, 10 aa, Influenza virus
GNNQVFPQLN

SEQ ID NO: 373865 - protein, 10 aa, Influenza virus
DNQVFPQLNQ

SEQ ID NO: 373866 - protein, 10 aa, Influenza virus
RQSFSPSPGA

SEQ ID NO: 373867 - protein, 10 aa, Influenza virus
MKNVPEKIRV

SEQ ID NO: 373868 - protein, 10 aa, Influenza virus
KNVPEKIRVK

SEQ ID NO: 373869 - protein, 10 aa, Influenza virus
NVPEKIRVKR

SEQ ID NO: 373870 - protein, 10 aa, Influenza virus
VPEKIRVKRR

SEQ ID NO: 373871 - protein, 10 aa, Influenza virus
PEKIRVKRRP

SEQ ID NO: 373872 - protein, 10 aa, Influenza virus
EKIRVKRRPV

SEQ ID NO: 373873 - protein, 10 aa, Influenza virus
KIRVKRRPVA

SEQ ID NO: 373874 - protein, 10 aa, Influenza virus
IRVKRRPVAK

SEQ ID NO: 373875 - protein, 10 aa, Influenza virus
RVKRRPVAKA

SEQ ID NO: 373876 - protein, 10 aa, Influenza virus
GRYSIADKIC

SEQ ID NO: 373877 - protein, 10 aa, Influenza virus
RYSIADKICI

SEQ ID NO: 373878 - protein, 10 aa, Influenza virus
YSIADKICIG

SEQ ID NO: 373879 - protein, 10 aa, Influenza virus
SIADKICIGY

SEQ ID NO: 373880 - protein, 10 aa, Influenza virus
IADKICIGYL

SEQ ID NO: 373881 - protein, 10 aa, Influenza virus
CIGYLSNNAT

SEQ ID NO: 373882 - protein, 10 aa, Influenza virus
IGYLSNNATD

SEQ ID NO: 373883 - protein, 10 aa, Influenza virus
GYLSNNSTDT

SEQ ID NO: 373884 - protein, 10 aa, Influenza virus
YLSNNSTDTV

SEQ ID NO: 373885 - protein, 10 aa, Influenza virus
LSNNSTDTVD

SEQ ID NO: 373886 - protein, 10 aa, Influenza virus
SNNSTDTVDT

SEQ ID NO: 373887 - protein, 10 aa, Influenza virus
NNSTDTVDTL

SEQ ID NO: 373888 - protein, 10 aa, Influenza virus
NSTDTVDTLT

SEQ ID NO: 373889 - protein, 10 aa, Influenza virus
STDTVDTLTE

SEQ ID NO: 373890 - protein, 10 aa, Influenza virus
TDKVDTLTEN

SEQ ID NO: 373891 - protein, 10 aa, Influenza virus
DKIDTLTETG

SEQ ID NO: 373892 - protein, 10 aa, Influenza virus
KIDTLTETGV

SEQ ID NO: 373893 - protein, 10 aa, Influenza virus
VDTLTETGVP

SEQ ID NO: 373894 - protein, 10 aa, Influenza virus
ETGVPVTSSV

SEQ ID NO: 373895 - protein, 10 aa, Influenza virus
TGVPVTSSVD

SEQ ID NO: 373896 - protein, 10 aa, Influenza virus
YCSLNGVSPV

SEQ ID NO: 373897 - protein, 10 aa, Influenza virus
CSLNGVSPVH

SEQ ID NO: 373898 - protein, 10 aa, Influenza virus
SLNGVSPVHL

SEQ ID NO: 373899 - protein, 10 aa, Influenza virus
LNGVSPVHLG

SEQ ID NO: 373900 - protein, 10 aa, Influenza virus
NGVSPVHLGD

SEQ ID NO: 373901 - protein, 10 aa, Influenza virus
GVSPVHLGDC

SEQ ID NO: 373902 - protein, 10 aa, Influenza virus
VSPVHLGDCS

SEQ ID NO: 373903 - protein, 10 aa, Influenza virus
IEDPNAPNKF

SEQ ID NO: 373904 - protein, 10 aa, Influenza virus
EDPNAPNKFC

SEQ ID NO: 373905 - protein, 10 aa, Influenza virus
DPNAPNKLCY

SEQ ID NO: 373906 - protein, 10 aa, Influenza virus
PNAPNKLCYP

SEQ ID NO: 373907 - protein, 10 aa, Influenza virus
NAPNKLCYPG

SEQ ID NO: 373908 - protein, 10 aa, Influenza virus
APNKLCYPGE

SEQ ID NO: 373909 - protein, 10 aa, Influenza virus
KLCFPGEVDN

SEQ ID NO: 373910 - protein, 10 aa, Influenza virus
LCFPGEVDNN

SEQ ID NO: 373911 - protein, 10 aa, Influenza virus
CFPGEVDNNG

SEQ ID NO: 373912 - protein, 10 aa, Influenza virus
FPGEVDNNGE

SEQ ID NO: 373913 - protein, 10 aa, Influenza virus
NSFSRTELIP

SEQ ID NO: 373914 - protein, 10 aa, Influenza virus
SFSRTELIPP

SEQ ID NO: 373915 - protein, 10 aa, Influenza virus
FSRTELINPS

SEQ ID NO: 373916 - protein, 10 aa, Influenza virus
SRTELINPSK

SEQ ID NO: 373917 - protein, 10 aa, Influenza virus
RTELIPPSKW

SEQ ID NO: 373918 - protein, 10 aa, Influenza virus
TELIPPSKWG

SEQ ID NO: 373919 - protein, 10 aa, Influenza virus
PSKWGDVLDG

SEQ ID NO: 373920 - protein, 10 aa, Influenza virus
SKWGDVLDGV

SEQ ID NO: 373921 - protein, 10 aa, Influenza virus
KWGDVLDGVT

SEQ ID NO: 373922 - protein, 10 aa, Influenza virus
WGDVLDGVTA

SEQ ID NO: 373923 - protein, 10 aa, Influenza virus
GDVLDGVTAS

SEQ ID NO: 373924 - protein, 10 aa, Influenza virus
DVLDGVTASC

SEQ ID NO: 373925 - protein, 10 aa, Influenza virus
ILDGVTASCR

SEQ ID NO: 373926 - protein, 10 aa, Influenza virus
LDGVTASCRD

SEQ ID NO: 373927 - protein, 10 aa, Influenza virus
DGVTASCLDK

SEQ ID NO: 373928 - protein, 10 aa, Influenza virus
GVTASCLDKG

SEQ ID NO: 373929 - protein, 10 aa, Influenza virus
VTASCLDKGA

SEQ ID NO: 373930 - protein, 10 aa, Influenza virus
SFYRNLVWIV

SEQ ID NO: 373931 - protein, 10 aa, Influenza virus
FYRNLVWIVK

SEQ ID NO: 373932 - protein, 10 aa, Influenza virus
IKGDYNNTTG

SEQ ID NO: 373933 - protein, 10 aa, Influenza virus
RGDYNNTTGR

SEQ ID NO: 373934 - protein, 10 aa, Influenza virus
WGIHHPDSET

SEQ ID NO: 373935 - protein, 10 aa, Influenza virus
GIHHPDSETT

SEQ ID NO: 373936 - protein, 10 aa, Influenza virus
IHHPDTEATA

SEQ ID NO: 373937 - protein, 10 aa, Influenza virus
ANKLYVNKNP

SEQ ID NO: 373938 - protein, 10 aa, Influenza virus
NKLYVNKNPY

SEQ ID NO: 373939 - protein, 10 aa, Influenza virus
RLYVNKNPYT

SEQ ID NO: 373940 - protein, 10 aa, Influenza virus
SKRYELEIGA

SEQ ID NO: 373941 - protein, 10 aa, Influenza virus
KRYELEIGAR

SEQ ID NO: 373942 - protein, 10 aa, Influenza virus
ELEIGTRIGE

SEQ ID NO: 373943 - protein, 10 aa, Influenza virus
GEGQRSWMKI

SEQ ID NO: 373944 - protein, 10 aa, Influenza virus
EGQRSWMKIY

SEQ ID NO: 373945 - protein, 10 aa, Influenza virus
WMKLYWHLMH

SEQ ID NO: 373946 - protein, 10 aa, Influenza virus
MKLYWHLMHP

SEQ ID NO: 373947 - protein, 10 aa, Influenza virus
KLYWHLMHPG

SEQ ID NO: 373948 - protein, 10 aa, Influenza virus
LYWHLMHPGE

SEQ ID NO: 373949 - protein, 10 aa, Influenza virus
YWHLMSPGER

SEQ ID NO: 373950 - protein, 10 aa, Influenza virus
WHLMSPGERI

SEQ ID NO: 373951 - protein, 10 aa, Influenza virus
PGERITFESS

SEQ ID NO: 373952 - protein, 10 aa, Influenza virus
GERITFESSG

SEQ ID NO: 373953 - protein, 10 aa, Influenza virus
ERITFESSGG

SEQ ID NO: 373954 - protein, 10 aa, Influenza virus
RITFESSGGL

SEQ ID NO: 373955 - protein, 10 aa, Influenza virus
MFESNGGLLA

SEQ ID NO: 373956 - protein, 10 aa, Influenza virus
FESSGGLLAP

SEQ ID NO: 373957 - protein, 10 aa, Influenza virus
ESSGGLLAPR

SEQ ID NO: 373958 - protein, 10 aa, Influenza virus
SSGGLLAPRY

SEQ ID NO: 373959 - protein, 10 aa, Influenza virus
SGGLLAPRYG

SEQ ID NO: 373960 - protein, 10 aa, Influenza virus
YGTGRIFQSR

SEQ ID NO: 373961 - protein, 10 aa, Influenza virus
GTGRIFQSGI

SEQ ID NO: 373962 - protein, 10 aa, Influenza virus
TGRIFQSGIR

SEQ ID NO: 373963 - protein, 10 aa, Influenza virus
GRIFQSGIRM

SEQ ID NO: 373964 - protein, 10 aa, Influenza virus
RIFQSGIRMA

SEQ ID NO: 373965 - protein, 10 aa, Influenza virus
RMARCNTKCQ

SEQ ID NO: 373966 - protein, 10 aa, Influenza virus
MARCNTKCQT

SEQ ID NO: 373967 - protein, 10 aa, Influenza virus
GKCNTKCQTS

SEQ ID NO: 373968 - protein, 10 aa, Influenza virus
KCNTKCQTSL

SEQ ID NO: 373969 - protein, 10 aa, Influenza virus
CNTKCQTSLG

SEQ ID NO: 373970 - protein, 10 aa, Influenza virus
NTKCQTSVGG

SEQ ID NO: 373971 - protein, 10 aa, Influenza virus
TKCQTSMGGI

SEQ ID NO: 373972 - protein, 10 aa, Influenza virus
GGIDTNKTFQ

SEQ ID NO: 373973 - protein, 10 aa, Influenza virus
GIDTNKTFQN

SEQ ID NO: 373974 - protein, 10 aa, Influenza virus
IDTNKTFQNI

SEQ ID NO: 373975 - protein, 10 aa, Influenza virus
DTNKTFQNID

SEQ ID NO: 373976 - protein, 10 aa, Influenza virus
TNKTFQNIEK

SEQ ID NO: 373977 - protein, 10 aa, Influenza virus
NKTFQNIEKN

SEQ ID NO: 373978 - protein, 10 aa, Influenza virus
KTFQNIEKNA

SEQ ID NO: 373979 - protein, 10 aa, Influenza virus
TFQNIEKNAL

SEQ ID NO: 373980 - protein, 10 aa, Influenza virus
FQNIEKNALG

SEQ ID NO: 373981 - protein, 10 aa, Influenza virus
QNIEKNALGD

SEQ ID NO: 373982 - protein, 10 aa, Influenza virus
NIEKNALGDC

SEQ ID NO: 373983 - protein, 10 aa, Influenza virus
IEKNALGDCP

SEQ ID NO: 373984 - protein, 10 aa, Influenza virus
EKNALGDCPK

SEQ ID NO: 373985 - protein, 10 aa, Influenza virus
KNALGDCPKY

SEQ ID NO: 373986 - protein, 10 aa, Influenza virus
ATGLRNVPIP

SEQ ID NO: 373987 - protein, 10 aa, Influenza virus
VERGLFGAIA

SEQ ID NO: 373988 - protein, 10 aa, Influenza virus
QGTGIAADKV

SEQ ID NO: 373989 - protein, 10 aa, Influenza virus
GTGIAADKVS

SEQ ID NO: 373990 - protein, 10 aa, Influenza virus
TGIAADKVST

SEQ ID NO: 373991 - protein, 10 aa, Influenza virus
GIAADKVSTQ

SEQ ID NO: 373992 - protein, 10 aa, Influenza virus
IAADKVSTQK

SEQ ID NO: 373993 - protein, 10 aa, Influenza virus
AADKVSTQKA

SEQ ID NO: 373994 - protein, 10 aa, Influenza virus
ADKVSTQKAI

SEQ ID NO: 373995 - protein, 10 aa, Influenza virus
DKTSTQKAIN

SEQ ID NO: 373996 - protein, 10 aa, Influenza virus
KTSTQKAINE

SEQ ID NO: 373997 - protein, 10 aa, Influenza virus
TSTQKAINEI

SEQ ID NO: 373998 - protein, 10 aa, Influenza virus
STQKALNEIT

SEQ ID NO: 373999 - protein, 10 aa, Influenza virus
TQKALNEITT

SEQ ID NO: 374000 - protein, 10 aa, Influenza virus
QKALNEITTK

SEQ ID NO: 374001 - protein, 10 aa, Influenza virus
KALNEITTKI

SEQ ID NO: 374002 - protein, 10 aa, Influenza virus
ALNEITTKIN

SEQ ID NO: 374003 - protein, 10 aa, Influenza virus
LNEITTKINN

SEQ ID NO: 374004 - protein, 10 aa, Influenza virus
EKRINMLADW

SEQ ID NO: 374005 - protein, 10 aa, Influenza virus
KRINMLADWV

SEQ ID NO: 374006 - protein, 10 aa, Influenza virus
RINMLADWVD

SEQ ID NO: 374007 - protein, 10 aa, Influenza virus
INMLADWVDD

SEQ ID NO: 374008 - protein, 10 aa, Influenza virus
NMLADWVDDA

SEQ ID NO: 374009 - protein, 10 aa, Influenza virus
MLADWVDDAV

SEQ ID NO: 374010 - protein, 10 aa, Influenza virus
LADWVDDAVT

SEQ ID NO: 374011 - protein, 10 aa, Influenza virus
DWVDDAVTDI

SEQ ID NO: 374012 - protein, 10 aa, Influenza virus
WVDDAVTDIW

SEQ ID NO: 374013 - protein, 10 aa, Influenza virus
AKLLVLLEND

SEQ ID NO: 374014 - protein, 10 aa, Influenza virus
KLLVLLENDR

SEQ ID NO: 374015 - protein, 10 aa, Influenza virus
LLVLLENDRT

SEQ ID NO: 374016 - protein, 10 aa, Influenza virus
LVLLENDRTL

SEQ ID NO: 374017 - protein, 10 aa, Influenza virus
VLLENDRTLD

SEQ ID NO: 374018 - protein, 10 aa, Influenza virus
LLENDRTLDL

SEQ ID NO: 374019 - protein, 10 aa, Influenza virus
LENDRTLDLH

SEQ ID NO: 374020 - protein, 10 aa, Influenza virus
ENGRTLGLHD

SEQ ID NO: 374021 - protein, 10 aa, Influenza virus
NGRTLGLHDA

SEQ ID NO: 374022 - protein, 10 aa, Influenza virus
GRTLGLHDAN

SEQ ID NO: 374023 - protein, 10 aa, Influenza virus
TLGLHDANVR

SEQ ID NO: 374024 - protein, 10 aa, Influenza virus
LGLHDANVRN

SEQ ID NO: 374025 - protein, 10 aa, Influenza virus
GLHDANVRNL

SEQ ID NO: 374026 - protein, 10 aa, Influenza virus
HDANVKNLHE

SEQ ID NO: 374027 - protein, 10 aa, Influenza virus
DANVKNLHEQ

SEQ ID NO: 374028 - protein, 10 aa, Influenza virus
ANVKNLHEQV

SEQ ID NO: 374029 - protein, 10 aa, Influenza virus
NVRNLHDQIK

SEQ ID NO: 374030 - protein, 10 aa, Influenza virus
VRNLHDQIKR

SEQ ID NO: 374031 - protein, 10 aa, Influenza virus
LKSNAIDEGD

SEQ ID NO: 374032 - protein, 10 aa, Influenza virus
KSNAIDEGDG

SEQ ID NO: 374033 - protein, 10 aa, Influenza virus
DNAIDEGDGC

SEQ ID NO: 374034 - protein, 10 aa, Influenza virus
IDEGDGCFSL

SEQ ID NO: 374035 - protein, 10 aa, Influenza virus
DEGDGCFSLL

SEQ ID NO: 374036 - protein, 10 aa, Influenza virus
EGDGCFSLLH

SEQ ID NO: 374037 - protein, 10 aa, Influenza virus
GDGCFSLLHK

SEQ ID NO: 374038 - protein, 10 aa, Influenza virus
DGCFSLLHKC

SEQ ID NO: 374039 - protein, 10 aa, Influenza virus
GCFSLLHKCN

SEQ ID NO: 374040 - protein, 10 aa, Influenza virus
CFSLLHKCND

SEQ ID NO: 374041 - protein, 10 aa, Influenza virus
FSLLHKCNDS

SEQ ID NO: 374042 - protein, 10 aa, Influenza virus
SLLHKCNDSC

SEQ ID NO: 374043 - protein, 10 aa, Influenza virus
FFHKCNDSCM

SEQ ID NO: 374044 - protein, 10 aa, Influenza virus
DYREESQLKK

SEQ ID NO: 374045 - protein, 10 aa, Influenza virus
YREESQLKKQ

SEQ ID NO: 374046 - protein, 10 aa, Influenza virus
REESQLKKQE

SEQ ID NO: 374047 - protein, 10 aa, Influenza virus
GIKLKSEDNV

SEQ ID NO: 374048 - protein, 10 aa, Influenza virus
IKLKSEDNVY

SEQ ID NO: 374049 - protein, 10 aa, Influenza virus
KLKSEDNVYK

SEQ ID NO: 374050 - protein, 10 aa, Influenza virus
LKTEDNIYKI

SEQ ID NO: 374051 - protein, 10 aa, Influenza virus
KTEDNIYKIL

SEQ ID NO: 374052 - protein, 10 aa, Influenza virus
TEDNVYKVLA

SEQ ID NO: 374053 - protein, 10 aa, Influenza virus
EDNIYKILSI

SEQ ID NO: 374054 - protein, 10 aa, Influenza virus
DNIYKILSIY

SEQ ID NO: 374055 - protein, 10 aa, Influenza virus
NIYKILSIYS

SEQ ID NO: 374056 - protein, 10 aa, Influenza virus
VYKVLAIYSC

SEQ ID NO: 374057 - protein, 10 aa, Influenza virus
YKVLAIYSCI

SEQ ID NO: 374058 - protein, 10 aa, Influenza virus
KVLAIYSCIA

SEQ ID NO: 374059 - protein, 10 aa, Influenza virus
VLAIYSCIAS

SEQ ID NO: 374060 - protein, 10 aa, Influenza virus
SIYSCIASSV

SEQ ID NO: 374061 - protein, 10 aa, Influenza virus
IYSCIASSVV

SEQ ID NO: 374062 - protein, 10 aa, Influenza virus
YSCIASSIVL

SEQ ID NO: 374063 - protein, 10 aa, Influenza virus
SCIASSIVMV

SEQ ID NO: 374064 - protein, 10 aa, Influenza virus
CIASSIVLVG

SEQ ID NO: 374065 - protein, 10 aa, Influenza virus
IASSIVLVGL

SEQ ID NO: 374066 - protein, 10 aa, Influenza virus
ASSVVLVGLI

SEQ ID NO: 374067 - protein, 10 aa, Influenza virus
SSIVMVGLIL

SEQ ID NO: 374068 - protein, 10 aa, Influenza virus
SVVLVGLILA

SEQ ID NO: 374069 - protein, 10 aa, Influenza virus
VVLVGLILAF

SEQ ID NO: 374070 - protein, 10 aa, Influenza virus
LVGLILAFIL

SEQ ID NO: 374071 - protein, 10 aa, Influenza virus
LAFILWACSS

SEQ ID NO: 374072 - protein, 10 aa, Influenza virus
AFILWACSSG

SEQ ID NO: 374073 - protein, 10 aa, Influenza virus
FILWACSSGN

SEQ ID NO: 374074 - protein, 10 aa, Influenza virus
ILWACSSGNC

SEQ ID NO: 374075 - protein, 10 aa, Influenza virus
LWACSSGNCR

SEQ ID NO: 374076 - protein, 10 aa, Influenza virus
WACSNGNCRF

SEQ ID NO: 374077 - protein, 10 aa, Influenza virus
ACSNGNCRFN

SEQ ID NO: 374078 - protein, 10 aa, Influenza virus
CSNGNCRFNV

SEQ ID NO: 374079 - protein, 10 aa, Influenza virus
SSGNCRFSVC

SEQ ID NO: 374080 - protein, 10 aa, Influenza virus
SGNCRFSVCI

SEQ ID NO: 374081 - protein, 10 aa, Influenza virus
TKATKMEAIL

SEQ ID NO: 374082 - protein, 10 aa, Influenza virus
KATKMEAILV

SEQ ID NO: 374083 - protein, 10 aa, Influenza virus
ATKMEAILVV

SEQ ID NO: 374084 - protein, 10 aa, Influenza virus
TKMEAILVVL

SEQ ID NO: 374085 - protein, 10 aa, Influenza virus
IAGFIENGWE

SEQ ID NO: 374086 - protein, 10 aa, Influenza virus
AGFIENGWEG

SEQ ID NO: 374087 - protein, 10 aa, Influenza virus
GFIENGWEGM

SEQ ID NO: 374088 - protein, 10 aa, Influenza virus
FIEGGWPGLI

SEQ ID NO: 374089 - protein, 10 aa, Influenza virus
IEGGWPGLIN

SEQ ID NO: 374090 - protein, 10 aa, Influenza virus
EGGWPGLING

SEQ ID NO: 374091 - protein, 10 aa, Influenza virus
GGWPGLINGW

SEQ ID NO: 374092 - protein, 10 aa, Influenza virus
GWPGLINGWY

SEQ ID NO: 374093 - protein, 10 aa, Influenza virus
WPGLINGWYG

SEQ ID NO: 374094 - protein, 10 aa, Influenza virus
PGLINGWYGF

SEQ ID NO: 374095 - protein, 10 aa, Influenza virus
GLINGWYGFQ

SEQ ID NO: 374096 - protein, 10 aa, Influenza virus
LINGWYGFQH

SEQ ID NO: 374097 - protein, 10 aa, Influenza virus
NGWYGFQHRN

SEQ ID NO: 374098 - protein, 10 aa, Influenza virus
YNAELLILLE

SEQ ID NO: 374099 - protein, 10 aa, Influenza virus
NAELLILLEN

SEQ ID NO: 374100 - protein, 10 aa, Influenza virus
HSCLQCRICI

SEQ ID NO: 374101 - protein, 10 aa, Influenza virus
LQCRICIDFR

SEQ ID NO: 374102 - protein, 10 aa, Influenza virus
QCRICIDFRD

SEQ ID NO: 374103 - protein, 10 aa, Influenza virus
CTISLVKTTL

SEQ ID NO: 374104 - protein, 10 aa, Influenza virus
TISLVKTTLF

SEQ ID NO: 374105 - protein, 10 aa, Influenza virus
ICIDFRDMRK

SEQ ID NO: 374106 - protein, 10 aa, Influenza virus
TKATKMEAIL

SEQ ID NO: 374107 - protein, 10 aa, Influenza virus
KATKMEAILV

SEQ ID NO: 374108 - protein, 10 aa, Influenza virus
ATKMKAIIVV

SEQ ID NO: 374109 - protein, 10 aa, Influenza virus
TKMKAIIVVL

SEQ ID NO: 374110 - protein, 10 aa, Influenza virus
EREAKLFVLF

SEQ ID NO: 374111 - protein, 10 aa, Influenza virus
ADTICVGYHA

SEQ ID NO: 374112 - protein, 10 aa, Influenza virus
DTICVGYHAN

SEQ ID NO: 374113 - protein, 10 aa, Influenza virus
TICVGYHANN

SEQ ID NO: 374114 - protein, 10 aa, Influenza virus
ICVGYHANNS

SEQ ID NO: 374115 - protein, 10 aa, Influenza virus
NSTDTVDTLL

SEQ ID NO: 374116 - protein, 10 aa, Influenza virus
STDTVDTLLE

SEQ ID NO: 374117 - protein, 10 aa, Influenza virus
TDTVDTVLER

SEQ ID NO: 374118 - protein, 10 aa, Influenza virus
DTVDTVLERN

SEQ ID NO: 374119 - protein, 10 aa, Influenza virus
TVDTVLERNV

SEQ ID NO: 374120 - protein, 10 aa, Influenza virus
VDTVLERNVT

SEQ ID NO: 374121 - protein, 10 aa, Influenza virus
DTVLERNVTV

SEQ ID NO: 374122 - protein, 10 aa, Influenza virus
TVLERNVTVT

SEQ ID NO: 374123 - protein, 10 aa, Influenza virus
VLERNVTVTH

SEQ ID NO: 374124 - protein, 10 aa, Influenza virus
KNVTVTHSVD

SEQ ID NO: 374125 - protein, 10 aa, Influenza virus
NVTVTHSVDL

SEQ ID NO: 374126 - protein, 10 aa, Influenza virus
VTVTHSVDLL

SEQ ID NO: 374127 - protein, 10 aa, Influenza virus
TVTHSVDLLE

SEQ ID NO: 374128 - protein, 10 aa, Influenza virus
IAGWLLGNPE

SEQ ID NO: 374129 - protein, 10 aa, Influenza virus
AGWILGNPKC

SEQ ID NO: 374130 - protein, 10 aa, Influenza virus
DYEELKEQLS

SEQ ID NO: 374131 - protein, 10 aa, Influenza virus
YEELREQLST

SEQ ID NO: 374132 - protein, 10 aa, Influenza virus
EELREQLSTV

SEQ ID NO: 374133 - protein, 10 aa, Influenza virus
ELREQLSTVS

SEQ ID NO: 374134 - protein, 10 aa, Influenza virus
LREQLSTVSS

SEQ ID NO: 374135 - protein, 10 aa, Influenza virus
REQLSTVSSF

SEQ ID NO: 374136 - protein, 10 aa, Influenza virus
EHLSSVSSFE

SEQ ID NO: 374137 - protein, 10 aa, Influenza virus
QLSTVSSFER

SEQ ID NO: 374138 - protein, 10 aa, Influenza virus
LSTVSSFERF

SEQ ID NO: 374139 - protein, 10 aa, Influenza virus
STVSSFERFE

SEQ ID NO: 374140 - protein, 10 aa, Influenza virus
TVSSFERFEI

SEQ ID NO: 374141 - protein, 10 aa, Influenza virus
VSSFERFEMF

SEQ ID NO: 374142 - protein, 10 aa, Influenza virus
SSFERFEMFP

SEQ ID NO: 374143 - protein, 10 aa, Influenza virus
SFERFEMFPK

SEQ ID NO: 374144 - protein, 10 aa, Influenza virus
DTITFEATGN

SEQ ID NO: 374145 - protein, 10 aa, Influenza virus
TITFEATGNL

SEQ ID NO: 374146 - protein, 10 aa, Influenza virus
FEATGNLIAP

SEQ ID NO: 374147 - protein, 10 aa, Influenza virus
ITIGECPKYV

SEQ ID NO: 374148 - protein, 10 aa, Influenza virus
TIGECPKYVK

SEQ ID NO: 374149 - protein, 10 aa, Influenza virus
IGECPKYVKS

SEQ ID NO: 374150 - protein, 10 aa, Influenza virus
GECPKYVKST

SEQ ID NO: 374151 - protein, 10 aa, Influenza virus
KLRMATGLRN

SEQ ID NO: 374152 - protein, 10 aa, Influenza virus
LRMATGLRNI

SEQ ID NO: 374153 - protein, 10 aa, Influenza virus
RMATGLRNIP

SEQ ID NO: 374154 - protein, 10 aa, Influenza virus
MATGLRNIPS

SEQ ID NO: 374155 - protein, 10 aa, Influenza virus
ATGLRNIPSI

SEQ ID NO: 374156 - protein, 10 aa, Influenza virus
TGLRNIPSVQ

SEQ ID NO: 374157 - protein, 10 aa, Influenza virus
GLRNIPSVQS

SEQ ID NO: 374158 - protein, 10 aa, Influenza virus
LRNIPSVQSR

SEQ ID NO: 374159 - protein, 10 aa, Influenza virus
RNIPSVQSRG

SEQ ID NO: 374160 - protein, 10 aa, Influenza virus
NIPSVQSRGL

SEQ ID NO: 374161 - protein, 10 aa, Influenza virus
IPSVQSRGLF

SEQ ID NO: 374162 - protein, 10 aa, Influenza virus
GYHHQNAQGS

SEQ ID NO: 374163 - protein, 10 aa, Influenza virus
YHHQNAQGSG

SEQ ID NO: 374164 - protein, 10 aa, Influenza virus
HHQNAQGSGY

SEQ ID NO: 374165 - protein, 10 aa, Influenza virus
HQNAQGSGYA

SEQ ID NO: 374166 - protein, 10 aa, Influenza virus
QNAQGSGYAA

SEQ ID NO: 374167 - protein, 10 aa, Influenza virus
GQGSGYAADQ

SEQ ID NO: 374168 - protein, 10 aa, Influenza virus
QGSGYAADRK

SEQ ID NO: 374169 - protein, 10 aa, Influenza virus
GSGYAADRKS

SEQ ID NO: 374170 - protein, 10 aa, Influenza virus
SGYAADRKST

SEQ ID NO: 374171 - protein, 10 aa, Influenza virus
GYAADRKSTQ

SEQ ID NO: 374172 - protein, 10 aa, Influenza virus
NKVNSVVEKM

SEQ ID NO: 374173 - protein, 10 aa, Influenza virus
KVNSVVEKMN

SEQ ID NO: 374174 - protein, 10 aa, Influenza virus
NSIIEKMNTQ

SEQ ID NO: 374175 - protein, 10 aa, Influenza virus
SIIEKMNTQF

SEQ ID NO: 374176 - protein, 10 aa, Influenza virus
IIEKMNTQFT

SEQ ID NO: 374177 - protein, 10 aa, Influenza virus
IEKMNIQFTA

SEQ ID NO: 374178 - protein, 10 aa, Influenza virus
EKMNIQFTAV

SEQ ID NO: 374179 - protein, 10 aa, Influenza virus
KMNIQFTAVG

SEQ ID NO: 374180 - protein, 10 aa, Influenza virus
MNIQFTAVGK

SEQ ID NO: 374181 - protein, 10 aa, Influenza virus
NIQFTAVGKE

SEQ ID NO: 374182 - protein, 10 aa, Influenza virus
IQFTAVGKEF

SEQ ID NO: 374183 - protein, 10 aa, Influenza virus
QFTSVGKEFN

SEQ ID NO: 374184 - protein, 10 aa, Influenza virus
RIENLNKKID

SEQ ID NO: 374185 - protein, 10 aa, Influenza virus
IENLNKKIDD

SEQ ID NO: 374186 - protein, 10 aa, Influenza virus
ENLNRKVDDG

SEQ ID NO: 374187 - protein, 10 aa, Influenza virus
NLNKKVDDGL

SEQ ID NO: 374188 - protein, 10 aa, Influenza virus
LNKKIDDGFL

SEQ ID NO: 374189 - protein, 10 aa, Influenza virus
NKKIDDGFLD

SEQ ID NO: 374190 - protein, 10 aa, Influenza virus
DDGFLDVWTY

SEQ ID NO: 374191 - protein, 10 aa, Influenza virus
DGFLDVWTYN

SEQ ID NO: 374192 - protein, 10 aa, Influenza virus
GFLDVWTYNA

SEQ ID NO: 374193 - protein, 10 aa, Influenza virus
FLDVWTYNAE

SEQ ID NO: 374194 - protein, 10 aa, Influenza virus
LDVWTYNAEL

SEQ ID NO: 374195 - protein, 10 aa, Influenza virus
VWTYNAELLI

SEQ ID NO: 374196 - protein, 10 aa, Influenza virus
NERTLDFHDL

SEQ ID NO: 374197 - protein, 10 aa, Influenza virus
NNAKEVGNGC

SEQ ID NO: 374198 - protein, 10 aa, Influenza virus
NAKEVGNGCF

SEQ ID NO: 374199 - protein, 10 aa, Influenza virus
AKEVGNGCFE

SEQ ID NO: 374200 - protein, 10 aa, Influenza virus
KEVGNGCFEF

SEQ ID NO: 374201 - protein, 10 aa, Influenza virus
EVGNGCFEFY

SEQ ID NO: 374202 - protein, 10 aa, Influenza virus
VGNGCFEFYH

SEQ ID NO: 374203 - protein, 10 aa, Influenza virus
CFEFYHKCDD

SEQ ID NO: 374204 - protein, 10 aa, Influenza virus
CMESIKNGTY

SEQ ID NO: 374205 - protein, 10 aa, Influenza virus
MESVRNGTYD

SEQ ID NO: 374206 - protein, 10 aa, Influenza virus
ESVRNGTYDY

SEQ ID NO: 374207 - protein, 10 aa, Influenza virus
SVRNGTYDYP

SEQ ID NO: 374208 - protein, 10 aa, Influenza virus
VRNGTYDYPK

SEQ ID NO: 374209 - protein, 10 aa, Influenza virus
RNGTYDYPKY

SEQ ID NO: 374210 - protein, 10 aa, Influenza virus
GTYDYPKYSK

SEQ ID NO: 374211 - protein, 10 aa, Influenza virus
TYDYPKYSKE

SEQ ID NO: 374212 - protein, 10 aa, Influenza virus
YNYPKYSEES

SEQ ID NO: 374213 - protein, 10 aa, Influenza virus
YPKYSEESRL

SEQ ID NO: 374214 - protein, 10 aa, Influenza virus
IHQILAIYST

SEQ ID NO: 374215 - protein, 10 aa, Influenza virus
HQILAIYSTV

SEQ ID NO: 374216 - protein, 10 aa, Influenza virus
AIYSTVASSS

SEQ ID NO: 374217 - protein, 10 aa, Influenza virus
IYSTVASSSV

SEQ ID NO: 374218 - protein, 10 aa, Influenza virus
YSTVASSSVL

SEQ ID NO: 374219 - protein, 10 aa, Influenza virus
ASSSVLLVSL

SEQ ID NO: 374220 - protein, 10 aa, Influenza virus
SSSVLLVSLG

SEQ ID NO: 374221 - protein, 10 aa, Influenza virus
SSVLLVSLGA

SEQ ID NO: 374222 - protein, 10 aa, Influenza virus
LIVSLGAISF

SEQ ID NO: 374223 - protein, 10 aa, Influenza virus
IVSLGAISFW

SEQ ID NO: 374224 - protein, 10 aa, Influenza virus
GAVSFWMCSN

SEQ ID NO: 374225 - protein, 10 aa, Influenza virus
AVSFWMCSNG

SEQ ID NO: 374226 - protein, 10 aa, Influenza virus
VSFWMCSNGS

SEQ ID NO: 374227 - protein, 10 aa, Influenza virus
GFWMCSNGSL

SEQ ID NO: 374228 - protein, 10 aa, Influenza virus
FWMCSGHSCR

SEQ ID NO: 374229 - protein, 10 aa, Influenza virus
WMCSGHSCRI

SEQ ID NO: 374230 - protein, 10 aa, Influenza virus
MCSGHSCRIC

SEQ ID NO: 374231 - protein, 10 aa, Influenza virus
CSNGSLRCRI

SEQ ID NO: 374232 - protein, 10 aa, Influenza virus
SNGSLRCRIC

SEQ ID NO: 374233 - protein, 10 aa, Influenza virus
NGSLRCRICI

SEQ ID NO: 374234 - protein, 10 aa, Influenza virus
HSCLQCRICI

SEQ ID NO: 374235 - protein, 10 aa, Influenza virus
LQCRICIDFR

SEQ ID NO: 374236 - protein, 10 aa, Influenza virus
QCRICIDFRD

SEQ ID NO: 374237 - protein, 10 aa, Influenza virus
GWAIYSKDNG

SEQ ID NO: 374238 - protein, 10 aa, Influenza virus
SKDNSVRIGS

SEQ ID NO: 374239 - protein, 10 aa, Influenza virus
KDNGIRIGSK

SEQ ID NO: 374240 - protein, 10 aa, Influenza virus
DNGIRIGSKG

SEQ ID NO: 374241 - protein, 10 aa, Influenza virus
NGIRIGSKGD

SEQ ID NO: 374242 - protein, 10 aa, Influenza virus
SIRIGSKGDI

SEQ ID NO: 374243 - protein, 10 aa, Influenza virus
IRIGSKGDIF

SEQ ID NO: 374244 - protein, 10 aa, Influenza virus
IGSKGDIFVM

SEQ ID NO: 374245 - protein, 10 aa, Influenza virus
GSKGDIFVMR

SEQ ID NO: 374246 - protein, 10 aa, Influenza virus
SKGDIFVMRE

SEQ ID NO: 374247 - protein, 10 aa, Influenza virus
KGDIFVMREP

SEQ ID NO: 374248 - protein, 10 aa, Influenza virus
GDIFVMREPF

SEQ ID NO: 374249 - protein, 10 aa, Influenza virus
DIFVMREPFI

SEQ ID NO: 374250 - protein, 10 aa, Influenza virus
IFVMREPFIS

SEQ ID NO: 374251 - protein, 10 aa, Influenza virus
MREPFISCSH

SEQ ID NO: 374252 - protein, 10 aa, Influenza virus
REPFISCSQL

SEQ ID NO: 374253 - protein, 10 aa, Influenza virus
EPFISCSQLE

SEQ ID NO: 374254 - protein, 10 aa, Influenza virus
PFISCSQLEC

SEQ ID NO: 374255 - protein, 10 aa, Influenza virus
FECRTFFLTQ

SEQ ID NO: 374256 - protein, 10 aa, Influenza virus
LNDRHSNGTV

SEQ ID NO: 374257 - protein, 10 aa, Influenza virus
NDRHSNGTVK

SEQ ID NO: 374258 - protein, 10 aa, Influenza virus
HSNGTAKDRS

SEQ ID NO: 374259 - protein, 10 aa, Influenza virus
KDRSPHRTLM

SEQ ID NO: 374260 - protein, 10 aa, Influenza virus
DRSPHRTLMS

SEQ ID NO: 374261 - protein, 10 aa, Influenza virus
SPHRTLMSCP

SEQ ID NO: 374262 - protein, 10 aa, Influenza virus
RTLMSCPVGE

SEQ ID NO: 374263 - protein, 10 aa, Influenza virus
LMSCPIGEAP

SEQ ID NO: 374264 - protein, 10 aa, Influenza virus
MSCPIGEAPS

SEQ ID NO: 374265 - protein, 10 aa, Influenza virus
SCPIGEAPSP

SEQ ID NO: 374266 - protein, 10 aa, Influenza virus
CPIGEAPSPY

SEQ ID NO: 374267 - protein, 10 aa, Influenza virus
PIGEAPSPYN

SEQ ID NO: 374268 - protein, 10 aa, Influenza virus
IGEAPSPYNS

SEQ ID NO: 374269 - protein, 10 aa, Influenza virus
GEAPSPYNSR

SEQ ID NO: 374270 - protein, 10 aa, Influenza virus
EAPSPYNSRF

SEQ ID NO: 374271 - protein, 10 aa, Influenza virus
APSPYNSRFE

SEQ ID NO: 374272 - protein, 10 aa, Influenza virus
WSASACHDGT

SEQ ID NO: 374273 - protein, 10 aa, Influenza virus
SWLTIGISGP

SEQ ID NO: 374274 - protein, 10 aa, Influenza virus
ITIGISGPDD

SEQ ID NO: 374275 - protein, 10 aa, Influenza virus
GISGPDNEAV

SEQ ID NO: 374276 - protein, 10 aa, Influenza virus
ISGPDNEAVA

SEQ ID NO: 374277 - protein, 10 aa, Influenza virus
SGPDNEAVAV

SEQ ID NO: 374278 - protein, 10 aa, Influenza virus
GPDNEAVAVL

SEQ ID NO: 374279 - protein, 10 aa, Influenza virus
PDNEAVAVLK

SEQ ID NO: 374280 - protein, 10 aa, Influenza virus
DNEAVAVLKY

SEQ ID NO: 374281 - protein, 10 aa, Influenza virus
NGAVAVLKYK

SEQ ID NO: 374282 - protein, 10 aa, Influenza virus
GAVAVLKYND

SEQ ID NO: 374283 - protein, 10 aa, Influenza virus
AVAVLKYNDI

SEQ ID NO: 374284 - protein, 10 aa, Influenza virus
VAVLKYNDII

SEQ ID NO: 374285 - protein, 10 aa, Influenza virus
AVLKYNDIIT

SEQ ID NO: 374286 - protein, 10 aa, Influenza virus
VLKYNGIITE

SEQ ID NO: 374287 - protein, 10 aa, Influenza virus
LKYNGIITET

SEQ ID NO: 374288 - protein, 10 aa, Influenza virus
GIITETIKSW

SEQ ID NO: 374289 - protein, 10 aa, Influenza virus
RILRTQESEC

SEQ ID NO: 374290 - protein, 10 aa, Influenza virus
RTQESECVCV

SEQ ID NO: 374291 - protein, 10 aa, Influenza virus
TQESECVCVN

SEQ ID NO: 374292 - protein, 10 aa, Influenza virus
QESECVCVNG

SEQ ID NO: 374293 - protein, 10 aa, Influenza virus
ESECVCVNGS

SEQ ID NO: 374294 - protein, 10 aa, Influenza virus
SECVCVNGSC

SEQ ID NO: 374295 - protein, 10 aa, Influenza virus
NGSCFTVLTD

SEQ ID NO: 374296 - protein, 10 aa, Influenza virus
GSCFTVLTDG

SEQ ID NO: 374297 - protein, 10 aa, Influenza virus
SCFTVLTDGP

SEQ ID NO: 374298 - protein, 10 aa, Influenza virus
CFTVLTDGPS

SEQ ID NO: 374299 - protein, 10 aa, Influenza virus
APNFYYEECS

SEQ ID NO: 374300 - protein, 10 aa, Influenza virus
PNFYYEECSC

SEQ ID NO: 374301 - protein, 10 aa, Influenza virus
NFYYEECSCY

SEQ ID NO: 374302 - protein, 10 aa, Influenza virus
FYYEECSCYP

SEQ ID NO: 374303 - protein, 10 aa, Influenza virus
HYEECSCYPE

SEQ ID NO: 374304 - protein, 10 aa, Influenza virus
YEECSCYPDA

SEQ ID NO: 374305 - protein, 10 aa, Influenza virus
VVCVCRDNWH

SEQ ID NO: 374306 - protein, 10 aa, Influenza virus
VCVCRDNWHA

SEQ ID NO: 374307 - protein, 10 aa, Influenza virus
WHASNRPWIS

SEQ ID NO: 374308 - protein, 10 aa, Influenza virus
HASNRPWISF

SEQ ID NO: 374309 - protein, 10 aa, Influenza virus
GSNRPWVSFD

SEQ ID NO: 374310 - protein, 10 aa, Influenza virus
SNRPWISFDQ

SEQ ID NO: 374311 - protein, 10 aa, Influenza virus
NRPWVSFNQD

SEQ ID NO: 374312 - protein, 10 aa, Influenza virus
RPWVSFNQDL

SEQ ID NO: 374313 - protein, 10 aa, Influenza virus
MGYICSGIFG

SEQ ID NO: 374314 - protein, 10 aa, Influenza virus
SGVFGDNPRS

SEQ ID NO: 374315 - protein, 10 aa, Influenza virus
GADGVKGFSY

SEQ ID NO: 374316 - protein, 10 aa, Influenza virus
GVKGFSFRYG

SEQ ID NO: 374317 - protein, 10 aa, Influenza virus
KGFSFRYGNG

SEQ ID NO: 374318 - protein, 10 aa, Influenza virus
GFSFRYGNGV

SEQ ID NO: 374319 - protein, 10 aa, Influenza virus
FSFRYGNGVW

SEQ ID NO: 374320 - protein, 10 aa, Influenza virus
KYDNGVWIGR

SEQ ID NO: 374321 - protein, 10 aa, Influenza virus
YGNGVWMGRT

SEQ ID NO: 374322 - protein, 10 aa, Influenza virus
GNGVWMGRTK

SEQ ID NO: 374323 - protein, 10 aa, Influenza virus
GVWIGRTKST

SEQ ID NO: 374324 - protein, 10 aa, Influenza virus
GFEMVWDPNG

SEQ ID NO: 374325 - protein, 10 aa, Influenza virus
FEMVWDPNGW

SEQ ID NO: 374326 - protein, 10 aa, Influenza virus
EMVWDPNGWT

SEQ ID NO: 374327 - protein, 10 aa, Influenza virus
NDWSGYSGSF

SEQ ID NO: 374328 - protein, 10 aa, Influenza virus
VQHPELTGLN

SEQ ID NO: 374329 - protein, 10 aa, Influenza virus
QHPELTGLNC

SEQ ID NO: 374330 - protein, 10 aa, Influenza virus
HPELTGMNCI

SEQ ID NO: 374331 - protein, 10 aa, Influenza virus
NCIRPCFWVE

SEQ ID NO: 374332 - protein, 10 aa, Influenza virus
CIKPCFWVEL

SEQ ID NO: 374333 - protein, 10 aa, Influenza virus
MRPCFWVELI

SEQ ID NO: 374334 - protein, 10 aa, Influenza virus
KPCFWVELIR

SEQ ID NO: 374335 - protein, 10 aa, Influenza virus
CFWVELIRGQ

SEQ ID NO: 374336 - protein, 10 aa, Influenza virus
FWVELIRGQP

SEQ ID NO: 374337 - protein, 10 aa, Influenza virus
TIWTSASSIS

SEQ ID NO: 374338 - protein, 10 aa, Influenza virus
IWTSGSIISF

SEQ ID NO: 374339 - protein, 10 aa, Influenza virus
WTSGSIISFC

SEQ ID NO: 374340 - protein, 10 aa, Influenza virus
TSGSIISFCG

SEQ ID NO: 374341 - protein, 10 aa, Influenza virus
GSIISFCGVN

SEQ ID NO: 374342 - protein, 10 aa, Influenza virus
SSISFCGVNG

SEQ ID NO: 374343 - protein, 10 aa, Influenza virus
WSWPDGAKLP

SEQ ID NO: 374344 - protein, 10 aa, Influenza virus
SWPDGAKLPF

SEQ ID NO: 374345 - protein, 10 aa, Influenza virus
WPDGAKLPFT

SEQ ID NO: 374346 - protein, 10 aa, Influenza virus
PDGAKLPFTI

SEQ ID NO: 374347 - protein, 10 aa, Influenza virus
DTICVGYHAN

SEQ ID NO: 374348 - protein, 10 aa, Influenza virus
TICVGYHANN

SEQ ID NO: 374349 - protein, 10 aa, Influenza virus
ICVGYHANNS

SEQ ID NO: 374350 - protein, 10 aa, Influenza virus
IGYHANNSTE

SEQ ID NO: 374351 - protein, 10 aa, Influenza virus
YHANNSTDTI

SEQ ID NO: 374352 - protein, 10 aa, Influenza virus
HANNSTDTID

SEQ ID NO: 374353 - protein, 10 aa, Influenza virus
ANNSTDTIDT

SEQ ID NO: 374354 - protein, 10 aa, Influenza virus
KNVTVTHSIN

SEQ ID NO: 374355 - protein, 10 aa, Influenza virus
NVTVTHSINL

SEQ ID NO: 374356 - protein, 10 aa, Influenza virus
VTVTHSINLL

SEQ ID NO: 374357 - protein, 10 aa, Influenza virus
KVTHRENLLL

SEQ ID NO: 374358 - protein, 10 aa, Influenza virus
PFQNVHPITI

SEQ ID NO: 374359 - protein, 10 aa, Influenza virus
FQNVHPITIG

SEQ ID NO: 374360 - protein, 10 aa, Influenza virus
HPATIGECPK

SEQ ID NO: 374361 - protein, 10 aa, Influenza virus
PATIGECPKY

SEQ ID NO: 374362 - protein, 10 aa, Influenza virus
ATIGECPKYV

SEQ ID NO: 374363 - protein, 10 aa, Influenza virus
TIGKCPKYVK

SEQ ID NO: 374364 - protein, 10 aa, Influenza virus
IGKCPKYVKS

SEQ ID NO: 374365 - protein, 10 aa, Influenza virus
SVQSRGLFGA

SEQ ID NO: 374366 - protein, 10 aa, Influenza virus
VQSRGLFGAI

SEQ ID NO: 374367 - protein, 10 aa, Influenza virus
QSKGLFGAIA

SEQ ID NO: 374368 - protein, 10 aa, Influenza virus
SKGLFGAIAG

SEQ ID NO: 374369 - protein, 10 aa, Influenza virus
IEGGWTGMVN

SEQ ID NO: 374370 - protein, 10 aa, Influenza virus
EGGWTGMVNG

SEQ ID NO: 374371 - protein, 10 aa, Influenza virus
GGWTGMVNGW

SEQ ID NO: 374372 - protein, 10 aa, Influenza virus
GWTGMVNGWY

SEQ ID NO: 374373 - protein, 10 aa, Influenza virus
WTGMVNGWYG

SEQ ID NO: 374374 - protein, 10 aa, Influenza virus
TGMVNGWYGY

SEQ ID NO: 374375 - protein, 10 aa, Influenza virus
NDQGSGYAAD

SEQ ID NO: 374376 - protein, 10 aa, Influenza virus
ENLNKKIDDG

SEQ ID NO: 374377 - protein, 10 aa, Influenza virus
DLWTYNAELL

SEQ ID NO: 374378 - protein, 10 aa, Influenza virus
VWTYNAELLI

SEQ ID NO: 374379 - protein, 10 aa, Influenza virus
LLENERTLDL

SEQ ID NO: 374380 - protein, 10 aa, Influenza virus
LENERTLDLH

SEQ ID NO: 374381 - protein, 10 aa, Influenza virus
ENERTLDLHD

SEQ ID NO: 374382 - protein, 10 aa, Influenza virus
NERTLDLHDS

SEQ ID NO: 374383 - protein, 10 aa, Influenza virus
ERTLDLHDSN

SEQ ID NO: 374384 - protein, 10 aa, Influenza virus
RTLDLHDSNV

SEQ ID NO: 374385 - protein, 10 aa, Influenza virus
NNAQEIGNGC

SEQ ID NO: 374386 - protein, 10 aa, Influenza virus
NAQEIGNGCF

SEQ ID NO: 374387 - protein, 10 aa, Influenza virus
VKEIGNGCFE

SEQ ID NO: 374388 - protein, 10 aa, Influenza virus
QEIGNGCFEF

SEQ ID NO: 374389 - protein, 10 aa, Influenza virus
GCFEFYHRCD

SEQ ID NO: 374390 - protein, 10 aa, Influenza virus
CFEFYHKCND

SEQ ID NO: 374391 - protein, 10 aa, Influenza virus
CMESVRNGTY

SEQ ID NO: 374392 - protein, 10 aa, Influenza virus
GFWMCSNGSL

SEQ ID NO: 374393 - protein, 10 aa, Influenza virus
FWMCPNGSLQ

SEQ ID NO: 374394 - protein, 10 aa, Influenza virus
WMCSNGSLHG

SEQ ID NO: 374395 - protein, 10 aa, Influenza virus
MCSNGSLHGR

SEQ ID NO: 374396 - protein, 10 aa, Influenza virus
CSNGSLQCRV

SEQ ID NO: 374397 - protein, 10 aa, Influenza virus
KNNQVILCEQ

SEQ ID NO: 374398 - protein, 10 aa, Influenza virus
VTGFAPFSKD

SEQ ID NO: 374399 - protein, 10 aa, Influenza virus
RGFAPFSKDN

SEQ ID NO: 374400 - protein, 10 aa, Influenza virus
NSIRLSASGD

SEQ ID NO: 374401 - protein, 10 aa, Influenza virus
SIRLSASGDV

SEQ ID NO: 374402 - protein, 10 aa, Influenza virus
IRLSAGGAVW

SEQ ID NO: 374403 - protein, 10 aa, Influenza virus
RLSAGGDIWI

SEQ ID NO: 374404 - protein, 10 aa, Influenza virus
LSAGGDIWIT

SEQ ID NO: 374405 - protein, 10 aa, Influenza virus
SAGGDIWITR

SEQ ID NO: 374406 - protein, 10 aa, Influenza virus
AGGDIWITRE

SEQ ID NO: 374407 - protein, 10 aa, Influenza virus
GGDIWITREP

SEQ ID NO: 374408 - protein, 10 aa, Influenza virus
GDIWITREPY

SEQ ID NO: 374409 - protein, 10 aa, Influenza virus
DIWITREPYV

SEQ ID NO: 374410 - protein, 10 aa, Influenza virus
VWVTREPYVS

SEQ ID NO: 374411 - protein, 10 aa, Influenza virus
FALGQGTTLK

SEQ ID NO: 374412 - protein, 10 aa, Influenza virus
ALGQGTTLSN

SEQ ID NO: 374413 - protein, 10 aa, Influenza virus
DRIPHRTLLM

SEQ ID NO: 374414 - protein, 10 aa, Influenza virus
SYRTLLMNEL

SEQ ID NO: 374415 - protein, 10 aa, Influenza virus
HRTLLMSELG

SEQ ID NO: 374416 - protein, 10 aa, Influenza virus
RTLLMSELGV

SEQ ID NO: 374417 - protein, 10 aa, Influenza virus
LMNELGVPFY

SEQ ID NO: 374418 - protein, 10 aa, Influenza virus
MNELGVPFYL

SEQ ID NO: 374419 - protein, 10 aa, Influenza virus
NELGVPFYLG

SEQ ID NO: 374420 - protein, 10 aa, Influenza virus
ELGVPFYLGT

SEQ ID NO: 374421 - protein, 10 aa, Influenza virus
LGIPFHLGTK

SEQ ID NO: 374422 - protein, 10 aa, Influenza virus
PFYLGTKQVC

SEQ ID NO: 374423 - protein, 10 aa, Influenza virus
LGTRQVCMAW

SEQ ID NO: 374424 - protein, 10 aa, Influenza virus
GTRQVCMAWS

SEQ ID NO: 374425 - protein, 10 aa, Influenza virus
TRQVCMAWSS

SEQ ID NO: 374426 - protein, 10 aa, Influenza virus
RQVCMAWSSS

SEQ ID NO: 374427 - protein, 10 aa, Influenza virus
CIAWSSSSCY

SEQ ID NO: 374428 - protein, 10 aa, Influenza virus
IAWSSSSCYD

SEQ ID NO: 374429 - protein, 10 aa, Influenza virus
WSSSSCHDGR

SEQ ID NO: 374430 - protein, 10 aa, Influenza virus
SSSSCHDGRA

SEQ ID NO: 374431 - protein, 10 aa, Influenza virus
SSSCHDGRAW

SEQ ID NO: 374432 - protein, 10 aa, Influenza virus
SSCHDGRAWL

SEQ ID NO: 374433 - protein, 10 aa, Influenza virus
SCHDGRAWLH

SEQ ID NO: 374434 - protein, 10 aa, Influenza virus
CHDGRAWLHV

SEQ ID NO: 374435 - protein, 10 aa, Influenza virus
HDGRAWLHVC

SEQ ID NO: 374436 - protein, 10 aa, Influenza virus
RILRTQESEC

SEQ ID NO: 374437 - protein, 10 aa, Influenza virus
ILRTHESECV

SEQ ID NO: 374438 - protein, 10 aa, Influenza virus
LRTHESECVC

SEQ ID NO: 374439 - protein, 10 aa, Influenza virus
RTQESECVCV

SEQ ID NO: 374440 - protein, 10 aa, Influenza virus
TCTVIMTDGS

SEQ ID NO: 374441 - protein, 10 aa, Influenza virus
CTVIMTDGSA

SEQ ID NO: 374442 - protein, 10 aa, Influenza virus
TVIMTDGSAS

SEQ ID NO: 374443 - protein, 10 aa, Influenza virus
VVMTDGSASE

SEQ ID NO: 374444 - protein, 10 aa, Influenza virus
GGAQHVEECS

SEQ ID NO: 374445 - protein, 10 aa, Influenza virus
GAQHVEECSC

SEQ ID NO: 374446 - protein, 10 aa, Influenza virus
IEECSCYPRY

SEQ ID NO: 374447 - protein, 10 aa, Influenza virus
EECSCYPRSP

SEQ ID NO: 374448 - protein, 10 aa, Influenza virus
VRCVCRDNWR

SEQ ID NO: 374449 - protein, 10 aa, Influenza virus
RCVCRDNWRG

SEQ ID NO: 374450 - protein, 10 aa, Influenza virus
CVCRDNWRGS

SEQ ID NO: 374451 - protein, 10 aa, Influenza virus
VCRDNWRGSN

SEQ ID NO: 374452 - protein, 10 aa, Influenza virus
DNWRGSNRPI

SEQ ID NO: 374453 - protein, 10 aa, Influenza virus
NWKGSNRPII

SEQ ID NO: 374454 - protein, 10 aa, Influenza virus
WKGSNRPIID

SEQ ID NO: 374455 - protein, 10 aa, Influenza virus
KGSNRPIIDI

SEQ ID NO: 374456 - protein, 10 aa, Influenza virus
SSYICSGLVG

SEQ ID NO: 374457 - protein, 10 aa, Influenza virus
SYICSGLVGD

SEQ ID NO: 374458 - protein, 10 aa, Influenza virus
YICSGLVGDT

SEQ ID NO: 374459 - protein, 10 aa, Influenza virus
ICSGLVGDTP

SEQ ID NO: 374460 - protein, 10 aa, Influenza virus
GNPGVKGWAF

SEQ ID NO: 374461 - protein, 10 aa, Influenza virus
NPGVKGWAFD

SEQ ID NO: 374462 - protein, 10 aa, Influenza virus
RSGYETFRVI

SEQ ID NO: 374463 - protein, 10 aa, Influenza virus
SGYSGIFSIE

SEQ ID NO: 374464 - protein, 10 aa, Influenza virus
RCINRCFYVE

SEQ ID NO: 374465 - protein, 10 aa, Influenza virus
FYVELIRGRN

SEQ ID NO: 374466 - protein, 10 aa, Influenza virus
VGWTSNSIVV

SEQ ID NO: 374467 - protein, 10 aa, Influenza virus
GWTSNSIVVF

SEQ ID NO: 374468 - protein, 10 aa, Influenza virus
TSNSVVVFCG

SEQ ID NO: 374469 - protein, 10 aa, Influenza virus
SNSVVVFCGT

SEQ ID NO: 374470 - protein, 10 aa, Influenza virus
NSIVVFCSTS

SEQ ID NO: 374471 - protein, 10 aa, Influenza virus
SVVVFCGTSG

SEQ ID NO: 374472 - protein, 10 aa, Influenza virus
IVVFCGASGT

SEQ ID NO: 374473 - protein, 10 aa, Influenza virus
VVFCGTSGIY

SEQ ID NO: 374474 - protein, 10 aa, Influenza virus
EFCGTSGTYG

SEQ ID NO: 374475 - protein, 10 aa, Influenza virus
GTYGSGSWPD

SEQ ID NO: 374476 - protein, 10 aa, Influenza virus
MDNQTKKMTI

SEQ ID NO: 374477 - protein, 10 aa, Influenza virus
DKQTKTMTIT

SEQ ID NO: 374478 - protein, 10 aa, Influenza virus
NKTKKMTITF

SEQ ID NO: 374479 - protein, 10 aa, Influenza virus
KTKKMTITFL

SEQ ID NO: 374480 - protein, 10 aa, Influenza virus
GDQICVGYHS

SEQ ID NO: 374481 - protein, 10 aa, Influenza virus
DQICVGYHSN

SEQ ID NO: 374482 - protein, 10 aa, Influenza virus
QICVGYHSNN

SEQ ID NO: 374483 - protein, 10 aa, Influenza virus
ICVGYHSNNS

SEQ ID NO: 374484 - protein, 10 aa, Influenza virus
CVGYHSNNST

SEQ ID NO: 374485 - protein, 10 aa, Influenza virus
VGYHSNNSTE

SEQ ID NO: 374486 - protein, 10 aa, Influenza virus
GYHANNSTET

SEQ ID NO: 374487 - protein, 10 aa, Influenza virus
DTILEKNVTV

SEQ ID NO: 374488 - protein, 10 aa, Influenza virus
TILEKNVTVT

SEQ ID NO: 374489 - protein, 10 aa, Influenza virus
ILEKNVTVTH

SEQ ID NO: 374490 - protein, 10 aa, Influenza virus
LEKNVTVTHA

SEQ ID NO: 374491 - protein, 10 aa, Influenza virus
EQNVTVTHAK

SEQ ID NO: 374492 - protein, 10 aa, Influenza virus
NVTVTHAKNI

SEQ ID NO: 374493 - protein, 10 aa, Influenza virus
VTVTHAKNIL

SEQ ID NO: 374494 - protein, 10 aa, Influenza virus
TVTHAKNILE

SEQ ID NO: 374495 - protein, 10 aa, Influenza virus
VTHAKNILEK

SEQ ID NO: 374496 - protein, 10 aa, Influenza virus
DILEKVHNGK

SEQ ID NO: 374497 - protein, 10 aa, Influenza virus
ILERTHNGKL

SEQ ID NO: 374498 - protein, 10 aa, Influenza virus
LERTHNGKLC

SEQ ID NO: 374499 - protein, 10 aa, Influenza virus
HNGKLCRLRG

SEQ ID NO: 374500 - protein, 10 aa, Influenza virus
GIPPLVLGDC

SEQ ID NO: 374501 - protein, 10 aa, Influenza virus
IPPLVLGDCS

SEQ ID NO: 374502 - protein, 10 aa, Influenza virus
PPLVLGDCSI

SEQ ID NO: 374503 - protein, 10 aa, Influenza virus
PLVLGDCSIA

SEQ ID NO: 374504 - protein, 10 aa, Influenza virus
LVLGDCSIAG

SEQ ID NO: 374505 - protein, 10 aa, Influenza virus
VLGDCSIAGW

SEQ ID NO: 374506 - protein, 10 aa, Influenza virus
WLLGNPECDL

SEQ ID NO: 374507 - protein, 10 aa, Influenza virus
LLGNPECDLL

SEQ ID NO: 374508 - protein, 10 aa, Influenza virus
LGNPECDLLL

SEQ ID NO: 374509 - protein, 10 aa, Influenza virus
VPEWSYIVER

SEQ ID NO: 374510 - protein, 10 aa, Influenza virus
PEWSYIVERE

SEQ ID NO: 374511 - protein, 10 aa, Influenza virus
PSFFRNMIWL

SEQ ID NO: 374512 - protein, 10 aa, Influenza virus
GSYNNTNGEQ

SEQ ID NO: 374513 - protein, 10 aa, Influenza virus
SYNNTSGEQI

SEQ ID NO: 374514 - protein, 10 aa, Influenza virus
YNNTSGEQIL

SEQ ID NO: 374515 - protein, 10 aa, Influenza virus
ISFESTGNLI

SEQ ID NO: 374516 - protein, 10 aa, Influenza virus
SFESTGNLIA

SEQ ID NO: 374517 - protein, 10 aa, Influenza virus
FESNGNLIAP

SEQ ID NO: 374518 - protein, 10 aa, Influenza virus
ESNGNLIAPE

SEQ ID NO: 374519 - protein, 10 aa, Influenza virus
SNGNLIAPEY

SEQ ID NO: 374520 - protein, 10 aa, Influenza virus
NGNLIAPEYG

SEQ ID NO: 374521 - protein, 10 aa, Influenza virus
NLIAPEYGFR

SEQ ID NO: 374522 - protein, 10 aa, Influenza virus
LIAPEYGFRI

SEQ ID NO: 374523 - protein, 10 aa, Influenza virus
IAPEYGFRIS

SEQ ID NO: 374524 - protein, 10 aa, Influenza virus
YGFRISKRGS

SEQ ID NO: 374525 - protein, 10 aa, Influenza virus
GFKISKRGNS

SEQ ID NO: 374526 - protein, 10 aa, Influenza virus
FKISKRGNSG

SEQ ID NO: 374527 - protein, 10 aa, Influenza virus
KISKRGNSGI

SEQ ID NO: 374528 - protein, 10 aa, Influenza virus
ISKRGSSGIV

SEQ ID NO: 374529 - protein, 10 aa, Influenza virus
SKRGSSGIVK

SEQ ID NO: 374530 - protein, 10 aa, Influenza virus
KRGSSGIVKT

SEQ ID NO: 374531 - protein, 10 aa, Influenza virus
CETQCQTPLG

SEQ ID NO: 374532 - protein, 10 aa, Influenza virus
ETQCQTPLGA

SEQ ID NO: 374533 - protein, 10 aa, Influenza virus
TQCQTPLGAI

SEQ ID NO: 374534 - protein, 10 aa, Influenza virus
QCQTPLGAIN

SEQ ID NO: 374535 - protein, 10 aa, Influenza virus
CQSPLGAINT

SEQ ID NO: 374536 - protein, 10 aa, Influenza virus
QSPLGAINTT

SEQ ID NO: 374537 - protein, 10 aa, Influenza virus
SPLGAINTTL

SEQ ID NO: 374538 - protein, 10 aa, Influenza virus
LNTTLPFHNI

SEQ ID NO: 374539 - protein, 10 aa, Influenza virus
LPFHNIHPLA

SEQ ID NO: 374540 - protein, 10 aa, Influenza virus
PFHNIHPLAI

SEQ ID NO: 374541 - protein, 10 aa, Influenza virus
FHNIHPLAIG

SEQ ID NO: 374542 - protein, 10 aa, Influenza virus
HNIHPLAIGE

SEQ ID NO: 374543 - protein, 10 aa, Influenza virus
NIHPLAIGEC

SEQ ID NO: 374544 - protein, 10 aa, Influenza virus
IHPLAIGECP

SEQ ID NO: 374545 - protein, 10 aa, Influenza virus
LTIGECPKYI

SEQ ID NO: 374546 - protein, 10 aa, Influenza virus
TIGECPKYIK

SEQ ID NO: 374547 - protein, 10 aa, Influenza virus
IGECPKYVRS

SEQ ID NO: 374548 - protein, 10 aa, Influenza virus
PQIEPRGLFG

SEQ ID NO: 374549 - protein, 10 aa, Influenza virus
QIEPRGLFGA

SEQ ID NO: 374550 - protein, 10 aa, Influenza virus
IEPRGLFGAI

SEQ ID NO: 374551 - protein, 10 aa, Influenza virus
EARGLFGAIA

SEQ ID NO: 374552 - protein, 10 aa, Influenza virus
ARGLFGAIAG

SEQ ID NO: 374553 - protein, 10 aa, Influenza virus
QGSGYAADKA

SEQ ID NO: 374554 - protein, 10 aa, Influenza virus
GSGYAADKAS

SEQ ID NO: 374555 - protein, 10 aa, Influenza virus
SGYAADKAST

SEQ ID NO: 374556 - protein, 10 aa, Influenza virus
YAADKASTQK

SEQ ID NO: 374557 - protein, 10 aa, Influenza virus
AADKASTQKA

SEQ ID NO: 374558 - protein, 10 aa, Influenza virus
SLERRLENLN

SEQ ID NO: 374559 - protein, 10 aa, Influenza virus
LEKRLGNLNK

SEQ ID NO: 374560 - protein, 10 aa, Influenza virus
EKRLGNLNKK

SEQ ID NO: 374561 - protein, 10 aa, Influenza virus
RLGNLNKKME

SEQ ID NO: 374562 - protein, 10 aa, Influenza virus
LGNLNKKMED

SEQ ID NO: 374563 - protein, 10 aa, Influenza virus
GNLNKKMEDG

SEQ ID NO: 374564 - protein, 10 aa, Influenza virus
NLDKKMEDGF

SEQ ID NO: 374565 - protein, 10 aa, Influenza virus
VWTYNAEVLV

SEQ ID NO: 374566 - protein, 10 aa, Influenza virus
WTYNAEVLVL

SEQ ID NO: 374567 - protein, 10 aa, Influenza virus
TYNAEVLVLM

SEQ ID NO: 374568 - protein, 10 aa, Influenza virus
YNVELLVLME

SEQ ID NO: 374569 - protein, 10 aa, Influenza virus
NVELLVLMEN

SEQ ID NO: 374570 - protein, 10 aa, Influenza virus
VELLVLMENE

SEQ ID NO: 374571 - protein, 10 aa, Influenza virus
VLVLMENERT

SEQ ID NO: 374572 - protein, 10 aa, Influenza virus
VLMENERTLE

SEQ ID NO: 374573 - protein, 10 aa, Influenza virus
LMENEMTLDF

SEQ ID NO: 374574 - protein, 10 aa, Influenza virus
MENEMTLDFH

SEQ ID NO: 374575 - protein, 10 aa, Influenza virus
ENEMTLDFHD

SEQ ID NO: 374576 - protein, 10 aa, Influenza virus
NEMTLDFHDS

SEQ ID NO: 374577 - protein, 10 aa, Influenza virus
EMTLDFHDSN

SEQ ID NO: 374578 - protein, 10 aa, Influenza virus
MTLDFHDSNV

SEQ ID NO: 374579 - protein, 10 aa, Influenza virus
TLDYHDSNVK

SEQ ID NO: 374580 - protein, 10 aa, Influenza virus
LDFHDSNVKS

SEQ ID NO: 374581 - protein, 10 aa, Influenza virus
DFHDSNVKSL

SEQ ID NO: 374582 - protein, 10 aa, Influenza virus
FHDSNVKSLY

SEQ ID NO: 374583 - protein, 10 aa, Influenza virus
HDSNVKNLYN

SEQ ID NO: 374584 - protein, 10 aa, Influenza virus
NLYNKVRMQL

SEQ ID NO: 374585 - protein, 10 aa, Influenza virus
LYDRVRMQLR

SEQ ID NO: 374586 - protein, 10 aa, Influenza virus
YDRVRMQLRD

SEQ ID NO: 374587 - protein, 10 aa, Influenza virus
DRVRMQLRDN

SEQ ID NO: 374588 - protein, 10 aa, Influenza virus
RVRMQLRDNA

SEQ ID NO: 374589 - protein, 10 aa, Influenza virus
VRMQLKDNAK

SEQ ID NO: 374590 - protein, 10 aa, Influenza virus
RMQLKDNAKE

SEQ ID NO: 374591 - protein, 10 aa, Influenza virus
MQLRDNAKEL

SEQ ID NO: 374592 - protein, 10 aa, Influenza virus
QLRDNAKELG

SEQ ID NO: 374593 - protein, 10 aa, Influenza virus
DNAKELGNGC

SEQ ID NO: 374594 - protein, 10 aa, Influenza virus
NAKELGNGCF

SEQ ID NO: 374595 - protein, 10 aa, Influenza virus
AKELGNGCFE

SEQ ID NO: 374596 - protein, 10 aa, Influenza virus
KEVGNGCFEF

SEQ ID NO: 374597 - protein, 10 aa, Influenza virus
ETGNGCFEFY

SEQ ID NO: 374598 - protein, 10 aa, Influenza virus
TGNGCFEFYH

SEQ ID NO: 374599 - protein, 10 aa, Influenza virus
CFEFYHKCND

SEQ ID NO: 374600 - protein, 10 aa, Influenza virus
FEFYHKCNDE

SEQ ID NO: 374601 - protein, 10 aa, Influenza virus
EFYHKCNDEC

SEQ ID NO: 374602 - protein, 10 aa, Influenza virus
FYHKCNDECM

SEQ ID NO: 374603 - protein, 10 aa, Influenza virus
YHKCDNECMD

SEQ ID NO: 374604 - protein, 10 aa, Influenza virus
HKCDNECMDS

SEQ ID NO: 374605 - protein, 10 aa, Influenza virus
NGTYNYPKYE

SEQ ID NO: 374606 - protein, 10 aa, Influenza virus
GTYNYPKYEE

SEQ ID NO: 374607 - protein, 10 aa, Influenza virus
TYNYPKYEEE

SEQ ID NO: 374608 - protein, 10 aa, Influenza virus
YNYPKYEEES

SEQ ID NO: 374609 - protein, 10 aa, Influenza virus
YPKYEEESRL

SEQ ID NO: 374610 - protein, 10 aa, Influenza virus
SKYEEESKLN

SEQ ID NO: 374611 - protein, 10 aa, Influenza virus
KYEEESRLNR

SEQ ID NO: 374612 - protein, 10 aa, Influenza virus
YEEESKLNRT

SEQ ID NO: 374613 - protein, 10 aa, Influenza virus
EEESKLNRTE

SEQ ID NO: 374614 - protein, 10 aa, Influenza virus
EESKLNRTEI

SEQ ID NO: 374615 - protein, 10 aa, Influenza virus
ESKLNRTEIK

SEQ ID NO: 374616 - protein, 10 aa, Influenza virus
SKLNRTEIKG

SEQ ID NO: 374617 - protein, 10 aa, Influenza virus
MGAYQILAIY

SEQ ID NO: 374618 - protein, 10 aa, Influenza virus
GVYQILVIYA

SEQ ID NO: 374619 - protein, 10 aa, Influenza virus
VYQILVIYAT

SEQ ID NO: 374620 - protein, 10 aa, Influenza virus
AGSLSLAIMV

SEQ ID NO: 374621 - protein, 10 aa, Influenza virus
GSLSLAIMVA

SEQ ID NO: 374622 - protein, 10 aa, Influenza virus
SLSLAIMVAG

SEQ ID NO: 374623 - protein, 10 aa, Influenza virus
LSLAIMVAGI

SEQ ID NO: 374624 - protein, 10 aa, Influenza virus
SLAIMVAGIS

SEQ ID NO: 374625 - protein, 10 aa, Influenza virus
AGISIWMCSN

SEQ ID NO: 374626 - protein, 10 aa, Influenza virus
GISIWMCSNG

SEQ ID NO: 374627 - protein, 10 aa, Influenza virus
ISIWMCSNGS

SEQ ID NO: 374628 - protein, 10 aa, Influenza virus
SIWMCSNGSL

SEQ ID NO: 374629 - protein, 10 aa, Influenza virus
IWMCSNGSLQ

SEQ ID NO: 374630 - protein, 10 aa, Influenza virus
VRGDQICVGY

SEQ ID NO: 374631 - protein, 10 aa, Influenza virus
RGDQICVGYH

SEQ ID NO: 374632 - protein, 10 aa, Influenza virus
GDQICVGYHS

SEQ ID NO: 374633 - protein, 10 aa, Influenza virus
DQICVGYHSN

SEQ ID NO: 374634 - protein, 10 aa, Influenza virus
QICVGYHSNN

SEQ ID NO: 374635 - protein, 10 aa, Influenza virus
ICVGYHSNNS

SEQ ID NO: 374636 - protein, 10 aa, Influenza virus
CVGYHSNNST

SEQ ID NO: 374637 - protein, 10 aa, Influenza virus
VGYHSNNSTE

SEQ ID NO: 374638 - protein, 10 aa, Influenza virus
GYHANNSTET

SEQ ID NO: 374639 - protein, 10 aa, Influenza virus
KVDTNLERNV

SEQ ID NO: 374640 - protein, 10 aa, Influenza virus
ADTILERNVT

SEQ ID NO: 374641 - protein, 10 aa, Influenza virus
RNVTVTHAKN

SEQ ID NO: 374642 - protein, 10 aa, Influenza virus
NVTVTHAKNI

SEQ ID NO: 374643 - protein, 10 aa, Influenza virus
VTVTHAKNIL

SEQ ID NO: 374644 - protein, 10 aa, Influenza virus
TVTHAKNILE

SEQ ID NO: 374645 - protein, 10 aa, Influenza virus
VTHAKNILEK

SEQ ID NO: 374646 - protein, 10 aa, Influenza virus
THAKNILEKT

SEQ ID NO: 374647 - protein, 10 aa, Influenza virus
HAKNILEKTH

SEQ ID NO: 374648 - protein, 10 aa, Influenza virus
AKNILEKTHN

SEQ ID NO: 374649 - protein, 10 aa, Influenza virus
KNILEKTHNG

SEQ ID NO: 374650 - protein, 10 aa, Influenza virus
DILERTHNGK

SEQ ID NO: 374651 - protein, 10 aa, Influenza virus
ILEKAHNGKL

SEQ ID NO: 374652 - protein, 10 aa, Influenza virus
LEKTHNGRLC

SEQ ID NO: 374653 - protein, 10 aa, Influenza virus
EKAHNGKLCR

SEQ ID NO: 374654 - protein, 10 aa, Influenza virus
KTHNGRLCKL

SEQ ID NO: 374655 - protein, 10 aa, Influenza virus
THNGKLCRLR

SEQ ID NO: 374656 - protein, 10 aa, Influenza virus
HNGKLCRLRG

SEQ ID NO: 374657 - protein, 10 aa, Influenza virus
NGKLCRLRGI

SEQ ID NO: 374658 - protein, 10 aa, Influenza virus
GKLCRLRGIP

SEQ ID NO: 374659 - protein, 10 aa, Influenza virus
KLCRLRGIPP

SEQ ID NO: 374660 - protein, 10 aa, Influenza virus
LCRLRGIPPL

SEQ ID NO: 374661 - protein, 10 aa, Influenza virus
CRLRGIPPLE

SEQ ID NO: 374662 - protein, 10 aa, Influenza virus
RLRGIPPLEL

SEQ ID NO: 374663 - protein, 10 aa, Influenza virus
LRGIPPLELG

SEQ ID NO: 374664 - protein, 10 aa, Influenza virus
RGIPPLELGD

SEQ ID NO: 374665 - protein, 10 aa, Influenza virus
GNPECDRLLT

SEQ ID NO: 374666 - protein, 10 aa, Influenza virus
VPEWSYIVEK

SEQ ID NO: 374667 - protein, 10 aa, Influenza virus
PEWSYIVEKE

SEQ ID NO: 374668 - protein, 10 aa, Influenza virus
EWSYIVERET

SEQ ID NO: 374669 - protein, 10 aa, Influenza virus
WSYIVERETP

SEQ ID NO: 374670 - protein, 10 aa, Influenza virus
LCYPGNFNDY

SEQ ID NO: 374671 - protein, 10 aa, Influenza virus
CYPGNFNDYE

SEQ ID NO: 374672 - protein, 10 aa, Influenza virus
YPGSLNDYEE

SEQ ID NO: 374673 - protein, 10 aa, Influenza virus
PGNFNDYEEL

SEQ ID NO: 374674 - protein, 10 aa, Influenza virus
GNFNDYEELK

SEQ ID NO: 374675 - protein, 10 aa, Influenza virus
VKHFEKVRIL

SEQ ID NO: 374676 - protein, 10 aa, Influenza virus
HFEKVRILPK

SEQ ID NO: 374677 - protein, 10 aa, Influenza virus
FEKVRILPKD

SEQ ID NO: 374678 - protein, 10 aa, Influenza virus
SSFFRNMVWL

SEQ ID NO: 374679 - protein, 10 aa, Influenza virus
ARGSYNNTSG

SEQ ID NO: 374680 - protein, 10 aa, Influenza virus
KGSYNNTNGE

SEQ ID NO: 374681 - protein, 10 aa, Influenza virus
GSYNNTNGEQ

SEQ ID NO: 374682 - protein, 10 aa, Influenza virus
SYNNTSGEQV

SEQ ID NO: 374683 - protein, 10 aa, Influenza virus
YNNTSGEQVL

SEQ ID NO: 374684 - protein, 10 aa, Influenza virus
NNTNGEQILI

SEQ ID NO: 374685 - protein, 10 aa, Influenza virus
NTNGEQILII

SEQ ID NO: 374686 - protein, 10 aa, Influenza virus
TNGEQILIIW

SEQ ID NO: 374687 - protein, 10 aa, Influenza virus
NGEQILIIWG

SEQ ID NO: 374688 - protein, 10 aa, Influenza virus
IWGVHHPIDE

SEQ ID NO: 374689 - protein, 10 aa, Influenza virus
LYQEVGTYVS

SEQ ID NO: 374690 - protein, 10 aa, Influenza virus
WDVISFESTG

SEQ ID NO: 374691 - protein, 10 aa, Influenza virus
DVISFESTGN

SEQ ID NO: 374692 - protein, 10 aa, Influenza virus
VISFESTGNL

SEQ ID NO: 374693 - protein, 10 aa, Influenza virus
ISFESTGNLI

SEQ ID NO: 374694 - protein, 10 aa, Influenza virus
SFESTGNLIA

SEQ ID NO: 374695 - protein, 10 aa, Influenza virus
NLVVPEYGFK

SEQ ID NO: 374696 - protein, 10 aa, Influenza virus
LVVPEYGFKI

SEQ ID NO: 374697 - protein, 10 aa, Influenza virus
VVPEYGFKIS

SEQ ID NO: 374698 - protein, 10 aa, Influenza virus
APEYGFRISK

SEQ ID NO: 374699 - protein, 10 aa, Influenza virus
YGFRISKRGS

SEQ ID NO: 374700 - protein, 10 aa, Influenza virus
GFKISRRGNS

SEQ ID NO: 374701 - protein, 10 aa, Influenza virus
FKISRRGNSG

SEQ ID NO: 374702 - protein, 10 aa, Influenza virus
KISKRGSSGV

SEQ ID NO: 374703 - protein, 10 aa, Influenza virus
ISKRGSSGVM

SEQ ID NO: 374704 - protein, 10 aa, Influenza virus
SKRGSSGVMK

SEQ ID NO: 374705 - protein, 10 aa, Influenza virus
KRGSSGVMKT

SEQ ID NO: 374706 - protein, 10 aa, Influenza virus
RGSSGIMKTG

SEQ ID NO: 374707 - protein, 10 aa, Influenza virus
SGIMKTGGTL

SEQ ID NO: 374708 - protein, 10 aa, Influenza virus
DCETKCQTPL

SEQ ID NO: 374709 - protein, 10 aa, Influenza virus
CDTKCQTPLG

SEQ ID NO: 374710 - protein, 10 aa, Influenza virus
DTKCQTPLGA

SEQ ID NO: 374711 - protein, 10 aa, Influenza virus
TKCQSPLGAI

SEQ ID NO: 374712 - protein, 10 aa, Influenza virus
KCQSPLGAIN

SEQ ID NO: 374713 - protein, 10 aa, Influenza virus
CQSPLGAINT

SEQ ID NO: 374714 - protein, 10 aa, Influenza virus
QSPLGAINTT

SEQ ID NO: 374715 - protein, 10 aa, Influenza virus
SPLGAINTTL

SEQ ID NO: 374716 - protein, 10 aa, Influenza virus
LNTTLPFHNI

SEQ ID NO: 374717 - protein, 10 aa, Influenza virus
PFHNVHPLAI

SEQ ID NO: 374718 - protein, 10 aa, Influenza virus
FHNIHPLTMG

SEQ ID NO: 374719 - protein, 10 aa, Influenza virus
HNIHPLTMGE

SEQ ID NO: 374720 - protein, 10 aa, Influenza virus
NVHPLAIGEC

SEQ ID NO: 374721 - protein, 10 aa, Influenza virus
IHPLTMGECP

SEQ ID NO: 374722 - protein, 10 aa, Influenza virus
HPLTMGECPK

SEQ ID NO: 374723 - protein, 10 aa, Influenza virus
PLAIGECPKY

SEQ ID NO: 374724 - protein, 10 aa, Influenza virus
LTMGECPKYV

SEQ ID NO: 374725 - protein, 10 aa, Influenza virus
AIGECPKYVK

SEQ ID NO: 374726 - protein, 10 aa, Influenza virus
MGECPKYVKS

SEQ ID NO: 374727 - protein, 10 aa, Influenza virus
GECPKYVRSE

SEQ ID NO: 374728 - protein, 10 aa, Influenza virus
ECPKYVKSER

SEQ ID NO: 374729 - protein, 10 aa, Influenza virus
CPKYVKSERL

SEQ ID NO: 374730 - protein, 10 aa, Influenza virus
PKYVKSERLV

SEQ ID NO: 374731 - protein, 10 aa, Influenza virus
KYVKSERLVL

SEQ ID NO: 374732 - protein, 10 aa, Influenza virus
YVKSERLVLA

SEQ ID NO: 374733 - protein, 10 aa, Influenza virus
VKSERLVLAT

SEQ ID NO: 374734 - protein, 10 aa, Influenza virus
KSERLVLATG

SEQ ID NO: 374735 - protein, 10 aa, Influenza virus
SERLVLATGL

SEQ ID NO: 374736 - protein, 10 aa, Influenza virus
ERLVLATGLR

SEQ ID NO: 374737 - protein, 10 aa, Influenza virus
KLVLATGPRN

SEQ ID NO: 374738 - protein, 10 aa, Influenza virus
LVLATGPRNV

SEQ ID NO: 374739 - protein, 10 aa, Influenza virus
VLATGPRNVP

SEQ ID NO: 374740 - protein, 10 aa, Influenza virus
LATGPRNVPQ

SEQ ID NO: 374741 - protein, 10 aa, Influenza virus
ATGPRNVPQI

SEQ ID NO: 374742 - protein, 10 aa, Influenza virus
TGLRNVPQME

SEQ ID NO: 374743 - protein, 10 aa, Influenza virus
RNVPQMESRG

SEQ ID NO: 374744 - protein, 10 aa, Influenza virus
NVPQMESRGL

SEQ ID NO: 374745 - protein, 10 aa, Influenza virus
VPQMESRGLF

SEQ ID NO: 374746 - protein, 10 aa, Influenza virus
PQIEARGLFG

SEQ ID NO: 374747 - protein, 10 aa, Influenza virus
KMESRGLFGA

SEQ ID NO: 374748 - protein, 10 aa, Influenza virus
IEPRGLFGAI

SEQ ID NO: 374749 - protein, 10 aa, Influenza virus
QGAGYAADKE

SEQ ID NO: 374750 - protein, 10 aa, Influenza virus
GAGYAADKES

SEQ ID NO: 374751 - protein, 10 aa, Influenza virus
AGYAADKEST

SEQ ID NO: 374752 - protein, 10 aa, Influenza virus
YAADKESTQR

SEQ ID NO: 374753 - protein, 10 aa, Influenza virus
AADKESTQRA

SEQ ID NO: 374754 - protein, 10 aa, Influenza virus
ADKASTQKAI

SEQ ID NO: 374755 - protein, 10 aa, Influenza virus
NSVIEKMNIQ

SEQ ID NO: 374756 - protein, 10 aa, Influenza virus
AVGKEFGNLE

SEQ ID NO: 374757 - protein, 10 aa, Influenza virus
KEFNNLERRL

SEQ ID NO: 374758 - protein, 10 aa, Influenza virus
EFNNLERRLE

SEQ ID NO: 374759 - protein, 10 aa, Influenza virus
FNNLERRLEN

SEQ ID NO: 374760 - protein, 10 aa, Influenza virus
NNLERRLENL

SEQ ID NO: 374761 - protein, 10 aa, Influenza virus
NLEKRLGNLN

SEQ ID NO: 374762 - protein, 10 aa, Influenza virus
LEKRLGNLNK

SEQ ID NO: 374763 - protein, 10 aa, Influenza virus
ERRLENLSKR

SEQ ID NO: 374764 - protein, 10 aa, Influenza virus
RLENLDKKME

SEQ ID NO: 374765 - protein, 10 aa, Influenza virus
LENLSKRMED

SEQ ID NO: 374766 - protein, 10 aa, Influenza virus
ENLSKRMEDG

SEQ ID NO: 374767 - protein, 10 aa, Influenza virus
NLDKKMEDGF

SEQ ID NO: 374768 - protein, 10 aa, Influenza virus
VEDGFLDVWT

SEQ ID NO: 374769 - protein, 10 aa, Influenza virus
EDGFRDVWTY

SEQ ID NO: 374770 - protein, 10 aa, Influenza virus
DGFRDVWTYN

SEQ ID NO: 374771 - protein, 10 aa, Influenza virus
GFRDVWTYNA

SEQ ID NO: 374772 - protein, 10 aa, Influenza virus
FLDVWTYNTE

SEQ ID NO: 374773 - protein, 10 aa, Influenza virus
LGVWTYNAEL

SEQ ID NO: 374774 - protein, 10 aa, Influenza virus
VLMENERTLG

SEQ ID NO: 374775 - protein, 10 aa, Influenza virus
LMENERTLGF

SEQ ID NO: 374776 - protein, 10 aa, Influenza virus
MENERILDFH

SEQ ID NO: 374777 - protein, 10 aa, Influenza virus
ENERILDFHD

SEQ ID NO: 374778 - protein, 10 aa, Influenza virus
NERTLGFHDS

SEQ ID NO: 374779 - protein, 10 aa, Influenza virus
ERILDFHDSN

SEQ ID NO: 374780 - protein, 10 aa, Influenza virus
RILDFHDSNV

SEQ ID NO: 374781 - protein, 10 aa, Influenza virus
TLDFHDSSVK

SEQ ID NO: 374782 - protein, 10 aa, Influenza virus
LDFHDSNVRN

SEQ ID NO: 374783 - protein, 10 aa, Influenza virus
DFHDSNVRNL

SEQ ID NO: 374784 - protein, 10 aa, Influenza virus
FHDSNVRNLY

SEQ ID NO: 374785 - protein, 10 aa, Influenza virus
HDSNVKNLYN

SEQ ID NO: 374786 - protein, 10 aa, Influenza virus
VKNLYNKVRM

SEQ ID NO: 374787 - protein, 10 aa, Influenza virus
KNLYNKVRMQ

SEQ ID NO: 374788 - protein, 10 aa, Influenza virus
NLYNKVRMQL

SEQ ID NO: 374789 - protein, 10 aa, Influenza virus
LYEKVRMQLR

SEQ ID NO: 374790 - protein, 10 aa, Influenza virus
YEKVRMQLRD

SEQ ID NO: 374791 - protein, 10 aa, Influenza virus
EKVRMQLRDN

SEQ ID NO: 374792 - protein, 10 aa, Influenza virus
RVRMQLRDNA

SEQ ID NO: 374793 - protein, 10 aa, Influenza virus
MQLRDNAKEL

SEQ ID NO: 374794 - protein, 10 aa, Influenza virus
QLRDNAKELG

SEQ ID NO: 374795 - protein, 10 aa, Influenza virus
LRDNAKELGN

SEQ ID NO: 374796 - protein, 10 aa, Influenza virus
RDNAKELGNG

SEQ ID NO: 374797 - protein, 10 aa, Influenza virus
DNAKELGNGC

SEQ ID NO: 374798 - protein, 10 aa, Influenza virus
NAKELGNGCF

SEQ ID NO: 374799 - protein, 10 aa, Influenza virus
AKELGNGCFE

SEQ ID NO: 374800 - protein, 10 aa, Influenza virus
CFEFYHKCND

SEQ ID NO: 374801 - protein, 10 aa, Influenza virus
FEFYHKCNDE

SEQ ID NO: 374802 - protein, 10 aa, Influenza virus
EFYHKCNDEC

SEQ ID NO: 374803 - protein, 10 aa, Influenza virus
FYHKCNDECM

SEQ ID NO: 374804 - protein, 10 aa, Influenza virus
CMDSVKNGTY

SEQ ID NO: 374805 - protein, 10 aa, Influenza virus
KNGTYYYPKY

SEQ ID NO: 374806 - protein, 10 aa, Influenza virus
NGTYDYSKYE

SEQ ID NO: 374807 - protein, 10 aa, Influenza virus
GTYDYPKYEK

SEQ ID NO: 374808 - protein, 10 aa, Influenza virus
TYNYPKYEEE

SEQ ID NO: 374809 - protein, 10 aa, Influenza virus
YNYPKYEEES

SEQ ID NO: 374810 - protein, 10 aa, Influenza virus
YYPKYEEESK

SEQ ID NO: 374811 - protein, 10 aa, Influenza virus
YSKYEEESKL

SEQ ID NO: 374812 - protein, 10 aa, Influenza virus
PKYEEESRLN

SEQ ID NO: 374813 - protein, 10 aa, Influenza virus
KYEEESRLNR

SEQ ID NO: 374814 - protein, 10 aa, Influenza virus
YEEESRLNRN

SEQ ID NO: 374815 - protein, 10 aa, Influenza virus
EEESRLNRNE

SEQ ID NO: 374816 - protein, 10 aa, Influenza virus
EESRLNRNEI

SEQ ID NO: 374817 - protein, 10 aa, Influenza virus
ESRLNRNEIK

SEQ ID NO: 374818 - protein, 10 aa, Influenza virus
SRLNRNEIKG

SEQ ID NO: 374819 - protein, 10 aa, Influenza virus
RLNRNEIKGV

SEQ ID NO: 374820 - protein, 10 aa, Influenza virus
LKRNEIKGVE

SEQ ID NO: 374821 - protein, 10 aa, Influenza virus
KRNEIKGVEL

SEQ ID NO: 374822 - protein, 10 aa, Influenza virus
RNEIKGIKLS

SEQ ID NO: 374823 - protein, 10 aa, Influenza virus
NEIKGVELSS

SEQ ID NO: 374824 - protein, 10 aa, Influenza virus
EIKGVELSSM

SEQ ID NO: 374825 - protein, 10 aa, Influenza virus
IKGVELSSMG

SEQ ID NO: 374826 - protein, 10 aa, Influenza virus
KGVKLSNMGI

SEQ ID NO: 374827 - protein, 10 aa, Influenza virus
GVKLSNMGIY

SEQ ID NO: 374828 - protein, 10 aa, Influenza virus
VKLSNMGIYQ

SEQ ID NO: 374829 - protein, 10 aa, Influenza virus
KLSNMGIYQI

SEQ ID NO: 374830 - protein, 10 aa, Influenza virus
LSNMGIYQIL

SEQ ID NO: 374831 - protein, 10 aa, Influenza virus
SNMGIYQILA

SEQ ID NO: 374832 - protein, 10 aa, Influenza virus
NMGIYQILAI

SEQ ID NO: 374833 - protein, 10 aa, Influenza virus
MGVYQILVIY

SEQ ID NO: 374834 - protein, 10 aa, Influenza virus
GVYQILVIYA

SEQ ID NO: 374835 - protein, 10 aa, Influenza virus
VYQILVIYAT

SEQ ID NO: 374836 - protein, 10 aa, Influenza virus
AGSLSLAIMV

SEQ ID NO: 374837 - protein, 10 aa, Influenza virus
GSLSLAIMVA

SEQ ID NO: 374838 - protein, 10 aa, Influenza virus
SLSLAIMVAG

SEQ ID NO: 374839 - protein, 10 aa, Influenza virus
LSLAIMVAGI

SEQ ID NO: 374840 - protein, 10 aa, Influenza virus
SLAIMVAGIS

SEQ ID NO: 374841 - protein, 10 aa, Influenza virus
AGIFLWMCSN

SEQ ID NO: 374842 - protein, 10 aa, Influenza virus
GIFLWMCSNG

SEQ ID NO: 374843 - protein, 10 aa, Influenza virus
IFLWMCSNGS

SEQ ID NO: 374844 - protein, 10 aa, Influenza virus
FLWMCSNGSL

SEQ ID NO: 374845 - protein, 10 aa, Influenza virus
NPNQKIITID

SEQ ID NO: 374846 - protein, 10 aa, Influenza virus
PNQKIITMGS

SEQ ID NO: 374847 - protein, 10 aa, Influenza virus
NQKTITIGSV

SEQ ID NO: 374848 - protein, 10 aa, Influenza virus
QKTITIGSVS

SEQ ID NO: 374849 - protein, 10 aa, Influenza virus
KTITIGSVSL

SEQ ID NO: 374850 - protein, 10 aa, Influenza virus
QIAILAATVT

SEQ ID NO: 374851 - protein, 10 aa, Influenza virus
IAILAATVTL

SEQ ID NO: 374852 - protein, 10 aa, Influenza virus
AILATTITLH

SEQ ID NO: 374853 - protein, 10 aa, Influenza virus
ILATTITLHF

SEQ ID NO: 374854 - protein, 10 aa, Influenza virus
LATTITLHFK

SEQ ID NO: 374855 - protein, 10 aa, Influenza virus
AATVTLHFKQ

SEQ ID NO: 374856 - protein, 10 aa, Influenza virus
TTITLHFKQN

SEQ ID NO: 374857 - protein, 10 aa, Influenza virus
TVTLHFKQHK

SEQ ID NO: 374858 - protein, 10 aa, Influenza virus
VTLHFKQHKC

SEQ ID NO: 374859 - protein, 10 aa, Influenza virus
TLHFKQHECN

SEQ ID NO: 374860 - protein, 10 aa, Influenza virus
PCEPIIIEKN

SEQ ID NO: 374861 - protein, 10 aa, Influenza virus
WSKPQCQIAG

SEQ ID NO: 374862 - protein, 10 aa, Influenza virus
SKPQCHITGF

SEQ ID NO: 374863 - protein, 10 aa, Influenza virus
KPQCQIAGFA

SEQ ID NO: 374864 - protein, 10 aa, Influenza virus
PQCQIAGFAP

SEQ ID NO: 374865 - protein, 10 aa, Influenza virus
QCQIAGFAPF

SEQ ID NO: 374866 - protein, 10 aa, Influenza virus
CQIAGFAPFS

SEQ ID NO: 374867 - protein, 10 aa, Influenza virus
QIAGFAPFSK

SEQ ID NO: 374868 - protein, 10 aa, Influenza virus
KDNSIRLSAD

SEQ ID NO: 374869 - protein, 10 aa, Influenza virus
DNPIRLSGGG

SEQ ID NO: 374870 - protein, 10 aa, Influenza virus
NSIRLSADGD

SEQ ID NO: 374871 - protein, 10 aa, Influenza virus
PIRLSGGGDI

SEQ ID NO: 374872 - protein, 10 aa, Influenza virus
IRLSGGGDIW

SEQ ID NO: 374873 - protein, 10 aa, Influenza virus
RLSADGDIWV

SEQ ID NO: 374874 - protein, 10 aa, Influenza virus
LSADGDIWVT

SEQ ID NO: 374875 - protein, 10 aa, Influenza virus
SASGDIWVTR

SEQ ID NO: 374876 - protein, 10 aa, Influenza virus
ASGDIWVTRE

SEQ ID NO: 374877 - protein, 10 aa, Influenza virus
GGDIWVMREP

SEQ ID NO: 374878 - protein, 10 aa, Influenza virus
VTREPYVSCS

SEQ ID NO: 374879 - protein, 10 aa, Influenza virus
TREPYVSCSP

SEQ ID NO: 374880 - protein, 10 aa, Influenza virus
VKCYQFALGQ

SEQ ID NO: 374881 - protein, 10 aa, Influenza virus
FALGQGTTLN

SEQ ID NO: 374882 - protein, 10 aa, Influenza virus
ALGQGTTLEN

SEQ ID NO: 374883 - protein, 10 aa, Influenza virus
LGQGTTLENK

SEQ ID NO: 374884 - protein, 10 aa, Influenza virus
GQGTTLNNKH

SEQ ID NO: 374885 - protein, 10 aa, Influenza virus
QGTTLENKHS

SEQ ID NO: 374886 - protein, 10 aa, Influenza virus
GTTLENKHSN

SEQ ID NO: 374887 - protein, 10 aa, Influenza virus
TTLENKHSNG

SEQ ID NO: 374888 - protein, 10 aa, Influenza virus
TLNNKHSNGT

SEQ ID NO: 374889 - protein, 10 aa, Influenza virus
LDNKHSNDTV

SEQ ID NO: 374890 - protein, 10 aa, Influenza virus
DNKHSNDTVH

SEQ ID NO: 374891 - protein, 10 aa, Influenza virus
NKHSNDTVHD

SEQ ID NO: 374892 - protein, 10 aa, Influenza virus
KHSNDTVHDR

SEQ ID NO: 374893 - protein, 10 aa, Influenza virus
TIHDRTPHRT

SEQ ID NO: 374894 - protein, 10 aa, Influenza virus
IHDRTPHRTL

SEQ ID NO: 374895 - protein, 10 aa, Influenza virus
HDRSPHRTLL

SEQ ID NO: 374896 - protein, 10 aa, Influenza virus
DRSPHRTLLM

SEQ ID NO: 374897 - protein, 10 aa, Influenza virus
RSPHRTLLMN

SEQ ID NO: 374898 - protein, 10 aa, Influenza virus
SPHRTLLMNE

SEQ ID NO: 374899 - protein, 10 aa, Influenza virus
LGVSFHLGTK

SEQ ID NO: 374900 - protein, 10 aa, Influenza virus
GVSFHLGTKQ

SEQ ID NO: 374901 - protein, 10 aa, Influenza virus
VSFHLGTKQV

SEQ ID NO: 374902 - protein, 10 aa, Influenza virus
SFHLGTKQVC

SEQ ID NO: 374903 - protein, 10 aa, Influenza virus
FHLGTKQVCI

SEQ ID NO: 374904 - protein, 10 aa, Influenza virus
HLGTKQVCIA

SEQ ID NO: 374905 - protein, 10 aa, Influenza virus
LGTKQVCIAW

SEQ ID NO: 374906 - protein, 10 aa, Influenza virus
GTKQVCIAWS

SEQ ID NO: 374907 - protein, 10 aa, Influenza virus
TKQVCIAWSS

SEQ ID NO: 374908 - protein, 10 aa, Influenza virus
KQVCIAWSSS

SEQ ID NO: 374909 - protein, 10 aa, Influenza virus
QVCAAWSSSS

SEQ ID NO: 374910 - protein, 10 aa, Influenza virus
VCAAWSSSSC

SEQ ID NO: 374911 - protein, 10 aa, Influenza virus
CAAWSSSSCH

SEQ ID NO: 374912 - protein, 10 aa, Influenza virus
AAWSSSSCHD

SEQ ID NO: 374913 - protein, 10 aa, Influenza virus
CHDGKAWLHI

SEQ ID NO: 374914 - protein, 10 aa, Influenza virus
HDGKAWLHIC

SEQ ID NO: 374915 - protein, 10 aa, Influenza virus
DGRAWLHVCV

SEQ ID NO: 374916 - protein, 10 aa, Influenza virus
GRAWLHVCVT

SEQ ID NO: 374917 - protein, 10 aa, Influenza virus
RAWLHVCVTG

SEQ ID NO: 374918 - protein, 10 aa, Influenza virus
AWLHICVTGD

SEQ ID NO: 374919 - protein, 10 aa, Influenza virus
WLHICVTGDD

SEQ ID NO: 374920 - protein, 10 aa, Influenza virus
CITGDDKNAT

SEQ ID NO: 374921 - protein, 10 aa, Influenza virus
ITGDDKNATA

SEQ ID NO: 374922 - protein, 10 aa, Influenza virus
TGYEKNATAS

SEQ ID NO: 374923 - protein, 10 aa, Influenza virus
GDDRNATASL

SEQ ID NO: 374924 - protein, 10 aa, Influenza virus
DDRNATASLI

SEQ ID NO: 374925 - protein, 10 aa, Influenza virus
DRNATASLIY

SEQ ID NO: 374926 - protein, 10 aa, Influenza virus
NATASLIYDG

SEQ ID NO: 374927 - protein, 10 aa, Influenza virus
DSIGSWSHNI

SEQ ID NO: 374928 - protein, 10 aa, Influenza virus
SISSWSQNIL

SEQ ID NO: 374929 - protein, 10 aa, Influenza virus
VGSWSQNILR

SEQ ID NO: 374930 - protein, 10 aa, Influenza virus
SSWSQNILRT

SEQ ID NO: 374931 - protein, 10 aa, Influenza virus
THESECVCIN

SEQ ID NO: 374932 - protein, 10 aa, Influenza virus
QESECICINR

SEQ ID NO: 374933 - protein, 10 aa, Influenza virus
ESECVCINGI

SEQ ID NO: 374934 - protein, 10 aa, Influenza virus
SECVCINGIC

SEQ ID NO: 374935 - protein, 10 aa, Influenza virus
ECVCINGICT

SEQ ID NO: 374936 - protein, 10 aa, Influenza virus
CVCINGICTV

SEQ ID NO: 374937 - protein, 10 aa, Influenza virus
VCINGICTVV

SEQ ID NO: 374938 - protein, 10 aa, Influenza virus
CINGICTVVM

SEQ ID NO: 374939 - protein, 10 aa, Influenza virus
INGICTVVMT

SEQ ID NO: 374940 - protein, 10 aa, Influenza virus
NGICTVVMTD

SEQ ID NO: 374941 - protein, 10 aa, Influenza virus
GICTVVMTDG

SEQ ID NO: 374942 - protein, 10 aa, Influenza virus
ICTVVMTDGS

SEQ ID NO: 374943 - protein, 10 aa, Influenza virus
GSASGRADTK

SEQ ID NO: 374944 - protein, 10 aa, Influenza virus
SASGRADTKI

SEQ ID NO: 374945 - protein, 10 aa, Influenza virus
ASGRADTKIL

SEQ ID NO: 374946 - protein, 10 aa, Influenza virus
SGRADTKILF

SEQ ID NO: 374947 - protein, 10 aa, Influenza virus
GKADTRILFV

SEQ ID NO: 374948 - protein, 10 aa, Influenza virus
ADTRILFVKE

SEQ ID NO: 374949 - protein, 10 aa, Influenza virus
DTRILFVKEG

SEQ ID NO: 374950 - protein, 10 aa, Influenza virus
TRILFVKEGK

SEQ ID NO: 374951 - protein, 10 aa, Influenza virus
EGKIVHIGPL

SEQ ID NO: 374952 - protein, 10 aa, Influenza virus
VHIGPLSGSA

SEQ ID NO: 374953 - protein, 10 aa, Influenza virus
HVSPLSGSAQ

SEQ ID NO: 374954 - protein, 10 aa, Influenza virus
VSPLSGSAQH

SEQ ID NO: 374955 - protein, 10 aa, Influenza virus
GPLSGSAQHI

SEQ ID NO: 374956 - protein, 10 aa, Influenza virus
PLAGSAQHVE

SEQ ID NO: 374957 - protein, 10 aa, Influenza virus
LAGSAQHVEE

SEQ ID NO: 374958 - protein, 10 aa, Influenza virus
AGSAQHVEEC

SEQ ID NO: 374959 - protein, 10 aa, Influenza virus
HIEECSCYSR

SEQ ID NO: 374960 - protein, 10 aa, Influenza virus
IEECSCYPQY

SEQ ID NO: 374961 - protein, 10 aa, Influenza virus
ECSCYPRYPN

SEQ ID NO: 374962 - protein, 10 aa, Influenza virus
CSCYPRYPNV

SEQ ID NO: 374963 - protein, 10 aa, Influenza virus
SCYPRYPNVR

SEQ ID NO: 374964 - protein, 10 aa, Influenza virus
CYPRYPNVRC

SEQ ID NO: 374965 - protein, 10 aa, Influenza virus
YPNVRCVCRD

SEQ ID NO: 374966 - protein, 10 aa, Influenza virus
PNVRCVCRDN

SEQ ID NO: 374967 - protein, 10 aa, Influenza virus
NVRCVCRDNW

SEQ ID NO: 374968 - protein, 10 aa, Influenza virus
VRCVCRDNWR

SEQ ID NO: 374969 - protein, 10 aa, Influenza virus
RCVCRDNWRG

SEQ ID NO: 374970 - protein, 10 aa, Influenza virus
CVCRDNWRGS

SEQ ID NO: 374971 - protein, 10 aa, Influenza virus
VCRDNWRGSN

SEQ ID NO: 374972 - protein, 10 aa, Influenza virus
DNWRGSNRPV

SEQ ID NO: 374973 - protein, 10 aa, Influenza virus
GSNRPIIDIN

SEQ ID NO: 374974 - protein, 10 aa, Influenza virus
DISMEDYSID

SEQ ID NO: 374975 - protein, 10 aa, Influenza virus
ISMEDYSIDS

SEQ ID NO: 374976 - protein, 10 aa, Influenza virus
DYSIDSSYIC

SEQ ID NO: 374977 - protein, 10 aa, Influenza virus
YSIDSNYVCS

SEQ ID NO: 374978 - protein, 10 aa, Influenza virus
SIDSGYVCSG

SEQ ID NO: 374979 - protein, 10 aa, Influenza virus
IDSGYVCSGL

SEQ ID NO: 374980 - protein, 10 aa, Influenza virus
DSGYVCSGLV

SEQ ID NO: 374981 - protein, 10 aa, Influenza virus
SGYVCSGLVG

SEQ ID NO: 374982 - protein, 10 aa, Influenza virus
GYVCSGLVGD

SEQ ID NO: 374983 - protein, 10 aa, Influenza virus
GLVGDTPRSD

SEQ ID NO: 374984 - protein, 10 aa, Influenza virus
LVGDTPRNND

SEQ ID NO: 374985 - protein, 10 aa, Influenza virus
VGDTPRNGDS

SEQ ID NO: 374986 - protein, 10 aa, Influenza virus
GDTPRNDDRF

SEQ ID NO: 374987 - protein, 10 aa, Influenza virus
DTPRNDDRFS

SEQ ID NO: 374988 - protein, 10 aa, Influenza virus
SSSNCRDPNN

SEQ ID NO: 374989 - protein, 10 aa, Influenza virus
SSNCRDPNNE

SEQ ID NO: 374990 - protein, 10 aa, Influenza virus
SNCRNPNNEK

SEQ ID NO: 374991 - protein, 10 aa, Influenza virus
NCRNPNNEKG

SEQ ID NO: 374992 - protein, 10 aa, Influenza virus
PNNEKGNQGV

SEQ ID NO: 374993 - protein, 10 aa, Influenza virus
NNEKGNQGVK

SEQ ID NO: 374994 - protein, 10 aa, Influenza virus
NEKGNQGVKG

SEQ ID NO: 374995 - protein, 10 aa, Influenza virus
EKGNQGVKGW

SEQ ID NO: 374996 - protein, 10 aa, Influenza virus
KGNQGVKGWA

SEQ ID NO: 374997 - protein, 10 aa, Influenza virus
GTQGVKGWAF

SEQ ID NO: 374998 - protein, 10 aa, Influenza virus
TQGVKGWAFD

SEQ ID NO: 374999 - protein, 10 aa, Influenza virus
PGVKGWAFDS

SEQ ID NO: 375000 - protein, 10 aa, Influenza virus
GVKGWAFDDG

SEQ ID NO: 375001 - protein, 10 aa, Influenza virus
GSDVWMGRTI

SEQ ID NO: 375002 - protein, 10 aa, Influenza virus
RDSRSGYETF

SEQ ID NO: 375003 - protein, 10 aa, Influenza virus
DSRSGYETFR

SEQ ID NO: 375004 - protein, 10 aa, Influenza virus
SRSGYETFRV

SEQ ID NO: 375005 - protein, 10 aa, Influenza virus
RSGYETFRVT

SEQ ID NO: 375006 - protein, 10 aa, Influenza virus
SGYETFRVTG

SEQ ID NO: 375007 - protein, 10 aa, Influenza virus
ETFRVIGGWA

SEQ ID NO: 375008 - protein, 10 aa, Influenza virus
TFRVIGGWAT

SEQ ID NO: 375009 - protein, 10 aa, Influenza virus
SNNWSGYSGI

SEQ ID NO: 375010 - protein, 10 aa, Influenza virus
NNRSGYSGIF

SEQ ID NO: 375011 - protein, 10 aa, Influenza virus
GYSGIFSVEN

SEQ ID NO: 375012 - protein, 10 aa, Influenza virus
YSGIFSVEHK

SEQ ID NO: 375013 - protein, 10 aa, Influenza virus
KRCINRCFYV

SEQ ID NO: 375014 - protein, 10 aa, Influenza virus
RCINRCFYVE

SEQ ID NO: 375015 - protein, 10 aa, Influenza virus
FYVELIRGRQ

SEQ ID NO: 375016 - protein, 10 aa, Influenza virus
YVELIRGRQQ

SEQ ID NO: 375017 - protein, 10 aa, Influenza virus
VELIRGRQQE

SEQ ID NO: 375018 - protein, 10 aa, Influenza virus
QQETRVWWTS

SEQ ID NO: 375019 - protein, 10 aa, Influenza virus
WTSSSIVVFC

SEQ ID NO: 375020 - protein, 10 aa, Influenza virus
TSSSIVVFCG

SEQ ID NO: 375021 - protein, 10 aa, Influenza virus
SNSIVVFVAP

SEQ ID NO: 375022 - protein, 10 aa, Influenza virus
SSIVVFCGTS

SEQ ID NO: 375023 - protein, 10 aa, Influenza virus
KGSWPDGANI

SEQ ID NO: 375024 - protein, 10 aa, Influenza virus
GSWPDGANID

SEQ ID NO: 375025 - protein, 10 aa, Influenza virus
SWPDGADINF

SEQ ID NO: 375026 - protein, 10 aa, Influenza virus
WPDGADINFM

SEQ ID NO: 375027 - protein, 10 aa, Influenza virus
PDGADINFMP

SEQ ID NO: 375028 - protein, 10 aa, Influenza virus
DGADINFMPI

SEQ ID NO: 375029 - protein, 10 aa, Influenza virus
IFIFLLLTHW

SEQ ID NO: 375030 - protein, 10 aa, Influenza virus
FIFLLLTHWA

SEQ ID NO: 375031 - protein, 10 aa, Influenza virus
AATLCLGHHA

SEQ ID NO: 375032 - protein, 10 aa, Influenza virus
TLCLGHHAVQ

SEQ ID NO: 375033 - protein, 10 aa, Influenza virus
LCLGHHAVQN

SEQ ID NO: 375034 - protein, 10 aa, Influenza virus
CLGHHAVQNG

SEQ ID NO: 375035 - protein, 10 aa, Influenza virus
LGHHAVQNGT

SEQ ID NO: 375036 - protein, 10 aa, Influenza virus
DQVEVTNATE

SEQ ID NO: 375037 - protein, 10 aa, Influenza virus
QVEVTNATEL

SEQ ID NO: 375038 - protein, 10 aa, Influenza virus
VTNATELVQI

SEQ ID NO: 375039 - protein, 10 aa, Influenza virus
CTLIDAMLGD

SEQ ID NO: 375040 - protein, 10 aa, Influenza virus
TLIDAMLGDP

SEQ ID NO: 375041 - protein, 10 aa, Influenza virus
DAMLGDPHCD

SEQ ID NO: 375042 - protein, 10 aa, Influenza virus
SLRSIVASSG

SEQ ID NO: 375043 - protein, 10 aa, Influenza virus
LRSIVASSGT

SEQ ID NO: 375044 - protein, 10 aa, Influenza virus
RSIVASSGTL

SEQ ID NO: 375045 - protein, 10 aa, Influenza virus
SIVASSGTLE

SEQ ID NO: 375046 - protein, 10 aa, Influenza virus
FDKLYIWGIH

SEQ ID NO: 375047 - protein, 10 aa, Influenza virus
DKLYIWGIHH

SEQ ID NO: 375048 - protein, 10 aa, Influenza virus
KLYIWGIHHP

SEQ ID NO: 375049 - protein, 10 aa, Influenza virus
SNGNLVAPRG

SEQ ID NO: 375050 - protein, 10 aa, Influenza virus
NGNLVAPRGY

SEQ ID NO: 375051 - protein, 10 aa, Influenza virus
NLIAPRGYFR

SEQ ID NO: 375052 - protein, 10 aa, Influenza virus
SGCITPNGSI

SEQ ID NO: 375053 - protein, 10 aa, Influenza virus
ACITPNGSIP

SEQ ID NO: 375054 - protein, 10 aa, Influenza virus
ITPNGSIPNE

SEQ ID NO: 375055 - protein, 10 aa, Influenza virus
GSIPNEKPFQ

SEQ ID NO: 375056 - protein, 10 aa, Influenza virus
KPFQNVNKVT

SEQ ID NO: 375057 - protein, 10 aa, Influenza virus
PFQNVNKVTY

SEQ ID NO: 375058 - protein, 10 aa, Influenza virus
FQNVNKVTYG

SEQ ID NO: 375059 - protein, 10 aa, Influenza virus
ATGMRNIPEK

SEQ ID NO: 375060 - protein, 10 aa, Influenza virus
KGLFGAIAGF

SEQ ID NO: 375061 - protein, 10 aa, Influenza virus
FIENGWEGMM

SEQ ID NO: 375062 - protein, 10 aa, Influenza virus
IENGWEGMMD

SEQ ID NO: 375063 - protein, 10 aa, Influenza virus
ENGWEGMMDG

SEQ ID NO: 375064 - protein, 10 aa, Influenza virus
NGWEGMMDGW

SEQ ID NO: 375065 - protein, 10 aa, Influenza virus
GWEGMMDGWY

SEQ ID NO: 375066 - protein, 10 aa, Influenza virus
WEGMMDGWYG

SEQ ID NO: 375067 - protein, 10 aa, Influenza virus
EGMMDGWYGF

SEQ ID NO: 375068 - protein, 10 aa, Influenza virus
GMMDGWYGFR

SEQ ID NO: 375069 - protein, 10 aa, Influenza virus
MMDGWYGFRH

SEQ ID NO: 375070 - protein, 10 aa, Influenza virus
NGWYGFRHQN

SEQ ID NO: 375071 - protein, 10 aa, Influenza virus
GWYGFRHHNS

SEQ ID NO: 375072 - protein, 10 aa, Influenza virus
WYGFRHLNSE

SEQ ID NO: 375073 - protein, 10 aa, Influenza virus
YGFRHHNSEG

SEQ ID NO: 375074 - protein, 10 aa, Influenza virus
NSEGRGQAAD

SEQ ID NO: 375075 - protein, 10 aa, Influenza virus
SEGRGQAADL

SEQ ID NO: 375076 - protein, 10 aa, Influenza virus
EGRGQAADLK

SEQ ID NO: 375077 - protein, 10 aa, Influenza virus
GRGQAADLKS

SEQ ID NO: 375078 - protein, 10 aa, Influenza virus
RGQAADLKST

SEQ ID NO: 375079 - protein, 10 aa, Influenza virus
ADFKSTQAAI

SEQ ID NO: 375080 - protein, 10 aa, Influenza virus
DLKSTQTAID

SEQ ID NO: 375081 - protein, 10 aa, Influenza virus
LKSTQTAIDQ

SEQ ID NO: 375082 - protein, 10 aa, Influenza virus
KSTQTAIDQI

SEQ ID NO: 375083 - protein, 10 aa, Influenza virus
IERTNEKFHQ

SEQ ID NO: 375084 - protein, 10 aa, Influenza virus
ERTNEKFHQI

SEQ ID NO: 375085 - protein, 10 aa, Influenza virus
KEFTEVEGRI

SEQ ID NO: 375086 - protein, 10 aa, Influenza virus
EFTEVEGRIQ

SEQ ID NO: 375087 - protein, 10 aa, Influenza virus
FTEVEGRIQD

SEQ ID NO: 375088 - protein, 10 aa, Influenza virus
TEVEGRIQDL

SEQ ID NO: 375089 - protein, 10 aa, Influenza virus
VEGRIQDLER

SEQ ID NO: 375090 - protein, 10 aa, Influenza virus
GRIQDLEKYI

SEQ ID NO: 375091 - protein, 10 aa, Influenza virus
RIQDLEKYIE

SEQ ID NO: 375092 - protein, 10 aa, Influenza virus
LERYVEDTKI

SEQ ID NO: 375093 - protein, 10 aa, Influenza virus
ERYVEDTKID

SEQ ID NO: 375094 - protein, 10 aa, Influenza virus
RYVEDTKIDL

SEQ ID NO: 375095 - protein, 10 aa, Influenza virus
KIDLWSYNAG

SEQ ID NO: 375096 - protein, 10 aa, Influenza virus
IDLWSYNAGL

SEQ ID NO: 375097 - protein, 10 aa, Influenza virus
LWSYNADVLV

SEQ ID NO: 375098 - protein, 10 aa, Influenza virus
WSYNADVLVA

SEQ ID NO: 375099 - protein, 10 aa, Influenza virus
SYNADVLVAL

SEQ ID NO: 375100 - protein, 10 aa, Influenza virus
YNADVLVALE

SEQ ID NO: 375101 - protein, 10 aa, Influenza virus
NADVLVALEN

SEQ ID NO: 375102 - protein, 10 aa, Influenza virus
ADVLVALENQ

SEQ ID NO: 375103 - protein, 10 aa, Influenza virus
DVLVALENQH

SEQ ID NO: 375104 - protein, 10 aa, Influenza virus
LLVALENQNT

SEQ ID NO: 375105 - protein, 10 aa, Influenza virus
VALENQNTID

SEQ ID NO: 375106 - protein, 10 aa, Influenza virus
ALENQNTIDL

SEQ ID NO: 375107 - protein, 10 aa, Influenza virus
LENQNTIDLT

SEQ ID NO: 375108 - protein, 10 aa, Influenza virus
ENQHTIDLAD

SEQ ID NO: 375109 - protein, 10 aa, Influenza virus
NQHTIHLTDS

SEQ ID NO: 375110 - protein, 10 aa, Influenza virus
QHTIHLTDSE

SEQ ID NO: 375111 - protein, 10 aa, Influenza virus
HTIHLTDSEM

SEQ ID NO: 375112 - protein, 10 aa, Influenza virus
TIDLTDSEMS

SEQ ID NO: 375113 - protein, 10 aa, Influenza virus
LTDSEMSKLF

SEQ ID NO: 375114 - protein, 10 aa, Influenza virus
TDSEMSKLFE

SEQ ID NO: 375115 - protein, 10 aa, Influenza virus
TRKQLRENAE

SEQ ID NO: 375116 - protein, 10 aa, Influenza virus
RKQLRENAED

SEQ ID NO: 375117 - protein, 10 aa, Influenza virus
KQLRENAEDL

SEQ ID NO: 375118 - protein, 10 aa, Influenza virus
QLRENAEDLG

SEQ ID NO: 375119 - protein, 10 aa, Influenza virus
LRENAEDMGD

SEQ ID NO: 375120 - protein, 10 aa, Influenza virus
RENAEDMGDG

SEQ ID NO: 375121 - protein, 10 aa, Influenza virus
ENAEDMGDGC

SEQ ID NO: 375122 - protein, 10 aa, Influenza virus
NAEDMGNGCL

SEQ ID NO: 375123 - protein, 10 aa, Influenza virus
GCLKIYHKCD

SEQ ID NO: 375124 - protein, 10 aa, Influenza virus
CLKIYHKCDN

SEQ ID NO: 375125 - protein, 10 aa, Influenza virus
EYKDWILWIS

SEQ ID NO: 375126 - protein, 10 aa, Influenza virus
YKNWILWISF

SEQ ID NO: 375127 - protein, 10 aa, Influenza virus
KNWILWISFA

SEQ ID NO: 375128 - protein, 10 aa, Influenza virus
DWILWISFAT

SEQ ID NO: 375129 - protein, 10 aa, Influenza virus
WILWISFATS

SEQ ID NO: 375130 - protein, 10 aa, Influenza virus
ILWISFATSC

SEQ ID NO: 375131 - protein, 10 aa, Influenza virus
LWISFAMSCF

SEQ ID NO: 375132 - protein, 10 aa, Influenza virus
WISFAMSCFL

SEQ ID NO: 375133 - protein, 10 aa, Influenza virus
GFIVWACQRG

SEQ ID NO: 375134 - protein, 10 aa, Influenza virus
FIVWACQRGN

SEQ ID NO: 375135 - protein, 10 aa, Influenza virus
IVWACQRGNI

SEQ ID NO: 375136 - protein, 10 aa, Influenza virus
MWACQKGNIK

SEQ ID NO: 375137 - protein, 10 aa, Influenza virus
WACQKGNIKC

SEQ ID NO: 375138 - protein, 10 aa, Influenza virus
ACQKGNIKCN

SEQ ID NO: 375139 - protein, 10 aa, Influenza virus
CQKGNIKCNI

SEQ ID NO: 375140 - protein, 10 aa, Influenza virus
QKGNIKCNIC

SEQ ID NO: 375141 - protein, 10 aa, Influenza virus
KGNIKCNICI

SEQ ID NO: 375142 - protein, 10 aa, Influenza virus
AATLCLGHHA

SEQ ID NO: 375143 - protein, 10 aa, Influenza virus
GHHAVPNGTV

SEQ ID NO: 375144 - protein, 10 aa, Influenza virus
HHAVPNGTVV

SEQ ID NO: 375145 - protein, 10 aa, Influenza virus
HAVPNGTVVK

SEQ ID NO: 375146 - protein, 10 aa, Influenza virus
AVPNGTVVKT

SEQ ID NO: 375147 - protein, 10 aa, Influenza virus
VPNGTVVKTI

SEQ ID NO: 375148 - protein, 10 aa, Influenza virus
PNGTVVKTIT

SEQ ID NO: 375149 - protein, 10 aa, Influenza virus
DQVEVTNATE

SEQ ID NO: 375150 - protein, 10 aa, Influenza virus
QVEVTNATEL

SEQ ID NO: 375151 - protein, 10 aa, Influenza virus
VTNATELVQI

SEQ ID NO: 375152 - protein, 10 aa, Influenza virus
CTLVDALLGD

SEQ ID NO: 375153 - protein, 10 aa, Influenza virus
TLVDALLGDP

SEQ ID NO: 375154 - protein, 10 aa, Influenza virus
LMDALLGDPH

SEQ ID NO: 375155 - protein, 10 aa, Influenza virus
MDALLGDPHC

SEQ ID NO: 375156 - protein, 10 aa, Influenza virus
SLRSIVASSG

SEQ ID NO: 375157 - protein, 10 aa, Influenza virus
LRSIVASSGT

SEQ ID NO: 375158 - protein, 10 aa, Influenza virus
RSIVASSGTL

SEQ ID NO: 375159 - protein, 10 aa, Influenza virus
SIVASSGTLE

SEQ ID NO: 375160 - protein, 10 aa, Influenza virus
IVASSGTLEF

SEQ ID NO: 375161 - protein, 10 aa, Influenza virus
SDKLYIWGVH

SEQ ID NO: 375162 - protein, 10 aa, Influenza virus
DKLYIWGIHH

SEQ ID NO: 375163 - protein, 10 aa, Influenza virus
KLYIWGIHHP

SEQ ID NO: 375164 - protein, 10 aa, Influenza virus
SIHWTIVKPG

SEQ ID NO: 375165 - protein, 10 aa, Influenza virus
IHWTIVKPGD

SEQ ID NO: 375166 - protein, 10 aa, Influenza virus
CTGNLIAPRG

SEQ ID NO: 375167 - protein, 10 aa, Influenza virus
NLIAPRGYYK

SEQ ID NO: 375168 - protein, 10 aa, Influenza virus
LIAPRGYFKV

SEQ ID NO: 375169 - protein, 10 aa, Influenza virus
SGCITPNGSI

SEQ ID NO: 375170 - protein, 10 aa, Influenza virus
ECITPNGSIS

SEQ ID NO: 375171 - protein, 10 aa, Influenza virus
ITPNGSISND

SEQ ID NO: 375172 - protein, 10 aa, Influenza virus
TPNGSISNDK

SEQ ID NO: 375173 - protein, 10 aa, Influenza virus
PNGSISNDKP

SEQ ID NO: 375174 - protein, 10 aa, Influenza virus
NGSISNDKPF

SEQ ID NO: 375175 - protein, 10 aa, Influenza virus
GSISNDKPFQ

SEQ ID NO: 375176 - protein, 10 aa, Influenza virus
SISNDKPFQN

SEQ ID NO: 375177 - protein, 10 aa, Influenza virus
SNDKPFQNVN

SEQ ID NO: 375178 - protein, 10 aa, Influenza virus
NEKPFQNVNK

SEQ ID NO: 375179 - protein, 10 aa, Influenza virus
QNVNRITYGP

SEQ ID NO: 375180 - protein, 10 aa, Influenza virus
NVNRITYGPC

SEQ ID NO: 375181 - protein, 10 aa, Influenza virus
VNRITYGPCP

SEQ ID NO: 375182 - protein, 10 aa, Influenza virus
YIKQNTLKLA

SEQ ID NO: 375183 - protein, 10 aa, Influenza virus
IKQNTLKLAT

SEQ ID NO: 375184 - protein, 10 aa, Influenza virus
KQKTLKLATG

SEQ ID NO: 375185 - protein, 10 aa, Influenza virus
QKTLKLATGM

SEQ ID NO: 375186 - protein, 10 aa, Influenza virus
KTLKLATGMR

SEQ ID NO: 375187 - protein, 10 aa, Influenza virus
ATGMRNVPET

SEQ ID NO: 375188 - protein, 10 aa, Influenza virus
TGMRNVPERQ

SEQ ID NO: 375189 - protein, 10 aa, Influenza virus
GMRNVPERQT

SEQ ID NO: 375190 - protein, 10 aa, Influenza virus
MRNVPERQTR

SEQ ID NO: 375191 - protein, 10 aa, Influenza virus
RNVPERQTRG

SEQ ID NO: 375192 - protein, 10 aa, Influenza virus
PETQTRGIFG

SEQ ID NO: 375193 - protein, 10 aa, Influenza virus
ETQTRGIFGA

SEQ ID NO: 375194 - protein, 10 aa, Influenza virus
TQTRGIFGAI

SEQ ID NO: 375195 - protein, 10 aa, Influenza virus
FIENGWEGMI

SEQ ID NO: 375196 - protein, 10 aa, Influenza virus
IENGWEGMID

SEQ ID NO: 375197 - protein, 10 aa, Influenza virus
ENGWEGMIDG

SEQ ID NO: 375198 - protein, 10 aa, Influenza virus
NGWEGMIDGW

SEQ ID NO: 375199 - protein, 10 aa, Influenza virus
GWEGMIDGWY

SEQ ID NO: 375200 - protein, 10 aa, Influenza virus
WEGMIDGWYG

SEQ ID NO: 375201 - protein, 10 aa, Influenza virus
EGMIDGWYGF

SEQ ID NO: 375202 - protein, 10 aa, Influenza virus
GMIDGWYGFR

SEQ ID NO: 375203 - protein, 10 aa, Influenza virus
MIDGWYGFRH

SEQ ID NO: 375204 - protein, 10 aa, Influenza virus
IDGWYGFRHQ

SEQ ID NO: 375205 - protein, 10 aa, Influenza virus
DGWYGFRHHN

SEQ ID NO: 375206 - protein, 10 aa, Influenza virus
GWYGFRHLNS

SEQ ID NO: 375207 - protein, 10 aa, Influenza virus
WYGFRHLNSE

SEQ ID NO: 375208 - protein, 10 aa, Influenza virus
YGFRHLNSEG

SEQ ID NO: 375209 - protein, 10 aa, Influenza virus
RHQNSEGRGQ

SEQ ID NO: 375210 - protein, 10 aa, Influenza virus
NSEGRGQAAD

SEQ ID NO: 375211 - protein, 10 aa, Influenza virus
SEGRGQAADL

SEQ ID NO: 375212 - protein, 10 aa, Influenza virus
EGRGQAADLK

SEQ ID NO: 375213 - protein, 10 aa, Influenza virus
GRGQAADLKS

SEQ ID NO: 375214 - protein, 10 aa, Influenza virus
RGQAADLKST

SEQ ID NO: 375215 - protein, 10 aa, Influenza virus
DLKSTQAAVN

SEQ ID NO: 375216 - protein, 10 aa, Influenza virus
LKSTQAAVNQ

SEQ ID NO: 375217 - protein, 10 aa, Influenza virus
KSTQAAIDQV

SEQ ID NO: 375218 - protein, 10 aa, Influenza virus
IKKTNEKFHQ

SEQ ID NO: 375219 - protein, 10 aa, Influenza virus
KKTNEKFHQI

SEQ ID NO: 375220 - protein, 10 aa, Influenza virus
RIQDLEKYIE

SEQ ID NO: 375221 - protein, 10 aa, Influenza virus
DLEKYIEDTK

SEQ ID NO: 375222 - protein, 10 aa, Influenza virus
LERYVEDTKI

SEQ ID NO: 375223 - protein, 10 aa, Influenza virus
ERYVEDTKID

SEQ ID NO: 375224 - protein, 10 aa, Influenza virus
RYVEDTKIDL

SEQ ID NO: 375225 - protein, 10 aa, Influenza virus
KVDLWSYNAE

SEQ ID NO: 375226 - protein, 10 aa, Influenza virus
VDLWSYNAEL

SEQ ID NO: 375227 - protein, 10 aa, Influenza virus
LWSYNAELLI

SEQ ID NO: 375228 - protein, 10 aa, Influenza virus
WSYNAELLIA

SEQ ID NO: 375229 - protein, 10 aa, Influenza virus
SYNAEFLVAL

SEQ ID NO: 375230 - protein, 10 aa, Influenza virus
YNAEFLVALE

SEQ ID NO: 375231 - protein, 10 aa, Influenza virus
NAEFLVALEN

SEQ ID NO: 375232 - protein, 10 aa, Influenza virus
AEFLVALENQ

SEQ ID NO: 375233 - protein, 10 aa, Influenza virus
FLVALENQHT

SEQ ID NO: 375234 - protein, 10 aa, Influenza virus
VALENQNTID

SEQ ID NO: 375235 - protein, 10 aa, Influenza virus
AMENQHTIDL

SEQ ID NO: 375236 - protein, 10 aa, Influenza virus
LENQNTIDLT

SEQ ID NO: 375237 - protein, 10 aa, Influenza virus
NQNTIDLTDS

SEQ ID NO: 375238 - protein, 10 aa, Influenza virus
QNTIDLTDSE

SEQ ID NO: 375239 - protein, 10 aa, Influenza virus
NTIDLTDSEM

SEQ ID NO: 375240 - protein, 10 aa, Influenza virus
TIHLTDSEMN

SEQ ID NO: 375241 - protein, 10 aa, Influenza virus
IHLTDSEMNK

SEQ ID NO: 375242 - protein, 10 aa, Influenza virus
HLTDSEMNKL

SEQ ID NO: 375243 - protein, 10 aa, Influenza virus
MTDSEMNKLF

SEQ ID NO: 375244 - protein, 10 aa, Influenza virus
TDSEMNKLFD

SEQ ID NO: 375245 - protein, 10 aa, Influenza virus
DSEMSKLFER

SEQ ID NO: 375246 - protein, 10 aa, Influenza virus
SEMSKLFERT

SEQ ID NO: 375247 - protein, 10 aa, Influenza virus
TRRQLRENAE

SEQ ID NO: 375248 - protein, 10 aa, Influenza virus
RRQLRENAED

SEQ ID NO: 375249 - protein, 10 aa, Influenza virus
KQLRENAEDL

SEQ ID NO: 375250 - protein, 10 aa, Influenza virus
NAEEMGNGCF

SEQ ID NO: 375251 - protein, 10 aa, Influenza virus
AEDMGNGCLK

SEQ ID NO: 375252 - protein, 10 aa, Influenza virus
EDMGNGCLKI

SEQ ID NO: 375253 - protein, 10 aa, Influenza virus
DMGNGCLKIY

SEQ ID NO: 375254 - protein, 10 aa, Influenza virus
MGNGCLKIYH

SEQ ID NO: 375255 - protein, 10 aa, Influenza virus
GNGCLKIYHK

SEQ ID NO: 375256 - protein, 10 aa, Influenza virus
NGCLKIYHKC

SEQ ID NO: 375257 - protein, 10 aa, Influenza virus
GCLKIYHKCD

SEQ ID NO: 375258 - protein, 10 aa, Influenza virus
CLKIYHKCDN

SEQ ID NO: 375259 - protein, 10 aa, Influenza virus
CIGSIRNETY

SEQ ID NO: 375260 - protein, 10 aa, Influenza virus
IGSIRNGTYN

SEQ ID NO: 375261 - protein, 10 aa, Influenza virus
GSIRNGTYNH

SEQ ID NO: 375262 - protein, 10 aa, Influenza virus
SIRNGTYNHD

SEQ ID NO: 375263 - protein, 10 aa, Influenza virus
YRNEALNNRF

SEQ ID NO: 375264 - protein, 10 aa, Influenza virus
RNEALNNRFQ

SEQ ID NO: 375265 - protein, 10 aa, Influenza virus
EALNNRSQIK

SEQ ID NO: 375266 - protein, 10 aa, Influenza virus
EYKDWILWIS

SEQ ID NO: 375267 - protein, 10 aa, Influenza virus
YKNWILWISF

SEQ ID NO: 375268 - protein, 10 aa, Influenza virus
KNWILWISFA

SEQ ID NO: 375269 - protein, 10 aa, Influenza virus
DWILWISFAT

SEQ ID NO: 375270 - protein, 10 aa, Influenza virus
WILWISFATS

SEQ ID NO: 375271 - protein, 10 aa, Influenza virus
ILWISFATSC

SEQ ID NO: 375272 - protein, 10 aa, Influenza virus
LWISFAMSCF

SEQ ID NO: 375273 - protein, 10 aa, Influenza virus
WISFAMSCFL

SEQ ID NO: 375274 - protein, 10 aa, Influenza virus
ISFAMSCFLL

SEQ ID NO: 375275 - protein, 10 aa, Influenza virus
SFAMSCFLLC

SEQ ID NO: 375276 - protein, 10 aa, Influenza virus
LGFIMWTCQK

SEQ ID NO: 375277 - protein, 10 aa, Influenza virus
GFIMWTCQKG

SEQ ID NO: 375278 - protein, 10 aa, Influenza virus
FIMWTCQKGN

SEQ ID NO: 375279 - protein, 10 aa, Influenza virus
IMWTCQKGNI

SEQ ID NO: 375280 - protein, 10 aa, Influenza virus
MWACQKGNIK

SEQ ID NO: 375281 - protein, 10 aa, Influenza virus
WACQKGNIKC

SEQ ID NO: 375282 - protein, 10 aa, Influenza virus
ACQKGNIKCN

SEQ ID NO: 375283 - protein, 10 aa, Influenza virus
CQKGNIKCNI

SEQ ID NO: 375284 - protein, 10 aa, Influenza virus
QKGNIKCNIC

SEQ ID NO: 375285 - protein, 10 aa, Influenza virus
KGNIKCNICI

SEQ ID NO: 375286 - protein, 10 aa, Influenza virus
NSIRLAAGGD

SEQ ID NO: 375287 - protein, 10 aa, Influenza virus
SIRLAAGGDI

SEQ ID NO: 375288 - protein, 10 aa, Influenza virus
IRLAAGGDIW

SEQ ID NO: 375289 - protein, 10 aa, Influenza virus
RLAAGGDIWV

SEQ ID NO: 375290 - protein, 10 aa, Influenza virus
LAAGGDIWVT

SEQ ID NO: 375291 - protein, 10 aa, Influenza virus
AAGGDIWVTR

SEQ ID NO: 375292 - protein, 10 aa, Influenza virus
AGGDIWVTRV

SEQ ID NO: 375293 - protein, 10 aa, Influenza virus
GGAIWVTREP

SEQ ID NO: 375294 - protein, 10 aa, Influenza virus
GAIWVTREPY

SEQ ID NO: 375295 - protein, 10 aa, Influenza virus
AIWVTREPYV

SEQ ID NO: 375296 - protein, 10 aa, Influenza virus
VTRELYVSCD

SEQ ID NO: 375297 - protein, 10 aa, Influenza virus
SKCYQFALGQ

SEQ ID NO: 375298 - protein, 10 aa, Influenza virus
FALGQGTTLS

SEQ ID NO: 375299 - protein, 10 aa, Influenza virus
ALGQGTTLSN

SEQ ID NO: 375300 - protein, 10 aa, Influenza virus
RTPHRTLLMN

SEQ ID NO: 375301 - protein, 10 aa, Influenza virus
TPHRTLLMNE

SEQ ID NO: 375302 - protein, 10 aa, Influenza virus
LMNELGIPFH

SEQ ID NO: 375303 - protein, 10 aa, Influenza virus
MNELGIPFHL

SEQ ID NO: 375304 - protein, 10 aa, Influenza virus
NELGIPFHLG

SEQ ID NO: 375305 - protein, 10 aa, Influenza virus
LGVPFYLGTK

SEQ ID NO: 375306 - protein, 10 aa, Influenza virus
GVPFYLGTKQ

SEQ ID NO: 375307 - protein, 10 aa, Influenza virus
VPFYLGTKQV

SEQ ID NO: 375308 - protein, 10 aa, Influenza virus
FHLGTRQVCM

SEQ ID NO: 375309 - protein, 10 aa, Influenza virus
HLGTRQVCMA

SEQ ID NO: 375310 - protein, 10 aa, Influenza virus
LGTRQVCMAW

SEQ ID NO: 375311 - protein, 10 aa, Influenza virus
GTRQVCMAWS

SEQ ID NO: 375312 - protein, 10 aa, Influenza virus
TRQVCMAWSS

SEQ ID NO: 375313 - protein, 10 aa, Influenza virus
RQVCMAWSSS

SEQ ID NO: 375314 - protein, 10 aa, Influenza virus
NATASFIYGG

SEQ ID NO: 375315 - protein, 10 aa, Influenza virus
NILRTQESEC

SEQ ID NO: 375316 - protein, 10 aa, Influenza virus
ECICINGTCT

SEQ ID NO: 375317 - protein, 10 aa, Influenza virus
CICINGTCTV

SEQ ID NO: 375318 - protein, 10 aa, Influenza virus
ICINGTCTVV

SEQ ID NO: 375319 - protein, 10 aa, Influenza virus
CISGTCAVVM

SEQ ID NO: 375320 - protein, 10 aa, Influenza virus
ISGTCAVVMT

SEQ ID NO: 375321 - protein, 10 aa, Influenza virus
SGTCAVVMTD

SEQ ID NO: 375322 - protein, 10 aa, Influenza virus
TCTVVMTDGN

SEQ ID NO: 375323 - protein, 10 aa, Influenza virus
CTVVMTDGNA

SEQ ID NO: 375324 - protein, 10 aa, Influenza virus
TVVMTDGNAS

SEQ ID NO: 375325 - protein, 10 aa, Influenza virus
VVMTDGSASD

SEQ ID NO: 375326 - protein, 10 aa, Influenza virus
LLGSAQHVEE

SEQ ID NO: 375327 - protein, 10 aa, Influenza virus
LGSAQHVEEC

SEQ ID NO: 375328 - protein, 10 aa, Influenza virus
VEECSCYPRF

SEQ ID NO: 375329 - protein, 10 aa, Influenza virus
EECSCYPRYS

SEQ ID NO: 375330 - protein, 10 aa, Influenza virus
ECSCYPRYPD

SEQ ID NO: 375331 - protein, 10 aa, Influenza virus
IRCVCRDNWK

SEQ ID NO: 375332 - protein, 10 aa, Influenza virus
RCVCRDNWRG

SEQ ID NO: 375333 - protein, 10 aa, Influenza virus
CVCRDNWRGS

SEQ ID NO: 375334 - protein, 10 aa, Influenza virus
VCRDNWRGSN

SEQ ID NO: 375335 - protein, 10 aa, Influenza virus
DNWRGSNRPI

SEQ ID NO: 375336 - protein, 10 aa, Influenza virus
NWKGSNRPVI

SEQ ID NO: 375337 - protein, 10 aa, Influenza virus
WKGSNRPVID

SEQ ID NO: 375338 - protein, 10 aa, Influenza virus
KGSNRPVIDI

SEQ ID NO: 375339 - protein, 10 aa, Influenza virus
GSNRPVIDIN

SEQ ID NO: 375340 - protein, 10 aa, Influenza virus
SSYMCSGLVG

SEQ ID NO: 375341 - protein, 10 aa, Influenza virus
SYMCSGLVGD

SEQ ID NO: 375342 - protein, 10 aa, Influenza virus
YLCSGLVGDT

SEQ ID NO: 375343 - protein, 10 aa, Influenza virus
LCSGLVGDTP

SEQ ID NO: 375344 - protein, 10 aa, Influenza virus
QGVKGWAFDN

SEQ ID NO: 375345 - protein, 10 aa, Influenza virus
GVKGWAFDNE

SEQ ID NO: 375346 - protein, 10 aa, Influenza virus
ENDVWMGRTI

SEQ ID NO: 375347 - protein, 10 aa, Influenza virus
RSGYETFRVI

SEQ ID NO: 375348 - protein, 10 aa, Influenza virus
MSGYSGIFSV

SEQ ID NO: 375349 - protein, 10 aa, Influenza virus
GYSGIFSVEN

SEQ ID NO: 375350 - protein, 10 aa, Influenza virus
YSGIFSVENK

SEQ ID NO: 375351 - protein, 10 aa, Influenza virus
KNCINRCFYV

SEQ ID NO: 375352 - protein, 10 aa, Influenza virus
NCINRCFYVE

SEQ ID NO: 375353 - protein, 10 aa, Influenza virus
RVWWTSNSIV

SEQ ID NO: 375354 - protein, 10 aa, Influenza virus
VWWTSNSIVA

SEQ ID NO: 375355 - protein, 10 aa, Influenza virus
WWTSNSIVAF

SEQ ID NO: 375356 - protein, 10 aa, Influenza virus
GSGSWPDGAD

SEQ ID NO: 375357 - protein, 10 aa, Influenza virus
GADIKSHAYI

SEQ ID NO: 375358 - protein, 10 aa, Influenza virus
ADINLMPIYS

SEQ ID NO: 375359 - protein, 10 aa, Influenza virus
YTENPVICLG

SEQ ID NO: 375360 - protein, 10 aa, Influenza virus
TENPVICLGH

SEQ ID NO: 375361 - protein, 10 aa, Influenza virus
ENPVICLGHH

SEQ ID NO: 375362 - protein, 10 aa, Influenza virus
NPVICLGHHS

SEQ ID NO: 375363 - protein, 10 aa, Influenza virus
PVICLGHHSV

SEQ ID NO: 375364 - protein, 10 aa, Influenza virus
NGTIVKTLTD

SEQ ID NO: 375365 - protein, 10 aa, Influenza virus
IEVVAAQELV

SEQ ID NO: 375366 - protein, 10 aa, Influenza virus
EVITAQELVE

SEQ ID NO: 375367 - protein, 10 aa, Influenza virus
VVTAQELVEA

SEQ ID NO: 375368 - protein, 10 aa, Influenza virus
LCPSPLKLID

SEQ ID NO: 375369 - protein, 10 aa, Influenza virus
CDIVNSALGS

SEQ ID NO: 375370 - protein, 10 aa, Influenza virus
DIVNSALGSP

SEQ ID NO: 375371 - protein, 10 aa, Influenza virus
IVNSALGSPG

SEQ ID NO: 375372 - protein, 10 aa, Influenza virus
VNSALGSPGC

SEQ ID NO: 375373 - protein, 10 aa, Influenza virus
NAALGSPGCD

SEQ ID NO: 375374 - protein, 10 aa, Influenza virus
SALGSPGCDH

SEQ ID NO: 375375 - protein, 10 aa, Influenza virus
DTCYPFDVPG

SEQ ID NO: 375376 - protein, 10 aa, Influenza virus
TCYPFDVPGY

SEQ ID NO: 375377 - protein, 10 aa, Influenza virus
CYPFDVPNYQ

SEQ ID NO: 375378 - protein, 10 aa, Influenza virus
YPFDVPGYQS

SEQ ID NO: 375379 - protein, 10 aa, Influenza virus
DVPGYQSLRS

SEQ ID NO: 375380 - protein, 10 aa, Influenza virus
VPGYQSLRSI

SEQ ID NO: 375381 - protein, 10 aa, Influenza virus
PNYQSLRSIL

SEQ ID NO: 375382 - protein, 10 aa, Influenza virus
NYQSLRSILA

SEQ ID NO: 375383 - protein, 10 aa, Influenza virus
ANNGKFEFIV

SEQ ID NO: 375384 - protein, 10 aa, Influenza virus
NNGKFEFIVE

SEQ ID NO: 375385 - protein, 10 aa, Influenza virus
NGKFEFIAED

SEQ ID NO: 375386 - protein, 10 aa, Influenza virus
GKFEFIAEDF

SEQ ID NO: 375387 - protein, 10 aa, Influenza virus
TVKQDGKSSA

SEQ ID NO: 375388 - protein, 10 aa, Influenza virus
VKQDGKSSAC

SEQ ID NO: 375389 - protein, 10 aa, Influenza virus
KQDGKSSACK

SEQ ID NO: 375390 - protein, 10 aa, Influenza virus
QDGKSSACKR

SEQ ID NO: 375391 - protein, 10 aa, Influenza virus
DGKSSACKRA

SEQ ID NO: 375392 - protein, 10 aa, Influenza virus
GKSGACKRAD

SEQ ID NO: 375393 - protein, 10 aa, Influenza virus
DDFFNRLNWL

SEQ ID NO: 375394 - protein, 10 aa, Influenza virus
YPLQNLTKTN

SEQ ID NO: 375395 - protein, 10 aa, Influenza virus
QNLTKVNSGD

SEQ ID NO: 375396 - protein, 10 aa, Influenza virus
NLTKVNSGDY

SEQ ID NO: 375397 - protein, 10 aa, Influenza virus
NNGNYARLYI

SEQ ID NO: 375398 - protein, 10 aa, Influenza virus
NGNYARLYIW

SEQ ID NO: 375399 - protein, 10 aa, Influenza virus
GNYARLYIWG

SEQ ID NO: 375400 - protein, 10 aa, Influenza virus
NYARLYIWGV

SEQ ID NO: 375401 - protein, 10 aa, Influenza virus
WGVHHPSTDA

SEQ ID NO: 375402 - protein, 10 aa, Influenza virus
GVHHPSTDAE

SEQ ID NO: 375403 - protein, 10 aa, Influenza virus
VHHPSTDAEQ

SEQ ID NO: 375404 - protein, 10 aa, Influenza virus
LYKNNPGRVS

SEQ ID NO: 375405 - protein, 10 aa, Influenza virus
NNPGRVSVST

SEQ ID NO: 375406 - protein, 10 aa, Influenza virus
SPGRVTVSTK

SEQ ID NO: 375407 - protein, 10 aa, Influenza virus
RPLVRSQSGR

SEQ ID NO: 375408 - protein, 10 aa, Influenza virus
VRSQSGRISF

SEQ ID NO: 375409 - protein, 10 aa, Influenza virus
RSQSGRISFY

SEQ ID NO: 375410 - protein, 10 aa, Influenza virus
SQSGRISFYW

SEQ ID NO: 375411 - protein, 10 aa, Influenza virus
LSSRISFYWT

SEQ ID NO: 375412 - protein, 10 aa, Influenza virus
SSRISFYWTI

SEQ ID NO: 375413 - protein, 10 aa, Influenza virus
SRISFYWTIV

SEQ ID NO: 375414 - protein, 10 aa, Influenza virus
RISFYWTIVD

SEQ ID NO: 375415 - protein, 10 aa, Influenza virus
ISFYWTIVDP

SEQ ID NO: 375416 - protein, 10 aa, Influenza virus
SFYWTIVEPE

SEQ ID NO: 375417 - protein, 10 aa, Influenza virus
FYWTIVEPGN

SEQ ID NO: 375418 - protein, 10 aa, Influenza virus
PGDLILFNTI

SEQ ID NO: 375419 - protein, 10 aa, Influenza virus
GDLILFNTIG

SEQ ID NO: 375420 - protein, 10 aa, Influenza virus
DLILFNTIGN

SEQ ID NO: 375421 - protein, 10 aa, Influenza virus
LILFNTIGNL

SEQ ID NO: 375422 - protein, 10 aa, Influenza virus
ILFNTIGNLI

SEQ ID NO: 375423 - protein, 10 aa, Influenza virus
LFNTIGNLIA

SEQ ID NO: 375424 - protein, 10 aa, Influenza virus
NLIAPRGHYR

SEQ ID NO: 375425 - protein, 10 aa, Influenza virus
LIAPRGHYRL

SEQ ID NO: 375426 - protein, 10 aa, Influenza virus
IGSCESKCHT

SEQ ID NO: 375427 - protein, 10 aa, Influenza virus
GECPKYVKQG

SEQ ID NO: 375428 - protein, 10 aa, Influenza virus
DCPKYIKQGS

SEQ ID NO: 375429 - protein, 10 aa, Influenza virus
CPRYVKQGSL

SEQ ID NO: 375430 - protein, 10 aa, Influenza virus
PRYVKQGSLK

SEQ ID NO: 375431 - protein, 10 aa, Influenza virus
RYVKQGSLKL

SEQ ID NO: 375432 - protein, 10 aa, Influenza virus
YVKQGSLRLA

SEQ ID NO: 375433 - protein, 10 aa, Influenza virus
VKQGSLRLAT

SEQ ID NO: 375434 - protein, 10 aa, Influenza virus
LKSTQAAIDK

SEQ ID NO: 375435 - protein, 10 aa, Influenza virus
KSTQAAIDQV

SEQ ID NO: 375436 - protein, 10 aa, Influenza virus
TQTAIDQITG

SEQ ID NO: 375437 - protein, 10 aa, Influenza virus
QTAIDQITGK

SEQ ID NO: 375438 - protein, 10 aa, Influenza virus
TAIDQITGKL

SEQ ID NO: 375439 - protein, 10 aa, Influenza virus
AIDQVNGKLN

SEQ ID NO: 375440 - protein, 10 aa, Influenza virus
IDQISGKLNR

SEQ ID NO: 375441 - protein, 10 aa, Influenza virus
DKINGKLNRL

SEQ ID NO: 375442 - protein, 10 aa, Influenza virus
QISGKLNRLI

SEQ ID NO: 375443 - protein, 10 aa, Influenza virus
VNGKLNRLIE

SEQ ID NO: 375444 - protein, 10 aa, Influenza virus
TGKLNRLIEK

SEQ ID NO: 375445 - protein, 10 aa, Influenza virus
LNRLIERTNE

SEQ ID NO: 375446 - protein, 10 aa, Influenza virus
NRLIERTNEK

SEQ ID NO: 375447 - protein, 10 aa, Influenza virus
RLIERTNEKY

SEQ ID NO: 375448 - protein, 10 aa, Influenza virus
LIEKTNDKYH

SEQ ID NO: 375449 - protein, 10 aa, Influenza virus
IEKTNDKYHQ

SEQ ID NO: 375450 - protein, 10 aa, Influenza virus
ERTNEKYHQI

SEQ ID NO: 375451 - protein, 10 aa, Influenza virus
RTNEKYHQIE

SEQ ID NO: 375452 - protein, 10 aa, Influenza virus
KEFEQVEGRT

SEQ ID NO: 375453 - protein, 10 aa, Influenza virus
EFEQVEGRTQ

SEQ ID NO: 375454 - protein, 10 aa, Influenza virus
FEQVEGRIQY

SEQ ID NO: 375455 - protein, 10 aa, Influenza virus
EQVEGRIQYL

SEQ ID NO: 375456 - protein, 10 aa, Influenza virus
QVEGRTQDLE

SEQ ID NO: 375457 - protein, 10 aa, Influenza virus
QYLEKYVEDT

SEQ ID NO: 375458 - protein, 10 aa, Influenza virus
DLENYVEDTK

SEQ ID NO: 375459 - protein, 10 aa, Influenza virus
LERYVEDTKI

SEQ ID NO: 375460 - protein, 10 aa, Influenza virus
ERYVEDTKID

SEQ ID NO: 375461 - protein, 10 aa, Influenza virus
RYVEDTKIDL

SEQ ID NO: 375462 - protein, 10 aa, Influenza virus
NQHTIDVADS

SEQ ID NO: 375463 - protein, 10 aa, Influenza virus
QHIIDVTDSE

SEQ ID NO: 375464 - protein, 10 aa, Influenza virus
HTIDVADSEM

SEQ ID NO: 375465 - protein, 10 aa, Influenza virus
TIDMTDSEMN

SEQ ID NO: 375466 - protein, 10 aa, Influenza virus
IDVTDSEMDK

SEQ ID NO: 375467 - protein, 10 aa, Influenza virus
VTDSEMDKLF

SEQ ID NO: 375468 - protein, 10 aa, Influenza virus
TDSEMNRLFE

SEQ ID NO: 375469 - protein, 10 aa, Influenza virus
DSEMDKLFER

SEQ ID NO: 375470 - protein, 10 aa, Influenza virus
SEMDKLFERV

SEQ ID NO: 375471 - protein, 10 aa, Influenza virus
EMNRLFERVR

SEQ ID NO: 375472 - protein, 10 aa, Influenza virus
KLFERVKRQL

SEQ ID NO: 375473 - protein, 10 aa, Influenza virus
LFERVKRQLR

SEQ ID NO: 375474 - protein, 10 aa, Influenza virus
FERVKRQLRE

SEQ ID NO: 375475 - protein, 10 aa, Influenza virus
ERVKRQLREN

SEQ ID NO: 375476 - protein, 10 aa, Influenza virus
RVKRQLRENA

SEQ ID NO: 375477 - protein, 10 aa, Influenza virus
VKRQLRENAE

SEQ ID NO: 375478 - protein, 10 aa, Influenza virus
HQLRENAEDK

SEQ ID NO: 375479 - protein, 10 aa, Influenza virus
GNGCFEIFHR

SEQ ID NO: 375480 - protein, 10 aa, Influenza virus
NGCFEIFHRC

SEQ ID NO: 375481 - protein, 10 aa, Influenza virus
GCFEIFHRCD

SEQ ID NO: 375482 - protein, 10 aa, Influenza virus
CFEIFHRCDN

SEQ ID NO: 375483 - protein, 10 aa, Influenza virus
CDNKCIESIR

SEQ ID NO: 375484 - protein, 10 aa, Influenza virus
DNKCIESIRN

SEQ ID NO: 375485 - protein, 10 aa, Influenza virus
NKCIESIRNG

SEQ ID NO: 375486 - protein, 10 aa, Influenza virus
KCIESIRNGT

SEQ ID NO: 375487 - protein, 10 aa, Influenza virus
SIRNGTYDHN

SEQ ID NO: 375488 - protein, 10 aa, Influenza virus
YRNEAINNRF

SEQ ID NO: 375489 - protein, 10 aa, Influenza virus
RNEAINNRFQ

SEQ ID NO: 375490 - protein, 10 aa, Influenza virus
NEAINNRFQI

SEQ ID NO: 375491 - protein, 10 aa, Influenza virus
EAINSRFQIQ

SEQ ID NO: 375492 - protein, 10 aa, Influenza virus
AINSRFQIQG

SEQ ID NO: 375493 - protein, 10 aa, Influenza virus
INSRFQIQGV

SEQ ID NO: 375494 - protein, 10 aa, Influenza virus
SRFQIQGVKL

SEQ ID NO: 375495 - protein, 10 aa, Influenza virus
RFQIQGVKLA

SEQ ID NO: 375496 - protein, 10 aa, Influenza virus
FQIQGVKLAQ

SEQ ID NO: 375497 - protein, 10 aa, Influenza virus
QIQGVKLAQG

SEQ ID NO: 375498 - protein, 10 aa, Influenza virus
IQGVKLAQGY

SEQ ID NO: 375499 - protein, 10 aa, Influenza virus
QGVKLAQGYK

SEQ ID NO: 375500 - protein, 10 aa, Influenza virus
GVKLAQGYKD

SEQ ID NO: 375501 - protein, 10 aa, Influenza virus
KLAQGYKDII

SEQ ID NO: 375502 - protein, 10 aa, Influenza virus
LIQGYKDIIL

SEQ ID NO: 375503 - protein, 10 aa, Influenza virus
IQGYKDIILW

SEQ ID NO: 375504 - protein, 10 aa, Influenza virus
QGYKDIILWF

SEQ ID NO: 375505 - protein, 10 aa, Influenza virus
GYKDIILWFS

SEQ ID NO: 375506 - protein, 10 aa, Influenza virus
YKDIILWFSF

SEQ ID NO: 375507 - protein, 10 aa, Influenza virus
KDIILWFSFS

SEQ ID NO: 375508 - protein, 10 aa, Influenza virus
DIILWISFSM

SEQ ID NO: 375509 - protein, 10 aa, Influenza virus
IILWISFSMS

SEQ ID NO: 375510 - protein, 10 aa, Influenza virus
ISFSISCFLF

SEQ ID NO: 375511 - protein, 10 aa, Influenza virus
SFSISCFLLI

SEQ ID NO: 375512 - protein, 10 aa, Influenza virus
FSISCFLLIA

SEQ ID NO: 375513 - protein, 10 aa, Influenza virus
SISCFLLIAL

SEQ ID NO: 375514 - protein, 10 aa, Influenza virus
ISCFLLVALF

SEQ ID NO: 375515 - protein, 10 aa, Influenza virus
SCFLLVALLI

SEQ ID NO: 375516 - protein, 10 aa, Influenza virus
ALLLAFVLWA

SEQ ID NO: 375517 - protein, 10 aa, Influenza virus
LLLAFMLWAC

SEQ ID NO: 375518 - protein, 10 aa, Influenza virus
LLAFVLWACQ

SEQ ID NO: 375519 - protein, 10 aa, Influenza virus
LAFMLWACQN

SEQ ID NO: 375520 - protein, 10 aa, Influenza virus
AFMLWACQNG

SEQ ID NO: 375521 - protein, 10 aa, Influenza virus
FMLWACQNGN

SEQ ID NO: 375522 - protein, 10 aa, Influenza virus
LWACQNGNVR

SEQ ID NO: 375523 - protein, 10 aa, Influenza virus
WACQNGNVRC

SEQ ID NO: 375524 - protein, 10 aa, Influenza virus
ACQNGNVRCQ

SEQ ID NO: 375525 - protein, 10 aa, Influenza virus
CQNGNVRCQI

SEQ ID NO: 375526 - protein, 10 aa, Influenza virus
QNGNVRCQIC

SEQ ID NO: 375527 - protein, 10 aa, Influenza virus
NGNVRCQICI

SEQ ID NO: 375528 - protein, 10 aa, Influenza virus
SDHICIGYHA

SEQ ID NO: 375529 - protein, 10 aa, Influenza virus
DRICIGYHAN

SEQ ID NO: 375530 - protein, 10 aa, Influenza virus
RICIGYHANN

SEQ ID NO: 375531 - protein, 10 aa, Influenza virus
IGYHANNSTV

SEQ ID NO: 375532 - protein, 10 aa, Influenza virus
QVDTIMERNV

SEQ ID NO: 375533 - protein, 10 aa, Influenza virus
IDTIMEKNVT

SEQ ID NO: 375534 - protein, 10 aa, Influenza virus
TIMEKNITVT

SEQ ID NO: 375535 - protein, 10 aa, Influenza virus
IMEKNITVTH

SEQ ID NO: 375536 - protein, 10 aa, Influenza virus
MEKNITVTHA

SEQ ID NO: 375537 - protein, 10 aa, Influenza virus
EKNVTVTHAK

SEQ ID NO: 375538 - protein, 10 aa, Influenza virus
RNVTVTHAQD

SEQ ID NO: 375539 - protein, 10 aa, Influenza virus
NVTVTHAKDI

SEQ ID NO: 375540 - protein, 10 aa, Influenza virus
VTVTHAKDIL

SEQ ID NO: 375541 - protein, 10 aa, Influenza virus
TVTHAKDILE

SEQ ID NO: 375542 - protein, 10 aa, Influenza virus
VTHAQNILEK

SEQ ID NO: 375543 - protein, 10 aa, Influenza virus
LKDCSIAGWL

SEQ ID NO: 375544 - protein, 10 aa, Influenza virus
DCSVSGWLLG

SEQ ID NO: 375545 - protein, 10 aa, Influenza virus
IAGWLLGNPM

SEQ ID NO: 375546 - protein, 10 aa, Influenza virus
SGWLLGNPMC

SEQ ID NO: 375547 - protein, 10 aa, Influenza virus
WLLGNPMCDK

SEQ ID NO: 375548 - protein, 10 aa, Influenza virus
LLGNPMCDKF

SEQ ID NO: 375549 - protein, 10 aa, Influenza virus
VPEWSYIVER

SEQ ID NO: 375550 - protein, 10 aa, Influenza virus
SGRSSFFRNV

SEQ ID NO: 375551 - protein, 10 aa, Influenza virus
YISIGTSTLN

SEQ ID NO: 375552 - protein, 10 aa, Influenza virus
SVGTSTLNLR

SEQ ID NO: 375553 - protein, 10 aa, Influenza virus
FDSNGNFIAP

SEQ ID NO: 375554 - protein, 10 aa, Influenza virus
DSNGNFIAPE

SEQ ID NO: 375555 - protein, 10 aa, Influenza virus
STGNFIAPEY

SEQ ID NO: 375556 - protein, 10 aa, Influenza virus
TGNFIAPEYA

SEQ ID NO: 375557 - protein, 10 aa, Influenza virus
NFIAPEYAYI

SEQ ID NO: 375558 - protein, 10 aa, Influenza virus
FIAPEYAYIV

SEQ ID NO: 375559 - protein, 10 aa, Influenza virus
PFHNVHPFTI

SEQ ID NO: 375560 - protein, 10 aa, Influenza virus
FHNVHPFTIG

SEQ ID NO: 375561 - protein, 10 aa, Influenza virus
HPFTIGECPR

SEQ ID NO: 375562 - protein, 10 aa, Influenza virus
PFTIGECPRY

SEQ ID NO: 375563 - protein, 10 aa, Influenza virus
TIGKCPKYVK

SEQ ID NO: 375564 - protein, 10 aa, Influenza virus
IGKCPKYVKS

SEQ ID NO: 375565 - protein, 10 aa, Influenza virus
RRRKRGLFGA

SEQ ID NO: 375566 - protein, 10 aa, Influenza virus
RRGLFGAIAG

SEQ ID NO: 375567 - protein, 10 aa, Influenza virus
QGMIDGWYGY

SEQ ID NO: 375568 - protein, 10 aa, Influenza virus
GMIDGWYGYH

SEQ ID NO: 375569 - protein, 10 aa, Influenza virus
MIDGWYGYHH

SEQ ID NO: 375570 - protein, 10 aa, Influenza virus
IDGWYGYHHS

SEQ ID NO: 375571 - protein, 10 aa, Influenza virus
DGWYGYHHNN

SEQ ID NO: 375572 - protein, 10 aa, Influenza virus
KEQGSGYAAD

SEQ ID NO: 375573 - protein, 10 aa, Influenza virus
EQGSGYAADQ

SEQ ID NO: 375574 - protein, 10 aa, Influenza virus
QGSGYAADKK

SEQ ID NO: 375575 - protein, 10 aa, Influenza virus
GSGYAADKKS

SEQ ID NO: 375576 - protein, 10 aa, Influenza virus
SGYAADKKST

SEQ ID NO: 375577 - protein, 10 aa, Influenza virus
GYAADKKSTQ

SEQ ID NO: 375578 - protein, 10 aa, Influenza virus
YAADQESTQK

SEQ ID NO: 375579 - protein, 10 aa, Influenza virus
AADQESTQKA

SEQ ID NO: 375580 - protein, 10 aa, Influenza virus
GITNKINSII

SEQ ID NO: 375581 - protein, 10 aa, Influenza virus
VNSIIGKMNT

SEQ ID NO: 375582 - protein, 10 aa, Influenza virus
FIDVWTYNAE

SEQ ID NO: 375583 - protein, 10 aa, Influenza virus
IDVWTYNAEL

SEQ ID NO: 375584 - protein, 10 aa, Influenza virus
GVWTYNAELL

SEQ ID NO: 375585 - protein, 10 aa, Influenza virus
TLDFHDSNVR

SEQ ID NO: 375586 - protein, 10 aa, Influenza virus
LDFHDSNVRN

SEQ ID NO: 375587 - protein, 10 aa, Influenza virus
DFHDSNVRNL

SEQ ID NO: 375588 - protein, 10 aa, Influenza virus
FHDSNVRNLY

SEQ ID NO: 375589 - protein, 10 aa, Influenza virus
HDSNVRNLYD

SEQ ID NO: 375590 - protein, 10 aa, Influenza virus
DSNVRNLYDK

SEQ ID NO: 375591 - protein, 10 aa, Influenza virus
NVRNLYDKVR

SEQ ID NO: 375592 - protein, 10 aa, Influenza virus
NLYDRVRLQL

SEQ ID NO: 375593 - protein, 10 aa, Influenza virus
RVRLQLRDNA

SEQ ID NO: 375594 - protein, 10 aa, Influenza virus
VRLQLKDNAR

SEQ ID NO: 375595 - protein, 10 aa, Influenza virus
RLQLKDNARE

SEQ ID NO: 375596 - protein, 10 aa, Influenza virus
LQLKDNAREL

SEQ ID NO: 375597 - protein, 10 aa, Influenza virus
QLKDNARELG

SEQ ID NO: 375598 - protein, 10 aa, Influenza virus
LKDNARELGN

SEQ ID NO: 375599 - protein, 10 aa, Influenza virus
KDNARELGNG

SEQ ID NO: 375600 - protein, 10 aa, Influenza virus
GCFEFYHKCN

SEQ ID NO: 375601 - protein, 10 aa, Influenza virus
CFEFYHKCDD

SEQ ID NO: 375602 - protein, 10 aa, Influenza virus
CMESVKNGTY

SEQ ID NO: 375603 - protein, 10 aa, Influenza virus
YQILSLYSTV

SEQ ID NO: 375604 - protein, 10 aa, Influenza virus
QILSIYSTVV

SEQ ID NO: 375605 - protein, 10 aa, Influenza virus
ILSIYSTVVS

SEQ ID NO: 375606 - protein, 10 aa, Influenza virus
LSIYSTVVSS

SEQ ID NO: 375607 - protein, 10 aa, Influenza virus
SIYSTVVSSL

SEQ ID NO: 375608 - protein, 10 aa, Influenza virus
GLFLWMCSNG

SEQ ID NO: 375609 - protein, 10 aa, Influenza virus
LFLWMCSNGS

SEQ ID NO: 375610 - protein, 10 aa, Influenza virus
LWMCFNGSLQ

SEQ ID NO: 375611 - protein, 10 aa, Influenza virus
WMCSNGSYNA

SEQ ID NO: 375612 - protein, 10 aa, Influenza virus
CSNGSLQCKI

SEQ ID NO: 375613 - protein, 10 aa, Influenza virus
SNGSLQCRIA

SEQ ID NO: 375614 - protein, 10 aa, Influenza virus
NGSLQCKICI

SEQ ID NO: 375615 - protein, 10 aa, Influenza virus
CIKICESRLR

SEQ ID NO: 375616 - protein, 10 aa, Influenza virus
GDQICIGYHA

SEQ ID NO: 375617 - protein, 10 aa, Influenza virus
DQICVGYHAN

SEQ ID NO: 375618 - protein, 10 aa, Influenza virus
QICVGYHANN

SEQ ID NO: 375619 - protein, 10 aa, Influenza virus
IGYHANNSTV

SEQ ID NO: 375620 - protein, 10 aa, Influenza virus
GYHANNSTVQ

SEQ ID NO: 375621 - protein, 10 aa, Influenza virus
HANNSTVQVD

SEQ ID NO: 375622 - protein, 10 aa, Influenza virus
ANNSTVQVDT

SEQ ID NO: 375623 - protein, 10 aa, Influenza virus
NNSTVQVDTI

SEQ ID NO: 375624 - protein, 10 aa, Influenza virus
NSTVQVDTIM

SEQ ID NO: 375625 - protein, 10 aa, Influenza virus
STVQVDTIME

SEQ ID NO: 375626 - protein, 10 aa, Influenza virus
TVQVDTIMEK

SEQ ID NO: 375627 - protein, 10 aa, Influenza virus
VQVDTIMEKN

SEQ ID NO: 375628 - protein, 10 aa, Influenza virus
RVDTIMEKNV

SEQ ID NO: 375629 - protein, 10 aa, Influenza virus
IMEKNITVTH

SEQ ID NO: 375630 - protein, 10 aa, Influenza virus
MEKNITVTHA

SEQ ID NO: 375631 - protein, 10 aa, Influenza virus
EKNVTVTHAK

SEQ ID NO: 375632 - protein, 10 aa, Influenza virus
KNVTVTHAQN

SEQ ID NO: 375633 - protein, 10 aa, Influenza virus
NVTVTHAKDI

SEQ ID NO: 375634 - protein, 10 aa, Influenza virus
VTVTHAKDIL

SEQ ID NO: 375635 - protein, 10 aa, Influenza virus
TVTHAKDILE

SEQ ID NO: 375636 - protein, 10 aa, Influenza virus
VTHAQNILEK

SEQ ID NO: 375637 - protein, 10 aa, Influenza virus
GVRPLILKDC

SEQ ID NO: 375638 - protein, 10 aa, Influenza virus
VRPLILKDCS

SEQ ID NO: 375639 - protein, 10 aa, Influenza virus
RPLILRDCSV

SEQ ID NO: 375640 - protein, 10 aa, Influenza virus
PLILKDCSIA

SEQ ID NO: 375641 - protein, 10 aa, Influenza virus
LILKDCSIAG

SEQ ID NO: 375642 - protein, 10 aa, Influenza virus
ILKDCSIAGW

SEQ ID NO: 375643 - protein, 10 aa, Influenza virus
WLLGNPMCDK

SEQ ID NO: 375644 - protein, 10 aa, Influenza virus
LLGNPMCDKF

SEQ ID NO: 375645 - protein, 10 aa, Influenza virus
DVPEWSYIVE

SEQ ID NO: 375646 - protein, 10 aa, Influenza virus
LNDYEELKHL

SEQ ID NO: 375647 - protein, 10 aa, Influenza virus
SDYEELKHLM

SEQ ID NO: 375648 - protein, 10 aa, Influenza virus
DYEELKHLMS

SEQ ID NO: 375649 - protein, 10 aa, Influenza virus
YEELKHLLSS

SEQ ID NO: 375650 - protein, 10 aa, Influenza virus
EELKHLLSST

SEQ ID NO: 375651 - protein, 10 aa, Influenza virus
TYVSVGTSTL

SEQ ID NO: 375652 - protein, 10 aa, Influenza virus
YVSVGTSTLN

SEQ ID NO: 375653 - protein, 10 aa, Influenza virus
ISVGTSTLNL

SEQ ID NO: 375654 - protein, 10 aa, Influenza virus
SVGTSTLNLR

SEQ ID NO: 375655 - protein, 10 aa, Influenza virus
VGTSTLNLRL

SEQ ID NO: 375656 - protein, 10 aa, Influenza virus
ISFESNGNFI

SEQ ID NO: 375657 - protein, 10 aa, Influenza virus
SFESNGNFIA

SEQ ID NO: 375658 - protein, 10 aa, Influenza virus
FESNGNFITP

SEQ ID NO: 375659 - protein, 10 aa, Influenza virus
ESNGNFITPE

SEQ ID NO: 375660 - protein, 10 aa, Influenza virus
SNGNFITPEY

SEQ ID NO: 375661 - protein, 10 aa, Influenza virus
NGNFITPEYA

SEQ ID NO: 375662 - protein, 10 aa, Influenza virus
NFIAPEYAYI

SEQ ID NO: 375663 - protein, 10 aa, Influenza virus
FIAPEYAYIV

SEQ ID NO: 375664 - protein, 10 aa, Influenza virus
AYIVKKGDSA

SEQ ID NO: 375665 - protein, 10 aa, Influenza virus
CQTPVGAINS

SEQ ID NO: 375666 - protein, 10 aa, Influenza virus
GAINSSMPLH

SEQ ID NO: 375667 - protein, 10 aa, Influenza virus
AINSSMPLHN

SEQ ID NO: 375668 - protein, 10 aa, Influenza virus
VNSSMPFHNI

SEQ ID NO: 375669 - protein, 10 aa, Influenza virus
NSSMPLHNIH

SEQ ID NO: 375670 - protein, 10 aa, Influenza virus
SSMPLHNIHP

SEQ ID NO: 375671 - protein, 10 aa, Influenza virus
SMPLHNIHPL

SEQ ID NO: 375672 - protein, 10 aa, Influenza virus
MPLHNIHPLT

SEQ ID NO: 375673 - protein, 10 aa, Influenza virus
PLHNIHPLTI

SEQ ID NO: 375674 - protein, 10 aa, Influenza virus
HNIHPLTIGK

SEQ ID NO: 375675 - protein, 10 aa, Influenza virus
NIHPLTIGKC

SEQ ID NO: 375676 - protein, 10 aa, Influenza virus
IHPLTIGKCP

SEQ ID NO: 375677 - protein, 10 aa, Influenza virus
GECPKYVKSS

SEQ ID NO: 375678 - protein, 10 aa, Influenza virus
RLILATGLRN

SEQ ID NO: 375679 - protein, 10 aa, Influenza virus
RRKRGLFGAI

SEQ ID NO: 375680 - protein, 10 aa, Influenza virus
RKRGLFGAIA

SEQ ID NO: 375681 - protein, 10 aa, Influenza virus
RRGLFGAIAG

SEQ ID NO: 375682 - protein, 10 aa, Influenza virus
QGMIDGWYGY

SEQ ID NO: 375683 - protein, 10 aa, Influenza virus
GMIDGWYGYH

SEQ ID NO: 375684 - protein, 10 aa, Influenza virus
MIDGWYGYHH

SEQ ID NO: 375685 - protein, 10 aa, Influenza virus
IDGWYGYHHS

SEQ ID NO: 375686 - protein, 10 aa, Influenza virus
DGWYGYHHNN

SEQ ID NO: 375687 - protein, 10 aa, Influenza virus
GWYGYHHSNG

SEQ ID NO: 375688 - protein, 10 aa, Influenza virus
HNNEQGSGYA

SEQ ID NO: 375689 - protein, 10 aa, Influenza virus
NNEQGSGYAA

SEQ ID NO: 375690 - protein, 10 aa, Influenza virus
KEQGSGYAAD

SEQ ID NO: 375691 - protein, 10 aa, Influenza virus
EQGSGYAADQ

SEQ ID NO: 375692 - protein, 10 aa, Influenza virus
QGSGYAADRE

SEQ ID NO: 375693 - protein, 10 aa, Influenza virus
GSGYAADRES

SEQ ID NO: 375694 - protein, 10 aa, Influenza virus
SGYAADREST

SEQ ID NO: 375695 - protein, 10 aa, Influenza virus
GYAADRESTQ

SEQ ID NO: 375696 - protein, 10 aa, Influenza virus
YAADQESTQK

SEQ ID NO: 375697 - protein, 10 aa, Influenza virus
AADQESTQKA

SEQ ID NO: 375698 - protein, 10 aa, Influenza virus
ESTQRAIDGV

SEQ ID NO: 375699 - protein, 10 aa, Influenza virus
STQRAIDGVT

SEQ ID NO: 375700 - protein, 10 aa, Influenza virus
TQRAIDGVTN

SEQ ID NO: 375701 - protein, 10 aa, Influenza virus
QRAIDGVTNK

SEQ ID NO: 375702 - protein, 10 aa, Influenza virus
AINGVTNKVN

SEQ ID NO: 375703 - protein, 10 aa, Influenza virus
INGVTNKVNS

SEQ ID NO: 375704 - protein, 10 aa, Influenza virus
NGVTNKVNSI

SEQ ID NO: 375705 - protein, 10 aa, Influenza virus
ITNKVNSIID

SEQ ID NO: 375706 - protein, 10 aa, Influenza virus
TNKINSIIDK

SEQ ID NO: 375707 - protein, 10 aa, Influenza virus
NKINSIIDKM

SEQ ID NO: 375708 - protein, 10 aa, Influenza virus
KINSIIDKMN

SEQ ID NO: 375709 - protein, 10 aa, Influenza virus
INSIIDKMNT

SEQ ID NO: 375710 - protein, 10 aa, Influenza virus
NSIIGKMNTQ

SEQ ID NO: 375711 - protein, 10 aa, Influenza virus
SIIGKMNTQF

SEQ ID NO: 375712 - protein, 10 aa, Influenza virus
IIGKMNTQFE

SEQ ID NO: 375713 - protein, 10 aa, Influenza virus
IGKMNTQFEA

SEQ ID NO: 375714 - protein, 10 aa, Influenza virus
KMNIQFEAVG

SEQ ID NO: 375715 - protein, 10 aa, Influenza virus
MNTQFEAIGR

SEQ ID NO: 375716 - protein, 10 aa, Influenza virus
NTQFEAIGRE

SEQ ID NO: 375717 - protein, 10 aa, Influenza virus
TQFEAIGREF

SEQ ID NO: 375718 - protein, 10 aa, Influenza virus
QFEAVGREFS

SEQ ID NO: 375719 - protein, 10 aa, Influenza virus
LERRIESLNK

SEQ ID NO: 375720 - protein, 10 aa, Influenza virus
ERRIESLNKK

SEQ ID NO: 375721 - protein, 10 aa, Influenza virus
RRIESLNKKM

SEQ ID NO: 375722 - protein, 10 aa, Influenza virus
RIENLNRKME

SEQ ID NO: 375723 - protein, 10 aa, Influenza virus
IENLNRKMED

SEQ ID NO: 375724 - protein, 10 aa, Influenza virus
ENLNRKMEDG

SEQ ID NO: 375725 - protein, 10 aa, Influenza virus
NLNRKMEDGF

SEQ ID NO: 375726 - protein, 10 aa, Influenza virus
NKKMEDGFLN

SEQ ID NO: 375727 - protein, 10 aa, Influenza virus
KKMEDGFLDI

SEQ ID NO: 375728 - protein, 10 aa, Influenza virus
HDSNVRNLYD

SEQ ID NO: 375729 - protein, 10 aa, Influenza virus
DSNVRNLYDK

SEQ ID NO: 375730 - protein, 10 aa, Influenza virus
SNVRNLYDKV

SEQ ID NO: 375731 - protein, 10 aa, Influenza virus
NVRNLYDKVR

SEQ ID NO: 375732 - protein, 10 aa, Influenza virus
VRNLYDKVRL

SEQ ID NO: 375733 - protein, 10 aa, Influenza virus
RNLYDKVRLQ

SEQ ID NO: 375734 - protein, 10 aa, Influenza virus
NLYDRVRLQL

SEQ ID NO: 375735 - protein, 10 aa, Influenza virus
LYEKVRLQLR

SEQ ID NO: 375736 - protein, 10 aa, Influenza virus
YEKVRLQLRD

SEQ ID NO: 375737 - protein, 10 aa, Influenza virus
EKVRLQLRDN

SEQ ID NO: 375738 - protein, 10 aa, Influenza virus
RVRLQLRDNA

SEQ ID NO: 375739 - protein, 10 aa, Influenza virus
GCFEFYHKCN

SEQ ID NO: 375740 - protein, 10 aa, Influenza virus
CFEFYHKCNN

SEQ ID NO: 375741 - protein, 10 aa, Influenza virus
CMESVKNGTY

SEQ ID NO: 375742 - protein, 10 aa, Influenza virus
VTYQILSIYS

SEQ ID NO: 375743 - protein, 10 aa, Influenza virus
VYQILSIYST

SEQ ID NO: 375744 - protein, 10 aa, Influenza virus
QILSIYSTVV

SEQ ID NO: 375745 - protein, 10 aa, Influenza virus
ILSIYSTVVS

SEQ ID NO: 375746 - protein, 10 aa, Influenza virus
LSIYSTVVSS

SEQ ID NO: 375747 - protein, 10 aa, Influenza virus
SIYSTVVSSL

SEQ ID NO: 375748 - protein, 10 aa, Influenza virus
YSTAASSLAL

SEQ ID NO: 375749 - protein, 10 aa, Influenza virus
STAASSLALA

SEQ ID NO: 375750 - protein, 10 aa, Influenza virus
TAASSLALAI

SEQ ID NO: 375751 - protein, 10 aa, Influenza virus
AGLSFWMCSN

SEQ ID NO: 375752 - protein, 10 aa, Influenza virus
GLSFWMCSNG

SEQ ID NO: 375753 - protein, 10 aa, Influenza virus
LSFWMCSNGS

SEQ ID NO: 375754 - protein, 10 aa, Influenza virus
SFWMCSNGSL

SEQ ID NO: 375755 - protein, 10 aa, Influenza virus
LWMCFNGSLQ

SEQ ID NO: 375756 - protein, 10 aa, Influenza virus
WMCSNGSYNA

SEQ ID NO: 375757 - protein, 10 aa, Influenza virus
CSNGSLQCKI

SEQ ID NO: 375758 - protein, 10 aa, Influenza virus
SNGSLQCRIA

SEQ ID NO: 375759 - protein, 10 aa, Influenza virus
NGSLQCKICI

SEQ ID NO: 375760 - protein, 10 aa, Influenza virus
CIRFVNSDCS

SEQ ID NO: 375761 - protein, 10 aa, Influenza virus
VFREQKQEFK

SEQ ID NO: 375762 - protein, 10 aa, Influenza virus
FREQKQEFKM

SEQ ID NO: 375763 - protein, 10 aa, Influenza virus
IKMNPNQKII

SEQ ID NO: 375764 - protein, 10 aa, Influenza virus
KMNPNQKIMT

SEQ ID NO: 375765 - protein, 10 aa, Influenza virus
YKNNTWVNQT

SEQ ID NO: 375766 - protein, 10 aa, Influenza virus
ENTTWVNQTY

SEQ ID NO: 375767 - protein, 10 aa, Influenza virus
YSKDNGIRIG

SEQ ID NO: 375768 - protein, 10 aa, Influenza virus
SKDNNIRIGS

SEQ ID NO: 375769 - protein, 10 aa, Influenza virus
KDNGIRIGSK

SEQ ID NO: 375770 - protein, 10 aa, Influenza virus
DNGIRIGSKG

SEQ ID NO: 375771 - protein, 10 aa, Influenza virus
NGIRIGSKGD

SEQ ID NO: 375772 - protein, 10 aa, Influenza virus
GIRIGSKGDV

SEQ ID NO: 375773 - protein, 10 aa, Influenza virus
RIGSRGDVFI

SEQ ID NO: 375774 - protein, 10 aa, Influenza virus
GDVFVTREPF

SEQ ID NO: 375775 - protein, 10 aa, Influenza virus
IREPFVSCSH

SEQ ID NO: 375776 - protein, 10 aa, Influenza virus
REPFISCSHS

SEQ ID NO: 375777 - protein, 10 aa, Influenza virus
EPFISCSHSE

SEQ ID NO: 375778 - protein, 10 aa, Influenza virus
PFVSCSHLEC

SEQ ID NO: 375779 - protein, 10 aa, Influenza virus
FISCSHSECR

SEQ ID NO: 375780 - protein, 10 aa, Influenza virus
VSCSHLECRT

SEQ ID NO: 375781 - protein, 10 aa, Influenza virus
SCSHSECRTF

SEQ ID NO: 375782 - protein, 10 aa, Influenza virus
CSHSECRTFF

SEQ ID NO: 375783 - protein, 10 aa, Influenza virus
SHSECRTFFL

SEQ ID NO: 375784 - protein, 10 aa, Influenza virus
HSECRTFFLT

SEQ ID NO: 375785 - protein, 10 aa, Influenza virus
SECRTFFLTQ

SEQ ID NO: 375786 - protein, 10 aa, Influenza virus
CRTFFLTHGA

SEQ ID NO: 375787 - protein, 10 aa, Influenza virus
RTFFLTHGAL

SEQ ID NO: 375788 - protein, 10 aa, Influenza virus
TFFLTHGALL

SEQ ID NO: 375789 - protein, 10 aa, Influenza virus
FFLTHGALLN

SEQ ID NO: 375790 - protein, 10 aa, Influenza virus
FLTHGALLND

SEQ ID NO: 375791 - protein, 10 aa, Influenza virus
LTHGALLNDK

SEQ ID NO: 375792 - protein, 10 aa, Influenza virus
THGALLNDKH

SEQ ID NO: 375793 - protein, 10 aa, Influenza virus
HGALLNDKHS

SEQ ID NO: 375794 - protein, 10 aa, Influenza virus
ALLNDKHSNE

SEQ ID NO: 375795 - protein, 10 aa, Influenza virus
LNDKHSNETV

SEQ ID NO: 375796 - protein, 10 aa, Influenza virus
KHSNETVKDR

SEQ ID NO: 375797 - protein, 10 aa, Influenza virus
HSNGTVNDRS

SEQ ID NO: 375798 - protein, 10 aa, Influenza virus
SNGTVNDRSP

SEQ ID NO: 375799 - protein, 10 aa, Influenza virus
KDRSPHRALM

SEQ ID NO: 375800 - protein, 10 aa, Influenza virus
DRSPHRALMS

SEQ ID NO: 375801 - protein, 10 aa, Influenza virus
RSPHRALMSC

SEQ ID NO: 375802 - protein, 10 aa, Influenza virus
SPHRALMSCP

SEQ ID NO: 375803 - protein, 10 aa, Influenza virus
GEVPSPYNSR

SEQ ID NO: 375804 - protein, 10 aa, Influenza virus
EVPSPYNSRF

SEQ ID NO: 375805 - protein, 10 aa, Influenza virus
VPSPYNSRFE

SEQ ID NO: 375806 - protein, 10 aa, Influenza virus
WSASACHDGS

SEQ ID NO: 375807 - protein, 10 aa, Influenza virus
SASACHDGTN

SEQ ID NO: 375808 - protein, 10 aa, Influenza virus
ASACHDGTNW

SEQ ID NO: 375809 - protein, 10 aa, Influenza virus
SACHDGTNWL

SEQ ID NO: 375810 - protein, 10 aa, Influenza virus
CHDGTNWLTI

SEQ ID NO: 375811 - protein, 10 aa, Influenza virus
SWLTIGVSGP

SEQ ID NO: 375812 - protein, 10 aa, Influenza virus
LTIGVSGPDN

SEQ ID NO: 375813 - protein, 10 aa, Influenza virus
IGISGPDSGA

SEQ ID NO: 375814 - protein, 10 aa, Influenza virus
GISGPDSGAV

SEQ ID NO: 375815 - protein, 10 aa, Influenza virus
ISGPDSGAVA

SEQ ID NO: 375816 - protein, 10 aa, Influenza virus
SGPDSGAVAV

SEQ ID NO: 375817 - protein, 10 aa, Influenza virus
GPDSGAVAVL

SEQ ID NO: 375818 - protein, 10 aa, Influenza virus
PDSGAVAVLK

SEQ ID NO: 375819 - protein, 10 aa, Influenza virus
DSGAVAVLKY

SEQ ID NO: 375820 - protein, 10 aa, Influenza virus
GAVAVVKYNG

SEQ ID NO: 375821 - protein, 10 aa, Influenza virus
KYDGIITDTI

SEQ ID NO: 375822 - protein, 10 aa, Influenza virus
GLITDTIKSW

SEQ ID NO: 375823 - protein, 10 aa, Influenza virus
NTLRTQESEC

SEQ ID NO: 375824 - protein, 10 aa, Influenza virus
TLRTQESECA

SEQ ID NO: 375825 - protein, 10 aa, Influenza virus
TQESECACAN

SEQ ID NO: 375826 - protein, 10 aa, Influenza virus
QESECACANG

SEQ ID NO: 375827 - protein, 10 aa, Influenza virus
GFCFTVMTDG

SEQ ID NO: 375828 - protein, 10 aa, Influenza virus
FCFTVMTDGP

SEQ ID NO: 375829 - protein, 10 aa, Influenza virus
CFTVMTDGPN

SEQ ID NO: 375830 - protein, 10 aa, Influenza virus
APNYYYEECS

SEQ ID NO: 375831 - protein, 10 aa, Influenza virus
PNYYYEECSC

SEQ ID NO: 375832 - protein, 10 aa, Influenza virus
YEECSCYPNA

SEQ ID NO: 375833 - protein, 10 aa, Influenza virus
EECSCYPDSG

SEQ ID NO: 375834 - protein, 10 aa, Influenza virus
ECSCYPDSGE

SEQ ID NO: 375835 - protein, 10 aa, Influenza virus
MCVCRDNWHG

SEQ ID NO: 375836 - protein, 10 aa, Influenza virus
NWHGSNRPWL

SEQ ID NO: 375837 - protein, 10 aa, Influenza virus
WHGSNRPWLS

SEQ ID NO: 375838 - protein, 10 aa, Influenza virus
HGSNRPWLSF

SEQ ID NO: 375839 - protein, 10 aa, Influenza virus
GSNRPWLSFN

SEQ ID NO: 375840 - protein, 10 aa, Influenza virus
IGYICSGFFG

SEQ ID NO: 375841 - protein, 10 aa, Influenza virus
GYICSGFFGD

SEQ ID NO: 375842 - protein, 10 aa, Influenza virus
YICSGVFGDT

SEQ ID NO: 375843 - protein, 10 aa, Influenza virus
ICSGVFGDTP

SEQ ID NO: 375844 - protein, 10 aa, Influenza virus
CSGVFGDTPR

SEQ ID NO: 375845 - protein, 10 aa, Influenza virus
SGVFGDTPRP

SEQ ID NO: 375846 - protein, 10 aa, Influenza virus
FGDSPRPNDG

SEQ ID NO: 375847 - protein, 10 aa, Influenza virus
GVKGFSFRYG

SEQ ID NO: 375848 - protein, 10 aa, Influenza virus
KGFAFKYGNG

SEQ ID NO: 375849 - protein, 10 aa, Influenza virus
FKYGDGVWIG

SEQ ID NO: 375850 - protein, 10 aa, Influenza virus
KYGNGAWIGR

SEQ ID NO: 375851 - protein, 10 aa, Influenza virus
YGDGVWIGRT

SEQ ID NO: 375852 - protein, 10 aa, Influenza virus
GDGVWIGRTK

SEQ ID NO: 375853 - protein, 10 aa, Influenza virus
NGAWIGRTKS

SEQ ID NO: 375854 - protein, 10 aa, Influenza virus
GVWIGRTKSI

SEQ ID NO: 375855 - protein, 10 aa, Influenza virus
SRSGFEIIWD

SEQ ID NO: 375856 - protein, 10 aa, Influenza virus
RSGFEIIWDP

SEQ ID NO: 375857 - protein, 10 aa, Influenza virus
SGFEMIWDPD

SEQ ID NO: 375858 - protein, 10 aa, Influenza virus
GFEMIWDPDG

SEQ ID NO: 375859 - protein, 10 aa, Influenza virus
FEMIWDPDGW

SEQ ID NO: 375860 - protein, 10 aa, Influenza virus
TTDWSGYSGS

SEQ ID NO: 375861 - protein, 10 aa, Influenza virus
SGSFVQHPEM

SEQ ID NO: 375862 - protein, 10 aa, Influenza virus
GSFVQHPEMT

SEQ ID NO: 375863 - protein, 10 aa, Influenza virus
SFVQHPEMTG

SEQ ID NO: 375864 - protein, 10 aa, Influenza virus
FVQHPEMTGL

SEQ ID NO: 375865 - protein, 10 aa, Influenza virus
IQHPELTGLN

SEQ ID NO: 375866 - protein, 10 aa, Influenza virus
QHPEMTGLDC

SEQ ID NO: 375867 - protein, 10 aa, Influenza virus
NCIRPCFWVE

SEQ ID NO: 375868 - protein, 10 aa, Influenza virus
CIKPCFWVEL

SEQ ID NO: 375869 - protein, 10 aa, Influenza virus
IRPCFWVELV

SEQ ID NO: 375870 - protein, 10 aa, Influenza virus
KPCFWVELIR

SEQ ID NO: 375871 - protein, 10 aa, Influenza virus
CFWVELVRGR

SEQ ID NO: 375872 - protein, 10 aa, Influenza virus
FWVELVRGRP

SEQ ID NO: 375873 - protein, 10 aa, Influenza virus
WVELVRGRPK

SEQ ID NO: 375874 - protein, 10 aa, Influenza virus
VELVRGRPKE

SEQ ID NO: 375875 - protein, 10 aa, Influenza virus
VWTSGSIISF

SEQ ID NO: 375876 - protein, 10 aa, Influenza virus
WASGSSISFC

SEQ ID NO: 375877 - protein, 10 aa, Influenza virus
ASGSSISFCG

SEQ ID NO: 375878 - protein, 10 aa, Influenza virus
GSSISFCGVD

SEQ ID NO: 375879 - protein, 10 aa, Influenza virus
SWPDGAELPS

SEQ ID NO: 375880 - protein, 10 aa, Influenza virus
DQICIGHHAN

SEQ ID NO: 375881 - protein, 10 aa, Influenza virus
RICVGYHANN

SEQ ID NO: 375882 - protein, 10 aa, Influenza virus
CIGHHANNST

SEQ ID NO: 375883 - protein, 10 aa, Influenza virus
IGHHANNSTE

SEQ ID NO: 375884 - protein, 10 aa, Influenza virus
GYHANNSKKQ

SEQ ID NO: 375885 - protein, 10 aa, Influenza virus
YHANNSTKQI

SEQ ID NO: 375886 - protein, 10 aa, Influenza virus
HANNSTKQID

SEQ ID NO: 375887 - protein, 10 aa, Influenza virus
ANNSTKQIDT

SEQ ID NO: 375888 - protein, 10 aa, Influenza virus
NNSTKQIDTI

SEQ ID NO: 375889 - protein, 10 aa, Influenza virus
QVDTIMERNV

SEQ ID NO: 375890 - protein, 10 aa, Influenza virus
DTIMEKNVIF

SEQ ID NO: 375891 - protein, 10 aa, Influenza virus
TIMEKNVIFT

SEQ ID NO: 375892 - protein, 10 aa, Influenza virus
EKNVTVTHAR

SEQ ID NO: 375893 - protein, 10 aa, Influenza virus
AGLVLGNPMC

SEQ ID NO: 375894 - protein, 10 aa, Influenza virus
TPEWSYIVEK

SEQ ID NO: 375895 - protein, 10 aa, Influenza virus
PEWSYIVEKA

SEQ ID NO: 375896 - protein, 10 aa, Influenza virus
EWSYIVEKNN

SEQ ID NO: 375897 - protein, 10 aa, Influenza virus
WSYIVEKNNP

SEQ ID NO: 375898 - protein, 10 aa, Influenza virus
PSFFRNVVWL

SEQ ID NO: 375899 - protein, 10 aa, Influenza virus
SFFRNVVWLV

SEQ ID NO: 375900 - protein, 10 aa, Influenza virus
FFRNVVWLVK

SEQ ID NO: 375901 - protein, 10 aa, Influenza virus
FRNVVWLVKK

SEQ ID NO: 375902 - protein, 10 aa, Influenza virus
IATRPRVNGQ

SEQ ID NO: 375903 - protein, 10 aa, Influenza virus
NFIAPEYAFK

SEQ ID NO: 375904 - protein, 10 aa, Influenza virus
FIAPEYAYRI

SEQ ID NO: 375905 - protein, 10 aa, Influenza virus
YGNCNAKCQT

SEQ ID NO: 375906 - protein, 10 aa, Influenza virus
GNCNAKCQTP

SEQ ID NO: 375907 - protein, 10 aa, Influenza virus
KTRGLFGAIA

SEQ ID NO: 375908 - protein, 10 aa, Influenza virus
FIEGGWQGLV

SEQ ID NO: 375909 - protein, 10 aa, Influenza virus
IEGGWQGLVD

SEQ ID NO: 375910 - protein, 10 aa, Influenza virus
EGGWQGLVDG

SEQ ID NO: 375911 - protein, 10 aa, Influenza virus
GGWQGLVDGW

SEQ ID NO: 375912 - protein, 10 aa, Influenza virus
GWQGLVDGWY

SEQ ID NO: 375913 - protein, 10 aa, Influenza virus
WQGLVDGWYG

SEQ ID NO: 375914 - protein, 10 aa, Influenza virus
QGLVDGWYGY

SEQ ID NO: 375915 - protein, 10 aa, Influenza virus
GLVDGWYGYH

SEQ ID NO: 375916 - protein, 10 aa, Influenza virus
LVDGWYGYHH

SEQ ID NO: 375917 - protein, 10 aa, Influenza virus
VDGWYGYHHI

SEQ ID NO: 375918 - protein, 10 aa, Influenza virus
DGWYGYHHTN

SEQ ID NO: 375919 - protein, 10 aa, Influenza virus
GSGYAADRKS

SEQ ID NO: 375920 - protein, 10 aa, Influenza virus
SGYAADRKST

SEQ ID NO: 375921 - protein, 10 aa, Influenza virus
GYAADRKSTQ

SEQ ID NO: 375922 - protein, 10 aa, Influenza virus
YAADKESTQR

SEQ ID NO: 375923 - protein, 10 aa, Influenza virus
AADKESTQRA

SEQ ID NO: 375924 - protein, 10 aa, Influenza virus
STQRAIDGIT

SEQ ID NO: 375925 - protein, 10 aa, Influenza virus
VWTYNAELFV

SEQ ID NO: 375926 - protein, 10 aa, Influenza virus
WTYNTELLVL

SEQ ID NO: 375927 - protein, 10 aa, Influenza virus
TYNTELLVLM

SEQ ID NO: 375928 - protein, 10 aa, Influenza virus
YNTELLVLME

SEQ ID NO: 375929 - protein, 10 aa, Influenza virus
NTELLVLMEN

SEQ ID NO: 375930 - protein, 10 aa, Influenza virus
AELFVLMENE

SEQ ID NO: 375931 - protein, 10 aa, Influenza virus
ELLVLIENER

SEQ ID NO: 375932 - protein, 10 aa, Influenza virus
LFVLMENERT

SEQ ID NO: 375933 - protein, 10 aa, Influenza virus
LVLIENERTL

SEQ ID NO: 375934 - protein, 10 aa, Influenza virus
VLIENERTLD

SEQ ID NO: 375935 - protein, 10 aa, Influenza virus
LMENERTLYF

SEQ ID NO: 375936 - protein, 10 aa, Influenza virus
MENERTLYFH

SEQ ID NO: 375937 - protein, 10 aa, Influenza virus
ENERTLYFHD

SEQ ID NO: 375938 - protein, 10 aa, Influenza virus
NERTLYFHDS

SEQ ID NO: 375939 - protein, 10 aa, Influenza virus
ERTLYFHDSN

SEQ ID NO: 375940 - protein, 10 aa, Influenza virus
RTLYFHDSNV

SEQ ID NO: 375941 - protein, 10 aa, Influenza virus
TLDFHDSNVR

SEQ ID NO: 375942 - protein, 10 aa, Influenza virus
LDFHDSNVRN

SEQ ID NO: 375943 - protein, 10 aa, Influenza virus
DFHDSNVRNL

SEQ ID NO: 375944 - protein, 10 aa, Influenza virus
FHDSNVRNLY

SEQ ID NO: 375945 - protein, 10 aa, Influenza virus
HDSNVKNLYN

SEQ ID NO: 375946 - protein, 10 aa, Influenza virus
DSNVKNLYNK

SEQ ID NO: 375947 - protein, 10 aa, Influenza virus
SNVKNLYNKV

SEQ ID NO: 375948 - protein, 10 aa, Influenza virus
NVKNLYNKVR

SEQ ID NO: 375949 - protein, 10 aa, Influenza virus
NLYDKVRHQL

SEQ ID NO: 375950 - protein, 10 aa, Influenza virus
DNAKEMGNGC

SEQ ID NO: 375951 - protein, 10 aa, Influenza virus
NAKEMGNGCF

SEQ ID NO: 375952 - protein, 10 aa, Influenza virus
AKEMGNGCFE

SEQ ID NO: 375953 - protein, 10 aa, Influenza virus
KEMGNGCFEF

SEQ ID NO: 375954 - protein, 10 aa, Influenza virus
EWGNGCFEFY

SEQ ID NO: 375955 - protein, 10 aa, Influenza virus
WGNGCFEFYH

SEQ ID NO: 375956 - protein, 10 aa, Influenza virus
GCFEFYHKCN

SEQ ID NO: 375957 - protein, 10 aa, Influenza virus
KCMESVRNGT

SEQ ID NO: 375958 - protein, 10 aa, Influenza virus
CIESVRNGTY

SEQ ID NO: 375959 - protein, 10 aa, Influenza virus
ESVKNGTYDY

SEQ ID NO: 375960 - protein, 10 aa, Influenza virus
ILSIYSSVAS

SEQ ID NO: 375961 - protein, 10 aa, Influenza virus
LSIYSSVASS

SEQ ID NO: 375962 - protein, 10 aa, Influenza virus
SIYSSVASSL

SEQ ID NO: 375963 - protein, 10 aa, Influenza virus
LAIMMAGLSF

SEQ ID NO: 375964 - protein, 10 aa, Influenza virus
AIMMAGLSFW

SEQ ID NO: 375965 - protein, 10 aa, Influenza virus
MAGLSFWMCS

SEQ ID NO: 375966 - protein, 10 aa, Influenza virus
LSLCMCSNGS

SEQ ID NO: 375967 - protein, 10 aa, Influenza virus
SFWRCSNGSL

SEQ ID NO: 375968 - protein, 10 aa, Influenza virus
CSNGSLQCRV

SEQ ID NO: 375969 - protein, 10 aa, Influenza virus
SNGSLQCTIC

SEQ ID NO: 375970 - protein, 10 aa, Influenza virus
NGSLQCRVCI

SEQ ID NO: 375971 - protein, 10 aa, Influenza virus
KPQCQIAGFA

SEQ ID NO: 375972 - protein, 10 aa, Influenza virus
PQCQIAGFAP

SEQ ID NO: 375973 - protein, 10 aa, Influenza virus
QCQIAGFAPF

SEQ ID NO: 375974 - protein, 10 aa, Influenza virus
IAGFAPFSKD

SEQ ID NO: 375975 - protein, 10 aa, Influenza virus
SKDNSVRLSA

SEQ ID NO: 375976 - protein, 10 aa, Influenza virus
ITREPYVSCD

SEQ ID NO: 375977 - protein, 10 aa, Influenza virus
FALGQGTPLN

SEQ ID NO: 375978 - protein, 10 aa, Influenza virus
RHSNGTIHDR

SEQ ID NO: 375979 - protein, 10 aa, Influenza virus
HSNGTIHDRS

SEQ ID NO: 375980 - protein, 10 aa, Influenza virus
SYRTLLMNEL

SEQ ID NO: 375981 - protein, 10 aa, Influenza virus
YRTLLMNELG

SEQ ID NO: 375982 - protein, 10 aa, Influenza virus
RTLLMNELGI

SEQ ID NO: 375983 - protein, 10 aa, Influenza virus
TLLMNELGIP

SEQ ID NO: 375984 - protein, 10 aa, Influenza virus
LLMNELGIPF

SEQ ID NO: 375985 - protein, 10 aa, Influenza virus
LMNELGIPFH

SEQ ID NO: 375986 - protein, 10 aa, Influenza virus
MNELGIPFHL

SEQ ID NO: 375987 - protein, 10 aa, Influenza virus
NELGIPFHLG

SEQ ID NO: 375988 - protein, 10 aa, Influenza virus
LGIPFHLGTK

SEQ ID NO: 375989 - protein, 10 aa, Influenza virus
GIPFHLGTKQ

SEQ ID NO: 375990 - protein, 10 aa, Influenza virus
IPFHLGTKQV

SEQ ID NO: 375991 - protein, 10 aa, Influenza virus
FHLGTKQVCM

SEQ ID NO: 375992 - protein, 10 aa, Influenza virus
HLGTKQVCMA

SEQ ID NO: 375993 - protein, 10 aa, Influenza virus
LGTKQVCMAW

SEQ ID NO: 375994 - protein, 10 aa, Influenza virus
GTKQVCMAWS

SEQ ID NO: 375995 - protein, 10 aa, Influenza virus
TKQVCMAWSS

SEQ ID NO: 375996 - protein, 10 aa, Influenza virus
KQVCMAWSSS

SEQ ID NO: 375997 - protein, 10 aa, Influenza virus
QVCVAWSSSS

SEQ ID NO: 375998 - protein, 10 aa, Influenza virus
VCVAWSSSSC

SEQ ID NO: 375999 - protein, 10 aa, Influenza virus
CVAWSSSSCH

SEQ ID NO: 376000 - protein, 10 aa, Influenza virus
VAWSSSSCHD

SEQ ID NO: 376001 - protein, 10 aa, Influenza virus
AWSSSSCYDG

SEQ ID NO: 376002 - protein, 10 aa, Influenza virus
WSSSSCHDGN

SEQ ID NO: 376003 - protein, 10 aa, Influenza virus
SSSSCHDGNA

SEQ ID NO: 376004 - protein, 10 aa, Influenza virus
SSSCHDGNAW

SEQ ID NO: 376005 - protein, 10 aa, Influenza virus
SSCHDGNAWL

SEQ ID NO: 376006 - protein, 10 aa, Influenza virus
SCHDGNAWLH

SEQ ID NO: 376007 - protein, 10 aa, Influenza virus
CHDGNAWLHV

SEQ ID NO: 376008 - protein, 10 aa, Influenza virus
HDGNAWLHVC

SEQ ID NO: 376009 - protein, 10 aa, Influenza virus
AWLHVCITGD

SEQ ID NO: 376010 - protein, 10 aa, Influenza virus
WLHVCITGDD

SEQ ID NO: 376011 - protein, 10 aa, Influenza virus
SWSLNILRTQ

SEQ ID NO: 376012 - protein, 10 aa, Influenza virus
WSQNILRTHE

SEQ ID NO: 376013 - protein, 10 aa, Influenza virus
SQNILRTQEP

SEQ ID NO: 376014 - protein, 10 aa, Influenza virus
RTQESECICI

SEQ ID NO: 376015 - protein, 10 aa, Influenza virus
TQESECVCID

SEQ ID NO: 376016 - protein, 10 aa, Influenza virus
CTVIMTDGSA

SEQ ID NO: 376017 - protein, 10 aa, Influenza virus
TVIMTDGSAS

SEQ ID NO: 376018 - protein, 10 aa, Influenza virus
VVMTDGNASG

SEQ ID NO: 376019 - protein, 10 aa, Influenza virus
GNAQHIEECS

SEQ ID NO: 376020 - protein, 10 aa, Influenza virus
SAQATEECSR

SEQ ID NO: 376021 - protein, 10 aa, Influenza virus
VRCICRDNWK

SEQ ID NO: 376022 - protein, 10 aa, Influenza virus
RCVCRDNWMG

SEQ ID NO: 376023 - protein, 10 aa, Influenza virus
CVCRDNWMGS

SEQ ID NO: 376024 - protein, 10 aa, Influenza virus
VCRDNWMGSN

SEQ ID NO: 376025 - protein, 10 aa, Influenza virus
DNWMGSNRPV

SEQ ID NO: 376026 - protein, 10 aa, Influenza virus
SRYICSGLVG

SEQ ID NO: 376027 - protein, 10 aa, Influenza virus
RYICSGLVGD

SEQ ID NO: 376028 - protein, 10 aa, Influenza virus
VGDTPRNNDS

SEQ ID NO: 376029 - protein, 10 aa, Influenza virus
SNSNCRDPNN

SEQ ID NO: 376030 - protein, 10 aa, Influenza virus
NSNCRDPNNE

SEQ ID NO: 376031 - protein, 10 aa, Influenza virus
SNCRDPNNES

SEQ ID NO: 376032 - protein, 10 aa, Influenza virus
GSQGVKGWAF

SEQ ID NO: 376033 - protein, 10 aa, Influenza virus
SQGVKGWAFD

SEQ ID NO: 376034 - protein, 10 aa, Influenza virus
SRDSRSGYET

SEQ ID NO: 376035 - protein, 10 aa, Influenza virus
RDSRSGYETF

SEQ ID NO: 376036 - protein, 10 aa, Influenza virus
RSGYETFRVT

SEQ ID NO: 376037 - protein, 10 aa, Influenza virus
NRSGYSGIFS

SEQ ID NO: 376038 - protein, 10 aa, Influenza virus
WSGYSGIFSI

SEQ ID NO: 376039 - protein, 10 aa, Influenza virus
SGYSGIFSIE

SEQ ID NO: 376040 - protein, 10 aa, Influenza virus
SCVNRCFYVE

SEQ ID NO: 376041 - protein, 10 aa, Influenza virus
YVEMIRGRPK

SEQ ID NO: 376042 - protein, 10 aa, Influenza virus
VELTRGRPQE

SEQ ID NO: 376043 - protein, 10 aa, Influenza virus
RVWWTTNSIV

SEQ ID NO: 376044 - protein, 10 aa, Influenza virus
VWWTTNSIVV

SEQ ID NO: 376045 - protein, 10 aa, Influenza virus
WWTTNSIVVF

SEQ ID NO: 376046 - protein, 10 aa, Influenza virus
WTTNSIVVFC

SEQ ID NO: 376047 - protein, 10 aa, Influenza virus
TTNSIVVFCG

SEQ ID NO: 376048 - protein, 10 aa, Influenza virus
TNSIVVFCGT

SEQ ID NO: 376049 - protein, 10 aa, Influenza virus
SWPDGADINF

SEQ ID NO: 376050 - protein, 10 aa, Influenza virus
WPDGADINFM

SEQ ID NO: 376051 - protein, 10 aa, Influenza virus
PDGANINFMA

SEQ ID NO: 376052 - protein, 10 aa, Influenza virus
KSDRICIGYH

SEQ ID NO: 376053 - protein, 10 aa, Influenza virus
SHKICIGYHA

SEQ ID NO: 376054 - protein, 10 aa, Influenza virus
HKICIGYHAN

SEQ ID NO: 376055 - protein, 10 aa, Influenza virus
YHANNSTTQI

SEQ ID NO: 376056 - protein, 10 aa, Influenza virus
HANNSTTQVN

SEQ ID NO: 376057 - protein, 10 aa, Influenza virus
ANNSTTQVNT

SEQ ID NO: 376058 - protein, 10 aa, Influenza virus
NNSTTQVDTL

SEQ ID NO: 376059 - protein, 10 aa, Influenza virus
VDTILERNVT

SEQ ID NO: 376060 - protein, 10 aa, Influenza virus
DTILERNVTV

SEQ ID NO: 376061 - protein, 10 aa, Influenza virus
TILERNVTVT

SEQ ID NO: 376062 - protein, 10 aa, Influenza virus
ILERNVTVTH

SEQ ID NO: 376063 - protein, 10 aa, Influenza virus
LEKNITVTHS

SEQ ID NO: 376064 - protein, 10 aa, Influenza virus
ERNVTVTHSV

SEQ ID NO: 376065 - protein, 10 aa, Influenza virus
RNVTVTHSVE

SEQ ID NO: 376066 - protein, 10 aa, Influenza virus
NITVTHSVEL

SEQ ID NO: 376067 - protein, 10 aa, Influenza virus
ITVTHSVELL

SEQ ID NO: 376068 - protein, 10 aa, Influenza virus
VTHSIELLEN

SEQ ID NO: 376069 - protein, 10 aa, Influenza virus
DGWILGNPQC

SEQ ID NO: 376070 - protein, 10 aa, Influenza virus
GWILGNPRCG

SEQ ID NO: 376071 - protein, 10 aa, Influenza virus
SSFYRNLVWI

SEQ ID NO: 376072 - protein, 10 aa, Influenza virus
VLYFWGIHHP

SEQ ID NO: 376073 - protein, 10 aa, Influenza virus
WSVLRPGETL

SEQ ID NO: 376074 - protein, 10 aa, Influenza virus
LKPGETLKVE

SEQ ID NO: 376075 - protein, 10 aa, Influenza virus
KPGETLKVES

SEQ ID NO: 376076 - protein, 10 aa, Influenza virus
PGETLNIESN

SEQ ID NO: 376077 - protein, 10 aa, Influenza virus
GETLNIESNG

SEQ ID NO: 376078 - protein, 10 aa, Influenza virus
ETLNIESNGN

SEQ ID NO: 376079 - protein, 10 aa, Influenza virus
TLNIESNGNL

SEQ ID NO: 376080 - protein, 10 aa, Influenza virus
LKVESNGNLI

SEQ ID NO: 376081 - protein, 10 aa, Influenza virus
KVESNGNLIA

SEQ ID NO: 376082 - protein, 10 aa, Influenza virus
IESNGNLIAP

SEQ ID NO: 376083 - protein, 10 aa, Influenza virus
GNLIAPWYAF

SEQ ID NO: 376084 - protein, 10 aa, Influenza virus
NLVAPWYAYK

SEQ ID NO: 376085 - protein, 10 aa, Influenza virus
TNRTFQNVSP

SEQ ID NO: 376086 - protein, 10 aa, Influenza virus
NKTFQNVSPV

SEQ ID NO: 376087 - protein, 10 aa, Influenza virus
KTFQNVSPVW

SEQ ID NO: 376088 - protein, 10 aa, Influenza virus
FQNVSPVWIG

SEQ ID NO: 376089 - protein, 10 aa, Influenza virus
NLKLATGLRN

SEQ ID NO: 376090 - protein, 10 aa, Influenza virus
LRLATGLRNI

SEQ ID NO: 376091 - protein, 10 aa, Influenza virus
RLATGLRNIP

SEQ ID NO: 376092 - protein, 10 aa, Influenza virus
LATGLRNVPK

SEQ ID NO: 376093 - protein, 10 aa, Influenza virus
NRGLFGAIAG

SEQ ID NO: 376094 - protein, 10 aa, Influenza virus
FIEGGWTGLI

SEQ ID NO: 376095 - protein, 10 aa, Influenza virus
IEGGWTGLID

SEQ ID NO: 376096 - protein, 10 aa, Influenza virus
EGGWTGLIDG

SEQ ID NO: 376097 - protein, 10 aa, Influenza virus
GGWTGLIDGW

SEQ ID NO: 376098 - protein, 10 aa, Influenza virus
GWTGLIDGWY

SEQ ID NO: 376099 - protein, 10 aa, Influenza virus
WTGLIDGWYG

SEQ ID NO: 376100 - protein, 10 aa, Influenza virus
TGLIDGWYGY

SEQ ID NO: 376101 - protein, 10 aa, Influenza virus
GLIDGWYGYH

SEQ ID NO: 376102 - protein, 10 aa, Influenza virus
LIDGWYGYHH

SEQ ID NO: 376103 - protein, 10 aa, Influenza virus
YAADRESTQR

SEQ ID NO: 376104 - protein, 10 aa, Influenza virus
AADRESTQRA

SEQ ID NO: 376105 - protein, 10 aa, Influenza virus
HEFSNLEKRI

SEQ ID NO: 376106 - protein, 10 aa, Influenza virus
DGFMDVWTYN

SEQ ID NO: 376107 - protein, 10 aa, Influenza virus
GFMDVWTYNA

SEQ ID NO: 376108 - protein, 10 aa, Influenza virus
FMDVWTYNAE

SEQ ID NO: 376109 - protein, 10 aa, Influenza virus
MDVWTYNAEL

SEQ ID NO: 376110 - protein, 10 aa, Influenza virus
GVWTYNAELL

SEQ ID NO: 376111 - protein, 10 aa, Influenza virus
NAELLVLLED

SEQ ID NO: 376112 - protein, 10 aa, Influenza virus
AELLVLLENG

SEQ ID NO: 376113 - protein, 10 aa, Influenza virus
ELLVLLENGR

SEQ ID NO: 376114 - protein, 10 aa, Influenza virus
LLVLLENGRT

SEQ ID NO: 376115 - protein, 10 aa, Influenza virus
LVLLENGRTL

SEQ ID NO: 376116 - protein, 10 aa, Influenza virus
VLLENGRTLD

SEQ ID NO: 376117 - protein, 10 aa, Influenza virus
ENGRTLDMHD

SEQ ID NO: 376118 - protein, 10 aa, Influenza virus
NGRTLDMHDA

SEQ ID NO: 376119 - protein, 10 aa, Influenza virus
GRTLDMHDAN

SEQ ID NO: 376120 - protein, 10 aa, Influenza virus
RTLDQHDANV

SEQ ID NO: 376121 - protein, 10 aa, Influenza virus
TLDLHDANVR

SEQ ID NO: 376122 - protein, 10 aa, Influenza virus
LKDNAKDLGN

SEQ ID NO: 376123 - protein, 10 aa, Influenza virus
KDNAKDLGNG

SEQ ID NO: 376124 - protein, 10 aa, Influenza virus
CFEFWHKCNN

SEQ ID NO: 376125 - protein, 10 aa, Influenza virus
FEFWHKCDND

SEQ ID NO: 376126 - protein, 10 aa, Influenza virus
EFWHKCDNDC

SEQ ID NO: 376127 - protein, 10 aa, Influenza virus
KKGTYDYPKY

SEQ ID NO: 376128 - protein, 10 aa, Influenza virus
NGTYNYPKYH

SEQ ID NO: 376129 - protein, 10 aa, Influenza virus
GIYQILAIYS

SEQ ID NO: 376130 - protein, 10 aa, Influenza virus
VYQILSIYST

SEQ ID NO: 376131 - protein, 10 aa, Influenza virus
LSIYSTVSSS

SEQ ID NO: 376132 - protein, 10 aa, Influenza virus
SIYSTVSSSL

SEQ ID NO: 376133 - protein, 10 aa, Influenza virus
STVSSGLVLV

SEQ ID NO: 376134 - protein, 10 aa, Influenza virus
TVSSGLVLVG

SEQ ID NO: 376135 - protein, 10 aa, Influenza virus
ISSSLVLMGL

SEQ ID NO: 376136 - protein, 10 aa, Influenza virus
SSSLVLMGLI

SEQ ID NO: 376137 - protein, 10 aa, Influenza virus
WMCLNGSMQC

SEQ ID NO: 376138 - protein, 10 aa, Influenza virus
MCSNGSMQCN

SEQ ID NO: 376139 - protein, 10 aa, Influenza virus
NGSMQCNVCI

SEQ ID NO: 376140 - protein, 10 aa, Influenza virus
SKSRGYKMNI

SEQ ID NO: 376141 - protein, 10 aa, Influenza virus
KSRGYKMNTR

SEQ ID NO: 376142 - protein, 10 aa, Influenza virus
SRGYKMNTRI

SEQ ID NO: 376143 - protein, 10 aa, Influenza virus
RGYKMNTRIL

SEQ ID NO: 376144 - protein, 10 aa, Influenza virus
TLTEKGIEVV

SEQ ID NO: 376145 - protein, 10 aa, Influenza virus
LTEKGIEVVN

SEQ ID NO: 376146 - protein, 10 aa, Influenza virus
TEKGIEVVNA

SEQ ID NO: 376147 - protein, 10 aa, Influenza virus
EKGIEVVNAT

SEQ ID NO: 376148 - protein, 10 aa, Influenza virus
KGIEVVNATE

SEQ ID NO: 376149 - protein, 10 aa, Influenza virus
GVEVVDATET

SEQ ID NO: 376150 - protein, 10 aa, Influenza virus
VEVVDATETV

SEQ ID NO: 376151 - protein, 10 aa, Influenza virus
VVNATETVEQ

SEQ ID NO: 376152 - protein, 10 aa, Influenza virus
GPPQCDRFLE

SEQ ID NO: 376153 - protein, 10 aa, Influenza virus
PPQCDRFLEF

SEQ ID NO: 376154 - protein, 10 aa, Influenza virus
SSFYAEMEWL

SEQ ID NO: 376155 - protein, 10 aa, Influenza virus
YAEMEWLLSN

SEQ ID NO: 376156 - protein, 10 aa, Influenza virus
GQFGRINFHW

SEQ ID NO: 376157 - protein, 10 aa, Influenza virus
FSFNGAFVAP

SEQ ID NO: 376158 - protein, 10 aa, Influenza virus
FNGAFVAPDR

SEQ ID NO: 376159 - protein, 10 aa, Influenza virus
NGAFIAPNRA

SEQ ID NO: 376160 - protein, 10 aa, Influenza virus
GAFIAPNRAS

SEQ ID NO: 376161 - protein, 10 aa, Influenza virus
AFIAPNRASF

SEQ ID NO: 376162 - protein, 10 aa, Influenza virus
SLMLATGMKN

SEQ ID NO: 376163 - protein, 10 aa, Influenza virus
LMLATGMKNV

SEQ ID NO: 376164 - protein, 10 aa, Influenza virus
MLATGMKNVP

SEQ ID NO: 376165 - protein, 10 aa, Influenza virus
LATGMRNIPE

SEQ ID NO: 376166 - protein, 10 aa, Influenza virus
IHKQLTHHMR

SEQ ID NO: 376167 - protein, 10 aa, Influenza virus
RKTRGLFGAI

SEQ ID NO: 376168 - protein, 10 aa, Influenza virus
KTRGLFGAIA

SEQ ID NO: 376169 - protein, 10 aa, Influenza virus
KRGLFGAIAG

SEQ ID NO: 376170 - protein, 10 aa, Influenza virus
IENGWEGLVD

SEQ ID NO: 376171 - protein, 10 aa, Influenza virus
ENGWEGLVDG

SEQ ID NO: 376172 - protein, 10 aa, Influenza virus
NGWEGLVDGW

SEQ ID NO: 376173 - protein, 10 aa, Influenza virus
GWEGLVDGWY

SEQ ID NO: 376174 - protein, 10 aa, Influenza virus
WEGLVDGWYG

SEQ ID NO: 376175 - protein, 10 aa, Influenza virus
EGLVDGWYGF

SEQ ID NO: 376176 - protein, 10 aa, Influenza virus
GLVDGWYGFR

SEQ ID NO: 376177 - protein, 10 aa, Influenza virus
LVDGWYGFRH

SEQ ID NO: 376178 - protein, 10 aa, Influenza virus
VDGWYGFRHQ

SEQ ID NO: 376179 - protein, 10 aa, Influenza virus
DGWYGYRHQN

SEQ ID NO: 376180 - protein, 10 aa, Influenza virus
GWYGFRHQNS

SEQ ID NO: 376181 - protein, 10 aa, Influenza virus
WYGFRHQNSQ

SEQ ID NO: 376182 - protein, 10 aa, Influenza virus
YGFRHQNSQG

SEQ ID NO: 376183 - protein, 10 aa, Influenza virus
GFRHQNSQGE

SEQ ID NO: 376184 - protein, 10 aa, Influenza virus
FRHQNSQGEG

SEQ ID NO: 376185 - protein, 10 aa, Influenza virus
KHQNAQGEGT

SEQ ID NO: 376186 - protein, 10 aa, Influenza virus
HQNSQGEGTA

SEQ ID NO: 376187 - protein, 10 aa, Influenza virus
QNSQGEGTAA

SEQ ID NO: 376188 - protein, 10 aa, Influenza virus
NSQGEGTAAD

SEQ ID NO: 376189 - protein, 10 aa, Influenza virus
SQGEGTAADY

SEQ ID NO: 376190 - protein, 10 aa, Influenza virus
DYKSTQSAVD

SEQ ID NO: 376191 - protein, 10 aa, Influenza virus
YKSTQSAVDQ

SEQ ID NO: 376192 - protein, 10 aa, Influenza virus
KSTQSAINQI

SEQ ID NO: 376193 - protein, 10 aa, Influenza virus
STQSAINQIT

SEQ ID NO: 376194 - protein, 10 aa, Influenza virus
TQSAINQITG

SEQ ID NO: 376195 - protein, 10 aa, Influenza virus
QSAINQITGK

SEQ ID NO: 376196 - protein, 10 aa, Influenza virus
SAINQITGKL

SEQ ID NO: 376197 - protein, 10 aa, Influenza virus
AINQITGKLN

SEQ ID NO: 376198 - protein, 10 aa, Influenza virus
INQITGKLNR

SEQ ID NO: 376199 - protein, 10 aa, Influenza virus
NQITGKLNRL

SEQ ID NO: 376200 - protein, 10 aa, Influenza virus
QITGKLNRII

SEQ ID NO: 376201 - protein, 10 aa, Influenza virus
ERQIGNVINW

SEQ ID NO: 376202 - protein, 10 aa, Influenza virus
RQIGNVINWT

SEQ ID NO: 376203 - protein, 10 aa, Influenza virus
QLGNVINWTR

SEQ ID NO: 376204 - protein, 10 aa, Influenza virus
LGNVINWTRD

SEQ ID NO: 376205 - protein, 10 aa, Influenza virus
GNVINWTQDA

SEQ ID NO: 376206 - protein, 10 aa, Influenza virus
WSYNAELLIA

SEQ ID NO: 376207 - protein, 10 aa, Influenza virus
AELLIAMENQ

SEQ ID NO: 376208 - protein, 10 aa, Influenza virus
ELLIAMENQH

SEQ ID NO: 376209 - protein, 10 aa, Influenza virus
LLIAMENQHT

SEQ ID NO: 376210 - protein, 10 aa, Influenza virus
LIAMENQHTI

SEQ ID NO: 376211 - protein, 10 aa, Influenza virus
IAMENQHTID

SEQ ID NO: 376212 - protein, 10 aa, Influenza virus
ALENQHTIDL

SEQ ID NO: 376213 - protein, 10 aa, Influenza virus
VENQHTIDLT

SEQ ID NO: 376214 - protein, 10 aa, Influenza virus
ENQHIIDLAD

SEQ ID NO: 376215 - protein, 10 aa, Influenza virus
NQHIIDLADS

SEQ ID NO: 376216 - protein, 10 aa, Influenza virus
QHIIDLADSE

SEQ ID NO: 376217 - protein, 10 aa, Influenza virus
HIIDLADSEM

SEQ ID NO: 376218 - protein, 10 aa, Influenza virus
SEMNKLYEKV

SEQ ID NO: 376219 - protein, 10 aa, Influenza virus
VRRQLRENAE

SEQ ID NO: 376220 - protein, 10 aa, Influenza virus
RRQLRENAEE

SEQ ID NO: 376221 - protein, 10 aa, Influenza virus
RLLRENAEED

SEQ ID NO: 376222 - protein, 10 aa, Influenza virus
EDGTGCFEIL

SEQ ID NO: 376223 - protein, 10 aa, Influenza virus
GTGCFEILHK

SEQ ID NO: 376224 - protein, 10 aa, Influenza virus
CFEIFHKCDN

SEQ ID NO: 376225 - protein, 10 aa, Influenza virus
CMASIRNSTY

SEQ ID NO: 376226 - protein, 10 aa, Influenza virus
MESIRNNTYN

SEQ ID NO: 376227 - protein, 10 aa, Influenza virus
ESIRNNTYNH

SEQ ID NO: 376228 - protein, 10 aa, Influenza virus
SGYKEVILWF

SEQ ID NO: 376229 - protein, 10 aa, Influenza virus
GYKEVILWFS

SEQ ID NO: 376230 - protein, 10 aa, Influenza virus
YKEVILWFSF

SEQ ID NO: 376231 - protein, 10 aa, Influenza virus
KEVILWFSFG

SEQ ID NO: 376232 - protein, 10 aa, Influenza virus
EVILWFSFGA

SEQ ID NO: 376233 - protein, 10 aa, Influenza virus
WFSFGASCLI

SEQ ID NO: 376234 - protein, 10 aa, Influenza virus
FSFGASCFLF

SEQ ID NO: 376235 - protein, 10 aa, Influenza virus
RNGNMRCTIC

SEQ ID NO: 376236 - protein, 10 aa, Influenza virus
TNADKICLGH

SEQ ID NO: 376237 - protein, 10 aa, Influenza virus
RGDKICLGHH

SEQ ID NO: 376238 - protein, 10 aa, Influenza virus
HAVSNGTKIN

SEQ ID NO: 376239 - protein, 10 aa, Influenza virus
AVSNGTKINT

SEQ ID NO: 376240 - protein, 10 aa, Influenza virus
VSNGTKINTL

SEQ ID NO: 376241 - protein, 10 aa, Influenza virus
SNGTKINTLT

SEQ ID NO: 376242 - protein, 10 aa, Influenza virus
GTKINTLTER

SEQ ID NO: 376243 - protein, 10 aa, Influenza virus
TKINTLTERG

SEQ ID NO: 376244 - protein, 10 aa, Influenza virus
KVNTLTERGV

SEQ ID NO: 376245 - protein, 10 aa, Influenza virus
VNTLTERGVE

SEQ ID NO: 376246 - protein, 10 aa, Influenza virus
NTLTERGVEV

SEQ ID NO: 376247 - protein, 10 aa, Influenza virus
TLTERGVEVV

SEQ ID NO: 376248 - protein, 10 aa, Influenza virus
LTERGVEVVN

SEQ ID NO: 376249 - protein, 10 aa, Influenza virus
TERGVEVVNA

SEQ ID NO: 376250 - protein, 10 aa, Influenza virus
ERGVEVVNAT

SEQ ID NO: 376251 - protein, 10 aa, Influenza virus
RGVEVVNATE

SEQ ID NO: 376252 - protein, 10 aa, Influenza virus
VNATETVERT

SEQ ID NO: 376253 - protein, 10 aa, Influenza virus
DLGQCGLLGI

SEQ ID NO: 376254 - protein, 10 aa, Influenza virus
CGLLGTITGP

SEQ ID NO: 376255 - protein, 10 aa, Influenza virus
GLLGTITGPP

SEQ ID NO: 376256 - protein, 10 aa, Influenza virus
IGPPQCDKFL

SEQ ID NO: 376257 - protein, 10 aa, Influenza virus
GPPHCDQFLE

SEQ ID NO: 376258 - protein, 10 aa, Influenza virus
PPHCDQFLEF

SEQ ID NO: 376259 - protein, 10 aa, Influenza virus
SDLIIERKEG

SEQ ID NO: 376260 - protein, 10 aa, Influenza virus
DLIIERREGA

SEQ ID NO: 376261 - protein, 10 aa, Influenza virus
LIIERKEGTD

SEQ ID NO: 376262 - protein, 10 aa, Influenza virus
CYPGKFVNEE

SEQ ID NO: 376263 - protein, 10 aa, Influenza virus
FVNGEALRQI

SEQ ID NO: 376264 - protein, 10 aa, Influenza virus
NGEALRQILR

SEQ ID NO: 376265 - protein, 10 aa, Influenza virus
LRQILRESGG

SEQ ID NO: 376266 - protein, 10 aa, Influenza virus
RQILRESGGI

SEQ ID NO: 376267 - protein, 10 aa, Influenza virus
GFIYSGIRTN

SEQ ID NO: 376268 - protein, 10 aa, Influenza virus
FIYSGIRTNG

SEQ ID NO: 376269 - protein, 10 aa, Influenza virus
TYSGIRTNGT

SEQ ID NO: 376270 - protein, 10 aa, Influenza virus
RSGSSFYAEL

SEQ ID NO: 376271 - protein, 10 aa, Influenza virus
SSSSFYAEMK

SEQ ID NO: 376272 - protein, 10 aa, Influenza virus
SSSFYAEMKW

SEQ ID NO: 376273 - protein, 10 aa, Influenza virus
AEMKWLLSSS

SEQ ID NO: 376274 - protein, 10 aa, Influenza virus
EMKWLLSSSD

SEQ ID NO: 376275 - protein, 10 aa, Influenza virus
MKWLLSSSDN

SEQ ID NO: 376276 - protein, 10 aa, Influenza virus
ALIVWGIHHS

SEQ ID NO: 376277 - protein, 10 aa, Influenza virus
EQTKLYGSGS

SEQ ID NO: 376278 - protein, 10 aa, Influenza virus
QTKLYGSGSK

SEQ ID NO: 376279 - protein, 10 aa, Influenza virus
TKLYGSGSKL

SEQ ID NO: 376280 - protein, 10 aa, Influenza virus
KLYGNGNKLV

SEQ ID NO: 376281 - protein, 10 aa, Influenza virus
PGTRRIDFHW

SEQ ID NO: 376282 - protein, 10 aa, Influenza virus
GTRRIDFHWL

SEQ ID NO: 376283 - protein, 10 aa, Influenza virus
TRRIDFHWLL

SEQ ID NO: 376284 - protein, 10 aa, Influenza virus
RRIDFHWLFL

SEQ ID NO: 376285 - protein, 10 aa, Influenza virus
SGRIDFHWLI

SEQ ID NO: 376286 - protein, 10 aa, Influenza virus
GRIDFHWLIL

SEQ ID NO: 376287 - protein, 10 aa, Influenza virus
NDTVTFIFNG

SEQ ID NO: 376288 - protein, 10 aa, Influenza virus
DTVTFIFNGA

SEQ ID NO: 376289 - protein, 10 aa, Influenza virus
TVTFIFNGAF

SEQ ID NO: 376290 - protein, 10 aa, Influenza virus
VTFIFNGAFI

SEQ ID NO: 376291 - protein, 10 aa, Influenza virus
TFIFNGAFIA

SEQ ID NO: 376292 - protein, 10 aa, Influenza virus
FIFNGAFIAP

SEQ ID NO: 376293 - protein, 10 aa, Influenza virus
TFNGAFIAPN

SEQ ID NO: 376294 - protein, 10 aa, Influenza virus
FIAPNRASFF

SEQ ID NO: 376295 - protein, 10 aa, Influenza virus
IAPNRASFFR

SEQ ID NO: 376296 - protein, 10 aa, Influenza virus
APNRASFFRG

SEQ ID NO: 376297 - protein, 10 aa, Influenza virus
GGTIISSLPF

SEQ ID NO: 376298 - protein, 10 aa, Influenza virus
GTIISSLPFQ

SEQ ID NO: 376299 - protein, 10 aa, Influenza virus
TIISSLPFQN

SEQ ID NO: 376300 - protein, 10 aa, Influenza virus
IVSSLPFQSI

SEQ ID NO: 376301 - protein, 10 aa, Influenza virus
VSSLPFQNIS

SEQ ID NO: 376302 - protein, 10 aa, Influenza virus
SNLPFQNINS

SEQ ID NO: 376303 - protein, 10 aa, Influenza virus
AVGKCPRYVK

SEQ ID NO: 376304 - protein, 10 aa, Influenza virus
VGKCPKYVKQ

SEQ ID NO: 376305 - protein, 10 aa, Influenza virus
VKQESLLLAT

SEQ ID NO: 376306 - protein, 10 aa, Influenza virus
KQESLLLATG

SEQ ID NO: 376307 - protein, 10 aa, Influenza virus
QESLLLATGM

SEQ ID NO: 376308 - protein, 10 aa, Influenza virus
ESLLLATGMK

SEQ ID NO: 376309 - protein, 10 aa, Influenza virus
SLMLATGMKN

SEQ ID NO: 376310 - protein, 10 aa, Influenza virus
LLLATGMRNI

SEQ ID NO: 376311 - protein, 10 aa, Influenza virus
LLATGMRNIP

SEQ ID NO: 376312 - protein, 10 aa, Influenza virus
LATGMRNIPE

SEQ ID NO: 376313 - protein, 10 aa, Influenza virus
ATGMKNVPEI

SEQ ID NO: 376314 - protein, 10 aa, Influenza virus
TGMKNVPEIP

SEQ ID NO: 376315 - protein, 10 aa, Influenza virus
GMKNVPEIPK

SEQ ID NO: 376316 - protein, 10 aa, Influenza virus
PKTRGLFGAI

SEQ ID NO: 376317 - protein, 10 aa, Influenza virus
KTRGLFGAIA

SEQ ID NO: 376318 - protein, 10 aa, Influenza virus
TRGLFGAIAG

SEQ ID NO: 376319 - protein, 10 aa, Influenza virus
IENGWEGLVD

SEQ ID NO: 376320 - protein, 10 aa, Influenza virus
ENGWEGLVDG

SEQ ID NO: 376321 - protein, 10 aa, Influenza virus
NGWEGLVDGW

SEQ ID NO: 376322 - protein, 10 aa, Influenza virus
GWEGLVDGWY

SEQ ID NO: 376323 - protein, 10 aa, Influenza virus
WEGLVDGWYG

SEQ ID NO: 376324 - protein, 10 aa, Influenza virus
EGLVDGWYGF

SEQ ID NO: 376325 - protein, 10 aa, Influenza virus
GLVDGWYGFR

SEQ ID NO: 376326 - protein, 10 aa, Influenza virus
LVDGWYGFRH

SEQ ID NO: 376327 - protein, 10 aa, Influenza virus
VDGWYGFRHQ

SEQ ID NO: 376328 - protein, 10 aa, Influenza virus
ITGKLNRLIS

SEQ ID NO: 376329 - protein, 10 aa, Influenza virus
TGKLNRLISK

SEQ ID NO: 376330 - protein, 10 aa, Influenza virus
GKLNRLISKT

SEQ ID NO: 376331 - protein, 10 aa, Influenza virus
KLNRLISKTN

SEQ ID NO: 376332 - protein, 10 aa, Influenza virus
LNRLISKTNQ

SEQ ID NO: 376333 - protein, 10 aa, Influenza virus
NRLIEKTNQQ

SEQ ID NO: 376334 - protein, 10 aa, Influenza virus
RLIEKTNQQF

SEQ ID NO: 376335 - protein, 10 aa, Influenza virus
LIEKTNQQFE

SEQ ID NO: 376336 - protein, 10 aa, Influenza virus
IEKTNQQFEL

SEQ ID NO: 376337 - protein, 10 aa, Influenza virus
EKTNQQFELI

SEQ ID NO: 376338 - protein, 10 aa, Influenza virus
RTNQQFELID

SEQ ID NO: 376339 - protein, 10 aa, Influenza virus
TNQQFGLIDN

SEQ ID NO: 376340 - protein, 10 aa, Influenza virus
NQQFEMIDNE

SEQ ID NO: 376341 - protein, 10 aa, Influenza virus
QRFELIDNEF

SEQ ID NO: 376342 - protein, 10 aa, Influenza virus
FELIDNEFTE

SEQ ID NO: 376343 - protein, 10 aa, Influenza virus
NEFTEVEKQI

SEQ ID NO: 376344 - protein, 10 aa, Influenza virus
EFTEVEKQIG

SEQ ID NO: 376345 - protein, 10 aa, Influenza virus
FTEVEKQIGN

SEQ ID NO: 376346 - protein, 10 aa, Influenza virus
TEVEKQIGNV

SEQ ID NO: 376347 - protein, 10 aa, Influenza virus
EVEKQIGNVI

SEQ ID NO: 376348 - protein, 10 aa, Influenza virus
VEKQIGNVIN

SEQ ID NO: 376349 - protein, 10 aa, Influenza virus
GNVINWTRDS

SEQ ID NO: 376350 - protein, 10 aa, Influenza virus
NVINWTRDSM

SEQ ID NO: 376351 - protein, 10 aa, Influenza virus
VINWTRDSMT

SEQ ID NO: 376352 - protein, 10 aa, Influenza virus
INWTRDSMTE

SEQ ID NO: 376353 - protein, 10 aa, Influenza virus
NWTRDSMTEV

SEQ ID NO: 376354 - protein, 10 aa, Influenza virus
WTRDSMTEVW

SEQ ID NO: 376355 - protein, 10 aa, Influenza virus
TRDSMTEVWS

SEQ ID NO: 376356 - protein, 10 aa, Influenza virus
RDSMTEVWSY

SEQ ID NO: 376357 - protein, 10 aa, Influenza virus
DSMTEVWSYN

SEQ ID NO: 376358 - protein, 10 aa, Influenza virus
SMTEVWSYNA

SEQ ID NO: 376359 - protein, 10 aa, Influenza virus
ITEVWSYNAE

SEQ ID NO: 376360 - protein, 10 aa, Influenza virus
SYNAELLVAI

SEQ ID NO: 376361 - protein, 10 aa, Influenza virus
LLVAIENQHT

SEQ ID NO: 376362 - protein, 10 aa, Influenza virus
LVAIENQHTI

SEQ ID NO: 376363 - protein, 10 aa, Influenza virus
VAIENQHTID

SEQ ID NO: 376364 - protein, 10 aa, Influenza virus
AIENQHTIDL

SEQ ID NO: 376365 - protein, 10 aa, Influenza virus
LENQHTIDLA

SEQ ID NO: 376366 - protein, 10 aa, Influenza virus
HTIDLADSEI

SEQ ID NO: 376367 - protein, 10 aa, Influenza virus
IDLTDSEMSK

SEQ ID NO: 376368 - protein, 10 aa, Influenza virus
DLTDSEMSKL

SEQ ID NO: 376369 - protein, 10 aa, Influenza virus
LTDSEMSKLY

SEQ ID NO: 376370 - protein, 10 aa, Influenza virus
DSEMKKLYER

SEQ ID NO: 376371 - protein, 10 aa, Influenza virus
SEMKKLYERV

SEQ ID NO: 376372 - protein, 10 aa, Influenza virus
EMNKLYERVR

SEQ ID NO: 376373 - protein, 10 aa, Influenza virus
KLYERVRRQL

SEQ ID NO: 376374 - protein, 10 aa, Influenza virus
LYERVRRQLR

SEQ ID NO: 376375 - protein, 10 aa, Influenza virus
YERVRRQLRE

SEQ ID NO: 376376 - protein, 10 aa, Influenza virus
ERVRRQLREN

SEQ ID NO: 376377 - protein, 10 aa, Influenza virus
RVRRQLRENA

SEQ ID NO: 376378 - protein, 10 aa, Influenza virus
VRRQLRENAE

SEQ ID NO: 376379 - protein, 10 aa, Influenza virus
RRQLRENAEE

SEQ ID NO: 376380 - protein, 10 aa, Influenza virus
FEIFHKCDDD

SEQ ID NO: 376381 - protein, 10 aa, Influenza virus
EIFHKCDDDC

SEQ ID NO: 376382 - protein, 10 aa, Influenza virus
IFHKCDDDCM

SEQ ID NO: 376383 - protein, 10 aa, Influenza virus
FHKCDDDCMA

SEQ ID NO: 376384 - protein, 10 aa, Influenza virus
HKCDDDCMAS

SEQ ID NO: 376385 - protein, 10 aa, Influenza virus
KCDDDCMASI

SEQ ID NO: 376386 - protein, 10 aa, Influenza virus
CDDDCMASIR

SEQ ID NO: 376387 - protein, 10 aa, Influenza virus
DDDCMASIRN

SEQ ID NO: 376388 - protein, 10 aa, Influenza virus
DDCMASIRNN

SEQ ID NO: 376389 - protein, 10 aa, Influenza virus
DCMASIRNNT

SEQ ID NO: 376390 - protein, 10 aa, Influenza virus
MESIRNNTYN

SEQ ID NO: 376391 - protein, 10 aa, Influenza virus
ESIRNNTYNH

SEQ ID NO: 376392 - protein, 10 aa, Influenza virus
SIRNNTYNHT

SEQ ID NO: 376393 - protein, 10 aa, Influenza virus
IRNNTYNHTQ

SEQ ID NO: 376394 - protein, 10 aa, Influenza virus
RNNTYDHTKY

SEQ ID NO: 376395 - protein, 10 aa, Influenza virus
NNTYDHTKYR

SEQ ID NO: 376396 - protein, 10 aa, Influenza virus
KYRTESLQNR

SEQ ID NO: 376397 - protein, 10 aa, Influenza virus
YREEAMQNRL

SEQ ID NO: 376398 - protein, 10 aa, Influenza virus
RTGSLQNRIQ

SEQ ID NO: 376399 - protein, 10 aa, Influenza virus
KEAMQNRIQI

SEQ ID NO: 376400 - protein, 10 aa, Influenza virus
EAMQNRLKID

SEQ ID NO: 376401 - protein, 10 aa, Influenza virus
SLQNRIQIDS

SEQ ID NO: 376402 - protein, 10 aa, Influenza virus
MQNRIQIDPV

SEQ ID NO: 376403 - protein, 10 aa, Influenza virus
QNRIQIDQVK

SEQ ID NO: 376404 - protein, 10 aa, Influenza virus
NRIQIDQVKL

SEQ ID NO: 376405 - protein, 10 aa, Influenza virus
RIQIDQVKLS

SEQ ID NO: 376406 - protein, 10 aa, Influenza virus
IQIDQVKLSS

SEQ ID NO: 376407 - protein, 10 aa, Influenza virus
QIDQVKLSSG

SEQ ID NO: 376408 - protein, 10 aa, Influenza virus
IDQVKLSSGY

SEQ ID NO: 376409 - protein, 10 aa, Influenza virus
DQVKLSSGYK

SEQ ID NO: 376410 - protein, 10 aa, Influenza virus
QVKLSSGYKD

SEQ ID NO: 376411 - protein, 10 aa, Influenza virus
VKLSGGYKDI

SEQ ID NO: 376412 - protein, 10 aa, Influenza virus
KLSGGYKDII

SEQ ID NO: 376413 - protein, 10 aa, Influenza virus
LSGGYKDIIL

SEQ ID NO: 376414 - protein, 10 aa, Influenza virus
SGGYKDIILW

SEQ ID NO: 376415 - protein, 10 aa, Influenza virus
GGYKDIILWF

SEQ ID NO: 376416 - protein, 10 aa, Influenza virus
GASCFLLLAV

SEQ ID NO: 376417 - protein, 10 aa, Influenza virus
ASCFLLLAIV

SEQ ID NO: 376418 - protein, 10 aa, Influenza virus
LLAVVMGLVF

SEQ ID NO: 376419 - protein, 10 aa, Influenza virus
AIAMGLVFMC

SEQ ID NO: 376420 - protein, 10 aa, Influenza virus
AMGLVFMCVK

SEQ ID NO: 376421 - protein, 10 aa, Influenza virus
MGLVFICVKN

SEQ ID NO: 376422 - protein, 10 aa, Influenza virus
GLVFICVKNG

SEQ ID NO: 376423 - protein, 10 aa, Influenza virus
LVFICVKNGN

SEQ ID NO: 376424 - protein, 10 aa, Influenza virus
VFICVKNGNM

SEQ ID NO: 376425 - protein, 10 aa, Influenza virus
FMCVKNGNMR

SEQ ID NO: 376426 - protein, 10 aa, Influenza virus
ICVKNGNMRC

SEQ ID NO: 376427 - protein, 10 aa, Influenza virus
CVKNGNMRCT

SEQ ID NO: 376428 - protein, 10 aa, Influenza virus
VKNGNMRCTI

SEQ ID NO: 376429 - protein, 10 aa, Influenza virus
TIGSVSLIIA

SEQ ID NO: 376430 - protein, 10 aa, Influenza virus
IGSVSLIIAT

SEQ ID NO: 376431 - protein, 10 aa, Influenza virus
KRNITEIVYL

SEQ ID NO: 376432 - protein, 10 aa, Influenza virus
KNITKIVYLN

SEQ ID NO: 376433 - protein, 10 aa, Influenza virus
NITEIVYLNS

SEQ ID NO: 376434 - protein, 10 aa, Influenza virus
ITEIVYLNHT

SEQ ID NO: 376435 - protein, 10 aa, Influenza virus
YRDWSKPQCQ

SEQ ID NO: 376436 - protein, 10 aa, Influenza virus
RDWSKPQCQI

SEQ ID NO: 376437 - protein, 10 aa, Influenza virus
WSKPQCQIIG

SEQ ID NO: 376438 - protein, 10 aa, Influenza virus
FAPFSKDNSV

SEQ ID NO: 376439 - protein, 10 aa, Influenza virus
APFSKDNSVR

SEQ ID NO: 376440 - protein, 10 aa, Influenza virus
PFSKDNSVRL

SEQ ID NO: 376441 - protein, 10 aa, Influenza virus
FSKDNSVRLS

SEQ ID NO: 376442 - protein, 10 aa, Influenza virus
SKDNSVRLSA

SEQ ID NO: 376443 - protein, 10 aa, Influenza virus
NSIRLSAGGN

SEQ ID NO: 376444 - protein, 10 aa, Influenza virus
SVRLSASGDI

SEQ ID NO: 376445 - protein, 10 aa, Influenza virus
VRLSAGGDIW

SEQ ID NO: 376446 - protein, 10 aa, Influenza virus
RLSAGGDIWV

SEQ ID NO: 376447 - protein, 10 aa, Influenza virus
LSAGGDIWVT

SEQ ID NO: 376448 - protein, 10 aa, Influenza virus
SAGGDIWVTR

SEQ ID NO: 376449 - protein, 10 aa, Influenza virus
AGGDIWVTRE

SEQ ID NO: 376450 - protein, 10 aa, Influenza virus
GGDIWVTREP

SEQ ID NO: 376451 - protein, 10 aa, Influenza virus
GDIWVTREPY

SEQ ID NO: 376452 - protein, 10 aa, Influenza virus
DIWVTREPYV

SEQ ID NO: 376453 - protein, 10 aa, Influenza virus
VTREPYVSCS

SEQ ID NO: 376454 - protein, 10 aa, Influenza virus
TREPYVSCDN

SEQ ID NO: 376455 - protein, 10 aa, Influenza virus
GKCYQFALGQ

SEQ ID NO: 376456 - protein, 10 aa, Influenza virus
FALGQGTTLE

SEQ ID NO: 376457 - protein, 10 aa, Influenza virus
ALGQGTTLEN

SEQ ID NO: 376458 - protein, 10 aa, Influenza virus
LGQGTTLYNK

SEQ ID NO: 376459 - protein, 10 aa, Influenza virus
GQGTTLYNKH

SEQ ID NO: 376460 - protein, 10 aa, Influenza virus
QGTTLYNKHS

SEQ ID NO: 376461 - protein, 10 aa, Influenza virus
GTTLYNKHSN

SEQ ID NO: 376462 - protein, 10 aa, Influenza virus
TTLYNKHSNG

SEQ ID NO: 376463 - protein, 10 aa, Influenza virus
TLYNKHSNGT

SEQ ID NO: 376464 - protein, 10 aa, Influenza virus
NEHSNGTTHD

SEQ ID NO: 376465 - protein, 10 aa, Influenza virus
EHSNGTTHDR

SEQ ID NO: 376466 - protein, 10 aa, Influenza virus
HSNGTTHDRI

SEQ ID NO: 376467 - protein, 10 aa, Influenza virus
HDRTSHRTLL

SEQ ID NO: 376468 - protein, 10 aa, Influenza virus
DRTSHRTLLM

SEQ ID NO: 376469 - protein, 10 aa, Influenza virus
RTSHRTLLMN

SEQ ID NO: 376470 - protein, 10 aa, Influenza virus
TSHRTLLMNE

SEQ ID NO: 376471 - protein, 10 aa, Influenza virus
HLGTKQVCMA

SEQ ID NO: 376472 - protein, 10 aa, Influenza virus
LGTKQVCMAW

SEQ ID NO: 376473 - protein, 10 aa, Influenza virus
GTKQVCMAWS

SEQ ID NO: 376474 - protein, 10 aa, Influenza virus
TKQVCMAWSS

SEQ ID NO: 376475 - protein, 10 aa, Influenza virus
KQVCMAWSSS

SEQ ID NO: 376476 - protein, 10 aa, Influenza virus
DGKAWLHICV

SEQ ID NO: 376477 - protein, 10 aa, Influenza virus
GKAWLHICVT

SEQ ID NO: 376478 - protein, 10 aa, Influenza virus
KAWLHICVTG

SEQ ID NO: 376479 - protein, 10 aa, Influenza virus
AWLHICVTGD

SEQ ID NO: 376480 - protein, 10 aa, Influenza virus
WLHICVTGDD

SEQ ID NO: 376481 - protein, 10 aa, Influenza virus
LHVCITGDDR

SEQ ID NO: 376482 - protein, 10 aa, Influenza virus
HVCVTGDDKN

SEQ ID NO: 376483 - protein, 10 aa, Influenza virus
ICVTGDDRNA

SEQ ID NO: 376484 - protein, 10 aa, Influenza virus
CVTGDDKNAT

SEQ ID NO: 376485 - protein, 10 aa, Influenza virus
VTGDDKNATA

SEQ ID NO: 376486 - protein, 10 aa, Influenza virus
GDDRNATASL

SEQ ID NO: 376487 - protein, 10 aa, Influenza virus
DDRNATASLI

SEQ ID NO: 376488 - protein, 10 aa, Influenza virus
DRNATASLIY

SEQ ID NO: 376489 - protein, 10 aa, Influenza virus
NATASFIYNE

SEQ ID NO: 376490 - protein, 10 aa, Influenza virus
LIDSIGSWSQ

SEQ ID NO: 376491 - protein, 10 aa, Influenza virus
IDSIGSWSQN

SEQ ID NO: 376492 - protein, 10 aa, Influenza virus
ECVCINGSCA

SEQ ID NO: 376493 - protein, 10 aa, Influenza virus
CVCINGSCAV

SEQ ID NO: 376494 - protein, 10 aa, Influenza virus
VCINGSCAVV

SEQ ID NO: 376495 - protein, 10 aa, Influenza virus
CINGSCAVVM

SEQ ID NO: 376496 - protein, 10 aa, Influenza virus
INGSCAVVMT

SEQ ID NO: 376497 - protein, 10 aa, Influenza virus
NGSCAVVMTD

SEQ ID NO: 376498 - protein, 10 aa, Influenza virus
GSCAVVMTDG

SEQ ID NO: 376499 - protein, 10 aa, Influenza virus
TCTVVMTDGS

SEQ ID NO: 376500 - protein, 10 aa, Influenza virus
CAVVMTDGSA

SEQ ID NO: 376501 - protein, 10 aa, Influenza virus
AVVMTDGSAS

SEQ ID NO: 376502 - protein, 10 aa, Influenza virus
VMTDGSASGR

SEQ ID NO: 376503 - protein, 10 aa, Influenza virus
MTDGSASGRA

SEQ ID NO: 376504 - protein, 10 aa, Influenza virus
TDGSASGKAE

SEQ ID NO: 376505 - protein, 10 aa, Influenza virus
DGSASGKAET

SEQ ID NO: 376506 - protein, 10 aa, Influenza virus
EGKIAHISPL

SEQ ID NO: 376507 - protein, 10 aa, Influenza virus
GKIAHISPLS

SEQ ID NO: 376508 - protein, 10 aa, Influenza virus
KIAHISPLSG

SEQ ID NO: 376509 - protein, 10 aa, Influenza virus
IAHISPLSGS

SEQ ID NO: 376510 - protein, 10 aa, Influenza virus
AHISPLSGSA

SEQ ID NO: 376511 - protein, 10 aa, Influenza virus
ECSCYPRYPD

SEQ ID NO: 376512 - protein, 10 aa, Influenza virus
CSCYPRYPDV

SEQ ID NO: 376513 - protein, 10 aa, Influenza virus
SCYPRYPDVR

SEQ ID NO: 376514 - protein, 10 aa, Influenza virus
CYPRYPDVRC

SEQ ID NO: 376515 - protein, 10 aa, Influenza virus
YPRYPDVRCV

SEQ ID NO: 376516 - protein, 10 aa, Influenza virus
PRYPDVRCVC

SEQ ID NO: 376517 - protein, 10 aa, Influenza virus
RYPDVRCVCR

SEQ ID NO: 376518 - protein, 10 aa, Influenza virus
NWKGSNRPVV

SEQ ID NO: 376519 - protein, 10 aa, Influenza virus
WKGSNRPVVD

SEQ ID NO: 376520 - protein, 10 aa, Influenza virus
KGSNRPIIDI

SEQ ID NO: 376521 - protein, 10 aa, Influenza virus
GSNRPIIDIN

SEQ ID NO: 376522 - protein, 10 aa, Influenza virus
SNRPIIDINM

SEQ ID NO: 376523 - protein, 10 aa, Influenza virus
IGSSYVCSGL

SEQ ID NO: 376524 - protein, 10 aa, Influenza virus
DSSYLCSGLV

SEQ ID NO: 376525 - protein, 10 aa, Influenza virus
VGDTPRNDDS

SEQ ID NO: 376526 - protein, 10 aa, Influenza virus
GDTPRNDDSS

SEQ ID NO: 376527 - protein, 10 aa, Influenza virus
DTPRNDDSSS

SEQ ID NO: 376528 - protein, 10 aa, Influenza virus
TPRNDDSSSS

SEQ ID NO: 376529 - protein, 10 aa, Influenza virus
PRNDDSSSSS

SEQ ID NO: 376530 - protein, 10 aa, Influenza virus
RNDDSSSSSN

SEQ ID NO: 376531 - protein, 10 aa, Influenza virus
NDDSSSSSNC

SEQ ID NO: 376532 - protein, 10 aa, Influenza virus
DPNNERGNPG

SEQ ID NO: 376533 - protein, 10 aa, Influenza virus
PNNERGNPGV

SEQ ID NO: 376534 - protein, 10 aa, Influenza virus
NNERGNPGVK

SEQ ID NO: 376535 - protein, 10 aa, Influenza virus
NERGNPGVKG

SEQ ID NO: 376536 - protein, 10 aa, Influenza virus
ERGSPGVKGW

SEQ ID NO: 376537 - protein, 10 aa, Influenza virus
RGSPGVKGWA

SEQ ID NO: 376538 - protein, 10 aa, Influenza virus
PGVKGWAFDY

SEQ ID NO: 376539 - protein, 10 aa, Influenza virus
GVKGWAFDYG

SEQ ID NO: 376540 - protein, 10 aa, Influenza virus
VKGWAFDYGN

SEQ ID NO: 376541 - protein, 10 aa, Influenza virus
KGWAFDYGND

SEQ ID NO: 376542 - protein, 10 aa, Influenza virus
YGNDVWMGRT

SEQ ID NO: 376543 - protein, 10 aa, Influenza virus
GSDVWMGRTI

SEQ ID NO: 376544 - protein, 10 aa, Influenza virus
DVWMGRTISM

SEQ ID NO: 376545 - protein, 10 aa, Influenza virus
VWMGRTISMD

SEQ ID NO: 376546 - protein, 10 aa, Influenza virus
WMGRTISMDS

SEQ ID NO: 376547 - protein, 10 aa, Influenza virus
MGRTISMDSR

SEQ ID NO: 376548 - protein, 10 aa, Influenza virus
GRTISMDSRS

SEQ ID NO: 376549 - protein, 10 aa, Influenza virus
RTISMDSRSG

SEQ ID NO: 376550 - protein, 10 aa, Influenza virus
TISMDSRSGY

SEQ ID NO: 376551 - protein, 10 aa, Influenza virus
ISMDSRSGYE

SEQ ID NO: 376552 - protein, 10 aa, Influenza virus
SMDSRSGYET

SEQ ID NO: 376553 - protein, 10 aa, Influenza virus
MDSRSGYETF

SEQ ID NO: 376554 - protein, 10 aa, Influenza virus
SGYETFRVID

SEQ ID NO: 376555 - protein, 10 aa, Influenza virus
GYETFRVIDG

SEQ ID NO: 376556 - protein, 10 aa, Influenza virus
YETFRVIDGW

SEQ ID NO: 376557 - protein, 10 aa, Influenza virus
ETFRVISGWT

SEQ ID NO: 376558 - protein, 10 aa, Influenza virus
VIGGWTIANS

SEQ ID NO: 376559 - protein, 10 aa, Influenza virus
IGGWTIANSK

SEQ ID NO: 376560 - protein, 10 aa, Influenza virus
GGWTIANSKS

SEQ ID NO: 376561 - protein, 10 aa, Influenza virus
GWTIANSKSQ

SEQ ID NO: 376562 - protein, 10 aa, Influenza virus
RQIIVDNNNW

SEQ ID NO: 376563 - protein, 10 aa, Influenza virus
IVDNSNWSGY

SEQ ID NO: 376564 - protein, 10 aa, Influenza virus
VDNNNWFGYF

SEQ ID NO: 376565 - protein, 10 aa, Influenza virus
DNSNWSGYSG

SEQ ID NO: 376566 - protein, 10 aa, Influenza virus
NNNWFGYFGI

SEQ ID NO: 376567 - protein, 10 aa, Influenza virus
SNWSGYSGIF

SEQ ID NO: 376568 - protein, 10 aa, Influenza virus
NWSGYSGVFS

SEQ ID NO: 376569 - protein, 10 aa, Influenza virus
WSGYSGVFSV

SEQ ID NO: 376570 - protein, 10 aa, Influenza virus
KRCINRCFYV

SEQ ID NO: 376571 - protein, 10 aa, Influenza virus
RCINRCFYVE

SEQ ID NO: 376572 - protein, 10 aa, Influenza virus
YVELIRGMPQ

SEQ ID NO: 376573 - protein, 10 aa, Influenza virus
VELIRGMPQE

SEQ ID NO: 376574 - protein, 10 aa, Influenza virus
PQENRVWWTS

SEQ ID NO: 376575 - protein, 10 aa, Influenza virus
QENRVWWTSN

SEQ ID NO: 376576 - protein, 10 aa, Influenza virus
ETKVWWTSNS

SEQ ID NO: 376577 - protein, 10 aa, Influenza virus
TTVWWTSNSI

SEQ ID NO: 376578 - protein, 10 aa, Influenza virus
TVWWTSNSIV

SEQ ID NO: 376579 - protein, 10 aa, Influenza virus
SIVVFCGTSA

SEQ ID NO: 376580 - protein, 10 aa, Influenza virus
IVVFCGTSAT

SEQ ID NO: 376581 - protein, 10 aa, Influenza virus
VVFCGTSATY

SEQ ID NO: 376582 - protein, 10 aa, Influenza virus
GSWPDGANID

SEQ ID NO: 376583 - protein, 10 aa, Influenza virus
SWPDGANIDF

SEQ ID NO: 376584 - protein, 10 aa, Influenza virus
WPDGANINLM

SEQ ID NO: 376585 - protein, 10 aa, Influenza virus
KSRGYKMNTR

SEQ ID NO: 376586 - protein, 10 aa, Influenza virus
SRGYKMNTRI

SEQ ID NO: 376587 - protein, 10 aa, Influenza virus
RGYKMNTRIL

SEQ ID NO: 376588 - protein, 10 aa, Influenza virus
GYKMNNQILI

SEQ ID NO: 376589 - protein, 10 aa, Influenza virus
YKMNTRILIL

SEQ ID NO: 376590 - protein, 10 aa, Influenza virus
KMNNQILILA

SEQ ID NO: 376591 - protein, 10 aa, Influenza virus
KICLGHHAVP

SEQ ID NO: 376592 - protein, 10 aa, Influenza virus
ICLGHHAVPN

SEQ ID NO: 376593 - protein, 10 aa, Influenza virus
CLGHHAVPNG

SEQ ID NO: 376594 - protein, 10 aa, Influenza virus
LGHHAVPNGT

SEQ ID NO: 376595 - protein, 10 aa, Influenza virus
GHHAVPNGTK

SEQ ID NO: 376596 - protein, 10 aa, Influenza virus
HHAVPNGTKV

SEQ ID NO: 376597 - protein, 10 aa, Influenza virus
NGTKVDTLTE

SEQ ID NO: 376598 - protein, 10 aa, Influenza virus
VNTLTEKGIE

SEQ ID NO: 376599 - protein, 10 aa, Influenza virus
NTLTEKGIEV

SEQ ID NO: 376600 - protein, 10 aa, Influenza virus
TLTEKGIEVV

SEQ ID NO: 376601 - protein, 10 aa, Influenza virus
LTEKGIEVVN

SEQ ID NO: 376602 - protein, 10 aa, Influenza virus
TEKGIEVVNA

SEQ ID NO: 376603 - protein, 10 aa, Influenza virus
EKGIEVVNAT

SEQ ID NO: 376604 - protein, 10 aa, Influenza virus
KGIEVVNATE

SEQ ID NO: 376605 - protein, 10 aa, Influenza virus
GVEVVDATET

SEQ ID NO: 376606 - protein, 10 aa, Influenza virus
VEVVDATETV

SEQ ID NO: 376607 - protein, 10 aa, Influenza virus
VVDATETVER

SEQ ID NO: 376608 - protein, 10 aa, Influenza virus
IDLGQCGLLG

SEQ ID NO: 376609 - protein, 10 aa, Influenza virus
DLGQCGLLGI

SEQ ID NO: 376610 - protein, 10 aa, Influenza virus
CGLLGTVTGP

SEQ ID NO: 376611 - protein, 10 aa, Influenza virus
GLLGTVTGPP

SEQ ID NO: 376612 - protein, 10 aa, Influenza virus
LLGTVTGPPQ

SEQ ID NO: 376613 - protein, 10 aa, Influenza virus
LGTVTGPPQC

SEQ ID NO: 376614 - protein, 10 aa, Influenza virus
GTVTGPPQCD

SEQ ID NO: 376615 - protein, 10 aa, Influenza virus
IGPPQCDLFL

SEQ ID NO: 376616 - protein, 10 aa, Influenza virus
GPPQCDRFLE

SEQ ID NO: 376617 - protein, 10 aa, Influenza virus
PPQCDRFLEF

SEQ ID NO: 376618 - protein, 10 aa, Influenza virus
DVCYPGKFAN

SEQ ID NO: 376619 - protein, 10 aa, Influenza virus
LRQILRRSGG

SEQ ID NO: 376620 - protein, 10 aa, Influenza virus
RQILRRSGGI

SEQ ID NO: 376621 - protein, 10 aa, Influenza virus
GPSFYAEMKW

SEQ ID NO: 376622 - protein, 10 aa, Influenza virus
AEMKWLLSNN

SEQ ID NO: 376623 - protein, 10 aa, Influenza virus
EMKWLLSNND

SEQ ID NO: 376624 - protein, 10 aa, Influenza virus
MKWLLSNNDN

SEQ ID NO: 376625 - protein, 10 aa, Influenza virus
PALIVWGIHH

SEQ ID NO: 376626 - protein, 10 aa, Influenza virus
ALIVWGIHHS

SEQ ID NO: 376627 - protein, 10 aa, Influenza virus
LYGSGSKLIT

SEQ ID NO: 376628 - protein, 10 aa, Influenza virus
YGSGSKLITV

SEQ ID NO: 376629 - protein, 10 aa, Influenza virus
SSNYHQSFVP

SEQ ID NO: 376630 - protein, 10 aa, Influenza virus
SNYHQSFVPS

SEQ ID NO: 376631 - protein, 10 aa, Influenza virus
NYHQSFVPSP

SEQ ID NO: 376632 - protein, 10 aa, Influenza virus
YHQSFVPSPG

SEQ ID NO: 376633 - protein, 10 aa, Influenza virus
QSFVPSPGVR

SEQ ID NO: 376634 - protein, 10 aa, Influenza virus
VDGQSGRIDF

SEQ ID NO: 376635 - protein, 10 aa, Influenza virus
DGQSGRIDFH

SEQ ID NO: 376636 - protein, 10 aa, Influenza virus
GQTGRIDFHW

SEQ ID NO: 376637 - protein, 10 aa, Influenza virus
QSGRIDFHWM

SEQ ID NO: 376638 - protein, 10 aa, Influenza virus
NDTITFSFNG

SEQ ID NO: 376639 - protein, 10 aa, Influenza virus
FSFNGAFVAP

SEQ ID NO: 376640 - protein, 10 aa, Influenza virus
SFNGAFVAPD

SEQ ID NO: 376641 - protein, 10 aa, Influenza virus
NGAFVAPDRV

SEQ ID NO: 376642 - protein, 10 aa, Influenza virus
GAFIAPDRAT

SEQ ID NO: 376643 - protein, 10 aa, Influenza virus
AFIAPDRATF

SEQ ID NO: 376644 - protein, 10 aa, Influenza virus
FIAPDRVSFL

SEQ ID NO: 376645 - protein, 10 aa, Influenza virus
GGTITSPLPF

SEQ ID NO: 376646 - protein, 10 aa, Influenza virus
GTITSPLPFQ

SEQ ID NO: 376647 - protein, 10 aa, Influenza virus
TITSPLPFQN

SEQ ID NO: 376648 - protein, 10 aa, Influenza virus
ITSPLPFQNI

SEQ ID NO: 376649 - protein, 10 aa, Influenza virus
TSPLPFQNIN

SEQ ID NO: 376650 - protein, 10 aa, Influenza virus
SLPFQNINSR

SEQ ID NO: 376651 - protein, 10 aa, Influenza virus
LPFQNINSRT

SEQ ID NO: 376652 - protein, 10 aa, Influenza virus
VGKCPRYVRQ

SEQ ID NO: 376653 - protein, 10 aa, Influenza virus
SLMLATGMKN

SEQ ID NO: 376654 - protein, 10 aa, Influenza virus
LMLATGMKNV

SEQ ID NO: 376655 - protein, 10 aa, Influenza virus
MLATGMKNVP

SEQ ID NO: 376656 - protein, 10 aa, Influenza virus
ATGMKNVPET

SEQ ID NO: 376657 - protein, 10 aa, Influenza virus
TGMKNVPETP

SEQ ID NO: 376658 - protein, 10 aa, Influenza virus
GMKNVPETPK

SEQ ID NO: 376659 - protein, 10 aa, Influenza virus
KRKRGLFGAI

SEQ ID NO: 376660 - protein, 10 aa, Influenza virus
SPLSRCRKTR

SEQ ID NO: 376661 - protein, 10 aa, Influenza virus
AYRKRMTRGL

SEQ ID NO: 376662 - protein, 10 aa, Influenza virus
SRCRKTRGLF

SEQ ID NO: 376663 - protein, 10 aa, Influenza virus
RCRKTRGLFG

SEQ ID NO: 376664 - protein, 10 aa, Influenza virus
CRKTRGLFGA

SEQ ID NO: 376665 - protein, 10 aa, Influenza virus
RKTRGLFGAI

SEQ ID NO: 376666 - protein, 10 aa, Influenza virus
KTRGLFGAIA

SEQ ID NO: 376667 - protein, 10 aa, Influenza virus
TTKPRPRRGL

SEQ ID NO: 376668 - protein, 10 aa, Influenza virus
IENGWEGLIN

SEQ ID NO: 376669 - protein, 10 aa, Influenza virus
ENGWEGLING

SEQ ID NO: 376670 - protein, 10 aa, Influenza virus
NGWEGLINGW

SEQ ID NO: 376671 - protein, 10 aa, Influenza virus
GWEGLINGWY

SEQ ID NO: 376672 - protein, 10 aa, Influenza virus
WEGLINGWYG

SEQ ID NO: 376673 - protein, 10 aa, Influenza virus
EGLINGWYGF

SEQ ID NO: 376674 - protein, 10 aa, Influenza virus
GLINGWYGFR

SEQ ID NO: 376675 - protein, 10 aa, Influenza virus
LINGWYGFRH

SEQ ID NO: 376676 - protein, 10 aa, Influenza virus
INGWYGFRHQ

SEQ ID NO: 376677 - protein, 10 aa, Influenza virus
DGWYGFKHQN

SEQ ID NO: 376678 - protein, 10 aa, Influenza virus
KHQNAQGEGT

SEQ ID NO: 376679 - protein, 10 aa, Influenza virus
GTAADYKSTP

SEQ ID NO: 376680 - protein, 10 aa, Influenza virus
TAADYKSTPS

SEQ ID NO: 376681 - protein, 10 aa, Influenza virus
ADYKSTPSAI

SEQ ID NO: 376682 - protein, 10 aa, Influenza virus
DYKSTQSAVD

SEQ ID NO: 376683 - protein, 10 aa, Influenza virus
YKSTQSAVDQ

SEQ ID NO: 376684 - protein, 10 aa, Influenza virus
KSTQSAVDQI

SEQ ID NO: 376685 - protein, 10 aa, Influenza virus
STQSAVDQIT

SEQ ID NO: 376686 - protein, 10 aa, Influenza virus
TQSAVDQITG

SEQ ID NO: 376687 - protein, 10 aa, Influenza virus
QSAVDQITGK

SEQ ID NO: 376688 - protein, 10 aa, Influenza virus
SAVDQITGKL

SEQ ID NO: 376689 - protein, 10 aa, Influenza virus
AVDQITGKLN

SEQ ID NO: 376690 - protein, 10 aa, Influenza virus
VDQITGKLNR

SEQ ID NO: 376691 - protein, 10 aa, Influenza virus
NQITGKLNRI

SEQ ID NO: 376692 - protein, 10 aa, Influenza virus
ITGKLNRIIE

SEQ ID NO: 376693 - protein, 10 aa, Influenza virus
TGKLNRIIEK

SEQ ID NO: 376694 - protein, 10 aa, Influenza virus
GKLNRIIEKT

SEQ ID NO: 376695 - protein, 10 aa, Influenza virus
KLNRIIEKTN

SEQ ID NO: 376696 - protein, 10 aa, Influenza virus
LNRIIEKTNQ

SEQ ID NO: 376697 - protein, 10 aa, Influenza virus
NRIIEKTNQQ

SEQ ID NO: 376698 - protein, 10 aa, Influenza virus
RIIEKTNQQF

SEQ ID NO: 376699 - protein, 10 aa, Influenza virus
IDKTNQQFEM

SEQ ID NO: 376700 - protein, 10 aa, Influenza virus
DKTNQQFEMI

SEQ ID NO: 376701 - protein, 10 aa, Influenza virus
KTNQQFKLID

SEQ ID NO: 376702 - protein, 10 aa, Influenza virus
TNQQFKLIDN

SEQ ID NO: 376703 - protein, 10 aa, Influenza virus
NQQFKLIDNE

SEQ ID NO: 376704 - protein, 10 aa, Influenza virus
QQFKLIDNEF

SEQ ID NO: 376705 - protein, 10 aa, Influenza virus
FSEIEQQIGN

SEQ ID NO: 376706 - protein, 10 aa, Influenza virus
EVERQIGNVI

SEQ ID NO: 376707 - protein, 10 aa, Influenza virus
VERQIGNVIN

SEQ ID NO: 376708 - protein, 10 aa, Influenza virus
ERQIGNVINW

SEQ ID NO: 376709 - protein, 10 aa, Influenza virus
RQIGNVINWT

SEQ ID NO: 376710 - protein, 10 aa, Influenza virus
NVINWTRDSV

SEQ ID NO: 376711 - protein, 10 aa, Influenza virus
VINWTRDSVT

SEQ ID NO: 376712 - protein, 10 aa, Influenza virus
INWTRDSVTE

SEQ ID NO: 376713 - protein, 10 aa, Influenza virus
NWTRDSITEV

SEQ ID NO: 376714 - protein, 10 aa, Influenza virus
WTRDSITEVW

SEQ ID NO: 376715 - protein, 10 aa, Influenza virus
TRDSITEVWS

SEQ ID NO: 376716 - protein, 10 aa, Influenza virus
RDSITEVWSY

SEQ ID NO: 376717 - protein, 10 aa, Influenza virus
DSITEVWSYN

SEQ ID NO: 376718 - protein, 10 aa, Influenza virus
SITEVWSYNA

SEQ ID NO: 376719 - protein, 10 aa, Influenza virus
ITEVWSYNAE

SEQ ID NO: 376720 - protein, 10 aa, Influenza virus
TELWSYNAEL

SEQ ID NO: 376721 - protein, 10 aa, Influenza virus
ELWSYNAELL

SEQ ID NO: 376722 - protein, 10 aa, Influenza virus
LWSYNAELLV

SEQ ID NO: 376723 - protein, 10 aa, Influenza virus
TIDLANSEMN

SEQ ID NO: 376724 - protein, 10 aa, Influenza virus
IDLADSEMNN

SEQ ID NO: 376725 - protein, 10 aa, Influenza virus
DLADSEMSKL

SEQ ID NO: 376726 - protein, 10 aa, Influenza virus
QADSEMNKLY

SEQ ID NO: 376727 - protein, 10 aa, Influenza virus
ANSEMNKLYE

SEQ ID NO: 376728 - protein, 10 aa, Influenza virus
DSEMDKLYTR

SEQ ID NO: 376729 - protein, 10 aa, Influenza virus
SEMDKLYTRV

SEQ ID NO: 376730 - protein, 10 aa, Influenza virus
KLYERVKRQL

SEQ ID NO: 376731 - protein, 10 aa, Influenza virus
LYERVKRQLR

SEQ ID NO: 376732 - protein, 10 aa, Influenza virus
YERVKRQLRE

SEQ ID NO: 376733 - protein, 10 aa, Influenza virus
ERVKRQLREN

SEQ ID NO: 376734 - protein, 10 aa, Influenza virus
RVKRQLRENA

SEQ ID NO: 376735 - protein, 10 aa, Influenza virus
VKRQLRENAE

SEQ ID NO: 376736 - protein, 10 aa, Influenza virus
KRQLRENAEE

SEQ ID NO: 376737 - protein, 10 aa, Influenza virus
CMASIRNSTY

SEQ ID NO: 376738 - protein, 10 aa, Influenza virus
MASIRNSTYD

SEQ ID NO: 376739 - protein, 10 aa, Influenza virus
ASIRNSTYDH

SEQ ID NO: 376740 - protein, 10 aa, Influenza virus
SIRNSTYDHS

SEQ ID NO: 376741 - protein, 10 aa, Influenza virus
RYREEAMQNR

SEQ ID NO: 376742 - protein, 10 aa, Influenza virus
YRAESLQNRI

SEQ ID NO: 376743 - protein, 10 aa, Influenza virus
QNRIRIDPVK

SEQ ID NO: 376744 - protein, 10 aa, Influenza virus
NRIRIDPVKL

SEQ ID NO: 376745 - protein, 10 aa, Influenza virus
DPVKLSGGYK

SEQ ID NO: 376746 - protein, 10 aa, Influenza virus
PVKLSGGYKD

SEQ ID NO: 376747 - protein, 10 aa, Influenza virus
SSGYKEVILW

SEQ ID NO: 376748 - protein, 10 aa, Influenza virus
SGYKEVILWF

SEQ ID NO: 376749 - protein, 10 aa, Influenza virus
GYKEVILWFS

SEQ ID NO: 376750 - protein, 10 aa, Influenza virus
YKEVILWFSF

SEQ ID NO: 376751 - protein, 10 aa, Influenza virus
KEVILWFSFG

SEQ ID NO: 376752 - protein, 10 aa, Influenza virus
EVILWFSFGA

SEQ ID NO: 376753 - protein, 10 aa, Influenza virus
FSFGASCFLF

SEQ ID NO: 376754 - protein, 10 aa, Influenza virus
SFGASCFLLI

SEQ ID NO: 376755 - protein, 10 aa, Influenza virus
FGASCFLLIA

SEQ ID NO: 376756 - protein, 10 aa, Influenza virus
GASCFLLIAI

SEQ ID NO: 376757 - protein, 10 aa, Influenza virus
FMCVKNGNMR

SEQ ID NO: 376758 - protein, 10 aa, Influenza virus
MCVKNGNMRC

SEQ ID NO: 376759 - protein, 10 aa, Influenza virus
CIKDGNMRCT

SEQ ID NO: 376760 - protein, 10 aa, Influenza virus
VKNGNHAVHY

SEQ ID NO: 376761 - protein, 10 aa, Influenza virus
GAVNTTLSTI

SEQ ID NO: 376762 - protein, 10 aa, Influenza virus
AVNTTLSTIA

SEQ ID NO: 376763 - protein, 10 aa, Influenza virus
VNTVLSIIAL

SEQ ID NO: 376764 - protein, 10 aa, Influenza virus
NTTLSTIALF

SEQ ID NO: 376765 - protein, 10 aa, Influenza virus
TTLSTIALFI

SEQ ID NO: 376766 - protein, 10 aa, Influenza virus
TLSTIALFIG

SEQ ID NO: 376767 - protein, 10 aa, Influenza virus
LSTIALIIGV

SEQ ID NO: 376768 - protein, 10 aa, Influenza virus
STIALIIGVG

SEQ ID NO: 376769 - protein, 10 aa, Influenza virus
TIALIIGVGN

SEQ ID NO: 376770 - protein, 10 aa, Influenza virus
IALIIGVGNL

SEQ ID NO: 376771 - protein, 10 aa, Influenza virus
IGIGNLVFNT

SEQ ID NO: 376772 - protein, 10 aa, Influenza virus
GIGNLVFNTV

SEQ ID NO: 376773 - protein, 10 aa, Influenza virus
IGNLVFNTVI

SEQ ID NO: 376774 - protein, 10 aa, Influenza virus
GNLAFNTVIH

SEQ ID NO: 376775 - protein, 10 aa, Influenza virus
NLIFNTVIHE

SEQ ID NO: 376776 - protein, 10 aa, Influenza virus
ITYNNTVVNN

SEQ ID NO: 376777 - protein, 10 aa, Influenza virus
TYNNTVVNNI

SEQ ID NO: 376778 - protein, 10 aa, Influenza virus
YNNTVVNNIT

SEQ ID NO: 376779 - protein, 10 aa, Influenza virus
NNTVVNNITT

SEQ ID NO: 376780 - protein, 10 aa, Influenza virus
NTVVNNITTT

SEQ ID NO: 376781 - protein, 10 aa, Influenza virus
TTINNITNVV

SEQ ID NO: 376782 - protein, 10 aa, Influenza virus
VVNNITTTII

SEQ ID NO: 376783 - protein, 10 aa, Influenza virus
FKPPLPLCPF

SEQ ID NO: 376784 - protein, 10 aa, Influenza virus
SLPLCPFQGF

SEQ ID NO: 376785 - protein, 10 aa, Influenza virus
LPLCPFKGFF

SEQ ID NO: 376786 - protein, 10 aa, Influenza virus
PLCPFKGFFP

SEQ ID NO: 376787 - protein, 10 aa, Influenza virus
LCPFKGFFPF

SEQ ID NO: 376788 - protein, 10 aa, Influenza virus
CPFKGFFPFH

SEQ ID NO: 376789 - protein, 10 aa, Influenza virus
PFKGFFPFHK

SEQ ID NO: 376790 - protein, 10 aa, Influenza virus
FKGFFPFHKD

SEQ ID NO: 376791 - protein, 10 aa, Influenza virus
KGFFPFHKDN

SEQ ID NO: 376792 - protein, 10 aa, Influenza virus
PFHKGNSARL

SEQ ID NO: 376793 - protein, 10 aa, Influenza virus
FHKDNAIRPG

SEQ ID NO: 376794 - protein, 10 aa, Influenza virus
HKDNALRLAE

SEQ ID NO: 376795 - protein, 10 aa, Influenza virus
KDNAIRPGEN

SEQ ID NO: 376796 - protein, 10 aa, Influenza virus
DNAIRPGENK

SEQ ID NO: 376797 - protein, 10 aa, Influenza virus
VIITREPYVS

SEQ ID NO: 376798 - protein, 10 aa, Influenza virus
IITREPYVSC

SEQ ID NO: 376799 - protein, 10 aa, Influenza virus
ITREPYVSCD

SEQ ID NO: 376800 - protein, 10 aa, Influenza virus
TREPYISCDN

SEQ ID NO: 376801 - protein, 10 aa, Influenza virus
HCWSFALAQG

SEQ ID NO: 376802 - protein, 10 aa, Influenza virus
SFALAQGVLL

SEQ ID NO: 376803 - protein, 10 aa, Influenza virus
FALAQGVLLG

SEQ ID NO: 376804 - protein, 10 aa, Influenza virus
ALAQGVLLGT

SEQ ID NO: 376805 - protein, 10 aa, Influenza virus
LAQGALLGTN

SEQ ID NO: 376806 - protein, 10 aa, Influenza virus
AQGALVGTKH

SEQ ID NO: 376807 - protein, 10 aa, Influenza virus
QGALVGTKHS

SEQ ID NO: 376808 - protein, 10 aa, Influenza virus
GALLGTNHSN

SEQ ID NO: 376809 - protein, 10 aa, Influenza virus
ALLGTNHSNG

SEQ ID NO: 376810 - protein, 10 aa, Influenza virus
LVGTKHSNGT

SEQ ID NO: 376811 - protein, 10 aa, Influenza virus
EDRTPYRSLI

SEQ ID NO: 376812 - protein, 10 aa, Influenza virus
DRTSYRSLIR

SEQ ID NO: 376813 - protein, 10 aa, Influenza virus
RTSYRSLIRF

SEQ ID NO: 376814 - protein, 10 aa, Influenza virus
TSYRSLIRFP

SEQ ID NO: 376815 - protein, 10 aa, Influenza virus
PYRSLIQFPM

SEQ ID NO: 376816 - protein, 10 aa, Influenza virus
YRSLIQFPMG

SEQ ID NO: 376817 - protein, 10 aa, Influenza virus
RSLIQFPIGT

SEQ ID NO: 376818 - protein, 10 aa, Influenza virus
SLIQFPIGTA

SEQ ID NO: 376819 - protein, 10 aa, Influenza virus
LIQFPMGTAP

SEQ ID NO: 376820 - protein, 10 aa, Influenza virus
FPMGTAPVLG

SEQ ID NO: 376821 - protein, 10 aa, Influenza virus
PMGTAPVLGN

SEQ ID NO: 376822 - protein, 10 aa, Influenza virus
MGTAPVLGNY

SEQ ID NO: 376823 - protein, 10 aa, Influenza virus
GTAPVLGNYR

SEQ ID NO: 376824 - protein, 10 aa, Influenza virus
TAPVLGNYRE

SEQ ID NO: 376825 - protein, 10 aa, Influenza virus
APILGNYKEI

SEQ ID NO: 376826 - protein, 10 aa, Influenza virus
PILGNYKEIC

SEQ ID NO: 376827 - protein, 10 aa, Influenza virus
LGNYREICIA

SEQ ID NO: 376828 - protein, 10 aa, Influenza virus
GNYREICIAW

SEQ ID NO: 376829 - protein, 10 aa, Influenza virus
NYREICIAWS

SEQ ID NO: 376830 - protein, 10 aa, Influenza virus
YREICIAWSS

SEQ ID NO: 376831 - protein, 10 aa, Influenza virus
EICVAWSSTS

SEQ ID NO: 376832 - protein, 10 aa, Influenza virus
ICVAWSSTSC

SEQ ID NO: 376833 - protein, 10 aa, Influenza virus
CVAWSSTSCF

SEQ ID NO: 376834 - protein, 10 aa, Influenza virus
VAWSSTSCFD

SEQ ID NO: 376835 - protein, 10 aa, Influenza virus
FDGKEWMHVS

SEQ ID NO: 376836 - protein, 10 aa, Influenza virus
DGKEWMHVSM

SEQ ID NO: 376837 - protein, 10 aa, Influenza virus
GKEWLHVCIT

SEQ ID NO: 376838 - protein, 10 aa, Influenza virus
KEWMHVSMTG

SEQ ID NO: 376839 - protein, 10 aa, Influenza virus
GRVTDSIKSW

SEQ ID NO: 376840 - protein, 10 aa, Influenza virus
KMRDSIKSWR

SEQ ID NO: 376841 - protein, 10 aa, Influenza virus
VTDSIKSWRK

SEQ ID NO: 376842 - protein, 10 aa, Influenza virus
SDSIKSWRKD

SEQ ID NO: 376843 - protein, 10 aa, Influenza virus
RTQESECLCI

SEQ ID NO: 376844 - protein, 10 aa, Influenza virus
TQESECQCIS

SEQ ID NO: 376845 - protein, 10 aa, Influenza virus
QESECQCISG

SEQ ID NO: 376846 - protein, 10 aa, Influenza virus
GICVVAVTDG

SEQ ID NO: 376847 - protein, 10 aa, Influenza virus
ICVVAVTDGP

SEQ ID NO: 376848 - protein, 10 aa, Influenza virus
CIVAVTDGPA

SEQ ID NO: 376849 - protein, 10 aa, Influenza virus
IVAVTDGPAA

SEQ ID NO: 376850 - protein, 10 aa, Influenza virus
VSVTDGPAAN

SEQ ID NO: 376851 - protein, 10 aa, Influenza virus
TVTDGPAANS

SEQ ID NO: 376852 - protein, 10 aa, Influenza virus
TDGPADNKAD

SEQ ID NO: 376853 - protein, 10 aa, Influenza virus
DGPAANSAHH

SEQ ID NO: 376854 - protein, 10 aa, Influenza virus
GPADNKADHR

SEQ ID NO: 376855 - protein, 10 aa, Influenza virus
PAANNADHRI

SEQ ID NO: 376856 - protein, 10 aa, Influenza virus
AANNADHRIY

SEQ ID NO: 376857 - protein, 10 aa, Influenza virus
ANNADHRIYW

SEQ ID NO: 376858 - protein, 10 aa, Influenza virus
NNADHRIYWI

SEQ ID NO: 376859 - protein, 10 aa, Influenza virus
NADHRIYWIR

SEQ ID NO: 376860 - protein, 10 aa, Influenza virus
ADHRIYWIRK

SEQ ID NO: 376861 - protein, 10 aa, Influenza virus
DHRIYWIRKG

SEQ ID NO: 376862 - protein, 10 aa, Influenza virus
HRIYWIRKGR

SEQ ID NO: 376863 - protein, 10 aa, Influenza virus
RIQHLEECSC

SEQ ID NO: 376864 - protein, 10 aa, Influenza virus
IRHLEECSCY

SEQ ID NO: 376865 - protein, 10 aa, Influenza virus
QHLEECSCYM

SEQ ID NO: 376866 - protein, 10 aa, Influenza virus
HLEECSCYTD

SEQ ID NO: 376867 - protein, 10 aa, Influenza virus
LEECSCYVDV

SEQ ID NO: 376868 - protein, 10 aa, Influenza virus
EECSCYVDTD

SEQ ID NO: 376869 - protein, 10 aa, Influenza virus
ECSCYMDIDV

SEQ ID NO: 376870 - protein, 10 aa, Influenza virus
CSCYMDIDVY

SEQ ID NO: 376871 - protein, 10 aa, Influenza virus
SCYMDIDVYC

SEQ ID NO: 376872 - protein, 10 aa, Influenza virus
DIDVYCVCRD

SEQ ID NO: 376873 - protein, 10 aa, Influenza virus
IDVYCVCRDN

SEQ ID NO: 376874 - protein, 10 aa, Influenza virus
DVYCVCRDNW

SEQ ID NO: 376875 - protein, 10 aa, Influenza virus
VYCVCRDNWK

SEQ ID NO: 376876 - protein, 10 aa, Influenza virus
NWKGSNRPWV

SEQ ID NO: 376877 - protein, 10 aa, Influenza virus
WKGSNRPWVR

SEQ ID NO: 376878 - protein, 10 aa, Influenza virus
KGSNRPWVRI

SEQ ID NO: 376879 - protein, 10 aa, Influenza virus
GSNRPWMRIS

SEQ ID NO: 376880 - protein, 10 aa, Influenza virus
SNRPWMRISN

SEQ ID NO: 376881 - protein, 10 aa, Influenza virus
NRPWMRISNE

SEQ ID NO: 376882 - protein, 10 aa, Influenza virus
RPWMRISNET

SEQ ID NO: 376883 - protein, 10 aa, Influenza virus
PWMRISNETI

SEQ ID NO: 376884 - protein, 10 aa, Influenza virus
WMRISNETIL

SEQ ID NO: 376885 - protein, 10 aa, Influenza virus
MRISNETILE

SEQ ID NO: 376886 - protein, 10 aa, Influenza virus
RMNNETILET

SEQ ID NO: 376887 - protein, 10 aa, Influenza virus
INNETIVETG

SEQ ID NO: 376888 - protein, 10 aa, Influenza virus
NNETILETRY

SEQ ID NO: 376889 - protein, 10 aa, Influenza virus
NETIVETGYV

SEQ ID NO: 376890 - protein, 10 aa, Influenza virus
ETIVETGYVC

SEQ ID NO: 376891 - protein, 10 aa, Influenza virus
TILETRYVCS

SEQ ID NO: 376892 - protein, 10 aa, Influenza virus
ILETGYICSK

SEQ ID NO: 376893 - protein, 10 aa, Influenza virus
VETGYVCSKF

SEQ ID NO: 376894 - protein, 10 aa, Influenza virus
KFHSDTPRPT

SEQ ID NO: 376895 - protein, 10 aa, Influenza virus
FHSDTPRPTD

SEQ ID NO: 376896 - protein, 10 aa, Influenza virus
HSDTPRPVDP

SEQ ID NO: 376897 - protein, 10 aa, Influenza virus
SDTPRPVDPS

SEQ ID NO: 376898 - protein, 10 aa, Influenza virus
DPSTISCDSP

SEQ ID NO: 376899 - protein, 10 aa, Influenza virus
PSTISCDSPS

SEQ ID NO: 376900 - protein, 10 aa, Influenza virus
STISCDSPSN

SEQ ID NO: 376901 - protein, 10 aa, Influenza virus
SCDSPSNVKG

SEQ ID NO: 376902 - protein, 10 aa, Influenza virus
CDSPSNINGE

SEQ ID NO: 376903 - protein, 10 aa, Influenza virus
NGEPGVKGFG

SEQ ID NO: 376904 - protein, 10 aa, Influenza virus
GEPGVKGFGF

SEQ ID NO: 376905 - protein, 10 aa, Influenza virus
EPGVKGFGFK

SEQ ID NO: 376906 - protein, 10 aa, Influenza virus
GVKGFGFKKG

SEQ ID NO: 376907 - protein, 10 aa, Influenza virus
GSDVWLGRTV

SEQ ID NO: 376908 - protein, 10 aa, Influenza virus
SDVWLGRTVS

SEQ ID NO: 376909 - protein, 10 aa, Influenza virus
DVWLGRTVSI

SEQ ID NO: 376910 - protein, 10 aa, Influenza virus
VWLGRTVSIN

SEQ ID NO: 376911 - protein, 10 aa, Influenza virus
WLGRTVSING

SEQ ID NO: 376912 - protein, 10 aa, Influenza virus
LGRTVSISGR

SEQ ID NO: 376913 - protein, 10 aa, Influenza virus
GRTVSISGRS

SEQ ID NO: 376914 - protein, 10 aa, Influenza virus
EGWINSPSQA

SEQ ID NO: 376915 - protein, 10 aa, Influenza virus
GWINSPSQAK

SEQ ID NO: 376916 - protein, 10 aa, Influenza virus
WINSPSQAKS

SEQ ID NO: 376917 - protein, 10 aa, Influenza virus
VKSITQTLVS

SEQ ID NO: 376918 - protein, 10 aa, Influenza virus
KAATQTLVSN

SEQ ID NO: 376919 - protein, 10 aa, Influenza virus
SLTQTLVSNN

SEQ ID NO: 376920 - protein, 10 aa, Influenza virus
ITQTLVSNDD

SEQ ID NO: 376921 - protein, 10 aa, Influenza virus
WSGYSGSFTV

SEQ ID NO: 376922 - protein, 10 aa, Influenza virus
GCFQPCFYVE

SEQ ID NO: 376923 - protein, 10 aa, Influenza virus
FQSCFYVELI

SEQ ID NO: 376924 - protein, 10 aa, Influenza virus
QSCFYVELIR

SEQ ID NO: 376925 - protein, 10 aa, Influenza virus
PCFYVELTRG

SEQ ID NO: 376926 - protein, 10 aa, Influenza virus
CFYIELIRGK

SEQ ID NO: 376927 - protein, 10 aa, Influenza virus
FYIELIRGKP

SEQ ID NO: 376928 - protein, 10 aa, Influenza virus
YIELIRGKPN

SEQ ID NO: 376929 - protein, 10 aa, Influenza virus
NDEVSWTSNS

SEQ ID NO: 376930 - protein, 10 aa, Influenza virus
DEVSWTSNSI

SEQ ID NO: 376931 - protein, 10 aa, Influenza virus
EVSWTSNSIV

SEQ ID NO: 376932 - protein, 10 aa, Influenza virus
GLDNEPGSGK

SEQ ID NO: 376933 - protein, 10 aa, Influenza virus
LDNEPGSGHW

SEQ ID NO: 376934 - protein, 10 aa, Influenza virus
GSGNWPDGSD

SEQ ID NO: 376935 - protein, 10 aa, Influenza virus
SGNWPDGSDI

SEQ ID NO: 376936 - protein, 10 aa, Influenza virus
GHWPDGSNIG

SEQ ID NO: 376937 - protein, 10 aa, Influenza virus
HWPDGSNIGF

SEQ ID NO: 376938 - protein, 10 aa, Influenza virus
MKSRGYKMNT

SEQ ID NO: 376939 - protein, 10 aa, Influenza virus
KSRGYKMNIQ

SEQ ID NO: 376940 - protein, 10 aa, Influenza virus
SRGYKMNTKI

SEQ ID NO: 376941 - protein, 10 aa, Influenza virus
RGYKMNTKIL

SEQ ID NO: 376942 - protein, 10 aa, Influenza virus
GYKMNTKILV

SEQ ID NO: 376943 - protein, 10 aa, Influenza virus
YKMNTQILIF

SEQ ID NO: 376944 - protein, 10 aa, Influenza virus
KMNTKILVLA

SEQ ID NO: 376945 - protein, 10 aa, Influenza virus
ADKICLGRHA

SEQ ID NO: 376946 - protein, 10 aa, Influenza virus
DKISLGHHAV

SEQ ID NO: 376947 - protein, 10 aa, Influenza virus
NGIKVDTLTE

SEQ ID NO: 376948 - protein, 10 aa, Influenza virus
GAKVNTLTER

SEQ ID NO: 376949 - protein, 10 aa, Influenza virus
KVNTLTERGI

SEQ ID NO: 376950 - protein, 10 aa, Influenza virus
VNTLTERGIE

SEQ ID NO: 376951 - protein, 10 aa, Influenza virus
NTLTERGIEV

SEQ ID NO: 376952 - protein, 10 aa, Influenza virus
TLTERGIEVV

SEQ ID NO: 376953 - protein, 10 aa, Influenza virus
LTERGIEVVN

SEQ ID NO: 376954 - protein, 10 aa, Influenza virus
TERGIEVVNA

SEQ ID NO: 376955 - protein, 10 aa, Influenza virus
ERGIEVVNAT

SEQ ID NO: 376956 - protein, 10 aa, Influenza virus
RGIEVVNATE

SEQ ID NO: 376957 - protein, 10 aa, Influenza virus
EVEVVNATET

SEQ ID NO: 376958 - protein, 10 aa, Influenza virus
VVNATETVET

SEQ ID NO: 376959 - protein, 10 aa, Influenza virus
DLSQCGLLGT

SEQ ID NO: 376960 - protein, 10 aa, Influenza virus
IGPPQCDLFL

SEQ ID NO: 376961 - protein, 10 aa, Influenza virus
LRQILRGSGG

SEQ ID NO: 376962 - protein, 10 aa, Influenza virus
TGFTYSGIRT

SEQ ID NO: 376963 - protein, 10 aa, Influenza virus
GFTYSGIRTD

SEQ ID NO: 376964 - protein, 10 aa, Influenza virus
FTYSGIRTDG

SEQ ID NO: 376965 - protein, 10 aa, Influenza virus
RSESSFYAEM

SEQ ID NO: 376966 - protein, 10 aa, Influenza virus
SGPSFYAEMK

SEQ ID NO: 376967 - protein, 10 aa, Influenza virus
ESSFYAEMEW

SEQ ID NO: 376968 - protein, 10 aa, Influenza virus
PSFYAEMKWL

SEQ ID NO: 376969 - protein, 10 aa, Influenza virus
YAEMEWLLSN

SEQ ID NO: 376970 - protein, 10 aa, Influenza virus
FPQMTKSYRN

SEQ ID NO: 376971 - protein, 10 aa, Influenza virus
PALIIWGVHH

SEQ ID NO: 376972 - protein, 10 aa, Influenza virus
TVWSSKYQQS

SEQ ID NO: 376973 - protein, 10 aa, Influenza virus
RPQMNGQSGR

SEQ ID NO: 376974 - protein, 10 aa, Influenza virus
PQMNGQSGRI

SEQ ID NO: 376975 - protein, 10 aa, Influenza virus
QMNGQSGRID

SEQ ID NO: 376976 - protein, 10 aa, Influenza virus
MNGQSGRIDF

SEQ ID NO: 376977 - protein, 10 aa, Influenza virus
QSGRIDFHWM

SEQ ID NO: 376978 - protein, 10 aa, Influenza virus
NDTITFSFNG

SEQ ID NO: 376979 - protein, 10 aa, Influenza virus
DTITFSFNGA

SEQ ID NO: 376980 - protein, 10 aa, Influenza virus
TITFSFNGAF

SEQ ID NO: 376981 - protein, 10 aa, Influenza virus
TFSFNGAFVA

SEQ ID NO: 376982 - protein, 10 aa, Influenza virus
FSFNGAFVAP

SEQ ID NO: 376983 - protein, 10 aa, Influenza virus
FNGAFIAPNR

SEQ ID NO: 376984 - protein, 10 aa, Influenza virus
NGAFIAPNRA

SEQ ID NO: 376985 - protein, 10 aa, Influenza virus
GAFIAPNRAS

SEQ ID NO: 376986 - protein, 10 aa, Influenza virus
AFIAPNRASF

SEQ ID NO: 376987 - protein, 10 aa, Influenza virus
LPFQNINPRT

SEQ ID NO: 376988 - protein, 10 aa, Influenza virus
VGKCPKYVKQ

SEQ ID NO: 376989 - protein, 10 aa, Influenza virus
SLLLATGMRN

SEQ ID NO: 376990 - protein, 10 aa, Influenza virus
LLLATGMRNV

SEQ ID NO: 376991 - protein, 10 aa, Influenza virus
LLATGMRNVP

SEQ ID NO: 376992 - protein, 10 aa, Influenza virus
IHKQLTHHMR

SEQ ID NO: 376993 - protein, 10 aa, Influenza virus
KKRKKRGLFG

SEQ ID NO: 376994 - protein, 10 aa, Influenza virus
KKKKRGLFGA

SEQ ID NO: 376995 - protein, 10 aa, Influenza virus
RKRGLFGAIA

SEQ ID NO: 376996 - protein, 10 aa, Influenza virus
EGLIDGWYGY

SEQ ID NO: 376997 - protein, 10 aa, Influenza virus
GLIDGWYGYR

SEQ ID NO: 376998 - protein, 10 aa, Influenza virus
LIDGWYGYRH

SEQ ID NO: 376999 - protein, 10 aa, Influenza virus
IDGWYGYRHQ

SEQ ID NO: 377000 - protein, 10 aa, Influenza virus
DGWYGYKHQN

SEQ ID NO: 377001 - protein, 10 aa, Influenza virus
GWYGYKHQNA

SEQ ID NO: 377002 - protein, 10 aa, Influenza virus
WYGFRHQNSQ

SEQ ID NO: 377003 - protein, 10 aa, Influenza virus
YGFRHQNSQG

SEQ ID NO: 377004 - protein, 10 aa, Influenza virus
GFRHQNSQGE

SEQ ID NO: 377005 - protein, 10 aa, Influenza virus
YKHQNAQGEG

SEQ ID NO: 377006 - protein, 10 aa, Influenza virus
RHQNSQGEGT

SEQ ID NO: 377007 - protein, 10 aa, Influenza virus
HQNAQGEGIA

SEQ ID NO: 377008 - protein, 10 aa, Influenza virus
QKAQGEGTAA

SEQ ID NO: 377009 - protein, 10 aa, Influenza virus
NAQGEGIAAD

SEQ ID NO: 377010 - protein, 10 aa, Influenza virus
DYKSTQSAVN

SEQ ID NO: 377011 - protein, 10 aa, Influenza virus
YKSTQSAVNQ

SEQ ID NO: 377012 - protein, 10 aa, Influenza virus
KSTQSAVNQI

SEQ ID NO: 377013 - protein, 10 aa, Influenza virus
STQSAVNQIT

SEQ ID NO: 377014 - protein, 10 aa, Influenza virus
TQSAVNQITG

SEQ ID NO: 377015 - protein, 10 aa, Influenza virus
QSAIDQITRK

SEQ ID NO: 377016 - protein, 10 aa, Influenza virus
SAIDQITRKL

SEQ ID NO: 377017 - protein, 10 aa, Influenza virus
AIDQITRKLN

SEQ ID NO: 377018 - protein, 10 aa, Influenza virus
IDQITGTLNR

SEQ ID NO: 377019 - protein, 10 aa, Influenza virus
DQITRKLNRL

SEQ ID NO: 377020 - protein, 10 aa, Influenza virus
ITGTLNRLID

SEQ ID NO: 377021 - protein, 10 aa, Influenza virus
TGKLNRLIER

SEQ ID NO: 377022 - protein, 10 aa, Influenza virus
GKLNRLIERT

SEQ ID NO: 377023 - protein, 10 aa, Influenza virus
KLNRLIERTN

SEQ ID NO: 377024 - protein, 10 aa, Influenza virus
LNRLIERTNQ

SEQ ID NO: 377025 - protein, 10 aa, Influenza virus
NRLIERTNQQ

SEQ ID NO: 377026 - protein, 10 aa, Influenza virus
RLIERTNQQF

SEQ ID NO: 377027 - protein, 10 aa, Influenza virus
LIERTNQQFE

SEQ ID NO: 377028 - protein, 10 aa, Influenza virus
IERTNQQFEL

SEQ ID NO: 377029 - protein, 10 aa, Influenza virus
ERTNQQFELI

SEQ ID NO: 377030 - protein, 10 aa, Influenza virus
KTNQQFEMID

SEQ ID NO: 377031 - protein, 10 aa, Influenza virus
NQQFELIDNK

SEQ ID NO: 377032 - protein, 10 aa, Influenza virus
QQFELIDNKF

SEQ ID NO: 377033 - protein, 10 aa, Influenza virus
QFELIDNEFS

SEQ ID NO: 377034 - protein, 10 aa, Influenza virus
FELIDNEFSE

SEQ ID NO: 377035 - protein, 10 aa, Influenza virus
EIEQQIGNVI

SEQ ID NO: 377036 - protein, 10 aa, Influenza virus
IEQQIGNVIN

SEQ ID NO: 377037 - protein, 10 aa, Influenza virus
ERQIGNVINW

SEQ ID NO: 377038 - protein, 10 aa, Influenza virus
RQIGNVINWT

SEQ ID NO: 377039 - protein, 10 aa, Influenza virus
NVINWTRDSL

SEQ ID NO: 377040 - protein, 10 aa, Influenza virus
VINWTRDSII

SEQ ID NO: 377041 - protein, 10 aa, Influenza virus
INWTRDSIIE

SEQ ID NO: 377042 - protein, 10 aa, Influenza virus
TEMWSYNAEL

SEQ ID NO: 377043 - protein, 10 aa, Influenza virus
EMWSYNAELL

SEQ ID NO: 377044 - protein, 10 aa, Influenza virus
WSYNAELLIA

SEQ ID NO: 377045 - protein, 10 aa, Influenza virus
SYNAELLIAM

SEQ ID NO: 377046 - protein, 10 aa, Influenza virus
YNAELLIAME

SEQ ID NO: 377047 - protein, 10 aa, Influenza virus
NAELLIAMEN

SEQ ID NO: 377048 - protein, 10 aa, Influenza virus
ADLLVAMENQ

SEQ ID NO: 377049 - protein, 10 aa, Influenza virus
DLLVAMENQH

SEQ ID NO: 377050 - protein, 10 aa, Influenza virus
LLIAMENQHT

SEQ ID NO: 377051 - protein, 10 aa, Influenza virus
LIAMENQHTI

SEQ ID NO: 377052 - protein, 10 aa, Influenza virus
IAMENQHTID

SEQ ID NO: 377053 - protein, 10 aa, Influenza virus
AMENQHIIDL

SEQ ID NO: 377054 - protein, 10 aa, Influenza virus
MENQHTIDLT

SEQ ID NO: 377055 - protein, 10 aa, Influenza virus
ENQHTIDLAE

SEQ ID NO: 377056 - protein, 10 aa, Influenza virus
NQHTIDLTNS

SEQ ID NO: 377057 - protein, 10 aa, Influenza virus
QHTIDLTNSE

SEQ ID NO: 377058 - protein, 10 aa, Influenza virus
HTIDLAESEM

SEQ ID NO: 377059 - protein, 10 aa, Influenza virus
TIDLAESEMN

SEQ ID NO: 377060 - protein, 10 aa, Influenza virus
IDLAESEMNK

SEQ ID NO: 377061 - protein, 10 aa, Influenza virus
DLAESEMNKL

SEQ ID NO: 377062 - protein, 10 aa, Influenza virus
LTNSEMNKLY

SEQ ID NO: 377063 - protein, 10 aa, Influenza virus
TNSEMNKLYE

SEQ ID NO: 377064 - protein, 10 aa, Influenza virus
ESEMNKLYER

SEQ ID NO: 377065 - protein, 10 aa, Influenza virus
EMNKLYEKVR

SEQ ID NO: 377066 - protein, 10 aa, Influenza virus
MNKLYEKVRR

SEQ ID NO: 377067 - protein, 10 aa, Influenza virus
NKLYEKVRRQ

SEQ ID NO: 377068 - protein, 10 aa, Influenza virus
KLYEKVRRQL

SEQ ID NO: 377069 - protein, 10 aa, Influenza virus
LYEKVRRQLR

SEQ ID NO: 377070 - protein, 10 aa, Influenza virus
YEKVRRQLRE

SEQ ID NO: 377071 - protein, 10 aa, Influenza virus
EKVRRQLREN

SEQ ID NO: 377072 - protein, 10 aa, Influenza virus
KVRRQLRENA

SEQ ID NO: 377073 - protein, 10 aa, Influenza virus
VRKQLRENAE

SEQ ID NO: 377074 - protein, 10 aa, Influenza virus
RKQLRENAEE

SEQ ID NO: 377075 - protein, 10 aa, Influenza virus
LRENAEEDCT

SEQ ID NO: 377076 - protein, 10 aa, Influenza virus
RENAEEDCTG

SEQ ID NO: 377077 - protein, 10 aa, Influenza virus
ENAEEDCTGC

SEQ ID NO: 377078 - protein, 10 aa, Influenza virus
NAEEDCTGCF

SEQ ID NO: 377079 - protein, 10 aa, Influenza virus
AEEDCTGCFE

SEQ ID NO: 377080 - protein, 10 aa, Influenza virus
EEDCTGCFEI

SEQ ID NO: 377081 - protein, 10 aa, Influenza virus
EDCTGCFEIF

SEQ ID NO: 377082 - protein, 10 aa, Influenza virus
DCTGCFEIFH

SEQ ID NO: 377083 - protein, 10 aa, Influenza virus
CTGCFEIFHK

SEQ ID NO: 377084 - protein, 10 aa, Influenza virus
TACFEIFHKC

SEQ ID NO: 377085 - protein, 10 aa, Influenza virus
GCFELFHKCD

SEQ ID NO: 377086 - protein, 10 aa, Influenza virus
FEIFHKCDDQ

SEQ ID NO: 377087 - protein, 10 aa, Influenza virus
EIFHKCDDQC

SEQ ID NO: 377088 - protein, 10 aa, Influenza virus
IFHKCDDQCM

SEQ ID NO: 377089 - protein, 10 aa, Influenza virus
CMTSIRNNTY

SEQ ID NO: 377090 - protein, 10 aa, Influenza virus
MASIRNNSYD

SEQ ID NO: 377091 - protein, 10 aa, Influenza virus
ANIRNNTYDH

SEQ ID NO: 377092 - protein, 10 aa, Influenza virus
SIRNNTYDHT

SEQ ID NO: 377093 - protein, 10 aa, Influenza virus
IRNNTYDHTQ

SEQ ID NO: 377094 - protein, 10 aa, Influenza virus
RNNTYDHTQY

SEQ ID NO: 377095 - protein, 10 aa, Influenza virus
NNTYDHTQYR

SEQ ID NO: 377096 - protein, 10 aa, Influenza virus
INPVKLSSGY

SEQ ID NO: 377097 - protein, 10 aa, Influenza virus
NPVKLSSGYK

SEQ ID NO: 377098 - protein, 10 aa, Influenza virus
PVKLSSGYKE

SEQ ID NO: 377099 - protein, 10 aa, Influenza virus
VELSSGYKDV

SEQ ID NO: 377100 - protein, 10 aa, Influenza virus
KLSSGYKEVI

SEQ ID NO: 377101 - protein, 10 aa, Influenza virus
LSGGYKDVIL

SEQ ID NO: 377102 - protein, 10 aa, Influenza virus
SSGYKEVILW

SEQ ID NO: 377103 - protein, 10 aa, Influenza virus
SGYKEVILWF

SEQ ID NO: 377104 - protein, 10 aa, Influenza virus
GYKEVILWFS

SEQ ID NO: 377105 - protein, 10 aa, Influenza virus
YKEVILWFSF

SEQ ID NO: 377106 - protein, 10 aa, Influenza virus
KDVILWFSLG

SEQ ID NO: 377107 - protein, 10 aa, Influenza virus
EVILWFSFGA

SEQ ID NO: 377108 - protein, 10 aa, Influenza virus
VILWFSLGAS

SEQ ID NO: 377109 - protein, 10 aa, Influenza virus
WFSFGASCFT

SEQ ID NO: 377110 - protein, 10 aa, Influenza virus
FSFGASCFLF

SEQ ID NO: 377111 - protein, 10 aa, Influenza virus
GASCFLFLAI

SEQ ID NO: 377112 - protein, 10 aa, Influenza virus
LAFICIKNGN

SEQ ID NO: 377113 - protein, 10 aa, Influenza virus
VFICIKNGNM

SEQ ID NO: 377114 - protein, 10 aa, Influenza virus
FICIKNGNMR

SEQ ID NO: 377115 - protein, 10 aa, Influenza virus
ICIKNGNMRC

SEQ ID NO: 377116 - protein, 10 aa, Influenza virus
CVKNGNMQCT

SEQ ID NO: 377117 - protein, 10 aa, Influenza virus
VKNGNMQCTI

SEQ ID NO: 377118 - protein, 10 aa, Influenza virus
KNGNHAVHYC

SEQ ID NO: 377119 - protein, 10 aa, Influenza virus
NGNHAVHYCI

SEQ ID NO: 377120 - protein, 10 aa, Influenza virus
MNPSQKLFAL

SEQ ID NO: 377121 - protein, 10 aa, Influenza virus
NPSQKLFALS

SEQ ID NO: 377122 - protein, 10 aa, Influenza virus
PSQKLFALSG

SEQ ID NO: 377123 - protein, 10 aa, Influenza virus
SQKLFALSGV

SEQ ID NO: 377124 - protein, 10 aa, Influenza virus
QKLFTLSGVA

SEQ ID NO: 377125 - protein, 10 aa, Influenza virus
KLFTLSGVAI

SEQ ID NO: 377126 - protein, 10 aa, Influenza virus
LFASSGIAIA

SEQ ID NO: 377127 - protein, 10 aa, Influenza virus
FASSGIAIAL

SEQ ID NO: 377128 - protein, 10 aa, Influenza virus
ASSGIAIALG

SEQ ID NO: 377129 - protein, 10 aa, Influenza virus
SSGIAIVLGI

SEQ ID NO: 377130 - protein, 10 aa, Influenza virus
SGIAIVLGII

SEQ ID NO: 377131 - protein, 10 aa, Influenza virus
GIAIVLGIIN

SEQ ID NO: 377132 - protein, 10 aa, Influenza virus
IAIVLGIINL

SEQ ID NO: 377133 - protein, 10 aa, Influenza virus
AIVLGIINLL

SEQ ID NO: 377134 - protein, 10 aa, Influenza virus
IVLGIINLLI

SEQ ID NO: 377135 - protein, 10 aa, Influenza virus
VLGIINLLIG

SEQ ID NO: 377136 - protein, 10 aa, Influenza virus
LGIINLLIGI

SEQ ID NO: 377137 - protein, 10 aa, Influenza virus
GIINLLIGIS

SEQ ID NO: 377138 - protein, 10 aa, Influenza virus
IINLLIGISN

SEQ ID NO: 377139 - protein, 10 aa, Influenza virus
LNLLIGVSNV

SEQ ID NO: 377140 - protein, 10 aa, Influenza virus
NLLIGVSNVG

SEQ ID NO: 377141 - protein, 10 aa, Influenza virus
LLIGVSNVGL

SEQ ID NO: 377142 - protein, 10 aa, Influenza virus
LIGVSNVGLN

SEQ ID NO: 377143 - protein, 10 aa, Influenza virus
SNVVLNVSLH

SEQ ID NO: 377144 - protein, 10 aa, Influenza virus
NVVLNVSLHL

SEQ ID NO: 377145 - protein, 10 aa, Influenza virus
KNTYVNNTTI

SEQ ID NO: 377146 - protein, 10 aa, Influenza virus
NTYINNATII

SEQ ID NO: 377147 - protein, 10 aa, Influenza virus
GYLLLNKSLC

SEQ ID NO: 377148 - protein, 10 aa, Influenza virus
YLLLNKSLCS

SEQ ID NO: 377149 - protein, 10 aa, Influenza virus
LLLNKSLCSV

SEQ ID NO: 377150 - protein, 10 aa, Influenza virus
LLNKSLCSVE

SEQ ID NO: 377151 - protein, 10 aa, Influenza virus
LNKSLCSVEG

SEQ ID NO: 377152 - protein, 10 aa, Influenza virus
NKSLCSVEGW

SEQ ID NO: 377153 - protein, 10 aa, Influenza virus
KSLCSVEGWV

SEQ ID NO: 377154 - protein, 10 aa, Influenza virus
SLCSVEGWVV

SEQ ID NO: 377155 - protein, 10 aa, Influenza virus
LCNVEGWVVV

SEQ ID NO: 377156 - protein, 10 aa, Influenza virus
IEGWVVVAKD

SEQ ID NO: 377157 - protein, 10 aa, Influenza virus
EGWVVIAQDN

SEQ ID NO: 377158 - protein, 10 aa, Influenza virus
GWVVIEKDNA

SEQ ID NO: 377159 - protein, 10 aa, Influenza virus
WVVIAKDNAI

SEQ ID NO: 377160 - protein, 10 aa, Influenza virus
VVIAKDNAIR

SEQ ID NO: 377161 - protein, 10 aa, Influenza virus
VIAKDNAIRF

SEQ ID NO: 377162 - protein, 10 aa, Influenza virus
IAKDNAIRFG

SEQ ID NO: 377163 - protein, 10 aa, Influenza virus
AQDNAIRFGE

SEQ ID NO: 377164 - protein, 10 aa, Influenza virus
QDNAIRFGES

SEQ ID NO: 377165 - protein, 10 aa, Influenza virus
AIRFGESEQV

SEQ ID NO: 377166 - protein, 10 aa, Influenza virus
IRFGESEQVI

SEQ ID NO: 377167 - protein, 10 aa, Influenza virus
RFGESEQIVV

SEQ ID NO: 377168 - protein, 10 aa, Influenza virus
FGESEQIVVT

SEQ ID NO: 377169 - protein, 10 aa, Influenza virus
GESEQIVVTR

SEQ ID NO: 377170 - protein, 10 aa, Influenza virus
ESEQIVVTRE

SEQ ID NO: 377171 - protein, 10 aa, Influenza virus
SEQIVVTREP

SEQ ID NO: 377172 - protein, 10 aa, Influenza virus
EQIVVTREPY

SEQ ID NO: 377173 - protein, 10 aa, Influenza virus
QIVVTREPYV

SEQ ID NO: 377174 - protein, 10 aa, Influenza virus
IVVTREPYVS

SEQ ID NO: 377175 - protein, 10 aa, Influenza virus
REPYVSCDPS

SEQ ID NO: 377176 - protein, 10 aa, Influenza virus
GCRMYALHQG

SEQ ID NO: 377177 - protein, 10 aa, Influenza virus
IRNKHSNGTT

SEQ ID NO: 377178 - protein, 10 aa, Influenza virus
RNKHSNGTTH

SEQ ID NO: 377179 - protein, 10 aa, Influenza virus
NKHSNGTTHD

SEQ ID NO: 377180 - protein, 10 aa, Influenza virus
KHSNGTTHDR

SEQ ID NO: 377181 - protein, 10 aa, Influenza virus
HSNGTTHDRT

SEQ ID NO: 377182 - protein, 10 aa, Influenza virus
SNGTTHDRTA

SEQ ID NO: 377183 - protein, 10 aa, Influenza virus
NGTTHDRTAF

SEQ ID NO: 377184 - protein, 10 aa, Influenza virus
GTTHDRTAFR

SEQ ID NO: 377185 - protein, 10 aa, Influenza virus
TIHDRTTFRG

SEQ ID NO: 377186 - protein, 10 aa, Influenza virus
IHDRTTFRGL

SEQ ID NO: 377187 - protein, 10 aa, Influenza virus
HDRAAFRGLI

SEQ ID NO: 377188 - protein, 10 aa, Influenza virus
DRAAFRGLIS

SEQ ID NO: 377189 - protein, 10 aa, Influenza virus
RTTFRGLIST

SEQ ID NO: 377190 - protein, 10 aa, Influenza virus
FRGLISTQLG

SEQ ID NO: 377191 - protein, 10 aa, Influenza virus
SNSDFLCVGW

SEQ ID NO: 377192 - protein, 10 aa, Influenza virus
NSDFICVGWS

SEQ ID NO: 377193 - protein, 10 aa, Influenza virus
SDFLCVGWSS

SEQ ID NO: 377194 - protein, 10 aa, Influenza virus
DFLCVGWSST

SEQ ID NO: 377195 - protein, 10 aa, Influenza virus
FLCVGWSSTS

SEQ ID NO: 377196 - protein, 10 aa, Influenza virus
LCVGWSSTSC

SEQ ID NO: 377197 - protein, 10 aa, Influenza virus
WSSTSCHDGV

SEQ ID NO: 377198 - protein, 10 aa, Influenza virus
CHDGVNRMTI

SEQ ID NO: 377199 - protein, 10 aa, Influenza virus
HDGVNRMTIC

SEQ ID NO: 377200 - protein, 10 aa, Influenza virus
RMTICVQGDN

SEQ ID NO: 377201 - protein, 10 aa, Influenza virus
QGNNNNATAT

SEQ ID NO: 377202 - protein, 10 aa, Influenza virus
GNNENATATV

SEQ ID NO: 377203 - protein, 10 aa, Influenza virus
NNNNATATVY

SEQ ID NO: 377204 - protein, 10 aa, Influenza virus
NNNATATVYY

SEQ ID NO: 377205 - protein, 10 aa, Influenza virus
DNATATVYYD

SEQ ID NO: 377206 - protein, 10 aa, Influenza virus
NATATVYYNK

SEQ ID NO: 377207 - protein, 10 aa, Influenza virus
ATATVYYNKR

SEQ ID NO: 377208 - protein, 10 aa, Influenza virus
TATVYYNKRL

SEQ ID NO: 377209 - protein, 10 aa, Influenza virus
ATVYYNKRLT

SEQ ID NO: 377210 - protein, 10 aa, Influenza virus
TVYYNKRLTT

SEQ ID NO: 377211 - protein, 10 aa, Influenza virus
VYYNKRLTTT

SEQ ID NO: 377212 - protein, 10 aa, Influenza virus
YYNKRLTTTI

SEQ ID NO: 377213 - protein, 10 aa, Influenza virus
GRLTTTIKTW

SEQ ID NO: 377214 - protein, 10 aa, Influenza virus
RLTTTVKTWA

SEQ ID NO: 377215 - protein, 10 aa, Influenza virus
LTTTIKTWAG

SEQ ID NO: 377216 - protein, 10 aa, Influenza virus
TTTIKTWAGN

SEQ ID NO: 377217 - protein, 10 aa, Influenza virus
TTIKTWAGNI

SEQ ID NO: 377218 - protein, 10 aa, Influenza virus
TIKTWAGNIL

SEQ ID NO: 377219 - protein, 10 aa, Influenza virus
IKTWAGNILR

SEQ ID NO: 377220 - protein, 10 aa, Influenza virus
KTWAGNILRT

SEQ ID NO: 377221 - protein, 10 aa, Influenza virus
TWAGNILRTQ

SEQ ID NO: 377222 - protein, 10 aa, Influenza virus
WAGNILRTQE

SEQ ID NO: 377223 - protein, 10 aa, Influenza virus
AGNILRTQES

SEQ ID NO: 377224 - protein, 10 aa, Influenza virus
GNILRTQESE

SEQ ID NO: 377225 - protein, 10 aa, Influenza virus
LRTQDSECVS

SEQ ID NO: 377226 - protein, 10 aa, Influenza virus
RTQDSECVSH

SEQ ID NO: 377227 - protein, 10 aa, Influenza virus
TQDSECVSHN

SEQ ID NO: 377228 - protein, 10 aa, Influenza virus
QESECVRHNG

SEQ ID NO: 377229 - protein, 10 aa, Influenza virus
DSECVSHNGT

SEQ ID NO: 377230 - protein, 10 aa, Influenza virus
SECVSHNGTW

SEQ ID NO: 377231 - protein, 10 aa, Influenza virus
ECVCHNSTCV

SEQ ID NO: 377232 - protein, 10 aa, Influenza virus
CVCHNSTCVV

SEQ ID NO: 377233 - protein, 10 aa, Influenza virus
HNGTCVVIMT

SEQ ID NO: 377234 - protein, 10 aa, Influenza virus
NGTCVVIMTD

SEQ ID NO: 377235 - protein, 10 aa, Influenza virus
GTCVVIMTDG

SEQ ID NO: 377236 - protein, 10 aa, Influenza virus
VVIMTDGSAS

SEQ ID NO: 377237 - protein, 10 aa, Influenza virus
VIMTDGSASS

SEQ ID NO: 377238 - protein, 10 aa, Influenza virus
MTDGPASSQA

SEQ ID NO: 377239 - protein, 10 aa, Influenza virus
LRGSARHIEE

SEQ ID NO: 377240 - protein, 10 aa, Influenza virus
RGSARHIEEC

SEQ ID NO: 377241 - protein, 10 aa, Influenza virus
GSARHIEEWS

SEQ ID NO: 377242 - protein, 10 aa, Influenza virus
SARHIEEWSC

SEQ ID NO: 377243 - protein, 10 aa, Influenza virus
ARHIEEWSCY

SEQ ID NO: 377244 - protein, 10 aa, Influenza virus
RHIEEWSCYG

SEQ ID NO: 377245 - protein, 10 aa, Influenza virus
IEECSCYGHD

SEQ ID NO: 377246 - protein, 10 aa, Influenza virus
ITCVCRDNWQ

SEQ ID NO: 377247 - protein, 10 aa, Influenza virus
TCGCRDNWQG

SEQ ID NO: 377248 - protein, 10 aa, Influenza virus
NRPIIEIDMT

SEQ ID NO: 377249 - protein, 10 aa, Influenza virus
MEHTSQYLCT

SEQ ID NO: 377250 - protein, 10 aa, Influenza virus
EHTSQYLCTG

SEQ ID NO: 377251 - protein, 10 aa, Influenza virus
YICTGVLTDT

SEQ ID NO: 377252 - protein, 10 aa, Influenza virus
ICTGVLTDTS

SEQ ID NO: 377253 - protein, 10 aa, Influenza virus
GVLTDTSRPK

SEQ ID NO: 377254 - protein, 10 aa, Influenza virus
VLTDTSRPKD

SEQ ID NO: 377255 - protein, 10 aa, Influenza virus
LTDTSRPKDK

SEQ ID NO: 377256 - protein, 10 aa, Influenza virus
GECFNPITGS

SEQ ID NO: 377257 - protein, 10 aa, Influenza virus
ECFNPITGSP

SEQ ID NO: 377258 - protein, 10 aa, Influenza virus
CFNPITGSPG

SEQ ID NO: 377259 - protein, 10 aa, Influenza virus
NPITGSPCAP

SEQ ID NO: 377260 - protein, 10 aa, Influenza virus
PITGSPGSPG

SEQ ID NO: 377261 - protein, 10 aa, Influenza virus
VPGVKGFGFL

SEQ ID NO: 377262 - protein, 10 aa, Influenza virus
PGIKGFGFLN

SEQ ID NO: 377263 - protein, 10 aa, Influenza virus
GIKGFGFLNE

SEQ ID NO: 377264 - protein, 10 aa, Influenza virus
SNTWLGRTIS

SEQ ID NO: 377265 - protein, 10 aa, Influenza virus
WLGRTISPKL

SEQ ID NO: 377266 - protein, 10 aa, Influenza virus
LGRTISPKLR

SEQ ID NO: 377267 - protein, 10 aa, Influenza virus
GRTISPKLRS

SEQ ID NO: 377268 - protein, 10 aa, Influenza virus
RTISPKLRSG

SEQ ID NO: 377269 - protein, 10 aa, Influenza virus
TISPKLRSGF

SEQ ID NO: 377270 - protein, 10 aa, Influenza virus
ISPKLRSGFE

SEQ ID NO: 377271 - protein, 10 aa, Influenza virus
SPKLRSGFEM

SEQ ID NO: 377272 - protein, 10 aa, Influenza virus
PKLRSGFEML

SEQ ID NO: 377273 - protein, 10 aa, Influenza virus
KLRSGFEMLK

SEQ ID NO: 377274 - protein, 10 aa, Influenza virus
SRNGFEMLKI

SEQ ID NO: 377275 - protein, 10 aa, Influenza virus
RSGFEMLRIP

SEQ ID NO: 377276 - protein, 10 aa, Influenza virus
NGFEMLKIPN

SEQ ID NO: 377277 - protein, 10 aa, Influenza virus
GFEMLRIPNA

SEQ ID NO: 377278 - protein, 10 aa, Influenza virus
FEMLKIHNAG

SEQ ID NO: 377279 - protein, 10 aa, Influenza virus
EMLKIPNAGI

SEQ ID NO: 377280 - protein, 10 aa, Influenza virus
MLKIPNAGID

SEQ ID NO: 377281 - protein, 10 aa, Influenza virus
LKIPNAGIDP

SEQ ID NO: 377282 - protein, 10 aa, Influenza virus
RQEIVGNDNW

SEQ ID NO: 377283 - protein, 10 aa, Influenza virus
QEIVGNDNWS

SEQ ID NO: 377284 - protein, 10 aa, Influenza virus
EIVGNDNWSG

SEQ ID NO: 377285 - protein, 10 aa, Influenza virus
IVGNDNWSGY

SEQ ID NO: 377286 - protein, 10 aa, Influenza virus
VGNDNWSGYS

SEQ ID NO: 377287 - protein, 10 aa, Influenza virus
GNDNWSGYSG

SEQ ID NO: 377288 - protein, 10 aa, Influenza virus
NSNWSGYSGS

SEQ ID NO: 377289 - protein, 10 aa, Influenza virus
KNWSGYSGSF

SEQ ID NO: 377290 - protein, 10 aa, Influenza virus
SGSFIDYWDD

SEQ ID NO: 377291 - protein, 10 aa, Influenza virus
PEEAKYVWWA

SEQ ID NO: 377292 - protein, 10 aa, Influenza virus
EEAKYVWWAS

SEQ ID NO: 377293 - protein, 10 aa, Influenza virus
EAKYVWWASN

SEQ ID NO: 377294 - protein, 10 aa, Influenza virus
AKYVWWASNS

SEQ ID NO: 377295 - protein, 10 aa, Influenza virus
KYVWWASNSL

SEQ ID NO: 377296 - protein, 10 aa, Influenza virus
YVEWTSNSLI

SEQ ID NO: 377297 - protein, 10 aa, Influenza virus
VEWTSNSLIA

SEQ ID NO: 377298 - protein, 10 aa, Influenza virus
EWTSNSLIAL

SEQ ID NO: 377299 - protein, 10 aa, Influenza virus
WASNSLIALC

SEQ ID NO: 377300 - protein, 10 aa, Influenza virus
ASNSLIALCG

SEQ ID NO: 377301 - protein, 10 aa, Influenza virus
PVGPGSFPDG

SEQ ID NO: 377302 - protein, 10 aa, Influenza virus
IGSGFFPDGP

SEQ ID NO: 377303 - protein, 10 aa, Influenza virus
GSGFFPDGPQ

SEQ ID NO: 377304 - protein, 10 aa, Influenza virus
SGFFPDGPQI

SEQ ID NO: 377305 - protein, 10 aa, Influenza virus
GFFPDGPQIQ

SEQ ID NO: 377306 - protein, 10 aa, Influenza virus
FFPDGPQIQY

SEQ ID NO: 377307 - protein, 10 aa, Influenza virus
FPDGPQIQYF

SEQ ID NO: 377308 - protein, 10 aa, Influenza virus
PDGPQIQYFS

SEQ ID NO: 377309 - protein, 10 aa, Influenza virus
LLASTNAHDR

SEQ ID NO: 377310 - protein, 10 aa, Influenza virus
LASTNAHDRI

SEQ ID NO: 377311 - protein, 10 aa, Influenza virus
ASTNAHDRIC

SEQ ID NO: 377312 - protein, 10 aa, Influenza virus
QSNNSTDTVD

SEQ ID NO: 377313 - protein, 10 aa, Influenza virus
SNNSTNTVNT

SEQ ID NO: 377314 - protein, 10 aa, Influenza virus
NNSTNTVNTL

SEQ ID NO: 377315 - protein, 10 aa, Influenza virus
NSTDTVNTLT

SEQ ID NO: 377316 - protein, 10 aa, Influenza virus
STDTVDTLIE

SEQ ID NO: 377317 - protein, 10 aa, Influenza virus
TDTVNTLTEQ

SEQ ID NO: 377318 - protein, 10 aa, Influenza virus
TLMEQNVPVT

SEQ ID NO: 377319 - protein, 10 aa, Influenza virus
LTEQNVPVTQ

SEQ ID NO: 377320 - protein, 10 aa, Influenza virus
EQNIPVTQTM

SEQ ID NO: 377321 - protein, 10 aa, Influenza virus
QNIPVTQTME

SEQ ID NO: 377322 - protein, 10 aa, Influenza virus
NIPVTQTMEL

SEQ ID NO: 377323 - protein, 10 aa, Influenza virus
IPVTQTMELV

SEQ ID NO: 377324 - protein, 10 aa, Influenza virus
VTQAMELVEA

SEQ ID NO: 377325 - protein, 10 aa, Influenza virus
TQAMELVEAE

SEQ ID NO: 377326 - protein, 10 aa, Influenza virus
QTMELVETKK

SEQ ID NO: 377327 - protein, 10 aa, Influenza virus
AMELVEAEKH

SEQ ID NO: 377328 - protein, 10 aa, Influenza virus
KKHPAYCNTD

SEQ ID NO: 377329 - protein, 10 aa, Influenza virus
KNPAYCNTDL

SEQ ID NO: 377330 - protein, 10 aa, Influenza virus
HLAYCNTDLG

SEQ ID NO: 377331 - protein, 10 aa, Influenza virus
PAYCNTDLGS

SEQ ID NO: 377332 - protein, 10 aa, Influenza virus
AYCNTDLGSP

SEQ ID NO: 377333 - protein, 10 aa, Influenza virus
YCNTDLGSPL

SEQ ID NO: 377334 - protein, 10 aa, Influenza virus
CNTDLGSPLE

SEQ ID NO: 377335 - protein, 10 aa, Influenza virus
NTDLGSPLEL

SEQ ID NO: 377336 - protein, 10 aa, Influenza virus
TDLGSPLELR

SEQ ID NO: 377337 - protein, 10 aa, Influenza virus
DLGSPLELRD

SEQ ID NO: 377338 - protein, 10 aa, Influenza virus
LGSPLELRDC

SEQ ID NO: 377339 - protein, 10 aa, Influenza virus
GSPLELRDCK

SEQ ID NO: 377340 - protein, 10 aa, Influenza virus
SPLELRDCKI

SEQ ID NO: 377341 - protein, 10 aa, Influenza virus
VIYGNPKCDT

SEQ ID NO: 377342 - protein, 10 aa, Influenza virus
IYGNPKCDTH

SEQ ID NO: 377343 - protein, 10 aa, Influenza virus
YGNPKCDTHL

SEQ ID NO: 377344 - protein, 10 aa, Influenza virus
GNPKCDTHLK

SEQ ID NO: 377345 - protein, 10 aa, Influenza virus
NPKCDTHLKD

SEQ ID NO: 377346 - protein, 10 aa, Influenza virus
PKCDTHLKDQ

SEQ ID NO: 377347 - protein, 10 aa, Influenza virus
HLKDQSWSYI

SEQ ID NO: 377348 - protein, 10 aa, Influenza virus
LKDQSWSYIV

SEQ ID NO: 377349 - protein, 10 aa, Influenza virus
KDQDWSYIVE

SEQ ID NO: 377350 - protein, 10 aa, Influenza virus
DQSWSYIVER

SEQ ID NO: 377351 - protein, 10 aa, Influenza virus
QSWSYIVERP

SEQ ID NO: 377352 - protein, 10 aa, Influenza virus
DWSYIVERPS

SEQ ID NO: 377353 - protein, 10 aa, Influenza virus
PEGMCYPGFV

SEQ ID NO: 377354 - protein, 10 aa, Influenza virus
EGMCYPGFVE

SEQ ID NO: 377355 - protein, 10 aa, Influenza virus
GMCYPGFVEN

SEQ ID NO: 377356 - protein, 10 aa, Influenza virus
MCYPGFVENL

SEQ ID NO: 377357 - protein, 10 aa, Influenza virus
CYPGFVENLE

SEQ ID NO: 377358 - protein, 10 aa, Influenza virus
YPGFVENLEE

SEQ ID NO: 377359 - protein, 10 aa, Influenza virus
PGFVENLEEL

SEQ ID NO: 377360 - protein, 10 aa, Influenza virus
GFVENLEELR

SEQ ID NO: 377361 - protein, 10 aa, Influenza virus
FVENLEELRF

SEQ ID NO: 377362 - protein, 10 aa, Influenza virus
LEELRFVFSI

SEQ ID NO: 377363 - protein, 10 aa, Influenza virus
EELRFVFSIA

SEQ ID NO: 377364 - protein, 10 aa, Influenza virus
ELRFVFSIAA

SEQ ID NO: 377365 - protein, 10 aa, Influenza virus
LRFVFSIAAS

SEQ ID NO: 377366 - protein, 10 aa, Influenza virus
RFVFSIAASY

SEQ ID NO: 377367 - protein, 10 aa, Influenza virus
FVFSIAASYK

SEQ ID NO: 377368 - protein, 10 aa, Influenza virus
VFSIAASYKR

SEQ ID NO: 377369 - protein, 10 aa, Influenza virus
FSSAASYKRV

SEQ ID NO: 377370 - protein, 10 aa, Influenza virus
SSAASYKRVR

SEQ ID NO: 377371 - protein, 10 aa, Influenza virus
SAASYKRVRL

SEQ ID NO: 377372 - protein, 10 aa, Influenza virus
KRIRLFDYSG

SEQ ID NO: 377373 - protein, 10 aa, Influenza virus
RVRLFDYSRW

SEQ ID NO: 377374 - protein, 10 aa, Influenza virus
VRLFDYSRWN

SEQ ID NO: 377375 - protein, 10 aa, Influenza virus
RLFDYSGWNV

SEQ ID NO: 377376 - protein, 10 aa, Influenza virus
LFDYSKWNVS

SEQ ID NO: 377377 - protein, 10 aa, Influenza virus
WNVSSSGTSK

SEQ ID NO: 377378 - protein, 10 aa, Influenza virus
NVSSSGTSKA

SEQ ID NO: 377379 - protein, 10 aa, Influenza virus
VSSSGTSKAC

SEQ ID NO: 377380 - protein, 10 aa, Influenza virus
TSSGTSKACS

SEQ ID NO: 377381 - protein, 10 aa, Influenza virus
SSGTSKACSA

SEQ ID NO: 377382 - protein, 10 aa, Influenza virus
SGTSKACNAL

SEQ ID NO: 377383 - protein, 10 aa, Influenza virus
GTSKACNALT

SEQ ID NO: 377384 - protein, 10 aa, Influenza virus
TSKACNALTG

SEQ ID NO: 377385 - protein, 10 aa, Influenza virus
SKACNALTGG

SEQ ID NO: 377386 - protein, 10 aa, Influenza virus
KACNALTGGQ

SEQ ID NO: 377387 - protein, 10 aa, Influenza virus
ACSASTGGQS

SEQ ID NO: 377388 - protein, 10 aa, Influenza virus
CSASTGGQSF

SEQ ID NO: 377389 - protein, 10 aa, Influenza virus
SASTGGQSFY

SEQ ID NO: 377390 - protein, 10 aa, Influenza virus
ALTGGQSFYR

SEQ ID NO: 377391 - protein, 10 aa, Influenza virus
LTGGQSFYRS

SEQ ID NO: 377392 - protein, 10 aa, Influenza virus
TGAQSFYRSI

SEQ ID NO: 377393 - protein, 10 aa, Influenza virus
GAQSFYRSIN

SEQ ID NO: 377394 - protein, 10 aa, Influenza virus
AQSFYRSINW

SEQ ID NO: 377395 - protein, 10 aa, Influenza virus
SINWLTKKEP

SEQ ID NO: 377396 - protein, 10 aa, Influenza virus
INWLTKKEPD

SEQ ID NO: 377397 - protein, 10 aa, Influenza virus
NWLTKKEPDT

SEQ ID NO: 377398 - protein, 10 aa, Influenza virus
WLTKKEPDTY

SEQ ID NO: 377399 - protein, 10 aa, Influenza virus
LTKKEPDTYD

SEQ ID NO: 377400 - protein, 10 aa, Influenza virus
TKKKPDIYDF

SEQ ID NO: 377401 - protein, 10 aa, Influenza virus
KKEPDTYDFN

SEQ ID NO: 377402 - protein, 10 aa, Influenza virus
KEPDTYDFNE

SEQ ID NO: 377403 - protein, 10 aa, Influenza virus
EPDTYDFNEG

SEQ ID NO: 377404 - protein, 10 aa, Influenza virus
PDTYDFNEGA

SEQ ID NO: 377405 - protein, 10 aa, Influenza virus
DTYDFNEGAY

SEQ ID NO: 377406 - protein, 10 aa, Influenza virus
NNEEGDIIFL

SEQ ID NO: 377407 - protein, 10 aa, Influenza virus
NEEGDIIFLW

SEQ ID NO: 377408 - protein, 10 aa, Influenza virus
KDGDIIFLWG

SEQ ID NO: 377409 - protein, 10 aa, Influenza virus
EGDIIFLWGI

SEQ ID NO: 377410 - protein, 10 aa, Influenza virus
LWGIHHPPNT

SEQ ID NO: 377411 - protein, 10 aa, Influenza virus
WGIHHPPNTK

SEQ ID NO: 377412 - protein, 10 aa, Influenza virus
GIHHPPNTKE

SEQ ID NO: 377413 - protein, 10 aa, Influenza virus
IHHPPNTKEQ

SEQ ID NO: 377414 - protein, 10 aa, Influenza virus
HHPPNTKEQT

SEQ ID NO: 377415 - protein, 10 aa, Influenza virus
AKEQTALYKN

SEQ ID NO: 377416 - protein, 10 aa, Influenza virus
TEQTKLYKNT

SEQ ID NO: 377417 - protein, 10 aa, Influenza virus
EQTKLYKNTN

SEQ ID NO: 377418 - protein, 10 aa, Influenza virus
QTKLYKNTNT

SEQ ID NO: 377419 - protein, 10 aa, Influenza virus
TKLYKNTNTL

SEQ ID NO: 377420 - protein, 10 aa, Influenza virus
KLYKNTNTLS

SEQ ID NO: 377421 - protein, 10 aa, Influenza virus
LYKNANTLTS

SEQ ID NO: 377422 - protein, 10 aa, Influenza virus
YKNANTLTSV

SEQ ID NO: 377423 - protein, 10 aa, Influenza virus
KNTNTLSSVT

SEQ ID NO: 377424 - protein, 10 aa, Influenza virus
NANTLSSVNT

SEQ ID NO: 377425 - protein, 10 aa, Influenza virus
ANTLSSVNTN

SEQ ID NO: 377426 - protein, 10 aa, Influenza virus
NTLTSVTTNT

SEQ ID NO: 377427 - protein, 10 aa, Influenza virus
TLTSVTTNTI

SEQ ID NO: 377428 - protein, 10 aa, Influenza virus
LTSVTTNTIN

SEQ ID NO: 377429 - protein, 10 aa, Influenza virus
TSVTTNTINR

SEQ ID NO: 377430 - protein, 10 aa, Influenza virus
SVNTNTINRS

SEQ ID NO: 377431 - protein, 10 aa, Influenza virus
VNTNTINRSF

SEQ ID NO: 377432 - protein, 10 aa, Influenza virus
TTNTINRIFQ

SEQ ID NO: 377433 - protein, 10 aa, Influenza virus
TNTINRIFQP

SEQ ID NO: 377434 - protein, 10 aa, Influenza virus
NTINRIFQPN

SEQ ID NO: 377435 - protein, 10 aa, Influenza virus
TINRIFQPNI

SEQ ID NO: 377436 - protein, 10 aa, Influenza virus
INRSFRPNIG

SEQ ID NO: 377437 - protein, 10 aa, Influenza virus
NRIFQPNIGP

SEQ ID NO: 377438 - protein, 10 aa, Influenza virus
RSFRPNIGPR

SEQ ID NO: 377439 - protein, 10 aa, Influenza virus
SFRPNIGPRP

SEQ ID NO: 377440 - protein, 10 aa, Influenza virus
FQPNIGPRAL

SEQ ID NO: 377441 - protein, 10 aa, Influenza virus
QPNIGPRALV

SEQ ID NO: 377442 - protein, 10 aa, Influenza virus
NIGPRALVRG

SEQ ID NO: 377443 - protein, 10 aa, Influenza virus
IGPRALVRGQ

SEQ ID NO: 377444 - protein, 10 aa, Influenza virus
GPRPLVREQQ

SEQ ID NO: 377445 - protein, 10 aa, Influenza virus
PRALVRGQQG

SEQ ID NO: 377446 - protein, 10 aa, Influenza virus
RPLVRGQQGT

SEQ ID NO: 377447 - protein, 10 aa, Influenza virus
PLVRGQQGTM

SEQ ID NO: 377448 - protein, 10 aa, Influenza virus
LVREQQGRMD

SEQ ID NO: 377449 - protein, 10 aa, Influenza virus
VREQQGRMDY

SEQ ID NO: 377450 - protein, 10 aa, Influenza virus
REQQGRMDYY

SEQ ID NO: 377451 - protein, 10 aa, Influenza virus
GQQGWMDYYW

SEQ ID NO: 377452 - protein, 10 aa, Influenza virus
QQGWMDYYWG

SEQ ID NO: 377453 - protein, 10 aa, Influenza virus
QGTMDYYWGI

SEQ ID NO: 377454 - protein, 10 aa, Influenza virus
GWMDYYWGIL

SEQ ID NO: 377455 - protein, 10 aa, Influenza virus
TMDYYWGILK

SEQ ID NO: 377456 - protein, 10 aa, Influenza virus
FGYLLRGESH

SEQ ID NO: 377457 - protein, 10 aa, Influenza virus
GYLLRGESHG

SEQ ID NO: 377458 - protein, 10 aa, Influenza virus
YLLRGESHGR

SEQ ID NO: 377459 - protein, 10 aa, Influenza virus
GESHGRTIQN

SEQ ID NO: 377460 - protein, 10 aa, Influenza virus
ESHCRIIQNE

SEQ ID NO: 377461 - protein, 10 aa, Influenza virus
SHCRIIQNED

SEQ ID NO: 377462 - protein, 10 aa, Influenza virus
HGKIIQNEDI

SEQ ID NO: 377463 - protein, 10 aa, Influenza virus
CRIIQNEDIP

SEQ ID NO: 377464 - protein, 10 aa, Influenza virus
RTIQNEDIPI

SEQ ID NO: 377465 - protein, 10 aa, Influenza virus
TIQNEDIPIG

SEQ ID NO: 377466 - protein, 10 aa, Influenza virus
IQNEDIPIEN

SEQ ID NO: 377467 - protein, 10 aa, Influenza virus
QNEDIPIENC

SEQ ID NO: 377468 - protein, 10 aa, Influenza virus
CHTKCQTYTG

SEQ ID NO: 377469 - protein, 10 aa, Influenza virus
YTKCQTYAGA

SEQ ID NO: 377470 - protein, 10 aa, Influenza virus
TKCQTYAGAV

SEQ ID NO: 377471 - protein, 10 aa, Influenza virus
KCQTYAGAVN

SEQ ID NO: 377472 - protein, 10 aa, Influenza virus
CQTYAGAVNS

SEQ ID NO: 377473 - protein, 10 aa, Influenza virus
QTYAGAVNSS

SEQ ID NO: 377474 - protein, 10 aa, Influenza virus
TYTGAINSSR

SEQ ID NO: 377475 - protein, 10 aa, Influenza virus
YAGAVNSSKP

SEQ ID NO: 377476 - protein, 10 aa, Influenza virus
GAVNSSKPFQ

SEQ ID NO: 377477 - protein, 10 aa, Influenza virus
AINSSKPLQN

SEQ ID NO: 377478 - protein, 10 aa, Influenza virus
INSSKPFQNT

SEQ ID NO: 377479 - protein, 10 aa, Influenza virus
NSSKPFQNTS

SEQ ID NO: 377480 - protein, 10 aa, Influenza virus
SSKPFQNTSR

SEQ ID NO: 377481 - protein, 10 aa, Influenza virus
SKPFQNTSRH

SEQ ID NO: 377482 - protein, 10 aa, Influenza virus
PFQNASRHHM

SEQ ID NO: 377483 - protein, 10 aa, Influenza virus
FQNASRYYMG

SEQ ID NO: 377484 - protein, 10 aa, Influenza virus
QNASRYYMGE

SEQ ID NO: 377485 - protein, 10 aa, Influenza virus
NASRHHMGEC

SEQ ID NO: 377486 - protein, 10 aa, Influenza virus
ASRYYMGECP

SEQ ID NO: 377487 - protein, 10 aa, Influenza virus
SRHYMGECPE

SEQ ID NO: 377488 - protein, 10 aa, Influenza virus
RHYMGECPEY

SEQ ID NO: 377489 - protein, 10 aa, Influenza virus
MGECPEYVKK

SEQ ID NO: 377490 - protein, 10 aa, Influenza virus
YVRKASLRLA

SEQ ID NO: 377491 - protein, 10 aa, Influenza virus
RKASLRLAVG

SEQ ID NO: 377492 - protein, 10 aa, Influenza virus
KESLRLALGL

SEQ ID NO: 377493 - protein, 10 aa, Influenza virus
ESLRLALGLR

SEQ ID NO: 377494 - protein, 10 aa, Influenza virus
SLRLAIGLRN

SEQ ID NO: 377495 - protein, 10 aa, Influenza virus
LRLAIGLRNT

SEQ ID NO: 377496 - protein, 10 aa, Influenza virus
RLAIGLRNTP

SEQ ID NO: 377497 - protein, 10 aa, Influenza virus
LAIGLRNTPS

SEQ ID NO: 377498 - protein, 10 aa, Influenza virus
ALGLRNTPSI

SEQ ID NO: 377499 - protein, 10 aa, Influenza virus
VGLRNTPSID

SEQ ID NO: 377500 - protein, 10 aa, Influenza virus
GLRNTPSIDP

SEQ ID NO: 377501 - protein, 10 aa, Influenza virus
LRNTPSVEPR

SEQ ID NO: 377502 - protein, 10 aa, Influenza virus
RNTPSVEPRG

SEQ ID NO: 377503 - protein, 10 aa, Influenza virus
NTPSVEPRGL

SEQ ID NO: 377504 - protein, 10 aa, Influenza virus
TPSVEPKGLF

SEQ ID NO: 377505 - protein, 10 aa, Influenza virus
PSVEPKGLFG

SEQ ID NO: 377506 - protein, 10 aa, Influenza virus
SVEPKGLFGA

SEQ ID NO: 377507 - protein, 10 aa, Influenza virus
VEPKGLFGAI

SEQ ID NO: 377508 - protein, 10 aa, Influenza virus
DPKGLFGAIA

SEQ ID NO: 377509 - protein, 10 aa, Influenza virus
DQKSTQEAIG

SEQ ID NO: 377510 - protein, 10 aa, Influenza virus
QKSTQEAINK

SEQ ID NO: 377511 - protein, 10 aa, Influenza virus
KSTQEAIEKI

SEQ ID NO: 377512 - protein, 10 aa, Influenza virus
STQEAIEKIT

SEQ ID NO: 377513 - protein, 10 aa, Influenza virus
TQEAIEKITN

SEQ ID NO: 377514 - protein, 10 aa, Influenza virus
QEAIEKITNK

SEQ ID NO: 377515 - protein, 10 aa, Influenza virus
EAIEKITNKV

SEQ ID NO: 377516 - protein, 10 aa, Influenza virus
AIGKITNKVN

SEQ ID NO: 377517 - protein, 10 aa, Influenza virus
IEKITNKVNN

SEQ ID NO: 377518 - protein, 10 aa, Influenza virus
NKITNKVNNI

SEQ ID NO: 377519 - protein, 10 aa, Influenza virus
DKMNREFEVM

SEQ ID NO: 377520 - protein, 10 aa, Influenza virus
KMNREFEVMN

SEQ ID NO: 377521 - protein, 10 aa, Influenza virus
MNREFEVMNH

SEQ ID NO: 377522 - protein, 10 aa, Influenza virus
NREFEVMNHE

SEQ ID NO: 377523 - protein, 10 aa, Influenza virus
REFEVMNHEF

SEQ ID NO: 377524 - protein, 10 aa, Influenza virus
EFEVMNHEFS

SEQ ID NO: 377525 - protein, 10 aa, Influenza virus
EKRINMISDK

SEQ ID NO: 377526 - protein, 10 aa, Influenza virus
KRINVINDKI

SEQ ID NO: 377527 - protein, 10 aa, Influenza virus
INMISDKIDD

SEQ ID NO: 377528 - protein, 10 aa, Influenza virus
NVINDKIDDQ

SEQ ID NO: 377529 - protein, 10 aa, Influenza virus
MISDKIDDQI

SEQ ID NO: 377530 - protein, 10 aa, Influenza virus
ISDKIDDQIE

SEQ ID NO: 377531 - protein, 10 aa, Influenza virus
DKIDDQIENL

SEQ ID NO: 377532 - protein, 10 aa, Influenza virus
KIDDQIEGLW

SEQ ID NO: 377533 - protein, 10 aa, Influenza virus
IDDQIENLWA

SEQ ID NO: 377534 - protein, 10 aa, Influenza virus
DDQIEGLWAY

SEQ ID NO: 377535 - protein, 10 aa, Influenza virus
DQIENLWAYN

SEQ ID NO: 377536 - protein, 10 aa, Influenza virus
QIEGLWAYNA

SEQ ID NO: 377537 - protein, 10 aa, Influenza virus
IENLWAYNAE

SEQ ID NO: 377538 - protein, 10 aa, Influenza virus
EGLWAYNAEL

SEQ ID NO: 377539 - protein, 10 aa, Influenza virus
NLWAYNAELL

SEQ ID NO: 377540 - protein, 10 aa, Influenza virus
LLENQKTLDK

SEQ ID NO: 377541 - protein, 10 aa, Influenza virus
LENQKILDEH

SEQ ID NO: 377542 - protein, 10 aa, Influenza virus
ENQKTLDKHD

SEQ ID NO: 377543 - protein, 10 aa, Influenza virus
NQKILDEHDS

SEQ ID NO: 377544 - protein, 10 aa, Influenza virus
QKILDEHDSN

SEQ ID NO: 377545 - protein, 10 aa, Influenza virus
KILDEHDSNV

SEQ ID NO: 377546 - protein, 10 aa, Influenza virus
TLDKHDSNVK

SEQ ID NO: 377547 - protein, 10 aa, Influenza virus
LDKHDSNVKN

SEQ ID NO: 377548 - protein, 10 aa, Influenza virus
DKHDSNVKNL

SEQ ID NO: 377549 - protein, 10 aa, Influenza virus
KHDSNVKNLF

SEQ ID NO: 377550 - protein, 10 aa, Influenza virus
NVENLFDEVR

SEQ ID NO: 377551 - protein, 10 aa, Influenza virus
VENLFDEVRR

SEQ ID NO: 377552 - protein, 10 aa, Influenza virus
ENLFDEVRRR

SEQ ID NO: 377553 - protein, 10 aa, Influenza virus
FDEVRRRLSA

SEQ ID NO: 377554 - protein, 10 aa, Influenza virus
DEVRRRLSAN

SEQ ID NO: 377555 - protein, 10 aa, Influenza virus
EVRRRLSANA

SEQ ID NO: 377556 - protein, 10 aa, Influenza virus
NAMDAGNGCF

SEQ ID NO: 377557 - protein, 10 aa, Influenza virus
AMDAGNGCFD

SEQ ID NO: 377558 - protein, 10 aa, Influenza virus
MDAGNGCFDI

SEQ ID NO: 377559 - protein, 10 aa, Influenza virus
DTGKGCFDIL

SEQ ID NO: 377560 - protein, 10 aa, Influenza virus
TGKGCFDILH

SEQ ID NO: 377561 - protein, 10 aa, Influenza virus
FDILHKCDNK

SEQ ID NO: 377562 - protein, 10 aa, Influenza virus
DILHKCDNKC

SEQ ID NO: 377563 - protein, 10 aa, Influenza virus
ILHKCDNKCM

SEQ ID NO: 377564 - protein, 10 aa, Influenza virus
LHKCDNKCME

SEQ ID NO: 377565 - protein, 10 aa, Influenza virus
HKCDNKCMET

SEQ ID NO: 377566 - protein, 10 aa, Influenza virus
KCDNKCMETI

SEQ ID NO: 377567 - protein, 10 aa, Influenza virus
CDNKCMETIK

SEQ ID NO: 377568 - protein, 10 aa, Influenza virus
DNKCMETIKN

SEQ ID NO: 377569 - protein, 10 aa, Influenza virus
ETIKNGTYNR

SEQ ID NO: 377570 - protein, 10 aa, Influenza virus
TIKNGTYNRK

SEQ ID NO: 377571 - protein, 10 aa, Influenza virus
IKNGTYNHKD

SEQ ID NO: 377572 - protein, 10 aa, Influenza virus
KNGTYDHKDY

SEQ ID NO: 377573 - protein, 10 aa, Influenza virus
NGTYNRKEYE

SEQ ID NO: 377574 - protein, 10 aa, Influenza virus
GTYNRKEYEE

SEQ ID NO: 377575 - protein, 10 aa, Influenza virus
TYNRKEYEEE

SEQ ID NO: 377576 - protein, 10 aa, Influenza virus
YNHKDYEEEA

SEQ ID NO: 377577 - protein, 10 aa, Influenza virus
DHKDYEEEAK

SEQ ID NO: 377578 - protein, 10 aa, Influenza virus
RKEYEEEAKL

SEQ ID NO: 377579 - protein, 10 aa, Influenza virus
EYEEEAKLEK

SEQ ID NO: 377580 - protein, 10 aa, Influenza virus
AKLERSKINE

SEQ ID NO: 377581 - protein, 10 aa, Influenza virus
KLEKSRINGV

SEQ ID NO: 377582 - protein, 10 aa, Influenza virus
LERSKINGVR

SEQ ID NO: 377583 - protein, 10 aa, Influenza virus
EKSRINGVKL

SEQ ID NO: 377584 - protein, 10 aa, Influenza virus
RSKINEVKLE

SEQ ID NO: 377585 - protein, 10 aa, Influenza virus
SKINGVRLEE

SEQ ID NO: 377586 - protein, 10 aa, Influenza virus
KINGVILEEN

SEQ ID NO: 377587 - protein, 10 aa, Influenza virus
INGVILEENT

SEQ ID NO: 377588 - protein, 10 aa, Influenza virus
NEVKLEENTT

SEQ ID NO: 377589 - protein, 10 aa, Influenza virus
GVKLEENTSY

SEQ ID NO: 377590 - protein, 10 aa, Influenza virus
VKLEENTTYR

SEQ ID NO: 377591 - protein, 10 aa, Influenza virus
KLEENTTYRI

SEQ ID NO: 377592 - protein, 10 aa, Influenza virus
LEENTTYRIL

SEQ ID NO: 377593 - protein, 10 aa, Influenza virus
EENTTYRILS

SEQ ID NO: 377594 - protein, 10 aa, Influenza virus
ENTTYRILSI

SEQ ID NO: 377595 - protein, 10 aa, Influenza virus
NTSYKILSIY

SEQ ID NO: 377596 - protein, 10 aa, Influenza virus
TTYRILSIYS

SEQ ID NO: 377597 - protein, 10 aa, Influenza virus
TYRILSIYST

SEQ ID NO: 377598 - protein, 10 aa, Influenza virus
AASLCLAILV

SEQ ID NO: 377599 - protein, 10 aa, Influenza virus
ASLCLAILVA

SEQ ID NO: 377600 - protein, 10 aa, Influenza virus
SLCLAVLIAG

SEQ ID NO: 377601 - protein, 10 aa, Influenza virus
LCLAILVAGG

SEQ ID NO: 377602 - protein, 10 aa, Influenza virus
CLAILVAGGL

SEQ ID NO: 377603 - protein, 10 aa, Influenza virus
LAILVAGGLI

SEQ ID NO: 377604 - protein, 10 aa, Influenza virus
AILVAGGLIL

SEQ ID NO: 377605 - protein, 10 aa, Influenza virus
ILVAGGLILG

SEQ ID NO: 377606 - protein, 10 aa, Influenza virus
YQSTNSTEAV

SEQ ID NO: 377607 - protein, 10 aa, Influenza virus
EGLVYGNPAC

SEQ ID NO: 377608 - protein, 10 aa, Influenza virus
GLVYGNPACD

SEQ ID NO: 377609 - protein, 10 aa, Influenza virus
LKPGQTLRVK

SEQ ID NO: 377610 - protein, 10 aa, Influenza virus
KPGQTLRVKS

SEQ ID NO: 377611 - protein, 10 aa, Influenza virus
PGQTLRVRSD

SEQ ID NO: 377612 - protein, 10 aa, Influenza virus
QTLRVRSDGN

SEQ ID NO: 377613 - protein, 10 aa, Influenza virus
TLRVRSDGNL

SEQ ID NO: 377614 - protein, 10 aa, Influenza virus
SDGNLIAPWY

SEQ ID NO: 377615 - protein, 10 aa, Influenza virus
SLKLAVGMRN

SEQ ID NO: 377616 - protein, 10 aa, Influenza virus
FIEGGWSGLI

SEQ ID NO: 377617 - protein, 10 aa, Influenza virus
IEGGWSGLIA

SEQ ID NO: 377618 - protein, 10 aa, Influenza virus
EGGWSGLIAG

SEQ ID NO: 377619 - protein, 10 aa, Influenza virus
GGWSGLIAGW

SEQ ID NO: 377620 - protein, 10 aa, Influenza virus
GWSGLIAGWY

SEQ ID NO: 377621 - protein, 10 aa, Influenza virus
WSGLIAGWYG

SEQ ID NO: 377622 - protein, 10 aa, Influenza virus
SGLIAGWYGF

SEQ ID NO: 377623 - protein, 10 aa, Influenza virus
VAGWYGFQHT

SEQ ID NO: 377624 - protein, 10 aa, Influenza virus
GWYGFQHSNE

SEQ ID NO: 377625 - protein, 10 aa, Influenza virus
WYGFQHSNEQ

SEQ ID NO: 377626 - protein, 10 aa, Influenza virus
YGFQHSNEQG

SEQ ID NO: 377627 - protein, 10 aa, Influenza virus
DQIQNIWAYN

SEQ ID NO: 377628 - protein, 10 aa, Influenza virus
QIQNIWAYNA

SEQ ID NO: 377629 - protein, 10 aa, Influenza virus
IQNIWAYNAE

SEQ ID NO: 377630 - protein, 10 aa, Influenza virus
QNIWAYNAEL

SEQ ID NO: 377631 - protein, 10 aa, Influenza virus
NIWAYNAELL

SEQ ID NO: 377632 - protein, 10 aa, Influenza virus
LWAYNAELLV

SEQ ID NO: 377633 - protein, 10 aa, Influenza virus
AELLVLIENQ

SEQ ID NO: 377634 - protein, 10 aa, Influenza virus
ELLVLIENQK

SEQ ID NO: 377635 - protein, 10 aa, Influenza virus
LLVLIENQKT

SEQ ID NO: 377636 - protein, 10 aa, Influenza virus
LVLIENQKTL

SEQ ID NO: 377637 - protein, 10 aa, Influenza virus
VLIENQKTLD

SEQ ID NO: 377638 - protein, 10 aa, Influenza virus
LIENQKTLDE

SEQ ID NO: 377639 - protein, 10 aa, Influenza virus
IENQKTLDEH

SEQ ID NO: 377640 - protein, 10 aa, Influenza virus
EDGKGCFDLY

SEQ ID NO: 377641 - protein, 10 aa, Influenza virus
DGKGCFDLYH

SEQ ID NO: 377642 - protein, 10 aa, Influenza virus
GKGCFDLYHK

SEQ ID NO: 377643 - protein, 10 aa, Influenza virus
KGCFDLYHKC

SEQ ID NO: 377644 - protein, 10 aa, Influenza virus
GCFELYHRCD

SEQ ID NO: 377645 - protein, 10 aa, Influenza virus
CMGTIRNGTY

SEQ ID NO: 377646 - protein, 10 aa, Influenza virus
EETYKILTIY

SEQ ID NO: 377647 - protein, 10 aa, Influenza virus
ETYKILTIYS

SEQ ID NO: 377648 - protein, 10 aa, Influenza virus
AYKILTIYST

SEQ ID NO: 377649 - protein, 10 aa, Influenza virus
YKILSIYSTV

SEQ ID NO: 377650 - protein, 10 aa, Influenza virus
KILSIYSTVA

SEQ ID NO: 377651 - protein, 10 aa, Influenza virus
ILSIYSTVAS

SEQ ID NO: 377652 - protein, 10 aa, Influenza virus
LSIYSTVASS

SEQ ID NO: 377653 - protein, 10 aa, Influenza virus
TIYSTVASSI

SEQ ID NO: 377654 - protein, 10 aa, Influenza virus
YQSTNSTEAV

SEQ ID NO: 377655 - protein, 10 aa, Influenza virus
EGLVYGNPAC

SEQ ID NO: 377656 - protein, 10 aa, Influenza virus
GLVYGNPACD

SEQ ID NO: 377657 - protein, 10 aa, Influenza virus
LKPGQTLRVK

SEQ ID NO: 377658 - protein, 10 aa, Influenza virus
KPGQTLRVKS

SEQ ID NO: 377659 - protein, 10 aa, Influenza virus
PGQTLRVRSD

SEQ ID NO: 377660 - protein, 10 aa, Influenza virus
QTLRVRSDGN

SEQ ID NO: 377661 - protein, 10 aa, Influenza virus
TLRVRSDGNL

SEQ ID NO: 377662 - protein, 10 aa, Influenza virus
SDGNLIAPWY

SEQ ID NO: 377663 - protein, 10 aa, Influenza virus
SLKLAVGMRN

SEQ ID NO: 377664 - protein, 10 aa, Influenza virus
FIEGGWSGLI

SEQ ID NO: 377665 - protein, 10 aa, Influenza virus
IEGGWSGLIA

SEQ ID NO: 377666 - protein, 10 aa, Influenza virus
EGGWSGLIAG

SEQ ID NO: 377667 - protein, 10 aa, Influenza virus
GGWSGLIAGW

SEQ ID NO: 377668 - protein, 10 aa, Influenza virus
GWSGLIAGWY

SEQ ID NO: 377669 - protein, 10 aa, Influenza virus
WSGLIAGWYG

SEQ ID NO: 377670 - protein, 10 aa, Influenza virus
SGLIAGWYGF

SEQ ID NO: 377671 - protein, 10 aa, Influenza virus
VAGWYGFQHT

SEQ ID NO: 377672 - protein, 10 aa, Influenza virus
GWYGFQHSNE

SEQ ID NO: 377673 - protein, 10 aa, Influenza virus
WYGFQHSNEQ

SEQ ID NO: 377674 - protein, 10 aa, Influenza virus
YGFQHSNEQG

SEQ ID NO: 377675 - protein, 10 aa, Influenza virus
DDQIQNIWAY

SEQ ID NO: 377676 - protein, 10 aa, Influenza virus
DQIQNIWAYN

SEQ ID NO: 377677 - protein, 10 aa, Influenza virus
QIQNIWAYNA

SEQ ID NO: 377678 - protein, 10 aa, Influenza virus
IQNIWAYNAE

SEQ ID NO: 377679 - protein, 10 aa, Influenza virus
QNIWAYNAEL

SEQ ID NO: 377680 - protein, 10 aa, Influenza virus
NIWAYNAELL

SEQ ID NO: 377681 - protein, 10 aa, Influenza virus
LWAYNAELLV

SEQ ID NO: 377682 - protein, 10 aa, Influenza virus
ELLVLIENQK

SEQ ID NO: 377683 - protein, 10 aa, Influenza virus
LLVLIENQKT

SEQ ID NO: 377684 - protein, 10 aa, Influenza virus
LVLIENQKTL

SEQ ID NO: 377685 - protein, 10 aa, Influenza virus
VLIENQKTLD

SEQ ID NO: 377686 - protein, 10 aa, Influenza virus
LIENQKTLDE

SEQ ID NO: 377687 - protein, 10 aa, Influenza virus
IENQKTLDEH

SEQ ID NO: 377688 - protein, 10 aa, Influenza virus
ENQKTLDEHE

SEQ ID NO: 377689 - protein, 10 aa, Influenza virus
EDGKGCFDLY

SEQ ID NO: 377690 - protein, 10 aa, Influenza virus
DGKGCFDLYH

SEQ ID NO: 377691 - protein, 10 aa, Influenza virus
GKGCFDLYHK

SEQ ID NO: 377692 - protein, 10 aa, Influenza virus
KGCFDLYHKC

SEQ ID NO: 377693 - protein, 10 aa, Influenza virus
GCFELYHRCD

SEQ ID NO: 377694 - protein, 10 aa, Influenza virus
CMGTIRNGTY

SEQ ID NO: 377695 - protein, 10 aa, Influenza virus
EETYKILTIY

SEQ ID NO: 377696 - protein, 10 aa, Influenza virus
ETYKILTIYS

SEQ ID NO: 377697 - protein, 10 aa, Influenza virus
AYKILTIYST

SEQ ID NO: 377698 - protein, 10 aa, Influenza virus
YKILSIYSTV

SEQ ID NO: 377699 - protein, 10 aa, Influenza virus
KILSIYSTVA

SEQ ID NO: 377700 - protein, 10 aa, Influenza virus
ILSIYSTVAS

SEQ ID NO: 377701 - protein, 10 aa, Influenza virus
LSIYSTVASS

SEQ ID NO: 377702 - protein, 10 aa, Influenza virus
TIYSTVASSI

SEQ ID NO: 377703 - protein, 10 aa, Influenza virus
WSKPQCQIAG

SEQ ID NO: 377704 - protein, 10 aa, Influenza virus
SKPQCLITGF

SEQ ID NO: 377705 - protein, 10 aa, Influenza virus
KPQCLITGFA

SEQ ID NO: 377706 - protein, 10 aa, Influenza virus
CYQFALGQGA

SEQ ID NO: 377707 - protein, 10 aa, Influenza virus
YQFALGQGAT

SEQ ID NO: 377708 - protein, 10 aa, Influenza virus
QFALGQGATL

SEQ ID NO: 377709 - protein, 10 aa, Influenza virus
PHRTLLMSEL

SEQ ID NO: 377710 - protein, 10 aa, Influenza virus
HRTLLMSELG

SEQ ID NO: 377711 - protein, 10 aa, Influenza virus
LLMNELGVPL

SEQ ID NO: 377712 - protein, 10 aa, Influenza virus
LMNELGVPLH

SEQ ID NO: 377713 - protein, 10 aa, Influenza virus
TRQVCIAWSS

SEQ ID NO: 377714 - protein, 10 aa, Influenza virus
QVCIAWSSAS

SEQ ID NO: 377715 - protein, 10 aa, Influenza virus
VCIAWSSASC

SEQ ID NO: 377716 - protein, 10 aa, Influenza virus
CIAWSSASCH

SEQ ID NO: 377717 - protein, 10 aa, Influenza virus
IAWSSSSCYD

SEQ ID NO: 377718 - protein, 10 aa, Influenza virus
AWSSASCHDG

SEQ ID NO: 377719 - protein, 10 aa, Influenza virus
WSSSSCYDGK

SEQ ID NO: 377720 - protein, 10 aa, Influenza virus
SSSSCYDGKA

SEQ ID NO: 377721 - protein, 10 aa, Influenza virus
SSSCYDGKAW

SEQ ID NO: 377722 - protein, 10 aa, Influenza virus
SSCYDGKAWL

SEQ ID NO: 377723 - protein, 10 aa, Influenza virus
SCYDGKAWLH

SEQ ID NO: 377724 - protein, 10 aa, Influenza virus
TILRTQESEC

SEQ ID NO: 377725 - protein, 10 aa, Influenza virus
ILITQESECV

SEQ ID NO: 377726 - protein, 10 aa, Influenza virus
LITQESECVC

SEQ ID NO: 377727 - protein, 10 aa, Influenza virus
GGAQHVEECS

SEQ ID NO: 377728 - protein, 10 aa, Influenza virus
NAQHVEECSC

SEQ ID NO: 377729 - protein, 10 aa, Influenza virus
AKHVEECSCY

SEQ ID NO: 377730 - protein, 10 aa, Influenza virus
HVEECSCYPQ

SEQ ID NO: 377731 - protein, 10 aa, Influenza virus
VYRDNWKGSN

SEQ ID NO: 377732 - protein, 10 aa, Influenza virus
YRDNWKGSNR

SEQ ID NO: 377733 - protein, 10 aa, Influenza virus
DNWKGSNRPI

SEQ ID NO: 377734 - protein, 10 aa, Influenza virus
YFLDVFAGDT

SEQ ID NO: 377735 - protein, 10 aa, Influenza virus
SGLVGDTPRD

SEQ ID NO: 377736 - protein, 10 aa, Influenza virus
INRCFYVELV

SEQ ID NO: 377737 - protein, 10 aa, Influenza virus
CFYVELIRGK

SEQ ID NO: 377738 - protein, 10 aa, Influenza virus
FYVELIRGKP

SEQ ID NO: 377739 - protein, 10 aa, Influenza virus
GAGSWPDGAN

SEQ ID NO: 377740 - protein, 10 aa, Influenza virus
EVETYVLSVI

SEQ ID NO: 377741 - protein, 10 aa, Influenza virus
VETYVLSVIP

SEQ ID NO: 377742 - protein, 10 aa, Influenza virus
ETYVLSVIPS

SEQ ID NO: 377743 - protein, 10 aa, Influenza virus
TYVLSVIPSG

SEQ ID NO: 377744 - protein, 10 aa, Influenza virus
YVLSVIPSGP

SEQ ID NO: 377745 - protein, 10 aa, Influenza virus
VLSVIPSGPL

SEQ ID NO: 377746 - protein, 10 aa, Influenza virus
LSVIPSGPLK

SEQ ID NO: 377747 - protein, 10 aa, Influenza virus
SVIPSGPLKA

SEQ ID NO: 377748 - protein, 10 aa, Influenza virus
VIPSGPLKAE

SEQ ID NO: 377749 - protein, 10 aa, Influenza virus
KAEIAQKLED

SEQ ID NO: 377750 - protein, 10 aa, Influenza virus
AEIAQKLEDV

SEQ ID NO: 377751 - protein, 10 aa, Influenza virus
EIAQKLEDVF

SEQ ID NO: 377752 - protein, 10 aa, Influenza virus
IAQKLEDVFA

SEQ ID NO: 377753 - protein, 10 aa, Influenza virus
AQKLEDVFAG

SEQ ID NO: 377754 - protein, 10 aa, Influenza virus
QKLEDVFAGK

SEQ ID NO: 377755 - protein, 10 aa, Influenza virus
VFAGKNSDLE

SEQ ID NO: 377756 - protein, 10 aa, Influenza virus
FAGKNSDLEA

SEQ ID NO: 377757 - protein, 10 aa, Influenza virus
AGKNSDLEAL

SEQ ID NO: 377758 - protein, 10 aa, Influenza virus
GKNSDLEALM

SEQ ID NO: 377759 - protein, 10 aa, Influenza virus
KNSDLEALME

SEQ ID NO: 377760 - protein, 10 aa, Influenza virus
NSDLEALMEW

SEQ ID NO: 377761 - protein, 10 aa, Influenza virus
ADLEALMEWL

SEQ ID NO: 377762 - protein, 10 aa, Influenza virus
SLTKGVLGFV

SEQ ID NO: 377763 - protein, 10 aa, Influenza virus
LTKGVLGFVF

SEQ ID NO: 377764 - protein, 10 aa, Influenza virus
TKGVLGFVFT

SEQ ID NO: 377765 - protein, 10 aa, Influenza virus
RRRFIQNALN

SEQ ID NO: 377766 - protein, 10 aa, Influenza virus
RRFIQNALNG

SEQ ID NO: 377767 - protein, 10 aa, Influenza virus
RFIQNALNGN

SEQ ID NO: 377768 - protein, 10 aa, Influenza virus
FIQNALNGNG

SEQ ID NO: 377769 - protein, 10 aa, Influenza virus
IQNALNGNGD

SEQ ID NO: 377770 - protein, 10 aa, Influenza virus
NGNGDPSNMD

SEQ ID NO: 377771 - protein, 10 aa, Influenza virus
NGDPSNMDRA

SEQ ID NO: 377772 - protein, 10 aa, Influenza virus
GDPSNMDRAV

SEQ ID NO: 377773 - protein, 10 aa, Influenza virus
DPSNMDRAVK

SEQ ID NO: 377774 - protein, 10 aa, Influenza virus
PSNMDRAVKL

SEQ ID NO: 377775 - protein, 10 aa, Influenza virus
SNMDRAVKLY

SEQ ID NO: 377776 - protein, 10 aa, Influenza virus
NMDKAVKLYR

SEQ ID NO: 377777 - protein, 10 aa, Influenza virus
MDKAVKLYRK

SEQ ID NO: 377778 - protein, 10 aa, Influenza virus
DKAVKLYRKL

SEQ ID NO: 377779 - protein, 10 aa, Influenza virus
KAVKLYRKLK

SEQ ID NO: 377780 - protein, 10 aa, Influenza virus
KLYKKLKREM

SEQ ID NO: 377781 - protein, 10 aa, Influenza virus
LYKKLKREMT

SEQ ID NO: 377782 - protein, 10 aa, Influenza virus
YKKLKREMTF

SEQ ID NO: 377783 - protein, 10 aa, Influenza virus
KKLKREMTFH

SEQ ID NO: 377784 - protein, 10 aa, Influenza virus
KREITFYGAK

SEQ ID NO: 377785 - protein, 10 aa, Influenza virus
REITFYGAKE

SEQ ID NO: 377786 - protein, 10 aa, Influenza virus
EMTFHGAKEV

SEQ ID NO: 377787 - protein, 10 aa, Influenza virus
GAKEVSLSYS

SEQ ID NO: 377788 - protein, 10 aa, Influenza virus
VSLSYSTGAL

SEQ ID NO: 377789 - protein, 10 aa, Influenza virus
SLSYSTGALA

SEQ ID NO: 377790 - protein, 10 aa, Influenza virus
LGYSTGALAS

SEQ ID NO: 377791 - protein, 10 aa, Influenza virus
GYSTGALASC

SEQ ID NO: 377792 - protein, 10 aa, Influenza virus
GLIYNRMGTI

SEQ ID NO: 377793 - protein, 10 aa, Influenza virus
LIYNRMGTVA

SEQ ID NO: 377794 - protein, 10 aa, Influenza virus
ALGLVCATCE

SEQ ID NO: 377795 - protein, 10 aa, Influenza virus
LGLVCATCEQ

SEQ ID NO: 377796 - protein, 10 aa, Influenza virus
ATCEQIADSH

SEQ ID NO: 377797 - protein, 10 aa, Influenza virus
TCEQIADSHH

SEQ ID NO: 377798 - protein, 10 aa, Influenza virus
CEQIADAQHR

SEQ ID NO: 377799 - protein, 10 aa, Influenza virus
EQIADAQHRS

SEQ ID NO: 377800 - protein, 10 aa, Influenza virus
QIADAQHRSH

SEQ ID NO: 377801 - protein, 10 aa, Influenza virus
IADAQHRSHR

SEQ ID NO: 377802 - protein, 10 aa, Influenza virus
ADAQHRSHRQ

SEQ ID NO: 377803 - protein, 10 aa, Influenza virus
DAQHRSHRQM

SEQ ID NO: 377804 - protein, 10 aa, Influenza virus
TITNPLIRHE

SEQ ID NO: 377805 - protein, 10 aa, Influenza virus
ITNPLIRHEN

SEQ ID NO: 377806 - protein, 10 aa, Influenza virus
LIRHENRMVI

SEQ ID NO: 377807 - protein, 10 aa, Influenza virus
IRHENRMVIA

SEQ ID NO: 377808 - protein, 10 aa, Influenza virus
RHENRMVIAS

SEQ ID NO: 377809 - protein, 10 aa, Influenza virus
QIAGSSEQAA

SEQ ID NO: 377810 - protein, 10 aa, Influenza virus
IAGSSEQAAE

SEQ ID NO: 377811 - protein, 10 aa, Influenza virus
GSNEQAAEAM

SEQ ID NO: 377812 - protein, 10 aa, Influenza virus
SSEQAAEAIE

SEQ ID NO: 377813 - protein, 10 aa, Influenza virus
SEQAAEAIEV

SEQ ID NO: 377814 - protein, 10 aa, Influenza virus
EQAAEAIEVA

SEQ ID NO: 377815 - protein, 10 aa, Influenza virus
MVQAMRAIGT

SEQ ID NO: 377816 - protein, 10 aa, Influenza virus
NLLENLQAYQ

SEQ ID NO: 377817 - protein, 10 aa, Influenza virus
LIENLQAYQK

SEQ ID NO: 377818 - protein, 10 aa, Influenza virus
IENLQAYQKR

SEQ ID NO: 377819 - protein, 10 aa, Influenza virus
DNLQAYQKRM

SEQ ID NO: 377820 - protein, 10 aa, Influenza virus
LQAYQKRMGL

SEQ ID NO: 377821 - protein, 10 aa, Influenza virus
QAYQKRMGLQ

SEQ ID NO: 377822 - protein, 10 aa, Influenza virus
AYQKRMGVQL

SEQ ID NO: 377823 - protein, 10 aa, Influenza virus
YQKRMGVQIQ

SEQ ID NO: 377824 - protein, 10 aa, Influenza virus
QKRMGVQIQR

SEQ ID NO: 377825 - protein, 10 aa, Influenza virus
RMGVQIQRFK

SEQ ID NO: 377826 - protein, 10 aa, Influenza virus
MSLLTEVETH

SEQ ID NO: 377827 - protein, 10 aa, Influenza virus
GIPESMREEY

SEQ ID NO: 377828 - protein, 10 aa, Influenza virus
MSDIEIMASQ

SEQ ID NO: 377829 - protein, 10 aa, Influenza virus
SDIEIMASQG

SEQ ID NO: 377830 - protein, 10 aa, Influenza virus
DIEAMATQGT

SEQ ID NO: 377831 - protein, 10 aa, Influenza virus
IEAMATQGTK

SEQ ID NO: 377832 - protein, 10 aa, Influenza virus
EIMASQGTKR

SEQ ID NO: 377833 - protein, 10 aa, Influenza virus
MALQGTKRSY

SEQ ID NO: 377834 - protein, 10 aa, Influenza virus
ALQGTKRSYE

SEQ ID NO: 377835 - protein, 10 aa, Influenza virus
LQGTKRSYEQ

SEQ ID NO: 377836 - protein, 10 aa, Influenza virus
KRSYEQMETS

SEQ ID NO: 377837 - protein, 10 aa, Influenza virus
RSYEQMETSG

SEQ ID NO: 377838 - protein, 10 aa, Influenza virus
YEQMETDGER

SEQ ID NO: 377839 - protein, 10 aa, Influenza virus
EQMETDGERQ

SEQ ID NO: 377840 - protein, 10 aa, Influenza virus
TEIRSSVGKM

SEQ ID NO: 377841 - protein, 10 aa, Influenza virus
EIRASVGKMI

SEQ ID NO: 377842 - protein, 10 aa, Influenza virus
SGIGRFYIQM

SEQ ID NO: 377843 - protein, 10 aa, Influenza virus
GIGKFYIQMC

SEQ ID NO: 377844 - protein, 10 aa, Influenza virus
IGKFYIQMCT

SEQ ID NO: 377845 - protein, 10 aa, Influenza virus
GKFYIQMCTE

SEQ ID NO: 377846 - protein, 10 aa, Influenza virus
KFYIQMCTEL

SEQ ID NO: 377847 - protein, 10 aa, Influenza virus
FYIQMCTELQ

SEQ ID NO: 377848 - protein, 10 aa, Influenza virus
YIQMCTELQL

SEQ ID NO: 377849 - protein, 10 aa, Influenza virus
VQMCTELKLN

SEQ ID NO: 377850 - protein, 10 aa, Influenza virus
QMCTELQLSD

SEQ ID NO: 377851 - protein, 10 aa, Influenza virus
DGRLIQNSIT

SEQ ID NO: 377852 - protein, 10 aa, Influenza virus
GRLIQNSMTI

SEQ ID NO: 377853 - protein, 10 aa, Influenza virus
RLIQNSMTIE

SEQ ID NO: 377854 - protein, 10 aa, Influenza virus
TVERMVLSAF

SEQ ID NO: 377855 - protein, 10 aa, Influenza virus
VERMVLSAFD

SEQ ID NO: 377856 - protein, 10 aa, Influenza virus
RNKYLEEHPN

SEQ ID NO: 377857 - protein, 10 aa, Influenza virus
NKYLEEHPNA

SEQ ID NO: 377858 - protein, 10 aa, Influenza virus
KYLEEHPNAG

SEQ ID NO: 377859 - protein, 10 aa, Influenza virus
YLEEHPSTGK

SEQ ID NO: 377860 - protein, 10 aa, Influenza virus
LEEHPSTGKD

SEQ ID NO: 377861 - protein, 10 aa, Influenza virus
EEHPSTGKDP

SEQ ID NO: 377862 - protein, 10 aa, Influenza virus
EHPSTGKDPK

SEQ ID NO: 377863 - protein, 10 aa, Influenza virus
HPSTGKDPKK

SEQ ID NO: 377864 - protein, 10 aa, Influenza virus
PSTGKDPKKT

SEQ ID NO: 377865 - protein, 10 aa, Influenza virus
STGKDPKKTG

SEQ ID NO: 377866 - protein, 10 aa, Influenza virus
KKTGGPIYKK

SEQ ID NO: 377867 - protein, 10 aa, Influenza virus
EIMRIWRQAN

SEQ ID NO: 377868 - protein, 10 aa, Influenza virus
MRIWRQANNG

SEQ ID NO: 377869 - protein, 10 aa, Influenza virus
RIWRQANNGD

SEQ ID NO: 377870 - protein, 10 aa, Influenza virus
WRQANNGEDS

SEQ ID NO: 377871 - protein, 10 aa, Influenza virus
AGLTHMMIWH

SEQ ID NO: 377872 - protein, 10 aa, Influenza virus
GLTHMMIWHS

SEQ ID NO: 377873 - protein, 10 aa, Influenza virus
LTHMMIWHSN

SEQ ID NO: 377874 - protein, 10 aa, Influenza virus
THMMIWHSNL

SEQ ID NO: 377875 - protein, 10 aa, Influenza virus
HMMIWHSNLN

SEQ ID NO: 377876 - protein, 10 aa, Influenza virus
MMIWHSNLND

SEQ ID NO: 377877 - protein, 10 aa, Influenza virus
GAAGAAIKGV

SEQ ID NO: 377878 - protein, 10 aa, Influenza virus
AAGAAIKGVG

SEQ ID NO: 377879 - protein, 10 aa, Influenza virus
AGAAIKGVGT

SEQ ID NO: 377880 - protein, 10 aa, Influenza virus
GAAVKGIGTM

SEQ ID NO: 377881 - protein, 10 aa, Influenza virus
VMELIRMVKR

SEQ ID NO: 377882 - protein, 10 aa, Influenza virus
LELIRMIKRG

SEQ ID NO: 377883 - protein, 10 aa, Influenza virus
ELVRMIKRGI

SEQ ID NO: 377884 - protein, 10 aa, Influenza virus
LVRMIKRGIN

SEQ ID NO: 377885 - protein, 10 aa, Influenza virus
VRMIKRGIND

SEQ ID NO: 377886 - protein, 10 aa, Influenza virus
RMIKRGVNDR

SEQ ID NO: 377887 - protein, 10 aa, Influenza virus
MIKRGVNDRN

SEQ ID NO: 377888 - protein, 10 aa, Influenza virus
IKRGVNDRNF

SEQ ID NO: 377889 - protein, 10 aa, Influenza virus
INDRNFWRGD

SEQ ID NO: 377890 - protein, 10 aa, Influenza virus
NFWRGDNGRR

SEQ ID NO: 377891 - protein, 10 aa, Influenza virus
FWRGDNGRRT

SEQ ID NO: 377892 - protein, 10 aa, Influenza virus
WRGDNGRRTR

SEQ ID NO: 377893 - protein, 10 aa, Influenza virus
TRSAYERMCN

SEQ ID NO: 377894 - protein, 10 aa, Influenza virus
RSAYERMCNI

SEQ ID NO: 377895 - protein, 10 aa, Influenza virus
SAYERMCNIL

SEQ ID NO: 377896 - protein, 10 aa, Influenza virus
FQTAAQKAMM

SEQ ID NO: 377897 - protein, 10 aa, Influenza virus
QTAAQKAMMD

SEQ ID NO: 377898 - protein, 10 aa, Influenza virus
TAAQKAMMDQ

SEQ ID NO: 377899 - protein, 10 aa, Influenza virus
AAQKAMMDQV

SEQ ID NO: 377900 - protein, 10 aa, Influenza virus
AQKAMMDQVR

SEQ ID NO: 377901 - protein, 10 aa, Influenza virus
QKAMMDQVRE

SEQ ID NO: 377902 - protein, 10 aa, Influenza virus
KAMMDQVRES

SEQ ID NO: 377903 - protein, 10 aa, Influenza virus
AMMDQVREGR

SEQ ID NO: 377904 - protein, 10 aa, Influenza virus
MMDQVREGRN

SEQ ID NO: 377905 - protein, 10 aa, Influenza virus
MDQVREGRNP

SEQ ID NO: 377906 - protein, 10 aa, Influenza virus
ESRSPGNAEI

SEQ ID NO: 377907 - protein, 10 aa, Influenza virus
SRSPGNAEIE

SEQ ID NO: 377908 - protein, 10 aa, Influenza virus
NAEIEDLIFS

SEQ ID NO: 377909 - protein, 10 aa, Influenza virus
AEIEDLIFSA

SEQ ID NO: 377910 - protein, 10 aa, Influenza virus
EIEDLIFSAR

SEQ ID NO: 377911 - protein, 10 aa, Influenza virus
IEDLIFSARS

SEQ ID NO: 377912 - protein, 10 aa, Influenza virus
EDLIFSARSA

SEQ ID NO: 377913 - protein, 10 aa, Influenza virus
DLIFSARSAL

SEQ ID NO: 377914 - protein, 10 aa, Influenza virus
LIFSARSALI

SEQ ID NO: 377915 - protein, 10 aa, Influenza virus
IFSARSALIL

SEQ ID NO: 377916 - protein, 10 aa, Influenza virus
FMARSALILR

SEQ ID NO: 377917 - protein, 10 aa, Influenza virus
MARSALILRG

SEQ ID NO: 377918 - protein, 10 aa, Influenza virus
RSALILRGAV

SEQ ID NO: 377919 - protein, 10 aa, Influenza virus
SALILRGAVA

SEQ ID NO: 377920 - protein, 10 aa, Influenza virus
ALILRGAVAH

SEQ ID NO: 377921 - protein, 10 aa, Influenza virus
LILRGAVAHK

SEQ ID NO: 377922 - protein, 10 aa, Influenza virus
ILRGAVAHKS

SEQ ID NO: 377923 - protein, 10 aa, Influenza virus
AHKSCLPACI

SEQ ID NO: 377924 - protein, 10 aa, Influenza virus
HKSCLPACIY

SEQ ID NO: 377925 - protein, 10 aa, Influenza virus
KSCLPACIYG

SEQ ID NO: 377926 - protein, 10 aa, Influenza virus
SCLPACAYGP

SEQ ID NO: 377927 - protein, 10 aa, Influenza virus
CLPACAYGPA

SEQ ID NO: 377928 - protein, 10 aa, Influenza virus
GYDFEKEGYS

SEQ ID NO: 377929 - protein, 10 aa, Influenza virus
YDFEKEGYSL

SEQ ID NO: 377930 - protein, 10 aa, Influenza virus
NFEKEGYSLV

SEQ ID NO: 377931 - protein, 10 aa, Influenza virus
EKEGYSLVGV

SEQ ID NO: 377932 - protein, 10 aa, Influenza virus
KEGYSLVGVD

SEQ ID NO: 377933 - protein, 10 aa, Influenza virus
YSLVGVDPFK

SEQ ID NO: 377934 - protein, 10 aa, Influenza virus
SLVGVDPFKL

SEQ ID NO: 377935 - protein, 10 aa, Influenza virus
LVGVDPFKLL

SEQ ID NO: 377936 - protein, 10 aa, Influenza virus
VGVDPFKLLQ

SEQ ID NO: 377937 - protein, 10 aa, Influenza virus
DPFKLLQTSQ

SEQ ID NO: 377938 - protein, 10 aa, Influenza virus
PFKLLQNSQI

SEQ ID NO: 377939 - protein, 10 aa, Influenza virus
RPKENPAHKS

SEQ ID NO: 377940 - protein, 10 aa, Influenza virus
PKENPAHKSQ

SEQ ID NO: 377941 - protein, 10 aa, Influenza virus
KENPAHKSQL

SEQ ID NO: 377942 - protein, 10 aa, Influenza virus
ENPAHKSQLI

SEQ ID NO: 377943 - protein, 10 aa, Influenza virus
NPAHKSQLIW

SEQ ID NO: 377944 - protein, 10 aa, Influenza virus
PAHKSQLIWM

SEQ ID NO: 377945 - protein, 10 aa, Influenza virus
AHKSQLIWMA

SEQ ID NO: 377946 - protein, 10 aa, Influenza virus
KSQLIWMACH

SEQ ID NO: 377947 - protein, 10 aa, Influenza virus
SQLIWMACHS

SEQ ID NO: 377948 - protein, 10 aa, Influenza virus
QLIWMACHSA

SEQ ID NO: 377949 - protein, 10 aa, Influenza virus
LIWMACHSAA

SEQ ID NO: 377950 - protein, 10 aa, Influenza virus
IWMACHSAAF

SEQ ID NO: 377951 - protein, 10 aa, Influenza virus
NSAAFEDLRV

SEQ ID NO: 377952 - protein, 10 aa, Influenza virus
SAAFEDLRVL

SEQ ID NO: 377953 - protein, 10 aa, Influenza virus
LSTRGIQIAS

SEQ ID NO: 377954 - protein, 10 aa, Influenza virus
STRGIQIASN

SEQ ID NO: 377955 - protein, 10 aa, Influenza virus
TRGIQIASNE

SEQ ID NO: 377956 - protein, 10 aa, Influenza virus
RGIQIASNEN

SEQ ID NO: 377957 - protein, 10 aa, Influenza virus
TLELRSKYWA

SEQ ID NO: 377958 - protein, 10 aa, Influenza virus
LELRSKYWAI

SEQ ID NO: 377959 - protein, 10 aa, Influenza virus
ELRSKYWAIR

SEQ ID NO: 377960 - protein, 10 aa, Influenza virus
LRSKYWAIRT

SEQ ID NO: 377961 - protein, 10 aa, Influenza virus
RSKYWAIRTR

SEQ ID NO: 377962 - protein, 10 aa, Influenza virus
SKYWAIRTRS

SEQ ID NO: 377963 - protein, 10 aa, Influenza virus
KYWAIRTRSG

SEQ ID NO: 377964 - protein, 10 aa, Influenza virus
IRTRSGGNNN

SEQ ID NO: 377965 - protein, 10 aa, Influenza virus
RTRSGGNNNQ

SEQ ID NO: 377966 - protein, 10 aa, Influenza virus
ASAGQISTQP

SEQ ID NO: 377967 - protein, 10 aa, Influenza virus
SIQPTFSVQR

SEQ ID NO: 377968 - protein, 10 aa, Influenza virus
IQPTFSVQRN

SEQ ID NO: 377969 - protein, 10 aa, Influenza virus
QPTFSVQRSL

SEQ ID NO: 377970 - protein, 10 aa, Influenza virus
PTFSVQRSLP

SEQ ID NO: 377971 - protein, 10 aa, Influenza virus
TFSVQRSLPF

SEQ ID NO: 377972 - protein, 10 aa, Influenza virus
FSVQRSLPFE

SEQ ID NO: 377973 - protein, 10 aa, Influenza virus
SVQRNLPFDK

SEQ ID NO: 377974 - protein, 10 aa, Influenza virus
GRTSDMRTEV

SEQ ID NO: 377975 - protein, 10 aa, Influenza virus
RTSDMRTEVI

SEQ ID NO: 377976 - protein, 10 aa, Influenza virus
EVSFRGRGVF

SEQ ID NO: 377977 - protein, 10 aa, Influenza virus
VSFRGRGVFE

SEQ ID NO: 377978 - protein, 10 aa, Influenza virus
SFQGRGVFEF

SEQ ID NO: 377979 - protein, 10 aa, Influenza virus
FQGRGVFEFS

SEQ ID NO: 377980 - protein, 10 aa, Influenza virus
QGRGVFEFSD

SEQ ID NO: 377981 - protein, 10 aa, Influenza virus
RGVFEFSDER

SEQ ID NO: 377982 - protein, 10 aa, Influenza virus
GVFEFSDERA

SEQ ID NO: 377983 - protein, 10 aa, Influenza virus
VFELSDEKAA

SEQ ID NO: 377984 - protein, 10 aa, Influenza virus
AANPIVPSFD

SEQ ID NO: 377985 - protein, 10 aa, Influenza virus
PIVPSFEMSN

SEQ ID NO: 377986 - protein, 10 aa, Influenza virus
MSKEGSYFFG

SEQ ID NO: 377987 - protein, 10 aa, Influenza virus
SKEGSYFFGD

SEQ ID NO: 377988 - protein, 10 aa, Influenza virus
NEGSYFFGDS

SEQ ID NO: 377989 - protein, 10 aa, Influenza virus
GSYFFGDSAE

SEQ ID NO: 377990 - protein, 10 aa, Influenza virus
SYFFGDNAKE

SEQ ID NO: 377991 - protein, 10 aa, Influenza virus
YFFGDNAKEY

SEQ ID NO: 377992 - protein, 10 aa, Influenza virus
LSFQVDCFLW

SEQ ID NO: 377993 - protein, 10 aa, Influenza virus
SFQVDCFIWH

SEQ ID NO: 377994 - protein, 10 aa, Influenza virus
FQVDCYLWHI

SEQ ID NO: 377995 - protein, 10 aa, Influenza virus
QVDCYLWHIR

SEQ ID NO: 377996 - protein, 10 aa, Influenza virus
CDAPFDDRLR

SEQ ID NO: 377997 - protein, 10 aa, Influenza virus
DAPFLDRIRR

SEQ ID NO: 377998 - protein, 10 aa, Influenza virus
APFLDRIRRD

SEQ ID NO: 377999 - protein, 10 aa, Influenza virus
PFLDRIRRDQ

SEQ ID NO: 378000 - protein, 10 aa, Influenza virus
DRLRRDQKAL

SEQ ID NO: 378001 - protein, 10 aa, Influenza virus
RRDQRSLRGR

SEQ ID NO: 378002 - protein, 10 aa, Influenza virus
LKMPASRYLT

SEQ ID NO: 378003 - protein, 10 aa, Influenza virus
KMPASRYLTD

SEQ ID NO: 378004 - protein, 10 aa, Influenza virus
VPASRYLTDM

SEQ ID NO: 378005 - protein, 10 aa, Influenza virus
PASRYLIDMT

SEQ ID NO: 378006 - protein, 10 aa, Influenza virus
EVRRDQMAHC

SEQ ID NO: 378007 - protein, 10 aa, Influenza virus
ESSFEQITFM

SEQ ID NO: 378008 - protein, 10 aa, Influenza virus
SSFEQITFMQ

SEQ ID NO: 378009 - protein, 10 aa, Influenza virus
SFEQITFIQA

SEQ ID NO: 378010 - protein, 10 aa, Influenza virus
FEQITFIQAL

SEQ ID NO: 378011 - protein, 10 aa, Influenza virus
EQITFIQALQ

SEQ ID NO: 378012 - protein, 10 aa, Influenza virus
QITFIQALQL

SEQ ID NO: 378013 - protein, 10 aa, Influenza virus
ITFIQALQLL

SEQ ID NO: 378014 - protein, 10 aa, Influenza virus
TFLQALQLLL

SEQ ID NO: 378015 - protein, 10 aa, Influenza virus
FLQALQLLLE

SEQ ID NO: 378016 - protein, 10 aa, Influenza virus
LQALQLLLEV

SEQ ID NO: 378017 - protein, 10 aa, Influenza virus
ALQLLLEVES

SEQ ID NO: 378018 - protein, 10 aa, Influenza virus
LQLLLEVESE

SEQ ID NO: 378019 - protein, 10 aa, Influenza virus
EVESEIRTFS

SEQ ID NO: 378020 - protein, 10 aa, Influenza virus
EMRTFSFQLI

SEQ ID NO: 378021 - protein, 10 aa, Influenza virus
RTFSFQLILL

SEQ ID NO: 378022 - protein, 10 aa, Influenza virus
MEGFVRQCFN

SEQ ID NO: 378023 - protein, 10 aa, Influenza virus
GFVRQCFNPM

SEQ ID NO: 378024 - protein, 10 aa, Influenza virus
FVRQCFNPMT

SEQ ID NO: 378025 - protein, 10 aa, Influenza virus
VRQCFNPMVV

SEQ ID NO: 378026 - protein, 10 aa, Influenza virus
RQCFNPMVVE

SEQ ID NO: 378027 - protein, 10 aa, Influenza virus
QCFNPMVVEL

SEQ ID NO: 378028 - protein, 10 aa, Influenza virus
CFNPMVVELA

SEQ ID NO: 378029 - protein, 10 aa, Influenza virus
FNPMVVELAE

SEQ ID NO: 378030 - protein, 10 aa, Influenza virus
IELAEKAMKE

SEQ ID NO: 378031 - protein, 10 aa, Influenza virus
ELAEKAMKEH

SEQ ID NO: 378032 - protein, 10 aa, Influenza virus
LAEKAMKEHG

SEQ ID NO: 378033 - protein, 10 aa, Influenza virus
AEKAMKEHGE

SEQ ID NO: 378034 - protein, 10 aa, Influenza virus
ETNKFASICT

SEQ ID NO: 378035 - protein, 10 aa, Influenza virus
TNKFASICTH

SEQ ID NO: 378036 - protein, 10 aa, Influenza virus
NKLAAICTHL

SEQ ID NO: 378037 - protein, 10 aa, Influenza virus
KLAAICTHLE

SEQ ID NO: 378038 - protein, 10 aa, Influenza virus
AAICTHLEIC

SEQ ID NO: 378039 - protein, 10 aa, Influenza virus
AICTHLEICF

SEQ ID NO: 378040 - protein, 10 aa, Influenza virus
ICTHLEICFM

SEQ ID NO: 378041 - protein, 10 aa, Influenza virus
CTHLEICFMY

SEQ ID NO: 378042 - protein, 10 aa, Influenza virus
THLEICFMYS

SEQ ID NO: 378043 - protein, 10 aa, Influenza virus
HLEICFMYSD

SEQ ID NO: 378044 - protein, 10 aa, Influenza virus
LEICFMYSDF

SEQ ID NO: 378045 - protein, 10 aa, Influenza virus
YSDFHFINER

SEQ ID NO: 378046 - protein, 10 aa, Influenza virus
DPNVLLKHRF

SEQ ID NO: 378047 - protein, 10 aa, Influenza virus
PNVLLKHRFE

SEQ ID NO: 378048 - protein, 10 aa, Influenza virus
TLLKHRFEII

SEQ ID NO: 378049 - protein, 10 aa, Influenza virus
FEIIEGRDRN

SEQ ID NO: 378050 - protein, 10 aa, Influenza virus
KPRYLPDLYD

SEQ ID NO: 378051 - protein, 10 aa, Influenza virus
PRYLPDLYDY

SEQ ID NO: 378052 - protein, 10 aa, Influenza virus
RYLPDLYDYK

SEQ ID NO: 378053 - protein, 10 aa, Influenza virus
SLPDLYDYKE

SEQ ID NO: 378054 - protein, 10 aa, Influenza virus
LPDLYDYKES

SEQ ID NO: 378055 - protein, 10 aa, Influenza virus
PDLYDYKESR

SEQ ID NO: 378056 - protein, 10 aa, Influenza virus
DLYDYKESRF

SEQ ID NO: 378057 - protein, 10 aa, Influenza virus
RFLEIGVTRR

SEQ ID NO: 378058 - protein, 10 aa, Influenza virus
FLEIGVTRRE

SEQ ID NO: 378059 - protein, 10 aa, Influenza virus
IGVTRREVHV

SEQ ID NO: 378060 - protein, 10 aa, Influenza virus
GVTRREVHVY

SEQ ID NO: 378061 - protein, 10 aa, Influenza virus
VTRREVHVYY

SEQ ID NO: 378062 - protein, 10 aa, Influenza virus
TRREVHVYYL

SEQ ID NO: 378063 - protein, 10 aa, Influenza virus
RREVHVYYLE

SEQ ID NO: 378064 - protein, 10 aa, Influenza virus
REVHVYYLEK

SEQ ID NO: 378065 - protein, 10 aa, Influenza virus
YLEKASKIKS

SEQ ID NO: 378066 - protein, 10 aa, Influenza virus
EETHIHIFSF

SEQ ID NO: 378067 - protein, 10 aa, Influenza virus
FSFTGEEMAS

SEQ ID NO: 378068 - protein, 10 aa, Influenza virus
SFNGEEMATK

SEQ ID NO: 378069 - protein, 10 aa, Influenza virus
EYTLDEESRA

SEQ ID NO: 378070 - protein, 10 aa, Influenza virus
LFTIRQEMAI

SEQ ID NO: 378071 - protein, 10 aa, Influenza virus
KGLWDSFRQS

SEQ ID NO: 378072 - protein, 10 aa, Influenza virus
GLWDPFRQSE

SEQ ID NO: 378073 - protein, 10 aa, Influenza virus
RQSERGEETV

SEQ ID NO: 378074 - protein, 10 aa, Influenza virus
QSERGEETVE

SEQ ID NO: 378075 - protein, 10 aa, Influenza virus
SERGEETVEE

SEQ ID NO: 378076 - protein, 10 aa, Influenza virus
ERGEDTIEER

SEQ ID NO: 378077 - protein, 10 aa, Influenza virus
RGEDTIEERF

SEQ ID NO: 378078 - protein, 10 aa, Influenza virus
GEDTIEERFE

SEQ ID NO: 378079 - protein, 10 aa, Influenza virus
EDTIEERFEI

SEQ ID NO: 378080 - protein, 10 aa, Influenza virus
LANYSLPPNF

SEQ ID NO: 378081 - protein, 10 aa, Influenza virus
ANYSLPPNFS

SEQ ID NO: 378082 - protein, 10 aa, Influenza virus
FRVYVDGFEP

SEQ ID NO: 378083 - protein, 10 aa, Influenza virus
RVYVDGFEPN

SEQ ID NO: 378084 - protein, 10 aa, Influenza virus
VYVDGFEPNG

SEQ ID NO: 378085 - protein, 10 aa, Influenza virus
YVDGFKPNGC

SEQ ID NO: 378086 - protein, 10 aa, Influenza virus
VDGFKPNGCI

SEQ ID NO: 378087 - protein, 10 aa, Influenza virus
DGFKPNGCIE

SEQ ID NO: 378088 - protein, 10 aa, Influenza virus
GFKPNGCIEG

SEQ ID NO: 378089 - protein, 10 aa, Influenza virus
FKPNGCIEGK

SEQ ID NO: 378090 - protein, 10 aa, Influenza virus
KPNGCIEGKL

SEQ ID NO: 378091 - protein, 10 aa, Influenza virus
PNGCIESKLS

SEQ ID NO: 378092 - protein, 10 aa, Influenza virus
NGCIESKLSQ

SEQ ID NO: 378093 - protein, 10 aa, Influenza virus
GCIESKLSQM

SEQ ID NO: 378094 - protein, 10 aa, Influenza virus
CIESKLSQMS

SEQ ID NO: 378095 - protein, 10 aa, Influenza virus
IESKLSQMSK

SEQ ID NO: 378096 - protein, 10 aa, Influenza virus
CYQRSKFLLM

SEQ ID NO: 378097 - protein, 10 aa, Influenza virus
YQRSKFLLMD

SEQ ID NO: 378098 - protein, 10 aa, Influenza virus
LKLSIEDPDH

SEQ ID NO: 378099 - protein, 10 aa, Influenza virus
KLSIEDPDHE

SEQ ID NO: 378100 - protein, 10 aa, Influenza virus
LSIEDPDHEG

SEQ ID NO: 378101 - protein, 10 aa, Influenza virus
SIEDPDHEGE

SEQ ID NO: 378102 - protein, 10 aa, Influenza virus
IEDPDHEGEG

SEQ ID NO: 378103 - protein, 10 aa, Influenza virus
EDPDHEGEGI

SEQ ID NO: 378104 - protein, 10 aa, Influenza virus
DPDHEGEGIP

SEQ ID NO: 378105 - protein, 10 aa, Influenza virus
PDHEGEGIPL

SEQ ID NO: 378106 - protein, 10 aa, Influenza virus
DHEGEGIPLY

SEQ ID NO: 378107 - protein, 10 aa, Influenza virus
GEGIPLHDAI

SEQ ID NO: 378108 - protein, 10 aa, Influenza virus
EGIPLHDAIK

SEQ ID NO: 378109 - protein, 10 aa, Influenza virus
GIPLHDAIKC

SEQ ID NO: 378110 - protein, 10 aa, Influenza virus
LKWVLGENMA

SEQ ID NO: 378111 - protein, 10 aa, Influenza virus
KWVLGENMAP

SEQ ID NO: 378112 - protein, 10 aa, Influenza virus
WTLGENMAPE

SEQ ID NO: 378113 - protein, 10 aa, Influenza virus
TLGENMAPEK

SEQ ID NO: 378114 - protein, 10 aa, Influenza virus
LGENMAPEKI

SEQ ID NO: 378115 - protein, 10 aa, Influenza virus
GENMAPEKID

SEQ ID NO: 378116 - protein, 10 aa, Influenza virus
ENMAPEKIDF

SEQ ID NO: 378117 - protein, 10 aa, Influenza virus
WVQNEFNKAC

SEQ ID NO: 378118 - protein, 10 aa, Influenza virus
VQNEFNKACE

SEQ ID NO: 378119 - protein, 10 aa, Influenza virus
NKACELTDSV

SEQ ID NO: 378120 - protein, 10 aa, Influenza virus
KACELTDSVW

SEQ ID NO: 378121 - protein, 10 aa, Influenza virus
WMELDEIGED

SEQ ID NO: 378122 - protein, 10 aa, Influenza virus
ELDEIGEDLA

SEQ ID NO: 378123 - protein, 10 aa, Influenza virus
LDEIGEDLAP

SEQ ID NO: 378124 - protein, 10 aa, Influenza virus
DEIGEDLAPI

SEQ ID NO: 378125 - protein, 10 aa, Influenza virus
EIGEDLAPIE

SEQ ID NO: 378126 - protein, 10 aa, Influenza virus
IGEDIAPIEH

SEQ ID NO: 378127 - protein, 10 aa, Influenza virus
APIEYVASMR

SEQ ID NO: 378128 - protein, 10 aa, Influenza virus
PIEYVASMRR

SEQ ID NO: 378129 - protein, 10 aa, Influenza virus
IASMRRDYFT

SEQ ID NO: 378130 - protein, 10 aa, Influenza virus
RRSYFTAEVS

SEQ ID NO: 378131 - protein, 10 aa, Influenza virus
YFTAEVSYCR

SEQ ID NO: 378132 - protein, 10 aa, Influenza virus
FTAEVSYCRA

SEQ ID NO: 378133 - protein, 10 aa, Influenza virus
TAEVSYCRAT

SEQ ID NO: 378134 - protein, 10 aa, Influenza virus
AEVSYCRATE

SEQ ID NO: 378135 - protein, 10 aa, Influenza virus
VSYCRATEYI

SEQ ID NO: 378136 - protein, 10 aa, Influenza virus
SHCRATEYMM

SEQ ID NO: 378137 - protein, 10 aa, Influenza virus
HCRATEYMMK

SEQ ID NO: 378138 - protein, 10 aa, Influenza virus
ATEYIIKGVY

SEQ ID NO: 378139 - protein, 10 aa, Influenza virus
MKGVYMNTAL

SEQ ID NO: 378140 - protein, 10 aa, Influenza virus
KGVYMNTALL

SEQ ID NO: 378141 - protein, 10 aa, Influenza virus
GVYMNTALLN

SEQ ID NO: 378142 - protein, 10 aa, Influenza virus
VYMNTALLNA

SEQ ID NO: 378143 - protein, 10 aa, Influenza virus
YMNTALLNAS

SEQ ID NO: 378144 - protein, 10 aa, Influenza virus
MNTALLNASC

SEQ ID NO: 378145 - protein, 10 aa, Influenza virus
LLNASCAAME

SEQ ID NO: 378146 - protein, 10 aa, Influenza virus
LNASCAAMED

SEQ ID NO: 378147 - protein, 10 aa, Influenza virus
NASCAAMEDF

SEQ ID NO: 378148 - protein, 10 aa, Influenza virus
ASCAAMEDFQ

SEQ ID NO: 378149 - protein, 10 aa, Influenza virus
SCAAMEDFQL

SEQ ID NO: 378150 - protein, 10 aa, Influenza virus
CAAMEDFQLI

SEQ ID NO: 378151 - protein, 10 aa, Influenza virus
AAMEDFQLIP

SEQ ID NO: 378152 - protein, 10 aa, Influenza virus
AMEDFQLIPM

SEQ ID NO: 378153 - protein, 10 aa, Influenza virus
MEDFQLIPMI

SEQ ID NO: 378154 - protein, 10 aa, Influenza virus
EDFQLIPMIS

SEQ ID NO: 378155 - protein, 10 aa, Influenza virus
DYQLIPMISK

SEQ ID NO: 378156 - protein, 10 aa, Influenza virus
LIPMISKSRT

SEQ ID NO: 378157 - protein, 10 aa, Influenza virus
IPMISKCKTK

SEQ ID NO: 378158 - protein, 10 aa, Influenza virus
PMISKCKTKE

SEQ ID NO: 378159 - protein, 10 aa, Influenza virus
MISKCKTKEG

SEQ ID NO: 378160 - protein, 10 aa, Influenza virus
ISKCKTKEGR

SEQ ID NO: 378161 - protein, 10 aa, Influenza virus
SKCKTKEGRR

SEQ ID NO: 378162 - protein, 10 aa, Influenza virus
KCRTKEGRRR

SEQ ID NO: 378163 - protein, 10 aa, Influenza virus
CRTKEGRRRT

SEQ ID NO: 378164 - protein, 10 aa, Influenza virus
RTKEGRRRTN

SEQ ID NO: 378165 - protein, 10 aa, Influenza virus
TKEGRRRTNL

SEQ ID NO: 378166 - protein, 10 aa, Influenza virus
KEGRRRTNLY

SEQ ID NO: 378167 - protein, 10 aa, Influenza virus
RRTNLYGFII

SEQ ID NO: 378168 - protein, 10 aa, Influenza virus
RTNLYGFIIK

SEQ ID NO: 378169 - protein, 10 aa, Influenza virus
RNDTDVVNFL

SEQ ID NO: 378170 - protein, 10 aa, Influenza virus
NDTDVVNFLS

SEQ ID NO: 378171 - protein, 10 aa, Influenza virus
DTDVVNFLSM

SEQ ID NO: 378172 - protein, 10 aa, Influenza virus
TDVVNFLSME

SEQ ID NO: 378173 - protein, 10 aa, Influenza virus
DVVNFLSMEF

SEQ ID NO: 378174 - protein, 10 aa, Influenza virus
VVNFLSMEFS

SEQ ID NO: 378175 - protein, 10 aa, Influenza virus
VNFLSMEFSL

SEQ ID NO: 378176 - protein, 10 aa, Influenza virus
NFLSMEFSLT

SEQ ID NO: 378177 - protein, 10 aa, Influenza virus
FLSMEFSLTD

SEQ ID NO: 378178 - protein, 10 aa, Influenza virus
MEFSLTDPKL

SEQ ID NO: 378179 - protein, 10 aa, Influenza virus
EFSLTDPKLE

SEQ ID NO: 378180 - protein, 10 aa, Influenza virus
PIFLYVRTNG

SEQ ID NO: 378181 - protein, 10 aa, Influenza virus
IFLYVRTNGT

SEQ ID NO: 378182 - protein, 10 aa, Influenza virus
YIRTNGTSKI

SEQ ID NO: 378183 - protein, 10 aa, Influenza virus
IRTNGTSKIK

SEQ ID NO: 378184 - protein, 10 aa, Influenza virus
KIKMKWGMEL

SEQ ID NO: 378185 - protein, 10 aa, Influenza virus
IKMKWGMELR

SEQ ID NO: 378186 - protein, 10 aa, Influenza virus
QSLQQIESII

SEQ ID NO: 378187 - protein, 10 aa, Influenza virus
SLQQIESIIE

SEQ ID NO: 378188 - protein, 10 aa, Influenza virus
LQQIESIIEA

SEQ ID NO: 378189 - protein, 10 aa, Influenza virus
QQIESIIEAE

SEQ ID NO: 378190 - protein, 10 aa, Influenza virus
QIESIIEAES

SEQ ID NO: 378191 - protein, 10 aa, Influenza virus
IESIIEAESS

SEQ ID NO: 378192 - protein, 10 aa, Influenza virus
ESMVEAESSV

SEQ ID NO: 378193 - protein, 10 aa, Influenza virus
SMVEAESSVK

SEQ ID NO: 378194 - protein, 10 aa, Influenza virus
MVEAESSVKE

SEQ ID NO: 378195 - protein, 10 aa, Influenza virus
VEAESSVKEK

SEQ ID NO: 378196 - protein, 10 aa, Influenza virus
EAESSVREKD

SEQ ID NO: 378197 - protein, 10 aa, Influenza virus
AESSVREKDM

SEQ ID NO: 378198 - protein, 10 aa, Influenza virus
ESSVREKDMT

SEQ ID NO: 378199 - protein, 10 aa, Influenza virus
SSVKEKDMTR

SEQ ID NO: 378200 - protein, 10 aa, Influenza virus
REKDMTKEFF

SEQ ID NO: 378201 - protein, 10 aa, Influenza virus
EKDLTKEFFE

SEQ ID NO: 378202 - protein, 10 aa, Influenza virus
VEDGSIGKVC

SEQ ID NO: 378203 - protein, 10 aa, Influenza virus
EDGSIGKVCR

SEQ ID NO: 378204 - protein, 10 aa, Influenza virus
DGSIGKVCRT

SEQ ID NO: 378205 - protein, 10 aa, Influenza virus
GSIGKVCRAL

SEQ ID NO: 378206 - protein, 10 aa, Influenza virus
TLLAKSVFNN

SEQ ID NO: 378207 - protein, 10 aa, Influenza virus
LLAKSVFNNL

SEQ ID NO: 378208 - protein, 10 aa, Influenza virus
LAKSVFNNLY

SEQ ID NO: 378209 - protein, 10 aa, Influenza virus
AKSVFNNLYA

SEQ ID NO: 378210 - protein, 10 aa, Influenza virus
KSVFNNLYAS

SEQ ID NO: 378211 - protein, 10 aa, Influenza virus
SVFNCLYASP

SEQ ID NO: 378212 - protein, 10 aa, Influenza virus
FNCLYASPQL

SEQ ID NO: 378213 - protein, 10 aa, Influenza virus
NCLYASPQLE

SEQ ID NO: 378214 - protein, 10 aa, Influenza virus
CLYASPQLEG

SEQ ID NO: 378215 - protein, 10 aa, Influenza virus
LYSSPQLEGF

SEQ ID NO: 378216 - protein, 10 aa, Influenza virus
YSSPQLEGFS

SEQ ID NO: 378217 - protein, 10 aa, Influenza virus
SAESRKMLLI

SEQ ID NO: 378218 - protein, 10 aa, Influenza virus
AESRKLLLIA

SEQ ID NO: 378219 - protein, 10 aa, Influenza virus
ESRKLLLIAQ

SEQ ID NO: 378220 - protein, 10 aa, Influenza virus
SRKLLLIAQA

SEQ ID NO: 378221 - protein, 10 aa, Influenza virus
QAFRDNLEPG

SEQ ID NO: 378222 - protein, 10 aa, Influenza virus
AFRDNLEPGT

SEQ ID NO: 378223 - protein, 10 aa, Influenza virus
FRDNLEPGTF

SEQ ID NO: 378224 - protein, 10 aa, Influenza virus
KDNLEPGTFD

SEQ ID NO: 378225 - protein, 10 aa, Influenza virus
DSLEPGTFDL

SEQ ID NO: 378226 - protein, 10 aa, Influenza virus
LEPGTFDIGG

SEQ ID NO: 378227 - protein, 10 aa, Influenza virus
EPGTFDIGGL

SEQ ID NO: 378228 - protein, 10 aa, Influenza virus
PGTFDIGGLY

SEQ ID NO: 378229 - protein, 10 aa, Influenza virus
GLYDAIEECL

SEQ ID NO: 378230 - protein, 10 aa, Influenza virus
LYDAIEECLI

SEQ ID NO: 378231 - protein, 10 aa, Influenza virus
YDAIEECLIN

SEQ ID NO: 378232 - protein, 10 aa, Influenza virus
DAIEECLIND

SEQ ID NO: 378233 - protein, 10 aa, Influenza virus
AVEECLINDP

SEQ ID NO: 378234 - protein, 10 aa, Influenza virus
NASWFNSFLV

SEQ ID NO: 378235 - protein, 10 aa, Influenza virus
ASWFNSFLVH

SEQ ID NO: 378236 - protein, 10 aa, Influenza virus
NSFLAHALKL

SEQ ID NO: 378237 - protein, 10 aa, Influenza virus
SFLTHALRFL

SEQ ID NO: 378238 - protein, 10 aa, Influenza virus
DVNPTLLFLR

SEQ ID NO: 378239 - protein, 10 aa, Influenza virus
VNPTLLFLEV

SEQ ID NO: 378240 - protein, 10 aa, Influenza virus
HPTLLFLKVP

SEQ ID NO: 378241 - protein, 10 aa, Influenza virus
PAQNAISITF

SEQ ID NO: 378242 - protein, 10 aa, Influenza virus
AQNAISITFP

SEQ ID NO: 378243 - protein, 10 aa, Influenza virus
VSRTHQYSEK

SEQ ID NO: 378244 - protein, 10 aa, Influenza virus
SRTHQYSEKG

SEQ ID NO: 378245 - protein, 10 aa, Influenza virus
RTHQYSERGK

SEQ ID NO: 378246 - protein, 10 aa, Influenza virus
THQYSERGKW

SEQ ID NO: 378247 - protein, 10 aa, Influenza virus
TEIGAPQLNP

SEQ ID NO: 378248 - protein, 10 aa, Influenza virus
ETKAPQLNPI

SEQ ID NO: 378249 - protein, 10 aa, Influenza virus
TKAPQLNPID

SEQ ID NO: 378250 - protein, 10 aa, Influenza virus
GALQLNPIDG

SEQ ID NO: 378251 - protein, 10 aa, Influenza virus
LNPIDGPLPD

SEQ ID NO: 378252 - protein, 10 aa, Influenza virus
NNEPSGYAQT

SEQ ID NO: 378253 - protein, 10 aa, Influenza virus
NDPSGYAQTD

SEQ ID NO: 378254 - protein, 10 aa, Influenza virus
DPSGYAQTDC

SEQ ID NO: 378255 - protein, 10 aa, Influenza virus
VLEAMAFLEN

SEQ ID NO: 378256 - protein, 10 aa, Influenza virus
LEAMAFLENS

SEQ ID NO: 378257 - protein, 10 aa, Influenza virus
EAMAFLENSH

SEQ ID NO: 378258 - protein, 10 aa, Influenza virus
AMAFLENSHP

SEQ ID NO: 378259 - protein, 10 aa, Influenza virus
MAFLENSHPG

SEQ ID NO: 378260 - protein, 10 aa, Influenza virus
LEESHPGLFE

SEQ ID NO: 378261 - protein, 10 aa, Influenza virus
SHPGIFGNSC

SEQ ID NO: 378262 - protein, 10 aa, Influenza virus
HPGLFENSCL

SEQ ID NO: 378263 - protein, 10 aa, Influenza virus
PGLFENSCLE

SEQ ID NO: 378264 - protein, 10 aa, Influenza virus
VQQTRVDRLT

SEQ ID NO: 378265 - protein, 10 aa, Influenza virus
DRLTQGRQTY

SEQ ID NO: 378266 - protein, 10 aa, Influenza virus
RLTQGRQTYD

SEQ ID NO: 378267 - protein, 10 aa, Influenza virus
LANTIEVFRL

SEQ ID NO: 378268 - protein, 10 aa, Influenza virus
ANTIEVFRLN

SEQ ID NO: 378269 - protein, 10 aa, Influenza virus
NESGRLMDFL

SEQ ID NO: 378270 - protein, 10 aa, Influenza virus
RLIDFLKDVV

SEQ ID NO: 378271 - protein, 10 aa, Influenza virus
IVTHFQRKRR

SEQ ID NO: 378272 - protein, 10 aa, Influenza virus
TTHFQRKRRI

SEQ ID NO: 378273 - protein, 10 aa, Influenza virus
THFHRKRRVR

SEQ ID NO: 378274 - protein, 10 aa, Influenza virus
HFHRKRRVRD

SEQ ID NO: 378275 - protein, 10 aa, Influenza virus
FHRKRRVRDN

SEQ ID NO: 378276 - protein, 10 aa, Influenza virus
MVTQRTVGKK

SEQ ID NO: 378277 - protein, 10 aa, Influenza virus
TQRTVGKKKQ

SEQ ID NO: 378278 - protein, 10 aa, Influenza virus
NYLIRALTLN

SEQ ID NO: 378279 - protein, 10 aa, Influenza virus
YIIRALTLNT

SEQ ID NO: 378280 - protein, 10 aa, Influenza virus
IIRALTLNTM

SEQ ID NO: 378281 - protein, 10 aa, Influenza virus
IRGFVHFVEA

SEQ ID NO: 378282 - protein, 10 aa, Influenza virus
RGFVHFVEAL

SEQ ID NO: 378283 - protein, 10 aa, Influenza virus
GFVHFVEALA

SEQ ID NO: 378284 - protein, 10 aa, Influenza virus
LARCICEKLE

SEQ ID NO: 378285 - protein, 10 aa, Influenza virus
ARCICEKLEQ

SEQ ID NO: 378286 - protein, 10 aa, Influenza virus
RCICEKLEQS

SEQ ID NO: 378287 - protein, 10 aa, Influenza virus
CICEKLEQSG

SEQ ID NO: 378288 - protein, 10 aa, Influenza virus
VVRKMMTNSR

SEQ ID NO: 378289 - protein, 10 aa, Influenza virus
VRKMMTNSRD

SEQ ID NO: 378290 - protein, 10 aa, Influenza virus
RKMMTNSRDT

SEQ ID NO: 378291 - protein, 10 aa, Influenza virus
SSQDTELSFT

SEQ ID NO: 378292 - protein, 10 aa, Influenza virus
SQDTELSFTV

SEQ ID NO: 378293 - protein, 10 aa, Influenza virus
QDTELSFTVT

SEQ ID NO: 378294 - protein, 10 aa, Influenza virus
DTELSFTVTG

SEQ ID NO: 378295 - protein, 10 aa, Influenza virus
TELSFTVTGD

SEQ ID NO: 378296 - protein, 10 aa, Influenza virus
ELSFTVTGDN

SEQ ID NO: 378297 - protein, 10 aa, Influenza virus
LSFTVTGDNT

SEQ ID NO: 378298 - protein, 10 aa, Influenza virus
KWNENQNPRI

SEQ ID NO: 378299 - protein, 10 aa, Influenza virus
WNENQNPRIF

SEQ ID NO: 378300 - protein, 10 aa, Influenza virus
NENQNPRIFL

SEQ ID NO: 378301 - protein, 10 aa, Influenza virus
ENQNPRVFLA

SEQ ID NO: 378302 - protein, 10 aa, Influenza virus
NQNPRVFLAM

SEQ ID NO: 378303 - protein, 10 aa, Influenza virus
QNPRVFLAMI

SEQ ID NO: 378304 - protein, 10 aa, Influenza virus
NPRVFLAMIT

SEQ ID NO: 378305 - protein, 10 aa, Influenza virus
PRVFLAMITY

SEQ ID NO: 378306 - protein, 10 aa, Influenza virus
RVFLAMITYI

SEQ ID NO: 378307 - protein, 10 aa, Influenza virus
VFLAMITYIT

SEQ ID NO: 378308 - protein, 10 aa, Influenza virus
FLTMITYITR

SEQ ID NO: 378309 - protein, 10 aa, Influenza virus
QPGWFRNVLS

SEQ ID NO: 378310 - protein, 10 aa, Influenza virus
WFRNILSIAP

SEQ ID NO: 378311 - protein, 10 aa, Influenza virus
FRNILSIAPI

SEQ ID NO: 378312 - protein, 10 aa, Influenza virus
RNILSIAPIM

SEQ ID NO: 378313 - protein, 10 aa, Influenza virus
NILSIAPIMF

SEQ ID NO: 378314 - protein, 10 aa, Influenza virus
ILSIAPIMFS

SEQ ID NO: 378315 - protein, 10 aa, Influenza virus
LSVAPIMFSN

SEQ ID NO: 378316 - protein, 10 aa, Influenza virus
SVAPIMFSNK

SEQ ID NO: 378317 - protein, 10 aa, Influenza virus
VAPIMFSNKM

SEQ ID NO: 378318 - protein, 10 aa, Influenza virus
PIMFSNKMAK

SEQ ID NO: 378319 - protein, 10 aa, Influenza virus
IMFSNKMAKL

SEQ ID NO: 378320 - protein, 10 aa, Influenza virus
FSNKVARLGK

SEQ ID NO: 378321 - protein, 10 aa, Influenza virus
SNKVARLGKG

SEQ ID NO: 378322 - protein, 10 aa, Influenza virus
NKVARLGKGY

SEQ ID NO: 378323 - protein, 10 aa, Influenza virus
KVARLGKGYM

SEQ ID NO: 378324 - protein, 10 aa, Influenza virus
VARLGKGYMF

SEQ ID NO: 378325 - protein, 10 aa, Influenza virus
GTVSLSPGMM

SEQ ID NO: 378326 - protein, 10 aa, Influenza virus
TVSLSPGMMM

SEQ ID NO: 378327 - protein, 10 aa, Influenza virus
GVSVLNLGQK

SEQ ID NO: 378328 - protein, 10 aa, Influenza virus
TSYWWDGLQS

SEQ ID NO: 378329 - protein, 10 aa, Influenza virus
SYWWDGLQSS

SEQ ID NO: 378330 - protein, 10 aa, Influenza virus
DDFALIVNAL

SEQ ID NO: 378331 - protein, 10 aa, Influenza virus
GVQAGVDRFY

SEQ ID NO: 378332 - protein, 10 aa, Influenza virus
QAGVNRFYRT

SEQ ID NO: 378333 - protein, 10 aa, Influenza virus
AGVNRFYRTC

SEQ ID NO: 378334 - protein, 10 aa, Influenza virus
GVNRFYRTCK

SEQ ID NO: 378335 - protein, 10 aa, Influenza virus
VNRFYRTCKL

SEQ ID NO: 378336 - protein, 10 aa, Influenza virus
DRFYRICKLV

SEQ ID NO: 378337 - protein, 10 aa, Influenza virus
RFYRICKLVG

SEQ ID NO: 378338 - protein, 10 aa, Influenza virus
FYRICKLVGI

SEQ ID NO: 378339 - protein, 10 aa, Influenza virus
YRICKLVGIN

SEQ ID NO: 378340 - protein, 10 aa, Influenza virus
RICKLVGINM

SEQ ID NO: 378341 - protein, 10 aa, Influenza virus
ICKLVGINMS

SEQ ID NO: 378342 - protein, 10 aa, Influenza virus
KLVGINMSKR

SEQ ID NO: 378343 - protein, 10 aa, Influenza virus
LVGINMSKRK

SEQ ID NO: 378344 - protein, 10 aa, Influenza virus
VGINMSKRKS

SEQ ID NO: 378345 - protein, 10 aa, Influenza virus
MSKRKSYINK

SEQ ID NO: 378346 - protein, 10 aa, Influenza virus
SKRKSYINKT

SEQ ID NO: 378347 - protein, 10 aa, Influenza virus
SADMSIGVAV

SEQ ID NO: 378348 - protein, 10 aa, Influenza virus
ADMSIGVAVI

SEQ ID NO: 378349 - protein, 10 aa, Influenza virus
DMSIGVTVIR

SEQ ID NO: 378350 - protein, 10 aa, Influenza virus
MSIGVTVIRN

SEQ ID NO: 378351 - protein, 10 aa, Influenza virus
SIGVTVIRNN

SEQ ID NO: 378352 - protein, 10 aa, Influenza virus
IGVTVIRNNM

SEQ ID NO: 378353 - protein, 10 aa, Influenza virus
GVTVIRNNMI

SEQ ID NO: 378354 - protein, 10 aa, Influenza virus
VTVIRNNMIN

SEQ ID NO: 378355 - protein, 10 aa, Influenza virus
TVIKNNMVNN

SEQ ID NO: 378356 - protein, 10 aa, Influenza virus
VIKNNMVNND

SEQ ID NO: 378357 - protein, 10 aa, Influenza virus
IKNNMVNNDL

SEQ ID NO: 378358 - protein, 10 aa, Influenza virus
YTYRCHRGDM

SEQ ID NO: 378359 - protein, 10 aa, Influenza virus
TYRCHRGDMQ

SEQ ID NO: 378360 - protein, 10 aa, Influenza virus
YRCHRGDMQI

SEQ ID NO: 378361 - protein, 10 aa, Influenza virus
GLLVADGGPN

SEQ ID NO: 378362 - protein, 10 aa, Influenza virus
LLVADGGPNL

SEQ ID NO: 378363 - protein, 10 aa, Influenza virus
LVADGGPNLY

SEQ ID NO: 378364 - protein, 10 aa, Influenza virus
VADGGPNLYN

SEQ ID NO: 378365 - protein, 10 aa, Influenza virus
HIPEAGLKWE

SEQ ID NO: 378366 - protein, 10 aa, Influenza virus
IPEAGLKWEL

SEQ ID NO: 378367 - protein, 10 aa, Influenza virus
PEAGLKWELM

SEQ ID NO: 378368 - protein, 10 aa, Influenza virus
EAGLKWELMD

SEQ ID NO: 378369 - protein, 10 aa, Influenza virus
YKGRLCNPLN

SEQ ID NO: 378370 - protein, 10 aa, Influenza virus
KGRLCNPLNP

SEQ ID NO: 378371 - protein, 10 aa, Influenza virus
LCNPLNPFVT

SEQ ID NO: 378372 - protein, 10 aa, Influenza virus
CNPLNPFVTH

SEQ ID NO: 378373 - protein, 10 aa, Influenza virus
VEYDAVATTH

SEQ ID NO: 378374 - protein, 10 aa, Influenza virus
DAVATTHSWT

SEQ ID NO: 378375 - protein, 10 aa, Influenza virus
AVATTHSWTP

SEQ ID NO: 378376 - protein, 10 aa, Influenza virus
VATTHSWTPK

SEQ ID NO: 378377 - protein, 10 aa, Influenza virus
ATTHSWTPKR

SEQ ID NO: 378378 - protein, 10 aa, Influenza virus
TTHSWTPKRN

SEQ ID NO: 378379 - protein, 10 aa, Influenza virus
THSWTPKRNR

SEQ ID NO: 378380 - protein, 10 aa, Influenza virus
HSWTPKRNRS

SEQ ID NO: 378381 - protein, 10 aa, Influenza virus
SWTPKRNRSI

SEQ ID NO: 378382 - protein, 10 aa, Influenza virus
WTPKRNRSIL

SEQ ID NO: 378383 - protein, 10 aa, Influenza virus
TPKRNRSILN

SEQ ID NO: 378384 - protein, 10 aa, Influenza virus
NQRGILEDEQ

SEQ ID NO: 378385 - protein, 10 aa, Influenza virus
QKGILEDEQM

SEQ ID NO: 378386 - protein, 10 aa, Influenza virus
KGILEDEQMY

SEQ ID NO: 378387 - protein, 10 aa, Influenza virus
VLEDEQMYQK

SEQ ID NO: 378388 - protein, 10 aa, Influenza virus
DEQMYQKCCS

SEQ ID NO: 378389 - protein, 10 aa, Influenza virus
EQMYQKCCSL

SEQ ID NO: 378390 - protein, 10 aa, Influenza virus
QMYQKCCSLF

SEQ ID NO: 378391 - protein, 10 aa, Influenza virus
MYQKCCSLFE

SEQ ID NO: 378392 - protein, 10 aa, Influenza virus
YQKCCSLFEK

SEQ ID NO: 378393 - protein, 10 aa, Influenza virus
QKCCSLFEKF

SEQ ID NO: 378394 - protein, 10 aa, Influenza virus
KCCSLFEKFF

SEQ ID NO: 378395 - protein, 10 aa, Influenza virus
CCTLFEKFFP

SEQ ID NO: 378396 - protein, 10 aa, Influenza virus
CTLFEKFFPS

SEQ ID NO: 378397 - protein, 10 aa, Influenza virus
TLFEKFFPSS

SEQ ID NO: 378398 - protein, 10 aa, Influenza virus
RRPVGISSMG

SEQ ID NO: 378399 - protein, 10 aa, Influenza virus
RPVGISSMGE

SEQ ID NO: 378400 - protein, 10 aa, Influenza virus
PVGISSMGEA

SEQ ID NO: 378401 - protein, 10 aa, Influenza virus
VGISSMGEAM

SEQ ID NO: 378402 - protein, 10 aa, Influenza virus
GISSMGEAMV

SEQ ID NO: 378403 - protein, 10 aa, Influenza virus
ISSMGEAMVS

SEQ ID NO: 378404 - protein, 10 aa, Influenza virus
SSMGEAMVSR

SEQ ID NO: 378405 - protein, 10 aa, Influenza virus
SMGEAMVSRA

SEQ ID NO: 378406 - protein, 10 aa, Influenza virus
MGEAMVSRAR

SEQ ID NO: 378407 - protein, 10 aa, Influenza virus
GEAMVSRARI

SEQ ID NO: 378408 - protein, 10 aa, Influenza virus
EAMMSRARID

SEQ ID NO: 378409 - protein, 10 aa, Influenza virus
AMMSRARIDA

SEQ ID NO: 378410 - protein, 10 aa, Influenza virus
MMSRARIDAR

SEQ ID NO: 378411 - protein, 10 aa, Influenza virus
ISRARIDARI

SEQ ID NO: 378412 - protein, 10 aa, Influenza virus
RARIDARVDS

SEQ ID NO: 378413 - protein, 10 aa, Influenza virus
ARIDARVDSE

SEQ ID NO: 378414 - protein, 10 aa, Influenza virus
RIDARVDSES

SEQ ID NO: 378415 - protein, 10 aa, Influenza virus
ARIDFESGRM

SEQ ID NO: 378416 - protein, 10 aa, Influenza virus
SKSRSIIFNM

SEQ ID NO: 378417 - protein, 10 aa, Influenza virus
KSRSIIFNME

SEQ ID NO: 378418 - protein, 10 aa, Influenza virus
LMSQSRTRGI

SEQ ID NO: 378419 - protein, 10 aa, Influenza virus
MSQSRTRGIL

SEQ ID NO: 378420 - protein, 10 aa, Influenza virus
SQSRTRGILT

SEQ ID NO: 378421 - protein, 10 aa, Influenza virus
QSRTRGILTK

SEQ ID NO: 378422 - protein, 10 aa, Influenza virus
SRTREILTKI

SEQ ID NO: 378423 - protein, 10 aa, Influenza virus
RTREILTKIT

SEQ ID NO: 378424 - protein, 10 aa, Influenza virus
TREILTKITV

SEQ ID NO: 378425 - protein, 10 aa, Influenza virus
REILTKITVD

SEQ ID NO: 378426 - protein, 10 aa, Influenza virus
EILTKITVDH

SEQ ID NO: 378427 - protein, 10 aa, Influenza virus
ILTKITVDHM

SEQ ID NO: 378428 - protein, 10 aa, Influenza virus
LTKITVDHMA

SEQ ID NO: 378429 - protein, 10 aa, Influenza virus
TKITVDHMAI

SEQ ID NO: 378430 - protein, 10 aa, Influenza virus
KITVDHMAII

SEQ ID NO: 378431 - protein, 10 aa, Influenza virus
MAIIKRYTSG

SEQ ID NO: 378432 - protein, 10 aa, Influenza virus
TSARQEKNPA

SEQ ID NO: 378433 - protein, 10 aa, Influenza virus
SARQEKNPAL

SEQ ID NO: 378434 - protein, 10 aa, Influenza virus
ARQEKNPALR

SEQ ID NO: 378435 - protein, 10 aa, Influenza virus
MAMKYPITAE

SEQ ID NO: 378436 - protein, 10 aa, Influenza virus
IVSPLAVTWW

SEQ ID NO: 378437 - protein, 10 aa, Influenza virus
PLAVTWWNRS

SEQ ID NO: 378438 - protein, 10 aa, Influenza virus
LAVTWWNRSG

SEQ ID NO: 378439 - protein, 10 aa, Influenza virus
AVTWWNRSGP

SEQ ID NO: 378440 - protein, 10 aa, Influenza virus
HYPKVYRTYF

SEQ ID NO: 378441 - protein, 10 aa, Influenza virus
GIFGPVHFRN

SEQ ID NO: 378442 - protein, 10 aa, Influenza virus
IFGPVHFRNQ

SEQ ID NO: 378443 - protein, 10 aa, Influenza virus
FGPVHFQNQV

SEQ ID NO: 378444 - protein, 10 aa, Influenza virus
GPVHFQNQVK

SEQ ID NO: 378445 - protein, 10 aa, Influenza virus
PVHFQNQVKI

SEQ ID NO: 378446 - protein, 10 aa, Influenza virus
VHFQNQVKIR

SEQ ID NO: 378447 - protein, 10 aa, Influenza virus
HFQNQVKIRR

SEQ ID NO: 378448 - protein, 10 aa, Influenza virus
FQNQVKIRRR

SEQ ID NO: 378449 - protein, 10 aa, Influenza virus
QNQVKIRRRV

SEQ ID NO: 378450 - protein, 10 aa, Influenza virus
QVKIRRRVDV

SEQ ID NO: 378451 - protein, 10 aa, Influenza virus
VKIRRRVDVN

SEQ ID NO: 378452 - protein, 10 aa, Influenza virus
KIRRRVDVNP

SEQ ID NO: 378453 - protein, 10 aa, Influenza virus
IRRRVDVNPG

SEQ ID NO: 378454 - protein, 10 aa, Influenza virus
RRRVDVNPGH

SEQ ID NO: 378455 - protein, 10 aa, Influenza virus
RRVDVNPGHA

SEQ ID NO: 378456 - protein, 10 aa, Influenza virus
RVDVNPGHAD

SEQ ID NO: 378457 - protein, 10 aa, Influenza virus
TKEAQDVIME

SEQ ID NO: 378458 - protein, 10 aa, Influenza virus
FPNEVGARII

SEQ ID NO: 378459 - protein, 10 aa, Influenza virus
PNEVGARIIT

SEQ ID NO: 378460 - protein, 10 aa, Influenza virus
NEVGARIITS

SEQ ID NO: 378461 - protein, 10 aa, Influenza virus
EVGARIITSE

SEQ ID NO: 378462 - protein, 10 aa, Influenza virus
VGARIITSES

SEQ ID NO: 378463 - protein, 10 aa, Influenza virus
GARIITSESQ

SEQ ID NO: 378464 - protein, 10 aa, Influenza virus
ARILTSESQM

SEQ ID NO: 378465 - protein, 10 aa, Influenza virus
IAPLMMAYML

SEQ ID NO: 378466 - protein, 10 aa, Influenza virus
APLMMAYMLE

SEQ ID NO: 378467 - protein, 10 aa, Influenza virus
VRKTRFLPVT

SEQ ID NO: 378468 - protein, 10 aa, Influenza virus
RKTRFLPVTG

SEQ ID NO: 378469 - protein, 10 aa, Influenza virus
KTRFLPVTGG

SEQ ID NO: 378470 - protein, 10 aa, Influenza virus
TRFLPVTGGT

SEQ ID NO: 378471 - protein, 10 aa, Influenza virus
RFLPVSGGTS

SEQ ID NO: 378472 - protein, 10 aa, Influenza virus
FLPVSGGTSS

SEQ ID NO: 378473 - protein, 10 aa, Influenza virus
GGTSSIYIEV

SEQ ID NO: 378474 - protein, 10 aa, Influenza virus
GTSSIYIEVL

SEQ ID NO: 378475 - protein, 10 aa, Influenza virus
TSSIYIEVLH

SEQ ID NO: 378476 - protein, 10 aa, Influenza virus
SSIYIEVLHL

SEQ ID NO: 378477 - protein, 10 aa, Influenza virus
SVYVEVLHLT

SEQ ID NO: 378478 - protein, 10 aa, Influenza virus
VYVEVLHLTQ

SEQ ID NO: 378479 - protein, 10 aa, Influenza virus
VEVLHLTQGT

SEQ ID NO: 378480 - protein, 10 aa, Influenza virus
LTQGTCWEQL

SEQ ID NO: 378481 - protein, 10 aa, Influenza virus
TQGTCWEQLY

SEQ ID NO: 378482 - protein, 10 aa, Influenza virus
QGTCWEQLYT

SEQ ID NO: 378483 - protein, 10 aa, Influenza virus
GTCWEQLYTP

SEQ ID NO: 378484 - protein, 10 aa, Influenza virus
TCWEQLYTPG

SEQ ID NO: 378485 - protein, 10 aa, Influenza virus
WEQLYTPGGE

SEQ ID NO: 378486 - protein, 10 aa, Influenza virus
EQLYTPGGEV

SEQ ID NO: 378487 - protein, 10 aa, Influenza virus
YTPGGEVKND

SEQ ID NO: 378488 - protein, 10 aa, Influenza virus
VKNDDVDQSL

SEQ ID NO: 378489 - protein, 10 aa, Influenza virus
NDDVDQSLVI

SEQ ID NO: 378490 - protein, 10 aa, Influenza virus
DDVDQSLVIA

SEQ ID NO: 378491 - protein, 10 aa, Influenza virus
DVDQSLVIAA

SEQ ID NO: 378492 - protein, 10 aa, Influenza virus
VDQSLVIAAR

SEQ ID NO: 378493 - protein, 10 aa, Influenza virus
DQSLVIAARN

SEQ ID NO: 378494 - protein, 10 aa, Influenza virus
QSLVIAARNI

SEQ ID NO: 378495 - protein, 10 aa, Influenza virus
SLVIAARNIV

SEQ ID NO: 378496 - protein, 10 aa, Influenza virus
LVIAARNIVR

SEQ ID NO: 378497 - protein, 10 aa, Influenza virus
VIAARNIVRR

SEQ ID NO: 378498 - protein, 10 aa, Influenza virus
AARSIVRRAT

SEQ ID NO: 378499 - protein, 10 aa, Influenza virus
ARSIVRRATV

SEQ ID NO: 378500 - protein, 10 aa, Influenza virus
RSIVRRATVS

SEQ ID NO: 378501 - protein, 10 aa, Influenza virus
SIVRRATVSA

SEQ ID NO: 378502 - protein, 10 aa, Influenza virus
IVRRAIVSAD

SEQ ID NO: 378503 - protein, 10 aa, Influenza virus
VRRAIVSADP

SEQ ID NO: 378504 - protein, 10 aa, Influenza virus
RRAIVSADPL

SEQ ID NO: 378505 - protein, 10 aa, Influenza virus
RAIVSADPLA

SEQ ID NO: 378506 - protein, 10 aa, Influenza virus
AIVSADPLAS

SEQ ID NO: 378507 - protein, 10 aa, Influenza virus
IVSADPLASL

SEQ ID NO: 378508 - protein, 10 aa, Influenza virus
VSADPLVSLL

SEQ ID NO: 378509 - protein, 10 aa, Influenza virus
SADPLVSLLE

SEQ ID NO: 378510 - protein, 10 aa, Influenza virus
ADPLVSLLEM

SEQ ID NO: 378511 - protein, 10 aa, Influenza virus
LLSLLEMCHS

SEQ ID NO: 378512 - protein, 10 aa, Influenza virus
ASLLEMCHGT

SEQ ID NO: 378513 - protein, 10 aa, Influenza virus
SLLEMCHGTQ

SEQ ID NO: 378514 - protein, 10 aa, Influenza virus
LLEMCHGTQI

SEQ ID NO: 378515 - protein, 10 aa, Influenza virus
LEMCHGTQIG

SEQ ID NO: 378516 - protein, 10 aa, Influenza virus
EMCHGTQIGG

SEQ ID NO: 378517 - protein, 10 aa, Influenza virus
DILKHNPTEE

SEQ ID NO: 378518 - protein, 10 aa, Influenza virus
ILKHNPTEEQ

SEQ ID NO: 378519 - protein, 10 aa, Influenza virus
LKHNPTEEQA

SEQ ID NO: 378520 - protein, 10 aa, Influenza virus
KHNPTEEQAV

SEQ ID NO: 378521 - protein, 10 aa, Influenza virus
QNPTEEQAVN

SEQ ID NO: 378522 - protein, 10 aa, Influenza virus
NPTEEQAVNI

SEQ ID NO: 378523 - protein, 10 aa, Influenza virus
PTEEQAVNIC

SEQ ID NO: 378524 - protein, 10 aa, Influenza virus
TEEQAVNICK

SEQ ID NO: 378525 - protein, 10 aa, Influenza virus
EEQAVNICKA

SEQ ID NO: 378526 - protein, 10 aa, Influenza virus
EQAVNICKAA

SEQ ID NO: 378527 - protein, 10 aa, Influenza virus
QAVGICKAAM

SEQ ID NO: 378528 - protein, 10 aa, Influenza virus
AVGICKAAMG

SEQ ID NO: 378529 - protein, 10 aa, Influenza virus
ICKAALGLRI

SEQ ID NO: 378530 - protein, 10 aa, Influenza virus
CKAALGLRIS

SEQ ID NO: 378531 - protein, 10 aa, Influenza virus
KAALGLRISS

SEQ ID NO: 378532 - protein, 10 aa, Influenza virus
AALGLRISSS

SEQ ID NO: 378533 - protein, 10 aa, Influenza virus
ALGLRISSSF

SEQ ID NO: 378534 - protein, 10 aa, Influenza virus
LGLRISSSFS

SEQ ID NO: 378535 - protein, 10 aa, Influenza virus
FGGFTFKRTN

SEQ ID NO: 378536 - protein, 10 aa, Influenza virus
GGFTFKRTNG

SEQ ID NO: 378537 - protein, 10 aa, Influenza virus
FTFKRTKGFS

SEQ ID NO: 378538 - protein, 10 aa, Influenza virus
EEELLTGNLQ

SEQ ID NO: 378539 - protein, 10 aa, Influenza virus
EEVLTGNLQA

SEQ ID NO: 378540 - protein, 10 aa, Influenza virus
EVLTGNLQAL

SEQ ID NO: 378541 - protein, 10 aa, Influenza virus
MLTGNLQTLK

SEQ ID NO: 378542 - protein, 10 aa, Influenza virus
LTGNLQTLRI

SEQ ID NO: 378543 - protein, 10 aa, Influenza virus
EGYEEFTIVG

SEQ ID NO: 378544 - protein, 10 aa, Influenza virus
ATAILRKATK

SEQ ID NO: 378545 - protein, 10 aa, Influenza virus
IVAMVFSQEE

SEQ ID NO: 378546 - protein, 10 aa, Influenza virus
VAIVFSQEDC

SEQ ID NO: 378547 - protein, 10 aa, Influenza virus
AMVFSQEDCV

SEQ ID NO: 378548 - protein, 10 aa, Influenza virus
MVFSQEECMI

SEQ ID NO: 378549 - protein, 10 aa, Influenza virus
VFSQEECMIK

SEQ ID NO: 378550 - protein, 10 aa, Influenza virus
FSQEECMIKA

SEQ ID NO: 378551 - protein, 10 aa, Influenza virus
QEECMIKAVR

SEQ ID NO: 378552 - protein, 10 aa, Influenza virus
ECMIKAVRGD

SEQ ID NO: 378553 - protein, 10 aa, Influenza virus
CMMKAVRGDL

SEQ ID NO: 378554 - protein, 10 aa, Influenza virus
MMKAVRGDLN

SEQ ID NO: 378555 - protein, 10 aa, Influenza virus
LLRHFQKNAK

SEQ ID NO: 378556 - protein, 10 aa, Influenza virus
LRHFQKDARV

SEQ ID NO: 378557 - protein, 10 aa, Influenza virus
RHFQKDARVL

SEQ ID NO: 378558 - protein, 10 aa, Influenza virus
RVSKVGVDEY

SEQ ID NO: 378559 - protein, 10 aa, Influenza virus
SKVGVDEYSS

SEQ ID NO: 378560 - protein, 10 aa, Influenza virus
VGVDEYSSTE

SEQ ID NO: 378561 - protein, 10 aa, Influenza virus
GVDEYSNAEK

SEQ ID NO: 378562 - protein, 10 aa, Influenza virus
VVNIDRFLRV

SEQ ID NO: 378563 - protein, 10 aa, Influenza virus
VSIDRFLRVK

SEQ ID NO: 378564 - protein, 10 aa, Influenza virus
SIDRFLRVKD

SEQ ID NO: 378565 - protein, 10 aa, Influenza virus
DRFLRVKDQQ

SEQ ID NO: 378566 - protein, 10 aa, Influenza virus
RFLRVKDQQG

SEQ ID NO: 378567 - protein, 10 aa, Influenza virus
FLRVKDQQGN

SEQ ID NO: 378568 - protein, 10 aa, Influenza virus
RGNILLSPEE

SEQ ID NO: 378569 - protein, 10 aa, Influenza virus
PEEVSETQGM

SEQ ID NO: 378570 - protein, 10 aa, Influenza virus
EEVSETQGME

SEQ ID NO: 378571 - protein, 10 aa, Influenza virus
EKLTIIYSSS

SEQ ID NO: 378572 - protein, 10 aa, Influenza virus
KLTITYSSSL

SEQ ID NO: 378573 - protein, 10 aa, Influenza virus
LTIIYSSSMM

SEQ ID NO: 378574 - protein, 10 aa, Influenza virus
TIIYSSSMMW

SEQ ID NO: 378575 - protein, 10 aa, Influenza virus
IIYSSSMMWE

SEQ ID NO: 378576 - protein, 10 aa, Influenza virus
TYSSSMMWEV

SEQ ID NO: 378577 - protein, 10 aa, Influenza virus
YSSSMMWEVN

SEQ ID NO: 378578 - protein, 10 aa, Influenza virus
SSSMMWEVNG

SEQ ID NO: 378579 - protein, 10 aa, Influenza virus
SSMMWEVNGP

SEQ ID NO: 378580 - protein, 10 aa, Influenza virus
SMMWEVNGPE

SEQ ID NO: 378581 - protein, 10 aa, Influenza virus
MMWEVNGPES

SEQ ID NO: 378582 - protein, 10 aa, Influenza virus
MWEINGPDSV

SEQ ID NO: 378583 - protein, 10 aa, Influenza virus
WEINGPDSVL

SEQ ID NO: 378584 - protein, 10 aa, Influenza virus
EVNGPESVLV

SEQ ID NO: 378585 - protein, 10 aa, Influenza virus
VNGPESVLVN

SEQ ID NO: 378586 - protein, 10 aa, Influenza virus
NGPDSVLVNT

SEQ ID NO: 378587 - protein, 10 aa, Influenza virus
GPDSVLVNTY

SEQ ID NO: 378588 - protein, 10 aa, Influenza virus
PDSVLVNTYQ

SEQ ID NO: 378589 - protein, 10 aa, Influenza virus
SVLVNTYQWV

SEQ ID NO: 378590 - protein, 10 aa, Influenza virus
VLVNTYQWVI

SEQ ID NO: 378591 - protein, 10 aa, Influenza virus
LVNTYQWVIR

SEQ ID NO: 378592 - protein, 10 aa, Influenza virus
VNTYQWVIRN

SEQ ID NO: 378593 - protein, 10 aa, Influenza virus
NTYQWIIKNW

SEQ ID NO: 378594 - protein, 10 aa, Influenza virus
TYQWIIKNWE

SEQ ID NO: 378595 - protein, 10 aa, Influenza virus
LYNKVEFEPF

SEQ ID NO: 378596 - protein, 10 aa, Influenza virus
YNKVEFEPFQ

SEQ ID NO: 378597 - protein, 10 aa, Influenza virus
NKVEFEPFQS

SEQ ID NO: 378598 - protein, 10 aa, Influenza virus
KVEFEPFQSL

SEQ ID NO: 378599 - protein, 10 aa, Influenza virus
MEFEPFQSLI

SEQ ID NO: 378600 - protein, 10 aa, Influenza virus
FEPFQSLIPK

SEQ ID NO: 378601 - protein, 10 aa, Influenza virus
EPFQSLIPKA

SEQ ID NO: 378602 - protein, 10 aa, Influenza virus
LYSGFVRTLF

SEQ ID NO: 378603 - protein, 10 aa, Influenza virus
TLFQQMRDVI

SEQ ID NO: 378604 - protein, 10 aa, Influenza virus
QMRDVIGTFD

SEQ ID NO: 378605 - protein, 10 aa, Influenza virus
MRDVIGTFDT

SEQ ID NO: 378606 - protein, 10 aa, Influenza virus
GTFDTAQIIK

SEQ ID NO: 378607 - protein, 10 aa, Influenza virus
TAQIIKLLPF

SEQ ID NO: 378608 - protein, 10 aa, Influenza virus
AQIIKLLPFA

SEQ ID NO: 378609 - protein, 10 aa, Influenza virus
QIIKLLPFAS

SEQ ID NO: 378610 - protein, 10 aa, Influenza virus
IIKLLPFASA

SEQ ID NO: 378611 - protein, 10 aa, Influenza virus
LLPFAAAPPV

SEQ ID NO: 378612 - protein, 10 aa, Influenza virus
LPFAAAPPVQ

SEQ ID NO: 378613 - protein, 10 aa, Influenza virus
PFAAAPPVQS

SEQ ID NO: 378614 - protein, 10 aa, Influenza virus
APPVQSKMQF

SEQ ID NO: 378615 - protein, 10 aa, Influenza virus
PPVQSKMQFS

SEQ ID NO: 378616 - protein, 10 aa, Influenza virus
PVQSKMQFSS

SEQ ID NO: 378617 - protein, 10 aa, Influenza virus
QNRMQFSSLT

SEQ ID NO: 378618 - protein, 10 aa, Influenza virus
NRMQFSSLTV

SEQ ID NO: 378619 - protein, 10 aa, Influenza virus
RMQFSSLTVS

SEQ ID NO: 378620 - protein, 10 aa, Influenza virus
MQFSSLAVNV

SEQ ID NO: 378621 - protein, 10 aa, Influenza virus
QFSSLAVNVR

SEQ ID NO: 378622 - protein, 10 aa, Influenza virus
FSSLAVNVRG

SEQ ID NO: 378623 - protein, 10 aa, Influenza virus
SSLTVSVRGS

SEQ ID NO: 378624 - protein, 10 aa, Influenza virus
SLTVSVRGSG

SEQ ID NO: 378625 - protein, 10 aa, Influenza virus
LTVNVRGTGM

SEQ ID NO: 378626 - protein, 10 aa, Influenza virus
TVNVRGTGMR

SEQ ID NO: 378627 - protein, 10 aa, Influenza virus
VNVRGTGMRI

SEQ ID NO: 378628 - protein, 10 aa, Influenza virus
NVRGTGMRIL

SEQ ID NO: 378629 - protein, 10 aa, Influenza virus
RGSGMRILIR

SEQ ID NO: 378630 - protein, 10 aa, Influenza virus
GSGMRILIRG

SEQ ID NO: 378631 - protein, 10 aa, Influenza virus
GMRILIRGNS

SEQ ID NO: 378632 - protein, 10 aa, Influenza virus
MRILIRGNSP

SEQ ID NO: 378633 - protein, 10 aa, Influenza virus
LVRGNSPAFN

SEQ ID NO: 378634 - protein, 10 aa, Influenza virus
VRGNSPAFNY

SEQ ID NO: 378635 - protein, 10 aa, Influenza virus
RGNSPAFNYN

SEQ ID NO: 378636 - protein, 10 aa, Influenza virus
GNSPIFNYNK

SEQ ID NO: 378637 - protein, 10 aa, Influenza virus
KRLTIIGKDA

SEQ ID NO: 378638 - protein, 10 aa, Influenza virus
RLTIIGKDAG

SEQ ID NO: 378639 - protein, 10 aa, Influenza virus
TGVESAVLRG

SEQ ID NO: 378640 - protein, 10 aa, Influenza virus
VLRGFLILGR

SEQ ID NO: 378641 - protein, 10 aa, Influenza virus
LRGFLILGRE

SEQ ID NO: 378642 - protein, 10 aa, Influenza virus
RGFLILGKEN

SEQ ID NO: 378643 - protein, 10 aa, Influenza virus
GFLILGKEDR

SEQ ID NO: 378644 - protein, 10 aa, Influenza virus
GREDKRYGPA

SEQ ID NO: 378645 - protein, 10 aa, Influenza virus
REDKRYGPAL

SEQ ID NO: 378646 - protein, 10 aa, Influenza virus
ENKRYGPALS

SEQ ID NO: 378647 - protein, 10 aa, Influenza virus
NKRYGPALSI

SEQ ID NO: 378648 - protein, 10 aa, Influenza virus
KKYGPALSIN

SEQ ID NO: 378649 - protein, 10 aa, Influenza virus
KYGPALSINE

SEQ ID NO: 378650 - protein, 10 aa, Influenza virus
GPALSINELG

SEQ ID NO: 378651 - protein, 10 aa, Influenza virus
LARGEKANVL

SEQ ID NO: 378652 - protein, 10 aa, Influenza virus
ARGEKANVLI

SEQ ID NO: 378653 - protein, 10 aa, Influenza virus
VVLVMKRKRN

SEQ ID NO: 378654 - protein, 10 aa, Influenza virus
TATKRIRMAT

SEQ ID NO: 378655 - protein, 10 aa, Influenza virus
KRIRMATNEC

SEQ ID NO: 378656 - protein, 10 aa, Influenza virus
KRKKRGLFGA

SEQ ID NO: 378657 - protein, 10 aa, Influenza virus
QMTRGLFGAI

SEQ ID NO: 378658 - protein, 10 aa, Influenza virus
ARGLFGAIAG

SEQ ID NO: 378659 - protein, 10 aa, Influenza virus
MVLLQCRICI

SEQ ID NO: 378660 - protein, 10 aa, Influenza virus
KAGVKMNPNQ

SEQ ID NO: 378661 - protein, 10 aa, Influenza virus
AGVKMNPNQK

SEQ ID NO: 378662 - protein, 10 aa, Influenza virus
GVKMNPNQKI

SEQ ID NO: 378663 - protein, 10 aa, Influenza virus
IKMNPNQKII

SEQ ID NO: 378664 - protein, 10 aa, Influenza virus
KMNPNQKIMT

SEQ ID NO: 378665 - protein, 10 aa, Influenza virus
IRHLEECSCY

SEQ ID NO: 378666 - protein, 10 aa, Influenza virus
IKMNPNQKII

SEQ ID NO: 378667 - protein, 10 aa, Influenza virus
KMNPNQKIMT

SEQ ID NO: 378668 - protein, 10 aa, Influenza virus
SKDNGIRIGS

SEQ ID NO: 378669 - protein, 10 aa, Influenza virus
KDNSIRIGSR

SEQ ID NO: 378670 - protein, 10 aa, Influenza virus
DNSIRIGSRG

SEQ ID NO: 378671 - protein, 10 aa, Influenza virus
NSIRIGSRGD

SEQ ID NO: 378672 - protein, 10 aa, Influenza virus
IRIGSRGDVF

SEQ ID NO: 378673 - protein, 10 aa, Influenza virus
GDVFVMREPF

SEQ ID NO: 378674 - protein, 10 aa, Influenza virus
FIIREPFISC

SEQ ID NO: 378675 - protein, 10 aa, Influenza virus
SECRTFFLTQ

SEQ ID NO: 378676 - protein, 10 aa, Influenza virus
LNDKHSNGTA

SEQ ID NO: 378677 - protein, 10 aa, Influenza virus
DRSPHRALMS

SEQ ID NO: 378678 - protein, 10 aa, Influenza virus
SPHRALMSCP

SEQ ID NO: 378679 - protein, 10 aa, Influenza virus
IGEAPSPYNS

SEQ ID NO: 378680 - protein, 10 aa, Influenza virus
WSASACHDGL

SEQ ID NO: 378681 - protein, 10 aa, Influenza virus
GWITIGISGP

SEQ ID NO: 378682 - protein, 10 aa, Influenza virus
TIGISGPDSG

SEQ ID NO: 378683 - protein, 10 aa, Influenza virus
IGISGPDSGA

SEQ ID NO: 378684 - protein, 10 aa, Influenza virus
GISGPDSGAV

SEQ ID NO: 378685 - protein, 10 aa, Influenza virus
ISGPDSGAVA

SEQ ID NO: 378686 - protein, 10 aa, Influenza virus
SGPDSGAVAV

SEQ ID NO: 378687 - protein, 10 aa, Influenza virus
GPDSGAVAVL

SEQ ID NO: 378688 - protein, 10 aa, Influenza virus
PDSGAVAVLK

SEQ ID NO: 378689 - protein, 10 aa, Influenza virus
DSGAVAVLKY

SEQ ID NO: 378690 - protein, 10 aa, Influenza virus
GAVAVLKYKG

SEQ ID NO: 378691 - protein, 10 aa, Influenza virus
AVLKYKGIIT

SEQ ID NO: 378692 - protein, 10 aa, Influenza virus
NGFCFTVMTD

SEQ ID NO: 378693 - protein, 10 aa, Influenza virus
GSCFTLMTDG

SEQ ID NO: 378694 - protein, 10 aa, Influenza virus
SCFTLMTDGP

SEQ ID NO: 378695 - protein, 10 aa, Influenza virus
CFTVMTDGPN

SEQ ID NO: 378696 - protein, 10 aa, Influenza virus
APNSHYEECS

SEQ ID NO: 378697 - protein, 10 aa, Influenza virus
PNSHYEECSC

SEQ ID NO: 378698 - protein, 10 aa, Influenza virus
NSHYEECSCY

SEQ ID NO: 378699 - protein, 10 aa, Influenza virus
SHYEECSCYP

SEQ ID NO: 378700 - protein, 10 aa, Influenza virus
YEECSCYPES

SEQ ID NO: 378701 - protein, 10 aa, Influenza virus
NWHGANRPWV

SEQ ID NO: 378702 - protein, 10 aa, Influenza virus
WHGANRPWVS

SEQ ID NO: 378703 - protein, 10 aa, Influenza virus
HGANRPWVSF

SEQ ID NO: 378704 - protein, 10 aa, Influenza virus
YICSGVLGDN

SEQ ID NO: 378705 - protein, 10 aa, Influenza virus
ICSGVLGDNP

SEQ ID NO: 378706 - protein, 10 aa, Influenza virus
CSGVLGDNPR

SEQ ID NO: 378707 - protein, 10 aa, Influenza virus
KYGNGVWMGR

SEQ ID NO: 378708 - protein, 10 aa, Influenza virus
YGNGVWMGRT

SEQ ID NO: 378709 - protein, 10 aa, Influenza virus
GNGVWMGRTK

SEQ ID NO: 378710 - protein, 10 aa, Influenza virus
NGVWMGRTKS

SEQ ID NO: 378711 - protein, 10 aa, Influenza virus
TNWSGYSGSF

SEQ ID NO: 378712 - protein, 10 aa, Influenza virus
QHPELTGMDC

SEQ ID NO: 378713 - protein, 10 aa, Influenza virus
NCMRPCFWVE

SEQ ID NO: 378714 - protein, 10 aa, Influenza virus
MRPCFWVELV

SEQ ID NO: 378715 - protein, 10 aa, Influenza virus
CFWVELVRGR

SEQ ID NO: 378716 - protein, 10 aa, Influenza virus
FWVELVRGRP

SEQ ID NO: 378717 - protein, 10 aa, Influenza virus
TIWTSGSIIS

SEQ ID NO: 378718 - protein, 10 aa, Influenza virus
IWTSGSIISF

SEQ ID NO: 378719 - protein, 10 aa, Influenza virus
GSIISFCGVN

SEQ ID NO: 378720 - protein, 10 aa, Influenza virus
WSWPDDAELP

SEQ ID NO: 378721 - protein, 10 aa, Influenza virus
SWPDGAKLPF

SEQ ID NO: 378722 - protein, 10 aa, Influenza virus
GFAPFTKDNS

SEQ ID NO: 378723 - protein, 10 aa, Influenza virus
PLSKDNSIRL

SEQ ID NO: 378724 - protein, 10 aa, Influenza virus
SKDNSVRLSA

SEQ ID NO: 378725 - protein, 10 aa, Influenza virus
KDNSIRLAAG

SEQ ID NO: 378726 - protein, 10 aa, Influenza virus
DNSIRLAAGG

SEQ ID NO: 378727 - protein, 10 aa, Influenza virus
VWVTREPYVS

SEQ ID NO: 378728 - protein, 10 aa, Influenza virus
PYRTLLMSEL

SEQ ID NO: 378729 - protein, 10 aa, Influenza virus
YRTLLMSELG

SEQ ID NO: 378730 - protein, 10 aa, Influenza virus
NELGIPFHLG

SEQ ID NO: 378731 - protein, 10 aa, Influenza virus
LGIPFHLGTK

SEQ ID NO: 378732 - protein, 10 aa, Influenza virus
GIPFHLGTKQ

SEQ ID NO: 378733 - protein, 10 aa, Influenza virus
IPFHLGTKQV

SEQ ID NO: 378734 - protein, 10 aa, Influenza virus
PFYLGTKQVC

SEQ ID NO: 378735 - protein, 10 aa, Influenza virus
TRQVCMAWSS

SEQ ID NO: 378736 - protein, 10 aa, Influenza virus
RQVCMAWSSS

SEQ ID NO: 378737 - protein, 10 aa, Influenza virus
CIAWSSSSCY

SEQ ID NO: 378738 - protein, 10 aa, Influenza virus
IAWSSSSCYD

SEQ ID NO: 378739 - protein, 10 aa, Influenza virus
SSSSCHDGNA

SEQ ID NO: 378740 - protein, 10 aa, Influenza virus
SSSCHDGNAW

SEQ ID NO: 378741 - protein, 10 aa, Influenza virus
SSCHDGNAWL

SEQ ID NO: 378742 - protein, 10 aa, Influenza virus
SCHDGNAWLH

SEQ ID NO: 378743 - protein, 10 aa, Influenza virus
DILRTQESEC

SEQ ID NO: 378744 - protein, 10 aa, Influenza virus
CTVIMTDGSA

SEQ ID NO: 378745 - protein, 10 aa, Influenza virus
TVIMTDGSAS

SEQ ID NO: 378746 - protein, 10 aa, Influenza virus
HIEECSCYPQ

SEQ ID NO: 378747 - protein, 10 aa, Influenza virus
IRCVCRDNWK

SEQ ID NO: 378748 - protein, 10 aa, Influenza virus
KCVCRDNWKG

SEQ ID NO: 378749 - protein, 10 aa, Influenza virus
DNWRGSNRPI

SEQ ID NO: 378750 - protein, 10 aa, Influenza virus
SGLVGDTPRD

SEQ ID NO: 378751 - protein, 10 aa, Influenza virus
WTSNSIIAFC

SEQ ID NO: 378752 - protein, 10 aa, Influenza virus
TSNSIIAFCG

SEQ ID NO: 378753 - protein, 10 aa, Influenza virus
SNSIIAFCGT

SEQ ID NO: 378754 - protein, 10 aa, Influenza virus
NSIIAFCGTS

SEQ ID NO: 378755 - protein, 10 aa, Influenza virus
SIIAFCGTSG

SEQ ID NO: 378756 - protein, 10 aa, Influenza virus
IVAFCGTSGT

SEQ ID NO: 378757 - protein, 10 aa, Influenza virus
VAFCGTSGTY

SEQ ID NO: 378758 - protein, 10 aa, Influenza virus
GTSGTYGTGT

SEQ ID NO: 378759 - protein, 10 aa, Influenza virus
TSGTYGTGTW

SEQ ID NO: 378760 - protein, 10 aa, Influenza virus
SGTYGTGTWP

SEQ ID NO: 378761 - protein, 10 aa, Influenza virus
GTYGTGTWPD

SEQ ID NO: 378762 - protein, 10 aa, Influenza virus
TYGTGTWPDG

SEQ ID NO: 378763 - protein, 10 aa, Influenza virus
YGTGTWPDGA

SEQ ID NO: 378764 - protein, 10 aa, Influenza virus
ADINLMPIYS

SEQ ID NO: 378765 - protein, 10 aa, Influenza virus
DIKSHAYISF

SEQ ID NO: 378766 - protein, 10 aa, Influenza virus
GNLIFNAVIH

SEQ ID NO: 378767 - protein, 10 aa, Influenza virus
KDNAIRLGET

SEQ ID NO: 378768 - protein, 10 aa, Influenza virus
IITREPYVSC

SEQ ID NO: 378769 - protein, 10 aa, Influenza virus
TREPYVSCDS

SEQ ID NO: 378770 - protein, 10 aa, Influenza virus
HCWSFALAQG

SEQ ID NO: 378771 - protein, 10 aa, Influenza virus
SFALAQGVLL

SEQ ID NO: 378772 - protein, 10 aa, Influenza virus
FALAQGVLLG

SEQ ID NO: 378773 - protein, 10 aa, Influenza virus
ALSQGALLGT

SEQ ID NO: 378774 - protein, 10 aa, Influenza virus
LLGTRHSNGT

SEQ ID NO: 378775 - protein, 10 aa, Influenza virus
HSNGTIEDRT

SEQ ID NO: 378776 - protein, 10 aa, Influenza virus
KDRAPYRSLI

SEQ ID NO: 378777 - protein, 10 aa, Influenza virus
DRTPYRSLIK

SEQ ID NO: 378778 - protein, 10 aa, Influenza virus
RTPYRSLIKF

SEQ ID NO: 378779 - protein, 10 aa, Influenza virus
APYRSLIRFP

SEQ ID NO: 378780 - protein, 10 aa, Influenza virus
YRSLIQFPMG

SEQ ID NO: 378781 - protein, 10 aa, Influenza virus
CFDGREWMHV

SEQ ID NO: 378782 - protein, 10 aa, Influenza virus
FDGREWMHVC

SEQ ID NO: 378783 - protein, 10 aa, Influenza virus
KNILRTQESE

SEQ ID NO: 378784 - protein, 10 aa, Influenza virus
KVQHLEECSC

SEQ ID NO: 378785 - protein, 10 aa, Influenza virus
IRHLEECSCY

SEQ ID NO: 378786 - protein, 10 aa, Influenza virus
RHLEECSCYV

SEQ ID NO: 378787 - protein, 10 aa, Influenza virus
DIYCVCRDNW

SEQ ID NO: 378788 - protein, 10 aa, Influenza virus
IYCVCRDNWK

SEQ ID NO: 378789 - protein, 10 aa, Influenza virus
KGSNRPWIRI

SEQ ID NO: 378790 - protein, 10 aa, Influenza virus
GSNRPWVRIN

SEQ ID NO: 378791 - protein, 10 aa, Influenza virus
SNRPWVRINN

SEQ ID NO: 378792 - protein, 10 aa, Influenza virus
NRPWVRINNE

SEQ ID NO: 378793 - protein, 10 aa, Influenza virus
RPWVRINNET

SEQ ID NO: 378794 - protein, 10 aa, Influenza virus
PWVRINNETI

SEQ ID NO: 378795 - protein, 10 aa, Influenza virus
INNETIIETG

SEQ ID NO: 378796 - protein, 10 aa, Influenza virus
NNETIVETGY

SEQ ID NO: 378797 - protein, 10 aa, Influenza virus
NETIVETGYV

SEQ ID NO: 378798 - protein, 10 aa, Influenza virus
ETIVETGYVC

SEQ ID NO: 378799 - protein, 10 aa, Influenza virus
TIVETGYVCS

SEQ ID NO: 378800 - protein, 10 aa, Influenza virus
IVETGYVCSK

SEQ ID NO: 378801 - protein, 10 aa, Influenza virus
VETGYVCSKF

SEQ ID NO: 378802 - protein, 10 aa, Influenza virus
KFHSDTPRPS

SEQ ID NO: 378803 - protein, 10 aa, Influenza virus
FHSDTPRPSD

SEQ ID NO: 378804 - protein, 10 aa, Influenza virus
HSDTPRPSDP

SEQ ID NO: 378805 - protein, 10 aa, Influenza virus
SDTPRPSDPS

SEQ ID NO: 378806 - protein, 10 aa, Influenza virus
GSDVWLGRTV

SEQ ID NO: 378807 - protein, 10 aa, Influenza virus
SDVWLGRTVS

SEQ ID NO: 378808 - protein, 10 aa, Influenza virus
TQTLVANNDW

SEQ ID NO: 378809 - protein, 10 aa, Influenza virus
WSGYSGSFSV

SEQ ID NO: 378810 - protein, 10 aa, Influenza virus
ACFQPCFYVE

SEQ ID NO: 378811 - protein, 10 aa, Influenza virus
CFYVELTRGV

SEQ ID NO: 378812 - protein, 10 aa, Influenza virus
VSWTGNSIVT

SEQ ID NO: 378813 - protein, 10 aa, Influenza virus
SWTSNSIITF

SEQ ID NO: 378814 - protein, 10 aa, Influenza virus
SIITFCGLDN

SEQ ID NO: 378815 - protein, 10 aa, Influenza virus
IVTFCGLDBE

SEQ ID NO: 378816 - protein, 10 aa, Influenza virus
DNEPGSGSWP

SEQ ID NO: 378817 - protein, 10 aa, Influenza virus
PGSGNWPDGP

SEQ ID NO: 378818 - protein, 10 aa, Influenza virus
WPDGYNIGFM

SEQ ID NO: 378819 - protein, 10 aa, Influenza virus
PDGSKIGFMP

SEQ ID NO: 378820 - protein, 10 aa, Influenza virus
TTIGLLLQII

SEQ ID NO: 378821 - protein, 10 aa, Influenza virus
TIGPLLQITS

SEQ ID NO: 378822 - protein, 10 aa, Influenza virus
VGLLLQVTSL

SEQ ID NO: 378823 - protein, 10 aa, Influenza virus
IWFSHYNQIT

SEQ ID NO: 378824 - protein, 10 aa, Influenza virus
WFSHYNQVAQ

SEQ ID NO: 378825 - protein, 10 aa, Influenza virus
FSHYNQMKQA

SEQ ID NO: 378826 - protein, 10 aa, Influenza virus
FVNMTNVQNN

SEQ ID NO: 378827 - protein, 10 aa, Influenza virus
VNMTNVQNNY

SEQ ID NO: 378828 - protein, 10 aa, Influenza virus
NITNVQNNYT

SEQ ID NO: 378829 - protein, 10 aa, Influenza virus
ITNVQNNYTT

SEQ ID NO: 378830 - protein, 10 aa, Influenza virus
TNVQNDYTTV

SEQ ID NO: 378831 - protein, 10 aa, Influenza virus
ISCSVSECRT

SEQ ID NO: 378832 - protein, 10 aa, Influenza virus
SCSVSECRTF

SEQ ID NO: 378833 - protein, 10 aa, Influenza virus
CSVSECRTFF

SEQ ID NO: 378834 - protein, 10 aa, Influenza virus
SVSECRTFFL

SEQ ID NO: 378835 - protein, 10 aa, Influenza virus
IHECRTFFLT

SEQ ID NO: 378836 - protein, 10 aa, Influenza virus
HECRTFFLTQ

SEQ ID NO: 378837 - protein, 10 aa, Influenza virus
TLMSCPIGVV

SEQ ID NO: 378838 - protein, 10 aa, Influenza virus
LMSCHIGVAP

SEQ ID NO: 378839 - protein, 10 aa, Influenza virus
MSCPIGVVPS

SEQ ID NO: 378840 - protein, 10 aa, Influenza virus
SCPIGVVPSP

SEQ ID NO: 378841 - protein, 10 aa, Influenza virus
CHIGVAPSPS

SEQ ID NO: 378842 - protein, 10 aa, Influenza virus
HIGVAPSPSN

SEQ ID NO: 378843 - protein, 10 aa, Influenza virus
LTIGITGPDA

SEQ ID NO: 378844 - protein, 10 aa, Influenza virus
TIGITGPDAT

SEQ ID NO: 378845 - protein, 10 aa, Influenza virus
IGITGPDATA

SEQ ID NO: 378846 - protein, 10 aa, Influenza virus
GPDATAVAVI

SEQ ID NO: 378847 - protein, 10 aa, Influenza virus
PDATAVVVLK

SEQ ID NO: 378848 - protein, 10 aa, Influenza virus
DATAVAVIKY

SEQ ID NO: 378849 - protein, 10 aa, Influenza virus
ATAVAVIKYN

SEQ ID NO: 378850 - protein, 10 aa, Influenza virus
YTLITDGPSN

SEQ ID NO: 378851 - protein, 10 aa, Influenza virus
TLVTDGPSDA

SEQ ID NO: 378852 - protein, 10 aa, Influenza virus
LVTDGPSDAQ

SEQ ID NO: 378853 - protein, 10 aa, Influenza virus
VTDGPSDAQA

SEQ ID NO: 378854 - protein, 10 aa, Influenza virus
LLKIRKGKIV

SEQ ID NO: 378855 - protein, 10 aa, Influenza virus
ATGFHLEECS

SEQ ID NO: 378856 - protein, 10 aa, Influenza virus
AGFHFEECSC

SEQ ID NO: 378857 - protein, 10 aa, Influenza virus
ECSCYPSREN

SEQ ID NO: 378858 - protein, 10 aa, Influenza virus
NIECVCRDNW

SEQ ID NO: 378859 - protein, 10 aa, Influenza virus
PWIRFNSDLN

SEQ ID NO: 378860 - protein, 10 aa, Influenza virus
WIRFNSDLNY

SEQ ID NO: 378861 - protein, 10 aa, Influenza virus
IRFNSDLNYQ

SEQ ID NO: 378862 - protein, 10 aa, Influenza virus
SDPDYQIGYV

SEQ ID NO: 378863 - protein, 10 aa, Influenza virus
DLNYQIGYIC

SEQ ID NO: 378864 - protein, 10 aa, Influenza virus
YICSGIFGDN

SEQ ID NO: 378865 - protein, 10 aa, Influenza virus
VCSGIFGDSP

SEQ ID NO: 378866 - protein, 10 aa, Influenza virus
FGDNPRPMDG

SEQ ID NO: 378867 - protein, 10 aa, Influenza virus
PRPMDSTGSC

SEQ ID NO: 378868 - protein, 10 aa, Influenza virus
ANGWVSTDKS

SEQ ID NO: 378869 - protein, 10 aa, Influenza virus
FCGVNSDTTS

SEQ ID NO: 378870 - protein, 10 aa, Influenza virus
CGVNSDTTSW

SEQ ID NO: 378871 - protein, 10 aa, Influenza virus
SDTTGWPWPD

SEQ ID NO: 378872 - protein, 10 aa, Influenza virus
DTTGWPWPDG

SEQ ID NO: 378873 - protein, 10 aa, Influenza virus
CWSWPDGALL

SEQ ID NO: 378874 - protein, 10 aa, Influenza virus
NQKIMTIGSV

SEQ ID NO: 378875 - protein, 10 aa, Influenza virus
QKIITIGSMS

SEQ ID NO: 378876 - protein, 10 aa, Influenza virus
KIMTIGSVSL

SEQ ID NO: 378877 - protein, 10 aa, Influenza virus
IMTIGSVSLA

SEQ ID NO: 378878 - protein, 10 aa, Influenza virus
TTEVYSETVR

SEQ ID NO: 378879 - protein, 10 aa, Influenza virus
TEVYSETVRV

SEQ ID NO: 378880 - protein, 10 aa, Influenza virus
KFLNNTEPLC

SEQ ID NO: 378881 - protein, 10 aa, Influenza virus
FFNNTEPLCE

SEQ ID NO: 378882 - protein, 10 aa, Influenza virus
FNNTEPLCEV

SEQ ID NO: 378883 - protein, 10 aa, Influenza virus
EPLCEVSGFV

SEQ ID NO: 378884 - protein, 10 aa, Influenza virus
PLCEISGFAI

SEQ ID NO: 378885 - protein, 10 aa, Influenza virus
SGFVIVSKDN

SEQ ID NO: 378886 - protein, 10 aa, Influenza virus
GFVIVSKDNG

SEQ ID NO: 378887 - protein, 10 aa, Influenza virus
FVIVSKDNGI

SEQ ID NO: 378888 - protein, 10 aa, Influenza virus
VIVSKDNGIR

SEQ ID NO: 378889 - protein, 10 aa, Influenza virus
IFSKDNGIRI

SEQ ID NO: 378890 - protein, 10 aa, Influenza virus
ISKDNGIRIG

SEQ ID NO: 378891 - protein, 10 aa, Influenza virus
REPFVACGPA

SEQ ID NO: 378892 - protein, 10 aa, Influenza virus
EPFVACGPAE

SEQ ID NO: 378893 - protein, 10 aa, Influenza virus
PFVACGPAEC

SEQ ID NO: 378894 - protein, 10 aa, Influenza virus
FVACGPAECR

SEQ ID NO: 378895 - protein, 10 aa, Influenza virus
VACGPAECRT

SEQ ID NO: 378896 - protein, 10 aa, Influenza virus
ACGPAECRTF

SEQ ID NO: 378897 - protein, 10 aa, Influenza virus
CSPSECRTFF

SEQ ID NO: 378898 - protein, 10 aa, Influenza virus
SPSECRTFFL

SEQ ID NO: 378899 - protein, 10 aa, Influenza virus
TACHDGKGWL

SEQ ID NO: 378900 - protein, 10 aa, Influenza virus
GVSGTDDDAY

SEQ ID NO: 378901 - protein, 10 aa, Influenza virus
VSGTDDDAYA

SEQ ID NO: 378902 - protein, 10 aa, Influenza virus
HYGGVPTDVI

SEQ ID NO: 378903 - protein, 10 aa, Influenza virus
YGGVPTDVIR

SEQ ID NO: 378904 - protein, 10 aa, Influenza virus
GGVPTDVIRS

SEQ ID NO: 378905 - protein, 10 aa, Influenza virus
GVPTDVIRSW

SEQ ID NO: 378906 - protein, 10 aa, Influenza virus
PTDVVRSWRR

SEQ ID NO: 378907 - protein, 10 aa, Influenza virus
TDVVRSWRKK

SEQ ID NO: 378908 - protein, 10 aa, Influenza virus
DVVRSWRKKI

SEQ ID NO: 378909 - protein, 10 aa, Influenza virus
VVRSWRKKIL

SEQ ID NO: 378910 - protein, 10 aa, Influenza virus
VRSWRKKILR

SEQ ID NO: 378911 - protein, 10 aa, Influenza virus
RSWRRQILRT

SEQ ID NO: 378912 - protein, 10 aa, Influenza virus
SWRRQILRTQ

SEQ ID NO: 378913 - protein, 10 aa, Influenza virus
WRRQILRTQE

SEQ ID NO: 378914 - protein, 10 aa, Influenza virus
RRQILRTQES

SEQ ID NO: 378915 - protein, 10 aa, Influenza virus
TQESSCVCIK

SEQ ID NO: 378916 - protein, 10 aa, Influenza virus
QESSCVCIKG

SEQ ID NO: 378917 - protein, 10 aa, Influenza virus
WVMTDGPASN

SEQ ID NO: 378918 - protein, 10 aa, Influenza virus
VMTDGPASNQ

SEQ ID NO: 378919 - protein, 10 aa, Influenza virus
MTDGPASNQA

SEQ ID NO: 378920 - protein, 10 aa, Influenza virus
TDGPASNQAS

SEQ ID NO: 378921 - protein, 10 aa, Influenza virus
DGPASNQASY

SEQ ID NO: 378922 - protein, 10 aa, Influenza virus
GPASNQASYK

SEQ ID NO: 378923 - protein, 10 aa, Influenza virus
PASNQASYKI

SEQ ID NO: 378924 - protein, 10 aa, Influenza virus
ASNQASYKIF

SEQ ID NO: 378925 - protein, 10 aa, Influenza virus
NKQASYKIFK

SEQ ID NO: 378926 - protein, 10 aa, Influenza virus
NQASYRIFKS

SEQ ID NO: 378927 - protein, 10 aa, Influenza virus
QASYKIFKSR

SEQ ID NO: 378928 - protein, 10 aa, Influenza virus
EISFQSGHIE

SEQ ID NO: 378929 - protein, 10 aa, Influenza virus
VSFRGGHIEE

SEQ ID NO: 378930 - protein, 10 aa, Influenza virus
ECSCYPNLGQ

SEQ ID NO: 378931 - protein, 10 aa, Influenza virus
CSCYPNLGQV

SEQ ID NO: 378932 - protein, 10 aa, Influenza virus
SCYPNLGQVE

SEQ ID NO: 378933 - protein, 10 aa, Influenza virus
CYPNLGQVEC

SEQ ID NO: 378934 - protein, 10 aa, Influenza virus
YPNLGQVECV

SEQ ID NO: 378935 - protein, 10 aa, Influenza virus
PNLGQVECVC

SEQ ID NO: 378936 - protein, 10 aa, Influenza virus
NLGQVECVCR

SEQ ID NO: 378937 - protein, 10 aa, Influenza virus
LGQVECVCRD

SEQ ID NO: 378938 - protein, 10 aa, Influenza virus
YKVGYLCAGI

SEQ ID NO: 378939 - protein, 10 aa, Influenza virus
KVGYLCAGIP

SEQ ID NO: 378940 - protein, 10 aa, Influenza virus
PTDTPRVQDD

SEQ ID NO: 378941 - protein, 10 aa, Influenza virus
AIGGSGTDNY

SEQ ID NO: 378942 - protein, 10 aa, Influenza virus
IGGSGTDNYG

SEQ ID NO: 378943 - protein, 10 aa, Influenza virus
GNSVWAGRTM

SEQ ID NO: 378944 - protein, 10 aa, Influenza virus
SSRNGFEILL

SEQ ID NO: 378945 - protein, 10 aa, Influenza virus
SGFEVLFIED

SEQ ID NO: 378946 - protein, 10 aa, Influenza virus
GFEVLLIENG

SEQ ID NO: 378947 - protein, 10 aa, Influenza virus
FEVLFIEDGW

SEQ ID NO: 378948 - protein, 10 aa, Influenza virus
EILNNKNWSG

SEQ ID NO: 378949 - protein, 10 aa, Influenza virus
VLNNRNWSGY

SEQ ID NO: 378950 - protein, 10 aa, Influenza virus
LNNKHWSGYS

SEQ ID NO: 378951 - protein, 10 aa, Influenza virus
DNKNWSGYSG

SEQ ID NO: 378952 - protein, 10 aa, Influenza virus
NKHWSGYSGS

SEQ ID NO: 378953 - protein, 10 aa, Influenza virus
MNWSGYSGSF

SEQ ID NO: 378954 - protein, 10 aa, Influenza virus
GYSGAFTVPI

SEQ ID NO: 378955 - protein, 10 aa, Influenza virus
EMIRGKPKER

SEQ ID NO: 378956 - protein, 10 aa, Influenza virus
PEERPSIWTS

SEQ ID NO: 378957 - protein, 10 aa, Influenza virus
EERNSIWTSS

SEQ ID NO: 378958 - protein, 10 aa, Influenza virus
EKTSIWTSSS

SEQ ID NO: 378959 - protein, 10 aa, Influenza virus
KTSIWTSSSS

SEQ ID NO: 378960 - protein, 10 aa, Influenza virus
CGVSSEAPGW

SEQ ID NO: 378961 - protein, 10 aa, Influenza virus
GVSSEAPGWS

SEQ ID NO: 378962 - protein, 10 aa, Influenza virus
VSSEVPGCTM

SEQ ID NO: 378963 - protein, 10 aa, Influenza virus
SSEVPGWSWG

SEQ ID NO: 378964 - protein, 10 aa, Influenza virus
SEAPGWSWDD

SEQ ID NO: 378965 - protein, 10 aa, Influenza virus
PNQKIICIST

SEQ ID NO: 378966 - protein, 10 aa, Influenza virus
CISATGMALS

SEQ ID NO: 378967 - protein, 10 aa, Influenza virus
ISATGMILSV

SEQ ID NO: 378968 - protein, 10 aa, Influenza virus
SATGMILSVV

SEQ ID NO: 378969 - protein, 10 aa, Influenza virus
TGMALSVVSL

SEQ ID NO: 378970 - protein, 10 aa, Influenza virus
GMALSVVSLL

SEQ ID NO: 378971 - protein, 10 aa, Influenza virus
GLANLGLNVG

SEQ ID NO: 378972 - protein, 10 aa, Influenza virus
VNLGLNIGLH

SEQ ID NO: 378973 - protein, 10 aa, Influenza virus
KSLCEVNSWH

SEQ ID NO: 378974 - protein, 10 aa, Influenza virus
SLCEVNSWHI

SEQ ID NO: 378975 - protein, 10 aa, Influenza virus
LCEVNSWHIF

SEQ ID NO: 378976 - protein, 10 aa, Influenza virus
CEVNSWHIFS

SEQ ID NO: 378977 - protein, 10 aa, Influenza virus
EVNSWHIFSK

SEQ ID NO: 378978 - protein, 10 aa, Influenza virus
KDNAIRIGEG

SEQ ID NO: 378979 - protein, 10 aa, Influenza virus
DNAIRIGEGA

SEQ ID NO: 378980 - protein, 10 aa, Influenza virus
NAVRIGEDAH

SEQ ID NO: 378981 - protein, 10 aa, Influenza virus
DAHVLVTREP

SEQ ID NO: 378982 - protein, 10 aa, Influenza virus
LKGRHANGTI

SEQ ID NO: 378983 - protein, 10 aa, Influenza virus
RGRHANGTMH

SEQ ID NO: 378984 - protein, 10 aa, Influenza virus
GRHANGTIND

SEQ ID NO: 378985 - protein, 10 aa, Influenza virus
RHANGTINDR

SEQ ID NO: 378986 - protein, 10 aa, Influenza virus
ANGTINDRSP

SEQ ID NO: 378987 - protein, 10 aa, Influenza virus
NGTMHDRSPF

SEQ ID NO: 378988 - protein, 10 aa, Influenza virus
GTMHDRSPFR

SEQ ID NO: 378989 - protein, 10 aa, Influenza virus
TMHDRSPFRA

SEQ ID NO: 378990 - protein, 10 aa, Influenza virus
MHDRSPFRAL

SEQ ID NO: 378991 - protein, 10 aa, Influenza virus
HDRSPYRALI

SEQ ID NO: 378992 - protein, 10 aa, Influenza virus
DRSPYRALIS

SEQ ID NO: 378993 - protein, 10 aa, Influenza virus
RSPYRALISW

SEQ ID NO: 378994 - protein, 10 aa, Influenza virus
SPYRALISWE

SEQ ID NO: 378995 - protein, 10 aa, Influenza virus
PYRALISWEM

SEQ ID NO: 378996 - protein, 10 aa, Influenza virus
FRALISWGMG

SEQ ID NO: 378997 - protein, 10 aa, Influenza virus
RTLISWEMGQ

SEQ ID NO: 378998 - protein, 10 aa, Influenza virus
ALISWEMGLA

SEQ ID NO: 378999 - protein, 10 aa, Influenza virus
LISWEMGLAP

SEQ ID NO: 379000 - protein, 10 aa, Influenza virus
ISWEMGLAPS

SEQ ID NO: 379001 - protein, 10 aa, Influenza virus
EMGLAPSPYN

SEQ ID NO: 379002 - protein, 10 aa, Influenza virus
IECVGWSSTS

SEQ ID NO: 379003 - protein, 10 aa, Influenza virus
WSSTSCHDGR

SEQ ID NO: 379004 - protein, 10 aa, Influenza virus
SSTSCHDGRS

SEQ ID NO: 379005 - protein, 10 aa, Influenza virus
STSCHDGRSR

SEQ ID NO: 379006 - protein, 10 aa, Influenza virus
TSCHDGRSRM

SEQ ID NO: 379007 - protein, 10 aa, Influenza virus
SCHDGRSRMS

SEQ ID NO: 379008 - protein, 10 aa, Influenza virus
MSVCMSGPNN

SEQ ID NO: 379009 - protein, 10 aa, Influenza virus
SVCMSGPNNN

SEQ ID NO: 379010 - protein, 10 aa, Influenza virus
VCMSGPNNNA

SEQ ID NO: 379011 - protein, 10 aa, Influenza virus
VSGPNNNASA

SEQ ID NO: 379012 - protein, 10 aa, Influenza virus
TEIPTWAGNI

SEQ ID NO: 379013 - protein, 10 aa, Influenza virus
EIPSWAGNVL

SEQ ID NO: 379014 - protein, 10 aa, Influenza virus
IPSWAGNVLR

SEQ ID NO: 379015 - protein, 10 aa, Influenza virus
PSWAGNVLRT

SEQ ID NO: 379016 - protein, 10 aa, Influenza virus
ESECVCHNGV

SEQ ID NO: 379017 - protein, 10 aa, Influenza virus
SECVCHNGVC

SEQ ID NO: 379018 - protein, 10 aa, Influenza virus
ECVCHNGVCP

SEQ ID NO: 379019 - protein, 10 aa, Influenza virus
CVCHNGVCPV

SEQ ID NO: 379020 - protein, 10 aa, Influenza virus
VCHNGVCPVV

SEQ ID NO: 379021 - protein, 10 aa, Influenza virus
PVIMTDGPAN

SEQ ID NO: 379022 - protein, 10 aa, Influenza virus
GTAQHIEECS

SEQ ID NO: 379023 - protein, 10 aa, Influenza virus
KAQHIEECSC

SEQ ID NO: 379024 - protein, 10 aa, Influenza virus
IKCICRDNWR

SEQ ID NO: 379025 - protein, 10 aa, Influenza virus
WRGANRPVIT

SEQ ID NO: 379026 - protein, 10 aa, Influenza virus
RGANRPVITI

SEQ ID NO: 379027 - protein, 10 aa, Influenza virus
GANRPIITIN

SEQ ID NO: 379028 - protein, 10 aa, Influenza virus
MTHSSKYLCS

SEQ ID NO: 379029 - protein, 10 aa, Influenza virus
YLCSRVLTDT

SEQ ID NO: 379030 - protein, 10 aa, Influenza virus
LCSRVLTDTS

SEQ ID NO: 379031 - protein, 10 aa, Influenza virus
CSRVLTDTSR

SEQ ID NO: 379032 - protein, 10 aa, Influenza virus
SRVLTDTSRP

SEQ ID NO: 379033 - protein, 10 aa, Influenza virus
GGNPDPGVKG

SEQ ID NO: 379034 - protein, 10 aa, Influenza virus
GNPDPGVKGF

SEQ ID NO: 379035 - protein, 10 aa, Influenza virus
NPDPGVKGFA

SEQ ID NO: 379036 - protein, 10 aa, Influenza virus
GVKGFAFLDR

SEQ ID NO: 379037 - protein, 10 aa, Influenza virus
WLGRTISKDT

SEQ ID NO: 379038 - protein, 10 aa, Influenza virus
LGRTISKDTR

SEQ ID NO: 379039 - protein, 10 aa, Influenza virus
GRTISKDTRS

SEQ ID NO: 379040 - protein, 10 aa, Influenza virus
RTISKDTRSG

SEQ ID NO: 379041 - protein, 10 aa, Influenza virus
TISKDTRSGY

SEQ ID NO: 379042 - protein, 10 aa, Influenza virus
ISKDTRSGYE

SEQ ID NO: 379043 - protein, 10 aa, Influenza virus
DLRSGYEMLK

SEQ ID NO: 379044 - protein, 10 aa, Influenza virus
LRSGYEMLKV

SEQ ID NO: 379045 - protein, 10 aa, Influenza virus
SGYEVLKVPD

SEQ ID NO: 379046 - protein, 10 aa, Influenza virus
GYEVLKVPDA

SEQ ID NO: 379047 - protein, 10 aa, Influenza virus
YEVLKVPDAE

SEQ ID NO: 379048 - protein, 10 aa, Influenza virus
IVDNQNWSGY

SEQ ID NO: 379049 - protein, 10 aa, Influenza virus
VDNQNWSGYS

SEQ ID NO: 379050 - protein, 10 aa, Influenza virus
NQNWSGYSGV

SEQ ID NO: 379051 - protein, 10 aa, Influenza virus
QKWSGYSGAF

SEQ ID NO: 379052 - protein, 10 aa, Influenza virus
NWSGYSGAFM

SEQ ID NO: 379053 - protein, 10 aa, Influenza virus
WSGYSGAFVD

SEQ ID NO: 379054 - protein, 10 aa, Influenza virus
SGYSGAFVDY

SEQ ID NO: 379055 - protein, 10 aa, Influenza virus
GYSGAFVDYW

SEQ ID NO: 379056 - protein, 10 aa, Influenza virus
YVELIRGRPE

SEQ ID NO: 379057 - protein, 10 aa, Influenza virus
AELIRGRPKE

SEQ ID NO: 379058 - protein, 10 aa, Influenza virus
ELIRGRPRES

SEQ ID NO: 379059 - protein, 10 aa, Influenza virus
VWWTSNSIVA

SEQ ID NO: 379060 - protein, 10 aa, Influenza virus
WWTSNSIVAL

SEQ ID NO: 379061 - protein, 10 aa, Influenza virus
IVALCGSKKR

SEQ ID NO: 379062 - protein, 10 aa, Influenza virus
ALCGSKKRLG

SEQ ID NO: 379063 - protein, 10 aa, Influenza virus
LCGSKKRLGS

SEQ ID NO: 379064 - protein, 10 aa, Influenza virus
CGSKKRLGSW

SEQ ID NO: 379065 - protein, 10 aa, Influenza virus
GSKKRLGSWS

SEQ ID NO: 379066 - protein, 10 aa, Influenza virus
SKKRLGSWSW

SEQ ID NO: 379067 - protein, 10 aa, Influenza virus
KKRLGSWSWH

SEQ ID NO: 379068 - protein, 10 aa, Influenza virus
MNPSQKLFAL

SEQ ID NO: 379069 - protein, 10 aa, Influenza virus
NPSQKLFALS

SEQ ID NO: 379070 - protein, 10 aa, Influenza virus
PSQKLFALSG

SEQ ID NO: 379071 - protein, 10 aa, Influenza virus
SQKLFALSGV

SEQ ID NO: 379072 - protein, 10 aa, Influenza virus
QKLFALSEVA

SEQ ID NO: 379073 - protein, 10 aa, Influenza virus
KLFALSGVAV

SEQ ID NO: 379074 - protein, 10 aa, Influenza virus
NLLIGVSNVG

SEQ ID NO: 379075 - protein, 10 aa, Influenza virus
LLIGVSNVGL

SEQ ID NO: 379076 - protein, 10 aa, Influenza virus
LIGVSNVGLN

SEQ ID NO: 379077 - protein, 10 aa, Influenza virus
SNVGLNMSLH

SEQ ID NO: 379078 - protein, 10 aa, Influenza virus
NVGLNMSLHL

SEQ ID NO: 379079 - protein, 10 aa, Influenza virus
KNTYVNNTTI

SEQ ID NO: 379080 - protein, 10 aa, Influenza virus
NTYINNATII

SEQ ID NO: 379081 - protein, 10 aa, Influenza virus
YLLLNKSLCS

SEQ ID NO: 379082 - protein, 10 aa, Influenza virus
LLLNKSLCSV

SEQ ID NO: 379083 - protein, 10 aa, Influenza virus
GWVVIEKDNA

SEQ ID NO: 379084 - protein, 10 aa, Influenza virus
WVAVAKDNAI

SEQ ID NO: 379085 - protein, 10 aa, Influenza virus
VAVAKDNAIR

SEQ ID NO: 379086 - protein, 10 aa, Influenza virus
AVAKDNAIRF

SEQ ID NO: 379087 - protein, 10 aa, Influenza virus
IEKDNAVRFG

SEQ ID NO: 379088 - protein, 10 aa, Influenza virus
AIRFGEGEQI

SEQ ID NO: 379089 - protein, 10 aa, Influenza virus
IRFGEGEQII

SEQ ID NO: 379090 - protein, 10 aa, Influenza virus
REPYVSCDPI

SEQ ID NO: 379091 - protein, 10 aa, Influenza virus
ECKMYALHQG

SEQ ID NO: 379092 - protein, 10 aa, Influenza virus
IRNRHSNGTI

SEQ ID NO: 379093 - protein, 10 aa, Influenza virus
RNRHSNGTIH

SEQ ID NO: 379094 - protein, 10 aa, Influenza virus
NRHSNGTIHD

SEQ ID NO: 379095 - protein, 10 aa, Influenza virus
RHSNGTIHDR

SEQ ID NO: 379096 - protein, 10 aa, Influenza virus
HSNGTINDRT

SEQ ID NO: 379097 - protein, 10 aa, Influenza virus
TIHDGTAFRG

SEQ ID NO: 379098 - protein, 10 aa, Influenza virus
IHDGTAFRGL

SEQ ID NO: 379099 - protein, 10 aa, Influenza virus
DRTTFRGLLS

SEQ ID NO: 379100 - protein, 10 aa, Influenza virus
RTTFRGLLST

SEQ ID NO: 379101 - protein, 10 aa, Influenza virus
AFRGLISTQL

SEQ ID NO: 379102 - protein, 10 aa, Influenza virus
FRGLISTQLG

SEQ ID NO: 379103 - protein, 10 aa, Influenza virus
SNSEFICVGW

SEQ ID NO: 379104 - protein, 10 aa, Influenza virus
NSEFICVGWS

SEQ ID NO: 379105 - protein, 10 aa, Influenza virus
SEFICVGWSS

SEQ ID NO: 379106 - protein, 10 aa, Influenza virus
EFICVGWSST

SEQ ID NO: 379107 - protein, 10 aa, Influenza virus
FICVGWSSTT

SEQ ID NO: 379108 - protein, 10 aa, Influenza virus
ICVGWSSTTC

SEQ ID NO: 379109 - protein, 10 aa, Influenza virus
WSSTTCHDGV

SEQ ID NO: 379110 - protein, 10 aa, Influenza virus
CHDGVSRMTI

SEQ ID NO: 379111 - protein, 10 aa, Influenza virus
HDGVSRMTIC

SEQ ID NO: 379112 - protein, 10 aa, Influenza virus
QGNNENATAT

SEQ ID NO: 379113 - protein, 10 aa, Influenza virus
GNNENATATV

SEQ ID NO: 379114 - protein, 10 aa, Influenza virus
NNENATATVY

SEQ ID NO: 379115 - protein, 10 aa, Influenza virus
ENATATVYYN

SEQ ID NO: 379116 - protein, 10 aa, Influenza virus
NATATVYYNG

SEQ ID NO: 379117 - protein, 10 aa, Influenza virus
ATATVYYNGR

SEQ ID NO: 379118 - protein, 10 aa, Influenza virus
TATVYYNGRL

SEQ ID NO: 379119 - protein, 10 aa, Influenza virus
ATVYYNGRLT

SEQ ID NO: 379120 - protein, 10 aa, Influenza virus
TVYYNGRLTT

SEQ ID NO: 379121 - protein, 10 aa, Influenza virus
VYYNGRLTTT

SEQ ID NO: 379122 - protein, 10 aa, Influenza virus
YYNGRLTTTI

SEQ ID NO: 379123 - protein, 10 aa, Influenza virus
RRLTTTIKPW

SEQ ID NO: 379124 - protein, 10 aa, Influenza virus
LTTTIKPWAR

SEQ ID NO: 379125 - protein, 10 aa, Influenza virus
TTTIKTWAGK

SEQ ID NO: 379126 - protein, 10 aa, Influenza virus
TTIKTWAGKI

SEQ ID NO: 379127 - protein, 10 aa, Influenza virus
TIKTWAGKIL

SEQ ID NO: 379128 - protein, 10 aa, Influenza virus
IKTWAGKILR

SEQ ID NO: 379129 - protein, 10 aa, Influenza virus
KTWAGKILRT

SEQ ID NO: 379130 - protein, 10 aa, Influenza virus
TWAGKILRTQ

SEQ ID NO: 379131 - protein, 10 aa, Influenza virus
WAGKILRTQE

SEQ ID NO: 379132 - protein, 10 aa, Influenza virus
AGKILRTQES

SEQ ID NO: 379133 - protein, 10 aa, Influenza virus
GKILRTQESE

SEQ ID NO: 379134 - protein, 10 aa, Influenza virus
ECVCHDGTCV

SEQ ID NO: 379135 - protein, 10 aa, Influenza virus
STCVVVMTDG

SEQ ID NO: 379136 - protein, 10 aa, Influenza virus
MTDGSASGQA

SEQ ID NO: 379137 - protein, 10 aa, Influenza virus
LQGSARHIEE

SEQ ID NO: 379138 - protein, 10 aa, Influenza virus
QGSARHIEEC

SEQ ID NO: 379139 - protein, 10 aa, Influenza virus
GSAMHIEECS

SEQ ID NO: 379140 - protein, 10 aa, Influenza virus
SARHIEEWSC

SEQ ID NO: 379141 - protein, 10 aa, Influenza virus
ARHVEECSCY

SEQ ID NO: 379142 - protein, 10 aa, Influenza virus
RHIEECPCYG

SEQ ID NO: 379143 - protein, 10 aa, Influenza virus
IEEWSCYGHS

SEQ ID NO: 379144 - protein, 10 aa, Influenza virus
KITCVCRDNW

SEQ ID NO: 379145 - protein, 10 aa, Influenza virus
VSCVCRDNWQ

SEQ ID NO: 379146 - protein, 10 aa, Influenza virus
GANRPVIEIN

SEQ ID NO: 379147 - protein, 10 aa, Influenza virus
ANRPVIEINM

SEQ ID NO: 379148 - protein, 10 aa, Influenza virus
GVLTDTSRPG

SEQ ID NO: 379149 - protein, 10 aa, Influenza virus
VLTDTSRPGD

SEQ ID NO: 379150 - protein, 10 aa, Influenza virus
LTDTSRPGDR

SEQ ID NO: 379151 - protein, 10 aa, Influenza virus
CSNPITGSPS

SEQ ID NO: 379152 - protein, 10 aa, Influenza virus
NPITGSPGSP

SEQ ID NO: 379153 - protein, 10 aa, Influenza virus
PITGSPCAPG

SEQ ID NO: 379154 - protein, 10 aa, Influenza virus
NNTWLGRTIS

SEQ ID NO: 379155 - protein, 10 aa, Influenza virus
TWLGRTISPH

SEQ ID NO: 379156 - protein, 10 aa, Influenza virus
WLGRTFSPRS

SEQ ID NO: 379157 - protein, 10 aa, Influenza virus
LGGTISPRSR

SEQ ID NO: 379158 - protein, 10 aa, Influenza virus
TFSPRSRSGF

SEQ ID NO: 379159 - protein, 10 aa, Influenza virus
ISPHSRSGFE

SEQ ID NO: 379160 - protein, 10 aa, Influenza virus
SPRSRSGFEV

SEQ ID NO: 379161 - protein, 10 aa, Influenza virus
PRSRSGFEVL

SEQ ID NO: 379162 - protein, 10 aa, Influenza virus
RSRNGFEMLK

SEQ ID NO: 379163 - protein, 10 aa, Influenza virus
SRNGFEMLKI

SEQ ID NO: 379164 - protein, 10 aa, Influenza virus
RNGFEMLKIP

SEQ ID NO: 379165 - protein, 10 aa, Influenza virus
NGFEMLKIPN

SEQ ID NO: 379166 - protein, 10 aa, Influenza virus
FEMLKVPNAE

SEQ ID NO: 379167 - protein, 10 aa, Influenza virus
LKVPNAEKDP

SEQ ID NO: 379168 - protein, 10 aa, Influenza virus
SACYNPCFYV

SEQ ID NO: 379169 - protein, 10 aa, Influenza virus
PEEVKYVWWT

SEQ ID NO: 379170 - protein, 10 aa, Influenza virus
EEVKYVWWTS

SEQ ID NO: 379171 - protein, 10 aa, Influenza virus
EVKYVWWTSN

SEQ ID NO: 379172 - protein, 10 aa, Influenza virus
VKYVWWTSNS

SEQ ID NO: 379173 - protein, 10 aa, Influenza virus
YVWWASNSLI

SEQ ID NO: 379174 - protein, 10 aa, Influenza virus
VWWASNSLIA

SEQ ID NO: 379175 - protein, 10 aa, Influenza virus
WWASNSLIAL

SEQ ID NO: 379176 - protein, 10 aa, Influenza virus
SLIALCGSPI

SEQ ID NO: 379177 - protein, 10 aa, Influenza virus
PIGSGFFPDG

SEQ ID NO: 379178 - protein, 10 aa, Influenza virus
GSGSFPDGAR

SEQ ID NO: 379179 - protein, 10 aa, Influenza virus
SGFFPDGPQI

SEQ ID NO: 379180 - protein, 10 aa, Influenza virus
GSFPNGAQIQ

SEQ ID NO: 379181 - protein, 10 aa, Influenza virus
SFPDGARIQY

SEQ ID NO: 379182 - protein, 10 aa, Influenza virus
FPNGAQIQYF

SEQ ID NO: 379183 - protein, 10 aa, Influenza virus
PDGARIQYFS

SEQ ID NO: 379184 - protein, 10 aa, Influenza virus
EGFAPFSKDN

SEQ ID NO: 379185 - protein, 10 aa, Influenza virus
VFVIREPFIS

SEQ ID NO: 379186 - protein, 10 aa, Influenza virus
DCRTFFLTQG

SEQ ID NO: 379187 - protein, 10 aa, Influenza virus
TFFLTQGSLP

SEQ ID NO: 379188 - protein, 10 aa, Influenza virus
LTQGSLPNDK

SEQ ID NO: 379189 - protein, 10 aa, Influenza virus
QGSLLNDKHF

SEQ ID NO: 379190 - protein, 10 aa, Influenza virus
GSLLNDKHSS

SEQ ID NO: 379191 - protein, 10 aa, Influenza virus
SLLNDKHSSG

SEQ ID NO: 379192 - protein, 10 aa, Influenza virus
LLNDKHSSGT

SEQ ID NO: 379193 - protein, 10 aa, Influenza virus
NDKHSNGTMK

SEQ ID NO: 379194 - protein, 10 aa, Influenza virus
DKHSNGTMKD

SEQ ID NO: 379195 - protein, 10 aa, Influenza virus
KHSNGTMKDR

SEQ ID NO: 379196 - protein, 10 aa, Influenza virus
HSSGTVKDRS

SEQ ID NO: 379197 - protein, 10 aa, Influenza virus
SSGTVKDRSP

SEQ ID NO: 379198 - protein, 10 aa, Influenza virus
NGTMKDRSPY

SEQ ID NO: 379199 - protein, 10 aa, Influenza virus
GTMKDRSPYR

SEQ ID NO: 379200 - protein, 10 aa, Influenza virus
TMKDRSPYRT

SEQ ID NO: 379201 - protein, 10 aa, Influenza virus
MKDRSPYRTL

SEQ ID NO: 379202 - protein, 10 aa, Influenza virus
SPYRTLMSVG

SEQ ID NO: 379203 - protein, 10 aa, Influenza virus
RTLMSVKVGQ

SEQ ID NO: 379204 - protein, 10 aa, Influenza virus
IGQSANVYQA

SEQ ID NO: 379205 - protein, 10 aa, Influenza virus
GLSPNVYQAR

SEQ ID NO: 379206 - protein, 10 aa, Influenza virus
LSPNVYQARF

SEQ ID NO: 379207 - protein, 10 aa, Influenza virus
PNVYQSRFEA

SEQ ID NO: 379208 - protein, 10 aa, Influenza virus
NVYQSRFEAV

SEQ ID NO: 379209 - protein, 10 aa, Influenza virus
VYQSRFEAVA

SEQ ID NO: 379210 - protein, 10 aa, Influenza virus
YQSRFEAVAW

SEQ ID NO: 379211 - protein, 10 aa, Influenza virus
QSRFEAVAWS

SEQ ID NO: 379212 - protein, 10 aa, Influenza virus
SRFEAVAWSA

SEQ ID NO: 379213 - protein, 10 aa, Influenza virus
KFEAVAWSAT

SEQ ID NO: 379214 - protein, 10 aa, Influenza virus
TACHDGNKWM

SEQ ID NO: 379215 - protein, 10 aa, Influenza virus
ACHDGNKWMT

SEQ ID NO: 379216 - protein, 10 aa, Influenza virus
GDILRTHESS

SEQ ID NO: 379217 - protein, 10 aa, Influenza virus
TQESSCTCIL

SEQ ID NO: 379218 - protein, 10 aa, Influenza virus
QESSCTCILG

SEQ ID NO: 379219 - protein, 10 aa, Influenza virus
GNCYWVMTDG

SEQ ID NO: 379220 - protein, 10 aa, Influenza virus
NCYWVMTDGP

SEQ ID NO: 379221 - protein, 10 aa, Influenza virus
WVMTDGPANN

SEQ ID NO: 379222 - protein, 10 aa, Influenza virus
VMTDGPANNQ

SEQ ID NO: 379223 - protein, 10 aa, Influenza virus
MTDGPANNQA

SEQ ID NO: 379224 - protein, 10 aa, Influenza virus
FNEGHIEECS

SEQ ID NO: 379225 - protein, 10 aa, Influenza virus
NEGHIEECSC

SEQ ID NO: 379226 - protein, 10 aa, Influenza virus
YPNNGKVECI

SEQ ID NO: 379227 - protein, 10 aa, Influenza virus
PNNGKVECIC

SEQ ID NO: 379228 - protein, 10 aa, Influenza virus
NNGKVECICR

SEQ ID NO: 379229 - protein, 10 aa, Influenza virus
NGKVECICRD

SEQ ID NO: 379230 - protein, 10 aa, Influenza virus
WTGTNRPVVV

SEQ ID NO: 379231 - protein, 10 aa, Influenza virus
TGTNRPVLVV

SEQ ID NO: 379232 - protein, 10 aa, Influenza virus
GTNRPVLVVS

SEQ ID NO: 379233 - protein, 10 aa, Influenza virus
LSYQVGYLCA

SEQ ID NO: 379234 - protein, 10 aa, Influenza virus
SYQVGYLCAG

SEQ ID NO: 379235 - protein, 10 aa, Influenza virus
PSDTPRGEDN

SEQ ID NO: 379236 - protein, 10 aa, Influenza virus
SDTPRGEDNQ

SEQ ID NO: 379237 - protein, 10 aa, Influenza virus
DTPRGEDGQF

SEQ ID NO: 379238 - protein, 10 aa, Influenza virus
GFGFRQGSDV

SEQ ID NO: 379239 - protein, 10 aa, Influenza virus
FGFRQGSDVW

SEQ ID NO: 379240 - protein, 10 aa, Influenza virus
DNPNWSGYSG

SEQ ID NO: 379241 - protein, 10 aa, Influenza virus
NPNWSGYSGS

SEQ ID NO: 379242 - protein, 10 aa, Influenza virus
SGSFTLPVEM

SEQ ID NO: 379243 - protein, 10 aa, Influenza virus
SCLVPCFWVE

SEQ ID NO: 379244 - protein, 10 aa, Influenza virus
VETIRGKPEE

SEQ ID NO: 379245 - protein, 10 aa, Influenza virus
AIWTSSSSIV

SEQ ID NO: 379246 - protein, 10 aa, Influenza virus
SSIVMCGVNY

SEQ ID NO: 379247 - protein, 10 aa, Influenza virus
ASWSWHDGAV

SEQ ID NO: 379248 - protein, 10 aa, Influenza virus
SWSWHDGAVL

SEQ ID NO: 379249 - protein, 10 aa, Influenza virus
SWQDGAILPF

SEQ ID NO: 379250 - protein, 10 aa, Influenza virus
MNPNQRILCT

SEQ ID NO: 379251 - protein, 10 aa, Influenza virus
NPNQKIQCTS

SEQ ID NO: 379252 - protein, 10 aa, Influenza virus
PNQRILCTSA

SEQ ID NO: 379253 - protein, 10 aa, Influenza virus
NQKILFASAT

SEQ ID NO: 379254 - protein, 10 aa, Influenza virus
QKILFASATA

SEQ ID NO: 379255 - protein, 10 aa, Influenza virus
TNLGLNIGLH

SEQ ID NO: 379256 - protein, 10 aa, Influenza virus
SRTIINNYYN

SEQ ID NO: 379257 - protein, 10 aa, Influenza virus
QTIINNYHNE

SEQ ID NO: 379258 - protein, 10 aa, Influenza virus
TIINNYHNET

SEQ ID NO: 379259 - protein, 10 aa, Influenza virus
IINNYHNETN

SEQ ID NO: 379260 - protein, 10 aa, Influenza virus
FNNLTKRLCT

SEQ ID NO: 379261 - protein, 10 aa, Influenza virus
NNLTKRLCTI

SEQ ID NO: 379262 - protein, 10 aa, Influenza virus
NLTKRLCTIN

SEQ ID NO: 379263 - protein, 10 aa, Influenza virus
LTKRLCTINS

SEQ ID NO: 379264 - protein, 10 aa, Influenza virus
TKRLCTINSW

SEQ ID NO: 379265 - protein, 10 aa, Influenza virus
KRLCTINSWH

SEQ ID NO: 379266 - protein, 10 aa, Influenza virus
WHIYGKDNAI

SEQ ID NO: 379267 - protein, 10 aa, Influenza virus
HIYGKDNAIR

SEQ ID NO: 379268 - protein, 10 aa, Influenza virus
IYGKDNAIRI

SEQ ID NO: 379269 - protein, 10 aa, Influenza virus
YGKDNAIRIG

SEQ ID NO: 379270 - protein, 10 aa, Influenza virus
KDNAIRIGED

SEQ ID NO: 379271 - protein, 10 aa, Influenza virus
DNAIRIGEDS

SEQ ID NO: 379272 - protein, 10 aa, Influenza virus
RIGENSGVLV

SEQ ID NO: 379273 - protein, 10 aa, Influenza virus
IGEKSDVLVT

SEQ ID NO: 379274 - protein, 10 aa, Influenza virus
GEKSDVLVTR

SEQ ID NO: 379275 - protein, 10 aa, Influenza virus
EKSDVLVTRE

SEQ ID NO: 379276 - protein, 10 aa, Influenza virus
NSGVLVTREP

SEQ ID NO: 379277 - protein, 10 aa, Influenza virus
EPYVSCDPNE

SEQ ID NO: 379278 - protein, 10 aa, Influenza virus
PYVSCDPNEC

SEQ ID NO: 379279 - protein, 10 aa, Influenza virus
YVSCDPNECR

SEQ ID NO: 379280 - protein, 10 aa, Influenza virus
VSCDPNECRF

SEQ ID NO: 379281 - protein, 10 aa, Influenza virus
SCDPNECRFY

SEQ ID NO: 379282 - protein, 10 aa, Influenza virus
CDPNECRFYA

SEQ ID NO: 379283 - protein, 10 aa, Influenza virus
DPNECRFYAL

SEQ ID NO: 379284 - protein, 10 aa, Influenza virus
QYRALISWPQ

SEQ ID NO: 379285 - protein, 10 aa, Influenza virus
YRALISWPQS

SEQ ID NO: 379286 - protein, 10 aa, Influenza virus
RALISWPQSS

SEQ ID NO: 379287 - protein, 10 aa, Influenza virus
ALISWPQSSP

SEQ ID NO: 379288 - protein, 10 aa, Influenza virus
QSSPPTVYNS

SEQ ID NO: 379289 - protein, 10 aa, Influenza virus
SSPPTVYNSK

SEQ ID NO: 379290 - protein, 10 aa, Influenza virus
SSTSCHDGKF

SEQ ID NO: 379291 - protein, 10 aa, Influenza virus
STSCHDGKFR

SEQ ID NO: 379292 - protein, 10 aa, Influenza virus
TSCHDGKFRM

SEQ ID NO: 379293 - protein, 10 aa, Influenza virus
SCHDGKFRMS

SEQ ID NO: 379294 - protein, 10 aa, Influenza virus
GPNNNASPVI

SEQ ID NO: 379295 - protein, 10 aa, Influenza virus
PNNNASTVIW

SEQ ID NO: 379296 - protein, 10 aa, Influenza virus
NNNASTVIWY

SEQ ID NO: 379297 - protein, 10 aa, Influenza virus
NNASAIVWYN

SEQ ID NO: 379298 - protein, 10 aa, Influenza virus
KRPVTEINTW

SEQ ID NO: 379299 - protein, 10 aa, Influenza virus
RPTTEINTWA

SEQ ID NO: 379300 - protein, 10 aa, Influenza virus
PTTEINTWAR

SEQ ID NO: 379301 - protein, 10 aa, Influenza virus
TTEINTWARN

SEQ ID NO: 379302 - protein, 10 aa, Influenza virus
ESECVCQNGV

SEQ ID NO: 379303 - protein, 10 aa, Influenza virus
SECVCHDGVC

SEQ ID NO: 379304 - protein, 10 aa, Influenza virus
ECVCQNGVCP

SEQ ID NO: 379305 - protein, 10 aa, Influenza virus
CVCHDGVCPV

SEQ ID NO: 379306 - protein, 10 aa, Influenza virus
VCQNGVCPVV

SEQ ID NO: 379307 - protein, 10 aa, Influenza virus
CHSGVCPVVF

SEQ ID NO: 379308 - protein, 10 aa, Influenza virus
HNGICPVAFT

SEQ ID NO: 379309 - protein, 10 aa, Influenza virus
NGICPVAFTD

SEQ ID NO: 379310 - protein, 10 aa, Influenza virus
SATGPADTRV

SEQ ID NO: 379311 - protein, 10 aa, Influenza virus
ATGPADTRVY

SEQ ID NO: 379312 - protein, 10 aa, Influenza virus
TGPADTRVYY

SEQ ID NO: 379313 - protein, 10 aa, Influenza virus
GPADTRVYYF

SEQ ID NO: 379314 - protein, 10 aa, Influenza virus
TMTHTSQYIC

SEQ ID NO: 379315 - protein, 10 aa, Influenza virus
TDNPRPNDPV

SEQ ID NO: 379316 - protein, 10 aa, Influenza virus
NDPYPGSNNN

SEQ ID NO: 379317 - protein, 10 aa, Influenza virus
DPYPGNNNGV

SEQ ID NO: 379318 - protein, 10 aa, Influenza virus
PYPGNSNNGV

SEQ ID NO: 379319 - protein, 10 aa, Influenza virus
YPGNSNNGVK

SEQ ID NO: 379320 - protein, 10 aa, Influenza virus
PGSNNNGVKG

SEQ ID NO: 379321 - protein, 10 aa, Influenza virus
GSNNNGVKGF

SEQ ID NO: 379322 - protein, 10 aa, Influenza virus
NSNNGVKGFS

SEQ ID NO: 379323 - protein, 10 aa, Influenza virus
NTWVGRTISI

SEQ ID NO: 379324 - protein, 10 aa, Influenza virus
TWVGRTISIA

SEQ ID NO: 379325 - protein, 10 aa, Influenza virus
WLGRTTSTAS

SEQ ID NO: 379326 - protein, 10 aa, Influenza virus
LGRTLNTASR

SEQ ID NO: 379327 - protein, 10 aa, Influenza virus
GRTTSTASRS

SEQ ID NO: 379328 - protein, 10 aa, Influenza virus
RTINTASRSG

SEQ ID NO: 379329 - protein, 10 aa, Influenza virus
TTSTASRSGY

SEQ ID NO: 379330 - protein, 10 aa, Influenza virus
TSTASRSGYE

SEQ ID NO: 379331 - protein, 10 aa, Influenza virus
SIASRSGYEI

SEQ ID NO: 379332 - protein, 10 aa, Influenza virus
TASRAGYEML

SEQ ID NO: 379333 - protein, 10 aa, Influenza virus
LKVPNALIDD

SEQ ID NO: 379334 - protein, 10 aa, Influenza virus
KVPNALIDDR

SEQ ID NO: 379335 - protein, 10 aa, Influenza virus
VPNALTDERS

SEQ ID NO: 379336 - protein, 10 aa, Influenza virus
PNALTNDRSK

SEQ ID NO: 379337 - protein, 10 aa, Influenza virus
NALIDDRSKP

SEQ ID NO: 379338 - protein, 10 aa, Influenza virus
QGQIIVLNTD

SEQ ID NO: 379339 - protein, 10 aa, Influenza virus
GQTIVLDTDW

SEQ ID NO: 379340 - protein, 10 aa, Influenza virus
QIIVLNTDWS

SEQ ID NO: 379341 - protein, 10 aa, Influenza virus
TIVSNTDWSG

SEQ ID NO: 379342 - protein, 10 aa, Influenza virus
SGSFIDYWAE

SEQ ID NO: 379343 - protein, 10 aa, Influenza virus
GSFIDYWAEG

SEQ ID NO: 379344 - protein, 10 aa, Influenza virus
DYWAKGDCYR

SEQ ID NO: 379345 - protein, 10 aa, Influenza virus
YWAKGDCYRA

SEQ ID NO: 379346 - protein, 10 aa, Influenza virus
WAKGDCYRAC

SEQ ID NO: 379347 - protein, 10 aa, Influenza virus
AKGDCYRACF

SEQ ID NO: 379348 - protein, 10 aa, Influenza virus
KGDCYRACFY

SEQ ID NO: 379349 - protein, 10 aa, Influenza virus
IRGRPKEDEV

SEQ ID NO: 379350 - protein, 10 aa, Influenza virus
RGRPKEDEVW

SEQ ID NO: 379351 - protein, 10 aa, Influenza virus
GRPKEDEVWW

SEQ ID NO: 379352 - protein, 10 aa, Influenza virus
RPKEDEVWWT

SEQ ID NO: 379353 - protein, 10 aa, Influenza virus
PKEDEVWWTS

SEQ ID NO: 379354 - protein, 10 aa, Influenza virus
KEDEVWWTSN

SEQ ID NO: 379355 - protein, 10 aa, Influenza virus
EDEVWWTSNS

SEQ ID NO: 379356 - protein, 10 aa, Influenza virus
DEVWWTSNSI

SEQ ID NO: 379357 - protein, 10 aa, Influenza virus
KVWWTSNSII

SEQ ID NO: 379358 - protein, 10 aa, Influenza virus
DWPDGAKIKY

SEQ ID NO: 379359 - protein, 10 aa, Influenza virus
WPDGAKIETL

SEQ ID NO: 379360 - protein, 10 aa, Influenza virus
SLDKICLGHH

SEQ ID NO: 379361 - protein, 10 aa, Influenza virus
RICLGHHAVA

SEQ ID NO: 379362 - protein, 10 aa, Influenza virus
ICLGHHAVTN

SEQ ID NO: 379363 - protein, 10 aa, Influenza virus
CLGHHAVTNG

SEQ ID NO: 379364 - protein, 10 aa, Influenza virus
LGHHAVTNGT

SEQ ID NO: 379365 - protein, 10 aa, Influenza virus
MEEVTNATET

SEQ ID NO: 379366 - protein, 10 aa, Influenza virus
KDLDNCHPIG

SEQ ID NO: 379367 - protein, 10 aa, Influenza virus
DLDNCHPIGM

SEQ ID NO: 379368 - protein, 10 aa, Influenza virus
QNFPRTTNTY

SEQ ID NO: 379369 - protein, 10 aa, Influenza virus
SFPQTTNTYR

SEQ ID NO: 379370 - protein, 10 aa, Influenza virus
TTNTYRNTDP

SEQ ID NO: 379371 - protein, 10 aa, Influenza virus
YGAQSLSISV

SEQ ID NO: 379372 - protein, 10 aa, Influenza virus
GTQPLSISVG

SEQ ID NO: 379373 - protein, 10 aa, Influenza virus
AQSLSISVGS

SEQ ID NO: 379374 - protein, 10 aa, Influenza virus
QPLSISVGSS

SEQ ID NO: 379375 - protein, 10 aa, Influenza virus
PLSISVGSST

SEQ ID NO: 379376 - protein, 10 aa, Influenza virus
SISVGSSIYQ

SEQ ID NO: 379377 - protein, 10 aa, Influenza virus
ILVGSSTYQN

SEQ ID NO: 379378 - protein, 10 aa, Influenza virus
IGSSTYQNNF

SEQ ID NO: 379379 - protein, 10 aa, Influenza virus
GSSTYQSNFV

SEQ ID NO: 379380 - protein, 10 aa, Influenza virus
TYQNNFVPVM

SEQ ID NO: 379381 - protein, 10 aa, Influenza virus
YQNNFVPVVR

SEQ ID NO: 379382 - protein, 10 aa, Influenza virus
NNFVPVVRAR

SEQ ID NO: 379383 - protein, 10 aa, Influenza virus
NFVPVMGARP

SEQ ID NO: 379384 - protein, 10 aa, Influenza virus
FVPVVRARPQ

SEQ ID NO: 379385 - protein, 10 aa, Influenza virus
VPVVRARPQV

SEQ ID NO: 379386 - protein, 10 aa, Influenza virus
PVMGARPQVN

SEQ ID NO: 379387 - protein, 10 aa, Influenza virus
VVRARPQVNG

SEQ ID NO: 379388 - protein, 10 aa, Influenza virus
VRARPQVNGQ

SEQ ID NO: 379389 - protein, 10 aa, Influenza virus
GDRPLVNGQR

SEQ ID NO: 379390 - protein, 10 aa, Influenza virus
PLVNGQSGRI

SEQ ID NO: 379391 - protein, 10 aa, Influenza virus
VNGQRGRIDF

SEQ ID NO: 379392 - protein, 10 aa, Influenza virus
NGQSGRINFH

SEQ ID NO: 379393 - protein, 10 aa, Influenza virus
GQSGRIVFHW

SEQ ID NO: 379394 - protein, 10 aa, Influenza virus
PGDNITFSDN

SEQ ID NO: 379395 - protein, 10 aa, Influenza virus
GDNITFLHNG

SEQ ID NO: 379396 - protein, 10 aa, Influenza virus
DHITFSHNGG

SEQ ID NO: 379397 - protein, 10 aa, Influenza virus
NITFLHNGGL

SEQ ID NO: 379398 - protein, 10 aa, Influenza virus
IIFSHNGGLI

SEQ ID NO: 379399 - protein, 10 aa, Influenza virus
IFSHNGGLIA

SEQ ID NO: 379400 - protein, 10 aa, Influenza virus
HNGGRIAPSR

SEQ ID NO: 379401 - protein, 10 aa, Influenza virus
NGGRIAPSRV

SEQ ID NO: 379402 - protein, 10 aa, Influenza virus
ESKCFWREGS

SEQ ID NO: 379403 - protein, 10 aa, Influenza virus
KCFWRGGSII

SEQ ID NO: 379404 - protein, 10 aa, Influenza virus
CFWRGGSIIT

SEQ ID NO: 379405 - protein, 10 aa, Influenza virus
GGSIITELPF

SEQ ID NO: 379406 - protein, 10 aa, Influenza virus
GSIITELPFQ

SEQ ID NO: 379407 - protein, 10 aa, Influenza virus
SIITELPFQN

SEQ ID NO: 379408 - protein, 10 aa, Influenza virus
IITELPFQNL

SEQ ID NO: 379409 - protein, 10 aa, Influenza virus
ITELPFQNLS

SEQ ID NO: 379410 - protein, 10 aa, Influenza virus
RSLMLATGMR

SEQ ID NO: 379411 - protein, 10 aa, Influenza virus
QAADYKSTQK

SEQ ID NO: 379412 - protein, 10 aa, Influenza virus
AADYKSTQKT

SEQ ID NO: 379413 - protein, 10 aa, Influenza virus
ADYKSTQKTI

SEQ ID NO: 379414 - protein, 10 aa, Influenza virus
TIDQVTGKLN

SEQ ID NO: 379415 - protein, 10 aa, Influenza virus
INQITGKLNR

SEQ ID NO: 379416 - protein, 10 aa, Influenza virus
DQVTGKLNRL

SEQ ID NO: 379417 - protein, 10 aa, Influenza virus
IESEFNEIEY

SEQ ID NO: 379418 - protein, 10 aa, Influenza virus
ESEFNEIEYQ

SEQ ID NO: 379419 - protein, 10 aa, Influenza virus
SEFNEIEYQI

SEQ ID NO: 379420 - protein, 10 aa, Influenza virus
EFNEIEYQIG

SEQ ID NO: 379421 - protein, 10 aa, Influenza virus
FSEIEHQISN

SEQ ID NO: 379422 - protein, 10 aa, Influenza virus
NEIEYQIGNV

SEQ ID NO: 379423 - protein, 10 aa, Influenza virus
EIEHQISNVI

SEQ ID NO: 379424 - protein, 10 aa, Influenza virus
NCMERIRNNT

SEQ ID NO: 379425 - protein, 10 aa, Influenza virus
IRNNTYDHSH

SEQ ID NO: 379426 - protein, 10 aa, Influenza virus
RNNTYNHTQY

SEQ ID NO: 379427 - protein, 10 aa, Influenza virus
NNTYDHSHYR

SEQ ID NO: 379428 - protein, 10 aa, Influenza virus
NTYDHSHYRE

SEQ ID NO: 379429 - protein, 10 aa, Influenza virus
TYDHSHYREE

SEQ ID NO: 379430 - protein, 10 aa, Influenza virus
HSHYREEALL

SEQ ID NO: 379431 - protein, 10 aa, Influenza virus
REEALLNRIN

SEQ ID NO: 379432 - protein, 10 aa, Influenza virus
EEALLNRINI

SEQ ID NO: 379433 - protein, 10 aa, Influenza virus
EALLSRLNIN

SEQ ID NO: 379434 - protein, 10 aa, Influenza virus
SLLNRLSINP

SEQ ID NO: 379435 - protein, 10 aa, Influenza virus
LLNRININPV

SEQ ID NO: 379436 - protein, 10 aa, Influenza virus
INPVELSSGY

SEQ ID NO: 379437 - protein, 10 aa, Influenza virus
NPVELSSGYK

SEQ ID NO: 379438 - protein, 10 aa, Influenza virus
SLDKICLGHH

SEQ ID NO: 379439 - protein, 10 aa, Influenza virus
KICLGHHAVA

SEQ ID NO: 379440 - protein, 10 aa, Influenza virus
ICLGHHAIPN

SEQ ID NO: 379441 - protein, 10 aa, Influenza virus
CLGHHAIPNG

SEQ ID NO: 379442 - protein, 10 aa, Influenza virus
LGHHAIPNGT

SEQ ID NO: 379443 - protein, 10 aa, Influenza virus
GHHAIPNGTI

SEQ ID NO: 379444 - protein, 10 aa, Influenza virus
SNGTIIKTLT

SEQ ID NO: 379445 - protein, 10 aa, Influenza virus
TVVKTLTNEH

SEQ ID NO: 379446 - protein, 10 aa, Influenza virus
IIKTLTNEKE

SEQ ID NO: 379447 - protein, 10 aa, Influenza virus
KTLTNEHEEV

SEQ ID NO: 379448 - protein, 10 aa, Influenza virus
EKEKVTNATE

SEQ ID NO: 379449 - protein, 10 aa, Influenza virus
HEEVTNATET

SEQ ID NO: 379450 - protein, 10 aa, Influenza virus
TNATETVENK

SEQ ID NO: 379451 - protein, 10 aa, Influenza virus
KDLDNCHPIG

SEQ ID NO: 379452 - protein, 10 aa, Influenza virus
DLDNCHPIGM

SEQ ID NO: 379453 - protein, 10 aa, Influenza virus
GAPACDLHLT

SEQ ID NO: 379454 - protein, 10 aa, Influenza virus
APACDLHLTG

SEQ ID NO: 379455 - protein, 10 aa, Influenza virus
CDLHLTGMWD

SEQ ID NO: 379456 - protein, 10 aa, Influenza virus
DLHLTGIWDT

SEQ ID NO: 379457 - protein, 10 aa, Influenza virus
LHLTGMWDTL

SEQ ID NO: 379458 - protein, 10 aa, Influenza virus
HLTGKWDTLI

SEQ ID NO: 379459 - protein, 10 aa, Influenza virus
GKWDTLIERE

SEQ ID NO: 379460 - protein, 10 aa, Influenza virus
KWDTLIEREN

SEQ ID NO: 379461 - protein, 10 aa, Influenza virus
WDTLIERDNA

SEQ ID NO: 379462 - protein, 10 aa, Influenza virus
AYCYPGSTVN

SEQ ID NO: 379463 - protein, 10 aa, Influenza virus
YCYPGSTVNE

SEQ ID NO: 379464 - protein, 10 aa, Influenza virus
CYPGATVNEG

SEQ ID NO: 379465 - protein, 10 aa, Influenza virus
YPGSTVNEEA

SEQ ID NO: 379466 - protein, 10 aa, Influenza virus
PGATVNEGAL

SEQ ID NO: 379467 - protein, 10 aa, Influenza virus
GATVNEGALR

SEQ ID NO: 379468 - protein, 10 aa, Influenza virus
STVNEEALRQ

SEQ ID NO: 379469 - protein, 10 aa, Influenza virus
IMESGGIDKV

SEQ ID NO: 379470 - protein, 10 aa, Influenza virus
MESGGISKMS

SEQ ID NO: 379471 - protein, 10 aa, Influenza virus
ESGGISKMST

SEQ ID NO: 379472 - protein, 10 aa, Influenza virus
GRNSFYAELK

SEQ ID NO: 379473 - protein, 10 aa, Influenza virus
RNSFYAELKW

SEQ ID NO: 379474 - protein, 10 aa, Influenza virus
AELKWLISKS

SEQ ID NO: 379475 - protein, 10 aa, Influenza virus
ELKWLISKSK

SEQ ID NO: 379476 - protein, 10 aa, Influenza virus
LKWLISKSKE

SEQ ID NO: 379477 - protein, 10 aa, Influenza virus
KWLISKSKEQ

SEQ ID NO: 379478 - protein, 10 aa, Influenza virus
QSFPQTTNTY

SEQ ID NO: 379479 - protein, 10 aa, Influenza virus
SFPQTTNTYR

SEQ ID NO: 379480 - protein, 10 aa, Influenza virus
TTNTYRNTDP

SEQ ID NO: 379481 - protein, 10 aa, Influenza virus
EHLIMWGIHH

SEQ ID NO: 379482 - protein, 10 aa, Influenza virus
HLIMWGIHHP

SEQ ID NO: 379483 - protein, 10 aa, Influenza virus
LITWGIHHPS

SEQ ID NO: 379484 - protein, 10 aa, Influenza virus
ITWGIHHPSS

SEQ ID NO: 379485 - protein, 10 aa, Influenza virus
HPSSTKEKNE

SEQ ID NO: 379486 - protein, 10 aa, Influenza virus
PSSTKEKNEL

SEQ ID NO: 379487 - protein, 10 aa, Influenza virus
SSTKEKNELY

SEQ ID NO: 379488 - protein, 10 aa, Influenza virus
STKEKNELYG

SEQ ID NO: 379489 - protein, 10 aa, Influenza virus
QERNDLYGTQ

SEQ ID NO: 379490 - protein, 10 aa, Influenza virus
EKNALYGTQS

SEQ ID NO: 379491 - protein, 10 aa, Influenza virus
RNDLYGTQSL

SEQ ID NO: 379492 - protein, 10 aa, Influenza virus
NALYGTQSLS

SEQ ID NO: 379493 - protein, 10 aa, Influenza virus
ALYGTQSLSI

SEQ ID NO: 379494 - protein, 10 aa, Influenza virus
GTQPLSISVG

SEQ ID NO: 379495 - protein, 10 aa, Influenza virus
TQPLSISVGS

SEQ ID NO: 379496 - protein, 10 aa, Influenza virus
QSLSISIGSS

SEQ ID NO: 379497 - protein, 10 aa, Influenza virus
PLSISVGSST

SEQ ID NO: 379498 - protein, 10 aa, Influenza virus
SISVGSSIYQ

SEQ ID NO: 379499 - protein, 10 aa, Influenza virus
ISVGSSIYQN

SEQ ID NO: 379500 - protein, 10 aa, Influenza virus
SIGSSTYQNN

SEQ ID NO: 379501 - protein, 10 aa, Influenza virus
IGSSTYQNNF

SEQ ID NO: 379502 - protein, 10 aa, Influenza virus
GSSTYHNSFV

SEQ ID NO: 379503 - protein, 10 aa, Influenza virus
TYHNSFVPVV

SEQ ID NO: 379504 - protein, 10 aa, Influenza virus
VQPGDNIIFS

SEQ ID NO: 379505 - protein, 10 aa, Influenza virus
QPGDNIIFSH

SEQ ID NO: 379506 - protein, 10 aa, Influenza virus
ITFSDNGGLI

SEQ ID NO: 379507 - protein, 10 aa, Influenza virus
TFSHNGGLVA

SEQ ID NO: 379508 - protein, 10 aa, Influenza virus
SHNGGLVAPS

SEQ ID NO: 379509 - protein, 10 aa, Influenza virus
APSRVSKLTG

SEQ ID NO: 379510 - protein, 10 aa, Influenza virus
FWRGGSINTR

SEQ ID NO: 379511 - protein, 10 aa, Influenza virus
WRGGSINTRL

SEQ ID NO: 379512 - protein, 10 aa, Influenza virus
RGGSINTRLP

SEQ ID NO: 379513 - protein, 10 aa, Influenza virus
VGQCPKYVSQ

SEQ ID NO: 379514 - protein, 10 aa, Influenza virus
RSLMLATGMR

SEQ ID NO: 379515 - protein, 10 aa, Influenza virus
VADYKSTQAA

SEQ ID NO: 379516 - protein, 10 aa, Influenza virus
ADYESTQAAI

SEQ ID NO: 379517 - protein, 10 aa, Influenza virus
DYESTQAAID

SEQ ID NO: 379518 - protein, 10 aa, Influenza virus
YKSTQKTIDQ

SEQ ID NO: 379519 - protein, 10 aa, Influenza virus
ESTQAAIDQI

SEQ ID NO: 379520 - protein, 10 aa, Influenza virus
STQAAIDQMT

SEQ ID NO: 379521 - protein, 10 aa, Influenza virus
TQATIDQITG

SEQ ID NO: 379522 - protein, 10 aa, Influenza virus
QATIDQITGK

SEQ ID NO: 379523 - protein, 10 aa, Influenza virus
ATIDQITGKL

SEQ ID NO: 379524 - protein, 10 aa, Influenza virus
AIDQMTGKLN

SEQ ID NO: 379525 - protein, 10 aa, Influenza virus
IESEFNEIEY

SEQ ID NO: 379526 - protein, 10 aa, Influenza virus
ESEFNEIEYQ

SEQ ID NO: 379527 - protein, 10 aa, Influenza virus
SEFNEIEYQI

SEQ ID NO: 379528 - protein, 10 aa, Influenza virus
EFNEIEYQIG

SEQ ID NO: 379529 - protein, 10 aa, Influenza virus
FNEIEYQIGN

SEQ ID NO: 379530 - protein, 10 aa, Influenza virus
NEIEYQIGNV

SEQ ID NO: 379531 - protein, 10 aa, Influenza virus
GRGCFEIYHK

SEQ ID NO: 379532 - protein, 10 aa, Influenza virus
RGCFEIYHKC

SEQ ID NO: 379533 - protein, 10 aa, Influenza virus
GCFEIYHNCD

SEQ ID NO: 379534 - protein, 10 aa, Influenza virus
CNDNCMESIR

SEQ ID NO: 379535 - protein, 10 aa, Influenza virus
DNCMESIRDN

SEQ ID NO: 379536 - protein, 10 aa, Influenza virus
PCMESIRNNT

SEQ ID NO: 379537 - protein, 10 aa, Influenza virus
SIRDNTYDHT

SEQ ID NO: 379538 - protein, 10 aa, Influenza virus
LNRLNINPVT

SEQ ID NO: 379539 - protein, 10 aa, Influenza virus
NRLNINPVTL

SEQ ID NO: 379540 - protein, 10 aa, Influenza virus
RLNINPVTLS

SEQ ID NO: 379541 - protein, 10 aa, Influenza virus
LNINPVTLSS

SEQ ID NO: 379542 - protein, 10 aa, Influenza virus
NINPVTLSSG

SEQ ID NO: 379543 - protein, 10 aa, Influenza virus
PVRLSSGYKD

SEQ ID NO: 379544 - protein, 10 aa, Influenza virus
VKLSSGYKNV

SEQ ID NO: 379545 - protein, 10 aa, Influenza virus
RLSSGYKDII

SEQ ID NO: 379546 - protein, 10 aa, Influenza virus
GASCFVLLAD

SEQ ID NO: 379547 - protein, 10 aa, Influenza virus
IMGLFFFCLK

SEQ ID NO: 379548 - protein, 10 aa, Influenza virus
MGLFFFCLKN

SEQ ID NO: 379549 - protein, 10 aa, Influenza virus
LFALSGVAIT

SEQ ID NO: 379550 - protein, 10 aa, Influenza virus
FALSGMAIAL

SEQ ID NO: 379551 - protein, 10 aa, Influenza virus
FNLLIGISNV

SEQ ID NO: 379552 - protein, 10 aa, Influenza virus
ERGTKQEENL

SEQ ID NO: 379553 - protein, 10 aa, Influenza virus
TGTAKQNYLM

SEQ ID NO: 379554 - protein, 10 aa, Influenza virus
YVNKTTVINK

SEQ ID NO: 379555 - protein, 10 aa, Influenza virus
YLLLNKSLCS

SEQ ID NO: 379556 - protein, 10 aa, Influenza virus
LLLNKSLCSV

SEQ ID NO: 379557 - protein, 10 aa, Influenza virus
LLNKSLCSVE

SEQ ID NO: 379558 - protein, 10 aa, Influenza virus
LSKSLCKVEG

SEQ ID NO: 379559 - protein, 10 aa, Influenza virus
SKSLCKVEGW

SEQ ID NO: 379560 - protein, 10 aa, Influenza virus
KSLCKVEEWV

SEQ ID NO: 379561 - protein, 10 aa, Influenza virus
SLCKVEEWVV

SEQ ID NO: 379562 - protein, 10 aa, Influenza virus
AIRFGEGEQI

SEQ ID NO: 379563 - protein, 10 aa, Influenza virus
IRFGEGEQII

SEQ ID NO: 379564 - protein, 10 aa, Influenza virus
YVSCDPSGCK

SEQ ID NO: 379565 - protein, 10 aa, Influenza virus
VSCDPSGCKM

SEQ ID NO: 379566 - protein, 10 aa, Influenza virus
SCDPTGCKMY

SEQ ID NO: 379567 - protein, 10 aa, Influenza virus
CDPTGCKMYA

SEQ ID NO: 379568 - protein, 10 aa, Influenza virus
DPTGCKMYAL

SEQ ID NO: 379569 - protein, 10 aa, Influenza virus
PTGCKMYALH

SEQ ID NO: 379570 - protein, 10 aa, Influenza virus
SGCKMYALHQ

SEQ ID NO: 379571 - protein, 10 aa, Influenza virus
ISTPLGSPPM

SEQ ID NO: 379572 - protein, 10 aa, Influenza virus
STPLGSPPMV

SEQ ID NO: 379573 - protein, 10 aa, Influenza virus
TPLGSPPMVS

SEQ ID NO: 379574 - protein, 10 aa, Influenza virus
PLGSPPMVSN

SEQ ID NO: 379575 - protein, 10 aa, Influenza virus
LGSPPMVSNS

SEQ ID NO: 379576 - protein, 10 aa, Influenza virus
GSPPIVSNSE

SEQ ID NO: 379577 - protein, 10 aa, Influenza virus
SPPIVSNSEF

SEQ ID NO: 379578 - protein, 10 aa, Influenza virus
VSNSDFMCVG

SEQ ID NO: 379579 - protein, 10 aa, Influenza virus
SNSDFMCVGW

SEQ ID NO: 379580 - protein, 10 aa, Influenza virus
NSDFMCVGWS

SEQ ID NO: 379581 - protein, 10 aa, Influenza virus
SDFMCVGWSS

SEQ ID NO: 379582 - protein, 10 aa, Influenza virus
DFMCVGWSST

SEQ ID NO: 379583 - protein, 10 aa, Influenza virus
FICVGWSSTT

SEQ ID NO: 379584 - protein, 10 aa, Influenza virus
ICVGWSSTTC

SEQ ID NO: 379585 - protein, 10 aa, Influenza virus
TCHDGVGRMT

SEQ ID NO: 379586 - protein, 10 aa, Influenza virus
DGIGRMTICI

SEQ ID NO: 379587 - protein, 10 aa, Influenza virus
GVGRMTICIQ

SEQ ID NO: 379588 - protein, 10 aa, Influenza virus
IGRMTICIQG

SEQ ID NO: 379589 - protein, 10 aa, Influenza virus
MTICVQGNNK

SEQ ID NO: 379590 - protein, 10 aa, Influenza virus
TICVQGNNKN

SEQ ID NO: 379591 - protein, 10 aa, Influenza virus
ICVQGNNKNA

SEQ ID NO: 379592 - protein, 10 aa, Influenza virus
CVQGNNKNAT

SEQ ID NO: 379593 - protein, 10 aa, Influenza virus
VQGNNKNATA

SEQ ID NO: 379594 - protein, 10 aa, Influenza virus
KNATATVYYD

SEQ ID NO: 379595 - protein, 10 aa, Influenza virus
TATVYYERRL

SEQ ID NO: 379596 - protein, 10 aa, Influenza virus
ATVYYNRRPT

SEQ ID NO: 379597 - protein, 10 aa, Influenza virus
TVYYERRLTT

SEQ ID NO: 379598 - protein, 10 aa, Influenza virus
VYYNGRLTTT

SEQ ID NO: 379599 - protein, 10 aa, Influenza virus
YYERRLTTTI

SEQ ID NO: 379600 - protein, 10 aa, Influenza virus
YNRRPTTTIK

SEQ ID NO: 379601 - protein, 10 aa, Influenza virus
NGRLTTTIKT

SEQ ID NO: 379602 - protein, 10 aa, Influenza virus
TTTIKTWAGK

SEQ ID NO: 379603 - protein, 10 aa, Influenza virus
TTIKTWAGKI

SEQ ID NO: 379604 - protein, 10 aa, Influenza virus
TIKTWAGKIL

SEQ ID NO: 379605 - protein, 10 aa, Influenza virus
IKTWAGKILR

SEQ ID NO: 379606 - protein, 10 aa, Influenza virus
KTWAGKILRT

SEQ ID NO: 379607 - protein, 10 aa, Influenza virus
TWAGKILRTQ

SEQ ID NO: 379608 - protein, 10 aa, Influenza virus
TCVVIMTDGP

SEQ ID NO: 379609 - protein, 10 aa, Influenza virus
CVVIMTDGPA

SEQ ID NO: 379610 - protein, 10 aa, Influenza virus
VVIMTDGPAS

SEQ ID NO: 379611 - protein, 10 aa, Influenza virus
VIMTDGSANS

SEQ ID NO: 379612 - protein, 10 aa, Influenza virus
IMTDGSANSQ

SEQ ID NO: 379613 - protein, 10 aa, Influenza virus
MTDGPANSQA

SEQ ID NO: 379614 - protein, 10 aa, Influenza virus
TDGPANSQAY

SEQ ID NO: 379615 - protein, 10 aa, Influenza virus
DGPASSQAYT

SEQ ID NO: 379616 - protein, 10 aa, Influenza virus
GSASGQAYTK

SEQ ID NO: 379617 - protein, 10 aa, Influenza virus
QAYTKIMYFH

SEQ ID NO: 379618 - protein, 10 aa, Influenza virus
AYTKIMYFHK

SEQ ID NO: 379619 - protein, 10 aa, Influenza virus
YTKIMYFHKG

SEQ ID NO: 379620 - protein, 10 aa, Influenza virus
TKIMYFHKGL

SEQ ID NO: 379621 - protein, 10 aa, Influenza virus
YFHKGLVVKE

SEQ ID NO: 379622 - protein, 10 aa, Influenza virus
FHKGLVVKEE

SEQ ID NO: 379623 - protein, 10 aa, Influenza virus
KEETLKGSAR

SEQ ID NO: 379624 - protein, 10 aa, Influenza virus
EEALQGSARH

SEQ ID NO: 379625 - protein, 10 aa, Influenza virus
VEECSCYGHN

SEQ ID NO: 379626 - protein, 10 aa, Influenza virus
EECSCYGHSQ

SEQ ID NO: 379627 - protein, 10 aa, Influenza virus
ECSCYGHSQK

SEQ ID NO: 379628 - protein, 10 aa, Influenza virus
CYGHSQKVTC

SEQ ID NO: 379629 - protein, 10 aa, Influenza virus
SKVTCICRDN

SEQ ID NO: 379630 - protein, 10 aa, Influenza virus
GANRPVIEIN

SEQ ID NO: 379631 - protein, 10 aa, Influenza virus
ANRPVIEINM

SEQ ID NO: 379632 - protein, 10 aa, Influenza virus
AMDHTSQYLC

SEQ ID NO: 379633 - protein, 10 aa, Influenza virus
MDHTSQYLCT

SEQ ID NO: 379634 - protein, 10 aa, Influenza virus
KHTSQYLCTG

SEQ ID NO: 379635 - protein, 10 aa, Influenza virus
LTDTSKPSDK

SEQ ID NO: 379636 - protein, 10 aa, Influenza virus
CNNPITGSPE

SEQ ID NO: 379637 - protein, 10 aa, Influenza virus
DNPITGSPGA

SEQ ID NO: 379638 - protein, 10 aa, Influenza virus
GVKGFGFLDN

SEQ ID NO: 379639 - protein, 10 aa, Influenza virus
DNTWLGGTIS

SEQ ID NO: 379640 - protein, 10 aa, Influenza virus
EMLKIPNAGI

SEQ ID NO: 379641 - protein, 10 aa, Influenza virus
MLKIPNAGID

SEQ ID NO: 379642 - protein, 10 aa, Influenza virus
LKIPNAGIDP

SEQ ID NO: 379643 - protein, 10 aa, Influenza virus
KVPNAGTDPN

SEQ ID NO: 379644 - protein, 10 aa, Influenza virus
VPNAGTDPNS

SEQ ID NO: 379645 - protein, 10 aa, Influenza virus
NSDWSGYSGS

SEQ ID NO: 379646 - protein, 10 aa, Influenza virus
NKWSGYSGSF

SEQ ID NO: 379647 - protein, 10 aa, Influenza virus
SACYNPCFYV

SEQ ID NO: 379648 - protein, 10 aa, Influenza virus
KCYNPCFYVE

SEQ ID NO: 379649 - protein, 10 aa, Influenza virus
LIALCGSPFP

SEQ ID NO: 379650 - protein, 10 aa, Influenza virus
IALCGSPFPV

SEQ ID NO: 379651 - protein, 10 aa, Influenza virus
ALCGSPFPVG

SEQ ID NO: 379652 - protein, 10 aa, Influenza virus
LCGSPFPVGS

SEQ ID NO: 379653 - protein, 10 aa, Influenza virus
CGSPFPVGSG

SEQ ID NO: 379654 - protein, 10 aa, Influenza virus
GSPFPVGSGS

SEQ ID NO: 379655 - protein, 10 aa, Influenza virus
SPFPVGSGSF

SEQ ID NO: 379656 - protein, 10 aa, Influenza virus
PFPVGSGSFP

SEQ ID NO: 379657 - protein, 10 aa, Influenza virus
FPVGSGSFPD

SEQ ID NO: 379658 - protein, 10 aa, Influenza virus
QADEICIGYM

SEQ ID NO: 379659 - protein, 10 aa, Influenza virus
GYMSNNSTEK

SEQ ID NO: 379660 - protein, 10 aa, Influenza virus
YMSNNSTEKV

SEQ ID NO: 379661 - protein, 10 aa, Influenza virus
LSNNSTERVD

SEQ ID NO: 379662 - protein, 10 aa, Influenza virus
SNNSTERVDT

SEQ ID NO: 379663 - protein, 10 aa, Influenza virus
NNSTERVDTI

SEQ ID NO: 379664 - protein, 10 aa, Influenza virus
NSTERVDTII

SEQ ID NO: 379665 - protein, 10 aa, Influenza virus
STERVDTIIE

SEQ ID NO: 379666 - protein, 10 aa, Influenza virus
TERVDTIIES

SEQ ID NO: 379667 - protein, 10 aa, Influenza virus
ERVDTIIESN

SEQ ID NO: 379668 - protein, 10 aa, Influenza virus
RVDTIIESNV

SEQ ID NO: 379669 - protein, 10 aa, Influenza virus
VNTIIESNVT

SEQ ID NO: 379670 - protein, 10 aa, Influenza virus
NTIIESNVTV

SEQ ID NO: 379671 - protein, 10 aa, Influenza virus
ESNITVTSSV

SEQ ID NO: 379672 - protein, 10 aa, Influenza virus
SNVTVTNSVE

SEQ ID NO: 379673 - protein, 10 aa, Influenza virus
HTGSFCSLDG

SEQ ID NO: 379674 - protein, 10 aa, Influenza virus
TGSFCSLDGK

SEQ ID NO: 379675 - protein, 10 aa, Influenza virus
FCSINGRAPI

SEQ ID NO: 379676 - protein, 10 aa, Influenza virus
CSINGRAPIS

SEQ ID NO: 379677 - protein, 10 aa, Influenza virus
SINGRAPISL

SEQ ID NO: 379678 - protein, 10 aa, Influenza virus
INGKEPISLG

SEQ ID NO: 379679 - protein, 10 aa, Influenza virus
NGKEPISLGD

SEQ ID NO: 379680 - protein, 10 aa, Influenza virus
GKEPISLGDC

SEQ ID NO: 379681 - protein, 10 aa, Influenza virus
KEPISLGDCS

SEQ ID NO: 379682 - protein, 10 aa, Influenza virus
WILGNPMCDN

SEQ ID NO: 379683 - protein, 10 aa, Influenza virus
ILGNPMCDYL

SEQ ID NO: 379684 - protein, 10 aa, Influenza virus
LGNPMCDNLI

SEQ ID NO: 379685 - protein, 10 aa, Influenza virus
GNPMCDNLIG

SEQ ID NO: 379686 - protein, 10 aa, Influenza virus
NPMCDNLIGK

SEQ ID NO: 379687 - protein, 10 aa, Influenza virus
CDNLIGKTSW

SEQ ID NO: 379688 - protein, 10 aa, Influenza virus
DNLIGKTSWS

SEQ ID NO: 379689 - protein, 10 aa, Influenza virus
YLIGKTSWSY

SEQ ID NO: 379690 - protein, 10 aa, Influenza virus
TSWSYIVERP

SEQ ID NO: 379691 - protein, 10 aa, Influenza virus
SWSYIVEKLN

SEQ ID NO: 379692 - protein, 10 aa, Influenza virus
WSYIVEKTNP

SEQ ID NO: 379693 - protein, 10 aa, Influenza virus
NPINGICYPG

SEQ ID NO: 379694 - protein, 10 aa, Influenza virus
NGICYPGTLG

SEQ ID NO: 379695 - protein, 10 aa, Influenza virus
SFFRNMIWLI

SEQ ID NO: 379696 - protein, 10 aa, Influenza virus
WLIYQSGTYP

SEQ ID NO: 379697 - protein, 10 aa, Influenza virus
FKNTKGRDVL

SEQ ID NO: 379698 - protein, 10 aa, Influenza virus
QTGRMTFYWT

SEQ ID NO: 379699 - protein, 10 aa, Influenza virus
AGRMTFYWAI

SEQ ID NO: 379700 - protein, 10 aa, Influenza virus
GRMTFYWAIV

SEQ ID NO: 379701 - protein, 10 aa, Influenza virus
TFESNGALLA

SEQ ID NO: 379702 - protein, 10 aa, Influenza virus
FESNGALLAP

SEQ ID NO: 379703 - protein, 10 aa, Influenza virus
ESNGAFLAPG

SEQ ID NO: 379704 - protein, 10 aa, Influenza virus
SNGAFLAPGY

SEQ ID NO: 379705 - protein, 10 aa, Influenza virus
LAPRYALELV

SEQ ID NO: 379706 - protein, 10 aa, Influenza virus
APRYSFELVS

SEQ ID NO: 379707 - protein, 10 aa, Influenza virus
CQSEIGWINT

SEQ ID NO: 379708 - protein, 10 aa, Influenza virus
NVHRNTIGNC

SEQ ID NO: 379709 - protein, 10 aa, Influenza virus
VHRSTIGDCP

SEQ ID NO: 379710 - protein, 10 aa, Influenza virus
HRSTIGDCPK

SEQ ID NO: 379711 - protein, 10 aa, Influenza virus
RNTIGNCPKY

SEQ ID NO: 379712 - protein, 10 aa, Influenza virus
NTIGNCPKYV

SEQ ID NO: 379713 - protein, 10 aa, Influenza virus
TIGNCPKYVN

SEQ ID NO: 379714 - protein, 10 aa, Influenza virus
IGNCPKYVNV

SEQ ID NO: 379715 - protein, 10 aa, Influenza virus
GDCPKYVNIK

SEQ ID NO: 379716 - protein, 10 aa, Influenza virus
DCPKYVNIKS

SEQ ID NO: 379717 - protein, 10 aa, Influenza virus
CPKYVNIKSL

SEQ ID NO: 379718 - protein, 10 aa, Influenza virus
PKYVNIKSLK

SEQ ID NO: 379719 - protein, 10 aa, Influenza virus
KYVNIKSLKL

SEQ ID NO: 379720 - protein, 10 aa, Influenza virus
YVNIKSLKLA

SEQ ID NO: 379721 - protein, 10 aa, Influenza virus
NIKSLKLATG

SEQ ID NO: 379722 - protein, 10 aa, Influenza virus
KSLKLASGLR

SEQ ID NO: 379723 - protein, 10 aa, Influenza virus
SLKLAIGPRN

SEQ ID NO: 379724 - protein, 10 aa, Influenza virus
LKLASGLRNV

SEQ ID NO: 379725 - protein, 10 aa, Influenza virus
KLASGLRNVP

SEQ ID NO: 379726 - protein, 10 aa, Influenza virus
LASGLRNVPA

SEQ ID NO: 379727 - protein, 10 aa, Influenza virus
SRGLFGAKAG

SEQ ID NO: 379728 - protein, 10 aa, Influenza virus
IAADKESTQE

SEQ ID NO: 379729 - protein, 10 aa, Influenza virus
AADKESTQEA

SEQ ID NO: 379730 - protein, 10 aa, Influenza virus
DIWSYNAKLL

SEQ ID NO: 379731 - protein, 10 aa, Influenza virus
DSNVKNLHEK

SEQ ID NO: 379732 - protein, 10 aa, Influenza virus
LQDNAKDEGN

SEQ ID NO: 379733 - protein, 10 aa, Influenza virus
QDNAKDEGNG

SEQ ID NO: 379734 - protein, 10 aa, Influenza virus
CFPFYHKCDN

SEQ ID NO: 379735 - protein, 10 aa, Influenza virus
FYHKCNNECI

SEQ ID NO: 379736 - protein, 10 aa, Influenza virus
YHKCNNECIE

SEQ ID NO: 379737 - protein, 10 aa, Influenza virus
DECIEKVRNG

SEQ ID NO: 379738 - protein, 10 aa, Influenza virus
ECIEKIRNGT

SEQ ID NO: 379739 - protein, 10 aa, Influenza virus
DHKEFEKESR

SEQ ID NO: 379740 - protein, 10 aa, Influenza virus
ESRINRQEIE

SEQ ID NO: 379741 - protein, 10 aa, Influenza virus
SRINRQEIEG

SEQ ID NO: 379742 - protein, 10 aa, Influenza virus
LNRQEIGGVK

SEQ ID NO: 379743 - protein, 10 aa, Influenza virus
NRQEIEGARL

SEQ ID NO: 379744 - protein, 10 aa, Influenza virus
RQEIGGVKLD

SEQ ID NO: 379745 - protein, 10 aa, Influenza virus
GNVYKILSIC

SEQ ID NO: 379746 - protein, 10 aa, Influenza virus
IASSLILAAL

SEQ ID NO: 379747 - protein, 10 aa, Influenza virus
ASSLILAALI

SEQ ID NO: 379748 - protein, 10 aa, Influenza virus
SSLVLAALNM

SEQ ID NO: 379749 - protein, 10 aa, Influenza virus
SLVLAASIMG

SEQ ID NO: 379750 - protein, 10 aa, Influenza virus
WACGNGSCRC

SEQ ID NO: 379751 - protein, 10 aa, Influenza virus
VCSNGSCRCT

SEQ ID NO: 379752 - protein, 10 aa, Influenza virus
NSTETVNTLT

SEQ ID NO: 379753 - protein, 10 aa, Influenza virus
STETVNTLTE

SEQ ID NO: 379754 - protein, 10 aa, Influenza virus
TETVNTLTEQ

SEQ ID NO: 379755 - protein, 10 aa, Influenza virus
ETVNTLTEQN

SEQ ID NO: 379756 - protein, 10 aa, Influenza virus
TVNTLIEQNI

SEQ ID NO: 379757 - protein, 10 aa, Influenza virus
VNTLIEQNIP

SEQ ID NO: 379758 - protein, 10 aa, Influenza virus
NTLIEQNIPV

SEQ ID NO: 379759 - protein, 10 aa, Influenza virus
TLIEQNIPVT

SEQ ID NO: 379760 - protein, 10 aa, Influenza virus
LIEQNIPVTQ

SEQ ID NO: 379761 - protein, 10 aa, Influenza virus
IEQNIPVTQV

SEQ ID NO: 379762 - protein, 10 aa, Influenza virus
QVEELVHRGI

SEQ ID NO: 379763 - protein, 10 aa, Influenza virus
VEELVHRGID

SEQ ID NO: 379764 - protein, 10 aa, Influenza virus
EELVHGGINP

SEQ ID NO: 379765 - protein, 10 aa, Influenza virus
LDDCSLEGLV

SEQ ID NO: 379766 - protein, 10 aa, Influenza virus
DDCSLKGLIL

SEQ ID NO: 379767 - protein, 10 aa, Influenza virus
DCSLEGLVLG

SEQ ID NO: 379768 - protein, 10 aa, Influenza virus
CSLEGLVLGN

SEQ ID NO: 379769 - protein, 10 aa, Influenza virus
SLEGLVLGNP

SEQ ID NO: 379770 - protein, 10 aa, Influenza virus
LKGLILGNPK

SEQ ID NO: 379771 - protein, 10 aa, Influenza virus
EGLVLGNPKC

SEQ ID NO: 379772 - protein, 10 aa, Influenza virus
GLILSNPKCD

SEQ ID NO: 379773 - protein, 10 aa, Influenza virus
LILSNPKCDL

SEQ ID NO: 379774 - protein, 10 aa, Influenza virus
VLGNPKCDLY

SEQ ID NO: 379775 - protein, 10 aa, Influenza virus
SNPKCDLYLN

SEQ ID NO: 379776 - protein, 10 aa, Influenza virus
VERPKEIEGI

SEQ ID NO: 379777 - protein, 10 aa, Influenza virus
ERPKEIEGIC

SEQ ID NO: 379778 - protein, 10 aa, Influenza virus
RPKEIEGICY

SEQ ID NO: 379779 - protein, 10 aa, Influenza virus
PKEIEGICYP

SEQ ID NO: 379780 - protein, 10 aa, Influenza virus
MEGICYPGSV

SEQ ID NO: 379781 - protein, 10 aa, Influenza virus
EGVCYPGSIK

SEQ ID NO: 379782 - protein, 10 aa, Influenza virus
GVCYPGSIKN

SEQ ID NO: 379783 - protein, 10 aa, Influenza virus
VCYPGSIKNQ

SEQ ID NO: 379784 - protein, 10 aa, Influenza virus
GSVENQEELR

SEQ ID NO: 379785 - protein, 10 aa, Influenza virus
SVENQEELRS

SEQ ID NO: 379786 - protein, 10 aa, Influenza virus
VENQEELRSL

SEQ ID NO: 379787 - protein, 10 aa, Influenza virus
KNQEELRSLF

SEQ ID NO: 379788 - protein, 10 aa, Influenza virus
LKSLFSSIKK

SEQ ID NO: 379789 - protein, 10 aa, Influenza virus
KSLFSSIKKY

SEQ ID NO: 379790 - protein, 10 aa, Influenza virus
FDFIKWNVTY

SEQ ID NO: 379791 - protein, 10 aa, Influenza virus
DFTKWNVTHT

SEQ ID NO: 379792 - protein, 10 aa, Influenza virus
FTKWNVTHTG

SEQ ID NO: 379793 - protein, 10 aa, Influenza virus
TKWNVTHTGT

SEQ ID NO: 379794 - protein, 10 aa, Influenza virus
WNVTHTGTSK

SEQ ID NO: 379795 - protein, 10 aa, Influenza virus
NVTHTGTSKA

SEQ ID NO: 379796 - protein, 10 aa, Influenza virus
VTHTGTSKAC

SEQ ID NO: 379797 - protein, 10 aa, Influenza virus
THTGTSKACN

SEQ ID NO: 379798 - protein, 10 aa, Influenza virus
ISNQGSFYRS

SEQ ID NO: 379799 - protein, 10 aa, Influenza virus
SNQGSFYRNM

SEQ ID NO: 379800 - protein, 10 aa, Influenza virus
NRGSFYRSMR

SEQ ID NO: 379801 - protein, 10 aa, Influenza virus
RGSFYRSMRW

SEQ ID NO: 379802 - protein, 10 aa, Influenza virus
DSFYRSMKWL

SEQ ID NO: 379803 - protein, 10 aa, Influenza virus
SFYRSMKWLT

SEQ ID NO: 379804 - protein, 10 aa, Influenza virus
FYRSMKWLTL

SEQ ID NO: 379805 - protein, 10 aa, Influenza virus
YRSMKWLTLK

SEQ ID NO: 379806 - protein, 10 aa, Influenza virus
RSIRWLTLKS

SEQ ID NO: 379807 - protein, 10 aa, Influenza virus
MRWLTLKLGQ

SEQ ID NO: 379808 - protein, 10 aa, Influenza virus
KWLTLKSGQF

SEQ ID NO: 379809 - protein, 10 aa, Influenza virus
IWAIHHPPTS

SEQ ID NO: 379810 - protein, 10 aa, Influenza virus
WAIHHPPTSA

SEQ ID NO: 379811 - protein, 10 aa, Influenza virus
AIHHPPTSAE

SEQ ID NO: 379812 - protein, 10 aa, Influenza virus
IHHPPTSAEQ

SEQ ID NO: 379813 - protein, 10 aa, Influenza virus
HHPPTTDEQM

SEQ ID NO: 379814 - protein, 10 aa, Influenza virus
EINRNFKPNI

SEQ ID NO: 379815 - protein, 10 aa, Influenza virus
IDRSFRPNIG

SEQ ID NO: 379816 - protein, 10 aa, Influenza virus
DRSFRPNIGP

SEQ ID NO: 379817 - protein, 10 aa, Influenza virus
RNFKPNIGPR

SEQ ID NO: 379818 - protein, 10 aa, Influenza virus
NFKPNIGPRP

SEQ ID NO: 379819 - protein, 10 aa, Influenza virus
RPNIGPRPLI

SEQ ID NO: 379820 - protein, 10 aa, Influenza virus
PNIGPRPLIR

SEQ ID NO: 379821 - protein, 10 aa, Influenza virus
NIGPRPLIRG

SEQ ID NO: 379822 - protein, 10 aa, Influenza virus
IGPRPLVMGQ

SEQ ID NO: 379823 - protein, 10 aa, Influenza virus
GPRPLVMGQQ

SEQ ID NO: 379824 - protein, 10 aa, Influenza virus
PRPLVMGQQG

SEQ ID NO: 379825 - protein, 10 aa, Influenza virus
RPLIRGQQGR

SEQ ID NO: 379826 - protein, 10 aa, Influenza virus
PLIRGQQGRM

SEQ ID NO: 379827 - protein, 10 aa, Influenza virus
LIRGQQGRMD

SEQ ID NO: 379828 - protein, 10 aa, Influenza virus
IRGQQGRMDY

SEQ ID NO: 379829 - protein, 10 aa, Influenza virus
LIAPEYGHLT

SEQ ID NO: 379830 - protein, 10 aa, Influenza virus
IAPEYGYLIT

SEQ ID NO: 379831 - protein, 10 aa, Influenza virus
APEYGYLITG

SEQ ID NO: 379832 - protein, 10 aa, Influenza virus
PEYGYLITGK

SEQ ID NO: 379833 - protein, 10 aa, Influenza virus
EYGYLITGKS

SEQ ID NO: 379834 - protein, 10 aa, Influenza virus
YGHLTTGKSH

SEQ ID NO: 379835 - protein, 10 aa, Influenza virus
GYLITGKSHG

SEQ ID NO: 379836 - protein, 10 aa, Influenza virus
HLTTGKSHGR

SEQ ID NO: 379837 - protein, 10 aa, Influenza virus
LTTGKSHGRI

SEQ ID NO: 379838 - protein, 10 aa, Influenza virus
TTGKSHGRIL

SEQ ID NO: 379839 - protein, 10 aa, Influenza virus
TECQLNEGVI

SEQ ID NO: 379840 - protein, 10 aa, Influenza virus
ECQLNEGVIN

SEQ ID NO: 379841 - protein, 10 aa, Influenza virus
EGVMNTSKPL

SEQ ID NO: 379842 - protein, 10 aa, Influenza virus
GIMNTSKPFQ

SEQ ID NO: 379843 - protein, 10 aa, Influenza virus
VINTSKPFQN

SEQ ID NO: 379844 - protein, 10 aa, Influenza virus
INTSKPFQNT

SEQ ID NO: 379845 - protein, 10 aa, Influenza virus
TSKPFQNTSR

SEQ ID NO: 379846 - protein, 10 aa, Influenza virus
SKPLQNTSKH

SEQ ID NO: 379847 - protein, 10 aa, Influenza virus
KPLQNTSKHY

SEQ ID NO: 379848 - protein, 10 aa, Influenza virus
PFQNICKPYI

SEQ ID NO: 379849 - protein, 10 aa, Influenza virus
LQNTSKHYIG

SEQ ID NO: 379850 - protein, 10 aa, Influenza virus
CKPYIGKCPK

SEQ ID NO: 379851 - protein, 10 aa, Influenza virus
RHYIGKCPKY

SEQ ID NO: 379852 - protein, 10 aa, Influenza virus
GKCPKYISSG

SEQ ID NO: 379853 - protein, 10 aa, Influenza virus
KCPKYISSGS

SEQ ID NO: 379854 - protein, 10 aa, Influenza virus
CPKYISSGSL

SEQ ID NO: 379855 - protein, 10 aa, Influenza virus
PKYISSGSLK

SEQ ID NO: 379856 - protein, 10 aa, Influenza virus
KYISSGSLKL

SEQ ID NO: 379857 - protein, 10 aa, Influenza virus
YIPSRSLKLA

SEQ ID NO: 379858 - protein, 10 aa, Influenza virus
ISSGSLKLAI

SEQ ID NO: 379859 - protein, 10 aa, Influenza virus
SSGSLKLAIG

SEQ ID NO: 379860 - protein, 10 aa, Influenza virus
SRSLKLAIGL

SEQ ID NO: 379861 - protein, 10 aa, Influenza virus
RSLKLAIGLR

SEQ ID NO: 379862 - protein, 10 aa, Influenza virus
AIGPRNVPQV

SEQ ID NO: 379863 - protein, 10 aa, Influenza virus
IGLRNVPQIQ

SEQ ID NO: 379864 - protein, 10 aa, Influenza virus
RNVPQVQDRG

SEQ ID NO: 379865 - protein, 10 aa, Influenza virus
NVPQVQDRGL

SEQ ID NO: 379866 - protein, 10 aa, Influenza virus
VPQVQDRGLF

SEQ ID NO: 379867 - protein, 10 aa, Influenza virus
PQVQDRGLFG

SEQ ID NO: 379868 - protein, 10 aa, Influenza virus
QVQDRGLFGA

SEQ ID NO: 379869 - protein, 10 aa, Influenza virus
QDRGLFGAKA

SEQ ID NO: 379870 - protein, 10 aa, Influenza virus
DRGLFGAKAG

SEQ ID NO: 379871 - protein, 10 aa, Influenza virus
QHQNAEGIGI

SEQ ID NO: 379872 - protein, 10 aa, Influenza virus
HQNSEGTGIV

SEQ ID NO: 379873 - protein, 10 aa, Influenza virus
QNSEGTGIVA

SEQ ID NO: 379874 - protein, 10 aa, Influenza virus
NSEGTGIVAD

SEQ ID NO: 379875 - protein, 10 aa, Influenza virus
SEGTGIVADR

SEQ ID NO: 379876 - protein, 10 aa, Influenza virus
EGTGIVADRD

SEQ ID NO: 379877 - protein, 10 aa, Influenza virus
GIGIAADRDS

SEQ ID NO: 379878 - protein, 10 aa, Influenza virus
TGIAADRGST

SEQ ID NO: 379879 - protein, 10 aa, Influenza virus
GIVADRDSTQ

SEQ ID NO: 379880 - protein, 10 aa, Influenza virus
VADRDSTQKA

SEQ ID NO: 379881 - protein, 10 aa, Influenza virus
ADRGSTQKAI

SEQ ID NO: 379882 - protein, 10 aa, Influenza virus
DRGSTQKAID

SEQ ID NO: 379883 - protein, 10 aa, Influenza virus
RDSTQKAIDI

SEQ ID NO: 379884 - protein, 10 aa, Influenza virus
DSTQKAIDIM

SEQ ID NO: 379885 - protein, 10 aa, Influenza virus
STQKAIDIMQ

SEQ ID NO: 379886 - protein, 10 aa, Influenza virus
TQKAIDIMQN

SEQ ID NO: 379887 - protein, 10 aa, Influenza virus
QKAIDIMQNK

SEQ ID NO: 379888 - protein, 10 aa, Influenza virus
KAIDNMQNRL

SEQ ID NO: 379889 - protein, 10 aa, Influenza virus
NVIDKMNKQL

SEQ ID NO: 379890 - protein, 10 aa, Influenza virus
EFSEVGSRIN

SEQ ID NO: 379891 - protein, 10 aa, Influenza virus
VGSRINMINS

SEQ ID NO: 379892 - protein, 10 aa, Influenza virus
IRINMINSKI

SEQ ID NO: 379893 - protein, 10 aa, Influenza virus
RINMINSKIE

SEQ ID NO: 379894 - protein, 10 aa, Influenza virus
INMINSQIDD

SEQ ID NO: 379895 - protein, 10 aa, Influenza virus
NMINSQIDDQ

SEQ ID NO: 379896 - protein, 10 aa, Influenza virus
IDDQIIDIWA

SEQ ID NO: 379897 - protein, 10 aa, Influenza virus
NDQITDIWAY

SEQ ID NO: 379898 - protein, 10 aa, Influenza virus
ANVRNLHERI

SEQ ID NO: 379899 - protein, 10 aa, Influenza virus
NVRNLHDRTR

SEQ ID NO: 379900 - protein, 10 aa, Influenza virus
VRNLHDRTRR

SEQ ID NO: 379901 - protein, 10 aa, Influenza virus
ENAVDTGDGC

SEQ ID NO: 379902 - protein, 10 aa, Influenza virus
NAIDAGDGCF

SEQ ID NO: 379903 - protein, 10 aa, Influenza virus
AIDAGDGCFE

SEQ ID NO: 379904 - protein, 10 aa, Influenza virus
IDAGDGCFEI

SEQ ID NO: 379905 - protein, 10 aa, Influenza virus
GCFEILHKCN

SEQ ID NO: 379906 - protein, 10 aa, Influenza virus
CFEILHRCND

SEQ ID NO: 379907 - protein, 10 aa, Influenza virus
TIRNGTYNHQ

SEQ ID NO: 379908 - protein, 10 aa, Influenza virus
YEDESRIERQ

SEQ ID NO: 379909 - protein, 10 aa, Influenza virus
EDESRIERQK

SEQ ID NO: 379910 - protein, 10 aa, Influenza virus
ERQKISGVKL

SEQ ID NO: 379911 - protein, 10 aa, Influenza virus
RQKISGVKLE

SEQ ID NO: 379912 - protein, 10 aa, Influenza virus
QKISGVKLEE

SEQ ID NO: 379913 - protein, 10 aa, Influenza virus
KISGVKLEEN

SEQ ID NO: 379914 - protein, 10 aa, Influenza virus
VGYLSTNSSD

SEQ ID NO: 379915 - protein, 10 aa, Influenza virus
GYLSTNSSDK

SEQ ID NO: 379916 - protein, 10 aa, Influenza virus
YLSTNSSDKV

SEQ ID NO: 379917 - protein, 10 aa, Influenza virus
LSTNSSDKVD

SEQ ID NO: 379918 - protein, 10 aa, Influenza virus
STNSSDKVDT

SEQ ID NO: 379919 - protein, 10 aa, Influenza virus
TNSSEKVNTL

SEQ ID NO: 379920 - protein, 10 aa, Influenza virus
NSSEKVNTLL

SEQ ID NO: 379921 - protein, 10 aa, Influenza virus
SSEKVNTLLE

SEQ ID NO: 379922 - protein, 10 aa, Influenza virus
VNTLLENDVP

SEQ ID NO: 379923 - protein, 10 aa, Influenza virus
NTLLENDVPV

SEQ ID NO: 379924 - protein, 10 aa, Influenza virus
TLLESDVPVT

SEQ ID NO: 379925 - protein, 10 aa, Influenza virus
LLESDVPVTS

SEQ ID NO: 379926 - protein, 10 aa, Influenza virus
LESDVPVTSS

SEQ ID NO: 379927 - protein, 10 aa, Influenza virus
VPVTSSIDLV

SEQ ID NO: 379928 - protein, 10 aa, Influenza virus
PVTSSIDLVE

SEQ ID NO: 379929 - protein, 10 aa, Influenza virus
VTSSIDLVET

SEQ ID NO: 379930 - protein, 10 aa, Influenza virus
DLIETTHTGT

SEQ ID NO: 379931 - protein, 10 aa, Influenza virus
LIETTHTGTY

SEQ ID NO: 379932 - protein, 10 aa, Influenza virus
IETTHTGTYC

SEQ ID NO: 379933 - protein, 10 aa, Influenza virus
HTGTYCSLSG

SEQ ID NO: 379934 - protein, 10 aa, Influenza virus
VSPVHLGDCN

SEQ ID NO: 379935 - protein, 10 aa, Influenza virus
GDCNFEGWIV

SEQ ID NO: 379936 - protein, 10 aa, Influenza virus
DCNFEGWIVG

SEQ ID NO: 379937 - protein, 10 aa, Influenza virus
CSFEGWIGGN

SEQ ID NO: 379938 - protein, 10 aa, Influenza virus
SFEGWIGGNP

SEQ ID NO: 379939 - protein, 10 aa, Influenza virus
EWSYLIEDPT

SEQ ID NO: 379940 - protein, 10 aa, Influenza virus
WSYLIEDPTA

SEQ ID NO: 379941 - protein, 10 aa, Influenza virus
SYLIEDPTAP

SEQ ID NO: 379942 - protein, 10 aa, Influenza virus
YLIEDPTAPH

SEQ ID NO: 379943 - protein, 10 aa, Influenza virus
LIEDPAAPHG

SEQ ID NO: 379944 - protein, 10 aa, Influenza virus
IEDPAAPHGL

SEQ ID NO: 379945 - protein, 10 aa, Influenza virus
EDPTAPHGLC

SEQ ID NO: 379946 - protein, 10 aa, Influenza virus
DPTAPHGLCY

SEQ ID NO: 379947 - protein, 10 aa, Influenza virus
PTAPHGLCYP

SEQ ID NO: 379948 - protein, 10 aa, Influenza virus
TAPHGLCYPG

SEQ ID NO: 379949 - protein, 10 aa, Influenza virus
KSFSRTQLIA

SEQ ID NO: 379950 - protein, 10 aa, Influenza virus
RGTNSFYRNL

SEQ ID NO: 379951 - protein, 10 aa, Influenza virus
GAYNNTTGRD

SEQ ID NO: 379952 - protein, 10 aa, Influenza virus
GRDVLVMWGL

SEQ ID NO: 379953 - protein, 10 aa, Influenza virus
RDVLVMWGLH

SEQ ID NO: 379954 - protein, 10 aa, Influenza virus
DVLVMWGLHH

SEQ ID NO: 379955 - protein, 10 aa, Influenza virus
VLVMWGLHHP

SEQ ID NO: 379956 - protein, 10 aa, Influenza virus
PYTLVSTRSW

SEQ ID NO: 379957 - protein, 10 aa, Influenza virus
YTLVTTSSWS

SEQ ID NO: 379958 - protein, 10 aa, Influenza virus
GTRPGYNGQK

SEQ ID NO: 379959 - protein, 10 aa, Influenza virus
TRPGYNGQKS

SEQ ID NO: 379960 - protein, 10 aa, Influenza virus
PRYNGQRSWM

SEQ ID NO: 379961 - protein, 10 aa, Influenza virus
RYNGQRSWMK

SEQ ID NO: 379962 - protein, 10 aa, Influenza virus
VSFESNGGLL

SEQ ID NO: 379963 - protein, 10 aa, Influenza virus
YGRGRIFQSR

SEQ ID NO: 379964 - protein, 10 aa, Influenza virus
GRGRIFQSRI

SEQ ID NO: 379965 - protein, 10 aa, Influenza virus
RGRIFQSRIR

SEQ ID NO: 379966 - protein, 10 aa, Influenza virus
TNKTFQNIDK

SEQ ID NO: 379967 - protein, 10 aa, Influenza virus
NRTFQNIDRN

SEQ ID NO: 379968 - protein, 10 aa, Influenza virus
RTFQNIDRNA

SEQ ID NO: 379969 - protein, 10 aa, Influenza virus
QNIDRNALGD

SEQ ID NO: 379970 - protein, 10 aa, Influenza virus
NIDKNALGEC

SEQ ID NO: 379971 - protein, 10 aa, Influenza virus
IDRNALGDCP

SEQ ID NO: 379972 - protein, 10 aa, Influenza virus
DRNALGDCPK

SEQ ID NO: 379973 - protein, 10 aa, Influenza virus
KNALGECPKY

SEQ ID NO: 379974 - protein, 10 aa, Influenza virus
LATGLRNVPS

SEQ ID NO: 379975 - protein, 10 aa, Influenza virus
RGLLGAIAGF

SEQ ID NO: 379976 - protein, 10 aa, Influenza virus
AVDGTIAGFI

SEQ ID NO: 379977 - protein, 10 aa, Influenza virus
VDGTIAGFIE

SEQ ID NO: 379978 - protein, 10 aa, Influenza virus
QHQNEQGMGM

SEQ ID NO: 379979 - protein, 10 aa, Influenza virus
HQNEQGMGMA

SEQ ID NO: 379980 - protein, 10 aa, Influenza virus
QNEQGMGMAA

SEQ ID NO: 379981 - protein, 10 aa, Influenza virus
NEQGTGIAAE

SEQ ID NO: 379982 - protein, 10 aa, Influenza virus
EQGTGIAAEK

SEQ ID NO: 379983 - protein, 10 aa, Influenza virus
QGTGIAAEKE

SEQ ID NO: 379984 - protein, 10 aa, Influenza virus
GTGIAAEKES

SEQ ID NO: 379985 - protein, 10 aa, Influenza virus
TGIAAEKEST

SEQ ID NO: 379986 - protein, 10 aa, Influenza virus
IRGEFSQVER

SEQ ID NO: 379987 - protein, 10 aa, Influenza virus
RGEFSQVERR

SEQ ID NO: 379988 - protein, 10 aa, Influenza virus
GEFSQVERRI

SEQ ID NO: 379989 - protein, 10 aa, Influenza virus
EFSQVERRIN

SEQ ID NO: 379990 - protein, 10 aa, Influenza virus
FSQVERRINM

SEQ ID NO: 379991 - protein, 10 aa, Influenza virus
SQVERRINML

SEQ ID NO: 379992 - protein, 10 aa, Influenza virus
QVERRINMLA

SEQ ID NO: 379993 - protein, 10 aa, Influenza virus
VERRINMLAD

SEQ ID NO: 379994 - protein, 10 aa, Influenza virus
ERRINMLADR

SEQ ID NO: 379995 - protein, 10 aa, Influenza virus
RRINMLADRI

SEQ ID NO: 379996 - protein, 10 aa, Influenza virus
TLDLHDANVR

SEQ ID NO: 379997 - protein, 10 aa, Influenza virus
LNMHDANVRN

SEQ ID NO: 379998 - protein, 10 aa, Influenza virus
NMHDANVRNL

SEQ ID NO: 379999 - protein, 10 aa, Influenza virus
ANVRNLHDQI

SEQ ID NO: 380000 - protein, 10 aa, Influenza virus
NVRNLHEQIK

SEQ ID NO: 380001 - protein, 10 aa, Influenza virus
LHKCNDSCMD

SEQ ID NO: 380002 - protein, 10 aa, Influenza virus
HKCNNTCMET

SEQ ID NO: 380003 - protein, 10 aa, Influenza virus
KCNNTCMETI

SEQ ID NO: 380004 - protein, 10 aa, Influenza virus
CNNTCMETIR

SEQ ID NO: 380005 - protein, 10 aa, Influenza virus
NDSCMDTIRN

SEQ ID NO: 380006 - protein, 10 aa, Influenza virus
NTCMETIRNG

SEQ ID NO: 380007 - protein, 10 aa, Influenza virus
TIRNGTYNHI

SEQ ID NO: 380008 - protein, 10 aa, Influenza virus
LKRQEIEGIR

SEQ ID NO: 380009 - protein, 10 aa, Influenza virus
KRQEIEGIRL

SEQ ID NO: 380010 - protein, 10 aa, Influenza virus
RQEIEGIKLE

SEQ ID NO: 380011 - protein, 10 aa, Influenza virus
QEIEGIRLKS

SEQ ID NO: 380012 - protein, 10 aa, Influenza virus
SEDGVYKALS

SEQ ID NO: 380013 - protein, 10 aa, Influenza virus
EDGVYKALSI

SEQ ID NO: 380014 - protein, 10 aa, Influenza virus
DNVYRALSIY

SEQ ID NO: 380015 - protein, 10 aa, Influenza virus
NVYRALSIYS

SEQ ID NO: 380016 - protein, 10 aa, Influenza virus
IASSVVLVGP

SEQ ID NO: 380017 - protein, 10 aa, Influenza virus
ASSVVLVGPI

SEQ ID NO: 380018 - protein, 10 aa, Influenza virus
SSVVLVGPIL

SEQ ID NO: 380019 - protein, 10 aa, Influenza virus
VLVGPILSFI

SEQ ID NO: 380020 - protein, 10 aa, Influenza virus
LVGLILTFIM

SEQ ID NO: 380021 - protein, 10 aa, Influenza virus
VGPILSFIMW

SEQ ID NO: 380022 - protein, 10 aa, Influenza virus
GPILSFIMWA

SEQ ID NO: 380023 - protein, 10 aa, Influenza virus
PILSFIMWAG

SEQ ID NO: 380024 - protein, 10 aa, Influenza virus
FIMWACNSGN

SEQ ID NO: 380025 - protein, 10 aa, Influenza virus
IMWACNSGNC

SEQ ID NO: 380026 - protein, 10 aa, Influenza virus
MWACNSGNCR

SEQ ID NO: 380027 - protein, 10 aa, Influenza virus
WACNSGNCRF

SEQ ID NO: 380028 - protein, 10 aa, Influenza virus
EMKWLSSSGN

SEQ ID NO: 380029 - protein, 10 aa, Influenza virus
MKWLLSSKDN

SEQ ID NO: 380030 - protein, 10 aa, Influenza virus
KWLLSSKDNQ

SEQ ID NO: 380031 - protein, 10 aa, Influenza virus
WLSSSGNNQV

SEQ ID NO: 380032 - protein, 10 aa, Influenza virus
LSSSGNNQVF

SEQ ID NO: 380033 - protein, 10 aa, Influenza virus
LSSKDNQVFP

SEQ ID NO: 380034 - protein, 10 aa, Influenza virus
SSKDNQVFPQ

SEQ ID NO: 380035 - protein, 10 aa, Influenza virus
SKDNQVFPQL

SEQ ID NO: 380036 - protein, 10 aa, Influenza virus
KDNQVFPQLN

SEQ ID NO: 380037 - protein, 10 aa, Influenza virus
GRYSRADKIC

SEQ ID NO: 380038 - protein, 10 aa, Influenza virus
RYSRADKICI

SEQ ID NO: 380039 - protein, 10 aa, Influenza virus
GYLSNNATDT

SEQ ID NO: 380040 - protein, 10 aa, Influenza virus
YLSNNSTDKI

SEQ ID NO: 380041 - protein, 10 aa, Influenza virus
LSNNSTDKID

SEQ ID NO: 380042 - protein, 10 aa, Influenza virus
SNNSTDKIDT

SEQ ID NO: 380043 - protein, 10 aa, Influenza virus
NNSTDKIDTL

SEQ ID NO: 380044 - protein, 10 aa, Influenza virus
NSTDKIDTLT

SEQ ID NO: 380045 - protein, 10 aa, Influenza virus
STDKIDTLTE

SEQ ID NO: 380046 - protein, 10 aa, Influenza virus
TDKIDTLTET

SEQ ID NO: 380047 - protein, 10 aa, Influenza virus
DKVDTLTETG

SEQ ID NO: 380048 - protein, 10 aa, Influenza virus
KVDTLTETGV

SEQ ID NO: 380049 - protein, 10 aa, Influenza virus
YCSLNGISPV

SEQ ID NO: 380050 - protein, 10 aa, Influenza virus
CSLNGISPVH

SEQ ID NO: 380051 - protein, 10 aa, Influenza virus
SLNGISPVHL

SEQ ID NO: 380052 - protein, 10 aa, Influenza virus
LNGISPVHLG

SEQ ID NO: 380053 - protein, 10 aa, Influenza virus
NGISPVHLGD

SEQ ID NO: 380054 - protein, 10 aa, Influenza virus
GISPVHLGDC

SEQ ID NO: 380055 - protein, 10 aa, Influenza virus
ISPVHLGDCS

SEQ ID NO: 380056 - protein, 10 aa, Influenza virus
DPNAPHKLCY

SEQ ID NO: 380057 - protein, 10 aa, Influenza virus
PNAPHKLCYP

SEQ ID NO: 380058 - protein, 10 aa, Influenza virus
NAPHKLCYPG

SEQ ID NO: 380059 - protein, 10 aa, Influenza virus
APHKLCYPGE

SEQ ID NO: 380060 - protein, 10 aa, Influenza virus
KFCYPGELDN

SEQ ID NO: 380061 - protein, 10 aa, Influenza virus
FCYPGELDNN

SEQ ID NO: 380062 - protein, 10 aa, Influenza virus
CYPGEVDNNG

SEQ ID NO: 380063 - protein, 10 aa, Influenza virus
YPGEVDNNGE

SEQ ID NO: 380064 - protein, 10 aa, Influenza virus
FSRTELINPN

SEQ ID NO: 380065 - protein, 10 aa, Influenza virus
SRTELINPNK

SEQ ID NO: 380066 - protein, 10 aa, Influenza virus
RTELINPNKW

SEQ ID NO: 380067 - protein, 10 aa, Influenza virus
TELINPNKWG

SEQ ID NO: 380068 - protein, 10 aa, Influenza virus
PNKWGNVLDG

SEQ ID NO: 380069 - protein, 10 aa, Influenza virus
NKWGNVLDGV

SEQ ID NO: 380070 - protein, 10 aa, Influenza virus
KWGDILDGVT

SEQ ID NO: 380071 - protein, 10 aa, Influenza virus
WGDILDGVTA

SEQ ID NO: 380072 - protein, 10 aa, Influenza virus
GDILDGVTAS

SEQ ID NO: 380073 - protein, 10 aa, Influenza virus
DILDGVTASC

SEQ ID NO: 380074 - protein, 10 aa, Influenza virus
DGVTASCRDN

SEQ ID NO: 380075 - protein, 10 aa, Influenza virus
GVTASCRDNG

SEQ ID NO: 380076 - protein, 10 aa, Influenza virus
VTASCRDNGA

SEQ ID NO: 380077 - protein, 10 aa, Influenza virus
FYRNLIWLVK

SEQ ID NO: 380078 - protein, 10 aa, Influenza virus
VRGDYNNTTG

SEQ ID NO: 380079 - protein, 10 aa, Influenza virus
WGIHHPDTEE

SEQ ID NO: 380080 - protein, 10 aa, Influenza virus
GIHHPDTEAV

SEQ ID NO: 380081 - protein, 10 aa, Influenza virus
IHHPDTEAVA

SEQ ID NO: 380082 - protein, 10 aa, Influenza virus
AINLYASKNP

SEQ ID NO: 380083 - protein, 10 aa, Influenza virus
INLYASKNPY

SEQ ID NO: 380084 - protein, 10 aa, Influenza virus
NLYASKNPYT

SEQ ID NO: 380085 - protein, 10 aa, Influenza virus
WMKLYWHLMS

SEQ ID NO: 380086 - protein, 10 aa, Influenza virus
MKLYWHLMSP

SEQ ID NO: 380087 - protein, 10 aa, Influenza virus
KLYWHLMSPG

SEQ ID NO: 380088 - protein, 10 aa, Influenza virus
LYWHLMSPGE

SEQ ID NO: 380089 - protein, 10 aa, Influenza virus
WHLMRPGERT

SEQ ID NO: 380090 - protein, 10 aa, Influenza virus
PGERTTFESN

SEQ ID NO: 380091 - protein, 10 aa, Influenza virus
GERTTFESNG

SEQ ID NO: 380092 - protein, 10 aa, Influenza virus
ERTTFESNGG

SEQ ID NO: 380093 - protein, 10 aa, Influenza virus
RTTFESNGGL

SEQ ID NO: 380094 - protein, 10 aa, Influenza virus
TFESSGGLLA

SEQ ID NO: 380095 - protein, 10 aa, Influenza virus
GTGRIFQSRI

SEQ ID NO: 380096 - protein, 10 aa, Influenza virus
TGRIFQSRIR

SEQ ID NO: 380097 - protein, 10 aa, Influenza virus
GRIFQSRIRM

SEQ ID NO: 380098 - protein, 10 aa, Influenza virus
RIFQSGVRVA

SEQ ID NO: 380099 - protein, 10 aa, Influenza virus
RMGKCNTKCQ

SEQ ID NO: 380100 - protein, 10 aa, Influenza virus
VARCNTKCQT

SEQ ID NO: 380101 - protein, 10 aa, Influenza virus
RCNTKCQTSL

SEQ ID NO: 380102 - protein, 10 aa, Influenza virus
TKCQTSMGGV

SEQ ID NO: 380103 - protein, 10 aa, Influenza virus
SERGLFGAIA

SEQ ID NO: 380104 - protein, 10 aa, Influenza virus
ADKVSTQKAL

SEQ ID NO: 380105 - protein, 10 aa, Influenza virus
DKVSTQKAIN

SEQ ID NO: 380106 - protein, 10 aa, Influenza virus
KVSTQKAINE

SEQ ID NO: 380107 - protein, 10 aa, Influenza virus
VSTQKAINEI

SEQ ID NO: 380108 - protein, 10 aa, Influenza virus
VLLENGRTLG

SEQ ID NO: 380109 - protein, 10 aa, Influenza virus
LLENGRTLGL

SEQ ID NO: 380110 - protein, 10 aa, Influenza virus
LENGRTLGLH

SEQ ID NO: 380111 - protein, 10 aa, Influenza virus
HDANVKNLHD

SEQ ID NO: 380112 - protein, 10 aa, Influenza virus
DANVKNLHDQ

SEQ ID NO: 380113 - protein, 10 aa, Influenza virus
ANVRNLHDQI

SEQ ID NO: 380114 - protein, 10 aa, Influenza virus
NVKNLHEQVK

SEQ ID NO: 380115 - protein, 10 aa, Influenza virus
VKNLHEQVKR

SEQ ID NO: 380116 - protein, 10 aa, Influenza virus
LQNNAIDEGD

SEQ ID NO: 380117 - protein, 10 aa, Influenza virus
QNNAIDEGDG

SEQ ID NO: 380118 - protein, 10 aa, Influenza virus
IDEGDGCFNF

SEQ ID NO: 380119 - protein, 10 aa, Influenza virus
DEGDGCFNFF

SEQ ID NO: 380120 - protein, 10 aa, Influenza virus
EGDGCFNFFH

SEQ ID NO: 380121 - protein, 10 aa, Influenza virus
GDGCFNFFHK

SEQ ID NO: 380122 - protein, 10 aa, Influenza virus
DGCFNFFHKC

SEQ ID NO: 380123 - protein, 10 aa, Influenza virus
GCFNFFHKCN

SEQ ID NO: 380124 - protein, 10 aa, Influenza virus
CFNFFHKCND

SEQ ID NO: 380125 - protein, 10 aa, Influenza virus
FNFFHKCNDS

SEQ ID NO: 380126 - protein, 10 aa, Influenza virus
NFFHKCNDSC

SEQ ID NO: 380127 - protein, 10 aa, Influenza virus
LKSEDNVYKV

SEQ ID NO: 380128 - protein, 10 aa, Influenza virus
KSEDNVYKVL

SEQ ID NO: 380129 - protein, 10 aa, Influenza virus
TEDNIYKILS

SEQ ID NO: 380130 - protein, 10 aa, Influenza virus
EDNVYKVLAI

SEQ ID NO: 380131 - protein, 10 aa, Influenza virus
DNVYKVLAIY

SEQ ID NO: 380132 - protein, 10 aa, Influenza virus
NVYKVLAIYS

SEQ ID NO: 380133 - protein, 10 aa, Influenza virus
IYKILSIYSC

SEQ ID NO: 380134 - protein, 10 aa, Influenza virus
AIYSCIASSI

SEQ ID NO: 380135 - protein, 10 aa, Influenza virus
YSCIASSTVL

SEQ ID NO: 380136 - protein, 10 aa, Influenza virus
SCIASSTVLV

SEQ ID NO: 380137 - protein, 10 aa, Influenza virus
CIASSTVLVG

SEQ ID NO: 380138 - protein, 10 aa, Influenza virus
IASSTVLVGL

SEQ ID NO: 380139 - protein, 10 aa, Influenza virus
ASSTVLVGLI

SEQ ID NO: 380140 - protein, 10 aa, Influenza virus
SSTVLVGLIL

SEQ ID NO: 380141 - protein, 10 aa, Influenza virus
STVLVGLILA

SEQ ID NO: 380142 - protein, 10 aa, Influenza virus
TVLVGLILAF

SEQ ID NO: 380143 - protein, 10 aa, Influenza virus
FIMWACSNGN

SEQ ID NO: 380144 - protein, 10 aa, Influenza virus
IMWACSNGNC

SEQ ID NO: 380145 - protein, 10 aa, Influenza virus
MWACSNGNCR

SEQ ID NO: 380146 - protein, 10 aa, Influenza virus
ACSSGNCRFS

SEQ ID NO: 380147 - protein, 10 aa, Influenza virus
CSSGNCRFSV

SEQ ID NO: 380148 - protein, 10 aa, Influenza virus
SNGNCRFNVC

SEQ ID NO: 380149 - protein, 10 aa, Influenza virus
NGNCRFNVCI

SEQ ID NO: 380150 - protein, 10 aa, Influenza virus
ATKMKAIIVV

SEQ ID NO: 380151 - protein, 10 aa, Influenza virus
TKMKAIIVVL

SEQ ID NO: 380152 - protein, 10 aa, Influenza virus
FIENGWEGMV

SEQ ID NO: 380153 - protein, 10 aa, Influenza virus
IENGWEGMVD

SEQ ID NO: 380154 - protein, 10 aa, Influenza virus
ENGWEGMVDG

SEQ ID NO: 380155 - protein, 10 aa, Influenza virus
NGWEGMVDGW

SEQ ID NO: 380156 - protein, 10 aa, Influenza virus
GWEGMVDGWY

SEQ ID NO: 380157 - protein, 10 aa, Influenza virus
WEGMVDGWYG

SEQ ID NO: 380158 - protein, 10 aa, Influenza virus
EGMVDGWYGF

SEQ ID NO: 380159 - protein, 10 aa, Influenza virus
GMVDGWYGFR

SEQ ID NO: 380160 - protein, 10 aa, Influenza virus
MVDGWYGFRH

SEQ ID NO: 380161 - protein, 10 aa, Influenza virus
NGWYGFQHQN

SEQ ID NO: 380162 - protein, 10 aa, Influenza virus
YNAQLLVLLE

SEQ ID NO: 380163 - protein, 10 aa, Influenza virus
NAQLLVLLEN

SEQ ID NO: 380164 - protein, 10 aa, Influenza virus
HGSLQCRICI

SEQ ID NO: 380165 - protein, 10 aa, Influenza virus
LQCRICILDQ

SEQ ID NO: 380166 - protein, 10 aa, Influenza virus
RCTISLVKTT

SEQ ID NO: 380167 - protein, 10 aa, Influenza virus
KMKAIIVVLL

SEQ ID NO: 380168 - protein, 10 aa, Influenza virus
STDTVDTVRE

SEQ ID NO: 380169 - protein, 10 aa, Influenza virus
TDTVDTLLEK

SEQ ID NO: 380170 - protein, 10 aa, Influenza virus
DTVDTLLEKN

SEQ ID NO: 380171 - protein, 10 aa, Influenza virus
TVDTLLEKNV

SEQ ID NO: 380172 - protein, 10 aa, Influenza virus
VDTLLEKNVT

SEQ ID NO: 380173 - protein, 10 aa, Influenza virus
DTLLEKNVTV

SEQ ID NO: 380174 - protein, 10 aa, Influenza virus
TLLEKNVTVT

SEQ ID NO: 380175 - protein, 10 aa, Influenza virus
LLEKNVTVTH

SEQ ID NO: 380176 - protein, 10 aa, Influenza virus
VAGWLLGNPE

SEQ ID NO: 380177 - protein, 10 aa, Influenza virus
NYEELREHLS

SEQ ID NO: 380178 - protein, 10 aa, Influenza virus
YEELREHLSS

SEQ ID NO: 380179 - protein, 10 aa, Influenza virus
EELREHLSSV

SEQ ID NO: 380180 - protein, 10 aa, Influenza virus
ELREHLSSVS

SEQ ID NO: 380181 - protein, 10 aa, Influenza virus
LREHLSSVSS

SEQ ID NO: 380182 - protein, 10 aa, Influenza virus
REHLSSVSSF

SEQ ID NO: 380183 - protein, 10 aa, Influenza virus
EQLSSVSSFK

SEQ ID NO: 380184 - protein, 10 aa, Influenza virus
HLSSVSSFER

SEQ ID NO: 380185 - protein, 10 aa, Influenza virus
LSSVSSFKRF

SEQ ID NO: 380186 - protein, 10 aa, Influenza virus
SSVSSFKRFE

SEQ ID NO: 380187 - protein, 10 aa, Influenza virus
SVSSFERFEM

SEQ ID NO: 380188 - protein, 10 aa, Influenza virus
VSSFKRFEIF

SEQ ID NO: 380189 - protein, 10 aa, Influenza virus
SFERFEIFPN

SEQ ID NO: 380190 - protein, 10 aa, Influenza virus
DTIIFEASGN

SEQ ID NO: 380191 - protein, 10 aa, Influenza virus
TIIFEASGNL

SEQ ID NO: 380192 - protein, 10 aa, Influenza virus
FEATGNLLVP

SEQ ID NO: 380193 - protein, 10 aa, Influenza virus
ITIGKCSKYV

SEQ ID NO: 380194 - protein, 10 aa, Influenza virus
TIGKCSKYVK

SEQ ID NO: 380195 - protein, 10 aa, Influenza virus
GECPKYVRST

SEQ ID NO: 380196 - protein, 10 aa, Influenza virus
QLRMATGLRN

SEQ ID NO: 380197 - protein, 10 aa, Influenza virus
LRLATGLRNI

SEQ ID NO: 380198 - protein, 10 aa, Influenza virus
RLATGLRNIP

SEQ ID NO: 380199 - protein, 10 aa, Influenza virus
LATGLRNIPS

SEQ ID NO: 380200 - protein, 10 aa, Influenza virus
VTGLRNVPSI

SEQ ID NO: 380201 - protein, 10 aa, Influenza virus
VPSVQSRGLF

SEQ ID NO: 380202 - protein, 10 aa, Influenza virus
EQGSGYAADR

SEQ ID NO: 380203 - protein, 10 aa, Influenza virus
NKVNTVIEKM

SEQ ID NO: 380204 - protein, 10 aa, Influenza virus
NSVVEKMNTQ

SEQ ID NO: 380205 - protein, 10 aa, Influenza virus
SVVEKMNTQF

SEQ ID NO: 380206 - protein, 10 aa, Influenza virus
VVEKMNTQFT

SEQ ID NO: 380207 - protein, 10 aa, Influenza virus
VEKMNTQFTA

SEQ ID NO: 380208 - protein, 10 aa, Influenza virus
EKMNTQFTSV

SEQ ID NO: 380209 - protein, 10 aa, Influenza virus
KMNTQFTSVG

SEQ ID NO: 380210 - protein, 10 aa, Influenza virus
MNTQFTVVGK

SEQ ID NO: 380211 - protein, 10 aa, Influenza virus
NTQFTVVGKE

SEQ ID NO: 380212 - protein, 10 aa, Influenza virus
TQFTSVGKEF

SEQ ID NO: 380213 - protein, 10 aa, Influenza virus
RIENLNRKVD

SEQ ID NO: 380214 - protein, 10 aa, Influenza virus
IENLNRKVDD

SEQ ID NO: 380215 - protein, 10 aa, Influenza virus
NLNRKVDDGF

SEQ ID NO: 380216 - protein, 10 aa, Influenza virus
LNKKVDDGLL

SEQ ID NO: 380217 - protein, 10 aa, Influenza virus
NKKVDDGLLD

SEQ ID NO: 380218 - protein, 10 aa, Influenza virus
DDGLLDVWTY

SEQ ID NO: 380219 - protein, 10 aa, Influenza virus
DGLLDVWTYN

SEQ ID NO: 380220 - protein, 10 aa, Influenza virus
GLLDVWTYNA

SEQ ID NO: 380221 - protein, 10 aa, Influenza virus
LLDVWTYNAE

SEQ ID NO: 380222 - protein, 10 aa, Influenza virus
IDVWTYNAEL

SEQ ID NO: 380223 - protein, 10 aa, Influenza virus
NERTLDFHDF

SEQ ID NO: 380224 - protein, 10 aa, Influenza virus
CFEFYHKCNN

SEQ ID NO: 380225 - protein, 10 aa, Influenza virus
MESIKNGTYD

SEQ ID NO: 380226 - protein, 10 aa, Influenza virus
ESIKNGTYDY

SEQ ID NO: 380227 - protein, 10 aa, Influenza virus
IKNGTYDYPK

SEQ ID NO: 380228 - protein, 10 aa, Influenza virus
YDYPKYSKES

SEQ ID NO: 380229 - protein, 10 aa, Influenza virus
YPKYSKESKL

SEQ ID NO: 380230 - protein, 10 aa, Influenza virus
VHQILAIYST

SEQ ID NO: 380231 - protein, 10 aa, Influenza virus
YSTVASSLIL

SEQ ID NO: 380232 - protein, 10 aa, Influenza virus
ASSLVLIVSL

SEQ ID NO: 380233 - protein, 10 aa, Influenza virus
SSLVLIVSLG

SEQ ID NO: 380234 - protein, 10 aa, Influenza virus
SLVLIVSLGA

SEQ ID NO: 380235 - protein, 10 aa, Influenza virus
LLVSLGAVSF

SEQ ID NO: 380236 - protein, 10 aa, Influenza virus
LVSLGAVSFW

SEQ ID NO: 380237 - protein, 10 aa, Influenza virus
AIGFWMCSNG

SEQ ID NO: 380238 - protein, 10 aa, Influenza virus
IGFWMCSNGS

SEQ ID NO: 380239 - protein, 10 aa, Influenza virus
CSGHSCRICI

SEQ ID NO: 380240 - protein, 10 aa, Influenza virus
SWSLQCRICI

SEQ ID NO: 380241 - protein, 10 aa, Influenza virus
HGSLQCRICI

SEQ ID NO: 380242 - protein, 10 aa, Influenza virus
GWAIHTKDNS

SEQ ID NO: 380243 - protein, 10 aa, Influenza virus
SKDNGIRIGS

SEQ ID NO: 380244 - protein, 10 aa, Influenza virus
KDNGVRIGSK

SEQ ID NO: 380245 - protein, 10 aa, Influenza virus
DNGVRIGSKG

SEQ ID NO: 380246 - protein, 10 aa, Influenza virus
NGVRIGSKGD

SEQ ID NO: 380247 - protein, 10 aa, Influenza virus
GIRIGSKGDV

SEQ ID NO: 380248 - protein, 10 aa, Influenza virus
IGSKGDVFVM

SEQ ID NO: 380249 - protein, 10 aa, Influenza virus
GSKGDVFVMR

SEQ ID NO: 380250 - protein, 10 aa, Influenza virus
SKGDVFVMRE

SEQ ID NO: 380251 - protein, 10 aa, Influenza virus
KGDVFVMREP

SEQ ID NO: 380252 - protein, 10 aa, Influenza virus
IREPFISCSQ

SEQ ID NO: 380253 - protein, 10 aa, Influenza virus
REPFISCSHF

SEQ ID NO: 380254 - protein, 10 aa, Influenza virus
EPFISCSHFE

SEQ ID NO: 380255 - protein, 10 aa, Influenza virus
PFISCSHFEC

SEQ ID NO: 380256 - protein, 10 aa, Influenza virus
LNDKHSNGTA

SEQ ID NO: 380257 - protein, 10 aa, Influenza virus
NDKHSNGTAK

SEQ ID NO: 380258 - protein, 10 aa, Influenza virus
HSNGTVKNRS

SEQ ID NO: 380259 - protein, 10 aa, Influenza virus
KNRSPYRALM

SEQ ID NO: 380260 - protein, 10 aa, Influenza virus
NRSPYRALMS

SEQ ID NO: 380261 - protein, 10 aa, Influenza virus
RALMSCPIGE

SEQ ID NO: 380262 - protein, 10 aa, Influenza virus
LMSCPVGEAP

SEQ ID NO: 380263 - protein, 10 aa, Influenza virus
MSCPVGEAPS

SEQ ID NO: 380264 - protein, 10 aa, Influenza virus
SCPVGEAPSP

SEQ ID NO: 380265 - protein, 10 aa, Influenza virus
CPVGEAPSPY

SEQ ID NO: 380266 - protein, 10 aa, Influenza virus
PVGEAPSPYN

SEQ ID NO: 380267 - protein, 10 aa, Influenza virus
VGEAPSPYNS

SEQ ID NO: 380268 - protein, 10 aa, Influenza virus
WSASACHDGL

SEQ ID NO: 380269 - protein, 10 aa, Influenza virus
GWITIGISGP

SEQ ID NO: 380270 - protein, 10 aa, Influenza virus
ITIGISGPDN

SEQ ID NO: 380271 - protein, 10 aa, Influenza virus
VLKYNDIITD

SEQ ID NO: 380272 - protein, 10 aa, Influenza virus
LKYNDIITDT

SEQ ID NO: 380273 - protein, 10 aa, Influenza virus
DIITDTIKSW

SEQ ID NO: 380274 - protein, 10 aa, Influenza virus
KILRTQESEC

SEQ ID NO: 380275 - protein, 10 aa, Influenza virus
RTQESECVCI

SEQ ID NO: 380276 - protein, 10 aa, Influenza virus
TQESECVCIN

SEQ ID NO: 380277 - protein, 10 aa, Influenza virus
QESECVCING

SEQ ID NO: 380278 - protein, 10 aa, Influenza virus
ESECVCINGS

SEQ ID NO: 380279 - protein, 10 aa, Influenza virus
SECVCINGSC

SEQ ID NO: 380280 - protein, 10 aa, Influenza virus
CFTIMTDGPN

SEQ ID NO: 380281 - protein, 10 aa, Influenza virus
APNSHYEECS

SEQ ID NO: 380282 - protein, 10 aa, Influenza virus
PNSHYEECSC

SEQ ID NO: 380283 - protein, 10 aa, Influenza virus
NSHYEECSCY

SEQ ID NO: 380284 - protein, 10 aa, Influenza virus
SHYEECSCYP

SEQ ID NO: 380285 - protein, 10 aa, Influenza virus
YEECSCYPES

SEQ ID NO: 380286 - protein, 10 aa, Influenza virus
IICVCRDNWH

SEQ ID NO: 380287 - protein, 10 aa, Influenza virus
MCVCRDNWHA

SEQ ID NO: 380288 - protein, 10 aa, Influenza virus
ASNRPWVSFN

SEQ ID NO: 380289 - protein, 10 aa, Influenza virus
ANRPWVSFNQ

SEQ ID NO: 380290 - protein, 10 aa, Influenza virus
NRPWISFDQN

SEQ ID NO: 380291 - protein, 10 aa, Influenza virus
RPWISFDQNL

SEQ ID NO: 380292 - protein, 10 aa, Influenza virus
VGYICSGVFG

SEQ ID NO: 380293 - protein, 10 aa, Influenza virus
SGVLGDNPRP

SEQ ID NO: 380294 - protein, 10 aa, Influenza virus
GAYGVKGFSF

SEQ ID NO: 380295 - protein, 10 aa, Influenza virus
GVKGFSYKYD

SEQ ID NO: 380296 - protein, 10 aa, Influenza virus
KGFSYKYDNG

SEQ ID NO: 380297 - protein, 10 aa, Influenza virus
GFSYKYDNGV

SEQ ID NO: 380298 - protein, 10 aa, Influenza virus
FSYKYDNGVW

SEQ ID NO: 380299 - protein, 10 aa, Influenza virus
KYGNGVWMGR

SEQ ID NO: 380300 - protein, 10 aa, Influenza virus
GVWMGRTKSN

SEQ ID NO: 380301 - protein, 10 aa, Influenza virus
TNWSGYSGSF

SEQ ID NO: 380302 - protein, 10 aa, Influenza virus
VQHPELTGMD

SEQ ID NO: 380303 - protein, 10 aa, Influenza virus
QHPELTGMDC

SEQ ID NO: 380304 - protein, 10 aa, Influenza virus
HPELTGLNCI

SEQ ID NO: 380305 - protein, 10 aa, Influenza virus
NCIKPCFWVE

SEQ ID NO: 380306 - protein, 10 aa, Influenza virus
MRPCFWVELV

SEQ ID NO: 380307 - protein, 10 aa, Influenza virus
TIWTSGSIIS

SEQ ID NO: 380308 - protein, 10 aa, Influenza virus
IWTSASSISF

SEQ ID NO: 380309 - protein, 10 aa, Influenza virus
ASSISFCGVN

SEQ ID NO: 380310 - protein, 10 aa, Influenza virus
SIISFCGVNS

SEQ ID NO: 380311 - protein, 10 aa, Influenza virus
WPDGAELPFA

SEQ ID NO: 380312 - protein, 10 aa, Influenza virus
PDGAELPFAI

SEQ ID NO: 380313 - protein, 10 aa, Influenza virus
DPICIGYHAN

SEQ ID NO: 380314 - protein, 10 aa, Influenza virus
TLCICYHANN

SEQ ID NO: 380315 - protein, 10 aa, Influenza virus
KNVTVTHAVN

SEQ ID NO: 380316 - protein, 10 aa, Influenza virus
NVTVTHAVNL

SEQ ID NO: 380317 - protein, 10 aa, Influenza virus
VTVTHAVNLL

SEQ ID NO: 380318 - protein, 10 aa, Influenza virus
PFQNIHPITI

SEQ ID NO: 380319 - protein, 10 aa, Influenza virus
FQNIHPITIG

SEQ ID NO: 380320 - protein, 10 aa, Influenza virus
HPVTIGKCPK

SEQ ID NO: 380321 - protein, 10 aa, Influenza virus
PVTIGKCPKY

SEQ ID NO: 380322 - protein, 10 aa, Influenza virus
VTIGKCPKYV

SEQ ID NO: 380323 - protein, 10 aa, Influenza virus
SIHSRGLFGA

SEQ ID NO: 380324 - protein, 10 aa, Influenza virus
IQSKGLFGAI

SEQ ID NO: 380325 - protein, 10 aa, Influenza virus
HSRGLFGAIA

SEQ ID NO: 380326 - protein, 10 aa, Influenza virus
FEGGWTGMID

SEQ ID NO: 380327 - protein, 10 aa, Influenza virus
NEQGSGYAAN

SEQ ID NO: 380328 - protein, 10 aa, Influenza virus
ENLNRKVDDG

SEQ ID NO: 380329 - protein, 10 aa, Influenza virus
DIWTYNAEML

SEQ ID NO: 380330 - protein, 10 aa, Influenza virus
IWTYNAELLI

SEQ ID NO: 380331 - protein, 10 aa, Influenza virus
NERTLDFHDF

SEQ ID NO: 380332 - protein, 10 aa, Influenza virus
ERTLDFHDFN

SEQ ID NO: 380333 - protein, 10 aa, Influenza virus
RTLDFHDFNV

SEQ ID NO: 380334 - protein, 10 aa, Influenza virus
NNAREIGNGC

SEQ ID NO: 380335 - protein, 10 aa, Influenza virus
NAKETGNGCF

SEQ ID NO: 380336 - protein, 10 aa, Influenza virus
AKEIGNGCFK

SEQ ID NO: 380337 - protein, 10 aa, Influenza virus
RELGNGCFEF

SEQ ID NO: 380338 - protein, 10 aa, Influenza virus
CFEFYHKCDN

SEQ ID NO: 380339 - protein, 10 aa, Influenza virus
CMESIKNGTY

SEQ ID NO: 380340 - protein, 10 aa, Influenza virus
SFWMCPNGSL

SEQ ID NO: 380341 - protein, 10 aa, Influenza virus
MCPNGSLQCK

SEQ ID NO: 380342 - protein, 10 aa, Influenza virus
CSNGSLHGRI

SEQ ID NO: 380343 - protein, 10 aa, Influenza virus
IAGFAPFSKD

SEQ ID NO: 380344 - protein, 10 aa, Influenza virus
TGFAPFSEDN

SEQ ID NO: 380345 - protein, 10 aa, Influenza virus
SVRLSAGGDI

SEQ ID NO: 380346 - protein, 10 aa, Influenza virus
VRLSAGGDIW

SEQ ID NO: 380347 - protein, 10 aa, Influenza virus
RLSAGGAVWV

SEQ ID NO: 380348 - protein, 10 aa, Influenza virus
LSAGGDIWAT

SEQ ID NO: 380349 - protein, 10 aa, Influenza virus
SAGGAVWVTR

SEQ ID NO: 380350 - protein, 10 aa, Influenza virus
ASGDIWVTRE

SEQ ID NO: 380351 - protein, 10 aa, Influenza virus
GGDIWATREP

SEQ ID NO: 380352 - protein, 10 aa, Influenza virus
GDIWVTRKPY

SEQ ID NO: 380353 - protein, 10 aa, Influenza virus
DIWATREPYV

SEQ ID NO: 380354 - protein, 10 aa, Influenza virus
FALGQGTTLS

SEQ ID NO: 380355 - protein, 10 aa, Influenza virus
ALGQGTTLKN

SEQ ID NO: 380356 - protein, 10 aa, Influenza virus
DRTSYRTLLM

SEQ ID NO: 380357 - protein, 10 aa, Influenza virus
PHRTLLMSEL

SEQ ID NO: 380358 - protein, 10 aa, Influenza virus
LGVPFYLGTR

SEQ ID NO: 380359 - protein, 10 aa, Influenza virus
PFYLGTRQVC

SEQ ID NO: 380360 - protein, 10 aa, Influenza virus
LGTKQVCMAW

SEQ ID NO: 380361 - protein, 10 aa, Influenza virus
GTKQVCMAWS

SEQ ID NO: 380362 - protein, 10 aa, Influenza virus
TKQVCMAWSS

SEQ ID NO: 380363 - protein, 10 aa, Influenza virus
KQVCMAWSSS

SEQ ID NO: 380364 - protein, 10 aa, Influenza virus
SSSSCHDGKS

SEQ ID NO: 380365 - protein, 10 aa, Influenza virus
SSSCHDGKSW

SEQ ID NO: 380366 - protein, 10 aa, Influenza virus
SSCHDGKSWL

SEQ ID NO: 380367 - protein, 10 aa, Influenza virus
SCHDGKSWLH

SEQ ID NO: 380368 - protein, 10 aa, Influenza virus
CHDGKSWLHV

SEQ ID NO: 380369 - protein, 10 aa, Influenza virus
HDGKSWLHVC

SEQ ID NO: 380370 - protein, 10 aa, Influenza virus
KILRTHESEC

SEQ ID NO: 380371 - protein, 10 aa, Influenza virus
RTHESECVCI

SEQ ID NO: 380372 - protein, 10 aa, Influenza virus
TCAVVMTDGS

SEQ ID NO: 380373 - protein, 10 aa, Influenza virus
TVIMIDGSAS

SEQ ID NO: 380374 - protein, 10 aa, Influenza virus
VVMTDGSVSG

SEQ ID NO: 380375 - protein, 10 aa, Influenza virus
GNAQHVEECS

SEQ ID NO: 380376 - protein, 10 aa, Influenza virus
NAQHVEECSC

SEQ ID NO: 380377 - protein, 10 aa, Influenza virus
VEECSCYPRS

SEQ ID NO: 380378 - protein, 10 aa, Influenza virus
EEGSVYPRFL

SEQ ID NO: 380379 - protein, 10 aa, Influenza virus
VRCICRDNWR

SEQ ID NO: 380380 - protein, 10 aa, Influenza virus
NWRGSNRPIV

SEQ ID NO: 380381 - protein, 10 aa, Influenza virus
WRGSNRPIVD

SEQ ID NO: 380382 - protein, 10 aa, Influenza virus
RGSNRPIVDI

SEQ ID NO: 380383 - protein, 10 aa, Influenza virus
GDHGVKGWAF

SEQ ID NO: 380384 - protein, 10 aa, Influenza virus
DHGVKGWAFD

SEQ ID NO: 380385 - protein, 10 aa, Influenza virus
RLGYETFKVV

SEQ ID NO: 380386 - protein, 10 aa, Influenza virus
SGYFGVFSVE

SEQ ID NO: 380387 - protein, 10 aa, Influenza virus
SCVNRCFYVE

SEQ ID NO: 380388 - protein, 10 aa, Influenza virus
FYVELIRGRP

SEQ ID NO: 380389 - protein, 10 aa, Influenza virus
VWWTSTSIVV

SEQ ID NO: 380390 - protein, 10 aa, Influenza virus
LWTSNSIVEF

SEQ ID NO: 380391 - protein, 10 aa, Influenza virus
SNSIVVFCST

SEQ ID NO: 380392 - protein, 10 aa, Influenza virus
TSIVVFCGTS

SEQ ID NO: 380393 - protein, 10 aa, Influenza virus
SIVEFCGTSG

SEQ ID NO: 380394 - protein, 10 aa, Influenza virus
IVEFCGTSGT

SEQ ID NO: 380395 - protein, 10 aa, Influenza virus
VVFCGTSGTC

SEQ ID NO: 380396 - protein, 10 aa, Influenza virus
VFCGASGTYG

SEQ ID NO: 380397 - protein, 10 aa, Influenza virus
GTYGKGSWPD

SEQ ID NO: 380398 - protein, 10 aa, Influenza virus
MDNKTKKMTI

SEQ ID NO: 380399 - protein, 10 aa, Influenza virus
DNQTKKMTIT

SEQ ID NO: 380400 - protein, 10 aa, Influenza virus
KQTKTMTITF

SEQ ID NO: 380401 - protein, 10 aa, Influenza virus
GDRICIGYHA

SEQ ID NO: 380402 - protein, 10 aa, Influenza virus
DRICIGYHAN

SEQ ID NO: 380403 - protein, 10 aa, Influenza virus
RICIGYHANN

SEQ ID NO: 380404 - protein, 10 aa, Influenza virus
IGYHSNNSTK

SEQ ID NO: 380405 - protein, 10 aa, Influenza virus
GYHANNSTER

SEQ ID NO: 380406 - protein, 10 aa, Influenza virus
EKNVTVTHAQ

SEQ ID NO: 380407 - protein, 10 aa, Influenza virus
NITVTHAKDI

SEQ ID NO: 380408 - protein, 10 aa, Influenza virus
ITVTHAKDIL

SEQ ID NO: 380409 - protein, 10 aa, Influenza virus
VTHAQDILER

SEQ ID NO: 380410 - protein, 10 aa, Influenza virus
DILERTHNGK

SEQ ID NO: 380411 - protein, 10 aa, Influenza virus
ILEKMHNGKL

SEQ ID NO: 380412 - protein, 10 aa, Influenza virus
LEKAHNGKLC

SEQ ID NO: 380413 - protein, 10 aa, Influenza virus
HNGKLCKLSG

SEQ ID NO: 380414 - protein, 10 aa, Influenza virus
GVPPLELGDC

SEQ ID NO: 380415 - protein, 10 aa, Influenza virus
VPPLELGDCS

SEQ ID NO: 380416 - protein, 10 aa, Influenza virus
WLLGNPKCDR

SEQ ID NO: 380417 - protein, 10 aa, Influenza virus
LLGNPECDLF

SEQ ID NO: 380418 - protein, 10 aa, Influenza virus
LGNPECDLFL

SEQ ID NO: 380419 - protein, 10 aa, Influenza virus
VPEWSYIIEK

SEQ ID NO: 380420 - protein, 10 aa, Influenza virus
PEWSYIIEKE

SEQ ID NO: 380421 - protein, 10 aa, Influenza virus
RSYNNTSGKQ

SEQ ID NO: 380422 - protein, 10 aa, Influenza virus
SYNNTSGKQM

SEQ ID NO: 380423 - protein, 10 aa, Influenza virus
YNNTSGKQML

SEQ ID NO: 380424 - protein, 10 aa, Influenza virus
ISFESTGNLV

SEQ ID NO: 380425 - protein, 10 aa, Influenza virus
SFESTGNLVA

SEQ ID NO: 380426 - protein, 10 aa, Influenza virus
YGFKISKRGN

SEQ ID NO: 380427 - protein, 10 aa, Influenza virus
GFRISKRGSS

SEQ ID NO: 380428 - protein, 10 aa, Influenza virus
FRISKRGSSG

SEQ ID NO: 380429 - protein, 10 aa, Influenza virus
RISKRGSSGI

SEQ ID NO: 380430 - protein, 10 aa, Influenza virus
ISKRGNSGIM

SEQ ID NO: 380431 - protein, 10 aa, Influenza virus
SKRGNSGIMK

SEQ ID NO: 380432 - protein, 10 aa, Influenza virus
KRGNSGIMKT

SEQ ID NO: 380433 - protein, 10 aa, Influenza virus
CETKCQSPLG

SEQ ID NO: 380434 - protein, 10 aa, Influenza virus
ETKCQSPLGA

SEQ ID NO: 380435 - protein, 10 aa, Influenza virus
TKCQTPLGAL

SEQ ID NO: 380436 - protein, 10 aa, Influenza virus
KCQTPLGALN

SEQ ID NO: 380437 - protein, 10 aa, Influenza virus
TIGECPKYVR

SEQ ID NO: 380438 - protein, 10 aa, Influenza virus
PQTESRGLFG

SEQ ID NO: 380439 - protein, 10 aa, Influenza virus
QIEARGLFGA

SEQ ID NO: 380440 - protein, 10 aa, Influenza virus
TESRGLFGAI

SEQ ID NO: 380441 - protein, 10 aa, Influenza virus
NLEKRLGNLN

SEQ ID NO: 380442 - protein, 10 aa, Influenza virus
ERRLENLSKR

SEQ ID NO: 380443 - protein, 10 aa, Influenza virus
RLENLDKKME

SEQ ID NO: 380444 - protein, 10 aa, Influenza virus
LENLSKRMED

SEQ ID NO: 380445 - protein, 10 aa, Influenza virus
ENLSKRMEDG

SEQ ID NO: 380446 - protein, 10 aa, Influenza virus
NLNKKMEDGL

SEQ ID NO: 380447 - protein, 10 aa, Influenza virus
VWTYNTELLV

SEQ ID NO: 380448 - protein, 10 aa, Influenza virus
LMENERTLEF

SEQ ID NO: 380449 - protein, 10 aa, Influenza virus
MENERTLEFH

SEQ ID NO: 380450 - protein, 10 aa, Influenza virus
ENERTLEFHD

SEQ ID NO: 380451 - protein, 10 aa, Influenza virus
NERTLGFHDS

SEQ ID NO: 380452 - protein, 10 aa, Influenza virus
ERILDFHDSN

SEQ ID NO: 380453 - protein, 10 aa, Influenza virus
RILDFHDSNV

SEQ ID NO: 380454 - protein, 10 aa, Influenza virus
TLDFHDSSVK

SEQ ID NO: 380455 - protein, 10 aa, Influenza virus
LDYHDSNVKN

SEQ ID NO: 380456 - protein, 10 aa, Influenza virus
DYHDSNVKNL

SEQ ID NO: 380457 - protein, 10 aa, Influenza virus
YHDSNVKNLY

SEQ ID NO: 380458 - protein, 10 aa, Influenza virus
HDSNVKSLYD

SEQ ID NO: 380459 - protein, 10 aa, Influenza virus
NLYEKVRMQL

SEQ ID NO: 380460 - protein, 10 aa, Influenza virus
LYEKVRMQLR

SEQ ID NO: 380461 - protein, 10 aa, Influenza virus
YEKVRMQLRD

SEQ ID NO: 380462 - protein, 10 aa, Influenza virus
EKVRMQLRDN

SEQ ID NO: 380463 - protein, 10 aa, Influenza virus
KVRMQLKDNA

SEQ ID NO: 380464 - protein, 10 aa, Influenza virus
VKMQLRDNAK

SEQ ID NO: 380465 - protein, 10 aa, Influenza virus
KMQLRDNAKE

SEQ ID NO: 380466 - protein, 10 aa, Influenza virus
MQLKDNAKEV

SEQ ID NO: 380467 - protein, 10 aa, Influenza virus
QLRDNAKETG

SEQ ID NO: 380468 - protein, 10 aa, Influenza virus
DNAKETGNGC

SEQ ID NO: 380469 - protein, 10 aa, Influenza virus
NAKETGNGCF

SEQ ID NO: 380470 - protein, 10 aa, Influenza virus
AKETGNGCFE

SEQ ID NO: 380471 - protein, 10 aa, Influenza virus
KETGNGCFEF

SEQ ID NO: 380472 - protein, 10 aa, Influenza virus
EVGNGCFEFY

SEQ ID NO: 380473 - protein, 10 aa, Influenza virus
VGNGCFEFYH

SEQ ID NO: 380474 - protein, 10 aa, Influenza virus
YHKCDDECMS

SEQ ID NO: 380475 - protein, 10 aa, Influenza virus
HKCDDECMSS

SEQ ID NO: 380476 - protein, 10 aa, Influenza virus
NGTYYYPKYE

SEQ ID NO: 380477 - protein, 10 aa, Influenza virus
GTYYYPKYEE

SEQ ID NO: 380478 - protein, 10 aa, Influenza virus
TYYYPKYEEE

SEQ ID NO: 380479 - protein, 10 aa, Influenza virus
YYYPKYEEES

SEQ ID NO: 380480 - protein, 10 aa, Influenza virus
PKYEEESRLN

SEQ ID NO: 380481 - protein, 10 aa, Influenza virus
YEEESRLNRN

SEQ ID NO: 380482 - protein, 10 aa, Influenza virus
EEESRLNRNE

SEQ ID NO: 380483 - protein, 10 aa, Influenza virus
EESRLNRNEI

SEQ ID NO: 380484 - protein, 10 aa, Influenza virus
ESRLNRNEIK

SEQ ID NO: 380485 - protein, 10 aa, Influenza virus
SRLNRNEIKG

SEQ ID NO: 380486 - protein, 10 aa, Influenza virus
SLAIMIAGIF

SEQ ID NO: 380487 - protein, 10 aa, Influenza virus
AGIFLWMCSN

SEQ ID NO: 380488 - protein, 10 aa, Influenza virus
GIFLWMCSNG

SEQ ID NO: 380489 - protein, 10 aa, Influenza virus
IFLWMCSNGS

SEQ ID NO: 380490 - protein, 10 aa, Influenza virus
FLWMCSNGSL

SEQ ID NO: 380491 - protein, 10 aa, Influenza virus
VKGDRICIGY

SEQ ID NO: 380492 - protein, 10 aa, Influenza virus
KGDRICIGYH

SEQ ID NO: 380493 - protein, 10 aa, Influenza virus
GDRICIGYHA

SEQ ID NO: 380494 - protein, 10 aa, Influenza virus
DRICIGYHAN

SEQ ID NO: 380495 - protein, 10 aa, Influenza virus
RICIGYHANN

SEQ ID NO: 380496 - protein, 10 aa, Influenza virus
GYHSNNSTKK

SEQ ID NO: 380497 - protein, 10 aa, Influenza virus
KADTILERNV

SEQ ID NO: 380498 - protein, 10 aa, Influenza virus
VTHAQNILEK

SEQ ID NO: 380499 - protein, 10 aa, Influenza virus
THAKDILEKA

SEQ ID NO: 380500 - protein, 10 aa, Influenza virus
HAKDILEKAH

SEQ ID NO: 380501 - protein, 10 aa, Influenza virus
AQDILERTHN

SEQ ID NO: 380502 - protein, 10 aa, Influenza virus
KDILEKAHNG

SEQ ID NO: 380503 - protein, 10 aa, Influenza virus
NILEKTHNGR

SEQ ID NO: 380504 - protein, 10 aa, Influenza virus
ERTHNGKLCK

SEQ ID NO: 380505 - protein, 10 aa, Influenza virus
KAHNGKLCRL

SEQ ID NO: 380506 - protein, 10 aa, Influenza virus
AHNGKLCRLS

SEQ ID NO: 380507 - protein, 10 aa, Influenza virus
GNPECDRLLN

SEQ ID NO: 380508 - protein, 10 aa, Influenza virus
VPEWSYIIEK

SEQ ID NO: 380509 - protein, 10 aa, Influenza virus
PEWSYIIEKE

SEQ ID NO: 380510 - protein, 10 aa, Influenza virus
EWSYIVEKEN

SEQ ID NO: 380511 - protein, 10 aa, Influenza virus
WSYIVEKENP

SEQ ID NO: 380512 - protein, 10 aa, Influenza virus
LCYPGSLNDY

SEQ ID NO: 380513 - protein, 10 aa, Influenza virus
CYPGSLNDYE

SEQ ID NO: 380514 - protein, 10 aa, Influenza virus
YPGNFNDYEE

SEQ ID NO: 380515 - protein, 10 aa, Influenza virus
PGSLNDYEEL

SEQ ID NO: 380516 - protein, 10 aa, Influenza virus
GSLNDYEELK

SEQ ID NO: 380517 - protein, 10 aa, Influenza virus
VRHFEKVKIL

SEQ ID NO: 380518 - protein, 10 aa, Influenza virus
HFEKIKILPR

SEQ ID NO: 380519 - protein, 10 aa, Influenza virus
FEKVKILARN

SEQ ID NO: 380520 - protein, 10 aa, Influenza virus
AKGSYNNTNG

SEQ ID NO: 380521 - protein, 10 aa, Influenza virus
RGSYNNTSGE

SEQ ID NO: 380522 - protein, 10 aa, Influenza virus
NNTSGEQVLV

SEQ ID NO: 380523 - protein, 10 aa, Influenza virus
NTSGEQVLVI

SEQ ID NO: 380524 - protein, 10 aa, Influenza virus
TSGKQMLIIW

SEQ ID NO: 380525 - protein, 10 aa, Influenza virus
SGEQVLVIWG

SEQ ID NO: 380526 - protein, 10 aa, Influenza virus
IWGVHHPKDE

SEQ ID NO: 380527 - protein, 10 aa, Influenza virus
LYQNVETYVS

SEQ ID NO: 380528 - protein, 10 aa, Influenza virus
LDTINFESTG

SEQ ID NO: 380529 - protein, 10 aa, Influenza virus
DTISFESTGN

SEQ ID NO: 380530 - protein, 10 aa, Influenza virus
TISFESTGNL

SEQ ID NO: 380531 - protein, 10 aa, Influenza virus
ISFESTGNLV

SEQ ID NO: 380532 - protein, 10 aa, Influenza virus
SFESTGNLVA

SEQ ID NO: 380533 - protein, 10 aa, Influenza virus
RISKRGSSGI

SEQ ID NO: 380534 - protein, 10 aa, Influenza virus
RGSSGVMKTE

SEQ ID NO: 380535 - protein, 10 aa, Influenza virus
SGVMKTEGTL

SEQ ID NO: 380536 - protein, 10 aa, Influenza virus
NCDTKCQTPL

SEQ ID NO: 380537 - protein, 10 aa, Influenza virus
CETQCQTPLG

SEQ ID NO: 380538 - protein, 10 aa, Influenza virus
ETQCQTPLGA

SEQ ID NO: 380539 - protein, 10 aa, Influenza virus
TQCQTPLGAI

SEQ ID NO: 380540 - protein, 10 aa, Influenza virus
TIGECPRYVK

SEQ ID NO: 380541 - protein, 10 aa, Influenza virus
GECPRYVKSE

SEQ ID NO: 380542 - protein, 10 aa, Influenza virus
ECPKYVRSEK

SEQ ID NO: 380543 - protein, 10 aa, Influenza virus
CPKYVRSEKL

SEQ ID NO: 380544 - protein, 10 aa, Influenza virus
PKYVRSEKLV

SEQ ID NO: 380545 - protein, 10 aa, Influenza virus
KYVRSEKLVL

SEQ ID NO: 380546 - protein, 10 aa, Influenza virus
YVRSEKLVLA

SEQ ID NO: 380547 - protein, 10 aa, Influenza virus
VRSEKLVLAT

SEQ ID NO: 380548 - protein, 10 aa, Influenza virus
RSEKLVLATG

SEQ ID NO: 380549 - protein, 10 aa, Influenza virus
SEKLVLATGP

SEQ ID NO: 380550 - protein, 10 aa, Influenza virus
EKLVLATGPR

SEQ ID NO: 380551 - protein, 10 aa, Influenza virus
LVLAIGLRNV

SEQ ID NO: 380552 - protein, 10 aa, Influenza virus
VLATGLRNAH

SEQ ID NO: 380553 - protein, 10 aa, Influenza virus
LATGLRNAHK

SEQ ID NO: 380554 - protein, 10 aa, Influenza virus
ATGLRNVPQM

SEQ ID NO: 380555 - protein, 10 aa, Influenza virus
TGPRNVPQIE

SEQ ID NO: 380556 - protein, 10 aa, Influenza virus
RNAHKMESRG

SEQ ID NO: 380557 - protein, 10 aa, Influenza virus
NAHKMESRGL

SEQ ID NO: 380558 - protein, 10 aa, Influenza virus
AHKMESRGLF

SEQ ID NO: 380559 - protein, 10 aa, Influenza virus
HKMESRGLFG

SEQ ID NO: 380560 - protein, 10 aa, Influenza virus
QIEPRGLFGA

SEQ ID NO: 380561 - protein, 10 aa, Influenza virus
ADKESTQRAF

SEQ ID NO: 380562 - protein, 10 aa, Influenza virus
NFVIEKMNTQ

SEQ ID NO: 380563 - protein, 10 aa, Influenza virus
AVEKEFSNLE

SEQ ID NO: 380564 - protein, 10 aa, Influenza virus
KEFNNLEKRL

SEQ ID NO: 380565 - protein, 10 aa, Influenza virus
EFNNLEKRLE

SEQ ID NO: 380566 - protein, 10 aa, Influenza virus
FNNLEKRLEN

SEQ ID NO: 380567 - protein, 10 aa, Influenza virus
NNLEKRLENL

SEQ ID NO: 380568 - protein, 10 aa, Influenza virus
NLERRLENLS

SEQ ID NO: 380569 - protein, 10 aa, Influenza virus
LERRLENLSK

SEQ ID NO: 380570 - protein, 10 aa, Influenza virus
EKRLGNLNKK

SEQ ID NO: 380571 - protein, 10 aa, Influenza virus
RLGNLNKKME

SEQ ID NO: 380572 - protein, 10 aa, Influenza virus
LENLDKKMED

SEQ ID NO: 380573 - protein, 10 aa, Influenza virus
ENLDKKMEDG

SEQ ID NO: 380574 - protein, 10 aa, Influenza virus
NLNKKMEDGL

SEQ ID NO: 380575 - protein, 10 aa, Influenza virus
MEDGFRDVWT

SEQ ID NO: 380576 - protein, 10 aa, Influenza virus
EDGFLGVWTY

SEQ ID NO: 380577 - protein, 10 aa, Influenza virus
DGFLGVWTYN

SEQ ID NO: 380578 - protein, 10 aa, Influenza virus
GFLGVWTYNA

SEQ ID NO: 380579 - protein, 10 aa, Influenza virus
FLGVWTYNAE

SEQ ID NO: 380580 - protein, 10 aa, Influenza virus
LDVWTYNTEL

SEQ ID NO: 380581 - protein, 10 aa, Influenza virus
ERTLDFHDSS

SEQ ID NO: 380582 - protein, 10 aa, Influenza virus
RTLGFHDSNV

SEQ ID NO: 380583 - protein, 10 aa, Influenza virus
ILDFHDSNVK

SEQ ID NO: 380584 - protein, 10 aa, Influenza virus
LDFHDSSVKN

SEQ ID NO: 380585 - protein, 10 aa, Influenza virus
GFHDSNVKNL

SEQ ID NO: 380586 - protein, 10 aa, Influenza virus
HDSNVKNLYE

SEQ ID NO: 380587 - protein, 10 aa, Influenza virus
VKNLYEKVRM

SEQ ID NO: 380588 - protein, 10 aa, Influenza virus
KNLYEKVRMQ

SEQ ID NO: 380589 - protein, 10 aa, Influenza virus
NLYEKVRMQL

SEQ ID NO: 380590 - protein, 10 aa, Influenza virus
LYDRVRMQLR

SEQ ID NO: 380591 - protein, 10 aa, Influenza virus
YDRVRMQLRD

SEQ ID NO: 380592 - protein, 10 aa, Influenza virus
DRVRMQLRDN

SEQ ID NO: 380593 - protein, 10 aa, Influenza virus
LRDNVKELGD

SEQ ID NO: 380594 - protein, 10 aa, Influenza virus
RDNVKELGDG

SEQ ID NO: 380595 - protein, 10 aa, Influenza virus
CMSSVKNGTY

SEQ ID NO: 380596 - protein, 10 aa, Influenza virus
KTGTYDYPKY

SEQ ID NO: 380597 - protein, 10 aa, Influenza virus
TGTYDYPKYE

SEQ ID NO: 380598 - protein, 10 aa, Influenza virus
GTYNYPKYEE

SEQ ID NO: 380599 - protein, 10 aa, Influenza virus
TYDYPKYEKE

SEQ ID NO: 380600 - protein, 10 aa, Influenza virus
YDYSKYEEES

SEQ ID NO: 380601 - protein, 10 aa, Influenza virus
NYPKYEEESR

SEQ ID NO: 380602 - protein, 10 aa, Influenza virus
PKYEKESKLN

SEQ ID NO: 380603 - protein, 10 aa, Influenza virus
KYEEESKLNK

SEQ ID NO: 380604 - protein, 10 aa, Influenza virus
YEEESKLNKN

SEQ ID NO: 380605 - protein, 10 aa, Influenza virus
EEESKLNKNE

SEQ ID NO: 380606 - protein, 10 aa, Influenza virus
KESKLNRNEI

SEQ ID NO: 380607 - protein, 10 aa, Influenza virus
RLNRNEIKGI

SEQ ID NO: 380608 - protein, 10 aa, Influenza virus
LNRNEIKGIK

SEQ ID NO: 380609 - protein, 10 aa, Influenza virus
NKNEIKGVKL

SEQ ID NO: 380610 - protein, 10 aa, Influenza virus
KGVKLSSMGI

SEQ ID NO: 380611 - protein, 10 aa, Influenza virus
GVKLSSMGIY

SEQ ID NO: 380612 - protein, 10 aa, Influenza virus
VKLSSMGIYQ

SEQ ID NO: 380613 - protein, 10 aa, Influenza virus
KLSSMGIYQI

SEQ ID NO: 380614 - protein, 10 aa, Influenza virus
LSSMGIYQIL

SEQ ID NO: 380615 - protein, 10 aa, Influenza virus
SSMGIYQILA

SEQ ID NO: 380616 - protein, 10 aa, Influenza virus
SMGIYQILAI

SEQ ID NO: 380617 - protein, 10 aa, Influenza virus
SLAIMIAGIF

SEQ ID NO: 380618 - protein, 10 aa, Influenza virus
AGIFFWMCSN

SEQ ID NO: 380619 - protein, 10 aa, Influenza virus
GIFFWMCSNG

SEQ ID NO: 380620 - protein, 10 aa, Influenza virus
IFFWMCSNGS

SEQ ID NO: 380621 - protein, 10 aa, Influenza virus
FFWMCSNGSL

SEQ ID NO: 380622 - protein, 10 aa, Influenza virus
PNQKIITIDS

SEQ ID NO: 380623 - protein, 10 aa, Influenza virus
NQKIITIGFV

SEQ ID NO: 380624 - protein, 10 aa, Influenza virus
QKIITMGSVS

SEQ ID NO: 380625 - protein, 10 aa, Influenza virus
KIITMGSVSL

SEQ ID NO: 380626 - protein, 10 aa, Influenza virus
QIAILATTIT

SEQ ID NO: 380627 - protein, 10 aa, Influenza virus
IAILATTITL

SEQ ID NO: 380628 - protein, 10 aa, Influenza virus
AILAATVTLH

SEQ ID NO: 380629 - protein, 10 aa, Influenza virus
ILAATVTLHF

SEQ ID NO: 380630 - protein, 10 aa, Influenza virus
LAATVTLHFK

SEQ ID NO: 380631 - protein, 10 aa, Influenza virus
ATTITLHFKQ

SEQ ID NO: 380632 - protein, 10 aa, Influenza virus
ATVTLHFKQH

SEQ ID NO: 380633 - protein, 10 aa, Influenza virus
TVTLHFKQHD

SEQ ID NO: 380634 - protein, 10 aa, Influenza virus
VTLHFKQHDC

SEQ ID NO: 380635 - protein, 10 aa, Influenza virus
TLHFKQHDCD

SEQ ID NO: 380636 - protein, 10 aa, Influenza virus
PCEPTIIERN

SEQ ID NO: 380637 - protein, 10 aa, Influenza virus
WSKPQCHITG

SEQ ID NO: 380638 - protein, 10 aa, Influenza virus
SKTQCQITGF

SEQ ID NO: 380639 - protein, 10 aa, Influenza virus
KPQCHITGFA

SEQ ID NO: 380640 - protein, 10 aa, Influenza virus
TQCQITGFAP

SEQ ID NO: 380641 - protein, 10 aa, Influenza virus
RLSASGDIWV

SEQ ID NO: 380642 - protein, 10 aa, Influenza virus
LSAGGDIWVM

SEQ ID NO: 380643 - protein, 10 aa, Influenza virus
SAGGDIWVMR

SEQ ID NO: 380644 - protein, 10 aa, Influenza virus
GGGDIWVTRE

SEQ ID NO: 380645 - protein, 10 aa, Influenza virus
SGDIWVTREP

SEQ ID NO: 380646 - protein, 10 aa, Influenza virus
VMREPYVSCN

SEQ ID NO: 380647 - protein, 10 aa, Influenza virus
TREPYVSCDS

SEQ ID NO: 380648 - protein, 10 aa, Influenza virus
NKCYQFALGQ

SEQ ID NO: 380649 - protein, 10 aa, Influenza virus
TTLNNKHSNG

SEQ ID NO: 380650 - protein, 10 aa, Influenza virus
TLENKHSNGT

SEQ ID NO: 380651 - protein, 10 aa, Influenza virus
LNNKHSNGTI

SEQ ID NO: 380652 - protein, 10 aa, Influenza virus
NNKHSNGTIH

SEQ ID NO: 380653 - protein, 10 aa, Influenza virus
NKHSNGTKHD

SEQ ID NO: 380654 - protein, 10 aa, Influenza virus
KHSNGTKHDR

SEQ ID NO: 380655 - protein, 10 aa, Influenza virus
TKHDRIPHRT

SEQ ID NO: 380656 - protein, 10 aa, Influenza virus
KHDRIPHRTL

SEQ ID NO: 380657 - protein, 10 aa, Influenza virus
FHLGTRQVCV

SEQ ID NO: 380658 - protein, 10 aa, Influenza virus
HLGTRQVCVA

SEQ ID NO: 380659 - protein, 10 aa, Influenza virus
LGTRQVCVAW

SEQ ID NO: 380660 - protein, 10 aa, Influenza virus
GTRQVCVAWS

SEQ ID NO: 380661 - protein, 10 aa, Influenza virus
TRQVCVAWSS

SEQ ID NO: 380662 - protein, 10 aa, Influenza virus
RQVCVAWSSS

SEQ ID NO: 380663 - protein, 10 aa, Influenza virus
DGKAWLHICV

SEQ ID NO: 380664 - protein, 10 aa, Influenza virus
GKAWLHICVT

SEQ ID NO: 380665 - protein, 10 aa, Influenza virus
KAWLHICVTG

SEQ ID NO: 380666 - protein, 10 aa, Influenza virus
TWLHVCVTGD

SEQ ID NO: 380667 - protein, 10 aa, Influenza virus
CITGDDRNAT

SEQ ID NO: 380668 - protein, 10 aa, Influenza virus
ITGDDRNATA

SEQ ID NO: 380669 - protein, 10 aa, Influenza virus
GDDENATASF

SEQ ID NO: 380670 - protein, 10 aa, Influenza virus
YEKNATASFI

SEQ ID NO: 380671 - protein, 10 aa, Influenza virus
DENATASFIY

SEQ ID NO: 380672 - protein, 10 aa, Influenza virus
NATASFIYGG

SEQ ID NO: 380673 - protein, 10 aa, Influenza virus
DSISSWSQNI

SEQ ID NO: 380674 - protein, 10 aa, Influenza virus
SVGSWSQNIL

SEQ ID NO: 380675 - protein, 10 aa, Influenza virus
IGSWSHNILR

SEQ ID NO: 380676 - protein, 10 aa, Influenza virus
ESECVCISGT

SEQ ID NO: 380677 - protein, 10 aa, Influenza virus
SECVCISGTC

SEQ ID NO: 380678 - protein, 10 aa, Influenza virus
ECVCISGTCA

SEQ ID NO: 380679 - protein, 10 aa, Influenza virus
CVCISGTCAV

SEQ ID NO: 380680 - protein, 10 aa, Influenza virus
VCISGTCAVV

SEQ ID NO: 380681 - protein, 10 aa, Influenza virus
CISGTCAVVM

SEQ ID NO: 380682 - protein, 10 aa, Influenza virus
ISGTCAVVMT

SEQ ID NO: 380683 - protein, 10 aa, Influenza virus
SGTCAVVMTD

SEQ ID NO: 380684 - protein, 10 aa, Influenza virus
GTCAVVMTDG

SEQ ID NO: 380685 - protein, 10 aa, Influenza virus
TCAVVMTDGS

SEQ ID NO: 380686 - protein, 10 aa, Influenza virus
GRADTKILFI

SEQ ID NO: 380687 - protein, 10 aa, Influenza virus
ADTKILFIEE

SEQ ID NO: 380688 - protein, 10 aa, Influenza virus
DTRILFIREG

SEQ ID NO: 380689 - protein, 10 aa, Influenza virus
TRILFIREGK

SEQ ID NO: 380690 - protein, 10 aa, Influenza virus
EGKVVHISPL

SEQ ID NO: 380691 - protein, 10 aa, Influenza virus
VHISPLAGSA

SEQ ID NO: 380692 - protein, 10 aa, Influenza virus
HISPLAGSAQ

SEQ ID NO: 380693 - protein, 10 aa, Influenza virus
ISPLAGSAQH

SEQ ID NO: 380694 - protein, 10 aa, Influenza virus
SPLAGSAQHV

SEQ ID NO: 380695 - protein, 10 aa, Influenza virus
ECSCYPQYPD

SEQ ID NO: 380696 - protein, 10 aa, Influenza virus
CSCYSRYPNV

SEQ ID NO: 380697 - protein, 10 aa, Influenza virus
SCYSRYPNVR

SEQ ID NO: 380698 - protein, 10 aa, Influenza virus
CYSRYPNVRC

SEQ ID NO: 380699 - protein, 10 aa, Influenza virus
YPDVRCVCRD

SEQ ID NO: 380700 - protein, 10 aa, Influenza virus
PDVRCVCRDN

SEQ ID NO: 380701 - protein, 10 aa, Influenza virus
DVRCVCRDNW

SEQ ID NO: 380702 - protein, 10 aa, Influenza virus
VRCTCRDNWK

SEQ ID NO: 380703 - protein, 10 aa, Influenza virus
RCICKDNWKG

SEQ ID NO: 380704 - protein, 10 aa, Influenza virus
CTCRDNWKGS

SEQ ID NO: 380705 - protein, 10 aa, Influenza virus
TCRDNWKGSN

SEQ ID NO: 380706 - protein, 10 aa, Influenza virus
GSNRPVLDIS

SEQ ID NO: 380707 - protein, 10 aa, Influenza virus
DINIAEYSID

SEQ ID NO: 380708 - protein, 10 aa, Influenza virus
INIAEYSIDS

SEQ ID NO: 380709 - protein, 10 aa, Influenza virus
DYSIDSGYVC

SEQ ID NO: 380710 - protein, 10 aa, Influenza virus
YSIDSGYVCS

SEQ ID NO: 380711 - protein, 10 aa, Influenza virus
SIDSNYVCSG

SEQ ID NO: 380712 - protein, 10 aa, Influenza virus
IDSNYVCSGL

SEQ ID NO: 380713 - protein, 10 aa, Influenza virus
DSNYVCSGLV

SEQ ID NO: 380714 - protein, 10 aa, Influenza virus
SNYVCSGLVG

SEQ ID NO: 380715 - protein, 10 aa, Influenza virus
NYVCSGLVGD

SEQ ID NO: 380716 - protein, 10 aa, Influenza virus
VGDTPRNNDG

SEQ ID NO: 380717 - protein, 10 aa, Influenza virus
GDTPRNGDSS

SEQ ID NO: 380718 - protein, 10 aa, Influenza virus
DTPRNGDSSS

SEQ ID NO: 380719 - protein, 10 aa, Influenza virus
SNSNCKDPNN

SEQ ID NO: 380720 - protein, 10 aa, Influenza virus
NSNCKDPNNE

SEQ ID NO: 380721 - protein, 10 aa, Influenza virus
SNCKDPNNER

SEQ ID NO: 380722 - protein, 10 aa, Influenza virus
NCKDPNNERG

SEQ ID NO: 380723 - protein, 10 aa, Influenza virus
PNNERGTQGV

SEQ ID NO: 380724 - protein, 10 aa, Influenza virus
NNERGTQGVK

SEQ ID NO: 380725 - protein, 10 aa, Influenza virus
NERGTQGVKG

SEQ ID NO: 380726 - protein, 10 aa, Influenza virus
ERGTQGVKGW

SEQ ID NO: 380727 - protein, 10 aa, Influenza virus
RGTQGVKGWA

SEQ ID NO: 380728 - protein, 10 aa, Influenza virus
GYPGVKGWAF

SEQ ID NO: 380729 - protein, 10 aa, Influenza virus
YPGVKGWAFD

SEQ ID NO: 380730 - protein, 10 aa, Influenza virus
PGVKGWAFDD

SEQ ID NO: 380731 - protein, 10 aa, Influenza virus
GVKGWAFDYG

SEQ ID NO: 380732 - protein, 10 aa, Influenza virus
GNDLWMGRTI

SEQ ID NO: 380733 - protein, 10 aa, Influenza virus
KESRSGYETF

SEQ ID NO: 380734 - protein, 10 aa, Influenza virus
ESRSGYETFK

SEQ ID NO: 380735 - protein, 10 aa, Influenza virus
ETFRVIGGWT

SEQ ID NO: 380736 - protein, 10 aa, Influenza virus
TFRVIGGWTT

SEQ ID NO: 380737 - protein, 10 aa, Influenza virus
SNNRSGYSGI

SEQ ID NO: 380738 - protein, 10 aa, Influenza virus
KNCINRCFYV

SEQ ID NO: 380739 - protein, 10 aa, Influenza virus
NCINRCFYVE

SEQ ID NO: 380740 - protein, 10 aa, Influenza virus
FYVELIRGRS

SEQ ID NO: 380741 - protein, 10 aa, Influenza virus
YVELIRGRSQ

SEQ ID NO: 380742 - protein, 10 aa, Influenza virus
VELIRGRSQE

SEQ ID NO: 380743 - protein, 10 aa, Influenza virus
SQETRVWWTS

SEQ ID NO: 380744 - protein, 10 aa, Influenza virus
GSWPDGANTN

SEQ ID NO: 380745 - protein, 10 aa, Influenza virus
SWPDGANIDF

SEQ ID NO: 380746 - protein, 10 aa, Influenza virus
WPDGANIDFM

SEQ ID NO: 380747 - protein, 10 aa, Influenza virus
PDGANIDFMP

SEQ ID NO: 380748 - protein, 10 aa, Influenza virus
DGANISFMPI

SEQ ID NO: 380749 - protein, 10 aa, Influenza virus
TAMLCLGHHA

SEQ ID NO: 380750 - protein, 10 aa, Influenza virus
TLCLGHHAVS

SEQ ID NO: 380751 - protein, 10 aa, Influenza virus
LCLGHHAVSN

SEQ ID NO: 380752 - protein, 10 aa, Influenza virus
CLGHHAVSNG

SEQ ID NO: 380753 - protein, 10 aa, Influenza virus
LGHHAVSNGT

SEQ ID NO: 380754 - protein, 10 aa, Influenza virus
DRIEVTNATE

SEQ ID NO: 380755 - protein, 10 aa, Influenza virus
RIEVTNATEL

SEQ ID NO: 380756 - protein, 10 aa, Influenza virus
VTNATELVQG

SEQ ID NO: 380757 - protein, 10 aa, Influenza virus
CTLVDALLGD

SEQ ID NO: 380758 - protein, 10 aa, Influenza virus
TLVDALLGDP

SEQ ID NO: 380759 - protein, 10 aa, Influenza virus
DSLLGDPHCD

SEQ ID NO: 380760 - protein, 10 aa, Influenza virus
TLRSLVASSG

SEQ ID NO: 380761 - protein, 10 aa, Influenza virus
LRSLVASSGN

SEQ ID NO: 380762 - protein, 10 aa, Influenza virus
RSIVASSGTV

SEQ ID NO: 380763 - protein, 10 aa, Influenza virus
SIVASSGTVE

SEQ ID NO: 380764 - protein, 10 aa, Influenza virus
SDKLYIWGVH

SEQ ID NO: 380765 - protein, 10 aa, Influenza virus
DKLYVWGIHH

SEQ ID NO: 380766 - protein, 10 aa, Influenza virus
CTGNLIAPRG

SEQ ID NO: 380767 - protein, 10 aa, Influenza virus
FECITPNGSI

SEQ ID NO: 380768 - protein, 10 aa, Influenza virus
GCITPNGSIP

SEQ ID NO: 380769 - protein, 10 aa, Influenza virus
ITPNGSIPNN

SEQ ID NO: 380770 - protein, 10 aa, Influenza virus
GSIPNNKPFQ

SEQ ID NO: 380771 - protein, 10 aa, Influenza virus
RPFQNVNKIT

SEQ ID NO: 380772 - protein, 10 aa, Influenza virus
ATGMRNVPET

SEQ ID NO: 380773 - protein, 10 aa, Influenza virus
IENGWEGMVN

SEQ ID NO: 380774 - protein, 10 aa, Influenza virus
ENGWEGMVNG

SEQ ID NO: 380775 - protein, 10 aa, Influenza virus
NGWEGMVNGW

SEQ ID NO: 380776 - protein, 10 aa, Influenza virus
GWEGMVNGWY

SEQ ID NO: 380777 - protein, 10 aa, Influenza virus
WEGMVNGWYG

SEQ ID NO: 380778 - protein, 10 aa, Influenza virus
EGMVNGWYGF

SEQ ID NO: 380779 - protein, 10 aa, Influenza virus
GMVNGWYGFR

SEQ ID NO: 380780 - protein, 10 aa, Influenza virus
MVDGWYGFRY

SEQ ID NO: 380781 - protein, 10 aa, Influenza virus
DGWYGFRHHN

SEQ ID NO: 380782 - protein, 10 aa, Influenza virus
GWYGFRHLNS

SEQ ID NO: 380783 - protein, 10 aa, Influenza virus
WYGFRHHNSE

SEQ ID NO: 380784 - protein, 10 aa, Influenza virus
YGFRHLNSEG

SEQ ID NO: 380785 - protein, 10 aa, Influenza virus
NSEGMGQAAD

SEQ ID NO: 380786 - protein, 10 aa, Influenza virus
SEGMGQAADL

SEQ ID NO: 380787 - protein, 10 aa, Influenza virus
EGMGQAADLK

SEQ ID NO: 380788 - protein, 10 aa, Influenza virus
GMGQAADLKS

SEQ ID NO: 380789 - protein, 10 aa, Influenza virus
MGQAADLKST

SEQ ID NO: 380790 - protein, 10 aa, Influenza virus
ADLKSTQAAV

SEQ ID NO: 380791 - protein, 10 aa, Influenza virus
DLKSTQAAVN

SEQ ID NO: 380792 - protein, 10 aa, Influenza virus
LKSTQAAVNQ

SEQ ID NO: 380793 - protein, 10 aa, Influenza virus
KSTQAAIDQV

SEQ ID NO: 380794 - protein, 10 aa, Influenza virus
IKKTNEKFHQ

SEQ ID NO: 380795 - protein, 10 aa, Influenza virus
KKTNEKFHQI

SEQ ID NO: 380796 - protein, 10 aa, Influenza virus
IDLWSYNADV

SEQ ID NO: 380797 - protein, 10 aa, Influenza virus
SYNAEFLVAL

SEQ ID NO: 380798 - protein, 10 aa, Influenza virus
YNAEFLVALE

SEQ ID NO: 380799 - protein, 10 aa, Influenza virus
NAEFLVALEN

SEQ ID NO: 380800 - protein, 10 aa, Influenza virus
AEFLVALENQ

SEQ ID NO: 380801 - protein, 10 aa, Influenza virus
ELLVALENQN

SEQ ID NO: 380802 - protein, 10 aa, Influenza virus
FLVALENQHT

SEQ ID NO: 380803 - protein, 10 aa, Influenza virus
AMENQHTIDL

SEQ ID NO: 380804 - protein, 10 aa, Influenza virus
LENQHTIDLA

SEQ ID NO: 380805 - protein, 10 aa, Influenza virus
NQHTIDLADS

SEQ ID NO: 380806 - protein, 10 aa, Influenza virus
QHTIDLADSE

SEQ ID NO: 380807 - protein, 10 aa, Influenza virus
HTIDLADSEM

SEQ ID NO: 380808 - protein, 10 aa, Influenza virus
TIHLTDSEMN

SEQ ID NO: 380809 - protein, 10 aa, Influenza virus
LADSEMNKLF

SEQ ID NO: 380810 - protein, 10 aa, Influenza virus
ADSEMNKLFE

SEQ ID NO: 380811 - protein, 10 aa, Influenza virus
TKRQLRENAE

SEQ ID NO: 380812 - protein, 10 aa, Influenza virus
KRQLRENAED

SEQ ID NO: 380813 - protein, 10 aa, Influenza virus
RQLRENAEDI

SEQ ID NO: 380814 - protein, 10 aa, Influenza virus
LRENAEDIGN

SEQ ID NO: 380815 - protein, 10 aa, Influenza virus
RENAEDIGNG

SEQ ID NO: 380816 - protein, 10 aa, Influenza virus
ENAEDIGNGC

SEQ ID NO: 380817 - protein, 10 aa, Influenza virus
NAEDMGDGCF

SEQ ID NO: 380818 - protein, 10 aa, Influenza virus
GCFKIYHRCD

SEQ ID NO: 380819 - protein, 10 aa, Influenza virus
CFRIYHKCDN

SEQ ID NO: 380820 - protein, 10 aa, Influenza virus
GYKNWILWIS

SEQ ID NO: 380821 - protein, 10 aa, Influenza virus
DWILWISFAM

SEQ ID NO: 380822 - protein, 10 aa, Influenza virus
WILWISFAMS

SEQ ID NO: 380823 - protein, 10 aa, Influenza virus
ILWISFAMSC

SEQ ID NO: 380824 - protein, 10 aa, Influenza virus
GFIMWTCQKG

SEQ ID NO: 380825 - protein, 10 aa, Influenza virus
FIMWTCQKGN

SEQ ID NO: 380826 - protein, 10 aa, Influenza virus
IMWTCQKGNI

SEQ ID NO: 380827 - protein, 10 aa, Influenza virus
VWACQRGNIR

SEQ ID NO: 380828 - protein, 10 aa, Influenza virus
ACQKGNIRCD

SEQ ID NO: 380829 - protein, 10 aa, Influenza virus
CQKGNIRCDI

SEQ ID NO: 380830 - protein, 10 aa, Influenza virus
QKGNIRCDIC

SEQ ID NO: 380831 - protein, 10 aa, Influenza virus
KGNIRCDICI

SEQ ID NO: 380832 - protein, 10 aa, Influenza virus
TAMLCLGHHA

SEQ ID NO: 380833 - protein, 10 aa, Influenza virus
HAVPNGTIVR

SEQ ID NO: 380834 - protein, 10 aa, Influenza virus
AVPNGTIVRT

SEQ ID NO: 380835 - protein, 10 aa, Influenza virus
VPNGTIVRTI

SEQ ID NO: 380836 - protein, 10 aa, Influenza virus
PNGTIVRTIT

SEQ ID NO: 380837 - protein, 10 aa, Influenza virus
DNIEVTNATE

SEQ ID NO: 380838 - protein, 10 aa, Influenza virus
LVDALLGDPH

SEQ ID NO: 380839 - protein, 10 aa, Influenza virus
VDALLGDPHC

SEQ ID NO: 380840 - protein, 10 aa, Influenza virus
TLRSLVASSG

SEQ ID NO: 380841 - protein, 10 aa, Influenza virus
LRSLVASSGN

SEQ ID NO: 380842 - protein, 10 aa, Influenza virus
RSLVASSGNL

SEQ ID NO: 380843 - protein, 10 aa, Influenza virus
SLVASSGNLE

SEQ ID NO: 380844 - protein, 10 aa, Influenza virus
LVASSGNLEF

SEQ ID NO: 380845 - protein, 10 aa, Influenza virus
FDKLYIWGIH

SEQ ID NO: 380846 - protein, 10 aa, Influenza virus
SVYWTIVKPG

SEQ ID NO: 380847 - protein, 10 aa, Influenza virus
VYWTIVKPGD

SEQ ID NO: 380848 - protein, 10 aa, Influenza virus
LIAPRGYYKM

SEQ ID NO: 380849 - protein, 10 aa, Influenza virus
FECITPNGSI

SEQ ID NO: 380850 - protein, 10 aa, Influenza virus
GCITPNGSIP

SEQ ID NO: 380851 - protein, 10 aa, Influenza virus
ITPNGSIPNN

SEQ ID NO: 380852 - protein, 10 aa, Influenza virus
TPNGSIPNGK

SEQ ID NO: 380853 - protein, 10 aa, Influenza virus
PNGSIPNGKP

SEQ ID NO: 380854 - protein, 10 aa, Influenza virus
NGSIPNGKPF

SEQ ID NO: 380855 - protein, 10 aa, Influenza virus
GSIPNGKPFQ

SEQ ID NO: 380856 - protein, 10 aa, Influenza virus
SIPNGKPFQN

SEQ ID NO: 380857 - protein, 10 aa, Influenza virus
PNGKPFQNVN

SEQ ID NO: 380858 - protein, 10 aa, Influenza virus
NGKPFQNVNR

SEQ ID NO: 380859 - protein, 10 aa, Influenza virus
QNVNRITYGV

SEQ ID NO: 380860 - protein, 10 aa, Influenza virus
NVNRITYGVC

SEQ ID NO: 380861 - protein, 10 aa, Influenza virus
VNRITYGVCP

SEQ ID NO: 380862 - protein, 10 aa, Influenza virus
YVKQKTLKLA

SEQ ID NO: 380863 - protein, 10 aa, Influenza virus
VKQKTLKLAT

SEQ ID NO: 380864 - protein, 10 aa, Influenza virus
ATGMRNVPER

SEQ ID NO: 380865 - protein, 10 aa, Influenza virus
TGMRNIPEKQ

SEQ ID NO: 380866 - protein, 10 aa, Influenza virus
GMRNIPEKQT

SEQ ID NO: 380867 - protein, 10 aa, Influenza virus
MRNIPEKQTR

SEQ ID NO: 380868 - protein, 10 aa, Influenza virus
RNIPEKQTRG

SEQ ID NO: 380869 - protein, 10 aa, Influenza virus
PERQTRGIFG

SEQ ID NO: 380870 - protein, 10 aa, Influenza virus
ERQTRGIFGA

SEQ ID NO: 380871 - protein, 10 aa, Influenza virus
RQTRGIFGAI

SEQ ID NO: 380872 - protein, 10 aa, Influenza virus
IENGWEGMVN

SEQ ID NO: 380873 - protein, 10 aa, Influenza virus
ENGWEGMVNG

SEQ ID NO: 380874 - protein, 10 aa, Influenza virus
NGWEGMVNGW

SEQ ID NO: 380875 - protein, 10 aa, Influenza virus
GWEGMVNGWY

SEQ ID NO: 380876 - protein, 10 aa, Influenza virus
WEGMVNGWYG

SEQ ID NO: 380877 - protein, 10 aa, Influenza virus
EGMVNGWYGF

SEQ ID NO: 380878 - protein, 10 aa, Influenza virus
GMVNGWYGFR

SEQ ID NO: 380879 - protein, 10 aa, Influenza virus
MVNGWYGFRH

SEQ ID NO: 380880 - protein, 10 aa, Influenza virus
VNGWYGFRHQ

SEQ ID NO: 380881 - protein, 10 aa, Influenza virus
RHHNSEGTGQ

SEQ ID NO: 380882 - protein, 10 aa, Influenza virus
SEGMGQAADL

SEQ ID NO: 380883 - protein, 10 aa, Influenza virus
DFKSTQAAIN

SEQ ID NO: 380884 - protein, 10 aa, Influenza virus
LKSTQAAITQ

SEQ ID NO: 380885 - protein, 10 aa, Influenza virus
KSTQAAVNQI

SEQ ID NO: 380886 - protein, 10 aa, Influenza virus
VEKTNEKFHQ

SEQ ID NO: 380887 - protein, 10 aa, Influenza virus
SYNAEILVAL

SEQ ID NO: 380888 - protein, 10 aa, Influenza virus
YNAEILVALE

SEQ ID NO: 380889 - protein, 10 aa, Influenza virus
NAEILVALEN

SEQ ID NO: 380890 - protein, 10 aa, Influenza virus
AEILVALENQ

SEQ ID NO: 380891 - protein, 10 aa, Influenza virus
ILVALENQHT

SEQ ID NO: 380892 - protein, 10 aa, Influenza virus
IDLADSEMNK

SEQ ID NO: 380893 - protein, 10 aa, Influenza virus
DMTDSEMNKL

SEQ ID NO: 380894 - protein, 10 aa, Influenza virus
DSEMSKLFEK

SEQ ID NO: 380895 - protein, 10 aa, Influenza virus
SEMSKLFEKT

SEQ ID NO: 380896 - protein, 10 aa, Influenza virus
KQLRENAEEM

SEQ ID NO: 380897 - protein, 10 aa, Influenza virus
AEDMGNGCFR

SEQ ID NO: 380898 - protein, 10 aa, Influenza virus
EDMGNGCFRI

SEQ ID NO: 380899 - protein, 10 aa, Influenza virus
DMGNGCFRIY

SEQ ID NO: 380900 - protein, 10 aa, Influenza virus
MGNGCFRIYH

SEQ ID NO: 380901 - protein, 10 aa, Influenza virus
GCFRIYHKCD

SEQ ID NO: 380902 - protein, 10 aa, Influenza virus
CFKIYHKCNN

SEQ ID NO: 380903 - protein, 10 aa, Influenza virus
CMESIRNGTY

SEQ ID NO: 380904 - protein, 10 aa, Influenza virus
IGSIRNETYD

SEQ ID NO: 380905 - protein, 10 aa, Influenza virus
GSIRNETYDH

SEQ ID NO: 380906 - protein, 10 aa, Influenza virus
SIRNETYDHD

SEQ ID NO: 380907 - protein, 10 aa, Influenza virus
YRDEALNNRS

SEQ ID NO: 380908 - protein, 10 aa, Influenza virus
RDEALNNRSQ

SEQ ID NO: 380909 - protein, 10 aa, Influenza virus
EALSNRFQIK

SEQ ID NO: 380910 - protein, 10 aa, Influenza virus
GYKDWFLWIS

SEQ ID NO: 380911 - protein, 10 aa, Influenza virus
DWILWISFAM

SEQ ID NO: 380912 - protein, 10 aa, Influenza virus
WILWISFAMS

SEQ ID NO: 380913 - protein, 10 aa, Influenza virus
ILWISFAMSC

SEQ ID NO: 380914 - protein, 10 aa, Influenza virus
LGFIVWACQR

SEQ ID NO: 380915 - protein, 10 aa, Influenza virus
GFIVWACQRG

SEQ ID NO: 380916 - protein, 10 aa, Influenza virus
FIVWACQRGN

SEQ ID NO: 380917 - protein, 10 aa, Influenza virus
IVWACQRGNI

SEQ ID NO: 380918 - protein, 10 aa, Influenza virus
VWACQRGNIR

SEQ ID NO: 380919 - protein, 10 aa, Influenza virus
ACQKGNIRCD

SEQ ID NO: 380920 - protein, 10 aa, Influenza virus
CQKGNIRCDI

SEQ ID NO: 380921 - protein, 10 aa, Influenza virus
QKGNIRCDIC

SEQ ID NO: 380922 - protein, 10 aa, Influenza virus
KGNIRCDICI

SEQ ID NO: 380923 - protein, 10 aa, Influenza virus
SIRLAAGGAI

SEQ ID NO: 380924 - protein, 10 aa, Influenza virus
IRLAAGGAIW

SEQ ID NO: 380925 - protein, 10 aa, Influenza virus
RLAAGGAIWV

SEQ ID NO: 380926 - protein, 10 aa, Influenza virus
LAAGGAIWVT

SEQ ID NO: 380927 - protein, 10 aa, Influenza virus
GGDIWVTRVP

SEQ ID NO: 380928 - protein, 10 aa, Influenza virus
GDIWVTRVPY

SEQ ID NO: 380929 - protein, 10 aa, Influenza virus
DIWVTRVPYV

SEQ ID NO: 380930 - protein, 10 aa, Influenza virus
VTREPYVSCG

SEQ ID NO: 380931 - protein, 10 aa, Influenza virus
NKCYQFALGQ

SEQ ID NO: 380932 - protein, 10 aa, Influenza virus
FHLGTKQVCM

SEQ ID NO: 380933 - protein, 10 aa, Influenza virus
HLGTKQVCMA

SEQ ID NO: 380934 - protein, 10 aa, Influenza virus
NATASFVYDG

SEQ ID NO: 380935 - protein, 10 aa, Influenza virus
DILRTQESEC

SEQ ID NO: 380936 - protein, 10 aa, Influenza virus
ECVCISGTCA

SEQ ID NO: 380937 - protein, 10 aa, Influenza virus
CVCISGTCAV

SEQ ID NO: 380938 - protein, 10 aa, Influenza virus
VCISGTCAVV

SEQ ID NO: 380939 - protein, 10 aa, Influenza virus
CINGTCTVIM

SEQ ID NO: 380940 - protein, 10 aa, Influenza virus
INGTCTVIMT

SEQ ID NO: 380941 - protein, 10 aa, Influenza virus
NGTCTVIMTD

SEQ ID NO: 380942 - protein, 10 aa, Influenza virus
VVMTDGNASG

SEQ ID NO: 380943 - protein, 10 aa, Influenza virus
LSGNAQHVEE

SEQ ID NO: 380944 - protein, 10 aa, Influenza virus
SGNAQHVEEC

SEQ ID NO: 380945 - protein, 10 aa, Influenza virus
ECSCYPRFPG

SEQ ID NO: 380946 - protein, 10 aa, Influenza virus
VRCVCRDNWR

SEQ ID NO: 380947 - protein, 10 aa, Influenza virus
NWKGSNRPII

SEQ ID NO: 380948 - protein, 10 aa, Influenza virus
WKGSNRPIID

SEQ ID NO: 380949 - protein, 10 aa, Influenza virus
KGSNRPIIDI

SEQ ID NO: 380950 - protein, 10 aa, Influenza virus
GSNRPIIDIN

SEQ ID NO: 380951 - protein, 10 aa, Influenza virus
SSYLCSGLVG

SEQ ID NO: 380952 - protein, 10 aa, Influenza virus
SYLCSGLVGD

SEQ ID NO: 380953 - protein, 10 aa, Influenza virus
PGVKGWAFDD

SEQ ID NO: 380954 - protein, 10 aa, Influenza virus
GVKGWAFDYG

SEQ ID NO: 380955 - protein, 10 aa, Influenza virus
GNDIWMGRTI

SEQ ID NO: 380956 - protein, 10 aa, Influenza virus
RLGYETFKVV

SEQ ID NO: 380957 - protein, 10 aa, Influenza virus
RSGYSGVFSV

SEQ ID NO: 380958 - protein, 10 aa, Influenza virus
GYSGVFSVEG

SEQ ID NO: 380959 - protein, 10 aa, Influenza virus
YSGVFSVEGK

SEQ ID NO: 380960 - protein, 10 aa, Influenza virus
KVWWTSNSIV

SEQ ID NO: 380961 - protein, 10 aa, Influenza virus
GTGSWPDGAE

SEQ ID NO: 380962 - protein, 10 aa, Influenza virus
HTGNPVICLG

SEQ ID NO: 380963 - protein, 10 aa, Influenza virus
NGTMVKTLTG

SEQ ID NO: 380964 - protein, 10 aa, Influenza virus
VEVVAAQELV

SEQ ID NO: 380965 - protein, 10 aa, Influenza virus
VITAQELVES

SEQ ID NO: 380966 - protein, 10 aa, Influenza virus
LCPSPLKLVD

SEQ ID NO: 380967 - protein, 10 aa, Influenza virus
CDIVNAALGS

SEQ ID NO: 380968 - protein, 10 aa, Influenza virus
DIVNAALGSP

SEQ ID NO: 380969 - protein, 10 aa, Influenza virus
IVNAALGSPG

SEQ ID NO: 380970 - protein, 10 aa, Influenza virus
AALGSPGCDH

SEQ ID NO: 380971 - protein, 10 aa, Influenza virus
DTCYPFDVPN

SEQ ID NO: 380972 - protein, 10 aa, Influenza virus
TCYPFDVPNY

SEQ ID NO: 380973 - protein, 10 aa, Influenza virus
CYPFDVPGYQ

SEQ ID NO: 380974 - protein, 10 aa, Influenza virus
YPFDVPNYQS

SEQ ID NO: 380975 - protein, 10 aa, Influenza virus
DVPDYQSIRS

SEQ ID NO: 380976 - protein, 10 aa, Influenza virus
VPNYQSLRSI

SEQ ID NO: 380977 - protein, 10 aa, Influenza virus
PDYQSIRSIL

SEQ ID NO: 380978 - protein, 10 aa, Influenza virus
GYQSLRSILA

SEQ ID NO: 380979 - protein, 10 aa, Influenza virus
ANNGKLEFIA

SEQ ID NO: 380980 - protein, 10 aa, Influenza virus
NNGKLEFIAE

SEQ ID NO: 380981 - protein, 10 aa, Influenza virus
NGKLEFIAEE

SEQ ID NO: 380982 - protein, 10 aa, Influenza virus
GKFEFIVEKF

SEQ ID NO: 380983 - protein, 10 aa, Influenza virus
TIKQNGKSGA

SEQ ID NO: 380984 - protein, 10 aa, Influenza virus
IKQNGKSGAC

SEQ ID NO: 380985 - protein, 10 aa, Influenza virus
NDFFKRLNWL

SEQ ID NO: 380986 - protein, 10 aa, Influenza virus
YPIQNLTKVN

SEQ ID NO: 380987 - protein, 10 aa, Influenza virus
QNLTKVNNGN

SEQ ID NO: 380988 - protein, 10 aa, Influenza virus
NLTKVNNGNY

SEQ ID NO: 380989 - protein, 10 aa, Influenza virus
NSGDYARLYI

SEQ ID NO: 380990 - protein, 10 aa, Influenza virus
SGDYARLYIW

SEQ ID NO: 380991 - protein, 10 aa, Influenza virus
LYENNPGRVT

SEQ ID NO: 380992 - protein, 10 aa, Influenza virus
SNPGRVTVST

SEQ ID NO: 380993 - protein, 10 aa, Influenza virus
NPGRVSVSTK

SEQ ID NO: 380994 - protein, 10 aa, Influenza virus
GPWVRGQSGR

SEQ ID NO: 380995 - protein, 10 aa, Influenza virus
VRGLSSRISF

SEQ ID NO: 380996 - protein, 10 aa, Influenza virus
RGLSSRISFY

SEQ ID NO: 380997 - protein, 10 aa, Influenza virus
GLSSRISFYW

SEQ ID NO: 380998 - protein, 10 aa, Influenza virus
RISFYWTIVK

SEQ ID NO: 380999 - protein, 10 aa, Influenza virus
ISFYWTVVEP

SEQ ID NO: 381000 - protein, 10 aa, Influenza virus
SFYWTIVKPG

SEQ ID NO: 381001 - protein, 10 aa, Influenza virus
FYWTIVEPED

SEQ ID NO: 381002 - protein, 10 aa, Influenza virus
PGNLIVFNTI

SEQ ID NO: 381003 - protein, 10 aa, Influenza virus
GNLIVFNTIG

SEQ ID NO: 381004 - protein, 10 aa, Influenza virus
DVIVFNTIGN

SEQ ID NO: 381005 - protein, 10 aa, Influenza virus
IGSCVSRCHT

SEQ ID NO: 381006 - protein, 10 aa, Influenza virus
GDCPRYVKQG

SEQ ID NO: 381007 - protein, 10 aa, Influenza virus
DCPRYVKQGS

SEQ ID NO: 381008 - protein, 10 aa, Influenza virus
PKYVKQGSLR

SEQ ID NO: 381009 - protein, 10 aa, Influenza virus
KYVKQGSLRL

SEQ ID NO: 381010 - protein, 10 aa, Influenza virus
KSTQAAINQI

SEQ ID NO: 381011 - protein, 10 aa, Influenza virus
TQAAINQING

SEQ ID NO: 381012 - protein, 10 aa, Influenza virus
QAAIDQVNGK

SEQ ID NO: 381013 - protein, 10 aa, Influenza virus
AAIDQISGKL

SEQ ID NO: 381014 - protein, 10 aa, Influenza virus
AIDKINGKLN

SEQ ID NO: 381015 - protein, 10 aa, Influenza virus
INQINGKLNR

SEQ ID NO: 381016 - protein, 10 aa, Influenza virus
DQVNGKLNRL

SEQ ID NO: 381017 - protein, 10 aa, Influenza virus
FEQVEGRTQD

SEQ ID NO: 381018 - protein, 10 aa, Influenza virus
EQVEGRTQDL

SEQ ID NO: 381019 - protein, 10 aa, Influenza virus
QIEGRIQDLE

SEQ ID NO: 381020 - protein, 10 aa, Influenza virus
QDLEEYVEDT

SEQ ID NO: 381021 - protein, 10 aa, Influenza virus
DLEEYVEDTK

SEQ ID NO: 381022 - protein, 10 aa, Influenza virus
LENYVEDTKI

SEQ ID NO: 381023 - protein, 10 aa, Influenza virus
EEYVEDTKID

SEQ ID NO: 381024 - protein, 10 aa, Influenza virus
TIDVADSEMN

SEQ ID NO: 381025 - protein, 10 aa, Influenza virus
IDMTDSEMNK

SEQ ID NO: 381026 - protein, 10 aa, Influenza virus
VTDSEMNRLF

SEQ ID NO: 381027 - protein, 10 aa, Influenza virus
ADSEMNKLFE

SEQ ID NO: 381028 - protein, 10 aa, Influenza virus
DSEMSKLFER

SEQ ID NO: 381029 - protein, 10 aa, Influenza virus
SEMNKLFERI

SEQ ID NO: 381030 - protein, 10 aa, Influenza virus
EMDKLFERVR

SEQ ID NO: 381031 - protein, 10 aa, Influenza virus
RLFERVRRQL

SEQ ID NO: 381032 - protein, 10 aa, Influenza virus
CFEIFHQCNN

SEQ ID NO: 381033 - protein, 10 aa, Influenza virus
CNNNCIESIR

SEQ ID NO: 381034 - protein, 10 aa, Influenza virus
DNTCIESIRN

SEQ ID NO: 381035 - protein, 10 aa, Influenza virus
NTCIESIRNG

SEQ ID NO: 381036 - protein, 10 aa, Influenza virus
TCIESIRNGT

SEQ ID NO: 381037 - protein, 10 aa, Influenza virus
SIRNGTYNHN

SEQ ID NO: 381038 - protein, 10 aa, Influenza virus
YRDEAINSRF

SEQ ID NO: 381039 - protein, 10 aa, Influenza virus
RDEAINSRFQ

SEQ ID NO: 381040 - protein, 10 aa, Influenza virus
DEAINSRFQI

SEQ ID NO: 381041 - protein, 10 aa, Influenza virus
DAINNRFQIQ

SEQ ID NO: 381042 - protein, 10 aa, Influenza virus
INNRFQIQGI

SEQ ID NO: 381043 - protein, 10 aa, Influenza virus
NRFQIQGIKL

SEQ ID NO: 381044 - protein, 10 aa, Influenza virus
RFQIQGVKLI

SEQ ID NO: 381045 - protein, 10 aa, Influenza virus
FQIQGVKLIQ

SEQ ID NO: 381046 - protein, 10 aa, Influenza virus
QIQGVKLIQG

SEQ ID NO: 381047 - protein, 10 aa, Influenza virus
IQGVKLIQGY

SEQ ID NO: 381048 - protein, 10 aa, Influenza virus
QGVKLIQGYK

SEQ ID NO: 381049 - protein, 10 aa, Influenza virus
GVKLIQGYKD

SEQ ID NO: 381050 - protein, 10 aa, Influenza virus
KLIQGYKDII

SEQ ID NO: 381051 - protein, 10 aa, Influenza virus
TQGYKDVILW

SEQ ID NO: 381052 - protein, 10 aa, Influenza virus
DVILWISFSI

SEQ ID NO: 381053 - protein, 10 aa, Influenza virus
IILWFSFSIS

SEQ ID NO: 381054 - protein, 10 aa, Influenza virus
ISCFLLIALL

SEQ ID NO: 381055 - protein, 10 aa, Influenza virus
SCFLLIALLL

SEQ ID NO: 381056 - protein, 10 aa, Influenza virus
ALLLAFMLWA

SEQ ID NO: 381057 - protein, 10 aa, Influenza virus
LLLAFVLWAC

SEQ ID NO: 381058 - protein, 10 aa, Influenza virus
LLAFMLWACQ

SEQ ID NO: 381059 - protein, 10 aa, Influenza virus
LAFVLWACQN

SEQ ID NO: 381060 - protein, 10 aa, Influenza virus
TFILWACQNG

SEQ ID NO: 381061 - protein, 10 aa, Influenza virus
FILWACQTGN

SEQ ID NO: 381062 - protein, 10 aa, Influenza virus
LWACQTGNIR

SEQ ID NO: 381063 - protein, 10 aa, Influenza virus
WACQNGNIRW

SEQ ID NO: 381064 - protein, 10 aa, Influenza virus
ACQTGNIRCQ

SEQ ID NO: 381065 - protein, 10 aa, Influenza virus
GDRICIGYHA

SEQ ID NO: 381066 - protein, 10 aa, Influenza virus
DQICVGYHAN

SEQ ID NO: 381067 - protein, 10 aa, Influenza virus
QICVGYHANN

SEQ ID NO: 381068 - protein, 10 aa, Influenza virus
VGYHANNSTE

SEQ ID NO: 381069 - protein, 10 aa, Influenza virus
QVDTIMEKNI

SEQ ID NO: 381070 - protein, 10 aa, Influenza virus
VDTIMEKNIT

SEQ ID NO: 381071 - protein, 10 aa, Influenza virus
MEKNVAVTHA

SEQ ID NO: 381072 - protein, 10 aa, Influenza virus
EKNITVTHAQ

SEQ ID NO: 381073 - protein, 10 aa, Influenza virus
KNVTVTHAKD

SEQ ID NO: 381074 - protein, 10 aa, Influenza virus
NITVTHAQDI

SEQ ID NO: 381075 - protein, 10 aa, Influenza virus
ITVTHAQDIL

SEQ ID NO: 381076 - protein, 10 aa, Influenza virus
TVTHAQDLLE

SEQ ID NO: 381077 - protein, 10 aa, Influenza virus
VTHAKDILEK

SEQ ID NO: 381078 - protein, 10 aa, Influenza virus
LKDCSVSGWL

SEQ ID NO: 381079 - protein, 10 aa, Influenza virus
VSGWLLGNPM

SEQ ID NO: 381080 - protein, 10 aa, Influenza virus
WLLGNPMCDA

SEQ ID NO: 381081 - protein, 10 aa, Influenza virus
LLGNPTCDEF

SEQ ID NO: 381082 - protein, 10 aa, Influenza virus
APEWSYIVEK

SEQ ID NO: 381083 - protein, 10 aa, Influenza virus
YVSIGTSTLN

SEQ ID NO: 381084 - protein, 10 aa, Influenza virus
SVGTSTLNQK

SEQ ID NO: 381085 - protein, 10 aa, Influenza virus
FESNGNFITP

SEQ ID NO: 381086 - protein, 10 aa, Influenza virus
ESNGNFITPE

SEQ ID NO: 381087 - protein, 10 aa, Influenza virus
SNGNFITPEY

SEQ ID NO: 381088 - protein, 10 aa, Influenza virus
NGNFITPEYA

SEQ ID NO: 381089 - protein, 10 aa, Influenza virus
NFITPEYAYK

SEQ ID NO: 381090 - protein, 10 aa, Influenza virus
FITPEYAYKI

SEQ ID NO: 381091 - protein, 10 aa, Influenza virus
PLHNIHPLTI

SEQ ID NO: 381092 - protein, 10 aa, Influenza virus
LHNIHPLTIG

SEQ ID NO: 381093 - protein, 10 aa, Influenza virus
HPLTIGKCPK

SEQ ID NO: 381094 - protein, 10 aa, Influenza virus
PLTIGKCPKY

SEQ ID NO: 381095 - protein, 10 aa, Influenza virus
AIGECPKYVK

SEQ ID NO: 381096 - protein, 10 aa, Influenza virus
KRKKRGLFGA

SEQ ID NO: 381097 - protein, 10 aa, Influenza virus
VDGWYGYHHN

SEQ ID NO: 381098 - protein, 10 aa, Influenza virus
DGWYGYHHIN

SEQ ID NO: 381099 - protein, 10 aa, Influenza virus
NDQGSGYAAD

SEQ ID NO: 381100 - protein, 10 aa, Influenza virus
EQGSGYAADR

SEQ ID NO: 381101 - protein, 10 aa, Influenza virus
QGSGYAADRE

SEQ ID NO: 381102 - protein, 10 aa, Influenza virus
GSGYAADRES

SEQ ID NO: 381103 - protein, 10 aa, Influenza virus
SGYAADREST

SEQ ID NO: 381104 - protein, 10 aa, Influenza virus
GYAADRESTQ

SEQ ID NO: 381105 - protein, 10 aa, Influenza virus
YAADKKSTQK

SEQ ID NO: 381106 - protein, 10 aa, Influenza virus
AADKKSTQKA

SEQ ID NO: 381107 - protein, 10 aa, Influenza virus
GITNRVNSII

SEQ ID NO: 381108 - protein, 10 aa, Influenza virus
INSIIDKMNT

SEQ ID NO: 381109 - protein, 10 aa, Influenza virus
FLGVWTYNAE

SEQ ID NO: 381110 - protein, 10 aa, Influenza virus
LGVWTYNAEL

SEQ ID NO: 381111 - protein, 10 aa, Influenza virus
DIWTYNAELL

SEQ ID NO: 381112 - protein, 10 aa, Influenza virus
HDSNVKNLYN

SEQ ID NO: 381113 - protein, 10 aa, Influenza virus
DSNVKNLYDR

SEQ ID NO: 381114 - protein, 10 aa, Influenza virus
NVKNLYDRVR

SEQ ID NO: 381115 - protein, 10 aa, Influenza virus
NLYNKVRLQL

SEQ ID NO: 381116 - protein, 10 aa, Influenza virus
KVRHQLRDNA

SEQ ID NO: 381117 - protein, 10 aa, Influenza virus
VRLQLRDNAR

SEQ ID NO: 381118 - protein, 10 aa, Influenza virus
RLQLRDNARE

SEQ ID NO: 381119 - protein, 10 aa, Influenza virus
LQLRDNAREL

SEQ ID NO: 381120 - protein, 10 aa, Influenza virus
CFEFYHKCNN

SEQ ID NO: 381121 - protein, 10 aa, Influenza virus
CIESVRNGTY

SEQ ID NO: 381122 - protein, 10 aa, Influenza virus
QILSIYSTVT

SEQ ID NO: 381123 - protein, 10 aa, Influenza virus
ILSIYSTVTS

SEQ ID NO: 381124 - protein, 10 aa, Influenza virus
LSIYSTVTSS

SEQ ID NO: 381125 - protein, 10 aa, Influenza virus
SIYSTVTSSL

SEQ ID NO: 381126 - protein, 10 aa, Influenza virus
GLLLWMCSNG

SEQ ID NO: 381127 - protein, 10 aa, Influenza virus
LLLWMCSNGS

SEQ ID NO: 381128 - protein, 10 aa, Influenza virus
LWMCSNGALQ

SEQ ID NO: 381129 - protein, 10 aa, Influenza virus
CFNGSLQCRI

SEQ ID NO: 381130 - protein, 10 aa, Influenza virus
SNGSLQCKIC

SEQ ID NO: 381131 - protein, 10 aa, Influenza virus
CIKFVSSDCS

SEQ ID NO: 381132 - protein, 10 aa, Influenza virus
SDQICVGYHA

SEQ ID NO: 381133 - protein, 10 aa, Influenza virus
VGYHANNSTE

SEQ ID NO: 381134 - protein, 10 aa, Influenza virus
GYHANNSTER

SEQ ID NO: 381135 - protein, 10 aa, Influenza virus
HANNSTEHVD

SEQ ID NO: 381136 - protein, 10 aa, Influenza virus
ANNSTEHVDT

SEQ ID NO: 381137 - protein, 10 aa, Influenza virus
NNSTERVDTI

SEQ ID NO: 381138 - protein, 10 aa, Influenza virus
NSTERVDTIM

SEQ ID NO: 381139 - protein, 10 aa, Influenza virus
STERVDTIME

SEQ ID NO: 381140 - protein, 10 aa, Influenza virus
TEQVDTIMER

SEQ ID NO: 381141 - protein, 10 aa, Influenza virus
EQVDTIMERN

SEQ ID NO: 381142 - protein, 10 aa, Influenza virus
HVDTIMEKNV

SEQ ID NO: 381143 - protein, 10 aa, Influenza virus
EKNITVTHAQ

SEQ ID NO: 381144 - protein, 10 aa, Influenza virus
KNVTVTHAKD

SEQ ID NO: 381145 - protein, 10 aa, Influenza virus
NITVTHAQDI

SEQ ID NO: 381146 - protein, 10 aa, Influenza virus
ITVTHAQDIL

SEQ ID NO: 381147 - protein, 10 aa, Influenza virus
GVRPLILRDC

SEQ ID NO: 381148 - protein, 10 aa, Influenza virus
VRPLILRDCS

SEQ ID NO: 381149 - protein, 10 aa, Influenza virus
RPLILKDCSV

SEQ ID NO: 381150 - protein, 10 aa, Influenza virus
KVPEWSYIVE

SEQ ID NO: 381151 - protein, 10 aa, Influenza virus
FSDYEELKHL

SEQ ID NO: 381152 - protein, 10 aa, Influenza virus
NDYEELKHLM

SEQ ID NO: 381153 - protein, 10 aa, Influenza virus
DYEELKHLLN

SEQ ID NO: 381154 - protein, 10 aa, Influenza virus
YEELKHLLNR

SEQ ID NO: 381155 - protein, 10 aa, Influenza virus
EELKHLLNRI

SEQ ID NO: 381156 - protein, 10 aa, Influenza virus
TYVSIGTSTL

SEQ ID NO: 381157 - protein, 10 aa, Influenza virus
YVSIGTSTLN

SEQ ID NO: 381158 - protein, 10 aa, Influenza virus
VSVGTSTLNQ

SEQ ID NO: 381159 - protein, 10 aa, Influenza virus
VGTSTLNQRS

SEQ ID NO: 381160 - protein, 10 aa, Influenza virus
INFDSNGNFI

SEQ ID NO: 381161 - protein, 10 aa, Influenza virus
NFDSNGNFIA

SEQ ID NO: 381162 - protein, 10 aa, Influenza virus
NFITPEYAYK

SEQ ID NO: 381163 - protein, 10 aa, Influenza virus
FITPEYAYKI

SEQ ID NO: 381164 - protein, 10 aa, Influenza virus
AYKIVKTGDS

SEQ ID NO: 381165 - protein, 10 aa, Influenza virus
CQTPLGAINS

SEQ ID NO: 381166 - protein, 10 aa, Influenza virus
GAISSSMPFH

SEQ ID NO: 381167 - protein, 10 aa, Influenza virus
AISSSMPFHN

SEQ ID NO: 381168 - protein, 10 aa, Influenza virus
INSSMPLHNI

SEQ ID NO: 381169 - protein, 10 aa, Influenza virus
GECPKYVKST

SEQ ID NO: 381170 - protein, 10 aa, Influenza virus
KLILATGLRN

SEQ ID NO: 381171 - protein, 10 aa, Influenza virus
VDGWYGYHHN

SEQ ID NO: 381172 - protein, 10 aa, Influenza virus
DGWYGYHHSK

SEQ ID NO: 381173 - protein, 10 aa, Influenza virus
GWYGYHHNNE

SEQ ID NO: 381174 - protein, 10 aa, Influenza virus
HSKEQGSGYA

SEQ ID NO: 381175 - protein, 10 aa, Influenza virus
SKEQGSGYAA

SEQ ID NO: 381176 - protein, 10 aa, Influenza virus
EQGSGYAADR

SEQ ID NO: 381177 - protein, 10 aa, Influenza virus
SGYAADKESS

SEQ ID NO: 381178 - protein, 10 aa, Influenza virus
YAADRESTQK

SEQ ID NO: 381179 - protein, 10 aa, Influenza virus
AADRESTQKA

SEQ ID NO: 381180 - protein, 10 aa, Influenza virus
ESTQKAINGV

SEQ ID NO: 381181 - protein, 10 aa, Influenza virus
STQKAINGVT

SEQ ID NO: 381182 - protein, 10 aa, Influenza virus
TQKAINGVTN

SEQ ID NO: 381183 - protein, 10 aa, Influenza virus
QKAINGVTNK

SEQ ID NO: 381184 - protein, 10 aa, Influenza virus
AIDGITNKIN

SEQ ID NO: 381185 - protein, 10 aa, Influenza virus
IDGITNKINS

SEQ ID NO: 381186 - protein, 10 aa, Influenza virus
VTNKVNSIIG

SEQ ID NO: 381187 - protein, 10 aa, Influenza virus
VNSIIGKMNT

SEQ ID NO: 381188 - protein, 10 aa, Influenza virus
IIDKMNTRFE

SEQ ID NO: 381189 - protein, 10 aa, Influenza virus
IDKMNTQFET

SEQ ID NO: 381190 - protein, 10 aa, Influenza virus
KMNTQFETVG

SEQ ID NO: 381191 - protein, 10 aa, Influenza virus
MNTQFETVGK

SEQ ID NO: 381192 - protein, 10 aa, Influenza virus
NTQFETVGKE

SEQ ID NO: 381193 - protein, 10 aa, Influenza virus
IQFEAVGREF

SEQ ID NO: 381194 - protein, 10 aa, Influenza virus
QFEAIGREFN

SEQ ID NO: 381195 - protein, 10 aa, Influenza virus
LERRIENLNR

SEQ ID NO: 381196 - protein, 10 aa, Influenza virus
ERRIENLNRK

SEQ ID NO: 381197 - protein, 10 aa, Influenza virus
RRIENLNRKM

SEQ ID NO: 381198 - protein, 10 aa, Influenza virus
VENLNKKMED

SEQ ID NO: 381199 - protein, 10 aa, Influenza virus
DSNVKNLYDR

SEQ ID NO: 381200 - protein, 10 aa, Influenza virus
SNVKNLYDRV

SEQ ID NO: 381201 - protein, 10 aa, Influenza virus
NVKNLYDRVR

SEQ ID NO: 381202 - protein, 10 aa, Influenza virus
VKNLYDRVRL

SEQ ID NO: 381203 - protein, 10 aa, Influenza virus
KNLYDRVRLQ

SEQ ID NO: 381204 - protein, 10 aa, Influenza virus
LYDRVRLQLR

SEQ ID NO: 381205 - protein, 10 aa, Influenza virus
YDRVRLQLRD

SEQ ID NO: 381206 - protein, 10 aa, Influenza virus
DRVRLQLRDN

SEQ ID NO: 381207 - protein, 10 aa, Influenza virus
CFEFYHKCDD

SEQ ID NO: 381208 - protein, 10 aa, Influenza virus
CIESVRNGTY

SEQ ID NO: 381209 - protein, 10 aa, Influenza virus
GVYQILSIYS

SEQ ID NO: 381210 - protein, 10 aa, Influenza virus
QILSIYSTVT

SEQ ID NO: 381211 - protein, 10 aa, Influenza virus
ILSIYSTVTS

SEQ ID NO: 381212 - protein, 10 aa, Influenza virus
LSIYSTVTSS

SEQ ID NO: 381213 - protein, 10 aa, Influenza virus
SIYSTVTSSL

SEQ ID NO: 381214 - protein, 10 aa, Influenza virus
YSTVASSLTL

SEQ ID NO: 381215 - protein, 10 aa, Influenza virus
STVASSLTLA

SEQ ID NO: 381216 - protein, 10 aa, Influenza virus
TVASSLTLAI

SEQ ID NO: 381217 - protein, 10 aa, Influenza virus
AGLLLWMCSN

SEQ ID NO: 381218 - protein, 10 aa, Influenza virus
GLLLWMCSNG

SEQ ID NO: 381219 - protein, 10 aa, Influenza virus
LLLWMCSNGS

SEQ ID NO: 381220 - protein, 10 aa, Influenza virus
LLWMCSNGSL

SEQ ID NO: 381221 - protein, 10 aa, Influenza virus
LWMCSNGALQ

SEQ ID NO: 381222 - protein, 10 aa, Influenza virus
CFNGSLQCRI

SEQ ID NO: 381223 - protein, 10 aa, Influenza virus
SNGSLQCKIC

SEQ ID NO: 381224 - protein, 10 aa, Influenza virus
CIKICESRLR

SEQ ID NO: 381225 - protein, 10 aa, Influenza virus
NQNSTWVSQT

SEQ ID NO: 381226 - protein, 10 aa, Influenza virus
ENNTWGNQTY

SEQ ID NO: 381227 - protein, 10 aa, Influenza virus
HSKDNNIRIG

SEQ ID NO: 381228 - protein, 10 aa, Influenza virus
KDNNIRIGSK

SEQ ID NO: 381229 - protein, 10 aa, Influenza virus
DNNIRIGSKG

SEQ ID NO: 381230 - protein, 10 aa, Influenza virus
NNIRIGSKGD

SEQ ID NO: 381231 - protein, 10 aa, Influenza virus
NIRIGSKGDV

SEQ ID NO: 381232 - protein, 10 aa, Influenza virus
GDVFIIREPF

SEQ ID NO: 381233 - protein, 10 aa, Influenza virus
TREPFISCSH

SEQ ID NO: 381234 - protein, 10 aa, Influenza virus
REPFVSCSHL

SEQ ID NO: 381235 - protein, 10 aa, Influenza virus
EPFVSCSHLE

SEQ ID NO: 381236 - protein, 10 aa, Influenza virus
PFISCSHSEC

SEQ ID NO: 381237 - protein, 10 aa, Influenza virus
FVSCSHLECR

SEQ ID NO: 381238 - protein, 10 aa, Influenza virus
ISCSHSECRT

SEQ ID NO: 381239 - protein, 10 aa, Influenza virus
SCSYLECRTF

SEQ ID NO: 381240 - protein, 10 aa, Influenza virus
CSYLECRTFF

SEQ ID NO: 381241 - protein, 10 aa, Influenza virus
SYLECRTFFL

SEQ ID NO: 381242 - protein, 10 aa, Influenza virus
YLECRTFFLT

SEQ ID NO: 381243 - protein, 10 aa, Influenza virus
LECRTFFLTH

SEQ ID NO: 381244 - protein, 10 aa, Influenza virus
LNDKHSNGTA

SEQ ID NO: 381245 - protein, 10 aa, Influenza virus
KHSNGTVNDR

SEQ ID NO: 381246 - protein, 10 aa, Influenza virus
HSNETVKDRS

SEQ ID NO: 381247 - protein, 10 aa, Influenza virus
SNETVKDRSP

SEQ ID NO: 381248 - protein, 10 aa, Influenza virus
NDRSPHRTLM

SEQ ID NO: 381249 - protein, 10 aa, Influenza virus
DRSPQRTLMS

SEQ ID NO: 381250 - protein, 10 aa, Influenza virus
RSPQRTLMSC

SEQ ID NO: 381251 - protein, 10 aa, Influenza virus
SPQRTLMSCP

SEQ ID NO: 381252 - protein, 10 aa, Influenza virus
GVAPSPYNSR

SEQ ID NO: 381253 - protein, 10 aa, Influenza virus
VAPSPYNSRF

SEQ ID NO: 381254 - protein, 10 aa, Influenza virus
SASACHDGSS

SEQ ID NO: 381255 - protein, 10 aa, Influenza virus
ASACHDGSSW

SEQ ID NO: 381256 - protein, 10 aa, Influenza virus
SACHDGSSWL

SEQ ID NO: 381257 - protein, 10 aa, Influenza virus
CHDGSSWLTI

SEQ ID NO: 381258 - protein, 10 aa, Influenza virus
SWLIIGISGP

SEQ ID NO: 381259 - protein, 10 aa, Influenza virus
LIIGISGPDN

SEQ ID NO: 381260 - protein, 10 aa, Influenza virus
IGVSGPDNGA

SEQ ID NO: 381261 - protein, 10 aa, Influenza virus
GVSGPDNGAV

SEQ ID NO: 381262 - protein, 10 aa, Influenza virus
VSGPDNGAVA

SEQ ID NO: 381263 - protein, 10 aa, Influenza virus
SGPDDGAVAV

SEQ ID NO: 381264 - protein, 10 aa, Influenza virus
GPDNGAVAVV

SEQ ID NO: 381265 - protein, 10 aa, Influenza virus
PDNGAVAVVK

SEQ ID NO: 381266 - protein, 10 aa, Influenza virus
DNGAVAVVKY

SEQ ID NO: 381267 - protein, 10 aa, Influenza virus
GAVAVLKYDG

SEQ ID NO: 381268 - protein, 10 aa, Influenza virus
KYKGIITDTI

SEQ ID NO: 381269 - protein, 10 aa, Influenza virus
GIITDTIRSW

SEQ ID NO: 381270 - protein, 10 aa, Influenza virus
SILRTQESEC

SEQ ID NO: 381271 - protein, 10 aa, Influenza virus
VLRTQESECA

SEQ ID NO: 381272 - protein, 10 aa, Influenza virus
GYCFTVMTDG

SEQ ID NO: 381273 - protein, 10 aa, Influenza virus
YCFTVMTDGP

SEQ ID NO: 381274 - protein, 10 aa, Influenza virus
EECSCYPNAG

SEQ ID NO: 381275 - protein, 10 aa, Influenza virus
ECSCYPDAGK

SEQ ID NO: 381276 - protein, 10 aa, Influenza virus
TCVCRDSWHG

SEQ ID NO: 381277 - protein, 10 aa, Influenza virus
GSNRPWVSFD

SEQ ID NO: 381278 - protein, 10 aa, Influenza virus
IGYICSGVLG

SEQ ID NO: 381279 - protein, 10 aa, Influenza virus
YICSGVFGDS

SEQ ID NO: 381280 - protein, 10 aa, Influenza virus
ICSGVFGDSP

SEQ ID NO: 381281 - protein, 10 aa, Influenza virus
CSGVFGDSPR

SEQ ID NO: 381282 - protein, 10 aa, Influenza virus
SGVFGDSPRP

SEQ ID NO: 381283 - protein, 10 aa, Influenza virus
FGDNPRPSDG

SEQ ID NO: 381284 - protein, 10 aa, Influenza virus
GVKGFAFKYG

SEQ ID NO: 381285 - protein, 10 aa, Influenza virus
KGFSFKYGDG

SEQ ID NO: 381286 - protein, 10 aa, Influenza virus
FKYGNGAWIG

SEQ ID NO: 381287 - protein, 10 aa, Influenza virus
KYGDGVWIGR

SEQ ID NO: 381288 - protein, 10 aa, Influenza virus
GVWIGRTKSA

SEQ ID NO: 381289 - protein, 10 aa, Influenza virus
SGFEIIWDPN

SEQ ID NO: 381290 - protein, 10 aa, Influenza virus
ITEWSGYSGS

SEQ ID NO: 381291 - protein, 10 aa, Influenza virus
FVQHPELTGV

SEQ ID NO: 381292 - protein, 10 aa, Influenza virus
VQHPEMTGLD

SEQ ID NO: 381293 - protein, 10 aa, Influenza virus
QHPELTGVDC

SEQ ID NO: 381294 - protein, 10 aa, Influenza virus
NCMRPCFWVE

SEQ ID NO: 381295 - protein, 10 aa, Influenza virus
IKPCFWVELI

SEQ ID NO: 381296 - protein, 10 aa, Influenza virus
CFWIELIRGR

SEQ ID NO: 381297 - protein, 10 aa, Influenza virus
FWIELIRGRP

SEQ ID NO: 381298 - protein, 10 aa, Influenza virus
WVELIRGRPE

SEQ ID NO: 381299 - protein, 10 aa, Influenza virus
VELIRGRPEE

SEQ ID NO: 381300 - protein, 10 aa, Influenza virus
IWASGSSISF

SEQ ID NO: 381301 - protein, 10 aa, Influenza virus
GSIISFCGVN

SEQ ID NO: 381302 - protein, 10 aa, Influenza virus
SWPDRAELPF

SEQ ID NO: 381303 - protein, 10 aa, Influenza virus
DRICVGYHAN

SEQ ID NO: 381304 - protein, 10 aa, Influenza virus
QICIGHHANN

SEQ ID NO: 381305 - protein, 10 aa, Influenza virus
CVGYHANNST

SEQ ID NO: 381306 - protein, 10 aa, Influenza virus
IGYHANNSKK

SEQ ID NO: 381307 - protein, 10 aa, Influenza virus
GHHANNSTEQ

SEQ ID NO: 381308 - protein, 10 aa, Influenza virus
YHANNSKKQI

SEQ ID NO: 381309 - protein, 10 aa, Influenza virus
HANNSKKQID

SEQ ID NO: 381310 - protein, 10 aa, Influenza virus
ANNSKKQIDT

SEQ ID NO: 381311 - protein, 10 aa, Influenza virus
NNSKKQIDTI

SEQ ID NO: 381312 - protein, 10 aa, Influenza virus
QVDTIREKNV

SEQ ID NO: 381313 - protein, 10 aa, Influenza virus
DTTMEKNVTV

SEQ ID NO: 381314 - protein, 10 aa, Influenza virus
TIVEKNVTVT

SEQ ID NO: 381315 - protein, 10 aa, Influenza virus
EKNVTVTHTQ

SEQ ID NO: 381316 - protein, 10 aa, Influenza virus
AGWILGNPMC

SEQ ID NO: 381317 - protein, 10 aa, Influenza virus
EWSYIVEKDK

SEQ ID NO: 381318 - protein, 10 aa, Influenza virus
WSYIVEKDKP

SEQ ID NO: 381319 - protein, 10 aa, Influenza virus
SSFFRNIVWL

SEQ ID NO: 381320 - protein, 10 aa, Influenza virus
SFYRNVVWLI

SEQ ID NO: 381321 - protein, 10 aa, Influenza virus
FYRNVVWLIK

SEQ ID NO: 381322 - protein, 10 aa, Influenza virus
YRNVVWLIKK

SEQ ID NO: 381323 - protein, 10 aa, Influenza virus
IAIRPKVNGQ

SEQ ID NO: 381324 - protein, 10 aa, Influenza virus
YGNCDAKCQT

SEQ ID NO: 381325 - protein, 10 aa, Influenza virus
GNCDAKCQTP

SEQ ID NO: 381326 - protein, 10 aa, Influenza virus
ETKGLFGAIA

SEQ ID NO: 381327 - protein, 10 aa, Influenza virus
VDGWYGYHHT

SEQ ID NO: 381328 - protein, 10 aa, Influenza virus
DGWYGYHHNN

SEQ ID NO: 381329 - protein, 10 aa, Influenza virus
GGGYAADKES

SEQ ID NO: 381330 - protein, 10 aa, Influenza virus
SGYAADKAST

SEQ ID NO: 381331 - protein, 10 aa, Influenza virus
GYAEGQESPP

SEQ ID NO: 381332 - protein, 10 aa, Influenza virus
YAADRKSTQK

SEQ ID NO: 381333 - protein, 10 aa, Influenza virus
AADRKSTQKA

SEQ ID NO: 381334 - protein, 10 aa, Influenza virus
STQKAIDGVT

SEQ ID NO: 381335 - protein, 10 aa, Influenza virus
TYNAELFVLM

SEQ ID NO: 381336 - protein, 10 aa, Influenza virus
YNAELLVLIE

SEQ ID NO: 381337 - protein, 10 aa, Influenza virus
NAELFVLMEN

SEQ ID NO: 381338 - protein, 10 aa, Influenza virus
TELLVLMENE

SEQ ID NO: 381339 - protein, 10 aa, Influenza virus
ELLVLMVNER

SEQ ID NO: 381340 - protein, 10 aa, Influenza virus
LLVLMENEIT

SEQ ID NO: 381341 - protein, 10 aa, Influenza virus
LMENEITLDF

SEQ ID NO: 381342 - protein, 10 aa, Influenza virus
MVNERTLDFH

SEQ ID NO: 381343 - protein, 10 aa, Influenza virus
TLYFHDSNVK

SEQ ID NO: 381344 - protein, 10 aa, Influenza virus
LYFHDSNVKN

SEQ ID NO: 381345 - protein, 10 aa, Influenza virus
YFHDSNVKNL

SEQ ID NO: 381346 - protein, 10 aa, Influenza virus
KLYDRVRLQL

SEQ ID NO: 381347 - protein, 10 aa, Influenza virus
NNAKELGNGC

SEQ ID NO: 381348 - protein, 10 aa, Influenza virus
NAKEWGNGCF

SEQ ID NO: 381349 - protein, 10 aa, Influenza virus
AKEWGNGCFE

SEQ ID NO: 381350 - protein, 10 aa, Influenza virus
KEWGNGCFEF

SEQ ID NO: 381351 - protein, 10 aa, Influenza virus
VCMESVRNGT

SEQ ID NO: 381352 - protein, 10 aa, Influenza virus
ESVKNGTYNY

SEQ ID NO: 381353 - protein, 10 aa, Influenza virus
ILTIYSTVAS

SEQ ID NO: 381354 - protein, 10 aa, Influenza virus
LSVYSTVASS

SEQ ID NO: 381355 - protein, 10 aa, Influenza virus
TIYSTVASSL

SEQ ID NO: 381356 - protein, 10 aa, Influenza virus
LAIMIAGLFF

SEQ ID NO: 381357 - protein, 10 aa, Influenza virus
AIMIAGLFFW

SEQ ID NO: 381358 - protein, 10 aa, Influenza virus
IAGLFFWMCS

SEQ ID NO: 381359 - protein, 10 aa, Influenza virus
SYWMCSNGSL

SEQ ID NO: 381360 - protein, 10 aa, Influenza virus
KPQCEITGFA

SEQ ID NO: 381361 - protein, 10 aa, Influenza virus
PQCEITGFAP

SEQ ID NO: 381362 - protein, 10 aa, Influenza virus
QCEITGFAPF

SEQ ID NO: 381363 - protein, 10 aa, Influenza virus
VTREPYVSCG

SEQ ID NO: 381364 - protein, 10 aa, Influenza virus
HSNDTIHDRT

SEQ ID NO: 381365 - protein, 10 aa, Influenza virus
SHRTLLMNEL

SEQ ID NO: 381366 - protein, 10 aa, Influenza virus
MTELGVPFHL

SEQ ID NO: 381367 - protein, 10 aa, Influenza virus
NELGVPFHMG

SEQ ID NO: 381368 - protein, 10 aa, Influenza virus
FHLGTKQVCV

SEQ ID NO: 381369 - protein, 10 aa, Influenza virus
HLGTKQVCVA

SEQ ID NO: 381370 - protein, 10 aa, Influenza virus
LGTKQVCVAW

SEQ ID NO: 381371 - protein, 10 aa, Influenza virus
TKQVCVAWSS

SEQ ID NO: 381372 - protein, 10 aa, Influenza virus
KQVCVAWSSS

SEQ ID NO: 381373 - protein, 10 aa, Influenza virus
CIAWSSSSCY

SEQ ID NO: 381374 - protein, 10 aa, Influenza virus
IAWSSSSCYD

SEQ ID NO: 381375 - protein, 10 aa, Influenza virus
WSSSSCYDGK

SEQ ID NO: 381376 - protein, 10 aa, Influenza virus
SRSSCHDGKA

SEQ ID NO: 381377 - protein, 10 aa, Influenza virus
RSSCHDGKAW

SEQ ID NO: 381378 - protein, 10 aa, Influenza virus
SSCYDGKAWL

SEQ ID NO: 381379 - protein, 10 aa, Influenza virus
SCYDGKAWLH

SEQ ID NO: 381380 - protein, 10 aa, Influenza virus
CHDGKAWLHI

SEQ ID NO: 381381 - protein, 10 aa, Influenza virus
HDGKAWLHIC

SEQ ID NO: 381382 - protein, 10 aa, Influenza virus
AWLHVCVTGH

SEQ ID NO: 381383 - protein, 10 aa, Influenza virus
TWSQNILRTQ

SEQ ID NO: 381384 - protein, 10 aa, Influenza virus
TQESECICIN

SEQ ID NO: 381385 - protein, 10 aa, Influenza virus
CAVVMTDGNA

SEQ ID NO: 381386 - protein, 10 aa, Influenza virus
AVVMTDGNAS

SEQ ID NO: 381387 - protein, 10 aa, Influenza virus
VIMTDGSASG

SEQ ID NO: 381388 - protein, 10 aa, Influenza virus
VRCVCRDNWM

SEQ ID NO: 381389 - protein, 10 aa, Influenza virus
TCVCRDNWKS

SEQ ID NO: 381390 - protein, 10 aa, Influenza virus
DNWKSSNRPV

SEQ ID NO: 381391 - protein, 10 aa, Influenza virus
SHYVCSGLVG

SEQ ID NO: 381392 - protein, 10 aa, Influenza virus
HYVCSGLVGD

SEQ ID NO: 381393 - protein, 10 aa, Influenza virus
VGDTPRNDDI

SEQ ID NO: 381394 - protein, 10 aa, Influenza virus
SSSNCKDPNN

SEQ ID NO: 381395 - protein, 10 aa, Influenza virus
SSNCKDPNNE

SEQ ID NO: 381396 - protein, 10 aa, Influenza virus
SNCRDPNNEK

SEQ ID NO: 381397 - protein, 10 aa, Influenza virus
GSPGVKGWAF

SEQ ID NO: 381398 - protein, 10 aa, Influenza virus
SPGVKGWAFD

SEQ ID NO: 381399 - protein, 10 aa, Influenza virus
SEDSRSGYET

SEQ ID NO: 381400 - protein, 10 aa, Influenza virus
RSGYETFRVL

SEQ ID NO: 381401 - protein, 10 aa, Influenza virus
RSGYSGIFSV

SEQ ID NO: 381402 - protein, 10 aa, Influenza virus
NCINRCFYVE

SEQ ID NO: 381403 - protein, 10 aa, Influenza virus
TSNSIIVLCG

SEQ ID NO: 381404 - protein, 10 aa, Influenza virus
PDGADINFMP

SEQ ID NO: 381405 - protein, 10 aa, Influenza virus
RSHKICIGYH

SEQ ID NO: 381406 - protein, 10 aa, Influenza virus
HANNSTTQID

SEQ ID NO: 381407 - protein, 10 aa, Influenza virus
ANNSTTQIDT

SEQ ID NO: 381408 - protein, 10 aa, Influenza virus
NNSTTQVNTI

SEQ ID NO: 381409 - protein, 10 aa, Influenza virus
VDTILEKNIT

SEQ ID NO: 381410 - protein, 10 aa, Influenza virus
DTILEKNITV

SEQ ID NO: 381411 - protein, 10 aa, Influenza virus
TILEKNITVT

SEQ ID NO: 381412 - protein, 10 aa, Influenza virus
ILEKNITVTH

SEQ ID NO: 381413 - protein, 10 aa, Influenza virus
EKNITVTHSV

SEQ ID NO: 381414 - protein, 10 aa, Influenza virus
KNITVTHSVE

SEQ ID NO: 381415 - protein, 10 aa, Influenza virus
VTHSIELLES

SEQ ID NO: 381416 - protein, 10 aa, Influenza virus
EGWILGNPKC

SEQ ID NO: 381417 - protein, 10 aa, Influenza virus
GWILGNPKCD

SEQ ID NO: 381418 - protein, 10 aa, Influenza virus
SSFYRNLLWM

SEQ ID NO: 381419 - protein, 10 aa, Influenza virus
WSMLKPGETL

SEQ ID NO: 381420 - protein, 10 aa, Influenza virus
LKPGETLNIE

SEQ ID NO: 381421 - protein, 10 aa, Influenza virus
KPGETLNIES

SEQ ID NO: 381422 - protein, 10 aa, Influenza virus
LNIESNGNLI

SEQ ID NO: 381423 - protein, 10 aa, Influenza virus
NIESNGNLIA

SEQ ID NO: 381424 - protein, 10 aa, Influenza virus
NLIAPWYAFR

SEQ ID NO: 381425 - protein, 10 aa, Influenza virus
TNKTFQNASP

SEQ ID NO: 381426 - protein, 10 aa, Influenza virus
NKTFQNVSPI

SEQ ID NO: 381427 - protein, 10 aa, Influenza virus
KTFQNVSPIW

SEQ ID NO: 381428 - protein, 10 aa, Influenza virus
FQNVSPIWIG

SEQ ID NO: 381429 - protein, 10 aa, Influenza virus
ARGLFGAIAG

SEQ ID NO: 381430 - protein, 10 aa, Influenza virus
YAADKESTQR

SEQ ID NO: 381431 - protein, 10 aa, Influenza virus
AADKESTQRA

SEQ ID NO: 381432 - protein, 10 aa, Influenza virus
HEFSNLERRV

SEQ ID NO: 381433 - protein, 10 aa, Influenza virus
NGFLDVWTYN

SEQ ID NO: 381434 - protein, 10 aa, Influenza virus
GLLDVWTYNA

SEQ ID NO: 381435 - protein, 10 aa, Influenza virus
LLDVWTYNAE

SEQ ID NO: 381436 - protein, 10 aa, Influenza virus
LGVWTYNAEL

SEQ ID NO: 381437 - protein, 10 aa, Influenza virus
AELLVLLEDE

SEQ ID NO: 381438 - protein, 10 aa, Influenza virus
ELLVLLEDER

SEQ ID NO: 381439 - protein, 10 aa, Influenza virus
LLVLLEDERT

SEQ ID NO: 381440 - protein, 10 aa, Influenza virus
LVLLEDERTL

SEQ ID NO: 381441 - protein, 10 aa, Influenza virus
VLLEDERTLD

SEQ ID NO: 381442 - protein, 10 aa, Influenza virus
ENERTLDQHD

SEQ ID NO: 381443 - protein, 10 aa, Influenza virus
NERTLDMHDV

SEQ ID NO: 381444 - protein, 10 aa, Influenza virus
ERTLDMHDVN

SEQ ID NO: 381445 - protein, 10 aa, Influenza virus
TLDMHDVNVK

SEQ ID NO: 381446 - protein, 10 aa, Influenza virus
LKDNANDLGN

SEQ ID NO: 381447 - protein, 10 aa, Influenza virus
KDNANDLGNG

SEQ ID NO: 381448 - protein, 10 aa, Influenza virus
FEFWHKCNNE

SEQ ID NO: 381449 - protein, 10 aa, Influenza virus
EFWHKCNNEC

SEQ ID NO: 381450 - protein, 10 aa, Influenza virus
KNGTYKYPKY

SEQ ID NO: 381451 - protein, 10 aa, Influenza virus
KGTYDYPKYQ

SEQ ID NO: 381452 - protein, 10 aa, Influenza virus
GVYQILSIYS

SEQ ID NO: 381453 - protein, 10 aa, Influenza virus
VSSGLVLVGL

SEQ ID NO: 381454 - protein, 10 aa, Influenza virus
SSSLVLAGLI

SEQ ID NO: 381455 - protein, 10 aa, Influenza virus
MCSNSSMQCR

SEQ ID NO: 381456 - protein, 10 aa, Influenza virus
NSSMQCRICI

SEQ ID NO: 381457 - protein, 10 aa, Influenza virus
MKSRGYKMNT

SEQ ID NO: 381458 - protein, 10 aa, Influenza virus
KSRGYKMNIQ

SEQ ID NO: 381459 - protein, 10 aa, Influenza virus
SRGYKMNIQI

SEQ ID NO: 381460 - protein, 10 aa, Influenza virus
RGYKMNIQIL

SEQ ID NO: 381461 - protein, 10 aa, Influenza virus
TLTEREVEVV

SEQ ID NO: 381462 - protein, 10 aa, Influenza virus
LTERGVEVVD

SEQ ID NO: 381463 - protein, 10 aa, Influenza virus
TERGVEVVDA

SEQ ID NO: 381464 - protein, 10 aa, Influenza virus
ERGVEVVDAT

SEQ ID NO: 381465 - protein, 10 aa, Influenza virus
RGVEVVDATE

SEQ ID NO: 381466 - protein, 10 aa, Influenza virus
VVDATETVER

SEQ ID NO: 381467 - protein, 10 aa, Influenza virus
GPPQCDKFLE

SEQ ID NO: 381468 - protein, 10 aa, Influenza virus
PPQCDKFLEF

SEQ ID NO: 381469 - protein, 10 aa, Influenza virus
GQSGRINFHW

SEQ ID NO: 381470 - protein, 10 aa, Influenza virus
FIFNGAFIAP

SEQ ID NO: 381471 - protein, 10 aa, Influenza virus
NGAFVAPDRV

SEQ ID NO: 381472 - protein, 10 aa, Influenza virus
GAFVAPDRVS

SEQ ID NO: 381473 - protein, 10 aa, Influenza virus
AFVAPDRVSF

SEQ ID NO: 381474 - protein, 10 aa, Influenza virus
LLLATGMRNI

SEQ ID NO: 381475 - protein, 10 aa, Influenza virus
LLATGMRNIP

SEQ ID NO: 381476 - protein, 10 aa, Influenza virus
QMTRGLFGAI

SEQ ID NO: 381477 - protein, 10 aa, Influenza virus
ARGLFGAIAG

SEQ ID NO: 381478 - protein, 10 aa, Influenza virus
EGLIDGWYGY

SEQ ID NO: 381479 - protein, 10 aa, Influenza virus
GLIDGWYGYR

SEQ ID NO: 381480 - protein, 10 aa, Influenza virus
LIDGWYGYRH

SEQ ID NO: 381481 - protein, 10 aa, Influenza virus
IDGWYGYRHQ

SEQ ID NO: 381482 - protein, 10 aa, Influenza virus
DGWYGFKHQN

SEQ ID NO: 381483 - protein, 10 aa, Influenza virus
GWYGFKHQNA

SEQ ID NO: 381484 - protein, 10 aa, Influenza virus
WYGFKHQNAQ

SEQ ID NO: 381485 - protein, 10 aa, Influenza virus
YGFKHQNAQG

SEQ ID NO: 381486 - protein, 10 aa, Influenza virus
GFKHQNAQGE

SEQ ID NO: 381487 - protein, 10 aa, Influenza virus
FKHQNAQGEG

SEQ ID NO: 381488 - protein, 10 aa, Influenza virus
RHQNSQGEGT

SEQ ID NO: 381489 - protein, 10 aa, Influenza virus
KSTQSAVDQI

SEQ ID NO: 381490 - protein, 10 aa, Influenza virus
STQSAVDQIT

SEQ ID NO: 381491 - protein, 10 aa, Influenza virus
TQSAVDQITG

SEQ ID NO: 381492 - protein, 10 aa, Influenza virus
QSAVDQITGK

SEQ ID NO: 381493 - protein, 10 aa, Influenza virus
SAVDQITGKL

SEQ ID NO: 381494 - protein, 10 aa, Influenza virus
AVDQITGKLN

SEQ ID NO: 381495 - protein, 10 aa, Influenza virus
VDQITGKLNR

SEQ ID NO: 381496 - protein, 10 aa, Influenza virus
NQITGKLNRI

SEQ ID NO: 381497 - protein, 10 aa, Influenza virus
QITGKLNHLI

SEQ ID NO: 381498 - protein, 10 aa, Influenza virus
EKQLGNVINW

SEQ ID NO: 381499 - protein, 10 aa, Influenza virus
KQLGNVINWT

SEQ ID NO: 381500 - protein, 10 aa, Influenza virus
AELLVALENQ

SEQ ID NO: 381501 - protein, 10 aa, Influenza virus
ELLVALENQH

SEQ ID NO: 381502 - protein, 10 aa, Influenza virus
LLVALENQHT

SEQ ID NO: 381503 - protein, 10 aa, Influenza virus
LVALENQHTI

SEQ ID NO: 381504 - protein, 10 aa, Influenza virus
VALENQHTID

SEQ ID NO: 381505 - protein, 10 aa, Influenza virus
AIENQHTIDL

SEQ ID NO: 381506 - protein, 10 aa, Influenza virus
LENQHTIDLA

SEQ ID NO: 381507 - protein, 10 aa, Influenza virus
HTIDLADSEI

SEQ ID NO: 381508 - protein, 10 aa, Influenza virus
SEMDKLYERV

SEQ ID NO: 381509 - protein, 10 aa, Influenza virus
VKRQLRENAE

SEQ ID NO: 381510 - protein, 10 aa, Influenza virus
KRQLRENAEE

SEQ ID NO: 381511 - protein, 10 aa, Influenza virus
MASIRNSTYD

SEQ ID NO: 381512 - protein, 10 aa, Influenza virus
ASIRNSTYDH

SEQ ID NO: 381513 - protein, 10 aa, Influenza virus
GGYKDIILWF

SEQ ID NO: 381514 - protein, 10 aa, Influenza virus
FSFGASCLIL

SEQ ID NO: 381515 - protein, 10 aa, Influenza virus
TKGDKICLGH

SEQ ID NO: 381516 - protein, 10 aa, Influenza virus
KINTLTERGV

SEQ ID NO: 381517 - protein, 10 aa, Influenza virus
INTLTERGVE

SEQ ID NO: 381518 - protein, 10 aa, Influenza virus
VNATETVETV

SEQ ID NO: 381519 - protein, 10 aa, Influenza virus
CGLLGILIGP

SEQ ID NO: 381520 - protein, 10 aa, Influenza virus
GLLGILIGPP

SEQ ID NO: 381521 - protein, 10 aa, Influenza virus
IGPPHCDQFL

SEQ ID NO: 381522 - protein, 10 aa, Influenza virus
DLIIERKEGT

SEQ ID NO: 381523 - protein, 10 aa, Influenza virus
LIIERREGAD

SEQ ID NO: 381524 - protein, 10 aa, Influenza virus
CYPGKFVNGE

SEQ ID NO: 381525 - protein, 10 aa, Influenza virus
FANEESLRQI

SEQ ID NO: 381526 - protein, 10 aa, Influenza virus
NEESLRQIIR

SEQ ID NO: 381527 - protein, 10 aa, Influenza virus
LRQILRKSGG

SEQ ID NO: 381528 - protein, 10 aa, Influenza virus
RQILRKSGGI

SEQ ID NO: 381529 - protein, 10 aa, Influenza virus
GFTYSEIRTN

SEQ ID NO: 381530 - protein, 10 aa, Influenza virus
IYSGIRTNGA

SEQ ID NO: 381531 - protein, 10 aa, Influenza virus
RSSSSFYAEM

SEQ ID NO: 381532 - protein, 10 aa, Influenza virus
SGSSFYAELK

SEQ ID NO: 381533 - protein, 10 aa, Influenza virus
AEMKWLLSST

SEQ ID NO: 381534 - protein, 10 aa, Influenza virus
EMKWLLSSTD

SEQ ID NO: 381535 - protein, 10 aa, Influenza virus
MKWLLSSTDN

SEQ ID NO: 381536 - protein, 10 aa, Influenza virus
ALIVWGVHHS

SEQ ID NO: 381537 - protein, 10 aa, Influenza virus
KLYGNGNKLI

SEQ ID NO: 381538 - protein, 10 aa, Influenza virus
TGARRIDFHW

SEQ ID NO: 381539 - protein, 10 aa, Influenza virus
GARRIDFNWL

SEQ ID NO: 381540 - protein, 10 aa, Influenza virus
ARRIDFHWLF

SEQ ID NO: 381541 - protein, 10 aa, Influenza virus
RRIDFNWLLL

SEQ ID NO: 381542 - protein, 10 aa, Influenza virus
SGRIDFHWLV

SEQ ID NO: 381543 - protein, 10 aa, Influenza virus
GRIDFHWLVL

SEQ ID NO: 381544 - protein, 10 aa, Influenza virus
NDTITFSFNG

SEQ ID NO: 381545 - protein, 10 aa, Influenza virus
DTITFSFNGA

SEQ ID NO: 381546 - protein, 10 aa, Influenza virus
TITFSFNGAF

SEQ ID NO: 381547 - protein, 10 aa, Influenza virus
ITFSFNGAFI

SEQ ID NO: 381548 - protein, 10 aa, Influenza virus
IFNGAFIAPD

SEQ ID NO: 381549 - protein, 10 aa, Influenza virus
IAPDRASFFK

SEQ ID NO: 381550 - protein, 10 aa, Influenza virus
APDRASFFKG

SEQ ID NO: 381551 - protein, 10 aa, Influenza virus
RGTIVSSLPF

SEQ ID NO: 381552 - protein, 10 aa, Influenza virus
TIVSSLPFQS

SEQ ID NO: 381553 - protein, 10 aa, Influenza virus
IISSLPFQNI

SEQ ID NO: 381554 - protein, 10 aa, Influenza virus
VSSLPFQSIN

SEQ ID NO: 381555 - protein, 10 aa, Influenza virus
SSLPFQNISP

SEQ ID NO: 381556 - protein, 10 aa, Influenza virus
TVGKCPRYIK

SEQ ID NO: 381557 - protein, 10 aa, Influenza virus
VGKCPRYIKQ

SEQ ID NO: 381558 - protein, 10 aa, Influenza virus
VKQESLMLAT

SEQ ID NO: 381559 - protein, 10 aa, Influenza virus
KQESLMLATG

SEQ ID NO: 381560 - protein, 10 aa, Influenza virus
QESLMLATGM

SEQ ID NO: 381561 - protein, 10 aa, Influenza virus
ESLMLATGMK

SEQ ID NO: 381562 - protein, 10 aa, Influenza virus
LMLATGMKNV

SEQ ID NO: 381563 - protein, 10 aa, Influenza virus
MLATGMKNVP

SEQ ID NO: 381564 - protein, 10 aa, Influenza virus
ATGMRNIPEN

SEQ ID NO: 381565 - protein, 10 aa, Influenza virus
TGMRNIPENP

SEQ ID NO: 381566 - protein, 10 aa, Influenza virus
GMRNIPENPK

SEQ ID NO: 381567 - protein, 10 aa, Influenza virus
PKGRGLFGAI

SEQ ID NO: 381568 - protein, 10 aa, Influenza virus
KGRGLFGAIA

SEQ ID NO: 381569 - protein, 10 aa, Influenza virus
GRGLFGAIAG

SEQ ID NO: 381570 - protein, 10 aa, Influenza virus
ITGKLNRLIE

SEQ ID NO: 381571 - protein, 10 aa, Influenza virus
TGKLNRLIEK

SEQ ID NO: 381572 - protein, 10 aa, Influenza virus
GKLNRLIEKT

SEQ ID NO: 381573 - protein, 10 aa, Influenza virus
KLNRLIEKTN

SEQ ID NO: 381574 - protein, 10 aa, Influenza virus
LNRLIEKTNQ

SEQ ID NO: 381575 - protein, 10 aa, Influenza virus
NRLISKTNQQ

SEQ ID NO: 381576 - protein, 10 aa, Influenza virus
RLISKTNQQF

SEQ ID NO: 381577 - protein, 10 aa, Influenza virus
LISKTNQQFE

SEQ ID NO: 381578 - protein, 10 aa, Influenza virus
ISKTNQQFEL

SEQ ID NO: 381579 - protein, 10 aa, Influenza virus
SKTNQQFELI

SEQ ID NO: 381580 - protein, 10 aa, Influenza virus
KTNQQFGLID

SEQ ID NO: 381581 - protein, 10 aa, Influenza virus
TNQQFELIDS

SEQ ID NO: 381582 - protein, 10 aa, Influenza virus
NQQFELIDSE

SEQ ID NO: 381583 - protein, 10 aa, Influenza virus
QQFELIDSEF

SEQ ID NO: 381584 - protein, 10 aa, Influenza virus
FELIDNEFSE

SEQ ID NO: 381585 - protein, 10 aa, Influenza virus
NEFSEIEQQI

SEQ ID NO: 381586 - protein, 10 aa, Influenza virus
EFSEIEQQIG

SEQ ID NO: 381587 - protein, 10 aa, Influenza virus
FSEIEQQIGN

SEQ ID NO: 381588 - protein, 10 aa, Influenza virus
SEIEQQIGNV

SEQ ID NO: 381589 - protein, 10 aa, Influenza virus
NVINWTRDSI

SEQ ID NO: 381590 - protein, 10 aa, Influenza virus
VINWTRDSIT

SEQ ID NO: 381591 - protein, 10 aa, Influenza virus
INWTRDSITE

SEQ ID NO: 381592 - protein, 10 aa, Influenza virus
NWTRDAMTEV

SEQ ID NO: 381593 - protein, 10 aa, Influenza virus
WTRDAMTEVW

SEQ ID NO: 381594 - protein, 10 aa, Influenza virus
TRDAMTEVWS

SEQ ID NO: 381595 - protein, 10 aa, Influenza virus
RDAMTEVWSY

SEQ ID NO: 381596 - protein, 10 aa, Influenza virus
DSITEVWSYN

SEQ ID NO: 381597 - protein, 10 aa, Influenza virus
SITEVWSYNA

SEQ ID NO: 381598 - protein, 10 aa, Influenza virus
IDLADSEMKK

SEQ ID NO: 381599 - protein, 10 aa, Influenza virus
DLTDSEMNKL

SEQ ID NO: 381600 - protein, 10 aa, Influenza virus
LADSEMKKLY

SEQ ID NO: 381601 - protein, 10 aa, Influenza virus
DSEMDKLYER

SEQ ID NO: 381602 - protein, 10 aa, Influenza virus
EMNKLYERVK

SEQ ID NO: 381603 - protein, 10 aa, Influenza virus
KLYERVKRQL

SEQ ID NO: 381604 - protein, 10 aa, Influenza virus
LYERVKRQLR

SEQ ID NO: 381605 - protein, 10 aa, Influenza virus
YERVKRQLRE

SEQ ID NO: 381606 - protein, 10 aa, Influenza virus
ERVKRQLREN

SEQ ID NO: 381607 - protein, 10 aa, Influenza virus
RVKRQLRENA

SEQ ID NO: 381608 - protein, 10 aa, Influenza virus
VKRQLRENAE

SEQ ID NO: 381609 - protein, 10 aa, Influenza virus
KRQLRENAEE

SEQ ID NO: 381610 - protein, 10 aa, Influenza virus
FEIFHKCDNQ

SEQ ID NO: 381611 - protein, 10 aa, Influenza virus
EIFHKCDNQC

SEQ ID NO: 381612 - protein, 10 aa, Influenza virus
IFHKCDNQCM

SEQ ID NO: 381613 - protein, 10 aa, Influenza virus
FHKCDNQCME

SEQ ID NO: 381614 - protein, 10 aa, Influenza virus
HKCDNQCMES

SEQ ID NO: 381615 - protein, 10 aa, Influenza virus
KCDNQCMESI

SEQ ID NO: 381616 - protein, 10 aa, Influenza virus
CDNQCMESIR

SEQ ID NO: 381617 - protein, 10 aa, Influenza virus
DNQCMESIRN

SEQ ID NO: 381618 - protein, 10 aa, Influenza virus
NQCMESIRNN

SEQ ID NO: 381619 - protein, 10 aa, Influenza virus
IRNNTYDHTK

SEQ ID NO: 381620 - protein, 10 aa, Influenza virus
RNNTYNHTQY

SEQ ID NO: 381621 - protein, 10 aa, Influenza virus
NNTYNHTQYR

SEQ ID NO: 381622 - protein, 10 aa, Influenza virus
RYREEAMQNR

SEQ ID NO: 381623 - protein, 10 aa, Influenza virus
SLQNRIQIDQ

SEQ ID NO: 381624 - protein, 10 aa, Influenza virus
LQNRIQIDQV

SEQ ID NO: 381625 - protein, 10 aa, Influenza virus
IQIDPVKLSG

SEQ ID NO: 381626 - protein, 10 aa, Influenza virus
QIDPVKLSGG

SEQ ID NO: 381627 - protein, 10 aa, Influenza virus
IDPVKLSGGY

SEQ ID NO: 381628 - protein, 10 aa, Influenza virus
DPVKLSGGYK

SEQ ID NO: 381629 - protein, 10 aa, Influenza virus
PVKLSGGYKD

SEQ ID NO: 381630 - protein, 10 aa, Influenza virus
ASCFLLLAVV

SEQ ID NO: 381631 - protein, 10 aa, Influenza virus
LLAIAMGLGF

SEQ ID NO: 381632 - protein, 10 aa, Influenza virus
AVVMGLVFIC

SEQ ID NO: 381633 - protein, 10 aa, Influenza virus
AMGLVFICVK

SEQ ID NO: 381634 - protein, 10 aa, Influenza virus
MGLVFICMKN

SEQ ID NO: 381635 - protein, 10 aa, Influenza virus
GLVFICMKNG

SEQ ID NO: 381636 - protein, 10 aa, Influenza virus
LVFICMKNGN

SEQ ID NO: 381637 - protein, 10 aa, Influenza virus
VFICIKNGNV

SEQ ID NO: 381638 - protein, 10 aa, Influenza virus
FICVKNGNMR

SEQ ID NO: 381639 - protein, 10 aa, Influenza virus
MCVKNGNMRC

SEQ ID NO: 381640 - protein, 10 aa, Influenza virus
CIKNGNVRCT

SEQ ID NO: 381641 - protein, 10 aa, Influenza virus
IKNGNVRCTI

SEQ ID NO: 381642 - protein, 10 aa, Influenza virus
IGSVSLTIAI

SEQ ID NO: 381643 - protein, 10 aa, Influenza virus
EKNITKIVYL

SEQ ID NO: 381644 - protein, 10 aa, Influenza virus
RNVTETLYLN

SEQ ID NO: 381645 - protein, 10 aa, Influenza virus
NITKIVYLNS

SEQ ID NO: 381646 - protein, 10 aa, Influenza virus
ITEIVYLNST

SEQ ID NO: 381647 - protein, 10 aa, Influenza virus
YRIWSKPQCQ

SEQ ID NO: 381648 - protein, 10 aa, Influenza virus
KSWSKPQCQI

SEQ ID NO: 381649 - protein, 10 aa, Influenza virus
WSKPQCKITG

SEQ ID NO: 381650 - protein, 10 aa, Influenza virus
NSVRLSAGGD

SEQ ID NO: 381651 - protein, 10 aa, Influenza virus
SVRLSAGGDI

SEQ ID NO: 381652 - protein, 10 aa, Influenza virus
VRLSASGDIW

SEQ ID NO: 381653 - protein, 10 aa, Influenza virus
RLSAGGNIWI

SEQ ID NO: 381654 - protein, 10 aa, Influenza virus
LSAGGNIWIT

SEQ ID NO: 381655 - protein, 10 aa, Influenza virus
SAGGNIWITR

SEQ ID NO: 381656 - protein, 10 aa, Influenza virus
AGGNIWITRE

SEQ ID NO: 381657 - protein, 10 aa, Influenza virus
SGDIWITREP

SEQ ID NO: 381658 - protein, 10 aa, Influenza virus
GNIWITREPY

SEQ ID NO: 381659 - protein, 10 aa, Influenza virus
NIWITREPYV

SEQ ID NO: 381660 - protein, 10 aa, Influenza virus
VTREPYVSCG

SEQ ID NO: 381661 - protein, 10 aa, Influenza virus
TREPYVSCSL

SEQ ID NO: 381662 - protein, 10 aa, Influenza virus
DKCYQFALGQ

SEQ ID NO: 381663 - protein, 10 aa, Influenza virus
FALGQGTTLN

SEQ ID NO: 381664 - protein, 10 aa, Influenza virus
ALGQGTTLNN

SEQ ID NO: 381665 - protein, 10 aa, Influenza virus
LGQGTTLENK

SEQ ID NO: 381666 - protein, 10 aa, Influenza virus
GQGTTLENKH

SEQ ID NO: 381667 - protein, 10 aa, Influenza virus
QGTTLENKHS

SEQ ID NO: 381668 - protein, 10 aa, Influenza virus
GTTLENKHSN

SEQ ID NO: 381669 - protein, 10 aa, Influenza virus
TTLENKHSNG

SEQ ID NO: 381670 - protein, 10 aa, Influenza virus
TLENKHSNGT

SEQ ID NO: 381671 - protein, 10 aa, Influenza virus
HSNGTTHDRT

SEQ ID NO: 381672 - protein, 10 aa, Influenza virus
HDRISHRTLL

SEQ ID NO: 381673 - protein, 10 aa, Influenza virus
DRISHRTLLM

SEQ ID NO: 381674 - protein, 10 aa, Influenza virus
RISHRTLLMN

SEQ ID NO: 381675 - protein, 10 aa, Influenza virus
ISHRTLLMNE

SEQ ID NO: 381676 - protein, 10 aa, Influenza virus
LHICVTGDDR

SEQ ID NO: 381677 - protein, 10 aa, Influenza virus
HVCITGDDRN

SEQ ID NO: 381678 - protein, 10 aa, Influenza virus
VCVTGDDKNA

SEQ ID NO: 381679 - protein, 10 aa, Influenza virus
NATASFIYGG

SEQ ID NO: 381680 - protein, 10 aa, Influenza virus
ECVCINGTCA

SEQ ID NO: 381681 - protein, 10 aa, Influenza virus
CVCINGTCAV

SEQ ID NO: 381682 - protein, 10 aa, Influenza virus
VCINGTCAVV

SEQ ID NO: 381683 - protein, 10 aa, Influenza virus
CINGTCAVVM

SEQ ID NO: 381684 - protein, 10 aa, Influenza virus
INGTCAVVMT

SEQ ID NO: 381685 - protein, 10 aa, Influenza virus
NGTCAVVMTD

SEQ ID NO: 381686 - protein, 10 aa, Influenza virus
GTCAVVMTDG

SEQ ID NO: 381687 - protein, 10 aa, Influenza virus
SCAVVMTDGS

SEQ ID NO: 381688 - protein, 10 aa, Influenza virus
IVVMTDGSAS

SEQ ID NO: 381689 - protein, 10 aa, Influenza virus
VMTDGSASRK

SEQ ID NO: 381690 - protein, 10 aa, Influenza virus
MTDGSASRKA

SEQ ID NO: 381691 - protein, 10 aa, Influenza virus
TDGSASGRAD

SEQ ID NO: 381692 - protein, 10 aa, Influenza virus
DGSASGRADT

SEQ ID NO: 381693 - protein, 10 aa, Influenza virus
EGKISHISPL

SEQ ID NO: 381694 - protein, 10 aa, Influenza virus
GKISHISPLS

SEQ ID NO: 381695 - protein, 10 aa, Influenza virus
KISHISPLSG

SEQ ID NO: 381696 - protein, 10 aa, Influenza virus
ISHISPLSGS

SEQ ID NO: 381697 - protein, 10 aa, Influenza virus
SHISPLSGSA

SEQ ID NO: 381698 - protein, 10 aa, Influenza virus
KGSNRPVVDI

SEQ ID NO: 381699 - protein, 10 aa, Influenza virus
GSNRPVVDIN

SEQ ID NO: 381700 - protein, 10 aa, Influenza virus
SNRPVVDINM

SEQ ID NO: 381701 - protein, 10 aa, Influenza virus
IDSSYLCSGL

SEQ ID NO: 381702 - protein, 10 aa, Influenza virus
GSSYVCSGLV

SEQ ID NO: 381703 - protein, 10 aa, Influenza virus
TPRNDDSSSN

SEQ ID NO: 381704 - protein, 10 aa, Influenza virus
PRNEDSSSNS

SEQ ID NO: 381705 - protein, 10 aa, Influenza virus
RNDDSSSNSN

SEQ ID NO: 381706 - protein, 10 aa, Influenza virus
NEDSSSNSNC

SEQ ID NO: 381707 - protein, 10 aa, Influenza virus
DPNNEKGNPG

SEQ ID NO: 381708 - protein, 10 aa, Influenza virus
PNNEKGNPGV

SEQ ID NO: 381709 - protein, 10 aa, Influenza virus
NNEKGNPGVK

SEQ ID NO: 381710 - protein, 10 aa, Influenza virus
NEKGNPGVKG

SEQ ID NO: 381711 - protein, 10 aa, Influenza virus
VKGWAFDYGS

SEQ ID NO: 381712 - protein, 10 aa, Influenza virus
KGWAFDNGND

SEQ ID NO: 381713 - protein, 10 aa, Influenza virus
YGSDVWMGRT

SEQ ID NO: 381714 - protein, 10 aa, Influenza virus
SGYETFKVIG

SEQ ID NO: 381715 - protein, 10 aa, Influenza virus
GYETFKVIGG

SEQ ID NO: 381716 - protein, 10 aa, Influenza virus
YETFKVIGGW

SEQ ID NO: 381717 - protein, 10 aa, Influenza virus
ETFRVIDGWT

SEQ ID NO: 381718 - protein, 10 aa, Influenza virus
VISGWTTANS

SEQ ID NO: 381719 - protein, 10 aa, Influenza virus
ISGWTTANSK

SEQ ID NO: 381720 - protein, 10 aa, Influenza virus
SGWTTANSKS

SEQ ID NO: 381721 - protein, 10 aa, Influenza virus
GWTTANSKSK

SEQ ID NO: 381722 - protein, 10 aa, Influenza virus
RQVIVDNNSW

SEQ ID NO: 381723 - protein, 10 aa, Influenza virus
IVDNNSWSGY

SEQ ID NO: 381724 - protein, 10 aa, Influenza virus
VDNNSWSGYS

SEQ ID NO: 381725 - protein, 10 aa, Influenza virus
DNNSWSGYSG

SEQ ID NO: 381726 - protein, 10 aa, Influenza virus
NNSWSGYSGI

SEQ ID NO: 381727 - protein, 10 aa, Influenza virus
NNWSGYSGVF

SEQ ID NO: 381728 - protein, 10 aa, Influenza virus
NCINRCFYVE

SEQ ID NO: 381729 - protein, 10 aa, Influenza virus
PQETGVWWTS

SEQ ID NO: 381730 - protein, 10 aa, Influenza virus
QEARVWWTSN

SEQ ID NO: 381731 - protein, 10 aa, Influenza virus
ETTVWWTSNS

SEQ ID NO: 381732 - protein, 10 aa, Influenza virus
ARVWWTSNSI

SEQ ID NO: 381733 - protein, 10 aa, Influenza virus
IVVFCGTSRT

SEQ ID NO: 381734 - protein, 10 aa, Influenza virus
SWPDGANINL

SEQ ID NO: 381735 - protein, 10 aa, Influenza virus
WPDGANIDFV

SEQ ID NO: 381736 - protein, 10 aa, Influenza virus
GYKMNTQILI

SEQ ID NO: 381737 - protein, 10 aa, Influenza virus
YKMNTQILIF

SEQ ID NO: 381738 - protein, 10 aa, Influenza virus
KMNTQILIFT

SEQ ID NO: 381739 - protein, 10 aa, Influenza virus
KICLGHHAVT

SEQ ID NO: 381740 - protein, 10 aa, Influenza virus
ICLGHHAVTN

SEQ ID NO: 381741 - protein, 10 aa, Influenza virus
CLGHHAVTNG

SEQ ID NO: 381742 - protein, 10 aa, Influenza virus
LGHHAVTNGT

SEQ ID NO: 381743 - protein, 10 aa, Influenza virus
GHHAVANGTR

SEQ ID NO: 381744 - protein, 10 aa, Influenza virus
HHAVANGTRV

SEQ ID NO: 381745 - protein, 10 aa, Influenza virus
NGTKVDTLTG

SEQ ID NO: 381746 - protein, 10 aa, Influenza virus
VDTLTEKGIE

SEQ ID NO: 381747 - protein, 10 aa, Influenza virus
DTLTEKGIEV

SEQ ID NO: 381748 - protein, 10 aa, Influenza virus
TLTGRGIEVV

SEQ ID NO: 381749 - protein, 10 aa, Influenza virus
LTERGVEVVD

SEQ ID NO: 381750 - protein, 10 aa, Influenza virus
TERGVEVVDA

SEQ ID NO: 381751 - protein, 10 aa, Influenza virus
ERGVEVVDAT

SEQ ID NO: 381752 - protein, 10 aa, Influenza virus
RGVEVVDATE

SEQ ID NO: 381753 - protein, 10 aa, Influenza virus
VVNATETVEQ

SEQ ID NO: 381754 - protein, 10 aa, Influenza virus
TDLGQCGILG

SEQ ID NO: 381755 - protein, 10 aa, Influenza virus
DMGQCGLLGT

SEQ ID NO: 381756 - protein, 10 aa, Influenza virus
CGILGILTGP

SEQ ID NO: 381757 - protein, 10 aa, Influenza virus
GILGILTGPP

SEQ ID NO: 381758 - protein, 10 aa, Influenza virus
ILGILTGPPQ

SEQ ID NO: 381759 - protein, 10 aa, Influenza virus
LGILTGPPQC

SEQ ID NO: 381760 - protein, 10 aa, Influenza virus
GILTGPPQCD

SEQ ID NO: 381761 - protein, 10 aa, Influenza virus
IGPPQCDRFL

SEQ ID NO: 381762 - protein, 10 aa, Influenza virus
DVCYPGKFSN

SEQ ID NO: 381763 - protein, 10 aa, Influenza virus
LRQVLRESGG

SEQ ID NO: 381764 - protein, 10 aa, Influenza virus
RQVLRESGGI

SEQ ID NO: 381765 - protein, 10 aa, Influenza virus
DSSFYAEMKW

SEQ ID NO: 381766 - protein, 10 aa, Influenza virus
AEMKWLLSNA

SEQ ID NO: 381767 - protein, 10 aa, Influenza virus
EMKWLLSNAD

SEQ ID NO: 381768 - protein, 10 aa, Influenza virus
MKWLLSNADN

SEQ ID NO: 381769 - protein, 10 aa, Influenza virus
PALIVWGVHH

SEQ ID NO: 381770 - protein, 10 aa, Influenza virus
ALIVWGVHHS

SEQ ID NO: 381771 - protein, 10 aa, Influenza virus
LYGSGNKLVT

SEQ ID NO: 381772 - protein, 10 aa, Influenza virus
YGSGNKLVTV

SEQ ID NO: 381773 - protein, 10 aa, Influenza virus
SSKCQQSFTP

SEQ ID NO: 381774 - protein, 10 aa, Influenza virus
SKYLQSFTPS

SEQ ID NO: 381775 - protein, 10 aa, Influenza virus
YLQSFTPSPG

SEQ ID NO: 381776 - protein, 10 aa, Influenza virus
QSFVPSPGSR

SEQ ID NO: 381777 - protein, 10 aa, Influenza virus
VNGQTGRIDF

SEQ ID NO: 381778 - protein, 10 aa, Influenza virus
NGQTGRIDFH

SEQ ID NO: 381779 - protein, 10 aa, Influenza virus
GQSGRINFHW

SEQ ID NO: 381780 - protein, 10 aa, Influenza virus
QTGRIDFHWL

SEQ ID NO: 381781 - protein, 10 aa, Influenza virus
NDTVIFSFNG

SEQ ID NO: 381782 - protein, 10 aa, Influenza virus
FNFNGAFIAP

SEQ ID NO: 381783 - protein, 10 aa, Influenza virus
SSNGAFIAPD

SEQ ID NO: 381784 - protein, 10 aa, Influenza virus
GAFVAPDRVS

SEQ ID NO: 381785 - protein, 10 aa, Influenza virus
AFVAPDRVSF

SEQ ID NO: 381786 - protein, 10 aa, Influenza virus
FIAPDRATFL

SEQ ID NO: 381787 - protein, 10 aa, Influenza virus
GGTITSNLPF

SEQ ID NO: 381788 - protein, 10 aa, Influenza virus
GTITSNLPFQ

SEQ ID NO: 381789 - protein, 10 aa, Influenza virus
TITSNLPFQN

SEQ ID NO: 381790 - protein, 10 aa, Influenza virus
ITSNLPFQNV

SEQ ID NO: 381791 - protein, 10 aa, Influenza virus
TSNLPFQNVN

SEQ ID NO: 381792 - protein, 10 aa, Influenza virus
PLPFQNINPR

SEQ ID NO: 381793 - protein, 10 aa, Influenza virus
LPFQNVNSRA

SEQ ID NO: 381794 - protein, 10 aa, Influenza virus
VGRCPRYVKQ

SEQ ID NO: 381795 - protein, 10 aa, Influenza virus
ATGMRNVPEK

SEQ ID NO: 381796 - protein, 10 aa, Influenza virus
TGMRNVPEKP

SEQ ID NO: 381797 - protein, 10 aa, Influenza virus
GMRNVPEKPK

SEQ ID NO: 381798 - protein, 10 aa, Influenza virus
RRRGLFGAIA

SEQ ID NO: 381799 - protein, 10 aa, Influenza virus
AYQKRMTRGL

SEQ ID NO: 381800 - protein, 10 aa, Influenza virus
YQKRMTRGLF

SEQ ID NO: 381801 - protein, 10 aa, Influenza virus
QKRMTRGLFG

SEQ ID NO: 381802 - protein, 10 aa, Influenza virus
KQMTRGLFGA

SEQ ID NO: 381803 - protein, 10 aa, Influenza virus
QMTRGLFGAI

SEQ ID NO: 381804 - protein, 10 aa, Influenza virus
GLIDGWYGFK

SEQ ID NO: 381805 - protein, 10 aa, Influenza virus
LIDGWYGFKH

SEQ ID NO: 381806 - protein, 10 aa, Influenza virus
IDGWYGFKHQ

SEQ ID NO: 381807 - protein, 10 aa, Influenza virus
DYKSTPSAID

SEQ ID NO: 381808 - protein, 10 aa, Influenza virus
YKSTPSAIDQ

SEQ ID NO: 381809 - protein, 10 aa, Influenza virus
KSTPSAIDQI

SEQ ID NO: 381810 - protein, 10 aa, Influenza virus
STPSAIDQIT

SEQ ID NO: 381811 - protein, 10 aa, Influenza virus
TPSAIDQITG

SEQ ID NO: 381812 - protein, 10 aa, Influenza virus
PSAIDQITGK

SEQ ID NO: 381813 - protein, 10 aa, Influenza virus
ITGKLNRFIE

SEQ ID NO: 381814 - protein, 10 aa, Influenza virus
TGKLNRLIDR

SEQ ID NO: 381815 - protein, 10 aa, Influenza virus
GKLNRLIDRT

SEQ ID NO: 381816 - protein, 10 aa, Influenza virus
KLNRFIEKTN

SEQ ID NO: 381817 - protein, 10 aa, Influenza virus
LNRLIDRTNH

SEQ ID NO: 381818 - protein, 10 aa, Influenza virus
NRFIEKTNQQ

SEQ ID NO: 381819 - protein, 10 aa, Influenza virus
RFIEKTNQQF

SEQ ID NO: 381820 - protein, 10 aa, Influenza virus
IEKTNQQFKL

SEQ ID NO: 381821 - protein, 10 aa, Influenza virus
EKTNQQFKLI

SEQ ID NO: 381822 - protein, 10 aa, Influenza virus
RTNHQFELID

SEQ ID NO: 381823 - protein, 10 aa, Influenza virus
TNHQFELIDN

SEQ ID NO: 381824 - protein, 10 aa, Influenza virus
NHQFELIDNE

SEQ ID NO: 381825 - protein, 10 aa, Influenza virus
HQFELIDNEF

SEQ ID NO: 381826 - protein, 10 aa, Influenza virus
FIEVEKQIGN

SEQ ID NO: 381827 - protein, 10 aa, Influenza virus
NVINWTRDAM

SEQ ID NO: 381828 - protein, 10 aa, Influenza virus
IINWTRDSMT

SEQ ID NO: 381829 - protein, 10 aa, Influenza virus
NWTRDSVTEL

SEQ ID NO: 381830 - protein, 10 aa, Influenza virus
WTRDSVTELW

SEQ ID NO: 381831 - protein, 10 aa, Influenza virus
TRDSVTELWS

SEQ ID NO: 381832 - protein, 10 aa, Influenza virus
RDSVTELWSY

SEQ ID NO: 381833 - protein, 10 aa, Influenza virus
DSVTELWSYN

SEQ ID NO: 381834 - protein, 10 aa, Influenza virus
SVTELWSYNA

SEQ ID NO: 381835 - protein, 10 aa, Influenza virus
VTELWSYNAE

SEQ ID NO: 381836 - protein, 10 aa, Influenza virus
VWSYNAELLI

SEQ ID NO: 381837 - protein, 10 aa, Influenza virus
IDLANSEMNK

SEQ ID NO: 381838 - protein, 10 aa, Influenza virus
DLADSEMNNL

SEQ ID NO: 381839 - protein, 10 aa, Influenza virus
LADSEMNNLY

SEQ ID NO: 381840 - protein, 10 aa, Influenza virus
ADSEMDKLYT

SEQ ID NO: 381841 - protein, 10 aa, Influenza virus
NSEMNKLYER

SEQ ID NO: 381842 - protein, 10 aa, Influenza virus
SEMNNLYERV

SEQ ID NO: 381843 - protein, 10 aa, Influenza virus
NLYERVRKQL

SEQ ID NO: 381844 - protein, 10 aa, Influenza virus
LHERVRKQLR

SEQ ID NO: 381845 - protein, 10 aa, Influenza virus
YERVRKQLRA

SEQ ID NO: 381846 - protein, 10 aa, Influenza virus
TRVKRQLREN

SEQ ID NO: 381847 - protein, 10 aa, Influenza virus
KRQLRENAEK

SEQ ID NO: 381848 - protein, 10 aa, Influenza virus
SIRNNTYDHN

SEQ ID NO: 381849 - protein, 10 aa, Influenza virus
QYRAESLQNR

SEQ ID NO: 381850 - protein, 10 aa, Influenza virus
YREEAMQNRM

SEQ ID NO: 381851 - protein, 10 aa, Influenza virus
QNRMQINPVK

SEQ ID NO: 381852 - protein, 10 aa, Influenza virus
NRMQINPVKL

SEQ ID NO: 381853 - protein, 10 aa, Influenza virus
DPVKLSNGYK

SEQ ID NO: 381854 - protein, 10 aa, Influenza virus
PVKLSNGYKD

SEQ ID NO: 381855 - protein, 10 aa, Influenza virus
SGGYKDIILW

SEQ ID NO: 381856 - protein, 10 aa, Influenza virus
GGYKDIILWF

SEQ ID NO: 381857 - protein, 10 aa, Influenza virus
FGFGASCFLL

SEQ ID NO: 381858 - protein, 10 aa, Influenza virus
SFGASCFLFL

SEQ ID NO: 381859 - protein, 10 aa, Influenza virus
FGASCFLFLA

SEQ ID NO: 381860 - protein, 10 aa, Influenza virus
GASCFLFLAI

SEQ ID NO: 381861 - protein, 10 aa, Influenza virus
FICVKNGNHA

SEQ ID NO: 381862 - protein, 10 aa, Influenza virus
ICIKNGNMQC

SEQ ID NO: 381863 - protein, 10 aa, Influenza virus
GVVNTALSTI

SEQ ID NO: 381864 - protein, 10 aa, Influenza virus
SVNTVLSIIA

SEQ ID NO: 381865 - protein, 10 aa, Influenza virus
NTALSTIALL

SEQ ID NO: 381866 - protein, 10 aa, Influenza virus
TALSTIALLI

SEQ ID NO: 381867 - protein, 10 aa, Influenza virus
VLSIIALLIG

SEQ ID NO: 381868 - protein, 10 aa, Influenza virus
LSTIALFIGV

SEQ ID NO: 381869 - protein, 10 aa, Influenza virus
STIALFIGVG

SEQ ID NO: 381870 - protein, 10 aa, Influenza virus
TIALFIGVGN

SEQ ID NO: 381871 - protein, 10 aa, Influenza virus
IALFIGVGNL

SEQ ID NO: 381872 - protein, 10 aa, Influenza virus
IGVGNLAFNT

SEQ ID NO: 381873 - protein, 10 aa, Influenza virus
GIGNLIFNTV

SEQ ID NO: 381874 - protein, 10 aa, Influenza virus
IGNLIFNTVI

SEQ ID NO: 381875 - protein, 10 aa, Influenza virus
NLVFNTVIHG

SEQ ID NO: 381876 - protein, 10 aa, Influenza virus
ITYNKTVINN

SEQ ID NO: 381877 - protein, 10 aa, Influenza virus
TYNKTVINNI

SEQ ID NO: 381878 - protein, 10 aa, Influenza virus
YNKTVINNIT

SEQ ID NO: 381879 - protein, 10 aa, Influenza virus
NKTVINNITT

SEQ ID NO: 381880 - protein, 10 aa, Influenza virus
KTVINNITTT

SEQ ID NO: 381881 - protein, 10 aa, Influenza virus
VINNMTTTII

SEQ ID NO: 381882 - protein, 10 aa, Influenza virus
FKPSLPLCPF

SEQ ID NO: 381883 - protein, 10 aa, Influenza virus
SLPLCPFKGF

SEQ ID NO: 381884 - protein, 10 aa, Influenza virus
VQGFFPFHKD

SEQ ID NO: 381885 - protein, 10 aa, Influenza virus
GNSARLIHHT

SEQ ID NO: 381886 - protein, 10 aa, Influenza virus
VLVTREPYIS

SEQ ID NO: 381887 - protein, 10 aa, Influenza virus
IVTREPCVSC

SEQ ID NO: 381888 - protein, 10 aa, Influenza virus
GCWSFALAQG

SEQ ID NO: 381889 - protein, 10 aa, Influenza virus
LAQGALLGTR

SEQ ID NO: 381890 - protein, 10 aa, Influenza virus
AQGALLGTRH

SEQ ID NO: 381891 - protein, 10 aa, Influenza virus
QGALLGTRHS

SEQ ID NO: 381892 - protein, 10 aa, Influenza virus
GALLGTRHSN

SEQ ID NO: 381893 - protein, 10 aa, Influenza virus
ALLGTRHSNG

SEQ ID NO: 381894 - protein, 10 aa, Influenza virus
LLGTRHSNGT

SEQ ID NO: 381895 - protein, 10 aa, Influenza virus
KDRAPYRSLI

SEQ ID NO: 381896 - protein, 10 aa, Influenza virus
DKTPYRSLIR

SEQ ID NO: 381897 - protein, 10 aa, Influenza virus
KTPYRSLIRF

SEQ ID NO: 381898 - protein, 10 aa, Influenza virus
SYRSLIRFPI

SEQ ID NO: 381899 - protein, 10 aa, Influenza virus
YRSLIRFPVG

SEQ ID NO: 381900 - protein, 10 aa, Influenza virus
RSLIQFPMGT

SEQ ID NO: 381901 - protein, 10 aa, Influenza virus
SLIQFPMGTA

SEQ ID NO: 381902 - protein, 10 aa, Influenza virus
LIQFPIGTAP

SEQ ID NO: 381903 - protein, 10 aa, Influenza virus
FPIGTAPILG

SEQ ID NO: 381904 - protein, 10 aa, Influenza virus
PVGTAPVLGN

SEQ ID NO: 381905 - protein, 10 aa, Influenza virus
VGTAPVLGNY

SEQ ID NO: 381906 - protein, 10 aa, Influenza virus
GTAPILGNYK

SEQ ID NO: 381907 - protein, 10 aa, Influenza virus
TAPILGNYKE

SEQ ID NO: 381908 - protein, 10 aa, Influenza virus
APVLGNYREV

SEQ ID NO: 381909 - protein, 10 aa, Influenza virus
PVLGNYREVC

SEQ ID NO: 381910 - protein, 10 aa, Influenza virus
LGNYKEMCAA

SEQ ID NO: 381911 - protein, 10 aa, Influenza virus
GNYREVCIAW

SEQ ID NO: 381912 - protein, 10 aa, Influenza virus
NYKEIRIAWS

SEQ ID NO: 381913 - protein, 10 aa, Influenza virus
YREVCIAWSS

SEQ ID NO: 381914 - protein, 10 aa, Influenza virus
EMCAAWSSSS

SEQ ID NO: 381915 - protein, 10 aa, Influenza virus
IRIAWSSSSC

SEQ ID NO: 381916 - protein, 10 aa, Influenza virus
RIAWSSSSCF

SEQ ID NO: 381917 - protein, 10 aa, Influenza virus
DGKEWMHICM

SEQ ID NO: 381918 - protein, 10 aa, Influenza virus
GKEWMHICMT

SEQ ID NO: 381919 - protein, 10 aa, Influenza virus
KEWMHVCMAG

SEQ ID NO: 381920 - protein, 10 aa, Influenza virus
GKMRDSIKSW

SEQ ID NO: 381921 - protein, 10 aa, Influenza virus
RVTDSIKSWR

SEQ ID NO: 381922 - protein, 10 aa, Influenza virus
MADSIKSWRK

SEQ ID NO: 381923 - protein, 10 aa, Influenza virus
RDSIKSWRNN

SEQ ID NO: 381924 - protein, 10 aa, Influenza virus
TQESECQRID

SEQ ID NO: 381925 - protein, 10 aa, Influenza virus
QESECLCIDG

SEQ ID NO: 381926 - protein, 10 aa, Influenza virus
GTCIVAVTDG

SEQ ID NO: 381927 - protein, 10 aa, Influenza virus
TCIVAVTDGP

SEQ ID NO: 381928 - protein, 10 aa, Influenza virus
VVAVTDGPAD

SEQ ID NO: 381929 - protein, 10 aa, Influenza virus
SVTDGPAANS

SEQ ID NO: 381930 - protein, 10 aa, Influenza virus
PAANSAHHRV

SEQ ID NO: 381931 - protein, 10 aa, Influenza virus
ADNKADHRIY

SEQ ID NO: 381932 - protein, 10 aa, Influenza virus
ANNADHRVYW

SEQ ID NO: 381933 - protein, 10 aa, Influenza virus
NKADHRIYWI

SEQ ID NO: 381934 - protein, 10 aa, Influenza virus
NADHRVYWIR

SEQ ID NO: 381935 - protein, 10 aa, Influenza virus
AHHRVYWIRE

SEQ ID NO: 381936 - protein, 10 aa, Influenza virus
HHRVYWIREG

SEQ ID NO: 381937 - protein, 10 aa, Influenza virus
HRIYWIREGK

SEQ ID NO: 381938 - protein, 10 aa, Influenza virus
KIRHLEECSC

SEQ ID NO: 381939 - protein, 10 aa, Influenza virus
RHLEECSCYV

SEQ ID NO: 381940 - protein, 10 aa, Influenza virus
LEECSCYVDT

SEQ ID NO: 381941 - protein, 10 aa, Influenza virus
EECSCYVDVD

SEQ ID NO: 381942 - protein, 10 aa, Influenza virus
ECSCYVDVDV

SEQ ID NO: 381943 - protein, 10 aa, Influenza virus
CSCYVDTDVY

SEQ ID NO: 381944 - protein, 10 aa, Influenza virus
SCYVDTDVYC

SEQ ID NO: 381945 - protein, 10 aa, Influenza virus
DVDVYCICRD

SEQ ID NO: 381946 - protein, 10 aa, Influenza virus
TDVYCICRDN

SEQ ID NO: 381947 - protein, 10 aa, Influenza virus
GSNRPWVRIN

SEQ ID NO: 381948 - protein, 10 aa, Influenza virus
SNRPWVRMNN

SEQ ID NO: 381949 - protein, 10 aa, Influenza virus
NRPWVRMNNE

SEQ ID NO: 381950 - protein, 10 aa, Influenza virus
RPWVRMNNET

SEQ ID NO: 381951 - protein, 10 aa, Influenza virus
PWVRINNETI

SEQ ID NO: 381952 - protein, 10 aa, Influenza virus
WVRMNNETIL

SEQ ID NO: 381953 - protein, 10 aa, Influenza virus
VRINNETILE

SEQ ID NO: 381954 - protein, 10 aa, Influenza virus
INNETILETR

SEQ ID NO: 381955 - protein, 10 aa, Influenza virus
KFHSDTPRPV

SEQ ID NO: 381956 - protein, 10 aa, Influenza virus
FHSDTPRPVD

SEQ ID NO: 381957 - protein, 10 aa, Influenza virus
HSDTPRPTDP

SEQ ID NO: 381958 - protein, 10 aa, Influenza virus
SDTPRPTDPS

SEQ ID NO: 381959 - protein, 10 aa, Influenza virus
DPSIMSCDSP

SEQ ID NO: 381960 - protein, 10 aa, Influenza virus
PSIMSCDSPS

SEQ ID NO: 381961 - protein, 10 aa, Influenza virus
SIMSCDSPSN

SEQ ID NO: 381962 - protein, 10 aa, Influenza virus
SCDSPSNANG

SEQ ID NO: 381963 - protein, 10 aa, Influenza virus
CDSPSNVKGG

SEQ ID NO: 381964 - protein, 10 aa, Influenza virus
KGGPGVKGFG

SEQ ID NO: 381965 - protein, 10 aa, Influenza virus
GVKGFGFKVG

SEQ ID NO: 381966 - protein, 10 aa, Influenza virus
VWLGRTVSIS

SEQ ID NO: 381967 - protein, 10 aa, Influenza virus
WLGRTVSISG

SEQ ID NO: 381968 - protein, 10 aa, Influenza virus
LGRTVSINGR

SEQ ID NO: 381969 - protein, 10 aa, Influenza virus
GRTVSINGRS

SEQ ID NO: 381970 - protein, 10 aa, Influenza virus
DGWINSPNHA

SEQ ID NO: 381971 - protein, 10 aa, Influenza virus
GWIDSPNHAK

SEQ ID NO: 381972 - protein, 10 aa, Influenza virus
WIDSPNHAKS

SEQ ID NO: 381973 - protein, 10 aa, Influenza virus
AKSLTQTLVS

SEQ ID NO: 381974 - protein, 10 aa, Influenza virus
SITQTLVSNS

SEQ ID NO: 381975 - protein, 10 aa, Influenza virus
ITQTLVSNSD

SEQ ID NO: 381976 - protein, 10 aa, Influenza virus
FYVELIRGRL

SEQ ID NO: 381977 - protein, 10 aa, Influenza virus
YVELIRGRLN

SEQ ID NO: 381978 - protein, 10 aa, Influenza virus
NDDVSWASNS

SEQ ID NO: 381979 - protein, 10 aa, Influenza virus
DDVSWASNSI

SEQ ID NO: 381980 - protein, 10 aa, Influenza virus
DVSWASNSIV

SEQ ID NO: 381981 - protein, 10 aa, Influenza virus
GYKMNTQILI

SEQ ID NO: 381982 - protein, 10 aa, Influenza virus
YKMNIQILIL

SEQ ID NO: 381983 - protein, 10 aa, Influenza virus
KMNIQILILA

SEQ ID NO: 381984 - protein, 10 aa, Influenza virus
DKICLGHHAA

SEQ ID NO: 381985 - protein, 10 aa, Influenza virus
NGAKVNTLTE

SEQ ID NO: 381986 - protein, 10 aa, Influenza virus
GTKVNTLTEK

SEQ ID NO: 381987 - protein, 10 aa, Influenza virus
KVNTLTEREV

SEQ ID NO: 381988 - protein, 10 aa, Influenza virus
VNTLTEKGIE

SEQ ID NO: 381989 - protein, 10 aa, Influenza virus
NTLTEKGIEV

SEQ ID NO: 381990 - protein, 10 aa, Influenza virus
TLTEREVEVV

SEQ ID NO: 381991 - protein, 10 aa, Influenza virus
LTEREVEVVN

SEQ ID NO: 381992 - protein, 10 aa, Influenza virus
TEREVEVVNA

SEQ ID NO: 381993 - protein, 10 aa, Influenza virus
EREVEVVNAT

SEQ ID NO: 381994 - protein, 10 aa, Influenza virus
REVEVVNATE

SEQ ID NO: 381995 - protein, 10 aa, Influenza virus
DLGRCGLLGT

SEQ ID NO: 381996 - protein, 10 aa, Influenza virus
TGPPQCDLFL

SEQ ID NO: 381997 - protein, 10 aa, Influenza virus
LRKILRKSGG

SEQ ID NO: 381998 - protein, 10 aa, Influenza virus
MRFTYSGIRT

SEQ ID NO: 381999 - protein, 10 aa, Influenza virus
RFTYSGIRTN

SEQ ID NO: 382000 - protein, 10 aa, Influenza virus
FTYTGVRTDG

SEQ ID NO: 382001 - protein, 10 aa, Influenza virus
RSGPSFYAEM

SEQ ID NO: 382002 - protein, 10 aa, Influenza virus
SESSFYAEME

SEQ ID NO: 382003 - protein, 10 aa, Influenza virus
GPSFYAEMKW

SEQ ID NO: 382004 - protein, 10 aa, Influenza virus
YAEMKWLLSD

SEQ ID NO: 382005 - protein, 10 aa, Influenza virus
FPQMTRSYKN

SEQ ID NO: 382006 - protein, 10 aa, Influenza virus
PALITWGIHH

SEQ ID NO: 382007 - protein, 10 aa, Influenza virus
TVWSSKYQRS

SEQ ID NO: 382008 - protein, 10 aa, Influenza virus
RPPVNGQSGR

SEQ ID NO: 382009 - protein, 10 aa, Influenza virus
PPVNGQSGRI

SEQ ID NO: 382010 - protein, 10 aa, Influenza virus
PVNGQSGRID

SEQ ID NO: 382011 - protein, 10 aa, Influenza virus
NDTVNFSFNG

SEQ ID NO: 382012 - protein, 10 aa, Influenza virus
DTVNFSFNGA

SEQ ID NO: 382013 - protein, 10 aa, Influenza virus
TVNFSFNGAF

SEQ ID NO: 382014 - protein, 10 aa, Influenza virus
NFSFNGAFIA

SEQ ID NO: 382015 - protein, 10 aa, Influenza virus
FNFNGAFVAP

SEQ ID NO: 382016 - protein, 10 aa, Influenza virus
GAFIAPDRAG

SEQ ID NO: 382017 - protein, 10 aa, Influenza virus
AFIAPDRAGF

SEQ ID NO: 382018 - protein, 10 aa, Influenza virus
LPFQNVNSRA

SEQ ID NO: 382019 - protein, 10 aa, Influenza virus
VGRCPRYVKQ

SEQ ID NO: 382020 - protein, 10 aa, Influenza virus
KKKKKKRGLF

SEQ ID NO: 382021 - protein, 10 aa, Influenza virus
KKRGLFGAIA

SEQ ID NO: 382022 - protein, 10 aa, Influenza virus
GLIDGWYGYK

SEQ ID NO: 382023 - protein, 10 aa, Influenza virus
LIDGWYGYKH

SEQ ID NO: 382024 - protein, 10 aa, Influenza virus
IDGWYGYKHQ

SEQ ID NO: 382025 - protein, 10 aa, Influenza virus
DGWYGFKHQN

SEQ ID NO: 382026 - protein, 10 aa, Influenza virus
GWYGFRHQNS

SEQ ID NO: 382027 - protein, 10 aa, Influenza virus
WYGYKHQNAQ

SEQ ID NO: 382028 - protein, 10 aa, Influenza virus
YGYKHQNAQG

SEQ ID NO: 382029 - protein, 10 aa, Influenza virus
GYKHQNAQGE

SEQ ID NO: 382030 - protein, 10 aa, Influenza virus
FRHQNSQGEG

SEQ ID NO: 382031 - protein, 10 aa, Influenza virus
RHQNAQGEGI

SEQ ID NO: 382032 - protein, 10 aa, Influenza virus
TQSAIDQITR

SEQ ID NO: 382033 - protein, 10 aa, Influenza virus
QSAIDQITGT

SEQ ID NO: 382034 - protein, 10 aa, Influenza virus
AAIDQITGKL

SEQ ID NO: 382035 - protein, 10 aa, Influenza virus
AVNQITGKLN

SEQ ID NO: 382036 - protein, 10 aa, Influenza virus
VNQITGKLNR

SEQ ID NO: 382037 - protein, 10 aa, Influenza virus
TGTLNRLIDK

SEQ ID NO: 382038 - protein, 10 aa, Influenza virus
RKLNRLIEKT

SEQ ID NO: 382039 - protein, 10 aa, Influenza virus
IDKTNQQFEM

SEQ ID NO: 382040 - protein, 10 aa, Influenza virus
DKTNQQFEMI

SEQ ID NO: 382041 - protein, 10 aa, Influenza virus
QFEMIDNEFN

SEQ ID NO: 382042 - protein, 10 aa, Influenza virus
FEMIDNEFNE

SEQ ID NO: 382043 - protein, 10 aa, Influenza virus
EVERQIGNVI

SEQ ID NO: 382044 - protein, 10 aa, Influenza virus
VERQIGNVIN

SEQ ID NO: 382045 - protein, 10 aa, Influenza virus
EKQLGNVINW

SEQ ID NO: 382046 - protein, 10 aa, Influenza virus
KQLGNVINWT

SEQ ID NO: 382047 - protein, 10 aa, Influenza virus
VINWTRDSLT

SEQ ID NO: 382048 - protein, 10 aa, Influenza virus
INWTRDSLTE

SEQ ID NO: 382049 - protein, 10 aa, Influenza virus
IEIWSYNAEF

SEQ ID NO: 382050 - protein, 10 aa, Influenza virus
EIWSYNAEFL

SEQ ID NO: 382051 - protein, 10 aa, Influenza virus
WSYNADLLVA

SEQ ID NO: 382052 - protein, 10 aa, Influenza virus
SYNADLLVAM

SEQ ID NO: 382053 - protein, 10 aa, Influenza virus
YNADLLVAME

SEQ ID NO: 382054 - protein, 10 aa, Influenza virus
NADLLVAMEN

SEQ ID NO: 382055 - protein, 10 aa, Influenza virus
AELLIAMENQ

SEQ ID NO: 382056 - protein, 10 aa, Influenza virus
ELLIAMENQH

SEQ ID NO: 382057 - protein, 10 aa, Influenza virus
VENQHTIDST

SEQ ID NO: 382058 - protein, 10 aa, Influenza virus
ENQHTIDSTD

SEQ ID NO: 382059 - protein, 10 aa, Influenza virus
NQHTIDLAES

SEQ ID NO: 382060 - protein, 10 aa, Influenza virus
QHIIDLADSE

SEQ ID NO: 382061 - protein, 10 aa, Influenza virus
HTIDLTNSEM

SEQ ID NO: 382062 - protein, 10 aa, Influenza virus
TIDLTNSEMN

SEQ ID NO: 382063 - protein, 10 aa, Influenza virus
IDSTDSEMNK

SEQ ID NO: 382064 - protein, 10 aa, Influenza virus
DSTDSEMNKL

SEQ ID NO: 382065 - protein, 10 aa, Influenza virus
LAESEMNKLY

SEQ ID NO: 382066 - protein, 10 aa, Influenza virus
MNKLYERVRK

SEQ ID NO: 382067 - protein, 10 aa, Influenza virus
NKLYERVRKQ

SEQ ID NO: 382068 - protein, 10 aa, Influenza virus
KLYERVRKQL

SEQ ID NO: 382069 - protein, 10 aa, Influenza virus
LYERVRKQLR

SEQ ID NO: 382070 - protein, 10 aa, Influenza virus
YERVRKQLRE

SEQ ID NO: 382071 - protein, 10 aa, Influenza virus
ERVRKQLREN

SEQ ID NO: 382072 - protein, 10 aa, Influenza virus
RVRKQLRENA

SEQ ID NO: 382073 - protein, 10 aa, Influenza virus
RENAEEDGTA

SEQ ID NO: 382074 - protein, 10 aa, Influenza virus
EEDGTGCFEL

SEQ ID NO: 382075 - protein, 10 aa, Influenza virus
EDGTGCFELF

SEQ ID NO: 382076 - protein, 10 aa, Influenza virus
DGTACFEIFH

SEQ ID NO: 382077 - protein, 10 aa, Influenza virus
GTGCFELFHK

SEQ ID NO: 382078 - protein, 10 aa, Influenza virus
FEIFHKCDDR

SEQ ID NO: 382079 - protein, 10 aa, Influenza virus
ELFHKCDDDC

SEQ ID NO: 382080 - protein, 10 aa, Influenza virus
IFHKCDDRCM

SEQ ID NO: 382081 - protein, 10 aa, Influenza virus
CMASIRNNSY

SEQ ID NO: 382082 - protein, 10 aa, Influenza virus
MANIRNNTYD

SEQ ID NO: 382083 - protein, 10 aa, Influenza virus
TSIRNNTYDH

SEQ ID NO: 382084 - protein, 10 aa, Influenza virus
NIRNNTYDHS

SEQ ID NO: 382085 - protein, 10 aa, Influenza virus
IRNNTYDHST

SEQ ID NO: 382086 - protein, 10 aa, Influenza virus
RNNTYDHSTY

SEQ ID NO: 382087 - protein, 10 aa, Influenza virus
NNTYDHSTYR

SEQ ID NO: 382088 - protein, 10 aa, Influenza virus
IDPVELSSGY

SEQ ID NO: 382089 - protein, 10 aa, Influenza virus
DPVKLSGGYK

SEQ ID NO: 382090 - protein, 10 aa, Influenza virus
PVELSSGYKD

SEQ ID NO: 382091 - protein, 10 aa, Influenza virus
VKLSSGYKEV

SEQ ID NO: 382092 - protein, 10 aa, Influenza virus
ELSSGYKDVI

SEQ ID NO: 382093 - protein, 10 aa, Influenza virus
LSSGYKEVIL

SEQ ID NO: 382094 - protein, 10 aa, Influenza virus
SGGYKDVILW

SEQ ID NO: 382095 - protein, 10 aa, Influenza virus
GGYKDVILWF

SEQ ID NO: 382096 - protein, 10 aa, Influenza virus
GYKDVIIWFS

SEQ ID NO: 382097 - protein, 10 aa, Influenza virus
YKDVILWFSL

SEQ ID NO: 382098 - protein, 10 aa, Influenza virus
KEVILWFSFG

SEQ ID NO: 382099 - protein, 10 aa, Influenza virus
DVILWFSLGA

SEQ ID NO: 382100 - protein, 10 aa, Influenza virus
WFSLGASCFL

SEQ ID NO: 382101 - protein, 10 aa, Influenza virus
FSFGASCFTL

SEQ ID NO: 382102 - protein, 10 aa, Influenza virus
GASCFLLIAI

SEQ ID NO: 382103 - protein, 10 aa, Influenza virus
LVFICIKNGN

SEQ ID NO: 382104 - protein, 10 aa, Influenza virus
AFICIKNGNM

SEQ ID NO: 382105 - protein, 10 aa, Influenza virus
FICVKNGNMQ

SEQ ID NO: 382106 - protein, 10 aa, Influenza virus
ICVKNGNMQC

SEQ ID NO: 382107 - protein, 10 aa, Influenza virus
CVKNGNHAVH

SEQ ID NO: 382108 - protein, 10 aa, Influenza virus
VKNGNHAVHY

SEQ ID NO: 382109 - protein, 10 aa, Influenza virus
KNGNMRGTNW

SEQ ID NO: 382110 - protein, 10 aa, Influenza virus
NGNMRGTNWI

SEQ ID NO: 382111 - protein, 10 aa, Influenza virus
MNPNQKLFTL

SEQ ID NO: 382112 - protein, 10 aa, Influenza virus
NPNQKLFTLS

SEQ ID NO: 382113 - protein, 10 aa, Influenza virus
PNQKLFTLSG

SEQ ID NO: 382114 - protein, 10 aa, Influenza virus
NQKLFTLSGV

SEQ ID NO: 382115 - protein, 10 aa, Influenza virus
LFTLSGVAIA

SEQ ID NO: 382116 - protein, 10 aa, Influenza virus
FTLSGVAIAL

SEQ ID NO: 382117 - protein, 10 aa, Influenza virus
TLSGVAIALS

SEQ ID NO: 382118 - protein, 10 aa, Influenza virus
SSGIAIALGI

SEQ ID NO: 382119 - protein, 10 aa, Influenza virus
SGIAIALGII

SEQ ID NO: 382120 - protein, 10 aa, Influenza virus
GIAIALGIIN

SEQ ID NO: 382121 - protein, 10 aa, Influenza virus
IAIALGIINL

SEQ ID NO: 382122 - protein, 10 aa, Influenza virus
AIALGIINLL

SEQ ID NO: 382123 - protein, 10 aa, Influenza virus
IALGIINLLI

SEQ ID NO: 382124 - protein, 10 aa, Influenza virus
ALGIINLLIG

SEQ ID NO: 382125 - protein, 10 aa, Influenza virus
LSVLNLLIGV

SEQ ID NO: 382126 - protein, 10 aa, Influenza virus
SVLNLLIGVS

SEQ ID NO: 382127 - protein, 10 aa, Influenza virus
VLNLLIGVSN

SEQ ID NO: 382128 - protein, 10 aa, Influenza virus
LNLLIGISNI

SEQ ID NO: 382129 - protein, 10 aa, Influenza virus
NLLIGISNVV

SEQ ID NO: 382130 - protein, 10 aa, Influenza virus
LLIGISNVVL

SEQ ID NO: 382131 - protein, 10 aa, Influenza virus
LIGISNVVLN

SEQ ID NO: 382132 - protein, 10 aa, Influenza virus
SNIGLNVSLH

SEQ ID NO: 382133 - protein, 10 aa, Influenza virus
NVGLNMSLHL

SEQ ID NO: 382134 - protein, 10 aa, Influenza virus
ENKYVNNTTI

SEQ ID NO: 382135 - protein, 10 aa, Influenza virus
NTYINNTTII

SEQ ID NO: 382136 - protein, 10 aa, Influenza virus
NYLLLNKSLC

SEQ ID NO: 382137 - protein, 10 aa, Influenza virus
LMLNKSLCKI

SEQ ID NO: 382138 - protein, 10 aa, Influenza virus
MLNKSLCKIE

SEQ ID NO: 382139 - protein, 10 aa, Influenza virus
LNKSLCKIEG

SEQ ID NO: 382140 - protein, 10 aa, Influenza virus
NKSLCKIEGW

SEQ ID NO: 382141 - protein, 10 aa, Influenza virus
KSLCKIEGWV

SEQ ID NO: 382142 - protein, 10 aa, Influenza virus
SLCKIEGWVV

SEQ ID NO: 382143 - protein, 10 aa, Influenza virus
LCSVEGWVVI

SEQ ID NO: 382144 - protein, 10 aa, Influenza virus
VEGWVVIEKD

SEQ ID NO: 382145 - protein, 10 aa, Influenza virus
EGWVVIEKDN

SEQ ID NO: 382146 - protein, 10 aa, Influenza virus
GWVVIAQDNA

SEQ ID NO: 382147 - protein, 10 aa, Influenza virus
WVVIEKDNAV

SEQ ID NO: 382148 - protein, 10 aa, Influenza virus
VVIAQDNAIR

SEQ ID NO: 382149 - protein, 10 aa, Influenza virus
VIAQDNAIRF

SEQ ID NO: 382150 - protein, 10 aa, Influenza virus
IAQDNAIRFG

SEQ ID NO: 382151 - protein, 10 aa, Influenza virus
EKDNAVRFGE

SEQ ID NO: 382152 - protein, 10 aa, Influenza virus
IRFGESEQIV

SEQ ID NO: 382153 - protein, 10 aa, Influenza virus
REPYVSCDPI

SEQ ID NO: 382154 - protein, 10 aa, Influenza virus
HSNGTIHDRA

SEQ ID NO: 382155 - protein, 10 aa, Influenza virus
SNGTIHDRTT

SEQ ID NO: 382156 - protein, 10 aa, Influenza virus
NGTIHDRTTF

SEQ ID NO: 382157 - protein, 10 aa, Influenza virus
GTIHDRTTFR

SEQ ID NO: 382158 - protein, 10 aa, Influenza virus
TIHDRAAFRG

SEQ ID NO: 382159 - protein, 10 aa, Influenza virus
IHDRAAFRGL

SEQ ID NO: 382160 - protein, 10 aa, Influenza virus
HDRTAFRGLM

SEQ ID NO: 382161 - protein, 10 aa, Influenza virus
DRTTFRGLIS

SEQ ID NO: 382162 - protein, 10 aa, Influenza virus
RTTFRGLLST

SEQ ID NO: 382163 - protein, 10 aa, Influenza virus
FRGLMSTPLG

SEQ ID NO: 382164 - protein, 10 aa, Influenza virus
SNSEFICVGW

SEQ ID NO: 382165 - protein, 10 aa, Influenza virus
NSEFICVGWS

SEQ ID NO: 382166 - protein, 10 aa, Influenza virus
SEFICVGWSS

SEQ ID NO: 382167 - protein, 10 aa, Influenza virus
EFICVGWSST

SEQ ID NO: 382168 - protein, 10 aa, Influenza virus
FICVGWSSTT

SEQ ID NO: 382169 - protein, 10 aa, Influenza virus
ICVGWSSTTC

SEQ ID NO: 382170 - protein, 10 aa, Influenza virus
WSSTTCHDGV

SEQ ID NO: 382171 - protein, 10 aa, Influenza virus
CHDGIARMTI

SEQ ID NO: 382172 - protein, 10 aa, Influenza virus
HDGIARMTIC

SEQ ID NO: 382173 - protein, 10 aa, Influenza virus
QGNNENATAT

SEQ ID NO: 382174 - protein, 10 aa, Influenza virus
GNNNNATATV

SEQ ID NO: 382175 - protein, 10 aa, Influenza virus
NNENATATVY

SEQ ID NO: 382176 - protein, 10 aa, Influenza virus
NNATATVYYD

SEQ ID NO: 382177 - protein, 10 aa, Influenza virus
NATATVYYNG

SEQ ID NO: 382178 - protein, 10 aa, Influenza virus
ATATVYYNGR

SEQ ID NO: 382179 - protein, 10 aa, Influenza virus
TATVYYNGRL

SEQ ID NO: 382180 - protein, 10 aa, Influenza virus
ATVYYNGRLT

SEQ ID NO: 382181 - protein, 10 aa, Influenza virus
TVYYNGRLTT

SEQ ID NO: 382182 - protein, 10 aa, Influenza virus
VYYNGRLTTT

SEQ ID NO: 382183 - protein, 10 aa, Influenza virus
YYNGRLTTTI

SEQ ID NO: 382184 - protein, 10 aa, Influenza virus
RRLTTTVKTW

SEQ ID NO: 382185 - protein, 10 aa, Influenza virus
LTTTIRTWAK

SEQ ID NO: 382186 - protein, 10 aa, Influenza virus
TTTIRTWAKN

SEQ ID NO: 382187 - protein, 10 aa, Influenza virus
TTIRTWAKNI

SEQ ID NO: 382188 - protein, 10 aa, Influenza virus
TVKTWAGNIL

SEQ ID NO: 382189 - protein, 10 aa, Influenza virus
VKTWAGNILR

SEQ ID NO: 382190 - protein, 10 aa, Influenza virus
RTWAKNILRT

SEQ ID NO: 382191 - protein, 10 aa, Influenza virus
WARNILRTQD

SEQ ID NO: 382192 - protein, 10 aa, Influenza virus
ARNILRTQDS

SEQ ID NO: 382193 - protein, 10 aa, Influenza virus
RNILRTQDSE

SEQ ID NO: 382194 - protein, 10 aa, Influenza virus
QDSECVSHNG

SEQ ID NO: 382195 - protein, 10 aa, Influenza virus
ESECVRHNGT

SEQ ID NO: 382196 - protein, 10 aa, Influenza virus
SECVRHNGTC

SEQ ID NO: 382197 - protein, 10 aa, Influenza virus
ECVSHNGTWA

SEQ ID NO: 382198 - protein, 10 aa, Influenza virus
CVSHNGTWAV

SEQ ID NO: 382199 - protein, 10 aa, Influenza virus
HNGTCVVVMT

SEQ ID NO: 382200 - protein, 10 aa, Influenza virus
NGTCVVVMTD

SEQ ID NO: 382201 - protein, 10 aa, Influenza virus
GTCVVVMTDG

SEQ ID NO: 382202 - protein, 10 aa, Influenza virus
VVVMTDGSAS

SEQ ID NO: 382203 - protein, 10 aa, Influenza virus
VVMTDGPASS

SEQ ID NO: 382204 - protein, 10 aa, Influenza virus
MTDGSASSRA

SEQ ID NO: 382205 - protein, 10 aa, Influenza virus
KGSARHIEEW

SEQ ID NO: 382206 - protein, 10 aa, Influenza virus
IEEWSCYGHS

SEQ ID NO: 382207 - protein, 10 aa, Influenza virus
VSCVCRDNWQ

SEQ ID NO: 382208 - protein, 10 aa, Influenza virus
NRPIIEIDMS

SEQ ID NO: 382209 - protein, 10 aa, Influenza virus
LEHTSKYVCT

SEQ ID NO: 382210 - protein, 10 aa, Influenza virus
EHTSKYVCTG

SEQ ID NO: 382211 - protein, 10 aa, Influenza virus
YVCTGVLTDT

SEQ ID NO: 382212 - protein, 10 aa, Influenza virus
VCTGVLTDTS

SEQ ID NO: 382213 - protein, 10 aa, Influenza virus
GVLTDTSRPG

SEQ ID NO: 382214 - protein, 10 aa, Influenza virus
VLTDTSRPGD

SEQ ID NO: 382215 - protein, 10 aa, Influenza virus
LTDTSRPGDR

SEQ ID NO: 382216 - protein, 10 aa, Influenza virus
CSNPITGSPC

SEQ ID NO: 382217 - protein, 10 aa, Influenza virus
NPITGSPGSP

SEQ ID NO: 382218 - protein, 10 aa, Influenza virus
PITGSPCAPG

SEQ ID NO: 382219 - protein, 10 aa, Influenza virus
SPGVKGFGFL

SEQ ID NO: 382220 - protein, 10 aa, Influenza virus
PGTKGFGFLN

SEQ ID NO: 382221 - protein, 10 aa, Influenza virus
GTKGFGFLNE

SEQ ID NO: 382222 - protein, 10 aa, Influenza virus
NNTWLGRTIS

SEQ ID NO: 382223 - protein, 10 aa, Influenza virus
GRTISPRSRN

SEQ ID NO: 382224 - protein, 10 aa, Influenza virus
RTISPRSRNG

SEQ ID NO: 382225 - protein, 10 aa, Influenza virus
TISPRSRNGF

SEQ ID NO: 382226 - protein, 10 aa, Influenza virus
ISPRSRNGFE

SEQ ID NO: 382227 - protein, 10 aa, Influenza virus
SPRSRNGFEM

SEQ ID NO: 382228 - protein, 10 aa, Influenza virus
PRSRNGFEML

SEQ ID NO: 382229 - protein, 10 aa, Influenza virus
RSRNGFEMLK

SEQ ID NO: 382230 - protein, 10 aa, Influenza virus
SRSGFEMLRI

SEQ ID NO: 382231 - protein, 10 aa, Influenza virus
RSGFEMLKIH

SEQ ID NO: 382232 - protein, 10 aa, Influenza virus
SGFEMLRIPN

SEQ ID NO: 382233 - protein, 10 aa, Influenza virus
FEMLRIPNAG

SEQ ID NO: 382234 - protein, 10 aa, Influenza virus
EMLRIPNAGI

SEQ ID NO: 382235 - protein, 10 aa, Influenza virus
MLRIPNAGID

SEQ ID NO: 382236 - protein, 10 aa, Influenza virus
LKIHNAGTDP

SEQ ID NO: 382237 - protein, 10 aa, Influenza virus
RQEIVDNSNW

SEQ ID NO: 382238 - protein, 10 aa, Influenza virus
QEIVDNKNWS

SEQ ID NO: 382239 - protein, 10 aa, Influenza virus
EIVDNKNWSG

SEQ ID NO: 382240 - protein, 10 aa, Influenza virus
IVDNKNWSGY

SEQ ID NO: 382241 - protein, 10 aa, Influenza virus
VDNSNWSGYS

SEQ ID NO: 382242 - protein, 10 aa, Influenza virus
DNSNWSGYSG

SEQ ID NO: 382243 - protein, 10 aa, Influenza virus
NKNWSGYSGS

SEQ ID NO: 382244 - protein, 10 aa, Influenza virus
SNWSGYSGSF

SEQ ID NO: 382245 - protein, 10 aa, Influenza virus
YVWWASNSLI

SEQ ID NO: 382246 - protein, 10 aa, Influenza virus
VWWASNSLIA

SEQ ID NO: 382247 - protein, 10 aa, Influenza virus
WWASNSLIAL

SEQ ID NO: 382248 - protein, 10 aa, Influenza virus
PIGSGFFPDG

SEQ ID NO: 382249 - protein, 10 aa, Influenza virus
ILVSTNAYDR

SEQ ID NO: 382250 - protein, 10 aa, Influenza virus
LMSTNAYDRI

SEQ ID NO: 382251 - protein, 10 aa, Influenza virus
MSTNAYDRIC

SEQ ID NO: 382252 - protein, 10 aa, Influenza virus
NSTDTVNTLM

SEQ ID NO: 382253 - protein, 10 aa, Influenza virus
STNTVNTLIE

SEQ ID NO: 382254 - protein, 10 aa, Influenza virus
TDTVNTLMEQ

SEQ ID NO: 382255 - protein, 10 aa, Influenza virus
TLIEQKVPVT

SEQ ID NO: 382256 - protein, 10 aa, Influenza virus
LIEQNIPVTQ

SEQ ID NO: 382257 - protein, 10 aa, Influenza virus
EQKVPVTQTM

SEQ ID NO: 382258 - protein, 10 aa, Influenza virus
QKVPVTQTME

SEQ ID NO: 382259 - protein, 10 aa, Influenza virus
KVPVTQTMEL

SEQ ID NO: 382260 - protein, 10 aa, Influenza virus
TQTMELVETK

SEQ ID NO: 382261 - protein, 10 aa, Influenza virus
QAMELVEAEK

SEQ ID NO: 382262 - protein, 10 aa, Influenza virus
TMELVETKKH

SEQ ID NO: 382263 - protein, 10 aa, Influenza virus
EKHLAYCNTD

SEQ ID NO: 382264 - protein, 10 aa, Influenza virus
KHLAYCNTDL

SEQ ID NO: 382265 - protein, 10 aa, Influenza virus
NPAYCNTDLG

SEQ ID NO: 382266 - protein, 10 aa, Influenza virus
SAYCNTDLGA

SEQ ID NO: 382267 - protein, 10 aa, Influenza virus
APLELRDCKV

SEQ ID NO: 382268 - protein, 10 aa, Influenza virus
GNPKCDIHLR

SEQ ID NO: 382269 - protein, 10 aa, Influenza virus
NPKCDIHLRD

SEQ ID NO: 382270 - protein, 10 aa, Influenza virus
PKCDIHLRDQ

SEQ ID NO: 382271 - protein, 10 aa, Influenza virus
HLRDQGWSYI

SEQ ID NO: 382272 - protein, 10 aa, Influenza virus
LRDQGWSYIV

SEQ ID NO: 382273 - protein, 10 aa, Influenza virus
RDQGWSYIVE

SEQ ID NO: 382274 - protein, 10 aa, Influenza virus
DQAWSYIVER

SEQ ID NO: 382275 - protein, 10 aa, Influenza virus
QAWSYIVERP

SEQ ID NO: 382276 - protein, 10 aa, Influenza virus
AWSYIVERPS

SEQ ID NO: 382277 - protein, 10 aa, Influenza virus
FSIAASYKRI

SEQ ID NO: 382278 - protein, 10 aa, Influenza virus
SIAASYKRIR

SEQ ID NO: 382279 - protein, 10 aa, Influenza virus
IAASYKRIRL

SEQ ID NO: 382280 - protein, 10 aa, Influenza virus
KRVRLFDYSR

SEQ ID NO: 382281 - protein, 10 aa, Influenza virus
RIRLFDYSGW

SEQ ID NO: 382282 - protein, 10 aa, Influenza virus
IRLFDYSGWN

SEQ ID NO: 382283 - protein, 10 aa, Influenza virus
LFDYSGWNVT

SEQ ID NO: 382284 - protein, 10 aa, Influenza virus
SSSGTSKACN

SEQ ID NO: 382285 - protein, 10 aa, Influenza virus
SKACNASTGA

SEQ ID NO: 382286 - protein, 10 aa, Influenza virus
KACNASTGAQ

SEQ ID NO: 382287 - protein, 10 aa, Influenza virus
ACNALTGGQS

SEQ ID NO: 382288 - protein, 10 aa, Influenza virus
CNALTGGQSF

SEQ ID NO: 382289 - protein, 10 aa, Influenza virus
NALTGGQSFY

SEQ ID NO: 382290 - protein, 10 aa, Influenza virus
ASTGAQSFYR

SEQ ID NO: 382291 - protein, 10 aa, Influenza virus
STGAQSFYRS

SEQ ID NO: 382292 - protein, 10 aa, Influenza virus
NWLTKKKPDI

SEQ ID NO: 382293 - protein, 10 aa, Influenza virus
WLTKKKPDIY

SEQ ID NO: 382294 - protein, 10 aa, Influenza virus
LTKKKPDIYD

SEQ ID NO: 382295 - protein, 10 aa, Influenza virus
TKKEPDTYDF

SEQ ID NO: 382296 - protein, 10 aa, Influenza virus
KKKPDIYDFN

SEQ ID NO: 382297 - protein, 10 aa, Influenza virus
KKPDIYDFNE

SEQ ID NO: 382298 - protein, 10 aa, Influenza virus
KPDIYDFNEG

SEQ ID NO: 382299 - protein, 10 aa, Influenza virus
PEAYNFNEGS

SEQ ID NO: 382300 - protein, 10 aa, Influenza virus
EAYNFNEGSY

SEQ ID NO: 382301 - protein, 10 aa, Influenza virus
NNENGDIIFL

SEQ ID NO: 382302 - protein, 10 aa, Influenza virus
NKDGDIIFLW

SEQ ID NO: 382303 - protein, 10 aa, Influenza virus
ENGDIIFLWG

SEQ ID NO: 382304 - protein, 10 aa, Influenza virus
NGDIIFLWGI

SEQ ID NO: 382305 - protein, 10 aa, Influenza virus
LWGIHHPPDE

SEQ ID NO: 382306 - protein, 10 aa, Influenza virus
WGIHHPPDET

SEQ ID NO: 382307 - protein, 10 aa, Influenza virus
GIHHPPDETE

SEQ ID NO: 382308 - protein, 10 aa, Influenza virus
IHHPPDETEQ

SEQ ID NO: 382309 - protein, 10 aa, Influenza virus
HHPPDETEQT

SEQ ID NO: 382310 - protein, 10 aa, Influenza virus
ETEQTKLYKN

SEQ ID NO: 382311 - protein, 10 aa, Influenza virus
TLYKNANTLT

SEQ ID NO: 382312 - protein, 10 aa, Influenza virus
KNANTLTSVT

SEQ ID NO: 382313 - protein, 10 aa, Influenza virus
NANTLTSVTT

SEQ ID NO: 382314 - protein, 10 aa, Influenza virus
ANTLTSVTTN

SEQ ID NO: 382315 - protein, 10 aa, Influenza virus
SVTTNTINRN

SEQ ID NO: 382316 - protein, 10 aa, Influenza virus
VTTNTINRNF

SEQ ID NO: 382317 - protein, 10 aa, Influenza virus
NTNTINRSFQ

SEQ ID NO: 382318 - protein, 10 aa, Influenza virus
TNTINRNFQP

SEQ ID NO: 382319 - protein, 10 aa, Influenza virus
NTINRNFQPN

SEQ ID NO: 382320 - protein, 10 aa, Influenza virus
TINRNFQPNI

SEQ ID NO: 382321 - protein, 10 aa, Influenza virus
INRNFQPNIG

SEQ ID NO: 382322 - protein, 10 aa, Influenza virus
NRNFQPNIGP

SEQ ID NO: 382323 - protein, 10 aa, Influenza virus
RNFQPNIGPR

SEQ ID NO: 382324 - protein, 10 aa, Influenza virus
NFQPNIGPRP

SEQ ID NO: 382325 - protein, 10 aa, Influenza virus
RPLVREQQGR

SEQ ID NO: 382326 - protein, 10 aa, Influenza virus
PLVRGQQGWM

SEQ ID NO: 382327 - protein, 10 aa, Influenza virus
LVRGQQGTMD

SEQ ID NO: 382328 - protein, 10 aa, Influenza virus
VRGQQGWMDY

SEQ ID NO: 382329 - protein, 10 aa, Influenza virus
RGQQGWMDYY

SEQ ID NO: 382330 - protein, 10 aa, Influenza virus
GQQGTMDYYW

SEQ ID NO: 382331 - protein, 10 aa, Influenza virus
GYLLKGESHC

SEQ ID NO: 382332 - protein, 10 aa, Influenza virus
YLLKGESHGK

SEQ ID NO: 382333 - protein, 10 aa, Influenza virus
GESHCRIIQN

SEQ ID NO: 382334 - protein, 10 aa, Influenza virus
ESHGKIIQNE

SEQ ID NO: 382335 - protein, 10 aa, Influenza virus
SHGRTIQNED

SEQ ID NO: 382336 - protein, 10 aa, Influenza virus
HGRTIQNEDI

SEQ ID NO: 382337 - protein, 10 aa, Influenza virus
GRTIQNEDIP

SEQ ID NO: 382338 - protein, 10 aa, Influenza virus
CKTKCQTYAG

SEQ ID NO: 382339 - protein, 10 aa, Influenza virus
KTKCQTYAGA

SEQ ID NO: 382340 - protein, 10 aa, Influenza virus
TYAGAINSSR

SEQ ID NO: 382341 - protein, 10 aa, Influenza virus
YAGAINSSRP

SEQ ID NO: 382342 - protein, 10 aa, Influenza virus
GAINSSKPLQ

SEQ ID NO: 382343 - protein, 10 aa, Influenza virus
AVNSSKPFQN

SEQ ID NO: 382344 - protein, 10 aa, Influenza virus
INSSKPLQNA

SEQ ID NO: 382345 - protein, 10 aa, Influenza virus
NSSKPLQNAS

SEQ ID NO: 382346 - protein, 10 aa, Influenza virus
SSKPLQNASR

SEQ ID NO: 382347 - protein, 10 aa, Influenza virus
SKPFQNASRY

SEQ ID NO: 382348 - protein, 10 aa, Influenza virus
PLQNASRHYM

SEQ ID NO: 382349 - protein, 10 aa, Influenza virus
LQNASRHYMG

SEQ ID NO: 382350 - protein, 10 aa, Influenza virus
QNTSRHYMGE

SEQ ID NO: 382351 - protein, 10 aa, Influenza virus
NTSRHYMGEC

SEQ ID NO: 382352 - protein, 10 aa, Influenza virus
TSRHYMGECP

SEQ ID NO: 382353 - protein, 10 aa, Influenza virus
SRHYMGECPN

SEQ ID NO: 382354 - protein, 10 aa, Influenza virus
RHHMGECPKY

SEQ ID NO: 382355 - protein, 10 aa, Influenza virus
MGECPNYVKK

SEQ ID NO: 382356 - protein, 10 aa, Influenza virus
YAKKASLRLA

SEQ ID NO: 382357 - protein, 10 aa, Influenza virus
KKESLRLALG

SEQ ID NO: 382358 - protein, 10 aa, Influenza virus
KESLRLAIGL

SEQ ID NO: 382359 - protein, 10 aa, Influenza virus
ESLRLAIGLR

SEQ ID NO: 382360 - protein, 10 aa, Influenza virus
AIGLRNTPSI

SEQ ID NO: 382361 - protein, 10 aa, Influenza virus
LGLRNTPSIE

SEQ ID NO: 382362 - protein, 10 aa, Influenza virus
LRNTPSIEPR

SEQ ID NO: 382363 - protein, 10 aa, Influenza virus
RNTPSIEPRG

SEQ ID NO: 382364 - protein, 10 aa, Influenza virus
NTPSIEPRGL

SEQ ID NO: 382365 - protein, 10 aa, Influenza virus
TPSIEPRGLF

SEQ ID NO: 382366 - protein, 10 aa, Influenza virus
PSIEPRGLFG

SEQ ID NO: 382367 - protein, 10 aa, Influenza virus
SIEPRGLFGA

SEQ ID NO: 382368 - protein, 10 aa, Influenza virus
IEPRGLFGAI

SEQ ID NO: 382369 - protein, 10 aa, Influenza virus
DQKSTQEAIE

SEQ ID NO: 382370 - protein, 10 aa, Influenza virus
QKSTQEAIEK

SEQ ID NO: 382371 - protein, 10 aa, Influenza virus
KSTQEAIGKI

SEQ ID NO: 382372 - protein, 10 aa, Influenza virus
STQEAIGKIT

SEQ ID NO: 382373 - protein, 10 aa, Influenza virus
TQEAINKITN

SEQ ID NO: 382374 - protein, 10 aa, Influenza virus
QEAIGKITNK

SEQ ID NO: 382375 - protein, 10 aa, Influenza virus
EAINKITNKV

SEQ ID NO: 382376 - protein, 10 aa, Influenza virus
AINKITNKVN

SEQ ID NO: 382377 - protein, 10 aa, Influenza virus
IGKITNKVNN

SEQ ID NO: 382378 - protein, 10 aa, Influenza virus
GKITNKVNNI

SEQ ID NO: 382379 - protein, 10 aa, Influenza virus
KMNREFEVVD

SEQ ID NO: 382380 - protein, 10 aa, Influenza virus
MNREFEVVDH

SEQ ID NO: 382381 - protein, 10 aa, Influenza virus
NREFEVVDHE

SEQ ID NO: 382382 - protein, 10 aa, Influenza virus
REFEVVDHEF

SEQ ID NO: 382383 - protein, 10 aa, Influenza virus
EFEVVDHEFS

SEQ ID NO: 382384 - protein, 10 aa, Influenza virus
EKKINMINDK

SEQ ID NO: 382385 - protein, 10 aa, Influenza virus
KRINMISDKI

SEQ ID NO: 382386 - protein, 10 aa, Influenza virus
INVINDKIDD

SEQ ID NO: 382387 - protein, 10 aa, Influenza virus
NMISDKIDDQ

SEQ ID NO: 382388 - protein, 10 aa, Influenza virus
VINDKIDDQI

SEQ ID NO: 382389 - protein, 10 aa, Influenza virus
DKIDDQIEGL

SEQ ID NO: 382390 - protein, 10 aa, Influenza virus
KIDDQIENLW

SEQ ID NO: 382391 - protein, 10 aa, Influenza virus
IDDQIEGLWA

SEQ ID NO: 382392 - protein, 10 aa, Influenza virus
DDQIENLWAY

SEQ ID NO: 382393 - protein, 10 aa, Influenza virus
DQIEELWAYN

SEQ ID NO: 382394 - protein, 10 aa, Influenza virus
QIEELWAYNA

SEQ ID NO: 382395 - protein, 10 aa, Influenza virus
IEELWAYNAE

SEQ ID NO: 382396 - protein, 10 aa, Influenza virus
EELWAYNAEL

SEQ ID NO: 382397 - protein, 10 aa, Influenza virus
ELWAYNAELL

SEQ ID NO: 382398 - protein, 10 aa, Influenza virus
TLDEHDSNVE

SEQ ID NO: 382399 - protein, 10 aa, Influenza virus
FDEVRRRLST

SEQ ID NO: 382400 - protein, 10 aa, Influenza virus
DEVRRRLSTN

SEQ ID NO: 382401 - protein, 10 aa, Influenza virus
EVRRRLSTNA

SEQ ID NO: 382402 - protein, 10 aa, Influenza virus
NAVDTGNGCF

SEQ ID NO: 382403 - protein, 10 aa, Influenza virus
AIDTGKGCFD

SEQ ID NO: 382404 - protein, 10 aa, Influenza virus
VDTGNGCFDI

SEQ ID NO: 382405 - protein, 10 aa, Influenza virus
IKNGTYNRKE

SEQ ID NO: 382406 - protein, 10 aa, Influenza virus
KNGTYNRKEY

SEQ ID NO: 382407 - protein, 10 aa, Influenza virus
NGTYDHKDYE

SEQ ID NO: 382408 - protein, 10 aa, Influenza virus
GTYNHKDYEE

SEQ ID NO: 382409 - protein, 10 aa, Influenza virus
TYNHKDYEEE

SEQ ID NO: 382410 - protein, 10 aa, Influenza virus
YDHKDYEEEA

SEQ ID NO: 382411 - protein, 10 aa, Influenza virus
NRKEYEEEAK

SEQ ID NO: 382412 - protein, 10 aa, Influenza virus
LERSKINEVK

SEQ ID NO: 382413 - protein, 10 aa, Influenza virus
ERSKINGVRL

SEQ ID NO: 382414 - protein, 10 aa, Influenza virus
KSRINGVKLE

SEQ ID NO: 382415 - protein, 10 aa, Influenza virus
SKINEVKLEE

SEQ ID NO: 382416 - protein, 10 aa, Influenza virus
KINGVRLEEN

SEQ ID NO: 382417 - protein, 10 aa, Influenza virus
INGVRLEENT

SEQ ID NO: 382418 - protein, 10 aa, Influenza virus
NGVILEENTT

SEQ ID NO: 382419 - protein, 10 aa, Influenza virus
EVKLEENTTY

SEQ ID NO: 382420 - protein, 10 aa, Influenza virus
VILEENTTYK

SEQ ID NO: 382421 - protein, 10 aa, Influenza virus
RLEENTTYKI

SEQ ID NO: 382422 - protein, 10 aa, Influenza virus
YLSTNSTETV

SEQ ID NO: 382423 - protein, 10 aa, Influenza virus
GLIYGNPSCN

SEQ ID NO: 382424 - protein, 10 aa, Influenza virus
LRPGQTLRVR

SEQ ID NO: 382425 - protein, 10 aa, Influenza virus
RPGQTLRVRS

SEQ ID NO: 382426 - protein, 10 aa, Influenza virus
PGQTLRVKSN

SEQ ID NO: 382427 - protein, 10 aa, Influenza virus
QTLRVKSNGN

SEQ ID NO: 382428 - protein, 10 aa, Influenza virus
TLRVKSNGNL

SEQ ID NO: 382429 - protein, 10 aa, Influenza virus
SNGNLIAPLY

SEQ ID NO: 382430 - protein, 10 aa, Influenza virus
SLKLAVGLKN

SEQ ID NO: 382431 - protein, 10 aa, Influenza virus
IEGGWSGLVD

SEQ ID NO: 382432 - protein, 10 aa, Influenza virus
GWYGFQHTND

SEQ ID NO: 382433 - protein, 10 aa, Influenza virus
WYGFQHTNDQ

SEQ ID NO: 382434 - protein, 10 aa, Influenza virus
YGFQHTNDQG

SEQ ID NO: 382435 - protein, 10 aa, Influenza virus
DQIQDLWAYN

SEQ ID NO: 382436 - protein, 10 aa, Influenza virus
QIQDLWAYNA

SEQ ID NO: 382437 - protein, 10 aa, Influenza virus
IQDLWAYNAE

SEQ ID NO: 382438 - protein, 10 aa, Influenza virus
QDLWAYNAEL

SEQ ID NO: 382439 - protein, 10 aa, Influenza virus
DLWAYNAELL

SEQ ID NO: 382440 - protein, 10 aa, Influenza virus
LLVLLENQKI

SEQ ID NO: 382441 - protein, 10 aa, Influenza virus
LVLLENQKPL

SEQ ID NO: 382442 - protein, 10 aa, Influenza virus
VLLENQKPLD

SEQ ID NO: 382443 - protein, 10 aa, Influenza virus
LLENQKTLDD

SEQ ID NO: 382444 - protein, 10 aa, Influenza virus
LENQKPLDEH

SEQ ID NO: 382445 - protein, 10 aa, Influenza virus
ENGNGCFELY

SEQ ID NO: 382446 - protein, 10 aa, Influenza virus
NGNGCFELYH

SEQ ID NO: 382447 - protein, 10 aa, Influenza virus
GKGCFELYHR

SEQ ID NO: 382448 - protein, 10 aa, Influenza virus
KGCFELYHRC

SEQ ID NO: 382449 - protein, 10 aa, Influenza virus
GCFELYHKCN

SEQ ID NO: 382450 - protein, 10 aa, Influenza virus
CMEAIRNGTY

SEQ ID NO: 382451 - protein, 10 aa, Influenza virus
EGAYKILTIY

SEQ ID NO: 382452 - protein, 10 aa, Influenza virus
GAYKILTIYS

SEQ ID NO: 382453 - protein, 10 aa, Influenza virus
IYKILSIYST

SEQ ID NO: 382454 - protein, 10 aa, Influenza virus
TIYSTVASSF

SEQ ID NO: 382455 - protein, 10 aa, Influenza virus
YLSTNSTETV

SEQ ID NO: 382456 - protein, 10 aa, Influenza virus
GLIYGNPSCN

SEQ ID NO: 382457 - protein, 10 aa, Influenza virus
LKPGQTLRII

SEQ ID NO: 382458 - protein, 10 aa, Influenza virus
KPGQTLRIIS

SEQ ID NO: 382459 - protein, 10 aa, Influenza virus
PGQTLRVKSN

SEQ ID NO: 382460 - protein, 10 aa, Influenza virus
QTLRVKSNGN

SEQ ID NO: 382461 - protein, 10 aa, Influenza virus
TLRVKSNGNL

SEQ ID NO: 382462 - protein, 10 aa, Influenza virus
SNGNLIAPLY

SEQ ID NO: 382463 - protein, 10 aa, Influenza virus
SLKLAVGLKN

SEQ ID NO: 382464 - protein, 10 aa, Influenza virus
GWYGFQHTND

SEQ ID NO: 382465 - protein, 10 aa, Influenza virus
WYGFQHTNDQ

SEQ ID NO: 382466 - protein, 10 aa, Influenza virus
YGFQHTNDQG

SEQ ID NO: 382467 - protein, 10 aa, Influenza virus
DDQIQDLWAY

SEQ ID NO: 382468 - protein, 10 aa, Influenza virus
DQIQDLWAYN

SEQ ID NO: 382469 - protein, 10 aa, Influenza virus
QIQDLWAYNA

SEQ ID NO: 382470 - protein, 10 aa, Influenza virus
IQDLWAYNAE

SEQ ID NO: 382471 - protein, 10 aa, Influenza virus
QDLWAYNAEL

SEQ ID NO: 382472 - protein, 10 aa, Influenza virus
DLWAYNAELL

SEQ ID NO: 382473 - protein, 10 aa, Influenza virus
LLVLLENQKP

SEQ ID NO: 382474 - protein, 10 aa, Influenza virus
LVLLENQKPL

SEQ ID NO: 382475 - protein, 10 aa, Influenza virus
VLLENQKPLD

SEQ ID NO: 382476 - protein, 10 aa, Influenza virus
LLENQKTLDD

SEQ ID NO: 382477 - protein, 10 aa, Influenza virus
LENQKPLDEH

SEQ ID NO: 382478 - protein, 10 aa, Influenza virus
ENQKPLDEHD

SEQ ID NO: 382479 - protein, 10 aa, Influenza virus
ENGNGCFELY

SEQ ID NO: 382480 - protein, 10 aa, Influenza virus
NGNGCFELYH

SEQ ID NO: 382481 - protein, 10 aa, Influenza virus
GKGCFELYHR

SEQ ID NO: 382482 - protein, 10 aa, Influenza virus
KGCFELYHRC

SEQ ID NO: 382483 - protein, 10 aa, Influenza virus
GCFELYHKCN

SEQ ID NO: 382484 - protein, 10 aa, Influenza virus
CMEAIRNGTY

SEQ ID NO: 382485 - protein, 10 aa, Influenza virus
EGAYKILTIY

SEQ ID NO: 382486 - protein, 10 aa, Influenza virus
GAYKILTIYS

SEQ ID NO: 382487 - protein, 10 aa, Influenza virus
IYKILSIYST

SEQ ID NO: 382488 - protein, 10 aa, Influenza virus
TIYSTVASSF

SEQ ID NO: 382489 - protein, 10 aa, Influenza virus
WSKPQCLITG

SEQ ID NO: 382490 - protein, 10 aa, Influenza virus
SKPQCQIAGF

SEQ ID NO: 382491 - protein, 10 aa, Influenza virus
KPQCQIAGFA

SEQ ID NO: 382492 - protein, 10 aa, Influenza virus
CNQFALGQGT

SEQ ID NO: 382493 - protein, 10 aa, Influenza virus
NQFALGQGTT

SEQ ID NO: 382494 - protein, 10 aa, Influenza virus
SYRTLLMSEL

SEQ ID NO: 382495 - protein, 10 aa, Influenza virus
LMSELGVPFY

SEQ ID NO: 382496 - protein, 10 aa, Influenza virus
TQQVCIAWSS

SEQ ID NO: 382497 - protein, 10 aa, Influenza virus
CIAWSSSSCY

SEQ ID NO: 382498 - protein, 10 aa, Influenza virus
IAWSSASCHD

SEQ ID NO: 382499 - protein, 10 aa, Influenza virus
WSSASCHDGR

SEQ ID NO: 382500 - protein, 10 aa, Influenza virus
SSASCHDGRA

SEQ ID NO: 382501 - protein, 10 aa, Influenza virus
SASCHDGRAW

SEQ ID NO: 382502 - protein, 10 aa, Influenza virus
ASCHDGRAWL

SEQ ID NO: 382503 - protein, 10 aa, Influenza virus
SCHDGKEWLH

SEQ ID NO: 382504 - protein, 10 aa, Influenza virus
NILITQESEC

SEQ ID NO: 382505 - protein, 10 aa, Influenza virus
LRTQESDCVC

SEQ ID NO: 382506 - protein, 10 aa, Influenza virus
GNAQHVEECS

SEQ ID NO: 382507 - protein, 10 aa, Influenza virus
GAQHVEECSC

SEQ ID NO: 382508 - protein, 10 aa, Influenza virus
HVEECSCYPS

SEQ ID NO: 382509 - protein, 10 aa, Influenza virus
VHISPLSGSA

SEQ ID NO: 382510 - protein, 10 aa, Influenza virus
DNWKGCNRPV

SEQ ID NO: 382511 - protein, 10 aa, Influenza virus
SGLVGDTPRT

SEQ ID NO: 382512 - protein, 10 aa, Influenza virus
CFYVELTRGR

SEQ ID NO: 382513 - protein, 10 aa, Influenza virus
GTGSWADGAN

SEQ ID NO: 382514 - protein, 10 aa, Influenza virus
KAEIAQRLEG

SEQ ID NO: 382515 - protein, 10 aa, Influenza virus
AEIAQRLEGV

SEQ ID NO: 382516 - protein, 10 aa, Influenza virus
EIAQRLEGVF

SEQ ID NO: 382517 - protein, 10 aa, Influenza virus
IAQRLEGVFA

SEQ ID NO: 382518 - protein, 10 aa, Influenza virus
AQRLEGVFAG

SEQ ID NO: 382519 - protein, 10 aa, Influenza virus
QRLEGVFAGK

SEQ ID NO: 382520 - protein, 10 aa, Influenza virus
VFSGKNTDLE

SEQ ID NO: 382521 - protein, 10 aa, Influenza virus
FAGKNTDLEV

SEQ ID NO: 382522 - protein, 10 aa, Influenza virus
AGKNTDLEVL

SEQ ID NO: 382523 - protein, 10 aa, Influenza virus
GKNTDLEVLM

SEQ ID NO: 382524 - protein, 10 aa, Influenza virus
KNTDLEVLME

SEQ ID NO: 382525 - protein, 10 aa, Influenza virus
NTDLEVLMEW

SEQ ID NO: 382526 - protein, 10 aa, Influenza virus
SDLEALMEWL

SEQ ID NO: 382527 - protein, 10 aa, Influenza virus
DPNNMARAVK

SEQ ID NO: 382528 - protein, 10 aa, Influenza virus
PNNMARAVKL

SEQ ID NO: 382529 - protein, 10 aa, Influenza virus
NNMARAVKLY

SEQ ID NO: 382530 - protein, 10 aa, Influenza virus
NMDKAVKLYK

SEQ ID NO: 382531 - protein, 10 aa, Influenza virus
MDKAVKLYKK

SEQ ID NO: 382532 - protein, 10 aa, Influenza virus
DKAVKLYKKL

SEQ ID NO: 382533 - protein, 10 aa, Influenza virus
KAVKLYKKLK

SEQ ID NO: 382534 - protein, 10 aa, Influenza virus
EITFHRAKEV

SEQ ID NO: 382535 - protein, 10 aa, Influenza virus
GAKEVALGYS

SEQ ID NO: 382536 - protein, 10 aa, Influenza virus
VALSYSAGAL

SEQ ID NO: 382537 - protein, 10 aa, Influenza virus
ALGYSTGALA

SEQ ID NO: 382538 - protein, 10 aa, Influenza virus
LIYNRMGTIT

SEQ ID NO: 382539 - protein, 10 aa, Influenza virus
CEQIADSHHR

SEQ ID NO: 382540 - protein, 10 aa, Influenza virus
EQIADSHHRS

SEQ ID NO: 382541 - protein, 10 aa, Influenza virus
QIADSHHRSH

SEQ ID NO: 382542 - protein, 10 aa, Influenza virus
IADSHHRSHR

SEQ ID NO: 382543 - protein, 10 aa, Influenza virus
ADSHHRSHRQ

SEQ ID NO: 382544 - protein, 10 aa, Influenza virus
DSHHRSHRQM

SEQ ID NO: 382545 - protein, 10 aa, Influenza virus
ATTNPLIRHE

SEQ ID NO: 382546 - protein, 10 aa, Influenza virus
SNEQAAEAME

SEQ ID NO: 382547 - protein, 10 aa, Influenza virus
SEQAAEAMDI

SEQ ID NO: 382548 - protein, 10 aa, Influenza virus
EQAAEAMDIA

SEQ ID NO: 382549 - protein, 10 aa, Influenza virus
MVQAMRTVGT

SEQ ID NO: 382550 - protein, 10 aa, Influenza virus
DLIENLQAYQ

SEQ ID NO: 382551 - protein, 10 aa, Influenza virus
LLDNLQAYQK

SEQ ID NO: 382552 - protein, 10 aa, Influenza virus
LDNLQAYQKR

SEQ ID NO: 382553 - protein, 10 aa, Influenza virus
ENLQAYQNRM

SEQ ID NO: 382554 - protein, 10 aa, Influenza virus
AYQKRMGVQI

SEQ ID NO: 382555 - protein, 10 aa, Influenza virus
YQKRMGLQMQ

SEQ ID NO: 382556 - protein, 10 aa, Influenza virus
QKRMGLQMQR

SEQ ID NO: 382557 - protein, 10 aa, Influenza virus
RMGLQMQRFK

SEQ ID NO: 382558 - protein, 10 aa, Influenza virus
MSQLTEVETP

SEQ ID NO: 382559 - protein, 10 aa, Influenza virus
GMPESMREEY

SEQ ID NO: 382560 - protein, 10 aa, Influenza virus
MSDIEAMATQ

SEQ ID NO: 382561 - protein, 10 aa, Influenza virus
SDIEAMATQG

SEQ ID NO: 382562 - protein, 10 aa, Influenza virus
DIGAMASQGT

SEQ ID NO: 382563 - protein, 10 aa, Influenza virus
IGAMASQGTK

SEQ ID NO: 382564 - protein, 10 aa, Influenza virus
EAMATQGTKR

SEQ ID NO: 382565 - protein, 10 aa, Influenza virus
MASQGTKRPY

SEQ ID NO: 382566 - protein, 10 aa, Influenza virus
ASQGTKRPYE

SEQ ID NO: 382567 - protein, 10 aa, Influenza virus
SQGTKRPYEQ

SEQ ID NO: 382568 - protein, 10 aa, Influenza virus
KRSHEQMETG

SEQ ID NO: 382569 - protein, 10 aa, Influenza virus
RSHEQMETGG

SEQ ID NO: 382570 - protein, 10 aa, Influenza virus
YEQMETSGER

SEQ ID NO: 382571 - protein, 10 aa, Influenza virus
EQMETSGERQ

SEQ ID NO: 382572 - protein, 10 aa, Influenza virus
TEIRTSVGRM

SEQ ID NO: 382573 - protein, 10 aa, Influenza virus
EIRSSVGKMI

SEQ ID NO: 382574 - protein, 10 aa, Influenza virus
GGIGRFYVQM

SEQ ID NO: 382575 - protein, 10 aa, Influenza virus
IQMCTELQLS

SEQ ID NO: 382576 - protein, 10 aa, Influenza virus
QMCTELKLSE

SEQ ID NO: 382577 - protein, 10 aa, Influenza virus
EGRLIQNSMT

SEQ ID NO: 382578 - protein, 10 aa, Influenza virus
GRLVQNSITI

SEQ ID NO: 382579 - protein, 10 aa, Influenza virus
RLVQNSITIE

SEQ ID NO: 382580 - protein, 10 aa, Influenza virus
RNRYLEENPS

SEQ ID NO: 382581 - protein, 10 aa, Influenza virus
NRYLEENPSA

SEQ ID NO: 382582 - protein, 10 aa, Influenza virus
RYLEENPSAG

SEQ ID NO: 382583 - protein, 10 aa, Influenza virus
YLEENPSAGK

SEQ ID NO: 382584 - protein, 10 aa, Influenza virus
LEENPSAGKD

SEQ ID NO: 382585 - protein, 10 aa, Influenza virus
EENPSAGKDP

SEQ ID NO: 382586 - protein, 10 aa, Influenza virus
ENPSAGKDPK

SEQ ID NO: 382587 - protein, 10 aa, Influenza virus
NPSAGKDPKK

SEQ ID NO: 382588 - protein, 10 aa, Influenza virus
PSAGRDPKKT

SEQ ID NO: 382589 - protein, 10 aa, Influenza virus
SAGRDPKKTG

SEQ ID NO: 382590 - protein, 10 aa, Influenza virus
EVRRIWRQAN

SEQ ID NO: 382591 - protein, 10 aa, Influenza virus
RRNWRQANNG

SEQ ID NO: 382592 - protein, 10 aa, Influenza virus
RNWRQANNGE

SEQ ID NO: 382593 - protein, 10 aa, Influenza virus
WRQANNGEEA

SEQ ID NO: 382594 - protein, 10 aa, Influenza virus
SGLTHIMIWH

SEQ ID NO: 382595 - protein, 10 aa, Influenza virus
GAAIKGVGTM

SEQ ID NO: 382596 - protein, 10 aa, Influenza virus
VLELIRMIKR

SEQ ID NO: 382597 - protein, 10 aa, Influenza virus
MELVRMIKRG

SEQ ID NO: 382598 - protein, 10 aa, Influenza virus
ELIRMIKRGV

SEQ ID NO: 382599 - protein, 10 aa, Influenza virus
LIRMIKRGVN

SEQ ID NO: 382600 - protein, 10 aa, Influenza virus
IRMIKRGVND

SEQ ID NO: 382601 - protein, 10 aa, Influenza virus
TRTAYERMCN

SEQ ID NO: 382602 - protein, 10 aa, Influenza virus
RTAYERMCNI

SEQ ID NO: 382603 - protein, 10 aa, Influenza virus
TAYERMCNIL

SEQ ID NO: 382604 - protein, 10 aa, Influenza virus
RAMMDQVREG

SEQ ID NO: 382605 - protein, 10 aa, Influenza virus
NAEIEDLIFM

SEQ ID NO: 382606 - protein, 10 aa, Influenza virus
AEIEDLIFMA

SEQ ID NO: 382607 - protein, 10 aa, Influenza virus
EIEDLIFMAR

SEQ ID NO: 382608 - protein, 10 aa, Influenza virus
IEDLIFMARS

SEQ ID NO: 382609 - protein, 10 aa, Influenza virus
EDLIFMARSA

SEQ ID NO: 382610 - protein, 10 aa, Influenza virus
DLIFMARSAL

SEQ ID NO: 382611 - protein, 10 aa, Influenza virus
LIFMARSALI

SEQ ID NO: 382612 - protein, 10 aa, Influenza virus
IFMARSALIL

SEQ ID NO: 382613 - protein, 10 aa, Influenza virus
SCLPACIYGL

SEQ ID NO: 382614 - protein, 10 aa, Influenza virus
CLPACIYGLV

SEQ ID NO: 382615 - protein, 10 aa, Influenza virus
GYNFEKEGYS

SEQ ID NO: 382616 - protein, 10 aa, Influenza virus
YNFEKEGYSL

SEQ ID NO: 382617 - protein, 10 aa, Influenza virus
EREGYSLVGV

SEQ ID NO: 382618 - protein, 10 aa, Influenza virus
SLVGVDPFRL

SEQ ID NO: 382619 - protein, 10 aa, Influenza virus
LVGVDPFRLL

SEQ ID NO: 382620 - protein, 10 aa, Influenza virus
VGVDPFRLLQ

SEQ ID NO: 382621 - protein, 10 aa, Influenza virus
DPFRLLQSSQ

SEQ ID NO: 382622 - protein, 10 aa, Influenza virus
PFKLLQTSQV

SEQ ID NO: 382623 - protein, 10 aa, Influenza virus
RPNENPVHKS

SEQ ID NO: 382624 - protein, 10 aa, Influenza virus
PNENPVHKSQ

SEQ ID NO: 382625 - protein, 10 aa, Influenza virus
PVHKSQLVWM

SEQ ID NO: 382626 - protein, 10 aa, Influenza virus
VHKSQLVWMA

SEQ ID NO: 382627 - protein, 10 aa, Influenza virus
HSAAFEDLRI

SEQ ID NO: 382628 - protein, 10 aa, Influenza virus
SAAFEDLRIS

SEQ ID NO: 382629 - protein, 10 aa, Influenza virus
LATRGVQIAS

SEQ ID NO: 382630 - protein, 10 aa, Influenza virus
ATRGVQIASN

SEQ ID NO: 382631 - protein, 10 aa, Influenza virus
IRTKSGGNTN

SEQ ID NO: 382632 - protein, 10 aa, Influenza virus
RTRSGGNTNH

SEQ ID NO: 382633 - protein, 10 aa, Influenza virus
ASAGQISIQP

SEQ ID NO: 382634 - protein, 10 aa, Influenza virus
SVQPAFSVQR

SEQ ID NO: 382635 - protein, 10 aa, Influenza virus
VQPAFSVQRN

SEQ ID NO: 382636 - protein, 10 aa, Influenza virus
SVQRSLPFER

SEQ ID NO: 382637 - protein, 10 aa, Influenza virus
EVSFQGRGVF

SEQ ID NO: 382638 - protein, 10 aa, Influenza virus
MSFQGRGVFE

SEQ ID NO: 382639 - protein, 10 aa, Influenza virus
VFELSDERAA

SEQ ID NO: 382640 - protein, 10 aa, Influenza virus
ATSPIVPSFD

SEQ ID NO: 382641 - protein, 10 aa, Influenza virus
PIVPSFDMSK

SEQ ID NO: 382642 - protein, 10 aa, Influenza virus
ISNEGSYFFG

SEQ ID NO: 382643 - protein, 10 aa, Influenza virus
SYFFGDNAED

SEQ ID NO: 382644 - protein, 10 aa, Influenza virus
YFFGDSAEEY

SEQ ID NO: 382645 - protein, 10 aa, Influenza virus
SSFQVDCFIW

SEQ ID NO: 382646 - protein, 10 aa, Influenza virus
FQVDCFIWHI

SEQ ID NO: 382647 - protein, 10 aa, Influenza virus
QVDCFIWHIR

SEQ ID NO: 382648 - protein, 10 aa, Influenza virus
GDAPFLDRIR

SEQ ID NO: 382649 - protein, 10 aa, Influenza virus
DAPFIDRLRR

SEQ ID NO: 382650 - protein, 10 aa, Influenza virus
APFIDRLRRD

SEQ ID NO: 382651 - protein, 10 aa, Influenza virus
PFIDRLRRDQ

SEQ ID NO: 382652 - protein, 10 aa, Influenza virus
DRLRRDQRAL

SEQ ID NO: 382653 - protein, 10 aa, Influenza virus
RRDQKALKGR

SEQ ID NO: 382654 - protein, 10 aa, Influenza virus
SVPASRYLTD

SEQ ID NO: 382655 - protein, 10 aa, Influenza virus
MPASRYLTDM

SEQ ID NO: 382656 - protein, 10 aa, Influenza virus
ENSFEQITFI

SEQ ID NO: 382657 - protein, 10 aa, Influenza virus
NSFEQITFIQ

SEQ ID NO: 382658 - protein, 10 aa, Influenza virus
TFIQALQLLL

SEQ ID NO: 382659 - protein, 10 aa, Influenza virus
FIQALQLLLE

SEQ ID NO: 382660 - protein, 10 aa, Influenza virus
IQALQLLLEV

SEQ ID NO: 382661 - protein, 10 aa, Influenza virus
ALQLLLEVEN

SEQ ID NO: 382662 - protein, 10 aa, Influenza virus
LQLLLEVENE

SEQ ID NO: 382663 - protein, 10 aa, Influenza virus
EVEQEMRTFS

SEQ ID NO: 382664 - protein, 10 aa, Influenza virus
EIRTFSFQFI

SEQ ID NO: 382665 - protein, 10 aa, Influenza virus
MEEFVRQCFN

SEQ ID NO: 382666 - protein, 10 aa, Influenza virus
EFVRQCFNPM

SEQ ID NO: 382667 - protein, 10 aa, Influenza virus
FVRQCFSPMI

SEQ ID NO: 382668 - protein, 10 aa, Influenza virus
VRQCFNPMTV

SEQ ID NO: 382669 - protein, 10 aa, Influenza virus
RQCFNPMTVE

SEQ ID NO: 382670 - protein, 10 aa, Influenza virus
QCFNPMTVEL

SEQ ID NO: 382671 - protein, 10 aa, Influenza virus
CFNPMTVELA

SEQ ID NO: 382672 - protein, 10 aa, Influenza virus
FNPMTVELAE

SEQ ID NO: 382673 - protein, 10 aa, Influenza virus
AELAEKAMKE

SEQ ID NO: 382674 - protein, 10 aa, Influenza virus
ELAERAMKEY

SEQ ID NO: 382675 - protein, 10 aa, Influenza virus
LAERAMKEYG

SEQ ID NO: 382676 - protein, 10 aa, Influenza virus
AERAMKEYGE

SEQ ID NO: 382677 - protein, 10 aa, Influenza virus
ETNKFAAVCT

SEQ ID NO: 382678 - protein, 10 aa, Influenza virus
TNKFAAVCTH

SEQ ID NO: 382679 - protein, 10 aa, Influenza virus
NKFASICTHL

SEQ ID NO: 382680 - protein, 10 aa, Influenza virus
KFASICTHLE

SEQ ID NO: 382681 - protein, 10 aa, Influenza virus
ASICTHLEVC

SEQ ID NO: 382682 - protein, 10 aa, Influenza virus
SICTHLEVCF

SEQ ID NO: 382683 - protein, 10 aa, Influenza virus
YSDFHFIDEQ

SEQ ID NO: 382684 - protein, 10 aa, Influenza virus
DPNTLLKHRF

SEQ ID NO: 382685 - protein, 10 aa, Influenza virus
PNTLLKHRFE

SEQ ID NO: 382686 - protein, 10 aa, Influenza virus
FEIIEGRDRA

SEQ ID NO: 382687 - protein, 10 aa, Influenza virus
KPKYLPDLYD

SEQ ID NO: 382688 - protein, 10 aa, Influenza virus
PKYLPDLYDY

SEQ ID NO: 382689 - protein, 10 aa, Influenza virus
KYLPDLYDYK

SEQ ID NO: 382690 - protein, 10 aa, Influenza virus
LLPDLYDYKE

SEQ ID NO: 382691 - protein, 10 aa, Influenza virus
LPDLYDYKKN

SEQ ID NO: 382692 - protein, 10 aa, Influenza virus
PDLYDYKKNR

SEQ ID NO: 382693 - protein, 10 aa, Influenza virus
DLYDYKKNRF

SEQ ID NO: 382694 - protein, 10 aa, Influenza virus
RFTEIGVTRR

SEQ ID NO: 382695 - protein, 10 aa, Influenza virus
FTEIGVTRRE

SEQ ID NO: 382696 - protein, 10 aa, Influenza virus
IGVTRREIHI

SEQ ID NO: 382697 - protein, 10 aa, Influenza virus
GVTRREIHIY

SEQ ID NO: 382698 - protein, 10 aa, Influenza virus
VTRREIHIYY

SEQ ID NO: 382699 - protein, 10 aa, Influenza virus
TRREIHIYYL

SEQ ID NO: 382700 - protein, 10 aa, Influenza virus
RREIHIYYLE

SEQ ID NO: 382701 - protein, 10 aa, Influenza virus
REIHIYYLEK

SEQ ID NO: 382702 - protein, 10 aa, Influenza virus
YMEKANKIKS

SEQ ID NO: 382703 - protein, 10 aa, Influenza virus
ERTHIHIFSF

SEQ ID NO: 382704 - protein, 10 aa, Influenza virus
FSFIGEEMAT

SEQ ID NO: 382705 - protein, 10 aa, Influenza virus
SFTGEEMASK

SEQ ID NO: 382706 - protein, 10 aa, Influenza virus
DYILDEESRA

SEQ ID NO: 382707 - protein, 10 aa, Influenza virus
LFTIRQELAS

SEQ ID NO: 382708 - protein, 10 aa, Influenza virus
RGLWDPFRQS

SEQ ID NO: 382709 - protein, 10 aa, Influenza virus
ERGEETVEER

SEQ ID NO: 382710 - protein, 10 aa, Influenza virus
RGEETVEERF

SEQ ID NO: 382711 - protein, 10 aa, Influenza virus
GEETVEERFE

SEQ ID NO: 382712 - protein, 10 aa, Influenza virus
EETVEERFEI

SEQ ID NO: 382713 - protein, 10 aa, Influenza virus
ADQSLPPNFP

SEQ ID NO: 382714 - protein, 10 aa, Influenza virus
FRTYVDGFEP

SEQ ID NO: 382715 - protein, 10 aa, Influenza virus
RTYVDGFEPN

SEQ ID NO: 382716 - protein, 10 aa, Influenza virus
TYVDGFEPNG

SEQ ID NO: 382717 - protein, 10 aa, Influenza virus
YVDGFEPNGS

SEQ ID NO: 382718 - protein, 10 aa, Influenza virus
VDGFEPNGSI

SEQ ID NO: 382719 - protein, 10 aa, Influenza virus
DGFEPNGSIE

SEQ ID NO: 382720 - protein, 10 aa, Influenza virus
GFEPNGCIES

SEQ ID NO: 382721 - protein, 10 aa, Influenza virus
FEPNGCIESK

SEQ ID NO: 382722 - protein, 10 aa, Influenza virus
EPNGCIESKL

SEQ ID NO: 382723 - protein, 10 aa, Influenza virus
CIEGKLSQMP

SEQ ID NO: 382724 - protein, 10 aa, Influenza virus
CFQRSKFLLM

SEQ ID NO: 382725 - protein, 10 aa, Influenza virus
FQRSKFLLMD

SEQ ID NO: 382726 - protein, 10 aa, Influenza virus
LKLSIENPSH

SEQ ID NO: 382727 - protein, 10 aa, Influenza virus
KLSIENPSHE

SEQ ID NO: 382728 - protein, 10 aa, Influenza virus
LSIENPSHEG

SEQ ID NO: 382729 - protein, 10 aa, Influenza virus
SIENPSHEGE

SEQ ID NO: 382730 - protein, 10 aa, Influenza virus
IENPSHEGEG

SEQ ID NO: 382731 - protein, 10 aa, Influenza virus
ENPSHEGEGI

SEQ ID NO: 382732 - protein, 10 aa, Influenza virus
NPSHEGEGIP

SEQ ID NO: 382733 - protein, 10 aa, Influenza virus
SHEGEGIPLH

SEQ ID NO: 382734 - protein, 10 aa, Influenza virus
EGIPLYDAVK

SEQ ID NO: 382735 - protein, 10 aa, Influenza virus
GIPLYDAVKC

SEQ ID NO: 382736 - protein, 10 aa, Influenza virus
LKWTLGENMA

SEQ ID NO: 382737 - protein, 10 aa, Influenza virus
KWTLGENMAP

SEQ ID NO: 382738 - protein, 10 aa, Influenza virus
LGENIAPEKV

SEQ ID NO: 382739 - protein, 10 aa, Influenza virus
GENIAPEKVD

SEQ ID NO: 382740 - protein, 10 aa, Influenza virus
ENIAPEKVDF

SEQ ID NO: 382741 - protein, 10 aa, Influenza virus
WVQSEFNKAC

SEQ ID NO: 382742 - protein, 10 aa, Influenza virus
VQSEFNKACE

SEQ ID NO: 382743 - protein, 10 aa, Influenza virus
NKACELTDST

SEQ ID NO: 382744 - protein, 10 aa, Influenza virus
KACELTDSTW

SEQ ID NO: 382745 - protein, 10 aa, Influenza virus
WVELDEIGED

SEQ ID NO: 382746 - protein, 10 aa, Influenza virus
EFDEIGEDVA

SEQ ID NO: 382747 - protein, 10 aa, Influenza virus
IGEDIAPIEY

SEQ ID NO: 382748 - protein, 10 aa, Influenza virus
APIEHVASMR

SEQ ID NO: 382749 - protein, 10 aa, Influenza virus
PIEHVASMRR

SEQ ID NO: 382750 - protein, 10 aa, Influenza virus
IASIRRNYFT

SEQ ID NO: 382751 - protein, 10 aa, Influenza virus
RRDYFTAEVS

SEQ ID NO: 382752 - protein, 10 aa, Influenza virus
YFTTEVSHCR

SEQ ID NO: 382753 - protein, 10 aa, Influenza virus
FTTEVSHCRA

SEQ ID NO: 382754 - protein, 10 aa, Influenza virus
TTEVSHCRAT

SEQ ID NO: 382755 - protein, 10 aa, Influenza virus
TEVSHCRATE

SEQ ID NO: 382756 - protein, 10 aa, Influenza virus
VSHCRATEYM

SEQ ID NO: 382757 - protein, 10 aa, Influenza virus
MKGVYINTAM

SEQ ID NO: 382758 - protein, 10 aa, Influenza virus
KGVYINTAML

SEQ ID NO: 382759 - protein, 10 aa, Influenza virus
GVYINTAMLN

SEQ ID NO: 382760 - protein, 10 aa, Influenza virus
VYINTAMLNA

SEQ ID NO: 382761 - protein, 10 aa, Influenza virus
YINTAMLNAS

SEQ ID NO: 382762 - protein, 10 aa, Influenza virus
INTAMLNASC

SEQ ID NO: 382763 - protein, 10 aa, Influenza virus
LNSSCAAMDD

SEQ ID NO: 382764 - protein, 10 aa, Influenza virus
NSSCAAMDDF

SEQ ID NO: 382765 - protein, 10 aa, Influenza virus
SSCAAMDDFQ

SEQ ID NO: 382766 - protein, 10 aa, Influenza virus
CTAMDDFQLI

SEQ ID NO: 382767 - protein, 10 aa, Influenza virus
TAMDDFQLIP

SEQ ID NO: 382768 - protein, 10 aa, Influenza virus
IPMISNCRTK

SEQ ID NO: 382769 - protein, 10 aa, Influenza virus
PMISKSRTKE

SEQ ID NO: 382770 - protein, 10 aa, Influenza virus
MISKSRTKEG

SEQ ID NO: 382771 - protein, 10 aa, Influenza virus
ISKSRTKEGR

SEQ ID NO: 382772 - protein, 10 aa, Influenza virus
KCKTKEGRRK

SEQ ID NO: 382773 - protein, 10 aa, Influenza virus
CKTKEGRRKT

SEQ ID NO: 382774 - protein, 10 aa, Influenza virus
EFSLVDPRLE

SEQ ID NO: 382775 - protein, 10 aa, Influenza virus
PLFLYVRTNG

SEQ ID NO: 382776 - protein, 10 aa, Influenza virus
LFLYVRTNGT

SEQ ID NO: 382777 - protein, 10 aa, Influenza virus
LQQVESMIEA

SEQ ID NO: 382778 - protein, 10 aa, Influenza virus
QQVESMIEAE

SEQ ID NO: 382779 - protein, 10 aa, Influenza virus
QVESMIEAES

SEQ ID NO: 382780 - protein, 10 aa, Influenza virus
VESMIEAESS

SEQ ID NO: 382781 - protein, 10 aa, Influenza virus
ESIIEAESSV

SEQ ID NO: 382782 - protein, 10 aa, Influenza virus
SMIEAESSVR

SEQ ID NO: 382783 - protein, 10 aa, Influenza virus
MIEAESSVRE

SEQ ID NO: 382784 - protein, 10 aa, Influenza virus
IEAESSVREK

SEQ ID NO: 382785 - protein, 10 aa, Influenza virus
AESSVKEKDL

SEQ ID NO: 382786 - protein, 10 aa, Influenza virus
ESSVKEKDLT

SEQ ID NO: 382787 - protein, 10 aa, Influenza virus
SSVREKDMTK

SEQ ID NO: 382788 - protein, 10 aa, Influenza virus
KEKDLTKEFF

SEQ ID NO: 382789 - protein, 10 aa, Influenza virus
EKDMTKDFFE

SEQ ID NO: 382790 - protein, 10 aa, Influenza virus
MEEGSIGKVC

SEQ ID NO: 382791 - protein, 10 aa, Influenza virus
EGSIGKVCRA

SEQ ID NO: 382792 - protein, 10 aa, Influenza virus
LAKSVFNSIY

SEQ ID NO: 382793 - protein, 10 aa, Influenza virus
AKSVFNSLYS

SEQ ID NO: 382794 - protein, 10 aa, Influenza virus
KSVFNSLYSS

SEQ ID NO: 382795 - protein, 10 aa, Influenza virus
SVFNSLYSSP

SEQ ID NO: 382796 - protein, 10 aa, Influenza virus
FNSLYSSPQL

SEQ ID NO: 382797 - protein, 10 aa, Influenza virus
NSLYSSPQLE

SEQ ID NO: 382798 - protein, 10 aa, Influenza virus
SLYSSPQLEG

SEQ ID NO: 382799 - protein, 10 aa, Influenza virus
AESRKMLLIV

SEQ ID NO: 382800 - protein, 10 aa, Influenza virus
ESRKMLLIVQ

SEQ ID NO: 382801 - protein, 10 aa, Influenza virus
SRKMLLIVQA

SEQ ID NO: 382802 - protein, 10 aa, Influenza virus
QALKDNLEPG

SEQ ID NO: 382803 - protein, 10 aa, Influenza virus
ALKDNLEPGT

SEQ ID NO: 382804 - protein, 10 aa, Influenza virus
LKDNLEPGTF

SEQ ID NO: 382805 - protein, 10 aa, Influenza virus
RDDLEPGTFD

SEQ ID NO: 382806 - protein, 10 aa, Influenza virus
LEPGTFDIEG

SEQ ID NO: 382807 - protein, 10 aa, Influenza virus
EPGTFDIEGL

SEQ ID NO: 382808 - protein, 10 aa, Influenza virus
PGTFDIEGLY

SEQ ID NO: 382809 - protein, 10 aa, Influenza virus
GLYGAIEECL

SEQ ID NO: 382810 - protein, 10 aa, Influenza virus
LYGAIEECLI

SEQ ID NO: 382811 - protein, 10 aa, Influenza virus
YGAIEECLIN

SEQ ID NO: 382812 - protein, 10 aa, Influenza virus
GAIEECLIND

SEQ ID NO: 382813 - protein, 10 aa, Influenza virus
NASWFNSFLI

SEQ ID NO: 382814 - protein, 10 aa, Influenza virus
ASWFNSFLIH

SEQ ID NO: 382815 - protein, 10 aa, Influenza virus
NSFLVHALKS

SEQ ID NO: 382816 - protein, 10 aa, Influenza virus
VNPTLLFLKM

SEQ ID NO: 382817 - protein, 10 aa, Influenza virus
NPTLLFLEVP

SEQ ID NO: 382818 - protein, 10 aa, Influenza virus
RTHQYSEKGR

SEQ ID NO: 382819 - protein, 10 aa, Influenza virus
THQYSEKGRW

SEQ ID NO: 382820 - protein, 10 aa, Influenza virus
TETKAPQLNP

SEQ ID NO: 382821 - protein, 10 aa, Influenza virus
ETGALQLNPI

SEQ ID NO: 382822 - protein, 10 aa, Influenza virus
TGALQLNPID

SEQ ID NO: 382823 - protein, 10 aa, Influenza virus
GAPQLNPVDG

SEQ ID NO: 382824 - protein, 10 aa, Influenza virus
LNPIDGPLPV

SEQ ID NO: 382825 - protein, 10 aa, Influenza virus
DNDPSGYAQT

SEQ ID NO: 382826 - protein, 10 aa, Influenza virus
NEPNGYAQTD

SEQ ID NO: 382827 - protein, 10 aa, Influenza virus
VLEAMALLEE

SEQ ID NO: 382828 - protein, 10 aa, Influenza virus
LEAMALLEES

SEQ ID NO: 382829 - protein, 10 aa, Influenza virus
EAMALLEESH

SEQ ID NO: 382830 - protein, 10 aa, Influenza virus
AMALLEESHP

SEQ ID NO: 382831 - protein, 10 aa, Influenza virus
MALLEESHPG

SEQ ID NO: 382832 - protein, 10 aa, Influenza virus
LENSHPGIFE

SEQ ID NO: 382833 - protein, 10 aa, Influenza virus
SHPGIFESSC

SEQ ID NO: 382834 - protein, 10 aa, Influenza virus
HPGIFGNSCL

SEQ ID NO: 382835 - protein, 10 aa, Influenza virus
PGIFGNSCLE

SEQ ID NO: 382836 - protein, 10 aa, Influenza virus
VQQTRMDKLT

SEQ ID NO: 382837 - protein, 10 aa, Influenza virus
LANTIEVFKS

SEQ ID NO: 382838 - protein, 10 aa, Influenza virus
ANTIEVFKSN

SEQ ID NO: 382839 - protein, 10 aa, Influenza virus
RLMDFLKDVM

SEQ ID NO: 382840 - protein, 10 aa, Influenza virus
IITHFQRKRR

SEQ ID NO: 382841 - protein, 10 aa, Influenza virus
ITHFQRKRRV

SEQ ID NO: 382842 - protein, 10 aa, Influenza virus
MVTQRTIGKR

SEQ ID NO: 382843 - protein, 10 aa, Influenza virus
TQRTIGKRKQ

SEQ ID NO: 382844 - protein, 10 aa, Influenza virus
SYLIRTLTLN

SEQ ID NO: 382845 - protein, 10 aa, Influenza virus
IRGFVYFVEI

SEQ ID NO: 382846 - protein, 10 aa, Influenza virus
RGFVYFVEIL

SEQ ID NO: 382847 - protein, 10 aa, Influenza virus
GFVYFVEILA

SEQ ID NO: 382848 - protein, 10 aa, Influenza virus
LARNICEKLE

SEQ ID NO: 382849 - protein, 10 aa, Influenza virus
ARNICEKLEQ

SEQ ID NO: 382850 - protein, 10 aa, Influenza virus
RNICEKLEQS

SEQ ID NO: 382851 - protein, 10 aa, Influenza virus
NICEKLEQSG

SEQ ID NO: 382852 - protein, 10 aa, Influenza virus
NSQDTEVSFT

SEQ ID NO: 382853 - protein, 10 aa, Influenza virus
SQDTEVSFTI

SEQ ID NO: 382854 - protein, 10 aa, Influenza virus
QDTEVSFTIT

SEQ ID NO: 382855 - protein, 10 aa, Influenza virus
ENQNPRVFLT

SEQ ID NO: 382856 - protein, 10 aa, Influenza virus
NQNPRVFLTM

SEQ ID NO: 382857 - protein, 10 aa, Influenza virus
QNPRVFLTMI

SEQ ID NO: 382858 - protein, 10 aa, Influenza virus
NPRVFLTMIT

SEQ ID NO: 382859 - protein, 10 aa, Influenza virus
PRVFLTMITY

SEQ ID NO: 382860 - protein, 10 aa, Influenza virus
RVFLTMITYI

SEQ ID NO: 382861 - protein, 10 aa, Influenza virus
VFLTMITYIT

SEQ ID NO: 382862 - protein, 10 aa, Influenza virus
QPKWFRNVLS

SEQ ID NO: 382863 - protein, 10 aa, Influenza virus
WFRNVLSVAP

SEQ ID NO: 382864 - protein, 10 aa, Influenza virus
FRNVLSVAPI

SEQ ID NO: 382865 - protein, 10 aa, Influenza virus
RNVLSVAPIM

SEQ ID NO: 382866 - protein, 10 aa, Influenza virus
NVLSVAPIMF

SEQ ID NO: 382867 - protein, 10 aa, Influenza virus
VLSVAPIMFS

SEQ ID NO: 382868 - protein, 10 aa, Influenza virus
GTAALSPGMM

SEQ ID NO: 382869 - protein, 10 aa, Influenza virus
TVYWWDGLQS

SEQ ID NO: 382870 - protein, 10 aa, Influenza virus
VYWWDGLQSS

SEQ ID NO: 382871 - protein, 10 aa, Influenza virus
DDFALILNAP

SEQ ID NO: 382872 - protein, 10 aa, Influenza virus
NRFYRTCKLV

SEQ ID NO: 382873 - protein, 10 aa, Influenza virus
DMSIGVAVIK

SEQ ID NO: 382874 - protein, 10 aa, Influenza virus
MSIGVAVIKN

SEQ ID NO: 382875 - protein, 10 aa, Influenza virus
SIGVAVIKNN

SEQ ID NO: 382876 - protein, 10 aa, Influenza virus
IGVAVIKNNM

SEQ ID NO: 382877 - protein, 10 aa, Influenza virus
GVTVIKNNMV

SEQ ID NO: 382878 - protein, 10 aa, Influenza virus
VTVIKNNMVN

SEQ ID NO: 382879 - protein, 10 aa, Influenza virus
TYRCHRGDTH

SEQ ID NO: 382880 - protein, 10 aa, Influenza virus
YRCHRGDTHI

SEQ ID NO: 382881 - protein, 10 aa, Influenza virus
HIPEVCLKWG

SEQ ID NO: 382882 - protein, 10 aa, Influenza virus
IPEVCLKWGL

SEQ ID NO: 382883 - protein, 10 aa, Influenza virus
YQGRLCNPMN

SEQ ID NO: 382884 - protein, 10 aa, Influenza virus
QGRLCNPMNP

SEQ ID NO: 382885 - protein, 10 aa, Influenza virus
LCNPMNPFVS

SEQ ID NO: 382886 - protein, 10 aa, Influenza virus
CNPMNPFVSH

SEQ ID NO: 382887 - protein, 10 aa, Influenza virus
SQKGILEDEQ

SEQ ID NO: 382888 - protein, 10 aa, Influenza virus
ILEDERMYQK

SEQ ID NO: 382889 - protein, 10 aa, Influenza virus
DEQMYQKCCT

SEQ ID NO: 382890 - protein, 10 aa, Influenza virus
EQMYQKCCTL

SEQ ID NO: 382891 - protein, 10 aa, Influenza virus
QMYQKCCTLF

SEQ ID NO: 382892 - protein, 10 aa, Influenza virus
MYQKCCTLFE

SEQ ID NO: 382893 - protein, 10 aa, Influenza virus
YQKCCTLFEK

SEQ ID NO: 382894 - protein, 10 aa, Influenza virus
QKCCTLFEKF

SEQ ID NO: 382895 - protein, 10 aa, Influenza virus
KCCTLFEKFF

SEQ ID NO: 382896 - protein, 10 aa, Influenza virus
RRPVGISSMM

SEQ ID NO: 382897 - protein, 10 aa, Influenza virus
RPVGISSMME

SEQ ID NO: 382898 - protein, 10 aa, Influenza virus
PVGISSMMEA

SEQ ID NO: 382899 - protein, 10 aa, Influenza virus
VGISSMMEAM

SEQ ID NO: 382900 - protein, 10 aa, Influenza virus
GISSMVEAMI

SEQ ID NO: 382901 - protein, 10 aa, Influenza virus
ISSMVEAMIS

SEQ ID NO: 382902 - protein, 10 aa, Influenza virus
SSMVEAMISR

SEQ ID NO: 382903 - protein, 10 aa, Influenza virus
SMVEAMISRA

SEQ ID NO: 382904 - protein, 10 aa, Influenza virus
MVEAMISRAR

SEQ ID NO: 382905 - protein, 10 aa, Influenza virus
VEAMISRARI

SEQ ID NO: 382906 - protein, 10 aa, Influenza virus
MSRARIDARI

SEQ ID NO: 382907 - protein, 10 aa, Influenza virus
ARIDFESGRV

SEQ ID NO: 382908 - protein, 10 aa, Influenza virus
SLSRTREILT

SEQ ID NO: 382909 - protein, 10 aa, Influenza virus
LSRTREILTK

SEQ ID NO: 382910 - protein, 10 aa, Influenza virus
SRTRGILTKT

SEQ ID NO: 382911 - protein, 10 aa, Influenza virus
RTRGILTKTT

SEQ ID NO: 382912 - protein, 10 aa, Influenza virus
TRGILTKTTV

SEQ ID NO: 382913 - protein, 10 aa, Influenza virus
MAMKYPITAN

SEQ ID NO: 382914 - protein, 10 aa, Influenza virus
MVSPLAITWW

SEQ ID NO: 382915 - protein, 10 aa, Influenza virus
PLAITWWNRN

SEQ ID NO: 382916 - protein, 10 aa, Influenza virus
HYSKVYKTYF

SEQ ID NO: 382917 - protein, 10 aa, Influenza virus
GTFGPVHFRS

SEQ ID NO: 382918 - protein, 10 aa, Influenza virus
TFGPVHFRSQ

SEQ ID NO: 382919 - protein, 10 aa, Influenza virus
FGPVHFRSQV

SEQ ID NO: 382920 - protein, 10 aa, Influenza virus
GPVHFRSQVK

SEQ ID NO: 382921 - protein, 10 aa, Influenza virus
PVHFRSQVKI

SEQ ID NO: 382922 - protein, 10 aa, Influenza virus
VHFRSQVKIR

SEQ ID NO: 382923 - protein, 10 aa, Influenza virus
HFRSQVKIRR

SEQ ID NO: 382924 - protein, 10 aa, Influenza virus
QIKIRRRVDI

SEQ ID NO: 382925 - protein, 10 aa, Influenza virus
IKIRRRVDIN

SEQ ID NO: 382926 - protein, 10 aa, Influenza virus
KIRRRVDMNP

SEQ ID NO: 382927 - protein, 10 aa, Influenza virus
IRRRVDMNPG

SEQ ID NO: 382928 - protein, 10 aa, Influenza virus
RRRVDMNPGH

SEQ ID NO: 382929 - protein, 10 aa, Influenza virus
RRVDMNPGHA

SEQ ID NO: 382930 - protein, 10 aa, Influenza virus
RVDMNPGHAD

SEQ ID NO: 382931 - protein, 10 aa, Influenza virus
VKEAQDVIME

SEQ ID NO: 382932 - protein, 10 aa, Influenza virus
EVGARILASE

SEQ ID NO: 382933 - protein, 10 aa, Influenza virus
VGARILASES

SEQ ID NO: 382934 - protein, 10 aa, Influenza virus
GARILASESQ

SEQ ID NO: 382935 - protein, 10 aa, Influenza virus
ARIITSESQL

SEQ ID NO: 382936 - protein, 10 aa, Influenza virus
VRKTRFLPVV

SEQ ID NO: 382937 - protein, 10 aa, Influenza virus
RKTRFLPVVG

SEQ ID NO: 382938 - protein, 10 aa, Influenza virus
RFLPVTGGTS

SEQ ID NO: 382939 - protein, 10 aa, Influenza virus
FLPVTGGTSS

SEQ ID NO: 382940 - protein, 10 aa, Influenza virus
GGTSSVYVEV

SEQ ID NO: 382941 - protein, 10 aa, Influenza virus
GTSSVYVEVL

SEQ ID NO: 382942 - protein, 10 aa, Influenza virus
TSSVYVEVLH

SEQ ID NO: 382943 - protein, 10 aa, Influenza virus
SSVYVEVLHL

SEQ ID NO: 382944 - protein, 10 aa, Influenza virus
WEQMYTPGGK

SEQ ID NO: 382945 - protein, 10 aa, Influenza virus
EQMYTPGGKV

SEQ ID NO: 382946 - protein, 10 aa, Influenza virus
YTPGGKVRND

SEQ ID NO: 382947 - protein, 10 aa, Influenza virus
VKNDDIDQSL

SEQ ID NO: 382948 - protein, 10 aa, Influenza virus
NDEVDQSLII

SEQ ID NO: 382949 - protein, 10 aa, Influenza virus
DEVDQSLIIA

SEQ ID NO: 382950 - protein, 10 aa, Influenza virus
EVDQSLIIAA

SEQ ID NO: 382951 - protein, 10 aa, Influenza virus
AARNIVRRAI

SEQ ID NO: 382952 - protein, 10 aa, Influenza virus
ARNIVRRAIV

SEQ ID NO: 382953 - protein, 10 aa, Influenza virus
RNIVRRAIVS

SEQ ID NO: 382954 - protein, 10 aa, Influenza virus
NIVRRAIVSA

SEQ ID NO: 382955 - protein, 10 aa, Influenza virus
RATVSADPLL

SEQ ID NO: 382956 - protein, 10 aa, Influenza virus
ATVSADPLLS

SEQ ID NO: 382957 - protein, 10 aa, Influenza virus
TVSADPLLSL

SEQ ID NO: 382958 - protein, 10 aa, Influenza virus
LEMCHSTQVG

SEQ ID NO: 382959 - protein, 10 aa, Influenza virus
DILRQNPSEE

SEQ ID NO: 382960 - protein, 10 aa, Influenza virus
ILRQNPSEEQ

SEQ ID NO: 382961 - protein, 10 aa, Influenza virus
QNPTEEQAVE

SEQ ID NO: 382962 - protein, 10 aa, Influenza virus
NPTEEQAVEI

SEQ ID NO: 382963 - protein, 10 aa, Influenza virus
QAVDICKAAL

SEQ ID NO: 382964 - protein, 10 aa, Influenza virus
AVDICKAALG

SEQ ID NO: 382965 - protein, 10 aa, Influenza virus
ICKAAMGLKI

SEQ ID NO: 382966 - protein, 10 aa, Influenza virus
CKAAMGLKIS

SEQ ID NO: 382967 - protein, 10 aa, Influenza virus
KAAMGLKISS

SEQ ID NO: 382968 - protein, 10 aa, Influenza virus
AAMGLKISSS

SEQ ID NO: 382969 - protein, 10 aa, Influenza virus
AMGLKISSSF

SEQ ID NO: 382970 - protein, 10 aa, Influenza virus
MGLKISSSFS

SEQ ID NO: 382971 - protein, 10 aa, Influenza virus
FTFKRTSGTS

SEQ ID NO: 382972 - protein, 10 aa, Influenza virus
EELLTGNLQT

SEQ ID NO: 382973 - protein, 10 aa, Influenza virus
ELLTGNLQTL

SEQ ID NO: 382974 - protein, 10 aa, Influenza virus
VLTGNLQALK

SEQ ID NO: 382975 - protein, 10 aa, Influenza virus
LTGNLQTLKV

SEQ ID NO: 382976 - protein, 10 aa, Influenza virus
EGFEEFTMVG

SEQ ID NO: 382977 - protein, 10 aa, Influenza virus
ATAIIRKATR

SEQ ID NO: 382978 - protein, 10 aa, Influenza virus
IVAIVFSQED

SEQ ID NO: 382979 - protein, 10 aa, Influenza virus
VAMVFSQEDR

SEQ ID NO: 382980 - protein, 10 aa, Influenza virus
AIVFSQEDCM

SEQ ID NO: 382981 - protein, 10 aa, Influenza virus
IVFSQEDCMI

SEQ ID NO: 382982 - protein, 10 aa, Influenza virus
VFSQEDCMMK

SEQ ID NO: 382983 - protein, 10 aa, Influenza virus
FSQEDCMMKA

SEQ ID NO: 382984 - protein, 10 aa, Influenza virus
QEDCMMKAVR

SEQ ID NO: 382985 - protein, 10 aa, Influenza virus
DCMMKAVRGD

SEQ ID NO: 382986 - protein, 10 aa, Influenza virus
RMIKAVRGDL

SEQ ID NO: 382987 - protein, 10 aa, Influenza virus
LRHFQKNAKV

SEQ ID NO: 382988 - protein, 10 aa, Influenza virus
RHFQKNAKVL

SEQ ID NO: 382989 - protein, 10 aa, Influenza virus
RVSKTGVDEY

SEQ ID NO: 382990 - protein, 10 aa, Influenza virus
SKTGVDEYSS

SEQ ID NO: 382991 - protein, 10 aa, Influenza virus
TGVDEYSSTE

SEQ ID NO: 382992 - protein, 10 aa, Influenza virus
GVDEYSSAER

SEQ ID NO: 382993 - protein, 10 aa, Influenza virus
AVSIDRFLRV

SEQ ID NO: 382994 - protein, 10 aa, Influenza virus
DRFLRVRDQL

SEQ ID NO: 382995 - protein, 10 aa, Influenza virus
RFLRVRDQLG

SEQ ID NO: 382996 - protein, 10 aa, Influenza virus
FLRVRDQLGN

SEQ ID NO: 382997 - protein, 10 aa, Influenza virus
QGNILLSPEE

SEQ ID NO: 382998 - protein, 10 aa, Influenza virus
PEEVSEAQGT

SEQ ID NO: 382999 - protein, 10 aa, Influenza virus
EEVSEAQGTE

SEQ ID NO: 383000 - protein, 10 aa, Influenza virus
EKLTITYSSP

SEQ ID NO: 383001 - protein, 10 aa, Influenza virus
KLTIIYSSSM

SEQ ID NO: 383002 - protein, 10 aa, Influenza virus
LTITYSSPMM

SEQ ID NO: 383003 - protein, 10 aa, Influenza virus
TITYSSPMMW

SEQ ID NO: 383004 - protein, 10 aa, Influenza virus
ITYSSPMMWE

SEQ ID NO: 383005 - protein, 10 aa, Influenza virus
IYSSSMMWEI

SEQ ID NO: 383006 - protein, 10 aa, Influenza virus
YSSPMMWEIN

SEQ ID NO: 383007 - protein, 10 aa, Influenza virus
SSPMMWEING

SEQ ID NO: 383008 - protein, 10 aa, Influenza virus
SPMMWEINGP

SEQ ID NO: 383009 - protein, 10 aa, Influenza virus
PMMWEINGPE

SEQ ID NO: 383010 - protein, 10 aa, Influenza virus
MMWEINGPDS

SEQ ID NO: 383011 - protein, 10 aa, Influenza virus
EINGPDSVLV

SEQ ID NO: 383012 - protein, 10 aa, Influenza virus
INGPDSVLVN

SEQ ID NO: 383013 - protein, 10 aa, Influenza virus
LVNTYQWIIK

SEQ ID NO: 383014 - protein, 10 aa, Influenza virus
VNTYQWIIKN

SEQ ID NO: 383015 - protein, 10 aa, Influenza virus
LYNKLEFEPF

SEQ ID NO: 383016 - protein, 10 aa, Influenza virus
YNKLEFEPFQ

SEQ ID NO: 383017 - protein, 10 aa, Influenza virus
NKLEFEPFQS

SEQ ID NO: 383018 - protein, 10 aa, Influenza virus
KLEFEPFQSL

SEQ ID NO: 383019 - protein, 10 aa, Influenza virus
VEFEPFQSLV

SEQ ID NO: 383020 - protein, 10 aa, Influenza virus
GTFDTIQIIK

SEQ ID NO: 383021 - protein, 10 aa, Influenza virus
TIQIIKLLPF

SEQ ID NO: 383022 - protein, 10 aa, Influenza virus
IQIIKLLPFA

SEQ ID NO: 383023 - protein, 10 aa, Influenza virus
IIKMLPFAAA

SEQ ID NO: 383024 - protein, 10 aa, Influenza virus
LLPFASAPPE

SEQ ID NO: 383025 - protein, 10 aa, Influenza virus
LPFASAPPEQ

SEQ ID NO: 383026 - protein, 10 aa, Influenza virus
PFASAPPEQS

SEQ ID NO: 383027 - protein, 10 aa, Influenza virus
APPVQSRMQF

SEQ ID NO: 383028 - protein, 10 aa, Influenza virus
PPVQSRMQFS

SEQ ID NO: 383029 - protein, 10 aa, Influenza virus
PVQSRMQFSS

SEQ ID NO: 383030 - protein, 10 aa, Influenza virus
QSRMQFSSLA

SEQ ID NO: 383031 - protein, 10 aa, Influenza virus
SRMQFSSLAV

SEQ ID NO: 383032 - protein, 10 aa, Influenza virus
RMQFSSLAVN

SEQ ID NO: 383033 - protein, 10 aa, Influenza virus
MQFSSFTVNV

SEQ ID NO: 383034 - protein, 10 aa, Influenza virus
SSLAVNVRGS

SEQ ID NO: 383035 - protein, 10 aa, Influenza virus
SLAVNVRGSG

SEQ ID NO: 383036 - protein, 10 aa, Influenza virus
LTVSVRGSGM

SEQ ID NO: 383037 - protein, 10 aa, Influenza virus
TVSVRGSGMR

SEQ ID NO: 383038 - protein, 10 aa, Influenza virus
VSVRGSGMRI

SEQ ID NO: 383039 - protein, 10 aa, Influenza virus
SVRGSGMRIL

SEQ ID NO: 383040 - protein, 10 aa, Influenza virus
RGTGMRILVR

SEQ ID NO: 383041 - protein, 10 aa, Influenza virus
GTGMRILVRG

SEQ ID NO: 383042 - protein, 10 aa, Influenza virus
GLRILIRGNS

SEQ ID NO: 383043 - protein, 10 aa, Influenza virus
LRILIRGNSP

SEQ ID NO: 383044 - protein, 10 aa, Influenza virus
LIRGNSPIFN

SEQ ID NO: 383045 - protein, 10 aa, Influenza virus
IRGNSPIFNY

SEQ ID NO: 383046 - protein, 10 aa, Influenza virus
GNSPAFNYNK

SEQ ID NO: 383047 - protein, 10 aa, Influenza virus
RRLTVLGKDA

SEQ ID NO: 383048 - protein, 10 aa, Influenza virus
GGVESAVLRG

SEQ ID NO: 383049 - protein, 10 aa, Influenza virus
RGFLILGRED

SEQ ID NO: 383050 - protein, 10 aa, Influenza virus
GFLILGKENK

SEQ ID NO: 383051 - protein, 10 aa, Influenza virus
GKENKRYGPA

SEQ ID NO: 383052 - protein, 10 aa, Influenza virus
KENKRYGPAL

SEQ ID NO: 383053 - protein, 10 aa, Influenza virus
ENKKYGPALS

SEQ ID NO: 383054 - protein, 10 aa, Influenza virus
NKKYGPALSI

SEQ ID NO: 383055 - protein, 10 aa, Influenza virus
KRYGPALSIS

SEQ ID NO: 383056 - protein, 10 aa, Influenza virus
IAKGEKANVL

SEQ ID NO: 383057 - protein, 10 aa, Influenza virus
TATKRIRLAI

SEQ ID NO: 383058 - protein, 10 aa, Influenza virus
KRIRMAINWG

SEQ ID NO: 383059 - protein, 10 aa, Influenza virus
RRKRRGLFGA

SEQ ID NO: 383060 - protein, 10 aa, Influenza virus
VKMNPNQKII

SEQ ID NO: 383061 - protein, 10 aa, Influenza virus
SKDNNIRIGS

SEQ ID NO: 383062 - protein, 10 aa, Influenza virus
KDNNIRIGSK

SEQ ID NO: 383063 - protein, 10 aa, Influenza virus
DNNIRIGSKG

SEQ ID NO: 383064 - protein, 10 aa, Influenza virus
NNIRIGSKGD

SEQ ID NO: 383065 - protein, 10 aa, Influenza virus
GDVFVVREPF

SEQ ID NO: 383066 - protein, 10 aa, Influenza virus
FECRTFFLTQ

SEQ ID NO: 383067 - protein, 10 aa, Influenza virus
LNDRHSNGTI

SEQ ID NO: 383068 - protein, 10 aa, Influenza virus
DRSPFRALMS

SEQ ID NO: 383069 - protein, 10 aa, Influenza virus
VGEVPSPYNS

SEQ ID NO: 383070 - protein, 10 aa, Influenza virus
WSASACHDGV

SEQ ID NO: 383071 - protein, 10 aa, Influenza virus
SWLTIGVSGP

SEQ ID NO: 383072 - protein, 10 aa, Influenza virus
TIGVSGPDNG

SEQ ID NO: 383073 - protein, 10 aa, Influenza virus
IGVSGPDNGA

SEQ ID NO: 383074 - protein, 10 aa, Influenza virus
GVSGPDNGAV

SEQ ID NO: 383075 - protein, 10 aa, Influenza virus
VSGPDNGAVA

SEQ ID NO: 383076 - protein, 10 aa, Influenza virus
GPDNGAVAVV

SEQ ID NO: 383077 - protein, 10 aa, Influenza virus
PDNGAVAVVK

SEQ ID NO: 383078 - protein, 10 aa, Influenza virus
DNGAVAVVKY

SEQ ID NO: 383079 - protein, 10 aa, Influenza virus
GAVAVLKYND

SEQ ID NO: 383080 - protein, 10 aa, Influenza virus
AVLKYNGVIT

SEQ ID NO: 383081 - protein, 10 aa, Influenza virus
NGSCFTLMTD

SEQ ID NO: 383082 - protein, 10 aa, Influenza virus
FCFTVMTDGP

SEQ ID NO: 383083 - protein, 10 aa, Influenza virus
CFTIMTDGPN

SEQ ID NO: 383084 - protein, 10 aa, Influenza virus
APNYYYEECS

SEQ ID NO: 383085 - protein, 10 aa, Influenza virus
PNYYYEECSC

SEQ ID NO: 383086 - protein, 10 aa, Influenza virus
NYYYEECSCY

SEQ ID NO: 383087 - protein, 10 aa, Influenza virus
YYYEECSCYP

SEQ ID NO: 383088 - protein, 10 aa, Influenza virus
KYGDGVWIGR

SEQ ID NO: 383089 - protein, 10 aa, Influenza virus
NCIKPCFWVE

SEQ ID NO: 383090 - protein, 10 aa, Influenza virus
IKPCFWVELI

SEQ ID NO: 383091 - protein, 10 aa, Influenza virus
TIWTSASSIS

SEQ ID NO: 383092 - protein, 10 aa, Influenza virus
IWTSASSISF

SEQ ID NO: 383093 - protein, 10 aa, Influenza virus
ASSISFCGVN

SEQ ID NO: 383094 - protein, 10 aa, Influenza virus
SWPDDAELPF

SEQ ID NO: 383095 - protein, 10 aa, Influenza virus
GFAPLSKDNS

SEQ ID NO: 383096 - protein, 10 aa, Influenza virus
PFSKDNSVRL

SEQ ID NO: 383097 - protein, 10 aa, Influenza virus
SKDNSIRLAA

SEQ ID NO: 383098 - protein, 10 aa, Influenza virus
KDNSIQLSAG

SEQ ID NO: 383099 - protein, 10 aa, Influenza virus
SHRTLLMNEL

SEQ ID NO: 383100 - protein, 10 aa, Influenza virus
LGVPFYLGTK

SEQ ID NO: 383101 - protein, 10 aa, Influenza virus
GVPFYLGTKQ

SEQ ID NO: 383102 - protein, 10 aa, Influenza virus
VPFYLGTKQV

SEQ ID NO: 383103 - protein, 10 aa, Influenza virus
TKQVCVAWSS

SEQ ID NO: 383104 - protein, 10 aa, Influenza virus
KQVCVAWSSS

SEQ ID NO: 383105 - protein, 10 aa, Influenza virus
SILRTQESEC

SEQ ID NO: 383106 - protein, 10 aa, Influenza virus
HVEECSCYPS

SEQ ID NO: 383107 - protein, 10 aa, Influenza virus
VKCVCRDNWK

SEQ ID NO: 383108 - protein, 10 aa, Influenza virus
SGLVGDTPRE

SEQ ID NO: 383109 - protein, 10 aa, Influenza virus
WTANSIIVFC

SEQ ID NO: 383110 - protein, 10 aa, Influenza virus
TANSIIVFCG

SEQ ID NO: 383111 - protein, 10 aa, Influenza virus
ANSIIVFCGT

SEQ ID NO: 383112 - protein, 10 aa, Influenza virus
SSIVVFCGTS

SEQ ID NO: 383113 - protein, 10 aa, Influenza virus
SVVVFCGTSG

SEQ ID NO: 383114 - protein, 10 aa, Influenza virus
VVVFCGTSGT

SEQ ID NO: 383115 - protein, 10 aa, Influenza virus
SGTYGKGSWP

SEQ ID NO: 383116 - protein, 10 aa, Influenza virus
ANINFMPYIS

SEQ ID NO: 383117 - protein, 10 aa, Influenza virus
IVTREPCVSC

SEQ ID NO: 383118 - protein, 10 aa, Influenza virus
VCWSFALAQG

SEQ ID NO: 383119 - protein, 10 aa, Influenza virus
HSNGTIKDRA

SEQ ID NO: 383120 - protein, 10 aa, Influenza virus
RDRTPYRSLI

SEQ ID NO: 383121 - protein, 10 aa, Influenza virus
DRAPYRSLIR

SEQ ID NO: 383122 - protein, 10 aa, Influenza virus
RAPYRSLIRF

SEQ ID NO: 383123 - protein, 10 aa, Influenza virus
TPYRSLIKFP

SEQ ID NO: 383124 - protein, 10 aa, Influenza virus
YRSLIKFPIG

SEQ ID NO: 383125 - protein, 10 aa, Influenza virus
RNILRTQESE

SEQ ID NO: 383126 - protein, 10 aa, Influenza virus
KIRHLEECSC

SEQ ID NO: 383127 - protein, 10 aa, Influenza virus
KGSNRPWMKI

SEQ ID NO: 383128 - protein, 10 aa, Influenza virus
GSNRPWIRIN

SEQ ID NO: 383129 - protein, 10 aa, Influenza virus
SNRPWIRINN

SEQ ID NO: 383130 - protein, 10 aa, Influenza virus
NRPWIRINNE

SEQ ID NO: 383131 - protein, 10 aa, Influenza virus
RPWIRINNET

SEQ ID NO: 383132 - protein, 10 aa, Influenza virus
PWIRINNETI

SEQ ID NO: 383133 - protein, 10 aa, Influenza virus
INNETIVETG

SEQ ID NO: 383134 - protein, 10 aa, Influenza virus
TILETGYVCG

SEQ ID NO: 383135 - protein, 10 aa, Influenza virus
ILETGYVCGK

SEQ ID NO: 383136 - protein, 10 aa, Influenza virus
LETGYVCGKF

SEQ ID NO: 383137 - protein, 10 aa, Influenza virus
KFHSDTPRPT

SEQ ID NO: 383138 - protein, 10 aa, Influenza virus
FHSDTPRPTD

SEQ ID NO: 383139 - protein, 10 aa, Influenza virus
HSDTPRPTDP

SEQ ID NO: 383140 - protein, 10 aa, Influenza virus
SDTPRPTDPS

SEQ ID NO: 383141 - protein, 10 aa, Influenza virus
SNDVWLGRTV

SEQ ID NO: 383142 - protein, 10 aa, Influenza virus
NDVWLGRTVT

SEQ ID NO: 383143 - protein, 10 aa, Influenza virus
NQTLVSNNDW

SEQ ID NO: 383144 - protein, 10 aa, Influenza virus
WPDGANIGLC

SEQ ID NO: 383145 - protein, 10 aa, Influenza virus
PDGANIGLCP

SEQ ID NO: 383146 - protein, 10 aa, Influenza virus
TTIGPLLQIT

SEQ ID NO: 383147 - protein, 10 aa, Influenza virus
TIGLLLQIIS

SEQ ID NO: 383148 - protein, 10 aa, Influenza virus
IGLLLQIISL

SEQ ID NO: 383149 - protein, 10 aa, Influenza virus
FSHYNQITQT

SEQ ID NO: 383150 - protein, 10 aa, Influenza virus
THVQNNYTTI

SEQ ID NO: 383151 - protein, 10 aa, Influenza virus
ISCSIHECRT

SEQ ID NO: 383152 - protein, 10 aa, Influenza virus
SCSIHECRTF

SEQ ID NO: 383153 - protein, 10 aa, Influenza virus
CSIHECRTFF

SEQ ID NO: 383154 - protein, 10 aa, Influenza virus
SIHECRTFFL

SEQ ID NO: 383155 - protein, 10 aa, Influenza virus
VSECRTFFLT

SEQ ID NO: 383156 - protein, 10 aa, Influenza virus
ILKIKKGKIM

SEQ ID NO: 383157 - protein, 10 aa, Influenza virus
AAGFHFEECS

SEQ ID NO: 383158 - protein, 10 aa, Influenza virus
IGFHFEECSC

SEQ ID NO: 383159 - protein, 10 aa, Influenza virus
SVECVCRDNW

SEQ ID NO: 383160 - protein, 10 aa, Influenza virus
FGDNPRSVDG

SEQ ID NO: 383161 - protein, 10 aa, Influenza virus
PRSVDGTGSC

SEQ ID NO: 383162 - protein, 10 aa, Influenza virus
FCGVNSNTTG

SEQ ID NO: 383163 - protein, 10 aa, Influenza virus
CGVNSDTTCW

SEQ ID NO: 383164 - protein, 10 aa, Influenza virus
IITIGSMSLA

SEQ ID NO: 383165 - protein, 10 aa, Influenza virus
TTEMYNETVR

SEQ ID NO: 383166 - protein, 10 aa, Influenza virus
TEMYNETVRV

SEQ ID NO: 383167 - protein, 10 aa, Influenza virus
PLCEVSGFAV

SEQ ID NO: 383168 - protein, 10 aa, Influenza virus
SGFAVVSKDN

SEQ ID NO: 383169 - protein, 10 aa, Influenza virus
GFAVVSKDNG

SEQ ID NO: 383170 - protein, 10 aa, Influenza virus
FAIASKDNGI

SEQ ID NO: 383171 - protein, 10 aa, Influenza virus
AIASKDNGIR

SEQ ID NO: 383172 - protein, 10 aa, Influenza virus
IASKDNGIRI

SEQ ID NO: 383173 - protein, 10 aa, Influenza virus
REPFVACSPS

SEQ ID NO: 383174 - protein, 10 aa, Influenza virus
EPFVACSPSE

SEQ ID NO: 383175 - protein, 10 aa, Influenza virus
PFVACSPSEC

SEQ ID NO: 383176 - protein, 10 aa, Influenza virus
FVACSPSECR

SEQ ID NO: 383177 - protein, 10 aa, Influenza virus
VACSPSECRT

SEQ ID NO: 383178 - protein, 10 aa, Influenza virus
ACSPSECRTF

SEQ ID NO: 383179 - protein, 10 aa, Influenza virus
TACHDGKKWM

SEQ ID NO: 383180 - protein, 10 aa, Influenza virus
HYGGIPTDVI

SEQ ID NO: 383181 - protein, 10 aa, Influenza virus
YGGVPTDVMR

SEQ ID NO: 383182 - protein, 10 aa, Influenza virus
GGVPTDVMRS

SEQ ID NO: 383183 - protein, 10 aa, Influenza virus
GIPTDVIRSW

SEQ ID NO: 383184 - protein, 10 aa, Influenza virus
TDVVRSWRRQ

SEQ ID NO: 383185 - protein, 10 aa, Influenza virus
DVVRSWRRQI

SEQ ID NO: 383186 - protein, 10 aa, Influenza virus
VVRSWRRQIL

SEQ ID NO: 383187 - protein, 10 aa, Influenza virus
VRSWRRQILR

SEQ ID NO: 383188 - protein, 10 aa, Influenza virus
GPANNQASYR

SEQ ID NO: 383189 - protein, 10 aa, Influenza virus
PANNQASYRI

SEQ ID NO: 383190 - protein, 10 aa, Influenza virus
ANNQASYRIF

SEQ ID NO: 383191 - protein, 10 aa, Influenza virus
NNQASYRIFK

SEQ ID NO: 383192 - protein, 10 aa, Influenza virus
QASYRIFKSH

SEQ ID NO: 383193 - protein, 10 aa, Influenza virus
ECSCYPNLGI

SEQ ID NO: 383194 - protein, 10 aa, Influenza virus
CSCYPNLGIV

SEQ ID NO: 383195 - protein, 10 aa, Influenza virus
SCYPNLCQVE

SEQ ID NO: 383196 - protein, 10 aa, Influenza virus
CYPNLGIVEC

SEQ ID NO: 383197 - protein, 10 aa, Influenza virus
YPNLGIVECV

SEQ ID NO: 383198 - protein, 10 aa, Influenza virus
PNLGIVECVC

SEQ ID NO: 383199 - protein, 10 aa, Influenza virus
NLGIVECVCR

SEQ ID NO: 383200 - protein, 10 aa, Influenza virus
LCQVECVCRD

SEQ ID NO: 383201 - protein, 10 aa, Influenza virus
PTDTPRVQDG

SEQ ID NO: 383202 - protein, 10 aa, Influenza virus
GTSVWAGRTV

SEQ ID NO: 383203 - protein, 10 aa, Influenza virus
SGFEVLLIEN

SEQ ID NO: 383204 - protein, 10 aa, Influenza virus
EVLNNKHWSG

SEQ ID NO: 383205 - protein, 10 aa, Influenza virus
ILNNKNWSGY

SEQ ID NO: 383206 - protein, 10 aa, Influenza virus
GYSGAFTIPV

SEQ ID NO: 383207 - protein, 10 aa, Influenza virus
PEEKTSIWTS

SEQ ID NO: 383208 - protein, 10 aa, Influenza virus
EEKTSIWTSS

SEQ ID NO: 383209 - protein, 10 aa, Influenza virus
SSEVPEWSWD

SEQ ID NO: 383210 - protein, 10 aa, Influenza virus
CISATGMILS

SEQ ID NO: 383211 - protein, 10 aa, Influenza virus
ISATGMALSV

SEQ ID NO: 383212 - protein, 10 aa, Influenza virus
SATGMALSVV

SEQ ID NO: 383213 - protein, 10 aa, Influenza virus
TGMTLSVVNL

SEQ ID NO: 383214 - protein, 10 aa, Influenza virus
GMTLSVVSLI

SEQ ID NO: 383215 - protein, 10 aa, Influenza virus
GLVNLGLNIG

SEQ ID NO: 383216 - protein, 10 aa, Influenza virus
DNAVRIGEDA

SEQ ID NO: 383217 - protein, 10 aa, Influenza virus
NAIRIGEGAH

SEQ ID NO: 383218 - protein, 10 aa, Influenza virus
GAHILVTREP

SEQ ID NO: 383219 - protein, 10 aa, Influenza virus
KGRHANGTIH

SEQ ID NO: 383220 - protein, 10 aa, Influenza virus
NGTINDRSPF

SEQ ID NO: 383221 - protein, 10 aa, Influenza virus
GTINDRSPFR

SEQ ID NO: 383222 - protein, 10 aa, Influenza virus
TINDRSPFRA

SEQ ID NO: 383223 - protein, 10 aa, Influenza virus
INDRSPFRAL

SEQ ID NO: 383224 - protein, 10 aa, Influenza virus
NDRSPFRALV

SEQ ID NO: 383225 - protein, 10 aa, Influenza virus
SPFRALISWG

SEQ ID NO: 383226 - protein, 10 aa, Influenza virus
PFRALISWGM

SEQ ID NO: 383227 - protein, 10 aa, Influenza virus
TLISWEMGQA

SEQ ID NO: 383228 - protein, 10 aa, Influenza virus
EMGHAPSPYN

SEQ ID NO: 383229 - protein, 10 aa, Influenza virus
WSSTSCHDGK

SEQ ID NO: 383230 - protein, 10 aa, Influenza virus
SSTSCHDGKS

SEQ ID NO: 383231 - protein, 10 aa, Influenza virus
STSCHDGKSR

SEQ ID NO: 383232 - protein, 10 aa, Influenza virus
TSCHDGKSRM

SEQ ID NO: 383233 - protein, 10 aa, Influenza virus
SCHDGKSRMS

SEQ ID NO: 383234 - protein, 10 aa, Influenza virus
MSICVSGPNN

SEQ ID NO: 383235 - protein, 10 aa, Influenza virus
SICVSGPNNN

SEQ ID NO: 383236 - protein, 10 aa, Influenza virus
TEIPSWAGNV

SEQ ID NO: 383237 - protein, 10 aa, Influenza virus
VCHKGVCPVI

SEQ ID NO: 383238 - protein, 10 aa, Influenza virus
GANRPVIIIN

SEQ ID NO: 383239 - protein, 10 aa, Influenza virus
MTHISKYLCS

SEQ ID NO: 383240 - protein, 10 aa, Influenza virus
YLCSKTLTDT

SEQ ID NO: 383241 - protein, 10 aa, Influenza virus
LCSKTLTDTS

SEQ ID NO: 383242 - protein, 10 aa, Influenza virus
CSKTLTDTSR

SEQ ID NO: 383243 - protein, 10 aa, Influenza virus
SKTLTDTSRP

SEQ ID NO: 383244 - protein, 10 aa, Influenza virus
GIKGFAFLDG

SEQ ID NO: 383245 - protein, 10 aa, Influenza virus
DTRSGYEMLK

SEQ ID NO: 383246 - protein, 10 aa, Influenza virus
TRSGYEMLKV

SEQ ID NO: 383247 - protein, 10 aa, Influenza virus
SGYEMLKVPD

SEQ ID NO: 383248 - protein, 10 aa, Influenza virus
GYEMLKVPDA

SEQ ID NO: 383249 - protein, 10 aa, Influenza virus
YEMLKVPDAE

SEQ ID NO: 383250 - protein, 10 aa, Influenza virus
NWSGYSGAFV

SEQ ID NO: 383251 - protein, 10 aa, Influenza virus
ELVRGRPKES

SEQ ID NO: 383252 - protein, 10 aa, Influenza virus
MNPNQNLFTL

SEQ ID NO: 383253 - protein, 10 aa, Influenza virus
PKSKLFTLSG

SEQ ID NO: 383254 - protein, 10 aa, Influenza virus
NQKLFALSEV

SEQ ID NO: 383255 - protein, 10 aa, Influenza virus
NLLIGISNVV

SEQ ID NO: 383256 - protein, 10 aa, Influenza virus
LLIGISNVVL

SEQ ID NO: 383257 - protein, 10 aa, Influenza virus
LIGISNVVLN

SEQ ID NO: 383258 - protein, 10 aa, Influenza virus
SNIGLNVSLH

SEQ ID NO: 383259 - protein, 10 aa, Influenza virus
NVGLNISLHL

SEQ ID NO: 383260 - protein, 10 aa, Influenza virus
ENTYVNKTTV

SEQ ID NO: 383261 - protein, 10 aa, Influenza virus
NKYVNNTTII

SEQ ID NO: 383262 - protein, 10 aa, Influenza virus
YLMLSKSLCK

SEQ ID NO: 383263 - protein, 10 aa, Influenza virus
LMLSKSLCKV

SEQ ID NO: 383264 - protein, 10 aa, Influenza virus
WVVVAKDNAV

SEQ ID NO: 383265 - protein, 10 aa, Influenza virus
VVVAKDNAVR

SEQ ID NO: 383266 - protein, 10 aa, Influenza virus
VIAQDNAIRF

SEQ ID NO: 383267 - protein, 10 aa, Influenza virus
HSNGTIHDRA

SEQ ID NO: 383268 - protein, 10 aa, Influenza virus
TINDRTAFRG

SEQ ID NO: 383269 - protein, 10 aa, Influenza virus
INDRTAFRGL

SEQ ID NO: 383270 - protein, 10 aa, Influenza virus
DGTAFRGLIS

SEQ ID NO: 383271 - protein, 10 aa, Influenza virus
GTAFRGLIST

SEQ ID NO: 383272 - protein, 10 aa, Influenza virus
TFRGLISTPL

SEQ ID NO: 383273 - protein, 10 aa, Influenza virus
SNSEFLCVGW

SEQ ID NO: 383274 - protein, 10 aa, Influenza virus
NSEFLCVGWS

SEQ ID NO: 383275 - protein, 10 aa, Influenza virus
SEFLCVGWSS

SEQ ID NO: 383276 - protein, 10 aa, Influenza virus
EFLCVGWSST

SEQ ID NO: 383277 - protein, 10 aa, Influenza virus
CHDGIARMTI

SEQ ID NO: 383278 - protein, 10 aa, Influenza virus
HDGVNRMTIC

SEQ ID NO: 383279 - protein, 10 aa, Influenza virus
QGNNKNATAT

SEQ ID NO: 383280 - protein, 10 aa, Influenza virus
GNNKNATATV

SEQ ID NO: 383281 - protein, 10 aa, Influenza virus
NNKNATATVY

SEQ ID NO: 383282 - protein, 10 aa, Influenza virus
KNATATVYYD

SEQ ID NO: 383283 - protein, 10 aa, Influenza virus
YYERRLTTTI

SEQ ID NO: 383284 - protein, 10 aa, Influenza virus
RRLTTTVKTW

SEQ ID NO: 383285 - protein, 10 aa, Influenza virus
PTTTIKTWAR

SEQ ID NO: 383286 - protein, 10 aa, Influenza virus
TTTIKPWARN

SEQ ID NO: 383287 - protein, 10 aa, Influenza virus
TTIKPWARNI

SEQ ID NO: 383288 - protein, 10 aa, Influenza virus
TIKPWARNIL

SEQ ID NO: 383289 - protein, 10 aa, Influenza virus
IKPWARNILR

SEQ ID NO: 383290 - protein, 10 aa, Influenza virus
KPWARNILRT

SEQ ID NO: 383291 - protein, 10 aa, Influenza virus
PWARNILRTQ

SEQ ID NO: 383292 - protein, 10 aa, Influenza virus
ECVSHNGTWA

SEQ ID NO: 383293 - protein, 10 aa, Influenza virus
GTCVAVMTDG

SEQ ID NO: 383294 - protein, 10 aa, Influenza virus
MTDGSASSRA

SEQ ID NO: 383295 - protein, 10 aa, Influenza virus
KGSARHIEEW

SEQ ID NO: 383296 - protein, 10 aa, Influenza virus
KVSCVCRDNW

SEQ ID NO: 383297 - protein, 10 aa, Influenza virus
VTCVCRDNWR

SEQ ID NO: 383298 - protein, 10 aa, Influenza virus
GILTDTSRPS

SEQ ID NO: 383299 - protein, 10 aa, Influenza virus
ILTDTSRPSD

SEQ ID NO: 383300 - protein, 10 aa, Influenza virus
LTDTSRPSDR

SEQ ID NO: 383301 - protein, 10 aa, Influenza virus
CSNPITGSPC

SEQ ID NO: 383302 - protein, 10 aa, Influenza virus
DNTWLGGTIS

SEQ ID NO: 383303 - protein, 10 aa, Influenza virus
WLGRTISPHS

SEQ ID NO: 383304 - protein, 10 aa, Influenza virus
LGRTISTRSR

SEQ ID NO: 383305 - protein, 10 aa, Influenza virus
TISPHSRSGF

SEQ ID NO: 383306 - protein, 10 aa, Influenza virus
FSPRSRSGFE

SEQ ID NO: 383307 - protein, 10 aa, Influenza virus
SPRSRNGFEM

SEQ ID NO: 383308 - protein, 10 aa, Influenza virus
PRSRNGFEML

SEQ ID NO: 383309 - protein, 10 aa, Influenza virus
HSRSGFEMLK

SEQ ID NO: 383310 - protein, 10 aa, Influenza virus
FEMLKIHNAG

SEQ ID NO: 383311 - protein, 10 aa, Influenza virus
LKVPNAGTDP

SEQ ID NO: 383312 - protein, 10 aa, Influenza virus
SKCYNPCFYV

SEQ ID NO: 383313 - protein, 10 aa, Influenza virus
SLIALCGSPV

SEQ ID NO: 383314 - protein, 10 aa, Influenza virus
GSGSLPDGAQ

SEQ ID NO: 383315 - protein, 10 aa, Influenza virus
SGSLPDGAQI

SEQ ID NO: 383316 - protein, 10 aa, Influenza virus
GSFPDGAKIQ

SEQ ID NO: 383317 - protein, 10 aa, Influenza virus
FFPDGPQIQY

SEQ ID NO: 383318 - protein, 10 aa, Influenza virus
LPDGAQIQYF

SEQ ID NO: 383319 - protein, 10 aa, Influenza virus
KHSSGTVKDR

SEQ ID NO: 383320 - protein, 10 aa, Influenza virus
SPFRTLMSVK

SEQ ID NO: 383321 - protein, 10 aa, Influenza virus
RTLMSVGIGQ

SEQ ID NO: 383322 - protein, 10 aa, Influenza virus
IGLSPNVYQA

SEQ ID NO: 383323 - protein, 10 aa, Influenza virus
PNVYQAKFEA

SEQ ID NO: 383324 - protein, 10 aa, Influenza virus
NVYQAKFEAV

SEQ ID NO: 383325 - protein, 10 aa, Influenza virus
VYQAKFEAVA

SEQ ID NO: 383326 - protein, 10 aa, Influenza virus
YQAKFEAVAW

SEQ ID NO: 383327 - protein, 10 aa, Influenza virus
QAKFEAVAWS

SEQ ID NO: 383328 - protein, 10 aa, Influenza virus
AKFEAVAWSA

SEQ ID NO: 383329 - protein, 10 aa, Influenza virus
ACHDGKKWTT

SEQ ID NO: 383330 - protein, 10 aa, Influenza virus
GDILRTQDSS

SEQ ID NO: 383331 - protein, 10 aa, Influenza virus
FTEGHIEECS

SEQ ID NO: 383332 - protein, 10 aa, Influenza virus
TEGHIEECSC

SEQ ID NO: 383333 - protein, 10 aa, Influenza virus
KGTNRPVLVI

SEQ ID NO: 383334 - protein, 10 aa, Influenza virus
LSYSVGYLCA

SEQ ID NO: 383335 - protein, 10 aa, Influenza virus
SYSVGYLCAG

SEQ ID NO: 383336 - protein, 10 aa, Influenza virus
PSDTPRGEDG

SEQ ID NO: 383337 - protein, 10 aa, Influenza virus
SDTPRGEDGQ

SEQ ID NO: 383338 - protein, 10 aa, Influenza virus
ECLVPCFWVE

SEQ ID NO: 383339 - protein, 10 aa, Influenza virus
SSIVMCGVEH

SEQ ID NO: 383340 - protein, 10 aa, Influenza virus
ANWSWHDGAI

SEQ ID NO: 383341 - protein, 10 aa, Influenza virus
NWSWHDGAIL

SEQ ID NO: 383342 - protein, 10 aa, Influenza virus
NQKIQCTSAT

SEQ ID NO: 383343 - protein, 10 aa, Influenza virus
QTIINNYYND

SEQ ID NO: 383344 - protein, 10 aa, Influenza virus
TIINNYYNDT

SEQ ID NO: 383345 - protein, 10 aa, Influenza virus
IINNYYNDTN

SEQ ID NO: 383346 - protein, 10 aa, Influenza virus
FNNLTKELCT

SEQ ID NO: 383347 - protein, 10 aa, Influenza virus
NNLTKGLCII

SEQ ID NO: 383348 - protein, 10 aa, Influenza virus
NLTRGLCKIN

SEQ ID NO: 383349 - protein, 10 aa, Influenza virus
LTRGLCKINS

SEQ ID NO: 383350 - protein, 10 aa, Influenza virus
TRGLCKINSW

SEQ ID NO: 383351 - protein, 10 aa, Influenza virus
RGLCKINSWH

SEQ ID NO: 383352 - protein, 10 aa, Influenza virus
KDNAVRIGEK

SEQ ID NO: 383353 - protein, 10 aa, Influenza virus
DNAVRIGESS

SEQ ID NO: 383354 - protein, 10 aa, Influenza virus
RIGEKSDVLV

SEQ ID NO: 383355 - protein, 10 aa, Influenza virus
IGENSGVLVT

SEQ ID NO: 383356 - protein, 10 aa, Influenza virus
GESSDVLVTR

SEQ ID NO: 383357 - protein, 10 aa, Influenza virus
ESSDVLVTRE

SEQ ID NO: 383358 - protein, 10 aa, Influenza virus
SSDVLVTREP

SEQ ID NO: 383359 - protein, 10 aa, Influenza virus
SSPPTVYSSR

SEQ ID NO: 383360 - protein, 10 aa, Influenza virus
SSTSCHDGKT

SEQ ID NO: 383361 - protein, 10 aa, Influenza virus
STSCHDGKTR

SEQ ID NO: 383362 - protein, 10 aa, Influenza virus
TSCHDGKTRM

SEQ ID NO: 383363 - protein, 10 aa, Influenza virus
NNASTVIWYN

SEQ ID NO: 383364 - protein, 10 aa, Influenza virus
GRPTTEINTW

SEQ ID NO: 383365 - protein, 10 aa, Influenza virus
VCHSGVCPVV

SEQ ID NO: 383366 - protein, 10 aa, Influenza virus
CHDGVCPVVF

SEQ ID NO: 383367 - protein, 10 aa, Influenza virus
QNGVCPVVFT

SEQ ID NO: 383368 - protein, 10 aa, Influenza virus
AMKHTSQYIC

SEQ ID NO: 383369 - protein, 10 aa, Influenza virus
TDNPRPNDPS

SEQ ID NO: 383370 - protein, 10 aa, Influenza virus
NDPYPGNNNK

SEQ ID NO: 383371 - protein, 10 aa, Influenza virus
DPYPGNNNKG

SEQ ID NO: 383372 - protein, 10 aa, Influenza virus
GRTISTASRA

SEQ ID NO: 383373 - protein, 10 aa, Influenza virus
RTISTASRYG

SEQ ID NO: 383374 - protein, 10 aa, Influenza virus
TLNTASRSGY

SEQ ID NO: 383375 - protein, 10 aa, Influenza virus
INTASRSGYE

SEQ ID NO: 383376 - protein, 10 aa, Influenza virus
STASRSGYEV

SEQ ID NO: 383377 - protein, 10 aa, Influenza virus
KVPNALTDER

SEQ ID NO: 383378 - protein, 10 aa, Influenza virus
PNALTDDRST

SEQ ID NO: 383379 - protein, 10 aa, Influenza virus
NALTDERSKP

SEQ ID NO: 383380 - protein, 10 aa, Influenza virus
GSFIDYWAKE

SEQ ID NO: 383381 - protein, 10 aa, Influenza virus
DYWAKEECYR

SEQ ID NO: 383382 - protein, 10 aa, Influenza virus
YWAKEECYRA

SEQ ID NO: 383383 - protein, 10 aa, Influenza virus
WAKEECYRAC

SEQ ID NO: 383384 - protein, 10 aa, Influenza virus
AKEECYRACF

SEQ ID NO: 383385 - protein, 10 aa, Influenza virus
KEECYRACFY

SEQ ID NO: 383386 - protein, 10 aa, Influenza virus
KICLGHHAVT

SEQ ID NO: 383387 - protein, 10 aa, Influenza virus
KEEVINATET

SEQ ID NO: 383388 - protein, 10 aa, Influenza virus
RDLGNCHPIG

SEQ ID NO: 383389 - protein, 10 aa, Influenza virus
DLGNCHPIGI

SEQ ID NO: 383390 - protein, 10 aa, Influenza virus
RNFPQTTNTY

SEQ ID NO: 383391 - protein, 10 aa, Influenza virus
GAQSLSISVG

SEQ ID NO: 383392 - protein, 10 aa, Influenza virus
TQPLSISVGS

SEQ ID NO: 383393 - protein, 10 aa, Influenza virus
ISVGSSIYQN

SEQ ID NO: 383394 - protein, 10 aa, Influenza virus
VGSSTYQSNF

SEQ ID NO: 383395 - protein, 10 aa, Influenza virus
TYQSNFVPVV

SEQ ID NO: 383396 - protein, 10 aa, Influenza virus
YQNNFVPVMG

SEQ ID NO: 383397 - protein, 10 aa, Influenza virus
NNFVPVMGAR

SEQ ID NO: 383398 - protein, 10 aa, Influenza virus
NFVPVVRARP

SEQ ID NO: 383399 - protein, 10 aa, Influenza virus
FVPVVGDRPL

SEQ ID NO: 383400 - protein, 10 aa, Influenza virus
VPVVGARPLV

SEQ ID NO: 383401 - protein, 10 aa, Influenza virus
PVVGARPKVN

SEQ ID NO: 383402 - protein, 10 aa, Influenza virus
VVGDRPLVNG

SEQ ID NO: 383403 - protein, 10 aa, Influenza virus
VGARPLVNGQ

SEQ ID NO: 383404 - protein, 10 aa, Influenza virus
VNGQSGRIVF

SEQ ID NO: 383405 - protein, 10 aa, Influenza virus
NGQSGRIVFH

SEQ ID NO: 383406 - protein, 10 aa, Influenza virus
GQSGRINFHW

SEQ ID NO: 383407 - protein, 10 aa, Influenza virus
PGHNITFSHN

SEQ ID NO: 383408 - protein, 10 aa, Influenza virus
GDNITFSDNG

SEQ ID NO: 383409 - protein, 10 aa, Influenza virus
DNIIFSHNGG

SEQ ID NO: 383410 - protein, 10 aa, Influenza virus
NIIFSHNGGL

SEQ ID NO: 383411 - protein, 10 aa, Influenza virus
DNGGLIAPSR

SEQ ID NO: 383412 - protein, 10 aa, Influenza virus
KCFWKGGTIN

SEQ ID NO: 383413 - protein, 10 aa, Influenza virus
CFWKSGSINT

SEQ ID NO: 383414 - protein, 10 aa, Influenza virus
GGTINTKLPF

SEQ ID NO: 383415 - protein, 10 aa, Influenza virus
GSLLLATGMR

SEQ ID NO: 383416 - protein, 10 aa, Influenza virus
ADYESTQAAI

SEQ ID NO: 383417 - protein, 10 aa, Influenza virus
AIVQITGKLN

SEQ ID NO: 383418 - protein, 10 aa, Influenza virus
IVQITGKLNR

SEQ ID NO: 383419 - protein, 10 aa, Influenza virus
EFSEIEHQIS

SEQ ID NO: 383420 - protein, 10 aa, Influenza virus
FNEIEYQIGN

SEQ ID NO: 383421 - protein, 10 aa, Influenza virus
SEIEHQISNV

SEQ ID NO: 383422 - protein, 10 aa, Influenza virus
PCMESIRNNT

SEQ ID NO: 383423 - protein, 10 aa, Influenza virus
IRNNTYNHTQ

SEQ ID NO: 383424 - protein, 10 aa, Influenza virus
RNNTYDHSHY

SEQ ID NO: 383425 - protein, 10 aa, Influenza virus
NNTYNHTQYR

SEQ ID NO: 383426 - protein, 10 aa, Influenza virus
NTYNHTQYRE

SEQ ID NO: 383427 - protein, 10 aa, Influenza virus
TYNHTQYREE

SEQ ID NO: 383428 - protein, 10 aa, Influenza virus
HTQYREESLL

SEQ ID NO: 383429 - protein, 10 aa, Influenza virus
ALLNRININP

SEQ ID NO: 383430 - protein, 10 aa, Influenza virus
INPVRLSSGY

SEQ ID NO: 383431 - protein, 10 aa, Influenza virus
NSVKLFSGYK

SEQ ID NO: 383432 - protein, 10 aa, Influenza virus
KICLGHHAIP

SEQ ID NO: 383433 - protein, 10 aa, Influenza virus
GHHAVANGTV

SEQ ID NO: 383434 - protein, 10 aa, Influenza virus
TNGTIVKTLT

SEQ ID NO: 383435 - protein, 10 aa, Influenza virus
TIIKTLTNEK

SEQ ID NO: 383436 - protein, 10 aa, Influenza virus
IVKTLTNERE

SEQ ID NO: 383437 - protein, 10 aa, Influenza virus
KTLTNEKEKV

SEQ ID NO: 383438 - protein, 10 aa, Influenza virus
EHEEVTNATE

SEQ ID NO: 383439 - protein, 10 aa, Influenza virus
KEEVINATET

SEQ ID NO: 383440 - protein, 10 aa, Influenza virus
RDLGNCHPIG

SEQ ID NO: 383441 - protein, 10 aa, Influenza virus
GAPSCDLHLT

SEQ ID NO: 383442 - protein, 10 aa, Influenza virus
APSCDLHLTG

SEQ ID NO: 383443 - protein, 10 aa, Influenza virus
CDLHLTGKWD

SEQ ID NO: 383444 - protein, 10 aa, Influenza virus
DLHLTGMWDT

SEQ ID NO: 383445 - protein, 10 aa, Influenza virus
LHLTGKWDTL

SEQ ID NO: 383446 - protein, 10 aa, Influenza virus
GMWDTLIERD

SEQ ID NO: 383447 - protein, 10 aa, Influenza virus
IWDTLIERDN

SEQ ID NO: 383448 - protein, 10 aa, Influenza virus
WDTLIERGSS

SEQ ID NO: 383449 - protein, 10 aa, Influenza virus
ANCYPGATVN

SEQ ID NO: 383450 - protein, 10 aa, Influenza virus
YCYPGATMNE

SEQ ID NO: 383451 - protein, 10 aa, Influenza virus
CYPGSTVNEE

SEQ ID NO: 383452 - protein, 10 aa, Influenza virus
YPGATVNEGA

SEQ ID NO: 383453 - protein, 10 aa, Influenza virus
PGSTVNEEAL

SEQ ID NO: 383454 - protein, 10 aa, Influenza virus
GSTVNEEALR

SEQ ID NO: 383455 - protein, 10 aa, Influenza virus
ATVNEGALRQ

SEQ ID NO: 383456 - protein, 10 aa, Influenza virus
MESGGIDKVS

SEQ ID NO: 383457 - protein, 10 aa, Influenza virus
ESGGIDKVST

SEQ ID NO: 383458 - protein, 10 aa, Influenza virus
AELKWLVSKD

SEQ ID NO: 383459 - protein, 10 aa, Influenza virus
ELKWLVSKDK

SEQ ID NO: 383460 - protein, 10 aa, Influenza virus
LKWLVSKDKG

SEQ ID NO: 383461 - protein, 10 aa, Influenza virus
KWLVSKDKGR

SEQ ID NO: 383462 - protein, 10 aa, Influenza virus
RNFPQTTNTY

SEQ ID NO: 383463 - protein, 10 aa, Influenza virus
EHLVMWGIHH

SEQ ID NO: 383464 - protein, 10 aa, Influenza virus
HLVMWGIHHP

SEQ ID NO: 383465 - protein, 10 aa, Influenza virus
LVMWGIHHPS

SEQ ID NO: 383466 - protein, 10 aa, Influenza virus
HPSSTQEKNA

SEQ ID NO: 383467 - protein, 10 aa, Influenza virus
PSSTQERNDL

SEQ ID NO: 383468 - protein, 10 aa, Influenza virus
SSTQERNDLY

SEQ ID NO: 383469 - protein, 10 aa, Influenza virus
STQEKNALYG

SEQ ID NO: 383470 - protein, 10 aa, Influenza virus
QEKNDLYGAQ

SEQ ID NO: 383471 - protein, 10 aa, Influenza virus
ERNDLYGTQS

SEQ ID NO: 383472 - protein, 10 aa, Influenza virus
KNALYGTQSL

SEQ ID NO: 383473 - protein, 10 aa, Influenza virus
SVGSSIYQNS

SEQ ID NO: 383474 - protein, 10 aa, Influenza virus
VGSSTYHNSF

SEQ ID NO: 383475 - protein, 10 aa, Influenza virus
APSRVSKLIG

SEQ ID NO: 383476 - protein, 10 aa, Influenza virus
GSLLLATGMR

SEQ ID NO: 383477 - protein, 10 aa, Influenza virus
KSTQAAIDQM

SEQ ID NO: 383478 - protein, 10 aa, Influenza virus
GKGCFEIYHN

SEQ ID NO: 383479 - protein, 10 aa, Influenza virus
KGCFEIYHNC

SEQ ID NO: 383480 - protein, 10 aa, Influenza virus
GCFEIYHRCD

SEQ ID NO: 383481 - protein, 10 aa, Influenza virus
CDDNCMERIR

SEQ ID NO: 383482 - protein, 10 aa, Influenza virus
DNCMERIRNN

SEQ ID NO: 383483 - protein, 10 aa, Influenza virus
LNRLNINPVR

SEQ ID NO: 383484 - protein, 10 aa, Influenza virus
NRLNINPVRL

SEQ ID NO: 383485 - protein, 10 aa, Influenza virus
GASCFVLLAI

SEQ ID NO: 383486 - protein, 10 aa, Influenza virus
IVGLVFFCLK

SEQ ID NO: 383487 - protein, 10 aa, Influenza virus
LFALSGMAIA

SEQ ID NO: 383488 - protein, 10 aa, Influenza virus
FALSGVAITL

SEQ ID NO: 383489 - protein, 10 aa, Influenza virus
EKGPKQEENL

SEQ ID NO: 383490 - protein, 10 aa, Influenza virus
YVNNTTIISK

SEQ ID NO: 383491 - protein, 10 aa, Influenza virus
YLMLSKSLCK

SEQ ID NO: 383492 - protein, 10 aa, Influenza virus
LMLSKSLCKV

SEQ ID NO: 383493 - protein, 10 aa, Influenza virus
MLSKSLCKVE

SEQ ID NO: 383494 - protein, 10 aa, Influenza virus
LNKRLCKVEG

SEQ ID NO: 383495 - protein, 10 aa, Influenza virus
NKSLCKVEEW

SEQ ID NO: 383496 - protein, 10 aa, Influenza virus
VSCDPLGCKT

SEQ ID NO: 383497 - protein, 10 aa, Influenza virus
SCDPLGCKTY

SEQ ID NO: 383498 - protein, 10 aa, Influenza virus
CDPLGCKTYA

SEQ ID NO: 383499 - protein, 10 aa, Influenza virus
DPLGCKTYAL

SEQ ID NO: 383500 - protein, 10 aa, Influenza virus
PLGCKTYALH

SEQ ID NO: 383501 - protein, 10 aa, Influenza virus
LGCKTYALHQ

SEQ ID NO: 383502 - protein, 10 aa, Influenza virus
MSTPLGTPPT

SEQ ID NO: 383503 - protein, 10 aa, Influenza virus
GSPPMVSNSD

SEQ ID NO: 383504 - protein, 10 aa, Influenza virus
SPPMVSNSDF

SEQ ID NO: 383505 - protein, 10 aa, Influenza virus
MTICVQGKND

SEQ ID NO: 383506 - protein, 10 aa, Influenza virus
IICIQGNNDN

SEQ ID NO: 383507 - protein, 10 aa, Influenza virus
NRRPTTTIKT

SEQ ID NO: 383508 - protein, 10 aa, Influenza virus
VVIMTDGPAN

SEQ ID NO: 383509 - protein, 10 aa, Influenza virus
VIMTDGPANS

SEQ ID NO: 383510 - protein, 10 aa, Influenza virus
VMTDGSASGQ

SEQ ID NO: 383511 - protein, 10 aa, Influenza virus
TDGSANSQAY

SEQ ID NO: 383512 - protein, 10 aa, Influenza virus
DGPANSQAYT

SEQ ID NO: 383513 - protein, 10 aa, Influenza virus
GPASSQAYTK

SEQ ID NO: 383514 - protein, 10 aa, Influenza virus
QAYTKILYFH

SEQ ID NO: 383515 - protein, 10 aa, Influenza virus
AHTKILYFHK

SEQ ID NO: 383516 - protein, 10 aa, Influenza virus
YTKILYFHKG

SEQ ID NO: 383517 - protein, 10 aa, Influenza virus
TKILYFHKGL

SEQ ID NO: 383518 - protein, 10 aa, Influenza virus
YFHKGLLIKE

SEQ ID NO: 383519 - protein, 10 aa, Influenza virus
FHKGLLIKEE

SEQ ID NO: 383520 - protein, 10 aa, Influenza virus
KEEALQGSAR

SEQ ID NO: 383521 - protein, 10 aa, Influenza virus
EEVLKGSARH

SEQ ID NO: 383522 - protein, 10 aa, Influenza virus
CYGHSQKATC

SEQ ID NO: 383523 - protein, 10 aa, Influenza virus
GANRPIIEIN

SEQ ID NO: 383524 - protein, 10 aa, Influenza virus
ANRPIIEINM

SEQ ID NO: 383525 - protein, 10 aa, Influenza virus
AMKHTSQYLC

SEQ ID NO: 383526 - protein, 10 aa, Influenza virus
KIPNAGIDPN

SEQ ID NO: 383527 - protein, 10 aa, Influenza virus
IPNAGIDPNS

SEQ ID NO: 383528 - protein, 10 aa, Influenza virus
NRNWSGYSGS

SEQ ID NO: 383529 - protein, 10 aa, Influenza virus
SDWSGYSGSF

SEQ ID NO: 383530 - protein, 10 aa, Influenza virus
SKCYNPCFYV

SEQ ID NO: 383531 - protein, 10 aa, Influenza virus
LIALCGSPFS

SEQ ID NO: 383532 - protein, 10 aa, Influenza virus
IALCGSPISV

SEQ ID NO: 383533 - protein, 10 aa, Influenza virus
FSVGSGSFPD

SEQ ID NO: 383534 - protein, 10 aa, Influenza virus
MSNNSTEKVD

SEQ ID NO: 383535 - protein, 10 aa, Influenza virus
TEKVDTIIEN

SEQ ID NO: 383536 - protein, 10 aa, Influenza virus
EKVNTIIESN

SEQ ID NO: 383537 - protein, 10 aa, Influenza virus
KVNTIIESNV

SEQ ID NO: 383538 - protein, 10 aa, Influenza virus
FCSINGKEPI

SEQ ID NO: 383539 - protein, 10 aa, Influenza virus
CSLDGKAPIS

SEQ ID NO: 383540 - protein, 10 aa, Influenza virus
SLDGKAPISL

SEQ ID NO: 383541 - protein, 10 aa, Influenza virus
LDGKAPISLG

SEQ ID NO: 383542 - protein, 10 aa, Influenza virus
DGKAPISLGG

SEQ ID NO: 383543 - protein, 10 aa, Influenza virus
WILGNPMCDY

SEQ ID NO: 383544 - protein, 10 aa, Influenza virus
ILGNPMCDNL

SEQ ID NO: 383545 - protein, 10 aa, Influenza virus
LGNPMCDYLI

SEQ ID NO: 383546 - protein, 10 aa, Influenza virus
GNPMCDYLIG

SEQ ID NO: 383547 - protein, 10 aa, Influenza virus
NPMCDYLIGK

SEQ ID NO: 383548 - protein, 10 aa, Influenza virus
CDDLIGKNSW

SEQ ID NO: 383549 - protein, 10 aa, Influenza virus
DDLIEKTSWS

SEQ ID NO: 383550 - protein, 10 aa, Influenza virus
DLIGKNSWSY

SEQ ID NO: 383551 - protein, 10 aa, Influenza virus
TSWSYIVEKL

SEQ ID NO: 383552 - protein, 10 aa, Influenza virus
SFFRNMVWLV

SEQ ID NO: 383553 - protein, 10 aa, Influenza virus
WLIDQSGTYP

SEQ ID NO: 383554 - protein, 10 aa, Influenza virus
FNNIKGRDVL

SEQ ID NO: 383555 - protein, 10 aa, Influenza virus
AGRMTFYWII

SEQ ID NO: 383556 - protein, 10 aa, Influenza virus
GRMTFYWTII

SEQ ID NO: 383557 - protein, 10 aa, Influenza virus
IFESNGAFLA

SEQ ID NO: 383558 - protein, 10 aa, Influenza virus
ESNGVFLAPR

SEQ ID NO: 383559 - protein, 10 aa, Influenza virus
SNGVFLAPRY

SEQ ID NO: 383560 - protein, 10 aa, Influenza virus
LAPRYSFELV

SEQ ID NO: 383561 - protein, 10 aa, Influenza virus
APGYAFEIVS

SEQ ID NO: 383562 - protein, 10 aa, Influenza virus
CQSEIGGIST

SEQ ID NO: 383563 - protein, 10 aa, Influenza virus
NVHRNAIGDC

SEQ ID NO: 383564 - protein, 10 aa, Influenza virus
STIGDCPKYV

SEQ ID NO: 383565 - protein, 10 aa, Influenza virus
NVKSLKLAIG

SEQ ID NO: 383566 - protein, 10 aa, Influenza virus
KSLKLVTGLR

SEQ ID NO: 383567 - protein, 10 aa, Influenza virus
LKLVTGLRNV

SEQ ID NO: 383568 - protein, 10 aa, Influenza virus
KLAIGPRNVP

SEQ ID NO: 383569 - protein, 10 aa, Influenza virus
LVTGLRNVPA

SEQ ID NO: 383570 - protein, 10 aa, Influenza virus
IAADKESTQR

SEQ ID NO: 383571 - protein, 10 aa, Influenza virus
AADKESTQKT

SEQ ID NO: 383572 - protein, 10 aa, Influenza virus
LKNNAKDEGN

SEQ ID NO: 383573 - protein, 10 aa, Influenza virus
KNNAKDEGNG

SEQ ID NO: 383574 - protein, 10 aa, Influenza virus
FYHKCDNGCI

SEQ ID NO: 383575 - protein, 10 aa, Influenza virus
YHKCDNGCIE

SEQ ID NO: 383576 - protein, 10 aa, Influenza virus
NECIEKIRNG

SEQ ID NO: 383577 - protein, 10 aa, Influenza virus
DHKDFEEESK

SEQ ID NO: 383578 - protein, 10 aa, Influenza virus
ESKLNRQEIG

SEQ ID NO: 383579 - protein, 10 aa, Influenza virus
SKLNRQEIGG

SEQ ID NO: 383580 - protein, 10 aa, Influenza virus
INRQEIEGAR

SEQ ID NO: 383581 - protein, 10 aa, Influenza virus
RQEVEGVKLD

SEQ ID NO: 383582 - protein, 10 aa, Influenza virus
IASSLVLAAS

SEQ ID NO: 383583 - protein, 10 aa, Influenza virus
ASSLVLAALN

SEQ ID NO: 383584 - protein, 10 aa, Influenza virus
SSLILAALIM

SEQ ID NO: 383585 - protein, 10 aa, Influenza virus
SLVLAALNMG

SEQ ID NO: 383586 - protein, 10 aa, Influenza virus
WVCSNGSCRC

SEQ ID NO: 383587 - protein, 10 aa, Influenza virus
ACGNGSCRCT

SEQ ID NO: 383588 - protein, 10 aa, Influenza virus
NSTDTVNTLT

SEQ ID NO: 383589 - protein, 10 aa, Influenza virus
STDTVNTLTE

SEQ ID NO: 383590 - protein, 10 aa, Influenza virus
TDTVNTLTEQ

SEQ ID NO: 383591 - protein, 10 aa, Influenza virus
DTVNTLTEQN

SEQ ID NO: 383592 - protein, 10 aa, Influenza virus
VEELVHGGIN

SEQ ID NO: 383593 - protein, 10 aa, Influenza virus
EELVHRGIDP

SEQ ID NO: 383594 - protein, 10 aa, Influenza virus
DCSLEGLILS

SEQ ID NO: 383595 - protein, 10 aa, Influenza virus
CSLKGLILGN

SEQ ID NO: 383596 - protein, 10 aa, Influenza virus
SLEGLILSNP

SEQ ID NO: 383597 - protein, 10 aa, Influenza virus
LEGLVLGNPK

SEQ ID NO: 383598 - protein, 10 aa, Influenza virus
EGLILSNPKC

SEQ ID NO: 383599 - protein, 10 aa, Influenza virus
LVLGNPKCDL

SEQ ID NO: 383600 - protein, 10 aa, Influenza virus
SIENQEELKS

SEQ ID NO: 383601 - protein, 10 aa, Influenza virus
IENQEELKSL

SEQ ID NO: 383602 - protein, 10 aa, Influenza virus
IKWNVTYTGT

SEQ ID NO: 383603 - protein, 10 aa, Influenza virus
TSNQDSFYRS

SEQ ID NO: 383604 - protein, 10 aa, Influenza virus
SNQDSFYRSM

SEQ ID NO: 383605 - protein, 10 aa, Influenza virus
NQDSFYRSMK

SEQ ID NO: 383606 - protein, 10 aa, Influenza virus
QDSFYRSMKW

SEQ ID NO: 383607 - protein, 10 aa, Influenza virus
RSMKWLTLKS

SEQ ID NO: 383608 - protein, 10 aa, Influenza virus
MKWLTLKSGQ

SEQ ID NO: 383609 - protein, 10 aa, Influenza virus
HHPPTSAEQV

SEQ ID NO: 383610 - protein, 10 aa, Influenza virus
EIDRSFRPNI

SEQ ID NO: 383611 - protein, 10 aa, Influenza virus
INRNFKPNIG

SEQ ID NO: 383612 - protein, 10 aa, Influenza virus
NRNFKPNIGP

SEQ ID NO: 383613 - protein, 10 aa, Influenza virus
NIGPRPLVMG

SEQ ID NO: 383614 - protein, 10 aa, Influenza virus
IGPRPLIRGQ

SEQ ID NO: 383615 - protein, 10 aa, Influenza virus
GPRPLIRGQQ

SEQ ID NO: 383616 - protein, 10 aa, Influenza virus
PRPLIRGQQG

SEQ ID NO: 383617 - protein, 10 aa, Influenza virus
RPLVMGQQGR

SEQ ID NO: 383618 - protein, 10 aa, Influenza virus
PLVMGQQGRM

SEQ ID NO: 383619 - protein, 10 aa, Influenza virus
LVMGQQGRMD

SEQ ID NO: 383620 - protein, 10 aa, Influenza virus
TECQLNEGIM

SEQ ID NO: 383621 - protein, 10 aa, Influenza virus
ECQLNEGIMN

SEQ ID NO: 383622 - protein, 10 aa, Influenza virus
GKCPKYIPSR

SEQ ID NO: 383623 - protein, 10 aa, Influenza virus
KCPKYIPSRS

SEQ ID NO: 383624 - protein, 10 aa, Influenza virus
CPKYIPSRSL

SEQ ID NO: 383625 - protein, 10 aa, Influenza virus
PKYIPSRSLK

SEQ ID NO: 383626 - protein, 10 aa, Influenza virus
KYIPSRSLKL

SEQ ID NO: 383627 - protein, 10 aa, Influenza virus
AIGLRNVPQI

SEQ ID NO: 383628 - protein, 10 aa, Influenza virus
IGPRNVPQAQ

SEQ ID NO: 383629 - protein, 10 aa, Influenza virus
RNVPQIQNRG

SEQ ID NO: 383630 - protein, 10 aa, Influenza virus
NVPQIQNRGL

SEQ ID NO: 383631 - protein, 10 aa, Influenza virus
VPQIQNRGLF

SEQ ID NO: 383632 - protein, 10 aa, Influenza virus
PQIQNRGLFG

SEQ ID NO: 383633 - protein, 10 aa, Influenza virus
QIQNRGLFGA

SEQ ID NO: 383634 - protein, 10 aa, Influenza virus
HQNAEGIGIA

SEQ ID NO: 383635 - protein, 10 aa, Influenza virus
QNAEGIGIAA

SEQ ID NO: 383636 - protein, 10 aa, Influenza virus
NAEGIGIAAD

SEQ ID NO: 383637 - protein, 10 aa, Influenza virus
AEGIGIAADR

SEQ ID NO: 383638 - protein, 10 aa, Influenza virus
EGIGIAADRD

SEQ ID NO: 383639 - protein, 10 aa, Influenza virus
GTGIVADRDS

SEQ ID NO: 383640 - protein, 10 aa, Influenza virus
TGIVADRDST

SEQ ID NO: 383641 - protein, 10 aa, Influenza virus
AADRGSTQKA

SEQ ID NO: 383642 - protein, 10 aa, Influenza virus
RGSTQKAIDN

SEQ ID NO: 383643 - protein, 10 aa, Influenza virus
GSTQKAIDNM

SEQ ID NO: 383644 - protein, 10 aa, Influenza virus
QKAIDNMQNR

SEQ ID NO: 383645 - protein, 10 aa, Influenza virus
KAIDIMQNKL

SEQ ID NO: 383646 - protein, 10 aa, Influenza virus
EFSEVEIRIN

SEQ ID NO: 383647 - protein, 10 aa, Influenza virus
VEIRINMINS

SEQ ID NO: 383648 - protein, 10 aa, Influenza virus
SRINMINSQI

SEQ ID NO: 383649 - protein, 10 aa, Influenza virus
RINMINSQID

SEQ ID NO: 383650 - protein, 10 aa, Influenza virus
INMINSKIND

SEQ ID NO: 383651 - protein, 10 aa, Influenza virus
NMINSKIEDQ

SEQ ID NO: 383652 - protein, 10 aa, Influenza virus
INDQITDIWA

SEQ ID NO: 383653 - protein, 10 aa, Influenza virus
DDQIIDIWAY

SEQ ID NO: 383654 - protein, 10 aa, Influenza virus
NVRNLHERIR

SEQ ID NO: 383655 - protein, 10 aa, Influenza virus
VRNLHERIRR

SEQ ID NO: 383656 - protein, 10 aa, Influenza virus
ENAIDNGDGC

SEQ ID NO: 383657 - protein, 10 aa, Influenza virus
NAIDNGDGCF

SEQ ID NO: 383658 - protein, 10 aa, Influenza virus
AIDNGDGCFE

SEQ ID NO: 383659 - protein, 10 aa, Influenza virus
IDNGDGCFEI

SEQ ID NO: 383660 - protein, 10 aa, Influenza virus
CFEILHKCND

SEQ ID NO: 383661 - protein, 10 aa, Influenza virus
TIRTGTYNHR

SEQ ID NO: 383662 - protein, 10 aa, Influenza virus
EEESRIERQK

SEQ ID NO: 383663 - protein, 10 aa, Influenza virus
LSTNSSEKVN

SEQ ID NO: 383664 - protein, 10 aa, Influenza virus
STNSSEKVNT

SEQ ID NO: 383665 - protein, 10 aa, Influenza virus
TNSSDKVDTL

SEQ ID NO: 383666 - protein, 10 aa, Influenza virus
NSSDKVDTLL

SEQ ID NO: 383667 - protein, 10 aa, Influenza virus
SSDKVDTLLE

SEQ ID NO: 383668 - protein, 10 aa, Influenza virus
VDTLLESDVP

SEQ ID NO: 383669 - protein, 10 aa, Influenza virus
DTLLESDVPV

SEQ ID NO: 383670 - protein, 10 aa, Influenza virus
LENGVPVTST

SEQ ID NO: 383671 - protein, 10 aa, Influenza virus
VPVTSTIDLI

SEQ ID NO: 383672 - protein, 10 aa, Influenza virus
PVTSTIDLIE

SEQ ID NO: 383673 - protein, 10 aa, Influenza virus
VTSTIDLIET

SEQ ID NO: 383674 - protein, 10 aa, Influenza virus
LIEDPSAPHR

SEQ ID NO: 383675 - protein, 10 aa, Influenza virus
IEDPSAPHRL

SEQ ID NO: 383676 - protein, 10 aa, Influenza virus
EDPSAPHRLC

SEQ ID NO: 383677 - protein, 10 aa, Influenza virus
DPSAPHRLCY

SEQ ID NO: 383678 - protein, 10 aa, Influenza virus
PSAPHRLCYP

SEQ ID NO: 383679 - protein, 10 aa, Influenza virus
SAPHRLCYPG

SEQ ID NO: 383680 - protein, 10 aa, Influenza virus
KGFNSFYRNL

SEQ ID NO: 383681 - protein, 10 aa, Influenza virus
GVYNNTTGRD

SEQ ID NO: 383682 - protein, 10 aa, Influenza virus
PYTLVTTSSW

SEQ ID NO: 383683 - protein, 10 aa, Influenza virus
YTLVSTRSWS

SEQ ID NO: 383684 - protein, 10 aa, Influenza virus
GVRPRYNGQR

SEQ ID NO: 383685 - protein, 10 aa, Influenza virus
VRPRYNGQRS

SEQ ID NO: 383686 - protein, 10 aa, Influenza virus
KGRIFQSRII

SEQ ID NO: 383687 - protein, 10 aa, Influenza virus
QNIDKNALGE

SEQ ID NO: 383688 - protein, 10 aa, Influenza virus
NIDRNALGDC

SEQ ID NO: 383689 - protein, 10 aa, Influenza virus
IDKNALGECP

SEQ ID NO: 383690 - protein, 10 aa, Influenza virus
DKNALGECPK

SEQ ID NO: 383691 - protein, 10 aa, Influenza virus
LATGLKNVPA

SEQ ID NO: 383692 - protein, 10 aa, Influenza virus
NEQGMGMAAD

SEQ ID NO: 383693 - protein, 10 aa, Influenza virus
EQGMGMAADK

SEQ ID NO: 383694 - protein, 10 aa, Influenza virus
QGMGMAADKE

SEQ ID NO: 383695 - protein, 10 aa, Influenza virus
GMGMAADKES

SEQ ID NO: 383696 - protein, 10 aa, Influenza virus
MGMAADKEST

SEQ ID NO: 383697 - protein, 10 aa, Influenza virus
IRGEFNQVEQ

SEQ ID NO: 383698 - protein, 10 aa, Influenza virus
RGEFNQVEQR

SEQ ID NO: 383699 - protein, 10 aa, Influenza virus
GEFNQVEQRI

SEQ ID NO: 383700 - protein, 10 aa, Influenza virus
EFNQVEQRIN

SEQ ID NO: 383701 - protein, 10 aa, Influenza virus
FNQVEQRINM

SEQ ID NO: 383702 - protein, 10 aa, Influenza virus
NQVEQRINML

SEQ ID NO: 383703 - protein, 10 aa, Influenza virus
ANVRNLHEQI

SEQ ID NO: 383704 - protein, 10 aa, Influenza virus
NVRNLHDQIR

SEQ ID NO: 383705 - protein, 10 aa, Influenza virus
TIRNGTYNHS

SEQ ID NO: 383706 - protein, 10 aa, Influenza virus
RQEIEGIRLK

SEQ ID NO: 383707 - protein, 10 aa, Influenza virus
QEIEGIKLES

SEQ ID NO: 383708 - protein, 10 aa, Influenza virus
SEDNVYRALS

SEQ ID NO: 383709 - protein, 10 aa, Influenza virus
EDNVYRALSI

SEQ ID NO: 383710 - protein, 10 aa, Influenza virus
VLVGLILTFI

SEQ ID NO: 383711 - protein, 10 aa, Influenza virus
LVGPILSFIM

SEQ ID NO: 383712 - protein, 10 aa, Influenza virus
GLILTFIMWA

SEQ ID NO: 383713 - protein, 10 aa, Influenza virus
LILTFIMWAC

SEQ ID NO: 383714 - protein, 10 aa, Influenza virus
FIMWACSNGN

SEQ ID NO: 383715 - protein, 10 aa, Influenza virus
IMWACSNGNC

SEQ ID NO: 383716 - protein, 10 aa, Influenza virus
MWACSNGNCR

SEQ ID NO: 383717 - protein, 10 aa, Influenza virus
WACSNGNCRF

SEQ ID NO: 383718 - protein, 10 aa, Influenza virus
SRYSKADKIC

SEQ ID NO: 383719 - protein, 10 aa, Influenza virus
YLSNNATDTV

SEQ ID NO: 383720 - protein, 10 aa, Influenza virus
LSNNATDTVD

SEQ ID NO: 383721 - protein, 10 aa, Influenza virus
SNNATDTVDT

SEQ ID NO: 383722 - protein, 10 aa, Influenza virus
NNATDTVDTL

SEQ ID NO: 383723 - protein, 10 aa, Influenza virus
NATDTVDTLT

SEQ ID NO: 383724 - protein, 10 aa, Influenza virus
ATDTVDTLTE

SEQ ID NO: 383725 - protein, 10 aa, Influenza virus
TDKVDTLTET

SEQ ID NO: 383726 - protein, 10 aa, Influenza virus
DPNAPNKFCY

SEQ ID NO: 383727 - protein, 10 aa, Influenza virus
PNAPNKFCYP

SEQ ID NO: 383728 - protein, 10 aa, Influenza virus
NAPNKFCYPG

SEQ ID NO: 383729 - protein, 10 aa, Influenza virus
APNKFCYPGE

SEQ ID NO: 383730 - protein, 10 aa, Influenza virus
KLCYPGEVDN

SEQ ID NO: 383731 - protein, 10 aa, Influenza virus
LCYPGEVDNN

SEQ ID NO: 383732 - protein, 10 aa, Influenza virus
FSRTELISPN

SEQ ID NO: 383733 - protein, 10 aa, Influenza virus
SRTELISPNK

SEQ ID NO: 383734 - protein, 10 aa, Influenza virus
RTELISPNKW

SEQ ID NO: 383735 - protein, 10 aa, Influenza virus
TELISPNKWG

SEQ ID NO: 383736 - protein, 10 aa, Influenza virus
PNKWGDILDG

SEQ ID NO: 383737 - protein, 10 aa, Influenza virus
NKWGDILDGV

SEQ ID NO: 383738 - protein, 10 aa, Influenza virus
VTASCLDRGT

SEQ ID NO: 383739 - protein, 10 aa, Influenza virus
FYRNLIWLVQ

SEQ ID NO: 383740 - protein, 10 aa, Influenza virus
GIHHPDTEEV

SEQ ID NO: 383741 - protein, 10 aa, Influenza virus
IHHPDTEEVA

SEQ ID NO: 383742 - protein, 10 aa, Influenza virus
ATRLYVNKNP

SEQ ID NO: 383743 - protein, 10 aa, Influenza virus
TRLYVNKNPY

SEQ ID NO: 383744 - protein, 10 aa, Influenza virus
TFESNGGLIA

SEQ ID NO: 383745 - protein, 10 aa, Influenza virus
GRIFQSGVRV

SEQ ID NO: 383746 - protein, 10 aa, Influenza virus
RIFQSRIRMG

SEQ ID NO: 383747 - protein, 10 aa, Influenza virus
RVARCNTKCQ

SEQ ID NO: 383748 - protein, 10 aa, Influenza virus
MGKCNTKCQT

SEQ ID NO: 383749 - protein, 10 aa, Influenza virus
RCNTKCQTSV

SEQ ID NO: 383750 - protein, 10 aa, Influenza virus
TKCQTSLGGV

SEQ ID NO: 383751 - protein, 10 aa, Influenza virus
DERGLFGAIA

SEQ ID NO: 383752 - protein, 10 aa, Influenza virus
DKVSTQKALN

SEQ ID NO: 383753 - protein, 10 aa, Influenza virus
KVSTQKALNE

SEQ ID NO: 383754 - protein, 10 aa, Influenza virus
VSTQKALNEI

SEQ ID NO: 383755 - protein, 10 aa, Influenza virus
ANVKNLHDQI

SEQ ID NO: 383756 - protein, 10 aa, Influenza virus
NVKNLHDQIK

SEQ ID NO: 383757 - protein, 10 aa, Influenza virus
VKNLHDQIKR

SEQ ID NO: 383758 - protein, 10 aa, Influenza virus
SEDNVYKVLS

SEQ ID NO: 383759 - protein, 10 aa, Influenza virus
YSCIASSTVM

SEQ ID NO: 383760 - protein, 10 aa, Influenza virus
SCIASSTVMV

SEQ ID NO: 383761 - protein, 10 aa, Influenza virus
CIASSTVMVG

SEQ ID NO: 383762 - protein, 10 aa, Influenza virus
IASSTVMVGL

SEQ ID NO: 383763 - protein, 10 aa, Influenza virus
ASSTVMVGLI

SEQ ID NO: 383764 - protein, 10 aa, Influenza virus
SSTVMVGLIL

SEQ ID NO: 383765 - protein, 10 aa, Influenza virus
STVMVGLILA

SEQ ID NO: 383766 - protein, 10 aa, Influenza virus
TVMVGLILAF

SEQ ID NO: 383767 - protein, 10 aa, Influenza virus
FIEGGWPGLV

SEQ ID NO: 383768 - protein, 10 aa, Influenza virus
IEGGWPGLVA

SEQ ID NO: 383769 - protein, 10 aa, Influenza virus
EGGWPGLVAG

SEQ ID NO: 383770 - protein, 10 aa, Influenza virus
GGWPGLVAGW

SEQ ID NO: 383771 - protein, 10 aa, Influenza virus
GWPGLVAGWY

SEQ ID NO: 383772 - protein, 10 aa, Influenza virus
WPGLVAGWYG

SEQ ID NO: 383773 - protein, 10 aa, Influenza virus
PGLVAGWYGF

SEQ ID NO: 383774 - protein, 10 aa, Influenza virus
GLVAGWYGFQ

SEQ ID NO: 383775 - protein, 10 aa, Influenza virus
LVAGWYGFQH

SEQ ID NO: 383776 - protein, 10 aa, Influenza virus
AGWYGFQHQN

SEQ ID NO: 383777 - protein, 10 aa, Influenza virus
YNAKLLVLLE

SEQ ID NO: 383778 - protein, 10 aa, Influenza virus
NAKLLVLLEN

SEQ ID NO: 383779 - protein, 10 aa, Influenza virus
TDTVDTVREK

SEQ ID NO: 383780 - protein, 10 aa, Influenza virus
DTVDTVREKN

SEQ ID NO: 383781 - protein, 10 aa, Influenza virus
TVDTVREKNV

SEQ ID NO: 383782 - protein, 10 aa, Influenza virus
VDTVREKNVT

SEQ ID NO: 383783 - protein, 10 aa, Influenza virus
DTVREKNVTV

SEQ ID NO: 383784 - protein, 10 aa, Influenza virus
VREKNVTVTH

SEQ ID NO: 383785 - protein, 10 aa, Influenza virus
VAGWILGNPK

SEQ ID NO: 383786 - protein, 10 aa, Influenza virus
KEQLSSVSSF

SEQ ID NO: 383787 - protein, 10 aa, Influenza virus
QLSSVSSFKR

SEQ ID NO: 383788 - protein, 10 aa, Influenza virus
SVSSFKRFEI

SEQ ID NO: 383789 - protein, 10 aa, Influenza virus
DTIIFEATGN

SEQ ID NO: 383790 - protein, 10 aa, Influenza virus
TIIFEATGNL

SEQ ID NO: 383791 - protein, 10 aa, Influenza virus
FEATGNLVAP

SEQ ID NO: 383792 - protein, 10 aa, Influenza virus
FTIGECPKYV

SEQ ID NO: 383793 - protein, 10 aa, Influenza virus
GKCSKYVKST

SEQ ID NO: 383794 - protein, 10 aa, Influenza virus
RLRMATGLRN

SEQ ID NO: 383795 - protein, 10 aa, Influenza virus
LRMATGLRNV

SEQ ID NO: 383796 - protein, 10 aa, Influenza virus
RMATGLRNVP

SEQ ID NO: 383797 - protein, 10 aa, Influenza virus
MATGLRNVPS

SEQ ID NO: 383798 - protein, 10 aa, Influenza virus
AQGSGYAADL

SEQ ID NO: 383799 - protein, 10 aa, Influenza virus
IEKMNTQFTV

SEQ ID NO: 383800 - protein, 10 aa, Influenza virus
KMNIQFTSVS

SEQ ID NO: 383801 - protein, 10 aa, Influenza virus
MNTQFTSVGK

SEQ ID NO: 383802 - protein, 10 aa, Influenza virus
NTQFTSVGKE

SEQ ID NO: 383803 - protein, 10 aa, Influenza virus
TQFTVVGKEF

SEQ ID NO: 383804 - protein, 10 aa, Influenza virus
RIESLNNKVD

SEQ ID NO: 383805 - protein, 10 aa, Influenza virus
LNRKVDDGFL

SEQ ID NO: 383806 - protein, 10 aa, Influenza virus
NRKVDDGFLD

SEQ ID NO: 383807 - protein, 10 aa, Influenza virus
DDGFIDVWTY

SEQ ID NO: 383808 - protein, 10 aa, Influenza virus
DGFIDVWTYN

SEQ ID NO: 383809 - protein, 10 aa, Influenza virus
GFIDVWTYNA

SEQ ID NO: 383810 - protein, 10 aa, Influenza virus
FIDVWTYNAE

SEQ ID NO: 383811 - protein, 10 aa, Influenza virus
NERTLDYHDF

SEQ ID NO: 383812 - protein, 10 aa, Influenza virus
YPKYSKEAKL

SEQ ID NO: 383813 - protein, 10 aa, Influenza virus
ASTLVLLVSL

SEQ ID NO: 383814 - protein, 10 aa, Influenza virus
STLVLLVSLG

SEQ ID NO: 383815 - protein, 10 aa, Influenza virus
TLVLLVSLGA

SEQ ID NO: 383816 - protein, 10 aa, Influenza virus
LLVSLGAIGF

SEQ ID NO: 383817 - protein, 10 aa, Influenza virus
LVSLGAIGFW

SEQ ID NO: 383818 - protein, 10 aa, Influenza virus
CSWSLQCRIC

SEQ ID NO: 383819 - protein, 10 aa, Influenza virus
GVRIGSKGDV

SEQ ID NO: 383820 - protein, 10 aa, Influenza virus
NDRHSNGTIK

SEQ ID NO: 383821 - protein, 10 aa, Influenza virus
HSNGTVKBRS

SEQ ID NO: 383822 - protein, 10 aa, Influenza virus
KDRSPFRALM

SEQ ID NO: 383823 - protein, 10 aa, Influenza virus
RALMSCPVGE

SEQ ID NO: 383824 - protein, 10 aa, Influenza virus
WSASACHDGV

SEQ ID NO: 383825 - protein, 10 aa, Influenza virus
VLKYKGIITG

SEQ ID NO: 383826 - protein, 10 aa, Influenza virus
LKYKGIITGT

SEQ ID NO: 383827 - protein, 10 aa, Influenza virus
GVITDTIKSW

SEQ ID NO: 383828 - protein, 10 aa, Influenza virus
RTQESECACI

SEQ ID NO: 383829 - protein, 10 aa, Influenza virus
TQESECACIN

SEQ ID NO: 383830 - protein, 10 aa, Influenza virus
QESECACING

SEQ ID NO: 383831 - protein, 10 aa, Influenza virus
ESECACINGS

SEQ ID NO: 383832 - protein, 10 aa, Influenza virus
SECACINGSC

SEQ ID NO: 383833 - protein, 10 aa, Influenza virus
APNYYYEECS

SEQ ID NO: 383834 - protein, 10 aa, Influenza virus
PNYYYEECSC

SEQ ID NO: 383835 - protein, 10 aa, Influenza virus
NYYYEECSCY

SEQ ID NO: 383836 - protein, 10 aa, Influenza virus
YYYEECSCYP

SEQ ID NO: 383837 - protein, 10 aa, Influenza virus
ICVCRDNWHG

SEQ ID NO: 383838 - protein, 10 aa, Influenza virus
ASNRPWISFD

SEQ ID NO: 383839 - protein, 10 aa, Influenza virus
NRPWVSFNHN

SEQ ID NO: 383840 - protein, 10 aa, Influenza virus
RPWVSFNHNL

SEQ ID NO: 383841 - protein, 10 aa, Influenza virus
MGYICSGVFG

SEQ ID NO: 383842 - protein, 10 aa, Influenza virus
GTNGVKGFSF

SEQ ID NO: 383843 - protein, 10 aa, Influenza virus
GVKGFSYRYG

SEQ ID NO: 383844 - protein, 10 aa, Influenza virus
KGFSYRYGNG

SEQ ID NO: 383845 - protein, 10 aa, Influenza virus
GFSYRYGNGV

SEQ ID NO: 383846 - protein, 10 aa, Influenza virus
FSYRYGNGVW

SEQ ID NO: 383847 - protein, 10 aa, Influenza virus
GIWIGRTKST

SEQ ID NO: 383848 - protein, 10 aa, Influenza virus
HPELTGMDCI

SEQ ID NO: 383849 - protein, 10 aa, Influenza virus
NCMRPCFWVE

SEQ ID NO: 383850 - protein, 10 aa, Influenza virus
IKPCFWVELI

SEQ ID NO: 383851 - protein, 10 aa, Influenza virus
SSISFCGVSS

SEQ ID NO: 383852 - protein, 10 aa, Influenza virus
WPDGAELPFI

SEQ ID NO: 383853 - protein, 10 aa, Influenza virus
PDGAELPFII

SEQ ID NO: 383854 - protein, 10 aa, Influenza virus
KKLTVTHSVN

SEQ ID NO: 383855 - protein, 10 aa, Influenza virus
VTVTHSVNLF

SEQ ID NO: 383856 - protein, 10 aa, Influenza virus
PFQNIHPATI

SEQ ID NO: 383857 - protein, 10 aa, Influenza virus
FQNIHPATIG

SEQ ID NO: 383858 - protein, 10 aa, Influenza virus
SIQSKGLFGA

SEQ ID NO: 383859 - protein, 10 aa, Influenza virus
IHSRGLFGAI

SEQ ID NO: 383860 - protein, 10 aa, Influenza virus
NEQGYGYAAD

SEQ ID NO: 383861 - protein, 10 aa, Influenza virus
ENLNKRVDDG

SEQ ID NO: 383862 - protein, 10 aa, Influenza virus
LWTYNAELLI

SEQ ID NO: 383863 - protein, 10 aa, Influenza virus
ERTLDFHESN

SEQ ID NO: 383864 - protein, 10 aa, Influenza virus
RTLDFHDLNV

SEQ ID NO: 383865 - protein, 10 aa, Influenza virus
NKVKEIGNGC

SEQ ID NO: 383866 - protein, 10 aa, Influenza virus
AREIGNGCFE

SEQ ID NO: 383867 - protein, 10 aa, Influenza virus
CFEFYHRCDD

SEQ ID NO: 383868 - protein, 10 aa, Influenza virus
MCSHGSLQCR

SEQ ID NO: 383869 - protein, 10 aa, Influenza virus
CPNGSLQCTI

SEQ ID NO: 383870 - protein, 10 aa, Influenza virus
ITGFASFSKD

SEQ ID NO: 383871 - protein, 10 aa, Influenza virus
RLSASGDVWV

SEQ ID NO: 383872 - protein, 10 aa, Influenza virus
VSAGGDIWVT

SEQ ID NO: 383873 - protein, 10 aa, Influenza virus
AGGDIWATRE

SEQ ID NO: 383874 - protein, 10 aa, Influenza virus
GGAVWVTREP

SEQ ID NO: 383875 - protein, 10 aa, Influenza virus
DIWVTREPYA

SEQ ID NO: 383876 - protein, 10 aa, Influenza virus
DRSPYRTLLM

SEQ ID NO: 383877 - protein, 10 aa, Influenza virus
LGVPFYLGTK

SEQ ID NO: 383878 - protein, 10 aa, Influenza virus
CYDGKAWLHI

SEQ ID NO: 383879 - protein, 10 aa, Influenza virus
YDGKAWLHIC

SEQ ID NO: 383880 - protein, 10 aa, Influenza virus
ICAVVMTDGS

SEQ ID NO: 383881 - protein, 10 aa, Influenza virus
TVVMTDGSVS

SEQ ID NO: 383882 - protein, 10 aa, Influenza virus
VVMTDGSALG

SEQ ID NO: 383883 - protein, 10 aa, Influenza virus
NWKGSNRPVI

SEQ ID NO: 383884 - protein, 10 aa, Influenza virus
WKGSNRPVID

SEQ ID NO: 383885 - protein, 10 aa, Influenza virus
KGSNRPVIDI

SEQ ID NO: 383886 - protein, 10 aa, Influenza virus
GSHGVKGWAF

SEQ ID NO: 383887 - protein, 10 aa, Influenza virus
SHGVKGWAFD

SEQ ID NO: 383888 - protein, 10 aa, Influenza virus
RSGYETFRVT

SEQ ID NO: 383889 - protein, 10 aa, Influenza virus
FYVELIRGRE

SEQ ID NO: 383890 - protein, 10 aa, Influenza virus
VWWTSNSVVV

SEQ ID NO: 383891 - protein, 10 aa, Influenza virus
NSVVVFCGTS

SEQ ID NO: 383892 - protein, 10 aa, Influenza virus
IVVFCGTPGT

SEQ ID NO: 383893 - protein, 10 aa, Influenza virus
VVFCGTPGTY

SEQ ID NO: 383894 - protein, 10 aa, Influenza virus
VFCSTSGTYG

SEQ ID NO: 383895 - protein, 10 aa, Influenza virus
GTCGTGSWPD

SEQ ID NO: 383896 - protein, 10 aa, Influenza virus
GDQICVGYHA

SEQ ID NO: 383897 - protein, 10 aa, Influenza virus
DQICVGYHAN

SEQ ID NO: 383898 - protein, 10 aa, Influenza virus
QICVGYHANN

SEQ ID NO: 383899 - protein, 10 aa, Influenza virus
GYHSNNSTKK

SEQ ID NO: 383900 - protein, 10 aa, Influenza virus
VTHAKDILER

SEQ ID NO: 383901 - protein, 10 aa, Influenza virus
DILEKAHNGK

SEQ ID NO: 383902 - protein, 10 aa, Influenza virus
HNGKLCRLNG

SEQ ID NO: 383903 - protein, 10 aa, Influenza virus
GIPPLELGNC

SEQ ID NO: 383904 - protein, 10 aa, Influenza virus
TPPLELGDCS

SEQ ID NO: 383905 - protein, 10 aa, Influenza virus
LLGNPKCDRL

SEQ ID NO: 383906 - protein, 10 aa, Influenza virus
LGNPKCDRLL

SEQ ID NO: 383907 - protein, 10 aa, Influenza virus
PEWSYIMEKK

SEQ ID NO: 383908 - protein, 10 aa, Influenza virus
GSYNNTSGKQ

SEQ ID NO: 383909 - protein, 10 aa, Influenza virus
SYNNTSGEQV

SEQ ID NO: 383910 - protein, 10 aa, Influenza virus
YNNTSGEQVL

SEQ ID NO: 383911 - protein, 10 aa, Influenza virus
INFESNGNLI

SEQ ID NO: 383912 - protein, 10 aa, Influenza virus
NFESNGNLIA

SEQ ID NO: 383913 - protein, 10 aa, Influenza virus
KISKRGSSGV

SEQ ID NO: 383914 - protein, 10 aa, Influenza virus
ISKRGSSGVM

SEQ ID NO: 383915 - protein, 10 aa, Influenza virus
SKRGSSGVMK

SEQ ID NO: 383916 - protein, 10 aa, Influenza virus
KRGSSGVMKT

SEQ ID NO: 383917 - protein, 10 aa, Influenza virus
CDTKCQTPLG

SEQ ID NO: 383918 - protein, 10 aa, Influenza virus
DTKCQTPLGA

SEQ ID NO: 383919 - protein, 10 aa, Influenza virus
TKCQSPLGAI

SEQ ID NO: 383920 - protein, 10 aa, Influenza virus
KCQSPLGAIN

SEQ ID NO: 383921 - protein, 10 aa, Influenza virus
PQIEARGLFG

SEQ ID NO: 383922 - protein, 10 aa, Influenza virus
QTESRGLFGA

SEQ ID NO: 383923 - protein, 10 aa, Influenza virus
IEARGLFGAI

SEQ ID NO: 383924 - protein, 10 aa, Influenza virus
ERTLEFHDSN

SEQ ID NO: 383925 - protein, 10 aa, Influenza virus
RTLEFHDSNV

SEQ ID NO: 383926 - protein, 10 aa, Influenza virus
ILDFHDSNVK

SEQ ID NO: 383927 - protein, 10 aa, Influenza virus
LDFHDSSVKN

SEQ ID NO: 383928 - protein, 10 aa, Influenza virus
GFHDSNVKNL

SEQ ID NO: 383929 - protein, 10 aa, Influenza virus
HDSNVKNLYE

SEQ ID NO: 383930 - protein, 10 aa, Influenza virus
NLYDRVRMQL

SEQ ID NO: 383931 - protein, 10 aa, Influenza virus
LYDKVRMQLK

SEQ ID NO: 383932 - protein, 10 aa, Influenza virus
YDKVRMQLKD

SEQ ID NO: 383933 - protein, 10 aa, Influenza virus
DKVRMQLKDN

SEQ ID NO: 383934 - protein, 10 aa, Influenza virus
MQLRDNAKET

SEQ ID NO: 383935 - protein, 10 aa, Influenza virus
QLKDNAKEVG

SEQ ID NO: 383936 - protein, 10 aa, Influenza virus
DNAKEVGNGC

SEQ ID NO: 383937 - protein, 10 aa, Influenza virus
NAKEVGNGCF

SEQ ID NO: 383938 - protein, 10 aa, Influenza virus
AKEVGNGCFE

SEQ ID NO: 383939 - protein, 10 aa, Influenza virus
YHKCNDECMN

SEQ ID NO: 383940 - protein, 10 aa, Influenza virus
HKCNDECMNS

SEQ ID NO: 383941 - protein, 10 aa, Influenza virus
NGTYDYIKYE

SEQ ID NO: 383942 - protein, 10 aa, Influenza virus
GTYDYPKYEK

SEQ ID NO: 383943 - protein, 10 aa, Influenza virus
TYDYPKYEKE

SEQ ID NO: 383944 - protein, 10 aa, Influenza virus
YDYIKYEEES

SEQ ID NO: 383945 - protein, 10 aa, Influenza virus
YEEESKLNRS

SEQ ID NO: 383946 - protein, 10 aa, Influenza virus
EEESKLNRSE

SEQ ID NO: 383947 - protein, 10 aa, Influenza virus
EESKLNRSEI

SEQ ID NO: 383948 - protein, 10 aa, Influenza virus
ESKLNRSEIK

SEQ ID NO: 383949 - protein, 10 aa, Influenza virus
SKLNRSEIKG

SEQ ID NO: 383950 - protein, 10 aa, Influenza virus
SLAIMMAGIF

SEQ ID NO: 383951 - protein, 10 aa, Influenza virus
AGIFFWMCSN

SEQ ID NO: 383952 - protein, 10 aa, Influenza virus
GIFFWMCSNG

SEQ ID NO: 383953 - protein, 10 aa, Influenza virus
IFFWMCSNGS

SEQ ID NO: 383954 - protein, 10 aa, Influenza virus
FFWMCSNGSL

SEQ ID NO: 383955 - protein, 10 aa, Influenza virus
KIDTILERNV

SEQ ID NO: 383956 - protein, 10 aa, Influenza virus
THAQDILERT

SEQ ID NO: 383957 - protein, 10 aa, Influenza virus
HAQNILEKTH

SEQ ID NO: 383958 - protein, 10 aa, Influenza virus
AQNILEKTHN

SEQ ID NO: 383959 - protein, 10 aa, Influenza virus
QNILEKTHNG

SEQ ID NO: 383960 - protein, 10 aa, Influenza virus
GNPECDRFLS

SEQ ID NO: 383961 - protein, 10 aa, Influenza virus
IPEWSYIMEK

SEQ ID NO: 383962 - protein, 10 aa, Influenza virus
EWSYIIEKEN

SEQ ID NO: 383963 - protein, 10 aa, Influenza virus
WSYIIEKENP

SEQ ID NO: 383964 - protein, 10 aa, Influenza virus
VTHFEKIKIL

SEQ ID NO: 383965 - protein, 10 aa, Influenza virus
HFEKVKILAR

SEQ ID NO: 383966 - protein, 10 aa, Influenza virus
FEKIKILPRD

SEQ ID NO: 383967 - protein, 10 aa, Influenza virus
AQGSYNNTSG

SEQ ID NO: 383968 - protein, 10 aa, Influenza virus
QGSYNNTSGE

SEQ ID NO: 383969 - protein, 10 aa, Influenza virus
IWGIHHPNDE

SEQ ID NO: 383970 - protein, 10 aa, Influenza virus
WDTISFESTG

SEQ ID NO: 383971 - protein, 10 aa, Influenza virus
SGIMKTERTL

SEQ ID NO: 383972 - protein, 10 aa, Influenza virus
NCETQCQTPL

SEQ ID NO: 383973 - protein, 10 aa, Influenza virus
ECPKYVKSKR

SEQ ID NO: 383974 - protein, 10 aa, Influenza virus
CPRYVKSEKL

SEQ ID NO: 383975 - protein, 10 aa, Influenza virus
PKYVKSKRLV

SEQ ID NO: 383976 - protein, 10 aa, Influenza virus
KYVKSKRLVL

SEQ ID NO: 383977 - protein, 10 aa, Influenza virus
VKSDRLVLAI

SEQ ID NO: 383978 - protein, 10 aa, Influenza virus
KSDRLVLAIG

SEQ ID NO: 383979 - protein, 10 aa, Influenza virus
SDRLVLAIGL

SEQ ID NO: 383980 - protein, 10 aa, Influenza virus
KRLVLATGLR

SEQ ID NO: 383981 - protein, 10 aa, Influenza virus
ATGLRNAHKM

SEQ ID NO: 383982 - protein, 10 aa, Influenza virus
IGLRNVPQIE

SEQ ID NO: 383983 - protein, 10 aa, Influenza virus
RNVPQIEPRG

SEQ ID NO: 383984 - protein, 10 aa, Influenza virus
NVPQIEPRGL

SEQ ID NO: 383985 - protein, 10 aa, Influenza virus
VPQIEARGLF

SEQ ID NO: 383986 - protein, 10 aa, Influenza virus
ADKESTQKAV

SEQ ID NO: 383987 - protein, 10 aa, Influenza virus
NSVIEKINTQ

SEQ ID NO: 383988 - protein, 10 aa, Influenza virus
SVGKEFSNLE

SEQ ID NO: 383989 - protein, 10 aa, Influenza virus
KEFGNLERRL

SEQ ID NO: 383990 - protein, 10 aa, Influenza virus
EFGNLERRLE

SEQ ID NO: 383991 - protein, 10 aa, Influenza virus
FGNLERRLEN

SEQ ID NO: 383992 - protein, 10 aa, Influenza virus
GNLERRLENL

SEQ ID NO: 383993 - protein, 10 aa, Influenza virus
ERRLENLNKR

SEQ ID NO: 383994 - protein, 10 aa, Influenza virus
RLENLNKRME

SEQ ID NO: 383995 - protein, 10 aa, Influenza virus
LGNLNKKMED

SEQ ID NO: 383996 - protein, 10 aa, Influenza virus
GNLNKKMEDG

SEQ ID NO: 383997 - protein, 10 aa, Influenza virus
NLSKRMEDGF

SEQ ID NO: 383998 - protein, 10 aa, Influenza virus
MEDGFLGVWT

SEQ ID NO: 383999 - protein, 10 aa, Influenza virus
GLLDVWTYNA

SEQ ID NO: 384000 - protein, 10 aa, Influenza virus
LLDVWTYNAE

SEQ ID NO: 384001 - protein, 10 aa, Influenza virus
HDSNVRNLYD

SEQ ID NO: 384002 - protein, 10 aa, Influenza virus
VRNLYDKVRM

SEQ ID NO: 384003 - protein, 10 aa, Influenza virus
RNLYDKVRMQ

SEQ ID NO: 384004 - protein, 10 aa, Influenza virus
CMNSVKTGTY

SEQ ID NO: 384005 - protein, 10 aa, Influenza virus
RNGTYNYPKY

SEQ ID NO: 384006 - protein, 10 aa, Influenza virus
DYPKYEKESK

SEQ ID NO: 384007 - protein, 10 aa, Influenza virus
KGVELSSMGV

SEQ ID NO: 384008 - protein, 10 aa, Influenza virus
GVELSSMGVY

SEQ ID NO: 384009 - protein, 10 aa, Influenza virus
VELSSMGVYQ

SEQ ID NO: 384010 - protein, 10 aa, Influenza virus
ELSSMGVYQI

SEQ ID NO: 384011 - protein, 10 aa, Influenza virus
SSMGVYQILV

SEQ ID NO: 384012 - protein, 10 aa, Influenza virus
NMGVYQVLAI

SEQ ID NO: 384013 - protein, 10 aa, Influenza virus
SLAIMMAGIF

SEQ ID NO: 384014 - protein, 10 aa, Influenza virus
PNQKIITIGF

SEQ ID NO: 384015 - protein, 10 aa, Influenza virus
NQKIITMGSV

SEQ ID NO: 384016 - protein, 10 aa, Influenza virus
QKIITIDSVS

SEQ ID NO: 384017 - protein, 10 aa, Influenza virus
KIITIDSVSL

SEQ ID NO: 384018 - protein, 10 aa, Influenza virus
HIAILVTTVT

SEQ ID NO: 384019 - protein, 10 aa, Influenza virus
TITLHFKQNE

SEQ ID NO: 384020 - protein, 10 aa, Influenza virus
ITLHFKQNEC

SEQ ID NO: 384021 - protein, 10 aa, Influenza virus
TLHFKQHKCD

SEQ ID NO: 384022 - protein, 10 aa, Influenza virus
LSGGGDIWVT

SEQ ID NO: 384023 - protein, 10 aa, Influenza virus
SGGGDIWVTR

SEQ ID NO: 384024 - protein, 10 aa, Influenza virus
ADGDIWVTRE

SEQ ID NO: 384025 - protein, 10 aa, Influenza virus
TREPYVSCGP

SEQ ID NO: 384026 - protein, 10 aa, Influenza virus
DKCYQFALGQ

SEQ ID NO: 384027 - protein, 10 aa, Influenza virus
LENKHSNGTK

SEQ ID NO: 384028 - protein, 10 aa, Influenza virus
ENKHSNGTKH

SEQ ID NO: 384029 - protein, 10 aa, Influenza virus
TIHDRSPHRT

SEQ ID NO: 384030 - protein, 10 aa, Influenza virus
IHDRSPHRTL

SEQ ID NO: 384031 - protein, 10 aa, Influenza virus
FHLGTKQVCA

SEQ ID NO: 384032 - protein, 10 aa, Influenza virus
HLGTKQVCAA

SEQ ID NO: 384033 - protein, 10 aa, Influenza virus
LGTKQVCAAW

SEQ ID NO: 384034 - protein, 10 aa, Influenza virus
GTKQVCAAWS

SEQ ID NO: 384035 - protein, 10 aa, Influenza virus
TKQVCAAWSS

SEQ ID NO: 384036 - protein, 10 aa, Influenza virus
KQVCAAWSSS

SEQ ID NO: 384037 - protein, 10 aa, Influenza virus
CVTGDDENAT

SEQ ID NO: 384038 - protein, 10 aa, Influenza virus
VTGYEKNATA

SEQ ID NO: 384039 - protein, 10 aa, Influenza virus
DDENATASFI

SEQ ID NO: 384040 - protein, 10 aa, Influenza virus
EKNATASFIY

SEQ ID NO: 384041 - protein, 10 aa, Influenza virus
NATASFIYEG

SEQ ID NO: 384042 - protein, 10 aa, Influenza virus
ADTRILFIRE

SEQ ID NO: 384043 - protein, 10 aa, Influenza virus
DTKILFIEEG

SEQ ID NO: 384044 - protein, 10 aa, Influenza virus
TKILFIEEGK

SEQ ID NO: 384045 - protein, 10 aa, Influenza virus
EGKIVHVSPL

SEQ ID NO: 384046 - protein, 10 aa, Influenza virus
VHVSPLSGSA

SEQ ID NO: 384047 - protein, 10 aa, Influenza virus
YPDVRCTCRD

SEQ ID NO: 384048 - protein, 10 aa, Influenza virus
PDVRCICKDN

SEQ ID NO: 384049 - protein, 10 aa, Influenza virus
DVRCTCRDNW

SEQ ID NO: 384050 - protein, 10 aa, Influenza virus
GSNRPIVDIN

SEQ ID NO: 384051 - protein, 10 aa, Influenza virus
DISMEDYSIG

SEQ ID NO: 384052 - protein, 10 aa, Influenza virus
ISMEDYSIGS

SEQ ID NO: 384053 - protein, 10 aa, Influenza virus
DYSIDSNYVC

SEQ ID NO: 384054 - protein, 10 aa, Influenza virus
GDTPRSDDSS

SEQ ID NO: 384055 - protein, 10 aa, Influenza virus
DTPRSDDSSS

SEQ ID NO: 384056 - protein, 10 aa, Influenza virus
SNSKSRDPNN

SEQ ID NO: 384057 - protein, 10 aa, Influenza virus
SSNCRNPNNE

SEQ ID NO: 384058 - protein, 10 aa, Influenza virus
PNNERGNHGV

SEQ ID NO: 384059 - protein, 10 aa, Influenza virus
NNERGNHGVK

SEQ ID NO: 384060 - protein, 10 aa, Influenza virus
NERGYPGVKG

SEQ ID NO: 384061 - protein, 10 aa, Influenza virus
ERGNHGVKGW

SEQ ID NO: 384062 - protein, 10 aa, Influenza virus
RGYPGVKGWA

SEQ ID NO: 384063 - protein, 10 aa, Influenza virus
PGVKGWAFDY

SEQ ID NO: 384064 - protein, 10 aa, Influenza virus
GDDVLMGRTI

SEQ ID NO: 384065 - protein, 10 aa, Influenza virus
ETFRVIGGWV

SEQ ID NO: 384066 - protein, 10 aa, Influenza virus
TFRVIGGWVT

SEQ ID NO: 384067 - protein, 10 aa, Influenza virus
KNNWSGYSGI

SEQ ID NO: 384068 - protein, 10 aa, Influenza virus
KSCVNRCFYV

SEQ ID NO: 384069 - protein, 10 aa, Influenza virus
SCVNRCFYVE

SEQ ID NO: 384070 - protein, 10 aa, Influenza virus
FYVELIRGMP

SEQ ID NO: 384071 - protein, 10 aa, Influenza virus
YVELIRGMPQ

SEQ ID NO: 384072 - protein, 10 aa, Influenza virus
VELIRGMPQE

SEQ ID NO: 384073 - protein, 10 aa, Influenza virus
PQEARVWWTS

SEQ ID NO: 384074 - protein, 10 aa, Influenza virus
SWPDGANISF

SEQ ID NO: 384075 - protein, 10 aa, Influenza virus
WPDGANTNFM

SEQ ID NO: 384076 - protein, 10 aa, Influenza virus
PDGANTNFMP

SEQ ID NO: 384077 - protein, 10 aa, Influenza virus
DGANIDFMPV

SEQ ID NO: 384078 - protein, 10 aa, Influenza virus
MLCLGHHAVP

SEQ ID NO: 384079 - protein, 10 aa, Influenza virus
DNIEVTNATE

SEQ ID NO: 384080 - protein, 10 aa, Influenza virus
RSLVASSGNL

SEQ ID NO: 384081 - protein, 10 aa, Influenza virus
SLVASSGNLE

SEQ ID NO: 384082 - protein, 10 aa, Influenza virus
FDKLYVWGIH

SEQ ID NO: 384083 - protein, 10 aa, Influenza virus
KCITPNGSIP

SEQ ID NO: 384084 - protein, 10 aa, Influenza virus
ITPNGSIPNG

SEQ ID NO: 384085 - protein, 10 aa, Influenza virus
GSIPNGKPFQ

SEQ ID NO: 384086 - protein, 10 aa, Influenza virus
ATGMRNIPER

SEQ ID NO: 384087 - protein, 10 aa, Influenza virus
MVNGWYGFRH

SEQ ID NO: 384088 - protein, 10 aa, Influenza virus
SEGTGQAGDL

SEQ ID NO: 384089 - protein, 10 aa, Influenza virus
DFKSTQAAIN

SEQ ID NO: 384090 - protein, 10 aa, Influenza virus
LKSTQAAITQ

SEQ ID NO: 384091 - protein, 10 aa, Influenza virus
KSTQAAVNQI

SEQ ID NO: 384092 - protein, 10 aa, Influenza virus
VEKTNEKFHQ

SEQ ID NO: 384093 - protein, 10 aa, Influenza virus
YNAEILVALE

SEQ ID NO: 384094 - protein, 10 aa, Influenza virus
EFLVALENQH

SEQ ID NO: 384095 - protein, 10 aa, Influenza virus
QNTIDLTDSE

SEQ ID NO: 384096 - protein, 10 aa, Influenza virus
NTIDLTDSEM

SEQ ID NO: 384097 - protein, 10 aa, Influenza virus
TIDLADSEMN

SEQ ID NO: 384098 - protein, 10 aa, Influenza virus
MTDSEMNKLF

SEQ ID NO: 384099 - protein, 10 aa, Influenza virus
TDSEMNKLFD

SEQ ID NO: 384100 - protein, 10 aa, Influenza virus
KQLRENAEEM

SEQ ID NO: 384101 - protein, 10 aa, Influenza virus
NAEDIGNGCF

SEQ ID NO: 384102 - protein, 10 aa, Influenza virus
GCFRIYHKCD

SEQ ID NO: 384103 - protein, 10 aa, Influenza virus
CFKIYHRCDN

SEQ ID NO: 384104 - protein, 10 aa, Influenza virus
GYKDWFLWIS

SEQ ID NO: 384105 - protein, 10 aa, Influenza virus
NWILWISFAI

SEQ ID NO: 384106 - protein, 10 aa, Influenza virus
GFVMWACQKG

SEQ ID NO: 384107 - protein, 10 aa, Influenza virus
FVMWACQKGN

SEQ ID NO: 384108 - protein, 10 aa, Influenza virus
HAVPNGTMVK

SEQ ID NO: 384109 - protein, 10 aa, Influenza virus
AVPNGTMVKT

SEQ ID NO: 384110 - protein, 10 aa, Influenza virus
VPNGTMVKTI

SEQ ID NO: 384111 - protein, 10 aa, Influenza virus
PNGTMVKTIT

SEQ ID NO: 384112 - protein, 10 aa, Influenza virus
LIDSLLGDPH

SEQ ID NO: 384113 - protein, 10 aa, Influenza virus
IDSLLGDPHC

SEQ ID NO: 384114 - protein, 10 aa, Influenza virus
FNKLYIWGVH

SEQ ID NO: 384115 - protein, 10 aa, Influenza virus
SIYWTVVKPG

SEQ ID NO: 384116 - protein, 10 aa, Influenza virus
IYWTVVKPGD

SEQ ID NO: 384117 - protein, 10 aa, Influenza virus
LIAPRGYFRI

SEQ ID NO: 384118 - protein, 10 aa, Influenza virus
SKCITPNGSI

SEQ ID NO: 384119 - protein, 10 aa, Influenza virus
KCITPNGSIP

SEQ ID NO: 384120 - protein, 10 aa, Influenza virus
ITPNGSIPNG

SEQ ID NO: 384121 - protein, 10 aa, Influenza virus
TPNGSIPNNK

SEQ ID NO: 384122 - protein, 10 aa, Influenza virus
PNGSIPNNKP

SEQ ID NO: 384123 - protein, 10 aa, Influenza virus
NGSIPNNKPF

SEQ ID NO: 384124 - protein, 10 aa, Influenza virus
GSIPNNKPFQ

SEQ ID NO: 384125 - protein, 10 aa, Influenza virus
SIPNNKPFQN

SEQ ID NO: 384126 - protein, 10 aa, Influenza virus
PNNKPFQNVN

SEQ ID NO: 384127 - protein, 10 aa, Influenza virus
NNKPFQNVNK

SEQ ID NO: 384128 - protein, 10 aa, Influenza virus
QNINRITYGA

SEQ ID NO: 384129 - protein, 10 aa, Influenza virus
NINRITYGAC

SEQ ID NO: 384130 - protein, 10 aa, Influenza virus
INRITYGACP

SEQ ID NO: 384131 - protein, 10 aa, Influenza virus
YVRQNTLKLA

SEQ ID NO: 384132 - protein, 10 aa, Influenza virus
VRQNTLKLAT

SEQ ID NO: 384133 - protein, 10 aa, Influenza virus
ATGMRNIPER

SEQ ID NO: 384134 - protein, 10 aa, Influenza virus
TGMRNIPERQ

SEQ ID NO: 384135 - protein, 10 aa, Influenza virus
GMRNIPERQT

SEQ ID NO: 384136 - protein, 10 aa, Influenza virus
MRNIPERQTR

SEQ ID NO: 384137 - protein, 10 aa, Influenza virus
RNIPERQTRG

SEQ ID NO: 384138 - protein, 10 aa, Influenza virus
PERQTRGLFG

SEQ ID NO: 384139 - protein, 10 aa, Influenza virus
ERQTRGLFGA

SEQ ID NO: 384140 - protein, 10 aa, Influenza virus
RQTRGLFGAI

SEQ ID NO: 384141 - protein, 10 aa, Influenza virus
VDGWYGFRHH

SEQ ID NO: 384142 - protein, 10 aa, Influenza virus
RHQNSEGMGQ

SEQ ID NO: 384143 - protein, 10 aa, Influenza virus
DLKSTQAAIT

SEQ ID NO: 384144 - protein, 10 aa, Influenza virus
FKSTQAAINQ

SEQ ID NO: 384145 - protein, 10 aa, Influenza virus
YNAELLVAME

SEQ ID NO: 384146 - protein, 10 aa, Influenza virus
NAELLIALEN

SEQ ID NO: 384147 - protein, 10 aa, Influenza virus
AEEMGNGCFK

SEQ ID NO: 384148 - protein, 10 aa, Influenza virus
EEMGNGCFKI

SEQ ID NO: 384149 - protein, 10 aa, Influenza virus
DLGNGCFKIY

SEQ ID NO: 384150 - protein, 10 aa, Influenza virus
MESIRNGTYD

SEQ ID NO: 384151 - protein, 10 aa, Influenza virus
RDEALSNRFQ

SEQ ID NO: 384152 - protein, 10 aa, Influenza virus
NWILWISFAI

SEQ ID NO: 384153 - protein, 10 aa, Influenza virus
LGFVMWACQK

SEQ ID NO: 384154 - protein, 10 aa, Influenza virus
DRCYQFALGQ

SEQ ID NO: 384155 - protein, 10 aa, Influenza virus
VCINGTCTVI

SEQ ID NO: 384156 - protein, 10 aa, Influenza virus
CINGICTVVM

SEQ ID NO: 384157 - protein, 10 aa, Influenza virus
IDGTCTVVMT

SEQ ID NO: 384158 - protein, 10 aa, Influenza virus
LSGGAQHVEE

SEQ ID NO: 384159 - protein, 10 aa, Influenza virus
ECSCYPRYSG

SEQ ID NO: 384160 - protein, 10 aa, Influenza virus
NWRGSNRPIV

SEQ ID NO: 384161 - protein, 10 aa, Influenza virus
WRGSNRPIVD

SEQ ID NO: 384162 - protein, 10 aa, Influenza virus
RGSNRPIVDI

SEQ ID NO: 384163 - protein, 10 aa, Influenza virus
GSNRPVVDIR

SEQ ID NO: 384164 - protein, 10 aa, Influenza virus
PGVKGWAFDY

SEQ ID NO: 384165 - protein, 10 aa, Influenza virus
GNDLWMGRTI

SEQ ID NO: 384166 - protein, 10 aa, Influenza virus
DVLWTSNSIV

SEQ ID NO: 384167 - protein, 10 aa, Influenza virus
YPGNPVICLG

SEQ ID NO: 384168 - protein, 10 aa, Influenza virus
NGTVVKTLTD

SEQ ID NO: 384169 - protein, 10 aa, Influenza virus
VEVITAQELV

SEQ ID NO: 384170 - protein, 10 aa, Influenza virus
LCPKPLKLVD

SEQ ID NO: 384171 - protein, 10 aa, Influenza virus
TCYPFDVPDH

SEQ ID NO: 384172 - protein, 10 aa, Influenza virus
DVPNYQSLRS

SEQ ID NO: 384173 - protein, 10 aa, Influenza virus
VPDYQSIRSI

SEQ ID NO: 384174 - protein, 10 aa, Influenza virus
PGYQSLRSIL

SEQ ID NO: 384175 - protein, 10 aa, Influenza virus
DYQSIRSILA

SEQ ID NO: 384176 - protein, 10 aa, Influenza virus
NGKFEFIVEK

SEQ ID NO: 384177 - protein, 10 aa, Influenza virus
GKLEFIAEEF

SEQ ID NO: 384178 - protein, 10 aa, Influenza virus
AVKQNGKSGA

SEQ ID NO: 384179 - protein, 10 aa, Influenza virus
QNLTKTNNGD

SEQ ID NO: 384180 - protein, 10 aa, Influenza virus
NLTKTNNGDY

SEQ ID NO: 384181 - protein, 10 aa, Influenza virus
LYKSNPGRVT

SEQ ID NO: 384182 - protein, 10 aa, Influenza virus
NPGRVTVSTR

SEQ ID NO: 384183 - protein, 10 aa, Influenza virus
RPWVRGLSSR

SEQ ID NO: 384184 - protein, 10 aa, Influenza virus
VKGQSGRISF

SEQ ID NO: 384185 - protein, 10 aa, Influenza virus
PEDLIVFNTI

SEQ ID NO: 384186 - protein, 10 aa, Influenza virus
EDLIVFNTIG

SEQ ID NO: 384187 - protein, 10 aa, Influenza virus
IGSCISKCHT

SEQ ID NO: 384188 - protein, 10 aa, Influenza virus
GNCPKYVKQG

SEQ ID NO: 384189 - protein, 10 aa, Influenza virus
NCPKYVKQGS

SEQ ID NO: 384190 - protein, 10 aa, Influenza virus
TQAAIDQVNG

SEQ ID NO: 384191 - protein, 10 aa, Influenza virus
QAAIDQISGK

SEQ ID NO: 384192 - protein, 10 aa, Influenza virus
AAIDQVNGKL

SEQ ID NO: 384193 - protein, 10 aa, Influenza virus
FEQIEGRIQD

SEQ ID NO: 384194 - protein, 10 aa, Influenza virus
NKIEGRVQDL

SEQ ID NO: 384195 - protein, 10 aa, Influenza virus
QVEGRIQNLE

SEQ ID NO: 384196 - protein, 10 aa, Influenza virus
TIDVTDSEMS

SEQ ID NO: 384197 - protein, 10 aa, Influenza virus
IDVADSEMNK

SEQ ID NO: 384198 - protein, 10 aa, Influenza virus
VTDSEMSKLF

SEQ ID NO: 384199 - protein, 10 aa, Influenza virus
SEMSKLFERV

SEQ ID NO: 384200 - protein, 10 aa, Influenza virus
EMSKLFERVR

SEQ ID NO: 384201 - protein, 10 aa, Influenza virus
CGNNCIESIR

SEQ ID NO: 384202 - protein, 10 aa, Influenza virus
GNNCIESIRN

SEQ ID NO: 384203 - protein, 10 aa, Influenza virus
RDDAINNRFQ

SEQ ID NO: 384204 - protein, 10 aa, Influenza virus
DDAINNRFQI

SEQ ID NO: 384205 - protein, 10 aa, Influenza virus
RFQIQGIKLT

SEQ ID NO: 384206 - protein, 10 aa, Influenza virus
FQIQGIKLTQ

SEQ ID NO: 384207 - protein, 10 aa, Influenza virus
QIQGIKLTQG

SEQ ID NO: 384208 - protein, 10 aa, Influenza virus
QGIKLTQGYK

SEQ ID NO: 384209 - protein, 10 aa, Influenza virus
SCFLLVALFL

SEQ ID NO: 384210 - protein, 10 aa, Influenza virus
ALFLAFILWA

SEQ ID NO: 384211 - protein, 10 aa, Influenza virus
LFLAFILWAC

SEQ ID NO: 384212 - protein, 10 aa, Influenza virus
LLTFILWACQ

SEQ ID NO: 384213 - protein, 10 aa, Influenza virus
LTFILWACQN

SEQ ID NO: 384214 - protein, 10 aa, Influenza virus
AFILWACQTG

SEQ ID NO: 384215 - protein, 10 aa, Influenza virus
SDQICVGYHA

SEQ ID NO: 384216 - protein, 10 aa, Influenza virus
RVDTIMEKNV

SEQ ID NO: 384217 - protein, 10 aa, Influenza virus
MEKNVTVTQA

SEQ ID NO: 384218 - protein, 10 aa, Influenza virus
KNITVTHAQD

SEQ ID NO: 384219 - protein, 10 aa, Influenza virus
NVTVTHAQDL

SEQ ID NO: 384220 - protein, 10 aa, Influenza virus
VTVTHAQDLL

SEQ ID NO: 384221 - protein, 10 aa, Influenza virus
TVTHAQDILG

SEQ ID NO: 384222 - protein, 10 aa, Influenza virus
VTHAQDLLEK

SEQ ID NO: 384223 - protein, 10 aa, Influenza virus
LGDCSVAGWL

SEQ ID NO: 384224 - protein, 10 aa, Influenza virus
HISVGTSTLN

SEQ ID NO: 384225 - protein, 10 aa, Influenza virus
FIAPEYAYKV

SEQ ID NO: 384226 - protein, 10 aa, Influenza virus
PFHNVHPLAI

SEQ ID NO: 384227 - protein, 10 aa, Influenza virus
FHNVHPLAIG

SEQ ID NO: 384228 - protein, 10 aa, Influenza virus
HPLAIGECPK

SEQ ID NO: 384229 - protein, 10 aa, Influenza virus
PLAIGECPKY

SEQ ID NO: 384230 - protein, 10 aa, Influenza virus
RRKRRGLFGA

SEQ ID NO: 384231 - protein, 10 aa, Influenza virus
VDGWYGYHHI

SEQ ID NO: 384232 - protein, 10 aa, Influenza virus
DGWYGYHHSK

SEQ ID NO: 384233 - protein, 10 aa, Influenza virus
DQGSGYAADK

SEQ ID NO: 384234 - protein, 10 aa, Influenza virus
QGSGYAADRK

SEQ ID NO: 384235 - protein, 10 aa, Influenza virus
SGYAADKESS

SEQ ID NO: 384236 - protein, 10 aa, Influenza virus
YAADRESTQK

SEQ ID NO: 384237 - protein, 10 aa, Influenza virus
AADRESTQKA

SEQ ID NO: 384238 - protein, 10 aa, Influenza virus
VNSIIDKMNI

SEQ ID NO: 384239 - protein, 10 aa, Influenza virus
FLDIWTYNAE

SEQ ID NO: 384240 - protein, 10 aa, Influenza virus
LDVWTYNAEI

SEQ ID NO: 384241 - protein, 10 aa, Influenza virus
DSNVKNLYNK

SEQ ID NO: 384242 - protein, 10 aa, Influenza virus
NVKNLYNKVR

SEQ ID NO: 384243 - protein, 10 aa, Influenza virus
NLYDKVRHQL

SEQ ID NO: 384244 - protein, 10 aa, Influenza virus
VRHQLRDNAK

SEQ ID NO: 384245 - protein, 10 aa, Influenza virus
HQLRDNAKEL

SEQ ID NO: 384246 - protein, 10 aa, Influenza virus
CMDSVRNGTY

SEQ ID NO: 384247 - protein, 10 aa, Influenza virus
QILSLYSTVA

SEQ ID NO: 384248 - protein, 10 aa, Influenza virus
ILSLYSTVAS

SEQ ID NO: 384249 - protein, 10 aa, Influenza virus
LSVYSTVASS

SEQ ID NO: 384250 - protein, 10 aa, Influenza virus
SVYSTVASSL

SEQ ID NO: 384251 - protein, 10 aa, Influenza virus
GLSLWMCFNG

SEQ ID NO: 384252 - protein, 10 aa, Influenza virus
LSLWMCFNGS

SEQ ID NO: 384253 - protein, 10 aa, Influenza virus
LWMCSNGSYN

SEQ ID NO: 384254 - protein, 10 aa, Influenza virus
FNGSLQCRIC

SEQ ID NO: 384255 - protein, 10 aa, Influenza virus
GYHANNSTEH

SEQ ID NO: 384256 - protein, 10 aa, Influenza virus
HANNSTERVD

SEQ ID NO: 384257 - protein, 10 aa, Influenza virus
ANNSTERVDT

SEQ ID NO: 384258 - protein, 10 aa, Influenza virus
NNSTEHVDTI

SEQ ID NO: 384259 - protein, 10 aa, Influenza virus
NSTEHVDTIM

SEQ ID NO: 384260 - protein, 10 aa, Influenza virus
STEHVDTIME

SEQ ID NO: 384261 - protein, 10 aa, Influenza virus
TERVDTIMEK

SEQ ID NO: 384262 - protein, 10 aa, Influenza virus
ERVDTIMEKN

SEQ ID NO: 384263 - protein, 10 aa, Influenza virus
GVKPLILRNC

SEQ ID NO: 384264 - protein, 10 aa, Influenza virus
VKPLILRNCS

SEQ ID NO: 384265 - protein, 10 aa, Influenza virus
RPLILKDCSI

SEQ ID NO: 384266 - protein, 10 aa, Influenza virus
FRDYEELKHL

SEQ ID NO: 384267 - protein, 10 aa, Influenza virus
RDYEELKHLM

SEQ ID NO: 384268 - protein, 10 aa, Influenza virus
EELKHLLSRT

SEQ ID NO: 384269 - protein, 10 aa, Influenza virus
THISVGTSTL

SEQ ID NO: 384270 - protein, 10 aa, Influenza virus
HISVGTSTLN

SEQ ID NO: 384271 - protein, 10 aa, Influenza virus
VSIGTSTLNQ

SEQ ID NO: 384272 - protein, 10 aa, Influenza virus
VNFESNGNFI

SEQ ID NO: 384273 - protein, 10 aa, Influenza virus
NFESNGNFIT

SEQ ID NO: 384274 - protein, 10 aa, Influenza virus
FIAPEYAYKV

SEQ ID NO: 384275 - protein, 10 aa, Influenza virus
AYKIIKKGDS

SEQ ID NO: 384276 - protein, 10 aa, Influenza virus
CQTPMGAVNS

SEQ ID NO: 384277 - protein, 10 aa, Influenza virus
GWYGYHHSKE

SEQ ID NO: 384278 - protein, 10 aa, Influenza virus
ESTQKAMDGV

SEQ ID NO: 384279 - protein, 10 aa, Influenza virus
AMDGVTNKVN

SEQ ID NO: 384280 - protein, 10 aa, Influenza virus
MDGVTNKVNS

SEQ ID NO: 384281 - protein, 10 aa, Influenza virus
ITNKINSIID

SEQ ID NO: 384282 - protein, 10 aa, Influenza virus
IDKMNTRFEA

SEQ ID NO: 384283 - protein, 10 aa, Influenza virus
MNIQFEAVGR

SEQ ID NO: 384284 - protein, 10 aa, Influenza virus
RRVENLNKKM

SEQ ID NO: 384285 - protein, 10 aa, Influenza virus
CMDSVRNGTY

SEQ ID NO: 384286 - protein, 10 aa, Influenza virus
YSTVVSSLAL

SEQ ID NO: 384287 - protein, 10 aa, Influenza virus
STVVSSLALA

SEQ ID NO: 384288 - protein, 10 aa, Influenza virus
TVVSSLALAI

SEQ ID NO: 384289 - protein, 10 aa, Influenza virus
AGLSLWMCFN

SEQ ID NO: 384290 - protein, 10 aa, Influenza virus
SLWMCSNGSY

SEQ ID NO: 384291 - protein, 10 aa, Influenza virus
FNGSLQCRIC

SEQ ID NO: 384292 - protein, 10 aa, Influenza virus
KNNTWVNQTY

SEQ ID NO: 384293 - protein, 10 aa, Influenza virus
HSKDNGIRIG

SEQ ID NO: 384294 - protein, 10 aa, Influenza virus
GDVFAIREPF

SEQ ID NO: 384295 - protein, 10 aa, Influenza virus
IREPFISCSQ

SEQ ID NO: 384296 - protein, 10 aa, Influenza virus
RAPFISCSYL

SEQ ID NO: 384297 - protein, 10 aa, Influenza virus
APFISCSYLE

SEQ ID NO: 384298 - protein, 10 aa, Influenza virus
PFISCSYLEC

SEQ ID NO: 384299 - protein, 10 aa, Influenza virus
FISCSYLECR

SEQ ID NO: 384300 - protein, 10 aa, Influenza virus
ISCSYLECRT

SEQ ID NO: 384301 - protein, 10 aa, Influenza virus
CSQMECRTFF

SEQ ID NO: 384302 - protein, 10 aa, Influenza virus
HLECRTFFLA

SEQ ID NO: 384303 - protein, 10 aa, Influenza virus
KHSNGTAKDR

SEQ ID NO: 384304 - protein, 10 aa, Influenza virus
HSNGTAKDRS

SEQ ID NO: 384305 - protein, 10 aa, Influenza virus
SNGTAKDRSP

SEQ ID NO: 384306 - protein, 10 aa, Influenza virus
KDRSPQRTLM

SEQ ID NO: 384307 - protein, 10 aa, Influenza virus
RSPHRSLMSC

SEQ ID NO: 384308 - protein, 10 aa, Influenza virus
SPHRSLMSCP

SEQ ID NO: 384309 - protein, 10 aa, Influenza virus
SASACHDGAS

SEQ ID NO: 384310 - protein, 10 aa, Influenza virus
ASACHDGASW

SEQ ID NO: 384311 - protein, 10 aa, Influenza virus
SACHDGASWL

SEQ ID NO: 384312 - protein, 10 aa, Influenza virus
CHDGASWLTI

SEQ ID NO: 384313 - protein, 10 aa, Influenza virus
GISGPDDGAV

SEQ ID NO: 384314 - protein, 10 aa, Influenza virus
ISGPDDGAVA

SEQ ID NO: 384315 - protein, 10 aa, Influenza virus
GPDDGAVAVL

SEQ ID NO: 384316 - protein, 10 aa, Influenza virus
PDDGAVAVLK

SEQ ID NO: 384317 - protein, 10 aa, Influenza virus
DDGAVAVLKY

SEQ ID NO: 384318 - protein, 10 aa, Influenza virus
GAVAVLKYKG

SEQ ID NO: 384319 - protein, 10 aa, Influenza virus
KYNGLITDTI

SEQ ID NO: 384320 - protein, 10 aa, Influenza virus
GVITDTIKSW

SEQ ID NO: 384321 - protein, 10 aa, Influenza virus
NVLRTQESEC

SEQ ID NO: 384322 - protein, 10 aa, Influenza virus
SCFTLMTDGP

SEQ ID NO: 384323 - protein, 10 aa, Influenza virus
ECSCYPNAGE

SEQ ID NO: 384324 - protein, 10 aa, Influenza virus
LGYICSGVFG

SEQ ID NO: 384325 - protein, 10 aa, Influenza virus
YICSGFFGDN

SEQ ID NO: 384326 - protein, 10 aa, Influenza virus
ICSGFFGDNP

SEQ ID NO: 384327 - protein, 10 aa, Influenza virus
CSGFFGDNPR

SEQ ID NO: 384328 - protein, 10 aa, Influenza virus
SGFFGDNPRP

SEQ ID NO: 384329 - protein, 10 aa, Influenza virus
FGDNPRPDDG

SEQ ID NO: 384330 - protein, 10 aa, Influenza virus
GIKGFSFRYG

SEQ ID NO: 384331 - protein, 10 aa, Influenza virus
KGFSYKYGNG

SEQ ID NO: 384332 - protein, 10 aa, Influenza virus
YKYGNGVWIG

SEQ ID NO: 384333 - protein, 10 aa, Influenza virus
GAWIGRTKST

SEQ ID NO: 384334 - protein, 10 aa, Influenza virus
ITNWSGYSGS

SEQ ID NO: 384335 - protein, 10 aa, Influenza virus
VQHPELTGVD

SEQ ID NO: 384336 - protein, 10 aa, Influenza virus
DCIRPCFWIE

SEQ ID NO: 384337 - protein, 10 aa, Influenza virus
WIELIRGRPK

SEQ ID NO: 384338 - protein, 10 aa, Influenza virus
IELIRGRPKE

SEQ ID NO: 384339 - protein, 10 aa, Influenza virus
IWTSGSIISF

SEQ ID NO: 384340 - protein, 10 aa, Influenza virus
SWPDGADLPF

SEQ ID NO: 384341 - protein, 10 aa, Influenza virus
VGYHANNSTK

SEQ ID NO: 384342 - protein, 10 aa, Influenza virus
HHANNSTEQV

SEQ ID NO: 384343 - protein, 10 aa, Influenza virus
QVDTIMEKIV

SEQ ID NO: 384344 - protein, 10 aa, Influenza virus
DTIMEKIVTV

SEQ ID NO: 384345 - protein, 10 aa, Influenza virus
TIMEKSVTVS

SEQ ID NO: 384346 - protein, 10 aa, Influenza virus
EKIVTVTHAQ

SEQ ID NO: 384347 - protein, 10 aa, Influenza virus
EWSYIVEKAN

SEQ ID NO: 384348 - protein, 10 aa, Influenza virus
WSYIVEKANP

SEQ ID NO: 384349 - protein, 10 aa, Influenza virus
SFFRNIVWLI

SEQ ID NO: 384350 - protein, 10 aa, Influenza virus
FFRNIVWLIK

SEQ ID NO: 384351 - protein, 10 aa, Influenza virus
IATRSKVNGQ

SEQ ID NO: 384352 - protein, 10 aa, Influenza virus
VDGWYGYHHN

SEQ ID NO: 384353 - protein, 10 aa, Influenza virus
GSGYGEDNES

SEQ ID NO: 384354 - protein, 10 aa, Influenza virus
SGYAANKEST

SEQ ID NO: 384355 - protein, 10 aa, Influenza virus
YAADKASTQK

SEQ ID NO: 384356 - protein, 10 aa, Influenza virus
AADKDSTQKA

SEQ ID NO: 384357 - protein, 10 aa, Influenza virus
STQKAVDGIT

SEQ ID NO: 384358 - protein, 10 aa, Influenza virus
NAEFFVLMEN

SEQ ID NO: 384359 - protein, 10 aa, Influenza virus
AELLVLMETE

SEQ ID NO: 384360 - protein, 10 aa, Influenza virus
LLVLMETERT

SEQ ID NO: 384361 - protein, 10 aa, Influenza virus
LIENERTLDL

SEQ ID NO: 384362 - protein, 10 aa, Influenza virus
IENERTLDFH

SEQ ID NO: 384363 - protein, 10 aa, Influenza virus
NLYDKVRFQL

SEQ ID NO: 384364 - protein, 10 aa, Influenza virus
NELGNGCFEF

SEQ ID NO: 384365 - protein, 10 aa, Influenza virus
ECIESVRNGT

SEQ ID NO: 384366 - protein, 10 aa, Influenza virus
ESVRNGTYKY

SEQ ID NO: 384367 - protein, 10 aa, Influenza virus
ILSVYSTVAS

SEQ ID NO: 384368 - protein, 10 aa, Influenza virus
LTIYSTVASS

SEQ ID NO: 384369 - protein, 10 aa, Influenza virus
SVYSTVASSL

SEQ ID NO: 384370 - protein, 10 aa, Influenza virus
LAIIIAGLSF

SEQ ID NO: 384371 - protein, 10 aa, Influenza virus
AIIIAGLSFW

SEQ ID NO: 384372 - protein, 10 aa, Influenza virus
VAGLSFWRCS

SEQ ID NO: 384373 - protein, 10 aa, Influenza virus
KPQCKITGFA

SEQ ID NO: 384374 - protein, 10 aa, Influenza virus
PQCKITGFAP

SEQ ID NO: 384375 - protein, 10 aa, Influenza virus
QCKITGFAPF

SEQ ID NO: 384376 - protein, 10 aa, Influenza virus
PYRTLLMNEL

SEQ ID NO: 384377 - protein, 10 aa, Influenza virus
IAWSRSSCHD

SEQ ID NO: 384378 - protein, 10 aa, Influenza virus
SSSSCYDGKA

SEQ ID NO: 384379 - protein, 10 aa, Influenza virus
SSSCYDGKAW

SEQ ID NO: 384380 - protein, 10 aa, Influenza virus
CHDGRAWLHI

SEQ ID NO: 384381 - protein, 10 aa, Influenza virus
HDGRAWLHIC

SEQ ID NO: 384382 - protein, 10 aa, Influenza virus
TQESECVCVN

SEQ ID NO: 384383 - protein, 10 aa, Influenza virus
VVITDGSASG

SEQ ID NO: 384384 - protein, 10 aa, Influenza virus
VTCVCRDNWK

SEQ ID NO: 384385 - protein, 10 aa, Influenza virus
SSSNCRDSNN

SEQ ID NO: 384386 - protein, 10 aa, Influenza virus
SSNCRDSNNE

SEQ ID NO: 384387 - protein, 10 aa, Influenza virus
SNCRDSNNER

SEQ ID NO: 384388 - protein, 10 aa, Influenza virus
RNPGVKGWAF

SEQ ID NO: 384389 - protein, 10 aa, Influenza virus
RSGYETFRII

SEQ ID NO: 384390 - protein, 10 aa, Influenza virus
HCINRCFYVE

SEQ ID NO: 384391 - protein, 10 aa, Influenza virus
PDGGNINFMP

SEQ ID NO: 384392 - protein, 10 aa, Influenza virus
NNSTTQIDTI

SEQ ID NO: 384393 - protein, 10 aa, Influenza virus
VNTILEKNVT

SEQ ID NO: 384394 - protein, 10 aa, Influenza virus
NTILEKNVTV

SEQ ID NO: 384395 - protein, 10 aa, Influenza virus
VTHSVELLED

SEQ ID NO: 384396 - protein, 10 aa, Influenza virus
KGWILGNPRC

SEQ ID NO: 384397 - protein, 10 aa, Influenza virus
SSFYRSLLWI

SEQ ID NO: 384398 - protein, 10 aa, Influenza virus
WSVLQPGETL

SEQ ID NO: 384399 - protein, 10 aa, Influenza virus
NLVAPWYAYR

SEQ ID NO: 384400 - protein, 10 aa, Influenza virus
NRTFQNVSPL

SEQ ID NO: 384401 - protein, 10 aa, Influenza virus
RTFQNVSPLW

SEQ ID NO: 384402 - protein, 10 aa, Influenza virus
FQNVSPLWVG

SEQ ID NO: 384403 - protein, 10 aa, Influenza virus
YEFSNLERRI

SEQ ID NO: 384404 - protein, 10 aa, Influenza virus
DGLLDVWTYN

SEQ ID NO: 384405 - protein, 10 aa, Influenza virus
NERTLDQHDA

SEQ ID NO: 384406 - protein, 10 aa, Influenza virus
TLDQHDANVK

SEQ ID NO: 384407 - protein, 10 aa, Influenza virus
LRDNAMILGN

SEQ ID NO: 384408 - protein, 10 aa, Influenza virus
RDNAMILGNG

SEQ ID NO: 384409 - protein, 10 aa, Influenza virus
ENGTYDYPKY

SEQ ID NO: 384410 - protein, 10 aa, Influenza virus
NGTYKYPKYQ

SEQ ID NO: 384411 - protein, 10 aa, Influenza virus
MCLNGSMQCR

SEQ ID NO: 384412 - protein, 10 aa, Influenza virus
NGSMQCRVCI

SEQ ID NO: 384413 - protein, 10 aa, Influenza virus
KSRGYKMNTK

SEQ ID NO: 384414 - protein, 10 aa, Influenza virus
SRGYKMNTKI

SEQ ID NO: 384415 - protein, 10 aa, Influenza virus
RGYKMNTKIL

SEQ ID NO: 384416 - protein, 10 aa, Influenza virus
THTERGVEVV

SEQ ID NO: 384417 - protein, 10 aa, Influenza virus
LTEREVEVVN

SEQ ID NO: 384418 - protein, 10 aa, Influenza virus
VVNATETVEN

SEQ ID NO: 384419 - protein, 10 aa, Influenza virus
GQTGRIDFHW

SEQ ID NO: 384420 - protein, 10 aa, Influenza virus
GAFIAPDRAT

SEQ ID NO: 384421 - protein, 10 aa, Influenza virus
AFIAPDRATF

SEQ ID NO: 384422 - protein, 10 aa, Influenza virus
ILLATGMRNV

SEQ ID NO: 384423 - protein, 10 aa, Influenza virus
GLIDGWYGFK

SEQ ID NO: 384424 - protein, 10 aa, Influenza virus
LIDGWYGFKH

SEQ ID NO: 384425 - protein, 10 aa, Influenza virus
IDGWYGFKHQ

SEQ ID NO: 384426 - protein, 10 aa, Influenza virus
GWYGYKHQNA

SEQ ID NO: 384427 - protein, 10 aa, Influenza virus
WYGYKHQNAQ

SEQ ID NO: 384428 - protein, 10 aa, Influenza virus
YGYKHQNAQG

SEQ ID NO: 384429 - protein, 10 aa, Influenza virus
GYKHQNAQGE

SEQ ID NO: 384430 - protein, 10 aa, Influenza virus
YKHQNAQGEG

SEQ ID NO: 384431 - protein, 10 aa, Influenza virus
PSAIDQITGK

SEQ ID NO: 384432 - protein, 10 aa, Influenza virus
IDQITGKLNH

SEQ ID NO: 384433 - protein, 10 aa, Influenza virus
DQITGKLNHL

SEQ ID NO: 384434 - protein, 10 aa, Influenza virus
EKQIGNLINW

SEQ ID NO: 384435 - protein, 10 aa, Influenza virus
KQIGNLINWT

SEQ ID NO: 384436 - protein, 10 aa, Influenza virus
AEFLVAMENQ

SEQ ID NO: 384437 - protein, 10 aa, Influenza virus
EFLVAMENQH

SEQ ID NO: 384438 - protein, 10 aa, Influenza virus
LLVAIENQHT

SEQ ID NO: 384439 - protein, 10 aa, Influenza virus
IENQHTIDLA

SEQ ID NO: 384440 - protein, 10 aa, Influenza virus
SEMKKLYERV

SEQ ID NO: 384441 - protein, 10 aa, Influenza virus
VKRLLRENAE

SEQ ID NO: 384442 - protein, 10 aa, Influenza virus
KRLLRENAEE

SEQ ID NO: 384443 - protein, 10 aa, Influenza virus
MASIRNNTYN

SEQ ID NO: 384444 - protein, 10 aa, Influenza virus
ASIRNNTYNH

SEQ ID NO: 384445 - protein, 10 aa, Influenza virus
NGYKDVILWF

SEQ ID NO: 384446 - protein, 10 aa, Influenza virus
FSFGASCFTL

SEQ ID NO: 384447 - protein, 10 aa, Influenza virus
ARGDKICLGH

SEQ ID NO: 384448 - protein, 10 aa, Influenza virus
CGLLGTVTGP

SEQ ID NO: 384449 - protein, 10 aa, Influenza virus
GLLGTVTGPP

SEQ ID NO: 384450 - protein, 10 aa, Influenza virus
DLIIERREGS

SEQ ID NO: 384451 - protein, 10 aa, Influenza virus
LIIERREGSD

SEQ ID NO: 384452 - protein, 10 aa, Influenza virus
CYPGGFTNEE

SEQ ID NO: 384453 - protein, 10 aa, Influenza virus
FTNEESLRQV

SEQ ID NO: 384454 - protein, 10 aa, Influenza virus
NEEPLRQILR

SEQ ID NO: 384455 - protein, 10 aa, Influenza virus
RQVLRRSGGI

SEQ ID NO: 384456 - protein, 10 aa, Influenza virus
TYSGIRTNGV

SEQ ID NO: 384457 - protein, 10 aa, Influenza virus
RPGSSFYAEM

SEQ ID NO: 384458 - protein, 10 aa, Influenza virus
SDSSFYAEMK

SEQ ID NO: 384459 - protein, 10 aa, Influenza virus
ALVIWGVHHS

SEQ ID NO: 384460 - protein, 10 aa, Influenza virus
KLYGSGSKLI

SEQ ID NO: 384461 - protein, 10 aa, Influenza virus
PGARRIDFNW

SEQ ID NO: 384462 - protein, 10 aa, Influenza virus
GARPQVNGQF

SEQ ID NO: 384463 - protein, 10 aa, Influenza virus
ARRIDFNWLL

SEQ ID NO: 384464 - protein, 10 aa, Influenza virus
FGRIDFHWLM

SEQ ID NO: 384465 - protein, 10 aa, Influenza virus
GGTIASSLPF

SEQ ID NO: 384466 - protein, 10 aa, Influenza virus
ISSLPFQNIN

SEQ ID NO: 384467 - protein, 10 aa, Influenza virus
AVGKCPKYVK

SEQ ID NO: 384468 - protein, 10 aa, Influenza virus
VKQKSILLAT

SEQ ID NO: 384469 - protein, 10 aa, Influenza virus
ATGMRNIPEK

SEQ ID NO: 384470 - protein, 10 aa, Influenza virus
TGMRNIPEKP

SEQ ID NO: 384471 - protein, 10 aa, Influenza virus
GMRNIPEKPK

SEQ ID NO: 384472 - protein, 10 aa, Influenza virus
LNHLIGKTNQ

SEQ ID NO: 384473 - protein, 10 aa, Influenza virus
NHLIGKTNQQ

SEQ ID NO: 384474 - protein, 10 aa, Influenza virus
HLIGKTNQQF

SEQ ID NO: 384475 - protein, 10 aa, Influenza virus
LIGRTNQQFE

SEQ ID NO: 384476 - protein, 10 aa, Influenza virus
IGRTNQQFEL

SEQ ID NO: 384477 - protein, 10 aa, Influenza virus
GRTNQQFELI

SEQ ID NO: 384478 - protein, 10 aa, Influenza virus
TNQQFEMIDN

SEQ ID NO: 384479 - protein, 10 aa, Influenza virus
NQQFGLIDNE

SEQ ID NO: 384480 - protein, 10 aa, Influenza virus
QQFEMIDNEF

SEQ ID NO: 384481 - protein, 10 aa, Influenza virus
FGLIDNEFNE

SEQ ID NO: 384482 - protein, 10 aa, Influenza virus
NEFTEIEQQI

SEQ ID NO: 384483 - protein, 10 aa, Influenza virus
NWTRDSITEV

SEQ ID NO: 384484 - protein, 10 aa, Influenza virus
WTRDSITEVW

SEQ ID NO: 384485 - protein, 10 aa, Influenza virus
TRDSITEVWS

SEQ ID NO: 384486 - protein, 10 aa, Influenza virus
RDSITEVWSY

SEQ ID NO: 384487 - protein, 10 aa, Influenza virus
IDLTDSEMNK

SEQ ID NO: 384488 - protein, 10 aa, Influenza virus
DLADSEMKKL

SEQ ID NO: 384489 - protein, 10 aa, Influenza virus
LTDSEMNKLY

SEQ ID NO: 384490 - protein, 10 aa, Influenza virus
EMKKLYERVR

SEQ ID NO: 384491 - protein, 10 aa, Influenza virus
IRNNTYDHSR

SEQ ID NO: 384492 - protein, 10 aa, Influenza virus
RNNTYDHSRY

SEQ ID NO: 384493 - protein, 10 aa, Influenza virus
NNTYDHSRYR

SEQ ID NO: 384494 - protein, 10 aa, Influenza virus
QYRTGSLQNR

SEQ ID NO: 384495 - protein, 10 aa, Influenza virus
QINPVKLSSG

SEQ ID NO: 384496 - protein, 10 aa, Influenza virus
ASCFILLAIV

SEQ ID NO: 384497 - protein, 10 aa, Influenza virus
  MOD_RES (4)..(4): Leu or Ile
LLAXVMGLVF

SEQ ID NO: 384498 - protein, 10 aa, Influenza virus
  MOD_RES (2)..(2): Leu or Ile
AXVMGLVFIC

SEQ ID NO: 384499 - protein, 10 aa, Influenza virus
AMGLVFICMK

SEQ ID NO: 384500 - protein, 10 aa, Influenza virus
FICIKNGNVR

SEQ ID NO: 384501 - protein, 10 aa, Influenza virus
ICIKNGNVRC

SEQ ID NO: 384502 - protein, 10 aa, Influenza virus
IGSVSLTIAA

SEQ ID NO: 384503 - protein, 10 aa, Influenza virus
ERNVTETLYL

SEQ ID NO: 384504 - protein, 10 aa, Influenza virus
NITEIVYLNH

SEQ ID NO: 384505 - protein, 10 aa, Influenza virus
ITKIVYLNST

SEQ ID NO: 384506 - protein, 10 aa, Influenza virus
YKSWSKPQCQ

SEQ ID NO: 384507 - protein, 10 aa, Influenza virus
RIWSKPQCQI

SEQ ID NO: 384508 - protein, 10 aa, Influenza virus
WSKPQCQIAG

SEQ ID NO: 384509 - protein, 10 aa, Influenza virus
SIRLSAGGNI

SEQ ID NO: 384510 - protein, 10 aa, Influenza virus
IRLSAGGNIW

SEQ ID NO: 384511 - protein, 10 aa, Influenza virus
RLSASGDIWI

SEQ ID NO: 384512 - protein, 10 aa, Influenza virus
LSASGDIWIT

SEQ ID NO: 384513 - protein, 10 aa, Influenza virus
SASGDIWITR

SEQ ID NO: 384514 - protein, 10 aa, Influenza virus
ASGDIWITRE

SEQ ID NO: 384515 - protein, 10 aa, Influenza virus
GGNIWITREP

SEQ ID NO: 384516 - protein, 10 aa, Influenza virus
TREPYVSCSP

SEQ ID NO: 384517 - protein, 10 aa, Influenza virus
NRCYQFALGQ

SEQ ID NO: 384518 - protein, 10 aa, Influenza virus
LGQGTTLNNK

SEQ ID NO: 384519 - protein, 10 aa, Influenza virus
GQGTTLNNKH

SEQ ID NO: 384520 - protein, 10 aa, Influenza virus
QGTTLNNKHS

SEQ ID NO: 384521 - protein, 10 aa, Influenza virus
GTTLNNKHSN

SEQ ID NO: 384522 - protein, 10 aa, Influenza virus
TTLNNKHSNG

SEQ ID NO: 384523 - protein, 10 aa, Influenza virus
TLNNKHSNGT

SEQ ID NO: 384524 - protein, 10 aa, Influenza virus
RIPHRTLLMS

SEQ ID NO: 384525 - protein, 10 aa, Influenza virus
IPHRTLLMSE

SEQ ID NO: 384526 - protein, 10 aa, Influenza virus
LHVCVTGDDG

SEQ ID NO: 384527 - protein, 10 aa, Influenza virus
HVCVTGDDGN

SEQ ID NO: 384528 - protein, 10 aa, Influenza virus
VCVTGDDGNA

SEQ ID NO: 384529 - protein, 10 aa, Influenza virus
ECVCINGSCI

SEQ ID NO: 384530 - protein, 10 aa, Influenza virus
CVCINGSCIV

SEQ ID NO: 384531 - protein, 10 aa, Influenza virus
VCINGSCIVV

SEQ ID NO: 384532 - protein, 10 aa, Influenza virus
CINGSCIVVM

SEQ ID NO: 384533 - protein, 10 aa, Influenza virus
INGSCIVVMT

SEQ ID NO: 384534 - protein, 10 aa, Influenza virus
TCAVVMTDGS

SEQ ID NO: 384535 - protein, 10 aa, Influenza virus
TDGSASRKAD

SEQ ID NO: 384536 - protein, 10 aa, Influenza virus
DGSASRKADT

SEQ ID NO: 384537 - protein, 10 aa, Influenza virus
EGKVVHISPL

SEQ ID NO: 384538 - protein, 10 aa, Influenza virus
GKVVHISPLS

SEQ ID NO: 384539 - protein, 10 aa, Influenza virus
KVVHISPLSG

SEQ ID NO: 384540 - protein, 10 aa, Influenza virus
VVHISPLSGS

SEQ ID NO: 384541 - protein, 10 aa, Influenza virus
TPRNEDSSSN

SEQ ID NO: 384542 - protein, 10 aa, Influenza virus
PRNDDSSSNS

SEQ ID NO: 384543 - protein, 10 aa, Influenza virus
RNEDSSSNSN

SEQ ID NO: 384544 - protein, 10 aa, Influenza virus
NDDSSSNSNC

SEQ ID NO: 384545 - protein, 10 aa, Influenza virus
DPNEERGSPG

SEQ ID NO: 384546 - protein, 10 aa, Influenza virus
PNEERGSPGV

SEQ ID NO: 384547 - protein, 10 aa, Influenza virus
NEERGSPGVK

SEQ ID NO: 384548 - protein, 10 aa, Influenza virus
EERGSPGVKG

SEQ ID NO: 384549 - protein, 10 aa, Influenza virus
VKGWAFDNGN

SEQ ID NO: 384550 - protein, 10 aa, Influenza virus
KGWAFDYGSD

SEQ ID NO: 384551 - protein, 10 aa, Influenza virus
NGNDVWMGRT

SEQ ID NO: 384552 - protein, 10 aa, Influenza virus
ETFKVIGGWT

SEQ ID NO: 384553 - protein, 10 aa, Influenza virus
VIDGWTTANS

SEQ ID NO: 384554 - protein, 10 aa, Influenza virus
IDGWTTANSK

SEQ ID NO: 384555 - protein, 10 aa, Influenza virus
DGWTTANSKS

SEQ ID NO: 384556 - protein, 10 aa, Influenza virus
RQVIVDNNNR

SEQ ID NO: 384557 - protein, 10 aa, Influenza virus
IVNNNNWSGY

SEQ ID NO: 384558 - protein, 10 aa, Influenza virus
VNNNNWSGYS

SEQ ID NO: 384559 - protein, 10 aa, Influenza virus
DNNNRSGYSG

SEQ ID NO: 384560 - protein, 10 aa, Influenza virus
KETTVWWTSN

SEQ ID NO: 384561 - protein, 10 aa, Influenza virus
TGVWWTSNSI

SEQ ID NO: 384562 - protein, 10 aa, Influenza virus
GHHAVTNGTK

SEQ ID NO: 384563 - protein, 10 aa, Influenza virus
HHAVTNGTKV

SEQ ID NO: 384564 - protein, 10 aa, Influenza virus
VDTLTGRGIE

SEQ ID NO: 384565 - protein, 10 aa, Influenza virus
NTLAERGVEV

SEQ ID NO: 384566 - protein, 10 aa, Influenza virus
LTGRGIEVVN

SEQ ID NO: 384567 - protein, 10 aa, Influenza virus
TGRGIEVVNA

SEQ ID NO: 384568 - protein, 10 aa, Influenza virus
GRGIEVVNAT

SEQ ID NO: 384569 - protein, 10 aa, Influenza virus
VVNATETVEN

SEQ ID NO: 384570 - protein, 10 aa, Influenza virus
TDMGQCGLLG

SEQ ID NO: 384571 - protein, 10 aa, Influenza virus
CGLLGIITGP

SEQ ID NO: 384572 - protein, 10 aa, Influenza virus
GLLGIITGPP

SEQ ID NO: 384573 - protein, 10 aa, Influenza virus
LLGIITGPPQ

SEQ ID NO: 384574 - protein, 10 aa, Influenza virus
LGIITGPPQC

SEQ ID NO: 384575 - protein, 10 aa, Influenza virus
GIITGPPQCD

SEQ ID NO: 384576 - protein, 10 aa, Influenza virus
DICYPGKFTN

SEQ ID NO: 384577 - protein, 10 aa, Influenza virus
RQILRGSGGV

SEQ ID NO: 384578 - protein, 10 aa, Influenza virus
GSSSFYAEMK

SEQ ID NO: 384579 - protein, 10 aa, Influenza virus
MKWLLSNSNN

SEQ ID NO: 384580 - protein, 10 aa, Influenza virus
LYGNGNKLIT

SEQ ID NO: 384581 - protein, 10 aa, Influenza virus
YGSENKLITV

SEQ ID NO: 384582 - protein, 10 aa, Influenza virus
SSKYLQSFTP

SEQ ID NO: 384583 - protein, 10 aa, Influenza virus
SKCQQSFTPS

SEQ ID NO: 384584 - protein, 10 aa, Influenza virus
YQQSFTPSPE

SEQ ID NO: 384585 - protein, 10 aa, Influenza virus
QSFTPSPGTR

SEQ ID NO: 384586 - protein, 10 aa, Influenza virus
VNGQSGRINF

SEQ ID NO: 384587 - protein, 10 aa, Influenza virus
NGQSGRINFH

SEQ ID NO: 384588 - protein, 10 aa, Influenza virus
QSGRINFHWL

SEQ ID NO: 384589 - protein, 10 aa, Influenza virus
NDTVTGSFNG

SEQ ID NO: 384590 - protein, 10 aa, Influenza virus
FSSNGAFIAP

SEQ ID NO: 384591 - protein, 10 aa, Influenza virus
FVAPDRVSFF

SEQ ID NO: 384592 - protein, 10 aa, Influenza virus
GGTIASSLPF

SEQ ID NO: 384593 - protein, 10 aa, Influenza virus
GTIASSLPFQ

SEQ ID NO: 384594 - protein, 10 aa, Influenza virus
TIASSLPFQN

SEQ ID NO: 384595 - protein, 10 aa, Influenza virus
IASSLPFQNI

SEQ ID NO: 384596 - protein, 10 aa, Influenza virus
ASSLPFQNIN

SEQ ID NO: 384597 - protein, 10 aa, Influenza virus
NLPFQNVNSR

SEQ ID NO: 384598 - protein, 10 aa, Influenza virus
LPFQNINSRV

SEQ ID NO: 384599 - protein, 10 aa, Influenza virus
LGKCPRYVKQ

SEQ ID NO: 384600 - protein, 10 aa, Influenza virus
GMKNVPEIPR

SEQ ID NO: 384601 - protein, 10 aa, Influenza virus
KKRGLFGAIA

SEQ ID NO: 384602 - protein, 10 aa, Influenza virus
AYQKQMTRGL

SEQ ID NO: 384603 - protein, 10 aa, Influenza virus
YQKQMTRGLF

SEQ ID NO: 384604 - protein, 10 aa, Influenza virus
QKQMTRGLFG

SEQ ID NO: 384605 - protein, 10 aa, Influenza virus
TGKLNRFIEK

SEQ ID NO: 384606 - protein, 10 aa, Influenza virus
GKLNRFIEKT

SEQ ID NO: 384607 - protein, 10 aa, Influenza virus
KLNRLIDRTN

SEQ ID NO: 384608 - protein, 10 aa, Influenza virus
LNRFIEKTNQ

SEQ ID NO: 384609 - protein, 10 aa, Influenza virus
NRLIDRTNHQ

SEQ ID NO: 384610 - protein, 10 aa, Influenza virus
RLIDRTNHQF

SEQ ID NO: 384611 - protein, 10 aa, Influenza virus
IDRTNHQFEL

SEQ ID NO: 384612 - protein, 10 aa, Influenza virus
DRTNHQFELI

SEQ ID NO: 384613 - protein, 10 aa, Influenza virus
FNEVEKQIGN

SEQ ID NO: 384614 - protein, 10 aa, Influenza virus
NWTRDSITEL

SEQ ID NO: 384615 - protein, 10 aa, Influenza virus
WTRDAMTEIW

SEQ ID NO: 384616 - protein, 10 aa, Influenza virus
TRDSMTEVMV

SEQ ID NO: 384617 - protein, 10 aa, Influenza virus
RDSITELWSY

SEQ ID NO: 384618 - protein, 10 aa, Influenza virus
DAMTEIWSYN

SEQ ID NO: 384619 - protein, 10 aa, Influenza virus
SITELWSYNA

SEQ ID NO: 384620 - protein, 10 aa, Influenza virus
LADSEMSKLY

SEQ ID NO: 384621 - protein, 10 aa, Influenza virus
ADSEMNNLYE

SEQ ID NO: 384622 - protein, 10 aa, Influenza virus
DSEMNNLYER

SEQ ID NO: 384623 - protein, 10 aa, Influenza virus
KLYERVKKQL

SEQ ID NO: 384624 - protein, 10 aa, Influenza virus
YERVKKQLRE

SEQ ID NO: 384625 - protein, 10 aa, Influenza virus
TYREEAMQNR

SEQ ID NO: 384626 - protein, 10 aa, Influenza virus
YREEAMQNRV

SEQ ID NO: 384627 - protein, 10 aa, Influenza virus
QNRVKIDPVK

SEQ ID NO: 384628 - protein, 10 aa, Influenza virus
NRVKIDPVKL

SEQ ID NO: 384629 - protein, 10 aa, Influenza virus
NPVKLNSGYK

SEQ ID NO: 384630 - protein, 10 aa, Influenza virus
PVKLNSGYKD

SEQ ID NO: 384631 - protein, 10 aa, Influenza virus
NSGYKDIILW

SEQ ID NO: 384632 - protein, 10 aa, Influenza virus
SFGASCFIFL

SEQ ID NO: 384633 - protein, 10 aa, Influenza virus
GASCFIFLAI

SEQ ID NO: 384634 - protein, 10 aa, Influenza virus
FICIKDGNMR

SEQ ID NO: 384635 - protein, 10 aa, Influenza virus
GVVNTILSTK

SEQ ID NO: 384636 - protein, 10 aa, Influenza virus
VVNTALSTIA

SEQ ID NO: 384637 - protein, 10 aa, Influenza virus
NTILSTKALL

SEQ ID NO: 384638 - protein, 10 aa, Influenza virus
TVLSIIALLI

SEQ ID NO: 384639 - protein, 10 aa, Influenza virus
ILSTKALLIG

SEQ ID NO: 384640 - protein, 10 aa, Influenza virus
LSIIALLIGI

SEQ ID NO: 384641 - protein, 10 aa, Influenza virus
SIIALLIGIG

SEQ ID NO: 384642 - protein, 10 aa, Influenza virus
TKALLIGIGN

SEQ ID NO: 384643 - protein, 10 aa, Influenza virus
IGIGNLIFNT

SEQ ID NO: 384644 - protein, 10 aa, Influenza virus
GVGNLAFNTV

SEQ ID NO: 384645 - protein, 10 aa, Influenza virus
IGNLAFNAVI

SEQ ID NO: 384646 - protein, 10 aa, Influenza virus
NLAFNAVIHG

SEQ ID NO: 384647 - protein, 10 aa, Influenza virus
VTYNNTVINN

SEQ ID NO: 384648 - protein, 10 aa, Influenza virus
TYNNTVINNM

SEQ ID NO: 384649 - protein, 10 aa, Influenza virus
YNNTVINNMT

SEQ ID NO: 384650 - protein, 10 aa, Influenza virus
NHTTINNITN

SEQ ID NO: 384651 - protein, 10 aa, Influenza virus
HTTINNITNV

SEQ ID NO: 384652 - protein, 10 aa, Influenza virus
TINNITNVVL

SEQ ID NO: 384653 - protein, 10 aa, Influenza virus
FKPSLPLCPV

SEQ ID NO: 384654 - protein, 10 aa, Influenza virus
PLPLCPFKGF

SEQ ID NO: 384655 - protein, 10 aa, Influenza virus
LAQGVLLGTK

SEQ ID NO: 384656 - protein, 10 aa, Influenza virus
AQGVLLGTKH

SEQ ID NO: 384657 - protein, 10 aa, Influenza virus
QGVLLGTKHS

SEQ ID NO: 384658 - protein, 10 aa, Influenza virus
GVLLGTKHSN

SEQ ID NO: 384659 - protein, 10 aa, Influenza virus
VLLGTKHSNG

SEQ ID NO: 384660 - protein, 10 aa, Influenza virus
KDKTPYRSLI

SEQ ID NO: 384661 - protein, 10 aa, Influenza virus
PYRSLIRFPV

SEQ ID NO: 384662 - protein, 10 aa, Influenza virus
RSLIRFPVGT

SEQ ID NO: 384663 - protein, 10 aa, Influenza virus
SLIRFPVGTA

SEQ ID NO: 384664 - protein, 10 aa, Influenza virus
LIRFPVGTAP

SEQ ID NO: 384665 - protein, 10 aa, Influenza virus
FPVGTAPVLG

SEQ ID NO: 384666 - protein, 10 aa, Influenza virus
PIGTAPILGN

SEQ ID NO: 384667 - protein, 10 aa, Influenza virus
IGTAPILGNY

SEQ ID NO: 384668 - protein, 10 aa, Influenza virus
PVLGNYKEMC

SEQ ID NO: 384669 - protein, 10 aa, Influenza virus
LGNYKEIRIA

SEQ ID NO: 384670 - protein, 10 aa, Influenza virus
GNYKEMCAAW

SEQ ID NO: 384671 - protein, 10 aa, Influenza virus
NYKEMCAAWS

SEQ ID NO: 384672 - protein, 10 aa, Influenza virus
YKEIRIAWSS

SEQ ID NO: 384673 - protein, 10 aa, Influenza virus
EIRIAWSSSS

SEQ ID NO: 384674 - protein, 10 aa, Influenza virus
MCAAWSSSSC

SEQ ID NO: 384675 - protein, 10 aa, Influenza virus
GKEWMHVCMA

SEQ ID NO: 384676 - protein, 10 aa, Influenza virus
KEWMHICMTG

SEQ ID NO: 384677 - protein, 10 aa, Influenza virus
GRMSDSIKSW

SEQ ID NO: 384678 - protein, 10 aa, Influenza virus
RMSDSIKSWR

SEQ ID NO: 384679 - protein, 10 aa, Influenza virus
MRDSIKSWRN

SEQ ID NO: 384680 - protein, 10 aa, Influenza virus
TQESECQCLY

SEQ ID NO: 384681 - protein, 10 aa, Influenza virus
QESECQRIDG

SEQ ID NO: 384682 - protein, 10 aa, Influenza virus
PADNKADHRI

SEQ ID NO: 384683 - protein, 10 aa, Influenza virus
AANSAHHRVY

SEQ ID NO: 384684 - protein, 10 aa, Influenza virus
ANSAHHRVYW

SEQ ID NO: 384685 - protein, 10 aa, Influenza virus
NSAHHRVYWI

SEQ ID NO: 384686 - protein, 10 aa, Influenza virus
SAHHRVYWIR

SEQ ID NO: 384687 - protein, 10 aa, Influenza virus
HRIYWIREGR

SEQ ID NO: 384688 - protein, 10 aa, Influenza virus
QHSEECSCYV

SEQ ID NO: 384689 - protein, 10 aa, Influenza virus
SEECSCYVDI

SEQ ID NO: 384690 - protein, 10 aa, Influenza virus
ECSCYVDTDV

SEQ ID NO: 384691 - protein, 10 aa, Influenza virus
CSCYVDVDVY

SEQ ID NO: 384692 - protein, 10 aa, Influenza virus
SCYVDVDVYC

SEQ ID NO: 384693 - protein, 10 aa, Influenza virus
DTDVYCICRD

SEQ ID NO: 384694 - protein, 10 aa, Influenza virus
VDVYCICRDN

SEQ ID NO: 384695 - protein, 10 aa, Influenza virus
WVRINNETIL

SEQ ID NO: 384696 - protein, 10 aa, Influenza virus
VRMNNETILE

SEQ ID NO: 384697 - protein, 10 aa, Influenza virus
DPSVVSCDSP

SEQ ID NO: 384698 - protein, 10 aa, Influenza virus
PSVVSCDSPS

SEQ ID NO: 384699 - protein, 10 aa, Influenza virus
SVVSCDSPSN

SEQ ID NO: 384700 - protein, 10 aa, Influenza virus
CSSPSGIEGR

SEQ ID NO: 384701 - protein, 10 aa, Influenza virus
GVKGFGFKSG

SEQ ID NO: 384702 - protein, 10 aa, Influenza virus
GRTVSTSGRL

SEQ ID NO: 384703 - protein, 10 aa, Influenza virus
EGWIDSPNHA

SEQ ID NO: 384704 - protein, 10 aa, Influenza virus
VKSVTQTLVS

SEQ ID NO: 384705 - protein, 10 aa, Influenza virus
AATQTLVSNN

SEQ ID NO: 384706 - protein, 10 aa, Influenza virus
ATQTLVSNND

SEQ ID NO: 384707 - protein, 10 aa, Influenza virus
YVELIRGRPI

SEQ ID NO: 384708 - protein, 10 aa, Influenza virus
DDDVSWTSNS

SEQ ID NO: 384709 - protein, 10 aa, Influenza virus
EDVSWTSNSI

SEQ ID NO: 384710 - protein, 10 aa, Influenza virus
GIKVDTLTEK

SEQ ID NO: 384711 - protein, 10 aa, Influenza virus
KVNTLTEKGI

SEQ ID NO: 384712 - protein, 10 aa, Influenza virus
VNTLTEREVE

SEQ ID NO: 384713 - protein, 10 aa, Influenza virus
NTLTEREVEV

SEQ ID NO: 384714 - protein, 10 aa, Influenza virus
DLGKCGLLGT

SEQ ID NO: 384715 - protein, 10 aa, Influenza virus
LRQILRRSGG

SEQ ID NO: 384716 - protein, 10 aa, Influenza virus
MGLTYNGIRT

SEQ ID NO: 384717 - protein, 10 aa, Influenza virus
GFTYTGVRTD

SEQ ID NO: 384718 - protein, 10 aa, Influenza virus
RLGSSFYAEM

SEQ ID NO: 384719 - protein, 10 aa, Influenza virus
LGSSFYAEMK

SEQ ID NO: 384720 - protein, 10 aa, Influenza virus
TVWSSKYRRS

SEQ ID NO: 384721 - protein, 10 aa, Influenza virus
NDTVTFNFNG

SEQ ID NO: 384722 - protein, 10 aa, Influenza virus
DTVTFNFNGA

SEQ ID NO: 384723 - protein, 10 aa, Influenza virus
TVTFNFNGAF

SEQ ID NO: 384724 - protein, 10 aa, Influenza virus
TFNFNGAFVA

SEQ ID NO: 384725 - protein, 10 aa, Influenza virus
VGECPRYVKQ

SEQ ID NO: 384726 - protein, 10 aa, Influenza virus
GWYGFRHQKA

SEQ ID NO: 384727 - protein, 10 aa, Influenza virus
WYGFRHQKAQ

SEQ ID NO: 384728 - protein, 10 aa, Influenza virus
YGFRHQKAQG

SEQ ID NO: 384729 - protein, 10 aa, Influenza virus
GFRHQKAQGE

SEQ ID NO: 384730 - protein, 10 aa, Influenza virus
FRHQKAQGEG

SEQ ID NO: 384731 - protein, 10 aa, Influenza virus
QSAVNQITGK

SEQ ID NO: 384732 - protein, 10 aa, Influenza virus
SAVNQITGKL

SEQ ID NO: 384733 - protein, 10 aa, Influenza virus
QFELIDNKFN

SEQ ID NO: 384734 - protein, 10 aa, Influenza virus
FKLIDNEFTE

SEQ ID NO: 384735 - protein, 10 aa, Influenza virus
EVEKQLGNVI

SEQ ID NO: 384736 - protein, 10 aa, Influenza virus
VEKQLGNVIN

SEQ ID NO: 384737 - protein, 10 aa, Influenza virus
TEVWSYNADL

SEQ ID NO: 384738 - protein, 10 aa, Influenza virus
EVWSYNADLL

SEQ ID NO: 384739 - protein, 10 aa, Influenza virus
ENQHTIDLTN

SEQ ID NO: 384740 - protein, 10 aa, Influenza virus
NQHTIDSTDS

SEQ ID NO: 384741 - protein, 10 aa, Influenza virus
QHTIDSTDSE

SEQ ID NO: 384742 - protein, 10 aa, Influenza virus
HIIDLADSEM

SEQ ID NO: 384743 - protein, 10 aa, Influenza virus
IIDLADSEMN

SEQ ID NO: 384744 - protein, 10 aa, Influenza virus
FEIFHKCDDN

SEQ ID NO: 384745 - protein, 10 aa, Influenza virus
EIFHKCDDRC

SEQ ID NO: 384746 - protein, 10 aa, Influenza virus
LFHKCDDDCM

SEQ ID NO: 384747 - protein, 10 aa, Influenza virus
CMGSIRNNTY

SEQ ID NO: 384748 - protein, 10 aa, Influenza virus
MGSIRNNTYD

SEQ ID NO: 384749 - protein, 10 aa, Influenza virus
GSIRNNTYDH

SEQ ID NO: 384750 - protein, 10 aa, Influenza virus
SIRNNTYDHR

SEQ ID NO: 384751 - protein, 10 aa, Influenza virus
IRNNSYDHSK

SEQ ID NO: 384752 - protein, 10 aa, Influenza virus
RNNTYDHRKY

SEQ ID NO: 384753 - protein, 10 aa, Influenza virus
NNTYDHRKYK

SEQ ID NO: 384754 - protein, 10 aa, Influenza virus
IDPVKLSGGY

SEQ ID NO: 384755 - protein, 10 aa, Influenza virus
DPVELSSGYK

SEQ ID NO: 384756 - protein, 10 aa, Influenza virus
PVKLSGGYKD

SEQ ID NO: 384757 - protein, 10 aa, Influenza virus
VKLSGGYKDV

SEQ ID NO: 384758 - protein, 10 aa, Influenza virus
KLSGGYKDVI

SEQ ID NO: 384759 - protein, 10 aa, Influenza virus
LSSGYKEIIL

SEQ ID NO: 384760 - protein, 10 aa, Influenza virus
SSGYKDVIIW

SEQ ID NO: 384761 - protein, 10 aa, Influenza virus
SGYKDVIIWF

SEQ ID NO: 384762 - protein, 10 aa, Influenza virus
YKDVIIWFSF

SEQ ID NO: 384763 - protein, 10 aa, Influenza virus
KDVIIWFSFG

SEQ ID NO: 384764 - protein, 10 aa, Influenza virus
EIILWFSFGA

SEQ ID NO: 384765 - protein, 10 aa, Influenza virus
FSLGASCFLL

SEQ ID NO: 384766 - protein, 10 aa, Influenza virus
GASCFTLLAI

SEQ ID NO: 384767 - protein, 10 aa, Influenza virus
LIFMCVKNGN

SEQ ID NO: 384768 - protein, 10 aa, Influenza virus
IFMCVKNGNM

SEQ ID NO: 384769 - protein, 10 aa, Influenza virus
ICVKNGNHAV

SEQ ID NO: 384770 - protein, 10 aa, Influenza virus
VKNGNMRCTS

SEQ ID NO: 384771 - protein, 10 aa, Influenza virus
NLLIGISNIG

SEQ ID NO: 384772 - protein, 10 aa, Influenza virus
LLIGISNIGL

SEQ ID NO: 384773 - protein, 10 aa, Influenza virus
LIGISNIGLN

SEQ ID NO: 384774 - protein, 10 aa, Influenza virus
SNVGLNMSLH

SEQ ID NO: 384775 - protein, 10 aa, Influenza virus
NIGLNVSLHL

SEQ ID NO: 384776 - protein, 10 aa, Influenza virus
GNTYVNNTTV

SEQ ID NO: 384777 - protein, 10 aa, Influenza virus
NKYVNNTTII

SEQ ID NO: 384778 - protein, 10 aa, Influenza virus
LCKIEGWVVV

SEQ ID NO: 384779 - protein, 10 aa, Influenza virus
VEGWVVIAQD

SEQ ID NO: 384780 - protein, 10 aa, Influenza virus
WVVIAQDNAI

SEQ ID NO: 384781 - protein, 10 aa, Influenza virus
VVIEKDNAVR

SEQ ID NO: 384782 - protein, 10 aa, Influenza virus
VIEKDNAVRF

SEQ ID NO: 384783 - protein, 10 aa, Influenza virus
IEKDNAVRFG

SEQ ID NO: 384784 - protein, 10 aa, Influenza virus
REPYVSCDPK

SEQ ID NO: 384785 - protein, 10 aa, Influenza virus
SNGTIHDRAA

SEQ ID NO: 384786 - protein, 10 aa, Influenza virus
NGTIHDRAAF

SEQ ID NO: 384787 - protein, 10 aa, Influenza virus
GTIHDRAAFR

SEQ ID NO: 384788 - protein, 10 aa, Influenza virus
HDRTTFRGLL

SEQ ID NO: 384789 - protein, 10 aa, Influenza virus
DRTTFRGLLS

SEQ ID NO: 384790 - protein, 10 aa, Influenza virus
RAAFRGLIST

SEQ ID NO: 384791 - protein, 10 aa, Influenza virus
FRGLLSTPLG

SEQ ID NO: 384792 - protein, 10 aa, Influenza virus
CHDGVSRMTI

SEQ ID NO: 384793 - protein, 10 aa, Influenza virus
HDGVSRMTIC

SEQ ID NO: 384794 - protein, 10 aa, Influenza virus
NNATATVYYN

SEQ ID NO: 384795 - protein, 10 aa, Influenza virus
YYDRRLTTTV

SEQ ID NO: 384796 - protein, 10 aa, Influenza virus
RRLTTTIRTW

SEQ ID NO: 384797 - protein, 10 aa, Influenza virus
LTTTVKTWAG

SEQ ID NO: 384798 - protein, 10 aa, Influenza virus
TTTVKTWAGN

SEQ ID NO: 384799 - protein, 10 aa, Influenza virus
TTVKTWAGNI

SEQ ID NO: 384800 - protein, 10 aa, Influenza virus
TIRTWAKNIL

SEQ ID NO: 384801 - protein, 10 aa, Influenza virus
IRTWAKNILR

SEQ ID NO: 384802 - protein, 10 aa, Influenza virus
ECVRHNGTCA

SEQ ID NO: 384803 - protein, 10 aa, Influenza virus
CVRHNGTCAV

SEQ ID NO: 384804 - protein, 10 aa, Influenza virus
HNGTWAVVMT

SEQ ID NO: 384805 - protein, 10 aa, Influenza virus
NGTWAVVMTD

SEQ ID NO: 384806 - protein, 10 aa, Influenza virus
GTWAVVMTDG

SEQ ID NO: 384807 - protein, 10 aa, Influenza virus
AVVMTDGPAS

SEQ ID NO: 384808 - protein, 10 aa, Influenza virus
VVMTDGSASG

SEQ ID NO: 384809 - protein, 10 aa, Influenza virus
MTDGSASGQA

SEQ ID NO: 384810 - protein, 10 aa, Influenza virus
VTCGCRDNWQ

SEQ ID NO: 384811 - protein, 10 aa, Influenza virus
NRPVIEIDMS

SEQ ID NO: 384812 - protein, 10 aa, Influenza virus
MDHTSQYLCT

SEQ ID NO: 384813 - protein, 10 aa, Influenza virus
DHTSQYLCTG

SEQ ID NO: 384814 - protein, 10 aa, Influenza virus
YICTGILTDT

SEQ ID NO: 384815 - protein, 10 aa, Influenza virus
ICTGILTDTS

SEQ ID NO: 384816 - protein, 10 aa, Influenza virus
APGTKGFGFL

SEQ ID NO: 384817 - protein, 10 aa, Influenza virus
PGVKGFGFLS

SEQ ID NO: 384818 - protein, 10 aa, Influenza virus
GVKGFGFLSG

SEQ ID NO: 384819 - protein, 10 aa, Influenza virus
DSTWLGRTIS

SEQ ID NO: 384820 - protein, 10 aa, Influenza virus
RSRSGFEMLR

SEQ ID NO: 384821 - protein, 10 aa, Influenza virus
EMLKIHNAGT

SEQ ID NO: 384822 - protein, 10 aa, Influenza virus
MLKIHNAGTD

SEQ ID NO: 384823 - protein, 10 aa, Influenza virus
LRIPNAGIDP

SEQ ID NO: 384824 - protein, 10 aa, Influenza virus
RQEIVDNKNW

SEQ ID NO: 384825 - protein, 10 aa, Influenza virus
QEIVDNSNWS

SEQ ID NO: 384826 - protein, 10 aa, Influenza virus
EIVDNSNWSG

SEQ ID NO: 384827 - protein, 10 aa, Influenza virus
IVDNSNWSGY

SEQ ID NO: 384828 - protein, 10 aa, Influenza virus
VDNKNWSGYS

SEQ ID NO: 384829 - protein, 10 aa, Influenza virus
DNKNWSGYSG

SEQ ID NO: 384830 - protein, 10 aa, Influenza virus
SNRSGYSGSF

SEQ ID NO: 384831 - protein, 10 aa, Influenza virus
LLMSTNAYDR

SEQ ID NO: 384832 - protein, 10 aa, Influenza virus
NSTNTVNTLI

SEQ ID NO: 384833 - protein, 10 aa, Influenza virus
STDTVNTLME

SEQ ID NO: 384834 - protein, 10 aa, Influenza virus
TDTVDTLIEQ

SEQ ID NO: 384835 - protein, 10 aa, Influenza virus
TLIEQNIPVT

SEQ ID NO: 384836 - protein, 10 aa, Influenza virus
LIEQKVPVTQ

SEQ ID NO: 384837 - protein, 10 aa, Influenza virus
TMELVETEKN

SEQ ID NO: 384838 - protein, 10 aa, Influenza virus
EKNPAYCNTD

SEQ ID NO: 384839 - protein, 10 aa, Influenza virus
LAYCNTDLGT

SEQ ID NO: 384840 - protein, 10 aa, Influenza virus
HLKDQAWSYI

SEQ ID NO: 384841 - protein, 10 aa, Influenza virus
LKDQAWSYIV

SEQ ID NO: 384842 - protein, 10 aa, Influenza virus
KDQAWSYIVE

SEQ ID NO: 384843 - protein, 10 aa, Influenza virus
ACNASTGAQS

SEQ ID NO: 384844 - protein, 10 aa, Influenza virus
CNASTGAQSF

SEQ ID NO: 384845 - protein, 10 aa, Influenza virus
NASTGAQSFY

SEQ ID NO: 384846 - protein, 10 aa, Influenza virus
PDIYDFNEGS

SEQ ID NO: 384847 - protein, 10 aa, Influenza virus
DIYDFNEGSY

SEQ ID NO: 384848 - protein, 10 aa, Influenza virus
NNKDGDIIFL

SEQ ID NO: 384849 - protein, 10 aa, Influenza virus
NENGDIIFLW

SEQ ID NO: 384850 - protein, 10 aa, Influenza virus
EEGDIIFLWG

SEQ ID NO: 384851 - protein, 10 aa, Influenza virus
TKEQTALYKN

SEQ ID NO: 384852 - protein, 10 aa, Influenza virus
TTNTINRNFQ

SEQ ID NO: 384853 - protein, 10 aa, Influenza virus
SFQPNIGPRA

SEQ ID NO: 384854 - protein, 10 aa, Influenza virus
RPLVRGQQGW

SEQ ID NO: 384855 - protein, 10 aa, Influenza virus
ALVRGQQGRM

SEQ ID NO: 384856 - protein, 10 aa, Influenza virus
YLLKGESHCR

SEQ ID NO: 384857 - protein, 10 aa, Influenza virus
GESHGKIIQN

SEQ ID NO: 384858 - protein, 10 aa, Influenza virus
ESHGRTIQNE

SEQ ID NO: 384859 - protein, 10 aa, Influenza virus
SHGKIIQNED

SEQ ID NO: 384860 - protein, 10 aa, Influenza virus
HCRIIQNEDI

SEQ ID NO: 384861 - protein, 10 aa, Influenza virus
CYTKCQTYAG

SEQ ID NO: 384862 - protein, 10 aa, Influenza virus
HTKCQTYTGA

SEQ ID NO: 384863 - protein, 10 aa, Influenza virus
TYAGAVNSSK

SEQ ID NO: 384864 - protein, 10 aa, Influenza virus
YTGAINSSRP

SEQ ID NO: 384865 - protein, 10 aa, Influenza virus
VNSSKPFQNA

SEQ ID NO: 384866 - protein, 10 aa, Influenza virus
SKPLQNASRH

SEQ ID NO: 384867 - protein, 10 aa, Influenza virus
PFQNASRYYM

SEQ ID NO: 384868 - protein, 10 aa, Influenza virus
FQNASRHHMG

SEQ ID NO: 384869 - protein, 10 aa, Influenza virus
SRHHMGECPK

SEQ ID NO: 384870 - protein, 10 aa, Influenza virus
RHYMGECPNY

SEQ ID NO: 384871 - protein, 10 aa, Influenza virus
MGECPKYAKK

SEQ ID NO: 384872 - protein, 10 aa, Influenza virus
KKESLRLAIG

SEQ ID NO: 384873 - protein, 10 aa, Influenza virus
IGLRNTPSIE

SEQ ID NO: 384874 - protein, 10 aa, Influenza virus
LRNTPSIDPK

SEQ ID NO: 384875 - protein, 10 aa, Influenza virus
RNTPSIDPKG

SEQ ID NO: 384876 - protein, 10 aa, Influenza virus
NTPSIDPKGL

SEQ ID NO: 384877 - protein, 10 aa, Influenza virus
TPSIDPKGLF

SEQ ID NO: 384878 - protein, 10 aa, Influenza virus
PSIDPKGLFG

SEQ ID NO: 384879 - protein, 10 aa, Influenza virus
SIDPKGLFGA

SEQ ID NO: 384880 - protein, 10 aa, Influenza virus
IDPKGLFGAI

SEQ ID NO: 384881 - protein, 10 aa, Influenza virus
EAIGKITNKV

SEQ ID NO: 384882 - protein, 10 aa, Influenza virus
AIEKITNKVN

SEQ ID NO: 384883 - protein, 10 aa, Influenza virus
INKITNKVNN

SEQ ID NO: 384884 - protein, 10 aa, Influenza virus
EKITNKVNNI

SEQ ID NO: 384885 - protein, 10 aa, Influenza virus
EKRTNMINDK

SEQ ID NO: 384886 - protein, 10 aa, Influenza virus
KRTNMINDKI

SEQ ID NO: 384887 - protein, 10 aa, Influenza virus
TNMINDKIDD

SEQ ID NO: 384888 - protein, 10 aa, Influenza virus
DKIDDQIEEL

SEQ ID NO: 384889 - protein, 10 aa, Influenza virus
KIDDQIEELW

SEQ ID NO: 384890 - protein, 10 aa, Influenza virus
IDDQIEELWA

SEQ ID NO: 384891 - protein, 10 aa, Influenza virus
DDQIEELWAY

SEQ ID NO: 384892 - protein, 10 aa, Influenza virus
FDEVRRRLSV

SEQ ID NO: 384893 - protein, 10 aa, Influenza virus
DEVRRRLSVN

SEQ ID NO: 384894 - protein, 10 aa, Influenza virus
EVRRRLSVNA

SEQ ID NO: 384895 - protein, 10 aa, Influenza virus
NAIDTGKGCF

SEQ ID NO: 384896 - protein, 10 aa, Influenza virus
AVDTGNGCFD

SEQ ID NO: 384897 - protein, 10 aa, Influenza virus
IDTGKGCFDI

SEQ ID NO: 384898 - protein, 10 aa, Influenza virus
IKNGTYDHKD

SEQ ID NO: 384899 - protein, 10 aa, Influenza virus
KNGTYNHKDY

SEQ ID NO: 384900 - protein, 10 aa, Influenza virus
NGTYNHKDYE

SEQ ID NO: 384901 - protein, 10 aa, Influenza virus
GTYDHKDYEE

SEQ ID NO: 384902 - protein, 10 aa, Influenza virus
TYDHKDYEEE

SEQ ID NO: 384903 - protein, 10 aa, Influenza virus
YNRKEYEEEA

SEQ ID NO: 384904 - protein, 10 aa, Influenza virus
NHKDYEEEAK

SEQ ID NO: 384905 - protein, 10 aa, Influenza virus
LEKSRINGVK

SEQ ID NO: 384906 - protein, 10 aa, Influenza virus
ERSKINEVKL

SEQ ID NO: 384907 - protein, 10 aa, Influenza virus
RSKINGVILE

SEQ ID NO: 384908 - protein, 10 aa, Influenza virus
SRINGVKLEE

SEQ ID NO: 384909 - protein, 10 aa, Influenza virus
RINGVKLEEN

SEQ ID NO: 384910 - protein, 10 aa, Influenza virus
NGVKLEENTS

SEQ ID NO: 384911 - protein, 10 aa, Influenza virus
GVILEENTTY

SEQ ID NO: 384912 - protein, 10 aa, Influenza virus
VRLEENTTYK

SEQ ID NO: 384913 - protein, 10 aa, Influenza virus
ILEENTTYKI

SEQ ID NO: 384914 - protein, 10 aa, Influenza virus
YQSTNSTEIV

SEQ ID NO: 384915 - protein, 10 aa, Influenza virus
GLIYGNPFCD

SEQ ID NO: 384916 - protein, 10 aa, Influenza virus
LKPGQTLRII

SEQ ID NO: 384917 - protein, 10 aa, Influenza virus
PSQTLRVRSN

SEQ ID NO: 384918 - protein, 10 aa, Influenza virus
QTLRIISNGN

SEQ ID NO: 384919 - protein, 10 aa, Influenza virus
TLRIISNGNL

SEQ ID NO: 384920 - protein, 10 aa, Influenza virus
SNENLIAPWY

SEQ ID NO: 384921 - protein, 10 aa, Influenza virus
SLKLAVGPRN

SEQ ID NO: 384922 - protein, 10 aa, Influenza virus
DRIQDIWAYN

SEQ ID NO: 384923 - protein, 10 aa, Influenza virus
RIQDIWAYNA

SEQ ID NO: 384924 - protein, 10 aa, Influenza virus
LLVLLENQKP

SEQ ID NO: 384925 - protein, 10 aa, Influenza virus
LVLLENQKIL

SEQ ID NO: 384926 - protein, 10 aa, Influenza virus
VLLENQKILD

SEQ ID NO: 384927 - protein, 10 aa, Influenza virus
LLENQKILDE

SEQ ID NO: 384928 - protein, 10 aa, Influenza virus
EDGKGCSELY

SEQ ID NO: 384929 - protein, 10 aa, Influenza virus
DGKGCFELHH

SEQ ID NO: 384930 - protein, 10 aa, Influenza virus
GKGCFELYHE

SEQ ID NO: 384931 - protein, 10 aa, Influenza virus
GCFELYHECD

SEQ ID NO: 384932 - protein, 10 aa, Influenza virus
CMETTRNGTY

SEQ ID NO: 384933 - protein, 10 aa, Influenza virus
DGTYKILTIY

SEQ ID NO: 384934 - protein, 10 aa, Influenza virus
TIYSTVASPL

SEQ ID NO: 384935 - protein, 10 aa, Influenza virus
YQSTNSTEIV

SEQ ID NO: 384936 - protein, 10 aa, Influenza virus
GLIYGNPFCD

SEQ ID NO: 384937 - protein, 10 aa, Influenza virus
LRPGQTLRVR

SEQ ID NO: 384938 - protein, 10 aa, Influenza virus
PSQTLRVRSN

SEQ ID NO: 384939 - protein, 10 aa, Influenza virus
QTLRIISNGN

SEQ ID NO: 384940 - protein, 10 aa, Influenza virus
TLRIISNGNL

SEQ ID NO: 384941 - protein, 10 aa, Influenza virus
SNENLIAPWY

SEQ ID NO: 384942 - protein, 10 aa, Influenza virus
SLKLAVGPRN

SEQ ID NO: 384943 - protein, 10 aa, Influenza virus
DDRIQDIWAY

SEQ ID NO: 384944 - protein, 10 aa, Influenza virus
DRIQDIWAYN

SEQ ID NO: 384945 - protein, 10 aa, Influenza virus
ENQKTLDEHV

SEQ ID NO: 384946 - protein, 10 aa, Influenza virus
EDGKGCSELY

SEQ ID NO: 384947 - protein, 10 aa, Influenza virus
DGKGCFELHH

SEQ ID NO: 384948 - protein, 10 aa, Influenza virus
GKGCFELYHE

SEQ ID NO: 384949 - protein, 10 aa, Influenza virus
GCFELYHECD

SEQ ID NO: 384950 - protein, 10 aa, Influenza virus
CMETTRNGTY

SEQ ID NO: 384951 - protein, 10 aa, Influenza virus
DGTYKILTIY

SEQ ID NO: 384952 - protein, 10 aa, Influenza virus
TIYSTVASPL

SEQ ID NO: 384953 - protein, 10 aa, Influenza virus
WSKPQCHITG

SEQ ID NO: 384954 - protein, 10 aa, Influenza virus
SKPQCQITGS

SEQ ID NO: 384955 - protein, 10 aa, Influenza virus
KPQCQITGSA

SEQ ID NO: 384956 - protein, 10 aa, Influenza virus
SHRTLLMNEL

SEQ ID NO: 384957 - protein, 10 aa, Influenza virus
LMSELGVPFN

SEQ ID NO: 384958 - protein, 10 aa, Influenza virus
TKQMCIAWSS

SEQ ID NO: 384959 - protein, 10 aa, Influenza virus
SSCHDGKEWL

SEQ ID NO: 384960 - protein, 10 aa, Influenza virus
NILRSQESEC

SEQ ID NO: 384961 - protein, 10 aa, Influenza virus
LKTQEYECVC

SEQ ID NO: 384962 - protein, 10 aa, Influenza virus
GSAKHVEECS

SEQ ID NO: 384963 - protein, 10 aa, Influenza virus
SAKHVEECSC

SEQ ID NO: 384964 - protein, 10 aa, Influenza virus
HIEECSCYPQ

SEQ ID NO: 384965 - protein, 10 aa, Influenza virus
VCRDNWKGCN

SEQ ID NO: 384966 - protein, 10 aa, Influenza virus
DNWKGSNRPD

SEQ ID NO: 384967 - protein, 10 aa, Influenza virus
SGLVGDTPRG

SEQ ID NO: 384968 - protein, 10 aa, Influenza virus
KAEIAQRLEN

SEQ ID NO: 384969 - protein, 10 aa, Influenza virus
AEIAQRLENV

SEQ ID NO: 384970 - protein, 10 aa, Influenza virus
EIAQRLENVF

SEQ ID NO: 384971 - protein, 10 aa, Influenza virus
IAQRLENVFA

SEQ ID NO: 384972 - protein, 10 aa, Influenza virus
AQRLENVFAG

SEQ ID NO: 384973 - protein, 10 aa, Influenza virus
QRLENVFAGK

SEQ ID NO: 384974 - protein, 10 aa, Influenza virus
SGKNTDLEAL

SEQ ID NO: 384975 - protein, 10 aa, Influenza virus
TDLEVLMEWL

SEQ ID NO: 384976 - protein, 10 aa, Influenza virus
PNNIDRAVKL

SEQ ID NO: 384977 - protein, 10 aa, Influenza virus
NNIDRAVKLY

SEQ ID NO: 384978 - protein, 10 aa, Influenza virus
NMARAVKLYK

SEQ ID NO: 384979 - protein, 10 aa, Influenza virus
MARAVKLYKK

SEQ ID NO: 384980 - protein, 10 aa, Influenza virus
EITFHGSKEV

SEQ ID NO: 384981 - protein, 10 aa, Influenza virus
GAKEISLSYS

SEQ ID NO: 384982 - protein, 10 aa, Influenza virus
VALGYSTGAL

SEQ ID NO: 384983 - protein, 10 aa, Influenza virus
SLSYSAGALA

SEQ ID NO: 384984 - protein, 10 aa, Influenza virus
NEQAAEAMEV

SEQ ID NO: 384985 - protein, 10 aa, Influenza virus
MVQAMRAVGT

SEQ ID NO: 384986 - protein, 10 aa, Influenza virus
DLLDNLQAYQ

SEQ ID NO: 384987 - protein, 10 aa, Influenza virus
AYQKRMGLQM

SEQ ID NO: 384988 - protein, 10 aa, Influenza virus
YQKRMGVQMH

SEQ ID NO: 384989 - protein, 10 aa, Influenza virus
QKRMGVQMHR

SEQ ID NO: 384990 - protein, 10 aa, Influenza virus
RMGVQMHRFK

SEQ ID NO: 384991 - protein, 10 aa, Influenza virus
RSYEQMETGE

SEQ ID NO: 384992 - protein, 10 aa, Influenza virus
HEQMETGGER

SEQ ID NO: 384993 - protein, 10 aa, Influenza virus
NEIRASVGRM

SEQ ID NO: 384994 - protein, 10 aa, Influenza virus
EIRTSVGRMV

SEQ ID NO: 384995 - protein, 10 aa, Influenza virus
GGIGKFYIQM

SEQ ID NO: 384996 - protein, 10 aa, Influenza virus
VQMCTELKLS

SEQ ID NO: 384997 - protein, 10 aa, Influenza virus
GRLIQNSITV

SEQ ID NO: 384998 - protein, 10 aa, Influenza virus
NKYLEEHPST

SEQ ID NO: 384999 - protein, 10 aa, Influenza virus
KYLEEHPSTG

SEQ ID NO: 385000 - protein, 10 aa, Influenza virus
YLEEHPSAGR

SEQ ID NO: 385001 - protein, 10 aa, Influenza virus
LEEHPSAGRD

SEQ ID NO: 385002 - protein, 10 aa, Influenza virus
EEHPSAGRDP

SEQ ID NO: 385003 - protein, 10 aa, Influenza virus
EHPSAGRDPK

SEQ ID NO: 385004 - protein, 10 aa, Influenza virus
HPSAGRDPKK

SEQ ID NO: 385005 - protein, 10 aa, Influenza virus
ELRRIWRQAN

SEQ ID NO: 385006 - protein, 10 aa, Influenza virus
RRIWRQANSG

SEQ ID NO: 385007 - protein, 10 aa, Influenza virus
WRQANSGEDA

SEQ ID NO: 385008 - protein, 10 aa, Influenza virus
GAAIKGIGTM

SEQ ID NO: 385009 - protein, 10 aa, Influenza virus
VMELVRMIKR

SEQ ID NO: 385010 - protein, 10 aa, Influenza virus
TRGAYERMCN

SEQ ID NO: 385011 - protein, 10 aa, Influenza virus
RGAYERMCNI

SEQ ID NO: 385012 - protein, 10 aa, Influenza virus
GAYERMCNIL

SEQ ID NO: 385013 - protein, 10 aa, Influenza virus
AEIEDLIFLT

SEQ ID NO: 385014 - protein, 10 aa, Influenza virus
EIEDLIFLTR

SEQ ID NO: 385015 - protein, 10 aa, Influenza virus
IEDLIFLTRS

SEQ ID NO: 385016 - protein, 10 aa, Influenza virus
CLPACVYGLV

SEQ ID NO: 385017 - protein, 10 aa, Influenza virus
PFRLLQSSQV

SEQ ID NO: 385018 - protein, 10 aa, Influenza virus
LTTRGVQIAS

SEQ ID NO: 385019 - protein, 10 aa, Influenza virus
TTRGVQIASN

SEQ ID NO: 385020 - protein, 10 aa, Influenza virus
RTKSGGNTNQ

SEQ ID NO: 385021 - protein, 10 aa, Influenza virus
ASAGQVSVQP

SEQ ID NO: 385022 - protein, 10 aa, Influenza virus
VQPTFSVQRS

SEQ ID NO: 385023 - protein, 10 aa, Influenza virus
EMSFQGRGVF

SEQ ID NO: 385024 - protein, 10 aa, Influenza virus
VFEFSDERAA

SEQ ID NO: 385025 - protein, 10 aa, Influenza virus
ATNPVVPSFD

SEQ ID NO: 385026 - protein, 10 aa, Influenza virus
PVVPSFDMSN

SEQ ID NO: 385027 - protein, 10 aa, Influenza virus
FQVDCFLWYV

SEQ ID NO: 385028 - protein, 10 aa, Influenza virus
QVDCFLWYVR

SEQ ID NO: 385029 - protein, 10 aa, Influenza virus
GDAPFIDRLR

SEQ ID NO: 385030 - protein, 10 aa, Influenza virus
PFLDRVRRDQ

SEQ ID NO: 385031 - protein, 10 aa, Influenza virus
DRIRRDQKSL

SEQ ID NO: 385032 - protein, 10 aa, Influenza virus
RRDQRALKGR

SEQ ID NO: 385033 - protein, 10 aa, Influenza virus
EVENEIRTFS

SEQ ID NO: 385034 - protein, 10 aa, Influenza virus
MGDFVRQCFN

SEQ ID NO: 385035 - protein, 10 aa, Influenza virus
DFVRQCFSPM

SEQ ID NO: 385036 - protein, 10 aa, Influenza virus
VRQCFNPMIA

SEQ ID NO: 385037 - protein, 10 aa, Influenza virus
RQCFNPMIAE

SEQ ID NO: 385038 - protein, 10 aa, Influenza virus
QCFNPMIAEL

SEQ ID NO: 385039 - protein, 10 aa, Influenza virus
CFNPMIAELA

SEQ ID NO: 385040 - protein, 10 aa, Influenza virus
FNPMIAELAE

SEQ ID NO: 385041 - protein, 10 aa, Influenza virus
VELAERAMKE

SEQ ID NO: 385042 - protein, 10 aa, Influenza virus
YSDFHFINEL

SEQ ID NO: 385043 - protein, 10 aa, Influenza virus
KPKSLPDLYD

SEQ ID NO: 385044 - protein, 10 aa, Influenza virus
PKSLPDLYDY

SEQ ID NO: 385045 - protein, 10 aa, Influenza virus
KSLPDLYDYK

SEQ ID NO: 385046 - protein, 10 aa, Influenza virus
IGVTRREVHM

SEQ ID NO: 385047 - protein, 10 aa, Influenza virus
GVTRREVHMY

SEQ ID NO: 385048 - protein, 10 aa, Influenza virus
VTRREVHMYY

SEQ ID NO: 385049 - protein, 10 aa, Influenza virus
TRREVHMYYL

SEQ ID NO: 385050 - protein, 10 aa, Influenza virus
RREVHMYYLE

SEQ ID NO: 385051 - protein, 10 aa, Influenza virus
REVHMYYLEK

SEQ ID NO: 385052 - protein, 10 aa, Influenza virus
EDTHIHIFSF

SEQ ID NO: 385053 - protein, 10 aa, Influenza virus
SFIGEEMATK

SEQ ID NO: 385054 - protein, 10 aa, Influenza virus
LFTIRQEMAG

SEQ ID NO: 385055 - protein, 10 aa, Influenza virus
FRTYVDGFKP

SEQ ID NO: 385056 - protein, 10 aa, Influenza virus
RTYVDGFKPN

SEQ ID NO: 385057 - protein, 10 aa, Influenza virus
TYVDGFKPNG

SEQ ID NO: 385058 - protein, 10 aa, Influenza virus
GFEPNGSIEG

SEQ ID NO: 385059 - protein, 10 aa, Influenza virus
FEPNGSIEGK

SEQ ID NO: 385060 - protein, 10 aa, Influenza virus
EPNGSIEGKL

SEQ ID NO: 385061 - protein, 10 aa, Influenza virus
LKLSIEEPSH

SEQ ID NO: 385062 - protein, 10 aa, Influenza virus
KLSIEEPSHE

SEQ ID NO: 385063 - protein, 10 aa, Influenza virus
LSIEEPSHEG

SEQ ID NO: 385064 - protein, 10 aa, Influenza virus
SIEEPSHEGE

SEQ ID NO: 385065 - protein, 10 aa, Influenza virus
SHEGEGIPLC

SEQ ID NO: 385066 - protein, 10 aa, Influenza virus
LMWALGENMA

SEQ ID NO: 385067 - protein, 10 aa, Influenza virus
MWALGENMAP

SEQ ID NO: 385068 - protein, 10 aa, Influenza virus
NKACELTGSS

SEQ ID NO: 385069 - protein, 10 aa, Influenza virus
KACELTGSSW

SEQ ID NO: 385070 - protein, 10 aa, Influenza virus
WIEFDEIGED

SEQ ID NO: 385071 - protein, 10 aa, Influenza virus
IGEDLAPIEY

SEQ ID NO: 385072 - protein, 10 aa, Influenza virus
APIEHIASIR

SEQ ID NO: 385073 - protein, 10 aa, Influenza virus
PIEHIASIRR

SEQ ID NO: 385074 - protein, 10 aa, Influenza virus
IASMRRSYFT

SEQ ID NO: 385075 - protein, 10 aa, Influenza virus
RRNYFTTEVS

SEQ ID NO: 385076 - protein, 10 aa, Influenza virus
TEEVSHCRAT

SEQ ID NO: 385077 - protein, 10 aa, Influenza virus
IKGVYINTAL

SEQ ID NO: 385078 - protein, 10 aa, Influenza virus
VYINTALLNS

SEQ ID NO: 385079 - protein, 10 aa, Influenza virus
SMFLYVRTNG

SEQ ID NO: 385080 - protein, 10 aa, Influenza virus
SIIEAESSVK

SEQ ID NO: 385081 - protein, 10 aa, Influenza virus
IIEAESSVKE

SEQ ID NO: 385082 - protein, 10 aa, Influenza virus
SSVKEKDLTK

SEQ ID NO: 385083 - protein, 10 aa, Influenza virus
EKDMTKEFFV

SEQ ID NO: 385084 - protein, 10 aa, Influenza virus
IEEGSIGKVC

SEQ ID NO: 385085 - protein, 10 aa, Influenza virus
AKSVFNSIYA

SEQ ID NO: 385086 - protein, 10 aa, Influenza virus
KSVFNSIYAS

SEQ ID NO: 385087 - protein, 10 aa, Influenza virus
SVFNSIYASP

SEQ ID NO: 385088 - protein, 10 aa, Influenza virus
FNSIYASPQL

SEQ ID NO: 385089 - protein, 10 aa, Influenza virus
NSIYASPQLE

SEQ ID NO: 385090 - protein, 10 aa, Influenza virus
SIYASPQLEG

SEQ ID NO: 385091 - protein, 10 aa, Influenza virus
AESRKLLLIT

SEQ ID NO: 385092 - protein, 10 aa, Influenza virus
ESRKLLLITQ

SEQ ID NO: 385093 - protein, 10 aa, Influenza virus
SRKLLLITQA

SEQ ID NO: 385094 - protein, 10 aa, Influenza virus
YEAVEECLIN

SEQ ID NO: 385095 - protein, 10 aa, Influenza virus
EAVEECLIND

SEQ ID NO: 385096 - protein, 10 aa, Influenza virus
NASWFNSFLK

SEQ ID NO: 385097 - protein, 10 aa, Influenza virus
ASWFNSFLKH

SEQ ID NO: 385098 - protein, 10 aa, Influenza virus
VNPTLLFLRV

SEQ ID NO: 385099 - protein, 10 aa, Influenza virus
NPTLLFLKMP

SEQ ID NO: 385100 - protein, 10 aa, Influenza virus
TETGALQLNP

SEQ ID NO: 385101 - protein, 10 aa, Influenza virus
ETGAPQLNPV

SEQ ID NO: 385102 - protein, 10 aa, Influenza virus
TGAPQLNPVD

SEQ ID NO: 385103 - protein, 10 aa, Influenza virus
DNEPNGYAQT

SEQ ID NO: 385104 - protein, 10 aa, Influenza virus
VLEAMAFLED

SEQ ID NO: 385105 - protein, 10 aa, Influenza virus
LEAMAFLEDS

SEQ ID NO: 385106 - protein, 10 aa, Influenza virus
EAMAFLEDSH

SEQ ID NO: 385107 - protein, 10 aa, Influenza virus
AMAFLEDSHP

SEQ ID NO: 385108 - protein, 10 aa, Influenza virus
MAFLEDSHPG

SEQ ID NO: 385109 - protein, 10 aa, Influenza virus
LEESHPGIFG

SEQ ID NO: 385110 - protein, 10 aa, Influenza virus
HPGIFESSCL

SEQ ID NO: 385111 - protein, 10 aa, Influenza virus
PGIFESSCLE

SEQ ID NO: 385112 - protein, 10 aa, Influenza virus
RLIDFLKDVT

SEQ ID NO: 385113 - protein, 10 aa, Influenza virus
VTTHFHRKRR

SEQ ID NO: 385114 - protein, 10 aa, Influenza virus
TTHFHRKRRV

SEQ ID NO: 385115 - protein, 10 aa, Influenza virus
MVTQRTMGKK

SEQ ID NO: 385116 - protein, 10 aa, Influenza virus
TQRTMGKKKQ

SEQ ID NO: 385117 - protein, 10 aa, Influenza virus
SYIIRALTLN

SEQ ID NO: 385118 - protein, 10 aa, Influenza virus
IRGVVYFVET

SEQ ID NO: 385119 - protein, 10 aa, Influenza virus
ENQSPRMFLA

SEQ ID NO: 385120 - protein, 10 aa, Influenza virus
NQSPRMFLAM

SEQ ID NO: 385121 - protein, 10 aa, Influenza virus
QSPRMFLAMI

SEQ ID NO: 385122 - protein, 10 aa, Influenza virus
SPRMFLAMIT

SEQ ID NO: 385123 - protein, 10 aa, Influenza virus
RTFLAMITYI

SEQ ID NO: 385124 - protein, 10 aa, Influenza virus
TFLAMITYIT

SEQ ID NO: 385125 - protein, 10 aa, Influenza virus
QPDWFRNVLS

SEQ ID NO: 385126 - protein, 10 aa, Influenza virus
FRNALSIAPI

SEQ ID NO: 385127 - protein, 10 aa, Influenza virus
RNALSIAPIM

SEQ ID NO: 385128 - protein, 10 aa, Influenza virus
NALSIAPIMF

SEQ ID NO: 385129 - protein, 10 aa, Influenza virus
ALSIAPIMFS

SEQ ID NO: 385130 - protein, 10 aa, Influenza virus
TAYWWDGLQS

SEQ ID NO: 385131 - protein, 10 aa, Influenza virus
AYWWDGLQSS

SEQ ID NO: 385132 - protein, 10 aa, Influenza virus
NRFYRTCKLL

SEQ ID NO: 385133 - protein, 10 aa, Influenza virus
TYRCHRGDAQ

SEQ ID NO: 385134 - protein, 10 aa, Influenza virus
YRCHRGDAQI

SEQ ID NO: 385135 - protein, 10 aa, Influenza virus
CNPLNPFVGH

SEQ ID NO: 385136 - protein, 10 aa, Influenza virus
DERMYQKCCN

SEQ ID NO: 385137 - protein, 10 aa, Influenza virus
ERMYQKCCNL

SEQ ID NO: 385138 - protein, 10 aa, Influenza virus
RMYQKCCNLF

SEQ ID NO: 385139 - protein, 10 aa, Influenza virus
GISSMVEAMM

SEQ ID NO: 385140 - protein, 10 aa, Influenza virus
ISSMVEAMMS

SEQ ID NO: 385141 - protein, 10 aa, Influenza virus
SSMVEAMMSR

SEQ ID NO: 385142 - protein, 10 aa, Influenza virus
SMVEAMMSRA

SEQ ID NO: 385143 - protein, 10 aa, Influenza virus
MVEAMMSRAR

SEQ ID NO: 385144 - protein, 10 aa, Influenza virus
VEAMMSRARI

SEQ ID NO: 385145 - protein, 10 aa, Influenza virus
ARVDSESGRI

SEQ ID NO: 385146 - protein, 10 aa, Influenza virus
QPRTREILTK

SEQ ID NO: 385147 - protein, 10 aa, Influenza virus
HYPKVYKPYF

SEQ ID NO: 385148 - protein, 10 aa, Influenza virus
GAFGPVHFRN

SEQ ID NO: 385149 - protein, 10 aa, Influenza virus
AFGPVHFRNQ

SEQ ID NO: 385150 - protein, 10 aa, Influenza virus
QVKIRRRVDM

SEQ ID NO: 385151 - protein, 10 aa, Influenza virus
VKIRRRVDMN

SEQ ID NO: 385152 - protein, 10 aa, Influenza virus
RRVDINPGHS

SEQ ID NO: 385153 - protein, 10 aa, Influenza virus
RVDINPGHSD

SEQ ID NO: 385154 - protein, 10 aa, Influenza virus
ARILASESQL

SEQ ID NO: 385155 - protein, 10 aa, Influenza virus
GGTSSMYIEV

SEQ ID NO: 385156 - protein, 10 aa, Influenza virus
GTGSIYIEVL

SEQ ID NO: 385157 - protein, 10 aa, Influenza virus
TGSIYIEVLH

SEQ ID NO: 385158 - protein, 10 aa, Influenza virus
GSIYIEVLHL

SEQ ID NO: 385159 - protein, 10 aa, Influenza virus
YTPGGEVIND

SEQ ID NO: 385160 - protein, 10 aa, Influenza virus
VKNDEVDQSL

SEQ ID NO: 385161 - protein, 10 aa, Influenza virus
RATVSADPLV

SEQ ID NO: 385162 - protein, 10 aa, Influenza virus
ATVSADPLVS

SEQ ID NO: 385163 - protein, 10 aa, Influenza virus
TVSADPLVSL

SEQ ID NO: 385164 - protein, 10 aa, Influenza virus
QAVNICKAAM

SEQ ID NO: 385165 - protein, 10 aa, Influenza virus
AVNICKAAMG

SEQ ID NO: 385166 - protein, 10 aa, Influenza virus
ICKAAMGMRI

SEQ ID NO: 385167 - protein, 10 aa, Influenza virus
CKAAMGMRIS

SEQ ID NO: 385168 - protein, 10 aa, Influenza virus
KAAMGMRISS

SEQ ID NO: 385169 - protein, 10 aa, Influenza virus
AAMGMRISSS

SEQ ID NO: 385170 - protein, 10 aa, Influenza virus
AMGMRISSSF

SEQ ID NO: 385171 - protein, 10 aa, Influenza virus
FTFKRTNGSS

SEQ ID NO: 385172 - protein, 10 aa, Influenza virus
LTGNLQALKI

SEQ ID NO: 385173 - protein, 10 aa, Influenza virus
EGYEEFTMIG

SEQ ID NO: 385174 - protein, 10 aa, Influenza virus
ATAIFRKATR

SEQ ID NO: 385175 - protein, 10 aa, Influenza virus
MVFSQEDCMM

SEQ ID NO: 385176 - protein, 10 aa, Influenza virus
VFSQEDRMIK

SEQ ID NO: 385177 - protein, 10 aa, Influenza virus
FSQEDRMIKA

SEQ ID NO: 385178 - protein, 10 aa, Influenza virus
QEDRMIKAVR

SEQ ID NO: 385179 - protein, 10 aa, Influenza virus
DRMIKAVRGD

SEQ ID NO: 385180 - protein, 10 aa, Influenza virus
LRHFQKDAKM

SEQ ID NO: 385181 - protein, 10 aa, Influenza virus
RHFQKDAKML

SEQ ID NO: 385182 - protein, 10 aa, Influenza virus
RVSRMGVDEY

SEQ ID NO: 385183 - protein, 10 aa, Influenza virus
SRMGVDEYSS

SEQ ID NO: 385184 - protein, 10 aa, Influenza virus
MGVDEYSSAE

SEQ ID NO: 385185 - protein, 10 aa, Influenza virus
GVDEYSSTEK

SEQ ID NO: 385186 - protein, 10 aa, Influenza virus
TVSIDRFLRV

SEQ ID NO: 385187 - protein, 10 aa, Influenza virus
DRFLRVRDQM

SEQ ID NO: 385188 - protein, 10 aa, Influenza virus
RFLRVRDQMG

SEQ ID NO: 385189 - protein, 10 aa, Influenza virus
FLRVRDQMGN

SEQ ID NO: 385190 - protein, 10 aa, Influenza virus
LGNILLSPEE

SEQ ID NO: 385191 - protein, 10 aa, Influenza virus
PEEISETQGT

SEQ ID NO: 385192 - protein, 10 aa, Influenza virus
EEISETQGTE

SEQ ID NO: 385193 - protein, 10 aa, Influenza virus
KLTITYSSPM

SEQ ID NO: 385194 - protein, 10 aa, Influenza virus
TYSSPMMWEI

SEQ ID NO: 385195 - protein, 10 aa, Influenza virus
SMMWEINGPD

SEQ ID NO: 385196 - protein, 10 aa, Influenza virus
LEFEPFQSLV

SEQ ID NO: 385197 - protein, 10 aa, Influenza virus
GTFDTVQVIK

SEQ ID NO: 385198 - protein, 10 aa, Influenza virus
TVQVIKLLPF

SEQ ID NO: 385199 - protein, 10 aa, Influenza virus
VQVIKLLPFA

SEQ ID NO: 385200 - protein, 10 aa, Influenza virus
APPEQSKMQF

SEQ ID NO: 385201 - protein, 10 aa, Influenza virus
PPEQSKMQFS

SEQ ID NO: 385202 - protein, 10 aa, Influenza virus
PEQSKMQFSS

SEQ ID NO: 385203 - protein, 10 aa, Influenza virus
LAVNVRGSGM

SEQ ID NO: 385204 - protein, 10 aa, Influenza virus
NVRGSGMRVL

SEQ ID NO: 385205 - protein, 10 aa, Influenza virus
RGSGLRILIR

SEQ ID NO: 385206 - protein, 10 aa, Influenza virus
GSGLRILIRG

SEQ ID NO: 385207 - protein, 10 aa, Influenza virus
GMRVLIRGNS

SEQ ID NO: 385208 - protein, 10 aa, Influenza virus
MRVLIRGNSP

SEQ ID NO: 385209 - protein, 10 aa, Influenza virus
GNSPVFNYSK

SEQ ID NO: 385210 - protein, 10 aa, Influenza virus
KRLAVLGKDA

SEQ ID NO: 385211 - protein, 10 aa, Influenza virus
GFLILGREDK

SEQ ID NO: 385212 - protein, 10 aa, Influenza virus
GKENKKYGPA

SEQ ID NO: 385213 - protein, 10 aa, Influenza virus
KENKKYGPAL

SEQ ID NO: 385214 - protein, 10 aa, Influenza virus
RRYGPALSIS

SEQ ID NO: 385215 - protein, 10 aa, Influenza virus
KRIRMAINYS

SEQ ID NO: 385216 - protein, 11 aa, Influenza virus
KQGKTKATKMK

SEQ ID NO: 385217 - protein, 11 aa, Influenza virus
QGKTKATKMKA

SEQ ID NO: 385218 - protein, 11 aa, Influenza virus
IFIFILLTHWA

SEQ ID NO: 385219 - protein, 11 aa, Influenza virus
FIFILLTHWAY

SEQ ID NO: 385220 - protein, 11 aa, Influenza virus
VLSCIFCLAFG

SEQ ID NO: 385221 - protein, 11 aa, Influenza virus
SQITNGTTGNP

SEQ ID NO: 385222 - protein, 11 aa, Influenza virus
QITNGTTGNPI

SEQ ID NO: 385223 - protein, 11 aa, Influenza virus
ITNGTTGNPII

SEQ ID NO: 385224 - protein, 11 aa, Influenza virus
TNGTTGNPIIC

SEQ ID NO: 385225 - protein, 11 aa, Influenza virus
NGTTGNPIICL

SEQ ID NO: 385226 - protein, 11 aa, Influenza virus
GTTGNPIICLG

SEQ ID NO: 385227 - protein, 11 aa, Influenza virus
TTGNPIICLGH

SEQ ID NO: 385228 - protein, 11 aa, Influenza virus
NNNNNTATLCL

SEQ ID NO: 385229 - protein, 11 aa, Influenza virus
NNSTATLCLGH

SEQ ID NO: 385230 - protein, 11 aa, Influenza virus
GVIPLTTTPTK

SEQ ID NO: 385231 - protein, 11 aa, Influenza virus
VIPLTTTPTKS

SEQ ID NO: 385232 - protein, 11 aa, Influenza virus
IPLTTTPTKSY

SEQ ID NO: 385233 - protein, 11 aa, Influenza virus
PLTTTPTKSYF

SEQ ID NO: 385234 - protein, 11 aa, Influenza virus
LTTTPTKSYFA

SEQ ID NO: 385235 - protein, 11 aa, Influenza virus
TTTPTKSYFAN

SEQ ID NO: 385236 - protein, 11 aa, Influenza virus
TTPTKSYFANL

SEQ ID NO: 385237 - protein, 11 aa, Influenza virus
TPTKSYFANLK

SEQ ID NO: 385238 - protein, 11 aa, Influenza virus
PTKSYFANLKG

SEQ ID NO: 385239 - protein, 11 aa, Influenza virus
TKSYFANLKGT

SEQ ID NO: 385240 - protein, 11 aa, Influenza virus
KSYFANLKGTR

SEQ ID NO: 385241 - protein, 11 aa, Influenza virus
SYFANLKGTRT

SEQ ID NO: 385242 - protein, 11 aa, Influenza virus
IMHDRTKIRQL

SEQ ID NO: 385243 - protein, 11 aa, Influenza virus
MHDRTKIRQLP

SEQ ID NO: 385244 - protein, 11 aa, Influenza virus
EKENSYPMINK

SEQ ID NO: 385245 - protein, 11 aa, Influenza virus
LTVEVPYVCTE

SEQ ID NO: 385246 - protein, 11 aa, Influenza virus
GVTTHYVSQIG

SEQ ID NO: 385247 - protein, 11 aa, Influenza virus
DEGLPQSGRIV

SEQ ID NO: 385248 - protein, 11 aa, Influenza virus
EGLPQSGRIVV

SEQ ID NO: 385249 - protein, 11 aa, Influenza virus
GLPQSGRIVVD

SEQ ID NO: 385250 - protein, 11 aa, Influenza virus
LPQSGRIVVDY

SEQ ID NO: 385251 - protein, 11 aa, Influenza virus
PQSGRIVVDYM

SEQ ID NO: 385252 - protein, 11 aa, Influenza virus
APSGIEYNGKS

SEQ ID NO: 385253 - protein, 11 aa, Influenza virus
SGIEYNGKSLG

SEQ ID NO: 385254 - protein, 11 aa, Influenza virus
GIEYNGKSLGI

SEQ ID NO: 385255 - protein, 11 aa, Influenza virus
IEYNGKSLGIQ

SEQ ID NO: 385256 - protein, 11 aa, Influenza virus
EYNGKSLGIQS

SEQ ID NO: 385257 - protein, 11 aa, Influenza virus
YNGKSLGIQSD

SEQ ID NO: 385258 - protein, 11 aa, Influenza virus
NGKSLGIQSDA

SEQ ID NO: 385259 - protein, 11 aa, Influenza virus
PSVKLPMGAIN

SEQ ID NO: 385260 - protein, 11 aa, Influenza virus
GAIGAIDSSMP

SEQ ID NO: 385261 - protein, 11 aa, Influenza virus
AIGAIDSSMPF

SEQ ID NO: 385262 - protein, 11 aa, Influenza virus
IGAIDSSMPFH

SEQ ID NO: 385263 - protein, 11 aa, Influenza virus
TSLTSLPFQNI

SEQ ID NO: 385264 - protein, 11 aa, Influenza virus
SLTSLPFQNIH

SEQ ID NO: 385265 - protein, 11 aa, Influenza virus
LTSLPFQNIHP

SEQ ID NO: 385266 - protein, 11 aa, Influenza virus
GEHAKAIGNCP

SEQ ID NO: 385267 - protein, 11 aa, Influenza virus
PAKLLKERGFF

SEQ ID NO: 385268 - protein, 11 aa, Influenza virus
REREGGRRRKR

SEQ ID NO: 385269 - protein, 11 aa, Influenza virus
EREGGRRRKRG

SEQ ID NO: 385270 - protein, 11 aa, Influenza virus
KKKRGLFGAIA

SEQ ID NO: 385271 - protein, 11 aa, Influenza virus
TRRQKRGLFGA

SEQ ID NO: 385272 - protein, 11 aa, Influenza virus
RRQKRGLFGAI

SEQ ID NO: 385273 - protein, 11 aa, Influenza virus
RQKRGLFGAIA

SEQ ID NO: 385274 - protein, 11 aa, Influenza virus
KKRGLFGAIAG

SEQ ID NO: 385275 - protein, 11 aa, Influenza virus
THKQLTHHMRK

SEQ ID NO: 385276 - protein, 11 aa, Influenza virus
HKQLTHHMRKK

SEQ ID NO: 385277 - protein, 11 aa, Influenza virus
KQLTHHMRKKR

SEQ ID NO: 385278 - protein, 11 aa, Influenza virus
QLTHHMRKKRG

SEQ ID NO: 385279 - protein, 11 aa, Influenza virus
LTHHMRKKRGL

SEQ ID NO: 385280 - protein, 11 aa, Influenza virus
THHMRKKRGLF

SEQ ID NO: 385281 - protein, 11 aa, Influenza virus
HHMRKKRGLFG

SEQ ID NO: 385282 - protein, 11 aa, Influenza virus
HMRKKRGLFGA

SEQ ID NO: 385283 - protein, 11 aa, Influenza virus
MRKKRGLFGAI

SEQ ID NO: 385284 - protein, 11 aa, Influenza virus
RKKRGLFGAIA

SEQ ID NO: 385285 - protein, 11 aa, Influenza virus
RMTRGLFGAIA

SEQ ID NO: 385286 - protein, 11 aa, Influenza virus
MTRGLFGAIAG

SEQ ID NO: 385287 - protein, 11 aa, Influenza virus
PRGLFGAIAGF

SEQ ID NO: 385288 - protein, 11 aa, Influenza virus
TKPRPRRGLFG

SEQ ID NO: 385289 - protein, 11 aa, Influenza virus
KPRPRRGLFGA

SEQ ID NO: 385290 - protein, 11 aa, Influenza virus
PRPRRGLFGAI

SEQ ID NO: 385291 - protein, 11 aa, Influenza virus
RPRRGLFGAIA

SEQ ID NO: 385292 - protein, 11 aa, Influenza virus
PRRGLFGAIAG

SEQ ID NO: 385293 - protein, 11 aa, Influenza virus
RRGLFGAIAGF

SEQ ID NO: 385294 - protein, 11 aa, Influenza virus
RGLFGAIAGFI

SEQ ID NO: 385295 - protein, 11 aa, Influenza virus
GLFGAIAGFIE

SEQ ID NO: 385296 - protein, 11 aa, Influenza virus
LFGAIAGFIEG

SEQ ID NO: 385297 - protein, 11 aa, Influenza virus
FGAIAGFIEGG

SEQ ID NO: 385298 - protein, 11 aa, Influenza virus
GAIAGFIEGGW

SEQ ID NO: 385299 - protein, 11 aa, Influenza virus
GRLVRFRHQNS

SEQ ID NO: 385300 - protein, 11 aa, Influenza virus
RLVRFRHQNSE

SEQ ID NO: 385301 - protein, 11 aa, Influenza virus
LPTFDSLNITA

SEQ ID NO: 385302 - protein, 11 aa, Influenza virus
PTFDSLNITAA

SEQ ID NO: 385303 - protein, 11 aa, Influenza virus
TFDSLNITAAS

SEQ ID NO: 385304 - protein, 11 aa, Influenza virus
FDSLNITAASL

SEQ ID NO: 385305 - protein, 11 aa, Influenza virus
DSLNITAASLN

SEQ ID NO: 385306 - protein, 11 aa, Influenza virus
SLNITAASLND

SEQ ID NO: 385307 - protein, 11 aa, Influenza virus
LNITAASLNDD

SEQ ID NO: 385308 - protein, 11 aa, Influenza virus
NITAASLNDDG

SEQ ID NO: 385309 - protein, 11 aa, Influenza virus
ITAASLNDDGL

SEQ ID NO: 385310 - protein, 11 aa, Influenza virus
VTTRQASPSCL

SEQ ID NO: 385311 - protein, 11 aa, Influenza virus
TTRQASPSCLV

SEQ ID NO: 385312 - protein, 11 aa, Influenza virus
TRQASPSCLVV

SEQ ID NO: 385313 - protein, 11 aa, Influenza virus
RQASPSCLVVR

SEQ ID NO: 385314 - protein, 11 aa, Influenza virus
QASPSCLVVRK

SEQ ID NO: 385315 - protein, 11 aa, Influenza virus
ASPSCLVVRKS

SEQ ID NO: 385316 - protein, 11 aa, Influenza virus
EFPSTGNHGSL

SEQ ID NO: 385317 - protein, 11 aa, Influenza virus
FPSTGNHGSLV

SEQ ID NO: 385318 - protein, 11 aa, Influenza virus
PSTGNHGSLVL

SEQ ID NO: 385319 - protein, 11 aa, Influenza virus
STGNHGSLVLS

SEQ ID NO: 385320 - protein, 11 aa, Influenza virus
TGNHGSLVLSL

SEQ ID NO: 385321 - protein, 11 aa, Influenza virus
GNHGSLVLSLW

SEQ ID NO: 385322 - protein, 11 aa, Influenza virus
NHGSLVLSLWM

SEQ ID NO: 385323 - protein, 11 aa, Influenza virus
LCSVEYASKTR

SEQ ID NO: 385324 - protein, 11 aa, Influenza virus
CSVEYASKTRI

SEQ ID NO: 385325 - protein, 11 aa, Influenza virus
SVEYASKTRIS

SEQ ID NO: 385326 - protein, 11 aa, Influenza virus
VEYASKTRISE

SEQ ID NO: 385327 - protein, 11 aa, Influenza virus
EYASKTRISEI

SEQ ID NO: 385328 - protein, 11 aa, Influenza virus
CIDFRDMRKNT

SEQ ID NO: 385329 - protein, 11 aa, Influenza virus
ILDQNFRNIRK

SEQ ID NO: 385330 - protein, 11 aa, Influenza virus
IGLREQKQEFK

SEQ ID NO: 385331 - protein, 11 aa, Influenza virus
GLREQKQEFKM

SEQ ID NO: 385332 - protein, 11 aa, Influenza virus
LREQKQEFKMN

SEQ ID NO: 385333 - protein, 11 aa, Influenza virus
REQKQEFKMNP

SEQ ID NO: 385334 - protein, 11 aa, Influenza virus
EQKQEFKMNPN

SEQ ID NO: 385335 - protein, 11 aa, Influenza virus
QKQEFKMNPNK

SEQ ID NO: 385336 - protein, 11 aa, Influenza virus
KQEFKMNPNKK

SEQ ID NO: 385337 - protein, 11 aa, Influenza virus
QEFKMNPNKKI

SEQ ID NO: 385338 - protein, 11 aa, Influenza virus
EFKMNPNKKII

SEQ ID NO: 385339 - protein, 11 aa, Influenza virus
KMNPNKKIITI

SEQ ID NO: 385340 - protein, 11 aa, Influenza virus
IIIAIGSVSRT

SEQ ID NO: 385341 - protein, 11 aa, Influenza virus
NRDITIGSICM

SEQ ID NO: 385342 - protein, 11 aa, Influenza virus
RDITIGSICMV

SEQ ID NO: 385343 - protein, 11 aa, Influenza virus
DITIGSICMVT

SEQ ID NO: 385344 - protein, 11 aa, Influenza virus
VPLVPCEPIII

SEQ ID NO: 385345 - protein, 11 aa, Influenza virus
PLVPCEPIIIE

SEQ ID NO: 385346 - protein, 11 aa, Influenza virus
LVPCEPIIIER

SEQ ID NO: 385347 - protein, 11 aa, Influenza virus
IRKGLILEYYS

SEQ ID NO: 385348 - protein, 11 aa, Influenza virus
REGLILEYYFV

SEQ ID NO: 385349 - protein, 11 aa, Influenza virus
YKYKIFKNGKK

SEQ ID NO: 385350 - protein, 11 aa, Influenza virus
KYKIFKNGKKG

SEQ ID NO: 385351 - protein, 11 aa, Influenza virus
GKKGKWLNQSK

SEQ ID NO: 385352 - protein, 11 aa, Influenza virus
IQHLEECSCYV

SEQ ID NO: 385353 - protein, 11 aa, Influenza virus
SYLNVRCVCRD

SEQ ID NO: 385354 - protein, 11 aa, Influenza virus
KLDINMADYSI

SEQ ID NO: 385355 - protein, 11 aa, Influenza virus
NNYGVKGFGFR

SEQ ID NO: 385356 - protein, 11 aa, Influenza virus
NYGVKGFGFRQ

SEQ ID NO: 385357 - protein, 11 aa, Influenza virus
IFLWCKIVTTV

SEQ ID NO: 385358 - protein, 11 aa, Influenza virus
FLWCKIVTTVG

SEQ ID NO: 385359 - protein, 11 aa, Influenza virus
LWCKIVTTVGW

SEQ ID NO: 385360 - protein, 11 aa, Influenza virus
WCKIVTTVGWS

SEQ ID NO: 385361 - protein, 11 aa, Influenza virus
CKIVTTVGWSW

SEQ ID NO: 385362 - protein, 11 aa, Influenza virus
KIVTTVGWSWP

SEQ ID NO: 385363 - protein, 11 aa, Influenza virus
IVTTVGWSWPD

SEQ ID NO: 385364 - protein, 11 aa, Influenza virus
VTTVGWSWPDG

SEQ ID NO: 385365 - protein, 11 aa, Influenza virus
TTVGWSWPDGA

SEQ ID NO: 385366 - protein, 11 aa, Influenza virus
RTSISCLYKLS

SEQ ID NO: 385367 - protein, 11 aa, Influenza virus
NLHAYISFRNL

SEQ ID NO: 385368 - protein, 11 aa, Influenza virus
IGLREQKQEFK

SEQ ID NO: 385369 - protein, 11 aa, Influenza virus
GLREQKQEFKM

SEQ ID NO: 385370 - protein, 11 aa, Influenza virus
LREQKQEFKMN

SEQ ID NO: 385371 - protein, 11 aa, Influenza virus
REQKQEFKMNP

SEQ ID NO: 385372 - protein, 11 aa, Influenza virus
EQKQEFKMNPN

SEQ ID NO: 385373 - protein, 11 aa, Influenza virus
QKQEFKMNPNK

SEQ ID NO: 385374 - protein, 11 aa, Influenza virus
KQEFKMNPNKK

SEQ ID NO: 385375 - protein, 11 aa, Influenza virus
QEFKMNPNKKI

SEQ ID NO: 385376 - protein, 11 aa, Influenza virus
EFKMNPNKKII

SEQ ID NO: 385377 - protein, 11 aa, Influenza virus
FKMNPNKKIIT

SEQ ID NO: 385378 - protein, 11 aa, Influenza virus
KMNPNKKIITI

SEQ ID NO: 385379 - protein, 11 aa, Influenza virus
NRDITIGSICM

SEQ ID NO: 385380 - protein, 11 aa, Influenza virus
RDITIGSICMV

SEQ ID NO: 385381 - protein, 11 aa, Influenza virus
DITIGSICMVT

SEQ ID NO: 385382 - protein, 11 aa, Influenza virus
DLNMGQPFYSH

SEQ ID NO: 385383 - protein, 11 aa, Influenza virus
IRIGSKGDVFV

SEQ ID NO: 385384 - protein, 11 aa, Influenza virus
FVIREPFISCS

SEQ ID NO: 385385 - protein, 11 aa, Influenza virus
LECRTFFLTQG

SEQ ID NO: 385386 - protein, 11 aa, Influenza virus
ECRTFFLTQGA

SEQ ID NO: 385387 - protein, 11 aa, Influenza virus
CRTFFLTQGAL

SEQ ID NO: 385388 - protein, 11 aa, Influenza virus
RTFFLTQGALL

SEQ ID NO: 385389 - protein, 11 aa, Influenza virus
TFFLTQGALLN

SEQ ID NO: 385390 - protein, 11 aa, Influenza virus
FFLTQGALLND

SEQ ID NO: 385391 - protein, 11 aa, Influenza virus
FLTQGALLNDK

SEQ ID NO: 385392 - protein, 11 aa, Influenza virus
LTQGALLNDKH

SEQ ID NO: 385393 - protein, 11 aa, Influenza virus
TQGALLNDKHS

SEQ ID NO: 385394 - protein, 11 aa, Influenza virus
QGALLNDKHSN

SEQ ID NO: 385395 - protein, 11 aa, Influenza virus
GALLNDKHSNG

SEQ ID NO: 385396 - protein, 11 aa, Influenza virus
ALLNDKHSNGT

SEQ ID NO: 385397 - protein, 11 aa, Influenza virus
LLNDKHSNGTI

SEQ ID NO: 385398 - protein, 11 aa, Influenza virus
RSPYRTLMSCP

SEQ ID NO: 385399 - protein, 11 aa, Influenza virus
GEVPSPYNSRF

SEQ ID NO: 385400 - protein, 11 aa, Influenza virus
EVPSPYNSRFE

SEQ ID NO: 385401 - protein, 11 aa, Influenza virus
VPSPYNSRFES

SEQ ID NO: 385402 - protein, 11 aa, Influenza virus
PSPYNSRFESV

SEQ ID NO: 385403 - protein, 11 aa, Influenza virus
SPYNSRFESVA

SEQ ID NO: 385404 - protein, 11 aa, Influenza virus
PYNSRFESVAW

SEQ ID NO: 385405 - protein, 11 aa, Influenza virus
YNSRFESVAWS

SEQ ID NO: 385406 - protein, 11 aa, Influenza virus
NSRFESVAWSA

SEQ ID NO: 385407 - protein, 11 aa, Influenza virus
SRFESVAWSAS

SEQ ID NO: 385408 - protein, 11 aa, Influenza virus
RFESVAWSASA

SEQ ID NO: 385409 - protein, 11 aa, Influenza virus
FESVAWSASAC

SEQ ID NO: 385410 - protein, 11 aa, Influenza virus
ESVAWSASACH

SEQ ID NO: 385411 - protein, 11 aa, Influenza virus
SVAWSASACHD

SEQ ID NO: 385412 - protein, 11 aa, Influenza virus
VAWSASACHDG

SEQ ID NO: 385413 - protein, 11 aa, Influenza virus
AWSASACHDGI

SEQ ID NO: 385414 - protein, 11 aa, Influenza virus
NWLTIGISGPD

SEQ ID NO: 385415 - protein, 11 aa, Influenza virus
TIGISGPDNGA

SEQ ID NO: 385416 - protein, 11 aa, Influenza virus
IGISGPDNGAV

SEQ ID NO: 385417 - protein, 11 aa, Influenza virus
GISGPDNGAVA

SEQ ID NO: 385418 - protein, 11 aa, Influenza virus
ISGPDNGAVAV

SEQ ID NO: 385419 - protein, 11 aa, Influenza virus
SGPDNGAVAVL

SEQ ID NO: 385420 - protein, 11 aa, Influenza virus
GPDNGAVAVLK

SEQ ID NO: 385421 - protein, 11 aa, Influenza virus
PDNGAVAVLKY

SEQ ID NO: 385422 - protein, 11 aa, Influenza virus
ILRTQESECAC

SEQ ID NO: 385423 - protein, 11 aa, Influenza virus
NGSCFTVMTDG

SEQ ID NO: 385424 - protein, 11 aa, Influenza virus
GSCFTVMTDGP

SEQ ID NO: 385425 - protein, 11 aa, Influenza virus
VMGQASYKIFK

SEQ ID NO: 385426 - protein, 11 aa, Influenza virus
YKYKIFKNGKK

SEQ ID NO: 385427 - protein, 11 aa, Influenza virus
KYKIFKNGKKG

SEQ ID NO: 385428 - protein, 11 aa, Influenza virus
GKKGKWLNQSK

SEQ ID NO: 385429 - protein, 11 aa, Influenza virus
APNYHYEECSC

SEQ ID NO: 385430 - protein, 11 aa, Influenza virus
PNYHYEECSCY

SEQ ID NO: 385431 - protein, 11 aa, Influenza virus
NYHYEECSCYP

SEQ ID NO: 385432 - protein, 11 aa, Influenza virus
CVCRDNWHGSN

SEQ ID NO: 385433 - protein, 11 aa, Influenza virus
VCRDNWHGSNR

SEQ ID NO: 385434 - protein, 11 aa, Influenza virus
CRDNWHGSNRP

SEQ ID NO: 385435 - protein, 11 aa, Influenza virus
RDNWHGSNRPW

SEQ ID NO: 385436 - protein, 11 aa, Influenza virus
DNWHGSNRPWV

SEQ ID NO: 385437 - protein, 11 aa, Influenza virus
NWHGSNRPWVS

SEQ ID NO: 385438 - protein, 11 aa, Influenza virus
WHGSNRPWVSF

SEQ ID NO: 385439 - protein, 11 aa, Influenza virus
GYICSGVFGDN

SEQ ID NO: 385440 - protein, 11 aa, Influenza virus
YICSGVFGDNP

SEQ ID NO: 385441 - protein, 11 aa, Influenza virus
ICSGVFGDNPR

SEQ ID NO: 385442 - protein, 11 aa, Influenza virus
YGNGVWIGRTK

SEQ ID NO: 385443 - protein, 11 aa, Influenza virus
GFEMIWDPNGW

SEQ ID NO: 385444 - protein, 11 aa, Influenza virus
TDWSGYSGSFV

SEQ ID NO: 385445 - protein, 11 aa, Influenza virus
DWSGYSGSFVQ

SEQ ID NO: 385446 - protein, 11 aa, Influenza virus
WSGYSGSFVQH

SEQ ID NO: 385447 - protein, 11 aa, Influenza virus
SGYSGSFVQHP

SEQ ID NO: 385448 - protein, 11 aa, Influenza virus
GYSGSFVQHPE

SEQ ID NO: 385449 - protein, 11 aa, Influenza virus
YSGSFVQHPEL

SEQ ID NO: 385450 - protein, 11 aa, Influenza virus
SGSFVQHPELT

SEQ ID NO: 385451 - protein, 11 aa, Influenza virus
GSFVQHPELTG

SEQ ID NO: 385452 - protein, 11 aa, Influenza virus
SFVQHPELTGL

SEQ ID NO: 385453 - protein, 11 aa, Influenza virus
DCIRPCFWVEL

SEQ ID NO: 385454 - protein, 11 aa, Influenza virus
CIRPCFWVELI

SEQ ID NO: 385455 - protein, 11 aa, Influenza virus
IRPCFWVELIR

SEQ ID NO: 385456 - protein, 11 aa, Influenza virus
RPCFWVELIRG

SEQ ID NO: 385457 - protein, 11 aa, Influenza virus
PCFWVELIRGR

SEQ ID NO: 385458 - protein, 11 aa, Influenza virus
CFWVELIRGRP

SEQ ID NO: 385459 - protein, 11 aa, Influenza virus
TTIWTSGSSIS

SEQ ID NO: 385460 - protein, 11 aa, Influenza virus
TIWTSGSSISF

SEQ ID NO: 385461 - protein, 11 aa, Influenza virus
IWTSGSSISFC

SEQ ID NO: 385462 - protein, 11 aa, Influenza virus
WTSGSSISFCG

SEQ ID NO: 385463 - protein, 11 aa, Influenza virus
TSGSSISFCGV

SEQ ID NO: 385464 - protein, 11 aa, Influenza virus
SGSSISFCGVN

SEQ ID NO: 385465 - protein, 11 aa, Influenza virus
IFLWCKIVTTV

SEQ ID NO: 385466 - protein, 11 aa, Influenza virus
FLWCKIVTTVG

SEQ ID NO: 385467 - protein, 11 aa, Influenza virus
LWCKIVTTVGW

SEQ ID NO: 385468 - protein, 11 aa, Influenza virus
WCKIVTTVGWS

SEQ ID NO: 385469 - protein, 11 aa, Influenza virus
CKIVTTVGWSW

SEQ ID NO: 385470 - protein, 11 aa, Influenza virus
KIVTTVGWSWP

SEQ ID NO: 385471 - protein, 11 aa, Influenza virus
IVTTVGWSWPD

SEQ ID NO: 385472 - protein, 11 aa, Influenza virus
VTTVGWSWPDG

SEQ ID NO: 385473 - protein, 11 aa, Influenza virus
TTVGWSWPDGA

SEQ ID NO: 385474 - protein, 11 aa, Influenza virus
WSWPDGAELPF

SEQ ID NO: 385475 - protein, 11 aa, Influenza virus
AKAGVKMNPNQ

SEQ ID NO: 385476 - protein, 11 aa, Influenza virus
KAGVKMNPNQK

SEQ ID NO: 385477 - protein, 11 aa, Influenza virus
AGVKMNPNQKI

SEQ ID NO: 385478 - protein, 11 aa, Influenza virus
GVKMNPNQKII

SEQ ID NO: 385479 - protein, 11 aa, Influenza virus
VKMNPNQKIIT

SEQ ID NO: 385480 - protein, 11 aa, Influenza virus
KMNPNQKIITI

SEQ ID NO: 385481 - protein, 11 aa, Influenza virus
IIIAIGSVSRT

SEQ ID NO: 385482 - protein, 11 aa, Influenza virus
KNNQVILCEPT

SEQ ID NO: 385483 - protein, 11 aa, Influenza virus
VPLVPCEPIII

SEQ ID NO: 385484 - protein, 11 aa, Influenza virus
PLVPCEPIIIE

SEQ ID NO: 385485 - protein, 11 aa, Influenza virus
LVPCEPIIIER

SEQ ID NO: 385486 - protein, 11 aa, Influenza virus
KTVVHLNSTTI

SEQ ID NO: 385487 - protein, 11 aa, Influenza virus
EKEKEICSVVL

SEQ ID NO: 385488 - protein, 11 aa, Influenza virus
KEKEICSVVLE

SEQ ID NO: 385489 - protein, 11 aa, Influenza virus
KDNSIRLSAGG

SEQ ID NO: 385490 - protein, 11 aa, Influenza virus
IWVTREPYVSC

SEQ ID NO: 385491 - protein, 11 aa, Influenza virus
KCYQFALGQGT

SEQ ID NO: 385492 - protein, 11 aa, Influenza virus
CYQFALGQGTT

SEQ ID NO: 385493 - protein, 11 aa, Influenza virus
YQFALGQGTTL

SEQ ID NO: 385494 - protein, 11 aa, Influenza virus
PYRTLLMNELG

SEQ ID NO: 385495 - protein, 11 aa, Influenza virus
YRTLLMNELGV

SEQ ID NO: 385496 - protein, 11 aa, Influenza virus
RTLLMNELGVP

SEQ ID NO: 385497 - protein, 11 aa, Influenza virus
TLLMNELGVPF

SEQ ID NO: 385498 - protein, 11 aa, Influenza virus
LLMNELGVPFH

SEQ ID NO: 385499 - protein, 11 aa, Influenza virus
LMNELGVPFHL

SEQ ID NO: 385500 - protein, 11 aa, Influenza virus
MNELGVPFHLG

SEQ ID NO: 385501 - protein, 11 aa, Influenza virus
NELGVPFHLGT

SEQ ID NO: 385502 - protein, 11 aa, Influenza virus
ELGVPFHLGTK

SEQ ID NO: 385503 - protein, 11 aa, Influenza virus
LGVPFHLGTKQ

SEQ ID NO: 385504 - protein, 11 aa, Influenza virus
GVPFHLGTKQV

SEQ ID NO: 385505 - protein, 11 aa, Influenza virus
VPFHLGTKQVC

SEQ ID NO: 385506 - protein, 11 aa, Influenza virus
KQVCIAWSSSS

SEQ ID NO: 385507 - protein, 11 aa, Influenza virus
QVCIAWSSSSC

SEQ ID NO: 385508 - protein, 11 aa, Influenza virus
VCIAWSSSSCH

SEQ ID NO: 385509 - protein, 11 aa, Influenza virus
CIAWSSSSCHD

SEQ ID NO: 385510 - protein, 11 aa, Influenza virus
IAWSSSSCHDG

SEQ ID NO: 385511 - protein, 11 aa, Influenza virus
AWSSSSCHDGK

SEQ ID NO: 385512 - protein, 11 aa, Influenza virus
WSSSSCHDGKA

SEQ ID NO: 385513 - protein, 11 aa, Influenza virus
SSSSCHDGKAW

SEQ ID NO: 385514 - protein, 11 aa, Influenza virus
SSSCHDGKAWL

SEQ ID NO: 385515 - protein, 11 aa, Influenza virus
SSCHDGKAWLH

SEQ ID NO: 385516 - protein, 11 aa, Influenza virus
ILRTQESECVC

SEQ ID NO: 385517 - protein, 11 aa, Influenza virus
LRTQESECVCI

SEQ ID NO: 385518 - protein, 11 aa, Influenza virus
RTQESECVCIN

SEQ ID NO: 385519 - protein, 11 aa, Influenza virus
CTVVMTDGSAS

SEQ ID NO: 385520 - protein, 11 aa, Influenza virus
IREGLILEYYF

SEQ ID NO: 385521 - protein, 11 aa, Influenza virus
REGLILEYYFV

SEQ ID NO: 385522 - protein, 11 aa, Influenza virus
GSAQHVEECSC

SEQ ID NO: 385523 - protein, 11 aa, Influenza virus
SAQHVEECSCY

SEQ ID NO: 385524 - protein, 11 aa, Influenza virus
AQHVEECSCYP

SEQ ID NO: 385525 - protein, 11 aa, Influenza virus
QHVEECSCYPR

SEQ ID NO: 385526 - protein, 11 aa, Influenza virus
SYLNVRCVCRD

SEQ ID NO: 385527 - protein, 11 aa, Influenza virus
VRCVCRDNWKG

SEQ ID NO: 385528 - protein, 11 aa, Influenza virus
RCVCRDNWKGS

SEQ ID NO: 385529 - protein, 11 aa, Influenza virus
CVCRDNWKGSN

SEQ ID NO: 385530 - protein, 11 aa, Influenza virus
VCRDNWKGSNR

SEQ ID NO: 385531 - protein, 11 aa, Influenza virus
CRDNWKGSNRP

SEQ ID NO: 385532 - protein, 11 aa, Influenza virus
RDNWKGSNRPI

SEQ ID NO: 385533 - protein, 11 aa, Influenza virus
KLDINMADYSI

SEQ ID NO: 385534 - protein, 11 aa, Influenza virus
YVCSGLVGDTP

SEQ ID NO: 385535 - protein, 11 aa, Influenza virus
VCSGLVGDTPR

SEQ ID NO: 385536 - protein, 11 aa, Influenza virus
CSGLVGDTPRK

SEQ ID NO: 385537 - protein, 11 aa, Influenza virus
CINRCFYVELI

SEQ ID NO: 385538 - protein, 11 aa, Influenza virus
INRCFYVELIR

SEQ ID NO: 385539 - protein, 11 aa, Influenza virus
NRCFYVELIRG

SEQ ID NO: 385540 - protein, 11 aa, Influenza virus
RCFYVELIRGR

SEQ ID NO: 385541 - protein, 11 aa, Influenza virus
TSNSIVVFCGT

SEQ ID NO: 385542 - protein, 11 aa, Influenza virus
VVFCGTSGTYG

SEQ ID NO: 385543 - protein, 11 aa, Influenza virus
VFCGTSGTYGT

SEQ ID NO: 385544 - protein, 11 aa, Influenza virus
FCGTSGTYGTG

SEQ ID NO: 385545 - protein, 11 aa, Influenza virus
CGTSGTYGTGS

SEQ ID NO: 385546 - protein, 11 aa, Influenza virus
GTSGTYGTGSW

SEQ ID NO: 385547 - protein, 11 aa, Influenza virus
TSGTYGTGSWP

SEQ ID NO: 385548 - protein, 11 aa, Influenza virus
SGTYGTGSWPD

SEQ ID NO: 385549 - protein, 11 aa, Influenza virus
GTYGTGSWPDG

SEQ ID NO: 385550 - protein, 11 aa, Influenza virus
TYGTGSWPDGA

SEQ ID NO: 385551 - protein, 11 aa, Influenza virus
GADINLHAYIS

SEQ ID NO: 385552 - protein, 11 aa, Influenza virus
RTSISCLYKLS

SEQ ID NO: 385553 - protein, 11 aa, Influenza virus
ADINLHAYISF

SEQ ID NO: 385554 - protein, 11 aa, Influenza virus
DINLHAYISFR

SEQ ID NO: 385555 - protein, 11 aa, Influenza virus
INLHAYISFRN

SEQ ID NO: 385556 - protein, 11 aa, Influenza virus
NLHAYISFRNL

SEQ ID NO: 385557 - protein, 11 aa, Influenza virus
LPLCPFRGFFP

SEQ ID NO: 385558 - protein, 11 aa, Influenza virus
PLCPFRGFFPF

SEQ ID NO: 385559 - protein, 11 aa, Influenza virus
LCPFRGFFPFH

SEQ ID NO: 385560 - protein, 11 aa, Influenza virus
CPFRGFFPFHK

SEQ ID NO: 385561 - protein, 11 aa, Influenza virus
PFRGFFPFHKD

SEQ ID NO: 385562 - protein, 11 aa, Influenza virus
FRGFFPFHKDN

SEQ ID NO: 385563 - protein, 11 aa, Influenza virus
RGFFPFHKDNA

SEQ ID NO: 385564 - protein, 11 aa, Influenza virus
GFFPFHKDNAI

SEQ ID NO: 385565 - protein, 11 aa, Influenza virus
FFPFHKDNAIR

SEQ ID NO: 385566 - protein, 11 aa, Influenza virus
FPFHKDNAIRL

SEQ ID NO: 385567 - protein, 11 aa, Influenza virus
PFHKDNAIRLG

SEQ ID NO: 385568 - protein, 11 aa, Influenza virus
FHKDNAIRLGE

SEQ ID NO: 385569 - protein, 11 aa, Influenza virus
HKDNAIRLGEN

SEQ ID NO: 385570 - protein, 11 aa, Influenza virus
IVTREPYVSCD

SEQ ID NO: 385571 - protein, 11 aa, Influenza virus
VTREPYVSCDN

SEQ ID NO: 385572 - protein, 11 aa, Influenza virus
CWSFALAQGAL

SEQ ID NO: 385573 - protein, 11 aa, Influenza virus
WSFALAQGALL

SEQ ID NO: 385574 - protein, 11 aa, Influenza virus
SFALAQGALLG

SEQ ID NO: 385575 - protein, 11 aa, Influenza virus
FALAQGALLGT

SEQ ID NO: 385576 - protein, 11 aa, Influenza virus
DRTPYRSLIRF

SEQ ID NO: 385577 - protein, 11 aa, Influenza virus
RTPYRSLIRFP

SEQ ID NO: 385578 - protein, 11 aa, Influenza virus
CIAWSSSSCFD

SEQ ID NO: 385579 - protein, 11 aa, Influenza virus
IAWSSSSCFDG

SEQ ID NO: 385580 - protein, 11 aa, Influenza virus
AWSSSSCFDGK

SEQ ID NO: 385581 - protein, 11 aa, Influenza virus
WSSSSCFDGKE

SEQ ID NO: 385582 - protein, 11 aa, Influenza virus
SSSSCFDGKEW

SEQ ID NO: 385583 - protein, 11 aa, Influenza virus
SSSCFDGKEWM

SEQ ID NO: 385584 - protein, 11 aa, Influenza virus
SSCFDGKEWMH

SEQ ID NO: 385585 - protein, 11 aa, Influenza virus
SCFDGKEWMHV

SEQ ID NO: 385586 - protein, 11 aa, Influenza virus
CFDGKEWMHVC

SEQ ID NO: 385587 - protein, 11 aa, Influenza virus
KDILRTQESEC

SEQ ID NO: 385588 - protein, 11 aa, Influenza virus
DILRTQESECQ

SEQ ID NO: 385589 - protein, 11 aa, Influenza virus
ILRTQESECQC

SEQ ID NO: 385590 - protein, 11 aa, Influenza virus
LRTQESECQCI

SEQ ID NO: 385591 - protein, 11 aa, Influenza virus
KIQHLEECSCY

SEQ ID NO: 385592 - protein, 11 aa, Influenza virus
IQHLEECSCYV

SEQ ID NO: 385593 - protein, 11 aa, Influenza virus
QHLEECSCYVD

SEQ ID NO: 385594 - protein, 11 aa, Influenza virus
DVYCICRDNWK

SEQ ID NO: 385595 - protein, 11 aa, Influenza virus
VYCICRDNWKG

SEQ ID NO: 385596 - protein, 11 aa, Influenza virus
YCICRDNWKGS

SEQ ID NO: 385597 - protein, 11 aa, Influenza virus
CICRDNWKGSN

SEQ ID NO: 385598 - protein, 11 aa, Influenza virus
ICRDNWKGSNR

SEQ ID NO: 385599 - protein, 11 aa, Influenza virus
CRDNWKGSNRP

SEQ ID NO: 385600 - protein, 11 aa, Influenza virus
RDNWKGSNRPW

SEQ ID NO: 385601 - protein, 11 aa, Influenza virus
DNWKGSNRPWM

SEQ ID NO: 385602 - protein, 11 aa, Influenza virus
NWKGSNRPWMR

SEQ ID NO: 385603 - protein, 11 aa, Influenza virus
WKGSNRPWMRI

SEQ ID NO: 385604 - protein, 11 aa, Influenza virus
GSNRPWMRINN

SEQ ID NO: 385605 - protein, 11 aa, Influenza virus
SNRPWMRINNE

SEQ ID NO: 385606 - protein, 11 aa, Influenza virus
NRPWMRINNET

SEQ ID NO: 385607 - protein, 11 aa, Influenza virus
RPWMRINNETI

SEQ ID NO: 385608 - protein, 11 aa, Influenza virus
INNETILETGY

SEQ ID NO: 385609 - protein, 11 aa, Influenza virus
NNETILETGYV

SEQ ID NO: 385610 - protein, 11 aa, Influenza virus
NETILETGYVC

SEQ ID NO: 385611 - protein, 11 aa, Influenza virus
ETILETGYVCS

SEQ ID NO: 385612 - protein, 11 aa, Influenza virus
TILETGYVCSK

SEQ ID NO: 385613 - protein, 11 aa, Influenza virus
ILETGYVCSKF

SEQ ID NO: 385614 - protein, 11 aa, Influenza virus
LETGYVCSKFH

SEQ ID NO: 385615 - protein, 11 aa, Influenza virus
ETGYVCSKFHS

SEQ ID NO: 385616 - protein, 11 aa, Influenza virus
TGYVCSKFHSD

SEQ ID NO: 385617 - protein, 11 aa, Influenza virus
GYVCSKFHSDT

SEQ ID NO: 385618 - protein, 11 aa, Influenza virus
YVCSKFHSDTP

SEQ ID NO: 385619 - protein, 11 aa, Influenza virus
VCSKFHSDTPR

SEQ ID NO: 385620 - protein, 11 aa, Influenza virus
CSKFHSDTPRP

SEQ ID NO: 385621 - protein, 11 aa, Influenza virus
KFHSDTPRPAD

SEQ ID NO: 385622 - protein, 11 aa, Influenza virus
FHSDTPRPADP

SEQ ID NO: 385623 - protein, 11 aa, Influenza virus
HSDTPRPADPS

SEQ ID NO: 385624 - protein, 11 aa, Influenza virus
TQTLVSNNDWS

SEQ ID NO: 385625 - protein, 11 aa, Influenza virus
QTLVSNNDWSG

SEQ ID NO: 385626 - protein, 11 aa, Influenza virus
TLVSNNDWSGY

SEQ ID NO: 385627 - protein, 11 aa, Influenza virus
LVSNNDWSGYS

SEQ ID NO: 385628 - protein, 11 aa, Influenza virus
VSNNDWSGYSG

SEQ ID NO: 385629 - protein, 11 aa, Influenza virus
SNNDWSGYSGS

SEQ ID NO: 385630 - protein, 11 aa, Influenza virus
NNDWSGYSGSF

SEQ ID NO: 385631 - protein, 11 aa, Influenza virus
NDWSGYSGSFI

SEQ ID NO: 385632 - protein, 11 aa, Influenza virus
DWSGYSGSFIV

SEQ ID NO: 385633 - protein, 11 aa, Influenza virus
DCFQPCFYVEL

SEQ ID NO: 385634 - protein, 11 aa, Influenza virus
CFQPCFYVELI

SEQ ID NO: 385635 - protein, 11 aa, Influenza virus
FQPCFYVELIR

SEQ ID NO: 385636 - protein, 11 aa, Influenza virus
QPCFYVELIRG

SEQ ID NO: 385637 - protein, 11 aa, Influenza virus
PCFYVELIRGR

SEQ ID NO: 385638 - protein, 11 aa, Influenza virus
VSWTSNSIVTF

SEQ ID NO: 385639 - protein, 11 aa, Influenza virus
SWTSNSIVTFC

SEQ ID NO: 385640 - protein, 11 aa, Influenza virus
WTSNSIVTFCG

SEQ ID NO: 385641 - protein, 11 aa, Influenza virus
TSNSIVTFCGL

SEQ ID NO: 385642 - protein, 11 aa, Influenza virus
SNSIVTFCGLD

SEQ ID NO: 385643 - protein, 11 aa, Influenza virus
NSIVTFCGLDN

SEQ ID NO: 385644 - protein, 11 aa, Influenza virus
SIVTFCGLDNE

SEQ ID NO: 385645 - protein, 11 aa, Influenza virus
IVTFCGLDNEP

SEQ ID NO: 385646 - protein, 11 aa, Influenza virus
VTFCGLDNEPG

SEQ ID NO: 385647 - protein, 11 aa, Influenza virus
TFCGLDNEPGS

SEQ ID NO: 385648 - protein, 11 aa, Influenza virus
FCGLDNEPGSG

SEQ ID NO: 385649 - protein, 11 aa, Influenza virus
LDNEPGSGNWP

SEQ ID NO: 385650 - protein, 11 aa, Influenza virus
DNEPGSGNWPD

SEQ ID NO: 385651 - protein, 11 aa, Influenza virus
NEPGSGNWPDG

SEQ ID NO: 385652 - protein, 11 aa, Influenza virus
EPGSGNWPDGS

SEQ ID NO: 385653 - protein, 11 aa, Influenza virus
WPDGSNIGFMP

SEQ ID NO: 385654 - protein, 11 aa, Influenza virus
PDGSNIGFMPK

SEQ ID NO: 385655 - protein, 11 aa, Influenza virus
MNPNQKIITIG

SEQ ID NO: 385656 - protein, 11 aa, Influenza virus
NPNQKIITIGS

SEQ ID NO: 385657 - protein, 11 aa, Influenza virus
PNQKIITIGSI

SEQ ID NO: 385658 - protein, 11 aa, Influenza virus
LTTVGLLLQIT

SEQ ID NO: 385659 - protein, 11 aa, Influenza virus
TTVGLLLQITS

SEQ ID NO: 385660 - protein, 11 aa, Influenza virus
TVGLLLQITSL

SEQ ID NO: 385661 - protein, 11 aa, Influenza virus
VGLLLQITSLC

SEQ ID NO: 385662 - protein, 11 aa, Influenza virus
GLLLQITSLCS

SEQ ID NO: 385663 - protein, 11 aa, Influenza virus
LLLQITSLCSI

SEQ ID NO: 385664 - protein, 11 aa, Influenza virus
LLQITSLCSIW

SEQ ID NO: 385665 - protein, 11 aa, Influenza virus
LQITSLCSIWF

SEQ ID NO: 385666 - protein, 11 aa, Influenza virus
QITSLCSIWFS

SEQ ID NO: 385667 - protein, 11 aa, Influenza virus
ITSLCSIWFSH

SEQ ID NO: 385668 - protein, 11 aa, Influenza virus
TSLCSIWFSHY

SEQ ID NO: 385669 - protein, 11 aa, Influenza virus
SLCSIWFSHYN

SEQ ID NO: 385670 - protein, 11 aa, Influenza virus
LCSIWFSHYNQ

SEQ ID NO: 385671 - protein, 11 aa, Influenza virus
CSIWFSHYNQV

SEQ ID NO: 385672 - protein, 11 aa, Influenza virus
SIWFSHYNQVT

SEQ ID NO: 385673 - protein, 11 aa, Influenza virus
IWFSHYNQVTQ

SEQ ID NO: 385674 - protein, 11 aa, Influenza virus
WFSHYNQVTQT

SEQ ID NO: 385675 - protein, 11 aa, Influenza virus
CSNNTTNYYNE

SEQ ID NO: 385676 - protein, 11 aa, Influenza virus
SNNTTNYYNET

SEQ ID NO: 385677 - protein, 11 aa, Influenza virus
NNTTNYYNETF

SEQ ID NO: 385678 - protein, 11 aa, Influenza virus
NTTNYYNETFV

SEQ ID NO: 385679 - protein, 11 aa, Influenza virus
TTNYYNETFVN

SEQ ID NO: 385680 - protein, 11 aa, Influenza virus
TNYYNETFVNV

SEQ ID NO: 385681 - protein, 11 aa, Influenza virus
NYYNETFVNVT

SEQ ID NO: 385682 - protein, 11 aa, Influenza virus
YYNETFVNVTN

SEQ ID NO: 385683 - protein, 11 aa, Influenza virus
YNETFVNVTNV

SEQ ID NO: 385684 - protein, 11 aa, Influenza virus
NETFVNVTNVQ

SEQ ID NO: 385685 - protein, 11 aa, Influenza virus
ETFVNVTNVQN

SEQ ID NO: 385686 - protein, 11 aa, Influenza virus
TFVNVTNVQNN

SEQ ID NO: 385687 - protein, 11 aa, Influenza virus
FVNVTNVQNNY

SEQ ID NO: 385688 - protein, 11 aa, Influenza virus
VNVTNVQNNYT

SEQ ID NO: 385689 - protein, 11 aa, Influenza virus
NVTNVQNNYTT

SEQ ID NO: 385690 - protein, 11 aa, Influenza virus
LCPIRGWAPLS

SEQ ID NO: 385691 - protein, 11 aa, Influenza virus
CPIRGWAPLSK

SEQ ID NO: 385692 - protein, 11 aa, Influenza virus
PIRGWAPLSKD

SEQ ID NO: 385693 - protein, 11 aa, Influenza virus
IRGWAPLSKDN

SEQ ID NO: 385694 - protein, 11 aa, Influenza virus
RGWAPLSKDNG

SEQ ID NO: 385695 - protein, 11 aa, Influenza virus
GWAPLSKDNGI

SEQ ID NO: 385696 - protein, 11 aa, Influenza virus
WAPLSKDNGIR

SEQ ID NO: 385697 - protein, 11 aa, Influenza virus
APLSKDNGIRI

SEQ ID NO: 385698 - protein, 11 aa, Influenza virus
PLSKDNGIRIG

SEQ ID NO: 385699 - protein, 11 aa, Influenza virus
LSKDNGIRIGS

SEQ ID NO: 385700 - protein, 11 aa, Influenza virus
SKDNGIRIGSR

SEQ ID NO: 385701 - protein, 11 aa, Influenza virus
KDNGIRIGSRG

SEQ ID NO: 385702 - protein, 11 aa, Influenza virus
DNGIRIGSRGE

SEQ ID NO: 385703 - protein, 11 aa, Influenza virus
NGIRIGSRGEV

SEQ ID NO: 385704 - protein, 11 aa, Influenza virus
GIRIGSRGEVF

SEQ ID NO: 385705 - protein, 11 aa, Influenza virus
IRIGSRGEVFV

SEQ ID NO: 385706 - protein, 11 aa, Influenza virus
RIGSRGEVFVI

SEQ ID NO: 385707 - protein, 11 aa, Influenza virus
IGSRGEVFVIR

SEQ ID NO: 385708 - protein, 11 aa, Influenza virus
GSRGEVFVIRE

SEQ ID NO: 385709 - protein, 11 aa, Influenza virus
SRGEVFVIREP

SEQ ID NO: 385710 - protein, 11 aa, Influenza virus
RGEVFVIREPF

SEQ ID NO: 385711 - protein, 11 aa, Influenza virus
GEVFVIREPFI

SEQ ID NO: 385712 - protein, 11 aa, Influenza virus
EVFVIREPFIS

SEQ ID NO: 385713 - protein, 11 aa, Influenza virus
VFVIREPFISC

SEQ ID NO: 385714 - protein, 11 aa, Influenza virus
FVIREPFISCS

SEQ ID NO: 385715 - protein, 11 aa, Influenza virus
VIREPFISCSI

SEQ ID NO: 385716 - protein, 11 aa, Influenza virus
ISCSISECRTF

SEQ ID NO: 385717 - protein, 11 aa, Influenza virus
SCSISECRTFF

SEQ ID NO: 385718 - protein, 11 aa, Influenza virus
CSISECRTFFL

SEQ ID NO: 385719 - protein, 11 aa, Influenza virus
SISECRTFFLT

SEQ ID NO: 385720 - protein, 11 aa, Influenza virus
ISECRTFFLTQ

SEQ ID NO: 385721 - protein, 11 aa, Influenza virus
SECRTFFLTQG

SEQ ID NO: 385722 - protein, 11 aa, Influenza virus
ECRTFFLTQGA

SEQ ID NO: 385723 - protein, 11 aa, Influenza virus
CRTFFLTQGAL

SEQ ID NO: 385724 - protein, 11 aa, Influenza virus
RTFFLTQGALL

SEQ ID NO: 385725 - protein, 11 aa, Influenza virus
TFFLTQGALLN

SEQ ID NO: 385726 - protein, 11 aa, Influenza virus
FFLTQGALLND

SEQ ID NO: 385727 - protein, 11 aa, Influenza virus
FLTQGALLNDK

SEQ ID NO: 385728 - protein, 11 aa, Influenza virus
LTQGALLNDKH

SEQ ID NO: 385729 - protein, 11 aa, Influenza virus
TQGALLNDKHS

SEQ ID NO: 385730 - protein, 11 aa, Influenza virus
QGALLNDKHSN

SEQ ID NO: 385731 - protein, 11 aa, Influenza virus
GALLNDKHSNG

SEQ ID NO: 385732 - protein, 11 aa, Influenza virus
ALLNDKHSNGT

SEQ ID NO: 385733 - protein, 11 aa, Influenza virus
LLNDKHSNGTV

SEQ ID NO: 385734 - protein, 11 aa, Influenza virus
LNDKHSNGTVK

SEQ ID NO: 385735 - protein, 11 aa, Influenza virus
NDKHSNGTVKD

SEQ ID NO: 385736 - protein, 11 aa, Influenza virus
DKHSNGTVKDR

SEQ ID NO: 385737 - protein, 11 aa, Influenza virus
KHSNGTVKDRS

SEQ ID NO: 385738 - protein, 11 aa, Influenza virus
HSNGTVKDRSP

SEQ ID NO: 385739 - protein, 11 aa, Influenza virus
SNGTVKDRSPF

SEQ ID NO: 385740 - protein, 11 aa, Influenza virus
NGTVKDRSPFR

SEQ ID NO: 385741 - protein, 11 aa, Influenza virus
GTVKDRSPFRT

SEQ ID NO: 385742 - protein, 11 aa, Influenza virus
TVKDRSPFRTL

SEQ ID NO: 385743 - protein, 11 aa, Influenza virus
VKDRSPFRTLM

SEQ ID NO: 385744 - protein, 11 aa, Influenza virus
KDRSPFRTLMS

SEQ ID NO: 385745 - protein, 11 aa, Influenza virus
DRSPFRTLMSC

SEQ ID NO: 385746 - protein, 11 aa, Influenza virus
RSPFRTLMSCP

SEQ ID NO: 385747 - protein, 11 aa, Influenza virus
SPFRTLMSCPI

SEQ ID NO: 385748 - protein, 11 aa, Influenza virus
PFRTLMSCPIG

SEQ ID NO: 385749 - protein, 11 aa, Influenza virus
FRTLMSCPIGV

SEQ ID NO: 385750 - protein, 11 aa, Influenza virus
RTLMSCPIGVA

SEQ ID NO: 385751 - protein, 11 aa, Influenza virus
TLMSCPIGVAP

SEQ ID NO: 385752 - protein, 11 aa, Influenza virus
LMSCPIGVAPS

SEQ ID NO: 385753 - protein, 11 aa, Influenza virus
MSCPIGVAPSP

SEQ ID NO: 385754 - protein, 11 aa, Influenza virus
SCPIGVAPSPS

SEQ ID NO: 385755 - protein, 11 aa, Influenza virus
CPIGVAPSPSN

SEQ ID NO: 385756 - protein, 11 aa, Influenza virus
PIGVAPSPSNS

SEQ ID NO: 385757 - protein, 11 aa, Influenza virus
IGVAPSPSNSR

SEQ ID NO: 385758 - protein, 11 aa, Influenza virus
GVAPSPSNSRF

SEQ ID NO: 385759 - protein, 11 aa, Influenza virus
VAPSPSNSRFE

SEQ ID NO: 385760 - protein, 11 aa, Influenza virus
APSPSNSRFES

SEQ ID NO: 385761 - protein, 11 aa, Influenza virus
PSPSNSRFESV

SEQ ID NO: 385762 - protein, 11 aa, Influenza virus
SPSNSRFESVA

SEQ ID NO: 385763 - protein, 11 aa, Influenza virus
PSNSRFESVAW

SEQ ID NO: 385764 - protein, 11 aa, Influenza virus
SNSRFESVAWS

SEQ ID NO: 385765 - protein, 11 aa, Influenza virus
NSRFESVAWSA

SEQ ID NO: 385766 - protein, 11 aa, Influenza virus
SRFESVAWSAT

SEQ ID NO: 385767 - protein, 11 aa, Influenza virus
RFESVAWSATA

SEQ ID NO: 385768 - protein, 11 aa, Influenza virus
FESVAWSATAC

SEQ ID NO: 385769 - protein, 11 aa, Influenza virus
ESVAWSATACS

SEQ ID NO: 385770 - protein, 11 aa, Influenza virus
SVAWSATACSD

SEQ ID NO: 385771 - protein, 11 aa, Influenza virus
VAWSATACSDG

SEQ ID NO: 385772 - protein, 11 aa, Influenza virus
AWSATACSDGP

SEQ ID NO: 385773 - protein, 11 aa, Influenza virus
WSATACSDGPG

SEQ ID NO: 385774 - protein, 11 aa, Influenza virus
SATACSDGPGW

SEQ ID NO: 385775 - protein, 11 aa, Influenza virus
ATACSDGPGWL

SEQ ID NO: 385776 - protein, 11 aa, Influenza virus
TACSDGPGWLT

SEQ ID NO: 385777 - protein, 11 aa, Influenza virus
ACSDGPGWLTL

SEQ ID NO: 385778 - protein, 11 aa, Influenza virus
CSDGPGWLTLG

SEQ ID NO: 385779 - protein, 11 aa, Influenza virus
SDGPGWLTLGI

SEQ ID NO: 385780 - protein, 11 aa, Influenza virus
DGPGWLTLGIT

SEQ ID NO: 385781 - protein, 11 aa, Influenza virus
GPGWLTLGITG

SEQ ID NO: 385782 - protein, 11 aa, Influenza virus
PGWLTLGITGP

SEQ ID NO: 385783 - protein, 11 aa, Influenza virus
GWLTLGITGPD

SEQ ID NO: 385784 - protein, 11 aa, Influenza virus
WLTLGITGPDA

SEQ ID NO: 385785 - protein, 11 aa, Influenza virus
LTLGITGPDAT

SEQ ID NO: 385786 - protein, 11 aa, Influenza virus
TLGITGPDATA

SEQ ID NO: 385787 - protein, 11 aa, Influenza virus
LGITGPDATAV

SEQ ID NO: 385788 - protein, 11 aa, Influenza virus
GITGPDATAVA

SEQ ID NO: 385789 - protein, 11 aa, Influenza virus
ITGPDATAVAV

SEQ ID NO: 385790 - protein, 11 aa, Influenza virus
TGPDATAVAVL

SEQ ID NO: 385791 - protein, 11 aa, Influenza virus
GPDATAVAVLK

SEQ ID NO: 385792 - protein, 11 aa, Influenza virus
PDATAVAVLKY

SEQ ID NO: 385793 - protein, 11 aa, Influenza virus
DATAVAVLKYN

SEQ ID NO: 385794 - protein, 11 aa, Influenza virus
ATAVAVLKYNG

SEQ ID NO: 385795 - protein, 11 aa, Influenza virus
TAVAVLKYNGI

SEQ ID NO: 385796 - protein, 11 aa, Influenza virus
AVAVLKYNGII

SEQ ID NO: 385797 - protein, 11 aa, Influenza virus
VAVLKYNGIIT

SEQ ID NO: 385798 - protein, 11 aa, Influenza virus
AVLKYNGIITD

SEQ ID NO: 385799 - protein, 11 aa, Influenza virus
VLKYNGIITDT

SEQ ID NO: 385800 - protein, 11 aa, Influenza virus
LKYNGIITDTL

SEQ ID NO: 385801 - protein, 11 aa, Influenza virus
KYNGIITDTLK

SEQ ID NO: 385802 - protein, 11 aa, Influenza virus
YNGIITDTLKS

SEQ ID NO: 385803 - protein, 11 aa, Influenza virus
NGIITDTLKSW

SEQ ID NO: 385804 - protein, 11 aa, Influenza virus
GIITDTLKSWK

SEQ ID NO: 385805 - protein, 11 aa, Influenza virus
IITDTLKSWKG

SEQ ID NO: 385806 - protein, 11 aa, Influenza virus
ITDTLKSWKGN

SEQ ID NO: 385807 - protein, 11 aa, Influenza virus
TDTLKSWKGNI

SEQ ID NO: 385808 - protein, 11 aa, Influenza virus
DTLKSWKGNIM

SEQ ID NO: 385809 - protein, 11 aa, Influenza virus
TLKSWKGNIMR

SEQ ID NO: 385810 - protein, 11 aa, Influenza virus
LKSWKGNIMRT

SEQ ID NO: 385811 - protein, 11 aa, Influenza virus
KSWKGNIMRTQ

SEQ ID NO: 385812 - protein, 11 aa, Influenza virus
SWKGNIMRTQE

SEQ ID NO: 385813 - protein, 11 aa, Influenza virus
WKGNIMRTQES

SEQ ID NO: 385814 - protein, 11 aa, Influenza virus
KGNIMRTQESE

SEQ ID NO: 385815 - protein, 11 aa, Influenza virus
GNIMRTQESEC

SEQ ID NO: 385816 - protein, 11 aa, Influenza virus
NIMRTQESECV

SEQ ID NO: 385817 - protein, 11 aa, Influenza virus
IMRTQESECVC

SEQ ID NO: 385818 - protein, 11 aa, Influenza virus
MRTQESECVCQ

SEQ ID NO: 385819 - protein, 11 aa, Influenza virus
RTQESECVCQD

SEQ ID NO: 385820 - protein, 11 aa, Influenza virus
TQESECVCQDE

SEQ ID NO: 385821 - protein, 11 aa, Influenza virus
QESECVCQDEF

SEQ ID NO: 385822 - protein, 11 aa, Influenza virus
ESECVCQDEFC

SEQ ID NO: 385823 - protein, 11 aa, Influenza virus
SECVCQDEFCY

SEQ ID NO: 385824 - protein, 11 aa, Influenza virus
ECVCQDEFCYT

SEQ ID NO: 385825 - protein, 11 aa, Influenza virus
CVCQDEFCYTL

SEQ ID NO: 385826 - protein, 11 aa, Influenza virus
VCQDEFCYTLI

SEQ ID NO: 385827 - protein, 11 aa, Influenza virus
CQDEFCYTLIT

SEQ ID NO: 385828 - protein, 11 aa, Influenza virus
QDEFCYTLITD

SEQ ID NO: 385829 - protein, 11 aa, Influenza virus
DEFCYTLITDG

SEQ ID NO: 385830 - protein, 11 aa, Influenza virus
EFCYTLITDGP

SEQ ID NO: 385831 - protein, 11 aa, Influenza virus
FCYTLITDGPS

SEQ ID NO: 385832 - protein, 11 aa, Influenza virus
CYTLITDGPSD

SEQ ID NO: 385833 - protein, 11 aa, Influenza virus
YTLITDGPSDA

SEQ ID NO: 385834 - protein, 11 aa, Influenza virus
TLITDGPSDAQ

SEQ ID NO: 385835 - protein, 11 aa, Influenza virus
LITDGPSDAQA

SEQ ID NO: 385836 - protein, 11 aa, Influenza virus
ITDGPSDAQAF

SEQ ID NO: 385837 - protein, 11 aa, Influenza virus
TDGPSDAQAFY

SEQ ID NO: 385838 - protein, 11 aa, Influenza virus
DGPSDAQAFYK

SEQ ID NO: 385839 - protein, 11 aa, Influenza virus
GPSDAQAFYKI

SEQ ID NO: 385840 - protein, 11 aa, Influenza virus
PSDAQAFYKIL

SEQ ID NO: 385841 - protein, 11 aa, Influenza virus
SDAQAFYKILK

SEQ ID NO: 385842 - protein, 11 aa, Influenza virus
DAQAFYKILKI

SEQ ID NO: 385843 - protein, 11 aa, Influenza virus
AQAFYKILKIR

SEQ ID NO: 385844 - protein, 11 aa, Influenza virus
QAFYKILKIRK

SEQ ID NO: 385845 - protein, 11 aa, Influenza virus
AFYKILKIRKG

SEQ ID NO: 385846 - protein, 11 aa, Influenza virus
FYKILKIRKGK

SEQ ID NO: 385847 - protein, 11 aa, Influenza virus
YKILKIRKGKI

SEQ ID NO: 385848 - protein, 11 aa, Influenza virus
KILKIRKGKIV

SEQ ID NO: 385849 - protein, 11 aa, Influenza virus
ATGFHFEECSC

SEQ ID NO: 385850 - protein, 11 aa, Influenza virus
TGFHFEECSCY

SEQ ID NO: 385851 - protein, 11 aa, Influenza virus
GFHFEECSCYP

SEQ ID NO: 385852 - protein, 11 aa, Influenza virus
FHFEECSCYPS

SEQ ID NO: 385853 - protein, 11 aa, Influenza virus
HFEECSCYPSG

SEQ ID NO: 385854 - protein, 11 aa, Influenza virus
FEECSCYPSGT

SEQ ID NO: 385855 - protein, 11 aa, Influenza virus
EECSCYPSGTD

SEQ ID NO: 385856 - protein, 11 aa, Influenza virus
IECVCRDNWRG

SEQ ID NO: 385857 - protein, 11 aa, Influenza virus
ECVCRDNWRGS

SEQ ID NO: 385858 - protein, 11 aa, Influenza virus
CVCRDNWRGSN

SEQ ID NO: 385859 - protein, 11 aa, Influenza virus
VCRDNWRGSNR

SEQ ID NO: 385860 - protein, 11 aa, Influenza virus
CRDNWRGSNRP

SEQ ID NO: 385861 - protein, 11 aa, Influenza virus
RDNWRGSNRPW

SEQ ID NO: 385862 - protein, 11 aa, Influenza virus
DNWRGSNRPWI

SEQ ID NO: 385863 - protein, 11 aa, Influenza virus
NWRGSNRPWIR

SEQ ID NO: 385864 - protein, 11 aa, Influenza virus
WRGSNRPWIRF

SEQ ID NO: 385865 - protein, 11 aa, Influenza virus
RGSNRPWIRFN

SEQ ID NO: 385866 - protein, 11 aa, Influenza virus
GSNRPWIRFNS

SEQ ID NO: 385867 - protein, 11 aa, Influenza virus
SNRPWIRFNSD

SEQ ID NO: 385868 - protein, 11 aa, Influenza virus
NRPWIRFNSDL

SEQ ID NO: 385869 - protein, 11 aa, Influenza virus
RPWIRFNSDLD

SEQ ID NO: 385870 - protein, 11 aa, Influenza virus
PWIRFNSDLDY

SEQ ID NO: 385871 - protein, 11 aa, Influenza virus
WIRFNSDLDYQ

SEQ ID NO: 385872 - protein, 11 aa, Influenza virus
IRFNSDLDYQI

SEQ ID NO: 385873 - protein, 11 aa, Influenza virus
RFNSDLDYQIG

SEQ ID NO: 385874 - protein, 11 aa, Influenza virus
FNSDLDYQIGY

SEQ ID NO: 385875 - protein, 11 aa, Influenza virus
NSDLDYQIGYV

SEQ ID NO: 385876 - protein, 11 aa, Influenza virus
SDLDYQIGYVC

SEQ ID NO: 385877 - protein, 11 aa, Influenza virus
DLDYQIGYVCS

SEQ ID NO: 385878 - protein, 11 aa, Influenza virus
LDYQIGYVCSG

SEQ ID NO: 385879 - protein, 11 aa, Influenza virus
DYQIGYVCSGI

SEQ ID NO: 385880 - protein, 11 aa, Influenza virus
YQIGYVCSGIF

SEQ ID NO: 385881 - protein, 11 aa, Influenza virus
QIGYVCSGIFG

SEQ ID NO: 385882 - protein, 11 aa, Influenza virus
IGYVCSGIFGD

SEQ ID NO: 385883 - protein, 11 aa, Influenza virus
GYVCSGIFGDN

SEQ ID NO: 385884 - protein, 11 aa, Influenza virus
YVCSGIFGDNP

SEQ ID NO: 385885 - protein, 11 aa, Influenza virus
VCSGIFGDNPR

SEQ ID NO: 385886 - protein, 11 aa, Influenza virus
CSGIFGDNPRP

SEQ ID NO: 385887 - protein, 11 aa, Influenza virus
SPVNNGKGRYG

SEQ ID NO: 385888 - protein, 11 aa, Influenza virus
PVNNGKGRYGV

SEQ ID NO: 385889 - protein, 11 aa, Influenza virus
VNNGKGRYGVK

SEQ ID NO: 385890 - protein, 11 aa, Influenza virus
NNGKGRYGVKG

SEQ ID NO: 385891 - protein, 11 aa, Influenza virus
NGKGRYGVKGF

SEQ ID NO: 385892 - protein, 11 aa, Influenza virus
GKGRYGVKGFS

SEQ ID NO: 385893 - protein, 11 aa, Influenza virus
KGRYGVKGFSF

SEQ ID NO: 385894 - protein, 11 aa, Influenza virus
GRYGVKGFSFR

SEQ ID NO: 385895 - protein, 11 aa, Influenza virus
RYGVKGFSFRY

SEQ ID NO: 385896 - protein, 11 aa, Influenza virus
YGVKGFSFRYG

SEQ ID NO: 385897 - protein, 11 aa, Influenza virus
GVKGFSFRYGD

SEQ ID NO: 385898 - protein, 11 aa, Influenza virus
VKGFSFRYGDG

SEQ ID NO: 385899 - protein, 11 aa, Influenza virus
KGFSFRYGDGV

SEQ ID NO: 385900 - protein, 11 aa, Influenza virus
GFSFRYGDGVW

SEQ ID NO: 385901 - protein, 11 aa, Influenza virus
FSFRYGDGVWI

SEQ ID NO: 385902 - protein, 11 aa, Influenza virus
SFRYGDGVWIG

SEQ ID NO: 385903 - protein, 11 aa, Influenza virus
FRYGDGVWIGR

SEQ ID NO: 385904 - protein, 11 aa, Influenza virus
RYGDGVWIGRT

SEQ ID NO: 385905 - protein, 11 aa, Influenza virus
YGDGVWIGRTK

SEQ ID NO: 385906 - protein, 11 aa, Influenza virus
GDGVWIGRTKS

SEQ ID NO: 385907 - protein, 11 aa, Influenza virus
DGVWIGRTKSL

SEQ ID NO: 385908 - protein, 11 aa, Influenza virus
GVWIGRTKSLE

SEQ ID NO: 385909 - protein, 11 aa, Influenza virus
VWIGRTKSLES

SEQ ID NO: 385910 - protein, 11 aa, Influenza virus
WIGRTKSLESR

SEQ ID NO: 385911 - protein, 11 aa, Influenza virus
IGRTKSLESRS

SEQ ID NO: 385912 - protein, 11 aa, Influenza virus
GRTKSLESRSG

SEQ ID NO: 385913 - protein, 11 aa, Influenza virus
RTKSLESRSGF

SEQ ID NO: 385914 - protein, 11 aa, Influenza virus
TKSLESRSGFE

SEQ ID NO: 385915 - protein, 11 aa, Influenza virus
KSLESRSGFEM

SEQ ID NO: 385916 - protein, 11 aa, Influenza virus
SLESRSGFEMV

SEQ ID NO: 385917 - protein, 11 aa, Influenza virus
LESRSGFEMVW

SEQ ID NO: 385918 - protein, 11 aa, Influenza virus
ESRSGFEMVWD

SEQ ID NO: 385919 - protein, 11 aa, Influenza virus
SRSGFEMVWDA

SEQ ID NO: 385920 - protein, 11 aa, Influenza virus
RSGFEMVWDAN

SEQ ID NO: 385921 - protein, 11 aa, Influenza virus
SGFEMVWDANG

SEQ ID NO: 385922 - protein, 11 aa, Influenza virus
GFEMVWDANGW

SEQ ID NO: 385923 - protein, 11 aa, Influenza virus
FEMVWDANGWV

SEQ ID NO: 385924 - protein, 11 aa, Influenza virus
EMVWDANGWVS

SEQ ID NO: 385925 - protein, 11 aa, Influenza virus
MVWDANGWVST

SEQ ID NO: 385926 - protein, 11 aa, Influenza virus
VWDANGWVSTD

SEQ ID NO: 385927 - protein, 11 aa, Influenza virus
WDANGWVSTDK

SEQ ID NO: 385928 - protein, 11 aa, Influenza virus
DANGWVSTDKD

SEQ ID NO: 385929 - protein, 11 aa, Influenza virus
ANGWVSTDKDS

SEQ ID NO: 385930 - protein, 11 aa, Influenza virus
NGWVSTDKDSN

SEQ ID NO: 385931 - protein, 11 aa, Influenza virus
GWVSTDKDSNG

SEQ ID NO: 385932 - protein, 11 aa, Influenza virus
WVSTDKDSNGV

SEQ ID NO: 385933 - protein, 11 aa, Influenza virus
VSTDKDSNGVQ

SEQ ID NO: 385934 - protein, 11 aa, Influenza virus
STDKDSNGVQD

SEQ ID NO: 385935 - protein, 11 aa, Influenza virus
TDKDSNGVQDI

SEQ ID NO: 385936 - protein, 11 aa, Influenza virus
DKDSNGVQDII

SEQ ID NO: 385937 - protein, 11 aa, Influenza virus
KDSNGVQDIID

SEQ ID NO: 385938 - protein, 11 aa, Influenza virus
DSNGVQDIIDN

SEQ ID NO: 385939 - protein, 11 aa, Influenza virus
SNGVQDIIDND

SEQ ID NO: 385940 - protein, 11 aa, Influenza virus
NGVQDIIDNDN

SEQ ID NO: 385941 - protein, 11 aa, Influenza virus
GVQDIIDNDNW

SEQ ID NO: 385942 - protein, 11 aa, Influenza virus
VQDIIDNDNWS

SEQ ID NO: 385943 - protein, 11 aa, Influenza virus
QDIIDNDNWSG

SEQ ID NO: 385944 - protein, 11 aa, Influenza virus
DIIDNDNWSGY

SEQ ID NO: 385945 - protein, 11 aa, Influenza virus
IIDNDNWSGYS

SEQ ID NO: 385946 - protein, 11 aa, Influenza virus
IDNDNWSGYSG

SEQ ID NO: 385947 - protein, 11 aa, Influenza virus
DNDNWSGYSGS

SEQ ID NO: 385948 - protein, 11 aa, Influenza virus
NDNWSGYSGSF

SEQ ID NO: 385949 - protein, 11 aa, Influenza virus
DNWSGYSGSFS

SEQ ID NO: 385950 - protein, 11 aa, Influenza virus
NWSGYSGSFSI

SEQ ID NO: 385951 - protein, 11 aa, Influenza virus
WSGYSGSFSIR

SEQ ID NO: 385952 - protein, 11 aa, Influenza virus
SGYSGSFSIRG

SEQ ID NO: 385953 - protein, 11 aa, Influenza virus
GYSGSFSIRGE

SEQ ID NO: 385954 - protein, 11 aa, Influenza virus
YSGSFSIRGET

SEQ ID NO: 385955 - protein, 11 aa, Influenza virus
SGSFSIRGETT

SEQ ID NO: 385956 - protein, 11 aa, Influenza virus
GSFSIRGETTG

SEQ ID NO: 385957 - protein, 11 aa, Influenza virus
SFSIRGETTGR

SEQ ID NO: 385958 - protein, 11 aa, Influenza virus
FSIRGETTGRN

SEQ ID NO: 385959 - protein, 11 aa, Influenza virus
SIRGETTGRNC

SEQ ID NO: 385960 - protein, 11 aa, Influenza virus
IRGETTGRNCT

SEQ ID NO: 385961 - protein, 11 aa, Influenza virus
RGETTGRNCTV

SEQ ID NO: 385962 - protein, 11 aa, Influenza virus
GETTGRNCTVP

SEQ ID NO: 385963 - protein, 11 aa, Influenza virus
ETTGRNCTVPC

SEQ ID NO: 385964 - protein, 11 aa, Influenza virus
TTGRNCTVPCF

SEQ ID NO: 385965 - protein, 11 aa, Influenza virus
TGRNCTVPCFW

SEQ ID NO: 385966 - protein, 11 aa, Influenza virus
GRNCTVPCFWV

SEQ ID NO: 385967 - protein, 11 aa, Influenza virus
RNCTVPCFWVE

SEQ ID NO: 385968 - protein, 11 aa, Influenza virus
NCTVPCFWVEM

SEQ ID NO: 385969 - protein, 11 aa, Influenza virus
CTVPCFWVEMI

SEQ ID NO: 385970 - protein, 11 aa, Influenza virus
TVPCFWVEMIR

SEQ ID NO: 385971 - protein, 11 aa, Influenza virus
VPCFWVEMIRG

SEQ ID NO: 385972 - protein, 11 aa, Influenza virus
PCFWVEMIRGQ

SEQ ID NO: 385973 - protein, 11 aa, Influenza virus
CFWVEMIRGQP

SEQ ID NO: 385974 - protein, 11 aa, Influenza virus
FWVEMIRGQPK

SEQ ID NO: 385975 - protein, 11 aa, Influenza virus
WVEMIRGQPKE

SEQ ID NO: 385976 - protein, 11 aa, Influenza virus
VEMIRGQPKEK

SEQ ID NO: 385977 - protein, 11 aa, Influenza virus
EMIRGQPKEKT

SEQ ID NO: 385978 - protein, 11 aa, Influenza virus
MIRGQPKEKTI

SEQ ID NO: 385979 - protein, 11 aa, Influenza virus
IRGQPKEKTIW

SEQ ID NO: 385980 - protein, 11 aa, Influenza virus
RGQPKEKTIWT

SEQ ID NO: 385981 - protein, 11 aa, Influenza virus
GQPKEKTIWTS

SEQ ID NO: 385982 - protein, 11 aa, Influenza virus
QPKEKTIWTSG

SEQ ID NO: 385983 - protein, 11 aa, Influenza virus
PKEKTIWTSGS

SEQ ID NO: 385984 - protein, 11 aa, Influenza virus
KEKTIWTSGSS

SEQ ID NO: 385985 - protein, 11 aa, Influenza virus
EKTIWTSGSSI

SEQ ID NO: 385986 - protein, 11 aa, Influenza virus
KTIWTSGSSIA

SEQ ID NO: 385987 - protein, 11 aa, Influenza virus
TIWTSGSSIAF

SEQ ID NO: 385988 - protein, 11 aa, Influenza virus
IWTSGSSIAFC

SEQ ID NO: 385989 - protein, 11 aa, Influenza virus
WTSGSSIAFCG

SEQ ID NO: 385990 - protein, 11 aa, Influenza virus
TSGSSIAFCGV

SEQ ID NO: 385991 - protein, 11 aa, Influenza virus
SGSSIAFCGVN

SEQ ID NO: 385992 - protein, 11 aa, Influenza virus
GSSIAFCGVNS

SEQ ID NO: 385993 - protein, 11 aa, Influenza virus
SSIAFCGVNSD

SEQ ID NO: 385994 - protein, 11 aa, Influenza virus
SIAFCGVNSDT

SEQ ID NO: 385995 - protein, 11 aa, Influenza virus
IAFCGVNSDTT

SEQ ID NO: 385996 - protein, 11 aa, Influenza virus
AFCGVNSDTTG

SEQ ID NO: 385997 - protein, 11 aa, Influenza virus
FCGVNSDTTGW

SEQ ID NO: 385998 - protein, 11 aa, Influenza virus
SDTTGWSWPDG

SEQ ID NO: 385999 - protein, 11 aa, Influenza virus
DTTGWSWPDGA

SEQ ID NO: 386000 - protein, 11 aa, Influenza virus
TTGWSWPDGAL

SEQ ID NO: 386001 - protein, 11 aa, Influenza virus
TGWSWPDGALL

SEQ ID NO: 386002 - protein, 11 aa, Influenza virus
GWSWPDGALLP

SEQ ID NO: 386003 - protein, 11 aa, Influenza virus
WSWPDGALLPF

SEQ ID NO: 386004 - protein, 11 aa, Influenza virus
SWPDGALLPFD

SEQ ID NO: 386005 - protein, 11 aa, Influenza virus
WPDGALLPFDI

SEQ ID NO: 386006 - protein, 11 aa, Influenza virus
PDGALLPFDID

SEQ ID NO: 386007 - protein, 11 aa, Influenza virus
DGALLPFDIDK

SEQ ID NO: 386008 - protein, 11 aa, Influenza virus
MNPNQKIITIG

SEQ ID NO: 386009 - protein, 11 aa, Influenza virus
NPNQKIITIGS

SEQ ID NO: 386010 - protein, 11 aa, Influenza virus
PNQKIITIGSV

SEQ ID NO: 386011 - protein, 11 aa, Influenza virus
NQKIITIGSVS

SEQ ID NO: 386012 - protein, 11 aa, Influenza virus
QKIITIGSVSL

SEQ ID NO: 386013 - protein, 11 aa, Influenza virus
KIITIGSVSLA

SEQ ID NO: 386014 - protein, 11 aa, Influenza virus
IITIGSVSLAL

SEQ ID NO: 386015 - protein, 11 aa, Influenza virus
FLNNTEPLCNV

SEQ ID NO: 386016 - protein, 11 aa, Influenza virus
LNNTEPLCNVS

SEQ ID NO: 386017 - protein, 11 aa, Influenza virus
NNTEPLCNVSG

SEQ ID NO: 386018 - protein, 11 aa, Influenza virus
NTEPLCNVSGF

SEQ ID NO: 386019 - protein, 11 aa, Influenza virus
TEPLCNVSGFA

SEQ ID NO: 386020 - protein, 11 aa, Influenza virus
EPLCNVSGFAI

SEQ ID NO: 386021 - protein, 11 aa, Influenza virus
SGFAIVSKDNG

SEQ ID NO: 386022 - protein, 11 aa, Influenza virus
GFAIVSKDNGI

SEQ ID NO: 386023 - protein, 11 aa, Influenza virus
FAIVSKDNGIR

SEQ ID NO: 386024 - protein, 11 aa, Influenza virus
IVSKDNGIRIG

SEQ ID NO: 386025 - protein, 11 aa, Influenza virus
VSKDNGIRIGS

SEQ ID NO: 386026 - protein, 11 aa, Influenza virus
SKDNGIRIGSR

SEQ ID NO: 386027 - protein, 11 aa, Influenza virus
KDNGIRIGSRG

SEQ ID NO: 386028 - protein, 11 aa, Influenza virus
DNGIRIGSRGH

SEQ ID NO: 386029 - protein, 11 aa, Influenza virus
NGIRIGSRGHV

SEQ ID NO: 386030 - protein, 11 aa, Influenza virus
GIRIGSRGHVF

SEQ ID NO: 386031 - protein, 11 aa, Influenza virus
IRIGSRGHVFV

SEQ ID NO: 386032 - protein, 11 aa, Influenza virus
RIGSRGHVFVI

SEQ ID NO: 386033 - protein, 11 aa, Influenza virus
IGSRGHVFVIR

SEQ ID NO: 386034 - protein, 11 aa, Influenza virus
GSRGHVFVIRE

SEQ ID NO: 386035 - protein, 11 aa, Influenza virus
SRGHVFVIREP

SEQ ID NO: 386036 - protein, 11 aa, Influenza virus
RGHVFVIREPF

SEQ ID NO: 386037 - protein, 11 aa, Influenza virus
GHVFVIREPFV

SEQ ID NO: 386038 - protein, 11 aa, Influenza virus
HVFVIREPFVA

SEQ ID NO: 386039 - protein, 11 aa, Influenza virus
VFVIREPFVAC

SEQ ID NO: 386040 - protein, 11 aa, Influenza virus
FVIREPFVACG

SEQ ID NO: 386041 - protein, 11 aa, Influenza virus
VIREPFVACGP

SEQ ID NO: 386042 - protein, 11 aa, Influenza virus
IREPFVACGPT

SEQ ID NO: 386043 - protein, 11 aa, Influenza virus
REPFVACGPTE

SEQ ID NO: 386044 - protein, 11 aa, Influenza virus
EPFVACGPTEC

SEQ ID NO: 386045 - protein, 11 aa, Influenza virus
PFVACGPTECR

SEQ ID NO: 386046 - protein, 11 aa, Influenza virus
FVACGPTECRT

SEQ ID NO: 386047 - protein, 11 aa, Influenza virus
VACGPTECRTF

SEQ ID NO: 386048 - protein, 11 aa, Influenza virus
ACGPTECRTFF

SEQ ID NO: 386049 - protein, 11 aa, Influenza virus
CGPTECRTFFL

SEQ ID NO: 386050 - protein, 11 aa, Influenza virus
GPTECRTFFLT

SEQ ID NO: 386051 - protein, 11 aa, Influenza virus
PTECRTFFLTQ

SEQ ID NO: 386052 - protein, 11 aa, Influenza virus
TECRTFFLTQG

SEQ ID NO: 386053 - protein, 11 aa, Influenza virus
ECRTFFLTQGA

SEQ ID NO: 386054 - protein, 11 aa, Influenza virus
CRTFFLTQGAL

SEQ ID NO: 386055 - protein, 11 aa, Influenza virus
RTFFLTQGALL

SEQ ID NO: 386056 - protein, 11 aa, Influenza virus
TFFLTQGALLN

SEQ ID NO: 386057 - protein, 11 aa, Influenza virus
FFLTQGALLND

SEQ ID NO: 386058 - protein, 11 aa, Influenza virus
FLTQGALLNDK

SEQ ID NO: 386059 - protein, 11 aa, Influenza virus
LTQGALLNDKH

SEQ ID NO: 386060 - protein, 11 aa, Influenza virus
TQGALLNDKHS

SEQ ID NO: 386061 - protein, 11 aa, Influenza virus
QGALLNDKHSN

SEQ ID NO: 386062 - protein, 11 aa, Influenza virus
GALLNDKHSNN

SEQ ID NO: 386063 - protein, 11 aa, Influenza virus
ALLNDKHSNNT

SEQ ID NO: 386064 - protein, 11 aa, Influenza virus
LLNDKHSNNTV

SEQ ID NO: 386065 - protein, 11 aa, Influenza virus
LNDKHSNNTVK

SEQ ID NO: 386066 - protein, 11 aa, Influenza virus
NDKHSNNTVKD

SEQ ID NO: 386067 - protein, 11 aa, Influenza virus
DKHSNNTVKDR

SEQ ID NO: 386068 - protein, 11 aa, Influenza virus
KHSNNTVKDRS

SEQ ID NO: 386069 - protein, 11 aa, Influenza virus
HSNNTVKDRSP

SEQ ID NO: 386070 - protein, 11 aa, Influenza virus
SNNTVKDRSPY

SEQ ID NO: 386071 - protein, 11 aa, Influenza virus
NNTVKDRSPYR

SEQ ID NO: 386072 - protein, 11 aa, Influenza virus
NTVKDRSPYRA

SEQ ID NO: 386073 - protein, 11 aa, Influenza virus
TVKDRSPYRAL

SEQ ID NO: 386074 - protein, 11 aa, Influenza virus
VKDRSPYRALM

SEQ ID NO: 386075 - protein, 11 aa, Influenza virus
KDRSPYRALMS

SEQ ID NO: 386076 - protein, 11 aa, Influenza virus
DRSPYRALMSV

SEQ ID NO: 386077 - protein, 11 aa, Influenza virus
RSPYRALMSVP

SEQ ID NO: 386078 - protein, 11 aa, Influenza virus
SPYRALMSVPL

SEQ ID NO: 386079 - protein, 11 aa, Influenza virus
PYRALMSVPLG

SEQ ID NO: 386080 - protein, 11 aa, Influenza virus
YRALMSVPLGS

SEQ ID NO: 386081 - protein, 11 aa, Influenza virus
RALMSVPLGSS

SEQ ID NO: 386082 - protein, 11 aa, Influenza virus
ALMSVPLGSSP

SEQ ID NO: 386083 - protein, 11 aa, Influenza virus
LMSVPLGSSPN

SEQ ID NO: 386084 - protein, 11 aa, Influenza virus
MSVPLGSSPNA

SEQ ID NO: 386085 - protein, 11 aa, Influenza virus
SVPLGSSPNAY

SEQ ID NO: 386086 - protein, 11 aa, Influenza virus
VPLGSSPNAYQ

SEQ ID NO: 386087 - protein, 11 aa, Influenza virus
PLGSSPNAYQA

SEQ ID NO: 386088 - protein, 11 aa, Influenza virus
LGSSPNAYQAK

SEQ ID NO: 386089 - protein, 11 aa, Influenza virus
GSSPNAYQAKF

SEQ ID NO: 386090 - protein, 11 aa, Influenza virus
SSPNAYQAKFE

SEQ ID NO: 386091 - protein, 11 aa, Influenza virus
SPNAYQAKFES

SEQ ID NO: 386092 - protein, 11 aa, Influenza virus
PNAYQAKFESV

SEQ ID NO: 386093 - protein, 11 aa, Influenza virus
FESVAWSATAC

SEQ ID NO: 386094 - protein, 11 aa, Influenza virus
ESVAWSATACH

SEQ ID NO: 386095 - protein, 11 aa, Influenza virus
SVAWSATACHD

SEQ ID NO: 386096 - protein, 11 aa, Influenza virus
VAWSATACHDG

SEQ ID NO: 386097 - protein, 11 aa, Influenza virus
AWSATACHDGK

SEQ ID NO: 386098 - protein, 11 aa, Influenza virus
WSATACHDGKE

SEQ ID NO: 386099 - protein, 11 aa, Influenza virus
SATACHDGKEW

SEQ ID NO: 386100 - protein, 11 aa, Influenza virus
ATACHDGKEWL

SEQ ID NO: 386101 - protein, 11 aa, Influenza virus
GISGADDDAYA

SEQ ID NO: 386102 - protein, 11 aa, Influenza virus
ISGADDDAYAV

SEQ ID NO: 386103 - protein, 11 aa, Influenza virus
SGADDDAYAVI

SEQ ID NO: 386104 - protein, 11 aa, Influenza virus
GADDDAYAVIH

SEQ ID NO: 386105 - protein, 11 aa, Influenza virus
ADDDAYAVIHY

SEQ ID NO: 386106 - protein, 11 aa, Influenza virus
DDDAYAVIHYG

SEQ ID NO: 386107 - protein, 11 aa, Influenza virus
DDAYAVIHYGG

SEQ ID NO: 386108 - protein, 11 aa, Influenza virus
DAYAVIHYGGM

SEQ ID NO: 386109 - protein, 11 aa, Influenza virus
AYAVIHYGGMP

SEQ ID NO: 386110 - protein, 11 aa, Influenza virus
YAVIHYGGMPT

SEQ ID NO: 386111 - protein, 11 aa, Influenza virus
AVIHYGGMPTD

SEQ ID NO: 386112 - protein, 11 aa, Influenza virus
VIHYGGMPTDV

SEQ ID NO: 386113 - protein, 11 aa, Influenza virus
IHYGGMPTDVV

SEQ ID NO: 386114 - protein, 11 aa, Influenza virus
HYGGMPTDVVR

SEQ ID NO: 386115 - protein, 11 aa, Influenza virus
YGGMPTDVVRS

SEQ ID NO: 386116 - protein, 11 aa, Influenza virus
GGMPTDVVRSW

SEQ ID NO: 386117 - protein, 11 aa, Influenza virus
PTDVVRSWRKQ

SEQ ID NO: 386118 - protein, 11 aa, Influenza virus
TDVVRSWRKQI

SEQ ID NO: 386119 - protein, 11 aa, Influenza virus
DVVRSWRKQIL

SEQ ID NO: 386120 - protein, 11 aa, Influenza virus
VVRSWRKQILR

SEQ ID NO: 386121 - protein, 11 aa, Influenza virus
VRSWRKQILRT

SEQ ID NO: 386122 - protein, 11 aa, Influenza virus
RSWRKQILRTQ

SEQ ID NO: 386123 - protein, 11 aa, Influenza virus
SWRKQILRTQE

SEQ ID NO: 386124 - protein, 11 aa, Influenza virus
WRKQILRTQES

SEQ ID NO: 386125 - protein, 11 aa, Influenza virus
RKQILRTQESS

SEQ ID NO: 386126 - protein, 11 aa, Influenza virus
KQILRTQESSC

SEQ ID NO: 386127 - protein, 11 aa, Influenza virus
QILRTQESSCV

SEQ ID NO: 386128 - protein, 11 aa, Influenza virus
ILRTQESSCVC

SEQ ID NO: 386129 - protein, 11 aa, Influenza virus
LRTQESSCVCM

SEQ ID NO: 386130 - protein, 11 aa, Influenza virus
RTQESSCVCMK

SEQ ID NO: 386131 - protein, 11 aa, Influenza virus
TQESSCVCMKG

SEQ ID NO: 386132 - protein, 11 aa, Influenza virus
CYWVMTDGPAN

SEQ ID NO: 386133 - protein, 11 aa, Influenza virus
YWVMTDGPANN

SEQ ID NO: 386134 - protein, 11 aa, Influenza virus
WVMTDGPANNQ

SEQ ID NO: 386135 - protein, 11 aa, Influenza virus
VMTDGPANNQA

SEQ ID NO: 386136 - protein, 11 aa, Influenza virus
MTDGPANNQAS

SEQ ID NO: 386137 - protein, 11 aa, Influenza virus
TDGPANNQASY

SEQ ID NO: 386138 - protein, 11 aa, Influenza virus
DGPANNQASYK

SEQ ID NO: 386139 - protein, 11 aa, Influenza virus
GPANNQASYKI

SEQ ID NO: 386140 - protein, 11 aa, Influenza virus
PANNQASYKIF

SEQ ID NO: 386141 - protein, 11 aa, Influenza virus
ANNQASYKIFK

SEQ ID NO: 386142 - protein, 11 aa, Influenza virus
NNQASYKIFKS

SEQ ID NO: 386143 - protein, 11 aa, Influenza virus
EVSFQGGHIEE

SEQ ID NO: 386144 - protein, 11 aa, Influenza virus
VSFQGGHIEEC

SEQ ID NO: 386145 - protein, 11 aa, Influenza virus
SFQGGHIEECS

SEQ ID NO: 386146 - protein, 11 aa, Influenza virus
FQGGHIEECSC

SEQ ID NO: 386147 - protein, 11 aa, Influenza virus
QGGHIEECSCY

SEQ ID NO: 386148 - protein, 11 aa, Influenza virus
GGHIEECSCYP

SEQ ID NO: 386149 - protein, 11 aa, Influenza virus
GHIEECSCYPN

SEQ ID NO: 386150 - protein, 11 aa, Influenza virus
HIEECSCYPNL

SEQ ID NO: 386151 - protein, 11 aa, Influenza virus
IEECSCYPNLG

SEQ ID NO: 386152 - protein, 11 aa, Influenza virus
EECSCYPNLGK

SEQ ID NO: 386153 - protein, 11 aa, Influenza virus
ECSCYPNLGKV

SEQ ID NO: 386154 - protein, 11 aa, Influenza virus
CSCYPNLGKVE

SEQ ID NO: 386155 - protein, 11 aa, Influenza virus
SCYPNLGKVEC

SEQ ID NO: 386156 - protein, 11 aa, Influenza virus
CYPNLGKVECV

SEQ ID NO: 386157 - protein, 11 aa, Influenza virus
YPNLGKVECVC

SEQ ID NO: 386158 - protein, 11 aa, Influenza virus
PNLGKVECVCR

SEQ ID NO: 386159 - protein, 11 aa, Influenza virus
NLGKVECVCRD

SEQ ID NO: 386160 - protein, 11 aa, Influenza virus
LGKVECVCRDN

SEQ ID NO: 386161 - protein, 11 aa, Influenza virus
GKVECVCRDNW

SEQ ID NO: 386162 - protein, 11 aa, Influenza virus
KVECVCRDNWN

SEQ ID NO: 386163 - protein, 11 aa, Influenza virus
VECVCRDNWNG

SEQ ID NO: 386164 - protein, 11 aa, Influenza virus
ECVCRDNWNGM

SEQ ID NO: 386165 - protein, 11 aa, Influenza virus
CVCRDNWNGMN

SEQ ID NO: 386166 - protein, 11 aa, Influenza virus
VCRDNWNGMNR

SEQ ID NO: 386167 - protein, 11 aa, Influenza virus
CRDNWNGMNRP

SEQ ID NO: 386168 - protein, 11 aa, Influenza virus
RDNWNGMNRPI

SEQ ID NO: 386169 - protein, 11 aa, Influenza virus
DNWNGMNRPIL

SEQ ID NO: 386170 - protein, 11 aa, Influenza virus
YEVGYLCAGIP

SEQ ID NO: 386171 - protein, 11 aa, Influenza virus
EVGYLCAGIPT

SEQ ID NO: 386172 - protein, 11 aa, Influenza virus
VGYLCAGIPTD

SEQ ID NO: 386173 - protein, 11 aa, Influenza virus
GYLCAGIPTDT

SEQ ID NO: 386174 - protein, 11 aa, Influenza virus
YLCAGIPTDTP

SEQ ID NO: 386175 - protein, 11 aa, Influenza virus
LCAGIPTDTPR

SEQ ID NO: 386176 - protein, 11 aa, Influenza virus
CAGIPTDTPRV

SEQ ID NO: 386177 - protein, 11 aa, Influenza virus
AGIPTDTPRVQ

SEQ ID NO: 386178 - protein, 11 aa, Influenza virus
GIPTDTPRVQD

SEQ ID NO: 386179 - protein, 11 aa, Influenza virus
IPTDTPRVQDS

SEQ ID NO: 386180 - protein, 11 aa, Influenza virus
AVGGSGTNNYG

SEQ ID NO: 386181 - protein, 11 aa, Influenza virus
VGGSGTNNYGV

SEQ ID NO: 386182 - protein, 11 aa, Influenza virus
GGSGTNNYGVK

SEQ ID NO: 386183 - protein, 11 aa, Influenza virus
GSGTNNYGVKG

SEQ ID NO: 386184 - protein, 11 aa, Influenza virus
SGTNNYGVKGF

SEQ ID NO: 386185 - protein, 11 aa, Influenza virus
GTNNYGVKGFG

SEQ ID NO: 386186 - protein, 11 aa, Influenza virus
TNNYGVKGFGF

SEQ ID NO: 386187 - protein, 11 aa, Influenza virus
NNYGVKGFGFR

SEQ ID NO: 386188 - protein, 11 aa, Influenza virus
NYGVKGFGFRQ

SEQ ID NO: 386189 - protein, 11 aa, Influenza virus
YGVKGFGFRQG

SEQ ID NO: 386190 - protein, 11 aa, Influenza virus
GVKGFGFRQGN

SEQ ID NO: 386191 - protein, 11 aa, Influenza virus
VKGFGFRQGNS

SEQ ID NO: 386192 - protein, 11 aa, Influenza virus
KGFGFRQGNSV

SEQ ID NO: 386193 - protein, 11 aa, Influenza virus
GFGFRQGNSVW

SEQ ID NO: 386194 - protein, 11 aa, Influenza virus
FGFRQGNSVWA

SEQ ID NO: 386195 - protein, 11 aa, Influenza virus
GFRQGNSVWAG

SEQ ID NO: 386196 - protein, 11 aa, Influenza virus
FRQGNSVWAGR

SEQ ID NO: 386197 - protein, 11 aa, Influenza virus
RQGNSVWAGRT

SEQ ID NO: 386198 - protein, 11 aa, Influenza virus
QGNSVWAGRTV

SEQ ID NO: 386199 - protein, 11 aa, Influenza virus
SSRSGFEILLI

SEQ ID NO: 386200 - protein, 11 aa, Influenza virus
SRSGFEILLIE

SEQ ID NO: 386201 - protein, 11 aa, Influenza virus
RSGFEILLIED

SEQ ID NO: 386202 - protein, 11 aa, Influenza virus
SGFEILLIEDG

SEQ ID NO: 386203 - protein, 11 aa, Influenza virus
GFEILLIEDGW

SEQ ID NO: 386204 - protein, 11 aa, Influenza virus
EVLNNKNWSGY

SEQ ID NO: 386205 - protein, 11 aa, Influenza virus
VLNNKNWSGYS

SEQ ID NO: 386206 - protein, 11 aa, Influenza virus
LNNKNWSGYSG

SEQ ID NO: 386207 - protein, 11 aa, Influenza virus
NNKNWSGYSGA

SEQ ID NO: 386208 - protein, 11 aa, Influenza virus
NKNWSGYSGAF

SEQ ID NO: 386209 - protein, 11 aa, Influenza virus
KNWSGYSGAFT

SEQ ID NO: 386210 - protein, 11 aa, Influenza virus
NWSGYSGAFTI

SEQ ID NO: 386211 - protein, 11 aa, Influenza virus
WSGYSGAFTIP

SEQ ID NO: 386212 - protein, 11 aa, Influenza virus
SGYSGAFTIPI

SEQ ID NO: 386213 - protein, 11 aa, Influenza virus
CLVPCFWLEMI

SEQ ID NO: 386214 - protein, 11 aa, Influenza virus
LVPCFWLEMIR

SEQ ID NO: 386215 - protein, 11 aa, Influenza virus
VPCFWLEMIRG

SEQ ID NO: 386216 - protein, 11 aa, Influenza virus
PCFWLEMIRGK

SEQ ID NO: 386217 - protein, 11 aa, Influenza virus
CFWLEMIRGKP

SEQ ID NO: 386218 - protein, 11 aa, Influenza virus
FWLEMIRGKPE

SEQ ID NO: 386219 - protein, 11 aa, Influenza virus
WLEMIRGKPEE

SEQ ID NO: 386220 - protein, 11 aa, Influenza virus
LEMIRGKPEER

SEQ ID NO: 386221 - protein, 11 aa, Influenza virus
PEERTSIWTSS

SEQ ID NO: 386222 - protein, 11 aa, Influenza virus
EERTSIWTSSS

SEQ ID NO: 386223 - protein, 11 aa, Influenza virus
ERTSIWTSSSS

SEQ ID NO: 386224 - protein, 11 aa, Influenza virus
RTSIWTSSSST

SEQ ID NO: 386225 - protein, 11 aa, Influenza virus
TSIWTSSSSTV

SEQ ID NO: 386226 - protein, 11 aa, Influenza virus
SIWTSSSSTVF

SEQ ID NO: 386227 - protein, 11 aa, Influenza virus
IWTSSSSTVFC

SEQ ID NO: 386228 - protein, 11 aa, Influenza virus
WTSSSSTVFCG

SEQ ID NO: 386229 - protein, 11 aa, Influenza virus
TSSSSTVFCGV

SEQ ID NO: 386230 - protein, 11 aa, Influenza virus
SSSSTVFCGVS

SEQ ID NO: 386231 - protein, 11 aa, Influenza virus
SSSTVFCGVSS

SEQ ID NO: 386232 - protein, 11 aa, Influenza virus
SSTVFCGVSSE

SEQ ID NO: 386233 - protein, 11 aa, Influenza virus
STVFCGVSSEV

SEQ ID NO: 386234 - protein, 11 aa, Influenza virus
TVFCGVSSEVP

SEQ ID NO: 386235 - protein, 11 aa, Influenza virus
VFCGVSSEVPG

SEQ ID NO: 386236 - protein, 11 aa, Influenza virus
FCGVSSEVPGW

SEQ ID NO: 386237 - protein, 11 aa, Influenza virus
CGVSSEVPGWS

SEQ ID NO: 386238 - protein, 11 aa, Influenza virus
GVSSEVPGWSW

SEQ ID NO: 386239 - protein, 11 aa, Influenza virus
VSSEVPGWSWD

SEQ ID NO: 386240 - protein, 11 aa, Influenza virus
SSEVPGWSWDD

SEQ ID NO: 386241 - protein, 11 aa, Influenza virus
SEVPGWSWDDG

SEQ ID NO: 386242 - protein, 11 aa, Influenza virus
EVPGWSWDDGA

SEQ ID NO: 386243 - protein, 11 aa, Influenza virus
VPGWSWDDGAI

SEQ ID NO: 386244 - protein, 11 aa, Influenza virus
PGWSWDDGAIL

SEQ ID NO: 386245 - protein, 11 aa, Influenza virus
GWSWDDGAILP

SEQ ID NO: 386246 - protein, 11 aa, Influenza virus
WSWDDGAILPF

SEQ ID NO: 386247 - protein, 11 aa, Influenza virus
SWDDGAILPFD

SEQ ID NO: 386248 - protein, 11 aa, Influenza virus
WDDGAILPFDI

SEQ ID NO: 386249 - protein, 11 aa, Influenza virus
DDGAILPFDID

SEQ ID NO: 386250 - protein, 11 aa, Influenza virus
DGAILPFDIDK

SEQ ID NO: 386251 - protein, 11 aa, Influenza virus
GAILPFDIDKM

SEQ ID NO: 386252 - protein, 11 aa, Influenza virus
MNPNQKIICIS

SEQ ID NO: 386253 - protein, 11 aa, Influenza virus
NPNQKIICISA

SEQ ID NO: 386254 - protein, 11 aa, Influenza virus
PNQKIICISAT

SEQ ID NO: 386255 - protein, 11 aa, Influenza virus
CISATGMTLSV

SEQ ID NO: 386256 - protein, 11 aa, Influenza virus
TTTTIINNNTQ

SEQ ID NO: 386257 - protein, 11 aa, Influenza virus
KPLCEVNSWHI

SEQ ID NO: 386258 - protein, 11 aa, Influenza virus
PLCEVNSWHIL

SEQ ID NO: 386259 - protein, 11 aa, Influenza virus
LCEVNSWHILS

SEQ ID NO: 386260 - protein, 11 aa, Influenza virus
CEVNSWHILSK

SEQ ID NO: 386261 - protein, 11 aa, Influenza virus
EVNSWHILSKD

SEQ ID NO: 386262 - protein, 11 aa, Influenza virus
VNSWHILSKDN

SEQ ID NO: 386263 - protein, 11 aa, Influenza virus
NSWHILSKDNA

SEQ ID NO: 386264 - protein, 11 aa, Influenza virus
SWHILSKDNAI

SEQ ID NO: 386265 - protein, 11 aa, Influenza virus
WHILSKDNAIR

SEQ ID NO: 386266 - protein, 11 aa, Influenza virus
HILSKDNAIRI

SEQ ID NO: 386267 - protein, 11 aa, Influenza virus
ILSKDNAIRIG

SEQ ID NO: 386268 - protein, 11 aa, Influenza virus
LSKDNAIRIGE

SEQ ID NO: 386269 - protein, 11 aa, Influenza virus
SKDNAIRIGED

SEQ ID NO: 386270 - protein, 11 aa, Influenza virus
KDNAIRIGEDA

SEQ ID NO: 386271 - protein, 11 aa, Influenza virus
DNAIRIGEDAH

SEQ ID NO: 386272 - protein, 11 aa, Influenza virus
DAHILVTREPY

SEQ ID NO: 386273 - protein, 11 aa, Influenza virus
AHILVTREPYL

SEQ ID NO: 386274 - protein, 11 aa, Influenza virus
HILVTREPYLS

SEQ ID NO: 386275 - protein, 11 aa, Influenza virus
ILVTREPYLSC

SEQ ID NO: 386276 - protein, 11 aa, Influenza virus
LVTREPYLSCG

SEQ ID NO: 386277 - protein, 11 aa, Influenza virus
VTREPYLSCGP

SEQ ID NO: 386278 - protein, 11 aa, Influenza virus
ECRMFALSQGT

SEQ ID NO: 386279 - protein, 11 aa, Influenza virus
CRMFALSQGTT

SEQ ID NO: 386280 - protein, 11 aa, Influenza virus
RMFALSQGTTL

SEQ ID NO: 386281 - protein, 11 aa, Influenza virus
MFALSQGTTLR

SEQ ID NO: 386282 - protein, 11 aa, Influenza virus
FALSQGTTLRG

SEQ ID NO: 386283 - protein, 11 aa, Influenza virus
ALSQGTTLRGR

SEQ ID NO: 386284 - protein, 11 aa, Influenza virus
LSQGTTLRGRH

SEQ ID NO: 386285 - protein, 11 aa, Influenza virus
SQGTTLRGRHA

SEQ ID NO: 386286 - protein, 11 aa, Influenza virus
QGTTLRGRHAN

SEQ ID NO: 386287 - protein, 11 aa, Influenza virus
GTTLRGRHANG

SEQ ID NO: 386288 - protein, 11 aa, Influenza virus
TTLRGRHANGT

SEQ ID NO: 386289 - protein, 11 aa, Influenza virus
TLRGRHANGTI

SEQ ID NO: 386290 - protein, 11 aa, Influenza virus
LRGRHANGTIH

SEQ ID NO: 386291 - protein, 11 aa, Influenza virus
RGRHANGTIHD

SEQ ID NO: 386292 - protein, 11 aa, Influenza virus
GRHANGTIHDR

SEQ ID NO: 386293 - protein, 11 aa, Influenza virus
RHANGTIHDRS

SEQ ID NO: 386294 - protein, 11 aa, Influenza virus
HANGTIHDRSP

SEQ ID NO: 386295 - protein, 11 aa, Influenza virus
ANGTIHDRSPF

SEQ ID NO: 386296 - protein, 11 aa, Influenza virus
NGTIHDRSPFR

SEQ ID NO: 386297 - protein, 11 aa, Influenza virus
GTIHDRSPFRA

SEQ ID NO: 386298 - protein, 11 aa, Influenza virus
TIHDRSPFRAL

SEQ ID NO: 386299 - protein, 11 aa, Influenza virus
HDRSPFRALIS

SEQ ID NO: 386300 - protein, 11 aa, Influenza virus
DRSPFRALISW

SEQ ID NO: 386301 - protein, 11 aa, Influenza virus
RSPFRALISWE

SEQ ID NO: 386302 - protein, 11 aa, Influenza virus
SPFRALISWEM

SEQ ID NO: 386303 - protein, 11 aa, Influenza virus
PFRALISWEMG

SEQ ID NO: 386304 - protein, 11 aa, Influenza virus
FRALISWEMGQ

SEQ ID NO: 386305 - protein, 11 aa, Influenza virus
RALISWEMGQA

SEQ ID NO: 386306 - protein, 11 aa, Influenza virus
ALISWEMGQAP

SEQ ID NO: 386307 - protein, 11 aa, Influenza virus
LISWEMGQAPS

SEQ ID NO: 386308 - protein, 11 aa, Influenza virus
ISWEMGQAPSP

SEQ ID NO: 386309 - protein, 11 aa, Influenza virus
SWEMGQAPSPY

SEQ ID NO: 386310 - protein, 11 aa, Influenza virus
WEMGQAPSPYN

SEQ ID NO: 386311 - protein, 11 aa, Influenza virus
VECVGWSSTSC

SEQ ID NO: 386312 - protein, 11 aa, Influenza virus
ECVGWSSTSCH

SEQ ID NO: 386313 - protein, 11 aa, Influenza virus
CVGWSSTSCHD

SEQ ID NO: 386314 - protein, 11 aa, Influenza virus
VGWSSTSCHDG

SEQ ID NO: 386315 - protein, 11 aa, Influenza virus
GWSSTSCHDGI

SEQ ID NO: 386316 - protein, 11 aa, Influenza virus
SSTSCHDGISR

SEQ ID NO: 386317 - protein, 11 aa, Influenza virus
STSCHDGISRM

SEQ ID NO: 386318 - protein, 11 aa, Influenza virus
TSCHDGISRMS

SEQ ID NO: 386319 - protein, 11 aa, Influenza virus
SRMSICMSGPN

SEQ ID NO: 386320 - protein, 11 aa, Influenza virus
RMSICMSGPNN

SEQ ID NO: 386321 - protein, 11 aa, Influenza virus
MSICMSGPNNN

SEQ ID NO: 386322 - protein, 11 aa, Influenza virus
SICMSGPNNNA

SEQ ID NO: 386323 - protein, 11 aa, Influenza virus
ICMSGPNNNAS

SEQ ID NO: 386324 - protein, 11 aa, Influenza virus
CMSGPNNNASA

SEQ ID NO: 386325 - protein, 11 aa, Influenza virus
MSGPNNNASAV

SEQ ID NO: 386326 - protein, 11 aa, Influenza virus
SGPNNNASAVV

SEQ ID NO: 386327 - protein, 11 aa, Influenza virus
GPNNNASAVVW

SEQ ID NO: 386328 - protein, 11 aa, Influenza virus
PNNNASAVVWY

SEQ ID NO: 386329 - protein, 11 aa, Influenza virus
TEIASWAGNIL

SEQ ID NO: 386330 - protein, 11 aa, Influenza virus
EIASWAGNILR

SEQ ID NO: 386331 - protein, 11 aa, Influenza virus
IASWAGNILRT

SEQ ID NO: 386332 - protein, 11 aa, Influenza virus
ASWAGNILRTQ

SEQ ID NO: 386333 - protein, 11 aa, Influenza virus
SWAGNILRTQE

SEQ ID NO: 386334 - protein, 11 aa, Influenza virus
WAGNILRTQES

SEQ ID NO: 386335 - protein, 11 aa, Influenza virus
AGNILRTQESE

SEQ ID NO: 386336 - protein, 11 aa, Influenza virus
GNILRTQESEC

SEQ ID NO: 386337 - protein, 11 aa, Influenza virus
NILRTQESECV

SEQ ID NO: 386338 - protein, 11 aa, Influenza virus
ILRTQESECVC

SEQ ID NO: 386339 - protein, 11 aa, Influenza virus
LRTQESECVCH

SEQ ID NO: 386340 - protein, 11 aa, Influenza virus
RTQESECVCHN

SEQ ID NO: 386341 - protein, 11 aa, Influenza virus
TQESECVCHNG

SEQ ID NO: 386342 - protein, 11 aa, Influenza virus
QESECVCHNGI

SEQ ID NO: 386343 - protein, 11 aa, Influenza virus
ESECVCHNGIC

SEQ ID NO: 386344 - protein, 11 aa, Influenza virus
SECVCHNGICP

SEQ ID NO: 386345 - protein, 11 aa, Influenza virus
ECVCHNGICPV

SEQ ID NO: 386346 - protein, 11 aa, Influenza virus
CVCHNGICPVV

SEQ ID NO: 386347 - protein, 11 aa, Influenza virus
GICPVVMTDGP

SEQ ID NO: 386348 - protein, 11 aa, Influenza virus
ICPVVMTDGPA

SEQ ID NO: 386349 - protein, 11 aa, Influenza virus
CPVVMTDGPAN

SEQ ID NO: 386350 - protein, 11 aa, Influenza virus
GSAQHIEECSC

SEQ ID NO: 386351 - protein, 11 aa, Influenza virus
SAQHIEECSCY

SEQ ID NO: 386352 - protein, 11 aa, Influenza virus
AQHIEECSCYG

SEQ ID NO: 386353 - protein, 11 aa, Influenza virus
QHIEECSCYGA

SEQ ID NO: 386354 - protein, 11 aa, Influenza virus
IKCICRDNWKG

SEQ ID NO: 386355 - protein, 11 aa, Influenza virus
KCICRDNWKGA

SEQ ID NO: 386356 - protein, 11 aa, Influenza virus
CICRDNWKGAN

SEQ ID NO: 386357 - protein, 11 aa, Influenza virus
ICRDNWKGANR

SEQ ID NO: 386358 - protein, 11 aa, Influenza virus
CRDNWKGANRP

SEQ ID NO: 386359 - protein, 11 aa, Influenza virus
RDNWKGANRPV

SEQ ID NO: 386360 - protein, 11 aa, Influenza virus
DNWKGANRPVI

SEQ ID NO: 386361 - protein, 11 aa, Influenza virus
NWKGANRPVIT

SEQ ID NO: 386362 - protein, 11 aa, Influenza virus
WKGANRPVITI

SEQ ID NO: 386363 - protein, 11 aa, Influenza virus
YLCSKILTDTS

SEQ ID NO: 386364 - protein, 11 aa, Influenza virus
LCSKILTDTSR

SEQ ID NO: 386365 - protein, 11 aa, Influenza virus
CSKILTDTSRP

SEQ ID NO: 386366 - protein, 11 aa, Influenza virus
GGSPDPGVKGF

SEQ ID NO: 386367 - protein, 11 aa, Influenza virus
GSPDPGVKGFA

SEQ ID NO: 386368 - protein, 11 aa, Influenza virus
SPDPGVKGFAF

SEQ ID NO: 386369 - protein, 11 aa, Influenza virus
PDPGVKGFAFL

SEQ ID NO: 386370 - protein, 11 aa, Influenza virus
DPGVKGFAFLD

SEQ ID NO: 386371 - protein, 11 aa, Influenza virus
PGVKGFAFLDG

SEQ ID NO: 386372 - protein, 11 aa, Influenza virus
NSWLGRTISKD

SEQ ID NO: 386373 - protein, 11 aa, Influenza virus
SWLGRTISKDS

SEQ ID NO: 386374 - protein, 11 aa, Influenza virus
WLGRTISKDSR

SEQ ID NO: 386375 - protein, 11 aa, Influenza virus
LGRTISKDSRS

SEQ ID NO: 386376 - protein, 11 aa, Influenza virus
GRTISKDSRSG

SEQ ID NO: 386377 - protein, 11 aa, Influenza virus
RTISKDSRSGY

SEQ ID NO: 386378 - protein, 11 aa, Influenza virus
TISKDSRSGYE

SEQ ID NO: 386379 - protein, 11 aa, Influenza virus
DSRSGYEMLKV

SEQ ID NO: 386380 - protein, 11 aa, Influenza virus
SRSGYEMLKVP

SEQ ID NO: 386381 - protein, 11 aa, Influenza virus
RSGYEMLKVPN

SEQ ID NO: 386382 - protein, 11 aa, Influenza virus
SGYEMLKVPNA

SEQ ID NO: 386383 - protein, 11 aa, Influenza virus
GYEMLKVPNAE

SEQ ID NO: 386384 - protein, 11 aa, Influenza virus
IVNNQNWSGYS

SEQ ID NO: 386385 - protein, 11 aa, Influenza virus
VNNQNWSGYSG

SEQ ID NO: 386386 - protein, 11 aa, Influenza virus
NNQNWSGYSGA

SEQ ID NO: 386387 - protein, 11 aa, Influenza virus
NQNWSGYSGAF

SEQ ID NO: 386388 - protein, 11 aa, Influenza virus
WSGYSGAFIDY

SEQ ID NO: 386389 - protein, 11 aa, Influenza virus
SGYSGAFIDYW

SEQ ID NO: 386390 - protein, 11 aa, Influenza virus
RECFNPCFYVE

SEQ ID NO: 386391 - protein, 11 aa, Influenza virus
ECFNPCFYVEL

SEQ ID NO: 386392 - protein, 11 aa, Influenza virus
CFNPCFYVELI

SEQ ID NO: 386393 - protein, 11 aa, Influenza virus
FNPCFYVELIR

SEQ ID NO: 386394 - protein, 11 aa, Influenza virus
NPCFYVELIRG

SEQ ID NO: 386395 - protein, 11 aa, Influenza virus
PCFYVELIRGR

SEQ ID NO: 386396 - protein, 11 aa, Influenza virus
CFYVELIRGRP

SEQ ID NO: 386397 - protein, 11 aa, Influenza virus
FYVELIRGRPK

SEQ ID NO: 386398 - protein, 11 aa, Influenza virus
YVELIRGRPKE

SEQ ID NO: 386399 - protein, 11 aa, Influenza virus
VLWTSNSIVAL

SEQ ID NO: 386400 - protein, 11 aa, Influenza virus
LWTSNSIVALC

SEQ ID NO: 386401 - protein, 11 aa, Influenza virus
WTSNSIVALCG

SEQ ID NO: 386402 - protein, 11 aa, Influenza virus
TSNSIVALCGS

SEQ ID NO: 386403 - protein, 11 aa, Influenza virus
SNSIVALCGSK

SEQ ID NO: 386404 - protein, 11 aa, Influenza virus
NSIVALCGSKE

SEQ ID NO: 386405 - protein, 11 aa, Influenza virus
SIVALCGSKER

SEQ ID NO: 386406 - protein, 11 aa, Influenza virus
IVALCGSKERL

SEQ ID NO: 386407 - protein, 11 aa, Influenza virus
VALCGSKERLG

SEQ ID NO: 386408 - protein, 11 aa, Influenza virus
ALCGSKERLGS

SEQ ID NO: 386409 - protein, 11 aa, Influenza virus
LCGSKERLGSW

SEQ ID NO: 386410 - protein, 11 aa, Influenza virus
CGSKERLGSWS

SEQ ID NO: 386411 - protein, 11 aa, Influenza virus
GSKERLGSWSW

SEQ ID NO: 386412 - protein, 11 aa, Influenza virus
SKERLGSWSWH

SEQ ID NO: 386413 - protein, 11 aa, Influenza virus
KERLGSWSWHD

SEQ ID NO: 386414 - protein, 11 aa, Influenza virus
ERLGSWSWHDG

SEQ ID NO: 386415 - protein, 11 aa, Influenza virus
RLGSWSWHDGA

SEQ ID NO: 386416 - protein, 11 aa, Influenza virus
LGSWSWHDGAE

SEQ ID NO: 386417 - protein, 11 aa, Influenza virus
GSWSWHDGAEI

SEQ ID NO: 386418 - protein, 11 aa, Influenza virus
SWSWHDGAEII

SEQ ID NO: 386419 - protein, 11 aa, Influenza virus
WSWHDGAEIIY

SEQ ID NO: 386420 - protein, 11 aa, Influenza virus
SWHDGAEIIYF

SEQ ID NO: 386421 - protein, 11 aa, Influenza virus
WHDGAEIIYFK

SEQ ID NO: 386422 - protein, 11 aa, Influenza virus
MNPNQKLFALS

SEQ ID NO: 386423 - protein, 11 aa, Influenza virus
NPNQKLFALSG

SEQ ID NO: 386424 - protein, 11 aa, Influenza virus
PNQKLFALSGV

SEQ ID NO: 386425 - protein, 11 aa, Influenza virus
NQKLFALSGVA

SEQ ID NO: 386426 - protein, 11 aa, Influenza virus
QKLFALSGVAI

SEQ ID NO: 386427 - protein, 11 aa, Influenza virus
NLLIGISNVGL

SEQ ID NO: 386428 - protein, 11 aa, Influenza virus
LLIGISNVGLN

SEQ ID NO: 386429 - protein, 11 aa, Influenza virus
SNVGLNVSLHL

SEQ ID NO: 386430 - protein, 11 aa, Influenza virus
ENTYVNNTTVI

SEQ ID NO: 386431 - protein, 11 aa, Influenza virus
YLMLNKSLCKV

SEQ ID NO: 386432 - protein, 11 aa, Influenza virus
WVVVAKDNAIR

SEQ ID NO: 386433 - protein, 11 aa, Influenza virus
VVVAKDNAIRF

SEQ ID NO: 386434 - protein, 11 aa, Influenza virus
VVAKDNAIRFG

SEQ ID NO: 386435 - protein, 11 aa, Influenza virus
VAKDNAIRFGE

SEQ ID NO: 386436 - protein, 11 aa, Influenza virus
AKDNAIRFGES

SEQ ID NO: 386437 - protein, 11 aa, Influenza virus
KDNAIRFGESE

SEQ ID NO: 386438 - protein, 11 aa, Influenza virus
DNAIRFGESEQ

SEQ ID NO: 386439 - protein, 11 aa, Influenza virus
NAIRFGESEQI

SEQ ID NO: 386440 - protein, 11 aa, Influenza virus
AIRFGESEQII

SEQ ID NO: 386441 - protein, 11 aa, Influenza virus
IRFGESEQIIV

SEQ ID NO: 386442 - protein, 11 aa, Influenza virus
RFGESEQIIVT

SEQ ID NO: 386443 - protein, 11 aa, Influenza virus
FGESEQIIVTR

SEQ ID NO: 386444 - protein, 11 aa, Influenza virus
GESEQIIVTRE

SEQ ID NO: 386445 - protein, 11 aa, Influenza virus
ESEQIIVTREP

SEQ ID NO: 386446 - protein, 11 aa, Influenza virus
SEQIIVTREPY

SEQ ID NO: 386447 - protein, 11 aa, Influenza virus
EQIIVTREPYV

SEQ ID NO: 386448 - protein, 11 aa, Influenza virus
QIIVTREPYVS

SEQ ID NO: 386449 - protein, 11 aa, Influenza virus
IIVTREPYVSC

SEQ ID NO: 386450 - protein, 11 aa, Influenza virus
IVTREPYVSCD

SEQ ID NO: 386451 - protein, 11 aa, Influenza virus
VTREPYVSCDP

SEQ ID NO: 386452 - protein, 11 aa, Influenza virus
TREPYVSCDPL

SEQ ID NO: 386453 - protein, 11 aa, Influenza virus
GCKMYALHQGT

SEQ ID NO: 386454 - protein, 11 aa, Influenza virus
CKMYALHQGTT

SEQ ID NO: 386455 - protein, 11 aa, Influenza virus
KMYALHQGTTI

SEQ ID NO: 386456 - protein, 11 aa, Influenza virus
MYALHQGTTIR

SEQ ID NO: 386457 - protein, 11 aa, Influenza virus
YALHQGTTIRN

SEQ ID NO: 386458 - protein, 11 aa, Influenza virus
ALHQGTTIRNK

SEQ ID NO: 386459 - protein, 11 aa, Influenza virus
LHQGTTIRNKH

SEQ ID NO: 386460 - protein, 11 aa, Influenza virus
HQGTTIRNKHS

SEQ ID NO: 386461 - protein, 11 aa, Influenza virus
QGTTIRNKHSN

SEQ ID NO: 386462 - protein, 11 aa, Influenza virus
GTTIRNKHSNG

SEQ ID NO: 386463 - protein, 11 aa, Influenza virus
TTIRNKHSNGT

SEQ ID NO: 386464 - protein, 11 aa, Influenza virus
TIRNKHSNGTI

SEQ ID NO: 386465 - protein, 11 aa, Influenza virus
IRNKHSNGTIH

SEQ ID NO: 386466 - protein, 11 aa, Influenza virus
RNKHSNGTIHD

SEQ ID NO: 386467 - protein, 11 aa, Influenza virus
NKHSNGTIHDR

SEQ ID NO: 386468 - protein, 11 aa, Influenza virus
TIHDRTAFRGL

SEQ ID NO: 386469 - protein, 11 aa, Influenza virus
DRTAFRGLIST

SEQ ID NO: 386470 - protein, 11 aa, Influenza virus
AFRGLISTPLG

SEQ ID NO: 386471 - protein, 11 aa, Influenza virus
SNSDFLCVGWS

SEQ ID NO: 386472 - protein, 11 aa, Influenza virus
NSDFLCVGWSS

SEQ ID NO: 386473 - protein, 11 aa, Influenza virus
SDFLCVGWSST

SEQ ID NO: 386474 - protein, 11 aa, Influenza virus
FLCVGWSSTSC

SEQ ID NO: 386475 - protein, 11 aa, Influenza virus
LCVGWSSTSCH

SEQ ID NO: 386476 - protein, 11 aa, Influenza virus
CVGWSSTSCHD

SEQ ID NO: 386477 - protein, 11 aa, Influenza virus
VGWSSTSCHDG

SEQ ID NO: 386478 - protein, 11 aa, Influenza virus
GWSSTSCHDGI

SEQ ID NO: 386479 - protein, 11 aa, Influenza virus
CHDGIGRMTIC

SEQ ID NO: 386480 - protein, 11 aa, Influenza virus
QGNNDNATATV

SEQ ID NO: 386481 - protein, 11 aa, Influenza virus
GNNDNATATVY

SEQ ID NO: 386482 - protein, 11 aa, Influenza virus
NNDNATATVYY

SEQ ID NO: 386483 - protein, 11 aa, Influenza virus
NDNATATVYYD

SEQ ID NO: 386484 - protein, 11 aa, Influenza virus
NATATVYYDRR

SEQ ID NO: 386485 - protein, 11 aa, Influenza virus
ATATVYYDRRL

SEQ ID NO: 386486 - protein, 11 aa, Influenza virus
TATVYYDRRLT

SEQ ID NO: 386487 - protein, 11 aa, Influenza virus
ATVYYDRRLTT

SEQ ID NO: 386488 - protein, 11 aa, Influenza virus
TVYYDRRLTTT

SEQ ID NO: 386489 - protein, 11 aa, Influenza virus
VYYDRRLTTTI

SEQ ID NO: 386490 - protein, 11 aa, Influenza virus
RRLTTTIKTWA

SEQ ID NO: 386491 - protein, 11 aa, Influenza virus
RLTTTIKTWAG

SEQ ID NO: 386492 - protein, 11 aa, Influenza virus
TTTIKTWAGNI

SEQ ID NO: 386493 - protein, 11 aa, Influenza virus
TTIKTWAGNIL

SEQ ID NO: 386494 - protein, 11 aa, Influenza virus
TIKTWAGNILR

SEQ ID NO: 386495 - protein, 11 aa, Influenza virus
IKTWAGNILRT

SEQ ID NO: 386496 - protein, 11 aa, Influenza virus
KTWAGNILRTQ

SEQ ID NO: 386497 - protein, 11 aa, Influenza virus
TWAGNILRTQE

SEQ ID NO: 386498 - protein, 11 aa, Influenza virus
WAGNILRTQES

SEQ ID NO: 386499 - protein, 11 aa, Influenza virus
AGNILRTQESE

SEQ ID NO: 386500 - protein, 11 aa, Influenza virus
GNILRTQESEC

SEQ ID NO: 386501 - protein, 11 aa, Influenza virus
NILRTQESECV

SEQ ID NO: 386502 - protein, 11 aa, Influenza virus
ILRTQESECVC

SEQ ID NO: 386503 - protein, 11 aa, Influenza virus
LRTQESECVCH

SEQ ID NO: 386504 - protein, 11 aa, Influenza virus
RTQESECVCHN

SEQ ID NO: 386505 - protein, 11 aa, Influenza virus
TQESECVCHNG

SEQ ID NO: 386506 - protein, 11 aa, Influenza virus
QESECVCHNGT

SEQ ID NO: 386507 - protein, 11 aa, Influenza virus
ESECVCHNGTC

SEQ ID NO: 386508 - protein, 11 aa, Influenza virus
SECVCHNGTCV

SEQ ID NO: 386509 - protein, 11 aa, Influenza virus
LKGSARHIEEC

SEQ ID NO: 386510 - protein, 11 aa, Influenza virus
GSARHIEECSC

SEQ ID NO: 386511 - protein, 11 aa, Influenza virus
SARHIEECSCY

SEQ ID NO: 386512 - protein, 11 aa, Influenza virus
ARHIEECSCYG

SEQ ID NO: 386513 - protein, 11 aa, Influenza virus
RHIEECSCYGH

SEQ ID NO: 386514 - protein, 11 aa, Influenza virus
HIEECSCYGHN

SEQ ID NO: 386515 - protein, 11 aa, Influenza virus
VTCVCRDNWQG

SEQ ID NO: 386516 - protein, 11 aa, Influenza virus
TCVCRDNWQGA

SEQ ID NO: 386517 - protein, 11 aa, Influenza virus
CVCRDNWQGAN

SEQ ID NO: 386518 - protein, 11 aa, Influenza virus
VCRDNWQGANR

SEQ ID NO: 386519 - protein, 11 aa, Influenza virus
CRDNWQGANRP

SEQ ID NO: 386520 - protein, 11 aa, Influenza virus
RDNWQGANRPV

SEQ ID NO: 386521 - protein, 11 aa, Influenza virus
DNWQGANRPVI

SEQ ID NO: 386522 - protein, 11 aa, Influenza virus
NWQGANRPVIE

SEQ ID NO: 386523 - protein, 11 aa, Influenza virus
WQGANRPVIEI

SEQ ID NO: 386524 - protein, 11 aa, Influenza virus
QGANRPVIEID

SEQ ID NO: 386525 - protein, 11 aa, Influenza virus
GANRPVIEIDM

SEQ ID NO: 386526 - protein, 11 aa, Influenza virus
CTGVLTDTSRP

SEQ ID NO: 386527 - protein, 11 aa, Influenza virus
TGVLTDTSRPS

SEQ ID NO: 386528 - protein, 11 aa, Influenza virus
GVLTDTSRPSD

SEQ ID NO: 386529 - protein, 11 aa, Influenza virus
GDCNNPITGSP

SEQ ID NO: 386530 - protein, 11 aa, Influenza virus
DCNNPITGSPG

SEQ ID NO: 386531 - protein, 11 aa, Influenza virus
NPITGSPGAPG

SEQ ID NO: 386532 - protein, 11 aa, Influenza virus
APGVKGFGFLD

SEQ ID NO: 386533 - protein, 11 aa, Influenza virus
NTWLGRTISPR

SEQ ID NO: 386534 - protein, 11 aa, Influenza virus
TWLGRTISPRS

SEQ ID NO: 386535 - protein, 11 aa, Influenza virus
WLGRTISPRSR

SEQ ID NO: 386536 - protein, 11 aa, Influenza virus
TISPRSRSGFE

SEQ ID NO: 386537 - protein, 11 aa, Influenza virus
SPRSRSGFEML

SEQ ID NO: 386538 - protein, 11 aa, Influenza virus
SRSGFEMLKIP

SEQ ID NO: 386539 - protein, 11 aa, Influenza virus
RSGFEMLKIPN

SEQ ID NO: 386540 - protein, 11 aa, Influenza virus
SGFEMLKIPNA

SEQ ID NO: 386541 - protein, 11 aa, Influenza virus
GFEMLKIPNAG

SEQ ID NO: 386542 - protein, 11 aa, Influenza virus
NWSGYSGSFID

SEQ ID NO: 386543 - protein, 11 aa, Influenza virus
WSGYSGSFIDY

SEQ ID NO: 386544 - protein, 11 aa, Influenza virus
SGYSGSFIDYW

SEQ ID NO: 386545 - protein, 11 aa, Influenza virus
GYSGSFIDYWD

SEQ ID NO: 386546 - protein, 11 aa, Influenza virus
YSGSFIDYWDE

SEQ ID NO: 386547 - protein, 11 aa, Influenza virus
SECYNPCFYVE

SEQ ID NO: 386548 - protein, 11 aa, Influenza virus
ECYNPCFYVEL

SEQ ID NO: 386549 - protein, 11 aa, Influenza virus
CYNPCFYVELI

SEQ ID NO: 386550 - protein, 11 aa, Influenza virus
YNPCFYVELIR

SEQ ID NO: 386551 - protein, 11 aa, Influenza virus
NPCFYVELIRG

SEQ ID NO: 386552 - protein, 11 aa, Influenza virus
PCFYVELIRGR

SEQ ID NO: 386553 - protein, 11 aa, Influenza virus
CFYVELIRGRP

SEQ ID NO: 386554 - protein, 11 aa, Influenza virus
FYVELIRGRPE

SEQ ID NO: 386555 - protein, 11 aa, Influenza virus
YVELIRGRPEE

SEQ ID NO: 386556 - protein, 11 aa, Influenza virus
VELIRGRPEEA

SEQ ID NO: 386557 - protein, 11 aa, Influenza virus
ELIRGRPEEAK

SEQ ID NO: 386558 - protein, 11 aa, Influenza virus
LIRGRPEEAKY

SEQ ID NO: 386559 - protein, 11 aa, Influenza virus
IRGRPEEAKYV

SEQ ID NO: 386560 - protein, 11 aa, Influenza virus
RGRPEEAKYVW

SEQ ID NO: 386561 - protein, 11 aa, Influenza virus
GRPEEAKYVWW

SEQ ID NO: 386562 - protein, 11 aa, Influenza virus
RPEEAKYVWWT

SEQ ID NO: 386563 - protein, 11 aa, Influenza virus
PEEAKYVWWTS

SEQ ID NO: 386564 - protein, 11 aa, Influenza virus
EEAKYVWWTSN

SEQ ID NO: 386565 - protein, 11 aa, Influenza virus
EAKYVWWTSNS

SEQ ID NO: 386566 - protein, 11 aa, Influenza virus
AKYVWWTSNSL

SEQ ID NO: 386567 - protein, 11 aa, Influenza virus
KYVWWTSNSLV

SEQ ID NO: 386568 - protein, 11 aa, Influenza virus
YVWWTSNSLVA

SEQ ID NO: 386569 - protein, 11 aa, Influenza virus
VWWTSNSLVAL

SEQ ID NO: 386570 - protein, 11 aa, Influenza virus
WWTSNSLVALC

SEQ ID NO: 386571 - protein, 11 aa, Influenza virus
WTSNSLVALCG

SEQ ID NO: 386572 - protein, 11 aa, Influenza virus
TSNSLVALCGS

SEQ ID NO: 386573 - protein, 11 aa, Influenza virus
SNSLVALCGSP

SEQ ID NO: 386574 - protein, 11 aa, Influenza virus
NSLVALCGSPI

SEQ ID NO: 386575 - protein, 11 aa, Influenza virus
SVGSGSFPDGA

SEQ ID NO: 386576 - protein, 11 aa, Influenza virus
VGSGSFPDGAQ

SEQ ID NO: 386577 - protein, 11 aa, Influenza virus
GSGSFPDGAQI

SEQ ID NO: 386578 - protein, 11 aa, Influenza virus
GSFPDGAQIQY

SEQ ID NO: 386579 - protein, 11 aa, Influenza virus
SFPDGAQIQYF

SEQ ID NO: 386580 - protein, 11 aa, Influenza virus
FPDGAQIQYFS

SEQ ID NO: 386581 - protein, 11 aa, Influenza virus
KGFAPFSKDNG

SEQ ID NO: 386582 - protein, 11 aa, Influenza virus
GFAPFSKDNGI

SEQ ID NO: 386583 - protein, 11 aa, Influenza virus
FAPFSKDNGIR

SEQ ID NO: 386584 - protein, 11 aa, Influenza virus
APFSKDNGIRI

SEQ ID NO: 386585 - protein, 11 aa, Influenza virus
PFSKDNGIRIG

SEQ ID NO: 386586 - protein, 11 aa, Influenza virus
FSKDNGIRIGS

SEQ ID NO: 386587 - protein, 11 aa, Influenza virus
SKDNGIRIGSR

SEQ ID NO: 386588 - protein, 11 aa, Influenza virus
KDNGIRIGSRG

SEQ ID NO: 386589 - protein, 11 aa, Influenza virus
DNGIRIGSRGH

SEQ ID NO: 386590 - protein, 11 aa, Influenza virus
NGIRIGSRGHV

SEQ ID NO: 386591 - protein, 11 aa, Influenza virus
GIRIGSRGHVF

SEQ ID NO: 386592 - protein, 11 aa, Influenza virus
IRIGSRGHVFV

SEQ ID NO: 386593 - protein, 11 aa, Influenza virus
RIGSRGHVFVI

SEQ ID NO: 386594 - protein, 11 aa, Influenza virus
IGSRGHVFVIR

SEQ ID NO: 386595 - protein, 11 aa, Influenza virus
GSRGHVFVIRE

SEQ ID NO: 386596 - protein, 11 aa, Influenza virus
SRGHVFVIREP

SEQ ID NO: 386597 - protein, 11 aa, Influenza virus
RGHVFVIREPF

SEQ ID NO: 386598 - protein, 11 aa, Influenza virus
GHVFVIREPFV

SEQ ID NO: 386599 - protein, 11 aa, Influenza virus
HVFVIREPFVS

SEQ ID NO: 386600 - protein, 11 aa, Influenza virus
VFVIREPFVSC

SEQ ID NO: 386601 - protein, 11 aa, Influenza virus
FVIREPFVSCS

SEQ ID NO: 386602 - protein, 11 aa, Influenza virus
VIREPFVSCSP

SEQ ID NO: 386603 - protein, 11 aa, Influenza virus
ECRTFFLTQGS

SEQ ID NO: 386604 - protein, 11 aa, Influenza virus
CRTFFLTQGSL

SEQ ID NO: 386605 - protein, 11 aa, Influenza virus
RTFFLTQGSLL

SEQ ID NO: 386606 - protein, 11 aa, Influenza virus
TFFLTQGSLLN

SEQ ID NO: 386607 - protein, 11 aa, Influenza virus
FFLTQGSLLND

SEQ ID NO: 386608 - protein, 11 aa, Influenza virus
FLTQGSLLNDK

SEQ ID NO: 386609 - protein, 11 aa, Influenza virus
LTQGSLLNDKH

SEQ ID NO: 386610 - protein, 11 aa, Influenza virus
TQGSLLNDKHS

SEQ ID NO: 386611 - protein, 11 aa, Influenza virus
QGSLLNDKHSN

SEQ ID NO: 386612 - protein, 11 aa, Influenza virus
GSLLNDKHSNG

SEQ ID NO: 386613 - protein, 11 aa, Influenza virus
SLLNDKHSNGT

SEQ ID NO: 386614 - protein, 11 aa, Influenza virus
NDKHSNGTVKD

SEQ ID NO: 386615 - protein, 11 aa, Influenza virus
DKHSNGTVKDR

SEQ ID NO: 386616 - protein, 11 aa, Influenza virus
KHSNGTVKDRS

SEQ ID NO: 386617 - protein, 11 aa, Influenza virus
HSNGTVKDRSP

SEQ ID NO: 386618 - protein, 11 aa, Influenza virus
SNGTVKDRSPY

SEQ ID NO: 386619 - protein, 11 aa, Influenza virus
NGTVKDRSPYR

SEQ ID NO: 386620 - protein, 11 aa, Influenza virus
GTVKDRSPYRT

SEQ ID NO: 386621 - protein, 11 aa, Influenza virus
TVKDRSPYRTL

SEQ ID NO: 386622 - protein, 11 aa, Influenza virus
VKDRSPYRTLM

SEQ ID NO: 386623 - protein, 11 aa, Influenza virus
KDRSPYRTLMS

SEQ ID NO: 386624 - protein, 11 aa, Influenza virus
DRSPYRTLMSV

SEQ ID NO: 386625 - protein, 11 aa, Influenza virus
RSPYRTLMSVE

SEQ ID NO: 386626 - protein, 11 aa, Influenza virus
GQSPNVYQARF

SEQ ID NO: 386627 - protein, 11 aa, Influenza virus
QSPNVYQARFE

SEQ ID NO: 386628 - protein, 11 aa, Influenza virus
VYQARFEAVAW

SEQ ID NO: 386629 - protein, 11 aa, Influenza virus
YQARFEAVAWS

SEQ ID NO: 386630 - protein, 11 aa, Influenza virus
QARFEAVAWSA

SEQ ID NO: 386631 - protein, 11 aa, Influenza virus
ARFEAVAWSAT

SEQ ID NO: 386632 - protein, 11 aa, Influenza virus
RFEAVAWSATA

SEQ ID NO: 386633 - protein, 11 aa, Influenza virus
FEAVAWSATAC

SEQ ID NO: 386634 - protein, 11 aa, Influenza virus
EAVAWSATACH

SEQ ID NO: 386635 - protein, 11 aa, Influenza virus
AVAWSATACHD

SEQ ID NO: 386636 - protein, 11 aa, Influenza virus
VAWSATACHDG

SEQ ID NO: 386637 - protein, 11 aa, Influenza virus
AWSATACHDGK

SEQ ID NO: 386638 - protein, 11 aa, Influenza virus
WSATACHDGKK

SEQ ID NO: 386639 - protein, 11 aa, Influenza virus
SATACHDGKKW

SEQ ID NO: 386640 - protein, 11 aa, Influenza virus
ATACHDGKKWM

SEQ ID NO: 386641 - protein, 11 aa, Influenza virus
GDILRTQESSC

SEQ ID NO: 386642 - protein, 11 aa, Influenza virus
DILRTQESSCT

SEQ ID NO: 386643 - protein, 11 aa, Influenza virus
ILRTQESSCTC

SEQ ID NO: 386644 - protein, 11 aa, Influenza virus
LRTQESSCTCI

SEQ ID NO: 386645 - protein, 11 aa, Influenza virus
RTQESSCTCIQ

SEQ ID NO: 386646 - protein, 11 aa, Influenza virus
TQESSCTCIQG

SEQ ID NO: 386647 - protein, 11 aa, Influenza virus
GECYWVMTDGP

SEQ ID NO: 386648 - protein, 11 aa, Influenza virus
ECYWVMTDGPA

SEQ ID NO: 386649 - protein, 11 aa, Influenza virus
CYWVMTDGPAN

SEQ ID NO: 386650 - protein, 11 aa, Influenza virus
WVMTDGPANRQ

SEQ ID NO: 386651 - protein, 11 aa, Influenza virus
VMTDGPANRQA

SEQ ID NO: 386652 - protein, 11 aa, Influenza virus
FNGGHIEECSC

SEQ ID NO: 386653 - protein, 11 aa, Influenza virus
NGGHIEECSCY

SEQ ID NO: 386654 - protein, 11 aa, Influenza virus
GGHIEECSCYP

SEQ ID NO: 386655 - protein, 11 aa, Influenza virus
GHIEECSCYPN

SEQ ID NO: 386656 - protein, 11 aa, Influenza virus
HIEECSCYPNE

SEQ ID NO: 386657 - protein, 11 aa, Influenza virus
IEECSCYPNEG

SEQ ID NO: 386658 - protein, 11 aa, Influenza virus
EECSCYPNEGK

SEQ ID NO: 386659 - protein, 11 aa, Influenza virus
ECSCYPNEGKV

SEQ ID NO: 386660 - protein, 11 aa, Influenza virus
CSCYPNEGKVE

SEQ ID NO: 386661 - protein, 11 aa, Influenza virus
SCYPNEGKVEC

SEQ ID NO: 386662 - protein, 11 aa, Influenza virus
CYPNEGKVECV

SEQ ID NO: 386663 - protein, 11 aa, Influenza virus
YPNEGKVECVC

SEQ ID NO: 386664 - protein, 11 aa, Influenza virus
PNEGKVECVCR

SEQ ID NO: 386665 - protein, 11 aa, Influenza virus
NEGKVECVCRD

SEQ ID NO: 386666 - protein, 11 aa, Influenza virus
EGKVECVCRDN

SEQ ID NO: 386667 - protein, 11 aa, Influenza virus
GKVECVCRDNW

SEQ ID NO: 386668 - protein, 11 aa, Influenza virus
KVECVCRDNWT

SEQ ID NO: 386669 - protein, 11 aa, Influenza virus
VECVCRDNWTG

SEQ ID NO: 386670 - protein, 11 aa, Influenza virus
ECVCRDNWTGT

SEQ ID NO: 386671 - protein, 11 aa, Influenza virus
CVCRDNWTGTN

SEQ ID NO: 386672 - protein, 11 aa, Influenza virus
VCRDNWTGTNR

SEQ ID NO: 386673 - protein, 11 aa, Influenza virus
CRDNWTGTNRP

SEQ ID NO: 386674 - protein, 11 aa, Influenza virus
RDNWTGTNRPV

SEQ ID NO: 386675 - protein, 11 aa, Influenza virus
DNWTGTNRPVL

SEQ ID NO: 386676 - protein, 11 aa, Influenza virus
NWTGTNRPVLV

SEQ ID NO: 386677 - protein, 11 aa, Influenza virus
WTGTNRPVLVI

SEQ ID NO: 386678 - protein, 11 aa, Influenza virus
LSYRVGYLCAG

SEQ ID NO: 386679 - protein, 11 aa, Influenza virus
VGYLCAGLPSD

SEQ ID NO: 386680 - protein, 11 aa, Influenza virus
GYLCAGLPSDT

SEQ ID NO: 386681 - protein, 11 aa, Influenza virus
YLCAGLPSDTP

SEQ ID NO: 386682 - protein, 11 aa, Influenza virus
LCAGLPSDTPR

SEQ ID NO: 386683 - protein, 11 aa, Influenza virus
CAGLPSDTPRG

SEQ ID NO: 386684 - protein, 11 aa, Influenza virus
AGLPSDTPRGE

SEQ ID NO: 386685 - protein, 11 aa, Influenza virus
GLPSDTPRGED

SEQ ID NO: 386686 - protein, 11 aa, Influenza virus
PSDTPRGEDSQ

SEQ ID NO: 386687 - protein, 11 aa, Influenza virus
SDTPRGEDSQF

SEQ ID NO: 386688 - protein, 11 aa, Influenza virus
QGYGVKGFGFR

SEQ ID NO: 386689 - protein, 11 aa, Influenza virus
GYGVKGFGFRQ

SEQ ID NO: 386690 - protein, 11 aa, Influenza virus
YGVKGFGFRQG

SEQ ID NO: 386691 - protein, 11 aa, Influenza virus
GVKGFGFRQGN

SEQ ID NO: 386692 - protein, 11 aa, Influenza virus
VKGFGFRQGND

SEQ ID NO: 386693 - protein, 11 aa, Influenza virus
KGFGFRQGNDV

SEQ ID NO: 386694 - protein, 11 aa, Influenza virus
GFGFRQGNDVW

SEQ ID NO: 386695 - protein, 11 aa, Influenza virus
DNLNWSGYSGS

SEQ ID NO: 386696 - protein, 11 aa, Influenza virus
NLNWSGYSGSF

SEQ ID NO: 386697 - protein, 11 aa, Influenza virus
LNWSGYSGSFT

SEQ ID NO: 386698 - protein, 11 aa, Influenza virus
NWSGYSGSFTL

SEQ ID NO: 386699 - protein, 11 aa, Influenza virus
WSGYSGSFTLP

SEQ ID NO: 386700 - protein, 11 aa, Influenza virus
SGYSGSFTLPV

SEQ ID NO: 386701 - protein, 11 aa, Influenza virus
GYSGSFTLPVE

SEQ ID NO: 386702 - protein, 11 aa, Influenza virus
YSGSFTLPVEL

SEQ ID NO: 386703 - protein, 11 aa, Influenza virus
CLVPCFWVEMI

SEQ ID NO: 386704 - protein, 11 aa, Influenza virus
LVPCFWVEMIR

SEQ ID NO: 386705 - protein, 11 aa, Influenza virus
VPCFWVEMIRG

SEQ ID NO: 386706 - protein, 11 aa, Influenza virus
PCFWVEMIRGK

SEQ ID NO: 386707 - protein, 11 aa, Influenza virus
CFWVEMIRGKP

SEQ ID NO: 386708 - protein, 11 aa, Influenza virus
FWVEMIRGKPE

SEQ ID NO: 386709 - protein, 11 aa, Influenza virus
WVEMIRGKPEE

SEQ ID NO: 386710 - protein, 11 aa, Influenza virus
TIWTSSSSIVM

SEQ ID NO: 386711 - protein, 11 aa, Influenza virus
IWTSSSSIVMC

SEQ ID NO: 386712 - protein, 11 aa, Influenza virus
WTSSSSIVMCG

SEQ ID NO: 386713 - protein, 11 aa, Influenza virus
TSSSSIVMCGV

SEQ ID NO: 386714 - protein, 11 aa, Influenza virus
SSSSIVMCGVD

SEQ ID NO: 386715 - protein, 11 aa, Influenza virus
SSSIVMCGVDH

SEQ ID NO: 386716 - protein, 11 aa, Influenza virus
DWSWHDGAILP

SEQ ID NO: 386717 - protein, 11 aa, Influenza virus
WSWHDGAILPF

SEQ ID NO: 386718 - protein, 11 aa, Influenza virus
AILPFDFDKIS

SEQ ID NO: 386719 - protein, 11 aa, Influenza virus
ILPFDFDKISQ

SEQ ID NO: 386720 - protein, 11 aa, Influenza virus
MNPNQKILCTS

SEQ ID NO: 386721 - protein, 11 aa, Influenza virus
NPNQKILCTSA

SEQ ID NO: 386722 - protein, 11 aa, Influenza virus
PNQKILCTSAT

SEQ ID NO: 386723 - protein, 11 aa, Influenza virus
NQKILCTSATA

SEQ ID NO: 386724 - protein, 11 aa, Influenza virus
QKILCTSATAI

SEQ ID NO: 386725 - protein, 11 aa, Influenza virus
ANLGLNIGLHL

SEQ ID NO: 386726 - protein, 11 aa, Influenza virus
NLGLNIGLHLK

SEQ ID NO: 386727 - protein, 11 aa, Influenza virus
LGLNIGLHLKP

SEQ ID NO: 386728 - protein, 11 aa, Influenza virus
FNNLTKGLCTI

SEQ ID NO: 386729 - protein, 11 aa, Influenza virus
NNLTKGLCTIN

SEQ ID NO: 386730 - protein, 11 aa, Influenza virus
NLTKGLCTINS

SEQ ID NO: 386731 - protein, 11 aa, Influenza virus
LTKGLCTINSW

SEQ ID NO: 386732 - protein, 11 aa, Influenza virus
TKGLCTINSWH

SEQ ID NO: 386733 - protein, 11 aa, Influenza virus
KGLCTINSWHI

SEQ ID NO: 386734 - protein, 11 aa, Influenza virus
GLCTINSWHIY

SEQ ID NO: 386735 - protein, 11 aa, Influenza virus
LCTINSWHIYG

SEQ ID NO: 386736 - protein, 11 aa, Influenza virus
CTINSWHIYGK

SEQ ID NO: 386737 - protein, 11 aa, Influenza virus
TINSWHIYGKD

SEQ ID NO: 386738 - protein, 11 aa, Influenza virus
INSWHIYGKDN

SEQ ID NO: 386739 - protein, 11 aa, Influenza virus
NSWHIYGKDNA

SEQ ID NO: 386740 - protein, 11 aa, Influenza virus
SWHIYGKDNAV

SEQ ID NO: 386741 - protein, 11 aa, Influenza virus
WHIYGKDNAVR

SEQ ID NO: 386742 - protein, 11 aa, Influenza virus
HIYGKDNAVRI

SEQ ID NO: 386743 - protein, 11 aa, Influenza virus
IYGKDNAVRIG

SEQ ID NO: 386744 - protein, 11 aa, Influenza virus
YGKDNAVRIGE

SEQ ID NO: 386745 - protein, 11 aa, Influenza virus
GKDNAVRIGED

SEQ ID NO: 386746 - protein, 11 aa, Influenza virus
KDNAVRIGEDS

SEQ ID NO: 386747 - protein, 11 aa, Influenza virus
RIGEDSDVLVT

SEQ ID NO: 386748 - protein, 11 aa, Influenza virus
IGEDSDVLVTR

SEQ ID NO: 386749 - protein, 11 aa, Influenza virus
GEDSDVLVTRE

SEQ ID NO: 386750 - protein, 11 aa, Influenza virus
DSDVLVTREPY

SEQ ID NO: 386751 - protein, 11 aa, Influenza virus
SDVLVTREPYV

SEQ ID NO: 386752 - protein, 11 aa, Influenza virus
DVLVTREPYVS

SEQ ID NO: 386753 - protein, 11 aa, Influenza virus
VLVTREPYVSC

SEQ ID NO: 386754 - protein, 11 aa, Influenza virus
LVTREPYVSCD

SEQ ID NO: 386755 - protein, 11 aa, Influenza virus
VTREPYVSCDP

SEQ ID NO: 386756 - protein, 11 aa, Influenza virus
TREPYVSCDPD

SEQ ID NO: 386757 - protein, 11 aa, Influenza virus
REPYVSCDPDE

SEQ ID NO: 386758 - protein, 11 aa, Influenza virus
EPYVSCDPDEC

SEQ ID NO: 386759 - protein, 11 aa, Influenza virus
PYVSCDPDECR

SEQ ID NO: 386760 - protein, 11 aa, Influenza virus
YVSCDPDECRF

SEQ ID NO: 386761 - protein, 11 aa, Influenza virus
VSCDPDECRFY

SEQ ID NO: 386762 - protein, 11 aa, Influenza virus
SCDPDECRFYA

SEQ ID NO: 386763 - protein, 11 aa, Influenza virus
CDPDECRFYAL

SEQ ID NO: 386764 - protein, 11 aa, Influenza virus
DPDECRFYALS

SEQ ID NO: 386765 - protein, 11 aa, Influenza virus
PDECRFYALSQ

SEQ ID NO: 386766 - protein, 11 aa, Influenza virus
DECRFYALSQG

SEQ ID NO: 386767 - protein, 11 aa, Influenza virus
ECRFYALSQGT

SEQ ID NO: 386768 - protein, 11 aa, Influenza virus
CRFYALSQGTT

SEQ ID NO: 386769 - protein, 11 aa, Influenza virus
RFYALSQGTTI

SEQ ID NO: 386770 - protein, 11 aa, Influenza virus
FYALSQGTTIR

SEQ ID NO: 386771 - protein, 11 aa, Influenza virus
YALSQGTTIRG

SEQ ID NO: 386772 - protein, 11 aa, Influenza virus
ALSQGTTIRGK

SEQ ID NO: 386773 - protein, 11 aa, Influenza virus
LSQGTTIRGKH

SEQ ID NO: 386774 - protein, 11 aa, Influenza virus
SQGTTIRGKHS

SEQ ID NO: 386775 - protein, 11 aa, Influenza virus
QGTTIRGKHSN

SEQ ID NO: 386776 - protein, 11 aa, Influenza virus
GTTIRGKHSNG

SEQ ID NO: 386777 - protein, 11 aa, Influenza virus
TTIRGKHSNGT

SEQ ID NO: 386778 - protein, 11 aa, Influenza virus
TIRGKHSNGTI

SEQ ID NO: 386779 - protein, 11 aa, Influenza virus
IRGKHSNGTIH

SEQ ID NO: 386780 - protein, 11 aa, Influenza virus
RGKHSNGTIHD

SEQ ID NO: 386781 - protein, 11 aa, Influenza virus
GKHSNGTIHDR

SEQ ID NO: 386782 - protein, 11 aa, Influenza virus
KHSNGTIHDRS

SEQ ID NO: 386783 - protein, 11 aa, Influenza virus
HSNGTIHDRSQ

SEQ ID NO: 386784 - protein, 11 aa, Influenza virus
SNGTIHDRSQY

SEQ ID NO: 386785 - protein, 11 aa, Influenza virus
NGTIHDRSQYR

SEQ ID NO: 386786 - protein, 11 aa, Influenza virus
GTIHDRSQYRA

SEQ ID NO: 386787 - protein, 11 aa, Influenza virus
TIHDRSQYRAL

SEQ ID NO: 386788 - protein, 11 aa, Influenza virus
IHDRSQYRALI

SEQ ID NO: 386789 - protein, 11 aa, Influenza virus
HDRSQYRALIS

SEQ ID NO: 386790 - protein, 11 aa, Influenza virus
DRSQYRALISW

SEQ ID NO: 386791 - protein, 11 aa, Influenza virus
RSQYRALISWP

SEQ ID NO: 386792 - protein, 11 aa, Influenza virus
SQYRALISWPL

SEQ ID NO: 386793 - protein, 11 aa, Influenza virus
QYRALISWPLS

SEQ ID NO: 386794 - protein, 11 aa, Influenza virus
YRALISWPLSS

SEQ ID NO: 386795 - protein, 11 aa, Influenza virus
RALISWPLSSP

SEQ ID NO: 386796 - protein, 11 aa, Influenza virus
ALISWPLSSPP

SEQ ID NO: 386797 - protein, 11 aa, Influenza virus
LISWPLSSPPT

SEQ ID NO: 386798 - protein, 11 aa, Influenza virus
ISWPLSSPPTV

SEQ ID NO: 386799 - protein, 11 aa, Influenza virus
SWPLSSPPTVY

SEQ ID NO: 386800 - protein, 11 aa, Influenza virus
WPLSSPPTVYN

SEQ ID NO: 386801 - protein, 11 aa, Influenza virus
PLSSPPTVYNS

SEQ ID NO: 386802 - protein, 11 aa, Influenza virus
RVECIGWSSTS

SEQ ID NO: 386803 - protein, 11 aa, Influenza virus
VECIGWSSTSC

SEQ ID NO: 386804 - protein, 11 aa, Influenza virus
ECIGWSSTSCH

SEQ ID NO: 386805 - protein, 11 aa, Influenza virus
CIGWSSTSCHD

SEQ ID NO: 386806 - protein, 11 aa, Influenza virus
IGWSSTSCHDG

SEQ ID NO: 386807 - protein, 11 aa, Influenza virus
GWSSTSCHDGR

SEQ ID NO: 386808 - protein, 11 aa, Influenza virus
WSSTSCHDGRA

SEQ ID NO: 386809 - protein, 11 aa, Influenza virus
SSTSCHDGRAR

SEQ ID NO: 386810 - protein, 11 aa, Influenza virus
STSCHDGRARM

SEQ ID NO: 386811 - protein, 11 aa, Influenza virus
TSCHDGRARMS

SEQ ID NO: 386812 - protein, 11 aa, Influenza virus
RMSICISGPNN

SEQ ID NO: 386813 - protein, 11 aa, Influenza virus
MSICISGPNNN

SEQ ID NO: 386814 - protein, 11 aa, Influenza virus
SICISGPNNNA

SEQ ID NO: 386815 - protein, 11 aa, Influenza virus
ICISGPNNNAS

SEQ ID NO: 386816 - protein, 11 aa, Influenza virus
CISGPNNNASA

SEQ ID NO: 386817 - protein, 11 aa, Influenza virus
ISGPNNNASAV

SEQ ID NO: 386818 - protein, 11 aa, Influenza virus
SGPNNNASAVI

SEQ ID NO: 386819 - protein, 11 aa, Influenza virus
GPNNNASAVIW

SEQ ID NO: 386820 - protein, 11 aa, Influenza virus
PNNNASAVIWY

SEQ ID NO: 386821 - protein, 11 aa, Influenza virus
NNNASAVIWYN

SEQ ID NO: 386822 - protein, 11 aa, Influenza virus
RPVTEINTWAR

SEQ ID NO: 386823 - protein, 11 aa, Influenza virus
PVTEINTWARN

SEQ ID NO: 386824 - protein, 11 aa, Influenza virus
VTEINTWARNI

SEQ ID NO: 386825 - protein, 11 aa, Influenza virus
TEINTWARNIL

SEQ ID NO: 386826 - protein, 11 aa, Influenza virus
EINTWARNILR

SEQ ID NO: 386827 - protein, 11 aa, Influenza virus
INTWARNILRT

SEQ ID NO: 386828 - protein, 11 aa, Influenza virus
NTWARNILRTQ

SEQ ID NO: 386829 - protein, 11 aa, Influenza virus
TWARNILRTQE

SEQ ID NO: 386830 - protein, 11 aa, Influenza virus
WARNILRTQES

SEQ ID NO: 386831 - protein, 11 aa, Influenza virus
ARNILRTQESE

SEQ ID NO: 386832 - protein, 11 aa, Influenza virus
RNILRTQESEC

SEQ ID NO: 386833 - protein, 11 aa, Influenza virus
NILRTQESECV

SEQ ID NO: 386834 - protein, 11 aa, Influenza virus
ILRTQESECVC

SEQ ID NO: 386835 - protein, 11 aa, Influenza virus
LRTQESECVCH

SEQ ID NO: 386836 - protein, 11 aa, Influenza virus
RTQESECVCHN

SEQ ID NO: 386837 - protein, 11 aa, Influenza virus
TQESECVCHNG

SEQ ID NO: 386838 - protein, 11 aa, Influenza virus
QESECVCHNGV

SEQ ID NO: 386839 - protein, 11 aa, Influenza virus
ESECVCHNGVC

SEQ ID NO: 386840 - protein, 11 aa, Influenza virus
SECVCHNGVCP

SEQ ID NO: 386841 - protein, 11 aa, Influenza virus
ECVCHNGVCPV

SEQ ID NO: 386842 - protein, 11 aa, Influenza virus
CVCHNGVCPVV

SEQ ID NO: 386843 - protein, 11 aa, Influenza virus
VCHNGVCPVVF

SEQ ID NO: 386844 - protein, 11 aa, Influenza virus
CHNGVCPVVFT

SEQ ID NO: 386845 - protein, 11 aa, Influenza virus
HNGVCPVVFTD

SEQ ID NO: 386846 - protein, 11 aa, Influenza virus
NGVCPVVFTDG

SEQ ID NO: 386847 - protein, 11 aa, Influenza virus
GVCPVVFTDGS

SEQ ID NO: 386848 - protein, 11 aa, Influenza virus
VCPVVFTDGSA

SEQ ID NO: 386849 - protein, 11 aa, Influenza virus
CPVVFTDGSAT

SEQ ID NO: 386850 - protein, 11 aa, Influenza virus
PVVFTDGSATG

SEQ ID NO: 386851 - protein, 11 aa, Influenza virus
VVFTDGSATGP

SEQ ID NO: 386852 - protein, 11 aa, Influenza virus
VFTDGSATGPA

SEQ ID NO: 386853 - protein, 11 aa, Influenza virus
FTDGSATGPAE

SEQ ID NO: 386854 - protein, 11 aa, Influenza virus
TDGSATGPAET

SEQ ID NO: 386855 - protein, 11 aa, Influenza virus
DGSATGPAETR

SEQ ID NO: 386856 - protein, 11 aa, Influenza virus
GSATGPAETRV

SEQ ID NO: 386857 - protein, 11 aa, Influenza virus
SATGPAETRVY

SEQ ID NO: 386858 - protein, 11 aa, Influenza virus
ATGPAETRVYY

SEQ ID NO: 386859 - protein, 11 aa, Influenza virus
TGPAETRVYYF

SEQ ID NO: 386860 - protein, 11 aa, Influenza virus
LTGTAKHIEEC

SEQ ID NO: 386861 - protein, 11 aa, Influenza virus
TGTAKHIEECS

SEQ ID NO: 386862 - protein, 11 aa, Influenza virus
GTAKHIEECSC

SEQ ID NO: 386863 - protein, 11 aa, Influenza virus
TAKHIEECSCY

SEQ ID NO: 386864 - protein, 11 aa, Influenza virus
AKHIEECSCYG

SEQ ID NO: 386865 - protein, 11 aa, Influenza virus
KHIEECSCYGE

SEQ ID NO: 386866 - protein, 11 aa, Influenza virus
ITCTCRDNWQG

SEQ ID NO: 386867 - protein, 11 aa, Influenza virus
TCTCRDNWQGS

SEQ ID NO: 386868 - protein, 11 aa, Influenza virus
CTCRDNWQGSN

SEQ ID NO: 386869 - protein, 11 aa, Influenza virus
TCRDNWQGSNR

SEQ ID NO: 386870 - protein, 11 aa, Influenza virus
CRDNWQGSNRP

SEQ ID NO: 386871 - protein, 11 aa, Influenza virus
RDNWQGSNRPV

SEQ ID NO: 386872 - protein, 11 aa, Influenza virus
DNWQGSNRPVI

SEQ ID NO: 386873 - protein, 11 aa, Influenza virus
NWQGSNRPVIQ

SEQ ID NO: 386874 - protein, 11 aa, Influenza virus
WQGSNRPVIQI

SEQ ID NO: 386875 - protein, 11 aa, Influenza virus
QGSNRPVIQID

SEQ ID NO: 386876 - protein, 11 aa, Influenza virus
GSNRPVIQIDP

SEQ ID NO: 386877 - protein, 11 aa, Influenza virus
AMTHTSQYICS

SEQ ID NO: 386878 - protein, 11 aa, Influenza virus
MTHTSQYICSP

SEQ ID NO: 386879 - protein, 11 aa, Influenza virus
THTSQYICSPV

SEQ ID NO: 386880 - protein, 11 aa, Influenza virus
HTSQYICSPVL

SEQ ID NO: 386881 - protein, 11 aa, Influenza virus
TSQYICSPVLT

SEQ ID NO: 386882 - protein, 11 aa, Influenza virus
SQYICSPVLTD

SEQ ID NO: 386883 - protein, 11 aa, Influenza virus
QYICSPVLTDN

SEQ ID NO: 386884 - protein, 11 aa, Influenza virus
YICSPVLTDNP

SEQ ID NO: 386885 - protein, 11 aa, Influenza virus
ICSPVLTDNPR

SEQ ID NO: 386886 - protein, 11 aa, Influenza virus
CSPVLTDNPRP

SEQ ID NO: 386887 - protein, 11 aa, Influenza virus
SPVLTDNPRPN

SEQ ID NO: 386888 - protein, 11 aa, Influenza virus
PVLTDNPRPND

SEQ ID NO: 386889 - protein, 11 aa, Influenza virus
VLTDNPRPNDP

SEQ ID NO: 386890 - protein, 11 aa, Influenza virus
LTDNPRPNDPA

SEQ ID NO: 386891 - protein, 11 aa, Influenza virus
VGKCNDPYPGN

SEQ ID NO: 386892 - protein, 11 aa, Influenza virus
GKCNDPYPGNN

SEQ ID NO: 386893 - protein, 11 aa, Influenza virus
KCNDPYPGNNN

SEQ ID NO: 386894 - protein, 11 aa, Influenza virus
CNDPYPGNNNN

SEQ ID NO: 386895 - protein, 11 aa, Influenza virus
NDPYPGNNNNG

SEQ ID NO: 386896 - protein, 11 aa, Influenza virus
DPYPGNNNNGV

SEQ ID NO: 386897 - protein, 11 aa, Influenza virus
PYPGNNNNGVK

SEQ ID NO: 386898 - protein, 11 aa, Influenza virus
YPGNNNNGVKG

SEQ ID NO: 386899 - protein, 11 aa, Influenza virus
PGNNNNGVKGF

SEQ ID NO: 386900 - protein, 11 aa, Influenza virus
GNNNNGVKGFS

SEQ ID NO: 386901 - protein, 11 aa, Influenza virus
NNNNGVKGFSY

SEQ ID NO: 386902 - protein, 11 aa, Influenza virus
NNNGVKGFSYL

SEQ ID NO: 386903 - protein, 11 aa, Influenza virus
NNGVKGFSYLD

SEQ ID NO: 386904 - protein, 11 aa, Influenza virus
NGVKGFSYLDG

SEQ ID NO: 386905 - protein, 11 aa, Influenza virus
NTWLGRTISTA

SEQ ID NO: 386906 - protein, 11 aa, Influenza virus
TWLGRTISTAS

SEQ ID NO: 386907 - protein, 11 aa, Influenza virus
WLGRTISTASR

SEQ ID NO: 386908 - protein, 11 aa, Influenza virus
GRTISTASRSG

SEQ ID NO: 386909 - protein, 11 aa, Influenza virus
RTISTASRSGY

SEQ ID NO: 386910 - protein, 11 aa, Influenza virus
TISTASRSGYE

SEQ ID NO: 386911 - protein, 11 aa, Influenza virus
STASRSGYEML

SEQ ID NO: 386912 - protein, 11 aa, Influenza virus
TASRSGYEMLK

SEQ ID NO: 386913 - protein, 11 aa, Influenza virus
ASRSGYEMLKV

SEQ ID NO: 386914 - protein, 11 aa, Influenza virus
SRSGYEMLKVP

SEQ ID NO: 386915 - protein, 11 aa, Influenza virus
RSGYEMLKVPN

SEQ ID NO: 386916 - protein, 11 aa, Influenza virus
SGYEMLKVPNA

SEQ ID NO: 386917 - protein, 11 aa, Influenza virus
GYEMLKVPNAL

SEQ ID NO: 386918 - protein, 11 aa, Influenza virus
YEMLKVPNALT

SEQ ID NO: 386919 - protein, 11 aa, Influenza virus
EMLKVPNALTD

SEQ ID NO: 386920 - protein, 11 aa, Influenza virus
MLKVPNALTDD

SEQ ID NO: 386921 - protein, 11 aa, Influenza virus
LKVPNALTDDR

SEQ ID NO: 386922 - protein, 11 aa, Influenza virus
KVPNALTDDRS

SEQ ID NO: 386923 - protein, 11 aa, Influenza virus
VPNALTDDRSK

SEQ ID NO: 386924 - protein, 11 aa, Influenza virus
PNALTDDRSKP

SEQ ID NO: 386925 - protein, 11 aa, Influenza virus
QGQTIVLNTDW

SEQ ID NO: 386926 - protein, 11 aa, Influenza virus
GQTIVLNTDWS

SEQ ID NO: 386927 - protein, 11 aa, Influenza virus
QTIVLNTDWSG

SEQ ID NO: 386928 - protein, 11 aa, Influenza virus
TIVLNTDWSGY

SEQ ID NO: 386929 - protein, 11 aa, Influenza virus
IVLNTDWSGYS

SEQ ID NO: 386930 - protein, 11 aa, Influenza virus
VLNTDWSGYSG

SEQ ID NO: 386931 - protein, 11 aa, Influenza virus
LNTDWSGYSGS

SEQ ID NO: 386932 - protein, 11 aa, Influenza virus
NTDWSGYSGSF

SEQ ID NO: 386933 - protein, 11 aa, Influenza virus
TDWSGYSGSFM

SEQ ID NO: 386934 - protein, 11 aa, Influenza virus
DWSGYSGSFMD

SEQ ID NO: 386935 - protein, 11 aa, Influenza virus
WSGYSGSFMDY

SEQ ID NO: 386936 - protein, 11 aa, Influenza virus
SGYSGSFMDYW

SEQ ID NO: 386937 - protein, 11 aa, Influenza virus
GYSGSFMDYWA

SEQ ID NO: 386938 - protein, 11 aa, Influenza virus
YSGSFMDYWAE

SEQ ID NO: 386939 - protein, 11 aa, Influenza virus
SGSFMDYWAEG

SEQ ID NO: 386940 - protein, 11 aa, Influenza virus
DYWAEGECYRA

SEQ ID NO: 386941 - protein, 11 aa, Influenza virus
YWAEGECYRAC

SEQ ID NO: 386942 - protein, 11 aa, Influenza virus
WAEGECYRACF

SEQ ID NO: 386943 - protein, 11 aa, Influenza virus
AEGECYRACFY

SEQ ID NO: 386944 - protein, 11 aa, Influenza virus
EGECYRACFYV

SEQ ID NO: 386945 - protein, 11 aa, Influenza virus
GECYRACFYVE

SEQ ID NO: 386946 - protein, 11 aa, Influenza virus
ECYRACFYVEL

SEQ ID NO: 386947 - protein, 11 aa, Influenza virus
CYRACFYVELI

SEQ ID NO: 386948 - protein, 11 aa, Influenza virus
YRACFYVELIR

SEQ ID NO: 386949 - protein, 11 aa, Influenza virus
RACFYVELIRG

SEQ ID NO: 386950 - protein, 11 aa, Influenza virus
ACFYVELIRGR

SEQ ID NO: 386951 - protein, 11 aa, Influenza virus
CFYVELIRGRP

SEQ ID NO: 386952 - protein, 11 aa, Influenza virus
FYVELIRGRPK

SEQ ID NO: 386953 - protein, 11 aa, Influenza virus
YVELIRGRPKE

SEQ ID NO: 386954 - protein, 11 aa, Influenza virus
VELIRGRPKED

SEQ ID NO: 386955 - protein, 11 aa, Influenza virus
ELIRGRPKEDK

SEQ ID NO: 386956 - protein, 11 aa, Influenza virus
LIRGRPKEDKV

SEQ ID NO: 386957 - protein, 11 aa, Influenza virus
IRGRPKEDKVW

SEQ ID NO: 386958 - protein, 11 aa, Influenza virus
RGRPKEDKVWW

SEQ ID NO: 386959 - protein, 11 aa, Influenza virus
GRPKEDKVWWT

SEQ ID NO: 386960 - protein, 11 aa, Influenza virus
RPKEDKVWWTS

SEQ ID NO: 386961 - protein, 11 aa, Influenza virus
PKEDKVWWTSN

SEQ ID NO: 386962 - protein, 11 aa, Influenza virus
KEDKVWWTSNS

SEQ ID NO: 386963 - protein, 11 aa, Influenza virus
EDKVWWTSNSI

SEQ ID NO: 386964 - protein, 11 aa, Influenza virus
DKVWWTSNSIV

SEQ ID NO: 386965 - protein, 11 aa, Influenza virus
KVWWTSNSIVS

SEQ ID NO: 386966 - protein, 11 aa, Influenza virus
VWWTSNSIVSM

SEQ ID NO: 386967 - protein, 11 aa, Influenza virus
WWTSNSIVSMC

SEQ ID NO: 386968 - protein, 11 aa, Influenza virus
WTSNSIVSMCS

SEQ ID NO: 386969 - protein, 11 aa, Influenza virus
TSNSIVSMCSS

SEQ ID NO: 386970 - protein, 11 aa, Influenza virus
SNSIVSMCSST

SEQ ID NO: 386971 - protein, 11 aa, Influenza virus
NSIVSMCSSTE

SEQ ID NO: 386972 - protein, 11 aa, Influenza virus
SIVSMCSSTEF

SEQ ID NO: 386973 - protein, 11 aa, Influenza virus
IVSMCSSTEFL

SEQ ID NO: 386974 - protein, 11 aa, Influenza virus
VSMCSSTEFLG

SEQ ID NO: 386975 - protein, 11 aa, Influenza virus
SMCSSTEFLGQ

SEQ ID NO: 386976 - protein, 11 aa, Influenza virus
MCSSTEFLGQW

SEQ ID NO: 386977 - protein, 11 aa, Influenza virus
CSSTEFLGQWN

SEQ ID NO: 386978 - protein, 11 aa, Influenza virus
SSTEFLGQWNW

SEQ ID NO: 386979 - protein, 11 aa, Influenza virus
STEFLGQWNWP

SEQ ID NO: 386980 - protein, 11 aa, Influenza virus
TEFLGQWNWPD

SEQ ID NO: 386981 - protein, 11 aa, Influenza virus
EFLGQWNWPDG

SEQ ID NO: 386982 - protein, 11 aa, Influenza virus
FLGQWNWPDGA

SEQ ID NO: 386983 - protein, 11 aa, Influenza virus
LGQWNWPDGAK

SEQ ID NO: 386984 - protein, 11 aa, Influenza virus
GQWNWPDGAKI

SEQ ID NO: 386985 - protein, 11 aa, Influenza virus
QWNWPDGAKIE

SEQ ID NO: 386986 - protein, 11 aa, Influenza virus
WNWPDGAKIEY

SEQ ID NO: 386987 - protein, 11 aa, Influenza virus
NWPDGAKIEYF

SEQ ID NO: 386988 - protein, 11 aa, Influenza virus
WPDGAKIEYFL

SEQ ID NO: 386989 - protein, 11 aa, Influenza virus
GLDKICLGHHA

SEQ ID NO: 386990 - protein, 11 aa, Influenza virus
LDKICLGHHAV

SEQ ID NO: 386991 - protein, 11 aa, Influenza virus
DKICLGHHAVS

SEQ ID NO: 386992 - protein, 11 aa, Influenza virus
KICLGHHAVSN

SEQ ID NO: 386993 - protein, 11 aa, Influenza virus
ICLGHHAVSNG

SEQ ID NO: 386994 - protein, 11 aa, Influenza virus
CLGHHAVSNGT

SEQ ID NO: 386995 - protein, 11 aa, Influenza virus
KEEVTNATETV

SEQ ID NO: 386996 - protein, 11 aa, Influenza virus
EEVTNATETVE

SEQ ID NO: 386997 - protein, 11 aa, Influenza virus
EVTNATETVES

SEQ ID NO: 386998 - protein, 11 aa, Influenza virus
NEEALRQKIME

SEQ ID NO: 386999 - protein, 11 aa, Influenza virus
EEALRQKIMES

SEQ ID NO: 387000 - protein, 11 aa, Influenza virus
EALRQKIMESG

SEQ ID NO: 387001 - protein, 11 aa, Influenza virus
ALRQKIMESGG

SEQ ID NO: 387002 - protein, 11 aa, Influenza virus
LRQKIMESGGI

SEQ ID NO: 387003 - protein, 11 aa, Influenza virus
QNFPQTTNTYR

SEQ ID NO: 387004 - protein, 11 aa, Influenza virus
NFPQTTNTYRN

SEQ ID NO: 387005 - protein, 11 aa, Influenza virus
FPQTTNTYRNT

SEQ ID NO: 387006 - protein, 11 aa, Influenza virus
PQTTNTYRNTD

SEQ ID NO: 387007 - protein, 11 aa, Influenza virus
QTTNTYRNTDS

SEQ ID NO: 387008 - protein, 11 aa, Influenza virus
LYGTQSLSISV

SEQ ID NO: 387009 - protein, 11 aa, Influenza virus
YGTQSLSISVG

SEQ ID NO: 387010 - protein, 11 aa, Influenza virus
GTQSLSISVGS

SEQ ID NO: 387011 - protein, 11 aa, Influenza virus
TQSLSISVGSS

SEQ ID NO: 387012 - protein, 11 aa, Influenza virus
QSLSISVGSST

SEQ ID NO: 387013 - protein, 11 aa, Influenza virus
SLSISVGSSTY

SEQ ID NO: 387014 - protein, 11 aa, Influenza virus
LSISVGSSTYQ

SEQ ID NO: 387015 - protein, 11 aa, Influenza virus
SISVGSSTYQN

SEQ ID NO: 387016 - protein, 11 aa, Influenza virus
VGSSTYQNNFV

SEQ ID NO: 387017 - protein, 11 aa, Influenza virus
GSSTYQNNFVP

SEQ ID NO: 387018 - protein, 11 aa, Influenza virus
SSTYQNNFVPV

SEQ ID NO: 387019 - protein, 11 aa, Influenza virus
STYQNNFVPVV

SEQ ID NO: 387020 - protein, 11 aa, Influenza virus
NNFVPVVGARP

SEQ ID NO: 387021 - protein, 11 aa, Influenza virus
FVPVVGARPQV

SEQ ID NO: 387022 - protein, 11 aa, Influenza virus
VPVVGARPQVN

SEQ ID NO: 387023 - protein, 11 aa, Influenza virus
PVVGARPQVNG

SEQ ID NO: 387024 - protein, 11 aa, Influenza virus
VVGARPQVNGQ

SEQ ID NO: 387025 - protein, 11 aa, Influenza virus
GARPQVNGQSG

SEQ ID NO: 387026 - protein, 11 aa, Influenza virus
ARPQVNGQSGR

SEQ ID NO: 387027 - protein, 11 aa, Influenza virus
RPQVNGQSGRI

SEQ ID NO: 387028 - protein, 11 aa, Influenza virus
VNGQSGRIDFH

SEQ ID NO: 387029 - protein, 11 aa, Influenza virus
NGQSGRIDFHW

SEQ ID NO: 387030 - protein, 11 aa, Influenza virus
PGDNITFSHNG

SEQ ID NO: 387031 - protein, 11 aa, Influenza virus
GDNITFSHNGG

SEQ ID NO: 387032 - protein, 11 aa, Influenza virus
ITFSHNGGLIA

SEQ ID NO: 387033 - protein, 11 aa, Influenza virus
TFSHNGGLIAP

SEQ ID NO: 387034 - protein, 11 aa, Influenza virus
HNGGLIAPSRV

SEQ ID NO: 387035 - protein, 11 aa, Influenza virus
CESKCFWKGGS

SEQ ID NO: 387036 - protein, 11 aa, Influenza virus
ESKCFWKGGSI

SEQ ID NO: 387037 - protein, 11 aa, Influenza virus
SKCFWKGGSIN

SEQ ID NO: 387038 - protein, 11 aa, Influenza virus
KCFWKGGSINT

SEQ ID NO: 387039 - protein, 11 aa, Influenza virus
GGSINTKLPFQ

SEQ ID NO: 387040 - protein, 11 aa, Influenza virus
GSINTKLPFQN

SEQ ID NO: 387041 - protein, 11 aa, Influenza virus
SINTKLPFQNL

SEQ ID NO: 387042 - protein, 11 aa, Influenza virus
INTKLPFQNLS

SEQ ID NO: 387043 - protein, 11 aa, Influenza virus
NTKLPFQNLSP

SEQ ID NO: 387044 - protein, 11 aa, Influenza virus
TKLPFQNLSPR

SEQ ID NO: 387045 - protein, 11 aa, Influenza virus
KLPFQNLSPRT

SEQ ID NO: 387046 - protein, 11 aa, Influenza virus
LPFQNLSPRTV

SEQ ID NO: 387047 - protein, 11 aa, Influenza virus
PFQNLSPRTVG

SEQ ID NO: 387048 - protein, 11 aa, Influenza virus
FQNLSPRTVGQ

SEQ ID NO: 387049 - protein, 11 aa, Influenza virus
QNLSPRTVGQC

SEQ ID NO: 387050 - protein, 11 aa, Influenza virus
NLSPRTVGQCP

SEQ ID NO: 387051 - protein, 11 aa, Influenza virus
LSPRTVGQCPK

SEQ ID NO: 387052 - protein, 11 aa, Influenza virus
SPRTVGQCPKY

SEQ ID NO: 387053 - protein, 11 aa, Influenza virus
PRTVGQCPKYV

SEQ ID NO: 387054 - protein, 11 aa, Influenza virus
RTVGQCPKYVN

SEQ ID NO: 387055 - protein, 11 aa, Influenza virus
KSLLLATGMRN

SEQ ID NO: 387056 - protein, 11 aa, Influenza virus
SLLLATGMRNV

SEQ ID NO: 387057 - protein, 11 aa, Influenza virus
LLLATGMRNVP

SEQ ID NO: 387058 - protein, 11 aa, Influenza virus
LLATGMRNVPE

SEQ ID NO: 387059 - protein, 11 aa, Influenza virus
LATGMRNVPEV

SEQ ID NO: 387060 - protein, 11 aa, Influenza virus
QGRGLFGAIAG

SEQ ID NO: 387061 - protein, 11 aa, Influenza virus
GRGLFGAIAGF

SEQ ID NO: 387062 - protein, 11 aa, Influenza virus
RGLFGAIAGFI

SEQ ID NO: 387063 - protein, 11 aa, Influenza virus
GLFGAIAGFIE

SEQ ID NO: 387064 - protein, 11 aa, Influenza virus
LFGAIAGFIEN

SEQ ID NO: 387065 - protein, 11 aa, Influenza virus
FGAIAGFIENG

SEQ ID NO: 387066 - protein, 11 aa, Influenza virus
GAIAGFIENGW

SEQ ID NO: 387067 - protein, 11 aa, Influenza virus
AIAGFIENGWE

SEQ ID NO: 387068 - protein, 11 aa, Influenza virus
IAGFIENGWEG

SEQ ID NO: 387069 - protein, 11 aa, Influenza virus
AGFIENGWEGM

SEQ ID NO: 387070 - protein, 11 aa, Influenza virus
GFIENGWEGMV

SEQ ID NO: 387071 - protein, 11 aa, Influenza virus
FIENGWEGMVD

SEQ ID NO: 387072 - protein, 11 aa, Influenza virus
IENGWEGMVDG

SEQ ID NO: 387073 - protein, 11 aa, Influenza virus
ENGWEGMVDGW

SEQ ID NO: 387074 - protein, 11 aa, Influenza virus
NGWEGMVDGWY

SEQ ID NO: 387075 - protein, 11 aa, Influenza virus
GWEGMVDGWYG

SEQ ID NO: 387076 - protein, 11 aa, Influenza virus
WEGMVDGWYGF

SEQ ID NO: 387077 - protein, 11 aa, Influenza virus
EGMVDGWYGFR

SEQ ID NO: 387078 - protein, 11 aa, Influenza virus
GMVDGWYGFRH

SEQ ID NO: 387079 - protein, 11 aa, Influenza virus
MVDGWYGFRHQ

SEQ ID NO: 387080 - protein, 11 aa, Influenza virus
VDGWYGFRHQN

SEQ ID NO: 387081 - protein, 11 aa, Influenza virus
DGWYGFRHQNA

SEQ ID NO: 387082 - protein, 11 aa, Influenza virus
GWYGFRHQNAQ

SEQ ID NO: 387083 - protein, 11 aa, Influenza virus
WYGFRHQNAQG

SEQ ID NO: 387084 - protein, 11 aa, Influenza virus
YGFRHQNAQGT

SEQ ID NO: 387085 - protein, 11 aa, Influenza virus
GFRHQNAQGTG

SEQ ID NO: 387086 - protein, 11 aa, Influenza virus
FRHQNAQGTGQ

SEQ ID NO: 387087 - protein, 11 aa, Influenza virus
RHQNAQGTGQA

SEQ ID NO: 387088 - protein, 11 aa, Influenza virus
HQNAQGTGQAA

SEQ ID NO: 387089 - protein, 11 aa, Influenza virus
QNAQGTGQAAD

SEQ ID NO: 387090 - protein, 11 aa, Influenza virus
NAQGTGQAADY

SEQ ID NO: 387091 - protein, 11 aa, Influenza virus
AQGTGQAADYK

SEQ ID NO: 387092 - protein, 11 aa, Influenza virus
QGTGQAADYKS

SEQ ID NO: 387093 - protein, 11 aa, Influenza virus
GTGQAADYKST

SEQ ID NO: 387094 - protein, 11 aa, Influenza virus
TGQAADYKSTQ

SEQ ID NO: 387095 - protein, 11 aa, Influenza virus
GQAADYKSTQA

SEQ ID NO: 387096 - protein, 11 aa, Influenza virus
QAADYKSTQAA

SEQ ID NO: 387097 - protein, 11 aa, Influenza virus
AADYKSTQAAI

SEQ ID NO: 387098 - protein, 11 aa, Influenza virus
AIDQITGKLNR

SEQ ID NO: 387099 - protein, 11 aa, Influenza virus
IDQITGKLNRL

SEQ ID NO: 387100 - protein, 11 aa, Influenza virus
DQITGKLNRLI

SEQ ID NO: 387101 - protein, 11 aa, Influenza virus
QITGKLNRLIE

SEQ ID NO: 387102 - protein, 11 aa, Influenza virus
ITGKLNRLIEK

SEQ ID NO: 387103 - protein, 11 aa, Influenza virus
TGKLNRLIEKT

SEQ ID NO: 387104 - protein, 11 aa, Influenza virus
GKLNRLIEKTN

SEQ ID NO: 387105 - protein, 11 aa, Influenza virus
KLNRLIEKTNT

SEQ ID NO: 387106 - protein, 11 aa, Influenza virus
LNRLIEKTNTE

SEQ ID NO: 387107 - protein, 11 aa, Influenza virus
NRLIEKTNTEF

SEQ ID NO: 387108 - protein, 11 aa, Influenza virus
RLIEKTNTEFE

SEQ ID NO: 387109 - protein, 11 aa, Influenza virus
LIEKTNTEFES

SEQ ID NO: 387110 - protein, 11 aa, Influenza virus
IEKTNTEFESI

SEQ ID NO: 387111 - protein, 11 aa, Influenza virus
EKTNTEFESIE

SEQ ID NO: 387112 - protein, 11 aa, Influenza virus
KTNTEFESIES

SEQ ID NO: 387113 - protein, 11 aa, Influenza virus
TNTEFESIESE

SEQ ID NO: 387114 - protein, 11 aa, Influenza virus
NTEFESIESEF

SEQ ID NO: 387115 - protein, 11 aa, Influenza virus
TEFESIESEFS

SEQ ID NO: 387116 - protein, 11 aa, Influenza virus
EFESIESEFSE

SEQ ID NO: 387117 - protein, 11 aa, Influenza virus
FESIESEFSEI

SEQ ID NO: 387118 - protein, 11 aa, Influenza virus
ESIESEFSEIE

SEQ ID NO: 387119 - protein, 11 aa, Influenza virus
SIESEFSEIEH

SEQ ID NO: 387120 - protein, 11 aa, Influenza virus
IESEFSEIEHQ

SEQ ID NO: 387121 - protein, 11 aa, Influenza virus
ESEFSEIEHQI

SEQ ID NO: 387122 - protein, 11 aa, Influenza virus
SEFSEIEHQIG

SEQ ID NO: 387123 - protein, 11 aa, Influenza virus
EFSEIEHQIGN

SEQ ID NO: 387124 - protein, 11 aa, Influenza virus
FSEIEHQIGNV

SEQ ID NO: 387125 - protein, 11 aa, Influenza virus
SEIEHQIGNVI

SEQ ID NO: 387126 - protein, 11 aa, Influenza virus
EIEHQIGNVIN

SEQ ID NO: 387127 - protein, 11 aa, Influenza virus
IEHQIGNVINW

SEQ ID NO: 387128 - protein, 11 aa, Influenza virus
EHQIGNVINWT

SEQ ID NO: 387129 - protein, 11 aa, Influenza virus
HQIGNVINWTK

SEQ ID NO: 387130 - protein, 11 aa, Influenza virus
QIGNVINWTKD

SEQ ID NO: 387131 - protein, 11 aa, Influenza virus
IGNVINWTKDS

SEQ ID NO: 387132 - protein, 11 aa, Influenza virus
GNVINWTKDSI

SEQ ID NO: 387133 - protein, 11 aa, Influenza virus
NVINWTKDSIT

SEQ ID NO: 387134 - protein, 11 aa, Influenza virus
VINWTKDSITD

SEQ ID NO: 387135 - protein, 11 aa, Influenza virus
INWTKDSITDI

SEQ ID NO: 387136 - protein, 11 aa, Influenza virus
NWTKDSITDIW

SEQ ID NO: 387137 - protein, 11 aa, Influenza virus
WTKDSITDIWT

SEQ ID NO: 387138 - protein, 11 aa, Influenza virus
TKDSITDIWTY

SEQ ID NO: 387139 - protein, 11 aa, Influenza virus
KDSITDIWTYQ

SEQ ID NO: 387140 - protein, 11 aa, Influenza virus
DSITDIWTYQA

SEQ ID NO: 387141 - protein, 11 aa, Influenza virus
SITDIWTYQAE

SEQ ID NO: 387142 - protein, 11 aa, Influenza virus
ITDIWTYQAEL

SEQ ID NO: 387143 - protein, 11 aa, Influenza virus
TDIWTYQAELL

SEQ ID NO: 387144 - protein, 11 aa, Influenza virus
DIWTYQAELLV

SEQ ID NO: 387145 - protein, 11 aa, Influenza virus
IWTYQAELLVA

SEQ ID NO: 387146 - protein, 11 aa, Influenza virus
WTYQAELLVAM

SEQ ID NO: 387147 - protein, 11 aa, Influenza virus
TYQAELLVAME

SEQ ID NO: 387148 - protein, 11 aa, Influenza virus
YQAELLVAMEN

SEQ ID NO: 387149 - protein, 11 aa, Influenza virus
QAELLVAMENQ

SEQ ID NO: 387150 - protein, 11 aa, Influenza virus
AELLVAMENQH

SEQ ID NO: 387151 - protein, 11 aa, Influenza virus
ELLVAMENQHT

SEQ ID NO: 387152 - protein, 11 aa, Influenza virus
LLVAMENQHTI

SEQ ID NO: 387153 - protein, 11 aa, Influenza virus
LVAMENQHTID

SEQ ID NO: 387154 - protein, 11 aa, Influenza virus
VAMENQHTIDM

SEQ ID NO: 387155 - protein, 11 aa, Influenza virus
AMENQHTIDMA

SEQ ID NO: 387156 - protein, 11 aa, Influenza virus
MENQHTIDMAD

SEQ ID NO: 387157 - protein, 11 aa, Influenza virus
ENQHTIDMADS

SEQ ID NO: 387158 - protein, 11 aa, Influenza virus
NQHTIDMADSE

SEQ ID NO: 387159 - protein, 11 aa, Influenza virus
QHTIDMADSEM

SEQ ID NO: 387160 - protein, 11 aa, Influenza virus
HTIDMADSEML

SEQ ID NO: 387161 - protein, 11 aa, Influenza virus
TIDMADSEMLN

SEQ ID NO: 387162 - protein, 11 aa, Influenza virus
IDMADSEMLNL

SEQ ID NO: 387163 - protein, 11 aa, Influenza virus
DMADSEMLNLY

SEQ ID NO: 387164 - protein, 11 aa, Influenza virus
MADSEMLNLYE

SEQ ID NO: 387165 - protein, 11 aa, Influenza virus
ADSEMLNLYER

SEQ ID NO: 387166 - protein, 11 aa, Influenza virus
DSEMLNLYERV

SEQ ID NO: 387167 - protein, 11 aa, Influenza virus
SEMLNLYERVR

SEQ ID NO: 387168 - protein, 11 aa, Influenza virus
EMLNLYERVRK

SEQ ID NO: 387169 - protein, 11 aa, Influenza virus
MLNLYERVRKQ

SEQ ID NO: 387170 - protein, 11 aa, Influenza virus
LNLYERVRKQL

SEQ ID NO: 387171 - protein, 11 aa, Influenza virus
NLYERVRKQLR

SEQ ID NO: 387172 - protein, 11 aa, Influenza virus
LYERVRKQLRQ

SEQ ID NO: 387173 - protein, 11 aa, Influenza virus
YERVRKQLRQN

SEQ ID NO: 387174 - protein, 11 aa, Influenza virus
ERVRKQLRQNA

SEQ ID NO: 387175 - protein, 11 aa, Influenza virus
RVRKQLRQNAE

SEQ ID NO: 387176 - protein, 11 aa, Influenza virus
VRKQLRQNAEE

SEQ ID NO: 387177 - protein, 11 aa, Influenza virus
RKQLRQNAEED

SEQ ID NO: 387178 - protein, 11 aa, Influenza virus
KQLRQNAEEDG

SEQ ID NO: 387179 - protein, 11 aa, Influenza virus
QLRQNAEEDGK

SEQ ID NO: 387180 - protein, 11 aa, Influenza virus
LRQNAEEDGKG

SEQ ID NO: 387181 - protein, 11 aa, Influenza virus
RQNAEEDGKGC

SEQ ID NO: 387182 - protein, 11 aa, Influenza virus
QNAEEDGKGCF

SEQ ID NO: 387183 - protein, 11 aa, Influenza virus
NAEEDGKGCFE

SEQ ID NO: 387184 - protein, 11 aa, Influenza virus
AEEDGKGCFEI

SEQ ID NO: 387185 - protein, 11 aa, Influenza virus
EEDGKGCFEIY

SEQ ID NO: 387186 - protein, 11 aa, Influenza virus
EDGKGCFEIYH

SEQ ID NO: 387187 - protein, 11 aa, Influenza virus
NCMESIRNNTY

SEQ ID NO: 387188 - protein, 11 aa, Influenza virus
CMESIRNNTYD

SEQ ID NO: 387189 - protein, 11 aa, Influenza virus
MESIRNNTYDH

SEQ ID NO: 387190 - protein, 11 aa, Influenza virus
IRNNTYDHTQY

SEQ ID NO: 387191 - protein, 11 aa, Influenza virus
RNNTYDHTQYR

SEQ ID NO: 387192 - protein, 11 aa, Influenza virus
NNTYDHTQYRE

SEQ ID NO: 387193 - protein, 11 aa, Influenza virus
NTYDHTQYREE

SEQ ID NO: 387194 - protein, 11 aa, Influenza virus
QYREEALLNRL

SEQ ID NO: 387195 - protein, 11 aa, Influenza virus
YREEALLNRLN

SEQ ID NO: 387196 - protein, 11 aa, Influenza virus
REEALLNRLNI

SEQ ID NO: 387197 - protein, 11 aa, Influenza virus
EEALLNRLNIN

SEQ ID NO: 387198 - protein, 11 aa, Influenza virus
EALLNRLNINP

SEQ ID NO: 387199 - protein, 11 aa, Influenza virus
ALLNRLNINPV

SEQ ID NO: 387200 - protein, 11 aa, Influenza virus
INPVKLSSGYK

SEQ ID NO: 387201 - protein, 11 aa, Influenza virus
LSSGYKDVILW

SEQ ID NO: 387202 - protein, 11 aa, Influenza virus
SSGYKDVILWF

SEQ ID NO: 387203 - protein, 11 aa, Influenza virus
SGYKDVILWFS

SEQ ID NO: 387204 - protein, 11 aa, Influenza virus
GYKDVILWFSF

SEQ ID NO: 387205 - protein, 11 aa, Influenza virus
YKDVILWFSFG

SEQ ID NO: 387206 - protein, 11 aa, Influenza virus
KDVILWFSFGA

SEQ ID NO: 387207 - protein, 11 aa, Influenza virus
DVILWFSFGAS

SEQ ID NO: 387208 - protein, 11 aa, Influenza virus
VILWFSFGASC

SEQ ID NO: 387209 - protein, 11 aa, Influenza virus
ILWFSFGASCF

SEQ ID NO: 387210 - protein, 11 aa, Influenza virus
LWFSFGASCFV

SEQ ID NO: 387211 - protein, 11 aa, Influenza virus
WFSFGASCFVL

SEQ ID NO: 387212 - protein, 11 aa, Influenza virus
FSFGASCFVLL

SEQ ID NO: 387213 - protein, 11 aa, Influenza virus
SFGASCFVLLA

SEQ ID NO: 387214 - protein, 11 aa, Influenza virus
NGNMRCTISLV

SEQ ID NO: 387215 - protein, 11 aa, Influenza virus
GNMRCTISLVK

SEQ ID NO: 387216 - protein, 11 aa, Influenza virus
NMRCTISLVKT

SEQ ID NO: 387217 - protein, 11 aa, Influenza virus
MRCTISLVKTT

SEQ ID NO: 387218 - protein, 11 aa, Influenza virus
RCTISLVKTTL

SEQ ID NO: 387219 - protein, 11 aa, Influenza virus
CTISLVKTTLF

SEQ ID NO: 387220 - protein, 11 aa, Influenza virus
TISLVKTTLFL

SEQ ID NO: 387221 - protein, 11 aa, Influenza virus
GLDKICLGHHA

SEQ ID NO: 387222 - protein, 11 aa, Influenza virus
LDKICLGHHAV

SEQ ID NO: 387223 - protein, 11 aa, Influenza virus
DKICLGHHAVS

SEQ ID NO: 387224 - protein, 11 aa, Influenza virus
KICLGHHAVSN

SEQ ID NO: 387225 - protein, 11 aa, Influenza virus
ICLGHHAVSNG

SEQ ID NO: 387226 - protein, 11 aa, Influenza virus
CLGHHAVSNGT

SEQ ID NO: 387227 - protein, 11 aa, Influenza virus
LGHHAVSNGTI

SEQ ID NO: 387228 - protein, 11 aa, Influenza virus
NGTIVKTLTNE

SEQ ID NO: 387229 - protein, 11 aa, Influenza virus
GTIVKTLTNEK

SEQ ID NO: 387230 - protein, 11 aa, Influenza virus
TIVKTLTNEKE

SEQ ID NO: 387231 - protein, 11 aa, Influenza virus
EKEEVTNATET

SEQ ID NO: 387232 - protein, 11 aa, Influenza virus
KEEVTNATETV

SEQ ID NO: 387233 - protein, 11 aa, Influenza virus
EEVTNATETVE

SEQ ID NO: 387234 - protein, 11 aa, Influenza virus
EVTNATETVES

SEQ ID NO: 387235 - protein, 11 aa, Influenza virus
VTNATETVESK

SEQ ID NO: 387236 - protein, 11 aa, Influenza virus
KDLGNCHPIGM

SEQ ID NO: 387237 - protein, 11 aa, Influenza virus
GTPACDLHLTG

SEQ ID NO: 387238 - protein, 11 aa, Influenza virus
CDLHLTGTWDT

SEQ ID NO: 387239 - protein, 11 aa, Influenza virus
DLHLTGTWDTL

SEQ ID NO: 387240 - protein, 11 aa, Influenza virus
LHLTGTWDTLI

SEQ ID NO: 387241 - protein, 11 aa, Influenza virus
HLTGTWDTLIE

SEQ ID NO: 387242 - protein, 11 aa, Influenza virus
LTGTWDTLIER

SEQ ID NO: 387243 - protein, 11 aa, Influenza virus
TGTWDTLIERD

SEQ ID NO: 387244 - protein, 11 aa, Influenza virus
GTWDTLIERDN

SEQ ID NO: 387245 - protein, 11 aa, Influenza virus
AYCYPGATVNE

SEQ ID NO: 387246 - protein, 11 aa, Influenza virus
CYPGATVNEEA

SEQ ID NO: 387247 - protein, 11 aa, Influenza virus
YPGATVNEEAL

SEQ ID NO: 387248 - protein, 11 aa, Influenza virus
PGATVNEEALR

SEQ ID NO: 387249 - protein, 11 aa, Influenza virus
GATVNEEALRQ

SEQ ID NO: 387250 - protein, 11 aa, Influenza virus
ATVNEEALRQK

SEQ ID NO: 387251 - protein, 11 aa, Influenza virus
TVNEEALRQKI

SEQ ID NO: 387252 - protein, 11 aa, Influenza virus
VNEEALRQKIM

SEQ ID NO: 387253 - protein, 11 aa, Influenza virus
NEEALRQKIME

SEQ ID NO: 387254 - protein, 11 aa, Influenza virus
EEALRQKIMES

SEQ ID NO: 387255 - protein, 11 aa, Influenza virus
EALRQKIMESG

SEQ ID NO: 387256 - protein, 11 aa, Influenza virus
ALRQKIMESGG

SEQ ID NO: 387257 - protein, 11 aa, Influenza virus
LRQKIMESGGI

SEQ ID NO: 387258 - protein, 11 aa, Influenza virus
RQKIMESGGID

SEQ ID NO: 387259 - protein, 11 aa, Influenza virus
QKIMESGGIDK

SEQ ID NO: 387260 - protein, 11 aa, Influenza virus
KIMESGGIDKI

SEQ ID NO: 387261 - protein, 11 aa, Influenza virus
IMESGGIDKIS

SEQ ID NO: 387262 - protein, 11 aa, Influenza virus
MESGGIDKIST

SEQ ID NO: 387263 - protein, 11 aa, Influenza virus
GGNSFYAELKW

SEQ ID NO: 387264 - protein, 11 aa, Influenza virus
GNSFYAELKWL

SEQ ID NO: 387265 - protein, 11 aa, Influenza virus
NSFYAELKWLV

SEQ ID NO: 387266 - protein, 11 aa, Influenza virus
SFYAELKWLVS

SEQ ID NO: 387267 - protein, 11 aa, Influenza virus
FYAELKWLVSK

SEQ ID NO: 387268 - protein, 11 aa, Influenza virus
YAELKWLVSKS

SEQ ID NO: 387269 - protein, 11 aa, Influenza virus
AELKWLVSKSK

SEQ ID NO: 387270 - protein, 11 aa, Influenza virus
ELKWLVSKSKG

SEQ ID NO: 387271 - protein, 11 aa, Influenza virus
LKWLVSKSKGQ

SEQ ID NO: 387272 - protein, 11 aa, Influenza virus
QNFPQTTNTYR

SEQ ID NO: 387273 - protein, 11 aa, Influenza virus
NFPQTTNTYRN

SEQ ID NO: 387274 - protein, 11 aa, Influenza virus
FPQTTNTYRNT

SEQ ID NO: 387275 - protein, 11 aa, Influenza virus
PQTTNTYRNTD

SEQ ID NO: 387276 - protein, 11 aa, Influenza virus
QTTNTYRNTDS

SEQ ID NO: 387277 - protein, 11 aa, Influenza virus
EHLIIWGIHHP

SEQ ID NO: 387278 - protein, 11 aa, Influenza virus
HLIIWGIHHPS

SEQ ID NO: 387279 - protein, 11 aa, Influenza virus
LIIWGIHHPSS

SEQ ID NO: 387280 - protein, 11 aa, Influenza virus
WGIHHPSSTQE

SEQ ID NO: 387281 - protein, 11 aa, Influenza virus
GIHHPSSTQEK

SEQ ID NO: 387282 - protein, 11 aa, Influenza virus
IHHPSSTQEKN

SEQ ID NO: 387283 - protein, 11 aa, Influenza virus
HHPSSTQEKND

SEQ ID NO: 387284 - protein, 11 aa, Influenza virus
HPSSTQEKNDL

SEQ ID NO: 387285 - protein, 11 aa, Influenza virus
PSSTQEKNDLY

SEQ ID NO: 387286 - protein, 11 aa, Influenza virus
SSTQEKNDLYG

SEQ ID NO: 387287 - protein, 11 aa, Influenza virus
EKNDLYGTQSL

SEQ ID NO: 387288 - protein, 11 aa, Influenza virus
KNDLYGTQSLS

SEQ ID NO: 387289 - protein, 11 aa, Influenza virus
NDLYGTQSLSI

SEQ ID NO: 387290 - protein, 11 aa, Influenza virus
DLYGTQSLSIS

SEQ ID NO: 387291 - protein, 11 aa, Influenza virus
LYGTQSLSISV

SEQ ID NO: 387292 - protein, 11 aa, Influenza virus
YGTQSLSISVG

SEQ ID NO: 387293 - protein, 11 aa, Influenza virus
GTQSLSISVGS

SEQ ID NO: 387294 - protein, 11 aa, Influenza virus
TQSLSISVGSS

SEQ ID NO: 387295 - protein, 11 aa, Influenza virus
QSLSISVGSST

SEQ ID NO: 387296 - protein, 11 aa, Influenza virus
SLSISVGSSTY

SEQ ID NO: 387297 - protein, 11 aa, Influenza virus
LSISVGSSTYQ

SEQ ID NO: 387298 - protein, 11 aa, Influenza virus
SISVGSSTYQN

SEQ ID NO: 387299 - protein, 11 aa, Influenza virus
ISVGSSTYQNN

SEQ ID NO: 387300 - protein, 11 aa, Influenza virus
SVGSSTYQNNF

SEQ ID NO: 387301 - protein, 11 aa, Influenza virus
VGSSTYQNNFV

SEQ ID NO: 387302 - protein, 11 aa, Influenza virus
GSSTYQNNFVP

SEQ ID NO: 387303 - protein, 11 aa, Influenza virus
SSTYQNNFVPV

SEQ ID NO: 387304 - protein, 11 aa, Influenza virus
STYQNNFVPVV

SEQ ID NO: 387305 - protein, 11 aa, Influenza virus
TYQNNFVPVVG

SEQ ID NO: 387306 - protein, 11 aa, Influenza virus
YQNNFVPVVGA

SEQ ID NO: 387307 - protein, 11 aa, Influenza virus
QNNFVPVVGAR

SEQ ID NO: 387308 - protein, 11 aa, Influenza virus
NNFVPVVGARP

SEQ ID NO: 387309 - protein, 11 aa, Influenza virus
NFVPVVGARPQ

SEQ ID NO: 387310 - protein, 11 aa, Influenza virus
FVPVVGARPQV

SEQ ID NO: 387311 - protein, 11 aa, Influenza virus
VPVVGARPQVN

SEQ ID NO: 387312 - protein, 11 aa, Influenza virus
PVVGARPQVNG

SEQ ID NO: 387313 - protein, 11 aa, Influenza virus
VVGARPQVNGQ

SEQ ID NO: 387314 - protein, 11 aa, Influenza virus
VGARPQVNGQS

SEQ ID NO: 387315 - protein, 11 aa, Influenza virus
GARPQVNGQSG

SEQ ID NO: 387316 - protein, 11 aa, Influenza virus
ARPQVNGQSGR

SEQ ID NO: 387317 - protein, 11 aa, Influenza virus
RPQVNGQSGRI

SEQ ID NO: 387318 - protein, 11 aa, Influenza virus
PQVNGQSGRID

SEQ ID NO: 387319 - protein, 11 aa, Influenza virus
QVNGQSGRIDF

SEQ ID NO: 387320 - protein, 11 aa, Influenza virus
VNGQSGRIDFH

SEQ ID NO: 387321 - protein, 11 aa, Influenza virus
NGQSGRIDFHW

SEQ ID NO: 387322 - protein, 11 aa, Influenza virus
GQSGRIDFHWT

SEQ ID NO: 387323 - protein, 11 aa, Influenza virus
VQPGDNITFSH

SEQ ID NO: 387324 - protein, 11 aa, Influenza virus
QPGDNITFSHN

SEQ ID NO: 387325 - protein, 11 aa, Influenza virus
PGDNITFSHNG

SEQ ID NO: 387326 - protein, 11 aa, Influenza virus
GDNITFSHNGG

SEQ ID NO: 387327 - protein, 11 aa, Influenza virus
DNITFSHNGGL

SEQ ID NO: 387328 - protein, 11 aa, Influenza virus
NITFSHNGGLI

SEQ ID NO: 387329 - protein, 11 aa, Influenza virus
ITFSHNGGLIA

SEQ ID NO: 387330 - protein, 11 aa, Influenza virus
TFSHNGGLIAP

SEQ ID NO: 387331 - protein, 11 aa, Influenza virus
FSHNGGLIAPS

SEQ ID NO: 387332 - protein, 11 aa, Influenza virus
SHNGGLIAPSR

SEQ ID NO: 387333 - protein, 11 aa, Influenza virus
HNGGLIAPSRV

SEQ ID NO: 387334 - protein, 11 aa, Influenza virus
NGGLIAPSRVS

SEQ ID NO: 387335 - protein, 11 aa, Influenza virus
GGLIAPSRVSK

SEQ ID NO: 387336 - protein, 11 aa, Influenza virus
GLIAPSRVSKL

SEQ ID NO: 387337 - protein, 11 aa, Influenza virus
CESKCFWKGGS

SEQ ID NO: 387338 - protein, 11 aa, Influenza virus
ESKCFWKGGSI

SEQ ID NO: 387339 - protein, 11 aa, Influenza virus
SKCFWKGGSIN

SEQ ID NO: 387340 - protein, 11 aa, Influenza virus
KCFWKGGSINT

SEQ ID NO: 387341 - protein, 11 aa, Influenza virus
CFWKGGSINTK

SEQ ID NO: 387342 - protein, 11 aa, Influenza virus
FWKGGSINTKL

SEQ ID NO: 387343 - protein, 11 aa, Influenza virus
WKGGSINTKLP

SEQ ID NO: 387344 - protein, 11 aa, Influenza virus
KGGSINTKLPF

SEQ ID NO: 387345 - protein, 11 aa, Influenza virus
GGSINTKLPFQ

SEQ ID NO: 387346 - protein, 11 aa, Influenza virus
GSINTKLPFQN

SEQ ID NO: 387347 - protein, 11 aa, Influenza virus
SINTKLPFQNL

SEQ ID NO: 387348 - protein, 11 aa, Influenza virus
INTKLPFQNLS

SEQ ID NO: 387349 - protein, 11 aa, Influenza virus
NTKLPFQNLSP

SEQ ID NO: 387350 - protein, 11 aa, Influenza virus
TKLPFQNLSPR

SEQ ID NO: 387351 - protein, 11 aa, Influenza virus
KLPFQNLSPRT

SEQ ID NO: 387352 - protein, 11 aa, Influenza virus
LPFQNLSPRTV

SEQ ID NO: 387353 - protein, 11 aa, Influenza virus
PFQNLSPRTVG

SEQ ID NO: 387354 - protein, 11 aa, Influenza virus
FQNLSPRTVGQ

SEQ ID NO: 387355 - protein, 11 aa, Influenza virus
QNLSPRTVGQC

SEQ ID NO: 387356 - protein, 11 aa, Influenza virus
NLSPRTVGQCP

SEQ ID NO: 387357 - protein, 11 aa, Influenza virus
LSPRTVGQCPK

SEQ ID NO: 387358 - protein, 11 aa, Influenza virus
SPRTVGQCPKY

SEQ ID NO: 387359 - protein, 11 aa, Influenza virus
PRTVGQCPKYV

SEQ ID NO: 387360 - protein, 11 aa, Influenza virus
RTVGQCPKYVN

SEQ ID NO: 387361 - protein, 11 aa, Influenza virus
TVGQCPKYVNK

SEQ ID NO: 387362 - protein, 11 aa, Influenza virus
KSLLLATGMRN

SEQ ID NO: 387363 - protein, 11 aa, Influenza virus
SLLLATGMRNV

SEQ ID NO: 387364 - protein, 11 aa, Influenza virus
LLLATGMRNVP

SEQ ID NO: 387365 - protein, 11 aa, Influenza virus
LLATGMRNVPE

SEQ ID NO: 387366 - protein, 11 aa, Influenza virus
LATGMRNVPEV

SEQ ID NO: 387367 - protein, 11 aa, Influenza virus
QGRGLFGAIAG

SEQ ID NO: 387368 - protein, 11 aa, Influenza virus
GRGLFGAIAGF

SEQ ID NO: 387369 - protein, 11 aa, Influenza virus
RGLFGAIAGFI

SEQ ID NO: 387370 - protein, 11 aa, Influenza virus
GLFGAIAGFIE

SEQ ID NO: 387371 - protein, 11 aa, Influenza virus
LFGAIAGFIEN

SEQ ID NO: 387372 - protein, 11 aa, Influenza virus
FGAIAGFIENG

SEQ ID NO: 387373 - protein, 11 aa, Influenza virus
GAIAGFIENGW

SEQ ID NO: 387374 - protein, 11 aa, Influenza virus
AIAGFIENGWE

SEQ ID NO: 387375 - protein, 11 aa, Influenza virus
IAGFIENGWEG

SEQ ID NO: 387376 - protein, 11 aa, Influenza virus
AGFIENGWEGM

SEQ ID NO: 387377 - protein, 11 aa, Influenza virus
GFIENGWEGMV

SEQ ID NO: 387378 - protein, 11 aa, Influenza virus
FIENGWEGMVD

SEQ ID NO: 387379 - protein, 11 aa, Influenza virus
IENGWEGMVDG

SEQ ID NO: 387380 - protein, 11 aa, Influenza virus
ENGWEGMVDGW

SEQ ID NO: 387381 - protein, 11 aa, Influenza virus
NGWEGMVDGWY

SEQ ID NO: 387382 - protein, 11 aa, Influenza virus
GWEGMVDGWYG

SEQ ID NO: 387383 - protein, 11 aa, Influenza virus
WEGMVDGWYGF

SEQ ID NO: 387384 - protein, 11 aa, Influenza virus
EGMVDGWYGFR

SEQ ID NO: 387385 - protein, 11 aa, Influenza virus
GMVDGWYGFRH

SEQ ID NO: 387386 - protein, 11 aa, Influenza virus
MVDGWYGFRHQ

SEQ ID NO: 387387 - protein, 11 aa, Influenza virus
VDGWYGFRHQN

SEQ ID NO: 387388 - protein, 11 aa, Influenza virus
DGWYGFRHQNA

SEQ ID NO: 387389 - protein, 11 aa, Influenza virus
GWYGFRHQNAQ

SEQ ID NO: 387390 - protein, 11 aa, Influenza virus
WYGFRHQNAQG

SEQ ID NO: 387391 - protein, 11 aa, Influenza virus
YGFRHQNAQGT

SEQ ID NO: 387392 - protein, 11 aa, Influenza virus
GFRHQNAQGTG

SEQ ID NO: 387393 - protein, 11 aa, Influenza virus
FRHQNAQGTGQ

SEQ ID NO: 387394 - protein, 11 aa, Influenza virus
RHQNAQGTGQA

SEQ ID NO: 387395 - protein, 11 aa, Influenza virus
HQNAQGTGQAA

SEQ ID NO: 387396 - protein, 11 aa, Influenza virus
QNAQGTGQAAD

SEQ ID NO: 387397 - protein, 11 aa, Influenza virus
NAQGTGQAADY

SEQ ID NO: 387398 - protein, 11 aa, Influenza virus
AQGTGQAADYK

SEQ ID NO: 387399 - protein, 11 aa, Influenza virus
QGTGQAADYKS

SEQ ID NO: 387400 - protein, 11 aa, Influenza virus
GTGQAADYKST

SEQ ID NO: 387401 - protein, 11 aa, Influenza virus
TGQAADYKSTQ

SEQ ID NO: 387402 - protein, 11 aa, Influenza virus
GQAADYKSTQA

SEQ ID NO: 387403 - protein, 11 aa, Influenza virus
QAADYKSTQAA

SEQ ID NO: 387404 - protein, 11 aa, Influenza virus
AADYKSTQAAI

SEQ ID NO: 387405 - protein, 11 aa, Influenza virus
ADYKSTQAAID

SEQ ID NO: 387406 - protein, 11 aa, Influenza virus
DYKSTQAAIDQ

SEQ ID NO: 387407 - protein, 11 aa, Influenza virus
YKSTQAAIDQI

SEQ ID NO: 387408 - protein, 11 aa, Influenza virus
KSTQAAIDQIT

SEQ ID NO: 387409 - protein, 11 aa, Influenza virus
STQAAIDQITG

SEQ ID NO: 387410 - protein, 11 aa, Influenza virus
TQAAIDQITGK

SEQ ID NO: 387411 - protein, 11 aa, Influenza virus
QAAIDQITGKL

SEQ ID NO: 387412 - protein, 11 aa, Influenza virus
AAIDQITGKLN

SEQ ID NO: 387413 - protein, 11 aa, Influenza virus
AIDQITGKLNR

SEQ ID NO: 387414 - protein, 11 aa, Influenza virus
IDQITGKLNRL

SEQ ID NO: 387415 - protein, 11 aa, Influenza virus
DQITGKLNRLI

SEQ ID NO: 387416 - protein, 11 aa, Influenza virus
QITGKLNRLIE

SEQ ID NO: 387417 - protein, 11 aa, Influenza virus
ITGKLNRLIEK

SEQ ID NO: 387418 - protein, 11 aa, Influenza virus
TGKLNRLIEKT

SEQ ID NO: 387419 - protein, 11 aa, Influenza virus
GKLNRLIEKTN

SEQ ID NO: 387420 - protein, 11 aa, Influenza virus
KLNRLIEKTNT

SEQ ID NO: 387421 - protein, 11 aa, Influenza virus
LNRLIEKTNTE

SEQ ID NO: 387422 - protein, 11 aa, Influenza virus
NRLIEKTNTEF

SEQ ID NO: 387423 - protein, 11 aa, Influenza virus
RLIEKTNTEFE

SEQ ID NO: 387424 - protein, 11 aa, Influenza virus
LIEKTNTEFES

SEQ ID NO: 387425 - protein, 11 aa, Influenza virus
IEKTNTEFESI

SEQ ID NO: 387426 - protein, 11 aa, Influenza virus
EKTNTEFESIE

SEQ ID NO: 387427 - protein, 11 aa, Influenza virus
KTNTEFESIES

SEQ ID NO: 387428 - protein, 11 aa, Influenza virus
TNTEFESIESE

SEQ ID NO: 387429 - protein, 11 aa, Influenza virus
NTEFESIESEF

SEQ ID NO: 387430 - protein, 11 aa, Influenza virus
TEFESIESEFS

SEQ ID NO: 387431 - protein, 11 aa, Influenza virus
EFESIESEFSE

SEQ ID NO: 387432 - protein, 11 aa, Influenza virus
FESIESEFSEI

SEQ ID NO: 387433 - protein, 11 aa, Influenza virus
ESIESEFSEIE

SEQ ID NO: 387434 - protein, 11 aa, Influenza virus
SIESEFSEIEH

SEQ ID NO: 387435 - protein, 11 aa, Influenza virus
IESEFSEIEHQ

SEQ ID NO: 387436 - protein, 11 aa, Influenza virus
ESEFSEIEHQI

SEQ ID NO: 387437 - protein, 11 aa, Influenza virus
SEFSEIEHQIG

SEQ ID NO: 387438 - protein, 11 aa, Influenza virus
EFSEIEHQIGN

SEQ ID NO: 387439 - protein, 11 aa, Influenza virus
FSEIEHQIGNV

SEQ ID NO: 387440 - protein, 11 aa, Influenza virus
SEIEHQIGNVI

SEQ ID NO: 387441 - protein, 11 aa, Influenza virus
EIEHQIGNVIN

SEQ ID NO: 387442 - protein, 11 aa, Influenza virus
IEHQIGNVINW

SEQ ID NO: 387443 - protein, 11 aa, Influenza virus
EHQIGNVINWT

SEQ ID NO: 387444 - protein, 11 aa, Influenza virus
HQIGNVINWTK

SEQ ID NO: 387445 - protein, 11 aa, Influenza virus
QIGNVINWTKD

SEQ ID NO: 387446 - protein, 11 aa, Influenza virus
IGNVINWTKDS

SEQ ID NO: 387447 - protein, 11 aa, Influenza virus
GNVINWTKDSI

SEQ ID NO: 387448 - protein, 11 aa, Influenza virus
NVINWTKDSIT

SEQ ID NO: 387449 - protein, 11 aa, Influenza virus
VINWTKDSITD

SEQ ID NO: 387450 - protein, 11 aa, Influenza virus
INWTKDSITDI

SEQ ID NO: 387451 - protein, 11 aa, Influenza virus
NWTKDSITDIW

SEQ ID NO: 387452 - protein, 11 aa, Influenza virus
WTKDSITDIWT

SEQ ID NO: 387453 - protein, 11 aa, Influenza virus
TKDSITDIWTY

SEQ ID NO: 387454 - protein, 11 aa, Influenza virus
KDSITDIWTYQ

SEQ ID NO: 387455 - protein, 11 aa, Influenza virus
DSITDIWTYQA

SEQ ID NO: 387456 - protein, 11 aa, Influenza virus
SITDIWTYQAE

SEQ ID NO: 387457 - protein, 11 aa, Influenza virus
ITDIWTYQAEL

SEQ ID NO: 387458 - protein, 11 aa, Influenza virus
TDIWTYQAELL

SEQ ID NO: 387459 - protein, 11 aa, Influenza virus
DIWTYQAELLV

SEQ ID NO: 387460 - protein, 11 aa, Influenza virus
IWTYQAELLVA

SEQ ID NO: 387461 - protein, 11 aa, Influenza virus
WTYQAELLVAM

SEQ ID NO: 387462 - protein, 11 aa, Influenza virus
TYQAELLVAME

SEQ ID NO: 387463 - protein, 11 aa, Influenza virus
YQAELLVAMEN

SEQ ID NO: 387464 - protein, 11 aa, Influenza virus
QAELLVAMENQ

SEQ ID NO: 387465 - protein, 11 aa, Influenza virus
AELLVAMENQH

SEQ ID NO: 387466 - protein, 11 aa, Influenza virus
ELLVAMENQHT

SEQ ID NO: 387467 - protein, 11 aa, Influenza virus
LLVAMENQHTI

SEQ ID NO: 387468 - protein, 11 aa, Influenza virus
LVAMENQHTID

SEQ ID NO: 387469 - protein, 11 aa, Influenza virus
VAMENQHTIDM

SEQ ID NO: 387470 - protein, 11 aa, Influenza virus
AMENQHTIDMA

SEQ ID NO: 387471 - protein, 11 aa, Influenza virus
MENQHTIDMAD

SEQ ID NO: 387472 - protein, 11 aa, Influenza virus
ENQHTIDMADS

SEQ ID NO: 387473 - protein, 11 aa, Influenza virus
NQHTIDMADSE

SEQ ID NO: 387474 - protein, 11 aa, Influenza virus
QHTIDMADSEM

SEQ ID NO: 387475 - protein, 11 aa, Influenza virus
HTIDMADSEML

SEQ ID NO: 387476 - protein, 11 aa, Influenza virus
TIDMADSEMLN

SEQ ID NO: 387477 - protein, 11 aa, Influenza virus
IDMADSEMLNL

SEQ ID NO: 387478 - protein, 11 aa, Influenza virus
DMADSEMLNLY

SEQ ID NO: 387479 - protein, 11 aa, Influenza virus
MADSEMLNLYE

SEQ ID NO: 387480 - protein, 11 aa, Influenza virus
ADSEMLNLYER

SEQ ID NO: 387481 - protein, 11 aa, Influenza virus
DSEMLNLYERV

SEQ ID NO: 387482 - protein, 11 aa, Influenza virus
SEMLNLYERVR

SEQ ID NO: 387483 - protein, 11 aa, Influenza virus
EMLNLYERVRK

SEQ ID NO: 387484 - protein, 11 aa, Influenza virus
MLNLYERVRKQ

SEQ ID NO: 387485 - protein, 11 aa, Influenza virus
LNLYERVRKQL

SEQ ID NO: 387486 - protein, 11 aa, Influenza virus
NLYERVRKQLR

SEQ ID NO: 387487 - protein, 11 aa, Influenza virus
LYERVRKQLRQ

SEQ ID NO: 387488 - protein, 11 aa, Influenza virus
YERVRKQLRQN

SEQ ID NO: 387489 - protein, 11 aa, Influenza virus
ERVRKQLRQNA

SEQ ID NO: 387490 - protein, 11 aa, Influenza virus
RVRKQLRQNAE

SEQ ID NO: 387491 - protein, 11 aa, Influenza virus
VRKQLRQNAEE

SEQ ID NO: 387492 - protein, 11 aa, Influenza virus
RKQLRQNAEED

SEQ ID NO: 387493 - protein, 11 aa, Influenza virus
KQLRQNAEEDG

SEQ ID NO: 387494 - protein, 11 aa, Influenza virus
QLRQNAEEDGK

SEQ ID NO: 387495 - protein, 11 aa, Influenza virus
LRQNAEEDGKG

SEQ ID NO: 387496 - protein, 11 aa, Influenza virus
RQNAEEDGKGC

SEQ ID NO: 387497 - protein, 11 aa, Influenza virus
QNAEEDGKGCF

SEQ ID NO: 387498 - protein, 11 aa, Influenza virus
NAEEDGKGCFE

SEQ ID NO: 387499 - protein, 11 aa, Influenza virus
AEEDGKGCFEI

SEQ ID NO: 387500 - protein, 11 aa, Influenza virus
EEDGKGCFEIY

SEQ ID NO: 387501 - protein, 11 aa, Influenza virus
EDGKGCFEIYH

SEQ ID NO: 387502 - protein, 11 aa, Influenza virus
DGKGCFEIYHK

SEQ ID NO: 387503 - protein, 11 aa, Influenza virus
GKGCFEIYHKC

SEQ ID NO: 387504 - protein, 11 aa, Influenza virus
DNCMESIRNNT

SEQ ID NO: 387505 - protein, 11 aa, Influenza virus
NCMESIRNNTY

SEQ ID NO: 387506 - protein, 11 aa, Influenza virus
CMESIRNNTYD

SEQ ID NO: 387507 - protein, 11 aa, Influenza virus
MESIRNNTYDH

SEQ ID NO: 387508 - protein, 11 aa, Influenza virus
ESIRNNTYDHT

SEQ ID NO: 387509 - protein, 11 aa, Influenza virus
SIRNNTYDHTQ

SEQ ID NO: 387510 - protein, 11 aa, Influenza virus
IRNNTYDHTQY

SEQ ID NO: 387511 - protein, 11 aa, Influenza virus
RNNTYDHTQYR

SEQ ID NO: 387512 - protein, 11 aa, Influenza virus
NNTYDHTQYRE

SEQ ID NO: 387513 - protein, 11 aa, Influenza virus
NTYDHTQYREE

SEQ ID NO: 387514 - protein, 11 aa, Influenza virus
TYDHTQYREEA

SEQ ID NO: 387515 - protein, 11 aa, Influenza virus
YDHTQYREEAL

SEQ ID NO: 387516 - protein, 11 aa, Influenza virus
DHTQYREEALL

SEQ ID NO: 387517 - protein, 11 aa, Influenza virus
HTQYREEALLN

SEQ ID NO: 387518 - protein, 11 aa, Influenza virus
TQYREEALLNR

SEQ ID NO: 387519 - protein, 11 aa, Influenza virus
QYREEALLNRL

SEQ ID NO: 387520 - protein, 11 aa, Influenza virus
YREEALLNRLN

SEQ ID NO: 387521 - protein, 11 aa, Influenza virus
REEALLNRLNI

SEQ ID NO: 387522 - protein, 11 aa, Influenza virus
EEALLNRLNIN

SEQ ID NO: 387523 - protein, 11 aa, Influenza virus
EALLNRLNINP

SEQ ID NO: 387524 - protein, 11 aa, Influenza virus
ALLNRLNINPV

SEQ ID NO: 387525 - protein, 11 aa, Influenza virus
LLNRLNINPVK

SEQ ID NO: 387526 - protein, 11 aa, Influenza virus
LNRLNINPVKL

SEQ ID NO: 387527 - protein, 11 aa, Influenza virus
NRLNINPVKLS

SEQ ID NO: 387528 - protein, 11 aa, Influenza virus
RLNINPVKLSS

SEQ ID NO: 387529 - protein, 11 aa, Influenza virus
LNINPVKLSSG

SEQ ID NO: 387530 - protein, 11 aa, Influenza virus
NINPVKLSSGY

SEQ ID NO: 387531 - protein, 11 aa, Influenza virus
INPVKLSSGYK

SEQ ID NO: 387532 - protein, 11 aa, Influenza virus
NPVKLSSGYKD

SEQ ID NO: 387533 - protein, 11 aa, Influenza virus
VKLSSGYKDVI

SEQ ID NO: 387534 - protein, 11 aa, Influenza virus
KLSSGYKDVIL

SEQ ID NO: 387535 - protein, 11 aa, Influenza virus
LSSGYKDVILW

SEQ ID NO: 387536 - protein, 11 aa, Influenza virus
SSGYKDVILWF

SEQ ID NO: 387537 - protein, 11 aa, Influenza virus
SGYKDVILWFS

SEQ ID NO: 387538 - protein, 11 aa, Influenza virus
GYKDVILWFSF

SEQ ID NO: 387539 - protein, 11 aa, Influenza virus
YKDVILWFSFG

SEQ ID NO: 387540 - protein, 11 aa, Influenza virus
KDVILWFSFGA

SEQ ID NO: 387541 - protein, 11 aa, Influenza virus
DVILWFSFGAS

SEQ ID NO: 387542 - protein, 11 aa, Influenza virus
VILWFSFGASC

SEQ ID NO: 387543 - protein, 11 aa, Influenza virus
ILWFSFGASCF

SEQ ID NO: 387544 - protein, 11 aa, Influenza virus
LWFSFGASCFV

SEQ ID NO: 387545 - protein, 11 aa, Influenza virus
WFSFGASCFVL

SEQ ID NO: 387546 - protein, 11 aa, Influenza virus
FSFGASCFVLL

SEQ ID NO: 387547 - protein, 11 aa, Influenza virus
SFGASCFVLLA

SEQ ID NO: 387548 - protein, 11 aa, Influenza virus
FGASCFVLLAV

SEQ ID NO: 387549 - protein, 11 aa, Influenza virus
IMGLVFFCLKN

SEQ ID NO: 387550 - protein, 11 aa, Influenza virus
MGLVFFCLKNG

SEQ ID NO: 387551 - protein, 11 aa, Influenza virus
GLVFFCLKNGN

SEQ ID NO: 387552 - protein, 11 aa, Influenza virus
LVFFCLKNGNM

SEQ ID NO: 387553 - protein, 11 aa, Influenza virus
VFFCLKNGNMR

SEQ ID NO: 387554 - protein, 11 aa, Influenza virus
FFCLKNGNMRC

SEQ ID NO: 387555 - protein, 11 aa, Influenza virus
FCLKNGNMRCT

SEQ ID NO: 387556 - protein, 11 aa, Influenza virus
CLKNGNMRCTI

SEQ ID NO: 387557 - protein, 11 aa, Influenza virus
LKNGNMRCTIC

SEQ ID NO: 387558 - protein, 11 aa, Influenza virus
KNGNMRCTICI

SEQ ID NO: 387559 - protein, 11 aa, Influenza virus
MNPNQKLFALS

SEQ ID NO: 387560 - protein, 11 aa, Influenza virus
NPNQKLFALSG

SEQ ID NO: 387561 - protein, 11 aa, Influenza virus
PNQKLFALSGV

SEQ ID NO: 387562 - protein, 11 aa, Influenza virus
NQKLFALSGVA

SEQ ID NO: 387563 - protein, 11 aa, Influenza virus
QKLFALSGVAI

SEQ ID NO: 387564 - protein, 11 aa, Influenza virus
KLFALSGVAIA

SEQ ID NO: 387565 - protein, 11 aa, Influenza virus
LFALSGVAIAL

SEQ ID NO: 387566 - protein, 11 aa, Influenza virus
LNLLIGISNVG

SEQ ID NO: 387567 - protein, 11 aa, Influenza virus
NLLIGISNVGL

SEQ ID NO: 387568 - protein, 11 aa, Influenza virus
LLIGISNVGLN

SEQ ID NO: 387569 - protein, 11 aa, Influenza virus
LIGISNVGLNV

SEQ ID NO: 387570 - protein, 11 aa, Influenza virus
IGISNVGLNVS

SEQ ID NO: 387571 - protein, 11 aa, Influenza virus
GISNVGLNVSL

SEQ ID NO: 387572 - protein, 11 aa, Influenza virus
ISNVGLNVSLH

SEQ ID NO: 387573 - protein, 11 aa, Influenza virus
SNVGLNVSLHL

SEQ ID NO: 387574 - protein, 11 aa, Influenza virus
NVGLNVSLHLK

SEQ ID NO: 387575 - protein, 11 aa, Influenza virus
EKGTKQEENLT

SEQ ID NO: 387576 - protein, 11 aa, Influenza virus
TQNNTTLIENT

SEQ ID NO: 387577 - protein, 11 aa, Influenza virus
QNNTTLIENTY

SEQ ID NO: 387578 - protein, 11 aa, Influenza virus
NNTTLIENTYV

SEQ ID NO: 387579 - protein, 11 aa, Influenza virus
NTTLIENTYVN

SEQ ID NO: 387580 - protein, 11 aa, Influenza virus
TTLIENTYVNN

SEQ ID NO: 387581 - protein, 11 aa, Influenza virus
TLIENTYVNNT

SEQ ID NO: 387582 - protein, 11 aa, Influenza virus
LIENTYVNNTT

SEQ ID NO: 387583 - protein, 11 aa, Influenza virus
IENTYVNNTTV

SEQ ID NO: 387584 - protein, 11 aa, Influenza virus
ENTYVNNTTVI

SEQ ID NO: 387585 - protein, 11 aa, Influenza virus
YLMLNKSLCKV

SEQ ID NO: 387586 - protein, 11 aa, Influenza virus
LMLNKSLCKVE

SEQ ID NO: 387587 - protein, 11 aa, Influenza virus
LNKSLCKVEGW

SEQ ID NO: 387588 - protein, 11 aa, Influenza virus
NKSLCKVEGWV

SEQ ID NO: 387589 - protein, 11 aa, Influenza virus
KSLCKVEGWVV

SEQ ID NO: 387590 - protein, 11 aa, Influenza virus
SLCKVEGWVVV

SEQ ID NO: 387591 - protein, 11 aa, Influenza virus
LCKVEGWVVVA

SEQ ID NO: 387592 - protein, 11 aa, Influenza virus
CKVEGWVVVAK

SEQ ID NO: 387593 - protein, 11 aa, Influenza virus
KVEGWVVVAKD

SEQ ID NO: 387594 - protein, 11 aa, Influenza virus
VEGWVVVAKDN

SEQ ID NO: 387595 - protein, 11 aa, Influenza virus
EGWVVVAKDNA

SEQ ID NO: 387596 - protein, 11 aa, Influenza virus
GWVVVAKDNAI

SEQ ID NO: 387597 - protein, 11 aa, Influenza virus
WVVVAKDNAIR

SEQ ID NO: 387598 - protein, 11 aa, Influenza virus
VVVAKDNAIRF

SEQ ID NO: 387599 - protein, 11 aa, Influenza virus
VVAKDNAIRFG

SEQ ID NO: 387600 - protein, 11 aa, Influenza virus
VAKDNAIRFGE

SEQ ID NO: 387601 - protein, 11 aa, Influenza virus
AKDNAIRFGES

SEQ ID NO: 387602 - protein, 11 aa, Influenza virus
KDNAIRFGESE

SEQ ID NO: 387603 - protein, 11 aa, Influenza virus
DNAIRFGESEQ

SEQ ID NO: 387604 - protein, 11 aa, Influenza virus
NAIRFGESEQI

SEQ ID NO: 387605 - protein, 11 aa, Influenza virus
AIRFGESEQII

SEQ ID NO: 387606 - protein, 11 aa, Influenza virus
IRFGESEQIIV

SEQ ID NO: 387607 - protein, 11 aa, Influenza virus
RFGESEQIIVT

SEQ ID NO: 387608 - protein, 11 aa, Influenza virus
FGESEQIIVTR

SEQ ID NO: 387609 - protein, 11 aa, Influenza virus
GESEQIIVTRE

SEQ ID NO: 387610 - protein, 11 aa, Influenza virus
ESEQIIVTREP

SEQ ID NO: 387611 - protein, 11 aa, Influenza virus
SEQIIVTREPY

SEQ ID NO: 387612 - protein, 11 aa, Influenza virus
EQIIVTREPYV

SEQ ID NO: 387613 - protein, 11 aa, Influenza virus
QIIVTREPYVS

SEQ ID NO: 387614 - protein, 11 aa, Influenza virus
IIVTREPYVSC

SEQ ID NO: 387615 - protein, 11 aa, Influenza virus
IVTREPYVSCD

SEQ ID NO: 387616 - protein, 11 aa, Influenza virus
VTREPYVSCDP

SEQ ID NO: 387617 - protein, 11 aa, Influenza virus
TREPYVSCDPL

SEQ ID NO: 387618 - protein, 11 aa, Influenza virus
REPYVSCDPLG

SEQ ID NO: 387619 - protein, 11 aa, Influenza virus
EPYVSCDPLGC

SEQ ID NO: 387620 - protein, 11 aa, Influenza virus
PYVSCDPLGCK

SEQ ID NO: 387621 - protein, 11 aa, Influenza virus
YVSCDPLGCKM

SEQ ID NO: 387622 - protein, 11 aa, Influenza virus
VSCDPLGCKMY

SEQ ID NO: 387623 - protein, 11 aa, Influenza virus
SCDPLGCKMYA

SEQ ID NO: 387624 - protein, 11 aa, Influenza virus
CDPLGCKMYAL

SEQ ID NO: 387625 - protein, 11 aa, Influenza virus
DPLGCKMYALH

SEQ ID NO: 387626 - protein, 11 aa, Influenza virus
PLGCKMYALHQ

SEQ ID NO: 387627 - protein, 11 aa, Influenza virus
LGCKMYALHQG

SEQ ID NO: 387628 - protein, 11 aa, Influenza virus
GCKMYALHQGT

SEQ ID NO: 387629 - protein, 11 aa, Influenza virus
CKMYALHQGTT

SEQ ID NO: 387630 - protein, 11 aa, Influenza virus
KMYALHQGTTI

SEQ ID NO: 387631 - protein, 11 aa, Influenza virus
MYALHQGTTIR

SEQ ID NO: 387632 - protein, 11 aa, Influenza virus
YALHQGTTIRN

SEQ ID NO: 387633 - protein, 11 aa, Influenza virus
ALHQGTTIRNK

SEQ ID NO: 387634 - protein, 11 aa, Influenza virus
LHQGTTIRNKH

SEQ ID NO: 387635 - protein, 11 aa, Influenza virus
HQGTTIRNKHS

SEQ ID NO: 387636 - protein, 11 aa, Influenza virus
QGTTIRNKHSN

SEQ ID NO: 387637 - protein, 11 aa, Influenza virus
GTTIRNKHSNG

SEQ ID NO: 387638 - protein, 11 aa, Influenza virus
TTIRNKHSNGT

SEQ ID NO: 387639 - protein, 11 aa, Influenza virus
TIRNKHSNGTI

SEQ ID NO: 387640 - protein, 11 aa, Influenza virus
IRNKHSNGTIH

SEQ ID NO: 387641 - protein, 11 aa, Influenza virus
RNKHSNGTIHD

SEQ ID NO: 387642 - protein, 11 aa, Influenza virus
NKHSNGTIHDR

SEQ ID NO: 387643 - protein, 11 aa, Influenza virus
KHSNGTIHDRT

SEQ ID NO: 387644 - protein, 11 aa, Influenza virus
HSNGTIHDRTA

SEQ ID NO: 387645 - protein, 11 aa, Influenza virus
SNGTIHDRTAF

SEQ ID NO: 387646 - protein, 11 aa, Influenza virus
NGTIHDRTAFR

SEQ ID NO: 387647 - protein, 11 aa, Influenza virus
GTIHDRTAFRG

SEQ ID NO: 387648 - protein, 11 aa, Influenza virus
TIHDRTAFRGL

SEQ ID NO: 387649 - protein, 11 aa, Influenza virus
IHDRTAFRGLI

SEQ ID NO: 387650 - protein, 11 aa, Influenza virus
HDRTAFRGLIS

SEQ ID NO: 387651 - protein, 11 aa, Influenza virus
DRTAFRGLIST

SEQ ID NO: 387652 - protein, 11 aa, Influenza virus
RTAFRGLISTP

SEQ ID NO: 387653 - protein, 11 aa, Influenza virus
TAFRGLISTPL

SEQ ID NO: 387654 - protein, 11 aa, Influenza virus
AFRGLISTPLG

SEQ ID NO: 387655 - protein, 11 aa, Influenza virus
FRGLISTPLGS

SEQ ID NO: 387656 - protein, 11 aa, Influenza virus
RGLISTPLGSP

SEQ ID NO: 387657 - protein, 11 aa, Influenza virus
GLISTPLGSPP

SEQ ID NO: 387658 - protein, 11 aa, Influenza virus
LISTPLGSPPI

SEQ ID NO: 387659 - protein, 11 aa, Influenza virus
ISTPLGSPPIV

SEQ ID NO: 387660 - protein, 11 aa, Influenza virus
STPLGSPPIVS

SEQ ID NO: 387661 - protein, 11 aa, Influenza virus
TPLGSPPIVSN

SEQ ID NO: 387662 - protein, 11 aa, Influenza virus
PLGSPPIVSNS

SEQ ID NO: 387663 - protein, 11 aa, Influenza virus
LGSPPIVSNSD

SEQ ID NO: 387664 - protein, 11 aa, Influenza virus
GSPPIVSNSDF

SEQ ID NO: 387665 - protein, 11 aa, Influenza virus
VSNSDFLCVGW

SEQ ID NO: 387666 - protein, 11 aa, Influenza virus
SNSDFLCVGWS

SEQ ID NO: 387667 - protein, 11 aa, Influenza virus
NSDFLCVGWSS

SEQ ID NO: 387668 - protein, 11 aa, Influenza virus
SDFLCVGWSST

SEQ ID NO: 387669 - protein, 11 aa, Influenza virus
DFLCVGWSSTS

SEQ ID NO: 387670 - protein, 11 aa, Influenza virus
FLCVGWSSTSC

SEQ ID NO: 387671 - protein, 11 aa, Influenza virus
LCVGWSSTSCH

SEQ ID NO: 387672 - protein, 11 aa, Influenza virus
CVGWSSTSCHD

SEQ ID NO: 387673 - protein, 11 aa, Influenza virus
VGWSSTSCHDG

SEQ ID NO: 387674 - protein, 11 aa, Influenza virus
GWSSTSCHDGI

SEQ ID NO: 387675 - protein, 11 aa, Influenza virus
WSSTSCHDGIG

SEQ ID NO: 387676 - protein, 11 aa, Influenza virus
SSTSCHDGIGR

SEQ ID NO: 387677 - protein, 11 aa, Influenza virus
STSCHDGIGRM

SEQ ID NO: 387678 - protein, 11 aa, Influenza virus
TSCHDGIGRMT

SEQ ID NO: 387679 - protein, 11 aa, Influenza virus
SCHDGIGRMTI

SEQ ID NO: 387680 - protein, 11 aa, Influenza virus
CHDGIGRMTIC

SEQ ID NO: 387681 - protein, 11 aa, Influenza virus
HDGIGRMTICV

SEQ ID NO: 387682 - protein, 11 aa, Influenza virus
DGIGRMTICVQ

SEQ ID NO: 387683 - protein, 11 aa, Influenza virus
GIGRMTICVQG

SEQ ID NO: 387684 - protein, 11 aa, Influenza virus
IGRMTICVQGN

SEQ ID NO: 387685 - protein, 11 aa, Influenza virus
GRMTICVQGNN

SEQ ID NO: 387686 - protein, 11 aa, Influenza virus
RMTICVQGNND

SEQ ID NO: 387687 - protein, 11 aa, Influenza virus
MTICVQGNNDN

SEQ ID NO: 387688 - protein, 11 aa, Influenza virus
TICVQGNNDNA

SEQ ID NO: 387689 - protein, 11 aa, Influenza virus
ICVQGNNDNAT

SEQ ID NO: 387690 - protein, 11 aa, Influenza virus
CVQGNNDNATA

SEQ ID NO: 387691 - protein, 11 aa, Influenza virus
VQGNNDNATAT

SEQ ID NO: 387692 - protein, 11 aa, Influenza virus
QGNNDNATATV

SEQ ID NO: 387693 - protein, 11 aa, Influenza virus
GNNDNATATVY

SEQ ID NO: 387694 - protein, 11 aa, Influenza virus
NNDNATATVYY

SEQ ID NO: 387695 - protein, 11 aa, Influenza virus
NDNATATVYYD

SEQ ID NO: 387696 - protein, 11 aa, Influenza virus
DNATATVYYDR

SEQ ID NO: 387697 - protein, 11 aa, Influenza virus
NATATVYYDRR

SEQ ID NO: 387698 - protein, 11 aa, Influenza virus
ATATVYYDRRL

SEQ ID NO: 387699 - protein, 11 aa, Influenza virus
TATVYYDRRLT

SEQ ID NO: 387700 - protein, 11 aa, Influenza virus
ATVYYDRRLTT

SEQ ID NO: 387701 - protein, 11 aa, Influenza virus
TVYYDRRLTTT

SEQ ID NO: 387702 - protein, 11 aa, Influenza virus
VYYDRRLTTTI

SEQ ID NO: 387703 - protein, 11 aa, Influenza virus
YYDRRLTTTIK

SEQ ID NO: 387704 - protein, 11 aa, Influenza virus
YDRRLTTTIKT

SEQ ID NO: 387705 - protein, 11 aa, Influenza virus
DRRLTTTIKTW

SEQ ID NO: 387706 - protein, 11 aa, Influenza virus
RRLTTTIKTWA

SEQ ID NO: 387707 - protein, 11 aa, Influenza virus
RLTTTIKTWAG

SEQ ID NO: 387708 - protein, 11 aa, Influenza virus
LTTTIKTWAGN

SEQ ID NO: 387709 - protein, 11 aa, Influenza virus
TTTIKTWAGNI

SEQ ID NO: 387710 - protein, 11 aa, Influenza virus
TTIKTWAGNIL

SEQ ID NO: 387711 - protein, 11 aa, Influenza virus
TIKTWAGNILR

SEQ ID NO: 387712 - protein, 11 aa, Influenza virus
IKTWAGNILRT

SEQ ID NO: 387713 - protein, 11 aa, Influenza virus
KTWAGNILRTQ

SEQ ID NO: 387714 - protein, 11 aa, Influenza virus
TWAGNILRTQE

SEQ ID NO: 387715 - protein, 11 aa, Influenza virus
WAGNILRTQES

SEQ ID NO: 387716 - protein, 11 aa, Influenza virus
AGNILRTQESE

SEQ ID NO: 387717 - protein, 11 aa, Influenza virus
GNILRTQESEC

SEQ ID NO: 387718 - protein, 11 aa, Influenza virus
NILRTQESECV

SEQ ID NO: 387719 - protein, 11 aa, Influenza virus
ILRTQESECVC

SEQ ID NO: 387720 - protein, 11 aa, Influenza virus
LRTQESECVCH

SEQ ID NO: 387721 - protein, 11 aa, Influenza virus
RTQESECVCHN

SEQ ID NO: 387722 - protein, 11 aa, Influenza virus
TQESECVCHNG

SEQ ID NO: 387723 - protein, 11 aa, Influenza virus
QESECVCHNGT

SEQ ID NO: 387724 - protein, 11 aa, Influenza virus
ESECVCHNGTC

SEQ ID NO: 387725 - protein, 11 aa, Influenza virus
SECVCHNGTCV

SEQ ID NO: 387726 - protein, 11 aa, Influenza virus
ECVCHNGTCVV

SEQ ID NO: 387727 - protein, 11 aa, Influenza virus
CVCHNGTCVVI

SEQ ID NO: 387728 - protein, 11 aa, Influenza virus
VCHNGTCVVIM

SEQ ID NO: 387729 - protein, 11 aa, Influenza virus
CHNGTCVVIMT

SEQ ID NO: 387730 - protein, 11 aa, Influenza virus
HNGTCVVIMTD

SEQ ID NO: 387731 - protein, 11 aa, Influenza virus
NGTCVVIMTDG

SEQ ID NO: 387732 - protein, 11 aa, Influenza virus
GTCVVIMTDGS

SEQ ID NO: 387733 - protein, 11 aa, Influenza virus
TCVVIMTDGSA

SEQ ID NO: 387734 - protein, 11 aa, Influenza virus
CVVIMTDGSAS

SEQ ID NO: 387735 - protein, 11 aa, Influenza virus
VIMTDGSASSQ

SEQ ID NO: 387736 - protein, 11 aa, Influenza virus
IMTDGSASSQA

SEQ ID NO: 387737 - protein, 11 aa, Influenza virus
MTDGSASSQAY

SEQ ID NO: 387738 - protein, 11 aa, Influenza virus
TDGSASSQAYT

SEQ ID NO: 387739 - protein, 11 aa, Influenza virus
DGSASSQAYTK

SEQ ID NO: 387740 - protein, 11 aa, Influenza virus
QAYTKVLYFHK

SEQ ID NO: 387741 - protein, 11 aa, Influenza virus
AYTKVLYFHKG

SEQ ID NO: 387742 - protein, 11 aa, Influenza virus
YFHKGLVIKEE

SEQ ID NO: 387743 - protein, 11 aa, Influenza virus
KEEALKGSARH

SEQ ID NO: 387744 - protein, 11 aa, Influenza virus
LKGSARHIEEC

SEQ ID NO: 387745 - protein, 11 aa, Influenza virus
KGSARHIEECS

SEQ ID NO: 387746 - protein, 11 aa, Influenza virus
GSARHIEECSC

SEQ ID NO: 387747 - protein, 11 aa, Influenza virus
SARHIEECSCY

SEQ ID NO: 387748 - protein, 11 aa, Influenza virus
ARHIEECSCYG

SEQ ID NO: 387749 - protein, 11 aa, Influenza virus
RHIEECSCYGH

SEQ ID NO: 387750 - protein, 11 aa, Influenza virus
HIEECSCYGHN

SEQ ID NO: 387751 - protein, 11 aa, Influenza virus
IEECSCYGHNS

SEQ ID NO: 387752 - protein, 11 aa, Influenza virus
EECSCYGHNSK

SEQ ID NO: 387753 - protein, 11 aa, Influenza virus
SKVTCVCRDNW

SEQ ID NO: 387754 - protein, 11 aa, Influenza virus
KVTCVCRDNWQ

SEQ ID NO: 387755 - protein, 11 aa, Influenza virus
VTCVCRDNWQG

SEQ ID NO: 387756 - protein, 11 aa, Influenza virus
TCVCRDNWQGA

SEQ ID NO: 387757 - protein, 11 aa, Influenza virus
CVCRDNWQGAN

SEQ ID NO: 387758 - protein, 11 aa, Influenza virus
VCRDNWQGANR

SEQ ID NO: 387759 - protein, 11 aa, Influenza virus
CRDNWQGANRP

SEQ ID NO: 387760 - protein, 11 aa, Influenza virus
RDNWQGANRPV

SEQ ID NO: 387761 - protein, 11 aa, Influenza virus
DNWQGANRPVI

SEQ ID NO: 387762 - protein, 11 aa, Influenza virus
NWQGANRPVIE

SEQ ID NO: 387763 - protein, 11 aa, Influenza virus
WQGANRPVIEI

SEQ ID NO: 387764 - protein, 11 aa, Influenza virus
QGANRPVIEID

SEQ ID NO: 387765 - protein, 11 aa, Influenza virus
GANRPVIEIDM

SEQ ID NO: 387766 - protein, 11 aa, Influenza virus
AMEHTSQYLCT

SEQ ID NO: 387767 - protein, 11 aa, Influenza virus
MEHTSQYLCTG

SEQ ID NO: 387768 - protein, 11 aa, Influenza virus
EHTSQYLCTGV

SEQ ID NO: 387769 - protein, 11 aa, Influenza virus
HTSQYLCTGVL

SEQ ID NO: 387770 - protein, 11 aa, Influenza virus
TSQYLCTGVLT

SEQ ID NO: 387771 - protein, 11 aa, Influenza virus
SQYLCTGVLTD

SEQ ID NO: 387772 - protein, 11 aa, Influenza virus
QYLCTGVLTDT

SEQ ID NO: 387773 - protein, 11 aa, Influenza virus
YLCTGVLTDTS

SEQ ID NO: 387774 - protein, 11 aa, Influenza virus
LCTGVLTDTSR

SEQ ID NO: 387775 - protein, 11 aa, Influenza virus
CTGVLTDTSRP

SEQ ID NO: 387776 - protein, 11 aa, Influenza virus
TGVLTDTSRPS

SEQ ID NO: 387777 - protein, 11 aa, Influenza virus
GVLTDTSRPSD

SEQ ID NO: 387778 - protein, 11 aa, Influenza virus
VLTDTSRPSDK

SEQ ID NO: 387779 - protein, 11 aa, Influenza virus
GDCNNPITGSP

SEQ ID NO: 387780 - protein, 11 aa, Influenza virus
DCNNPITGSPG

SEQ ID NO: 387781 - protein, 11 aa, Influenza virus
CNNPITGSPGA

SEQ ID NO: 387782 - protein, 11 aa, Influenza virus
NNPITGSPGAP

SEQ ID NO: 387783 - protein, 11 aa, Influenza virus
NPITGSPGAPG

SEQ ID NO: 387784 - protein, 11 aa, Influenza virus
PITGSPGAPGV

SEQ ID NO: 387785 - protein, 11 aa, Influenza virus
ITGSPGAPGVK

SEQ ID NO: 387786 - protein, 11 aa, Influenza virus
TGSPGAPGVKG

SEQ ID NO: 387787 - protein, 11 aa, Influenza virus
GSPGAPGVKGF

SEQ ID NO: 387788 - protein, 11 aa, Influenza virus
SPGAPGVKGFG

SEQ ID NO: 387789 - protein, 11 aa, Influenza virus
PGAPGVKGFGF

SEQ ID NO: 387790 - protein, 11 aa, Influenza virus
GAPGVKGFGFL

SEQ ID NO: 387791 - protein, 11 aa, Influenza virus
APGVKGFGFLD

SEQ ID NO: 387792 - protein, 11 aa, Influenza virus
PGVKGFGFLDS

SEQ ID NO: 387793 - protein, 11 aa, Influenza virus
GNTWLGRTISP

SEQ ID NO: 387794 - protein, 11 aa, Influenza virus
NTWLGRTISPR

SEQ ID NO: 387795 - protein, 11 aa, Influenza virus
TWLGRTISPRS

SEQ ID NO: 387796 - protein, 11 aa, Influenza virus
WLGRTISPRSR

SEQ ID NO: 387797 - protein, 11 aa, Influenza virus
LGRTISPRSRS

SEQ ID NO: 387798 - protein, 11 aa, Influenza virus
GRTISPRSRSG

SEQ ID NO: 387799 - protein, 11 aa, Influenza virus
RTISPRSRSGF

SEQ ID NO: 387800 - protein, 11 aa, Influenza virus
TISPRSRSGFE

SEQ ID NO: 387801 - protein, 11 aa, Influenza virus
ISPRSRSGFEM

SEQ ID NO: 387802 - protein, 11 aa, Influenza virus
SPRSRSGFEML

SEQ ID NO: 387803 - protein, 11 aa, Influenza virus
PRSRSGFEMLK

SEQ ID NO: 387804 - protein, 11 aa, Influenza virus
RSRSGFEMLKI

SEQ ID NO: 387805 - protein, 11 aa, Influenza virus
SRSGFEMLKIP

SEQ ID NO: 387806 - protein, 11 aa, Influenza virus
RSGFEMLKIPN

SEQ ID NO: 387807 - protein, 11 aa, Influenza virus
SGFEMLKIPNA

SEQ ID NO: 387808 - protein, 11 aa, Influenza virus
GFEMLKIPNAG

SEQ ID NO: 387809 - protein, 11 aa, Influenza virus
FEMLKIPNAGT

SEQ ID NO: 387810 - protein, 11 aa, Influenza virus
EMLKIPNAGTD

SEQ ID NO: 387811 - protein, 11 aa, Influenza virus
MLKIPNAGTDP

SEQ ID NO: 387812 - protein, 11 aa, Influenza virus
LKIPNAGTDPN

SEQ ID NO: 387813 - protein, 11 aa, Influenza virus
KIPNAGTDPNS

SEQ ID NO: 387814 - protein, 11 aa, Influenza virus
NNNWSGYSGSF

SEQ ID NO: 387815 - protein, 11 aa, Influenza virus
NNWSGYSGSFI

SEQ ID NO: 387816 - protein, 11 aa, Influenza virus
NWSGYSGSFID

SEQ ID NO: 387817 - protein, 11 aa, Influenza virus
WSGYSGSFIDY

SEQ ID NO: 387818 - protein, 11 aa, Influenza virus
SGYSGSFIDYW

SEQ ID NO: 387819 - protein, 11 aa, Influenza virus
GYSGSFIDYWD

SEQ ID NO: 387820 - protein, 11 aa, Influenza virus
YSGSFIDYWDE

SEQ ID NO: 387821 - protein, 11 aa, Influenza virus
SECYNPCFYVE

SEQ ID NO: 387822 - protein, 11 aa, Influenza virus
ECYNPCFYVEL

SEQ ID NO: 387823 - protein, 11 aa, Influenza virus
CYNPCFYVELI

SEQ ID NO: 387824 - protein, 11 aa, Influenza virus
YNPCFYVELIR

SEQ ID NO: 387825 - protein, 11 aa, Influenza virus
NPCFYVELIRG

SEQ ID NO: 387826 - protein, 11 aa, Influenza virus
PCFYVELIRGR

SEQ ID NO: 387827 - protein, 11 aa, Influenza virus
CFYVELIRGRP

SEQ ID NO: 387828 - protein, 11 aa, Influenza virus
FYVELIRGRPE

SEQ ID NO: 387829 - protein, 11 aa, Influenza virus
YVELIRGRPEE

SEQ ID NO: 387830 - protein, 11 aa, Influenza virus
VELIRGRPEEA

SEQ ID NO: 387831 - protein, 11 aa, Influenza virus
ELIRGRPEEAK

SEQ ID NO: 387832 - protein, 11 aa, Influenza virus
LIRGRPEEAKY

SEQ ID NO: 387833 - protein, 11 aa, Influenza virus
IRGRPEEAKYV

SEQ ID NO: 387834 - protein, 11 aa, Influenza virus
RGRPEEAKYVW

SEQ ID NO: 387835 - protein, 11 aa, Influenza virus
GRPEEAKYVWW

SEQ ID NO: 387836 - protein, 11 aa, Influenza virus
RPEEAKYVWWT

SEQ ID NO: 387837 - protein, 11 aa, Influenza virus
PEEAKYVWWTS

SEQ ID NO: 387838 - protein, 11 aa, Influenza virus
EEAKYVWWTSN

SEQ ID NO: 387839 - protein, 11 aa, Influenza virus
EAKYVWWTSNS

SEQ ID NO: 387840 - protein, 11 aa, Influenza virus
AKYVWWTSNSL

SEQ ID NO: 387841 - protein, 11 aa, Influenza virus
KYVWWTSNSLV

SEQ ID NO: 387842 - protein, 11 aa, Influenza virus
YVWWTSNSLVA

SEQ ID NO: 387843 - protein, 11 aa, Influenza virus
VWWTSNSLVAL

SEQ ID NO: 387844 - protein, 11 aa, Influenza virus
WWTSNSLVALC

SEQ ID NO: 387845 - protein, 11 aa, Influenza virus
WTSNSLVALCG

SEQ ID NO: 387846 - protein, 11 aa, Influenza virus
TSNSLVALCGS

SEQ ID NO: 387847 - protein, 11 aa, Influenza virus
SNSLVALCGSP

SEQ ID NO: 387848 - protein, 11 aa, Influenza virus
NSLVALCGSPI

SEQ ID NO: 387849 - protein, 11 aa, Influenza virus
SLVALCGSPIS

SEQ ID NO: 387850 - protein, 11 aa, Influenza virus
LVALCGSPISV

SEQ ID NO: 387851 - protein, 11 aa, Influenza virus
VALCGSPISVG

SEQ ID NO: 387852 - protein, 11 aa, Influenza virus
ALCGSPISVGS

SEQ ID NO: 387853 - protein, 11 aa, Influenza virus
LCGSPISVGSG

SEQ ID NO: 387854 - protein, 11 aa, Influenza virus
CGSPISVGSGS

SEQ ID NO: 387855 - protein, 11 aa, Influenza virus
GSPISVGSGSF

SEQ ID NO: 387856 - protein, 11 aa, Influenza virus
SPISVGSGSFP

SEQ ID NO: 387857 - protein, 11 aa, Influenza virus
PISVGSGSFPD

SEQ ID NO: 387858 - protein, 11 aa, Influenza virus
ISVGSGSFPDG

SEQ ID NO: 387859 - protein, 11 aa, Influenza virus
SVGSGSFPDGA

SEQ ID NO: 387860 - protein, 11 aa, Influenza virus
VGSGSFPDGAQ

SEQ ID NO: 387861 - protein, 11 aa, Influenza virus
GSGSFPDGAQI

SEQ ID NO: 387862 - protein, 11 aa, Influenza virus
SGSFPDGAQIQ

SEQ ID NO: 387863 - protein, 11 aa, Influenza virus
GSFPDGAQIQY

SEQ ID NO: 387864 - protein, 11 aa, Influenza virus
SFPDGAQIQYF

SEQ ID NO: 387865 - protein, 11 aa, Influenza virus
FPDGAQIQYFS

SEQ ID NO: 387866 - protein, 11 aa, Influenza virus
QADEICIGYLS

SEQ ID NO: 387867 - protein, 11 aa, Influenza virus
ADEICIGYLSN

SEQ ID NO: 387868 - protein, 11 aa, Influenza virus
DEICIGYLSNN

SEQ ID NO: 387869 - protein, 11 aa, Influenza virus
EICIGYLSNNS

SEQ ID NO: 387870 - protein, 11 aa, Influenza virus
ICIGYLSNNST

SEQ ID NO: 387871 - protein, 11 aa, Influenza virus
CIGYLSNNSTE

SEQ ID NO: 387872 - protein, 11 aa, Influenza virus
IGYLSNNSTEK

SEQ ID NO: 387873 - protein, 11 aa, Influenza virus
GYLSNNSTEKV

SEQ ID NO: 387874 - protein, 11 aa, Influenza virus
LSNNSTEKVDT

SEQ ID NO: 387875 - protein, 11 aa, Influenza virus
SNNSTEKVDTI

SEQ ID NO: 387876 - protein, 11 aa, Influenza virus
NNSTEKVDTII

SEQ ID NO: 387877 - protein, 11 aa, Influenza virus
NSTEKVDTIIE

SEQ ID NO: 387878 - protein, 11 aa, Influenza virus
STEKVDTIIES

SEQ ID NO: 387879 - protein, 11 aa, Influenza virus
TEKVDTIIESN

SEQ ID NO: 387880 - protein, 11 aa, Influenza virus
KVDTIIESNVT

SEQ ID NO: 387881 - protein, 11 aa, Influenza virus
VDTIIESNVTV

SEQ ID NO: 387882 - protein, 11 aa, Influenza virus
DTIIESNVTVT

SEQ ID NO: 387883 - protein, 11 aa, Influenza virus
TIIESNVTVTS

SEQ ID NO: 387884 - protein, 11 aa, Influenza virus
IIESNVTVTSS

SEQ ID NO: 387885 - protein, 11 aa, Influenza virus
IESNVTVTSSV

SEQ ID NO: 387886 - protein, 11 aa, Influenza virus
ESNVTVTSSVE

SEQ ID NO: 387887 - protein, 11 aa, Influenza virus
SNVTVTSSVEL

SEQ ID NO: 387888 - protein, 11 aa, Influenza virus
NVTVTSSVELV

SEQ ID NO: 387889 - protein, 11 aa, Influenza virus
VTVTSSVELVE

SEQ ID NO: 387890 - protein, 11 aa, Influenza virus
TVTSSVELVEN

SEQ ID NO: 387891 - protein, 11 aa, Influenza virus
HTGSFCSIDGK

SEQ ID NO: 387892 - protein, 11 aa, Influenza virus
FCSIDGKAPIS

SEQ ID NO: 387893 - protein, 11 aa, Influenza virus
CSIDGKAPISL

SEQ ID NO: 387894 - protein, 11 aa, Influenza virus
SIDGKAPISLG

SEQ ID NO: 387895 - protein, 11 aa, Influenza virus
DGKAPISLGDC

SEQ ID NO: 387896 - protein, 11 aa, Influenza virus
GKAPISLGDCS

SEQ ID NO: 387897 - protein, 11 aa, Influenza virus
KAPISLGDCSF

SEQ ID NO: 387898 - protein, 11 aa, Influenza virus
APISLGDCSFA

SEQ ID NO: 387899 - protein, 11 aa, Influenza virus
PISLGDCSFAG

SEQ ID NO: 387900 - protein, 11 aa, Influenza virus
ISLGDCSFAGW

SEQ ID NO: 387901 - protein, 11 aa, Influenza virus
SLGDCSFAGWI

SEQ ID NO: 387902 - protein, 11 aa, Influenza virus
LGDCSFAGWIL

SEQ ID NO: 387903 - protein, 11 aa, Influenza virus
GDCSFAGWILG

SEQ ID NO: 387904 - protein, 11 aa, Influenza virus
DCSFAGWILGN

SEQ ID NO: 387905 - protein, 11 aa, Influenza virus
CSFAGWILGNP

SEQ ID NO: 387906 - protein, 11 aa, Influenza virus
SFAGWILGNPM

SEQ ID NO: 387907 - protein, 11 aa, Influenza virus
FAGWILGNPMC

SEQ ID NO: 387908 - protein, 11 aa, Influenza virus
AGWILGNPMCD

SEQ ID NO: 387909 - protein, 11 aa, Influenza virus
GWILGNPMCDD

SEQ ID NO: 387910 - protein, 11 aa, Influenza virus
WILGNPMCDDL

SEQ ID NO: 387911 - protein, 11 aa, Influenza virus
ILGNPMCDDLI

SEQ ID NO: 387912 - protein, 11 aa, Influenza virus
LGNPMCDDLIG

SEQ ID NO: 387913 - protein, 11 aa, Influenza virus
GNPMCDDLIGK

SEQ ID NO: 387914 - protein, 11 aa, Influenza virus
CDDLIGKTSWS

SEQ ID NO: 387915 - protein, 11 aa, Influenza virus
DDLIGKTSWSY

SEQ ID NO: 387916 - protein, 11 aa, Influenza virus
DLIGKTSWSYI

SEQ ID NO: 387917 - protein, 11 aa, Influenza virus
LIGKTSWSYIV

SEQ ID NO: 387918 - protein, 11 aa, Influenza virus
IGKTSWSYIVE

SEQ ID NO: 387919 - protein, 11 aa, Influenza virus
GKTSWSYIVEK

SEQ ID NO: 387920 - protein, 11 aa, Influenza virus
KTSWSYIVEKP

SEQ ID NO: 387921 - protein, 11 aa, Influenza virus
TSWSYIVEKPN

SEQ ID NO: 387922 - protein, 11 aa, Influenza virus
SWSYIVEKPNP

SEQ ID NO: 387923 - protein, 11 aa, Influenza virus
VNGQAGRMTFY

SEQ ID NO: 387924 - protein, 11 aa, Influenza virus
NGQAGRMTFYW

SEQ ID NO: 387925 - protein, 11 aa, Influenza virus
GQAGRMTFYWT

SEQ ID NO: 387926 - protein, 11 aa, Influenza virus
QAGRMTFYWTI

SEQ ID NO: 387927 - protein, 11 aa, Influenza virus
TFESNGAFLAP

SEQ ID NO: 387928 - protein, 11 aa, Influenza virus
FESNGAFLAPR

SEQ ID NO: 387929 - protein, 11 aa, Influenza virus
ESNGAFLAPRY

SEQ ID NO: 387930 - protein, 11 aa, Influenza virus
NVHRNTIGDCP

SEQ ID NO: 387931 - protein, 11 aa, Influenza virus
VHRNTIGDCPK

SEQ ID NO: 387932 - protein, 11 aa, Influenza virus
HRNTIGDCPKY

SEQ ID NO: 387933 - protein, 11 aa, Influenza virus
RNTIGDCPKYV

SEQ ID NO: 387934 - protein, 11 aa, Influenza virus
NTIGDCPKYVN

SEQ ID NO: 387935 - protein, 11 aa, Influenza virus
TIGDCPKYVNV

SEQ ID NO: 387936 - protein, 11 aa, Influenza virus
IGDCPKYVNVK

SEQ ID NO: 387937 - protein, 11 aa, Influenza virus
GDCPKYVNVKS

SEQ ID NO: 387938 - protein, 11 aa, Influenza virus
DCPKYVNVKSL

SEQ ID NO: 387939 - protein, 11 aa, Influenza virus
CPKYVNVKSLK

SEQ ID NO: 387940 - protein, 11 aa, Influenza virus
PKYVNVKSLKL

SEQ ID NO: 387941 - protein, 11 aa, Influenza virus
KYVNVKSLKLA

SEQ ID NO: 387942 - protein, 11 aa, Influenza virus
KSLKLATGLRN

SEQ ID NO: 387943 - protein, 11 aa, Influenza virus
SLKLATGLRNV

SEQ ID NO: 387944 - protein, 11 aa, Influenza virus
LKLATGLRNVP

SEQ ID NO: 387945 - protein, 11 aa, Influenza virus
KLATGLRNVPA

SEQ ID NO: 387946 - protein, 11 aa, Influenza virus
TRGLFGAIAGF

SEQ ID NO: 387947 - protein, 11 aa, Influenza virus
RGLFGAIAGFI

SEQ ID NO: 387948 - protein, 11 aa, Influenza virus
GLFGAIAGFIE

SEQ ID NO: 387949 - protein, 11 aa, Influenza virus
LFGAIAGFIEG

SEQ ID NO: 387950 - protein, 11 aa, Influenza virus
FGAIAGFIEGG

SEQ ID NO: 387951 - protein, 11 aa, Influenza virus
GAIAGFIEGGW

SEQ ID NO: 387952 - protein, 11 aa, Influenza virus
AIAGFIEGGWP

SEQ ID NO: 387953 - protein, 11 aa, Influenza virus
IAGFIEGGWPG

SEQ ID NO: 387954 - protein, 11 aa, Influenza virus
AGFIEGGWPGL

SEQ ID NO: 387955 - protein, 11 aa, Influenza virus
GFIEGGWPGLI

SEQ ID NO: 387956 - protein, 11 aa, Influenza virus
FIEGGWPGLIN

SEQ ID NO: 387957 - protein, 11 aa, Influenza virus
IEGGWPGLING

SEQ ID NO: 387958 - protein, 11 aa, Influenza virus
EGGWPGLINGW

SEQ ID NO: 387959 - protein, 11 aa, Influenza virus
GGWPGLINGWY

SEQ ID NO: 387960 - protein, 11 aa, Influenza virus
GWPGLINGWYG

SEQ ID NO: 387961 - protein, 11 aa, Influenza virus
WPGLINGWYGF

SEQ ID NO: 387962 - protein, 11 aa, Influenza virus
PGLINGWYGFQ

SEQ ID NO: 387963 - protein, 11 aa, Influenza virus
GLINGWYGFQH

SEQ ID NO: 387964 - protein, 11 aa, Influenza virus
LINGWYGFQHR

SEQ ID NO: 387965 - protein, 11 aa, Influenza virus
INGWYGFQHRN

SEQ ID NO: 387966 - protein, 11 aa, Influenza virus
NGWYGFQHRNE

SEQ ID NO: 387967 - protein, 11 aa, Influenza virus
GWYGFQHRNEE

SEQ ID NO: 387968 - protein, 11 aa, Influenza virus
WYGFQHRNEEG

SEQ ID NO: 387969 - protein, 11 aa, Influenza virus
YGFQHRNEEGT

SEQ ID NO: 387970 - protein, 11 aa, Influenza virus
GFQHRNEEGTG

SEQ ID NO: 387971 - protein, 11 aa, Influenza virus
FQHRNEEGTGI

SEQ ID NO: 387972 - protein, 11 aa, Influenza virus
QHRNEEGTGIA

SEQ ID NO: 387973 - protein, 11 aa, Influenza virus
HRNEEGTGIAA

SEQ ID NO: 387974 - protein, 11 aa, Influenza virus
RNEEGTGIAAD

SEQ ID NO: 387975 - protein, 11 aa, Influenza virus
NEEGTGIAADK

SEQ ID NO: 387976 - protein, 11 aa, Influenza virus
EEGTGIAADKE

SEQ ID NO: 387977 - protein, 11 aa, Influenza virus
EGTGIAADKES

SEQ ID NO: 387978 - protein, 11 aa, Influenza virus
GTGIAADKEST

SEQ ID NO: 387979 - protein, 11 aa, Influenza virus
TGIAADKESTQ

SEQ ID NO: 387980 - protein, 11 aa, Influenza virus
GIAADKESTQK

SEQ ID NO: 387981 - protein, 11 aa, Influenza virus
DIWSYNAQLLV

SEQ ID NO: 387982 - protein, 11 aa, Influenza virus
IWSYNAQLLVL

SEQ ID NO: 387983 - protein, 11 aa, Influenza virus
WSYNAQLLVLL

SEQ ID NO: 387984 - protein, 11 aa, Influenza virus
SYNAQLLVLLE

SEQ ID NO: 387985 - protein, 11 aa, Influenza virus
YNAQLLVLLEN

SEQ ID NO: 387986 - protein, 11 aa, Influenza virus
NAQLLVLLENE

SEQ ID NO: 387987 - protein, 11 aa, Influenza virus
AQLLVLLENEK

SEQ ID NO: 387988 - protein, 11 aa, Influenza virus
QLLVLLENEKT

SEQ ID NO: 387989 - protein, 11 aa, Influenza virus
LLVLLENEKTL

SEQ ID NO: 387990 - protein, 11 aa, Influenza virus
LVLLENEKTLD

SEQ ID NO: 387991 - protein, 11 aa, Influenza virus
VLLENEKTLDL

SEQ ID NO: 387992 - protein, 11 aa, Influenza virus
LLENEKTLDLH

SEQ ID NO: 387993 - protein, 11 aa, Influenza virus
LENEKTLDLHD

SEQ ID NO: 387994 - protein, 11 aa, Influenza virus
ENEKTLDLHDS

SEQ ID NO: 387995 - protein, 11 aa, Influenza virus
NEKTLDLHDSN

SEQ ID NO: 387996 - protein, 11 aa, Influenza virus
EKTLDLHDSNV

SEQ ID NO: 387997 - protein, 11 aa, Influenza virus
KTLDLHDSNVR

SEQ ID NO: 387998 - protein, 11 aa, Influenza virus
TLDLHDSNVRN

SEQ ID NO: 387999 - protein, 11 aa, Influenza virus
LDLHDSNVRNL

SEQ ID NO: 388000 - protein, 11 aa, Influenza virus
DLHDSNVRNLH

SEQ ID NO: 388001 - protein, 11 aa, Influenza virus
LHDSNVRNLHE

SEQ ID NO: 388002 - protein, 11 aa, Influenza virus
HDSNVRNLHEK

SEQ ID NO: 388003 - protein, 11 aa, Influenza virus
LKDNAKDEGNG

SEQ ID NO: 388004 - protein, 11 aa, Influenza virus
KDNAKDEGNGC

SEQ ID NO: 388005 - protein, 11 aa, Influenza virus
DNAKDEGNGCF

SEQ ID NO: 388006 - protein, 11 aa, Influenza virus
NAKDEGNGCFT

SEQ ID NO: 388007 - protein, 11 aa, Influenza virus
AKDEGNGCFTF

SEQ ID NO: 388008 - protein, 11 aa, Influenza virus
KDEGNGCFTFY

SEQ ID NO: 388009 - protein, 11 aa, Influenza virus
DEGNGCFTFYH

SEQ ID NO: 388010 - protein, 11 aa, Influenza virus
EGNGCFTFYHK

SEQ ID NO: 388011 - protein, 11 aa, Influenza virus
GNGCFTFYHKC

SEQ ID NO: 388012 - protein, 11 aa, Influenza virus
NGCFTFYHKCD

SEQ ID NO: 388013 - protein, 11 aa, Influenza virus
GCFTFYHKCDN

SEQ ID NO: 388014 - protein, 11 aa, Influenza virus
FYHKCDNECIE

SEQ ID NO: 388015 - protein, 11 aa, Influenza virus
NECIEKVRNGT

SEQ ID NO: 388016 - protein, 11 aa, Influenza virus
ECIEKVRNGTY

SEQ ID NO: 388017 - protein, 11 aa, Influenza virus
CIEKVRNGTYD

SEQ ID NO: 388018 - protein, 11 aa, Influenza virus
IEKVRNGTYDH

SEQ ID NO: 388019 - protein, 11 aa, Influenza virus
EKVRNGTYDHK

SEQ ID NO: 388020 - protein, 11 aa, Influenza virus
KVRNGTYDHKE

SEQ ID NO: 388021 - protein, 11 aa, Influenza virus
VRNGTYDHKEF

SEQ ID NO: 388022 - protein, 11 aa, Influenza virus
RNGTYDHKEFE

SEQ ID NO: 388023 - protein, 11 aa, Influenza virus
NGTYDHKEFEE

SEQ ID NO: 388024 - protein, 11 aa, Influenza virus
GTYDHKEFEEE

SEQ ID NO: 388025 - protein, 11 aa, Influenza virus
TYDHKEFEEES

SEQ ID NO: 388026 - protein, 11 aa, Influenza virus
YDHKEFEEESK

SEQ ID NO: 388027 - protein, 11 aa, Influenza virus
ESKLNRQEIEG

SEQ ID NO: 388028 - protein, 11 aa, Influenza virus
LNRQEIEGVKL

SEQ ID NO: 388029 - protein, 11 aa, Influenza virus
NRQEIEGVKLD

SEQ ID NO: 388030 - protein, 11 aa, Influenza virus
GNVYKILSIYS

SEQ ID NO: 388031 - protein, 11 aa, Influenza virus
NVYKILSIYSC

SEQ ID NO: 388032 - protein, 11 aa, Influenza virus
VYKILSIYSCI

SEQ ID NO: 388033 - protein, 11 aa, Influenza virus
YKILSIYSCIA

SEQ ID NO: 388034 - protein, 11 aa, Influenza virus
KILSIYSCIAS

SEQ ID NO: 388035 - protein, 11 aa, Influenza virus
ILSIYSCIASS

SEQ ID NO: 388036 - protein, 11 aa, Influenza virus
LSIYSCIASSL

SEQ ID NO: 388037 - protein, 11 aa, Influenza virus
SIYSCIASSLV

SEQ ID NO: 388038 - protein, 11 aa, Influenza virus
IYSCIASSLVL

SEQ ID NO: 388039 - protein, 11 aa, Influenza virus
YSCIASSLVLA

SEQ ID NO: 388040 - protein, 11 aa, Influenza virus
SCIASSLVLAA

SEQ ID NO: 388041 - protein, 11 aa, Influenza virus
CIASSLVLAAI

SEQ ID NO: 388042 - protein, 11 aa, Influenza virus
ASSLVLAAIIM

SEQ ID NO: 388043 - protein, 11 aa, Influenza virus
SSLVLAAIIMG

SEQ ID NO: 388044 - protein, 11 aa, Influenza virus
WACSNGSCRCT

SEQ ID NO: 388045 - protein, 11 aa, Influenza virus
ACSNGSCRCTI

SEQ ID NO: 388046 - protein, 11 aa, Influenza virus
CSNGSCRCTIC

SEQ ID NO: 388047 - protein, 11 aa, Influenza virus
SNGSCRCTICI

SEQ ID NO: 388048 - protein, 11 aa, Influenza virus
FAYDKICIGYQ

SEQ ID NO: 388049 - protein, 11 aa, Influenza virus
AYDKICIGYQT

SEQ ID NO: 388050 - protein, 11 aa, Influenza virus
YDKICIGYQTN

SEQ ID NO: 388051 - protein, 11 aa, Influenza virus
DKICIGYQTNN

SEQ ID NO: 388052 - protein, 11 aa, Influenza virus
KICIGYQTNNS

SEQ ID NO: 388053 - protein, 11 aa, Influenza virus
ICIGYQTNNST

SEQ ID NO: 388054 - protein, 11 aa, Influenza virus
CIGYQTNNSTE

SEQ ID NO: 388055 - protein, 11 aa, Influenza virus
IGYQTNNSTET

SEQ ID NO: 388056 - protein, 11 aa, Influenza virus
GYQTNNSTETV

SEQ ID NO: 388057 - protein, 11 aa, Influenza virus
YQTNNSTETVN

SEQ ID NO: 388058 - protein, 11 aa, Influenza virus
QTNNSTETVNT

SEQ ID NO: 388059 - protein, 11 aa, Influenza virus
TNNSTETVNTL

SEQ ID NO: 388060 - protein, 11 aa, Influenza virus
NNSTETVNTLI

SEQ ID NO: 388061 - protein, 11 aa, Influenza virus
NSTETVNTLIE

SEQ ID NO: 388062 - protein, 11 aa, Influenza virus
STETVNTLIEQ

SEQ ID NO: 388063 - protein, 11 aa, Influenza virus
TETVNTLIEQN

SEQ ID NO: 388064 - protein, 11 aa, Influenza virus
TVNTLIEQNVP

SEQ ID NO: 388065 - protein, 11 aa, Influenza virus
VNTLIEQNVPV

SEQ ID NO: 388066 - protein, 11 aa, Influenza virus
NTLIEQNVPVT

SEQ ID NO: 388067 - protein, 11 aa, Influenza virus
TLIEQNVPVTQ

SEQ ID NO: 388068 - protein, 11 aa, Influenza virus
LIEQNVPVTQV

SEQ ID NO: 388069 - protein, 11 aa, Influenza virus
IEQNVPVTQVE

SEQ ID NO: 388070 - protein, 11 aa, Influenza virus
EQNVPVTQVEE

SEQ ID NO: 388071 - protein, 11 aa, Influenza virus
QNVPVTQVEEL

SEQ ID NO: 388072 - protein, 11 aa, Influenza virus
NVPVTQVEELV

SEQ ID NO: 388073 - protein, 11 aa, Influenza virus
VPVTQVEELVH

SEQ ID NO: 388074 - protein, 11 aa, Influenza virus
PVTQVEELVHG

SEQ ID NO: 388075 - protein, 11 aa, Influenza virus
VTQVEELVHGG

SEQ ID NO: 388076 - protein, 11 aa, Influenza virus
TQVEELVHGGI

SEQ ID NO: 388077 - protein, 11 aa, Influenza virus
QVEELVHGGID

SEQ ID NO: 388078 - protein, 11 aa, Influenza virus
VEELVHGGIDP

SEQ ID NO: 388079 - protein, 11 aa, Influenza virus
TELGSPLVLDD

SEQ ID NO: 388080 - protein, 11 aa, Influenza virus
ELGSPLVLDDC

SEQ ID NO: 388081 - protein, 11 aa, Influenza virus
LGSPLVLDDCS

SEQ ID NO: 388082 - protein, 11 aa, Influenza virus
GSPLVLDDCSL

SEQ ID NO: 388083 - protein, 11 aa, Influenza virus
SPLVLDDCSLE

SEQ ID NO: 388084 - protein, 11 aa, Influenza virus
PLVLDDCSLEG

SEQ ID NO: 388085 - protein, 11 aa, Influenza virus
LVLDDCSLEGL

SEQ ID NO: 388086 - protein, 11 aa, Influenza virus
VLDDCSLEGLI

SEQ ID NO: 388087 - protein, 11 aa, Influenza virus
LDDCSLEGLIL

SEQ ID NO: 388088 - protein, 11 aa, Influenza virus
DDCSLEGLILG

SEQ ID NO: 388089 - protein, 11 aa, Influenza virus
DCSLEGLILGN

SEQ ID NO: 388090 - protein, 11 aa, Influenza virus
CSLEGLILGNP

SEQ ID NO: 388091 - protein, 11 aa, Influenza virus
SLEGLILGNPK

SEQ ID NO: 388092 - protein, 11 aa, Influenza virus
LEGLILGNPKC

SEQ ID NO: 388093 - protein, 11 aa, Influenza virus
EGLILGNPKCD

SEQ ID NO: 388094 - protein, 11 aa, Influenza virus
GLILGNPKCDL

SEQ ID NO: 388095 - protein, 11 aa, Influenza virus
LILGNPKCDLY

SEQ ID NO: 388096 - protein, 11 aa, Influenza virus
ILGNPKCDLYL

SEQ ID NO: 388097 - protein, 11 aa, Influenza virus
LGNPKCDLYLN

SEQ ID NO: 388098 - protein, 11 aa, Influenza virus
GNPKCDLYLNG

SEQ ID NO: 388099 - protein, 11 aa, Influenza virus
NPKCDLYLNGR

SEQ ID NO: 388100 - protein, 11 aa, Influenza virus
PKCDLYLNGRE

SEQ ID NO: 388101 - protein, 11 aa, Influenza virus
KCDLYLNGREW

SEQ ID NO: 388102 - protein, 11 aa, Influenza virus
CDLYLNGREWS

SEQ ID NO: 388103 - protein, 11 aa, Influenza virus
DLYLNGREWSY

SEQ ID NO: 388104 - protein, 11 aa, Influenza virus
LYLNGREWSYI

SEQ ID NO: 388105 - protein, 11 aa, Influenza virus
YLNGREWSYIV

SEQ ID NO: 388106 - protein, 11 aa, Influenza virus
LNGREWSYIVE

SEQ ID NO: 388107 - protein, 11 aa, Influenza virus
NGREWSYIVER

SEQ ID NO: 388108 - protein, 11 aa, Influenza virus
GREWSYIVERP

SEQ ID NO: 388109 - protein, 11 aa, Influenza virus
REWSYIVERPK

SEQ ID NO: 388110 - protein, 11 aa, Influenza virus
EWSYIVERPKE

SEQ ID NO: 388111 - protein, 11 aa, Influenza virus
WSYIVERPKEM

SEQ ID NO: 388112 - protein, 11 aa, Influenza virus
SYIVERPKEME

SEQ ID NO: 388113 - protein, 11 aa, Influenza virus
YIVERPKEMEG

SEQ ID NO: 388114 - protein, 11 aa, Influenza virus
IVERPKEMEGI

SEQ ID NO: 388115 - protein, 11 aa, Influenza virus
VERPKEMEGIC

SEQ ID NO: 388116 - protein, 11 aa, Influenza virus
ERPKEMEGICY

SEQ ID NO: 388117 - protein, 11 aa, Influenza virus
RPKEMEGICYP

SEQ ID NO: 388118 - protein, 11 aa, Influenza virus
PKEMEGICYPG

SEQ ID NO: 388119 - protein, 11 aa, Influenza virus
KEMEGICYPGS

SEQ ID NO: 388120 - protein, 11 aa, Influenza virus
EMEGICYPGSI

SEQ ID NO: 388121 - protein, 11 aa, Influenza virus
MEGICYPGSIE

SEQ ID NO: 388122 - protein, 11 aa, Influenza virus
EGICYPGSIEN

SEQ ID NO: 388123 - protein, 11 aa, Influenza virus
GICYPGSIENQ

SEQ ID NO: 388124 - protein, 11 aa, Influenza virus
ICYPGSIENQE

SEQ ID NO: 388125 - protein, 11 aa, Influenza virus
CYPGSIENQEE

SEQ ID NO: 388126 - protein, 11 aa, Influenza virus
YPGSIENQEEL

SEQ ID NO: 388127 - protein, 11 aa, Influenza virus
PGSIENQEELR

SEQ ID NO: 388128 - protein, 11 aa, Influenza virus
GSIENQEELRS

SEQ ID NO: 388129 - protein, 11 aa, Influenza virus
SIENQEELRSL

SEQ ID NO: 388130 - protein, 11 aa, Influenza virus
IENQEELRSLF

SEQ ID NO: 388131 - protein, 11 aa, Influenza virus
ENQEELRSLFS

SEQ ID NO: 388132 - protein, 11 aa, Influenza virus
NQEELRSLFSS

SEQ ID NO: 388133 - protein, 11 aa, Influenza virus
QEELRSLFSSI

SEQ ID NO: 388134 - protein, 11 aa, Influenza virus
EELRSLFSSIK

SEQ ID NO: 388135 - protein, 11 aa, Influenza virus
ELRSLFSSIKK

SEQ ID NO: 388136 - protein, 11 aa, Influenza virus
LRSLFSSIKKY

SEQ ID NO: 388137 - protein, 11 aa, Influenza virus
RSLFSSIKKYE

SEQ ID NO: 388138 - protein, 11 aa, Influenza virus
SLFSSIKKYER

SEQ ID NO: 388139 - protein, 11 aa, Influenza virus
LFSSIKKYERV

SEQ ID NO: 388140 - protein, 11 aa, Influenza virus
FSSIKKYERVK

SEQ ID NO: 388141 - protein, 11 aa, Influenza virus
SSIKKYERVKM

SEQ ID NO: 388142 - protein, 11 aa, Influenza virus
SIKKYERVKMF

SEQ ID NO: 388143 - protein, 11 aa, Influenza virus
IKKYERVKMFD

SEQ ID NO: 388144 - protein, 11 aa, Influenza virus
KKYERVKMFDF

SEQ ID NO: 388145 - protein, 11 aa, Influenza virus
KYERVKMFDFT

SEQ ID NO: 388146 - protein, 11 aa, Influenza virus
YERVKMFDFTK

SEQ ID NO: 388147 - protein, 11 aa, Influenza virus
ERVKMFDFTKW

SEQ ID NO: 388148 - protein, 11 aa, Influenza virus
RVKMFDFTKWN

SEQ ID NO: 388149 - protein, 11 aa, Influenza virus
VKMFDFTKWNV

SEQ ID NO: 388150 - protein, 11 aa, Influenza virus
KMFDFTKWNVT

SEQ ID NO: 388151 - protein, 11 aa, Influenza virus
MFDFTKWNVTY

SEQ ID NO: 388152 - protein, 11 aa, Influenza virus
FDFTKWNVTYT

SEQ ID NO: 388153 - protein, 11 aa, Influenza virus
DFTKWNVTYTG

SEQ ID NO: 388154 - protein, 11 aa, Influenza virus
FTKWNVTYTGT

SEQ ID NO: 388155 - protein, 11 aa, Influenza virus
TKWNVTYTGTS

SEQ ID NO: 388156 - protein, 11 aa, Influenza virus
KWNVTYTGTSK

SEQ ID NO: 388157 - protein, 11 aa, Influenza virus
WNVTYTGTSKA

SEQ ID NO: 388158 - protein, 11 aa, Influenza virus
NVTYTGTSKAC

SEQ ID NO: 388159 - protein, 11 aa, Influenza virus
VTYTGTSKACN

SEQ ID NO: 388160 - protein, 11 aa, Influenza virus
SNQGSFYRSMR

SEQ ID NO: 388161 - protein, 11 aa, Influenza virus
NQGSFYRSMRW

SEQ ID NO: 388162 - protein, 11 aa, Influenza virus
QGSFYRSMRWL

SEQ ID NO: 388163 - protein, 11 aa, Influenza virus
GSFYRSMRWLT

SEQ ID NO: 388164 - protein, 11 aa, Influenza virus
SFYRSMRWLTL

SEQ ID NO: 388165 - protein, 11 aa, Influenza virus
FYRSMRWLTLK

SEQ ID NO: 388166 - protein, 11 aa, Influenza virus
YRSMRWLTLKS

SEQ ID NO: 388167 - protein, 11 aa, Influenza virus
MRWLTLKSGQF

SEQ ID NO: 388168 - protein, 11 aa, Influenza virus
RWLTLKSGQFP

SEQ ID NO: 388169 - protein, 11 aa, Influenza virus
WLTLKSGQFPV

SEQ ID NO: 388170 - protein, 11 aa, Influenza virus
LTLKSGQFPVQ

SEQ ID NO: 388171 - protein, 11 aa, Influenza virus
TLKSGQFPVQT

SEQ ID NO: 388172 - protein, 11 aa, Influenza virus
LKSGQFPVQTD

SEQ ID NO: 388173 - protein, 11 aa, Influenza virus
KSGQFPVQTDE

SEQ ID NO: 388174 - protein, 11 aa, Influenza virus
SGQFPVQTDEY

SEQ ID NO: 388175 - protein, 11 aa, Influenza virus
GQFPVQTDEYK

SEQ ID NO: 388176 - protein, 11 aa, Influenza virus
QFPVQTDEYKN

SEQ ID NO: 388177 - protein, 11 aa, Influenza virus
FPVQTDEYKNT

SEQ ID NO: 388178 - protein, 11 aa, Influenza virus
PVQTDEYKNTR

SEQ ID NO: 388179 - protein, 11 aa, Influenza virus
VQTDEYKNTRD

SEQ ID NO: 388180 - protein, 11 aa, Influenza virus
QTDEYKNTRDS

SEQ ID NO: 388181 - protein, 11 aa, Influenza virus
TDEYKNTRDSD

SEQ ID NO: 388182 - protein, 11 aa, Influenza virus
DEYKNTRDSDI

SEQ ID NO: 388183 - protein, 11 aa, Influenza virus
FTWAIHHPPTS

SEQ ID NO: 388184 - protein, 11 aa, Influenza virus
WAIHHPPTSDE

SEQ ID NO: 388185 - protein, 11 aa, Influenza virus
AIHHPPTSDEQ

SEQ ID NO: 388186 - protein, 11 aa, Influenza virus
IHHPPTSDEQV

SEQ ID NO: 388187 - protein, 11 aa, Influenza virus
EINRSFKPNIG

SEQ ID NO: 388188 - protein, 11 aa, Influenza virus
INRSFKPNIGP

SEQ ID NO: 388189 - protein, 11 aa, Influenza virus
NRSFKPNIGPR

SEQ ID NO: 388190 - protein, 11 aa, Influenza virus
RSFKPNIGPRP

SEQ ID NO: 388191 - protein, 11 aa, Influenza virus
SFKPNIGPRPL

SEQ ID NO: 388192 - protein, 11 aa, Influenza virus
FKPNIGPRPLV

SEQ ID NO: 388193 - protein, 11 aa, Influenza virus
KPNIGPRPLVR

SEQ ID NO: 388194 - protein, 11 aa, Influenza virus
PNIGPRPLVRG

SEQ ID NO: 388195 - protein, 11 aa, Influenza virus
NIGPRPLVRGQ

SEQ ID NO: 388196 - protein, 11 aa, Influenza virus
IGPRPLVRGQQ

SEQ ID NO: 388197 - protein, 11 aa, Influenza virus
GPRPLVRGQQG

SEQ ID NO: 388198 - protein, 11 aa, Influenza virus
PRPLVRGQQGR

SEQ ID NO: 388199 - protein, 11 aa, Influenza virus
RPLVRGQQGRM

SEQ ID NO: 388200 - protein, 11 aa, Influenza virus
PLVRGQQGRMD

SEQ ID NO: 388201 - protein, 11 aa, Influenza virus
LVRGQQGRMDY

SEQ ID NO: 388202 - protein, 11 aa, Influenza virus
VRGQQGRMDYY

SEQ ID NO: 388203 - protein, 11 aa, Influenza virus
RGQQGRMDYYW

SEQ ID NO: 388204 - protein, 11 aa, Influenza virus
GQQGRMDYYWA

SEQ ID NO: 388205 - protein, 11 aa, Influenza virus
QQGRMDYYWAV

SEQ ID NO: 388206 - protein, 11 aa, Influenza virus
QGRMDYYWAVL

SEQ ID NO: 388207 - protein, 11 aa, Influenza virus
GRMDYYWAVLK

SEQ ID NO: 388208 - protein, 11 aa, Influenza virus
RMDYYWAVLKP

SEQ ID NO: 388209 - protein, 11 aa, Influenza virus
MDYYWAVLKPG

SEQ ID NO: 388210 - protein, 11 aa, Influenza virus
DYYWAVLKPGQ

SEQ ID NO: 388211 - protein, 11 aa, Influenza virus
YYWAVLKPGQT

SEQ ID NO: 388212 - protein, 11 aa, Influenza virus
YWAVLKPGQTV

SEQ ID NO: 388213 - protein, 11 aa, Influenza virus
WAVLKPGQTVK

SEQ ID NO: 388214 - protein, 11 aa, Influenza virus
AVLKPGQTVKI

SEQ ID NO: 388215 - protein, 11 aa, Influenza virus
VLKPGQTVKIQ

SEQ ID NO: 388216 - protein, 11 aa, Influenza virus
LKPGQTVKIQT

SEQ ID NO: 388217 - protein, 11 aa, Influenza virus
KPGQTVKIQTN

SEQ ID NO: 388218 - protein, 11 aa, Influenza virus
PGQTVKIQTNG

SEQ ID NO: 388219 - protein, 11 aa, Influenza virus
GQTVKIQTNGN

SEQ ID NO: 388220 - protein, 11 aa, Influenza virus
QTVKIQTNGNL

SEQ ID NO: 388221 - protein, 11 aa, Influenza virus
TVKIQTNGNLI

SEQ ID NO: 388222 - protein, 11 aa, Influenza virus
VKIQTNGNLIA

SEQ ID NO: 388223 - protein, 11 aa, Influenza virus
KIQTNGNLIAP

SEQ ID NO: 388224 - protein, 11 aa, Influenza virus
IQTNGNLIAPE

SEQ ID NO: 388225 - protein, 11 aa, Influenza virus
QTNGNLIAPEY

SEQ ID NO: 388226 - protein, 11 aa, Influenza virus
TNGNLIAPEYG

SEQ ID NO: 388227 - protein, 11 aa, Influenza virus
NGNLIAPEYGH

SEQ ID NO: 388228 - protein, 11 aa, Influenza virus
GNLIAPEYGHL

SEQ ID NO: 388229 - protein, 11 aa, Influenza virus
NLIAPEYGHLI

SEQ ID NO: 388230 - protein, 11 aa, Influenza virus
LIAPEYGHLIT

SEQ ID NO: 388231 - protein, 11 aa, Influenza virus
IAPEYGHLITG

SEQ ID NO: 388232 - protein, 11 aa, Influenza virus
APEYGHLITGK

SEQ ID NO: 388233 - protein, 11 aa, Influenza virus
PEYGHLITGKS

SEQ ID NO: 388234 - protein, 11 aa, Influenza virus
EYGHLITGKSH

SEQ ID NO: 388235 - protein, 11 aa, Influenza virus
YGHLITGKSHG

SEQ ID NO: 388236 - protein, 11 aa, Influenza virus
GHLITGKSHGR

SEQ ID NO: 388237 - protein, 11 aa, Influenza virus
HLITGKSHGRI

SEQ ID NO: 388238 - protein, 11 aa, Influenza virus
LITGKSHGRIL

SEQ ID NO: 388239 - protein, 11 aa, Influenza virus
ITGKSHGRILK

SEQ ID NO: 388240 - protein, 11 aa, Influenza virus
TGKSHGRILKN

SEQ ID NO: 388241 - protein, 11 aa, Influenza virus
GKSHGRILKNN

SEQ ID NO: 388242 - protein, 11 aa, Influenza virus
KSHGRILKNNL

SEQ ID NO: 388243 - protein, 11 aa, Influenza virus
SHGRILKNNLP

SEQ ID NO: 388244 - protein, 11 aa, Influenza virus
TECQLNEGVMN

SEQ ID NO: 388245 - protein, 11 aa, Influenza virus
ECQLNEGVMNT

SEQ ID NO: 388246 - protein, 11 aa, Influenza virus
CQLNEGVMNTS

SEQ ID NO: 388247 - protein, 11 aa, Influenza virus
QLNEGVMNTSK

SEQ ID NO: 388248 - protein, 11 aa, Influenza virus
LNEGVMNTSKP

SEQ ID NO: 388249 - protein, 11 aa, Influenza virus
NEGVMNTSKPF

SEQ ID NO: 388250 - protein, 11 aa, Influenza virus
EGVMNTSKPFQ

SEQ ID NO: 388251 - protein, 11 aa, Influenza virus
GVMNTSKPFQN

SEQ ID NO: 388252 - protein, 11 aa, Influenza virus
VMNTSKPFQNT

SEQ ID NO: 388253 - protein, 11 aa, Influenza virus
MNTSKPFQNTS

SEQ ID NO: 388254 - protein, 11 aa, Influenza virus
NTSKPFQNTSK

SEQ ID NO: 388255 - protein, 11 aa, Influenza virus
TSKPFQNTSKH

SEQ ID NO: 388256 - protein, 11 aa, Influenza virus
SKPFQNTSKHY

SEQ ID NO: 388257 - protein, 11 aa, Influenza virus
KPFQNTSKHYI

SEQ ID NO: 388258 - protein, 11 aa, Influenza virus
PFQNTSKHYIG

SEQ ID NO: 388259 - protein, 11 aa, Influenza virus
FQNTSKHYIGK

SEQ ID NO: 388260 - protein, 11 aa, Influenza virus
QNTSKHYIGKC

SEQ ID NO: 388261 - protein, 11 aa, Influenza virus
NTSKHYIGKCP

SEQ ID NO: 388262 - protein, 11 aa, Influenza virus
TSKHYIGKCPK

SEQ ID NO: 388263 - protein, 11 aa, Influenza virus
SKHYIGKCPKY

SEQ ID NO: 388264 - protein, 11 aa, Influenza virus
KHYIGKCPKYI

SEQ ID NO: 388265 - protein, 11 aa, Influenza virus
HYIGKCPKYIP

SEQ ID NO: 388266 - protein, 11 aa, Influenza virus
YIGKCPKYIPS

SEQ ID NO: 388267 - protein, 11 aa, Influenza virus
IGKCPKYIPSG

SEQ ID NO: 388268 - protein, 11 aa, Influenza virus
GKCPKYIPSGS

SEQ ID NO: 388269 - protein, 11 aa, Influenza virus
KCPKYIPSGSL

SEQ ID NO: 388270 - protein, 11 aa, Influenza virus
CPKYIPSGSLK

SEQ ID NO: 388271 - protein, 11 aa, Influenza virus
PKYIPSGSLKL

SEQ ID NO: 388272 - protein, 11 aa, Influenza virus
KYIPSGSLKLA

SEQ ID NO: 388273 - protein, 11 aa, Influenza virus
YIPSGSLKLAI

SEQ ID NO: 388274 - protein, 11 aa, Influenza virus
IPSGSLKLAIG

SEQ ID NO: 388275 - protein, 11 aa, Influenza virus
PSGSLKLAIGL

SEQ ID NO: 388276 - protein, 11 aa, Influenza virus
SGSLKLAIGLR

SEQ ID NO: 388277 - protein, 11 aa, Influenza virus
GSLKLAIGLRN

SEQ ID NO: 388278 - protein, 11 aa, Influenza virus
SLKLAIGLRNV

SEQ ID NO: 388279 - protein, 11 aa, Influenza virus
LKLAIGLRNVP

SEQ ID NO: 388280 - protein, 11 aa, Influenza virus
KLAIGLRNVPQ

SEQ ID NO: 388281 - protein, 11 aa, Influenza virus
LAIGLRNVPQA

SEQ ID NO: 388282 - protein, 11 aa, Influenza virus
AIGLRNVPQAQ

SEQ ID NO: 388283 - protein, 11 aa, Influenza virus
RNVPQAQDRGL

SEQ ID NO: 388284 - protein, 11 aa, Influenza virus
NVPQAQDRGLF

SEQ ID NO: 388285 - protein, 11 aa, Influenza virus
VPQAQDRGLFG

SEQ ID NO: 388286 - protein, 11 aa, Influenza virus
PQAQDRGLFGA

SEQ ID NO: 388287 - protein, 11 aa, Influenza virus
QNRGLFGAIAG

SEQ ID NO: 388288 - protein, 11 aa, Influenza virus
NRGLFGAIAGF

SEQ ID NO: 388289 - protein, 11 aa, Influenza virus
RGLFGAIAGFI

SEQ ID NO: 388290 - protein, 11 aa, Influenza virus
GLFGAIAGFIE

SEQ ID NO: 388291 - protein, 11 aa, Influenza virus
LFGAIAGFIEG

SEQ ID NO: 388292 - protein, 11 aa, Influenza virus
FGAIAGFIEGG

SEQ ID NO: 388293 - protein, 11 aa, Influenza virus
GAIAGFIEGGW

SEQ ID NO: 388294 - protein, 11 aa, Influenza virus
AIAGFIEGGWP

SEQ ID NO: 388295 - protein, 11 aa, Influenza virus
IAGFIEGGWPG

SEQ ID NO: 388296 - protein, 11 aa, Influenza virus
AGFIEGGWPGL

SEQ ID NO: 388297 - protein, 11 aa, Influenza virus
GFIEGGWPGLV

SEQ ID NO: 388298 - protein, 11 aa, Influenza virus
FIEGGWPGLVA

SEQ ID NO: 388299 - protein, 11 aa, Influenza virus
IEGGWPGLVAG

SEQ ID NO: 388300 - protein, 11 aa, Influenza virus
EGGWPGLVAGW

SEQ ID NO: 388301 - protein, 11 aa, Influenza virus
GGWPGLVAGWY

SEQ ID NO: 388302 - protein, 11 aa, Influenza virus
GWPGLVAGWYG

SEQ ID NO: 388303 - protein, 11 aa, Influenza virus
WPGLVAGWYGF

SEQ ID NO: 388304 - protein, 11 aa, Influenza virus
PGLVAGWYGFQ

SEQ ID NO: 388305 - protein, 11 aa, Influenza virus
GLVAGWYGFQH

SEQ ID NO: 388306 - protein, 11 aa, Influenza virus
LVAGWYGFQHQ

SEQ ID NO: 388307 - protein, 11 aa, Influenza virus
VAGWYGFQHQN

SEQ ID NO: 388308 - protein, 11 aa, Influenza virus
AGWYGFQHQNA

SEQ ID NO: 388309 - protein, 11 aa, Influenza virus
GWYGFQHQNAE

SEQ ID NO: 388310 - protein, 11 aa, Influenza virus
WYGFQHQNAEG

SEQ ID NO: 388311 - protein, 11 aa, Influenza virus
YGFQHQNAEGT

SEQ ID NO: 388312 - protein, 11 aa, Influenza virus
GFQHQNAEGTG

SEQ ID NO: 388313 - protein, 11 aa, Influenza virus
FQHQNAEGTGI

SEQ ID NO: 388314 - protein, 11 aa, Influenza virus
QHQNAEGTGIA

SEQ ID NO: 388315 - protein, 11 aa, Influenza virus
HQNAEGTGIAA

SEQ ID NO: 388316 - protein, 11 aa, Influenza virus
QNAEGTGIAAD

SEQ ID NO: 388317 - protein, 11 aa, Influenza virus
NAEGTGIAADR

SEQ ID NO: 388318 - protein, 11 aa, Influenza virus
EGTGIAADRDS

SEQ ID NO: 388319 - protein, 11 aa, Influenza virus
GTGIAADRDST

SEQ ID NO: 388320 - protein, 11 aa, Influenza virus
TGIAADRDSTQ

SEQ ID NO: 388321 - protein, 11 aa, Influenza virus
AADRDSTQKAI

SEQ ID NO: 388322 - protein, 11 aa, Influenza virus
ADRDSTQKAID

SEQ ID NO: 388323 - protein, 11 aa, Influenza virus
DRDSTQKAIDN

SEQ ID NO: 388324 - protein, 11 aa, Influenza virus
RDSTQKAIDNM

SEQ ID NO: 388325 - protein, 11 aa, Influenza virus
DSTQKAIDNMQ

SEQ ID NO: 388326 - protein, 11 aa, Influenza virus
STQKAIDNMQN

SEQ ID NO: 388327 - protein, 11 aa, Influenza virus
TQKAIDNMQNK

SEQ ID NO: 388328 - protein, 11 aa, Influenza virus
QKAIDNMQNKL

SEQ ID NO: 388329 - protein, 11 aa, Influenza virus
KAIDNMQNKLN

SEQ ID NO: 388330 - protein, 11 aa, Influenza virus
AIDNMQNKLNN

SEQ ID NO: 388331 - protein, 11 aa, Influenza virus
IDNMQNKLNNV

SEQ ID NO: 388332 - protein, 11 aa, Influenza virus
DNMQNKLNNVI

SEQ ID NO: 388333 - protein, 11 aa, Influenza virus
NMQNKLNNVID

SEQ ID NO: 388334 - protein, 11 aa, Influenza virus
MQNKLNNVIDK

SEQ ID NO: 388335 - protein, 11 aa, Influenza virus
QNKLNNVIDKM

SEQ ID NO: 388336 - protein, 11 aa, Influenza virus
NKLNNVIDKMN

SEQ ID NO: 388337 - protein, 11 aa, Influenza virus
KLNNVIDKMNK

SEQ ID NO: 388338 - protein, 11 aa, Influenza virus
LNNVIDKMNKQ

SEQ ID NO: 388339 - protein, 11 aa, Influenza virus
NNVIDKMNKQF

SEQ ID NO: 388340 - protein, 11 aa, Influenza virus
RINMINSKIDD

SEQ ID NO: 388341 - protein, 11 aa, Influenza virus
INMINSKIDDQ

SEQ ID NO: 388342 - protein, 11 aa, Influenza virus
IDDQITDIWAY

SEQ ID NO: 388343 - protein, 11 aa, Influenza virus
DDQITDIWAYN

SEQ ID NO: 388344 - protein, 11 aa, Influenza virus
DQITDIWAYNA

SEQ ID NO: 388345 - protein, 11 aa, Influenza virus
QITDIWAYNAE

SEQ ID NO: 388346 - protein, 11 aa, Influenza virus
ITDIWAYNAEL

SEQ ID NO: 388347 - protein, 11 aa, Influenza virus
TDIWAYNAELL

SEQ ID NO: 388348 - protein, 11 aa, Influenza virus
DIWAYNAELLV

SEQ ID NO: 388349 - protein, 11 aa, Influenza virus
IWAYNAELLVL

SEQ ID NO: 388350 - protein, 11 aa, Influenza virus
WAYNAELLVLL

SEQ ID NO: 388351 - protein, 11 aa, Influenza virus
AYNAELLVLLE

SEQ ID NO: 388352 - protein, 11 aa, Influenza virus
YNAELLVLLEN

SEQ ID NO: 388353 - protein, 11 aa, Influenza virus
NAELLVLLENQ

SEQ ID NO: 388354 - protein, 11 aa, Influenza virus
AELLVLLENQK

SEQ ID NO: 388355 - protein, 11 aa, Influenza virus
ELLVLLENQKT

SEQ ID NO: 388356 - protein, 11 aa, Influenza virus
LLVLLENQKTL

SEQ ID NO: 388357 - protein, 11 aa, Influenza virus
LVLLENQKTLD

SEQ ID NO: 388358 - protein, 11 aa, Influenza virus
VLLENQKTLDE

SEQ ID NO: 388359 - protein, 11 aa, Influenza virus
LLENQKTLDEH

SEQ ID NO: 388360 - protein, 11 aa, Influenza virus
LENQKTLDEHD

SEQ ID NO: 388361 - protein, 11 aa, Influenza virus
ENQKTLDEHDA

SEQ ID NO: 388362 - protein, 11 aa, Influenza virus
NQKTLDEHDAN

SEQ ID NO: 388363 - protein, 11 aa, Influenza virus
QKTLDEHDANV

SEQ ID NO: 388364 - protein, 11 aa, Influenza virus
KTLDEHDANVR

SEQ ID NO: 388365 - protein, 11 aa, Influenza virus
TLDEHDANVRN

SEQ ID NO: 388366 - protein, 11 aa, Influenza virus
LDEHDANVRNL

SEQ ID NO: 388367 - protein, 11 aa, Influenza virus
DEHDANVRNLH

SEQ ID NO: 388368 - protein, 11 aa, Influenza virus
EHDANVRNLHD

SEQ ID NO: 388369 - protein, 11 aa, Influenza virus
HDANVRNLHDR

SEQ ID NO: 388370 - protein, 11 aa, Influenza virus
DANVRNLHDRV

SEQ ID NO: 388371 - protein, 11 aa, Influenza virus
ANVRNLHDRVR

SEQ ID NO: 388372 - protein, 11 aa, Influenza virus
NVRNLHDRVRR

SEQ ID NO: 388373 - protein, 11 aa, Influenza virus
ENAIDTGDGCF

SEQ ID NO: 388374 - protein, 11 aa, Influenza virus
NAIDTGDGCFE

SEQ ID NO: 388375 - protein, 11 aa, Influenza virus
AIDTGDGCFEI

SEQ ID NO: 388376 - protein, 11 aa, Influenza virus
IDTGDGCFEIL

SEQ ID NO: 388377 - protein, 11 aa, Influenza virus
DTGDGCFEILH

SEQ ID NO: 388378 - protein, 11 aa, Influenza virus
TGDGCFEILHK

SEQ ID NO: 388379 - protein, 11 aa, Influenza virus
GDGCFEILHKC

SEQ ID NO: 388380 - protein, 11 aa, Influenza virus
DGCFEILHKCD

SEQ ID NO: 388381 - protein, 11 aa, Influenza virus
GCFEILHKCDN

SEQ ID NO: 388382 - protein, 11 aa, Influenza virus
YEEESKIERQK

SEQ ID NO: 388383 - protein, 11 aa, Influenza virus
ERQKINGVKLE

SEQ ID NO: 388384 - protein, 11 aa, Influenza virus
RQKINGVKLEE

SEQ ID NO: 388385 - protein, 11 aa, Influenza virus
QKINGVKLEEN

SEQ ID NO: 388386 - protein, 11 aa, Influenza virus
KINGVKLEENS

SEQ ID NO: 388387 - protein, 11 aa, Influenza virus
INGVKLEENST

SEQ ID NO: 388388 - protein, 11 aa, Influenza virus
NGVKLEENSTY

SEQ ID NO: 388389 - protein, 11 aa, Influenza virus
GVKLEENSTYK

SEQ ID NO: 388390 - protein, 11 aa, Influenza virus
VKLEENSTYKI

SEQ ID NO: 388391 - protein, 11 aa, Influenza virus
KLEENSTYKIL

SEQ ID NO: 388392 - protein, 11 aa, Influenza virus
LEENSTYKILS

SEQ ID NO: 388393 - protein, 11 aa, Influenza virus
EENSTYKILSI

SEQ ID NO: 388394 - protein, 11 aa, Influenza virus
ENSTYKILSIY

SEQ ID NO: 388395 - protein, 11 aa, Influenza virus
NSTYKILSIYS

SEQ ID NO: 388396 - protein, 11 aa, Influenza virus
STYKILSIYSS

SEQ ID NO: 388397 - protein, 11 aa, Influenza virus
TYKILSIYSSV

SEQ ID NO: 388398 - protein, 11 aa, Influenza virus
YKILSIYSSVA

SEQ ID NO: 388399 - protein, 11 aa, Influenza virus
KILSIYSSVAS

SEQ ID NO: 388400 - protein, 11 aa, Influenza virus
ILSIYSSVASS

SEQ ID NO: 388401 - protein, 11 aa, Influenza virus
LSIYSSVASSL

SEQ ID NO: 388402 - protein, 11 aa, Influenza virus
SIYSSVASSLV

SEQ ID NO: 388403 - protein, 11 aa, Influenza virus
IYSSVASSLVL

SEQ ID NO: 388404 - protein, 11 aa, Influenza virus
YSSVASSLVLL

SEQ ID NO: 388405 - protein, 11 aa, Influenza virus
SSVASSLVLLL

SEQ ID NO: 388406 - protein, 11 aa, Influenza virus
SVASSLVLLLM

SEQ ID NO: 388407 - protein, 11 aa, Influenza virus
VASSLVLLLMI

SEQ ID NO: 388408 - protein, 11 aa, Influenza virus
ASSLVLLLMII

SEQ ID NO: 388409 - protein, 11 aa, Influenza virus
SSLVLLLMIIG

SEQ ID NO: 388410 - protein, 11 aa, Influenza virus
SLVLLLMIIGG

SEQ ID NO: 388411 - protein, 11 aa, Influenza virus
LVLLLMIIGGF

SEQ ID NO: 388412 - protein, 11 aa, Influenza virus
VLLLMIIGGFI

SEQ ID NO: 388413 - protein, 11 aa, Influenza virus
LLLMIIGGFIF

SEQ ID NO: 388414 - protein, 11 aa, Influenza virus
LLMIIGGFIFG

SEQ ID NO: 388415 - protein, 11 aa, Influenza virus
LMIIGGFIFGC

SEQ ID NO: 388416 - protein, 11 aa, Influenza virus
MIIGGFIFGCQ

SEQ ID NO: 388417 - protein, 11 aa, Influenza virus
IIGGFIFGCQN

SEQ ID NO: 388418 - protein, 11 aa, Influenza virus
IGGFIFGCQNG

SEQ ID NO: 388419 - protein, 11 aa, Influenza virus
GGFIFGCQNGN

SEQ ID NO: 388420 - protein, 11 aa, Influenza virus
GFIFGCQNGNV

SEQ ID NO: 388421 - protein, 11 aa, Influenza virus
FIFGCQNGNVR

SEQ ID NO: 388422 - protein, 11 aa, Influenza virus
IFGCQNGNVRC

SEQ ID NO: 388423 - protein, 11 aa, Influenza virus
FGCQNGNVRCT

SEQ ID NO: 388424 - protein, 11 aa, Influenza virus
GCQNGNVRCTF

SEQ ID NO: 388425 - protein, 11 aa, Influenza virus
CQNGNVRCTFC

SEQ ID NO: 388426 - protein, 11 aa, Influenza virus
QNGNVRCTFCI

SEQ ID NO: 388427 - protein, 11 aa, Influenza virus
ADRICVGYLST

SEQ ID NO: 388428 - protein, 11 aa, Influenza virus
DRICVGYLSTN

SEQ ID NO: 388429 - protein, 11 aa, Influenza virus
RICVGYLSTNS

SEQ ID NO: 388430 - protein, 11 aa, Influenza virus
ICVGYLSTNSS

SEQ ID NO: 388431 - protein, 11 aa, Influenza virus
CVGYLSTNSSE

SEQ ID NO: 388432 - protein, 11 aa, Influenza virus
VGYLSTNSSER

SEQ ID NO: 388433 - protein, 11 aa, Influenza virus
GYLSTNSSERV

SEQ ID NO: 388434 - protein, 11 aa, Influenza virus
YLSTNSSERVD

SEQ ID NO: 388435 - protein, 11 aa, Influenza virus
LSTNSSERVDT

SEQ ID NO: 388436 - protein, 11 aa, Influenza virus
STNSSERVDTL

SEQ ID NO: 388437 - protein, 11 aa, Influenza virus
TNSSERVDTLL

SEQ ID NO: 388438 - protein, 11 aa, Influenza virus
NSSERVDTLLE

SEQ ID NO: 388439 - protein, 11 aa, Influenza virus
VDTLLENGVPV

SEQ ID NO: 388440 - protein, 11 aa, Influenza virus
DTLLENGVPVT

SEQ ID NO: 388441 - protein, 11 aa, Influenza virus
TLLENGVPVTS

SEQ ID NO: 388442 - protein, 11 aa, Influenza virus
LLENGVPVTSS

SEQ ID NO: 388443 - protein, 11 aa, Influenza virus
VPVTSSVDLVE

SEQ ID NO: 388444 - protein, 11 aa, Influenza virus
PVTSSVDLVET

SEQ ID NO: 388445 - protein, 11 aa, Influenza virus
DLVETNHTGTY

SEQ ID NO: 388446 - protein, 11 aa, Influenza virus
LVETNHTGTYC

SEQ ID NO: 388447 - protein, 11 aa, Influenza virus
VETNHTGTYCS

SEQ ID NO: 388448 - protein, 11 aa, Influenza virus
ETNHTGTYCSL

SEQ ID NO: 388449 - protein, 11 aa, Influenza virus
GISPVHLGDCS

SEQ ID NO: 388450 - protein, 11 aa, Influenza virus
ISPVHLGDCSF

SEQ ID NO: 388451 - protein, 11 aa, Influenza virus
SPVHLGDCSFE

SEQ ID NO: 388452 - protein, 11 aa, Influenza virus
PVHLGDCSFEG

SEQ ID NO: 388453 - protein, 11 aa, Influenza virus
VHLGDCSFEGW

SEQ ID NO: 388454 - protein, 11 aa, Influenza virus
HLGDCSFEGWI

SEQ ID NO: 388455 - protein, 11 aa, Influenza virus
LGDCSFEGWIV

SEQ ID NO: 388456 - protein, 11 aa, Influenza virus
GDCSFEGWIVG

SEQ ID NO: 388457 - protein, 11 aa, Influenza virus
DCSFEGWIVGN

SEQ ID NO: 388458 - protein, 11 aa, Influenza virus
CSFEGWIVGNP

SEQ ID NO: 388459 - protein, 11 aa, Influenza virus
SFEGWIVGNPA

SEQ ID NO: 388460 - protein, 11 aa, Influenza virus
FEGWIVGNPAC

SEQ ID NO: 388461 - protein, 11 aa, Influenza virus
GIREWSYLIED

SEQ ID NO: 388462 - protein, 11 aa, Influenza virus
IREWSYLIEDP

SEQ ID NO: 388463 - protein, 11 aa, Influenza virus
REWSYLIEDPS

SEQ ID NO: 388464 - protein, 11 aa, Influenza virus
EWSYLIEDPSA

SEQ ID NO: 388465 - protein, 11 aa, Influenza virus
WSYLIEDPSAP

SEQ ID NO: 388466 - protein, 11 aa, Influenza virus
SYLIEDPSAPH

SEQ ID NO: 388467 - protein, 11 aa, Influenza virus
YLIEDPSAPHG

SEQ ID NO: 388468 - protein, 11 aa, Influenza virus
LIEDPSAPHGL

SEQ ID NO: 388469 - protein, 11 aa, Influenza virus
IEDPSAPHGLC

SEQ ID NO: 388470 - protein, 11 aa, Influenza virus
EDPSAPHGLCY

SEQ ID NO: 388471 - protein, 11 aa, Influenza virus
DPSAPHGLCYP

SEQ ID NO: 388472 - protein, 11 aa, Influenza virus
PSAPHGLCYPG

SEQ ID NO: 388473 - protein, 11 aa, Influenza virus
SAPHGLCYPGE

SEQ ID NO: 388474 - protein, 11 aa, Influenza virus
APHGLCYPGEL

SEQ ID NO: 388475 - protein, 11 aa, Influenza virus
PHGLCYPGELD

SEQ ID NO: 388476 - protein, 11 aa, Influenza virus
HGLCYPGELDN

SEQ ID NO: 388477 - protein, 11 aa, Influenza virus
GLCYPGELDNN

SEQ ID NO: 388478 - protein, 11 aa, Influenza virus
LCYPGELDNNG

SEQ ID NO: 388479 - protein, 11 aa, Influenza virus
CYPGELDNNGE

SEQ ID NO: 388480 - protein, 11 aa, Influenza virus
YPGELDNNGEL

SEQ ID NO: 388481 - protein, 11 aa, Influenza virus
PGELDNNGELR

SEQ ID NO: 388482 - protein, 11 aa, Influenza virus
GELDNNGELRH

SEQ ID NO: 388483 - protein, 11 aa, Influenza virus
ELDNNGELRHL

SEQ ID NO: 388484 - protein, 11 aa, Influenza virus
LDNNGELRHLF

SEQ ID NO: 388485 - protein, 11 aa, Influenza virus
DNNGELRHLFS

SEQ ID NO: 388486 - protein, 11 aa, Influenza virus
NNGELRHLFSG

SEQ ID NO: 388487 - protein, 11 aa, Influenza virus
NGELRHLFSGI

SEQ ID NO: 388488 - protein, 11 aa, Influenza virus
GELRHLFSGIR

SEQ ID NO: 388489 - protein, 11 aa, Influenza virus
ELRHLFSGIRS

SEQ ID NO: 388490 - protein, 11 aa, Influenza virus
LRHLFSGIRSF

SEQ ID NO: 388491 - protein, 11 aa, Influenza virus
RHLFSGIRSFS

SEQ ID NO: 388492 - protein, 11 aa, Influenza virus
HLFSGIRSFSR

SEQ ID NO: 388493 - protein, 11 aa, Influenza virus
LFSGIRSFSRT

SEQ ID NO: 388494 - protein, 11 aa, Influenza virus
FSGIRSFSRTE

SEQ ID NO: 388495 - protein, 11 aa, Influenza virus
SGIRSFSRTEL

SEQ ID NO: 388496 - protein, 11 aa, Influenza virus
GIRSFSRTELI

SEQ ID NO: 388497 - protein, 11 aa, Influenza virus
IRSFSRTELIP

SEQ ID NO: 388498 - protein, 11 aa, Influenza virus
RSFSRTELIAP

SEQ ID NO: 388499 - protein, 11 aa, Influenza virus
GGYPVIKKTYN

SEQ ID NO: 388500 - protein, 11 aa, Influenza virus
KTYNNTTGRDV

SEQ ID NO: 388501 - protein, 11 aa, Influenza virus
TYNNTTGRDVL

SEQ ID NO: 388502 - protein, 11 aa, Influenza virus
YNNTTGRDVLV

SEQ ID NO: 388503 - protein, 11 aa, Influenza virus
NNTTGRDVLVL

SEQ ID NO: 388504 - protein, 11 aa, Influenza virus
NTTGRDVLVLW

SEQ ID NO: 388505 - protein, 11 aa, Influenza virus
TTGRDVLVLWG

SEQ ID NO: 388506 - protein, 11 aa, Influenza virus
TGRDVLVLWGI

SEQ ID NO: 388507 - protein, 11 aa, Influenza virus
GRDVLVLWGIH

SEQ ID NO: 388508 - protein, 11 aa, Influenza virus
RDVLVLWGIHH

SEQ ID NO: 388509 - protein, 11 aa, Influenza virus
DVLVLWGIHHP

SEQ ID NO: 388510 - protein, 11 aa, Influenza virus
PYTLVSTSSWS

SEQ ID NO: 388511 - protein, 11 aa, Influenza virus
GVRPGYNGQRS

SEQ ID NO: 388512 - protein, 11 aa, Influenza virus
VRPGYNGQRSW

SEQ ID NO: 388513 - protein, 11 aa, Influenza virus
RPGYNGQRSWM

SEQ ID NO: 388514 - protein, 11 aa, Influenza virus
PGYNGQRSWMK

SEQ ID NO: 388515 - protein, 11 aa, Influenza virus
GYNGQRSWMKI

SEQ ID NO: 388516 - protein, 11 aa, Influenza virus
YNGQRSWMKIY

SEQ ID NO: 388517 - protein, 11 aa, Influenza virus
NGQRSWMKIYW

SEQ ID NO: 388518 - protein, 11 aa, Influenza virus
ISFESNGGLLA

SEQ ID NO: 388519 - protein, 11 aa, Influenza virus
SFESNGGLLAP

SEQ ID NO: 388520 - protein, 11 aa, Influenza virus
FESNGGLLAPR

SEQ ID NO: 388521 - protein, 11 aa, Influenza virus
ESNGGLLAPRY

SEQ ID NO: 388522 - protein, 11 aa, Influenza virus
SNGGLLAPRYG

SEQ ID NO: 388523 - protein, 11 aa, Influenza virus
NGGLLAPRYGY

SEQ ID NO: 388524 - protein, 11 aa, Influenza virus
GGLLAPRYGYI

SEQ ID NO: 388525 - protein, 11 aa, Influenza virus
GLLAPRYGYII

SEQ ID NO: 388526 - protein, 11 aa, Influenza virus
LLAPRYGYIIE

SEQ ID NO: 388527 - protein, 11 aa, Influenza virus
LAPRYGYIIEE

SEQ ID NO: 388528 - protein, 11 aa, Influenza virus
APRYGYIIEEY

SEQ ID NO: 388529 - protein, 11 aa, Influenza virus
PRYGYIIEEYG

SEQ ID NO: 388530 - protein, 11 aa, Influenza virus
RYGYIIEEYGK

SEQ ID NO: 388531 - protein, 11 aa, Influenza virus
YGYIIEEYGKG

SEQ ID NO: 388532 - protein, 11 aa, Influenza virus
GYIIEEYGKGR

SEQ ID NO: 388533 - protein, 11 aa, Influenza virus
YIIEEYGKGRI

SEQ ID NO: 388534 - protein, 11 aa, Influenza virus
IIEEYGKGRIF

SEQ ID NO: 388535 - protein, 11 aa, Influenza virus
IEEYGKGRIFQ

SEQ ID NO: 388536 - protein, 11 aa, Influenza virus
EEYGKGRIFQS

SEQ ID NO: 388537 - protein, 11 aa, Influenza virus
EYGKGRIFQSR

SEQ ID NO: 388538 - protein, 11 aa, Influenza virus
YGKGRIFQSRI

SEQ ID NO: 388539 - protein, 11 aa, Influenza virus
GKGRIFQSRIR

SEQ ID NO: 388540 - protein, 11 aa, Influenza virus
KCNTKCQTSVG

SEQ ID NO: 388541 - protein, 11 aa, Influenza virus
CNTKCQTSVGG

SEQ ID NO: 388542 - protein, 11 aa, Influenza virus
NTKCQTSVGGI

SEQ ID NO: 388543 - protein, 11 aa, Influenza virus
TKCQTSVGGIN

SEQ ID NO: 388544 - protein, 11 aa, Influenza virus
KCQTSVGGINT

SEQ ID NO: 388545 - protein, 11 aa, Influenza virus
CQTSVGGINTN

SEQ ID NO: 388546 - protein, 11 aa, Influenza virus
QTSVGGINTNK

SEQ ID NO: 388547 - protein, 11 aa, Influenza virus
TSVGGINTNKT

SEQ ID NO: 388548 - protein, 11 aa, Influenza virus
SVGGINTNKTF

SEQ ID NO: 388549 - protein, 11 aa, Influenza virus
VGGINTNKTFQ

SEQ ID NO: 388550 - protein, 11 aa, Influenza virus
GGINTNKTFQN

SEQ ID NO: 388551 - protein, 11 aa, Influenza virus
GINTNKTFQNI

SEQ ID NO: 388552 - protein, 11 aa, Influenza virus
INTNKTFQNIE

SEQ ID NO: 388553 - protein, 11 aa, Influenza virus
NTNKTFQNIER

SEQ ID NO: 388554 - protein, 11 aa, Influenza virus
TNKTFQNIERN

SEQ ID NO: 388555 - protein, 11 aa, Influenza virus
NKTFQNIERNA

SEQ ID NO: 388556 - protein, 11 aa, Influenza virus
KTFQNIERNAL

SEQ ID NO: 388557 - protein, 11 aa, Influenza virus
TFQNIERNALG

SEQ ID NO: 388558 - protein, 11 aa, Influenza virus
FQNIERNALGD

SEQ ID NO: 388559 - protein, 11 aa, Influenza virus
QNIERNALGDC

SEQ ID NO: 388560 - protein, 11 aa, Influenza virus
NIERNALGDCP

SEQ ID NO: 388561 - protein, 11 aa, Influenza virus
IERNALGDCPK

SEQ ID NO: 388562 - protein, 11 aa, Influenza virus
ERNALGDCPKY

SEQ ID NO: 388563 - protein, 11 aa, Influenza virus
RNALGDCPKYI

SEQ ID NO: 388564 - protein, 11 aa, Influenza virus
NALGDCPKYIK

SEQ ID NO: 388565 - protein, 11 aa, Influenza virus
ALGDCPKYIKS

SEQ ID NO: 388566 - protein, 11 aa, Influenza virus
LGDCPKYIKSG

SEQ ID NO: 388567 - protein, 11 aa, Influenza virus
GDCPKYIKSGQ

SEQ ID NO: 388568 - protein, 11 aa, Influenza virus
DCPKYIKSGQL

SEQ ID NO: 388569 - protein, 11 aa, Influenza virus
CPKYIKSGQLK

SEQ ID NO: 388570 - protein, 11 aa, Influenza virus
PKYIKSGQLKL

SEQ ID NO: 388571 - protein, 11 aa, Influenza virus
KYIKSGQLKLA

SEQ ID NO: 388572 - protein, 11 aa, Influenza virus
YIKSGQLKLAT

SEQ ID NO: 388573 - protein, 11 aa, Influenza virus
IKSGQLKLATG

SEQ ID NO: 388574 - protein, 11 aa, Influenza virus
KSGQLKLATGL

SEQ ID NO: 388575 - protein, 11 aa, Influenza virus
SGQLKLATGLR

SEQ ID NO: 388576 - protein, 11 aa, Influenza virus
GQLKLATGLRN

SEQ ID NO: 388577 - protein, 11 aa, Influenza virus
QLKLATGLRNV

SEQ ID NO: 388578 - protein, 11 aa, Influenza virus
LKLATGLRNVP

SEQ ID NO: 388579 - protein, 11 aa, Influenza virus
KLATGLRNVPA

SEQ ID NO: 388580 - protein, 11 aa, Influenza virus
RGLFGAIAGFI

SEQ ID NO: 388581 - protein, 11 aa, Influenza virus
GLFGAIAGFIE

SEQ ID NO: 388582 - protein, 11 aa, Influenza virus
LFGAIAGFIEG

SEQ ID NO: 388583 - protein, 11 aa, Influenza virus
FGAIAGFIEGG

SEQ ID NO: 388584 - protein, 11 aa, Influenza virus
GAIAGFIEGGW

SEQ ID NO: 388585 - protein, 11 aa, Influenza virus
AIAGFIEGGWP

SEQ ID NO: 388586 - protein, 11 aa, Influenza virus
IAGFIEGGWPG

SEQ ID NO: 388587 - protein, 11 aa, Influenza virus
AGFIEGGWPGL

SEQ ID NO: 388588 - protein, 11 aa, Influenza virus
GFIEGGWPGLI

SEQ ID NO: 388589 - protein, 11 aa, Influenza virus
FIEGGWPGLIN

SEQ ID NO: 388590 - protein, 11 aa, Influenza virus
IEGGWPGLING

SEQ ID NO: 388591 - protein, 11 aa, Influenza virus
EGGWPGLINGW

SEQ ID NO: 388592 - protein, 11 aa, Influenza virus
GGWPGLINGWY

SEQ ID NO: 388593 - protein, 11 aa, Influenza virus
GWPGLINGWYG

SEQ ID NO: 388594 - protein, 11 aa, Influenza virus
WPGLINGWYGF

SEQ ID NO: 388595 - protein, 11 aa, Influenza virus
PGLINGWYGFQ

SEQ ID NO: 388596 - protein, 11 aa, Influenza virus
GLINGWYGFQH

SEQ ID NO: 388597 - protein, 11 aa, Influenza virus
LINGWYGFQHQ

SEQ ID NO: 388598 - protein, 11 aa, Influenza virus
INGWYGFQHQN

SEQ ID NO: 388599 - protein, 11 aa, Influenza virus
NGWYGFQHQNE

SEQ ID NO: 388600 - protein, 11 aa, Influenza virus
GWYGFQHQNEQ

SEQ ID NO: 388601 - protein, 11 aa, Influenza virus
WYGFQHQNEQG

SEQ ID NO: 388602 - protein, 11 aa, Influenza virus
YGFQHQNEQGV

SEQ ID NO: 388603 - protein, 11 aa, Influenza virus
GFQHQNEQGVG

SEQ ID NO: 388604 - protein, 11 aa, Influenza virus
FQHQNEQGTGI

SEQ ID NO: 388605 - protein, 11 aa, Influenza virus
QHQNEQGTGIA

SEQ ID NO: 388606 - protein, 11 aa, Influenza virus
HQNEQGTGIAA

SEQ ID NO: 388607 - protein, 11 aa, Influenza virus
QNEQGTGIAAD

SEQ ID NO: 388608 - protein, 11 aa, Influenza virus
NEQGTGIAADK

SEQ ID NO: 388609 - protein, 11 aa, Influenza virus
EQGTGIAADKE

SEQ ID NO: 388610 - protein, 11 aa, Influenza virus
QGTGIAADKES

SEQ ID NO: 388611 - protein, 11 aa, Influenza virus
GTGIAADKEST

SEQ ID NO: 388612 - protein, 11 aa, Influenza virus
TGIAADKESTQ

SEQ ID NO: 388613 - protein, 11 aa, Influenza virus
GIAADKESTQK

SEQ ID NO: 388614 - protein, 11 aa, Influenza virus
IAADKESTQKA

SEQ ID NO: 388615 - protein, 11 aa, Influenza virus
AADKESTQKAI

SEQ ID NO: 388616 - protein, 11 aa, Influenza virus
ADKESTQKAID

SEQ ID NO: 388617 - protein, 11 aa, Influenza virus
DKESTQKAIDQ

SEQ ID NO: 388618 - protein, 11 aa, Influenza virus
KESTQKAIDQI

SEQ ID NO: 388619 - protein, 11 aa, Influenza virus
ESTQKAIDQIT

SEQ ID NO: 388620 - protein, 11 aa, Influenza virus
STQKAIDQITT

SEQ ID NO: 388621 - protein, 11 aa, Influenza virus
TQKAIDQITTK

SEQ ID NO: 388622 - protein, 11 aa, Influenza virus
QKAIDQITTKI

SEQ ID NO: 388623 - protein, 11 aa, Influenza virus
KAIDQITTKIN

SEQ ID NO: 388624 - protein, 11 aa, Influenza virus
AIDQITTKINN

SEQ ID NO: 388625 - protein, 11 aa, Influenza virus
IDQITTKINNI

SEQ ID NO: 388626 - protein, 11 aa, Influenza virus
DQITTKINNII

SEQ ID NO: 388627 - protein, 11 aa, Influenza virus
QITTKINNIID

SEQ ID NO: 388628 - protein, 11 aa, Influenza virus
ITTKINNIIDK

SEQ ID NO: 388629 - protein, 11 aa, Influenza virus
TTKINNIIDKM

SEQ ID NO: 388630 - protein, 11 aa, Influenza virus
TKINNIIDKMN

SEQ ID NO: 388631 - protein, 11 aa, Influenza virus
KINNIIDKMNG

SEQ ID NO: 388632 - protein, 11 aa, Influenza virus
INNIIDKMNGN

SEQ ID NO: 388633 - protein, 11 aa, Influenza virus
NNIIDKMNGNY

SEQ ID NO: 388634 - protein, 11 aa, Influenza virus
NIIDKMNGNYD

SEQ ID NO: 388635 - protein, 11 aa, Influenza virus
IIDKMNGNYDS

SEQ ID NO: 388636 - protein, 11 aa, Influenza virus
IDKMNGNYDSI

SEQ ID NO: 388637 - protein, 11 aa, Influenza virus
DKMNGNYDSIR

SEQ ID NO: 388638 - protein, 11 aa, Influenza virus
KMNGNYDSIRG

SEQ ID NO: 388639 - protein, 11 aa, Influenza virus
MNGNYDSIRGE

SEQ ID NO: 388640 - protein, 11 aa, Influenza virus
NGNYDSIRGEF

SEQ ID NO: 388641 - protein, 11 aa, Influenza virus
GNYDSIRGEFN

SEQ ID NO: 388642 - protein, 11 aa, Influenza virus
NYDSIRGEFNQ

SEQ ID NO: 388643 - protein, 11 aa, Influenza virus
YDSIRGEFNQV

SEQ ID NO: 388644 - protein, 11 aa, Influenza virus
DSIRGEFNQVE

SEQ ID NO: 388645 - protein, 11 aa, Influenza virus
SIRGEFNQVEK

SEQ ID NO: 388646 - protein, 11 aa, Influenza virus
IRGEFNQVEKR

SEQ ID NO: 388647 - protein, 11 aa, Influenza virus
RGEFNQVEKRI

SEQ ID NO: 388648 - protein, 11 aa, Influenza virus
GEFNQVEKRIN

SEQ ID NO: 388649 - protein, 11 aa, Influenza virus
EFNQVEKRINM

SEQ ID NO: 388650 - protein, 11 aa, Influenza virus
FNQVEKRINML

SEQ ID NO: 388651 - protein, 11 aa, Influenza virus
NQVEKRINMLA

SEQ ID NO: 388652 - protein, 11 aa, Influenza virus
QVEQRINMLAD

SEQ ID NO: 388653 - protein, 11 aa, Influenza virus
VEQRINMLADR

SEQ ID NO: 388654 - protein, 11 aa, Influenza virus
EQRINMLADRI

SEQ ID NO: 388655 - protein, 11 aa, Influenza virus
QRINMLADRID

SEQ ID NO: 388656 - protein, 11 aa, Influenza virus
RINMLADRIDD

SEQ ID NO: 388657 - protein, 11 aa, Influenza virus
INMLADRIDDA

SEQ ID NO: 388658 - protein, 11 aa, Influenza virus
NMLADRIDDAV

SEQ ID NO: 388659 - protein, 11 aa, Influenza virus
MLADRIDDAVT

SEQ ID NO: 388660 - protein, 11 aa, Influenza virus
LADRIDDAVTD

SEQ ID NO: 388661 - protein, 11 aa, Influenza virus
ADRIDDAVTDV

SEQ ID NO: 388662 - protein, 11 aa, Influenza virus
DRIDDAVTDVW

SEQ ID NO: 388663 - protein, 11 aa, Influenza virus
RIDDAVTDVWS

SEQ ID NO: 388664 - protein, 11 aa, Influenza virus
IDDAVTDVWSY

SEQ ID NO: 388665 - protein, 11 aa, Influenza virus
DDAVTDVWSYN

SEQ ID NO: 388666 - protein, 11 aa, Influenza virus
DAVTDVWSYNA

SEQ ID NO: 388667 - protein, 11 aa, Influenza virus
AVTDVWSYNAK

SEQ ID NO: 388668 - protein, 11 aa, Influenza virus
VTDVWSYNAKL

SEQ ID NO: 388669 - protein, 11 aa, Influenza virus
TDVWSYNAKLL

SEQ ID NO: 388670 - protein, 11 aa, Influenza virus
DVWSYNAKLLV

SEQ ID NO: 388671 - protein, 11 aa, Influenza virus
VWSYNAKLLVL

SEQ ID NO: 388672 - protein, 11 aa, Influenza virus
WSYNAKLLVLL

SEQ ID NO: 388673 - protein, 11 aa, Influenza virus
SYNAKLLVLLE

SEQ ID NO: 388674 - protein, 11 aa, Influenza virus
YNAKLLVLLEN

SEQ ID NO: 388675 - protein, 11 aa, Influenza virus
NAKLLVLLEND

SEQ ID NO: 388676 - protein, 11 aa, Influenza virus
AKLLVLLENDK

SEQ ID NO: 388677 - protein, 11 aa, Influenza virus
KLLVLLENDKT

SEQ ID NO: 388678 - protein, 11 aa, Influenza virus
LLVLLENDKTL

SEQ ID NO: 388679 - protein, 11 aa, Influenza virus
LVLLENDKTLD

SEQ ID NO: 388680 - protein, 11 aa, Influenza virus
VLLENDKTLDM

SEQ ID NO: 388681 - protein, 11 aa, Influenza virus
LLENDKTLDMH

SEQ ID NO: 388682 - protein, 11 aa, Influenza virus
LENDKTLDMHD

SEQ ID NO: 388683 - protein, 11 aa, Influenza virus
ENDKTLDMHDA

SEQ ID NO: 388684 - protein, 11 aa, Influenza virus
NDKTLDMHDAN

SEQ ID NO: 388685 - protein, 11 aa, Influenza virus
DKTLDMHDANV

SEQ ID NO: 388686 - protein, 11 aa, Influenza virus
KTLDMHDANVR

SEQ ID NO: 388687 - protein, 11 aa, Influenza virus
TLDMHDANVRN

SEQ ID NO: 388688 - protein, 11 aa, Influenza virus
LDMHDANVRNL

SEQ ID NO: 388689 - protein, 11 aa, Influenza virus
DMHDANVRNLH

SEQ ID NO: 388690 - protein, 11 aa, Influenza virus
MHDANVRNLHD

SEQ ID NO: 388691 - protein, 11 aa, Influenza virus
HDANVRNLHDQ

SEQ ID NO: 388692 - protein, 11 aa, Influenza virus
DANVRNLHDQV

SEQ ID NO: 388693 - protein, 11 aa, Influenza virus
ANVRNLHDQVR

SEQ ID NO: 388694 - protein, 11 aa, Influenza virus
NAIDEGNGCFE

SEQ ID NO: 388695 - protein, 11 aa, Influenza virus
AIDEGNGCFEL

SEQ ID NO: 388696 - protein, 11 aa, Influenza virus
IDEGNGCFELL

SEQ ID NO: 388697 - protein, 11 aa, Influenza virus
DEGNGCFELLH

SEQ ID NO: 388698 - protein, 11 aa, Influenza virus
EGNGCFELLHK

SEQ ID NO: 388699 - protein, 11 aa, Influenza virus
GNGCFELLHKC

SEQ ID NO: 388700 - protein, 11 aa, Influenza virus
NGCFELLHKCN

SEQ ID NO: 388701 - protein, 11 aa, Influenza virus
GCFELLHKCND

SEQ ID NO: 388702 - protein, 11 aa, Influenza virus
CFELLHKCNDS

SEQ ID NO: 388703 - protein, 11 aa, Influenza virus
FELLHKCNDSC

SEQ ID NO: 388704 - protein, 11 aa, Influenza virus
ELLHKCNDSCM

SEQ ID NO: 388705 - protein, 11 aa, Influenza virus
LLHKCNDSCME

SEQ ID NO: 388706 - protein, 11 aa, Influenza virus
LHKCNDSCMET

SEQ ID NO: 388707 - protein, 11 aa, Influenza virus
HKCNDSCMETI

SEQ ID NO: 388708 - protein, 11 aa, Influenza virus
KCNDSCMETIR

SEQ ID NO: 388709 - protein, 11 aa, Influenza virus
CNDSCMETIRN

SEQ ID NO: 388710 - protein, 11 aa, Influenza virus
NDSCMETIRNG

SEQ ID NO: 388711 - protein, 11 aa, Influenza virus
DSCMETIRNGT

SEQ ID NO: 388712 - protein, 11 aa, Influenza virus
SCMETIRNGTY

SEQ ID NO: 388713 - protein, 11 aa, Influenza virus
CMETIRNGTYN

SEQ ID NO: 388714 - protein, 11 aa, Influenza virus
METIRNGTYNH

SEQ ID NO: 388715 - protein, 11 aa, Influenza virus
EYAEESKLKRQ

SEQ ID NO: 388716 - protein, 11 aa, Influenza virus
YAEESKLKRQE

SEQ ID NO: 388717 - protein, 11 aa, Influenza virus
AEESKLKRQEI

SEQ ID NO: 388718 - protein, 11 aa, Influenza virus
EESKLKRQEIE

SEQ ID NO: 388719 - protein, 11 aa, Influenza virus
ESKLKRQEIEG

SEQ ID NO: 388720 - protein, 11 aa, Influenza virus
SKLKRQEIEGI

SEQ ID NO: 388721 - protein, 11 aa, Influenza virus
KLKRQEIEGIK

SEQ ID NO: 388722 - protein, 11 aa, Influenza virus
LKRQEIEGIKL

SEQ ID NO: 388723 - protein, 11 aa, Influenza virus
KRQEIEGIKLK

SEQ ID NO: 388724 - protein, 11 aa, Influenza virus
RQEIEGIKLKS

SEQ ID NO: 388725 - protein, 11 aa, Influenza virus
SEDNVYKALSI

SEQ ID NO: 388726 - protein, 11 aa, Influenza virus
EDNVYKALSIY

SEQ ID NO: 388727 - protein, 11 aa, Influenza virus
DNVYKALSIYS

SEQ ID NO: 388728 - protein, 11 aa, Influenza virus
NVYKALSIYSC

SEQ ID NO: 388729 - protein, 11 aa, Influenza virus
VYKALSIYSCI

SEQ ID NO: 388730 - protein, 11 aa, Influenza virus
YKALSIYSCIA

SEQ ID NO: 388731 - protein, 11 aa, Influenza virus
KALSIYSCIAS

SEQ ID NO: 388732 - protein, 11 aa, Influenza virus
ALSIYSCIASS

SEQ ID NO: 388733 - protein, 11 aa, Influenza virus
LSIYSCIASSV

SEQ ID NO: 388734 - protein, 11 aa, Influenza virus
SIYSCIASSVV

SEQ ID NO: 388735 - protein, 11 aa, Influenza virus
IYSCIASSVVL

SEQ ID NO: 388736 - protein, 11 aa, Influenza virus
YSCIASSVVLV

SEQ ID NO: 388737 - protein, 11 aa, Influenza virus
SCIASSVVLVG

SEQ ID NO: 388738 - protein, 11 aa, Influenza virus
CIASSVVLVGL

SEQ ID NO: 388739 - protein, 11 aa, Influenza virus
IASSVVLVGLI

SEQ ID NO: 388740 - protein, 11 aa, Influenza virus
ASSVVLVGLIL

SEQ ID NO: 388741 - protein, 11 aa, Influenza virus
VLVGLILAFIM

SEQ ID NO: 388742 - protein, 11 aa, Influenza virus
LVGLILAFIMW

SEQ ID NO: 388743 - protein, 11 aa, Influenza virus
VGLILAFIMWA

SEQ ID NO: 388744 - protein, 11 aa, Influenza virus
GLILAFIMWAC

SEQ ID NO: 388745 - protein, 11 aa, Influenza virus
FIMWACSSGNC

SEQ ID NO: 388746 - protein, 11 aa, Influenza virus
IMWACSSGNCR

SEQ ID NO: 388747 - protein, 11 aa, Influenza virus
MWACSSGNCRF

SEQ ID NO: 388748 - protein, 11 aa, Influenza virus
MIALILVALAL

SEQ ID NO: 388749 - protein, 11 aa, Influenza virus
IALILVALALS

SEQ ID NO: 388750 - protein, 11 aa, Influenza virus
ALILVALALSH

SEQ ID NO: 388751 - protein, 11 aa, Influenza virus
LILVALALSHT

SEQ ID NO: 388752 - protein, 11 aa, Influenza virus
ILVALALSHTA

SEQ ID NO: 388753 - protein, 11 aa, Influenza virus
LVALALSHTAY

SEQ ID NO: 388754 - protein, 11 aa, Influenza virus
VALALSHTAYS

SEQ ID NO: 388755 - protein, 11 aa, Influenza virus
ALALSHTAYSQ

SEQ ID NO: 388756 - protein, 11 aa, Influenza virus
LALSHTAYSQI

SEQ ID NO: 388757 - protein, 11 aa, Influenza virus
ALSHTAYSQIT

SEQ ID NO: 388758 - protein, 11 aa, Influenza virus
LSHTAYSQITN

SEQ ID NO: 388759 - protein, 11 aa, Influenza virus
SHTAYSQITNG

SEQ ID NO: 388760 - protein, 11 aa, Influenza virus
HTAYSQITNGT

SEQ ID NO: 388761 - protein, 11 aa, Influenza virus
TAYSQITNGTT

SEQ ID NO: 388762 - protein, 11 aa, Influenza virus
AYSQITNGTTG

SEQ ID NO: 388763 - protein, 11 aa, Influenza virus
YSQITNGTTGN

SEQ ID NO: 388764 - protein, 11 aa, Influenza virus
SQITNGTTGNP

SEQ ID NO: 388765 - protein, 11 aa, Influenza virus
QITNGTTGNPI

SEQ ID NO: 388766 - protein, 11 aa, Influenza virus
ITNGTTGNPII

SEQ ID NO: 388767 - protein, 11 aa, Influenza virus
TNGTTGNPIIC

SEQ ID NO: 388768 - protein, 11 aa, Influenza virus
NGTTGNPIICL

SEQ ID NO: 388769 - protein, 11 aa, Influenza virus
GTTGNPIICLG

SEQ ID NO: 388770 - protein, 11 aa, Influenza virus
TTGNPIICLGH

SEQ ID NO: 388771 - protein, 11 aa, Influenza virus
TGNPIICLGHH

SEQ ID NO: 388772 - protein, 11 aa, Influenza virus
GNPIICLGHHA

SEQ ID NO: 388773 - protein, 11 aa, Influenza virus
NPIICLGHHAV

SEQ ID NO: 388774 - protein, 11 aa, Influenza virus
PIICLGHHAVE

SEQ ID NO: 388775 - protein, 11 aa, Influenza virus
IICLGHHAVEN

SEQ ID NO: 388776 - protein, 11 aa, Influenza virus
ICLGHHAVENG

SEQ ID NO: 388777 - protein, 11 aa, Influenza virus
CLGHHAVENGT

SEQ ID NO: 388778 - protein, 11 aa, Influenza virus
LGHHAVENGTS

SEQ ID NO: 388779 - protein, 11 aa, Influenza virus
GHHAVENGTSV

SEQ ID NO: 388780 - protein, 11 aa, Influenza virus
HHAVENGTSVK

SEQ ID NO: 388781 - protein, 11 aa, Influenza virus
HAVENGTSVKT

SEQ ID NO: 388782 - protein, 11 aa, Influenza virus
AVENGTSVKTL

SEQ ID NO: 388783 - protein, 11 aa, Influenza virus
VENGTSVKTLT

SEQ ID NO: 388784 - protein, 11 aa, Influenza virus
ENGTSVKTLTD

SEQ ID NO: 388785 - protein, 11 aa, Influenza virus
NGTSVKTLTDN

SEQ ID NO: 388786 - protein, 11 aa, Influenza virus
GTSVKTLTDNH

SEQ ID NO: 388787 - protein, 11 aa, Influenza virus
TSVKTLTDNHV

SEQ ID NO: 388788 - protein, 11 aa, Influenza virus
SVKTLTDNHVE

SEQ ID NO: 388789 - protein, 11 aa, Influenza virus
VKTLTDNHVEV

SEQ ID NO: 388790 - protein, 11 aa, Influenza virus
KTLTDNHVEVV

SEQ ID NO: 388791 - protein, 11 aa, Influenza virus
TLTDNHVEVVS

SEQ ID NO: 388792 - protein, 11 aa, Influenza virus
LTDNHVEVVSA

SEQ ID NO: 388793 - protein, 11 aa, Influenza virus
TDNHVEVVSAK

SEQ ID NO: 388794 - protein, 11 aa, Influenza virus
DNHVEVVSAKE

SEQ ID NO: 388795 - protein, 11 aa, Influenza virus
NHVEVVSAKEL

SEQ ID NO: 388796 - protein, 11 aa, Influenza virus
HVEVVSAKELV

SEQ ID NO: 388797 - protein, 11 aa, Influenza virus
VEVVSAKELVE

SEQ ID NO: 388798 - protein, 11 aa, Influenza virus
EVVSAKELVET

SEQ ID NO: 388799 - protein, 11 aa, Influenza virus
VVSAKELVETN

SEQ ID NO: 388800 - protein, 11 aa, Influenza virus
VSAKELVETNH

SEQ ID NO: 388801 - protein, 11 aa, Influenza virus
SAKELVETNHT

SEQ ID NO: 388802 - protein, 11 aa, Influenza virus
AKELVETNHTD

SEQ ID NO: 388803 - protein, 11 aa, Influenza virus
KELVETNHTDE

SEQ ID NO: 388804 - protein, 11 aa, Influenza virus
ELVETNHTDEL

SEQ ID NO: 388805 - protein, 11 aa, Influenza virus
LVETNHTDELC

SEQ ID NO: 388806 - protein, 11 aa, Influenza virus
VETNHTDELCP

SEQ ID NO: 388807 - protein, 11 aa, Influenza virus
ETNHTDELCPS

SEQ ID NO: 388808 - protein, 11 aa, Influenza virus
TNHTDELCPSP

SEQ ID NO: 388809 - protein, 11 aa, Influenza virus
NHTDELCPSPL

SEQ ID NO: 388810 - protein, 11 aa, Influenza virus
HTDELCPSPLK

SEQ ID NO: 388811 - protein, 11 aa, Influenza virus
TDELCPSPLKL

SEQ ID NO: 388812 - protein, 11 aa, Influenza virus
DELCPSPLKLV

SEQ ID NO: 388813 - protein, 11 aa, Influenza virus
ELCPSPLKLVD

SEQ ID NO: 388814 - protein, 11 aa, Influenza virus
LCPSPLKLVDG

SEQ ID NO: 388815 - protein, 11 aa, Influenza virus
CPSPLKLVDGQ

SEQ ID NO: 388816 - protein, 11 aa, Influenza virus
PSPLKLVDGQD

SEQ ID NO: 388817 - protein, 11 aa, Influenza virus
SPLKLVDGQDC

SEQ ID NO: 388818 - protein, 11 aa, Influenza virus
PLKLVDGQDCD

SEQ ID NO: 388819 - protein, 11 aa, Influenza virus
LKLVDGQDCDL

SEQ ID NO: 388820 - protein, 11 aa, Influenza virus
KLVDGQDCDLI

SEQ ID NO: 388821 - protein, 11 aa, Influenza virus
LVDGQDCDLIN

SEQ ID NO: 388822 - protein, 11 aa, Influenza virus
VDGQDCDLING

SEQ ID NO: 388823 - protein, 11 aa, Influenza virus
DGQDCDLINGA

SEQ ID NO: 388824 - protein, 11 aa, Influenza virus
GQDCDLINGAL

SEQ ID NO: 388825 - protein, 11 aa, Influenza virus
QDCDLINGALG

SEQ ID NO: 388826 - protein, 11 aa, Influenza virus
DCDLINGALGS

SEQ ID NO: 388827 - protein, 11 aa, Influenza virus
CDLINGALGSP

SEQ ID NO: 388828 - protein, 11 aa, Influenza virus
DLINGALGSPG

SEQ ID NO: 388829 - protein, 11 aa, Influenza virus
LINGALGSPGC

SEQ ID NO: 388830 - protein, 11 aa, Influenza virus
INGALGSPGCD

SEQ ID NO: 388831 - protein, 11 aa, Influenza virus
NGALGSPGCDR

SEQ ID NO: 388832 - protein, 11 aa, Influenza virus
GALGSPGCDRL

SEQ ID NO: 388833 - protein, 11 aa, Influenza virus
ALGSPGCDRLQ

SEQ ID NO: 388834 - protein, 11 aa, Influenza virus
LGSPGCDRLQD

SEQ ID NO: 388835 - protein, 11 aa, Influenza virus
GSPGCDRLQDT

SEQ ID NO: 388836 - protein, 11 aa, Influenza virus
SPGCDRLQDTT

SEQ ID NO: 388837 - protein, 11 aa, Influenza virus
PGCDRLQDTTW

SEQ ID NO: 388838 - protein, 11 aa, Influenza virus
GCDRLQDTTWD

SEQ ID NO: 388839 - protein, 11 aa, Influenza virus
CDRLQDTTWDV

SEQ ID NO: 388840 - protein, 11 aa, Influenza virus
DRLQDTTWDVF

SEQ ID NO: 388841 - protein, 11 aa, Influenza virus
RLQDTTWDVFI

SEQ ID NO: 388842 - protein, 11 aa, Influenza virus
LQDTTWDVFIE

SEQ ID NO: 388843 - protein, 11 aa, Influenza virus
QDTTWDVFIER

SEQ ID NO: 388844 - protein, 11 aa, Influenza virus
DTTWDVFIERP

SEQ ID NO: 388845 - protein, 11 aa, Influenza virus
TTWDVFIERPT

SEQ ID NO: 388846 - protein, 11 aa, Influenza virus
TWDVFIERPTA

SEQ ID NO: 388847 - protein, 11 aa, Influenza virus
WDVFIERPTAV

SEQ ID NO: 388848 - protein, 11 aa, Influenza virus
DVFIERPTAVD

SEQ ID NO: 388849 - protein, 11 aa, Influenza virus
VFIERPTAVDT

SEQ ID NO: 388850 - protein, 11 aa, Influenza virus
FIERPTAVDTC

SEQ ID NO: 388851 - protein, 11 aa, Influenza virus
IERPTAVDTCY

SEQ ID NO: 388852 - protein, 11 aa, Influenza virus
ERPTAVDTCYP

SEQ ID NO: 388853 - protein, 11 aa, Influenza virus
RPTAVDTCYPF

SEQ ID NO: 388854 - protein, 11 aa, Influenza virus
PTAVDTCYPFD

SEQ ID NO: 388855 - protein, 11 aa, Influenza virus
TAVDTCYPFDV

SEQ ID NO: 388856 - protein, 11 aa, Influenza virus
AVDTCYPFDVP

SEQ ID NO: 388857 - protein, 11 aa, Influenza virus
VDTCYPFDVPD

SEQ ID NO: 388858 - protein, 11 aa, Influenza virus
DTCYPFDVPDY

SEQ ID NO: 388859 - protein, 11 aa, Influenza virus
TCYPFDVPDYQ

SEQ ID NO: 388860 - protein, 11 aa, Influenza virus
CYPFDVPDYQS

SEQ ID NO: 388861 - protein, 11 aa, Influenza virus
YPFDVPDYQSL

SEQ ID NO: 388862 - protein, 11 aa, Influenza virus
PFDVPDYQSLR

SEQ ID NO: 388863 - protein, 11 aa, Influenza virus
FDVPDYQSLRS

SEQ ID NO: 388864 - protein, 11 aa, Influenza virus
DVPDYQSLRSI

SEQ ID NO: 388865 - protein, 11 aa, Influenza virus
VPDYQSLRSIL

SEQ ID NO: 388866 - protein, 11 aa, Influenza virus
PDYQSLRSILA

SEQ ID NO: 388867 - protein, 11 aa, Influenza virus
DYQSLRSILAS

SEQ ID NO: 388868 - protein, 11 aa, Influenza virus
YQSLRSILASS

SEQ ID NO: 388869 - protein, 11 aa, Influenza virus
QSLRSILASSG

SEQ ID NO: 388870 - protein, 11 aa, Influenza virus
SLRSILASSGS

SEQ ID NO: 388871 - protein, 11 aa, Influenza virus
LRSILASSGSL

SEQ ID NO: 388872 - protein, 11 aa, Influenza virus
RSILASSGSLE

SEQ ID NO: 388873 - protein, 11 aa, Influenza virus
SILASSGSLEF

SEQ ID NO: 388874 - protein, 11 aa, Influenza virus
ILASSGSLEFI

SEQ ID NO: 388875 - protein, 11 aa, Influenza virus
LASSGSLEFIA

SEQ ID NO: 388876 - protein, 11 aa, Influenza virus
ASSGSLEFIAE

SEQ ID NO: 388877 - protein, 11 aa, Influenza virus
SSGSLEFIAEQ

SEQ ID NO: 388878 - protein, 11 aa, Influenza virus
SGSLEFIAEQF

SEQ ID NO: 388879 - protein, 11 aa, Influenza virus
GSLEFIAEQFT

SEQ ID NO: 388880 - protein, 11 aa, Influenza virus
SLEFIAEQFTW

SEQ ID NO: 388881 - protein, 11 aa, Influenza virus
LEFIAEQFTWN

SEQ ID NO: 388882 - protein, 11 aa, Influenza virus
EFIAEQFTWNG

SEQ ID NO: 388883 - protein, 11 aa, Influenza virus
FIAEQFTWNGV

SEQ ID NO: 388884 - protein, 11 aa, Influenza virus
IAEQFTWNGVK

SEQ ID NO: 388885 - protein, 11 aa, Influenza virus
AEQFTWNGVKV

SEQ ID NO: 388886 - protein, 11 aa, Influenza virus
EQFTWNGVKVD

SEQ ID NO: 388887 - protein, 11 aa, Influenza virus
QFTWNGVKVDG

SEQ ID NO: 388888 - protein, 11 aa, Influenza virus
FTWNGVKVDGS

SEQ ID NO: 388889 - protein, 11 aa, Influenza virus
TWNGVKVDGSS

SEQ ID NO: 388890 - protein, 11 aa, Influenza virus
WNGVKVDGSSS

SEQ ID NO: 388891 - protein, 11 aa, Influenza virus
NGVKVDGSSSA

SEQ ID NO: 388892 - protein, 11 aa, Influenza virus
GVKVDGSSSAC

SEQ ID NO: 388893 - protein, 11 aa, Influenza virus
VKVDGSSSACL

SEQ ID NO: 388894 - protein, 11 aa, Influenza virus
KVDGSSSACLR

SEQ ID NO: 388895 - protein, 11 aa, Influenza virus
VDGSSSACLRG

SEQ ID NO: 388896 - protein, 11 aa, Influenza virus
DGSSSACLRGG

SEQ ID NO: 388897 - protein, 11 aa, Influenza virus
GSSSACLRGGR

SEQ ID NO: 388898 - protein, 11 aa, Influenza virus
SSSACLRGGRN

SEQ ID NO: 388899 - protein, 11 aa, Influenza virus
SSACLRGGRNS

SEQ ID NO: 388900 - protein, 11 aa, Influenza virus
SACLRGGRNSF

SEQ ID NO: 388901 - protein, 11 aa, Influenza virus
ACLRGGRNSFF

SEQ ID NO: 388902 - protein, 11 aa, Influenza virus
CLRGGRNSFFS

SEQ ID NO: 388903 - protein, 11 aa, Influenza virus
LRGGRNSFFSR

SEQ ID NO: 388904 - protein, 11 aa, Influenza virus
RGGRNSFFSRL

SEQ ID NO: 388905 - protein, 11 aa, Influenza virus
GGRNSFFSRLN

SEQ ID NO: 388906 - protein, 11 aa, Influenza virus
GRNSFFSRLNW

SEQ ID NO: 388907 - protein, 11 aa, Influenza virus
RNSFFSRLNWL

SEQ ID NO: 388908 - protein, 11 aa, Influenza virus
NSFFSRLNWLT

SEQ ID NO: 388909 - protein, 11 aa, Influenza virus
SFFSRLNWLTK

SEQ ID NO: 388910 - protein, 11 aa, Influenza virus
FFSRLNWLTKA

SEQ ID NO: 388911 - protein, 11 aa, Influenza virus
FSRLNWLTKAT

SEQ ID NO: 388912 - protein, 11 aa, Influenza virus
SRLNWLTKATN

SEQ ID NO: 388913 - protein, 11 aa, Influenza virus
RLNWLTKATNG

SEQ ID NO: 388914 - protein, 11 aa, Influenza virus
LNWLTKATNGN

SEQ ID NO: 388915 - protein, 11 aa, Influenza virus
NWLTKATNGNY

SEQ ID NO: 388916 - protein, 11 aa, Influenza virus
WLTKATNGNYG

SEQ ID NO: 388917 - protein, 11 aa, Influenza virus
LTKATNGNYGP

SEQ ID NO: 388918 - protein, 11 aa, Influenza virus
TKATNGNYGPI

SEQ ID NO: 388919 - protein, 11 aa, Influenza virus
KATNGNYGPIN

SEQ ID NO: 388920 - protein, 11 aa, Influenza virus
ATNGNYGPINV

SEQ ID NO: 388921 - protein, 11 aa, Influenza virus
TNGNYGPINVT

SEQ ID NO: 388922 - protein, 11 aa, Influenza virus
NGNYGPINVTK

SEQ ID NO: 388923 - protein, 11 aa, Influenza virus
GNYGPINVTKE

SEQ ID NO: 388924 - protein, 11 aa, Influenza virus
NYGPINVTKEN

SEQ ID NO: 388925 - protein, 11 aa, Influenza virus
YGPINVTKENT

SEQ ID NO: 388926 - protein, 11 aa, Influenza virus
GPINVTKENTG

SEQ ID NO: 388927 - protein, 11 aa, Influenza virus
PINVTKENTGS

SEQ ID NO: 388928 - protein, 11 aa, Influenza virus
INVTKENTGSY

SEQ ID NO: 388929 - protein, 11 aa, Influenza virus
NVTKENTGSYV

SEQ ID NO: 388930 - protein, 11 aa, Influenza virus
VTKENTGSYVR

SEQ ID NO: 388931 - protein, 11 aa, Influenza virus
TKENTGSYVRL

SEQ ID NO: 388932 - protein, 11 aa, Influenza virus
KENTGSYVRLY

SEQ ID NO: 388933 - protein, 11 aa, Influenza virus
ENTGSYVRLYL

SEQ ID NO: 388934 - protein, 11 aa, Influenza virus
NTGSYVRLYLW

SEQ ID NO: 388935 - protein, 11 aa, Influenza virus
TGSYVRLYLWG

SEQ ID NO: 388936 - protein, 11 aa, Influenza virus
GSYVRLYLWGV

SEQ ID NO: 388937 - protein, 11 aa, Influenza virus
SYVRLYLWGVH

SEQ ID NO: 388938 - protein, 11 aa, Influenza virus
YVRLYLWGVHH

SEQ ID NO: 388939 - protein, 11 aa, Influenza virus
VRLYLWGVHHP

SEQ ID NO: 388940 - protein, 11 aa, Influenza virus
RLYLWGVHHPS

SEQ ID NO: 388941 - protein, 11 aa, Influenza virus
LYLWGVHHPSS

SEQ ID NO: 388942 - protein, 11 aa, Influenza virus
YLWGVHHPSSD

SEQ ID NO: 388943 - protein, 11 aa, Influenza virus
LWGVHHPSSDN

SEQ ID NO: 388944 - protein, 11 aa, Influenza virus
WGVHHPSSDNE

SEQ ID NO: 388945 - protein, 11 aa, Influenza virus
GVHHPSSDNEQ

SEQ ID NO: 388946 - protein, 11 aa, Influenza virus
VHHPSSDNEQT

SEQ ID NO: 388947 - protein, 11 aa, Influenza virus
HHPSSDNEQTD

SEQ ID NO: 388948 - protein, 11 aa, Influenza virus
HPSSDNEQTDL

SEQ ID NO: 388949 - protein, 11 aa, Influenza virus
PSSDNEQTDLY

SEQ ID NO: 388950 - protein, 11 aa, Influenza virus
SSDNEQTDLYK

SEQ ID NO: 388951 - protein, 11 aa, Influenza virus
SDNEQTDLYKV

SEQ ID NO: 388952 - protein, 11 aa, Influenza virus
DNEQTDLYKVA

SEQ ID NO: 388953 - protein, 11 aa, Influenza virus
NEQTDLYKVAT

SEQ ID NO: 388954 - protein, 11 aa, Influenza virus
EQTDLYKVATG

SEQ ID NO: 388955 - protein, 11 aa, Influenza virus
QTDLYKVATGR

SEQ ID NO: 388956 - protein, 11 aa, Influenza virus
TDLYKVATGRV

SEQ ID NO: 388957 - protein, 11 aa, Influenza virus
DLYKVATGRVT

SEQ ID NO: 388958 - protein, 11 aa, Influenza virus
LYKVATGRVTV

SEQ ID NO: 388959 - protein, 11 aa, Influenza virus
YKVATGRVTVS

SEQ ID NO: 388960 - protein, 11 aa, Influenza virus
KVATGRVTVST

SEQ ID NO: 388961 - protein, 11 aa, Influenza virus
VATGRVTVSTR

SEQ ID NO: 388962 - protein, 11 aa, Influenza virus
ATGRVTVSTRS

SEQ ID NO: 388963 - protein, 11 aa, Influenza virus
TGRVTVSTRSD

SEQ ID NO: 388964 - protein, 11 aa, Influenza virus
GRVTVSTRSDQ

SEQ ID NO: 388965 - protein, 11 aa, Influenza virus
RVTVSTRSDQI

SEQ ID NO: 388966 - protein, 11 aa, Influenza virus
VTVSTRSDQIS

SEQ ID NO: 388967 - protein, 11 aa, Influenza virus
TVSTRSDQISI

SEQ ID NO: 388968 - protein, 11 aa, Influenza virus
VSTRSDQISIV

SEQ ID NO: 388969 - protein, 11 aa, Influenza virus
STRSDQISIVP

SEQ ID NO: 388970 - protein, 11 aa, Influenza virus
TRSDQISIVPN

SEQ ID NO: 388971 - protein, 11 aa, Influenza virus
RSDQISIVPNI

SEQ ID NO: 388972 - protein, 11 aa, Influenza virus
SDQISIVPNIG

SEQ ID NO: 388973 - protein, 11 aa, Influenza virus
DQISIVPNIGS

SEQ ID NO: 388974 - protein, 11 aa, Influenza virus
QISIVPNIGSR

SEQ ID NO: 388975 - protein, 11 aa, Influenza virus
ISIVPNIGSRP

SEQ ID NO: 388976 - protein, 11 aa, Influenza virus
SIVPNIGSRPR

SEQ ID NO: 388977 - protein, 11 aa, Influenza virus
IVPNIGSRPRV

SEQ ID NO: 388978 - protein, 11 aa, Influenza virus
VPNIGSRPRVR

SEQ ID NO: 388979 - protein, 11 aa, Influenza virus
PNIGSRPRVRN

SEQ ID NO: 388980 - protein, 11 aa, Influenza virus
NIGSRPRVRNQ

SEQ ID NO: 388981 - protein, 11 aa, Influenza virus
IGSRPRVRNQS

SEQ ID NO: 388982 - protein, 11 aa, Influenza virus
GSRPRVRNQSG

SEQ ID NO: 388983 - protein, 11 aa, Influenza virus
SRPRVRNQSGR

SEQ ID NO: 388984 - protein, 11 aa, Influenza virus
RPRVRNQSGRI

SEQ ID NO: 388985 - protein, 11 aa, Influenza virus
PRVRNQSGRIS

SEQ ID NO: 388986 - protein, 11 aa, Influenza virus
RVRNQSGRISI

SEQ ID NO: 388987 - protein, 11 aa, Influenza virus
VRNQSGRISIY

SEQ ID NO: 388988 - protein, 11 aa, Influenza virus
RNQSGRISIYW

SEQ ID NO: 388989 - protein, 11 aa, Influenza virus
NQSGRISIYWT

SEQ ID NO: 388990 - protein, 11 aa, Influenza virus
QSGRISIYWTL

SEQ ID NO: 388991 - protein, 11 aa, Influenza virus
SGRISIYWTLV

SEQ ID NO: 388992 - protein, 11 aa, Influenza virus
GRISIYWTLVN

SEQ ID NO: 388993 - protein, 11 aa, Influenza virus
RISIYWTLVNP

SEQ ID NO: 388994 - protein, 11 aa, Influenza virus
ISIYWTLVNPG

SEQ ID NO: 388995 - protein, 11 aa, Influenza virus
SIYWTLVNPGD

SEQ ID NO: 388996 - protein, 11 aa, Influenza virus
IYWTLVNPGDS

SEQ ID NO: 388997 - protein, 11 aa, Influenza virus
YWTLVNPGDSI

SEQ ID NO: 388998 - protein, 11 aa, Influenza virus
WTLVNPGDSII

SEQ ID NO: 388999 - protein, 11 aa, Influenza virus
TLVNPGDSIIF

SEQ ID NO: 389000 - protein, 11 aa, Influenza virus
LVNPGDSIIFN

SEQ ID NO: 389001 - protein, 11 aa, Influenza virus
VNPGDSIIFNS

SEQ ID NO: 389002 - protein, 11 aa, Influenza virus
NPGDSIIFNSI

SEQ ID NO: 389003 - protein, 11 aa, Influenza virus
PGDSIIFNSIG

SEQ ID NO: 389004 - protein, 11 aa, Influenza virus
GDSIIFNSIGN

SEQ ID NO: 389005 - protein, 11 aa, Influenza virus
DSIIFNSIGNL

SEQ ID NO: 389006 - protein, 11 aa, Influenza virus
SIIFNSIGNLI

SEQ ID NO: 389007 - protein, 11 aa, Influenza virus
IIFNSIGNLIA

SEQ ID NO: 389008 - protein, 11 aa, Influenza virus
IFNSIGNLIAP

SEQ ID NO: 389009 - protein, 11 aa, Influenza virus
FNSIGNLIAPR

SEQ ID NO: 389010 - protein, 11 aa, Influenza virus
NSIGNLIAPRG

SEQ ID NO: 389011 - protein, 11 aa, Influenza virus
SIGNLIAPRGH

SEQ ID NO: 389012 - protein, 11 aa, Influenza virus
IGNLIAPRGHY

SEQ ID NO: 389013 - protein, 11 aa, Influenza virus
GNLIAPRGHYK

SEQ ID NO: 389014 - protein, 11 aa, Influenza virus
NLIAPRGHYKI

SEQ ID NO: 389015 - protein, 11 aa, Influenza virus
LIAPRGHYKIS

SEQ ID NO: 389016 - protein, 11 aa, Influenza virus
IAPRGHYKISK

SEQ ID NO: 389017 - protein, 11 aa, Influenza virus
APRGHYKISKS

SEQ ID NO: 389018 - protein, 11 aa, Influenza virus
PRGHYKISKST

SEQ ID NO: 389019 - protein, 11 aa, Influenza virus
RGHYKISKSTK

SEQ ID NO: 389020 - protein, 11 aa, Influenza virus
GHYKISKSTKS

SEQ ID NO: 389021 - protein, 11 aa, Influenza virus
HYKISKSTKST

SEQ ID NO: 389022 - protein, 11 aa, Influenza virus
YKISKSTKSTV

SEQ ID NO: 389023 - protein, 11 aa, Influenza virus
KISKSTKSTVL

SEQ ID NO: 389024 - protein, 11 aa, Influenza virus
ISKSTKSTVLK

SEQ ID NO: 389025 - protein, 11 aa, Influenza virus
SKSTKSTVLKS

SEQ ID NO: 389026 - protein, 11 aa, Influenza virus
KSTKSTVLKSD

SEQ ID NO: 389027 - protein, 11 aa, Influenza virus
STKSTVLKSDK

SEQ ID NO: 389028 - protein, 11 aa, Influenza virus
TKSTVLKSDKR

SEQ ID NO: 389029 - protein, 11 aa, Influenza virus
KSTVLKSDKRI

SEQ ID NO: 389030 - protein, 11 aa, Influenza virus
STVLKSDKRIG

SEQ ID NO: 389031 - protein, 11 aa, Influenza virus
TVLKSDKRIGS

SEQ ID NO: 389032 - protein, 11 aa, Influenza virus
VLKSDKRIGSC

SEQ ID NO: 389033 - protein, 11 aa, Influenza virus
LKSDKRIGSCT

SEQ ID NO: 389034 - protein, 11 aa, Influenza virus
KSDKRIGSCTS

SEQ ID NO: 389035 - protein, 11 aa, Influenza virus
SDKRIGSCTSP

SEQ ID NO: 389036 - protein, 11 aa, Influenza virus
DKRIGSCTSPC

SEQ ID NO: 389037 - protein, 11 aa, Influenza virus
KRIGSCTSPCL

SEQ ID NO: 389038 - protein, 11 aa, Influenza virus
RIGSCTSPCLT

SEQ ID NO: 389039 - protein, 11 aa, Influenza virus
IGSCTSPCLTD

SEQ ID NO: 389040 - protein, 11 aa, Influenza virus
GSCTSPCLTDK

SEQ ID NO: 389041 - protein, 11 aa, Influenza virus
SCTSPCLTDKG

SEQ ID NO: 389042 - protein, 11 aa, Influenza virus
CTSPCLTDKGS

SEQ ID NO: 389043 - protein, 11 aa, Influenza virus
TSPCLTDKGSI

SEQ ID NO: 389044 - protein, 11 aa, Influenza virus
SPCLTDKGSIQ

SEQ ID NO: 389045 - protein, 11 aa, Influenza virus
PCLTDKGSIQS

SEQ ID NO: 389046 - protein, 11 aa, Influenza virus
CLTDKGSIQSD

SEQ ID NO: 389047 - protein, 11 aa, Influenza virus
LTDKGSIQSDK

SEQ ID NO: 389048 - protein, 11 aa, Influenza virus
TDKGSIQSDKP

SEQ ID NO: 389049 - protein, 11 aa, Influenza virus
DKGSIQSDKPF

SEQ ID NO: 389050 - protein, 11 aa, Influenza virus
KGSIQSDKPFQ

SEQ ID NO: 389051 - protein, 11 aa, Influenza virus
GSIQSDKPFQN

SEQ ID NO: 389052 - protein, 11 aa, Influenza virus
SIQSDKPFQNV

SEQ ID NO: 389053 - protein, 11 aa, Influenza virus
IQSDKPFQNVS

SEQ ID NO: 389054 - protein, 11 aa, Influenza virus
QSDKPFQNVSR

SEQ ID NO: 389055 - protein, 11 aa, Influenza virus
SDKPFQNVSRI

SEQ ID NO: 389056 - protein, 11 aa, Influenza virus
DKPFQNVSRIA

SEQ ID NO: 389057 - protein, 11 aa, Influenza virus
KPFQNVSRIAI

SEQ ID NO: 389058 - protein, 11 aa, Influenza virus
PFQNVSRIAIG

SEQ ID NO: 389059 - protein, 11 aa, Influenza virus
FQNVSRIAIGN

SEQ ID NO: 389060 - protein, 11 aa, Influenza virus
QNVSRIAIGNC

SEQ ID NO: 389061 - protein, 11 aa, Influenza virus
NVSRIAIGNCP

SEQ ID NO: 389062 - protein, 11 aa, Influenza virus
VSRIAIGNCPK

SEQ ID NO: 389063 - protein, 11 aa, Influenza virus
SRIAIGNCPKY

SEQ ID NO: 389064 - protein, 11 aa, Influenza virus
RIAIGNCPKYV

SEQ ID NO: 389065 - protein, 11 aa, Influenza virus
IAIGNCPKYVK

SEQ ID NO: 389066 - protein, 11 aa, Influenza virus
AIGNCPKYVKQ

SEQ ID NO: 389067 - protein, 11 aa, Influenza virus
IGNCPKYVKQG

SEQ ID NO: 389068 - protein, 11 aa, Influenza virus
GNCPKYVKQGS

SEQ ID NO: 389069 - protein, 11 aa, Influenza virus
NCPKYVKQGSL

SEQ ID NO: 389070 - protein, 11 aa, Influenza virus
CPKYVKQGSLM

SEQ ID NO: 389071 - protein, 11 aa, Influenza virus
PKYVKQGSLML

SEQ ID NO: 389072 - protein, 11 aa, Influenza virus
KYVKQGSLMLA

SEQ ID NO: 389073 - protein, 11 aa, Influenza virus
YVKQGSLMLAT

SEQ ID NO: 389074 - protein, 11 aa, Influenza virus
VKQGSLMLATG

SEQ ID NO: 389075 - protein, 11 aa, Influenza virus
KQGSLMLATGM

SEQ ID NO: 389076 - protein, 11 aa, Influenza virus
QGSLMLATGMR

SEQ ID NO: 389077 - protein, 11 aa, Influenza virus
GSLMLATGMRN

SEQ ID NO: 389078 - protein, 11 aa, Influenza virus
SLMLATGMRNI

SEQ ID NO: 389079 - protein, 11 aa, Influenza virus
LMLATGMRNIP

SEQ ID NO: 389080 - protein, 11 aa, Influenza virus
MLATGMRNIPG

SEQ ID NO: 389081 - protein, 11 aa, Influenza virus
LATGMRNIPGK

SEQ ID NO: 389082 - protein, 11 aa, Influenza virus
ATGMRNIPGKQ

SEQ ID NO: 389083 - protein, 11 aa, Influenza virus
TGMRNIPGKQA

SEQ ID NO: 389084 - protein, 11 aa, Influenza virus
GMRNIPGKQAK

SEQ ID NO: 389085 - protein, 11 aa, Influenza virus
MRNIPGKQAKG

SEQ ID NO: 389086 - protein, 11 aa, Influenza virus
RNIPGKQAKGL

SEQ ID NO: 389087 - protein, 11 aa, Influenza virus
NIPGKQAKGLF

SEQ ID NO: 389088 - protein, 11 aa, Influenza virus
IPGKQAKGLFG

SEQ ID NO: 389089 - protein, 11 aa, Influenza virus
PGKQAKGLFGA

SEQ ID NO: 389090 - protein, 11 aa, Influenza virus
GKQAKGLFGAI

SEQ ID NO: 389091 - protein, 11 aa, Influenza virus
KQAKGLFGAIA

SEQ ID NO: 389092 - protein, 11 aa, Influenza virus
QAKGLFGAIAG

SEQ ID NO: 389093 - protein, 11 aa, Influenza virus
AKGLFGAIAGF

SEQ ID NO: 389094 - protein, 11 aa, Influenza virus
KGLFGAIAGFI

SEQ ID NO: 389095 - protein, 11 aa, Influenza virus
GLFGAIAGFIE

SEQ ID NO: 389096 - protein, 11 aa, Influenza virus
LFGAIAGFIEN

SEQ ID NO: 389097 - protein, 11 aa, Influenza virus
FGAIAGFIENG

SEQ ID NO: 389098 - protein, 11 aa, Influenza virus
GAIAGFIENGW

SEQ ID NO: 389099 - protein, 11 aa, Influenza virus
AIAGFIENGWQ

SEQ ID NO: 389100 - protein, 11 aa, Influenza virus
IAGFIENGWQG

SEQ ID NO: 389101 - protein, 11 aa, Influenza virus
AGFIENGWQGL

SEQ ID NO: 389102 - protein, 11 aa, Influenza virus
GFIENGWQGLI

SEQ ID NO: 389103 - protein, 11 aa, Influenza virus
FIENGWQGLID

SEQ ID NO: 389104 - protein, 11 aa, Influenza virus
IENGWQGLIDG

SEQ ID NO: 389105 - protein, 11 aa, Influenza virus
ENGWQGLIDGW

SEQ ID NO: 389106 - protein, 11 aa, Influenza virus
NGWQGLIDGWY

SEQ ID NO: 389107 - protein, 11 aa, Influenza virus
GWQGLIDGWYG

SEQ ID NO: 389108 - protein, 11 aa, Influenza virus
WQGLIDGWYGF

SEQ ID NO: 389109 - protein, 11 aa, Influenza virus
QGLIDGWYGFR

SEQ ID NO: 389110 - protein, 11 aa, Influenza virus
GLIDGWYGFRH

SEQ ID NO: 389111 - protein, 11 aa, Influenza virus
LIDGWYGFRHQ

SEQ ID NO: 389112 - protein, 11 aa, Influenza virus
IDGWYGFRHQN

SEQ ID NO: 389113 - protein, 11 aa, Influenza virus
DGWYGFRHQNA

SEQ ID NO: 389114 - protein, 11 aa, Influenza virus
GWYGFRHQNAE

SEQ ID NO: 389115 - protein, 11 aa, Influenza virus
WYGFRHQNAEG

SEQ ID NO: 389116 - protein, 11 aa, Influenza virus
YGFRHQNAEGT

SEQ ID NO: 389117 - protein, 11 aa, Influenza virus
GFRHQNAEGTG

SEQ ID NO: 389118 - protein, 11 aa, Influenza virus
FRHQNAEGTGT

SEQ ID NO: 389119 - protein, 11 aa, Influenza virus
RHQNAEGTGTA

SEQ ID NO: 389120 - protein, 11 aa, Influenza virus
HQNAEGTGTAA

SEQ ID NO: 389121 - protein, 11 aa, Influenza virus
QNAEGTGTAAD

SEQ ID NO: 389122 - protein, 11 aa, Influenza virus
NAEGTGTAADL

SEQ ID NO: 389123 - protein, 11 aa, Influenza virus
AEGTGTAADLK

SEQ ID NO: 389124 - protein, 11 aa, Influenza virus
EGTGTAADLKS

SEQ ID NO: 389125 - protein, 11 aa, Influenza virus
GTGTAADLKST

SEQ ID NO: 389126 - protein, 11 aa, Influenza virus
TGTAADLKSTQ

SEQ ID NO: 389127 - protein, 11 aa, Influenza virus
GTAADLKSTQA

SEQ ID NO: 389128 - protein, 11 aa, Influenza virus
TAADLKSTQAA

SEQ ID NO: 389129 - protein, 11 aa, Influenza virus
AADLKSTQAAI

SEQ ID NO: 389130 - protein, 11 aa, Influenza virus
ADLKSTQAAID

SEQ ID NO: 389131 - protein, 11 aa, Influenza virus
DLKSTQAAIDQ

SEQ ID NO: 389132 - protein, 11 aa, Influenza virus
LKSTQAAIDQI

SEQ ID NO: 389133 - protein, 11 aa, Influenza virus
KSTQAAIDQIN

SEQ ID NO: 389134 - protein, 11 aa, Influenza virus
STQAAIDQING

SEQ ID NO: 389135 - protein, 11 aa, Influenza virus
TQAAIDQINGK

SEQ ID NO: 389136 - protein, 11 aa, Influenza virus
QAAIDQINGKL

SEQ ID NO: 389137 - protein, 11 aa, Influenza virus
AAIDQINGKLN

SEQ ID NO: 389138 - protein, 11 aa, Influenza virus
AIDQINGKLNR

SEQ ID NO: 389139 - protein, 11 aa, Influenza virus
IDQINGKLNRL

SEQ ID NO: 389140 - protein, 11 aa, Influenza virus
DQINGKLNRLI

SEQ ID NO: 389141 - protein, 11 aa, Influenza virus
QINGKLNRLIE

SEQ ID NO: 389142 - protein, 11 aa, Influenza virus
INGKLNRLIEK

SEQ ID NO: 389143 - protein, 11 aa, Influenza virus
NGKLNRLIEKT

SEQ ID NO: 389144 - protein, 11 aa, Influenza virus
GKLNRLIEKTN

SEQ ID NO: 389145 - protein, 11 aa, Influenza virus
KLNRLIEKTNE

SEQ ID NO: 389146 - protein, 11 aa, Influenza virus
LNRLIEKTNEK

SEQ ID NO: 389147 - protein, 11 aa, Influenza virus
NRLIEKTNEKY

SEQ ID NO: 389148 - protein, 11 aa, Influenza virus
RLIEKTNEKYH

SEQ ID NO: 389149 - protein, 11 aa, Influenza virus
LIEKTNEKYHQ

SEQ ID NO: 389150 - protein, 11 aa, Influenza virus
IEKTNEKYHQI

SEQ ID NO: 389151 - protein, 11 aa, Influenza virus
EKTNEKYHQIE

SEQ ID NO: 389152 - protein, 11 aa, Influenza virus
KTNEKYHQIEK

SEQ ID NO: 389153 - protein, 11 aa, Influenza virus
TNEKYHQIEKE

SEQ ID NO: 389154 - protein, 11 aa, Influenza virus
NEKYHQIEKEF

SEQ ID NO: 389155 - protein, 11 aa, Influenza virus
EKYHQIEKEFE

SEQ ID NO: 389156 - protein, 11 aa, Influenza virus
KYHQIEKEFEQ

SEQ ID NO: 389157 - protein, 11 aa, Influenza virus
YHQIEKEFEQV

SEQ ID NO: 389158 - protein, 11 aa, Influenza virus
HQIEKEFEQVE

SEQ ID NO: 389159 - protein, 11 aa, Influenza virus
QIEKEFEQVEG

SEQ ID NO: 389160 - protein, 11 aa, Influenza virus
IEKEFEQVEGR

SEQ ID NO: 389161 - protein, 11 aa, Influenza virus
EKEFEQVEGRI

SEQ ID NO: 389162 - protein, 11 aa, Influenza virus
KEFEQVEGRIQ

SEQ ID NO: 389163 - protein, 11 aa, Influenza virus
EFEQVEGRIQD

SEQ ID NO: 389164 - protein, 11 aa, Influenza virus
FEQVEGRIQDL

SEQ ID NO: 389165 - protein, 11 aa, Influenza virus
EQVEGRIQDLE

SEQ ID NO: 389166 - protein, 11 aa, Influenza virus
QVEGRIQDLEK

SEQ ID NO: 389167 - protein, 11 aa, Influenza virus
VEGRIQDLEKY

SEQ ID NO: 389168 - protein, 11 aa, Influenza virus
EGRIQDLEKYV

SEQ ID NO: 389169 - protein, 11 aa, Influenza virus
GRIQDLEKYVE

SEQ ID NO: 389170 - protein, 11 aa, Influenza virus
RIQDLEKYVED

SEQ ID NO: 389171 - protein, 11 aa, Influenza virus
IQDLEKYVEDT

SEQ ID NO: 389172 - protein, 11 aa, Influenza virus
QDLEKYVEDTK

SEQ ID NO: 389173 - protein, 11 aa, Influenza virus
DLEKYVEDTKI

SEQ ID NO: 389174 - protein, 11 aa, Influenza virus
LEKYVEDTKID

SEQ ID NO: 389175 - protein, 11 aa, Influenza virus
EKYVEDTKIDL

SEQ ID NO: 389176 - protein, 11 aa, Influenza virus
KYVEDTKIDLW

SEQ ID NO: 389177 - protein, 11 aa, Influenza virus
YVEDTKIDLWS

SEQ ID NO: 389178 - protein, 11 aa, Influenza virus
VEDTKIDLWSY

SEQ ID NO: 389179 - protein, 11 aa, Influenza virus
EDTKIDLWSYN

SEQ ID NO: 389180 - protein, 11 aa, Influenza virus
DTKIDLWSYNA

SEQ ID NO: 389181 - protein, 11 aa, Influenza virus
TKIDLWSYNAE

SEQ ID NO: 389182 - protein, 11 aa, Influenza virus
KIDLWSYNAEL

SEQ ID NO: 389183 - protein, 11 aa, Influenza virus
IDLWSYNAELL

SEQ ID NO: 389184 - protein, 11 aa, Influenza virus
DLWSYNAELLV

SEQ ID NO: 389185 - protein, 11 aa, Influenza virus
LWSYNAELLVA

SEQ ID NO: 389186 - protein, 11 aa, Influenza virus
WSYNAELLVAL

SEQ ID NO: 389187 - protein, 11 aa, Influenza virus
SYNAELLVALE

SEQ ID NO: 389188 - protein, 11 aa, Influenza virus
YNAELLVALEN

SEQ ID NO: 389189 - protein, 11 aa, Influenza virus
NAELLVALENQ

SEQ ID NO: 389190 - protein, 11 aa, Influenza virus
AELLVALENQH

SEQ ID NO: 389191 - protein, 11 aa, Influenza virus
ELLVALENQHT

SEQ ID NO: 389192 - protein, 11 aa, Influenza virus
LLVALENQHTI

SEQ ID NO: 389193 - protein, 11 aa, Influenza virus
LVALENQHTID

SEQ ID NO: 389194 - protein, 11 aa, Influenza virus
VALENQHTIDV

SEQ ID NO: 389195 - protein, 11 aa, Influenza virus
ALENQHTIDVT

SEQ ID NO: 389196 - protein, 11 aa, Influenza virus
LENQHTIDVTD

SEQ ID NO: 389197 - protein, 11 aa, Influenza virus
ENQHTIDVTDS

SEQ ID NO: 389198 - protein, 11 aa, Influenza virus
NQHTIDVTDSE

SEQ ID NO: 389199 - protein, 11 aa, Influenza virus
QHTIDVTDSEM

SEQ ID NO: 389200 - protein, 11 aa, Influenza virus
HTIDVTDSEMN

SEQ ID NO: 389201 - protein, 11 aa, Influenza virus
TIDVTDSEMNK

SEQ ID NO: 389202 - protein, 11 aa, Influenza virus
IDVTDSEMNKL

SEQ ID NO: 389203 - protein, 11 aa, Influenza virus
DVTDSEMNKLF

SEQ ID NO: 389204 - protein, 11 aa, Influenza virus
VTDSEMNKLFE

SEQ ID NO: 389205 - protein, 11 aa, Influenza virus
TDSEMNKLFER

SEQ ID NO: 389206 - protein, 11 aa, Influenza virus
DSEMNKLFERV

SEQ ID NO: 389207 - protein, 11 aa, Influenza virus
SEMNKLFERVR

SEQ ID NO: 389208 - protein, 11 aa, Influenza virus
EMNKLFERVRR

SEQ ID NO: 389209 - protein, 11 aa, Influenza virus
MNKLFERVRRQ

SEQ ID NO: 389210 - protein, 11 aa, Influenza virus
NKLFERVRRQL

SEQ ID NO: 389211 - protein, 11 aa, Influenza virus
KLFERVRRQLR

SEQ ID NO: 389212 - protein, 11 aa, Influenza virus
LFERVRRQLRE

SEQ ID NO: 389213 - protein, 11 aa, Influenza virus
FERVRRQLREN

SEQ ID NO: 389214 - protein, 11 aa, Influenza virus
ERVRRQLRENA

SEQ ID NO: 389215 - protein, 11 aa, Influenza virus
RVRRQLRENAE

SEQ ID NO: 389216 - protein, 11 aa, Influenza virus
VRRQLRENAED

SEQ ID NO: 389217 - protein, 11 aa, Influenza virus
RRQLRENAEDQ

SEQ ID NO: 389218 - protein, 11 aa, Influenza virus
RQLRENAEDQG

SEQ ID NO: 389219 - protein, 11 aa, Influenza virus
QLRENAEDQGN

SEQ ID NO: 389220 - protein, 11 aa, Influenza virus
LRENAEDQGNG

SEQ ID NO: 389221 - protein, 11 aa, Influenza virus
RENAEDQGNGC

SEQ ID NO: 389222 - protein, 11 aa, Influenza virus
ENAEDQGNGCF

SEQ ID NO: 389223 - protein, 11 aa, Influenza virus
NAEDQGNGCFE

SEQ ID NO: 389224 - protein, 11 aa, Influenza virus
AEDQGNGCFEI

SEQ ID NO: 389225 - protein, 11 aa, Influenza virus
EDQGNGCFEIF

SEQ ID NO: 389226 - protein, 11 aa, Influenza virus
DQGNGCFEIFH

SEQ ID NO: 389227 - protein, 11 aa, Influenza virus
QGNGCFEIFHQ

SEQ ID NO: 389228 - protein, 11 aa, Influenza virus
GNGCFEIFHQC

SEQ ID NO: 389229 - protein, 11 aa, Influenza virus
NGCFEIFHQCD

SEQ ID NO: 389230 - protein, 11 aa, Influenza virus
GCFEIFHQCDN

SEQ ID NO: 389231 - protein, 11 aa, Influenza virus
CFEIFHQCDNN

SEQ ID NO: 389232 - protein, 11 aa, Influenza virus
FEIFHQCDNNC

SEQ ID NO: 389233 - protein, 11 aa, Influenza virus
EIFHQCDNNCI

SEQ ID NO: 389234 - protein, 11 aa, Influenza virus
IFHQCDNNCIE

SEQ ID NO: 389235 - protein, 11 aa, Influenza virus
FHQCDNNCIES

SEQ ID NO: 389236 - protein, 11 aa, Influenza virus
HQCDNNCIESI

SEQ ID NO: 389237 - protein, 11 aa, Influenza virus
QCDNNCIESIR

SEQ ID NO: 389238 - protein, 11 aa, Influenza virus
CDNNCIESIRN

SEQ ID NO: 389239 - protein, 11 aa, Influenza virus
DNNCIESIRNG

SEQ ID NO: 389240 - protein, 11 aa, Influenza virus
NNCIESIRNGT

SEQ ID NO: 389241 - protein, 11 aa, Influenza virus
NCIESIRNGTY

SEQ ID NO: 389242 - protein, 11 aa, Influenza virus
CIESIRNGTYD

SEQ ID NO: 389243 - protein, 11 aa, Influenza virus
IESIRNGTYDH

SEQ ID NO: 389244 - protein, 11 aa, Influenza virus
ESIRNGTYDHN

SEQ ID NO: 389245 - protein, 11 aa, Influenza virus
SIRNGTYDHNI

SEQ ID NO: 389246 - protein, 11 aa, Influenza virus
IRNGTYDHNIY

SEQ ID NO: 389247 - protein, 11 aa, Influenza virus
RNGTYDHNIYR

SEQ ID NO: 389248 - protein, 11 aa, Influenza virus
NGTYDHNIYRD

SEQ ID NO: 389249 - protein, 11 aa, Influenza virus
GTYDHNIYRDE

SEQ ID NO: 389250 - protein, 11 aa, Influenza virus
TYDHNIYRDEA

SEQ ID NO: 389251 - protein, 11 aa, Influenza virus
YDHNIYRDEAI

SEQ ID NO: 389252 - protein, 11 aa, Influenza virus
DHNIYRDEAIN

SEQ ID NO: 389253 - protein, 11 aa, Influenza virus
HNIYRDEAINN

SEQ ID NO: 389254 - protein, 11 aa, Influenza virus
NIYRDEAINNR

SEQ ID NO: 389255 - protein, 11 aa, Influenza virus
IYRDEAINNRI

SEQ ID NO: 389256 - protein, 11 aa, Influenza virus
YRDEAINNRIK

SEQ ID NO: 389257 - protein, 11 aa, Influenza virus
RDEAINNRIKI

SEQ ID NO: 389258 - protein, 11 aa, Influenza virus
DEAINNRIKIN

SEQ ID NO: 389259 - protein, 11 aa, Influenza virus
EAINNRIKINP

SEQ ID NO: 389260 - protein, 11 aa, Influenza virus
AINNRIKINPV

SEQ ID NO: 389261 - protein, 11 aa, Influenza virus
INNRIKINPVT

SEQ ID NO: 389262 - protein, 11 aa, Influenza virus
NNRIKINPVTL

SEQ ID NO: 389263 - protein, 11 aa, Influenza virus
NRIKINPVTLT

SEQ ID NO: 389264 - protein, 11 aa, Influenza virus
RIKINPVTLTM

SEQ ID NO: 389265 - protein, 11 aa, Influenza virus
IKINPVTLTMG

SEQ ID NO: 389266 - protein, 11 aa, Influenza virus
KINPVTLTMGY

SEQ ID NO: 389267 - protein, 11 aa, Influenza virus
INPVTLTMGYK

SEQ ID NO: 389268 - protein, 11 aa, Influenza virus
NPVTLTMGYKD

SEQ ID NO: 389269 - protein, 11 aa, Influenza virus
PVTLTMGYKDI

SEQ ID NO: 389270 - protein, 11 aa, Influenza virus
VTLTMGYKDII

SEQ ID NO: 389271 - protein, 11 aa, Influenza virus
TLTMGYKDIIL

SEQ ID NO: 389272 - protein, 11 aa, Influenza virus
LTMGYKDIILW

SEQ ID NO: 389273 - protein, 11 aa, Influenza virus
TMGYKDIILWI

SEQ ID NO: 389274 - protein, 11 aa, Influenza virus
MGYKDIILWIS

SEQ ID NO: 389275 - protein, 11 aa, Influenza virus
GYKDIILWISF

SEQ ID NO: 389276 - protein, 11 aa, Influenza virus
YKDIILWISFS

SEQ ID NO: 389277 - protein, 11 aa, Influenza virus
KDIILWISFSM

SEQ ID NO: 389278 - protein, 11 aa, Influenza virus
DIILWISFSMS

SEQ ID NO: 389279 - protein, 11 aa, Influenza virus
IILWISFSMSC

SEQ ID NO: 389280 - protein, 11 aa, Influenza virus
ILWISFSMSCF

SEQ ID NO: 389281 - protein, 11 aa, Influenza virus
LWISFSMSCFV

SEQ ID NO: 389282 - protein, 11 aa, Influenza virus
WISFSMSCFVF

SEQ ID NO: 389283 - protein, 11 aa, Influenza virus
ISFSMSCFVFV

SEQ ID NO: 389284 - protein, 11 aa, Influenza virus
SFSMSCFVFVA

SEQ ID NO: 389285 - protein, 11 aa, Influenza virus
FSMSCFVFVAL

SEQ ID NO: 389286 - protein, 11 aa, Influenza virus
SMSCFVFVALI

SEQ ID NO: 389287 - protein, 11 aa, Influenza virus
MSCFVFVALIL

SEQ ID NO: 389288 - protein, 11 aa, Influenza virus
SCFVFVALILG

SEQ ID NO: 389289 - protein, 11 aa, Influenza virus
CFVFVALILGF

SEQ ID NO: 389290 - protein, 11 aa, Influenza virus
FVFVALILGFV

SEQ ID NO: 389291 - protein, 11 aa, Influenza virus
VFVALILGFVL

SEQ ID NO: 389292 - protein, 11 aa, Influenza virus
FVALILGFVLW

SEQ ID NO: 389293 - protein, 11 aa, Influenza virus
VALILGFVLWA

SEQ ID NO: 389294 - protein, 11 aa, Influenza virus
ALILGFVLWAC

SEQ ID NO: 389295 - protein, 11 aa, Influenza virus
LILGFVLWACQ

SEQ ID NO: 389296 - protein, 11 aa, Influenza virus
ILGFVLWACQN

SEQ ID NO: 389297 - protein, 11 aa, Influenza virus
LGFVLWACQNG

SEQ ID NO: 389298 - protein, 11 aa, Influenza virus
GFVLWACQNGN

SEQ ID NO: 389299 - protein, 11 aa, Influenza virus
FVLWACQNGNI

SEQ ID NO: 389300 - protein, 11 aa, Influenza virus
VLWACQNGNIR

SEQ ID NO: 389301 - protein, 11 aa, Influenza virus
LWACQNGNIRC

SEQ ID NO: 389302 - protein, 11 aa, Influenza virus
WACQNGNIRCQ

SEQ ID NO: 389303 - protein, 11 aa, Influenza virus
ACQNGNIRCQI

SEQ ID NO: 389304 - protein, 11 aa, Influenza virus
CQNGNIRCQIC

SEQ ID NO: 389305 - protein, 11 aa, Influenza virus
QNGNIRCQICI

SEQ ID NO: 389306 - protein, 11 aa, Influenza virus
MNTQIIVILVL

SEQ ID NO: 389307 - protein, 11 aa, Influenza virus
NTQIIVILVLG

SEQ ID NO: 389308 - protein, 11 aa, Influenza virus
TQIIVILVLGL

SEQ ID NO: 389309 - protein, 11 aa, Influenza virus
QIIVILVLGLS

SEQ ID NO: 389310 - protein, 11 aa, Influenza virus
IIVILVLGLSM

SEQ ID NO: 389311 - protein, 11 aa, Influenza virus
IVILVLGLSMV

SEQ ID NO: 389312 - protein, 11 aa, Influenza virus
VILVLGLSMVK

SEQ ID NO: 389313 - protein, 11 aa, Influenza virus
ILVLGLSMVKS

SEQ ID NO: 389314 - protein, 11 aa, Influenza virus
LVLGLSMVKSD

SEQ ID NO: 389315 - protein, 11 aa, Influenza virus
VLGLSMVKSDK

SEQ ID NO: 389316 - protein, 11 aa, Influenza virus
LGLSMVKSDKI

SEQ ID NO: 389317 - protein, 11 aa, Influenza virus
GLSMVKSDKIC

SEQ ID NO: 389318 - protein, 11 aa, Influenza virus
LSMVKSDKICL

SEQ ID NO: 389319 - protein, 11 aa, Influenza virus
SMVKSDKICLG

SEQ ID NO: 389320 - protein, 11 aa, Influenza virus
MVKSDKICLGH

SEQ ID NO: 389321 - protein, 11 aa, Influenza virus
VKSDKICLGHH

SEQ ID NO: 389322 - protein, 11 aa, Influenza virus
KSDKICLGHHA

SEQ ID NO: 389323 - protein, 11 aa, Influenza virus
SDKICLGHHAV

SEQ ID NO: 389324 - protein, 11 aa, Influenza virus
DKICLGHHAVA

SEQ ID NO: 389325 - protein, 11 aa, Influenza virus
KICLGHHAVAN

SEQ ID NO: 389326 - protein, 11 aa, Influenza virus
ICLGHHAVANG

SEQ ID NO: 389327 - protein, 11 aa, Influenza virus
CLGHHAVANGT

SEQ ID NO: 389328 - protein, 11 aa, Influenza virus
LGHHAVANGTK

SEQ ID NO: 389329 - protein, 11 aa, Influenza virus
GHHAVANGTKV

SEQ ID NO: 389330 - protein, 11 aa, Influenza virus
HHAVANGTKVN

SEQ ID NO: 389331 - protein, 11 aa, Influenza virus
HAVANGTKVNT

SEQ ID NO: 389332 - protein, 11 aa, Influenza virus
AVANGTKVNTL

SEQ ID NO: 389333 - protein, 11 aa, Influenza virus
VANGTKVNTLT

SEQ ID NO: 389334 - protein, 11 aa, Influenza virus
ANGTKVNTLTE

SEQ ID NO: 389335 - protein, 11 aa, Influenza virus
NGTKVNTLTER

SEQ ID NO: 389336 - protein, 11 aa, Influenza virus
GTKVNTLTERG

SEQ ID NO: 389337 - protein, 11 aa, Influenza virus
TKVNTLTERGV

SEQ ID NO: 389338 - protein, 11 aa, Influenza virus
KVNTLTERGVE

SEQ ID NO: 389339 - protein, 11 aa, Influenza virus
VNTLTERGVEV

SEQ ID NO: 389340 - protein, 11 aa, Influenza virus
NTLTERGVEVV

SEQ ID NO: 389341 - protein, 11 aa, Influenza virus
TLTERGVEVVN

SEQ ID NO: 389342 - protein, 11 aa, Influenza virus
LTERGVEVVNA

SEQ ID NO: 389343 - protein, 11 aa, Influenza virus
TERGVEVVNAT

SEQ ID NO: 389344 - protein, 11 aa, Influenza virus
ERGVEVVNATE

SEQ ID NO: 389345 - protein, 11 aa, Influenza virus
RGVEVVNATET

SEQ ID NO: 389346 - protein, 11 aa, Influenza virus
GVEVVNATETV

SEQ ID NO: 389347 - protein, 11 aa, Influenza virus
VEVVNATETVE

SEQ ID NO: 389348 - protein, 11 aa, Influenza virus
EVVNATETVEI

SEQ ID NO: 389349 - protein, 11 aa, Influenza virus
VVNATETVEIT

SEQ ID NO: 389350 - protein, 11 aa, Influenza virus
VNATETVEITG

SEQ ID NO: 389351 - protein, 11 aa, Influenza virus
NATETVEITGI

SEQ ID NO: 389352 - protein, 11 aa, Influenza virus
ATETVEITGID

SEQ ID NO: 389353 - protein, 11 aa, Influenza virus
TETVEITGIDK

SEQ ID NO: 389354 - protein, 11 aa, Influenza virus
ETVEITGIDKV

SEQ ID NO: 389355 - protein, 11 aa, Influenza virus
TVEITGIDKVC

SEQ ID NO: 389356 - protein, 11 aa, Influenza virus
VEITGIDKVCT

SEQ ID NO: 389357 - protein, 11 aa, Influenza virus
EITGIDKVCTK

SEQ ID NO: 389358 - protein, 11 aa, Influenza virus
ITGIDKVCTKG

SEQ ID NO: 389359 - protein, 11 aa, Influenza virus
TGIDKVCTKGK

SEQ ID NO: 389360 - protein, 11 aa, Influenza virus
GIDKVCTKGKK

SEQ ID NO: 389361 - protein, 11 aa, Influenza virus
IDKVCTKGKKA

SEQ ID NO: 389362 - protein, 11 aa, Influenza virus
DKVCTKGKKAV

SEQ ID NO: 389363 - protein, 11 aa, Influenza virus
KVCTKGKKAVD

SEQ ID NO: 389364 - protein, 11 aa, Influenza virus
VCTKGKKAVDL

SEQ ID NO: 389365 - protein, 11 aa, Influenza virus
CTKGKKAVDLG

SEQ ID NO: 389366 - protein, 11 aa, Influenza virus
TKGKKAVDLGS

SEQ ID NO: 389367 - protein, 11 aa, Influenza virus
KGKKAVDLGSC

SEQ ID NO: 389368 - protein, 11 aa, Influenza virus
GKKAVDLGSCG

SEQ ID NO: 389369 - protein, 11 aa, Influenza virus
KKAVDLGSCGI

SEQ ID NO: 389370 - protein, 11 aa, Influenza virus
KAVDLGSCGIL

SEQ ID NO: 389371 - protein, 11 aa, Influenza virus
AVDLGSCGILG

SEQ ID NO: 389372 - protein, 11 aa, Influenza virus
VDLGSCGILGT

SEQ ID NO: 389373 - protein, 11 aa, Influenza virus
DLGSCGILGTI

SEQ ID NO: 389374 - protein, 11 aa, Influenza virus
LGSCGILGTII

SEQ ID NO: 389375 - protein, 11 aa, Influenza virus
GSCGILGTIIG

SEQ ID NO: 389376 - protein, 11 aa, Influenza virus
SCGILGTIIGP

SEQ ID NO: 389377 - protein, 11 aa, Influenza virus
CGILGTIIGPP

SEQ ID NO: 389378 - protein, 11 aa, Influenza virus
GILGTIIGPPQ

SEQ ID NO: 389379 - protein, 11 aa, Influenza virus
ILGTIIGPPQC

SEQ ID NO: 389380 - protein, 11 aa, Influenza virus
LGTIIGPPQCD

SEQ ID NO: 389381 - protein, 11 aa, Influenza virus
GTIIGPPQCDL

SEQ ID NO: 389382 - protein, 11 aa, Influenza virus
TIIGPPQCDLH

SEQ ID NO: 389383 - protein, 11 aa, Influenza virus
IIGPPQCDLHL

SEQ ID NO: 389384 - protein, 11 aa, Influenza virus
IGPPQCDLHLE

SEQ ID NO: 389385 - protein, 11 aa, Influenza virus
GPPQCDLHLEF

SEQ ID NO: 389386 - protein, 11 aa, Influenza virus
PPQCDLHLEFK

SEQ ID NO: 389387 - protein, 11 aa, Influenza virus
PQCDLHLEFKA

SEQ ID NO: 389388 - protein, 11 aa, Influenza virus
QCDLHLEFKAD

SEQ ID NO: 389389 - protein, 11 aa, Influenza virus
CDLHLEFKADL

SEQ ID NO: 389390 - protein, 11 aa, Influenza virus
DLHLEFKADLI

SEQ ID NO: 389391 - protein, 11 aa, Influenza virus
LHLEFKADLII

SEQ ID NO: 389392 - protein, 11 aa, Influenza virus
HLEFKADLIIE

SEQ ID NO: 389393 - protein, 11 aa, Influenza virus
LEFKADLIIER

SEQ ID NO: 389394 - protein, 11 aa, Influenza virus
EFKADLIIERR

SEQ ID NO: 389395 - protein, 11 aa, Influenza virus
FKADLIIERRN

SEQ ID NO: 389396 - protein, 11 aa, Influenza virus
KADLIIERRNS

SEQ ID NO: 389397 - protein, 11 aa, Influenza virus
ADLIIERRNSS

SEQ ID NO: 389398 - protein, 11 aa, Influenza virus
DLIIERRNSSD

SEQ ID NO: 389399 - protein, 11 aa, Influenza virus
LIIERRNSSDI

SEQ ID NO: 389400 - protein, 11 aa, Influenza virus
IIERRNSSDIC

SEQ ID NO: 389401 - protein, 11 aa, Influenza virus
IERRNSSDICY

SEQ ID NO: 389402 - protein, 11 aa, Influenza virus
ERRNSSDICYP

SEQ ID NO: 389403 - protein, 11 aa, Influenza virus
RRNSSDICYPG

SEQ ID NO: 389404 - protein, 11 aa, Influenza virus
RNSSDICYPGR

SEQ ID NO: 389405 - protein, 11 aa, Influenza virus
NSSDICYPGRF

SEQ ID NO: 389406 - protein, 11 aa, Influenza virus
SSDICYPGRFT

SEQ ID NO: 389407 - protein, 11 aa, Influenza virus
SDICYPGRFTN

SEQ ID NO: 389408 - protein, 11 aa, Influenza virus
DICYPGRFTNE

SEQ ID NO: 389409 - protein, 11 aa, Influenza virus
ICYPGRFTNEE

SEQ ID NO: 389410 - protein, 11 aa, Influenza virus
CYPGRFTNEEA

SEQ ID NO: 389411 - protein, 11 aa, Influenza virus
YPGRFTNEEAL

SEQ ID NO: 389412 - protein, 11 aa, Influenza virus
PGRFTNEEALR

SEQ ID NO: 389413 - protein, 11 aa, Influenza virus
GRFTNEEALRQ

SEQ ID NO: 389414 - protein, 11 aa, Influenza virus
RFTNEEALRQI

SEQ ID NO: 389415 - protein, 11 aa, Influenza virus
FTNEEALRQII

SEQ ID NO: 389416 - protein, 11 aa, Influenza virus
TNEEALRQIIR

SEQ ID NO: 389417 - protein, 11 aa, Influenza virus
NEEALRQIIRE

SEQ ID NO: 389418 - protein, 11 aa, Influenza virus
EEALRQIIRES

SEQ ID NO: 389419 - protein, 11 aa, Influenza virus
EALRQIIRESG

SEQ ID NO: 389420 - protein, 11 aa, Influenza virus
ALRQIIRESGG

SEQ ID NO: 389421 - protein, 11 aa, Influenza virus
LRQIIRESGGI

SEQ ID NO: 389422 - protein, 11 aa, Influenza virus
RQIIRESGGID

SEQ ID NO: 389423 - protein, 11 aa, Influenza virus
QIIRESGGIDK

SEQ ID NO: 389424 - protein, 11 aa, Influenza virus
IIRESGGIDKE

SEQ ID NO: 389425 - protein, 11 aa, Influenza virus
IRESGGIDKES

SEQ ID NO: 389426 - protein, 11 aa, Influenza virus
RESGGIDKESM

SEQ ID NO: 389427 - protein, 11 aa, Influenza virus
ESGGIDKESMG

SEQ ID NO: 389428 - protein, 11 aa, Influenza virus
SGGIDKESMGF

SEQ ID NO: 389429 - protein, 11 aa, Influenza virus
GGIDKESMGFR

SEQ ID NO: 389430 - protein, 11 aa, Influenza virus
GIDKESMGFRY

SEQ ID NO: 389431 - protein, 11 aa, Influenza virus
IDKESMGFRYS

SEQ ID NO: 389432 - protein, 11 aa, Influenza virus
DKESMGFRYSG

SEQ ID NO: 389433 - protein, 11 aa, Influenza virus
KESMGFRYSGI

SEQ ID NO: 389434 - protein, 11 aa, Influenza virus
ESMGFRYSGIR

SEQ ID NO: 389435 - protein, 11 aa, Influenza virus
SMGFRYSGIRT

SEQ ID NO: 389436 - protein, 11 aa, Influenza virus
MGFRYSGIRTD

SEQ ID NO: 389437 - protein, 11 aa, Influenza virus
GFRYSGIRTDG

SEQ ID NO: 389438 - protein, 11 aa, Influenza virus
FRYSGIRTDGA

SEQ ID NO: 389439 - protein, 11 aa, Influenza virus
RYSGIRTDGAT

SEQ ID NO: 389440 - protein, 11 aa, Influenza virus
YSGIRTDGATS

SEQ ID NO: 389441 - protein, 11 aa, Influenza virus
SGIRTDGATSA

SEQ ID NO: 389442 - protein, 11 aa, Influenza virus
GIRTDGATSAC

SEQ ID NO: 389443 - protein, 11 aa, Influenza virus
IRTDGATSACK

SEQ ID NO: 389444 - protein, 11 aa, Influenza virus
RTDGATSACKR

SEQ ID NO: 389445 - protein, 11 aa, Influenza virus
TDGATSACKRT

SEQ ID NO: 389446 - protein, 11 aa, Influenza virus
DGATSACKRTV

SEQ ID NO: 389447 - protein, 11 aa, Influenza virus
GATSACKRTVS

SEQ ID NO: 389448 - protein, 11 aa, Influenza virus
ATSACKRTVSS

SEQ ID NO: 389449 - protein, 11 aa, Influenza virus
TSACKRTVSSF

SEQ ID NO: 389450 - protein, 11 aa, Influenza virus
SACKRTVSSFY

SEQ ID NO: 389451 - protein, 11 aa, Influenza virus
ACKRTVSSFYS

SEQ ID NO: 389452 - protein, 11 aa, Influenza virus
CKRTVSSFYSE

SEQ ID NO: 389453 - protein, 11 aa, Influenza virus
KRTVSSFYSEM

SEQ ID NO: 389454 - protein, 11 aa, Influenza virus
RTVSSFYSEMK

SEQ ID NO: 389455 - protein, 11 aa, Influenza virus
TVSSFYSEMKW

SEQ ID NO: 389456 - protein, 11 aa, Influenza virus
VSSFYSEMKWL

SEQ ID NO: 389457 - protein, 11 aa, Influenza virus
SSFYSEMKWLS

SEQ ID NO: 389458 - protein, 11 aa, Influenza virus
SFYSEMKWLSS

SEQ ID NO: 389459 - protein, 11 aa, Influenza virus
FYSEMKWLSSS

SEQ ID NO: 389460 - protein, 11 aa, Influenza virus
YSEMKWLSSSM

SEQ ID NO: 389461 - protein, 11 aa, Influenza virus
SEMKWLSSSMN

SEQ ID NO: 389462 - protein, 11 aa, Influenza virus
EMKWLSSSMNN

SEQ ID NO: 389463 - protein, 11 aa, Influenza virus
MKWLSSSMNNQ

SEQ ID NO: 389464 - protein, 11 aa, Influenza virus
KWLSSSMNNQV

SEQ ID NO: 389465 - protein, 11 aa, Influenza virus
WLSSSMNNQVF

SEQ ID NO: 389466 - protein, 11 aa, Influenza virus
LSSSMNNQVFP

SEQ ID NO: 389467 - protein, 11 aa, Influenza virus
SSSMNNQVFPQ

SEQ ID NO: 389468 - protein, 11 aa, Influenza virus
SSMNNQVFPQL

SEQ ID NO: 389469 - protein, 11 aa, Influenza virus
SMNNQVFPQLN

SEQ ID NO: 389470 - protein, 11 aa, Influenza virus
MNNQVFPQLNQ

SEQ ID NO: 389471 - protein, 11 aa, Influenza virus
NNQVFPQLNQT

SEQ ID NO: 389472 - protein, 11 aa, Influenza virus
NQVFPQLNQTY

SEQ ID NO: 389473 - protein, 11 aa, Influenza virus
QVFPQLNQTYR

SEQ ID NO: 389474 - protein, 11 aa, Influenza virus
VFPQLNQTYRN

SEQ ID NO: 389475 - protein, 11 aa, Influenza virus
FPQLNQTYRNT

SEQ ID NO: 389476 - protein, 11 aa, Influenza virus
PQLNQTYRNTR

SEQ ID NO: 389477 - protein, 11 aa, Influenza virus
QLNQTYRNTRK

SEQ ID NO: 389478 - protein, 11 aa, Influenza virus
LNQTYRNTRKE

SEQ ID NO: 389479 - protein, 11 aa, Influenza virus
NQTYRNTRKEP

SEQ ID NO: 389480 - protein, 11 aa, Influenza virus
QTYRNTRKEPA

SEQ ID NO: 389481 - protein, 11 aa, Influenza virus
TYRNTRKEPAL

SEQ ID NO: 389482 - protein, 11 aa, Influenza virus
YRNTRKEPALI

SEQ ID NO: 389483 - protein, 11 aa, Influenza virus
RNTRKEPALIV

SEQ ID NO: 389484 - protein, 11 aa, Influenza virus
NTRKEPALIVW

SEQ ID NO: 389485 - protein, 11 aa, Influenza virus
TRKEPALIVWG

SEQ ID NO: 389486 - protein, 11 aa, Influenza virus
RKEPALIVWGV

SEQ ID NO: 389487 - protein, 11 aa, Influenza virus
KEPALIVWGVH

SEQ ID NO: 389488 - protein, 11 aa, Influenza virus
EPALIVWGVHH

SEQ ID NO: 389489 - protein, 11 aa, Influenza virus
PALIVWGVHHS

SEQ ID NO: 389490 - protein, 11 aa, Influenza virus
ALIVWGVHHSS

SEQ ID NO: 389491 - protein, 11 aa, Influenza virus
LIVWGVHHSSS

SEQ ID NO: 389492 - protein, 11 aa, Influenza virus
IVWGVHHSSSL

SEQ ID NO: 389493 - protein, 11 aa, Influenza virus
VWGVHHSSSLD

SEQ ID NO: 389494 - protein, 11 aa, Influenza virus
WGVHHSSSLDE

SEQ ID NO: 389495 - protein, 11 aa, Influenza virus
GVHHSSSLDEQ

SEQ ID NO: 389496 - protein, 11 aa, Influenza virus
VHHSSSLDEQN

SEQ ID NO: 389497 - protein, 11 aa, Influenza virus
HHSSSLDEQNK

SEQ ID NO: 389498 - protein, 11 aa, Influenza virus
HSSSLDEQNKL

SEQ ID NO: 389499 - protein, 11 aa, Influenza virus
SSSLDEQNKLY

SEQ ID NO: 389500 - protein, 11 aa, Influenza virus
SSLDEQNKLYG

SEQ ID NO: 389501 - protein, 11 aa, Influenza virus
SLDEQNKLYGT

SEQ ID NO: 389502 - protein, 11 aa, Influenza virus
LDEQNKLYGTG

SEQ ID NO: 389503 - protein, 11 aa, Influenza virus
DEQNKLYGTGN

SEQ ID NO: 389504 - protein, 11 aa, Influenza virus
EQNKLYGTGNK

SEQ ID NO: 389505 - protein, 11 aa, Influenza virus
QNKLYGTGNKL

SEQ ID NO: 389506 - protein, 11 aa, Influenza virus
NKLYGTGNKLI

SEQ ID NO: 389507 - protein, 11 aa, Influenza virus
KLYGTGNKLIT

SEQ ID NO: 389508 - protein, 11 aa, Influenza virus
LYGTGNKLITV

SEQ ID NO: 389509 - protein, 11 aa, Influenza virus
YGTGNKLITVG

SEQ ID NO: 389510 - protein, 11 aa, Influenza virus
GTGNKLITVGS

SEQ ID NO: 389511 - protein, 11 aa, Influenza virus
TGNKLITVGSS

SEQ ID NO: 389512 - protein, 11 aa, Influenza virus
GNKLITVGSSK

SEQ ID NO: 389513 - protein, 11 aa, Influenza virus
NKLITVGSSKY

SEQ ID NO: 389514 - protein, 11 aa, Influenza virus
KLITVGSSKYQ

SEQ ID NO: 389515 - protein, 11 aa, Influenza virus
LITVGSSKYQQ

SEQ ID NO: 389516 - protein, 11 aa, Influenza virus
ITVGSSKYQQS

SEQ ID NO: 389517 - protein, 11 aa, Influenza virus
TVGSSKYQQSF

SEQ ID NO: 389518 - protein, 11 aa, Influenza virus
VGSSKYQQSFS

SEQ ID NO: 389519 - protein, 11 aa, Influenza virus
GSSKYQQSFSP

SEQ ID NO: 389520 - protein, 11 aa, Influenza virus
SSKYQQSFSPS

SEQ ID NO: 389521 - protein, 11 aa, Influenza virus
SKYQQSFSPSP

SEQ ID NO: 389522 - protein, 11 aa, Influenza virus
KYQQSFSPSPG

SEQ ID NO: 389523 - protein, 11 aa, Influenza virus
YQQSFSPSPGA

SEQ ID NO: 389524 - protein, 11 aa, Influenza virus
QQSFSPSPGAR

SEQ ID NO: 389525 - protein, 11 aa, Influenza virus
QSFSPSPGARP

SEQ ID NO: 389526 - protein, 11 aa, Influenza virus
SFSPSPGARPK

SEQ ID NO: 389527 - protein, 11 aa, Influenza virus
FSPSPGARPKV

SEQ ID NO: 389528 - protein, 11 aa, Influenza virus
SPSPGARPKVN

SEQ ID NO: 389529 - protein, 11 aa, Influenza virus
PSPGARPKVNG

SEQ ID NO: 389530 - protein, 11 aa, Influenza virus
SPGARPKVNGQ

SEQ ID NO: 389531 - protein, 11 aa, Influenza virus
PGARPKVNGQA

SEQ ID NO: 389532 - protein, 11 aa, Influenza virus
GARPKVNGQAG

SEQ ID NO: 389533 - protein, 11 aa, Influenza virus
ARPKVNGQAGR

SEQ ID NO: 389534 - protein, 11 aa, Influenza virus
RPKVNGQAGRI

SEQ ID NO: 389535 - protein, 11 aa, Influenza virus
PKVNGQAGRID

SEQ ID NO: 389536 - protein, 11 aa, Influenza virus
KVNGQAGRIDF

SEQ ID NO: 389537 - protein, 11 aa, Influenza virus
VNGQAGRIDFH

SEQ ID NO: 389538 - protein, 11 aa, Influenza virus
NGQAGRIDFHW

SEQ ID NO: 389539 - protein, 11 aa, Influenza virus
GQAGRIDFHWM

SEQ ID NO: 389540 - protein, 11 aa, Influenza virus
QAGRIDFHWML

SEQ ID NO: 389541 - protein, 11 aa, Influenza virus
AGRIDFHWMLL

SEQ ID NO: 389542 - protein, 11 aa, Influenza virus
GRIDFHWMLLD

SEQ ID NO: 389543 - protein, 11 aa, Influenza virus
RIDFHWMLLDP

SEQ ID NO: 389544 - protein, 11 aa, Influenza virus
IDFHWMLLDPG

SEQ ID NO: 389545 - protein, 11 aa, Influenza virus
DFHWMLLDPGD

SEQ ID NO: 389546 - protein, 11 aa, Influenza virus
FHWMLLDPGDT

SEQ ID NO: 389547 - protein, 11 aa, Influenza virus
HWMLLDPGDTV

SEQ ID NO: 389548 - protein, 11 aa, Influenza virus
WMLLDPGDTVT

SEQ ID NO: 389549 - protein, 11 aa, Influenza virus
MLLDPGDTVTF

SEQ ID NO: 389550 - protein, 11 aa, Influenza virus
LLDPGDTVTFT

SEQ ID NO: 389551 - protein, 11 aa, Influenza virus
LDPGDTVTFTF

SEQ ID NO: 389552 - protein, 11 aa, Influenza virus
DPGDTVTFTFN

SEQ ID NO: 389553 - protein, 11 aa, Influenza virus
PGDTVTFTFNG

SEQ ID NO: 389554 - protein, 11 aa, Influenza virus
GDTVTFTFNGA

SEQ ID NO: 389555 - protein, 11 aa, Influenza virus
DTVTFTFNGAF

SEQ ID NO: 389556 - protein, 11 aa, Influenza virus
TVTFTFNGAFI

SEQ ID NO: 389557 - protein, 11 aa, Influenza virus
VTFTFNGAFIA

SEQ ID NO: 389558 - protein, 11 aa, Influenza virus
TFTFNGAFIAP

SEQ ID NO: 389559 - protein, 11 aa, Influenza virus
FTFNGAFIAPD

SEQ ID NO: 389560 - protein, 11 aa, Influenza virus
TFNGAFIAPDR

SEQ ID NO: 389561 - protein, 11 aa, Influenza virus
FNGAFIAPDRA

SEQ ID NO: 389562 - protein, 11 aa, Influenza virus
NGAFIAPDRAT

SEQ ID NO: 389563 - protein, 11 aa, Influenza virus
GAFIAPDRATF

SEQ ID NO: 389564 - protein, 11 aa, Influenza virus
AFIAPDRATFL

SEQ ID NO: 389565 - protein, 11 aa, Influenza virus
FIAPDRATFLR

SEQ ID NO: 389566 - protein, 11 aa, Influenza virus
IAPDRATFLRS

SEQ ID NO: 389567 - protein, 11 aa, Influenza virus
APDRATFLRSN

SEQ ID NO: 389568 - protein, 11 aa, Influenza virus
PDRATFLRSNA

SEQ ID NO: 389569 - protein, 11 aa, Influenza virus
DRATFLRSNAP

SEQ ID NO: 389570 - protein, 11 aa, Influenza virus
RATFLRSNAPS

SEQ ID NO: 389571 - protein, 11 aa, Influenza virus
ATFLRSNAPSG

SEQ ID NO: 389572 - protein, 11 aa, Influenza virus
TFLRSNAPSGI

SEQ ID NO: 389573 - protein, 11 aa, Influenza virus
FLRSNAPSGIE

SEQ ID NO: 389574 - protein, 11 aa, Influenza virus
LRSNAPSGIEY

SEQ ID NO: 389575 - protein, 11 aa, Influenza virus
RSNAPSGIEYN

SEQ ID NO: 389576 - protein, 11 aa, Influenza virus
SNAPSGIEYNG

SEQ ID NO: 389577 - protein, 11 aa, Influenza virus
NAPSGIEYNGK

SEQ ID NO: 389578 - protein, 11 aa, Influenza virus
APSGIEYNGKS

SEQ ID NO: 389579 - protein, 11 aa, Influenza virus
PSGIEYNGKSL

SEQ ID NO: 389580 - protein, 11 aa, Influenza virus
SGIEYNGKSLG

SEQ ID NO: 389581 - protein, 11 aa, Influenza virus
GIEYNGKSLGI

SEQ ID NO: 389582 - protein, 11 aa, Influenza virus
IEYNGKSLGIQ

SEQ ID NO: 389583 - protein, 11 aa, Influenza virus
EYNGKSLGIQS

SEQ ID NO: 389584 - protein, 11 aa, Influenza virus
YNGKSLGIQSD

SEQ ID NO: 389585 - protein, 11 aa, Influenza virus
NGKSLGIQSDA

SEQ ID NO: 389586 - protein, 11 aa, Influenza virus
GKSLGIQSDAQ

SEQ ID NO: 389587 - protein, 11 aa, Influenza virus
KSLGIQSDAQI

SEQ ID NO: 389588 - protein, 11 aa, Influenza virus
SLGIQSDAQID

SEQ ID NO: 389589 - protein, 11 aa, Influenza virus
LGIQSDAQIDE

SEQ ID NO: 389590 - protein, 11 aa, Influenza virus
GIQSDAQIDES

SEQ ID NO: 389591 - protein, 11 aa, Influenza virus
IQSDAQIDESC

SEQ ID NO: 389592 - protein, 11 aa, Influenza virus
QSDAQIDESCE

SEQ ID NO: 389593 - protein, 11 aa, Influenza virus
SDAQIDESCEG

SEQ ID NO: 389594 - protein, 11 aa, Influenza virus
DAQIDESCEGE

SEQ ID NO: 389595 - protein, 11 aa, Influenza virus
AQIDESCEGEC

SEQ ID NO: 389596 - protein, 11 aa, Influenza virus
QIDESCEGECF

SEQ ID NO: 389597 - protein, 11 aa, Influenza virus
IDESCEGECFY

SEQ ID NO: 389598 - protein, 11 aa, Influenza virus
DESCEGECFYS

SEQ ID NO: 389599 - protein, 11 aa, Influenza virus
ESCEGECFYSG

SEQ ID NO: 389600 - protein, 11 aa, Influenza virus
SCEGECFYSGG

SEQ ID NO: 389601 - protein, 11 aa, Influenza virus
CEGECFYSGGT

SEQ ID NO: 389602 - protein, 11 aa, Influenza virus
EGECFYSGGTI

SEQ ID NO: 389603 - protein, 11 aa, Influenza virus
GECFYSGGTIN

SEQ ID NO: 389604 - protein, 11 aa, Influenza virus
ECFYSGGTINS

SEQ ID NO: 389605 - protein, 11 aa, Influenza virus
CFYSGGTINSP

SEQ ID NO: 389606 - protein, 11 aa, Influenza virus
FYSGGTINSPL

SEQ ID NO: 389607 - protein, 11 aa, Influenza virus
YSGGTINSPLP

SEQ ID NO: 389608 - protein, 11 aa, Influenza virus
SGGTINSPLPF

SEQ ID NO: 389609 - protein, 11 aa, Influenza virus
GGTINSPLPFQ

SEQ ID NO: 389610 - protein, 11 aa, Influenza virus
GTINSPLPFQN

SEQ ID NO: 389611 - protein, 11 aa, Influenza virus
TINSPLPFQNI

SEQ ID NO: 389612 - protein, 11 aa, Influenza virus
INSPLPFQNID

SEQ ID NO: 389613 - protein, 11 aa, Influenza virus
NSPLPFQNIDS

SEQ ID NO: 389614 - protein, 11 aa, Influenza virus
SPLPFQNIDSR

SEQ ID NO: 389615 - protein, 11 aa, Influenza virus
PLPFQNIDSRA

SEQ ID NO: 389616 - protein, 11 aa, Influenza virus
LPFQNIDSRAV

SEQ ID NO: 389617 - protein, 11 aa, Influenza virus
PFQNIDSRAVG

SEQ ID NO: 389618 - protein, 11 aa, Influenza virus
FQNIDSRAVGK

SEQ ID NO: 389619 - protein, 11 aa, Influenza virus
QNIDSRAVGKC

SEQ ID NO: 389620 - protein, 11 aa, Influenza virus
NIDSRAVGKCP

SEQ ID NO: 389621 - protein, 11 aa, Influenza virus
IDSRAVGKCPR

SEQ ID NO: 389622 - protein, 11 aa, Influenza virus
DSRAVGKCPRY

SEQ ID NO: 389623 - protein, 11 aa, Influenza virus
SRAVGKCPRYV

SEQ ID NO: 389624 - protein, 11 aa, Influenza virus
RAVGKCPRYVK

SEQ ID NO: 389625 - protein, 11 aa, Influenza virus
AVGKCPRYVKQ

SEQ ID NO: 389626 - protein, 11 aa, Influenza virus
VGKCPRYVKQS

SEQ ID NO: 389627 - protein, 11 aa, Influenza virus
GKCPRYVKQSS

SEQ ID NO: 389628 - protein, 11 aa, Influenza virus
KCPRYVKQSSL

SEQ ID NO: 389629 - protein, 11 aa, Influenza virus
CPRYVKQSSLP

SEQ ID NO: 389630 - protein, 11 aa, Influenza virus
PRYVKQSSLPL

SEQ ID NO: 389631 - protein, 11 aa, Influenza virus
RYVKQSSLPLA

SEQ ID NO: 389632 - protein, 11 aa, Influenza virus
YVKQSSLPLAL

SEQ ID NO: 389633 - protein, 11 aa, Influenza virus
VKQSSLPLALG

SEQ ID NO: 389634 - protein, 11 aa, Influenza virus
KQSSLPLALGM

SEQ ID NO: 389635 - protein, 11 aa, Influenza virus
QSSLPLALGMK

SEQ ID NO: 389636 - protein, 11 aa, Influenza virus
SSLPLALGMKN

SEQ ID NO: 389637 - protein, 11 aa, Influenza virus
SLPLALGMKNV

SEQ ID NO: 389638 - protein, 11 aa, Influenza virus
LPLALGMKNVP

SEQ ID NO: 389639 - protein, 11 aa, Influenza virus
PLALGMKNVPE

SEQ ID NO: 389640 - protein, 11 aa, Influenza virus
LALGMKNVPEK

SEQ ID NO: 389641 - protein, 11 aa, Influenza virus
ALGMKNVPEKI

SEQ ID NO: 389642 - protein, 11 aa, Influenza virus
LGMKNVPEKIR

SEQ ID NO: 389643 - protein, 11 aa, Influenza virus
GMKNVPEKIRT

SEQ ID NO: 389644 - protein, 11 aa, Influenza virus
MKNVPEKIRTR

SEQ ID NO: 389645 - protein, 11 aa, Influenza virus
KNVPEKIRTRG

SEQ ID NO: 389646 - protein, 11 aa, Influenza virus
NVPEKIRTRGL

SEQ ID NO: 389647 - protein, 11 aa, Influenza virus
VPEKIRTRGLF

SEQ ID NO: 389648 - protein, 11 aa, Influenza virus
PEKIRTRGLFG

SEQ ID NO: 389649 - protein, 11 aa, Influenza virus
EKIRTRGLFGA

SEQ ID NO: 389650 - protein, 11 aa, Influenza virus
KIRTRGLFGAI

SEQ ID NO: 389651 - protein, 11 aa, Influenza virus
IRTRGLFGAIA

SEQ ID NO: 389652 - protein, 11 aa, Influenza virus
RTRGLFGAIAG

SEQ ID NO: 389653 - protein, 11 aa, Influenza virus
TRGLFGAIAGF

SEQ ID NO: 389654 - protein, 11 aa, Influenza virus
RGLFGAIAGFI

SEQ ID NO: 389655 - protein, 11 aa, Influenza virus
GLFGAIAGFIE

SEQ ID NO: 389656 - protein, 11 aa, Influenza virus
LFGAIAGFIEN

SEQ ID NO: 389657 - protein, 11 aa, Influenza virus
FGAIAGFIENG

SEQ ID NO: 389658 - protein, 11 aa, Influenza virus
GAIAGFIENGW

SEQ ID NO: 389659 - protein, 11 aa, Influenza virus
AIAGFIENGWE

SEQ ID NO: 389660 - protein, 11 aa, Influenza virus
IAGFIENGWEG

SEQ ID NO: 389661 - protein, 11 aa, Influenza virus
AGFIENGWEGL

SEQ ID NO: 389662 - protein, 11 aa, Influenza virus
GFIENGWEGLI

SEQ ID NO: 389663 - protein, 11 aa, Influenza virus
FIENGWEGLID

SEQ ID NO: 389664 - protein, 11 aa, Influenza virus
IENGWEGLIDG

SEQ ID NO: 389665 - protein, 11 aa, Influenza virus
ENGWEGLIDGW

SEQ ID NO: 389666 - protein, 11 aa, Influenza virus
NGWEGLIDGWY

SEQ ID NO: 389667 - protein, 11 aa, Influenza virus
GWEGLIDGWYG

SEQ ID NO: 389668 - protein, 11 aa, Influenza virus
WEGLIDGWYGF

SEQ ID NO: 389669 - protein, 11 aa, Influenza virus
EGLIDGWYGFR

SEQ ID NO: 389670 - protein, 11 aa, Influenza virus
GLIDGWYGFRH

SEQ ID NO: 389671 - protein, 11 aa, Influenza virus
LIDGWYGFRHQ

SEQ ID NO: 389672 - protein, 11 aa, Influenza virus
IDGWYGFRHQN

SEQ ID NO: 389673 - protein, 11 aa, Influenza virus
DGWYGFRHQNA

SEQ ID NO: 389674 - protein, 11 aa, Influenza virus
GWYGFRHQNAQ

SEQ ID NO: 389675 - protein, 11 aa, Influenza virus
WYGFRHQNAQG

SEQ ID NO: 389676 - protein, 11 aa, Influenza virus
YGFRHQNAQGQ

SEQ ID NO: 389677 - protein, 11 aa, Influenza virus
GFRHQNAQGQG

SEQ ID NO: 389678 - protein, 11 aa, Influenza virus
FRHQNAQGQGT

SEQ ID NO: 389679 - protein, 11 aa, Influenza virus
RHQNAQGQGTA

SEQ ID NO: 389680 - protein, 11 aa, Influenza virus
HQNAQGQGTAA

SEQ ID NO: 389681 - protein, 11 aa, Influenza virus
QNAQGQGTAAD

SEQ ID NO: 389682 - protein, 11 aa, Influenza virus
NAQGQGTAADY

SEQ ID NO: 389683 - protein, 11 aa, Influenza virus
AQGQGTAADYK

SEQ ID NO: 389684 - protein, 11 aa, Influenza virus
QGQGTAADYKS

SEQ ID NO: 389685 - protein, 11 aa, Influenza virus
GQGTAADYKST

SEQ ID NO: 389686 - protein, 11 aa, Influenza virus
QGTAADYKSTQ

SEQ ID NO: 389687 - protein, 11 aa, Influenza virus
GTAADYKSTQA

SEQ ID NO: 389688 - protein, 11 aa, Influenza virus
TAADYKSTQAA

SEQ ID NO: 389689 - protein, 11 aa, Influenza virus
AADYKSTQAAI

SEQ ID NO: 389690 - protein, 11 aa, Influenza virus
ADYKSTQAAID

SEQ ID NO: 389691 - protein, 11 aa, Influenza virus
DYKSTQAAIDQ

SEQ ID NO: 389692 - protein, 11 aa, Influenza virus
YKSTQAAIDQI

SEQ ID NO: 389693 - protein, 11 aa, Influenza virus
KSTQAAIDQIT

SEQ ID NO: 389694 - protein, 11 aa, Influenza virus
STQAAIDQITG

SEQ ID NO: 389695 - protein, 11 aa, Influenza virus
TQAAIDQITGK

SEQ ID NO: 389696 - protein, 11 aa, Influenza virus
QAAIDQITGKL

SEQ ID NO: 389697 - protein, 11 aa, Influenza virus
AAIDQITGKLN

SEQ ID NO: 389698 - protein, 11 aa, Influenza virus
AIDQITGKLNR

SEQ ID NO: 389699 - protein, 11 aa, Influenza virus
IDQITGKLNRL

SEQ ID NO: 389700 - protein, 11 aa, Influenza virus
DQITGKLNRLI

SEQ ID NO: 389701 - protein, 11 aa, Influenza virus
QITGKLNRLIE

SEQ ID NO: 389702 - protein, 11 aa, Influenza virus
ITGKLNRLIEK

SEQ ID NO: 389703 - protein, 11 aa, Influenza virus
TGKLNRLIEKT

SEQ ID NO: 389704 - protein, 11 aa, Influenza virus
GKLNRLIEKTN

SEQ ID NO: 389705 - protein, 11 aa, Influenza virus
KLNRLIEKTNK

SEQ ID NO: 389706 - protein, 11 aa, Influenza virus
LNRLIEKTNKQ

SEQ ID NO: 389707 - protein, 11 aa, Influenza virus
NRLIEKTNKQF

SEQ ID NO: 389708 - protein, 11 aa, Influenza virus
RLIEKTNKQFE

SEQ ID NO: 389709 - protein, 11 aa, Influenza virus
LIEKTNKQFEL

SEQ ID NO: 389710 - protein, 11 aa, Influenza virus
IEKTNKQFELI

SEQ ID NO: 389711 - protein, 11 aa, Influenza virus
EKTNKQFELID

SEQ ID NO: 389712 - protein, 11 aa, Influenza virus
KTNKQFELIDN

SEQ ID NO: 389713 - protein, 11 aa, Influenza virus
TNKQFELIDNE

SEQ ID NO: 389714 - protein, 11 aa, Influenza virus
NKQFELIDNEF

SEQ ID NO: 389715 - protein, 11 aa, Influenza virus
KQFELIDNEFT

SEQ ID NO: 389716 - protein, 11 aa, Influenza virus
QFELIDNEFTE

SEQ ID NO: 389717 - protein, 11 aa, Influenza virus
FELIDNEFTEV

SEQ ID NO: 389718 - protein, 11 aa, Influenza virus
ELIDNEFTEVE

SEQ ID NO: 389719 - protein, 11 aa, Influenza virus
LIDNEFTEVEQ

SEQ ID NO: 389720 - protein, 11 aa, Influenza virus
IDNEFTEVEQQ

SEQ ID NO: 389721 - protein, 11 aa, Influenza virus
DNEFTEVEQQI

SEQ ID NO: 389722 - protein, 11 aa, Influenza virus
NEFTEVEQQIG

SEQ ID NO: 389723 - protein, 11 aa, Influenza virus
EFTEVEQQIGN

SEQ ID NO: 389724 - protein, 11 aa, Influenza virus
FTEVEQQIGNV

SEQ ID NO: 389725 - protein, 11 aa, Influenza virus
TEVEQQIGNVI

SEQ ID NO: 389726 - protein, 11 aa, Influenza virus
EVEQQIGNVIN

SEQ ID NO: 389727 - protein, 11 aa, Influenza virus
VEQQIGNVINW

SEQ ID NO: 389728 - protein, 11 aa, Influenza virus
EQQIGNVINWT

SEQ ID NO: 389729 - protein, 11 aa, Influenza virus
QQIGNVINWTR

SEQ ID NO: 389730 - protein, 11 aa, Influenza virus
QIGNVINWTRD

SEQ ID NO: 389731 - protein, 11 aa, Influenza virus
IGNVINWTRDS

SEQ ID NO: 389732 - protein, 11 aa, Influenza virus
GNVINWTRDSL

SEQ ID NO: 389733 - protein, 11 aa, Influenza virus
NVINWTRDSLT

SEQ ID NO: 389734 - protein, 11 aa, Influenza virus
VINWTRDSLTE

SEQ ID NO: 389735 - protein, 11 aa, Influenza virus
INWTRDSLTEI

SEQ ID NO: 389736 - protein, 11 aa, Influenza virus
NWTRDSLTEIW

SEQ ID NO: 389737 - protein, 11 aa, Influenza virus
WTRDSLTEIWS

SEQ ID NO: 389738 - protein, 11 aa, Influenza virus
TRDSLTEIWSY

SEQ ID NO: 389739 - protein, 11 aa, Influenza virus
RDSLTEIWSYN

SEQ ID NO: 389740 - protein, 11 aa, Influenza virus
DSLTEIWSYNA

SEQ ID NO: 389741 - protein, 11 aa, Influenza virus
SLTEIWSYNAE

SEQ ID NO: 389742 - protein, 11 aa, Influenza virus
LTEIWSYNAEL

SEQ ID NO: 389743 - protein, 11 aa, Influenza virus
TEIWSYNAELL

SEQ ID NO: 389744 - protein, 11 aa, Influenza virus
EIWSYNAELLV

SEQ ID NO: 389745 - protein, 11 aa, Influenza virus
IWSYNAELLVA

SEQ ID NO: 389746 - protein, 11 aa, Influenza virus
WSYNAELLVAM

SEQ ID NO: 389747 - protein, 11 aa, Influenza virus
SYNAELLVAME

SEQ ID NO: 389748 - protein, 11 aa, Influenza virus
YNAELLVAMEN

SEQ ID NO: 389749 - protein, 11 aa, Influenza virus
NAELLVAMENQ

SEQ ID NO: 389750 - protein, 11 aa, Influenza virus
AELLVAMENQH

SEQ ID NO: 389751 - protein, 11 aa, Influenza virus
ELLVAMENQHT

SEQ ID NO: 389752 - protein, 11 aa, Influenza virus
LLVAMENQHTI

SEQ ID NO: 389753 - protein, 11 aa, Influenza virus
LVAMENQHTID

SEQ ID NO: 389754 - protein, 11 aa, Influenza virus
VAMENQHTIDL

SEQ ID NO: 389755 - protein, 11 aa, Influenza virus
AMENQHTIDLA

SEQ ID NO: 389756 - protein, 11 aa, Influenza virus
MENQHTIDLAD

SEQ ID NO: 389757 - protein, 11 aa, Influenza virus
ENQHTIDLADS

SEQ ID NO: 389758 - protein, 11 aa, Influenza virus
NQHTIDLADSE

SEQ ID NO: 389759 - protein, 11 aa, Influenza virus
QHTIDLADSEM

SEQ ID NO: 389760 - protein, 11 aa, Influenza virus
HTIDLADSEMN

SEQ ID NO: 389761 - protein, 11 aa, Influenza virus
TIDLADSEMNK

SEQ ID NO: 389762 - protein, 11 aa, Influenza virus
IDLADSEMNKL

SEQ ID NO: 389763 - protein, 11 aa, Influenza virus
DLADSEMNKLY

SEQ ID NO: 389764 - protein, 11 aa, Influenza virus
LADSEMNKLYE

SEQ ID NO: 389765 - protein, 11 aa, Influenza virus
ADSEMNKLYER

SEQ ID NO: 389766 - protein, 11 aa, Influenza virus
DSEMNKLYERV

SEQ ID NO: 389767 - protein, 11 aa, Influenza virus
SEMNKLYERVR

SEQ ID NO: 389768 - protein, 11 aa, Influenza virus
EMNKLYERVRR

SEQ ID NO: 389769 - protein, 11 aa, Influenza virus
MNKLYERVRRQ

SEQ ID NO: 389770 - protein, 11 aa, Influenza virus
NKLYERVRRQL

SEQ ID NO: 389771 - protein, 11 aa, Influenza virus
KLYERVRRQLR

SEQ ID NO: 389772 - protein, 11 aa, Influenza virus
LYERVRRQLRE

SEQ ID NO: 389773 - protein, 11 aa, Influenza virus
YERVRRQLREN

SEQ ID NO: 389774 - protein, 11 aa, Influenza virus
ERVRRQLRENA

SEQ ID NO: 389775 - protein, 11 aa, Influenza virus
RVRRQLRENAE

SEQ ID NO: 389776 - protein, 11 aa, Influenza virus
VRRQLRENAEE

SEQ ID NO: 389777 - protein, 11 aa, Influenza virus
RRQLRENAEED

SEQ ID NO: 389778 - protein, 11 aa, Influenza virus
RQLRENAEEDG

SEQ ID NO: 389779 - protein, 11 aa, Influenza virus
QLRENAEEDGT

SEQ ID NO: 389780 - protein, 11 aa, Influenza virus
LRENAEEDGTG

SEQ ID NO: 389781 - protein, 11 aa, Influenza virus
RENAEEDGTGC

SEQ ID NO: 389782 - protein, 11 aa, Influenza virus
ENAEEDGTGCF

SEQ ID NO: 389783 - protein, 11 aa, Influenza virus
NAEEDGTGCFE

SEQ ID NO: 389784 - protein, 11 aa, Influenza virus
AEEDGTGCFEI

SEQ ID NO: 389785 - protein, 11 aa, Influenza virus
EEDGTGCFEIF

SEQ ID NO: 389786 - protein, 11 aa, Influenza virus
EDGTGCFEIFH

SEQ ID NO: 389787 - protein, 11 aa, Influenza virus
DGTGCFEIFHR

SEQ ID NO: 389788 - protein, 11 aa, Influenza virus
GTGCFEIFHRC

SEQ ID NO: 389789 - protein, 11 aa, Influenza virus
TGCFEIFHRCD

SEQ ID NO: 389790 - protein, 11 aa, Influenza virus
GCFEIFHRCDD

SEQ ID NO: 389791 - protein, 11 aa, Influenza virus
CFEIFHRCDDQ

SEQ ID NO: 389792 - protein, 11 aa, Influenza virus
FEIFHRCDDQC

SEQ ID NO: 389793 - protein, 11 aa, Influenza virus
EIFHRCDDQCM

SEQ ID NO: 389794 - protein, 11 aa, Influenza virus
IFHRCDDQCME

SEQ ID NO: 389795 - protein, 11 aa, Influenza virus
FHRCDDQCMES

SEQ ID NO: 389796 - protein, 11 aa, Influenza virus
HRCDDQCMESI

SEQ ID NO: 389797 - protein, 11 aa, Influenza virus
RCDDQCMESIR

SEQ ID NO: 389798 - protein, 11 aa, Influenza virus
CDDQCMESIRN

SEQ ID NO: 389799 - protein, 11 aa, Influenza virus
DDQCMESIRNN

SEQ ID NO: 389800 - protein, 11 aa, Influenza virus
DQCMESIRNNT

SEQ ID NO: 389801 - protein, 11 aa, Influenza virus
QCMESIRNNTY

SEQ ID NO: 389802 - protein, 11 aa, Influenza virus
CMESIRNNTYN

SEQ ID NO: 389803 - protein, 11 aa, Influenza virus
MESIRNNTYNH

SEQ ID NO: 389804 - protein, 11 aa, Influenza virus
ESIRNNTYNHT

SEQ ID NO: 389805 - protein, 11 aa, Influenza virus
SIRNNTYNHTE

SEQ ID NO: 389806 - protein, 11 aa, Influenza virus
IRNNTYNHTEY

SEQ ID NO: 389807 - protein, 11 aa, Influenza virus
RNNTYNHTEYR

SEQ ID NO: 389808 - protein, 11 aa, Influenza virus
NNTYNHTEYRQ

SEQ ID NO: 389809 - protein, 11 aa, Influenza virus
NTYNHTEYRQE

SEQ ID NO: 389810 - protein, 11 aa, Influenza virus
TYNHTEYRQEA

SEQ ID NO: 389811 - protein, 11 aa, Influenza virus
YNHTEYRQEAL

SEQ ID NO: 389812 - protein, 11 aa, Influenza virus
NHTEYRQEALQ

SEQ ID NO: 389813 - protein, 11 aa, Influenza virus
HTEYRQEALQN

SEQ ID NO: 389814 - protein, 11 aa, Influenza virus
TEYRQEALQNR

SEQ ID NO: 389815 - protein, 11 aa, Influenza virus
EYRQEALQNRI

SEQ ID NO: 389816 - protein, 11 aa, Influenza virus
YRQEALQNRIM

SEQ ID NO: 389817 - protein, 11 aa, Influenza virus
RQEALQNRIMI

SEQ ID NO: 389818 - protein, 11 aa, Influenza virus
QEALQNRIMIN

SEQ ID NO: 389819 - protein, 11 aa, Influenza virus
EALQNRIMINP

SEQ ID NO: 389820 - protein, 11 aa, Influenza virus
ALQNRIMINPV

SEQ ID NO: 389821 - protein, 11 aa, Influenza virus
LQNRIMINPVK

SEQ ID NO: 389822 - protein, 11 aa, Influenza virus
QNRIMINPVKL

SEQ ID NO: 389823 - protein, 11 aa, Influenza virus
NRIMINPVKLS

SEQ ID NO: 389824 - protein, 11 aa, Influenza virus
RIMINPVKLSS

SEQ ID NO: 389825 - protein, 11 aa, Influenza virus
IMINPVKLSSG

SEQ ID NO: 389826 - protein, 11 aa, Influenza virus
MINPVKLSSGY

SEQ ID NO: 389827 - protein, 11 aa, Influenza virus
INPVKLSSGYK

SEQ ID NO: 389828 - protein, 11 aa, Influenza virus
NPVKLSSGYKD

SEQ ID NO: 389829 - protein, 11 aa, Influenza virus
PVKLSSGYKDV

SEQ ID NO: 389830 - protein, 11 aa, Influenza virus
VKLSSGYKDVI

SEQ ID NO: 389831 - protein, 11 aa, Influenza virus
KLSSGYKDVIL

SEQ ID NO: 389832 - protein, 11 aa, Influenza virus
LSSGYKDVILW

SEQ ID NO: 389833 - protein, 11 aa, Influenza virus
SSGYKDVILWF

SEQ ID NO: 389834 - protein, 11 aa, Influenza virus
SGYKDVILWFS

SEQ ID NO: 389835 - protein, 11 aa, Influenza virus
GYKDVILWFSF

SEQ ID NO: 389836 - protein, 11 aa, Influenza virus
YKDVILWFSFG

SEQ ID NO: 389837 - protein, 11 aa, Influenza virus
KDVILWFSFGA

SEQ ID NO: 389838 - protein, 11 aa, Influenza virus
DVILWFSFGAS

SEQ ID NO: 389839 - protein, 11 aa, Influenza virus
VILWFSFGASC

SEQ ID NO: 389840 - protein, 11 aa, Influenza virus
ILWFSFGASCV

SEQ ID NO: 389841 - protein, 11 aa, Influenza virus
LWFSFGASCVM

SEQ ID NO: 389842 - protein, 11 aa, Influenza virus
WFSFGASCVML

SEQ ID NO: 389843 - protein, 11 aa, Influenza virus
FSFGASCVMLL

SEQ ID NO: 389844 - protein, 11 aa, Influenza virus
SFGASCVMLLA

SEQ ID NO: 389845 - protein, 11 aa, Influenza virus
FGASCVMLLAI

SEQ ID NO: 389846 - protein, 11 aa, Influenza virus
GASCVMLLAIA

SEQ ID NO: 389847 - protein, 11 aa, Influenza virus
ASCVMLLAIAM

SEQ ID NO: 389848 - protein, 11 aa, Influenza virus
SCVMLLAIAMG

SEQ ID NO: 389849 - protein, 11 aa, Influenza virus
CVMLLAIAMGL

SEQ ID NO: 389850 - protein, 11 aa, Influenza virus
VMLLAIAMGLI

SEQ ID NO: 389851 - protein, 11 aa, Influenza virus
MLLAIAMGLIF

SEQ ID NO: 389852 - protein, 11 aa, Influenza virus
LLAIAMGLIFM

SEQ ID NO: 389853 - protein, 11 aa, Influenza virus
LAIAMGLIFMC

SEQ ID NO: 389854 - protein, 11 aa, Influenza virus
AIAMGLIFMCV

SEQ ID NO: 389855 - protein, 11 aa, Influenza virus
IAMGLIFMCVK

SEQ ID NO: 389856 - protein, 11 aa, Influenza virus
AMGLIFMCVKN

SEQ ID NO: 389857 - protein, 11 aa, Influenza virus
MGLIFMCVKNG

SEQ ID NO: 389858 - protein, 11 aa, Influenza virus
GLIFMCVKNGN

SEQ ID NO: 389859 - protein, 11 aa, Influenza virus
LIFMCVKNGNL

SEQ ID NO: 389860 - protein, 11 aa, Influenza virus
IFMCVKNGNLR

SEQ ID NO: 389861 - protein, 11 aa, Influenza virus
FMCVKNGNLRC

SEQ ID NO: 389862 - protein, 11 aa, Influenza virus
MCVKNGNLRCT

SEQ ID NO: 389863 - protein, 11 aa, Influenza virus
CVKNGNLRCTI

SEQ ID NO: 389864 - protein, 11 aa, Influenza virus
VKNGNLRCTIC

SEQ ID NO: 389865 - protein, 11 aa, Influenza virus
KNGNLRCTICI

SEQ ID NO: 389866 - protein, 11 aa, Influenza virus
QPNDGQVLYFL

SEQ ID NO: 389867 - protein, 11 aa, Influenza virus
PNDGQVLYFLI

SEQ ID NO: 389868 - protein, 11 aa, Influenza virus
GRYSKADKICI

SEQ ID NO: 389869 - protein, 11 aa, Influenza virus
RYSKADKICIG

SEQ ID NO: 389870 - protein, 11 aa, Influenza virus
YSKADKICIGY

SEQ ID NO: 389871 - protein, 11 aa, Influenza virus
SKADKICIGYL

SEQ ID NO: 389872 - protein, 11 aa, Influenza virus
KADKICIGYLS

SEQ ID NO: 389873 - protein, 11 aa, Influenza virus
ADKICIGYLSN

SEQ ID NO: 389874 - protein, 11 aa, Influenza virus
DKICIGYLSNN

SEQ ID NO: 389875 - protein, 11 aa, Influenza virus
KICIGYLSNNS

SEQ ID NO: 389876 - protein, 11 aa, Influenza virus
ICIGYLSNNSS

SEQ ID NO: 389877 - protein, 11 aa, Influenza virus
CIGYLSNNSSD

SEQ ID NO: 389878 - protein, 11 aa, Influenza virus
IGYLSNNSSDT

SEQ ID NO: 389879 - protein, 11 aa, Influenza virus
GYLSNNSSDTV

SEQ ID NO: 389880 - protein, 11 aa, Influenza virus
YLSNNSSDTVD

SEQ ID NO: 389881 - protein, 11 aa, Influenza virus
LSNNSSDTVDT

SEQ ID NO: 389882 - protein, 11 aa, Influenza virus
SNNSSDTVDTL

SEQ ID NO: 389883 - protein, 11 aa, Influenza virus
NNSSDTVDTLT

SEQ ID NO: 389884 - protein, 11 aa, Influenza virus
NSSDTVDTLTE

SEQ ID NO: 389885 - protein, 11 aa, Influenza virus
SDTVDTLTENG

SEQ ID NO: 389886 - protein, 11 aa, Influenza virus
DTVDTLTENGV

SEQ ID NO: 389887 - protein, 11 aa, Influenza virus
TVDTLTENGVP

SEQ ID NO: 389888 - protein, 11 aa, Influenza virus
VDTLTENGVPV

SEQ ID NO: 389889 - protein, 11 aa, Influenza virus
DTLTENGVPVT

SEQ ID NO: 389890 - protein, 11 aa, Influenza virus
TLTENGVPVTS

SEQ ID NO: 389891 - protein, 11 aa, Influenza virus
LTENGVPVTSS

SEQ ID NO: 389892 - protein, 11 aa, Influenza virus
TENGVPVTSSI

SEQ ID NO: 389893 - protein, 11 aa, Influenza virus
ENGVPVTSSID

SEQ ID NO: 389894 - protein, 11 aa, Influenza virus
NGVPVTSSIDL

SEQ ID NO: 389895 - protein, 11 aa, Influenza virus
GVPVTSSVDLV

SEQ ID NO: 389896 - protein, 11 aa, Influenza virus
VPVTSSVDLVE

SEQ ID NO: 389897 - protein, 11 aa, Influenza virus
PVTSSVDLVET

SEQ ID NO: 389898 - protein, 11 aa, Influenza virus
VTSSVDLVETN

SEQ ID NO: 389899 - protein, 11 aa, Influenza virus
TSSVDLVETNH

SEQ ID NO: 389900 - protein, 11 aa, Influenza virus
SSVDLVETNHT

SEQ ID NO: 389901 - protein, 11 aa, Influenza virus
SVDLVETNHTG

SEQ ID NO: 389902 - protein, 11 aa, Influenza virus
VDLVETNHTGT

SEQ ID NO: 389903 - protein, 11 aa, Influenza virus
DLVETNHTGTY

SEQ ID NO: 389904 - protein, 11 aa, Influenza virus
LVETNHTGTYC

SEQ ID NO: 389905 - protein, 11 aa, Influenza virus
VETNHTGTYCS

SEQ ID NO: 389906 - protein, 11 aa, Influenza virus
ETNHTGTYCSL

SEQ ID NO: 389907 - protein, 11 aa, Influenza virus
TNHTGTYCSLN

SEQ ID NO: 389908 - protein, 11 aa, Influenza virus
NHTGTYCSLNG

SEQ ID NO: 389909 - protein, 11 aa, Influenza virus
HTGTYCSLNGV

SEQ ID NO: 389910 - protein, 11 aa, Influenza virus
TGTYCSLNGVS

SEQ ID NO: 389911 - protein, 11 aa, Influenza virus
GTYCSLNGVSP

SEQ ID NO: 389912 - protein, 11 aa, Influenza virus
TYCSLNGVSPI

SEQ ID NO: 389913 - protein, 11 aa, Influenza virus
YCSLNGVSPIH

SEQ ID NO: 389914 - protein, 11 aa, Influenza virus
CSLNGVSPIHL

SEQ ID NO: 389915 - protein, 11 aa, Influenza virus
SLNGVSPIHLG

SEQ ID NO: 389916 - protein, 11 aa, Influenza virus
LNGVSPIHLGD

SEQ ID NO: 389917 - protein, 11 aa, Influenza virus
NGVSPIHLGDC

SEQ ID NO: 389918 - protein, 11 aa, Influenza virus
GVSPIHLGDCS

SEQ ID NO: 389919 - protein, 11 aa, Influenza virus
VSPIHLGDCSF

SEQ ID NO: 389920 - protein, 11 aa, Influenza virus
SPIHLGDCSFE

SEQ ID NO: 389921 - protein, 11 aa, Influenza virus
PIHLGDCSFEG

SEQ ID NO: 389922 - protein, 11 aa, Influenza virus
IHLGDCSFEGW

SEQ ID NO: 389923 - protein, 11 aa, Influenza virus
HLGDCSFEGWI

SEQ ID NO: 389924 - protein, 11 aa, Influenza virus
LGDCSFEGWIV

SEQ ID NO: 389925 - protein, 11 aa, Influenza virus
GDCSFEGWIVG

SEQ ID NO: 389926 - protein, 11 aa, Influenza virus
DCSFEGWIVGN

SEQ ID NO: 389927 - protein, 11 aa, Influenza virus
CSFEGWIVGNP

SEQ ID NO: 389928 - protein, 11 aa, Influenza virus
SFEGWIVGNPS

SEQ ID NO: 389929 - protein, 11 aa, Influenza virus
FEGWIVGNPSC

SEQ ID NO: 389930 - protein, 11 aa, Influenza virus
EGWIVGNPSCA

SEQ ID NO: 389931 - protein, 11 aa, Influenza virus
GWIVGNPSCAT

SEQ ID NO: 389932 - protein, 11 aa, Influenza virus
WIVGNPSCATN

SEQ ID NO: 389933 - protein, 11 aa, Influenza virus
IVGNPSCATNI

SEQ ID NO: 389934 - protein, 11 aa, Influenza virus
VGNPSCATNIN

SEQ ID NO: 389935 - protein, 11 aa, Influenza virus
GNPSCATNINI

SEQ ID NO: 389936 - protein, 11 aa, Influenza virus
NPSCATNINIR

SEQ ID NO: 389937 - protein, 11 aa, Influenza virus
PSCATNINIRE

SEQ ID NO: 389938 - protein, 11 aa, Influenza virus
SCATNINIREW

SEQ ID NO: 389939 - protein, 11 aa, Influenza virus
CATNINIREWS

SEQ ID NO: 389940 - protein, 11 aa, Influenza virus
ATNINIREWSY

SEQ ID NO: 389941 - protein, 11 aa, Influenza virus
TNINIREWSYL

SEQ ID NO: 389942 - protein, 11 aa, Influenza virus
NINIREWSYLI

SEQ ID NO: 389943 - protein, 11 aa, Influenza virus
INIREWSYLIE

SEQ ID NO: 389944 - protein, 11 aa, Influenza virus
NIREWSYLIED

SEQ ID NO: 389945 - protein, 11 aa, Influenza virus
IREWSYLIEDP

SEQ ID NO: 389946 - protein, 11 aa, Influenza virus
REWSYLIEDPN

SEQ ID NO: 389947 - protein, 11 aa, Influenza virus
EWSYLIEDPNA

SEQ ID NO: 389948 - protein, 11 aa, Influenza virus
WSYLIEDPNAP

SEQ ID NO: 389949 - protein, 11 aa, Influenza virus
SYLIEDPNAPN

SEQ ID NO: 389950 - protein, 11 aa, Influenza virus
YLIEDPNAPNK

SEQ ID NO: 389951 - protein, 11 aa, Influenza virus
LIEDPNAPNKL

SEQ ID NO: 389952 - protein, 11 aa, Influenza virus
IEDPNAPNKLC

SEQ ID NO: 389953 - protein, 11 aa, Influenza virus
EDPNAPHKLCF

SEQ ID NO: 389954 - protein, 11 aa, Influenza virus
DPNAPNKLCFP

SEQ ID NO: 389955 - protein, 11 aa, Influenza virus
PNAPNKLCFPG

SEQ ID NO: 389956 - protein, 11 aa, Influenza virus
NAPNKLCFPGE

SEQ ID NO: 389957 - protein, 11 aa, Influenza virus
KLCFPGELDNN

SEQ ID NO: 389958 - protein, 11 aa, Influenza virus
LCFPGELDNNG

SEQ ID NO: 389959 - protein, 11 aa, Influenza virus
CFPGELDNNGE

SEQ ID NO: 389960 - protein, 11 aa, Influenza virus
FPGELDNNGEL

SEQ ID NO: 389961 - protein, 11 aa, Influenza virus
PGELDNNGELR

SEQ ID NO: 389962 - protein, 11 aa, Influenza virus
GELDNNGELRH

SEQ ID NO: 389963 - protein, 11 aa, Influenza virus
ELDNNGELRHL

SEQ ID NO: 389964 - protein, 11 aa, Influenza virus
LDNNGELRHLF

SEQ ID NO: 389965 - protein, 11 aa, Influenza virus
DNNGELRHLFS

SEQ ID NO: 389966 - protein, 11 aa, Influenza virus
NNGELRHLFSG

SEQ ID NO: 389967 - protein, 11 aa, Influenza virus
NGELRHLFSGV

SEQ ID NO: 389968 - protein, 11 aa, Influenza virus
GELRHLFSGVN

SEQ ID NO: 389969 - protein, 11 aa, Influenza virus
ELRHLFSGVNS

SEQ ID NO: 389970 - protein, 11 aa, Influenza virus
LRHLFSGVNSF

SEQ ID NO: 389971 - protein, 11 aa, Influenza virus
RHLFSGVNSFS

SEQ ID NO: 389972 - protein, 11 aa, Influenza virus
HLFSGVNSFSR

SEQ ID NO: 389973 - protein, 11 aa, Influenza virus
LFSGVNSFSRT

SEQ ID NO: 389974 - protein, 11 aa, Influenza virus
FSGVNSFSRTE

SEQ ID NO: 389975 - protein, 11 aa, Influenza virus
SGVNSFSRTEL

SEQ ID NO: 389976 - protein, 11 aa, Influenza virus
GVNSFSRTELI

SEQ ID NO: 389977 - protein, 11 aa, Influenza virus
VNSFSRTELIS

SEQ ID NO: 389978 - protein, 11 aa, Influenza virus
NSFSRTELISP

SEQ ID NO: 389979 - protein, 11 aa, Influenza virus
SFSRTELISPS

SEQ ID NO: 389980 - protein, 11 aa, Influenza virus
FSRTELISPSK

SEQ ID NO: 389981 - protein, 11 aa, Influenza virus
SRTELISPSKW

SEQ ID NO: 389982 - protein, 11 aa, Influenza virus
RTELISPSKWG

SEQ ID NO: 389983 - protein, 11 aa, Influenza virus
PSKWGNVLDGV

SEQ ID NO: 389984 - protein, 11 aa, Influenza virus
SKWGNVLDGVT

SEQ ID NO: 389985 - protein, 11 aa, Influenza virus
KWGNVLDGVTA

SEQ ID NO: 389986 - protein, 11 aa, Influenza virus
WGNVLDGVTAS

SEQ ID NO: 389987 - protein, 11 aa, Influenza virus
GNVLDGVTASC

SEQ ID NO: 389988 - protein, 11 aa, Influenza virus
NVLDGVTASCL

SEQ ID NO: 389989 - protein, 11 aa, Influenza virus
VLDGVTASCLD

SEQ ID NO: 389990 - protein, 11 aa, Influenza virus
LDGVTASCLDR

SEQ ID NO: 389991 - protein, 11 aa, Influenza virus
DGVTASCLDRG

SEQ ID NO: 389992 - protein, 11 aa, Influenza virus
GVTASCLDRGA

SEQ ID NO: 389993 - protein, 11 aa, Influenza virus
SFYRNLVWLVK

SEQ ID NO: 389994 - protein, 11 aa, Influenza virus
IGEYPVVKGEY

SEQ ID NO: 389995 - protein, 11 aa, Influenza virus
VKGDYNNTTGR

SEQ ID NO: 389996 - protein, 11 aa, Influenza virus
KGDYNNTTGRD

SEQ ID NO: 389997 - protein, 11 aa, Influenza virus
GDYNNTTGRDV

SEQ ID NO: 389998 - protein, 11 aa, Influenza virus
DYNNTTGRDVL

SEQ ID NO: 389999 - protein, 11 aa, Influenza virus
YNNTTGRDVLV

SEQ ID NO: 390000 - protein, 11 aa, Influenza virus
NNTTGRDVLVL

SEQ ID NO: 390001 - protein, 11 aa, Influenza virus
NTTGRDVLVLW

SEQ ID NO: 390002 - protein, 11 aa, Influenza virus
TTGRDVLVLWG

SEQ ID NO: 390003 - protein, 11 aa, Influenza virus
TGRDVLVLWGI

SEQ ID NO: 390004 - protein, 11 aa, Influenza virus
GRDVLVLWGIH

SEQ ID NO: 390005 - protein, 11 aa, Influenza virus
RDVLVLWGIHH

SEQ ID NO: 390006 - protein, 11 aa, Influenza virus
DVLVLWGIHHP

SEQ ID NO: 390007 - protein, 11 aa, Influenza virus
VLVLWGIHHPD

SEQ ID NO: 390008 - protein, 11 aa, Influenza virus
LVLWGIHHPDT

SEQ ID NO: 390009 - protein, 11 aa, Influenza virus
VLWGIHHPDTE

SEQ ID NO: 390010 - protein, 11 aa, Influenza virus
LWGIHHPDTET

SEQ ID NO: 390011 - protein, 11 aa, Influenza virus
WGIHHPDTETT

SEQ ID NO: 390012 - protein, 11 aa, Influenza virus
GIHHPDTETTA

SEQ ID NO: 390013 - protein, 11 aa, Influenza virus
ATNLYVNKNPY

SEQ ID NO: 390014 - protein, 11 aa, Influenza virus
TNLYVNKNPYT

SEQ ID NO: 390015 - protein, 11 aa, Influenza virus
KLYVNKNPYTL

SEQ ID NO: 390016 - protein, 11 aa, Influenza virus
LYVNKNPYTLV

SEQ ID NO: 390017 - protein, 11 aa, Influenza virus
YVNKNPYTLVS

SEQ ID NO: 390018 - protein, 11 aa, Influenza virus
VNKNPYTLVST

SEQ ID NO: 390019 - protein, 11 aa, Influenza virus
NKNPYTLVSTK

SEQ ID NO: 390020 - protein, 11 aa, Influenza virus
KNPYTLVSTKE

SEQ ID NO: 390021 - protein, 11 aa, Influenza virus
NPYTLVSTKEW

SEQ ID NO: 390022 - protein, 11 aa, Influenza virus
PYTLVSTKEWS

SEQ ID NO: 390023 - protein, 11 aa, Influenza virus
YTLVSTKEWSK

SEQ ID NO: 390024 - protein, 11 aa, Influenza virus
TLVSTKEWSKR

SEQ ID NO: 390025 - protein, 11 aa, Influenza virus
LVSTKEWSKRY

SEQ ID NO: 390026 - protein, 11 aa, Influenza virus
VSTKEWSKRYE

SEQ ID NO: 390027 - protein, 11 aa, Influenza virus
STKEWSKRYEL

SEQ ID NO: 390028 - protein, 11 aa, Influenza virus
TKEWSKRYELE

SEQ ID NO: 390029 - protein, 11 aa, Influenza virus
KEWSKRYELEI

SEQ ID NO: 390030 - protein, 11 aa, Influenza virus
EWSKRYELEIG

SEQ ID NO: 390031 - protein, 11 aa, Influenza virus
WSKRYELEIGT

SEQ ID NO: 390032 - protein, 11 aa, Influenza virus
SKRYELEIGTR

SEQ ID NO: 390033 - protein, 11 aa, Influenza virus
KRYELEIGTRI

SEQ ID NO: 390034 - protein, 11 aa, Influenza virus
RYELEIGTRIG

SEQ ID NO: 390035 - protein, 11 aa, Influenza virus
YELEIGTRIGD

SEQ ID NO: 390036 - protein, 11 aa, Influenza virus
ELEIGTRIGDG

SEQ ID NO: 390037 - protein, 11 aa, Influenza virus
LEIGTRIGDGQ

SEQ ID NO: 390038 - protein, 11 aa, Influenza virus
EIGTRIGDGQR

SEQ ID NO: 390039 - protein, 11 aa, Influenza virus
IGTRIGDGQRS

SEQ ID NO: 390040 - protein, 11 aa, Influenza virus
GTRIGDGQRSW

SEQ ID NO: 390041 - protein, 11 aa, Influenza virus
TRIGDGQRSWM

SEQ ID NO: 390042 - protein, 11 aa, Influenza virus
RIGDGQRSWMK

SEQ ID NO: 390043 - protein, 11 aa, Influenza virus
IGDGQRSWMKL

SEQ ID NO: 390044 - protein, 11 aa, Influenza virus
GDGQRSWMKLY

SEQ ID NO: 390045 - protein, 11 aa, Influenza virus
DGQRSWMKLYW

SEQ ID NO: 390046 - protein, 11 aa, Influenza virus
GQRSWMKLYWH

SEQ ID NO: 390047 - protein, 11 aa, Influenza virus
QRSWMKLYWHL

SEQ ID NO: 390048 - protein, 11 aa, Influenza virus
RSWMKLYWHLM

SEQ ID NO: 390049 - protein, 11 aa, Influenza virus
SWMKIYWHLMH

SEQ ID NO: 390050 - protein, 11 aa, Influenza virus
WMKIYWHLMHP

SEQ ID NO: 390051 - protein, 11 aa, Influenza virus
MKIYWHLMHPG

SEQ ID NO: 390052 - protein, 11 aa, Influenza virus
KIYWHLMHPGE

SEQ ID NO: 390053 - protein, 11 aa, Influenza virus
IYWHLMHPGER

SEQ ID NO: 390054 - protein, 11 aa, Influenza virus
YWHLMHPGERI

SEQ ID NO: 390055 - protein, 11 aa, Influenza virus
PGERITFESNG

SEQ ID NO: 390056 - protein, 11 aa, Influenza virus
GERITFESNGG

SEQ ID NO: 390057 - protein, 11 aa, Influenza virus
ERITFESNGGL

SEQ ID NO: 390058 - protein, 11 aa, Influenza virus
TFESNGGLLAP

SEQ ID NO: 390059 - protein, 11 aa, Influenza virus
FESNGGLLAPR

SEQ ID NO: 390060 - protein, 11 aa, Influenza virus
ESNGGLLAPRY

SEQ ID NO: 390061 - protein, 11 aa, Influenza virus
SNGGLLAPRYG

SEQ ID NO: 390062 - protein, 11 aa, Influenza virus
NGGLLAPRYGY

SEQ ID NO: 390063 - protein, 11 aa, Influenza virus
GGLLAPRYGYI

SEQ ID NO: 390064 - protein, 11 aa, Influenza virus
GLLAPRYGYII

SEQ ID NO: 390065 - protein, 11 aa, Influenza virus
LLAPRYGYIIE

SEQ ID NO: 390066 - protein, 11 aa, Influenza virus
LAPRYGYIIEK

SEQ ID NO: 390067 - protein, 11 aa, Influenza virus
APRYGYIIEKY

SEQ ID NO: 390068 - protein, 11 aa, Influenza virus
PRYGYIIEKYG

SEQ ID NO: 390069 - protein, 11 aa, Influenza virus
RYGYIIEKYGT

SEQ ID NO: 390070 - protein, 11 aa, Influenza virus
YGYIIEKYGTG

SEQ ID NO: 390071 - protein, 11 aa, Influenza virus
GYIIEKYGTGR

SEQ ID NO: 390072 - protein, 11 aa, Influenza virus
YIIEKYGTGRI

SEQ ID NO: 390073 - protein, 11 aa, Influenza virus
IIEKYGTGRIF

SEQ ID NO: 390074 - protein, 11 aa, Influenza virus
IEKYGTGRIFQ

SEQ ID NO: 390075 - protein, 11 aa, Influenza virus
EKYGTGRIFQS

SEQ ID NO: 390076 - protein, 11 aa, Influenza virus
KYGTGRIFQSG

SEQ ID NO: 390077 - protein, 11 aa, Influenza virus
YGTGRIFQSGV

SEQ ID NO: 390078 - protein, 11 aa, Influenza virus
GTGRIFQSGVR

SEQ ID NO: 390079 - protein, 11 aa, Influenza virus
GRIFQSGVRMA

SEQ ID NO: 390080 - protein, 11 aa, Influenza virus
RMAKCNTKCQT

SEQ ID NO: 390081 - protein, 11 aa, Influenza virus
MAKCNTKCQTS

SEQ ID NO: 390082 - protein, 11 aa, Influenza virus
KCNTKCQTSMG

SEQ ID NO: 390083 - protein, 11 aa, Influenza virus
CNTKCQTSMGG

SEQ ID NO: 390084 - protein, 11 aa, Influenza virus
NTKCQTSVGGI

SEQ ID NO: 390085 - protein, 11 aa, Influenza virus
GGINTNKTFQN

SEQ ID NO: 390086 - protein, 11 aa, Influenza virus
GINTNKTFQNI

SEQ ID NO: 390087 - protein, 11 aa, Influenza virus
INTNKTFQNIE

SEQ ID NO: 390088 - protein, 11 aa, Influenza virus
NTNKTFQNIER

SEQ ID NO: 390089 - protein, 11 aa, Influenza virus
TNKTFQNIERN

SEQ ID NO: 390090 - protein, 11 aa, Influenza virus
NKTFQNIERNA

SEQ ID NO: 390091 - protein, 11 aa, Influenza virus
KTFQNIERNAL

SEQ ID NO: 390092 - protein, 11 aa, Influenza virus
TFQNIERNALG

SEQ ID NO: 390093 - protein, 11 aa, Influenza virus
FQNIERNALGD

SEQ ID NO: 390094 - protein, 11 aa, Influenza virus
QNIERNALGDC

SEQ ID NO: 390095 - protein, 11 aa, Influenza virus
NIERNALGDCP

SEQ ID NO: 390096 - protein, 11 aa, Influenza virus
IERNALGDCPK

SEQ ID NO: 390097 - protein, 11 aa, Influenza virus
ERNALGDCPKY

SEQ ID NO: 390098 - protein, 11 aa, Influenza virus
RNALGDCPKYI

SEQ ID NO: 390099 - protein, 11 aa, Influenza virus
NALGDCPKYIK

SEQ ID NO: 390100 - protein, 11 aa, Influenza virus
ALGDCPKYIKS

SEQ ID NO: 390101 - protein, 11 aa, Influenza virus
LGDCPKYIKSG

SEQ ID NO: 390102 - protein, 11 aa, Influenza virus
GDCPKYIKSGQ

SEQ ID NO: 390103 - protein, 11 aa, Influenza virus
DCPKYIKSGQL

SEQ ID NO: 390104 - protein, 11 aa, Influenza virus
CPKYIKSGQLK

SEQ ID NO: 390105 - protein, 11 aa, Influenza virus
PKYIKSGQLKL

SEQ ID NO: 390106 - protein, 11 aa, Influenza virus
KYIKSGQLKLA

SEQ ID NO: 390107 - protein, 11 aa, Influenza virus
YIKSGQLKLAT

SEQ ID NO: 390108 - protein, 11 aa, Influenza virus
IKSGQLKLATG

SEQ ID NO: 390109 - protein, 11 aa, Influenza virus
KSGQLKLATGL

SEQ ID NO: 390110 - protein, 11 aa, Influenza virus
SGQLKLATGLR

SEQ ID NO: 390111 - protein, 11 aa, Influenza virus
GQLKLATGLRN

SEQ ID NO: 390112 - protein, 11 aa, Influenza virus
QLKLATGLRNV

SEQ ID NO: 390113 - protein, 11 aa, Influenza virus
LKLATGLRNVP

SEQ ID NO: 390114 - protein, 11 aa, Influenza virus
KLATGLRNVPS

SEQ ID NO: 390115 - protein, 11 aa, Influenza virus
LATGLRNVPSI

SEQ ID NO: 390116 - protein, 11 aa, Influenza virus
IPIGERGLFGA

SEQ ID NO: 390117 - protein, 11 aa, Influenza virus
GERGLFGAIAG

SEQ ID NO: 390118 - protein, 11 aa, Influenza virus
ERGLFGAIAGF

SEQ ID NO: 390119 - protein, 11 aa, Influenza virus
RGLFGAIAGFI

SEQ ID NO: 390120 - protein, 11 aa, Influenza virus
GLFGAIAGFIE

SEQ ID NO: 390121 - protein, 11 aa, Influenza virus
LFGAIAGFIEG

SEQ ID NO: 390122 - protein, 11 aa, Influenza virus
FGAIAGFIEGG

SEQ ID NO: 390123 - protein, 11 aa, Influenza virus
GAIAGFIEGGW

SEQ ID NO: 390124 - protein, 11 aa, Influenza virus
AIAGFIEGGWP

SEQ ID NO: 390125 - protein, 11 aa, Influenza virus
IAGFIEGGWPG

SEQ ID NO: 390126 - protein, 11 aa, Influenza virus
AGFIEGGWPGL

SEQ ID NO: 390127 - protein, 11 aa, Influenza virus
GFIEGGWPGLI

SEQ ID NO: 390128 - protein, 11 aa, Influenza virus
FIEGGWPGLIN

SEQ ID NO: 390129 - protein, 11 aa, Influenza virus
IEGGWPGLING

SEQ ID NO: 390130 - protein, 11 aa, Influenza virus
EGGWPGLINGW

SEQ ID NO: 390131 - protein, 11 aa, Influenza virus
GGWPGLINGWY

SEQ ID NO: 390132 - protein, 11 aa, Influenza virus
GWPGLINGWYG

SEQ ID NO: 390133 - protein, 11 aa, Influenza virus
WPGLINGWYGF

SEQ ID NO: 390134 - protein, 11 aa, Influenza virus
PGLINGWYGFQ

SEQ ID NO: 390135 - protein, 11 aa, Influenza virus
GLINGWYGFQH

SEQ ID NO: 390136 - protein, 11 aa, Influenza virus
LINGWYGFQHQ

SEQ ID NO: 390137 - protein, 11 aa, Influenza virus
INGWYGFQHQN

SEQ ID NO: 390138 - protein, 11 aa, Influenza virus
NGWYGFQHQNE

SEQ ID NO: 390139 - protein, 11 aa, Influenza virus
GWYGFQHQNEQ

SEQ ID NO: 390140 - protein, 11 aa, Influenza virus
WYGFQHQNEQG

SEQ ID NO: 390141 - protein, 11 aa, Influenza virus
YGFQHQNEQGT

SEQ ID NO: 390142 - protein, 11 aa, Influenza virus
GFQHQNEQGTG

SEQ ID NO: 390143 - protein, 11 aa, Influenza virus
FQHQNEQGTGI

SEQ ID NO: 390144 - protein, 11 aa, Influenza virus
QHQNEQGTGIA

SEQ ID NO: 390145 - protein, 11 aa, Influenza virus
HQNEQGTGIAA

SEQ ID NO: 390146 - protein, 11 aa, Influenza virus
QNEQGTGIAAD

SEQ ID NO: 390147 - protein, 11 aa, Influenza virus
NEQGTGIAADK

SEQ ID NO: 390148 - protein, 11 aa, Influenza virus
EQGTGIAADKA

SEQ ID NO: 390149 - protein, 11 aa, Influenza virus
QGTGIAADKAS

SEQ ID NO: 390150 - protein, 11 aa, Influenza virus
GTGIAADKAST

SEQ ID NO: 390151 - protein, 11 aa, Influenza virus
TGIAADKASTQ

SEQ ID NO: 390152 - protein, 11 aa, Influenza virus
GIAADKASTQK

SEQ ID NO: 390153 - protein, 11 aa, Influenza virus
IAADKASTQKA

SEQ ID NO: 390154 - protein, 11 aa, Influenza virus
AADKASTQKAI

SEQ ID NO: 390155 - protein, 11 aa, Influenza virus
ADKASTQKAID

SEQ ID NO: 390156 - protein, 11 aa, Influenza virus
DKASTQKAIDE

SEQ ID NO: 390157 - protein, 11 aa, Influenza virus
KASTQKAIDEI

SEQ ID NO: 390158 - protein, 11 aa, Influenza virus
ASTQKAIDEIT

SEQ ID NO: 390159 - protein, 11 aa, Influenza virus
STQKAINEITT

SEQ ID NO: 390160 - protein, 11 aa, Influenza virus
TQKAINEITTK

SEQ ID NO: 390161 - protein, 11 aa, Influenza virus
QKAINEITTKI

SEQ ID NO: 390162 - protein, 11 aa, Influenza virus
KAINEITTKIN

SEQ ID NO: 390163 - protein, 11 aa, Influenza virus
AINEITTKINN

SEQ ID NO: 390164 - protein, 11 aa, Influenza virus
INEITTKINNI

SEQ ID NO: 390165 - protein, 11 aa, Influenza virus
NEITTKINNII

SEQ ID NO: 390166 - protein, 11 aa, Influenza virus
EITTKINNIIE

SEQ ID NO: 390167 - protein, 11 aa, Influenza virus
ITTKINNIIEK

SEQ ID NO: 390168 - protein, 11 aa, Influenza virus
TTKINNIIEKM

SEQ ID NO: 390169 - protein, 11 aa, Influenza virus
TKINNIIEKMN

SEQ ID NO: 390170 - protein, 11 aa, Influenza virus
KINNIIEKMNG

SEQ ID NO: 390171 - protein, 11 aa, Influenza virus
INNIIEKMNGN

SEQ ID NO: 390172 - protein, 11 aa, Influenza virus
NNIIEKMNGNY

SEQ ID NO: 390173 - protein, 11 aa, Influenza virus
NIIEKMNGNYD

SEQ ID NO: 390174 - protein, 11 aa, Influenza virus
IIEKMNGNYDS

SEQ ID NO: 390175 - protein, 11 aa, Influenza virus
IEKMNGNYDSI

SEQ ID NO: 390176 - protein, 11 aa, Influenza virus
EKMNGNYDSIR

SEQ ID NO: 390177 - protein, 11 aa, Influenza virus
KMNGNYDSIRG

SEQ ID NO: 390178 - protein, 11 aa, Influenza virus
MNGNYDSIRGE

SEQ ID NO: 390179 - protein, 11 aa, Influenza virus
NGNYDSIRGEF

SEQ ID NO: 390180 - protein, 11 aa, Influenza virus
GNYDSIRGEFN

SEQ ID NO: 390181 - protein, 11 aa, Influenza virus
NYDSIRGEFNQ

SEQ ID NO: 390182 - protein, 11 aa, Influenza virus
YDSIRGEFNQV

SEQ ID NO: 390183 - protein, 11 aa, Influenza virus
DSIRGEFNQVE

SEQ ID NO: 390184 - protein, 11 aa, Influenza virus
SIRGEFNQVEK

SEQ ID NO: 390185 - protein, 11 aa, Influenza virus
IRGEFNQVEKR

SEQ ID NO: 390186 - protein, 11 aa, Influenza virus
RGEFNQVEKRI

SEQ ID NO: 390187 - protein, 11 aa, Influenza virus
GEFNQVEKRIN

SEQ ID NO: 390188 - protein, 11 aa, Influenza virus
EFNQVEKRINM

SEQ ID NO: 390189 - protein, 11 aa, Influenza virus
FNQVEKRINML

SEQ ID NO: 390190 - protein, 11 aa, Influenza virus
NQVEKRINMLA

SEQ ID NO: 390191 - protein, 11 aa, Influenza virus
QVEKRINMLAD

SEQ ID NO: 390192 - protein, 11 aa, Influenza virus
VEKRINMLADR

SEQ ID NO: 390193 - protein, 11 aa, Influenza virus
EKRINMLADRV

SEQ ID NO: 390194 - protein, 11 aa, Influenza virus
KRINMLADRVD

SEQ ID NO: 390195 - protein, 11 aa, Influenza virus
RINMLADRVDD

SEQ ID NO: 390196 - protein, 11 aa, Influenza virus
INMLADRVDDA

SEQ ID NO: 390197 - protein, 11 aa, Influenza virus
NMLADRVDDAV

SEQ ID NO: 390198 - protein, 11 aa, Influenza virus
MLADRVDDAVT

SEQ ID NO: 390199 - protein, 11 aa, Influenza virus
LADRVDDAVTD

SEQ ID NO: 390200 - protein, 11 aa, Influenza virus
ADRVDDAVTDI

SEQ ID NO: 390201 - protein, 11 aa, Influenza virus
DRVDDAVTDIW

SEQ ID NO: 390202 - protein, 11 aa, Influenza virus
RVDDAVTDIWS

SEQ ID NO: 390203 - protein, 11 aa, Influenza virus
VDDAVTDIWSY

SEQ ID NO: 390204 - protein, 11 aa, Influenza virus
DDAVTDIWSYN

SEQ ID NO: 390205 - protein, 11 aa, Influenza virus
DAVTDIWSYNA

SEQ ID NO: 390206 - protein, 11 aa, Influenza virus
AVTDIWSYNAK

SEQ ID NO: 390207 - protein, 11 aa, Influenza virus
VTDIWSYNAKL

SEQ ID NO: 390208 - protein, 11 aa, Influenza virus
TDIWSYNAKLL

SEQ ID NO: 390209 - protein, 11 aa, Influenza virus
DIWSYNAKLLV

SEQ ID NO: 390210 - protein, 11 aa, Influenza virus
IWSYNAKLLVL

SEQ ID NO: 390211 - protein, 11 aa, Influenza virus
WSYNAKLLVLI

SEQ ID NO: 390212 - protein, 11 aa, Influenza virus
SYNAKLLVLIE

SEQ ID NO: 390213 - protein, 11 aa, Influenza virus
YNAKLLVLIEN

SEQ ID NO: 390214 - protein, 11 aa, Influenza virus
NAKLLVLIEND

SEQ ID NO: 390215 - protein, 11 aa, Influenza virus
AKLLVLIENDR

SEQ ID NO: 390216 - protein, 11 aa, Influenza virus
KLLVLIENDRT

SEQ ID NO: 390217 - protein, 11 aa, Influenza virus
LLVLIENDRTL

SEQ ID NO: 390218 - protein, 11 aa, Influenza virus
LVLIENDRTLD

SEQ ID NO: 390219 - protein, 11 aa, Influenza virus
VLIENDRTLDL

SEQ ID NO: 390220 - protein, 11 aa, Influenza virus
LIENDRTLDLH

SEQ ID NO: 390221 - protein, 11 aa, Influenza virus
IENDRTLDLHD

SEQ ID NO: 390222 - protein, 11 aa, Influenza virus
ENDRTLDLHDA

SEQ ID NO: 390223 - protein, 11 aa, Influenza virus
NDRTLDLHDAN

SEQ ID NO: 390224 - protein, 11 aa, Influenza virus
DRTLDLHDANV

SEQ ID NO: 390225 - protein, 11 aa, Influenza virus
RTLDLHDANVR

SEQ ID NO: 390226 - protein, 11 aa, Influenza virus
TLDLHDANVRN

SEQ ID NO: 390227 - protein, 11 aa, Influenza virus
LDLHDANVRNL

SEQ ID NO: 390228 - protein, 11 aa, Influenza virus
DLHDANVRNLH

SEQ ID NO: 390229 - protein, 11 aa, Influenza virus
LHDANVRNLHD

SEQ ID NO: 390230 - protein, 11 aa, Influenza virus
HDANVRNLHDQ

SEQ ID NO: 390231 - protein, 11 aa, Influenza virus
DANVRNLHDQV

SEQ ID NO: 390232 - protein, 11 aa, Influenza virus
ANVRNLHDQVK

SEQ ID NO: 390233 - protein, 11 aa, Influenza virus
NVRNLHDQVKR

SEQ ID NO: 390234 - protein, 11 aa, Influenza virus
LKNNAIDEGDG

SEQ ID NO: 390235 - protein, 11 aa, Influenza virus
KNNAIDEGDGC

SEQ ID NO: 390236 - protein, 11 aa, Influenza virus
NNAIDEGDGCF

SEQ ID NO: 390237 - protein, 11 aa, Influenza virus
NAIDEGDGCFN

SEQ ID NO: 390238 - protein, 11 aa, Influenza virus
AIDEGDGCFNL

SEQ ID NO: 390239 - protein, 11 aa, Influenza virus
IDEGDGCFNLL

SEQ ID NO: 390240 - protein, 11 aa, Influenza virus
DEGDGCFNLLH

SEQ ID NO: 390241 - protein, 11 aa, Influenza virus
EGDGCFNLLHK

SEQ ID NO: 390242 - protein, 11 aa, Influenza virus
GDGCFNLLHKC

SEQ ID NO: 390243 - protein, 11 aa, Influenza virus
DGCFNLLHKCN

SEQ ID NO: 390244 - protein, 11 aa, Influenza virus
GCFNLLHKCND

SEQ ID NO: 390245 - protein, 11 aa, Influenza virus
CFNLLHKCNDS

SEQ ID NO: 390246 - protein, 11 aa, Influenza virus
FNLLHKCNDSC

SEQ ID NO: 390247 - protein, 11 aa, Influenza virus
NLLHKCNDSCM

SEQ ID NO: 390248 - protein, 11 aa, Influenza virus
LLHKCNDSCME

SEQ ID NO: 390249 - protein, 11 aa, Influenza virus
LHKCNDSCMET

SEQ ID NO: 390250 - protein, 11 aa, Influenza virus
HKCNDSCMETI

SEQ ID NO: 390251 - protein, 11 aa, Influenza virus
KCNDSCMETIR

SEQ ID NO: 390252 - protein, 11 aa, Influenza virus
CNDSCMETIRN

SEQ ID NO: 390253 - protein, 11 aa, Influenza virus
NDSCMETIRNG

SEQ ID NO: 390254 - protein, 11 aa, Influenza virus
DSCMETIRNGT

SEQ ID NO: 390255 - protein, 11 aa, Influenza virus
SCMETIRNGTY

SEQ ID NO: 390256 - protein, 11 aa, Influenza virus
CMETIRNGTYN

SEQ ID NO: 390257 - protein, 11 aa, Influenza virus
METIRNGTYNH

SEQ ID NO: 390258 - protein, 11 aa, Influenza virus
ETIRNGTYNHE

SEQ ID NO: 390259 - protein, 11 aa, Influenza virus
TIRNGTYNHED

SEQ ID NO: 390260 - protein, 11 aa, Influenza virus
IRNGTYNHEDY

SEQ ID NO: 390261 - protein, 11 aa, Influenza virus
RNGTYNHEDYK

SEQ ID NO: 390262 - protein, 11 aa, Influenza virus
NGTYNHEDYKE

SEQ ID NO: 390263 - protein, 11 aa, Influenza virus
GTYNHEDYKEE

SEQ ID NO: 390264 - protein, 11 aa, Influenza virus
TYNHEDYKEES

SEQ ID NO: 390265 - protein, 11 aa, Influenza virus
YNHEDYKEESQ

SEQ ID NO: 390266 - protein, 11 aa, Influenza virus
NHEDYKEESQL

SEQ ID NO: 390267 - protein, 11 aa, Influenza virus
HEDYKEESQLK

SEQ ID NO: 390268 - protein, 11 aa, Influenza virus
EDYKEESQLKR

SEQ ID NO: 390269 - protein, 11 aa, Influenza virus
DYKEESQLKRQ

SEQ ID NO: 390270 - protein, 11 aa, Influenza virus
YKEESQLKRQE

SEQ ID NO: 390271 - protein, 11 aa, Influenza virus
KEESQLKRQEI

SEQ ID NO: 390272 - protein, 11 aa, Influenza virus
EESQLKRQEIE

SEQ ID NO: 390273 - protein, 11 aa, Influenza virus
ESQLKRQEIEG

SEQ ID NO: 390274 - protein, 11 aa, Influenza virus
SQLKRQEIEGI

SEQ ID NO: 390275 - protein, 11 aa, Influenza virus
QLKRQEIEGIK

SEQ ID NO: 390276 - protein, 11 aa, Influenza virus
LKRQEIEGIKL

SEQ ID NO: 390277 - protein, 11 aa, Influenza virus
KRQEIEGIKLK

SEQ ID NO: 390278 - protein, 11 aa, Influenza virus
RQEIEGIKLKT

SEQ ID NO: 390279 - protein, 11 aa, Influenza virus
QEIEGIKLKTE

SEQ ID NO: 390280 - protein, 11 aa, Influenza virus
EIEGIKLKTED

SEQ ID NO: 390281 - protein, 11 aa, Influenza virus
IEGIKLKTEDN

SEQ ID NO: 390282 - protein, 11 aa, Influenza virus
EGIKLKTEDNV

SEQ ID NO: 390283 - protein, 11 aa, Influenza virus
GIKLKTEDNVY

SEQ ID NO: 390284 - protein, 11 aa, Influenza virus
IKLKTEDNVYK

SEQ ID NO: 390285 - protein, 11 aa, Influenza virus
KLKTEDNVYKV

SEQ ID NO: 390286 - protein, 11 aa, Influenza virus
LKTEDNVYKVL

SEQ ID NO: 390287 - protein, 11 aa, Influenza virus
KTEDNVYKVLS

SEQ ID NO: 390288 - protein, 11 aa, Influenza virus
TEDNVYKILSI

SEQ ID NO: 390289 - protein, 11 aa, Influenza virus
EDNVYKVLSIY

SEQ ID NO: 390290 - protein, 11 aa, Influenza virus
DNVYKVLSIYS

SEQ ID NO: 390291 - protein, 11 aa, Influenza virus
NVYKVLSIYSC

SEQ ID NO: 390292 - protein, 11 aa, Influenza virus
VYKVLSIYSCI

SEQ ID NO: 390293 - protein, 11 aa, Influenza virus
YKILSIYSCIA

SEQ ID NO: 390294 - protein, 11 aa, Influenza virus
KILSIYSCIAS

SEQ ID NO: 390295 - protein, 11 aa, Influenza virus
ILSIYSCIASS

SEQ ID NO: 390296 - protein, 11 aa, Influenza virus
LSIYSCIASSI

SEQ ID NO: 390297 - protein, 11 aa, Influenza virus
SIYSCIASSIV

SEQ ID NO: 390298 - protein, 11 aa, Influenza virus
IYSCIASSIVM

SEQ ID NO: 390299 - protein, 11 aa, Influenza virus
YSCIASSIVLV

SEQ ID NO: 390300 - protein, 11 aa, Influenza virus
SCIASSVVLVG

SEQ ID NO: 390301 - protein, 11 aa, Influenza virus
CIASSVVLVGL

SEQ ID NO: 390302 - protein, 11 aa, Influenza virus
IASSIVLVGLI

SEQ ID NO: 390303 - protein, 11 aa, Influenza virus
ASSIVMVGLIL

SEQ ID NO: 390304 - protein, 11 aa, Influenza virus
SSVVLVGLILA

SEQ ID NO: 390305 - protein, 11 aa, Influenza virus
SVVLVGLILAF

SEQ ID NO: 390306 - protein, 11 aa, Influenza virus
VVLVGLILAFI

SEQ ID NO: 390307 - protein, 11 aa, Influenza virus
VLVGLILAFIM

SEQ ID NO: 390308 - protein, 11 aa, Influenza virus
LVGLILAFIMW

SEQ ID NO: 390309 - protein, 11 aa, Influenza virus
VGLILAFIMWA

SEQ ID NO: 390310 - protein, 11 aa, Influenza virus
GLILAFIMWAC

SEQ ID NO: 390311 - protein, 11 aa, Influenza virus
LILAFIMWACS

SEQ ID NO: 390312 - protein, 11 aa, Influenza virus
ILAFIMWACSS

SEQ ID NO: 390313 - protein, 11 aa, Influenza virus
LAFIMWACSSG

SEQ ID NO: 390314 - protein, 11 aa, Influenza virus
AFIMWACSSGN

SEQ ID NO: 390315 - protein, 11 aa, Influenza virus
FIMWACSSGNC

SEQ ID NO: 390316 - protein, 11 aa, Influenza virus
IMWACSSGNCR

SEQ ID NO: 390317 - protein, 11 aa, Influenza virus
MWACSSGNCRF

SEQ ID NO: 390318 - protein, 11 aa, Influenza virus
WACSSGNCRFN

SEQ ID NO: 390319 - protein, 11 aa, Influenza virus
ACSSGNCRFNV

SEQ ID NO: 390320 - protein, 11 aa, Influenza virus
CSSGNCRFNVC

SEQ ID NO: 390321 - protein, 11 aa, Influenza virus
SSGNCRFNVCI

SEQ ID NO: 390322 - protein, 11 aa, Influenza virus
KQGKTKATKMK

SEQ ID NO: 390323 - protein, 11 aa, Influenza virus
QGKTKATKMKA

SEQ ID NO: 390324 - protein, 11 aa, Influenza virus
GKTKATKMKAI

SEQ ID NO: 390325 - protein, 11 aa, Influenza virus
KTKATKMKAIL

SEQ ID NO: 390326 - protein, 11 aa, Influenza virus
TKATKMKAILV

SEQ ID NO: 390327 - protein, 11 aa, Influenza virus
KATKMKAILVV

SEQ ID NO: 390328 - protein, 11 aa, Influenza virus
ATKMKAILVVL

SEQ ID NO: 390329 - protein, 11 aa, Influenza virus
TKMKAILVVLL

SEQ ID NO: 390330 - protein, 11 aa, Influenza virus
TAYSQITNGTT

SEQ ID NO: 390331 - protein, 11 aa, Influenza virus
AYSQITNGTTG

SEQ ID NO: 390332 - protein, 11 aa, Influenza virus
YSQITNGTTGN

SEQ ID NO: 390333 - protein, 11 aa, Influenza virus
SQITNGTTGNP

SEQ ID NO: 390334 - protein, 11 aa, Influenza virus
QITNGTTGNPI

SEQ ID NO: 390335 - protein, 11 aa, Influenza virus
ITNGTTGNPII

SEQ ID NO: 390336 - protein, 11 aa, Influenza virus
TNGTTGNPIIC

SEQ ID NO: 390337 - protein, 11 aa, Influenza virus
NGTTGNPIICL

SEQ ID NO: 390338 - protein, 11 aa, Influenza virus
GTTGNPIICLG

SEQ ID NO: 390339 - protein, 11 aa, Influenza virus
TTGNPIICLGH

SEQ ID NO: 390340 - protein, 11 aa, Influenza virus
TGNPIICLGHH

SEQ ID NO: 390341 - protein, 11 aa, Influenza virus
SNAPSGIEYNG

SEQ ID NO: 390342 - protein, 11 aa, Influenza virus
NAPSGIEYNGK

SEQ ID NO: 390343 - protein, 11 aa, Influenza virus
APSGIEYNGKS

SEQ ID NO: 390344 - protein, 11 aa, Influenza virus
PSGIEYNGKSL

SEQ ID NO: 390345 - protein, 11 aa, Influenza virus
SGIEYNGKSLG

SEQ ID NO: 390346 - protein, 11 aa, Influenza virus
GIEYNGKSLGI

SEQ ID NO: 390347 - protein, 11 aa, Influenza virus
IEYNGKSLGIQ

SEQ ID NO: 390348 - protein, 11 aa, Influenza virus
EYNGKSLGIQS

SEQ ID NO: 390349 - protein, 11 aa, Influenza virus
YNGKSLGIQSD

SEQ ID NO: 390350 - protein, 11 aa, Influenza virus
NGKSLGIQSDA

SEQ ID NO: 390351 - protein, 11 aa, Influenza virus
TSLTSLPFQNI

SEQ ID NO: 390352 - protein, 11 aa, Influenza virus
SLTSLPFQNIH

SEQ ID NO: 390353 - protein, 11 aa, Influenza virus
LTSLPFQNIHP

SEQ ID NO: 390354 - protein, 11 aa, Influenza virus
RGLFGAIAGFI

SEQ ID NO: 390355 - protein, 11 aa, Influenza virus
GLFGAIAGFIE

SEQ ID NO: 390356 - protein, 11 aa, Influenza virus
LFGAIAGFIEG

SEQ ID NO: 390357 - protein, 11 aa, Influenza virus
FGAIAGFIEGG

SEQ ID NO: 390358 - protein, 11 aa, Influenza virus
GAIAGFIEGGW

SEQ ID NO: 390359 - protein, 11 aa, Influenza virus
AIAGFIEGGWT

SEQ ID NO: 390360 - protein, 11 aa, Influenza virus
IAGFIEGGWTG

SEQ ID NO: 390361 - protein, 11 aa, Influenza virus
AGFIEGGWTGM

SEQ ID NO: 390362 - protein, 11 aa, Influenza virus
GFIEGGWTGMV

SEQ ID NO: 390363 - protein, 11 aa, Influenza virus
FIEGGWTGMVD

SEQ ID NO: 390364 - protein, 11 aa, Influenza virus
IEGGWTGMVDG

SEQ ID NO: 390365 - protein, 11 aa, Influenza virus
EGGWTGMVDGW

SEQ ID NO: 390366 - protein, 11 aa, Influenza virus
GGWTGMVDGWY

SEQ ID NO: 390367 - protein, 11 aa, Influenza virus
GWTGMVDGWYG

SEQ ID NO: 390368 - protein, 11 aa, Influenza virus
WTGMVDGWYGY

SEQ ID NO: 390369 - protein, 11 aa, Influenza virus
TGMVDGWYGYH

SEQ ID NO: 390370 - protein, 11 aa, Influenza virus
GMVDGWYGYHH

SEQ ID NO: 390371 - protein, 11 aa, Influenza virus
YNAELLVLLEN

SEQ ID NO: 390372 - protein, 11 aa, Influenza virus
LCSVEYASKTR

SEQ ID NO: 390373 - protein, 11 aa, Influenza virus
CSVEYASKTRI

SEQ ID NO: 390374 - protein, 11 aa, Influenza virus
SVEYASKTRIS

SEQ ID NO: 390375 - protein, 11 aa, Influenza virus
VEYASKTRISE

SEQ ID NO: 390376 - protein, 11 aa, Influenza virus
EYASKTRISEI

SEQ ID NO: 390377 - protein, 11 aa, Influenza virus
SLQCRICIRAD

SEQ ID NO: 390378 - protein, 11 aa, Influenza virus
LQCRICIRADG

SEQ ID NO: 390379 - protein, 11 aa, Influenza virus
QCRICIDFRDM

SEQ ID NO: 390380 - protein, 11 aa, Influenza virus
CRICILDQNFR

SEQ ID NO: 390381 - protein, 11 aa, Influenza virus
TISLVKTTLFL

SEQ ID NO: 390382 - protein, 11 aa, Influenza virus
ICILDQNFRNI

SEQ ID NO: 390383 - protein, 11 aa, Influenza virus
CIDFRDMRKNT

SEQ ID NO: 390384 - protein, 11 aa, Influenza virus
IDFRDMRKNTL

SEQ ID NO: 390385 - protein, 11 aa, Influenza virus
KQGKTKATKMK

SEQ ID NO: 390386 - protein, 11 aa, Influenza virus
QGKTKATKMKA

SEQ ID NO: 390387 - protein, 11 aa, Influenza virus
GKTKATKMKAI

SEQ ID NO: 390388 - protein, 11 aa, Influenza virus
KTKATKMKAIL

SEQ ID NO: 390389 - protein, 11 aa, Influenza virus
TKATKMKAILV

SEQ ID NO: 390390 - protein, 11 aa, Influenza virus
KATKMKAILVV

SEQ ID NO: 390391 - protein, 11 aa, Influenza virus
ATKMKAILVVL

SEQ ID NO: 390392 - protein, 11 aa, Influenza virus
TKMKAILVVLL

SEQ ID NO: 390393 - protein, 11 aa, Influenza virus
KMKAILVVLLY

SEQ ID NO: 390394 - protein, 11 aa, Influenza virus
IIIVVLLYTFA

SEQ ID NO: 390395 - protein, 11 aa, Influenza virus
ADTLCIGYHAN

SEQ ID NO: 390396 - protein, 11 aa, Influenza virus
DTLCIGYHANN

SEQ ID NO: 390397 - protein, 11 aa, Influenza virus
TLCIGYHANNS

SEQ ID NO: 390398 - protein, 11 aa, Influenza virus
LCIGYHANNST

SEQ ID NO: 390399 - protein, 11 aa, Influenza virus
CIGYHANNSTD

SEQ ID NO: 390400 - protein, 11 aa, Influenza virus
IGYHANNSTDT

SEQ ID NO: 390401 - protein, 11 aa, Influenza virus
GYHANNSTDTV

SEQ ID NO: 390402 - protein, 11 aa, Influenza virus
YHANNSTDTVD

SEQ ID NO: 390403 - protein, 11 aa, Influenza virus
HANNSTDTVDT

SEQ ID NO: 390404 - protein, 11 aa, Influenza virus
ANNSTDTVDTV

SEQ ID NO: 390405 - protein, 11 aa, Influenza virus
NNSTDTVDTVL

SEQ ID NO: 390406 - protein, 11 aa, Influenza virus
NSTDTVDTVLE

SEQ ID NO: 390407 - protein, 11 aa, Influenza virus
STDTVDTVLEK

SEQ ID NO: 390408 - protein, 11 aa, Influenza virus
TDTVDTVLEKN

SEQ ID NO: 390409 - protein, 11 aa, Influenza virus
TVDTVLEKNVT

SEQ ID NO: 390410 - protein, 11 aa, Influenza virus
VDTVLEKNVTV

SEQ ID NO: 390411 - protein, 11 aa, Influenza virus
DTVLEKNVTVT

SEQ ID NO: 390412 - protein, 11 aa, Influenza virus
TVLEKNVTVTH

SEQ ID NO: 390413 - protein, 11 aa, Influenza virus
VLEKNVTVTHS

SEQ ID NO: 390414 - protein, 11 aa, Influenza virus
LEKNVTVTHSV

SEQ ID NO: 390415 - protein, 11 aa, Influenza virus
EKNVTVTHSVN

SEQ ID NO: 390416 - protein, 11 aa, Influenza virus
KNVTVTHSVNL

SEQ ID NO: 390417 - protein, 11 aa, Influenza virus
NVTVTHSVNLL

SEQ ID NO: 390418 - protein, 11 aa, Influenza virus
VTVTHSVNLLE

SEQ ID NO: 390419 - protein, 11 aa, Influenza virus
IAGWILGNPEC

SEQ ID NO: 390420 - protein, 11 aa, Influenza virus
DYEELREQLSS

SEQ ID NO: 390421 - protein, 11 aa, Influenza virus
YEELREQLSSV

SEQ ID NO: 390422 - protein, 11 aa, Influenza virus
EELREQLSSVS

SEQ ID NO: 390423 - protein, 11 aa, Influenza virus
ELREQLSSVSS

SEQ ID NO: 390424 - protein, 11 aa, Influenza virus
LREQLSSVSSF

SEQ ID NO: 390425 - protein, 11 aa, Influenza virus
EQLSSVSSFER

SEQ ID NO: 390426 - protein, 11 aa, Influenza virus
QLSSVSSFERF

SEQ ID NO: 390427 - protein, 11 aa, Influenza virus
LSSVSSFERFE

SEQ ID NO: 390428 - protein, 11 aa, Influenza virus
SSVSSFERFEI

SEQ ID NO: 390429 - protein, 11 aa, Influenza virus
SVSSFERFEIF

SEQ ID NO: 390430 - protein, 11 aa, Influenza virus
VSSFERFEIFP

SEQ ID NO: 390431 - protein, 11 aa, Influenza virus
SSFERFEIFPK

SEQ ID NO: 390432 - protein, 11 aa, Influenza virus
KEKENSYPMIN

SEQ ID NO: 390433 - protein, 11 aa, Influenza virus
EKENSYPMINK

SEQ ID NO: 390434 - protein, 11 aa, Influenza virus
DKITFEATGNL

SEQ ID NO: 390435 - protein, 11 aa, Influenza virus
TSLTSLPFQNI

SEQ ID NO: 390436 - protein, 11 aa, Influenza virus
SLTSLPFQNIH

SEQ ID NO: 390437 - protein, 11 aa, Influenza virus
LTSLPFQNIHP

SEQ ID NO: 390438 - protein, 11 aa, Influenza virus
TIGKCPKYVKS

SEQ ID NO: 390439 - protein, 11 aa, Influenza virus
IGKCPKYVKST

SEQ ID NO: 390440 - protein, 11 aa, Influenza virus
LRLATGLRNVP

SEQ ID NO: 390441 - protein, 11 aa, Influenza virus
RLATGLRNVPS

SEQ ID NO: 390442 - protein, 11 aa, Influenza virus
ATGLRNVPSIQ

SEQ ID NO: 390443 - protein, 11 aa, Influenza virus
TGLRNVPSIQS

SEQ ID NO: 390444 - protein, 11 aa, Influenza virus
GLRNVPSIQSR

SEQ ID NO: 390445 - protein, 11 aa, Influenza virus
LRNVPSIQSRG

SEQ ID NO: 390446 - protein, 11 aa, Influenza virus
RNVPSIQSRGL

SEQ ID NO: 390447 - protein, 11 aa, Influenza virus
NVPSIQSRGLF

SEQ ID NO: 390448 - protein, 11 aa, Influenza virus
VPSIQSRGLFG

SEQ ID NO: 390449 - protein, 11 aa, Influenza virus
PSIQSRGLFGA

SEQ ID NO: 390450 - protein, 11 aa, Influenza virus
SIQSRGLFGAI

SEQ ID NO: 390451 - protein, 11 aa, Influenza virus
IQSRGLFGAIA

SEQ ID NO: 390452 - protein, 11 aa, Influenza virus
QSRGLFGAIAG

SEQ ID NO: 390453 - protein, 11 aa, Influenza virus
SRGLFGAIAGF

SEQ ID NO: 390454 - protein, 11 aa, Influenza virus
RGLFGAIAGFI

SEQ ID NO: 390455 - protein, 11 aa, Influenza virus
GLFGAIAGFIE

SEQ ID NO: 390456 - protein, 11 aa, Influenza virus
LFGAIAGFIEG

SEQ ID NO: 390457 - protein, 11 aa, Influenza virus
FGAIAGFIEGG

SEQ ID NO: 390458 - protein, 11 aa, Influenza virus
GAIAGFIEGGW

SEQ ID NO: 390459 - protein, 11 aa, Influenza virus
AIAGFIEGGWT

SEQ ID NO: 390460 - protein, 11 aa, Influenza virus
IAGFIEGGWTG

SEQ ID NO: 390461 - protein, 11 aa, Influenza virus
AGFIEGGWTGM

SEQ ID NO: 390462 - protein, 11 aa, Influenza virus
GFIEGGWTGMV

SEQ ID NO: 390463 - protein, 11 aa, Influenza virus
FIEGGWTGMVD

SEQ ID NO: 390464 - protein, 11 aa, Influenza virus
IEGGWTGMVDG

SEQ ID NO: 390465 - protein, 11 aa, Influenza virus
EGGWTGMVDGW

SEQ ID NO: 390466 - protein, 11 aa, Influenza virus
GGWTGMVDGWY

SEQ ID NO: 390467 - protein, 11 aa, Influenza virus
GWTGMVDGWYG

SEQ ID NO: 390468 - protein, 11 aa, Influenza virus
WTGMVDGWYGY

SEQ ID NO: 390469 - protein, 11 aa, Influenza virus
TGMVDGWYGYH

SEQ ID NO: 390470 - protein, 11 aa, Influenza virus
GMVDGWYGYHH

SEQ ID NO: 390471 - protein, 11 aa, Influenza virus
MVDGWYGYHHQ

SEQ ID NO: 390472 - protein, 11 aa, Influenza virus
VDGWYGYHHQN

SEQ ID NO: 390473 - protein, 11 aa, Influenza virus
DGWYGYHHQNE

SEQ ID NO: 390474 - protein, 11 aa, Influenza virus
GWYGYHHQNEQ

SEQ ID NO: 390475 - protein, 11 aa, Influenza virus
WYGYHHQNEQG

SEQ ID NO: 390476 - protein, 11 aa, Influenza virus
YGYHHQNEQGS

SEQ ID NO: 390477 - protein, 11 aa, Influenza virus
GYHHQNEQGSG

SEQ ID NO: 390478 - protein, 11 aa, Influenza virus
YHHQNEQGSGY

SEQ ID NO: 390479 - protein, 11 aa, Influenza virus
HHQNEQGSGYA

SEQ ID NO: 390480 - protein, 11 aa, Influenza virus
HQNEQGSGYAA

SEQ ID NO: 390481 - protein, 11 aa, Influenza virus
QNEQGSGYAAD

SEQ ID NO: 390482 - protein, 11 aa, Influenza virus
NEQGSGYAADL

SEQ ID NO: 390483 - protein, 11 aa, Influenza virus
EQGSGYAADLK

SEQ ID NO: 390484 - protein, 11 aa, Influenza virus
QGSGYAADLKS

SEQ ID NO: 390485 - protein, 11 aa, Influenza virus
GSGYAADLKST

SEQ ID NO: 390486 - protein, 11 aa, Influenza virus
SGYAADLKSTQ

SEQ ID NO: 390487 - protein, 11 aa, Influenza virus
NKVNSVIEKMN

SEQ ID NO: 390488 - protein, 11 aa, Influenza virus
NSVIEKMNTQF

SEQ ID NO: 390489 - protein, 11 aa, Influenza virus
SVIEKMNTQFT

SEQ ID NO: 390490 - protein, 11 aa, Influenza virus
MNTQFTAVGKE

SEQ ID NO: 390491 - protein, 11 aa, Influenza virus
NTQFTAVGKEF

SEQ ID NO: 390492 - protein, 11 aa, Influenza virus
RIENLNKKVDD

SEQ ID NO: 390493 - protein, 11 aa, Influenza virus
IENLNKKVDDG

SEQ ID NO: 390494 - protein, 11 aa, Influenza virus
ENLNKKVDDGF

SEQ ID NO: 390495 - protein, 11 aa, Influenza virus
NLNKKVDDGFL

SEQ ID NO: 390496 - protein, 11 aa, Influenza virus
LNKKVDDGFLD

SEQ ID NO: 390497 - protein, 11 aa, Influenza virus
DDGFLDIWTYN

SEQ ID NO: 390498 - protein, 11 aa, Influenza virus
DGFLDIWTYNA

SEQ ID NO: 390499 - protein, 11 aa, Influenza virus
GFLDIWTYNAE

SEQ ID NO: 390500 - protein, 11 aa, Influenza virus
FLDIWTYNAEL

SEQ ID NO: 390501 - protein, 11 aa, Influenza virus
LDIWTYNAELL

SEQ ID NO: 390502 - protein, 11 aa, Influenza virus
DIWTYNAELLV

SEQ ID NO: 390503 - protein, 11 aa, Influenza virus
IWTYNAELLVL

SEQ ID NO: 390504 - protein, 11 aa, Influenza virus
WTYNAELLVLL

SEQ ID NO: 390505 - protein, 11 aa, Influenza virus
TYNAELLVLLE

SEQ ID NO: 390506 - protein, 11 aa, Influenza virus
YNAELLVLLEN

SEQ ID NO: 390507 - protein, 11 aa, Influenza virus
NAELLVLLENE

SEQ ID NO: 390508 - protein, 11 aa, Influenza virus
AELLVLLENER

SEQ ID NO: 390509 - protein, 11 aa, Influenza virus
ELLVLLENERT

SEQ ID NO: 390510 - protein, 11 aa, Influenza virus
LLVLLENERTL

SEQ ID NO: 390511 - protein, 11 aa, Influenza virus
LVLLENERTLD

SEQ ID NO: 390512 - protein, 11 aa, Influenza virus
VLLENERTLDY

SEQ ID NO: 390513 - protein, 11 aa, Influenza virus
LLENERTLDYH

SEQ ID NO: 390514 - protein, 11 aa, Influenza virus
LENERTLDYHD

SEQ ID NO: 390515 - protein, 11 aa, Influenza virus
ENERTLDYHDS

SEQ ID NO: 390516 - protein, 11 aa, Influenza virus
NNAKEIGNGCF

SEQ ID NO: 390517 - protein, 11 aa, Influenza virus
NAKEIGNGCFE

SEQ ID NO: 390518 - protein, 11 aa, Influenza virus
AKEIGNGCFEF

SEQ ID NO: 390519 - protein, 11 aa, Influenza virus
KEIGNGCFEFY

SEQ ID NO: 390520 - protein, 11 aa, Influenza virus
EIGNGCFEFYH

SEQ ID NO: 390521 - protein, 11 aa, Influenza virus
IGNGCFEFYHK

SEQ ID NO: 390522 - protein, 11 aa, Influenza virus
GNGCFEFYHKC

SEQ ID NO: 390523 - protein, 11 aa, Influenza virus
NGCFEFYHKCD

SEQ ID NO: 390524 - protein, 11 aa, Influenza virus
GCFEFYHKCDN

SEQ ID NO: 390525 - protein, 11 aa, Influenza virus
CMESVKNGTYD

SEQ ID NO: 390526 - protein, 11 aa, Influenza virus
MESVKNGTYDY

SEQ ID NO: 390527 - protein, 11 aa, Influenza virus
ESVKNGTYDYP

SEQ ID NO: 390528 - protein, 11 aa, Influenza virus
SVKNGTYDYPK

SEQ ID NO: 390529 - protein, 11 aa, Influenza virus
VKNGTYDYPKY

SEQ ID NO: 390530 - protein, 11 aa, Influenza virus
KNGTYDYPKYS

SEQ ID NO: 390531 - protein, 11 aa, Influenza virus
NGTYDYPKYSE

SEQ ID NO: 390532 - protein, 11 aa, Influenza virus
GTYDYPKYSEE

SEQ ID NO: 390533 - protein, 11 aa, Influenza virus
TYDYPKYSEEA

SEQ ID NO: 390534 - protein, 11 aa, Influenza virus
YQILAIYSTVA

SEQ ID NO: 390535 - protein, 11 aa, Influenza virus
QILAIYSTVAS

SEQ ID NO: 390536 - protein, 11 aa, Influenza virus
ILAIYSTVASS

SEQ ID NO: 390537 - protein, 11 aa, Influenza virus
LAIYSTVASSL

SEQ ID NO: 390538 - protein, 11 aa, Influenza virus
AIYSTVASSLV

SEQ ID NO: 390539 - protein, 11 aa, Influenza virus
IYSTVASSLVL

SEQ ID NO: 390540 - protein, 11 aa, Influenza virus
ASSLVLVVSLG

SEQ ID NO: 390541 - protein, 11 aa, Influenza virus
SSLVLVVSLGA

SEQ ID NO: 390542 - protein, 11 aa, Influenza virus
LVVSLGAISFW

SEQ ID NO: 390543 - protein, 11 aa, Influenza virus
VVSLGAISFWM

SEQ ID NO: 390544 - protein, 11 aa, Influenza virus
VSLGAISFWMC

SEQ ID NO: 390545 - protein, 11 aa, Influenza virus
SLGAISFWMCS

SEQ ID NO: 390546 - protein, 11 aa, Influenza virus
LGAISFWMCSN

SEQ ID NO: 390547 - protein, 11 aa, Influenza virus
GAISFWMCSNG

SEQ ID NO: 390548 - protein, 11 aa, Influenza virus
AISFWMCSNGS

SEQ ID NO: 390549 - protein, 11 aa, Influenza virus
ISFWMCSNGSL

SEQ ID NO: 390550 - protein, 11 aa, Influenza virus
SFWMCSNGSLQ

SEQ ID NO: 390551 - protein, 11 aa, Influenza virus
FWMCSNGSLQC

SEQ ID NO: 390552 - protein, 11 aa, Influenza virus
WMCSNGSLQCR

SEQ ID NO: 390553 - protein, 11 aa, Influenza virus
MCSNGSLQCRI

SEQ ID NO: 390554 - protein, 11 aa, Influenza virus
CSNGSLQCRIC

SEQ ID NO: 390555 - protein, 11 aa, Influenza virus
SNGSLQCRICI

SEQ ID NO: 390556 - protein, 11 aa, Influenza virus
LCSVEYASKTR

SEQ ID NO: 390557 - protein, 11 aa, Influenza virus
CSVEYASKTRI

SEQ ID NO: 390558 - protein, 11 aa, Influenza virus
SVEYASKTRIS

SEQ ID NO: 390559 - protein, 11 aa, Influenza virus
VEYASKTRISE

SEQ ID NO: 390560 - protein, 11 aa, Influenza virus
EYASKTRISEI

SEQ ID NO: 390561 - protein, 11 aa, Influenza virus
SLQCRICIRAD

SEQ ID NO: 390562 - protein, 11 aa, Influenza virus
LQCRICIRADG

SEQ ID NO: 390563 - protein, 11 aa, Influenza virus
QCRICILDQNF

SEQ ID NO: 390564 - protein, 11 aa, Influenza virus
CRICILDQNFR

SEQ ID NO: 390565 - protein, 11 aa, Influenza virus
RICILDQNFRN

SEQ ID NO: 390566 - protein, 11 aa, Influenza virus
ICIDFRDMRKN

SEQ ID NO: 390567 - protein, 11 aa, Influenza virus
CILDQNFRNIR

SEQ ID NO: 390568 - protein, 11 aa, Influenza virus
IDFRDMRKNTL

SEQ ID NO: 390569 - protein, 11 aa, Influenza virus
IGLREQKQEFK

SEQ ID NO: 390570 - protein, 11 aa, Influenza virus
GLREQKQEFKM

SEQ ID NO: 390571 - protein, 11 aa, Influenza virus
LREQKQEFKMN

SEQ ID NO: 390572 - protein, 11 aa, Influenza virus
REQKQEFKMNP

SEQ ID NO: 390573 - protein, 11 aa, Influenza virus
EQKQEFKMNPN

SEQ ID NO: 390574 - protein, 11 aa, Influenza virus
QKQEFKMNPNQ

SEQ ID NO: 390575 - protein, 11 aa, Influenza virus
KQEFKMNPNQK

SEQ ID NO: 390576 - protein, 11 aa, Influenza virus
QEFKMNPNQKI

SEQ ID NO: 390577 - protein, 11 aa, Influenza virus
EFKMNPNQKII

SEQ ID NO: 390578 - protein, 11 aa, Influenza virus
FKMNPNQKIII

SEQ ID NO: 390579 - protein, 11 aa, Influenza virus
KMNPNQKIIII

SEQ ID NO: 390580 - protein, 11 aa, Influenza virus
SKDNSIRIGSK

SEQ ID NO: 390581 - protein, 11 aa, Influenza virus
KDNSIRIGSKG

SEQ ID NO: 390582 - protein, 11 aa, Influenza virus
DNSIRIGSKGD

SEQ ID NO: 390583 - protein, 11 aa, Influenza virus
NSIRIGSKGDV

SEQ ID NO: 390584 - protein, 11 aa, Influenza virus
SIRIGSKGDVF

SEQ ID NO: 390585 - protein, 11 aa, Influenza virus
IRIGSKGDVFV

SEQ ID NO: 390586 - protein, 11 aa, Influenza virus
RIGSKGDVFVI

SEQ ID NO: 390587 - protein, 11 aa, Influenza virus
IGSKGDVFVIR

SEQ ID NO: 390588 - protein, 11 aa, Influenza virus
GSKGDVFVIRE

SEQ ID NO: 390589 - protein, 11 aa, Influenza virus
SKGDVFVIREP

SEQ ID NO: 390590 - protein, 11 aa, Influenza virus
KGDVFVIREPF

SEQ ID NO: 390591 - protein, 11 aa, Influenza virus
GDVFVIREPFI

SEQ ID NO: 390592 - protein, 11 aa, Influenza virus
DVFVIREPFIS

SEQ ID NO: 390593 - protein, 11 aa, Influenza virus
VFVIREPFISC

SEQ ID NO: 390594 - protein, 11 aa, Influenza virus
FVIREPFISCS

SEQ ID NO: 390595 - protein, 11 aa, Influenza virus
VIREPFISCSP

SEQ ID NO: 390596 - protein, 11 aa, Influenza virus
IREPFISCSPL

SEQ ID NO: 390597 - protein, 11 aa, Influenza virus
REPFISCSPLE

SEQ ID NO: 390598 - protein, 11 aa, Influenza virus
EPFISCSPLEC

SEQ ID NO: 390599 - protein, 11 aa, Influenza virus
LECRTFFLTQG

SEQ ID NO: 390600 - protein, 11 aa, Influenza virus
ECRTFFLTQGA

SEQ ID NO: 390601 - protein, 11 aa, Influenza virus
CRTFFLTQGAL

SEQ ID NO: 390602 - protein, 11 aa, Influenza virus
RTFFLTQGALL

SEQ ID NO: 390603 - protein, 11 aa, Influenza virus
TFFLTQGALLN

SEQ ID NO: 390604 - protein, 11 aa, Influenza virus
FFLTQGALLND

SEQ ID NO: 390605 - protein, 11 aa, Influenza virus
FLTQGALLNDK

SEQ ID NO: 390606 - protein, 11 aa, Influenza virus
LTQGALLNDKH

SEQ ID NO: 390607 - protein, 11 aa, Influenza virus
TQGALLNDKHS

SEQ ID NO: 390608 - protein, 11 aa, Influenza virus
QGALLNDKHSN

SEQ ID NO: 390609 - protein, 11 aa, Influenza virus
GALLNDKHSNG

SEQ ID NO: 390610 - protein, 11 aa, Influenza virus
ALLNDKHSNGT

SEQ ID NO: 390611 - protein, 11 aa, Influenza virus
LLNDKHSNGTI

SEQ ID NO: 390612 - protein, 11 aa, Influenza virus
LNDKHSNGTIK

SEQ ID NO: 390613 - protein, 11 aa, Influenza virus
KDRSPYRTLMS

SEQ ID NO: 390614 - protein, 11 aa, Influenza virus
DRSPYRTLMSC

SEQ ID NO: 390615 - protein, 11 aa, Influenza virus
RSPYRTLMSCP

SEQ ID NO: 390616 - protein, 11 aa, Influenza virus
LMSCPIGEVPS

SEQ ID NO: 390617 - protein, 11 aa, Influenza virus
MSCPIGEVPSP

SEQ ID NO: 390618 - protein, 11 aa, Influenza virus
SCPIGEVPSPY

SEQ ID NO: 390619 - protein, 11 aa, Influenza virus
CPIGEVPSPYN

SEQ ID NO: 390620 - protein, 11 aa, Influenza virus
PIGEVPSPYNS

SEQ ID NO: 390621 - protein, 11 aa, Influenza virus
GEVPSPYNSRF

SEQ ID NO: 390622 - protein, 11 aa, Influenza virus
EVPSPYNSRFE

SEQ ID NO: 390623 - protein, 11 aa, Influenza virus
VPSPYNSRFES

SEQ ID NO: 390624 - protein, 11 aa, Influenza virus
PSPYNSRFESV

SEQ ID NO: 390625 - protein, 11 aa, Influenza virus
SPYNSRFESVA

SEQ ID NO: 390626 - protein, 11 aa, Influenza virus
PYNSRFESVAW

SEQ ID NO: 390627 - protein, 11 aa, Influenza virus
YNSRFESVAWS

SEQ ID NO: 390628 - protein, 11 aa, Influenza virus
NSRFESVAWSA

SEQ ID NO: 390629 - protein, 11 aa, Influenza virus
SRFESVAWSAS

SEQ ID NO: 390630 - protein, 11 aa, Influenza virus
RFESVAWSASA

SEQ ID NO: 390631 - protein, 11 aa, Influenza virus
FESVAWSASAC

SEQ ID NO: 390632 - protein, 11 aa, Influenza virus
ESVAWSASACH

SEQ ID NO: 390633 - protein, 11 aa, Influenza virus
SVAWSASACHD

SEQ ID NO: 390634 - protein, 11 aa, Influenza virus
VAWSASACHDG

SEQ ID NO: 390635 - protein, 11 aa, Influenza virus
AWSASACHDGI

SEQ ID NO: 390636 - protein, 11 aa, Influenza virus
NWLTIGISGPD

SEQ ID NO: 390637 - protein, 11 aa, Influenza virus
WLTIGISGPDN

SEQ ID NO: 390638 - protein, 11 aa, Influenza virus
LTIGISGPDNG

SEQ ID NO: 390639 - protein, 11 aa, Influenza virus
TIGISGPDNGA

SEQ ID NO: 390640 - protein, 11 aa, Influenza virus
IGISGPDNGAV

SEQ ID NO: 390641 - protein, 11 aa, Influenza virus
GISGPDNGAVA

SEQ ID NO: 390642 - protein, 11 aa, Influenza virus
ISGPDNGAVAV

SEQ ID NO: 390643 - protein, 11 aa, Influenza virus
SGPDNGAVAVL

SEQ ID NO: 390644 - protein, 11 aa, Influenza virus
GPDNGAVAVLK

SEQ ID NO: 390645 - protein, 11 aa, Influenza virus
PDNGAVAVLKY

SEQ ID NO: 390646 - protein, 11 aa, Influenza virus
DNGAVAVLKYN

SEQ ID NO: 390647 - protein, 11 aa, Influenza virus
NGAVAVLKYNG

SEQ ID NO: 390648 - protein, 11 aa, Influenza virus
GAVAVLKYNGI

SEQ ID NO: 390649 - protein, 11 aa, Influenza virus
AVAVLKYNGII

SEQ ID NO: 390650 - protein, 11 aa, Influenza virus
VAVLKYNGIIT

SEQ ID NO: 390651 - protein, 11 aa, Influenza virus
AVLKYNGIITD

SEQ ID NO: 390652 - protein, 11 aa, Influenza virus
VLKYNGIITDT

SEQ ID NO: 390653 - protein, 11 aa, Influenza virus
ILRTQESECAC

SEQ ID NO: 390654 - protein, 11 aa, Influenza virus
LRTQESECACV

SEQ ID NO: 390655 - protein, 11 aa, Influenza virus
QESECACVNGS

SEQ ID NO: 390656 - protein, 11 aa, Influenza virus
ESECACVNGSC

SEQ ID NO: 390657 - protein, 11 aa, Influenza virus
NGSCFTVMTDG

SEQ ID NO: 390658 - protein, 11 aa, Influenza virus
GSCFTVMTDGP

SEQ ID NO: 390659 - protein, 11 aa, Influenza virus
SCFTVMTDGPS

SEQ ID NO: 390660 - protein, 11 aa, Influenza virus
VMGQASYKIFK

SEQ ID NO: 390661 - protein, 11 aa, Influenza virus
APNYHYEECSC

SEQ ID NO: 390662 - protein, 11 aa, Influenza virus
PNYHYEECSCY

SEQ ID NO: 390663 - protein, 11 aa, Influenza virus
NYHYEECSCYP

SEQ ID NO: 390664 - protein, 11 aa, Influenza virus
CVCRDNWHGSN

SEQ ID NO: 390665 - protein, 11 aa, Influenza virus
VCRDNWHGSNR

SEQ ID NO: 390666 - protein, 11 aa, Influenza virus
CRDNWHGSNRP

SEQ ID NO: 390667 - protein, 11 aa, Influenza virus
RDNWHGSNRPW

SEQ ID NO: 390668 - protein, 11 aa, Influenza virus
DNWHGSNRPWV

SEQ ID NO: 390669 - protein, 11 aa, Influenza virus
NWHGSNRPWVS

SEQ ID NO: 390670 - protein, 11 aa, Influenza virus
WHGSNRPWVSF

SEQ ID NO: 390671 - protein, 11 aa, Influenza virus
HGSNRPWVSFN

SEQ ID NO: 390672 - protein, 11 aa, Influenza virus
NRPWVSFNQNL

SEQ ID NO: 390673 - protein, 11 aa, Influenza virus
IGYICSGIFGD

SEQ ID NO: 390674 - protein, 11 aa, Influenza virus
GYICSGIFGDN

SEQ ID NO: 390675 - protein, 11 aa, Influenza virus
YICSGIFGDNP

SEQ ID NO: 390676 - protein, 11 aa, Influenza virus
ICSGIFGDNPR

SEQ ID NO: 390677 - protein, 11 aa, Influenza virus
CSGIFGDNPRP

SEQ ID NO: 390678 - protein, 11 aa, Influenza virus
GFSFKYGNGVW

SEQ ID NO: 390679 - protein, 11 aa, Influenza virus
KYGNGVWIGRT

SEQ ID NO: 390680 - protein, 11 aa, Influenza virus
YGNGVWIGRTK

SEQ ID NO: 390681 - protein, 11 aa, Influenza virus
GNGVWIGRTKS

SEQ ID NO: 390682 - protein, 11 aa, Influenza virus
GFEMIWDPNGW

SEQ ID NO: 390683 - protein, 11 aa, Influenza virus
FEMIWDPNGWT

SEQ ID NO: 390684 - protein, 11 aa, Influenza virus
NEWSGYSGSFV

SEQ ID NO: 390685 - protein, 11 aa, Influenza virus
EWSGYSGSFVQ

SEQ ID NO: 390686 - protein, 11 aa, Influenza virus
WSGYSGSFVQH

SEQ ID NO: 390687 - protein, 11 aa, Influenza virus
SGYSGSFVQHP

SEQ ID NO: 390688 - protein, 11 aa, Influenza virus
GYSGSFVQHPE

SEQ ID NO: 390689 - protein, 11 aa, Influenza virus
YSGSFVQHPEL

SEQ ID NO: 390690 - protein, 11 aa, Influenza virus
SGSFVQHPELT

SEQ ID NO: 390691 - protein, 11 aa, Influenza virus
GSFVQHPELTG

SEQ ID NO: 390692 - protein, 11 aa, Influenza virus
SFVQHPELTGL

SEQ ID NO: 390693 - protein, 11 aa, Influenza virus
FVQHPELTGLD

SEQ ID NO: 390694 - protein, 11 aa, Influenza virus
VQHPELTGLDC

SEQ ID NO: 390695 - protein, 11 aa, Influenza virus
QHPELTGLDCI

SEQ ID NO: 390696 - protein, 11 aa, Influenza virus
DCIRPCFWVEL

SEQ ID NO: 390697 - protein, 11 aa, Influenza virus
CIRPCFWVELI

SEQ ID NO: 390698 - protein, 11 aa, Influenza virus
IRPCFWVELIR

SEQ ID NO: 390699 - protein, 11 aa, Influenza virus
RPCFWVELIRG

SEQ ID NO: 390700 - protein, 11 aa, Influenza virus
PCFWVELIRGR

SEQ ID NO: 390701 - protein, 11 aa, Influenza virus
CFWVELIRGRP

SEQ ID NO: 390702 - protein, 11 aa, Influenza virus
TTIWTSGSSIS

SEQ ID NO: 390703 - protein, 11 aa, Influenza virus
TIWTSGSSISF

SEQ ID NO: 390704 - protein, 11 aa, Influenza virus
IWTSGSSISFC

SEQ ID NO: 390705 - protein, 11 aa, Influenza virus
WTSGSSISFCG

SEQ ID NO: 390706 - protein, 11 aa, Influenza virus
TSGSSISFCGV

SEQ ID NO: 390707 - protein, 11 aa, Influenza virus
SGSSISFCGVN

SEQ ID NO: 390708 - protein, 11 aa, Influenza virus
WSWPDGAELPF

SEQ ID NO: 390709 - protein, 11 aa, Influenza virus
GADLPFTQEQK

SEQ ID NO: 390710 - protein, 11 aa, Influenza virus
DTICIGYHANN

SEQ ID NO: 390711 - protein, 11 aa, Influenza virus
TICIGYHANNS

SEQ ID NO: 390712 - protein, 11 aa, Influenza virus
ICIGYHANNST

SEQ ID NO: 390713 - protein, 11 aa, Influenza virus
CIGYHANNSTD

SEQ ID NO: 390714 - protein, 11 aa, Influenza virus
IGYHANNSTDT

SEQ ID NO: 390715 - protein, 11 aa, Influenza virus
GYHANNSTDTV

SEQ ID NO: 390716 - protein, 11 aa, Influenza virus
YHANNSTDTVD

SEQ ID NO: 390717 - protein, 11 aa, Influenza virus
HANNSTDTVDT

SEQ ID NO: 390718 - protein, 11 aa, Influenza virus
KNVTVTHSVNL

SEQ ID NO: 390719 - protein, 11 aa, Influenza virus
NVTVTHSVNLL

SEQ ID NO: 390720 - protein, 11 aa, Influenza virus
VTVTHSVNLLE

SEQ ID NO: 390721 - protein, 11 aa, Influenza virus
PFQNVHPVTIG

SEQ ID NO: 390722 - protein, 11 aa, Influenza virus
HPVTIGECPKY

SEQ ID NO: 390723 - protein, 11 aa, Influenza virus
PVTIGECPKYV

SEQ ID NO: 390724 - protein, 11 aa, Influenza virus
VTIGECPKYVR

SEQ ID NO: 390725 - protein, 11 aa, Influenza virus
TIGECPKYVKS

SEQ ID NO: 390726 - protein, 11 aa, Influenza virus
SIQSRGLFGAI

SEQ ID NO: 390727 - protein, 11 aa, Influenza virus
IQSRGLFGAIA

SEQ ID NO: 390728 - protein, 11 aa, Influenza virus
QSRGLFGAIAG

SEQ ID NO: 390729 - protein, 11 aa, Influenza virus
SRGLFGAIAGF

SEQ ID NO: 390730 - protein, 11 aa, Influenza virus
RGLFGAIAGFI

SEQ ID NO: 390731 - protein, 11 aa, Influenza virus
GLFGAIAGFIE

SEQ ID NO: 390732 - protein, 11 aa, Influenza virus
LFGAIAGFIEG

SEQ ID NO: 390733 - protein, 11 aa, Influenza virus
FGAIAGFIEGG

SEQ ID NO: 390734 - protein, 11 aa, Influenza virus
GAIAGFIEGGW

SEQ ID NO: 390735 - protein, 11 aa, Influenza virus
AIAGFIEGGWT

SEQ ID NO: 390736 - protein, 11 aa, Influenza virus
IAGFIEGGWTG

SEQ ID NO: 390737 - protein, 11 aa, Influenza virus
AGFIEGGWTGM

SEQ ID NO: 390738 - protein, 11 aa, Influenza virus
GFIEGGWTGMI

SEQ ID NO: 390739 - protein, 11 aa, Influenza virus
FIEGGWTGMID

SEQ ID NO: 390740 - protein, 11 aa, Influenza virus
IEGGWTGMIDG

SEQ ID NO: 390741 - protein, 11 aa, Influenza virus
EGGWTGMIDGW

SEQ ID NO: 390742 - protein, 11 aa, Influenza virus
GGWTGMIDGWY

SEQ ID NO: 390743 - protein, 11 aa, Influenza virus
GWTGMIDGWYG

SEQ ID NO: 390744 - protein, 11 aa, Influenza virus
WTGMIDGWYGY

SEQ ID NO: 390745 - protein, 11 aa, Influenza virus
IWTYNAELLVL

SEQ ID NO: 390746 - protein, 11 aa, Influenza virus
WTYNAELLVLL

SEQ ID NO: 390747 - protein, 11 aa, Influenza virus
TYNAELLVLLE

SEQ ID NO: 390748 - protein, 11 aa, Influenza virus
YNAELLVLLEN

SEQ ID NO: 390749 - protein, 11 aa, Influenza virus
NAELLVLLENE

SEQ ID NO: 390750 - protein, 11 aa, Influenza virus
AELLVLLENER

SEQ ID NO: 390751 - protein, 11 aa, Influenza virus
ELLVLLENERT

SEQ ID NO: 390752 - protein, 11 aa, Influenza virus
LLVLLENERTL

SEQ ID NO: 390753 - protein, 11 aa, Influenza virus
LVLLENERTLD

SEQ ID NO: 390754 - protein, 11 aa, Influenza virus
VLLENERTLDF

SEQ ID NO: 390755 - protein, 11 aa, Influenza virus
LLENERTLDFH

SEQ ID NO: 390756 - protein, 11 aa, Influenza virus
LENERTLDFHD

SEQ ID NO: 390757 - protein, 11 aa, Influenza virus
ENERTLDFHDS

SEQ ID NO: 390758 - protein, 11 aa, Influenza virus
NERTLDFHDSN

SEQ ID NO: 390759 - protein, 11 aa, Influenza virus
ERTLDFHDSNV

SEQ ID NO: 390760 - protein, 11 aa, Influenza virus
NNAKEIGNGCF

SEQ ID NO: 390761 - protein, 11 aa, Influenza virus
NAKEIGNGCFE

SEQ ID NO: 390762 - protein, 11 aa, Influenza virus
AKEIGNGCFEF

SEQ ID NO: 390763 - protein, 11 aa, Influenza virus
KEIGNGCFEFY

SEQ ID NO: 390764 - protein, 11 aa, Influenza virus
EIGNGCFEFYH

SEQ ID NO: 390765 - protein, 11 aa, Influenza virus
IGNGCFEFYHK

SEQ ID NO: 390766 - protein, 11 aa, Influenza virus
GNGCFEFYHKC

SEQ ID NO: 390767 - protein, 11 aa, Influenza virus
NGCFEFYHKCN

SEQ ID NO: 390768 - protein, 11 aa, Influenza virus
GCFEFYHKCNN

SEQ ID NO: 390769 - protein, 11 aa, Influenza virus
SFWMCSNGSLQ

SEQ ID NO: 390770 - protein, 11 aa, Influenza virus
FWMCSNGSLQC

SEQ ID NO: 390771 - protein, 11 aa, Influenza virus
WMCSNGSLQCR

SEQ ID NO: 390772 - protein, 11 aa, Influenza virus
MCSNGSLQCRI

SEQ ID NO: 390773 - protein, 11 aa, Influenza virus
KNNQVILCEPT

SEQ ID NO: 390774 - protein, 11 aa, Influenza virus
ITGFAPFSKDN

SEQ ID NO: 390775 - protein, 11 aa, Influenza virus
TGFAPFSKDNS

SEQ ID NO: 390776 - protein, 11 aa, Influenza virus
GFAPFSKDNSI

SEQ ID NO: 390777 - protein, 11 aa, Influenza virus
FAPFSKDNSIR

SEQ ID NO: 390778 - protein, 11 aa, Influenza virus
APFSKDNSIRL

SEQ ID NO: 390779 - protein, 11 aa, Influenza virus
PFSKDNSIRLS

SEQ ID NO: 390780 - protein, 11 aa, Influenza virus
FSKDNSIRLSA

SEQ ID NO: 390781 - protein, 11 aa, Influenza virus
SKDNSIRLSAG

SEQ ID NO: 390782 - protein, 11 aa, Influenza virus
KDNSIRLSAGG

SEQ ID NO: 390783 - protein, 11 aa, Influenza virus
DNSIRLSAGGD

SEQ ID NO: 390784 - protein, 11 aa, Influenza virus
NSIRLSAGGDI

SEQ ID NO: 390785 - protein, 11 aa, Influenza virus
SIRLSAGGDIW

SEQ ID NO: 390786 - protein, 11 aa, Influenza virus
RLSAGGDIWVT

SEQ ID NO: 390787 - protein, 11 aa, Influenza virus
LSAGGDIWVTR

SEQ ID NO: 390788 - protein, 11 aa, Influenza virus
SAGGDIWVTRE

SEQ ID NO: 390789 - protein, 11 aa, Influenza virus
AGGDIWVTREP

SEQ ID NO: 390790 - protein, 11 aa, Influenza virus
GGDIWVTREPY

SEQ ID NO: 390791 - protein, 11 aa, Influenza virus
GDIWVTREPYV

SEQ ID NO: 390792 - protein, 11 aa, Influenza virus
DIWVTREPYVS

SEQ ID NO: 390793 - protein, 11 aa, Influenza virus
IWVTREPYVSC

SEQ ID NO: 390794 - protein, 11 aa, Influenza virus
KCYQFALGQGT

SEQ ID NO: 390795 - protein, 11 aa, Influenza virus
CYQFALGQGTT

SEQ ID NO: 390796 - protein, 11 aa, Influenza virus
YQFALGQGTTL

SEQ ID NO: 390797 - protein, 11 aa, Influenza virus
QFALGQGTTLN

SEQ ID NO: 390798 - protein, 11 aa, Influenza virus
FALGQGTTLNN

SEQ ID NO: 390799 - protein, 11 aa, Influenza virus
PYRTLLMNELG

SEQ ID NO: 390800 - protein, 11 aa, Influenza virus
YRTLLMNELGV

SEQ ID NO: 390801 - protein, 11 aa, Influenza virus
RTLLMNELGVP

SEQ ID NO: 390802 - protein, 11 aa, Influenza virus
TLLMNELGVPF

SEQ ID NO: 390803 - protein, 11 aa, Influenza virus
LLMNELGVPFH

SEQ ID NO: 390804 - protein, 11 aa, Influenza virus
LMNELGVPFHL

SEQ ID NO: 390805 - protein, 11 aa, Influenza virus
MNELGVPFHLG

SEQ ID NO: 390806 - protein, 11 aa, Influenza virus
NELGVPFHLGT

SEQ ID NO: 390807 - protein, 11 aa, Influenza virus
ELGVPFHLGTK

SEQ ID NO: 390808 - protein, 11 aa, Influenza virus
LGTKQVCIAWS

SEQ ID NO: 390809 - protein, 11 aa, Influenza virus
GTKQVCIAWSS

SEQ ID NO: 390810 - protein, 11 aa, Influenza virus
TKQVCIAWSSS

SEQ ID NO: 390811 - protein, 11 aa, Influenza virus
KQVCIAWSSSS

SEQ ID NO: 390812 - protein, 11 aa, Influenza virus
QVCIAWSSSSC

SEQ ID NO: 390813 - protein, 11 aa, Influenza virus
VCIAWSSSSCH

SEQ ID NO: 390814 - protein, 11 aa, Influenza virus
CIAWSSSSCHD

SEQ ID NO: 390815 - protein, 11 aa, Influenza virus
IAWSSSSCHDG

SEQ ID NO: 390816 - protein, 11 aa, Influenza virus
AWSSSSCHDGK

SEQ ID NO: 390817 - protein, 11 aa, Influenza virus
WSSSSCHDGKA

SEQ ID NO: 390818 - protein, 11 aa, Influenza virus
SSSSCHDGKAW

SEQ ID NO: 390819 - protein, 11 aa, Influenza virus
SSSCHDGKAWL

SEQ ID NO: 390820 - protein, 11 aa, Influenza virus
SSCHDGKAWLH

SEQ ID NO: 390821 - protein, 11 aa, Influenza virus
SCHDGKAWLHV

SEQ ID NO: 390822 - protein, 11 aa, Influenza virus
CHDGKAWLHVC

SEQ ID NO: 390823 - protein, 11 aa, Influenza virus
ILRTQESECVC

SEQ ID NO: 390824 - protein, 11 aa, Influenza virus
LRTQESECVCI

SEQ ID NO: 390825 - protein, 11 aa, Influenza virus
TCTVVMTDGSA

SEQ ID NO: 390826 - protein, 11 aa, Influenza virus
CTVVMTDGSAS

SEQ ID NO: 390827 - protein, 11 aa, Influenza virus
GSAQHVEECSC

SEQ ID NO: 390828 - protein, 11 aa, Influenza virus
SAQHVEECSCY

SEQ ID NO: 390829 - protein, 11 aa, Influenza virus
AQHVEECSCYP

SEQ ID NO: 390830 - protein, 11 aa, Influenza virus
QHVEECSCYPR

SEQ ID NO: 390831 - protein, 11 aa, Influenza virus
HVEECSCYPRY

SEQ ID NO: 390832 - protein, 11 aa, Influenza virus
VEECSCYPRYP

SEQ ID NO: 390833 - protein, 11 aa, Influenza virus
VRCVCRDNWKG

SEQ ID NO: 390834 - protein, 11 aa, Influenza virus
RCVCRDNWKGS

SEQ ID NO: 390835 - protein, 11 aa, Influenza virus
CVCRDNWKGSN

SEQ ID NO: 390836 - protein, 11 aa, Influenza virus
VCRDNWKGSNR

SEQ ID NO: 390837 - protein, 11 aa, Influenza virus
CRDNWKGSNRP

SEQ ID NO: 390838 - protein, 11 aa, Influenza virus
RDNWKGSNRPI

SEQ ID NO: 390839 - protein, 11 aa, Influenza virus
DNWKGSNRPIV

SEQ ID NO: 390840 - protein, 11 aa, Influenza virus
NWKGSNRPIVD

SEQ ID NO: 390841 - protein, 11 aa, Influenza virus
WKGSNRPIVDI

SEQ ID NO: 390842 - protein, 11 aa, Influenza virus
SSYVCSGLVGD

SEQ ID NO: 390843 - protein, 11 aa, Influenza virus
SYVCSGLVGDT

SEQ ID NO: 390844 - protein, 11 aa, Influenza virus
YVCSGLVGDTP

SEQ ID NO: 390845 - protein, 11 aa, Influenza virus
VCSGLVGDTPR

SEQ ID NO: 390846 - protein, 11 aa, Influenza virus
GGHGVKGWAFD

SEQ ID NO: 390847 - protein, 11 aa, Influenza virus
SCINRCFYVEL

SEQ ID NO: 390848 - protein, 11 aa, Influenza virus
CINRCFYVELI

SEQ ID NO: 390849 - protein, 11 aa, Influenza virus
INRCFYVELIR

SEQ ID NO: 390850 - protein, 11 aa, Influenza virus
NRCFYVELIRG

SEQ ID NO: 390851 - protein, 11 aa, Influenza virus
RCFYVELIRGR

SEQ ID NO: 390852 - protein, 11 aa, Influenza virus
CFYVELIRGRK

SEQ ID NO: 390853 - protein, 11 aa, Influenza virus
VWWTSNSIVVF

SEQ ID NO: 390854 - protein, 11 aa, Influenza virus
WWTSNSIVVFC

SEQ ID NO: 390855 - protein, 11 aa, Influenza virus
WTSNSIVVFCG

SEQ ID NO: 390856 - protein, 11 aa, Influenza virus
TSNSIVVFCGT

SEQ ID NO: 390857 - protein, 11 aa, Influenza virus
SNSIVVFCGTS

SEQ ID NO: 390858 - protein, 11 aa, Influenza virus
NSIVVFCGTSG

SEQ ID NO: 390859 - protein, 11 aa, Influenza virus
SIVVFCGTSGT

SEQ ID NO: 390860 - protein, 11 aa, Influenza virus
VVFCGTSGTYG

SEQ ID NO: 390861 - protein, 11 aa, Influenza virus
GRTSISCLYKL

SEQ ID NO: 390862 - protein, 11 aa, Influenza virus
RTSISCLYKLS

SEQ ID NO: 390863 - protein, 11 aa, Influenza virus
TSISCLYKLSQ

SEQ ID NO: 390864 - protein, 11 aa, Influenza virus
SISCLYKLSQF

SEQ ID NO: 390865 - protein, 11 aa, Influenza virus
MDNQTKTMTIT

SEQ ID NO: 390866 - protein, 11 aa, Influenza virus
DNQTKTMTITF

SEQ ID NO: 390867 - protein, 11 aa, Influenza virus
NQTKTMTITFL

SEQ ID NO: 390868 - protein, 11 aa, Influenza virus
QTKTMTITFLI

SEQ ID NO: 390869 - protein, 11 aa, Influenza virus
TKTMTITFLIL

SEQ ID NO: 390870 - protein, 11 aa, Influenza virus
KTMTITFLILL

SEQ ID NO: 390871 - protein, 11 aa, Influenza virus
TMTITFLILLF

SEQ ID NO: 390872 - protein, 11 aa, Influenza virus
GDQICIGYHAN

SEQ ID NO: 390873 - protein, 11 aa, Influenza virus
DQICIGYHANN

SEQ ID NO: 390874 - protein, 11 aa, Influenza virus
QICIGYHANNS

SEQ ID NO: 390875 - protein, 11 aa, Influenza virus
ICIGYHANNST

SEQ ID NO: 390876 - protein, 11 aa, Influenza virus
CIGYHANNSTE

SEQ ID NO: 390877 - protein, 11 aa, Influenza virus
DTILERNVTVT

SEQ ID NO: 390878 - protein, 11 aa, Influenza virus
TILERNVTVTH

SEQ ID NO: 390879 - protein, 11 aa, Influenza virus
ILERNVTVTHA

SEQ ID NO: 390880 - protein, 11 aa, Influenza virus
LERNVTVTHAK

SEQ ID NO: 390881 - protein, 11 aa, Influenza virus
NVTVTHAKDIL

SEQ ID NO: 390882 - protein, 11 aa, Influenza virus
VTVTHAKDILE

SEQ ID NO: 390883 - protein, 11 aa, Influenza virus
TVTHAKDILEK

SEQ ID NO: 390884 - protein, 11 aa, Influenza virus
DILEKTHNGKL

SEQ ID NO: 390885 - protein, 11 aa, Influenza virus
ILEKTHNGKLC

SEQ ID NO: 390886 - protein, 11 aa, Influenza virus
GIPPLELGDCS

SEQ ID NO: 390887 - protein, 11 aa, Influenza virus
IPPLELGDCSI

SEQ ID NO: 390888 - protein, 11 aa, Influenza virus
PPLELGDCSIA

SEQ ID NO: 390889 - protein, 11 aa, Influenza virus
PLELGDCSIAG

SEQ ID NO: 390890 - protein, 11 aa, Influenza virus
LELGDCSIAGW

SEQ ID NO: 390891 - protein, 11 aa, Influenza virus
ELGDCSIAGWL

SEQ ID NO: 390892 - protein, 11 aa, Influenza virus
LGDCSIAGWLL

SEQ ID NO: 390893 - protein, 11 aa, Influenza virus
GDCSIAGWLLG

SEQ ID NO: 390894 - protein, 11 aa, Influenza virus
DCSIAGWLLGN

SEQ ID NO: 390895 - protein, 11 aa, Influenza virus
CSIAGWLLGNP

SEQ ID NO: 390896 - protein, 11 aa, Influenza virus
SIAGWLLGNPE

SEQ ID NO: 390897 - protein, 11 aa, Influenza virus
IAGWLLGNPEC

SEQ ID NO: 390898 - protein, 11 aa, Influenza virus
AGWLLGNPECD

SEQ ID NO: 390899 - protein, 11 aa, Influenza virus
GWLLGNPECDR

SEQ ID NO: 390900 - protein, 11 aa, Influenza virus
WLLGNPECDRL

SEQ ID NO: 390901 - protein, 11 aa, Influenza virus
LLGNPECDRLL

SEQ ID NO: 390902 - protein, 11 aa, Influenza virus
VPEWSYIVEKE

SEQ ID NO: 390903 - protein, 11 aa, Influenza virus
PSFFRNMVWLT

SEQ ID NO: 390904 - protein, 11 aa, Influenza virus
SYNNTSGEQML

SEQ ID NO: 390905 - protein, 11 aa, Influenza virus
INFESTGNLIA

SEQ ID NO: 390906 - protein, 11 aa, Influenza virus
NFESTGNLIAP

SEQ ID NO: 390907 - protein, 11 aa, Influenza virus
FESTGNLIAPE

SEQ ID NO: 390908 - protein, 11 aa, Influenza virus
ESTGNLIAPEY

SEQ ID NO: 390909 - protein, 11 aa, Influenza virus
STGNLIAPEYG

SEQ ID NO: 390910 - protein, 11 aa, Influenza virus
TGNLIAPEYGF

SEQ ID NO: 390911 - protein, 11 aa, Influenza virus
GNLIAPEYGFK

SEQ ID NO: 390912 - protein, 11 aa, Influenza virus
NLIAPEYGFKI

SEQ ID NO: 390913 - protein, 11 aa, Influenza virus
LIAPEYGFKIS

SEQ ID NO: 390914 - protein, 11 aa, Influenza virus
IAPEYGFKISK

SEQ ID NO: 390915 - protein, 11 aa, Influenza virus
APEYGFKISKR

SEQ ID NO: 390916 - protein, 11 aa, Influenza virus
PEYGFKISKRG

SEQ ID NO: 390917 - protein, 11 aa, Influenza virus
EYGFKISKRGS

SEQ ID NO: 390918 - protein, 11 aa, Influenza virus
YGFKISKRGSS

SEQ ID NO: 390919 - protein, 11 aa, Influenza virus
GFKISKRGSSG

SEQ ID NO: 390920 - protein, 11 aa, Influenza virus
FKISKRGSSGI

SEQ ID NO: 390921 - protein, 11 aa, Influenza virus
ISKRGSSGIMK

SEQ ID NO: 390922 - protein, 11 aa, Influenza virus
SKRGSSGIMKT

SEQ ID NO: 390923 - protein, 11 aa, Influenza virus
CETKCQTPLGA

SEQ ID NO: 390924 - protein, 11 aa, Influenza virus
TKCQTPLGAIN

SEQ ID NO: 390925 - protein, 11 aa, Influenza virus
KCQTPLGAINT

SEQ ID NO: 390926 - protein, 11 aa, Influenza virus
CQTPLGAINTT

SEQ ID NO: 390927 - protein, 11 aa, Influenza virus
QTPLGAINTTL

SEQ ID NO: 390928 - protein, 11 aa, Influenza virus
TPLGAINTTLP

SEQ ID NO: 390929 - protein, 11 aa, Influenza virus
PLGAINTTLPF

SEQ ID NO: 390930 - protein, 11 aa, Influenza virus
LGAINTTLPFH

SEQ ID NO: 390931 - protein, 11 aa, Influenza virus
GAINTTLPFHN

SEQ ID NO: 390932 - protein, 11 aa, Influenza virus
AINTTLPFHNI

SEQ ID NO: 390933 - protein, 11 aa, Influenza virus
INTTLPFHNIH

SEQ ID NO: 390934 - protein, 11 aa, Influenza virus
NTTLPFHNIHP

SEQ ID NO: 390935 - protein, 11 aa, Influenza virus
TTLPFHNIHPL

SEQ ID NO: 390936 - protein, 11 aa, Influenza virus
TLPFHNIHPLT

SEQ ID NO: 390937 - protein, 11 aa, Influenza virus
LPFHNIHPLTI

SEQ ID NO: 390938 - protein, 11 aa, Influenza virus
PFHNIHPLTIG

SEQ ID NO: 390939 - protein, 11 aa, Influenza virus
FHNIHPLTIGE

SEQ ID NO: 390940 - protein, 11 aa, Influenza virus
HNIHPLTIGEC

SEQ ID NO: 390941 - protein, 11 aa, Influenza virus
NIHPLTIGECP

SEQ ID NO: 390942 - protein, 11 aa, Influenza virus
IHPLTIGECPK

SEQ ID NO: 390943 - protein, 11 aa, Influenza virus
HPLTIGECPKY

SEQ ID NO: 390944 - protein, 11 aa, Influenza virus
PLTIGECPKYV

SEQ ID NO: 390945 - protein, 11 aa, Influenza virus
LTIGECPKYVK

SEQ ID NO: 390946 - protein, 11 aa, Influenza virus
TIGECPKYVKS

SEQ ID NO: 390947 - protein, 11 aa, Influenza virus
PQIESRGLFGA

SEQ ID NO: 390948 - protein, 11 aa, Influenza virus
QIESRGLFGAI

SEQ ID NO: 390949 - protein, 11 aa, Influenza virus
IESRGLFGAIA

SEQ ID NO: 390950 - protein, 11 aa, Influenza virus
ESRGLFGAIAG

SEQ ID NO: 390951 - protein, 11 aa, Influenza virus
SRGLFGAIAGF

SEQ ID NO: 390952 - protein, 11 aa, Influenza virus
RGLFGAIAGFI

SEQ ID NO: 390953 - protein, 11 aa, Influenza virus
GLFGAIAGFIE

SEQ ID NO: 390954 - protein, 11 aa, Influenza virus
LFGAIAGFIEG

SEQ ID NO: 390955 - protein, 11 aa, Influenza virus
FGAIAGFIEGG

SEQ ID NO: 390956 - protein, 11 aa, Influenza virus
GAIAGFIEGGW

SEQ ID NO: 390957 - protein, 11 aa, Influenza virus
AIAGFIEGGWQ

SEQ ID NO: 390958 - protein, 11 aa, Influenza virus
IAGFIEGGWQG

SEQ ID NO: 390959 - protein, 11 aa, Influenza virus
AGFIEGGWQGM

SEQ ID NO: 390960 - protein, 11 aa, Influenza virus
GFIEGGWQGMV

SEQ ID NO: 390961 - protein, 11 aa, Influenza virus
FIEGGWQGMVD

SEQ ID NO: 390962 - protein, 11 aa, Influenza virus
IEGGWQGMVDG

SEQ ID NO: 390963 - protein, 11 aa, Influenza virus
EGGWQGMVDGW

SEQ ID NO: 390964 - protein, 11 aa, Influenza virus
GGWQGMVDGWY

SEQ ID NO: 390965 - protein, 11 aa, Influenza virus
GWQGMVDGWYG

SEQ ID NO: 390966 - protein, 11 aa, Influenza virus
WQGMVDGWYGY

SEQ ID NO: 390967 - protein, 11 aa, Influenza virus
QGMVDGWYGYH

SEQ ID NO: 390968 - protein, 11 aa, Influenza virus
GMVDGWYGYHH

SEQ ID NO: 390969 - protein, 11 aa, Influenza virus
MVDGWYGYHHS

SEQ ID NO: 390970 - protein, 11 aa, Influenza virus
VDGWYGYHHSN

SEQ ID NO: 390971 - protein, 11 aa, Influenza virus
DGWYGYHHSND

SEQ ID NO: 390972 - protein, 11 aa, Influenza virus
GWYGYHHSNDQ

SEQ ID NO: 390973 - protein, 11 aa, Influenza virus
WYGYHHSNDQG

SEQ ID NO: 390974 - protein, 11 aa, Influenza virus
YGYHHSNDQGS

SEQ ID NO: 390975 - protein, 11 aa, Influenza virus
GYHHSNDQGSG

SEQ ID NO: 390976 - protein, 11 aa, Influenza virus
YHHSNDQGSGY

SEQ ID NO: 390977 - protein, 11 aa, Influenza virus
HHSNDQGSGYA

SEQ ID NO: 390978 - protein, 11 aa, Influenza virus
HSNDQGSGYAA

SEQ ID NO: 390979 - protein, 11 aa, Influenza virus
SNDQGSGYAAD

SEQ ID NO: 390980 - protein, 11 aa, Influenza virus
NDQGSGYAADK

SEQ ID NO: 390981 - protein, 11 aa, Influenza virus
DQGSGYAADKE

SEQ ID NO: 390982 - protein, 11 aa, Influenza virus
QGSGYAADKES

SEQ ID NO: 390983 - protein, 11 aa, Influenza virus
GSGYAADKEST

SEQ ID NO: 390984 - protein, 11 aa, Influenza virus
SGYAADKESTQ

SEQ ID NO: 390985 - protein, 11 aa, Influenza virus
GYAADKESTQK

SEQ ID NO: 390986 - protein, 11 aa, Influenza virus
YAADKESTQKA

SEQ ID NO: 390987 - protein, 11 aa, Influenza virus
NLERRLENLNK

SEQ ID NO: 390988 - protein, 11 aa, Influenza virus
LERRLENLNKK

SEQ ID NO: 390989 - protein, 11 aa, Influenza virus
RLENLNKKMED

SEQ ID NO: 390990 - protein, 11 aa, Influenza virus
LENLNKKMEDG

SEQ ID NO: 390991 - protein, 11 aa, Influenza virus
ENLNKKMEDGF

SEQ ID NO: 390992 - protein, 11 aa, Influenza virus
VWTYNAELLVL

SEQ ID NO: 390993 - protein, 11 aa, Influenza virus
WTYNAELLVLM

SEQ ID NO: 390994 - protein, 11 aa, Influenza virus
TYNAELLVLME

SEQ ID NO: 390995 - protein, 11 aa, Influenza virus
YNAELLVLMEN

SEQ ID NO: 390996 - protein, 11 aa, Influenza virus
NAELLVLMENE

SEQ ID NO: 390997 - protein, 11 aa, Influenza virus
AELLVLMENER

SEQ ID NO: 390998 - protein, 11 aa, Influenza virus
ELLVLMENERT

SEQ ID NO: 390999 - protein, 11 aa, Influenza virus
LLVLMENERTL

SEQ ID NO: 391000 - protein, 11 aa, Influenza virus
LVLMENERTLD

SEQ ID NO: 391001 - protein, 11 aa, Influenza virus
VLMENERTLDF

SEQ ID NO: 391002 - protein, 11 aa, Influenza virus
LMENERTLDFH

SEQ ID NO: 391003 - protein, 11 aa, Influenza virus
MENERTLDFHD

SEQ ID NO: 391004 - protein, 11 aa, Influenza virus
ENERTLDFHDS

SEQ ID NO: 391005 - protein, 11 aa, Influenza virus
NERTLDFHDSN

SEQ ID NO: 391006 - protein, 11 aa, Influenza virus
ERTLDFHDSNV

SEQ ID NO: 391007 - protein, 11 aa, Influenza virus
LDFHDSNVKNL

SEQ ID NO: 391008 - protein, 11 aa, Influenza virus
DFHDSNVKNLY

SEQ ID NO: 391009 - protein, 11 aa, Influenza virus
LYDKVRMQLRD

SEQ ID NO: 391010 - protein, 11 aa, Influenza virus
YDKVRMQLRDN

SEQ ID NO: 391011 - protein, 11 aa, Influenza virus
KVRMQLRDNAK

SEQ ID NO: 391012 - protein, 11 aa, Influenza virus
VRMQLRDNAKE

SEQ ID NO: 391013 - protein, 11 aa, Influenza virus
MQLRDNAKEIG

SEQ ID NO: 391014 - protein, 11 aa, Influenza virus
DNAKEIGNGCF

SEQ ID NO: 391015 - protein, 11 aa, Influenza virus
NAKEIGNGCFE

SEQ ID NO: 391016 - protein, 11 aa, Influenza virus
AKEIGNGCFEF

SEQ ID NO: 391017 - protein, 11 aa, Influenza virus
KEIGNGCFEFY

SEQ ID NO: 391018 - protein, 11 aa, Influenza virus
EIGNGCFEFYH

SEQ ID NO: 391019 - protein, 11 aa, Influenza virus
IGNGCFEFYHK

SEQ ID NO: 391020 - protein, 11 aa, Influenza virus
GNGCFEFYHKC

SEQ ID NO: 391021 - protein, 11 aa, Influenza virus
NGCFEFYHKCD

SEQ ID NO: 391022 - protein, 11 aa, Influenza virus
GCFEFYHKCDD

SEQ ID NO: 391023 - protein, 11 aa, Influenza virus
CFEFYHKCDDE

SEQ ID NO: 391024 - protein, 11 aa, Influenza virus
FEFYHKCDDEC

SEQ ID NO: 391025 - protein, 11 aa, Influenza virus
EFYHKCDDECM

SEQ ID NO: 391026 - protein, 11 aa, Influenza virus
FYHKCDDECMN

SEQ ID NO: 391027 - protein, 11 aa, Influenza virus
YHKCDDECMNS

SEQ ID NO: 391028 - protein, 11 aa, Influenza virus
GTYDYPKYEEE

SEQ ID NO: 391029 - protein, 11 aa, Influenza virus
TYDYPKYEEES

SEQ ID NO: 391030 - protein, 11 aa, Influenza virus
YPKYEEESKLN

SEQ ID NO: 391031 - protein, 11 aa, Influenza virus
PKYEEESKLNR

SEQ ID NO: 391032 - protein, 11 aa, Influenza virus
KYEEESKLNRN

SEQ ID NO: 391033 - protein, 11 aa, Influenza virus
YEEESKLNRNE

SEQ ID NO: 391034 - protein, 11 aa, Influenza virus
EEESKLNRNEI

SEQ ID NO: 391035 - protein, 11 aa, Influenza virus
ESKLNRNEIKG

SEQ ID NO: 391036 - protein, 11 aa, Influenza virus
MGVYQILAIYA

SEQ ID NO: 391037 - protein, 11 aa, Influenza virus
GVYQILAIYAT

SEQ ID NO: 391038 - protein, 11 aa, Influenza virus
VYQILAIYATV

SEQ ID NO: 391039 - protein, 11 aa, Influenza virus
YQILAIYATVA

SEQ ID NO: 391040 - protein, 11 aa, Influenza virus
QILAIYATVAG

SEQ ID NO: 391041 - protein, 11 aa, Influenza virus
ILAIYATVAGS

SEQ ID NO: 391042 - protein, 11 aa, Influenza virus
LAIYATVAGSL

SEQ ID NO: 391043 - protein, 11 aa, Influenza virus
AIYATVAGSLS

SEQ ID NO: 391044 - protein, 11 aa, Influenza virus
IYATVAGSLSL

SEQ ID NO: 391045 - protein, 11 aa, Influenza virus
YATVAGSLSLA

SEQ ID NO: 391046 - protein, 11 aa, Influenza virus
ATVAGSLSLAI

SEQ ID NO: 391047 - protein, 11 aa, Influenza virus
TVAGSLSLAIM

SEQ ID NO: 391048 - protein, 11 aa, Influenza virus
VAGSLSLAIMI

SEQ ID NO: 391049 - protein, 11 aa, Influenza virus
AGSLSLAIMIA

SEQ ID NO: 391050 - protein, 11 aa, Influenza virus
GSLSLAIMIAG

SEQ ID NO: 391051 - protein, 11 aa, Influenza virus
SLSLAIMIAGI

SEQ ID NO: 391052 - protein, 11 aa, Influenza virus
LSLAIMIAGIS

SEQ ID NO: 391053 - protein, 11 aa, Influenza virus
AGISFWMCSNG

SEQ ID NO: 391054 - protein, 11 aa, Influenza virus
GISFWMCSNGS

SEQ ID NO: 391055 - protein, 11 aa, Influenza virus
ISFWMCSNGSL

SEQ ID NO: 391056 - protein, 11 aa, Influenza virus
SFWMCSNGSLQ

SEQ ID NO: 391057 - protein, 11 aa, Influenza virus
FWMCSNGSLQC

SEQ ID NO: 391058 - protein, 11 aa, Influenza virus
WMCSNGSLQCR

SEQ ID NO: 391059 - protein, 11 aa, Influenza virus
MCSNGSLQCRI

SEQ ID NO: 391060 - protein, 11 aa, Influenza virus
CSNGSLQCRIC

SEQ ID NO: 391061 - protein, 11 aa, Influenza virus
SNGSLQCRICI

SEQ ID NO: 391062 - protein, 11 aa, Influenza virus
VRGDQICIGYH

SEQ ID NO: 391063 - protein, 11 aa, Influenza virus
RGDQICIGYHA

SEQ ID NO: 391064 - protein, 11 aa, Influenza virus
GDQICIGYHAN

SEQ ID NO: 391065 - protein, 11 aa, Influenza virus
DQICIGYHANN

SEQ ID NO: 391066 - protein, 11 aa, Influenza virus
QICIGYHANNS

SEQ ID NO: 391067 - protein, 11 aa, Influenza virus
ICIGYHANNST

SEQ ID NO: 391068 - protein, 11 aa, Influenza virus
CIGYHANNSTE

SEQ ID NO: 391069 - protein, 11 aa, Influenza virus
IGYHANNSTEK

SEQ ID NO: 391070 - protein, 11 aa, Influenza virus
KVDTILERNVT

SEQ ID NO: 391071 - protein, 11 aa, Influenza virus
VDTILERNVTV

SEQ ID NO: 391072 - protein, 11 aa, Influenza virus
DTILERNVTVT

SEQ ID NO: 391073 - protein, 11 aa, Influenza virus
TILERNVTVTH

SEQ ID NO: 391074 - protein, 11 aa, Influenza virus
ILERNVTVTHA

SEQ ID NO: 391075 - protein, 11 aa, Influenza virus
LERNVTVTHAK

SEQ ID NO: 391076 - protein, 11 aa, Influenza virus
ERNVTVTHAKD

SEQ ID NO: 391077 - protein, 11 aa, Influenza virus
RNVTVTHAKDI

SEQ ID NO: 391078 - protein, 11 aa, Influenza virus
NVTVTHAKDIL

SEQ ID NO: 391079 - protein, 11 aa, Influenza virus
VTVTHAKDILE

SEQ ID NO: 391080 - protein, 11 aa, Influenza virus
TVTHAKDILEK

SEQ ID NO: 391081 - protein, 11 aa, Influenza virus
VTHAKDILEKT

SEQ ID NO: 391082 - protein, 11 aa, Influenza virus
THAKDILEKTH

SEQ ID NO: 391083 - protein, 11 aa, Influenza virus
HAKDILEKTHN

SEQ ID NO: 391084 - protein, 11 aa, Influenza virus
AKDILEKTHNG

SEQ ID NO: 391085 - protein, 11 aa, Influenza virus
DILEKTHNGKL

SEQ ID NO: 391086 - protein, 11 aa, Influenza virus
ILEKTHNGKLC

SEQ ID NO: 391087 - protein, 11 aa, Influenza virus
LEKTHNGKLCK

SEQ ID NO: 391088 - protein, 11 aa, Influenza virus
EKTHNGKLCKL

SEQ ID NO: 391089 - protein, 11 aa, Influenza virus
KTHNGKLCKLN

SEQ ID NO: 391090 - protein, 11 aa, Influenza virus
THNGKLCKLNG

SEQ ID NO: 391091 - protein, 11 aa, Influenza virus
HNGKLCKLNGI

SEQ ID NO: 391092 - protein, 11 aa, Influenza virus
NGKLCKLNGIP

SEQ ID NO: 391093 - protein, 11 aa, Influenza virus
GKLCKLNGIPP

SEQ ID NO: 391094 - protein, 11 aa, Influenza virus
KLCKLNGIPPL

SEQ ID NO: 391095 - protein, 11 aa, Influenza virus
LCKLNGIPPLE

SEQ ID NO: 391096 - protein, 11 aa, Influenza virus
CKLNGIPPLEL

SEQ ID NO: 391097 - protein, 11 aa, Influenza virus
KLNGIPPLELG

SEQ ID NO: 391098 - protein, 11 aa, Influenza virus
LNGIPPLELGD

SEQ ID NO: 391099 - protein, 11 aa, Influenza virus
NGIPPLELGDC

SEQ ID NO: 391100 - protein, 11 aa, Influenza virus
GIPPLELGDCS

SEQ ID NO: 391101 - protein, 11 aa, Influenza virus
IPPLELGDCSI

SEQ ID NO: 391102 - protein, 11 aa, Influenza virus
PPLELGDCSIA

SEQ ID NO: 391103 - protein, 11 aa, Influenza virus
PLELGDCSIAG

SEQ ID NO: 391104 - protein, 11 aa, Influenza virus
LELGDCSIAGW

SEQ ID NO: 391105 - protein, 11 aa, Influenza virus
ELGDCSIAGWL

SEQ ID NO: 391106 - protein, 11 aa, Influenza virus
LGDCSIAGWLL

SEQ ID NO: 391107 - protein, 11 aa, Influenza virus
GDCSIAGWLLG

SEQ ID NO: 391108 - protein, 11 aa, Influenza virus
DCSIAGWLLGN

SEQ ID NO: 391109 - protein, 11 aa, Influenza virus
CSIAGWLLGNP

SEQ ID NO: 391110 - protein, 11 aa, Influenza virus
SIAGWLLGNPE

SEQ ID NO: 391111 - protein, 11 aa, Influenza virus
IAGWLLGNPEC

SEQ ID NO: 391112 - protein, 11 aa, Influenza virus
AGWLLGNPECD

SEQ ID NO: 391113 - protein, 11 aa, Influenza virus
GWLLGNPECDR

SEQ ID NO: 391114 - protein, 11 aa, Influenza virus
WLLGNPECDRL

SEQ ID NO: 391115 - protein, 11 aa, Influenza virus
LLGNPECDRLL

SEQ ID NO: 391116 - protein, 11 aa, Influenza virus
LGNPECDRLLS

SEQ ID NO: 391117 - protein, 11 aa, Influenza virus
VPEWSYIMEKE

SEQ ID NO: 391118 - protein, 11 aa, Influenza virus
PEWSYIMEKEN

SEQ ID NO: 391119 - protein, 11 aa, Influenza virus
EWSYIMEKENP

SEQ ID NO: 391120 - protein, 11 aa, Influenza virus
LCYPGSFNDYE

SEQ ID NO: 391121 - protein, 11 aa, Influenza virus
CYPGSFNDYEE

SEQ ID NO: 391122 - protein, 11 aa, Influenza virus
YPGSFNDYEEL

SEQ ID NO: 391123 - protein, 11 aa, Influenza virus
PGSFNDYEELK

SEQ ID NO: 391124 - protein, 11 aa, Influenza virus
HFEKVKILPKD

SEQ ID NO: 391125 - protein, 11 aa, Influenza virus
PSFFRNMVWLT

SEQ ID NO: 391126 - protein, 11 aa, Influenza virus
AKGSYNNTSGE

SEQ ID NO: 391127 - protein, 11 aa, Influenza virus
KGSYNNTSGEQ

SEQ ID NO: 391128 - protein, 11 aa, Influenza virus
GSYNNTSGEQM

SEQ ID NO: 391129 - protein, 11 aa, Influenza virus
SYNNTSGEQML

SEQ ID NO: 391130 - protein, 11 aa, Influenza virus
YNNTSGEQMLI

SEQ ID NO: 391131 - protein, 11 aa, Influenza virus
NNTSGEQMLII

SEQ ID NO: 391132 - protein, 11 aa, Influenza virus
NTSGEQMLIIW

SEQ ID NO: 391133 - protein, 11 aa, Influenza virus
TSGEQMLIIWG

SEQ ID NO: 391134 - protein, 11 aa, Influenza virus
WDTINFESTGN

SEQ ID NO: 391135 - protein, 11 aa, Influenza virus
DTINFESTGNL

SEQ ID NO: 391136 - protein, 11 aa, Influenza virus
TINFESTGNLI

SEQ ID NO: 391137 - protein, 11 aa, Influenza virus
INFESTGNLIA

SEQ ID NO: 391138 - protein, 11 aa, Influenza virus
NFESTGNLIAP

SEQ ID NO: 391139 - protein, 11 aa, Influenza virus
FESTGNLIAPE

SEQ ID NO: 391140 - protein, 11 aa, Influenza virus
ESTGNLIAPEY

SEQ ID NO: 391141 - protein, 11 aa, Influenza virus
STGNLIAPEYG

SEQ ID NO: 391142 - protein, 11 aa, Influenza virus
TGNLIAPEYGF

SEQ ID NO: 391143 - protein, 11 aa, Influenza virus
GNLIAPEYGFK

SEQ ID NO: 391144 - protein, 11 aa, Influenza virus
NLIAPEYGFKI

SEQ ID NO: 391145 - protein, 11 aa, Influenza virus
LIAPEYGFKIS

SEQ ID NO: 391146 - protein, 11 aa, Influenza virus
IAPEYGFKISK

SEQ ID NO: 391147 - protein, 11 aa, Influenza virus
APEYGFKISKR

SEQ ID NO: 391148 - protein, 11 aa, Influenza virus
PEYGFKISKRG

SEQ ID NO: 391149 - protein, 11 aa, Influenza virus
EYGFKISKRGS

SEQ ID NO: 391150 - protein, 11 aa, Influenza virus
YGFKISKRGSS

SEQ ID NO: 391151 - protein, 11 aa, Influenza virus
GFKISKRGSSG

SEQ ID NO: 391152 - protein, 11 aa, Influenza virus
FKISKRGSSGI

SEQ ID NO: 391153 - protein, 11 aa, Influenza virus
KISKRGSSGIM

SEQ ID NO: 391154 - protein, 11 aa, Influenza virus
ISKRGSSGIMK

SEQ ID NO: 391155 - protein, 11 aa, Influenza virus
SKRGSSGIMKT

SEQ ID NO: 391156 - protein, 11 aa, Influenza virus
KRGSSGIMKTE

SEQ ID NO: 391157 - protein, 11 aa, Influenza virus
NCETKCQTPLG

SEQ ID NO: 391158 - protein, 11 aa, Influenza virus
CETKCQTPLGA

SEQ ID NO: 391159 - protein, 11 aa, Influenza virus
ETKCQTPLGAI

SEQ ID NO: 391160 - protein, 11 aa, Influenza virus
TKCQTPLGAIN

SEQ ID NO: 391161 - protein, 11 aa, Influenza virus
KCQTPLGAINT

SEQ ID NO: 391162 - protein, 11 aa, Influenza virus
CQTPLGAINTT

SEQ ID NO: 391163 - protein, 11 aa, Influenza virus
QTPLGAINTTL

SEQ ID NO: 391164 - protein, 11 aa, Influenza virus
TPLGAINTTLP

SEQ ID NO: 391165 - protein, 11 aa, Influenza virus
PLGAINTTLPF

SEQ ID NO: 391166 - protein, 11 aa, Influenza virus
LGAINTTLPFH

SEQ ID NO: 391167 - protein, 11 aa, Influenza virus
GAINTTLPFHN

SEQ ID NO: 391168 - protein, 11 aa, Influenza virus
AINTTLPFHNV

SEQ ID NO: 391169 - protein, 11 aa, Influenza virus
INTTLPFHNVH

SEQ ID NO: 391170 - protein, 11 aa, Influenza virus
NTTLPFHNVHP

SEQ ID NO: 391171 - protein, 11 aa, Influenza virus
TTLPFHNVHPL

SEQ ID NO: 391172 - protein, 11 aa, Influenza virus
TLPFHNVHPLT

SEQ ID NO: 391173 - protein, 11 aa, Influenza virus
LPFHNVHPLTI

SEQ ID NO: 391174 - protein, 11 aa, Influenza virus
PFHNVHPLTIG

SEQ ID NO: 391175 - protein, 11 aa, Influenza virus
FHNVHPLTIGE

SEQ ID NO: 391176 - protein, 11 aa, Influenza virus
HNVHPLTIGEC

SEQ ID NO: 391177 - protein, 11 aa, Influenza virus
NVHPLTIGECP

SEQ ID NO: 391178 - protein, 11 aa, Influenza virus
VHPLTIGECPK

SEQ ID NO: 391179 - protein, 11 aa, Influenza virus
HPLTIGECPKY

SEQ ID NO: 391180 - protein, 11 aa, Influenza virus
PLTIGECPKYV

SEQ ID NO: 391181 - protein, 11 aa, Influenza virus
LTIGECPKYVK

SEQ ID NO: 391182 - protein, 11 aa, Influenza virus
TIGECPKYVKS

SEQ ID NO: 391183 - protein, 11 aa, Influenza virus
IGECPKYVKSE

SEQ ID NO: 391184 - protein, 11 aa, Influenza virus
GECPKYVKSEK

SEQ ID NO: 391185 - protein, 11 aa, Influenza virus
ECPKYVKSEKL

SEQ ID NO: 391186 - protein, 11 aa, Influenza virus
CPKYVKSEKLV

SEQ ID NO: 391187 - protein, 11 aa, Influenza virus
PKYVKSEKLVL

SEQ ID NO: 391188 - protein, 11 aa, Influenza virus
KYVKSEKLVLA

SEQ ID NO: 391189 - protein, 11 aa, Influenza virus
YVKSEKLVLAT

SEQ ID NO: 391190 - protein, 11 aa, Influenza virus
VKSEKLVLATG

SEQ ID NO: 391191 - protein, 11 aa, Influenza virus
SEKLVLATGLR

SEQ ID NO: 391192 - protein, 11 aa, Influenza virus
EKLVLATGLRN

SEQ ID NO: 391193 - protein, 11 aa, Influenza virus
KLVLATGLRNV

SEQ ID NO: 391194 - protein, 11 aa, Influenza virus
LVLATGLRNVP

SEQ ID NO: 391195 - protein, 11 aa, Influenza virus
VLATGLRNVPQ

SEQ ID NO: 391196 - protein, 11 aa, Influenza virus
LATGLRNVPQI

SEQ ID NO: 391197 - protein, 11 aa, Influenza virus
ATGLRNVPQIE

SEQ ID NO: 391198 - protein, 11 aa, Influenza virus
RNVPQIESRGL

SEQ ID NO: 391199 - protein, 11 aa, Influenza virus
NVPQIESRGLF

SEQ ID NO: 391200 - protein, 11 aa, Influenza virus
VPQIESRGLFG

SEQ ID NO: 391201 - protein, 11 aa, Influenza virus
PQIESRGLFGA

SEQ ID NO: 391202 - protein, 11 aa, Influenza virus
QIESRGLFGAI

SEQ ID NO: 391203 - protein, 11 aa, Influenza virus
IESRGLFGAIA

SEQ ID NO: 391204 - protein, 11 aa, Influenza virus
ESRGLFGAIAG

SEQ ID NO: 391205 - protein, 11 aa, Influenza virus
SRGLFGAIAGF

SEQ ID NO: 391206 - protein, 11 aa, Influenza virus
RGLFGAIAGFI

SEQ ID NO: 391207 - protein, 11 aa, Influenza virus
GLFGAIAGFIE

SEQ ID NO: 391208 - protein, 11 aa, Influenza virus
LFGAIAGFIEG

SEQ ID NO: 391209 - protein, 11 aa, Influenza virus
FGAIAGFIEGG

SEQ ID NO: 391210 - protein, 11 aa, Influenza virus
GAIAGFIEGGW

SEQ ID NO: 391211 - protein, 11 aa, Influenza virus
AIAGFIEGGWQ

SEQ ID NO: 391212 - protein, 11 aa, Influenza virus
IAGFIEGGWQG

SEQ ID NO: 391213 - protein, 11 aa, Influenza virus
AGFIEGGWQGM

SEQ ID NO: 391214 - protein, 11 aa, Influenza virus
GFIEGGWQGMV

SEQ ID NO: 391215 - protein, 11 aa, Influenza virus
FIEGGWQGMVD

SEQ ID NO: 391216 - protein, 11 aa, Influenza virus
IEGGWQGMVDG

SEQ ID NO: 391217 - protein, 11 aa, Influenza virus
EGGWQGMVDGW

SEQ ID NO: 391218 - protein, 11 aa, Influenza virus
GGWQGMVDGWY

SEQ ID NO: 391219 - protein, 11 aa, Influenza virus
GWQGMVDGWYG

SEQ ID NO: 391220 - protein, 11 aa, Influenza virus
WQGMVDGWYGY

SEQ ID NO: 391221 - protein, 11 aa, Influenza virus
QGMVDGWYGYH

SEQ ID NO: 391222 - protein, 11 aa, Influenza virus
GMVDGWYGYHH

SEQ ID NO: 391223 - protein, 11 aa, Influenza virus
MVDGWYGYHHS

SEQ ID NO: 391224 - protein, 11 aa, Influenza virus
VDGWYGYHHSN

SEQ ID NO: 391225 - protein, 11 aa, Influenza virus
DGWYGYHHSND

SEQ ID NO: 391226 - protein, 11 aa, Influenza virus
GWYGYHHSNDQ

SEQ ID NO: 391227 - protein, 11 aa, Influenza virus
WYGYHHSNDQG

SEQ ID NO: 391228 - protein, 11 aa, Influenza virus
YGYHHSNDQGS

SEQ ID NO: 391229 - protein, 11 aa, Influenza virus
GYHHSNDQGSG

SEQ ID NO: 391230 - protein, 11 aa, Influenza virus
YHHSNDQGSGY

SEQ ID NO: 391231 - protein, 11 aa, Influenza virus
HHSNDQGSGYA

SEQ ID NO: 391232 - protein, 11 aa, Influenza virus
HSNDQGSGYAA

SEQ ID NO: 391233 - protein, 11 aa, Influenza virus
SNDQGSGYAAD

SEQ ID NO: 391234 - protein, 11 aa, Influenza virus
NDQGSGYAADK

SEQ ID NO: 391235 - protein, 11 aa, Influenza virus
DQGSGYAADKE

SEQ ID NO: 391236 - protein, 11 aa, Influenza virus
QGSGYAADKES

SEQ ID NO: 391237 - protein, 11 aa, Influenza virus
GSGYAADKEST

SEQ ID NO: 391238 - protein, 11 aa, Influenza virus
SGYAADKESTQ

SEQ ID NO: 391239 - protein, 11 aa, Influenza virus
GYAADKESTQK

SEQ ID NO: 391240 - protein, 11 aa, Influenza virus
YAADKESTQKA

SEQ ID NO: 391241 - protein, 11 aa, Influenza virus
AADKESTQKAF

SEQ ID NO: 391242 - protein, 11 aa, Influenza virus
KEFSNLERRLE

SEQ ID NO: 391243 - protein, 11 aa, Influenza virus
EFSNLERRLEN

SEQ ID NO: 391244 - protein, 11 aa, Influenza virus
FSNLERRLENL

SEQ ID NO: 391245 - protein, 11 aa, Influenza virus
NLERRLENLNK

SEQ ID NO: 391246 - protein, 11 aa, Influenza virus
LERRLENLNKK

SEQ ID NO: 391247 - protein, 11 aa, Influenza virus
RLENLNKKMED

SEQ ID NO: 391248 - protein, 11 aa, Influenza virus
LENLNKKMEDG

SEQ ID NO: 391249 - protein, 11 aa, Influenza virus
MEDGFLDVWTY

SEQ ID NO: 391250 - protein, 11 aa, Influenza virus
EDGFLDVWTYN

SEQ ID NO: 391251 - protein, 11 aa, Influenza virus
DGFLDVWTYNA

SEQ ID NO: 391252 - protein, 11 aa, Influenza virus
GFLDVWTYNAE

SEQ ID NO: 391253 - protein, 11 aa, Influenza virus
FLDVWTYNAEL

SEQ ID NO: 391254 - protein, 11 aa, Influenza virus
LDVWTYNAELL

SEQ ID NO: 391255 - protein, 11 aa, Influenza virus
DVWTYNAELLV

SEQ ID NO: 391256 - protein, 11 aa, Influenza virus
VWTYNAELLVL

SEQ ID NO: 391257 - protein, 11 aa, Influenza virus
WTYNAELLVLM

SEQ ID NO: 391258 - protein, 11 aa, Influenza virus
TYNAELLVLME

SEQ ID NO: 391259 - protein, 11 aa, Influenza virus
YNAELLVLMEN

SEQ ID NO: 391260 - protein, 11 aa, Influenza virus
NAELLVLMENE

SEQ ID NO: 391261 - protein, 11 aa, Influenza virus
AELLVLMENER

SEQ ID NO: 391262 - protein, 11 aa, Influenza virus
ELLVLMENERT

SEQ ID NO: 391263 - protein, 11 aa, Influenza virus
LLVLMENERTL

SEQ ID NO: 391264 - protein, 11 aa, Influenza virus
LVLMENERTLD

SEQ ID NO: 391265 - protein, 11 aa, Influenza virus
VLMENERTLDF

SEQ ID NO: 391266 - protein, 11 aa, Influenza virus
LMENERTLDFH

SEQ ID NO: 391267 - protein, 11 aa, Influenza virus
MENERTLDFHD

SEQ ID NO: 391268 - protein, 11 aa, Influenza virus
ENERTLDFHDS

SEQ ID NO: 391269 - protein, 11 aa, Influenza virus
NERTLDFHDSN

SEQ ID NO: 391270 - protein, 11 aa, Influenza virus
ERTLDFHDSNV

SEQ ID NO: 391271 - protein, 11 aa, Influenza virus
RTLDFHDSNVK

SEQ ID NO: 391272 - protein, 11 aa, Influenza virus
TLDFHDSNVKN

SEQ ID NO: 391273 - protein, 11 aa, Influenza virus
LDFHDSNVKNL

SEQ ID NO: 391274 - protein, 11 aa, Influenza virus
DFHDSNVKNLY

SEQ ID NO: 391275 - protein, 11 aa, Influenza virus
FHDSNVKNLYD

SEQ ID NO: 391276 - protein, 11 aa, Influenza virus
VKNLYDKVRMQ

SEQ ID NO: 391277 - protein, 11 aa, Influenza virus
KNLYDKVRMQL

SEQ ID NO: 391278 - protein, 11 aa, Influenza virus
NLYDKVRMQLR

SEQ ID NO: 391279 - protein, 11 aa, Influenza virus
LYDKVRMQLRD

SEQ ID NO: 391280 - protein, 11 aa, Influenza virus
YDKVRMQLRDN

SEQ ID NO: 391281 - protein, 11 aa, Influenza virus
DKVRMQLRDNV

SEQ ID NO: 391282 - protein, 11 aa, Influenza virus
KVRMQLRDNVK

SEQ ID NO: 391283 - protein, 11 aa, Influenza virus
VRMQLRDNVKE

SEQ ID NO: 391284 - protein, 11 aa, Influenza virus
RMQLRDNVKEL

SEQ ID NO: 391285 - protein, 11 aa, Influenza virus
MQLRDNVKELG

SEQ ID NO: 391286 - protein, 11 aa, Influenza virus
QLRDNVKELGN

SEQ ID NO: 391287 - protein, 11 aa, Influenza virus
LRDNVKELGNG

SEQ ID NO: 391288 - protein, 11 aa, Influenza virus
RDNVKELGNGC

SEQ ID NO: 391289 - protein, 11 aa, Influenza virus
DNVKELGNGCF

SEQ ID NO: 391290 - protein, 11 aa, Influenza virus
NVKELGNGCFE

SEQ ID NO: 391291 - protein, 11 aa, Influenza virus
VKELGNGCFEF

SEQ ID NO: 391292 - protein, 11 aa, Influenza virus
KELGNGCFEFY

SEQ ID NO: 391293 - protein, 11 aa, Influenza virus
ELGNGCFEFYH

SEQ ID NO: 391294 - protein, 11 aa, Influenza virus
LGNGCFEFYHK

SEQ ID NO: 391295 - protein, 11 aa, Influenza virus
GNGCFEFYHKC

SEQ ID NO: 391296 - protein, 11 aa, Influenza virus
NGCFEFYHKCD

SEQ ID NO: 391297 - protein, 11 aa, Influenza virus
GCFEFYHKCDD

SEQ ID NO: 391298 - protein, 11 aa, Influenza virus
CFEFYHKCDDE

SEQ ID NO: 391299 - protein, 11 aa, Influenza virus
FEFYHKCDDEC

SEQ ID NO: 391300 - protein, 11 aa, Influenza virus
EFYHKCDDECM

SEQ ID NO: 391301 - protein, 11 aa, Influenza virus
KNGTYDYPKYE

SEQ ID NO: 391302 - protein, 11 aa, Influenza virus
NGTYDYPKYEE

SEQ ID NO: 391303 - protein, 11 aa, Influenza virus
GTYDYPKYEEE

SEQ ID NO: 391304 - protein, 11 aa, Influenza virus
TYDYPKYEEES

SEQ ID NO: 391305 - protein, 11 aa, Influenza virus
YDYPKYEEESK

SEQ ID NO: 391306 - protein, 11 aa, Influenza virus
DYPKYEEESKL

SEQ ID NO: 391307 - protein, 11 aa, Influenza virus
YPKYEEESKLN

SEQ ID NO: 391308 - protein, 11 aa, Influenza virus
PKYEEESKLNR

SEQ ID NO: 391309 - protein, 11 aa, Influenza virus
KYEEESKLNRN

SEQ ID NO: 391310 - protein, 11 aa, Influenza virus
YEEESKLNRNE

SEQ ID NO: 391311 - protein, 11 aa, Influenza virus
EEESKLNRNEI

SEQ ID NO: 391312 - protein, 11 aa, Influenza virus
EESKLNRNEIK

SEQ ID NO: 391313 - protein, 11 aa, Influenza virus
ESKLNRNEIKG

SEQ ID NO: 391314 - protein, 11 aa, Influenza virus
SKLNRNEIKGV

SEQ ID NO: 391315 - protein, 11 aa, Influenza virus
KLNRNEIKGVK

SEQ ID NO: 391316 - protein, 11 aa, Influenza virus
LNRNEIKGVKL

SEQ ID NO: 391317 - protein, 11 aa, Influenza virus
NRNEIKGVKLS

SEQ ID NO: 391318 - protein, 11 aa, Influenza virus
RNEIKGVKLSS

SEQ ID NO: 391319 - protein, 11 aa, Influenza virus
NEIKGVKLSSM

SEQ ID NO: 391320 - protein, 11 aa, Influenza virus
EIKGVKLSSMG

SEQ ID NO: 391321 - protein, 11 aa, Influenza virus
IKGVKLSSMGV

SEQ ID NO: 391322 - protein, 11 aa, Influenza virus
KGVKLSSMGVY

SEQ ID NO: 391323 - protein, 11 aa, Influenza virus
GVKLSSMGVYQ

SEQ ID NO: 391324 - protein, 11 aa, Influenza virus
VKLSSMGVYQI

SEQ ID NO: 391325 - protein, 11 aa, Influenza virus
KLSSMGVYQIL

SEQ ID NO: 391326 - protein, 11 aa, Influenza virus
LSSMGVYQILA

SEQ ID NO: 391327 - protein, 11 aa, Influenza virus
SSMGVYQILAI

SEQ ID NO: 391328 - protein, 11 aa, Influenza virus
SMGVYQILAIY

SEQ ID NO: 391329 - protein, 11 aa, Influenza virus
MGVYQILAIYA

SEQ ID NO: 391330 - protein, 11 aa, Influenza virus
GVYQILAIYAT

SEQ ID NO: 391331 - protein, 11 aa, Influenza virus
VYQILAIYATV

SEQ ID NO: 391332 - protein, 11 aa, Influenza virus
YQILAIYATVA

SEQ ID NO: 391333 - protein, 11 aa, Influenza virus
QILAIYATVAG

SEQ ID NO: 391334 - protein, 11 aa, Influenza virus
ILAIYATVAGS

SEQ ID NO: 391335 - protein, 11 aa, Influenza virus
LAIYATVAGSL

SEQ ID NO: 391336 - protein, 11 aa, Influenza virus
AIYATVAGSLS

SEQ ID NO: 391337 - protein, 11 aa, Influenza virus
IYATVAGSLSL

SEQ ID NO: 391338 - protein, 11 aa, Influenza virus
YATVAGSLSLA

SEQ ID NO: 391339 - protein, 11 aa, Influenza virus
ATVAGSLSLAI

SEQ ID NO: 391340 - protein, 11 aa, Influenza virus
TVAGSLSLAIM

SEQ ID NO: 391341 - protein, 11 aa, Influenza virus
VAGSLSLAIMM

SEQ ID NO: 391342 - protein, 11 aa, Influenza virus
AGSLSLAIMMA

SEQ ID NO: 391343 - protein, 11 aa, Influenza virus
GSLSLAIMMAG

SEQ ID NO: 391344 - protein, 11 aa, Influenza virus
SLSLAIMMAGI

SEQ ID NO: 391345 - protein, 11 aa, Influenza virus
LSLAIMMAGIS

SEQ ID NO: 391346 - protein, 11 aa, Influenza virus
AGISFWMCSNG

SEQ ID NO: 391347 - protein, 11 aa, Influenza virus
GISFWMCSNGS

SEQ ID NO: 391348 - protein, 11 aa, Influenza virus
ISFWMCSNGSL

SEQ ID NO: 391349 - protein, 11 aa, Influenza virus
SFWMCSNGSLQ

SEQ ID NO: 391350 - protein, 11 aa, Influenza virus
FWMCSNGSLQC

SEQ ID NO: 391351 - protein, 11 aa, Influenza virus
WMCSNGSLQCR

SEQ ID NO: 391352 - protein, 11 aa, Influenza virus
MCSNGSLQCRI

SEQ ID NO: 391353 - protein, 11 aa, Influenza virus
CSNGSLQCRIC

SEQ ID NO: 391354 - protein, 11 aa, Influenza virus
SNGSLQCRICI

SEQ ID NO: 391355 - protein, 11 aa, Influenza virus
MNPNQKIITIG

SEQ ID NO: 391356 - protein, 11 aa, Influenza virus
NPNQKIITIGS

SEQ ID NO: 391357 - protein, 11 aa, Influenza virus
NQKIITIGSVS

SEQ ID NO: 391358 - protein, 11 aa, Influenza virus
QKIITIGSVSL

SEQ ID NO: 391359 - protein, 11 aa, Influenza virus
QIAILATTVTL

SEQ ID NO: 391360 - protein, 11 aa, Influenza virus
IAILATTVTLH

SEQ ID NO: 391361 - protein, 11 aa, Influenza virus
AILATTVTLHF

SEQ ID NO: 391362 - protein, 11 aa, Influenza virus
ILATTVTLHFK

SEQ ID NO: 391363 - protein, 11 aa, Influenza virus
LATTVTLHFKQ

SEQ ID NO: 391364 - protein, 11 aa, Influenza virus
ATTVTLHFKQH

SEQ ID NO: 391365 - protein, 11 aa, Influenza virus
TVTLHFKQHEC

SEQ ID NO: 391366 - protein, 11 aa, Influenza virus
WSKPQCQITGF

SEQ ID NO: 391367 - protein, 11 aa, Influenza virus
SKPQCQITGFA

SEQ ID NO: 391368 - protein, 11 aa, Influenza virus
KPQCQITGFAP

SEQ ID NO: 391369 - protein, 11 aa, Influenza virus
PQCQITGFAPF

SEQ ID NO: 391370 - protein, 11 aa, Influenza virus
QCQITGFAPFS

SEQ ID NO: 391371 - protein, 11 aa, Influenza virus
CQITGFAPFSK

SEQ ID NO: 391372 - protein, 11 aa, Influenza virus
QITGFAPFSKD

SEQ ID NO: 391373 - protein, 11 aa, Influenza virus
ITGFAPFSKDN

SEQ ID NO: 391374 - protein, 11 aa, Influenza virus
TGFAPFSKDNS

SEQ ID NO: 391375 - protein, 11 aa, Influenza virus
GFAPFSKDNSI

SEQ ID NO: 391376 - protein, 11 aa, Influenza virus
FAPFSKDNSIR

SEQ ID NO: 391377 - protein, 11 aa, Influenza virus
APFSKDNSIRL

SEQ ID NO: 391378 - protein, 11 aa, Influenza virus
PFSKDNSIRLS

SEQ ID NO: 391379 - protein, 11 aa, Influenza virus
FSKDNSIRLSA

SEQ ID NO: 391380 - protein, 11 aa, Influenza virus
SKDNSIRLSAG

SEQ ID NO: 391381 - protein, 11 aa, Influenza virus
KDNSIRLSAGG

SEQ ID NO: 391382 - protein, 11 aa, Influenza virus
DNSIRLSAGGD

SEQ ID NO: 391383 - protein, 11 aa, Influenza virus
NSIRLSAGGDI

SEQ ID NO: 391384 - protein, 11 aa, Influenza virus
SIRLSAGGDIW

SEQ ID NO: 391385 - protein, 11 aa, Influenza virus
IRLSAGGDIWV

SEQ ID NO: 391386 - protein, 11 aa, Influenza virus
RLSAGGDIWVT

SEQ ID NO: 391387 - protein, 11 aa, Influenza virus
LSAGGDIWVTR

SEQ ID NO: 391388 - protein, 11 aa, Influenza virus
SAGGDIWVTRE

SEQ ID NO: 391389 - protein, 11 aa, Influenza virus
AGGDIWVTREP

SEQ ID NO: 391390 - protein, 11 aa, Influenza virus
GGDIWVTREPY

SEQ ID NO: 391391 - protein, 11 aa, Influenza virus
GDIWVTREPYV

SEQ ID NO: 391392 - protein, 11 aa, Influenza virus
DIWVTREPYVS

SEQ ID NO: 391393 - protein, 11 aa, Influenza virus
IWVTREPYVSC

SEQ ID NO: 391394 - protein, 11 aa, Influenza virus
WVTREPYVSCD

SEQ ID NO: 391395 - protein, 11 aa, Influenza virus
GKCYQFALGQG

SEQ ID NO: 391396 - protein, 11 aa, Influenza virus
KCYQFALGQGT

SEQ ID NO: 391397 - protein, 11 aa, Influenza virus
CYQFALGQGTT

SEQ ID NO: 391398 - protein, 11 aa, Influenza virus
YQFALGQGTTL

SEQ ID NO: 391399 - protein, 11 aa, Influenza virus
QFALGQGTTLD

SEQ ID NO: 391400 - protein, 11 aa, Influenza virus
FALGQGTTLDN

SEQ ID NO: 391401 - protein, 11 aa, Influenza virus
ALGQGTTLDNK

SEQ ID NO: 391402 - protein, 11 aa, Influenza virus
LGQGTTLDNKH

SEQ ID NO: 391403 - protein, 11 aa, Influenza virus
GQGTTLDNKHS

SEQ ID NO: 391404 - protein, 11 aa, Influenza virus
QGTTLDNKHSN

SEQ ID NO: 391405 - protein, 11 aa, Influenza virus
GTTLDNKHSNG

SEQ ID NO: 391406 - protein, 11 aa, Influenza virus
TTLDNKHSNGT

SEQ ID NO: 391407 - protein, 11 aa, Influenza virus
TLDNKHSNGTI

SEQ ID NO: 391408 - protein, 11 aa, Influenza virus
LDNKHSNGTIH

SEQ ID NO: 391409 - protein, 11 aa, Influenza virus
DNKHSNGTIHD

SEQ ID NO: 391410 - protein, 11 aa, Influenza virus
NKHSNGTIHDR

SEQ ID NO: 391411 - protein, 11 aa, Influenza virus
TIHDRIPHRTL

SEQ ID NO: 391412 - protein, 11 aa, Influenza virus
IHDRIPHRTLL

SEQ ID NO: 391413 - protein, 11 aa, Influenza virus
HDRIPHRTLLM

SEQ ID NO: 391414 - protein, 11 aa, Influenza virus
DRIPHRTLLMN

SEQ ID NO: 391415 - protein, 11 aa, Influenza virus
RIPHRTLLMNE

SEQ ID NO: 391416 - protein, 11 aa, Influenza virus
IPHRTLLMNEL

SEQ ID NO: 391417 - protein, 11 aa, Influenza virus
PHRTLLMNELG

SEQ ID NO: 391418 - protein, 11 aa, Influenza virus
HRTLLMNELGV

SEQ ID NO: 391419 - protein, 11 aa, Influenza virus
RTLLMNELGVP

SEQ ID NO: 391420 - protein, 11 aa, Influenza virus
TLLMNELGVPF

SEQ ID NO: 391421 - protein, 11 aa, Influenza virus
LLMNELGVPFH

SEQ ID NO: 391422 - protein, 11 aa, Influenza virus
LMNELGVPFHL

SEQ ID NO: 391423 - protein, 11 aa, Influenza virus
MNELGVPFHLG

SEQ ID NO: 391424 - protein, 11 aa, Influenza virus
NELGVPFHLGT

SEQ ID NO: 391425 - protein, 11 aa, Influenza virus
ELGVPFHLGTK

SEQ ID NO: 391426 - protein, 11 aa, Influenza virus
LGVPFHLGTKQ

SEQ ID NO: 391427 - protein, 11 aa, Influenza virus
GVPFHLGTKQV

SEQ ID NO: 391428 - protein, 11 aa, Influenza virus
VPFHLGTKQVC

SEQ ID NO: 391429 - protein, 11 aa, Influenza virus
FHLGTKQVCVA

SEQ ID NO: 391430 - protein, 11 aa, Influenza virus
HLGTKQVCVAW

SEQ ID NO: 391431 - protein, 11 aa, Influenza virus
LGTKQVCVAWS

SEQ ID NO: 391432 - protein, 11 aa, Influenza virus
GTKQVCVAWSS

SEQ ID NO: 391433 - protein, 11 aa, Influenza virus
TKQVCVAWSSS

SEQ ID NO: 391434 - protein, 11 aa, Influenza virus
KQVCVAWSSSS

SEQ ID NO: 391435 - protein, 11 aa, Influenza virus
QVCVAWSSSSC

SEQ ID NO: 391436 - protein, 11 aa, Influenza virus
VCVAWSSSSCH

SEQ ID NO: 391437 - protein, 11 aa, Influenza virus
CVAWSSSSCHD

SEQ ID NO: 391438 - protein, 11 aa, Influenza virus
VAWSSSSCHDG

SEQ ID NO: 391439 - protein, 11 aa, Influenza virus
AWSSSSCHDGK

SEQ ID NO: 391440 - protein, 11 aa, Influenza virus
WSSSSCHDGKA

SEQ ID NO: 391441 - protein, 11 aa, Influenza virus
SSSSCHDGKAW

SEQ ID NO: 391442 - protein, 11 aa, Influenza virus
SSSCHDGKAWL

SEQ ID NO: 391443 - protein, 11 aa, Influenza virus
SSCHDGKAWLH

SEQ ID NO: 391444 - protein, 11 aa, Influenza virus
SCHDGKAWLHV

SEQ ID NO: 391445 - protein, 11 aa, Influenza virus
CHDGKAWLHVC

SEQ ID NO: 391446 - protein, 11 aa, Influenza virus
HDGKAWLHVCV

SEQ ID NO: 391447 - protein, 11 aa, Influenza virus
DGKAWLHVCVT

SEQ ID NO: 391448 - protein, 11 aa, Influenza virus
GKAWLHVCVTG

SEQ ID NO: 391449 - protein, 11 aa, Influenza virus
KAWLHVCVTGD

SEQ ID NO: 391450 - protein, 11 aa, Influenza virus
AWLHVCVTGDD

SEQ ID NO: 391451 - protein, 11 aa, Influenza virus
CVTGDDRNATA

SEQ ID NO: 391452 - protein, 11 aa, Influenza virus
VTGDDRNATAS

SEQ ID NO: 391453 - protein, 11 aa, Influenza virus
TGDDRNATASF

SEQ ID NO: 391454 - protein, 11 aa, Influenza virus
GDDRNATASFI

SEQ ID NO: 391455 - protein, 11 aa, Influenza virus
DDRNATASFIY

SEQ ID NO: 391456 - protein, 11 aa, Influenza virus
DSIGSWSQNIL

SEQ ID NO: 391457 - protein, 11 aa, Influenza virus
SIGSWSQNILR

SEQ ID NO: 391458 - protein, 11 aa, Influenza virus
IGSWSQNILRT

SEQ ID NO: 391459 - protein, 11 aa, Influenza virus
GSWSQNILRTQ

SEQ ID NO: 391460 - protein, 11 aa, Influenza virus
SWSQNILRTQE

SEQ ID NO: 391461 - protein, 11 aa, Influenza virus
WSQNILRTQES

SEQ ID NO: 391462 - protein, 11 aa, Influenza virus
SQNILRTQESE

SEQ ID NO: 391463 - protein, 11 aa, Influenza virus
QNILRTQESEC

SEQ ID NO: 391464 - protein, 11 aa, Influenza virus
NILRTQESECV

SEQ ID NO: 391465 - protein, 11 aa, Influenza virus
ILRTQESECVC

SEQ ID NO: 391466 - protein, 11 aa, Influenza virus
LRTQESECVCI

SEQ ID NO: 391467 - protein, 11 aa, Influenza virus
RTQESECVCIN

SEQ ID NO: 391468 - protein, 11 aa, Influenza virus
TQESECVCING

SEQ ID NO: 391469 - protein, 11 aa, Influenza virus
QESECVCINGT

SEQ ID NO: 391470 - protein, 11 aa, Influenza virus
ESECVCINGTC

SEQ ID NO: 391471 - protein, 11 aa, Influenza virus
SECVCINGTCT

SEQ ID NO: 391472 - protein, 11 aa, Influenza virus
ECVCINGTCTV

SEQ ID NO: 391473 - protein, 11 aa, Influenza virus
CVCINGTCTVV

SEQ ID NO: 391474 - protein, 11 aa, Influenza virus
VCINGTCTVVM

SEQ ID NO: 391475 - protein, 11 aa, Influenza virus
CINGTCTVVMT

SEQ ID NO: 391476 - protein, 11 aa, Influenza virus
INGTCTVVMTD

SEQ ID NO: 391477 - protein, 11 aa, Influenza virus
NGTCTVVMTDG

SEQ ID NO: 391478 - protein, 11 aa, Influenza virus
GTCTVVMTDGS

SEQ ID NO: 391479 - protein, 11 aa, Influenza virus
TCTVVMTDGSA

SEQ ID NO: 391480 - protein, 11 aa, Influenza virus
CTVVMTDGSAS

SEQ ID NO: 391481 - protein, 11 aa, Influenza virus
TVVMTDGSASG

SEQ ID NO: 391482 - protein, 11 aa, Influenza virus
VVMTDGSASGR

SEQ ID NO: 391483 - protein, 11 aa, Influenza virus
VMTDGSASGRA

SEQ ID NO: 391484 - protein, 11 aa, Influenza virus
MTDGSASGRAD

SEQ ID NO: 391485 - protein, 11 aa, Influenza virus
TDGSASGRADT

SEQ ID NO: 391486 - protein, 11 aa, Influenza virus
DGSASGRADTR

SEQ ID NO: 391487 - protein, 11 aa, Influenza virus
GSASGRADTRI

SEQ ID NO: 391488 - protein, 11 aa, Influenza virus
SASGRADTRIL

SEQ ID NO: 391489 - protein, 11 aa, Influenza virus
ASGRADTRILF

SEQ ID NO: 391490 - protein, 11 aa, Influenza virus
SGRADTRILFI

SEQ ID NO: 391491 - protein, 11 aa, Influenza virus
ADTRILFIKEG

SEQ ID NO: 391492 - protein, 11 aa, Influenza virus
DTRILFIKEGK

SEQ ID NO: 391493 - protein, 11 aa, Influenza virus
VHISPLSGSAQ

SEQ ID NO: 391494 - protein, 11 aa, Influenza virus
HISPLSGSAQH

SEQ ID NO: 391495 - protein, 11 aa, Influenza virus
ISPLSGSAQHI

SEQ ID NO: 391496 - protein, 11 aa, Influenza virus
SPLSGSAQHIE

SEQ ID NO: 391497 - protein, 11 aa, Influenza virus
PLSGSAQHIEE

SEQ ID NO: 391498 - protein, 11 aa, Influenza virus
LSGSAQHIEEC

SEQ ID NO: 391499 - protein, 11 aa, Influenza virus
SGSAQHIEECS

SEQ ID NO: 391500 - protein, 11 aa, Influenza virus
GSAQHIEECSC

SEQ ID NO: 391501 - protein, 11 aa, Influenza virus
SAQHIEECSCY

SEQ ID NO: 391502 - protein, 11 aa, Influenza virus
AQHIEECSCYP

SEQ ID NO: 391503 - protein, 11 aa, Influenza virus
QHIEECSCYPR

SEQ ID NO: 391504 - protein, 11 aa, Influenza virus
HIEECSCYPRY

SEQ ID NO: 391505 - protein, 11 aa, Influenza virus
IEECSCYPRYP

SEQ ID NO: 391506 - protein, 11 aa, Influenza virus
EECSCYPRYPD

SEQ ID NO: 391507 - protein, 11 aa, Influenza virus
ECSCYPRYPDV

SEQ ID NO: 391508 - protein, 11 aa, Influenza virus
CSCYPRYPDVR

SEQ ID NO: 391509 - protein, 11 aa, Influenza virus
SCYPRYPDVRC

SEQ ID NO: 391510 - protein, 11 aa, Influenza virus
YPDVRCICRDN

SEQ ID NO: 391511 - protein, 11 aa, Influenza virus
PDVRCICRDNW

SEQ ID NO: 391512 - protein, 11 aa, Influenza virus
VRCICRDNWKG

SEQ ID NO: 391513 - protein, 11 aa, Influenza virus
RCICRDNWKGS

SEQ ID NO: 391514 - protein, 11 aa, Influenza virus
CICRDNWKGSN

SEQ ID NO: 391515 - protein, 11 aa, Influenza virus
ICRDNWKGSNR

SEQ ID NO: 391516 - protein, 11 aa, Influenza virus
CRDNWKGSNRP

SEQ ID NO: 391517 - protein, 11 aa, Influenza virus
RDNWKGSNRPV

SEQ ID NO: 391518 - protein, 11 aa, Influenza virus
DINMEDYSIDS

SEQ ID NO: 391519 - protein, 11 aa, Influenza virus
DYSIDSSYVCS

SEQ ID NO: 391520 - protein, 11 aa, Influenza virus
YSIDSSYVCSG

SEQ ID NO: 391521 - protein, 11 aa, Influenza virus
SIDSSYVCSGL

SEQ ID NO: 391522 - protein, 11 aa, Influenza virus
IDSSYVCSGLV

SEQ ID NO: 391523 - protein, 11 aa, Influenza virus
DSSYVCSGLVG

SEQ ID NO: 391524 - protein, 11 aa, Influenza virus
SSYVCSGLVGD

SEQ ID NO: 391525 - protein, 11 aa, Influenza virus
SYVCSGLVGDT

SEQ ID NO: 391526 - protein, 11 aa, Influenza virus
YVCSGLVGDTP

SEQ ID NO: 391527 - protein, 11 aa, Influenza virus
VCSGLVGDTPR

SEQ ID NO: 391528 - protein, 11 aa, Influenza virus
CSGLVGDTPRN

SEQ ID NO: 391529 - protein, 11 aa, Influenza virus
SGLVGDTPRND

SEQ ID NO: 391530 - protein, 11 aa, Influenza virus
GLVGDTPRNDD

SEQ ID NO: 391531 - protein, 11 aa, Influenza virus
LVGDTPRNDDS

SEQ ID NO: 391532 - protein, 11 aa, Influenza virus
VGDTPRNDDSS

SEQ ID NO: 391533 - protein, 11 aa, Influenza virus
GDTPRNDDSSS

SEQ ID NO: 391534 - protein, 11 aa, Influenza virus
SNSNCRDPNNE

SEQ ID NO: 391535 - protein, 11 aa, Influenza virus
SNCRDPNNERG

SEQ ID NO: 391536 - protein, 11 aa, Influenza virus
PNNERGNPGVK

SEQ ID NO: 391537 - protein, 11 aa, Influenza virus
NNERGNPGVKG

SEQ ID NO: 391538 - protein, 11 aa, Influenza virus
NERGNPGVKGW

SEQ ID NO: 391539 - protein, 11 aa, Influenza virus
ERGNPGVKGWA

SEQ ID NO: 391540 - protein, 11 aa, Influenza virus
RGNPGVKGWAF

SEQ ID NO: 391541 - protein, 11 aa, Influenza virus
GNPGVKGWAFD

SEQ ID NO: 391542 - protein, 11 aa, Influenza virus
PGVKGWAFDNG

SEQ ID NO: 391543 - protein, 11 aa, Influenza virus
KDLRSGYETFK

SEQ ID NO: 391544 - protein, 11 aa, Influenza virus
DLRSGYETFKV

SEQ ID NO: 391545 - protein, 11 aa, Influenza virus
LRSGYETFKVI

SEQ ID NO: 391546 - protein, 11 aa, Influenza virus
RSGYETFKVIG

SEQ ID NO: 391547 - protein, 11 aa, Influenza virus
SGYETFKVIGG

SEQ ID NO: 391548 - protein, 11 aa, Influenza virus
GYETFKVIGGW

SEQ ID NO: 391549 - protein, 11 aa, Influenza virus
YETFKVIGGWS

SEQ ID NO: 391550 - protein, 11 aa, Influenza virus
ETFKVIGGWST

SEQ ID NO: 391551 - protein, 11 aa, Influenza virus
NNNWSGYSGIF

SEQ ID NO: 391552 - protein, 11 aa, Influenza virus
NNWSGYSGIFS

SEQ ID NO: 391553 - protein, 11 aa, Influenza virus
NWSGYSGIFSV

SEQ ID NO: 391554 - protein, 11 aa, Influenza virus
WSGYSGIFSVE

SEQ ID NO: 391555 - protein, 11 aa, Influenza virus
SGYSGIFSVEG

SEQ ID NO: 391556 - protein, 11 aa, Influenza virus
GYSGIFSVEGK

SEQ ID NO: 391557 - protein, 11 aa, Influenza virus
KSCINRCFYVE

SEQ ID NO: 391558 - protein, 11 aa, Influenza virus
SCINRCFYVEL

SEQ ID NO: 391559 - protein, 11 aa, Influenza virus
CINRCFYVELI

SEQ ID NO: 391560 - protein, 11 aa, Influenza virus
INRCFYVELIR

SEQ ID NO: 391561 - protein, 11 aa, Influenza virus
NRCFYVELIRG

SEQ ID NO: 391562 - protein, 11 aa, Influenza virus
RCFYVELIRGR

SEQ ID NO: 391563 - protein, 11 aa, Influenza virus
CFYVELIRGRP

SEQ ID NO: 391564 - protein, 11 aa, Influenza virus
FYVELIRGRPQ

SEQ ID NO: 391565 - protein, 11 aa, Influenza virus
YVELIRGRPQE

SEQ ID NO: 391566 - protein, 11 aa, Influenza virus
QETRVWWTSNS

SEQ ID NO: 391567 - protein, 11 aa, Influenza virus
ETRVWWTSNSI

SEQ ID NO: 391568 - protein, 11 aa, Influenza virus
TRVWWTSNSIV

SEQ ID NO: 391569 - protein, 11 aa, Influenza virus
RVWWTSNSIVV

SEQ ID NO: 391570 - protein, 11 aa, Influenza virus
VWWTSNSIVVF

SEQ ID NO: 391571 - protein, 11 aa, Influenza virus
WWTSNSIVVFC

SEQ ID NO: 391572 - protein, 11 aa, Influenza virus
WTSNSIVVFCG

SEQ ID NO: 391573 - protein, 11 aa, Influenza virus
TSNSIVVFCGT

SEQ ID NO: 391574 - protein, 11 aa, Influenza virus
SNSIVVFCGTS

SEQ ID NO: 391575 - protein, 11 aa, Influenza virus
NSIVVFCGTSG

SEQ ID NO: 391576 - protein, 11 aa, Influenza virus
SIVVFCGTSGT

SEQ ID NO: 391577 - protein, 11 aa, Influenza virus
IVVFCGTSGTY

SEQ ID NO: 391578 - protein, 11 aa, Influenza virus
VVFCGTSGTYG

SEQ ID NO: 391579 - protein, 11 aa, Influenza virus
VFCGTSGTYGT

SEQ ID NO: 391580 - protein, 11 aa, Influenza virus
FCGTSGTYGTG

SEQ ID NO: 391581 - protein, 11 aa, Influenza virus
CGTSGTYGTGS

SEQ ID NO: 391582 - protein, 11 aa, Influenza virus
GTSGTYGTGSW

SEQ ID NO: 391583 - protein, 11 aa, Influenza virus
TSGTYGTGSWP

SEQ ID NO: 391584 - protein, 11 aa, Influenza virus
SGTYGTGSWPD

SEQ ID NO: 391585 - protein, 11 aa, Influenza virus
GTYGTGSWPDG

SEQ ID NO: 391586 - protein, 11 aa, Influenza virus
TYGTGSWPDGA

SEQ ID NO: 391587 - protein, 11 aa, Influenza virus
YGTGSWPDGAN

SEQ ID NO: 391588 - protein, 11 aa, Influenza virus
GTGSWPDGANI

SEQ ID NO: 391589 - protein, 11 aa, Influenza virus
TGSWPDGANIN

SEQ ID NO: 391590 - protein, 11 aa, Influenza virus
GSWPDGANINF

SEQ ID NO: 391591 - protein, 11 aa, Influenza virus
SWPDGANINFM

SEQ ID NO: 391592 - protein, 11 aa, Influenza virus
WPDGANINFMP

SEQ ID NO: 391593 - protein, 11 aa, Influenza virus
PDGANINFMPI

SEQ ID NO: 391594 - protein, 11 aa, Influenza virus
MLSLIMRTVIA

SEQ ID NO: 391595 - protein, 11 aa, Influenza virus
LSLIMRTVIAL

SEQ ID NO: 391596 - protein, 11 aa, Influenza virus
SLIMRTVIALS

SEQ ID NO: 391597 - protein, 11 aa, Influenza virus
HSMSGFRSNLP

SEQ ID NO: 391598 - protein, 11 aa, Influenza virus
IMRTVIALSYI

SEQ ID NO: 391599 - protein, 11 aa, Influenza virus
IFIFILLTHWA

SEQ ID NO: 391600 - protein, 11 aa, Influenza virus
FIFILLTHWAY

SEQ ID NO: 391601 - protein, 11 aa, Influenza virus
VLSCIFCLAFG

SEQ ID NO: 391602 - protein, 11 aa, Influenza virus
NNNNNTATLCL

SEQ ID NO: 391603 - protein, 11 aa, Influenza virus
NNSTATLCLGH

SEQ ID NO: 391604 - protein, 11 aa, Influenza virus
TATLCLGHHAV

SEQ ID NO: 391605 - protein, 11 aa, Influenza virus
ATLCLGHHAVP

SEQ ID NO: 391606 - protein, 11 aa, Influenza virus
TLCLGHHAVPN

SEQ ID NO: 391607 - protein, 11 aa, Influenza virus
LCLGHHAVPNG

SEQ ID NO: 391608 - protein, 11 aa, Influenza virus
CLGHHAVPNGT

SEQ ID NO: 391609 - protein, 11 aa, Influenza virus
DQIEVTNATEL

SEQ ID NO: 391610 - protein, 11 aa, Influenza virus
QIEVTNATELV

SEQ ID NO: 391611 - protein, 11 aa, Influenza virus
IEVTNATELVQ

SEQ ID NO: 391612 - protein, 11 aa, Influenza virus
EVTNATELVQS

SEQ ID NO: 391613 - protein, 11 aa, Influenza virus
WEKNCTLIDAL

SEQ ID NO: 391614 - protein, 11 aa, Influenza virus
CTLIDALLGDP

SEQ ID NO: 391615 - protein, 11 aa, Influenza virus
SLRSLVASSGT

SEQ ID NO: 391616 - protein, 11 aa, Influenza virus
LRSLVASSGTL

SEQ ID NO: 391617 - protein, 11 aa, Influenza virus
FDKLYIWGVHH

SEQ ID NO: 391618 - protein, 11 aa, Influenza virus
DKLYIWGVHHP

SEQ ID NO: 391619 - protein, 11 aa, Influenza virus
STGNLIAPRGY

SEQ ID NO: 391620 - protein, 11 aa, Influenza virus
TGNLIAPRGYF

SEQ ID NO: 391621 - protein, 11 aa, Influenza virus
GNLIAPRGYFK

SEQ ID NO: 391622 - protein, 11 aa, Influenza virus
LNNEIRWPPHW

SEQ ID NO: 391623 - protein, 11 aa, Influenza virus
ECITPNGSIPN

SEQ ID NO: 391624 - protein, 11 aa, Influenza virus
CITPNGSIPND

SEQ ID NO: 391625 - protein, 11 aa, Influenza virus
KPFQNVNRITY

SEQ ID NO: 391626 - protein, 11 aa, Influenza virus
PFQNVNRITYG

SEQ ID NO: 391627 - protein, 11 aa, Influenza virus
TLKLATGMRNV

SEQ ID NO: 391628 - protein, 11 aa, Influenza virus
LKLATGMRNVP

SEQ ID NO: 391629 - protein, 11 aa, Influenza virus
KLATGMRNVPE

SEQ ID NO: 391630 - protein, 11 aa, Influenza virus
LATGMRNVPEK

SEQ ID NO: 391631 - protein, 11 aa, Influenza virus
RGIFGAIAGFI

SEQ ID NO: 391632 - protein, 11 aa, Influenza virus
GIFGAIAGFIE

SEQ ID NO: 391633 - protein, 11 aa, Influenza virus
IFGAIAGFIEN

SEQ ID NO: 391634 - protein, 11 aa, Influenza virus
FGAIAGFIENG

SEQ ID NO: 391635 - protein, 11 aa, Influenza virus
GAIAGFIENGW

SEQ ID NO: 391636 - protein, 11 aa, Influenza virus
AIAGFIENGWE

SEQ ID NO: 391637 - protein, 11 aa, Influenza virus
IAGFIENGWEG

SEQ ID NO: 391638 - protein, 11 aa, Influenza virus
AGFIENGWEGM

SEQ ID NO: 391639 - protein, 11 aa, Influenza virus
GFIENGWEGMV

SEQ ID NO: 391640 - protein, 11 aa, Influenza virus
FIENGWEGMVD

SEQ ID NO: 391641 - protein, 11 aa, Influenza virus
IENGWEGMVDG

SEQ ID NO: 391642 - protein, 11 aa, Influenza virus
ENGWEGMVDGW

SEQ ID NO: 391643 - protein, 11 aa, Influenza virus
NGWEGMVDGWY

SEQ ID NO: 391644 - protein, 11 aa, Influenza virus
GWEGMVDGWYG

SEQ ID NO: 391645 - protein, 11 aa, Influenza virus
WEGMVDGWYGF

SEQ ID NO: 391646 - protein, 11 aa, Influenza virus
EGMVDGWYGFR

SEQ ID NO: 391647 - protein, 11 aa, Influenza virus
GMVDGWYGFRH

SEQ ID NO: 391648 - protein, 11 aa, Influenza virus
DGWYGFRHQNS

SEQ ID NO: 391649 - protein, 11 aa, Influenza virus
GWYGFRHQNSE

SEQ ID NO: 391650 - protein, 11 aa, Influenza virus
GRLVRFRHQNS

SEQ ID NO: 391651 - protein, 11 aa, Influenza virus
RLVRFRHQNSE

SEQ ID NO: 391652 - protein, 11 aa, Influenza virus
WYGFRHQNSEG

SEQ ID NO: 391653 - protein, 11 aa, Influenza virus
NSEGTGQAADL

SEQ ID NO: 391654 - protein, 11 aa, Influenza virus
SEGTGQAADLK

SEQ ID NO: 391655 - protein, 11 aa, Influenza virus
EGTGQAADLKS

SEQ ID NO: 391656 - protein, 11 aa, Influenza virus
GTGQAADLKST

SEQ ID NO: 391657 - protein, 11 aa, Influenza virus
TGQAADLKSTQ

SEQ ID NO: 391658 - protein, 11 aa, Influenza virus
GQAADLKSTQA

SEQ ID NO: 391659 - protein, 11 aa, Influenza virus
QAADLKSTQAA

SEQ ID NO: 391660 - protein, 11 aa, Influenza virus
AADLKSTQAAI

SEQ ID NO: 391661 - protein, 11 aa, Influenza virus
DLKSTQAAIDQ

SEQ ID NO: 391662 - protein, 11 aa, Influenza virus
IGKTNEKFHQI

SEQ ID NO: 391663 - protein, 11 aa, Influenza virus
GKTNEKFHQIE

SEQ ID NO: 391664 - protein, 11 aa, Influenza virus
KTNEKFHQIEK

SEQ ID NO: 391665 - protein, 11 aa, Influenza virus
TNEKFHQIEKE

SEQ ID NO: 391666 - protein, 11 aa, Influenza virus
NEKFHQIEKEF

SEQ ID NO: 391667 - protein, 11 aa, Influenza virus
EKFHQIEKEFS

SEQ ID NO: 391668 - protein, 11 aa, Influenza virus
KFHQIEKEFSE

SEQ ID NO: 391669 - protein, 11 aa, Influenza virus
FHQIEKEFSEV

SEQ ID NO: 391670 - protein, 11 aa, Influenza virus
HQIEKEFSEVE

SEQ ID NO: 391671 - protein, 11 aa, Influenza virus
QIEKEFSEVEG

SEQ ID NO: 391672 - protein, 11 aa, Influenza virus
IEKEFSEVEGR

SEQ ID NO: 391673 - protein, 11 aa, Influenza virus
EKEFSEVEGRI

SEQ ID NO: 391674 - protein, 11 aa, Influenza virus
KEFSEVEGRIQ

SEQ ID NO: 391675 - protein, 11 aa, Influenza virus
EFSEVEGRIQD

SEQ ID NO: 391676 - protein, 11 aa, Influenza virus
FSEVEGRIQDL

SEQ ID NO: 391677 - protein, 11 aa, Influenza virus
SEVEGRIQDLE

SEQ ID NO: 391678 - protein, 11 aa, Influenza virus
EVEGRIQDLEK

SEQ ID NO: 391679 - protein, 11 aa, Influenza virus
VEGRIQDLEKY

SEQ ID NO: 391680 - protein, 11 aa, Influenza virus
EGRIQDLEKYV

SEQ ID NO: 391681 - protein, 11 aa, Influenza virus
GRIQDLEKYVE

SEQ ID NO: 391682 - protein, 11 aa, Influenza virus
RIQDLEKYVED

SEQ ID NO: 391683 - protein, 11 aa, Influenza virus
IQDLEKYVEDT

SEQ ID NO: 391684 - protein, 11 aa, Influenza virus
QDLEKYVEDTK

SEQ ID NO: 391685 - protein, 11 aa, Influenza virus
DLEKYVEDTKI

SEQ ID NO: 391686 - protein, 11 aa, Influenza virus
LEKYVEDTKID

SEQ ID NO: 391687 - protein, 11 aa, Influenza virus
EKYVEDTKIDL

SEQ ID NO: 391688 - protein, 11 aa, Influenza virus
KYVEDTKIDLW

SEQ ID NO: 391689 - protein, 11 aa, Influenza virus
YVEDTKIDLWS

SEQ ID NO: 391690 - protein, 11 aa, Influenza virus
VEDTKIDLWSY

SEQ ID NO: 391691 - protein, 11 aa, Influenza virus
EDTKIDLWSYN

SEQ ID NO: 391692 - protein, 11 aa, Influenza virus
DTKIDLWSYNA

SEQ ID NO: 391693 - protein, 11 aa, Influenza virus
TKIDLWSYNAE

SEQ ID NO: 391694 - protein, 11 aa, Influenza virus
KIDLWSYNAEL

SEQ ID NO: 391695 - protein, 11 aa, Influenza virus
IDLWSYNAELL

SEQ ID NO: 391696 - protein, 11 aa, Influenza virus
DLWSYNAELLV

SEQ ID NO: 391697 - protein, 11 aa, Influenza virus
LWSYNAELLVA

SEQ ID NO: 391698 - protein, 11 aa, Influenza virus
WSYNAELLVAL

SEQ ID NO: 391699 - protein, 11 aa, Influenza virus
SYNAELLVALE

SEQ ID NO: 391700 - protein, 11 aa, Influenza virus
YNAELLVALEN

SEQ ID NO: 391701 - protein, 11 aa, Influenza virus
NAELLVALENQ

SEQ ID NO: 391702 - protein, 11 aa, Influenza virus
LLVALENQHTI

SEQ ID NO: 391703 - protein, 11 aa, Influenza virus
LVALENQHTID

SEQ ID NO: 391704 - protein, 11 aa, Influenza virus
VALENQHTIDL

SEQ ID NO: 391705 - protein, 11 aa, Influenza virus
ALENQHTIDLT

SEQ ID NO: 391706 - protein, 11 aa, Influenza virus
LENQHTIDLTD

SEQ ID NO: 391707 - protein, 11 aa, Influenza virus
ENQHTIDLTDS

SEQ ID NO: 391708 - protein, 11 aa, Influenza virus
NQHTIDLTDSE

SEQ ID NO: 391709 - protein, 11 aa, Influenza virus
QHTIDLTDSEM

SEQ ID NO: 391710 - protein, 11 aa, Influenza virus
TKKQLRENAED

SEQ ID NO: 391711 - protein, 11 aa, Influenza virus
KQLRENAEDMG

SEQ ID NO: 391712 - protein, 11 aa, Influenza virus
QLRENAEDMGN

SEQ ID NO: 391713 - protein, 11 aa, Influenza virus
LRENAEDMGNG

SEQ ID NO: 391714 - protein, 11 aa, Influenza virus
RENAEDMGNGC

SEQ ID NO: 391715 - protein, 11 aa, Influenza virus
ENAEDMGNGCF

SEQ ID NO: 391716 - protein, 11 aa, Influenza virus
GCFKIYHKCDN

SEQ ID NO: 391717 - protein, 11 aa, Influenza virus
GYKDWILWISF

SEQ ID NO: 391718 - protein, 11 aa, Influenza virus
YKDWILWISFA

SEQ ID NO: 391719 - protein, 11 aa, Influenza virus
KDWILWISFAI

SEQ ID NO: 391720 - protein, 11 aa, Influenza virus
DWILWISFAIS

SEQ ID NO: 391721 - protein, 11 aa, Influenza virus
WILWISFAISC

SEQ ID NO: 391722 - protein, 11 aa, Influenza virus
ILWISFAISCF

SEQ ID NO: 391723 - protein, 11 aa, Influenza virus
LWISFAISCFL

SEQ ID NO: 391724 - protein, 11 aa, Influenza virus
GFIMWACQKGN

SEQ ID NO: 391725 - protein, 11 aa, Influenza virus
MWACQKGNIRC

SEQ ID NO: 391726 - protein, 11 aa, Influenza virus
WACQKGNIRCN

SEQ ID NO: 391727 - protein, 11 aa, Influenza virus
ACQKGNIRCNI

SEQ ID NO: 391728 - protein, 11 aa, Influenza virus
CQKGNIRCNIC

SEQ ID NO: 391729 - protein, 11 aa, Influenza virus
QKGNIRCNICI

SEQ ID NO: 391730 - protein, 11 aa, Influenza virus
HSMSGFRSNLP

SEQ ID NO: 391731 - protein, 11 aa, Influenza virus
SMSGFRSNLPG

SEQ ID NO: 391732 - protein, 11 aa, Influenza virus
NNNNNTATLCL

SEQ ID NO: 391733 - protein, 11 aa, Influenza virus
NNSTATLCLGH

SEQ ID NO: 391734 - protein, 11 aa, Influenza virus
TATLCLGHHAV

SEQ ID NO: 391735 - protein, 11 aa, Influenza virus
ATLCLGHHAVP

SEQ ID NO: 391736 - protein, 11 aa, Influenza virus
TLCLGHHAVPN

SEQ ID NO: 391737 - protein, 11 aa, Influenza virus
LCLGHHAVPNG

SEQ ID NO: 391738 - protein, 11 aa, Influenza virus
CLGHHAVPNGT

SEQ ID NO: 391739 - protein, 11 aa, Influenza virus
LGHHAVPNGTI

SEQ ID NO: 391740 - protein, 11 aa, Influenza virus
GHHAVPNGTIV

SEQ ID NO: 391741 - protein, 11 aa, Influenza virus
HHAVPNGTIVK

SEQ ID NO: 391742 - protein, 11 aa, Influenza virus
HAVPNGTIVKT

SEQ ID NO: 391743 - protein, 11 aa, Influenza virus
AVPNGTIVKTI

SEQ ID NO: 391744 - protein, 11 aa, Influenza virus
VPNGTIVKTIT

SEQ ID NO: 391745 - protein, 11 aa, Influenza virus
DQIEVTNATEL

SEQ ID NO: 391746 - protein, 11 aa, Influenza virus
QIEVTNATELV

SEQ ID NO: 391747 - protein, 11 aa, Influenza virus
IEVTNATELVQ

SEQ ID NO: 391748 - protein, 11 aa, Influenza virus
EVTNATELVQS

SEQ ID NO: 391749 - protein, 11 aa, Influenza virus
KNCTLIDALLG

SEQ ID NO: 391750 - protein, 11 aa, Influenza virus
CTLIDALLGDP

SEQ ID NO: 391751 - protein, 11 aa, Influenza virus
TLIDALLGDPQ

SEQ ID NO: 391752 - protein, 11 aa, Influenza virus
LIDALLGDPQC

SEQ ID NO: 391753 - protein, 11 aa, Influenza virus
IDALLGDPQCD

SEQ ID NO: 391754 - protein, 11 aa, Influenza virus
SLRSLVASSGT

SEQ ID NO: 391755 - protein, 11 aa, Influenza virus
LRSLVASSGTL

SEQ ID NO: 391756 - protein, 11 aa, Influenza virus
RSLVASSGTLE

SEQ ID NO: 391757 - protein, 11 aa, Influenza virus
SLVASSGTLEF

SEQ ID NO: 391758 - protein, 11 aa, Influenza virus
FDKLYIWGVHH

SEQ ID NO: 391759 - protein, 11 aa, Influenza virus
DKLYIWGVHHP

SEQ ID NO: 391760 - protein, 11 aa, Influenza virus
SIYWTIVKPGD

SEQ ID NO: 391761 - protein, 11 aa, Influenza virus
STGNLIAPRGY

SEQ ID NO: 391762 - protein, 11 aa, Influenza virus
TGNLIAPRGYF

SEQ ID NO: 391763 - protein, 11 aa, Influenza virus
GNLIAPRGYFK

SEQ ID NO: 391764 - protein, 11 aa, Influenza virus
NLIAPRGYFKI

SEQ ID NO: 391765 - protein, 11 aa, Influenza virus
LNNEIRWPPHW

SEQ ID NO: 391766 - protein, 11 aa, Influenza virus
ECITPNGSIPN

SEQ ID NO: 391767 - protein, 11 aa, Influenza virus
CITPNGSIPND

SEQ ID NO: 391768 - protein, 11 aa, Influenza virus
TPNGSIPNDKP

SEQ ID NO: 391769 - protein, 11 aa, Influenza virus
NGSIPNDKPFQ

SEQ ID NO: 391770 - protein, 11 aa, Influenza virus
GSIPNDKPFQN

SEQ ID NO: 391771 - protein, 11 aa, Influenza virus
KPFQNVNRITY

SEQ ID NO: 391772 - protein, 11 aa, Influenza virus
PFQNVNRITYG

SEQ ID NO: 391773 - protein, 11 aa, Influenza virus
FQNVNRITYGA

SEQ ID NO: 391774 - protein, 11 aa, Influenza virus
QNVNRITYGAC

SEQ ID NO: 391775 - protein, 11 aa, Influenza virus
NVNRITYGACP

SEQ ID NO: 391776 - protein, 11 aa, Influenza virus
YVKQNTLKLAT

SEQ ID NO: 391777 - protein, 11 aa, Influenza virus
VKQNTLKLATG

SEQ ID NO: 391778 - protein, 11 aa, Influenza virus
KQNTLKLATGM

SEQ ID NO: 391779 - protein, 11 aa, Influenza virus
QNTLKLATGMR

SEQ ID NO: 391780 - protein, 11 aa, Influenza virus
NTLKLATGMRN

SEQ ID NO: 391781 - protein, 11 aa, Influenza virus
TLKLATGMRNV

SEQ ID NO: 391782 - protein, 11 aa, Influenza virus
LKLATGMRNVP

SEQ ID NO: 391783 - protein, 11 aa, Influenza virus
KLATGMRNVPE

SEQ ID NO: 391784 - protein, 11 aa, Influenza virus
LATGMRNVPEK

SEQ ID NO: 391785 - protein, 11 aa, Influenza virus
ATGMRNVPEKQ

SEQ ID NO: 391786 - protein, 11 aa, Influenza virus
TGMRNVPEKQT

SEQ ID NO: 391787 - protein, 11 aa, Influenza virus
GMRNVPEKQTR

SEQ ID NO: 391788 - protein, 11 aa, Influenza virus
MRNVPEKQTRG

SEQ ID NO: 391789 - protein, 11 aa, Influenza virus
PEKQTRGIFGA

SEQ ID NO: 391790 - protein, 11 aa, Influenza virus
EKQTRGIFGAI

SEQ ID NO: 391791 - protein, 11 aa, Influenza virus
KQTRGIFGAIA

SEQ ID NO: 391792 - protein, 11 aa, Influenza virus
QTRGIFGAIAG

SEQ ID NO: 391793 - protein, 11 aa, Influenza virus
TRGIFGAIAGF

SEQ ID NO: 391794 - protein, 11 aa, Influenza virus
RGIFGAIAGFI

SEQ ID NO: 391795 - protein, 11 aa, Influenza virus
GIFGAIAGFIE

SEQ ID NO: 391796 - protein, 11 aa, Influenza virus
IFGAIAGFIEN

SEQ ID NO: 391797 - protein, 11 aa, Influenza virus
FGAIAGFIENG

SEQ ID NO: 391798 - protein, 11 aa, Influenza virus
GAIAGFIENGW

SEQ ID NO: 391799 - protein, 11 aa, Influenza virus
AIAGFIENGWE

SEQ ID NO: 391800 - protein, 11 aa, Influenza virus
IAGFIENGWEG

SEQ ID NO: 391801 - protein, 11 aa, Influenza virus
AGFIENGWEGM

SEQ ID NO: 391802 - protein, 11 aa, Influenza virus
GFIENGWEGMV

SEQ ID NO: 391803 - protein, 11 aa, Influenza virus
FIENGWEGMVD

SEQ ID NO: 391804 - protein, 11 aa, Influenza virus
IENGWEGMVDG

SEQ ID NO: 391805 - protein, 11 aa, Influenza virus
ENGWEGMVDGW

SEQ ID NO: 391806 - protein, 11 aa, Influenza virus
NGWEGMVDGWY

SEQ ID NO: 391807 - protein, 11 aa, Influenza virus
GWEGMVDGWYG

SEQ ID NO: 391808 - protein, 11 aa, Influenza virus
WEGMVDGWYGF

SEQ ID NO: 391809 - protein, 11 aa, Influenza virus
EGMVDGWYGFR

SEQ ID NO: 391810 - protein, 11 aa, Influenza virus
GMVDGWYGFRH

SEQ ID NO: 391811 - protein, 11 aa, Influenza virus
MVDGWYGFRHQ

SEQ ID NO: 391812 - protein, 11 aa, Influenza virus
VDGWYGFRHQN

SEQ ID NO: 391813 - protein, 11 aa, Influenza virus
DGWYGFRHQNS

SEQ ID NO: 391814 - protein, 11 aa, Influenza virus
GWYGFRHQNSE

SEQ ID NO: 391815 - protein, 11 aa, Influenza virus
GRLVRFRHQNS

SEQ ID NO: 391816 - protein, 11 aa, Influenza virus
RLVRFRHQNSE

SEQ ID NO: 391817 - protein, 11 aa, Influenza virus
WYGFRHQNSEG

SEQ ID NO: 391818 - protein, 11 aa, Influenza virus
NSEGTGQAADL

SEQ ID NO: 391819 - protein, 11 aa, Influenza virus
SEGTGQAADLK

SEQ ID NO: 391820 - protein, 11 aa, Influenza virus
EGTGQAADLKS

SEQ ID NO: 391821 - protein, 11 aa, Influenza virus
GTGQAADLKST

SEQ ID NO: 391822 - protein, 11 aa, Influenza virus
TGQAADLKSTQ

SEQ ID NO: 391823 - protein, 11 aa, Influenza virus
GQAADLKSTQA

SEQ ID NO: 391824 - protein, 11 aa, Influenza virus
QAADLKSTQAA

SEQ ID NO: 391825 - protein, 11 aa, Influenza virus
AADLKSTQAAI

SEQ ID NO: 391826 - protein, 11 aa, Influenza virus
ADLKSTQAAIN

SEQ ID NO: 391827 - protein, 11 aa, Influenza virus
DLKSTQAAINQ

SEQ ID NO: 391828 - protein, 11 aa, Influenza virus
IGKTNEKFHQI

SEQ ID NO: 391829 - protein, 11 aa, Influenza virus
GKTNEKFHQIE

SEQ ID NO: 391830 - protein, 11 aa, Influenza virus
KTNEKFHQIEK

SEQ ID NO: 391831 - protein, 11 aa, Influenza virus
TNEKFHQIEKE

SEQ ID NO: 391832 - protein, 11 aa, Influenza virus
NEKFHQIEKEF

SEQ ID NO: 391833 - protein, 11 aa, Influenza virus
EKFHQIEKEFS

SEQ ID NO: 391834 - protein, 11 aa, Influenza virus
KFHQIEKEFSE

SEQ ID NO: 391835 - protein, 11 aa, Influenza virus
FHQIEKEFSEV

SEQ ID NO: 391836 - protein, 11 aa, Influenza virus
HQIEKEFSEVE

SEQ ID NO: 391837 - protein, 11 aa, Influenza virus
QIEKEFSEVEG

SEQ ID NO: 391838 - protein, 11 aa, Influenza virus
IEKEFSEVEGR

SEQ ID NO: 391839 - protein, 11 aa, Influenza virus
EKEFSEVEGRI

SEQ ID NO: 391840 - protein, 11 aa, Influenza virus
KEFSEVEGRIQ

SEQ ID NO: 391841 - protein, 11 aa, Influenza virus
EFSEVEGRIQD

SEQ ID NO: 391842 - protein, 11 aa, Influenza virus
FSEVEGRIQDL

SEQ ID NO: 391843 - protein, 11 aa, Influenza virus
SEVEGRIQDLE

SEQ ID NO: 391844 - protein, 11 aa, Influenza virus
EVEGRIQDLEK

SEQ ID NO: 391845 - protein, 11 aa, Influenza virus
VEGRIQDLEKY

SEQ ID NO: 391846 - protein, 11 aa, Influenza virus
EGRIQDLEKYV

SEQ ID NO: 391847 - protein, 11 aa, Influenza virus
GRIQDLEKYVE

SEQ ID NO: 391848 - protein, 11 aa, Influenza virus
RIQDLEKYVED

SEQ ID NO: 391849 - protein, 11 aa, Influenza virus
IQDLEKYVEDT

SEQ ID NO: 391850 - protein, 11 aa, Influenza virus
QDLEKYVEDTK

SEQ ID NO: 391851 - protein, 11 aa, Influenza virus
DLEKYVEDTKI

SEQ ID NO: 391852 - protein, 11 aa, Influenza virus
LEKYVEDTKID

SEQ ID NO: 391853 - protein, 11 aa, Influenza virus
EKYVEDTKIDL

SEQ ID NO: 391854 - protein, 11 aa, Influenza virus
KYVEDTKIDLW

SEQ ID NO: 391855 - protein, 11 aa, Influenza virus
YVEDTKIDLWS

SEQ ID NO: 391856 - protein, 11 aa, Influenza virus
VEDTKIDLWSY

SEQ ID NO: 391857 - protein, 11 aa, Influenza virus
EDTKIDLWSYN

SEQ ID NO: 391858 - protein, 11 aa, Influenza virus
DTKIDLWSYNA

SEQ ID NO: 391859 - protein, 11 aa, Influenza virus
TKIDLWSYNAE

SEQ ID NO: 391860 - protein, 11 aa, Influenza virus
KIDLWSYNAEL

SEQ ID NO: 391861 - protein, 11 aa, Influenza virus
IDLWSYNAELL

SEQ ID NO: 391862 - protein, 11 aa, Influenza virus
DLWSYNAELLV

SEQ ID NO: 391863 - protein, 11 aa, Influenza virus
LWSYNAELLVA

SEQ ID NO: 391864 - protein, 11 aa, Influenza virus
WSYNAELLVAL

SEQ ID NO: 391865 - protein, 11 aa, Influenza virus
SYNAELLVALE

SEQ ID NO: 391866 - protein, 11 aa, Influenza virus
YNAELLVALEN

SEQ ID NO: 391867 - protein, 11 aa, Influenza virus
NAELLVALENQ

SEQ ID NO: 391868 - protein, 11 aa, Influenza virus
LLVALENQHTI

SEQ ID NO: 391869 - protein, 11 aa, Influenza virus
LVALENQHTID

SEQ ID NO: 391870 - protein, 11 aa, Influenza virus
VALENQHTIDL

SEQ ID NO: 391871 - protein, 11 aa, Influenza virus
ALENQHTIDLT

SEQ ID NO: 391872 - protein, 11 aa, Influenza virus
LENQHTIDLTD

SEQ ID NO: 391873 - protein, 11 aa, Influenza virus
ENQHTIDLTDS

SEQ ID NO: 391874 - protein, 11 aa, Influenza virus
NQHTIDLTDSE

SEQ ID NO: 391875 - protein, 11 aa, Influenza virus
QHTIDLTDSEM

SEQ ID NO: 391876 - protein, 11 aa, Influenza virus
HTIDLTDSEMN

SEQ ID NO: 391877 - protein, 11 aa, Influenza virus
TIDLTDSEMNK

SEQ ID NO: 391878 - protein, 11 aa, Influenza virus
IDLTDSEMNKL

SEQ ID NO: 391879 - protein, 11 aa, Influenza virus
DLTDSEMNKLF

SEQ ID NO: 391880 - protein, 11 aa, Influenza virus
LTDSEMNKLFE

SEQ ID NO: 391881 - protein, 11 aa, Influenza virus
TDSEMNKLFER

SEQ ID NO: 391882 - protein, 11 aa, Influenza virus
DSEMNKLFERT

SEQ ID NO: 391883 - protein, 11 aa, Influenza virus
TKKQLRENAED

SEQ ID NO: 391884 - protein, 11 aa, Influenza virus
KQLRENAEDMG

SEQ ID NO: 391885 - protein, 11 aa, Influenza virus
QLRENAEDMGN

SEQ ID NO: 391886 - protein, 11 aa, Influenza virus
LRENAEDMGNG

SEQ ID NO: 391887 - protein, 11 aa, Influenza virus
RENAEDMGNGC

SEQ ID NO: 391888 - protein, 11 aa, Influenza virus
ENAEDMGNGCF

SEQ ID NO: 391889 - protein, 11 aa, Influenza virus
NAEDMGNGCFK

SEQ ID NO: 391890 - protein, 11 aa, Influenza virus
AEDMGNGCFKI

SEQ ID NO: 391891 - protein, 11 aa, Influenza virus
EDMGNGCFKIY

SEQ ID NO: 391892 - protein, 11 aa, Influenza virus
MGNGCFKIYHK

SEQ ID NO: 391893 - protein, 11 aa, Influenza virus
GNGCFKIYHKC

SEQ ID NO: 391894 - protein, 11 aa, Influenza virus
NGCFKIYHKCD

SEQ ID NO: 391895 - protein, 11 aa, Influenza virus
GCFKIYHKCDN

SEQ ID NO: 391896 - protein, 11 aa, Influenza virus
IGSIRNGTYDH

SEQ ID NO: 391897 - protein, 11 aa, Influenza virus
YRDEALNNRFQ

SEQ ID NO: 391898 - protein, 11 aa, Influenza virus
GYKDWILWISF

SEQ ID NO: 391899 - protein, 11 aa, Influenza virus
YKDWILWISFA

SEQ ID NO: 391900 - protein, 11 aa, Influenza virus
KDWILWISFAI

SEQ ID NO: 391901 - protein, 11 aa, Influenza virus
WILWISFAISC

SEQ ID NO: 391902 - protein, 11 aa, Influenza virus
ILWISFAISCF

SEQ ID NO: 391903 - protein, 11 aa, Influenza virus
LWISFAISCFL

SEQ ID NO: 391904 - protein, 11 aa, Influenza virus
WISFAISCFLL

SEQ ID NO: 391905 - protein, 11 aa, Influenza virus
ISFAISCFLLC

SEQ ID NO: 391906 - protein, 11 aa, Influenza virus
LGFIMWACQKG

SEQ ID NO: 391907 - protein, 11 aa, Influenza virus
GFIMWACQKGN

SEQ ID NO: 391908 - protein, 11 aa, Influenza virus
FIMWACQKGNI

SEQ ID NO: 391909 - protein, 11 aa, Influenza virus
IMWACQKGNIR

SEQ ID NO: 391910 - protein, 11 aa, Influenza virus
MWACQKGNIRC

SEQ ID NO: 391911 - protein, 11 aa, Influenza virus
WACQKGNIRCN

SEQ ID NO: 391912 - protein, 11 aa, Influenza virus
ACQKGNIRCNI

SEQ ID NO: 391913 - protein, 11 aa, Influenza virus
CQKGNIRCNIC

SEQ ID NO: 391914 - protein, 11 aa, Influenza virus
QKGNIRCNICI

SEQ ID NO: 391915 - protein, 11 aa, Influenza virus
AKAGVKMNPNQ

SEQ ID NO: 391916 - protein, 11 aa, Influenza virus
KAGVKMNPNQK

SEQ ID NO: 391917 - protein, 11 aa, Influenza virus
AGVKMNPNQKI

SEQ ID NO: 391918 - protein, 11 aa, Influenza virus
GVKMNPNQKII

SEQ ID NO: 391919 - protein, 11 aa, Influenza virus
VKMNPNQKIIT

SEQ ID NO: 391920 - protein, 11 aa, Influenza virus
KMNPNQKIITI

SEQ ID NO: 391921 - protein, 11 aa, Influenza virus
EKEKEICSVVL

SEQ ID NO: 391922 - protein, 11 aa, Influenza virus
KEKEICSVVLE

SEQ ID NO: 391923 - protein, 11 aa, Influenza virus
ITGFAPFSKDN

SEQ ID NO: 391924 - protein, 11 aa, Influenza virus
TGFAPFSKDNS

SEQ ID NO: 391925 - protein, 11 aa, Influenza virus
GFAPFSKDNSI

SEQ ID NO: 391926 - protein, 11 aa, Influenza virus
FAPFSKDNSIR

SEQ ID NO: 391927 - protein, 11 aa, Influenza virus
APFSKDNSIRL

SEQ ID NO: 391928 - protein, 11 aa, Influenza virus
PFSKDNSIRLS

SEQ ID NO: 391929 - protein, 11 aa, Influenza virus
FSKDNSIRLSA

SEQ ID NO: 391930 - protein, 11 aa, Influenza virus
SKDNSIRLSAG

SEQ ID NO: 391931 - protein, 11 aa, Influenza virus
KDNSIRLSAGG

SEQ ID NO: 391932 - protein, 11 aa, Influenza virus
DNSIRLSAGGD

SEQ ID NO: 391933 - protein, 11 aa, Influenza virus
NSIRLSAGGDI

SEQ ID NO: 391934 - protein, 11 aa, Influenza virus
SIRLSAGGDIW

SEQ ID NO: 391935 - protein, 11 aa, Influenza virus
IRLSAGGDIWV

SEQ ID NO: 391936 - protein, 11 aa, Influenza virus
RLSAGGDIWVT

SEQ ID NO: 391937 - protein, 11 aa, Influenza virus
LSAGGDIWVTR

SEQ ID NO: 391938 - protein, 11 aa, Influenza virus
SAGGDIWVTRE

SEQ ID NO: 391939 - protein, 11 aa, Influenza virus
AGGDIWVTREP

SEQ ID NO: 391940 - protein, 11 aa, Influenza virus
GGDIWVTREPY

SEQ ID NO: 391941 - protein, 11 aa, Influenza virus
GDIWVTREPYV

SEQ ID NO: 391942 - protein, 11 aa, Influenza virus
DIWVTREPYVS

SEQ ID NO: 391943 - protein, 11 aa, Influenza virus
IWVTREPYVSC

SEQ ID NO: 391944 - protein, 11 aa, Influenza virus
WVTREPYVSCD

SEQ ID NO: 391945 - protein, 11 aa, Influenza virus
DKCYQFALGQG

SEQ ID NO: 391946 - protein, 11 aa, Influenza virus
KCYQFALGQGT

SEQ ID NO: 391947 - protein, 11 aa, Influenza virus
CYQFALGQGTT

SEQ ID NO: 391948 - protein, 11 aa, Influenza virus
YQFALGQGTTL

SEQ ID NO: 391949 - protein, 11 aa, Influenza virus
QFALGQGTTLN

SEQ ID NO: 391950 - protein, 11 aa, Influenza virus
FALGQGTTLNN

SEQ ID NO: 391951 - protein, 11 aa, Influenza virus
RTPYRTLLMNE

SEQ ID NO: 391952 - protein, 11 aa, Influenza virus
TPYRTLLMNEL

SEQ ID NO: 391953 - protein, 11 aa, Influenza virus
PYRTLLMNELG

SEQ ID NO: 391954 - protein, 11 aa, Influenza virus
YRTLLMNELGV

SEQ ID NO: 391955 - protein, 11 aa, Influenza virus
RTLLMNELGVP

SEQ ID NO: 391956 - protein, 11 aa, Influenza virus
TLLMNELGVPF

SEQ ID NO: 391957 - protein, 11 aa, Influenza virus
LLMNELGVPFH

SEQ ID NO: 391958 - protein, 11 aa, Influenza virus
LMNELGVPFHL

SEQ ID NO: 391959 - protein, 11 aa, Influenza virus
MNELGVPFHLG

SEQ ID NO: 391960 - protein, 11 aa, Influenza virus
NELGVPFHLGT

SEQ ID NO: 391961 - protein, 11 aa, Influenza virus
ELGVPFHLGTK

SEQ ID NO: 391962 - protein, 11 aa, Influenza virus
LGVPFHLGTKQ

SEQ ID NO: 391963 - protein, 11 aa, Influenza virus
GVPFHLGTKQV

SEQ ID NO: 391964 - protein, 11 aa, Influenza virus
VPFHLGTKQVC

SEQ ID NO: 391965 - protein, 11 aa, Influenza virus
PFHLGTKQVCI

SEQ ID NO: 391966 - protein, 11 aa, Influenza virus
FHLGTKQVCIA

SEQ ID NO: 391967 - protein, 11 aa, Influenza virus
HLGTKQVCIAW

SEQ ID NO: 391968 - protein, 11 aa, Influenza virus
LGTKQVCIAWS

SEQ ID NO: 391969 - protein, 11 aa, Influenza virus
GTKQVCIAWSS

SEQ ID NO: 391970 - protein, 11 aa, Influenza virus
TKQVCIAWSSS

SEQ ID NO: 391971 - protein, 11 aa, Influenza virus
KQVCIAWSSSS

SEQ ID NO: 391972 - protein, 11 aa, Influenza virus
QVCIAWSSSSC

SEQ ID NO: 391973 - protein, 11 aa, Influenza virus
VCIAWSSSSCH

SEQ ID NO: 391974 - protein, 11 aa, Influenza virus
CIAWSSSSCHD

SEQ ID NO: 391975 - protein, 11 aa, Influenza virus
IAWSSSSCHDG

SEQ ID NO: 391976 - protein, 11 aa, Influenza virus
AWSSSSCHDGK

SEQ ID NO: 391977 - protein, 11 aa, Influenza virus
WSSSSCHDGKA

SEQ ID NO: 391978 - protein, 11 aa, Influenza virus
SSSSCHDGKAW

SEQ ID NO: 391979 - protein, 11 aa, Influenza virus
SSSCHDGKAWL

SEQ ID NO: 391980 - protein, 11 aa, Influenza virus
SSCHDGKAWLH

SEQ ID NO: 391981 - protein, 11 aa, Influenza virus
SCHDGKAWLHV

SEQ ID NO: 391982 - protein, 11 aa, Influenza virus
CHDGKAWLHVC

SEQ ID NO: 391983 - protein, 11 aa, Influenza virus
HDGKAWLHVCV

SEQ ID NO: 391984 - protein, 11 aa, Influenza virus
DGKAWLHVCVT

SEQ ID NO: 391985 - protein, 11 aa, Influenza virus
GKAWLHVCVTG

SEQ ID NO: 391986 - protein, 11 aa, Influenza virus
EILRTQESECV

SEQ ID NO: 391987 - protein, 11 aa, Influenza virus
ILRTQESECVC

SEQ ID NO: 391988 - protein, 11 aa, Influenza virus
LRTQESECVCI

SEQ ID NO: 391989 - protein, 11 aa, Influenza virus
RTQESECVCIN

SEQ ID NO: 391990 - protein, 11 aa, Influenza virus
TQESECVCING

SEQ ID NO: 391991 - protein, 11 aa, Influenza virus
QESECVCINGT

SEQ ID NO: 391992 - protein, 11 aa, Influenza virus
ESECVCINGTC

SEQ ID NO: 391993 - protein, 11 aa, Influenza virus
SECVCINGTCT

SEQ ID NO: 391994 - protein, 11 aa, Influenza virus
ECVCINGTCTV

SEQ ID NO: 391995 - protein, 11 aa, Influenza virus
CVCINGTCTVV

SEQ ID NO: 391996 - protein, 11 aa, Influenza virus
CINGTCTVVMT

SEQ ID NO: 391997 - protein, 11 aa, Influenza virus
INGTCTVVMTD

SEQ ID NO: 391998 - protein, 11 aa, Influenza virus
NGTCTVVMTDG

SEQ ID NO: 391999 - protein, 11 aa, Influenza virus
GTCTVVMTDGS

SEQ ID NO: 392000 - protein, 11 aa, Influenza virus
TCTVVMTDGSA

SEQ ID NO: 392001 - protein, 11 aa, Influenza virus
CTVVMTDGSAS

SEQ ID NO: 392002 - protein, 11 aa, Influenza virus
TVVMTDGSASG

SEQ ID NO: 392003 - protein, 11 aa, Influenza virus
EYYFVKEGKIV

SEQ ID NO: 392004 - protein, 11 aa, Influenza virus
YYFVKEGKIVH

SEQ ID NO: 392005 - protein, 11 aa, Influenza virus
YFVKEGKIVHI

SEQ ID NO: 392006 - protein, 11 aa, Influenza virus
LSGSAQHVEEC

SEQ ID NO: 392007 - protein, 11 aa, Influenza virus
SGSAQHVEECS

SEQ ID NO: 392008 - protein, 11 aa, Influenza virus
GSAQHVEECSC

SEQ ID NO: 392009 - protein, 11 aa, Influenza virus
SAQHVEECSCY

SEQ ID NO: 392010 - protein, 11 aa, Influenza virus
AQHVEECSCYP

SEQ ID NO: 392011 - protein, 11 aa, Influenza virus
QHVEECSCYPR

SEQ ID NO: 392012 - protein, 11 aa, Influenza virus
HVEECSCYPRY

SEQ ID NO: 392013 - protein, 11 aa, Influenza virus
VEECSCYPRYP

SEQ ID NO: 392014 - protein, 11 aa, Influenza virus
EECSCYPRYPG

SEQ ID NO: 392015 - protein, 11 aa, Influenza virus
VRCVCRDNWKG

SEQ ID NO: 392016 - protein, 11 aa, Influenza virus
RCVCRDNWKGS

SEQ ID NO: 392017 - protein, 11 aa, Influenza virus
CVCRDNWKGSN

SEQ ID NO: 392018 - protein, 11 aa, Influenza virus
VCRDNWKGSNR

SEQ ID NO: 392019 - protein, 11 aa, Influenza virus
CRDNWKGSNRP

SEQ ID NO: 392020 - protein, 11 aa, Influenza virus
RDNWKGSNRPI

SEQ ID NO: 392021 - protein, 11 aa, Influenza virus
DNWKGSNRPIV

SEQ ID NO: 392022 - protein, 11 aa, Influenza virus
NWKGSNRPIVD

SEQ ID NO: 392023 - protein, 11 aa, Influenza virus
WKGSNRPIVDI

SEQ ID NO: 392024 - protein, 11 aa, Influenza virus
SSYVCSGLVGD

SEQ ID NO: 392025 - protein, 11 aa, Influenza virus
SYVCSGLVGDT

SEQ ID NO: 392026 - protein, 11 aa, Influenza virus
YVCSGLVGDTP

SEQ ID NO: 392027 - protein, 11 aa, Influenza virus
VCSGLVGDTPR

SEQ ID NO: 392028 - protein, 11 aa, Influenza virus
CSGLVGDTPRK

SEQ ID NO: 392029 - protein, 11 aa, Influenza virus
RSGYSGIFSVE

SEQ ID NO: 392030 - protein, 11 aa, Influenza virus
SGYSGIFSVEG

SEQ ID NO: 392031 - protein, 11 aa, Influenza virus
GYSGIFSVEGK

SEQ ID NO: 392032 - protein, 11 aa, Influenza virus
KSCINRCFYVE

SEQ ID NO: 392033 - protein, 11 aa, Influenza virus
SCINRCFYVEL

SEQ ID NO: 392034 - protein, 11 aa, Influenza virus
CINRCFYVELI

SEQ ID NO: 392035 - protein, 11 aa, Influenza virus
INRCFYVELIR

SEQ ID NO: 392036 - protein, 11 aa, Influenza virus
NRCFYVELIRG

SEQ ID NO: 392037 - protein, 11 aa, Influenza virus
RCFYVELIRGR

SEQ ID NO: 392038 - protein, 11 aa, Influenza virus
VLWTSNSIVVF

SEQ ID NO: 392039 - protein, 11 aa, Influenza virus
LWTSNSIVVFC

SEQ ID NO: 392040 - protein, 11 aa, Influenza virus
WTSNSIVVFCG

SEQ ID NO: 392041 - protein, 11 aa, Influenza virus
TSNSIVVFCGT

SEQ ID NO: 392042 - protein, 11 aa, Influenza virus
SNSIVVFCGTS

SEQ ID NO: 392043 - protein, 11 aa, Influenza virus
NSIVVFCGTSG

SEQ ID NO: 392044 - protein, 11 aa, Influenza virus
SIVVFCGTSGT

SEQ ID NO: 392045 - protein, 11 aa, Influenza virus
IVVFCGTSGTY

SEQ ID NO: 392046 - protein, 11 aa, Influenza virus
VVFCGTSGTYG

SEQ ID NO: 392047 - protein, 11 aa, Influenza virus
VFCGTSGTYGT

SEQ ID NO: 392048 - protein, 11 aa, Influenza virus
FCGTSGTYGTG

SEQ ID NO: 392049 - protein, 11 aa, Influenza virus
CGTSGTYGTGS

SEQ ID NO: 392050 - protein, 11 aa, Influenza virus
GTSGTYGTGSW

SEQ ID NO: 392051 - protein, 11 aa, Influenza virus
TSGTYGTGSWP

SEQ ID NO: 392052 - protein, 11 aa, Influenza virus
SGTYGTGSWPD

SEQ ID NO: 392053 - protein, 11 aa, Influenza virus
GTYGTGSWPDG

SEQ ID NO: 392054 - protein, 11 aa, Influenza virus
TYGTGSWPDGA

SEQ ID NO: 392055 - protein, 11 aa, Influenza virus
YGTGSWPDGAD

SEQ ID NO: 392056 - protein, 11 aa, Influenza virus
DGADINLHAYI

SEQ ID NO: 392057 - protein, 11 aa, Influenza virus
GADINLHAYIS

SEQ ID NO: 392058 - protein, 11 aa, Influenza virus
ADINLHAYISF

SEQ ID NO: 392059 - protein, 11 aa, Influenza virus
DINLHAYISFR

SEQ ID NO: 392060 - protein, 11 aa, Influenza virus
INLHAYISFRN

SEQ ID NO: 392061 - protein, 11 aa, Influenza virus
NLHAYISFRNL

SEQ ID NO: 392062 - protein, 11 aa, Influenza virus
YTGNPVICLGH

SEQ ID NO: 392063 - protein, 11 aa, Influenza virus
TGNPVICLGHH

SEQ ID NO: 392064 - protein, 11 aa, Influenza virus
GNPVICLGHHA

SEQ ID NO: 392065 - protein, 11 aa, Influenza virus
NPVICLGHHAV

SEQ ID NO: 392066 - protein, 11 aa, Influenza virus
WICMGHHAVAN

SEQ ID NO: 392067 - protein, 11 aa, Influenza virus
IEVVTAQELVE

SEQ ID NO: 392068 - protein, 11 aa, Influenza virus
EVVTAQELVES

SEQ ID NO: 392069 - protein, 11 aa, Influenza virus
CDIVNGALGSP

SEQ ID NO: 392070 - protein, 11 aa, Influenza virus
DIVNGALGSPG

SEQ ID NO: 392071 - protein, 11 aa, Influenza virus
IVNGALGSPGC

SEQ ID NO: 392072 - protein, 11 aa, Influenza virus
VNGALGSPGCD

SEQ ID NO: 392073 - protein, 11 aa, Influenza virus
NGALGSPGCDH

SEQ ID NO: 392074 - protein, 11 aa, Influenza virus
GALGSPGCDHL

SEQ ID NO: 392075 - protein, 11 aa, Influenza virus
CYPFDVPDYQS

SEQ ID NO: 392076 - protein, 11 aa, Influenza virus
VPDYQSLRSIL

SEQ ID NO: 392077 - protein, 11 aa, Influenza virus
PDYQSLRSILA

SEQ ID NO: 392078 - protein, 11 aa, Influenza virus
DYQSLRSILAN

SEQ ID NO: 392079 - protein, 11 aa, Influenza virus
YQSLRSILANN

SEQ ID NO: 392080 - protein, 11 aa, Influenza virus
QSLRSILANNG

SEQ ID NO: 392081 - protein, 11 aa, Influenza virus
SLRSILANNGK

SEQ ID NO: 392082 - protein, 11 aa, Influenza virus
LRSILANNGKF

SEQ ID NO: 392083 - protein, 11 aa, Influenza virus
RSILANNGKFE

SEQ ID NO: 392084 - protein, 11 aa, Influenza virus
SILANNGKFEF

SEQ ID NO: 392085 - protein, 11 aa, Influenza virus
ILANNGKFEFI

SEQ ID NO: 392086 - protein, 11 aa, Influenza virus
LANNGKFEFIA

SEQ ID NO: 392087 - protein, 11 aa, Influenza virus
ANNGKFEFIAE

SEQ ID NO: 392088 - protein, 11 aa, Influenza virus
NNGKFEFIAEE

SEQ ID NO: 392089 - protein, 11 aa, Influenza virus
NGKFEFIAEEF

SEQ ID NO: 392090 - protein, 11 aa, Influenza virus
TVKQNGKSGAC

SEQ ID NO: 392091 - protein, 11 aa, Influenza virus
VKQNGKSGACK

SEQ ID NO: 392092 - protein, 11 aa, Influenza virus
KQNGKSGACKR

SEQ ID NO: 392093 - protein, 11 aa, Influenza virus
QNGKSGACKRA

SEQ ID NO: 392094 - protein, 11 aa, Influenza virus
NGKSGACKRAN

SEQ ID NO: 392095 - protein, 11 aa, Influenza virus
QNLTKVNNGDY

SEQ ID NO: 392096 - protein, 11 aa, Influenza virus
NNGDYARLYIW

SEQ ID NO: 392097 - protein, 11 aa, Influenza virus
NGDYARLYIWG

SEQ ID NO: 392098 - protein, 11 aa, Influenza virus
GDYARLYIWGV

SEQ ID NO: 392099 - protein, 11 aa, Influenza virus
DYARLYIWGVH

SEQ ID NO: 392100 - protein, 11 aa, Influenza virus
YARLYIWGVHH

SEQ ID NO: 392101 - protein, 11 aa, Influenza virus
ARLYIWGVHHP

SEQ ID NO: 392102 - protein, 11 aa, Influenza virus
RLYIWGVHHPS

SEQ ID NO: 392103 - protein, 11 aa, Influenza virus
LYIWGVHHPST

SEQ ID NO: 392104 - protein, 11 aa, Influenza virus
YIWGVHHPSTD

SEQ ID NO: 392105 - protein, 11 aa, Influenza virus
IWGVHHPSTDT

SEQ ID NO: 392106 - protein, 11 aa, Influenza virus
WGVHHPSTDTE

SEQ ID NO: 392107 - protein, 11 aa, Influenza virus
GVHHPSTDTEQ

SEQ ID NO: 392108 - protein, 11 aa, Influenza virus
VRGQSGRISFY

SEQ ID NO: 392109 - protein, 11 aa, Influenza virus
RGQSGRISFYW

SEQ ID NO: 392110 - protein, 11 aa, Influenza virus
GQSGRISFYWT

SEQ ID NO: 392111 - protein, 11 aa, Influenza virus
QSGRISFYWTI

SEQ ID NO: 392112 - protein, 11 aa, Influenza virus
SGRISFYWTIV

SEQ ID NO: 392113 - protein, 11 aa, Influenza virus
GRISFYWTIVE

SEQ ID NO: 392114 - protein, 11 aa, Influenza virus
RISFYWTIVEP

SEQ ID NO: 392115 - protein, 11 aa, Influenza virus
ISFYWTIVEPG

SEQ ID NO: 392116 - protein, 11 aa, Influenza virus
SFYWTIVEPGD

SEQ ID NO: 392117 - protein, 11 aa, Influenza virus
PGDLIVFNTIG

SEQ ID NO: 392118 - protein, 11 aa, Influenza virus
GDLIVFNTIGN

SEQ ID NO: 392119 - protein, 11 aa, Influenza virus
DLIVFNTIGNL

SEQ ID NO: 392120 - protein, 11 aa, Influenza virus
LIVFNTIGNLI

SEQ ID NO: 392121 - protein, 11 aa, Influenza virus
IVFNTIGNLIA

SEQ ID NO: 392122 - protein, 11 aa, Influenza virus
VFNTIGNLIAP

SEQ ID NO: 392123 - protein, 11 aa, Influenza virus
FNTIGNLIAPR

SEQ ID NO: 392124 - protein, 11 aa, Influenza virus
NTIGNLIAPRG

SEQ ID NO: 392125 - protein, 11 aa, Influenza virus
TIGNLIAPRGH

SEQ ID NO: 392126 - protein, 11 aa, Influenza virus
IGNLIAPRGHY

SEQ ID NO: 392127 - protein, 11 aa, Influenza virus
GNLIAPRGHYK

SEQ ID NO: 392128 - protein, 11 aa, Influenza virus
NLIAPRGHYKL

SEQ ID NO: 392129 - protein, 11 aa, Influenza virus
GDCPKYVKQGS

SEQ ID NO: 392130 - protein, 11 aa, Influenza virus
DCPKYVKQGSL

SEQ ID NO: 392131 - protein, 11 aa, Influenza virus
CPKYVKQGSLK

SEQ ID NO: 392132 - protein, 11 aa, Influenza virus
PKYVKQGSLKL

SEQ ID NO: 392133 - protein, 11 aa, Influenza virus
KYVKQGSLKLA

SEQ ID NO: 392134 - protein, 11 aa, Influenza virus
YVKQGSLKLAT

SEQ ID NO: 392135 - protein, 11 aa, Influenza virus
VKQGSLKLATG

SEQ ID NO: 392136 - protein, 11 aa, Influenza virus
KQGSLKLATGM

SEQ ID NO: 392137 - protein, 11 aa, Influenza virus
QGSLKLATGMR

SEQ ID NO: 392138 - protein, 11 aa, Influenza virus
GSLKLATGMRN

SEQ ID NO: 392139 - protein, 11 aa, Influenza virus
SLKLATGMRNI

SEQ ID NO: 392140 - protein, 11 aa, Influenza virus
LKLATGMRNIP

SEQ ID NO: 392141 - protein, 11 aa, Influenza virus
KLATGMRNIPE

SEQ ID NO: 392142 - protein, 11 aa, Influenza virus
LATGMRNIPEK

SEQ ID NO: 392143 - protein, 11 aa, Influenza virus
RGLFGAIAGFI

SEQ ID NO: 392144 - protein, 11 aa, Influenza virus
GLFGAIAGFIE

SEQ ID NO: 392145 - protein, 11 aa, Influenza virus
LFGAIAGFIEN

SEQ ID NO: 392146 - protein, 11 aa, Influenza virus
FGAIAGFIENG

SEQ ID NO: 392147 - protein, 11 aa, Influenza virus
GAIAGFIENGW

SEQ ID NO: 392148 - protein, 11 aa, Influenza virus
AIAGFIENGWQ

SEQ ID NO: 392149 - protein, 11 aa, Influenza virus
IAGFIENGWQG

SEQ ID NO: 392150 - protein, 11 aa, Influenza virus
AGFIENGWQGL

SEQ ID NO: 392151 - protein, 11 aa, Influenza virus
GFIENGWQGLI

SEQ ID NO: 392152 - protein, 11 aa, Influenza virus
FIENGWQGLID

SEQ ID NO: 392153 - protein, 11 aa, Influenza virus
IENGWQGLIDG

SEQ ID NO: 392154 - protein, 11 aa, Influenza virus
ENGWQGLIDGW

SEQ ID NO: 392155 - protein, 11 aa, Influenza virus
NGWQGLIDGWY

SEQ ID NO: 392156 - protein, 11 aa, Influenza virus
GWQGLIDGWYG

SEQ ID NO: 392157 - protein, 11 aa, Influenza virus
WQGLIDGWYGF

SEQ ID NO: 392158 - protein, 11 aa, Influenza virus
QGLIDGWYGFR

SEQ ID NO: 392159 - protein, 11 aa, Influenza virus
GLIDGWYGFRH

SEQ ID NO: 392160 - protein, 11 aa, Influenza virus
LIDGWYGFRHQ

SEQ ID NO: 392161 - protein, 11 aa, Influenza virus
IDGWYGFRHQN

SEQ ID NO: 392162 - protein, 11 aa, Influenza virus
DGWYGFRHQNA

SEQ ID NO: 392163 - protein, 11 aa, Influenza virus
GWYGFRHQNAE

SEQ ID NO: 392164 - protein, 11 aa, Influenza virus
WYGFRHQNAEG

SEQ ID NO: 392165 - protein, 11 aa, Influenza virus
YGFRHQNAEGT

SEQ ID NO: 392166 - protein, 11 aa, Influenza virus
GFRHQNAEGTG

SEQ ID NO: 392167 - protein, 11 aa, Influenza virus
FRHQNAEGTGT

SEQ ID NO: 392168 - protein, 11 aa, Influenza virus
RHQNAEGTGTA

SEQ ID NO: 392169 - protein, 11 aa, Influenza virus
HQNAEGTGTAA

SEQ ID NO: 392170 - protein, 11 aa, Influenza virus
QNAEGTGTAAD

SEQ ID NO: 392171 - protein, 11 aa, Influenza virus
NAEGTGTAADL

SEQ ID NO: 392172 - protein, 11 aa, Influenza virus
AEGTGTAADLK

SEQ ID NO: 392173 - protein, 11 aa, Influenza virus
EGTGTAADLKS

SEQ ID NO: 392174 - protein, 11 aa, Influenza virus
GTGTAADLKST

SEQ ID NO: 392175 - protein, 11 aa, Influenza virus
TGTAADLKSTQ

SEQ ID NO: 392176 - protein, 11 aa, Influenza virus
GTAADLKSTQA

SEQ ID NO: 392177 - protein, 11 aa, Influenza virus
TAADLKSTQAA

SEQ ID NO: 392178 - protein, 11 aa, Influenza virus
AADLKSTQAAI

SEQ ID NO: 392179 - protein, 11 aa, Influenza virus
ADLKSTQAAID

SEQ ID NO: 392180 - protein, 11 aa, Influenza virus
DLKSTQAAIDQ

SEQ ID NO: 392181 - protein, 11 aa, Influenza virus
LKSTQAAIDQI

SEQ ID NO: 392182 - protein, 11 aa, Influenza virus
TQAAIDQINGK

SEQ ID NO: 392183 - protein, 11 aa, Influenza virus
QAAIDQINGKL

SEQ ID NO: 392184 - protein, 11 aa, Influenza virus
AAIDQINGKLN

SEQ ID NO: 392185 - protein, 11 aa, Influenza virus
AIDQINGKLNR

SEQ ID NO: 392186 - protein, 11 aa, Influenza virus
IDQINGKLNRL

SEQ ID NO: 392187 - protein, 11 aa, Influenza virus
DQINGKLNRLI

SEQ ID NO: 392188 - protein, 11 aa, Influenza virus
QINGKLNRLIE

SEQ ID NO: 392189 - protein, 11 aa, Influenza virus
INGKLNRLIEK

SEQ ID NO: 392190 - protein, 11 aa, Influenza virus
NGKLNRLIEKT

SEQ ID NO: 392191 - protein, 11 aa, Influenza virus
GKLNRLIEKTN

SEQ ID NO: 392192 - protein, 11 aa, Influenza virus
KLNRLIEKTNE

SEQ ID NO: 392193 - protein, 11 aa, Influenza virus
LNRLIEKTNEK

SEQ ID NO: 392194 - protein, 11 aa, Influenza virus
NRLIEKTNEKY

SEQ ID NO: 392195 - protein, 11 aa, Influenza virus
RLIEKTNEKYH

SEQ ID NO: 392196 - protein, 11 aa, Influenza virus
LIEKTNEKYHQ

SEQ ID NO: 392197 - protein, 11 aa, Influenza virus
IEKTNEKYHQI

SEQ ID NO: 392198 - protein, 11 aa, Influenza virus
EKTNEKYHQIE

SEQ ID NO: 392199 - protein, 11 aa, Influenza virus
KTNEKYHQIEK

SEQ ID NO: 392200 - protein, 11 aa, Influenza virus
TNEKYHQIEKE

SEQ ID NO: 392201 - protein, 11 aa, Influenza virus
NEKYHQIEKEF

SEQ ID NO: 392202 - protein, 11 aa, Influenza virus
EKYHQIEKEFE

SEQ ID NO: 392203 - protein, 11 aa, Influenza virus
KYHQIEKEFEQ

SEQ ID NO: 392204 - protein, 11 aa, Influenza virus
YHQIEKEFEQV

SEQ ID NO: 392205 - protein, 11 aa, Influenza virus
HQIEKEFEQVE

SEQ ID NO: 392206 - protein, 11 aa, Influenza virus
QIEKEFEQVEG

SEQ ID NO: 392207 - protein, 11 aa, Influenza virus
IEKEFEQVEGR

SEQ ID NO: 392208 - protein, 11 aa, Influenza virus
EKEFEQVEGRI

SEQ ID NO: 392209 - protein, 11 aa, Influenza virus
KEFEQVEGRIQ

SEQ ID NO: 392210 - protein, 11 aa, Influenza virus
EFEQVEGRIQD

SEQ ID NO: 392211 - protein, 11 aa, Influenza virus
FEQVEGRIQDL

SEQ ID NO: 392212 - protein, 11 aa, Influenza virus
QDLEKYVEDTK

SEQ ID NO: 392213 - protein, 11 aa, Influenza virus
DLEKYVEDTKI

SEQ ID NO: 392214 - protein, 11 aa, Influenza virus
LEKYVEDTKID

SEQ ID NO: 392215 - protein, 11 aa, Influenza virus
EKYVEDTKIDL

SEQ ID NO: 392216 - protein, 11 aa, Influenza virus
KYVEDTKIDLW

SEQ ID NO: 392217 - protein, 11 aa, Influenza virus
YVEDTKIDLWS

SEQ ID NO: 392218 - protein, 11 aa, Influenza virus
VEDTKIDLWSY

SEQ ID NO: 392219 - protein, 11 aa, Influenza virus
EDTKIDLWSYN

SEQ ID NO: 392220 - protein, 11 aa, Influenza virus
DTKIDLWSYNA

SEQ ID NO: 392221 - protein, 11 aa, Influenza virus
TKIDLWSYNAE

SEQ ID NO: 392222 - protein, 11 aa, Influenza virus
KIDLWSYNAEL

SEQ ID NO: 392223 - protein, 11 aa, Influenza virus
IDLWSYNAELL

SEQ ID NO: 392224 - protein, 11 aa, Influenza virus
DLWSYNAELLV

SEQ ID NO: 392225 - protein, 11 aa, Influenza virus
LWSYNAELLVA

SEQ ID NO: 392226 - protein, 11 aa, Influenza virus
WSYNAELLVAL

SEQ ID NO: 392227 - protein, 11 aa, Influenza virus
SYNAELLVALE

SEQ ID NO: 392228 - protein, 11 aa, Influenza virus
YNAELLVALEN

SEQ ID NO: 392229 - protein, 11 aa, Influenza virus
NAELLVALENQ

SEQ ID NO: 392230 - protein, 11 aa, Influenza virus
AELLVALENQH

SEQ ID NO: 392231 - protein, 11 aa, Influenza virus
ELLVALENQHT

SEQ ID NO: 392232 - protein, 11 aa, Influenza virus
LLVALENQHTI

SEQ ID NO: 392233 - protein, 11 aa, Influenza virus
LVALENQHTID

SEQ ID NO: 392234 - protein, 11 aa, Influenza virus
VALENQHTIDV

SEQ ID NO: 392235 - protein, 11 aa, Influenza virus
ALENQHTIDVT

SEQ ID NO: 392236 - protein, 11 aa, Influenza virus
LENQHTIDVTD

SEQ ID NO: 392237 - protein, 11 aa, Influenza virus
ENQHTIDVTDS

SEQ ID NO: 392238 - protein, 11 aa, Influenza virus
NQHTIDVTDSE

SEQ ID NO: 392239 - protein, 11 aa, Influenza virus
QHTIDVTDSEM

SEQ ID NO: 392240 - protein, 11 aa, Influenza virus
HTIDVTDSEMN

SEQ ID NO: 392241 - protein, 11 aa, Influenza virus
TDSEMNKLFER

SEQ ID NO: 392242 - protein, 11 aa, Influenza virus
DSEMNKLFERV

SEQ ID NO: 392243 - protein, 11 aa, Influenza virus
KLFERVRRQLR

SEQ ID NO: 392244 - protein, 11 aa, Influenza virus
LFERVRRQLRE

SEQ ID NO: 392245 - protein, 11 aa, Influenza virus
FERVRRQLREN

SEQ ID NO: 392246 - protein, 11 aa, Influenza virus
ERVRRQLRENA

SEQ ID NO: 392247 - protein, 11 aa, Influenza virus
RVRRQLRENAE

SEQ ID NO: 392248 - protein, 11 aa, Influenza virus
VRRQLRENAED

SEQ ID NO: 392249 - protein, 11 aa, Influenza virus
RRQLRENAEDK

SEQ ID NO: 392250 - protein, 11 aa, Influenza virus
RQLRENAEDKG

SEQ ID NO: 392251 - protein, 11 aa, Influenza virus
QLRENAEDKGN

SEQ ID NO: 392252 - protein, 11 aa, Influenza virus
LRENAEDKGNG

SEQ ID NO: 392253 - protein, 11 aa, Influenza virus
RENAEDKGNGC

SEQ ID NO: 392254 - protein, 11 aa, Influenza virus
ENAEDKGNGCF

SEQ ID NO: 392255 - protein, 11 aa, Influenza virus
NAEDKGNGCFE

SEQ ID NO: 392256 - protein, 11 aa, Influenza virus
AEDKGNGCFEI

SEQ ID NO: 392257 - protein, 11 aa, Influenza virus
EDKGNGCFEIF

SEQ ID NO: 392258 - protein, 11 aa, Influenza virus
DKGNGCFEIFH

SEQ ID NO: 392259 - protein, 11 aa, Influenza virus
KGNGCFEIFHQ

SEQ ID NO: 392260 - protein, 11 aa, Influenza virus
GNGCFEIFHQC

SEQ ID NO: 392261 - protein, 11 aa, Influenza virus
NGCFEIFHQCD

SEQ ID NO: 392262 - protein, 11 aa, Influenza virus
GCFEIFHQCDN

SEQ ID NO: 392263 - protein, 11 aa, Influenza virus
CDNNCIESIRN

SEQ ID NO: 392264 - protein, 11 aa, Influenza virus
NNCIESIRNGT

SEQ ID NO: 392265 - protein, 11 aa, Influenza virus
NCIESIRNGTY

SEQ ID NO: 392266 - protein, 11 aa, Influenza virus
CIESIRNGTYD

SEQ ID NO: 392267 - protein, 11 aa, Influenza virus
IESIRNGTYDH

SEQ ID NO: 392268 - protein, 11 aa, Influenza virus
ESIRNGTYDHD

SEQ ID NO: 392269 - protein, 11 aa, Influenza virus
YRDEAINNRFQ

SEQ ID NO: 392270 - protein, 11 aa, Influenza virus
RDEAINNRFQI

SEQ ID NO: 392271 - protein, 11 aa, Influenza virus
EAINNRFQIQG

SEQ ID NO: 392272 - protein, 11 aa, Influenza virus
AINNRFQIQGV

SEQ ID NO: 392273 - protein, 11 aa, Influenza virus
RFQIQGVKLTQ

SEQ ID NO: 392274 - protein, 11 aa, Influenza virus
FQIQGVKLTQG

SEQ ID NO: 392275 - protein, 11 aa, Influenza virus
QIQGVKLTQGY

SEQ ID NO: 392276 - protein, 11 aa, Influenza virus
IQGVKLTQGYK

SEQ ID NO: 392277 - protein, 11 aa, Influenza virus
QGVKLTQGYKD

SEQ ID NO: 392278 - protein, 11 aa, Influenza virus
KLTQGYKDIIL

SEQ ID NO: 392279 - protein, 11 aa, Influenza virus
LTQGYKDIILW

SEQ ID NO: 392280 - protein, 11 aa, Influenza virus
QGYKDIILWIS

SEQ ID NO: 392281 - protein, 11 aa, Influenza virus
GYKDIILWISF

SEQ ID NO: 392282 - protein, 11 aa, Influenza virus
YKDIILWISFS

SEQ ID NO: 392283 - protein, 11 aa, Influenza virus
KDIILWISFSI

SEQ ID NO: 392284 - protein, 11 aa, Influenza virus
DIILWISFSIS

SEQ ID NO: 392285 - protein, 11 aa, Influenza virus
IILWISFSISC

SEQ ID NO: 392286 - protein, 11 aa, Influenza virus
ILWISFSISCF

SEQ ID NO: 392287 - protein, 11 aa, Influenza virus
LWISFSISCFL

SEQ ID NO: 392288 - protein, 11 aa, Influenza virus
WISFSISCFLL

SEQ ID NO: 392289 - protein, 11 aa, Influenza virus
ISFSISCFLLV

SEQ ID NO: 392290 - protein, 11 aa, Influenza virus
SFSISCFLLVA

SEQ ID NO: 392291 - protein, 11 aa, Influenza virus
FSISCFLLVAL

SEQ ID NO: 392292 - protein, 11 aa, Influenza virus
VTTRQASPSCL

SEQ ID NO: 392293 - protein, 11 aa, Influenza virus
TTRQASPSCLV

SEQ ID NO: 392294 - protein, 11 aa, Influenza virus
TRQASPSCLVV

SEQ ID NO: 392295 - protein, 11 aa, Influenza virus
RQASPSCLVVR

SEQ ID NO: 392296 - protein, 11 aa, Influenza virus
QASPSCLVVRK

SEQ ID NO: 392297 - protein, 11 aa, Influenza virus
ASPSCLVVRKS

SEQ ID NO: 392298 - protein, 11 aa, Influenza virus
SISCFLLVALL

SEQ ID NO: 392299 - protein, 11 aa, Influenza virus
ISCFLLVALLL

SEQ ID NO: 392300 - protein, 11 aa, Influenza virus
ALLLAFILWAC

SEQ ID NO: 392301 - protein, 11 aa, Influenza virus
LLLAFILWACQ

SEQ ID NO: 392302 - protein, 11 aa, Influenza virus
LWACQNGNIRC

SEQ ID NO: 392303 - protein, 11 aa, Influenza virus
WACQNGNIRCQ

SEQ ID NO: 392304 - protein, 11 aa, Influenza virus
ACQNGNIRCQI

SEQ ID NO: 392305 - protein, 11 aa, Influenza virus
CQNGNIRCQIC

SEQ ID NO: 392306 - protein, 11 aa, Influenza virus
QNGNIRCQICI

SEQ ID NO: 392307 - protein, 11 aa, Influenza virus
ICQMEKIVLLF

SEQ ID NO: 392308 - protein, 11 aa, Influenza virus
VKMEKIVLLLA

SEQ ID NO: 392309 - protein, 11 aa, Influenza virus
KMEKIVLLLAT

SEQ ID NO: 392310 - protein, 11 aa, Influenza virus
SDQICIGYHAN

SEQ ID NO: 392311 - protein, 11 aa, Influenza virus
DQICIGYHANN

SEQ ID NO: 392312 - protein, 11 aa, Influenza virus
QICIGYHANNS

SEQ ID NO: 392313 - protein, 11 aa, Influenza virus
ICIGYHANNST

SEQ ID NO: 392314 - protein, 11 aa, Influenza virus
CIGYHANNSTE

SEQ ID NO: 392315 - protein, 11 aa, Influenza virus
VDTIMEKNVTV

SEQ ID NO: 392316 - protein, 11 aa, Influenza virus
DTIMEKNVTVT

SEQ ID NO: 392317 - protein, 11 aa, Influenza virus
TIMEKNVTVTH

SEQ ID NO: 392318 - protein, 11 aa, Influenza virus
IMEKNVTVTHA

SEQ ID NO: 392319 - protein, 11 aa, Influenza virus
EKNVTVTHAQD

SEQ ID NO: 392320 - protein, 11 aa, Influenza virus
DCSVAGWLLGN

SEQ ID NO: 392321 - protein, 11 aa, Influenza virus
CSVAGWLLGNP

SEQ ID NO: 392322 - protein, 11 aa, Influenza virus
SVAGWLLGNPM

SEQ ID NO: 392323 - protein, 11 aa, Influenza virus
VAGWLLGNPMC

SEQ ID NO: 392324 - protein, 11 aa, Influenza virus
AGWLLGNPMCD

SEQ ID NO: 392325 - protein, 11 aa, Influenza virus
GWLLGNPMCDE

SEQ ID NO: 392326 - protein, 11 aa, Influenza virus
WLLGNPMCDEF

SEQ ID NO: 392327 - protein, 11 aa, Influenza virus
ADHPPKVAWSS

SEQ ID NO: 392328 - protein, 11 aa, Influenza virus
NGRSSFFRNVV

SEQ ID NO: 392329 - protein, 11 aa, Influenza virus
FESNGNFIAPE

SEQ ID NO: 392330 - protein, 11 aa, Influenza virus
ESNGNFIAPEY

SEQ ID NO: 392331 - protein, 11 aa, Influenza virus
SNGNFIAPEYA

SEQ ID NO: 392332 - protein, 11 aa, Influenza virus
NGNFIAPEYAY

SEQ ID NO: 392333 - protein, 11 aa, Influenza virus
GNFIAPEYAYK

SEQ ID NO: 392334 - protein, 11 aa, Influenza virus
NFIAPEYAYKI

SEQ ID NO: 392335 - protein, 11 aa, Influenza virus
PSVKLPMGAIN

SEQ ID NO: 392336 - protein, 11 aa, Influenza virus
GAIGAIDSSMP

SEQ ID NO: 392337 - protein, 11 aa, Influenza virus
AIGAIDSSMPF

SEQ ID NO: 392338 - protein, 11 aa, Influenza virus
IGAIDSSMPFH

SEQ ID NO: 392339 - protein, 11 aa, Influenza virus
PFHNIHPLTIG

SEQ ID NO: 392340 - protein, 11 aa, Influenza virus
HPLTIGECPKY

SEQ ID NO: 392341 - protein, 11 aa, Influenza virus
TIGECPKYVKS

SEQ ID NO: 392342 - protein, 11 aa, Influenza virus
REREGGRRRKR

SEQ ID NO: 392343 - protein, 11 aa, Influenza virus
EREGGRRRKRG

SEQ ID NO: 392344 - protein, 11 aa, Influenza virus
KKKRGLFGAIA

SEQ ID NO: 392345 - protein, 11 aa, Influenza virus
TRRQKRGLFGA

SEQ ID NO: 392346 - protein, 11 aa, Influenza virus
RRKKRGLFGAI

SEQ ID NO: 392347 - protein, 11 aa, Influenza virus
RQKRGLFGAIA

SEQ ID NO: 392348 - protein, 11 aa, Influenza virus
KKRGLFGAIAG

SEQ ID NO: 392349 - protein, 11 aa, Influenza virus
KRGLFGAIAGF

SEQ ID NO: 392350 - protein, 11 aa, Influenza virus
RRGLFGAIAGF

SEQ ID NO: 392351 - protein, 11 aa, Influenza virus
RGLFGAIAGFI

SEQ ID NO: 392352 - protein, 11 aa, Influenza virus
GLFGAIAGFIE

SEQ ID NO: 392353 - protein, 11 aa, Influenza virus
LFGAIAGFIEG

SEQ ID NO: 392354 - protein, 11 aa, Influenza virus
FGAIAGFIEGG

SEQ ID NO: 392355 - protein, 11 aa, Influenza virus
GAIAGFIEGGW

SEQ ID NO: 392356 - protein, 11 aa, Influenza virus
AIAGFIEGGWQ

SEQ ID NO: 392357 - protein, 11 aa, Influenza virus
IAGFIEGGWQG

SEQ ID NO: 392358 - protein, 11 aa, Influenza virus
AGFIEGGWQGM

SEQ ID NO: 392359 - protein, 11 aa, Influenza virus
GFIEGGWQGMV

SEQ ID NO: 392360 - protein, 11 aa, Influenza virus
FIEGGWQGMVD

SEQ ID NO: 392361 - protein, 11 aa, Influenza virus
IEGGWQGMVDG

SEQ ID NO: 392362 - protein, 11 aa, Influenza virus
EGGWQGMVDGW

SEQ ID NO: 392363 - protein, 11 aa, Influenza virus
GGWQGMVDGWY

SEQ ID NO: 392364 - protein, 11 aa, Influenza virus
GWQGMVDGWYG

SEQ ID NO: 392365 - protein, 11 aa, Influenza virus
WQGMVDGWYGY

SEQ ID NO: 392366 - protein, 11 aa, Influenza virus
QGMVDGWYGYH

SEQ ID NO: 392367 - protein, 11 aa, Influenza virus
GMVDGWYGYHH

SEQ ID NO: 392368 - protein, 11 aa, Influenza virus
QGSGYAADKES

SEQ ID NO: 392369 - protein, 11 aa, Influenza virus
GSGYAADKEST

SEQ ID NO: 392370 - protein, 11 aa, Influenza virus
GYAADKESTQK

SEQ ID NO: 392371 - protein, 11 aa, Influenza virus
YAADKESTQKA

SEQ ID NO: 392372 - protein, 11 aa, Influenza virus
DVWTYNAELLV

SEQ ID NO: 392373 - protein, 11 aa, Influenza virus
VWTYNAELLVL

SEQ ID NO: 392374 - protein, 11 aa, Influenza virus
WTYNAELLVLM

SEQ ID NO: 392375 - protein, 11 aa, Influenza virus
TYNAELLVLME

SEQ ID NO: 392376 - protein, 11 aa, Influenza virus
YNAELLVLMEN

SEQ ID NO: 392377 - protein, 11 aa, Influenza virus
NAELLVLMENE

SEQ ID NO: 392378 - protein, 11 aa, Influenza virus
AELLVLMENER

SEQ ID NO: 392379 - protein, 11 aa, Influenza virus
ELLVLMENERT

SEQ ID NO: 392380 - protein, 11 aa, Influenza virus
LLVLMENERTL

SEQ ID NO: 392381 - protein, 11 aa, Influenza virus
LVLMENERTLD

SEQ ID NO: 392382 - protein, 11 aa, Influenza virus
VLMENERTLDF

SEQ ID NO: 392383 - protein, 11 aa, Influenza virus
LMENERTLDFH

SEQ ID NO: 392384 - protein, 11 aa, Influenza virus
MENERTLDFHD

SEQ ID NO: 392385 - protein, 11 aa, Influenza virus
ENERTLDFHDS

SEQ ID NO: 392386 - protein, 11 aa, Influenza virus
NERTLDFHDSN

SEQ ID NO: 392387 - protein, 11 aa, Influenza virus
ERTLDFHDSNV

SEQ ID NO: 392388 - protein, 11 aa, Influenza virus
RTLDFHDSNVK

SEQ ID NO: 392389 - protein, 11 aa, Influenza virus
TLDFHDSNVKN

SEQ ID NO: 392390 - protein, 11 aa, Influenza virus
LDFHDSNVKNL

SEQ ID NO: 392391 - protein, 11 aa, Influenza virus
DFHDSNVKNLY

SEQ ID NO: 392392 - protein, 11 aa, Influenza virus
FHDSNVKNLYD

SEQ ID NO: 392393 - protein, 11 aa, Influenza virus
HDSNVKNLYDK

SEQ ID NO: 392394 - protein, 11 aa, Influenza virus
VRLQLRDNAKE

SEQ ID NO: 392395 - protein, 11 aa, Influenza virus
RLQLRDNAKEL

SEQ ID NO: 392396 - protein, 11 aa, Influenza virus
LQLRDNAKELG

SEQ ID NO: 392397 - protein, 11 aa, Influenza virus
QLRDNAKELGN

SEQ ID NO: 392398 - protein, 11 aa, Influenza virus
LRDNAKELGNG

SEQ ID NO: 392399 - protein, 11 aa, Influenza virus
RDNAKELGNGC

SEQ ID NO: 392400 - protein, 11 aa, Influenza virus
DNAKELGNGCF

SEQ ID NO: 392401 - protein, 11 aa, Influenza virus
NAKELGNGCFE

SEQ ID NO: 392402 - protein, 11 aa, Influenza virus
AKELGNGCFEF

SEQ ID NO: 392403 - protein, 11 aa, Influenza virus
KELGNGCFEFY

SEQ ID NO: 392404 - protein, 11 aa, Influenza virus
ELGNGCFEFYH

SEQ ID NO: 392405 - protein, 11 aa, Influenza virus
LGNGCFEFYHK

SEQ ID NO: 392406 - protein, 11 aa, Influenza virus
GNGCFEFYHKC

SEQ ID NO: 392407 - protein, 11 aa, Influenza virus
NGCFEFYHKCD

SEQ ID NO: 392408 - protein, 11 aa, Influenza virus
GCFEFYHKCDN

SEQ ID NO: 392409 - protein, 11 aa, Influenza virus
LSIYSTVASSL

SEQ ID NO: 392410 - protein, 11 aa, Influenza virus
EFPSTGNHGSL

SEQ ID NO: 392411 - protein, 11 aa, Influenza virus
FPSTGNHGSLV

SEQ ID NO: 392412 - protein, 11 aa, Influenza virus
PSTGNHGSLVL

SEQ ID NO: 392413 - protein, 11 aa, Influenza virus
STGNHGSLVLS

SEQ ID NO: 392414 - protein, 11 aa, Influenza virus
TGNHGSLVLSL

SEQ ID NO: 392415 - protein, 11 aa, Influenza virus
GNHGSLVLSLW

SEQ ID NO: 392416 - protein, 11 aa, Influenza virus
NHGSLVLSLWM

SEQ ID NO: 392417 - protein, 11 aa, Influenza virus
HGSLVLSLWMC

SEQ ID NO: 392418 - protein, 11 aa, Influenza virus
LWMCSNGSLQC

SEQ ID NO: 392419 - protein, 11 aa, Influenza virus
WMCSNGSLQCR

SEQ ID NO: 392420 - protein, 11 aa, Influenza virus
MCSNGSLQCRI

SEQ ID NO: 392421 - protein, 11 aa, Influenza virus
SNGSLQCRICI

SEQ ID NO: 392422 - protein, 11 aa, Influenza virus
FAFKFVSSDCS

SEQ ID NO: 392423 - protein, 11 aa, Influenza virus
CIRFVNSDCSK

SEQ ID NO: 392424 - protein, 11 aa, Influenza virus
ICQMEKIVLLF

SEQ ID NO: 392425 - protein, 11 aa, Influenza virus
VKMEKIVLLLA

SEQ ID NO: 392426 - protein, 11 aa, Influenza virus
KMEKIVLLLAT

SEQ ID NO: 392427 - protein, 11 aa, Influenza virus
SDQICIGYHAN

SEQ ID NO: 392428 - protein, 11 aa, Influenza virus
DQICIGYHANN

SEQ ID NO: 392429 - protein, 11 aa, Influenza virus
QICIGYHANNS

SEQ ID NO: 392430 - protein, 11 aa, Influenza virus
ICIGYHANNST

SEQ ID NO: 392431 - protein, 11 aa, Influenza virus
CIGYHANNSTE

SEQ ID NO: 392432 - protein, 11 aa, Influenza virus
ANNSTEQVDTI

SEQ ID NO: 392433 - protein, 11 aa, Influenza virus
NNSTEQVDTIM

SEQ ID NO: 392434 - protein, 11 aa, Influenza virus
QVDTIMEKNVT

SEQ ID NO: 392435 - protein, 11 aa, Influenza virus
VDTIMEKNVTV

SEQ ID NO: 392436 - protein, 11 aa, Influenza virus
DTIMEKNVTVT

SEQ ID NO: 392437 - protein, 11 aa, Influenza virus
TIMEKNVTVTH

SEQ ID NO: 392438 - protein, 11 aa, Influenza virus
IMEKNVTVTHA

SEQ ID NO: 392439 - protein, 11 aa, Influenza virus
MEKNVTVTHAQ

SEQ ID NO: 392440 - protein, 11 aa, Influenza virus
EKNVTVTHAQD

SEQ ID NO: 392441 - protein, 11 aa, Influenza virus
KNVTVTHAQDI

SEQ ID NO: 392442 - protein, 11 aa, Influenza virus
NVTVTHAQDIL

SEQ ID NO: 392443 - protein, 11 aa, Influenza virus
VTVTHAQDILE

SEQ ID NO: 392444 - protein, 11 aa, Influenza virus
TVTHAQDILEK

SEQ ID NO: 392445 - protein, 11 aa, Influenza virus
KPLILRDCSVA

SEQ ID NO: 392446 - protein, 11 aa, Influenza virus
PLILRDCSVAG

SEQ ID NO: 392447 - protein, 11 aa, Influenza virus
LILRDCSVAGW

SEQ ID NO: 392448 - protein, 11 aa, Influenza virus
ILRDCSVAGWL

SEQ ID NO: 392449 - protein, 11 aa, Influenza virus
LRDCSVAGWLL

SEQ ID NO: 392450 - protein, 11 aa, Influenza virus
RDCSVAGWLLG

SEQ ID NO: 392451 - protein, 11 aa, Influenza virus
DCSVAGWLLGN

SEQ ID NO: 392452 - protein, 11 aa, Influenza virus
CSVAGWLLGNP

SEQ ID NO: 392453 - protein, 11 aa, Influenza virus
SVAGWLLGNPM

SEQ ID NO: 392454 - protein, 11 aa, Influenza virus
VAGWLLGNPMC

SEQ ID NO: 392455 - protein, 11 aa, Influenza virus
AGWLLGNPMCD

SEQ ID NO: 392456 - protein, 11 aa, Influenza virus
GWLLGNPMCDE

SEQ ID NO: 392457 - protein, 11 aa, Influenza virus
WLLGNPMCDEF

SEQ ID NO: 392458 - protein, 11 aa, Influenza virus
NVPEWSYIVEK

SEQ ID NO: 392459 - protein, 11 aa, Influenza virus
YEELKHLLSRI

SEQ ID NO: 392460 - protein, 11 aa, Influenza virus
ADHPPKVAWSS

SEQ ID NO: 392461 - protein, 11 aa, Influenza virus
TYISVGTSTLN

SEQ ID NO: 392462 - protein, 11 aa, Influenza virus
ISVGTSTLNQR

SEQ ID NO: 392463 - protein, 11 aa, Influenza virus
SVGTSTLNQRL

SEQ ID NO: 392464 - protein, 11 aa, Influenza virus
NFESNGNFIAP

SEQ ID NO: 392465 - protein, 11 aa, Influenza virus
FESNGNFIAPE

SEQ ID NO: 392466 - protein, 11 aa, Influenza virus
ESNGNFIAPEY

SEQ ID NO: 392467 - protein, 11 aa, Influenza virus
SNGNFIAPEYA

SEQ ID NO: 392468 - protein, 11 aa, Influenza virus
NGNFIAPEYAY

SEQ ID NO: 392469 - protein, 11 aa, Influenza virus
GNFIAPEYAYK

SEQ ID NO: 392470 - protein, 11 aa, Influenza virus
NFIAPEYAYKI

SEQ ID NO: 392471 - protein, 11 aa, Influenza virus
PSVKLPMGAIN

SEQ ID NO: 392472 - protein, 11 aa, Influenza virus
GAIGAIDSSMP

SEQ ID NO: 392473 - protein, 11 aa, Influenza virus
AIGAIDSSMPF

SEQ ID NO: 392474 - protein, 11 aa, Influenza virus
IGAIDSSMPFH

SEQ ID NO: 392475 - protein, 11 aa, Influenza virus
GAINSSMPFHN

SEQ ID NO: 392476 - protein, 11 aa, Influenza virus
AINSSMPFHNI

SEQ ID NO: 392477 - protein, 11 aa, Influenza virus
INSSMPFHNIH

SEQ ID NO: 392478 - protein, 11 aa, Influenza virus
NSSMPFHNIHP

SEQ ID NO: 392479 - protein, 11 aa, Influenza virus
SSMPFHNIHPL

SEQ ID NO: 392480 - protein, 11 aa, Influenza virus
SMPFHNIHPLT

SEQ ID NO: 392481 - protein, 11 aa, Influenza virus
MPFHNIHPLTI

SEQ ID NO: 392482 - protein, 11 aa, Influenza virus
PFHNIHPLTIG

SEQ ID NO: 392483 - protein, 11 aa, Influenza virus
FHNIHPLTIGE

SEQ ID NO: 392484 - protein, 11 aa, Influenza virus
HNIHPLTIGEC

SEQ ID NO: 392485 - protein, 11 aa, Influenza virus
NIHPLTIGECP

SEQ ID NO: 392486 - protein, 11 aa, Influenza virus
IHPLTIGECPK

SEQ ID NO: 392487 - protein, 11 aa, Influenza virus
HPLTIGECPKY

SEQ ID NO: 392488 - protein, 11 aa, Influenza virus
PLTIGECPKYV

SEQ ID NO: 392489 - protein, 11 aa, Influenza virus
LTIGECPKYVK

SEQ ID NO: 392490 - protein, 11 aa, Influenza virus
TIGECPKYVKS

SEQ ID NO: 392491 - protein, 11 aa, Influenza virus
IGECPKYVKSN

SEQ ID NO: 392492 - protein, 11 aa, Influenza virus
REREGGRRRKR

SEQ ID NO: 392493 - protein, 11 aa, Influenza virus
EREGGRRRKRG

SEQ ID NO: 392494 - protein, 11 aa, Influenza virus
RKKRGLFGAIA

SEQ ID NO: 392495 - protein, 11 aa, Influenza virus
KKRGLFGAIAG

SEQ ID NO: 392496 - protein, 11 aa, Influenza virus
KKRGLFGAIAG

SEQ ID NO: 392497 - protein, 11 aa, Influenza virus
KRGLFGAIAGF

SEQ ID NO: 392498 - protein, 11 aa, Influenza virus
RGLFGAIAGFI

SEQ ID NO: 392499 - protein, 11 aa, Influenza virus
GLFGAIAGFIE

SEQ ID NO: 392500 - protein, 11 aa, Influenza virus
LFGAIAGFIEG

SEQ ID NO: 392501 - protein, 11 aa, Influenza virus
FGAIAGFIEGG

SEQ ID NO: 392502 - protein, 11 aa, Influenza virus
GAIAGFIEGGW

SEQ ID NO: 392503 - protein, 11 aa, Influenza virus
AIAGFIEGGWQ

SEQ ID NO: 392504 - protein, 11 aa, Influenza virus
IAGFIEGGWQG

SEQ ID NO: 392505 - protein, 11 aa, Influenza virus
AGFIEGGWQGM

SEQ ID NO: 392506 - protein, 11 aa, Influenza virus
GFIEGGWQGMV

SEQ ID NO: 392507 - protein, 11 aa, Influenza virus
FIEGGWQGMVD

SEQ ID NO: 392508 - protein, 11 aa, Influenza virus
IEGGWQGMVDG

SEQ ID NO: 392509 - protein, 11 aa, Influenza virus
EGGWQGMVDGW

SEQ ID NO: 392510 - protein, 11 aa, Influenza virus
GGWQGMVDGWY

SEQ ID NO: 392511 - protein, 11 aa, Influenza virus
GWQGMVDGWYG

SEQ ID NO: 392512 - protein, 11 aa, Influenza virus
WQGMVDGWYGY

SEQ ID NO: 392513 - protein, 11 aa, Influenza virus
QGMVDGWYGYH

SEQ ID NO: 392514 - protein, 11 aa, Influenza virus
GMVDGWYGYHH

SEQ ID NO: 392515 - protein, 11 aa, Influenza virus
MVDGWYGYHHS

SEQ ID NO: 392516 - protein, 11 aa, Influenza virus
VDGWYGYHHSN

SEQ ID NO: 392517 - protein, 11 aa, Influenza virus
HSNEQGSGYAA

SEQ ID NO: 392518 - protein, 11 aa, Influenza virus
SNEQGSGYAAD

SEQ ID NO: 392519 - protein, 11 aa, Influenza virus
NEQGSGYAADK

SEQ ID NO: 392520 - protein, 11 aa, Influenza virus
QGSGYAADKES

SEQ ID NO: 392521 - protein, 11 aa, Influenza virus
GSGYAADKEST

SEQ ID NO: 392522 - protein, 11 aa, Influenza virus
SGYAADKESTQ

SEQ ID NO: 392523 - protein, 11 aa, Influenza virus
GYAADKESTQK

SEQ ID NO: 392524 - protein, 11 aa, Influenza virus
YAADKESTQKA

SEQ ID NO: 392525 - protein, 11 aa, Influenza virus
STQKAIDGVTN

SEQ ID NO: 392526 - protein, 11 aa, Influenza virus
TQKAIDGVTNK

SEQ ID NO: 392527 - protein, 11 aa, Influenza virus
AIDGVTNKVNS

SEQ ID NO: 392528 - protein, 11 aa, Influenza virus
IDGVTNKVNSI

SEQ ID NO: 392529 - protein, 11 aa, Influenza virus
DGVTNKVNSII

SEQ ID NO: 392530 - protein, 11 aa, Influenza virus
GVTNKVNSIID

SEQ ID NO: 392531 - protein, 11 aa, Influenza virus
VTNKVNSIIDK

SEQ ID NO: 392532 - protein, 11 aa, Influenza virus
TNKVNSIIDKM

SEQ ID NO: 392533 - protein, 11 aa, Influenza virus
NKVNSIIDKMN

SEQ ID NO: 392534 - protein, 11 aa, Influenza virus
KVNSIIDKMNT

SEQ ID NO: 392535 - protein, 11 aa, Influenza virus
VNSIIDKMNTQ

SEQ ID NO: 392536 - protein, 11 aa, Influenza virus
NSIIDKMNTQF

SEQ ID NO: 392537 - protein, 11 aa, Influenza virus
SIIDKMNTQFE

SEQ ID NO: 392538 - protein, 11 aa, Influenza virus
IIDKMNTQFEA

SEQ ID NO: 392539 - protein, 11 aa, Influenza virus
KMNTQFEAVGR

SEQ ID NO: 392540 - protein, 11 aa, Influenza virus
MNTQFEAVGRE

SEQ ID NO: 392541 - protein, 11 aa, Influenza virus
NTQFEAVGREF

SEQ ID NO: 392542 - protein, 11 aa, Influenza virus
LERRIENLNKK

SEQ ID NO: 392543 - protein, 11 aa, Influenza virus
ERRIENLNKKM

SEQ ID NO: 392544 - protein, 11 aa, Influenza virus
RRIENLNKKME

SEQ ID NO: 392545 - protein, 11 aa, Influenza virus
RIENLNKKMED

SEQ ID NO: 392546 - protein, 11 aa, Influenza virus
IENLNKKMEDG

SEQ ID NO: 392547 - protein, 11 aa, Influenza virus
ENLNKKMEDGF

SEQ ID NO: 392548 - protein, 11 aa, Influenza virus
NLNKKMEDGFL

SEQ ID NO: 392549 - protein, 11 aa, Influenza virus
LNKKMEDGFLD

SEQ ID NO: 392550 - protein, 11 aa, Influenza virus
NKKMEDGFLDV

SEQ ID NO: 392551 - protein, 11 aa, Influenza virus
KKMEDGFLDVW

SEQ ID NO: 392552 - protein, 11 aa, Influenza virus
KMEDGFLDVWT

SEQ ID NO: 392553 - protein, 11 aa, Influenza virus
MEDGFLDVWTY

SEQ ID NO: 392554 - protein, 11 aa, Influenza virus
EDGFLDVWTYN

SEQ ID NO: 392555 - protein, 11 aa, Influenza virus
DGFLDVWTYNA

SEQ ID NO: 392556 - protein, 11 aa, Influenza virus
GFLDVWTYNAE

SEQ ID NO: 392557 - protein, 11 aa, Influenza virus
FLDVWTYNAEL

SEQ ID NO: 392558 - protein, 11 aa, Influenza virus
LDVWTYNAELL

SEQ ID NO: 392559 - protein, 11 aa, Influenza virus
DVWTYNAELLV

SEQ ID NO: 392560 - protein, 11 aa, Influenza virus
VWTYNAELLVL

SEQ ID NO: 392561 - protein, 11 aa, Influenza virus
WTYNAELLVLM

SEQ ID NO: 392562 - protein, 11 aa, Influenza virus
TYNAELLVLME

SEQ ID NO: 392563 - protein, 11 aa, Influenza virus
YNAELLVLMEN

SEQ ID NO: 392564 - protein, 11 aa, Influenza virus
NAELLVLMENE

SEQ ID NO: 392565 - protein, 11 aa, Influenza virus
AELLVLMENER

SEQ ID NO: 392566 - protein, 11 aa, Influenza virus
ELLVLMENERT

SEQ ID NO: 392567 - protein, 11 aa, Influenza virus
LLVLMENERTL

SEQ ID NO: 392568 - protein, 11 aa, Influenza virus
LVLMENERTLD

SEQ ID NO: 392569 - protein, 11 aa, Influenza virus
VLMENERTLDF

SEQ ID NO: 392570 - protein, 11 aa, Influenza virus
LMENERTLDFH

SEQ ID NO: 392571 - protein, 11 aa, Influenza virus
MENERTLDFHD

SEQ ID NO: 392572 - protein, 11 aa, Influenza virus
ENERTLDFHDS

SEQ ID NO: 392573 - protein, 11 aa, Influenza virus
NERTLDFHDSN

SEQ ID NO: 392574 - protein, 11 aa, Influenza virus
ERTLDFHDSNV

SEQ ID NO: 392575 - protein, 11 aa, Influenza virus
RTLDFHDSNVK

SEQ ID NO: 392576 - protein, 11 aa, Influenza virus
TLDFHDSNVKN

SEQ ID NO: 392577 - protein, 11 aa, Influenza virus
LDFHDSNVKNL

SEQ ID NO: 392578 - protein, 11 aa, Influenza virus
DFHDSNVKNLY

SEQ ID NO: 392579 - protein, 11 aa, Influenza virus
FHDSNVKNLYD

SEQ ID NO: 392580 - protein, 11 aa, Influenza virus
HDSNVKNLYDK

SEQ ID NO: 392581 - protein, 11 aa, Influenza virus
DSNVKNLYDKV

SEQ ID NO: 392582 - protein, 11 aa, Influenza virus
SNVKNLYDKVR

SEQ ID NO: 392583 - protein, 11 aa, Influenza virus
NVKNLYDKVRL

SEQ ID NO: 392584 - protein, 11 aa, Influenza virus
VKNLYDKVRLQ

SEQ ID NO: 392585 - protein, 11 aa, Influenza virus
KNLYDKVRLQL

SEQ ID NO: 392586 - protein, 11 aa, Influenza virus
NLYDKVRLQLR

SEQ ID NO: 392587 - protein, 11 aa, Influenza virus
LYDKVRLQLRD

SEQ ID NO: 392588 - protein, 11 aa, Influenza virus
YDKVRLQLRDN

SEQ ID NO: 392589 - protein, 11 aa, Influenza virus
DKVRLQLRDNA

SEQ ID NO: 392590 - protein, 11 aa, Influenza virus
KVRLQLRDNAK

SEQ ID NO: 392591 - protein, 11 aa, Influenza virus
VRLQLRDNAKE

SEQ ID NO: 392592 - protein, 11 aa, Influenza virus
RLQLRDNAKEL

SEQ ID NO: 392593 - protein, 11 aa, Influenza virus
LQLRDNAKELG

SEQ ID NO: 392594 - protein, 11 aa, Influenza virus
QLRDNAKELGN

SEQ ID NO: 392595 - protein, 11 aa, Influenza virus
LRDNAKELGNG

SEQ ID NO: 392596 - protein, 11 aa, Influenza virus
RDNAKELGNGC

SEQ ID NO: 392597 - protein, 11 aa, Influenza virus
DNAKELGNGCF

SEQ ID NO: 392598 - protein, 11 aa, Influenza virus
NAKELGNGCFE

SEQ ID NO: 392599 - protein, 11 aa, Influenza virus
AKELGNGCFEF

SEQ ID NO: 392600 - protein, 11 aa, Influenza virus
KELGNGCFEFY

SEQ ID NO: 392601 - protein, 11 aa, Influenza virus
ELGNGCFEFYH

SEQ ID NO: 392602 - protein, 11 aa, Influenza virus
LGNGCFEFYHK

SEQ ID NO: 392603 - protein, 11 aa, Influenza virus
GNGCFEFYHKC

SEQ ID NO: 392604 - protein, 11 aa, Influenza virus
NGCFEFYHKCD

SEQ ID NO: 392605 - protein, 11 aa, Influenza virus
GCFEFYHKCDN

SEQ ID NO: 392606 - protein, 11 aa, Influenza virus
GTYQILSIYST

SEQ ID NO: 392607 - protein, 11 aa, Influenza virus
YQILSIYSTVA

SEQ ID NO: 392608 - protein, 11 aa, Influenza virus
QILSIYSTVAS

SEQ ID NO: 392609 - protein, 11 aa, Influenza virus
ILSIYSTVASS

SEQ ID NO: 392610 - protein, 11 aa, Influenza virus
LSIYSTVASSL

SEQ ID NO: 392611 - protein, 11 aa, Influenza virus
YSTVASSLALA

SEQ ID NO: 392612 - protein, 11 aa, Influenza virus
STVASSLALAI

SEQ ID NO: 392613 - protein, 11 aa, Influenza virus
EFPSTGNHGSL

SEQ ID NO: 392614 - protein, 11 aa, Influenza virus
FPSTGNHGSLV

SEQ ID NO: 392615 - protein, 11 aa, Influenza virus
PSTGNHGSLVL

SEQ ID NO: 392616 - protein, 11 aa, Influenza virus
STGNHGSLVLS

SEQ ID NO: 392617 - protein, 11 aa, Influenza virus
TGNHGSLVLSL

SEQ ID NO: 392618 - protein, 11 aa, Influenza virus
GNHGSLVLSLW

SEQ ID NO: 392619 - protein, 11 aa, Influenza virus
NHGSLVLSLWM

SEQ ID NO: 392620 - protein, 11 aa, Influenza virus
HGSLVLSLWMC

SEQ ID NO: 392621 - protein, 11 aa, Influenza virus
AGLSLWMCSNG

SEQ ID NO: 392622 - protein, 11 aa, Influenza virus
GLSLWMCSNGS

SEQ ID NO: 392623 - protein, 11 aa, Influenza virus
LWMCSNGSLQC

SEQ ID NO: 392624 - protein, 11 aa, Influenza virus
WMCSNGSLQCR

SEQ ID NO: 392625 - protein, 11 aa, Influenza virus
MCSNGSLQCRI

SEQ ID NO: 392626 - protein, 11 aa, Influenza virus
CSNGSLQCRIC

SEQ ID NO: 392627 - protein, 11 aa, Influenza virus
SNGSLQCRICI

SEQ ID NO: 392628 - protein, 11 aa, Influenza virus
FAFKFVSSDCS

SEQ ID NO: 392629 - protein, 11 aa, Influenza virus
CIRFVNSDCSK

SEQ ID NO: 392630 - protein, 11 aa, Influenza virus
LVFREQKQEFK

SEQ ID NO: 392631 - protein, 11 aa, Influenza virus
GLREQKQEFKM

SEQ ID NO: 392632 - protein, 11 aa, Influenza virus
LREQKQEFKMN

SEQ ID NO: 392633 - protein, 11 aa, Influenza virus
REQKQEFKMNP

SEQ ID NO: 392634 - protein, 11 aa, Influenza virus
EQKQEFKMNPN

SEQ ID NO: 392635 - protein, 11 aa, Influenza virus
QKQEFKMNPNK

SEQ ID NO: 392636 - protein, 11 aa, Influenza virus
KQEFKMNPNKK

SEQ ID NO: 392637 - protein, 11 aa, Influenza virus
QEFKMNPNKKI

SEQ ID NO: 392638 - protein, 11 aa, Influenza virus
EFKMNPNKKII

SEQ ID NO: 392639 - protein, 11 aa, Influenza virus
FKMNPNKKIIT

SEQ ID NO: 392640 - protein, 11 aa, Influenza virus
KMNPNKKIITI

SEQ ID NO: 392641 - protein, 11 aa, Influenza virus
IEIITIGSICM

SEQ ID NO: 392642 - protein, 11 aa, Influenza virus
RDITIGSICMV

SEQ ID NO: 392643 - protein, 11 aa, Influenza virus
IITIGSICMVT

SEQ ID NO: 392644 - protein, 11 aa, Influenza virus
NLDLNMGQPFY

SEQ ID NO: 392645 - protein, 11 aa, Influenza virus
LDLNMGQPFYS

SEQ ID NO: 392646 - protein, 11 aa, Influenza virus
DLNMGQPFYSH

SEQ ID NO: 392647 - protein, 11 aa, Influenza virus
LNMGQPFYSHR

SEQ ID NO: 392648 - protein, 11 aa, Influenza virus
GPSHSIHTGNQ

SEQ ID NO: 392649 - protein, 11 aa, Influenza virus
YENNTWVNQTY

SEQ ID NO: 392650 - protein, 11 aa, Influenza virus
YSKDNSIRIGS

SEQ ID NO: 392651 - protein, 11 aa, Influenza virus
SKDNSIRIGSK

SEQ ID NO: 392652 - protein, 11 aa, Influenza virus
KDNSIRIGSKG

SEQ ID NO: 392653 - protein, 11 aa, Influenza virus
DNSIRIGSKGD

SEQ ID NO: 392654 - protein, 11 aa, Influenza virus
NSIRIGSKGDV

SEQ ID NO: 392655 - protein, 11 aa, Influenza virus
SIRIGSKGDVF

SEQ ID NO: 392656 - protein, 11 aa, Influenza virus
IRIGSKGDVFV

SEQ ID NO: 392657 - protein, 11 aa, Influenza virus
EPFISCSHLEC

SEQ ID NO: 392658 - protein, 11 aa, Influenza virus
PFISCSHLECR

SEQ ID NO: 392659 - protein, 11 aa, Influenza virus
ISCSHLECRTF

SEQ ID NO: 392660 - protein, 11 aa, Influenza virus
SCSHLECRTFF

SEQ ID NO: 392661 - protein, 11 aa, Influenza virus
CSHLECRTFFL

SEQ ID NO: 392662 - protein, 11 aa, Influenza virus
SHLECRTFFLT

SEQ ID NO: 392663 - protein, 11 aa, Influenza virus
LECRTFFLTQG

SEQ ID NO: 392664 - protein, 11 aa, Influenza virus
ECRTFFLTQGA

SEQ ID NO: 392665 - protein, 11 aa, Influenza virus
CRTFFLTQGAL

SEQ ID NO: 392666 - protein, 11 aa, Influenza virus
RTFFLTQGALL

SEQ ID NO: 392667 - protein, 11 aa, Influenza virus
TFFLTQGALLN

SEQ ID NO: 392668 - protein, 11 aa, Influenza virus
FFLTQGALLND

SEQ ID NO: 392669 - protein, 11 aa, Influenza virus
FLTQGALLNDK

SEQ ID NO: 392670 - protein, 11 aa, Influenza virus
LTQGALLNDKH

SEQ ID NO: 392671 - protein, 11 aa, Influenza virus
TQGALLNDKHS

SEQ ID NO: 392672 - protein, 11 aa, Influenza virus
QGALLNDKHSN

SEQ ID NO: 392673 - protein, 11 aa, Influenza virus
GALLNDKHSNG

SEQ ID NO: 392674 - protein, 11 aa, Influenza virus
ALLNDKHSNGT

SEQ ID NO: 392675 - protein, 11 aa, Influenza virus
LLNDKHSNGTV

SEQ ID NO: 392676 - protein, 11 aa, Influenza virus
HSNGTVKDRSP

SEQ ID NO: 392677 - protein, 11 aa, Influenza virus
KDRSPHRTLMS

SEQ ID NO: 392678 - protein, 11 aa, Influenza virus
DRSPHRTLMSC

SEQ ID NO: 392679 - protein, 11 aa, Influenza virus
RSPHRTLMSCP

SEQ ID NO: 392680 - protein, 11 aa, Influenza virus
GEAPSPYNSRF

SEQ ID NO: 392681 - protein, 11 aa, Influenza virus
EAPSPYNSRFE

SEQ ID NO: 392682 - protein, 11 aa, Influenza virus
APSPYNSRFES

SEQ ID NO: 392683 - protein, 11 aa, Influenza virus
PSPYNSRFESV

SEQ ID NO: 392684 - protein, 11 aa, Influenza virus
SPYNSRFESVA

SEQ ID NO: 392685 - protein, 11 aa, Influenza virus
PYNSRFESVAW

SEQ ID NO: 392686 - protein, 11 aa, Influenza virus
YNSRFESVAWS

SEQ ID NO: 392687 - protein, 11 aa, Influenza virus
NSRFESVAWSA

SEQ ID NO: 392688 - protein, 11 aa, Influenza virus
SRFESVAWSAS

SEQ ID NO: 392689 - protein, 11 aa, Influenza virus
RFESVAWSASA

SEQ ID NO: 392690 - protein, 11 aa, Influenza virus
FESVAWSASAC

SEQ ID NO: 392691 - protein, 11 aa, Influenza virus
ESVAWSASACH

SEQ ID NO: 392692 - protein, 11 aa, Influenza virus
SVAWSASACHD

SEQ ID NO: 392693 - protein, 11 aa, Influenza virus
VAWSASACHDG

SEQ ID NO: 392694 - protein, 11 aa, Influenza virus
AWSASACHDGT

SEQ ID NO: 392695 - protein, 11 aa, Influenza virus
WSASACHDGTS

SEQ ID NO: 392696 - protein, 11 aa, Influenza virus
SASACHDGTSW

SEQ ID NO: 392697 - protein, 11 aa, Influenza virus
ASACHDGTSWL

SEQ ID NO: 392698 - protein, 11 aa, Influenza virus
SWLTIGISGPD

SEQ ID NO: 392699 - protein, 11 aa, Influenza virus
WLTIGISGPDN

SEQ ID NO: 392700 - protein, 11 aa, Influenza virus
IGISGPDNGAV

SEQ ID NO: 392701 - protein, 11 aa, Influenza virus
GISGPDNGAVA

SEQ ID NO: 392702 - protein, 11 aa, Influenza virus
ISGPDNGAVAV

SEQ ID NO: 392703 - protein, 11 aa, Influenza virus
SGPDNGAVAVL

SEQ ID NO: 392704 - protein, 11 aa, Influenza virus
GPDNGAVAVLK

SEQ ID NO: 392705 - protein, 11 aa, Influenza virus
PDNGAVAVLKY

SEQ ID NO: 392706 - protein, 11 aa, Influenza virus
ILRTQESECAC

SEQ ID NO: 392707 - protein, 11 aa, Influenza virus
LRTQESECACV

SEQ ID NO: 392708 - protein, 11 aa, Influenza virus
RTQESECACVN

SEQ ID NO: 392709 - protein, 11 aa, Influenza virus
TQESECACVNG

SEQ ID NO: 392710 - protein, 11 aa, Influenza virus
GSCFTVMTDGP

SEQ ID NO: 392711 - protein, 11 aa, Influenza virus
YKYKIFKNGKK

SEQ ID NO: 392712 - protein, 11 aa, Influenza virus
KYKIFKNGKKG

SEQ ID NO: 392713 - protein, 11 aa, Influenza virus
GKKGKWLNQSK

SEQ ID NO: 392714 - protein, 11 aa, Influenza virus
APNYHYEECSC

SEQ ID NO: 392715 - protein, 11 aa, Influenza virus
PNYHYEECSCY

SEQ ID NO: 392716 - protein, 11 aa, Influenza virus
NYHYEECSCYP

SEQ ID NO: 392717 - protein, 11 aa, Influenza virus
YHYEECSCYPD

SEQ ID NO: 392718 - protein, 11 aa, Influenza virus
HYEECSCYPDA

SEQ ID NO: 392719 - protein, 11 aa, Influenza virus
YEECSCYPDAG

SEQ ID NO: 392720 - protein, 11 aa, Influenza virus
TCVCRDNWHGS

SEQ ID NO: 392721 - protein, 11 aa, Influenza virus
CVCRDNWHGSN

SEQ ID NO: 392722 - protein, 11 aa, Influenza virus
VCRDNWHGSNR

SEQ ID NO: 392723 - protein, 11 aa, Influenza virus
CRDNWHGSNRP

SEQ ID NO: 392724 - protein, 11 aa, Influenza virus
RDNWHGSNRPW

SEQ ID NO: 392725 - protein, 11 aa, Influenza virus
DNWHGSNRPWV

SEQ ID NO: 392726 - protein, 11 aa, Influenza virus
NWHGSNRPWVS

SEQ ID NO: 392727 - protein, 11 aa, Influenza virus
WHGSNRPWVSF

SEQ ID NO: 392728 - protein, 11 aa, Influenza virus
HGSNRPWVSFN

SEQ ID NO: 392729 - protein, 11 aa, Influenza virus
GYICSGVFGDN

SEQ ID NO: 392730 - protein, 11 aa, Influenza virus
YICSGVFGDNP

SEQ ID NO: 392731 - protein, 11 aa, Influenza virus
ICSGVFGDNPR

SEQ ID NO: 392732 - protein, 11 aa, Influenza virus
CSGVFGDNPRP

SEQ ID NO: 392733 - protein, 11 aa, Influenza virus
FKYGNGVWIGR

SEQ ID NO: 392734 - protein, 11 aa, Influenza virus
KYGNGVWIGRT

SEQ ID NO: 392735 - protein, 11 aa, Influenza virus
YGNGVWIGRTK

SEQ ID NO: 392736 - protein, 11 aa, Influenza virus
GNGVWIGRTKS

SEQ ID NO: 392737 - protein, 11 aa, Influenza virus
SRSGFEMIWDP

SEQ ID NO: 392738 - protein, 11 aa, Influenza virus
RSGFEMIWDPN

SEQ ID NO: 392739 - protein, 11 aa, Influenza virus
SGFEMIWDPNG

SEQ ID NO: 392740 - protein, 11 aa, Influenza virus
GFEMIWDPNGW

SEQ ID NO: 392741 - protein, 11 aa, Influenza virus
ITDWSGYSGSF

SEQ ID NO: 392742 - protein, 11 aa, Influenza virus
TDWSGYSGSFV

SEQ ID NO: 392743 - protein, 11 aa, Influenza virus
DWSGYSGSFVQ

SEQ ID NO: 392744 - protein, 11 aa, Influenza virus
WSGYSGSFVQH

SEQ ID NO: 392745 - protein, 11 aa, Influenza virus
SGYSGSFVQHP

SEQ ID NO: 392746 - protein, 11 aa, Influenza virus
GYSGSFVQHPE

SEQ ID NO: 392747 - protein, 11 aa, Influenza virus
YSGSFVQHPEL

SEQ ID NO: 392748 - protein, 11 aa, Influenza virus
SGSFVQHPELT

SEQ ID NO: 392749 - protein, 11 aa, Influenza virus
GSFVQHPELTG

SEQ ID NO: 392750 - protein, 11 aa, Influenza virus
SFVQHPELTGL

SEQ ID NO: 392751 - protein, 11 aa, Influenza virus
FVQHPELTGLD

SEQ ID NO: 392752 - protein, 11 aa, Influenza virus
VQHPELTGLDC

SEQ ID NO: 392753 - protein, 11 aa, Influenza virus
DCIRPCFWVEL

SEQ ID NO: 392754 - protein, 11 aa, Influenza virus
CIRPCFWVELI

SEQ ID NO: 392755 - protein, 11 aa, Influenza virus
IRPCFWVELIR

SEQ ID NO: 392756 - protein, 11 aa, Influenza virus
RPCFWVELIRG

SEQ ID NO: 392757 - protein, 11 aa, Influenza virus
PCFWVELIRGR

SEQ ID NO: 392758 - protein, 11 aa, Influenza virus
CFWVELIRGRP

SEQ ID NO: 392759 - protein, 11 aa, Influenza virus
FWVELIRGRPK

SEQ ID NO: 392760 - protein, 11 aa, Influenza virus
WVELIRGRPKE

SEQ ID NO: 392761 - protein, 11 aa, Influenza virus
IWTSGSSISFC

SEQ ID NO: 392762 - protein, 11 aa, Influenza virus
WTSGSSISFCG

SEQ ID NO: 392763 - protein, 11 aa, Influenza virus
TSGSSISFCGV

SEQ ID NO: 392764 - protein, 11 aa, Influenza virus
SGSSISFCGVN

SEQ ID NO: 392765 - protein, 11 aa, Influenza virus
IFLWCKIVTTV

SEQ ID NO: 392766 - protein, 11 aa, Influenza virus
FLWCKIVTTVG

SEQ ID NO: 392767 - protein, 11 aa, Influenza virus
LWCKIVTTVGW

SEQ ID NO: 392768 - protein, 11 aa, Influenza virus
WCKIVTTVGWS

SEQ ID NO: 392769 - protein, 11 aa, Influenza virus
CKIVTTVGWSW

SEQ ID NO: 392770 - protein, 11 aa, Influenza virus
KIVTTVGWSWP

SEQ ID NO: 392771 - protein, 11 aa, Influenza virus
IVTTVGWSWPD

SEQ ID NO: 392772 - protein, 11 aa, Influenza virus
VTTVGWSWPDG

SEQ ID NO: 392773 - protein, 11 aa, Influenza virus
WSWPDGAELPF

SEQ ID NO: 392774 - protein, 11 aa, Influenza virus
GAELPFTIDKS

SEQ ID NO: 392775 - protein, 11 aa, Influenza virus
DQICIGYHANN

SEQ ID NO: 392776 - protein, 11 aa, Influenza virus
QICIGYHANNS

SEQ ID NO: 392777 - protein, 11 aa, Influenza virus
ICIGYHANNST

SEQ ID NO: 392778 - protein, 11 aa, Influenza virus
CIGYHANNSTE

SEQ ID NO: 392779 - protein, 11 aa, Influenza virus
IGYHANNSTEQ

SEQ ID NO: 392780 - protein, 11 aa, Influenza virus
GYHANNSTEQV

SEQ ID NO: 392781 - protein, 11 aa, Influenza virus
YHANNSTEQVD

SEQ ID NO: 392782 - protein, 11 aa, Influenza virus
HANNSTEQVDT

SEQ ID NO: 392783 - protein, 11 aa, Influenza virus
ANNSTEQVDTI

SEQ ID NO: 392784 - protein, 11 aa, Influenza virus
DTIMEKNVTVT

SEQ ID NO: 392785 - protein, 11 aa, Influenza virus
PEWSYIVEKDN

SEQ ID NO: 392786 - protein, 11 aa, Influenza virus
YYNGRSSFFRN

SEQ ID NO: 392787 - protein, 11 aa, Influenza virus
SFFRNVVWLIK

SEQ ID NO: 392788 - protein, 11 aa, Influenza virus
FFRNVVWLIKK

SEQ ID NO: 392789 - protein, 11 aa, Influenza virus
FESNGNFIAPE

SEQ ID NO: 392790 - protein, 11 aa, Influenza virus
ESNGNFIAPEY

SEQ ID NO: 392791 - protein, 11 aa, Influenza virus
SNGNFIAPEYA

SEQ ID NO: 392792 - protein, 11 aa, Influenza virus
NGNFIAPEYAY

SEQ ID NO: 392793 - protein, 11 aa, Influenza virus
GNFIAPEYAYK

SEQ ID NO: 392794 - protein, 11 aa, Influenza virus
NFIAPEYAYKI

SEQ ID NO: 392795 - protein, 11 aa, Influenza virus
YGNCDTKCQTP

SEQ ID NO: 392796 - protein, 11 aa, Influenza virus
RKRKRKTRGLF

SEQ ID NO: 392797 - protein, 11 aa, Influenza virus
KRKRKTRGLFG

SEQ ID NO: 392798 - protein, 11 aa, Influenza virus
RKRKTRGLFGA

SEQ ID NO: 392799 - protein, 11 aa, Influenza virus
KRKTRGLFGAI

SEQ ID NO: 392800 - protein, 11 aa, Influenza virus
EKRRKKRGLFG

SEQ ID NO: 392801 - protein, 11 aa, Influenza virus
KRRKKRGLFGA

SEQ ID NO: 392802 - protein, 11 aa, Influenza virus
RRKKRGLFGAI

SEQ ID NO: 392803 - protein, 11 aa, Influenza virus
RKKRGLFGAIA

SEQ ID NO: 392804 - protein, 11 aa, Influenza virus
ETRGLFGAIAG

SEQ ID NO: 392805 - protein, 11 aa, Influenza virus
TRGLFGAIAGF

SEQ ID NO: 392806 - protein, 11 aa, Influenza virus
RGLFGAIAGFI

SEQ ID NO: 392807 - protein, 11 aa, Influenza virus
GLFGAIAGFIE

SEQ ID NO: 392808 - protein, 11 aa, Influenza virus
LFGAIAGFIEG

SEQ ID NO: 392809 - protein, 11 aa, Influenza virus
FGAIAGFIEGG

SEQ ID NO: 392810 - protein, 11 aa, Influenza virus
GAIAGFIEGGW

SEQ ID NO: 392811 - protein, 11 aa, Influenza virus
AIAGFIEGGWQ

SEQ ID NO: 392812 - protein, 11 aa, Influenza virus
IAGFIEGGWQG

SEQ ID NO: 392813 - protein, 11 aa, Influenza virus
AGFIEGGWQGM

SEQ ID NO: 392814 - protein, 11 aa, Influenza virus
GFIEGGWQGMV

SEQ ID NO: 392815 - protein, 11 aa, Influenza virus
FIEGGWQGMVD

SEQ ID NO: 392816 - protein, 11 aa, Influenza virus
IEGGWQGMVDG

SEQ ID NO: 392817 - protein, 11 aa, Influenza virus
EGGWQGMVDGW

SEQ ID NO: 392818 - protein, 11 aa, Influenza virus
GGWQGMVDGWY

SEQ ID NO: 392819 - protein, 11 aa, Influenza virus
GWQGMVDGWYG

SEQ ID NO: 392820 - protein, 11 aa, Influenza virus
WQGMVDGWYGY

SEQ ID NO: 392821 - protein, 11 aa, Influenza virus
QGMVDGWYGYH

SEQ ID NO: 392822 - protein, 11 aa, Influenza virus
GMVDGWYGYHH

SEQ ID NO: 392823 - protein, 11 aa, Influenza virus
VDGWYGYHHSN

SEQ ID NO: 392824 - protein, 11 aa, Influenza virus
GSGYAADKEST

SEQ ID NO: 392825 - protein, 11 aa, Influenza virus
SGYAADKESTQ

SEQ ID NO: 392826 - protein, 11 aa, Influenza virus
GYAADKESTQK

SEQ ID NO: 392827 - protein, 11 aa, Influenza virus
YAADKESTQKA

SEQ ID NO: 392828 - protein, 11 aa, Influenza virus
VWTYNAELLVL

SEQ ID NO: 392829 - protein, 11 aa, Influenza virus
WTYNAELLVLM

SEQ ID NO: 392830 - protein, 11 aa, Influenza virus
TYNAELLVLME

SEQ ID NO: 392831 - protein, 11 aa, Influenza virus
YNAELLVLMEN

SEQ ID NO: 392832 - protein, 11 aa, Influenza virus
NAELLVLMENE

SEQ ID NO: 392833 - protein, 11 aa, Influenza virus
ELLVLMENERT

SEQ ID NO: 392834 - protein, 11 aa, Influenza virus
LLVLMENERTL

SEQ ID NO: 392835 - protein, 11 aa, Influenza virus
LVLMENERTLD

SEQ ID NO: 392836 - protein, 11 aa, Influenza virus
VLMENERTLDF

SEQ ID NO: 392837 - protein, 11 aa, Influenza virus
LMENERTLDFH

SEQ ID NO: 392838 - protein, 11 aa, Influenza virus
MENERTLDFHD

SEQ ID NO: 392839 - protein, 11 aa, Influenza virus
ENERTLDFHDS

SEQ ID NO: 392840 - protein, 11 aa, Influenza virus
NERTLDFHDSN

SEQ ID NO: 392841 - protein, 11 aa, Influenza virus
ERTLDFHDSNV

SEQ ID NO: 392842 - protein, 11 aa, Influenza virus
RTLDFHDSNVK

SEQ ID NO: 392843 - protein, 11 aa, Influenza virus
TLDFHDSNVKN

SEQ ID NO: 392844 - protein, 11 aa, Influenza virus
LDFHDSNVKNL

SEQ ID NO: 392845 - protein, 11 aa, Influenza virus
DFHDSNVKNLY

SEQ ID NO: 392846 - protein, 11 aa, Influenza virus
FHDSNVKNLYD

SEQ ID NO: 392847 - protein, 11 aa, Influenza virus
HDSNVKNLYDK

SEQ ID NO: 392848 - protein, 11 aa, Influenza virus
DSNVKNLYDKV

SEQ ID NO: 392849 - protein, 11 aa, Influenza virus
SNVKNLYDKVR

SEQ ID NO: 392850 - protein, 11 aa, Influenza virus
DNAKELGNGCF

SEQ ID NO: 392851 - protein, 11 aa, Influenza virus
NAKELGNGCFE

SEQ ID NO: 392852 - protein, 11 aa, Influenza virus
AKELGNGCFEF

SEQ ID NO: 392853 - protein, 11 aa, Influenza virus
KELGNGCFEFY

SEQ ID NO: 392854 - protein, 11 aa, Influenza virus
ELGNGCFEFYH

SEQ ID NO: 392855 - protein, 11 aa, Influenza virus
LGNGCFEFYHK

SEQ ID NO: 392856 - protein, 11 aa, Influenza virus
GNGCFEFYHKC

SEQ ID NO: 392857 - protein, 11 aa, Influenza virus
NGCFEFYHKCD

SEQ ID NO: 392858 - protein, 11 aa, Influenza virus
ECMESVRNGTY

SEQ ID NO: 392859 - protein, 11 aa, Influenza virus
ILSIYSTVASS

SEQ ID NO: 392860 - protein, 11 aa, Influenza virus
LSIYSTVASSL

SEQ ID NO: 392861 - protein, 11 aa, Influenza virus
LAIMIAGLSFW

SEQ ID NO: 392862 - protein, 11 aa, Influenza virus
IAGLSFWMCSN

SEQ ID NO: 392863 - protein, 11 aa, Influenza virus
AGLSFWMCSNG

SEQ ID NO: 392864 - protein, 11 aa, Influenza virus
GLSFWMCSNGS

SEQ ID NO: 392865 - protein, 11 aa, Influenza virus
LSFWMCSNGSL

SEQ ID NO: 392866 - protein, 11 aa, Influenza virus
SFWMCSNGSLQ

SEQ ID NO: 392867 - protein, 11 aa, Influenza virus
FWMCSNGSLQC

SEQ ID NO: 392868 - protein, 11 aa, Influenza virus
WMCSNGSLQCR

SEQ ID NO: 392869 - protein, 11 aa, Influenza virus
MCSNGSLQCRI

SEQ ID NO: 392870 - protein, 11 aa, Influenza virus
CSNGSLQCRIC

SEQ ID NO: 392871 - protein, 11 aa, Influenza virus
SNGSLQCRICI

SEQ ID NO: 392872 - protein, 11 aa, Influenza virus
KPQCQITGFAP

SEQ ID NO: 392873 - protein, 11 aa, Influenza virus
PQCQITGFAPF

SEQ ID NO: 392874 - protein, 11 aa, Influenza virus
ITGFAPFSKDN

SEQ ID NO: 392875 - protein, 11 aa, Influenza virus
TGFAPFSKDNS

SEQ ID NO: 392876 - protein, 11 aa, Influenza virus
GFAPFSKDNSI

SEQ ID NO: 392877 - protein, 11 aa, Influenza virus
FAPFSKDNSIR

SEQ ID NO: 392878 - protein, 11 aa, Influenza virus
APFSKDNSIRL

SEQ ID NO: 392879 - protein, 11 aa, Influenza virus
PFSKDNSIRLS

SEQ ID NO: 392880 - protein, 11 aa, Influenza virus
FSKDNSIRLSA

SEQ ID NO: 392881 - protein, 11 aa, Influenza virus
SKDNSIRLSAG

SEQ ID NO: 392882 - protein, 11 aa, Influenza virus
KDNSIRLSAGG

SEQ ID NO: 392883 - protein, 11 aa, Influenza virus
IWVTREPYVSC

SEQ ID NO: 392884 - protein, 11 aa, Influenza virus
WVTREPYVSCD

SEQ ID NO: 392885 - protein, 11 aa, Influenza virus
KCYQFALGQGT

SEQ ID NO: 392886 - protein, 11 aa, Influenza virus
CYQFALGQGTT

SEQ ID NO: 392887 - protein, 11 aa, Influenza virus
YQFALGQGTTL

SEQ ID NO: 392888 - protein, 11 aa, Influenza virus
QFALGQGTTLD

SEQ ID NO: 392889 - protein, 11 aa, Influenza virus
PHRTLLMNELG

SEQ ID NO: 392890 - protein, 11 aa, Influenza virus
HRTLLMNELGV

SEQ ID NO: 392891 - protein, 11 aa, Influenza virus
RTLLMNELGVP

SEQ ID NO: 392892 - protein, 11 aa, Influenza virus
TLLMNELGVPF

SEQ ID NO: 392893 - protein, 11 aa, Influenza virus
LLMNELGVPFH

SEQ ID NO: 392894 - protein, 11 aa, Influenza virus
LMNELGVPFHL

SEQ ID NO: 392895 - protein, 11 aa, Influenza virus
MNELGVPFHLG

SEQ ID NO: 392896 - protein, 11 aa, Influenza virus
NELGVPFHLGT

SEQ ID NO: 392897 - protein, 11 aa, Influenza virus
ELGVPFHLGTK

SEQ ID NO: 392898 - protein, 11 aa, Influenza virus
LGVPFHLGTKQ

SEQ ID NO: 392899 - protein, 11 aa, Influenza virus
GVPFHLGTKQV

SEQ ID NO: 392900 - protein, 11 aa, Influenza virus
VPFHLGTKQVC

SEQ ID NO: 392901 - protein, 11 aa, Influenza virus
PFHLGTKQVCI

SEQ ID NO: 392902 - protein, 11 aa, Influenza virus
FHLGTKQVCIA

SEQ ID NO: 392903 - protein, 11 aa, Influenza virus
HLGTKQVCIAW

SEQ ID NO: 392904 - protein, 11 aa, Influenza virus
LGTKQVCIAWS

SEQ ID NO: 392905 - protein, 11 aa, Influenza virus
GTKQVCIAWSS

SEQ ID NO: 392906 - protein, 11 aa, Influenza virus
TKQVCIAWSSS

SEQ ID NO: 392907 - protein, 11 aa, Influenza virus
KQVCIAWSSSS

SEQ ID NO: 392908 - protein, 11 aa, Influenza virus
QVCIAWSSSSC

SEQ ID NO: 392909 - protein, 11 aa, Influenza virus
VCIAWSSSSCH

SEQ ID NO: 392910 - protein, 11 aa, Influenza virus
CIAWSSSSCHD

SEQ ID NO: 392911 - protein, 11 aa, Influenza virus
IAWSSSSCHDG

SEQ ID NO: 392912 - protein, 11 aa, Influenza virus
AWSSSSCHDGK

SEQ ID NO: 392913 - protein, 11 aa, Influenza virus
WSSSSCHDGKA

SEQ ID NO: 392914 - protein, 11 aa, Influenza virus
SSSSCHDGKAW

SEQ ID NO: 392915 - protein, 11 aa, Influenza virus
SSSCHDGKAWL

SEQ ID NO: 392916 - protein, 11 aa, Influenza virus
SSCHDGKAWLH

SEQ ID NO: 392917 - protein, 11 aa, Influenza virus
CHDGKAWLHVC

SEQ ID NO: 392918 - protein, 11 aa, Influenza virus
AWLHVCVTGDD

SEQ ID NO: 392919 - protein, 11 aa, Influenza virus
SWSQNILRTQE

SEQ ID NO: 392920 - protein, 11 aa, Influenza virus
WSQNILRTQES

SEQ ID NO: 392921 - protein, 11 aa, Influenza virus
SQNILRTQESE

SEQ ID NO: 392922 - protein, 11 aa, Influenza virus
QNILRTQESEC

SEQ ID NO: 392923 - protein, 11 aa, Influenza virus
NILRTQESECV

SEQ ID NO: 392924 - protein, 11 aa, Influenza virus
ILRTQESECVC

SEQ ID NO: 392925 - protein, 11 aa, Influenza virus
LRTQESECVCI

SEQ ID NO: 392926 - protein, 11 aa, Influenza virus
RTQESECVCIN

SEQ ID NO: 392927 - protein, 11 aa, Influenza virus
CTVVMTDGSAS

SEQ ID NO: 392928 - protein, 11 aa, Influenza virus
GSAQHIEECSC

SEQ ID NO: 392929 - protein, 11 aa, Influenza virus
SAQHIEECSCY

SEQ ID NO: 392930 - protein, 11 aa, Influenza virus
AQHIEECSCYP

SEQ ID NO: 392931 - protein, 11 aa, Influenza virus
SYPNVRCVCRD

SEQ ID NO: 392932 - protein, 11 aa, Influenza virus
VRCVCRDNWKG

SEQ ID NO: 392933 - protein, 11 aa, Influenza virus
RCVCRDNWKGS

SEQ ID NO: 392934 - protein, 11 aa, Influenza virus
CVCRDNWKGSN

SEQ ID NO: 392935 - protein, 11 aa, Influenza virus
VCRDNWKGSNR

SEQ ID NO: 392936 - protein, 11 aa, Influenza virus
CRDNWKGSNRP

SEQ ID NO: 392937 - protein, 11 aa, Influenza virus
RDNWKGSNRPV

SEQ ID NO: 392938 - protein, 11 aa, Influenza virus
KLDINMADYSI

SEQ ID NO: 392939 - protein, 11 aa, Influenza virus
SSYVCSGLVGD

SEQ ID NO: 392940 - protein, 11 aa, Influenza virus
SYVCSGLVGDT

SEQ ID NO: 392941 - protein, 11 aa, Influenza virus
YVCSGLVGDTP

SEQ ID NO: 392942 - protein, 11 aa, Influenza virus
VCSGLVGDTPR

SEQ ID NO: 392943 - protein, 11 aa, Influenza virus
CSGLVGDTPRN

SEQ ID NO: 392944 - protein, 11 aa, Influenza virus
SGLVGDTPRND

SEQ ID NO: 392945 - protein, 11 aa, Influenza virus
GLVGDTPRNDD

SEQ ID NO: 392946 - protein, 11 aa, Influenza virus
LVGDTPRNDDS

SEQ ID NO: 392947 - protein, 11 aa, Influenza virus
SSSNCRDPNNE

SEQ ID NO: 392948 - protein, 11 aa, Influenza virus
GNPGVKGWAFD

SEQ ID NO: 392949 - protein, 11 aa, Influenza virus
SKDSRSGYETF

SEQ ID NO: 392950 - protein, 11 aa, Influenza virus
KDSRSGYETFR

SEQ ID NO: 392951 - protein, 11 aa, Influenza virus
DSRSGYETFRV

SEQ ID NO: 392952 - protein, 11 aa, Influenza virus
SRSGYETFRVI

SEQ ID NO: 392953 - protein, 11 aa, Influenza virus
NWSGYSGIFSV

SEQ ID NO: 392954 - protein, 11 aa, Influenza virus
WSGYSGIFSVE

SEQ ID NO: 392955 - protein, 11 aa, Influenza virus
SCINRCFYVEL

SEQ ID NO: 392956 - protein, 11 aa, Influenza virus
CINRCFYVELI

SEQ ID NO: 392957 - protein, 11 aa, Influenza virus
INRCFYVELIR

SEQ ID NO: 392958 - protein, 11 aa, Influenza virus
NRCFYVELIRG

SEQ ID NO: 392959 - protein, 11 aa, Influenza virus
RCFYVELIRGR

SEQ ID NO: 392960 - protein, 11 aa, Influenza virus
CFYVELIRGRP

SEQ ID NO: 392961 - protein, 11 aa, Influenza virus
FYVELIRGRPQ

SEQ ID NO: 392962 - protein, 11 aa, Influenza virus
YVELIRGRPQE

SEQ ID NO: 392963 - protein, 11 aa, Influenza virus
RVWWTSNSIVV

SEQ ID NO: 392964 - protein, 11 aa, Influenza virus
VWWTSNSIVVF

SEQ ID NO: 392965 - protein, 11 aa, Influenza virus
WWTSNSIVVFC

SEQ ID NO: 392966 - protein, 11 aa, Influenza virus
WTSNSIVVFCG

SEQ ID NO: 392967 - protein, 11 aa, Influenza virus
TSNSIVVFCGT

SEQ ID NO: 392968 - protein, 11 aa, Influenza virus
SNSIVVFCGTS

SEQ ID NO: 392969 - protein, 11 aa, Influenza virus
NSIVVFCGTSG

SEQ ID NO: 392970 - protein, 11 aa, Influenza virus
SIVVFCGTSGT

SEQ ID NO: 392971 - protein, 11 aa, Influenza virus
IVVFCGTSGTY

SEQ ID NO: 392972 - protein, 11 aa, Influenza virus
VVFCGTSGTYG

SEQ ID NO: 392973 - protein, 11 aa, Influenza virus
VFCGTSGTYGT

SEQ ID NO: 392974 - protein, 11 aa, Influenza virus
FCGTSGTYGTG

SEQ ID NO: 392975 - protein, 11 aa, Influenza virus
CGTSGTYGTGS

SEQ ID NO: 392976 - protein, 11 aa, Influenza virus
GTSGTYGTGSW

SEQ ID NO: 392977 - protein, 11 aa, Influenza virus
TSGTYGTGSWP

SEQ ID NO: 392978 - protein, 11 aa, Influenza virus
SGTYGTGSWPD

SEQ ID NO: 392979 - protein, 11 aa, Influenza virus
GTYGTGSWPDG

SEQ ID NO: 392980 - protein, 11 aa, Influenza virus
TYGTGSWPDGA

SEQ ID NO: 392981 - protein, 11 aa, Influenza virus
YGTGSWPDGAN

SEQ ID NO: 392982 - protein, 11 aa, Influenza virus
GTGSWPDGANI

SEQ ID NO: 392983 - protein, 11 aa, Influenza virus
TGSWPDGANIN

SEQ ID NO: 392984 - protein, 11 aa, Influenza virus
GSWPDGANINF

SEQ ID NO: 392985 - protein, 11 aa, Influenza virus
SWPDGANINFM

SEQ ID NO: 392986 - protein, 11 aa, Influenza virus
WPDGANINFMP

SEQ ID NO: 392987 - protein, 11 aa, Influenza virus
KSDKICIGYHA

SEQ ID NO: 392988 - protein, 11 aa, Influenza virus
SDKICIGYHAN

SEQ ID NO: 392989 - protein, 11 aa, Influenza virus
DKICIGYHANN

SEQ ID NO: 392990 - protein, 11 aa, Influenza virus
KICIGYHANNS

SEQ ID NO: 392991 - protein, 11 aa, Influenza virus
ICIGYHANNST

SEQ ID NO: 392992 - protein, 11 aa, Influenza virus
CIGYHANNSTT

SEQ ID NO: 392993 - protein, 11 aa, Influenza virus
IGYHANNSTTQ

SEQ ID NO: 392994 - protein, 11 aa, Influenza virus
GYHANNSTTQV

SEQ ID NO: 392995 - protein, 11 aa, Influenza virus
YHANNSTTQVD

SEQ ID NO: 392996 - protein, 11 aa, Influenza virus
HANNSTTQVDT

SEQ ID NO: 392997 - protein, 11 aa, Influenza virus
ANNSTTQVDTI

SEQ ID NO: 392998 - protein, 11 aa, Influenza virus
VDTILEKNVTV

SEQ ID NO: 392999 - protein, 11 aa, Influenza virus
DTILEKNVTVT

SEQ ID NO: 393000 - protein, 11 aa, Influenza virus
TILEKNVTVTH

SEQ ID NO: 393001 - protein, 11 aa, Influenza virus
ILEKNVTVTHS

SEQ ID NO: 393002 - protein, 11 aa, Influenza virus
LEKNVTVTHSV

SEQ ID NO: 393003 - protein, 11 aa, Influenza virus
EKNVTVTHSVE

SEQ ID NO: 393004 - protein, 11 aa, Influenza virus
KNVTVTHSVEL

SEQ ID NO: 393005 - protein, 11 aa, Influenza virus
NVTVTHSVELL

SEQ ID NO: 393006 - protein, 11 aa, Influenza virus
VTVTHSVELLE

SEQ ID NO: 393007 - protein, 11 aa, Influenza virus
TVTHSVELLEN

SEQ ID NO: 393008 - protein, 11 aa, Influenza virus
LKPGETLNVES

SEQ ID NO: 393009 - protein, 11 aa, Influenza virus
KPGETLNVESN

SEQ ID NO: 393010 - protein, 11 aa, Influenza virus
PGETLNVESNG

SEQ ID NO: 393011 - protein, 11 aa, Influenza virus
GETLNVESNGN

SEQ ID NO: 393012 - protein, 11 aa, Influenza virus
ETLNVESNGNL

SEQ ID NO: 393013 - protein, 11 aa, Influenza virus
TLNVESNGNLI

SEQ ID NO: 393014 - protein, 11 aa, Influenza virus
LNVESNGNLIA

SEQ ID NO: 393015 - protein, 11 aa, Influenza virus
NVESNGNLIAP

SEQ ID NO: 393016 - protein, 11 aa, Influenza virus
VESNGNLIAPW

SEQ ID NO: 393017 - protein, 11 aa, Influenza virus
ESNGNLIAPWY

SEQ ID NO: 393018 - protein, 11 aa, Influenza virus
SNGNLIAPWYA

SEQ ID NO: 393019 - protein, 11 aa, Influenza virus
NGNLIAPWYAY

SEQ ID NO: 393020 - protein, 11 aa, Influenza virus
GNLIAPWYAYK

SEQ ID NO: 393021 - protein, 11 aa, Influenza virus
NNNKGAVFKSN

SEQ ID NO: 393022 - protein, 11 aa, Influenza virus
NKTFQNVSPLW

SEQ ID NO: 393023 - protein, 11 aa, Influenza virus
SLRLATGLRNV

SEQ ID NO: 393024 - protein, 11 aa, Influenza virus
LRLATGLRNVP

SEQ ID NO: 393025 - protein, 11 aa, Influenza virus
RLATGLRNVPQ

SEQ ID NO: 393026 - protein, 11 aa, Influenza virus
TRGLFGAIAGF

SEQ ID NO: 393027 - protein, 11 aa, Influenza virus
RGLFGAIAGFI

SEQ ID NO: 393028 - protein, 11 aa, Influenza virus
GLFGAIAGFIE

SEQ ID NO: 393029 - protein, 11 aa, Influenza virus
LFGAIAGFIEG

SEQ ID NO: 393030 - protein, 11 aa, Influenza virus
FGAIAGFIEGG

SEQ ID NO: 393031 - protein, 11 aa, Influenza virus
GAIAGFIEGGW

SEQ ID NO: 393032 - protein, 11 aa, Influenza virus
AIAGFIEGGWT

SEQ ID NO: 393033 - protein, 11 aa, Influenza virus
IAGFIEGGWTG

SEQ ID NO: 393034 - protein, 11 aa, Influenza virus
AGFIEGGWTGM

SEQ ID NO: 393035 - protein, 11 aa, Influenza virus
GFIEGGWTGMI

SEQ ID NO: 393036 - protein, 11 aa, Influenza virus
FIEGGWTGMID

SEQ ID NO: 393037 - protein, 11 aa, Influenza virus
IEGGWTGMIDG

SEQ ID NO: 393038 - protein, 11 aa, Influenza virus
EGGWTGMIDGW

SEQ ID NO: 393039 - protein, 11 aa, Influenza virus
GGWTGMIDGWY

SEQ ID NO: 393040 - protein, 11 aa, Influenza virus
GWTGMIDGWYG

SEQ ID NO: 393041 - protein, 11 aa, Influenza virus
WTGMIDGWYGY

SEQ ID NO: 393042 - protein, 11 aa, Influenza virus
TGMIDGWYGYH

SEQ ID NO: 393043 - protein, 11 aa, Influenza virus
GMIDGWYGYHH

SEQ ID NO: 393044 - protein, 11 aa, Influenza virus
MIDGWYGYHHE

SEQ ID NO: 393045 - protein, 11 aa, Influenza virus
IDGWYGYHHEN

SEQ ID NO: 393046 - protein, 11 aa, Influenza virus
DGWYGYHHENS

SEQ ID NO: 393047 - protein, 11 aa, Influenza virus
GWYGYHHENSQ

SEQ ID NO: 393048 - protein, 11 aa, Influenza virus
WYGYHHENSQG

SEQ ID NO: 393049 - protein, 11 aa, Influenza virus
YGYHHENSQGS

SEQ ID NO: 393050 - protein, 11 aa, Influenza virus
GYHHENSQGSG

SEQ ID NO: 393051 - protein, 11 aa, Influenza virus
YHHENSQGSGY

SEQ ID NO: 393052 - protein, 11 aa, Influenza virus
HHENSQGSGYA

SEQ ID NO: 393053 - protein, 11 aa, Influenza virus
HENSQGSGYAA

SEQ ID NO: 393054 - protein, 11 aa, Influenza virus
ENSQGSGYAAD

SEQ ID NO: 393055 - protein, 11 aa, Influenza virus
NSQGSGYAADK

SEQ ID NO: 393056 - protein, 11 aa, Influenza virus
SQGSGYAADKE

SEQ ID NO: 393057 - protein, 11 aa, Influenza virus
QGSGYAADKES

SEQ ID NO: 393058 - protein, 11 aa, Influenza virus
GSGYAADKEST

SEQ ID NO: 393059 - protein, 11 aa, Influenza virus
SGYAADKESTQ

SEQ ID NO: 393060 - protein, 11 aa, Influenza virus
GYAADKESTQK

SEQ ID NO: 393061 - protein, 11 aa, Influenza virus
YAADKESTQKA

SEQ ID NO: 393062 - protein, 11 aa, Influenza virus
DGFLDVWTYNA

SEQ ID NO: 393063 - protein, 11 aa, Influenza virus
GFLDVWTYNAE

SEQ ID NO: 393064 - protein, 11 aa, Influenza virus
FLDVWTYNAEL

SEQ ID NO: 393065 - protein, 11 aa, Influenza virus
LDVWTYNAELL

SEQ ID NO: 393066 - protein, 11 aa, Influenza virus
DVWTYNAELLV

SEQ ID NO: 393067 - protein, 11 aa, Influenza virus
VWTYNAELLVL

SEQ ID NO: 393068 - protein, 11 aa, Influenza virus
WTYNAELLVLL

SEQ ID NO: 393069 - protein, 11 aa, Influenza virus
TYNAELLVLLE

SEQ ID NO: 393070 - protein, 11 aa, Influenza virus
YNAELLVLLEN

SEQ ID NO: 393071 - protein, 11 aa, Influenza virus
NAELLVLLENE

SEQ ID NO: 393072 - protein, 11 aa, Influenza virus
AELLVLLENER

SEQ ID NO: 393073 - protein, 11 aa, Influenza virus
ELLVLLENERT

SEQ ID NO: 393074 - protein, 11 aa, Influenza virus
LLVLLENERTL

SEQ ID NO: 393075 - protein, 11 aa, Influenza virus
LVLLENERTLD

SEQ ID NO: 393076 - protein, 11 aa, Influenza virus
ENERTLDLHDA

SEQ ID NO: 393077 - protein, 11 aa, Influenza virus
NERTLDLHDAN

SEQ ID NO: 393078 - protein, 11 aa, Influenza virus
ERTLDLHDANV

SEQ ID NO: 393079 - protein, 11 aa, Influenza virus
LRDNANDLGNG

SEQ ID NO: 393080 - protein, 11 aa, Influenza virus
RDNANDLGNGC

SEQ ID NO: 393081 - protein, 11 aa, Influenza virus
DNANDLGNGCF

SEQ ID NO: 393082 - protein, 11 aa, Influenza virus
NANDLGNGCFE

SEQ ID NO: 393083 - protein, 11 aa, Influenza virus
ANDLGNGCFEF

SEQ ID NO: 393084 - protein, 11 aa, Influenza virus
NDLGNGCFEFW

SEQ ID NO: 393085 - protein, 11 aa, Influenza virus
DLGNGCFEFWH

SEQ ID NO: 393086 - protein, 11 aa, Influenza virus
LGNGCFEFWHK

SEQ ID NO: 393087 - protein, 11 aa, Influenza virus
GNGCFEFWHKC

SEQ ID NO: 393088 - protein, 11 aa, Influenza virus
NGCFEFWHKCD

SEQ ID NO: 393089 - protein, 11 aa, Influenza virus
GCFEFWHKCDN

SEQ ID NO: 393090 - protein, 11 aa, Influenza virus
CFEFWHKCDNE

SEQ ID NO: 393091 - protein, 11 aa, Influenza virus
FEFWHKCDNEC

SEQ ID NO: 393092 - protein, 11 aa, Influenza virus
GVYQILAIYST

SEQ ID NO: 393093 - protein, 11 aa, Influenza virus
VYQILAIYSTV

SEQ ID NO: 393094 - protein, 11 aa, Influenza virus
YQILAIYSTVS

SEQ ID NO: 393095 - protein, 11 aa, Influenza virus
QILAIYSTVSS

SEQ ID NO: 393096 - protein, 11 aa, Influenza virus
ILAIYSTVSSS

SEQ ID NO: 393097 - protein, 11 aa, Influenza virus
LAIYSTVSSSL

SEQ ID NO: 393098 - protein, 11 aa, Influenza virus
AIYSTVSSSLV

SEQ ID NO: 393099 - protein, 11 aa, Influenza virus
IYSTVSSSLVL

SEQ ID NO: 393100 - protein, 11 aa, Influenza virus
YSTVSSSLVLV

SEQ ID NO: 393101 - protein, 11 aa, Influenza virus
STVSSSLVLVG

SEQ ID NO: 393102 - protein, 11 aa, Influenza virus
TVSSSLVLVGL

SEQ ID NO: 393103 - protein, 11 aa, Influenza virus
VSSSLVLVGLI

SEQ ID NO: 393104 - protein, 11 aa, Influenza virus
WMCSNGSMQCR

SEQ ID NO: 393105 - protein, 11 aa, Influenza virus
NGSMQCRICIG

SEQ ID NO: 393106 - protein, 11 aa, Influenza virus
GSMQCRICIGS

SEQ ID NO: 393107 - protein, 11 aa, Influenza virus
KSRGYKMNTQI

SEQ ID NO: 393108 - protein, 11 aa, Influenza virus
SRGYKMNTQIL

SEQ ID NO: 393109 - protein, 11 aa, Influenza virus
GCDHSDNADKI

SEQ ID NO: 393110 - protein, 11 aa, Influenza virus
CDHSDNADKIC

SEQ ID NO: 393111 - protein, 11 aa, Influenza virus
DHSDNADKICL

SEQ ID NO: 393112 - protein, 11 aa, Influenza virus
HSDNADKICLG

SEQ ID NO: 393113 - protein, 11 aa, Influenza virus
SDNADKICLGH

SEQ ID NO: 393114 - protein, 11 aa, Influenza virus
DNADKICLGHH

SEQ ID NO: 393115 - protein, 11 aa, Influenza virus
GDKICLGHHAV

SEQ ID NO: 393116 - protein, 11 aa, Influenza virus
LTERGIEVVNA

SEQ ID NO: 393117 - protein, 11 aa, Influenza virus
TERGIEVVNAT

SEQ ID NO: 393118 - protein, 11 aa, Influenza virus
ERGIEVVNATE

SEQ ID NO: 393119 - protein, 11 aa, Influenza virus
RGIEVVNATET

SEQ ID NO: 393120 - protein, 11 aa, Influenza virus
GIEVVNATETV

SEQ ID NO: 393121 - protein, 11 aa, Influenza virus
IEVVNATETVE

SEQ ID NO: 393122 - protein, 11 aa, Influenza virus
EVVNATETVET

SEQ ID NO: 393123 - protein, 11 aa, Influenza virus
GPPQCDQFLEF

SEQ ID NO: 393124 - protein, 11 aa, Influenza virus
SSSFYAEMKWL

SEQ ID NO: 393125 - protein, 11 aa, Influenza virus
SSFYAEMKWLL

SEQ ID NO: 393126 - protein, 11 aa, Influenza virus
SFYAEMKWLLS

SEQ ID NO: 393127 - protein, 11 aa, Influenza virus
FYAEMKWLLSN

SEQ ID NO: 393128 - protein, 11 aa, Influenza virus
FNGAFIAPDRA

SEQ ID NO: 393129 - protein, 11 aa, Influenza virus
NGAFIAPDRAS

SEQ ID NO: 393130 - protein, 11 aa, Influenza virus
GAFIAPDRASF

SEQ ID NO: 393131 - protein, 11 aa, Influenza virus
SLLLATGMRNV

SEQ ID NO: 393132 - protein, 11 aa, Influenza virus
LLLATGMRNVP

SEQ ID NO: 393133 - protein, 11 aa, Influenza virus
LLATGMRNVPE

SEQ ID NO: 393134 - protein, 11 aa, Influenza virus
THKQLTHHMRK

SEQ ID NO: 393135 - protein, 11 aa, Influenza virus
HKQLTHHMRKK

SEQ ID NO: 393136 - protein, 11 aa, Influenza virus
KQLTHHMRKKR

SEQ ID NO: 393137 - protein, 11 aa, Influenza virus
QLTHHMRKKRG

SEQ ID NO: 393138 - protein, 11 aa, Influenza virus
LTHHMRKKRGL

SEQ ID NO: 393139 - protein, 11 aa, Influenza virus
THHMRKKRGLF

SEQ ID NO: 393140 - protein, 11 aa, Influenza virus
HHMRKKRGLFG

SEQ ID NO: 393141 - protein, 11 aa, Influenza virus
HMRKKRGLFGA

SEQ ID NO: 393142 - protein, 11 aa, Influenza virus
MRKKRGLFGAI

SEQ ID NO: 393143 - protein, 11 aa, Influenza virus
RKKRGLFGAIA

SEQ ID NO: 393144 - protein, 11 aa, Influenza virus
RMTRGLFGAIA

SEQ ID NO: 393145 - protein, 11 aa, Influenza virus
MTRGLFGAIAG

SEQ ID NO: 393146 - protein, 11 aa, Influenza virus
PRGLFGAIAGF

SEQ ID NO: 393147 - protein, 11 aa, Influenza virus
TKPRPRRGLFG

SEQ ID NO: 393148 - protein, 11 aa, Influenza virus
KPRPRRGLFGA

SEQ ID NO: 393149 - protein, 11 aa, Influenza virus
PRPRRGLFGAI

SEQ ID NO: 393150 - protein, 11 aa, Influenza virus
RPRRGLFGAIA

SEQ ID NO: 393151 - protein, 11 aa, Influenza virus
PRRGLFGAIAG

SEQ ID NO: 393152 - protein, 11 aa, Influenza virus
RRGLFGAIAGF

SEQ ID NO: 393153 - protein, 11 aa, Influenza virus
RGLFGAIAGFI

SEQ ID NO: 393154 - protein, 11 aa, Influenza virus
GLFGAIAGFIE

SEQ ID NO: 393155 - protein, 11 aa, Influenza virus
LFGAIAGFIEN

SEQ ID NO: 393156 - protein, 11 aa, Influenza virus
FGAIAGFIENG

SEQ ID NO: 393157 - protein, 11 aa, Influenza virus
GAIAGFIENGW

SEQ ID NO: 393158 - protein, 11 aa, Influenza virus
AIAGFIENGWE

SEQ ID NO: 393159 - protein, 11 aa, Influenza virus
IAGFIENGWEG

SEQ ID NO: 393160 - protein, 11 aa, Influenza virus
AGFIENGWEGL

SEQ ID NO: 393161 - protein, 11 aa, Influenza virus
GFIENGWEGLI

SEQ ID NO: 393162 - protein, 11 aa, Influenza virus
FIENGWEGLID

SEQ ID NO: 393163 - protein, 11 aa, Influenza virus
IENGWEGLIDG

SEQ ID NO: 393164 - protein, 11 aa, Influenza virus
ENGWEGLIDGW

SEQ ID NO: 393165 - protein, 11 aa, Influenza virus
NGWEGLIDGWY

SEQ ID NO: 393166 - protein, 11 aa, Influenza virus
GWEGLIDGWYG

SEQ ID NO: 393167 - protein, 11 aa, Influenza virus
WEGLIDGWYGF

SEQ ID NO: 393168 - protein, 11 aa, Influenza virus
EGLIDGWYGFR

SEQ ID NO: 393169 - protein, 11 aa, Influenza virus
GLIDGWYGFRH

SEQ ID NO: 393170 - protein, 11 aa, Influenza virus
LIDGWYGFRHQ

SEQ ID NO: 393171 - protein, 11 aa, Influenza virus
IDGWYGFRHQN

SEQ ID NO: 393172 - protein, 11 aa, Influenza virus
GWYGFRHQNAQ

SEQ ID NO: 393173 - protein, 11 aa, Influenza virus
WYGFRHQNAQG

SEQ ID NO: 393174 - protein, 11 aa, Influenza virus
YGFRHQNAQGE

SEQ ID NO: 393175 - protein, 11 aa, Influenza virus
GFRHQNAQGEG

SEQ ID NO: 393176 - protein, 11 aa, Influenza virus
RHQNAQGEGTA

SEQ ID NO: 393177 - protein, 11 aa, Influenza virus
HQNAQGEGTAA

SEQ ID NO: 393178 - protein, 11 aa, Influenza virus
QNAQGEGTAAD

SEQ ID NO: 393179 - protein, 11 aa, Influenza virus
NAQGEGTAADY

SEQ ID NO: 393180 - protein, 11 aa, Influenza virus
AQGEGTAADYK

SEQ ID NO: 393181 - protein, 11 aa, Influenza virus
QGEGTAADYKS

SEQ ID NO: 393182 - protein, 11 aa, Influenza virus
GEGTAADYKST

SEQ ID NO: 393183 - protein, 11 aa, Influenza virus
EGTAADYKSTQ

SEQ ID NO: 393184 - protein, 11 aa, Influenza virus
GTAADYKSTQS

SEQ ID NO: 393185 - protein, 11 aa, Influenza virus
TAADYKSTQSA

SEQ ID NO: 393186 - protein, 11 aa, Influenza virus
AADYKSTQSAI

SEQ ID NO: 393187 - protein, 11 aa, Influenza virus
ADYKSTQSAID

SEQ ID NO: 393188 - protein, 11 aa, Influenza virus
DYKSTQSAIDQ

SEQ ID NO: 393189 - protein, 11 aa, Influenza virus
YKSTQSAIDQI

SEQ ID NO: 393190 - protein, 11 aa, Influenza virus
KSTQSAIDQIT

SEQ ID NO: 393191 - protein, 11 aa, Influenza virus
STQSAIDQITG

SEQ ID NO: 393192 - protein, 11 aa, Influenza virus
TQSAIDQITGK

SEQ ID NO: 393193 - protein, 11 aa, Influenza virus
QSAIDQITGKL

SEQ ID NO: 393194 - protein, 11 aa, Influenza virus
SAIDQITGKLN

SEQ ID NO: 393195 - protein, 11 aa, Influenza virus
AIDQITGKLNR

SEQ ID NO: 393196 - protein, 11 aa, Influenza virus
DQITGKLNRLI

SEQ ID NO: 393197 - protein, 11 aa, Influenza virus
EQQIGNVINWT

SEQ ID NO: 393198 - protein, 11 aa, Influenza virus
QIGNVINWTRD

SEQ ID NO: 393199 - protein, 11 aa, Influenza virus
IGNVINWTRDS

SEQ ID NO: 393200 - protein, 11 aa, Influenza virus
LLVAMENQHTI

SEQ ID NO: 393201 - protein, 11 aa, Influenza virus
LVAMENQHTID

SEQ ID NO: 393202 - protein, 11 aa, Influenza virus
VAMENQHTIDL

SEQ ID NO: 393203 - protein, 11 aa, Influenza virus
AMENQHTIDLA

SEQ ID NO: 393204 - protein, 11 aa, Influenza virus
ENQHTIDLADS

SEQ ID NO: 393205 - protein, 11 aa, Influenza virus
NQHTIDLADSE

SEQ ID NO: 393206 - protein, 11 aa, Influenza virus
QHTIDLADSEM

SEQ ID NO: 393207 - protein, 11 aa, Influenza virus
VRKQLRENAEE

SEQ ID NO: 393208 - protein, 11 aa, Influenza virus
RKQLRENAEED

SEQ ID NO: 393209 - protein, 11 aa, Influenza virus
KQLRENAEEDG

SEQ ID NO: 393210 - protein, 11 aa, Influenza virus
QLRENAEEDGT

SEQ ID NO: 393211 - protein, 11 aa, Influenza virus
LRENAEEDGTG

SEQ ID NO: 393212 - protein, 11 aa, Influenza virus
RENAEEDGTGC

SEQ ID NO: 393213 - protein, 11 aa, Influenza virus
ENAEEDGTGCF

SEQ ID NO: 393214 - protein, 11 aa, Influenza virus
NAEEDGTGCFE

SEQ ID NO: 393215 - protein, 11 aa, Influenza virus
AEEDGTGCFEI

SEQ ID NO: 393216 - protein, 11 aa, Influenza virus
EEDGTGCFEIF

SEQ ID NO: 393217 - protein, 11 aa, Influenza virus
EDGTGCFEIFH

SEQ ID NO: 393218 - protein, 11 aa, Influenza virus
DGTGCFEIFHK

SEQ ID NO: 393219 - protein, 11 aa, Influenza virus
GTGCFEIFHKC

SEQ ID NO: 393220 - protein, 11 aa, Influenza virus
TGCFEIFHKCD

SEQ ID NO: 393221 - protein, 11 aa, Influenza virus
GCFEIFHKCDD

SEQ ID NO: 393222 - protein, 11 aa, Influenza virus
CMESIRNNTYD

SEQ ID NO: 393223 - protein, 11 aa, Influenza virus
MESIRNNTYDH

SEQ ID NO: 393224 - protein, 11 aa, Influenza virus
SGYKDIILWFS

SEQ ID NO: 393225 - protein, 11 aa, Influenza virus
GYKDIILWFSF

SEQ ID NO: 393226 - protein, 11 aa, Influenza virus
YKDIILWFSFG

SEQ ID NO: 393227 - protein, 11 aa, Influenza virus
KDIILWFSFGA

SEQ ID NO: 393228 - protein, 11 aa, Influenza virus
DIILWFSFGAS

SEQ ID NO: 393229 - protein, 11 aa, Influenza virus
IILWFSFGASC

SEQ ID NO: 393230 - protein, 11 aa, Influenza virus
ILWFSFGASCF

SEQ ID NO: 393231 - protein, 11 aa, Influenza virus
LWFSFGASCFL

SEQ ID NO: 393232 - protein, 11 aa, Influenza virus
WFSFGASCFLL

SEQ ID NO: 393233 - protein, 11 aa, Influenza virus
KNGNMRCTICI

SEQ ID NO: 393234 - protein, 11 aa, Influenza virus
NETCSALFVYS

SEQ ID NO: 393235 - protein, 11 aa, Influenza virus
ETCSALFVYSL

SEQ ID NO: 393236 - protein, 11 aa, Influenza virus
TCSALFVYSLR

SEQ ID NO: 393237 - protein, 11 aa, Influenza virus
CSALFVYSLRK

SEQ ID NO: 393238 - protein, 11 aa, Influenza virus
SKSRGYKMNTQ

SEQ ID NO: 393239 - protein, 11 aa, Influenza virus
KSRGYKMNTQI

SEQ ID NO: 393240 - protein, 11 aa, Influenza virus
SRGYKMNTQIL

SEQ ID NO: 393241 - protein, 11 aa, Influenza virus
RGYKMNTQILI

SEQ ID NO: 393242 - protein, 11 aa, Influenza virus
GYKMNTQILIL

SEQ ID NO: 393243 - protein, 11 aa, Influenza virus
YKMNTQILILA

SEQ ID NO: 393244 - protein, 11 aa, Influenza virus
KMNTQILILAL

SEQ ID NO: 393245 - protein, 11 aa, Influenza virus
AKGDKICLGHH

SEQ ID NO: 393246 - protein, 11 aa, Influenza virus
KGDKICLGHHA

SEQ ID NO: 393247 - protein, 11 aa, Influenza virus
GDKICLGHHAV

SEQ ID NO: 393248 - protein, 11 aa, Influenza virus
DKICLGHHAVA

SEQ ID NO: 393249 - protein, 11 aa, Influenza virus
KICLGHHAVAN

SEQ ID NO: 393250 - protein, 11 aa, Influenza virus
ICLGHHAVANG

SEQ ID NO: 393251 - protein, 11 aa, Influenza virus
CLGHHAVANGT

SEQ ID NO: 393252 - protein, 11 aa, Influenza virus
LGHHAVANGTK

SEQ ID NO: 393253 - protein, 11 aa, Influenza virus
GHHAVANGTKV

SEQ ID NO: 393254 - protein, 11 aa, Influenza virus
HHAVANGTKVN

SEQ ID NO: 393255 - protein, 11 aa, Influenza virus
HAVANGTKVNT

SEQ ID NO: 393256 - protein, 11 aa, Influenza virus
AVANGTKVNTL

SEQ ID NO: 393257 - protein, 11 aa, Influenza virus
VANGTKVNTLT

SEQ ID NO: 393258 - protein, 11 aa, Influenza virus
ANGTKVNTLTE

SEQ ID NO: 393259 - protein, 11 aa, Influenza virus
NGTKVNTLTER

SEQ ID NO: 393260 - protein, 11 aa, Influenza virus
GTKVNTLTERG

SEQ ID NO: 393261 - protein, 11 aa, Influenza virus
TKVNTLTERGI

SEQ ID NO: 393262 - protein, 11 aa, Influenza virus
KVNTLTERGIE

SEQ ID NO: 393263 - protein, 11 aa, Influenza virus
VNTLTERGIEV

SEQ ID NO: 393264 - protein, 11 aa, Influenza virus
NTLTERGIEVV

SEQ ID NO: 393265 - protein, 11 aa, Influenza virus
TLTERGIEVVN

SEQ ID NO: 393266 - protein, 11 aa, Influenza virus
LTERGIEVVNA

SEQ ID NO: 393267 - protein, 11 aa, Influenza virus
TERGIEVVNAT

SEQ ID NO: 393268 - protein, 11 aa, Influenza virus
ERGIEVVNATE

SEQ ID NO: 393269 - protein, 11 aa, Influenza virus
RGIEVVNATET

SEQ ID NO: 393270 - protein, 11 aa, Influenza virus
GIEVVNATETV

SEQ ID NO: 393271 - protein, 11 aa, Influenza virus
IEVVNATETVE

SEQ ID NO: 393272 - protein, 11 aa, Influenza virus
EVVNATETVET

SEQ ID NO: 393273 - protein, 11 aa, Influenza virus
VVNATETVETA

SEQ ID NO: 393274 - protein, 11 aa, Influenza virus
CGLLGTLIGPP

SEQ ID NO: 393275 - protein, 11 aa, Influenza virus
IGPPQCDQFLE

SEQ ID NO: 393276 - protein, 11 aa, Influenza virus
GPPQCDQFLEF

SEQ ID NO: 393277 - protein, 11 aa, Influenza virus
DLIIERREGTD

SEQ ID NO: 393278 - protein, 11 aa, Influenza virus
LRQILRRSGGI

SEQ ID NO: 393279 - protein, 11 aa, Influenza virus
GFTYSGIRTNG

SEQ ID NO: 393280 - protein, 11 aa, Influenza virus
RSGSSFYAEMK

SEQ ID NO: 393281 - protein, 11 aa, Influenza virus
SGSSFYAEMKW

SEQ ID NO: 393282 - protein, 11 aa, Influenza virus
GSSFYAEMKWL

SEQ ID NO: 393283 - protein, 11 aa, Influenza virus
SSFYAEMKWLL

SEQ ID NO: 393284 - protein, 11 aa, Influenza virus
SFYAEMKWLLS

SEQ ID NO: 393285 - protein, 11 aa, Influenza virus
FYAEMKWLLSN

SEQ ID NO: 393286 - protein, 11 aa, Influenza virus
YAEMKWLLSNS

SEQ ID NO: 393287 - protein, 11 aa, Influenza virus
AEMKWLLSNSD

SEQ ID NO: 393288 - protein, 11 aa, Influenza virus
EMKWLLSNSDN

SEQ ID NO: 393289 - protein, 11 aa, Influenza virus
EQTKLYGSGNK

SEQ ID NO: 393290 - protein, 11 aa, Influenza virus
QTKLYGSGNKL

SEQ ID NO: 393291 - protein, 11 aa, Influenza virus
TKLYGSGNKLI

SEQ ID NO: 393292 - protein, 11 aa, Influenza virus
ARRIDFHWLLL

SEQ ID NO: 393293 - protein, 11 aa, Influenza virus
RRIDFHWLLLD

SEQ ID NO: 393294 - protein, 11 aa, Influenza virus
PQVNGQSGRID

SEQ ID NO: 393295 - protein, 11 aa, Influenza virus
QVNGQSGRIDF

SEQ ID NO: 393296 - protein, 11 aa, Influenza virus
VNGQSGRIDFH

SEQ ID NO: 393297 - protein, 11 aa, Influenza virus
NGQSGRIDFHW

SEQ ID NO: 393298 - protein, 11 aa, Influenza virus
GQSGRIDFHWL

SEQ ID NO: 393299 - protein, 11 aa, Influenza virus
QSGRIDFHWLL

SEQ ID NO: 393300 - protein, 11 aa, Influenza virus
SGRIDFHWLLL

SEQ ID NO: 393301 - protein, 11 aa, Influenza virus
GRIDFHWLLLD

SEQ ID NO: 393302 - protein, 11 aa, Influenza virus
NDTVTFTFNGA

SEQ ID NO: 393303 - protein, 11 aa, Influenza virus
DTVTFTFNGAF

SEQ ID NO: 393304 - protein, 11 aa, Influenza virus
TVTFTFNGAFI

SEQ ID NO: 393305 - protein, 11 aa, Influenza virus
VTFTFNGAFIA

SEQ ID NO: 393306 - protein, 11 aa, Influenza virus
TFTFNGAFIAP

SEQ ID NO: 393307 - protein, 11 aa, Influenza virus
FTFNGAFIAPD

SEQ ID NO: 393308 - protein, 11 aa, Influenza virus
TFNGAFIAPDR

SEQ ID NO: 393309 - protein, 11 aa, Influenza virus
FNGAFIAPDRA

SEQ ID NO: 393310 - protein, 11 aa, Influenza virus
NGAFIAPDRAS

SEQ ID NO: 393311 - protein, 11 aa, Influenza virus
GAFIAPDRASF

SEQ ID NO: 393312 - protein, 11 aa, Influenza virus
AFIAPDRASFF

SEQ ID NO: 393313 - protein, 11 aa, Influenza virus
FIAPDRASFFR

SEQ ID NO: 393314 - protein, 11 aa, Influenza virus
IAPDRASFFRG

SEQ ID NO: 393315 - protein, 11 aa, Influenza virus
GGTIVSSLPFQ

SEQ ID NO: 393316 - protein, 11 aa, Influenza virus
GTIVSSLPFQN

SEQ ID NO: 393317 - protein, 11 aa, Influenza virus
TIVSSLPFQNI

SEQ ID NO: 393318 - protein, 11 aa, Influenza virus
IVSSLPFQNIN

SEQ ID NO: 393319 - protein, 11 aa, Influenza virus
TVGKCPRYVKQ

SEQ ID NO: 393320 - protein, 11 aa, Influenza virus
VKQKSLLLATG

SEQ ID NO: 393321 - protein, 11 aa, Influenza virus
KQKSLLLATGM

SEQ ID NO: 393322 - protein, 11 aa, Influenza virus
QKSLLLATGMR

SEQ ID NO: 393323 - protein, 11 aa, Influenza virus
KSLLLATGMRN

SEQ ID NO: 393324 - protein, 11 aa, Influenza virus
SLLLATGMRNV

SEQ ID NO: 393325 - protein, 11 aa, Influenza virus
LLLATGMRNVP

SEQ ID NO: 393326 - protein, 11 aa, Influenza virus
LLATGMRNVPE

SEQ ID NO: 393327 - protein, 11 aa, Influenza virus
LATGMRNVPEK

SEQ ID NO: 393328 - protein, 11 aa, Influenza virus
ATGMRNVPEKP

SEQ ID NO: 393329 - protein, 11 aa, Influenza virus
TGMRNVPEKPK

SEQ ID NO: 393330 - protein, 11 aa, Influenza virus
PKPRGLFGAIA

SEQ ID NO: 393331 - protein, 11 aa, Influenza virus
KPRGLFGAIAG

SEQ ID NO: 393332 - protein, 11 aa, Influenza virus
PRGLFGAIAGF

SEQ ID NO: 393333 - protein, 11 aa, Influenza virus
RGLFGAIAGFI

SEQ ID NO: 393334 - protein, 11 aa, Influenza virus
GLFGAIAGFIE

SEQ ID NO: 393335 - protein, 11 aa, Influenza virus
LFGAIAGFIEN

SEQ ID NO: 393336 - protein, 11 aa, Influenza virus
FGAIAGFIENG

SEQ ID NO: 393337 - protein, 11 aa, Influenza virus
GAIAGFIENGW

SEQ ID NO: 393338 - protein, 11 aa, Influenza virus
AIAGFIENGWE

SEQ ID NO: 393339 - protein, 11 aa, Influenza virus
IAGFIENGWEG

SEQ ID NO: 393340 - protein, 11 aa, Influenza virus
AGFIENGWEGL

SEQ ID NO: 393341 - protein, 11 aa, Influenza virus
GFIENGWEGLI

SEQ ID NO: 393342 - protein, 11 aa, Influenza virus
FIENGWEGLIN

SEQ ID NO: 393343 - protein, 11 aa, Influenza virus
IENGWEGLING

SEQ ID NO: 393344 - protein, 11 aa, Influenza virus
ENGWEGLINGW

SEQ ID NO: 393345 - protein, 11 aa, Influenza virus
NGWEGLINGWY

SEQ ID NO: 393346 - protein, 11 aa, Influenza virus
GWEGLINGWYG

SEQ ID NO: 393347 - protein, 11 aa, Influenza virus
WEGLINGWYGF

SEQ ID NO: 393348 - protein, 11 aa, Influenza virus
EGLINGWYGFR

SEQ ID NO: 393349 - protein, 11 aa, Influenza virus
GLINGWYGFRH

SEQ ID NO: 393350 - protein, 11 aa, Influenza virus
LINGWYGFRHQ

SEQ ID NO: 393351 - protein, 11 aa, Influenza virus
INGWYGFRHQN

SEQ ID NO: 393352 - protein, 11 aa, Influenza virus
NGWYGFRHQNA

SEQ ID NO: 393353 - protein, 11 aa, Influenza virus
GWYGFRHQNAQ

SEQ ID NO: 393354 - protein, 11 aa, Influenza virus
WYGFRHQNAQG

SEQ ID NO: 393355 - protein, 11 aa, Influenza virus
YGFRHQNAQGE

SEQ ID NO: 393356 - protein, 11 aa, Influenza virus
GFRHQNAQGEG

SEQ ID NO: 393357 - protein, 11 aa, Influenza virus
FRHQNAQGEGT

SEQ ID NO: 393358 - protein, 11 aa, Influenza virus
RHQNAQGEGTA

SEQ ID NO: 393359 - protein, 11 aa, Influenza virus
HQNAQGEGTAA

SEQ ID NO: 393360 - protein, 11 aa, Influenza virus
QNAQGEGTAAD

SEQ ID NO: 393361 - protein, 11 aa, Influenza virus
NAQGEGTAADY

SEQ ID NO: 393362 - protein, 11 aa, Influenza virus
AQGEGTAADYK

SEQ ID NO: 393363 - protein, 11 aa, Influenza virus
QGEGTAADYKS

SEQ ID NO: 393364 - protein, 11 aa, Influenza virus
GEGTAADYKST

SEQ ID NO: 393365 - protein, 11 aa, Influenza virus
EGTAADYKSTQ

SEQ ID NO: 393366 - protein, 11 aa, Influenza virus
GTAADYKSTQS

SEQ ID NO: 393367 - protein, 11 aa, Influenza virus
TAADYKSTQSA

SEQ ID NO: 393368 - protein, 11 aa, Influenza virus
AADYKSTQSAI

SEQ ID NO: 393369 - protein, 11 aa, Influenza virus
ADYKSTQSAID

SEQ ID NO: 393370 - protein, 11 aa, Influenza virus
DYKSTQSAIDQ

SEQ ID NO: 393371 - protein, 11 aa, Influenza virus
YKSTQSAIDQI

SEQ ID NO: 393372 - protein, 11 aa, Influenza virus
KSTQSAIDQIT

SEQ ID NO: 393373 - protein, 11 aa, Influenza virus
STQSAIDQITG

SEQ ID NO: 393374 - protein, 11 aa, Influenza virus
TQSAIDQITGK

SEQ ID NO: 393375 - protein, 11 aa, Influenza virus
QSAIDQITGKL

SEQ ID NO: 393376 - protein, 11 aa, Influenza virus
SAIDQITGKLN

SEQ ID NO: 393377 - protein, 11 aa, Influenza virus
AIDQITGKLNR

SEQ ID NO: 393378 - protein, 11 aa, Influenza virus
IDQITGKLNRL

SEQ ID NO: 393379 - protein, 11 aa, Influenza virus
DQITGKLNRLI

SEQ ID NO: 393380 - protein, 11 aa, Influenza virus
QITGKLNRLIG

SEQ ID NO: 393381 - protein, 11 aa, Influenza virus
ITGKLNRLIGK

SEQ ID NO: 393382 - protein, 11 aa, Influenza virus
TGKLNRLIGKT

SEQ ID NO: 393383 - protein, 11 aa, Influenza virus
GKLNRLIGKTN

SEQ ID NO: 393384 - protein, 11 aa, Influenza virus
KLNRLIGKTNQ

SEQ ID NO: 393385 - protein, 11 aa, Influenza virus
LNRLIGKTNQQ

SEQ ID NO: 393386 - protein, 11 aa, Influenza virus
NRLIGKTNQQF

SEQ ID NO: 393387 - protein, 11 aa, Influenza virus
LIGKTNQQFEL

SEQ ID NO: 393388 - protein, 11 aa, Influenza virus
IGKTNQQFELI

SEQ ID NO: 393389 - protein, 11 aa, Influenza virus
TNQQFELIDNE

SEQ ID NO: 393390 - protein, 11 aa, Influenza virus
NQQFELIDNEF

SEQ ID NO: 393391 - protein, 11 aa, Influenza virus
NEFNEIEQQIG

SEQ ID NO: 393392 - protein, 11 aa, Influenza virus
EFNEIEQQIGN

SEQ ID NO: 393393 - protein, 11 aa, Influenza virus
FNEIEQQIGNV

SEQ ID NO: 393394 - protein, 11 aa, Influenza virus
NEIEQQIGNVI

SEQ ID NO: 393395 - protein, 11 aa, Influenza virus
EIEQQIGNVIN

SEQ ID NO: 393396 - protein, 11 aa, Influenza virus
IEQQIGNVINW

SEQ ID NO: 393397 - protein, 11 aa, Influenza virus
EQQIGNVINWT

SEQ ID NO: 393398 - protein, 11 aa, Influenza virus
QQIGNVINWTR

SEQ ID NO: 393399 - protein, 11 aa, Influenza virus
QIGNVINWTRD

SEQ ID NO: 393400 - protein, 11 aa, Influenza virus
IGNVINWTRDA

SEQ ID NO: 393401 - protein, 11 aa, Influenza virus
GNVINWTRDAM

SEQ ID NO: 393402 - protein, 11 aa, Influenza virus
NVINWTRDAMT

SEQ ID NO: 393403 - protein, 11 aa, Influenza virus
VINWTRDAMTE

SEQ ID NO: 393404 - protein, 11 aa, Influenza virus
INWTRDAMTEI

SEQ ID NO: 393405 - protein, 11 aa, Influenza virus
NWTRDAMTEIW

SEQ ID NO: 393406 - protein, 11 aa, Influenza virus
WTRDAMTEIWS

SEQ ID NO: 393407 - protein, 11 aa, Influenza virus
TRDAMTEIWSY

SEQ ID NO: 393408 - protein, 11 aa, Influenza virus
RDAMTEIWSYN

SEQ ID NO: 393409 - protein, 11 aa, Influenza virus
DAMTEIWSYNA

SEQ ID NO: 393410 - protein, 11 aa, Influenza virus
AMTEIWSYNAE

SEQ ID NO: 393411 - protein, 11 aa, Influenza virus
MTEIWSYNAEL

SEQ ID NO: 393412 - protein, 11 aa, Influenza virus
TEIWSYNAELL

SEQ ID NO: 393413 - protein, 11 aa, Influenza virus
EIWSYNAELLV

SEQ ID NO: 393414 - protein, 11 aa, Influenza virus
IWSYNAELLVA

SEQ ID NO: 393415 - protein, 11 aa, Influenza virus
WSYNAELLVAM

SEQ ID NO: 393416 - protein, 11 aa, Influenza virus
SYNAELLVAME

SEQ ID NO: 393417 - protein, 11 aa, Influenza virus
YNAELLVAMEN

SEQ ID NO: 393418 - protein, 11 aa, Influenza virus
NAELLVAMENQ

SEQ ID NO: 393419 - protein, 11 aa, Influenza virus
AELLVAMENQH

SEQ ID NO: 393420 - protein, 11 aa, Influenza virus
ELLVAMENQHT

SEQ ID NO: 393421 - protein, 11 aa, Influenza virus
LLVAMENQHTI

SEQ ID NO: 393422 - protein, 11 aa, Influenza virus
LVAMENQHTID

SEQ ID NO: 393423 - protein, 11 aa, Influenza virus
VAMENQHTIDL

SEQ ID NO: 393424 - protein, 11 aa, Influenza virus
AMENQHTIDLA

SEQ ID NO: 393425 - protein, 11 aa, Influenza virus
MENQHTIDLAD

SEQ ID NO: 393426 - protein, 11 aa, Influenza virus
ENQHTIDLADS

SEQ ID NO: 393427 - protein, 11 aa, Influenza virus
NQHTIDLADSE

SEQ ID NO: 393428 - protein, 11 aa, Influenza virus
QHTIDLADSEM

SEQ ID NO: 393429 - protein, 11 aa, Influenza virus
IDLADSEMSKL

SEQ ID NO: 393430 - protein, 11 aa, Influenza virus
DLADSEMSKLY

SEQ ID NO: 393431 - protein, 11 aa, Influenza virus
DSEMSKLYERV

SEQ ID NO: 393432 - protein, 11 aa, Influenza virus
SEMSKLYERVK

SEQ ID NO: 393433 - protein, 11 aa, Influenza virus
KLYERVKKQLR

SEQ ID NO: 393434 - protein, 11 aa, Influenza virus
LYERVKKQLRE

SEQ ID NO: 393435 - protein, 11 aa, Influenza virus
YERVKKQLREN

SEQ ID NO: 393436 - protein, 11 aa, Influenza virus
ERVKKQLRENA

SEQ ID NO: 393437 - protein, 11 aa, Influenza virus
RVKKQLRENAE

SEQ ID NO: 393438 - protein, 11 aa, Influenza virus
VKKQLRENAEE

SEQ ID NO: 393439 - protein, 11 aa, Influenza virus
KKQLRENAEED

SEQ ID NO: 393440 - protein, 11 aa, Influenza virus
KQLRENAEEDG

SEQ ID NO: 393441 - protein, 11 aa, Influenza virus
QLRENAEEDGT

SEQ ID NO: 393442 - protein, 11 aa, Influenza virus
LRENAEEDGTG

SEQ ID NO: 393443 - protein, 11 aa, Influenza virus
RENAEEDGTGC

SEQ ID NO: 393444 - protein, 11 aa, Influenza virus
ENAEEDGTGCF

SEQ ID NO: 393445 - protein, 11 aa, Influenza virus
NAEEDGTGCFE

SEQ ID NO: 393446 - protein, 11 aa, Influenza virus
AEEDGTGCFEI

SEQ ID NO: 393447 - protein, 11 aa, Influenza virus
EEDGTGCFEIF

SEQ ID NO: 393448 - protein, 11 aa, Influenza virus
EDGTGCFEIFH

SEQ ID NO: 393449 - protein, 11 aa, Influenza virus
DGTGCFEIFHK

SEQ ID NO: 393450 - protein, 11 aa, Influenza virus
GTGCFEIFHKC

SEQ ID NO: 393451 - protein, 11 aa, Influenza virus
TGCFEIFHKCD

SEQ ID NO: 393452 - protein, 11 aa, Influenza virus
GCFEIFHKCDD

SEQ ID NO: 393453 - protein, 11 aa, Influenza virus
CFEIFHKCDDQ

SEQ ID NO: 393454 - protein, 11 aa, Influenza virus
FEIFHKCDDQC

SEQ ID NO: 393455 - protein, 11 aa, Influenza virus
EIFHKCDDQCM

SEQ ID NO: 393456 - protein, 11 aa, Influenza virus
IFHKCDDQCME

SEQ ID NO: 393457 - protein, 11 aa, Influenza virus
FHKCDDQCMES

SEQ ID NO: 393458 - protein, 11 aa, Influenza virus
HKCDDQCMESI

SEQ ID NO: 393459 - protein, 11 aa, Influenza virus
KCDDQCMESIR

SEQ ID NO: 393460 - protein, 11 aa, Influenza virus
CDDQCMESIRN

SEQ ID NO: 393461 - protein, 11 aa, Influenza virus
DDQCMESIRNN

SEQ ID NO: 393462 - protein, 11 aa, Influenza virus
DQCMESIRNNT

SEQ ID NO: 393463 - protein, 11 aa, Influenza virus
QCMESIRNNTY

SEQ ID NO: 393464 - protein, 11 aa, Influenza virus
CMESIRNNTYD

SEQ ID NO: 393465 - protein, 11 aa, Influenza virus
MESIRNNTYDH

SEQ ID NO: 393466 - protein, 11 aa, Influenza virus
ESIRNNTYDHT

SEQ ID NO: 393467 - protein, 11 aa, Influenza virus
SIRNNTYDHTQ

SEQ ID NO: 393468 - protein, 11 aa, Influenza virus
IRNNTYDHTQY

SEQ ID NO: 393469 - protein, 11 aa, Influenza virus
RNNTYDHTQYR

SEQ ID NO: 393470 - protein, 11 aa, Influenza virus
QYRTESLQNRI

SEQ ID NO: 393471 - protein, 11 aa, Influenza virus
YRTESLQNRIQ

SEQ ID NO: 393472 - protein, 11 aa, Influenza virus
RTESLQNRIQI

SEQ ID NO: 393473 - protein, 11 aa, Influenza virus
TESLQNRIQID

SEQ ID NO: 393474 - protein, 11 aa, Influenza virus
ESLQNRIQIDP

SEQ ID NO: 393475 - protein, 11 aa, Influenza virus
SLQNRIQIDPV

SEQ ID NO: 393476 - protein, 11 aa, Influenza virus
LQNRIQIDPVK

SEQ ID NO: 393477 - protein, 11 aa, Influenza virus
QNRIQIDPVKL

SEQ ID NO: 393478 - protein, 11 aa, Influenza virus
NRIQIDPVKLS

SEQ ID NO: 393479 - protein, 11 aa, Influenza virus
RIQIDPVKLSS

SEQ ID NO: 393480 - protein, 11 aa, Influenza virus
IQIDPVKLSSG

SEQ ID NO: 393481 - protein, 11 aa, Influenza virus
QIDPVKLSSGY

SEQ ID NO: 393482 - protein, 11 aa, Influenza virus
IDPVKLSSGYK

SEQ ID NO: 393483 - protein, 11 aa, Influenza virus
DPVKLSSGYKD

SEQ ID NO: 393484 - protein, 11 aa, Influenza virus
PVKLSSGYKDI

SEQ ID NO: 393485 - protein, 11 aa, Influenza virus
VKLSSGYKDII

SEQ ID NO: 393486 - protein, 11 aa, Influenza virus
KLSSGYKDIIL

SEQ ID NO: 393487 - protein, 11 aa, Influenza virus
LSSGYKDIILW

SEQ ID NO: 393488 - protein, 11 aa, Influenza virus
SSGYKDIILWF

SEQ ID NO: 393489 - protein, 11 aa, Influenza virus
SGYKDIILWFS

SEQ ID NO: 393490 - protein, 11 aa, Influenza virus
GYKDIILWFSF

SEQ ID NO: 393491 - protein, 11 aa, Influenza virus
YKDIILWFSFG

SEQ ID NO: 393492 - protein, 11 aa, Influenza virus
KDIILWFSFGA

SEQ ID NO: 393493 - protein, 11 aa, Influenza virus
DIILWFSFGAS

SEQ ID NO: 393494 - protein, 11 aa, Influenza virus
IILWFSFGASC

SEQ ID NO: 393495 - protein, 11 aa, Influenza virus
ILWFSFGASCF

SEQ ID NO: 393496 - protein, 11 aa, Influenza virus
LWFSFGASCFL

SEQ ID NO: 393497 - protein, 11 aa, Influenza virus
WFSFGASCFLL

SEQ ID NO: 393498 - protein, 11 aa, Influenza virus
FSFGASCFLLL

SEQ ID NO: 393499 - protein, 11 aa, Influenza virus
SFGASCFLLLA

SEQ ID NO: 393500 - protein, 11 aa, Influenza virus
FGASCFLLLAI

SEQ ID NO: 393501 - protein, 11 aa, Influenza virus
GASCFLLLAIA

SEQ ID NO: 393502 - protein, 11 aa, Influenza virus
AMGLVFICIKN

SEQ ID NO: 393503 - protein, 11 aa, Influenza virus
MGLVFICIKNG

SEQ ID NO: 393504 - protein, 11 aa, Influenza virus
GLVFICIKNGN

SEQ ID NO: 393505 - protein, 11 aa, Influenza virus
LVFICIKNGNM

SEQ ID NO: 393506 - protein, 11 aa, Influenza virus
VFICIKNGNMQ

SEQ ID NO: 393507 - protein, 11 aa, Influenza virus
FICIKNGNMQC

SEQ ID NO: 393508 - protein, 11 aa, Influenza virus
ICIKNGNMQCT

SEQ ID NO: 393509 - protein, 11 aa, Influenza virus
CIKNGNMQCTI

SEQ ID NO: 393510 - protein, 11 aa, Influenza virus
IKNGNMQCTIC

SEQ ID NO: 393511 - protein, 11 aa, Influenza virus
KNGNMQCTICI

SEQ ID NO: 393512 - protein, 11 aa, Influenza virus
NETCSALFVYS

SEQ ID NO: 393513 - protein, 11 aa, Influenza virus
ETCSALFVYSL

SEQ ID NO: 393514 - protein, 11 aa, Influenza virus
TCSALFVYSLR

SEQ ID NO: 393515 - protein, 11 aa, Influenza virus
CSALFVYSLRK

SEQ ID NO: 393516 - protein, 11 aa, Influenza virus
MNPNQKIITIG

SEQ ID NO: 393517 - protein, 11 aa, Influenza virus
NPNQKIITIGS

SEQ ID NO: 393518 - protein, 11 aa, Influenza virus
PNQKIITIGSV

SEQ ID NO: 393519 - protein, 11 aa, Influenza virus
NQKIITIGSVS

SEQ ID NO: 393520 - protein, 11 aa, Influenza virus
QKIITIGSVSL

SEQ ID NO: 393521 - protein, 11 aa, Influenza virus
KIITIGSVSLT

SEQ ID NO: 393522 - protein, 11 aa, Influenza virus
IITIGSVSLTI

SEQ ID NO: 393523 - protein, 11 aa, Influenza virus
ITIGSVSLTIA

SEQ ID NO: 393524 - protein, 11 aa, Influenza virus
TIGSVSLTIAT

SEQ ID NO: 393525 - protein, 11 aa, Influenza virus
ERNITEIVYLN

SEQ ID NO: 393526 - protein, 11 aa, Influenza virus
NITEIVYLNNT

SEQ ID NO: 393527 - protein, 11 aa, Influenza virus
YRSWSKPQCQI

SEQ ID NO: 393528 - protein, 11 aa, Influenza virus
GFAPFSKDNSI

SEQ ID NO: 393529 - protein, 11 aa, Influenza virus
FAPFSKDNSIR

SEQ ID NO: 393530 - protein, 11 aa, Influenza virus
APFSKDNSIRL

SEQ ID NO: 393531 - protein, 11 aa, Influenza virus
PFSKDNSIRLS

SEQ ID NO: 393532 - protein, 11 aa, Influenza virus
FSKDNSIRLSA

SEQ ID NO: 393533 - protein, 11 aa, Influenza virus
SKDNSIRLSAG

SEQ ID NO: 393534 - protein, 11 aa, Influenza virus
KDNSIRLSAGG

SEQ ID NO: 393535 - protein, 11 aa, Influenza virus
DNSIRLSAGGD

SEQ ID NO: 393536 - protein, 11 aa, Influenza virus
NSIRLSAGGDI

SEQ ID NO: 393537 - protein, 11 aa, Influenza virus
SIRLSAGGDIW

SEQ ID NO: 393538 - protein, 11 aa, Influenza virus
RLSAGGDIWIT

SEQ ID NO: 393539 - protein, 11 aa, Influenza virus
LSAGGDIWITR

SEQ ID NO: 393540 - protein, 11 aa, Influenza virus
SAGGDIWITRE

SEQ ID NO: 393541 - protein, 11 aa, Influenza virus
AGGDIWITREP

SEQ ID NO: 393542 - protein, 11 aa, Influenza virus
GGDIWITREPY

SEQ ID NO: 393543 - protein, 11 aa, Influenza virus
GDIWITREPYV

SEQ ID NO: 393544 - protein, 11 aa, Influenza virus
DIWITREPYVS

SEQ ID NO: 393545 - protein, 11 aa, Influenza virus
IWITREPYVSC

SEQ ID NO: 393546 - protein, 11 aa, Influenza virus
WITREPYVSCD

SEQ ID NO: 393547 - protein, 11 aa, Influenza virus
SKCYQFALGQG

SEQ ID NO: 393548 - protein, 11 aa, Influenza virus
KCYQFALGQGT

SEQ ID NO: 393549 - protein, 11 aa, Influenza virus
CYQFALGQGTT

SEQ ID NO: 393550 - protein, 11 aa, Influenza virus
YQFALGQGTTL

SEQ ID NO: 393551 - protein, 11 aa, Influenza virus
QFALGQGTTLD

SEQ ID NO: 393552 - protein, 11 aa, Influenza virus
FALGQGTTLDN

SEQ ID NO: 393553 - protein, 11 aa, Influenza virus
ALGQGTTLDNK

SEQ ID NO: 393554 - protein, 11 aa, Influenza virus
LGQGTTLDNKH

SEQ ID NO: 393555 - protein, 11 aa, Influenza virus
GQGTTLDNKHS

SEQ ID NO: 393556 - protein, 11 aa, Influenza virus
QGTTLDNKHSN

SEQ ID NO: 393557 - protein, 11 aa, Influenza virus
GTTLDNKHSNG

SEQ ID NO: 393558 - protein, 11 aa, Influenza virus
TTLDNKHSNGT

SEQ ID NO: 393559 - protein, 11 aa, Influenza virus
NKHSNGTIHDR

SEQ ID NO: 393560 - protein, 11 aa, Influenza virus
KHSNGTIHDRI

SEQ ID NO: 393561 - protein, 11 aa, Influenza virus
HDRIPHRTLLM

SEQ ID NO: 393562 - protein, 11 aa, Influenza virus
DRIPHRTLLMN

SEQ ID NO: 393563 - protein, 11 aa, Influenza virus
RIPHRTLLMNE

SEQ ID NO: 393564 - protein, 11 aa, Influenza virus
IPHRTLLMNEL

SEQ ID NO: 393565 - protein, 11 aa, Influenza virus
PHRTLLMNELG

SEQ ID NO: 393566 - protein, 11 aa, Influenza virus
HRTLLMNELGV

SEQ ID NO: 393567 - protein, 11 aa, Influenza virus
RTLLMNELGVP

SEQ ID NO: 393568 - protein, 11 aa, Influenza virus
TLLMNELGVPF

SEQ ID NO: 393569 - protein, 11 aa, Influenza virus
LLMNELGVPFH

SEQ ID NO: 393570 - protein, 11 aa, Influenza virus
LMNELGVPFHL

SEQ ID NO: 393571 - protein, 11 aa, Influenza virus
MNELGVPFHLG

SEQ ID NO: 393572 - protein, 11 aa, Influenza virus
NELGVPFHLGT

SEQ ID NO: 393573 - protein, 11 aa, Influenza virus
ELGVPFHLGTK

SEQ ID NO: 393574 - protein, 11 aa, Influenza virus
LGVPFHLGTKQ

SEQ ID NO: 393575 - protein, 11 aa, Influenza virus
GVPFHLGTKQV

SEQ ID NO: 393576 - protein, 11 aa, Influenza virus
VPFHLGTKQVC

SEQ ID NO: 393577 - protein, 11 aa, Influenza virus
PFHLGTKQVCI

SEQ ID NO: 393578 - protein, 11 aa, Influenza virus
FHLGTKQVCIA

SEQ ID NO: 393579 - protein, 11 aa, Influenza virus
HLGTKQVCIAW

SEQ ID NO: 393580 - protein, 11 aa, Influenza virus
LGTKQVCIAWS

SEQ ID NO: 393581 - protein, 11 aa, Influenza virus
GTKQVCIAWSS

SEQ ID NO: 393582 - protein, 11 aa, Influenza virus
TKQVCIAWSSS

SEQ ID NO: 393583 - protein, 11 aa, Influenza virus
KQVCIAWSSSS

SEQ ID NO: 393584 - protein, 11 aa, Influenza virus
QVCIAWSSSSC

SEQ ID NO: 393585 - protein, 11 aa, Influenza virus
VCIAWSSSSCH

SEQ ID NO: 393586 - protein, 11 aa, Influenza virus
CIAWSSSSCHD

SEQ ID NO: 393587 - protein, 11 aa, Influenza virus
IAWSSSSCHDG

SEQ ID NO: 393588 - protein, 11 aa, Influenza virus
AWSSSSCHDGK

SEQ ID NO: 393589 - protein, 11 aa, Influenza virus
WSSSSCHDGKA

SEQ ID NO: 393590 - protein, 11 aa, Influenza virus
SSSSCHDGKAW

SEQ ID NO: 393591 - protein, 11 aa, Influenza virus
SSSCHDGKAWL

SEQ ID NO: 393592 - protein, 11 aa, Influenza virus
SSCHDGKAWLH

SEQ ID NO: 393593 - protein, 11 aa, Influenza virus
SCHDGKAWLHV

SEQ ID NO: 393594 - protein, 11 aa, Influenza virus
CHDGKAWLHVC

SEQ ID NO: 393595 - protein, 11 aa, Influenza virus
HDGKAWLHVCV

SEQ ID NO: 393596 - protein, 11 aa, Influenza virus
DGKAWLHVCVT

SEQ ID NO: 393597 - protein, 11 aa, Influenza virus
GKAWLHVCVTG

SEQ ID NO: 393598 - protein, 11 aa, Influenza virus
KAWLHVCVTGD

SEQ ID NO: 393599 - protein, 11 aa, Influenza virus
AWLHVCVTGDD

SEQ ID NO: 393600 - protein, 11 aa, Influenza virus
WLHVCVTGDDR

SEQ ID NO: 393601 - protein, 11 aa, Influenza virus
LHVCVTGDDRN

SEQ ID NO: 393602 - protein, 11 aa, Influenza virus
HVCVTGDDRNA

SEQ ID NO: 393603 - protein, 11 aa, Influenza virus
VCVTGDDRNAT

SEQ ID NO: 393604 - protein, 11 aa, Influenza virus
CVTGDDRNATA

SEQ ID NO: 393605 - protein, 11 aa, Influenza virus
VTGDDRNATAS

SEQ ID NO: 393606 - protein, 11 aa, Influenza virus
TGDDRNATASF

SEQ ID NO: 393607 - protein, 11 aa, Influenza virus
GDDRNATASFI

SEQ ID NO: 393608 - protein, 11 aa, Influenza virus
DDRNATASFIY

SEQ ID NO: 393609 - protein, 11 aa, Influenza virus
LVDSIGSWSQN

SEQ ID NO: 393610 - protein, 11 aa, Influenza virus
VDSIGSWSQNI

SEQ ID NO: 393611 - protein, 11 aa, Influenza virus
DSIGSWSQNIL

SEQ ID NO: 393612 - protein, 11 aa, Influenza virus
SIGSWSQNILR

SEQ ID NO: 393613 - protein, 11 aa, Influenza virus
IGSWSQNILRT

SEQ ID NO: 393614 - protein, 11 aa, Influenza virus
GSWSQNILRTQ

SEQ ID NO: 393615 - protein, 11 aa, Influenza virus
SWSQNILRTQE

SEQ ID NO: 393616 - protein, 11 aa, Influenza virus
WSQNILRTQES

SEQ ID NO: 393617 - protein, 11 aa, Influenza virus
SQNILRTQESE

SEQ ID NO: 393618 - protein, 11 aa, Influenza virus
QNILRTQESEC

SEQ ID NO: 393619 - protein, 11 aa, Influenza virus
NILRTQESECV

SEQ ID NO: 393620 - protein, 11 aa, Influenza virus
ILRTQESECVC

SEQ ID NO: 393621 - protein, 11 aa, Influenza virus
LRTQESECVCI

SEQ ID NO: 393622 - protein, 11 aa, Influenza virus
RTQESECVCIN

SEQ ID NO: 393623 - protein, 11 aa, Influenza virus
TQESECVCING

SEQ ID NO: 393624 - protein, 11 aa, Influenza virus
QESECVCINGS

SEQ ID NO: 393625 - protein, 11 aa, Influenza virus
ESECVCINGSC

SEQ ID NO: 393626 - protein, 11 aa, Influenza virus
SECVCINGSCT

SEQ ID NO: 393627 - protein, 11 aa, Influenza virus
ECVCINGSCTV

SEQ ID NO: 393628 - protein, 11 aa, Influenza virus
CVCINGSCTVV

SEQ ID NO: 393629 - protein, 11 aa, Influenza virus
VCINGSCTVVM

SEQ ID NO: 393630 - protein, 11 aa, Influenza virus
CINGSCTVVMT

SEQ ID NO: 393631 - protein, 11 aa, Influenza virus
INGSCTVVMTD

SEQ ID NO: 393632 - protein, 11 aa, Influenza virus
NGSCTVVMTDG

SEQ ID NO: 393633 - protein, 11 aa, Influenza virus
GSCTVVMTDGS

SEQ ID NO: 393634 - protein, 11 aa, Influenza virus
SCTVVMTDGSA

SEQ ID NO: 393635 - protein, 11 aa, Influenza virus
CTVVMTDGSAS

SEQ ID NO: 393636 - protein, 11 aa, Influenza virus
TVVMTDGSASG

SEQ ID NO: 393637 - protein, 11 aa, Influenza virus
VVMTDGSASGK

SEQ ID NO: 393638 - protein, 11 aa, Influenza virus
VMTDGSASGKA

SEQ ID NO: 393639 - protein, 11 aa, Influenza virus
MTDGSASGKAD

SEQ ID NO: 393640 - protein, 11 aa, Influenza virus
TDGSASGKADT

SEQ ID NO: 393641 - protein, 11 aa, Influenza virus
EGKIVHISPLS

SEQ ID NO: 393642 - protein, 11 aa, Influenza virus
GKIVHISPLSG

SEQ ID NO: 393643 - protein, 11 aa, Influenza virus
IVHISPLSGSA

SEQ ID NO: 393644 - protein, 11 aa, Influenza virus
VHISPLSGSAQ

SEQ ID NO: 393645 - protein, 11 aa, Influenza virus
HISPLSGSAQH

SEQ ID NO: 393646 - protein, 11 aa, Influenza virus
ISPLSGSAQHI

SEQ ID NO: 393647 - protein, 11 aa, Influenza virus
SPLSGSAQHIE

SEQ ID NO: 393648 - protein, 11 aa, Influenza virus
PLSGSAQHIEE

SEQ ID NO: 393649 - protein, 11 aa, Influenza virus
LSGSAQHIEEC

SEQ ID NO: 393650 - protein, 11 aa, Influenza virus
SGSAQHIEECS

SEQ ID NO: 393651 - protein, 11 aa, Influenza virus
GSAQHIEECSC

SEQ ID NO: 393652 - protein, 11 aa, Influenza virus
SAQHIEECSCY

SEQ ID NO: 393653 - protein, 11 aa, Influenza virus
AQHIEECSCYP

SEQ ID NO: 393654 - protein, 11 aa, Influenza virus
QHIEECSCYPR

SEQ ID NO: 393655 - protein, 11 aa, Influenza virus
HIEECSCYPRY

SEQ ID NO: 393656 - protein, 11 aa, Influenza virus
IEECSCYPRYP

SEQ ID NO: 393657 - protein, 11 aa, Influenza virus
EECSCYPRYPN

SEQ ID NO: 393658 - protein, 11 aa, Influenza virus
ECSCYPRYPNV

SEQ ID NO: 393659 - protein, 11 aa, Influenza virus
CSCYPRYPNVR

SEQ ID NO: 393660 - protein, 11 aa, Influenza virus
SCYPRYPNVRC

SEQ ID NO: 393661 - protein, 11 aa, Influenza virus
CYPRYPNVRCV

SEQ ID NO: 393662 - protein, 11 aa, Influenza virus
YPRYPNVRCVC

SEQ ID NO: 393663 - protein, 11 aa, Influenza virus
PRYPNVRCVCR

SEQ ID NO: 393664 - protein, 11 aa, Influenza virus
RYPNVRCVCRD

SEQ ID NO: 393665 - protein, 11 aa, Influenza virus
YPNVRCVCRDN

SEQ ID NO: 393666 - protein, 11 aa, Influenza virus
PNVRCVCRDNW

SEQ ID NO: 393667 - protein, 11 aa, Influenza virus
NVRCVCRDNWK

SEQ ID NO: 393668 - protein, 11 aa, Influenza virus
VRCVCRDNWKG

SEQ ID NO: 393669 - protein, 11 aa, Influenza virus
RCVCRDNWKGS

SEQ ID NO: 393670 - protein, 11 aa, Influenza virus
CVCRDNWKGSN

SEQ ID NO: 393671 - protein, 11 aa, Influenza virus
VCRDNWKGSNR

SEQ ID NO: 393672 - protein, 11 aa, Influenza virus
CRDNWKGSNRP

SEQ ID NO: 393673 - protein, 11 aa, Influenza virus
RDNWKGSNRPV

SEQ ID NO: 393674 - protein, 11 aa, Influenza virus
DNWKGSNRPVI

SEQ ID NO: 393675 - protein, 11 aa, Influenza virus
NWKGSNRPVID

SEQ ID NO: 393676 - protein, 11 aa, Influenza virus
WKGSNRPVIDI

SEQ ID NO: 393677 - protein, 11 aa, Influenza virus
KGSNRPVIDIN

SEQ ID NO: 393678 - protein, 11 aa, Influenza virus
GSNRPVIDINM

SEQ ID NO: 393679 - protein, 11 aa, Influenza virus
IDSSYVCSGLV

SEQ ID NO: 393680 - protein, 11 aa, Influenza virus
DSSYVCSGLVG

SEQ ID NO: 393681 - protein, 11 aa, Influenza virus
SSYVCSGLVGD

SEQ ID NO: 393682 - protein, 11 aa, Influenza virus
SYVCSGLVGDT

SEQ ID NO: 393683 - protein, 11 aa, Influenza virus
YVCSGLVGDTP

SEQ ID NO: 393684 - protein, 11 aa, Influenza virus
VCSGLVGDTPR

SEQ ID NO: 393685 - protein, 11 aa, Influenza virus
CSGLVGDTPRN

SEQ ID NO: 393686 - protein, 11 aa, Influenza virus
SGLVGDTPRNE

SEQ ID NO: 393687 - protein, 11 aa, Influenza virus
GLVGDTPRNED

SEQ ID NO: 393688 - protein, 11 aa, Influenza virus
LVGDTPRNEDG

SEQ ID NO: 393689 - protein, 11 aa, Influenza virus
VGDTPRNEDGS

SEQ ID NO: 393690 - protein, 11 aa, Influenza virus
GDTPRNEDGSS

SEQ ID NO: 393691 - protein, 11 aa, Influenza virus
DTPRNEDGSSS

SEQ ID NO: 393692 - protein, 11 aa, Influenza virus
TPRNEDGSSSS

SEQ ID NO: 393693 - protein, 11 aa, Influenza virus
PRNEDGSSSSN

SEQ ID NO: 393694 - protein, 11 aa, Influenza virus
RNEDGSSSSNC

SEQ ID NO: 393695 - protein, 11 aa, Influenza virus
DPNEERGNPGV

SEQ ID NO: 393696 - protein, 11 aa, Influenza virus
PNEERGNPGVK

SEQ ID NO: 393697 - protein, 11 aa, Influenza virus
NEERGNPGVKG

SEQ ID NO: 393698 - protein, 11 aa, Influenza virus
EERGNPGVKGW

SEQ ID NO: 393699 - protein, 11 aa, Influenza virus
ERGNPGVKGWA

SEQ ID NO: 393700 - protein, 11 aa, Influenza virus
RGNPGVKGWAF

SEQ ID NO: 393701 - protein, 11 aa, Influenza virus
GNPGVKGWAFD

SEQ ID NO: 393702 - protein, 11 aa, Influenza virus
NPGVKGWAFDS

SEQ ID NO: 393703 - protein, 11 aa, Influenza virus
PGVKGWAFDSG

SEQ ID NO: 393704 - protein, 11 aa, Influenza virus
GVKGWAFDSGD

SEQ ID NO: 393705 - protein, 11 aa, Influenza virus
VKGWAFDSGDD

SEQ ID NO: 393706 - protein, 11 aa, Influenza virus
SGDDVWMGRTI

SEQ ID NO: 393707 - protein, 11 aa, Influenza virus
GDDVWMGRTIS

SEQ ID NO: 393708 - protein, 11 aa, Influenza virus
DDVWMGRTISR

SEQ ID NO: 393709 - protein, 11 aa, Influenza virus
DVWMGRTISRD

SEQ ID NO: 393710 - protein, 11 aa, Influenza virus
VWMGRTISRDS

SEQ ID NO: 393711 - protein, 11 aa, Influenza virus
WMGRTISRDSR

SEQ ID NO: 393712 - protein, 11 aa, Influenza virus
MGRTISRDSRS

SEQ ID NO: 393713 - protein, 11 aa, Influenza virus
GRTISRDSRSG

SEQ ID NO: 393714 - protein, 11 aa, Influenza virus
RTISRDSRSGY

SEQ ID NO: 393715 - protein, 11 aa, Influenza virus
TISRDSRSGYE

SEQ ID NO: 393716 - protein, 11 aa, Influenza virus
ISRDSRSGYET

SEQ ID NO: 393717 - protein, 11 aa, Influenza virus
SRDSRSGYETF

SEQ ID NO: 393718 - protein, 11 aa, Influenza virus
RDSRSGYETFR

SEQ ID NO: 393719 - protein, 11 aa, Influenza virus
DSRSGYETFRV

SEQ ID NO: 393720 - protein, 11 aa, Influenza virus
SRSGYETFRVI

SEQ ID NO: 393721 - protein, 11 aa, Influenza virus
RSGYETFRVIG

SEQ ID NO: 393722 - protein, 11 aa, Influenza virus
SGYETFRVIGG

SEQ ID NO: 393723 - protein, 11 aa, Influenza virus
GYETFRVIGGW

SEQ ID NO: 393724 - protein, 11 aa, Influenza virus
YETFRVIGGWT

SEQ ID NO: 393725 - protein, 11 aa, Influenza virus
VIGGWTTANSK

SEQ ID NO: 393726 - protein, 11 aa, Influenza virus
IGGWTTANSKS

SEQ ID NO: 393727 - protein, 11 aa, Influenza virus
VDNNNWSGYSG

SEQ ID NO: 393728 - protein, 11 aa, Influenza virus
NNNWSGYSGIF

SEQ ID NO: 393729 - protein, 11 aa, Influenza virus
NNWSGYSGIFS

SEQ ID NO: 393730 - protein, 11 aa, Influenza virus
NWSGYSGIFSV

SEQ ID NO: 393731 - protein, 11 aa, Influenza virus
WSGYSGIFSVE

SEQ ID NO: 393732 - protein, 11 aa, Influenza virus
KSCINRCFYVE

SEQ ID NO: 393733 - protein, 11 aa, Influenza virus
SCINRCFYVEL

SEQ ID NO: 393734 - protein, 11 aa, Influenza virus
CINRCFYVELI

SEQ ID NO: 393735 - protein, 11 aa, Influenza virus
INRCFYVELIR

SEQ ID NO: 393736 - protein, 11 aa, Influenza virus
NRCFYVELIRG

SEQ ID NO: 393737 - protein, 11 aa, Influenza virus
RCFYVELIRGR

SEQ ID NO: 393738 - protein, 11 aa, Influenza virus
CFYVELIRGRP

SEQ ID NO: 393739 - protein, 11 aa, Influenza virus
FYVELIRGRPK

SEQ ID NO: 393740 - protein, 11 aa, Influenza virus
YVELIRGRPKE

SEQ ID NO: 393741 - protein, 11 aa, Influenza virus
PKETRVWWTSN

SEQ ID NO: 393742 - protein, 11 aa, Influenza virus
KETRVWWTSNS

SEQ ID NO: 393743 - protein, 11 aa, Influenza virus
ETRVWWTSNSI

SEQ ID NO: 393744 - protein, 11 aa, Influenza virus
RVWWTSNSIVV

SEQ ID NO: 393745 - protein, 11 aa, Influenza virus
VWWTSNSIVVF

SEQ ID NO: 393746 - protein, 11 aa, Influenza virus
WWTSNSIVVFC

SEQ ID NO: 393747 - protein, 11 aa, Influenza virus
WTSNSIVVFCG

SEQ ID NO: 393748 - protein, 11 aa, Influenza virus
TSNSIVVFCGT

SEQ ID NO: 393749 - protein, 11 aa, Influenza virus
SNSIVVFCGTS

SEQ ID NO: 393750 - protein, 11 aa, Influenza virus
NSIVVFCGTSG

SEQ ID NO: 393751 - protein, 11 aa, Influenza virus
SIVVFCGTSGT

SEQ ID NO: 393752 - protein, 11 aa, Influenza virus
IVVFCGTSGTY

SEQ ID NO: 393753 - protein, 11 aa, Influenza virus
VVFCGTSGTYG

SEQ ID NO: 393754 - protein, 11 aa, Influenza virus
VFCGTSGTYGT

SEQ ID NO: 393755 - protein, 11 aa, Influenza virus
FCGTSGTYGTG

SEQ ID NO: 393756 - protein, 11 aa, Influenza virus
CGTSGTYGTGS

SEQ ID NO: 393757 - protein, 11 aa, Influenza virus
GTSGTYGTGSW

SEQ ID NO: 393758 - protein, 11 aa, Influenza virus
TSGTYGTGSWP

SEQ ID NO: 393759 - protein, 11 aa, Influenza virus
SGTYGTGSWPD

SEQ ID NO: 393760 - protein, 11 aa, Influenza virus
GTYGTGSWPDG

SEQ ID NO: 393761 - protein, 11 aa, Influenza virus
TYGTGSWPDGA

SEQ ID NO: 393762 - protein, 11 aa, Influenza virus
YGTGSWPDGAN

SEQ ID NO: 393763 - protein, 11 aa, Influenza virus
GTGSWPDGANI

SEQ ID NO: 393764 - protein, 11 aa, Influenza virus
TGSWPDGANIN

SEQ ID NO: 393765 - protein, 11 aa, Influenza virus
GSWPDGANINF

SEQ ID NO: 393766 - protein, 11 aa, Influenza virus
SWPDGANINFM

SEQ ID NO: 393767 - protein, 11 aa, Influenza virus
SKSRGYKMNTQ

SEQ ID NO: 393768 - protein, 11 aa, Influenza virus
KSRGYKMNNQI

SEQ ID NO: 393769 - protein, 11 aa, Influenza virus
SRGYKMNNQIL

SEQ ID NO: 393770 - protein, 11 aa, Influenza virus
RGYKMNNQILI

SEQ ID NO: 393771 - protein, 11 aa, Influenza virus
GYKMNTQILVF

SEQ ID NO: 393772 - protein, 11 aa, Influenza virus
YKMNTQILVFA

SEQ ID NO: 393773 - protein, 11 aa, Influenza virus
KMNTQILVFAL

SEQ ID NO: 393774 - protein, 11 aa, Influenza virus
GDKICLGHHAV

SEQ ID NO: 393775 - protein, 11 aa, Influenza virus
DKICLGHHAVA

SEQ ID NO: 393776 - protein, 11 aa, Influenza virus
KICLGHHAVAN

SEQ ID NO: 393777 - protein, 11 aa, Influenza virus
ICLGHHAVANG

SEQ ID NO: 393778 - protein, 11 aa, Influenza virus
CLGHHAVANGT

SEQ ID NO: 393779 - protein, 11 aa, Influenza virus
LGHHAVANGTK

SEQ ID NO: 393780 - protein, 11 aa, Influenza virus
GHHAVANGTKV

SEQ ID NO: 393781 - protein, 11 aa, Influenza virus
VNTLTERGIEV

SEQ ID NO: 393782 - protein, 11 aa, Influenza virus
TLTERGIEVVN

SEQ ID NO: 393783 - protein, 11 aa, Influenza virus
LTERGIEVVNA

SEQ ID NO: 393784 - protein, 11 aa, Influenza virus
TERGIEVVNAT

SEQ ID NO: 393785 - protein, 11 aa, Influenza virus
ERGIEVVNATE

SEQ ID NO: 393786 - protein, 11 aa, Influenza virus
RGIEVVNATET

SEQ ID NO: 393787 - protein, 11 aa, Influenza virus
GIEVVNATETV

SEQ ID NO: 393788 - protein, 11 aa, Influenza virus
IEVVNATETVE

SEQ ID NO: 393789 - protein, 11 aa, Influenza virus
EVVNATETVET

SEQ ID NO: 393790 - protein, 11 aa, Influenza virus
CGLLGTLIGPP

SEQ ID NO: 393791 - protein, 11 aa, Influenza virus
GLLGTLIGPPQ

SEQ ID NO: 393792 - protein, 11 aa, Influenza virus
LLGTLIGPPQC

SEQ ID NO: 393793 - protein, 11 aa, Influenza virus
LGTLIGPPQCD

SEQ ID NO: 393794 - protein, 11 aa, Influenza virus
IGPPQCDQFLE

SEQ ID NO: 393795 - protein, 11 aa, Influenza virus
GPPQCDQFLEF

SEQ ID NO: 393796 - protein, 11 aa, Influenza virus
LRQILRGSGGI

SEQ ID NO: 393797 - protein, 11 aa, Influenza virus
GSSFYAEMKWL

SEQ ID NO: 393798 - protein, 11 aa, Influenza virus
SSSFYAEMKWL

SEQ ID NO: 393799 - protein, 11 aa, Influenza virus
SSFYAEMKWLL

SEQ ID NO: 393800 - protein, 11 aa, Influenza virus
SFYAEMKWLLS

SEQ ID NO: 393801 - protein, 11 aa, Influenza virus
FYAEMKWLLSN

SEQ ID NO: 393802 - protein, 11 aa, Influenza virus
YAEMKWLLSNS

SEQ ID NO: 393803 - protein, 11 aa, Influenza virus
AEMKWLLSNSD

SEQ ID NO: 393804 - protein, 11 aa, Influenza virus
EMKWLLSNSDN

SEQ ID NO: 393805 - protein, 11 aa, Influenza virus
PALIIWGVHHS

SEQ ID NO: 393806 - protein, 11 aa, Influenza virus
LYGSGNKLITV

SEQ ID NO: 393807 - protein, 11 aa, Influenza virus
SSKYQQSFTPS

SEQ ID NO: 393808 - protein, 11 aa, Influenza virus
SKYQQSFTPSP

SEQ ID NO: 393809 - protein, 11 aa, Influenza virus
KYQQSFTPSPG

SEQ ID NO: 393810 - protein, 11 aa, Influenza virus
VNGQSGRIDFH

SEQ ID NO: 393811 - protein, 11 aa, Influenza virus
NGQSGRIDFHW

SEQ ID NO: 393812 - protein, 11 aa, Influenza virus
GQSGRIDFHWL

SEQ ID NO: 393813 - protein, 11 aa, Influenza virus
FTFNGAFIAPD

SEQ ID NO: 393814 - protein, 11 aa, Influenza virus
TFNGAFIAPDR

SEQ ID NO: 393815 - protein, 11 aa, Influenza virus
FNGAFIAPDRA

SEQ ID NO: 393816 - protein, 11 aa, Influenza virus
NGAFIAPDRAS

SEQ ID NO: 393817 - protein, 11 aa, Influenza virus
GAFIAPDRASF

SEQ ID NO: 393818 - protein, 11 aa, Influenza virus
GGTIVSSLPFQ

SEQ ID NO: 393819 - protein, 11 aa, Influenza virus
GTIVSSLPFQN

SEQ ID NO: 393820 - protein, 11 aa, Influenza virus
TIVSSLPFQNI

SEQ ID NO: 393821 - protein, 11 aa, Influenza virus
IVSSLPFQNIN

SEQ ID NO: 393822 - protein, 11 aa, Influenza virus
SLLLATGMRNV

SEQ ID NO: 393823 - protein, 11 aa, Influenza virus
LLLATGMRNVP

SEQ ID NO: 393824 - protein, 11 aa, Influenza virus
LLATGMRNVPE

SEQ ID NO: 393825 - protein, 11 aa, Influenza virus
LATGMRNVPEN

SEQ ID NO: 393826 - protein, 11 aa, Influenza virus
ATGMRNVPENP

SEQ ID NO: 393827 - protein, 11 aa, Influenza virus
TGMRNVPENPK

SEQ ID NO: 393828 - protein, 11 aa, Influenza virus
CSPLSRCRETR

SEQ ID NO: 393829 - protein, 11 aa, Influenza virus
RKRGLFGAIAG

SEQ ID NO: 393830 - protein, 11 aa, Influenza virus
LSRCRETRGLF

SEQ ID NO: 393831 - protein, 11 aa, Influenza virus
SRCRETRGLFG

SEQ ID NO: 393832 - protein, 11 aa, Influenza virus
RCRETRGLFGA

SEQ ID NO: 393833 - protein, 11 aa, Influenza virus
CRETRGLFGAI

SEQ ID NO: 393834 - protein, 11 aa, Influenza virus
RMTRGLFGAIA

SEQ ID NO: 393835 - protein, 11 aa, Influenza virus
MTRGLFGAIAG

SEQ ID NO: 393836 - protein, 11 aa, Influenza virus
TRGLFGAIAGF

SEQ ID NO: 393837 - protein, 11 aa, Influenza virus
TKPRPRRGLFG

SEQ ID NO: 393838 - protein, 11 aa, Influenza virus
KPRPRRGLFGA

SEQ ID NO: 393839 - protein, 11 aa, Influenza virus
PRPRRGLFGAI

SEQ ID NO: 393840 - protein, 11 aa, Influenza virus
RPRRGLFGAIA

SEQ ID NO: 393841 - protein, 11 aa, Influenza virus
PRRGLFGAIAG

SEQ ID NO: 393842 - protein, 11 aa, Influenza virus
RRGLFGAIAGF

SEQ ID NO: 393843 - protein, 11 aa, Influenza virus
RGLFGAIAGFI

SEQ ID NO: 393844 - protein, 11 aa, Influenza virus
GLFGAIAGFIE

SEQ ID NO: 393845 - protein, 11 aa, Influenza virus
LFGAIAGFIEN

SEQ ID NO: 393846 - protein, 11 aa, Influenza virus
FGAIAGFIENG

SEQ ID NO: 393847 - protein, 11 aa, Influenza virus
GAIAGFIENGW

SEQ ID NO: 393848 - protein, 11 aa, Influenza virus
AIAGFIENGWE

SEQ ID NO: 393849 - protein, 11 aa, Influenza virus
IAGFIENGWEG

SEQ ID NO: 393850 - protein, 11 aa, Influenza virus
AGFIENGWEGL

SEQ ID NO: 393851 - protein, 11 aa, Influenza virus
GFIENGWEGLI

SEQ ID NO: 393852 - protein, 11 aa, Influenza virus
FIENGWEGLID

SEQ ID NO: 393853 - protein, 11 aa, Influenza virus
IENGWEGLIDG

SEQ ID NO: 393854 - protein, 11 aa, Influenza virus
ENGWEGLIDGW

SEQ ID NO: 393855 - protein, 11 aa, Influenza virus
NGWEGLIDGWY

SEQ ID NO: 393856 - protein, 11 aa, Influenza virus
GWEGLIDGWYG

SEQ ID NO: 393857 - protein, 11 aa, Influenza virus
WEGLIDGWYGF

SEQ ID NO: 393858 - protein, 11 aa, Influenza virus
EGLIDGWYGFR

SEQ ID NO: 393859 - protein, 11 aa, Influenza virus
GLIDGWYGFRH

SEQ ID NO: 393860 - protein, 11 aa, Influenza virus
LIDGWYGFRHQ

SEQ ID NO: 393861 - protein, 11 aa, Influenza virus
IDGWYGFRHQN

SEQ ID NO: 393862 - protein, 11 aa, Influenza virus
DGWYGFRHQNA

SEQ ID NO: 393863 - protein, 11 aa, Influenza virus
GWYGFRHQNAQ

SEQ ID NO: 393864 - protein, 11 aa, Influenza virus
WYGFRHQNAQG

SEQ ID NO: 393865 - protein, 11 aa, Influenza virus
YGFRHQNAQGE

SEQ ID NO: 393866 - protein, 11 aa, Influenza virus
GFRHQNAQGEG

SEQ ID NO: 393867 - protein, 11 aa, Influenza virus
FRHQNAQGEGT

SEQ ID NO: 393868 - protein, 11 aa, Influenza virus
RHQNAQGEGTA

SEQ ID NO: 393869 - protein, 11 aa, Influenza virus
HQNAQGEGTAA

SEQ ID NO: 393870 - protein, 11 aa, Influenza virus
QNAQGEGTAAD

SEQ ID NO: 393871 - protein, 11 aa, Influenza virus
NAQGEGTAADY

SEQ ID NO: 393872 - protein, 11 aa, Influenza virus
AQGEGTAADYK

SEQ ID NO: 393873 - protein, 11 aa, Influenza virus
QGEGTAADYKS

SEQ ID NO: 393874 - protein, 11 aa, Influenza virus
GEGTAADYKST

SEQ ID NO: 393875 - protein, 11 aa, Influenza virus
EGTAADYKSTQ

SEQ ID NO: 393876 - protein, 11 aa, Influenza virus
GTAADYKSTQS

SEQ ID NO: 393877 - protein, 11 aa, Influenza virus
TAADYKSTQSA

SEQ ID NO: 393878 - protein, 11 aa, Influenza virus
AADYKSTQSAI

SEQ ID NO: 393879 - protein, 11 aa, Influenza virus
ADYKSTQSAID

SEQ ID NO: 393880 - protein, 11 aa, Influenza virus
DYKSTQSAIDQ

SEQ ID NO: 393881 - protein, 11 aa, Influenza virus
YKSTQSAIDQI

SEQ ID NO: 393882 - protein, 11 aa, Influenza virus
KSTQSAIDQIT

SEQ ID NO: 393883 - protein, 11 aa, Influenza virus
STQSAIDQITG

SEQ ID NO: 393884 - protein, 11 aa, Influenza virus
TQSAIDQITGK

SEQ ID NO: 393885 - protein, 11 aa, Influenza virus
QSAIDQITGKL

SEQ ID NO: 393886 - protein, 11 aa, Influenza virus
SAIDQITGKLN

SEQ ID NO: 393887 - protein, 11 aa, Influenza virus
AIDQITGKLNR

SEQ ID NO: 393888 - protein, 11 aa, Influenza virus
IDQITGKLNRL

SEQ ID NO: 393889 - protein, 11 aa, Influenza virus
DQITGKLNRLI

SEQ ID NO: 393890 - protein, 11 aa, Influenza virus
QITGKLNRLID

SEQ ID NO: 393891 - protein, 11 aa, Influenza virus
ITGKLNRLIDK

SEQ ID NO: 393892 - protein, 11 aa, Influenza virus
TGKLNRLIDKT

SEQ ID NO: 393893 - protein, 11 aa, Influenza virus
GKLNRLIDKTN

SEQ ID NO: 393894 - protein, 11 aa, Influenza virus
KLNRLIDKTNQ

SEQ ID NO: 393895 - protein, 11 aa, Influenza virus
LNRLIDKTNQQ

SEQ ID NO: 393896 - protein, 11 aa, Influenza virus
NRLIDKTNQQF

SEQ ID NO: 393897 - protein, 11 aa, Influenza virus
IDKTNQQFELI

SEQ ID NO: 393898 - protein, 11 aa, Influenza virus
DKTNQQFELID

SEQ ID NO: 393899 - protein, 11 aa, Influenza virus
KTNQQFELIDN

SEQ ID NO: 393900 - protein, 11 aa, Influenza virus
TNQQFELIDNE

SEQ ID NO: 393901 - protein, 11 aa, Influenza virus
NQQFELIDNEF

SEQ ID NO: 393902 - protein, 11 aa, Influenza virus
EIEQQIGNVIN

SEQ ID NO: 393903 - protein, 11 aa, Influenza virus
IEQQIGNVINW

SEQ ID NO: 393904 - protein, 11 aa, Influenza virus
EQQIGNVINWT

SEQ ID NO: 393905 - protein, 11 aa, Influenza virus
QQIGNVINWTR

SEQ ID NO: 393906 - protein, 11 aa, Influenza virus
QIGNVINWTRD

SEQ ID NO: 393907 - protein, 11 aa, Influenza virus
IGNVINWTRDS

SEQ ID NO: 393908 - protein, 11 aa, Influenza virus
GNVINWTRDSM

SEQ ID NO: 393909 - protein, 11 aa, Influenza virus
NVINWTRDSMT

SEQ ID NO: 393910 - protein, 11 aa, Influenza virus
VINWTRDSMTE

SEQ ID NO: 393911 - protein, 11 aa, Influenza virus
INWTRDSMTEV

SEQ ID NO: 393912 - protein, 11 aa, Influenza virus
WTRDSMTEVWS

SEQ ID NO: 393913 - protein, 11 aa, Influenza virus
TRDSMTEVWSY

SEQ ID NO: 393914 - protein, 11 aa, Influenza virus
RDSMTEVWSYN

SEQ ID NO: 393915 - protein, 11 aa, Influenza virus
DSMTEVWSYNA

SEQ ID NO: 393916 - protein, 11 aa, Influenza virus
SMTEVWSYNAE

SEQ ID NO: 393917 - protein, 11 aa, Influenza virus
MTEVWSYNAEL

SEQ ID NO: 393918 - protein, 11 aa, Influenza virus
TEVWSYNAELL

SEQ ID NO: 393919 - protein, 11 aa, Influenza virus
EVWSYNAELLV

SEQ ID NO: 393920 - protein, 11 aa, Influenza virus
VWSYNAELLVA

SEQ ID NO: 393921 - protein, 11 aa, Influenza virus
WSYNAELLVAM

SEQ ID NO: 393922 - protein, 11 aa, Influenza virus
SYNAELLVAME

SEQ ID NO: 393923 - protein, 11 aa, Influenza virus
YNAELLVAMEN

SEQ ID NO: 393924 - protein, 11 aa, Influenza virus
NAELLVAMENQ

SEQ ID NO: 393925 - protein, 11 aa, Influenza virus
AELLVAMENQH

SEQ ID NO: 393926 - protein, 11 aa, Influenza virus
ELLVAMENQHT

SEQ ID NO: 393927 - protein, 11 aa, Influenza virus
LLVAMENQHTI

SEQ ID NO: 393928 - protein, 11 aa, Influenza virus
LVAMENQHTID

SEQ ID NO: 393929 - protein, 11 aa, Influenza virus
VAMENQHTIDL

SEQ ID NO: 393930 - protein, 11 aa, Influenza virus
AMENQHTIDLA

SEQ ID NO: 393931 - protein, 11 aa, Influenza virus
MENQHTIDLAD

SEQ ID NO: 393932 - protein, 11 aa, Influenza virus
ENQHTIDLADS

SEQ ID NO: 393933 - protein, 11 aa, Influenza virus
NQHTIDLADSE

SEQ ID NO: 393934 - protein, 11 aa, Influenza virus
QHTIDLADSEM

SEQ ID NO: 393935 - protein, 11 aa, Influenza virus
HTIDLADSEMN

SEQ ID NO: 393936 - protein, 11 aa, Influenza virus
TIDLADSEMNK

SEQ ID NO: 393937 - protein, 11 aa, Influenza virus
IDLADSEMNKL

SEQ ID NO: 393938 - protein, 11 aa, Influenza virus
DLADSEMNKLY

SEQ ID NO: 393939 - protein, 11 aa, Influenza virus
ADSEMNKLYER

SEQ ID NO: 393940 - protein, 11 aa, Influenza virus
DSEMNKLYERV

SEQ ID NO: 393941 - protein, 11 aa, Influenza virus
KLYERVRKQLR

SEQ ID NO: 393942 - protein, 11 aa, Influenza virus
LYERVRKQLRE

SEQ ID NO: 393943 - protein, 11 aa, Influenza virus
YERVRKQLREN

SEQ ID NO: 393944 - protein, 11 aa, Influenza virus
ERVRKQLRENA

SEQ ID NO: 393945 - protein, 11 aa, Influenza virus
RVRKQLRENAE

SEQ ID NO: 393946 - protein, 11 aa, Influenza virus
VRKQLRENAEE

SEQ ID NO: 393947 - protein, 11 aa, Influenza virus
RKQLRENAEED

SEQ ID NO: 393948 - protein, 11 aa, Influenza virus
KQLRENAEEDG

SEQ ID NO: 393949 - protein, 11 aa, Influenza virus
QLRENAEEDGT

SEQ ID NO: 393950 - protein, 11 aa, Influenza virus
LRENAEEDGTG

SEQ ID NO: 393951 - protein, 11 aa, Influenza virus
RENAEEDGTGC

SEQ ID NO: 393952 - protein, 11 aa, Influenza virus
ENAEEDGTGCF

SEQ ID NO: 393953 - protein, 11 aa, Influenza virus
NAEEDGTGCFE

SEQ ID NO: 393954 - protein, 11 aa, Influenza virus
AEEDGTGCFEI

SEQ ID NO: 393955 - protein, 11 aa, Influenza virus
EEDGTGCFEIF

SEQ ID NO: 393956 - protein, 11 aa, Influenza virus
EDGTGCFEIFH

SEQ ID NO: 393957 - protein, 11 aa, Influenza virus
DGTGCFEIFHK

SEQ ID NO: 393958 - protein, 11 aa, Influenza virus
GTGCFEIFHKC

SEQ ID NO: 393959 - protein, 11 aa, Influenza virus
TGCFEIFHKCD

SEQ ID NO: 393960 - protein, 11 aa, Influenza virus
GCFEIFHKCDD

SEQ ID NO: 393961 - protein, 11 aa, Influenza virus
CMESIRNNTYD

SEQ ID NO: 393962 - protein, 11 aa, Influenza virus
MESIRNNTYDH

SEQ ID NO: 393963 - protein, 11 aa, Influenza virus
ESIRNNTYDHT

SEQ ID NO: 393964 - protein, 11 aa, Influenza virus
QNRIQIDPVKL

SEQ ID NO: 393965 - protein, 11 aa, Influenza virus
SSGYKDIILWF

SEQ ID NO: 393966 - protein, 11 aa, Influenza virus
SGYKDIILWFS

SEQ ID NO: 393967 - protein, 11 aa, Influenza virus
GYKDIILWFSF

SEQ ID NO: 393968 - protein, 11 aa, Influenza virus
YKDIILWFSFG

SEQ ID NO: 393969 - protein, 11 aa, Influenza virus
KDIILWFSFGA

SEQ ID NO: 393970 - protein, 11 aa, Influenza virus
DIILWFSFGAS

SEQ ID NO: 393971 - protein, 11 aa, Influenza virus
IILWFSFGASC

SEQ ID NO: 393972 - protein, 11 aa, Influenza virus
ILWFSFGASCF

SEQ ID NO: 393973 - protein, 11 aa, Influenza virus
LWFSFGASCFL

SEQ ID NO: 393974 - protein, 11 aa, Influenza virus
WFSFGASCFLL

SEQ ID NO: 393975 - protein, 11 aa, Influenza virus
FSFGASCFLLL

SEQ ID NO: 393976 - protein, 11 aa, Influenza virus
SFGASCFLLLA

SEQ ID NO: 393977 - protein, 11 aa, Influenza virus
FGASCFLLLAI

SEQ ID NO: 393978 - protein, 11 aa, Influenza virus
FICIKNGNMRC

SEQ ID NO: 393979 - protein, 11 aa, Influenza virus
ICIKNGNMRCT

SEQ ID NO: 393980 - protein, 11 aa, Influenza virus
CIKNGNMRCTI

SEQ ID NO: 393981 - protein, 11 aa, Influenza virus
IKNGNMRCTIC

SEQ ID NO: 393982 - protein, 11 aa, Influenza virus
KNGNMRCTICI

SEQ ID NO: 393983 - protein, 11 aa, Influenza virus
GVVNTTLSTIA

SEQ ID NO: 393984 - protein, 11 aa, Influenza virus
VVNTTLSTIAL

SEQ ID NO: 393985 - protein, 11 aa, Influenza virus
VNTTLSTIALL

SEQ ID NO: 393986 - protein, 11 aa, Influenza virus
NTTLSTIALLI

SEQ ID NO: 393987 - protein, 11 aa, Influenza virus
TTLSTIALLIG

SEQ ID NO: 393988 - protein, 11 aa, Influenza virus
LSTIALLIGVG

SEQ ID NO: 393989 - protein, 11 aa, Influenza virus
STIALLIGVGN

SEQ ID NO: 393990 - protein, 11 aa, Influenza virus
TIALLIGVGNL

SEQ ID NO: 393991 - protein, 11 aa, Influenza virus
IGVGNLVFNTV

SEQ ID NO: 393992 - protein, 11 aa, Influenza virus
GVGNLVFNTVI

SEQ ID NO: 393993 - protein, 11 aa, Influenza virus
VGNLVFNTVIH

SEQ ID NO: 393994 - protein, 11 aa, Influenza virus
GNLVFNTVIHE

SEQ ID NO: 393995 - protein, 11 aa, Influenza virus
TYNNTVINNIT

SEQ ID NO: 393996 - protein, 11 aa, Influenza virus
YNNTVINNITT

SEQ ID NO: 393997 - protein, 11 aa, Influenza virus
NNTVINNITTT

SEQ ID NO: 393998 - protein, 11 aa, Influenza virus
NTVINNITTTI

SEQ ID NO: 393999 - protein, 11 aa, Influenza virus
TVINNITTTII

SEQ ID NO: 394000 - protein, 11 aa, Influenza virus
PLPLCPFRGFF

SEQ ID NO: 394001 - protein, 11 aa, Influenza virus
LPLCPFRGFFP

SEQ ID NO: 394002 - protein, 11 aa, Influenza virus
PLCPFRGFFPF

SEQ ID NO: 394003 - protein, 11 aa, Influenza virus
LCPFRGFFPFH

SEQ ID NO: 394004 - protein, 11 aa, Influenza virus
CPFRGFFPFHK

SEQ ID NO: 394005 - protein, 11 aa, Influenza virus
PFRGFFPFHKD

SEQ ID NO: 394006 - protein, 11 aa, Influenza virus
FRGFFPFHKDN

SEQ ID NO: 394007 - protein, 11 aa, Influenza virus
RGFFPFHKDNA

SEQ ID NO: 394008 - protein, 11 aa, Influenza virus
GFFPFHKDNAI

SEQ ID NO: 394009 - protein, 11 aa, Influenza virus
FFPFHKDNAIR

SEQ ID NO: 394010 - protein, 11 aa, Influenza virus
FPFHKDNAIRL

SEQ ID NO: 394011 - protein, 11 aa, Influenza virus
PFHKDNAIRLG

SEQ ID NO: 394012 - protein, 11 aa, Influenza virus
FHKDNAIRLGE

SEQ ID NO: 394013 - protein, 11 aa, Influenza virus
HKDNAIRLGEN

SEQ ID NO: 394014 - protein, 11 aa, Influenza virus
KDNAIRLGENK

SEQ ID NO: 394015 - protein, 11 aa, Influenza virus
VIVTREPYVSC

SEQ ID NO: 394016 - protein, 11 aa, Influenza virus
IVTREPYVSCD

SEQ ID NO: 394017 - protein, 11 aa, Influenza virus
VTREPYVSCDN

SEQ ID NO: 394018 - protein, 11 aa, Influenza virus
NCWSFALAQGA

SEQ ID NO: 394019 - protein, 11 aa, Influenza virus
CWSFALAQGAL

SEQ ID NO: 394020 - protein, 11 aa, Influenza virus
WSFALAQGALL

SEQ ID NO: 394021 - protein, 11 aa, Influenza virus
SFALAQGALLG

SEQ ID NO: 394022 - protein, 11 aa, Influenza virus
FALAQGALLGT

SEQ ID NO: 394023 - protein, 11 aa, Influenza virus
ALAQGALLGTK

SEQ ID NO: 394024 - protein, 11 aa, Influenza virus
LAQGALLGTKH

SEQ ID NO: 394025 - protein, 11 aa, Influenza virus
AQGALLGTKHS

SEQ ID NO: 394026 - protein, 11 aa, Influenza virus
QGALLGTKHSN

SEQ ID NO: 394027 - protein, 11 aa, Influenza virus
GALLGTKHSNG

SEQ ID NO: 394028 - protein, 11 aa, Influenza virus
ALLGTKHSNGT

SEQ ID NO: 394029 - protein, 11 aa, Influenza virus
DRTPYRSLIRF

SEQ ID NO: 394030 - protein, 11 aa, Influenza virus
RTPYRSLIRFP

SEQ ID NO: 394031 - protein, 11 aa, Influenza virus
TPYRSLIRFPI

SEQ ID NO: 394032 - protein, 11 aa, Influenza virus
PYRSLIRFPIG

SEQ ID NO: 394033 - protein, 11 aa, Influenza virus
YRSLIRFPIGT

SEQ ID NO: 394034 - protein, 11 aa, Influenza virus
RSLIRFPIGTA

SEQ ID NO: 394035 - protein, 11 aa, Influenza virus
SLIRFPIGTAP

SEQ ID NO: 394036 - protein, 11 aa, Influenza virus
FPIGTAPVLGN

SEQ ID NO: 394037 - protein, 11 aa, Influenza virus
PIGTAPVLGNY

SEQ ID NO: 394038 - protein, 11 aa, Influenza virus
GTAPVLGNYKE

SEQ ID NO: 394039 - protein, 11 aa, Influenza virus
APVLGNYKEIC

SEQ ID NO: 394040 - protein, 11 aa, Influenza virus
LGNYKEICIAW

SEQ ID NO: 394041 - protein, 11 aa, Influenza virus
GNYKEICIAWS

SEQ ID NO: 394042 - protein, 11 aa, Influenza virus
NYKEICIAWSS

SEQ ID NO: 394043 - protein, 11 aa, Influenza virus
EICIAWSSSSC

SEQ ID NO: 394044 - protein, 11 aa, Influenza virus
ICIAWSSSSCF

SEQ ID NO: 394045 - protein, 11 aa, Influenza virus
CIAWSSSSCFD

SEQ ID NO: 394046 - protein, 11 aa, Influenza virus
IAWSSSSCFDG

SEQ ID NO: 394047 - protein, 11 aa, Influenza virus
AWSSSSCFDGK

SEQ ID NO: 394048 - protein, 11 aa, Influenza virus
WSSSSCFDGKE

SEQ ID NO: 394049 - protein, 11 aa, Influenza virus
SSSSCFDGKEW

SEQ ID NO: 394050 - protein, 11 aa, Influenza virus
SSSCFDGKEWM

SEQ ID NO: 394051 - protein, 11 aa, Influenza virus
SSCFDGKEWMH

SEQ ID NO: 394052 - protein, 11 aa, Influenza virus
SCFDGKEWMHV

SEQ ID NO: 394053 - protein, 11 aa, Influenza virus
CFDGKEWMHVC

SEQ ID NO: 394054 - protein, 11 aa, Influenza virus
FDGKEWMHVCM

SEQ ID NO: 394055 - protein, 11 aa, Influenza virus
DGKEWMHVCMT

SEQ ID NO: 394056 - protein, 11 aa, Influenza virus
GKEWMHVCMTG

SEQ ID NO: 394057 - protein, 11 aa, Influenza virus
GRMTDSIKSWR

SEQ ID NO: 394058 - protein, 11 aa, Influenza virus
MTDSIKSWRKD

SEQ ID NO: 394059 - protein, 11 aa, Influenza virus
TDSIKSWRKDI

SEQ ID NO: 394060 - protein, 11 aa, Influenza virus
DSIKSWRKDIL

SEQ ID NO: 394061 - protein, 11 aa, Influenza virus
SIKSWRKDILR

SEQ ID NO: 394062 - protein, 11 aa, Influenza virus
IKSWRKDILRT

SEQ ID NO: 394063 - protein, 11 aa, Influenza virus
KSWRKDILRTQ

SEQ ID NO: 394064 - protein, 11 aa, Influenza virus
SWRKDILRTQE

SEQ ID NO: 394065 - protein, 11 aa, Influenza virus
WRKDILRTQES

SEQ ID NO: 394066 - protein, 11 aa, Influenza virus
RKDILRTQESE

SEQ ID NO: 394067 - protein, 11 aa, Influenza virus
KDILRTQESEC

SEQ ID NO: 394068 - protein, 11 aa, Influenza virus
DILRTQESECQ

SEQ ID NO: 394069 - protein, 11 aa, Influenza virus
ILRTQESECQC

SEQ ID NO: 394070 - protein, 11 aa, Influenza virus
LRTQESECQCI

SEQ ID NO: 394071 - protein, 11 aa, Influenza virus
RTQESECQCID

SEQ ID NO: 394072 - protein, 11 aa, Influenza virus
TQESECQCIDG

SEQ ID NO: 394073 - protein, 11 aa, Influenza virus
GTCVVAVTDGP

SEQ ID NO: 394074 - protein, 11 aa, Influenza virus
TCVVAVTDGPA

SEQ ID NO: 394075 - protein, 11 aa, Influenza virus
CVVAVTDGPAA

SEQ ID NO: 394076 - protein, 11 aa, Influenza virus
VVAVTDGPAAN

SEQ ID NO: 394077 - protein, 11 aa, Influenza virus
VAVTDGPAANS

SEQ ID NO: 394078 - protein, 11 aa, Influenza virus
AVTDGPAANSA

SEQ ID NO: 394079 - protein, 11 aa, Influenza virus
VTDGPAANSAD

SEQ ID NO: 394080 - protein, 11 aa, Influenza virus
TDGPAANSADH

SEQ ID NO: 394081 - protein, 11 aa, Influenza virus
DGPAANSADHR

SEQ ID NO: 394082 - protein, 11 aa, Influenza virus
GPAANSADHRV

SEQ ID NO: 394083 - protein, 11 aa, Influenza virus
PAANSADHRVY

SEQ ID NO: 394084 - protein, 11 aa, Influenza virus
AANSADHRVYW

SEQ ID NO: 394085 - protein, 11 aa, Influenza virus
ANSADHRVYWI

SEQ ID NO: 394086 - protein, 11 aa, Influenza virus
NSADHRVYWIR

SEQ ID NO: 394087 - protein, 11 aa, Influenza virus
SADHRVYWIRE

SEQ ID NO: 394088 - protein, 11 aa, Influenza virus
ADHRVYWIREG

SEQ ID NO: 394089 - protein, 11 aa, Influenza virus
KIQHLEECSCY

SEQ ID NO: 394090 - protein, 11 aa, Influenza virus
IQHLEECSCYV

SEQ ID NO: 394091 - protein, 11 aa, Influenza virus
QHLEECSCYVD

SEQ ID NO: 394092 - protein, 11 aa, Influenza virus
HLEECSCYVDI

SEQ ID NO: 394093 - protein, 11 aa, Influenza virus
LEECSCYVDID

SEQ ID NO: 394094 - protein, 11 aa, Influenza virus
EECSCYVDIDV

SEQ ID NO: 394095 - protein, 11 aa, Influenza virus
ECSCYVDIDVY

SEQ ID NO: 394096 - protein, 11 aa, Influenza virus
CSCYVDIDVYC

SEQ ID NO: 394097 - protein, 11 aa, Influenza virus
DIDVYCICRDN

SEQ ID NO: 394098 - protein, 11 aa, Influenza virus
IDVYCICRDNW

SEQ ID NO: 394099 - protein, 11 aa, Influenza virus
DVYCICRDNWK

SEQ ID NO: 394100 - protein, 11 aa, Influenza virus
VYCICRDNWKG

SEQ ID NO: 394101 - protein, 11 aa, Influenza virus
YCICRDNWKGS

SEQ ID NO: 394102 - protein, 11 aa, Influenza virus
CICRDNWKGSN

SEQ ID NO: 394103 - protein, 11 aa, Influenza virus
ICRDNWKGSNR

SEQ ID NO: 394104 - protein, 11 aa, Influenza virus
CRDNWKGSNRP

SEQ ID NO: 394105 - protein, 11 aa, Influenza virus
RDNWKGSNRPW

SEQ ID NO: 394106 - protein, 11 aa, Influenza virus
DNWKGSNRPWM

SEQ ID NO: 394107 - protein, 11 aa, Influenza virus
NWKGSNRPWMR

SEQ ID NO: 394108 - protein, 11 aa, Influenza virus
WKGSNRPWMRI

SEQ ID NO: 394109 - protein, 11 aa, Influenza virus
KGSNRPWMRIN

SEQ ID NO: 394110 - protein, 11 aa, Influenza virus
GSNRPWMRINN

SEQ ID NO: 394111 - protein, 11 aa, Influenza virus
SNRPWMRINNE

SEQ ID NO: 394112 - protein, 11 aa, Influenza virus
NRPWMRINNET

SEQ ID NO: 394113 - protein, 11 aa, Influenza virus
RPWMRINNETI

SEQ ID NO: 394114 - protein, 11 aa, Influenza virus
PWMRINNETIL

SEQ ID NO: 394115 - protein, 11 aa, Influenza virus
WMRINNETILE

SEQ ID NO: 394116 - protein, 11 aa, Influenza virus
MRINNETILET

SEQ ID NO: 394117 - protein, 11 aa, Influenza virus
RINNETILETG

SEQ ID NO: 394118 - protein, 11 aa, Influenza virus
INNETILETGY

SEQ ID NO: 394119 - protein, 11 aa, Influenza virus
NNETILETGYV

SEQ ID NO: 394120 - protein, 11 aa, Influenza virus
NETILETGYVC

SEQ ID NO: 394121 - protein, 11 aa, Influenza virus
ETILETGYVCS

SEQ ID NO: 394122 - protein, 11 aa, Influenza virus
TILETGYVCSK

SEQ ID NO: 394123 - protein, 11 aa, Influenza virus
ILETGYVCSKF

SEQ ID NO: 394124 - protein, 11 aa, Influenza virus
LETGYVCSKFH

SEQ ID NO: 394125 - protein, 11 aa, Influenza virus
ETGYVCSKFHS

SEQ ID NO: 394126 - protein, 11 aa, Influenza virus
TGYVCSKFHSD

SEQ ID NO: 394127 - protein, 11 aa, Influenza virus
GYVCSKFHSDT

SEQ ID NO: 394128 - protein, 11 aa, Influenza virus
YVCSKFHSDTP

SEQ ID NO: 394129 - protein, 11 aa, Influenza virus
VCSKFHSDTPR

SEQ ID NO: 394130 - protein, 11 aa, Influenza virus
CSKFHSDTPRP

SEQ ID NO: 394131 - protein, 11 aa, Influenza virus
SKFHSDTPRPA

SEQ ID NO: 394132 - protein, 11 aa, Influenza virus
KFHSDTPRPAD

SEQ ID NO: 394133 - protein, 11 aa, Influenza virus
FHSDTPRPADP

SEQ ID NO: 394134 - protein, 11 aa, Influenza virus
HSDTPRPADPS

SEQ ID NO: 394135 - protein, 11 aa, Influenza virus
DPSTVSCDSPS

SEQ ID NO: 394136 - protein, 11 aa, Influenza virus
PSTVSCDSPSN

SEQ ID NO: 394137 - protein, 11 aa, Influenza virus
SCDSPSNVNGG

SEQ ID NO: 394138 - protein, 11 aa, Influenza virus
NGGPGVKGFGF

SEQ ID NO: 394139 - protein, 11 aa, Influenza virus
GGPGVKGFGFK

SEQ ID NO: 394140 - protein, 11 aa, Influenza virus
GNDVWLGRTVS

SEQ ID NO: 394141 - protein, 11 aa, Influenza virus
NDVWLGRTVST

SEQ ID NO: 394142 - protein, 11 aa, Influenza virus
DVWLGRTVSTS

SEQ ID NO: 394143 - protein, 11 aa, Influenza virus
VWLGRTVSTSG

SEQ ID NO: 394144 - protein, 11 aa, Influenza virus
WLGRTVSTSGR

SEQ ID NO: 394145 - protein, 11 aa, Influenza virus
LGRTVSTSGRS

SEQ ID NO: 394146 - protein, 11 aa, Influenza virus
EGWINSPNHAK

SEQ ID NO: 394147 - protein, 11 aa, Influenza virus
GWINSPNHAKS

SEQ ID NO: 394148 - protein, 11 aa, Influenza virus
AKSVTQTLVSN

SEQ ID NO: 394149 - protein, 11 aa, Influenza virus
KSITQTLVSNN

SEQ ID NO: 394150 - protein, 11 aa, Influenza virus
SITQTLVSNND

SEQ ID NO: 394151 - protein, 11 aa, Influenza virus
ITQTLVSNNDW

SEQ ID NO: 394152 - protein, 11 aa, Influenza virus
TQTLVSNNDWS

SEQ ID NO: 394153 - protein, 11 aa, Influenza virus
QTLVSNNDWSG

SEQ ID NO: 394154 - protein, 11 aa, Influenza virus
TLVSNNDWSGY

SEQ ID NO: 394155 - protein, 11 aa, Influenza virus
LVSNNDWSGYS

SEQ ID NO: 394156 - protein, 11 aa, Influenza virus
VSNNDWSGYSG

SEQ ID NO: 394157 - protein, 11 aa, Influenza virus
SNNDWSGYSGS

SEQ ID NO: 394158 - protein, 11 aa, Influenza virus
NNDWSGYSGSF

SEQ ID NO: 394159 - protein, 11 aa, Influenza virus
NDWSGYSGSFI

SEQ ID NO: 394160 - protein, 11 aa, Influenza virus
DWSGYSGSFIV

SEQ ID NO: 394161 - protein, 11 aa, Influenza virus
DCFQPCFYVEL

SEQ ID NO: 394162 - protein, 11 aa, Influenza virus
CFQPCFYVELI

SEQ ID NO: 394163 - protein, 11 aa, Influenza virus
FQPCFYVELIR

SEQ ID NO: 394164 - protein, 11 aa, Influenza virus
QPCFYVELIRG

SEQ ID NO: 394165 - protein, 11 aa, Influenza virus
PCFYVELIRGR

SEQ ID NO: 394166 - protein, 11 aa, Influenza virus
CFYVELIRGRP

SEQ ID NO: 394167 - protein, 11 aa, Influenza virus
FYVELIRGRPN

SEQ ID NO: 394168 - protein, 11 aa, Influenza virus
DDVSWTSNSIV

SEQ ID NO: 394169 - protein, 11 aa, Influenza virus
DVSWTSNSIVT

SEQ ID NO: 394170 - protein, 11 aa, Influenza virus
VSWTSNSIVTF

SEQ ID NO: 394171 - protein, 11 aa, Influenza virus
SWTSNSIVTFC

SEQ ID NO: 394172 - protein, 11 aa, Influenza virus
WTSNSIVTFCG

SEQ ID NO: 394173 - protein, 11 aa, Influenza virus
TSNSIVTFCGL

SEQ ID NO: 394174 - protein, 11 aa, Influenza virus
SNSIVTFCGLD

SEQ ID NO: 394175 - protein, 11 aa, Influenza virus
NSIVTFCGLDN

SEQ ID NO: 394176 - protein, 11 aa, Influenza virus
SIVTFCGLDNE

SEQ ID NO: 394177 - protein, 11 aa, Influenza virus
IVTFCGLDNEP

SEQ ID NO: 394178 - protein, 11 aa, Influenza virus
VTFCGLDNEPG

SEQ ID NO: 394179 - protein, 11 aa, Influenza virus
TFCGLDNEPGS

SEQ ID NO: 394180 - protein, 11 aa, Influenza virus
FCGLDNEPGSG

SEQ ID NO: 394181 - protein, 11 aa, Influenza virus
CGLDNEPGSGN

SEQ ID NO: 394182 - protein, 11 aa, Influenza virus
GLDNEPGSGNW

SEQ ID NO: 394183 - protein, 11 aa, Influenza virus
LDNEPGSGNWP

SEQ ID NO: 394184 - protein, 11 aa, Influenza virus
DNEPGSGNWPD

SEQ ID NO: 394185 - protein, 11 aa, Influenza virus
NEPGSGNWPDG

SEQ ID NO: 394186 - protein, 11 aa, Influenza virus
EPGSGNWPDGS

SEQ ID NO: 394187 - protein, 11 aa, Influenza virus
PGSGNWPDGSN

SEQ ID NO: 394188 - protein, 11 aa, Influenza virus
GSGNWPDGSNI

SEQ ID NO: 394189 - protein, 11 aa, Influenza virus
SGNWPDGSNIG

SEQ ID NO: 394190 - protein, 11 aa, Influenza virus
GNWPDGSNIGF

SEQ ID NO: 394191 - protein, 11 aa, Influenza virus
NWPDGSNIGFM

SEQ ID NO: 394192 - protein, 11 aa, Influenza virus
WPDGSNIGFMP

SEQ ID NO: 394193 - protein, 11 aa, Influenza virus
PDGSNIGFMPK

SEQ ID NO: 394194 - protein, 11 aa, Influenza virus
SKSRGYKMNTQ

SEQ ID NO: 394195 - protein, 11 aa, Influenza virus
KSRGYKMNTQI

SEQ ID NO: 394196 - protein, 11 aa, Influenza virus
SRGYKMNTQIL

SEQ ID NO: 394197 - protein, 11 aa, Influenza virus
RGYKMNTQILV

SEQ ID NO: 394198 - protein, 11 aa, Influenza virus
GYKMNTQILVF

SEQ ID NO: 394199 - protein, 11 aa, Influenza virus
YKMNTQILVFA

SEQ ID NO: 394200 - protein, 11 aa, Influenza virus
KMNTQILVFAL

SEQ ID NO: 394201 - protein, 11 aa, Influenza virus
GCDHSDNADKI

SEQ ID NO: 394202 - protein, 11 aa, Influenza virus
CDHSDNADKIC

SEQ ID NO: 394203 - protein, 11 aa, Influenza virus
DHSDNADKICL

SEQ ID NO: 394204 - protein, 11 aa, Influenza virus
HSDNADKICLG

SEQ ID NO: 394205 - protein, 11 aa, Influenza virus
SDNADKICLGH

SEQ ID NO: 394206 - protein, 11 aa, Influenza virus
DNADKICLGHH

SEQ ID NO: 394207 - protein, 11 aa, Influenza virus
ADKICLGHHAV

SEQ ID NO: 394208 - protein, 11 aa, Influenza virus
NGTKVNTLTER

SEQ ID NO: 394209 - protein, 11 aa, Influenza virus
KVNTLTERGVE

SEQ ID NO: 394210 - protein, 11 aa, Influenza virus
VNTLTERGVEV

SEQ ID NO: 394211 - protein, 11 aa, Influenza virus
NTLTERGVEVV

SEQ ID NO: 394212 - protein, 11 aa, Influenza virus
TLTERGVEVVN

SEQ ID NO: 394213 - protein, 11 aa, Influenza virus
LTERGVEVVNA

SEQ ID NO: 394214 - protein, 11 aa, Influenza virus
TERGVEVVNAT

SEQ ID NO: 394215 - protein, 11 aa, Influenza virus
ERGVEVVNATE

SEQ ID NO: 394216 - protein, 11 aa, Influenza virus
RGVEVVNATET

SEQ ID NO: 394217 - protein, 11 aa, Influenza virus
GVEVVNATETV

SEQ ID NO: 394218 - protein, 11 aa, Influenza virus
VEVVNATETVE

SEQ ID NO: 394219 - protein, 11 aa, Influenza virus
EVVNATETVER

SEQ ID NO: 394220 - protein, 11 aa, Influenza virus
TGPPQCDQFLE

SEQ ID NO: 394221 - protein, 11 aa, Influenza virus
GPPQCDQFLEF

SEQ ID NO: 394222 - protein, 11 aa, Influenza virus
GFTYSGIRTNG

SEQ ID NO: 394223 - protein, 11 aa, Influenza virus
RSGSSFYAEMK

SEQ ID NO: 394224 - protein, 11 aa, Influenza virus
SGSSFYAEMKW

SEQ ID NO: 394225 - protein, 11 aa, Influenza virus
GSSFYAEMKWL

SEQ ID NO: 394226 - protein, 11 aa, Influenza virus
SSFYAEMKWLL

SEQ ID NO: 394227 - protein, 11 aa, Influenza virus
SFYAEMKWLLS

SEQ ID NO: 394228 - protein, 11 aa, Influenza virus
FYAEMKWLLSN

SEQ ID NO: 394229 - protein, 11 aa, Influenza virus
RPQVNGQSGRI

SEQ ID NO: 394230 - protein, 11 aa, Influenza virus
PQVNGQSGRID

SEQ ID NO: 394231 - protein, 11 aa, Influenza virus
QVNGQSGRIDF

SEQ ID NO: 394232 - protein, 11 aa, Influenza virus
VNGQSGRIDFH

SEQ ID NO: 394233 - protein, 11 aa, Influenza virus
NGQSGRIDFHW

SEQ ID NO: 394234 - protein, 11 aa, Influenza virus
GQSGRIDFHWL

SEQ ID NO: 394235 - protein, 11 aa, Influenza virus
NDTVTFSFNGA

SEQ ID NO: 394236 - protein, 11 aa, Influenza virus
DTVTFSFNGAF

SEQ ID NO: 394237 - protein, 11 aa, Influenza virus
TFSFNGAFIAP

SEQ ID NO: 394238 - protein, 11 aa, Influenza virus
FNGAFIAPDRA

SEQ ID NO: 394239 - protein, 11 aa, Influenza virus
NGAFIAPDRAS

SEQ ID NO: 394240 - protein, 11 aa, Influenza virus
GAFIAPDRASF

SEQ ID NO: 394241 - protein, 11 aa, Influenza virus
SLLLATGMKNV

SEQ ID NO: 394242 - protein, 11 aa, Influenza virus
LLLATGMKNVP

SEQ ID NO: 394243 - protein, 11 aa, Influenza virus
LLATGMKNVPE

SEQ ID NO: 394244 - protein, 11 aa, Influenza virus
THKQLTHHMRK

SEQ ID NO: 394245 - protein, 11 aa, Influenza virus
HKQLTHHMRKK

SEQ ID NO: 394246 - protein, 11 aa, Influenza virus
KQLTHHMRKKR

SEQ ID NO: 394247 - protein, 11 aa, Influenza virus
QLTHHMRKKRG

SEQ ID NO: 394248 - protein, 11 aa, Influenza virus
LTHHMRKKRGL

SEQ ID NO: 394249 - protein, 11 aa, Influenza virus
THHMRKKRGLF

SEQ ID NO: 394250 - protein, 11 aa, Influenza virus
HHMRKKRGLFG

SEQ ID NO: 394251 - protein, 11 aa, Influenza virus
HMRKKRGLFGA

SEQ ID NO: 394252 - protein, 11 aa, Influenza virus
MRKKRGLFGAI

SEQ ID NO: 394253 - protein, 11 aa, Influenza virus
EKRGLFGAIAG

SEQ ID NO: 394254 - protein, 11 aa, Influenza virus
RGLFGAIAGFI

SEQ ID NO: 394255 - protein, 11 aa, Influenza virus
GLFGAIAGFIE

SEQ ID NO: 394256 - protein, 11 aa, Influenza virus
LFGAIAGFIEN

SEQ ID NO: 394257 - protein, 11 aa, Influenza virus
FGAIAGFIENG

SEQ ID NO: 394258 - protein, 11 aa, Influenza virus
GAIAGFIENGW

SEQ ID NO: 394259 - protein, 11 aa, Influenza virus
AIAGFIENGWE

SEQ ID NO: 394260 - protein, 11 aa, Influenza virus
IAGFIENGWEG

SEQ ID NO: 394261 - protein, 11 aa, Influenza virus
AGFIENGWEGL

SEQ ID NO: 394262 - protein, 11 aa, Influenza virus
GFIENGWEGLI

SEQ ID NO: 394263 - protein, 11 aa, Influenza virus
FIENGWEGLID

SEQ ID NO: 394264 - protein, 11 aa, Influenza virus
IENGWEGLIDG

SEQ ID NO: 394265 - protein, 11 aa, Influenza virus
ENGWEGLIDGW

SEQ ID NO: 394266 - protein, 11 aa, Influenza virus
NGWEGLIDGWY

SEQ ID NO: 394267 - protein, 11 aa, Influenza virus
GWEGLIDGWYG

SEQ ID NO: 394268 - protein, 11 aa, Influenza virus
WEGLIDGWYGF

SEQ ID NO: 394269 - protein, 11 aa, Influenza virus
EGLIDGWYGFR

SEQ ID NO: 394270 - protein, 11 aa, Influenza virus
GLIDGWYGFRH

SEQ ID NO: 394271 - protein, 11 aa, Influenza virus
LIDGWYGFRHQ

SEQ ID NO: 394272 - protein, 11 aa, Influenza virus
IDGWYGFRHQN

SEQ ID NO: 394273 - protein, 11 aa, Influenza virus
DGWYGFRHQNA

SEQ ID NO: 394274 - protein, 11 aa, Influenza virus
GWYGFRHQNAQ

SEQ ID NO: 394275 - protein, 11 aa, Influenza virus
WYGFRHQNAQG

SEQ ID NO: 394276 - protein, 11 aa, Influenza virus
YGFRHQNAQGE

SEQ ID NO: 394277 - protein, 11 aa, Influenza virus
GFRHQNAQGEG

SEQ ID NO: 394278 - protein, 11 aa, Influenza virus
RHQNAQGEGTA

SEQ ID NO: 394279 - protein, 11 aa, Influenza virus
HQNAQGEGTAA

SEQ ID NO: 394280 - protein, 11 aa, Influenza virus
QNAQGEGTAAD

SEQ ID NO: 394281 - protein, 11 aa, Influenza virus
NAQGEGTAADY

SEQ ID NO: 394282 - protein, 11 aa, Influenza virus
AQGEGTAADYK

SEQ ID NO: 394283 - protein, 11 aa, Influenza virus
QGEGTAADYKS

SEQ ID NO: 394284 - protein, 11 aa, Influenza virus
GEGTAADYKST

SEQ ID NO: 394285 - protein, 11 aa, Influenza virus
EGTAADYKSTQ

SEQ ID NO: 394286 - protein, 11 aa, Influenza virus
GTAADYKSTQS

SEQ ID NO: 394287 - protein, 11 aa, Influenza virus
TAADYKSTQSA

SEQ ID NO: 394288 - protein, 11 aa, Influenza virus
AADYKSTQSAI

SEQ ID NO: 394289 - protein, 11 aa, Influenza virus
ADYKSTQSAID

SEQ ID NO: 394290 - protein, 11 aa, Influenza virus
DYKSTQSAIDQ

SEQ ID NO: 394291 - protein, 11 aa, Influenza virus
YKSTQSAIDQI

SEQ ID NO: 394292 - protein, 11 aa, Influenza virus
KSTQSAIDQIT

SEQ ID NO: 394293 - protein, 11 aa, Influenza virus
STQSAIDQITG

SEQ ID NO: 394294 - protein, 11 aa, Influenza virus
TQSAIDQITGK

SEQ ID NO: 394295 - protein, 11 aa, Influenza virus
QSAIDQITGKL

SEQ ID NO: 394296 - protein, 11 aa, Influenza virus
SAIDQITGKLN

SEQ ID NO: 394297 - protein, 11 aa, Influenza virus
AIDQITGKLNR

SEQ ID NO: 394298 - protein, 11 aa, Influenza virus
IDQITGKLNRL

SEQ ID NO: 394299 - protein, 11 aa, Influenza virus
DQITGKLNRLI

SEQ ID NO: 394300 - protein, 11 aa, Influenza virus
QITGKLNRLIE

SEQ ID NO: 394301 - protein, 11 aa, Influenza virus
ITGKLNRLIEK

SEQ ID NO: 394302 - protein, 11 aa, Influenza virus
TGKLNRLIEKT

SEQ ID NO: 394303 - protein, 11 aa, Influenza virus
GKLNRLIEKTN

SEQ ID NO: 394304 - protein, 11 aa, Influenza virus
KLNRLIEKTNQ

SEQ ID NO: 394305 - protein, 11 aa, Influenza virus
LNRLIEKTNQQ

SEQ ID NO: 394306 - protein, 11 aa, Influenza virus
NRLIEKTNQQF

SEQ ID NO: 394307 - protein, 11 aa, Influenza virus
RLIEKTNQQFE

SEQ ID NO: 394308 - protein, 11 aa, Influenza virus
LIEKTNQQFEL

SEQ ID NO: 394309 - protein, 11 aa, Influenza virus
IEKTNQQFELI

SEQ ID NO: 394310 - protein, 11 aa, Influenza virus
EKTNQQFELID

SEQ ID NO: 394311 - protein, 11 aa, Influenza virus
KTNQQFELIDN

SEQ ID NO: 394312 - protein, 11 aa, Influenza virus
TNQQFELIDNE

SEQ ID NO: 394313 - protein, 11 aa, Influenza virus
NQQFELIDNEF

SEQ ID NO: 394314 - protein, 11 aa, Influenza virus
QQFELIDNEFT

SEQ ID NO: 394315 - protein, 11 aa, Influenza virus
QFELIDNEFTE

SEQ ID NO: 394316 - protein, 11 aa, Influenza virus
EVEKQIGNVIN

SEQ ID NO: 394317 - protein, 11 aa, Influenza virus
VEKQIGNVINW

SEQ ID NO: 394318 - protein, 11 aa, Influenza virus
EKQIGNVINWT

SEQ ID NO: 394319 - protein, 11 aa, Influenza virus
KQIGNVINWTR

SEQ ID NO: 394320 - protein, 11 aa, Influenza virus
QIGNVINWTRD

SEQ ID NO: 394321 - protein, 11 aa, Influenza virus
IGNVINWTRDS

SEQ ID NO: 394322 - protein, 11 aa, Influenza virus
GNVINWTRDSM

SEQ ID NO: 394323 - protein, 11 aa, Influenza virus
NVINWTRDSMT

SEQ ID NO: 394324 - protein, 11 aa, Influenza virus
VINWTRDSMTE

SEQ ID NO: 394325 - protein, 11 aa, Influenza virus
TEVWSYNAELL

SEQ ID NO: 394326 - protein, 11 aa, Influenza virus
WSYNAELLVAM

SEQ ID NO: 394327 - protein, 11 aa, Influenza virus
SYNAELLVAME

SEQ ID NO: 394328 - protein, 11 aa, Influenza virus
YNAELLVAMEN

SEQ ID NO: 394329 - protein, 11 aa, Influenza virus
NAELLVAMENQ

SEQ ID NO: 394330 - protein, 11 aa, Influenza virus
AELLVAMENQH

SEQ ID NO: 394331 - protein, 11 aa, Influenza virus
ELLVAMENQHT

SEQ ID NO: 394332 - protein, 11 aa, Influenza virus
LLVAMENQHTI

SEQ ID NO: 394333 - protein, 11 aa, Influenza virus
LVAMENQHTID

SEQ ID NO: 394334 - protein, 11 aa, Influenza virus
VAMENQHTIDL

SEQ ID NO: 394335 - protein, 11 aa, Influenza virus
AMENQHTIDLA

SEQ ID NO: 394336 - protein, 11 aa, Influenza virus
ENQHTIDLADS

SEQ ID NO: 394337 - protein, 11 aa, Influenza virus
NQHTIDLADSE

SEQ ID NO: 394338 - protein, 11 aa, Influenza virus
QHTIDLADSEM

SEQ ID NO: 394339 - protein, 11 aa, Influenza virus
HTIDLADSEMN

SEQ ID NO: 394340 - protein, 11 aa, Influenza virus
TIDLADSEMNK

SEQ ID NO: 394341 - protein, 11 aa, Influenza virus
IDLADSEMNKL

SEQ ID NO: 394342 - protein, 11 aa, Influenza virus
DLADSEMNKLY

SEQ ID NO: 394343 - protein, 11 aa, Influenza virus
LADSEMNKLYE

SEQ ID NO: 394344 - protein, 11 aa, Influenza virus
ADSEMNKLYER

SEQ ID NO: 394345 - protein, 11 aa, Influenza virus
DSEMNKLYERV

SEQ ID NO: 394346 - protein, 11 aa, Influenza virus
SEMNKLYERVR

SEQ ID NO: 394347 - protein, 11 aa, Influenza virus
EMNKLYERVKR

SEQ ID NO: 394348 - protein, 11 aa, Influenza virus
MNKLYERVKRQ

SEQ ID NO: 394349 - protein, 11 aa, Influenza virus
NKLYERVKRQL

SEQ ID NO: 394350 - protein, 11 aa, Influenza virus
KLYERVKRQLR

SEQ ID NO: 394351 - protein, 11 aa, Influenza virus
LYERVKRQLRE

SEQ ID NO: 394352 - protein, 11 aa, Influenza virus
YERVKRQLREN

SEQ ID NO: 394353 - protein, 11 aa, Influenza virus
ERVKRQLRENA

SEQ ID NO: 394354 - protein, 11 aa, Influenza virus
RVKRQLRENAE

SEQ ID NO: 394355 - protein, 11 aa, Influenza virus
VRRQLRENAEE

SEQ ID NO: 394356 - protein, 11 aa, Influenza virus
RRQLRENAEED

SEQ ID NO: 394357 - protein, 11 aa, Influenza virus
RQLRENAEEDG

SEQ ID NO: 394358 - protein, 11 aa, Influenza virus
QLRENAEEDGT

SEQ ID NO: 394359 - protein, 11 aa, Influenza virus
LRENAEEDGTG

SEQ ID NO: 394360 - protein, 11 aa, Influenza virus
RENAEEDGTGC

SEQ ID NO: 394361 - protein, 11 aa, Influenza virus
ENAEEDGTGCF

SEQ ID NO: 394362 - protein, 11 aa, Influenza virus
NAEEDGTGCFE

SEQ ID NO: 394363 - protein, 11 aa, Influenza virus
AEEDGTGCFEI

SEQ ID NO: 394364 - protein, 11 aa, Influenza virus
EEDGTGCFEIF

SEQ ID NO: 394365 - protein, 11 aa, Influenza virus
EDGTGCFEIFH

SEQ ID NO: 394366 - protein, 11 aa, Influenza virus
DGTGCFEIFHK

SEQ ID NO: 394367 - protein, 11 aa, Influenza virus
GTGCFEIFHKC

SEQ ID NO: 394368 - protein, 11 aa, Influenza virus
TGCFEIFHKCD

SEQ ID NO: 394369 - protein, 11 aa, Influenza virus
GCFEIFHKCDD

SEQ ID NO: 394370 - protein, 11 aa, Influenza virus
CFEIFHKCDDD

SEQ ID NO: 394371 - protein, 11 aa, Influenza virus
FEIFHKCDDDC

SEQ ID NO: 394372 - protein, 11 aa, Influenza virus
EIFHKCDDDCM

SEQ ID NO: 394373 - protein, 11 aa, Influenza virus
CMASIRNNTYD

SEQ ID NO: 394374 - protein, 11 aa, Influenza virus
MASIRNNTYDH

SEQ ID NO: 394375 - protein, 11 aa, Influenza virus
IRNNTYDHSKY

SEQ ID NO: 394376 - protein, 11 aa, Influenza virus
RNNTYDHSKYR

SEQ ID NO: 394377 - protein, 11 aa, Influenza virus
IDPVKLSSGYK

SEQ ID NO: 394378 - protein, 11 aa, Influenza virus
VKLSSGYKDVI

SEQ ID NO: 394379 - protein, 11 aa, Influenza virus
LSSGYKDVILW

SEQ ID NO: 394380 - protein, 11 aa, Influenza virus
SSGYKDVILWF

SEQ ID NO: 394381 - protein, 11 aa, Influenza virus
SGYKDVILWFS

SEQ ID NO: 394382 - protein, 11 aa, Influenza virus
GYKDVILWFSF

SEQ ID NO: 394383 - protein, 11 aa, Influenza virus
YKDVILWFSFG

SEQ ID NO: 394384 - protein, 11 aa, Influenza virus
KDVILWFSFGA

SEQ ID NO: 394385 - protein, 11 aa, Influenza virus
DVILWFSFGAS

SEQ ID NO: 394386 - protein, 11 aa, Influenza virus
VILWFSFGASC

SEQ ID NO: 394387 - protein, 11 aa, Influenza virus
ILWFSFGASCF

SEQ ID NO: 394388 - protein, 11 aa, Influenza virus
LWFSFGASCFI

SEQ ID NO: 394389 - protein, 11 aa, Influenza virus
WFSFGASCFIL

SEQ ID NO: 394390 - protein, 11 aa, Influenza virus
LVFICVKNGNM

SEQ ID NO: 394391 - protein, 11 aa, Influenza virus
FICVKNGNMRC

SEQ ID NO: 394392 - protein, 11 aa, Influenza virus
ICVKNGNMRCT

SEQ ID NO: 394393 - protein, 11 aa, Influenza virus
CVKNGNMRCTI

SEQ ID NO: 394394 - protein, 11 aa, Influenza virus
VKNGNMRCTIC

SEQ ID NO: 394395 - protein, 11 aa, Influenza virus
KNGNMRCTICI

SEQ ID NO: 394396 - protein, 11 aa, Influenza virus
MNPNQKLFALS

SEQ ID NO: 394397 - protein, 11 aa, Influenza virus
NPNQKLFALSG

SEQ ID NO: 394398 - protein, 11 aa, Influenza virus
PNQKLFALSGV

SEQ ID NO: 394399 - protein, 11 aa, Influenza virus
NQKLFALSGVA

SEQ ID NO: 394400 - protein, 11 aa, Influenza virus
QKLFALSGVAI

SEQ ID NO: 394401 - protein, 11 aa, Influenza virus
KLFALSGVAIA

SEQ ID NO: 394402 - protein, 11 aa, Influenza virus
LFALSGVAIAL

SEQ ID NO: 394403 - protein, 11 aa, Influenza virus
FALSGVAIALS

SEQ ID NO: 394404 - protein, 11 aa, Influenza virus
ALSGVAIALSV

SEQ ID NO: 394405 - protein, 11 aa, Influenza virus
LSGVAIALSVL

SEQ ID NO: 394406 - protein, 11 aa, Influenza virus
SGVAIALSVLN

SEQ ID NO: 394407 - protein, 11 aa, Influenza virus
GVAIALSVLNL

SEQ ID NO: 394408 - protein, 11 aa, Influenza virus
VAIALSVLNLL

SEQ ID NO: 394409 - protein, 11 aa, Influenza virus
AIALSVLNLLI

SEQ ID NO: 394410 - protein, 11 aa, Influenza virus
IALSVLNLLIG

SEQ ID NO: 394411 - protein, 11 aa, Influenza virus
ALSVLNLLIGI

SEQ ID NO: 394412 - protein, 11 aa, Influenza virus
LSVLNLLIGIS

SEQ ID NO: 394413 - protein, 11 aa, Influenza virus
SVLNLLIGISN

SEQ ID NO: 394414 - protein, 11 aa, Influenza virus
VLNLLIGISNV

SEQ ID NO: 394415 - protein, 11 aa, Influenza virus
LNLLIGISNVG

SEQ ID NO: 394416 - protein, 11 aa, Influenza virus
NLLIGISNVGL

SEQ ID NO: 394417 - protein, 11 aa, Influenza virus
LLIGISNVGLN

SEQ ID NO: 394418 - protein, 11 aa, Influenza virus
SNVGLNVSLHL

SEQ ID NO: 394419 - protein, 11 aa, Influenza virus
ENTYVNNTTII

SEQ ID NO: 394420 - protein, 11 aa, Influenza virus
SYLLLNKSLCN

SEQ ID NO: 394421 - protein, 11 aa, Influenza virus
YLLLNKSLCNV

SEQ ID NO: 394422 - protein, 11 aa, Influenza virus
LLLNKSLCNVE

SEQ ID NO: 394423 - protein, 11 aa, Influenza virus
LLNKSLCNVEG

SEQ ID NO: 394424 - protein, 11 aa, Influenza virus
LNKSLCNVEGW

SEQ ID NO: 394425 - protein, 11 aa, Influenza virus
NKSLCNVEGWV

SEQ ID NO: 394426 - protein, 11 aa, Influenza virus
KSLCNVEGWVV

SEQ ID NO: 394427 - protein, 11 aa, Influenza virus
SLCNVEGWVVI

SEQ ID NO: 394428 - protein, 11 aa, Influenza virus
VEGWVVIAKDN

SEQ ID NO: 394429 - protein, 11 aa, Influenza virus
EGWVVIAKDNA

SEQ ID NO: 394430 - protein, 11 aa, Influenza virus
GWVVIAKDNAV

SEQ ID NO: 394431 - protein, 11 aa, Influenza virus
WVVIAKDNAVR

SEQ ID NO: 394432 - protein, 11 aa, Influenza virus
VVIAKDNAVRF

SEQ ID NO: 394433 - protein, 11 aa, Influenza virus
VIAKDNAVRFG

SEQ ID NO: 394434 - protein, 11 aa, Influenza virus
IAKDNAVRFGE

SEQ ID NO: 394435 - protein, 11 aa, Influenza virus
AKDNAVRFGES

SEQ ID NO: 394436 - protein, 11 aa, Influenza virus
KDNAVRFGESE

SEQ ID NO: 394437 - protein, 11 aa, Influenza virus
DNAVRFGESEQ

SEQ ID NO: 394438 - protein, 11 aa, Influenza virus
NAVRFGESEQI

SEQ ID NO: 394439 - protein, 11 aa, Influenza virus
AVRFGESEQII

SEQ ID NO: 394440 - protein, 11 aa, Influenza virus
VRFGESEQIIV

SEQ ID NO: 394441 - protein, 11 aa, Influenza virus
RFGESEQIIVT

SEQ ID NO: 394442 - protein, 11 aa, Influenza virus
FGESEQIIVTR

SEQ ID NO: 394443 - protein, 11 aa, Influenza virus
GESEQIIVTRE

SEQ ID NO: 394444 - protein, 11 aa, Influenza virus
ESEQIIVTREP

SEQ ID NO: 394445 - protein, 11 aa, Influenza virus
SEQIIVTREPY

SEQ ID NO: 394446 - protein, 11 aa, Influenza virus
EQIIVTREPYV

SEQ ID NO: 394447 - protein, 11 aa, Influenza virus
QIIVTREPYVS

SEQ ID NO: 394448 - protein, 11 aa, Influenza virus
IIVTREPYVSC

SEQ ID NO: 394449 - protein, 11 aa, Influenza virus
IVTREPYVSCD

SEQ ID NO: 394450 - protein, 11 aa, Influenza virus
VTREPYVSCDP

SEQ ID NO: 394451 - protein, 11 aa, Influenza virus
TREPYVSCDPT

SEQ ID NO: 394452 - protein, 11 aa, Influenza virus
GCKMYALHQGT

SEQ ID NO: 394453 - protein, 11 aa, Influenza virus
CKMYALHQGTT

SEQ ID NO: 394454 - protein, 11 aa, Influenza virus
KMYALHQGTTI

SEQ ID NO: 394455 - protein, 11 aa, Influenza virus
MYALHQGTTIR

SEQ ID NO: 394456 - protein, 11 aa, Influenza virus
YALHQGTTIRN

SEQ ID NO: 394457 - protein, 11 aa, Influenza virus
ALHQGTTIRNK

SEQ ID NO: 394458 - protein, 11 aa, Influenza virus
LHQGTTIRNKH

SEQ ID NO: 394459 - protein, 11 aa, Influenza virus
HQGTTIRNKHS

SEQ ID NO: 394460 - protein, 11 aa, Influenza virus
QGTTIRNKHSN

SEQ ID NO: 394461 - protein, 11 aa, Influenza virus
GTTIRNKHSNG

SEQ ID NO: 394462 - protein, 11 aa, Influenza virus
TTIRNKHSNGT

SEQ ID NO: 394463 - protein, 11 aa, Influenza virus
TIRNKHSNGTI

SEQ ID NO: 394464 - protein, 11 aa, Influenza virus
IRNKHSNGTIH

SEQ ID NO: 394465 - protein, 11 aa, Influenza virus
RNKHSNGTIHD

SEQ ID NO: 394466 - protein, 11 aa, Influenza virus
NKHSNGTIHDR

SEQ ID NO: 394467 - protein, 11 aa, Influenza virus
KHSNGTIHDRT

SEQ ID NO: 394468 - protein, 11 aa, Influenza virus
HSNGTIHDRTA

SEQ ID NO: 394469 - protein, 11 aa, Influenza virus
SNGTIHDRTAF

SEQ ID NO: 394470 - protein, 11 aa, Influenza virus
NGTIHDRTAFR

SEQ ID NO: 394471 - protein, 11 aa, Influenza virus
GTIHDRTAFRG

SEQ ID NO: 394472 - protein, 11 aa, Influenza virus
TIHDRTAFRGL

SEQ ID NO: 394473 - protein, 11 aa, Influenza virus
HDRTAFRGLIS

SEQ ID NO: 394474 - protein, 11 aa, Influenza virus
DRTAFRGLIST

SEQ ID NO: 394475 - protein, 11 aa, Influenza virus
SNSDFMCVGWS

SEQ ID NO: 394476 - protein, 11 aa, Influenza virus
NSDFMCVGWSS

SEQ ID NO: 394477 - protein, 11 aa, Influenza virus
SDFMCVGWSST

SEQ ID NO: 394478 - protein, 11 aa, Influenza virus
DFMCVGWSSTT

SEQ ID NO: 394479 - protein, 11 aa, Influenza virus
FMCVGWSSTTC

SEQ ID NO: 394480 - protein, 11 aa, Influenza virus
MCVGWSSTTCH

SEQ ID NO: 394481 - protein, 11 aa, Influenza virus
CVGWSSTTCHD

SEQ ID NO: 394482 - protein, 11 aa, Influenza virus
VGWSSTTCHDG

SEQ ID NO: 394483 - protein, 11 aa, Influenza virus
GWSSTTCHDGI

SEQ ID NO: 394484 - protein, 11 aa, Influenza virus
CHDGIGRMTIC

SEQ ID NO: 394485 - protein, 11 aa, Influenza virus
QGNNDNATATV

SEQ ID NO: 394486 - protein, 11 aa, Influenza virus
GNNDNATATVY

SEQ ID NO: 394487 - protein, 11 aa, Influenza virus
NNDNATATVYY

SEQ ID NO: 394488 - protein, 11 aa, Influenza virus
NDNATATVYYN

SEQ ID NO: 394489 - protein, 11 aa, Influenza virus
NATATVYYNRR

SEQ ID NO: 394490 - protein, 11 aa, Influenza virus
ATATVYYNRRL

SEQ ID NO: 394491 - protein, 11 aa, Influenza virus
TATVYYNRRLT

SEQ ID NO: 394492 - protein, 11 aa, Influenza virus
ATVYYNRRLTT

SEQ ID NO: 394493 - protein, 11 aa, Influenza virus
TVYYNRRLTTT

SEQ ID NO: 394494 - protein, 11 aa, Influenza virus
VYYNRRLTTTI

SEQ ID NO: 394495 - protein, 11 aa, Influenza virus
RRLTTTIKTWA

SEQ ID NO: 394496 - protein, 11 aa, Influenza virus
RLTTTIKTWAR

SEQ ID NO: 394497 - protein, 11 aa, Influenza virus
LTTTIKTWARN

SEQ ID NO: 394498 - protein, 11 aa, Influenza virus
TTTIKTWARNI

SEQ ID NO: 394499 - protein, 11 aa, Influenza virus
TTIKTWARNIL

SEQ ID NO: 394500 - protein, 11 aa, Influenza virus
TIKTWARNILR

SEQ ID NO: 394501 - protein, 11 aa, Influenza virus
IKTWARNILRT

SEQ ID NO: 394502 - protein, 11 aa, Influenza virus
KTWARNILRTQ

SEQ ID NO: 394503 - protein, 11 aa, Influenza virus
TWARNILRTQE

SEQ ID NO: 394504 - protein, 11 aa, Influenza virus
WARNILRTQES

SEQ ID NO: 394505 - protein, 11 aa, Influenza virus
ARNILRTQESE

SEQ ID NO: 394506 - protein, 11 aa, Influenza virus
RNILRTQESEC

SEQ ID NO: 394507 - protein, 11 aa, Influenza virus
NILRTQESECV

SEQ ID NO: 394508 - protein, 11 aa, Influenza virus
ILRTQESECVC

SEQ ID NO: 394509 - protein, 11 aa, Influenza virus
LRTQESECVCH

SEQ ID NO: 394510 - protein, 11 aa, Influenza virus
RTQESECVCHN

SEQ ID NO: 394511 - protein, 11 aa, Influenza virus
TQESECVCHNG

SEQ ID NO: 394512 - protein, 11 aa, Influenza virus
QESECVCHNGT

SEQ ID NO: 394513 - protein, 11 aa, Influenza virus
ESECVCHNGTC

SEQ ID NO: 394514 - protein, 11 aa, Influenza virus
SECVCHNGTCA

SEQ ID NO: 394515 - protein, 11 aa, Influenza virus
ECVCHNGTCAV

SEQ ID NO: 394516 - protein, 11 aa, Influenza virus
HNGTCAVVMTD

SEQ ID NO: 394517 - protein, 11 aa, Influenza virus
NGTCAVVMTDG

SEQ ID NO: 394518 - protein, 11 aa, Influenza virus
LKGSARHIEEC

SEQ ID NO: 394519 - protein, 11 aa, Influenza virus
KGSARHIEECS

SEQ ID NO: 394520 - protein, 11 aa, Influenza virus
GSARHIEECSC

SEQ ID NO: 394521 - protein, 11 aa, Influenza virus
SARHIEECSCY

SEQ ID NO: 394522 - protein, 11 aa, Influenza virus
ARHIEECSCYG

SEQ ID NO: 394523 - protein, 11 aa, Influenza virus
RHIEECSCYGH

SEQ ID NO: 394524 - protein, 11 aa, Influenza virus
HIEECSCYGHN

SEQ ID NO: 394525 - protein, 11 aa, Influenza virus
VTCVCRDNWQG

SEQ ID NO: 394526 - protein, 11 aa, Influenza virus
TCVCRDNWQGA

SEQ ID NO: 394527 - protein, 11 aa, Influenza virus
CVCRDNWQGAN

SEQ ID NO: 394528 - protein, 11 aa, Influenza virus
VCRDNWQGANR

SEQ ID NO: 394529 - protein, 11 aa, Influenza virus
CRDNWQGANRP

SEQ ID NO: 394530 - protein, 11 aa, Influenza virus
RDNWQGANRPI

SEQ ID NO: 394531 - protein, 11 aa, Influenza virus
DNWQGANRPII

SEQ ID NO: 394532 - protein, 11 aa, Influenza virus
NWQGANRPIIE

SEQ ID NO: 394533 - protein, 11 aa, Influenza virus
WQGANRPIIEI

SEQ ID NO: 394534 - protein, 11 aa, Influenza virus
QGANRPIIEID

SEQ ID NO: 394535 - protein, 11 aa, Influenza virus
GANRPIIEIDM

SEQ ID NO: 394536 - protein, 11 aa, Influenza virus
ANRPIIEIDMN

SEQ ID NO: 394537 - protein, 11 aa, Influenza virus
LEHTSRYVCTG

SEQ ID NO: 394538 - protein, 11 aa, Influenza virus
YVCTGILTDTS

SEQ ID NO: 394539 - protein, 11 aa, Influenza virus
VCTGILTDTSR

SEQ ID NO: 394540 - protein, 11 aa, Influenza virus
CTGILTDTSRP

SEQ ID NO: 394541 - protein, 11 aa, Influenza virus
TGILTDTSRPG

SEQ ID NO: 394542 - protein, 11 aa, Influenza virus
GILTDTSRPGD

SEQ ID NO: 394543 - protein, 11 aa, Influenza virus
ILTDTSRPGDK

SEQ ID NO: 394544 - protein, 11 aa, Influenza virus
GDCSNPITGSP

SEQ ID NO: 394545 - protein, 11 aa, Influenza virus
DCSNPITGSPG

SEQ ID NO: 394546 - protein, 11 aa, Influenza virus
NPITGSPGAPG

SEQ ID NO: 394547 - protein, 11 aa, Influenza virus
PGVKGFGFLNG

SEQ ID NO: 394548 - protein, 11 aa, Influenza virus
DNTWLGRTISP

SEQ ID NO: 394549 - protein, 11 aa, Influenza virus
NTWLGRTISPR

SEQ ID NO: 394550 - protein, 11 aa, Influenza virus
TWLGRTISPRS

SEQ ID NO: 394551 - protein, 11 aa, Influenza virus
WLGRTISPRSR

SEQ ID NO: 394552 - protein, 11 aa, Influenza virus
LGRTISPRSRS

SEQ ID NO: 394553 - protein, 11 aa, Influenza virus
GRTISPRSRSG

SEQ ID NO: 394554 - protein, 11 aa, Influenza virus
RTISPRSRSGF

SEQ ID NO: 394555 - protein, 11 aa, Influenza virus
TISPRSRSGFE

SEQ ID NO: 394556 - protein, 11 aa, Influenza virus
ISPRSRSGFEM

SEQ ID NO: 394557 - protein, 11 aa, Influenza virus
SPRSRSGFEML

SEQ ID NO: 394558 - protein, 11 aa, Influenza virus
PRSRSGFEMLK

SEQ ID NO: 394559 - protein, 11 aa, Influenza virus
RSRSGFEMLKI

SEQ ID NO: 394560 - protein, 11 aa, Influenza virus
SRSGFEMLKIP

SEQ ID NO: 394561 - protein, 11 aa, Influenza virus
RSGFEMLKIPN

SEQ ID NO: 394562 - protein, 11 aa, Influenza virus
SGFEMLKIPNA

SEQ ID NO: 394563 - protein, 11 aa, Influenza virus
GFEMLKIPNAG

SEQ ID NO: 394564 - protein, 11 aa, Influenza virus
FEMLKIPNAGT

SEQ ID NO: 394565 - protein, 11 aa, Influenza virus
EMLKIPNAGTD

SEQ ID NO: 394566 - protein, 11 aa, Influenza virus
MLKIPNAGTDP

SEQ ID NO: 394567 - protein, 11 aa, Influenza virus
RQEIVDNNNWS

SEQ ID NO: 394568 - protein, 11 aa, Influenza virus
QEIVDNNNWSG

SEQ ID NO: 394569 - protein, 11 aa, Influenza virus
EIVDNNNWSGY

SEQ ID NO: 394570 - protein, 11 aa, Influenza virus
IVDNNNWSGYS

SEQ ID NO: 394571 - protein, 11 aa, Influenza virus
VDNNNWSGYSG

SEQ ID NO: 394572 - protein, 11 aa, Influenza virus
DNNNWSGYSGS

SEQ ID NO: 394573 - protein, 11 aa, Influenza virus
NNNWSGYSGSF

SEQ ID NO: 394574 - protein, 11 aa, Influenza virus
NNWSGYSGSFI

SEQ ID NO: 394575 - protein, 11 aa, Influenza virus
NWSGYSGSFID

SEQ ID NO: 394576 - protein, 11 aa, Influenza virus
WSGYSGSFIDY

SEQ ID NO: 394577 - protein, 11 aa, Influenza virus
SGYSGSFIDYW

SEQ ID NO: 394578 - protein, 11 aa, Influenza virus
GYSGSFIDYWN

SEQ ID NO: 394579 - protein, 11 aa, Influenza virus
YSGSFIDYWND

SEQ ID NO: 394580 - protein, 11 aa, Influenza virus
SECYNPCFYVE

SEQ ID NO: 394581 - protein, 11 aa, Influenza virus
ECYNPCFYVEL

SEQ ID NO: 394582 - protein, 11 aa, Influenza virus
CYNPCFYVELI

SEQ ID NO: 394583 - protein, 11 aa, Influenza virus
YNPCFYVELIR

SEQ ID NO: 394584 - protein, 11 aa, Influenza virus
NPCFYVELIRG

SEQ ID NO: 394585 - protein, 11 aa, Influenza virus
PCFYVELIRGR

SEQ ID NO: 394586 - protein, 11 aa, Influenza virus
CFYVELIRGRP

SEQ ID NO: 394587 - protein, 11 aa, Influenza virus
FYVELIRGRPE

SEQ ID NO: 394588 - protein, 11 aa, Influenza virus
YVELIRGRPEE

SEQ ID NO: 394589 - protein, 11 aa, Influenza virus
VELIRGRPEEA

SEQ ID NO: 394590 - protein, 11 aa, Influenza virus
ELIRGRPEEAK

SEQ ID NO: 394591 - protein, 11 aa, Influenza virus
LIRGRPEEAKY

SEQ ID NO: 394592 - protein, 11 aa, Influenza virus
IRGRPEEAKYV

SEQ ID NO: 394593 - protein, 11 aa, Influenza virus
RGRPEEAKYVW

SEQ ID NO: 394594 - protein, 11 aa, Influenza virus
GRPEEAKYVWW

SEQ ID NO: 394595 - protein, 11 aa, Influenza virus
RPEEAKYVWWT

SEQ ID NO: 394596 - protein, 11 aa, Influenza virus
PEEAKYVWWTS

SEQ ID NO: 394597 - protein, 11 aa, Influenza virus
EEAKYVWWTSN

SEQ ID NO: 394598 - protein, 11 aa, Influenza virus
EAKYVWWTSNS

SEQ ID NO: 394599 - protein, 11 aa, Influenza virus
AKYVWWTSNSL

SEQ ID NO: 394600 - protein, 11 aa, Influenza virus
KYVWWTSNSLI

SEQ ID NO: 394601 - protein, 11 aa, Influenza virus
YVWWTSNSLIA

SEQ ID NO: 394602 - protein, 11 aa, Influenza virus
VWWTSNSLIAL

SEQ ID NO: 394603 - protein, 11 aa, Influenza virus
WWTSNSLIALC

SEQ ID NO: 394604 - protein, 11 aa, Influenza virus
WTSNSLIALCG

SEQ ID NO: 394605 - protein, 11 aa, Influenza virus
TSNSLIALCGS

SEQ ID NO: 394606 - protein, 11 aa, Influenza virus
SNSLIALCGSP

SEQ ID NO: 394607 - protein, 11 aa, Influenza virus
PVGSGSFPDGA

SEQ ID NO: 394608 - protein, 11 aa, Influenza virus
VGSGSFPDGAQ

SEQ ID NO: 394609 - protein, 11 aa, Influenza virus
GSGSFPDGAQI

SEQ ID NO: 394610 - protein, 11 aa, Influenza virus
SGSFPDGAQIQ

SEQ ID NO: 394611 - protein, 11 aa, Influenza virus
GSFPDGAQIQY

SEQ ID NO: 394612 - protein, 11 aa, Influenza virus
SFPDGAQIQYF

SEQ ID NO: 394613 - protein, 11 aa, Influenza virus
FPDGAQIQYFS

SEQ ID NO: 394614 - protein, 11 aa, Influenza virus
LLASTNAYDRI

SEQ ID NO: 394615 - protein, 11 aa, Influenza virus
LASTNAYDRIC

SEQ ID NO: 394616 - protein, 11 aa, Influenza virus
ASTNAYDRICI

SEQ ID NO: 394617 - protein, 11 aa, Influenza virus
STNAYDRICIG

SEQ ID NO: 394618 - protein, 11 aa, Influenza virus
TNAYDRICIGY

SEQ ID NO: 394619 - protein, 11 aa, Influenza virus
NAYDRICIGYQ

SEQ ID NO: 394620 - protein, 11 aa, Influenza virus
AYDRICIGYQS

SEQ ID NO: 394621 - protein, 11 aa, Influenza virus
YDRICIGYQSN

SEQ ID NO: 394622 - protein, 11 aa, Influenza virus
DRICIGYQSNN

SEQ ID NO: 394623 - protein, 11 aa, Influenza virus
RICIGYQSNNS

SEQ ID NO: 394624 - protein, 11 aa, Influenza virus
ICIGYQSNNST

SEQ ID NO: 394625 - protein, 11 aa, Influenza virus
CIGYQSNNSTD

SEQ ID NO: 394626 - protein, 11 aa, Influenza virus
IGYQSNNSTDT

SEQ ID NO: 394627 - protein, 11 aa, Influenza virus
GYQSNNSTDTV

SEQ ID NO: 394628 - protein, 11 aa, Influenza virus
YQSNNSTDTVN

SEQ ID NO: 394629 - protein, 11 aa, Influenza virus
QSNNSTDTVNT

SEQ ID NO: 394630 - protein, 11 aa, Influenza virus
SNNSTDTVNTL

SEQ ID NO: 394631 - protein, 11 aa, Influenza virus
NNSTDTVNTLI

SEQ ID NO: 394632 - protein, 11 aa, Influenza virus
NSTDTVNTLIE

SEQ ID NO: 394633 - protein, 11 aa, Influenza virus
STDTVNTLIEQ

SEQ ID NO: 394634 - protein, 11 aa, Influenza virus
TLIEQNVPVTQ

SEQ ID NO: 394635 - protein, 11 aa, Influenza virus
EQNVPVTQTME

SEQ ID NO: 394636 - protein, 11 aa, Influenza virus
QNVPVTQTMEL

SEQ ID NO: 394637 - protein, 11 aa, Influenza virus
NVPVTQTMELV

SEQ ID NO: 394638 - protein, 11 aa, Influenza virus
VPVTQTMELVE

SEQ ID NO: 394639 - protein, 11 aa, Influenza virus
PVTQTMELVET

SEQ ID NO: 394640 - protein, 11 aa, Influenza virus
VTQTMELVETE

SEQ ID NO: 394641 - protein, 11 aa, Influenza virus
TQTMELVETEK

SEQ ID NO: 394642 - protein, 11 aa, Influenza virus
QTMELVETEKH

SEQ ID NO: 394643 - protein, 11 aa, Influenza virus
EKHPAYCNTDL

SEQ ID NO: 394644 - protein, 11 aa, Influenza virus
KHPAYCNTDLG

SEQ ID NO: 394645 - protein, 11 aa, Influenza virus
PAYCNTDLGTP

SEQ ID NO: 394646 - protein, 11 aa, Influenza virus
AYCNTDLGAPL

SEQ ID NO: 394647 - protein, 11 aa, Influenza virus
YCNTDLGAPLE

SEQ ID NO: 394648 - protein, 11 aa, Influenza virus
CNTDLGAPLEL

SEQ ID NO: 394649 - protein, 11 aa, Influenza virus
NTDLGAPLELR

SEQ ID NO: 394650 - protein, 11 aa, Influenza virus
TDLGAPLELRD

SEQ ID NO: 394651 - protein, 11 aa, Influenza virus
DLGAPLELRDC

SEQ ID NO: 394652 - protein, 11 aa, Influenza virus
LGAPLELRDCK

SEQ ID NO: 394653 - protein, 11 aa, Influenza virus
GAPLELRDCKI

SEQ ID NO: 394654 - protein, 11 aa, Influenza virus
APLELRDCKIE

SEQ ID NO: 394655 - protein, 11 aa, Influenza virus
PLELRDCKIEA

SEQ ID NO: 394656 - protein, 11 aa, Influenza virus
LELRDCKIEAV

SEQ ID NO: 394657 - protein, 11 aa, Influenza virus
ELRDCKIEAVI

SEQ ID NO: 394658 - protein, 11 aa, Influenza virus
LRDCKIEAVIY

SEQ ID NO: 394659 - protein, 11 aa, Influenza virus
RDCKIEAVIYG

SEQ ID NO: 394660 - protein, 11 aa, Influenza virus
DCKIEAVIYGN

SEQ ID NO: 394661 - protein, 11 aa, Influenza virus
CKIEAVIYGNP

SEQ ID NO: 394662 - protein, 11 aa, Influenza virus
KIEAVIYGNPK

SEQ ID NO: 394663 - protein, 11 aa, Influenza virus
IEAVIYGNPKC

SEQ ID NO: 394664 - protein, 11 aa, Influenza virus
EAVIYGNPKCD

SEQ ID NO: 394665 - protein, 11 aa, Influenza virus
AVIYGNPKCDI

SEQ ID NO: 394666 - protein, 11 aa, Influenza virus
VIYGNPKCDIH

SEQ ID NO: 394667 - protein, 11 aa, Influenza virus
IYGNPKCDIHL

SEQ ID NO: 394668 - protein, 11 aa, Influenza virus
YGNPKCDIHLK

SEQ ID NO: 394669 - protein, 11 aa, Influenza virus
GNPKCDIHLKD

SEQ ID NO: 394670 - protein, 11 aa, Influenza virus
NPKCDIHLKDQ

SEQ ID NO: 394671 - protein, 11 aa, Influenza virus
HLKDQGWSYIV

SEQ ID NO: 394672 - protein, 11 aa, Influenza virus
LKDQGWSYIVE

SEQ ID NO: 394673 - protein, 11 aa, Influenza virus
KDQGWSYIVER

SEQ ID NO: 394674 - protein, 11 aa, Influenza virus
DQGWSYIVERP

SEQ ID NO: 394675 - protein, 11 aa, Influenza virus
QGWSYIVERPS

SEQ ID NO: 394676 - protein, 11 aa, Influenza virus
GWSYIVERPSA

SEQ ID NO: 394677 - protein, 11 aa, Influenza virus
WSYIVERPSAP

SEQ ID NO: 394678 - protein, 11 aa, Influenza virus
SYIVERPSAPE

SEQ ID NO: 394679 - protein, 11 aa, Influenza virus
YIVERPSAPEG

SEQ ID NO: 394680 - protein, 11 aa, Influenza virus
IVERPSAPEGM

SEQ ID NO: 394681 - protein, 11 aa, Influenza virus
VERPSAPEGMC

SEQ ID NO: 394682 - protein, 11 aa, Influenza virus
ERPSAPEGMCY

SEQ ID NO: 394683 - protein, 11 aa, Influenza virus
RPSAPEGMCYP

SEQ ID NO: 394684 - protein, 11 aa, Influenza virus
PSAPEGMCYPG

SEQ ID NO: 394685 - protein, 11 aa, Influenza virus
SAPEGMCYPGS

SEQ ID NO: 394686 - protein, 11 aa, Influenza virus
APEGMCYPGSV

SEQ ID NO: 394687 - protein, 11 aa, Influenza virus
PEGMCYPGSVE

SEQ ID NO: 394688 - protein, 11 aa, Influenza virus
EGMCYPGSVEN

SEQ ID NO: 394689 - protein, 11 aa, Influenza virus
GMCYPGSVENL

SEQ ID NO: 394690 - protein, 11 aa, Influenza virus
MCYPGSVENLE

SEQ ID NO: 394691 - protein, 11 aa, Influenza virus
CYPGSVENLEE

SEQ ID NO: 394692 - protein, 11 aa, Influenza virus
YPGSVENLEEL

SEQ ID NO: 394693 - protein, 11 aa, Influenza virus
PGSVENLEELR

SEQ ID NO: 394694 - protein, 11 aa, Influenza virus
GSVENLEELRF

SEQ ID NO: 394695 - protein, 11 aa, Influenza virus
SVENLEELRFV

SEQ ID NO: 394696 - protein, 11 aa, Influenza virus
VENLEELRFVF

SEQ ID NO: 394697 - protein, 11 aa, Influenza virus
ENLEELRFVFS

SEQ ID NO: 394698 - protein, 11 aa, Influenza virus
NLEELRFVFSN

SEQ ID NO: 394699 - protein, 11 aa, Influenza virus
LEELRFVFSNA

SEQ ID NO: 394700 - protein, 11 aa, Influenza virus
EELRFVFSNAA

SEQ ID NO: 394701 - protein, 11 aa, Influenza virus
ELRFVFSNAAS

SEQ ID NO: 394702 - protein, 11 aa, Influenza virus
LRFVFSNAASY

SEQ ID NO: 394703 - protein, 11 aa, Influenza virus
RFVFSNAASYK

SEQ ID NO: 394704 - protein, 11 aa, Influenza virus
FVFSNAASYKR

SEQ ID NO: 394705 - protein, 11 aa, Influenza virus
VFSNAASYKRI

SEQ ID NO: 394706 - protein, 11 aa, Influenza virus
FSNAASYKRIR

SEQ ID NO: 394707 - protein, 11 aa, Influenza virus
SNAASYKRIRL

SEQ ID NO: 394708 - protein, 11 aa, Influenza virus
NAASYKRIRLF

SEQ ID NO: 394709 - protein, 11 aa, Influenza virus
AASYKRIRLFD

SEQ ID NO: 394710 - protein, 11 aa, Influenza virus
ASYKRIRLFDY

SEQ ID NO: 394711 - protein, 11 aa, Influenza virus
SYKRIRLFDYS

SEQ ID NO: 394712 - protein, 11 aa, Influenza virus
YKRIRLFDYSR

SEQ ID NO: 394713 - protein, 11 aa, Influenza virus
KRIRLFDYSRW

SEQ ID NO: 394714 - protein, 11 aa, Influenza virus
RIRLFDYSRWN

SEQ ID NO: 394715 - protein, 11 aa, Influenza virus
IRLFDYSRWNV

SEQ ID NO: 394716 - protein, 11 aa, Influenza virus
RLFDYSRWNVT

SEQ ID NO: 394717 - protein, 11 aa, Influenza virus
WNVTSSGTSKA

SEQ ID NO: 394718 - protein, 11 aa, Influenza virus
NVTSSGTSKAC

SEQ ID NO: 394719 - protein, 11 aa, Influenza virus
VTSSGTSKACN

SEQ ID NO: 394720 - protein, 11 aa, Influenza virus
TSSGTSKACNA

SEQ ID NO: 394721 - protein, 11 aa, Influenza virus
SSGTSKACNAS

SEQ ID NO: 394722 - protein, 11 aa, Influenza virus
SGTSKACNAST

SEQ ID NO: 394723 - protein, 11 aa, Influenza virus
GTSKACNASTG

SEQ ID NO: 394724 - protein, 11 aa, Influenza virus
TSKACNASTGG

SEQ ID NO: 394725 - protein, 11 aa, Influenza virus
SKACNASTGGQ

SEQ ID NO: 394726 - protein, 11 aa, Influenza virus
KACNASTGGQS

SEQ ID NO: 394727 - protein, 11 aa, Influenza virus
ACNASTGGQSF

SEQ ID NO: 394728 - protein, 11 aa, Influenza virus
CNASTGGQSFY

SEQ ID NO: 394729 - protein, 11 aa, Influenza virus
NASTGGQSFYR

SEQ ID NO: 394730 - protein, 11 aa, Influenza virus
ASTGGQSFYRS

SEQ ID NO: 394731 - protein, 11 aa, Influenza virus
STGGQSFYRSI

SEQ ID NO: 394732 - protein, 11 aa, Influenza virus
TGGQSFYRSIN

SEQ ID NO: 394733 - protein, 11 aa, Influenza virus
GGQSFYRSINW

SEQ ID NO: 394734 - protein, 11 aa, Influenza virus
GQSFYRSINWL

SEQ ID NO: 394735 - protein, 11 aa, Influenza virus
QSFYRSINWLT

SEQ ID NO: 394736 - protein, 11 aa, Influenza virus
SFYRSINWLTK

SEQ ID NO: 394737 - protein, 11 aa, Influenza virus
FYRSINWLTKK

SEQ ID NO: 394738 - protein, 11 aa, Influenza virus
YRSINWLTKKK

SEQ ID NO: 394739 - protein, 11 aa, Influenza virus
RSINWLTKKKP

SEQ ID NO: 394740 - protein, 11 aa, Influenza virus
SINWLTKKKPD

SEQ ID NO: 394741 - protein, 11 aa, Influenza virus
INWLTKKKPDT

SEQ ID NO: 394742 - protein, 11 aa, Influenza virus
NWLTKKKPDTY

SEQ ID NO: 394743 - protein, 11 aa, Influenza virus
WLTKKKPDTYD

SEQ ID NO: 394744 - protein, 11 aa, Influenza virus
LTKKKPDTYDF

SEQ ID NO: 394745 - protein, 11 aa, Influenza virus
TKKKPDTYDFN

SEQ ID NO: 394746 - protein, 11 aa, Influenza virus
KKKPDTYDFNE

SEQ ID NO: 394747 - protein, 11 aa, Influenza virus
KKPDTYDFNEG

SEQ ID NO: 394748 - protein, 11 aa, Influenza virus
NPEAYNFNEGS

SEQ ID NO: 394749 - protein, 11 aa, Influenza virus
PDTYDFNEGSY

SEQ ID NO: 394750 - protein, 11 aa, Influenza virus
NNEDGDIIFLW

SEQ ID NO: 394751 - protein, 11 aa, Influenza virus
NEDGDIIFLWG

SEQ ID NO: 394752 - protein, 11 aa, Influenza virus
EDGDIIFLWGI

SEQ ID NO: 394753 - protein, 11 aa, Influenza virus
DGDIIFLWGIH

SEQ ID NO: 394754 - protein, 11 aa, Influenza virus
GDIIFLWGIHH

SEQ ID NO: 394755 - protein, 11 aa, Influenza virus
DIIFLWGIHHP

SEQ ID NO: 394756 - protein, 11 aa, Influenza virus
IIFLWGIHHPP

SEQ ID NO: 394757 - protein, 11 aa, Influenza virus
IFLWGIHHPPD

SEQ ID NO: 394758 - protein, 11 aa, Influenza virus
FLWGIHHPPDT

SEQ ID NO: 394759 - protein, 11 aa, Influenza virus
LWGIHHPPDTK

SEQ ID NO: 394760 - protein, 11 aa, Influenza virus
WGIHHPPDTKE

SEQ ID NO: 394761 - protein, 11 aa, Influenza virus
GIHHPPDTKEQ

SEQ ID NO: 394762 - protein, 11 aa, Influenza virus
IHHPPDTKEQT

SEQ ID NO: 394763 - protein, 11 aa, Influenza virus
TKEQTTLYKNA

SEQ ID NO: 394764 - protein, 11 aa, Influenza virus
KEQTTLYKNAN

SEQ ID NO: 394765 - protein, 11 aa, Influenza virus
EQTTLYKNANT

SEQ ID NO: 394766 - protein, 11 aa, Influenza virus
QTTLYKNANTL

SEQ ID NO: 394767 - protein, 11 aa, Influenza virus
TTLYKNANTLS

SEQ ID NO: 394768 - protein, 11 aa, Influenza virus
TLYKNANTLSS

SEQ ID NO: 394769 - protein, 11 aa, Influenza virus
LYKNANTLSSV

SEQ ID NO: 394770 - protein, 11 aa, Influenza virus
YKNANTLSSVT

SEQ ID NO: 394771 - protein, 11 aa, Influenza virus
KNANTLSSVTT

SEQ ID NO: 394772 - protein, 11 aa, Influenza virus
NANTLSSVTTN

SEQ ID NO: 394773 - protein, 11 aa, Influenza virus
ANTLSSVTTNT

SEQ ID NO: 394774 - protein, 11 aa, Influenza virus
NTLSSVTTNTI

SEQ ID NO: 394775 - protein, 11 aa, Influenza virus
TLSSVTTNTIN

SEQ ID NO: 394776 - protein, 11 aa, Influenza virus
LSSVTTNTINR

SEQ ID NO: 394777 - protein, 11 aa, Influenza virus
SSVTTNTINRS

SEQ ID NO: 394778 - protein, 11 aa, Influenza virus
SVTTNTINRSF

SEQ ID NO: 394779 - protein, 11 aa, Influenza virus
VTTNTINRSFQ

SEQ ID NO: 394780 - protein, 11 aa, Influenza virus
TTNTINRSFQP

SEQ ID NO: 394781 - protein, 11 aa, Influenza virus
TNTINRSFQPN

SEQ ID NO: 394782 - protein, 11 aa, Influenza virus
NTINRSFQPNI

SEQ ID NO: 394783 - protein, 11 aa, Influenza virus
TINRSFQPNIG

SEQ ID NO: 394784 - protein, 11 aa, Influenza virus
INRSFQPNIGP

SEQ ID NO: 394785 - protein, 11 aa, Influenza virus
NRSFQPNIGPR

SEQ ID NO: 394786 - protein, 11 aa, Influenza virus
RSFQPNIGPRP

SEQ ID NO: 394787 - protein, 11 aa, Influenza virus
SFQPNIGPRPL

SEQ ID NO: 394788 - protein, 11 aa, Influenza virus
FQPNIGPRPLV

SEQ ID NO: 394789 - protein, 11 aa, Influenza virus
QPNIGPRPLVR

SEQ ID NO: 394790 - protein, 11 aa, Influenza virus
PNIGPRPLVRG

SEQ ID NO: 394791 - protein, 11 aa, Influenza virus
NIGPRPLVRGQ

SEQ ID NO: 394792 - protein, 11 aa, Influenza virus
IGPRPLVRGQQ

SEQ ID NO: 394793 - protein, 11 aa, Influenza virus
GPRPLVRGQQG

SEQ ID NO: 394794 - protein, 11 aa, Influenza virus
PRPLVRGQQGR

SEQ ID NO: 394795 - protein, 11 aa, Influenza virus
RPLVRGQQGRM

SEQ ID NO: 394796 - protein, 11 aa, Influenza virus
PLVRGQQGRMD

SEQ ID NO: 394797 - protein, 11 aa, Influenza virus
LVRGQQGRMDY

SEQ ID NO: 394798 - protein, 11 aa, Influenza virus
VRGQQGRMDYY

SEQ ID NO: 394799 - protein, 11 aa, Influenza virus
RGQQGRMDYYW

SEQ ID NO: 394800 - protein, 11 aa, Influenza virus
GQQGRMDYYWG

SEQ ID NO: 394801 - protein, 11 aa, Influenza virus
QQGRMDYYWGI

SEQ ID NO: 394802 - protein, 11 aa, Influenza virus
QGRMDYYWGIL

SEQ ID NO: 394803 - protein, 11 aa, Influenza virus
GRMDYYWGILK

SEQ ID NO: 394804 - protein, 11 aa, Influenza virus
RMDYYWGILKR

SEQ ID NO: 394805 - protein, 11 aa, Influenza virus
MDYYWGILKRG

SEQ ID NO: 394806 - protein, 11 aa, Influenza virus
DYYWGILKRGE

SEQ ID NO: 394807 - protein, 11 aa, Influenza virus
YYWGILKRGET

SEQ ID NO: 394808 - protein, 11 aa, Influenza virus
YWGILKRGETL

SEQ ID NO: 394809 - protein, 11 aa, Influenza virus
WGILKRGETLK

SEQ ID NO: 394810 - protein, 11 aa, Influenza virus
GILKRGETLKI

SEQ ID NO: 394811 - protein, 11 aa, Influenza virus
ILKRGETLKIR

SEQ ID NO: 394812 - protein, 11 aa, Influenza virus
LKRGETLKIRT

SEQ ID NO: 394813 - protein, 11 aa, Influenza virus
KRGETLKIRTN

SEQ ID NO: 394814 - protein, 11 aa, Influenza virus
RGETLKIRTNG

SEQ ID NO: 394815 - protein, 11 aa, Influenza virus
GETLKIRTNGN

SEQ ID NO: 394816 - protein, 11 aa, Influenza virus
ETLKIRTNGNL

SEQ ID NO: 394817 - protein, 11 aa, Influenza virus
TLKIRTNGNLI

SEQ ID NO: 394818 - protein, 11 aa, Influenza virus
LKIRTNGNLIA

SEQ ID NO: 394819 - protein, 11 aa, Influenza virus
KIRTNGNLIAP

SEQ ID NO: 394820 - protein, 11 aa, Influenza virus
IRTNGNLIAPE

SEQ ID NO: 394821 - protein, 11 aa, Influenza virus
RTNGNLIAPEF

SEQ ID NO: 394822 - protein, 11 aa, Influenza virus
TNGNLIAPEFG

SEQ ID NO: 394823 - protein, 11 aa, Influenza virus
NGNLIAPEFGY

SEQ ID NO: 394824 - protein, 11 aa, Influenza virus
GNLIAPEFGYL

SEQ ID NO: 394825 - protein, 11 aa, Influenza virus
NLIAPEFGYLL

SEQ ID NO: 394826 - protein, 11 aa, Influenza virus
LIAPEFGYLLK

SEQ ID NO: 394827 - protein, 11 aa, Influenza virus
IAPEFGYLLKG

SEQ ID NO: 394828 - protein, 11 aa, Influenza virus
APEFGYLLKGE

SEQ ID NO: 394829 - protein, 11 aa, Influenza virus
PEFGYLLKGES

SEQ ID NO: 394830 - protein, 11 aa, Influenza virus
EFGYLLKGESH

SEQ ID NO: 394831 - protein, 11 aa, Influenza virus
FGYLLKGESHG

SEQ ID NO: 394832 - protein, 11 aa, Influenza virus
GYLLKGESHGR

SEQ ID NO: 394833 - protein, 11 aa, Influenza virus
GESHGRIIQNE

SEQ ID NO: 394834 - protein, 11 aa, Influenza virus
ESHGRIIQNED

SEQ ID NO: 394835 - protein, 11 aa, Influenza virus
SHGRIIQNEDI

SEQ ID NO: 394836 - protein, 11 aa, Influenza virus
HGRIIQNEDIP

SEQ ID NO: 394837 - protein, 11 aa, Influenza virus
GRIIQNEDIPI

SEQ ID NO: 394838 - protein, 11 aa, Influenza virus
RIIQNEDIPIG

SEQ ID NO: 394839 - protein, 11 aa, Influenza virus
IIQNEDIPIGN

SEQ ID NO: 394840 - protein, 11 aa, Influenza virus
IQNEDIPIGNC

SEQ ID NO: 394841 - protein, 11 aa, Influenza virus
CHTKCQTYAGA

SEQ ID NO: 394842 - protein, 11 aa, Influenza virus
TKCQTYAGAIN

SEQ ID NO: 394843 - protein, 11 aa, Influenza virus
KCQTYAGAINS

SEQ ID NO: 394844 - protein, 11 aa, Influenza virus
CQTYAGAINSS

SEQ ID NO: 394845 - protein, 11 aa, Influenza virus
QTYAGAINSSK

SEQ ID NO: 394846 - protein, 11 aa, Influenza virus
TYAGAINSSKP

SEQ ID NO: 394847 - protein, 11 aa, Influenza virus
GAINSSKPFQN

SEQ ID NO: 394848 - protein, 11 aa, Influenza virus
AINSSKPFQNA

SEQ ID NO: 394849 - protein, 11 aa, Influenza virus
INSSKPFQNAS

SEQ ID NO: 394850 - protein, 11 aa, Influenza virus
NSSKPFQNASR

SEQ ID NO: 394851 - protein, 11 aa, Influenza virus
SSKPFQNASRH

SEQ ID NO: 394852 - protein, 11 aa, Influenza virus
PFQNASRHYMG

SEQ ID NO: 394853 - protein, 11 aa, Influenza virus
FQNASRHYMGE

SEQ ID NO: 394854 - protein, 11 aa, Influenza virus
QNASRHYMGEC

SEQ ID NO: 394855 - protein, 11 aa, Influenza virus
NASRHYMGECP

SEQ ID NO: 394856 - protein, 11 aa, Influenza virus
SRHYMGECPKY

SEQ ID NO: 394857 - protein, 11 aa, Influenza virus
KKASLRLAVGL

SEQ ID NO: 394858 - protein, 11 aa, Influenza virus
KASLRLAVGLR

SEQ ID NO: 394859 - protein, 11 aa, Influenza virus
ASLRLAVGLRN

SEQ ID NO: 394860 - protein, 11 aa, Influenza virus
SLRLAVGLRNT

SEQ ID NO: 394861 - protein, 11 aa, Influenza virus
LRLAVGLRNTP

SEQ ID NO: 394862 - protein, 11 aa, Influenza virus
RLAVGLRNTPS

SEQ ID NO: 394863 - protein, 11 aa, Influenza virus
LAVGLRNTPSI

SEQ ID NO: 394864 - protein, 11 aa, Influenza virus
AVGLRNTPSIE

SEQ ID NO: 394865 - protein, 11 aa, Influenza virus
VGLRNTPSIEP

SEQ ID NO: 394866 - protein, 11 aa, Influenza virus
GLRNTPSIEPK

SEQ ID NO: 394867 - protein, 11 aa, Influenza virus
LRNTPSIEPKG

SEQ ID NO: 394868 - protein, 11 aa, Influenza virus
RNTPSIEPKGL

SEQ ID NO: 394869 - protein, 11 aa, Influenza virus
NTPSIEPKGLF

SEQ ID NO: 394870 - protein, 11 aa, Influenza virus
TPSIEPKGLFG

SEQ ID NO: 394871 - protein, 11 aa, Influenza virus
PSIEPKGLFGA

SEQ ID NO: 394872 - protein, 11 aa, Influenza virus
SIEPKGLFGAI

SEQ ID NO: 394873 - protein, 11 aa, Influenza virus
IEPKGLFGAIA

SEQ ID NO: 394874 - protein, 11 aa, Influenza virus
EPKGLFGAIAG

SEQ ID NO: 394875 - protein, 11 aa, Influenza virus
PKGLFGAIAGF

SEQ ID NO: 394876 - protein, 11 aa, Influenza virus
KGLFGAIAGFI

SEQ ID NO: 394877 - protein, 11 aa, Influenza virus
GLFGAIAGFIE

SEQ ID NO: 394878 - protein, 11 aa, Influenza virus
LFGAIAGFIEG

SEQ ID NO: 394879 - protein, 11 aa, Influenza virus
FGAIAGFIEGG

SEQ ID NO: 394880 - protein, 11 aa, Influenza virus
GAIAGFIEGGW

SEQ ID NO: 394881 - protein, 11 aa, Influenza virus
AIAGFIEGGWS

SEQ ID NO: 394882 - protein, 11 aa, Influenza virus
IAGFIEGGWSG

SEQ ID NO: 394883 - protein, 11 aa, Influenza virus
AGFIEGGWSGM

SEQ ID NO: 394884 - protein, 11 aa, Influenza virus
GFIEGGWSGMI

SEQ ID NO: 394885 - protein, 11 aa, Influenza virus
FIEGGWSGMID

SEQ ID NO: 394886 - protein, 11 aa, Influenza virus
IEGGWSGMIDG

SEQ ID NO: 394887 - protein, 11 aa, Influenza virus
EGGWSGMIDGW

SEQ ID NO: 394888 - protein, 11 aa, Influenza virus
GGWSGMIDGWY

SEQ ID NO: 394889 - protein, 11 aa, Influenza virus
GWSGMIDGWYG

SEQ ID NO: 394890 - protein, 11 aa, Influenza virus
WSGMIDGWYGF

SEQ ID NO: 394891 - protein, 11 aa, Influenza virus
SGMIDGWYGFH

SEQ ID NO: 394892 - protein, 11 aa, Influenza virus
GMIDGWYGFHH

SEQ ID NO: 394893 - protein, 11 aa, Influenza virus
MIDGWYGFHHS

SEQ ID NO: 394894 - protein, 11 aa, Influenza virus
IDGWYGFHHSN

SEQ ID NO: 394895 - protein, 11 aa, Influenza virus
DGWYGFHHSNS

SEQ ID NO: 394896 - protein, 11 aa, Influenza virus
GWYGFHHSNSE

SEQ ID NO: 394897 - protein, 11 aa, Influenza virus
WYGFHHSNSEG

SEQ ID NO: 394898 - protein, 11 aa, Influenza virus
YGFHHSNSEGT

SEQ ID NO: 394899 - protein, 11 aa, Influenza virus
GFHHSNSEGTG

SEQ ID NO: 394900 - protein, 11 aa, Influenza virus
FHHSNSEGTGM

SEQ ID NO: 394901 - protein, 11 aa, Influenza virus
HHSNSEGTGMA

SEQ ID NO: 394902 - protein, 11 aa, Influenza virus
HSNSEGTGMAA

SEQ ID NO: 394903 - protein, 11 aa, Influenza virus
SNSEGTGMAAD

SEQ ID NO: 394904 - protein, 11 aa, Influenza virus
NSEGTGMAADQ

SEQ ID NO: 394905 - protein, 11 aa, Influenza virus
SEGTGMAADQK

SEQ ID NO: 394906 - protein, 11 aa, Influenza virus
EGTGMAADQKS

SEQ ID NO: 394907 - protein, 11 aa, Influenza virus
GTGMAADQKST

SEQ ID NO: 394908 - protein, 11 aa, Influenza virus
TGMAADQKSTQ

SEQ ID NO: 394909 - protein, 11 aa, Influenza virus
GMAADQKSTQE

SEQ ID NO: 394910 - protein, 11 aa, Influenza virus
MAADQKSTQEA

SEQ ID NO: 394911 - protein, 11 aa, Influenza virus
AADQKSTQEAI

SEQ ID NO: 394912 - protein, 11 aa, Influenza virus
ADQKSTQEAID

SEQ ID NO: 394913 - protein, 11 aa, Influenza virus
DQKSTQEAIDK

SEQ ID NO: 394914 - protein, 11 aa, Influenza virus
QKSTQEAIDKI

SEQ ID NO: 394915 - protein, 11 aa, Influenza virus
KSTQEAIDKIT

SEQ ID NO: 394916 - protein, 11 aa, Influenza virus
STQEAIDKITN

SEQ ID NO: 394917 - protein, 11 aa, Influenza virus
TQEAIDKITNK

SEQ ID NO: 394918 - protein, 11 aa, Influenza virus
QEAIDKITNKV

SEQ ID NO: 394919 - protein, 11 aa, Influenza virus
EAIDKITNKVN

SEQ ID NO: 394920 - protein, 11 aa, Influenza virus
AIDKITNKVNN

SEQ ID NO: 394921 - protein, 11 aa, Influenza virus
IDKITNKVNNI

SEQ ID NO: 394922 - protein, 11 aa, Influenza virus
DKITNKVNNIV

SEQ ID NO: 394923 - protein, 11 aa, Influenza virus
KITNKVNNIVD

SEQ ID NO: 394924 - protein, 11 aa, Influenza virus
ITNKVNNIVDK

SEQ ID NO: 394925 - protein, 11 aa, Influenza virus
TNKVNNIVDKM

SEQ ID NO: 394926 - protein, 11 aa, Influenza virus
NKVNNIVDKMN

SEQ ID NO: 394927 - protein, 11 aa, Influenza virus
KVNNIVDKMNR

SEQ ID NO: 394928 - protein, 11 aa, Influenza virus
VNNIVDKMNRE

SEQ ID NO: 394929 - protein, 11 aa, Influenza virus
NNIVDKMNREF

SEQ ID NO: 394930 - protein, 11 aa, Influenza virus
NIVDKMNREFE

SEQ ID NO: 394931 - protein, 11 aa, Influenza virus
IVDKMNREFEV

SEQ ID NO: 394932 - protein, 11 aa, Influenza virus
VDKMNREFEVV

SEQ ID NO: 394933 - protein, 11 aa, Influenza virus
DKMNREFEVVN

SEQ ID NO: 394934 - protein, 11 aa, Influenza virus
KMNREFEVVNH

SEQ ID NO: 394935 - protein, 11 aa, Influenza virus
MNREFEVVNHE

SEQ ID NO: 394936 - protein, 11 aa, Influenza virus
NREFEVVNHEF

SEQ ID NO: 394937 - protein, 11 aa, Influenza virus
REFEVVNHEFS

SEQ ID NO: 394938 - protein, 11 aa, Influenza virus
EKRINMINDKI

SEQ ID NO: 394939 - protein, 11 aa, Influenza virus
INMINDKIDDQ

SEQ ID NO: 394940 - protein, 11 aa, Influenza virus
NMINDKIDDQI

SEQ ID NO: 394941 - protein, 11 aa, Influenza virus
MINDKIDDQIE

SEQ ID NO: 394942 - protein, 11 aa, Influenza virus
DKIDDQIEDLW

SEQ ID NO: 394943 - protein, 11 aa, Influenza virus
KIDDQIEDLWA

SEQ ID NO: 394944 - protein, 11 aa, Influenza virus
IDDQIEDLWAY

SEQ ID NO: 394945 - protein, 11 aa, Influenza virus
DDQIEDLWAYN

SEQ ID NO: 394946 - protein, 11 aa, Influenza virus
DQIEDLWAYNA

SEQ ID NO: 394947 - protein, 11 aa, Influenza virus
QIEDLWAYNAE

SEQ ID NO: 394948 - protein, 11 aa, Influenza virus
IEDLWAYNAEL

SEQ ID NO: 394949 - protein, 11 aa, Influenza virus
EDLWAYNAELL

SEQ ID NO: 394950 - protein, 11 aa, Influenza virus
DLWAYNAELLV

SEQ ID NO: 394951 - protein, 11 aa, Influenza virus
LWAYNAELLVL

SEQ ID NO: 394952 - protein, 11 aa, Influenza virus
WAYNAELLVLL

SEQ ID NO: 394953 - protein, 11 aa, Influenza virus
AYNAELLVLLE

SEQ ID NO: 394954 - protein, 11 aa, Influenza virus
YNAELLVLLEN

SEQ ID NO: 394955 - protein, 11 aa, Influenza virus
NAELLVLLENQ

SEQ ID NO: 394956 - protein, 11 aa, Influenza virus
AELLVLLENQK

SEQ ID NO: 394957 - protein, 11 aa, Influenza virus
ELLVLLENQKT

SEQ ID NO: 394958 - protein, 11 aa, Influenza virus
LLVLLENQKTL

SEQ ID NO: 394959 - protein, 11 aa, Influenza virus
LVLLENQKTLD

SEQ ID NO: 394960 - protein, 11 aa, Influenza virus
VLLENQKTLDE

SEQ ID NO: 394961 - protein, 11 aa, Influenza virus
LLENQKTLDEH

SEQ ID NO: 394962 - protein, 11 aa, Influenza virus
LENQKTLDEHD

SEQ ID NO: 394963 - protein, 11 aa, Influenza virus
ENQKTLDEHDS

SEQ ID NO: 394964 - protein, 11 aa, Influenza virus
NQKTLDEHDSN

SEQ ID NO: 394965 - protein, 11 aa, Influenza virus
QKTLDEHDSNV

SEQ ID NO: 394966 - protein, 11 aa, Influenza virus
KTLDEHDSNVK

SEQ ID NO: 394967 - protein, 11 aa, Influenza virus
TLDEHDSNVKN

SEQ ID NO: 394968 - protein, 11 aa, Influenza virus
LDEHDSNVKNL

SEQ ID NO: 394969 - protein, 11 aa, Influenza virus
DEHDSNVKNLF

SEQ ID NO: 394970 - protein, 11 aa, Influenza virus
EHDSNVKNLFD

SEQ ID NO: 394971 - protein, 11 aa, Influenza virus
HDSNVKNLFDE

SEQ ID NO: 394972 - protein, 11 aa, Influenza virus
DSNVKNLFDEV

SEQ ID NO: 394973 - protein, 11 aa, Influenza virus
SNVKNLFDEVK

SEQ ID NO: 394974 - protein, 11 aa, Influenza virus
NVKNLFDEVKR

SEQ ID NO: 394975 - protein, 11 aa, Influenza virus
VKNLFDEVKRR

SEQ ID NO: 394976 - protein, 11 aa, Influenza virus
KNLFDEVKRRL

SEQ ID NO: 394977 - protein, 11 aa, Influenza virus
NLFDEVKRRLS

SEQ ID NO: 394978 - protein, 11 aa, Influenza virus
LFDEVKRRLSA

SEQ ID NO: 394979 - protein, 11 aa, Influenza virus
FDEVKRRLSAN

SEQ ID NO: 394980 - protein, 11 aa, Influenza virus
DEVKRRLSANA

SEQ ID NO: 394981 - protein, 11 aa, Influenza virus
NAIDAGNGCFD

SEQ ID NO: 394982 - protein, 11 aa, Influenza virus
AIDAGNGCFDI

SEQ ID NO: 394983 - protein, 11 aa, Influenza virus
IDAGNGCFDIL

SEQ ID NO: 394984 - protein, 11 aa, Influenza virus
DAGNGCFDILH

SEQ ID NO: 394985 - protein, 11 aa, Influenza virus
AGNGCFDILHK

SEQ ID NO: 394986 - protein, 11 aa, Influenza virus
GNGCFDILHKC

SEQ ID NO: 394987 - protein, 11 aa, Influenza virus
NGCFDILHKCN

SEQ ID NO: 394988 - protein, 11 aa, Influenza virus
GCFDILHKCNN

SEQ ID NO: 394989 - protein, 11 aa, Influenza virus
CFDILHKCNNE

SEQ ID NO: 394990 - protein, 11 aa, Influenza virus
FDILHKCNNEC

SEQ ID NO: 394991 - protein, 11 aa, Influenza virus
DILHKCNNECM

SEQ ID NO: 394992 - protein, 11 aa, Influenza virus
ILHKCNNECME

SEQ ID NO: 394993 - protein, 11 aa, Influenza virus
LHKCNNECMET

SEQ ID NO: 394994 - protein, 11 aa, Influenza virus
HKCNNECMETI

SEQ ID NO: 394995 - protein, 11 aa, Influenza virus
KCNNECMETIK

SEQ ID NO: 394996 - protein, 11 aa, Influenza virus
CNNECMETIKN

SEQ ID NO: 394997 - protein, 11 aa, Influenza virus
NNECMETIKNG

SEQ ID NO: 394998 - protein, 11 aa, Influenza virus
NECMETIKNGT

SEQ ID NO: 394999 - protein, 11 aa, Influenza virus
ECMETIKNGTY

SEQ ID NO: 395000 - protein, 11 aa, Influenza virus
CMETIKNGTYN

SEQ ID NO: 395001 - protein, 11 aa, Influenza virus
METIKNGTYDH

SEQ ID NO: 395002 - protein, 11 aa, Influenza virus
ETIKNGTYDHK

SEQ ID NO: 395003 - protein, 11 aa, Influenza virus
TIKNGTYNHKE

SEQ ID NO: 395004 - protein, 11 aa, Influenza virus
IKNGTYDHKEY

SEQ ID NO: 395005 - protein, 11 aa, Influenza virus
KNGTYNHKEYE

SEQ ID NO: 395006 - protein, 11 aa, Influenza virus
NGTYNHKEYEE

SEQ ID NO: 395007 - protein, 11 aa, Influenza virus
GTYNHKEYEEE

SEQ ID NO: 395008 - protein, 11 aa, Influenza virus
TYDHKEYEEEA

SEQ ID NO: 395009 - protein, 11 aa, Influenza virus
YNHKEYEEEAK

SEQ ID NO: 395010 - protein, 11 aa, Influenza virus
NHKEYEEEAKL

SEQ ID NO: 395011 - protein, 11 aa, Influenza virus
HKEYEEEAKLE

SEQ ID NO: 395012 - protein, 11 aa, Influenza virus
KEYEEEAKLER

SEQ ID NO: 395013 - protein, 11 aa, Influenza virus
EYEEEAKLERS

SEQ ID NO: 395014 - protein, 11 aa, Influenza virus
YEEEAKLERSK

SEQ ID NO: 395015 - protein, 11 aa, Influenza virus
EEEAKLERSKI

SEQ ID NO: 395016 - protein, 11 aa, Influenza virus
EEAKLERSKIN

SEQ ID NO: 395017 - protein, 11 aa, Influenza virus
EAKLERSKING

SEQ ID NO: 395018 - protein, 11 aa, Influenza virus
AKLERSKINGV

SEQ ID NO: 395019 - protein, 11 aa, Influenza virus
KLERSKINGVK

SEQ ID NO: 395020 - protein, 11 aa, Influenza virus
LERSKINGVKL

SEQ ID NO: 395021 - protein, 11 aa, Influenza virus
ERSKINGVKLE

SEQ ID NO: 395022 - protein, 11 aa, Influenza virus
RSKINGVKLEE

SEQ ID NO: 395023 - protein, 11 aa, Influenza virus
SKINGVKLEEN

SEQ ID NO: 395024 - protein, 11 aa, Influenza virus
KINGVKLEENT

SEQ ID NO: 395025 - protein, 11 aa, Influenza virus
INGVKLEENTT

SEQ ID NO: 395026 - protein, 11 aa, Influenza virus
NGVKLEENTTY

SEQ ID NO: 395027 - protein, 11 aa, Influenza virus
VKLEENTTYKI

SEQ ID NO: 395028 - protein, 11 aa, Influenza virus
KLEENTTYKIL

SEQ ID NO: 395029 - protein, 11 aa, Influenza virus
LEENTTYKILS

SEQ ID NO: 395030 - protein, 11 aa, Influenza virus
EENTTYKILSI

SEQ ID NO: 395031 - protein, 11 aa, Influenza virus
ENTTYKILSIY

SEQ ID NO: 395032 - protein, 11 aa, Influenza virus
NTTYKILSIYS

SEQ ID NO: 395033 - protein, 11 aa, Influenza virus
TTYKILSIYST

SEQ ID NO: 395034 - protein, 11 aa, Influenza virus
TYKILSIYSTV

SEQ ID NO: 395035 - protein, 11 aa, Influenza virus
YKILSIYSTVA

SEQ ID NO: 395036 - protein, 11 aa, Influenza virus
KILSIYSTVAA

SEQ ID NO: 395037 - protein, 11 aa, Influenza virus
ILSIYSTVAAS

SEQ ID NO: 395038 - protein, 11 aa, Influenza virus
LSIYSTVAASL

SEQ ID NO: 395039 - protein, 11 aa, Influenza virus
SIYSTVAASLC

SEQ ID NO: 395040 - protein, 11 aa, Influenza virus
IYSTVAASLCL

SEQ ID NO: 395041 - protein, 11 aa, Influenza virus
YSTVAASLCLA

SEQ ID NO: 395042 - protein, 11 aa, Influenza virus
STVAASLCLAI

SEQ ID NO: 395043 - protein, 11 aa, Influenza virus
TVAASLCLAIL

SEQ ID NO: 395044 - protein, 11 aa, Influenza virus
VAASLCLAILI

SEQ ID NO: 395045 - protein, 11 aa, Influenza virus
AASLCLAILIA

SEQ ID NO: 395046 - protein, 11 aa, Influenza virus
ASLCLAILIAG

SEQ ID NO: 395047 - protein, 11 aa, Influenza virus
SLCLAILIAGG

SEQ ID NO: 395048 - protein, 11 aa, Influenza virus
LCLAILIAGGL

SEQ ID NO: 395049 - protein, 11 aa, Influenza virus
CLAILIAGGLI

SEQ ID NO: 395050 - protein, 11 aa, Influenza virus
LAILIAGGLIL

SEQ ID NO: 395051 - protein, 11 aa, Influenza virus
AILIAGGLILG

SEQ ID NO: 395052 - protein, 11 aa, Influenza virus
ILIAGGLILGM

SEQ ID NO: 395053 - protein, 11 aa, Influenza virus
LIAGGLILGMQ

SEQ ID NO: 395054 - protein, 11 aa, Influenza virus
IAGGLILGMQN

SEQ ID NO: 395055 - protein, 11 aa, Influenza virus
AGGLILGMQNG

SEQ ID NO: 395056 - protein, 11 aa, Influenza virus
GGLILGMQNGS

SEQ ID NO: 395057 - protein, 11 aa, Influenza virus
GLILGMQNGSC

SEQ ID NO: 395058 - protein, 11 aa, Influenza virus
LILGMQNGSCR

SEQ ID NO: 395059 - protein, 11 aa, Influenza virus
ILGMQNGSCRC

SEQ ID NO: 395060 - protein, 11 aa, Influenza virus
LGMQNGSCRCM

SEQ ID NO: 395061 - protein, 11 aa, Influenza virus
GMQNGSCRCMF

SEQ ID NO: 395062 - protein, 11 aa, Influenza virus
MQNGSCRCMFC

SEQ ID NO: 395063 - protein, 11 aa, Influenza virus
QNGSCRCMFCI

SEQ ID NO: 395064 - protein, 11 aa, Influenza virus
RWKHVTNTILL

SEQ ID NO: 395065 - protein, 11 aa, Influenza virus
WKHVTNTILLV

SEQ ID NO: 395066 - protein, 11 aa, Influenza virus
EGLIYGNPSCD

SEQ ID NO: 395067 - protein, 11 aa, Influenza virus
LKPGQTLRIRS

SEQ ID NO: 395068 - protein, 11 aa, Influenza virus
RGLFGAIAGFI

SEQ ID NO: 395069 - protein, 11 aa, Influenza virus
GLFGAIAGFIE

SEQ ID NO: 395070 - protein, 11 aa, Influenza virus
LFGAIAGFIEG

SEQ ID NO: 395071 - protein, 11 aa, Influenza virus
FGAIAGFIEGG

SEQ ID NO: 395072 - protein, 11 aa, Influenza virus
GAIAGFIEGGW

SEQ ID NO: 395073 - protein, 11 aa, Influenza virus
AIAGFIEGGWS

SEQ ID NO: 395074 - protein, 11 aa, Influenza virus
IAGFIEGGWSG

SEQ ID NO: 395075 - protein, 11 aa, Influenza virus
AGFIEGGWSGL

SEQ ID NO: 395076 - protein, 11 aa, Influenza virus
GFIEGGWSGLV

SEQ ID NO: 395077 - protein, 11 aa, Influenza virus
FIEGGWSGLVA

SEQ ID NO: 395078 - protein, 11 aa, Influenza virus
IEGGWSGLVAG

SEQ ID NO: 395079 - protein, 11 aa, Influenza virus
EGGWSGLVAGW

SEQ ID NO: 395080 - protein, 11 aa, Influenza virus
GGWSGLVAGWY

SEQ ID NO: 395081 - protein, 11 aa, Influenza virus
GWSGLVAGWYG

SEQ ID NO: 395082 - protein, 11 aa, Influenza virus
WSGLVAGWYGF

SEQ ID NO: 395083 - protein, 11 aa, Influenza virus
SGLVAGWYGFQ

SEQ ID NO: 395084 - protein, 11 aa, Influenza virus
GLVAGWYGFQH

SEQ ID NO: 395085 - protein, 11 aa, Influenza virus
LVAGWYGFQHS

SEQ ID NO: 395086 - protein, 11 aa, Influenza virus
VAGWYGFQHSN

SEQ ID NO: 395087 - protein, 11 aa, Influenza virus
GWYGFQHSNDQ

SEQ ID NO: 395088 - protein, 11 aa, Influenza virus
WYGFQHSNDQG

SEQ ID NO: 395089 - protein, 11 aa, Influenza virus
DQIQDIWAYNA

SEQ ID NO: 395090 - protein, 11 aa, Influenza virus
QIQDIWAYNAE

SEQ ID NO: 395091 - protein, 11 aa, Influenza virus
IQDIWAYNAEL

SEQ ID NO: 395092 - protein, 11 aa, Influenza virus
QDIWAYNAELL

SEQ ID NO: 395093 - protein, 11 aa, Influenza virus
DIWAYNAELLV

SEQ ID NO: 395094 - protein, 11 aa, Influenza virus
IWAYNAELLVL

SEQ ID NO: 395095 - protein, 11 aa, Influenza virus
WAYNAELLVLL

SEQ ID NO: 395096 - protein, 11 aa, Influenza virus
AYNAELLVLLE

SEQ ID NO: 395097 - protein, 11 aa, Influenza virus
YNAELLVLLEN

SEQ ID NO: 395098 - protein, 11 aa, Influenza virus
NAELLVLLENQ

SEQ ID NO: 395099 - protein, 11 aa, Influenza virus
AELLVLLENQK

SEQ ID NO: 395100 - protein, 11 aa, Influenza virus
ELLVLLENQKT

SEQ ID NO: 395101 - protein, 11 aa, Influenza virus
LLENQKTLDEH

SEQ ID NO: 395102 - protein, 11 aa, Influenza virus
EDGKGCFELYH

SEQ ID NO: 395103 - protein, 11 aa, Influenza virus
GKGCFELYHKC

SEQ ID NO: 395104 - protein, 11 aa, Influenza virus
GTYKILTIYST

SEQ ID NO: 395105 - protein, 11 aa, Influenza virus
TYKILTIYSTV

SEQ ID NO: 395106 - protein, 11 aa, Influenza virus
YKILTIYSTVA

SEQ ID NO: 395107 - protein, 11 aa, Influenza virus
KILTIYSTVAS

SEQ ID NO: 395108 - protein, 11 aa, Influenza virus
ILTIYSTVASS

SEQ ID NO: 395109 - protein, 11 aa, Influenza virus
LTIYSTVASSL

SEQ ID NO: 395110 - protein, 11 aa, Influenza virus
RWKHVTNTILL

SEQ ID NO: 395111 - protein, 11 aa, Influenza virus
WKHVTNTILLV

SEQ ID NO: 395112 - protein, 11 aa, Influenza virus
EGLIYGNPSCD

SEQ ID NO: 395113 - protein, 11 aa, Influenza virus
LKPGQTLRIRS

SEQ ID NO: 395114 - protein, 11 aa, Influenza virus
RGLFGAIAGFI

SEQ ID NO: 395115 - protein, 11 aa, Influenza virus
GLFGAIAGFIE

SEQ ID NO: 395116 - protein, 11 aa, Influenza virus
LFGAIAGFIEG

SEQ ID NO: 395117 - protein, 11 aa, Influenza virus
FGAIAGFIEGG

SEQ ID NO: 395118 - protein, 11 aa, Influenza virus
GAIAGFIEGGW

SEQ ID NO: 395119 - protein, 11 aa, Influenza virus
AIAGFIEGGWS

SEQ ID NO: 395120 - protein, 11 aa, Influenza virus
IAGFIEGGWSG

SEQ ID NO: 395121 - protein, 11 aa, Influenza virus
AGFIEGGWSGL

SEQ ID NO: 395122 - protein, 11 aa, Influenza virus
GFIEGGWSGLV

SEQ ID NO: 395123 - protein, 11 aa, Influenza virus
FIEGGWSGLVA

SEQ ID NO: 395124 - protein, 11 aa, Influenza virus
IEGGWSGLVAG

SEQ ID NO: 395125 - protein, 11 aa, Influenza virus
EGGWSGLVAGW

SEQ ID NO: 395126 - protein, 11 aa, Influenza virus
GGWSGLVAGWY

SEQ ID NO: 395127 - protein, 11 aa, Influenza virus
GWSGLVAGWYG

SEQ ID NO: 395128 - protein, 11 aa, Influenza virus
WSGLVAGWYGF

SEQ ID NO: 395129 - protein, 11 aa, Influenza virus
SGLVAGWYGFQ

SEQ ID NO: 395130 - protein, 11 aa, Influenza virus
GLVAGWYGFQH

SEQ ID NO: 395131 - protein, 11 aa, Influenza virus
LVAGWYGFQHS

SEQ ID NO: 395132 - protein, 11 aa, Influenza virus
VAGWYGFQHSN

SEQ ID NO: 395133 - protein, 11 aa, Influenza virus
GWYGFQHSNDQ

SEQ ID NO: 395134 - protein, 11 aa, Influenza virus
WYGFQHSNDQG

SEQ ID NO: 395135 - protein, 11 aa, Influenza virus
DQIQDIWAYNA

SEQ ID NO: 395136 - protein, 11 aa, Influenza virus
QIQDIWAYNAE

SEQ ID NO: 395137 - protein, 11 aa, Influenza virus
IQDIWAYNAEL

SEQ ID NO: 395138 - protein, 11 aa, Influenza virus
QDIWAYNAELL

SEQ ID NO: 395139 - protein, 11 aa, Influenza virus
DIWAYNAELLV

SEQ ID NO: 395140 - protein, 11 aa, Influenza virus
IWAYNAELLVL

SEQ ID NO: 395141 - protein, 11 aa, Influenza virus
WAYNAELLVLL

SEQ ID NO: 395142 - protein, 11 aa, Influenza virus
AYNAELLVLLE

SEQ ID NO: 395143 - protein, 11 aa, Influenza virus
YNAELLVLLEN

SEQ ID NO: 395144 - protein, 11 aa, Influenza virus
NAELLVLLENQ

SEQ ID NO: 395145 - protein, 11 aa, Influenza virus
AELLVLLENQK

SEQ ID NO: 395146 - protein, 11 aa, Influenza virus
ELLVLLENQKT

SEQ ID NO: 395147 - protein, 11 aa, Influenza virus
LLVLLENQKTL

SEQ ID NO: 395148 - protein, 11 aa, Influenza virus
LVLLENQKTLD

SEQ ID NO: 395149 - protein, 11 aa, Influenza virus
VLLENQKTLDE

SEQ ID NO: 395150 - protein, 11 aa, Influenza virus
LLENQKTLDEH

SEQ ID NO: 395151 - protein, 11 aa, Influenza virus
EDGKGCFELYH

SEQ ID NO: 395152 - protein, 11 aa, Influenza virus
GKGCFELYHKC

SEQ ID NO: 395153 - protein, 11 aa, Influenza virus
GTYKILTIYST

SEQ ID NO: 395154 - protein, 11 aa, Influenza virus
TYKILTIYSTV

SEQ ID NO: 395155 - protein, 11 aa, Influenza virus
YKILTIYSTVA

SEQ ID NO: 395156 - protein, 11 aa, Influenza virus
KILTIYSTVAS

SEQ ID NO: 395157 - protein, 11 aa, Influenza virus
ILTIYSTVASS

SEQ ID NO: 395158 - protein, 11 aa, Influenza virus
LTIYSTVASSL

SEQ ID NO: 395159 - protein, 11 aa, Influenza virus
IAIGSVSRTIA

SEQ ID NO: 395160 - protein, 11 aa, Influenza virus
VPLVPCEPIII

SEQ ID NO: 395161 - protein, 11 aa, Influenza virus
PLVPCEPIIIE

SEQ ID NO: 395162 - protein, 11 aa, Influenza virus
LVPCEPIIIER

SEQ ID NO: 395163 - protein, 11 aa, Influenza virus
CYQFALGQGTT

SEQ ID NO: 395164 - protein, 11 aa, Influenza virus
YQFALGQGTTL

SEQ ID NO: 395165 - protein, 11 aa, Influenza virus
PHRTLLMNELG

SEQ ID NO: 395166 - protein, 11 aa, Influenza virus
HRTLLMNELGV

SEQ ID NO: 395167 - protein, 11 aa, Influenza virus
RTLLMNELGVP

SEQ ID NO: 395168 - protein, 11 aa, Influenza virus
TLLMNELGVPF

SEQ ID NO: 395169 - protein, 11 aa, Influenza virus
LLMNELGVPFH

SEQ ID NO: 395170 - protein, 11 aa, Influenza virus
QVCIAWSSSSC

SEQ ID NO: 395171 - protein, 11 aa, Influenza virus
VCIAWSSSSCH

SEQ ID NO: 395172 - protein, 11 aa, Influenza virus
CIAWSSSSCHD

SEQ ID NO: 395173 - protein, 11 aa, Influenza virus
IAWSSSSCHDG

SEQ ID NO: 395174 - protein, 11 aa, Influenza virus
AWSSSSCHDGK

SEQ ID NO: 395175 - protein, 11 aa, Influenza virus
WSSSSCHDGKA

SEQ ID NO: 395176 - protein, 11 aa, Influenza virus
SSSSCHDGKAW

SEQ ID NO: 395177 - protein, 11 aa, Influenza virus
SSSCHDGKAWL

SEQ ID NO: 395178 - protein, 11 aa, Influenza virus
ILRTQESECVC

SEQ ID NO: 395179 - protein, 11 aa, Influenza virus
GSAQHVEECSC

SEQ ID NO: 395180 - protein, 11 aa, Influenza virus
SAQHVEECSCY

SEQ ID NO: 395181 - protein, 11 aa, Influenza virus
AQHVEECSCYP

SEQ ID NO: 395182 - protein, 11 aa, Influenza virus
VCRDNWKGSNR

SEQ ID NO: 395183 - protein, 11 aa, Influenza virus
CRDNWKGSNRP

SEQ ID NO: 395184 - protein, 11 aa, Influenza virus
YVCSGLVGDTP

SEQ ID NO: 395185 - protein, 11 aa, Influenza virus
VCSGLVGDTPR

SEQ ID NO: 395186 - protein, 11 aa, Influenza virus
CSGLVGDTPRN

SEQ ID NO: 395187 - protein, 11 aa, Influenza virus
CINRCFYVELI

SEQ ID NO: 395188 - protein, 11 aa, Influenza virus
INRCFYVELIR

SEQ ID NO: 395189 - protein, 11 aa, Influenza virus
NRCFYVELIRG

SEQ ID NO: 395190 - protein, 11 aa, Influenza virus
RCFYVELIRGR

SEQ ID NO: 395191 - protein, 11 aa, Influenza virus
CFYVELIRGRP

SEQ ID NO: 395192 - protein, 11 aa, Influenza virus
YGTGSWPDGAN

SEQ ID NO: 395193 - protein, 11 aa, Influenza virus
MLKMSLLTEVE

SEQ ID NO: 395194 - protein, 11 aa, Influenza virus
LKMSLLTEVET

SEQ ID NO: 395195 - protein, 11 aa, Influenza virus
KMSLLTEVETY

SEQ ID NO: 395196 - protein, 11 aa, Influenza virus
MSLLTEVETYV

SEQ ID NO: 395197 - protein, 11 aa, Influenza virus
SLLTEVETYVL

SEQ ID NO: 395198 - protein, 11 aa, Influenza virus
LLTEVETYVLS

SEQ ID NO: 395199 - protein, 11 aa, Influenza virus
LTEVETYVLSI

SEQ ID NO: 395200 - protein, 11 aa, Influenza virus
TEVETYVLSIV

SEQ ID NO: 395201 - protein, 11 aa, Influenza virus
EVETYVLSIVP

SEQ ID NO: 395202 - protein, 11 aa, Influenza virus
VETYVLSIVPS

SEQ ID NO: 395203 - protein, 11 aa, Influenza virus
ETYVLSIVPSG

SEQ ID NO: 395204 - protein, 11 aa, Influenza virus
TYVLSIVPSGP

SEQ ID NO: 395205 - protein, 11 aa, Influenza virus
YVLSIVPSGPL

SEQ ID NO: 395206 - protein, 11 aa, Influenza virus
VLSIVPSGPLK

SEQ ID NO: 395207 - protein, 11 aa, Influenza virus
LSIVPSGPLKA

SEQ ID NO: 395208 - protein, 11 aa, Influenza virus
SIVPSGPLKAE

SEQ ID NO: 395209 - protein, 11 aa, Influenza virus
IVPSGPLKAEI

SEQ ID NO: 395210 - protein, 11 aa, Influenza virus
VPSGPLKAEIA

SEQ ID NO: 395211 - protein, 11 aa, Influenza virus
PSGPLKAEIAQ

SEQ ID NO: 395212 - protein, 11 aa, Influenza virus
SGPLKAEIAQR

SEQ ID NO: 395213 - protein, 11 aa, Influenza virus
GPLKAEIAQRL

SEQ ID NO: 395214 - protein, 11 aa, Influenza virus
PLKAEIAQRLE

SEQ ID NO: 395215 - protein, 11 aa, Influenza virus
LKAEIAQRLED

SEQ ID NO: 395216 - protein, 11 aa, Influenza virus
KAEIAQRLEDV

SEQ ID NO: 395217 - protein, 11 aa, Influenza virus
AEIAQRLEDVF

SEQ ID NO: 395218 - protein, 11 aa, Influenza virus
EIAQRLEDVFA

SEQ ID NO: 395219 - protein, 11 aa, Influenza virus
IAQRLEDVFAG

SEQ ID NO: 395220 - protein, 11 aa, Influenza virus
AQRLEDVFAGK

SEQ ID NO: 395221 - protein, 11 aa, Influenza virus
VFAGKNTDLEA

SEQ ID NO: 395222 - protein, 11 aa, Influenza virus
FAGKNTDLEAL

SEQ ID NO: 395223 - protein, 11 aa, Influenza virus
AGKNTDLEALM

SEQ ID NO: 395224 - protein, 11 aa, Influenza virus
GKNTDLEALME

SEQ ID NO: 395225 - protein, 11 aa, Influenza virus
KNTDLEALMEW

SEQ ID NO: 395226 - protein, 11 aa, Influenza virus
NTDLEALMEWL

SEQ ID NO: 395227 - protein, 11 aa, Influenza virus
TDLEALMEWLK

SEQ ID NO: 395228 - protein, 11 aa, Influenza virus
DLEALMEWLKT

SEQ ID NO: 395229 - protein, 11 aa, Influenza virus
LEALMEWLKTR

SEQ ID NO: 395230 - protein, 11 aa, Influenza virus
EALMEWLKTRP

SEQ ID NO: 395231 - protein, 11 aa, Influenza virus
ALMEWLKTRPI

SEQ ID NO: 395232 - protein, 11 aa, Influenza virus
LMEWLKTRPIL

SEQ ID NO: 395233 - protein, 11 aa, Influenza virus
MEWLKTRPILS

SEQ ID NO: 395234 - protein, 11 aa, Influenza virus
EWLKTRPILSP

SEQ ID NO: 395235 - protein, 11 aa, Influenza virus
WLKTRPILSPL

SEQ ID NO: 395236 - protein, 11 aa, Influenza virus
LKTRPILSPLT

SEQ ID NO: 395237 - protein, 11 aa, Influenza virus
KTRPILSPLTK

SEQ ID NO: 395238 - protein, 11 aa, Influenza virus
TRPILSPLTKG

SEQ ID NO: 395239 - protein, 11 aa, Influenza virus
RPILSPLTKGI

SEQ ID NO: 395240 - protein, 11 aa, Influenza virus
PILSPLTKGIL

SEQ ID NO: 395241 - protein, 11 aa, Influenza virus
ILSPLTKGILG

SEQ ID NO: 395242 - protein, 11 aa, Influenza virus
LSPLTKGILGF

SEQ ID NO: 395243 - protein, 11 aa, Influenza virus
SPLTKGILGFV

SEQ ID NO: 395244 - protein, 11 aa, Influenza virus
PLTKGILGFVF

SEQ ID NO: 395245 - protein, 11 aa, Influenza virus
LTKGILGFVFT

SEQ ID NO: 395246 - protein, 11 aa, Influenza virus
TKGILGFVFTL

SEQ ID NO: 395247 - protein, 11 aa, Influenza virus
KGILGFVFTLT

SEQ ID NO: 395248 - protein, 11 aa, Influenza virus
GILGFVFTLTV

SEQ ID NO: 395249 - protein, 11 aa, Influenza virus
ILGFVFTLTVP

SEQ ID NO: 395250 - protein, 11 aa, Influenza virus
LGFVFTLTVPS

SEQ ID NO: 395251 - protein, 11 aa, Influenza virus
GFVFTLTVPSE

SEQ ID NO: 395252 - protein, 11 aa, Influenza virus
FVFTLTVPSER

SEQ ID NO: 395253 - protein, 11 aa, Influenza virus
VFTLTVPSERG

SEQ ID NO: 395254 - protein, 11 aa, Influenza virus
FTLTVPSERGL

SEQ ID NO: 395255 - protein, 11 aa, Influenza virus
TLTVPSERGLQ

SEQ ID NO: 395256 - protein, 11 aa, Influenza virus
LTVPSERGLQR

SEQ ID NO: 395257 - protein, 11 aa, Influenza virus
TVPSERGLQRR

SEQ ID NO: 395258 - protein, 11 aa, Influenza virus
VPSERGLQRRR

SEQ ID NO: 395259 - protein, 11 aa, Influenza virus
PSERGLQRRRF

SEQ ID NO: 395260 - protein, 11 aa, Influenza virus
SERGLQRRRFV

SEQ ID NO: 395261 - protein, 11 aa, Influenza virus
ERGLQRRRFVQ

SEQ ID NO: 395262 - protein, 11 aa, Influenza virus
RGLQRRRFVQN

SEQ ID NO: 395263 - protein, 11 aa, Influenza virus
GLQRRRFVQNA

SEQ ID NO: 395264 - protein, 11 aa, Influenza virus
LQRRRFVQNAL

SEQ ID NO: 395265 - protein, 11 aa, Influenza virus
QRRRFVQNALN

SEQ ID NO: 395266 - protein, 11 aa, Influenza virus
RRRFVQNALNG

SEQ ID NO: 395267 - protein, 11 aa, Influenza virus
RRFVQNALNGN

SEQ ID NO: 395268 - protein, 11 aa, Influenza virus
RFVQNALNGNG

SEQ ID NO: 395269 - protein, 11 aa, Influenza virus
FVQNALNGNGD

SEQ ID NO: 395270 - protein, 11 aa, Influenza virus
VQNALNGNGDP

SEQ ID NO: 395271 - protein, 11 aa, Influenza virus
QNALNGNGDPN

SEQ ID NO: 395272 - protein, 11 aa, Influenza virus
NALNGNGDPNN

SEQ ID NO: 395273 - protein, 11 aa, Influenza virus
ALNGNGDPNNM

SEQ ID NO: 395274 - protein, 11 aa, Influenza virus
LNGNGDPNNMD

SEQ ID NO: 395275 - protein, 11 aa, Influenza virus
NGNGDPNNMDR

SEQ ID NO: 395276 - protein, 11 aa, Influenza virus
GNGDPNNMDRA

SEQ ID NO: 395277 - protein, 11 aa, Influenza virus
NGDPNNMDRAV

SEQ ID NO: 395278 - protein, 11 aa, Influenza virus
GDPNNMDRAVK

SEQ ID NO: 395279 - protein, 11 aa, Influenza virus
DPNNMDRAVKL

SEQ ID NO: 395280 - protein, 11 aa, Influenza virus
PNNMDRAVKLY

SEQ ID NO: 395281 - protein, 11 aa, Influenza virus
NMDRAVKLYRK

SEQ ID NO: 395282 - protein, 11 aa, Influenza virus
MDRAVKLYRKL

SEQ ID NO: 395283 - protein, 11 aa, Influenza virus
DRAVKLYRKLK

SEQ ID NO: 395284 - protein, 11 aa, Influenza virus
RAVKLYRKLKR

SEQ ID NO: 395285 - protein, 11 aa, Influenza virus
AVKLYRKLKRE

SEQ ID NO: 395286 - protein, 11 aa, Influenza virus
VKLYRKLKREI

SEQ ID NO: 395287 - protein, 11 aa, Influenza virus
KLYRKLKREIT

SEQ ID NO: 395288 - protein, 11 aa, Influenza virus
LYRKLKREITF

SEQ ID NO: 395289 - protein, 11 aa, Influenza virus
YRKLKREITFH

SEQ ID NO: 395290 - protein, 11 aa, Influenza virus
RKLKREITFHG

SEQ ID NO: 395291 - protein, 11 aa, Influenza virus
KLKREITFHGA

SEQ ID NO: 395292 - protein, 11 aa, Influenza virus
LKREITFHGAK

SEQ ID NO: 395293 - protein, 11 aa, Influenza virus
KREITFHGAKE

SEQ ID NO: 395294 - protein, 11 aa, Influenza virus
REITFHGAKEV

SEQ ID NO: 395295 - protein, 11 aa, Influenza virus
ALSYSTGALAS

SEQ ID NO: 395296 - protein, 11 aa, Influenza virus
LSYSTGALASC

SEQ ID NO: 395297 - protein, 11 aa, Influenza virus
SYSTGALASCM

SEQ ID NO: 395298 - protein, 11 aa, Influenza virus
YSTGALASCMG

SEQ ID NO: 395299 - protein, 11 aa, Influenza virus
STGALASCMGL

SEQ ID NO: 395300 - protein, 11 aa, Influenza virus
TGALASCMGLI

SEQ ID NO: 395301 - protein, 11 aa, Influenza virus
GALASCMGLIY

SEQ ID NO: 395302 - protein, 11 aa, Influenza virus
ALASCMGLIYN

SEQ ID NO: 395303 - protein, 11 aa, Influenza virus
LASCMGLIYNR

SEQ ID NO: 395304 - protein, 11 aa, Influenza virus
ASCMGLIYNRM

SEQ ID NO: 395305 - protein, 11 aa, Influenza virus
SCMGLIYNRMG

SEQ ID NO: 395306 - protein, 11 aa, Influenza virus
CMGLIYNRMGT

SEQ ID NO: 395307 - protein, 11 aa, Influenza virus
MGLIYNRMGTV

SEQ ID NO: 395308 - protein, 11 aa, Influenza virus
GLIYNRMGTVT

SEQ ID NO: 395309 - protein, 11 aa, Influenza virus
AFGLVCATCEQ

SEQ ID NO: 395310 - protein, 11 aa, Influenza virus
FGLVCATCEQI

SEQ ID NO: 395311 - protein, 11 aa, Influenza virus
GLVCATCEQIA

SEQ ID NO: 395312 - protein, 11 aa, Influenza virus
LVCATCEQIAD

SEQ ID NO: 395313 - protein, 11 aa, Influenza virus
VCATCEQIADS

SEQ ID NO: 395314 - protein, 11 aa, Influenza virus
CATCEQIADSQ

SEQ ID NO: 395315 - protein, 11 aa, Influenza virus
ATCEQIADSQH

SEQ ID NO: 395316 - protein, 11 aa, Influenza virus
TCEQIADSQHR

SEQ ID NO: 395317 - protein, 11 aa, Influenza virus
CEQIADSQHRS

SEQ ID NO: 395318 - protein, 11 aa, Influenza virus
EQIADSQHRSH

SEQ ID NO: 395319 - protein, 11 aa, Influenza virus
QIADSQHRSHR

SEQ ID NO: 395320 - protein, 11 aa, Influenza virus
IADSQHRSHRQ

SEQ ID NO: 395321 - protein, 11 aa, Influenza virus
ADSQHRSHRQM

SEQ ID NO: 395322 - protein, 11 aa, Influenza virus
TTTNPLIRHEN

SEQ ID NO: 395323 - protein, 11 aa, Influenza virus
TTNPLIRHENR

SEQ ID NO: 395324 - protein, 11 aa, Influenza virus
TNPLIRHENRM

SEQ ID NO: 395325 - protein, 11 aa, Influenza virus
NPLIRHENRMV

SEQ ID NO: 395326 - protein, 11 aa, Influenza virus
PLIRHENRMVL

SEQ ID NO: 395327 - protein, 11 aa, Influenza virus
LIRHENRMVLA

SEQ ID NO: 395328 - protein, 11 aa, Influenza virus
IRHENRMVLAS

SEQ ID NO: 395329 - protein, 11 aa, Influenza virus
RHENRMVLAST

SEQ ID NO: 395330 - protein, 11 aa, Influenza virus
HENRMVLASTT

SEQ ID NO: 395331 - protein, 11 aa, Influenza virus
ENRMVLASTTA

SEQ ID NO: 395332 - protein, 11 aa, Influenza virus
NRMVLASTTAK

SEQ ID NO: 395333 - protein, 11 aa, Influenza virus
RMVLASTTAKA

SEQ ID NO: 395334 - protein, 11 aa, Influenza virus
MVLASTTAKAM

SEQ ID NO: 395335 - protein, 11 aa, Influenza virus
VLASTTAKAME

SEQ ID NO: 395336 - protein, 11 aa, Influenza virus
LASTTAKAMEQ

SEQ ID NO: 395337 - protein, 11 aa, Influenza virus
ASTTAKAMEQM

SEQ ID NO: 395338 - protein, 11 aa, Influenza virus
STTAKAMEQMA

SEQ ID NO: 395339 - protein, 11 aa, Influenza virus
TTAKAMEQMAG

SEQ ID NO: 395340 - protein, 11 aa, Influenza virus
TAKAMEQMAGS

SEQ ID NO: 395341 - protein, 11 aa, Influenza virus
AKAMEQMAGSS

SEQ ID NO: 395342 - protein, 11 aa, Influenza virus
KAMEQMAGSSE

SEQ ID NO: 395343 - protein, 11 aa, Influenza virus
AMEQMAGSSEQ

SEQ ID NO: 395344 - protein, 11 aa, Influenza virus
MEQMAGSSEQA

SEQ ID NO: 395345 - protein, 11 aa, Influenza virus
EQMAGSSEQAA

SEQ ID NO: 395346 - protein, 11 aa, Influenza virus
QMAGSSEQAAE

SEQ ID NO: 395347 - protein, 11 aa, Influenza virus
MAGSSEQAAEA

SEQ ID NO: 395348 - protein, 11 aa, Influenza virus
AGSSEQAAEAM

SEQ ID NO: 395349 - protein, 11 aa, Influenza virus
GSSEQAAEAME

SEQ ID NO: 395350 - protein, 11 aa, Influenza virus
SEQAAEAMEVA

SEQ ID NO: 395351 - protein, 11 aa, Influenza virus
LLENLQAYQKR

SEQ ID NO: 395352 - protein, 11 aa, Influenza virus
LENLQAYQKRM

SEQ ID NO: 395353 - protein, 11 aa, Influenza virus
ENLQAYQKRMG

SEQ ID NO: 395354 - protein, 11 aa, Influenza virus
NLQAYQKRMGV

SEQ ID NO: 395355 - protein, 11 aa, Influenza virus
LQAYQKRMGVQ

SEQ ID NO: 395356 - protein, 11 aa, Influenza virus
QAYQKRMGVQM

SEQ ID NO: 395357 - protein, 11 aa, Influenza virus
YQKRMGVQMQR

SEQ ID NO: 395358 - protein, 11 aa, Influenza virus
RMGVQMQRFRR

SEQ ID NO: 395359 - protein, 11 aa, Influenza virus
MGVQMQRFRRP

SEQ ID NO: 395360 - protein, 11 aa, Influenza virus
GVQMQRFRRPD

SEQ ID NO: 395361 - protein, 11 aa, Influenza virus
VQMQRFRRPDS

SEQ ID NO: 395362 - protein, 11 aa, Influenza virus
QMQRFRRPDSS

SEQ ID NO: 395363 - protein, 11 aa, Influenza virus
MQRFRRPDSSW

SEQ ID NO: 395364 - protein, 11 aa, Influenza virus
QRFRRPDSSWL

SEQ ID NO: 395365 - protein, 11 aa, Influenza virus
RFRRPDSSWLF

SEQ ID NO: 395366 - protein, 11 aa, Influenza virus
FRRPDSSWLFG

SEQ ID NO: 395367 - protein, 11 aa, Influenza virus
RRPDSSWLFGG

SEQ ID NO: 395368 - protein, 11 aa, Influenza virus
SSRHCSKYHWN

SEQ ID NO: 395369 - protein, 11 aa, Influenza virus
SRHCSKYHWNL

SEQ ID NO: 395370 - protein, 11 aa, Influenza virus
RHCSKYHWNLA

SEQ ID NO: 395371 - protein, 11 aa, Influenza virus
HCSKYHWNLAL

SEQ ID NO: 395372 - protein, 11 aa, Influenza virus
CSKYHWNLALD

SEQ ID NO: 395373 - protein, 11 aa, Influenza virus
SKYHWNLALDI

SEQ ID NO: 395374 - protein, 11 aa, Influenza virus
KYHWNLALDIV

SEQ ID NO: 395375 - protein, 11 aa, Influenza virus
YHWNLALDIVD

SEQ ID NO: 395376 - protein, 11 aa, Influenza virus
HWNLALDIVDS

SEQ ID NO: 395377 - protein, 11 aa, Influenza virus
RPTRNGWGCKC

SEQ ID NO: 395378 - protein, 11 aa, Influenza virus
DDHFVSIELEG

SEQ ID NO: 395379 - protein, 11 aa, Influenza virus
SKSRVDNHSMS

SEQ ID NO: 395380 - protein, 11 aa, Influenza virus
KSRVDNHSMSD

SEQ ID NO: 395381 - protein, 11 aa, Influenza virus
SRVDNHSMSDI

SEQ ID NO: 395382 - protein, 11 aa, Influenza virus
RVDNHSMSDIE

SEQ ID NO: 395383 - protein, 11 aa, Influenza virus
VDNHSMSDIEA

SEQ ID NO: 395384 - protein, 11 aa, Influenza virus
DNHSMSDIEAM

SEQ ID NO: 395385 - protein, 11 aa, Influenza virus
NHSMSDIEAMA

SEQ ID NO: 395386 - protein, 11 aa, Influenza virus
HSMSDIEAMAS

SEQ ID NO: 395387 - protein, 11 aa, Influenza virus
SMSDIEAMASQ

SEQ ID NO: 395388 - protein, 11 aa, Influenza virus
MSDIEAMASQG

SEQ ID NO: 395389 - protein, 11 aa, Influenza virus
SDIEAMASQGT

SEQ ID NO: 395390 - protein, 11 aa, Influenza virus
DIEAMASQGTK

SEQ ID NO: 395391 - protein, 11 aa, Influenza virus
IEAMASQGTKR

SEQ ID NO: 395392 - protein, 11 aa, Influenza virus
EAMASQGTKRS

SEQ ID NO: 395393 - protein, 11 aa, Influenza virus
AMASQGTKRSY

SEQ ID NO: 395394 - protein, 11 aa, Influenza virus
MASQGTKRSYE

SEQ ID NO: 395395 - protein, 11 aa, Influenza virus
ASQGTKRSYEQ

SEQ ID NO: 395396 - protein, 11 aa, Influenza virus
SQGTKRSYEQM

SEQ ID NO: 395397 - protein, 11 aa, Influenza virus
QGTKRSYEQME

SEQ ID NO: 395398 - protein, 11 aa, Influenza virus
GTKRSYEQMET

SEQ ID NO: 395399 - protein, 11 aa, Influenza virus
TKRSYEQMETG

SEQ ID NO: 395400 - protein, 11 aa, Influenza virus
KRSYEQMETGG

SEQ ID NO: 395401 - protein, 11 aa, Influenza virus
SEQMETGGERQ

SEQ ID NO: 395402 - protein, 11 aa, Influenza virus
GIGRFYIQMCT

SEQ ID NO: 395403 - protein, 11 aa, Influenza virus
IGRFYIQMCTE

SEQ ID NO: 395404 - protein, 11 aa, Influenza virus
GRFYIQMCTEL

SEQ ID NO: 395405 - protein, 11 aa, Influenza virus
RFYIQMCTELK

SEQ ID NO: 395406 - protein, 11 aa, Influenza virus
FYIQMCTELKL

SEQ ID NO: 395407 - protein, 11 aa, Influenza virus
YIQMCTELKLS

SEQ ID NO: 395408 - protein, 11 aa, Influenza virus
GRLIQNSITIE

SEQ ID NO: 395409 - protein, 11 aa, Influenza virus
TIERMVLSAFD

SEQ ID NO: 395410 - protein, 11 aa, Influenza virus
IERMVLSAFDE

SEQ ID NO: 395411 - protein, 11 aa, Influenza virus
ERMVLSAFDER

SEQ ID NO: 395412 - protein, 11 aa, Influenza virus
RMVLSAFDERR

SEQ ID NO: 395413 - protein, 11 aa, Influenza virus
MVLSAFDERRN

SEQ ID NO: 395414 - protein, 11 aa, Influenza virus
VLSAFDERRNK

SEQ ID NO: 395415 - protein, 11 aa, Influenza virus
LSAFDERRNKY

SEQ ID NO: 395416 - protein, 11 aa, Influenza virus
SAFDERRNKYL

SEQ ID NO: 395417 - protein, 11 aa, Influenza virus
AFDERRNKYLE

SEQ ID NO: 395418 - protein, 11 aa, Influenza virus
FDERRNKYLEE

SEQ ID NO: 395419 - protein, 11 aa, Influenza virus
DERRNKYLEEH

SEQ ID NO: 395420 - protein, 11 aa, Influenza virus
ERRNKYLEEHP

SEQ ID NO: 395421 - protein, 11 aa, Influenza virus
RRNKYLEEHPS

SEQ ID NO: 395422 - protein, 11 aa, Influenza virus
RNKYLEEHPSA

SEQ ID NO: 395423 - protein, 11 aa, Influenza virus
NKYLEEHPSAG

SEQ ID NO: 395424 - protein, 11 aa, Influenza virus
YLEEHPSAGKD

SEQ ID NO: 395425 - protein, 11 aa, Influenza virus
LEEHPSAGKDP

SEQ ID NO: 395426 - protein, 11 aa, Influenza virus
EEHPSAGKDPK

SEQ ID NO: 395427 - protein, 11 aa, Influenza virus
EHPSAGKDPKK

SEQ ID NO: 395428 - protein, 11 aa, Influenza virus
HPSAGKDPKKT

SEQ ID NO: 395429 - protein, 11 aa, Influenza virus
PSAGKDPKKTG

SEQ ID NO: 395430 - protein, 11 aa, Influenza virus
SAGKDPKKTGG

SEQ ID NO: 395431 - protein, 11 aa, Influenza virus
AGKDPKKTGGP

SEQ ID NO: 395432 - protein, 11 aa, Influenza virus
GKDPKKTGGPI

SEQ ID NO: 395433 - protein, 11 aa, Influenza virus
KDPKKTGGPIY

SEQ ID NO: 395434 - protein, 11 aa, Influenza virus
DPKKTGGPIYR

SEQ ID NO: 395435 - protein, 11 aa, Influenza virus
PKKTGGPIYRR

SEQ ID NO: 395436 - protein, 11 aa, Influenza virus
AGLTHIMIWHS

SEQ ID NO: 395437 - protein, 11 aa, Influenza virus
GLTHIMIWHSN

SEQ ID NO: 395438 - protein, 11 aa, Influenza virus
LTHIMIWHSNL

SEQ ID NO: 395439 - protein, 11 aa, Influenza virus
THIMIWHSNLN

SEQ ID NO: 395440 - protein, 11 aa, Influenza virus
HIMIWHSNLND

SEQ ID NO: 395441 - protein, 11 aa, Influenza virus
LMIWHSNLNDA

SEQ ID NO: 395442 - protein, 11 aa, Influenza virus
MIWHSNLNDAT

SEQ ID NO: 395443 - protein, 11 aa, Influenza virus
IWHSNLNDATY

SEQ ID NO: 395444 - protein, 11 aa, Influenza virus
WHSNLNDATYQ

SEQ ID NO: 395445 - protein, 11 aa, Influenza virus
HSNLNDATYQR

SEQ ID NO: 395446 - protein, 11 aa, Influenza virus
SNLNDATYQRT

SEQ ID NO: 395447 - protein, 11 aa, Influenza virus
NLNDATYQRTR

SEQ ID NO: 395448 - protein, 11 aa, Influenza virus
LNDATYQRTRA

SEQ ID NO: 395449 - protein, 11 aa, Influenza virus
NDATYQRTRAL

SEQ ID NO: 395450 - protein, 11 aa, Influenza virus
DATYQRTRALV

SEQ ID NO: 395451 - protein, 11 aa, Influenza virus
ATYQRTRALVR

SEQ ID NO: 395452 - protein, 11 aa, Influenza virus
TYQRTRALVRT

SEQ ID NO: 395453 - protein, 11 aa, Influenza virus
YQRTRALVRTG

SEQ ID NO: 395454 - protein, 11 aa, Influenza virus
QRTRALVRTGM

SEQ ID NO: 395455 - protein, 11 aa, Influenza virus
RTRALVRTGMD

SEQ ID NO: 395456 - protein, 11 aa, Influenza virus
TRALVRTGMDP

SEQ ID NO: 395457 - protein, 11 aa, Influenza virus
RALVRTGMDPR

SEQ ID NO: 395458 - protein, 11 aa, Influenza virus
ALVRTGMDPRM

SEQ ID NO: 395459 - protein, 11 aa, Influenza virus
LVRTGMDPRMC

SEQ ID NO: 395460 - protein, 11 aa, Influenza virus
VRTGMDPRMCS

SEQ ID NO: 395461 - protein, 11 aa, Influenza virus
RTGMDPRMCSL

SEQ ID NO: 395462 - protein, 11 aa, Influenza virus
TGMDPRMCSLM

SEQ ID NO: 395463 - protein, 11 aa, Influenza virus
GMDPRMCSLMQ

SEQ ID NO: 395464 - protein, 11 aa, Influenza virus
MDPRMCSLMQG

SEQ ID NO: 395465 - protein, 11 aa, Influenza virus
DPRMCSLMQGS

SEQ ID NO: 395466 - protein, 11 aa, Influenza virus
PRMCSLMQGST

SEQ ID NO: 395467 - protein, 11 aa, Influenza virus
RMCSLMQGSTL

SEQ ID NO: 395468 - protein, 11 aa, Influenza virus
MCSLMQGSTLP

SEQ ID NO: 395469 - protein, 11 aa, Influenza virus
CSLMQGSTLPR

SEQ ID NO: 395470 - protein, 11 aa, Influenza virus
SLMQGSTLPRR

SEQ ID NO: 395471 - protein, 11 aa, Influenza virus
LMQGSTLPRRS

SEQ ID NO: 395472 - protein, 11 aa, Influenza virus
MQGSTLPRRSG

SEQ ID NO: 395473 - protein, 11 aa, Influenza virus
QGSTLPRRSGA

SEQ ID NO: 395474 - protein, 11 aa, Influenza virus
GSTLPRRSGAA

SEQ ID NO: 395475 - protein, 11 aa, Influenza virus
STLPRRSGAAG

SEQ ID NO: 395476 - protein, 11 aa, Influenza virus
TLPRRSGAAGA

SEQ ID NO: 395477 - protein, 11 aa, Influenza virus
LPRRSGAAGAA

SEQ ID NO: 395478 - protein, 11 aa, Influenza virus
PRRSGAAGAAV

SEQ ID NO: 395479 - protein, 11 aa, Influenza virus
RRSGAAGAAVK

SEQ ID NO: 395480 - protein, 11 aa, Influenza virus
RSGAAGAAVKG

SEQ ID NO: 395481 - protein, 11 aa, Influenza virus
SGAAGAAVKGV

SEQ ID NO: 395482 - protein, 11 aa, Influenza virus
GAAGAAVKGVG

SEQ ID NO: 395483 - protein, 11 aa, Influenza virus
AAGAAVKGVGT

SEQ ID NO: 395484 - protein, 11 aa, Influenza virus
AGAAVKGVGTM

SEQ ID NO: 395485 - protein, 11 aa, Influenza virus
VMELIRMIKRG

SEQ ID NO: 395486 - protein, 11 aa, Influenza virus
MELIRMIKRGI

SEQ ID NO: 395487 - protein, 11 aa, Influenza virus
ELIRMIKRGIN

SEQ ID NO: 395488 - protein, 11 aa, Influenza virus
LIRMIKRGIND

SEQ ID NO: 395489 - protein, 11 aa, Influenza virus
IRMIKRGINDR

SEQ ID NO: 395490 - protein, 11 aa, Influenza virus
RMIKRGINDRN

SEQ ID NO: 395491 - protein, 11 aa, Influenza virus
MIKRGINDRNF

SEQ ID NO: 395492 - protein, 11 aa, Influenza virus
IKRGINDRNFW

SEQ ID NO: 395493 - protein, 11 aa, Influenza virus
KRGINDRNFWR

SEQ ID NO: 395494 - protein, 11 aa, Influenza virus
RGINDRNFWRG

SEQ ID NO: 395495 - protein, 11 aa, Influenza virus
GINDRNFWRGE

SEQ ID NO: 395496 - protein, 11 aa, Influenza virus
INDRNFWRGEN

SEQ ID NO: 395497 - protein, 11 aa, Influenza virus
NDRNFWRGENG

SEQ ID NO: 395498 - protein, 11 aa, Influenza virus
DRNFWRGENGR

SEQ ID NO: 395499 - protein, 11 aa, Influenza virus
RNFWRGENGRR

SEQ ID NO: 395500 - protein, 11 aa, Influenza virus
NFWRGENGRRT

SEQ ID NO: 395501 - protein, 11 aa, Influenza virus
FWRGENGRRTR

SEQ ID NO: 395502 - protein, 11 aa, Influenza virus
TRIAYERMCNI

SEQ ID NO: 395503 - protein, 11 aa, Influenza virus
RIAYERMCNIL

SEQ ID NO: 395504 - protein, 11 aa, Influenza virus
IAYERMCNILK

SEQ ID NO: 395505 - protein, 11 aa, Influenza virus
AYERMCNILKG

SEQ ID NO: 395506 - protein, 11 aa, Influenza virus
YERMCNILKGK

SEQ ID NO: 395507 - protein, 11 aa, Influenza virus
ERMCNILKGKF

SEQ ID NO: 395508 - protein, 11 aa, Influenza virus
RMCNILKGKFQ

SEQ ID NO: 395509 - protein, 11 aa, Influenza virus
MCNILKGKFQT

SEQ ID NO: 395510 - protein, 11 aa, Influenza virus
CNILKGKFQTA

SEQ ID NO: 395511 - protein, 11 aa, Influenza virus
NILKGKFQTAA

SEQ ID NO: 395512 - protein, 11 aa, Influenza virus
ILKGKFQTAAQ

SEQ ID NO: 395513 - protein, 11 aa, Influenza virus
LKGKFQTAAQR

SEQ ID NO: 395514 - protein, 11 aa, Influenza virus
SKGSSKQQHKE

SEQ ID NO: 395515 - protein, 11 aa, Influenza virus
KGKFQTAAQRA

SEQ ID NO: 395516 - protein, 11 aa, Influenza virus
GKFQTAAQRAM

SEQ ID NO: 395517 - protein, 11 aa, Influenza virus
KFQTAAQRAMM

SEQ ID NO: 395518 - protein, 11 aa, Influenza virus
FQTAAQRAMMD

SEQ ID NO: 395519 - protein, 11 aa, Influenza virus
QTAAQRAMMDQ

SEQ ID NO: 395520 - protein, 11 aa, Influenza virus
TAAQRAMMDQV

SEQ ID NO: 395521 - protein, 11 aa, Influenza virus
AAQRAMMDQVR

SEQ ID NO: 395522 - protein, 11 aa, Influenza virus
AQRAMMDQVRE

SEQ ID NO: 395523 - protein, 11 aa, Influenza virus
QRAMMDQVRES

SEQ ID NO: 395524 - protein, 11 aa, Influenza virus
RAMMDQVRESR

SEQ ID NO: 395525 - protein, 11 aa, Influenza virus
AMMDQVRESRN

SEQ ID NO: 395526 - protein, 11 aa, Influenza virus
MMDQVRESRNP

SEQ ID NO: 395527 - protein, 11 aa, Influenza virus
MDQVRESRNPG

SEQ ID NO: 395528 - protein, 11 aa, Influenza virus
DQVRESRNPGN

SEQ ID NO: 395529 - protein, 11 aa, Influenza virus
QVRESRNPGNA

SEQ ID NO: 395530 - protein, 11 aa, Influenza virus
VRESRNPGNAE

SEQ ID NO: 395531 - protein, 11 aa, Influenza virus
RESRNPGNAEI

SEQ ID NO: 395532 - protein, 11 aa, Influenza virus
ESRNPGNAEIE

SEQ ID NO: 395533 - protein, 11 aa, Influenza virus
SRNPGNAEIED

SEQ ID NO: 395534 - protein, 11 aa, Influenza virus
RNPGNAEIEDL

SEQ ID NO: 395535 - protein, 11 aa, Influenza virus
NPGNAEIEDLI

SEQ ID NO: 395536 - protein, 11 aa, Influenza virus
PGNAEIEDLIF

SEQ ID NO: 395537 - protein, 11 aa, Influenza virus
GNAEIEDLIFL

SEQ ID NO: 395538 - protein, 11 aa, Influenza virus
NAEIEDLIFLA

SEQ ID NO: 395539 - protein, 11 aa, Influenza virus
AEIEDLIFLAR

SEQ ID NO: 395540 - protein, 11 aa, Influenza virus
EIEDLIFLARS

SEQ ID NO: 395541 - protein, 11 aa, Influenza virus
IEDLIFLARSA

SEQ ID NO: 395542 - protein, 11 aa, Influenza virus
EDLIFLARSAL

SEQ ID NO: 395543 - protein, 11 aa, Influenza virus
DLIFLARSALI

SEQ ID NO: 395544 - protein, 11 aa, Influenza virus
LIFLARSALIL

SEQ ID NO: 395545 - protein, 11 aa, Influenza virus
IFLARSALILR

SEQ ID NO: 395546 - protein, 11 aa, Influenza virus
FLARSALILRG

SEQ ID NO: 395547 - protein, 11 aa, Influenza virus
LARSALILRGS

SEQ ID NO: 395548 - protein, 11 aa, Influenza virus
ARSALILRGSV

SEQ ID NO: 395549 - protein, 11 aa, Influenza virus
RSALILRGSVA

SEQ ID NO: 395550 - protein, 11 aa, Influenza virus
SASALILRGSV

SEQ ID NO: 395551 - protein, 11 aa, Influenza virus
ASALILRGSVA

SEQ ID NO: 395552 - protein, 11 aa, Influenza virus
SALILRGSVAH

SEQ ID NO: 395553 - protein, 11 aa, Influenza virus
ALILRGSVAHK

SEQ ID NO: 395554 - protein, 11 aa, Influenza virus
LILRGSVAHKS

SEQ ID NO: 395555 - protein, 11 aa, Influenza virus
ILRGSVAHKSC

SEQ ID NO: 395556 - protein, 11 aa, Influenza virus
LRGSVAHKSCL

SEQ ID NO: 395557 - protein, 11 aa, Influenza virus
RGSVAHKSCLP

SEQ ID NO: 395558 - protein, 11 aa, Influenza virus
GSVAHKSCLPA

SEQ ID NO: 395559 - protein, 11 aa, Influenza virus
SVAHKSCLPAC

SEQ ID NO: 395560 - protein, 11 aa, Influenza virus
VAHKSCLPACV

SEQ ID NO: 395561 - protein, 11 aa, Influenza virus
AHKSCLPACVY

SEQ ID NO: 395562 - protein, 11 aa, Influenza virus
HKSCLPACVYG

SEQ ID NO: 395563 - protein, 11 aa, Influenza virus
KSCLPACVYGL

SEQ ID NO: 395564 - protein, 11 aa, Influenza virus
SCLPACVYGLA

SEQ ID NO: 395565 - protein, 11 aa, Influenza virus
GYDFEREGYSL

SEQ ID NO: 395566 - protein, 11 aa, Influenza virus
YDFEREGYSLV

SEQ ID NO: 395567 - protein, 11 aa, Influenza virus
DFEREGYSLVG

SEQ ID NO: 395568 - protein, 11 aa, Influenza virus
FEREGYSLVGI

SEQ ID NO: 395569 - protein, 11 aa, Influenza virus
EREGYSLVGID

SEQ ID NO: 395570 - protein, 11 aa, Influenza virus
REGYSLVGIDP

SEQ ID NO: 395571 - protein, 11 aa, Influenza virus
EGYSLVGIDPF

SEQ ID NO: 395572 - protein, 11 aa, Influenza virus
GYSLVGIDPFK

SEQ ID NO: 395573 - protein, 11 aa, Influenza virus
YSLVGIDPFKL

SEQ ID NO: 395574 - protein, 11 aa, Influenza virus
SLVGIDPFKLL

SEQ ID NO: 395575 - protein, 11 aa, Influenza virus
LVGIDPFKLLQ

SEQ ID NO: 395576 - protein, 11 aa, Influenza virus
DPDPFRLLQNS

SEQ ID NO: 395577 - protein, 11 aa, Influenza virus
PDPFRLLQNSQ

SEQ ID NO: 395578 - protein, 11 aa, Influenza virus
DPFRLLQNSQV

SEQ ID NO: 395579 - protein, 11 aa, Influenza virus
PRLLQNSQVFS

SEQ ID NO: 395580 - protein, 11 aa, Influenza virus
RPNENPAHKSQ

SEQ ID NO: 395581 - protein, 11 aa, Influenza virus
PNENPAHKSQL

SEQ ID NO: 395582 - protein, 11 aa, Influenza virus
NENPAHKSQLV

SEQ ID NO: 395583 - protein, 11 aa, Influenza virus
ENPAHKSQLVW

SEQ ID NO: 395584 - protein, 11 aa, Influenza virus
NPAHKSQLVWM

SEQ ID NO: 395585 - protein, 11 aa, Influenza virus
PAHKSQLVWMA

SEQ ID NO: 395586 - protein, 11 aa, Influenza virus
AHKSQLVWMAC

SEQ ID NO: 395587 - protein, 11 aa, Influenza virus
HKSQLVWMACH

SEQ ID NO: 395588 - protein, 11 aa, Influenza virus
KSQLVWMACHS

SEQ ID NO: 395589 - protein, 11 aa, Influenza virus
SQLVWMACHSA

SEQ ID NO: 395590 - protein, 11 aa, Influenza virus
QLVWMACHSAA

SEQ ID NO: 395591 - protein, 11 aa, Influenza virus
LVWMACHSAAF

SEQ ID NO: 395592 - protein, 11 aa, Influenza virus
VWMACHSAAFE

SEQ ID NO: 395593 - protein, 11 aa, Influenza virus
WMACHSAAFED

SEQ ID NO: 395594 - protein, 11 aa, Influenza virus
MACHSAAFEDL

SEQ ID NO: 395595 - protein, 11 aa, Influenza virus
ACHSAAFEDLR

SEQ ID NO: 395596 - protein, 11 aa, Influenza virus
CHSAAFEDLRV

SEQ ID NO: 395597 - protein, 11 aa, Influenza virus
LSTRGVQIASN

SEQ ID NO: 395598 - protein, 11 aa, Influenza virus
STRGVQIASNE

SEQ ID NO: 395599 - protein, 11 aa, Influenza virus
TRGVQIASNEN

SEQ ID NO: 395600 - protein, 11 aa, Influenza virus
TLELRSRYWAI

SEQ ID NO: 395601 - protein, 11 aa, Influenza virus
LELRSRYWAIR

SEQ ID NO: 395602 - protein, 11 aa, Influenza virus
ELRSRYWAIRT

SEQ ID NO: 395603 - protein, 11 aa, Influenza virus
LRSRYWAIRTR

SEQ ID NO: 395604 - protein, 11 aa, Influenza virus
RSRYWAIRTRS

SEQ ID NO: 395605 - protein, 11 aa, Influenza virus
SRYWAIRTRSG

SEQ ID NO: 395606 - protein, 11 aa, Influenza virus
RYWAIRTRSGG

SEQ ID NO: 395607 - protein, 11 aa, Influenza virus
YWAIRTRSGGN

SEQ ID NO: 395608 - protein, 11 aa, Influenza virus
WAIRTRSGGNT

SEQ ID NO: 395609 - protein, 11 aa, Influenza virus
AIRTRSGGNTN

SEQ ID NO: 395610 - protein, 11 aa, Influenza virus
IRTRSGGNTNQ

SEQ ID NO: 395611 - protein, 11 aa, Influenza virus
SVQPTFSVQRN

SEQ ID NO: 395612 - protein, 11 aa, Influenza virus
VQPTFSVQRNL

SEQ ID NO: 395613 - protein, 11 aa, Influenza virus
QPTFSVQRNLP

SEQ ID NO: 395614 - protein, 11 aa, Influenza virus
PTFSVQRNLPF

SEQ ID NO: 395615 - protein, 11 aa, Influenza virus
TFSVQRNLPFE

SEQ ID NO: 395616 - protein, 11 aa, Influenza virus
FSVQRNLPFER

SEQ ID NO: 395617 - protein, 11 aa, Influenza virus
EGRTSDMRTEI

SEQ ID NO: 395618 - protein, 11 aa, Influenza virus
GRTSDMRTEII

SEQ ID NO: 395619 - protein, 11 aa, Influenza virus
RRAEIIKMESA

SEQ ID NO: 395620 - protein, 11 aa, Influenza virus
TEIIIRMMENA

SEQ ID NO: 395621 - protein, 11 aa, Influenza virus
EIIIRMMENAR

SEQ ID NO: 395622 - protein, 11 aa, Influenza virus
IIIRMMENARP

SEQ ID NO: 395623 - protein, 11 aa, Influenza virus
DVSFQGRGVFE

SEQ ID NO: 395624 - protein, 11 aa, Influenza virus
VSFQGRGVFEL

SEQ ID NO: 395625 - protein, 11 aa, Influenza virus
SFQGRGVFELS

SEQ ID NO: 395626 - protein, 11 aa, Influenza virus
FQGRGVFELSD

SEQ ID NO: 395627 - protein, 11 aa, Influenza virus
QGRGVFELSDE

SEQ ID NO: 395628 - protein, 11 aa, Influenza virus
GRGVFELSDEK

SEQ ID NO: 395629 - protein, 11 aa, Influenza virus
RRGQGHLDEKA

SEQ ID NO: 395630 - protein, 11 aa, Influenza virus
RGVFELSDEKA

SEQ ID NO: 395631 - protein, 11 aa, Influenza virus
GVFELSDEKAT

SEQ ID NO: 395632 - protein, 11 aa, Influenza virus
MSNEGSYFFGD

SEQ ID NO: 395633 - protein, 11 aa, Influenza virus
SNEGSYFFGDN

SEQ ID NO: 395634 - protein, 11 aa, Influenza virus
NEGSYFFGDNA

SEQ ID NO: 395635 - protein, 11 aa, Influenza virus
EGSYFFGDNAE

SEQ ID NO: 395636 - protein, 11 aa, Influenza virus
GSYFFGDNAEE

SEQ ID NO: 395637 - protein, 11 aa, Influenza virus
SYFFGDNAEEY

SEQ ID NO: 395638 - protein, 11 aa, Influenza virus
GDNAEEYRRLR

SEQ ID NO: 395639 - protein, 11 aa, Influenza virus
MLFVQSYFQLF

SEQ ID NO: 395640 - protein, 11 aa, Influenza virus
LFVQSYFQLFL

SEQ ID NO: 395641 - protein, 11 aa, Influenza virus
FVQSYFQLFLV

SEQ ID NO: 395642 - protein, 11 aa, Influenza virus
VQSYFQLFLVC

SEQ ID NO: 395643 - protein, 11 aa, Influenza virus
QSYFQLFLVCV

SEQ ID NO: 395644 - protein, 11 aa, Influenza virus
SYFQLFLVCVS

SEQ ID NO: 395645 - protein, 11 aa, Influenza virus
YFQLFLVCVSL

SEQ ID NO: 395646 - protein, 11 aa, Influenza virus
FQLFLVCVSLL

SEQ ID NO: 395647 - protein, 11 aa, Influenza virus
QLFLVCVSLLQ

SEQ ID NO: 395648 - protein, 11 aa, Influenza virus
LFLVCVSLLQS

SEQ ID NO: 395649 - protein, 11 aa, Influenza virus
FLVCVSLLQSA

SEQ ID NO: 395650 - protein, 11 aa, Influenza virus
LVCVSLLQSAI

SEQ ID NO: 395651 - protein, 11 aa, Influenza virus
VCVSLLQSAIL

SEQ ID NO: 395652 - protein, 11 aa, Influenza virus
CVSLLQSAILS

SEQ ID NO: 395653 - protein, 11 aa, Influenza virus
VSLLQSAILSL

SEQ ID NO: 395654 - protein, 11 aa, Influenza virus
SLLQSAILSLQ

SEQ ID NO: 395655 - protein, 11 aa, Influenza virus
LLQSAILSLQT

SEQ ID NO: 395656 - protein, 11 aa, Influenza virus
FQVDCFLWHVR

SEQ ID NO: 395657 - protein, 11 aa, Influenza virus
GDAPFLDRLRR

SEQ ID NO: 395658 - protein, 11 aa, Influenza virus
DAPFLDRLRRD

SEQ ID NO: 395659 - protein, 11 aa, Influenza virus
APFLDRLRRDQ

SEQ ID NO: 395660 - protein, 11 aa, Influenza virus
SLLLLQANLCR

SEQ ID NO: 395661 - protein, 11 aa, Influenza virus
LLLLQANLCRF

SEQ ID NO: 395662 - protein, 11 aa, Influenza virus
LLLQANLCRFL

SEQ ID NO: 395663 - protein, 11 aa, Influenza virus
LLQANLCRFLE

SEQ ID NO: 395664 - protein, 11 aa, Influenza virus
LQANLCRFLET

SEQ ID NO: 395665 - protein, 11 aa, Influenza virus
QANLCRFLETR

SEQ ID NO: 395666 - protein, 11 aa, Influenza virus
ANLCRFLETRT

SEQ ID NO: 395667 - protein, 11 aa, Influenza virus
NLCRFLETRTV

SEQ ID NO: 395668 - protein, 11 aa, Influenza virus
PMRTPIAFLTS

SEQ ID NO: 395669 - protein, 11 aa, Influenza virus
MRTPIAFLTSS

SEQ ID NO: 395670 - protein, 11 aa, Influenza virus
RTPIAFLTSSI

SEQ ID NO: 395671 - protein, 11 aa, Influenza virus
TPIAFLTSSIV

SEQ ID NO: 395672 - protein, 11 aa, Influenza virus
PIAFLTSSIVC

SEQ ID NO: 395673 - protein, 11 aa, Influenza virus
IAFLTSSIVCP

SEQ ID NO: 395674 - protein, 11 aa, Influenza virus
AFLTSSIVCPG

SEQ ID NO: 395675 - protein, 11 aa, Influenza virus
FLTSSIVCPGK

SEQ ID NO: 395676 - protein, 11 aa, Influenza virus
IASVPASRYLI

SEQ ID NO: 395677 - protein, 11 aa, Influenza virus
ASVPASRYLID

SEQ ID NO: 395678 - protein, 11 aa, Influenza virus
SKITLKFAFNM

SEQ ID NO: 395679 - protein, 11 aa, Influenza virus
KITLKFAFNMM

SEQ ID NO: 395680 - protein, 11 aa, Influenza virus
ITLKFAFNMMF

SEQ ID NO: 395681 - protein, 11 aa, Influenza virus
AGVETMVILSA

SEQ ID NO: 395682 - protein, 11 aa, Influenza virus
GVETMVILSAS

SEQ ID NO: 395683 - protein, 11 aa, Influenza virus
NWPSSSGGLEW

SEQ ID NO: 395684 - protein, 11 aa, Influenza virus
SRNGKWREQLS

SEQ ID NO: 395685 - protein, 11 aa, Influenza virus
RNGKWREQLSQ

SEQ ID NO: 395686 - protein, 11 aa, Influenza virus
NGKWREQLSQK

SEQ ID NO: 395687 - protein, 11 aa, Influenza virus
GKWREQLSQKF

SEQ ID NO: 395688 - protein, 11 aa, Influenza virus
KWREQLSQKFE

SEQ ID NO: 395689 - protein, 11 aa, Influenza virus
WREQLSQKFEE

SEQ ID NO: 395690 - protein, 11 aa, Influenza virus
REQLSQKFEEI

SEQ ID NO: 395691 - protein, 11 aa, Influenza virus
EQLSQKFEEIR

SEQ ID NO: 395692 - protein, 11 aa, Influenza virus
QLSQKFEEIRW

SEQ ID NO: 395693 - protein, 11 aa, Influenza virus
LSQKFEEIRWL

SEQ ID NO: 395694 - protein, 11 aa, Influenza virus
SEVRRDQMAHC

SEQ ID NO: 395695 - protein, 11 aa, Influenza virus
EVRRDQMAHCR

SEQ ID NO: 395696 - protein, 11 aa, Influenza virus
VRHRLKITENS

SEQ ID NO: 395697 - protein, 11 aa, Influenza virus
RHRLKITENSF

SEQ ID NO: 395698 - protein, 11 aa, Influenza virus
HRLKITENSFE

SEQ ID NO: 395699 - protein, 11 aa, Influenza virus
RLKITENSFEQ

SEQ ID NO: 395700 - protein, 11 aa, Influenza virus
LKITENSFEQI

SEQ ID NO: 395701 - protein, 11 aa, Influenza virus
KITENSFEQIT

SEQ ID NO: 395702 - protein, 11 aa, Influenza virus
ITENSFEQITF

SEQ ID NO: 395703 - protein, 11 aa, Influenza virus
TENSFEQITFM

SEQ ID NO: 395704 - protein, 11 aa, Influenza virus
ENSFEQITFMQ

SEQ ID NO: 395705 - protein, 11 aa, Influenza virus
NSFEQITFMQA

SEQ ID NO: 395706 - protein, 11 aa, Influenza virus
SFEQITFMQAL

SEQ ID NO: 395707 - protein, 11 aa, Influenza virus
FEQITFMQALQ

SEQ ID NO: 395708 - protein, 11 aa, Influenza virus
EQITFMQALQL

SEQ ID NO: 395709 - protein, 11 aa, Influenza virus
TAFSGMSANGD

SEQ ID NO: 395710 - protein, 11 aa, Influenza virus
AFSGMSANGDI

SEQ ID NO: 395711 - protein, 11 aa, Influenza virus
FSGMSANGDIL

SEQ ID NO: 395712 - protein, 11 aa, Influenza virus
SGMSANGDILM

SEQ ID NO: 395713 - protein, 11 aa, Influenza virus
GMSANGDILMR

SEQ ID NO: 395714 - protein, 11 aa, Influenza virus
FQYLLFQDILM

SEQ ID NO: 395715 - protein, 11 aa, Influenza virus
QYLLFQDILMR

SEQ ID NO: 395716 - protein, 11 aa, Influenza virus
YLLFQDILMRM

SEQ ID NO: 395717 - protein, 11 aa, Influenza virus
LLFQDILMRMS

SEQ ID NO: 395718 - protein, 11 aa, Influenza virus
LFQDILMRMSK

SEQ ID NO: 395719 - protein, 11 aa, Influenza virus
LWHVRKRFADQ

SEQ ID NO: 395720 - protein, 11 aa, Influenza virus
WHVRKRFADQE

SEQ ID NO: 395721 - protein, 11 aa, Influenza virus
HVRKRFADQEL

SEQ ID NO: 395722 - protein, 11 aa, Influenza virus
VRKRFADQELG

SEQ ID NO: 395723 - protein, 11 aa, Influenza virus
RKRFADQELGD

SEQ ID NO: 395724 - protein, 11 aa, Influenza virus
KRFADQELGDA

SEQ ID NO: 395725 - protein, 11 aa, Influenza virus
RFADQELGDAP

SEQ ID NO: 395726 - protein, 11 aa, Influenza virus
FADQELGDAPF

SEQ ID NO: 395727 - protein, 11 aa, Influenza virus
ADQELGDAPFL

SEQ ID NO: 395728 - protein, 11 aa, Influenza virus
DQELGDAPFLD

SEQ ID NO: 395729 - protein, 11 aa, Influenza virus
QELGDAPFLDR

SEQ ID NO: 395730 - protein, 11 aa, Influenza virus
ELGDAPFLDRL

SEQ ID NO: 395731 - protein, 11 aa, Influenza virus
LGDAPFLDRLR

SEQ ID NO: 395732 - protein, 11 aa, Influenza virus
GDAPFLDRLRR

SEQ ID NO: 395733 - protein, 11 aa, Influenza virus
DAPFLDRLRRD

SEQ ID NO: 395734 - protein, 11 aa, Influenza virus
APFLDRLRRDQ

SEQ ID NO: 395735 - protein, 11 aa, Influenza virus
PFLDRLRRDQK

SEQ ID NO: 395736 - protein, 11 aa, Influenza virus
FLDRLRRDQKS

SEQ ID NO: 395737 - protein, 11 aa, Influenza virus
LDRLRRDQKSL

SEQ ID NO: 395738 - protein, 11 aa, Influenza virus
DRLRRDQKSLR

SEQ ID NO: 395739 - protein, 11 aa, Influenza virus
RLRRDQKSLRG

SEQ ID NO: 395740 - protein, 11 aa, Influenza virus
LRRDQKSLRGR

SEQ ID NO: 395741 - protein, 11 aa, Influenza virus
RRDQKSLRGRG

SEQ ID NO: 395742 - protein, 11 aa, Influenza virus
RDQKSLRGRGS

SEQ ID NO: 395743 - protein, 11 aa, Influenza virus
DQKSLRGRGST

SEQ ID NO: 395744 - protein, 11 aa, Influenza virus
QKSLRGRGSTL

SEQ ID NO: 395745 - protein, 11 aa, Influenza virus
KSLRGRGSTLG

SEQ ID NO: 395746 - protein, 11 aa, Influenza virus
SLRGRGSTLGL

SEQ ID NO: 395747 - protein, 11 aa, Influenza virus
LRGRGSTLGLD

SEQ ID NO: 395748 - protein, 11 aa, Influenza virus
RGRGSTLGLDI

SEQ ID NO: 395749 - protein, 11 aa, Influenza virus
GRGSTLGLDIR

SEQ ID NO: 395750 - protein, 11 aa, Influenza virus
RGSTLGLDIRT

SEQ ID NO: 395751 - protein, 11 aa, Influenza virus
GSTLGLDIRTA

SEQ ID NO: 395752 - protein, 11 aa, Influenza virus
STLGLDIRTAT

SEQ ID NO: 395753 - protein, 11 aa, Influenza virus
TLGLDIRTATR

SEQ ID NO: 395754 - protein, 11 aa, Influenza virus
LGLDIRTATRE

SEQ ID NO: 395755 - protein, 11 aa, Influenza virus
GLDIRTATREG

SEQ ID NO: 395756 - protein, 11 aa, Influenza virus
LDIRTATREGK

SEQ ID NO: 395757 - protein, 11 aa, Influenza virus
DIRTATREGKH

SEQ ID NO: 395758 - protein, 11 aa, Influenza virus
IRTATREGKHI

SEQ ID NO: 395759 - protein, 11 aa, Influenza virus
RTATREGKHIV

SEQ ID NO: 395760 - protein, 11 aa, Influenza virus
TATREGKHIVE

SEQ ID NO: 395761 - protein, 11 aa, Influenza virus
ATREGKHIVER

SEQ ID NO: 395762 - protein, 11 aa, Influenza virus
TREGKHIVERI

SEQ ID NO: 395763 - protein, 11 aa, Influenza virus
REGKHIVERIL

SEQ ID NO: 395764 - protein, 11 aa, Influenza virus
EGKHIVERILE

SEQ ID NO: 395765 - protein, 11 aa, Influenza virus
GKHIVERILEE

SEQ ID NO: 395766 - protein, 11 aa, Influenza virus
KHIVERILEEE

SEQ ID NO: 395767 - protein, 11 aa, Influenza virus
HIVERILEEES

SEQ ID NO: 395768 - protein, 11 aa, Influenza virus
IVERILEEESD

SEQ ID NO: 395769 - protein, 11 aa, Influenza virus
VERILEEESDE

SEQ ID NO: 395770 - protein, 11 aa, Influenza virus
ERILEEESDEA

SEQ ID NO: 395771 - protein, 11 aa, Influenza virus
RILEEESDEAL

SEQ ID NO: 395772 - protein, 11 aa, Influenza virus
ILEEESDEALK

SEQ ID NO: 395773 - protein, 11 aa, Influenza virus
LEEESDEALKM

SEQ ID NO: 395774 - protein, 11 aa, Influenza virus
EEESDEALKMT

SEQ ID NO: 395775 - protein, 11 aa, Influenza virus
EESDEALKMTI

SEQ ID NO: 395776 - protein, 11 aa, Influenza virus
ESDEALKMTIA

SEQ ID NO: 395777 - protein, 11 aa, Influenza virus
SDEALKMTIAS

SEQ ID NO: 395778 - protein, 11 aa, Influenza virus
DEALKMTIASD

SEQ ID NO: 395779 - protein, 11 aa, Influenza virus
EALKMTIASDI

SEQ ID NO: 395780 - protein, 11 aa, Influenza virus
ALKMTIASDIL

SEQ ID NO: 395781 - protein, 11 aa, Influenza virus
LKMTIASDILT

SEQ ID NO: 395782 - protein, 11 aa, Influenza virus
KMTIASDILKR

SEQ ID NO: 395783 - protein, 11 aa, Influenza virus
MTIASDILKRM

SEQ ID NO: 395784 - protein, 11 aa, Influenza virus
TIASDILKRMS

SEQ ID NO: 395785 - protein, 11 aa, Influenza virus
IASDILTRMSK

SEQ ID NO: 395786 - protein, 11 aa, Influenza virus
ASDILTRMSKM

SEQ ID NO: 395787 - protein, 11 aa, Influenza virus
RPHPEDLNGMI

SEQ ID NO: 395788 - protein, 11 aa, Influenza virus
TENSFEQITFM

SEQ ID NO: 395789 - protein, 11 aa, Influenza virus
ENSFEQITFMQ

SEQ ID NO: 395790 - protein, 11 aa, Influenza virus
NSFEQITFMQA

SEQ ID NO: 395791 - protein, 11 aa, Influenza virus
SFEQITFMQAL

SEQ ID NO: 395792 - protein, 11 aa, Influenza virus
FEQITFMQALQ

SEQ ID NO: 395793 - protein, 11 aa, Influenza virus
EQITFMQALQL

SEQ ID NO: 395794 - protein, 11 aa, Influenza virus
QITFMQALQLL

SEQ ID NO: 395795 - protein, 11 aa, Influenza virus
ITFMQALQLLL

SEQ ID NO: 395796 - protein, 11 aa, Influenza virus
TFMQALQLLLE

SEQ ID NO: 395797 - protein, 11 aa, Influenza virus
FMQALQLLLEV

SEQ ID NO: 395798 - protein, 11 aa, Influenza virus
MQALQLLLEVE

SEQ ID NO: 395799 - protein, 11 aa, Influenza virus
QALQLLLEVEQ

SEQ ID NO: 395800 - protein, 11 aa, Influenza virus
ALQLLLEVEQE

SEQ ID NO: 395801 - protein, 11 aa, Influenza virus
EIRTFSFQLIL

SEQ ID NO: 395802 - protein, 11 aa, Influenza virus
IRTFSFQLILL

SEQ ID NO: 395803 - protein, 11 aa, Influenza virus
RTFSFQLINNK

SEQ ID NO: 395804 - protein, 11 aa, Influenza virus
TFSFQLINNKK

SEQ ID NO: 395805 - protein, 11 aa, Influenza virus
FSFQLINNKKP

SEQ ID NO: 395806 - protein, 11 aa, Influenza virus
MEDFVRQCFNP

SEQ ID NO: 395807 - protein, 11 aa, Influenza virus
RQCFNPMIVEL

SEQ ID NO: 395808 - protein, 11 aa, Influenza virus
QCFNPMIVELA

SEQ ID NO: 395809 - protein, 11 aa, Influenza virus
CFNPMIVELAE

SEQ ID NO: 395810 - protein, 11 aa, Influenza virus
ELAEKAMKEYG

SEQ ID NO: 395811 - protein, 11 aa, Influenza virus
LAEKAMKEYGE

SEQ ID NO: 395812 - protein, 11 aa, Influenza virus
ETNKFAAICTH

SEQ ID NO: 395813 - protein, 11 aa, Influenza virus
TNKFAAICTHL

SEQ ID NO: 395814 - protein, 11 aa, Influenza virus
NKFAAICTHLE

SEQ ID NO: 395815 - protein, 11 aa, Influenza virus
AAICTHLEVCF

SEQ ID NO: 395816 - protein, 11 aa, Influenza virus
AICTHLEVCFM

SEQ ID NO: 395817 - protein, 11 aa, Influenza virus
ICTHLEVCFMY

SEQ ID NO: 395818 - protein, 11 aa, Influenza virus
CTHLEVCFMYS

SEQ ID NO: 395819 - protein, 11 aa, Influenza virus
THLEVCFMYSD

SEQ ID NO: 395820 - protein, 11 aa, Influenza virus
HLEVCFMYSDF

SEQ ID NO: 395821 - protein, 11 aa, Influenza virus
LEVCFMYSDFH

SEQ ID NO: 395822 - protein, 11 aa, Influenza virus
EVCFMYSDFHF

SEQ ID NO: 395823 - protein, 11 aa, Influenza virus
VCFMYSDFHFI

SEQ ID NO: 395824 - protein, 11 aa, Influenza virus
CFMYSDFHFID

SEQ ID NO: 395825 - protein, 11 aa, Influenza virus
FMYSDFHFIDE

SEQ ID NO: 395826 - protein, 11 aa, Influenza virus
MYSDFHFIDER

SEQ ID NO: 395827 - protein, 11 aa, Influenza virus
DPNALLKHRFE

SEQ ID NO: 395828 - protein, 11 aa, Influenza virus
PNALLKHRFEI

SEQ ID NO: 395829 - protein, 11 aa, Influenza virus
NALLKHRFEII

SEQ ID NO: 395830 - protein, 11 aa, Influenza virus
ALLKHRFEIIE

SEQ ID NO: 395831 - protein, 11 aa, Influenza virus
LLKHRFEIIEG

SEQ ID NO: 395832 - protein, 11 aa, Influenza virus
LKHRFEIIEGR

SEQ ID NO: 395833 - protein, 11 aa, Influenza virus
KHRFEIIEGRD

SEQ ID NO: 395834 - protein, 11 aa, Influenza virus
HRFEIIEGRDR

SEQ ID NO: 395835 - protein, 11 aa, Influenza virus
RFEIIEGRDRT

SEQ ID NO: 395836 - protein, 11 aa, Influenza virus
KPKFLPDLYDY

SEQ ID NO: 395837 - protein, 11 aa, Influenza virus
PKFLPDLYDYK

SEQ ID NO: 395838 - protein, 11 aa, Influenza virus
LPDLYDYKENR

SEQ ID NO: 395839 - protein, 11 aa, Influenza virus
PDLYDYKENRF

SEQ ID NO: 395840 - protein, 11 aa, Influenza virus
RFIEIGVTRRE

SEQ ID NO: 395841 - protein, 11 aa, Influenza virus
IGVTRREVHIY

SEQ ID NO: 395842 - protein, 11 aa, Influenza virus
GVTRREVHIYY

SEQ ID NO: 395843 - protein, 11 aa, Influenza virus
VTRREVHIYYL

SEQ ID NO: 395844 - protein, 11 aa, Influenza virus
TRREVHIYYLE

SEQ ID NO: 395845 - protein, 11 aa, Influenza virus
RREVHIYYLEK

SEQ ID NO: 395846 - protein, 11 aa, Influenza virus
YYLEKANKIKS

SEQ ID NO: 395847 - protein, 11 aa, Influenza virus
THIHIFSFTGE

SEQ ID NO: 395848 - protein, 11 aa, Influenza virus
HIHIFSFTGEE

SEQ ID NO: 395849 - protein, 11 aa, Influenza virus
IHIFSFTGEEM

SEQ ID NO: 395850 - protein, 11 aa, Influenza virus
HIFSFTGEEMA

SEQ ID NO: 395851 - protein, 11 aa, Influenza virus
IFSFTGEEMAT

SEQ ID NO: 395852 - protein, 11 aa, Influenza virus
FSFTGEEMATK

SEQ ID NO: 395853 - protein, 11 aa, Influenza virus
DYTLDEESRAR

SEQ ID NO: 395854 - protein, 11 aa, Influenza virus
YTLDEESRARI

SEQ ID NO: 395855 - protein, 11 aa, Influenza virus
TLDEESRARIK

SEQ ID NO: 395856 - protein, 11 aa, Influenza virus
LDEESRARIKT

SEQ ID NO: 395857 - protein, 11 aa, Influenza virus
ASSKSRARIKT

SEQ ID NO: 395858 - protein, 11 aa, Influenza virus
DEESRARIKTR

SEQ ID NO: 395859 - protein, 11 aa, Influenza virus
EESRARIKTRL

SEQ ID NO: 395860 - protein, 11 aa, Influenza virus
ESRARIKTRLF

SEQ ID NO: 395861 - protein, 11 aa, Influenza virus
SRARIKTRLFT

SEQ ID NO: 395862 - protein, 11 aa, Influenza virus
RARIKTRLFTI

SEQ ID NO: 395863 - protein, 11 aa, Influenza virus
ARIKTRLFTIR

SEQ ID NO: 395864 - protein, 11 aa, Influenza virus
RIKTRLFTIRQ

SEQ ID NO: 395865 - protein, 11 aa, Influenza virus
IKTRLFTIRQE

SEQ ID NO: 395866 - protein, 11 aa, Influenza virus
KTRLFTIRQEM

SEQ ID NO: 395867 - protein, 11 aa, Influenza virus
TRLFTIRQEMA

SEQ ID NO: 395868 - protein, 11 aa, Influenza virus
RLFTIRQEMAS

SEQ ID NO: 395869 - protein, 11 aa, Influenza virus
RGLWDSFRQSE

SEQ ID NO: 395870 - protein, 11 aa, Influenza virus
GLWDSFRQSER

SEQ ID NO: 395871 - protein, 11 aa, Influenza virus
LWDSFRQSERG

SEQ ID NO: 395872 - protein, 11 aa, Influenza virus
WDSFRQSERGE

SEQ ID NO: 395873 - protein, 11 aa, Influenza virus
DSFRQSERGEE

SEQ ID NO: 395874 - protein, 11 aa, Influenza virus
SFRQSERGEET

SEQ ID NO: 395875 - protein, 11 aa, Influenza virus
FRQSERGEETI

SEQ ID NO: 395876 - protein, 11 aa, Influenza virus
RQSERGEETIE

SEQ ID NO: 395877 - protein, 11 aa, Influenza virus
QSERGEETIEE

SEQ ID NO: 395878 - protein, 11 aa, Influenza virus
SERGEETIEER

SEQ ID NO: 395879 - protein, 11 aa, Influenza virus
ERGEETIEERF

SEQ ID NO: 395880 - protein, 11 aa, Influenza virus
RGEETIEERFE

SEQ ID NO: 395881 - protein, 11 aa, Influenza virus
GEETIEERFEI

SEQ ID NO: 395882 - protein, 11 aa, Influenza virus
RSIEEKFEITG

SEQ ID NO: 395883 - protein, 11 aa, Influenza virus
LADQSLPPNFS

SEQ ID NO: 395884 - protein, 11 aa, Influenza virus
FRAYVDGFEPN

SEQ ID NO: 395885 - protein, 11 aa, Influenza virus
YVDGFEPNGCI

SEQ ID NO: 395886 - protein, 11 aa, Influenza virus
VDGFEPNGCIE

SEQ ID NO: 395887 - protein, 11 aa, Influenza virus
FEPNGCIEGKL

SEQ ID NO: 395888 - protein, 11 aa, Influenza virus
PNGCIEGKLSQ

SEQ ID NO: 395889 - protein, 11 aa, Influenza virus
NGCIEGKLSQM

SEQ ID NO: 395890 - protein, 11 aa, Influenza virus
GCIEGKLSQMS

SEQ ID NO: 395891 - protein, 11 aa, Influenza virus
CIEGKLSQMSK

SEQ ID NO: 395892 - protein, 11 aa, Influenza virus
CSQRSKFLLMD

SEQ ID NO: 395893 - protein, 11 aa, Influenza virus
QRSKFLLMDAL

SEQ ID NO: 395894 - protein, 11 aa, Influenza virus
RSKFLLMDALK

SEQ ID NO: 395895 - protein, 11 aa, Influenza virus
SKFLLMDALKL

SEQ ID NO: 395896 - protein, 11 aa, Influenza virus
KFLLMDALKLS

SEQ ID NO: 395897 - protein, 11 aa, Influenza virus
FLLMDALKLSI

SEQ ID NO: 395898 - protein, 11 aa, Influenza virus
LLMDALKLSIE

SEQ ID NO: 395899 - protein, 11 aa, Influenza virus
LMDALKLSIED

SEQ ID NO: 395900 - protein, 11 aa, Influenza virus
MDALKLSIEDP

SEQ ID NO: 395901 - protein, 11 aa, Influenza virus
KLSIEDPSHEG

SEQ ID NO: 395902 - protein, 11 aa, Influenza virus
LSIEDPSHEGE

SEQ ID NO: 395903 - protein, 11 aa, Influenza virus
KASKEPEVHEG

SEQ ID NO: 395904 - protein, 11 aa, Influenza virus
ASKEPEVHEGE

SEQ ID NO: 395905 - protein, 11 aa, Influenza virus
SIEDPSHEGEG

SEQ ID NO: 395906 - protein, 11 aa, Influenza virus
IEDPSHEGEGI

SEQ ID NO: 395907 - protein, 11 aa, Influenza virus
EDPSHEGEGIP

SEQ ID NO: 395908 - protein, 11 aa, Influenza virus
DPSHEGEGIPL

SEQ ID NO: 395909 - protein, 11 aa, Influenza virus
PSHEGEGIPLY

SEQ ID NO: 395910 - protein, 11 aa, Influenza virus
SHEGEGIPLYD

SEQ ID NO: 395911 - protein, 11 aa, Influenza virus
HEGEGIPLYDA

SEQ ID NO: 395912 - protein, 11 aa, Influenza virus
EGEGIPLYDAI

SEQ ID NO: 395913 - protein, 11 aa, Influenza virus
GEGIPLYDAIK

SEQ ID NO: 395914 - protein, 11 aa, Influenza virus
EGIPLYDAIKC

SEQ ID NO: 395915 - protein, 11 aa, Influenza virus
LKDEEKIPKTK

SEQ ID NO: 395916 - protein, 11 aa, Influenza virus
LKWALGENMAP

SEQ ID NO: 395917 - protein, 11 aa, Influenza virus
KWALGENMAPE

SEQ ID NO: 395918 - protein, 11 aa, Influenza virus
WALGENMAPEK

SEQ ID NO: 395919 - protein, 11 aa, Influenza virus
LGENMAPEKVD

SEQ ID NO: 395920 - protein, 11 aa, Influenza virus
GENMAPEKVDF

SEQ ID NO: 395921 - protein, 11 aa, Influenza virus
WIQSEFNKACE

SEQ ID NO: 395922 - protein, 11 aa, Influenza virus
IQSEFNKACEL

SEQ ID NO: 395923 - protein, 11 aa, Influenza virus
QNEFNKACELT

SEQ ID NO: 395924 - protein, 11 aa, Influenza virus
NEFNKACELTD

SEQ ID NO: 395925 - protein, 11 aa, Influenza virus
EFNKACELTDS

SEQ ID NO: 395926 - protein, 11 aa, Influenza virus
FNKACELTDSS

SEQ ID NO: 395927 - protein, 11 aa, Influenza virus
NKACELTDSSW

SEQ ID NO: 395928 - protein, 11 aa, Influenza virus
KTAYELTDSSW

SEQ ID NO: 395929 - protein, 11 aa, Influenza virus
TAYELTDSSWI

SEQ ID NO: 395930 - protein, 11 aa, Influenza virus
ELDEIGEDVAP

SEQ ID NO: 395931 - protein, 11 aa, Influenza virus
LDEIGEDVAPI

SEQ ID NO: 395932 - protein, 11 aa, Influenza virus
DEIGEDVAPIE

SEQ ID NO: 395933 - protein, 11 aa, Influenza virus
EIGEDVAPIEH

SEQ ID NO: 395934 - protein, 11 aa, Influenza virus
APIEHIASMRR

SEQ ID NO: 395935 - protein, 11 aa, Influenza virus
YFTAEVSHCRA

SEQ ID NO: 395936 - protein, 11 aa, Influenza virus
FTAEVSHCRAT

SEQ ID NO: 395937 - protein, 11 aa, Influenza virus
TAEVSHCRATE

SEQ ID NO: 395938 - protein, 11 aa, Influenza virus
AEVSHCRATEY

SEQ ID NO: 395939 - protein, 11 aa, Influenza virus
EVSHCRATEYI

SEQ ID NO: 395940 - protein, 11 aa, Influenza virus
VSHCRATEYIM

SEQ ID NO: 395941 - protein, 11 aa, Influenza virus
ISKSRATEYIM

SEQ ID NO: 395942 - protein, 11 aa, Influenza virus
SHCRATEYIMK

SEQ ID NO: 395943 - protein, 11 aa, Influenza virus
HCRATEYIMKG

SEQ ID NO: 395944 - protein, 11 aa, Influenza virus
CRATEYIMKGV

SEQ ID NO: 395945 - protein, 11 aa, Influenza virus
RATEYIMKGVY

SEQ ID NO: 395946 - protein, 11 aa, Influenza virus
KGVYINTALLN

SEQ ID NO: 395947 - protein, 11 aa, Influenza virus
GVYINTALLNA

SEQ ID NO: 395948 - protein, 11 aa, Influenza virus
VYINTALLNAS

SEQ ID NO: 395949 - protein, 11 aa, Influenza virus
YINTALLNASC

SEQ ID NO: 395950 - protein, 11 aa, Influenza virus
INTALLNASCA

SEQ ID NO: 395951 - protein, 11 aa, Influenza virus
NTALLNASCAA

SEQ ID NO: 395952 - protein, 11 aa, Influenza virus
TALLNASCAAM

SEQ ID NO: 395953 - protein, 11 aa, Influenza virus
ALLNASCAAMD

SEQ ID NO: 395954 - protein, 11 aa, Influenza virus
LLNASCAAMDD

SEQ ID NO: 395955 - protein, 11 aa, Influenza virus
LNASCAAMDDF

SEQ ID NO: 395956 - protein, 11 aa, Influenza virus
NASCAAMDDFQ

SEQ ID NO: 395957 - protein, 11 aa, Influenza virus
ASCAAMDDFQL

SEQ ID NO: 395958 - protein, 11 aa, Influenza virus
SCAAMDDFQLI

SEQ ID NO: 395959 - protein, 11 aa, Influenza virus
CAAMDDFQLIP

SEQ ID NO: 395960 - protein, 11 aa, Influenza virus
AAMDDFQLIPM

SEQ ID NO: 395961 - protein, 11 aa, Influenza virus
AMDDFQLIPMI

SEQ ID NO: 395962 - protein, 11 aa, Influenza virus
MDDFQLIPMIS

SEQ ID NO: 395963 - protein, 11 aa, Influenza virus
DDFQLIPMISK

SEQ ID NO: 395964 - protein, 11 aa, Influenza virus
DFQLIPMISKC

SEQ ID NO: 395965 - protein, 11 aa, Influenza virus
FQLIPMISKCR

SEQ ID NO: 395966 - protein, 11 aa, Influenza virus
QLIPMISKCRT

SEQ ID NO: 395967 - protein, 11 aa, Influenza virus
LIPMISKCRTK

SEQ ID NO: 395968 - protein, 11 aa, Influenza virus
IPMISKCRTKE

SEQ ID NO: 395969 - protein, 11 aa, Influenza virus
PMISKCRTKEG

SEQ ID NO: 395970 - protein, 11 aa, Influenza virus
MISKCRTKEGR

SEQ ID NO: 395971 - protein, 11 aa, Influenza virus
ISKCRTKEGRR

SEQ ID NO: 395972 - protein, 11 aa, Influenza virus
SKCRTKEGRRK

SEQ ID NO: 395973 - protein, 11 aa, Influenza virus
KCRTKEGRRKT

SEQ ID NO: 395974 - protein, 11 aa, Influenza virus
CRTKEGRRKTN

SEQ ID NO: 395975 - protein, 11 aa, Influenza virus
RTKEGRRKTNL

SEQ ID NO: 395976 - protein, 11 aa, Influenza virus
TKEGRRKTNLY

SEQ ID NO: 395977 - protein, 11 aa, Influenza virus
KEGRRKTNLYG

SEQ ID NO: 395978 - protein, 11 aa, Influenza virus
EGRRKTNLYGF

SEQ ID NO: 395979 - protein, 11 aa, Influenza virus
GRRKTNLYGFI

SEQ ID NO: 395980 - protein, 11 aa, Influenza virus
RRKTNLYGFII

SEQ ID NO: 395981 - protein, 11 aa, Influenza virus
RKTNLYGFIIK

SEQ ID NO: 395982 - protein, 11 aa, Influenza virus
KTNLYGFIIKG

SEQ ID NO: 395983 - protein, 11 aa, Influenza virus
TNLYGFIIKGR

SEQ ID NO: 395984 - protein, 11 aa, Influenza virus
NLYGFIIKGRS

SEQ ID NO: 395985 - protein, 11 aa, Influenza virus
LYGFIIKGRSH

SEQ ID NO: 395986 - protein, 11 aa, Influenza virus
YGFIIKGRSHL

SEQ ID NO: 395987 - protein, 11 aa, Influenza virus
GFIIKGRSHLR

SEQ ID NO: 395988 - protein, 11 aa, Influenza virus
FIIKGRSHLRN

SEQ ID NO: 395989 - protein, 11 aa, Influenza virus
IIKGRSHLRND

SEQ ID NO: 395990 - protein, 11 aa, Influenza virus
IKGRSHLRNDT

SEQ ID NO: 395991 - protein, 11 aa, Influenza virus
KGRSHLRNDTD

SEQ ID NO: 395992 - protein, 11 aa, Influenza virus
GRSHLRNDTDV

SEQ ID NO: 395993 - protein, 11 aa, Influenza virus
RSHLRNDTDVV

SEQ ID NO: 395994 - protein, 11 aa, Influenza virus
SHLRNDTDVVN

SEQ ID NO: 395995 - protein, 11 aa, Influenza virus
HLRNDTDVVNF

SEQ ID NO: 395996 - protein, 11 aa, Influenza virus
LRNDTDVVNFV

SEQ ID NO: 395997 - protein, 11 aa, Influenza virus
RNDTDVVNFVS

SEQ ID NO: 395998 - protein, 11 aa, Influenza virus
NDTDVVNFVSM

SEQ ID NO: 395999 - protein, 11 aa, Influenza virus
DTDVVNFVSME

SEQ ID NO: 396000 - protein, 11 aa, Influenza virus
TDVVNFVSMEF

SEQ ID NO: 396001 - protein, 11 aa, Influenza virus
DVVNFVSMEFS

SEQ ID NO: 396002 - protein, 11 aa, Influenza virus
GSLNFVSMEFS

SEQ ID NO: 396003 - protein, 11 aa, Influenza virus
VVNFVSMEFSL

SEQ ID NO: 396004 - protein, 11 aa, Influenza virus
VNFVSMEFSLT

SEQ ID NO: 396005 - protein, 11 aa, Influenza virus
NFVSMEFSLTD

SEQ ID NO: 396006 - protein, 11 aa, Influenza virus
FVSMEFSLTDP

SEQ ID NO: 396007 - protein, 11 aa, Influenza virus
VSMEFSLTDPR

SEQ ID NO: 396008 - protein, 11 aa, Influenza virus
SMEFSLTDPRL

SEQ ID NO: 396009 - protein, 11 aa, Influenza virus
MEFSLTDPRLE

SEQ ID NO: 396010 - protein, 11 aa, Influenza virus
MFLYVRTNGTS

SEQ ID NO: 396011 - protein, 11 aa, Influenza virus
FLYVRTNGTSK

SEQ ID NO: 396012 - protein, 11 aa, Influenza virus
LYVRTNGTSKI

SEQ ID NO: 396013 - protein, 11 aa, Influenza virus
YVRTNGTSKIK

SEQ ID NO: 396014 - protein, 11 aa, Influenza virus
VRTNGTSKIKM

SEQ ID NO: 396015 - protein, 11 aa, Influenza virus
RTNGTSKIKMK

SEQ ID NO: 396016 - protein, 11 aa, Influenza virus
TNGTSKIKMKW

SEQ ID NO: 396017 - protein, 11 aa, Influenza virus
NGTSKIKMKWG

SEQ ID NO: 396018 - protein, 11 aa, Influenza virus
GTSKIKMKWGM

SEQ ID NO: 396019 - protein, 11 aa, Influenza virus
TSKIKMKWGME

SEQ ID NO: 396020 - protein, 11 aa, Influenza virus
SKIKMKWGMEM

SEQ ID NO: 396021 - protein, 11 aa, Influenza virus
KIKMKWGMEMR

SEQ ID NO: 396022 - protein, 11 aa, Influenza virus
IKMKWGMEMRR

SEQ ID NO: 396023 - protein, 11 aa, Influenza virus
KMKWGMEMRRC

SEQ ID NO: 396024 - protein, 11 aa, Influenza virus
MKWGMEMRRCL

SEQ ID NO: 396025 - protein, 11 aa, Influenza virus
KWGMEMRRCLL

SEQ ID NO: 396026 - protein, 11 aa, Influenza virus
WGMEMRRCLLQ

SEQ ID NO: 396027 - protein, 11 aa, Influenza virus
GMEMRRCLLQS

SEQ ID NO: 396028 - protein, 11 aa, Influenza virus
MEMRRCLLQSL

SEQ ID NO: 396029 - protein, 11 aa, Influenza virus
EMRRCLLQSLQ

SEQ ID NO: 396030 - protein, 11 aa, Influenza virus
MRRCLLQSLQQ

SEQ ID NO: 396031 - protein, 11 aa, Influenza virus
RRCLLQSLQQI

SEQ ID NO: 396032 - protein, 11 aa, Influenza virus
RCLLQSLQQIE

SEQ ID NO: 396033 - protein, 11 aa, Influenza virus
CLLQSLQQIES

SEQ ID NO: 396034 - protein, 11 aa, Influenza virus
LLQSLQQIESM

SEQ ID NO: 396035 - protein, 11 aa, Influenza virus
LQSLQQIESMI

SEQ ID NO: 396036 - protein, 11 aa, Influenza virus
QSLQQIESMIE

SEQ ID NO: 396037 - protein, 11 aa, Influenza virus
SLQQIESMIEA

SEQ ID NO: 396038 - protein, 11 aa, Influenza virus
LQQIESMIEAE

SEQ ID NO: 396039 - protein, 11 aa, Influenza virus
QQIESMIEAES

SEQ ID NO: 396040 - protein, 11 aa, Influenza virus
QIESMIEAESS

SEQ ID NO: 396041 - protein, 11 aa, Influenza virus
IESMIEAESSV

SEQ ID NO: 396042 - protein, 11 aa, Influenza virus
ESMIEAESSVK

SEQ ID NO: 396043 - protein, 11 aa, Influenza virus
MIEAESSVKEK

SEQ ID NO: 396044 - protein, 11 aa, Influenza virus
IEAESSVKEKD

SEQ ID NO: 396045 - protein, 11 aa, Influenza virus
EAESSVKEKDM

SEQ ID NO: 396046 - protein, 11 aa, Influenza virus
AESSVKEKDMT

SEQ ID NO: 396047 - protein, 11 aa, Influenza virus
ESSVKEKDMTK

SEQ ID NO: 396048 - protein, 11 aa, Influenza virus
VEEGSIGKVCR

SEQ ID NO: 396049 - protein, 11 aa, Influenza virus
EEGSIGKVCRT

SEQ ID NO: 396050 - protein, 11 aa, Influenza virus
EGSIGKVCRTL

SEQ ID NO: 396051 - protein, 11 aa, Influenza virus
GSIGKVCRTLL

SEQ ID NO: 396052 - protein, 11 aa, Influenza virus
SIGKVCRTLLA

SEQ ID NO: 396053 - protein, 11 aa, Influenza virus
IGKVCRTLLAK

SEQ ID NO: 396054 - protein, 11 aa, Influenza virus
GKVCRTLLAKS

SEQ ID NO: 396055 - protein, 11 aa, Influenza virus
KVCRTLLAKSV

SEQ ID NO: 396056 - protein, 11 aa, Influenza virus
VCRTLLAKSVF

SEQ ID NO: 396057 - protein, 11 aa, Influenza virus
CRTLLAKSVFN

SEQ ID NO: 396058 - protein, 11 aa, Influenza virus
RTLLAKSVFNS

SEQ ID NO: 396059 - protein, 11 aa, Influenza virus
TLLAKSVFNSL

SEQ ID NO: 396060 - protein, 11 aa, Influenza virus
LLAKSVFNSLY

SEQ ID NO: 396061 - protein, 11 aa, Influenza virus
LAKSVFNSLYA

SEQ ID NO: 396062 - protein, 11 aa, Influenza virus
AKSVFNSLYAS

SEQ ID NO: 396063 - protein, 11 aa, Influenza virus
FNSLYASPQLE

SEQ ID NO: 396064 - protein, 11 aa, Influenza virus
NSLYASPQLEG

SEQ ID NO: 396065 - protein, 11 aa, Influenza virus
SLYASPQLEGF

SEQ ID NO: 396066 - protein, 11 aa, Influenza virus
LYASPQLEGFS

SEQ ID NO: 396067 - protein, 11 aa, Influenza virus
YASPQLEGFSA

SEQ ID NO: 396068 - protein, 11 aa, Influenza virus
ASPQLEGFSAE

SEQ ID NO: 396069 - protein, 11 aa, Influenza virus
SPQLEGFSAES

SEQ ID NO: 396070 - protein, 11 aa, Influenza virus
PQLEGFSAESR

SEQ ID NO: 396071 - protein, 11 aa, Influenza virus
QLEGFSAESRK

SEQ ID NO: 396072 - protein, 11 aa, Influenza virus
LEGFSAESRKL

SEQ ID NO: 396073 - protein, 11 aa, Influenza virus
EGFSAESRKLL

SEQ ID NO: 396074 - protein, 11 aa, Influenza virus
GFSAESRKLLL

SEQ ID NO: 396075 - protein, 11 aa, Influenza virus
FSAESRKLLLI

SEQ ID NO: 396076 - protein, 11 aa, Influenza virus
AESRKLLLIVQ

SEQ ID NO: 396077 - protein, 11 aa, Influenza virus
ESRKLLLIVQA

SEQ ID NO: 396078 - protein, 11 aa, Influenza virus
QALRDNLEPGT

SEQ ID NO: 396079 - protein, 11 aa, Influenza virus
ALRDNLEPGTF

SEQ ID NO: 396080 - protein, 11 aa, Influenza virus
LRDNLEPGTFD

SEQ ID NO: 396081 - protein, 11 aa, Influenza virus
RDNLEPGTFDL

SEQ ID NO: 396082 - protein, 11 aa, Influenza virus
LEPGTFDLGGL

SEQ ID NO: 396083 - protein, 11 aa, Influenza virus
EPGTFDLGGLY

SEQ ID NO: 396084 - protein, 11 aa, Influenza virus
GLYEAIEECLI

SEQ ID NO: 396085 - protein, 11 aa, Influenza virus
LYEAIEECLIN

SEQ ID NO: 396086 - protein, 11 aa, Influenza virus
YEAIEECLIND

SEQ ID NO: 396087 - protein, 11 aa, Influenza virus
EAIEECLINDP

SEQ ID NO: 396088 - protein, 11 aa, Influenza virus
AIEECLINDPW

SEQ ID NO: 396089 - protein, 11 aa, Influenza virus
IEECLINDPWV

SEQ ID NO: 396090 - protein, 11 aa, Influenza virus
EECLINDPWVL

SEQ ID NO: 396091 - protein, 11 aa, Influenza virus
ECLINDPWVLL

SEQ ID NO: 396092 - protein, 11 aa, Influenza virus
CLINDPWVLLN

SEQ ID NO: 396093 - protein, 11 aa, Influenza virus
LINDPWVLLNA

SEQ ID NO: 396094 - protein, 11 aa, Influenza virus
INDPWVLLNAS

SEQ ID NO: 396095 - protein, 11 aa, Influenza virus
NDPWVLLNASW

SEQ ID NO: 396096 - protein, 11 aa, Influenza virus
DPWVLLNASWF

SEQ ID NO: 396097 - protein, 11 aa, Influenza virus
PWVLLNASWFN

SEQ ID NO: 396098 - protein, 11 aa, Influenza virus
WVLLNASWFNS

SEQ ID NO: 396099 - protein, 11 aa, Influenza virus
VLLNASWFNSF

SEQ ID NO: 396100 - protein, 11 aa, Influenza virus
LLNASWFNSFL

SEQ ID NO: 396101 - protein, 11 aa, Influenza virus
LNASWFNSFLT

SEQ ID NO: 396102 - protein, 11 aa, Influenza virus
NASWFNSFLTH

SEQ ID NO: 396103 - protein, 11 aa, Influenza virus
FNSSLTHALRE

SEQ ID NO: 396104 - protein, 11 aa, Influenza virus
NSSLTHALREL

SEQ ID NO: 396105 - protein, 11 aa, Influenza virus
SSLTHALRELW

SEQ ID NO: 396106 - protein, 11 aa, Influenza virus
SLTHALRELWQ

SEQ ID NO: 396107 - protein, 11 aa, Influenza virus
LTHALRELWQC

SEQ ID NO: 396108 - protein, 11 aa, Influenza virus
THALRELWQCY

SEQ ID NO: 396109 - protein, 11 aa, Influenza virus
HALRELWQCYY

SEQ ID NO: 396110 - protein, 11 aa, Influenza virus
ALRELWQCYYL

SEQ ID NO: 396111 - protein, 11 aa, Influenza virus
LRELWQCYYLL

SEQ ID NO: 396112 - protein, 11 aa, Influenza virus
MDVNPTLLFLK

SEQ ID NO: 396113 - protein, 11 aa, Influenza virus
INPTLLFLKVP

SEQ ID NO: 396114 - protein, 11 aa, Influenza virus
YFFLKVPVQNA

SEQ ID NO: 396115 - protein, 11 aa, Influenza virus
PAQNAISTTFP

SEQ ID NO: 396116 - protein, 11 aa, Influenza virus
AQNAISTTFPY

SEQ ID NO: 396117 - protein, 11 aa, Influenza virus
QNAISTTFPYT

SEQ ID NO: 396118 - protein, 11 aa, Influenza virus
NAISTTFPYTG

SEQ ID NO: 396119 - protein, 11 aa, Influenza virus
AISTTFPYTGD

SEQ ID NO: 396120 - protein, 11 aa, Influenza virus
ISTTFPYTGDP

SEQ ID NO: 396121 - protein, 11 aa, Influenza virus
STTFPYTGDPP

SEQ ID NO: 396122 - protein, 11 aa, Influenza virus
TTFPYTGDPPY

SEQ ID NO: 396123 - protein, 11 aa, Influenza virus
TFPYTGDPPYS

SEQ ID NO: 396124 - protein, 11 aa, Influenza virus
FPYTGDPPYSH

SEQ ID NO: 396125 - protein, 11 aa, Influenza virus
PYTGDPPYSHG

SEQ ID NO: 396126 - protein, 11 aa, Influenza virus
YTGDPPYSHGT

SEQ ID NO: 396127 - protein, 11 aa, Influenza virus
TGDPPYSHGTG

SEQ ID NO: 396128 - protein, 11 aa, Influenza virus
GDPPYSHGTGT

SEQ ID NO: 396129 - protein, 11 aa, Influenza virus
DPPYSHGTGTG

SEQ ID NO: 396130 - protein, 11 aa, Influenza virus
PPYSHGTGTGY

SEQ ID NO: 396131 - protein, 11 aa, Influenza virus
PYSHGTGTGYT

SEQ ID NO: 396132 - protein, 11 aa, Influenza virus
YSHGTGTGYTM

SEQ ID NO: 396133 - protein, 11 aa, Influenza virus
SHGTGTGYTMD

SEQ ID NO: 396134 - protein, 11 aa, Influenza virus
HGTGTGYTMDT

SEQ ID NO: 396135 - protein, 11 aa, Influenza virus
GTGTGYTMDTV

SEQ ID NO: 396136 - protein, 11 aa, Influenza virus
TGTGYTMDTVN

SEQ ID NO: 396137 - protein, 11 aa, Influenza virus
GTGYTMDTVNR

SEQ ID NO: 396138 - protein, 11 aa, Influenza virus
TGYTMDTVNRT

SEQ ID NO: 396139 - protein, 11 aa, Influenza virus
GYTMDTVNRTH

SEQ ID NO: 396140 - protein, 11 aa, Influenza virus
YTMDTVNRTHQ

SEQ ID NO: 396141 - protein, 11 aa, Influenza virus
TMDTVNRTHQY

SEQ ID NO: 396142 - protein, 11 aa, Influenza virus
MDTVNRTHQYS

SEQ ID NO: 396143 - protein, 11 aa, Influenza virus
DTVNRTHQYSE

SEQ ID NO: 396144 - protein, 11 aa, Influenza virus
TVNRTHQYSEK

SEQ ID NO: 396145 - protein, 11 aa, Influenza virus
VNRTHQYSEKG

SEQ ID NO: 396146 - protein, 11 aa, Influenza virus
NRTHQYSEKGK

SEQ ID NO: 396147 - protein, 11 aa, Influenza virus
RTHQYSEKGKW

SEQ ID NO: 396148 - protein, 11 aa, Influenza virus
ETGAPQLNPID

SEQ ID NO: 396149 - protein, 11 aa, Influenza virus
TGAPQLNPIDG

SEQ ID NO: 396150 - protein, 11 aa, Influenza virus
GAPQLNPIDGP

SEQ ID NO: 396151 - protein, 11 aa, Influenza virus
APQLNPIDGPL

SEQ ID NO: 396152 - protein, 11 aa, Influenza virus
PQLNPIDGPLP

SEQ ID NO: 396153 - protein, 11 aa, Influenza virus
QLNPIDGPLPE

SEQ ID NO: 396154 - protein, 11 aa, Influenza virus
NEPSGYAQTDC

SEQ ID NO: 396155 - protein, 11 aa, Influenza virus
EPSGYAQTDCV

SEQ ID NO: 396156 - protein, 11 aa, Influenza virus
PSGYAQTDCVL

SEQ ID NO: 396157 - protein, 11 aa, Influenza virus
SGYAQTDCVLE

SEQ ID NO: 396158 - protein, 11 aa, Influenza virus
GYAQTDCVLEA

SEQ ID NO: 396159 - protein, 11 aa, Influenza virus
YAQTDCVLEAM

SEQ ID NO: 396160 - protein, 11 aa, Influenza virus
AQTDCVLEAMA

SEQ ID NO: 396161 - protein, 11 aa, Influenza virus
QTDCVLEAMAF

SEQ ID NO: 396162 - protein, 11 aa, Influenza virus
TDCVLEAMAFL

SEQ ID NO: 396163 - protein, 11 aa, Influenza virus
DCVLEAMAFLE

SEQ ID NO: 396164 - protein, 11 aa, Influenza virus
CVLEAMAFLEE

SEQ ID NO: 396165 - protein, 11 aa, Influenza virus
VLEAMAFLEES

SEQ ID NO: 396166 - protein, 11 aa, Influenza virus
EAMAFLEESHP

SEQ ID NO: 396167 - protein, 11 aa, Influenza virus
SHPGIFENSCL

SEQ ID NO: 396168 - protein, 11 aa, Influenza virus
HPGIFENSCLE

SEQ ID NO: 396169 - protein, 11 aa, Influenza virus
VQQTRVDKLTQ

SEQ ID NO: 396170 - protein, 11 aa, Influenza virus
QQTRVDKLTQG

SEQ ID NO: 396171 - protein, 11 aa, Influenza virus
QTRVDKLTQGR

SEQ ID NO: 396172 - protein, 11 aa, Influenza virus
TRVDKLTQGRQ

SEQ ID NO: 396173 - protein, 11 aa, Influenza virus
RVDKLTQGRQT

SEQ ID NO: 396174 - protein, 11 aa, Influenza virus
VDKLTQGRQTY

SEQ ID NO: 396175 - protein, 11 aa, Influenza virus
DKLTQGRQTYD

SEQ ID NO: 396176 - protein, 11 aa, Influenza virus
KLTQGRQTYDW

SEQ ID NO: 396177 - protein, 11 aa, Influenza virus
LTQGRQTYDWT

SEQ ID NO: 396178 - protein, 11 aa, Influenza virus
TQGRQTYDWTL

SEQ ID NO: 396179 - protein, 11 aa, Influenza virus
QGRQTYDWTLN

SEQ ID NO: 396180 - protein, 11 aa, Influenza virus
GRQTYDWTLNR

SEQ ID NO: 396181 - protein, 11 aa, Influenza virus
RQTYDWTLNRN

SEQ ID NO: 396182 - protein, 11 aa, Influenza virus
QTYDWTLNRNQ

SEQ ID NO: 396183 - protein, 11 aa, Influenza virus
TYDWTLNRNQP

SEQ ID NO: 396184 - protein, 11 aa, Influenza virus
YDWTLNRNQPA

SEQ ID NO: 396185 - protein, 11 aa, Influenza virus
DWTLNRNQPAA

SEQ ID NO: 396186 - protein, 11 aa, Influenza virus
WTLNRNQPAAT

SEQ ID NO: 396187 - protein, 11 aa, Influenza virus
TLNRNQPAATA

SEQ ID NO: 396188 - protein, 11 aa, Influenza virus
LNRNQPAATAL

SEQ ID NO: 396189 - protein, 11 aa, Influenza virus
NRNQPAATALA

SEQ ID NO: 396190 - protein, 11 aa, Influenza virus
RNQPAATALAN

SEQ ID NO: 396191 - protein, 11 aa, Influenza virus
NQPAATALANT

SEQ ID NO: 396192 - protein, 11 aa, Influenza virus
QPAATALANTI

SEQ ID NO: 396193 - protein, 11 aa, Influenza virus
PAATALANTIE

SEQ ID NO: 396194 - protein, 11 aa, Influenza virus
AATALANTIEV

SEQ ID NO: 396195 - protein, 11 aa, Influenza virus
ATALANTIEVF

SEQ ID NO: 396196 - protein, 11 aa, Influenza virus
TALANTIEVFR

SEQ ID NO: 396197 - protein, 11 aa, Influenza virus
ALANTIEVFRS

SEQ ID NO: 396198 - protein, 11 aa, Influenza virus
LANTIEVFRSN

SEQ ID NO: 396199 - protein, 11 aa, Influenza virus
NESGRLIDFLK

SEQ ID NO: 396200 - protein, 11 aa, Influenza virus
ESGRLIDFLKD

SEQ ID NO: 396201 - protein, 11 aa, Influenza virus
SGRLIDFLKDV

SEQ ID NO: 396202 - protein, 11 aa, Influenza virus
GRLIDFLKDVM

SEQ ID NO: 396203 - protein, 11 aa, Influenza virus
THFQRKRRVRD

SEQ ID NO: 396204 - protein, 11 aa, Influenza virus
HFQRKRRVRDN

SEQ ID NO: 396205 - protein, 11 aa, Influenza virus
SYLIRALTLNT

SEQ ID NO: 396206 - protein, 11 aa, Influenza virus
YLIRALTLNTM

SEQ ID NO: 396207 - protein, 11 aa, Influenza virus
LIRALTLNTMT

SEQ ID NO: 396208 - protein, 11 aa, Influenza virus
IRALTLNTMTK

SEQ ID NO: 396209 - protein, 11 aa, Influenza virus
RALTLNTMTKD

SEQ ID NO: 396210 - protein, 11 aa, Influenza virus
ALTLNTMTKDA

SEQ ID NO: 396211 - protein, 11 aa, Influenza virus
LTLNTMTKDAE

SEQ ID NO: 396212 - protein, 11 aa, Influenza virus
TLNTMTKDAER

SEQ ID NO: 396213 - protein, 11 aa, Influenza virus
LNTMTKDAERG

SEQ ID NO: 396214 - protein, 11 aa, Influenza virus
NTMTKDAERGK

SEQ ID NO: 396215 - protein, 11 aa, Influenza virus
TMTKDAERGKL

SEQ ID NO: 396216 - protein, 11 aa, Influenza virus
MTKDAERGKLK

SEQ ID NO: 396217 - protein, 11 aa, Influenza virus
TKDAERGKLKR

SEQ ID NO: 396218 - protein, 11 aa, Influenza virus
KDAERGKLKRR

SEQ ID NO: 396219 - protein, 11 aa, Influenza virus
DAERGKLKRRA

SEQ ID NO: 396220 - protein, 11 aa, Influenza virus
AERGKLKRRAI

SEQ ID NO: 396221 - protein, 11 aa, Influenza virus
ERGKLKRRAIA

SEQ ID NO: 396222 - protein, 11 aa, Influenza virus
RGKLKRRAIAT

SEQ ID NO: 396223 - protein, 11 aa, Influenza virus
GKLKRRAIATP

SEQ ID NO: 396224 - protein, 11 aa, Influenza virus
KLKRRAIATPG

SEQ ID NO: 396225 - protein, 11 aa, Influenza virus
LKRRAIATPGM

SEQ ID NO: 396226 - protein, 11 aa, Influenza virus
KRRAIATPGMQ

SEQ ID NO: 396227 - protein, 11 aa, Influenza virus
RRAIATPGMQI

SEQ ID NO: 396228 - protein, 11 aa, Influenza virus
RAIATPGMQIR

SEQ ID NO: 396229 - protein, 11 aa, Influenza virus
AIATPGMQIRG

SEQ ID NO: 396230 - protein, 11 aa, Influenza virus
IATPGMQIRGF

SEQ ID NO: 396231 - protein, 11 aa, Influenza virus
ATPGMQIRGFV

SEQ ID NO: 396232 - protein, 11 aa, Influenza virus
TPGMQIRGFVY

SEQ ID NO: 396233 - protein, 11 aa, Influenza virus
PGMQIRGFVYF

SEQ ID NO: 396234 - protein, 11 aa, Influenza virus
GMQIRGFVYFV

SEQ ID NO: 396235 - protein, 11 aa, Influenza virus
MQIRGFVYFVE

SEQ ID NO: 396236 - protein, 11 aa, Influenza virus
QIRGFVYFVET

SEQ ID NO: 396237 - protein, 11 aa, Influenza virus
IRGFVYFVETL

SEQ ID NO: 396238 - protein, 11 aa, Influenza virus
RGFVYFVETLA

SEQ ID NO: 396239 - protein, 11 aa, Influenza virus
LARSICEKLEQ

SEQ ID NO: 396240 - protein, 11 aa, Influenza virus
ARSICEKLEQS

SEQ ID NO: 396241 - protein, 11 aa, Influenza virus
RSICEKLEQSG

SEQ ID NO: 396242 - protein, 11 aa, Influenza virus
SICEKLEQSGL

SEQ ID NO: 396243 - protein, 11 aa, Influenza virus
ICEKLEQSGLP

SEQ ID NO: 396244 - protein, 11 aa, Influenza virus
CEKLEQSGLPV

SEQ ID NO: 396245 - protein, 11 aa, Influenza virus
EKLEQSGLPVG

SEQ ID NO: 396246 - protein, 11 aa, Influenza virus
KLEQSGLPVGG

SEQ ID NO: 396247 - protein, 11 aa, Influenza virus
LEQSGLPVGGN

SEQ ID NO: 396248 - protein, 11 aa, Influenza virus
EQSGLPVGGNE

SEQ ID NO: 396249 - protein, 11 aa, Influenza virus
QSGLPVGGNEK

SEQ ID NO: 396250 - protein, 11 aa, Influenza virus
SGLPVGGNEKK

SEQ ID NO: 396251 - protein, 11 aa, Influenza virus
GLPVGGNEKKA

SEQ ID NO: 396252 - protein, 11 aa, Influenza virus
LPVGGNEKKAK

SEQ ID NO: 396253 - protein, 11 aa, Influenza virus
PVGGNEKKAKL

SEQ ID NO: 396254 - protein, 11 aa, Influenza virus
VGGNEKKAKLA

SEQ ID NO: 396255 - protein, 11 aa, Influenza virus
GGNEKKAKLAN

SEQ ID NO: 396256 - protein, 11 aa, Influenza virus
GNEKKAKLANV

SEQ ID NO: 396257 - protein, 11 aa, Influenza virus
NEKKAKLANVV

SEQ ID NO: 396258 - protein, 11 aa, Influenza virus
EKKAKLANVVR

SEQ ID NO: 396259 - protein, 11 aa, Influenza virus
KKAKLANVVRK

SEQ ID NO: 396260 - protein, 11 aa, Influenza virus
KAKLANVVRKM

SEQ ID NO: 396261 - protein, 11 aa, Influenza virus
AKLANVVRKMM

SEQ ID NO: 396262 - protein, 11 aa, Influenza virus
KLANVVRKMMT

SEQ ID NO: 396263 - protein, 11 aa, Influenza virus
LANVVRKMMTN

SEQ ID NO: 396264 - protein, 11 aa, Influenza virus
ANVVRKMMTNS

SEQ ID NO: 396265 - protein, 11 aa, Influenza virus
NVVRKMMTNSQ

SEQ ID NO: 396266 - protein, 11 aa, Influenza virus
VVRKMMTNSQD

SEQ ID NO: 396267 - protein, 11 aa, Influenza virus
VRKMMTNSQDT

SEQ ID NO: 396268 - protein, 11 aa, Influenza virus
RKMMTNSQDTE

SEQ ID NO: 396269 - protein, 11 aa, Influenza virus
SQDTELSFTIT

SEQ ID NO: 396270 - protein, 11 aa, Influenza virus
QDTELSFTITG

SEQ ID NO: 396271 - protein, 11 aa, Influenza virus
DTELSFTITGD

SEQ ID NO: 396272 - protein, 11 aa, Influenza virus
TELSFTITGDN

SEQ ID NO: 396273 - protein, 11 aa, Influenza virus
ELSFTITGDNT

SEQ ID NO: 396274 - protein, 11 aa, Influenza virus
LSFTITGDNTK

SEQ ID NO: 396275 - protein, 11 aa, Influenza virus
SFTITGDNTKW

SEQ ID NO: 396276 - protein, 11 aa, Influenza virus
FTITGDNTKWN

SEQ ID NO: 396277 - protein, 11 aa, Influenza virus
TITGDNTKWNE

SEQ ID NO: 396278 - protein, 11 aa, Influenza virus
ITGDNTKWNEN

SEQ ID NO: 396279 - protein, 11 aa, Influenza virus
TGDNTKWNENQ

SEQ ID NO: 396280 - protein, 11 aa, Influenza virus
GDNTKWNENQN

SEQ ID NO: 396281 - protein, 11 aa, Influenza virus
DNTKWNENQNP

SEQ ID NO: 396282 - protein, 11 aa, Influenza virus
NTKWNENQNPR

SEQ ID NO: 396283 - protein, 11 aa, Influenza virus
TKWNENQNPRM

SEQ ID NO: 396284 - protein, 11 aa, Influenza virus
KWNENQNPRMF

SEQ ID NO: 396285 - protein, 11 aa, Influenza virus
WNENQNPRMFL

SEQ ID NO: 396286 - protein, 11 aa, Influenza virus
NENQNPRMFLA

SEQ ID NO: 396287 - protein, 11 aa, Influenza virus
ENQNPRMFLAM

SEQ ID NO: 396288 - protein, 11 aa, Influenza virus
NQNQNPRMFLA

SEQ ID NO: 396289 - protein, 11 aa, Influenza virus
QNQNPRMFLAM

SEQ ID NO: 396290 - protein, 11 aa, Influenza virus
NQNPRMFLAMI

SEQ ID NO: 396291 - protein, 11 aa, Influenza virus
QNPRMFLAMIT

SEQ ID NO: 396292 - protein, 11 aa, Influenza virus
NPRMFLAMITY

SEQ ID NO: 396293 - protein, 11 aa, Influenza virus
PRMFLAMITYI

SEQ ID NO: 396294 - protein, 11 aa, Influenza virus
RMFLAMITYIT

SEQ ID NO: 396295 - protein, 11 aa, Influenza virus
WFRNVLSIAPI

SEQ ID NO: 396296 - protein, 11 aa, Influenza virus
FRNVLSIAPIM

SEQ ID NO: 396297 - protein, 11 aa, Influenza virus
RNVLSIAPIMF

SEQ ID NO: 396298 - protein, 11 aa, Influenza virus
NVLSIAPIMFS

SEQ ID NO: 396299 - protein, 11 aa, Influenza virus
VLSIAPIMFSN

SEQ ID NO: 396300 - protein, 11 aa, Influenza virus
LSIAPIMFSNK

SEQ ID NO: 396301 - protein, 11 aa, Influenza virus
SIAPIMFSNKM

SEQ ID NO: 396302 - protein, 11 aa, Influenza virus
IAPIMFSNKMA

SEQ ID NO: 396303 - protein, 11 aa, Influenza virus
APIMFSNKMAR

SEQ ID NO: 396304 - protein, 11 aa, Influenza virus
PIMFSNKMARL

SEQ ID NO: 396305 - protein, 11 aa, Influenza virus
IMFSNKMARLG

SEQ ID NO: 396306 - protein, 11 aa, Influenza virus
MFSNKMARLGK

SEQ ID NO: 396307 - protein, 11 aa, Influenza virus
FSNKMARLGKG

SEQ ID NO: 396308 - protein, 11 aa, Influenza virus
SNKMARLGKGY

SEQ ID NO: 396309 - protein, 11 aa, Influenza virus
NKMARLGKGYM

SEQ ID NO: 396310 - protein, 11 aa, Influenza virus
KMARLGKGYMF

SEQ ID NO: 396311 - protein, 11 aa, Influenza virus
MARLGKGYMFE

SEQ ID NO: 396312 - protein, 11 aa, Influenza virus
ARLGKGYMFES

SEQ ID NO: 396313 - protein, 11 aa, Influenza virus
RLGKGYMFESK

SEQ ID NO: 396314 - protein, 11 aa, Influenza virus
KIEKIEKIRPL

SEQ ID NO: 396315 - protein, 11 aa, Influenza virus
IEKIEKIRPLL

SEQ ID NO: 396316 - protein, 11 aa, Influenza virus
EKIEKIRPLLI

SEQ ID NO: 396317 - protein, 11 aa, Influenza virus
GTASLSPGMMM

SEQ ID NO: 396318 - protein, 11 aa, Influenza virus
TASLSPGMMMG

SEQ ID NO: 396319 - protein, 11 aa, Influenza virus
ASLSPGMMMGM

SEQ ID NO: 396320 - protein, 11 aa, Influenza virus
SLSPGMMMGMF

SEQ ID NO: 396321 - protein, 11 aa, Influenza virus
LSPGMMMGMFN

SEQ ID NO: 396322 - protein, 11 aa, Influenza virus
SPGMMMGMFNM

SEQ ID NO: 396323 - protein, 11 aa, Influenza virus
PGMMMGMFNML

SEQ ID NO: 396324 - protein, 11 aa, Influenza virus
GMMMGMFNMLS

SEQ ID NO: 396325 - protein, 11 aa, Influenza virus
MMMGMFNMLST

SEQ ID NO: 396326 - protein, 11 aa, Influenza virus
MMGMFNMLSTV

SEQ ID NO: 396327 - protein, 11 aa, Influenza virus
MGMFNMLSTVL

SEQ ID NO: 396328 - protein, 11 aa, Influenza virus
GMFNMLSTVLG

SEQ ID NO: 396329 - protein, 11 aa, Influenza virus
MFNMLSTVLGV

SEQ ID NO: 396330 - protein, 11 aa, Influenza virus
FNMLSTVLGVS

SEQ ID NO: 396331 - protein, 11 aa, Influenza virus
NMLSTVLGVSI

SEQ ID NO: 396332 - protein, 11 aa, Influenza virus
MLSTVLGVSIL

SEQ ID NO: 396333 - protein, 11 aa, Influenza virus
LSTVLGVSILN

SEQ ID NO: 396334 - protein, 11 aa, Influenza virus
STVLGVSILNL

SEQ ID NO: 396335 - protein, 11 aa, Influenza virus
TVLGVSILNLG

SEQ ID NO: 396336 - protein, 11 aa, Influenza virus
VLGVSILNLGQ

SEQ ID NO: 396337 - protein, 11 aa, Influenza virus
LGVSILNLGQK

SEQ ID NO: 396338 - protein, 11 aa, Influenza virus
TTYWWDGLQSS

SEQ ID NO: 396339 - protein, 11 aa, Influenza virus
TYWWDGLQSSD

SEQ ID NO: 396340 - protein, 11 aa, Influenza virus
YWWDGLQSSDD

SEQ ID NO: 396341 - protein, 11 aa, Influenza virus
WWDGLQSSDDF

SEQ ID NO: 396342 - protein, 11 aa, Influenza virus
WDGLQSSDDFA

SEQ ID NO: 396343 - protein, 11 aa, Influenza virus
DGLQSSDDFAL

SEQ ID NO: 396344 - protein, 11 aa, Influenza virus
GLQSSDDFALI

SEQ ID NO: 396345 - protein, 11 aa, Influenza virus
LQSSDDFALIV

SEQ ID NO: 396346 - protein, 11 aa, Influenza virus
QSSDDFALIVN

SEQ ID NO: 396347 - protein, 11 aa, Influenza virus
SSDDFALIVNA

SEQ ID NO: 396348 - protein, 11 aa, Influenza virus
SDDFALIVNAP

SEQ ID NO: 396349 - protein, 11 aa, Influenza virus
GIQAGVDRFYR

SEQ ID NO: 396350 - protein, 11 aa, Influenza virus
IQAGVDRFYRT

SEQ ID NO: 396351 - protein, 11 aa, Influenza virus
QAGVDRFYRTC

SEQ ID NO: 396352 - protein, 11 aa, Influenza virus
AGVDRFYRTCK

SEQ ID NO: 396353 - protein, 11 aa, Influenza virus
GVDRFYRTCKL

SEQ ID NO: 396354 - protein, 11 aa, Influenza virus
DRFYRTCKLVG

SEQ ID NO: 396355 - protein, 11 aa, Influenza virus
RFYRTCKLVGI

SEQ ID NO: 396356 - protein, 11 aa, Influenza virus
FYRTCKLVGIN

SEQ ID NO: 396357 - protein, 11 aa, Influenza virus
YRTCKLVGINM

SEQ ID NO: 396358 - protein, 11 aa, Influenza virus
RTCKLVGINMS

SEQ ID NO: 396359 - protein, 11 aa, Influenza virus
TCKLVGINMSK

SEQ ID NO: 396360 - protein, 11 aa, Influenza virus
CKLVGINMSKK

SEQ ID NO: 396361 - protein, 11 aa, Influenza virus
KLVGINMSKKK

SEQ ID NO: 396362 - protein, 11 aa, Influenza virus
LVGINMSKKKS

SEQ ID NO: 396363 - protein, 11 aa, Influenza virus
VGINMSKKKSY

SEQ ID NO: 396364 - protein, 11 aa, Influenza virus
GINMSKKKSYI

SEQ ID NO: 396365 - protein, 11 aa, Influenza virus
INMSKKKSYIN

SEQ ID NO: 396366 - protein, 11 aa, Influenza virus
NMSKKKSYINR

SEQ ID NO: 396367 - protein, 11 aa, Influenza virus
MSKKKSYINRT

SEQ ID NO: 396368 - protein, 11 aa, Influenza virus
SKKKSYINRTG

SEQ ID NO: 396369 - protein, 11 aa, Influenza virus
KKKSYINRTGT

SEQ ID NO: 396370 - protein, 11 aa, Influenza virus
KKSYINRTGTF

SEQ ID NO: 396371 - protein, 11 aa, Influenza virus
KSYINRTGTFE

SEQ ID NO: 396372 - protein, 11 aa, Influenza virus
SYINRTGTFEF

SEQ ID NO: 396373 - protein, 11 aa, Influenza virus
YINRTGTFEFT

SEQ ID NO: 396374 - protein, 11 aa, Influenza virus
INRTGTFEFTS

SEQ ID NO: 396375 - protein, 11 aa, Influenza virus
NRTGTFEFTSF

SEQ ID NO: 396376 - protein, 11 aa, Influenza virus
RTGTFEFTSFF

SEQ ID NO: 396377 - protein, 11 aa, Influenza virus
TGTFEFTSFFY

SEQ ID NO: 396378 - protein, 11 aa, Influenza virus
GTFEFTSFFYR

SEQ ID NO: 396379 - protein, 11 aa, Influenza virus
TFEFTSFFYRY

SEQ ID NO: 396380 - protein, 11 aa, Influenza virus
FEFTSFFYRYG

SEQ ID NO: 396381 - protein, 11 aa, Influenza virus
EFTSFFYRYGF

SEQ ID NO: 396382 - protein, 11 aa, Influenza virus
FTSFFYRYGFV

SEQ ID NO: 396383 - protein, 11 aa, Influenza virus
TSFFYRYGFVA

SEQ ID NO: 396384 - protein, 11 aa, Influenza virus
SFFYRYGFVAN

SEQ ID NO: 396385 - protein, 11 aa, Influenza virus
FFYRYGFVANF

SEQ ID NO: 396386 - protein, 11 aa, Influenza virus
FYRYGFVANFS

SEQ ID NO: 396387 - protein, 11 aa, Influenza virus
YRYGFVANFSM

SEQ ID NO: 396388 - protein, 11 aa, Influenza virus
RYGFVANFSME

SEQ ID NO: 396389 - protein, 11 aa, Influenza virus
YGFVANFSMEL

SEQ ID NO: 396390 - protein, 11 aa, Influenza virus
GFVANFSMELP

SEQ ID NO: 396391 - protein, 11 aa, Influenza virus
FVANFSMELPS

SEQ ID NO: 396392 - protein, 11 aa, Influenza virus
VANFSMELPSF

SEQ ID NO: 396393 - protein, 11 aa, Influenza virus
ANFSMELPSFG

SEQ ID NO: 396394 - protein, 11 aa, Influenza virus
NFSMELPSFGV

SEQ ID NO: 396395 - protein, 11 aa, Influenza virus
FSMELPSFGVS

SEQ ID NO: 396396 - protein, 11 aa, Influenza virus
SMELPSFGVSG

SEQ ID NO: 396397 - protein, 11 aa, Influenza virus
MELPSFGVSGI

SEQ ID NO: 396398 - protein, 11 aa, Influenza virus
ELPSFGVSGIN

SEQ ID NO: 396399 - protein, 11 aa, Influenza virus
LPSFGVSGINE

SEQ ID NO: 396400 - protein, 11 aa, Influenza virus
PSFGVSGINES

SEQ ID NO: 396401 - protein, 11 aa, Influenza virus
SFGVSGINESA

SEQ ID NO: 396402 - protein, 11 aa, Influenza virus
FGVSGINESAD

SEQ ID NO: 396403 - protein, 11 aa, Influenza virus
GVSGINESADM

SEQ ID NO: 396404 - protein, 11 aa, Influenza virus
VSGINESADMS

SEQ ID NO: 396405 - protein, 11 aa, Influenza virus
SGINESADMSI

SEQ ID NO: 396406 - protein, 11 aa, Influenza virus
GINESADMSIG

SEQ ID NO: 396407 - protein, 11 aa, Influenza virus
INESADMSIGV

SEQ ID NO: 396408 - protein, 11 aa, Influenza virus
NESADMSIGVT

SEQ ID NO: 396409 - protein, 11 aa, Influenza virus
ESADMSIGVTV

SEQ ID NO: 396410 - protein, 11 aa, Influenza virus
SADMSIGVTVI

SEQ ID NO: 396411 - protein, 11 aa, Influenza virus
ADMSIGVTVIK

SEQ ID NO: 396412 - protein, 11 aa, Influenza virus
DMSIGVTVIKN

SEQ ID NO: 396413 - protein, 11 aa, Influenza virus
MSIGVTVIKNN

SEQ ID NO: 396414 - protein, 11 aa, Influenza virus
SIGVTVIKNNM

SEQ ID NO: 396415 - protein, 11 aa, Influenza virus
IGVTVIKNNMI

SEQ ID NO: 396416 - protein, 11 aa, Influenza virus
GVTVIKNNMIN

SEQ ID NO: 396417 - protein, 11 aa, Influenza virus
TVIKNNMINND

SEQ ID NO: 396418 - protein, 11 aa, Influenza virus
VIKNNMINNDL

SEQ ID NO: 396419 - protein, 11 aa, Influenza virus
IKNNMINNDLG

SEQ ID NO: 396420 - protein, 11 aa, Influenza virus
KNNMINNDLGP

SEQ ID NO: 396421 - protein, 11 aa, Influenza virus
NNMINNDLGPA

SEQ ID NO: 396422 - protein, 11 aa, Influenza virus
NMINNDLGPAT

SEQ ID NO: 396423 - protein, 11 aa, Influenza virus
MINNDLGPATA

SEQ ID NO: 396424 - protein, 11 aa, Influenza virus
INNDLGPATAQ

SEQ ID NO: 396425 - protein, 11 aa, Influenza virus
NNDLGPATAQM

SEQ ID NO: 396426 - protein, 11 aa, Influenza virus
NDLGPATAQMA

SEQ ID NO: 396427 - protein, 11 aa, Influenza virus
DLGPATAQMAL

SEQ ID NO: 396428 - protein, 11 aa, Influenza virus
LGPATAQMALQ

SEQ ID NO: 396429 - protein, 11 aa, Influenza virus
GPATAQMALQL

SEQ ID NO: 396430 - protein, 11 aa, Influenza virus
PATAQMALQLF

SEQ ID NO: 396431 - protein, 11 aa, Influenza virus
ATAQMALQLFI

SEQ ID NO: 396432 - protein, 11 aa, Influenza virus
TAQMALQLFIK

SEQ ID NO: 396433 - protein, 11 aa, Influenza virus
AQMALQLFIKD

SEQ ID NO: 396434 - protein, 11 aa, Influenza virus
QMALQLFIKDY

SEQ ID NO: 396435 - protein, 11 aa, Influenza virus
MALQLFIKDYR

SEQ ID NO: 396436 - protein, 11 aa, Influenza virus
ALQLFIKDYRY

SEQ ID NO: 396437 - protein, 11 aa, Influenza virus
LQLFIKDYRYT

SEQ ID NO: 396438 - protein, 11 aa, Influenza virus
QLFIKDYRYTY

SEQ ID NO: 396439 - protein, 11 aa, Influenza virus
LFIKDYRYTYR

SEQ ID NO: 396440 - protein, 11 aa, Influenza virus
FIKDYRYTYRC

SEQ ID NO: 396441 - protein, 11 aa, Influenza virus
IKDYRYTYRCH

SEQ ID NO: 396442 - protein, 11 aa, Influenza virus
KDYRYTYRCHR

SEQ ID NO: 396443 - protein, 11 aa, Influenza virus
DYRYTYRCHRG

SEQ ID NO: 396444 - protein, 11 aa, Influenza virus
YRYTYRCHRGD

SEQ ID NO: 396445 - protein, 11 aa, Influenza virus
RYTYRCHRGDT

SEQ ID NO: 396446 - protein, 11 aa, Influenza virus
YTYRCHRGDTQ

SEQ ID NO: 396447 - protein, 11 aa, Influenza virus
GLLVSDGGPNL

SEQ ID NO: 396448 - protein, 11 aa, Influenza virus
LLVSDGGPNLY

SEQ ID NO: 396449 - protein, 11 aa, Influenza virus
LVSDGGPNLYN

SEQ ID NO: 396450 - protein, 11 aa, Influenza virus
VSDGGPNLYNI

SEQ ID NO: 396451 - protein, 11 aa, Influenza virus
SDGGPNLYNIR

SEQ ID NO: 396452 - protein, 11 aa, Influenza virus
DGGPNLYNIRN

SEQ ID NO: 396453 - protein, 11 aa, Influenza virus
GGPNLYNIRNL

SEQ ID NO: 396454 - protein, 11 aa, Influenza virus
GPNLYNIRNLH

SEQ ID NO: 396455 - protein, 11 aa, Influenza virus
PNLYNIRNLHI

SEQ ID NO: 396456 - protein, 11 aa, Influenza virus
NLYNIRNLHIP

SEQ ID NO: 396457 - protein, 11 aa, Influenza virus
LYNIRNLHIPE

SEQ ID NO: 396458 - protein, 11 aa, Influenza virus
YNIRNLHIPEV

SEQ ID NO: 396459 - protein, 11 aa, Influenza virus
NIRNLHIPEVC

SEQ ID NO: 396460 - protein, 11 aa, Influenza virus
IRNLHIPEVCL

SEQ ID NO: 396461 - protein, 11 aa, Influenza virus
RNLHIPEVCLK

SEQ ID NO: 396462 - protein, 11 aa, Influenza virus
NLHIPEVCLKW

SEQ ID NO: 396463 - protein, 11 aa, Influenza virus
LHIPEVCLKWE

SEQ ID NO: 396464 - protein, 11 aa, Influenza virus
HIPEVCLKWEL

SEQ ID NO: 396465 - protein, 11 aa, Influenza virus
IPEVCLKWELM

SEQ ID NO: 396466 - protein, 11 aa, Influenza virus
PEVCLKWELMD

SEQ ID NO: 396467 - protein, 11 aa, Influenza virus
YQGRLCNPLNP

SEQ ID NO: 396468 - protein, 11 aa, Influenza virus
QGRLCNPLNPF

SEQ ID NO: 396469 - protein, 11 aa, Influenza virus
GRLCNPLNPFV

SEQ ID NO: 396470 - protein, 11 aa, Influenza virus
RLCNPLNPFVS

SEQ ID NO: 396471 - protein, 11 aa, Influenza virus
LCNPLNPFVSH

SEQ ID NO: 396472 - protein, 11 aa, Influenza virus
HPRGLLEVGTR

SEQ ID NO: 396473 - protein, 11 aa, Influenza virus
PRGLLEVGTRW

SEQ ID NO: 396474 - protein, 11 aa, Influenza virus
RGLLEVGTRWM

SEQ ID NO: 396475 - protein, 11 aa, Influenza virus
GLLEVGTRWMK

SEQ ID NO: 396476 - protein, 11 aa, Influenza virus
LLEVGTRWMKI

SEQ ID NO: 396477 - protein, 11 aa, Influenza virus
LEVGTRWMKII

SEQ ID NO: 396478 - protein, 11 aa, Influenza virus
EVGTRWMKIIR

SEQ ID NO: 396479 - protein, 11 aa, Influenza virus
VGTRWMKIIRV

SEQ ID NO: 396480 - protein, 11 aa, Influenza virus
GTRWMKIIRVG

SEQ ID NO: 396481 - protein, 11 aa, Influenza virus
TRWMKIIRVGC

SEQ ID NO: 396482 - protein, 11 aa, Influenza virus
RWMKIIRVGCV

SEQ ID NO: 396483 - protein, 11 aa, Influenza virus
WMKIIRVGCVI

SEQ ID NO: 396484 - protein, 11 aa, Influenza virus
MKIIRVGCVIL

SEQ ID NO: 396485 - protein, 11 aa, Influenza virus
KIIRVGCVILL

SEQ ID NO: 396486 - protein, 11 aa, Influenza virus
IIRVGCVILLN

SEQ ID NO: 396487 - protein, 11 aa, Influenza virus
IRVGCVILLNP

SEQ ID NO: 396488 - protein, 11 aa, Influenza virus
RVGCVILLNPF

SEQ ID NO: 396489 - protein, 11 aa, Influenza virus
VGCVILLNPFV

SEQ ID NO: 396490 - protein, 11 aa, Influenza virus
GCVILLNPFVS

SEQ ID NO: 396491 - protein, 11 aa, Influenza virus
CVILLNPFVSH

SEQ ID NO: 396492 - protein, 11 aa, Influenza virus
VILLNPFVSHK

SEQ ID NO: 396493 - protein, 11 aa, Influenza virus
ILLNPFVSHKE

SEQ ID NO: 396494 - protein, 11 aa, Influenza virus
LLNPFVSHKEI

SEQ ID NO: 396495 - protein, 11 aa, Influenza virus
MEYDAVATTHS

SEQ ID NO: 396496 - protein, 11 aa, Influenza virus
EYDAVATTHSW

SEQ ID NO: 396497 - protein, 11 aa, Influenza virus
YDAVATTHSWI

SEQ ID NO: 396498 - protein, 11 aa, Influenza virus
DAVATTHSWIP

SEQ ID NO: 396499 - protein, 11 aa, Influenza virus
AVATTHSWIPK

SEQ ID NO: 396500 - protein, 11 aa, Influenza virus
VATTHSWIPKR

SEQ ID NO: 396501 - protein, 11 aa, Influenza virus
ATTHSWIPKRN

SEQ ID NO: 396502 - protein, 11 aa, Influenza virus
TTHSWIPKRNR

SEQ ID NO: 396503 - protein, 11 aa, Influenza virus
THSWIPKRNRS

SEQ ID NO: 396504 - protein, 11 aa, Influenza virus
HSWIPKRNRSI

SEQ ID NO: 396505 - protein, 11 aa, Influenza virus
SWIPKRNRSIL

SEQ ID NO: 396506 - protein, 11 aa, Influenza virus
WIPKRNRSILN

SEQ ID NO: 396507 - protein, 11 aa, Influenza virus
IPKRNRSILNT

SEQ ID NO: 396508 - protein, 11 aa, Influenza virus
PKRNRSILNTS

SEQ ID NO: 396509 - protein, 11 aa, Influenza virus
KRNRSILNTSQ

SEQ ID NO: 396510 - protein, 11 aa, Influenza virus
RNRSILNTSQR

SEQ ID NO: 396511 - protein, 11 aa, Influenza virus
NRSILNTSQRG

SEQ ID NO: 396512 - protein, 11 aa, Influenza virus
RSILNTSQRGI

SEQ ID NO: 396513 - protein, 11 aa, Influenza virus
SILNTSQRGIL

SEQ ID NO: 396514 - protein, 11 aa, Influenza virus
ICNSNAITRSG

SEQ ID NO: 396515 - protein, 11 aa, Influenza virus
CNSNAITRSGQ

SEQ ID NO: 396516 - protein, 11 aa, Influenza virus
NSNAITRSGQN

SEQ ID NO: 396517 - protein, 11 aa, Influenza virus
SNAITRSGQNH

SEQ ID NO: 396518 - protein, 11 aa, Influenza virus
NAITRSGQNHG

SEQ ID NO: 396519 - protein, 11 aa, Influenza virus
AITRSGQNHGI

SEQ ID NO: 396520 - protein, 11 aa, Influenza virus
ITRSGQNHGIC

SEQ ID NO: 396521 - protein, 11 aa, Influenza virus
TRSGQNHGICA

SEQ ID NO: 396522 - protein, 11 aa, Influenza virus
RSGQNHGICAV

SEQ ID NO: 396523 - protein, 11 aa, Influenza virus
SGQNHGICAVA

SEQ ID NO: 396524 - protein, 11 aa, Influenza virus
GQNHGICAVAT

SEQ ID NO: 396525 - protein, 11 aa, Influenza virus
QNHGICAVATT

SEQ ID NO: 396526 - protein, 11 aa, Influenza virus
NHGICAVATTH

SEQ ID NO: 396527 - protein, 11 aa, Influenza virus
HGICAVATTHS

SEQ ID NO: 396528 - protein, 11 aa, Influenza virus
GICAVATTHSW

SEQ ID NO: 396529 - protein, 11 aa, Influenza virus
ICAVATTHSWV

SEQ ID NO: 396530 - protein, 11 aa, Influenza virus
CAVATTHSWVP

SEQ ID NO: 396531 - protein, 11 aa, Influenza virus
AVATTHSWVPI

SEQ ID NO: 396532 - protein, 11 aa, Influenza virus
VATTHSWVPIL

SEQ ID NO: 396533 - protein, 11 aa, Influenza virus
ATTHSWVPILN

SEQ ID NO: 396534 - protein, 11 aa, Influenza virus
TTHSWVPILNT

SEQ ID NO: 396535 - protein, 11 aa, Influenza virus
THSWVPILNTS

SEQ ID NO: 396536 - protein, 11 aa, Influenza virus
HSWVPILNTSQ

SEQ ID NO: 396537 - protein, 11 aa, Influenza virus
SWVPILNTSQR

SEQ ID NO: 396538 - protein, 11 aa, Influenza virus
WVPILNTSQRG

SEQ ID NO: 396539 - protein, 11 aa, Influenza virus
VPILNTSQRGI

SEQ ID NO: 396540 - protein, 11 aa, Influenza virus
PILNTSQRGIL

SEQ ID NO: 396541 - protein, 11 aa, Influenza virus
ILNTSQRGILE

SEQ ID NO: 396542 - protein, 11 aa, Influenza virus
LNTSQRGILED

SEQ ID NO: 396543 - protein, 11 aa, Influenza virus
NTSQRGILEDE

SEQ ID NO: 396544 - protein, 11 aa, Influenza virus
TSQRGILEDEQ

SEQ ID NO: 396545 - protein, 11 aa, Influenza virus
SQRGILEDEQM

SEQ ID NO: 396546 - protein, 11 aa, Influenza virus
QRGILEDEQMY

SEQ ID NO: 396547 - protein, 11 aa, Influenza virus
RGILEDEQMYQ

SEQ ID NO: 396548 - protein, 11 aa, Influenza virus
GILEDEQMYQK

SEQ ID NO: 396549 - protein, 11 aa, Influenza virus
ILEDEQMYQKC

SEQ ID NO: 396550 - protein, 11 aa, Influenza virus
LEDEQMYQKCC

SEQ ID NO: 396551 - protein, 11 aa, Influenza virus
EDEQMYQKCCN

SEQ ID NO: 396552 - protein, 11 aa, Influenza virus
DEQMYQKCCNL

SEQ ID NO: 396553 - protein, 11 aa, Influenza virus
EQMYQKCCNLF

SEQ ID NO: 396554 - protein, 11 aa, Influenza virus
MYQKCCNLFEK

SEQ ID NO: 396555 - protein, 11 aa, Influenza virus
YQKCCNLFEKF

SEQ ID NO: 396556 - protein, 11 aa, Influenza virus
QKCCNLFEKFF

SEQ ID NO: 396557 - protein, 11 aa, Influenza virus
KCCNLFEKFFP

SEQ ID NO: 396558 - protein, 11 aa, Influenza virus
CCNLFEKFFPS

SEQ ID NO: 396559 - protein, 11 aa, Influenza virus
CNLFEKFFPSS

SEQ ID NO: 396560 - protein, 11 aa, Influenza virus
NLFEKFFPSSS

SEQ ID NO: 396561 - protein, 11 aa, Influenza virus
LFEKFFPSSSY

SEQ ID NO: 396562 - protein, 11 aa, Influenza virus
FEKFFPSSSYR

SEQ ID NO: 396563 - protein, 11 aa, Influenza virus
EKFFPSSSYRR

SEQ ID NO: 396564 - protein, 11 aa, Influenza virus
KFFPSSSYRRP

SEQ ID NO: 396565 - protein, 11 aa, Influenza virus
FFPSSSYRRPV

SEQ ID NO: 396566 - protein, 11 aa, Influenza virus
FPSSSYRRPVG

SEQ ID NO: 396567 - protein, 11 aa, Influenza virus
PSSSYRRPVGI

SEQ ID NO: 396568 - protein, 11 aa, Influenza virus
SSSYRRPVGIS

SEQ ID NO: 396569 - protein, 11 aa, Influenza virus
SSYRRPVGISS

SEQ ID NO: 396570 - protein, 11 aa, Influenza virus
SYRRPVGISSM

SEQ ID NO: 396571 - protein, 11 aa, Influenza virus
YRRPVGISSMV

SEQ ID NO: 396572 - protein, 11 aa, Influenza virus
RRPVGISSMVE

SEQ ID NO: 396573 - protein, 11 aa, Influenza virus
RPVGISSMVEA

SEQ ID NO: 396574 - protein, 11 aa, Influenza virus
PVGISSMVEAM

SEQ ID NO: 396575 - protein, 11 aa, Influenza virus
GISSMVEAMVS

SEQ ID NO: 396576 - protein, 11 aa, Influenza virus
ISSMVEAMVSR

SEQ ID NO: 396577 - protein, 11 aa, Influenza virus
SSMVEAMVSRA

SEQ ID NO: 396578 - protein, 11 aa, Influenza virus
SMVEAMVSRAR

SEQ ID NO: 396579 - protein, 11 aa, Influenza virus
MVEAMVSRARI

SEQ ID NO: 396580 - protein, 11 aa, Influenza virus
VEAMVSRARID

SEQ ID NO: 396581 - protein, 11 aa, Influenza virus
EAMVSRARIDA

SEQ ID NO: 396582 - protein, 11 aa, Influenza virus
AMVSRARIDAR

SEQ ID NO: 396583 - protein, 11 aa, Influenza virus
MVSRARIDARI

SEQ ID NO: 396584 - protein, 11 aa, Influenza virus
VSRARIDARID

SEQ ID NO: 396585 - protein, 11 aa, Influenza virus
SRARIDARIDF

SEQ ID NO: 396586 - protein, 11 aa, Influenza virus
RARIDARIDFE

SEQ ID NO: 396587 - protein, 11 aa, Influenza virus
ARIDARIDFES

SEQ ID NO: 396588 - protein, 11 aa, Influenza virus
RIDARIDFESG

SEQ ID NO: 396589 - protein, 11 aa, Influenza virus
IDARIDFESGR

SEQ ID NO: 396590 - protein, 11 aa, Influenza virus
GKKEEFSEIMK

SEQ ID NO: 396591 - protein, 11 aa, Influenza virus
TIEELRRQKWW

SEQ ID NO: 396592 - protein, 11 aa, Influenza virus
IEELRRQKWWV

SEQ ID NO: 396593 - protein, 11 aa, Influenza virus
EELRRQKSLIW

SEQ ID NO: 396594 - protein, 11 aa, Influenza virus
ELRRQKWWVWL

SEQ ID NO: 396595 - protein, 11 aa, Influenza virus
LRRQKSLIWLW

SEQ ID NO: 396596 - protein, 11 aa, Influenza virus
RRQKSLIWLWL

SEQ ID NO: 396597 - protein, 11 aa, Influenza virus
RQKSLIWLWLV

SEQ ID NO: 396598 - protein, 11 aa, Influenza virus
QKWWVWLWLVL

SEQ ID NO: 396599 - protein, 11 aa, Influenza virus
KSLIWLWLVLR

SEQ ID NO: 396600 - protein, 11 aa, Influenza virus
WWVWLWLVLRE

SEQ ID NO: 396601 - protein, 11 aa, Influenza virus
LIWLWLVLREK

SEQ ID NO: 396602 - protein, 11 aa, Influenza virus
VWLWLVLREKM

SEQ ID NO: 396603 - protein, 11 aa, Influenza virus
WLWLVLREKMP

SEQ ID NO: 396604 - protein, 11 aa, Influenza virus
SESRSNIFNME

SEQ ID NO: 396605 - protein, 11 aa, Influenza virus
ESRSNIFNMER

SEQ ID NO: 396606 - protein, 11 aa, Influenza virus
SRSNIFNMERI

SEQ ID NO: 396607 - protein, 11 aa, Influenza virus
RSNIFNMERIK

SEQ ID NO: 396608 - protein, 11 aa, Influenza virus
SNIFNMERIKE

SEQ ID NO: 396609 - protein, 11 aa, Influenza virus
NIFNMERIKEL

SEQ ID NO: 396610 - protein, 11 aa, Influenza virus
IFNMERIKELR

SEQ ID NO: 396611 - protein, 11 aa, Influenza virus
FNMERIKELRD

SEQ ID NO: 396612 - protein, 11 aa, Influenza virus
NMERIKELRDL

SEQ ID NO: 396613 - protein, 11 aa, Influenza virus
LMSQSRTREIL

SEQ ID NO: 396614 - protein, 11 aa, Influenza virus
MSQSRTREILT

SEQ ID NO: 396615 - protein, 11 aa, Influenza virus
SRTREILTKTT

SEQ ID NO: 396616 - protein, 11 aa, Influenza virus
RTREILTKTTV

SEQ ID NO: 396617 - protein, 11 aa, Influenza virus
TREILTKTTVD

SEQ ID NO: 396618 - protein, 11 aa, Influenza virus
REILTKTTVDH

SEQ ID NO: 396619 - protein, 11 aa, Influenza virus
EILTKTTVDHM

SEQ ID NO: 396620 - protein, 11 aa, Influenza virus
ILTKTTVDHMA

SEQ ID NO: 396621 - protein, 11 aa, Influenza virus
LTKTTVDHMAI

SEQ ID NO: 396622 - protein, 11 aa, Influenza virus
TKTTVDHMAII

SEQ ID NO: 396623 - protein, 11 aa, Influenza virus
KTTVDHMAIIK

SEQ ID NO: 396624 - protein, 11 aa, Influenza virus
TTVDHMAIIKK

SEQ ID NO: 396625 - protein, 11 aa, Influenza virus
TVDHMAIIKKY

SEQ ID NO: 396626 - protein, 11 aa, Influenza virus
VDHMAIIKKYT

SEQ ID NO: 396627 - protein, 11 aa, Influenza virus
DHMAIIKKYTS

SEQ ID NO: 396628 - protein, 11 aa, Influenza virus
HMAIIKKYTSG

SEQ ID NO: 396629 - protein, 11 aa, Influenza virus
MAIIKKYTSGR

SEQ ID NO: 396630 - protein, 11 aa, Influenza virus
AIIKKYTSGRQ

SEQ ID NO: 396631 - protein, 11 aa, Influenza virus
IIKKYTSGRQE

SEQ ID NO: 396632 - protein, 11 aa, Influenza virus
IKKYTSGRQEK

SEQ ID NO: 396633 - protein, 11 aa, Influenza virus
GHNQEYTSGRQ

SEQ ID NO: 396634 - protein, 11 aa, Influenza virus
HNQEYTSGRQE

SEQ ID NO: 396635 - protein, 11 aa, Influenza virus
NQEYTSGRQEK

SEQ ID NO: 396636 - protein, 11 aa, Influenza virus
KKYTSGRQEKN

SEQ ID NO: 396637 - protein, 11 aa, Influenza virus
KYTSGRQEKNP

SEQ ID NO: 396638 - protein, 11 aa, Influenza virus
YTSGRQEKNPA

SEQ ID NO: 396639 - protein, 11 aa, Influenza virus
TSGRQEKNPAL

SEQ ID NO: 396640 - protein, 11 aa, Influenza virus
SGRQEKNPALR

SEQ ID NO: 396641 - protein, 11 aa, Influenza virus
GRQEKNPALRM

SEQ ID NO: 396642 - protein, 11 aa, Influenza virus
RQEKNPALRMK

SEQ ID NO: 396643 - protein, 11 aa, Influenza virus
QEKNPALRMKW

SEQ ID NO: 396644 - protein, 11 aa, Influenza virus
EKNPALRMKWM

SEQ ID NO: 396645 - protein, 11 aa, Influenza virus
KNPALRMKWMM

SEQ ID NO: 396646 - protein, 11 aa, Influenza virus
NPALRMKWMMA

SEQ ID NO: 396647 - protein, 11 aa, Influenza virus
PALRMKWMMAM

SEQ ID NO: 396648 - protein, 11 aa, Influenza virus
ALRMKWMMAMK

SEQ ID NO: 396649 - protein, 11 aa, Influenza virus
LRMKWMMAMKY

SEQ ID NO: 396650 - protein, 11 aa, Influenza virus
RMKWMMAMKYP

SEQ ID NO: 396651 - protein, 11 aa, Influenza virus
MKWMMAMKYPI

SEQ ID NO: 396652 - protein, 11 aa, Influenza virus
KWMMAMKYPIT

SEQ ID NO: 396653 - protein, 11 aa, Influenza virus
WMMAMKYPITA

SEQ ID NO: 396654 - protein, 11 aa, Influenza virus
MMAMKYPITAD

SEQ ID NO: 396655 - protein, 11 aa, Influenza virus
MVSPLAVTWWN

SEQ ID NO: 396656 - protein, 11 aa, Influenza virus
VSPLAVTWWNR

SEQ ID NO: 396657 - protein, 11 aa, Influenza virus
SPLAVTWWNRN

SEQ ID NO: 396658 - protein, 11 aa, Influenza virus
PLAVTWWNRNG

SEQ ID NO: 396659 - protein, 11 aa, Influenza virus
LAVTWWNRNGP

SEQ ID NO: 396660 - protein, 11 aa, Influenza virus
GTFGPVHFRNQ

SEQ ID NO: 396661 - protein, 11 aa, Influenza virus
FGPVHFRNQVK

SEQ ID NO: 396662 - protein, 11 aa, Influenza virus
GPVHFRNQVKI

SEQ ID NO: 396663 - protein, 11 aa, Influenza virus
PVHFRNQVKIR

SEQ ID NO: 396664 - protein, 11 aa, Influenza virus
VHFRNQVKIRR

SEQ ID NO: 396665 - protein, 11 aa, Influenza virus
HFRNQVKIRRR

SEQ ID NO: 396666 - protein, 11 aa, Influenza virus
FRNQVKIRRRV

SEQ ID NO: 396667 - protein, 11 aa, Influenza virus
RNQVKIRRRVD

SEQ ID NO: 396668 - protein, 11 aa, Influenza virus
QVKIRRRVDIN

SEQ ID NO: 396669 - protein, 11 aa, Influenza virus
VKIRRRVDINP

SEQ ID NO: 396670 - protein, 11 aa, Influenza virus
KIRRRVDINPG

SEQ ID NO: 396671 - protein, 11 aa, Influenza virus
IRRRVDINPGH

SEQ ID NO: 396672 - protein, 11 aa, Influenza virus
RRRVDINPGHA

SEQ ID NO: 396673 - protein, 11 aa, Influenza virus
AKEAQDVIMEV

SEQ ID NO: 396674 - protein, 11 aa, Influenza virus
KEAQDVIMEVV

SEQ ID NO: 396675 - protein, 11 aa, Influenza virus
EAQDVIMEVVF

SEQ ID NO: 396676 - protein, 11 aa, Influenza virus
AQDVIMEVVFP

SEQ ID NO: 396677 - protein, 11 aa, Influenza virus
QDVIMEVVFPN

SEQ ID NO: 396678 - protein, 11 aa, Influenza virus
DVIMEVVFPNE

SEQ ID NO: 396679 - protein, 11 aa, Influenza virus
VIMEVVFPNEV

SEQ ID NO: 396680 - protein, 11 aa, Influenza virus
IMEVVFPNEVG

SEQ ID NO: 396681 - protein, 11 aa, Influenza virus
MEVVFPNEVGA

SEQ ID NO: 396682 - protein, 11 aa, Influenza virus
EVVFPNEVGAR

SEQ ID NO: 396683 - protein, 11 aa, Influenza virus
VVFPNEVGARI

SEQ ID NO: 396684 - protein, 11 aa, Influenza virus
VFPNEVGARIL

SEQ ID NO: 396685 - protein, 11 aa, Influenza virus
FPNEVGARILT

SEQ ID NO: 396686 - protein, 11 aa, Influenza virus
PNEVGARILTS

SEQ ID NO: 396687 - protein, 11 aa, Influenza virus
NEVGARILTSE

SEQ ID NO: 396688 - protein, 11 aa, Influenza virus
EVGARILTSES

SEQ ID NO: 396689 - protein, 11 aa, Influenza virus
VGARILTSESQ

SEQ ID NO: 396690 - protein, 11 aa, Influenza virus
GARILTSESQL

SEQ ID NO: 396691 - protein, 11 aa, Influenza virus
IAPLMVAYMLE

SEQ ID NO: 396692 - protein, 11 aa, Influenza virus
APLMVAYMLER

SEQ ID NO: 396693 - protein, 11 aa, Influenza virus
PLMVAYMLERE

SEQ ID NO: 396694 - protein, 11 aa, Influenza virus
LMVAYMLEREL

SEQ ID NO: 396695 - protein, 11 aa, Influenza virus
MVAYMLERELV

SEQ ID NO: 396696 - protein, 11 aa, Influenza virus
VAYMLERELVR

SEQ ID NO: 396697 - protein, 11 aa, Influenza virus
AYMLERELVRK

SEQ ID NO: 396698 - protein, 11 aa, Influenza virus
YMLERELVRKT

SEQ ID NO: 396699 - protein, 11 aa, Influenza virus
MLERELVRKTR

SEQ ID NO: 396700 - protein, 11 aa, Influenza virus
LERELVRKTRF

SEQ ID NO: 396701 - protein, 11 aa, Influenza virus
ERELVRKTRFL

SEQ ID NO: 396702 - protein, 11 aa, Influenza virus
RELVRKTRFLP

SEQ ID NO: 396703 - protein, 11 aa, Influenza virus
ELVRKTRFLPV

SEQ ID NO: 396704 - protein, 11 aa, Influenza virus
LVRKTRFLPVA

SEQ ID NO: 396705 - protein, 11 aa, Influenza virus
VRKTRFLPVAG

SEQ ID NO: 396706 - protein, 11 aa, Influenza virus
RKTRFLPVAGG

SEQ ID NO: 396707 - protein, 11 aa, Influenza virus
KTRFLPVAGGT

SEQ ID NO: 396708 - protein, 11 aa, Influenza virus
TRFLPVAGGTS

SEQ ID NO: 396709 - protein, 11 aa, Influenza virus
RFLPVAGGTSS

SEQ ID NO: 396710 - protein, 11 aa, Influenza virus
GGTSSVYIEVL

SEQ ID NO: 396711 - protein, 11 aa, Influenza virus
GTSSVYIEVLH

SEQ ID NO: 396712 - protein, 11 aa, Influenza virus
TSSVYIEVLHL

SEQ ID NO: 396713 - protein, 11 aa, Influenza virus
SSVYIEVLHLT

SEQ ID NO: 396714 - protein, 11 aa, Influenza virus
SVYIEVLHLTQ

SEQ ID NO: 396715 - protein, 11 aa, Influenza virus
VYIEVLHLTQG

SEQ ID NO: 396716 - protein, 11 aa, Influenza virus
YIEVLHLTQGT

SEQ ID NO: 396717 - protein, 11 aa, Influenza virus
IEVLHLTQGTC

SEQ ID NO: 396718 - protein, 11 aa, Influenza virus
EVLHLTQGTCW

SEQ ID NO: 396719 - protein, 11 aa, Influenza virus
VLHLTQGTCWE

SEQ ID NO: 396720 - protein, 11 aa, Influenza virus
LHLTQGTCWEQ

SEQ ID NO: 396721 - protein, 11 aa, Influenza virus
HLTQGTCWEQM

SEQ ID NO: 396722 - protein, 11 aa, Influenza virus
LTQGTCWEQMY

SEQ ID NO: 396723 - protein, 11 aa, Influenza virus
TQGTCWEQMYT

SEQ ID NO: 396724 - protein, 11 aa, Influenza virus
QGTCWEQMYTP

SEQ ID NO: 396725 - protein, 11 aa, Influenza virus
GTCWEQMYTPG

SEQ ID NO: 396726 - protein, 11 aa, Influenza virus
TCWEQMYTPGG

SEQ ID NO: 396727 - protein, 11 aa, Influenza virus
CWEQMYTPGGE

SEQ ID NO: 396728 - protein, 11 aa, Influenza virus
WEQMYTPGGEV

SEQ ID NO: 396729 - protein, 11 aa, Influenza virus
NDDVDQSLIIA

SEQ ID NO: 396730 - protein, 11 aa, Influenza virus
DDVDQSLIIAA

SEQ ID NO: 396731 - protein, 11 aa, Influenza virus
DVDQSLIIAAR

SEQ ID NO: 396732 - protein, 11 aa, Influenza virus
VDQSLIIAARN

SEQ ID NO: 396733 - protein, 11 aa, Influenza virus
DQSLIIAARNI

SEQ ID NO: 396734 - protein, 11 aa, Influenza virus
QSLIIAARNIV

SEQ ID NO: 396735 - protein, 11 aa, Influenza virus
SLIIAARNIVR

SEQ ID NO: 396736 - protein, 11 aa, Influenza virus
LIIAARNIVRR

SEQ ID NO: 396737 - protein, 11 aa, Influenza virus
IIAARNIVRRA

SEQ ID NO: 396738 - protein, 11 aa, Influenza virus
IAARNIVRRAA

SEQ ID NO: 396739 - protein, 11 aa, Influenza virus
AARNIVRRAAV

SEQ ID NO: 396740 - protein, 11 aa, Influenza virus
ARNIVRRAAVS

SEQ ID NO: 396741 - protein, 11 aa, Influenza virus
RNIVRRAAVSA

SEQ ID NO: 396742 - protein, 11 aa, Influenza virus
NIVRRAAVSAD

SEQ ID NO: 396743 - protein, 11 aa, Influenza virus
IVRRAAVSADP

SEQ ID NO: 396744 - protein, 11 aa, Influenza virus
VRRAAVSADPL

SEQ ID NO: 396745 - protein, 11 aa, Influenza virus
RRAAVSADPLA

SEQ ID NO: 396746 - protein, 11 aa, Influenza virus
RAAVSADPLAS

SEQ ID NO: 396747 - protein, 11 aa, Influenza virus
AAVSADPLASL

SEQ ID NO: 396748 - protein, 11 aa, Influenza virus
VSADPLASLLE

SEQ ID NO: 396749 - protein, 11 aa, Influenza virus
SADPLASLLEM

SEQ ID NO: 396750 - protein, 11 aa, Influenza virus
ADPLASLLEMC

SEQ ID NO: 396751 - protein, 11 aa, Influenza virus
DPLASLLEMCH

SEQ ID NO: 396752 - protein, 11 aa, Influenza virus
PLASLLEMCHS

SEQ ID NO: 396753 - protein, 11 aa, Influenza virus
LASLLEMCHST

SEQ ID NO: 396754 - protein, 11 aa, Influenza virus
ASLLEMCHSTQ

SEQ ID NO: 396755 - protein, 11 aa, Influenza virus
SLLEMCHSTQI

SEQ ID NO: 396756 - protein, 11 aa, Influenza virus
LLEMCHSTQIG

SEQ ID NO: 396757 - protein, 11 aa, Influenza virus
LEMCHSTQIGG

SEQ ID NO: 396758 - protein, 11 aa, Influenza virus
DILRQNPTEEQ

SEQ ID NO: 396759 - protein, 11 aa, Influenza virus
ILRQNPTEEQA

SEQ ID NO: 396760 - protein, 11 aa, Influenza virus
LRQNPTEEQAV

SEQ ID NO: 396761 - protein, 11 aa, Influenza virus
QNPTEEQAVDI

SEQ ID NO: 396762 - protein, 11 aa, Influenza virus
NPTEEQAVDIC

SEQ ID NO: 396763 - protein, 11 aa, Influenza virus
PTEEQAVDICK

SEQ ID NO: 396764 - protein, 11 aa, Influenza virus
TEEQAVDICKA

SEQ ID NO: 396765 - protein, 11 aa, Influenza virus
EEQAVDICKAA

SEQ ID NO: 396766 - protein, 11 aa, Influenza virus
EQAVDICKAAM

SEQ ID NO: 396767 - protein, 11 aa, Influenza virus
QAVDICKAAMG

SEQ ID NO: 396768 - protein, 11 aa, Influenza virus
ICKAAMGLRIS

SEQ ID NO: 396769 - protein, 11 aa, Influenza virus
CKAAMGLRISS

SEQ ID NO: 396770 - protein, 11 aa, Influenza virus
KAAMGLRISSS

SEQ ID NO: 396771 - protein, 11 aa, Influenza virus
AAMGLRISSSF

SEQ ID NO: 396772 - protein, 11 aa, Influenza virus
AMGLRISSSFS

SEQ ID NO: 396773 - protein, 11 aa, Influenza virus
MGLRISSSFSF

SEQ ID NO: 396774 - protein, 11 aa, Influenza virus
GLRISSSFSFG

SEQ ID NO: 396775 - protein, 11 aa, Influenza virus
LRISSSFSFGG

SEQ ID NO: 396776 - protein, 11 aa, Influenza virus
RISSSFSFGGF

SEQ ID NO: 396777 - protein, 11 aa, Influenza virus
ISSSFSFGGFT

SEQ ID NO: 396778 - protein, 11 aa, Influenza virus
SSSFSFGGFTF

SEQ ID NO: 396779 - protein, 11 aa, Influenza virus
SSFSFGGFTFK

SEQ ID NO: 396780 - protein, 11 aa, Influenza virus
SFSFGGFTFKR

SEQ ID NO: 396781 - protein, 11 aa, Influenza virus
FSFGGFTFKRT

SEQ ID NO: 396782 - protein, 11 aa, Influenza virus
SFGGFTFKRTS

SEQ ID NO: 396783 - protein, 11 aa, Influenza virus
FGGFTFKRTSG

SEQ ID NO: 396784 - protein, 11 aa, Influenza virus
EEEVLTGNLQT

SEQ ID NO: 396785 - protein, 11 aa, Influenza virus
EEVLTGNLQTL

SEQ ID NO: 396786 - protein, 11 aa, Influenza virus
EVLTGNLQTLK

SEQ ID NO: 396787 - protein, 11 aa, Influenza virus
IVAMVFSQEDC

SEQ ID NO: 396788 - protein, 11 aa, Influenza virus
VAMVFSQEDCM

SEQ ID NO: 396789 - protein, 11 aa, Influenza virus
CMIKAVRGDLN

SEQ ID NO: 396790 - protein, 11 aa, Influenza virus
MIKAVRGDLNF

SEQ ID NO: 396791 - protein, 11 aa, Influenza virus
IKAVRGDLNFV

SEQ ID NO: 396792 - protein, 11 aa, Influenza virus
KAVRGDLNFVN

SEQ ID NO: 396793 - protein, 11 aa, Influenza virus
AVRGDLNFVNR

SEQ ID NO: 396794 - protein, 11 aa, Influenza virus
VRGDLNFVNRA

SEQ ID NO: 396795 - protein, 11 aa, Influenza virus
RGDLNFVNRAN

SEQ ID NO: 396796 - protein, 11 aa, Influenza virus
GDLNFVNRANQ

SEQ ID NO: 396797 - protein, 11 aa, Influenza virus
DLNFVNRANQR

SEQ ID NO: 396798 - protein, 11 aa, Influenza virus
LNFVNRANQRL

SEQ ID NO: 396799 - protein, 11 aa, Influenza virus
NFVNRANQRLN

SEQ ID NO: 396800 - protein, 11 aa, Influenza virus
FVNRANQRLNP

SEQ ID NO: 396801 - protein, 11 aa, Influenza virus
VNRANQRLNPM

SEQ ID NO: 396802 - protein, 11 aa, Influenza virus
NRANQRLNPMH

SEQ ID NO: 396803 - protein, 11 aa, Influenza virus
RANQRLNPMHQ

SEQ ID NO: 396804 - protein, 11 aa, Influenza virus
ANQRLNPMHQL

SEQ ID NO: 396805 - protein, 11 aa, Influenza virus
NQRLNPMHQLL

SEQ ID NO: 396806 - protein, 11 aa, Influenza virus
QRLNPMHQLLR

SEQ ID NO: 396807 - protein, 11 aa, Influenza virus
RLNPMHQLLRH

SEQ ID NO: 396808 - protein, 11 aa, Influenza virus
LNPMHQLLRHF

SEQ ID NO: 396809 - protein, 11 aa, Influenza virus
NPMHQLLRHFQ

SEQ ID NO: 396810 - protein, 11 aa, Influenza virus
PMHQLLRHFQK

SEQ ID NO: 396811 - protein, 11 aa, Influenza virus
MHQLLRHFQKD

SEQ ID NO: 396812 - protein, 11 aa, Influenza virus
HQLLRHFQKDA

SEQ ID NO: 396813 - protein, 11 aa, Influenza virus
QLLRHFQKDAK

SEQ ID NO: 396814 - protein, 11 aa, Influenza virus
LLRHFQKDAKV

SEQ ID NO: 396815 - protein, 11 aa, Influenza virus
LRHFQKDAKVL

SEQ ID NO: 396816 - protein, 11 aa, Influenza virus
VSIDRFLRVRD

SEQ ID NO: 396817 - protein, 11 aa, Influenza virus
SIDRFLRVRDQ

SEQ ID NO: 396818 - protein, 11 aa, Influenza virus
DRFLRVRDQRG

SEQ ID NO: 396819 - protein, 11 aa, Influenza virus
GNVLLSPEEVS

SEQ ID NO: 396820 - protein, 11 aa, Influenza virus
NVLLSPEEVSE

SEQ ID NO: 396821 - protein, 11 aa, Influenza virus
VLLSPEEVSET

SEQ ID NO: 396822 - protein, 11 aa, Influenza virus
LLSPEEVSETQ

SEQ ID NO: 396823 - protein, 11 aa, Influenza virus
LSPEEVSETQG

SEQ ID NO: 396824 - protein, 11 aa, Influenza virus
SPEEVSETQGT

SEQ ID NO: 396825 - protein, 11 aa, Influenza virus
PEEVSETQGTE

SEQ ID NO: 396826 - protein, 11 aa, Influenza virus
EKLTITYSSSM

SEQ ID NO: 396827 - protein, 11 aa, Influenza virus
KLTITYSSSMM

SEQ ID NO: 396828 - protein, 11 aa, Influenza virus
LTITYSSSMMW

SEQ ID NO: 396829 - protein, 11 aa, Influenza virus
TITYSSSMMWE

SEQ ID NO: 396830 - protein, 11 aa, Influenza virus
ITYSSSMMWEI

SEQ ID NO: 396831 - protein, 11 aa, Influenza virus
TYSSSMMWEIN

SEQ ID NO: 396832 - protein, 11 aa, Influenza virus
YSSSMMWEING

SEQ ID NO: 396833 - protein, 11 aa, Influenza virus
SSSMMWEINGP

SEQ ID NO: 396834 - protein, 11 aa, Influenza virus
SSMMWEINGPE

SEQ ID NO: 396835 - protein, 11 aa, Influenza virus
SMMWEINGPES

SEQ ID NO: 396836 - protein, 11 aa, Influenza virus
MMWEINGPESV

SEQ ID NO: 396837 - protein, 11 aa, Influenza virus
MWEINGPESVL

SEQ ID NO: 396838 - protein, 11 aa, Influenza virus
WEINGPESVLV

SEQ ID NO: 396839 - protein, 11 aa, Influenza virus
EINGPESVLVN

SEQ ID NO: 396840 - protein, 11 aa, Influenza virus
INGPESVLVNT

SEQ ID NO: 396841 - protein, 11 aa, Influenza virus
NGPESVLVNTY

SEQ ID NO: 396842 - protein, 11 aa, Influenza virus
GPESVLVNTYQ

SEQ ID NO: 396843 - protein, 11 aa, Influenza virus
PESVLVNTYQW

SEQ ID NO: 396844 - protein, 11 aa, Influenza virus
ESVLVNTYQWI

SEQ ID NO: 396845 - protein, 11 aa, Influenza virus
SVLVNTYQWII

SEQ ID NO: 396846 - protein, 11 aa, Influenza virus
VLVNTYQWIIR

SEQ ID NO: 396847 - protein, 11 aa, Influenza virus
LVNTYQWIIRN

SEQ ID NO: 396848 - protein, 11 aa, Influenza virus
VNTYQWIIRNW

SEQ ID NO: 396849 - protein, 11 aa, Influenza virus
NTYQWIIRNWE

SEQ ID NO: 396850 - protein, 11 aa, Influenza virus
LYNKMEFEPFQ

SEQ ID NO: 396851 - protein, 11 aa, Influenza virus
YNKMEFEPFQS

SEQ ID NO: 396852 - protein, 11 aa, Influenza virus
NKMEFEPFQSL

SEQ ID NO: 396853 - protein, 11 aa, Influenza virus
KMEFEPFQSLV

SEQ ID NO: 396854 - protein, 11 aa, Influenza virus
MEFEPFQSLVP

SEQ ID NO: 396855 - protein, 11 aa, Influenza virus
EFEPFQSLVPK

SEQ ID NO: 396856 - protein, 11 aa, Influenza virus
FEPFQSLVPKA

SEQ ID NO: 396857 - protein, 11 aa, Influenza virus
QYSGFVRTLFQ

SEQ ID NO: 396858 - protein, 11 aa, Influenza virus
YSGFVRTLFQQ

SEQ ID NO: 396859 - protein, 11 aa, Influenza virus
SGFVRTLFQQM

SEQ ID NO: 396860 - protein, 11 aa, Influenza virus
GFVRTLFQQMR

SEQ ID NO: 396861 - protein, 11 aa, Influenza virus
FVRTLFQQMRD

SEQ ID NO: 396862 - protein, 11 aa, Influenza virus
VRTLFQQMRDV

SEQ ID NO: 396863 - protein, 11 aa, Influenza virus
RTLFQQMRDVL

SEQ ID NO: 396864 - protein, 11 aa, Influenza virus
TLFQQMRDVLG

SEQ ID NO: 396865 - protein, 11 aa, Influenza virus
LFQQMRDVLGT

SEQ ID NO: 396866 - protein, 11 aa, Influenza virus
FQQMRDVLGTF

SEQ ID NO: 396867 - protein, 11 aa, Influenza virus
QQMRDVLGTFD

SEQ ID NO: 396868 - protein, 11 aa, Influenza virus
QMRDVLGTFDT

SEQ ID NO: 396869 - protein, 11 aa, Influenza virus
QIIKLLPFAAA

SEQ ID NO: 396870 - protein, 11 aa, Influenza virus
IIKLLPFAAAP

SEQ ID NO: 396871 - protein, 11 aa, Influenza virus
IKLLPFAAAPP

SEQ ID NO: 396872 - protein, 11 aa, Influenza virus
KLLPFAAAPPE

SEQ ID NO: 396873 - protein, 11 aa, Influenza virus
LLPFAAAPPEQ

SEQ ID NO: 396874 - protein, 11 aa, Influenza virus
LPFAAAPPEQS

SEQ ID NO: 396875 - protein, 11 aa, Influenza virus
PPEQSRMQFSS

SEQ ID NO: 396876 - protein, 11 aa, Influenza virus
QSRMQFSSLTV

SEQ ID NO: 396877 - protein, 11 aa, Influenza virus
RMQFSSLTVNV

SEQ ID NO: 396878 - protein, 11 aa, Influenza virus
MQFSSLTVNVR

SEQ ID NO: 396879 - protein, 11 aa, Influenza virus
QFSSLTVNVRG

SEQ ID NO: 396880 - protein, 11 aa, Influenza virus
FSSLTVNVRGS

SEQ ID NO: 396881 - protein, 11 aa, Influenza virus
SSLTVNVRGSG

SEQ ID NO: 396882 - protein, 11 aa, Influenza virus
SLTVNVRGSGM

SEQ ID NO: 396883 - protein, 11 aa, Influenza virus
LTVNVRGSGMR

SEQ ID NO: 396884 - protein, 11 aa, Influenza virus
TVNVRGSGMRI

SEQ ID NO: 396885 - protein, 11 aa, Influenza virus
VNVRGSGMRIL

SEQ ID NO: 396886 - protein, 11 aa, Influenza virus
RGSGMRILVRG

SEQ ID NO: 396887 - protein, 11 aa, Influenza virus
GMRILVRGNSP

SEQ ID NO: 396888 - protein, 11 aa, Influenza virus
LVRGNSPVFNY

SEQ ID NO: 396889 - protein, 11 aa, Influenza virus
VRGNSPVFNYN

SEQ ID NO: 396890 - protein, 11 aa, Influenza virus
RGNSPVFNYNK

SEQ ID NO: 396891 - protein, 11 aa, Influenza virus
KRLTVLGKDAG

SEQ ID NO: 396892 - protein, 11 aa, Influenza virus
AGAGALAEDPD

SEQ ID NO: 396893 - protein, 11 aa, Influenza virus
GAGALAEDPDE

SEQ ID NO: 396894 - protein, 11 aa, Influenza virus
AGVESAVLRGF

SEQ ID NO: 396895 - protein, 11 aa, Influenza virus
GVESAVLRGFL

SEQ ID NO: 396896 - protein, 11 aa, Influenza virus
VESAVLRGFLI

SEQ ID NO: 396897 - protein, 11 aa, Influenza virus
ESAVLRGFLIL

SEQ ID NO: 396898 - protein, 11 aa, Influenza virus
SAVLRGFLILG

SEQ ID NO: 396899 - protein, 11 aa, Influenza virus
AVLRGFLILGK

SEQ ID NO: 396900 - protein, 11 aa, Influenza virus
VLRGFLILGKE

SEQ ID NO: 396901 - protein, 11 aa, Influenza virus
LRGFLILGKED

SEQ ID NO: 396902 - protein, 11 aa, Influenza virus
RGFLILGKEDK

SEQ ID NO: 396903 - protein, 11 aa, Influenza virus
QKKDKRYGPAL

SEQ ID NO: 396904 - protein, 11 aa, Influenza virus
EDKRYGPALSI

SEQ ID NO: 396905 - protein, 11 aa, Influenza virus
KRYGPALSINE

SEQ ID NO: 396906 - protein, 11 aa, Influenza virus
RYGPALSINEL

SEQ ID NO: 396907 - protein, 11 aa, Influenza virus
YGPALSINELS

SEQ ID NO: 396908 - protein, 11 aa, Influenza virus
LAKGEKANVLI

SEQ ID NO: 396909 - protein, 11 aa, Influenza virus
AKGEKANVLIG

SEQ ID NO: 396910 - protein, 11 aa, Influenza virus
KGEKANVLIGQ

SEQ ID NO: 396911 - protein, 11 aa, Influenza virus
GEKANVLIGQG

SEQ ID NO: 396912 - protein, 11 aa, Influenza virus
EKANVLIGQGD

SEQ ID NO: 396913 - protein, 11 aa, Influenza virus
KANVLIGQGDV

SEQ ID NO: 396914 - protein, 11 aa, Influenza virus
ANVLIGQGDVV

SEQ ID NO: 396915 - protein, 11 aa, Influenza virus
NVLIGQGDVVL

SEQ ID NO: 396916 - protein, 11 aa, Influenza virus
VLIGQGDVVLV

SEQ ID NO: 396917 - protein, 11 aa, Influenza virus
LIGQGDVVLVM

SEQ ID NO: 396918 - protein, 11 aa, Influenza virus
IGQGDVVLVMK

SEQ ID NO: 396919 - protein, 11 aa, Influenza virus
GQGDVVLVMKR

SEQ ID NO: 396920 - protein, 11 aa, Influenza virus
QGDVVLVMKRK

SEQ ID NO: 396921 - protein, 11 aa, Influenza virus
GDVVLVMKRKR

SEQ ID NO: 396922 - protein, 11 aa, Influenza virus
DVVLVMKRKRD

SEQ ID NO: 396923 - protein, 11 aa, Influenza virus
VVLVMKRKRDS

SEQ ID NO: 396924 - protein, 11 aa, Influenza virus
VLVMKRKRDSS

SEQ ID NO: 396925 - protein, 11 aa, Influenza virus
LVMKRKRDSSI

SEQ ID NO: 396926 - protein, 11 aa, Influenza virus
VMKRKRDSSIL

SEQ ID NO: 396927 - protein, 11 aa, Influenza virus
MKRKRDSSILT

SEQ ID NO: 396928 - protein, 11 aa, Influenza virus
KRKRDSSILTD

SEQ ID NO: 396929 - protein, 11 aa, Influenza virus
RKRDSSILTDS

SEQ ID NO: 396930 - protein, 11 aa, Influenza virus
KRDSSILTDSQ

SEQ ID NO: 396931 - protein, 11 aa, Influenza virus
RDSSILTDSQT

SEQ ID NO: 396932 - protein, 11 aa, Influenza virus
DSSILTDSQTA

SEQ ID NO: 396933 - protein, 11 aa, Influenza virus
SSILTDSQTAT

SEQ ID NO: 396934 - protein, 11 aa, Influenza virus
SILTDSQTATK

SEQ ID NO: 396935 - protein, 11 aa, Influenza virus
ILTDSQTATKR

SEQ ID NO: 396936 - protein, 11 aa, Influenza virus
LTDSQTATKRI

SEQ ID NO: 396937 - protein, 11 aa, Influenza virus
TDSQTATKRIR

SEQ ID NO: 396938 - protein, 11 aa, Influenza virus
DSQTATKRIRM

SEQ ID NO: 396939 - protein, 11 aa, Influenza virus
SQTATKRIRMA

SEQ ID NO: 396940 - protein, 11 aa, Influenza virus
QTATKRIRMAI

SEQ ID NO: 396941 - protein, 11 aa, Influenza virus
TKRIRMAINQC

SEQ ID NO: 396942 - protein, 11 aa, Influenza virus
KRIRMATNECR

SEQ ID NO: 396943 - protein, 11 aa, Influenza virus
RIRMATNECRI

SEQ ID NO: 396944 - protein, 11 aa, Influenza virus
IRMAINWGRIV

SEQ ID NO: 396945 - protein, 11 aa, Influenza virus
KQGKTKATKME

SEQ ID NO: 396946 - protein, 11 aa, Influenza virus
QGKTKATKMEA

SEQ ID NO: 396947 - protein, 11 aa, Influenza virus
IFIFLLLTHWA

SEQ ID NO: 396948 - protein, 11 aa, Influenza virus
FNFILLTHWAY

SEQ ID NO: 396949 - protein, 11 aa, Influenza virus
RFSYVFCLALG

SEQ ID NO: 396950 - protein, 11 aa, Influenza virus
SDNADKICLGH

SEQ ID NO: 396951 - protein, 11 aa, Influenza virus
EKENSYPKINK

SEQ ID NO: 396952 - protein, 11 aa, Influenza virus
APSGVEYNGKS

SEQ ID NO: 396953 - protein, 11 aa, Influenza virus
SGVEYNGKSLG

SEQ ID NO: 396954 - protein, 11 aa, Influenza virus
GVEYNGKSLGI

SEQ ID NO: 396955 - protein, 11 aa, Influenza virus
VEYNGKSLGIQ

SEQ ID NO: 396956 - protein, 11 aa, Influenza virus
YGGLNKSKPYY

SEQ ID NO: 396957 - protein, 11 aa, Influenza virus
IPIGERGLFGA

SEQ ID NO: 396958 - protein, 11 aa, Influenza virus
KLLKERGFFGA

SEQ ID NO: 396959 - protein, 11 aa, Influenza virus
LLKERGFFGAI

SEQ ID NO: 396960 - protein, 11 aa, Influenza virus
KRRKKRGLFGA

SEQ ID NO: 396961 - protein, 11 aa, Influenza virus
RRKKRGLFGAI

SEQ ID NO: 396962 - protein, 11 aa, Influenza virus
RKKRGLFGAIA

SEQ ID NO: 396963 - protein, 11 aa, Influenza virus
QKRGLFGAIAG

SEQ ID NO: 396964 - protein, 11 aa, Influenza virus
AHKQLTHHMRK

SEQ ID NO: 396965 - protein, 11 aa, Influenza virus
MRKKRGLFGAK

SEQ ID NO: 396966 - protein, 11 aa, Influenza virus
RKKRGLFGAKA

SEQ ID NO: 396967 - protein, 11 aa, Influenza virus
RETRGLFGAIA

SEQ ID NO: 396968 - protein, 11 aa, Influenza virus
ETRGLFGAIAG

SEQ ID NO: 396969 - protein, 11 aa, Influenza virus
TRGLFGAIAGF

SEQ ID NO: 396970 - protein, 11 aa, Influenza virus
RGIFGAIAGFI

SEQ ID NO: 396971 - protein, 11 aa, Influenza virus
GIFGAIAGFIE

SEQ ID NO: 396972 - protein, 11 aa, Influenza virus
IFGAIAGFIEN

SEQ ID NO: 396973 - protein, 11 aa, Influenza virus
FGAIAGFIENG

SEQ ID NO: 396974 - protein, 11 aa, Influenza virus
GAIAGFIENGW

SEQ ID NO: 396975 - protein, 11 aa, Influenza virus
CIRFVNSDCSK

SEQ ID NO: 396976 - protein, 11 aa, Influenza virus
IDFRDMRKNTL

SEQ ID NO: 396977 - protein, 11 aa, Influenza virus
LVFREQKQEFK

SEQ ID NO: 396978 - protein, 11 aa, Influenza virus
FSGSQKQEFKM

SEQ ID NO: 396979 - protein, 11 aa, Influenza virus
FREQKQEFKMN

SEQ ID NO: 396980 - protein, 11 aa, Influenza virus
GSQKQEFKMNP

SEQ ID NO: 396981 - protein, 11 aa, Influenza virus
SQKQEFKMNPN

SEQ ID NO: 396982 - protein, 11 aa, Influenza virus
QKQEFKMNPNQ

SEQ ID NO: 396983 - protein, 11 aa, Influenza virus
KQEFKMNPNQK

SEQ ID NO: 396984 - protein, 11 aa, Influenza virus
QEFKMNPNQKI

SEQ ID NO: 396985 - protein, 11 aa, Influenza virus
EFKMNPNQKII

SEQ ID NO: 396986 - protein, 11 aa, Influenza virus
KMNPNQKIITI

SEQ ID NO: 396987 - protein, 11 aa, Influenza virus
IREGLILEYYF

SEQ ID NO: 396988 - protein, 11 aa, Influenza virus
RKGLILEYYSL

SEQ ID NO: 396989 - protein, 11 aa, Influenza virus
EKGKVVKSVEL

SEQ ID NO: 396990 - protein, 11 aa, Influenza virus
IKHLEECSCYV

SEQ ID NO: 396991 - protein, 11 aa, Influenza virus
SYPNVRCVCRD

SEQ ID NO: 396992 - protein, 11 aa, Influenza virus
DNYGVKGFGFR

SEQ ID NO: 396993 - protein, 11 aa, Influenza virus
LVFREQKQEFK

SEQ ID NO: 396994 - protein, 11 aa, Influenza virus
FSGSQKQEFKM

SEQ ID NO: 396995 - protein, 11 aa, Influenza virus
FREQKQEFKMN

SEQ ID NO: 396996 - protein, 11 aa, Influenza virus
GSQKQEFKMNP

SEQ ID NO: 396997 - protein, 11 aa, Influenza virus
SQKQEFKMNPN

SEQ ID NO: 396998 - protein, 11 aa, Influenza virus
QKQEFKMNPNQ

SEQ ID NO: 396999 - protein, 11 aa, Influenza virus
KQEFKMNPNQK

SEQ ID NO: 397000 - protein, 11 aa, Influenza virus
QEFKMNPNQKI

SEQ ID NO: 397001 - protein, 11 aa, Influenza virus
EFKMNPNQKII

SEQ ID NO: 397002 - protein, 11 aa, Influenza virus
FKMNPNQKIII

SEQ ID NO: 397003 - protein, 11 aa, Influenza virus
KMNPNQKIITI

SEQ ID NO: 397004 - protein, 11 aa, Influenza virus
ASQYGPSHSIH

SEQ ID NO: 397005 - protein, 11 aa, Influenza virus
VRIGSKGDVFV

SEQ ID NO: 397006 - protein, 11 aa, Influenza virus
FVMREPFISCS

SEQ ID NO: 397007 - protein, 11 aa, Influenza virus
LECKTFFLTQG

SEQ ID NO: 397008 - protein, 11 aa, Influenza virus
ECKTFFLTQGA

SEQ ID NO: 397009 - protein, 11 aa, Influenza virus
CKTFFLTQGAL

SEQ ID NO: 397010 - protein, 11 aa, Influenza virus
KTFFLTQGALL

SEQ ID NO: 397011 - protein, 11 aa, Influenza virus
TFFLTQGSLLN

SEQ ID NO: 397012 - protein, 11 aa, Influenza virus
FLTQGALLNDR

SEQ ID NO: 397013 - protein, 11 aa, Influenza virus
LTQGALLNDRH

SEQ ID NO: 397014 - protein, 11 aa, Influenza virus
TQGALLNDRHS

SEQ ID NO: 397015 - protein, 11 aa, Influenza virus
QGALLNDRHSN

SEQ ID NO: 397016 - protein, 11 aa, Influenza virus
GALLNDRHSNG

SEQ ID NO: 397017 - protein, 11 aa, Influenza virus
ALLNDRHSNGT

SEQ ID NO: 397018 - protein, 11 aa, Influenza virus
LLNDKHSNGTV

SEQ ID NO: 397019 - protein, 11 aa, Influenza virus
RSPYRALMSCP

SEQ ID NO: 397020 - protein, 11 aa, Influenza virus
GEAPSPYNSRF

SEQ ID NO: 397021 - protein, 11 aa, Influenza virus
EAPSPYNSRFE

SEQ ID NO: 397022 - protein, 11 aa, Influenza virus
APSPYNSRFES

SEQ ID NO: 397023 - protein, 11 aa, Influenza virus
PSPYNSKFESV

SEQ ID NO: 397024 - protein, 11 aa, Influenza virus
SPYNSKFESVA

SEQ ID NO: 397025 - protein, 11 aa, Influenza virus
PYNSKFESVAW

SEQ ID NO: 397026 - protein, 11 aa, Influenza virus
YNSKFESVAWS

SEQ ID NO: 397027 - protein, 11 aa, Influenza virus
NSKFESVAWSA

SEQ ID NO: 397028 - protein, 11 aa, Influenza virus
SKFESVAWSAS

SEQ ID NO: 397029 - protein, 11 aa, Influenza virus
KFESVAWSASA

SEQ ID NO: 397030 - protein, 11 aa, Influenza virus
AWSASACHDGM

SEQ ID NO: 397031 - protein, 11 aa, Influenza virus
SWLTIGISGPD

SEQ ID NO: 397032 - protein, 11 aa, Influenza virus
TIGISGPDDGA

SEQ ID NO: 397033 - protein, 11 aa, Influenza virus
IGISGPDDGAV

SEQ ID NO: 397034 - protein, 11 aa, Influenza virus
GISGPDDGAVA

SEQ ID NO: 397035 - protein, 11 aa, Influenza virus
ISGPDDGAVAV

SEQ ID NO: 397036 - protein, 11 aa, Influenza virus
SGPDDGAVAVL

SEQ ID NO: 397037 - protein, 11 aa, Influenza virus
GPDDGAVAVLK

SEQ ID NO: 397038 - protein, 11 aa, Influenza virus
PDDGAVAVLKY

SEQ ID NO: 397039 - protein, 11 aa, Influenza virus
ILRTQESECVC

SEQ ID NO: 397040 - protein, 11 aa, Influenza virus
NGSCFTIMTDG

SEQ ID NO: 397041 - protein, 11 aa, Influenza virus
GSCFTIMTDGP

SEQ ID NO: 397042 - protein, 11 aa, Influenza virus
EKGKVVKSVEL

SEQ ID NO: 397043 - protein, 11 aa, Influenza virus
APNFHYEECSC

SEQ ID NO: 397044 - protein, 11 aa, Influenza virus
PNFHYEECSCY

SEQ ID NO: 397045 - protein, 11 aa, Influenza virus
NFHYEECSCYP

SEQ ID NO: 397046 - protein, 11 aa, Influenza virus
CVCRDNWHASN

SEQ ID NO: 397047 - protein, 11 aa, Influenza virus
VCRDNWHASNR

SEQ ID NO: 397048 - protein, 11 aa, Influenza virus
CRDNWHASNRP

SEQ ID NO: 397049 - protein, 11 aa, Influenza virus
RDNWHASNRPW

SEQ ID NO: 397050 - protein, 11 aa, Influenza virus
DNWHASNRPWV

SEQ ID NO: 397051 - protein, 11 aa, Influenza virus
NWHASNRPWVS

SEQ ID NO: 397052 - protein, 11 aa, Influenza virus
WHASNRPWVSF

SEQ ID NO: 397053 - protein, 11 aa, Influenza virus
GYICSGIFGDN

SEQ ID NO: 397054 - protein, 11 aa, Influenza virus
YICSGIFGDNP

SEQ ID NO: 397055 - protein, 11 aa, Influenza virus
ICSGIFGDNPR

SEQ ID NO: 397056 - protein, 11 aa, Influenza virus
YDNGVWIGRTK

SEQ ID NO: 397057 - protein, 11 aa, Influenza virus
GFEMIWDPDGW

SEQ ID NO: 397058 - protein, 11 aa, Influenza virus
NEWSGYSGSFV

SEQ ID NO: 397059 - protein, 11 aa, Influenza virus
EWSGYSGSFVQ

SEQ ID NO: 397060 - protein, 11 aa, Influenza virus
WSGYSGSFIQH

SEQ ID NO: 397061 - protein, 11 aa, Influenza virus
SGYSGSFIQHP

SEQ ID NO: 397062 - protein, 11 aa, Influenza virus
GYSGSFIQHPE

SEQ ID NO: 397063 - protein, 11 aa, Influenza virus
YSGSFIQHPEL

SEQ ID NO: 397064 - protein, 11 aa, Influenza virus
SGSFIQHPELT

SEQ ID NO: 397065 - protein, 11 aa, Influenza virus
GSFIQHPELTG

SEQ ID NO: 397066 - protein, 11 aa, Influenza virus
SFVQHPELTGM

SEQ ID NO: 397067 - protein, 11 aa, Influenza virus
DCMRPCFWVEL

SEQ ID NO: 397068 - protein, 11 aa, Influenza virus
CIRPCFWVELV

SEQ ID NO: 397069 - protein, 11 aa, Influenza virus
IRPCFWVELVR

SEQ ID NO: 397070 - protein, 11 aa, Influenza virus
RPCFWVELVRG

SEQ ID NO: 397071 - protein, 11 aa, Influenza virus
PCFWVELVRGL

SEQ ID NO: 397072 - protein, 11 aa, Influenza virus
CFWVELVRGLP

SEQ ID NO: 397073 - protein, 11 aa, Influenza virus
ATIWTSGSSIS

SEQ ID NO: 397074 - protein, 11 aa, Influenza virus
TIWASGSSISF

SEQ ID NO: 397075 - protein, 11 aa, Influenza virus
IWASGSSISFC

SEQ ID NO: 397076 - protein, 11 aa, Influenza virus
WASGSSISFCG

SEQ ID NO: 397077 - protein, 11 aa, Influenza virus
ASGSSISFCGV

SEQ ID NO: 397078 - protein, 11 aa, Influenza virus
SGSSISFCGVD

SEQ ID NO: 397079 - protein, 11 aa, Influenza virus
WSWPDGADLPF

SEQ ID NO: 397080 - protein, 11 aa, Influenza virus
KNNQVILCEQT

SEQ ID NO: 397081 - protein, 11 aa, Influenza virus
KDNSIRLSASG

SEQ ID NO: 397082 - protein, 11 aa, Influenza virus
IWITREPYVSC

SEQ ID NO: 397083 - protein, 11 aa, Influenza virus
RCYQFALGQGT

SEQ ID NO: 397084 - protein, 11 aa, Influenza virus
PHRTLLMNELG

SEQ ID NO: 397085 - protein, 11 aa, Influenza virus
HRTLLMNELGV

SEQ ID NO: 397086 - protein, 11 aa, Influenza virus
RTLLMSELGVP

SEQ ID NO: 397087 - protein, 11 aa, Influenza virus
TLLMSELGVPF

SEQ ID NO: 397088 - protein, 11 aa, Influenza virus
LLMSELGVPFH

SEQ ID NO: 397089 - protein, 11 aa, Influenza virus
LMSELGVPFHL

SEQ ID NO: 397090 - protein, 11 aa, Influenza virus
MNELGVPFHLA

SEQ ID NO: 397091 - protein, 11 aa, Influenza virus
NELGVPFHLAT

SEQ ID NO: 397092 - protein, 11 aa, Influenza virus
ELGVPFHLGTR

SEQ ID NO: 397093 - protein, 11 aa, Influenza virus
LGVPFHLGTRQ

SEQ ID NO: 397094 - protein, 11 aa, Influenza virus
GVPFHLGTRQV

SEQ ID NO: 397095 - protein, 11 aa, Influenza virus
VPFHLGTRQVC

SEQ ID NO: 397096 - protein, 11 aa, Influenza virus
RQVCIAWSSSS

SEQ ID NO: 397097 - protein, 11 aa, Influenza virus
QVCMAWSSSSC

SEQ ID NO: 397098 - protein, 11 aa, Influenza virus
VCMAWSSSSCH

SEQ ID NO: 397099 - protein, 11 aa, Influenza virus
CMAWSSSSCHD

SEQ ID NO: 397100 - protein, 11 aa, Influenza virus
MAWSSSSCHDG

SEQ ID NO: 397101 - protein, 11 aa, Influenza virus
AWSSSSCHDGR

SEQ ID NO: 397102 - protein, 11 aa, Influenza virus
WSSSSCHDGRA

SEQ ID NO: 397103 - protein, 11 aa, Influenza virus
SSSSCHDGRAW

SEQ ID NO: 397104 - protein, 11 aa, Influenza virus
SSSCHDGRAWL

SEQ ID NO: 397105 - protein, 11 aa, Influenza virus
SSCHDGRAWLH

SEQ ID NO: 397106 - protein, 11 aa, Influenza virus
ILRTQESECIC

SEQ ID NO: 397107 - protein, 11 aa, Influenza virus
LRTQESECICI

SEQ ID NO: 397108 - protein, 11 aa, Influenza virus
RTQESECVCIS

SEQ ID NO: 397109 - protein, 11 aa, Influenza virus
CAVVMTDGSAS

SEQ ID NO: 397110 - protein, 11 aa, Influenza virus
IRKGLILEYYS

SEQ ID NO: 397111 - protein, 11 aa, Influenza virus
RKGLILEYYSL

SEQ ID NO: 397112 - protein, 11 aa, Influenza virus
GSAQHIEECSC

SEQ ID NO: 397113 - protein, 11 aa, Influenza virus
SAQHIEECSCY

SEQ ID NO: 397114 - protein, 11 aa, Influenza virus
AQHIEECSCYP

SEQ ID NO: 397115 - protein, 11 aa, Influenza virus
QHIEECSCYPR

SEQ ID NO: 397116 - protein, 11 aa, Influenza virus
SYPNVRCVCRD

SEQ ID NO: 397117 - protein, 11 aa, Influenza virus
VRCICRDNWKG

SEQ ID NO: 397118 - protein, 11 aa, Influenza virus
RCICRDNWKGS

SEQ ID NO: 397119 - protein, 11 aa, Influenza virus
CICRDNWKGSN

SEQ ID NO: 397120 - protein, 11 aa, Influenza virus
ICRDNWKGSNR

SEQ ID NO: 397121 - protein, 11 aa, Influenza virus
CRDNWRGSNRP

SEQ ID NO: 397122 - protein, 11 aa, Influenza virus
RDNWKGSNRPV

SEQ ID NO: 397123 - protein, 11 aa, Influenza virus
YLCSGLVGDTP

SEQ ID NO: 397124 - protein, 11 aa, Influenza virus
LCSGLVGDTPR

SEQ ID NO: 397125 - protein, 11 aa, Influenza virus
CSGLVGDTPRN

SEQ ID NO: 397126 - protein, 11 aa, Influenza virus
CVNRCFYVELI

SEQ ID NO: 397127 - protein, 11 aa, Influenza virus
VNRCFYVELIR

SEQ ID NO: 397128 - protein, 11 aa, Influenza virus
RCFYVELIRGS

SEQ ID NO: 397129 - protein, 11 aa, Influenza virus
TSNSIIVFCGT

SEQ ID NO: 397130 - protein, 11 aa, Influenza virus
IVFCGTSGTYG

SEQ ID NO: 397131 - protein, 11 aa, Influenza virus
AFCGTSGTYGT

SEQ ID NO: 397132 - protein, 11 aa, Influenza virus
FCGTSGTYGSG

SEQ ID NO: 397133 - protein, 11 aa, Influenza virus
CGTSGTYGSGS

SEQ ID NO: 397134 - protein, 11 aa, Influenza virus
GTSGTYGSGSW

SEQ ID NO: 397135 - protein, 11 aa, Influenza virus
TSGTYGSGSWP

SEQ ID NO: 397136 - protein, 11 aa, Influenza virus
SGTYGSGSWPD

SEQ ID NO: 397137 - protein, 11 aa, Influenza virus
GTYGSGSWPDG

SEQ ID NO: 397138 - protein, 11 aa, Influenza virus
TYGSGSWPDGA

SEQ ID NO: 397139 - protein, 11 aa, Influenza virus
GANINFMPYIS

SEQ ID NO: 397140 - protein, 11 aa, Influenza virus
TSISCLYKLSQ

SEQ ID NO: 397141 - protein, 11 aa, Influenza virus
NINFMPYISFA

SEQ ID NO: 397142 - protein, 11 aa, Influenza virus
LPLCPFKGFFP

SEQ ID NO: 397143 - protein, 11 aa, Influenza virus
PLCPFKGFFPF

SEQ ID NO: 397144 - protein, 11 aa, Influenza virus
LCPFKGFFPFH

SEQ ID NO: 397145 - protein, 11 aa, Influenza virus
CPFKGFFPFHK

SEQ ID NO: 397146 - protein, 11 aa, Influenza virus
PFKGFFPFHKD

SEQ ID NO: 397147 - protein, 11 aa, Influenza virus
FKGFFPFHKDN

SEQ ID NO: 397148 - protein, 11 aa, Influenza virus
QGFFPFHKDNA

SEQ ID NO: 397149 - protein, 11 aa, Influenza virus
GFFPFHKDNAL

SEQ ID NO: 397150 - protein, 11 aa, Influenza virus
FFPFHKDNALR

SEQ ID NO: 397151 - protein, 11 aa, Influenza virus
FPFHKDNALRL

SEQ ID NO: 397152 - protein, 11 aa, Influenza virus
PFHKDNALRLA

SEQ ID NO: 397153 - protein, 11 aa, Influenza virus
FHKDNALRLAE

SEQ ID NO: 397154 - protein, 11 aa, Influenza virus
HKDNALRLAEN

SEQ ID NO: 397155 - protein, 11 aa, Influenza virus
IVTREPYISCD

SEQ ID NO: 397156 - protein, 11 aa, Influenza virus
VTREPYISCDN

SEQ ID NO: 397157 - protein, 11 aa, Influenza virus
CWSFALAQGTL

SEQ ID NO: 397158 - protein, 11 aa, Influenza virus
WSFALAQGALV

SEQ ID NO: 397159 - protein, 11 aa, Influenza virus
SFALAQGALVG

SEQ ID NO: 397160 - protein, 11 aa, Influenza virus
FALAQGALVGT

SEQ ID NO: 397161 - protein, 11 aa, Influenza virus
DRTPYRSLIQF

SEQ ID NO: 397162 - protein, 11 aa, Influenza virus
RTPYRSLIQFP

SEQ ID NO: 397163 - protein, 11 aa, Influenza virus
CVAWSSSSCFD

SEQ ID NO: 397164 - protein, 11 aa, Influenza virus
VAWSSSSCFDG

SEQ ID NO: 397165 - protein, 11 aa, Influenza virus
AWSSSSCFDGR

SEQ ID NO: 397166 - protein, 11 aa, Influenza virus
WSSSSCFDGRE

SEQ ID NO: 397167 - protein, 11 aa, Influenza virus
SSSSCFDGREW

SEQ ID NO: 397168 - protein, 11 aa, Influenza virus
SSSCFDGKEWL

SEQ ID NO: 397169 - protein, 11 aa, Influenza virus
SSCFDGKEWLH

SEQ ID NO: 397170 - protein, 11 aa, Influenza virus
SCFDGKEWMHI

SEQ ID NO: 397171 - protein, 11 aa, Influenza virus
CFDGKEWMHIC

SEQ ID NO: 397172 - protein, 11 aa, Influenza virus
RDILRTQESEC

SEQ ID NO: 397173 - protein, 11 aa, Influenza virus
NILRTQESECQ

SEQ ID NO: 397174 - protein, 11 aa, Influenza virus
LRTQESECQCL

SEQ ID NO: 397175 - protein, 11 aa, Influenza virus
KIKHLEECSCY

SEQ ID NO: 397176 - protein, 11 aa, Influenza virus
IKHLEECSCYV

SEQ ID NO: 397177 - protein, 11 aa, Influenza virus
KHLEECSCYVD

SEQ ID NO: 397178 - protein, 11 aa, Influenza virus
DVYCVCRDNWK

SEQ ID NO: 397179 - protein, 11 aa, Influenza virus
VYCVCRDNWKG

SEQ ID NO: 397180 - protein, 11 aa, Influenza virus
YCVCRDNWKGS

SEQ ID NO: 397181 - protein, 11 aa, Influenza virus
CVCRDNWKGSN

SEQ ID NO: 397182 - protein, 11 aa, Influenza virus
VCRDNWKGSNR

SEQ ID NO: 397183 - protein, 11 aa, Influenza virus
DNWKGSNRPWV

SEQ ID NO: 397184 - protein, 11 aa, Influenza virus
NWKGSNRPWVR

SEQ ID NO: 397185 - protein, 11 aa, Influenza virus
WKGSNRPWVRM

SEQ ID NO: 397186 - protein, 11 aa, Influenza virus
GSNRPWVRMNN

SEQ ID NO: 397187 - protein, 11 aa, Influenza virus
SNRPWVRMNNE

SEQ ID NO: 397188 - protein, 11 aa, Influenza virus
NRPWVRMNNET

SEQ ID NO: 397189 - protein, 11 aa, Influenza virus
RPWVRMNNETI

SEQ ID NO: 397190 - protein, 11 aa, Influenza virus
MNNETILETGY

SEQ ID NO: 397191 - protein, 11 aa, Influenza virus
NNETILETGYI

SEQ ID NO: 397192 - protein, 11 aa, Influenza virus
NETILETGYIC

SEQ ID NO: 397193 - protein, 11 aa, Influenza virus
ETILETGYICS

SEQ ID NO: 397194 - protein, 11 aa, Influenza virus
TILETGYICSK

SEQ ID NO: 397195 - protein, 11 aa, Influenza virus
ILETGYICSKF

SEQ ID NO: 397196 - protein, 11 aa, Influenza virus
LETGYICSKFH

SEQ ID NO: 397197 - protein, 11 aa, Influenza virus
ETGYICSKFHS

SEQ ID NO: 397198 - protein, 11 aa, Influenza virus
TGYICSKFHSD

SEQ ID NO: 397199 - protein, 11 aa, Influenza virus
GYICSKFHSDT

SEQ ID NO: 397200 - protein, 11 aa, Influenza virus
YICSKFHSDTP

SEQ ID NO: 397201 - protein, 11 aa, Influenza virus
ICSKFHSDTPR

SEQ ID NO: 397202 - protein, 11 aa, Influenza virus
KFHSDTPRPDD

SEQ ID NO: 397203 - protein, 11 aa, Influenza virus
FHSDTPRPDDP

SEQ ID NO: 397204 - protein, 11 aa, Influenza virus
HSDTPRPDDPS

SEQ ID NO: 397205 - protein, 11 aa, Influenza virus
TQTLVSNSDWS

SEQ ID NO: 397206 - protein, 11 aa, Influenza virus
QTLVSNSDWSG

SEQ ID NO: 397207 - protein, 11 aa, Influenza virus
TLVSNSDWSGY

SEQ ID NO: 397208 - protein, 11 aa, Influenza virus
LVSNSDWSGYS

SEQ ID NO: 397209 - protein, 11 aa, Influenza virus
VSNSDWSGYSG

SEQ ID NO: 397210 - protein, 11 aa, Influenza virus
SNSDWSGYSGS

SEQ ID NO: 397211 - protein, 11 aa, Influenza virus
NSDWSGYSGSF

SEQ ID NO: 397212 - protein, 11 aa, Influenza virus
NDWSGYSGSFV

SEQ ID NO: 397213 - protein, 11 aa, Influenza virus
DWSGYSGSFII

SEQ ID NO: 397214 - protein, 11 aa, Influenza virus
GCFQPCFYIEL

SEQ ID NO: 397215 - protein, 11 aa, Influenza virus
CFQPCFYIELI

SEQ ID NO: 397216 - protein, 11 aa, Influenza virus
FQPCFYIELIR

SEQ ID NO: 397217 - protein, 11 aa, Influenza virus
QPCFYIELIRG

SEQ ID NO: 397218 - protein, 11 aa, Influenza virus
PCFYIELIRGR

SEQ ID NO: 397219 - protein, 11 aa, Influenza virus
VSWASNSIVTF

SEQ ID NO: 397220 - protein, 11 aa, Influenza virus
SWTSNSMVTFC

SEQ ID NO: 397221 - protein, 11 aa, Influenza virus
WTSNSMVTFCG

SEQ ID NO: 397222 - protein, 11 aa, Influenza virus
ASNSIVTFCGL

SEQ ID NO: 397223 - protein, 11 aa, Influenza virus
SNSIVTFCGLN

SEQ ID NO: 397224 - protein, 11 aa, Influenza virus
NSIVTFCGLNN

SEQ ID NO: 397225 - protein, 11 aa, Influenza virus
SIVTFCGLNNE

SEQ ID NO: 397226 - protein, 11 aa, Influenza virus
IVTFCGLNNEP

SEQ ID NO: 397227 - protein, 11 aa, Influenza virus
VTFCGLNNEPG

SEQ ID NO: 397228 - protein, 11 aa, Influenza virus
TFCGLNNEPGS

SEQ ID NO: 397229 - protein, 11 aa, Influenza virus
FCGLNNEPGSG

SEQ ID NO: 397230 - protein, 11 aa, Influenza virus
LNNEPGSGNWP

SEQ ID NO: 397231 - protein, 11 aa, Influenza virus
NNEPGSGNWPD

SEQ ID NO: 397232 - protein, 11 aa, Influenza virus
NEPGSGDWPDG

SEQ ID NO: 397233 - protein, 11 aa, Influenza virus
EPGSGNWPDGA

SEQ ID NO: 397234 - protein, 11 aa, Influenza virus
WPDGANIGFMP

SEQ ID NO: 397235 - protein, 11 aa, Influenza virus
PDGANIGFMPK

SEQ ID NO: 397236 - protein, 11 aa, Influenza virus
MNPNQSIITIG

SEQ ID NO: 397237 - protein, 11 aa, Influenza virus
NPNQSIITIGS

SEQ ID NO: 397238 - protein, 11 aa, Influenza virus
PNQKIITIGSV

SEQ ID NO: 397239 - protein, 11 aa, Influenza virus
LTTIGLLLQIT

SEQ ID NO: 397240 - protein, 11 aa, Influenza virus
TTIGLLLQITS

SEQ ID NO: 397241 - protein, 11 aa, Influenza virus
TIGLLLQITSL

SEQ ID NO: 397242 - protein, 11 aa, Influenza virus
IGLLLQITSLC

SEQ ID NO: 397243 - protein, 11 aa, Influenza virus
GLLLQIISLCS

SEQ ID NO: 397244 - protein, 11 aa, Influenza virus
LLLQIISLCSI

SEQ ID NO: 397245 - protein, 11 aa, Influenza virus
LLQIISLCSIW

SEQ ID NO: 397246 - protein, 11 aa, Influenza virus
LQIISLCSIWF

SEQ ID NO: 397247 - protein, 11 aa, Influenza virus
QIISLCSIWFS

SEQ ID NO: 397248 - protein, 11 aa, Influenza virus
IISLCSIWFSH

SEQ ID NO: 397249 - protein, 11 aa, Influenza virus
ISLCSIWFSHY

SEQ ID NO: 397250 - protein, 11 aa, Influenza virus
CSIWFSHYNQM

SEQ ID NO: 397251 - protein, 11 aa, Influenza virus
SIWFSHYNQMT

SEQ ID NO: 397252 - protein, 11 aa, Influenza virus
IWFSHYNQMTQ

SEQ ID NO: 397253 - protein, 11 aa, Influenza virus
WFSHYNQMTQA

SEQ ID NO: 397254 - protein, 11 aa, Influenza virus
CSNDTINYYNE

SEQ ID NO: 397255 - protein, 11 aa, Influenza virus
SNDTINYYNET

SEQ ID NO: 397256 - protein, 11 aa, Influenza virus
NDTINYYNETF

SEQ ID NO: 397257 - protein, 11 aa, Influenza virus
DTINYYNETFV

SEQ ID NO: 397258 - protein, 11 aa, Influenza virus
TINYYNETFVN

SEQ ID NO: 397259 - protein, 11 aa, Influenza virus
INYYNETFVNV

SEQ ID NO: 397260 - protein, 11 aa, Influenza virus
NYYNETFVNMT

SEQ ID NO: 397261 - protein, 11 aa, Influenza virus
YYNETFVNVTH

SEQ ID NO: 397262 - protein, 11 aa, Influenza virus
YNETFVNVTHV

SEQ ID NO: 397263 - protein, 11 aa, Influenza virus
NETFVNVTHVQ

SEQ ID NO: 397264 - protein, 11 aa, Influenza virus
ETFVNVTHVQN

SEQ ID NO: 397265 - protein, 11 aa, Influenza virus
TFVNVTHVQNN

SEQ ID NO: 397266 - protein, 11 aa, Influenza virus
FVNVTHVQNNY

SEQ ID NO: 397267 - protein, 11 aa, Influenza virus
VNVTHVQNNYT

SEQ ID NO: 397268 - protein, 11 aa, Influenza virus
NVTHVQNNYTT

SEQ ID NO: 397269 - protein, 11 aa, Influenza virus
LCPVKGWAPLS

SEQ ID NO: 397270 - protein, 11 aa, Influenza virus
CPVKGWAPLSK

SEQ ID NO: 397271 - protein, 11 aa, Influenza virus
PVKGWAPLSKD

SEQ ID NO: 397272 - protein, 11 aa, Influenza virus
VKGWAPLSKDN

SEQ ID NO: 397273 - protein, 11 aa, Influenza virus
KGWAPLSKDNG

SEQ ID NO: 397274 - protein, 11 aa, Influenza virus
RGEVSVIREPF

SEQ ID NO: 397275 - protein, 11 aa, Influenza virus
GEVFVIREPFV

SEQ ID NO: 397276 - protein, 11 aa, Influenza virus
EVFVIREPCIS

SEQ ID NO: 397277 - protein, 11 aa, Influenza virus
VFVIREPCISC

SEQ ID NO: 397278 - protein, 11 aa, Influenza virus
FVIREPFVSCS

SEQ ID NO: 397279 - protein, 11 aa, Influenza virus
VIREPFISCSV

SEQ ID NO: 397280 - protein, 11 aa, Influenza virus
ISCSINECRTF

SEQ ID NO: 397281 - protein, 11 aa, Influenza virus
SCSINECRTFF

SEQ ID NO: 397282 - protein, 11 aa, Influenza virus
CSINECRTFFL

SEQ ID NO: 397283 - protein, 11 aa, Influenza virus
SINECRTFFLT

SEQ ID NO: 397284 - protein, 11 aa, Influenza virus
INECRTFFLTQ

SEQ ID NO: 397285 - protein, 11 aa, Influenza virus
NECRTFFLTQG

SEQ ID NO: 397286 - protein, 11 aa, Influenza virus
SPFRTLMSCPM

SEQ ID NO: 397287 - protein, 11 aa, Influenza virus
PFRTLMSCPMG

SEQ ID NO: 397288 - protein, 11 aa, Influenza virus
FRTLMSCPMGV

SEQ ID NO: 397289 - protein, 11 aa, Influenza virus
RTLMSCPMGVA

SEQ ID NO: 397290 - protein, 11 aa, Influenza virus
TLMSCPMGVAP

SEQ ID NO: 397291 - protein, 11 aa, Influenza virus
LMSCPMGVAPS

SEQ ID NO: 397292 - protein, 11 aa, Influenza virus
MSCPMGVAPSP

SEQ ID NO: 397293 - protein, 11 aa, Influenza virus
SCPMGVAPSPS

SEQ ID NO: 397294 - protein, 11 aa, Influenza virus
CPMGVAPSPSN

SEQ ID NO: 397295 - protein, 11 aa, Influenza virus
PMGVAPSPSNS

SEQ ID NO: 397296 - protein, 11 aa, Influenza virus
MGVAPSPSNSR

SEQ ID NO: 397297 - protein, 11 aa, Influenza virus
AWSATACSDGS

SEQ ID NO: 397298 - protein, 11 aa, Influenza virus
WSATACSDGSG

SEQ ID NO: 397299 - protein, 11 aa, Influenza virus
SATACSDGSGW

SEQ ID NO: 397300 - protein, 11 aa, Influenza virus
ATACSDGSGWL

SEQ ID NO: 397301 - protein, 11 aa, Influenza virus
TACSDGSGWLT

SEQ ID NO: 397302 - protein, 11 aa, Influenza virus
ACSDGPGWLTI

SEQ ID NO: 397303 - protein, 11 aa, Influenza virus
CSDGPGWLTIG

SEQ ID NO: 397304 - protein, 11 aa, Influenza virus
SDGPGWLTIGI

SEQ ID NO: 397305 - protein, 11 aa, Influenza virus
DGPGWLTIGIT

SEQ ID NO: 397306 - protein, 11 aa, Influenza virus
GPGWLTIGITG

SEQ ID NO: 397307 - protein, 11 aa, Influenza virus
PGWLTIGITGP

SEQ ID NO: 397308 - protein, 11 aa, Influenza virus
GWLTIGITGPD

SEQ ID NO: 397309 - protein, 11 aa, Influenza virus
WLTLGITGPDS

SEQ ID NO: 397310 - protein, 11 aa, Influenza virus
LTLGITGPDST

SEQ ID NO: 397311 - protein, 11 aa, Influenza virus
TLGITGPDSTA

SEQ ID NO: 397312 - protein, 11 aa, Influenza virus
LGITGPDSTAV

SEQ ID NO: 397313 - protein, 11 aa, Influenza virus
GITGPDSTAVA

SEQ ID NO: 397314 - protein, 11 aa, Influenza virus
ITGPDSTAVAV

SEQ ID NO: 397315 - protein, 11 aa, Influenza virus
TGPDSTAVAVI

SEQ ID NO: 397316 - protein, 11 aa, Influenza virus
GPDSTAVAVIK

SEQ ID NO: 397317 - protein, 11 aa, Influenza virus
PDSTAVAVIKY

SEQ ID NO: 397318 - protein, 11 aa, Influenza virus
DSTAVAVIKYN

SEQ ID NO: 397319 - protein, 11 aa, Influenza virus
STAVAVIKYNG

SEQ ID NO: 397320 - protein, 11 aa, Influenza virus
TAVAVIKYNGI

SEQ ID NO: 397321 - protein, 11 aa, Influenza virus
AVAVIKYNGII

SEQ ID NO: 397322 - protein, 11 aa, Influenza virus
VAVIKYNGIIT

SEQ ID NO: 397323 - protein, 11 aa, Influenza virus
AVIKYNGIITD

SEQ ID NO: 397324 - protein, 11 aa, Influenza virus
VIKYNGIITDT

SEQ ID NO: 397325 - protein, 11 aa, Influenza virus
IKYNGIITDTL

SEQ ID NO: 397326 - protein, 11 aa, Influenza virus
KYNGVITDTLK

SEQ ID NO: 397327 - protein, 11 aa, Influenza virus
YNGVITDTLKS

SEQ ID NO: 397328 - protein, 11 aa, Influenza virus
NGVITDTLKSW

SEQ ID NO: 397329 - protein, 11 aa, Influenza virus
GVITDTLKSWK

SEQ ID NO: 397330 - protein, 11 aa, Influenza virus
VITDTLKSWKG

SEQ ID NO: 397331 - protein, 11 aa, Influenza virus
ITDTFKSWKGN

SEQ ID NO: 397332 - protein, 11 aa, Influenza virus
TDTFKSWKGNI

SEQ ID NO: 397333 - protein, 11 aa, Influenza virus
DTFKSWKGNIM

SEQ ID NO: 397334 - protein, 11 aa, Influenza virus
TFKSWKGNIMR

SEQ ID NO: 397335 - protein, 11 aa, Influenza virus
FKSWKGNIMRT

SEQ ID NO: 397336 - protein, 11 aa, Influenza virus
VCQDEFCYTLM

SEQ ID NO: 397337 - protein, 11 aa, Influenza virus
CQDEFCYTLMT

SEQ ID NO: 397338 - protein, 11 aa, Influenza virus
QDEFCYTLMTD

SEQ ID NO: 397339 - protein, 11 aa, Influenza virus
DEFCYTLMTDG

SEQ ID NO: 397340 - protein, 11 aa, Influenza virus
EFCYTLMTDGP

SEQ ID NO: 397341 - protein, 11 aa, Influenza virus
FCYTLMTDGPS

SEQ ID NO: 397342 - protein, 11 aa, Influenza virus
CYTLMTDGPSD

SEQ ID NO: 397343 - protein, 11 aa, Influenza virus
YTLMTDGPSDA

SEQ ID NO: 397344 - protein, 11 aa, Influenza virus
TLMTDGPSDAQ

SEQ ID NO: 397345 - protein, 11 aa, Influenza virus
LMTDGPSDAQA

SEQ ID NO: 397346 - protein, 11 aa, Influenza virus
MTDGPSDAQAF

SEQ ID NO: 397347 - protein, 11 aa, Influenza virus
TDGPSNAQAFY

SEQ ID NO: 397348 - protein, 11 aa, Influenza virus
DGPSNAQAFYK

SEQ ID NO: 397349 - protein, 11 aa, Influenza virus
GPSNAQAFYKI

SEQ ID NO: 397350 - protein, 11 aa, Influenza virus
PSNAQAFYKIL

SEQ ID NO: 397351 - protein, 11 aa, Influenza virus
SNAQAFYKILK

SEQ ID NO: 397352 - protein, 11 aa, Influenza virus
NAQAFYKILKI

SEQ ID NO: 397353 - protein, 11 aa, Influenza virus
AQAFYKILKIK

SEQ ID NO: 397354 - protein, 11 aa, Influenza virus
QAFYKILKIKK

SEQ ID NO: 397355 - protein, 11 aa, Influenza virus
AFYKILKIKKG

SEQ ID NO: 397356 - protein, 11 aa, Influenza virus
FYKILKIKKGK

SEQ ID NO: 397357 - protein, 11 aa, Influenza virus
YKILKIKKGKI

SEQ ID NO: 397358 - protein, 11 aa, Influenza virus
KILKIKKGKIV

SEQ ID NO: 397359 - protein, 11 aa, Influenza virus
ATGYHFEECSC

SEQ ID NO: 397360 - protein, 11 aa, Influenza virus
TGYHFEECSCY

SEQ ID NO: 397361 - protein, 11 aa, Influenza virus
GYHFEECSCYP

SEQ ID NO: 397362 - protein, 11 aa, Influenza virus
YHFEECSCYPS

SEQ ID NO: 397363 - protein, 11 aa, Influenza virus
HLEECSCYPSG

SEQ ID NO: 397364 - protein, 11 aa, Influenza virus
FEECSCYPSGE

SEQ ID NO: 397365 - protein, 11 aa, Influenza virus
EECSCYPSGEN

SEQ ID NO: 397366 - protein, 11 aa, Influenza virus
VECVCRDNWRG

SEQ ID NO: 397367 - protein, 11 aa, Influenza virus
DNWRGSNRPWV

SEQ ID NO: 397368 - protein, 11 aa, Influenza virus
NWQGSNRPWIR

SEQ ID NO: 397369 - protein, 11 aa, Influenza virus
WQGSNRPWIRF

SEQ ID NO: 397370 - protein, 11 aa, Influenza virus
QGSNRPWIRFN

SEQ ID NO: 397371 - protein, 11 aa, Influenza virus
SNRPWIRFNSN

SEQ ID NO: 397372 - protein, 11 aa, Influenza virus
NRPWIRFNSNL

SEQ ID NO: 397373 - protein, 11 aa, Influenza virus
RPWIRFNSNLD

SEQ ID NO: 397374 - protein, 11 aa, Influenza virus
PWIRFNSNLDY

SEQ ID NO: 397375 - protein, 11 aa, Influenza virus
WIRFNSNLDYQ

SEQ ID NO: 397376 - protein, 11 aa, Influenza virus
IRFNSNLDYQI

SEQ ID NO: 397377 - protein, 11 aa, Influenza virus
RFNSNLDYQIG

SEQ ID NO: 397378 - protein, 11 aa, Influenza virus
FNSNLDYQIGY

SEQ ID NO: 397379 - protein, 11 aa, Influenza virus
NSDLDYQIGYI

SEQ ID NO: 397380 - protein, 11 aa, Influenza virus
SDLDYQIGYIC

SEQ ID NO: 397381 - protein, 11 aa, Influenza virus
DLDYQIGYICS

SEQ ID NO: 397382 - protein, 11 aa, Influenza virus
LDYQIGYICSG

SEQ ID NO: 397383 - protein, 11 aa, Influenza virus
DYQIGYVCSGV

SEQ ID NO: 397384 - protein, 11 aa, Influenza virus
YQIGYVCSGVF

SEQ ID NO: 397385 - protein, 11 aa, Influenza virus
QIGYVCSGVFG

SEQ ID NO: 397386 - protein, 11 aa, Influenza virus
IGYVCSGVFGD

SEQ ID NO: 397387 - protein, 11 aa, Influenza virus
GYVCSGVFGDN

SEQ ID NO: 397388 - protein, 11 aa, Influenza virus
YVCSGVFGDNP

SEQ ID NO: 397389 - protein, 11 aa, Influenza virus
VCSGVFGDNPR

SEQ ID NO: 397390 - protein, 11 aa, Influenza virus
CSGVFGDNPRP

SEQ ID NO: 397391 - protein, 11 aa, Influenza virus
GPINNGKGRYG

SEQ ID NO: 397392 - protein, 11 aa, Influenza virus
PINNGKGRYGV

SEQ ID NO: 397393 - protein, 11 aa, Influenza virus
INNGKGRYGVK

SEQ ID NO: 397394 - protein, 11 aa, Influenza virus
GDGVWIGRTKN

SEQ ID NO: 397395 - protein, 11 aa, Influenza virus
EEVWIGRTKSL

SEQ ID NO: 397396 - protein, 11 aa, Influenza virus
EVWIGRTKSLE

SEQ ID NO: 397397 - protein, 11 aa, Influenza virus
IGRTKNLESRS

SEQ ID NO: 397398 - protein, 11 aa, Influenza virus
GRTKSLESRRG

SEQ ID NO: 397399 - protein, 11 aa, Influenza virus
RTKSLESRRGF

SEQ ID NO: 397400 - protein, 11 aa, Influenza virus
TKNLESRSGFE

SEQ ID NO: 397401 - protein, 11 aa, Influenza virus
KSLESRRGFEM

SEQ ID NO: 397402 - protein, 11 aa, Influenza virus
SLESRSGFEMI

SEQ ID NO: 397403 - protein, 11 aa, Influenza virus
LESRSGFEMIW

SEQ ID NO: 397404 - protein, 11 aa, Influenza virus
ESRSGFEMIWD

SEQ ID NO: 397405 - protein, 11 aa, Influenza virus
SRSGFEMIWDA

SEQ ID NO: 397406 - protein, 11 aa, Influenza virus
RSGFEMIWDAN

SEQ ID NO: 397407 - protein, 11 aa, Influenza virus
SGFEMIWDANG

SEQ ID NO: 397408 - protein, 11 aa, Influenza virus
GFEMIWDANGW

SEQ ID NO: 397409 - protein, 11 aa, Influenza virus
FEMIWDANGWV

SEQ ID NO: 397410 - protein, 11 aa, Influenza virus
EMIWDANGWVS

SEQ ID NO: 397411 - protein, 11 aa, Influenza virus
MIWDANGWVST

SEQ ID NO: 397412 - protein, 11 aa, Influenza virus
IWDANGWVSTD

SEQ ID NO: 397413 - protein, 11 aa, Influenza virus
WDANGWVTADK

SEQ ID NO: 397414 - protein, 11 aa, Influenza virus
DANGWVSTDKN

SEQ ID NO: 397415 - protein, 11 aa, Influenza virus
ANGWVSTDKNS

SEQ ID NO: 397416 - protein, 11 aa, Influenza virus
NGWVSTDKNSN

SEQ ID NO: 397417 - protein, 11 aa, Influenza virus
GWVSTDKNSNG

SEQ ID NO: 397418 - protein, 11 aa, Influenza virus
WVSTDKNSNGV

SEQ ID NO: 397419 - protein, 11 aa, Influenza virus
VSTDKNSNGVQ

SEQ ID NO: 397420 - protein, 11 aa, Influenza virus
STDKNSNGVQD

SEQ ID NO: 397421 - protein, 11 aa, Influenza virus
TDKNSNGVQDI

SEQ ID NO: 397422 - protein, 11 aa, Influenza virus
DKNSNGVQDII

SEQ ID NO: 397423 - protein, 11 aa, Influenza virus
KNSNGVQDIID

SEQ ID NO: 397424 - protein, 11 aa, Influenza virus
NSNGVQDIIDN

SEQ ID NO: 397425 - protein, 11 aa, Influenza virus
SNGVQDIIDNN

SEQ ID NO: 397426 - protein, 11 aa, Influenza virus
NGVQDIIDNNN

SEQ ID NO: 397427 - protein, 11 aa, Influenza virus
GVQDIIDNNNW

SEQ ID NO: 397428 - protein, 11 aa, Influenza virus
VQDIIDNNNWS

SEQ ID NO: 397429 - protein, 11 aa, Influenza virus
QDIIDNNNWSG

SEQ ID NO: 397430 - protein, 11 aa, Influenza virus
DIIDNNNWSGY

SEQ ID NO: 397431 - protein, 11 aa, Influenza virus
IIDNNNWSGYS

SEQ ID NO: 397432 - protein, 11 aa, Influenza virus
IDNNNWSGYSG

SEQ ID NO: 397433 - protein, 11 aa, Influenza virus
DNNNWSGYSGS

SEQ ID NO: 397434 - protein, 11 aa, Influenza virus
NNNWSGYSGSF

SEQ ID NO: 397435 - protein, 11 aa, Influenza virus
NNWSGYSGSFS

SEQ ID NO: 397436 - protein, 11 aa, Influenza virus
SGYSGSFSIRW

SEQ ID NO: 397437 - protein, 11 aa, Influenza virus
GYSGSFSIRWE

SEQ ID NO: 397438 - protein, 11 aa, Influenza virus
YSGSFSIRWET

SEQ ID NO: 397439 - protein, 11 aa, Influenza virus
SGSFSIRWETT

SEQ ID NO: 397440 - protein, 11 aa, Influenza virus
GSFSIRWETTG

SEQ ID NO: 397441 - protein, 11 aa, Influenza virus
SFSIRWETTGR

SEQ ID NO: 397442 - protein, 11 aa, Influenza virus
FSIRWETTGRN

SEQ ID NO: 397443 - protein, 11 aa, Influenza virus
SIRWETTGRNC

SEQ ID NO: 397444 - protein, 11 aa, Influenza virus
IRWETTGRNCT

SEQ ID NO: 397445 - protein, 11 aa, Influenza virus
RWETTGRNCTV

SEQ ID NO: 397446 - protein, 11 aa, Influenza virus
WETTGRNCTVP

SEQ ID NO: 397447 - protein, 11 aa, Influenza virus
ETTGRNCTIPC

SEQ ID NO: 397448 - protein, 11 aa, Influenza virus
TTGRNCTIPCF

SEQ ID NO: 397449 - protein, 11 aa, Influenza virus
TGRNCTIPCFW

SEQ ID NO: 397450 - protein, 11 aa, Influenza virus
GRNCTIPCFWV

SEQ ID NO: 397451 - protein, 11 aa, Influenza virus
RNCTIPCFWVE

SEQ ID NO: 397452 - protein, 11 aa, Influenza virus
NCTIPCFWVEM

SEQ ID NO: 397453 - protein, 11 aa, Influenza virus
CTIPCFWVEMI

SEQ ID NO: 397454 - protein, 11 aa, Influenza virus
TIPCFWVEMIR

SEQ ID NO: 397455 - protein, 11 aa, Influenza virus
IPCFWVEMIRG

SEQ ID NO: 397456 - protein, 11 aa, Influenza virus
LWVEMIRGQPK

SEQ ID NO: 397457 - protein, 11 aa, Influenza virus
VEMIRGQPNER

SEQ ID NO: 397458 - protein, 11 aa, Influenza virus
EMIRGQPKEKA

SEQ ID NO: 397459 - protein, 11 aa, Influenza virus
MIRGQPKEKAI

SEQ ID NO: 397460 - protein, 11 aa, Influenza virus
IRGQPKEKAIW

SEQ ID NO: 397461 - protein, 11 aa, Influenza virus
RGQPKEKAIWT

SEQ ID NO: 397462 - protein, 11 aa, Influenza virus
GQPKEKAIWTS

SEQ ID NO: 397463 - protein, 11 aa, Influenza virus
QPKEKAIWTSG

SEQ ID NO: 397464 - protein, 11 aa, Influenza virus
PKEKAIWTSGS

SEQ ID NO: 397465 - protein, 11 aa, Influenza virus
KEKAIWTSGSS

SEQ ID NO: 397466 - protein, 11 aa, Influenza virus
EKAIWTSGSSI

SEQ ID NO: 397467 - protein, 11 aa, Influenza virus
KAIWTSGSSIA

SEQ ID NO: 397468 - protein, 11 aa, Influenza virus
AIWTSGSSIAF

SEQ ID NO: 397469 - protein, 11 aa, Influenza virus
SGSSIAFCGVD

SEQ ID NO: 397470 - protein, 11 aa, Influenza virus
GSSIAFCGVDS

SEQ ID NO: 397471 - protein, 11 aa, Influenza virus
SSIAFCGVDSD

SEQ ID NO: 397472 - protein, 11 aa, Influenza virus
SIAFCGVDSDT

SEQ ID NO: 397473 - protein, 11 aa, Influenza virus
IAFCGVDSDTT

SEQ ID NO: 397474 - protein, 11 aa, Influenza virus
AFCGVDSDTTG

SEQ ID NO: 397475 - protein, 11 aa, Influenza virus
FCGVDSDTTGW

SEQ ID NO: 397476 - protein, 11 aa, Influenza virus
SDTTSWSWPDG

SEQ ID NO: 397477 - protein, 11 aa, Influenza virus
DTTSWSWPDGA

SEQ ID NO: 397478 - protein, 11 aa, Influenza virus
TTSWSWPDGAL

SEQ ID NO: 397479 - protein, 11 aa, Influenza virus
TSWSWPDGALL

SEQ ID NO: 397480 - protein, 11 aa, Influenza virus
SWSWPDGALLP

SEQ ID NO: 397481 - protein, 11 aa, Influenza virus
WSWPDGALLPL

SEQ ID NO: 397482 - protein, 11 aa, Influenza virus
SWPDGALLPLT

SEQ ID NO: 397483 - protein, 11 aa, Influenza virus
DGALLPFDIDR

SEQ ID NO: 397484 - protein, 11 aa, Influenza virus
PNQKIITIGSI

SEQ ID NO: 397485 - protein, 11 aa, Influenza virus
NQKIITIGSIS

SEQ ID NO: 397486 - protein, 11 aa, Influenza virus
QKIITIGSISL

SEQ ID NO: 397487 - protein, 11 aa, Influenza virus
KIITIGSISLG

SEQ ID NO: 397488 - protein, 11 aa, Influenza virus
IITIGSISLGL

SEQ ID NO: 397489 - protein, 11 aa, Influenza virus
FLNNTEPLCEV

SEQ ID NO: 397490 - protein, 11 aa, Influenza virus
LNNTEPLCEVS

SEQ ID NO: 397491 - protein, 11 aa, Influenza virus
NNTEPLCEVSG

SEQ ID NO: 397492 - protein, 11 aa, Influenza virus
NTEPLCEVSGF

SEQ ID NO: 397493 - protein, 11 aa, Influenza virus
TEPLCEVSGFA

SEQ ID NO: 397494 - protein, 11 aa, Influenza virus
EPLCEVSGFAI

SEQ ID NO: 397495 - protein, 11 aa, Influenza virus
SGFAIISKDNG

SEQ ID NO: 397496 - protein, 11 aa, Influenza virus
GFAIFSKDNGI

SEQ ID NO: 397497 - protein, 11 aa, Influenza virus
FAIISKDNGIR

SEQ ID NO: 397498 - protein, 11 aa, Influenza virus
IVSKDNGIRVG

SEQ ID NO: 397499 - protein, 11 aa, Influenza virus
VSKDNGIRVGS

SEQ ID NO: 397500 - protein, 11 aa, Influenza virus
SKDNGIRVGSR

SEQ ID NO: 397501 - protein, 11 aa, Influenza virus
KDNGIRVGSRG

SEQ ID NO: 397502 - protein, 11 aa, Influenza virus
DNGIRVGSRGH

SEQ ID NO: 397503 - protein, 11 aa, Influenza virus
NGIRIGSRGHI

SEQ ID NO: 397504 - protein, 11 aa, Influenza virus
GIRIGSRGHIF

SEQ ID NO: 397505 - protein, 11 aa, Influenza virus
IRIGSRGHIFV

SEQ ID NO: 397506 - protein, 11 aa, Influenza virus
RIGSRGHIFVI

SEQ ID NO: 397507 - protein, 11 aa, Influenza virus
IGSRGHIFVIR

SEQ ID NO: 397508 - protein, 11 aa, Influenza virus
GSRGHIFVIRE

SEQ ID NO: 397509 - protein, 11 aa, Influenza virus
SRGHIFVIREP

SEQ ID NO: 397510 - protein, 11 aa, Influenza virus
RGHIFVIREPF

SEQ ID NO: 397511 - protein, 11 aa, Influenza virus
GHIFVIREPFV

SEQ ID NO: 397512 - protein, 11 aa, Influenza virus
HVFVIREPFVS

SEQ ID NO: 397513 - protein, 11 aa, Influenza virus
VFVIREPFVSC

SEQ ID NO: 397514 - protein, 11 aa, Influenza virus
FVIREPFVSCG

SEQ ID NO: 397515 - protein, 11 aa, Influenza virus
VIREPFVSCGP

SEQ ID NO: 397516 - protein, 11 aa, Influenza virus
IREPFVACGPS

SEQ ID NO: 397517 - protein, 11 aa, Influenza virus
REPFVACGPSE

SEQ ID NO: 397518 - protein, 11 aa, Influenza virus
EPFVACGPSEC

SEQ ID NO: 397519 - protein, 11 aa, Influenza virus
PFVACGPSECR

SEQ ID NO: 397520 - protein, 11 aa, Influenza virus
FVACGPSECRT

SEQ ID NO: 397521 - protein, 11 aa, Influenza virus
VACGPSECRTF

SEQ ID NO: 397522 - protein, 11 aa, Influenza virus
ACGPSECRTFF

SEQ ID NO: 397523 - protein, 11 aa, Influenza virus
CGPSECRTFFL

SEQ ID NO: 397524 - protein, 11 aa, Influenza virus
GPSECRTFFLT

SEQ ID NO: 397525 - protein, 11 aa, Influenza virus
PSECRTFFLTQ

SEQ ID NO: 397526 - protein, 11 aa, Influenza virus
SECRTFFLTQG

SEQ ID NO: 397527 - protein, 11 aa, Influenza virus
FLTQGALLNDR

SEQ ID NO: 397528 - protein, 11 aa, Influenza virus
LTQGALLNDRH

SEQ ID NO: 397529 - protein, 11 aa, Influenza virus
TQGALLNDRHS

SEQ ID NO: 397530 - protein, 11 aa, Influenza virus
QGALLNDRHSN

SEQ ID NO: 397531 - protein, 11 aa, Influenza virus
CVLLNDKHSNN

SEQ ID NO: 397532 - protein, 11 aa, Influenza virus
VLLNDKHSNNT

SEQ ID NO: 397533 - protein, 11 aa, Influenza virus
LNDKHSNNTVR

SEQ ID NO: 397534 - protein, 11 aa, Influenza virus
NDRHSNNTVKD

SEQ ID NO: 397535 - protein, 11 aa, Influenza virus
DRHSNNTVKDR

SEQ ID NO: 397536 - protein, 11 aa, Influenza virus
RHSNNTVKDRS

SEQ ID NO: 397537 - protein, 11 aa, Influenza virus
SPYRALMSVPM

SEQ ID NO: 397538 - protein, 11 aa, Influenza virus
PYRALMSVPMG

SEQ ID NO: 397539 - protein, 11 aa, Influenza virus
YRALMSVLLGS

SEQ ID NO: 397540 - protein, 11 aa, Influenza virus
RALMSVLLGSS

SEQ ID NO: 397541 - protein, 11 aa, Influenza virus
ALMSVLLGSSP

SEQ ID NO: 397542 - protein, 11 aa, Influenza virus
LMSVLLGSSPN

SEQ ID NO: 397543 - protein, 11 aa, Influenza virus
MSVPMGSSPNA

SEQ ID NO: 397544 - protein, 11 aa, Influenza virus
SVPLGSSSNAY

SEQ ID NO: 397545 - protein, 11 aa, Influenza virus
VLLGSSPNAYQ

SEQ ID NO: 397546 - protein, 11 aa, Influenza virus
PMGSSPNAYQA

SEQ ID NO: 397547 - protein, 11 aa, Influenza virus
LGSSPNAYQAR

SEQ ID NO: 397548 - protein, 11 aa, Influenza virus
GSSPNAYQARF

SEQ ID NO: 397549 - protein, 11 aa, Influenza virus
SSPNAYQARFE

SEQ ID NO: 397550 - protein, 11 aa, Influenza virus
SPNAYQARFES

SEQ ID NO: 397551 - protein, 11 aa, Influenza virus
PNAYQARFESV

SEQ ID NO: 397552 - protein, 11 aa, Influenza virus
FESVGWSATAC

SEQ ID NO: 397553 - protein, 11 aa, Influenza virus
ESVGWSATACH

SEQ ID NO: 397554 - protein, 11 aa, Influenza virus
SVGWSATACHD

SEQ ID NO: 397555 - protein, 11 aa, Influenza virus
VGWSATACHDG

SEQ ID NO: 397556 - protein, 11 aa, Influenza virus
GWSATACHDGK

SEQ ID NO: 397557 - protein, 11 aa, Influenza virus
WSATACHDGKK

SEQ ID NO: 397558 - protein, 11 aa, Influenza virus
SATACHDGKKW

SEQ ID NO: 397559 - protein, 11 aa, Influenza virus
ATACHDGKKWL

SEQ ID NO: 397560 - protein, 11 aa, Influenza virus
GVSGADDDAYA

SEQ ID NO: 397561 - protein, 11 aa, Influenza virus
VSGADDDAYAV

SEQ ID NO: 397562 - protein, 11 aa, Influenza virus
SGADNDAYAVI

SEQ ID NO: 397563 - protein, 11 aa, Influenza virus
GADNDAYAVIH

SEQ ID NO: 397564 - protein, 11 aa, Influenza virus
ADNDAYAVIHY

SEQ ID NO: 397565 - protein, 11 aa, Influenza virus
DNDAYAVIHYG

SEQ ID NO: 397566 - protein, 11 aa, Influenza virus
NDAYAVIHYGG

SEQ ID NO: 397567 - protein, 11 aa, Influenza virus
DAYAVIHYGGV

SEQ ID NO: 397568 - protein, 11 aa, Influenza virus
AYAVIHYGGVP

SEQ ID NO: 397569 - protein, 11 aa, Influenza virus
YAVIHYGGVPT

SEQ ID NO: 397570 - protein, 11 aa, Influenza virus
AVIHYGGVPTD

SEQ ID NO: 397571 - protein, 11 aa, Influenza virus
VIHYGGVPTDV

SEQ ID NO: 397572 - protein, 11 aa, Influenza virus
IHYGGVPTDVV

SEQ ID NO: 397573 - protein, 11 aa, Influenza virus
HYGGVPTDVVR

SEQ ID NO: 397574 - protein, 11 aa, Influenza virus
YGGVPTDVVRS

SEQ ID NO: 397575 - protein, 11 aa, Influenza virus
GGVPTDVVRSW

SEQ ID NO: 397576 - protein, 11 aa, Influenza virus
PTDVVRSWKKQ

SEQ ID NO: 397577 - protein, 11 aa, Influenza virus
TDVVRSWKKQI

SEQ ID NO: 397578 - protein, 11 aa, Influenza virus
DVVRSWKKQIL

SEQ ID NO: 397579 - protein, 11 aa, Influenza virus
VVRSWKKQILR

SEQ ID NO: 397580 - protein, 11 aa, Influenza virus
VRSWKKQILRT

SEQ ID NO: 397581 - protein, 11 aa, Influenza virus
RSWKKQILRTQ

SEQ ID NO: 397582 - protein, 11 aa, Influenza virus
SWKKQILRTQE

SEQ ID NO: 397583 - protein, 11 aa, Influenza virus
WKKQILRTQES

SEQ ID NO: 397584 - protein, 11 aa, Influenza virus
KKQILRTQESS

SEQ ID NO: 397585 - protein, 11 aa, Influenza virus
KKILRTQESSC

SEQ ID NO: 397586 - protein, 11 aa, Influenza virus
KILRTQESSCV

SEQ ID NO: 397587 - protein, 11 aa, Influenza virus
LRTQESSCVCV

SEQ ID NO: 397588 - protein, 11 aa, Influenza virus
RTQESSCVCMN

SEQ ID NO: 397589 - protein, 11 aa, Influenza virus
TQESSCVCMNG

SEQ ID NO: 397590 - protein, 11 aa, Influenza virus
CYWVMTDGPAS

SEQ ID NO: 397591 - protein, 11 aa, Influenza virus
YWVMTDGPANS

SEQ ID NO: 397592 - protein, 11 aa, Influenza virus
WVMTDGPANSQ

SEQ ID NO: 397593 - protein, 11 aa, Influenza virus
VMTDGPANSQA

SEQ ID NO: 397594 - protein, 11 aa, Influenza virus
MTDGPANSQAS

SEQ ID NO: 397595 - protein, 11 aa, Influenza virus
TDGPANSQASY

SEQ ID NO: 397596 - protein, 11 aa, Influenza virus
DGPANSQASYK

SEQ ID NO: 397597 - protein, 11 aa, Influenza virus
GPANSQASYKI

SEQ ID NO: 397598 - protein, 11 aa, Influenza virus
PANSQASYKIF

SEQ ID NO: 397599 - protein, 11 aa, Influenza virus
ANSQASYKIFK

SEQ ID NO: 397600 - protein, 11 aa, Influenza virus
NSQASYKIFKS

SEQ ID NO: 397601 - protein, 11 aa, Influenza virus
EISFQGGHIEE

SEQ ID NO: 397602 - protein, 11 aa, Influenza virus
ISFQGGHIEEC

SEQ ID NO: 397603 - protein, 11 aa, Influenza virus
LFQGGHIEECS

SEQ ID NO: 397604 - protein, 11 aa, Influenza virus
FRGGHIEECSC

SEQ ID NO: 397605 - protein, 11 aa, Influenza virus
QSGHIEECSCY

SEQ ID NO: 397606 - protein, 11 aa, Influenza virus
HIEECSCYPNM

SEQ ID NO: 397607 - protein, 11 aa, Influenza virus
IEECSCYPNMG

SEQ ID NO: 397608 - protein, 11 aa, Influenza virus
EECSCYPNMGK

SEQ ID NO: 397609 - protein, 11 aa, Influenza virus
ECSCYPNMGKV

SEQ ID NO: 397610 - protein, 11 aa, Influenza virus
CSCYPNMGKVE

SEQ ID NO: 397611 - protein, 11 aa, Influenza virus
SCYPNMGKVEC

SEQ ID NO: 397612 - protein, 11 aa, Influenza virus
CYPNMGKVECV

SEQ ID NO: 397613 - protein, 11 aa, Influenza virus
YPNMGKVECVC

SEQ ID NO: 397614 - protein, 11 aa, Influenza virus
PNMGKVECVCR

SEQ ID NO: 397615 - protein, 11 aa, Influenza virus
NMGKVECVCRD

SEQ ID NO: 397616 - protein, 11 aa, Influenza virus
MGKVECVCRDN

SEQ ID NO: 397617 - protein, 11 aa, Influenza virus
GQVECVCRDNW

SEQ ID NO: 397618 - protein, 11 aa, Influenza virus
QVECVCRDNWN

SEQ ID NO: 397619 - protein, 11 aa, Influenza virus
RDNWNGMNRPV

SEQ ID NO: 397620 - protein, 11 aa, Influenza virus
DNWNGMNRPVL

SEQ ID NO: 397621 - protein, 11 aa, Influenza virus
YNVGYLCAGIP

SEQ ID NO: 397622 - protein, 11 aa, Influenza virus
NVGYLCAGIPT

SEQ ID NO: 397623 - protein, 11 aa, Influenza virus
CAGIPTDTPRI

SEQ ID NO: 397624 - protein, 11 aa, Influenza virus
AGIPTDTPRIQ

SEQ ID NO: 397625 - protein, 11 aa, Influenza virus
GIPTDTPRIQD

SEQ ID NO: 397626 - protein, 11 aa, Influenza virus
IPTDTPRVQDN

SEQ ID NO: 397627 - protein, 11 aa, Influenza virus
AIGGSGTNNYG

SEQ ID NO: 397628 - protein, 11 aa, Influenza virus
IGGSGTNNYGV

SEQ ID NO: 397629 - protein, 11 aa, Influenza virus
GGSGTDNYGVK

SEQ ID NO: 397630 - protein, 11 aa, Influenza virus
GSGTDNYGVKG

SEQ ID NO: 397631 - protein, 11 aa, Influenza virus
SGTDNYGVKGF

SEQ ID NO: 397632 - protein, 11 aa, Influenza virus
GTDNYGVKGFG

SEQ ID NO: 397633 - protein, 11 aa, Influenza virus
TDNYGVKGFGF

SEQ ID NO: 397634 - protein, 11 aa, Influenza virus
DNYGVKGFGFR

SEQ ID NO: 397635 - protein, 11 aa, Influenza virus
GVKGFGFRQGT

SEQ ID NO: 397636 - protein, 11 aa, Influenza virus
VKGFGFRQGTS

SEQ ID NO: 397637 - protein, 11 aa, Influenza virus
KGFGFRQGTSV

SEQ ID NO: 397638 - protein, 11 aa, Influenza virus
GFGFRQGTSVW

SEQ ID NO: 397639 - protein, 11 aa, Influenza virus
FGFRQGTSVWA

SEQ ID NO: 397640 - protein, 11 aa, Influenza virus
GFRQGTSVWAG

SEQ ID NO: 397641 - protein, 11 aa, Influenza virus
FRQGTSVWAGR

SEQ ID NO: 397642 - protein, 11 aa, Influenza virus
RQGTSVWAGRT

SEQ ID NO: 397643 - protein, 11 aa, Influenza virus
QGNSVWAGRTI

SEQ ID NO: 397644 - protein, 11 aa, Influenza virus
SSRSGFEVLLI

SEQ ID NO: 397645 - protein, 11 aa, Influenza virus
SRSGFEVLLIE

SEQ ID NO: 397646 - protein, 11 aa, Influenza virus
RSGFEVLLIED

SEQ ID NO: 397647 - protein, 11 aa, Influenza virus
SGFEVLLIEDG

SEQ ID NO: 397648 - protein, 11 aa, Influenza virus
GFEVLLIEDGW

SEQ ID NO: 397649 - protein, 11 aa, Influenza virus
EVLDNKNWSGY

SEQ ID NO: 397650 - protein, 11 aa, Influenza virus
VLNNMNWSGYS

SEQ ID NO: 397651 - protein, 11 aa, Influenza virus
LNNKHWSGYSG

SEQ ID NO: 397652 - protein, 11 aa, Influenza virus
NNKNWSGYSGS

SEQ ID NO: 397653 - protein, 11 aa, Influenza virus
NKNWSGYSGSF

SEQ ID NO: 397654 - protein, 11 aa, Influenza virus
KNWSGYSGSFT

SEQ ID NO: 397655 - protein, 11 aa, Influenza virus
NWSGYSGSFTI

SEQ ID NO: 397656 - protein, 11 aa, Influenza virus
WSGYSGSFTIP

SEQ ID NO: 397657 - protein, 11 aa, Influenza virus
SGYSGAFTIPT

SEQ ID NO: 397658 - protein, 11 aa, Influenza virus
CIVPCFWLEMI

SEQ ID NO: 397659 - protein, 11 aa, Influenza virus
IVPCFWLEMIR

SEQ ID NO: 397660 - protein, 11 aa, Influenza virus
PCFWLEMIRGR

SEQ ID NO: 397661 - protein, 11 aa, Influenza virus
CFWLEMIRGRP

SEQ ID NO: 397662 - protein, 11 aa, Influenza virus
FWLEMIRGRPE

SEQ ID NO: 397663 - protein, 11 aa, Influenza virus
WLEMIRGRPEE

SEQ ID NO: 397664 - protein, 11 aa, Influenza virus
LEMIRGKPEEG

SEQ ID NO: 397665 - protein, 11 aa, Influenza virus
PEEGTSIWTSS

SEQ ID NO: 397666 - protein, 11 aa, Influenza virus
EEGTSIWTSSS

SEQ ID NO: 397667 - protein, 11 aa, Influenza virus
EGTSIWTSSSS

SEQ ID NO: 397668 - protein, 11 aa, Influenza virus
GTSIWTSSSST

SEQ ID NO: 397669 - protein, 11 aa, Influenza virus
NSIWTSSSSTV

SEQ ID NO: 397670 - protein, 11 aa, Influenza virus
SSSTVFCGVSG

SEQ ID NO: 397671 - protein, 11 aa, Influenza virus
SSMVFCGVSGE

SEQ ID NO: 397672 - protein, 11 aa, Influenza virus
STVFCGVSGEV

SEQ ID NO: 397673 - protein, 11 aa, Influenza virus
TVFCGVSGEVP

SEQ ID NO: 397674 - protein, 11 aa, Influenza virus
VFCGVSGEVPG

SEQ ID NO: 397675 - protein, 11 aa, Influenza virus
FCGVSGEVPGW

SEQ ID NO: 397676 - protein, 11 aa, Influenza virus
CGVSGEVPGWS

SEQ ID NO: 397677 - protein, 11 aa, Influenza virus
GVSGEVPGWSW

SEQ ID NO: 397678 - protein, 11 aa, Influenza virus
VSGEVPGWSWD

SEQ ID NO: 397679 - protein, 11 aa, Influenza virus
SGEVPGWSWDD

SEQ ID NO: 397680 - protein, 11 aa, Influenza virus
GEVPGWSWDDG

SEQ ID NO: 397681 - protein, 11 aa, Influenza virus
EAPGWSWDDGA

SEQ ID NO: 397682 - protein, 11 aa, Influenza virus
APGWSWDDGAI

SEQ ID NO: 397683 - protein, 11 aa, Influenza virus
PGWSWGDGAIL

SEQ ID NO: 397684 - protein, 11 aa, Influenza virus
EWSWDDGAILP

SEQ ID NO: 397685 - protein, 11 aa, Influenza virus
WSWDDGAILPL

SEQ ID NO: 397686 - protein, 11 aa, Influenza virus
SWGDGAILPFD

SEQ ID NO: 397687 - protein, 11 aa, Influenza virus
WDDGAILPLTS

SEQ ID NO: 397688 - protein, 11 aa, Influenza virus
DDGAILPLTSI

SEQ ID NO: 397689 - protein, 11 aa, Influenza virus
DGAILPFGIDK

SEQ ID NO: 397690 - protein, 11 aa, Influenza virus
MNPNQKITCIS

SEQ ID NO: 397691 - protein, 11 aa, Influenza virus
NPNQKITCISA

SEQ ID NO: 397692 - protein, 11 aa, Influenza virus
PNQKITCISAT

SEQ ID NO: 397693 - protein, 11 aa, Influenza virus
CISATGVTLSV

SEQ ID NO: 397694 - protein, 11 aa, Influenza virus
KPLCEVSSWHI

SEQ ID NO: 397695 - protein, 11 aa, Influenza virus
PLCEVSSWHIL

SEQ ID NO: 397696 - protein, 11 aa, Influenza virus
LCEVSSWHILS

SEQ ID NO: 397697 - protein, 11 aa, Influenza virus
CEVSSWHILSK

SEQ ID NO: 397698 - protein, 11 aa, Influenza virus
EVSSWHILSKD

SEQ ID NO: 397699 - protein, 11 aa, Influenza virus
VSSWHILSKDN

SEQ ID NO: 397700 - protein, 11 aa, Influenza virus
SSWHILSKDNA

SEQ ID NO: 397701 - protein, 11 aa, Influenza virus
SWHIFSKDNAI

SEQ ID NO: 397702 - protein, 11 aa, Influenza virus
WHIFSKDNAIR

SEQ ID NO: 397703 - protein, 11 aa, Influenza virus
HIFSKDNAIRI

SEQ ID NO: 397704 - protein, 11 aa, Influenza virus
IFSKDNAIRIG

SEQ ID NO: 397705 - protein, 11 aa, Influenza virus
FSKDNAIRIGE

SEQ ID NO: 397706 - protein, 11 aa, Influenza virus
SKDNAIRIGEN

SEQ ID NO: 397707 - protein, 11 aa, Influenza virus
KDNAIRIGENA

SEQ ID NO: 397708 - protein, 11 aa, Influenza virus
DNAIRIGENAH

SEQ ID NO: 397709 - protein, 11 aa, Influenza virus
NAHILVTREPY

SEQ ID NO: 397710 - protein, 11 aa, Influenza virus
AHVLVTREPYL

SEQ ID NO: 397711 - protein, 11 aa, Influenza virus
HVLVTREPYLS

SEQ ID NO: 397712 - protein, 11 aa, Influenza virus
VLVTREPYLSC

SEQ ID NO: 397713 - protein, 11 aa, Influenza virus
LVTREPYLSCD

SEQ ID NO: 397714 - protein, 11 aa, Influenza virus
VTREPYLSCDP

SEQ ID NO: 397715 - protein, 11 aa, Influenza virus
GCRMFALSQGT

SEQ ID NO: 397716 - protein, 11 aa, Influenza virus
MFALSQGTTLK

SEQ ID NO: 397717 - protein, 11 aa, Influenza virus
FALSQGTTLKG

SEQ ID NO: 397718 - protein, 11 aa, Influenza virus
ALSQGTTLRGQ

SEQ ID NO: 397719 - protein, 11 aa, Influenza virus
LSQGTTLRGQH

SEQ ID NO: 397720 - protein, 11 aa, Influenza virus
SQGTTLRGQHA

SEQ ID NO: 397721 - protein, 11 aa, Influenza virus
QGTTLRGQHAN

SEQ ID NO: 397722 - protein, 11 aa, Influenza virus
GTTLRGQHANG

SEQ ID NO: 397723 - protein, 11 aa, Influenza virus
TTLRGQHANGT

SEQ ID NO: 397724 - protein, 11 aa, Influenza virus
TLRGQHANGTI

SEQ ID NO: 397725 - protein, 11 aa, Influenza virus
LRGQHANGTIH

SEQ ID NO: 397726 - protein, 11 aa, Influenza virus
RGQHANGTIHD

SEQ ID NO: 397727 - protein, 11 aa, Influenza virus
GQHANGTIHDR

SEQ ID NO: 397728 - protein, 11 aa, Influenza virus
QHANGTIHDRS

SEQ ID NO: 397729 - protein, 11 aa, Influenza virus
HANGTIHDRSQ

SEQ ID NO: 397730 - protein, 11 aa, Influenza virus
ANGTIHDRSQF

SEQ ID NO: 397731 - protein, 11 aa, Influenza virus
NGTIHDRSQFR

SEQ ID NO: 397732 - protein, 11 aa, Influenza virus
GTIHDRSQFRA

SEQ ID NO: 397733 - protein, 11 aa, Influenza virus
TIHDRSQFRAL

SEQ ID NO: 397734 - protein, 11 aa, Influenza virus
HDRSPFRALVS

SEQ ID NO: 397735 - protein, 11 aa, Influenza virus
DRSPFRALVSW

SEQ ID NO: 397736 - protein, 11 aa, Influenza virus
RSPFRALVSWE

SEQ ID NO: 397737 - protein, 11 aa, Influenza virus
SPFRALVSWEM

SEQ ID NO: 397738 - protein, 11 aa, Influenza virus
PFRALVSWEMG

SEQ ID NO: 397739 - protein, 11 aa, Influenza virus
FRALVSWEMGQ

SEQ ID NO: 397740 - protein, 11 aa, Influenza virus
RALVSWEMGQA

SEQ ID NO: 397741 - protein, 11 aa, Influenza virus
ALVSWEMGQAP

SEQ ID NO: 397742 - protein, 11 aa, Influenza virus
LVSWEMGQAPS

SEQ ID NO: 397743 - protein, 11 aa, Influenza virus
VSWEMGQAPSP

SEQ ID NO: 397744 - protein, 11 aa, Influenza virus
SWGMGQAPSPY

SEQ ID NO: 397745 - protein, 11 aa, Influenza virus
WGMGQAPSPYN

SEQ ID NO: 397746 - protein, 11 aa, Influenza virus
VECIGWSSTSC

SEQ ID NO: 397747 - protein, 11 aa, Influenza virus
ECIGWSSTSCH

SEQ ID NO: 397748 - protein, 11 aa, Influenza virus
CIGWSSTSCHD

SEQ ID NO: 397749 - protein, 11 aa, Influenza virus
IGWSSTSCHDG

SEQ ID NO: 397750 - protein, 11 aa, Influenza virus
GWSSTSCHDGM

SEQ ID NO: 397751 - protein, 11 aa, Influenza virus
SSTSCHDGMSR

SEQ ID NO: 397752 - protein, 11 aa, Influenza virus
STSCHDGMSRM

SEQ ID NO: 397753 - protein, 11 aa, Influenza virus
TSCHDGMSRMS

SEQ ID NO: 397754 - protein, 11 aa, Influenza virus
SRMSICISGPN

SEQ ID NO: 397755 - protein, 11 aa, Influenza virus
RMSICISGPNN

SEQ ID NO: 397756 - protein, 11 aa, Influenza virus
MSICISGPNNN

SEQ ID NO: 397757 - protein, 11 aa, Influenza virus
SICISGPNNNA

SEQ ID NO: 397758 - protein, 11 aa, Influenza virus
ICISGPNNNAS

SEQ ID NO: 397759 - protein, 11 aa, Influenza virus
CISGPNNNASA

SEQ ID NO: 397760 - protein, 11 aa, Influenza virus
ISGPNNNASAV

SEQ ID NO: 397761 - protein, 11 aa, Influenza virus
SGPNDNASAVV

SEQ ID NO: 397762 - protein, 11 aa, Influenza virus
GPNDNASAVVW

SEQ ID NO: 397763 - protein, 11 aa, Influenza virus
PNDNASAVVWY

SEQ ID NO: 397764 - protein, 11 aa, Influenza virus
TEIPSWAGNIL

SEQ ID NO: 397765 - protein, 11 aa, Influenza virus
EIPSWAGNILR

SEQ ID NO: 397766 - protein, 11 aa, Influenza virus
IPSWAGNILRT

SEQ ID NO: 397767 - protein, 11 aa, Influenza virus
PSWAGNILRTQ

SEQ ID NO: 397768 - protein, 11 aa, Influenza virus
SWEGNILRTQE

SEQ ID NO: 397769 - protein, 11 aa, Influenza virus
WEGNILRTQES

SEQ ID NO: 397770 - protein, 11 aa, Influenza virus
EGNILRTQESE

SEQ ID NO: 397771 - protein, 11 aa, Influenza virus
RTQESECVCHK

SEQ ID NO: 397772 - protein, 11 aa, Influenza virus
TQESECVCHKG

SEQ ID NO: 397773 - protein, 11 aa, Influenza virus
QESECVCHKGI

SEQ ID NO: 397774 - protein, 11 aa, Influenza virus
ESECVCHKGIC

SEQ ID NO: 397775 - protein, 11 aa, Influenza virus
SECVCHKGICP

SEQ ID NO: 397776 - protein, 11 aa, Influenza virus
ECVCHKGICPV

SEQ ID NO: 397777 - protein, 11 aa, Influenza virus
CVCHKGICPVV

SEQ ID NO: 397778 - protein, 11 aa, Influenza virus
GVCPVVMTDGP

SEQ ID NO: 397779 - protein, 11 aa, Influenza virus
VCPVVMTDGPA

SEQ ID NO: 397780 - protein, 11 aa, Influenza virus
CPVVMTDGPAS

SEQ ID NO: 397781 - protein, 11 aa, Influenza virus
GNAQHIEECSC

SEQ ID NO: 397782 - protein, 11 aa, Influenza virus
NAQHIEECSCY

SEQ ID NO: 397783 - protein, 11 aa, Influenza virus
QHIEECSCYGS

SEQ ID NO: 397784 - protein, 11 aa, Influenza virus
VKCICRDNWKG

SEQ ID NO: 397785 - protein, 11 aa, Influenza virus
KCVCRDNWKGA

SEQ ID NO: 397786 - protein, 11 aa, Influenza virus
CVCRDNWKGAN

SEQ ID NO: 397787 - protein, 11 aa, Influenza virus
VCRDNWKGANR

SEQ ID NO: 397788 - protein, 11 aa, Influenza virus
CRDNWRGANRP

SEQ ID NO: 397789 - protein, 11 aa, Influenza virus
RDNWKGANRPI

SEQ ID NO: 397790 - protein, 11 aa, Influenza virus
DNWKGANRPII

SEQ ID NO: 397791 - protein, 11 aa, Influenza virus
NWKGANRPVII

SEQ ID NO: 397792 - protein, 11 aa, Influenza virus
WKGANRPIITI

SEQ ID NO: 397793 - protein, 11 aa, Influenza virus
YLCSKVLTDTS

SEQ ID NO: 397794 - protein, 11 aa, Influenza virus
LCSKVLTDTSR

SEQ ID NO: 397795 - protein, 11 aa, Influenza virus
CSKVLTDTSRP

SEQ ID NO: 397796 - protein, 11 aa, Influenza virus
GGGPDPGVKGF

SEQ ID NO: 397797 - protein, 11 aa, Influenza virus
GGPDPGVKGFA

SEQ ID NO: 397798 - protein, 11 aa, Influenza virus
GPDPGVKGFAF

SEQ ID NO: 397799 - protein, 11 aa, Influenza virus
DPGVKGFAFLN

SEQ ID NO: 397800 - protein, 11 aa, Influenza virus
PGVKGFAFLNG

SEQ ID NO: 397801 - protein, 11 aa, Influenza virus
NSWLGRTTSKD

SEQ ID NO: 397802 - protein, 11 aa, Influenza virus
SWLGRTTSKDS

SEQ ID NO: 397803 - protein, 11 aa, Influenza virus
WLGRTTSKDSR

SEQ ID NO: 397804 - protein, 11 aa, Influenza virus
LGRTTSKDSRS

SEQ ID NO: 397805 - protein, 11 aa, Influenza virus
GRTTSKDSRSG

SEQ ID NO: 397806 - protein, 11 aa, Influenza virus
RTTSKDSRSGY

SEQ ID NO: 397807 - protein, 11 aa, Influenza virus
TTSKDSRSGYE

SEQ ID NO: 397808 - protein, 11 aa, Influenza virus
DSRSGYEVLKV

SEQ ID NO: 397809 - protein, 11 aa, Influenza virus
SRSGYEVLKVP

SEQ ID NO: 397810 - protein, 11 aa, Influenza virus
RSGYEVLKVPN

SEQ ID NO: 397811 - protein, 11 aa, Influenza virus
SGYEVLKVPNA

SEQ ID NO: 397812 - protein, 11 aa, Influenza virus
GYEVLKVPNAE

SEQ ID NO: 397813 - protein, 11 aa, Influenza virus
IVNNQDWSGYS

SEQ ID NO: 397814 - protein, 11 aa, Influenza virus
VNNQDWSGYSG

SEQ ID NO: 397815 - protein, 11 aa, Influenza virus
NNQNWSGYSGS

SEQ ID NO: 397816 - protein, 11 aa, Influenza virus
NQNWSGYSGSF

SEQ ID NO: 397817 - protein, 11 aa, Influenza virus
WSGYSGSFIDY

SEQ ID NO: 397818 - protein, 11 aa, Influenza virus
SGYSGSFIDYW

SEQ ID NO: 397819 - protein, 11 aa, Influenza virus
KECFNPCFYVE

SEQ ID NO: 397820 - protein, 11 aa, Influenza virus
KCFNPCFYVEL

SEQ ID NO: 397821 - protein, 11 aa, Influenza virus
PCFYVELIRGM

SEQ ID NO: 397822 - protein, 11 aa, Influenza virus
CFYVELIRGMP

SEQ ID NO: 397823 - protein, 11 aa, Influenza virus
FYVELIRGMPK

SEQ ID NO: 397824 - protein, 11 aa, Influenza virus
YVELIRGMPKE

SEQ ID NO: 397825 - protein, 11 aa, Influenza virus
VFWTSNSIVAL

SEQ ID NO: 397826 - protein, 11 aa, Influenza virus
FWTSNSIVALC

SEQ ID NO: 397827 - protein, 11 aa, Influenza virus
SNSIVALCGSR

SEQ ID NO: 397828 - protein, 11 aa, Influenza virus
NSIVALCGSRE

SEQ ID NO: 397829 - protein, 11 aa, Influenza virus
SIVALCGSRER

SEQ ID NO: 397830 - protein, 11 aa, Influenza virus
IVALCGSRERL

SEQ ID NO: 397831 - protein, 11 aa, Influenza virus
VALCGSRERLG

SEQ ID NO: 397832 - protein, 11 aa, Influenza virus
ALCGSRERLGS

SEQ ID NO: 397833 - protein, 11 aa, Influenza virus
LCGSRERLGSW

SEQ ID NO: 397834 - protein, 11 aa, Influenza virus
CGSRERLGSWS

SEQ ID NO: 397835 - protein, 11 aa, Influenza virus
GSRERLGSWSW

SEQ ID NO: 397836 - protein, 11 aa, Influenza virus
SRERLGSWSWH

SEQ ID NO: 397837 - protein, 11 aa, Influenza virus
RERLGSWSWHD

SEQ ID NO: 397838 - protein, 11 aa, Influenza virus
EQLGSWSWHDG

SEQ ID NO: 397839 - protein, 11 aa, Influenza virus
QLGSWSWHDGA

SEQ ID NO: 397840 - protein, 11 aa, Influenza virus
SWSWHDGAEIT

SEQ ID NO: 397841 - protein, 11 aa, Influenza virus
WSWHDGAEITY

SEQ ID NO: 397842 - protein, 11 aa, Influenza virus
SWHDGAEITYF

SEQ ID NO: 397843 - protein, 11 aa, Influenza virus
WHDGAEITYFK

SEQ ID NO: 397844 - protein, 11 aa, Influenza virus
MNPNQKLFASS

SEQ ID NO: 397845 - protein, 11 aa, Influenza virus
NPNQKLFASSG

SEQ ID NO: 397846 - protein, 11 aa, Influenza virus
PNQKLFASSGI

SEQ ID NO: 397847 - protein, 11 aa, Influenza virus
NQKLFASSGIA

SEQ ID NO: 397848 - protein, 11 aa, Influenza virus
QKLFASSGIAI

SEQ ID NO: 397849 - protein, 11 aa, Influenza virus
NLIIGISNVGL

SEQ ID NO: 397850 - protein, 11 aa, Influenza virus
LIIGISNVGLN

SEQ ID NO: 397851 - protein, 11 aa, Influenza virus
SNMSLNISLYS

SEQ ID NO: 397852 - protein, 11 aa, Influenza virus
ENTYVNNTTII

SEQ ID NO: 397853 - protein, 11 aa, Influenza virus
YLLLNKSLCNV

SEQ ID NO: 397854 - protein, 11 aa, Influenza virus
WVVIAKDNAVR

SEQ ID NO: 397855 - protein, 11 aa, Influenza virus
VVIAKDNAVRF

SEQ ID NO: 397856 - protein, 11 aa, Influenza virus
VIAKDNAVRFG

SEQ ID NO: 397857 - protein, 11 aa, Influenza virus
IAKDNAVRFGE

SEQ ID NO: 397858 - protein, 11 aa, Influenza virus
AKDNAVRFGES

SEQ ID NO: 397859 - protein, 11 aa, Influenza virus
KDNAVRFGESE

SEQ ID NO: 397860 - protein, 11 aa, Influenza virus
DNAVRFGESEQ

SEQ ID NO: 397861 - protein, 11 aa, Influenza virus
NAVRFGESEQI

SEQ ID NO: 397862 - protein, 11 aa, Influenza virus
AVRFGESEQII

SEQ ID NO: 397863 - protein, 11 aa, Influenza virus
VRFGESEQIIV

SEQ ID NO: 397864 - protein, 11 aa, Influenza virus
RFGESEQVIVT

SEQ ID NO: 397865 - protein, 11 aa, Influenza virus
FGESEQVIVTR

SEQ ID NO: 397866 - protein, 11 aa, Influenza virus
GESEQVIVTRE

SEQ ID NO: 397867 - protein, 11 aa, Influenza virus
ESEQVIVTREP

SEQ ID NO: 397868 - protein, 11 aa, Influenza virus
SEQVIVTREPY

SEQ ID NO: 397869 - protein, 11 aa, Influenza virus
EQVIVTREPYV

SEQ ID NO: 397870 - protein, 11 aa, Influenza virus
QVIVTREPYVS

SEQ ID NO: 397871 - protein, 11 aa, Influenza virus
VIVTREPYVSC

SEQ ID NO: 397872 - protein, 11 aa, Influenza virus
TREPYVSCDPT

SEQ ID NO: 397873 - protein, 11 aa, Influenza virus
GCRMYALHQGT

SEQ ID NO: 397874 - protein, 11 aa, Influenza virus
CRMYALHQGTT

SEQ ID NO: 397875 - protein, 11 aa, Influenza virus
RMYALHQGTTI

SEQ ID NO: 397876 - protein, 11 aa, Influenza virus
ALHQGTTIRNR

SEQ ID NO: 397877 - protein, 11 aa, Influenza virus
LHQGTTIRNRH

SEQ ID NO: 397878 - protein, 11 aa, Influenza virus
HQGTTIRNRHS

SEQ ID NO: 397879 - protein, 11 aa, Influenza virus
QGTTIRNRHSN

SEQ ID NO: 397880 - protein, 11 aa, Influenza virus
GTTIRNKHSNS

SEQ ID NO: 397881 - protein, 11 aa, Influenza virus
TTIRNKHSNST

SEQ ID NO: 397882 - protein, 11 aa, Influenza virus
TIRNKHSNSTT

SEQ ID NO: 397883 - protein, 11 aa, Influenza virus
IRNKHSNSTTH

SEQ ID NO: 397884 - protein, 11 aa, Influenza virus
RNKHSNSTTHD

SEQ ID NO: 397885 - protein, 11 aa, Influenza virus
NKHSNSTTHDR

SEQ ID NO: 397886 - protein, 11 aa, Influenza virus
TTHDRTAFRGL

SEQ ID NO: 397887 - protein, 11 aa, Influenza virus
DRTAFRGLMST

SEQ ID NO: 397888 - protein, 11 aa, Influenza virus
AFRGLMSTPLG

SEQ ID NO: 397889 - protein, 11 aa, Influenza virus
SNSDFMCVGWS

SEQ ID NO: 397890 - protein, 11 aa, Influenza virus
NSDFMCVGWSS

SEQ ID NO: 397891 - protein, 11 aa, Influenza virus
SDFMCVGWSST

SEQ ID NO: 397892 - protein, 11 aa, Influenza virus
FMCVGWSSTTC

SEQ ID NO: 397893 - protein, 11 aa, Influenza virus
MCVGWSSTTCH

SEQ ID NO: 397894 - protein, 11 aa, Influenza virus
CVGWSSTTCHD

SEQ ID NO: 397895 - protein, 11 aa, Influenza virus
VGWSSTTCHDG

SEQ ID NO: 397896 - protein, 11 aa, Influenza virus
GWSSTTCHDGI

SEQ ID NO: 397897 - protein, 11 aa, Influenza virus
CHDGVGRMTIC

SEQ ID NO: 397898 - protein, 11 aa, Influenza virus
QGNNNNATATV

SEQ ID NO: 397899 - protein, 11 aa, Influenza virus
GNNNNATATVY

SEQ ID NO: 397900 - protein, 11 aa, Influenza virus
NNNNATATVYY

SEQ ID NO: 397901 - protein, 11 aa, Influenza virus
NDNATATVYYN

SEQ ID NO: 397902 - protein, 11 aa, Influenza virus
NATATVYYNRR

SEQ ID NO: 397903 - protein, 11 aa, Influenza virus
ATATVYYNRRL

SEQ ID NO: 397904 - protein, 11 aa, Influenza virus
TATVYYNRRLT

SEQ ID NO: 397905 - protein, 11 aa, Influenza virus
ATVYYNRRLTT

SEQ ID NO: 397906 - protein, 11 aa, Influenza virus
TVYYNRRLTTT

SEQ ID NO: 397907 - protein, 11 aa, Influenza virus
VYYNRRLTTTI

SEQ ID NO: 397908 - protein, 11 aa, Influenza virus
KRLTTTIKTWA

SEQ ID NO: 397909 - protein, 11 aa, Influenza virus
RLTTTIKTWAR

SEQ ID NO: 397910 - protein, 11 aa, Influenza virus
TTTIKTWARNI

SEQ ID NO: 397911 - protein, 11 aa, Influenza virus
TTIKTWARNIL

SEQ ID NO: 397912 - protein, 11 aa, Influenza virus
TIKTWARNILR

SEQ ID NO: 397913 - protein, 11 aa, Influenza virus
IKTWARNILRT

SEQ ID NO: 397914 - protein, 11 aa, Influenza virus
KTWARNILRTQ

SEQ ID NO: 397915 - protein, 11 aa, Influenza virus
TWARNILRTQE

SEQ ID NO: 397916 - protein, 11 aa, Influenza virus
WARNILRTQES

SEQ ID NO: 397917 - protein, 11 aa, Influenza virus
ARNILRTQESE

SEQ ID NO: 397918 - protein, 11 aa, Influenza virus
RNILRTQESEC

SEQ ID NO: 397919 - protein, 11 aa, Influenza virus
KILRTQESECV

SEQ ID NO: 397920 - protein, 11 aa, Influenza virus
RTQDSECVSHN

SEQ ID NO: 397921 - protein, 11 aa, Influenza virus
TQESECVCHNS

SEQ ID NO: 397922 - protein, 11 aa, Influenza virus
QESECVCHNST

SEQ ID NO: 397923 - protein, 11 aa, Influenza virus
ESECVCHNSTC

SEQ ID NO: 397924 - protein, 11 aa, Influenza virus
SECVCHNGTCA

SEQ ID NO: 397925 - protein, 11 aa, Influenza virus
LKGSAKHIEEC

SEQ ID NO: 397926 - protein, 11 aa, Influenza virus
GSAKHIEECSC

SEQ ID NO: 397927 - protein, 11 aa, Influenza virus
SAKHIEECSCY

SEQ ID NO: 397928 - protein, 11 aa, Influenza virus
AKHIEECSCYG

SEQ ID NO: 397929 - protein, 11 aa, Influenza virus
KHIEECSCYGH

SEQ ID NO: 397930 - protein, 11 aa, Influenza virus
HIEECSCYGHS

SEQ ID NO: 397931 - protein, 11 aa, Influenza virus
ATCVCRDNWQG

SEQ ID NO: 397932 - protein, 11 aa, Influenza virus
SCVCRDNWQGA

SEQ ID NO: 397933 - protein, 11 aa, Influenza virus
CICRDNWQGAN

SEQ ID NO: 397934 - protein, 11 aa, Influenza virus
VCRDNWRGANR

SEQ ID NO: 397935 - protein, 11 aa, Influenza virus
RDNWQGANRPI

SEQ ID NO: 397936 - protein, 11 aa, Influenza virus
DNWQGANRPII

SEQ ID NO: 397937 - protein, 11 aa, Influenza virus
NWQGANRPIIE

SEQ ID NO: 397938 - protein, 11 aa, Influenza virus
WQGANRPIIEI

SEQ ID NO: 397939 - protein, 11 aa, Influenza virus
QGANRPIIEID

SEQ ID NO: 397940 - protein, 11 aa, Influenza virus
GANRPIIEIDM

SEQ ID NO: 397941 - protein, 11 aa, Influenza virus
CTGILTDTSRP

SEQ ID NO: 397942 - protein, 11 aa, Influenza virus
TGILTDTSRPG

SEQ ID NO: 397943 - protein, 11 aa, Influenza virus
GILTDTSRPGD

SEQ ID NO: 397944 - protein, 11 aa, Influenza virus
GDCSNPITGSP

SEQ ID NO: 397945 - protein, 11 aa, Influenza virus
DCSNPITGSPG

SEQ ID NO: 397946 - protein, 11 aa, Influenza virus
NPITGSPSAPG

SEQ ID NO: 397947 - protein, 11 aa, Influenza virus
APGVKGFGFLN

SEQ ID NO: 397948 - protein, 11 aa, Influenza virus
NTWLGRTISPK

SEQ ID NO: 397949 - protein, 11 aa, Influenza virus
TWLGRTISPKL

SEQ ID NO: 397950 - protein, 11 aa, Influenza virus
WLGRTISPRLR

SEQ ID NO: 397951 - protein, 11 aa, Influenza virus
TISPRLRSGFE

SEQ ID NO: 397952 - protein, 11 aa, Influenza virus
SPRLRSGFEML

SEQ ID NO: 397953 - protein, 11 aa, Influenza virus
LRSGFEMLKIP

SEQ ID NO: 397954 - protein, 11 aa, Influenza virus
RSGFEMLKVPN

SEQ ID NO: 397955 - protein, 11 aa, Influenza virus
SGFEMLKVPNA

SEQ ID NO: 397956 - protein, 11 aa, Influenza virus
GFEMLKIPNAE

SEQ ID NO: 397957 - protein, 11 aa, Influenza virus
NLSGYSGSFID

SEQ ID NO: 397958 - protein, 11 aa, Influenza virus
GYSGSFIDYWN

SEQ ID NO: 397959 - protein, 11 aa, Influenza virus
YSGSFIDYWND

SEQ ID NO: 397960 - protein, 11 aa, Influenza virus
NECYNPCFYVE

SEQ ID NO: 397961 - protein, 11 aa, Influenza virus
VCYNPCFYVEL

SEQ ID NO: 397962 - protein, 11 aa, Influenza virus
LIRGRPEEVKY

SEQ ID NO: 397963 - protein, 11 aa, Influenza virus
IRGRPEEVKYV

SEQ ID NO: 397964 - protein, 11 aa, Influenza virus
RGRPEEAKYVE

SEQ ID NO: 397965 - protein, 11 aa, Influenza virus
GRPEEAKYVEW

SEQ ID NO: 397966 - protein, 11 aa, Influenza virus
RPEEAKYVEWT

SEQ ID NO: 397967 - protein, 11 aa, Influenza virus
PEEAKYVEWTS

SEQ ID NO: 397968 - protein, 11 aa, Influenza virus
EEAKYVEWTSN

SEQ ID NO: 397969 - protein, 11 aa, Influenza virus
EAKYVEWTSNS

SEQ ID NO: 397970 - protein, 11 aa, Influenza virus
AKYVEWTSNSL

SEQ ID NO: 397971 - protein, 11 aa, Influenza virus
KYVWWTSNSLI

SEQ ID NO: 397972 - protein, 11 aa, Influenza virus
YVWWTSNSLIA

SEQ ID NO: 397973 - protein, 11 aa, Influenza virus
VWWTSNSLIAL

SEQ ID NO: 397974 - protein, 11 aa, Influenza virus
WWTSNSLIALC

SEQ ID NO: 397975 - protein, 11 aa, Influenza virus
WTSNSLIALCG

SEQ ID NO: 397976 - protein, 11 aa, Influenza virus
TSNSLIALCGS

SEQ ID NO: 397977 - protein, 11 aa, Influenza virus
SNSLIALCGSP

SEQ ID NO: 397978 - protein, 11 aa, Influenza virus
NSLVALCGSPV

SEQ ID NO: 397979 - protein, 11 aa, Influenza virus
PVGSGSFPDGA

SEQ ID NO: 397980 - protein, 11 aa, Influenza virus
VGPGSFPDGAQ

SEQ ID NO: 397981 - protein, 11 aa, Influenza virus
GPGSFPDGAQI

SEQ ID NO: 397982 - protein, 11 aa, Influenza virus
GSFPDGAQIKY

SEQ ID NO: 397983 - protein, 11 aa, Influenza virus
SFPDGAQIKYF

SEQ ID NO: 397984 - protein, 11 aa, Influenza virus
FPDGAQIKYFS

SEQ ID NO: 397985 - protein, 11 aa, Influenza virus
QGFAPFSKDNG

SEQ ID NO: 397986 - protein, 11 aa, Influenza virus
GLAPFSKDNGI

SEQ ID NO: 397987 - protein, 11 aa, Influenza virus
FAPFSKDNGVR

SEQ ID NO: 397988 - protein, 11 aa, Influenza virus
SKDNGIRIGSK

SEQ ID NO: 397989 - protein, 11 aa, Influenza virus
KDNGIRIGSKG

SEQ ID NO: 397990 - protein, 11 aa, Influenza virus
DNGIRIGSKGH

SEQ ID NO: 397991 - protein, 11 aa, Influenza virus
NGIRIGSRGHI

SEQ ID NO: 397992 - protein, 11 aa, Influenza virus
GIRIGSRGHIF

SEQ ID NO: 397993 - protein, 11 aa, Influenza virus
IRIGSRGHIFV

SEQ ID NO: 397994 - protein, 11 aa, Influenza virus
RIGSRGHIFVI

SEQ ID NO: 397995 - protein, 11 aa, Influenza virus
IGSRGHIFVIR

SEQ ID NO: 397996 - protein, 11 aa, Influenza virus
GSRGHIFVIRE

SEQ ID NO: 397997 - protein, 11 aa, Influenza virus
SRGHIFVIREP

SEQ ID NO: 397998 - protein, 11 aa, Influenza virus
RGHIFVIREPF

SEQ ID NO: 397999 - protein, 11 aa, Influenza virus
GHIFVIREPFV

SEQ ID NO: 398000 - protein, 11 aa, Influenza virus
HIFVIREPFVS

SEQ ID NO: 398001 - protein, 11 aa, Influenza virus
IFVIREPFVSC

SEQ ID NO: 398002 - protein, 11 aa, Influenza virus
FIIREPFVSCS

SEQ ID NO: 398003 - protein, 11 aa, Influenza virus
IIREPFVSCSP

SEQ ID NO: 398004 - protein, 11 aa, Influenza virus
GCRTFFLTQGS

SEQ ID NO: 398005 - protein, 11 aa, Influenza virus
CRTFFLTHGSL

SEQ ID NO: 398006 - protein, 11 aa, Influenza virus
RTFFLTHGSLL

SEQ ID NO: 398007 - protein, 11 aa, Influenza virus
TFFLTHGSLLN

SEQ ID NO: 398008 - protein, 11 aa, Influenza virus
FFLTHGSLLND

SEQ ID NO: 398009 - protein, 11 aa, Influenza virus
FLTQGSLLNDR

SEQ ID NO: 398010 - protein, 11 aa, Influenza virus
LTQGSLLNDRH

SEQ ID NO: 398011 - protein, 11 aa, Influenza virus
TQGSLLNDRHS

SEQ ID NO: 398012 - protein, 11 aa, Influenza virus
QGSLLNDRHSN

SEQ ID NO: 398013 - protein, 11 aa, Influenza virus
GSLLNDRHSNG

SEQ ID NO: 398014 - protein, 11 aa, Influenza virus
SLLNDRHSNGT

SEQ ID NO: 398015 - protein, 11 aa, Influenza virus
NDKHSNGTIKD

SEQ ID NO: 398016 - protein, 11 aa, Influenza virus
DKHSNGTIKDR

SEQ ID NO: 398017 - protein, 11 aa, Influenza virus
KHSNGTIKDRS

SEQ ID NO: 398018 - protein, 11 aa, Influenza virus
HSNGTIKDRSP

SEQ ID NO: 398019 - protein, 11 aa, Influenza virus
SNGTVKDRSPF

SEQ ID NO: 398020 - protein, 11 aa, Influenza virus
NGTVKDRSPFR

SEQ ID NO: 398021 - protein, 11 aa, Influenza virus
GTVKDRSPFRT

SEQ ID NO: 398022 - protein, 11 aa, Influenza virus
TVKDRSPFRTL

SEQ ID NO: 398023 - protein, 11 aa, Influenza virus
VKDRSPFRTLM

SEQ ID NO: 398024 - protein, 11 aa, Influenza virus
KDRSPFRTLMS

SEQ ID NO: 398025 - protein, 11 aa, Influenza virus
DRSPFRTLMSV

SEQ ID NO: 398026 - protein, 11 aa, Influenza virus
RSPYRTLMSVK

SEQ ID NO: 398027 - protein, 11 aa, Influenza virus
GQSPNVYQAKF

SEQ ID NO: 398028 - protein, 11 aa, Influenza virus
QSPNVYQAKFE

SEQ ID NO: 398029 - protein, 11 aa, Influenza virus
VYQARFESVAW

SEQ ID NO: 398030 - protein, 11 aa, Influenza virus
YQARFESVAWS

SEQ ID NO: 398031 - protein, 11 aa, Influenza virus
QARFESVAWSA

SEQ ID NO: 398032 - protein, 11 aa, Influenza virus
ARFESVAWSAT

SEQ ID NO: 398033 - protein, 11 aa, Influenza virus
RFESVAWSATA

SEQ ID NO: 398034 - protein, 11 aa, Influenza virus
FESVAWSATAC

SEQ ID NO: 398035 - protein, 11 aa, Influenza virus
ESVAWSATACH

SEQ ID NO: 398036 - protein, 11 aa, Influenza virus
SVAWSATACHD

SEQ ID NO: 398037 - protein, 11 aa, Influenza virus
IAWSATACHDG

SEQ ID NO: 398038 - protein, 11 aa, Influenza virus
AWSATACHDGR

SEQ ID NO: 398039 - protein, 11 aa, Influenza virus
WSATACHDGRK

SEQ ID NO: 398040 - protein, 11 aa, Influenza virus
SATACHDGRKW

SEQ ID NO: 398041 - protein, 11 aa, Influenza virus
ATACHDGRKWM

SEQ ID NO: 398042 - protein, 11 aa, Influenza virus
GNILRTQESSC

SEQ ID NO: 398043 - protein, 11 aa, Influenza virus
NILRTQESSCT

SEQ ID NO: 398044 - protein, 11 aa, Influenza virus
IMRTQESSCTC

SEQ ID NO: 398045 - protein, 11 aa, Influenza virus
MRTQESSCTCI

SEQ ID NO: 398046 - protein, 11 aa, Influenza virus
RTQESSCTCIK

SEQ ID NO: 398047 - protein, 11 aa, Influenza virus
TQESSCTCIKG

SEQ ID NO: 398048 - protein, 11 aa, Influenza virus
GDCYWVMTDGP

SEQ ID NO: 398049 - protein, 11 aa, Influenza virus
DCYWVMTDGPA

SEQ ID NO: 398050 - protein, 11 aa, Influenza virus
CFWVMTDGPAN

SEQ ID NO: 398051 - protein, 11 aa, Influenza virus
WVMTDGPANKQ

SEQ ID NO: 398052 - protein, 11 aa, Influenza virus
VMTDGPANKQA

SEQ ID NO: 398053 - protein, 11 aa, Influenza virus
FSGGHIEECSC

SEQ ID NO: 398054 - protein, 11 aa, Influenza virus
SGGHIEECSCY

SEQ ID NO: 398055 - protein, 11 aa, Influenza virus
EGHIEECSCYP

SEQ ID NO: 398056 - protein, 11 aa, Influenza virus
HIEECSCYPND

SEQ ID NO: 398057 - protein, 11 aa, Influenza virus
IEECSCYPNDG

SEQ ID NO: 398058 - protein, 11 aa, Influenza virus
EECSCYPNDGK

SEQ ID NO: 398059 - protein, 11 aa, Influenza virus
ECSCYPNDGKV

SEQ ID NO: 398060 - protein, 11 aa, Influenza virus
CSCYPNDGKVE

SEQ ID NO: 398061 - protein, 11 aa, Influenza virus
SCYPNDGKVEC

SEQ ID NO: 398062 - protein, 11 aa, Influenza virus
CYPNEGKVECI

SEQ ID NO: 398063 - protein, 11 aa, Influenza virus
YPNEGKVECIC

SEQ ID NO: 398064 - protein, 11 aa, Influenza virus
PNEGKVECICR

SEQ ID NO: 398065 - protein, 11 aa, Influenza virus
NEGKVECICRD

SEQ ID NO: 398066 - protein, 11 aa, Influenza virus
EGKVECICRDN

SEQ ID NO: 398067 - protein, 11 aa, Influenza virus
GKVECICRDNW

SEQ ID NO: 398068 - protein, 11 aa, Influenza virus
KVECICRDNWT

SEQ ID NO: 398069 - protein, 11 aa, Influenza virus
VECICRDNWTG

SEQ ID NO: 398070 - protein, 11 aa, Influenza virus
ECICRDNWTGT

SEQ ID NO: 398071 - protein, 11 aa, Influenza virus
CICRDNWTGTN

SEQ ID NO: 398072 - protein, 11 aa, Influenza virus
ICRDNWTGTNR

SEQ ID NO: 398073 - protein, 11 aa, Influenza virus
RDNWTGTNRPI

SEQ ID NO: 398074 - protein, 11 aa, Influenza virus
DNWTGTNRPIL

SEQ ID NO: 398075 - protein, 11 aa, Influenza virus
NWTGTNRPILV

SEQ ID NO: 398076 - protein, 11 aa, Influenza virus
WTGTNRPILVI

SEQ ID NO: 398077 - protein, 11 aa, Influenza virus
LSYTVGYLCAG

SEQ ID NO: 398078 - protein, 11 aa, Influenza virus
VGYLCAGIPTD

SEQ ID NO: 398079 - protein, 11 aa, Influenza virus
GYLCAGIPTDT

SEQ ID NO: 398080 - protein, 11 aa, Influenza virus
YLCAGIPTDTP

SEQ ID NO: 398081 - protein, 11 aa, Influenza virus
LCAGIPTDTPR

SEQ ID NO: 398082 - protein, 11 aa, Influenza virus
CAGIPTDTPRG

SEQ ID NO: 398083 - protein, 11 aa, Influenza virus
AGIPTDTPRGE

SEQ ID NO: 398084 - protein, 11 aa, Influenza virus
GIPTDTPRGED

SEQ ID NO: 398085 - protein, 11 aa, Influenza virus
PTDTPRGEDSQ

SEQ ID NO: 398086 - protein, 11 aa, Influenza virus
TDTPRGEDSQF

SEQ ID NO: 398087 - protein, 11 aa, Influenza virus
KGYGVKGFGFR

SEQ ID NO: 398088 - protein, 11 aa, Influenza virus
GVKGFGFRQGT

SEQ ID NO: 398089 - protein, 11 aa, Influenza virus
VKGFGFRQGTD

SEQ ID NO: 398090 - protein, 11 aa, Influenza virus
KGFGFRQGTDV

SEQ ID NO: 398091 - protein, 11 aa, Influenza virus
GFGFRQGTDVW

SEQ ID NO: 398092 - protein, 11 aa, Influenza virus
DDPNWSGYSGS

SEQ ID NO: 398093 - protein, 11 aa, Influenza virus
DPNWSGYSGSF

SEQ ID NO: 398094 - protein, 11 aa, Influenza virus
PNWSGYSGSFT

SEQ ID NO: 398095 - protein, 11 aa, Influenza virus
SGYSGSFTLPI

SEQ ID NO: 398096 - protein, 11 aa, Influenza virus
GYSGSFTLPIE

SEQ ID NO: 398097 - protein, 11 aa, Influenza virus
YSGSFTLPIEL

SEQ ID NO: 398098 - protein, 11 aa, Influenza virus
PCFWVEMIRGE

SEQ ID NO: 398099 - protein, 11 aa, Influenza virus
CFWVEMIRGEP

SEQ ID NO: 398100 - protein, 11 aa, Influenza virus
FWVEMIRGRPE

SEQ ID NO: 398101 - protein, 11 aa, Influenza virus
WVEMIRGRPEE

SEQ ID NO: 398102 - protein, 11 aa, Influenza virus
TIWTSSSSVVM

SEQ ID NO: 398103 - protein, 11 aa, Influenza virus
IWTSSSSVVMC

SEQ ID NO: 398104 - protein, 11 aa, Influenza virus
WTSSSSVVMCG

SEQ ID NO: 398105 - protein, 11 aa, Influenza virus
TSSSSVVMCGV

SEQ ID NO: 398106 - protein, 11 aa, Influenza virus
SSSSVVMCGVD

SEQ ID NO: 398107 - protein, 11 aa, Influenza virus
SSSIVMCGVDY

SEQ ID NO: 398108 - protein, 11 aa, Influenza virus
SWSWHDGAILP

SEQ ID NO: 398109 - protein, 11 aa, Influenza virus
WSWHDGAVLPF

SEQ ID NO: 398110 - protein, 11 aa, Influenza virus
AILPFDIDKII

SEQ ID NO: 398111 - protein, 11 aa, Influenza virus
ILPFDIDKIIT

SEQ ID NO: 398112 - protein, 11 aa, Influenza virus
MNPNQKILCAS

SEQ ID NO: 398113 - protein, 11 aa, Influenza virus
NPNQKILCASA

SEQ ID NO: 398114 - protein, 11 aa, Influenza virus
PNQKILCASAT

SEQ ID NO: 398115 - protein, 11 aa, Influenza virus
NQKILCASATA

SEQ ID NO: 398116 - protein, 11 aa, Influenza virus
QKILCASATAI

SEQ ID NO: 398117 - protein, 11 aa, Influenza virus
VNLGLNIGLHL

SEQ ID NO: 398118 - protein, 11 aa, Influenza virus
NLGLNIGLHLR

SEQ ID NO: 398119 - protein, 11 aa, Influenza virus
LGLNIGLHLRP

SEQ ID NO: 398120 - protein, 11 aa, Influenza virus
FNNLTRELCTI

SEQ ID NO: 398121 - protein, 11 aa, Influenza virus
NNLTRELCTIN

SEQ ID NO: 398122 - protein, 11 aa, Influenza virus
NLTRELCTINS

SEQ ID NO: 398123 - protein, 11 aa, Influenza virus
LTRELCTINSW

SEQ ID NO: 398124 - protein, 11 aa, Influenza virus
TRELCTINSWH

SEQ ID NO: 398125 - protein, 11 aa, Influenza virus
RELCTINSWHI

SEQ ID NO: 398126 - protein, 11 aa, Influenza virus
GLCTINSWHIF

SEQ ID NO: 398127 - protein, 11 aa, Influenza virus
LCTINSWHIFG

SEQ ID NO: 398128 - protein, 11 aa, Influenza virus
CTINSWHIFGK

SEQ ID NO: 398129 - protein, 11 aa, Influenza virus
TINSWHIFGKD

SEQ ID NO: 398130 - protein, 11 aa, Influenza virus
INSWHIFGKDN

SEQ ID NO: 398131 - protein, 11 aa, Influenza virus
NSWHIFGKDNA

SEQ ID NO: 398132 - protein, 11 aa, Influenza virus
SWHIFGKDNAI

SEQ ID NO: 398133 - protein, 11 aa, Influenza virus
WHIFGKDNAIR

SEQ ID NO: 398134 - protein, 11 aa, Influenza virus
HIFGKDNAIRI

SEQ ID NO: 398135 - protein, 11 aa, Influenza virus
IFGKDNAIRIG

SEQ ID NO: 398136 - protein, 11 aa, Influenza virus
FGKDNAIRIGE

SEQ ID NO: 398137 - protein, 11 aa, Influenza virus
GKDNAVRIGEN

SEQ ID NO: 398138 - protein, 11 aa, Influenza virus
KDNAVRIGENS

SEQ ID NO: 398139 - protein, 11 aa, Influenza virus
RIGENSDVLVT

SEQ ID NO: 398140 - protein, 11 aa, Influenza virus
IGENSDVLVTR

SEQ ID NO: 398141 - protein, 11 aa, Influenza virus
GENSDVLVTRE

SEQ ID NO: 398142 - protein, 11 aa, Influenza virus
NSDVLVTREPY

SEQ ID NO: 398143 - protein, 11 aa, Influenza virus
SDILVTREPYV

SEQ ID NO: 398144 - protein, 11 aa, Influenza virus
DILVTREPYVS

SEQ ID NO: 398145 - protein, 11 aa, Influenza virus
ILVTREPYVSC

SEQ ID NO: 398146 - protein, 11 aa, Influenza virus
LVTREPYVSCE

SEQ ID NO: 398147 - protein, 11 aa, Influenza virus
VTREPYVSCEP

SEQ ID NO: 398148 - protein, 11 aa, Influenza virus
TREPYVSCEPD

SEQ ID NO: 398149 - protein, 11 aa, Influenza virus
REPYVSCEPDE

SEQ ID NO: 398150 - protein, 11 aa, Influenza virus
EPYVSCEPDEC

SEQ ID NO: 398151 - protein, 11 aa, Influenza virus
PYVSCDPDGCR

SEQ ID NO: 398152 - protein, 11 aa, Influenza virus
YVSCEPDECRF

SEQ ID NO: 398153 - protein, 11 aa, Influenza virus
VSCEPDECRFY

SEQ ID NO: 398154 - protein, 11 aa, Influenza virus
SCDPDGCRFYA

SEQ ID NO: 398155 - protein, 11 aa, Influenza virus
CDPDGCRFYAL

SEQ ID NO: 398156 - protein, 11 aa, Influenza virus
DPDGCRFYALS

SEQ ID NO: 398157 - protein, 11 aa, Influenza virus
PDGCRFYALSQ

SEQ ID NO: 398158 - protein, 11 aa, Influenza virus
DGCRFYALSQG

SEQ ID NO: 398159 - protein, 11 aa, Influenza virus
GCRFYALSQGT

SEQ ID NO: 398160 - protein, 11 aa, Influenza virus
ALSQGTTIRGR

SEQ ID NO: 398161 - protein, 11 aa, Influenza virus
LSQGTTIRGRH

SEQ ID NO: 398162 - protein, 11 aa, Influenza virus
SQGTTIRGRHS

SEQ ID NO: 398163 - protein, 11 aa, Influenza virus
QGTTIRGRHSN

SEQ ID NO: 398164 - protein, 11 aa, Influenza virus
GTTIRGRHSNG

SEQ ID NO: 398165 - protein, 11 aa, Influenza virus
TTIRGRHSNGT

SEQ ID NO: 398166 - protein, 11 aa, Influenza virus
TIRGRHSNGTI

SEQ ID NO: 398167 - protein, 11 aa, Influenza virus
IRGRHSNGTIH

SEQ ID NO: 398168 - protein, 11 aa, Influenza virus
RGRHSNGTIHD

SEQ ID NO: 398169 - protein, 11 aa, Influenza virus
GRHSNGTIHDR

SEQ ID NO: 398170 - protein, 11 aa, Influenza virus
RHSNGTIHDRS

SEQ ID NO: 398171 - protein, 11 aa, Influenza virus
GTIHDRSQYRS

SEQ ID NO: 398172 - protein, 11 aa, Influenza virus
TIHDRSQYRSL

SEQ ID NO: 398173 - protein, 11 aa, Influenza virus
IHDRSQYRSLI

SEQ ID NO: 398174 - protein, 11 aa, Influenza virus
HDRSQYRSLIS

SEQ ID NO: 398175 - protein, 11 aa, Influenza virus
DRSQYRSLISW

SEQ ID NO: 398176 - protein, 11 aa, Influenza virus
RSQYRSLISWP

SEQ ID NO: 398177 - protein, 11 aa, Influenza virus
SQYRSLISWPL

SEQ ID NO: 398178 - protein, 11 aa, Influenza virus
QYRSLISWPLS

SEQ ID NO: 398179 - protein, 11 aa, Influenza virus
YRSLISWPLSS

SEQ ID NO: 398180 - protein, 11 aa, Influenza virus
RSLISWPLSSP

SEQ ID NO: 398181 - protein, 11 aa, Influenza virus
SLISWPLSSPP

SEQ ID NO: 398182 - protein, 11 aa, Influenza virus
LVSWPLSSPPT

SEQ ID NO: 398183 - protein, 11 aa, Influenza virus
VSWPLSSPPTV

SEQ ID NO: 398184 - protein, 11 aa, Influenza virus
SWPQSSPPTVY

SEQ ID NO: 398185 - protein, 11 aa, Influenza virus
WPQSSPPTVYN

SEQ ID NO: 398186 - protein, 11 aa, Influenza virus
PLSSPPTVYNT

SEQ ID NO: 398187 - protein, 11 aa, Influenza virus
RIECIGWSSTS

SEQ ID NO: 398188 - protein, 11 aa, Influenza virus
IECIGWSSTSC

SEQ ID NO: 398189 - protein, 11 aa, Influenza virus
GWSSTSCHDGK

SEQ ID NO: 398190 - protein, 11 aa, Influenza virus
WSSTSCHDGKS

SEQ ID NO: 398191 - protein, 11 aa, Influenza virus
SSTSCHDGKSR

SEQ ID NO: 398192 - protein, 11 aa, Influenza virus
STSCHDGKSRM

SEQ ID NO: 398193 - protein, 11 aa, Influenza virus
TSCHDGKSRMS

SEQ ID NO: 398194 - protein, 11 aa, Influenza virus
RMSICVSGPNN

SEQ ID NO: 398195 - protein, 11 aa, Influenza virus
MSICVSGPNNN

SEQ ID NO: 398196 - protein, 11 aa, Influenza virus
SICVSGPNNNA

SEQ ID NO: 398197 - protein, 11 aa, Influenza virus
ICVSGPNNNAS

SEQ ID NO: 398198 - protein, 11 aa, Influenza virus
CVSGPNNNASA

SEQ ID NO: 398199 - protein, 11 aa, Influenza virus
VSGPNNNASAV

SEQ ID NO: 398200 - protein, 11 aa, Influenza virus
SGPNNNASAVV

SEQ ID NO: 398201 - protein, 11 aa, Influenza virus
GPNNNASAVVW

SEQ ID NO: 398202 - protein, 11 aa, Influenza virus
PNNNASAVVWY

SEQ ID NO: 398203 - protein, 11 aa, Influenza virus
NNNASAVVWYN

SEQ ID NO: 398204 - protein, 11 aa, Influenza virus
RPVAEINTWAR

SEQ ID NO: 398205 - protein, 11 aa, Influenza virus
PVAEINTWARN

SEQ ID NO: 398206 - protein, 11 aa, Influenza virus
VAEINTWARNI

SEQ ID NO: 398207 - protein, 11 aa, Influenza virus
AEINTWARNIL

SEQ ID NO: 398208 - protein, 11 aa, Influenza virus
RTQESECVCHS

SEQ ID NO: 398209 - protein, 11 aa, Influenza virus
TQESECVCHSG

SEQ ID NO: 398210 - protein, 11 aa, Influenza virus
QESECVCHNGI

SEQ ID NO: 398211 - protein, 11 aa, Influenza virus
ESECVCHNGIC

SEQ ID NO: 398212 - protein, 11 aa, Influenza virus
SECVCHNGICP

SEQ ID NO: 398213 - protein, 11 aa, Influenza virus
ECVCHNGICPV

SEQ ID NO: 398214 - protein, 11 aa, Influenza virus
CVCHNGICPVV

SEQ ID NO: 398215 - protein, 11 aa, Influenza virus
VCHNGICPVVF

SEQ ID NO: 398216 - protein, 11 aa, Influenza virus
CHNGICPVVFT

SEQ ID NO: 398217 - protein, 11 aa, Influenza virus
HNGICPVVFTD

SEQ ID NO: 398218 - protein, 11 aa, Influenza virus
NGICPVVFTDG

SEQ ID NO: 398219 - protein, 11 aa, Influenza virus
GICPVVFTDGS

SEQ ID NO: 398220 - protein, 11 aa, Influenza virus
ICPVVFTDGSA

SEQ ID NO: 398221 - protein, 11 aa, Influenza virus
FTDGSATGPAD

SEQ ID NO: 398222 - protein, 11 aa, Influenza virus
TDGSATGPADT

SEQ ID NO: 398223 - protein, 11 aa, Influenza virus
DGSATGPADTR

SEQ ID NO: 398224 - protein, 11 aa, Influenza virus
GSATGPAETRI

SEQ ID NO: 398225 - protein, 11 aa, Influenza virus
SATGPAETRIY

SEQ ID NO: 398226 - protein, 11 aa, Influenza virus
ATGPAETRIYY

SEQ ID NO: 398227 - protein, 11 aa, Influenza virus
TGPAETRIYYF

SEQ ID NO: 398228 - protein, 11 aa, Influenza virus
LAGTAKHIEEC

SEQ ID NO: 398229 - protein, 11 aa, Influenza virus
AGTAKHIEECS

SEQ ID NO: 398230 - protein, 11 aa, Influenza virus
GTATHIEECSC

SEQ ID NO: 398231 - protein, 11 aa, Influenza virus
TAKHIEECSSY

SEQ ID NO: 398232 - protein, 11 aa, Influenza virus
ARHIEECSCYG

SEQ ID NO: 398233 - protein, 11 aa, Influenza virus
KHIEECSCYGV

SEQ ID NO: 398234 - protein, 11 aa, Influenza virus
VTCTCRDNWQG

SEQ ID NO: 398235 - protein, 11 aa, Influenza virus
ICTCRDNWQGS

SEQ ID NO: 398236 - protein, 11 aa, Influenza virus
NWQGSNRPVIR

SEQ ID NO: 398237 - protein, 11 aa, Influenza virus
WQGSNRPVIRI

SEQ ID NO: 398238 - protein, 11 aa, Influenza virus
QGSNRPVIQIN

SEQ ID NO: 398239 - protein, 11 aa, Influenza virus
GSNRPVIQINP

SEQ ID NO: 398240 - protein, 11 aa, Influenza virus
VMTHTSQYICS

SEQ ID NO: 398241 - protein, 11 aa, Influenza virus
MKHTSQYICSP

SEQ ID NO: 398242 - protein, 11 aa, Influenza virus
KHTSQYICSPV

SEQ ID NO: 398243 - protein, 11 aa, Influenza virus
LTDNPRPNDPT

SEQ ID NO: 398244 - protein, 11 aa, Influenza virus
IGKCNDPYPGN

SEQ ID NO: 398245 - protein, 11 aa, Influenza virus
GKCNEPYPGNN

SEQ ID NO: 398246 - protein, 11 aa, Influenza virus
KCNEPYPGNNN

SEQ ID NO: 398247 - protein, 11 aa, Influenza virus
CNEPYPGNNNN

SEQ ID NO: 398248 - protein, 11 aa, Influenza virus
NEPYPGNNNNG

SEQ ID NO: 398249 - protein, 11 aa, Influenza virus
EPYPGNNNNGV

SEQ ID NO: 398250 - protein, 11 aa, Influenza virus
PYPGNNBNGVK

SEQ ID NO: 398251 - protein, 11 aa, Influenza virus
YPGNNNKGVKG

SEQ ID NO: 398252 - protein, 11 aa, Influenza virus
PGNNBNGVKGF

SEQ ID NO: 398253 - protein, 11 aa, Influenza virus
GNNNNGVKGFA

SEQ ID NO: 398254 - protein, 11 aa, Influenza virus
NNNNGVKGFAY

SEQ ID NO: 398255 - protein, 11 aa, Influenza virus
NNNGVKGFAYL

SEQ ID NO: 398256 - protein, 11 aa, Influenza virus
NNGVKGFSYLN

SEQ ID NO: 398257 - protein, 11 aa, Influenza virus
NGVKGFSYLNG

SEQ ID NO: 398258 - protein, 11 aa, Influenza virus
NTWLGRTISIA

SEQ ID NO: 398259 - protein, 11 aa, Influenza virus
TWLGRTISIAS

SEQ ID NO: 398260 - protein, 11 aa, Influenza virus
WLGRTISIASR

SEQ ID NO: 398261 - protein, 11 aa, Influenza virus
GRTISIASRSG

SEQ ID NO: 398262 - protein, 11 aa, Influenza virus
RTISIASRSGY

SEQ ID NO: 398263 - protein, 11 aa, Influenza virus
TISIASRSGYE

SEQ ID NO: 398264 - protein, 11 aa, Influenza virus
SIASRSGYEML

SEQ ID NO: 398265 - protein, 11 aa, Influenza virus
IASRSGYEMLK

SEQ ID NO: 398266 - protein, 11 aa, Influenza virus
ASRSGYEVLRV

SEQ ID NO: 398267 - protein, 11 aa, Influenza virus
SRSGYEILKVP

SEQ ID NO: 398268 - protein, 11 aa, Influenza virus
RSGYEVLRVPN

SEQ ID NO: 398269 - protein, 11 aa, Influenza virus
SGYEILKVPNA

SEQ ID NO: 398270 - protein, 11 aa, Influenza virus
YEVLRVPNALT

SEQ ID NO: 398271 - protein, 11 aa, Influenza virus
EVLRVPNALTD

SEQ ID NO: 398272 - protein, 11 aa, Influenza virus
MLKVPNALTDN

SEQ ID NO: 398273 - protein, 11 aa, Influenza virus
LKVPNALTDNR

SEQ ID NO: 398274 - protein, 11 aa, Influenza virus
KVPNALTDNRS

SEQ ID NO: 398275 - protein, 11 aa, Influenza virus
VPNALTDDKSK

SEQ ID NO: 398276 - protein, 11 aa, Influenza virus
PNALTDNRSKP

SEQ ID NO: 398277 - protein, 11 aa, Influenza virus
QGQTVVLNTDW

SEQ ID NO: 398278 - protein, 11 aa, Influenza virus
GQTVVLNTDWS

SEQ ID NO: 398279 - protein, 11 aa, Influenza virus
QTVVLNTDWSG

SEQ ID NO: 398280 - protein, 11 aa, Influenza virus
TVVLNTDWSGY

SEQ ID NO: 398281 - protein, 11 aa, Influenza virus
VVLNTDWSGYS

SEQ ID NO: 398282 - protein, 11 aa, Influenza virus
VSNTDWSGYSG

SEQ ID NO: 398283 - protein, 11 aa, Influenza virus
SNTDWSGYSGS

SEQ ID NO: 398284 - protein, 11 aa, Influenza virus
TDWSGYSGSFI

SEQ ID NO: 398285 - protein, 11 aa, Influenza virus
DWSGYSGSFID

SEQ ID NO: 398286 - protein, 11 aa, Influenza virus
WSGYSGSFIDY

SEQ ID NO: 398287 - protein, 11 aa, Influenza virus
SGYSGSFIDYW

SEQ ID NO: 398288 - protein, 11 aa, Influenza virus
GYSGSFIDYWA

SEQ ID NO: 398289 - protein, 11 aa, Influenza virus
YSGSFIDYWAK

SEQ ID NO: 398290 - protein, 11 aa, Influenza virus
SGSFIDYWAKG

SEQ ID NO: 398291 - protein, 11 aa, Influenza virus
DYWAEGDCYRA

SEQ ID NO: 398292 - protein, 11 aa, Influenza virus
YWAEGDCYRAC

SEQ ID NO: 398293 - protein, 11 aa, Influenza virus
WAEGDCYRACF

SEQ ID NO: 398294 - protein, 11 aa, Influenza virus
AEGDCYRACFY

SEQ ID NO: 398295 - protein, 11 aa, Influenza virus
EGDCYRACFYV

SEQ ID NO: 398296 - protein, 11 aa, Influenza virus
GDCYRACFYVE

SEQ ID NO: 398297 - protein, 11 aa, Influenza virus
DCYRACFYVEL

SEQ ID NO: 398298 - protein, 11 aa, Influenza virus
VELIRGRPKEE

SEQ ID NO: 398299 - protein, 11 aa, Influenza virus
ELIRGRPKEEK

SEQ ID NO: 398300 - protein, 11 aa, Influenza virus
LIRGRPKEEKV

SEQ ID NO: 398301 - protein, 11 aa, Influenza virus
IRGRPKEEKVW

SEQ ID NO: 398302 - protein, 11 aa, Influenza virus
RGRPKEEKVWW

SEQ ID NO: 398303 - protein, 11 aa, Influenza virus
GRPKEEKVWWT

SEQ ID NO: 398304 - protein, 11 aa, Influenza virus
RPKEEKVWWTS

SEQ ID NO: 398305 - protein, 11 aa, Influenza virus
PKEEKVWWTSN

SEQ ID NO: 398306 - protein, 11 aa, Influenza virus
KEEKVWWTSNS

SEQ ID NO: 398307 - protein, 11 aa, Influenza virus
EEKVWWTSNSI

SEQ ID NO: 398308 - protein, 11 aa, Influenza virus
EKVWWTSNSIV

SEQ ID NO: 398309 - protein, 11 aa, Influenza virus
RVWWTSNSIVS

SEQ ID NO: 398310 - protein, 11 aa, Influenza virus
VWWTSNSIISM

SEQ ID NO: 398311 - protein, 11 aa, Influenza virus
WWTSNSIISMC

SEQ ID NO: 398312 - protein, 11 aa, Influenza virus
WTSNSIISMCS

SEQ ID NO: 398313 - protein, 11 aa, Influenza virus
SNSIISMCSST

SEQ ID NO: 398314 - protein, 11 aa, Influenza virus
NSIISMCSSTE

SEQ ID NO: 398315 - protein, 11 aa, Influenza virus
SIISMCSSTEF

SEQ ID NO: 398316 - protein, 11 aa, Influenza virus
IISMCSSTEFL

SEQ ID NO: 398317 - protein, 11 aa, Influenza virus
ISMCSSTEFLG

SEQ ID NO: 398318 - protein, 11 aa, Influenza virus
CSSTEFLGQWD

SEQ ID NO: 398319 - protein, 11 aa, Influenza virus
SSTEFLGQWDW

SEQ ID NO: 398320 - protein, 11 aa, Influenza virus
STEFLGQWDWP

SEQ ID NO: 398321 - protein, 11 aa, Influenza virus
TEFLGQWDWPD

SEQ ID NO: 398322 - protein, 11 aa, Influenza virus
EFLGQWDWPDG

SEQ ID NO: 398323 - protein, 11 aa, Influenza virus
FLGQWDWPDGA

SEQ ID NO: 398324 - protein, 11 aa, Influenza virus
LGQWDWPDGAK

SEQ ID NO: 398325 - protein, 11 aa, Influenza virus
GQWDWPDGAKI

SEQ ID NO: 398326 - protein, 11 aa, Influenza virus
QWDWPDGAKIE

SEQ ID NO: 398327 - protein, 11 aa, Influenza virus
WDWPDGAKIEY

SEQ ID NO: 398328 - protein, 11 aa, Influenza virus
DWPDGAKIEYF

SEQ ID NO: 398329 - protein, 11 aa, Influenza virus
WPDGAEIEYFL

SEQ ID NO: 398330 - protein, 11 aa, Influenza virus
GIDKICLGHHA

SEQ ID NO: 398331 - protein, 11 aa, Influenza virus
IDKICLGHHAV

SEQ ID NO: 398332 - protein, 11 aa, Influenza virus
DKICLGHHAVP

SEQ ID NO: 398333 - protein, 11 aa, Influenza virus
KICLGHHAVPN

SEQ ID NO: 398334 - protein, 11 aa, Influenza virus
ICLGHHAVPNG

SEQ ID NO: 398335 - protein, 11 aa, Influenza virus
CLGHHAVPNGT

SEQ ID NO: 398336 - protein, 11 aa, Influenza virus
QEEVTNATETV

SEQ ID NO: 398337 - protein, 11 aa, Influenza virus
EVTNATETVEN

SEQ ID NO: 398338 - protein, 11 aa, Influenza virus
NEGALRQKIME

SEQ ID NO: 398339 - protein, 11 aa, Influenza virus
EGALRQKIMES

SEQ ID NO: 398340 - protein, 11 aa, Influenza virus
GALRQKIMESG

SEQ ID NO: 398341 - protein, 11 aa, Influenza virus
ALRQKIMESGE

SEQ ID NO: 398342 - protein, 11 aa, Influenza virus
LRQKIMESGGV

SEQ ID NO: 398343 - protein, 11 aa, Influenza virus
QNFPQTANTYR

SEQ ID NO: 398344 - protein, 11 aa, Influenza virus
NFPQTANTYRN

SEQ ID NO: 398345 - protein, 11 aa, Influenza virus
FPQTANTYRNT

SEQ ID NO: 398346 - protein, 11 aa, Influenza virus
PQTANTYRNTD

SEQ ID NO: 398347 - protein, 11 aa, Influenza virus
QTTNTYRNTDT

SEQ ID NO: 398348 - protein, 11 aa, Influenza virus
LYGTQSLSISI

SEQ ID NO: 398349 - protein, 11 aa, Influenza virus
YGTQSLSISIG

SEQ ID NO: 398350 - protein, 11 aa, Influenza virus
GTQSLSISVES

SEQ ID NO: 398351 - protein, 11 aa, Influenza virus
TQSLSISIGSS

SEQ ID NO: 398352 - protein, 11 aa, Influenza virus
QSLSISIGSST

SEQ ID NO: 398353 - protein, 11 aa, Influenza virus
SLSISVESSTY

SEQ ID NO: 398354 - protein, 11 aa, Influenza virus
LSISVESSTYQ

SEQ ID NO: 398355 - protein, 11 aa, Influenza virus
SISIGSSTYQN

SEQ ID NO: 398356 - protein, 11 aa, Influenza virus
VGSSTYQNSFV

SEQ ID NO: 398357 - protein, 11 aa, Influenza virus
GSSTYQNSFVP

SEQ ID NO: 398358 - protein, 11 aa, Influenza virus
SSTYQNSFVPV

SEQ ID NO: 398359 - protein, 11 aa, Influenza virus
STYQNSFVPVV

SEQ ID NO: 398360 - protein, 11 aa, Influenza virus
NSFVPVVGARP

SEQ ID NO: 398361 - protein, 11 aa, Influenza virus
FVPVIGARPQV

SEQ ID NO: 398362 - protein, 11 aa, Influenza virus
VPVIGARPQVN

SEQ ID NO: 398363 - protein, 11 aa, Influenza virus
PVIGARPQVNG

SEQ ID NO: 398364 - protein, 11 aa, Influenza virus
VIGARPQVNGQ

SEQ ID NO: 398365 - protein, 11 aa, Influenza virus
RARPQVNGQSG

SEQ ID NO: 398366 - protein, 11 aa, Influenza virus
ARPQVNGQRGR

SEQ ID NO: 398367 - protein, 11 aa, Influenza virus
RPLVNGQSGRI

SEQ ID NO: 398368 - protein, 11 aa, Influenza virus
VNGQSGRIEFH

SEQ ID NO: 398369 - protein, 11 aa, Influenza virus
NGQSGRIEFHW

SEQ ID NO: 398370 - protein, 11 aa, Influenza virus
PGDSITFSHNG

SEQ ID NO: 398371 - protein, 11 aa, Influenza virus
GDSITFSHNGG

SEQ ID NO: 398372 - protein, 11 aa, Influenza virus
ITFSHNGGRIA

SEQ ID NO: 398373 - protein, 11 aa, Influenza virus
TFSHNGGRIAP

SEQ ID NO: 398374 - protein, 11 aa, Influenza virus
HNGGLIAPDRV

SEQ ID NO: 398375 - protein, 11 aa, Influenza virus
CESKCFWRGGS

SEQ ID NO: 398376 - protein, 11 aa, Influenza virus
ESKCFWRGGSI

SEQ ID NO: 398377 - protein, 11 aa, Influenza virus
SKCFWRGGSIN

SEQ ID NO: 398378 - protein, 11 aa, Influenza virus
KCFWRGGSINT

SEQ ID NO: 398379 - protein, 11 aa, Influenza virus
GGSINTRLPFQ

SEQ ID NO: 398380 - protein, 11 aa, Influenza virus
GSINTRLPFQN

SEQ ID NO: 398381 - protein, 11 aa, Influenza virus
SINTRLPFQNL

SEQ ID NO: 398382 - protein, 11 aa, Influenza virus
INTRLPFQNLS

SEQ ID NO: 398383 - protein, 11 aa, Influenza virus
NTRLPFQNLSP

SEQ ID NO: 398384 - protein, 11 aa, Influenza virus
TRLPFQNLSPR

SEQ ID NO: 398385 - protein, 11 aa, Influenza virus
RLPFQNLSPRT

SEQ ID NO: 398386 - protein, 11 aa, Influenza virus
RTVGQCPKYVS

SEQ ID NO: 398387 - protein, 11 aa, Influenza virus
RSLLLATGMRN

SEQ ID NO: 398388 - protein, 11 aa, Influenza virus
SLMLATGMRNV

SEQ ID NO: 398389 - protein, 11 aa, Influenza virus
LMLATGMRNVP

SEQ ID NO: 398390 - protein, 11 aa, Influenza virus
MLATGMRNVPE

SEQ ID NO: 398391 - protein, 11 aa, Influenza virus
LATGMRNVPEI

SEQ ID NO: 398392 - protein, 11 aa, Influenza virus
QERGLFGAIAG

SEQ ID NO: 398393 - protein, 11 aa, Influenza virus
ERGLFGAIAGF

SEQ ID NO: 398394 - protein, 11 aa, Influenza virus
RGLFGAKAGFI

SEQ ID NO: 398395 - protein, 11 aa, Influenza virus
GLFGAKAGFIE

SEQ ID NO: 398396 - protein, 11 aa, Influenza virus
LFGAKAGFIEN

SEQ ID NO: 398397 - protein, 11 aa, Influenza virus
FGAKAGFIENG

SEQ ID NO: 398398 - protein, 11 aa, Influenza virus
GAKAGFIENGW

SEQ ID NO: 398399 - protein, 11 aa, Influenza virus
AKAGFIENGWE

SEQ ID NO: 398400 - protein, 11 aa, Influenza virus
KAGFIENGWEG

SEQ ID NO: 398401 - protein, 11 aa, Influenza virus
GFIENGWEGMI

SEQ ID NO: 398402 - protein, 11 aa, Influenza virus
FIENGWEGMID

SEQ ID NO: 398403 - protein, 11 aa, Influenza virus
IENGWEGMIDG

SEQ ID NO: 398404 - protein, 11 aa, Influenza virus
ENGWEGMIDGW

SEQ ID NO: 398405 - protein, 11 aa, Influenza virus
NGWEGMIDGWY

SEQ ID NO: 398406 - protein, 11 aa, Influenza virus
GWEGMIDGWYG

SEQ ID NO: 398407 - protein, 11 aa, Influenza virus
WEGMIDGWYGF

SEQ ID NO: 398408 - protein, 11 aa, Influenza virus
EGMIDGWYGFR

SEQ ID NO: 398409 - protein, 11 aa, Influenza virus
GMIDGWYGFRH

SEQ ID NO: 398410 - protein, 11 aa, Influenza virus
MIDGWYGFRHQ

SEQ ID NO: 398411 - protein, 11 aa, Influenza virus
IDGWYGFRHQN

SEQ ID NO: 398412 - protein, 11 aa, Influenza virus
YGFRHQNAQGI

SEQ ID NO: 398413 - protein, 11 aa, Influenza virus
GFRHQNAQGIG

SEQ ID NO: 398414 - protein, 11 aa, Influenza virus
FRHQNAQGIGQ

SEQ ID NO: 398415 - protein, 11 aa, Influenza virus
RHQNAQGIGQA

SEQ ID NO: 398416 - protein, 11 aa, Influenza virus
HQNAQGIGQAA

SEQ ID NO: 398417 - protein, 11 aa, Influenza virus
QNAQGIGQAAD

SEQ ID NO: 398418 - protein, 11 aa, Influenza virus
NAQGIGQAADY

SEQ ID NO: 398419 - protein, 11 aa, Influenza virus
AQGIGQAADYK

SEQ ID NO: 398420 - protein, 11 aa, Influenza virus
QGIGQAADYKS

SEQ ID NO: 398421 - protein, 11 aa, Influenza virus
GIGQAADYKST

SEQ ID NO: 398422 - protein, 11 aa, Influenza virus
IGQAADYKSTQ

SEQ ID NO: 398423 - protein, 11 aa, Influenza virus
GQAADYKSTQT

SEQ ID NO: 398424 - protein, 11 aa, Influenza virus
QAADYKSTQTA

SEQ ID NO: 398425 - protein, 11 aa, Influenza virus
AADYKSTQAAV

SEQ ID NO: 398426 - protein, 11 aa, Influenza virus
AVDQITGKLNR

SEQ ID NO: 398427 - protein, 11 aa, Influenza virus
VDQITGKLNRL

SEQ ID NO: 398428 - protein, 11 aa, Influenza virus
VQITGKLNRLI

SEQ ID NO: 398429 - protein, 11 aa, Influenza virus
QVTGKLNRLIE

SEQ ID NO: 398430 - protein, 11 aa, Influenza virus
VTGKLNRLIEK

SEQ ID NO: 398431 - protein, 11 aa, Influenza virus
TEFESIESEFN

SEQ ID NO: 398432 - protein, 11 aa, Influenza virus
EFESIESEFNE

SEQ ID NO: 398433 - protein, 11 aa, Influenza virus
FESIESEFNEI

SEQ ID NO: 398434 - protein, 11 aa, Influenza virus
ESIESEFNEIE

SEQ ID NO: 398435 - protein, 11 aa, Influenza virus
SIESEFNEIEH

SEQ ID NO: 398436 - protein, 11 aa, Influenza virus
IESEFNEIEHQ

SEQ ID NO: 398437 - protein, 11 aa, Influenza virus
ESEFNEIEHQI

SEQ ID NO: 398438 - protein, 11 aa, Influenza virus
SEFNEIEHQIG

SEQ ID NO: 398439 - protein, 11 aa, Influenza virus
EFNEIEHQIGN

SEQ ID NO: 398440 - protein, 11 aa, Influenza virus
FNEIEHQIGNV

SEQ ID NO: 398441 - protein, 11 aa, Influenza virus
NEIEHQIGNVI

SEQ ID NO: 398442 - protein, 11 aa, Influenza virus
ETEHQIGNVIN

SEQ ID NO: 398443 - protein, 11 aa, Influenza virus
TEHQIGNVINW

SEQ ID NO: 398444 - protein, 11 aa, Influenza virus
EYQIGNVINWT

SEQ ID NO: 398445 - protein, 11 aa, Influenza virus
YQIGNVINWTK

SEQ ID NO: 398446 - protein, 11 aa, Influenza virus
KDSITYIWTYQ

SEQ ID NO: 398447 - protein, 11 aa, Influenza virus
DSITYIWTYQA

SEQ ID NO: 398448 - protein, 11 aa, Influenza virus
SITYIWTYQAE

SEQ ID NO: 398449 - protein, 11 aa, Influenza virus
ITYIWTYQAEL

SEQ ID NO: 398450 - protein, 11 aa, Influenza virus
TYIWTYQAELL

SEQ ID NO: 398451 - protein, 11 aa, Influenza virus
YIWTYQAELLV

SEQ ID NO: 398452 - protein, 11 aa, Influenza virus
IWTYQEELLVA

SEQ ID NO: 398453 - protein, 11 aa, Influenza virus
WTYQEELLVAM

SEQ ID NO: 398454 - protein, 11 aa, Influenza virus
TYQEELLVAME

SEQ ID NO: 398455 - protein, 11 aa, Influenza virus
YQAELLIAMEN

SEQ ID NO: 398456 - protein, 11 aa, Influenza virus
NAELLVAMENQ

SEQ ID NO: 398457 - protein, 11 aa, Influenza virus
IAMENQHTIDM

SEQ ID NO: 398458 - protein, 11 aa, Influenza virus
AMENQHTIDMG

SEQ ID NO: 398459 - protein, 11 aa, Influenza virus
MENQHTIEMTD

SEQ ID NO: 398460 - protein, 11 aa, Influenza virus
ENQHTIEMTDS

SEQ ID NO: 398461 - protein, 11 aa, Influenza virus
NQHTIDMADST

SEQ ID NO: 398462 - protein, 11 aa, Influenza virus
QHTIDLADSEM

SEQ ID NO: 398463 - protein, 11 aa, Influenza virus
HTIDLADSEML

SEQ ID NO: 398464 - protein, 11 aa, Influenza virus
TIDMADSTMLN

SEQ ID NO: 398465 - protein, 11 aa, Influenza virus
IDLADSEMLNL

SEQ ID NO: 398466 - protein, 11 aa, Influenza virus
DMGDSEMLNLY

SEQ ID NO: 398467 - protein, 11 aa, Influenza virus
MADSEMLNLYD

SEQ ID NO: 398468 - protein, 11 aa, Influenza virus
ADSEMLNLYDR

SEQ ID NO: 398469 - protein, 11 aa, Influenza virus
DSEMLNLYDRV

SEQ ID NO: 398470 - protein, 11 aa, Influenza virus
SEMLNLYDRVR

SEQ ID NO: 398471 - protein, 11 aa, Influenza virus
EMLNLYDRVRK

SEQ ID NO: 398472 - protein, 11 aa, Influenza virus
MLNLYDRVRKQ

SEQ ID NO: 398473 - protein, 11 aa, Influenza virus
LNLYDRVRKQL

SEQ ID NO: 398474 - protein, 11 aa, Influenza virus
NLYDRVRKQLR

SEQ ID NO: 398475 - protein, 11 aa, Influenza virus
LYDRVRKQLRQ

SEQ ID NO: 398476 - protein, 11 aa, Influenza virus
YDRVRKQLRQN

SEQ ID NO: 398477 - protein, 11 aa, Influenza virus
DRVRKQLRQNA

SEQ ID NO: 398478 - protein, 11 aa, Influenza virus
QLRQNAEEDGR

SEQ ID NO: 398479 - protein, 11 aa, Influenza virus
LRQNAEEDGRG

SEQ ID NO: 398480 - protein, 11 aa, Influenza virus
RQNAEEDGRGC

SEQ ID NO: 398481 - protein, 11 aa, Influenza virus
QNAEEDGRGCF

SEQ ID NO: 398482 - protein, 11 aa, Influenza virus
NAEEDGRGCFE

SEQ ID NO: 398483 - protein, 11 aa, Influenza virus
AEEDGRGCFEI

SEQ ID NO: 398484 - protein, 11 aa, Influenza virus
EEDGRGCFEIY

SEQ ID NO: 398485 - protein, 11 aa, Influenza virus
EDGRGCFEIYH

SEQ ID NO: 398486 - protein, 11 aa, Influenza virus
SCMESIRNNTY

SEQ ID NO: 398487 - protein, 11 aa, Influenza virus
CMESIRNNTYN

SEQ ID NO: 398488 - protein, 11 aa, Influenza virus
MESIRNNTYNH

SEQ ID NO: 398489 - protein, 11 aa, Influenza virus
IRNNTYDHSQY

SEQ ID NO: 398490 - protein, 11 aa, Influenza virus
RNNTYDHSQYR

SEQ ID NO: 398491 - protein, 11 aa, Influenza virus
NNTYDHSQYRE

SEQ ID NO: 398492 - protein, 11 aa, Influenza virus
NTYDHSQYREE

SEQ ID NO: 398493 - protein, 11 aa, Influenza virus
QYREESLLNRL

SEQ ID NO: 398494 - protein, 11 aa, Influenza virus
YREEALLNRLS

SEQ ID NO: 398495 - protein, 11 aa, Influenza virus
REEALLNRLSI

SEQ ID NO: 398496 - protein, 11 aa, Influenza virus
EEALLNRLSIN

SEQ ID NO: 398497 - protein, 11 aa, Influenza virus
EALLNRLNINS

SEQ ID NO: 398498 - protein, 11 aa, Influenza virus
ALLNRLNINSV

SEQ ID NO: 398499 - protein, 11 aa, Influenza virus
INSVKLSSGYK

SEQ ID NO: 398500 - protein, 11 aa, Influenza virus
LSSGYKDIILW

SEQ ID NO: 398501 - protein, 11 aa, Influenza virus
SSGYKDIILWF

SEQ ID NO: 398502 - protein, 11 aa, Influenza virus
SGYKDIILWFS

SEQ ID NO: 398503 - protein, 11 aa, Influenza virus
GYKDIILWFSF

SEQ ID NO: 398504 - protein, 11 aa, Influenza virus
YKDIILWFSFG

SEQ ID NO: 398505 - protein, 11 aa, Influenza virus
KDIILWFSFGA

SEQ ID NO: 398506 - protein, 11 aa, Influenza virus
DIILWFSFGAS

SEQ ID NO: 398507 - protein, 11 aa, Influenza virus
IILWFSFGASC

SEQ ID NO: 398508 - protein, 11 aa, Influenza virus
ILWFSFGASSF

SEQ ID NO: 398509 - protein, 11 aa, Influenza virus
LWFSFGASCFI

SEQ ID NO: 398510 - protein, 11 aa, Influenza virus
WFSFGASCFIL

SEQ ID NO: 398511 - protein, 11 aa, Influenza virus
FSFGASCFILL

SEQ ID NO: 398512 - protein, 11 aa, Influenza virus
SFGASCFILLA

SEQ ID NO: 398513 - protein, 11 aa, Influenza virus
GIDKICLGHHA

SEQ ID NO: 398514 - protein, 11 aa, Influenza virus
IDKICLGHHAV

SEQ ID NO: 398515 - protein, 11 aa, Influenza virus
DKICLGHHAVP

SEQ ID NO: 398516 - protein, 11 aa, Influenza virus
KICLGHHAVPN

SEQ ID NO: 398517 - protein, 11 aa, Influenza virus
ICLGHHAVPNG

SEQ ID NO: 398518 - protein, 11 aa, Influenza virus
CLGHHAVPNGT

SEQ ID NO: 398519 - protein, 11 aa, Influenza virus
LGHHAVPNGTI

SEQ ID NO: 398520 - protein, 11 aa, Influenza virus
NGTIVKTLTSE

SEQ ID NO: 398521 - protein, 11 aa, Influenza virus
GTIVKTLTNEQ

SEQ ID NO: 398522 - protein, 11 aa, Influenza virus
TIVKTLTNEQE

SEQ ID NO: 398523 - protein, 11 aa, Influenza virus
EQEEVTNATET

SEQ ID NO: 398524 - protein, 11 aa, Influenza virus
QEEVTNATETV

SEQ ID NO: 398525 - protein, 11 aa, Influenza virus
EEVINATETVE

SEQ ID NO: 398526 - protein, 11 aa, Influenza virus
EVTNATETVEN

SEQ ID NO: 398527 - protein, 11 aa, Influenza virus
VTNATETVEST

SEQ ID NO: 398528 - protein, 11 aa, Influenza virus
KDLGSCHPIGM

SEQ ID NO: 398529 - protein, 11 aa, Influenza virus
GTPVCDPHLTG

SEQ ID NO: 398530 - protein, 11 aa, Influenza virus
CDLYLTGTWDT

SEQ ID NO: 398531 - protein, 11 aa, Influenza virus
DLYLTGTWDTL

SEQ ID NO: 398532 - protein, 11 aa, Influenza virus
LYLTGTWDTLI

SEQ ID NO: 398533 - protein, 11 aa, Influenza virus
YLTGTWDTLIE

SEQ ID NO: 398534 - protein, 11 aa, Influenza virus
LTGMWDTLIER

SEQ ID NO: 398535 - protein, 11 aa, Influenza virus
TGTWDTLIERE

SEQ ID NO: 398536 - protein, 11 aa, Influenza virus
GTWDTLIEREN

SEQ ID NO: 398537 - protein, 11 aa, Influenza virus
AHCYPGATINE

SEQ ID NO: 398538 - protein, 11 aa, Influenza virus
CYPGATINEEA

SEQ ID NO: 398539 - protein, 11 aa, Influenza virus
YPGATINEEAL

SEQ ID NO: 398540 - protein, 11 aa, Influenza virus
PGATINEEALR

SEQ ID NO: 398541 - protein, 11 aa, Influenza virus
GATINEEALRQ

SEQ ID NO: 398542 - protein, 11 aa, Influenza virus
ATINEEALRQK

SEQ ID NO: 398543 - protein, 11 aa, Influenza virus
TINEEALRQKI

SEQ ID NO: 398544 - protein, 11 aa, Influenza virus
INEEALRQKIM

SEQ ID NO: 398545 - protein, 11 aa, Influenza virus
NEGALRQKIME

SEQ ID NO: 398546 - protein, 11 aa, Influenza virus
EGALRQKIMES

SEQ ID NO: 398547 - protein, 11 aa, Influenza virus
GALRQKIMESG

SEQ ID NO: 398548 - protein, 11 aa, Influenza virus
RQKIMESGGIS

SEQ ID NO: 398549 - protein, 11 aa, Influenza virus
QKIMESGGISK

SEQ ID NO: 398550 - protein, 11 aa, Influenza virus
KIMESGGISKI

SEQ ID NO: 398551 - protein, 11 aa, Influenza virus
IMESGGIDKIG

SEQ ID NO: 398552 - protein, 11 aa, Influenza virus
MESGGIDKIGT

SEQ ID NO: 398553 - protein, 11 aa, Influenza virus
GGDSFYAELKW

SEQ ID NO: 398554 - protein, 11 aa, Influenza virus
GDSFYAELKWL

SEQ ID NO: 398555 - protein, 11 aa, Influenza virus
DSFYAELKWLV

SEQ ID NO: 398556 - protein, 11 aa, Influenza virus
SFYAELKWLIS

SEQ ID NO: 398557 - protein, 11 aa, Influenza virus
FYAELKWLISK

SEQ ID NO: 398558 - protein, 11 aa, Influenza virus
YAELKWLVSKT

SEQ ID NO: 398559 - protein, 11 aa, Influenza virus
AELKWLVSKTK

SEQ ID NO: 398560 - protein, 11 aa, Influenza virus
ELKWLVSKTKG

SEQ ID NO: 398561 - protein, 11 aa, Influenza virus
LKWLVSKTKGQ

SEQ ID NO: 398562 - protein, 11 aa, Influenza virus
QNFPQTANTYR

SEQ ID NO: 398563 - protein, 11 aa, Influenza virus
NFPQTANTYRN

SEQ ID NO: 398564 - protein, 11 aa, Influenza virus
FPQTANTYRNT

SEQ ID NO: 398565 - protein, 11 aa, Influenza virus
PQTANTYRNTD

SEQ ID NO: 398566 - protein, 11 aa, Influenza virus
QTTNTYRNTDT

SEQ ID NO: 398567 - protein, 11 aa, Influenza virus
EHLIVWGIHHP

SEQ ID NO: 398568 - protein, 11 aa, Influenza virus
HLIVWGIHHPS

SEQ ID NO: 398569 - protein, 11 aa, Influenza virus
LIVWGIHHPSS

SEQ ID NO: 398570 - protein, 11 aa, Influenza virus
WGIHHPSSTKE

SEQ ID NO: 398571 - protein, 11 aa, Influenza virus
GIHHPSSTKEK

SEQ ID NO: 398572 - protein, 11 aa, Influenza virus
IHHPSSTKEKN

SEQ ID NO: 398573 - protein, 11 aa, Influenza virus
HHPSSTKEKND

SEQ ID NO: 398574 - protein, 11 aa, Influenza virus
HPSSAQEKNDL

SEQ ID NO: 398575 - protein, 11 aa, Influenza virus
PSSAQEKNDLY

SEQ ID NO: 398576 - protein, 11 aa, Influenza virus
SSTKEKNDLYG

SEQ ID NO: 398577 - protein, 11 aa, Influenza virus
EKNELYGTQSL

SEQ ID NO: 398578 - protein, 11 aa, Influenza virus
KNELYGTQSLS

SEQ ID NO: 398579 - protein, 11 aa, Influenza virus
NELYGTQSLSI

SEQ ID NO: 398580 - protein, 11 aa, Influenza virus
DLYGTQPLSIS

SEQ ID NO: 398581 - protein, 11 aa, Influenza virus
LYGTQPLSISV

SEQ ID NO: 398582 - protein, 11 aa, Influenza virus
YGTQSLSISVE

SEQ ID NO: 398583 - protein, 11 aa, Influenza virus
GTQSLSISVES

SEQ ID NO: 398584 - protein, 11 aa, Influenza virus
TQSLSISVESS

SEQ ID NO: 398585 - protein, 11 aa, Influenza virus
QSLSISVESST

SEQ ID NO: 398586 - protein, 11 aa, Influenza virus
SLSISVESSTY

SEQ ID NO: 398587 - protein, 11 aa, Influenza virus
LSISVESSTYQ

SEQ ID NO: 398588 - protein, 11 aa, Influenza virus
SISVESSTYQN

SEQ ID NO: 398589 - protein, 11 aa, Influenza virus
ISVGSSTYQNS

SEQ ID NO: 398590 - protein, 11 aa, Influenza virus
SVGSSTYQNSF

SEQ ID NO: 398591 - protein, 11 aa, Influenza virus
VESSTYQNNFV

SEQ ID NO: 398592 - protein, 11 aa, Influenza virus
ESSTYQNNFVP

SEQ ID NO: 398593 - protein, 11 aa, Influenza virus
SSTYQNSFVPV

SEQ ID NO: 398594 - protein, 11 aa, Influenza virus
STYQNSFVPVV

SEQ ID NO: 398595 - protein, 11 aa, Influenza virus
TYQNSFVPVVG

SEQ ID NO: 398596 - protein, 11 aa, Influenza virus
YQNSFVPVVGA

SEQ ID NO: 398597 - protein, 11 aa, Influenza virus
QNSFVPVVGAR

SEQ ID NO: 398598 - protein, 11 aa, Influenza virus
NSFVPVVGARP

SEQ ID NO: 398599 - protein, 11 aa, Influenza virus
SFVPVVGARPQ

SEQ ID NO: 398600 - protein, 11 aa, Influenza virus
PQVNGQSGRIN

SEQ ID NO: 398601 - protein, 11 aa, Influenza virus
QVNGQSGRINF

SEQ ID NO: 398602 - protein, 11 aa, Influenza virus
VNGQSGRINFH

SEQ ID NO: 398603 - protein, 11 aa, Influenza virus
NGQSGRINFHW

SEQ ID NO: 398604 - protein, 11 aa, Influenza virus
GQSGRINFHWT

SEQ ID NO: 398605 - protein, 11 aa, Influenza virus
VRPGDNITFSH

SEQ ID NO: 398606 - protein, 11 aa, Influenza virus
RPGDNITFSHN

SEQ ID NO: 398607 - protein, 11 aa, Influenza virus
PGDNITFSDNG

SEQ ID NO: 398608 - protein, 11 aa, Influenza virus
GDNITFSDNGG

SEQ ID NO: 398609 - protein, 11 aa, Influenza virus
DNITFSDNGGL

SEQ ID NO: 398610 - protein, 11 aa, Influenza virus
NIIFSHNGGLI

SEQ ID NO: 398611 - protein, 11 aa, Influenza virus
ITFSHNGGLVA

SEQ ID NO: 398612 - protein, 11 aa, Influenza virus
TFSDNGGLIAP

SEQ ID NO: 398613 - protein, 11 aa, Influenza virus
FLHNGGLIAPS

SEQ ID NO: 398614 - protein, 11 aa, Influenza virus
SHNGGLIAPDR

SEQ ID NO: 398615 - protein, 11 aa, Influenza virus
HNGGLVAPSRV

SEQ ID NO: 398616 - protein, 11 aa, Influenza virus
NGGLIAPSRVT

SEQ ID NO: 398617 - protein, 11 aa, Influenza virus
GGLIAPSRVTK

SEQ ID NO: 398618 - protein, 11 aa, Influenza virus
GLIAPSRVTKL

SEQ ID NO: 398619 - protein, 11 aa, Influenza virus
CESKCFWRGGS

SEQ ID NO: 398620 - protein, 11 aa, Influenza virus
ESKCFWRGGSI

SEQ ID NO: 398621 - protein, 11 aa, Influenza virus
SKCFWKGGSIK

SEQ ID NO: 398622 - protein, 11 aa, Influenza virus
KCFWKGGSIKT

SEQ ID NO: 398623 - protein, 11 aa, Influenza virus
CFWKGGSIKTK

SEQ ID NO: 398624 - protein, 11 aa, Influenza virus
FWKGGSIKTKL

SEQ ID NO: 398625 - protein, 11 aa, Influenza virus
WKGGSIKTKLP

SEQ ID NO: 398626 - protein, 11 aa, Influenza virus
KGGSIKTKLPF

SEQ ID NO: 398627 - protein, 11 aa, Influenza virus
GGSIKTKLPFQ

SEQ ID NO: 398628 - protein, 11 aa, Influenza virus
GSIKTKLPFQN

SEQ ID NO: 398629 - protein, 11 aa, Influenza virus
SIKTKLPFQNL

SEQ ID NO: 398630 - protein, 11 aa, Influenza virus
IKTKLPFQNLS

SEQ ID NO: 398631 - protein, 11 aa, Influenza virus
KTKLPFQNLSP

SEQ ID NO: 398632 - protein, 11 aa, Influenza virus
TRLPFQNLSPR

SEQ ID NO: 398633 - protein, 11 aa, Influenza virus
RLPFQNLSPRT

SEQ ID NO: 398634 - protein, 11 aa, Influenza virus
RTVGQCPKYVS

SEQ ID NO: 398635 - protein, 11 aa, Influenza virus
TVGQCPKYVSK

SEQ ID NO: 398636 - protein, 11 aa, Influenza virus
RSLLLATGMRN

SEQ ID NO: 398637 - protein, 11 aa, Influenza virus
SLMLATGMRNV

SEQ ID NO: 398638 - protein, 11 aa, Influenza virus
LMLATGMRNVP

SEQ ID NO: 398639 - protein, 11 aa, Influenza virus
MLATGMRNVPE

SEQ ID NO: 398640 - protein, 11 aa, Influenza virus
LATGMRNVPEI

SEQ ID NO: 398641 - protein, 11 aa, Influenza virus
QERGLFGAIAG

SEQ ID NO: 398642 - protein, 11 aa, Influenza virus
ERGLFGAIAGF

SEQ ID NO: 398643 - protein, 11 aa, Influenza virus
RGLFGAKAGFI

SEQ ID NO: 398644 - protein, 11 aa, Influenza virus
GLFGAIAGFLE

SEQ ID NO: 398645 - protein, 11 aa, Influenza virus
LFGAIAGFLEN

SEQ ID NO: 398646 - protein, 11 aa, Influenza virus
FGAIAGFLENG

SEQ ID NO: 398647 - protein, 11 aa, Influenza virus
GAKAGFIENGW

SEQ ID NO: 398648 - protein, 11 aa, Influenza virus
AIAGFLENGWE

SEQ ID NO: 398649 - protein, 11 aa, Influenza virus
KAGFIENGWEG

SEQ ID NO: 398650 - protein, 11 aa, Influenza virus
FLENGWEGMVD

SEQ ID NO: 398651 - protein, 11 aa, Influenza virus
IENGWEGMVNG

SEQ ID NO: 398652 - protein, 11 aa, Influenza virus
AQGTGQAADYE

SEQ ID NO: 398653 - protein, 11 aa, Influenza virus
QGTGQAADYES

SEQ ID NO: 398654 - protein, 11 aa, Influenza virus
GTGQAADYEST

SEQ ID NO: 398655 - protein, 11 aa, Influenza virus
TGQAADYESTQ

SEQ ID NO: 398656 - protein, 11 aa, Influenza virus
GQAADYKSTQK

SEQ ID NO: 398657 - protein, 11 aa, Influenza virus
QAADYESTQAA

SEQ ID NO: 398658 - protein, 11 aa, Influenza virus
AADYKSTQAAV

SEQ ID NO: 398659 - protein, 11 aa, Influenza virus
ADYKSTQAAVD

SEQ ID NO: 398660 - protein, 11 aa, Influenza virus
DYKSTQAAVDQ

SEQ ID NO: 398661 - protein, 11 aa, Influenza virus
YKSTQAAVDQI

SEQ ID NO: 398662 - protein, 11 aa, Influenza virus
KSTQAAVDQIT

SEQ ID NO: 398663 - protein, 11 aa, Influenza virus
STQAAVDQITG

SEQ ID NO: 398664 - protein, 11 aa, Influenza virus
TQAAVDQITGK

SEQ ID NO: 398665 - protein, 11 aa, Influenza virus
QAAVDQITGKL

SEQ ID NO: 398666 - protein, 11 aa, Influenza virus
AAVDQITGKLN

SEQ ID NO: 398667 - protein, 11 aa, Influenza virus
AVDQITGKLNR

SEQ ID NO: 398668 - protein, 11 aa, Influenza virus
VDQITGKLNRL

SEQ ID NO: 398669 - protein, 11 aa, Influenza virus
DQVTGKLNRLI

SEQ ID NO: 398670 - protein, 11 aa, Influenza virus
QVTGKLNRLIE

SEQ ID NO: 398671 - protein, 11 aa, Influenza virus
VTGKLNRLIEK

SEQ ID NO: 398672 - protein, 11 aa, Influenza virus
TEFESIESEFN

SEQ ID NO: 398673 - protein, 11 aa, Influenza virus
EFESIESEFNE

SEQ ID NO: 398674 - protein, 11 aa, Influenza virus
FESIESEFNEI

SEQ ID NO: 398675 - protein, 11 aa, Influenza virus
ESIESEFNEIE

SEQ ID NO: 398676 - protein, 11 aa, Influenza virus
SIESEFNEIEH

SEQ ID NO: 398677 - protein, 11 aa, Influenza virus
IESEFNEIEHQ

SEQ ID NO: 398678 - protein, 11 aa, Influenza virus
ESEFNEIEHQI

SEQ ID NO: 398679 - protein, 11 aa, Influenza virus
SEFNEIEHQIG

SEQ ID NO: 398680 - protein, 11 aa, Influenza virus
EFNEIEHQIGN

SEQ ID NO: 398681 - protein, 11 aa, Influenza virus
FNEIEHQIGNV

SEQ ID NO: 398682 - protein, 11 aa, Influenza virus
NEIEHQIGNVI

SEQ ID NO: 398683 - protein, 11 aa, Influenza virus
ETEHQIGNVIN

SEQ ID NO: 398684 - protein, 11 aa, Influenza virus
TEHQIGNVINW

SEQ ID NO: 398685 - protein, 11 aa, Influenza virus
EYQIGNVINWT

SEQ ID NO: 398686 - protein, 11 aa, Influenza virus
YQIGNVINWTK

SEQ ID NO: 398687 - protein, 11 aa, Influenza virus
DIWTYNAELLV

SEQ ID NO: 398688 - protein, 11 aa, Influenza virus
IWTYQAELLIA

SEQ ID NO: 398689 - protein, 11 aa, Influenza virus
WTYQAELLIAM

SEQ ID NO: 398690 - protein, 11 aa, Influenza virus
TYQAELLIAME

SEQ ID NO: 398691 - protein, 11 aa, Influenza virus
YQAELLIAMEN

SEQ ID NO: 398692 - protein, 11 aa, Influenza virus
NAELLVAMENQ

SEQ ID NO: 398693 - protein, 11 aa, Influenza virus
IAMENQHTIDM

SEQ ID NO: 398694 - protein, 11 aa, Influenza virus
NQHTIDLADSE

SEQ ID NO: 398695 - protein, 11 aa, Influenza virus
QHTIDLADSEM

SEQ ID NO: 398696 - protein, 11 aa, Influenza virus
HTIDMADSTML

SEQ ID NO: 398697 - protein, 11 aa, Influenza virus
TIDMADSTMLN

SEQ ID NO: 398698 - protein, 11 aa, Influenza virus
IDLADSEMLNL

SEQ ID NO: 398699 - protein, 11 aa, Influenza virus
DLADSEMLNLY

SEQ ID NO: 398700 - protein, 11 aa, Influenza virus
MADSEMLNLYD

SEQ ID NO: 398701 - protein, 11 aa, Influenza virus
ADSEMLNLYDR

SEQ ID NO: 398702 - protein, 11 aa, Influenza virus
DSEMLNLYDRV

SEQ ID NO: 398703 - protein, 11 aa, Influenza virus
SEMLNLYDRVR

SEQ ID NO: 398704 - protein, 11 aa, Influenza virus
EMLNLYDRVRK

SEQ ID NO: 398705 - protein, 11 aa, Influenza virus
MLNLYDRVRKQ

SEQ ID NO: 398706 - protein, 11 aa, Influenza virus
LNLYDRVRKQL

SEQ ID NO: 398707 - protein, 11 aa, Influenza virus
NLYDRVRKQLR

SEQ ID NO: 398708 - protein, 11 aa, Influenza virus
LYDRVRKQLRQ

SEQ ID NO: 398709 - protein, 11 aa, Influenza virus
YDRVRKQLRQN

SEQ ID NO: 398710 - protein, 11 aa, Influenza virus
DRVRKQLRQNA

SEQ ID NO: 398711 - protein, 11 aa, Influenza virus
QLRQNAEEDGR

SEQ ID NO: 398712 - protein, 11 aa, Influenza virus
LRQNAEEDGRG

SEQ ID NO: 398713 - protein, 11 aa, Influenza virus
RQNAEEDGRGC

SEQ ID NO: 398714 - protein, 11 aa, Influenza virus
QNAEEDGRGCF

SEQ ID NO: 398715 - protein, 11 aa, Influenza virus
NAEEDGRGCFE

SEQ ID NO: 398716 - protein, 11 aa, Influenza virus
AEEDGRGCFEI

SEQ ID NO: 398717 - protein, 11 aa, Influenza virus
EEDGRGCFEIY

SEQ ID NO: 398718 - protein, 11 aa, Influenza virus
EDGRGCFEIYH

SEQ ID NO: 398719 - protein, 11 aa, Influenza virus
DGKGCFEIYHA

SEQ ID NO: 398720 - protein, 11 aa, Influenza virus
GKGCFEIYHAC

SEQ ID NO: 398721 - protein, 11 aa, Influenza virus
DSCMESIRNNT

SEQ ID NO: 398722 - protein, 11 aa, Influenza virus
SCMESIRNNTY

SEQ ID NO: 398723 - protein, 11 aa, Influenza virus
CMERIRNNTYD

SEQ ID NO: 398724 - protein, 11 aa, Influenza virus
MESIRDNTYDH

SEQ ID NO: 398725 - protein, 11 aa, Influenza virus
ESIRNNTYDHA

SEQ ID NO: 398726 - protein, 11 aa, Influenza virus
SIRNNTYDHAQ

SEQ ID NO: 398727 - protein, 11 aa, Influenza virus
IRNNTYDHAQY

SEQ ID NO: 398728 - protein, 11 aa, Influenza virus
RNNTYDHAQYR

SEQ ID NO: 398729 - protein, 11 aa, Influenza virus
NNTYDHAQYRE

SEQ ID NO: 398730 - protein, 11 aa, Influenza virus
NTYDHAQYREE

SEQ ID NO: 398731 - protein, 11 aa, Influenza virus
TYDHAQYREEA

SEQ ID NO: 398732 - protein, 11 aa, Influenza virus
YDHAQYREEAL

SEQ ID NO: 398733 - protein, 11 aa, Influenza virus
DHAQYREEALL

SEQ ID NO: 398734 - protein, 11 aa, Influenza virus
HAQYREEALLN

SEQ ID NO: 398735 - protein, 11 aa, Influenza virus
AQYREEALLNR

SEQ ID NO: 398736 - protein, 11 aa, Influenza virus
YREEALLNRLS

SEQ ID NO: 398737 - protein, 11 aa, Influenza virus
REEALLNRLSI

SEQ ID NO: 398738 - protein, 11 aa, Influenza virus
EEALLNRLSIN

SEQ ID NO: 398739 - protein, 11 aa, Influenza virus
EALLNRLNINS

SEQ ID NO: 398740 - protein, 11 aa, Influenza virus
ALLNRLNINSV

SEQ ID NO: 398741 - protein, 11 aa, Influenza virus
LLNRLNINSVK

SEQ ID NO: 398742 - protein, 11 aa, Influenza virus
LNRLNINSVKL

SEQ ID NO: 398743 - protein, 11 aa, Influenza virus
NRLNINSVKLS

SEQ ID NO: 398744 - protein, 11 aa, Influenza virus
RLNINSVKLSS

SEQ ID NO: 398745 - protein, 11 aa, Influenza virus
LNINSVKLSSG

SEQ ID NO: 398746 - protein, 11 aa, Influenza virus
NINSVKLSSGY

SEQ ID NO: 398747 - protein, 11 aa, Influenza virus
INSVKLSSGYK

SEQ ID NO: 398748 - protein, 11 aa, Influenza virus
NSVKLSSGYKD

SEQ ID NO: 398749 - protein, 11 aa, Influenza virus
VKLSSGYKDII

SEQ ID NO: 398750 - protein, 11 aa, Influenza virus
KLSSGYKDIIL

SEQ ID NO: 398751 - protein, 11 aa, Influenza virus
LSSGYKDIILW

SEQ ID NO: 398752 - protein, 11 aa, Influenza virus
SSGYKDIILWF

SEQ ID NO: 398753 - protein, 11 aa, Influenza virus
SGYKDIILWFS

SEQ ID NO: 398754 - protein, 11 aa, Influenza virus
GYKDIILWFSF

SEQ ID NO: 398755 - protein, 11 aa, Influenza virus
YKDIILWFSFG

SEQ ID NO: 398756 - protein, 11 aa, Influenza virus
KDIILWFSFGA

SEQ ID NO: 398757 - protein, 11 aa, Influenza virus
DIILWFSFGAS

SEQ ID NO: 398758 - protein, 11 aa, Influenza virus
IILWFSFGASC

SEQ ID NO: 398759 - protein, 11 aa, Influenza virus
LWFSFGASCFI

SEQ ID NO: 398760 - protein, 11 aa, Influenza virus
WFSFGASCFIL

SEQ ID NO: 398761 - protein, 11 aa, Influenza virus
FSFGASCFILL

SEQ ID NO: 398762 - protein, 11 aa, Influenza virus
SFGASCFILLA

SEQ ID NO: 398763 - protein, 11 aa, Influenza virus
FGASCFILLAV

SEQ ID NO: 398764 - protein, 11 aa, Influenza virus
VMGLVFFCLKN

SEQ ID NO: 398765 - protein, 11 aa, Influenza virus
MGLVFFCLRNG

SEQ ID NO: 398766 - protein, 11 aa, Influenza virus
GLVFFCLRNGN

SEQ ID NO: 398767 - protein, 11 aa, Influenza virus
LVFFCLRNGNM

SEQ ID NO: 398768 - protein, 11 aa, Influenza virus
VFFCLRNGNMR

SEQ ID NO: 398769 - protein, 11 aa, Influenza virus
FFCLRNGNMRC

SEQ ID NO: 398770 - protein, 11 aa, Influenza virus
FCLRNGNMRCT

SEQ ID NO: 398771 - protein, 11 aa, Influenza virus
CLRNGNMRCTI

SEQ ID NO: 398772 - protein, 11 aa, Influenza virus
LRNGNMRCTIC

SEQ ID NO: 398773 - protein, 11 aa, Influenza virus
RNGNMRCTICI

SEQ ID NO: 398774 - protein, 11 aa, Influenza virus
MNPNQKLFTLS

SEQ ID NO: 398775 - protein, 11 aa, Influenza virus
NPNQKLFTLSG

SEQ ID NO: 398776 - protein, 11 aa, Influenza virus
PNQKLFTLSGV

SEQ ID NO: 398777 - protein, 11 aa, Influenza virus
NQKLFTLSGVA

SEQ ID NO: 398778 - protein, 11 aa, Influenza virus
QKLFTLSGVAI

SEQ ID NO: 398779 - protein, 11 aa, Influenza virus
KLFTLSGVAIA

SEQ ID NO: 398780 - protein, 11 aa, Influenza virus
LFTLSGVAIAL

SEQ ID NO: 398781 - protein, 11 aa, Influenza virus
LNLIIGISNVG

SEQ ID NO: 398782 - protein, 11 aa, Influenza virus
NLIIGISNVGL

SEQ ID NO: 398783 - protein, 11 aa, Influenza virus
LIIGISNVGLN

SEQ ID NO: 398784 - protein, 11 aa, Influenza virus
IIGISNVGLNV

SEQ ID NO: 398785 - protein, 11 aa, Influenza virus
IGISNVGLKVS

SEQ ID NO: 398786 - protein, 11 aa, Influenza virus
GISNVGLKVSL

SEQ ID NO: 398787 - protein, 11 aa, Influenza virus
ISNVGLNISLH

SEQ ID NO: 398788 - protein, 11 aa, Influenza virus
SNVGLNISLHL

SEQ ID NO: 398789 - protein, 11 aa, Influenza virus
NVGLNISLHLK

SEQ ID NO: 398790 - protein, 11 aa, Influenza virus
EKGAKQEENLT

SEQ ID NO: 398791 - protein, 11 aa, Influenza virus
TQNNTTVVENT

SEQ ID NO: 398792 - protein, 11 aa, Influenza virus
QNNTTVVENTY

SEQ ID NO: 398793 - protein, 11 aa, Influenza virus
NNTTVVENTYV

SEQ ID NO: 398794 - protein, 11 aa, Influenza virus
NTTVVENTYVN

SEQ ID NO: 398795 - protein, 11 aa, Influenza virus
TTVVENTYVNN

SEQ ID NO: 398796 - protein, 11 aa, Influenza virus
TVVENTYVNNT

SEQ ID NO: 398797 - protein, 11 aa, Influenza virus
VVENTYVNNTT

SEQ ID NO: 398798 - protein, 11 aa, Influenza virus
VENTYVNNTTI

SEQ ID NO: 398799 - protein, 11 aa, Influenza virus
ENTYVNNTTII

SEQ ID NO: 398800 - protein, 11 aa, Influenza virus
YLVLNKSLCKV

SEQ ID NO: 398801 - protein, 11 aa, Influenza virus
LVLNKSLCKVE

SEQ ID NO: 398802 - protein, 11 aa, Influenza virus
LNKSLCNVEGW

SEQ ID NO: 398803 - protein, 11 aa, Influenza virus
NKSLCNVEGWV

SEQ ID NO: 398804 - protein, 11 aa, Influenza virus
KSLCNVEGWVV

SEQ ID NO: 398805 - protein, 11 aa, Influenza virus
SLCNVEGWVVI

SEQ ID NO: 398806 - protein, 11 aa, Influenza virus
LCNVEGWVVIA

SEQ ID NO: 398807 - protein, 11 aa, Influenza virus
CNVEGWVVIAK

SEQ ID NO: 398808 - protein, 11 aa, Influenza virus
NVEGWVVIAKD

SEQ ID NO: 398809 - protein, 11 aa, Influenza virus
VEGWVVIAKDN

SEQ ID NO: 398810 - protein, 11 aa, Influenza virus
EGWVVIAKDNA

SEQ ID NO: 398811 - protein, 11 aa, Influenza virus
GWVVIAKDNAV

SEQ ID NO: 398812 - protein, 11 aa, Influenza virus
WVVIAKDNAVR

SEQ ID NO: 398813 - protein, 11 aa, Influenza virus
VVIAKDNAVRF

SEQ ID NO: 398814 - protein, 11 aa, Influenza virus
VIAKDNAVRFG

SEQ ID NO: 398815 - protein, 11 aa, Influenza virus
IAKDNAVRFGE

SEQ ID NO: 398816 - protein, 11 aa, Influenza virus
AKDNAVRFGES

SEQ ID NO: 398817 - protein, 11 aa, Influenza virus
KDNAVRFGESE

SEQ ID NO: 398818 - protein, 11 aa, Influenza virus
DNAVRFGESEQ

SEQ ID NO: 398819 - protein, 11 aa, Influenza virus
NAVRFGESEQI

SEQ ID NO: 398820 - protein, 11 aa, Influenza virus
AIRFGESEQVI

SEQ ID NO: 398821 - protein, 11 aa, Influenza virus
VRFGESEQIIV

SEQ ID NO: 398822 - protein, 11 aa, Influenza virus
RFGESEQVIVT

SEQ ID NO: 398823 - protein, 11 aa, Influenza virus
FGESEQVIVTR

SEQ ID NO: 398824 - protein, 11 aa, Influenza virus
GESEQVIVTRE

SEQ ID NO: 398825 - protein, 11 aa, Influenza virus
ESEQVIVTREP

SEQ ID NO: 398826 - protein, 11 aa, Influenza virus
SEQVIVTREPY

SEQ ID NO: 398827 - protein, 11 aa, Influenza virus
EQVIVTREPYV

SEQ ID NO: 398828 - protein, 11 aa, Influenza virus
QVIVTREPYVS

SEQ ID NO: 398829 - protein, 11 aa, Influenza virus
VIVTREPYVSC

SEQ ID NO: 398830 - protein, 11 aa, Influenza virus
TREPYVSCDPS

SEQ ID NO: 398831 - protein, 11 aa, Influenza virus
REPYVSCDPTG

SEQ ID NO: 398832 - protein, 11 aa, Influenza virus
EPYVSCDPTGC

SEQ ID NO: 398833 - protein, 11 aa, Influenza virus
PYVSCDPLGCR

SEQ ID NO: 398834 - protein, 11 aa, Influenza virus
YVSCDPLGCRM

SEQ ID NO: 398835 - protein, 11 aa, Influenza virus
VSCDPLGCRMY

SEQ ID NO: 398836 - protein, 11 aa, Influenza virus
SCDPLGCRMYA

SEQ ID NO: 398837 - protein, 11 aa, Influenza virus
CDPLGCRMYAL

SEQ ID NO: 398838 - protein, 11 aa, Influenza virus
DPLGCRMYALH

SEQ ID NO: 398839 - protein, 11 aa, Influenza virus
PLGCRMYALHQ

SEQ ID NO: 398840 - protein, 11 aa, Influenza virus
LGCRMYALHQG

SEQ ID NO: 398841 - protein, 11 aa, Influenza virus
GCRMYALHQGT

SEQ ID NO: 398842 - protein, 11 aa, Influenza virus
CRMYALHQGTT

SEQ ID NO: 398843 - protein, 11 aa, Influenza virus
RMYALHQGTTI

SEQ ID NO: 398844 - protein, 11 aa, Influenza virus
ALHQGTTIRNR

SEQ ID NO: 398845 - protein, 11 aa, Influenza virus
LHQGTTIRNRH

SEQ ID NO: 398846 - protein, 11 aa, Influenza virus
HQGTTIRNRHS

SEQ ID NO: 398847 - protein, 11 aa, Influenza virus
QGTTIRNRHSN

SEQ ID NO: 398848 - protein, 11 aa, Influenza virus
GTTIRNRHSNG

SEQ ID NO: 398849 - protein, 11 aa, Influenza virus
TTIRNRHSNGT

SEQ ID NO: 398850 - protein, 11 aa, Influenza virus
TIRNRHSNGTI

SEQ ID NO: 398851 - protein, 11 aa, Influenza virus
IRNRHSNGTIH

SEQ ID NO: 398852 - protein, 11 aa, Influenza virus
RNRHSNGTIHD

SEQ ID NO: 398853 - protein, 11 aa, Influenza virus
NRHSNGTIHDR

SEQ ID NO: 398854 - protein, 11 aa, Influenza virus
RHSNGTIHDRT

SEQ ID NO: 398855 - protein, 11 aa, Influenza virus
IHDRTAFRGLM

SEQ ID NO: 398856 - protein, 11 aa, Influenza virus
HDRTAFRGLMS

SEQ ID NO: 398857 - protein, 11 aa, Influenza virus
DRTAFRGLMST

SEQ ID NO: 398858 - protein, 11 aa, Influenza virus
RTAFRGLMSTP

SEQ ID NO: 398859 - protein, 11 aa, Influenza virus
TAFRGLMSTPL

SEQ ID NO: 398860 - protein, 11 aa, Influenza virus
AFRGLMSTPLG

SEQ ID NO: 398861 - protein, 11 aa, Influenza virus
FRGLISTPLGT

SEQ ID NO: 398862 - protein, 11 aa, Influenza virus
RGLISTPLGTP

SEQ ID NO: 398863 - protein, 11 aa, Influenza virus
GLISTPLGTPP

SEQ ID NO: 398864 - protein, 11 aa, Influenza virus
LISTPLGSPPV

SEQ ID NO: 398865 - protein, 11 aa, Influenza virus
ISTPLGSPPVV

SEQ ID NO: 398866 - protein, 11 aa, Influenza virus
STPLGSPPVVS

SEQ ID NO: 398867 - protein, 11 aa, Influenza virus
TPLGSPPVVSN

SEQ ID NO: 398868 - protein, 11 aa, Influenza virus
PLGSPPVVSNS

SEQ ID NO: 398869 - protein, 11 aa, Influenza virus
LGSPPVVSNSD

SEQ ID NO: 398870 - protein, 11 aa, Influenza virus
GSPPVVSNSDF

SEQ ID NO: 398871 - protein, 11 aa, Influenza virus
VSNSEFLCVGW

SEQ ID NO: 398872 - protein, 11 aa, Influenza virus
SNSEFLCVGWS

SEQ ID NO: 398873 - protein, 11 aa, Influenza virus
NSEFLCVGWSS

SEQ ID NO: 398874 - protein, 11 aa, Influenza virus
SEFLCVGWSST

SEQ ID NO: 398875 - protein, 11 aa, Influenza virus
EFLCVGWSSTS

SEQ ID NO: 398876 - protein, 11 aa, Influenza virus
FICVGWSSTSC

SEQ ID NO: 398877 - protein, 11 aa, Influenza virus
ICVGWSSTSCH

SEQ ID NO: 398878 - protein, 11 aa, Influenza virus
CVGWSSTTCHD

SEQ ID NO: 398879 - protein, 11 aa, Influenza virus
VGWSSTTCHDG

SEQ ID NO: 398880 - protein, 11 aa, Influenza virus
GWSSTSCHDGV

SEQ ID NO: 398881 - protein, 11 aa, Influenza virus
WSSTSCHDGVG

SEQ ID NO: 398882 - protein, 11 aa, Influenza virus
SSTSCHDGVGR

SEQ ID NO: 398883 - protein, 11 aa, Influenza virus
STSCHDGVGRM

SEQ ID NO: 398884 - protein, 11 aa, Influenza virus
TSCHDGVGRMT

SEQ ID NO: 398885 - protein, 11 aa, Influenza virus
SCHDGVGRMTI

SEQ ID NO: 398886 - protein, 11 aa, Influenza virus
CHDGVGRMTIC

SEQ ID NO: 398887 - protein, 11 aa, Influenza virus
HDGVGRMTICV

SEQ ID NO: 398888 - protein, 11 aa, Influenza virus
DGVGRMTICVQ

SEQ ID NO: 398889 - protein, 11 aa, Influenza virus
GVGRMTICVQG

SEQ ID NO: 398890 - protein, 11 aa, Influenza virus
VGRMTICVQGN

SEQ ID NO: 398891 - protein, 11 aa, Influenza virus
GRMTICIQGNN

SEQ ID NO: 398892 - protein, 11 aa, Influenza virus
RMTICVQGNNN

SEQ ID NO: 398893 - protein, 11 aa, Influenza virus
MTICVQGNNNN

SEQ ID NO: 398894 - protein, 11 aa, Influenza virus
TICVQGNNNNA

SEQ ID NO: 398895 - protein, 11 aa, Influenza virus
ICVQGNNNNAT

SEQ ID NO: 398896 - protein, 11 aa, Influenza virus
CVQGNNNNATA

SEQ ID NO: 398897 - protein, 11 aa, Influenza virus
VQGNNNNATAT

SEQ ID NO: 398898 - protein, 11 aa, Influenza virus
QGNNNNATATV

SEQ ID NO: 398899 - protein, 11 aa, Influenza virus
GNNNNATATVY

SEQ ID NO: 398900 - protein, 11 aa, Influenza virus
NNNNATATVYY

SEQ ID NO: 398901 - protein, 11 aa, Influenza virus
NNNATATVYYD

SEQ ID NO: 398902 - protein, 11 aa, Influenza virus
NNATATVYYDR

SEQ ID NO: 398903 - protein, 11 aa, Influenza virus
NATATVYYNRR

SEQ ID NO: 398904 - protein, 11 aa, Influenza virus
ATATVYYNRRL

SEQ ID NO: 398905 - protein, 11 aa, Influenza virus
TATVYYNRRLT

SEQ ID NO: 398906 - protein, 11 aa, Influenza virus
ATVYYNRRLTT

SEQ ID NO: 398907 - protein, 11 aa, Influenza virus
TVYYNRRLTTT

SEQ ID NO: 398908 - protein, 11 aa, Influenza virus
VYYNRRLTTTI

SEQ ID NO: 398909 - protein, 11 aa, Influenza virus
YYNRRLTTTIK

SEQ ID NO: 398910 - protein, 11 aa, Influenza virus
YNRRLTTTIKP

SEQ ID NO: 398911 - protein, 11 aa, Influenza virus
NRRLTTTIKTW

SEQ ID NO: 398912 - protein, 11 aa, Influenza virus
RRLTTTIKPWA

SEQ ID NO: 398913 - protein, 11 aa, Influenza virus
RLTTTIKTWAR

SEQ ID NO: 398914 - protein, 11 aa, Influenza virus
LTTTIKTWARN

SEQ ID NO: 398915 - protein, 11 aa, Influenza virus
TTTIKTWARNI

SEQ ID NO: 398916 - protein, 11 aa, Influenza virus
TTIKTWARNIL

SEQ ID NO: 398917 - protein, 11 aa, Influenza virus
TIKTWARNILR

SEQ ID NO: 398918 - protein, 11 aa, Influenza virus
IKTWARNILRT

SEQ ID NO: 398919 - protein, 11 aa, Influenza virus
KTWARNILRTQ

SEQ ID NO: 398920 - protein, 11 aa, Influenza virus
TWARNILRTQE

SEQ ID NO: 398921 - protein, 11 aa, Influenza virus
WARNILRTQES

SEQ ID NO: 398922 - protein, 11 aa, Influenza virus
ARNILRTQESE

SEQ ID NO: 398923 - protein, 11 aa, Influenza virus
RNILRTQESEC

SEQ ID NO: 398924 - protein, 11 aa, Influenza virus
KILRTQESECV

SEQ ID NO: 398925 - protein, 11 aa, Influenza virus
SECVCHNGTCA

SEQ ID NO: 398926 - protein, 11 aa, Influenza virus
ECVCHNGTCAV

SEQ ID NO: 398927 - protein, 11 aa, Influenza virus
CVCHNGTCVVV

SEQ ID NO: 398928 - protein, 11 aa, Influenza virus
VCHNGTCVVVM

SEQ ID NO: 398929 - protein, 11 aa, Influenza virus
CHNGTCVVVMT

SEQ ID NO: 398930 - protein, 11 aa, Influenza virus
HNGTCVVVMTD

SEQ ID NO: 398931 - protein, 11 aa, Influenza virus
NGTCVVVMTDG

SEQ ID NO: 398932 - protein, 11 aa, Influenza virus
GTCVVVMTDGS

SEQ ID NO: 398933 - protein, 11 aa, Influenza virus
TCVVVMTDGSA

SEQ ID NO: 398934 - protein, 11 aa, Influenza virus
CVVVMTDGSAS

SEQ ID NO: 398935 - protein, 11 aa, Influenza virus
VVMTDGSASSQ

SEQ ID NO: 398936 - protein, 11 aa, Influenza virus
VMTDGSASSQA

SEQ ID NO: 398937 - protein, 11 aa, Influenza virus
MTDGSASSQAH

SEQ ID NO: 398938 - protein, 11 aa, Influenza virus
TDGSASSQAHT

SEQ ID NO: 398939 - protein, 11 aa, Influenza virus
DGSASSQAHTK

SEQ ID NO: 398940 - protein, 11 aa, Influenza virus
QAHTKVLYFHK

SEQ ID NO: 398941 - protein, 11 aa, Influenza virus
AHTKVLYFHKG

SEQ ID NO: 398942 - protein, 11 aa, Influenza virus
YFHKGLIIKEE

SEQ ID NO: 398943 - protein, 11 aa, Influenza virus
KEEPLKGSAKH

SEQ ID NO: 398944 - protein, 11 aa, Influenza virus
LKGSAKHIEEC

SEQ ID NO: 398945 - protein, 11 aa, Influenza virus
KGSAKHIEECS

SEQ ID NO: 398946 - protein, 11 aa, Influenza virus
GSAKHIEECSC

SEQ ID NO: 398947 - protein, 11 aa, Influenza virus
SAKHIEECSCY

SEQ ID NO: 398948 - protein, 11 aa, Influenza virus
AKHIEECSCYG

SEQ ID NO: 398949 - protein, 11 aa, Influenza virus
KHIEECSCYGH

SEQ ID NO: 398950 - protein, 11 aa, Influenza virus
HIEECSCYGHD

SEQ ID NO: 398951 - protein, 11 aa, Influenza virus
IEECSCYGHDS

SEQ ID NO: 398952 - protein, 11 aa, Influenza virus
EECSCYGHDSK

SEQ ID NO: 398953 - protein, 11 aa, Influenza virus
QKVTCVCRDNW

SEQ ID NO: 398954 - protein, 11 aa, Influenza virus
KITCVCRDNWQ

SEQ ID NO: 398955 - protein, 11 aa, Influenza virus
ITCVCRDNWQG

SEQ ID NO: 398956 - protein, 11 aa, Influenza virus
RDNWQGANRPI

SEQ ID NO: 398957 - protein, 11 aa, Influenza virus
DNWQGANRPII

SEQ ID NO: 398958 - protein, 11 aa, Influenza virus
NWQGANRPIIE

SEQ ID NO: 398959 - protein, 11 aa, Influenza virus
WQGANRPIIEI

SEQ ID NO: 398960 - protein, 11 aa, Influenza virus
QGANRPVIKID

SEQ ID NO: 398961 - protein, 11 aa, Influenza virus
GANRPVIKIDM

SEQ ID NO: 398962 - protein, 11 aa, Influenza virus
TLEHTSRYVCT

SEQ ID NO: 398963 - protein, 11 aa, Influenza virus
LEHTSRYVCTG

SEQ ID NO: 398964 - protein, 11 aa, Influenza virus
EHTSRYVCTGI

SEQ ID NO: 398965 - protein, 11 aa, Influenza virus
HTSRYVCTGIL

SEQ ID NO: 398966 - protein, 11 aa, Influenza virus
TSRYVCTGILT

SEQ ID NO: 398967 - protein, 11 aa, Influenza virus
SRYVCTGILTD

SEQ ID NO: 398968 - protein, 11 aa, Influenza virus
RYVCTGILTDT

SEQ ID NO: 398969 - protein, 11 aa, Influenza virus
YVCTGILTDTS

SEQ ID NO: 398970 - protein, 11 aa, Influenza virus
VCTGILTDTSR

SEQ ID NO: 398971 - protein, 11 aa, Influenza virus
CTGILTDTSRP

SEQ ID NO: 398972 - protein, 11 aa, Influenza virus
TGILTDTSRPG

SEQ ID NO: 398973 - protein, 11 aa, Influenza virus
GILTDTSRPGD

SEQ ID NO: 398974 - protein, 11 aa, Influenza virus
ILTDTSRPGDK

SEQ ID NO: 398975 - protein, 11 aa, Influenza virus
GDCSNPITGSP

SEQ ID NO: 398976 - protein, 11 aa, Influenza virus
DCSNPITGSPG

SEQ ID NO: 398977 - protein, 11 aa, Influenza virus
CSNPITGSPGA

SEQ ID NO: 398978 - protein, 11 aa, Influenza virus
SNPITGSPGAP

SEQ ID NO: 398979 - protein, 11 aa, Influenza virus
NPITGSPSAPG

SEQ ID NO: 398980 - protein, 11 aa, Influenza virus
PITGSPSAPGV

SEQ ID NO: 398981 - protein, 11 aa, Influenza virus
ITGSPSAPGVK

SEQ ID NO: 398982 - protein, 11 aa, Influenza virus
TGSPSAPGVKG

SEQ ID NO: 398983 - protein, 11 aa, Influenza virus
GSPSAPGVKGF

SEQ ID NO: 398984 - protein, 11 aa, Influenza virus
SPSAPGVKGFG

SEQ ID NO: 398985 - protein, 11 aa, Influenza virus
PSAPGVKGFGF

SEQ ID NO: 398986 - protein, 11 aa, Influenza virus
SAPGVKGFGFL

SEQ ID NO: 398987 - protein, 11 aa, Influenza virus
APGVKGFGFLN

SEQ ID NO: 398988 - protein, 11 aa, Influenza virus
PGVKGFGFLNG

SEQ ID NO: 398989 - protein, 11 aa, Influenza virus
SNTWLGRTISP

SEQ ID NO: 398990 - protein, 11 aa, Influenza virus
NTWLGGTISPR

SEQ ID NO: 398991 - protein, 11 aa, Influenza virus
TWLGRTISPHS

SEQ ID NO: 398992 - protein, 11 aa, Influenza virus
WLGGTISPRSR

SEQ ID NO: 398993 - protein, 11 aa, Influenza virus
LGRTFSPRSRS

SEQ ID NO: 398994 - protein, 11 aa, Influenza virus
GGTISPRSRSG

SEQ ID NO: 398995 - protein, 11 aa, Influenza virus
RTISPHSRSGF

SEQ ID NO: 398996 - protein, 11 aa, Influenza virus
TISPHSRSGFE

SEQ ID NO: 398997 - protein, 11 aa, Influenza virus
ISPHSRSGFEM

SEQ ID NO: 398998 - protein, 11 aa, Influenza virus
RSRSGFEMLKV

SEQ ID NO: 398999 - protein, 11 aa, Influenza virus
SRSGFEMLKVP

SEQ ID NO: 399000 - protein, 11 aa, Influenza virus
RSGFEMLKVPN

SEQ ID NO: 399001 - protein, 11 aa, Influenza virus
SGFEMLKVPNA

SEQ ID NO: 399002 - protein, 11 aa, Influenza virus
GFEMLKIPNAE

SEQ ID NO: 399003 - protein, 11 aa, Influenza virus
FEMLKIPNAET

SEQ ID NO: 399004 - protein, 11 aa, Influenza virus
EMLKIPNAETD

SEQ ID NO: 399005 - protein, 11 aa, Influenza virus
MLKIPNAETDP

SEQ ID NO: 399006 - protein, 11 aa, Influenza virus
LKIPNAETDPN

SEQ ID NO: 399007 - protein, 11 aa, Influenza virus
KIPNAETDPNS

SEQ ID NO: 399008 - protein, 11 aa, Influenza virus
NSNWSGYSGSF

SEQ ID NO: 399009 - protein, 11 aa, Influenza virus
SNWSGYSGSFI

SEQ ID NO: 399010 - protein, 11 aa, Influenza virus
NLSGYSGSFID

SEQ ID NO: 399011 - protein, 11 aa, Influenza virus
GYSGSFIDYWN

SEQ ID NO: 399012 - protein, 11 aa, Influenza virus
YSGSFIDYWDD

SEQ ID NO: 399013 - protein, 11 aa, Influenza virus
NECYNPCFYVE

SEQ ID NO: 399014 - protein, 11 aa, Influenza virus
VCYNPCFYVEL

SEQ ID NO: 399015 - protein, 11 aa, Influenza virus
VELIRGRPEEV

SEQ ID NO: 399016 - protein, 11 aa, Influenza virus
ELIRGRPEEVK

SEQ ID NO: 399017 - protein, 11 aa, Influenza virus
LIRGRPEEVKY

SEQ ID NO: 399018 - protein, 11 aa, Influenza virus
IRGRPEEVKYV

SEQ ID NO: 399019 - protein, 11 aa, Influenza virus
RGRPEEVKYVW

SEQ ID NO: 399020 - protein, 11 aa, Influenza virus
GRPEEVKYVWW

SEQ ID NO: 399021 - protein, 11 aa, Influenza virus
RPEEVKYVWWT

SEQ ID NO: 399022 - protein, 11 aa, Influenza virus
PEEVKYVWWTS

SEQ ID NO: 399023 - protein, 11 aa, Influenza virus
EEVKYVWWTSN

SEQ ID NO: 399024 - protein, 11 aa, Influenza virus
EVKYVWWTSNS

SEQ ID NO: 399025 - protein, 11 aa, Influenza virus
VKYVWWTSNSL

SEQ ID NO: 399026 - protein, 11 aa, Influenza virus
KYVWWTSNSLI

SEQ ID NO: 399027 - protein, 11 aa, Influenza virus
YVWWTSNSLIA

SEQ ID NO: 399028 - protein, 11 aa, Influenza virus
VWWTSNSLIAL

SEQ ID NO: 399029 - protein, 11 aa, Influenza virus
WWTSNSLIALC

SEQ ID NO: 399030 - protein, 11 aa, Influenza virus
WTSNSLIALCG

SEQ ID NO: 399031 - protein, 11 aa, Influenza virus
TSNSLIALCGS

SEQ ID NO: 399032 - protein, 11 aa, Influenza virus
SNSLIALCGSP

SEQ ID NO: 399033 - protein, 11 aa, Influenza virus
NSLVALCGSPV

SEQ ID NO: 399034 - protein, 11 aa, Influenza virus
SLVALCGSPVS

SEQ ID NO: 399035 - protein, 11 aa, Influenza virus
LVALCGSPVSV

SEQ ID NO: 399036 - protein, 11 aa, Influenza virus
VALCGSPVSVG

SEQ ID NO: 399037 - protein, 11 aa, Influenza virus
ALCGSPVSVGS

SEQ ID NO: 399038 - protein, 11 aa, Influenza virus
LCGSPVSVGSG

SEQ ID NO: 399039 - protein, 11 aa, Influenza virus
CGSPVSVGSGS

SEQ ID NO: 399040 - protein, 11 aa, Influenza virus
GSPVSVGSGSF

SEQ ID NO: 399041 - protein, 11 aa, Influenza virus
SPVSVGSGSFP

SEQ ID NO: 399042 - protein, 11 aa, Influenza virus
PVSVGSGSFPD

SEQ ID NO: 399043 - protein, 11 aa, Influenza virus
VSVGSGSFPDG

SEQ ID NO: 399044 - protein, 11 aa, Influenza virus
PVGSGSFPDGA

SEQ ID NO: 399045 - protein, 11 aa, Influenza virus
VGSGSFPNGAQ

SEQ ID NO: 399046 - protein, 11 aa, Influenza virus
GSGSFPDGAKI

SEQ ID NO: 399047 - protein, 11 aa, Influenza virus
SGSFPDGAKIQ

SEQ ID NO: 399048 - protein, 11 aa, Influenza virus
GSFPNGAQIQY

SEQ ID NO: 399049 - protein, 11 aa, Influenza virus
SFPNGAQIQYF

SEQ ID NO: 399050 - protein, 11 aa, Influenza virus
FPNGAQIQYFS

SEQ ID NO: 399051 - protein, 11 aa, Influenza virus
KADEICIGYLS

SEQ ID NO: 399052 - protein, 11 aa, Influenza virus
ADEICIGYMSN

SEQ ID NO: 399053 - protein, 11 aa, Influenza virus
DEICIGYMSNN

SEQ ID NO: 399054 - protein, 11 aa, Influenza virus
EICIGYMSNNS

SEQ ID NO: 399055 - protein, 11 aa, Influenza virus
ICIGYMSNNST

SEQ ID NO: 399056 - protein, 11 aa, Influenza virus
CIGYLSNNSTD

SEQ ID NO: 399057 - protein, 11 aa, Influenza virus
IGYLSNNSTDK

SEQ ID NO: 399058 - protein, 11 aa, Influenza virus
GYLSNNSTDKV

SEQ ID NO: 399059 - protein, 11 aa, Influenza virus
LSNNSTDKVDT

SEQ ID NO: 399060 - protein, 11 aa, Influenza virus
SNNSTDKVDTI

SEQ ID NO: 399061 - protein, 11 aa, Influenza virus
NNSTDKVDTII

SEQ ID NO: 399062 - protein, 11 aa, Influenza virus
NSTDKVDTIIE

SEQ ID NO: 399063 - protein, 11 aa, Influenza virus
STDKVDTIIEN

SEQ ID NO: 399064 - protein, 11 aa, Influenza virus
TDKVDTIIENN

SEQ ID NO: 399065 - protein, 11 aa, Influenza virus
KVDTIIENNVT

SEQ ID NO: 399066 - protein, 11 aa, Influenza virus
VDTIIENNVTV

SEQ ID NO: 399067 - protein, 11 aa, Influenza virus
DTIIENNVTVT

SEQ ID NO: 399068 - protein, 11 aa, Influenza virus
TIIENNVTVTS

SEQ ID NO: 399069 - protein, 11 aa, Influenza virus
IIENNVTVTSS

SEQ ID NO: 399070 - protein, 11 aa, Influenza virus
IENNVTVTSSV

SEQ ID NO: 399071 - protein, 11 aa, Influenza virus
ENNVTVTSSVE

SEQ ID NO: 399072 - protein, 11 aa, Influenza virus
NNVTVTSSVEL

SEQ ID NO: 399073 - protein, 11 aa, Influenza virus
NVTVTSSIELV

SEQ ID NO: 399074 - protein, 11 aa, Influenza virus
VTVTSSIELVE

SEQ ID NO: 399075 - protein, 11 aa, Influenza virus
TVTSSVELVET

SEQ ID NO: 399076 - protein, 11 aa, Influenza virus
HTGSFCSINGK

SEQ ID NO: 399077 - protein, 11 aa, Influenza virus
FCSINGKQPIS

SEQ ID NO: 399078 - protein, 11 aa, Influenza virus
CSINGKQPISL

SEQ ID NO: 399079 - protein, 11 aa, Influenza virus
SINGKQPISLG

SEQ ID NO: 399080 - protein, 11 aa, Influenza virus
NGKQPISLGDC

SEQ ID NO: 399081 - protein, 11 aa, Influenza virus
GKQPISLGDCS

SEQ ID NO: 399082 - protein, 11 aa, Influenza virus
KQPISLGDCSF

SEQ ID NO: 399083 - protein, 11 aa, Influenza virus
QPISLGDCSFA

SEQ ID NO: 399084 - protein, 11 aa, Influenza virus
PISLGDCSFTG

SEQ ID NO: 399085 - protein, 11 aa, Influenza virus
ISLGDCSFTGW

SEQ ID NO: 399086 - protein, 11 aa, Influenza virus
SLGDCSFAGWL

SEQ ID NO: 399087 - protein, 11 aa, Influenza virus
LGDCSFAGWLL

SEQ ID NO: 399088 - protein, 11 aa, Influenza virus
GGCSFAGWILG

SEQ ID NO: 399089 - protein, 11 aa, Influenza virus
DCSFAGWLLGN

SEQ ID NO: 399090 - protein, 11 aa, Influenza virus
CSFTGWILGNP

SEQ ID NO: 399091 - protein, 11 aa, Influenza virus
SFAGWILGNPR

SEQ ID NO: 399092 - protein, 11 aa, Influenza virus
FAGWILGNPRC

SEQ ID NO: 399093 - protein, 11 aa, Influenza virus
AGWILGNPRCD

SEQ ID NO: 399094 - protein, 11 aa, Influenza virus
GWILGNPMCDE

SEQ ID NO: 399095 - protein, 11 aa, Influenza virus
WILGNPMCDEL

SEQ ID NO: 399096 - protein, 11 aa, Influenza virus
ILGNPMCDELI

SEQ ID NO: 399097 - protein, 11 aa, Influenza virus
LGNPMCDELIG

SEQ ID NO: 399098 - protein, 11 aa, Influenza virus
GNPMCDELIGK

SEQ ID NO: 399099 - protein, 11 aa, Influenza virus
CDELIGKTSWS

SEQ ID NO: 399100 - protein, 11 aa, Influenza virus
DELIGKTSWSY

SEQ ID NO: 399101 - protein, 11 aa, Influenza virus
ELIGKTSWSYI

SEQ ID NO: 399102 - protein, 11 aa, Influenza virus
LIGKNSWSYIV

SEQ ID NO: 399103 - protein, 11 aa, Influenza virus
IEKTSWSYIVE

SEQ ID NO: 399104 - protein, 11 aa, Influenza virus
GKTSWSYIVER

SEQ ID NO: 399105 - protein, 11 aa, Influenza virus
KNSWSYIVEKP

SEQ ID NO: 399106 - protein, 11 aa, Influenza virus
NSWSYIVEKPN

SEQ ID NO: 399107 - protein, 11 aa, Influenza virus
SWSYIVERPNP

SEQ ID NO: 399108 - protein, 11 aa, Influenza virus
INGQAGRMTFY

SEQ ID NO: 399109 - protein, 11 aa, Influenza virus
GQAGRMTFYWK

SEQ ID NO: 399110 - protein, 11 aa, Influenza virus
QAGRMTFYWKI

SEQ ID NO: 399111 - protein, 11 aa, Influenza virus
TFESNGAFIAP

SEQ ID NO: 399112 - protein, 11 aa, Influenza virus
FESNGAFIAPR

SEQ ID NO: 399113 - protein, 11 aa, Influenza virus
ESNGAFIAPRY

SEQ ID NO: 399114 - protein, 11 aa, Influenza virus
SVHRNTIGDCP

SEQ ID NO: 399115 - protein, 11 aa, Influenza virus
VHRNTFGDCPK

SEQ ID NO: 399116 - protein, 11 aa, Influenza virus
HRNTIGNCPKY

SEQ ID NO: 399117 - protein, 11 aa, Influenza virus
RNTIGDCPKYM

SEQ ID NO: 399118 - protein, 11 aa, Influenza virus
NTIGDCPKYMN

SEQ ID NO: 399119 - protein, 11 aa, Influenza virus
TIGDCPKYMNV

SEQ ID NO: 399120 - protein, 11 aa, Influenza virus
IGDCPKYVNVR

SEQ ID NO: 399121 - protein, 11 aa, Influenza virus
GDCPKYVNVRS

SEQ ID NO: 399122 - protein, 11 aa, Influenza virus
DCPKYMNVKSL

SEQ ID NO: 399123 - protein, 11 aa, Influenza virus
CPKYMNVKSLK

SEQ ID NO: 399124 - protein, 11 aa, Influenza virus
PKYVNVRSLKL

SEQ ID NO: 399125 - protein, 11 aa, Influenza virus
KYVNVRSLKLA

SEQ ID NO: 399126 - protein, 11 aa, Influenza virus
KSLKLATGPRN

SEQ ID NO: 399127 - protein, 11 aa, Influenza virus
SLKLATGLRNI

SEQ ID NO: 399128 - protein, 11 aa, Influenza virus
LKLATGLRNIP

SEQ ID NO: 399129 - protein, 11 aa, Influenza virus
KLATGLRNIPA

SEQ ID NO: 399130 - protein, 11 aa, Influenza virus
SRGLFGAIAGF

SEQ ID NO: 399131 - protein, 11 aa, Influenza virus
RGLFGAKAGFI

SEQ ID NO: 399132 - protein, 11 aa, Influenza virus
GLFGAKAGFIE

SEQ ID NO: 399133 - protein, 11 aa, Influenza virus
LFGAKAGFIEG

SEQ ID NO: 399134 - protein, 11 aa, Influenza virus
FGAKAGFIEGG

SEQ ID NO: 399135 - protein, 11 aa, Influenza virus
GAKAGFIEGGW

SEQ ID NO: 399136 - protein, 11 aa, Influenza virus
AKAGFIEGGWP

SEQ ID NO: 399137 - protein, 11 aa, Influenza virus
KAGFIEGGWPG

SEQ ID NO: 399138 - protein, 11 aa, Influenza virus
INGWYGFQHRD

SEQ ID NO: 399139 - protein, 11 aa, Influenza virus
NGWYGFQHRND

SEQ ID NO: 399140 - protein, 11 aa, Influenza virus
GWYGFQHRNDE

SEQ ID NO: 399141 - protein, 11 aa, Influenza virus
WYGFQHRDEEG

SEQ ID NO: 399142 - protein, 11 aa, Influenza virus
YGFQHRNDEGT

SEQ ID NO: 399143 - protein, 11 aa, Influenza virus
GFQHRNDEGTG

SEQ ID NO: 399144 - protein, 11 aa, Influenza virus
FQHRDEEGTGI

SEQ ID NO: 399145 - protein, 11 aa, Influenza virus
QHRNDEGTGIA

SEQ ID NO: 399146 - protein, 11 aa, Influenza virus
HRDEEGTGIAA

SEQ ID NO: 399147 - protein, 11 aa, Influenza virus
RNDEGTGIAAD

SEQ ID NO: 399148 - protein, 11 aa, Influenza virus
NEEGTGIAADR

SEQ ID NO: 399149 - protein, 11 aa, Influenza virus
EEGTGIAADRE

SEQ ID NO: 399150 - protein, 11 aa, Influenza virus
EGTGIAADRES

SEQ ID NO: 399151 - protein, 11 aa, Influenza virus
GTGIAADREST

SEQ ID NO: 399152 - protein, 11 aa, Influenza virus
TGIAADRESTQ

SEQ ID NO: 399153 - protein, 11 aa, Influenza virus
GIAADRESTQK

SEQ ID NO: 399154 - protein, 11 aa, Influenza virus
NIWSYNAQLLV

SEQ ID NO: 399155 - protein, 11 aa, Influenza virus
IWSYNAQLLVW

SEQ ID NO: 399156 - protein, 11 aa, Influenza virus
WSYNAQLLVWL

SEQ ID NO: 399157 - protein, 11 aa, Influenza virus
SYNAQLLVWLE

SEQ ID NO: 399158 - protein, 11 aa, Influenza virus
YNAQLLVWLEN

SEQ ID NO: 399159 - protein, 11 aa, Influenza virus
NAQLLVWLENE

SEQ ID NO: 399160 - protein, 11 aa, Influenza virus
AQLLVWLENEK

SEQ ID NO: 399161 - protein, 11 aa, Influenza virus
QLLVWLENEKT

SEQ ID NO: 399162 - protein, 11 aa, Influenza virus
LLVWLENEKTL

SEQ ID NO: 399163 - protein, 11 aa, Influenza virus
LVWLENEKTLD

SEQ ID NO: 399164 - protein, 11 aa, Influenza virus
VWLENEKTLDL

SEQ ID NO: 399165 - protein, 11 aa, Influenza virus
WLENEKTLDLH

SEQ ID NO: 399166 - protein, 11 aa, Influenza virus
KTLDLHDSNVT

SEQ ID NO: 399167 - protein, 11 aa, Influenza virus
TLDLHDSNVRS

SEQ ID NO: 399168 - protein, 11 aa, Influenza virus
LDLHDSNVRSL

SEQ ID NO: 399169 - protein, 11 aa, Influenza virus
DLHDSNVRSLH

SEQ ID NO: 399170 - protein, 11 aa, Influenza virus
LHDSNVRSLHE

SEQ ID NO: 399171 - protein, 11 aa, Influenza virus
HDSNVRNLHER

SEQ ID NO: 399172 - protein, 11 aa, Influenza virus
LRDNAKDEGNG

SEQ ID NO: 399173 - protein, 11 aa, Influenza virus
RDNAKDEGNGC

SEQ ID NO: 399174 - protein, 11 aa, Influenza virus
GNAKDEGNGCF

SEQ ID NO: 399175 - protein, 11 aa, Influenza virus
NAKDEGNGCFP

SEQ ID NO: 399176 - protein, 11 aa, Influenza virus
ARDEGNGCFTF

SEQ ID NO: 399177 - protein, 11 aa, Influenza virus
RDEGNGCFTFY

SEQ ID NO: 399178 - protein, 11 aa, Influenza virus
EGNGCFTFYHR

SEQ ID NO: 399179 - protein, 11 aa, Influenza virus
GNGCFTFYHRC

SEQ ID NO: 399180 - protein, 11 aa, Influenza virus
NGCFTFYHKCN

SEQ ID NO: 399181 - protein, 11 aa, Influenza virus
GCFTFYHKCDD

SEQ ID NO: 399182 - protein, 11 aa, Influenza virus
FYHKCDNKCIE

SEQ ID NO: 399183 - protein, 11 aa, Influenza virus
NECIERVRNGT

SEQ ID NO: 399184 - protein, 11 aa, Influenza virus
ECIERVRNGTY

SEQ ID NO: 399185 - protein, 11 aa, Influenza virus
CIERVRNGTYD

SEQ ID NO: 399186 - protein, 11 aa, Influenza virus
IERVRNGTYDH

SEQ ID NO: 399187 - protein, 11 aa, Influenza virus
ERVRNGTYDHK

SEQ ID NO: 399188 - protein, 11 aa, Influenza virus
RVRNGTYDHKE

SEQ ID NO: 399189 - protein, 11 aa, Influenza virus
IRNGTYDHKEF

SEQ ID NO: 399190 - protein, 11 aa, Influenza virus
RNGTYDHKEFK

SEQ ID NO: 399191 - protein, 11 aa, Influenza virus
NGTYDHKEFEK

SEQ ID NO: 399192 - protein, 11 aa, Influenza virus
GTYDHKEFEKE

SEQ ID NO: 399193 - protein, 11 aa, Influenza virus
TYDHKEFEKES

SEQ ID NO: 399194 - protein, 11 aa, Influenza virus
YDHKEFEEESR

SEQ ID NO: 399195 - protein, 11 aa, Influenza virus
ESKINRQEIEG

SEQ ID NO: 399196 - protein, 11 aa, Influenza virus
INRQEIEGVKL

SEQ ID NO: 399197 - protein, 11 aa, Influenza virus
NRQEIEGVRLD

SEQ ID NO: 399198 - protein, 11 aa, Influenza virus
GNIYKILSIYS

SEQ ID NO: 399199 - protein, 11 aa, Influenza virus
NIYKILSIYSC

SEQ ID NO: 399200 - protein, 11 aa, Influenza virus
IYKILSIYSCI

SEQ ID NO: 399201 - protein, 11 aa, Influenza virus
YKILSIYSCVA

SEQ ID NO: 399202 - protein, 11 aa, Influenza virus
KILSIYSCVAS

SEQ ID NO: 399203 - protein, 11 aa, Influenza virus
ILSIYSCVASS

SEQ ID NO: 399204 - protein, 11 aa, Influenza virus
LSIYSCVASSL

SEQ ID NO: 399205 - protein, 11 aa, Influenza virus
SIYSCIASSLI

SEQ ID NO: 399206 - protein, 11 aa, Influenza virus
IYSCIASSLIL

SEQ ID NO: 399207 - protein, 11 aa, Influenza virus
YSCIASSLILA

SEQ ID NO: 399208 - protein, 11 aa, Influenza virus
SCIASSLILAA

SEQ ID NO: 399209 - protein, 11 aa, Influenza virus
CIASSLVLAAL

SEQ ID NO: 399210 - protein, 11 aa, Influenza virus
ASSLVLAALIM

SEQ ID NO: 399211 - protein, 11 aa, Influenza virus
SSLVLAALIMG

SEQ ID NO: 399212 - protein, 11 aa, Influenza virus
WTCSNGSCRCT

SEQ ID NO: 399213 - protein, 11 aa, Influenza virus
TCSNGSCRCTI

SEQ ID NO: 399214 - protein, 11 aa, Influenza virus
CNNGSCRCTIC

SEQ ID NO: 399215 - protein, 11 aa, Influenza virus
NNGSCRCTICI

SEQ ID NO: 399216 - protein, 11 aa, Influenza virus
LAYDKICIGYQ

SEQ ID NO: 399217 - protein, 11 aa, Influenza virus
CIGYQTNNSTD

SEQ ID NO: 399218 - protein, 11 aa, Influenza virus
IGYQTNNSTDT

SEQ ID NO: 399219 - protein, 11 aa, Influenza virus
GYQTNNSTDTV

SEQ ID NO: 399220 - protein, 11 aa, Influenza virus
YQTNNSTDTVN

SEQ ID NO: 399221 - protein, 11 aa, Influenza virus
QTNNSTDTVNT

SEQ ID NO: 399222 - protein, 11 aa, Influenza virus
TNNSTDTVNTL

SEQ ID NO: 399223 - protein, 11 aa, Influenza virus
NNSTDTVNTLI

SEQ ID NO: 399224 - protein, 11 aa, Influenza virus
NSTDTVNTLIE

SEQ ID NO: 399225 - protein, 11 aa, Influenza virus
STDTVNTLIEQ

SEQ ID NO: 399226 - protein, 11 aa, Influenza virus
TDTVNTLIEQN

SEQ ID NO: 399227 - protein, 11 aa, Influenza virus
TVNTLSEQNVP

SEQ ID NO: 399228 - protein, 11 aa, Influenza virus
VNTLSEQNVPV

SEQ ID NO: 399229 - protein, 11 aa, Influenza virus
NTLSEQNVPVT

SEQ ID NO: 399230 - protein, 11 aa, Influenza virus
TLSEQNVPVTQ

SEQ ID NO: 399231 - protein, 11 aa, Influenza virus
LSEQNVPVTQV

SEQ ID NO: 399232 - protein, 11 aa, Influenza virus
SEQNVPVTQVE

SEQ ID NO: 399233 - protein, 11 aa, Influenza virus
EQNIPVTQVEE

SEQ ID NO: 399234 - protein, 11 aa, Influenza virus
QNIPVTQVEEL

SEQ ID NO: 399235 - protein, 11 aa, Influenza virus
NIPVTQVEELV

SEQ ID NO: 399236 - protein, 11 aa, Influenza virus
IPVTQVEELVH

SEQ ID NO: 399237 - protein, 11 aa, Influenza virus
PVTQVEELVHR

SEQ ID NO: 399238 - protein, 11 aa, Influenza virus
VTQVEELVHGQ

SEQ ID NO: 399239 - protein, 11 aa, Influenza virus
TQVEELVHGQV

SEQ ID NO: 399240 - protein, 11 aa, Influenza virus
QVEELVHGQVN

SEQ ID NO: 399241 - protein, 11 aa, Influenza virus
VEELVHGQVNP

SEQ ID NO: 399242 - protein, 11 aa, Influenza virus
TELGAPLVLDD

SEQ ID NO: 399243 - protein, 11 aa, Influenza virus
ELGAPLVLDDC

SEQ ID NO: 399244 - protein, 11 aa, Influenza virus
LGAPLVLDDCS

SEQ ID NO: 399245 - protein, 11 aa, Influenza virus
GAPLVLDDCSL

SEQ ID NO: 399246 - protein, 11 aa, Influenza virus
APLVLDDCSLE

SEQ ID NO: 399247 - protein, 11 aa, Influenza virus
PLVLDDCSLKG

SEQ ID NO: 399248 - protein, 11 aa, Influenza virus
LVLDDCSLEGI

SEQ ID NO: 399249 - protein, 11 aa, Influenza virus
VLDDCSLEGII

SEQ ID NO: 399250 - protein, 11 aa, Influenza virus
LDDCSLEGIIL

SEQ ID NO: 399251 - protein, 11 aa, Influenza virus
DDCSLEGIILG

SEQ ID NO: 399252 - protein, 11 aa, Influenza virus
DCSLEGIILGN

SEQ ID NO: 399253 - protein, 11 aa, Influenza virus
CSLEGIILGNP

SEQ ID NO: 399254 - protein, 11 aa, Influenza virus
SLEGIILGNPK

SEQ ID NO: 399255 - protein, 11 aa, Influenza virus
LEGIILGNPKC

SEQ ID NO: 399256 - protein, 11 aa, Influenza virus
EGIILGNPKCD

SEQ ID NO: 399257 - protein, 11 aa, Influenza virus
GLILGNPKCDP

SEQ ID NO: 399258 - protein, 11 aa, Influenza virus
LILGNPKCDPY

SEQ ID NO: 399259 - protein, 11 aa, Influenza virus
ILGNPKCDPYL

SEQ ID NO: 399260 - protein, 11 aa, Influenza virus
LGNPKCDPYLN

SEQ ID NO: 399261 - protein, 11 aa, Influenza virus
GNPKCDPYLNG

SEQ ID NO: 399262 - protein, 11 aa, Influenza virus
NPKCDPYLNGR

SEQ ID NO: 399263 - protein, 11 aa, Influenza virus
PKCDPYLNGRE

SEQ ID NO: 399264 - protein, 11 aa, Influenza virus
KCDPYLNGREW

SEQ ID NO: 399265 - protein, 11 aa, Influenza virus
CDPYLNGREWS

SEQ ID NO: 399266 - protein, 11 aa, Influenza virus
DPYLNGREWSY

SEQ ID NO: 399267 - protein, 11 aa, Influenza virus
PYLNGREWSYI

SEQ ID NO: 399268 - protein, 11 aa, Influenza virus
YLSGREWSYIV

SEQ ID NO: 399269 - protein, 11 aa, Influenza virus
LSGREWSYIVE

SEQ ID NO: 399270 - protein, 11 aa, Influenza virus
SGREWSYIVER

SEQ ID NO: 399271 - protein, 11 aa, Influenza virus
GREWSYIVERT

SEQ ID NO: 399272 - protein, 11 aa, Influenza virus
REWSYIVERTK

SEQ ID NO: 399273 - protein, 11 aa, Influenza virus
EWSYIVERTKE

SEQ ID NO: 399274 - protein, 11 aa, Influenza virus
WSYIVERTKEM

SEQ ID NO: 399275 - protein, 11 aa, Influenza virus
SYIVERTKEME

SEQ ID NO: 399276 - protein, 11 aa, Influenza virus
YIVERTKEMEG

SEQ ID NO: 399277 - protein, 11 aa, Influenza virus
IVERPKEMEGV

SEQ ID NO: 399278 - protein, 11 aa, Influenza virus
VERPKEMEGVC

SEQ ID NO: 399279 - protein, 11 aa, Influenza virus
ERPKEMEGVCY

SEQ ID NO: 399280 - protein, 11 aa, Influenza virus
RPKEMEGVCYP

SEQ ID NO: 399281 - protein, 11 aa, Influenza virus
PKEMEGVCYPG

SEQ ID NO: 399282 - protein, 11 aa, Influenza virus
KEMEGVCYPGS

SEQ ID NO: 399283 - protein, 11 aa, Influenza virus
EMEGVCYPGSI

SEQ ID NO: 399284 - protein, 11 aa, Influenza virus
MEGVCYPGSIE

SEQ ID NO: 399285 - protein, 11 aa, Influenza virus
EGVCYPGSIEN

SEQ ID NO: 399286 - protein, 11 aa, Influenza virus
GVCYPGSIENQ

SEQ ID NO: 399287 - protein, 11 aa, Influenza virus
VCYPGSIENQE

SEQ ID NO: 399288 - protein, 11 aa, Influenza virus
CYPGSIKNQEE

SEQ ID NO: 399289 - protein, 11 aa, Influenza virus
YPGSIKNQEEL

SEQ ID NO: 399290 - protein, 11 aa, Influenza virus
PGSVENQEELR

SEQ ID NO: 399291 - protein, 11 aa, Influenza virus
GSIENQEELRF

SEQ ID NO: 399292 - protein, 11 aa, Influenza virus
SIENQEELRFL

SEQ ID NO: 399293 - protein, 11 aa, Influenza virus
IENQEELRFLF

SEQ ID NO: 399294 - protein, 11 aa, Influenza virus
ENQEELRFLFS

SEQ ID NO: 399295 - protein, 11 aa, Influenza virus
NQEELRFLFSS

SEQ ID NO: 399296 - protein, 11 aa, Influenza virus
QEELRFLFSSI

SEQ ID NO: 399297 - protein, 11 aa, Influenza virus
EELRFLFSSIK

SEQ ID NO: 399298 - protein, 11 aa, Influenza virus
ELRFLFSSIKK

SEQ ID NO: 399299 - protein, 11 aa, Influenza virus
LRFLFSSIKKY

SEQ ID NO: 399300 - protein, 11 aa, Influenza virus
RFLFSSIKKYE

SEQ ID NO: 399301 - protein, 11 aa, Influenza virus
FLFSSIKKYER

SEQ ID NO: 399302 - protein, 11 aa, Influenza virus
LFSSIKRYERV

SEQ ID NO: 399303 - protein, 11 aa, Influenza virus
FSSIKRYERVK

SEQ ID NO: 399304 - protein, 11 aa, Influenza virus
SSIKRYERVKM

SEQ ID NO: 399305 - protein, 11 aa, Influenza virus
SIKRYERVKMF

SEQ ID NO: 399306 - protein, 11 aa, Influenza virus
IKRYERVKMFD

SEQ ID NO: 399307 - protein, 11 aa, Influenza virus
KRYERVKMFDF

SEQ ID NO: 399308 - protein, 11 aa, Influenza virus
KYERVKMFDFS

SEQ ID NO: 399309 - protein, 11 aa, Influenza virus
YERVKMFDFSK

SEQ ID NO: 399310 - protein, 11 aa, Influenza virus
ERVKMFDFSKW

SEQ ID NO: 399311 - protein, 11 aa, Influenza virus
RVKMFDFSKWN

SEQ ID NO: 399312 - protein, 11 aa, Influenza virus
VKMFDFSKWNV

SEQ ID NO: 399313 - protein, 11 aa, Influenza virus
KMFDFSKWNVT

SEQ ID NO: 399314 - protein, 11 aa, Influenza virus
MFDFSKWNVTY

SEQ ID NO: 399315 - protein, 11 aa, Influenza virus
FDFSKWNVTYT

SEQ ID NO: 399316 - protein, 11 aa, Influenza virus
DFSKWNVTYTG

SEQ ID NO: 399317 - protein, 11 aa, Influenza virus
FTKWNVTYTGI

SEQ ID NO: 399318 - protein, 11 aa, Influenza virus
TKWNVTYTGIS

SEQ ID NO: 399319 - protein, 11 aa, Influenza virus
KWNVTYTGTSR

SEQ ID NO: 399320 - protein, 11 aa, Influenza virus
WNVTYTGTSRA

SEQ ID NO: 399321 - protein, 11 aa, Influenza virus
NVTYTGTSRAC

SEQ ID NO: 399322 - protein, 11 aa, Influenza virus
VTYTGTSRACN

SEQ ID NO: 399323 - protein, 11 aa, Influenza virus
SNRGSFYRSMR

SEQ ID NO: 399324 - protein, 11 aa, Influenza virus
NQGSFYRNMRW

SEQ ID NO: 399325 - protein, 11 aa, Influenza virus
QGSFYRSIRWL

SEQ ID NO: 399326 - protein, 11 aa, Influenza virus
GSFYRSIRWLT

SEQ ID NO: 399327 - protein, 11 aa, Influenza virus
SFYRNMRWLTL

SEQ ID NO: 399328 - protein, 11 aa, Influenza virus
FYRNMRWLTLK

SEQ ID NO: 399329 - protein, 11 aa, Influenza virus
YRSIRWLTLKS

SEQ ID NO: 399330 - protein, 11 aa, Influenza virus
MRWLTLKSEQF

SEQ ID NO: 399331 - protein, 11 aa, Influenza virus
RWLTLKSEQFP

SEQ ID NO: 399332 - protein, 11 aa, Influenza virus
WLTLKSEQFPV

SEQ ID NO: 399333 - protein, 11 aa, Influenza virus
LTLKSEQFPVQ

SEQ ID NO: 399334 - protein, 11 aa, Influenza virus
TLKSEQFPVQT

SEQ ID NO: 399335 - protein, 11 aa, Influenza virus
LKSEQFPVQTD

SEQ ID NO: 399336 - protein, 11 aa, Influenza virus
KSEQFPVQTDE

SEQ ID NO: 399337 - protein, 11 aa, Influenza virus
SEQFPVQTDEY

SEQ ID NO: 399338 - protein, 11 aa, Influenza virus
EQFPVQTDEYK

SEQ ID NO: 399339 - protein, 11 aa, Influenza virus
PVQTDEYKNTG

SEQ ID NO: 399340 - protein, 11 aa, Influenza virus
VQTDEYKNTGD

SEQ ID NO: 399341 - protein, 11 aa, Influenza virus
QTDEYKNTGDS

SEQ ID NO: 399342 - protein, 11 aa, Influenza virus
TDEYKNTGDSD

SEQ ID NO: 399343 - protein, 11 aa, Influenza virus
DEYKNTGDSDI

SEQ ID NO: 399344 - protein, 11 aa, Influenza virus
FTWAIHHPPTT

SEQ ID NO: 399345 - protein, 11 aa, Influenza virus
WAIHHPPTSNE

SEQ ID NO: 399346 - protein, 11 aa, Influenza virus
AIHHPPTSNEQ

SEQ ID NO: 399347 - protein, 11 aa, Influenza virus
IHHPPTSNEQV

SEQ ID NO: 399348 - protein, 11 aa, Influenza virus
EINRSFRPNIG

SEQ ID NO: 399349 - protein, 11 aa, Influenza virus
INRSFRPNIGP

SEQ ID NO: 399350 - protein, 11 aa, Influenza virus
NRSFRPNIGPR

SEQ ID NO: 399351 - protein, 11 aa, Influenza virus
RSFRPNIGPRP

SEQ ID NO: 399352 - protein, 11 aa, Influenza virus
SFKPNIGPRPF

SEQ ID NO: 399353 - protein, 11 aa, Influenza virus
FKPNIGPRPFV

SEQ ID NO: 399354 - protein, 11 aa, Influenza virus
KPNIGPRPFVR

SEQ ID NO: 399355 - protein, 11 aa, Influenza virus
PNIGPRPFVRG

SEQ ID NO: 399356 - protein, 11 aa, Influenza virus
NIGPRPFVRGQ

SEQ ID NO: 399357 - protein, 11 aa, Influenza virus
IGPRPFVRGQQ

SEQ ID NO: 399358 - protein, 11 aa, Influenza virus
GPRPFVRGQQG

SEQ ID NO: 399359 - protein, 11 aa, Influenza virus
PRPFVRGQQGR

SEQ ID NO: 399360 - protein, 11 aa, Influenza virus
RPFVRGQQGRM

SEQ ID NO: 399361 - protein, 11 aa, Influenza virus
PFVRGQQGRMD

SEQ ID NO: 399362 - protein, 11 aa, Influenza virus
FVRGQQGRMDY

SEQ ID NO: 399363 - protein, 11 aa, Influenza virus
VREQQGRMDYY

SEQ ID NO: 399364 - protein, 11 aa, Influenza virus
REQQGRMDYYW

SEQ ID NO: 399365 - protein, 11 aa, Influenza virus
EQQGRMDYYWA

SEQ ID NO: 399366 - protein, 11 aa, Influenza virus
QQGRMDYYWAI

SEQ ID NO: 399367 - protein, 11 aa, Influenza virus
QGRMDYYWAIL

SEQ ID NO: 399368 - protein, 11 aa, Influenza virus
GRMDYYWAILK

SEQ ID NO: 399369 - protein, 11 aa, Influenza virus
RMDYYWAILKP

SEQ ID NO: 399370 - protein, 11 aa, Influenza virus
MDYYWAILKPG

SEQ ID NO: 399371 - protein, 11 aa, Influenza virus
DYYWAILKPGQ

SEQ ID NO: 399372 - protein, 11 aa, Influenza virus
YYWAILKPGQT

SEQ ID NO: 399373 - protein, 11 aa, Influenza virus
YWAILKPGQTV

SEQ ID NO: 399374 - protein, 11 aa, Influenza virus
WAILKPGQTVK

SEQ ID NO: 399375 - protein, 11 aa, Influenza virus
AILKPGQTVKI

SEQ ID NO: 399376 - protein, 11 aa, Influenza virus
ILKPGQTVKIQ

SEQ ID NO: 399377 - protein, 11 aa, Influenza virus
LKPGQTVKIKT

SEQ ID NO: 399378 - protein, 11 aa, Influenza virus
KPGQTVKIQTS

SEQ ID NO: 399379 - protein, 11 aa, Influenza virus
PGQTVKIKTNG

SEQ ID NO: 399380 - protein, 11 aa, Influenza virus
GQTVKIKTNGN

SEQ ID NO: 399381 - protein, 11 aa, Influenza virus
QTVKIQTSGNL

SEQ ID NO: 399382 - protein, 11 aa, Influenza virus
TVKIKTNGNLI

SEQ ID NO: 399383 - protein, 11 aa, Influenza virus
VKIKTNGNLIA

SEQ ID NO: 399384 - protein, 11 aa, Influenza virus
KIKTNGNLIAP

SEQ ID NO: 399385 - protein, 11 aa, Influenza virus
IQTSGNLIAPE

SEQ ID NO: 399386 - protein, 11 aa, Influenza virus
QTSGNLIAPEY

SEQ ID NO: 399387 - protein, 11 aa, Influenza virus
TSGNLIAPEYG

SEQ ID NO: 399388 - protein, 11 aa, Influenza virus
SGNLIAPEYGH

SEQ ID NO: 399389 - protein, 11 aa, Influenza virus
GNLIAPEYGYL

SEQ ID NO: 399390 - protein, 11 aa, Influenza virus
NLIAPEYGHLV

SEQ ID NO: 399391 - protein, 11 aa, Influenza virus
LIAPEYGHLVT

SEQ ID NO: 399392 - protein, 11 aa, Influenza virus
IAPEYGHLVTG

SEQ ID NO: 399393 - protein, 11 aa, Influenza virus
APEYGHLVTGK

SEQ ID NO: 399394 - protein, 11 aa, Influenza virus
PEYGHLVTGKS

SEQ ID NO: 399395 - protein, 11 aa, Influenza virus
EYGHLVTGKSH

SEQ ID NO: 399396 - protein, 11 aa, Influenza virus
YGHLVTGKSHG

SEQ ID NO: 399397 - protein, 11 aa, Influenza virus
GHLVTGKSHGR

SEQ ID NO: 399398 - protein, 11 aa, Influenza virus
HLITGKSHGRV

SEQ ID NO: 399399 - protein, 11 aa, Influenza virus
LVTGKSHGRIL

SEQ ID NO: 399400 - protein, 11 aa, Influenza virus
VTGKSHGRILK

SEQ ID NO: 399401 - protein, 11 aa, Influenza virus
TGKSHGRVLKN

SEQ ID NO: 399402 - protein, 11 aa, Influenza virus
GKSHGRILKND

SEQ ID NO: 399403 - protein, 11 aa, Influenza virus
KSHGRILKNDL

SEQ ID NO: 399404 - protein, 11 aa, Influenza virus
SHGRILKNDLP

SEQ ID NO: 399405 - protein, 11 aa, Influenza virus
TKCQLNEGVMN

SEQ ID NO: 399406 - protein, 11 aa, Influenza virus
GCQLNEGVMNT

SEQ ID NO: 399407 - protein, 11 aa, Influenza virus
CQLNEGIMNTS

SEQ ID NO: 399408 - protein, 11 aa, Influenza virus
QLNEGVINTSK

SEQ ID NO: 399409 - protein, 11 aa, Influenza virus
LNEGVINTSKP

SEQ ID NO: 399410 - protein, 11 aa, Influenza virus
NEGVINTSKPF

SEQ ID NO: 399411 - protein, 11 aa, Influenza virus
EGVINTSKPFQ

SEQ ID NO: 399412 - protein, 11 aa, Influenza virus
GIMNTSKPFQN

SEQ ID NO: 399413 - protein, 11 aa, Influenza virus
VMNTSKPLQNT

SEQ ID NO: 399414 - protein, 11 aa, Influenza virus
MNTSKPLQNTS

SEQ ID NO: 399415 - protein, 11 aa, Influenza virus
NTSKPFQNTSR

SEQ ID NO: 399416 - protein, 11 aa, Influenza virus
TSKPFQNICKP

SEQ ID NO: 399417 - protein, 11 aa, Influenza virus
SKPFQNICKPY

SEQ ID NO: 399418 - protein, 11 aa, Influenza virus
KPLQNTSKHYI

SEQ ID NO: 399419 - protein, 11 aa, Influenza virus
PFQNICKPYIG

SEQ ID NO: 399420 - protein, 11 aa, Influenza virus
FQNICKPYIGK

SEQ ID NO: 399421 - protein, 11 aa, Influenza virus
QNTSRHYIGKC

SEQ ID NO: 399422 - protein, 11 aa, Influenza virus
NICKPYIGKCP

SEQ ID NO: 399423 - protein, 11 aa, Influenza virus
TSKHYIGKCPR

SEQ ID NO: 399424 - protein, 11 aa, Influenza virus
SKHYIGKCPRY

SEQ ID NO: 399425 - protein, 11 aa, Influenza virus
KHYIGKCPRYI

SEQ ID NO: 399426 - protein, 11 aa, Influenza virus
HYIGKCPRYIP

SEQ ID NO: 399427 - protein, 11 aa, Influenza virus
YIGKCPRYIPS

SEQ ID NO: 399428 - protein, 11 aa, Influenza virus
IGKCPKYIPSN

SEQ ID NO: 399429 - protein, 11 aa, Influenza virus
GKCPKYIPSNS

SEQ ID NO: 399430 - protein, 11 aa, Influenza virus
KCPKYIPSNSL

SEQ ID NO: 399431 - protein, 11 aa, Influenza virus
CPKYIPSNSLK

SEQ ID NO: 399432 - protein, 11 aa, Influenza virus
PKYIPSNSLKL

SEQ ID NO: 399433 - protein, 11 aa, Influenza virus
KYIPSNSLKLA

SEQ ID NO: 399434 - protein, 11 aa, Influenza virus
YIPSNSLKLAI

SEQ ID NO: 399435 - protein, 11 aa, Influenza virus
IPSNSLKLAIG

SEQ ID NO: 399436 - protein, 11 aa, Influenza virus
PSNSLKLAIGL

SEQ ID NO: 399437 - protein, 11 aa, Influenza virus
SNSLKLAIGLR

SEQ ID NO: 399438 - protein, 11 aa, Influenza virus
NSLKLAIGLRN

SEQ ID NO: 399439 - protein, 11 aa, Influenza virus
SLKLAIGPRNV

SEQ ID NO: 399440 - protein, 11 aa, Influenza virus
LKLAIGPRNVP

SEQ ID NO: 399441 - protein, 11 aa, Influenza virus
KLAIGPRNVPQ

SEQ ID NO: 399442 - protein, 11 aa, Influenza virus
LAIGLRNVPQV

SEQ ID NO: 399443 - protein, 11 aa, Influenza virus
AIGLRNVPQVQ

SEQ ID NO: 399444 - protein, 11 aa, Influenza virus
RNVPQVQNRGL

SEQ ID NO: 399445 - protein, 11 aa, Influenza virus
NVPQVQNRGLF

SEQ ID NO: 399446 - protein, 11 aa, Influenza virus
VPQVQNRGLFG

SEQ ID NO: 399447 - protein, 11 aa, Influenza virus
PQVQNRGLFGA

SEQ ID NO: 399448 - protein, 11 aa, Influenza virus
QDRGLFGAIAG

SEQ ID NO: 399449 - protein, 11 aa, Influenza virus
DRGLFGAIAGF

SEQ ID NO: 399450 - protein, 11 aa, Influenza virus
RGLFGAKAGFI

SEQ ID NO: 399451 - protein, 11 aa, Influenza virus
GLFGAKAGFIE

SEQ ID NO: 399452 - protein, 11 aa, Influenza virus
LFGAKAGFIEG

SEQ ID NO: 399453 - protein, 11 aa, Influenza virus
FGAKAGFIEGG

SEQ ID NO: 399454 - protein, 11 aa, Influenza virus
GAKAGFIEGGW

SEQ ID NO: 399455 - protein, 11 aa, Influenza virus
AKAGFIEGGWP

SEQ ID NO: 399456 - protein, 11 aa, Influenza virus
KAGFIEGGWPG

SEQ ID NO: 399457 - protein, 11 aa, Influenza virus
AGFIEGRWPGL

SEQ ID NO: 399458 - protein, 11 aa, Influenza virus
GFIEGRWPGLV

SEQ ID NO: 399459 - protein, 11 aa, Influenza virus
FIEGRWPGLVA

SEQ ID NO: 399460 - protein, 11 aa, Influenza virus
IEGRWPGLVAG

SEQ ID NO: 399461 - protein, 11 aa, Influenza virus
EGRWPGLVAGW

SEQ ID NO: 399462 - protein, 11 aa, Influenza virus
GRWPGLVAGWY

SEQ ID NO: 399463 - protein, 11 aa, Influenza virus
RWPGLVAGWYG

SEQ ID NO: 399464 - protein, 11 aa, Influenza virus
AGWYGFQHQNS

SEQ ID NO: 399465 - protein, 11 aa, Influenza virus
GWYGFQHQNSE

SEQ ID NO: 399466 - protein, 11 aa, Influenza virus
WYGFQHQNSEG

SEQ ID NO: 399467 - protein, 11 aa, Influenza virus
YGFQHQNSEGT

SEQ ID NO: 399468 - protein, 11 aa, Influenza virus
GFQHQNSEGTG

SEQ ID NO: 399469 - protein, 11 aa, Influenza virus
FQHQNAEGTGM

SEQ ID NO: 399470 - protein, 11 aa, Influenza virus
QHQNAEGTGMA

SEQ ID NO: 399471 - protein, 11 aa, Influenza virus
HQNAEGTGMAA

SEQ ID NO: 399472 - protein, 11 aa, Influenza virus
QNAEGTGMAAD

SEQ ID NO: 399473 - protein, 11 aa, Influenza virus
NAEGTGMAADR

SEQ ID NO: 399474 - protein, 11 aa, Influenza virus
EGTGMAADRDS

SEQ ID NO: 399475 - protein, 11 aa, Influenza virus
GTGMAADRDST

SEQ ID NO: 399476 - protein, 11 aa, Influenza virus
TGMAADRDSTQ

SEQ ID NO: 399477 - protein, 11 aa, Influenza virus
AADRDSTQRAI

SEQ ID NO: 399478 - protein, 11 aa, Influenza virus
ADRDSTQRAID

SEQ ID NO: 399479 - protein, 11 aa, Influenza virus
DRDSTQRAIDN

SEQ ID NO: 399480 - protein, 11 aa, Influenza virus
RDSTQRAIDNM

SEQ ID NO: 399481 - protein, 11 aa, Influenza virus
DSTQRAIDNMQ

SEQ ID NO: 399482 - protein, 11 aa, Influenza virus
STQRAIDNMQN

SEQ ID NO: 399483 - protein, 11 aa, Influenza virus
TQRAIDNMQNK

SEQ ID NO: 399484 - protein, 11 aa, Influenza virus
QRAIDNMQNKL

SEQ ID NO: 399485 - protein, 11 aa, Influenza virus
RAIDNMQNKLN

SEQ ID NO: 399486 - protein, 11 aa, Influenza virus
AIDIMQNKLNN

SEQ ID NO: 399487 - protein, 11 aa, Influenza virus
IDIMQNKLNNV

SEQ ID NO: 399488 - protein, 11 aa, Influenza virus
DNMQNRLNNVI

SEQ ID NO: 399489 - protein, 11 aa, Influenza virus
IMQNKLNNVID

SEQ ID NO: 399490 - protein, 11 aa, Influenza virus
MQNRLNNVIDK

SEQ ID NO: 399491 - protein, 11 aa, Influenza virus
QNRLNNVIDKM

SEQ ID NO: 399492 - protein, 11 aa, Influenza virus
NKLNNVIDKMY

SEQ ID NO: 399493 - protein, 11 aa, Influenza virus
KLNNVIDKMYK

SEQ ID NO: 399494 - protein, 11 aa, Influenza virus
LNNVIDKMYKQ

SEQ ID NO: 399495 - protein, 11 aa, Influenza virus
NNVIDKMYKQF

SEQ ID NO: 399496 - protein, 11 aa, Influenza virus
RINTINSKIDD

SEQ ID NO: 399497 - protein, 11 aa, Influenza virus
INMINSKIEDQ

SEQ ID NO: 399498 - protein, 11 aa, Influenza virus
IDDQVTDIWAY

SEQ ID NO: 399499 - protein, 11 aa, Influenza virus
DDQVTDIWAYN

SEQ ID NO: 399500 - protein, 11 aa, Influenza virus
DQVTDIWAYNA

SEQ ID NO: 399501 - protein, 11 aa, Influenza virus
QVTDIWAYNAE

SEQ ID NO: 399502 - protein, 11 aa, Influenza virus
VTDIWAYNAEL

SEQ ID NO: 399503 - protein, 11 aa, Influenza virus
TDIWAYNAELI

SEQ ID NO: 399504 - protein, 11 aa, Influenza virus
DIWAYNAELIV

SEQ ID NO: 399505 - protein, 11 aa, Influenza virus
IWAYNAELIVL

SEQ ID NO: 399506 - protein, 11 aa, Influenza virus
WAYNAELIVLL

SEQ ID NO: 399507 - protein, 11 aa, Influenza virus
AYNAELIVLLE

SEQ ID NO: 399508 - protein, 11 aa, Influenza virus
YNAELIVLLEN

SEQ ID NO: 399509 - protein, 11 aa, Influenza virus
NAELIVLLENQ

SEQ ID NO: 399510 - protein, 11 aa, Influenza virus
AELIVLLENQK

SEQ ID NO: 399511 - protein, 11 aa, Influenza virus
ELIVLLENQKT

SEQ ID NO: 399512 - protein, 11 aa, Influenza virus
LIVLLENQKTL

SEQ ID NO: 399513 - protein, 11 aa, Influenza virus
IVLLENQKTLD

SEQ ID NO: 399514 - protein, 11 aa, Influenza virus
EHDANVRNLHE

SEQ ID NO: 399515 - protein, 11 aa, Influenza virus
HDANVRNLHER

SEQ ID NO: 399516 - protein, 11 aa, Influenza virus
DANVRNLHDRI

SEQ ID NO: 399517 - protein, 11 aa, Influenza virus
ANVRNLHDRIR

SEQ ID NO: 399518 - protein, 11 aa, Influenza virus
NVRNLHDRIRR

SEQ ID NO: 399519 - protein, 11 aa, Influenza virus
ENAIDAGDGCF

SEQ ID NO: 399520 - protein, 11 aa, Influenza virus
NALDTGDGCFE

SEQ ID NO: 399521 - protein, 11 aa, Influenza virus
AVDTGDGCFEI

SEQ ID NO: 399522 - protein, 11 aa, Influenza virus
LDTGDGCFEIL

SEQ ID NO: 399523 - protein, 11 aa, Influenza virus
DAGDGCFEILH

SEQ ID NO: 399524 - protein, 11 aa, Influenza virus
TGDGCFEILHR

SEQ ID NO: 399525 - protein, 11 aa, Influenza virus
GDGCFEILHRC

SEQ ID NO: 399526 - protein, 11 aa, Influenza virus
DGCFEILHRCD

SEQ ID NO: 399527 - protein, 11 aa, Influenza virus
GCFEILHKCDD

SEQ ID NO: 399528 - protein, 11 aa, Influenza virus
YEEESKLERQK

SEQ ID NO: 399529 - protein, 11 aa, Influenza virus
ERQRINGVKLE

SEQ ID NO: 399530 - protein, 11 aa, Influenza virus
RQKVNGVKLEE

SEQ ID NO: 399531 - protein, 11 aa, Influenza virus
QKVNGVKLEEN

SEQ ID NO: 399532 - protein, 11 aa, Influenza virus
RINGVKLEENS

SEQ ID NO: 399533 - protein, 11 aa, Influenza virus
VNGVKLEENST

SEQ ID NO: 399534 - protein, 11 aa, Influenza virus
SGVKLEENSTY

SEQ ID NO: 399535 - protein, 11 aa, Influenza virus
SSVASSLVLLF

SEQ ID NO: 399536 - protein, 11 aa, Influenza virus
SVASSLVLLFM

SEQ ID NO: 399537 - protein, 11 aa, Influenza virus
VASSLVLLFMI

SEQ ID NO: 399538 - protein, 11 aa, Influenza virus
ASSLVLLFMII

SEQ ID NO: 399539 - protein, 11 aa, Influenza virus
SSLVLLFMIIG

SEQ ID NO: 399540 - protein, 11 aa, Influenza virus
SLVLLFMIIGG

SEQ ID NO: 399541 - protein, 11 aa, Influenza virus
LVLLFMIIGGF

SEQ ID NO: 399542 - protein, 11 aa, Influenza virus
VLLFMIIGGFI

SEQ ID NO: 399543 - protein, 11 aa, Influenza virus
LLFMIIGGFIF

SEQ ID NO: 399544 - protein, 11 aa, Influenza virus
LFMIIGGFIFG

SEQ ID NO: 399545 - protein, 11 aa, Influenza virus
FMIIGGFIFGC

SEQ ID NO: 399546 - protein, 11 aa, Influenza virus
GFIFGCQNGNI

SEQ ID NO: 399547 - protein, 11 aa, Influenza virus
FIFGCQNGNIR

SEQ ID NO: 399548 - protein, 11 aa, Influenza virus
IFGCQNGNIRC

SEQ ID NO: 399549 - protein, 11 aa, Influenza virus
FGCQNGNIRCT

SEQ ID NO: 399550 - protein, 11 aa, Influenza virus
GCQNGNIRCTF

SEQ ID NO: 399551 - protein, 11 aa, Influenza virus
CQNGNIRCTFC

SEQ ID NO: 399552 - protein, 11 aa, Influenza virus
QNGNIRCTFCI

SEQ ID NO: 399553 - protein, 11 aa, Influenza virus
ADRICIGYLST

SEQ ID NO: 399554 - protein, 11 aa, Influenza virus
DRICIGYLSTN

SEQ ID NO: 399555 - protein, 11 aa, Influenza virus
KICVGYLSTNS

SEQ ID NO: 399556 - protein, 11 aa, Influenza virus
ICVGYLSTNST

SEQ ID NO: 399557 - protein, 11 aa, Influenza virus
CVGYLSTNSTE

SEQ ID NO: 399558 - protein, 11 aa, Influenza virus
VGYLSTNSSEK

SEQ ID NO: 399559 - protein, 11 aa, Influenza virus
GYLSTNSSEKV

SEQ ID NO: 399560 - protein, 11 aa, Influenza virus
YLSTNSSEKVD

SEQ ID NO: 399561 - protein, 11 aa, Influenza virus
LSTNSSEKVDT

SEQ ID NO: 399562 - protein, 11 aa, Influenza virus
STNSSEKVDTL

SEQ ID NO: 399563 - protein, 11 aa, Influenza virus
TNSSEKVDTLL

SEQ ID NO: 399564 - protein, 11 aa, Influenza virus
NSSEKVDTLLE

SEQ ID NO: 399565 - protein, 11 aa, Influenza virus
VDTLLENDVPV

SEQ ID NO: 399566 - protein, 11 aa, Influenza virus
DTLLENDVPVT

SEQ ID NO: 399567 - protein, 11 aa, Influenza virus
TLLENDVPVTS

SEQ ID NO: 399568 - protein, 11 aa, Influenza virus
LLENDVPVTSS

SEQ ID NO: 399569 - protein, 11 aa, Influenza virus
VPVTSSVDLIE

SEQ ID NO: 399570 - protein, 11 aa, Influenza virus
PVTSSVDLIET

SEQ ID NO: 399571 - protein, 11 aa, Influenza virus
DLIETNHTGTY

SEQ ID NO: 399572 - protein, 11 aa, Influenza virus
LIETNHTGTYC

SEQ ID NO: 399573 - protein, 11 aa, Influenza virus
IETNHTGTYCS

SEQ ID NO: 399574 - protein, 11 aa, Influenza virus
ETSHTGTYCSL

SEQ ID NO: 399575 - protein, 11 aa, Influenza virus
GVSPVHLGDCS

SEQ ID NO: 399576 - protein, 11 aa, Influenza virus
VSPVHLGDCSF

SEQ ID NO: 399577 - protein, 11 aa, Influenza virus
SPVHLGDCRFE

SEQ ID NO: 399578 - protein, 11 aa, Influenza virus
PVHLGDCRFEG

SEQ ID NO: 399579 - protein, 11 aa, Influenza virus
VHLGDCRFEGW

SEQ ID NO: 399580 - protein, 11 aa, Influenza virus
HLGDCRFEGWI

SEQ ID NO: 399581 - protein, 11 aa, Influenza virus
LGDCRFEGWIV

SEQ ID NO: 399582 - protein, 11 aa, Influenza virus
GDCRFEGWIVG

SEQ ID NO: 399583 - protein, 11 aa, Influenza virus
DCRFEGWIVGN

SEQ ID NO: 399584 - protein, 11 aa, Influenza virus
CRFEGWIVGNP

SEQ ID NO: 399585 - protein, 11 aa, Influenza virus
SFEGWIVGNPS

SEQ ID NO: 399586 - protein, 11 aa, Influenza virus
FEGWIVGNPSC

SEQ ID NO: 399587 - protein, 11 aa, Influenza virus
GVREWSYLIED

SEQ ID NO: 399588 - protein, 11 aa, Influenza virus
TREWSYLIEDP

SEQ ID NO: 399589 - protein, 11 aa, Influenza virus
REWSYLIEDPG

SEQ ID NO: 399590 - protein, 11 aa, Influenza virus
EWSYLIEDPGA

SEQ ID NO: 399591 - protein, 11 aa, Influenza virus
WSYLIEDPGAP

SEQ ID NO: 399592 - protein, 11 aa, Influenza virus
SYLIEDPGAPH

SEQ ID NO: 399593 - protein, 11 aa, Influenza virus
YLIEDPGAPHG

SEQ ID NO: 399594 - protein, 11 aa, Influenza virus
LIEDPGAPHGL

SEQ ID NO: 399595 - protein, 11 aa, Influenza virus
IEDPGAPHGLC

SEQ ID NO: 399596 - protein, 11 aa, Influenza virus
EDPGAPHGLCY

SEQ ID NO: 399597 - protein, 11 aa, Influenza virus
DPGAPHGLCYP

SEQ ID NO: 399598 - protein, 11 aa, Influenza virus
PGAPHGLCYPG

SEQ ID NO: 399599 - protein, 11 aa, Influenza virus
GAPHGLCYPGE

SEQ ID NO: 399600 - protein, 11 aa, Influenza virus
APHRLCYPGEL

SEQ ID NO: 399601 - protein, 11 aa, Influenza virus
PHGLCYPGELN

SEQ ID NO: 399602 - protein, 11 aa, Influenza virus
HGLCYPGELNN

SEQ ID NO: 399603 - protein, 11 aa, Influenza virus
GLCYPGELNNN

SEQ ID NO: 399604 - protein, 11 aa, Influenza virus
LCYPGELNNNG

SEQ ID NO: 399605 - protein, 11 aa, Influenza virus
CYPGELNNNGE

SEQ ID NO: 399606 - protein, 11 aa, Influenza virus
YPGELNNNGEL

SEQ ID NO: 399607 - protein, 11 aa, Influenza virus
PGELNNNGELR

SEQ ID NO: 399608 - protein, 11 aa, Influenza virus
GELNNNGELRH

SEQ ID NO: 399609 - protein, 11 aa, Influenza virus
ELNNNGELRHL

SEQ ID NO: 399610 - protein, 11 aa, Influenza virus
LNNNGELRHLF

SEQ ID NO: 399611 - protein, 11 aa, Influenza virus
NNNGELRHLFS

SEQ ID NO: 399612 - protein, 11 aa, Influenza virus
GELRHLFSGIK

SEQ ID NO: 399613 - protein, 11 aa, Influenza virus
ELRHLFSGIKS

SEQ ID NO: 399614 - protein, 11 aa, Influenza virus
LRHLFSGIKSF

SEQ ID NO: 399615 - protein, 11 aa, Influenza virus
RHLFSGIKSFS

SEQ ID NO: 399616 - protein, 11 aa, Influenza virus
HLFSGIKSFSR

SEQ ID NO: 399617 - protein, 11 aa, Influenza virus
LFSGIKSFSRT

SEQ ID NO: 399618 - protein, 11 aa, Influenza virus
FSGIKSFSRTE

SEQ ID NO: 399619 - protein, 11 aa, Influenza virus
SGIKSFSRTEL

SEQ ID NO: 399620 - protein, 11 aa, Influenza virus
GIKSFSRTELI

SEQ ID NO: 399621 - protein, 11 aa, Influenza virus
IRSFSRTELIA

SEQ ID NO: 399622 - protein, 11 aa, Influenza virus
RSFSRTELIPP

SEQ ID NO: 399623 - protein, 11 aa, Influenza virus
GTYNNTTGRDV

SEQ ID NO: 399624 - protein, 11 aa, Influenza virus
AYNNTTGRDVL

SEQ ID NO: 399625 - protein, 11 aa, Influenza virus
NNTTGRDVLVM

SEQ ID NO: 399626 - protein, 11 aa, Influenza virus
NTTGRDVLVMW

SEQ ID NO: 399627 - protein, 11 aa, Influenza virus
TTGRDVLVMWG

SEQ ID NO: 399628 - protein, 11 aa, Influenza virus
TGRDVLVMWGI

SEQ ID NO: 399629 - protein, 11 aa, Influenza virus
GRDVLVMWGIH

SEQ ID NO: 399630 - protein, 11 aa, Influenza virus
RDVLVMWGIHH

SEQ ID NO: 399631 - protein, 11 aa, Influenza virus
DVLVMWGIHHP

SEQ ID NO: 399632 - protein, 11 aa, Influenza virus
PYTLVSTKSWS

SEQ ID NO: 399633 - protein, 11 aa, Influenza virus
GIRPGYNGQKS

SEQ ID NO: 399634 - protein, 11 aa, Influenza virus
IRPGYNGQKSW

SEQ ID NO: 399635 - protein, 11 aa, Influenza virus
RPGYNGQKSWM

SEQ ID NO: 399636 - protein, 11 aa, Influenza virus
PGYNGQKSWMK

SEQ ID NO: 399637 - protein, 11 aa, Influenza virus
GYNGQKSWMKI

SEQ ID NO: 399638 - protein, 11 aa, Influenza virus
YNGQKSWMKIY

SEQ ID NO: 399639 - protein, 11 aa, Influenza virus
NGQKSWMKIYW

SEQ ID NO: 399640 - protein, 11 aa, Influenza virus
ITFESNGGLLA

SEQ ID NO: 399641 - protein, 11 aa, Influenza virus
TFESNGGLLAP

SEQ ID NO: 399642 - protein, 11 aa, Influenza virus
FESNGGLLAPK

SEQ ID NO: 399643 - protein, 11 aa, Influenza virus
ESNGGLLAPKY

SEQ ID NO: 399644 - protein, 11 aa, Influenza virus
SNGGLLAPKYG

SEQ ID NO: 399645 - protein, 11 aa, Influenza virus
NGGLLAPKYGY

SEQ ID NO: 399646 - protein, 11 aa, Influenza virus
GGLLAPKYGYI

SEQ ID NO: 399647 - protein, 11 aa, Influenza virus
GLLAPKYGYII

SEQ ID NO: 399648 - protein, 11 aa, Influenza virus
LLAPKYGYIIE

SEQ ID NO: 399649 - protein, 11 aa, Influenza virus
LAPKYGYIIEE

SEQ ID NO: 399650 - protein, 11 aa, Influenza virus
APKYGYIIEEY

SEQ ID NO: 399651 - protein, 11 aa, Influenza virus
PKYGYIIEEYG

SEQ ID NO: 399652 - protein, 11 aa, Influenza virus
KYGYIIEEYGK

SEQ ID NO: 399653 - protein, 11 aa, Influenza virus
YGYIIEEYGRG

SEQ ID NO: 399654 - protein, 11 aa, Influenza virus
GYIIEEYGRGR

SEQ ID NO: 399655 - protein, 11 aa, Influenza virus
YIIEEYGRGRI

SEQ ID NO: 399656 - protein, 11 aa, Influenza virus
IIEEYGRGRIF

SEQ ID NO: 399657 - protein, 11 aa, Influenza virus
IEEYGRGRIFQ

SEQ ID NO: 399658 - protein, 11 aa, Influenza virus
EEYGRGRIFQS

SEQ ID NO: 399659 - protein, 11 aa, Influenza virus
EYGKGRIFQSP

SEQ ID NO: 399660 - protein, 11 aa, Influenza virus
YGKGRIFQSPI

SEQ ID NO: 399661 - protein, 11 aa, Influenza virus
GKGRIFQSPIR

SEQ ID NO: 399662 - protein, 11 aa, Influenza virus
RCNTKCQTSVG

SEQ ID NO: 399663 - protein, 11 aa, Influenza virus
CNTRCQTSVGG

SEQ ID NO: 399664 - protein, 11 aa, Influenza virus
NTRCQTSVGGI

SEQ ID NO: 399665 - protein, 11 aa, Influenza virus
TRCQTSVGGIN

SEQ ID NO: 399666 - protein, 11 aa, Influenza virus
RCQTSVGGINT

SEQ ID NO: 399667 - protein, 11 aa, Influenza virus
CQTSVGGIDTN

SEQ ID NO: 399668 - protein, 11 aa, Influenza virus
QTSVGGINTNR

SEQ ID NO: 399669 - protein, 11 aa, Influenza virus
TSVGGINTNRT

SEQ ID NO: 399670 - protein, 11 aa, Influenza virus
SVGGINTNRTF

SEQ ID NO: 399671 - protein, 11 aa, Influenza virus
VGGINTNRTFQ

SEQ ID NO: 399672 - protein, 11 aa, Influenza virus
GGINTNRTFQN

SEQ ID NO: 399673 - protein, 11 aa, Influenza virus
GINTNRTFQNI

SEQ ID NO: 399674 - protein, 11 aa, Influenza virus
INTNRTFQNID

SEQ ID NO: 399675 - protein, 11 aa, Influenza virus
NTNRTFQNIDK

SEQ ID NO: 399676 - protein, 11 aa, Influenza virus
TNRTFQNIDKN

SEQ ID NO: 399677 - protein, 11 aa, Influenza virus
NRTFQNIDKNA

SEQ ID NO: 399678 - protein, 11 aa, Influenza virus
RTFQNIDKNAL

SEQ ID NO: 399679 - protein, 11 aa, Influenza virus
TFQNIDKNALG

SEQ ID NO: 399680 - protein, 11 aa, Influenza virus
FQNIDKNALGD

SEQ ID NO: 399681 - protein, 11 aa, Influenza virus
QNIDKNALGDC

SEQ ID NO: 399682 - protein, 11 aa, Influenza virus
NIDKNALGDCP

SEQ ID NO: 399683 - protein, 11 aa, Influenza virus
IDKNALGDCPK

SEQ ID NO: 399684 - protein, 11 aa, Influenza virus
DKNALGDCPKY

SEQ ID NO: 399685 - protein, 11 aa, Influenza virus
KNALGDCPKYI

SEQ ID NO: 399686 - protein, 11 aa, Influenza virus
NALGNCPKYIK

SEQ ID NO: 399687 - protein, 11 aa, Influenza virus
ALGNCPKYIKS

SEQ ID NO: 399688 - protein, 11 aa, Influenza virus
LGNCPKYIKSG

SEQ ID NO: 399689 - protein, 11 aa, Influenza virus
GNCPKYIKSGQ

SEQ ID NO: 399690 - protein, 11 aa, Influenza virus
NCPKYIKSGQL

SEQ ID NO: 399691 - protein, 11 aa, Influenza virus
CPKYIKSDQLK

SEQ ID NO: 399692 - protein, 11 aa, Influenza virus
PKYIKSDQLKL

SEQ ID NO: 399693 - protein, 11 aa, Influenza virus
KYIKSDQLKLA

SEQ ID NO: 399694 - protein, 11 aa, Influenza virus
YIKSDQLKLAT

SEQ ID NO: 399695 - protein, 11 aa, Influenza virus
IKSDQLKLATG

SEQ ID NO: 399696 - protein, 11 aa, Influenza virus
KSDQLKLATGL

SEQ ID NO: 399697 - protein, 11 aa, Influenza virus
SDQLKLATGLR

SEQ ID NO: 399698 - protein, 11 aa, Influenza virus
DQLKLATGLRN

SEQ ID NO: 399699 - protein, 11 aa, Influenza virus
QLKLATGLRNI

SEQ ID NO: 399700 - protein, 11 aa, Influenza virus
LKLATGLRNIP

SEQ ID NO: 399701 - protein, 11 aa, Influenza virus
KLATGLRNVPT

SEQ ID NO: 399702 - protein, 11 aa, Influenza virus
RGFFGAIAGFI

SEQ ID NO: 399703 - protein, 11 aa, Influenza virus
AVDGTIAGFIE

SEQ ID NO: 399704 - protein, 11 aa, Influenza virus
FFGAIAGFIEG

SEQ ID NO: 399705 - protein, 11 aa, Influenza virus
DGTIAGFIEGG

SEQ ID NO: 399706 - protein, 11 aa, Influenza virus
GTIAGFIEGGW

SEQ ID NO: 399707 - protein, 11 aa, Influenza virus
TIAGFIEGGWP

SEQ ID NO: 399708 - protein, 11 aa, Influenza virus
YGFQHQNEQGT

SEQ ID NO: 399709 - protein, 11 aa, Influenza virus
GFQHQNEQGTG

SEQ ID NO: 399710 - protein, 11 aa, Influenza virus
FQHQNEQGVGM

SEQ ID NO: 399711 - protein, 11 aa, Influenza virus
QHQNEQGVGMA

SEQ ID NO: 399712 - protein, 11 aa, Influenza virus
HQNEQGVGMAA

SEQ ID NO: 399713 - protein, 11 aa, Influenza virus
QNEQGVGMAAD

SEQ ID NO: 399714 - protein, 11 aa, Influenza virus
NEQGVGMAADK

SEQ ID NO: 399715 - protein, 11 aa, Influenza virus
EQGVGMAADKE

SEQ ID NO: 399716 - protein, 11 aa, Influenza virus
QGVGMAADKES

SEQ ID NO: 399717 - protein, 11 aa, Influenza virus
GVGMAADKEST

SEQ ID NO: 399718 - protein, 11 aa, Influenza virus
VGMAADKESTQ

SEQ ID NO: 399719 - protein, 11 aa, Influenza virus
GMAADKESTQK

SEQ ID NO: 399720 - protein, 11 aa, Influenza virus
MAADKESTQKA

SEQ ID NO: 399721 - protein, 11 aa, Influenza virus
AAEKESTQKAI

SEQ ID NO: 399722 - protein, 11 aa, Influenza virus
AEKESTQKAID

SEQ ID NO: 399723 - protein, 11 aa, Influenza virus
EKESTQKAIDQ

SEQ ID NO: 399724 - protein, 11 aa, Influenza virus
KESTQKAIDRI

SEQ ID NO: 399725 - protein, 11 aa, Influenza virus
ESTQKAIDRIT

SEQ ID NO: 399726 - protein, 11 aa, Influenza virus
STQKAIDRITT

SEQ ID NO: 399727 - protein, 11 aa, Influenza virus
TQKAIDRITTK

SEQ ID NO: 399728 - protein, 11 aa, Influenza virus
QKAIDRITTKI

SEQ ID NO: 399729 - protein, 11 aa, Influenza virus
KAIDRITTKIN

SEQ ID NO: 399730 - protein, 11 aa, Influenza virus
AIDRITTKINN

SEQ ID NO: 399731 - protein, 11 aa, Influenza virus
IDRITTKINNI

SEQ ID NO: 399732 - protein, 11 aa, Influenza virus
DRITTKINNII

SEQ ID NO: 399733 - protein, 11 aa, Influenza virus
QITTKINNIIE

SEQ ID NO: 399734 - protein, 11 aa, Influenza virus
ITTKINNIIEK

SEQ ID NO: 399735 - protein, 11 aa, Influenza virus
TTKINNIIEKM

SEQ ID NO: 399736 - protein, 11 aa, Influenza virus
TKINNIIEKMN

SEQ ID NO: 399737 - protein, 11 aa, Influenza virus
KINNIIEKMNG

SEQ ID NO: 399738 - protein, 11 aa, Influenza virus
INNIIEKMNGN

SEQ ID NO: 399739 - protein, 11 aa, Influenza virus
NNIIEKMNGNY

SEQ ID NO: 399740 - protein, 11 aa, Influenza virus
NIIEKMNGNYD

SEQ ID NO: 399741 - protein, 11 aa, Influenza virus
IIEKMNGNYDS

SEQ ID NO: 399742 - protein, 11 aa, Influenza virus
IEKMNGNYDSI

SEQ ID NO: 399743 - protein, 11 aa, Influenza virus
EKMNGNYDSIR

SEQ ID NO: 399744 - protein, 11 aa, Influenza virus
GNYDSIRGEFS

SEQ ID NO: 399745 - protein, 11 aa, Influenza virus
NYDSIRGEFSQ

SEQ ID NO: 399746 - protein, 11 aa, Influenza virus
YDSIRGEFSQV

SEQ ID NO: 399747 - protein, 11 aa, Influenza virus
DSIRGEFSQVE

SEQ ID NO: 399748 - protein, 11 aa, Influenza virus
SIRGEFSQVEQ

SEQ ID NO: 399749 - protein, 11 aa, Influenza virus
IRGEFSQVEQR

SEQ ID NO: 399750 - protein, 11 aa, Influenza virus
RGEFSQVEQRI

SEQ ID NO: 399751 - protein, 11 aa, Influenza virus
GEFSQVEQRIN

SEQ ID NO: 399752 - protein, 11 aa, Influenza virus
EFSQVEQRINM

SEQ ID NO: 399753 - protein, 11 aa, Influenza virus
FSQVEQRINML

SEQ ID NO: 399754 - protein, 11 aa, Influenza virus
SQVEQRINMLA

SEQ ID NO: 399755 - protein, 11 aa, Influenza virus
QVEKRINMLAD

SEQ ID NO: 399756 - protein, 11 aa, Influenza virus
VEKRINMLADR

SEQ ID NO: 399757 - protein, 11 aa, Influenza virus
EKRINMLADRI

SEQ ID NO: 399758 - protein, 11 aa, Influenza virus
KRINMLADRID

SEQ ID NO: 399759 - protein, 11 aa, Influenza virus
ADRIDDAVTDI

SEQ ID NO: 399760 - protein, 11 aa, Influenza virus
DRIDDAVTDIW

SEQ ID NO: 399761 - protein, 11 aa, Influenza virus
RIDDAVTDIWS

SEQ ID NO: 399762 - protein, 11 aa, Influenza virus
IDDAVTDIWSY

SEQ ID NO: 399763 - protein, 11 aa, Influenza virus
DDAVTDIWSYN

SEQ ID NO: 399764 - protein, 11 aa, Influenza virus
DAVTDIWSYNA

SEQ ID NO: 399765 - protein, 11 aa, Influenza virus
AVTDIWSYNAK

SEQ ID NO: 399766 - protein, 11 aa, Influenza virus
VTDIWSYNAKL

SEQ ID NO: 399767 - protein, 11 aa, Influenza virus
TDIWSYNAKLL

SEQ ID NO: 399768 - protein, 11 aa, Influenza virus
DIWSYNAKLLV

SEQ ID NO: 399769 - protein, 11 aa, Influenza virus
IWSYNAKLLVL

SEQ ID NO: 399770 - protein, 11 aa, Influenza virus
WSYNARLLVLL

SEQ ID NO: 399771 - protein, 11 aa, Influenza virus
SYNARLLVLLE

SEQ ID NO: 399772 - protein, 11 aa, Influenza virus
YNARLLVLLEN

SEQ ID NO: 399773 - protein, 11 aa, Influenza virus
NARLLVLLEND

SEQ ID NO: 399774 - protein, 11 aa, Influenza virus
ARLLVLLENDK

SEQ ID NO: 399775 - protein, 11 aa, Influenza virus
RLLVLLENDKT

SEQ ID NO: 399776 - protein, 11 aa, Influenza virus
LVLLENDKTLN

SEQ ID NO: 399777 - protein, 11 aa, Influenza virus
VLLENDKTLDL

SEQ ID NO: 399778 - protein, 11 aa, Influenza virus
LLENDKTLNMH

SEQ ID NO: 399779 - protein, 11 aa, Influenza virus
LENDKTLDLHD

SEQ ID NO: 399780 - protein, 11 aa, Influenza virus
ENDKTLNMHDA

SEQ ID NO: 399781 - protein, 11 aa, Influenza virus
NDKTLDLHDAN

SEQ ID NO: 399782 - protein, 11 aa, Influenza virus
DKTLNMHDANV

SEQ ID NO: 399783 - protein, 11 aa, Influenza virus
KTLDMHDANVK

SEQ ID NO: 399784 - protein, 11 aa, Influenza virus
TLDMHDANVKN

SEQ ID NO: 399785 - protein, 11 aa, Influenza virus
LDMHDANVKNL

SEQ ID NO: 399786 - protein, 11 aa, Influenza virus
DMHDANVKNLH

SEQ ID NO: 399787 - protein, 11 aa, Influenza virus
MHDANVRNLHE

SEQ ID NO: 399788 - protein, 11 aa, Influenza virus
HDANVRNLHEQ

SEQ ID NO: 399789 - protein, 11 aa, Influenza virus
DANVRNLHEQV

SEQ ID NO: 399790 - protein, 11 aa, Influenza virus
ANVRNLHEQVR

SEQ ID NO: 399791 - protein, 11 aa, Influenza virus
NAVDEGNGCFE

SEQ ID NO: 399792 - protein, 11 aa, Influenza virus
AVDEGNGCFEL

SEQ ID NO: 399793 - protein, 11 aa, Influenza virus
VDEGNGCFELL

SEQ ID NO: 399794 - protein, 11 aa, Influenza virus
NEGNGCFELLH

SEQ ID NO: 399795 - protein, 11 aa, Influenza virus
GCFELLHKCNN

SEQ ID NO: 399796 - protein, 11 aa, Influenza virus
CFELLHKCNNS

SEQ ID NO: 399797 - protein, 11 aa, Influenza virus
FELLHKCNNSC

SEQ ID NO: 399798 - protein, 11 aa, Influenza virus
ELLHKCNNSCM

SEQ ID NO: 399799 - protein, 11 aa, Influenza virus
LLHKCNNSCME

SEQ ID NO: 399800 - protein, 11 aa, Influenza virus
LHKCNNSCMET

SEQ ID NO: 399801 - protein, 11 aa, Influenza virus
HKCNNSCMETI

SEQ ID NO: 399802 - protein, 11 aa, Influenza virus
KCNNSCMETIR

SEQ ID NO: 399803 - protein, 11 aa, Influenza virus
CNNSCMETIRN

SEQ ID NO: 399804 - protein, 11 aa, Influenza virus
NNSCMETIRNG

SEQ ID NO: 399805 - protein, 11 aa, Influenza virus
NSCMETIRNGT

SEQ ID NO: 399806 - protein, 11 aa, Influenza virus
TCMETIRNGTY

SEQ ID NO: 399807 - protein, 11 aa, Influenza virus
CMETIRNGTYD

SEQ ID NO: 399808 - protein, 11 aa, Influenza virus
METIRNGTYDH

SEQ ID NO: 399809 - protein, 11 aa, Influenza virus
EYEEESKLKRQ

SEQ ID NO: 399810 - protein, 11 aa, Influenza virus
YEEESKLKRQE

SEQ ID NO: 399811 - protein, 11 aa, Influenza virus
EEESKLKRQEI

SEQ ID NO: 399812 - protein, 11 aa, Influenza virus
EESKLKRQEIN

SEQ ID NO: 399813 - protein, 11 aa, Influenza virus
ESKLKRQEING

SEQ ID NO: 399814 - protein, 11 aa, Influenza virus
SKLKRQEINGI

SEQ ID NO: 399815 - protein, 11 aa, Influenza virus
KLKRQEINGIK

SEQ ID NO: 399816 - protein, 11 aa, Influenza virus
LKRQEINGIKL

SEQ ID NO: 399817 - protein, 11 aa, Influenza virus
KRQEINGIKLK

SEQ ID NO: 399818 - protein, 11 aa, Influenza virus
RQEINGIKLKS

SEQ ID NO: 399819 - protein, 11 aa, Influenza virus
SDDSVYKALSI

SEQ ID NO: 399820 - protein, 11 aa, Influenza virus
DDSVYKALSIY

SEQ ID NO: 399821 - protein, 11 aa, Influenza virus
DSVYKALSIYS

SEQ ID NO: 399822 - protein, 11 aa, Influenza virus
SVYKALSIYSC

SEQ ID NO: 399823 - protein, 11 aa, Influenza virus
VYRALSIYSCI

SEQ ID NO: 399824 - protein, 11 aa, Influenza virus
YRALSIYSCIA

SEQ ID NO: 399825 - protein, 11 aa, Influenza virus
RALSIYSCIAS

SEQ ID NO: 399826 - protein, 11 aa, Influenza virus
LSIYSCIASSI

SEQ ID NO: 399827 - protein, 11 aa, Influenza virus
SIYSCIASSIV

SEQ ID NO: 399828 - protein, 11 aa, Influenza virus
IYSCIASSIVL

SEQ ID NO: 399829 - protein, 11 aa, Influenza virus
YSCIASSIVLV

SEQ ID NO: 399830 - protein, 11 aa, Influenza virus
SCIASSIVLVG

SEQ ID NO: 399831 - protein, 11 aa, Influenza virus
CIASSIVLVGL

SEQ ID NO: 399832 - protein, 11 aa, Influenza virus
IASSIVLVGLI

SEQ ID NO: 399833 - protein, 11 aa, Influenza virus
ASSIVLVGLIL

SEQ ID NO: 399834 - protein, 11 aa, Influenza virus
VLVGLILSFIM

SEQ ID NO: 399835 - protein, 11 aa, Influenza virus
LVGLILSFIMW

SEQ ID NO: 399836 - protein, 11 aa, Influenza virus
VGLILSFIMWA

SEQ ID NO: 399837 - protein, 11 aa, Influenza virus
GLILSFIMWAC

SEQ ID NO: 399838 - protein, 11 aa, Influenza virus
FIMWACSNGSC

SEQ ID NO: 399839 - protein, 11 aa, Influenza virus
IMWACSNGSCR

SEQ ID NO: 399840 - protein, 11 aa, Influenza virus
MWACSNGSCRF

SEQ ID NO: 399841 - protein, 11 aa, Influenza virus
GSEHTAYSQIT

SEQ ID NO: 399842 - protein, 11 aa, Influenza virus
SEHTAYSQITN

SEQ ID NO: 399843 - protein, 11 aa, Influenza virus
EHTAYSQITNG

SEQ ID NO: 399844 - protein, 11 aa, Influenza virus
FFSRLNWLTKE

SEQ ID NO: 399845 - protein, 11 aa, Influenza virus
FSRLNWLTKET

SEQ ID NO: 399846 - protein, 11 aa, Influenza virus
SRLNWLTKETN

SEQ ID NO: 399847 - protein, 11 aa, Influenza virus
RLNWLTKETNG

SEQ ID NO: 399848 - protein, 11 aa, Influenza virus
LNWLTKETNGN

SEQ ID NO: 399849 - protein, 11 aa, Influenza virus
NWLTKETNGNY

SEQ ID NO: 399850 - protein, 11 aa, Influenza virus
WLTKETNGNYG

SEQ ID NO: 399851 - protein, 11 aa, Influenza virus
LTKETNGNYGP

SEQ ID NO: 399852 - protein, 11 aa, Influenza virus
TKETNGNYGPI

SEQ ID NO: 399853 - protein, 11 aa, Influenza virus
KETNGNYGPIN

SEQ ID NO: 399854 - protein, 11 aa, Influenza virus
ETNGNYGPINV

SEQ ID NO: 399855 - protein, 11 aa, Influenza virus
VILVLGLSMVR

SEQ ID NO: 399856 - protein, 11 aa, Influenza virus
ILVLGLSMVRS

SEQ ID NO: 399857 - protein, 11 aa, Influenza virus
LVLGLSMVRSD

SEQ ID NO: 399858 - protein, 11 aa, Influenza virus
VLGLSMVRSDK

SEQ ID NO: 399859 - protein, 11 aa, Influenza virus
LGLSMVRSDKI

SEQ ID NO: 399860 - protein, 11 aa, Influenza virus
GLSMVRSDKIC

SEQ ID NO: 399861 - protein, 11 aa, Influenza virus
LSMVRSDKICL

SEQ ID NO: 399862 - protein, 11 aa, Influenza virus
SMVRSDKICLG

SEQ ID NO: 399863 - protein, 11 aa, Influenza virus
MVRSDKICLGH

SEQ ID NO: 399864 - protein, 11 aa, Influenza virus
VRSDKICLGHH

SEQ ID NO: 399865 - protein, 11 aa, Influenza virus
RSDKICLGHHA

SEQ ID NO: 399866 - protein, 11 aa, Influenza virus
DKICLGHHAVP

SEQ ID NO: 399867 - protein, 11 aa, Influenza virus
KICLGHHAVPN

SEQ ID NO: 399868 - protein, 11 aa, Influenza virus
ICLGHHAVPNG

SEQ ID NO: 399869 - protein, 11 aa, Influenza virus
CLGHHAVPNGT

SEQ ID NO: 399870 - protein, 11 aa, Influenza virus
LGHHAVPNGTK

SEQ ID NO: 399871 - protein, 11 aa, Influenza virus
GHHAVPNGTKV

SEQ ID NO: 399872 - protein, 11 aa, Influenza virus
HHAVPNGTKVN

SEQ ID NO: 399873 - protein, 11 aa, Influenza virus
HAVPNGTKVNT

SEQ ID NO: 399874 - protein, 11 aa, Influenza virus
AVPNGTKVNTL

SEQ ID NO: 399875 - protein, 11 aa, Influenza virus
VPNGTKVNTLT

SEQ ID NO: 399876 - protein, 11 aa, Influenza virus
PNGTKVNTLTE

SEQ ID NO: 399877 - protein, 11 aa, Influenza virus
NGTKVNTLTEK

SEQ ID NO: 399878 - protein, 11 aa, Influenza virus
GTKVNTLTEKG

SEQ ID NO: 399879 - protein, 11 aa, Influenza virus
TKVNTLTEKGV

SEQ ID NO: 399880 - protein, 11 aa, Influenza virus
KVNTLTEKGVE

SEQ ID NO: 399881 - protein, 11 aa, Influenza virus
VNTLTEKGVEV

SEQ ID NO: 399882 - protein, 11 aa, Influenza virus
NTLTEKGVEVV

SEQ ID NO: 399883 - protein, 11 aa, Influenza virus
TLTEKGVEVVN

SEQ ID NO: 399884 - protein, 11 aa, Influenza virus
LTEKGVEVVNA

SEQ ID NO: 399885 - protein, 11 aa, Influenza virus
TEKGVEVVNAT

SEQ ID NO: 399886 - protein, 11 aa, Influenza virus
EKGVEVVNATE

SEQ ID NO: 399887 - protein, 11 aa, Influenza virus
KGVEVVNATET

SEQ ID NO: 399888 - protein, 11 aa, Influenza virus
ATETVEITGIN

SEQ ID NO: 399889 - protein, 11 aa, Influenza virus
TETVEITGINK

SEQ ID NO: 399890 - protein, 11 aa, Influenza virus
ETVEITGINKV

SEQ ID NO: 399891 - protein, 11 aa, Influenza virus
TVEITGINKVC

SEQ ID NO: 399892 - protein, 11 aa, Influenza virus
VEITGINKVCT

SEQ ID NO: 399893 - protein, 11 aa, Influenza virus
EITGINKVCTK

SEQ ID NO: 399894 - protein, 11 aa, Influenza virus
ITGINKVCTKG

SEQ ID NO: 399895 - protein, 11 aa, Influenza virus
TGINKVCTKGK

SEQ ID NO: 399896 - protein, 11 aa, Influenza virus
GINKVCTKGKK

SEQ ID NO: 399897 - protein, 11 aa, Influenza virus
INKVCTKGKKA

SEQ ID NO: 399898 - protein, 11 aa, Influenza virus
NKVCTKGKKAV

SEQ ID NO: 399899 - protein, 11 aa, Influenza virus
GTIIGPPQCDS

SEQ ID NO: 399900 - protein, 11 aa, Influenza virus
TIIGPPQCDSH

SEQ ID NO: 399901 - protein, 11 aa, Influenza virus
IIGPPQCDSHL

SEQ ID NO: 399902 - protein, 11 aa, Influenza virus
IGPPQCDSHLK

SEQ ID NO: 399903 - protein, 11 aa, Influenza virus
GPPQCDSHLKF

SEQ ID NO: 399904 - protein, 11 aa, Influenza virus
PPQCDSHLKFK

SEQ ID NO: 399905 - protein, 11 aa, Influenza virus
PQCDSHLKFKA

SEQ ID NO: 399906 - protein, 11 aa, Influenza virus
QCDSHLKFKAD

SEQ ID NO: 399907 - protein, 11 aa, Influenza virus
CDSHLKFKADL

SEQ ID NO: 399908 - protein, 11 aa, Influenza virus
DSHLKFKADLI

SEQ ID NO: 399909 - protein, 11 aa, Influenza virus
SHLKFKADLII

SEQ ID NO: 399910 - protein, 11 aa, Influenza virus
HLKFKADLIIE

SEQ ID NO: 399911 - protein, 11 aa, Influenza virus
LKFKADLIIER

SEQ ID NO: 399912 - protein, 11 aa, Influenza virus
KFKADLIIERR

SEQ ID NO: 399913 - protein, 11 aa, Influenza virus
RNSSDICYPGK

SEQ ID NO: 399914 - protein, 11 aa, Influenza virus
NSSDICYPGKF

SEQ ID NO: 399915 - protein, 11 aa, Influenza virus
SSDICYPGKFT

SEQ ID NO: 399916 - protein, 11 aa, Influenza virus
SDICYPGKFTN

SEQ ID NO: 399917 - protein, 11 aa, Influenza virus
DICYPGKFTNE

SEQ ID NO: 399918 - protein, 11 aa, Influenza virus
ICYPGKFTNEE

SEQ ID NO: 399919 - protein, 11 aa, Influenza virus
CYPGKFTNEEA

SEQ ID NO: 399920 - protein, 11 aa, Influenza virus
YPGKFTNEEAL

SEQ ID NO: 399921 - protein, 11 aa, Influenza virus
PGKFTNEEALR

SEQ ID NO: 399922 - protein, 11 aa, Influenza virus
GKFTNEEALRQ

SEQ ID NO: 399923 - protein, 11 aa, Influenza virus
KFTNEEALRQI

SEQ ID NO: 399924 - protein, 11 aa, Influenza virus
IRESGGIDKEP

SEQ ID NO: 399925 - protein, 11 aa, Influenza virus
RESGGIDKEPM

SEQ ID NO: 399926 - protein, 11 aa, Influenza virus
ESGGIDKEPMG

SEQ ID NO: 399927 - protein, 11 aa, Influenza virus
SGGIDKEPMGF

SEQ ID NO: 399928 - protein, 11 aa, Influenza virus
GGIDKEPMGFR

SEQ ID NO: 399929 - protein, 11 aa, Influenza virus
GIDKEPMGFRY

SEQ ID NO: 399930 - protein, 11 aa, Influenza virus
IDKEPMGFRYS

SEQ ID NO: 399931 - protein, 11 aa, Influenza virus
DKEPMGFRYSG

SEQ ID NO: 399932 - protein, 11 aa, Influenza virus
KEPMGFRYSGI

SEQ ID NO: 399933 - protein, 11 aa, Influenza virus
EPMGFRYSGIK

SEQ ID NO: 399934 - protein, 11 aa, Influenza virus
PMGFRYSGIKT

SEQ ID NO: 399935 - protein, 11 aa, Influenza virus
MGFRYSGIKTD

SEQ ID NO: 399936 - protein, 11 aa, Influenza virus
GFRYSGIKTDG

SEQ ID NO: 399937 - protein, 11 aa, Influenza virus
FRYSGIKTDGA

SEQ ID NO: 399938 - protein, 11 aa, Influenza virus
RYSGIKTDGAT

SEQ ID NO: 399939 - protein, 11 aa, Influenza virus
YSGIKTDGATS

SEQ ID NO: 399940 - protein, 11 aa, Influenza virus
SGIKTDGATSA

SEQ ID NO: 399941 - protein, 11 aa, Influenza virus
GIKTDGATSAC

SEQ ID NO: 399942 - protein, 11 aa, Influenza virus
IKTDGATSACK

SEQ ID NO: 399943 - protein, 11 aa, Influenza virus
KTDGATSACKR

SEQ ID NO: 399944 - protein, 11 aa, Influenza virus
SSFYSEMKWLL

SEQ ID NO: 399945 - protein, 11 aa, Influenza virus
SFYSEMKWLLS

SEQ ID NO: 399946 - protein, 11 aa, Influenza virus
FYSEMKWLLSS

SEQ ID NO: 399947 - protein, 11 aa, Influenza virus
YSEMKWLLSSK

SEQ ID NO: 399948 - protein, 11 aa, Influenza virus
SEMKWLLSSKA

SEQ ID NO: 399949 - protein, 11 aa, Influenza virus
EMKWLLSSKAN

SEQ ID NO: 399950 - protein, 11 aa, Influenza virus
MKWLLSSKANQ

SEQ ID NO: 399951 - protein, 11 aa, Influenza virus
KWLLSSKANQV

SEQ ID NO: 399952 - protein, 11 aa, Influenza virus
WLLSSKANQVF

SEQ ID NO: 399953 - protein, 11 aa, Influenza virus
LLSSKANQVFP

SEQ ID NO: 399954 - protein, 11 aa, Influenza virus
LSSKANQVFPQ

SEQ ID NO: 399955 - protein, 11 aa, Influenza virus
SSKANQVFPQL

SEQ ID NO: 399956 - protein, 11 aa, Influenza virus
SKANQVFPQLN

SEQ ID NO: 399957 - protein, 11 aa, Influenza virus
KANQVFPQLNQ

SEQ ID NO: 399958 - protein, 11 aa, Influenza virus
ANQVFPQLNQT

SEQ ID NO: 399959 - protein, 11 aa, Influenza virus
FPQLNQTYRNN

SEQ ID NO: 399960 - protein, 11 aa, Influenza virus
PQLNQTYRNNR

SEQ ID NO: 399961 - protein, 11 aa, Influenza virus
QLNQTYRNNRK

SEQ ID NO: 399962 - protein, 11 aa, Influenza virus
LNQTYRNNRKE

SEQ ID NO: 399963 - protein, 11 aa, Influenza virus
NQTYRNNRKEP

SEQ ID NO: 399964 - protein, 11 aa, Influenza virus
QTYRNNRKEPA

SEQ ID NO: 399965 - protein, 11 aa, Influenza virus
TYRNNRKEPAL

SEQ ID NO: 399966 - protein, 11 aa, Influenza virus
YRNNRKEPALI

SEQ ID NO: 399967 - protein, 11 aa, Influenza virus
RNNRKEPALIV

SEQ ID NO: 399968 - protein, 11 aa, Influenza virus
NNRKEPALIVW

SEQ ID NO: 399969 - protein, 11 aa, Influenza virus
NRKEPALIVWG

SEQ ID NO: 399970 - protein, 11 aa, Influenza virus
SLDEQNKLYGA

SEQ ID NO: 399971 - protein, 11 aa, Influenza virus
LDEQNKLYGAG

SEQ ID NO: 399972 - protein, 11 aa, Influenza virus
DEQNKLYGAGN

SEQ ID NO: 399973 - protein, 11 aa, Influenza virus
EQNKLYGAGNK

SEQ ID NO: 399974 - protein, 11 aa, Influenza virus
QNKLYGAGNKL

SEQ ID NO: 399975 - protein, 11 aa, Influenza virus
NKLYGAGNKLI

SEQ ID NO: 399976 - protein, 11 aa, Influenza virus
KLYGAGNKLIT

SEQ ID NO: 399977 - protein, 11 aa, Influenza virus
LYGAGNKLITV

SEQ ID NO: 399978 - protein, 11 aa, Influenza virus
YGAGNKLITVG

SEQ ID NO: 399979 - protein, 11 aa, Influenza virus
GAGNKLITVGS

SEQ ID NO: 399980 - protein, 11 aa, Influenza virus
AGNKLITVGSS

SEQ ID NO: 399981 - protein, 11 aa, Influenza virus
KLITVGSSKYR

SEQ ID NO: 399982 - protein, 11 aa, Influenza virus
LITVGSSKYRQ

SEQ ID NO: 399983 - protein, 11 aa, Influenza virus
ITVGSSKYRQS

SEQ ID NO: 399984 - protein, 11 aa, Influenza virus
TVGSSKYRQSF

SEQ ID NO: 399985 - protein, 11 aa, Influenza virus
VGSSKYRQSFS

SEQ ID NO: 399986 - protein, 11 aa, Influenza virus
GSSKYRQSFSP

SEQ ID NO: 399987 - protein, 11 aa, Influenza virus
SSKYRQSFSPS

SEQ ID NO: 399988 - protein, 11 aa, Influenza virus
SKYRQSFSPSP

SEQ ID NO: 399989 - protein, 11 aa, Influenza virus
KYRQSFSPSPG

SEQ ID NO: 399990 - protein, 11 aa, Influenza virus
YQQSFSPSPGD

SEQ ID NO: 399991 - protein, 11 aa, Influenza virus
QQSFSPSPGDR

SEQ ID NO: 399992 - protein, 11 aa, Influenza virus
QSFSPSPGDRP

SEQ ID NO: 399993 - protein, 11 aa, Influenza virus
SFSPSPGDRPK

SEQ ID NO: 399994 - protein, 11 aa, Influenza virus
FSPSPGDRPKV

SEQ ID NO: 399995 - protein, 11 aa, Influenza virus
SPSPGDRPKVN

SEQ ID NO: 399996 - protein, 11 aa, Influenza virus
PSPGDRPKVNG

SEQ ID NO: 399997 - protein, 11 aa, Influenza virus
SPGDRPKVNGQ

SEQ ID NO: 399998 - protein, 11 aa, Influenza virus
PGDRPKVNGQA

SEQ ID NO: 399999 - protein, 11 aa, Influenza virus
GDRPKVNGQAG

SEQ ID NO: 400000 - protein, 11 aa, Influenza virus
DRPKVNGQAGR

SEQ ID NO: 400001 - protein, 11 aa, Influenza virus
TFLRSNAPSGV

SEQ ID NO: 400002 - protein, 11 aa, Influenza virus
FLRSNAPSGVE

SEQ ID NO: 400003 - protein, 11 aa, Influenza virus
LRSNAPSGVEY

SEQ ID NO: 400004 - protein, 11 aa, Influenza virus
RSNAPSGVEYN

SEQ ID NO: 400005 - protein, 11 aa, Influenza virus
SNAPSGVEYNG

SEQ ID NO: 400006 - protein, 11 aa, Influenza virus
NAPSGVEYNGK

SEQ ID NO: 400007 - protein, 11 aa, Influenza virus
APSGVEYNGKS

SEQ ID NO: 400008 - protein, 11 aa, Influenza virus
PSGVEYNGKSL

SEQ ID NO: 400009 - protein, 11 aa, Influenza virus
SGVEYNGKSLG

SEQ ID NO: 400010 - protein, 11 aa, Influenza virus
GVEYNGKSLGI

SEQ ID NO: 400011 - protein, 11 aa, Influenza virus
VEYNGKSLGIQ

SEQ ID NO: 400012 - protein, 11 aa, Influenza virus
SPLPFQNIDSW

SEQ ID NO: 400013 - protein, 11 aa, Influenza virus
PLPFQNIDSWA

SEQ ID NO: 400014 - protein, 11 aa, Influenza virus
LPFQNIDSWAV

SEQ ID NO: 400015 - protein, 11 aa, Influenza virus
PFQNIDSWAVG

SEQ ID NO: 400016 - protein, 11 aa, Influenza virus
FQNIDSWAVGR

SEQ ID NO: 400017 - protein, 11 aa, Influenza virus
QNIDSWAVGRC

SEQ ID NO: 400018 - protein, 11 aa, Influenza virus
NIDSWAVGRCP

SEQ ID NO: 400019 - protein, 11 aa, Influenza virus
IDSWAVGRCPR

SEQ ID NO: 400020 - protein, 11 aa, Influenza virus
DSWAVGRCPRY

SEQ ID NO: 400021 - protein, 11 aa, Influenza virus
SWAVGRCPRYV

SEQ ID NO: 400022 - protein, 11 aa, Influenza virus
WAVGRCPRYVK

SEQ ID NO: 400023 - protein, 11 aa, Influenza virus
AVGRCPRYVKQ

SEQ ID NO: 400024 - protein, 11 aa, Influenza virus
VGRCPRYVKQS

SEQ ID NO: 400025 - protein, 11 aa, Influenza virus
GRCPRYVKQSS

SEQ ID NO: 400026 - protein, 11 aa, Influenza virus
RCPRYVKQSSL

SEQ ID NO: 400027 - protein, 11 aa, Influenza virus
LGMKNVPEKIH

SEQ ID NO: 400028 - protein, 11 aa, Influenza virus
GMKNVPEKIHT

SEQ ID NO: 400029 - protein, 11 aa, Influenza virus
MKNVPEKIHTR

SEQ ID NO: 400030 - protein, 11 aa, Influenza virus
KNVPEKIHTRG

SEQ ID NO: 400031 - protein, 11 aa, Influenza virus
NVPEKIHTRGL

SEQ ID NO: 400032 - protein, 11 aa, Influenza virus
VPEKIHTRGLF

SEQ ID NO: 400033 - protein, 11 aa, Influenza virus
PEKIHTRGLFG

SEQ ID NO: 400034 - protein, 11 aa, Influenza virus
EKIHTRGLFGA

SEQ ID NO: 400035 - protein, 11 aa, Influenza virus
KIHTRGLFGAI

SEQ ID NO: 400036 - protein, 11 aa, Influenza virus
IHTRGLFGAIA

SEQ ID NO: 400037 - protein, 11 aa, Influenza virus
HTRGLFGAIAG

SEQ ID NO: 400038 - protein, 11 aa, Influenza virus
VKRRPVAKAGF

SEQ ID NO: 400039 - protein, 11 aa, Influenza virus
KRRPVAKAGFI

SEQ ID NO: 400040 - protein, 11 aa, Influenza virus
RRPVAKAGFIE

SEQ ID NO: 400041 - protein, 11 aa, Influenza virus
RPVAKAGFIEN

SEQ ID NO: 400042 - protein, 11 aa, Influenza virus
PVAKAGFIENG

SEQ ID NO: 400043 - protein, 11 aa, Influenza virus
VAKAGFIENGW

SEQ ID NO: 400044 - protein, 11 aa, Influenza virus
AKAGFIENGWE

SEQ ID NO: 400045 - protein, 11 aa, Influenza virus
KAGFIENGWEG

SEQ ID NO: 400046 - protein, 11 aa, Influenza virus
KLNRLIEKTNT

SEQ ID NO: 400047 - protein, 11 aa, Influenza virus
LNRLIEKTNTQ

SEQ ID NO: 400048 - protein, 11 aa, Influenza virus
NRLIEKTNTQF

SEQ ID NO: 400049 - protein, 11 aa, Influenza virus
RLIEKTNTQFE

SEQ ID NO: 400050 - protein, 11 aa, Influenza virus
LIEKTNTQFEL

SEQ ID NO: 400051 - protein, 11 aa, Influenza virus
IEKTNTQFELI

SEQ ID NO: 400052 - protein, 11 aa, Influenza virus
EKTNTQFELID

SEQ ID NO: 400053 - protein, 11 aa, Influenza virus
KTNTQFELIDN

SEQ ID NO: 400054 - protein, 11 aa, Influenza virus
TNTQFELIDNE

SEQ ID NO: 400055 - protein, 11 aa, Influenza virus
NTQFELIDNEF

SEQ ID NO: 400056 - protein, 11 aa, Influenza virus
TQFELIDNEFT

SEQ ID NO: 400057 - protein, 11 aa, Influenza virus
RIMINPVKLSG

SEQ ID NO: 400058 - protein, 11 aa, Influenza virus
IMINPVKLSGG

SEQ ID NO: 400059 - protein, 11 aa, Influenza virus
MINPVKLSGGY

SEQ ID NO: 400060 - protein, 11 aa, Influenza virus
INPVKLSGGYK

SEQ ID NO: 400061 - protein, 11 aa, Influenza virus
NPVKLSGGYKD

SEQ ID NO: 400062 - protein, 11 aa, Influenza virus
PVKLSGGYKDV

SEQ ID NO: 400063 - protein, 11 aa, Influenza virus
VKLSGGYKDVI

SEQ ID NO: 400064 - protein, 11 aa, Influenza virus
KLSGGYKDVIL

SEQ ID NO: 400065 - protein, 11 aa, Influenza virus
LSGGYKDVILW

SEQ ID NO: 400066 - protein, 11 aa, Influenza virus
SGGYKDVILWF

SEQ ID NO: 400067 - protein, 11 aa, Influenza virus
GGYKDVILWFS

SEQ ID NO: 400068 - protein, 11 aa, Influenza virus
VKYSRADKICI

SEQ ID NO: 400069 - protein, 11 aa, Influenza virus
KYSRADKICIG

SEQ ID NO: 400070 - protein, 11 aa, Influenza virus
YSRADKICIGY

SEQ ID NO: 400071 - protein, 11 aa, Influenza virus
SRADKICIGYL

SEQ ID NO: 400072 - protein, 11 aa, Influenza virus
RADKICIGYLS

SEQ ID NO: 400073 - protein, 11 aa, Influenza virus
KICIGYLSNNA

SEQ ID NO: 400074 - protein, 11 aa, Influenza virus
ICIGYLSNNST

SEQ ID NO: 400075 - protein, 11 aa, Influenza virus
CIGYLSNNSTD

SEQ ID NO: 400076 - protein, 11 aa, Influenza virus
IGYLSNNSTDK

SEQ ID NO: 400077 - protein, 11 aa, Influenza virus
GYLSNNSTDKV

SEQ ID NO: 400078 - protein, 11 aa, Influenza virus
YLSNNSTDKVD

SEQ ID NO: 400079 - protein, 11 aa, Influenza virus
LSNNSTDKVDT

SEQ ID NO: 400080 - protein, 11 aa, Influenza virus
SNNSTDKVDTL

SEQ ID NO: 400081 - protein, 11 aa, Influenza virus
NNSTDKVDTLT

SEQ ID NO: 400082 - protein, 11 aa, Influenza virus
NSTDKVDTLTE

SEQ ID NO: 400083 - protein, 11 aa, Influenza virus
TDTVDTLTENG

SEQ ID NO: 400084 - protein, 11 aa, Influenza virus
DKVDTLTENGV

SEQ ID NO: 400085 - protein, 11 aa, Influenza virus
KVDTLTENGVP

SEQ ID NO: 400086 - protein, 11 aa, Influenza virus
IDTLTETGVPV

SEQ ID NO: 400087 - protein, 11 aa, Influenza virus
DTLTETGVPVT

SEQ ID NO: 400088 - protein, 11 aa, Influenza virus
TLTETGVPVTS

SEQ ID NO: 400089 - protein, 11 aa, Influenza virus
LTETGVPVTSS

SEQ ID NO: 400090 - protein, 11 aa, Influenza virus
TENGVPVTSSV

SEQ ID NO: 400091 - protein, 11 aa, Influenza virus
ENGVPVTSSVD

SEQ ID NO: 400092 - protein, 11 aa, Influenza virus
NGVPVTSSVDL

SEQ ID NO: 400093 - protein, 11 aa, Influenza virus
GVPVTSSIDLV

SEQ ID NO: 400094 - protein, 11 aa, Influenza virus
VPVTSSIDLVE

SEQ ID NO: 400095 - protein, 11 aa, Influenza virus
PVTSSIDLVET

SEQ ID NO: 400096 - protein, 11 aa, Influenza virus
VTSSIDLVETN

SEQ ID NO: 400097 - protein, 11 aa, Influenza virus
TSSIDLVETNH

SEQ ID NO: 400098 - protein, 11 aa, Influenza virus
SSIDLVETNHT

SEQ ID NO: 400099 - protein, 11 aa, Influenza virus
SIDLVETNHTG

SEQ ID NO: 400100 - protein, 11 aa, Influenza virus
IDLVETNHTGT

SEQ ID NO: 400101 - protein, 11 aa, Influenza virus
HTGTYCSLNGI

SEQ ID NO: 400102 - protein, 11 aa, Influenza virus
TGTYCSLNGIS

SEQ ID NO: 400103 - protein, 11 aa, Influenza virus
GTYCSLNGISP

SEQ ID NO: 400104 - protein, 11 aa, Influenza virus
TYCSLNGISPI

SEQ ID NO: 400105 - protein, 11 aa, Influenza virus
YCSLNGISPIH

SEQ ID NO: 400106 - protein, 11 aa, Influenza virus
CSLNGISPIHL

SEQ ID NO: 400107 - protein, 11 aa, Influenza virus
SLNGISPIHLG

SEQ ID NO: 400108 - protein, 11 aa, Influenza virus
LNGISPIHLGD

SEQ ID NO: 400109 - protein, 11 aa, Influenza virus
NGISPIHLGDC

SEQ ID NO: 400110 - protein, 11 aa, Influenza virus
GISPIHLGDCS

SEQ ID NO: 400111 - protein, 11 aa, Influenza virus
ISPIHLGDCSF

SEQ ID NO: 400112 - protein, 11 aa, Influenza virus
SPVHLGDCSFE

SEQ ID NO: 400113 - protein, 11 aa, Influenza virus
PVHLGDCSFEG

SEQ ID NO: 400114 - protein, 11 aa, Influenza virus
VHLGDCSFEGW

SEQ ID NO: 400115 - protein, 11 aa, Influenza virus
GWIVGNPSCAS

SEQ ID NO: 400116 - protein, 11 aa, Influenza virus
WIVGNPSCASN

SEQ ID NO: 400117 - protein, 11 aa, Influenza virus
IVGNPSCASNI

SEQ ID NO: 400118 - protein, 11 aa, Influenza virus
VGNPSCASNIN

SEQ ID NO: 400119 - protein, 11 aa, Influenza virus
GNPSCASNINI

SEQ ID NO: 400120 - protein, 11 aa, Influenza virus
NPSCASNINIR

SEQ ID NO: 400121 - protein, 11 aa, Influenza virus
PSCASNINIRE

SEQ ID NO: 400122 - protein, 11 aa, Influenza virus
SCASNINIREW

SEQ ID NO: 400123 - protein, 11 aa, Influenza virus
CASNINIREWS

SEQ ID NO: 400124 - protein, 11 aa, Influenza virus
ASNINIREWSY

SEQ ID NO: 400125 - protein, 11 aa, Influenza virus
SNINIREWSYL

SEQ ID NO: 400126 - protein, 11 aa, Influenza virus
SYLIEDPNAPH

SEQ ID NO: 400127 - protein, 11 aa, Influenza virus
YLIEDPNAPHK

SEQ ID NO: 400128 - protein, 11 aa, Influenza virus
LIEDPNAPHKL

SEQ ID NO: 400129 - protein, 11 aa, Influenza virus
IEDPNAPHKLC

SEQ ID NO: 400130 - protein, 11 aa, Influenza virus
EDPNAPNKLCF

SEQ ID NO: 400131 - protein, 11 aa, Influenza virus
DPNAPHKLCFP

SEQ ID NO: 400132 - protein, 11 aa, Influenza virus
PNAPHKLCFPG

SEQ ID NO: 400133 - protein, 11 aa, Influenza virus
NAPHKLCFPGE

SEQ ID NO: 400134 - protein, 11 aa, Influenza virus
KLCYPGELDNN

SEQ ID NO: 400135 - protein, 11 aa, Influenza virus
LCYPGELDNNG

SEQ ID NO: 400136 - protein, 11 aa, Influenza virus
CYPGELDNNGE

SEQ ID NO: 400137 - protein, 11 aa, Influenza virus
YPGELDNNGEL

SEQ ID NO: 400138 - protein, 11 aa, Influenza virus
PGEVDNNGELR

SEQ ID NO: 400139 - protein, 11 aa, Influenza virus
GEVDNNGELRH

SEQ ID NO: 400140 - protein, 11 aa, Influenza virus
EVDNNGELRHL

SEQ ID NO: 400141 - protein, 11 aa, Influenza virus
VDNNGELRHLF

SEQ ID NO: 400142 - protein, 11 aa, Influenza virus
VNSFSRTELIN

SEQ ID NO: 400143 - protein, 11 aa, Influenza virus
NSFSRTELINP

SEQ ID NO: 400144 - protein, 11 aa, Influenza virus
SFSRTELINPS

SEQ ID NO: 400145 - protein, 11 aa, Influenza virus
FSRTELIPPSK

SEQ ID NO: 400146 - protein, 11 aa, Influenza virus
SRTELINPSKW

SEQ ID NO: 400147 - protein, 11 aa, Influenza virus
RTELINPSKWG

SEQ ID NO: 400148 - protein, 11 aa, Influenza virus
PSKWGDILEGT

SEQ ID NO: 400149 - protein, 11 aa, Influenza virus
SKWGDILEGTT

SEQ ID NO: 400150 - protein, 11 aa, Influenza virus
KWGDILEGTTA

SEQ ID NO: 400151 - protein, 11 aa, Influenza virus
WGDILEGTTAS

SEQ ID NO: 400152 - protein, 11 aa, Influenza virus
GDILEGTTASC

SEQ ID NO: 400153 - protein, 11 aa, Influenza virus
DILEGTTASCQ

SEQ ID NO: 400154 - protein, 11 aa, Influenza virus
ILEGTTASCQN

SEQ ID NO: 400155 - protein, 11 aa, Influenza virus
LEGTTASCQNR

SEQ ID NO: 400156 - protein, 11 aa, Influenza virus
EGTTASCQNRG

SEQ ID NO: 400157 - protein, 11 aa, Influenza virus
GTTASCQNRGA

SEQ ID NO: 400158 - protein, 11 aa, Influenza virus
SFYRNLIWLVN

SEQ ID NO: 400159 - protein, 11 aa, Influenza virus
NGKYPVIKGDY

SEQ ID NO: 400160 - protein, 11 aa, Influenza virus
VKGEYNNTTGR

SEQ ID NO: 400161 - protein, 11 aa, Influenza virus
KGEYNNTTGRD

SEQ ID NO: 400162 - protein, 11 aa, Influenza virus
GEYNNTTGRDV

SEQ ID NO: 400163 - protein, 11 aa, Influenza virus
EYNNTTGRDVL

SEQ ID NO: 400164 - protein, 11 aa, Influenza virus
LVLWGIHHPDS

SEQ ID NO: 400165 - protein, 11 aa, Influenza virus
VLWGIHHPDSE

SEQ ID NO: 400166 - protein, 11 aa, Influenza virus
LWGIHHPDTEA

SEQ ID NO: 400167 - protein, 11 aa, Influenza virus
WGIHHPDTEAT

SEQ ID NO: 400168 - protein, 11 aa, Influenza virus
GIHHPDTEATA

SEQ ID NO: 400169 - protein, 11 aa, Influenza virus
ATKLYVNKNPY

SEQ ID NO: 400170 - protein, 11 aa, Influenza virus
TKLYVNKNPYT

SEQ ID NO: 400171 - protein, 11 aa, Influenza virus
NLYVNKNPYTL

SEQ ID NO: 400172 - protein, 11 aa, Influenza virus
LYASKNPYTLV

SEQ ID NO: 400173 - protein, 11 aa, Influenza virus
YASKNPYTLVS

SEQ ID NO: 400174 - protein, 11 aa, Influenza virus
ASKNPYTLVST

SEQ ID NO: 400175 - protein, 11 aa, Influenza virus
SKNPYTLVSTK

SEQ ID NO: 400176 - protein, 11 aa, Influenza virus
YTLVSTKEWSR

SEQ ID NO: 400177 - protein, 11 aa, Influenza virus
TLVSTKEWSRR

SEQ ID NO: 400178 - protein, 11 aa, Influenza virus
LVSTKEWSRRY

SEQ ID NO: 400179 - protein, 11 aa, Influenza virus
VSTKEWSRRYE

SEQ ID NO: 400180 - protein, 11 aa, Influenza virus
STKEWSRRYEL

SEQ ID NO: 400181 - protein, 11 aa, Influenza virus
TKEWSRRYELE

SEQ ID NO: 400182 - protein, 11 aa, Influenza virus
KEWSRRYELEI

SEQ ID NO: 400183 - protein, 11 aa, Influenza virus
EWSRRYELEIG

SEQ ID NO: 400184 - protein, 11 aa, Influenza virus
WSRRYELEIGT

SEQ ID NO: 400185 - protein, 11 aa, Influenza virus
SRRYELEIGTR

SEQ ID NO: 400186 - protein, 11 aa, Influenza virus
RRYELEIGTRI

SEQ ID NO: 400187 - protein, 11 aa, Influenza virus
RYELEIGARIG

SEQ ID NO: 400188 - protein, 11 aa, Influenza virus
YELEIGTRIGE

SEQ ID NO: 400189 - protein, 11 aa, Influenza virus
ELEIGARIGEG

SEQ ID NO: 400190 - protein, 11 aa, Influenza virus
LEIGARIGEGQ

SEQ ID NO: 400191 - protein, 11 aa, Influenza virus
EIGARIGEGQR

SEQ ID NO: 400192 - protein, 11 aa, Influenza virus
IGARIGEGQRS

SEQ ID NO: 400193 - protein, 11 aa, Influenza virus
GARIGEGQRSW

SEQ ID NO: 400194 - protein, 11 aa, Influenza virus
ARIGEGQRSWM

SEQ ID NO: 400195 - protein, 11 aa, Influenza virus
RIGEGQRSWMK

SEQ ID NO: 400196 - protein, 11 aa, Influenza virus
IGDGQRSWMKI

SEQ ID NO: 400197 - protein, 11 aa, Influenza virus
GDGQRSWMKIY

SEQ ID NO: 400198 - protein, 11 aa, Influenza virus
DGQRSWMKIYW

SEQ ID NO: 400199 - protein, 11 aa, Influenza virus
GQRSWMKIYWH

SEQ ID NO: 400200 - protein, 11 aa, Influenza virus
QRSWMKIYWHL

SEQ ID NO: 400201 - protein, 11 aa, Influenza virus
RSWMKIYWHLM

SEQ ID NO: 400202 - protein, 11 aa, Influenza virus
SWMKLYWHLMR

SEQ ID NO: 400203 - protein, 11 aa, Influenza virus
WMKLYWHLMRP

SEQ ID NO: 400204 - protein, 11 aa, Influenza virus
MKLYWHLMRPG

SEQ ID NO: 400205 - protein, 11 aa, Influenza virus
KLYWHLMRPGE

SEQ ID NO: 400206 - protein, 11 aa, Influenza virus
LYWHLMRPGER

SEQ ID NO: 400207 - protein, 11 aa, Influenza virus
YWHLMRPGERI

SEQ ID NO: 400208 - protein, 11 aa, Influenza virus
PGERIMFESNG

SEQ ID NO: 400209 - protein, 11 aa, Influenza virus
GERIMFESNGG

SEQ ID NO: 400210 - protein, 11 aa, Influenza virus
ERIMFESNGGL

SEQ ID NO: 400211 - protein, 11 aa, Influenza virus
MFESNGGLIAP

SEQ ID NO: 400212 - protein, 11 aa, Influenza virus
FESNGGLIAPR

SEQ ID NO: 400213 - protein, 11 aa, Influenza virus
ESNGGLIAPRY

SEQ ID NO: 400214 - protein, 11 aa, Influenza virus
SNGGLIAPRYG

SEQ ID NO: 400215 - protein, 11 aa, Influenza virus
NGGLIAPRYGY

SEQ ID NO: 400216 - protein, 11 aa, Influenza virus
GGLIAPRYGYI

SEQ ID NO: 400217 - protein, 11 aa, Influenza virus
GLIAPRYGYII

SEQ ID NO: 400218 - protein, 11 aa, Influenza virus
LIAPRYGYIIE

SEQ ID NO: 400219 - protein, 11 aa, Influenza virus
IAPRYGYIIEK

SEQ ID NO: 400220 - protein, 11 aa, Influenza virus
RYGYIIEKYGS

SEQ ID NO: 400221 - protein, 11 aa, Influenza virus
YGYIIEKYGSG

SEQ ID NO: 400222 - protein, 11 aa, Influenza virus
GYIIEKYGSGR

SEQ ID NO: 400223 - protein, 11 aa, Influenza virus
YIIEKYGSGRI

SEQ ID NO: 400224 - protein, 11 aa, Influenza virus
IIEKYGSGRIF

SEQ ID NO: 400225 - protein, 11 aa, Influenza virus
IEKYGSGRIFQ

SEQ ID NO: 400226 - protein, 11 aa, Influenza virus
EKYGSGRIFQS

SEQ ID NO: 400227 - protein, 11 aa, Influenza virus
KYGSGRIFQSG

SEQ ID NO: 400228 - protein, 11 aa, Influenza virus
YGSGRIFQSGV

SEQ ID NO: 400229 - protein, 11 aa, Influenza virus
GSGRIFQSGVR

SEQ ID NO: 400230 - protein, 11 aa, Influenza virus
GRIFQSGVRLA

SEQ ID NO: 400231 - protein, 11 aa, Influenza virus
RLAKCNTKCQT

SEQ ID NO: 400232 - protein, 11 aa, Influenza virus
LAKCNTKCQTS

SEQ ID NO: 400233 - protein, 11 aa, Influenza virus
KCNTKCQTSVG

SEQ ID NO: 400234 - protein, 11 aa, Influenza virus
CNTKCQTSVGG

SEQ ID NO: 400235 - protein, 11 aa, Influenza virus
NTKCQTSLGGI

SEQ ID NO: 400236 - protein, 11 aa, Influenza virus
GGVNTNKTFQN

SEQ ID NO: 400237 - protein, 11 aa, Influenza virus
GVNTNKTFQNI

SEQ ID NO: 400238 - protein, 11 aa, Influenza virus
VNTNKTFQNIE

SEQ ID NO: 400239 - protein, 11 aa, Influenza virus
NTNKTFQNIDR

SEQ ID NO: 400240 - protein, 11 aa, Influenza virus
TNKTFQNIDRN

SEQ ID NO: 400241 - protein, 11 aa, Influenza virus
NKTFQNIDRNA

SEQ ID NO: 400242 - protein, 11 aa, Influenza virus
KTFQNIDRNAI

SEQ ID NO: 400243 - protein, 11 aa, Influenza virus
TFQNIDRNAIG

SEQ ID NO: 400244 - protein, 11 aa, Influenza virus
FQNIDRNAIGD

SEQ ID NO: 400245 - protein, 11 aa, Influenza virus
QNIDRNAIGDC

SEQ ID NO: 400246 - protein, 11 aa, Influenza virus
NIDRNAIGDCP

SEQ ID NO: 400247 - protein, 11 aa, Influenza virus
IDRNAIGDCPK

SEQ ID NO: 400248 - protein, 11 aa, Influenza virus
DRNAIGDCPKY

SEQ ID NO: 400249 - protein, 11 aa, Influenza virus
RNAIGDCPKYI

SEQ ID NO: 400250 - protein, 11 aa, Influenza virus
NAIGDCPKYIK

SEQ ID NO: 400251 - protein, 11 aa, Influenza virus
AIGDCPKYIKS

SEQ ID NO: 400252 - protein, 11 aa, Influenza virus
IGDCPKYIKSG

SEQ ID NO: 400253 - protein, 11 aa, Influenza virus
KLATGLRNVPI

SEQ ID NO: 400254 - protein, 11 aa, Influenza virus
LATGLRNVPIP

SEQ ID NO: 400255 - protein, 11 aa, Influenza virus
VERGLFGAIAG

SEQ ID NO: 400256 - protein, 11 aa, Influenza virus
EQGTGIAADKT

SEQ ID NO: 400257 - protein, 11 aa, Influenza virus
QGTGIAADKTS

SEQ ID NO: 400258 - protein, 11 aa, Influenza virus
GTGIAADKTST

SEQ ID NO: 400259 - protein, 11 aa, Influenza virus
TGIAADKTSTQ

SEQ ID NO: 400260 - protein, 11 aa, Influenza virus
GIAADKTSTQK

SEQ ID NO: 400261 - protein, 11 aa, Influenza virus
IAADKTSTQKA

SEQ ID NO: 400262 - protein, 11 aa, Influenza virus
AADKTSTQKAI

SEQ ID NO: 400263 - protein, 11 aa, Influenza virus
ADKASTQKAIN

SEQ ID NO: 400264 - protein, 11 aa, Influenza virus
DKASTQKAINE

SEQ ID NO: 400265 - protein, 11 aa, Influenza virus
KASTQKAINEI

SEQ ID NO: 400266 - protein, 11 aa, Influenza virus
ASTQKAINEIT

SEQ ID NO: 400267 - protein, 11 aa, Influenza virus
STQKAIDEITT

SEQ ID NO: 400268 - protein, 11 aa, Influenza virus
TQKAIDEITTK

SEQ ID NO: 400269 - protein, 11 aa, Influenza virus
QKAIDEITTKI

SEQ ID NO: 400270 - protein, 11 aa, Influenza virus
KAIDEITTKIN

SEQ ID NO: 400271 - protein, 11 aa, Influenza virus
AIDEITTKINN

SEQ ID NO: 400272 - protein, 11 aa, Influenza virus
IDEITTKINNI

SEQ ID NO: 400273 - protein, 11 aa, Influenza virus
DEITTKINNII

SEQ ID NO: 400274 - protein, 11 aa, Influenza virus
FNQVEKRINMI

SEQ ID NO: 400275 - protein, 11 aa, Influenza virus
NQVEKRINMIA

SEQ ID NO: 400276 - protein, 11 aa, Influenza virus
QVEKRINMIAD

SEQ ID NO: 400277 - protein, 11 aa, Influenza virus
VEKRINMIADR

SEQ ID NO: 400278 - protein, 11 aa, Influenza virus
EKRINMIADRV

SEQ ID NO: 400279 - protein, 11 aa, Influenza virus
KRINMIADRVD

SEQ ID NO: 400280 - protein, 11 aa, Influenza virus
RINMIADRVDD

SEQ ID NO: 400281 - protein, 11 aa, Influenza virus
INMIADRVDDA

SEQ ID NO: 400282 - protein, 11 aa, Influenza virus
NMIADRVDDAV

SEQ ID NO: 400283 - protein, 11 aa, Influenza virus
MIADRVDDAVT

SEQ ID NO: 400284 - protein, 11 aa, Influenza virus
IADRVDDAVTD

SEQ ID NO: 400285 - protein, 11 aa, Influenza virus
ADRVDDAVTDV

SEQ ID NO: 400286 - protein, 11 aa, Influenza virus
DRVDDAVTDVW

SEQ ID NO: 400287 - protein, 11 aa, Influenza virus
RVDDAVTDVWS

SEQ ID NO: 400288 - protein, 11 aa, Influenza virus
VDDAVTDVWSY

SEQ ID NO: 400289 - protein, 11 aa, Influenza virus
DDAVTDVWSYN

SEQ ID NO: 400290 - protein, 11 aa, Influenza virus
DAVTDVWSYNA

SEQ ID NO: 400291 - protein, 11 aa, Influenza virus
AVTDVWSYNAK

SEQ ID NO: 400292 - protein, 11 aa, Influenza virus
VTDVWSYNAKL

SEQ ID NO: 400293 - protein, 11 aa, Influenza virus
TDVWSYNAKLL

SEQ ID NO: 400294 - protein, 11 aa, Influenza virus
DVWSYNAKLLV

SEQ ID NO: 400295 - protein, 11 aa, Influenza virus
VWSYNAKLLVL

SEQ ID NO: 400296 - protein, 11 aa, Influenza virus
WSYNAKLLVLL

SEQ ID NO: 400297 - protein, 11 aa, Influenza virus
SYNAKLLVLLE

SEQ ID NO: 400298 - protein, 11 aa, Influenza virus
YNAKLLVLLEN

SEQ ID NO: 400299 - protein, 11 aa, Influenza virus
NAKLLVLLENG

SEQ ID NO: 400300 - protein, 11 aa, Influenza virus
AKLLVLLENGR

SEQ ID NO: 400301 - protein, 11 aa, Influenza virus
KLLVLLENGRT

SEQ ID NO: 400302 - protein, 11 aa, Influenza virus
LLVLLENGRTL

SEQ ID NO: 400303 - protein, 11 aa, Influenza virus
LVLLENGRTLD

SEQ ID NO: 400304 - protein, 11 aa, Influenza virus
VLLENGRTLDL

SEQ ID NO: 400305 - protein, 11 aa, Influenza virus
LLENGRTLDLH

SEQ ID NO: 400306 - protein, 11 aa, Influenza virus
LENGRTLDLHD

SEQ ID NO: 400307 - protein, 11 aa, Influenza virus
ENGRTLDLHDA

SEQ ID NO: 400308 - protein, 11 aa, Influenza virus
NGRTLDLHDAN

SEQ ID NO: 400309 - protein, 11 aa, Influenza virus
GRTLDLHDANV

SEQ ID NO: 400310 - protein, 11 aa, Influenza virus
RTLDLHDANVK

SEQ ID NO: 400311 - protein, 11 aa, Influenza virus
TLDLHDANVKN

SEQ ID NO: 400312 - protein, 11 aa, Influenza virus
LDLHDANVKNL

SEQ ID NO: 400313 - protein, 11 aa, Influenza virus
DLHDANVKNLH

SEQ ID NO: 400314 - protein, 11 aa, Influenza virus
LHDANVRNLHE

SEQ ID NO: 400315 - protein, 11 aa, Influenza virus
HDANVRNLHEQ

SEQ ID NO: 400316 - protein, 11 aa, Influenza virus
DANVRNLHEQI

SEQ ID NO: 400317 - protein, 11 aa, Influenza virus
ANVRNLHEQIK

SEQ ID NO: 400318 - protein, 11 aa, Influenza virus
NVRNLHEQIKR

SEQ ID NO: 400319 - protein, 11 aa, Influenza virus
LKDNAIDEGDG

SEQ ID NO: 400320 - protein, 11 aa, Influenza virus
KSNAIDEGDGC

SEQ ID NO: 400321 - protein, 11 aa, Influenza virus
SNAIDEGDGCF

SEQ ID NO: 400322 - protein, 11 aa, Influenza virus
NAIDEGDGCFS

SEQ ID NO: 400323 - protein, 11 aa, Influenza virus
AIDEGDGCFSI

SEQ ID NO: 400324 - protein, 11 aa, Influenza virus
IDEGDGCFSIL

SEQ ID NO: 400325 - protein, 11 aa, Influenza virus
DEGDGCFSILH

SEQ ID NO: 400326 - protein, 11 aa, Influenza virus
EGDGCFSILHK

SEQ ID NO: 400327 - protein, 11 aa, Influenza virus
GDGCFSILHKC

SEQ ID NO: 400328 - protein, 11 aa, Influenza virus
DGCFSILHKCN

SEQ ID NO: 400329 - protein, 11 aa, Influenza virus
GCFSILHKCND

SEQ ID NO: 400330 - protein, 11 aa, Influenza virus
CFSILHKCNDS

SEQ ID NO: 400331 - protein, 11 aa, Influenza virus
FSILHKCNDSC

SEQ ID NO: 400332 - protein, 11 aa, Influenza virus
SILHKCNDSCM

SEQ ID NO: 400333 - protein, 11 aa, Influenza virus
ILHKCNDSCME

SEQ ID NO: 400334 - protein, 11 aa, Influenza virus
LHKCNDSCMEA

SEQ ID NO: 400335 - protein, 11 aa, Influenza virus
HKCNDSCMEAI

SEQ ID NO: 400336 - protein, 11 aa, Influenza virus
KCNDSCMEAIR

SEQ ID NO: 400337 - protein, 11 aa, Influenza virus
CNDSCMEAIRN

SEQ ID NO: 400338 - protein, 11 aa, Influenza virus
NDSCMEAIRNG

SEQ ID NO: 400339 - protein, 11 aa, Influenza virus
DSCMEAIRNGT

SEQ ID NO: 400340 - protein, 11 aa, Influenza virus
SCMEAIRNGTY

SEQ ID NO: 400341 - protein, 11 aa, Influenza virus
CMEAIRNGTYN

SEQ ID NO: 400342 - protein, 11 aa, Influenza virus
MEAIRNGTYNH

SEQ ID NO: 400343 - protein, 11 aa, Influenza virus
EAIRNGTYNHE

SEQ ID NO: 400344 - protein, 11 aa, Influenza virus
AIRNGTYNHED

SEQ ID NO: 400345 - protein, 11 aa, Influenza virus
RNGTYNHEDYR

SEQ ID NO: 400346 - protein, 11 aa, Influenza virus
NGTYNHEDYRE

SEQ ID NO: 400347 - protein, 11 aa, Influenza virus
GTYNHEDYREE

SEQ ID NO: 400348 - protein, 11 aa, Influenza virus
TYNHEDYREES

SEQ ID NO: 400349 - protein, 11 aa, Influenza virus
YNHEDYREESQ

SEQ ID NO: 400350 - protein, 11 aa, Influenza virus
NHEDYREESQL

SEQ ID NO: 400351 - protein, 11 aa, Influenza virus
HEDYREESQLK

SEQ ID NO: 400352 - protein, 11 aa, Influenza virus
EDYREESQLKR

SEQ ID NO: 400353 - protein, 11 aa, Influenza virus
DYREESQLKRQ

SEQ ID NO: 400354 - protein, 11 aa, Influenza virus
YREESQLKRQE

SEQ ID NO: 400355 - protein, 11 aa, Influenza virus
REESQLKRQEI

SEQ ID NO: 400356 - protein, 11 aa, Influenza virus
EESQLKKQEIE

SEQ ID NO: 400357 - protein, 11 aa, Influenza virus
ESQLKKQEIEG

SEQ ID NO: 400358 - protein, 11 aa, Influenza virus
SQLKKQEIEGI

SEQ ID NO: 400359 - protein, 11 aa, Influenza virus
QLKKQEIEGIK

SEQ ID NO: 400360 - protein, 11 aa, Influenza virus
LKKQEIEGIKL

SEQ ID NO: 400361 - protein, 11 aa, Influenza virus
KKQEIEGIKLK

SEQ ID NO: 400362 - protein, 11 aa, Influenza virus
KQEIEGIKLKT

SEQ ID NO: 400363 - protein, 11 aa, Influenza virus
QEIEGIKLKSE

SEQ ID NO: 400364 - protein, 11 aa, Influenza virus
EIEGIKLKSED

SEQ ID NO: 400365 - protein, 11 aa, Influenza virus
IEGIKLKSEDN

SEQ ID NO: 400366 - protein, 11 aa, Influenza virus
EGIKLKTEDNI

SEQ ID NO: 400367 - protein, 11 aa, Influenza virus
GIKLKTEDNIY

SEQ ID NO: 400368 - protein, 11 aa, Influenza virus
IKLKTEDNIYK

SEQ ID NO: 400369 - protein, 11 aa, Influenza virus
KLKTEDNVYKI

SEQ ID NO: 400370 - protein, 11 aa, Influenza virus
LKTEDNVYKIL

SEQ ID NO: 400371 - protein, 11 aa, Influenza virus
KTEDNVYKILS

SEQ ID NO: 400372 - protein, 11 aa, Influenza virus
TEDNVYKVLSI

SEQ ID NO: 400373 - protein, 11 aa, Influenza virus
EDNVYKILSIY

SEQ ID NO: 400374 - protein, 11 aa, Influenza virus
DNVYKILSIYS

SEQ ID NO: 400375 - protein, 11 aa, Influenza virus
NVYKILSIYSC

SEQ ID NO: 400376 - protein, 11 aa, Influenza virus
VYKILSIYSCI

SEQ ID NO: 400377 - protein, 11 aa, Influenza virus
YKVLSIYSCIA

SEQ ID NO: 400378 - protein, 11 aa, Influenza virus
KVLSIYSCIAS

SEQ ID NO: 400379 - protein, 11 aa, Influenza virus
VLSIYSCIASS

SEQ ID NO: 400380 - protein, 11 aa, Influenza virus
LSIYSCIASST

SEQ ID NO: 400381 - protein, 11 aa, Influenza virus
SIYSCIASSTV

SEQ ID NO: 400382 - protein, 11 aa, Influenza virus
IYSCIASSVVL

SEQ ID NO: 400383 - protein, 11 aa, Influenza virus
YSCIASSIVMV

SEQ ID NO: 400384 - protein, 11 aa, Influenza virus
SCIASSIVLVG

SEQ ID NO: 400385 - protein, 11 aa, Influenza virus
CIASSIVMVGL

SEQ ID NO: 400386 - protein, 11 aa, Influenza virus
IASSVVLVGLI

SEQ ID NO: 400387 - protein, 11 aa, Influenza virus
ASSIVLVGLIL

SEQ ID NO: 400388 - protein, 11 aa, Influenza virus
SSIVLVGLILA

SEQ ID NO: 400389 - protein, 11 aa, Influenza virus
SIVLVGLILAF

SEQ ID NO: 400390 - protein, 11 aa, Influenza virus
IVLVGLILAFI

SEQ ID NO: 400391 - protein, 11 aa, Influenza virus
VMVGLILAFIM

SEQ ID NO: 400392 - protein, 11 aa, Influenza virus
MVGLILAFIMW

SEQ ID NO: 400393 - protein, 11 aa, Influenza virus
VGLILAFILWA

SEQ ID NO: 400394 - protein, 11 aa, Influenza virus
GLILAFILWAC

SEQ ID NO: 400395 - protein, 11 aa, Influenza virus
LILAFILWACS

SEQ ID NO: 400396 - protein, 11 aa, Influenza virus
ILAFIMWACSN

SEQ ID NO: 400397 - protein, 11 aa, Influenza virus
LAFIMWACSNG

SEQ ID NO: 400398 - protein, 11 aa, Influenza virus
AFIMWACSNGS

SEQ ID NO: 400399 - protein, 11 aa, Influenza virus
FIMWACSNGSC

SEQ ID NO: 400400 - protein, 11 aa, Influenza virus
IMWACSNGSCR

SEQ ID NO: 400401 - protein, 11 aa, Influenza virus
MWACSNGSCRF

SEQ ID NO: 400402 - protein, 11 aa, Influenza virus
WACSNGSCRFN

SEQ ID NO: 400403 - protein, 11 aa, Influenza virus
ACSNGSCRFNV

SEQ ID NO: 400404 - protein, 11 aa, Influenza virus
CSNGSCRFNVC

SEQ ID NO: 400405 - protein, 11 aa, Influenza virus
SNGSCRFNVCI

SEQ ID NO: 400406 - protein, 11 aa, Influenza virus
KQGKTKATKME

SEQ ID NO: 400407 - protein, 11 aa, Influenza virus
QGKTKATKMEA

SEQ ID NO: 400408 - protein, 11 aa, Influenza virus
GKTKATKMEAI

SEQ ID NO: 400409 - protein, 11 aa, Influenza virus
KTKATKMEAIL

SEQ ID NO: 400410 - protein, 11 aa, Influenza virus
TKATKMEAILV

SEQ ID NO: 400411 - protein, 11 aa, Influenza virus
KATKMEAILVV

SEQ ID NO: 400412 - protein, 11 aa, Influenza virus
ATKMKAIIVVL

SEQ ID NO: 400413 - protein, 11 aa, Influenza virus
TKMKAIIVVLL

SEQ ID NO: 400414 - protein, 11 aa, Influenza virus
SNAPSGVEYNG

SEQ ID NO: 400415 - protein, 11 aa, Influenza virus
NAPSGVEYNGK

SEQ ID NO: 400416 - protein, 11 aa, Influenza virus
APSGVEYNGKS

SEQ ID NO: 400417 - protein, 11 aa, Influenza virus
PSGVEYNGKSL

SEQ ID NO: 400418 - protein, 11 aa, Influenza virus
SGVEYNGKSLG

SEQ ID NO: 400419 - protein, 11 aa, Influenza virus
GVEYNGKSLGI

SEQ ID NO: 400420 - protein, 11 aa, Influenza virus
VEYNGKSLGIQ

SEQ ID NO: 400421 - protein, 11 aa, Influenza virus
LFGAIAGFIEN

SEQ ID NO: 400422 - protein, 11 aa, Influenza virus
FGAIAGFIENG

SEQ ID NO: 400423 - protein, 11 aa, Influenza virus
GAIAGFIENGW

SEQ ID NO: 400424 - protein, 11 aa, Influenza virus
AIAGFIEGGWP

SEQ ID NO: 400425 - protein, 11 aa, Influenza virus
IAGFIEGGWPG

SEQ ID NO: 400426 - protein, 11 aa, Influenza virus
AGFIEGGWPGL

SEQ ID NO: 400427 - protein, 11 aa, Influenza virus
GFIEGGWTGMI

SEQ ID NO: 400428 - protein, 11 aa, Influenza virus
FIEGGWTGMID

SEQ ID NO: 400429 - protein, 11 aa, Influenza virus
IEGGWTGMIDG

SEQ ID NO: 400430 - protein, 11 aa, Influenza virus
EGGWTGMIDGW

SEQ ID NO: 400431 - protein, 11 aa, Influenza virus
GGWTGMIDGWY

SEQ ID NO: 400432 - protein, 11 aa, Influenza virus
GWTGMIDGWYG

SEQ ID NO: 400433 - protein, 11 aa, Influenza virus
WTGMIDGWYGY

SEQ ID NO: 400434 - protein, 11 aa, Influenza virus
TGMIDGWYGYH

SEQ ID NO: 400435 - protein, 11 aa, Influenza virus
GMIDGWYGYHH

SEQ ID NO: 400436 - protein, 11 aa, Influenza virus
YQAELLVAMEN

SEQ ID NO: 400437 - protein, 11 aa, Influenza virus
SLQCRICILDQ

SEQ ID NO: 400438 - protein, 11 aa, Influenza virus
LQCRICIDFRD

SEQ ID NO: 400439 - protein, 11 aa, Influenza virus
QCRICILDQNF

SEQ ID NO: 400440 - protein, 11 aa, Influenza virus
CRICIDFRDMR

SEQ ID NO: 400441 - protein, 11 aa, Influenza virus
RICILDQNFRN

SEQ ID NO: 400442 - protein, 11 aa, Influenza virus
ICIDFRDMRKN

SEQ ID NO: 400443 - protein, 11 aa, Influenza virus
CILDQNFRNIR

SEQ ID NO: 400444 - protein, 11 aa, Influenza virus
ILDQNFRNIRK

SEQ ID NO: 400445 - protein, 11 aa, Influenza virus
KQGKTKATKME

SEQ ID NO: 400446 - protein, 11 aa, Influenza virus
QGKTKATKMEA

SEQ ID NO: 400447 - protein, 11 aa, Influenza virus
GKTKATKMEAI

SEQ ID NO: 400448 - protein, 11 aa, Influenza virus
KTKATKMEAIL

SEQ ID NO: 400449 - protein, 11 aa, Influenza virus
TKATKMEAILV

SEQ ID NO: 400450 - protein, 11 aa, Influenza virus
KATKMEAILVV

SEQ ID NO: 400451 - protein, 11 aa, Influenza virus
ATKMKAIIVVL

SEQ ID NO: 400452 - protein, 11 aa, Influenza virus
TKMKAIIVVLL

SEQ ID NO: 400453 - protein, 11 aa, Influenza virus
KMEAILVVLLY

SEQ ID NO: 400454 - protein, 11 aa, Influenza virus
ADTICIGYHAN

SEQ ID NO: 400455 - protein, 11 aa, Influenza virus
DTICIGYHANN

SEQ ID NO: 400456 - protein, 11 aa, Influenza virus
TICIGYHANNS

SEQ ID NO: 400457 - protein, 11 aa, Influenza virus
ICIGYHANNST

SEQ ID NO: 400458 - protein, 11 aa, Influenza virus
CVGYHANNSTD

SEQ ID NO: 400459 - protein, 11 aa, Influenza virus
VGYHANNSTDT

SEQ ID NO: 400460 - protein, 11 aa, Influenza virus
ANNSTDTVDTI

SEQ ID NO: 400461 - protein, 11 aa, Influenza virus
NNSTDTVDTIL

SEQ ID NO: 400462 - protein, 11 aa, Influenza virus
NSTDTVDTILE

SEQ ID NO: 400463 - protein, 11 aa, Influenza virus
STDTVDTILEK

SEQ ID NO: 400464 - protein, 11 aa, Influenza virus
TDTVDTILEKN

SEQ ID NO: 400465 - protein, 11 aa, Influenza virus
TVDTILEKNVT

SEQ ID NO: 400466 - protein, 11 aa, Influenza virus
VDTILEKNVTV

SEQ ID NO: 400467 - protein, 11 aa, Influenza virus
DTILEKNVTVT

SEQ ID NO: 400468 - protein, 11 aa, Influenza virus
TILEKNVTVTH

SEQ ID NO: 400469 - protein, 11 aa, Influenza virus
ILEKNVTVTHS

SEQ ID NO: 400470 - protein, 11 aa, Influenza virus
LERNVTVTHSV

SEQ ID NO: 400471 - protein, 11 aa, Influenza virus
ERNVTVTHSVN

SEQ ID NO: 400472 - protein, 11 aa, Influenza virus
KNVTVTHSVNI

SEQ ID NO: 400473 - protein, 11 aa, Influenza virus
NVTVTHSVNIL

SEQ ID NO: 400474 - protein, 11 aa, Influenza virus
VTVTHSVNILE

SEQ ID NO: 400475 - protein, 11 aa, Influenza virus
VAGWILGNPEC

SEQ ID NO: 400476 - protein, 11 aa, Influenza virus
NYEELREQLSS

SEQ ID NO: 400477 - protein, 11 aa, Influenza virus
YEELKEQLSTV

SEQ ID NO: 400478 - protein, 11 aa, Influenza virus
EELKEQLSTVS

SEQ ID NO: 400479 - protein, 11 aa, Influenza virus
ELKEQLSTVSS

SEQ ID NO: 400480 - protein, 11 aa, Influenza virus
LKEQLSTVSSF

SEQ ID NO: 400481 - protein, 11 aa, Influenza virus
EQLSSVSSFEK

SEQ ID NO: 400482 - protein, 11 aa, Influenza virus
QLSSVSSFEKF

SEQ ID NO: 400483 - protein, 11 aa, Influenza virus
LSSVSSFEKFE

SEQ ID NO: 400484 - protein, 11 aa, Influenza virus
SSVSSFEKFEI

SEQ ID NO: 400485 - protein, 11 aa, Influenza virus
SVSSFEKFEIF

SEQ ID NO: 400486 - protein, 11 aa, Influenza virus
VSSFEKFEIFP

SEQ ID NO: 400487 - protein, 11 aa, Influenza virus
SSFEKFEIFPK

SEQ ID NO: 400488 - protein, 11 aa, Influenza virus
KEKENSYPKIN

SEQ ID NO: 400489 - protein, 11 aa, Influenza virus
EKENSYPKINK

SEQ ID NO: 400490 - protein, 11 aa, Influenza virus
DTIIFEANGNL

SEQ ID NO: 400491 - protein, 11 aa, Influenza virus
TIGECPKYVRS

SEQ ID NO: 400492 - protein, 11 aa, Influenza virus
IGECPKYVRSA

SEQ ID NO: 400493 - protein, 11 aa, Influenza virus
LRMVTGLRNIP

SEQ ID NO: 400494 - protein, 11 aa, Influenza virus
RMVTGLRNIPS

SEQ ID NO: 400495 - protein, 11 aa, Influenza virus
VTGLRNIPSIQ

SEQ ID NO: 400496 - protein, 11 aa, Influenza virus
TGLRNIPSIQS

SEQ ID NO: 400497 - protein, 11 aa, Influenza virus
GLRNIPSIQSR

SEQ ID NO: 400498 - protein, 11 aa, Influenza virus
LRNIPSIQSRG

SEQ ID NO: 400499 - protein, 11 aa, Influenza virus
RNIPSIQSRGL

SEQ ID NO: 400500 - protein, 11 aa, Influenza virus
NIPSIQSRGLF

SEQ ID NO: 400501 - protein, 11 aa, Influenza virus
IPSIQSRGLFG

SEQ ID NO: 400502 - protein, 11 aa, Influenza virus
PSVQSRGLFGA

SEQ ID NO: 400503 - protein, 11 aa, Influenza virus
SVQSRGLFGAI

SEQ ID NO: 400504 - protein, 11 aa, Influenza virus
VQSRGLFGAIA

SEQ ID NO: 400505 - protein, 11 aa, Influenza virus
GFIEGGWTGMI

SEQ ID NO: 400506 - protein, 11 aa, Influenza virus
FIEGGWTGMID

SEQ ID NO: 400507 - protein, 11 aa, Influenza virus
IEGGWTGMIDG

SEQ ID NO: 400508 - protein, 11 aa, Influenza virus
EGGWTGMIDGW

SEQ ID NO: 400509 - protein, 11 aa, Influenza virus
GGWTGMIDGWY

SEQ ID NO: 400510 - protein, 11 aa, Influenza virus
GWTGMIDGWYG

SEQ ID NO: 400511 - protein, 11 aa, Influenza virus
WTGMIDGWYGY

SEQ ID NO: 400512 - protein, 11 aa, Influenza virus
TGMIDGWYGYH

SEQ ID NO: 400513 - protein, 11 aa, Influenza virus
GMIDGWYGYHH

SEQ ID NO: 400514 - protein, 11 aa, Influenza virus
MIDGWYGYHHQ

SEQ ID NO: 400515 - protein, 11 aa, Influenza virus
IDGWYGYHHQN

SEQ ID NO: 400516 - protein, 11 aa, Influenza virus
DGWYGYHHQNG

SEQ ID NO: 400517 - protein, 11 aa, Influenza virus
GWYGYHHQNGQ

SEQ ID NO: 400518 - protein, 11 aa, Influenza virus
WYGYHHQNGQG

SEQ ID NO: 400519 - protein, 11 aa, Influenza virus
YGYHHQNGQGS

SEQ ID NO: 400520 - protein, 11 aa, Influenza virus
GYHHQNGQGSG

SEQ ID NO: 400521 - protein, 11 aa, Influenza virus
YHHQNGQGSGY

SEQ ID NO: 400522 - protein, 11 aa, Influenza virus
HHQNGQGSGYA

SEQ ID NO: 400523 - protein, 11 aa, Influenza virus
HQNGQGSGYAA

SEQ ID NO: 400524 - protein, 11 aa, Influenza virus
QNGQGSGYAAD

SEQ ID NO: 400525 - protein, 11 aa, Influenza virus
NEQGSGYAADQ

SEQ ID NO: 400526 - protein, 11 aa, Influenza virus
EQGSGYAADQK

SEQ ID NO: 400527 - protein, 11 aa, Influenza virus
QGSGYAADQKS

SEQ ID NO: 400528 - protein, 11 aa, Influenza virus
GSGYAADQKST

SEQ ID NO: 400529 - protein, 11 aa, Influenza virus
SGYAADQKSTQ

SEQ ID NO: 400530 - protein, 11 aa, Influenza virus
NKVNSIIEKMN

SEQ ID NO: 400531 - protein, 11 aa, Influenza virus
NSVIEKMNIQF

SEQ ID NO: 400532 - protein, 11 aa, Influenza virus
SVIEKMNIQFT

SEQ ID NO: 400533 - protein, 11 aa, Influenza virus
MNIQFTSVGKE

SEQ ID NO: 400534 - protein, 11 aa, Influenza virus
NIQFTSVGKEF

SEQ ID NO: 400535 - protein, 11 aa, Influenza virus
RMENLNKKVDD

SEQ ID NO: 400536 - protein, 11 aa, Influenza virus
MENLNKKVDDG

SEQ ID NO: 400537 - protein, 11 aa, Influenza virus
ENLNKKIDDGF

SEQ ID NO: 400538 - protein, 11 aa, Influenza virus
NLNKKVDDGFI

SEQ ID NO: 400539 - protein, 11 aa, Influenza virus
LNKKVDDGFID

SEQ ID NO: 400540 - protein, 11 aa, Influenza virus
DDGFIDIWTYN

SEQ ID NO: 400541 - protein, 11 aa, Influenza virus
DGFIDIWTYNA

SEQ ID NO: 400542 - protein, 11 aa, Influenza virus
GFIDIWTYNAE

SEQ ID NO: 400543 - protein, 11 aa, Influenza virus
FIDIWTYNAEL

SEQ ID NO: 400544 - protein, 11 aa, Influenza virus
IDIWTYNAELL

SEQ ID NO: 400545 - protein, 11 aa, Influenza virus
DVWTYNAELLV

SEQ ID NO: 400546 - protein, 11 aa, Influenza virus
VWTYNAELLVL

SEQ ID NO: 400547 - protein, 11 aa, Influenza virus
WTYNAELLILL

SEQ ID NO: 400548 - protein, 11 aa, Influenza virus
TYNAELLILLE

SEQ ID NO: 400549 - protein, 11 aa, Influenza virus
YNAELLILLEN

SEQ ID NO: 400550 - protein, 11 aa, Influenza virus
NAELLILLENE

SEQ ID NO: 400551 - protein, 11 aa, Influenza virus
AELLILLENER

SEQ ID NO: 400552 - protein, 11 aa, Influenza virus
ELLILLENERT

SEQ ID NO: 400553 - protein, 11 aa, Influenza virus
LLILLENERTL

SEQ ID NO: 400554 - protein, 11 aa, Influenza virus
LILLENERTLD

SEQ ID NO: 400555 - protein, 11 aa, Influenza virus
VLLENERTLDF

SEQ ID NO: 400556 - protein, 11 aa, Influenza virus
LLENERTLDFH

SEQ ID NO: 400557 - protein, 11 aa, Influenza virus
LENERTLDFHD

SEQ ID NO: 400558 - protein, 11 aa, Influenza virus
ENERTLDFHDS

SEQ ID NO: 400559 - protein, 11 aa, Influenza virus
NNAKELGNGCF

SEQ ID NO: 400560 - protein, 11 aa, Influenza virus
NAKELGNGCFE

SEQ ID NO: 400561 - protein, 11 aa, Influenza virus
AKELGNGCFEF

SEQ ID NO: 400562 - protein, 11 aa, Influenza virus
KELGNGCFEFY

SEQ ID NO: 400563 - protein, 11 aa, Influenza virus
ELGNGCFEFYH

SEQ ID NO: 400564 - protein, 11 aa, Influenza virus
LGNGCFEFYHK

SEQ ID NO: 400565 - protein, 11 aa, Influenza virus
NGCFEFYHKCN

SEQ ID NO: 400566 - protein, 11 aa, Influenza virus
GCFEFYHKCND

SEQ ID NO: 400567 - protein, 11 aa, Influenza virus
CMESVKNGTYN

SEQ ID NO: 400568 - protein, 11 aa, Influenza virus
MESVKNGTYNY

SEQ ID NO: 400569 - protein, 11 aa, Influenza virus
ESVKNGTYNYP

SEQ ID NO: 400570 - protein, 11 aa, Influenza virus
SVKNGTYNYPK

SEQ ID NO: 400571 - protein, 11 aa, Influenza virus
VKNGTYNYPKY

SEQ ID NO: 400572 - protein, 11 aa, Influenza virus
KNGTYNYPKYS

SEQ ID NO: 400573 - protein, 11 aa, Influenza virus
NGTYNYPKYSE

SEQ ID NO: 400574 - protein, 11 aa, Influenza virus
GTYNYPKYSEE

SEQ ID NO: 400575 - protein, 11 aa, Influenza virus
TYDYPKYSEES

SEQ ID NO: 400576 - protein, 11 aa, Influenza virus
YQILAIYSTAA

SEQ ID NO: 400577 - protein, 11 aa, Influenza virus
QILAIYSTAAS

SEQ ID NO: 400578 - protein, 11 aa, Influenza virus
ILAIYSTAASS

SEQ ID NO: 400579 - protein, 11 aa, Influenza virus
LAIYSTAASSL

SEQ ID NO: 400580 - protein, 11 aa, Influenza virus
AIYSTAASSLV

SEQ ID NO: 400581 - protein, 11 aa, Influenza virus
IYSTAASSLVL

SEQ ID NO: 400582 - protein, 11 aa, Influenza virus
ASSLVLLVSLG

SEQ ID NO: 400583 - protein, 11 aa, Influenza virus
SSLVLLVSLGA

SEQ ID NO: 400584 - protein, 11 aa, Influenza virus
LLVSLGAISFW

SEQ ID NO: 400585 - protein, 11 aa, Influenza virus
LVSLGAISFWM

SEQ ID NO: 400586 - protein, 11 aa, Influenza virus
VSLGAVSFWMC

SEQ ID NO: 400587 - protein, 11 aa, Influenza virus
SLGAVSFWMCS

SEQ ID NO: 400588 - protein, 11 aa, Influenza virus
LGAISFWMCSG

SEQ ID NO: 400589 - protein, 11 aa, Influenza virus
GAISFWMCSGH

SEQ ID NO: 400590 - protein, 11 aa, Influenza virus
AISFWMCSGHS

SEQ ID NO: 400591 - protein, 11 aa, Influenza virus
VSFWMCSNGSL

SEQ ID NO: 400592 - protein, 11 aa, Influenza virus
SFWMCSNGSLR

SEQ ID NO: 400593 - protein, 11 aa, Influenza virus
FWMCSNGSLRC

SEQ ID NO: 400594 - protein, 11 aa, Influenza virus
WMCSNGSLRCR

SEQ ID NO: 400595 - protein, 11 aa, Influenza virus
MCSNGSLQCRV

SEQ ID NO: 400596 - protein, 11 aa, Influenza virus
CSNGSLQCRVC

SEQ ID NO: 400597 - protein, 11 aa, Influenza virus
SNGSLQCRVCI

SEQ ID NO: 400598 - protein, 11 aa, Influenza virus
SLQCRICIDFR

SEQ ID NO: 400599 - protein, 11 aa, Influenza virus
LQCRICIDFRD

SEQ ID NO: 400600 - protein, 11 aa, Influenza virus
QCRICIDFRDM

SEQ ID NO: 400601 - protein, 11 aa, Influenza virus
CRICIDFRDMR

SEQ ID NO: 400602 - protein, 11 aa, Influenza virus
RICIDFRDMRK

SEQ ID NO: 400603 - protein, 11 aa, Influenza virus
ICILDQNFRNI

SEQ ID NO: 400604 - protein, 11 aa, Influenza virus
CIDFRDMRKNT

SEQ ID NO: 400605 - protein, 11 aa, Influenza virus
ILDQNFRNIRK

SEQ ID NO: 400606 - protein, 11 aa, Influenza virus
FKMNPNQKIIT

SEQ ID NO: 400607 - protein, 11 aa, Influenza virus
KMNPNQKIITI

SEQ ID NO: 400608 - protein, 11 aa, Influenza virus
TKDNSIRIGSK

SEQ ID NO: 400609 - protein, 11 aa, Influenza virus
KDNSVRIGSKG

SEQ ID NO: 400610 - protein, 11 aa, Influenza virus
DNSVRIGSKGD

SEQ ID NO: 400611 - protein, 11 aa, Influenza virus
NSVRIGSKGDV

SEQ ID NO: 400612 - protein, 11 aa, Influenza virus
SVRIGSKGDVF

SEQ ID NO: 400613 - protein, 11 aa, Influenza virus
VRIGSKGDVFV

SEQ ID NO: 400614 - protein, 11 aa, Influenza virus
RIGSKGDIFVI

SEQ ID NO: 400615 - protein, 11 aa, Influenza virus
IGSKGDIFVIR

SEQ ID NO: 400616 - protein, 11 aa, Influenza virus
GSKGDIFVIRE

SEQ ID NO: 400617 - protein, 11 aa, Influenza virus
SKGDIFVIREP

SEQ ID NO: 400618 - protein, 11 aa, Influenza virus
KGDIFVIREPF

SEQ ID NO: 400619 - protein, 11 aa, Influenza virus
GDIFVIREPFI

SEQ ID NO: 400620 - protein, 11 aa, Influenza virus
DIFVIREPFIS

SEQ ID NO: 400621 - protein, 11 aa, Influenza virus
IFVIREPFISC

SEQ ID NO: 400622 - protein, 11 aa, Influenza virus
FVMREPFISCS

SEQ ID NO: 400623 - protein, 11 aa, Influenza virus
VIREPFISCSH

SEQ ID NO: 400624 - protein, 11 aa, Influenza virus
IREPFISCSHL

SEQ ID NO: 400625 - protein, 11 aa, Influenza virus
REPFISCSHLE

SEQ ID NO: 400626 - protein, 11 aa, Influenza virus
EPFISCSHLEC

SEQ ID NO: 400627 - protein, 11 aa, Influenza virus
LECKTFFLTQG

SEQ ID NO: 400628 - protein, 11 aa, Influenza virus
ECKTFFLTQGA

SEQ ID NO: 400629 - protein, 11 aa, Influenza virus
CKTFFLTQGAL

SEQ ID NO: 400630 - protein, 11 aa, Influenza virus
KTFFLTQGALL

SEQ ID NO: 400631 - protein, 11 aa, Influenza virus
FLTQGALLNDR

SEQ ID NO: 400632 - protein, 11 aa, Influenza virus
LTQGALLNDRH

SEQ ID NO: 400633 - protein, 11 aa, Influenza virus
TQGALLNDRHS

SEQ ID NO: 400634 - protein, 11 aa, Influenza virus
QGALLNDRHSN

SEQ ID NO: 400635 - protein, 11 aa, Influenza virus
GALLNDRHSNG

SEQ ID NO: 400636 - protein, 11 aa, Influenza virus
ALLNDRHSNGT

SEQ ID NO: 400637 - protein, 11 aa, Influenza virus
LLNDKHSNGTV

SEQ ID NO: 400638 - protein, 11 aa, Influenza virus
LNDKHSNGTVK

SEQ ID NO: 400639 - protein, 11 aa, Influenza virus
KDRSPYRALMS

SEQ ID NO: 400640 - protein, 11 aa, Influenza virus
DRSPYRALMSC

SEQ ID NO: 400641 - protein, 11 aa, Influenza virus
RSPYRALMSCP

SEQ ID NO: 400642 - protein, 11 aa, Influenza virus
LMSCPLGEAPS

SEQ ID NO: 400643 - protein, 11 aa, Influenza virus
MSCPLGEAPSP

SEQ ID NO: 400644 - protein, 11 aa, Influenza virus
SCPLGEAPSPY

SEQ ID NO: 400645 - protein, 11 aa, Influenza virus
CPLGEAPSPYN

SEQ ID NO: 400646 - protein, 11 aa, Influenza virus
PLGEAPSPYNS

SEQ ID NO: 400647 - protein, 11 aa, Influenza virus
GEAPSPYNSKF

SEQ ID NO: 400648 - protein, 11 aa, Influenza virus
EAPSPYNSKFE

SEQ ID NO: 400649 - protein, 11 aa, Influenza virus
APSPYNSKFES

SEQ ID NO: 400650 - protein, 11 aa, Influenza virus
PSPYNSKFESV

SEQ ID NO: 400651 - protein, 11 aa, Influenza virus
SPYNSKFESVA

SEQ ID NO: 400652 - protein, 11 aa, Influenza virus
PYNSKFESVAW

SEQ ID NO: 400653 - protein, 11 aa, Influenza virus
YNSKFESVAWS

SEQ ID NO: 400654 - protein, 11 aa, Influenza virus
NSKFESVAWSA

SEQ ID NO: 400655 - protein, 11 aa, Influenza virus
SKFESVAWSAS

SEQ ID NO: 400656 - protein, 11 aa, Influenza virus
KFESVAWSASA

SEQ ID NO: 400657 - protein, 11 aa, Influenza virus
AWSASACHDGM

SEQ ID NO: 400658 - protein, 11 aa, Influenza virus
GWLTIGISGPD

SEQ ID NO: 400659 - protein, 11 aa, Influenza virus
WLTIGISGPDD

SEQ ID NO: 400660 - protein, 11 aa, Influenza virus
LTIGISGPDDG

SEQ ID NO: 400661 - protein, 11 aa, Influenza virus
TIGISGPDDGA

SEQ ID NO: 400662 - protein, 11 aa, Influenza virus
IGISGPDDGAV

SEQ ID NO: 400663 - protein, 11 aa, Influenza virus
GISGPDDGAVA

SEQ ID NO: 400664 - protein, 11 aa, Influenza virus
ISGPDDGAVAV

SEQ ID NO: 400665 - protein, 11 aa, Influenza virus
SGPDDGAVAVL

SEQ ID NO: 400666 - protein, 11 aa, Influenza virus
GPDDGAVAVLK

SEQ ID NO: 400667 - protein, 11 aa, Influenza virus
PDDGAVAVLKY

SEQ ID NO: 400668 - protein, 11 aa, Influenza virus
DDGAVAVLKYN

SEQ ID NO: 400669 - protein, 11 aa, Influenza virus
DGAVAVLKYNG

SEQ ID NO: 400670 - protein, 11 aa, Influenza virus
GAVAVLKYKGI

SEQ ID NO: 400671 - protein, 11 aa, Influenza virus
AVAVLKYKGII

SEQ ID NO: 400672 - protein, 11 aa, Influenza virus
VAVLKYKGIIT

SEQ ID NO: 400673 - protein, 11 aa, Influenza virus
AVLKYNGIITG

SEQ ID NO: 400674 - protein, 11 aa, Influenza virus
VLKYNGIITGT

SEQ ID NO: 400675 - protein, 11 aa, Influenza virus
ILRTQESECVC

SEQ ID NO: 400676 - protein, 11 aa, Influenza virus
LRTQESECVCM

SEQ ID NO: 400677 - protein, 11 aa, Influenza virus
QESECVCMNGS

SEQ ID NO: 400678 - protein, 11 aa, Influenza virus
ESECVCMNGSC

SEQ ID NO: 400679 - protein, 11 aa, Influenza virus
NGSCFTIMTDG

SEQ ID NO: 400680 - protein, 11 aa, Influenza virus
GSCFTIMTDGP

SEQ ID NO: 400681 - protein, 11 aa, Influenza virus
SCFTIMTDGPS

SEQ ID NO: 400682 - protein, 11 aa, Influenza virus
APNFHYEECSC

SEQ ID NO: 400683 - protein, 11 aa, Influenza virus
PNFHYEECSCY

SEQ ID NO: 400684 - protein, 11 aa, Influenza virus
NFHYEECSCYP

SEQ ID NO: 400685 - protein, 11 aa, Influenza virus
CVCRDNWHASN

SEQ ID NO: 400686 - protein, 11 aa, Influenza virus
VCRDNWHASNR

SEQ ID NO: 400687 - protein, 11 aa, Influenza virus
CRDNWHASNRP

SEQ ID NO: 400688 - protein, 11 aa, Influenza virus
RDNWHASNRPW

SEQ ID NO: 400689 - protein, 11 aa, Influenza virus
DNWHASNRPWV

SEQ ID NO: 400690 - protein, 11 aa, Influenza virus
NWHASNRPWVS

SEQ ID NO: 400691 - protein, 11 aa, Influenza virus
WHASNRPWVSF

SEQ ID NO: 400692 - protein, 11 aa, Influenza virus
HASNRPWVSFD

SEQ ID NO: 400693 - protein, 11 aa, Influenza virus
NRPWVSFDQNL

SEQ ID NO: 400694 - protein, 11 aa, Influenza virus
IGYICSGVFGD

SEQ ID NO: 400695 - protein, 11 aa, Influenza virus
GYICSGVFGDN

SEQ ID NO: 400696 - protein, 11 aa, Influenza virus
YICSGVFGDNP

SEQ ID NO: 400697 - protein, 11 aa, Influenza virus
ICSGVFGDNPR

SEQ ID NO: 400698 - protein, 11 aa, Influenza virus
CSGVFGDNPRP

SEQ ID NO: 400699 - protein, 11 aa, Influenza virus
GFSYKYGNGVW

SEQ ID NO: 400700 - protein, 11 aa, Influenza virus
RYGNGVWIGRT

SEQ ID NO: 400701 - protein, 11 aa, Influenza virus
YDNGVWIGRTK

SEQ ID NO: 400702 - protein, 11 aa, Influenza virus
DNGVWIGRTKS

SEQ ID NO: 400703 - protein, 11 aa, Influenza virus
GFEMIWDPDGW

SEQ ID NO: 400704 - protein, 11 aa, Influenza virus
FEMIWDPDGWT

SEQ ID NO: 400705 - protein, 11 aa, Influenza virus
TDWSGYSGSFV

SEQ ID NO: 400706 - protein, 11 aa, Influenza virus
DWSGYSGSFVQ

SEQ ID NO: 400707 - protein, 11 aa, Influenza virus
SFVQHPELTGM

SEQ ID NO: 400708 - protein, 11 aa, Influenza virus
FVQHPELTGMN

SEQ ID NO: 400709 - protein, 11 aa, Influenza virus
VQHPELTGMNC

SEQ ID NO: 400710 - protein, 11 aa, Influenza virus
QHPELTGLDCM

SEQ ID NO: 400711 - protein, 11 aa, Influenza virus
DCMRPCFWVEL

SEQ ID NO: 400712 - protein, 11 aa, Influenza virus
CIRPCFWVELV

SEQ ID NO: 400713 - protein, 11 aa, Influenza virus
IRPCFWVELVR

SEQ ID NO: 400714 - protein, 11 aa, Influenza virus
RPCFWVELVRG

SEQ ID NO: 400715 - protein, 11 aa, Influenza virus
PCFWVELVRGL

SEQ ID NO: 400716 - protein, 11 aa, Influenza virus
CFWVELVRGLP

SEQ ID NO: 400717 - protein, 11 aa, Influenza virus
ATIWTSGSSIS

SEQ ID NO: 400718 - protein, 11 aa, Influenza virus
TIWASGSSISF

SEQ ID NO: 400719 - protein, 11 aa, Influenza virus
IWASGSSISFC

SEQ ID NO: 400720 - protein, 11 aa, Influenza virus
WASGSSISFCG

SEQ ID NO: 400721 - protein, 11 aa, Influenza virus
ASGSSISFCGV

SEQ ID NO: 400722 - protein, 11 aa, Influenza virus
SGSSISFCGVD

SEQ ID NO: 400723 - protein, 11 aa, Influenza virus
WSWPDGADLPF

SEQ ID NO: 400724 - protein, 11 aa, Influenza virus
DTLCIGYHANN

SEQ ID NO: 400725 - protein, 11 aa, Influenza virus
TLCIGYHANNS

SEQ ID NO: 400726 - protein, 11 aa, Influenza virus
LCIGYHANNST

SEQ ID NO: 400727 - protein, 11 aa, Influenza virus
CVGYHANNSTD

SEQ ID NO: 400728 - protein, 11 aa, Influenza virus
VGYHANNSTDT

SEQ ID NO: 400729 - protein, 11 aa, Influenza virus
GYHANNSTETV

SEQ ID NO: 400730 - protein, 11 aa, Influenza virus
YHANNSTETVD

SEQ ID NO: 400731 - protein, 11 aa, Influenza virus
HANNSTETVDT

SEQ ID NO: 400732 - protein, 11 aa, Influenza virus
KNVTVTHSINL

SEQ ID NO: 400733 - protein, 11 aa, Influenza virus
NITVTHSVNLL

SEQ ID NO: 400734 - protein, 11 aa, Influenza virus
ITVTHSVNLLE

SEQ ID NO: 400735 - protein, 11 aa, Influenza virus
PFQNIHPVTIG

SEQ ID NO: 400736 - protein, 11 aa, Influenza virus
HPITIGECPKY

SEQ ID NO: 400737 - protein, 11 aa, Influenza virus
PITIGECPKYV

SEQ ID NO: 400738 - protein, 11 aa, Influenza virus
VTIGECPKYVK

SEQ ID NO: 400739 - protein, 11 aa, Influenza virus
TIGECPKYVRS

SEQ ID NO: 400740 - protein, 11 aa, Influenza virus
SIQTRGLFGAI

SEQ ID NO: 400741 - protein, 11 aa, Influenza virus
IQTRGLFGAIA

SEQ ID NO: 400742 - protein, 11 aa, Influenza virus
HSRGLFGAIAG

SEQ ID NO: 400743 - protein, 11 aa, Influenza virus
TRGLFGAIAGF

SEQ ID NO: 400744 - protein, 11 aa, Influenza virus
KGLFGAIAGFI

SEQ ID NO: 400745 - protein, 11 aa, Influenza virus
GFIEGGWTGMV

SEQ ID NO: 400746 - protein, 11 aa, Influenza virus
FIEGGWTGMVD

SEQ ID NO: 400747 - protein, 11 aa, Influenza virus
IEGGWTGMVDG

SEQ ID NO: 400748 - protein, 11 aa, Influenza virus
EGGWTGMVDGW

SEQ ID NO: 400749 - protein, 11 aa, Influenza virus
GGWTGMVDGWY

SEQ ID NO: 400750 - protein, 11 aa, Influenza virus
GWTGMVDGWYG

SEQ ID NO: 400751 - protein, 11 aa, Influenza virus
WTGMVDGWYGY

SEQ ID NO: 400752 - protein, 11 aa, Influenza virus
VWTYNAELLVL

SEQ ID NO: 400753 - protein, 11 aa, Influenza virus
WTYNAELLILL

SEQ ID NO: 400754 - protein, 11 aa, Influenza virus
TYNAELLILLE

SEQ ID NO: 400755 - protein, 11 aa, Influenza virus
YNAELLILLEN

SEQ ID NO: 400756 - protein, 11 aa, Influenza virus
NAELLILLENE

SEQ ID NO: 400757 - protein, 11 aa, Influenza virus
AELLILLENER

SEQ ID NO: 400758 - protein, 11 aa, Influenza virus
ELLILLENERT

SEQ ID NO: 400759 - protein, 11 aa, Influenza virus
LLILLENERTL

SEQ ID NO: 400760 - protein, 11 aa, Influenza virus
LILLENERTLD

SEQ ID NO: 400761 - protein, 11 aa, Influenza virus
VLLENERTLDY

SEQ ID NO: 400762 - protein, 11 aa, Influenza virus
LLENERTLDYH

SEQ ID NO: 400763 - protein, 11 aa, Influenza virus
LENERTLDYHD

SEQ ID NO: 400764 - protein, 11 aa, Influenza virus
ENERTLDYHDS

SEQ ID NO: 400765 - protein, 11 aa, Influenza virus
NERTLDYHDSN

SEQ ID NO: 400766 - protein, 11 aa, Influenza virus
ERTLDYHDSNV

SEQ ID NO: 400767 - protein, 11 aa, Influenza virus
NNAKELGNGCF

SEQ ID NO: 400768 - protein, 11 aa, Influenza virus
NAKELGNGCFE

SEQ ID NO: 400769 - protein, 11 aa, Influenza virus
AKELGNGCFEF

SEQ ID NO: 400770 - protein, 11 aa, Influenza virus
KELGNGCFEFY

SEQ ID NO: 400771 - protein, 11 aa, Influenza virus
ELGNGCFEFYH

SEQ ID NO: 400772 - protein, 11 aa, Influenza virus
LGNGCFEFYHK

SEQ ID NO: 400773 - protein, 11 aa, Influenza virus
GNGCFEFYHRC

SEQ ID NO: 400774 - protein, 11 aa, Influenza virus
NGCFEFYHKCD

SEQ ID NO: 400775 - protein, 11 aa, Influenza virus
GCFEFYHKCDD

SEQ ID NO: 400776 - protein, 11 aa, Influenza virus
CFWMCSNGSLQ

SEQ ID NO: 400777 - protein, 11 aa, Influenza virus
FWMCSNGSLHG

SEQ ID NO: 400778 - protein, 11 aa, Influenza virus
WMCSNGSLQCK

SEQ ID NO: 400779 - protein, 11 aa, Influenza virus
MCSNGSLQCKI

SEQ ID NO: 400780 - protein, 11 aa, Influenza virus
KNNQVILCGPT

SEQ ID NO: 400781 - protein, 11 aa, Influenza virus
IKGFAPFSKDN

SEQ ID NO: 400782 - protein, 11 aa, Influenza virus
KGFAPFSKDNS

SEQ ID NO: 400783 - protein, 11 aa, Influenza virus
APFSEDNSIRL

SEQ ID NO: 400784 - protein, 11 aa, Influenza virus
PFSKDNSIRVS

SEQ ID NO: 400785 - protein, 11 aa, Influenza virus
SKDNSIRLSAS

SEQ ID NO: 400786 - protein, 11 aa, Influenza virus
KDNSIRLSASG

SEQ ID NO: 400787 - protein, 11 aa, Influenza virus
DNSIRLSAGGA

SEQ ID NO: 400788 - protein, 11 aa, Influenza virus
NSIRLSAGGAI

SEQ ID NO: 400789 - protein, 11 aa, Influenza virus
SIRLSAGGAIW

SEQ ID NO: 400790 - protein, 11 aa, Influenza virus
RLSAGGAIWVT

SEQ ID NO: 400791 - protein, 11 aa, Influenza virus
LSAGGAIWVTR

SEQ ID NO: 400792 - protein, 11 aa, Influenza virus
SAGGAIWVTRE

SEQ ID NO: 400793 - protein, 11 aa, Influenza virus
AGGAIWVTREP

SEQ ID NO: 400794 - protein, 11 aa, Influenza virus
GGAIWVTREPY

SEQ ID NO: 400795 - protein, 11 aa, Influenza virus
GAIWVTREPYV

SEQ ID NO: 400796 - protein, 11 aa, Influenza virus
AIWVTREPYVS

SEQ ID NO: 400797 - protein, 11 aa, Influenza virus
VWVTREPYVSC

SEQ ID NO: 400798 - protein, 11 aa, Influenza virus
RCYQFALGQGT

SEQ ID NO: 400799 - protein, 11 aa, Influenza virus
QFALGQGTTLD

SEQ ID NO: 400800 - protein, 11 aa, Influenza virus
FALGQGTTLDN

SEQ ID NO: 400801 - protein, 11 aa, Influenza virus
PHRTLLMNELG

SEQ ID NO: 400802 - protein, 11 aa, Influenza virus
HRTLLMNELGV

SEQ ID NO: 400803 - protein, 11 aa, Influenza virus
RTLLMNELGIP

SEQ ID NO: 400804 - protein, 11 aa, Influenza virus
TLLMNELGIPF

SEQ ID NO: 400805 - protein, 11 aa, Influenza virus
LLMNELGIPFH

SEQ ID NO: 400806 - protein, 11 aa, Influenza virus
LMNELGIPFHL

SEQ ID NO: 400807 - protein, 11 aa, Influenza virus
MNELGIPFHLG

SEQ ID NO: 400808 - protein, 11 aa, Influenza virus
NELGIPFHLGT

SEQ ID NO: 400809 - protein, 11 aa, Influenza virus
ELGVPFHLGTR

SEQ ID NO: 400810 - protein, 11 aa, Influenza virus
LGTRQVCIAWS

SEQ ID NO: 400811 - protein, 11 aa, Influenza virus
GTRQVCIAWSS

SEQ ID NO: 400812 - protein, 11 aa, Influenza virus
TRQVCIAWSSS

SEQ ID NO: 400813 - protein, 11 aa, Influenza virus
RQVCIAWSSSS

SEQ ID NO: 400814 - protein, 11 aa, Influenza virus
QVCMAWSSSSC

SEQ ID NO: 400815 - protein, 11 aa, Influenza virus
VCMAWSSSSCH

SEQ ID NO: 400816 - protein, 11 aa, Influenza virus
CMAWSSSSCHD

SEQ ID NO: 400817 - protein, 11 aa, Influenza virus
MAWSSSSCHDG

SEQ ID NO: 400818 - protein, 11 aa, Influenza virus
AWSSSSCYDGK

SEQ ID NO: 400819 - protein, 11 aa, Influenza virus
WSSSSCYDGKA

SEQ ID NO: 400820 - protein, 11 aa, Influenza virus
SSSSCYDGKAW

SEQ ID NO: 400821 - protein, 11 aa, Influenza virus
SSSCYDGKAWL

SEQ ID NO: 400822 - protein, 11 aa, Influenza virus
SSCYDGKAWLH

SEQ ID NO: 400823 - protein, 11 aa, Influenza virus
SCYDGKAWLHV

SEQ ID NO: 400824 - protein, 11 aa, Influenza virus
CYDGKAWLHVC

SEQ ID NO: 400825 - protein, 11 aa, Influenza virus
ILRTQESECIC

SEQ ID NO: 400826 - protein, 11 aa, Influenza virus
LRTQESECICI

SEQ ID NO: 400827 - protein, 11 aa, Influenza virus
ICTVVMTDGSA

SEQ ID NO: 400828 - protein, 11 aa, Influenza virus
CAVVMTDGSAS

SEQ ID NO: 400829 - protein, 11 aa, Influenza virus
GSAQHIEECSC

SEQ ID NO: 400830 - protein, 11 aa, Influenza virus
SAQHIEECSCY

SEQ ID NO: 400831 - protein, 11 aa, Influenza virus
AQHIEECSCYP

SEQ ID NO: 400832 - protein, 11 aa, Influenza virus
QHIEECSCYPR

SEQ ID NO: 400833 - protein, 11 aa, Influenza virus
HVEECSCYPRF

SEQ ID NO: 400834 - protein, 11 aa, Influenza virus
VEECSCYPRFP

SEQ ID NO: 400835 - protein, 11 aa, Influenza virus
VRCICRDNWKG

SEQ ID NO: 400836 - protein, 11 aa, Influenza virus
RCICRDNWKGS

SEQ ID NO: 400837 - protein, 11 aa, Influenza virus
CICRDNWKGSN

SEQ ID NO: 400838 - protein, 11 aa, Influenza virus
ICRDNWKGSNR

SEQ ID NO: 400839 - protein, 11 aa, Influenza virus
CRDNWRGSNRP

SEQ ID NO: 400840 - protein, 11 aa, Influenza virus
RDNWKGSNRPV

SEQ ID NO: 400841 - protein, 11 aa, Influenza virus
DNWKGSNRPVV

SEQ ID NO: 400842 - protein, 11 aa, Influenza virus
NWKGSNRPVVD

SEQ ID NO: 400843 - protein, 11 aa, Influenza virus
WKGSNRPVVDI

SEQ ID NO: 400844 - protein, 11 aa, Influenza virus
SSYMCSGLVGD

SEQ ID NO: 400845 - protein, 11 aa, Influenza virus
SYMCSGLVGDT

SEQ ID NO: 400846 - protein, 11 aa, Influenza virus
YMCSGLVGDTP

SEQ ID NO: 400847 - protein, 11 aa, Influenza virus
MCSGLVGDTPR

SEQ ID NO: 400848 - protein, 11 aa, Influenza virus
GNHGVKGWAFD

SEQ ID NO: 400849 - protein, 11 aa, Influenza virus
NCINRCFYVEL

SEQ ID NO: 400850 - protein, 11 aa, Influenza virus
CVNRCFYVELI

SEQ ID NO: 400851 - protein, 11 aa, Influenza virus
VNRCFYVELIR

SEQ ID NO: 400852 - protein, 11 aa, Influenza virus
CFYVELIRGRR

SEQ ID NO: 400853 - protein, 11 aa, Influenza virus
VLWTSNSIVVF

SEQ ID NO: 400854 - protein, 11 aa, Influenza virus
LWTSNSIVVFC

SEQ ID NO: 400855 - protein, 11 aa, Influenza virus
WTSNSVVVFCG

SEQ ID NO: 400856 - protein, 11 aa, Influenza virus
TSNSIVVFCST

SEQ ID NO: 400857 - protein, 11 aa, Influenza virus
SNSIVAFCGTS

SEQ ID NO: 400858 - protein, 11 aa, Influenza virus
NSIVVFCGTPG

SEQ ID NO: 400859 - protein, 11 aa, Influenza virus
SIVVFCGTSGI

SEQ ID NO: 400860 - protein, 11 aa, Influenza virus
VVFCGTSGIYG

SEQ ID NO: 400861 - protein, 11 aa, Influenza virus
MDKQTKTMTIT

SEQ ID NO: 400862 - protein, 11 aa, Influenza virus
DKQTKTMTITF

SEQ ID NO: 400863 - protein, 11 aa, Influenza virus
NQTKKMTITFL

SEQ ID NO: 400864 - protein, 11 aa, Influenza virus
QTKKMTITFLI

SEQ ID NO: 400865 - protein, 11 aa, Influenza virus
TKKMTITFLIL

SEQ ID NO: 400866 - protein, 11 aa, Influenza virus
KKMTITFLILL

SEQ ID NO: 400867 - protein, 11 aa, Influenza virus
KMTITFLILLF

SEQ ID NO: 400868 - protein, 11 aa, Influenza virus
GDQICIGYHSN

SEQ ID NO: 400869 - protein, 11 aa, Influenza virus
DQICIGYHSNN

SEQ ID NO: 400870 - protein, 11 aa, Influenza virus
QICIGYHSNNS

SEQ ID NO: 400871 - protein, 11 aa, Influenza virus
ICIGYHSNNST

SEQ ID NO: 400872 - protein, 11 aa, Influenza virus
CIGYHSNNSTE

SEQ ID NO: 400873 - protein, 11 aa, Influenza virus
DTILEQNVTVT

SEQ ID NO: 400874 - protein, 11 aa, Influenza virus
TILEQNVTVTH

SEQ ID NO: 400875 - protein, 11 aa, Influenza virus
ILEQNVTVTHA

SEQ ID NO: 400876 - protein, 11 aa, Influenza virus
LERNVTVTHAQ

SEQ ID NO: 400877 - protein, 11 aa, Influenza virus
NVTVTHAQDIL

SEQ ID NO: 400878 - protein, 11 aa, Influenza virus
VTVTHAQDILE

SEQ ID NO: 400879 - protein, 11 aa, Influenza virus
TVTHAQDILEK

SEQ ID NO: 400880 - protein, 11 aa, Influenza virus
NILEKTHNGKL

SEQ ID NO: 400881 - protein, 11 aa, Influenza virus
ILEKVHNGKLC

SEQ ID NO: 400882 - protein, 11 aa, Influenza virus
GIPPLELRDCS

SEQ ID NO: 400883 - protein, 11 aa, Influenza virus
IPPLELRDCSI

SEQ ID NO: 400884 - protein, 11 aa, Influenza virus
PPLELRDCSIA

SEQ ID NO: 400885 - protein, 11 aa, Influenza virus
PLELRDCSIAG

SEQ ID NO: 400886 - protein, 11 aa, Influenza virus
LELRDCSIAGW

SEQ ID NO: 400887 - protein, 11 aa, Influenza virus
ELRDCSIAGWL

SEQ ID NO: 400888 - protein, 11 aa, Influenza virus
LRDCSIAGWLL

SEQ ID NO: 400889 - protein, 11 aa, Influenza virus
RDCSIAGWLLG

SEQ ID NO: 400890 - protein, 11 aa, Influenza virus
SIAGWLLGNPK

SEQ ID NO: 400891 - protein, 11 aa, Influenza virus
IAGWLLGNPKC

SEQ ID NO: 400892 - protein, 11 aa, Influenza virus
AGWLLGNPKCD

SEQ ID NO: 400893 - protein, 11 aa, Influenza virus
GWLLGNPECDI

SEQ ID NO: 400894 - protein, 11 aa, Influenza virus
WLLGNPECDIL

SEQ ID NO: 400895 - protein, 11 aa, Influenza virus
LLGNPECDILL

SEQ ID NO: 400896 - protein, 11 aa, Influenza virus
VPEWSYIMEKE

SEQ ID NO: 400897 - protein, 11 aa, Influenza virus
SSFFRNMVWLT

SEQ ID NO: 400898 - protein, 11 aa, Influenza virus
SYNNTNGEQIL

SEQ ID NO: 400899 - protein, 11 aa, Influenza virus
INFESTGNLVA

SEQ ID NO: 400900 - protein, 11 aa, Influenza virus
NFESTGNLVAP

SEQ ID NO: 400901 - protein, 11 aa, Influenza virus
FESTGNLVAPE

SEQ ID NO: 400902 - protein, 11 aa, Influenza virus
ESTGNLVAPEY

SEQ ID NO: 400903 - protein, 11 aa, Influenza virus
STGNLVAPEYG

SEQ ID NO: 400904 - protein, 11 aa, Influenza virus
TGNLVAPEYGF

SEQ ID NO: 400905 - protein, 11 aa, Influenza virus
GNLVAPEYGFK

SEQ ID NO: 400906 - protein, 11 aa, Influenza virus
NLVAPEYGFKI

SEQ ID NO: 400907 - protein, 11 aa, Influenza virus
LVAPEYGFKIS

SEQ ID NO: 400908 - protein, 11 aa, Influenza virus
VAPEYGFKISK

SEQ ID NO: 400909 - protein, 11 aa, Influenza virus
APEYGFRISKR

SEQ ID NO: 400910 - protein, 11 aa, Influenza virus
PEYGFRISKRG

SEQ ID NO: 400911 - protein, 11 aa, Influenza virus
EYGFKISKRGG

SEQ ID NO: 400912 - protein, 11 aa, Influenza virus
YGFKISKRGGS

SEQ ID NO: 400913 - protein, 11 aa, Influenza virus
GFKISKRGGSG

SEQ ID NO: 400914 - protein, 11 aa, Influenza virus
FKISKRGGSGI

SEQ ID NO: 400915 - protein, 11 aa, Influenza virus
ISKRGGSGIMK

SEQ ID NO: 400916 - protein, 11 aa, Influenza virus
SKRGGSGIMKT

SEQ ID NO: 400917 - protein, 11 aa, Influenza virus
CETRCQTPLGA

SEQ ID NO: 400918 - protein, 11 aa, Influenza virus
TRCQTPLGAIN

SEQ ID NO: 400919 - protein, 11 aa, Influenza virus
RCQTPLGAINT

SEQ ID NO: 400920 - protein, 11 aa, Influenza virus
CQTPLGALNTT

SEQ ID NO: 400921 - protein, 11 aa, Influenza virus
QTPLGALNTTL

SEQ ID NO: 400922 - protein, 11 aa, Influenza virus
TPLGALNTTLP

SEQ ID NO: 400923 - protein, 11 aa, Influenza virus
PLGALNTTLPF

SEQ ID NO: 400924 - protein, 11 aa, Influenza virus
LGALNTTLPFH

SEQ ID NO: 400925 - protein, 11 aa, Influenza virus
GALNTTLPFHN

SEQ ID NO: 400926 - protein, 11 aa, Influenza virus
AINTTLPFHNV

SEQ ID NO: 400927 - protein, 11 aa, Influenza virus
INTTLPFHNVH

SEQ ID NO: 400928 - protein, 11 aa, Influenza virus
NTTLPFHNVHP

SEQ ID NO: 400929 - protein, 11 aa, Influenza virus
TTLPFHNVHPL

SEQ ID NO: 400930 - protein, 11 aa, Influenza virus
TLPFHNVHPLT

SEQ ID NO: 400931 - protein, 11 aa, Influenza virus
LPFHNVHPLTI

SEQ ID NO: 400932 - protein, 11 aa, Influenza virus
PFHNVHPLTIG

SEQ ID NO: 400933 - protein, 11 aa, Influenza virus
FHNVHPLTIGE

SEQ ID NO: 400934 - protein, 11 aa, Influenza virus
HNVHPLTIGEC

SEQ ID NO: 400935 - protein, 11 aa, Influenza virus
NVHPLTIGECP

SEQ ID NO: 400936 - protein, 11 aa, Influenza virus
VHPLTIGECPK

SEQ ID NO: 400937 - protein, 11 aa, Influenza virus
HPLAIGECPKY

SEQ ID NO: 400938 - protein, 11 aa, Influenza virus
PLAIGECPKYV

SEQ ID NO: 400939 - protein, 11 aa, Influenza virus
LAIGECPKYVK

SEQ ID NO: 400940 - protein, 11 aa, Influenza virus
AIGECPKYVKS

SEQ ID NO: 400941 - protein, 11 aa, Influenza virus
PQIEPRGLFGA

SEQ ID NO: 400942 - protein, 11 aa, Influenza virus
QMESRGLFGAI

SEQ ID NO: 400943 - protein, 11 aa, Influenza virus
MESRGLFGAIA

SEQ ID NO: 400944 - protein, 11 aa, Influenza virus
EPRGLFGAIAG

SEQ ID NO: 400945 - protein, 11 aa, Influenza virus
PRGLFGAIAGF

SEQ ID NO: 400946 - protein, 11 aa, Influenza virus
GFIEGGWQGMI

SEQ ID NO: 400947 - protein, 11 aa, Influenza virus
FIEGGWQGMID

SEQ ID NO: 400948 - protein, 11 aa, Influenza virus
IEGGWQGMIDG

SEQ ID NO: 400949 - protein, 11 aa, Influenza virus
EGGWQGMIDGW

SEQ ID NO: 400950 - protein, 11 aa, Influenza virus
GGWQGMIDGWY

SEQ ID NO: 400951 - protein, 11 aa, Influenza virus
GWQGMIDGWYG

SEQ ID NO: 400952 - protein, 11 aa, Influenza virus
WQGMIDGWYGY

SEQ ID NO: 400953 - protein, 11 aa, Influenza virus
QGMIDGWYGYH

SEQ ID NO: 400954 - protein, 11 aa, Influenza virus
GMIDGWYGYHH

SEQ ID NO: 400955 - protein, 11 aa, Influenza virus
MIDGWYGYHHS

SEQ ID NO: 400956 - protein, 11 aa, Influenza virus
IDGWYGYHHSN

SEQ ID NO: 400957 - protein, 11 aa, Influenza virus
YGYHHSNDQGA

SEQ ID NO: 400958 - protein, 11 aa, Influenza virus
GYHHSNDQGAG

SEQ ID NO: 400959 - protein, 11 aa, Influenza virus
YHHSNDQGAGY

SEQ ID NO: 400960 - protein, 11 aa, Influenza virus
HHSNDQGAGYA

SEQ ID NO: 400961 - protein, 11 aa, Influenza virus
HSNDQGAGYAA

SEQ ID NO: 400962 - protein, 11 aa, Influenza virus
SNDQGAGYAAD

SEQ ID NO: 400963 - protein, 11 aa, Influenza virus
NDQGAGYAADK

SEQ ID NO: 400964 - protein, 11 aa, Influenza virus
DQGAGYAADKE

SEQ ID NO: 400965 - protein, 11 aa, Influenza virus
QGAGYAADKES

SEQ ID NO: 400966 - protein, 11 aa, Influenza virus
GAGYAADKEST

SEQ ID NO: 400967 - protein, 11 aa, Influenza virus
AGYAADKESTQ

SEQ ID NO: 400968 - protein, 11 aa, Influenza virus
GYAADKESTQR

SEQ ID NO: 400969 - protein, 11 aa, Influenza virus
YAADKESTQRA

SEQ ID NO: 400970 - protein, 11 aa, Influenza virus
NLEKRLENLNK

SEQ ID NO: 400971 - protein, 11 aa, Influenza virus
LEKRLENLNKK

SEQ ID NO: 400972 - protein, 11 aa, Influenza virus
RLENLNKKVED

SEQ ID NO: 400973 - protein, 11 aa, Influenza virus
LENLNKKVEDG

SEQ ID NO: 400974 - protein, 11 aa, Influenza virus
ENLNKKVEDGF

SEQ ID NO: 400975 - protein, 11 aa, Influenza virus
VWTYNVELLVL

SEQ ID NO: 400976 - protein, 11 aa, Influenza virus
WTYNVELLVLM

SEQ ID NO: 400977 - protein, 11 aa, Influenza virus
TYNAEVLVLME

SEQ ID NO: 400978 - protein, 11 aa, Influenza virus
YNVELLVLMEN

SEQ ID NO: 400979 - protein, 11 aa, Influenza virus
NAEVLVLMENE

SEQ ID NO: 400980 - protein, 11 aa, Influenza virus
VELLVLMENER

SEQ ID NO: 400981 - protein, 11 aa, Influenza virus
ELLVLMENEMT

SEQ ID NO: 400982 - protein, 11 aa, Influenza virus
VLVLMENERTL

SEQ ID NO: 400983 - protein, 11 aa, Influenza virus
LVLMENEMTLD

SEQ ID NO: 400984 - protein, 11 aa, Influenza virus
VLMENERTLDY

SEQ ID NO: 400985 - protein, 11 aa, Influenza virus
LMENERTLDYH

SEQ ID NO: 400986 - protein, 11 aa, Influenza virus
MENERTLDYHD

SEQ ID NO: 400987 - protein, 11 aa, Influenza virus
ENERTLDYHDS

SEQ ID NO: 400988 - protein, 11 aa, Influenza virus
NERTLDYHDSN

SEQ ID NO: 400989 - protein, 11 aa, Influenza virus
ERTLDYHDSNV

SEQ ID NO: 400990 - protein, 11 aa, Influenza virus
LDFHDSNVRNL

SEQ ID NO: 400991 - protein, 11 aa, Influenza virus
DFHDSNVRNLY

SEQ ID NO: 400992 - protein, 11 aa, Influenza virus
LYNKVRMQLRD

SEQ ID NO: 400993 - protein, 11 aa, Influenza virus
YNKVRMQLRDN

SEQ ID NO: 400994 - protein, 11 aa, Influenza virus
KVRMQLRDNVK

SEQ ID NO: 400995 - protein, 11 aa, Influenza virus
VRMQLRDNVKE

SEQ ID NO: 400996 - protein, 11 aa, Influenza virus
MQLRDNVKELG

SEQ ID NO: 400997 - protein, 11 aa, Influenza virus
DNVKELGNGCF

SEQ ID NO: 400998 - protein, 11 aa, Influenza virus
NVKELGNGCFE

SEQ ID NO: 400999 - protein, 11 aa, Influenza virus
VKELGNGCFEF

SEQ ID NO: 401000 - protein, 11 aa, Influenza virus
KELGNGCFEFY

SEQ ID NO: 401001 - protein, 11 aa, Influenza virus
ELGNGCFEFYH

SEQ ID NO: 401002 - protein, 11 aa, Influenza virus
LGNGCFEFYHK

SEQ ID NO: 401003 - protein, 11 aa, Influenza virus
NGCFEFYHKCN

SEQ ID NO: 401004 - protein, 11 aa, Influenza virus
GCFEFYHKCDN

SEQ ID NO: 401005 - protein, 11 aa, Influenza virus
CFEFYHKCDNE

SEQ ID NO: 401006 - protein, 11 aa, Influenza virus
FEFYHKCDNEC

SEQ ID NO: 401007 - protein, 11 aa, Influenza virus
EFYHKCDNECM

SEQ ID NO: 401008 - protein, 11 aa, Influenza virus
FYHKCDDECMD

SEQ ID NO: 401009 - protein, 11 aa, Influenza virus
YHKCDDECMDS

SEQ ID NO: 401010 - protein, 11 aa, Influenza virus
GTYDYSKYEEE

SEQ ID NO: 401011 - protein, 11 aa, Influenza virus
TYDYSKYEEES

SEQ ID NO: 401012 - protein, 11 aa, Influenza virus
YPKYEEESKLK

SEQ ID NO: 401013 - protein, 11 aa, Influenza virus
PKYEEESKLKR

SEQ ID NO: 401014 - protein, 11 aa, Influenza virus
KYEEESKLKRN

SEQ ID NO: 401015 - protein, 11 aa, Influenza virus
YEEESKLKRNE

SEQ ID NO: 401016 - protein, 11 aa, Influenza virus
EEESKLKRNEI

SEQ ID NO: 401017 - protein, 11 aa, Influenza virus
ESKLKRNEIKG

SEQ ID NO: 401018 - protein, 11 aa, Influenza virus
MGIYQILAIYA

SEQ ID NO: 401019 - protein, 11 aa, Influenza virus
GIYQILAIYAT

SEQ ID NO: 401020 - protein, 11 aa, Influenza virus
IYQILAIYATV

SEQ ID NO: 401021 - protein, 11 aa, Influenza virus
VAGSLSLAIMM

SEQ ID NO: 401022 - protein, 11 aa, Influenza virus
AGSLSLAIMMA

SEQ ID NO: 401023 - protein, 11 aa, Influenza virus
GSLSLAIMMAG

SEQ ID NO: 401024 - protein, 11 aa, Influenza virus
SLSLAIMMAGI

SEQ ID NO: 401025 - protein, 11 aa, Influenza virus
LSLAIMMAGIS

SEQ ID NO: 401026 - protein, 11 aa, Influenza virus
AGISLWMCSNG

SEQ ID NO: 401027 - protein, 11 aa, Influenza virus
GISLWMCSNGS

SEQ ID NO: 401028 - protein, 11 aa, Influenza virus
ISLWMCSNGSL

SEQ ID NO: 401029 - protein, 11 aa, Influenza virus
SLWMCSNGSLQ

SEQ ID NO: 401030 - protein, 11 aa, Influenza virus
LWMCSNGSLQC

SEQ ID NO: 401031 - protein, 11 aa, Influenza virus
VKGDQICIGYH

SEQ ID NO: 401032 - protein, 11 aa, Influenza virus
KGDQICIGYHA

SEQ ID NO: 401033 - protein, 11 aa, Influenza virus
GDQICIGYHSN

SEQ ID NO: 401034 - protein, 11 aa, Influenza virus
DQICIGYHSNN

SEQ ID NO: 401035 - protein, 11 aa, Influenza virus
QICIGYHSNNS

SEQ ID NO: 401036 - protein, 11 aa, Influenza virus
ICIGYHSNNST

SEQ ID NO: 401037 - protein, 11 aa, Influenza virus
CIGYHSNNSTE

SEQ ID NO: 401038 - protein, 11 aa, Influenza virus
IGYHSNNSTEK

SEQ ID NO: 401039 - protein, 11 aa, Influenza virus
TVDTILERNVT

SEQ ID NO: 401040 - protein, 11 aa, Influenza virus
ADTILERNVTV

SEQ ID NO: 401041 - protein, 11 aa, Influenza virus
LERNVTVTHAQ

SEQ ID NO: 401042 - protein, 11 aa, Influenza virus
ERNVTVTHAQD

SEQ ID NO: 401043 - protein, 11 aa, Influenza virus
RNVTVTHAQDI

SEQ ID NO: 401044 - protein, 11 aa, Influenza virus
NVTVTHAQDIL

SEQ ID NO: 401045 - protein, 11 aa, Influenza virus
VTVTHAQDILE

SEQ ID NO: 401046 - protein, 11 aa, Influenza virus
TVTHAQDILEK

SEQ ID NO: 401047 - protein, 11 aa, Influenza virus
VTHAQDILEKT

SEQ ID NO: 401048 - protein, 11 aa, Influenza virus
THAQDILEKTH

SEQ ID NO: 401049 - protein, 11 aa, Influenza virus
HAQDILEKTHN

SEQ ID NO: 401050 - protein, 11 aa, Influenza virus
AQDILEKTHNG

SEQ ID NO: 401051 - protein, 11 aa, Influenza virus
NILEKTHNGKL

SEQ ID NO: 401052 - protein, 11 aa, Influenza virus
ILERTHNGKLC

SEQ ID NO: 401053 - protein, 11 aa, Influenza virus
LEKTHNGKLCR

SEQ ID NO: 401054 - protein, 11 aa, Influenza virus
EKTHNGKLCRL

SEQ ID NO: 401055 - protein, 11 aa, Influenza virus
KTHNGKLCRLS

SEQ ID NO: 401056 - protein, 11 aa, Influenza virus
THNGKLCRLSG

SEQ ID NO: 401057 - protein, 11 aa, Influenza virus
HNGKLCRLSGI

SEQ ID NO: 401058 - protein, 11 aa, Influenza virus
NGKLCRLSGIP

SEQ ID NO: 401059 - protein, 11 aa, Influenza virus
GKLCRLSGIPP

SEQ ID NO: 401060 - protein, 11 aa, Influenza virus
KLCRLSGIPPL

SEQ ID NO: 401061 - protein, 11 aa, Influenza virus
LCRLSGIPPLE

SEQ ID NO: 401062 - protein, 11 aa, Influenza virus
CRLSGIPPLEL

SEQ ID NO: 401063 - protein, 11 aa, Influenza virus
RLSGIPPLELG

SEQ ID NO: 401064 - protein, 11 aa, Influenza virus
LSGIPPLELGD

SEQ ID NO: 401065 - protein, 11 aa, Influenza virus
SGIPPLELGDC

SEQ ID NO: 401066 - protein, 11 aa, Influenza virus
PPLELGDCSIT

SEQ ID NO: 401067 - protein, 11 aa, Influenza virus
PLELGNCSIAG

SEQ ID NO: 401068 - protein, 11 aa, Influenza virus
LELGNCSIAGW

SEQ ID NO: 401069 - protein, 11 aa, Influenza virus
ELGNCSIAGWL

SEQ ID NO: 401070 - protein, 11 aa, Influenza virus
LGNCSIAGWLL

SEQ ID NO: 401071 - protein, 11 aa, Influenza virus
GNCSIAGWLLG

SEQ ID NO: 401072 - protein, 11 aa, Influenza virus
DCSITGWLLGN

SEQ ID NO: 401073 - protein, 11 aa, Influenza virus
LGNPECDRLLR

SEQ ID NO: 401074 - protein, 11 aa, Influenza virus
VPEWSYIVERE

SEQ ID NO: 401075 - protein, 11 aa, Influenza virus
PEWSYIVEREN

SEQ ID NO: 401076 - protein, 11 aa, Influenza virus
EWSYIVERENP

SEQ ID NO: 401077 - protein, 11 aa, Influenza virus
LCYPGSFNNYE

SEQ ID NO: 401078 - protein, 11 aa, Influenza virus
CYPGSFNNYEE

SEQ ID NO: 401079 - protein, 11 aa, Influenza virus
YPGSFNNYEEL

SEQ ID NO: 401080 - protein, 11 aa, Influenza virus
PGSFNNYEELK

SEQ ID NO: 401081 - protein, 11 aa, Influenza virus
HFEKVKILPRD

SEQ ID NO: 401082 - protein, 11 aa, Influenza virus
SSFFRNMVWLT

SEQ ID NO: 401083 - protein, 11 aa, Influenza virus
AKRSYNNTSGE

SEQ ID NO: 401084 - protein, 11 aa, Influenza virus
KRSYNNTSGEQ

SEQ ID NO: 401085 - protein, 11 aa, Influenza virus
RSYNNTSGEQM

SEQ ID NO: 401086 - protein, 11 aa, Influenza virus
SYNNTNGEQIL

SEQ ID NO: 401087 - protein, 11 aa, Influenza virus
YNNTSGEQMLV

SEQ ID NO: 401088 - protein, 11 aa, Influenza virus
NNTSGEQMLVI

SEQ ID NO: 401089 - protein, 11 aa, Influenza virus
NTSGEQMLVIW

SEQ ID NO: 401090 - protein, 11 aa, Influenza virus
TSGEQMLVIWG

SEQ ID NO: 401091 - protein, 11 aa, Influenza virus
WDVINFESTGN

SEQ ID NO: 401092 - protein, 11 aa, Influenza virus
DVINFESTGNL

SEQ ID NO: 401093 - protein, 11 aa, Influenza virus
TINFESTGNLV

SEQ ID NO: 401094 - protein, 11 aa, Influenza virus
INFESTGNLVA

SEQ ID NO: 401095 - protein, 11 aa, Influenza virus
NFESTGNLVAP

SEQ ID NO: 401096 - protein, 11 aa, Influenza virus
FESTGNLVAPE

SEQ ID NO: 401097 - protein, 11 aa, Influenza virus
ESTGNLVAPEY

SEQ ID NO: 401098 - protein, 11 aa, Influenza virus
STGNLVAPEYG

SEQ ID NO: 401099 - protein, 11 aa, Influenza virus
TGNLVAPEYGF

SEQ ID NO: 401100 - protein, 11 aa, Influenza virus
GNLVAPEYGFK

SEQ ID NO: 401101 - protein, 11 aa, Influenza virus
NLVAPEYGFKI

SEQ ID NO: 401102 - protein, 11 aa, Influenza virus
LVAPEYGFKIS

SEQ ID NO: 401103 - protein, 11 aa, Influenza virus
VAPEYGFKISK

SEQ ID NO: 401104 - protein, 11 aa, Influenza virus
VPEYGFKISKR

SEQ ID NO: 401105 - protein, 11 aa, Influenza virus
PEYGFRISKRG

SEQ ID NO: 401106 - protein, 11 aa, Influenza virus
EYGFKISKRGG

SEQ ID NO: 401107 - protein, 11 aa, Influenza virus
YGFKISKRGGS

SEQ ID NO: 401108 - protein, 11 aa, Influenza virus
GFKISKRGGSG

SEQ ID NO: 401109 - protein, 11 aa, Influenza virus
FKISKRGGSGI

SEQ ID NO: 401110 - protein, 11 aa, Influenza virus
KISKRGGSGIM

SEQ ID NO: 401111 - protein, 11 aa, Influenza virus
ISKRGGSGIMK

SEQ ID NO: 401112 - protein, 11 aa, Influenza virus
SKRGGSGIMKT

SEQ ID NO: 401113 - protein, 11 aa, Influenza virus
KRGGSGIMKTE

SEQ ID NO: 401114 - protein, 11 aa, Influenza virus
NCETKCQSPLG

SEQ ID NO: 401115 - protein, 11 aa, Influenza virus
CETKCQSPLGA

SEQ ID NO: 401116 - protein, 11 aa, Influenza virus
ETKCQTPLGAL

SEQ ID NO: 401117 - protein, 11 aa, Influenza virus
TKCQTPLGALN

SEQ ID NO: 401118 - protein, 11 aa, Influenza virus
KCQTPLGALNT

SEQ ID NO: 401119 - protein, 11 aa, Influenza virus
CQTPLGALNTT

SEQ ID NO: 401120 - protein, 11 aa, Influenza virus
QTPLGALNTTL

SEQ ID NO: 401121 - protein, 11 aa, Influenza virus
TPLGALNTTLP

SEQ ID NO: 401122 - protein, 11 aa, Influenza virus
PLGALNTTLPF

SEQ ID NO: 401123 - protein, 11 aa, Influenza virus
LGALNTTLPFH

SEQ ID NO: 401124 - protein, 11 aa, Influenza virus
GALNTTLPFHN

SEQ ID NO: 401125 - protein, 11 aa, Influenza virus
AINTTLPFHNI

SEQ ID NO: 401126 - protein, 11 aa, Influenza virus
INTTLPFHNIH

SEQ ID NO: 401127 - protein, 11 aa, Influenza virus
NTTLPFHNIHP

SEQ ID NO: 401128 - protein, 11 aa, Influenza virus
TTLPFHNIHPL

SEQ ID NO: 401129 - protein, 11 aa, Influenza virus
TLPFHNIHPLT

SEQ ID NO: 401130 - protein, 11 aa, Influenza virus
LPFHNIHPLTI

SEQ ID NO: 401131 - protein, 11 aa, Influenza virus
PFHNIHPLTIG

SEQ ID NO: 401132 - protein, 11 aa, Influenza virus
FHNIHPLTIGE

SEQ ID NO: 401133 - protein, 11 aa, Influenza virus
HNIHPLTIGEC

SEQ ID NO: 401134 - protein, 11 aa, Influenza virus
NIHPLTIGECP

SEQ ID NO: 401135 - protein, 11 aa, Influenza virus
IHPLTIGECPK

SEQ ID NO: 401136 - protein, 11 aa, Influenza virus
HPLTMGECPKY

SEQ ID NO: 401137 - protein, 11 aa, Influenza virus
PLTIGECPRYV

SEQ ID NO: 401138 - protein, 11 aa, Influenza virus
LTIGECPKYVR

SEQ ID NO: 401139 - protein, 11 aa, Influenza virus
TIGECPKYVRS

SEQ ID NO: 401140 - protein, 11 aa, Influenza virus
IGECPKYVKSD

SEQ ID NO: 401141 - protein, 11 aa, Influenza virus
GECPKYVKSDR

SEQ ID NO: 401142 - protein, 11 aa, Influenza virus
ECPKYVKSDRL

SEQ ID NO: 401143 - protein, 11 aa, Influenza virus
CPKYVKSDRLV

SEQ ID NO: 401144 - protein, 11 aa, Influenza virus
PKYVKSDRLVL

SEQ ID NO: 401145 - protein, 11 aa, Influenza virus
KYVKSDRLVLA

SEQ ID NO: 401146 - protein, 11 aa, Influenza virus
YVKSDRLVLAT

SEQ ID NO: 401147 - protein, 11 aa, Influenza virus
VKSDRLVLATG

SEQ ID NO: 401148 - protein, 11 aa, Influenza virus
SDRLVLATGLR

SEQ ID NO: 401149 - protein, 11 aa, Influenza virus
DRLVLATGLRN

SEQ ID NO: 401150 - protein, 11 aa, Influenza virus
RLVLATGLRNV

SEQ ID NO: 401151 - protein, 11 aa, Influenza virus
LVLATGLRNIP

SEQ ID NO: 401152 - protein, 11 aa, Influenza virus
VLATGLRNIPQ

SEQ ID NO: 401153 - protein, 11 aa, Influenza virus
LATGLRNIPQI

SEQ ID NO: 401154 - protein, 11 aa, Influenza virus
ATGLRNIPQIE

SEQ ID NO: 401155 - protein, 11 aa, Influenza virus
RNIPQIESRGL

SEQ ID NO: 401156 - protein, 11 aa, Influenza virus
NIPQIESRGLF

SEQ ID NO: 401157 - protein, 11 aa, Influenza virus
IPQIESRGLFG

SEQ ID NO: 401158 - protein, 11 aa, Influenza virus
PQMESRGLFGA

SEQ ID NO: 401159 - protein, 11 aa, Influenza virus
QMESRGLFGAI

SEQ ID NO: 401160 - protein, 11 aa, Influenza virus
MESRGLFGAIA

SEQ ID NO: 401161 - protein, 11 aa, Influenza virus
EARGLFGAIAG

SEQ ID NO: 401162 - protein, 11 aa, Influenza virus
PRGLFGAIAGF

SEQ ID NO: 401163 - protein, 11 aa, Influenza virus
GFIEGGWQGMI

SEQ ID NO: 401164 - protein, 11 aa, Influenza virus
FIEGGWQGMID

SEQ ID NO: 401165 - protein, 11 aa, Influenza virus
IEGGWQGMIDG

SEQ ID NO: 401166 - protein, 11 aa, Influenza virus
EGGWQGMIDGW

SEQ ID NO: 401167 - protein, 11 aa, Influenza virus
GGWQGMIDGWY

SEQ ID NO: 401168 - protein, 11 aa, Influenza virus
GWQGMIDGWYG

SEQ ID NO: 401169 - protein, 11 aa, Influenza virus
WQGMIDGWYGY

SEQ ID NO: 401170 - protein, 11 aa, Influenza virus
QGMIDGWYGYH

SEQ ID NO: 401171 - protein, 11 aa, Influenza virus
GMIDGWYGYHH

SEQ ID NO: 401172 - protein, 11 aa, Influenza virus
MIDGWYGYHHS

SEQ ID NO: 401173 - protein, 11 aa, Influenza virus
IDGWYGYHHSN

SEQ ID NO: 401174 - protein, 11 aa, Influenza virus
YGYHHSNDQGA

SEQ ID NO: 401175 - protein, 11 aa, Influenza virus
GYHHSNDQGAG

SEQ ID NO: 401176 - protein, 11 aa, Influenza virus
YHHSNDQGAGY

SEQ ID NO: 401177 - protein, 11 aa, Influenza virus
HHSNDQGAGYA

SEQ ID NO: 401178 - protein, 11 aa, Influenza virus
HSNDQGAGYAA

SEQ ID NO: 401179 - protein, 11 aa, Influenza virus
SNDQGAGYAAD

SEQ ID NO: 401180 - protein, 11 aa, Influenza virus
NDQGAGYAADK

SEQ ID NO: 401181 - protein, 11 aa, Influenza virus
DQGSGYAADKA

SEQ ID NO: 401182 - protein, 11 aa, Influenza virus
QGSGYAADKAS

SEQ ID NO: 401183 - protein, 11 aa, Influenza virus
GSGYAADKAST

SEQ ID NO: 401184 - protein, 11 aa, Influenza virus
SGYAADKASTQ

SEQ ID NO: 401185 - protein, 11 aa, Influenza virus
GYAADKASTQK

SEQ ID NO: 401186 - protein, 11 aa, Influenza virus
YAADKASTQKA

SEQ ID NO: 401187 - protein, 11 aa, Influenza virus
AADKESTQKAI

SEQ ID NO: 401188 - protein, 11 aa, Influenza virus
KEFSNLEKRLE

SEQ ID NO: 401189 - protein, 11 aa, Influenza virus
EFSNLEKRLEN

SEQ ID NO: 401190 - protein, 11 aa, Influenza virus
FSNLEKRLENL

SEQ ID NO: 401191 - protein, 11 aa, Influenza virus
NLEKRLENLNK

SEQ ID NO: 401192 - protein, 11 aa, Influenza virus
LEKRLENLNKK

SEQ ID NO: 401193 - protein, 11 aa, Influenza virus
RLENLNKKVED

SEQ ID NO: 401194 - protein, 11 aa, Influenza virus
LENLNKKVEDG

SEQ ID NO: 401195 - protein, 11 aa, Influenza virus
MEDGFIDVWTY

SEQ ID NO: 401196 - protein, 11 aa, Influenza virus
EDGFIDVWTYN

SEQ ID NO: 401197 - protein, 11 aa, Influenza virus
DGFIDVWTYNA

SEQ ID NO: 401198 - protein, 11 aa, Influenza virus
GFIDVWTYNAE

SEQ ID NO: 401199 - protein, 11 aa, Influenza virus
FIDVWTYNAEL

SEQ ID NO: 401200 - protein, 11 aa, Influenza virus
IDVWTYNAELL

SEQ ID NO: 401201 - protein, 11 aa, Influenza virus
GVWTYNAELLV

SEQ ID NO: 401202 - protein, 11 aa, Influenza virus
AELLVLMENEM

SEQ ID NO: 401203 - protein, 11 aa, Influenza virus
ELLVLMENEMT

SEQ ID NO: 401204 - protein, 11 aa, Influenza virus
LLVLMENEMTL

SEQ ID NO: 401205 - protein, 11 aa, Influenza virus
LVLMENEMTLD

SEQ ID NO: 401206 - protein, 11 aa, Influenza virus
VLMENEMTLDF

SEQ ID NO: 401207 - protein, 11 aa, Influenza virus
LMENEMTLDFH

SEQ ID NO: 401208 - protein, 11 aa, Influenza virus
MENEMTLDFHD

SEQ ID NO: 401209 - protein, 11 aa, Influenza virus
ENEMTLDFHDS

SEQ ID NO: 401210 - protein, 11 aa, Influenza virus
NEMTLDFHDSN

SEQ ID NO: 401211 - protein, 11 aa, Influenza virus
EMTLDFHDSNV

SEQ ID NO: 401212 - protein, 11 aa, Influenza virus
MTLDFHDSNVK

SEQ ID NO: 401213 - protein, 11 aa, Influenza virus
TLDFHDSNVKS

SEQ ID NO: 401214 - protein, 11 aa, Influenza virus
LDFHDSNVKSL

SEQ ID NO: 401215 - protein, 11 aa, Influenza virus
DFHDSNVKSLY

SEQ ID NO: 401216 - protein, 11 aa, Influenza virus
FHDSNVKSLYD

SEQ ID NO: 401217 - protein, 11 aa, Influenza virus
VKSLYDKVRMQ

SEQ ID NO: 401218 - protein, 11 aa, Influenza virus
KSLYDKVRMQL

SEQ ID NO: 401219 - protein, 11 aa, Influenza virus
SLYDKVRMQLR

SEQ ID NO: 401220 - protein, 11 aa, Influenza virus
LYNKVRMQLRD

SEQ ID NO: 401221 - protein, 11 aa, Influenza virus
YNKVRMQLRDN

SEQ ID NO: 401222 - protein, 11 aa, Influenza virus
DKVRMQLRDNA

SEQ ID NO: 401223 - protein, 11 aa, Influenza virus
KVRMQLRDNAK

SEQ ID NO: 401224 - protein, 11 aa, Influenza virus
VRMQLRDNAKE

SEQ ID NO: 401225 - protein, 11 aa, Influenza virus
RMQLRDNAKEI

SEQ ID NO: 401226 - protein, 11 aa, Influenza virus
MQLRDNAKEIG

SEQ ID NO: 401227 - protein, 11 aa, Influenza virus
QLRDNAKEIGN

SEQ ID NO: 401228 - protein, 11 aa, Influenza virus
LRDNAKEIGNG

SEQ ID NO: 401229 - protein, 11 aa, Influenza virus
RDNAKEIGNGC

SEQ ID NO: 401230 - protein, 11 aa, Influenza virus
DNAKEIGNGCF

SEQ ID NO: 401231 - protein, 11 aa, Influenza virus
NAKEIGNGCFE

SEQ ID NO: 401232 - protein, 11 aa, Influenza virus
AKEIGNGCFEF

SEQ ID NO: 401233 - protein, 11 aa, Influenza virus
KEIGNGCFEFY

SEQ ID NO: 401234 - protein, 11 aa, Influenza virus
EIGNGCFEFYH

SEQ ID NO: 401235 - protein, 11 aa, Influenza virus
IGNGCFEFYHK

SEQ ID NO: 401236 - protein, 11 aa, Influenza virus
NGCFEFYHKCN

SEQ ID NO: 401237 - protein, 11 aa, Influenza virus
GCFEFYHKCDN

SEQ ID NO: 401238 - protein, 11 aa, Influenza virus
CFEFYHKCDNE

SEQ ID NO: 401239 - protein, 11 aa, Influenza virus
FEFYHKCDNEC

SEQ ID NO: 401240 - protein, 11 aa, Influenza virus
EFYHKCDNECM

SEQ ID NO: 401241 - protein, 11 aa, Influenza virus
RNGTYDYPKYE

SEQ ID NO: 401242 - protein, 11 aa, Influenza virus
NGTYYYPKYEE

SEQ ID NO: 401243 - protein, 11 aa, Influenza virus
GTYYYPKYEEE

SEQ ID NO: 401244 - protein, 11 aa, Influenza virus
TYYYPKYEEES

SEQ ID NO: 401245 - protein, 11 aa, Influenza virus
YYYPKYEEESK

SEQ ID NO: 401246 - protein, 11 aa, Influenza virus
DYPKYEEESRL

SEQ ID NO: 401247 - protein, 11 aa, Influenza virus
YPKYEEESKLK

SEQ ID NO: 401248 - protein, 11 aa, Influenza virus
PKYEEESKLKR

SEQ ID NO: 401249 - protein, 11 aa, Influenza virus
KYEEESKLKRN

SEQ ID NO: 401250 - protein, 11 aa, Influenza virus
YEEESKLKRNE

SEQ ID NO: 401251 - protein, 11 aa, Influenza virus
EEESKLKRNEI

SEQ ID NO: 401252 - protein, 11 aa, Influenza virus
EESKLKRNEIK

SEQ ID NO: 401253 - protein, 11 aa, Influenza virus
ESKLKRNEIKG

SEQ ID NO: 401254 - protein, 11 aa, Influenza virus
SKLKRNEIKGV

SEQ ID NO: 401255 - protein, 11 aa, Influenza virus
KLKRNEIKGVK

SEQ ID NO: 401256 - protein, 11 aa, Influenza virus
LKRNEIKGVKL

SEQ ID NO: 401257 - protein, 11 aa, Influenza virus
KRNEIKGVKLS

SEQ ID NO: 401258 - protein, 11 aa, Influenza virus
RNEIKGVKLSN

SEQ ID NO: 401259 - protein, 11 aa, Influenza virus
NEIKGVKLSNM

SEQ ID NO: 401260 - protein, 11 aa, Influenza virus
EIKGVKLSNMG

SEQ ID NO: 401261 - protein, 11 aa, Influenza virus
IKGVKLSNMGV

SEQ ID NO: 401262 - protein, 11 aa, Influenza virus
KGVKLSNMGVY

SEQ ID NO: 401263 - protein, 11 aa, Influenza virus
GVKLSNMGVYQ

SEQ ID NO: 401264 - protein, 11 aa, Influenza virus
VKLSNMGVYQI

SEQ ID NO: 401265 - protein, 11 aa, Influenza virus
KLSNMGVYQIL

SEQ ID NO: 401266 - protein, 11 aa, Influenza virus
LSNMGVYQILA

SEQ ID NO: 401267 - protein, 11 aa, Influenza virus
SNMGVYQILAI

SEQ ID NO: 401268 - protein, 11 aa, Influenza virus
NMGVYQILAIY

SEQ ID NO: 401269 - protein, 11 aa, Influenza virus
MGIYQILAIYA

SEQ ID NO: 401270 - protein, 11 aa, Influenza virus
GIYQILAIYAT

SEQ ID NO: 401271 - protein, 11 aa, Influenza virus
IYQILAIYATV

SEQ ID NO: 401272 - protein, 11 aa, Influenza virus
YQVLAIYATVA

SEQ ID NO: 401273 - protein, 11 aa, Influenza virus
QVLAIYATVAG

SEQ ID NO: 401274 - protein, 11 aa, Influenza virus
ILVIYATVAGS

SEQ ID NO: 401275 - protein, 11 aa, Influenza virus
VAGSLSLAIMI

SEQ ID NO: 401276 - protein, 11 aa, Influenza virus
AGSLSLAIMIA

SEQ ID NO: 401277 - protein, 11 aa, Influenza virus
GSLSLAIMIAG

SEQ ID NO: 401278 - protein, 11 aa, Influenza virus
SLSLAIMIAGI

SEQ ID NO: 401279 - protein, 11 aa, Influenza virus
LSLAIMIAGIS

SEQ ID NO: 401280 - protein, 11 aa, Influenza virus
AGISLWMCSNG

SEQ ID NO: 401281 - protein, 11 aa, Influenza virus
GISLWMCSNGS

SEQ ID NO: 401282 - protein, 11 aa, Influenza virus
ISLWMCSNGSL

SEQ ID NO: 401283 - protein, 11 aa, Influenza virus
SLWMCSNGSLQ

SEQ ID NO: 401284 - protein, 11 aa, Influenza virus
LWMCSNGSLQC

SEQ ID NO: 401285 - protein, 11 aa, Influenza virus
MCSNGSLQFRI

SEQ ID NO: 401286 - protein, 11 aa, Influenza virus
CSNGSLQCRVC

SEQ ID NO: 401287 - protein, 11 aa, Influenza virus
SNGSLQFRICI

SEQ ID NO: 401288 - protein, 11 aa, Influenza virus
MNPNQKTITIG

SEQ ID NO: 401289 - protein, 11 aa, Influenza virus
NPNQKTITIGS

SEQ ID NO: 401290 - protein, 11 aa, Influenza virus
NQKIITIGSAS

SEQ ID NO: 401291 - protein, 11 aa, Influenza virus
QKIITIGSASL

SEQ ID NO: 401292 - protein, 11 aa, Influenza virus
QIAILVTTVTL

SEQ ID NO: 401293 - protein, 11 aa, Influenza virus
IAILVTTVTLH

SEQ ID NO: 401294 - protein, 11 aa, Influenza virus
AILVTTVTLHF

SEQ ID NO: 401295 - protein, 11 aa, Influenza virus
ILVTTVTLHFK

SEQ ID NO: 401296 - protein, 11 aa, Influenza virus
LVTTVTLHFKQ

SEQ ID NO: 401297 - protein, 11 aa, Influenza virus
VTTVTLHFKQH

SEQ ID NO: 401298 - protein, 11 aa, Influenza virus
TVTLHFKQNEC

SEQ ID NO: 401299 - protein, 11 aa, Influenza virus
WSKPQCKITGF

SEQ ID NO: 401300 - protein, 11 aa, Influenza virus
SKPQCKITGFA

SEQ ID NO: 401301 - protein, 11 aa, Influenza virus
KPQCKITGFAP

SEQ ID NO: 401302 - protein, 11 aa, Influenza virus
PQCKITGFAPF

SEQ ID NO: 401303 - protein, 11 aa, Influenza virus
QCKITGFAPFS

SEQ ID NO: 401304 - protein, 11 aa, Influenza virus
CKITGFAPFSK

SEQ ID NO: 401305 - protein, 11 aa, Influenza virus
KITGFAPFSKD

SEQ ID NO: 401306 - protein, 11 aa, Influenza virus
AGFAPFSKDNS

SEQ ID NO: 401307 - protein, 11 aa, Influenza virus
SKDNSIRLSAS

SEQ ID NO: 401308 - protein, 11 aa, Influenza virus
KDNSIRLSADG

SEQ ID NO: 401309 - protein, 11 aa, Influenza virus
DNPIRLSGGGD

SEQ ID NO: 401310 - protein, 11 aa, Influenza virus
NSIRLSASGDI

SEQ ID NO: 401311 - protein, 11 aa, Influenza virus
SIRLSASGDIW

SEQ ID NO: 401312 - protein, 11 aa, Influenza virus
IRLSAGGDIWI

SEQ ID NO: 401313 - protein, 11 aa, Influenza virus
RLSAGGDIWIT

SEQ ID NO: 401314 - protein, 11 aa, Influenza virus
LSAGGDIWITR

SEQ ID NO: 401315 - protein, 11 aa, Influenza virus
SAGGDIWITRE

SEQ ID NO: 401316 - protein, 11 aa, Influenza virus
AGGDIWITREP

SEQ ID NO: 401317 - protein, 11 aa, Influenza virus
GGDIWITREPY

SEQ ID NO: 401318 - protein, 11 aa, Influenza virus
GDIWITREPYV

SEQ ID NO: 401319 - protein, 11 aa, Influenza virus
DIWITREPYVS

SEQ ID NO: 401320 - protein, 11 aa, Influenza virus
IWITREPYVSC

SEQ ID NO: 401321 - protein, 11 aa, Influenza virus
WITREPYVSCD

SEQ ID NO: 401322 - protein, 11 aa, Influenza virus
SKCYQFALGQG

SEQ ID NO: 401323 - protein, 11 aa, Influenza virus
KCYQFALGQGA

SEQ ID NO: 401324 - protein, 11 aa, Influenza virus
CHQFALGQGTT

SEQ ID NO: 401325 - protein, 11 aa, Influenza virus
YQFALGQGATL

SEQ ID NO: 401326 - protein, 11 aa, Influenza virus
QFALGQGTTLE

SEQ ID NO: 401327 - protein, 11 aa, Influenza virus
FALGQGTTLNN

SEQ ID NO: 401328 - protein, 11 aa, Influenza virus
ALGQGTTLENK

SEQ ID NO: 401329 - protein, 11 aa, Influenza virus
LGQGTTLNNKH

SEQ ID NO: 401330 - protein, 11 aa, Influenza virus
GQGTTLENKHS

SEQ ID NO: 401331 - protein, 11 aa, Influenza virus
QGTTLENKHSN

SEQ ID NO: 401332 - protein, 11 aa, Influenza virus
GTTLDNKHSND

SEQ ID NO: 401333 - protein, 11 aa, Influenza virus
TTLDNKHSNDT

SEQ ID NO: 401334 - protein, 11 aa, Influenza virus
TLDNKHSNDTI

SEQ ID NO: 401335 - protein, 11 aa, Influenza virus
LDNKHSNDTIH

SEQ ID NO: 401336 - protein, 11 aa, Influenza virus
DNKHSNDTIHD

SEQ ID NO: 401337 - protein, 11 aa, Influenza virus
NKHSNDTIHDR

SEQ ID NO: 401338 - protein, 11 aa, Influenza virus
TVHDRIPHRTL

SEQ ID NO: 401339 - protein, 11 aa, Influenza virus
VHDRIPHRTLL

SEQ ID NO: 401340 - protein, 11 aa, Influenza virus
HDRTPHRTLLM

SEQ ID NO: 401341 - protein, 11 aa, Influenza virus
DRTPHRTLLMN

SEQ ID NO: 401342 - protein, 11 aa, Influenza virus
RTPHRTLLMNE

SEQ ID NO: 401343 - protein, 11 aa, Influenza virus
TPHRTLLMNEL

SEQ ID NO: 401344 - protein, 11 aa, Influenza virus
RTLLMNELGVS

SEQ ID NO: 401345 - protein, 11 aa, Influenza virus
TLLMNELGVSF

SEQ ID NO: 401346 - protein, 11 aa, Influenza virus
LLMNELGVSFH

SEQ ID NO: 401347 - protein, 11 aa, Influenza virus
LMNELGVSFHL

SEQ ID NO: 401348 - protein, 11 aa, Influenza virus
MNELGVSFHLG

SEQ ID NO: 401349 - protein, 11 aa, Influenza virus
NELGVSFHLGT

SEQ ID NO: 401350 - protein, 11 aa, Influenza virus
ELGVPFHLGTR

SEQ ID NO: 401351 - protein, 11 aa, Influenza virus
LGVPFHLGTRQ

SEQ ID NO: 401352 - protein, 11 aa, Influenza virus
GVPFHLGTRQV

SEQ ID NO: 401353 - protein, 11 aa, Influenza virus
VPFHLGTRQVC

SEQ ID NO: 401354 - protein, 11 aa, Influenza virus
FHLGTRQVCIA

SEQ ID NO: 401355 - protein, 11 aa, Influenza virus
HLGTRQVCIAW

SEQ ID NO: 401356 - protein, 11 aa, Influenza virus
LGTRQVCIAWS

SEQ ID NO: 401357 - protein, 11 aa, Influenza virus
GTRQVCIAWSS

SEQ ID NO: 401358 - protein, 11 aa, Influenza virus
TRQVCIAWSSS

SEQ ID NO: 401359 - protein, 11 aa, Influenza virus
RQVCIAWSSSS

SEQ ID NO: 401360 - protein, 11 aa, Influenza virus
QVCIAWSSSSC

SEQ ID NO: 401361 - protein, 11 aa, Influenza virus
VCIAWSSSSCH

SEQ ID NO: 401362 - protein, 11 aa, Influenza virus
CIAWSSSSCHD

SEQ ID NO: 401363 - protein, 11 aa, Influenza virus
IAWSSSSCHDG

SEQ ID NO: 401364 - protein, 11 aa, Influenza virus
AWSSSSCHDGR

SEQ ID NO: 401365 - protein, 11 aa, Influenza virus
WSSSSCHDGRA

SEQ ID NO: 401366 - protein, 11 aa, Influenza virus
SSSSCHDGRAW

SEQ ID NO: 401367 - protein, 11 aa, Influenza virus
SSSCHDGRAWL

SEQ ID NO: 401368 - protein, 11 aa, Influenza virus
SSCHDGRAWLH

SEQ ID NO: 401369 - protein, 11 aa, Influenza virus
SCHDGRAWLHV

SEQ ID NO: 401370 - protein, 11 aa, Influenza virus
CHDGRAWLHVC

SEQ ID NO: 401371 - protein, 11 aa, Influenza virus
HDGKAWLHVCI

SEQ ID NO: 401372 - protein, 11 aa, Influenza virus
DGKAWLHVCIT

SEQ ID NO: 401373 - protein, 11 aa, Influenza virus
GKAWLHVCITG

SEQ ID NO: 401374 - protein, 11 aa, Influenza virus
KAWLHVCITGD

SEQ ID NO: 401375 - protein, 11 aa, Influenza virus
AWLHVCITGDD

SEQ ID NO: 401376 - protein, 11 aa, Influenza virus
CVTGDDKNATA

SEQ ID NO: 401377 - protein, 11 aa, Influenza virus
VTGDDKNATAS

SEQ ID NO: 401378 - protein, 11 aa, Influenza virus
TGDDKNATASF

SEQ ID NO: 401379 - protein, 11 aa, Influenza virus
GDDKNATASFI

SEQ ID NO: 401380 - protein, 11 aa, Influenza virus
DDKNATASFIY

SEQ ID NO: 401381 - protein, 11 aa, Influenza virus
DSIVSWSQNIL

SEQ ID NO: 401382 - protein, 11 aa, Influenza virus
SIVSWSQNILR

SEQ ID NO: 401383 - protein, 11 aa, Influenza virus
IVSWSQNILRT

SEQ ID NO: 401384 - protein, 11 aa, Influenza virus
VSWSQNILRTQ

SEQ ID NO: 401385 - protein, 11 aa, Influenza virus
SWSHNILRTQE

SEQ ID NO: 401386 - protein, 11 aa, Influenza virus
WSHNILRTQES

SEQ ID NO: 401387 - protein, 11 aa, Influenza virus
SQNILRTHESE

SEQ ID NO: 401388 - protein, 11 aa, Influenza virus
HNILRTQESEC

SEQ ID NO: 401389 - protein, 11 aa, Influenza virus
NILRTHESECV

SEQ ID NO: 401390 - protein, 11 aa, Influenza virus
ILRTQESECIC

SEQ ID NO: 401391 - protein, 11 aa, Influenza virus
LRTQESECICI

SEQ ID NO: 401392 - protein, 11 aa, Influenza virus
RTQESECVCIS

SEQ ID NO: 401393 - protein, 11 aa, Influenza virus
TQESECVCISG

SEQ ID NO: 401394 - protein, 11 aa, Influenza virus
QESECVCINGS

SEQ ID NO: 401395 - protein, 11 aa, Influenza virus
ESECVCINGSC

SEQ ID NO: 401396 - protein, 11 aa, Influenza virus
SECVCINGSCT

SEQ ID NO: 401397 - protein, 11 aa, Influenza virus
ECVCINGSCTV

SEQ ID NO: 401398 - protein, 11 aa, Influenza virus
CVCINGSCTVV

SEQ ID NO: 401399 - protein, 11 aa, Influenza virus
VCINGSCTVVM

SEQ ID NO: 401400 - protein, 11 aa, Influenza virus
CINGSCTVVMT

SEQ ID NO: 401401 - protein, 11 aa, Influenza virus
INGSCTVVMTD

SEQ ID NO: 401402 - protein, 11 aa, Influenza virus
NGSCTVVMTDG

SEQ ID NO: 401403 - protein, 11 aa, Influenza virus
GSCTVVMTDGS

SEQ ID NO: 401404 - protein, 11 aa, Influenza virus
SCTVVMTDGSA

SEQ ID NO: 401405 - protein, 11 aa, Influenza virus
CAVVMTDGSAS

SEQ ID NO: 401406 - protein, 11 aa, Influenza virus
AVVMTDGSASG

SEQ ID NO: 401407 - protein, 11 aa, Influenza virus
VVMTDGSASGK

SEQ ID NO: 401408 - protein, 11 aa, Influenza virus
VMTDGSASGKA

SEQ ID NO: 401409 - protein, 11 aa, Influenza virus
MTDGSASGKAD

SEQ ID NO: 401410 - protein, 11 aa, Influenza virus
TDGSASGKADT

SEQ ID NO: 401411 - protein, 11 aa, Influenza virus
DGSASGKADTR

SEQ ID NO: 401412 - protein, 11 aa, Influenza virus
GSASGKADTRI

SEQ ID NO: 401413 - protein, 11 aa, Influenza virus
SASGKADTRIL

SEQ ID NO: 401414 - protein, 11 aa, Influenza virus
ASGKADTRILF

SEQ ID NO: 401415 - protein, 11 aa, Influenza virus
SGKADTRILFI

SEQ ID NO: 401416 - protein, 11 aa, Influenza virus
ADTRILFIEEG

SEQ ID NO: 401417 - protein, 11 aa, Influenza virus
DTRILFIEEGK

SEQ ID NO: 401418 - protein, 11 aa, Influenza virus
IHISPLSGSAQ

SEQ ID NO: 401419 - protein, 11 aa, Influenza virus
HIGPLSGSAQH

SEQ ID NO: 401420 - protein, 11 aa, Influenza virus
ISPLSGSAQHV

SEQ ID NO: 401421 - protein, 11 aa, Influenza virus
SPLSGSAQHVE

SEQ ID NO: 401422 - protein, 11 aa, Influenza virus
PLSGSAQHVEE

SEQ ID NO: 401423 - protein, 11 aa, Influenza virus
LSGSAQHVEEC

SEQ ID NO: 401424 - protein, 11 aa, Influenza virus
SGSAQHVEECS

SEQ ID NO: 401425 - protein, 11 aa, Influenza virus
GSAQHVEECSC

SEQ ID NO: 401426 - protein, 11 aa, Influenza virus
SAQHVEECSCY

SEQ ID NO: 401427 - protein, 11 aa, Influenza virus
AQHVEECSCYP

SEQ ID NO: 401428 - protein, 11 aa, Influenza virus
QHVEECSCYPR

SEQ ID NO: 401429 - protein, 11 aa, Influenza virus
HVEECSCYPRY

SEQ ID NO: 401430 - protein, 11 aa, Influenza virus
VEECSCYPRYP

SEQ ID NO: 401431 - protein, 11 aa, Influenza virus
EECSCYPRYPG

SEQ ID NO: 401432 - protein, 11 aa, Influenza virus
ECSCYPRYPGV

SEQ ID NO: 401433 - protein, 11 aa, Influenza virus
CSCYPRYPGVR

SEQ ID NO: 401434 - protein, 11 aa, Influenza virus
SCYPRYPGVRC

SEQ ID NO: 401435 - protein, 11 aa, Influenza virus
YPGVRCICRDN

SEQ ID NO: 401436 - protein, 11 aa, Influenza virus
PGVRCICRDNW

SEQ ID NO: 401437 - protein, 11 aa, Influenza virus
VRCVCRDNWKG

SEQ ID NO: 401438 - protein, 11 aa, Influenza virus
RCVCRDNWKGS

SEQ ID NO: 401439 - protein, 11 aa, Influenza virus
CVCRDNWKGSN

SEQ ID NO: 401440 - protein, 11 aa, Influenza virus
VCRDNWKGSNR

SEQ ID NO: 401441 - protein, 11 aa, Influenza virus
CRDNWRGSNRP

SEQ ID NO: 401442 - protein, 11 aa, Influenza virus
RDNWKGSNRPI

SEQ ID NO: 401443 - protein, 11 aa, Influenza virus
DINMADYSIDS

SEQ ID NO: 401444 - protein, 11 aa, Influenza virus
DYSIDSSYICS

SEQ ID NO: 401445 - protein, 11 aa, Influenza virus
YSIDSSYICSG

SEQ ID NO: 401446 - protein, 11 aa, Influenza virus
SIDSSYICSGL

SEQ ID NO: 401447 - protein, 11 aa, Influenza virus
IDSSYICSGLV

SEQ ID NO: 401448 - protein, 11 aa, Influenza virus
DSSYICSGLVG

SEQ ID NO: 401449 - protein, 11 aa, Influenza virus
SSYICSGLVGD

SEQ ID NO: 401450 - protein, 11 aa, Influenza virus
SYICSGLVGDT

SEQ ID NO: 401451 - protein, 11 aa, Influenza virus
YICSGLVGDTP

SEQ ID NO: 401452 - protein, 11 aa, Influenza virus
ICSGLVGDTPR

SEQ ID NO: 401453 - protein, 11 aa, Influenza virus
SGLVGDTPRNG

SEQ ID NO: 401454 - protein, 11 aa, Influenza virus
GLVGDTPRNGD

SEQ ID NO: 401455 - protein, 11 aa, Influenza virus
LVGDTPRNDDR

SEQ ID NO: 401456 - protein, 11 aa, Influenza virus
VGDTPRNDDRS

SEQ ID NO: 401457 - protein, 11 aa, Influenza virus
GDTPRNDDRSS

SEQ ID NO: 401458 - protein, 11 aa, Influenza virus
SNSNCRNPNNE

SEQ ID NO: 401459 - protein, 11 aa, Influenza virus
SNCRNPNNERG

SEQ ID NO: 401460 - protein, 11 aa, Influenza virus
PNNERGNQGVK

SEQ ID NO: 401461 - protein, 11 aa, Influenza virus
NNERGNQGVKG

SEQ ID NO: 401462 - protein, 11 aa, Influenza virus
NERGNQGVKGW

SEQ ID NO: 401463 - protein, 11 aa, Influenza virus
ERGNQGVKGWA

SEQ ID NO: 401464 - protein, 11 aa, Influenza virus
RGNQGVKGWAF

SEQ ID NO: 401465 - protein, 11 aa, Influenza virus
GNQGVKGWAFD

SEQ ID NO: 401466 - protein, 11 aa, Influenza virus
QGVKGWAFDNG

SEQ ID NO: 401467 - protein, 11 aa, Influenza virus
KDSRSGYETFK

SEQ ID NO: 401468 - protein, 11 aa, Influenza virus
DSRSGYETFKV

SEQ ID NO: 401469 - protein, 11 aa, Influenza virus
SRSGYETFKVI

SEQ ID NO: 401470 - protein, 11 aa, Influenza virus
RSGYETFRVIG

SEQ ID NO: 401471 - protein, 11 aa, Influenza virus
SGYETFRVIGG

SEQ ID NO: 401472 - protein, 11 aa, Influenza virus
GYETFRVIGGW

SEQ ID NO: 401473 - protein, 11 aa, Influenza virus
YETFKVIGGWT

SEQ ID NO: 401474 - protein, 11 aa, Influenza virus
ETFKVIGGWTT

SEQ ID NO: 401475 - protein, 11 aa, Influenza virus
SDNRSGYSGIF

SEQ ID NO: 401476 - protein, 11 aa, Influenza virus
DNRSGYSGIFS

SEQ ID NO: 401477 - protein, 11 aa, Influenza virus
NRSGYSGIFSV

SEQ ID NO: 401478 - protein, 11 aa, Influenza virus
RSGYSGIFSVE

SEQ ID NO: 401479 - protein, 11 aa, Influenza virus
SGYSGIFSVEN

SEQ ID NO: 401480 - protein, 11 aa, Influenza virus
GYSGIFSVEHK

SEQ ID NO: 401481 - protein, 11 aa, Influenza virus
KGCINRCFYVE

SEQ ID NO: 401482 - protein, 11 aa, Influenza virus
GCINRCFYVEL

SEQ ID NO: 401483 - protein, 11 aa, Influenza virus
CVNRCFYVELI

SEQ ID NO: 401484 - protein, 11 aa, Influenza virus
VNRCFYVELIR

SEQ ID NO: 401485 - protein, 11 aa, Influenza virus
CFYVELIRGRK

SEQ ID NO: 401486 - protein, 11 aa, Influenza virus
FYVELIRGRKQ

SEQ ID NO: 401487 - protein, 11 aa, Influenza virus
YVELIRGRKQE

SEQ ID NO: 401488 - protein, 11 aa, Influenza virus
QEARVWWTSNS

SEQ ID NO: 401489 - protein, 11 aa, Influenza virus
EARVWWTSNSI

SEQ ID NO: 401490 - protein, 11 aa, Influenza virus
ARVWWTSNSIV

SEQ ID NO: 401491 - protein, 11 aa, Influenza virus
RVWWTSNSIAV

SEQ ID NO: 401492 - protein, 11 aa, Influenza virus
VWWTSNSIAVF

SEQ ID NO: 401493 - protein, 11 aa, Influenza virus
WWTSNSIAVFC

SEQ ID NO: 401494 - protein, 11 aa, Influenza virus
WTSNSIAVFCG

SEQ ID NO: 401495 - protein, 11 aa, Influenza virus
TSNSIAVFCGT

SEQ ID NO: 401496 - protein, 11 aa, Influenza virus
SNSIAVFCGTS

SEQ ID NO: 401497 - protein, 11 aa, Influenza virus
NSIAVFCGTSG

SEQ ID NO: 401498 - protein, 11 aa, Influenza virus
SIAVFCGTSGT

SEQ ID NO: 401499 - protein, 11 aa, Influenza virus
IAVFCGTSGTY

SEQ ID NO: 401500 - protein, 11 aa, Influenza virus
AVFCGTSGTYG

SEQ ID NO: 401501 - protein, 11 aa, Influenza virus
YGTGSWPDGAD

SEQ ID NO: 401502 - protein, 11 aa, Influenza virus
GTGSWPDGADI

SEQ ID NO: 401503 - protein, 11 aa, Influenza virus
TGSWPDGADIN

SEQ ID NO: 401504 - protein, 11 aa, Influenza virus
GSWPDGANINL

SEQ ID NO: 401505 - protein, 11 aa, Influenza virus
SWPDGANINLM

SEQ ID NO: 401506 - protein, 11 aa, Influenza virus
WPDGANINLMP

SEQ ID NO: 401507 - protein, 11 aa, Influenza virus
PDGANINLMPI

SEQ ID NO: 401508 - protein, 11 aa, Influenza virus
LIMRTVIALSY

SEQ ID NO: 401509 - protein, 11 aa, Influenza virus
SMSGFRSNLPG

SEQ ID NO: 401510 - protein, 11 aa, Influenza virus
IFIFLLLTHWA

SEQ ID NO: 401511 - protein, 11 aa, Influenza virus
FNFILLTHWAY

SEQ ID NO: 401512 - protein, 11 aa, Influenza virus
RFSYVFCLALG

SEQ ID NO: 401513 - protein, 11 aa, Influenza virus
MATLCLGHHAV

SEQ ID NO: 401514 - protein, 11 aa, Influenza virus
ATLCLGHHAVA

SEQ ID NO: 401515 - protein, 11 aa, Influenza virus
TLCLGHHAVAN

SEQ ID NO: 401516 - protein, 11 aa, Influenza virus
LCLGHHAVANG

SEQ ID NO: 401517 - protein, 11 aa, Influenza virus
CLGHHAVANGT

SEQ ID NO: 401518 - protein, 11 aa, Influenza virus
DHIEVTNATEL

SEQ ID NO: 401519 - protein, 11 aa, Influenza virus
HIEVTNATELV

SEQ ID NO: 401520 - protein, 11 aa, Influenza virus
VEVTNATELVQ

SEQ ID NO: 401521 - protein, 11 aa, Influenza virus
EVTNATELVQN

SEQ ID NO: 401522 - protein, 11 aa, Influenza virus
CTLMDALLGDP

SEQ ID NO: 401523 - protein, 11 aa, Influenza virus
SLRSLIASSGT

SEQ ID NO: 401524 - protein, 11 aa, Influenza virus
LRSLIASSGTL

SEQ ID NO: 401525 - protein, 11 aa, Influenza virus
FDKLYVWGVHH

SEQ ID NO: 401526 - protein, 11 aa, Influenza virus
DKLYVWGVHHP

SEQ ID NO: 401527 - protein, 11 aa, Influenza virus
SNGNLIAPRGY

SEQ ID NO: 401528 - protein, 11 aa, Influenza virus
NGNLIAPRGYF

SEQ ID NO: 401529 - protein, 11 aa, Influenza virus
GNLVAPRGYFK

SEQ ID NO: 401530 - protein, 11 aa, Influenza virus
ECITPNGSISN

SEQ ID NO: 401531 - protein, 11 aa, Influenza virus
CITPNGSISND

SEQ ID NO: 401532 - protein, 11 aa, Influenza virus
KPFQNVNKITY

SEQ ID NO: 401533 - protein, 11 aa, Influenza virus
PFQNVNKITYG

SEQ ID NO: 401534 - protein, 11 aa, Influenza virus
TLKLATGMRNI

SEQ ID NO: 401535 - protein, 11 aa, Influenza virus
LKLATGMRNIP

SEQ ID NO: 401536 - protein, 11 aa, Influenza virus
KLATGMRNIPE

SEQ ID NO: 401537 - protein, 11 aa, Influenza virus
LATGMRNVPER

SEQ ID NO: 401538 - protein, 11 aa, Influenza virus
RGLFGAIAGFI

SEQ ID NO: 401539 - protein, 11 aa, Influenza virus
GLFGAIAGFIE

SEQ ID NO: 401540 - protein, 11 aa, Influenza virus
LFGAIAGFIEN

SEQ ID NO: 401541 - protein, 11 aa, Influenza virus
GFIENGWEGMI

SEQ ID NO: 401542 - protein, 11 aa, Influenza virus
FIENGWEGMID

SEQ ID NO: 401543 - protein, 11 aa, Influenza virus
IENGWEGMIDG

SEQ ID NO: 401544 - protein, 11 aa, Influenza virus
ENGWEGMIDGW

SEQ ID NO: 401545 - protein, 11 aa, Influenza virus
NGWEGMIDGWY

SEQ ID NO: 401546 - protein, 11 aa, Influenza virus
GWEGMIDGWYG

SEQ ID NO: 401547 - protein, 11 aa, Influenza virus
WEGMIDGWYGF

SEQ ID NO: 401548 - protein, 11 aa, Influenza virus
EGMIDGWYGFR

SEQ ID NO: 401549 - protein, 11 aa, Influenza virus
GMIDGWYGFRH

SEQ ID NO: 401550 - protein, 11 aa, Influenza virus
DGWYGFRYQNS

SEQ ID NO: 401551 - protein, 11 aa, Influenza virus
GWYGFRYQNSE

SEQ ID NO: 401552 - protein, 11 aa, Influenza virus
WYGFRYQNSEG

SEQ ID NO: 401553 - protein, 11 aa, Influenza virus
NSEGIGQAADL

SEQ ID NO: 401554 - protein, 11 aa, Influenza virus
SEGIGQAADLK

SEQ ID NO: 401555 - protein, 11 aa, Influenza virus
EGIGQAADLKS

SEQ ID NO: 401556 - protein, 11 aa, Influenza virus
GIGQAADLKST

SEQ ID NO: 401557 - protein, 11 aa, Influenza virus
IGQAADLKSTQ

SEQ ID NO: 401558 - protein, 11 aa, Influenza virus
GQAADLKSTQT

SEQ ID NO: 401559 - protein, 11 aa, Influenza virus
QAADLKSTQTA

SEQ ID NO: 401560 - protein, 11 aa, Influenza virus
AADLKSTQTAI

SEQ ID NO: 401561 - protein, 11 aa, Influenza virus
DLKSTQAAINQ

SEQ ID NO: 401562 - protein, 11 aa, Influenza virus
IEKTNEKFHQI

SEQ ID NO: 401563 - protein, 11 aa, Influenza virus
EKTNEKFHQIE

SEQ ID NO: 401564 - protein, 11 aa, Influenza virus
RTNEKFHQIEK

SEQ ID NO: 401565 - protein, 11 aa, Influenza virus
FHQIEKEFSEI

SEQ ID NO: 401566 - protein, 11 aa, Influenza virus
HQIEKEFSEIE

SEQ ID NO: 401567 - protein, 11 aa, Influenza virus
QIEKEFSEIEG

SEQ ID NO: 401568 - protein, 11 aa, Influenza virus
IEKEFSEIEGR

SEQ ID NO: 401569 - protein, 11 aa, Influenza virus
EKEFSEIEGRI

SEQ ID NO: 401570 - protein, 11 aa, Influenza virus
KEFSEIEGRIQ

SEQ ID NO: 401571 - protein, 11 aa, Influenza virus
EFSEIEGRIQD

SEQ ID NO: 401572 - protein, 11 aa, Influenza virus
FSEIEGRIQDL

SEQ ID NO: 401573 - protein, 11 aa, Influenza virus
SEIEGRIQDLE

SEQ ID NO: 401574 - protein, 11 aa, Influenza virus
EIEGRIQDLEK

SEQ ID NO: 401575 - protein, 11 aa, Influenza virus
IEGRIQDLEKY

SEQ ID NO: 401576 - protein, 11 aa, Influenza virus
EGRIQDLERYV

SEQ ID NO: 401577 - protein, 11 aa, Influenza virus
GRIQDLERYVE

SEQ ID NO: 401578 - protein, 11 aa, Influenza virus
RIQDLERYVED

SEQ ID NO: 401579 - protein, 11 aa, Influenza virus
IQDLERYVEDT

SEQ ID NO: 401580 - protein, 11 aa, Influenza virus
QDLERYVEDTK

SEQ ID NO: 401581 - protein, 11 aa, Influenza virus
DLEKYVEDTKV

SEQ ID NO: 401582 - protein, 11 aa, Influenza virus
LEKYVEDTKVD

SEQ ID NO: 401583 - protein, 11 aa, Influenza virus
EKYVEDTKVDL

SEQ ID NO: 401584 - protein, 11 aa, Influenza virus
KYVEDTKVDLW

SEQ ID NO: 401585 - protein, 11 aa, Influenza virus
YVEDTKVDLWS

SEQ ID NO: 401586 - protein, 11 aa, Influenza virus
VEDTKVDLWSY

SEQ ID NO: 401587 - protein, 11 aa, Influenza virus
EDTKVDLWSYN

SEQ ID NO: 401588 - protein, 11 aa, Influenza virus
DTKVDLWSYNA

SEQ ID NO: 401589 - protein, 11 aa, Influenza virus
TKVDLWSYNAE

SEQ ID NO: 401590 - protein, 11 aa, Influenza virus
KVDLWSYNAEL

SEQ ID NO: 401591 - protein, 11 aa, Influenza virus
VDLWSYNAELL

SEQ ID NO: 401592 - protein, 11 aa, Influenza virus
DLWSYNAGLLV

SEQ ID NO: 401593 - protein, 11 aa, Influenza virus
LWSYNAGLLVA

SEQ ID NO: 401594 - protein, 11 aa, Influenza virus
WSYNAGLLVAL

SEQ ID NO: 401595 - protein, 11 aa, Influenza virus
SYNAGLLVALE

SEQ ID NO: 401596 - protein, 11 aa, Influenza virus
YNAGLLVALEN

SEQ ID NO: 401597 - protein, 11 aa, Influenza virus
NAGLLVALENQ

SEQ ID NO: 401598 - protein, 11 aa, Influenza virus
VLVALENQHTI

SEQ ID NO: 401599 - protein, 11 aa, Influenza virus
LVALENQHTIH

SEQ ID NO: 401600 - protein, 11 aa, Influenza virus
VALENQHTIHL

SEQ ID NO: 401601 - protein, 11 aa, Influenza virus
ALENQHTIHLT

SEQ ID NO: 401602 - protein, 11 aa, Influenza virus
LENQHTIHLTD

SEQ ID NO: 401603 - protein, 11 aa, Influenza virus
ENQHTIDLTDA

SEQ ID NO: 401604 - protein, 11 aa, Influenza virus
NQHTIDLTDAE

SEQ ID NO: 401605 - protein, 11 aa, Influenza virus
QHTIDLTDAEM

SEQ ID NO: 401606 - protein, 11 aa, Influenza virus
TRRQLRENAED

SEQ ID NO: 401607 - protein, 11 aa, Influenza virus
RQLRENAEDMG

SEQ ID NO: 401608 - protein, 11 aa, Influenza virus
QLRENAEDMGG

SEQ ID NO: 401609 - protein, 11 aa, Influenza virus
LRENAEDMGGG

SEQ ID NO: 401610 - protein, 11 aa, Influenza virus
RENAEDMGGGC

SEQ ID NO: 401611 - protein, 11 aa, Influenza virus
ENAEDMGGGCF

SEQ ID NO: 401612 - protein, 11 aa, Influenza virus
GCFTIYHKCDN

SEQ ID NO: 401613 - protein, 11 aa, Influenza virus
GYKDWVLWISF

SEQ ID NO: 401614 - protein, 11 aa, Influenza virus
YKDWVLWISFA

SEQ ID NO: 401615 - protein, 11 aa, Influenza virus
KDWVLWISFAI

SEQ ID NO: 401616 - protein, 11 aa, Influenza virus
DWVLWISFAIS

SEQ ID NO: 401617 - protein, 11 aa, Influenza virus
WVLWISFAISC

SEQ ID NO: 401618 - protein, 11 aa, Influenza virus
VLWISFAISCF

SEQ ID NO: 401619 - protein, 11 aa, Influenza virus
LWISFATSCFL

SEQ ID NO: 401620 - protein, 11 aa, Influenza virus
GFIMWACQRGN

SEQ ID NO: 401621 - protein, 11 aa, Influenza virus
MWACQRGNIRC

SEQ ID NO: 401622 - protein, 11 aa, Influenza virus
WACQRGNIRCN

SEQ ID NO: 401623 - protein, 11 aa, Influenza virus
ACQRGNIRCNI

SEQ ID NO: 401624 - protein, 11 aa, Influenza virus
CQRGNIRCNIC

SEQ ID NO: 401625 - protein, 11 aa, Influenza virus
QRGNIRCNICI

SEQ ID NO: 401626 - protein, 11 aa, Influenza virus
MKTIIIVLSCI

SEQ ID NO: 401627 - protein, 11 aa, Influenza virus
MATLCLGHHAV

SEQ ID NO: 401628 - protein, 11 aa, Influenza virus
AMLCLGHHAVP

SEQ ID NO: 401629 - protein, 11 aa, Influenza virus
MLCLGHHAVPN

SEQ ID NO: 401630 - protein, 11 aa, Influenza virus
LGHHAVPNGTL

SEQ ID NO: 401631 - protein, 11 aa, Influenza virus
GHHAVPNGTLV

SEQ ID NO: 401632 - protein, 11 aa, Influenza virus
HHAVPNGTLVK

SEQ ID NO: 401633 - protein, 11 aa, Influenza virus
HAVPNGTLVKT

SEQ ID NO: 401634 - protein, 11 aa, Influenza virus
AVPNGTLVKTI

SEQ ID NO: 401635 - protein, 11 aa, Influenza virus
VPNGTLVKTIT

SEQ ID NO: 401636 - protein, 11 aa, Influenza virus
DHIEVTNATEL

SEQ ID NO: 401637 - protein, 11 aa, Influenza virus
HIEVTNATELV

SEQ ID NO: 401638 - protein, 11 aa, Influenza virus
VEVTNATELVQ

SEQ ID NO: 401639 - protein, 11 aa, Influenza virus
EVTNATELVQN

SEQ ID NO: 401640 - protein, 11 aa, Influenza virus
CTLMDALLGDP

SEQ ID NO: 401641 - protein, 11 aa, Influenza virus
TLIDALLGDPH

SEQ ID NO: 401642 - protein, 11 aa, Influenza virus
LIDALLGDPHC

SEQ ID NO: 401643 - protein, 11 aa, Influenza virus
IDALLGDPHCD

SEQ ID NO: 401644 - protein, 11 aa, Influenza virus
SLRSLIASSGT

SEQ ID NO: 401645 - protein, 11 aa, Influenza virus
LRSLIASSGTL

SEQ ID NO: 401646 - protein, 11 aa, Influenza virus
RSLIASSGTLE

SEQ ID NO: 401647 - protein, 11 aa, Influenza virus
SLIASSGTLEF

SEQ ID NO: 401648 - protein, 11 aa, Influenza virus
FDKLYVWGVHH

SEQ ID NO: 401649 - protein, 11 aa, Influenza virus
DKLYVWGVHHP

SEQ ID NO: 401650 - protein, 11 aa, Influenza virus
SVYWTVVKPGD

SEQ ID NO: 401651 - protein, 11 aa, Influenza virus
SNGNLIAPRGY

SEQ ID NO: 401652 - protein, 11 aa, Influenza virus
NGNLIAPRGYF

SEQ ID NO: 401653 - protein, 11 aa, Influenza virus
GNLIAPRGYFR

SEQ ID NO: 401654 - protein, 11 aa, Influenza virus
NLIAPRGYFKM

SEQ ID NO: 401655 - protein, 11 aa, Influenza virus
ACITPNGSIPN

SEQ ID NO: 401656 - protein, 11 aa, Influenza virus
CITPNGSIPNE

SEQ ID NO: 401657 - protein, 11 aa, Influenza virus
TPNGSIPNEKP

SEQ ID NO: 401658 - protein, 11 aa, Influenza virus
NGSIPNEKPFQ

SEQ ID NO: 401659 - protein, 11 aa, Influenza virus
GSIPNEKPFQN

SEQ ID NO: 401660 - protein, 11 aa, Influenza virus
KPFQNVNKITY

SEQ ID NO: 401661 - protein, 11 aa, Influenza virus
PFQNVNKITYG

SEQ ID NO: 401662 - protein, 11 aa, Influenza virus
FQNVNKITYGA

SEQ ID NO: 401663 - protein, 11 aa, Influenza virus
QNVNKITYGAC

SEQ ID NO: 401664 - protein, 11 aa, Influenza virus
NVNKITYGACP

SEQ ID NO: 401665 - protein, 11 aa, Influenza virus
YVKQSTLKLAT

SEQ ID NO: 401666 - protein, 11 aa, Influenza virus
VKQSTLKLATG

SEQ ID NO: 401667 - protein, 11 aa, Influenza virus
KQSTLKLATGM

SEQ ID NO: 401668 - protein, 11 aa, Influenza virus
QSTLKLATGMR

SEQ ID NO: 401669 - protein, 11 aa, Influenza virus
STLKLATGMRN

SEQ ID NO: 401670 - protein, 11 aa, Influenza virus
TLKLATGMRNI

SEQ ID NO: 401671 - protein, 11 aa, Influenza virus
LKLATGMRNIP

SEQ ID NO: 401672 - protein, 11 aa, Influenza virus
KLATGMRNIPE

SEQ ID NO: 401673 - protein, 11 aa, Influenza virus
LATGMRNIPEK

SEQ ID NO: 401674 - protein, 11 aa, Influenza virus
ATGMRNVPETQ

SEQ ID NO: 401675 - protein, 11 aa, Influenza virus
TGMRNVPETQT

SEQ ID NO: 401676 - protein, 11 aa, Influenza virus
GMRNVPETQTR

SEQ ID NO: 401677 - protein, 11 aa, Influenza virus
MRNVPETQTRG

SEQ ID NO: 401678 - protein, 11 aa, Influenza virus
PEKQTRGLFGA

SEQ ID NO: 401679 - protein, 11 aa, Influenza virus
EKQTRGLFGAI

SEQ ID NO: 401680 - protein, 11 aa, Influenza virus
KQTRGLFGAIA

SEQ ID NO: 401681 - protein, 11 aa, Influenza virus
QTRGLFGAIAG

SEQ ID NO: 401682 - protein, 11 aa, Influenza virus
TRGLFGAIAGF

SEQ ID NO: 401683 - protein, 11 aa, Influenza virus
RGLFGAIAGFI

SEQ ID NO: 401684 - protein, 11 aa, Influenza virus
GLFGAIAGFIE

SEQ ID NO: 401685 - protein, 11 aa, Influenza virus
LFGAIAGFIEN

SEQ ID NO: 401686 - protein, 11 aa, Influenza virus
GFIENGWEGMM

SEQ ID NO: 401687 - protein, 11 aa, Influenza virus
FIENGWEGMMD

SEQ ID NO: 401688 - protein, 11 aa, Influenza virus
IENGWEGMMDG

SEQ ID NO: 401689 - protein, 11 aa, Influenza virus
ENGWEGMMDGW

SEQ ID NO: 401690 - protein, 11 aa, Influenza virus
NGWEGMMDGWY

SEQ ID NO: 401691 - protein, 11 aa, Influenza virus
GWEGMMDGWYG

SEQ ID NO: 401692 - protein, 11 aa, Influenza virus
WEGMMDGWYGF

SEQ ID NO: 401693 - protein, 11 aa, Influenza virus
EGMMDGWYGFR

SEQ ID NO: 401694 - protein, 11 aa, Influenza virus
GMMDGWYGFRH

SEQ ID NO: 401695 - protein, 11 aa, Influenza virus
MMDGWYGFRHQ

SEQ ID NO: 401696 - protein, 11 aa, Influenza virus
MDGWYGFRHQN

SEQ ID NO: 401697 - protein, 11 aa, Influenza virus
NGWYGFRHQNS

SEQ ID NO: 401698 - protein, 11 aa, Influenza virus
GWYGFRHHNSE

SEQ ID NO: 401699 - protein, 11 aa, Influenza virus
WYGFRHHNSEG

SEQ ID NO: 401700 - protein, 11 aa, Influenza virus
NSEGIGQAADL

SEQ ID NO: 401701 - protein, 11 aa, Influenza virus
SEGIGQAADLK

SEQ ID NO: 401702 - protein, 11 aa, Influenza virus
EGIGQAADLKS

SEQ ID NO: 401703 - protein, 11 aa, Influenza virus
GIGQAADLKST

SEQ ID NO: 401704 - protein, 11 aa, Influenza virus
IGQAADLKSTQ

SEQ ID NO: 401705 - protein, 11 aa, Influenza virus
AADFKSTQAAI

SEQ ID NO: 401706 - protein, 11 aa, Influenza virus
ADLKSTQAAID

SEQ ID NO: 401707 - protein, 11 aa, Influenza virus
DLKSTQAAIDQ

SEQ ID NO: 401708 - protein, 11 aa, Influenza virus
IEKTNEKFHQI

SEQ ID NO: 401709 - protein, 11 aa, Influenza virus
EKTNEKFHQIE

SEQ ID NO: 401710 - protein, 11 aa, Influenza virus
KFHQIEKEFTE

SEQ ID NO: 401711 - protein, 11 aa, Influenza virus
FHQIEKEFTEV

SEQ ID NO: 401712 - protein, 11 aa, Influenza virus
HQIEKEFTEVE

SEQ ID NO: 401713 - protein, 11 aa, Influenza virus
QIEKEFTEVEG

SEQ ID NO: 401714 - protein, 11 aa, Influenza virus
IEKEFTEVEGR

SEQ ID NO: 401715 - protein, 11 aa, Influenza virus
EKEFTEVEGRI

SEQ ID NO: 401716 - protein, 11 aa, Influenza virus
KEFTEVEGRIQ

SEQ ID NO: 401717 - protein, 11 aa, Influenza virus
EFTEVEGRIQD

SEQ ID NO: 401718 - protein, 11 aa, Influenza virus
FTEVEGRIQDL

SEQ ID NO: 401719 - protein, 11 aa, Influenza virus
TEVEGRIQDLE

SEQ ID NO: 401720 - protein, 11 aa, Influenza virus
EVEGRIQDLER

SEQ ID NO: 401721 - protein, 11 aa, Influenza virus
VEGRIQDLERY

SEQ ID NO: 401722 - protein, 11 aa, Influenza virus
EGRIQDLERYV

SEQ ID NO: 401723 - protein, 11 aa, Influenza virus
GRIQDLERYVE

SEQ ID NO: 401724 - protein, 11 aa, Influenza virus
RIQDLERYVED

SEQ ID NO: 401725 - protein, 11 aa, Influenza virus
IQDLERYVEDT

SEQ ID NO: 401726 - protein, 11 aa, Influenza virus
QDLERYVEDTK

SEQ ID NO: 401727 - protein, 11 aa, Influenza virus
DLEKYVEDTKV

SEQ ID NO: 401728 - protein, 11 aa, Influenza virus
LEKYVEDTKVD

SEQ ID NO: 401729 - protein, 11 aa, Influenza virus
EKYVEDTKVDL

SEQ ID NO: 401730 - protein, 11 aa, Influenza virus
KYVEDTKVDLW

SEQ ID NO: 401731 - protein, 11 aa, Influenza virus
YVEDTKVDLWS

SEQ ID NO: 401732 - protein, 11 aa, Influenza virus
VEDTKVDLWSY

SEQ ID NO: 401733 - protein, 11 aa, Influenza virus
EDTKVDLWSYN

SEQ ID NO: 401734 - protein, 11 aa, Influenza virus
DTKVDLWSYNA

SEQ ID NO: 401735 - protein, 11 aa, Influenza virus
TKIDLWSYNAG

SEQ ID NO: 401736 - protein, 11 aa, Influenza virus
KIDLWSYNAGL

SEQ ID NO: 401737 - protein, 11 aa, Influenza virus
IDLWSYNAGLL

SEQ ID NO: 401738 - protein, 11 aa, Influenza virus
DLWSYNAGLLV

SEQ ID NO: 401739 - protein, 11 aa, Influenza virus
LWSYNAGLLVA

SEQ ID NO: 401740 - protein, 11 aa, Influenza virus
WSYNAGLLVAL

SEQ ID NO: 401741 - protein, 11 aa, Influenza virus
SYNAGLLVALE

SEQ ID NO: 401742 - protein, 11 aa, Influenza virus
YNAGLLVALEN

SEQ ID NO: 401743 - protein, 11 aa, Influenza virus
NAGLLVALENQ

SEQ ID NO: 401744 - protein, 11 aa, Influenza virus
LLVALENQNTI

SEQ ID NO: 401745 - protein, 11 aa, Influenza virus
LVALENQHTIH

SEQ ID NO: 401746 - protein, 11 aa, Influenza virus
VALENQHTIHL

SEQ ID NO: 401747 - protein, 11 aa, Influenza virus
ALENQHTIHLT

SEQ ID NO: 401748 - protein, 11 aa, Influenza virus
LENQHTIHLTD

SEQ ID NO: 401749 - protein, 11 aa, Influenza virus
ENQHTIHLTDS

SEQ ID NO: 401750 - protein, 11 aa, Influenza virus
NQHTIHLTDSE

SEQ ID NO: 401751 - protein, 11 aa, Influenza virus
QHTIHLTDSEM

SEQ ID NO: 401752 - protein, 11 aa, Influenza virus
HTIDLTDSEMS

SEQ ID NO: 401753 - protein, 11 aa, Influenza virus
TIDLTDSEMSK

SEQ ID NO: 401754 - protein, 11 aa, Influenza virus
IDLTDSEMSKL

SEQ ID NO: 401755 - protein, 11 aa, Influenza virus
DLTDSEMSKLF

SEQ ID NO: 401756 - protein, 11 aa, Influenza virus
LTDSEMSKLFE

SEQ ID NO: 401757 - protein, 11 aa, Influenza virus
TDSEMNKLFEK

SEQ ID NO: 401758 - protein, 11 aa, Influenza virus
DSEMNKLFEKT

SEQ ID NO: 401759 - protein, 11 aa, Influenza virus
TRKQLRENAED

SEQ ID NO: 401760 - protein, 11 aa, Influenza virus
RQLRENAEDMG

SEQ ID NO: 401761 - protein, 11 aa, Influenza virus
QLRENAEEMGN

SEQ ID NO: 401762 - protein, 11 aa, Influenza virus
LRENAEEMGNG

SEQ ID NO: 401763 - protein, 11 aa, Influenza virus
RENAEDLGNGC

SEQ ID NO: 401764 - protein, 11 aa, Influenza virus
ENAEDMGNGCL

SEQ ID NO: 401765 - protein, 11 aa, Influenza virus
NAEDMGNGCFT

SEQ ID NO: 401766 - protein, 11 aa, Influenza virus
AEDMGNGCFTI

SEQ ID NO: 401767 - protein, 11 aa, Influenza virus
EDMGNGCFTIY

SEQ ID NO: 401768 - protein, 11 aa, Influenza virus
MGNGCFTIYHK

SEQ ID NO: 401769 - protein, 11 aa, Influenza virus
GNGCFTIYHKC

SEQ ID NO: 401770 - protein, 11 aa, Influenza virus
NGCFTIYHKCD

SEQ ID NO: 401771 - protein, 11 aa, Influenza virus
GCFTIYHKCDN

SEQ ID NO: 401772 - protein, 11 aa, Influenza virus
IESIRNGTYDH

SEQ ID NO: 401773 - protein, 11 aa, Influenza virus
YRDEAVNNRFQ

SEQ ID NO: 401774 - protein, 11 aa, Influenza virus
GYKDWVLWISF

SEQ ID NO: 401775 - protein, 11 aa, Influenza virus
YKDWVLWISFA

SEQ ID NO: 401776 - protein, 11 aa, Influenza virus
KDWVLWISFAI

SEQ ID NO: 401777 - protein, 11 aa, Influenza virus
WVLWISFAISC

SEQ ID NO: 401778 - protein, 11 aa, Influenza virus
VLWISFAISCF

SEQ ID NO: 401779 - protein, 11 aa, Influenza virus
LWISFATSCFL

SEQ ID NO: 401780 - protein, 11 aa, Influenza virus
WISFATSCFLL

SEQ ID NO: 401781 - protein, 11 aa, Influenza virus
ISFATSCFLLC

SEQ ID NO: 401782 - protein, 11 aa, Influenza virus
LGFIMWACQRG

SEQ ID NO: 401783 - protein, 11 aa, Influenza virus
GFIMWACQRGN

SEQ ID NO: 401784 - protein, 11 aa, Influenza virus
FIMWACQRGNI

SEQ ID NO: 401785 - protein, 11 aa, Influenza virus
IMWACQRGNIR

SEQ ID NO: 401786 - protein, 11 aa, Influenza virus
MWACQRGNIRC

SEQ ID NO: 401787 - protein, 11 aa, Influenza virus
WACQRGNIRCN

SEQ ID NO: 401788 - protein, 11 aa, Influenza virus
ACQRGNIRCNI

SEQ ID NO: 401789 - protein, 11 aa, Influenza virus
CQRGNIRCNIC

SEQ ID NO: 401790 - protein, 11 aa, Influenza virus
QRGNIRCNICI

SEQ ID NO: 401791 - protein, 11 aa, Influenza virus
IAGFAPFSKDN

SEQ ID NO: 401792 - protein, 11 aa, Influenza virus
PFSKDNSIRLA

SEQ ID NO: 401793 - protein, 11 aa, Influenza virus
FSKDNSIRLAA

SEQ ID NO: 401794 - protein, 11 aa, Influenza virus
SKDNSIRLAAG

SEQ ID NO: 401795 - protein, 11 aa, Influenza virus
KDNSIRLAAGG

SEQ ID NO: 401796 - protein, 11 aa, Influenza virus
DNSIRLSAGGA

SEQ ID NO: 401797 - protein, 11 aa, Influenza virus
NSIRLSAGGAI

SEQ ID NO: 401798 - protein, 11 aa, Influenza virus
SIRLSAGGAIW

SEQ ID NO: 401799 - protein, 11 aa, Influenza virus
IRLSAGGAIWV

SEQ ID NO: 401800 - protein, 11 aa, Influenza virus
RLSAGGAIWVT

SEQ ID NO: 401801 - protein, 11 aa, Influenza virus
LSAGGAIWVTR

SEQ ID NO: 401802 - protein, 11 aa, Influenza virus
SAGGAIWVTRE

SEQ ID NO: 401803 - protein, 11 aa, Influenza virus
AGGDIWVTREL

SEQ ID NO: 401804 - protein, 11 aa, Influenza virus
GGDIWVTRELY

SEQ ID NO: 401805 - protein, 11 aa, Influenza virus
GDIWVTRELYV

SEQ ID NO: 401806 - protein, 11 aa, Influenza virus
DIWVTRELYVS

SEQ ID NO: 401807 - protein, 11 aa, Influenza virus
IWVTRELYVSC

SEQ ID NO: 401808 - protein, 11 aa, Influenza virus
WVTREPYVSCS

SEQ ID NO: 401809 - protein, 11 aa, Influenza virus
GKCYQFALGQG

SEQ ID NO: 401810 - protein, 11 aa, Influenza virus
QFALGQGTTLD

SEQ ID NO: 401811 - protein, 11 aa, Influenza virus
FALGQGTTLDN

SEQ ID NO: 401812 - protein, 11 aa, Influenza virus
RIPHRTLLMNE

SEQ ID NO: 401813 - protein, 11 aa, Influenza virus
IPHRTLLMNEL

SEQ ID NO: 401814 - protein, 11 aa, Influenza virus
PHRTLLMNELG

SEQ ID NO: 401815 - protein, 11 aa, Influenza virus
HRTLLMNELGV

SEQ ID NO: 401816 - protein, 11 aa, Influenza virus
TLLMSELGVPF

SEQ ID NO: 401817 - protein, 11 aa, Influenza virus
LLMSELGVPFH

SEQ ID NO: 401818 - protein, 11 aa, Influenza virus
LMSELGVPFHL

SEQ ID NO: 401819 - protein, 11 aa, Influenza virus
MSELGVPFHLG

SEQ ID NO: 401820 - protein, 11 aa, Influenza virus
SELGVPFHLGT

SEQ ID NO: 401821 - protein, 11 aa, Influenza virus
ELGVPFHLGTR

SEQ ID NO: 401822 - protein, 11 aa, Influenza virus
LGVPFHLGTRQ

SEQ ID NO: 401823 - protein, 11 aa, Influenza virus
GVPFHLGTRQV

SEQ ID NO: 401824 - protein, 11 aa, Influenza virus
VPFHLGTRQVC

SEQ ID NO: 401825 - protein, 11 aa, Influenza virus
PFHLGTRQVCI

SEQ ID NO: 401826 - protein, 11 aa, Influenza virus
FHLGTRQVCIA

SEQ ID NO: 401827 - protein, 11 aa, Influenza virus
HLGTRQVCIAW

SEQ ID NO: 401828 - protein, 11 aa, Influenza virus
LGTRQVCIAWS

SEQ ID NO: 401829 - protein, 11 aa, Influenza virus
GTRQVCIAWSS

SEQ ID NO: 401830 - protein, 11 aa, Influenza virus
TRQVCIAWSSS

SEQ ID NO: 401831 - protein, 11 aa, Influenza virus
RQVCIAWSSSS

SEQ ID NO: 401832 - protein, 11 aa, Influenza virus
QVCMAWSSSSC

SEQ ID NO: 401833 - protein, 11 aa, Influenza virus
VCMAWSSSSCH

SEQ ID NO: 401834 - protein, 11 aa, Influenza virus
CMAWSSSSCHD

SEQ ID NO: 401835 - protein, 11 aa, Influenza virus
MAWSSSSCHDG

SEQ ID NO: 401836 - protein, 11 aa, Influenza virus
SCHDGRAWLHV

SEQ ID NO: 401837 - protein, 11 aa, Influenza virus
CHDGRAWLHVC

SEQ ID NO: 401838 - protein, 11 aa, Influenza virus
HDGKAWLHVCI

SEQ ID NO: 401839 - protein, 11 aa, Influenza virus
DGKAWLHVCIT

SEQ ID NO: 401840 - protein, 11 aa, Influenza virus
GKAWLHVCITG

SEQ ID NO: 401841 - protein, 11 aa, Influenza virus
KILRTQESECV

SEQ ID NO: 401842 - protein, 11 aa, Influenza virus
RTQESECICIN

SEQ ID NO: 401843 - protein, 11 aa, Influenza virus
TQESECICING

SEQ ID NO: 401844 - protein, 11 aa, Influenza virus
QESECICINGT

SEQ ID NO: 401845 - protein, 11 aa, Influenza virus
ESECICINGTC

SEQ ID NO: 401846 - protein, 11 aa, Influenza virus
SECVCINGTCA

SEQ ID NO: 401847 - protein, 11 aa, Influenza virus
ECVCINGTCAV

SEQ ID NO: 401848 - protein, 11 aa, Influenza virus
CVCINGTCAVV

SEQ ID NO: 401849 - protein, 11 aa, Influenza virus
CINGTCAVVMT

SEQ ID NO: 401850 - protein, 11 aa, Influenza virus
INGTCAVVMTD

SEQ ID NO: 401851 - protein, 11 aa, Influenza virus
NGTCAVVMTDG

SEQ ID NO: 401852 - protein, 11 aa, Influenza virus
GTCAVVMTDGS

SEQ ID NO: 401853 - protein, 11 aa, Influenza virus
TCAVVMTDGSA

SEQ ID NO: 401854 - protein, 11 aa, Influenza virus
CAVVMTDGSAS

SEQ ID NO: 401855 - protein, 11 aa, Influenza virus
TVVMTDGSASE

SEQ ID NO: 401856 - protein, 11 aa, Influenza virus
LSGSAQHIEEC

SEQ ID NO: 401857 - protein, 11 aa, Influenza virus
SGSAQHIEECS

SEQ ID NO: 401858 - protein, 11 aa, Influenza virus
GSAQHIEECSC

SEQ ID NO: 401859 - protein, 11 aa, Influenza virus
SAQHIEECSCY

SEQ ID NO: 401860 - protein, 11 aa, Influenza virus
AQHIEECSCYP

SEQ ID NO: 401861 - protein, 11 aa, Influenza virus
QHIEECSCYPR

SEQ ID NO: 401862 - protein, 11 aa, Influenza virus
HIEECSCYPRY

SEQ ID NO: 401863 - protein, 11 aa, Influenza virus
IEECSCYPRYP

SEQ ID NO: 401864 - protein, 11 aa, Influenza virus
EECSCYPRYPN

SEQ ID NO: 401865 - protein, 11 aa, Influenza virus
VRCICRDNWKG

SEQ ID NO: 401866 - protein, 11 aa, Influenza virus
RCICRDNWKGS

SEQ ID NO: 401867 - protein, 11 aa, Influenza virus
CICRDNWKGSN

SEQ ID NO: 401868 - protein, 11 aa, Influenza virus
ICRDNWKGSNR

SEQ ID NO: 401869 - protein, 11 aa, Influenza virus
CRDNWRGSNRP

SEQ ID NO: 401870 - protein, 11 aa, Influenza virus
RDNWKGSNRPV

SEQ ID NO: 401871 - protein, 11 aa, Influenza virus
DNWKGSNRPVV

SEQ ID NO: 401872 - protein, 11 aa, Influenza virus
NWKGSNRPVVD

SEQ ID NO: 401873 - protein, 11 aa, Influenza virus
WKGSNRPVVDI

SEQ ID NO: 401874 - protein, 11 aa, Influenza virus
SRYVCSGLVGD

SEQ ID NO: 401875 - protein, 11 aa, Influenza virus
RYVCSGLVGDT

SEQ ID NO: 401876 - protein, 11 aa, Influenza virus
YMCSGLVGDTP

SEQ ID NO: 401877 - protein, 11 aa, Influenza virus
MCSGLVGDTPR

SEQ ID NO: 401878 - protein, 11 aa, Influenza virus
CSGLVGDTPRN

SEQ ID NO: 401879 - protein, 11 aa, Influenza virus
WSGYSGIFSVE

SEQ ID NO: 401880 - protein, 11 aa, Influenza virus
SGYSGIFSVES

SEQ ID NO: 401881 - protein, 11 aa, Influenza virus
GYSGIFSVESK

SEQ ID NO: 401882 - protein, 11 aa, Influenza virus
KSCVNRCFYVE

SEQ ID NO: 401883 - protein, 11 aa, Influenza virus
SCVNRCFYVEL

SEQ ID NO: 401884 - protein, 11 aa, Influenza virus
CVNRCFYVELI

SEQ ID NO: 401885 - protein, 11 aa, Influenza virus
VNRCFYVELIR

SEQ ID NO: 401886 - protein, 11 aa, Influenza virus
RCFYVELIRGS

SEQ ID NO: 401887 - protein, 11 aa, Influenza virus
VWWTSNSIVVF

SEQ ID NO: 401888 - protein, 11 aa, Influenza virus
WWTSNSIVVFC

SEQ ID NO: 401889 - protein, 11 aa, Influenza virus
WTSNSIVAFCG

SEQ ID NO: 401890 - protein, 11 aa, Influenza virus
SNSIVAFCGTS

SEQ ID NO: 401891 - protein, 11 aa, Influenza virus
NSIVAFCGTSG

SEQ ID NO: 401892 - protein, 11 aa, Influenza virus
SIVAFCGTSGT

SEQ ID NO: 401893 - protein, 11 aa, Influenza virus
IVAFCGTSGTY

SEQ ID NO: 401894 - protein, 11 aa, Influenza virus
VFCGTSGTYGS

SEQ ID NO: 401895 - protein, 11 aa, Influenza virus
FCGTSGTYGSG

SEQ ID NO: 401896 - protein, 11 aa, Influenza virus
CGTSGTYGSGS

SEQ ID NO: 401897 - protein, 11 aa, Influenza virus
GTSGTYGSGSW

SEQ ID NO: 401898 - protein, 11 aa, Influenza virus
TSGTYGSGSWP

SEQ ID NO: 401899 - protein, 11 aa, Influenza virus
SGTYGSGSWPD

SEQ ID NO: 401900 - protein, 11 aa, Influenza virus
GTYGSGSWPDG

SEQ ID NO: 401901 - protein, 11 aa, Influenza virus
TYGSGSWPDGA

SEQ ID NO: 401902 - protein, 11 aa, Influenza virus
YGTGSWPDGAN

SEQ ID NO: 401903 - protein, 11 aa, Influenza virus
DGADINLMPIY

SEQ ID NO: 401904 - protein, 11 aa, Influenza virus
GADINLMPIYS

SEQ ID NO: 401905 - protein, 11 aa, Influenza virus
ADIKSHAYISF

SEQ ID NO: 401906 - protein, 11 aa, Influenza virus
YTGNPVICMGH

SEQ ID NO: 401907 - protein, 11 aa, Influenza virus
TGNPVICMGHH

SEQ ID NO: 401908 - protein, 11 aa, Influenza virus
GNPVICMGHHA

SEQ ID NO: 401909 - protein, 11 aa, Influenza virus
NPVICMGHHAV

SEQ ID NO: 401910 - protein, 11 aa, Influenza virus
VEVVTAQELVE

SEQ ID NO: 401911 - protein, 11 aa, Influenza virus
EVVAAQELVES

SEQ ID NO: 401912 - protein, 11 aa, Influenza virus
CDIINGALGSP

SEQ ID NO: 401913 - protein, 11 aa, Influenza virus
DIINGALGSPG

SEQ ID NO: 401914 - protein, 11 aa, Influenza virus
IINGALGSPGC

SEQ ID NO: 401915 - protein, 11 aa, Influenza virus
INGALGSPGCD

SEQ ID NO: 401916 - protein, 11 aa, Influenza virus
NGALGSPGCDR

SEQ ID NO: 401917 - protein, 11 aa, Influenza virus
GALGSPGCDRL

SEQ ID NO: 401918 - protein, 11 aa, Influenza virus
CYPFDVPEYQS

SEQ ID NO: 401919 - protein, 11 aa, Influenza virus
VPEYQSLRSIL

SEQ ID NO: 401920 - protein, 11 aa, Influenza virus
PEYQSLRSILA

SEQ ID NO: 401921 - protein, 11 aa, Influenza virus
EYQSLRSILAN

SEQ ID NO: 401922 - protein, 11 aa, Influenza virus
YQSIRSILANN

SEQ ID NO: 401923 - protein, 11 aa, Influenza virus
SLRSILANNGR

SEQ ID NO: 401924 - protein, 11 aa, Influenza virus
LRSILANNGRF

SEQ ID NO: 401925 - protein, 11 aa, Influenza virus
RSILANNGRFE

SEQ ID NO: 401926 - protein, 11 aa, Influenza virus
SILANNGRFEF

SEQ ID NO: 401927 - protein, 11 aa, Influenza virus
ILANNGRFEFI

SEQ ID NO: 401928 - protein, 11 aa, Influenza virus
LANNGRFEFIA

SEQ ID NO: 401929 - protein, 11 aa, Influenza virus
ANNGRFEFIAE

SEQ ID NO: 401930 - protein, 11 aa, Influenza virus
NNGRFEFIAEE

SEQ ID NO: 401931 - protein, 11 aa, Influenza virus
NGRFEFIAEEF

SEQ ID NO: 401932 - protein, 11 aa, Influenza virus
TVKQNGKSSAC

SEQ ID NO: 401933 - protein, 11 aa, Influenza virus
VKQNGKSSACK

SEQ ID NO: 401934 - protein, 11 aa, Influenza virus
KQNGKSSACKR

SEQ ID NO: 401935 - protein, 11 aa, Influenza virus
QNGKSSACKRA

SEQ ID NO: 401936 - protein, 11 aa, Influenza virus
NGKSSACKRAN

SEQ ID NO: 401937 - protein, 11 aa, Influenza virus
QNLTKINNGDY

SEQ ID NO: 401938 - protein, 11 aa, Influenza virus
NNGDYTRLYIW

SEQ ID NO: 401939 - protein, 11 aa, Influenza virus
NGDYTRLYIWG

SEQ ID NO: 401940 - protein, 11 aa, Influenza virus
GDYTRLYIWGV

SEQ ID NO: 401941 - protein, 11 aa, Influenza virus
DYTRLYIWGVH

SEQ ID NO: 401942 - protein, 11 aa, Influenza virus
YTRLYIWGVHH

SEQ ID NO: 401943 - protein, 11 aa, Influenza virus
TRLYIWGVHHP

SEQ ID NO: 401944 - protein, 11 aa, Influenza virus
IWGVHHPSTDK

SEQ ID NO: 401945 - protein, 11 aa, Influenza virus
WGVHHPSTDKE

SEQ ID NO: 401946 - protein, 11 aa, Influenza virus
GVHHPSTDKEQ

SEQ ID NO: 401947 - protein, 11 aa, Influenza virus
VRGQSGRVSFY

SEQ ID NO: 401948 - protein, 11 aa, Influenza virus
RGQSGRVSFYW

SEQ ID NO: 401949 - protein, 11 aa, Influenza virus
GQSGRVSFYWT

SEQ ID NO: 401950 - protein, 11 aa, Influenza virus
QSGRVSFYWTI

SEQ ID NO: 401951 - protein, 11 aa, Influenza virus
SGRVSFYWTIV

SEQ ID NO: 401952 - protein, 11 aa, Influenza virus
GRVSFYWTIVE

SEQ ID NO: 401953 - protein, 11 aa, Influenza virus
RVSFYWTIVEP

SEQ ID NO: 401954 - protein, 11 aa, Influenza virus
VSFYWTIVEPG

SEQ ID NO: 401955 - protein, 11 aa, Influenza virus
SFYWTIVDPGD

SEQ ID NO: 401956 - protein, 11 aa, Influenza virus
PGDIIVFNTIG

SEQ ID NO: 401957 - protein, 11 aa, Influenza virus
GDIIVFNTIGN

SEQ ID NO: 401958 - protein, 11 aa, Influenza virus
DIIVFNTIGNL

SEQ ID NO: 401959 - protein, 11 aa, Influenza virus
IIVFNTIGNLI

SEQ ID NO: 401960 - protein, 11 aa, Influenza virus
IVFNTIGNLVA

SEQ ID NO: 401961 - protein, 11 aa, Influenza virus
VFNTIGNLVAP

SEQ ID NO: 401962 - protein, 11 aa, Influenza virus
FNTIGNLVAPR

SEQ ID NO: 401963 - protein, 11 aa, Influenza virus
NTIGNLVAPRG

SEQ ID NO: 401964 - protein, 11 aa, Influenza virus
TIGNLVAPRGH

SEQ ID NO: 401965 - protein, 11 aa, Influenza virus
IGNLVAPRGHY

SEQ ID NO: 401966 - protein, 11 aa, Influenza virus
GNLVAPRGHYK

SEQ ID NO: 401967 - protein, 11 aa, Influenza virus
NLVAPRGHYKL

SEQ ID NO: 401968 - protein, 11 aa, Influenza virus
GDCPKYIKQGS

SEQ ID NO: 401969 - protein, 11 aa, Influenza virus
ECPKYVKQGSL

SEQ ID NO: 401970 - protein, 11 aa, Influenza virus
CPKYIKQGSLK

SEQ ID NO: 401971 - protein, 11 aa, Influenza virus
PKYIKQGSLKL

SEQ ID NO: 401972 - protein, 11 aa, Influenza virus
KYIKQGSLKLA

SEQ ID NO: 401973 - protein, 11 aa, Influenza virus
YIKQGSLKLAT

SEQ ID NO: 401974 - protein, 11 aa, Influenza virus
IKQGSLKLATG

SEQ ID NO: 401975 - protein, 11 aa, Influenza virus
KQGSLRLATGM

SEQ ID NO: 401976 - protein, 11 aa, Influenza virus
QGSLRLATGMR

SEQ ID NO: 401977 - protein, 11 aa, Influenza virus
GSLRLATGMRN

SEQ ID NO: 401978 - protein, 11 aa, Influenza virus
SLRLATGMRNI

SEQ ID NO: 401979 - protein, 11 aa, Influenza virus
LRLATGMRNIP

SEQ ID NO: 401980 - protein, 11 aa, Influenza virus
RLATGMRNIPE

SEQ ID NO: 401981 - protein, 11 aa, Influenza virus
LATGMRNIPER

SEQ ID NO: 401982 - protein, 11 aa, Influenza virus
KGLFGAIAGFI

SEQ ID NO: 401983 - protein, 11 aa, Influenza virus
DGWYGFRHQNS

SEQ ID NO: 401984 - protein, 11 aa, Influenza virus
GWYGFRHQNSE

SEQ ID NO: 401985 - protein, 11 aa, Influenza virus
WYGFRHQNSEG

SEQ ID NO: 401986 - protein, 11 aa, Influenza virus
YGFRHQNSEGT

SEQ ID NO: 401987 - protein, 11 aa, Influenza virus
GFRHQNSEGTG

SEQ ID NO: 401988 - protein, 11 aa, Influenza virus
FRHQNSEGTGT

SEQ ID NO: 401989 - protein, 11 aa, Influenza virus
RHQNSEGTGTA

SEQ ID NO: 401990 - protein, 11 aa, Influenza virus
HQNSEGTGTAA

SEQ ID NO: 401991 - protein, 11 aa, Influenza virus
QNSEGTGTAAD

SEQ ID NO: 401992 - protein, 11 aa, Influenza virus
NSEGTGTAADL

SEQ ID NO: 401993 - protein, 11 aa, Influenza virus
SEGTGTAADLK

SEQ ID NO: 401994 - protein, 11 aa, Influenza virus
GTAADLKSTQT

SEQ ID NO: 401995 - protein, 11 aa, Influenza virus
TAADLKSTQTA

SEQ ID NO: 401996 - protein, 11 aa, Influenza virus
AADLKSTQTAI

SEQ ID NO: 401997 - protein, 11 aa, Influenza virus
ADLKSTQTAID

SEQ ID NO: 401998 - protein, 11 aa, Influenza virus
DLKSTQTAIDQ

SEQ ID NO: 401999 - protein, 11 aa, Influenza virus
LKSTQTAIDQI

SEQ ID NO: 402000 - protein, 11 aa, Influenza virus
TQTAIDQINGK

SEQ ID NO: 402001 - protein, 11 aa, Influenza virus
QTAIDQINGKL

SEQ ID NO: 402002 - protein, 11 aa, Influenza virus
TAIDQINGKLN

SEQ ID NO: 402003 - protein, 11 aa, Influenza virus
AIDQITGKLNR

SEQ ID NO: 402004 - protein, 11 aa, Influenza virus
IDQITGKLNRL

SEQ ID NO: 402005 - protein, 11 aa, Influenza virus
DQITGKLNRLI

SEQ ID NO: 402006 - protein, 11 aa, Influenza virus
QITGKLNRLIE

SEQ ID NO: 402007 - protein, 11 aa, Influenza virus
INGKLNRLIER

SEQ ID NO: 402008 - protein, 11 aa, Influenza virus
NGKLNRLIERT

SEQ ID NO: 402009 - protein, 11 aa, Influenza virus
GKLNRLIERTN

SEQ ID NO: 402010 - protein, 11 aa, Influenza virus
KLNRLIEKTND

SEQ ID NO: 402011 - protein, 11 aa, Influenza virus
LNRLIERTNEK

SEQ ID NO: 402012 - protein, 11 aa, Influenza virus
NRLIEKTNDKY

SEQ ID NO: 402013 - protein, 11 aa, Influenza virus
RLIERTNEKYH

SEQ ID NO: 402014 - protein, 11 aa, Influenza virus
LIERTNEKYHQ

SEQ ID NO: 402015 - protein, 11 aa, Influenza virus
IEKTNDKYHQI

SEQ ID NO: 402016 - protein, 11 aa, Influenza virus
ERTNEKYHQIE

SEQ ID NO: 402017 - protein, 11 aa, Influenza virus
KTNDKYHQIEK

SEQ ID NO: 402018 - protein, 11 aa, Influenza virus
TNDKYHQIEKE

SEQ ID NO: 402019 - protein, 11 aa, Influenza virus
NDKYHQIEKEF

SEQ ID NO: 402020 - protein, 11 aa, Influenza virus
DKYHQIEKEFE

SEQ ID NO: 402021 - protein, 11 aa, Influenza virus
KYHQIEKEFGQ

SEQ ID NO: 402022 - protein, 11 aa, Influenza virus
YHQIEKEFGQV

SEQ ID NO: 402023 - protein, 11 aa, Influenza virus
HQIEKEFGQVE

SEQ ID NO: 402024 - protein, 11 aa, Influenza virus
QIEKEFGQVEG

SEQ ID NO: 402025 - protein, 11 aa, Influenza virus
IEKEFGQVEGR

SEQ ID NO: 402026 - protein, 11 aa, Influenza virus
EKEFGQVEGRI

SEQ ID NO: 402027 - protein, 11 aa, Influenza virus
KEFGQVEGRIQ

SEQ ID NO: 402028 - protein, 11 aa, Influenza virus
EFGQVEGRIQD

SEQ ID NO: 402029 - protein, 11 aa, Influenza virus
FGQVEGRIQDL

SEQ ID NO: 402030 - protein, 11 aa, Influenza virus
QDLERYVEDTK

SEQ ID NO: 402031 - protein, 11 aa, Influenza virus
DLEKYVEDTKV

SEQ ID NO: 402032 - protein, 11 aa, Influenza virus
LEKYVEDTKVD

SEQ ID NO: 402033 - protein, 11 aa, Influenza virus
EKYVEDTKVDL

SEQ ID NO: 402034 - protein, 11 aa, Influenza virus
KYVEDTKVDLW

SEQ ID NO: 402035 - protein, 11 aa, Influenza virus
YVEDTKVDLWS

SEQ ID NO: 402036 - protein, 11 aa, Influenza virus
VEDTKVDLWSY

SEQ ID NO: 402037 - protein, 11 aa, Influenza virus
EDTKVDLWSYN

SEQ ID NO: 402038 - protein, 11 aa, Influenza virus
DTKVDLWSYNA

SEQ ID NO: 402039 - protein, 11 aa, Influenza virus
TKVDLWSYNAE

SEQ ID NO: 402040 - protein, 11 aa, Influenza virus
KVDLWSYNAEL

SEQ ID NO: 402041 - protein, 11 aa, Influenza virus
VDLWSYNAELL

SEQ ID NO: 402042 - protein, 11 aa, Influenza virus
VALENQHTIDM

SEQ ID NO: 402043 - protein, 11 aa, Influenza virus
ALENQHTIDMT

SEQ ID NO: 402044 - protein, 11 aa, Influenza virus
LENQHTIDMTD

SEQ ID NO: 402045 - protein, 11 aa, Influenza virus
ENQHTIDMTDS

SEQ ID NO: 402046 - protein, 11 aa, Influenza virus
NQHTIDMTDSE

SEQ ID NO: 402047 - protein, 11 aa, Influenza virus
QHTIDMTDSEM

SEQ ID NO: 402048 - protein, 11 aa, Influenza virus
HTIDMTDSEMN

SEQ ID NO: 402049 - protein, 11 aa, Influenza virus
TDSEMDKLFER

SEQ ID NO: 402050 - protein, 11 aa, Influenza virus
DSEMDKLFERV

SEQ ID NO: 402051 - protein, 11 aa, Influenza virus
KLFERVRHQLR

SEQ ID NO: 402052 - protein, 11 aa, Influenza virus
LFERVRHQLRE

SEQ ID NO: 402053 - protein, 11 aa, Influenza virus
FERVRHQLREN

SEQ ID NO: 402054 - protein, 11 aa, Influenza virus
ERVRHQLRENA

SEQ ID NO: 402055 - protein, 11 aa, Influenza virus
RVRHQLRENAE

SEQ ID NO: 402056 - protein, 11 aa, Influenza virus
VRHQLRENAED

SEQ ID NO: 402057 - protein, 11 aa, Influenza virus
RRQLRENAEDR

SEQ ID NO: 402058 - protein, 11 aa, Influenza virus
RQLRENAEDRG

SEQ ID NO: 402059 - protein, 11 aa, Influenza virus
QLRENAEDRGN

SEQ ID NO: 402060 - protein, 11 aa, Influenza virus
LRENAEDRGNG

SEQ ID NO: 402061 - protein, 11 aa, Influenza virus
RENAEDRGNGC

SEQ ID NO: 402062 - protein, 11 aa, Influenza virus
ENAEDRGNGCF

SEQ ID NO: 402063 - protein, 11 aa, Influenza virus
NAEDRGNGCFE

SEQ ID NO: 402064 - protein, 11 aa, Influenza virus
AEDRGNGCFEI

SEQ ID NO: 402065 - protein, 11 aa, Influenza virus
EDRGNGCFEIF

SEQ ID NO: 402066 - protein, 11 aa, Influenza virus
DRGNGCFEIFH

SEQ ID NO: 402067 - protein, 11 aa, Influenza virus
KGNGCFEIFHK

SEQ ID NO: 402068 - protein, 11 aa, Influenza virus
GNGCFEIFHKC

SEQ ID NO: 402069 - protein, 11 aa, Influenza virus
NGCFEIFHKCD

SEQ ID NO: 402070 - protein, 11 aa, Influenza virus
GCFEIFHKCDN

SEQ ID NO: 402071 - protein, 11 aa, Influenza virus
CDNSCIESIRN

SEQ ID NO: 402072 - protein, 11 aa, Influenza virus
NSCIESIRNGT

SEQ ID NO: 402073 - protein, 11 aa, Influenza virus
SCIESIRNGTY

SEQ ID NO: 402074 - protein, 11 aa, Influenza virus
CIESIRNGTYN

SEQ ID NO: 402075 - protein, 11 aa, Influenza virus
IESIRNGTYNH

SEQ ID NO: 402076 - protein, 11 aa, Influenza virus
ESIRNGTYNHD

SEQ ID NO: 402077 - protein, 11 aa, Influenza virus
YRDEAISNRFQ

SEQ ID NO: 402078 - protein, 11 aa, Influenza virus
RDEAISNRFQI

SEQ ID NO: 402079 - protein, 11 aa, Influenza virus
EAISNRFQIQG

SEQ ID NO: 402080 - protein, 11 aa, Influenza virus
AISNRFQIQGV

SEQ ID NO: 402081 - protein, 11 aa, Influenza virus
RFQIQGVRLTQ

SEQ ID NO: 402082 - protein, 11 aa, Influenza virus
FQIQGVRLTQG

SEQ ID NO: 402083 - protein, 11 aa, Influenza virus
QIQGVRLTQGY

SEQ ID NO: 402084 - protein, 11 aa, Influenza virus
IQGVRLTQGYK

SEQ ID NO: 402085 - protein, 11 aa, Influenza virus
QGVRLTQGYKD

SEQ ID NO: 402086 - protein, 11 aa, Influenza virus
RLTQGYKDIIL

SEQ ID NO: 402087 - protein, 11 aa, Influenza virus
LAQGYKDIILW

SEQ ID NO: 402088 - protein, 11 aa, Influenza virus
QGYKDIILWVS

SEQ ID NO: 402089 - protein, 11 aa, Influenza virus
GYKDIILWVSF

SEQ ID NO: 402090 - protein, 11 aa, Influenza virus
YKDIILWVSFS

SEQ ID NO: 402091 - protein, 11 aa, Influenza virus
KDIILWVSFSI

SEQ ID NO: 402092 - protein, 11 aa, Influenza virus
DIILWVSFSIS

SEQ ID NO: 402093 - protein, 11 aa, Influenza virus
IILWVSFSISC

SEQ ID NO: 402094 - protein, 11 aa, Influenza virus
ILWVSFSISCF

SEQ ID NO: 402095 - protein, 11 aa, Influenza virus
LWVSFSISCFL

SEQ ID NO: 402096 - protein, 11 aa, Influenza virus
WVSFSISCFLL

SEQ ID NO: 402097 - protein, 11 aa, Influenza virus
ISFSISCFLLA

SEQ ID NO: 402098 - protein, 11 aa, Influenza virus
SFSISCFLLAA

SEQ ID NO: 402099 - protein, 11 aa, Influenza virus
FSISCFLLAAL

SEQ ID NO: 402100 - protein, 11 aa, Influenza virus
SISCFLLAALL

SEQ ID NO: 402101 - protein, 11 aa, Influenza virus
ISCFLLAALLL

SEQ ID NO: 402102 - protein, 11 aa, Influenza virus
ALLIAFVLWAC

SEQ ID NO: 402103 - protein, 11 aa, Influenza virus
LLIAFVLWACQ

SEQ ID NO: 402104 - protein, 11 aa, Influenza virus
LWACQNGNLRC

SEQ ID NO: 402105 - protein, 11 aa, Influenza virus
WACQNGNLRCQ

SEQ ID NO: 402106 - protein, 11 aa, Influenza virus
ACQNGNLRCQI

SEQ ID NO: 402107 - protein, 11 aa, Influenza virus
CQNGNLRCQIC

SEQ ID NO: 402108 - protein, 11 aa, Influenza virus
QNGNLRCQICI

SEQ ID NO: 402109 - protein, 11 aa, Influenza virus
SVKMEKIVLLL

SEQ ID NO: 402110 - protein, 11 aa, Influenza virus
CQMEKIVLLFA

SEQ ID NO: 402111 - protein, 11 aa, Influenza virus
QMEKIVLLFAI

SEQ ID NO: 402112 - protein, 11 aa, Influenza virus
GDQICIGYHAN

SEQ ID NO: 402113 - protein, 11 aa, Influenza virus
DHICIGYHANN

SEQ ID NO: 402114 - protein, 11 aa, Influenza virus
HICIGYHANNS

SEQ ID NO: 402115 - protein, 11 aa, Influenza virus
ICVGYHANNST

SEQ ID NO: 402116 - protein, 11 aa, Influenza virus
CIGYHANNSTK

SEQ ID NO: 402117 - protein, 11 aa, Influenza virus
VDTIMERNVTV

SEQ ID NO: 402118 - protein, 11 aa, Influenza virus
DTIMERNVTVT

SEQ ID NO: 402119 - protein, 11 aa, Influenza virus
TIMERNVTVTH

SEQ ID NO: 402120 - protein, 11 aa, Influenza virus
IMERNVTVTHA

SEQ ID NO: 402121 - protein, 11 aa, Influenza virus
EKNVTVTHAQN

SEQ ID NO: 402122 - protein, 11 aa, Influenza virus
DCSIAGWLLGN

SEQ ID NO: 402123 - protein, 11 aa, Influenza virus
CSIAGWLLGNP

SEQ ID NO: 402124 - protein, 11 aa, Influenza virus
SVAGWLLGNPL

SEQ ID NO: 402125 - protein, 11 aa, Influenza virus
VAGWLLGNPLC

SEQ ID NO: 402126 - protein, 11 aa, Influenza virus
AGWLLGNPLCD

SEQ ID NO: 402127 - protein, 11 aa, Influenza virus
GWLLGNPLCDE

SEQ ID NO: 402128 - protein, 11 aa, Influenza virus
WLLGNPLCDEF

SEQ ID NO: 402129 - protein, 11 aa, Influenza virus
TGRSSFFRNVV

SEQ ID NO: 402130 - protein, 11 aa, Influenza virus
FESTGNFIAPE

SEQ ID NO: 402131 - protein, 11 aa, Influenza virus
ESNGNFIAPEN

SEQ ID NO: 402132 - protein, 11 aa, Influenza virus
SNGNFIAPENA

SEQ ID NO: 402133 - protein, 11 aa, Influenza virus
NGNFIAPENAY

SEQ ID NO: 402134 - protein, 11 aa, Influenza virus
GNFIAPENAYK

SEQ ID NO: 402135 - protein, 11 aa, Influenza virus
NFIAPENAYKI

SEQ ID NO: 402136 - protein, 11 aa, Influenza virus
PFHNVHPLTIG

SEQ ID NO: 402137 - protein, 11 aa, Influenza virus
HPFTIGECPKY

SEQ ID NO: 402138 - protein, 11 aa, Influenza virus
TIGECPRYVKS

SEQ ID NO: 402139 - protein, 11 aa, Influenza virus
KRRKKRGLFGA

SEQ ID NO: 402140 - protein, 11 aa, Influenza virus
RRQKRGLFGAI

SEQ ID NO: 402141 - protein, 11 aa, Influenza virus
RKKRGLFGAIA

SEQ ID NO: 402142 - protein, 11 aa, Influenza virus
QKRGLFGAIAG

SEQ ID NO: 402143 - protein, 11 aa, Influenza virus
TRGLFGAIAGF

SEQ ID NO: 402144 - protein, 11 aa, Influenza virus
GFIEGGWQGMI

SEQ ID NO: 402145 - protein, 11 aa, Influenza virus
FIEGGWQGMID

SEQ ID NO: 402146 - protein, 11 aa, Influenza virus
IEGGWQGMIDG

SEQ ID NO: 402147 - protein, 11 aa, Influenza virus
EGGWQGMIDGW

SEQ ID NO: 402148 - protein, 11 aa, Influenza virus
GGWQGMIDGWY

SEQ ID NO: 402149 - protein, 11 aa, Influenza virus
GWQGMIDGWYG

SEQ ID NO: 402150 - protein, 11 aa, Influenza virus
WQGMVDGWYGF

SEQ ID NO: 402151 - protein, 11 aa, Influenza virus
QGMVDGWYGFH

SEQ ID NO: 402152 - protein, 11 aa, Influenza virus
GMVDGWYGFHH

SEQ ID NO: 402153 - protein, 11 aa, Influenza virus
QGSGYAADQES

SEQ ID NO: 402154 - protein, 11 aa, Influenza virus
GSGYAADQEST

SEQ ID NO: 402155 - protein, 11 aa, Influenza virus
GYAADKESTQR

SEQ ID NO: 402156 - protein, 11 aa, Influenza virus
YAADKESTQRA

SEQ ID NO: 402157 - protein, 11 aa, Influenza virus
NVWTYNAELLV

SEQ ID NO: 402158 - protein, 11 aa, Influenza virus
VWTYNAEILVL

SEQ ID NO: 402159 - protein, 11 aa, Influenza virus
TYNAEILVLME

SEQ ID NO: 402160 - protein, 11 aa, Influenza virus
YNAEILVLMEN

SEQ ID NO: 402161 - protein, 11 aa, Influenza virus
NAEILVLMENE

SEQ ID NO: 402162 - protein, 11 aa, Influenza virus
AEILVLMENER

SEQ ID NO: 402163 - protein, 11 aa, Influenza virus
VLMENERTLDL

SEQ ID NO: 402164 - protein, 11 aa, Influenza virus
LMENERTLDLH

SEQ ID NO: 402165 - protein, 11 aa, Influenza virus
MENERTLDLHD

SEQ ID NO: 402166 - protein, 11 aa, Influenza virus
ENERTLDLHDS

SEQ ID NO: 402167 - protein, 11 aa, Influenza virus
NERTLDLHDSN

SEQ ID NO: 402168 - protein, 11 aa, Influenza virus
ERTLDLHDSNV

SEQ ID NO: 402169 - protein, 11 aa, Influenza virus
RTLDLHDSNVK

SEQ ID NO: 402170 - protein, 11 aa, Influenza virus
TLDLHDSNVKN

SEQ ID NO: 402171 - protein, 11 aa, Influenza virus
LDLHDSNVKNL

SEQ ID NO: 402172 - protein, 11 aa, Influenza virus
DLHDSNVKNLY

SEQ ID NO: 402173 - protein, 11 aa, Influenza virus
FHDSNVKNLYE

SEQ ID NO: 402174 - protein, 11 aa, Influenza virus
HDSNVKNLYEK

SEQ ID NO: 402175 - protein, 11 aa, Influenza virus
VRLQLKDNAKE

SEQ ID NO: 402176 - protein, 11 aa, Influenza virus
RLQLKDNAKEL

SEQ ID NO: 402177 - protein, 11 aa, Influenza virus
LQLKDNAKELG

SEQ ID NO: 402178 - protein, 11 aa, Influenza virus
QLKDNAKELGN

SEQ ID NO: 402179 - protein, 11 aa, Influenza virus
LKDNAKELGNG

SEQ ID NO: 402180 - protein, 11 aa, Influenza virus
KDNAKELGNGC

SEQ ID NO: 402181 - protein, 11 aa, Influenza virus
DNARELGNGCF

SEQ ID NO: 402182 - protein, 11 aa, Influenza virus
NARELGNGCFE

SEQ ID NO: 402183 - protein, 11 aa, Influenza virus
ARELGNGCFEF

SEQ ID NO: 402184 - protein, 11 aa, Influenza virus
RELGNGCFEFY

SEQ ID NO: 402185 - protein, 11 aa, Influenza virus
LGNGCFEFYHR

SEQ ID NO: 402186 - protein, 11 aa, Influenza virus
GNGCFEFYHRC

SEQ ID NO: 402187 - protein, 11 aa, Influenza virus
NGCFEFYHRCD

SEQ ID NO: 402188 - protein, 11 aa, Influenza virus
GCFEFYHRCDN

SEQ ID NO: 402189 - protein, 11 aa, Influenza virus
LSIYSTAASSL

SEQ ID NO: 402190 - protein, 11 aa, Influenza virus
FWMCSNGSLQC

SEQ ID NO: 402191 - protein, 11 aa, Influenza virus
WMCSNGSLQCK

SEQ ID NO: 402192 - protein, 11 aa, Influenza virus
MCSNGSLQCRV

SEQ ID NO: 402193 - protein, 11 aa, Influenza virus
SNGSLQCRVCI

SEQ ID NO: 402194 - protein, 11 aa, Influenza virus
VCIKFVSSDCS

SEQ ID NO: 402195 - protein, 11 aa, Influenza virus
SVKMEKIVLLL

SEQ ID NO: 402196 - protein, 11 aa, Influenza virus
CQMEKIVLLFA

SEQ ID NO: 402197 - protein, 11 aa, Influenza virus
QMEKIVLLFAI

SEQ ID NO: 402198 - protein, 11 aa, Influenza virus
SDHICIGYHAN

SEQ ID NO: 402199 - protein, 11 aa, Influenza virus
DHICIGYHANN

SEQ ID NO: 402200 - protein, 11 aa, Influenza virus
HICIGYHANNS

SEQ ID NO: 402201 - protein, 11 aa, Influenza virus
ICVGYHANNST

SEQ ID NO: 402202 - protein, 11 aa, Influenza virus
CIGYHANNSTK

SEQ ID NO: 402203 - protein, 11 aa, Influenza virus
ANNSTKQVDTI

SEQ ID NO: 402204 - protein, 11 aa, Influenza virus
NNSTKQVDTIM

SEQ ID NO: 402205 - protein, 11 aa, Influenza virus
QVDTIMERNVT

SEQ ID NO: 402206 - protein, 11 aa, Influenza virus
VDTIMERNVTV

SEQ ID NO: 402207 - protein, 11 aa, Influenza virus
DTIMERNVTVT

SEQ ID NO: 402208 - protein, 11 aa, Influenza virus
TIMERNVTVTH

SEQ ID NO: 402209 - protein, 11 aa, Influenza virus
IMERNVTVTHA

SEQ ID NO: 402210 - protein, 11 aa, Influenza virus
MERNVTVTHAQ

SEQ ID NO: 402211 - protein, 11 aa, Influenza virus
ERNVTVTHAQD

SEQ ID NO: 402212 - protein, 11 aa, Influenza virus
RNVTVTHAQDI

SEQ ID NO: 402213 - protein, 11 aa, Influenza virus
NVTVTHAQNIL

SEQ ID NO: 402214 - protein, 11 aa, Influenza virus
VTVTHAQNILE

SEQ ID NO: 402215 - protein, 11 aa, Influenza virus
TVTHAQDILER

SEQ ID NO: 402216 - protein, 11 aa, Influenza virus
KPLILKDCSVA

SEQ ID NO: 402217 - protein, 11 aa, Influenza virus
PLILKDCSVAG

SEQ ID NO: 402218 - protein, 11 aa, Influenza virus
LILKDCSVAGW

SEQ ID NO: 402219 - protein, 11 aa, Influenza virus
ILKDCSVAGWL

SEQ ID NO: 402220 - protein, 11 aa, Influenza virus
LKDCSVAGWLL

SEQ ID NO: 402221 - protein, 11 aa, Influenza virus
KDCSVAGWLLG

SEQ ID NO: 402222 - protein, 11 aa, Influenza virus
SVAGWLLGNPL

SEQ ID NO: 402223 - protein, 11 aa, Influenza virus
VAGWLLGNPLC

SEQ ID NO: 402224 - protein, 11 aa, Influenza virus
AGWLLGNPLCD

SEQ ID NO: 402225 - protein, 11 aa, Influenza virus
GWLLGNPLCDE

SEQ ID NO: 402226 - protein, 11 aa, Influenza virus
WLLGNPLCDEF

SEQ ID NO: 402227 - protein, 11 aa, Influenza virus
NVSEWSYIVEK

SEQ ID NO: 402228 - protein, 11 aa, Influenza virus
YEELKHLMSST

SEQ ID NO: 402229 - protein, 11 aa, Influenza virus
TYISIGTSTLN

SEQ ID NO: 402230 - protein, 11 aa, Influenza virus
ISIGTSTLNQR

SEQ ID NO: 402231 - protein, 11 aa, Influenza virus
SIGTSTLNQRL

SEQ ID NO: 402232 - protein, 11 aa, Influenza virus
HFESNGNFIAP

SEQ ID NO: 402233 - protein, 11 aa, Influenza virus
FDSNGNFIAPE

SEQ ID NO: 402234 - protein, 11 aa, Influenza virus
ESNGNFIAPEN

SEQ ID NO: 402235 - protein, 11 aa, Influenza virus
SNGNFIAPENA

SEQ ID NO: 402236 - protein, 11 aa, Influenza virus
NGNFIAPENAY

SEQ ID NO: 402237 - protein, 11 aa, Influenza virus
GNFIAPENAYK

SEQ ID NO: 402238 - protein, 11 aa, Influenza virus
NFIAPENAYKI

SEQ ID NO: 402239 - protein, 11 aa, Influenza virus
GAVNSSMPFHN

SEQ ID NO: 402240 - protein, 11 aa, Influenza virus
AINSSMPFHNV

SEQ ID NO: 402241 - protein, 11 aa, Influenza virus
INSSMPFHNVH

SEQ ID NO: 402242 - protein, 11 aa, Influenza virus
NSSMPFHNVHP

SEQ ID NO: 402243 - protein, 11 aa, Influenza virus
SSMPFHNVHPL

SEQ ID NO: 402244 - protein, 11 aa, Influenza virus
SMPFHNVHPLT

SEQ ID NO: 402245 - protein, 11 aa, Influenza virus
MPFHNVHPLTI

SEQ ID NO: 402246 - protein, 11 aa, Influenza virus
PFHNVHPLTIG

SEQ ID NO: 402247 - protein, 11 aa, Influenza virus
FHNVHPLTIGE

SEQ ID NO: 402248 - protein, 11 aa, Influenza virus
HNVHPLTIGEC

SEQ ID NO: 402249 - protein, 11 aa, Influenza virus
NVHPLTIGECP

SEQ ID NO: 402250 - protein, 11 aa, Influenza virus
VHPLTIGECPK

SEQ ID NO: 402251 - protein, 11 aa, Influenza virus
HPLTIGKCPKY

SEQ ID NO: 402252 - protein, 11 aa, Influenza virus
PLTIGKCPKYV

SEQ ID NO: 402253 - protein, 11 aa, Influenza virus
LTIGKCPKYVK

SEQ ID NO: 402254 - protein, 11 aa, Influenza virus
IGECPKYVKSD

SEQ ID NO: 402255 - protein, 11 aa, Influenza virus
RKRGLFGAIAG

SEQ ID NO: 402256 - protein, 11 aa, Influenza virus
KRGLFGAIAGF

SEQ ID NO: 402257 - protein, 11 aa, Influenza virus
TRGLFGAIAGF

SEQ ID NO: 402258 - protein, 11 aa, Influenza virus
GFIEGGWQGMI

SEQ ID NO: 402259 - protein, 11 aa, Influenza virus
FIEGGWQGMID

SEQ ID NO: 402260 - protein, 11 aa, Influenza virus
IEGGWQGMIDG

SEQ ID NO: 402261 - protein, 11 aa, Influenza virus
EGGWQGMIDGW

SEQ ID NO: 402262 - protein, 11 aa, Influenza virus
GGWQGMIDGWY

SEQ ID NO: 402263 - protein, 11 aa, Influenza virus
GWQGMIDGWYG

SEQ ID NO: 402264 - protein, 11 aa, Influenza virus
WQGMVDGWYGF

SEQ ID NO: 402265 - protein, 11 aa, Influenza virus
QGMVDGWYGFH

SEQ ID NO: 402266 - protein, 11 aa, Influenza virus
GMVDGWYGFHH

SEQ ID NO: 402267 - protein, 11 aa, Influenza virus
MVDGWYGFHHS

SEQ ID NO: 402268 - protein, 11 aa, Influenza virus
VDGWYGFHHSN

SEQ ID NO: 402269 - protein, 11 aa, Influenza virus
HSNGQGSGYAA

SEQ ID NO: 402270 - protein, 11 aa, Influenza virus
SNGQGSGYAAD

SEQ ID NO: 402271 - protein, 11 aa, Influenza virus
NGQGSGYAADK

SEQ ID NO: 402272 - protein, 11 aa, Influenza virus
QGSGYAADQES

SEQ ID NO: 402273 - protein, 11 aa, Influenza virus
GSGYAADQEST

SEQ ID NO: 402274 - protein, 11 aa, Influenza virus
SGYAADQESTQ

SEQ ID NO: 402275 - protein, 11 aa, Influenza virus
GYAADKESTQR

SEQ ID NO: 402276 - protein, 11 aa, Influenza virus
YAADKESTQRA

SEQ ID NO: 402277 - protein, 11 aa, Influenza virus
STQKAIDGITN

SEQ ID NO: 402278 - protein, 11 aa, Influenza virus
TQKAIDGITNK

SEQ ID NO: 402279 - protein, 11 aa, Influenza virus
AIDGITNKVNS

SEQ ID NO: 402280 - protein, 11 aa, Influenza virus
IDGITNKVNSI

SEQ ID NO: 402281 - protein, 11 aa, Influenza virus
DGITNKVNSII

SEQ ID NO: 402282 - protein, 11 aa, Influenza virus
GVTNKVNSIIN

SEQ ID NO: 402283 - protein, 11 aa, Influenza virus
VTNKVNSIINK

SEQ ID NO: 402284 - protein, 11 aa, Influenza virus
TNKVNSIINKM

SEQ ID NO: 402285 - protein, 11 aa, Influenza virus
NKVNSIINKMN

SEQ ID NO: 402286 - protein, 11 aa, Influenza virus
KVNSIINKMNT

SEQ ID NO: 402287 - protein, 11 aa, Influenza virus
VNSIINKMNTQ

SEQ ID NO: 402288 - protein, 11 aa, Influenza virus
NSIINKMNTQF

SEQ ID NO: 402289 - protein, 11 aa, Influenza virus
SIINKMNTQFE

SEQ ID NO: 402290 - protein, 11 aa, Influenza virus
IINKMNTQFEA

SEQ ID NO: 402291 - protein, 11 aa, Influenza virus
KMNTQFEAVGK

SEQ ID NO: 402292 - protein, 11 aa, Influenza virus
MNTQFEAVGKE

SEQ ID NO: 402293 - protein, 11 aa, Influenza virus
NTQFEAVGKEF

SEQ ID NO: 402294 - protein, 11 aa, Influenza virus
LEKRIENLNKK

SEQ ID NO: 402295 - protein, 11 aa, Influenza virus
EKRIENLNKKM

SEQ ID NO: 402296 - protein, 11 aa, Influenza virus
KRIENLNKKME

SEQ ID NO: 402297 - protein, 11 aa, Influenza virus
RIESLNKKMED

SEQ ID NO: 402298 - protein, 11 aa, Influenza virus
IESLNKKMEDG

SEQ ID NO: 402299 - protein, 11 aa, Influenza virus
ESLNKKMEDGF

SEQ ID NO: 402300 - protein, 11 aa, Influenza virus
SLNKKMEDGFL

SEQ ID NO: 402301 - protein, 11 aa, Influenza virus
LNRKMEDGFLD

SEQ ID NO: 402302 - protein, 11 aa, Influenza virus
NRKMEDGFLDV

SEQ ID NO: 402303 - protein, 11 aa, Influenza virus
RKMEDGFLDVW

SEQ ID NO: 402304 - protein, 11 aa, Influenza virus
FLNVWTYNAEL

SEQ ID NO: 402305 - protein, 11 aa, Influenza virus
LNVWTYNAELL

SEQ ID NO: 402306 - protein, 11 aa, Influenza virus
NVWTYNAELLV

SEQ ID NO: 402307 - protein, 11 aa, Influenza virus
RTLDFHDSNVR

SEQ ID NO: 402308 - protein, 11 aa, Influenza virus
TLDFHDSNVRN

SEQ ID NO: 402309 - protein, 11 aa, Influenza virus
LDFHDSNVRNL

SEQ ID NO: 402310 - protein, 11 aa, Influenza virus
DFHDSNVRNLY

SEQ ID NO: 402311 - protein, 11 aa, Influenza virus
FHDSNVKNLYE

SEQ ID NO: 402312 - protein, 11 aa, Influenza virus
HDSNVKNLYEK

SEQ ID NO: 402313 - protein, 11 aa, Influenza virus
DSNVKNLYEKV

SEQ ID NO: 402314 - protein, 11 aa, Influenza virus
SNVKNLYEKVR

SEQ ID NO: 402315 - protein, 11 aa, Influenza virus
NVKNLYEKVRL

SEQ ID NO: 402316 - protein, 11 aa, Influenza virus
VKNLYEKVRLQ

SEQ ID NO: 402317 - protein, 11 aa, Influenza virus
KNLYEKVRLQL

SEQ ID NO: 402318 - protein, 11 aa, Influenza virus
NLYDKVRLQLK

SEQ ID NO: 402319 - protein, 11 aa, Influenza virus
LYDKVRLQLKD

SEQ ID NO: 402320 - protein, 11 aa, Influenza virus
YDKVRLQLKDN

SEQ ID NO: 402321 - protein, 11 aa, Influenza virus
DKVRLQLKDNA

SEQ ID NO: 402322 - protein, 11 aa, Influenza virus
KVRLQLKDNAK

SEQ ID NO: 402323 - protein, 11 aa, Influenza virus
VRLQLKDNAKE

SEQ ID NO: 402324 - protein, 11 aa, Influenza virus
RLQLKDNAKEL

SEQ ID NO: 402325 - protein, 11 aa, Influenza virus
LQLKDNAKELG

SEQ ID NO: 402326 - protein, 11 aa, Influenza virus
QLKDNAKELGN

SEQ ID NO: 402327 - protein, 11 aa, Influenza virus
LKDNAKELGNG

SEQ ID NO: 402328 - protein, 11 aa, Influenza virus
KDNAKELGNGC

SEQ ID NO: 402329 - protein, 11 aa, Influenza virus
LGNGCFEFYHR

SEQ ID NO: 402330 - protein, 11 aa, Influenza virus
GNGCFEFYHRC

SEQ ID NO: 402331 - protein, 11 aa, Influenza virus
NGCFEFYHRCD

SEQ ID NO: 402332 - protein, 11 aa, Influenza virus
GCFEFYHRCDN

SEQ ID NO: 402333 - protein, 11 aa, Influenza virus
GIYQILSIYST

SEQ ID NO: 402334 - protein, 11 aa, Influenza virus
YQILSIYSTAA

SEQ ID NO: 402335 - protein, 11 aa, Influenza virus
QILSIYSTAAS

SEQ ID NO: 402336 - protein, 11 aa, Influenza virus
ILSIYSTAASS

SEQ ID NO: 402337 - protein, 11 aa, Influenza virus
LSIYSTAASSL

SEQ ID NO: 402338 - protein, 11 aa, Influenza virus
YSTVASSLVLA

SEQ ID NO: 402339 - protein, 11 aa, Influenza virus
STVASSLVLAI

SEQ ID NO: 402340 - protein, 11 aa, Influenza virus
AGLFLWMCSNG

SEQ ID NO: 402341 - protein, 11 aa, Influenza virus
GLFLWMCSNGS

SEQ ID NO: 402342 - protein, 11 aa, Influenza virus
FWMCSNGSLQC

SEQ ID NO: 402343 - protein, 11 aa, Influenza virus
WMCSNGSLQCK

SEQ ID NO: 402344 - protein, 11 aa, Influenza virus
MCSNGSLQCRV

SEQ ID NO: 402345 - protein, 11 aa, Influenza virus
CSNGSLQCRVC

SEQ ID NO: 402346 - protein, 11 aa, Influenza virus
SNGSLQCRVCI

SEQ ID NO: 402347 - protein, 11 aa, Influenza virus
VCIKFVSSDCS

SEQ ID NO: 402348 - protein, 11 aa, Influenza virus
FSGSQKQEFKM

SEQ ID NO: 402349 - protein, 11 aa, Influenza virus
FREQKQEFKMN

SEQ ID NO: 402350 - protein, 11 aa, Influenza virus
GSQKQEFKMNP

SEQ ID NO: 402351 - protein, 11 aa, Influenza virus
SQKQEFKMNPN

SEQ ID NO: 402352 - protein, 11 aa, Influenza virus
QKQEIKMNPNQ

SEQ ID NO: 402353 - protein, 11 aa, Influenza virus
KQEIKMNPNQK

SEQ ID NO: 402354 - protein, 11 aa, Influenza virus
QEIKMNPNQKI

SEQ ID NO: 402355 - protein, 11 aa, Influenza virus
EIKMNPNQKII

SEQ ID NO: 402356 - protein, 11 aa, Influenza virus
IKMNPNQKIMT

SEQ ID NO: 402357 - protein, 11 aa, Influenza virus
KMNPNQKIITI

SEQ ID NO: 402358 - protein, 11 aa, Influenza virus
NRDITIGSICM

SEQ ID NO: 402359 - protein, 11 aa, Influenza virus
EIITIGSICMV

SEQ ID NO: 402360 - protein, 11 aa, Influenza virus
DITIGSICMVT

SEQ ID NO: 402361 - protein, 11 aa, Influenza virus
YENNTWVNQTF

SEQ ID NO: 402362 - protein, 11 aa, Influenza virus
HSKDNSIRIGS

SEQ ID NO: 402363 - protein, 11 aa, Influenza virus
SKDNSIRIGSR

SEQ ID NO: 402364 - protein, 11 aa, Influenza virus
KDNSIRIGSRG

SEQ ID NO: 402365 - protein, 11 aa, Influenza virus
DNSIRIGSRGD

SEQ ID NO: 402366 - protein, 11 aa, Influenza virus
NSIRIGSRGDV

SEQ ID NO: 402367 - protein, 11 aa, Influenza virus
SIRIGSRGDVF

SEQ ID NO: 402368 - protein, 11 aa, Influenza virus
IRIGSRGDVFV

SEQ ID NO: 402369 - protein, 11 aa, Influenza virus
EPFISCSHMEC

SEQ ID NO: 402370 - protein, 11 aa, Influenza virus
PFISCSHMECR

SEQ ID NO: 402371 - protein, 11 aa, Influenza virus
ISCSHMECRTF

SEQ ID NO: 402372 - protein, 11 aa, Influenza virus
SCSHMECRTFF

SEQ ID NO: 402373 - protein, 11 aa, Influenza virus
CSHMECRTFFL

SEQ ID NO: 402374 - protein, 11 aa, Influenza virus
SHMECRTFFLT

SEQ ID NO: 402375 - protein, 11 aa, Influenza virus
MECRTFFLTQG

SEQ ID NO: 402376 - protein, 11 aa, Influenza virus
ECRTFFLTQGS

SEQ ID NO: 402377 - protein, 11 aa, Influenza virus
CRTFFLTQGSL

SEQ ID NO: 402378 - protein, 11 aa, Influenza virus
RTFFLTQGSLL

SEQ ID NO: 402379 - protein, 11 aa, Influenza virus
TFFLTQGSLLN

SEQ ID NO: 402380 - protein, 11 aa, Influenza virus
FFLTQGSLLND

SEQ ID NO: 402381 - protein, 11 aa, Influenza virus
FLTQGSLLNDK

SEQ ID NO: 402382 - protein, 11 aa, Influenza virus
LTQGSLLNDKH

SEQ ID NO: 402383 - protein, 11 aa, Influenza virus
TQGSLLNDKHS

SEQ ID NO: 402384 - protein, 11 aa, Influenza virus
QGSLLNDKHSN

SEQ ID NO: 402385 - protein, 11 aa, Influenza virus
GSLLNDKHSNG

SEQ ID NO: 402386 - protein, 11 aa, Influenza virus
SLLNDKHSNGT

SEQ ID NO: 402387 - protein, 11 aa, Influenza virus
LLNDKHSNGTI

SEQ ID NO: 402388 - protein, 11 aa, Influenza virus
HSNGTIKDRSP

SEQ ID NO: 402389 - protein, 11 aa, Influenza virus
KDRSPYRTLMS

SEQ ID NO: 402390 - protein, 11 aa, Influenza virus
DRSPYRTLMSC

SEQ ID NO: 402391 - protein, 11 aa, Influenza virus
RSPYRTLMSCP

SEQ ID NO: 402392 - protein, 11 aa, Influenza virus
GEAPSPYNSKF

SEQ ID NO: 402393 - protein, 11 aa, Influenza virus
EAPSPYNSKFE

SEQ ID NO: 402394 - protein, 11 aa, Influenza virus
APSPYNSKFES

SEQ ID NO: 402395 - protein, 11 aa, Influenza virus
PSPYNSKFESV

SEQ ID NO: 402396 - protein, 11 aa, Influenza virus
SPYNSKFESVA

SEQ ID NO: 402397 - protein, 11 aa, Influenza virus
PYNSKFESVAW

SEQ ID NO: 402398 - protein, 11 aa, Influenza virus
YNSKFESVAWS

SEQ ID NO: 402399 - protein, 11 aa, Influenza virus
NSKFESVAWSA

SEQ ID NO: 402400 - protein, 11 aa, Influenza virus
SKFESVAWSAS

SEQ ID NO: 402401 - protein, 11 aa, Influenza virus
AWSASACHDGI

SEQ ID NO: 402402 - protein, 11 aa, Influenza virus
WSASACHDGIS

SEQ ID NO: 402403 - protein, 11 aa, Influenza virus
SASACHDGISW

SEQ ID NO: 402404 - protein, 11 aa, Influenza virus
ASACHDGISWL

SEQ ID NO: 402405 - protein, 11 aa, Influenza virus
NWLTIGISGPD

SEQ ID NO: 402406 - protein, 11 aa, Influenza virus
WLTIGISGPDS

SEQ ID NO: 402407 - protein, 11 aa, Influenza virus
IGISGPDNEAV

SEQ ID NO: 402408 - protein, 11 aa, Influenza virus
GISGPDNEAVA

SEQ ID NO: 402409 - protein, 11 aa, Influenza virus
ISGPDNEAVAV

SEQ ID NO: 402410 - protein, 11 aa, Influenza virus
SGPDNEAVAVL

SEQ ID NO: 402411 - protein, 11 aa, Influenza virus
GPDNEAVAVLK

SEQ ID NO: 402412 - protein, 11 aa, Influenza virus
PDNEAVAVLKY

SEQ ID NO: 402413 - protein, 11 aa, Influenza virus
IMRTQESECAC

SEQ ID NO: 402414 - protein, 11 aa, Influenza virus
MRTQESECACV

SEQ ID NO: 402415 - protein, 11 aa, Influenza virus
RTQESECACIN

SEQ ID NO: 402416 - protein, 11 aa, Influenza virus
TQESECACING

SEQ ID NO: 402417 - protein, 11 aa, Influenza virus
GSCFTIMTDGP

SEQ ID NO: 402418 - protein, 11 aa, Influenza virus
GKRGKWVKSVQ

SEQ ID NO: 402419 - protein, 11 aa, Influenza virus
APDYHYEECSC

SEQ ID NO: 402420 - protein, 11 aa, Influenza virus
PDYHYEECSCY

SEQ ID NO: 402421 - protein, 11 aa, Influenza virus
DYHYEECSCYP

SEQ ID NO: 402422 - protein, 11 aa, Influenza virus
YHYEECSCYPN

SEQ ID NO: 402423 - protein, 11 aa, Influenza virus
HYEECSCYPDS

SEQ ID NO: 402424 - protein, 11 aa, Influenza virus
YEECSCYPDAS

SEQ ID NO: 402425 - protein, 11 aa, Influenza virus
ICVCRDNWHGS

SEQ ID NO: 402426 - protein, 11 aa, Influenza virus
VCRDSWHGSNR

SEQ ID NO: 402427 - protein, 11 aa, Influenza virus
DNWHGSNRPWI

SEQ ID NO: 402428 - protein, 11 aa, Influenza virus
NWHGSNRPWIS

SEQ ID NO: 402429 - protein, 11 aa, Influenza virus
WHGSNRPWISF

SEQ ID NO: 402430 - protein, 11 aa, Influenza virus
HGSNRPWISFN

SEQ ID NO: 402431 - protein, 11 aa, Influenza virus
GYICSGIFGDN

SEQ ID NO: 402432 - protein, 11 aa, Influenza virus
YICSGIFGDNP

SEQ ID NO: 402433 - protein, 11 aa, Influenza virus
ICSGIFGDNPR

SEQ ID NO: 402434 - protein, 11 aa, Influenza virus
CSGIFGDNPRP

SEQ ID NO: 402435 - protein, 11 aa, Influenza virus
FRYGNGVWIGR

SEQ ID NO: 402436 - protein, 11 aa, Influenza virus
RYGNGVWIGRT

SEQ ID NO: 402437 - protein, 11 aa, Influenza virus
YGDGVWIGRTK

SEQ ID NO: 402438 - protein, 11 aa, Influenza virus
GDGVWIGRTKS

SEQ ID NO: 402439 - protein, 11 aa, Influenza virus
SRSGFEMVWDP

SEQ ID NO: 402440 - protein, 11 aa, Influenza virus
RSGFEMVWDPN

SEQ ID NO: 402441 - protein, 11 aa, Influenza virus
SGFEMVWDPNG

SEQ ID NO: 402442 - protein, 11 aa, Influenza virus
GFEMVWDPNGW

SEQ ID NO: 402443 - protein, 11 aa, Influenza virus
LTDWSGYSGSF

SEQ ID NO: 402444 - protein, 11 aa, Influenza virus
TDWSGYSGSFI

SEQ ID NO: 402445 - protein, 11 aa, Influenza virus
DWSGYSGSFIQ

SEQ ID NO: 402446 - protein, 11 aa, Influenza virus
WSGYSGSFIQH

SEQ ID NO: 402447 - protein, 11 aa, Influenza virus
SGYSGSFIQHP

SEQ ID NO: 402448 - protein, 11 aa, Influenza virus
GYSGSFIQHPE

SEQ ID NO: 402449 - protein, 11 aa, Influenza virus
YSGSFIQHPEL

SEQ ID NO: 402450 - protein, 11 aa, Influenza virus
SGSFIQHPELT

SEQ ID NO: 402451 - protein, 11 aa, Influenza virus
GSFIQHPELTG

SEQ ID NO: 402452 - protein, 11 aa, Influenza virus
SFIQHPELTGL

SEQ ID NO: 402453 - protein, 11 aa, Influenza virus
FVQHPELTGLN

SEQ ID NO: 402454 - protein, 11 aa, Influenza virus
VQHPELTGLNC

SEQ ID NO: 402455 - protein, 11 aa, Influenza virus
DCMRPCFWVEL

SEQ ID NO: 402456 - protein, 11 aa, Influenza virus
CMRPCFWVELI

SEQ ID NO: 402457 - protein, 11 aa, Influenza virus
MRPCFWVELIR

SEQ ID NO: 402458 - protein, 11 aa, Influenza virus
RPCFWVELVRG

SEQ ID NO: 402459 - protein, 11 aa, Influenza virus
PCFWVELIRGQ

SEQ ID NO: 402460 - protein, 11 aa, Influenza virus
CFWVELIRGQP

SEQ ID NO: 402461 - protein, 11 aa, Influenza virus
FWVELIRGQPK

SEQ ID NO: 402462 - protein, 11 aa, Influenza virus
WVELIRGQPKE

SEQ ID NO: 402463 - protein, 11 aa, Influenza virus
VWTSGSSISFC

SEQ ID NO: 402464 - protein, 11 aa, Influenza virus
WTSGSIISFCG

SEQ ID NO: 402465 - protein, 11 aa, Influenza virus
TSGSIISFCGV

SEQ ID NO: 402466 - protein, 11 aa, Influenza virus
SGSSISFCGVS

SEQ ID NO: 402467 - protein, 11 aa, Influenza virus
WSWPDDAELPF

SEQ ID NO: 402468 - protein, 11 aa, Influenza virus
GAELPFTIDKY

SEQ ID NO: 402469 - protein, 11 aa, Influenza virus
DRICIGYHANN

SEQ ID NO: 402470 - protein, 11 aa, Influenza virus
RICIGYHANNS

SEQ ID NO: 402471 - protein, 11 aa, Influenza virus
ICIGYHANNSK

SEQ ID NO: 402472 - protein, 11 aa, Influenza virus
CIGYHANNSTK

SEQ ID NO: 402473 - protein, 11 aa, Influenza virus
IGYHANNSTKQ

SEQ ID NO: 402474 - protein, 11 aa, Influenza virus
GYHANNSTKQV

SEQ ID NO: 402475 - protein, 11 aa, Influenza virus
YHANNSTKQVD

SEQ ID NO: 402476 - protein, 11 aa, Influenza virus
HANNSTKQVDT

SEQ ID NO: 402477 - protein, 11 aa, Influenza virus
ANNSTKQVDTI

SEQ ID NO: 402478 - protein, 11 aa, Influenza virus
DTIMERNVTVT

SEQ ID NO: 402479 - protein, 11 aa, Influenza virus
PEWSYIVEKDS

SEQ ID NO: 402480 - protein, 11 aa, Influenza virus
YHTGRSSFFRN

SEQ ID NO: 402481 - protein, 11 aa, Influenza virus
SFFRNVVWLTK

SEQ ID NO: 402482 - protein, 11 aa, Influenza virus
FFRNVVWLTKK

SEQ ID NO: 402483 - protein, 11 aa, Influenza virus
FESTGNFIAPE

SEQ ID NO: 402484 - protein, 11 aa, Influenza virus
ESTGNFIAPEY

SEQ ID NO: 402485 - protein, 11 aa, Influenza virus
STGNFIAPEYA

SEQ ID NO: 402486 - protein, 11 aa, Influenza virus
TGNFIAPEYAY

SEQ ID NO: 402487 - protein, 11 aa, Influenza virus
GNFIAPEYAFK

SEQ ID NO: 402488 - protein, 11 aa, Influenza virus
NFIAPEYAFKI

SEQ ID NO: 402489 - protein, 11 aa, Influenza virus
YGNCNTKCQTP

SEQ ID NO: 402490 - protein, 11 aa, Influenza virus
ERRRKKRGLFG

SEQ ID NO: 402491 - protein, 11 aa, Influenza virus
RRRKKRGLFGA

SEQ ID NO: 402492 - protein, 11 aa, Influenza virus
KKRGLFGAIAG

SEQ ID NO: 402493 - protein, 11 aa, Influenza virus
KRGLFGAIAGF

SEQ ID NO: 402494 - protein, 11 aa, Influenza virus
AGFIEGGWQGL

SEQ ID NO: 402495 - protein, 11 aa, Influenza virus
GFIEGGWQGMI

SEQ ID NO: 402496 - protein, 11 aa, Influenza virus
FIEGGWQGMID

SEQ ID NO: 402497 - protein, 11 aa, Influenza virus
IEGGWQGMIDG

SEQ ID NO: 402498 - protein, 11 aa, Influenza virus
EGGWQGMIDGW

SEQ ID NO: 402499 - protein, 11 aa, Influenza virus
GGWQGMIDGWY

SEQ ID NO: 402500 - protein, 11 aa, Influenza virus
GWQGMIDGWYG

SEQ ID NO: 402501 - protein, 11 aa, Influenza virus
WQGMIDGWYGY

SEQ ID NO: 402502 - protein, 11 aa, Influenza virus
QGMIDGWYGYH

SEQ ID NO: 402503 - protein, 11 aa, Influenza virus
GMIDGWYGYHH

SEQ ID NO: 402504 - protein, 11 aa, Influenza virus
IDGWYGYHHSN

SEQ ID NO: 402505 - protein, 11 aa, Influenza virus
GSGYAADKKST

SEQ ID NO: 402506 - protein, 11 aa, Influenza virus
SGYAADKKSTQ

SEQ ID NO: 402507 - protein, 11 aa, Influenza virus
GYAADKKSTQK

SEQ ID NO: 402508 - protein, 11 aa, Influenza virus
YAADKKSTQKA

SEQ ID NO: 402509 - protein, 11 aa, Influenza virus
VWTYNAELFVL

SEQ ID NO: 402510 - protein, 11 aa, Influenza virus
WTYNAELLVLI

SEQ ID NO: 402511 - protein, 11 aa, Influenza virus
TYNAELLVLIE

SEQ ID NO: 402512 - protein, 11 aa, Influenza virus
YNTELLVLMEN

SEQ ID NO: 402513 - protein, 11 aa, Influenza virus
NAELFVLMENE

SEQ ID NO: 402514 - protein, 11 aa, Influenza virus
ELFVLMENERT

SEQ ID NO: 402515 - protein, 11 aa, Influenza virus
LLVLIENERTL

SEQ ID NO: 402516 - protein, 11 aa, Influenza virus
LVLMENERTLY

SEQ ID NO: 402517 - protein, 11 aa, Influenza virus
VLMENERTLDL

SEQ ID NO: 402518 - protein, 11 aa, Influenza virus
LMENERTLDLH

SEQ ID NO: 402519 - protein, 11 aa, Influenza virus
MENERTLDLHD

SEQ ID NO: 402520 - protein, 11 aa, Influenza virus
ENERTLDLHDS

SEQ ID NO: 402521 - protein, 11 aa, Influenza virus
NERTLDLHDSN

SEQ ID NO: 402522 - protein, 11 aa, Influenza virus
ERTLDLHDSNV

SEQ ID NO: 402523 - protein, 11 aa, Influenza virus
RTLDLHDSNVK

SEQ ID NO: 402524 - protein, 11 aa, Influenza virus
TLDLHDSNVKN

SEQ ID NO: 402525 - protein, 11 aa, Influenza virus
LDLHDSNVKNL

SEQ ID NO: 402526 - protein, 11 aa, Influenza virus
DLHDSNVKNLY

SEQ ID NO: 402527 - protein, 11 aa, Influenza virus
LHDSNVKNLYD

SEQ ID NO: 402528 - protein, 11 aa, Influenza virus
HDSNVRNLYDK

SEQ ID NO: 402529 - protein, 11 aa, Influenza virus
DSNVRNLYDKV

SEQ ID NO: 402530 - protein, 11 aa, Influenza virus
SNVRNLYDKVR

SEQ ID NO: 402531 - protein, 11 aa, Influenza virus
DNARELGNGCF

SEQ ID NO: 402532 - protein, 11 aa, Influenza virus
NARELGNGCFE

SEQ ID NO: 402533 - protein, 11 aa, Influenza virus
ARELGNGCFEF

SEQ ID NO: 402534 - protein, 11 aa, Influenza virus
RELGNGCFEFY

SEQ ID NO: 402535 - protein, 11 aa, Influenza virus
EMGNGCFEFYH

SEQ ID NO: 402536 - protein, 11 aa, Influenza virus
LGNGCFEFYHR

SEQ ID NO: 402537 - protein, 11 aa, Influenza virus
GNGCFEFYHRC

SEQ ID NO: 402538 - protein, 11 aa, Influenza virus
NGCFEFYHRCD

SEQ ID NO: 402539 - protein, 11 aa, Influenza virus
ECMESVKNGTY

SEQ ID NO: 402540 - protein, 11 aa, Influenza virus
ILSIYSTVVSS

SEQ ID NO: 402541 - protein, 11 aa, Influenza virus
LSIYSTVVSSL

SEQ ID NO: 402542 - protein, 11 aa, Influenza virus
LAIMVAGLSFW

SEQ ID NO: 402543 - protein, 11 aa, Influenza virus
VAGLSFWMCSN

SEQ ID NO: 402544 - protein, 11 aa, Influenza virus
AGLFFWMCSNG

SEQ ID NO: 402545 - protein, 11 aa, Influenza virus
GLFFWMCSNGS

SEQ ID NO: 402546 - protein, 11 aa, Influenza virus
LFFWMCSNGSL

SEQ ID NO: 402547 - protein, 11 aa, Influenza virus
FFWMCSNGSLQ

SEQ ID NO: 402548 - protein, 11 aa, Influenza virus
FWMCSNGPLQC

SEQ ID NO: 402549 - protein, 11 aa, Influenza virus
WMCSNGSLQCT

SEQ ID NO: 402550 - protein, 11 aa, Influenza virus
MCSNGSLQCTI

SEQ ID NO: 402551 - protein, 11 aa, Influenza virus
CSNGSLQCTIC

SEQ ID NO: 402552 - protein, 11 aa, Influenza virus
SNGSLQCTICI

SEQ ID NO: 402553 - protein, 11 aa, Influenza virus
KPQCQVTGFAP

SEQ ID NO: 402554 - protein, 11 aa, Influenza virus
PQCQVTGFAPF

SEQ ID NO: 402555 - protein, 11 aa, Influenza virus
VTGFAPFSKDN

SEQ ID NO: 402556 - protein, 11 aa, Influenza virus
AGFAPFSKDNS

SEQ ID NO: 402557 - protein, 11 aa, Influenza virus
FAPFSKDNSIQ

SEQ ID NO: 402558 - protein, 11 aa, Influenza virus
APFSKDNSIQL

SEQ ID NO: 402559 - protein, 11 aa, Influenza virus
PFSKDNSIQLS

SEQ ID NO: 402560 - protein, 11 aa, Influenza virus
FSKDNSIQLSA

SEQ ID NO: 402561 - protein, 11 aa, Influenza virus
SKDNSIQLSAG

SEQ ID NO: 402562 - protein, 11 aa, Influenza virus
KDNSIQLSAGG

SEQ ID NO: 402563 - protein, 11 aa, Influenza virus
IWITREPYVSC

SEQ ID NO: 402564 - protein, 11 aa, Influenza virus
WVTREPYVSCS

SEQ ID NO: 402565 - protein, 11 aa, Influenza virus
RCYQFALGQGT

SEQ ID NO: 402566 - protein, 11 aa, Influenza virus
QFALGQGTTLN

SEQ ID NO: 402567 - protein, 11 aa, Influenza virus
PHRTLLMSELG

SEQ ID NO: 402568 - protein, 11 aa, Influenza virus
HRTLLMSELGV

SEQ ID NO: 402569 - protein, 11 aa, Influenza virus
RTLLMSELGVP

SEQ ID NO: 402570 - protein, 11 aa, Influenza virus
TLLMSELGVPF

SEQ ID NO: 402571 - protein, 11 aa, Influenza virus
LLMSELGVPFH

SEQ ID NO: 402572 - protein, 11 aa, Influenza virus
LMSELGVPFHL

SEQ ID NO: 402573 - protein, 11 aa, Influenza virus
MSELGVPFHLG

SEQ ID NO: 402574 - protein, 11 aa, Influenza virus
SELGVPFHLGT

SEQ ID NO: 402575 - protein, 11 aa, Influenza virus
ELGVPFHLGTR

SEQ ID NO: 402576 - protein, 11 aa, Influenza virus
LGVPFHLGTRQ

SEQ ID NO: 402577 - protein, 11 aa, Influenza virus
GVPFHLGTRQV

SEQ ID NO: 402578 - protein, 11 aa, Influenza virus
VPFHLGTRQVC

SEQ ID NO: 402579 - protein, 11 aa, Influenza virus
PFHLGTRQVCI

SEQ ID NO: 402580 - protein, 11 aa, Influenza virus
FHLGTRQVCIA

SEQ ID NO: 402581 - protein, 11 aa, Influenza virus
HLGTRQVCIAW

SEQ ID NO: 402582 - protein, 11 aa, Influenza virus
LGTRQVCIAWS

SEQ ID NO: 402583 - protein, 11 aa, Influenza virus
GTRQVCIAWSS

SEQ ID NO: 402584 - protein, 11 aa, Influenza virus
TRQVCIAWSSS

SEQ ID NO: 402585 - protein, 11 aa, Influenza virus
RQVCIAWSSSS

SEQ ID NO: 402586 - protein, 11 aa, Influenza virus
QVCMAWSSSSC

SEQ ID NO: 402587 - protein, 11 aa, Influenza virus
VCMAWSSSSCH

SEQ ID NO: 402588 - protein, 11 aa, Influenza virus
CMAWSSSSCHD

SEQ ID NO: 402589 - protein, 11 aa, Influenza virus
MAWSSSSCHDG

SEQ ID NO: 402590 - protein, 11 aa, Influenza virus
AWSSSSCHDGR

SEQ ID NO: 402591 - protein, 11 aa, Influenza virus
WSSSSCHDGRA

SEQ ID NO: 402592 - protein, 11 aa, Influenza virus
SSSSCHDGRAW

SEQ ID NO: 402593 - protein, 11 aa, Influenza virus
SSSCHDGRAWL

SEQ ID NO: 402594 - protein, 11 aa, Influenza virus
SSCHDGRAWLH

SEQ ID NO: 402595 - protein, 11 aa, Influenza virus
CHDGRAWLHVC

SEQ ID NO: 402596 - protein, 11 aa, Influenza virus
AWLHICVTGDD

SEQ ID NO: 402597 - protein, 11 aa, Influenza virus
SWSKNILRTQE

SEQ ID NO: 402598 - protein, 11 aa, Influenza virus
WSKNILRTQES

SEQ ID NO: 402599 - protein, 11 aa, Influenza virus
SKNILRTQESE

SEQ ID NO: 402600 - protein, 11 aa, Influenza virus
KNILRTQESEC

SEQ ID NO: 402601 - protein, 11 aa, Influenza virus
NILRTQESECI

SEQ ID NO: 402602 - protein, 11 aa, Influenza virus
ILRTQESECIC

SEQ ID NO: 402603 - protein, 11 aa, Influenza virus
LRTQESECVCV

SEQ ID NO: 402604 - protein, 11 aa, Influenza virus
RTQESECVCIS

SEQ ID NO: 402605 - protein, 11 aa, Influenza virus
CAVVMTDGSAS

SEQ ID NO: 402606 - protein, 11 aa, Influenza virus
GSAQHVEECSC

SEQ ID NO: 402607 - protein, 11 aa, Influenza virus
SAQHVEECSCY

SEQ ID NO: 402608 - protein, 11 aa, Influenza virus
AQHVEECSCYP

SEQ ID NO: 402609 - protein, 11 aa, Influenza virus
SYLNVRCVCRD

SEQ ID NO: 402610 - protein, 11 aa, Influenza virus
IRCVCRDNWKG

SEQ ID NO: 402611 - protein, 11 aa, Influenza virus
RCICRDNWKGS

SEQ ID NO: 402612 - protein, 11 aa, Influenza virus
CICRDNWKGSN

SEQ ID NO: 402613 - protein, 11 aa, Influenza virus
ICRDNWKGSNR

SEQ ID NO: 402614 - protein, 11 aa, Influenza virus
CRDNWMGSNRP

SEQ ID NO: 402615 - protein, 11 aa, Influenza virus
RDNWKGSNRPI

SEQ ID NO: 402616 - protein, 11 aa, Influenza virus
SSYICSGLVGD

SEQ ID NO: 402617 - protein, 11 aa, Influenza virus
SYICSGLVGDT

SEQ ID NO: 402618 - protein, 11 aa, Influenza virus
YICSGLVGDTP

SEQ ID NO: 402619 - protein, 11 aa, Influenza virus
ICSGLVGDTPR

SEQ ID NO: 402620 - protein, 11 aa, Influenza virus
SGLVGDTPRNN

SEQ ID NO: 402621 - protein, 11 aa, Influenza virus
GLVGDTPRNND

SEQ ID NO: 402622 - protein, 11 aa, Influenza virus
LVGDTPRNDDG

SEQ ID NO: 402623 - protein, 11 aa, Influenza virus
SNSNCKDPNNE

SEQ ID NO: 402624 - protein, 11 aa, Influenza virus
GNSGVKGWAFD

SEQ ID NO: 402625 - protein, 11 aa, Influenza virus
SKNSRSGYETF

SEQ ID NO: 402626 - protein, 11 aa, Influenza virus
KDSRSGYETFK

SEQ ID NO: 402627 - protein, 11 aa, Influenza virus
DSRSGYETFKV

SEQ ID NO: 402628 - protein, 11 aa, Influenza virus
SRSGYETFKVI

SEQ ID NO: 402629 - protein, 11 aa, Influenza virus
NWSGYSGVFSV

SEQ ID NO: 402630 - protein, 11 aa, Influenza virus
WSGYSGVFSVE

SEQ ID NO: 402631 - protein, 11 aa, Influenza virus
SCVNRCFYVEL

SEQ ID NO: 402632 - protein, 11 aa, Influenza virus
CVNRCFYVELI

SEQ ID NO: 402633 - protein, 11 aa, Influenza virus
VNRCFYVELIR

SEQ ID NO: 402634 - protein, 11 aa, Influenza virus
CFYLELIRGRP

SEQ ID NO: 402635 - protein, 11 aa, Influenza virus
FYVELIRGRPK

SEQ ID NO: 402636 - protein, 11 aa, Influenza virus
YVELIRGRPKE

SEQ ID NO: 402637 - protein, 11 aa, Influenza virus
RVWWTSNSIVA

SEQ ID NO: 402638 - protein, 11 aa, Influenza virus
VWWTSNSIVAF

SEQ ID NO: 402639 - protein, 11 aa, Influenza virus
WWTSNSIVAFC

SEQ ID NO: 402640 - protein, 11 aa, Influenza virus
WTSNSIVAFCG

SEQ ID NO: 402641 - protein, 11 aa, Influenza virus
TSNSIVAFCGT

SEQ ID NO: 402642 - protein, 11 aa, Influenza virus
SNSIVAFCGTS

SEQ ID NO: 402643 - protein, 11 aa, Influenza virus
NSIVAFCGTSG

SEQ ID NO: 402644 - protein, 11 aa, Influenza virus
SIVAFCGTSGT

SEQ ID NO: 402645 - protein, 11 aa, Influenza virus
IVAFCGTSGTY

SEQ ID NO: 402646 - protein, 11 aa, Influenza virus
VAFCGTSGTYG

SEQ ID NO: 402647 - protein, 11 aa, Influenza virus
AFCGTSGTYGT

SEQ ID NO: 402648 - protein, 11 aa, Influenza virus
YGTGSWPDGAD

SEQ ID NO: 402649 - protein, 11 aa, Influenza virus
GTGSWPDGADI

SEQ ID NO: 402650 - protein, 11 aa, Influenza virus
TGSWPDGADIN

SEQ ID NO: 402651 - protein, 11 aa, Influenza virus
GSWPDGANINL

SEQ ID NO: 402652 - protein, 11 aa, Influenza virus
SWPDGANINLM

SEQ ID NO: 402653 - protein, 11 aa, Influenza virus
WPDGANINLMP

SEQ ID NO: 402654 - protein, 11 aa, Influenza virus
RSDKICIGYHA

SEQ ID NO: 402655 - protein, 11 aa, Influenza virus
SDRICIGYHAN

SEQ ID NO: 402656 - protein, 11 aa, Influenza virus
DRICIGYHANN

SEQ ID NO: 402657 - protein, 11 aa, Influenza virus
RICIGYHANNS

SEQ ID NO: 402658 - protein, 11 aa, Influenza virus
IGYHANNSTTK

SEQ ID NO: 402659 - protein, 11 aa, Influenza virus
GYHANNSTTKV

SEQ ID NO: 402660 - protein, 11 aa, Influenza virus
YHANNSTTKVD

SEQ ID NO: 402661 - protein, 11 aa, Influenza virus
HANNSTTKVDT

SEQ ID NO: 402662 - protein, 11 aa, Influenza virus
ANNSTTKVDTI

SEQ ID NO: 402663 - protein, 11 aa, Influenza virus
VDTLLEKNVTV

SEQ ID NO: 402664 - protein, 11 aa, Influenza virus
DTLLEKNVTVT

SEQ ID NO: 402665 - protein, 11 aa, Influenza virus
TLLEKNVTVTH

SEQ ID NO: 402666 - protein, 11 aa, Influenza virus
LLEKNVTVTHS

SEQ ID NO: 402667 - protein, 11 aa, Influenza virus
LEKNVTVTHSI

SEQ ID NO: 402668 - protein, 11 aa, Influenza virus
EKNVTVTHSIE

SEQ ID NO: 402669 - protein, 11 aa, Influenza virus
KNVTVTHSIEL

SEQ ID NO: 402670 - protein, 11 aa, Influenza virus
NVTVTHSIELL

SEQ ID NO: 402671 - protein, 11 aa, Influenza virus
VTVTHSIELLE

SEQ ID NO: 402672 - protein, 11 aa, Influenza virus
TVTHSVELLES

SEQ ID NO: 402673 - protein, 11 aa, Influenza virus
LRPGETLNVES

SEQ ID NO: 402674 - protein, 11 aa, Influenza virus
RPGETLNVESN

SEQ ID NO: 402675 - protein, 11 aa, Influenza virus
PGETLKVESNG

SEQ ID NO: 402676 - protein, 11 aa, Influenza virus
GETLKVESNGN

SEQ ID NO: 402677 - protein, 11 aa, Influenza virus
ETLKVESNGNL

SEQ ID NO: 402678 - protein, 11 aa, Influenza virus
TLNVESNGNLV

SEQ ID NO: 402679 - protein, 11 aa, Influenza virus
LNVESNGNLVA

SEQ ID NO: 402680 - protein, 11 aa, Influenza virus
NVESNGNLVAP

SEQ ID NO: 402681 - protein, 11 aa, Influenza virus
VESNGNLVAPW

SEQ ID NO: 402682 - protein, 11 aa, Influenza virus
ESNGNLVAPWY

SEQ ID NO: 402683 - protein, 11 aa, Influenza virus
SNGNLVAPWYA

SEQ ID NO: 402684 - protein, 11 aa, Influenza virus
NGNLVAPWYAY

SEQ ID NO: 402685 - protein, 11 aa, Influenza virus
GNLIAPWYAYR

SEQ ID NO: 402686 - protein, 11 aa, Influenza virus
NKTFQNISPVW

SEQ ID NO: 402687 - protein, 11 aa, Influenza virus
SLKLATGLRNV

SEQ ID NO: 402688 - protein, 11 aa, Influenza virus
LKLATGLRNVP

SEQ ID NO: 402689 - protein, 11 aa, Influenza virus
KLATGLRNVPQ

SEQ ID NO: 402690 - protein, 11 aa, Influenza virus
TRGIFGAIAGF

SEQ ID NO: 402691 - protein, 11 aa, Influenza virus
RGIFGAIAGFI

SEQ ID NO: 402692 - protein, 11 aa, Influenza virus
GIFGAIAGFIE

SEQ ID NO: 402693 - protein, 11 aa, Influenza virus
IFGAIAGFIEG

SEQ ID NO: 402694 - protein, 11 aa, Influenza virus
AGFIEGGWTGL

SEQ ID NO: 402695 - protein, 11 aa, Influenza virus
GFIEGGWTGMV

SEQ ID NO: 402696 - protein, 11 aa, Influenza virus
FIEGGWTGMVD

SEQ ID NO: 402697 - protein, 11 aa, Influenza virus
IEGGWTGMVDG

SEQ ID NO: 402698 - protein, 11 aa, Influenza virus
EGGWTGMVDGW

SEQ ID NO: 402699 - protein, 11 aa, Influenza virus
GGWTGMVDGWY

SEQ ID NO: 402700 - protein, 11 aa, Influenza virus
GWTGMVDGWYG

SEQ ID NO: 402701 - protein, 11 aa, Influenza virus
WTGMVDGWYGY

SEQ ID NO: 402702 - protein, 11 aa, Influenza virus
TGMVDGWYGYH

SEQ ID NO: 402703 - protein, 11 aa, Influenza virus
GMVDGWYGYHH

SEQ ID NO: 402704 - protein, 11 aa, Influenza virus
MVDGWYGYHHE

SEQ ID NO: 402705 - protein, 11 aa, Influenza virus
VDGWYGYHHEN

SEQ ID NO: 402706 - protein, 11 aa, Influenza virus
NSQGSGYAADR

SEQ ID NO: 402707 - protein, 11 aa, Influenza virus
SQGSGYAADRE

SEQ ID NO: 402708 - protein, 11 aa, Influenza virus
QGSGYAADRES

SEQ ID NO: 402709 - protein, 11 aa, Influenza virus
GSGYAADREST

SEQ ID NO: 402710 - protein, 11 aa, Influenza virus
SGYAADRESTQ

SEQ ID NO: 402711 - protein, 11 aa, Influenza virus
GYAADRESTQK

SEQ ID NO: 402712 - protein, 11 aa, Influenza virus
YAADRESTQKA

SEQ ID NO: 402713 - protein, 11 aa, Influenza virus
DGFLNVWTYNA

SEQ ID NO: 402714 - protein, 11 aa, Influenza virus
GFLNVWTYNAE

SEQ ID NO: 402715 - protein, 11 aa, Influenza virus
FLNVWTYNAEL

SEQ ID NO: 402716 - protein, 11 aa, Influenza virus
LNVWTYNAELL

SEQ ID NO: 402717 - protein, 11 aa, Influenza virus
NVWTYNAELLV

SEQ ID NO: 402718 - protein, 11 aa, Influenza virus
VWTYNAELLIL

SEQ ID NO: 402719 - protein, 11 aa, Influenza virus
WTYNAELLILL

SEQ ID NO: 402720 - protein, 11 aa, Influenza virus
TYNAELLILLE

SEQ ID NO: 402721 - protein, 11 aa, Influenza virus
YNAELLILLEN

SEQ ID NO: 402722 - protein, 11 aa, Influenza virus
NAELLILLENE

SEQ ID NO: 402723 - protein, 11 aa, Influenza virus
AELLILLENER

SEQ ID NO: 402724 - protein, 11 aa, Influenza virus
ELLILLENERT

SEQ ID NO: 402725 - protein, 11 aa, Influenza virus
LLILLENERTL

SEQ ID NO: 402726 - protein, 11 aa, Influenza virus
LILLENERTLD

SEQ ID NO: 402727 - protein, 11 aa, Influenza virus
ENERTLDMHDA

SEQ ID NO: 402728 - protein, 11 aa, Influenza virus
NERTLDMHDAN

SEQ ID NO: 402729 - protein, 11 aa, Influenza virus
ERTLDMHDANV

SEQ ID NO: 402730 - protein, 11 aa, Influenza virus
LRDNAKDLGNG

SEQ ID NO: 402731 - protein, 11 aa, Influenza virus
RDNAKDLGNGC

SEQ ID NO: 402732 - protein, 11 aa, Influenza virus
DNAKDLGNGCF

SEQ ID NO: 402733 - protein, 11 aa, Influenza virus
NAKDLGNGCFE

SEQ ID NO: 402734 - protein, 11 aa, Influenza virus
AKDLGNGCFEF

SEQ ID NO: 402735 - protein, 11 aa, Influenza virus
KDLGNGCFEFW

SEQ ID NO: 402736 - protein, 11 aa, Influenza virus
ILGNGCFEFWH

SEQ ID NO: 402737 - protein, 11 aa, Influenza virus
LGNGCFEFWHR

SEQ ID NO: 402738 - protein, 11 aa, Influenza virus
NGCFEFWHKCN

SEQ ID NO: 402739 - protein, 11 aa, Influenza virus
GCFEFWHKCDD

SEQ ID NO: 402740 - protein, 11 aa, Influenza virus
CFEFWHKCDDE

SEQ ID NO: 402741 - protein, 11 aa, Influenza virus
FEFWHKCDDEC

SEQ ID NO: 402742 - protein, 11 aa, Influenza virus
DVYQILAIYST

SEQ ID NO: 402743 - protein, 11 aa, Influenza virus
IYQILAIYSTV

SEQ ID NO: 402744 - protein, 11 aa, Influenza virus
YQILSIYSTVS

SEQ ID NO: 402745 - protein, 11 aa, Influenza virus
QILSIYSTVSS

SEQ ID NO: 402746 - protein, 11 aa, Influenza virus
ILSIYSTVSSS

SEQ ID NO: 402747 - protein, 11 aa, Influenza virus
LAIYSTISSSL

SEQ ID NO: 402748 - protein, 11 aa, Influenza virus
AIYSTISSSLV

SEQ ID NO: 402749 - protein, 11 aa, Influenza virus
IYSTISSSLVL

SEQ ID NO: 402750 - protein, 11 aa, Influenza virus
YSTVSSSLVLA

SEQ ID NO: 402751 - protein, 11 aa, Influenza virus
STVSSSLVLAG

SEQ ID NO: 402752 - protein, 11 aa, Influenza virus
TVSSSLVLAGL

SEQ ID NO: 402753 - protein, 11 aa, Influenza virus
VSSSLVLVGLV

SEQ ID NO: 402754 - protein, 11 aa, Influenza virus
WMCSNGSMQCK

SEQ ID NO: 402755 - protein, 11 aa, Influenza virus
KSRGYKMNNQI

SEQ ID NO: 402756 - protein, 11 aa, Influenza virus
SRGYKMNNQIL

SEQ ID NO: 402757 - protein, 11 aa, Influenza virus
ADKICLGHHAV

SEQ ID NO: 402758 - protein, 11 aa, Influenza virus
LTERGVEVVNA

SEQ ID NO: 402759 - protein, 11 aa, Influenza virus
TERGVEVVNAT

SEQ ID NO: 402760 - protein, 11 aa, Influenza virus
ERGVEVVNATE

SEQ ID NO: 402761 - protein, 11 aa, Influenza virus
RGVEVVNATET

SEQ ID NO: 402762 - protein, 11 aa, Influenza virus
GVEVVNATETV

SEQ ID NO: 402763 - protein, 11 aa, Influenza virus
VEVVNATETVE

SEQ ID NO: 402764 - protein, 11 aa, Influenza virus
EVVNATETVER

SEQ ID NO: 402765 - protein, 11 aa, Influenza virus
GPPQCDLFLEF

SEQ ID NO: 402766 - protein, 11 aa, Influenza virus
PSFYAEMKWLL

SEQ ID NO: 402767 - protein, 11 aa, Influenza virus
SFYAEMEWLLS

SEQ ID NO: 402768 - protein, 11 aa, Influenza virus
FYAEMKWLLSS

SEQ ID NO: 402769 - protein, 11 aa, Influenza virus
FNGAFIAPDRV

SEQ ID NO: 402770 - protein, 11 aa, Influenza virus
NGAFIAPDRVS

SEQ ID NO: 402771 - protein, 11 aa, Influenza virus
GAFIAPDRVSF

SEQ ID NO: 402772 - protein, 11 aa, Influenza virus
SLLLATGMKNV

SEQ ID NO: 402773 - protein, 11 aa, Influenza virus
LLLATGMKNVP

SEQ ID NO: 402774 - protein, 11 aa, Influenza virus
LLATGMKNVPE

SEQ ID NO: 402775 - protein, 11 aa, Influenza virus
AHKQLTHHMRK

SEQ ID NO: 402776 - protein, 11 aa, Influenza virus
MRKKRGLFGAK

SEQ ID NO: 402777 - protein, 11 aa, Influenza virus
RKKRGLFGAKA

SEQ ID NO: 402778 - protein, 11 aa, Influenza virus
RETRGLFGAIA

SEQ ID NO: 402779 - protein, 11 aa, Influenza virus
ETRGLFGAIAG

SEQ ID NO: 402780 - protein, 11 aa, Influenza virus
TRGLFGAIAGF

SEQ ID NO: 402781 - protein, 11 aa, Influenza virus
GFIENGWEGLV

SEQ ID NO: 402782 - protein, 11 aa, Influenza virus
FIENGWEGLIN

SEQ ID NO: 402783 - protein, 11 aa, Influenza virus
IENGWEGLING

SEQ ID NO: 402784 - protein, 11 aa, Influenza virus
ENGWEGLINGW

SEQ ID NO: 402785 - protein, 11 aa, Influenza virus
NGWEGLINGWY

SEQ ID NO: 402786 - protein, 11 aa, Influenza virus
GWEGLINGWYG

SEQ ID NO: 402787 - protein, 11 aa, Influenza virus
WEGLINGWYGF

SEQ ID NO: 402788 - protein, 11 aa, Influenza virus
EGLINGWYGFR

SEQ ID NO: 402789 - protein, 11 aa, Influenza virus
GLINGWYGFRH

SEQ ID NO: 402790 - protein, 11 aa, Influenza virus
LINGWYGFRHQ

SEQ ID NO: 402791 - protein, 11 aa, Influenza virus
INGWYGFRHQN

SEQ ID NO: 402792 - protein, 11 aa, Influenza virus
GWYGYRHQNAQ

SEQ ID NO: 402793 - protein, 11 aa, Influenza virus
WYGYRHQNAQG

SEQ ID NO: 402794 - protein, 11 aa, Influenza virus
YGYRHQNAQGE

SEQ ID NO: 402795 - protein, 11 aa, Influenza virus
GYRHQNAQGEG

SEQ ID NO: 402796 - protein, 11 aa, Influenza virus
RHQNAQGEGIA

SEQ ID NO: 402797 - protein, 11 aa, Influenza virus
HQNAQGEGIAA

SEQ ID NO: 402798 - protein, 11 aa, Influenza virus
QNAQGEGIAAD

SEQ ID NO: 402799 - protein, 11 aa, Influenza virus
NAQGEGIAADY

SEQ ID NO: 402800 - protein, 11 aa, Influenza virus
AQGEGIAADYK

SEQ ID NO: 402801 - protein, 11 aa, Influenza virus
QGEGIAADYKS

SEQ ID NO: 402802 - protein, 11 aa, Influenza virus
GEGIAADYKST

SEQ ID NO: 402803 - protein, 11 aa, Influenza virus
EGIAADYKSTQ

SEQ ID NO: 402804 - protein, 11 aa, Influenza virus
GIAADYKSTQS

SEQ ID NO: 402805 - protein, 11 aa, Influenza virus
IAADYKSTQSA

SEQ ID NO: 402806 - protein, 11 aa, Influenza virus
AADYKSTQSAV

SEQ ID NO: 402807 - protein, 11 aa, Influenza virus
ADYKSTQSAIN

SEQ ID NO: 402808 - protein, 11 aa, Influenza virus
DYKSTQSAINQ

SEQ ID NO: 402809 - protein, 11 aa, Influenza virus
YKSTQSAIDQV

SEQ ID NO: 402810 - protein, 11 aa, Influenza virus
KSTQSAIDQVT

SEQ ID NO: 402811 - protein, 11 aa, Influenza virus
STQSAIDQVTG

SEQ ID NO: 402812 - protein, 11 aa, Influenza virus
TQSAIDQVTGK

SEQ ID NO: 402813 - protein, 11 aa, Influenza virus
QSAIDQVTGKL

SEQ ID NO: 402814 - protein, 11 aa, Influenza virus
SAIDQVTGKLN

SEQ ID NO: 402815 - protein, 11 aa, Influenza virus
AIDQVTGKLNR

SEQ ID NO: 402816 - protein, 11 aa, Influenza virus
DQVTGKLNRLI

SEQ ID NO: 402817 - protein, 11 aa, Influenza virus
EKQIGNVINWT

SEQ ID NO: 402818 - protein, 11 aa, Influenza virus
QIGNVINWTQD

SEQ ID NO: 402819 - protein, 11 aa, Influenza virus
IGNVINWTRDA

SEQ ID NO: 402820 - protein, 11 aa, Influenza virus
FLVAVENQHTI

SEQ ID NO: 402821 - protein, 11 aa, Influenza virus
LVAVENQHTID

SEQ ID NO: 402822 - protein, 11 aa, Influenza virus
VAVENQHTIDL

SEQ ID NO: 402823 - protein, 11 aa, Influenza virus
AMENQHTIDLT

SEQ ID NO: 402824 - protein, 11 aa, Influenza virus
ENQHTIDLTDS

SEQ ID NO: 402825 - protein, 11 aa, Influenza virus
NQHTIDLTDSE

SEQ ID NO: 402826 - protein, 11 aa, Influenza virus
QHTIDLTDSEM

SEQ ID NO: 402827 - protein, 11 aa, Influenza virus
VKKQLRENAEE

SEQ ID NO: 402828 - protein, 11 aa, Influenza virus
KKQLRENAEED

SEQ ID NO: 402829 - protein, 11 aa, Influenza virus
RQLRENAEEDG

SEQ ID NO: 402830 - protein, 11 aa, Influenza virus
LLRENAEEDGT

SEQ ID NO: 402831 - protein, 11 aa, Influenza virus
LRENAEEDGNG

SEQ ID NO: 402832 - protein, 11 aa, Influenza virus
RENAEEDGNGC

SEQ ID NO: 402833 - protein, 11 aa, Influenza virus
ENAEEDGNGCF

SEQ ID NO: 402834 - protein, 11 aa, Influenza virus
NAEEDGNGCFE

SEQ ID NO: 402835 - protein, 11 aa, Influenza virus
AEEDGNGCFEI

SEQ ID NO: 402836 - protein, 11 aa, Influenza virus
EEDGNGCFEIF

SEQ ID NO: 402837 - protein, 11 aa, Influenza virus
EDGNGCFEIFH

SEQ ID NO: 402838 - protein, 11 aa, Influenza virus
DGNGCFEIFHQ

SEQ ID NO: 402839 - protein, 11 aa, Influenza virus
GNGCFEIFHQC

SEQ ID NO: 402840 - protein, 11 aa, Influenza virus
NGCFEIFHQCD

SEQ ID NO: 402841 - protein, 11 aa, Influenza virus
GCFEIFHQCDN

SEQ ID NO: 402842 - protein, 11 aa, Influenza virus
CMASIRNNTYD

SEQ ID NO: 402843 - protein, 11 aa, Influenza virus
MASIRNNTYDH

SEQ ID NO: 402844 - protein, 11 aa, Influenza virus
SGYKDVILWFS

SEQ ID NO: 402845 - protein, 11 aa, Influenza virus
GYKDVILWFSF

SEQ ID NO: 402846 - protein, 11 aa, Influenza virus
YKDVILWFSFG

SEQ ID NO: 402847 - protein, 11 aa, Influenza virus
KDVILWFSFGA

SEQ ID NO: 402848 - protein, 11 aa, Influenza virus
DVILWFSFGAS

SEQ ID NO: 402849 - protein, 11 aa, Influenza virus
VILWFSFGASC

SEQ ID NO: 402850 - protein, 11 aa, Influenza virus
LWFSFGASCFI

SEQ ID NO: 402851 - protein, 11 aa, Influenza virus
WFSFGASCFIL

SEQ ID NO: 402852 - protein, 11 aa, Influenza virus
KNGNMQCTICI

SEQ ID NO: 402853 - protein, 11 aa, Influenza virus
VKGDKICLGHH

SEQ ID NO: 402854 - protein, 11 aa, Influenza virus
NADKICLGHHA

SEQ ID NO: 402855 - protein, 11 aa, Influenza virus
ADKICLGHHAV

SEQ ID NO: 402856 - protein, 11 aa, Influenza virus
DKICLGHHAVS

SEQ ID NO: 402857 - protein, 11 aa, Influenza virus
KICLGHHAVSN

SEQ ID NO: 402858 - protein, 11 aa, Influenza virus
ICLGHHAVSNG

SEQ ID NO: 402859 - protein, 11 aa, Influenza virus
CLGHHAVSNGT

SEQ ID NO: 402860 - protein, 11 aa, Influenza virus
LGHHAVSNGTK

SEQ ID NO: 402861 - protein, 11 aa, Influenza virus
GHHAVSNGTKV

SEQ ID NO: 402862 - protein, 11 aa, Influenza virus
HHAVSNGTKVN

SEQ ID NO: 402863 - protein, 11 aa, Influenza virus
HAVSNGTKVNT

SEQ ID NO: 402864 - protein, 11 aa, Influenza virus
AVSNGTKVNTL

SEQ ID NO: 402865 - protein, 11 aa, Influenza virus
VSNGTKVNTLT

SEQ ID NO: 402866 - protein, 11 aa, Influenza virus
SNGTKVNTLTE

SEQ ID NO: 402867 - protein, 11 aa, Influenza virus
NGTKVNTLTEK

SEQ ID NO: 402868 - protein, 11 aa, Influenza virus
GTKVNTLTEKG

SEQ ID NO: 402869 - protein, 11 aa, Influenza virus
TKVNTLTEKGI

SEQ ID NO: 402870 - protein, 11 aa, Influenza virus
KVNTLTEKGIE

SEQ ID NO: 402871 - protein, 11 aa, Influenza virus
VNTLTEKGIEV

SEQ ID NO: 402872 - protein, 11 aa, Influenza virus
NTLTEKGIEVV

SEQ ID NO: 402873 - protein, 11 aa, Influenza virus
TLTEKGIEVVN

SEQ ID NO: 402874 - protein, 11 aa, Influenza virus
LTEKGIEVVNA

SEQ ID NO: 402875 - protein, 11 aa, Influenza virus
TEKGIEVVNAT

SEQ ID NO: 402876 - protein, 11 aa, Influenza virus
EKGIEVVNATE

SEQ ID NO: 402877 - protein, 11 aa, Influenza virus
KGIEVVNATET

SEQ ID NO: 402878 - protein, 11 aa, Influenza virus
GVEVVNATETV

SEQ ID NO: 402879 - protein, 11 aa, Influenza virus
VEVVNATETVE

SEQ ID NO: 402880 - protein, 11 aa, Influenza virus
EVVNATETVER

SEQ ID NO: 402881 - protein, 11 aa, Influenza virus
VVNATETVETT

SEQ ID NO: 402882 - protein, 11 aa, Influenza virus
CGLLGTLTGPP

SEQ ID NO: 402883 - protein, 11 aa, Influenza virus
TGPPQCDQFLE

SEQ ID NO: 402884 - protein, 11 aa, Influenza virus
GPPQCDKFLEF

SEQ ID NO: 402885 - protein, 11 aa, Influenza virus
DLIIERREGND

SEQ ID NO: 402886 - protein, 11 aa, Influenza virus
LRQILRGSGGI

SEQ ID NO: 402887 - protein, 11 aa, Influenza virus
GFTYNGIRTNG

SEQ ID NO: 402888 - protein, 11 aa, Influenza virus
RLGSSFYAEMK

SEQ ID NO: 402889 - protein, 11 aa, Influenza virus
LGSSFYAEMKW

SEQ ID NO: 402890 - protein, 11 aa, Influenza virus
GPSFYAEMKWL

SEQ ID NO: 402891 - protein, 11 aa, Influenza virus
FYAEMKWLLSS

SEQ ID NO: 402892 - protein, 11 aa, Influenza virus
YAEMKWLLSNT

SEQ ID NO: 402893 - protein, 11 aa, Influenza virus
AEMKWLLSNTD

SEQ ID NO: 402894 - protein, 11 aa, Influenza virus
EMKWLLSNTDN

SEQ ID NO: 402895 - protein, 11 aa, Influenza virus
EQTKLYGNGNK

SEQ ID NO: 402896 - protein, 11 aa, Influenza virus
QTKLYGNGNKL

SEQ ID NO: 402897 - protein, 11 aa, Influenza virus
TKLYGSGNKLV

SEQ ID NO: 402898 - protein, 11 aa, Influenza virus
ARPQVNGQSGR

SEQ ID NO: 402899 - protein, 11 aa, Influenza virus
RPQVNGQSGRI

SEQ ID NO: 402900 - protein, 11 aa, Influenza virus
PQVNGQFGRID

SEQ ID NO: 402901 - protein, 11 aa, Influenza virus
QVNGQFGRIDF

SEQ ID NO: 402902 - protein, 11 aa, Influenza virus
VNGQFGRIDFH

SEQ ID NO: 402903 - protein, 11 aa, Influenza virus
NGQFGRIDFHW

SEQ ID NO: 402904 - protein, 11 aa, Influenza virus
GQFGRIDFHWL

SEQ ID NO: 402905 - protein, 11 aa, Influenza virus
QSGRIDFHWLM

SEQ ID NO: 402906 - protein, 11 aa, Influenza virus
SGRIDFHWLML

SEQ ID NO: 402907 - protein, 11 aa, Influenza virus
GRIDFHWLMLN

SEQ ID NO: 402908 - protein, 11 aa, Influenza virus
NDTVTFSFNGA

SEQ ID NO: 402909 - protein, 11 aa, Influenza virus
DTVTFSFNGAF

SEQ ID NO: 402910 - protein, 11 aa, Influenza virus
TVTFSFNGAFI

SEQ ID NO: 402911 - protein, 11 aa, Influenza virus
VTFSFNGAFIA

SEQ ID NO: 402912 - protein, 11 aa, Influenza virus
TFSFNGAFIAP

SEQ ID NO: 402913 - protein, 11 aa, Influenza virus
FSFNGAFIAPD

SEQ ID NO: 402914 - protein, 11 aa, Influenza virus
SFNGAFIAPDR

SEQ ID NO: 402915 - protein, 11 aa, Influenza virus
FNGAFIAPNRA

SEQ ID NO: 402916 - protein, 11 aa, Influenza virus
NGAFIAPNRAS

SEQ ID NO: 402917 - protein, 11 aa, Influenza virus
GAFIAPNRASF

SEQ ID NO: 402918 - protein, 11 aa, Influenza virus
AFIAPDRASFL

SEQ ID NO: 402919 - protein, 11 aa, Influenza virus
FIAPDRASFLR

SEQ ID NO: 402920 - protein, 11 aa, Influenza virus
IAPDRASFLRG

SEQ ID NO: 402921 - protein, 11 aa, Influenza virus
GGTIISNLPFQ

SEQ ID NO: 402922 - protein, 11 aa, Influenza virus
GTIISNLPFQN

SEQ ID NO: 402923 - protein, 11 aa, Influenza virus
TIISNLPFQNI

SEQ ID NO: 402924 - protein, 11 aa, Influenza virus
IISNLPFQNIN

SEQ ID NO: 402925 - protein, 11 aa, Influenza virus
TVGRCPRYVKQ

SEQ ID NO: 402926 - protein, 11 aa, Influenza virus
VKQTSLLLATG

SEQ ID NO: 402927 - protein, 11 aa, Influenza virus
KQTSLLLATGM

SEQ ID NO: 402928 - protein, 11 aa, Influenza virus
QTSLLLATGMR

SEQ ID NO: 402929 - protein, 11 aa, Influenza virus
TSLLLATGMRN

SEQ ID NO: 402930 - protein, 11 aa, Influenza virus
SLLLATGMKNV

SEQ ID NO: 402931 - protein, 11 aa, Influenza virus
LLLATGMKNVP

SEQ ID NO: 402932 - protein, 11 aa, Influenza virus
LLATGMKNVPE

SEQ ID NO: 402933 - protein, 11 aa, Influenza virus
LATGMRNVPEN

SEQ ID NO: 402934 - protein, 11 aa, Influenza virus
ATGMRNVPENP

SEQ ID NO: 402935 - protein, 11 aa, Influenza virus
TGMRNVPENPK

SEQ ID NO: 402936 - protein, 11 aa, Influenza virus
PKKRGLFGAIA

SEQ ID NO: 402937 - protein, 11 aa, Influenza virus
KKRGLFGAIAG

SEQ ID NO: 402938 - protein, 11 aa, Influenza virus
KRGLFGAIAGF

SEQ ID NO: 402939 - protein, 11 aa, Influenza virus
GFIENGWEGLV

SEQ ID NO: 402940 - protein, 11 aa, Influenza virus
FIENGWEGLID

SEQ ID NO: 402941 - protein, 11 aa, Influenza virus
IENGWEGLIDG

SEQ ID NO: 402942 - protein, 11 aa, Influenza virus
ENGWEGLIDGW

SEQ ID NO: 402943 - protein, 11 aa, Influenza virus
NGWEGLIDGWY

SEQ ID NO: 402944 - protein, 11 aa, Influenza virus
GWEGLIDGWYG

SEQ ID NO: 402945 - protein, 11 aa, Influenza virus
WEGLIDGWYGF

SEQ ID NO: 402946 - protein, 11 aa, Influenza virus
EGLIDGWYGFR

SEQ ID NO: 402947 - protein, 11 aa, Influenza virus
GLIDGWYGFRH

SEQ ID NO: 402948 - protein, 11 aa, Influenza virus
LIDGWYGFRHQ

SEQ ID NO: 402949 - protein, 11 aa, Influenza virus
IDGWYGFRHQN

SEQ ID NO: 402950 - protein, 11 aa, Influenza virus
DGWYGFRHQNA

SEQ ID NO: 402951 - protein, 11 aa, Influenza virus
GWYGFRHQNTQ

SEQ ID NO: 402952 - protein, 11 aa, Influenza virus
WYGFRHQNTQG

SEQ ID NO: 402953 - protein, 11 aa, Influenza virus
YGFRHQNTQGE

SEQ ID NO: 402954 - protein, 11 aa, Influenza virus
GFRHQNTQGEG

SEQ ID NO: 402955 - protein, 11 aa, Influenza virus
FRHQNTQGEGT

SEQ ID NO: 402956 - protein, 11 aa, Influenza virus
RHQNTQGEGTA

SEQ ID NO: 402957 - protein, 11 aa, Influenza virus
HQNTQGEGTAA

SEQ ID NO: 402958 - protein, 11 aa, Influenza virus
QNTQGEGTAAD

SEQ ID NO: 402959 - protein, 11 aa, Influenza virus
NTQGEGTAADY

SEQ ID NO: 402960 - protein, 11 aa, Influenza virus
TQGEGTAADYK

SEQ ID NO: 402961 - protein, 11 aa, Influenza virus
QITGKLNRLID

SEQ ID NO: 402962 - protein, 11 aa, Influenza virus
ITGKLNRLIDK

SEQ ID NO: 402963 - protein, 11 aa, Influenza virus
TGKLNRLIDKT

SEQ ID NO: 402964 - protein, 11 aa, Influenza virus
GKLNRLIDKTN

SEQ ID NO: 402965 - protein, 11 aa, Influenza virus
KLNRLIDKTNQ

SEQ ID NO: 402966 - protein, 11 aa, Influenza virus
LNRLIDKTNQQ

SEQ ID NO: 402967 - protein, 11 aa, Influenza virus
NRLIDKTNQQF

SEQ ID NO: 402968 - protein, 11 aa, Influenza virus
LIDKTNQQFEL

SEQ ID NO: 402969 - protein, 11 aa, Influenza virus
IDKTNQQFELI

SEQ ID NO: 402970 - protein, 11 aa, Influenza virus
TNQQFELINNE

SEQ ID NO: 402971 - protein, 11 aa, Influenza virus
NQQFELINNEF

SEQ ID NO: 402972 - protein, 11 aa, Influenza virus
NEFNEVEQQIG

SEQ ID NO: 402973 - protein, 11 aa, Influenza virus
EFNEVEQQIGN

SEQ ID NO: 402974 - protein, 11 aa, Influenza virus
FNEVEQQIGNV

SEQ ID NO: 402975 - protein, 11 aa, Influenza virus
NEVEQQIGNVI

SEQ ID NO: 402976 - protein, 11 aa, Influenza virus
EVEQQIGNVIN

SEQ ID NO: 402977 - protein, 11 aa, Influenza virus
VEQQIGNVINW

SEQ ID NO: 402978 - protein, 11 aa, Influenza virus
EKQIGNVINWT

SEQ ID NO: 402979 - protein, 11 aa, Influenza virus
QQIGNVINWTQ

SEQ ID NO: 402980 - protein, 11 aa, Influenza virus
QIGNVINWTQD

SEQ ID NO: 402981 - protein, 11 aa, Influenza virus
IGNVINWTQDA

SEQ ID NO: 402982 - protein, 11 aa, Influenza virus
GNVINWTQDAM

SEQ ID NO: 402983 - protein, 11 aa, Influenza virus
NVINWTQDAMT

SEQ ID NO: 402984 - protein, 11 aa, Influenza virus
VINWTQDAMTE

SEQ ID NO: 402985 - protein, 11 aa, Influenza virus
INWTQDAMTEV

SEQ ID NO: 402986 - protein, 11 aa, Influenza virus
NWTQDAMTEVW

SEQ ID NO: 402987 - protein, 11 aa, Influenza virus
WTQDAMTEVWS

SEQ ID NO: 402988 - protein, 11 aa, Influenza virus
TQDAMTEVWSY

SEQ ID NO: 402989 - protein, 11 aa, Influenza virus
QDAMTEVWSYN

SEQ ID NO: 402990 - protein, 11 aa, Influenza virus
DAMTEVWSYNA

SEQ ID NO: 402991 - protein, 11 aa, Influenza virus
AMTEVWSYNAE

SEQ ID NO: 402992 - protein, 11 aa, Influenza virus
MTEVWSYNAEL

SEQ ID NO: 402993 - protein, 11 aa, Influenza virus
TEVWSYNAELL

SEQ ID NO: 402994 - protein, 11 aa, Influenza virus
EVWSYNAELLV

SEQ ID NO: 402995 - protein, 11 aa, Influenza virus
VWSYNAELLVA

SEQ ID NO: 402996 - protein, 11 aa, Influenza virus
WSYNAELLVAL

SEQ ID NO: 402997 - protein, 11 aa, Influenza virus
SYNAELLVALE

SEQ ID NO: 402998 - protein, 11 aa, Influenza virus
YNAELLVALEN

SEQ ID NO: 402999 - protein, 11 aa, Influenza virus
NAELLVALENQ

SEQ ID NO: 403000 - protein, 11 aa, Influenza virus
AELLVALENQH

SEQ ID NO: 403001 - protein, 11 aa, Influenza virus
ELLVALENQHT

SEQ ID NO: 403002 - protein, 11 aa, Influenza virus
LLVALENQHTI

SEQ ID NO: 403003 - protein, 11 aa, Influenza virus
LVALENQHTID

SEQ ID NO: 403004 - protein, 11 aa, Influenza virus
VALENQHTIDL

SEQ ID NO: 403005 - protein, 11 aa, Influenza virus
AMENQHTIDLT

SEQ ID NO: 403006 - protein, 11 aa, Influenza virus
MENQHTIDLTD

SEQ ID NO: 403007 - protein, 11 aa, Influenza virus
ENQHTIDLTDS

SEQ ID NO: 403008 - protein, 11 aa, Influenza virus
NQHTIDLTDSE

SEQ ID NO: 403009 - protein, 11 aa, Influenza virus
QHTIDLTDSEM

SEQ ID NO: 403010 - protein, 11 aa, Influenza virus
IDLADSEMNKL

SEQ ID NO: 403011 - protein, 11 aa, Influenza virus
DLADSEMNKLY

SEQ ID NO: 403012 - protein, 11 aa, Influenza virus
DSEMNKLYERV

SEQ ID NO: 403013 - protein, 11 aa, Influenza virus
SEMSKLYERVR

SEQ ID NO: 403014 - protein, 11 aa, Influenza virus
KLYERVRKQLR

SEQ ID NO: 403015 - protein, 11 aa, Influenza virus
LYERVRKQLRE

SEQ ID NO: 403016 - protein, 11 aa, Influenza virus
YERVRKQLREN

SEQ ID NO: 403017 - protein, 11 aa, Influenza virus
ERVRKQLRENA

SEQ ID NO: 403018 - protein, 11 aa, Influenza virus
RVRKQLRENAE

SEQ ID NO: 403019 - protein, 11 aa, Influenza virus
VRKQLRENAEE

SEQ ID NO: 403020 - protein, 11 aa, Influenza virus
RKQLRENAEED

SEQ ID NO: 403021 - protein, 11 aa, Influenza virus
RQLRENAEEDG

SEQ ID NO: 403022 - protein, 11 aa, Influenza virus
GCFEIFHKCDN

SEQ ID NO: 403023 - protein, 11 aa, Influenza virus
CFEIFHKCDDH

SEQ ID NO: 403024 - protein, 11 aa, Influenza virus
FEIFHKCDDHC

SEQ ID NO: 403025 - protein, 11 aa, Influenza virus
EIFHKCDDHCM

SEQ ID NO: 403026 - protein, 11 aa, Influenza virus
IFHKCDDHCME

SEQ ID NO: 403027 - protein, 11 aa, Influenza virus
FHKCDDHCMES

SEQ ID NO: 403028 - protein, 11 aa, Influenza virus
HKCDDHCMESI

SEQ ID NO: 403029 - protein, 11 aa, Influenza virus
KCDDHCMESIR

SEQ ID NO: 403030 - protein, 11 aa, Influenza virus
CDDHCMESIRN

SEQ ID NO: 403031 - protein, 11 aa, Influenza virus
DDHCMESIRNN

SEQ ID NO: 403032 - protein, 11 aa, Influenza virus
DHCMESIRNNT

SEQ ID NO: 403033 - protein, 11 aa, Influenza virus
HCMESIRNNTY

SEQ ID NO: 403034 - protein, 11 aa, Influenza virus
CMASIRNNTYD

SEQ ID NO: 403035 - protein, 11 aa, Influenza virus
MASIRNNTYDH

SEQ ID NO: 403036 - protein, 11 aa, Influenza virus
ASIRNNTYDHS

SEQ ID NO: 403037 - protein, 11 aa, Influenza virus
SIRNNTYDHSK

SEQ ID NO: 403038 - protein, 11 aa, Influenza virus
IRNNTYDHSKY

SEQ ID NO: 403039 - protein, 11 aa, Influenza virus
RNNTYDHSKYR

SEQ ID NO: 403040 - protein, 11 aa, Influenza virus
KYREEAMQNRI

SEQ ID NO: 403041 - protein, 11 aa, Influenza virus
YREEAMQNRIQ

SEQ ID NO: 403042 - protein, 11 aa, Influenza virus
REEAMQNRIQI

SEQ ID NO: 403043 - protein, 11 aa, Influenza virus
EEAMQNRIQID

SEQ ID NO: 403044 - protein, 11 aa, Influenza virus
EAMQNRIQIDP

SEQ ID NO: 403045 - protein, 11 aa, Influenza virus
AMQNRIQIDPV

SEQ ID NO: 403046 - protein, 11 aa, Influenza virus
MQNRIQIDPVK

SEQ ID NO: 403047 - protein, 11 aa, Influenza virus
QNRIQIDSVKL

SEQ ID NO: 403048 - protein, 11 aa, Influenza virus
NRIQIDSVKLS

SEQ ID NO: 403049 - protein, 11 aa, Influenza virus
RIQIDSVKLSS

SEQ ID NO: 403050 - protein, 11 aa, Influenza virus
IQIDSVKLSSG

SEQ ID NO: 403051 - protein, 11 aa, Influenza virus
QIDSVKLSSGY

SEQ ID NO: 403052 - protein, 11 aa, Influenza virus
IDSVKLSSGYK

SEQ ID NO: 403053 - protein, 11 aa, Influenza virus
DSVKLSSGYKD

SEQ ID NO: 403054 - protein, 11 aa, Influenza virus
PVKLSSGYKDV

SEQ ID NO: 403055 - protein, 11 aa, Influenza virus
VKLSSGYKDVI

SEQ ID NO: 403056 - protein, 11 aa, Influenza virus
KLSSGYKDVIL

SEQ ID NO: 403057 - protein, 11 aa, Influenza virus
LSSGYKDVILW

SEQ ID NO: 403058 - protein, 11 aa, Influenza virus
SSGYKDVILWF

SEQ ID NO: 403059 - protein, 11 aa, Influenza virus
SGYKDVILWFS

SEQ ID NO: 403060 - protein, 11 aa, Influenza virus
GYKDVILWFSF

SEQ ID NO: 403061 - protein, 11 aa, Influenza virus
YKDVILWFSFG

SEQ ID NO: 403062 - protein, 11 aa, Influenza virus
KDVILWFSFGA

SEQ ID NO: 403063 - protein, 11 aa, Influenza virus
DVILWFSFGAS

SEQ ID NO: 403064 - protein, 11 aa, Influenza virus
VILWFSFGASC

SEQ ID NO: 403065 - protein, 11 aa, Influenza virus
LWFSFGASCFI

SEQ ID NO: 403066 - protein, 11 aa, Influenza virus
WFSFGASCFIL

SEQ ID NO: 403067 - protein, 11 aa, Influenza virus
FSFGASCFILL

SEQ ID NO: 403068 - protein, 11 aa, Influenza virus
SFGASCFILLA

SEQ ID NO: 403069 - protein, 11 aa, Influenza virus
FGASCFILLAI

SEQ ID NO: 403070 - protein, 11 aa, Influenza virus
GASCFILLAIA

SEQ ID NO: 403071 - protein, 11 aa, Influenza virus
VMGLVFICIKN

SEQ ID NO: 403072 - protein, 11 aa, Influenza virus
MGLVFMCVKNG

SEQ ID NO: 403073 - protein, 11 aa, Influenza virus
GLVFMCVKNGN

SEQ ID NO: 403074 - protein, 11 aa, Influenza virus
LVFMCVKNGNM

SEQ ID NO: 403075 - protein, 11 aa, Influenza virus
VFICIKNGNMR

SEQ ID NO: 403076 - protein, 11 aa, Influenza virus
FICIKNGNMRC

SEQ ID NO: 403077 - protein, 11 aa, Influenza virus
ICIKNGNMRCT

SEQ ID NO: 403078 - protein, 11 aa, Influenza virus
CIKNGNMRCTI

SEQ ID NO: 403079 - protein, 11 aa, Influenza virus
IKNGNMRCTIC

SEQ ID NO: 403080 - protein, 11 aa, Influenza virus
KNGNMRCTICI

SEQ ID NO: 403081 - protein, 11 aa, Influenza virus
PNQKIITIGSI

SEQ ID NO: 403082 - protein, 11 aa, Influenza virus
QKIITIGSISL

SEQ ID NO: 403083 - protein, 11 aa, Influenza virus
KIITIGSISLT

SEQ ID NO: 403084 - protein, 11 aa, Influenza virus
IITIGSISLTI

SEQ ID NO: 403085 - protein, 11 aa, Influenza virus
ITIGSVSLTIT

SEQ ID NO: 403086 - protein, 11 aa, Influenza virus
TIGSVSLTITT

SEQ ID NO: 403087 - protein, 11 aa, Influenza virus
EKNITEIVYLN

SEQ ID NO: 403088 - protein, 11 aa, Influenza virus
NVTETLYLNHT

SEQ ID NO: 403089 - protein, 11 aa, Influenza virus
YRNWSKPQCQI

SEQ ID NO: 403090 - protein, 11 aa, Influenza virus
GFAPFAKDNSI

SEQ ID NO: 403091 - protein, 11 aa, Influenza virus
FAPFAKDNSIR

SEQ ID NO: 403092 - protein, 11 aa, Influenza virus
APFAKDNSIRL

SEQ ID NO: 403093 - protein, 11 aa, Influenza virus
PFAKDNSIRLS

SEQ ID NO: 403094 - protein, 11 aa, Influenza virus
FAKDNSIRLSA

SEQ ID NO: 403095 - protein, 11 aa, Influenza virus
AKDNSIRLSAG

SEQ ID NO: 403096 - protein, 11 aa, Influenza virus
KDNSVRLSASG

SEQ ID NO: 403097 - protein, 11 aa, Influenza virus
DNSIRLSAGGH

SEQ ID NO: 403098 - protein, 11 aa, Influenza virus
NSIRLSAGGHI

SEQ ID NO: 403099 - protein, 11 aa, Influenza virus
SIRLSAGGHIW

SEQ ID NO: 403100 - protein, 11 aa, Influenza virus
RLSAGGHIWVT

SEQ ID NO: 403101 - protein, 11 aa, Influenza virus
LSAGGHIWVTR

SEQ ID NO: 403102 - protein, 11 aa, Influenza virus
SAGGHIWVTRE

SEQ ID NO: 403103 - protein, 11 aa, Influenza virus
AGGHIWVTREP

SEQ ID NO: 403104 - protein, 11 aa, Influenza virus
GGHIWVTREPY

SEQ ID NO: 403105 - protein, 11 aa, Influenza virus
GHIWVTREPYV

SEQ ID NO: 403106 - protein, 11 aa, Influenza virus
HIWVTREPYVS

SEQ ID NO: 403107 - protein, 11 aa, Influenza virus
IWVTREPYVSC

SEQ ID NO: 403108 - protein, 11 aa, Influenza virus
WVTREPYVSCD

SEQ ID NO: 403109 - protein, 11 aa, Influenza virus
NKCYQFALGQG

SEQ ID NO: 403110 - protein, 11 aa, Influenza virus
RCYQFALGQGT

SEQ ID NO: 403111 - protein, 11 aa, Influenza virus
QFALGQGTTLY

SEQ ID NO: 403112 - protein, 11 aa, Influenza virus
FALGQGTTLYN

SEQ ID NO: 403113 - protein, 11 aa, Influenza virus
ALGQGTTLDNE

SEQ ID NO: 403114 - protein, 11 aa, Influenza virus
LGQGTTLDNEH

SEQ ID NO: 403115 - protein, 11 aa, Influenza virus
GQGTTLDNEHS

SEQ ID NO: 403116 - protein, 11 aa, Influenza virus
QGTTLDNEHSN

SEQ ID NO: 403117 - protein, 11 aa, Influenza virus
GTTLDNEHSNG

SEQ ID NO: 403118 - protein, 11 aa, Influenza virus
TTLDNEHSNGT

SEQ ID NO: 403119 - protein, 11 aa, Influenza virus
NEHSNGTIHDR

SEQ ID NO: 403120 - protein, 11 aa, Influenza virus
EHSNGTIHDRI

SEQ ID NO: 403121 - protein, 11 aa, Influenza virus
HDRTPHRTLLM

SEQ ID NO: 403122 - protein, 11 aa, Influenza virus
DRTPHRTLLMN

SEQ ID NO: 403123 - protein, 11 aa, Influenza virus
RTPHRTLLMNE

SEQ ID NO: 403124 - protein, 11 aa, Influenza virus
TPHRTLLMNEL

SEQ ID NO: 403125 - protein, 11 aa, Influenza virus
SHRTLLMNELG

SEQ ID NO: 403126 - protein, 11 aa, Influenza virus
ELGVPFHLGTR

SEQ ID NO: 403127 - protein, 11 aa, Influenza virus
LGVPFHLGTRQ

SEQ ID NO: 403128 - protein, 11 aa, Influenza virus
GVPFHLGTRQV

SEQ ID NO: 403129 - protein, 11 aa, Influenza virus
VPFHLGTRQVC

SEQ ID NO: 403130 - protein, 11 aa, Influenza virus
PFHLGTRQVCI

SEQ ID NO: 403131 - protein, 11 aa, Influenza virus
FHLGTRQVCIA

SEQ ID NO: 403132 - protein, 11 aa, Influenza virus
HLGTRQVCIAW

SEQ ID NO: 403133 - protein, 11 aa, Influenza virus
LGTRQVCIAWS

SEQ ID NO: 403134 - protein, 11 aa, Influenza virus
GTRQVCIAWSS

SEQ ID NO: 403135 - protein, 11 aa, Influenza virus
TRQVCIAWSSS

SEQ ID NO: 403136 - protein, 11 aa, Influenza virus
RQVCIAWSSSS

SEQ ID NO: 403137 - protein, 11 aa, Influenza virus
QVCMAWSSSSC

SEQ ID NO: 403138 - protein, 11 aa, Influenza virus
VCMAWSSSSCH

SEQ ID NO: 403139 - protein, 11 aa, Influenza virus
CMAWSSSSCHD

SEQ ID NO: 403140 - protein, 11 aa, Influenza virus
MAWSSSSCHDG

SEQ ID NO: 403141 - protein, 11 aa, Influenza virus
SCHDGKAWLHI

SEQ ID NO: 403142 - protein, 11 aa, Influenza virus
CHDGKAWLHIC

SEQ ID NO: 403143 - protein, 11 aa, Influenza virus
HDGKAWLHVCI

SEQ ID NO: 403144 - protein, 11 aa, Influenza virus
DGKAWLHVCIT

SEQ ID NO: 403145 - protein, 11 aa, Influenza virus
GKAWLHVCITG

SEQ ID NO: 403146 - protein, 11 aa, Influenza virus
KAWLHVCITGD

SEQ ID NO: 403147 - protein, 11 aa, Influenza virus
AWLHICVTGDD

SEQ ID NO: 403148 - protein, 11 aa, Influenza virus
WLHICVTGDDR

SEQ ID NO: 403149 - protein, 11 aa, Influenza virus
LHVCITGDDRN

SEQ ID NO: 403150 - protein, 11 aa, Influenza virus
HVCITGDDRNA

SEQ ID NO: 403151 - protein, 11 aa, Influenza virus
VCVTGDDKNAT

SEQ ID NO: 403152 - protein, 11 aa, Influenza virus
CITGDDRNATA

SEQ ID NO: 403153 - protein, 11 aa, Influenza virus
ITGDDRNATAS

SEQ ID NO: 403154 - protein, 11 aa, Influenza virus
TGDDKNATASF

SEQ ID NO: 403155 - protein, 11 aa, Influenza virus
GDDKNATASFI

SEQ ID NO: 403156 - protein, 11 aa, Influenza virus
DDKNATASFIY

SEQ ID NO: 403157 - protein, 11 aa, Influenza virus
LVDSIVSWSQN

SEQ ID NO: 403158 - protein, 11 aa, Influenza virus
VDSIVSWSQNI

SEQ ID NO: 403159 - protein, 11 aa, Influenza virus
DSIVSWSQNIL

SEQ ID NO: 403160 - protein, 11 aa, Influenza virus
SIVSWSQNILR

SEQ ID NO: 403161 - protein, 11 aa, Influenza virus
IVSWSQNILRT

SEQ ID NO: 403162 - protein, 11 aa, Influenza virus
VSWSQNILRTQ

SEQ ID NO: 403163 - protein, 11 aa, Influenza virus
QESECVCINGT

SEQ ID NO: 403164 - protein, 11 aa, Influenza virus
ESECVCINGTC

SEQ ID NO: 403165 - protein, 11 aa, Influenza virus
SECVCINGTCT

SEQ ID NO: 403166 - protein, 11 aa, Influenza virus
ECVCINGTCTV

SEQ ID NO: 403167 - protein, 11 aa, Influenza virus
CVCINGTCTVV

SEQ ID NO: 403168 - protein, 11 aa, Influenza virus
VCINGTCTVVM

SEQ ID NO: 403169 - protein, 11 aa, Influenza virus
CINGTCTVVMT

SEQ ID NO: 403170 - protein, 11 aa, Influenza virus
INGTCTVVMTD

SEQ ID NO: 403171 - protein, 11 aa, Influenza virus
NGTCTVVMTDG

SEQ ID NO: 403172 - protein, 11 aa, Influenza virus
GSCTVVMTDGN

SEQ ID NO: 403173 - protein, 11 aa, Influenza virus
SCTVVMTDGNA

SEQ ID NO: 403174 - protein, 11 aa, Influenza virus
CTVVMTDGNAS

SEQ ID NO: 403175 - protein, 11 aa, Influenza virus
TVVMTDGNASG

SEQ ID NO: 403176 - protein, 11 aa, Influenza virus
VVMTDGNASGK

SEQ ID NO: 403177 - protein, 11 aa, Influenza virus
VMTDGNASGKA

SEQ ID NO: 403178 - protein, 11 aa, Influenza virus
MTDGNASGKAD

SEQ ID NO: 403179 - protein, 11 aa, Influenza virus
TDGNASGKADT

SEQ ID NO: 403180 - protein, 11 aa, Influenza virus
EGKIIHISPLS

SEQ ID NO: 403181 - protein, 11 aa, Influenza virus
GKIIHISPLSG

SEQ ID NO: 403182 - protein, 11 aa, Influenza virus
IIHISPLSGSA

SEQ ID NO: 403183 - protein, 11 aa, Influenza virus
IHISPLSGSAQ

SEQ ID NO: 403184 - protein, 11 aa, Influenza virus
QHIEECSCYPQ

SEQ ID NO: 403185 - protein, 11 aa, Influenza virus
HIEECSCYPQY

SEQ ID NO: 403186 - protein, 11 aa, Influenza virus
IEECSCYPQYP

SEQ ID NO: 403187 - protein, 11 aa, Influenza virus
EECSCYPQYPN

SEQ ID NO: 403188 - protein, 11 aa, Influenza virus
ECSCYPQYPNV

SEQ ID NO: 403189 - protein, 11 aa, Influenza virus
CSCYPQYPNVR

SEQ ID NO: 403190 - protein, 11 aa, Influenza virus
SCYPQYPNVRC

SEQ ID NO: 403191 - protein, 11 aa, Influenza virus
CYPQYPNVRCV

SEQ ID NO: 403192 - protein, 11 aa, Influenza virus
YPQYPNVRCVC

SEQ ID NO: 403193 - protein, 11 aa, Influenza virus
PQYPNVRCVCR

SEQ ID NO: 403194 - protein, 11 aa, Influenza virus
QYPNVRCVCRD

SEQ ID NO: 403195 - protein, 11 aa, Influenza virus
YPDVRCVCRDN

SEQ ID NO: 403196 - protein, 11 aa, Influenza virus
PDVRCVCRDNW

SEQ ID NO: 403197 - protein, 11 aa, Influenza virus
DVRCVCRDNWK

SEQ ID NO: 403198 - protein, 11 aa, Influenza virus
KCVCRDNWKGS

SEQ ID NO: 403199 - protein, 11 aa, Influenza virus
RDNWKGSNRPI

SEQ ID NO: 403200 - protein, 11 aa, Influenza virus
DNWKGSNRPII

SEQ ID NO: 403201 - protein, 11 aa, Influenza virus
NWKGSNRPIID

SEQ ID NO: 403202 - protein, 11 aa, Influenza virus
WKGSNRPVIDV

SEQ ID NO: 403203 - protein, 11 aa, Influenza virus
KGSNRPVIDVN

SEQ ID NO: 403204 - protein, 11 aa, Influenza virus
GSNRPVIDVNM

SEQ ID NO: 403205 - protein, 11 aa, Influenza virus
INSSYVCSGLV

SEQ ID NO: 403206 - protein, 11 aa, Influenza virus
NSSYVCSGLVG

SEQ ID NO: 403207 - protein, 11 aa, Influenza virus
SSYMCSGLVGD

SEQ ID NO: 403208 - protein, 11 aa, Influenza virus
SYMCSGLVGDT

SEQ ID NO: 403209 - protein, 11 aa, Influenza virus
SGLVGDTPRND

SEQ ID NO: 403210 - protein, 11 aa, Influenza virus
GLVGDTPRNDD

SEQ ID NO: 403211 - protein, 11 aa, Influenza virus
LVGDTPRNEDS

SEQ ID NO: 403212 - protein, 11 aa, Influenza virus
VGDTPRNEDSS

SEQ ID NO: 403213 - protein, 11 aa, Influenza virus
GDTPRNEDSSS

SEQ ID NO: 403214 - protein, 11 aa, Influenza virus
DTPRNEDSSSS

SEQ ID NO: 403215 - protein, 11 aa, Influenza virus
TPRNEDSSSSS

SEQ ID NO: 403216 - protein, 11 aa, Influenza virus
PRNEDSSSSSN

SEQ ID NO: 403217 - protein, 11 aa, Influenza virus
RNEDSSSSSNC

SEQ ID NO: 403218 - protein, 11 aa, Influenza virus
DPNDERGNPGV
